United States Patent 7,691,997 (FUNCTIONAL AND HYPERFUNCTIONAL SIRNA) - sequence listing, part 22

SEQ ID NO: 880562 - RNA, 19 nt, Homo sapiens
cagaagaucuaugaggauu

SEQ ID NO: 880563 - RNA, 19 nt, Homo sapiens
aacaacagguuuaugauga

SEQ ID NO: 880564 - RNA, 19 nt, Homo sapiens
gagcacagaguagaagaua

SEQ ID NO: 880565 - RNA, 19 nt, Homo sapiens
agacuuauguccacuuuca

SEQ ID NO: 880566 - RNA, 19 nt, Homo sapiens
agcagaaucuugagaaauu

SEQ ID NO: 880567 - RNA, 19 nt, Homo sapiens
ucaaucaacucauccuugu

SEQ ID NO: 880568 - RNA, 19 nt, Homo sapiens
gugauucguucuauucuga

SEQ ID NO: 880569 - RNA, 19 nt, Homo sapiens
gggaagucgugauuaauag

SEQ ID NO: 880570 - RNA, 19 nt, Homo sapiens
cagagaugcuugaguuuca

SEQ ID NO: 880571 - RNA, 19 nt, Homo sapiens
gacuuuggguuugcaguua

SEQ ID NO: 880572 - RNA, 19 nt, Homo sapiens
caacagguuuaugaugaaa

SEQ ID NO: 880573 - RNA, 19 nt, Homo sapiens
ggaaagccauagagaacca

SEQ ID NO: 880574 - RNA, 19 nt, Homo sapiens
gaacagagaaggagguaac

SEQ ID NO: 880575 - RNA, 19 nt, Homo sapiens
ggaauuccuggauaacuuu

SEQ ID NO: 880576 - RNA, 19 nt, Homo sapiens
gaagcugugucugaucuug

SEQ ID NO: 880577 - RNA, 19 nt, Homo sapiens
gagcacuucucccgggaaa

SEQ ID NO: 880578 - RNA, 19 nt, Homo sapiens
gagcucacaguauuuguuu

SEQ ID NO: 880579 - RNA, 19 nt, Homo sapiens
aaacagagagccacggaaa

SEQ ID NO: 880580 - RNA, 19 nt, Homo sapiens
ccagauauggguuaaauuc

SEQ ID NO: 880581 - RNA, 19 nt, Homo sapiens
ugacuuggacccauuuaaa

SEQ ID NO: 880582 - RNA, 19 nt, Homo sapiens
gcggaccacuuuaaacugu

SEQ ID NO: 880583 - RNA, 19 nt, Homo sapiens
ugagcugccucuuugaauu

SEQ ID NO: 880584 - RNA, 19 nt, Homo sapiens
gagaagagcgucggacuca

SEQ ID NO: 880585 - RNA, 19 nt, Homo sapiens
caacaacagguuuaugaug

SEQ ID NO: 880586 - RNA, 19 nt, Homo sapiens
gaugaacuucugcauauau

SEQ ID NO: 880587 - RNA, 19 nt, Homo sapiens
gcaaaugacauggagaaau

SEQ ID NO: 880588 - RNA, 19 nt, Homo sapiens
gaugagauggagucacuuu

SEQ ID NO: 880589 - RNA, 19 nt, Homo sapiens
ccagacuuauguccacuuu

SEQ ID NO: 880590 - RNA, 19 nt, Homo sapiens
gaauggcugcucuaucuug

SEQ ID NO: 880591 - RNA, 19 nt, Homo sapiens
ucagaaaccuagaugaaac

SEQ ID NO: 880592 - RNA, 19 nt, Homo sapiens
ugagaaauuucacauggau

SEQ ID NO: 880593 - RNA, 19 nt, Homo sapiens
uaaaaguccugaagaauuc

SEQ ID NO: 880594 - RNA, 19 nt, Homo sapiens
guguaaggaucgccuggua

SEQ ID NO: 880595 - RNA, 19 nt, Homo sapiens
gaagucagaaauagaagga

SEQ ID NO: 880596 - RNA, 19 nt, Homo sapiens
gggaacugauccauacgaa

SEQ ID NO: 880597 - RNA, 19 nt, Homo sapiens
gaacaggaaagccauagag

SEQ ID NO: 880598 - RNA, 19 nt, Homo sapiens
gaagauauuuugacuuugg

SEQ ID NO: 880599 - RNA, 19 nt, Homo sapiens
ggaacucagcuaccucaaa

SEQ ID NO: 880600 - RNA, 19 nt, Homo sapiens
auaagaagcuccacguagu

SEQ ID NO: 880601 - RNA, 19 nt, Homo sapiens
gaagucgugauuaauaguu

SEQ ID NO: 880602 - RNA, 19 nt, Homo sapiens
agaugaaacuggucagaau

SEQ ID NO: 880603 - RNA, 19 nt, Homo sapiens
cauaaagugugaauuacca

SEQ ID NO: 880604 - RNA, 19 nt, Homo sapiens
uaaggugauucguucuauu

SEQ ID NO: 880605 - RNA, 19 nt, Homo sapiens
ugccagagaugcuugaguu

SEQ ID NO: 880606 - RNA, 19 nt, Homo sapiens
aaucaacucauccuuguaa

SEQ ID NO: 880607 - RNA, 19 nt, Homo sapiens
uaagucacaucuggucauu

SEQ ID NO: 880608 - RNA, 19 nt, Homo sapiens
aagcuuguacuguaucuua

SEQ ID NO: 880609 - RNA, 19 nt, Homo sapiens
gaaagcuuguacuguaucu

SEQ ID NO: 880610 - RNA, 19 nt, Homo sapiens
uggaggcucuuuccuuuau

SEQ ID NO: 880611 - RNA, 19 nt, Homo sapiens
ggauuugagcugccucuuu

SEQ ID NO: 880612 - RNA, 19 nt, Homo sapiens
cgaugaacuucugcauaua

SEQ ID NO: 880613 - RNA, 19 nt, Homo sapiens
gcuagagucuguaauucuc

SEQ ID NO: 880614 - RNA, 19 nt, Homo sapiens
gcauuuguaucgucauucu

SEQ ID NO: 880615 - RNA, 19 nt, Homo sapiens
cuacugacuuggacccauu

SEQ ID NO: 880616 - RNA, 19 nt, Homo sapiens
gagccgucauacugguuua

SEQ ID NO: 880617 - RNA, 19 nt, Homo sapiens
ucacauauauucugagcuu

SEQ ID NO: 880618 - RNA, 19 nt, Homo sapiens
gauuaaacauuccagauag

SEQ ID NO: 880619 - RNA, 19 nt, Homo sapiens
gaaaugcuaccuacguguu

SEQ ID NO: 880620 - RNA, 19 nt, Homo sapiens
gcugacagaugcaggaugu

SEQ ID NO: 880621 - RNA, 19 nt, Homo sapiens
gagaugcucacauauauuc

SEQ ID NO: 880622 - RNA, 19 nt, Homo sapiens
uggagaugcucacauauau

SEQ ID NO: 880623 - RNA, 19 nt, Homo sapiens
gcccacugcucuucauuga

SEQ ID NO: 880624 - RNA, 19 nt, Homo sapiens
ggccaaggcugcagcaucu

SEQ ID NO: 880625 - RNA, 19 nt, Homo sapiens
ccaaggugcuccaguuucu

SEQ ID NO: 880626 - RNA, 19 nt, Homo sapiens
guaccgugcugcccagaau

SEQ ID NO: 880627 - RNA, 19 nt, Homo sapiens
gagcaucaggccucaggua

SEQ ID NO: 880628 - RNA, 19 nt, Homo sapiens
ugaggcagcugucccuuag

SEQ ID NO: 880629 - RNA, 19 nt, Homo sapiens
uagccaaggugcuccaguu

SEQ ID NO: 880630 - RNA, 19 nt, Homo sapiens
ggagaugcucacauauauu

SEQ ID NO: 880631 - RNA, 19 nt, Homo sapiens
ugccagaacucacagacaa

SEQ ID NO: 880632 - RNA, 19 nt, Homo sapiens
cccuggagaugcucacaua

SEQ ID NO: 880633 - RNA, 19 nt, Homo sapiens
cuaggucugugcuguaaau

SEQ ID NO: 880634 - RNA, 19 nt, Homo sapiens
gccuaggucugugcuguaa

SEQ ID NO: 880635 - RNA, 19 nt, Homo sapiens
gggcugaccugacccuaac

SEQ ID NO: 880636 - RNA, 19 nt, Homo sapiens
gaccugacccuaacacucu

SEQ ID NO: 880637 - RNA, 19 nt, Homo sapiens
cuggagaugcucacauaua

SEQ ID NO: 880638 - RNA, 19 nt, Homo sapiens
cagcugagccuaggucugu

SEQ ID NO: 880639 - RNA, 19 nt, Homo sapiens
gcagacacuggaugcuauu

SEQ ID NO: 880640 - RNA, 19 nt, Homo sapiens
gcccuccucucagaccuaa

SEQ ID NO: 880641 - RNA, 19 nt, Homo sapiens
cagcacagccuccuugacu

SEQ ID NO: 880642 - RNA, 19 nt, Homo sapiens
guccuagccuggagcacuu

SEQ ID NO: 880643 - RNA, 19 nt, Homo sapiens
caucaggccucagguacca

SEQ ID NO: 880644 - RNA, 19 nt, Homo sapiens
ggucugugcuguaaauccu

SEQ ID NO: 880645 - RNA, 19 nt, Homo sapiens
gcagccgacucagugacaa

SEQ ID NO: 880646 - RNA, 19 nt, Homo sapiens
ucugugcuguaaauccuaa

SEQ ID NO: 880647 - RNA, 19 nt, Homo sapiens
aggccucccucgugaguug

SEQ ID NO: 880648 - RNA, 19 nt, Homo sapiens
ugccugcccuccucucaga

SEQ ID NO: 880649 - RNA, 19 nt, Homo sapiens
gccuggcaguagccucuuu

SEQ ID NO: 880650 - RNA, 19 nt, Homo sapiens
augcucacauauauucuga

SEQ ID NO: 880651 - RNA, 19 nt, Homo sapiens
ccaaggcugcagcaucuca

SEQ ID NO: 880652 - RNA, 19 nt, Homo sapiens
cugaggcagcugucccuua

SEQ ID NO: 880653 - RNA, 19 nt, Homo sapiens
guagauaggccuuaacuua

SEQ ID NO: 880654 - RNA, 19 nt, Homo sapiens
caaagugggcucucaauaa

SEQ ID NO: 880655 - RNA, 19 nt, Homo sapiens
aaagugggcucucaauaaa

SEQ ID NO: 880656 - RNA, 19 nt, Homo sapiens
gcaaagcacaggucauuga

SEQ ID NO: 880657 - RNA, 19 nt, Homo sapiens
gcauagguuugcuuaggua

SEQ ID NO: 880658 - RNA, 19 nt, Homo sapiens
guacuucgccuccuccuuu

SEQ ID NO: 880659 - RNA, 19 nt, Homo sapiens
ggccuuaacuuaguccaua

SEQ ID NO: 880660 - RNA, 19 nt, Homo sapiens
ucuacgagcucaccguuaa

SEQ ID NO: 880661 - RNA, 19 nt, Homo sapiens
agugggcucucaauaaaua

SEQ ID NO: 880662 - RNA, 19 nt, Homo sapiens
gaggguagauaggccuuaa

SEQ ID NO: 880663 - RNA, 19 nt, Homo sapiens
gaugagagcgucaagaagu

SEQ ID NO: 880664 - RNA, 19 nt, Homo sapiens
guagccggcuucuagaaug

SEQ ID NO: 880665 - RNA, 19 nt, Homo sapiens
ggagcugccuggagacagu

SEQ ID NO: 880666 - RNA, 19 nt, Homo sapiens
gagcagggagagagaaguu

SEQ ID NO: 880667 - RNA, 19 nt, Homo sapiens
ggagagagaaguuuuguug

SEQ ID NO: 880668 - RNA, 19 nt, Homo sapiens
acaaagugggcucucaaua

SEQ ID NO: 880669 - RNA, 19 nt, Homo sapiens
agauaggccuuaacuuagu

SEQ ID NO: 880670 - RNA, 19 nt, Homo sapiens
gauaggccuuaacuuaguc

SEQ ID NO: 880671 - RNA, 19 nt, Homo sapiens
agaacgugcuggcugaguu

SEQ ID NO: 880672 - RNA, 19 nt, Homo sapiens
aaacgacuccugaccuuuc

SEQ ID NO: 880673 - RNA, 19 nt, Homo sapiens
uagauaggccuuaacuuag

SEQ ID NO: 880674 - RNA, 19 nt, Homo sapiens
uuagguagccggcuucuag

SEQ ID NO: 880675 - RNA, 19 nt, Homo sapiens
gagaaguuuuguuggcaua

SEQ ID NO: 880676 - RNA, 19 nt, Homo sapiens
augagagcgucaagaagua

SEQ ID NO: 880677 - RNA, 19 nt, Homo sapiens
ggcauagguuugcuuaggu

SEQ ID NO: 880678 - RNA, 19 nt, Homo sapiens
ucgcaaagcacaggucauu

SEQ ID NO: 880679 - RNA, 19 nt, Homo sapiens
gcaaaggucgaggguagau

SEQ ID NO: 880680 - RNA, 19 nt, Homo sapiens
ggaguucacccacgaugag

SEQ ID NO: 880681 - RNA, 19 nt, Homo sapiens
ugaguggugucgcaaagca

SEQ ID NO: 880682 - RNA, 19 nt, Homo sapiens
guuggcauagguuugcuua

SEQ ID NO: 880683 - RNA, 19 nt, Homo sapiens
uggcauagguuugcuuagg

SEQ ID NO: 880684 - RNA, 19 nt, Homo sapiens
caaaggucgaggguagaua

SEQ ID NO: 880685 - RNA, 19 nt, Homo sapiens
gguagccggcuucuagaau

SEQ ID NO: 880686 - RNA, 19 nt, Homo sapiens
cgacgcugguugccucuac

SEQ ID NO: 880687 - RNA, 19 nt, Homo sapiens
acgaugagagcgucaagaa

SEQ ID NO: 880688 - RNA, 19 nt, Homo sapiens
uagccggcuucuagaaugu

SEQ ID NO: 880689 - RNA, 19 nt, Homo sapiens
gggcaggacuccgucuacu

SEQ ID NO: 880690 - RNA, 19 nt, Homo sapiens
aaaggucgaggguagauag

SEQ ID NO: 880691 - RNA, 19 nt, Homo sapiens
gcagggagagagaaguuuu

SEQ ID NO: 880692 - RNA, 19 nt, Homo sapiens
cgcuguggcugcucaagug

SEQ ID NO: 880693 - RNA, 19 nt, Homo sapiens
ggcccuggcugccuucuua

SEQ ID NO: 880694 - RNA, 19 nt, Homo sapiens
gagcucaaccugcaacuuu

SEQ ID NO: 880695 - RNA, 19 nt, Homo sapiens
gcaccggcaucaaccguaa

SEQ ID NO: 880696 - RNA, 19 nt, Homo sapiens
caucaaccguaauagcauu

SEQ ID NO: 880697 - RNA, 19 nt, Homo sapiens
ccagcccugugcucucuua

SEQ ID NO: 880698 - RNA, 19 nt, Homo sapiens
acccagaaguggugccaua

SEQ ID NO: 880699 - RNA, 19 nt, Homo sapiens
ugucgaggcucugcagaaa

SEQ ID NO: 880700 - RNA, 19 nt, Homo sapiens
ccacuggaagucucaggua

SEQ ID NO: 880701 - RNA, 19 nt, Homo sapiens
gcaaguuguggcugaccua

SEQ ID NO: 880702 - RNA, 19 nt, Homo sapiens
gcuuaugcccaaucgguuu

SEQ ID NO: 880703 - RNA, 19 nt, Homo sapiens
gcaacuuugugagcaacga

SEQ ID NO: 880704 - RNA, 19 nt, Homo sapiens
gagaccgcauucccuugga

SEQ ID NO: 880705 - RNA, 19 nt, Homo sapiens
cggcuggccuucaggaucu

SEQ ID NO: 880706 - RNA, 19 nt, Homo sapiens
uggaaauccuggugcagau

SEQ ID NO: 880707 - RNA, 19 nt, Homo sapiens
ggcaucaaccguaauagca

SEQ ID NO: 880708 - RNA, 19 nt, Homo sapiens
ugcccaauuucagauauuu

SEQ ID NO: 880709 - RNA, 19 nt, Homo sapiens
caagcacugucagcucugu

SEQ ID NO: 880710 - RNA, 19 nt, Homo sapiens
ucgaggcucugcagaaagg

SEQ ID NO: 880711 - RNA, 19 nt, Homo sapiens
gcuguccucggcucacuuu

SEQ ID NO: 880712 - RNA, 19 nt, Homo sapiens
gggucaaggcggagaagaa

SEQ ID NO: 880713 - RNA, 19 nt, Homo sapiens
cuccaccuuugcccaauuu

SEQ ID NO: 880714 - RNA, 19 nt, Homo sapiens
guaauagcauuccccuuca

SEQ ID NO: 880715 - RNA, 19 nt, Homo sapiens
cagaaguggugccauacac

SEQ ID NO: 880716 - RNA, 19 nt, Homo sapiens
ggucaaggcggagaagaag

SEQ ID NO: 880717 - RNA, 19 nt, Homo sapiens
cccaauuucagauauuuga

SEQ ID NO: 880718 - RNA, 19 nt, Homo sapiens
gcaucaaccguaauagcau

SEQ ID NO: 880719 - RNA, 19 nt, Homo sapiens
ccuccaccuuugcccaauu

SEQ ID NO: 880720 - RNA, 19 nt, Homo sapiens
acugucagcucugugauca

SEQ ID NO: 880721 - RNA, 19 nt, Homo sapiens
ggccagggguucagugaga

SEQ ID NO: 880722 - RNA, 19 nt, Homo sapiens
ugcgagaacuggacuugag

SEQ ID NO: 880723 - RNA, 19 nt, Homo sapiens
caaccugcgcuuacuggau

SEQ ID NO: 880724 - RNA, 19 nt, Homo sapiens
gcucaaccugcaacuuugu

SEQ ID NO: 880725 - RNA, 19 nt, Homo sapiens
ccagcuaggcagccacaga

SEQ ID NO: 880726 - RNA, 19 nt, Homo sapiens
ggcccuggcugccuucuua

SEQ ID NO: 880727 - RNA, 19 nt, Homo sapiens
gagcucaaccugcaacuuu

SEQ ID NO: 880728 - RNA, 19 nt, Homo sapiens
gcaccggcaucaaccguaa

SEQ ID NO: 880729 - RNA, 19 nt, Homo sapiens
caucaaccguaauagcauu

SEQ ID NO: 880730 - RNA, 19 nt, Homo sapiens
ccagcccugugcucucuua

SEQ ID NO: 880731 - RNA, 19 nt, Homo sapiens
acccagaaguggugccaua

SEQ ID NO: 880732 - RNA, 19 nt, Homo sapiens
ugucgaggcucugcagaaa

SEQ ID NO: 880733 - RNA, 19 nt, Homo sapiens
gcaaguuguggcugaccua

SEQ ID NO: 880734 - RNA, 19 nt, Homo sapiens
cuggaagucucagcuggua

SEQ ID NO: 880735 - RNA, 19 nt, Homo sapiens
gcuuaugcccaaucgguuu

SEQ ID NO: 880736 - RNA, 19 nt, Homo sapiens
gcaacuuugugagcaacga

SEQ ID NO: 880737 - RNA, 19 nt, Homo sapiens
gagaccgcauucccuugga

SEQ ID NO: 880738 - RNA, 19 nt, Homo sapiens
cggcuggccuucaggaucu

SEQ ID NO: 880739 - RNA, 19 nt, Homo sapiens
uggaaauccuggugcagau

SEQ ID NO: 880740 - RNA, 19 nt, Homo sapiens
ggcaucaaccguaauagca

SEQ ID NO: 880741 - RNA, 19 nt, Homo sapiens
ugcccaauuucagauauuu

SEQ ID NO: 880742 - RNA, 19 nt, Homo sapiens
caagcacugucagcucugu

SEQ ID NO: 880743 - RNA, 19 nt, Homo sapiens
ucgaggcucugcagaaagg

SEQ ID NO: 880744 - RNA, 19 nt, Homo sapiens
gcuguccucggcucacuuu

SEQ ID NO: 880745 - RNA, 19 nt, Homo sapiens
gggucaaggcggagaagaa

SEQ ID NO: 880746 - RNA, 19 nt, Homo sapiens
cuccaccuuugcccaauuu

SEQ ID NO: 880747 - RNA, 19 nt, Homo sapiens
guaauagcauuccccuuca

SEQ ID NO: 880748 - RNA, 19 nt, Homo sapiens
cagaaguggugccauacac

SEQ ID NO: 880749 - RNA, 19 nt, Homo sapiens
ggucaaggcggagaagaag

SEQ ID NO: 880750 - RNA, 19 nt, Homo sapiens
cccaauuucagauauuuga

SEQ ID NO: 880751 - RNA, 19 nt, Homo sapiens
gcaucaaccguaauagcau

SEQ ID NO: 880752 - RNA, 19 nt, Homo sapiens
ccuccaccuuugcccaauu

SEQ ID NO: 880753 - RNA, 19 nt, Homo sapiens
acugucagcucugugauca

SEQ ID NO: 880754 - RNA, 19 nt, Homo sapiens
ggccagggguucagugaga

SEQ ID NO: 880755 - RNA, 19 nt, Homo sapiens
ugcgagaacuggacuugag

SEQ ID NO: 880756 - RNA, 19 nt, Homo sapiens
caaccugcgcuuacuggau

SEQ ID NO: 880757 - RNA, 19 nt, Homo sapiens
gcucaaccugcaacuuugu

SEQ ID NO: 880758 - RNA, 19 nt, Homo sapiens
ccagcuaggcagccacaga

SEQ ID NO: 880759 - RNA, 19 nt, Homo sapiens
caacugaacuugauacuga

SEQ ID NO: 880760 - RNA, 19 nt, Homo sapiens
gaggagggcugccuuauuu

SEQ ID NO: 880761 - RNA, 19 nt, Homo sapiens
gaauaggacuacauacuuu

SEQ ID NO: 880762 - RNA, 19 nt, Homo sapiens
gaaacagcauccaacuuua

SEQ ID NO: 880763 - RNA, 19 nt, Homo sapiens
gcacaacacugcucucaga

SEQ ID NO: 880764 - RNA, 19 nt, Homo sapiens
ggaaacagcauccaacuuu

SEQ ID NO: 880765 - RNA, 19 nt, Homo sapiens
gaaaugaguuauucaguag

SEQ ID NO: 880766 - RNA, 19 nt, Homo sapiens
ggacuaagccuguuucuuc

SEQ ID NO: 880767 - RNA, 19 nt, Homo sapiens
ggaugaagaugcugacauu

SEQ ID NO: 880768 - RNA, 19 nt, Homo sapiens
uaaauuggcuucugagugu

SEQ ID NO: 880769 - RNA, 19 nt, Homo sapiens
gcauacagcucugcaguuu

SEQ ID NO: 880770 - RNA, 19 nt, Homo sapiens
caaacaaacccacauuuaa

SEQ ID NO: 880771 - RNA, 19 nt, Homo sapiens
gaauuucacuucuccuuau

SEQ ID NO: 880772 - RNA, 19 nt, Homo sapiens
gaaggccaauucaaacaaa

SEQ ID NO: 880773 - RNA, 19 nt, Homo sapiens
gauguuagaugcugaagau

SEQ ID NO: 880774 - RNA, 19 nt, Homo sapiens
ugagaacagucuuacauuu

SEQ ID NO: 880775 - RNA, 19 nt, Homo sapiens
ucagaacacuccacaggua

SEQ ID NO: 880776 - RNA, 19 nt, Homo sapiens
ucaaacaaacccacauuua

SEQ ID NO: 880777 - RNA, 19 nt, Homo sapiens
gagguaaugcugucaauuu

SEQ ID NO: 880778 - RNA, 19 nt, Homo sapiens
ggaacagcuuuaagaacua

SEQ ID NO: 880779 - RNA, 19 nt, Homo sapiens
gaaaacaucuacaagcaaa

SEQ ID NO: 880780 - RNA, 19 nt, Homo sapiens
cuccauggcuuaauucaua

SEQ ID NO: 880781 - RNA, 19 nt, Homo sapiens
gaaauggucucagcugaca

SEQ ID NO: 880782 - RNA, 19 nt, Homo sapiens
ggaaagcaccaaucgauau

SEQ ID NO: 880783 - RNA, 19 nt, Homo sapiens
guacuucuguuucucaguu

SEQ ID NO: 880784 - RNA, 19 nt, Homo sapiens
gaacagcuuuaagaacuau

SEQ ID NO: 880785 - RNA, 19 nt, Homo sapiens
gcagccagaccauuuauaa

SEQ ID NO: 880786 - RNA, 19 nt, Homo sapiens
acaggcauaugucaucuua

SEQ ID NO: 880787 - RNA, 19 nt, Homo sapiens
caacgcagccagaccauuu

SEQ ID NO: 880788 - RNA, 19 nt, Homo sapiens
ucaagagacuggacgugua

SEQ ID NO: 880789 - RNA, 19 nt, Homo sapiens
uaaagaagcagaaguguca

SEQ ID NO: 880790 - RNA, 19 nt, Homo sapiens
augaagagcuuaaggauau

SEQ ID NO: 880791 - RNA, 19 nt, Homo sapiens
gaaagcaccaaucgauauu

SEQ ID NO: 880792 - RNA, 19 nt, Homo sapiens
gaauggagacauagaaaug

SEQ ID NO: 880793 - RNA, 19 nt, Homo sapiens
ccagugaauuguaauguug

SEQ ID NO: 880794 - RNA, 19 nt, Homo sapiens
guuagaugcugaagauuug

SEQ ID NO: 880795 - RNA, 19 nt, Homo sapiens
gagcaggcuuucuuucaug

SEQ ID NO: 880796 - RNA, 19 nt, Homo sapiens
guaauacuguuguguugug

SEQ ID NO: 880797 - RNA, 19 nt, Homo sapiens
guaccaagcuuugcagauc

SEQ ID NO: 880798 - RNA, 19 nt, Homo sapiens
ggugccauguuuccaauaa

SEQ ID NO: 880799 - RNA, 19 nt, Homo sapiens
gaaugacccuugacuucug

SEQ ID NO: 880800 - RNA, 19 nt, Homo sapiens
guauuguggucacucauuu

SEQ ID NO: 880801 - RNA, 19 nt, Homo sapiens
aggcauaugucaucuuauu

SEQ ID NO: 880802 - RNA, 19 nt, Homo sapiens
cauuuaagguucuuuagga

SEQ ID NO: 880803 - RNA, 19 nt, Homo sapiens
ggacauuguuggacuaagg

SEQ ID NO: 880804 - RNA, 19 nt, Homo sapiens
gcggaggaaucaauugcua

SEQ ID NO: 880805 - RNA, 19 nt, Homo sapiens
ugacauugaugaaucugaa

SEQ ID NO: 880806 - RNA, 19 nt, Homo sapiens
gaacacuccacagguauaa

SEQ ID NO: 880807 - RNA, 19 nt, Homo sapiens
ggucuuagccuauggaauc

SEQ ID NO: 880808 - RNA, 19 nt, Homo sapiens
gaagagcuuaaggauauua

SEQ ID NO: 880809 - RNA, 19 nt, Homo sapiens
gggcauuggagaagaaaua

SEQ ID NO: 880810 - RNA, 19 nt, Homo sapiens
gaaggauacugcagaacuc

SEQ ID NO: 880811 - RNA, 19 nt, Homo sapiens
ugauacagauacaggcaua

SEQ ID NO: 880812 - RNA, 19 nt, Homo sapiens
gggauuaggucuuuucaaa

SEQ ID NO: 880813 - RNA, 19 nt, Homo sapiens
gccaguggaugccagaauu

SEQ ID NO: 880814 - RNA, 19 nt, Homo sapiens
ccacaaucauuugaagaaa

SEQ ID NO: 880815 - RNA, 19 nt, Homo sapiens
guccuucucugaaugauga

SEQ ID NO: 880816 - RNA, 19 nt, Homo sapiens
caguuuaucuggauguuau

SEQ ID NO: 880817 - RNA, 19 nt, Homo sapiens
agauuuggcugauauugaa

SEQ ID NO: 880818 - RNA, 19 nt, Homo sapiens
caagggcauuggagaagaa

SEQ ID NO: 880819 - RNA, 19 nt, Homo sapiens
uuacuacugugacaacauu

SEQ ID NO: 880820 - RNA, 19 nt, Homo sapiens
ggauuugguuucagcaugu

SEQ ID NO: 880821 - RNA, 19 nt, Homo sapiens
gauguuaucagaucacaga

SEQ ID NO: 880822 - RNA, 19 nt, Homo sapiens
gaacuuauuacccugacaa

SEQ ID NO: 880823 - RNA, 19 nt, Homo sapiens
uaaagaauguugguaaugc

SEQ ID NO: 880824 - RNA, 19 nt, Homo sapiens
ggaggagggcugccuuauu

SEQ ID NO: 880825 - RNA, 19 nt, Homo sapiens
ugaagaugcugacauugau

SEQ ID NO: 880826 - RNA, 19 nt, Homo sapiens
ucagaaggauacugcagaa

SEQ ID NO: 880827 - RNA, 19 nt, Homo sapiens
ucauaacguucuaccauau

SEQ ID NO: 880828 - RNA, 19 nt, Homo sapiens
gaagguuuauggcaacucu

SEQ ID NO: 880829 - RNA, 19 nt, Homo sapiens
cuacauacuuugucuuugg

SEQ ID NO: 880830 - RNA, 19 nt, Homo sapiens
gucccuaugucaucaaauu

SEQ ID NO: 880831 - RNA, 19 nt, Homo sapiens
gcaccaaucgauauuuguu

SEQ ID NO: 880832 - RNA, 19 nt, Homo sapiens
ccacauuuaagguucuuua

SEQ ID NO: 880833 - RNA, 19 nt, Homo sapiens
gcgaaugacccuugacuuc

SEQ ID NO: 880834 - RNA, 19 nt, Homo sapiens
uaaggacauuguuggacua

SEQ ID NO: 880835 - RNA, 19 nt, Homo sapiens
gcugaagauuuggcugaua

SEQ ID NO: 880836 - RNA, 19 nt, Homo sapiens
gaaaagggacugaagaaug

SEQ ID NO: 880837 - RNA, 19 nt, Homo sapiens
cgagaugcuuagccucuuu

SEQ ID NO: 880838 - RNA, 19 nt, Homo sapiens
gaccucccaugaacuuauu

SEQ ID NO: 880839 - RNA, 19 nt, Homo sapiens
aaaucucaauccagguuua

SEQ ID NO: 880840 - RNA, 19 nt, Homo sapiens
aaacaaacccacauuuaag

SEQ ID NO: 880841 - RNA, 19 nt, Homo sapiens
uaacaagggcauuggagaa

SEQ ID NO: 880842 - RNA, 19 nt, Homo sapiens
gaaagugauugcacaacac

SEQ ID NO: 880843 - RNA, 19 nt, Homo sapiens
acucauagcacauuucuug

SEQ ID NO: 880844 - RNA, 19 nt, Homo sapiens
auacugaaccugaugauga

SEQ ID NO: 880845 - RNA, 19 nt, Homo sapiens
caauaaaacuucuccuuuc

SEQ ID NO: 880846 - RNA, 19 nt, Homo sapiens
caauccagguuuacuuuag

SEQ ID NO: 880847 - RNA, 19 nt, Homo sapiens
uucaugcacuuuacucaua

SEQ ID NO: 880848 - RNA, 19 nt, Homo sapiens
uaagaacuaugucaucacu

SEQ ID NO: 880849 - RNA, 19 nt, Homo sapiens
caaguaagcaugaaauggu

SEQ ID NO: 880850 - RNA, 19 nt, Homo sapiens
gcguugagccagucuauug

SEQ ID NO: 880851 - RNA, 19 nt, Homo sapiens
cuaagccuguuucuucuga

SEQ ID NO: 880852 - RNA, 19 nt, Homo sapiens
caagcaguaugccuguuug

SEQ ID NO: 880853 - RNA, 19 nt, Homo sapiens
ugaugaaucugaagagucu

SEQ ID NO: 880854 - RNA, 19 nt, Homo sapiens
agaggugacugguauagug

SEQ ID NO: 880855 - RNA, 19 nt, Homo sapiens
aagcagaagugucagaaca

SEQ ID NO: 880856 - RNA, 19 nt, Homo sapiens
agaaagugauugcacaaca

SEQ ID NO: 880857 - RNA, 19 nt, Homo sapiens
gaaagaggaagaggagguu

SEQ ID NO: 880858 - RNA, 19 nt, Homo sapiens
gaucuuugucuacuucauu

SEQ ID NO: 880859 - RNA, 19 nt, Homo sapiens
caacugaacuugauacuga

SEQ ID NO: 880860 - RNA, 19 nt, Homo sapiens
gaggagggcugccuuauuu

SEQ ID NO: 880861 - RNA, 19 nt, Homo sapiens
gaauaggacuacauacuuu

SEQ ID NO: 880862 - RNA, 19 nt, Homo sapiens
gaaacagcauccaacuuua

SEQ ID NO: 880863 - RNA, 19 nt, Homo sapiens
gcacaacacugcucucaga

SEQ ID NO: 880864 - RNA, 19 nt, Homo sapiens
ggaaacagcauccaacuuu

SEQ ID NO: 880865 - RNA, 19 nt, Homo sapiens
gaaaugaguuauucaguag

SEQ ID NO: 880866 - RNA, 19 nt, Homo sapiens
ggacuaagccuguuucuuc

SEQ ID NO: 880867 - RNA, 19 nt, Homo sapiens
ggaugaagaugcugacauu

SEQ ID NO: 880868 - RNA, 19 nt, Homo sapiens
uaaauuggcuucugagugu

SEQ ID NO: 880869 - RNA, 19 nt, Homo sapiens
gcauacagcucugcaguuu

SEQ ID NO: 880870 - RNA, 19 nt, Homo sapiens
caaacaaacccacauuuaa

SEQ ID NO: 880871 - RNA, 19 nt, Homo sapiens
gaauuucacuucuccuuau

SEQ ID NO: 880872 - RNA, 19 nt, Homo sapiens
gaaggccaauucaaacaaa

SEQ ID NO: 880873 - RNA, 19 nt, Homo sapiens
gauguuagaugcugaagau

SEQ ID NO: 880874 - RNA, 19 nt, Homo sapiens
ugagaacagucuuacauuu

SEQ ID NO: 880875 - RNA, 19 nt, Homo sapiens
ucagaacacuccacaggua

SEQ ID NO: 880876 - RNA, 19 nt, Homo sapiens
ucaaacaaacccacauuua

SEQ ID NO: 880877 - RNA, 19 nt, Homo sapiens
gagguaaugcugucaauuu

SEQ ID NO: 880878 - RNA, 19 nt, Homo sapiens
ggaacagcuuuaagaacua

SEQ ID NO: 880879 - RNA, 19 nt, Homo sapiens
gaaaacaucuacaagcaaa

SEQ ID NO: 880880 - RNA, 19 nt, Homo sapiens
cuccauggcuuaauucaua

SEQ ID NO: 880881 - RNA, 19 nt, Homo sapiens
gaaauggucucagcugaca

SEQ ID NO: 880882 - RNA, 19 nt, Homo sapiens
ggaaagcaccaaucgauau

SEQ ID NO: 880883 - RNA, 19 nt, Homo sapiens
guacuucuguuucucaguu

SEQ ID NO: 880884 - RNA, 19 nt, Homo sapiens
gaacagcuuuaagaacuau

SEQ ID NO: 880885 - RNA, 19 nt, Homo sapiens
gcagccagaccauuuauaa

SEQ ID NO: 880886 - RNA, 19 nt, Homo sapiens
acaggcauaugucaucuua

SEQ ID NO: 880887 - RNA, 19 nt, Homo sapiens
caacgcagccagaccauuu

SEQ ID NO: 880888 - RNA, 19 nt, Homo sapiens
ucaagagacuggacgugua

SEQ ID NO: 880889 - RNA, 19 nt, Homo sapiens
uaaagaagcagaaguguca

SEQ ID NO: 880890 - RNA, 19 nt, Homo sapiens
augaagagcuuaaggauau

SEQ ID NO: 880891 - RNA, 19 nt, Homo sapiens
gaaagcaccaaucgauauu

SEQ ID NO: 880892 - RNA, 19 nt, Homo sapiens
gaauggagacauagaaaug

SEQ ID NO: 880893 - RNA, 19 nt, Homo sapiens
ccagugaauuguaauguug

SEQ ID NO: 880894 - RNA, 19 nt, Homo sapiens
guuagaugcugaagauuug

SEQ ID NO: 880895 - RNA, 19 nt, Homo sapiens
cuggaagccuuaccaauaa

SEQ ID NO: 880896 - RNA, 19 nt, Homo sapiens
gagcaggcuuucuuucaug

SEQ ID NO: 880897 - RNA, 19 nt, Homo sapiens
guaauacuguuguguugug

SEQ ID NO: 880898 - RNA, 19 nt, Homo sapiens
guaccaagcuuugcagauc

SEQ ID NO: 880899 - RNA, 19 nt, Homo sapiens
ggugccauguuuccaauaa

SEQ ID NO: 880900 - RNA, 19 nt, Homo sapiens
gaaugacccuugacuucug

SEQ ID NO: 880901 - RNA, 19 nt, Homo sapiens
guauuguggucacucauuu

SEQ ID NO: 880902 - RNA, 19 nt, Homo sapiens
aggcauaugucaucuuauu

SEQ ID NO: 880903 - RNA, 19 nt, Homo sapiens
cauuuaagguucuuuagga

SEQ ID NO: 880904 - RNA, 19 nt, Homo sapiens
ggacauuguuggacuaagg

SEQ ID NO: 880905 - RNA, 19 nt, Homo sapiens
gcggaggaaucaauugcua

SEQ ID NO: 880906 - RNA, 19 nt, Homo sapiens
ugacauugaugaaucugaa

SEQ ID NO: 880907 - RNA, 19 nt, Homo sapiens
gaacacuccacagguauaa

SEQ ID NO: 880908 - RNA, 19 nt, Homo sapiens
ggucuuagccuauggaauc

SEQ ID NO: 880909 - RNA, 19 nt, Homo sapiens
gaagagcuuaaggauauua

SEQ ID NO: 880910 - RNA, 19 nt, Homo sapiens
gggcauuggagaagaaaua

SEQ ID NO: 880911 - RNA, 19 nt, Homo sapiens
gaaggauacugcagaacuc

SEQ ID NO: 880912 - RNA, 19 nt, Homo sapiens
ugauacagauacaggcaua

SEQ ID NO: 880913 - RNA, 19 nt, Homo sapiens
gggauuaggucuuuucaaa

SEQ ID NO: 880914 - RNA, 19 nt, Homo sapiens
gccaguggaugccagaauu

SEQ ID NO: 880915 - RNA, 19 nt, Homo sapiens
ccacaaucauuugaagaaa

SEQ ID NO: 880916 - RNA, 19 nt, Homo sapiens
guccuucucugaaugauga

SEQ ID NO: 880917 - RNA, 19 nt, Homo sapiens
caguuuaucuggauguuau

SEQ ID NO: 880918 - RNA, 19 nt, Homo sapiens
agauuuggcugauauugaa

SEQ ID NO: 880919 - RNA, 19 nt, Homo sapiens
caagggcauuggagaagaa

SEQ ID NO: 880920 - RNA, 19 nt, Homo sapiens
uuacuacugugacaacauu

SEQ ID NO: 880921 - RNA, 19 nt, Homo sapiens
ggauuugguuucagcaugu

SEQ ID NO: 880922 - RNA, 19 nt, Homo sapiens
gauguuaucagaucacaga

SEQ ID NO: 880923 - RNA, 19 nt, Homo sapiens
gaacuuauuacccugacaa

SEQ ID NO: 880924 - RNA, 19 nt, Homo sapiens
uaaagaauguugguaaugc

SEQ ID NO: 880925 - RNA, 19 nt, Homo sapiens
ggaggagggcugccuuauu

SEQ ID NO: 880926 - RNA, 19 nt, Homo sapiens
ugaagaugcugacauugau

SEQ ID NO: 880927 - RNA, 19 nt, Homo sapiens
ucagaaggauacugcagaa

SEQ ID NO: 880928 - RNA, 19 nt, Homo sapiens
ucauaacguucuaccauau

SEQ ID NO: 880929 - RNA, 19 nt, Homo sapiens
gaagguuuauggcaacucu

SEQ ID NO: 880930 - RNA, 19 nt, Homo sapiens
cuacauacuuugucuuugg

SEQ ID NO: 880931 - RNA, 19 nt, Homo sapiens
gucccuaugucaucaaauu

SEQ ID NO: 880932 - RNA, 19 nt, Homo sapiens
gcaccaaucgauauuuguu

SEQ ID NO: 880933 - RNA, 19 nt, Homo sapiens
ccacauuuaagguucuuua

SEQ ID NO: 880934 - RNA, 19 nt, Homo sapiens
gcgaaugacccuugacuuc

SEQ ID NO: 880935 - RNA, 19 nt, Homo sapiens
uaaggacauuguuggacua

SEQ ID NO: 880936 - RNA, 19 nt, Homo sapiens
gcugaagauuuggcugaua

SEQ ID NO: 880937 - RNA, 19 nt, Homo sapiens
gaaaagggacugaagaaug

SEQ ID NO: 880938 - RNA, 19 nt, Homo sapiens
cgagaugcuuagccucuuu

SEQ ID NO: 880939 - RNA, 19 nt, Homo sapiens
gaccucccaugaacuuauu

SEQ ID NO: 880940 - RNA, 19 nt, Homo sapiens
aaaucucaauccagguuua

SEQ ID NO: 880941 - RNA, 19 nt, Homo sapiens
aaacaaacccacauuuaag

SEQ ID NO: 880942 - RNA, 19 nt, Homo sapiens
uaacaagggcauuggagaa

SEQ ID NO: 880943 - RNA, 19 nt, Homo sapiens
gaaagugauugcacaacac

SEQ ID NO: 880944 - RNA, 19 nt, Homo sapiens
cuacuacuguugacuggaa

SEQ ID NO: 880945 - RNA, 19 nt, Homo sapiens
acucauagcacauuucuug

SEQ ID NO: 880946 - RNA, 19 nt, Homo sapiens
auacugaaccugaugauga

SEQ ID NO: 880947 - RNA, 19 nt, Homo sapiens
acuggaagccuuaccaaua

SEQ ID NO: 880948 - RNA, 19 nt, Homo sapiens
caauaaaacuucuccuuuc

SEQ ID NO: 880949 - RNA, 19 nt, Homo sapiens
caauccagguuuacuuuag

SEQ ID NO: 880950 - RNA, 19 nt, Homo sapiens
uucaugcacuuuacucaua

SEQ ID NO: 880951 - RNA, 19 nt, Homo sapiens
uaagaacuaugucaucacu

SEQ ID NO: 880952 - RNA, 19 nt, Homo sapiens
caaguaagcaugaaauggu

SEQ ID NO: 880953 - RNA, 19 nt, Homo sapiens
gcguugagccagucuauug

SEQ ID NO: 880954 - RNA, 19 nt, Homo sapiens
cuaagccuguuucuucuga

SEQ ID NO: 880955 - RNA, 19 nt, Homo sapiens
caagcaguaugccuguuug

SEQ ID NO: 880956 - RNA, 19 nt, Homo sapiens
ugaugaaucugaagagucu

SEQ ID NO: 880957 - RNA, 19 nt, Homo sapiens
agaggugacugguauagug

SEQ ID NO: 880958 - RNA, 19 nt, Homo sapiens
aagcagaagugucagaaca

SEQ ID NO: 880959 - RNA, 19 nt, Homo sapiens
gaacauccuucaaagaguu

SEQ ID NO: 880960 - RNA, 19 nt, Homo sapiens
ccaaagaaguaguggauuu

SEQ ID NO: 880961 - RNA, 19 nt, Homo sapiens
gaaguaagaugggagauuc

SEQ ID NO: 880962 - RNA, 19 nt, Homo sapiens
acacagacauugaugaauu

SEQ ID NO: 880963 - RNA, 19 nt, Homo sapiens
ccaaauguauucccaaguu

SEQ ID NO: 880964 - RNA, 19 nt, Homo sapiens
ugaagacuaugaugugaua

SEQ ID NO: 880965 - RNA, 19 nt, Homo sapiens
ugugauagcuagcaugaua

SEQ ID NO: 880966 - RNA, 19 nt, Homo sapiens
gcaguugugucaugauuga

SEQ ID NO: 880967 - RNA, 19 nt, Homo sapiens
caaccacauugccaaguua

SEQ ID NO: 880968 - RNA, 19 nt, Homo sapiens
gaagucagcaugcaaaguu

SEQ ID NO: 880969 - RNA, 19 nt, Homo sapiens
gcacagacuugcaaacuac

SEQ ID NO: 880970 - RNA, 19 nt, Homo sapiens
uaaacuaccuuaugagcuu

SEQ ID NO: 880971 - RNA, 19 nt, Homo sapiens
guucucuucuggaauauua

SEQ ID NO: 880972 - RNA, 19 nt, Homo sapiens
gaaaugaugaacacccaua

SEQ ID NO: 880973 - RNA, 19 nt, Homo sapiens
ugaauuagaugcaguugug

SEQ ID NO: 880974 - RNA, 19 nt, Homo sapiens
gaacaacagguguauccua

SEQ ID NO: 880975 - RNA, 19 nt, Homo sapiens
ggaaucaugcuaacuuauu

SEQ ID NO: 880976 - RNA, 19 nt, Homo sapiens
ggauuuagcagguuucuga

SEQ ID NO: 880977 - RNA, 19 nt, Homo sapiens
ggaaguaaauaguucucuu

SEQ ID NO: 880978 - RNA, 19 nt, Homo sapiens
ucaagaauaugaguggaua

SEQ ID NO: 880979 - RNA, 19 nt, Homo sapiens
gaaguuauuucugagaugu

SEQ ID NO: 880980 - RNA, 19 nt, Homo sapiens
gcugugauccucugcaaua

SEQ ID NO: 880981 - RNA, 19 nt, Homo sapiens
ucucaagacuucacuuauu

SEQ ID NO: 880982 - RNA, 19 nt, Homo sapiens
gcagguuucugaagguuug

SEQ ID NO: 880983 - RNA, 19 nt, Homo sapiens
gcagccacuuucuuaauga

SEQ ID NO: 880984 - RNA, 19 nt, Homo sapiens
auaguucucuucuggaaua

SEQ ID NO: 880985 - RNA, 19 nt, Homo sapiens
ggauuucaguucccauuau

SEQ ID NO: 880986 - RNA, 19 nt, Homo sapiens
ucaaagaguucaugcaucu

SEQ ID NO: 880987 - RNA, 19 nt, Homo sapiens
uaaacgacuuguucucuau

SEQ ID NO: 880988 - RNA, 19 nt, Homo sapiens
ggacauauuaggaacaaga

SEQ ID NO: 880989 - RNA, 19 nt, Homo sapiens
gaugaugccuaugcagaaa

SEQ ID NO: 880990 - RNA, 19 nt, Homo sapiens
aaaggaacacugagcaaua

SEQ ID NO: 880991 - RNA, 19 nt, Homo sapiens
gaauauuacugagaaugga

SEQ ID NO: 880992 - RNA, 19 nt, Homo sapiens
gccaaguuaugcagccuua

SEQ ID NO: 880993 - RNA, 19 nt, Homo sapiens
ugacacuucucuggaauuu

SEQ ID NO: 880994 - RNA, 19 nt, Homo sapiens
aaggaacacugagcaauaa

SEQ ID NO: 880995 - RNA, 19 nt, Homo sapiens
gaaaacuccuggaaucuug

SEQ ID NO: 880996 - RNA, 19 nt, Homo sapiens
gagauucuuuggucagaga

SEQ ID NO: 880997 - RNA, 19 nt, Homo sapiens
ucacaugucagcauuugua

SEQ ID NO: 880998 - RNA, 19 nt, Homo sapiens
gugauaugcuuuagucaau

SEQ ID NO: 880999 - RNA, 19 nt, Homo sapiens
cuacaggccuuaaaucucu

SEQ ID NO: 881000 - RNA, 19 nt, Homo sapiens
ggaauggacagucuuaaca

SEQ ID NO: 881001 - RNA, 19 nt, Homo sapiens
gagcugugcuagaacugaa

SEQ ID NO: 881002 - RNA, 19 nt, Homo sapiens
uuaaacgacuuguucucua

SEQ ID NO: 881003 - RNA, 19 nt, Homo sapiens
uaccagaccuguguagauu

SEQ ID NO: 881004 - RNA, 19 nt, Homo sapiens
ggaacauccuucaaagagu

SEQ ID NO: 881005 - RNA, 19 nt, Homo sapiens
agagcuaguuggagaauga

SEQ ID NO: 881006 - RNA, 19 nt, Homo sapiens
gcaagcacuucucuucaag

SEQ ID NO: 881007 - RNA, 19 nt, Homo sapiens
ccuauacuauguggaauuu

SEQ ID NO: 881008 - RNA, 19 nt, Homo sapiens
uggauuaacuguucaacug

SEQ ID NO: 881009 - RNA, 19 nt, Homo sapiens
cuguggagauguaagaaua

SEQ ID NO: 881010 - RNA, 19 nt, Homo sapiens
gauaggagccaaguguaaa

SEQ ID NO: 881011 - RNA, 19 nt, Homo sapiens
gguuauuucucuggauuaa

SEQ ID NO: 881012 - RNA, 19 nt, Homo sapiens
aauaaaguaucguggcauu

SEQ ID NO: 881013 - RNA, 19 nt, Homo sapiens
ucagugauaugcuuuaguc

SEQ ID NO: 881014 - RNA, 19 nt, Homo sapiens
gaauggacagucuuaacaa

SEQ ID NO: 881015 - RNA, 19 nt, Homo sapiens
aaauaguucucuucuggaa

SEQ ID NO: 881016 - RNA, 19 nt, Homo sapiens
gaggagaaaugaugaacac

SEQ ID NO: 881017 - RNA, 19 nt, Homo sapiens
gcaaguguuuuguuuggua

SEQ ID NO: 881018 - RNA, 19 nt, Homo sapiens
gaacacugagcaauaaagu

SEQ ID NO: 881019 - RNA, 19 nt, Homo sapiens
gaacugaaugcaagcuuuc

SEQ ID NO: 881020 - RNA, 19 nt, Homo sapiens
gaucuuucuuuacuugaug

SEQ ID NO: 881021 - RNA, 19 nt, Homo sapiens
caaguuaugcagccuuaaa

SEQ ID NO: 881022 - RNA, 19 nt, Homo sapiens
caaauguauucccaaguuc

SEQ ID NO: 881023 - RNA, 19 nt, Homo sapiens
ucaaccacauugccaaguu

SEQ ID NO: 881024 - RNA, 19 nt, Homo sapiens
gauuucaguucccauuaug

SEQ ID NO: 881025 - RNA, 19 nt, Homo sapiens
acacugagcaauaaaguau

SEQ ID NO: 881026 - RNA, 19 nt, Homo sapiens
uaagaaaacuccuggaauc

SEQ ID NO: 881027 - RNA, 19 nt, Homo sapiens
gaugugauagcuagcauga

SEQ ID NO: 881028 - RNA, 19 nt, Homo sapiens
acacuucucuggaauuucu

SEQ ID NO: 881029 - RNA, 19 nt, Homo sapiens
cagcuguguuucgaacuua

SEQ ID NO: 881030 - RNA, 19 nt, Homo sapiens
ccaguaugccaaagaagua

SEQ ID NO: 881031 - RNA, 19 nt, Homo sapiens
gugcacaaauguuuucaua

SEQ ID NO: 881032 - RNA, 19 nt, Homo sapiens
agaacugaaugcaagcuuu

SEQ ID NO: 881033 - RNA, 19 nt, Homo sapiens
cacagacauugaugaauug

SEQ ID NO: 881034 - RNA, 19 nt, Homo sapiens
gaacaaaaguagagcaaac

SEQ ID NO: 881035 - RNA, 19 nt, Homo sapiens
gggaagggccaaauaaugg

SEQ ID NO: 881036 - RNA, 19 nt, Homo sapiens
agacuucacuuauugacau

SEQ ID NO: 881037 - RNA, 19 nt, Homo sapiens
gaugacacuucucuggaau

SEQ ID NO: 881038 - RNA, 19 nt, Homo sapiens
gaggacaccugaccuuuug

SEQ ID NO: 881039 - RNA, 19 nt, Homo sapiens
aaacuaccuuaugagcuua

SEQ ID NO: 881040 - RNA, 19 nt, Homo sapiens
cucaagacuucacuuauug

SEQ ID NO: 881041 - RNA, 19 nt, Homo sapiens
ggagcagucauuagaauuc

SEQ ID NO: 881042 - RNA, 19 nt, Homo sapiens
agaggacgccaccuaauuu

SEQ ID NO: 881043 - RNA, 19 nt, Homo sapiens
uugaugaauuggcauguaa

SEQ ID NO: 881044 - RNA, 19 nt, Homo sapiens
gcuaccaccucaagcuuuc

SEQ ID NO: 881045 - RNA, 19 nt, Homo sapiens
gaauuaguacgccuugaau

SEQ ID NO: 881046 - RNA, 19 nt, Homo sapiens
ucaagaggacgccaccuaa

SEQ ID NO: 881047 - RNA, 19 nt, Homo sapiens
ucaccggucuuucccaugu

SEQ ID NO: 881048 - RNA, 19 nt, Homo sapiens
ugacacagacauugaugaa

SEQ ID NO: 881049 - RNA, 19 nt, Homo sapiens
cuggaugaaugccaacuuu

SEQ ID NO: 881050 - RNA, 19 nt, Homo sapiens
gggaacauccuucaaagag

SEQ ID NO: 881051 - RNA, 19 nt, Homo sapiens
ucugagauguguccaaauc

SEQ ID NO: 881052 - RNA, 19 nt, Homo sapiens
aaaggaugguuguggaaug

SEQ ID NO: 881053 - RNA, 19 nt, Homo sapiens
uuagaauucucgcuuguuc

SEQ ID NO: 881054 - RNA, 19 nt, Homo sapiens
ccugugaccuggcaagugu

SEQ ID NO: 881055 - RNA, 19 nt, Homo sapiens
aaaguaucguggcauuuau

SEQ ID NO: 881056 - RNA, 19 nt, Homo sapiens
gagcuuuacucagugacuu

SEQ ID NO: 881057 - RNA, 19 nt, Homo sapiens
cacaccagcucccaaacuu

SEQ ID NO: 881058 - RNA, 19 nt, Homo sapiens
guggagauguaagaauauu

SEQ ID NO: 881059 - RNA, 19 nt, Homo sapiens
gaacauacacgauucauaa

SEQ ID NO: 881060 - RNA, 19 nt, Homo sapiens
gaaauuaucucaaggaucu

SEQ ID NO: 881061 - RNA, 19 nt, Homo sapiens
uaacauacccacacaauua

SEQ ID NO: 881062 - RNA, 19 nt, Homo sapiens
gagcauaacuaaaguauuc

SEQ ID NO: 881063 - RNA, 19 nt, Homo sapiens
ggagacggcuuucauaugu

SEQ ID NO: 881064 - RNA, 19 nt, Homo sapiens
ggacacuacugcuuaauau

SEQ ID NO: 881065 - RNA, 19 nt, Homo sapiens
ggugacaacuuaacaugua

SEQ ID NO: 881066 - RNA, 19 nt, Homo sapiens
ggaauuuggugucagcuaa

SEQ ID NO: 881067 - RNA, 19 nt, Homo sapiens
caucugggauuucuacuuu

SEQ ID NO: 881068 - RNA, 19 nt, Homo sapiens
ggacacaggugccaguuca

SEQ ID NO: 881069 - RNA, 19 nt, Homo sapiens
ggaccacccuccuaaucua

SEQ ID NO: 881070 - RNA, 19 nt, Homo sapiens
caauacauaugaacgcuuu

SEQ ID NO: 881071 - RNA, 19 nt, Homo sapiens
gaaugaaacgccuguauau

SEQ ID NO: 881072 - RNA, 19 nt, Homo sapiens
ucaaguguuucaccaauuu

SEQ ID NO: 881073 - RNA, 19 nt, Homo sapiens
gcacucugcuguguucuuu

SEQ ID NO: 881074 - RNA, 19 nt, Homo sapiens
ucuggaagcucaauuauca

SEQ ID NO: 881075 - RNA, 19 nt, Homo sapiens
gcaccgcggucacuauuuc

SEQ ID NO: 881076 - RNA, 19 nt, Homo sapiens
ggaaggguguaaagcaguu

SEQ ID NO: 881077 - RNA, 19 nt, Homo sapiens
aaacauuucucucgagugu

SEQ ID NO: 881078 - RNA, 19 nt, Homo sapiens
caaauuccuuucucuaagu

SEQ ID NO: 881079 - RNA, 19 nt, Homo sapiens
gauauguuguuaacuggaa

SEQ ID NO: 881080 - RNA, 19 nt, Homo sapiens
cagauacucuuaaaucaca

SEQ ID NO: 881081 - RNA, 19 nt, Homo sapiens
gaaacacgguccugauacu

SEQ ID NO: 881082 - RNA, 19 nt, Homo sapiens
ccaggacacuacugcuuaa

SEQ ID NO: 881083 - RNA, 19 nt, Homo sapiens
gcccucaccuguggaauuu

SEQ ID NO: 881084 - RNA, 19 nt, Homo sapiens
cagaaacacgguccugaua

SEQ ID NO: 881085 - RNA, 19 nt, Homo sapiens
ggaggcagcgugaguguga

SEQ ID NO: 881086 - RNA, 19 nt, Homo sapiens
agacggcuuucauauguuu

SEQ ID NO: 881087 - RNA, 19 nt, Homo sapiens
uaagggauauguuguuaac

SEQ ID NO: 881088 - RNA, 19 nt, Homo sapiens
agaaugaaacgccuguaua

SEQ ID NO: 881089 - RNA, 19 nt, Homo sapiens
gcagaugcagcucucauga

SEQ ID NO: 881090 - RNA, 19 nt, Homo sapiens
caaagcaguacaugugauu

SEQ ID NO: 881091 - RNA, 19 nt, Homo sapiens
ucaaauuccuuucucuaag

SEQ ID NO: 881092 - RNA, 19 nt, Homo sapiens
gagcaaagcaacugauguc

SEQ ID NO: 881093 - RNA, 19 nt, Homo sapiens
agagagagccucccaguca

SEQ ID NO: 881094 - RNA, 19 nt, Homo sapiens
gugacaacuuaacauguaa

SEQ ID NO: 881095 - RNA, 19 nt, Homo sapiens
ggucaaauuccuuucucua

SEQ ID NO: 881096 - RNA, 19 nt, Homo sapiens
uguauauccugguuaaguu

SEQ ID NO: 881097 - RNA, 19 nt, Homo sapiens
gccuguauauccugguuaa

SEQ ID NO: 881098 - RNA, 19 nt, Homo sapiens
gaagaagaaauggaaacuu

SEQ ID NO: 881099 - RNA, 19 nt, Homo sapiens
gagacggcuuucauauguu

SEQ ID NO: 881100 - RNA, 19 nt, Homo sapiens
gaaacagaaagucaagugu

SEQ ID NO: 881101 - RNA, 19 nt, Homo sapiens
caauacaucugggauuucu

SEQ ID NO: 881102 - RNA, 19 nt, Homo sapiens
ccacacaauuaauauaagg

SEQ ID NO: 881103 - RNA, 19 nt, Homo sapiens
aaaggaagaagaaauggaa

SEQ ID NO: 881104 - RNA, 19 nt, Homo sapiens
caaagggacggaggcauuu

SEQ ID NO: 881105 - RNA, 19 nt, Homo sapiens
gucaaauuccuuucucuaa

SEQ ID NO: 881106 - RNA, 19 nt, Homo sapiens
cuucguuucuuuagucaaa

SEQ ID NO: 881107 - RNA, 19 nt, Homo sapiens
cauacccacacaauuaaua

SEQ ID NO: 881108 - RNA, 19 nt, Homo sapiens
auaagaacauacacgauuc

SEQ ID NO: 881109 - RNA, 19 nt, Homo sapiens
gaaugugggcguaagaaag

SEQ ID NO: 881110 - RNA, 19 nt, Homo sapiens
gggcccagcaggucaaauu

SEQ ID NO: 881111 - RNA, 19 nt, Homo sapiens
gucaaguguuucaccaauu

SEQ ID NO: 881112 - RNA, 19 nt, Homo sapiens
cucaauacaucugggauuu

SEQ ID NO: 881113 - RNA, 19 nt, Homo sapiens
gaaguucugacucaauaca

SEQ ID NO: 881114 - RNA, 19 nt, Homo sapiens
gaauuuggugucagcuaaa

SEQ ID NO: 881115 - RNA, 19 nt, Homo sapiens
ugacagaaccaggacacua

SEQ ID NO: 881116 - RNA, 19 nt, Homo sapiens
uaugaacgcuuuuagagaa

SEQ ID NO: 881117 - RNA, 19 nt, Homo sapiens
gagccguguuuccgucuau

SEQ ID NO: 881118 - RNA, 19 nt, Homo sapiens
gaaagaaacacccguuacc

SEQ ID NO: 881119 - RNA, 19 nt, Homo sapiens
acaaagggacggaggcauu

SEQ ID NO: 881120 - RNA, 19 nt, Homo sapiens
ccaggcacaauacauauga

SEQ ID NO: 881121 - RNA, 19 nt, Homo sapiens
cagcaggucaaauuccuuu

SEQ ID NO: 881122 - RNA, 19 nt, Homo sapiens
agucaaaucuccuuuucua

SEQ ID NO: 881123 - RNA, 19 nt, Homo sapiens
ucaaagcaguacaugugau

SEQ ID NO: 881124 - RNA, 19 nt, Homo sapiens
ugggauuucuacuuucaaa

SEQ ID NO: 881125 - RNA, 19 nt, Homo sapiens
guauauccugguuaaguuu

SEQ ID NO: 881126 - RNA, 19 nt, Homo sapiens
ugacuggcaugcugaaagg

SEQ ID NO: 881127 - RNA, 19 nt, Homo sapiens
ccacccuccuaaucuacua

SEQ ID NO: 881128 - RNA, 19 nt, Homo sapiens
cuaaaguauucuucguuuc

SEQ ID NO: 881129 - RNA, 19 nt, Homo sapiens
cccaugaaauuaucucaag

SEQ ID NO: 881130 - RNA, 19 nt, Homo sapiens
guguuuccgucuauuguug

SEQ ID NO: 881131 - RNA, 19 nt, Homo sapiens
agggauauguuguuaacug

SEQ ID NO: 881132 - RNA, 19 nt, Homo sapiens
auaauaacauacccacaca

SEQ ID NO: 881133 - RNA, 19 nt, Homo sapiens
cuaaguaugggagacauuu

SEQ ID NO: 881134 - RNA, 19 nt, Homo sapiens
guuaccggguccagacuga

SEQ ID NO: 881135 - RNA, 19 nt, Homo sapiens
uaaaauuccaggcacaaua

SEQ ID NO: 881136 - RNA, 19 nt, Homo sapiens
gaggaggcuucugcacguu

SEQ ID NO: 881137 - RNA, 19 nt, Homo sapiens
gcuguacgcgucaugauag

SEQ ID NO: 881138 - RNA, 19 nt, Homo sapiens
gacagaaccaggacacuac

SEQ ID NO: 881139 - RNA, 19 nt, Homo sapiens
ggagcaaagcaacugaugu

SEQ ID NO: 881140 - RNA, 19 nt, Homo sapiens
ucaauuaucacgagcacau

SEQ ID NO: 881141 - RNA, 19 nt, Homo sapiens
gaagaaugaaacgccugua

SEQ ID NO: 881142 - RNA, 19 nt, Homo sapiens
ucauccugauaaucucuua

SEQ ID NO: 881143 - RNA, 19 nt, Homo sapiens
ggaagaagaaauggaaacu

SEQ ID NO: 881144 - RNA, 19 nt, Homo sapiens
agaacauacacgauucaua

SEQ ID NO: 881145 - RNA, 19 nt, Homo sapiens
cugauacucauccugauaa

SEQ ID NO: 881146 - RNA, 19 nt, Homo sapiens
ccugauacucauccugaua

SEQ ID NO: 881147 - RNA, 19 nt, Homo sapiens
ggcuguacgcgucaugaua

SEQ ID NO: 881148 - RNA, 19 nt, Homo sapiens
aauggagacggcuuucaua

SEQ ID NO: 881149 - RNA, 19 nt, Homo sapiens
gacacuacugcuuaauauu

SEQ ID NO: 881150 - RNA, 19 nt, Homo sapiens
caugaaauuaucucaagga

SEQ ID NO: 881151 - RNA, 19 nt, Homo sapiens
agucaaguguuucaccaau

SEQ ID NO: 881152 - RNA, 19 nt, Homo sapiens
uaagaaacagaaagucaag

SEQ ID NO: 881153 - RNA, 19 nt, Homo sapiens
uuucaaagcaguacaugug

SEQ ID NO: 881154 - RNA, 19 nt, Homo sapiens
uaacuggaaggguguaaag

SEQ ID NO: 881155 - RNA, 19 nt, Homo sapiens
ggaagccaggaaacucuga

SEQ ID NO: 881156 - RNA, 19 nt, Homo sapiens
ugaaugugggcguaagaaa

SEQ ID NO: 881157 - RNA, 19 nt, Homo sapiens
gcucucaugaggccugaaa

SEQ ID NO: 881158 - RNA, 19 nt, Homo sapiens
agaaacagaaagucaagug

SEQ ID NO: 881159 - RNA, 19 nt, Homo sapiens
gcaauaagcuggcuaugca

SEQ ID NO: 881160 - RNA, 19 nt, Homo sapiens
cuacuuagacucacaauua

SEQ ID NO: 881161 - RNA, 19 nt, Homo sapiens
gaucagagaacaaaucuaa

SEQ ID NO: 881162 - RNA, 19 nt, Homo sapiens
caccagcucugaucuguua

SEQ ID NO: 881163 - RNA, 19 nt, Homo sapiens
gcaagacgguaccuacaaa

SEQ ID NO: 881164 - RNA, 19 nt, Homo sapiens
uaaagaaugucaucaagga

SEQ ID NO: 881165 - RNA, 19 nt, Homo sapiens
ccaacauccuugagaauaa

SEQ ID NO: 881166 - RNA, 19 nt, Homo sapiens
gcaagaaugucaauguagu

SEQ ID NO: 881167 - RNA, 19 nt, Homo sapiens
gaacaaucccagucuuuga

SEQ ID NO: 881168 - RNA, 19 nt, Homo sapiens
gcucugaucuguuacuugu

SEQ ID NO: 881169 - RNA, 19 nt, Homo sapiens
gugcagagguuuaucacaa

SEQ ID NO: 881170 - RNA, 19 nt, Homo sapiens
caagaucgauaaccugaug

SEQ ID NO: 881171 - RNA, 19 nt, Homo sapiens
uagcaagaaugucaaugua

SEQ ID NO: 881172 - RNA, 19 nt, Homo sapiens
caacauccuugagaauaaa

SEQ ID NO: 881173 - RNA, 19 nt, Homo sapiens
ggagaaguauggaaaggau

SEQ ID NO: 881174 - RNA, 19 nt, Homo sapiens
gaagucauccugccuguuc

SEQ ID NO: 881175 - RNA, 19 nt, Homo sapiens
gaucccagcagauacauuu

SEQ ID NO: 881176 - RNA, 19 nt, Homo sapiens
guaacgaucgugcuuugua

SEQ ID NO: 881177 - RNA, 19 nt, Homo sapiens
gagcaagacaagaucgaua

SEQ ID NO: 881178 - RNA, 19 nt, Homo sapiens
caaccaacgugggugauga

SEQ ID NO: 881179 - RNA, 19 nt, Homo sapiens
ggcaugcagugaagaacua

SEQ ID NO: 881180 - RNA, 19 nt, Homo sapiens
guagaacaaucccagucuu

SEQ ID NO: 881181 - RNA, 19 nt, Homo sapiens
gcagagguuuaucacaauc

SEQ ID NO: 881182 - RNA, 19 nt, Homo sapiens
gaauaacccagaagucauc

SEQ ID NO: 881183 - RNA, 19 nt, Homo sapiens
gggaauaacccagaaguca

SEQ ID NO: 881184 - RNA, 19 nt, Homo sapiens
gaucgugcuuuguagaaca

SEQ ID NO: 881185 - RNA, 19 nt, Homo sapiens
uguaagcacuagucaccua

SEQ ID NO: 881186 - RNA, 19 nt, Homo sapiens
cgacacccguucugguuau

SEQ ID NO: 881187 - RNA, 19 nt, Homo sapiens
cuaccgcgauggaaaguau

SEQ ID NO: 881188 - RNA, 19 nt, Homo sapiens
ucaaggagaaguauggaaa

SEQ ID NO: 881189 - RNA, 19 nt, Homo sapiens
gcacugauuagcaagaaug

SEQ ID NO: 881190 - RNA, 19 nt, Homo sapiens
uaacgaucgugcuuuguag

SEQ ID NO: 881191 - RNA, 19 nt, Homo sapiens
gcacuagucaccuacuuag

SEQ ID NO: 881192 - RNA, 19 nt, Homo sapiens
gaaaggaugcaaccaacgu

SEQ ID NO: 881193 - RNA, 19 nt, Homo sapiens
ggguguaucucuggcugua

SEQ ID NO: 881194 - RNA, 19 nt, Homo sapiens
gaacuucgggacaaugaca

SEQ ID NO: 881195 - RNA, 19 nt, Homo sapiens
aguaugaccuggacuucaa

SEQ ID NO: 881196 - RNA, 19 nt, Homo sapiens
uggcuacucugacaagguu

SEQ ID NO: 881197 - RNA, 19 nt, Homo sapiens
ggaauaacccagaagucau

SEQ ID NO: 881198 - RNA, 19 nt, Homo sapiens
ggauggaucagagaacaaa

SEQ ID NO: 881199 - RNA, 19 nt, Homo sapiens
ccaugcccgugauaucuuu

SEQ ID NO: 881200 - RNA, 19 nt, Homo sapiens
gcauuggugcagagguuua

SEQ ID NO: 881201 - RNA, 19 nt, Homo sapiens
ucaauguaguggagcaaga

SEQ ID NO: 881202 - RNA, 19 nt, Homo sapiens
ccgaugaucccagcagaua

SEQ ID NO: 881203 - RNA, 19 nt, Homo sapiens
ugacaagacacgcuacaug

SEQ ID NO: 881204 - RNA, 19 nt, Homo sapiens
uuaugaagcucugcuggaa

SEQ ID NO: 881205 - RNA, 19 nt, Homo sapiens
ugccucaacuggaauuuau

SEQ ID NO: 881206 - RNA, 19 nt, Homo sapiens
caagauguccauucucaag

SEQ ID NO: 881207 - RNA, 19 nt, Homo sapiens
uaacgacgcaauccgcauu

SEQ ID NO: 881208 - RNA, 19 nt, Homo sapiens
ucacauugcugaccuugcu

SEQ ID NO: 881209 - RNA, 19 nt, Homo sapiens
uagaacaaucccagucuuu

SEQ ID NO: 881210 - RNA, 19 nt, Homo sapiens
guaaggcuggcuacucuga

SEQ ID NO: 881211 - RNA, 19 nt, Homo sapiens
ugaagacugccaucgguaa

SEQ ID NO: 881212 - RNA, 19 nt, Homo sapiens
agaaugucaucaaggagaa

SEQ ID NO: 881213 - RNA, 19 nt, Homo sapiens
ucuaaagaaugucaucaag

SEQ ID NO: 881214 - RNA, 19 nt, Homo sapiens
ccgcauuggugcagagguu

SEQ ID NO: 881215 - RNA, 19 nt, Homo sapiens
gugcggguguucaagaugu

SEQ ID NO: 881216 - RNA, 19 nt, Homo sapiens
guguaucucuggcuguaug

SEQ ID NO: 881217 - RNA, 19 nt, Homo sapiens
ggggaagggugucucaaaa

SEQ ID NO: 881218 - RNA, 19 nt, Homo sapiens
cacccguucugguuaugua

SEQ ID NO: 881219 - RNA, 19 nt, Homo sapiens
gaucugaccgugacuaagc

SEQ ID NO: 881220 - RNA, 19 nt, Homo sapiens
gaugaucccagcagauaca

SEQ ID NO: 881221 - RNA, 19 nt, Homo sapiens
guagaccuuuacacuaaca

SEQ ID NO: 881222 - RNA, 19 nt, Homo sapiens
agagguuuaucacaaucua

SEQ ID NO: 881223 - RNA, 19 nt, Homo sapiens
cccaacauccuugagaaua

SEQ ID NO: 881224 - RNA, 19 nt, Homo sapiens
uucaagauguccauucuca

SEQ ID NO: 881225 - RNA, 19 nt, Homo sapiens
cugagcgucuagccaagua

SEQ ID NO: 881226 - RNA, 19 nt, Homo sapiens
gauguccauucucaagauc

SEQ ID NO: 881227 - RNA, 19 nt, Homo sapiens
gagaaacagaagauaccuu

SEQ ID NO: 881228 - RNA, 19 nt, Homo sapiens
cgguaaggcuggcuacucu

SEQ ID NO: 881229 - RNA, 19 nt, Homo sapiens
ccucaacuggaauuuauga

SEQ ID NO: 881230 - RNA, 19 nt, Homo sapiens
caagaaugucaauguagug

SEQ ID NO: 881231 - RNA, 19 nt, Homo sapiens
gaagacugccaucgguaag

SEQ ID NO: 881232 - RNA, 19 nt, Homo sapiens
cacccgcacugauuagcaa

SEQ ID NO: 881233 - RNA, 19 nt, Homo sapiens
caaaagcuguugagcacau

SEQ ID NO: 881234 - RNA, 19 nt, Homo sapiens
agauguccauucucaagau

SEQ ID NO: 881235 - RNA, 19 nt, Homo sapiens
gcucccaugcuggcaauaa

SEQ ID NO: 881236 - RNA, 19 nt, Homo sapiens
caaucccagucuuugaugu

SEQ ID NO: 881237 - RNA, 19 nt, Homo sapiens
cccgugauaucuuugaauc

SEQ ID NO: 881238 - RNA, 19 nt, Homo sapiens
ccgcuuugcuggaagaaac

SEQ ID NO: 881239 - RNA, 19 nt, Homo sapiens
uggaagaagcuguuuacug

SEQ ID NO: 881240 - RNA, 19 nt, Homo sapiens
gagguuuaucacaaucuaa

SEQ ID NO: 881241 - RNA, 19 nt, Homo sapiens
ccgcacugauuagcaagaa

SEQ ID NO: 881242 - RNA, 19 nt, Homo sapiens
uugggaggcuguuugacuu

SEQ ID NO: 881243 - RNA, 19 nt, Homo sapiens
cuagaugacucuccuucac

SEQ ID NO: 881244 - RNA, 19 nt, Homo sapiens
ucaccuacuuagacucaca

SEQ ID NO: 881245 - RNA, 19 nt, Homo sapiens
gcuggaacuucgggacaau

SEQ ID NO: 881246 - RNA, 19 nt, Homo sapiens
gcaaccaacgugggugaug

SEQ ID NO: 881247 - RNA, 19 nt, Homo sapiens
gugccucaacuggaauuua

SEQ ID NO: 881248 - RNA, 19 nt, Homo sapiens
agcaagacaagaucgauaa

SEQ ID NO: 881249 - RNA, 19 nt, Homo sapiens
agaacaaucccagucuuug

SEQ ID NO: 881250 - RNA, 19 nt, Homo sapiens
gggugcggguguucaagau

SEQ ID NO: 881251 - RNA, 19 nt, Homo sapiens
gcuguugagcacauuauca

SEQ ID NO: 881252 - RNA, 19 nt, Homo sapiens
gcuaugcaggaguucauga

SEQ ID NO: 881253 - RNA, 19 nt, Homo sapiens
cugauuagcaagaauguca

SEQ ID NO: 881254 - RNA, 19 nt, Homo sapiens
ggaggcuguuugacuugca

SEQ ID NO: 881255 - RNA, 19 nt, Homo sapiens
ugacucuccuucaccuaca

SEQ ID NO: 881256 - RNA, 19 nt, Homo sapiens
ccucaaggucaaccagauu

SEQ ID NO: 881257 - RNA, 19 nt, Homo sapiens
gguagaccuuuacacuaac

SEQ ID NO: 881258 - RNA, 19 nt, Homo sapiens
ugcagagguuuaucacaau

SEQ ID NO: 881259 - RNA, 19 nt, Homo sapiens
caggagcucuuaauaaaua

SEQ ID NO: 881260 - RNA, 19 nt, Homo sapiens
ggaaggaguugccagauag

SEQ ID NO: 881261 - RNA, 19 nt, Homo sapiens
gcacaaaggaguuagcauu

SEQ ID NO: 881262 - RNA, 19 nt, Homo sapiens
ugaacaaucucaagaaugu

SEQ ID NO: 881263 - RNA, 19 nt, Homo sapiens
gcacagaggaggagauuca

SEQ ID NO: 881264 - RNA, 19 nt, Homo sapiens
gugcacagguaaguauuua

SEQ ID NO: 881265 - RNA, 19 nt, Homo sapiens
ggacagcaggcacugguua

SEQ ID NO: 881266 - RNA, 19 nt, Homo sapiens
gcgggaagguuaucgaaga

SEQ ID NO: 881267 - RNA, 19 nt, Homo sapiens
agacacagguuuauuucaa

SEQ ID NO: 881268 - RNA, 19 nt, Homo sapiens
gacgagagcugagcacguu

SEQ ID NO: 881269 - RNA, 19 nt, Homo sapiens
gaagugcacagguaaguau

SEQ ID NO: 881270 - RNA, 19 nt, Homo sapiens
caaaggaguuagcauuagu

SEQ ID NO: 881271 - RNA, 19 nt, Homo sapiens
gaaaguaugaagagggaaa

SEQ ID NO: 881272 - RNA, 19 nt, Homo sapiens
uaucaggagcucuuaauaa

SEQ ID NO: 881273 - RNA, 19 nt, Homo sapiens
gaaaggaggagcacaaagg

SEQ ID NO: 881274 - RNA, 19 nt, Homo sapiens
ggaguuagcauuagucucu

SEQ ID NO: 881275 - RNA, 19 nt, Homo sapiens
cacaaaggaguuagcauua

SEQ ID NO: 881276 - RNA, 19 nt, Homo sapiens
ggaagguuaucgaagacaa

SEQ ID NO: 881277 - RNA, 19 nt, Homo sapiens
uggaaggaguugccagaua

SEQ ID NO: 881278 - RNA, 19 nt, Homo sapiens
gaaagagaaagcagaaagu

SEQ ID NO: 881279 - RNA, 19 nt, Homo sapiens
ggaaagagaaagcagaaag

SEQ ID NO: 881280 - RNA, 19 nt, Homo sapiens
gagaaagcagaaaguauga

SEQ ID NO: 881281 - RNA, 19 nt, Homo sapiens
ggacugugcugugaaagag

SEQ ID NO: 881282 - RNA, 19 nt, Homo sapiens
acacauuucuacccaaguu

SEQ ID NO: 881283 - RNA, 19 nt, Homo sapiens
cgaggcagcuggagaugug

SEQ ID NO: 881284 - RNA, 19 nt, Homo sapiens
gcagaaagggaacacaugu

SEQ ID NO: 881285 - RNA, 19 nt, Homo sapiens
gcacaggcuucaugcacau

SEQ ID NO: 881286 - RNA, 19 nt, Homo sapiens
aucaggagcucuuaauaaa

SEQ ID NO: 881287 - RNA, 19 nt, Homo sapiens
uagcauuagucucuacuga

SEQ ID NO: 881288 - RNA, 19 nt, Homo sapiens
gagcugagcacguuuaaaa

SEQ ID NO: 881289 - RNA, 19 nt, Homo sapiens
ucagucacaugcugucuug

SEQ ID NO: 881290 - RNA, 19 nt, Homo sapiens
gccagacacagguuuauuu

SEQ ID NO: 881291 - RNA, 19 nt, Homo sapiens
gaaagagaucugugaccuu

SEQ ID NO: 881292 - RNA, 19 nt, Homo sapiens
gcuggccgauguugauuug

SEQ ID NO: 881293 - RNA, 19 nt, Homo sapiens
gaaagcagaaaguaugaag

SEQ ID NO: 881294 - RNA, 19 nt, Homo sapiens
aaagagaaagcagaaagua

SEQ ID NO: 881295 - RNA, 19 nt, Homo sapiens
gaccugcuaugcccacaga

SEQ ID NO: 881296 - RNA, 19 nt, Homo sapiens
gagaucucaggcucaauua

SEQ ID NO: 881297 - RNA, 19 nt, Homo sapiens
gaggagcacaaaggaguua

SEQ ID NO: 881298 - RNA, 19 nt, Homo sapiens
agagaaagcagaaaguaug

SEQ ID NO: 881299 - RNA, 19 nt, Homo sapiens
gcuguggacugugcuguga

SEQ ID NO: 881300 - RNA, 19 nt, Homo sapiens
gaagguuaucgaagacaaa

SEQ ID NO: 881301 - RNA, 19 nt, Homo sapiens
gaucucaggcucaauuaag

SEQ ID NO: 881302 - RNA, 19 nt, Homo sapiens
cuacugagcaauuccuauu

SEQ ID NO: 881303 - RNA, 19 nt, Homo sapiens
cgagagcugagcacguuua

SEQ ID NO: 881304 - RNA, 19 nt, Homo sapiens
aaggcuccauuccuacuua

SEQ ID NO: 881305 - RNA, 19 nt, Homo sapiens
ucacuucagacuucccuua

SEQ ID NO: 881306 - RNA, 19 nt, Homo sapiens
cagcucgacugcucacuuc

SEQ ID NO: 881307 - RNA, 19 nt, Homo sapiens
gcacgccgacugaaagcaa

SEQ ID NO: 881308 - RNA, 19 nt, Homo sapiens
acaaaggaguuagcauuag

SEQ ID NO: 881309 - RNA, 19 nt, Homo sapiens
aaguuuaaaugaccugcua

SEQ ID NO: 881310 - RNA, 19 nt, Homo sapiens
aggcacagcgggaagguua

SEQ ID NO: 881311 - RNA, 19 nt, Homo sapiens
ccagauagagcaaguaaaa

SEQ ID NO: 881312 - RNA, 19 nt, Homo sapiens
caaaacaggcaaugcagua

SEQ ID NO: 881313 - RNA, 19 nt, Homo sapiens
gaaggaguugccagauaga

SEQ ID NO: 881314 - RNA, 19 nt, Homo sapiens
gggagagggcugugaggaa

SEQ ID NO: 881315 - RNA, 19 nt, Homo sapiens
gugcagaugggaaagagaa

SEQ ID NO: 881316 - RNA, 19 nt, Homo sapiens
gagagcugagcacguuuaa

SEQ ID NO: 881317 - RNA, 19 nt, Homo sapiens
uggccgauguugauuugaa

SEQ ID NO: 881318 - RNA, 19 nt, Homo sapiens
cuucagacuucccuuaugg

SEQ ID NO: 881319 - RNA, 19 nt, Homo sapiens
gggaaaggaggagcacaaa

SEQ ID NO: 881320 - RNA, 19 nt, Homo sapiens
cauagugucgguuaagguu

SEQ ID NO: 881321 - RNA, 19 nt, Homo sapiens
uagcucauagugucgguua

SEQ ID NO: 881322 - RNA, 19 nt, Homo sapiens
guaaguguuguagcucaua

SEQ ID NO: 881323 - RNA, 19 nt, Homo sapiens
auccagaagugcacaggua

SEQ ID NO: 881324 - RNA, 19 nt, Homo sapiens
acacagguuuauuucaaca

SEQ ID NO: 881325 - RNA, 19 nt, Homo sapiens
gaguuagcauuagucucua

SEQ ID NO: 881326 - RNA, 19 nt, Homo sapiens
acauuucuacccaaguuua

SEQ ID NO: 881327 - RNA, 19 nt, Homo sapiens
ggaggagcacaaaggaguu

SEQ ID NO: 881328 - RNA, 19 nt, Homo sapiens
uaucagugcagaugggaaa

SEQ ID NO: 881329 - RNA, 19 nt, Homo sapiens
aacaggcaaugcaguauca

SEQ ID NO: 881330 - RNA, 19 nt, Homo sapiens
uuagcaggcuggccgaugu

SEQ ID NO: 881331 - RNA, 19 nt, Homo sapiens
ccagacacagguuuauuuc

SEQ ID NO: 881332 - RNA, 19 nt, Homo sapiens
gaaggcuccauuccuacuu

SEQ ID NO: 881333 - RNA, 19 nt, Homo sapiens
gacacagguuuauuucaac

SEQ ID NO: 881334 - RNA, 19 nt, Homo sapiens
uguggacugugcugugaaa

SEQ ID NO: 881335 - RNA, 19 nt, Homo sapiens
uaaguguuguagcucauag

SEQ ID NO: 881336 - RNA, 19 nt, Homo sapiens
gcacagguaaguauuuagc

SEQ ID NO: 881337 - RNA, 19 nt, Homo sapiens
uaaccuaucaggagcucuu

SEQ ID NO: 881338 - RNA, 19 nt, Homo sapiens
aaugaugaguuggauccua

SEQ ID NO: 881339 - RNA, 19 nt, Homo sapiens
ggaaaggaggagcacaaag

SEQ ID NO: 881340 - RNA, 19 nt, Homo sapiens
cuaucaggagcucuuaaua

SEQ ID NO: 881341 - RNA, 19 nt, Homo sapiens
agagaucugugaccuugca

SEQ ID NO: 881342 - RNA, 19 nt, Homo sapiens
cacagagcuugauccagaa

SEQ ID NO: 881343 - RNA, 19 nt, Homo sapiens
ggcaccagcuguggacugu

SEQ ID NO: 881344 - RNA, 19 nt, Homo sapiens
gugcauuaaacauauguga

SEQ ID NO: 881345 - RNA, 19 nt, Homo sapiens
aaaggaggagcacaaagga

SEQ ID NO: 881346 - RNA, 19 nt, Homo sapiens
aagagaaagcagaaaguau

SEQ ID NO: 881347 - RNA, 19 nt, Homo sapiens
ccuaaaugaugaguuggau

SEQ ID NO: 881348 - RNA, 19 nt, Homo sapiens
aaugugcucuuuagugcau

SEQ ID NO: 881349 - RNA, 19 nt, Homo sapiens
auauggcucuuuauguugu

SEQ ID NO: 881350 - RNA, 19 nt, Homo sapiens
ucaggagcucuuaauaaau

SEQ ID NO: 881351 - RNA, 19 nt, Homo sapiens
uuagacaucucagucacau

SEQ ID NO: 881352 - RNA, 19 nt, Homo sapiens
ugugcucuuuagugcauua

SEQ ID NO: 881353 - RNA, 19 nt, Homo sapiens
caggcucaauuaagagaca

SEQ ID NO: 881354 - RNA, 19 nt, Homo sapiens
uagugucgguuaagguuag

SEQ ID NO: 881355 - RNA, 19 nt, Homo sapiens
gcaggcuggccgauguuga

SEQ ID NO: 881356 - RNA, 19 nt, Homo sapiens
gcacagcgggaagguuauc

SEQ ID NO: 881357 - RNA, 19 nt, Homo sapiens
gcaauuccuauuccaacca

SEQ ID NO: 881358 - RNA, 19 nt, Homo sapiens
gaacaaucucaagaaugug

SEQ ID NO: 881359 - RNA, 19 nt, Homo sapiens
gaacuuugcacuugaugga

SEQ ID NO: 881360 - RNA, 19 nt, Homo sapiens
gcuuaacccuuuccauuuc

SEQ ID NO: 881361 - RNA, 19 nt, Homo sapiens
gggagaacuuugcacuuga

SEQ ID NO: 881362 - RNA, 19 nt, Homo sapiens
ggagaacuuugcacuugau

SEQ ID NO: 881363 - RNA, 19 nt, Homo sapiens
caaguguccucccaagugu

SEQ ID NO: 881364 - RNA, 19 nt, Homo sapiens
ugauggagcaccucaauug

SEQ ID NO: 881365 - RNA, 19 nt, Homo sapiens
ggacagcgaccacaaagac

SEQ ID NO: 881366 - RNA, 19 nt, Homo sapiens
ccuacagccugaugcuuaa

SEQ ID NO: 881367 - RNA, 19 nt, Homo sapiens
gaccaggguugacuaaacu

SEQ ID NO: 881368 - RNA, 19 nt, Homo sapiens
ugggagaacuuugcacuug

SEQ ID NO: 881369 - RNA, 19 nt, Homo sapiens
ggacagaauguuuaagaac

SEQ ID NO: 881370 - RNA, 19 nt, Homo sapiens
ccaaguguccucccaagug

SEQ ID NO: 881371 - RNA, 19 nt, Homo sapiens
gccugaugcuuaacccuuu

SEQ ID NO: 881372 - RNA, 19 nt, Homo sapiens
ugaccaggguugacuaaac

SEQ ID NO: 881373 - RNA, 19 nt, Homo sapiens
uggacagaauguuuaagaa

SEQ ID NO: 881374 - RNA, 19 nt, Homo sapiens
ugaccugggcuaagaagaa

SEQ ID NO: 881375 - RNA, 19 nt, Homo sapiens
cauuuccucucauuccauu

SEQ ID NO: 881376 - RNA, 19 nt, Homo sapiens
cugcugaccugggcuaaga

SEQ ID NO: 881377 - RNA, 19 nt, Homo sapiens
cgacugcugugagagugaa

SEQ ID NO: 881378 - RNA, 19 nt, Homo sapiens
uccuacagccugaugcuua

SEQ ID NO: 881379 - RNA, 19 nt, Homo sapiens
gaccugggcuaagaagaac

SEQ ID NO: 881380 - RNA, 19 nt, Homo sapiens
caaaauguccaccuaagug

SEQ ID NO: 881381 - RNA, 19 nt, Homo sapiens
uccuuuaccucauguuugu

SEQ ID NO: 881382 - RNA, 19 nt, Homo sapiens
agaacucuuuggacagaau

SEQ ID NO: 881383 - RNA, 19 nt, Homo sapiens
ugcuuaacccuuuccauuu

SEQ ID NO: 881384 - RNA, 19 nt, Homo sapiens
gaacucuuuggacagaaug

SEQ ID NO: 881385 - RNA, 19 nt, Homo sapiens
cuuuaccucauguuuguua

SEQ ID NO: 881386 - RNA, 19 nt, Homo sapiens
augcuuaacccuuuccauu

SEQ ID NO: 881387 - RNA, 19 nt, Homo sapiens
ucuuuggacagaauguuua

SEQ ID NO: 881388 - RNA, 19 nt, Homo sapiens
caagagcacuuacuuuaua

SEQ ID NO: 881389 - RNA, 19 nt, Homo sapiens
gaaauaacaagagcacuua

SEQ ID NO: 881390 - RNA, 19 nt, Homo sapiens
guaaaacgcuuagcucuua

SEQ ID NO: 881391 - RNA, 19 nt, Homo sapiens
acgcuuagcucuuaauaaa

SEQ ID NO: 881392 - RNA, 19 nt, Homo sapiens
gcuuagcucuuaauaaaug

SEQ ID NO: 881393 - RNA, 19 nt, Homo sapiens
gagaggagcugcgccaaga

SEQ ID NO: 881394 - RNA, 19 nt, Homo sapiens
cugcugagcuguauugaaa

SEQ ID NO: 881395 - RNA, 19 nt, Homo sapiens
gcaacacggugcagcaguu

SEQ ID NO: 881396 - RNA, 19 nt, Homo sapiens
ggaaauaacaagagcacuu

SEQ ID NO: 881397 - RNA, 19 nt, Homo sapiens
gggagacacucauuucuag

SEQ ID NO: 881398 - RNA, 19 nt, Homo sapiens
aacaagagcacuuacuuua

SEQ ID NO: 881399 - RNA, 19 nt, Homo sapiens
uaacaagagcacuuacuuu

SEQ ID NO: 881400 - RNA, 19 nt, Homo sapiens
uagaauaggaggcacauuu

SEQ ID NO: 881401 - RNA, 19 nt, Homo sapiens
ucaguuuggucaccuguaa

SEQ ID NO: 881402 - RNA, 19 nt, Homo sapiens
gagaagaagugggacaagu

SEQ ID NO: 881403 - RNA, 19 nt, Homo sapiens
ccaugcaccuccucaagaa

SEQ ID NO: 881404 - RNA, 19 nt, Homo sapiens
gacagaaauuagaauagga

SEQ ID NO: 881405 - RNA, 19 nt, Homo sapiens
acagaggguucucaugauu

SEQ ID NO: 881406 - RNA, 19 nt, Homo sapiens
agacagaggguucucauga

SEQ ID NO: 881407 - RNA, 19 nt, Homo sapiens
gacagaggguucucaugau

SEQ ID NO: 881408 - RNA, 19 nt, Homo sapiens
gugcagcaguuccugaaga

SEQ ID NO: 881409 - RNA, 19 nt, Homo sapiens
caaguacaccauccgcuaa

SEQ ID NO: 881410 - RNA, 19 nt, Homo sapiens
agaagaagugggacaagua

SEQ ID NO: 881411 - RNA, 19 nt, Homo sapiens
ccggaaaccugggcaagaa

SEQ ID NO: 881412 - RNA, 19 nt, Homo sapiens
gagaagaacaagcacaucu

SEQ ID NO: 881413 - RNA, 19 nt, Homo sapiens
gaagaagugggacaaguac

SEQ ID NO: 881414 - RNA, 19 nt, Homo sapiens
gcuucgaugugcacgauga

SEQ ID NO: 881415 - RNA, 19 nt, Homo sapiens
agacagaaauuagaauagg

SEQ ID NO: 881416 - RNA, 19 nt, Homo sapiens
gaugugaguauuaagugaa

SEQ ID NO: 881417 - RNA, 19 nt, Homo sapiens
ugaugugaguauuaaguga

SEQ ID NO: 881418 - RNA, 19 nt, Homo sapiens
uugcugauguuaugcuuug

SEQ ID NO: 881419 - RNA, 19 nt, Homo sapiens
acaagagcacuuacuuuau

SEQ ID NO: 881420 - RNA, 19 nt, Homo sapiens
ccuccuugcuguguaguuu

SEQ ID NO: 881421 - RNA, 19 nt, Homo sapiens
agaggguucucaugauuca

SEQ ID NO: 881422 - RNA, 19 nt, Homo sapiens
aaacgcuuagcucuuaaua

SEQ ID NO: 881423 - RNA, 19 nt, Homo sapiens
guugugcuauugcugaugu

SEQ ID NO: 881424 - RNA, 19 nt, Homo sapiens
uggguaagcuuauuaaacc

SEQ ID NO: 881425 - RNA, 19 nt, Homo sapiens
ucaagucgcagguggacaa

SEQ ID NO: 881426 - RNA, 19 nt, Homo sapiens
gccaugcaccuccucaaga

SEQ ID NO: 881427 - RNA, 19 nt, Homo sapiens
ggucuuuucugaguauuuu

SEQ ID NO: 881428 - RNA, 19 nt, Homo sapiens
gcagcugguacgagaagaa

SEQ ID NO: 881429 - RNA, 19 nt, Homo sapiens
gcacuaccacaccuucuac

SEQ ID NO: 881430 - RNA, 19 nt, Homo sapiens
cagcuucgaugugcacgau

SEQ ID NO: 881431 - RNA, 19 nt, Homo sapiens
ugcagcaguuccugaagaa

SEQ ID NO: 881432 - RNA, 19 nt, Homo sapiens
caccuggauuugcugcauu

SEQ ID NO: 881433 - RNA, 19 nt, Homo sapiens
guucucaugauucacauug

SEQ ID NO: 881434 - RNA, 19 nt, Homo sapiens
gcugguacgagaagaacaa

SEQ ID NO: 881435 - RNA, 19 nt, Homo sapiens
gagcgcaagcguaagaucu

SEQ ID NO: 881436 - RNA, 19 nt, Homo sapiens
gaguuugauucccgacaca

SEQ ID NO: 881437 - RNA, 19 nt, Homo sapiens
gguacgagaagaacaagca

SEQ ID NO: 881438 - RNA, 19 nt, Homo sapiens
ugcuauugcugauguuaug

SEQ ID NO: 881439 - RNA, 19 nt, Homo sapiens
gauuucgugaccuugauuu

SEQ ID NO: 881440 - RNA, 19 nt, Homo sapiens
ucaccagucacuugauuuc

SEQ ID NO: 881441 - RNA, 19 nt, Homo sapiens
gcucuucagcuucgaugug

SEQ ID NO: 881442 - RNA, 19 nt, Homo sapiens
gcagauggaggugcugaag

SEQ ID NO: 881443 - RNA, 19 nt, Homo sapiens
ccacaccuucuacgacuuc

SEQ ID NO: 881444 - RNA, 19 nt, Homo sapiens
gaggagcugcgccaagagu

SEQ ID NO: 881445 - RNA, 19 nt, Homo sapiens
uaaaacgcuuagcucuuaa

SEQ ID NO: 881446 - RNA, 19 nt, Homo sapiens
auaacaagagcacuuacuu

SEQ ID NO: 881447 - RNA, 19 nt, Homo sapiens
gaucuccugccuguccuuu

SEQ ID NO: 881448 - RNA, 19 nt, Homo sapiens
ugaaggacgaggagaugga

SEQ ID NO: 881449 - RNA, 19 nt, Homo sapiens
ccaccuggauuugcugcau

SEQ ID NO: 881450 - RNA, 19 nt, Homo sapiens
cugauguuaugcuuugguu

SEQ ID NO: 881451 - RNA, 19 nt, Homo sapiens
uucgugaccuugauuucuu

SEQ ID NO: 881452 - RNA, 19 nt, Homo sapiens
cagacagaaauuagaauag

SEQ ID NO: 881453 - RNA, 19 nt, Homo sapiens
ugagcuguauugaaaccau

SEQ ID NO: 881454 - RNA, 19 nt, Homo sapiens
aaaggcagcgggagcagau

SEQ ID NO: 881455 - RNA, 19 nt, Homo sapiens
cuacaaaguugcaguauua

SEQ ID NO: 881456 - RNA, 19 nt, Homo sapiens
gcaaggagguuagaaugua

SEQ ID NO: 881457 - RNA, 19 nt, Homo sapiens
ggaagagcguugagguuua

SEQ ID NO: 881458 - RNA, 19 nt, Homo sapiens
ccaaggaacuuuauaaauc

SEQ ID NO: 881459 - RNA, 19 nt, Homo sapiens
ggugagagcuuugcuaauu

SEQ ID NO: 881460 - RNA, 19 nt, Homo sapiens
uaaaugggcuccuguaugu

SEQ ID NO: 881461 - RNA, 19 nt, Homo sapiens
gaagaaaugucuccaaagg

SEQ ID NO: 881462 - RNA, 19 nt, Homo sapiens
guaaagacuuccucauuga

SEQ ID NO: 881463 - RNA, 19 nt, Homo sapiens
gggaaagcauucaagguua

SEQ ID NO: 881464 - RNA, 19 nt, Homo sapiens
ugaguaagcugauugacua

SEQ ID NO: 881465 - RNA, 19 nt, Homo sapiens
ggaaucauguucuaauuuc

SEQ ID NO: 881466 - RNA, 19 nt, Homo sapiens
guaaugaaauguuguguuc

SEQ ID NO: 881467 - RNA, 19 nt, Homo sapiens
gaauugaggcccaagguua

SEQ ID NO: 881468 - RNA, 19 nt, Homo sapiens
ggcagaagaugucgagaua

SEQ ID NO: 881469 - RNA, 19 nt, Homo sapiens
ucacaugcuugaucaguua

SEQ ID NO: 881470 - RNA, 19 nt, Homo sapiens
gcaccuagcuggaucaagu

SEQ ID NO: 881471 - RNA, 19 nt, Homo sapiens
gggagcaucuugucucuaa

SEQ ID NO: 881472 - RNA, 19 nt, Homo sapiens
ggucaagucugucuaaugu

SEQ ID NO: 881473 - RNA, 19 nt, Homo sapiens
gcgcagcggugcucaauga

SEQ ID NO: 881474 - RNA, 19 nt, Homo sapiens
gaagaagaagcuuugauaa

SEQ ID NO: 881475 - RNA, 19 nt, Homo sapiens
gcauaucugucaucugauu

SEQ ID NO: 881476 - RNA, 19 nt, Homo sapiens
ucacagaagcucucaauuu

SEQ ID NO: 881477 - RNA, 19 nt, Homo sapiens
ugaaugaacugcggaguaa

SEQ ID NO: 881478 - RNA, 19 nt, Homo sapiens
ggaaagcauucaagguuau

SEQ ID NO: 881479 - RNA, 19 nt, Homo sapiens
ggacugauguuauguucga

SEQ ID NO: 881480 - RNA, 19 nt, Homo sapiens
uggcauaucugucaucuga

SEQ ID NO: 881481 - RNA, 19 nt, Homo sapiens
caucuugucucuaaccuuu

SEQ ID NO: 881482 - RNA, 19 nt, Homo sapiens
gacauuggauggcuucaaa

SEQ ID NO: 881483 - RNA, 19 nt, Homo sapiens
agaaaugucuccaaaggaa

SEQ ID NO: 881484 - RNA, 19 nt, Homo sapiens
aaagaacacuugucacaug

SEQ ID NO: 881485 - RNA, 19 nt, Homo sapiens
cacagaagcucucaauuuc

SEQ ID NO: 881486 - RNA, 19 nt, Homo sapiens
aaacuucucuuucugaugu

SEQ ID NO: 881487 - RNA, 19 nt, Homo sapiens
acacuacacuuacaacuug

SEQ ID NO: 881488 - RNA, 19 nt, Homo sapiens
guucuggucuggaggauaa

SEQ ID NO: 881489 - RNA, 19 nt, Homo sapiens
cagaagaugucgagauaga

SEQ ID NO: 881490 - RNA, 19 nt, Homo sapiens
caaggagguuagaauguaa

SEQ ID NO: 881491 - RNA, 19 nt, Homo sapiens
ugaagaagaagcuuugaua

SEQ ID NO: 881492 - RNA, 19 nt, Homo sapiens
ggacaggugccauuuaaau

SEQ ID NO: 881493 - RNA, 19 nt, Homo sapiens
cgacaagccaguugcaaua

SEQ ID NO: 881494 - RNA, 19 nt, Homo sapiens
ccacuuggauacugauuug

SEQ ID NO: 881495 - RNA, 19 nt, Homo sapiens
guuggaagcugauggaaug

SEQ ID NO: 881496 - RNA, 19 nt, Homo sapiens
gcucuggucucacuaugaa

SEQ ID NO: 881497 - RNA, 19 nt, Homo sapiens
ggacgcugcuuccaacgaa

SEQ ID NO: 881498 - RNA, 19 nt, Homo sapiens
ccaaacgguugaagaagaa

SEQ ID NO: 881499 - RNA, 19 nt, Homo sapiens
caacauauugcauagguaa

SEQ ID NO: 881500 - RNA, 19 nt, Homo sapiens
gcuagggacugauguuaug

SEQ ID NO: 881501 - RNA, 19 nt, Homo sapiens
cagaagagcuggaaaauuc

SEQ ID NO: 881502 - RNA, 19 nt, Homo sapiens
uguaaagacuuccucauug

SEQ ID NO: 881503 - RNA, 19 nt, Homo sapiens
cagcagcacuuccagcauu

SEQ ID NO: 881504 - RNA, 19 nt, Homo sapiens
caacuugcuucuugagcua

SEQ ID NO: 881505 - RNA, 19 nt, Homo sapiens
ggacaguggauguguauga

SEQ ID NO: 881506 - RNA, 19 nt, Homo sapiens
cagagacuauugauuaaga

SEQ ID NO: 881507 - RNA, 19 nt, Homo sapiens
gaacacuugucacaugcuu

SEQ ID NO: 881508 - RNA, 19 nt, Homo sapiens
uggcaaagcugauggaaca

SEQ ID NO: 881509 - RNA, 19 nt, Homo sapiens
gcugaaauuucuggcauaa

SEQ ID NO: 881510 - RNA, 19 nt, Homo sapiens
ucaaaggaauauaccacua

SEQ ID NO: 881511 - RNA, 19 nt, Homo sapiens
agaccucucuucuggauuu

SEQ ID NO: 881512 - RNA, 19 nt, Homo sapiens
gcgacaagcugaccguuuc

SEQ ID NO: 881513 - RNA, 19 nt, Homo sapiens
ugacaugucugagaguaaa

SEQ ID NO: 881514 - RNA, 19 nt, Homo sapiens
gcacuugcccgucuguauu

SEQ ID NO: 881515 - RNA, 19 nt, Homo sapiens
ggaagcugauggaaugaga

SEQ ID NO: 881516 - RNA, 19 nt, Homo sapiens
ccuaagaugugcuugcauu

SEQ ID NO: 881517 - RNA, 19 nt, Homo sapiens
gaacaaauaccuggaagca

SEQ ID NO: 881518 - RNA, 19 nt, Homo sapiens
gaugcuaggagaagaauuu

SEQ ID NO: 881519 - RNA, 19 nt, Homo sapiens
cuagugccauguuugguua

SEQ ID NO: 881520 - RNA, 19 nt, Homo sapiens
gaucugaagcuuccaauag

SEQ ID NO: 881521 - RNA, 19 nt, Homo sapiens
gcacauacucccauagugu

SEQ ID NO: 881522 - RNA, 19 nt, Homo sapiens
aagggagucugcugaauuu

SEQ ID NO: 881523 - RNA, 19 nt, Homo sapiens
agcaauagcugaagaaaca

SEQ ID NO: 881524 - RNA, 19 nt, Homo sapiens
gagccacuuuguguauuua

SEQ ID NO: 881525 - RNA, 19 nt, Homo sapiens
gaaauguuguguucuuugc

SEQ ID NO: 881526 - RNA, 19 nt, Homo sapiens
caacucuccuaaagacaaa

SEQ ID NO: 881527 - RNA, 19 nt, Homo sapiens
gggcauggaguaauuugua

SEQ ID NO: 881528 - RNA, 19 nt, Homo sapiens
ggucugugcugcugugaga

SEQ ID NO: 881529 - RNA, 19 nt, Homo sapiens
gauggaacauguccgacuu

SEQ ID NO: 881530 - RNA, 19 nt, Homo sapiens
caggaaucauguucuaauu

SEQ ID NO: 881531 - RNA, 19 nt, Homo sapiens
guaaaaugcuuucguugaa

SEQ ID NO: 881532 - RNA, 19 nt, Homo sapiens
gcccacagaugccaccaaa

SEQ ID NO: 881533 - RNA, 19 nt, Homo sapiens
cuacuggauuucuuuacua

SEQ ID NO: 881534 - RNA, 19 nt, Homo sapiens
gagcgugugugacagucua

SEQ ID NO: 881535 - RNA, 19 nt, Homo sapiens
gaaccgcucuccucugacu

SEQ ID NO: 881536 - RNA, 19 nt, Homo sapiens
ggaccuuggugacuggauu

SEQ ID NO: 881537 - RNA, 19 nt, Homo sapiens
caacaccuguaaagacuuc

SEQ ID NO: 881538 - RNA, 19 nt, Homo sapiens
gaagagaagguguuugaag

SEQ ID NO: 881539 - RNA, 19 nt, Homo sapiens
cagaagagaagguguuuga

SEQ ID NO: 881540 - RNA, 19 nt, Homo sapiens
cgaggugacugaagagaau

SEQ ID NO: 881541 - RNA, 19 nt, Homo sapiens
cuucuguaguggauaauua

SEQ ID NO: 881542 - RNA, 19 nt, Homo sapiens
gaacaauguagaagucaga

SEQ ID NO: 881543 - RNA, 19 nt, Homo sapiens
ucagagaggguccuacuuu

SEQ ID NO: 881544 - RNA, 19 nt, Homo sapiens
gaagagcguugagguuuac

SEQ ID NO: 881545 - RNA, 19 nt, Homo sapiens
gaccaggugugcagcuuga

SEQ ID NO: 881546 - RNA, 19 nt, Homo sapiens
gggacuguauaucuuguaa

SEQ ID NO: 881547 - RNA, 19 nt, Homo sapiens
ugggacaggugccauuuaa

SEQ ID NO: 881548 - RNA, 19 nt, Homo sapiens
caugaucccuguguguuaa

SEQ ID NO: 881549 - RNA, 19 nt, Homo sapiens
ggccuuugcugcuggauga

SEQ ID NO: 881550 - RNA, 19 nt, Homo sapiens
caagggagucugcugaauu

SEQ ID NO: 881551 - RNA, 19 nt, Homo sapiens
gagcugucuuacuuugaua

SEQ ID NO: 881552 - RNA, 19 nt, Homo sapiens
ggacacagcaggcuauuuu

SEQ ID NO: 881553 - RNA, 19 nt, Homo sapiens
caacaagguacccagaauu

SEQ ID NO: 881554 - RNA, 19 nt, Homo sapiens
gauuugaggcuuccuaaga

SEQ ID NO: 881555 - RNA, 19 nt, Homo sapiens
gcgacgaguucuucuucga

SEQ ID NO: 881556 - RNA, 19 nt, Homo sapiens
gcgcgugugugacgacuac

SEQ ID NO: 881557 - RNA, 19 nt, Homo sapiens
gcgccacucaacaucauug

SEQ ID NO: 881558 - RNA, 19 nt, Homo sapiens
ggaaugauguaaccuguuu

SEQ ID NO: 881559 - RNA, 19 nt, Homo sapiens
ucacagagcucuccugcua

SEQ ID NO: 881560 - RNA, 19 nt, Homo sapiens
gaguauguauccaguaaua

SEQ ID NO: 881561 - RNA, 19 nt, Homo sapiens
gcccauccauuauuucuua

SEQ ID NO: 881562 - RNA, 19 nt, Homo sapiens
uaaccuguuuccucaauua

SEQ ID NO: 881563 - RNA, 19 nt, Homo sapiens
guaauagcccauucauuua

SEQ ID NO: 881564 - RNA, 19 nt, Homo sapiens
gugaggacaugcaguauuu

SEQ ID NO: 881565 - RNA, 19 nt, Homo sapiens
aagcauauaucgucucuuu

SEQ ID NO: 881566 - RNA, 19 nt, Homo sapiens
gaaacacaaugcacagaga

SEQ ID NO: 881567 - RNA, 19 nt, Homo sapiens
gaacagaaggcacaacuca

SEQ ID NO: 881568 - RNA, 19 nt, Homo sapiens
aguaauagcccauucauuu

SEQ ID NO: 881569 - RNA, 19 nt, Homo sapiens
caacucaaauguguaaaga

SEQ ID NO: 881570 - RNA, 19 nt, Homo sapiens
ugacucacauuuagauuga

SEQ ID NO: 881571 - RNA, 19 nt, Homo sapiens
caagaauuguuguccauug

SEQ ID NO: 881572 - RNA, 19 nt, Homo sapiens
ucaagcccauccauuauuu

SEQ ID NO: 881573 - RNA, 19 nt, Homo sapiens
gaauagugcugcaaugaac

SEQ ID NO: 881574 - RNA, 19 nt, Homo sapiens
ucauuuagcucccacuuau

SEQ ID NO: 881575 - RNA, 19 nt, Homo sapiens
gacagagucuagcaaagaa

SEQ ID NO: 881576 - RNA, 19 nt, Homo sapiens
ggauaaugguuuccaguuc

SEQ ID NO: 881577 - RNA, 19 nt, Homo sapiens
gaaaugguaggaauaaauc

SEQ ID NO: 881578 - RNA, 19 nt, Homo sapiens
ucaaaccugugaugagaaa

SEQ ID NO: 881579 - RNA, 19 nt, Homo sapiens
gaacauucaucuccacacu

SEQ ID NO: 881580 - RNA, 19 nt, Homo sapiens
gaauaccgguguggccuuu

SEQ ID NO: 881581 - RNA, 19 nt, Homo sapiens
ucaaauguguaaagaagga

SEQ ID NO: 881582 - RNA, 19 nt, Homo sapiens
ccuguuuccucaauuauuu

SEQ ID NO: 881583 - RNA, 19 nt, Homo sapiens
gauaaugguuuccaguucu

SEQ ID NO: 881584 - RNA, 19 nt, Homo sapiens
guuauucccuucuuugugu

SEQ ID NO: 881585 - RNA, 19 nt, Homo sapiens
ccauugaacugggaauauu

SEQ ID NO: 881586 - RNA, 19 nt, Homo sapiens
gagcucuccugcuacaauu

SEQ ID NO: 881587 - RNA, 19 nt, Homo sapiens
ggacaugcaguauuugguu

SEQ ID NO: 881588 - RNA, 19 nt, Homo sapiens
acauucaucuccacacuuu

SEQ ID NO: 881589 - RNA, 19 nt, Homo sapiens
ugucuucucuucuugguuu

SEQ ID NO: 881590 - RNA, 19 nt, Homo sapiens
gaaggaagagcaagaacau

SEQ ID NO: 881591 - RNA, 19 nt, Homo sapiens
caagaaaccuaaaaugaga

SEQ ID NO: 881592 - RNA, 19 nt, Homo sapiens
gacaugcaguauuugguuu

SEQ ID NO: 881593 - RNA, 19 nt, Homo sapiens
uaagugaggacaugcagua

SEQ ID NO: 881594 - RNA, 19 nt, Homo sapiens
ggaauaaauccuuugaaca

SEQ ID NO: 881595 - RNA, 19 nt, Homo sapiens
cagguucagucaagaauug

SEQ ID NO: 881596 - RNA, 19 nt, Homo sapiens
gagguuuguuguacagauu

SEQ ID NO: 881597 - RNA, 19 nt, Homo sapiens
cgaguccaauagucaauuu

SEQ ID NO: 881598 - RNA, 19 nt, Homo sapiens
ccuuugcucugccuuauuu

SEQ ID NO: 881599 - RNA, 19 nt, Homo sapiens
acaaagcaauucauaccuu

SEQ ID NO: 881600 - RNA, 19 nt, Homo sapiens
cuaccgauguucccacaaa

SEQ ID NO: 881601 - RNA, 19 nt, Homo sapiens
gagcugaacuuccuaaaag

SEQ ID NO: 881602 - RNA, 19 nt, Homo sapiens
gcauauaucgucucuuuac

SEQ ID NO: 881603 - RNA, 19 nt, Homo sapiens
gaaggcacaacucaaaugu

SEQ ID NO: 881604 - RNA, 19 nt, Homo sapiens
gaauuccuuuccuacaaga

SEQ ID NO: 881605 - RNA, 19 nt, Homo sapiens
cugaguauguauccaguaa

SEQ ID NO: 881606 - RNA, 19 nt, Homo sapiens
caaagucucugagcuucug

SEQ ID NO: 881607 - RNA, 19 nt, Homo sapiens
acaagucugucuucucuuc

SEQ ID NO: 881608 - RNA, 19 nt, Homo sapiens
caccagauguguugugaca

SEQ ID NO: 881609 - RNA, 19 nt, Homo sapiens
uaaagaaggaagagcaaga

SEQ ID NO: 881610 - RNA, 19 nt, Homo sapiens
acagaaggcacaacucaaa

SEQ ID NO: 881611 - RNA, 19 nt, Homo sapiens
ggacugugccaccaugaga

SEQ ID NO: 881612 - RNA, 19 nt, Homo sapiens
aagaauuguuguccauuga

SEQ ID NO: 881613 - RNA, 19 nt, Homo sapiens
ggagguuuguuguacagau

SEQ ID NO: 881614 - RNA, 19 nt, Homo sapiens
ugacaaagucucugagcuu

SEQ ID NO: 881615 - RNA, 19 nt, Homo sapiens
ggaugcuucucuucccaaa

SEQ ID NO: 881616 - RNA, 19 nt, Homo sapiens
uuucaucacccagguauua

SEQ ID NO: 881617 - RNA, 19 nt, Homo sapiens
acucaaauguguaaagaag

SEQ ID NO: 881618 - RNA, 19 nt, Homo sapiens
uuucaaaccugugaugaga

SEQ ID NO: 881619 - RNA, 19 nt, Homo sapiens
uaagcccagugccuaauau

SEQ ID NO: 881620 - RNA, 19 nt, Homo sapiens
gaucagguucagucaagaa

SEQ ID NO: 881621 - RNA, 19 nt, Homo sapiens
ugugacauuucgcaucuuu

SEQ ID NO: 881622 - RNA, 19 nt, Homo sapiens
guaaccuguuuccucaauu

SEQ ID NO: 881623 - RNA, 19 nt, Homo sapiens
ggacggcacaccuuugaca

SEQ ID NO: 881624 - RNA, 19 nt, Homo sapiens
cccauucauuuauugcaua

SEQ ID NO: 881625 - RNA, 19 nt, Homo sapiens
gucucaagcccauccauua

SEQ ID NO: 881626 - RNA, 19 nt, Homo sapiens
gaacuucaaaggacuucau

SEQ ID NO: 881627 - RNA, 19 nt, Homo sapiens
ucccaaauguucuuaugga

SEQ ID NO: 881628 - RNA, 19 nt, Homo sapiens
agagagagagagaaacaaa

SEQ ID NO: 881629 - RNA, 19 nt, Homo sapiens
gcagguccucuucuuucua

SEQ ID NO: 881630 - RNA, 19 nt, Homo sapiens
gugaaaugguaggaauaaa

SEQ ID NO: 881631 - RNA, 19 nt, Homo sapiens
gaauuguuguccauugaac

SEQ ID NO: 881632 - RNA, 19 nt, Homo sapiens
aguauuccaugguaucuau

SEQ ID NO: 881633 - RNA, 19 nt, Homo sapiens
aaagagagagagagaaaca

SEQ ID NO: 881634 - RNA, 19 nt, Homo sapiens
ccaagcauauaucgucucu

SEQ ID NO: 881635 - RNA, 19 nt, Homo sapiens
gcacagagagaggaugcuu

SEQ ID NO: 881636 - RNA, 19 nt, Homo sapiens
caauccagcugcuacuucu

SEQ ID NO: 881637 - RNA, 19 nt, Homo sapiens
gugcaugugucuuuauggu

SEQ ID NO: 881638 - RNA, 19 nt, Homo sapiens
ugaauagugcugcaaugaa

SEQ ID NO: 881639 - RNA, 19 nt, Homo sapiens
gugaauagugcugcaauga

SEQ ID NO: 881640 - RNA, 19 nt, Homo sapiens
gcccagugccuaauauugu

SEQ ID NO: 881641 - RNA, 19 nt, Homo sapiens
cagguccucuucuuucuag

SEQ ID NO: 881642 - RNA, 19 nt, Homo sapiens
guagcagguccucuucuuu

SEQ ID NO: 881643 - RNA, 19 nt, Homo sapiens
acagagcucuccugcuaca

SEQ ID NO: 881644 - RNA, 19 nt, Homo sapiens
auaaugguuuccaguucua

SEQ ID NO: 881645 - RNA, 19 nt, Homo sapiens
gaagugcauuuucucucua

SEQ ID NO: 881646 - RNA, 19 nt, Homo sapiens
guuacuggcugaagugcau

SEQ ID NO: 881647 - RNA, 19 nt, Homo sapiens
guugugacauuucgcaucu

SEQ ID NO: 881648 - RNA, 19 nt, Homo sapiens
cccugaaucuuaccaacaa

SEQ ID NO: 881649 - RNA, 19 nt, Homo sapiens
gguccucuucccagaauuu

SEQ ID NO: 881650 - RNA, 19 nt, Homo sapiens
augcuucucuucccaaaug

SEQ ID NO: 881651 - RNA, 19 nt, Homo sapiens
ugacauuucgcaucuuuca

SEQ ID NO: 881652 - RNA, 19 nt, Homo sapiens
acauuucgcaucuuucaaa

SEQ ID NO: 881653 - RNA, 19 nt, Homo sapiens
gaacaaaggaaaaucucuu

SEQ ID NO: 881654 - RNA, 19 nt, Homo sapiens
uagcagguccucuucuuuc

SEQ ID NO: 881655 - RNA, 19 nt, Homo sapiens
uguagcagguccucuucuu

SEQ ID NO: 881656 - RNA, 19 nt, Homo sapiens
cagguccucuucccagaau

SEQ ID NO: 881657 - RNA, 19 nt, Homo sapiens
gaacugggaauauuuucaa

SEQ ID NO: 881658 - RNA, 19 nt, Homo sapiens
ucaaagggcugacaaaguu

SEQ ID NO: 881659 - RNA, 19 nt, Homo sapiens
ggacaaaggucuccaugca

SEQ ID NO: 881660 - RNA, 19 nt, Homo sapiens
ggauugaccucuccaacaa

SEQ ID NO: 881661 - RNA, 19 nt, Homo sapiens
caacuauggugaagucauu

SEQ ID NO: 881662 - RNA, 19 nt, Homo sapiens
ggaggaggccugcuucuuu

SEQ ID NO: 881663 - RNA, 19 nt, Homo sapiens
cagaauaaccugauagaga

SEQ ID NO: 881664 - RNA, 19 nt, Homo sapiens
ugacaaaguugaagaggau

SEQ ID NO: 881665 - RNA, 19 nt, Homo sapiens
agagagacgucuucuguga

SEQ ID NO: 881666 - RNA, 19 nt, Homo sapiens
gcaggcagcuggaagacau

SEQ ID NO: 881667 - RNA, 19 nt, Homo sapiens
gcauugaguuccuggaugu

SEQ ID NO: 881668 - RNA, 19 nt, Homo sapiens
gaggaggccugcuucuuuc

SEQ ID NO: 881669 - RNA, 19 nt, Homo sapiens
ccaugaggcuccuggcuuu

SEQ ID NO: 881670 - RNA, 19 nt, Homo sapiens
gcgaugacauugaccuaga

SEQ ID NO: 881671 - RNA, 19 nt, Homo sapiens
cagcuucucucccaaggaa

SEQ ID NO: 881672 - RNA, 19 nt, Homo sapiens
cagacaaccugcuggauuc

SEQ ID NO: 881673 - RNA, 19 nt, Homo sapiens
gcaguuccuuuaccuguca

SEQ ID NO: 881674 - RNA, 19 nt, Homo sapiens
cuguacaccugcagaauaa

SEQ ID NO: 881675 - RNA, 19 nt, Homo sapiens
ucauugaccugagcaacua

SEQ ID NO: 881676 - RNA, 19 nt, Homo sapiens
ugacaaagaagcccaagga

SEQ ID NO: 881677 - RNA, 19 nt, Homo sapiens
ugacaaagaagcccaagga

SEQ ID NO: 881678 - RNA, 19 nt, Homo sapiens
gcuccuggcuuuccugagu

SEQ ID NO: 881679 - RNA, 19 nt, Homo sapiens
gagaagcugcaguuccuuu

SEQ ID NO: 881680 - RNA, 19 nt, Homo sapiens
agacaacuauggugaaguc

SEQ ID NO: 881681 - RNA, 19 nt, Homo sapiens
guacugcgggugacaaaga

SEQ ID NO: 881682 - RNA, 19 nt, Homo sapiens
ggaggacugccuaccugua

SEQ ID NO: 881683 - RNA, 19 nt, Homo sapiens
ggacauuccuccucuuccu

SEQ ID NO: 881684 - RNA, 19 nt, Homo sapiens
gaccagcgggcaucacauu

SEQ ID NO: 881685 - RNA, 19 nt, Homo sapiens
ucagacaaccugcuggauu

SEQ ID NO: 881686 - RNA, 19 nt, Homo sapiens
uagagaccaugcagagaga

SEQ ID NO: 881687 - RNA, 19 nt, Homo sapiens
gaggacugccuaccuguau

SEQ ID NO: 881688 - RNA, 19 nt, Homo sapiens
ccucccaggucaucucuug

SEQ ID NO: 881689 - RNA, 19 nt, Homo sapiens
gaccucauccucccagaga

SEQ ID NO: 881690 - RNA, 19 nt, Homo sapiens
acaaccugcuggauucuau

SEQ ID NO: 881691 - RNA, 19 nt, Homo sapiens
caauggagaagcugcaguu

SEQ ID NO: 881692 - RNA, 19 nt, Homo sapiens
gaggagagaggagcagaug

SEQ ID NO: 881693 - RNA, 19 nt, Homo sapiens
agaagcugcaguuccuuua

SEQ ID NO: 881694 - RNA, 19 nt, Homo sapiens
ccagacaacuauggugaag

SEQ ID NO: 881695 - RNA, 19 nt, Homo sapiens
caaaguugaagaggauuga

SEQ ID NO: 881696 - RNA, 19 nt, Homo sapiens
gaacccagacaacuauggu

SEQ ID NO: 881697 - RNA, 19 nt, Homo sapiens
cuacugcgggugacaaaga

SEQ ID NO: 881698 - RNA, 19 nt, Homo sapiens
ucacgucucccuucuacug

SEQ ID NO: 881699 - RNA, 19 nt, Homo sapiens
gauagagaccaugcagaga

SEQ ID NO: 881700 - RNA, 19 nt, Homo sapiens
ccugcagaauaaccugaua

SEQ ID NO: 881701 - RNA, 19 nt, Homo sapiens
uuuccuccaucgauaauga

SEQ ID NO: 881702 - RNA, 19 nt, Homo sapiens
cucauuuccuccaucgaua

SEQ ID NO: 881703 - RNA, 19 nt, Homo sapiens
guauugcgaugacauugac

SEQ ID NO: 881704 - RNA, 19 nt, Homo sapiens
gcggaaugauguccugaac

SEQ ID NO: 881705 - RNA, 19 nt, Homo sapiens
gaggagcucacagauuaug

SEQ ID NO: 881706 - RNA, 19 nt, Homo sapiens
ccuccuuccugccucauug

SEQ ID NO: 881707 - RNA, 19 nt, Homo sapiens
ccuccuuccugccucauug

SEQ ID NO: 881708 - RNA, 19 nt, Homo sapiens
gcucucacgucucccuucu

SEQ ID NO: 881709 - RNA, 19 nt, Homo sapiens
ggcgauuccuuugaaguuc

SEQ ID NO: 881710 - RNA, 19 nt, Homo sapiens
gcgauuccuuugaaguucu

SEQ ID NO: 881711 - RNA, 19 nt, Homo sapiens
acgaugaccagaccuacua

SEQ ID NO: 881712 - RNA, 19 nt, Homo sapiens
ucucacgucucccuucuac

SEQ ID NO: 881713 - RNA, 19 nt, Homo sapiens
ccaaggaaggagaggaaga

SEQ ID NO: 881714 - RNA, 19 nt, Homo sapiens
gggcugacaaaguugaaga

SEQ ID NO: 881715 - RNA, 19 nt, Homo sapiens
uggagaagcugcaguuccu

SEQ ID NO: 881716 - RNA, 19 nt, Homo sapiens
caaagggcugacaaaguug

SEQ ID NO: 881717 - RNA, 19 nt, Homo sapiens
ccugaacccagacaacuau

SEQ ID NO: 881718 - RNA, 19 nt, Homo sapiens
cugcagggcucuccaucca

SEQ ID NO: 881719 - RNA, 19 nt, Homo sapiens
gaagcugcaguuccuuuac

SEQ ID NO: 881720 - RNA, 19 nt, Homo sapiens
ucauuuccuccaucgauaa

SEQ ID NO: 881721 - RNA, 19 nt, Homo sapiens
ccaggauccagaagcauug

SEQ ID NO: 881722 - RNA, 19 nt, Homo sapiens
gggaggaggccugcuucuu

SEQ ID NO: 881723 - RNA, 19 nt, Homo sapiens
acauugaccuagaggacau

SEQ ID NO: 881724 - RNA, 19 nt, Homo sapiens
cuuccugccucauuguaau

SEQ ID NO: 881725 - RNA, 19 nt, Homo sapiens
caaggaaggagaggaagag

SEQ ID NO: 881726 - RNA, 19 nt, Homo sapiens
cagggcugcuacugaguuc

SEQ ID NO: 881727 - RNA, 19 nt, Homo sapiens
gaugggagaucucaaguuu

SEQ ID NO: 881728 - RNA, 19 nt, Homo sapiens
gaugauggcuauccagaaa

SEQ ID NO: 881729 - RNA, 19 nt, Homo sapiens
ugaagugccucucaugaua

SEQ ID NO: 881730 - RNA, 19 nt, Homo sapiens
gcugugacauagauauuua

SEQ ID NO: 881731 - RNA, 19 nt, Homo sapiens
gacccuggauguugaauug

SEQ ID NO: 881732 - RNA, 19 nt, Homo sapiens
gaucucaaguuucaauauc

SEQ ID NO: 881733 - RNA, 19 nt, Homo sapiens
caacagagcuacagaaaag

SEQ ID NO: 881734 - RNA, 19 nt, Homo sapiens
ugauggcuauccagaaaua

SEQ ID NO: 881735 - RNA, 19 nt, Homo sapiens
gaucuauguugauaaggaa

SEQ ID NO: 881736 - RNA, 19 nt, Homo sapiens
ugagaagacuguuaaagca

SEQ ID NO: 881737 - RNA, 19 nt, Homo sapiens
gcagucuccuuuaagcauu

SEQ ID NO: 881738 - RNA, 19 nt, Homo sapiens
agaagacuguuaaagcaaa

SEQ ID NO: 881739 - RNA, 19 nt, Homo sapiens
ugacugagaagacuguuaa

SEQ ID NO: 881740 - RNA, 19 nt, Homo sapiens
ugggagaucucaaguuuca

SEQ ID NO: 881741 - RNA, 19 nt, Homo sapiens
gaggagagagagcuugaaa

SEQ ID NO: 881742 - RNA, 19 nt, Homo sapiens
acucugaucuauguugaua

SEQ ID NO: 881743 - RNA, 19 nt, Homo sapiens
ggagaucucaaguuucaau

SEQ ID NO: 881744 - RNA, 19 nt, Homo sapiens
gucuggaccuucaaucaaa

SEQ ID NO: 881745 - RNA, 19 nt, Homo sapiens
gcucccacauccuuaccua

SEQ ID NO: 881746 - RNA, 19 nt, Homo sapiens
gagaagacuguuaaagcaa

SEQ ID NO: 881747 - RNA, 19 nt, Homo sapiens
ugaucuauguugauaagga

SEQ ID NO: 881748 - RNA, 19 nt, Homo sapiens
ggaaauccaaucuguugca

SEQ ID NO: 881749 - RNA, 19 nt, Homo sapiens
cuacucugaucuauguuga

SEQ ID NO: 881750 - RNA, 19 nt, Homo sapiens
cgaagaaccaggcauccuu

SEQ ID NO: 881751 - RNA, 19 nt, Homo sapiens
gagaucucaaguuucaaua

SEQ ID NO: 881752 - RNA, 19 nt, Homo sapiens
aaagaugacugagaagacu

SEQ ID NO: 881753 - RNA, 19 nt, Homo sapiens
gaagugccucucaugauac

SEQ ID NO: 881754 - RNA, 19 nt, Homo sapiens
gaagacuguuaaagcaaaa

SEQ ID NO: 881755 - RNA, 19 nt, Homo sapiens
uaccuaaagcuaccagaaa

SEQ ID NO: 881756 - RNA, 19 nt, Homo sapiens
ccuuuaagcauucuguuga

SEQ ID NO: 881757 - RNA, 19 nt, Homo sapiens
ggagagagagcuugaaaag

SEQ ID NO: 881758 - RNA, 19 nt, Homo sapiens
ucugaucuauguugauaag

SEQ ID NO: 881759 - RNA, 19 nt, Homo sapiens
gugaagugccucucaugau

SEQ ID NO: 881760 - RNA, 19 nt, Homo sapiens
ccacauccuuaccuaaagc

SEQ ID NO: 881761 - RNA, 19 nt, Homo sapiens
ucaaucaaagccuuagaug

SEQ ID NO: 881762 - RNA, 19 nt, Homo sapiens
guugaauugccaccuguuu

SEQ ID NO: 881763 - RNA, 19 nt, Homo sapiens
ugccucagaugauggcuau

SEQ ID NO: 881764 - RNA, 19 nt, Homo sapiens
ccaccuguuugcugugaca

SEQ ID NO: 881765 - RNA, 19 nt, Homo sapiens
guuccugccucagaugaug

SEQ ID NO: 881766 - RNA, 19 nt, Homo sapiens
uguugacccuggauguuga

SEQ ID NO: 881767 - RNA, 19 nt, Homo sapiens
cuguugcagucuccuuuaa

SEQ ID NO: 881768 - RNA, 19 nt, Homo sapiens
gcuacucugaucuauguug

SEQ ID NO: 881769 - RNA, 19 nt, Homo sapiens
caaaggaugggcugaagcu

SEQ ID NO: 881770 - RNA, 19 nt, Homo sapiens
acagaaaagucaguaaaga

SEQ ID NO: 881771 - RNA, 19 nt, Homo sapiens
cuacaaaggaugggcugaa

SEQ ID NO: 881772 - RNA, 19 nt, Homo sapiens
ucccacauccuuaccuaaa

SEQ ID NO: 881773 - RNA, 19 nt, Homo sapiens
gagugaagugccucucaug

SEQ ID NO: 881774 - RNA, 19 nt, Homo sapiens
gugccucucaugauacuug

SEQ ID NO: 881775 - RNA, 19 nt, Homo sapiens
uacaaaggaugggcugaag

SEQ ID NO: 881776 - RNA, 19 nt, Homo sapiens
ccuguuugcugugacauag

SEQ ID NO: 881777 - RNA, 19 nt, Homo sapiens
gccugaagagcaccagauu

SEQ ID NO: 881778 - RNA, 19 nt, Homo sapiens
caacagcucugcucucuga

SEQ ID NO: 881779 - RNA, 19 nt, Homo sapiens
uagcagagcuguucucaaa

SEQ ID NO: 881780 - RNA, 19 nt, Homo sapiens
ggaaucaacagcugaauaa

SEQ ID NO: 881781 - RNA, 19 nt, Homo sapiens
ggagaucacuucaauaguc

SEQ ID NO: 881782 - RNA, 19 nt, Homo sapiens
ugacaaaugugcucccuuu

SEQ ID NO: 881783 - RNA, 19 nt, Homo sapiens
ccaagcaacccucuauuua

SEQ ID NO: 881784 - RNA, 19 nt, Homo sapiens
ggaaagcaguugaguuaca

SEQ ID NO: 881785 - RNA, 19 nt, Homo sapiens
ucaauagucucugacaaua

SEQ ID NO: 881786 - RNA, 19 nt, Homo sapiens
uaaaguaccuacccagaug

SEQ ID NO: 881787 - RNA, 19 nt, Homo sapiens
gcaacugccagaacaaaua

SEQ ID NO: 881788 - RNA, 19 nt, Homo sapiens
caucaaacaucaaccaguu

SEQ ID NO: 881789 - RNA, 19 nt, Homo sapiens
gauguuagguaaaguuuca

SEQ ID NO: 881790 - RNA, 19 nt, Homo sapiens
gaacgacaccacagaagaa

SEQ ID NO: 881791 - RNA, 19 nt, Homo sapiens
gguaaaguuucaucuauuc

SEQ ID NO: 881792 - RNA, 19 nt, Homo sapiens
agucagaugucuugagaua

SEQ ID NO: 881793 - RNA, 19 nt, Homo sapiens
gagguuaugucaacuguuc

SEQ ID NO: 881794 - RNA, 19 nt, Homo sapiens
gagaaauaccagaaacaua

SEQ ID NO: 881795 - RNA, 19 nt, Homo sapiens
ucagaugucuugagauaug

SEQ ID NO: 881796 - RNA, 19 nt, Homo sapiens
ccggaaagcaguugaguua

SEQ ID NO: 881797 - RNA, 19 nt, Homo sapiens
ggaauacuacuauggauau

SEQ ID NO: 881798 - RNA, 19 nt, Homo sapiens
ucccaaaucuguaguagaa

SEQ ID NO: 881799 - RNA, 19 nt, Homo sapiens
acaagaaccuccugcuuau

SEQ ID NO: 881800 - RNA, 19 nt, Homo sapiens
guagagaaauggucagaag

SEQ ID NO: 881801 - RNA, 19 nt, Homo sapiens
ccaguguaauguaucaaua

SEQ ID NO: 881802 - RNA, 19 nt, Homo sapiens
gaacaagaaccuccugcuu

SEQ ID NO: 881803 - RNA, 19 nt, Homo sapiens
uuacagacauccugccaaa

SEQ ID NO: 881804 - RNA, 19 nt, Homo sapiens
ugaaggaguuguuuauauc

SEQ ID NO: 881805 - RNA, 19 nt, Homo sapiens
ucacaaacgucgcaaagca

SEQ ID NO: 881806 - RNA, 19 nt, Homo sapiens
gcaacccucuauuuaccua

SEQ ID NO: 881807 - RNA, 19 nt, Homo sapiens
gagcagucaccacgaguua

SEQ ID NO: 881808 - RNA, 19 nt, Homo sapiens
ggaauuagcagagcuguuc

SEQ ID NO: 881809 - RNA, 19 nt, Homo sapiens
ucaacaaggucacccauca

SEQ ID NO: 881810 - RNA, 19 nt, Homo sapiens
guucauauaucaucugucu

SEQ ID NO: 881811 - RNA, 19 nt, Homo sapiens
gaaaacugauccagaaaug

SEQ ID NO: 881812 - RNA, 19 nt, Homo sapiens
uuaguaggcucaaauguuc

SEQ ID NO: 881813 - RNA, 19 nt, Homo sapiens
ggacaaccaccaccauguu

SEQ ID NO: 881814 - RNA, 19 nt, Homo sapiens
gcucagauguuagguaaag

SEQ ID NO: 881815 - RNA, 19 nt, Homo sapiens
gagaaauggucagaaggaa

SEQ ID NO: 881816 - RNA, 19 nt, Homo sapiens
ccagaaacauacccuaagu

SEQ ID NO: 881817 - RNA, 19 nt, Homo sapiens
aaaugaggcugaaccauca

SEQ ID NO: 881818 - RNA, 19 nt, Homo sapiens
aacaagaaccuccugcuua

SEQ ID NO: 881819 - RNA, 19 nt, Homo sapiens
ggaagcaguugguggucuu

SEQ ID NO: 881820 - RNA, 19 nt, Homo sapiens
aguagaagauguagcuaaa

SEQ ID NO: 881821 - RNA, 19 nt, Homo sapiens
ugaauaagguuugaugaag

SEQ ID NO: 881822 - RNA, 19 nt, Homo sapiens
ucacuucaauagucucuga

SEQ ID NO: 881823 - RNA, 19 nt, Homo sapiens
cugaaggaguuguuuauau

SEQ ID NO: 881824 - RNA, 19 nt, Homo sapiens
gggaaucaacagcugaaua

SEQ ID NO: 881825 - RNA, 19 nt, Homo sapiens
cgacaccacagaagaaauu

SEQ ID NO: 881826 - RNA, 19 nt, Homo sapiens
gaaagcaguugaguuacag

SEQ ID NO: 881827 - RNA, 19 nt, Homo sapiens
gaaggaacgacaccacaga

SEQ ID NO: 881828 - RNA, 19 nt, Homo sapiens
gggaauacuacuauggaua

SEQ ID NO: 881829 - RNA, 19 nt, Homo sapiens
gaugagaaauaccagaaac

SEQ ID NO: 881830 - RNA, 19 nt, Homo sapiens
ugcagaaggugcuaucaaa

SEQ ID NO: 881831 - RNA, 19 nt, Homo sapiens
uaucaucugucuauaacga

SEQ ID NO: 881832 - RNA, 19 nt, Homo sapiens
ggaacgacaccacagaaga

SEQ ID NO: 881833 - RNA, 19 nt, Homo sapiens
gcaguugaguuacagacau

SEQ ID NO: 881834 - RNA, 19 nt, Homo sapiens
ucuaacauguggacccuuu

SEQ ID NO: 881835 - RNA, 19 nt, Homo sapiens
gcaacgaggaagcucuuaa

SEQ ID NO: 881836 - RNA, 19 nt, Homo sapiens
gaacagaauauagugacaa

SEQ ID NO: 881837 - RNA, 19 nt, Homo sapiens
acagucagaugucuugaga

SEQ ID NO: 881838 - RNA, 19 nt, Homo sapiens
ggaggagaaugcaaaauau

SEQ ID NO: 881839 - RNA, 19 nt, Homo sapiens
gaaccaaacaucuguccau

SEQ ID NO: 881840 - RNA, 19 nt, Homo sapiens
caacagcugaauaagguuu

SEQ ID NO: 881841 - RNA, 19 nt, Homo sapiens
cugcucagauguuagguaa

SEQ ID NO: 881842 - RNA, 19 nt, Homo sapiens
gcagugcacucagguacau

SEQ ID NO: 881843 - RNA, 19 nt, Homo sapiens
gagaucacuucaauagucu

SEQ ID NO: 881844 - RNA, 19 nt, Homo sapiens
ugagguaccugcacaacuc

SEQ ID NO: 881845 - RNA, 19 nt, Homo sapiens
ugacugaaggaguuguuua

SEQ ID NO: 881846 - RNA, 19 nt, Homo sapiens
caauguaaccagaacagaa

SEQ ID NO: 881847 - RNA, 19 nt, Homo sapiens
ccaccaguguaauguauca

SEQ ID NO: 881848 - RNA, 19 nt, Homo sapiens
agaaauaccagaaacauac

SEQ ID NO: 881849 - RNA, 19 nt, Homo sapiens
cuugagauauguugcaaug

SEQ ID NO: 881850 - RNA, 19 nt, Homo sapiens
agaaggugcuaucaaaaua

SEQ ID NO: 881851 - RNA, 19 nt, Homo sapiens
gagcaacugccagaacaaa

SEQ ID NO: 881852 - RNA, 19 nt, Homo sapiens
gcuugcugcucagauguua

SEQ ID NO: 881853 - RNA, 19 nt, Homo sapiens
guaccuacccagauggaaa

SEQ ID NO: 881854 - RNA, 19 nt, Homo sapiens
ggaagcacagggauggaaa

SEQ ID NO: 881855 - RNA, 19 nt, Homo sapiens
gaccaccucuggcaugucu

SEQ ID NO: 881856 - RNA, 19 nt, Homo sapiens
caguaugccuguuguuauc

SEQ ID NO: 881857 - RNA, 19 nt, Homo sapiens
guaaccagaacagaauaua

SEQ ID NO: 881858 - RNA, 19 nt, Homo sapiens
uucaggaucuggugacaaa

SEQ ID NO: 881859 - RNA, 19 nt, Homo sapiens
guggagaucacuucaauag

SEQ ID NO: 881860 - RNA, 19 nt, Homo sapiens
ccacagaagaaauuagaau

SEQ ID NO: 881861 - RNA, 19 nt, Homo sapiens
gagggaauacuacuaugga

SEQ ID NO: 881862 - RNA, 19 nt, Homo sapiens
caagcaacccucuauuuac

SEQ ID NO: 881863 - RNA, 19 nt, Homo sapiens
gaagcagugcacucaggua

SEQ ID NO: 881864 - RNA, 19 nt, Homo sapiens
gcaaaauauuccucaguau

SEQ ID NO: 881865 - RNA, 19 nt, Homo sapiens
ccaaaucuguaguagaaaa

SEQ ID NO: 881866 - RNA, 19 nt, Homo sapiens
ugucaacuguucauauauc

SEQ ID NO: 881867 - RNA, 19 nt, Homo sapiens
gcaggcugauauugagguu

SEQ ID NO: 881868 - RNA, 19 nt, Homo sapiens
aagaaccuccugcuuauga

SEQ ID NO: 881869 - RNA, 19 nt, Homo sapiens
ucuguaaagucaucuagug

SEQ ID NO: 881870 - RNA, 19 nt, Homo sapiens
aaaaugagcagucaaaaga

SEQ ID NO: 881871 - RNA, 19 nt, Homo sapiens
ccucuuguguguucuggaa

SEQ ID NO: 881872 - RNA, 19 nt, Homo sapiens
ucgcaaagcagaaacugaa

SEQ ID NO: 881873 - RNA, 19 nt, Homo sapiens
cuaaggauccacaguuuca

SEQ ID NO: 881874 - RNA, 19 nt, Homo sapiens
caaccaccaccauguucua

SEQ ID NO: 881875 - RNA, 19 nt, Homo sapiens
caugguggcugcuccucuu

SEQ ID NO: 881876 - RNA, 19 nt, Homo sapiens
gagguaaccgugacuacug

SEQ ID NO: 881877 - RNA, 19 nt, Homo sapiens
caacuguucauauaucauc

SEQ ID NO: 881878 - RNA, 19 nt, Homo sapiens
ggaaagcaguagagaaaug

SEQ ID NO: 881879 - RNA, 19 nt, Homo sapiens
ugacaaaugugcucccuuu

SEQ ID NO: 881880 - RNA, 19 nt, Homo sapiens
ccaagcaacccucuauuua

SEQ ID NO: 881881 - RNA, 19 nt, Homo sapiens
uaaaguaccuacccagaug

SEQ ID NO: 881882 - RNA, 19 nt, Homo sapiens
gaacgacaccacagaagaa

SEQ ID NO: 881883 - RNA, 19 nt, Homo sapiens
agucagaugucuugagaua

SEQ ID NO: 881884 - RNA, 19 nt, Homo sapiens
gagaaauaccagaaacaua

SEQ ID NO: 881885 - RNA, 19 nt, Homo sapiens
ucagaugucuugagauaug

SEQ ID NO: 881886 - RNA, 19 nt, Homo sapiens
guagagaaauggucagaag

SEQ ID NO: 881887 - RNA, 19 nt, Homo sapiens
ccaguguaauguaucaaua

SEQ ID NO: 881888 - RNA, 19 nt, Homo sapiens
ucacaaacgucgcaaagca

SEQ ID NO: 881889 - RNA, 19 nt, Homo sapiens
gcaacccucuauuuaccua

SEQ ID NO: 881890 - RNA, 19 nt, Homo sapiens
ucaacaaggucacccauca

SEQ ID NO: 881891 - RNA, 19 nt, Homo sapiens
gaaaacugauccagaaaug

SEQ ID NO: 881892 - RNA, 19 nt, Homo sapiens
uuaguaggcucaaauguuc

SEQ ID NO: 881893 - RNA, 19 nt, Homo sapiens
ggacaaccaccaccauguu

SEQ ID NO: 881894 - RNA, 19 nt, Homo sapiens
gagaaauggucagaaggaa

SEQ ID NO: 881895 - RNA, 19 nt, Homo sapiens
ccagaaacauacccuaagu

SEQ ID NO: 881896 - RNA, 19 nt, Homo sapiens
gcucagauguuagcaaugg

SEQ ID NO: 881897 - RNA, 19 nt, Homo sapiens
ggaagcaguugguggucuu

SEQ ID NO: 881898 - RNA, 19 nt, Homo sapiens
aguagaagauguagcuaaa

SEQ ID NO: 881899 - RNA, 19 nt, Homo sapiens
cgacaccacagaagaaauu

SEQ ID NO: 881900 - RNA, 19 nt, Homo sapiens
gaaggaacgacaccacaga

SEQ ID NO: 881901 - RNA, 19 nt, Homo sapiens
gaugagaaauaccagaaac

SEQ ID NO: 881902 - RNA, 19 nt, Homo sapiens
ggaacgacaccacagaaga

SEQ ID NO: 881903 - RNA, 19 nt, Homo sapiens
ucuaacauguggacccuuu

SEQ ID NO: 881904 - RNA, 19 nt, Homo sapiens
gaacagaauauagugacaa

SEQ ID NO: 881905 - RNA, 19 nt, Homo sapiens
gcaacgaggaagcucuuaa

SEQ ID NO: 881906 - RNA, 19 nt, Homo sapiens
acagucagaugucuugaga

SEQ ID NO: 881907 - RNA, 19 nt, Homo sapiens
ccggaaagcaguagagaaa

SEQ ID NO: 881908 - RNA, 19 nt, Homo sapiens
caauguaaccagaacagaa

SEQ ID NO: 881909 - RNA, 19 nt, Homo sapiens
ccaccaguguaauguauca

SEQ ID NO: 881910 - RNA, 19 nt, Homo sapiens
agaaauaccagaaacauac

SEQ ID NO: 881911 - RNA, 19 nt, Homo sapiens
cuugagauauguugcaaug

SEQ ID NO: 881912 - RNA, 19 nt, Homo sapiens
gcuugcugcucagauguua

SEQ ID NO: 881913 - RNA, 19 nt, Homo sapiens
guaccuacccagauggaaa

SEQ ID NO: 881914 - RNA, 19 nt, Homo sapiens
ggaagcacagggauggaaa

SEQ ID NO: 881915 - RNA, 19 nt, Homo sapiens
guaaccagaacagaauaua

SEQ ID NO: 881916 - RNA, 19 nt, Homo sapiens
ccacagaagaaauuagaau

SEQ ID NO: 881917 - RNA, 19 nt, Homo sapiens
uucaggaucuggugacaaa

SEQ ID NO: 881918 - RNA, 19 nt, Homo sapiens
caagcaacccucuauuuac

SEQ ID NO: 881919 - RNA, 19 nt, Homo sapiens
ucgcaaagcagaaacugaa

SEQ ID NO: 881920 - RNA, 19 nt, Homo sapiens
cuaaggauccacaguuuca

SEQ ID NO: 881921 - RNA, 19 nt, Homo sapiens
caaccaccaccauguucua

SEQ ID NO: 881922 - RNA, 19 nt, Homo sapiens
gagguaaccgugacuacug

SEQ ID NO: 881923 - RNA, 19 nt, Homo sapiens
gaaagcaguagagaaaugg

SEQ ID NO: 881924 - RNA, 19 nt, Homo sapiens
acacagacgaggacaaugu

SEQ ID NO: 881925 - RNA, 19 nt, Homo sapiens
cccaagcaacccucuauuu

SEQ ID NO: 881926 - RNA, 19 nt, Homo sapiens
uaacauguggacccuuuau

SEQ ID NO: 881927 - RNA, 19 nt, Homo sapiens
caacgaggaagcucuuaag

SEQ ID NO: 881928 - RNA, 19 nt, Homo sapiens
cagaugagaaauaccagaa

SEQ ID NO: 881929 - RNA, 19 nt, Homo sapiens
caccagaguuugccuacgu

SEQ ID NO: 881930 - RNA, 19 nt, Homo sapiens
gugcucccuuuggaaguua

SEQ ID NO: 881931 - RNA, 19 nt, Homo sapiens
ccacccaguuuccaucagu

SEQ ID NO: 881932 - RNA, 19 nt, Homo sapiens
caguagaagauguagcuaa

SEQ ID NO: 881933 - RNA, 19 nt, Homo sapiens
gaaugcuaauccuccaagu

SEQ ID NO: 881934 - RNA, 19 nt, Homo sapiens
uaccagaaacauacccuaa

SEQ ID NO: 881935 - RNA, 19 nt, Homo sapiens
cuuaguaggcucaaauguu

SEQ ID NO: 881936 - RNA, 19 nt, Homo sapiens
gagcaaacggaagcaguug

SEQ ID NO: 881937 - RNA, 19 nt, Homo sapiens
ccagaacagaauauaguga

SEQ ID NO: 881938 - RNA, 19 nt, Homo sapiens
acauguggacccuuuauug

SEQ ID NO: 881939 - RNA, 19 nt, Homo sapiens
caccacagaagaaauuaga

SEQ ID NO: 881940 - RNA, 19 nt, Homo sapiens
ggagucugccaccagugua

SEQ ID NO: 881941 - RNA, 19 nt, Homo sapiens
agagaaauggucagaagga

SEQ ID NO: 881942 - RNA, 19 nt, Homo sapiens
cuauuuaccuaauccuaag

SEQ ID NO: 881943 - RNA, 19 nt, Homo sapiens
uaaccagaacagaauauag

SEQ ID NO: 881944 - RNA, 19 nt, Homo sapiens
gcaaacggaagcaguuggu

SEQ ID NO: 881945 - RNA, 19 nt, Homo sapiens
aaacgucgcaaagcagaaa

SEQ ID NO: 881946 - RNA, 19 nt, Homo sapiens
gcucacaaacgucgcaaag

SEQ ID NO: 881947 - RNA, 19 nt, Homo sapiens
gaggacaauguaaccagaa

SEQ ID NO: 881948 - RNA, 19 nt, Homo sapiens
aggcucaaauguucaggaa

SEQ ID NO: 881949 - RNA, 19 nt, Homo sapiens
cauguggacccuuuauugu

SEQ ID NO: 881950 - RNA, 19 nt, Homo sapiens
cacagacgaggacaaugua

SEQ ID NO: 881951 - RNA, 19 nt, Homo sapiens
gacaaccaccaccauguuc

SEQ ID NO: 881952 - RNA, 19 nt, Homo sapiens
gcaguugguggucuuucuu

SEQ ID NO: 881953 - RNA, 19 nt, Homo sapiens
gagucugccaccaguguaa

SEQ ID NO: 881954 - RNA, 19 nt, Homo sapiens
ccaguuuccaucaguuuau

SEQ ID NO: 881955 - RNA, 19 nt, Homo sapiens
cuaaaguaccuacccagau

SEQ ID NO: 881956 - RNA, 19 nt, Homo sapiens
cacagaagaaauuagaaug

SEQ ID NO: 881957 - RNA, 19 nt, Homo sapiens
gacaccacagaagaaauua

SEQ ID NO: 881958 - RNA, 19 nt, Homo sapiens
uaucuuaguaggcucaaau

SEQ ID NO: 881959 - RNA, 19 nt, Homo sapiens
gcaauggcaacaagugaac

SEQ ID NO: 881960 - RNA, 19 nt, Homo sapiens
uagcaauggcaacaaguga

SEQ ID NO: 881961 - RNA, 19 nt, Homo sapiens
ugccaccaguguaauguau

SEQ ID NO: 881962 - RNA, 19 nt, Homo sapiens
aaacugauccagaaaugac

SEQ ID NO: 881963 - RNA, 19 nt, Homo sapiens
caggaucuggugacaaaug

SEQ ID NO: 881964 - RNA, 19 nt, Homo sapiens
uguggacccuuuauugucu

SEQ ID NO: 881965 - RNA, 19 nt, Homo sapiens
ugagcaaacggaagcaguu

SEQ ID NO: 881966 - RNA, 19 nt, Homo sapiens
gcaaagcagaaacugaaaa

SEQ ID NO: 881967 - RNA, 19 nt, Homo sapiens
cuuuggaaguuacgguauu

SEQ ID NO: 881968 - RNA, 19 nt, Homo sapiens
ggacaauguaaccagaaca

SEQ ID NO: 881969 - RNA, 19 nt, Homo sapiens
ugagaaauaccagaaacau

SEQ ID NO: 881970 - RNA, 19 nt, Homo sapiens
agaacagaauauagugaca

SEQ ID NO: 881971 - RNA, 19 nt, Homo sapiens
gaagcaguugguggucuuu

SEQ ID NO: 881972 - RNA, 19 nt, Homo sapiens
acugaaaacugauccagaa

SEQ ID NO: 881973 - RNA, 19 nt, Homo sapiens
gggcaacgaggaagcucuu

SEQ ID NO: 881974 - RNA, 19 nt, Homo sapiens
aauguaaccagaacagaau

SEQ ID NO: 881975 - RNA, 19 nt, Homo sapiens
agacacagacgaggacaau

SEQ ID NO: 881976 - RNA, 19 nt, Homo sapiens
guggacccuuuauugucua

SEQ ID NO: 881977 - RNA, 19 nt, Homo sapiens
acagcugucucaccagagu

SEQ ID NO: 881978 - RNA, 19 nt, Homo sapiens
uagcagagcuguucucaaa

SEQ ID NO: 881979 - RNA, 19 nt, Homo sapiens
ugacaaaugugcucccuuu

SEQ ID NO: 881980 - RNA, 19 nt, Homo sapiens
ccaagcaacccucuauuua

SEQ ID NO: 881981 - RNA, 19 nt, Homo sapiens
uaaaguaccuacccagaug

SEQ ID NO: 881982 - RNA, 19 nt, Homo sapiens
caucaaacaucaaccaguu

SEQ ID NO: 881983 - RNA, 19 nt, Homo sapiens
gaacgacaccacagaagaa

SEQ ID NO: 881984 - RNA, 19 nt, Homo sapiens
agucagaugucuugagaua

SEQ ID NO: 881985 - RNA, 19 nt, Homo sapiens
gagaaauaccagaaacaua

SEQ ID NO: 881986 - RNA, 19 nt, Homo sapiens
ucagaugucuugagauaug

SEQ ID NO: 881987 - RNA, 19 nt, Homo sapiens
ggaauacuacuauggauau

SEQ ID NO: 881988 - RNA, 19 nt, Homo sapiens
guagagaaauggucagaag

SEQ ID NO: 881989 - RNA, 19 nt, Homo sapiens
ccaguguaauguaucaaua

SEQ ID NO: 881990 - RNA, 19 nt, Homo sapiens
uuacagacauccugccaaa

SEQ ID NO: 881991 - RNA, 19 nt, Homo sapiens
ucacaaacgucgcaaagca

SEQ ID NO: 881992 - RNA, 19 nt, Homo sapiens
gcaacccucuauuuaccua

SEQ ID NO: 881993 - RNA, 19 nt, Homo sapiens
ggaauuagcagagcuguuc

SEQ ID NO: 881994 - RNA, 19 nt, Homo sapiens
ucaacaaggucacccauca

SEQ ID NO: 881995 - RNA, 19 nt, Homo sapiens
gaaaacugauccagaaaug

SEQ ID NO: 881996 - RNA, 19 nt, Homo sapiens
uuaguaggcucaaauguuc

SEQ ID NO: 881997 - RNA, 19 nt, Homo sapiens
ggacaaccaccaccauguu

SEQ ID NO: 881998 - RNA, 19 nt, Homo sapiens
gagaaauggucagaaggaa

SEQ ID NO: 881999 - RNA, 19 nt, Homo sapiens
ccagaaacauacccuaagu

SEQ ID NO: 882000 - RNA, 19 nt, Homo sapiens
gcucagauguuagcaaugg

SEQ ID NO: 882001 - RNA, 19 nt, Homo sapiens
ggaagcaguugguggucuu

SEQ ID NO: 882002 - RNA, 19 nt, Homo sapiens
aguagaagauguagcuaaa

SEQ ID NO: 882003 - RNA, 19 nt, Homo sapiens
cgacaccacagaagaaauu

SEQ ID NO: 882004 - RNA, 19 nt, Homo sapiens
gaaggaacgacaccacaga

SEQ ID NO: 882005 - RNA, 19 nt, Homo sapiens
gggaauacuacuauggaua

SEQ ID NO: 882006 - RNA, 19 nt, Homo sapiens
gaugagaaauaccagaaac

SEQ ID NO: 882007 - RNA, 19 nt, Homo sapiens
ggaacgacaccacagaaga

SEQ ID NO: 882008 - RNA, 19 nt, Homo sapiens
ucuaacauguggacccuuu

SEQ ID NO: 882009 - RNA, 19 nt, Homo sapiens
gaacagaauauagugacaa

SEQ ID NO: 882010 - RNA, 19 nt, Homo sapiens
acagucagaugucuugaga

SEQ ID NO: 882011 - RNA, 19 nt, Homo sapiens
gaaaguugaguuacagaca

SEQ ID NO: 882012 - RNA, 19 nt, Homo sapiens
caauguaaccagaacagaa

SEQ ID NO: 882013 - RNA, 19 nt, Homo sapiens
ccaccaguguaauguauca

SEQ ID NO: 882014 - RNA, 19 nt, Homo sapiens
agaaauaccagaaacauac

SEQ ID NO: 882015 - RNA, 19 nt, Homo sapiens
cuugagauauguugcaaug

SEQ ID NO: 882016 - RNA, 19 nt, Homo sapiens
gcuugcugcucagauguua

SEQ ID NO: 882017 - RNA, 19 nt, Homo sapiens
guaccuacccagauggaaa

SEQ ID NO: 882018 - RNA, 19 nt, Homo sapiens
ggaagcacagggauggaaa

SEQ ID NO: 882019 - RNA, 19 nt, Homo sapiens
guaaccagaacagaauaua

SEQ ID NO: 882020 - RNA, 19 nt, Homo sapiens
uucaggaucuggugacaaa

SEQ ID NO: 882021 - RNA, 19 nt, Homo sapiens
gcuggcauccugaaaguug

SEQ ID NO: 882022 - RNA, 19 nt, Homo sapiens
ccacagaagaaauuagaau

SEQ ID NO: 882023 - RNA, 19 nt, Homo sapiens
gagggaauacuacuaugga

SEQ ID NO: 882024 - RNA, 19 nt, Homo sapiens
caagcaacccucuauuuac

SEQ ID NO: 882025 - RNA, 19 nt, Homo sapiens
cauccugaaaguugaguua

SEQ ID NO: 882026 - RNA, 19 nt, Homo sapiens
ucgcaaagcagaaacugaa

SEQ ID NO: 882027 - RNA, 19 nt, Homo sapiens
cuaaggauccacaguuuca

SEQ ID NO: 882028 - RNA, 19 nt, Homo sapiens
caaccaccaccauguucua

SEQ ID NO: 882029 - RNA, 19 nt, Homo sapiens
gagguaaccgugacuacug

SEQ ID NO: 882030 - RNA, 19 nt, Homo sapiens
cccaagcaacccucuauuu

SEQ ID NO: 882031 - RNA, 19 nt, Homo sapiens
uaacauguggacccuuuau

SEQ ID NO: 882032 - RNA, 19 nt, Homo sapiens
acacagacgaggacaaugu

SEQ ID NO: 882033 - RNA, 19 nt, Homo sapiens
aaaguugaguuacagacau

SEQ ID NO: 882034 - RNA, 19 nt, Homo sapiens
cagaugagaaauaccagaa

SEQ ID NO: 882035 - RNA, 19 nt, Homo sapiens
caccagaguuugccuacgu

SEQ ID NO: 882036 - RNA, 19 nt, Homo sapiens
ccuauggccucaagacucu

SEQ ID NO: 882037 - RNA, 19 nt, Homo sapiens
gugcucccuuuggaaguua

SEQ ID NO: 882038 - RNA, 19 nt, Homo sapiens
ccacccaguuuccaucagu

SEQ ID NO: 882039 - RNA, 19 nt, Homo sapiens
caguagaagauguagcuaa

SEQ ID NO: 882040 - RNA, 19 nt, Homo sapiens
gaaugcuaauccuccaagu

SEQ ID NO: 882041 - RNA, 19 nt, Homo sapiens
uaccagaaacauacccuaa

SEQ ID NO: 882042 - RNA, 19 nt, Homo sapiens
cuuaguaggcucaaauguu

SEQ ID NO: 882043 - RNA, 19 nt, Homo sapiens
gagcaaacggaagcaguug

SEQ ID NO: 882044 - RNA, 19 nt, Homo sapiens
ccagaacagaauauaguga

SEQ ID NO: 882045 - RNA, 19 nt, Homo sapiens
acauguggacccuuuauug

SEQ ID NO: 882046 - RNA, 19 nt, Homo sapiens
caccacagaagaaauuaga

SEQ ID NO: 882047 - RNA, 19 nt, Homo sapiens
ggagucugccaccagugua

SEQ ID NO: 882048 - RNA, 19 nt, Homo sapiens
gcagagcuguucucaaaac

SEQ ID NO: 882049 - RNA, 19 nt, Homo sapiens
cuauuuaccuaauccuaag

SEQ ID NO: 882050 - RNA, 19 nt, Homo sapiens
gcaaacggaagcaguuggu

SEQ ID NO: 882051 - RNA, 19 nt, Homo sapiens
uaaccagaacagaauauag

SEQ ID NO: 882052 - RNA, 19 nt, Homo sapiens
agagaaauggucagaagga

SEQ ID NO: 882053 - RNA, 19 nt, Homo sapiens
aaacgucgcaaagcagaaa

SEQ ID NO: 882054 - RNA, 19 nt, Homo sapiens
gcucacaaacgucgcaaag

SEQ ID NO: 882055 - RNA, 19 nt, Homo sapiens
aggcucaaauguucaggaa

SEQ ID NO: 882056 - RNA, 19 nt, Homo sapiens
cauguggacccuuuauugu

SEQ ID NO: 882057 - RNA, 19 nt, Homo sapiens
gaggacaauguaaccagaa

SEQ ID NO: 882058 - RNA, 19 nt, Homo sapiens
uauagagggaauacuacua

SEQ ID NO: 882059 - RNA, 19 nt, Homo sapiens
ccgcuggcauccugaaagu

SEQ ID NO: 882060 - RNA, 19 nt, Homo sapiens
agacucugcucgagggaau

SEQ ID NO: 882061 - RNA, 19 nt, Homo sapiens
aaaccaacccaucaaacau

SEQ ID NO: 882062 - RNA, 19 nt, Homo sapiens
gacaaccaccaccauguuc

SEQ ID NO: 882063 - RNA, 19 nt, Homo sapiens
gcaguugguggucuuucuu

SEQ ID NO: 882064 - RNA, 19 nt, Homo sapiens
cacagacgaggacaaugua

SEQ ID NO: 882065 - RNA, 19 nt, Homo sapiens
uagagggaauacuacuaug

SEQ ID NO: 882066 - RNA, 19 nt, Homo sapiens
gagucugccaccaguguaa

SEQ ID NO: 882067 - RNA, 19 nt, Homo sapiens
ccaguuuccaucaguuuau

SEQ ID NO: 882068 - RNA, 19 nt, Homo sapiens
gagcuguucucaaaaccaa

SEQ ID NO: 882069 - RNA, 19 nt, Homo sapiens
uaucuuaguaggcucaaau

SEQ ID NO: 882070 - RNA, 19 nt, Homo sapiens
gcaauggcaacaagugaac

SEQ ID NO: 882071 - RNA, 19 nt, Homo sapiens
uagcaauggcaacaaguga

SEQ ID NO: 882072 - RNA, 19 nt, Homo sapiens
cuaaaguaccuacccagau

SEQ ID NO: 882073 - RNA, 19 nt, Homo sapiens
cacagaagaaauuagaaug

SEQ ID NO: 882074 - RNA, 19 nt, Homo sapiens
gacaccacagaagaaauua

SEQ ID NO: 882075 - RNA, 19 nt, Homo sapiens
ugccaccaguguaauguau

SEQ ID NO: 882076 - RNA, 19 nt, Homo sapiens
aaacugauccagaaaugac

SEQ ID NO: 882077 - RNA, 19 nt, Homo sapiens
gauuaaaguagagaaaugg

SEQ ID NO: 882078 - RNA, 19 nt, Homo sapiens
caacagcucugcucucuga

SEQ ID NO: 882079 - RNA, 19 nt, Homo sapiens
uagcagagcuguucucaaa

SEQ ID NO: 882080 - RNA, 19 nt, Homo sapiens
ggaaucaacagcugaauaa

SEQ ID NO: 882081 - RNA, 19 nt, Homo sapiens
ggagaucacuucaauaguc

SEQ ID NO: 882082 - RNA, 19 nt, Homo sapiens
ugacaaaugugcucccuuu

SEQ ID NO: 882083 - RNA, 19 nt, Homo sapiens
ccaagcaacccucuauuua

SEQ ID NO: 882084 - RNA, 19 nt, Homo sapiens
ggaaagcaguugaguuaca

SEQ ID NO: 882085 - RNA, 19 nt, Homo sapiens
ucaauagucucugacaaua

SEQ ID NO: 882086 - RNA, 19 nt, Homo sapiens
uaaaguaccuacccagaug

SEQ ID NO: 882087 - RNA, 19 nt, Homo sapiens
gcaacugccagaacaaaua

SEQ ID NO: 882088 - RNA, 19 nt, Homo sapiens
caucaaacaucaaccaguu

SEQ ID NO: 882089 - RNA, 19 nt, Homo sapiens
gauguuagguaaaguuuca

SEQ ID NO: 882090 - RNA, 19 nt, Homo sapiens
gaacgacaccacagaagaa

SEQ ID NO: 882091 - RNA, 19 nt, Homo sapiens
gguaaaguuucaucuauuc

SEQ ID NO: 882092 - RNA, 19 nt, Homo sapiens
agucagaugucuugagaua

SEQ ID NO: 882093 - RNA, 19 nt, Homo sapiens
gagguuaugucaacuguuc

SEQ ID NO: 882094 - RNA, 19 nt, Homo sapiens
gagaaauaccagaaacaua

SEQ ID NO: 882095 - RNA, 19 nt, Homo sapiens
ucagaugucuugagauaug

SEQ ID NO: 882096 - RNA, 19 nt, Homo sapiens
ccggaaagcaguugaguua

SEQ ID NO: 882097 - RNA, 19 nt, Homo sapiens
ucccaaaucuguaguagaa

SEQ ID NO: 882098 - RNA, 19 nt, Homo sapiens
acaagaaccuccugcuuau

SEQ ID NO: 882099 - RNA, 19 nt, Homo sapiens
guagagaaauggucagaag

SEQ ID NO: 882100 - RNA, 19 nt, Homo sapiens
ccaguguaauguaucaaua

SEQ ID NO: 882101 - RNA, 19 nt, Homo sapiens
gaacaagaaccuccugcuu

SEQ ID NO: 882102 - RNA, 19 nt, Homo sapiens
uuacagacauccugccaaa

SEQ ID NO: 882103 - RNA, 19 nt, Homo sapiens
ugaaggaguuguuuauauc

SEQ ID NO: 882104 - RNA, 19 nt, Homo sapiens
ucacaaacgucgcaaagca

SEQ ID NO: 882105 - RNA, 19 nt, Homo sapiens
gcaacccucuauuuaccua

SEQ ID NO: 882106 - RNA, 19 nt, Homo sapiens
gagcagucaccacgaguua

SEQ ID NO: 882107 - RNA, 19 nt, Homo sapiens
ggaauuagcagagcuguuc

SEQ ID NO: 882108 - RNA, 19 nt, Homo sapiens
ucaacaaggucacccauca

SEQ ID NO: 882109 - RNA, 19 nt, Homo sapiens
guucauauaucaucugucu

SEQ ID NO: 882110 - RNA, 19 nt, Homo sapiens
gaaaacugauccagaaaug

SEQ ID NO: 882111 - RNA, 19 nt, Homo sapiens
uuaguaggcucaaauguuc

SEQ ID NO: 882112 - RNA, 19 nt, Homo sapiens
ggacaaccaccaccauguu

SEQ ID NO: 882113 - RNA, 19 nt, Homo sapiens
gcucagauguuagguaaag

SEQ ID NO: 882114 - RNA, 19 nt, Homo sapiens
gagaaauggucagaaggaa

SEQ ID NO: 882115 - RNA, 19 nt, Homo sapiens
ccagaaacauacccuaagu

SEQ ID NO: 882116 - RNA, 19 nt, Homo sapiens
aaaugaggcugaaccauca

SEQ ID NO: 882117 - RNA, 19 nt, Homo sapiens
aacaagaaccuccugcuua

SEQ ID NO: 882118 - RNA, 19 nt, Homo sapiens
ggaagcaguugguggucuu

SEQ ID NO: 882119 - RNA, 19 nt, Homo sapiens
aguagaagauguagcuaaa

SEQ ID NO: 882120 - RNA, 19 nt, Homo sapiens
ugaauaagguuugaugaag

SEQ ID NO: 882121 - RNA, 19 nt, Homo sapiens
ucacuucaauagucucuga

SEQ ID NO: 882122 - RNA, 19 nt, Homo sapiens
cugaaggaguuguuuauau

SEQ ID NO: 882123 - RNA, 19 nt, Homo sapiens
gggaaucaacagcugaaua

SEQ ID NO: 882124 - RNA, 19 nt, Homo sapiens
cgacaccacagaagaaauu

SEQ ID NO: 882125 - RNA, 19 nt, Homo sapiens
gaaagcaguugaguuacag

SEQ ID NO: 882126 - RNA, 19 nt, Homo sapiens
gaaggaacgacaccacaga

SEQ ID NO: 882127 - RNA, 19 nt, Homo sapiens
gaugagaaauaccagaaac

SEQ ID NO: 882128 - RNA, 19 nt, Homo sapiens
ugcagaaggugcuaucaaa

SEQ ID NO: 882129 - RNA, 19 nt, Homo sapiens
uaucaucugucuauaacga

SEQ ID NO: 882130 - RNA, 19 nt, Homo sapiens
ggaacgacaccacagaaga

SEQ ID NO: 882131 - RNA, 19 nt, Homo sapiens
gcaguugaguuacagacau

SEQ ID NO: 882132 - RNA, 19 nt, Homo sapiens
ucuaacauguggacccuuu

SEQ ID NO: 882133 - RNA, 19 nt, Homo sapiens
gcaacgaggaagcucuuaa

SEQ ID NO: 882134 - RNA, 19 nt, Homo sapiens
gaacagaauauagugacaa

SEQ ID NO: 882135 - RNA, 19 nt, Homo sapiens
acagucagaugucuugaga

SEQ ID NO: 882136 - RNA, 19 nt, Homo sapiens
ggaggagaaugcaaaauau

SEQ ID NO: 882137 - RNA, 19 nt, Homo sapiens
gaaccaaacaucuguccau

SEQ ID NO: 882138 - RNA, 19 nt, Homo sapiens
caacagcugaauaagguuu

SEQ ID NO: 882139 - RNA, 19 nt, Homo sapiens
cugcucagauguuagguaa

SEQ ID NO: 882140 - RNA, 19 nt, Homo sapiens
gcagugcacucagguacau

SEQ ID NO: 882141 - RNA, 19 nt, Homo sapiens
gagaucacuucaauagucu

SEQ ID NO: 882142 - RNA, 19 nt, Homo sapiens
ugagguaccugcacaacuc

SEQ ID NO: 882143 - RNA, 19 nt, Homo sapiens
ugacugaaggaguuguuua

SEQ ID NO: 882144 - RNA, 19 nt, Homo sapiens
caauguaaccagaacagaa

SEQ ID NO: 882145 - RNA, 19 nt, Homo sapiens
ccaccaguguaauguauca

SEQ ID NO: 882146 - RNA, 19 nt, Homo sapiens
agaaauaccagaaacauac

SEQ ID NO: 882147 - RNA, 19 nt, Homo sapiens
cuugagauauguugcaaug

SEQ ID NO: 882148 - RNA, 19 nt, Homo sapiens
agaaggugcuaucaaaaua

SEQ ID NO: 882149 - RNA, 19 nt, Homo sapiens
gagcaacugccagaacaaa

SEQ ID NO: 882150 - RNA, 19 nt, Homo sapiens
gcuugcugcucagauguua

SEQ ID NO: 882151 - RNA, 19 nt, Homo sapiens
guaccuacccagauggaaa

SEQ ID NO: 882152 - RNA, 19 nt, Homo sapiens
ggaagcacagggauggaaa

SEQ ID NO: 882153 - RNA, 19 nt, Homo sapiens
gaccaccucuggcaugucu

SEQ ID NO: 882154 - RNA, 19 nt, Homo sapiens
caguaugccuguuguuauc

SEQ ID NO: 882155 - RNA, 19 nt, Homo sapiens
guaaccagaacagaauaua

SEQ ID NO: 882156 - RNA, 19 nt, Homo sapiens
uucaggaucuggugacaaa

SEQ ID NO: 882157 - RNA, 19 nt, Homo sapiens
guggagaucacuucaauag

SEQ ID NO: 882158 - RNA, 19 nt, Homo sapiens
ccacagaagaaauuagaau

SEQ ID NO: 882159 - RNA, 19 nt, Homo sapiens
caagcaacccucuauuuac

SEQ ID NO: 882160 - RNA, 19 nt, Homo sapiens
gaagcagugcacucaggua

SEQ ID NO: 882161 - RNA, 19 nt, Homo sapiens
gcaaaauauuccucaguau

SEQ ID NO: 882162 - RNA, 19 nt, Homo sapiens
ccaaaucuguaguagaaaa

SEQ ID NO: 882163 - RNA, 19 nt, Homo sapiens
ugucaacuguucauauauc

SEQ ID NO: 882164 - RNA, 19 nt, Homo sapiens
gcaggcugauauugagguu

SEQ ID NO: 882165 - RNA, 19 nt, Homo sapiens
aagaaccuccugcuuauga

SEQ ID NO: 882166 - RNA, 19 nt, Homo sapiens
ucuguaaagucaucuagug

SEQ ID NO: 882167 - RNA, 19 nt, Homo sapiens
aaaaugagcagucaaaaga

SEQ ID NO: 882168 - RNA, 19 nt, Homo sapiens
ccucuuguguguucuggaa

SEQ ID NO: 882169 - RNA, 19 nt, Homo sapiens
ucgcaaagcagaaacugaa

SEQ ID NO: 882170 - RNA, 19 nt, Homo sapiens
cuaaggauccacaguuuca

SEQ ID NO: 882171 - RNA, 19 nt, Homo sapiens
caaccaccaccauguucua

SEQ ID NO: 882172 - RNA, 19 nt, Homo sapiens
caugguggcugcuccucuu

SEQ ID NO: 882173 - RNA, 19 nt, Homo sapiens
gagguaaccgugacuacug

SEQ ID NO: 882174 - RNA, 19 nt, Homo sapiens
caacuguucauauaucauc

SEQ ID NO: 882175 - RNA, 19 nt, Homo sapiens
aggcugauauugagguuau

SEQ ID NO: 882176 - RNA, 19 nt, Homo sapiens
ucaaucugauguguuaaug

SEQ ID NO: 882177 - RNA, 19 nt, Homo sapiens
cccaagcaacccucuauuu

SEQ ID NO: 882178 - RNA, 19 nt, Homo sapiens
uagcagagcuguucucaaa

SEQ ID NO: 882179 - RNA, 19 nt, Homo sapiens
ugacaaaugugcucccuuu

SEQ ID NO: 882180 - RNA, 19 nt, Homo sapiens
ccaagcaacccucuauuua

SEQ ID NO: 882181 - RNA, 19 nt, Homo sapiens
ggaaagcaguugaguuaca

SEQ ID NO: 882182 - RNA, 19 nt, Homo sapiens
uaaaguaccuacccagaug

SEQ ID NO: 882183 - RNA, 19 nt, Homo sapiens
caucaaacaucaaccaguu

SEQ ID NO: 882184 - RNA, 19 nt, Homo sapiens
gaacgacaccacagaagaa

SEQ ID NO: 882185 - RNA, 19 nt, Homo sapiens
agucagaugucuugagaua

SEQ ID NO: 882186 - RNA, 19 nt, Homo sapiens
gagaaauaccagaaacaua

SEQ ID NO: 882187 - RNA, 19 nt, Homo sapiens
ucagaugucuugagauaug

SEQ ID NO: 882188 - RNA, 19 nt, Homo sapiens
ccggaaagcaguugaguua

SEQ ID NO: 882189 - RNA, 19 nt, Homo sapiens
ggaauacuacuauggauau

SEQ ID NO: 882190 - RNA, 19 nt, Homo sapiens
guagagaaauggucagaag

SEQ ID NO: 882191 - RNA, 19 nt, Homo sapiens
ccaguguaauguaucaaua

SEQ ID NO: 882192 - RNA, 19 nt, Homo sapiens
uuacagacauccugccaaa

SEQ ID NO: 882193 - RNA, 19 nt, Homo sapiens
ucacaaacgucgcaaagca

SEQ ID NO: 882194 - RNA, 19 nt, Homo sapiens
gcaacccucuauuuaccua

SEQ ID NO: 882195 - RNA, 19 nt, Homo sapiens
ggaauuagcagagcuguuc

SEQ ID NO: 882196 - RNA, 19 nt, Homo sapiens
ucaacaaggucacccauca

SEQ ID NO: 882197 - RNA, 19 nt, Homo sapiens
gaaaacugauccagaaaug

SEQ ID NO: 882198 - RNA, 19 nt, Homo sapiens
uuaguaggcucaaauguuc

SEQ ID NO: 882199 - RNA, 19 nt, Homo sapiens
ggacaaccaccaccauguu

SEQ ID NO: 882200 - RNA, 19 nt, Homo sapiens
gagaaauggucagaaggaa

SEQ ID NO: 882201 - RNA, 19 nt, Homo sapiens
ccagaaacauacccuaagu

SEQ ID NO: 882202 - RNA, 19 nt, Homo sapiens
gcucagauguuagcaaugg

SEQ ID NO: 882203 - RNA, 19 nt, Homo sapiens
ggaagcaguugguggucuu

SEQ ID NO: 882204 - RNA, 19 nt, Homo sapiens
aguagaagauguagcuaaa

SEQ ID NO: 882205 - RNA, 19 nt, Homo sapiens
cgacaccacagaagaaauu

SEQ ID NO: 882206 - RNA, 19 nt, Homo sapiens
gaaggaacgacaccacaga

SEQ ID NO: 882207 - RNA, 19 nt, Homo sapiens
gaaagcaguugaguuacag

SEQ ID NO: 882208 - RNA, 19 nt, Homo sapiens
gggaauacuacuauggaua

SEQ ID NO: 882209 - RNA, 19 nt, Homo sapiens
gaugagaaauaccagaaac

SEQ ID NO: 882210 - RNA, 19 nt, Homo sapiens
ggaacgacaccacagaaga

SEQ ID NO: 882211 - RNA, 19 nt, Homo sapiens
gcaacgaggaagcucuuaa

SEQ ID NO: 882212 - RNA, 19 nt, Homo sapiens
ucuaacauguggacccuuu

SEQ ID NO: 882213 - RNA, 19 nt, Homo sapiens
gaacagaauauagugacaa

SEQ ID NO: 882214 - RNA, 19 nt, Homo sapiens
gcaguugaguuacagacau

SEQ ID NO: 882215 - RNA, 19 nt, Homo sapiens
acagucagaugucuugaga

SEQ ID NO: 882216 - RNA, 19 nt, Homo sapiens
caauguaaccagaacagaa

SEQ ID NO: 882217 - RNA, 19 nt, Homo sapiens
ccaccaguguaauguauca

SEQ ID NO: 882218 - RNA, 19 nt, Homo sapiens
agaaauaccagaaacauac

SEQ ID NO: 882219 - RNA, 19 nt, Homo sapiens
cuugagauauguugcaaug

SEQ ID NO: 882220 - RNA, 19 nt, Homo sapiens
gcuugcugcucagauguua

SEQ ID NO: 882221 - RNA, 19 nt, Homo sapiens
guaccuacccagauggaaa

SEQ ID NO: 882222 - RNA, 19 nt, Homo sapiens
ggaagcacagggauggaaa

SEQ ID NO: 882223 - RNA, 19 nt, Homo sapiens
guaaccagaacagaauaua

SEQ ID NO: 882224 - RNA, 19 nt, Homo sapiens
uucaggaucuggugacaaa

SEQ ID NO: 882225 - RNA, 19 nt, Homo sapiens
ccacagaagaaauuagaau

SEQ ID NO: 882226 - RNA, 19 nt, Homo sapiens
gagggaauacuacuaugga

SEQ ID NO: 882227 - RNA, 19 nt, Homo sapiens
caagcaacccucuauuuac

SEQ ID NO: 882228 - RNA, 19 nt, Homo sapiens
ucgcaaagcagaaacugaa

SEQ ID NO: 882229 - RNA, 19 nt, Homo sapiens
cuaaggauccacaguuuca

SEQ ID NO: 882230 - RNA, 19 nt, Homo sapiens
caaccaccaccauguucua

SEQ ID NO: 882231 - RNA, 19 nt, Homo sapiens
gagguaaccgugacuacug

SEQ ID NO: 882232 - RNA, 19 nt, Homo sapiens
cccaagcaacccucuauuu

SEQ ID NO: 882233 - RNA, 19 nt, Homo sapiens
uaacauguggacccuuuau

SEQ ID NO: 882234 - RNA, 19 nt, Homo sapiens
acacagacgaggacaaugu

SEQ ID NO: 882235 - RNA, 19 nt, Homo sapiens
cagaugagaaauaccagaa

SEQ ID NO: 882236 - RNA, 19 nt, Homo sapiens
caccagaguuugccuacgu

SEQ ID NO: 882237 - RNA, 19 nt, Homo sapiens
ccuauggccucaagacucu

SEQ ID NO: 882238 - RNA, 19 nt, Homo sapiens
caacgaggaagcucuuaag

SEQ ID NO: 882239 - RNA, 19 nt, Homo sapiens
gugcucccuuuggaaguua

SEQ ID NO: 882240 - RNA, 19 nt, Homo sapiens
ccacccaguuuccaucagu

SEQ ID NO: 882241 - RNA, 19 nt, Homo sapiens
caguagaagauguagcuaa

SEQ ID NO: 882242 - RNA, 19 nt, Homo sapiens
gaaugcuaauccuccaagu

SEQ ID NO: 882243 - RNA, 19 nt, Homo sapiens
uaccagaaacauacccuaa

SEQ ID NO: 882244 - RNA, 19 nt, Homo sapiens
cuuaguaggcucaaauguu

SEQ ID NO: 882245 - RNA, 19 nt, Homo sapiens
gagcaaacggaagcaguug

SEQ ID NO: 882246 - RNA, 19 nt, Homo sapiens
ccagaacagaauauaguga

SEQ ID NO: 882247 - RNA, 19 nt, Homo sapiens
acauguggacccuuuauug

SEQ ID NO: 882248 - RNA, 19 nt, Homo sapiens
caccacagaagaaauuaga

SEQ ID NO: 882249 - RNA, 19 nt, Homo sapiens
ggagucugccaccagugua

SEQ ID NO: 882250 - RNA, 19 nt, Homo sapiens
cuauuuaccuaauccuaag

SEQ ID NO: 882251 - RNA, 19 nt, Homo sapiens
gcagagcuguucucaaaac

SEQ ID NO: 882252 - RNA, 19 nt, Homo sapiens
gcaaacggaagcaguuggu

SEQ ID NO: 882253 - RNA, 19 nt, Homo sapiens
uaaccagaacagaauauag

SEQ ID NO: 882254 - RNA, 19 nt, Homo sapiens
agagaaauggucagaagga

SEQ ID NO: 882255 - RNA, 19 nt, Homo sapiens
aaacgucgcaaagcagaaa

SEQ ID NO: 882256 - RNA, 19 nt, Homo sapiens
gcucacaaacgucgcaaag

SEQ ID NO: 882257 - RNA, 19 nt, Homo sapiens
aggcucaaauguucaggaa

SEQ ID NO: 882258 - RNA, 19 nt, Homo sapiens
cauguggacccuuuauugu

SEQ ID NO: 882259 - RNA, 19 nt, Homo sapiens
gaggacaauguaaccagaa

SEQ ID NO: 882260 - RNA, 19 nt, Homo sapiens
uauagagggaauacuacua

SEQ ID NO: 882261 - RNA, 19 nt, Homo sapiens
agacucugcucgagggaau

SEQ ID NO: 882262 - RNA, 19 nt, Homo sapiens
uagagggaauacuacuaug

SEQ ID NO: 882263 - RNA, 19 nt, Homo sapiens
aaaccaacccaucaaacau

SEQ ID NO: 882264 - RNA, 19 nt, Homo sapiens
gacaaccaccaccauguuc

SEQ ID NO: 882265 - RNA, 19 nt, Homo sapiens
gcaguugguggucuuucuu

SEQ ID NO: 882266 - RNA, 19 nt, Homo sapiens
cacagacgaggacaaugua

SEQ ID NO: 882267 - RNA, 19 nt, Homo sapiens
gagucugccaccaguguaa

SEQ ID NO: 882268 - RNA, 19 nt, Homo sapiens
gagcuguucucaaaaccaa

SEQ ID NO: 882269 - RNA, 19 nt, Homo sapiens
ccaguuuccaucaguuuau

SEQ ID NO: 882270 - RNA, 19 nt, Homo sapiens
uaucuuaguaggcucaaau

SEQ ID NO: 882271 - RNA, 19 nt, Homo sapiens
gcaauggcaacaagugaac

SEQ ID NO: 882272 - RNA, 19 nt, Homo sapiens
uagcaauggcaacaaguga

SEQ ID NO: 882273 - RNA, 19 nt, Homo sapiens
cuaaaguaccuacccagau

SEQ ID NO: 882274 - RNA, 19 nt, Homo sapiens
cacagaagaaauuagaaug

SEQ ID NO: 882275 - RNA, 19 nt, Homo sapiens
gacaccacagaagaaauua

SEQ ID NO: 882276 - RNA, 19 nt, Homo sapiens
ugccaccaguguaauguau

SEQ ID NO: 882277 - RNA, 19 nt, Homo sapiens
aaacugauccagaaaugac

SEQ ID NO: 882278 - RNA, 19 nt, Homo sapiens
uagcagagcuguucucaaa

SEQ ID NO: 882279 - RNA, 19 nt, Homo sapiens
ugacaaaugugcucccuuu

SEQ ID NO: 882280 - RNA, 19 nt, Homo sapiens
ggaaagcaguugaguuaca

SEQ ID NO: 882281 - RNA, 19 nt, Homo sapiens
uaaaguaccuacccagaug

SEQ ID NO: 882282 - RNA, 19 nt, Homo sapiens
caucaaacaucaaccaguu

SEQ ID NO: 882283 - RNA, 19 nt, Homo sapiens
gaacgacaccacagaagaa

SEQ ID NO: 882284 - RNA, 19 nt, Homo sapiens
ggaauacuacuauggauau

SEQ ID NO: 882285 - RNA, 19 nt, Homo sapiens
ccggaaagcaguugaguua

SEQ ID NO: 882286 - RNA, 19 nt, Homo sapiens
guagagaaauggucagaag

SEQ ID NO: 882287 - RNA, 19 nt, Homo sapiens
ccaguguaauguaucaaua

SEQ ID NO: 882288 - RNA, 19 nt, Homo sapiens
gcucagauguuagaagaug

SEQ ID NO: 882289 - RNA, 19 nt, Homo sapiens
uuacagacauccugccaaa

SEQ ID NO: 882290 - RNA, 19 nt, Homo sapiens
ucacaaacgucgcaaagca

SEQ ID NO: 882291 - RNA, 19 nt, Homo sapiens
ggaauuagcagagcuguuc

SEQ ID NO: 882292 - RNA, 19 nt, Homo sapiens
gaaaacugauccagaaaug

SEQ ID NO: 882293 - RNA, 19 nt, Homo sapiens
gagaaauggucagaaggaa

SEQ ID NO: 882294 - RNA, 19 nt, Homo sapiens
ggaagcaguugguggucuu

SEQ ID NO: 882295 - RNA, 19 nt, Homo sapiens
cgacaccacagaagaaauu

SEQ ID NO: 882296 - RNA, 19 nt, Homo sapiens
gaaagcaguugaguuacag

SEQ ID NO: 882297 - RNA, 19 nt, Homo sapiens
gaaggaacgacaccacaga

SEQ ID NO: 882298 - RNA, 19 nt, Homo sapiens
gggaauacuacuauggaua

SEQ ID NO: 882299 - RNA, 19 nt, Homo sapiens
ggaacgacaccacagaaga

SEQ ID NO: 882300 - RNA, 19 nt, Homo sapiens
gcaguugaguuacagacau

SEQ ID NO: 882301 - RNA, 19 nt, Homo sapiens
gaacagaauauagugacaa

SEQ ID NO: 882302 - RNA, 19 nt, Homo sapiens
gcaacgaggaagcucuuaa

SEQ ID NO: 882303 - RNA, 19 nt, Homo sapiens
caauguaaccagaacagaa

SEQ ID NO: 882304 - RNA, 19 nt, Homo sapiens
ccaccaguguaauguauca

SEQ ID NO: 882305 - RNA, 19 nt, Homo sapiens
gcuugcugcucagauguua

SEQ ID NO: 882306 - RNA, 19 nt, Homo sapiens
guaccuacccagauggaaa

SEQ ID NO: 882307 - RNA, 19 nt, Homo sapiens
guaaccagaacagaauaua

SEQ ID NO: 882308 - RNA, 19 nt, Homo sapiens
uucaggaucuggugacaaa

SEQ ID NO: 882309 - RNA, 19 nt, Homo sapiens
ccacagaagaaauuagaau

SEQ ID NO: 882310 - RNA, 19 nt, Homo sapiens
gagggaauacuacuaugga

SEQ ID NO: 882311 - RNA, 19 nt, Homo sapiens
cugcucagauguuagaaga

SEQ ID NO: 882312 - RNA, 19 nt, Homo sapiens
ucgcaaagcagaaacugaa

SEQ ID NO: 882313 - RNA, 19 nt, Homo sapiens
gagguaaccgugacuacug

SEQ ID NO: 882314 - RNA, 19 nt, Homo sapiens
acacagacgaggacaaugu

SEQ ID NO: 882315 - RNA, 19 nt, Homo sapiens
caccagaguuugccuacgu

SEQ ID NO: 882316 - RNA, 19 nt, Homo sapiens
caacgaggaagcucuuaag

SEQ ID NO: 882317 - RNA, 19 nt, Homo sapiens
ccuauggccucaagacucu

SEQ ID NO: 882318 - RNA, 19 nt, Homo sapiens
gugcucccuuuggaaguua

SEQ ID NO: 882319 - RNA, 19 nt, Homo sapiens
ccacccaguuuccaucagu

SEQ ID NO: 882320 - RNA, 19 nt, Homo sapiens
gagcaaacggaagcaguug

SEQ ID NO: 882321 - RNA, 19 nt, Homo sapiens
ccagaacagaauauaguga

SEQ ID NO: 882322 - RNA, 19 nt, Homo sapiens
gauguuagaagauguagcu

SEQ ID NO: 882323 - RNA, 19 nt, Homo sapiens
ucagauguuagaagaugua

SEQ ID NO: 882324 - RNA, 19 nt, Homo sapiens
caccacagaagaaauuaga

SEQ ID NO: 882325 - RNA, 19 nt, Homo sapiens
ggagucugccaccagugua

SEQ ID NO: 882326 - RNA, 19 nt, Homo sapiens
gcaaacggaagcaguuggu

SEQ ID NO: 882327 - RNA, 19 nt, Homo sapiens
uaaccagaacagaauauag

SEQ ID NO: 882328 - RNA, 19 nt, Homo sapiens
agagaaauggucagaagga

SEQ ID NO: 882329 - RNA, 19 nt, Homo sapiens
gcagagcuguucucaaaac

SEQ ID NO: 882330 - RNA, 19 nt, Homo sapiens
aaacgucgcaaagcagaaa

SEQ ID NO: 882331 - RNA, 19 nt, Homo sapiens
gcucacaaacgucgcaaag

SEQ ID NO: 882332 - RNA, 19 nt, Homo sapiens
gaggacaauguaaccagaa

SEQ ID NO: 882333 - RNA, 19 nt, Homo sapiens
uauagagggaauacuacua

SEQ ID NO: 882334 - RNA, 19 nt, Homo sapiens
gcaguugguggucuuucuu

SEQ ID NO: 882335 - RNA, 19 nt, Homo sapiens
cacagacgaggacaaugua

SEQ ID NO: 882336 - RNA, 19 nt, Homo sapiens
uagagggaauacuacuaug

SEQ ID NO: 882337 - RNA, 19 nt, Homo sapiens
agacucugcucgagggaau

SEQ ID NO: 882338 - RNA, 19 nt, Homo sapiens
aaaccaacccaucaaacau

SEQ ID NO: 882339 - RNA, 19 nt, Homo sapiens
gagucugccaccaguguaa

SEQ ID NO: 882340 - RNA, 19 nt, Homo sapiens
ccaguuuccaucaguuuau

SEQ ID NO: 882341 - RNA, 19 nt, Homo sapiens
gagcuguucucaaaaccaa

SEQ ID NO: 882342 - RNA, 19 nt, Homo sapiens
cuaaaguaccuacccagau

SEQ ID NO: 882343 - RNA, 19 nt, Homo sapiens
cacagaagaaauuagaaug

SEQ ID NO: 882344 - RNA, 19 nt, Homo sapiens
gacaccacagaagaaauua

SEQ ID NO: 882345 - RNA, 19 nt, Homo sapiens
ugccaccaguguaauguau

SEQ ID NO: 882346 - RNA, 19 nt, Homo sapiens
aaacugauccagaaaugac

SEQ ID NO: 882347 - RNA, 19 nt, Homo sapiens
caggaucuggugacaaaug

SEQ ID NO: 882348 - RNA, 19 nt, Homo sapiens
ugagcaaacggaagcaguu

SEQ ID NO: 882349 - RNA, 19 nt, Homo sapiens
gauuaaaguagagaaaugg

SEQ ID NO: 882350 - RNA, 19 nt, Homo sapiens
gcaaagcagaaacugaaaa

SEQ ID NO: 882351 - RNA, 19 nt, Homo sapiens
cuuuggaaguuacgguauu

SEQ ID NO: 882352 - RNA, 19 nt, Homo sapiens
gaagcaguugguggucuuu

SEQ ID NO: 882353 - RNA, 19 nt, Homo sapiens
ccaguuugcagcagcuuau

SEQ ID NO: 882354 - RNA, 19 nt, Homo sapiens
agaacagaauauagugaca

SEQ ID NO: 882355 - RNA, 19 nt, Homo sapiens
ggacaauguaaccagaaca

SEQ ID NO: 882356 - RNA, 19 nt, Homo sapiens
caguugaguuacagacauc

SEQ ID NO: 882357 - RNA, 19 nt, Homo sapiens
acugaaaacugauccagaa

SEQ ID NO: 882358 - RNA, 19 nt, Homo sapiens
gggcaacgaggaagcucuu

SEQ ID NO: 882359 - RNA, 19 nt, Homo sapiens
acagcugucucaccagagu

SEQ ID NO: 882360 - RNA, 19 nt, Homo sapiens
aauguaaccagaacagaau

SEQ ID NO: 882361 - RNA, 19 nt, Homo sapiens
agacacagacgaggacaau

SEQ ID NO: 882362 - RNA, 19 nt, Homo sapiens
gacuacugcucacaaacgu

SEQ ID NO: 882363 - RNA, 19 nt, Homo sapiens
ggagguaaccgugacuacu

SEQ ID NO: 882364 - RNA, 19 nt, Homo sapiens
cuucaaagcccagacuugu

SEQ ID NO: 882365 - RNA, 19 nt, Homo sapiens
aaccagaacagaauauagu

SEQ ID NO: 882366 - RNA, 19 nt, Homo sapiens
gaucugguuaaacaauuuc

SEQ ID NO: 882367 - RNA, 19 nt, Homo sapiens
ggauauaaaagaucugguu

SEQ ID NO: 882368 - RNA, 19 nt, Homo sapiens
agcagaaacugaaaacuga

SEQ ID NO: 882369 - RNA, 19 nt, Homo sapiens
agacuugucguacccuaug

SEQ ID NO: 882370 - RNA, 19 nt, Homo sapiens
gggaagagcuguuuauaua

SEQ ID NO: 882371 - RNA, 19 nt, Homo sapiens
gcgcagccuucuagauuua

SEQ ID NO: 882372 - RNA, 19 nt, Homo sapiens
cgacacggcuuuaggaaga

SEQ ID NO: 882373 - RNA, 19 nt, Homo sapiens
ggaagagcuguuuauauaa

SEQ ID NO: 882374 - RNA, 19 nt, Homo sapiens
ggaggaagcugaggcaacu

SEQ ID NO: 882375 - RNA, 19 nt, Homo sapiens
gcuugggccuuauuuguau

SEQ ID NO: 882376 - RNA, 19 nt, Homo sapiens
cgacagggcagaaggaguu

SEQ ID NO: 882377 - RNA, 19 nt, Homo sapiens
gggccuuauuuguauauuu

SEQ ID NO: 882378 - RNA, 19 nt, Homo sapiens
gcaagugccuaaguuaaaa

SEQ ID NO: 882379 - RNA, 19 nt, Homo sapiens
gugcgcagccuucuagauu

SEQ ID NO: 882380 - RNA, 19 nt, Homo sapiens
gggcuacccucgacuuugg

SEQ ID NO: 882381 - RNA, 19 nt, Homo sapiens
ccacgcaggucaagaucug

SEQ ID NO: 882382 - RNA, 19 nt, Homo sapiens
gaagagcaccggggaauuu

SEQ ID NO: 882383 - RNA, 19 nt, Homo sapiens
gcugcuggcguuucgaaua

SEQ ID NO: 882384 - RNA, 19 nt, Homo sapiens
ugaggcaacuuugggauuc

SEQ ID NO: 882385 - RNA, 19 nt, Homo sapiens
guauaggaagcaaguuauu

SEQ ID NO: 882386 - RNA, 19 nt, Homo sapiens
gcuguaaaugcgcuaauau

SEQ ID NO: 882387 - RNA, 19 nt, Homo sapiens
ccagaaucaucgcuacaag

SEQ ID NO: 882388 - RNA, 19 nt, Homo sapiens
cgcagacgcuggaguugga

SEQ ID NO: 882389 - RNA, 19 nt, Homo sapiens
cgcuguaaaugcgcuaaua

SEQ ID NO: 882390 - RNA, 19 nt, Homo sapiens
gagauuccgcuguaaaugc

SEQ ID NO: 882391 - RNA, 19 nt, Homo sapiens
cagagauuccgcuguaaau

SEQ ID NO: 882392 - RNA, 19 nt, Homo sapiens
gaauuuguaaccccuauuu

SEQ ID NO: 882393 - RNA, 19 nt, Homo sapiens
gugggaagagcuguuuaua

SEQ ID NO: 882394 - RNA, 19 nt, Homo sapiens
ugcaagugccuaaguuaaa

SEQ ID NO: 882395 - RNA, 19 nt, Homo sapiens
acacggcuuuaggaagaua

SEQ ID NO: 882396 - RNA, 19 nt, Homo sapiens
gagcugcuggcguuucgaa

SEQ ID NO: 882397 - RNA, 19 nt, Homo sapiens
ggugggaagagcuguuuau

SEQ ID NO: 882398 - RNA, 19 nt, Homo sapiens
gccugcaagugccuaaguu

SEQ ID NO: 882399 - RNA, 19 nt, Homo sapiens
ggaagcugaggcaacuuug

SEQ ID NO: 882400 - RNA, 19 nt, Homo sapiens
ccugcaagugccuaaguua

SEQ ID NO: 882401 - RNA, 19 nt, Homo sapiens
ugcgcagccuucuagauuu

SEQ ID NO: 882402 - RNA, 19 nt, Homo sapiens
ugggaagagcuguuuauau

SEQ ID NO: 882403 - RNA, 19 nt, Homo sapiens
cugcaagugccuaaguuaa

SEQ ID NO: 882404 - RNA, 19 nt, Homo sapiens
gcccuggucuccuggaacu

SEQ ID NO: 882405 - RNA, 19 nt, Homo sapiens
auagcgauuuguauaggaa

SEQ ID NO: 882406 - RNA, 19 nt, Homo sapiens
uuguauaggaagcaaguua

SEQ ID NO: 882407 - RNA, 19 nt, Homo sapiens
aauagcgauuuguauagga

SEQ ID NO: 882408 - RNA, 19 nt, Homo sapiens
cgcaagcuguuuccagagu

SEQ ID NO: 882409 - RNA, 19 nt, Homo sapiens
gcagucccgacacggcuuu

SEQ ID NO: 882410 - RNA, 19 nt, Homo sapiens
ccacgacagggcagaagga

SEQ ID NO: 882411 - RNA, 19 nt, Homo sapiens
gaagcugaggcaacuuugg

SEQ ID NO: 882412 - RNA, 19 nt, Homo sapiens
ggcgggugcuauucuccaa

SEQ ID NO: 882413 - RNA, 19 nt, Homo sapiens
cugcuggcguuucgaauac

SEQ ID NO: 882414 - RNA, 19 nt, Homo sapiens
gaaccaaguuguauuguua

SEQ ID NO: 882415 - RNA, 19 nt, Homo sapiens
aaggauugcuuucucauua

SEQ ID NO: 882416 - RNA, 19 nt, Homo sapiens
gaaggaguuugaaagagaa

SEQ ID NO: 882417 - RNA, 19 nt, Homo sapiens
agaaggaguuugaaagaga

SEQ ID NO: 882418 - RNA, 19 nt, Homo sapiens
ggauugcuuucucauuauu

SEQ ID NO: 882419 - RNA, 19 nt, Homo sapiens
ggacuugacuauagaagac

SEQ ID NO: 882420 - RNA, 19 nt, Homo sapiens
caaguuguauuguuagaca

SEQ ID NO: 882421 - RNA, 19 nt, Homo sapiens
gcaacuggcagaaggauug

SEQ ID NO: 882422 - RNA, 19 nt, Homo sapiens
gaaaagagaugcugaugcu

SEQ ID NO: 882423 - RNA, 19 nt, Homo sapiens
gaaggauugcuuucucauu

SEQ ID NO: 882424 - RNA, 19 nt, Homo sapiens
ugacacuucuccagaugaa

SEQ ID NO: 882425 - RNA, 19 nt, Homo sapiens
gagaaggaguuugaaagag

SEQ ID NO: 882426 - RNA, 19 nt, Homo sapiens
aaaaggaugugaaaaguug

SEQ ID NO: 882427 - RNA, 19 nt, Homo sapiens
uagaggacuugacuauaga

SEQ ID NO: 882428 - RNA, 19 nt, Homo sapiens
gagagaaggaguuugaaag

SEQ ID NO: 882429 - RNA, 19 nt, Homo sapiens
gaucgaagcccgcaguuuu

SEQ ID NO: 882430 - RNA, 19 nt, Homo sapiens
gucauucuauguuggauau

SEQ ID NO: 882431 - RNA, 19 nt, Homo sapiens
uagacacacuggaacaaga

SEQ ID NO: 882432 - RNA, 19 nt, Homo sapiens
uccaggaacucacacagaa

SEQ ID NO: 882433 - RNA, 19 nt, Homo sapiens
gcaacgagagaaggaguuu

SEQ ID NO: 882434 - RNA, 19 nt, Homo sapiens
acacuaucaugccaaguug

SEQ ID NO: 882435 - RNA, 19 nt, Homo sapiens
agaaccaaguuguauuguu

SEQ ID NO: 882436 - RNA, 19 nt, Homo sapiens
cgagagaaggaguuugaaa

SEQ ID NO: 882437 - RNA, 19 nt, Homo sapiens
gugcgacaaucucuucugu

SEQ ID NO: 882438 - RNA, 19 nt, Homo sapiens
agagaaggaguuugaaaga

SEQ ID NO: 882439 - RNA, 19 nt, Homo sapiens
acacagaaccaaguuguau

SEQ ID NO: 882440 - RNA, 19 nt, Homo sapiens
aagagaugcugaugcuuca

SEQ ID NO: 882441 - RNA, 19 nt, Homo sapiens
ggaaagggagcagcaacga

SEQ ID NO: 882442 - RNA, 19 nt, Homo sapiens
ggugccgccuugcuucuga

SEQ ID NO: 882443 - RNA, 19 nt, Homo sapiens
caaguuggugaauauaaga

SEQ ID NO: 882444 - RNA, 19 nt, Homo sapiens
cagaugaaggguuaauaga

SEQ ID NO: 882445 - RNA, 19 nt, Homo sapiens
ccagaugaaggguuaauag

SEQ ID NO: 882446 - RNA, 19 nt, Homo sapiens
gagccgacgccugguuuaa

SEQ ID NO: 882447 - RNA, 19 nt, Homo sapiens
ggagccgacgccugguuua

SEQ ID NO: 882448 - RNA, 19 nt, Homo sapiens
acagaaccaaguuguauug

SEQ ID NO: 882449 - RNA, 19 nt, Homo sapiens
gccgacgccugguuuaagu

SEQ ID NO: 882450 - RNA, 19 nt, Homo sapiens
gagaugcugaugcuucaug

SEQ ID NO: 882451 - RNA, 19 nt, Homo sapiens
agacaaagcaguggagcaa

SEQ ID NO: 882452 - RNA, 19 nt, Homo sapiens
acaaagcaguggagcaacu

SEQ ID NO: 882453 - RNA, 19 nt, Homo sapiens
ccaaaaggaugugaaaagu

SEQ ID NO: 882454 - RNA, 19 nt, Homo sapiens
ucacacagaaccaaguugu

SEQ ID NO: 882455 - RNA, 19 nt, Homo sapiens
gccacacguuugcuucuuc

SEQ ID NO: 882456 - RNA, 19 nt, Homo sapiens
gacuauagaagacaaagca

SEQ ID NO: 882457 - RNA, 19 nt, Homo sapiens
ggaacaagagauuucaaaa

SEQ ID NO: 882458 - RNA, 19 nt, Homo sapiens
guuaauagaggacuugacu

SEQ ID NO: 882459 - RNA, 19 nt, Homo sapiens
gaugugaaaaguuguguuu

SEQ ID NO: 882460 - RNA, 19 nt, Homo sapiens
gaaagagaaaagcaguuaa

SEQ ID NO: 882461 - RNA, 19 nt, Homo sapiens
ugaaagagaaaagcaguua

SEQ ID NO: 882462 - RNA, 19 nt, Homo sapiens
gaggcuaaacacuaucaug

SEQ ID NO: 882463 - RNA, 19 nt, Homo sapiens
uugcugaggcuaaacacua

SEQ ID NO: 882464 - RNA, 19 nt, Homo sapiens
uggaacaagagauuucaaa

SEQ ID NO: 882465 - RNA, 19 nt, Homo sapiens
aggauugcuuucucauuau

SEQ ID NO: 882466 - RNA, 19 nt, Homo sapiens
aacgagagaaggaguuuga

SEQ ID NO: 882467 - RNA, 19 nt, Homo sapiens
cacagaaccaaguuguauu

SEQ ID NO: 882468 - RNA, 19 nt, Homo sapiens
ggaacucacacagaaccaa

SEQ ID NO: 882469 - RNA, 19 nt, Homo sapiens
cgacgccugguuuaaguga

SEQ ID NO: 882470 - RNA, 19 nt, Homo sapiens
agaugcugaugcuucauga

SEQ ID NO: 882471 - RNA, 19 nt, Homo sapiens
aaaacaagcccuccaggaa

SEQ ID NO: 882472 - RNA, 19 nt, Homo sapiens
ugacacggccacccuacug

SEQ ID NO: 882473 - RNA, 19 nt, Homo sapiens
ggagcaacuggcagaagga

SEQ ID NO: 882474 - RNA, 19 nt, Homo sapiens
caaaaggaugugaaaaguu

SEQ ID NO: 882475 - RNA, 19 nt, Homo sapiens
cacacagaaccaaguugua

SEQ ID NO: 882476 - RNA, 19 nt, Homo sapiens
aacaagcccuccaggaacu

SEQ ID NO: 882477 - RNA, 19 nt, Homo sapiens
guaaagaucuggaggauuu

SEQ ID NO: 882478 - RNA, 19 nt, Homo sapiens
gaggauggguuucuuaaua

SEQ ID NO: 882479 - RNA, 19 nt, Homo sapiens
gcacuggccuuucccuaua

SEQ ID NO: 882480 - RNA, 19 nt, Homo sapiens
gcacaaagauucacaccau

SEQ ID NO: 882481 - RNA, 19 nt, Homo sapiens
gaagcaagauccuggugua

SEQ ID NO: 882482 - RNA, 19 nt, Homo sapiens
ggacuugcuuucugcuuua

SEQ ID NO: 882483 - RNA, 19 nt, Homo sapiens
ggaaagaacuaggaagaug

SEQ ID NO: 882484 - RNA, 19 nt, Homo sapiens
uaccacaacuggcuaauuu

SEQ ID NO: 882485 - RNA, 19 nt, Homo sapiens
gcaagauccugguguauag

SEQ ID NO: 882486 - RNA, 19 nt, Homo sapiens
guccguaguuguucuaaua

SEQ ID NO: 882487 - RNA, 19 nt, Homo sapiens
caacagcauccaccuaaua

SEQ ID NO: 882488 - RNA, 19 nt, Homo sapiens
ccaacugccuuacgaauug

SEQ ID NO: 882489 - RNA, 19 nt, Homo sapiens
ccgcagagccuguuucuaa

SEQ ID NO: 882490 - RNA, 19 nt, Homo sapiens
gucauuagacccagaauua

SEQ ID NO: 882491 - RNA, 19 nt, Homo sapiens
guacgaaggccacaaagaa

SEQ ID NO: 882492 - RNA, 19 nt, Homo sapiens
gaugugccuuucuuugaua

SEQ ID NO: 882493 - RNA, 19 nt, Homo sapiens
gaacagcucagaugcacaa

SEQ ID NO: 882494 - RNA, 19 nt, Homo sapiens
cagcucagaugcacaaaga

SEQ ID NO: 882495 - RNA, 19 nt, Homo sapiens
ccuauacggucccugcuua

SEQ ID NO: 882496 - RNA, 19 nt, Homo sapiens
ccaagacacugcacccuau

SEQ ID NO: 882497 - RNA, 19 nt, Homo sapiens
guagaugcguauggaauuu

SEQ ID NO: 882498 - RNA, 19 nt, Homo sapiens
caacaguucuaaacagcaa

SEQ ID NO: 882499 - RNA, 19 nt, Homo sapiens
gaucucauaucgccucuca

SEQ ID NO: 882500 - RNA, 19 nt, Homo sapiens
cuucugaccucaaaugauu

SEQ ID NO: 882501 - RNA, 19 nt, Homo sapiens
caccauacaggccaaauua

SEQ ID NO: 882502 - RNA, 19 nt, Homo sapiens
ugauagaacuacaaagaga

SEQ ID NO: 882503 - RNA, 19 nt, Homo sapiens
ugagcacgaugcaagaaua

SEQ ID NO: 882504 - RNA, 19 nt, Homo sapiens
gcagccaaaugucuccuuu

SEQ ID NO: 882505 - RNA, 19 nt, Homo sapiens
gccaacauguauccaaauu

SEQ ID NO: 882506 - RNA, 19 nt, Homo sapiens
ucaaacuucugaccucaaa

SEQ ID NO: 882507 - RNA, 19 nt, Homo sapiens
ugaagguucuggaagguuu

SEQ ID NO: 882508 - RNA, 19 nt, Homo sapiens
ccauacaggccaaauuaua

SEQ ID NO: 882509 - RNA, 19 nt, Homo sapiens
ggauggguuucuuaauauu

SEQ ID NO: 882510 - RNA, 19 nt, Homo sapiens
ggagcuggauggugaaaca

SEQ ID NO: 882511 - RNA, 19 nt, Homo sapiens
ugaaugaugugccuuucuu

SEQ ID NO: 882512 - RNA, 19 nt, Homo sapiens
gagcugccauuuccaaagu

SEQ ID NO: 882513 - RNA, 19 nt, Homo sapiens
gcagaauagugagaaauca

SEQ ID NO: 882514 - RNA, 19 nt, Homo sapiens
gggaagugcuugccauuac

SEQ ID NO: 882515 - RNA, 19 nt, Homo sapiens
agacaucaguggaaucgaa

SEQ ID NO: 882516 - RNA, 19 nt, Homo sapiens
gccauugccuuacucuuga

SEQ ID NO: 882517 - RNA, 19 nt, Homo sapiens
cagcaucucugacuauucu

SEQ ID NO: 882518 - RNA, 19 nt, Homo sapiens
gaaagaacuaggaagaugu

SEQ ID NO: 882519 - RNA, 19 nt, Homo sapiens
uaacguaccugccauucgu

SEQ ID NO: 882520 - RNA, 19 nt, Homo sapiens
uccagacacuccugaauuu

SEQ ID NO: 882521 - RNA, 19 nt, Homo sapiens
gaucuggaggauuuacuua

SEQ ID NO: 882522 - RNA, 19 nt, Homo sapiens
gacucaagcugucaucuuc

SEQ ID NO: 882523 - RNA, 19 nt, Homo sapiens
ccucuacuuuccuucuuua

SEQ ID NO: 882524 - RNA, 19 nt, Homo sapiens
cacaaagauucacaccaua

SEQ ID NO: 882525 - RNA, 19 nt, Homo sapiens
gcauguuccugacacaguu

SEQ ID NO: 882526 - RNA, 19 nt, Homo sapiens
ugagcgagcuggagcaugu

SEQ ID NO: 882527 - RNA, 19 nt, Homo sapiens
aggaugaggugcuguggua

SEQ ID NO: 882528 - RNA, 19 nt, Homo sapiens
gaaggugauugcagaggau

SEQ ID NO: 882529 - RNA, 19 nt, Homo sapiens
ggacaggaaagaacuagga

SEQ ID NO: 882530 - RNA, 19 nt, Homo sapiens
aaacagacaucaguggaau

SEQ ID NO: 882531 - RNA, 19 nt, Homo sapiens
gcucagaugcacaaagauu

SEQ ID NO: 882532 - RNA, 19 nt, Homo sapiens
gauaugugauacaaagcaa

SEQ ID NO: 882533 - RNA, 19 nt, Homo sapiens
ugaaacaccugaagaucuc

SEQ ID NO: 882534 - RNA, 19 nt, Homo sapiens
gccaauugauccucuacuu

SEQ ID NO: 882535 - RNA, 19 nt, Homo sapiens
ccauauucaucuccaacua

SEQ ID NO: 882536 - RNA, 19 nt, Homo sapiens
ggagugcaauggccugauc

SEQ ID NO: 882537 - RNA, 19 nt, Homo sapiens
gcaggcaaaucagugagaa

SEQ ID NO: 882538 - RNA, 19 nt, Homo sapiens
gcaacagcauccaccuaau

SEQ ID NO: 882539 - RNA, 19 nt, Homo sapiens
cgaaccaacuggaagaauc

SEQ ID NO: 882540 - RNA, 19 nt, Homo sapiens
uaaagauaacggaguguaa

SEQ ID NO: 882541 - RNA, 19 nt, Homo sapiens
ccagagcgcuuucuuucag

SEQ ID NO: 882542 - RNA, 19 nt, Homo sapiens
ccaaagugcugggauuaca

SEQ ID NO: 882543 - RNA, 19 nt, Homo sapiens
ucacaggugguaaacauuu

SEQ ID NO: 882544 - RNA, 19 nt, Homo sapiens
cggcgaauauggacgacua

SEQ ID NO: 882545 - RNA, 19 nt, Homo sapiens
ucaaccagauaacuuccua

SEQ ID NO: 882546 - RNA, 19 nt, Homo sapiens
agacuagacuggagugcaa

SEQ ID NO: 882547 - RNA, 19 nt, Homo sapiens
acacauagacgaugcacaa

SEQ ID NO: 882548 - RNA, 19 nt, Homo sapiens
cgaccugaaugaaaugaau

SEQ ID NO: 882549 - RNA, 19 nt, Homo sapiens
caauugauccucuacuuuc

SEQ ID NO: 882550 - RNA, 19 nt, Homo sapiens
ccaauugauccucuacuuu

SEQ ID NO: 882551 - RNA, 19 nt, Homo sapiens
acaaagaacagcucagaug

SEQ ID NO: 882552 - RNA, 19 nt, Homo sapiens
ugaaauaguuccagaaacc

SEQ ID NO: 882553 - RNA, 19 nt, Homo sapiens
ucaguaccuugaaauaguu

SEQ ID NO: 882554 - RNA, 19 nt, Homo sapiens
ccaacauguauccaaauua

SEQ ID NO: 882555 - RNA, 19 nt, Homo sapiens
ugacuccaaugcagaauag

SEQ ID NO: 882556 - RNA, 19 nt, Homo sapiens
ggacucaagcugucaucuu

SEQ ID NO: 882557 - RNA, 19 nt, Homo sapiens
gauagaacuacaaagagaa

SEQ ID NO: 882558 - RNA, 19 nt, Homo sapiens
auacagagcugccauuucc

SEQ ID NO: 882559 - RNA, 19 nt, Homo sapiens
ggccacagcuucugcuuuu

SEQ ID NO: 882560 - RNA, 19 nt, Homo sapiens
cggacuugcuuucugcuuu

SEQ ID NO: 882561 - RNA, 19 nt, Homo sapiens
ucucauaucgccucucaaa

SEQ ID NO: 882562 - RNA, 19 nt, Homo sapiens
cuacuuuccuucuuuaguc

SEQ ID NO: 882563 - RNA, 19 nt, Homo sapiens
gauacgcagccauuccaua

SEQ ID NO: 882564 - RNA, 19 nt, Homo sapiens
ccacacucauuccagagaa

SEQ ID NO: 882565 - RNA, 19 nt, Homo sapiens
caccuaauauaccuucaga

SEQ ID NO: 882566 - RNA, 19 nt, Homo sapiens
gcugccaacucaaacauag

SEQ ID NO: 882567 - RNA, 19 nt, Homo sapiens
aggauggguuucuuaauau

SEQ ID NO: 882568 - RNA, 19 nt, Homo sapiens
cauucgcccuuccuaguuu

SEQ ID NO: 882569 - RNA, 19 nt, Homo sapiens
ggaagugcuugccauuacu

SEQ ID NO: 882570 - RNA, 19 nt, Homo sapiens
aagguacaguggucuauga

SEQ ID NO: 882571 - RNA, 19 nt, Homo sapiens
ccacaaagaacagcucaga

SEQ ID NO: 882572 - RNA, 19 nt, Homo sapiens
ccuaauauaccuucagaau

SEQ ID NO: 882573 - RNA, 19 nt, Homo sapiens
caggaaagaacuaggaaga

SEQ ID NO: 882574 - RNA, 19 nt, Homo sapiens
gaaugaugugccuuucuuu

SEQ ID NO: 882575 - RNA, 19 nt, Homo sapiens
aagccaacauguauccaaa

SEQ ID NO: 882576 - RNA, 19 nt, Homo sapiens
aaagauaacggaguguaaa

SEQ ID NO: 882577 - RNA, 19 nt, Homo sapiens
ggaagaagcuuugucagua

SEQ ID NO: 882578 - RNA, 19 nt, Homo sapiens
gaagauggcuggaagagau

SEQ ID NO: 882579 - RNA, 19 nt, Homo sapiens
gaacugcccuucugcaaag

SEQ ID NO: 882580 - RNA, 19 nt, Homo sapiens
ggaguuggauuaagacaga

SEQ ID NO: 882581 - RNA, 19 nt, Homo sapiens
ggauggaguuggauuaaga

SEQ ID NO: 882582 - RNA, 19 nt, Homo sapiens
uagugaagauggagaaaua

SEQ ID NO: 882583 - RNA, 19 nt, Homo sapiens
uaacaucagucacagcauu

SEQ ID NO: 882584 - RNA, 19 nt, Homo sapiens
gaauaaccauuguaacauc

SEQ ID NO: 882585 - RNA, 19 nt, Homo sapiens
caagugcaauucaagauau

SEQ ID NO: 882586 - RNA, 19 nt, Homo sapiens
gaaaugacacaaauacuca

SEQ ID NO: 882587 - RNA, 19 nt, Homo sapiens
gagaauaaccauuguaaca

SEQ ID NO: 882588 - RNA, 19 nt, Homo sapiens
gagagaauaaccauuguaa

SEQ ID NO: 882589 - RNA, 19 nt, Homo sapiens
ccaguuaacuucauugagu

SEQ ID NO: 882590 - RNA, 19 nt, Homo sapiens
gaagaagcuuugucaguac

SEQ ID NO: 882591 - RNA, 19 nt, Homo sapiens
aaucaaagaucuucugcaa

SEQ ID NO: 882592 - RNA, 19 nt, Homo sapiens
ccacaauccucgcuuaauc

SEQ ID NO: 882593 - RNA, 19 nt, Homo sapiens
ccaccacaauccucgcuua

SEQ ID NO: 882594 - RNA, 19 nt, Homo sapiens
caagauauccgaacguuca

SEQ ID NO: 882595 - RNA, 19 nt, Homo sapiens
gucagaaacuugaaagaga

SEQ ID NO: 882596 - RNA, 19 nt, Homo sapiens
caggagaacuaugccauuu

SEQ ID NO: 882597 - RNA, 19 nt, Homo sapiens
gaagauggagaaauauuca

SEQ ID NO: 882598 - RNA, 19 nt, Homo sapiens
aaagagagaauaaccauug

SEQ ID NO: 882599 - RNA, 19 nt, Homo sapiens
cauagugaguguucuguga

SEQ ID NO: 882600 - RNA, 19 nt, Homo sapiens
cauauugaauggaaguuga

SEQ ID NO: 882601 - RNA, 19 nt, Homo sapiens
ugggaaacaucaauauuug

SEQ ID NO: 882602 - RNA, 19 nt, Homo sapiens
gcacugcagcauucucuuu

SEQ ID NO: 882603 - RNA, 19 nt, Homo sapiens
gacauuugauccuuucaga

SEQ ID NO: 882604 - RNA, 19 nt, Homo sapiens
ggaaacaucaauauuugga

SEQ ID NO: 882605 - RNA, 19 nt, Homo sapiens
gugggaaacaucaauauuu

SEQ ID NO: 882606 - RNA, 19 nt, Homo sapiens
ucaauuauguggucaaacu

SEQ ID NO: 882607 - RNA, 19 nt, Homo sapiens
guacuuugcacuucagaaa

SEQ ID NO: 882608 - RNA, 19 nt, Homo sapiens
ucaucgaccucuucaaguu

SEQ ID NO: 882609 - RNA, 19 nt, Homo sapiens
gaauggaaguugauguacu

SEQ ID NO: 882610 - RNA, 19 nt, Homo sapiens
gucaaacuguugcagcuaa

SEQ ID NO: 882611 - RNA, 19 nt, Homo sapiens
guagacauuugauccuuuc

SEQ ID NO: 882612 - RNA, 19 nt, Homo sapiens
gaaagagagaauaaccauu

SEQ ID NO: 882613 - RNA, 19 nt, Homo sapiens
ucuacccucugcauucuua

SEQ ID NO: 882614 - RNA, 19 nt, Homo sapiens
gagacacacugcauuucug

SEQ ID NO: 882615 - RNA, 19 nt, Homo sapiens
gcguggcacagaagaauua

SEQ ID NO: 882616 - RNA, 19 nt, Homo sapiens
ugacuaagcaagugaacaa

SEQ ID NO: 882617 - RNA, 19 nt, Homo sapiens
guagggaagucuguauuag

SEQ ID NO: 882618 - RNA, 19 nt, Homo sapiens
ucaagugcaauucaagaua

SEQ ID NO: 882619 - RNA, 19 nt, Homo sapiens
cuaagcaagugaacaaugg

SEQ ID NO: 882620 - RNA, 19 nt, Homo sapiens
uauuuggauuugccgauua

SEQ ID NO: 882621 - RNA, 19 nt, Homo sapiens
ggucaggacuggagaucuc

SEQ ID NO: 882622 - RNA, 19 nt, Homo sapiens
cguuguauaugcuuaguga

SEQ ID NO: 882623 - RNA, 19 nt, Homo sapiens
gauauccgaacguucaauu

SEQ ID NO: 882624 - RNA, 19 nt, Homo sapiens
agucacagcauuaucuuaa

SEQ ID NO: 882625 - RNA, 19 nt, Homo sapiens
gcacuucaucgaccucuuc

SEQ ID NO: 882626 - RNA, 19 nt, Homo sapiens
guucaauuauguggucaaa

SEQ ID NO: 882627 - RNA, 19 nt, Homo sapiens
ggagacacacugcauuucu

SEQ ID NO: 882628 - RNA, 19 nt, Homo sapiens
ucagaugacuaagcaagug

SEQ ID NO: 882629 - RNA, 19 nt, Homo sapiens
agggaagucuguauuagug

SEQ ID NO: 882630 - RNA, 19 nt, Homo sapiens
aauccucgcuuaaucaaag

SEQ ID NO: 882631 - RNA, 19 nt, Homo sapiens
uguagacauuugauccuuu

SEQ ID NO: 882632 - RNA, 19 nt, Homo sapiens
agaagccuuuaaucgguua

SEQ ID NO: 882633 - RNA, 19 nt, Homo sapiens
ucaauaaugaagagcauga

SEQ ID NO: 882634 - RNA, 19 nt, Homo sapiens
ggaguagggaagucuguau

SEQ ID NO: 882635 - RNA, 19 nt, Homo sapiens
gugaagauggagaaauauu

SEQ ID NO: 882636 - RNA, 19 nt, Homo sapiens
gucacagcauuaucuuaaa

SEQ ID NO: 882637 - RNA, 19 nt, Homo sapiens
ugucggcacugcagcauuc

SEQ ID NO: 882638 - RNA, 19 nt, Homo sapiens
ugaguggcguggcacagaa

SEQ ID NO: 882639 - RNA, 19 nt, Homo sapiens
aaggucauauugaauggaa

SEQ ID NO: 882640 - RNA, 19 nt, Homo sapiens
uguauaugcuuagugaaga

SEQ ID NO: 882641 - RNA, 19 nt, Homo sapiens
ccucugcauucuuauuaga

SEQ ID NO: 882642 - RNA, 19 nt, Homo sapiens
caucgaccucuucaaguuu

SEQ ID NO: 882643 - RNA, 19 nt, Homo sapiens
gcaacaacagcuacaggau

SEQ ID NO: 882644 - RNA, 19 nt, Homo sapiens
aguagggaagucuguauua

SEQ ID NO: 882645 - RNA, 19 nt, Homo sapiens
gaguagggaagucuguauu

SEQ ID NO: 882646 - RNA, 19 nt, Homo sapiens
gcucuacccucugcauucu

SEQ ID NO: 882647 - RNA, 19 nt, Homo sapiens
uauccgaacguucaauuau

SEQ ID NO: 882648 - RNA, 19 nt, Homo sapiens
uggauuugccgauuagaaa

SEQ ID NO: 882649 - RNA, 19 nt, Homo sapiens
gaaacuugaaagagagaau

SEQ ID NO: 882650 - RNA, 19 nt, Homo sapiens
ugaaucuuguagucagaaa

SEQ ID NO: 882651 - RNA, 19 nt, Homo sapiens
ugaagauggagaaauauuc

SEQ ID NO: 882652 - RNA, 19 nt, Homo sapiens
gaaagccugggaagaacug

SEQ ID NO: 882653 - RNA, 19 nt, Homo sapiens
aacaacagcuacaggaucu

SEQ ID NO: 882654 - RNA, 19 nt, Homo sapiens
gauaaaaucguucaaaagg

SEQ ID NO: 882655 - RNA, 19 nt, Homo sapiens
cagaaagccugggaagaac

SEQ ID NO: 882656 - RNA, 19 nt, Homo sapiens
caaaaucccaguuaacuuc

SEQ ID NO: 882657 - RNA, 19 nt, Homo sapiens
ugaaagagagaauaaccau

SEQ ID NO: 882658 - RNA, 19 nt, Homo sapiens
guacggagacacacugcau

SEQ ID NO: 882659 - RNA, 19 nt, Homo sapiens
ugauguacuuugcacuuca

SEQ ID NO: 882660 - RNA, 19 nt, Homo sapiens
ucaaacuguugcagcuaau

SEQ ID NO: 882661 - RNA, 19 nt, Homo sapiens
uccgaacguucaauuaugu

SEQ ID NO: 882662 - RNA, 19 nt, Homo sapiens
caacagcuacaggaucuuc

SEQ ID NO: 882663 - RNA, 19 nt, Homo sapiens
aaacuguugcagcuaauug

SEQ ID NO: 882664 - RNA, 19 nt, Homo sapiens
agaaaugacacaaauacuc

SEQ ID NO: 882665 - RNA, 19 nt, Homo sapiens
aagagagaauaaccauugu

SEQ ID NO: 882666 - RNA, 19 nt, Homo sapiens
uugaauggaaguugaugua

SEQ ID NO: 882667 - RNA, 19 nt, Homo sapiens
aaucccaguuaacuucauu

SEQ ID NO: 882668 - RNA, 19 nt, Homo sapiens
ugugaauccugcugucugu

SEQ ID NO: 882669 - RNA, 19 nt, Homo sapiens
uuagugggaaacaucaaua

SEQ ID NO: 882670 - RNA, 19 nt, Homo sapiens
gcagcauucucuuuuggaa

SEQ ID NO: 882671 - RNA, 19 nt, Homo sapiens
gcacaugcugaacaacauc

SEQ ID NO: 882672 - RNA, 19 nt, Homo sapiens
gaugugaaucuuguaguca

SEQ ID NO: 882673 - RNA, 19 nt, Homo sapiens
cuuaaauagugaagaugga

SEQ ID NO: 882674 - RNA, 19 nt, Homo sapiens
cuucucaagugcaauucaa

SEQ ID NO: 882675 - RNA, 19 nt, Homo sapiens
aaacuccuucuaagcauau

SEQ ID NO: 882676 - RNA, 19 nt, Homo sapiens
agagagaauaaccauugua

SEQ ID NO: 882677 - RNA, 19 nt, Homo sapiens
guaaauaccucuacgucuu

SEQ ID NO: 882678 - RNA, 19 nt, Homo sapiens
gaucacgucuucauucuug

SEQ ID NO: 882679 - RNA, 19 nt, Homo sapiens
ggaccugccucuucucuga

SEQ ID NO: 882680 - RNA, 19 nt, Homo sapiens
caagagauuugauggauag

SEQ ID NO: 882681 - RNA, 19 nt, Homo sapiens
gcaaggaaauaacagauac

SEQ ID NO: 882682 - RNA, 19 nt, Homo sapiens
gagauuugauggauagaau

SEQ ID NO: 882683 - RNA, 19 nt, Homo sapiens
ugaggaaggugucccacua

SEQ ID NO: 882684 - RNA, 19 nt, Homo sapiens
gacaagagauuugauggau

SEQ ID NO: 882685 - RNA, 19 nt, Homo sapiens
gcacggagaagaugaagga

SEQ ID NO: 882686 - RNA, 19 nt, Homo sapiens
ggacggcucuaccuaccaa

SEQ ID NO: 882687 - RNA, 19 nt, Homo sapiens
gcacuccacuagcaggaaa

SEQ ID NO: 882688 - RNA, 19 nt, Homo sapiens
gaauuuggccgaaucuuca

SEQ ID NO: 882689 - RNA, 19 nt, Homo sapiens
gcucagaguucagcaagga

SEQ ID NO: 882690 - RNA, 19 nt, Homo sapiens
acaagagauuugauggaua

SEQ ID NO: 882691 - RNA, 19 nt, Homo sapiens
acacgaagggccuguauuu

SEQ ID NO: 882692 - RNA, 19 nt, Homo sapiens
gaagaugaaggagaucgua

SEQ ID NO: 882693 - RNA, 19 nt, Homo sapiens
ugaaugagacccagcuuga

SEQ ID NO: 882694 - RNA, 19 nt, Homo sapiens
caccaaggaucacgucuuc

SEQ ID NO: 882695 - RNA, 19 nt, Homo sapiens
ggacaagagauuugaugga

SEQ ID NO: 882696 - RNA, 19 nt, Homo sapiens
cggagaagaugaaggagau

SEQ ID NO: 882697 - RNA, 19 nt, Homo sapiens
ggaugaauuuggccgaauc

SEQ ID NO: 882698 - RNA, 19 nt, Homo sapiens
uaacagauacgggcagcua

SEQ ID NO: 882699 - RNA, 19 nt, Homo sapiens
gaaucuucaugcaaggaaa

SEQ ID NO: 882700 - RNA, 19 nt, Homo sapiens
ggacggcuaaccaggguaa

SEQ ID NO: 882701 - RNA, 19 nt, Homo sapiens
ggacaccggcacuccacua

SEQ ID NO: 882702 - RNA, 19 nt, Homo sapiens
ucagccagauccacaguug

SEQ ID NO: 882703 - RNA, 19 nt, Homo sapiens
uggagcauaucaucucauu

SEQ ID NO: 882704 - RNA, 19 nt, Homo sapiens
ggaggcgggugaagagaag

SEQ ID NO: 882705 - RNA, 19 nt, Homo sapiens
uaaauaccucuacgucuug

SEQ ID NO: 882706 - RNA, 19 nt, Homo sapiens
cgaagggccuguauuucca

SEQ ID NO: 882707 - RNA, 19 nt, Homo sapiens
ucaagaaggccaauuagag

SEQ ID NO: 882708 - RNA, 19 nt, Homo sapiens
cgauuuccauccaguuguu

SEQ ID NO: 882709 - RNA, 19 nt, Homo sapiens
ccaauagcaugggcgagaa

SEQ ID NO: 882710 - RNA, 19 nt, Homo sapiens
ggacacgaagggccuguau

SEQ ID NO: 882711 - RNA, 19 nt, Homo sapiens
gagcauaucaucucauucc

SEQ ID NO: 882712 - RNA, 19 nt, Homo sapiens
uaaccaggguaagaauguu

SEQ ID NO: 882713 - RNA, 19 nt, Homo sapiens
uaucauggacaagagauuu

SEQ ID NO: 882714 - RNA, 19 nt, Homo sapiens
ggaaggaaagaucuacucu

SEQ ID NO: 882715 - RNA, 19 nt, Homo sapiens
auaaaaggcugcagcgaaa

SEQ ID NO: 882716 - RNA, 19 nt, Homo sapiens
caaggaucacgucuucauu

SEQ ID NO: 882717 - RNA, 19 nt, Homo sapiens
gguggagcauaucaucuca

SEQ ID NO: 882718 - RNA, 19 nt, Homo sapiens
cagagcugguggagcauau

SEQ ID NO: 882719 - RNA, 19 nt, Homo sapiens
gaacaggggacaaaaugga

SEQ ID NO: 882720 - RNA, 19 nt, Homo sapiens
acucuuugguagugaauga

SEQ ID NO: 882721 - RNA, 19 nt, Homo sapiens
gaugacauuccaccacuca

SEQ ID NO: 882722 - RNA, 19 nt, Homo sapiens
ccaaggaucacgucuucau

SEQ ID NO: 882723 - RNA, 19 nt, Homo sapiens
ccaaagaccaaucguaagc

SEQ ID NO: 882724 - RNA, 19 nt, Homo sapiens
ugacuaucauggacaagag

SEQ ID NO: 882725 - RNA, 19 nt, Homo sapiens
caccggcacuccacuagca

SEQ ID NO: 882726 - RNA, 19 nt, Homo sapiens
ugaauuuggccgaaucuuc

SEQ ID NO: 882727 - RNA, 19 nt, Homo sapiens
cuacgucacagauccuauu

SEQ ID NO: 882728 - RNA, 19 nt, Homo sapiens
caaugaccuucaagcagau

SEQ ID NO: 882729 - RNA, 19 nt, Homo sapiens
gauccacaguugccaaacg

SEQ ID NO: 882730 - RNA, 19 nt, Homo sapiens
ugacuguguugaggucuau

SEQ ID NO: 882731 - RNA, 19 nt, Homo sapiens
gugacuguguugaggucua

SEQ ID NO: 882732 - RNA, 19 nt, Homo sapiens
agccagagcucagaguuca

SEQ ID NO: 882733 - RNA, 19 nt, Homo sapiens
ugcaaggaaauaacagaua

SEQ ID NO: 882734 - RNA, 19 nt, Homo sapiens
ugacauuccaccacucaau

SEQ ID NO: 882735 - RNA, 19 nt, Homo sapiens
gagcugguggagcauauca

SEQ ID NO: 882736 - RNA, 19 nt, Homo sapiens
gucaagaaggccaauuaga

SEQ ID NO: 882737 - RNA, 19 nt, Homo sapiens
cagaggaaggaaagaucua

SEQ ID NO: 882738 - RNA, 19 nt, Homo sapiens
gcuaaccaggguaagaaug

SEQ ID NO: 882739 - RNA, 19 nt, Homo sapiens
gccgaugucucagcaagag

SEQ ID NO: 882740 - RNA, 19 nt, Homo sapiens
ccagucagagaccuuguug

SEQ ID NO: 882741 - RNA, 19 nt, Homo sapiens
cuaaccaggguaagaaugu

SEQ ID NO: 882742 - RNA, 19 nt, Homo sapiens
caagucaaggucccucugu

SEQ ID NO: 882743 - RNA, 19 nt, Homo sapiens
ucacagaggaaggaaagau

SEQ ID NO: 882744 - RNA, 19 nt, Homo sapiens
cugucaagaaggccaauua

SEQ ID NO: 882745 - RNA, 19 nt, Homo sapiens
uccaagaucaggacacgaa

SEQ ID NO: 882746 - RNA, 19 nt, Homo sapiens
ggaccgcacggagaagaug

SEQ ID NO: 882747 - RNA, 19 nt, Homo sapiens
gauccuauucugugcucuu

SEQ ID NO: 882748 - RNA, 19 nt, Homo sapiens
aaucuggaccugccucuuc

SEQ ID NO: 882749 - RNA, 19 nt, Homo sapiens
cgucuucauucuugacuac

SEQ ID NO: 882750 - RNA, 19 nt, Homo sapiens
ugagggacggcucuaccua

SEQ ID NO: 882751 - RNA, 19 nt, Homo sapiens
cggcuaaccaggguaagaa

SEQ ID NO: 882752 - RNA, 19 nt, Homo sapiens
cgaaucuucaugcaaggaa

SEQ ID NO: 882753 - RNA, 19 nt, Homo sapiens
ccugauggccgcacagaag

SEQ ID NO: 882754 - RNA, 19 nt, Homo sapiens
cagauccacaguugccaaa

SEQ ID NO: 882755 - RNA, 19 nt, Homo sapiens
ucgucaagcuccaagucaa

SEQ ID NO: 882756 - RNA, 19 nt, Homo sapiens
ucugugcucuuggcuacaa

SEQ ID NO: 882757 - RNA, 19 nt, Homo sapiens
gacccucuucuuccucaaa

SEQ ID NO: 882758 - RNA, 19 nt, Homo sapiens
aaggaucacgucuucauuc

SEQ ID NO: 882759 - RNA, 19 nt, Homo sapiens
ccaccaaggaucacgucuu

SEQ ID NO: 882760 - RNA, 19 nt, Homo sapiens
gacacgaagggccuguauu

SEQ ID NO: 882761 - RNA, 19 nt, Homo sapiens
gaagagagcugccauucug

SEQ ID NO: 882762 - RNA, 19 nt, Homo sapiens
guaaauaccucuacgucuu

SEQ ID NO: 882763 - RNA, 19 nt, Homo sapiens
gaucacgucuucauucuug

SEQ ID NO: 882764 - RNA, 19 nt, Homo sapiens
ggaccugccucuucucuga

SEQ ID NO: 882765 - RNA, 19 nt, Homo sapiens
gagcugccauucugaacua

SEQ ID NO: 882766 - RNA, 19 nt, Homo sapiens
caagagauuugauggauag

SEQ ID NO: 882767 - RNA, 19 nt, Homo sapiens
gcaaggaaauaacagauac

SEQ ID NO: 882768 - RNA, 19 nt, Homo sapiens
gagauuugauggauagaau

SEQ ID NO: 882769 - RNA, 19 nt, Homo sapiens
ugaggaaggugucccacua

SEQ ID NO: 882770 - RNA, 19 nt, Homo sapiens
gacaagagauuugauggau

SEQ ID NO: 882771 - RNA, 19 nt, Homo sapiens
gcacggagaagaugaagga

SEQ ID NO: 882772 - RNA, 19 nt, Homo sapiens
ggacggcucuaccuaccaa

SEQ ID NO: 882773 - RNA, 19 nt, Homo sapiens
gcacuccacuagcaggaaa

SEQ ID NO: 882774 - RNA, 19 nt, Homo sapiens
gaauuuggccgaaucuuca

SEQ ID NO: 882775 - RNA, 19 nt, Homo sapiens
gcucagaguucagcaagga

SEQ ID NO: 882776 - RNA, 19 nt, Homo sapiens
acaagagauuugauggaua

SEQ ID NO: 882777 - RNA, 19 nt, Homo sapiens
acacgaagggccuguauuu

SEQ ID NO: 882778 - RNA, 19 nt, Homo sapiens
gaagaugaaggagaucgua

SEQ ID NO: 882779 - RNA, 19 nt, Homo sapiens
ugaaugagacccagcuuga

SEQ ID NO: 882780 - RNA, 19 nt, Homo sapiens
caccaaggaucacgucuuc

SEQ ID NO: 882781 - RNA, 19 nt, Homo sapiens
ggacaagagauuugaugga

SEQ ID NO: 882782 - RNA, 19 nt, Homo sapiens
cggagaagaugaaggagau

SEQ ID NO: 882783 - RNA, 19 nt, Homo sapiens
ggaugaauuuggccgaauc

SEQ ID NO: 882784 - RNA, 19 nt, Homo sapiens
uaacagauacgggcagcua

SEQ ID NO: 882785 - RNA, 19 nt, Homo sapiens
gaaucuucaugcaaggaaa

SEQ ID NO: 882786 - RNA, 19 nt, Homo sapiens
ggacggcuaaccaggguaa

SEQ ID NO: 882787 - RNA, 19 nt, Homo sapiens
ucagccagauccacaguug

SEQ ID NO: 882788 - RNA, 19 nt, Homo sapiens
ggacaccggcacuccacua

SEQ ID NO: 882789 - RNA, 19 nt, Homo sapiens
uggagcauaucaucucauu

SEQ ID NO: 882790 - RNA, 19 nt, Homo sapiens
ggaggcgggugaagagaag

SEQ ID NO: 882791 - RNA, 19 nt, Homo sapiens
uaaauaccucuacgucuug

SEQ ID NO: 882792 - RNA, 19 nt, Homo sapiens
cgaagggccuguauuucca

SEQ ID NO: 882793 - RNA, 19 nt, Homo sapiens
ucaagaaggccaauuagag

SEQ ID NO: 882794 - RNA, 19 nt, Homo sapiens
cgauuuccauccaguuguu

SEQ ID NO: 882795 - RNA, 19 nt, Homo sapiens
ccaauagcaugggcgagaa

SEQ ID NO: 882796 - RNA, 19 nt, Homo sapiens
gagcauaucaucucauucc

SEQ ID NO: 882797 - RNA, 19 nt, Homo sapiens
uaaccaggguaagaauguu

SEQ ID NO: 882798 - RNA, 19 nt, Homo sapiens
ggaagagagcugccauucu

SEQ ID NO: 882799 - RNA, 19 nt, Homo sapiens
uaucauggacaagagauuu

SEQ ID NO: 882800 - RNA, 19 nt, Homo sapiens
ggaaggaaagaucuacucu

SEQ ID NO: 882801 - RNA, 19 nt, Homo sapiens
auaaaaggcugcagcgaaa

SEQ ID NO: 882802 - RNA, 19 nt, Homo sapiens
caaggaucacgucuucauu

SEQ ID NO: 882803 - RNA, 19 nt, Homo sapiens
gguggagcauaucaucuca

SEQ ID NO: 882804 - RNA, 19 nt, Homo sapiens
cagagcugguggagcauau

SEQ ID NO: 882805 - RNA, 19 nt, Homo sapiens
gaacaggggacaaaaugga

SEQ ID NO: 882806 - RNA, 19 nt, Homo sapiens
acucuuugguagugaauga

SEQ ID NO: 882807 - RNA, 19 nt, Homo sapiens
gaugacauuccaccacuca

SEQ ID NO: 882808 - RNA, 19 nt, Homo sapiens
ccaaggaucacgucuucau

SEQ ID NO: 882809 - RNA, 19 nt, Homo sapiens
ugacuaucauggacaagag

SEQ ID NO: 882810 - RNA, 19 nt, Homo sapiens
caccggcacuccacuagca

SEQ ID NO: 882811 - RNA, 19 nt, Homo sapiens
ugaauuuggccgaaucuuc

SEQ ID NO: 882812 - RNA, 19 nt, Homo sapiens
ccaaagaccaaucguaagc

SEQ ID NO: 882813 - RNA, 19 nt, Homo sapiens
caaugaccuucaagcagau

SEQ ID NO: 882814 - RNA, 19 nt, Homo sapiens
gauccacaguugccaaacg

SEQ ID NO: 882815 - RNA, 19 nt, Homo sapiens
ugacuguguugaggucuau

SEQ ID NO: 882816 - RNA, 19 nt, Homo sapiens
gugacuguguugaggucua

SEQ ID NO: 882817 - RNA, 19 nt, Homo sapiens
agccagagcucagaguuca

SEQ ID NO: 882818 - RNA, 19 nt, Homo sapiens
ugcaaggaaauaacagaua

SEQ ID NO: 882819 - RNA, 19 nt, Homo sapiens
gguguaucgcgaucucuuu

SEQ ID NO: 882820 - RNA, 19 nt, Homo sapiens
ugacauuccaccacucaau

SEQ ID NO: 882821 - RNA, 19 nt, Homo sapiens
gucaagaaggccaauuaga

SEQ ID NO: 882822 - RNA, 19 nt, Homo sapiens
gagcugguggagcauauca

SEQ ID NO: 882823 - RNA, 19 nt, Homo sapiens
cagaggaaggaaagaucua

SEQ ID NO: 882824 - RNA, 19 nt, Homo sapiens
gcuaaccaggguaagaaug

SEQ ID NO: 882825 - RNA, 19 nt, Homo sapiens
gccgaugucucagcaagag

SEQ ID NO: 882826 - RNA, 19 nt, Homo sapiens
ccagucagagaccuuguug

SEQ ID NO: 882827 - RNA, 19 nt, Homo sapiens
cuaaccaggguaagaaugu

SEQ ID NO: 882828 - RNA, 19 nt, Homo sapiens
caagucaaggucccucugu

SEQ ID NO: 882829 - RNA, 19 nt, Homo sapiens
ucacagaggaaggaaagau

SEQ ID NO: 882830 - RNA, 19 nt, Homo sapiens
cugucaagaaggccaauua

SEQ ID NO: 882831 - RNA, 19 nt, Homo sapiens
ggaccgcacggagaagaug

SEQ ID NO: 882832 - RNA, 19 nt, Homo sapiens
gauccuauucugugcucuu

SEQ ID NO: 882833 - RNA, 19 nt, Homo sapiens
cugccaagauccuauucug

SEQ ID NO: 882834 - RNA, 19 nt, Homo sapiens
ugagggacggcucuaccua

SEQ ID NO: 882835 - RNA, 19 nt, Homo sapiens
cgucuucauucuugacuac

SEQ ID NO: 882836 - RNA, 19 nt, Homo sapiens
aaucuggaccugccucuuc

SEQ ID NO: 882837 - RNA, 19 nt, Homo sapiens
cggcuaaccaggguaagaa

SEQ ID NO: 882838 - RNA, 19 nt, Homo sapiens
cgaaucuucaugcaaggaa

SEQ ID NO: 882839 - RNA, 19 nt, Homo sapiens
ccugauggccgcacagaag

SEQ ID NO: 882840 - RNA, 19 nt, Homo sapiens
cagauccacaguugccaaa

SEQ ID NO: 882841 - RNA, 19 nt, Homo sapiens
ucgucaagcuccaagucaa

SEQ ID NO: 882842 - RNA, 19 nt, Homo sapiens
ucugugcucuuggcuacaa

SEQ ID NO: 882843 - RNA, 19 nt, Homo sapiens
gacccucuucuuccucaaa

SEQ ID NO: 882844 - RNA, 19 nt, Homo sapiens
aaggaucacgucuucauuc

SEQ ID NO: 882845 - RNA, 19 nt, Homo sapiens
ccaccaaggaucacgucuu

SEQ ID NO: 882846 - RNA, 19 nt, Homo sapiens
cagaggagcuugagaaugu

SEQ ID NO: 882847 - RNA, 19 nt, Homo sapiens
gaaaagaacuaguauggaa

SEQ ID NO: 882848 - RNA, 19 nt, Homo sapiens
acaauuagguggacauaaa

SEQ ID NO: 882849 - RNA, 19 nt, Homo sapiens
guaauuaucugcagcaagu

SEQ ID NO: 882850 - RNA, 19 nt, Homo sapiens
ucucagagcuucuaauaug

SEQ ID NO: 882851 - RNA, 19 nt, Homo sapiens
guucgcaucuuaccacaua

SEQ ID NO: 882852 - RNA, 19 nt, Homo sapiens
ggaaacacaugguuagagu

SEQ ID NO: 882853 - RNA, 19 nt, Homo sapiens
gcuuacgguugaauaauua

SEQ ID NO: 882854 - RNA, 19 nt, Homo sapiens
aaacagcacuugcccuuga

SEQ ID NO: 882855 - RNA, 19 nt, Homo sapiens
ggaaauagaaauuggagaa

SEQ ID NO: 882856 - RNA, 19 nt, Homo sapiens
gaaaauagcuaaaguugag

SEQ ID NO: 882857 - RNA, 19 nt, Homo sapiens
caaucgaccucaggaaaua

SEQ ID NO: 882858 - RNA, 19 nt, Homo sapiens
ugagaauguucgcaucuua

SEQ ID NO: 882859 - RNA, 19 nt, Homo sapiens
uaaaggaaacacaugguua

SEQ ID NO: 882860 - RNA, 19 nt, Homo sapiens
gggaaauggucucagguuu

SEQ ID NO: 882861 - RNA, 19 nt, Homo sapiens
gcaccuucguguugaguaa

SEQ ID NO: 882862 - RNA, 19 nt, Homo sapiens
guaagucauccuaguuaua

SEQ ID NO: 882863 - RNA, 19 nt, Homo sapiens
agaauagcauuaccuguga

SEQ ID NO: 882864 - RNA, 19 nt, Homo sapiens
gacauugccuguugaucuu

SEQ ID NO: 882865 - RNA, 19 nt, Homo sapiens
gaaauuggagaaucugguu

SEQ ID NO: 882866 - RNA, 19 nt, Homo sapiens
uauagucucucuucugguu

SEQ ID NO: 882867 - RNA, 19 nt, Homo sapiens
gaaauggucucagguuuug

SEQ ID NO: 882868 - RNA, 19 nt, Homo sapiens
gacaucaacucacugaagu

SEQ ID NO: 882869 - RNA, 19 nt, Homo sapiens
ugagucacauucuccuuaa

SEQ ID NO: 882870 - RNA, 19 nt, Homo sapiens
gaacauaauucugcuuacg

SEQ ID NO: 882871 - RNA, 19 nt, Homo sapiens
guccuugucuuugguuaua

SEQ ID NO: 882872 - RNA, 19 nt, Homo sapiens
ccacucuguuuaauauuug

SEQ ID NO: 882873 - RNA, 19 nt, Homo sapiens
gcaaucgaccucaggaaau

SEQ ID NO: 882874 - RNA, 19 nt, Homo sapiens
ggugggagccaguaauuau

SEQ ID NO: 882875 - RNA, 19 nt, Homo sapiens
gaaguaggucuuuuagaua

SEQ ID NO: 882876 - RNA, 19 nt, Homo sapiens
agaaagacaucaacucacu

SEQ ID NO: 882877 - RNA, 19 nt, Homo sapiens
cccacucuguuuaauauuu

SEQ ID NO: 882878 - RNA, 19 nt, Homo sapiens
gcaaggaaaagaacuagua

SEQ ID NO: 882879 - RNA, 19 nt, Homo sapiens
uauuugcucuucugucuug

SEQ ID NO: 882880 - RNA, 19 nt, Homo sapiens
caucuuaccacauacaguu

SEQ ID NO: 882881 - RNA, 19 nt, Homo sapiens
uaauucugcuuacgguuga

SEQ ID NO: 882882 - RNA, 19 nt, Homo sapiens
ccacauacaguucuuuaca

SEQ ID NO: 882883 - RNA, 19 nt, Homo sapiens
cuguugaucuuuccuuuga

SEQ ID NO: 882884 - RNA, 19 nt, Homo sapiens
gcggagcaccuucguguug

SEQ ID NO: 882885 - RNA, 19 nt, Homo sapiens
ugaaguaggucuuuuagau

SEQ ID NO: 882886 - RNA, 19 nt, Homo sapiens
ucaacucacugaaguaggu

SEQ ID NO: 882887 - RNA, 19 nt, Homo sapiens
uuacuuccuuuccaucuug

SEQ ID NO: 882888 - RNA, 19 nt, Homo sapiens
gaugugguacucuguguga

SEQ ID NO: 882889 - RNA, 19 nt, Homo sapiens
gaacuuccuugagucacau

SEQ ID NO: 882890 - RNA, 19 nt, Homo sapiens
gaagagugucguggccaua

SEQ ID NO: 882891 - RNA, 19 nt, Homo sapiens
acauacaguucuuuacaug

SEQ ID NO: 882892 - RNA, 19 nt, Homo sapiens
uaauguaagucauccuagu

SEQ ID NO: 882893 - RNA, 19 nt, Homo sapiens
ggaauuguagugacuccaa

SEQ ID NO: 882894 - RNA, 19 nt, Homo sapiens
caaacaaugccaaguccuu

SEQ ID NO: 882895 - RNA, 19 nt, Homo sapiens
ggaaggagaauagcauuac

SEQ ID NO: 882896 - RNA, 19 nt, Homo sapiens
guuagaguguaucuuuaug

SEQ ID NO: 882897 - RNA, 19 nt, Homo sapiens
gguuauaauugcuguaagg

SEQ ID NO: 882898 - RNA, 19 nt, Homo sapiens
ccaaugggaucagguagca

SEQ ID NO: 882899 - RNA, 19 nt, Homo sapiens
uaagucauccuaguuauag

SEQ ID NO: 882900 - RNA, 19 nt, Homo sapiens
uagcagaggagcuugagaa

SEQ ID NO: 882901 - RNA, 19 nt, Homo sapiens
gaaugucuugcaagucgua

SEQ ID NO: 882902 - RNA, 19 nt, Homo sapiens
cacagaaugucuugcaagu

SEQ ID NO: 882903 - RNA, 19 nt, Homo sapiens
ugguuagaguguaucuuua

SEQ ID NO: 882904 - RNA, 19 nt, Homo sapiens
ggaaauggucucagguuuu

SEQ ID NO: 882905 - RNA, 19 nt, Homo sapiens
cuucugauuucgucuguga

SEQ ID NO: 882906 - RNA, 19 nt, Homo sapiens
gcuuuauuauucccucaaa

SEQ ID NO: 882907 - RNA, 19 nt, Homo sapiens
aauauuugcucuucugucu

SEQ ID NO: 882908 - RNA, 19 nt, Homo sapiens
cuucucagagcuucuaaua

SEQ ID NO: 882909 - RNA, 19 nt, Homo sapiens
cuaguuuccuccuuuaaag

SEQ ID NO: 882910 - RNA, 19 nt, Homo sapiens
aauuugacauugccuguug

SEQ ID NO: 882911 - RNA, 19 nt, Homo sapiens
aaagacaucaacucacuga

SEQ ID NO: 882912 - RNA, 19 nt, Homo sapiens
gaaaucuggaaggagaaua

SEQ ID NO: 882913 - RNA, 19 nt, Homo sapiens
gguuagaguguaucuuuau

SEQ ID NO: 882914 - RNA, 19 nt, Homo sapiens
uuucuaguuuccuccuuua

SEQ ID NO: 882915 - RNA, 19 nt, Homo sapiens
ugacauugccuguugaucu

SEQ ID NO: 882916 - RNA, 19 nt, Homo sapiens
gagucacauucuccuuaaa

SEQ ID NO: 882917 - RNA, 19 nt, Homo sapiens
gauuucgucugugaaugaa

SEQ ID NO: 882918 - RNA, 19 nt, Homo sapiens
uuagaaagacaucaacuca

SEQ ID NO: 882919 - RNA, 19 nt, Homo sapiens
gggaucagguagcaaucga

SEQ ID NO: 882920 - RNA, 19 nt, Homo sapiens
gggcuuacugaacauaauu

SEQ ID NO: 882921 - RNA, 19 nt, Homo sapiens
uguaguagacauuggcuaa

SEQ ID NO: 882922 - RNA, 19 nt, Homo sapiens
gcagaggagcuugagaaug

SEQ ID NO: 882923 - RNA, 19 nt, Homo sapiens
uaccacauacaguucuuua

SEQ ID NO: 882924 - RNA, 19 nt, Homo sapiens
cugaacauaauucugcuua

SEQ ID NO: 882925 - RNA, 19 nt, Homo sapiens
cacauacaguucuuuacau

SEQ ID NO: 882926 - RNA, 19 nt, Homo sapiens
ccucaaugcuuguaaacac

SEQ ID NO: 882927 - RNA, 19 nt, Homo sapiens
ggaaauucuguauuagauc

SEQ ID NO: 882928 - RNA, 19 nt, Homo sapiens
ugcuuacgguugaauaauu

SEQ ID NO: 882929 - RNA, 19 nt, Homo sapiens
aaguaugucuugugugcuu

SEQ ID NO: 882930 - RNA, 19 nt, Homo sapiens
ugaaaaguaugucuugugu

SEQ ID NO: 882931 - RNA, 19 nt, Homo sapiens
uguaagucauccuaguuau

SEQ ID NO: 882932 - RNA, 19 nt, Homo sapiens
aaacaauuagguggacaua

SEQ ID NO: 882933 - RNA, 19 nt, Homo sapiens
aaaggaaacacaugguuag

SEQ ID NO: 882934 - RNA, 19 nt, Homo sapiens
gccuguugaucuuuccuuu

SEQ ID NO: 882935 - RNA, 19 nt, Homo sapiens
ugauuucgucugugaauga

SEQ ID NO: 882936 - RNA, 19 nt, Homo sapiens
uuagauaacccugaacuuc

SEQ ID NO: 882937 - RNA, 19 nt, Homo sapiens
gaaacaauuagguggacau

SEQ ID NO: 882938 - RNA, 19 nt, Homo sapiens
gggagccauuacuuccuuu

SEQ ID NO: 882939 - RNA, 19 nt, Homo sapiens
gaaggagaauagcauuacc

SEQ ID NO: 882940 - RNA, 19 nt, Homo sapiens
uggaaggagaauagcauua

SEQ ID NO: 882941 - RNA, 19 nt, Homo sapiens
ugugucaccuccuuucuag

SEQ ID NO: 882942 - RNA, 19 nt, Homo sapiens
guugaucuuuccuuugaca

SEQ ID NO: 882943 - RNA, 19 nt, Homo sapiens
guaaggugggagccaguaa

SEQ ID NO: 882944 - RNA, 19 nt, Homo sapiens
cauccuaguuauagucucu

SEQ ID NO: 882945 - RNA, 19 nt, Homo sapiens
caauuagguggacauaaau

SEQ ID NO: 882946 - RNA, 19 nt, Homo sapiens
uaaauagucuuccugcaua

SEQ ID NO: 882947 - RNA, 19 nt, Homo sapiens
gaacaaaggaaguaaacua

SEQ ID NO: 882948 - RNA, 19 nt, Homo sapiens
guagaacacuugcaaggua

SEQ ID NO: 882949 - RNA, 19 nt, Homo sapiens
gaagcaaacugauuauagu

SEQ ID NO: 882950 - RNA, 19 nt, Homo sapiens
cagaggagcuugagaaugu

SEQ ID NO: 882951 - RNA, 19 nt, Homo sapiens
ggaaguaaacuaauccuuu

SEQ ID NO: 882952 - RNA, 19 nt, Homo sapiens
ucauguagcugcuguguaa

SEQ ID NO: 882953 - RNA, 19 nt, Homo sapiens
gaggaaauguaaugaggua

SEQ ID NO: 882954 - RNA, 19 nt, Homo sapiens
gaaaagaacuaguauggaa

SEQ ID NO: 882955 - RNA, 19 nt, Homo sapiens
guaauuaucugcagcaagu

SEQ ID NO: 882956 - RNA, 19 nt, Homo sapiens
cuaaauagcuaacuaacug

SEQ ID NO: 882957 - RNA, 19 nt, Homo sapiens
gauagucacugggaacuuu

SEQ ID NO: 882958 - RNA, 19 nt, Homo sapiens
gaaaagaacccucuggaua

SEQ ID NO: 882959 - RNA, 19 nt, Homo sapiens
guucgcaucuuaccacaua

SEQ ID NO: 882960 - RNA, 19 nt, Homo sapiens
caaaggaaguaaacuaauc

SEQ ID NO: 882961 - RNA, 19 nt, Homo sapiens
guuguuaggugaugucuuu

SEQ ID NO: 882962 - RNA, 19 nt, Homo sapiens
ggguaugccuccuagaaua

SEQ ID NO: 882963 - RNA, 19 nt, Homo sapiens
aaacagcacuugcccuuga

SEQ ID NO: 882964 - RNA, 19 nt, Homo sapiens
ugacaagacuaaucaguau

SEQ ID NO: 882965 - RNA, 19 nt, Homo sapiens
ggaaauagaaauuggagaa

SEQ ID NO: 882966 - RNA, 19 nt, Homo sapiens
cagaauaguugguauguca

SEQ ID NO: 882967 - RNA, 19 nt, Homo sapiens
caaucgaccucaggaaaua

SEQ ID NO: 882968 - RNA, 19 nt, Homo sapiens
gagagaaauuagcauauuc

SEQ ID NO: 882969 - RNA, 19 nt, Homo sapiens
ugagaauguucgcaucuua

SEQ ID NO: 882970 - RNA, 19 nt, Homo sapiens
caagagagaaauuagcaua

SEQ ID NO: 882971 - RNA, 19 nt, Homo sapiens
gcuagucauuccugucaua

SEQ ID NO: 882972 - RNA, 19 nt, Homo sapiens
gcaccuucguguugaguaa

SEQ ID NO: 882973 - RNA, 19 nt, Homo sapiens
ggcagaagcaaacugauua

SEQ ID NO: 882974 - RNA, 19 nt, Homo sapiens
acugauggcuggagaaauu

SEQ ID NO: 882975 - RNA, 19 nt, Homo sapiens
ggaaauguaaugagguaaa

SEQ ID NO: 882976 - RNA, 19 nt, Homo sapiens
aaagaacccucuggauauu

SEQ ID NO: 882977 - RNA, 19 nt, Homo sapiens
ggacgucagugaugagaag

SEQ ID NO: 882978 - RNA, 19 nt, Homo sapiens
gaaauuggagaaucugguu

SEQ ID NO: 882979 - RNA, 19 nt, Homo sapiens
gaauguggaucugguagug

SEQ ID NO: 882980 - RNA, 19 nt, Homo sapiens
guaaugagguaaaagauga

SEQ ID NO: 882981 - RNA, 19 nt, Homo sapiens
gcagaaucaugaagaccuu

SEQ ID NO: 882982 - RNA, 19 nt, Homo sapiens
ggacaacuuuggacauaac

SEQ ID NO: 882983 - RNA, 19 nt, Homo sapiens
ucacaugaggguaguauuu

SEQ ID NO: 882984 - RNA, 19 nt, Homo sapiens
gcugaugcauuuagaaagu

SEQ ID NO: 882985 - RNA, 19 nt, Homo sapiens
gacaucaacucacugaagu

SEQ ID NO: 882986 - RNA, 19 nt, Homo sapiens
acugggaacuuuauauuga

SEQ ID NO: 882987 - RNA, 19 nt, Homo sapiens
gcaggggcuuucaguauua

SEQ ID NO: 882988 - RNA, 19 nt, Homo sapiens
gcaacacaccauuguagaa

SEQ ID NO: 882989 - RNA, 19 nt, Homo sapiens
aauaagagaugugcagaga

SEQ ID NO: 882990 - RNA, 19 nt, Homo sapiens
aaggacaacuuuggacaua

SEQ ID NO: 882991 - RNA, 19 nt, Homo sapiens
uagaacacuugcaagguaa

SEQ ID NO: 882992 - RNA, 19 nt, Homo sapiens
gaauaaagacuacauuucc

SEQ ID NO: 882993 - RNA, 19 nt, Homo sapiens
ccucaaagcggccaacauu

SEQ ID NO: 882994 - RNA, 19 nt, Homo sapiens
ccacugugcuccucaacga

SEQ ID NO: 882995 - RNA, 19 nt, Homo sapiens
ucagauaaauugacaagac

SEQ ID NO: 882996 - RNA, 19 nt, Homo sapiens
guccuugucuuugguuaua

SEQ ID NO: 882997 - RNA, 19 nt, Homo sapiens
aaacauagcguggaacuca

SEQ ID NO: 882998 - RNA, 19 nt, Homo sapiens
uagcugcuguguaacauga

SEQ ID NO: 882999 - RNA, 19 nt, Homo sapiens
gugguuggacugucauuua

SEQ ID NO: 883000 - RNA, 19 nt, Homo sapiens
ggucuaaauagcuaacuaa

SEQ ID NO: 883001 - RNA, 19 nt, Homo sapiens
ggaacuuuauauugaggaa

SEQ ID NO: 883002 - RNA, 19 nt, Homo sapiens
uguugaggcugaugcauuu

SEQ ID NO: 883003 - RNA, 19 nt, Homo sapiens
uaacaccauuggcuucaug

SEQ ID NO: 883004 - RNA, 19 nt, Homo sapiens
gcaaucgaccucaggaaau

SEQ ID NO: 883005 - RNA, 19 nt, Homo sapiens
ugaagaaacaccauaagug

SEQ ID NO: 883006 - RNA, 19 nt, Homo sapiens
gguaugccuccuagaauaa

SEQ ID NO: 883007 - RNA, 19 nt, Homo sapiens
uguguaacaugaccuuaaa

SEQ ID NO: 883008 - RNA, 19 nt, Homo sapiens
ggugggagccaguaauuau

SEQ ID NO: 883009 - RNA, 19 nt, Homo sapiens
gaaguaggucuuuuagaua

SEQ ID NO: 883010 - RNA, 19 nt, Homo sapiens
agaaagacaucaacucacu

SEQ ID NO: 883011 - RNA, 19 nt, Homo sapiens
gcaaaaggguauucaucaa

SEQ ID NO: 883012 - RNA, 19 nt, Homo sapiens
ccauguguauuucaaacaa

SEQ ID NO: 883013 - RNA, 19 nt, Homo sapiens
aaacuugggccauguguau

SEQ ID NO: 883014 - RNA, 19 nt, Homo sapiens
ggaaauggagaaauuggau

SEQ ID NO: 883015 - RNA, 19 nt, Homo sapiens
uguacgaccucauugaaga

SEQ ID NO: 883016 - RNA, 19 nt, Homo sapiens
aacaugaccuuaaauaguc

SEQ ID NO: 883017 - RNA, 19 nt, Homo sapiens
gacauaacacugacuagga

SEQ ID NO: 883018 - RNA, 19 nt, Homo sapiens
acaugaggguaguauuuaa

SEQ ID NO: 883019 - RNA, 19 nt, Homo sapiens
gcaaggaaaagaacuagua

SEQ ID NO: 883020 - RNA, 19 nt, Homo sapiens
acacaccauuguagaagaa

SEQ ID NO: 883021 - RNA, 19 nt, Homo sapiens
ggggucaucuaaauaauaa

SEQ ID NO: 883022 - RNA, 19 nt, Homo sapiens
caucuuaccacauacaguu

SEQ ID NO: 883023 - RNA, 19 nt, Homo sapiens
agucauuccugucauauuc

SEQ ID NO: 883024 - RNA, 19 nt, Homo sapiens
guugagagcuuuugcauca

SEQ ID NO: 883025 - RNA, 19 nt, Homo sapiens
ccacauacaguucuuuaca

SEQ ID NO: 883026 - RNA, 19 nt, Homo sapiens
uaauggcacucauacaucu

SEQ ID NO: 883027 - RNA, 19 nt, Homo sapiens
ucacugggaacuuuauauu

SEQ ID NO: 883028 - RNA, 19 nt, Homo sapiens
agaacccucuggauauuga

SEQ ID NO: 883029 - RNA, 19 nt, Homo sapiens
uaaguggcguggacuaucu

SEQ ID NO: 883030 - RNA, 19 nt, Homo sapiens
gugcagguaugacuguguu

SEQ ID NO: 883031 - RNA, 19 nt, Homo sapiens
cacaugaggguaguauuua

SEQ ID NO: 883032 - RNA, 19 nt, Homo sapiens
gaaacuugggccaugugua

SEQ ID NO: 883033 - RNA, 19 nt, Homo sapiens
gcggagcaccuucguguug

SEQ ID NO: 883034 - RNA, 19 nt, Homo sapiens
ugaaguaggucuuuuagau

SEQ ID NO: 883035 - RNA, 19 nt, Homo sapiens
ucaacucacugaaguaggu

SEQ ID NO: 883036 - RNA, 19 nt, Homo sapiens
gaagagugucguggccaua

SEQ ID NO: 883037 - RNA, 19 nt, Homo sapiens
ccuucaauauccauucuuu

SEQ ID NO: 883038 - RNA, 19 nt, Homo sapiens
gcagagagcaccaauuuuc

SEQ ID NO: 883039 - RNA, 19 nt, Homo sapiens
gaugaacaaaggaaguaaa

SEQ ID NO: 883040 - RNA, 19 nt, Homo sapiens
caacaauaauggcacucau

SEQ ID NO: 883041 - RNA, 19 nt, Homo sapiens
aauuggaugugaucggaua

SEQ ID NO: 883042 - RNA, 19 nt, Homo sapiens
acauacaguucuuuacaug

SEQ ID NO: 883043 - RNA, 19 nt, Homo sapiens
gcagaagcaaacugauuau

SEQ ID NO: 883044 - RNA, 19 nt, Homo sapiens
ggagaaauuggaugugauc

SEQ ID NO: 883045 - RNA, 19 nt, Homo sapiens
ggaauuguagugacuccaa

SEQ ID NO: 883046 - RNA, 19 nt, Homo sapiens
gaacucaucuuugucaaug

SEQ ID NO: 883047 - RNA, 19 nt, Homo sapiens
caagaaagguuuaagaagu

SEQ ID NO: 883048 - RNA, 19 nt, Homo sapiens
gacauuagcuacccagaaa

SEQ ID NO: 883049 - RNA, 19 nt, Homo sapiens
gaucaaagauauggugaaa

SEQ ID NO: 883050 - RNA, 19 nt, Homo sapiens
ggaaagacaugugaacaga

SEQ ID NO: 883051 - RNA, 19 nt, Homo sapiens
gcaaagguguggcuuaaag

SEQ ID NO: 883052 - RNA, 19 nt, Homo sapiens
caagugaacugcaggaauc

SEQ ID NO: 883053 - RNA, 19 nt, Homo sapiens
gcucaucaaucccaccuaa

SEQ ID NO: 883054 - RNA, 19 nt, Homo sapiens
cagcaaagguguggcuuaa

SEQ ID NO: 883055 - RNA, 19 nt, Homo sapiens
gaacaguugucagagaaga

SEQ ID NO: 883056 - RNA, 19 nt, Homo sapiens
gggcaucccuccaccagaa

SEQ ID NO: 883057 - RNA, 19 nt, Homo sapiens
cugaaacgaugcacauuaa

SEQ ID NO: 883058 - RNA, 19 nt, Homo sapiens
gggaacaguugucagagaa

SEQ ID NO: 883059 - RNA, 19 nt, Homo sapiens
caaggcaaauuauaaguag

SEQ ID NO: 883060 - RNA, 19 nt, Homo sapiens
gaagaggauccaagaagaa

SEQ ID NO: 883061 - RNA, 19 nt, Homo sapiens
gaacagaguuaagguacca

SEQ ID NO: 883062 - RNA, 19 nt, Homo sapiens
caacacccaucccaggaaa

SEQ ID NO: 883063 - RNA, 19 nt, Homo sapiens
gcaagaagaagaagaccaa

SEQ ID NO: 883064 - RNA, 19 nt, Homo sapiens
gaucgugacugcuguguac

SEQ ID NO: 883065 - RNA, 19 nt, Homo sapiens
gcucuggccucucuacaug

SEQ ID NO: 883066 - RNA, 19 nt, Homo sapiens
ccgcagagguggugaacuu

SEQ ID NO: 883067 - RNA, 19 nt, Homo sapiens
guaaagaacagccaaccuu

SEQ ID NO: 883068 - RNA, 19 nt, Homo sapiens
ucaaagauauggugaaagc

SEQ ID NO: 883069 - RNA, 19 nt, Homo sapiens
uggcugggauucuuucuuu

SEQ ID NO: 883070 - RNA, 19 nt, Homo sapiens
ggaaccaauuugagggaaa

SEQ ID NO: 883071 - RNA, 19 nt, Homo sapiens
agaagaggauccaagaaga

SEQ ID NO: 883072 - RNA, 19 nt, Homo sapiens
agcagaagcugaacagaaa

SEQ ID NO: 883073 - RNA, 19 nt, Homo sapiens
cagccaaccuucucuggaa

SEQ ID NO: 883074 - RNA, 19 nt, Homo sapiens
cagaaauggugacuggauu

SEQ ID NO: 883075 - RNA, 19 nt, Homo sapiens
gguguggcuuaaaggauua

SEQ ID NO: 883076 - RNA, 19 nt, Homo sapiens
gauccaagaagaauaugaa

SEQ ID NO: 883077 - RNA, 19 nt, Homo sapiens
ccacguugcuguccaugug

SEQ ID NO: 883078 - RNA, 19 nt, Homo sapiens
gcagcaaagguguggcuua

SEQ ID NO: 883079 - RNA, 19 nt, Homo sapiens
gagaagaggauccaagaag

SEQ ID NO: 883080 - RNA, 19 nt, Homo sapiens
gaaccaauuugagggaaag

SEQ ID NO: 883081 - RNA, 19 nt, Homo sapiens
gaggauccaagaagaauau

SEQ ID NO: 883082 - RNA, 19 nt, Homo sapiens
uaacugcccucccguucug

SEQ ID NO: 883083 - RNA, 19 nt, Homo sapiens
gcacaacgagaaccugaau

SEQ ID NO: 883084 - RNA, 19 nt, Homo sapiens
gccaagaaagguuuaagaa

SEQ ID NO: 883085 - RNA, 19 nt, Homo sapiens
aaagacaugugaacagagu

SEQ ID NO: 883086 - RNA, 19 nt, Homo sapiens
cacaggagcugccaguauc

SEQ ID NO: 883087 - RNA, 19 nt, Homo sapiens
cagcaaccaucaccaucuu

SEQ ID NO: 883088 - RNA, 19 nt, Homo sapiens
gaagaggccgaacccauca

SEQ ID NO: 883089 - RNA, 19 nt, Homo sapiens
caucaaaacugcaaaccaa

SEQ ID NO: 883090 - RNA, 19 nt, Homo sapiens
gaaccugcauaagcgcauu

SEQ ID NO: 883091 - RNA, 19 nt, Homo sapiens
aagaaaggcuaccguacug

SEQ ID NO: 883092 - RNA, 19 nt, Homo sapiens
ucaccacucugaugcacaa

SEQ ID NO: 883093 - RNA, 19 nt, Homo sapiens
gcggaguacuucaagaaca

SEQ ID NO: 883094 - RNA, 19 nt, Homo sapiens
ggaagccaagaaagguuua

SEQ ID NO: 883095 - RNA, 19 nt, Homo sapiens
ucugaaacgaugcacauua

SEQ ID NO: 883096 - RNA, 19 nt, Homo sapiens
gaaaggcuaccguacugau

SEQ ID NO: 883097 - RNA, 19 nt, Homo sapiens
agacaugugaacagaguua

SEQ ID NO: 883098 - RNA, 19 nt, Homo sapiens
aagaaagguuuaagaaguc

SEQ ID NO: 883099 - RNA, 19 nt, Homo sapiens
agaaacagcgaggguauaa

SEQ ID NO: 883100 - RNA, 19 nt, Homo sapiens
auaaguagggaaccaauuu

SEQ ID NO: 883101 - RNA, 19 nt, Homo sapiens
ccacaggagcugccaguau

SEQ ID NO: 883102 - RNA, 19 nt, Homo sapiens
gagaggaggcccacuaugc

SEQ ID NO: 883103 - RNA, 19 nt, Homo sapiens
aaccauaggcucacagaaa

SEQ ID NO: 883104 - RNA, 19 nt, Homo sapiens
acacaucguucgcuguuag

SEQ ID NO: 883105 - RNA, 19 nt, Homo sapiens
gcagagguggugaacuuug

SEQ ID NO: 883106 - RNA, 19 nt, Homo sapiens
ccaggaagcagaagcugaa

SEQ ID NO: 883107 - RNA, 19 nt, Homo sapiens
agaaguggaaccugcauaa

SEQ ID NO: 883108 - RNA, 19 nt, Homo sapiens
uaucauccuuucccaguuc

SEQ ID NO: 883109 - RNA, 19 nt, Homo sapiens
aaagggaacaguugucaga

SEQ ID NO: 883110 - RNA, 19 nt, Homo sapiens
guagaaacagcgaggguau

SEQ ID NO: 883111 - RNA, 19 nt, Homo sapiens
gagcccagccucuuguaga

SEQ ID NO: 883112 - RNA, 19 nt, Homo sapiens
caacaaccacaaacacauc

SEQ ID NO: 883113 - RNA, 19 nt, Homo sapiens
cagagaagaggauccaaga

SEQ ID NO: 883114 - RNA, 19 nt, Homo sapiens
gcaacacccaucccaggaa

SEQ ID NO: 883115 - RNA, 19 nt, Homo sapiens
gagaaguggaaccugcaua

SEQ ID NO: 883116 - RNA, 19 nt, Homo sapiens
gcucaaggcaaauuauaag

SEQ ID NO: 883117 - RNA, 19 nt, Homo sapiens
gaaguccgcaugcaacucu

SEQ ID NO: 883118 - RNA, 19 nt, Homo sapiens
gcaugcugcugcucugcuu

SEQ ID NO: 883119 - RNA, 19 nt, Homo sapiens
gcaccuagaaugaaguuac

SEQ ID NO: 883120 - RNA, 19 nt, Homo sapiens
ggccugggagucaacguua

SEQ ID NO: 883121 - RNA, 19 nt, Homo sapiens
gaccaugcccugggagauu

SEQ ID NO: 883122 - RNA, 19 nt, Homo sapiens
aaagaaugauggagagaac

SEQ ID NO: 883123 - RNA, 19 nt, Homo sapiens
gcugggauucuuucuuuga

SEQ ID NO: 883124 - RNA, 19 nt, Homo sapiens
ccugggagauugucauucu

SEQ ID NO: 883125 - RNA, 19 nt, Homo sapiens
aagcagaagcugaacagaa

SEQ ID NO: 883126 - RNA, 19 nt, Homo sapiens
ugaauggugugcccucgau

SEQ ID NO: 883127 - RNA, 19 nt, Homo sapiens
acgcagaccucaccacucu

SEQ ID NO: 883128 - RNA, 19 nt, Homo sapiens
gaagauuccgccaccucaa

SEQ ID NO: 883129 - RNA, 19 nt, Homo sapiens
gcaaagaaaaccacuagga

SEQ ID NO: 883130 - RNA, 19 nt, Homo sapiens
ggaacucaucuuugucaau

SEQ ID NO: 883131 - RNA, 19 nt, Homo sapiens
ccaagaaagguuuaagaag

SEQ ID NO: 883132 - RNA, 19 nt, Homo sapiens
gccaucgucuucagcuaug

SEQ ID NO: 883133 - RNA, 19 nt, Homo sapiens
ccacucugaugcacaacga

SEQ ID NO: 883134 - RNA, 19 nt, Homo sapiens
ggauugggaaccagauguu

SEQ ID NO: 883135 - RNA, 19 nt, Homo sapiens
cuacauggauugggaacca

SEQ ID NO: 883136 - RNA, 19 nt, Homo sapiens
ggagauugucauucugguu

SEQ ID NO: 883137 - RNA, 19 nt, Homo sapiens
gcuggcaccuagaaugaag

SEQ ID NO: 883138 - RNA, 19 nt, Homo sapiens
uaaguagggaaccaauuug

SEQ ID NO: 883139 - RNA, 19 nt, Homo sapiens
ggaccgagcccaucaucac

SEQ ID NO: 883140 - RNA, 19 nt, Homo sapiens
ggaagcagaagcugaacag

SEQ ID NO: 883141 - RNA, 19 nt, Homo sapiens
cugcugcucugcuucaugu

SEQ ID NO: 883142 - RNA, 19 nt, Homo sapiens
gcuacuagagucuuaccaa

SEQ ID NO: 883143 - RNA, 19 nt, Homo sapiens
cagcaccacagcucaagaa

SEQ ID NO: 883144 - RNA, 19 nt, Homo sapiens
ggcucaaggcaaauuauaa

SEQ ID NO: 883145 - RNA, 19 nt, Homo sapiens
ccauaucccucaucaugcu

SEQ ID NO: 883146 - RNA, 19 nt, Homo sapiens
gguguaagcucuagcaauu

SEQ ID NO: 883147 - RNA, 19 nt, Homo sapiens
ggaaacagcuacauugaag

SEQ ID NO: 883148 - RNA, 19 nt, Homo sapiens
caauggagguccugaugua

SEQ ID NO: 883149 - RNA, 19 nt, Homo sapiens
caaaagagcaccuaaguua

SEQ ID NO: 883150 - RNA, 19 nt, Homo sapiens
gagggcaacugguguguuu

SEQ ID NO: 883151 - RNA, 19 nt, Homo sapiens
uguaagcucuagcaauuua

SEQ ID NO: 883152 - RNA, 19 nt, Homo sapiens
aaauggagcucucuaugaa

SEQ ID NO: 883153 - RNA, 19 nt, Homo sapiens
caacugguguguuuauaug

SEQ ID NO: 883154 - RNA, 19 nt, Homo sapiens
aaagagcaccuaaguuaua

SEQ ID NO: 883155 - RNA, 19 nt, Homo sapiens
gcagucagauucacauauc

SEQ ID NO: 883156 - RNA, 19 nt, Homo sapiens
caucauucuugucacauua

SEQ ID NO: 883157 - RNA, 19 nt, Homo sapiens
ggcaccaaguggaauauua

SEQ ID NO: 883158 - RNA, 19 nt, Homo sapiens
ggcagaagcuguauuaaac

SEQ ID NO: 883159 - RNA, 19 nt, Homo sapiens
uggcagaucucuuguccua

SEQ ID NO: 883160 - RNA, 19 nt, Homo sapiens
gaagauugucauucugaua

SEQ ID NO: 883161 - RNA, 19 nt, Homo sapiens
aaacucaucuggauacauc

SEQ ID NO: 883162 - RNA, 19 nt, Homo sapiens
caacaaacucaucuggaua

SEQ ID NO: 883163 - RNA, 19 nt, Homo sapiens
gggcagaagcuguauuaaa

SEQ ID NO: 883164 - RNA, 19 nt, Homo sapiens
gaagcuguauuaaacuugu

SEQ ID NO: 883165 - RNA, 19 nt, Homo sapiens
caaaucaacuggugagacu

SEQ ID NO: 883166 - RNA, 19 nt, Homo sapiens
acagcuacauugaagauaa

SEQ ID NO: 883167 - RNA, 19 nt, Homo sapiens
cagagcagaugaugaugaa

SEQ ID NO: 883168 - RNA, 19 nt, Homo sapiens
ccacuugacuauaaauaca

SEQ ID NO: 883169 - RNA, 19 nt, Homo sapiens
uaccaggacugaugcaauu

SEQ ID NO: 883170 - RNA, 19 nt, Homo sapiens
ccagagacccugaaauaug

SEQ ID NO: 883171 - RNA, 19 nt, Homo sapiens
ugaaaguccugcugaaaca

SEQ ID NO: 883172 - RNA, 19 nt, Homo sapiens
ucaacaaacucaucuggau

SEQ ID NO: 883173 - RNA, 19 nt, Homo sapiens
gcagaucucuuguccuacu

SEQ ID NO: 883174 - RNA, 19 nt, Homo sapiens
ggaacagucucuugauggu

SEQ ID NO: 883175 - RNA, 19 nt, Homo sapiens
gauggguggugucuaguga

SEQ ID NO: 883176 - RNA, 19 nt, Homo sapiens
gagcagaugaugaugaaga

SEQ ID NO: 883177 - RNA, 19 nt, Homo sapiens
cagagacccugaaauaugg

SEQ ID NO: 883178 - RNA, 19 nt, Homo sapiens
ugaggaagauugucauucu

SEQ ID NO: 883179 - RNA, 19 nt, Homo sapiens
cagaagcuguauuaaacuu

SEQ ID NO: 883180 - RNA, 19 nt, Homo sapiens
ugccagagacccugaaaua

SEQ ID NO: 883181 - RNA, 19 nt, Homo sapiens
ggcagaagcugaggaagau

SEQ ID NO: 883182 - RNA, 19 nt, Homo sapiens
caaguccaguccucuauca

SEQ ID NO: 883183 - RNA, 19 nt, Homo sapiens
gaacuugcuccagguguaa

SEQ ID NO: 883184 - RNA, 19 nt, Homo sapiens
ugaacuugcuccaggugua

SEQ ID NO: 883185 - RNA, 19 nt, Homo sapiens
gguggugucuagugacuug

SEQ ID NO: 883186 - RNA, 19 nt, Homo sapiens
aagagcaccuaaguuauaa

SEQ ID NO: 883187 - RNA, 19 nt, Homo sapiens
ggauacaucauucuuguca

SEQ ID NO: 883188 - RNA, 19 nt, Homo sapiens
gcaacugguguguuuauau

SEQ ID NO: 883189 - RNA, 19 nt, Homo sapiens
uaucagugcugccaaugga

SEQ ID NO: 883190 - RNA, 19 nt, Homo sapiens
gaaugagaaauguagauug

SEQ ID NO: 883191 - RNA, 19 nt, Homo sapiens
ggaagauugucauucugau

SEQ ID NO: 883192 - RNA, 19 nt, Homo sapiens
guccauuguuccacguuua

SEQ ID NO: 883193 - RNA, 19 nt, Homo sapiens
gagccucaguccauuguuc

SEQ ID NO: 883194 - RNA, 19 nt, Homo sapiens
aacagucucuugaugguuu

SEQ ID NO: 883195 - RNA, 19 nt, Homo sapiens
gauggcguguauaucagua

SEQ ID NO: 883196 - RNA, 19 nt, Homo sapiens
ucaggagucugugcuuaaa

SEQ ID NO: 883197 - RNA, 19 nt, Homo sapiens
cuaugaagccaucaaguuu

SEQ ID NO: 883198 - RNA, 19 nt, Homo sapiens
caccagagguucaacaaac

SEQ ID NO: 883199 - RNA, 19 nt, Homo sapiens
caaucagaccaaaguauuu

SEQ ID NO: 883200 - RNA, 19 nt, Homo sapiens
ugaagagccucaguccauu

SEQ ID NO: 883201 - RNA, 19 nt, Homo sapiens
uaaugaugaugacagcaaa

SEQ ID NO: 883202 - RNA, 19 nt, Homo sapiens
gaagagccucaguccauug

SEQ ID NO: 883203 - RNA, 19 nt, Homo sapiens
caaaauggcagaucucuug

SEQ ID NO: 883204 - RNA, 19 nt, Homo sapiens
ggcaacugguguguuuaua

SEQ ID NO: 883205 - RNA, 19 nt, Homo sapiens
ucagaucauuggagcaguu

SEQ ID NO: 883206 - RNA, 19 nt, Homo sapiens
gcaacuuguaccugauaua

SEQ ID NO: 883207 - RNA, 19 nt, Homo sapiens
aggcacaacuccagauguu

SEQ ID NO: 883208 - RNA, 19 nt, Homo sapiens
aaaugaaaguccugcugaa

SEQ ID NO: 883209 - RNA, 19 nt, Homo sapiens
ggaauauuacagguacaua

SEQ ID NO: 883210 - RNA, 19 nt, Homo sapiens
guuuauaugccugacauua

SEQ ID NO: 883211 - RNA, 19 nt, Homo sapiens
guagggcuaugcaacuugu

SEQ ID NO: 883212 - RNA, 19 nt, Homo sapiens
gcucgagaacucuuccuaa

SEQ ID NO: 883213 - RNA, 19 nt, Homo sapiens
acaaucagaccaaaguauu

SEQ ID NO: 883214 - RNA, 19 nt, Homo sapiens
gaggaagauugucauucug

SEQ ID NO: 883215 - RNA, 19 nt, Homo sapiens
cagcuacauugaagauaau

SEQ ID NO: 883216 - RNA, 19 nt, Homo sapiens
cucgagaacucuuccuaaa

SEQ ID NO: 883217 - RNA, 19 nt, Homo sapiens
gagcucaguggauguuuga

SEQ ID NO: 883218 - RNA, 19 nt, Homo sapiens
gacaaucagaccaaaguau

SEQ ID NO: 883219 - RNA, 19 nt, Homo sapiens
gagcagucagauucacaua

SEQ ID NO: 883220 - RNA, 19 nt, Homo sapiens
caacuuguaccugauauag

SEQ ID NO: 883221 - RNA, 19 nt, Homo sapiens
cagaaaacaucggcagaua

SEQ ID NO: 883222 - RNA, 19 nt, Homo sapiens
caggacugaugcaauucua

SEQ ID NO: 883223 - RNA, 19 nt, Homo sapiens
gaaacagcuacauugaaga

SEQ ID NO: 883224 - RNA, 19 nt, Homo sapiens
acaagaagcagaucagagu

SEQ ID NO: 883225 - RNA, 19 nt, Homo sapiens
ugacuuggaccucagauca

SEQ ID NO: 883226 - RNA, 19 nt, Homo sapiens
cggcagauaccaaaggaaa

SEQ ID NO: 883227 - RNA, 19 nt, Homo sapiens
cguuuaagaacuaggaaua

SEQ ID NO: 883228 - RNA, 19 nt, Homo sapiens
guuggaaacagcuacauug

SEQ ID NO: 883229 - RNA, 19 nt, Homo sapiens
gcaccaaguggaauauuac

SEQ ID NO: 883230 - RNA, 19 nt, Homo sapiens
gaacagucucuugaugguu

SEQ ID NO: 883231 - RNA, 19 nt, Homo sapiens
gggcaacugguguguuuau

SEQ ID NO: 883232 - RNA, 19 nt, Homo sapiens
cgagaacucuuccuaaaag

SEQ ID NO: 883233 - RNA, 19 nt, Homo sapiens
aaacaucggcagauaccaa

SEQ ID NO: 883234 - RNA, 19 nt, Homo sapiens
aaugagaaauguagauugc

SEQ ID NO: 883235 - RNA, 19 nt, Homo sapiens
uuucaggagucugugcuua

SEQ ID NO: 883236 - RNA, 19 nt, Homo sapiens
cgagcucaguggauguuug

SEQ ID NO: 883237 - RNA, 19 nt, Homo sapiens
aaacagcuacauugaagau

SEQ ID NO: 883238 - RNA, 19 nt, Homo sapiens
uaaaagcaguagaagaaga

SEQ ID NO: 883239 - RNA, 19 nt, Homo sapiens
cagcagcaacucacauuuc

SEQ ID NO: 883240 - RNA, 19 nt, Homo sapiens
ucuaugaagccaucaaguu

SEQ ID NO: 883241 - RNA, 19 nt, Homo sapiens
caguggauguuugaacuug

SEQ ID NO: 883242 - RNA, 19 nt, Homo sapiens
cuggauacaucauucuugu

SEQ ID NO: 883243 - RNA, 19 nt, Homo sapiens
cacaagacacagacaauca

SEQ ID NO: 883244 - RNA, 19 nt, Homo sapiens
ugucagagcagaugaugau

SEQ ID NO: 883245 - RNA, 19 nt, Homo sapiens
cgucuggccugcuugaaag

SEQ ID NO: 883246 - RNA, 19 nt, Homo sapiens
gauaguacacguuauguua

SEQ ID NO: 883247 - RNA, 19 nt, Homo sapiens
gguguaagcucuagcaauu

SEQ ID NO: 883248 - RNA, 19 nt, Homo sapiens
gcaccuaaguuauaaaugu

SEQ ID NO: 883249 - RNA, 19 nt, Homo sapiens
ggaaacagcuacauugaag

SEQ ID NO: 883250 - RNA, 19 nt, Homo sapiens
guaggcaccuuaccaauau

SEQ ID NO: 883251 - RNA, 19 nt, Homo sapiens
caauggagguccugaugua

SEQ ID NO: 883252 - RNA, 19 nt, Homo sapiens
caaaagagcaccuaaguua

SEQ ID NO: 883253 - RNA, 19 nt, Homo sapiens
uguaagcucuagcaauuua

SEQ ID NO: 883254 - RNA, 19 nt, Homo sapiens
aaauggagcucucuaugaa

SEQ ID NO: 883255 - RNA, 19 nt, Homo sapiens
aaagagcaccuaaguuaua

SEQ ID NO: 883256 - RNA, 19 nt, Homo sapiens
ggugaaaugugcauacaga

SEQ ID NO: 883257 - RNA, 19 nt, Homo sapiens
gagccaagaucgugccauu

SEQ ID NO: 883258 - RNA, 19 nt, Homo sapiens
gugagaaaccuuaauauga

SEQ ID NO: 883259 - RNA, 19 nt, Homo sapiens
gcagucagauucacauauc

SEQ ID NO: 883260 - RNA, 19 nt, Homo sapiens
gacaaauucucauguacuu

SEQ ID NO: 883261 - RNA, 19 nt, Homo sapiens
caucauucuugucacauua

SEQ ID NO: 883262 - RNA, 19 nt, Homo sapiens
ggcaccaaguggaauauua

SEQ ID NO: 883263 - RNA, 19 nt, Homo sapiens
ggcagaagcuguauuaaac

SEQ ID NO: 883264 - RNA, 19 nt, Homo sapiens
uggcagaucucuuguccua

SEQ ID NO: 883265 - RNA, 19 nt, Homo sapiens
gaagauugucauucugaua

SEQ ID NO: 883266 - RNA, 19 nt, Homo sapiens
ccuauaaucccaauacuuu

SEQ ID NO: 883267 - RNA, 19 nt, Homo sapiens
gagagugaaucccuuagga

SEQ ID NO: 883268 - RNA, 19 nt, Homo sapiens
gcggagacuuuaagaauca

SEQ ID NO: 883269 - RNA, 19 nt, Homo sapiens
ugagaaaccuuaauaugag

SEQ ID NO: 883270 - RNA, 19 nt, Homo sapiens
aaacucaucuggauacauc

SEQ ID NO: 883271 - RNA, 19 nt, Homo sapiens
caacaaacucaucuggaua

SEQ ID NO: 883272 - RNA, 19 nt, Homo sapiens
gggcagaagcuguauuaaa

SEQ ID NO: 883273 - RNA, 19 nt, Homo sapiens
gaagcuguauuaaacuugu

SEQ ID NO: 883274 - RNA, 19 nt, Homo sapiens
caucauuggucuuuauaug

SEQ ID NO: 883275 - RNA, 19 nt, Homo sapiens
caaaucaacuggugagacu

SEQ ID NO: 883276 - RNA, 19 nt, Homo sapiens
gcagagacaggcaggagua

SEQ ID NO: 883277 - RNA, 19 nt, Homo sapiens
acagcuacauugaagauaa

SEQ ID NO: 883278 - RNA, 19 nt, Homo sapiens
cagagcagaugaugaugaa

SEQ ID NO: 883279 - RNA, 19 nt, Homo sapiens
gcagauuuaugagcagauu

SEQ ID NO: 883280 - RNA, 19 nt, Homo sapiens
ccacuugacuauaaauaca

SEQ ID NO: 883281 - RNA, 19 nt, Homo sapiens
uaccaggacugaugcaauu

SEQ ID NO: 883282 - RNA, 19 nt, Homo sapiens
ccagagacccugaaauaug

SEQ ID NO: 883283 - RNA, 19 nt, Homo sapiens
ugaaaguccugcugaaaca

SEQ ID NO: 883284 - RNA, 19 nt, Homo sapiens
ucacauaagucgucuucug

SEQ ID NO: 883285 - RNA, 19 nt, Homo sapiens
ucaacaaacucaucuggau

SEQ ID NO: 883286 - RNA, 19 nt, Homo sapiens
gcagaucucuuguccuacu

SEQ ID NO: 883287 - RNA, 19 nt, Homo sapiens
cacaaacacugaccucaug

SEQ ID NO: 883288 - RNA, 19 nt, Homo sapiens
ggaacagucucuugauggu

SEQ ID NO: 883289 - RNA, 19 nt, Homo sapiens
gauggguggugucuaguga

SEQ ID NO: 883290 - RNA, 19 nt, Homo sapiens
gagcagaugaugaugaaga

SEQ ID NO: 883291 - RNA, 19 nt, Homo sapiens
cccaguaacaguccuauua

SEQ ID NO: 883292 - RNA, 19 nt, Homo sapiens
uaagucgucuucugcuuga

SEQ ID NO: 883293 - RNA, 19 nt, Homo sapiens
uuaaagggauaguugauuc

SEQ ID NO: 883294 - RNA, 19 nt, Homo sapiens
cagagacccugaaauaugg

SEQ ID NO: 883295 - RNA, 19 nt, Homo sapiens
cuucauagguucccacaau

SEQ ID NO: 883296 - RNA, 19 nt, Homo sapiens
uaauaagaguccuagauag

SEQ ID NO: 883297 - RNA, 19 nt, Homo sapiens
ugaggaagauugucauucu

SEQ ID NO: 883298 - RNA, 19 nt, Homo sapiens
ggcagaagcugaggaagau

SEQ ID NO: 883299 - RNA, 19 nt, Homo sapiens
cagaagcuguauuaaacuu

SEQ ID NO: 883300 - RNA, 19 nt, Homo sapiens
ugccagagacccugaaaua

SEQ ID NO: 883301 - RNA, 19 nt, Homo sapiens
gaccucaucucuucuaaaa

SEQ ID NO: 883302 - RNA, 19 nt, Homo sapiens
cauguaaaccugagccuaa

SEQ ID NO: 883303 - RNA, 19 nt, Homo sapiens
gcaccuuaccaauauauga

SEQ ID NO: 883304 - RNA, 19 nt, Homo sapiens
caaguccaguccucuauca

SEQ ID NO: 883305 - RNA, 19 nt, Homo sapiens
gaacuugcuccagguguaa

SEQ ID NO: 883306 - RNA, 19 nt, Homo sapiens
ugaacuugcuccaggugua

SEQ ID NO: 883307 - RNA, 19 nt, Homo sapiens
aagagacacuucauagguu

SEQ ID NO: 883308 - RNA, 19 nt, Homo sapiens
gagccuaacucuuguucca

SEQ ID NO: 883309 - RNA, 19 nt, Homo sapiens
gaauuugagucugggaguu

SEQ ID NO: 883310 - RNA, 19 nt, Homo sapiens
gguggugucuagugacuug

SEQ ID NO: 883311 - RNA, 19 nt, Homo sapiens
caaauucucauguacuuuc

SEQ ID NO: 883312 - RNA, 19 nt, Homo sapiens
guucuggauuuguuugaaa

SEQ ID NO: 883313 - RNA, 19 nt, Homo sapiens
gcuugaguauccuaauauu

SEQ ID NO: 883314 - RNA, 19 nt, Homo sapiens
aagagcaccuaaguuauaa

SEQ ID NO: 883315 - RNA, 19 nt, Homo sapiens
ggauacaucauucuuguca

SEQ ID NO: 883316 - RNA, 19 nt, Homo sapiens
uaucagugcugccaaugga

SEQ ID NO: 883317 - RNA, 19 nt, Homo sapiens
gaugauaguacacguuaug

SEQ ID NO: 883318 - RNA, 19 nt, Homo sapiens
ggagagcaccagccaccua

SEQ ID NO: 883319 - RNA, 19 nt, Homo sapiens
uaagaaucauugccucuag

SEQ ID NO: 883320 - RNA, 19 nt, Homo sapiens
guccauuguuccacguuua

SEQ ID NO: 883321 - RNA, 19 nt, Homo sapiens
gagccucaguccauuguuc

SEQ ID NO: 883322 - RNA, 19 nt, Homo sapiens
ggaagauugucauucugau

SEQ ID NO: 883323 - RNA, 19 nt, Homo sapiens
aaccauaguuagagacaaa

SEQ ID NO: 883324 - RNA, 19 nt, Homo sapiens
gacauuaagugagagugaa

SEQ ID NO: 883325 - RNA, 19 nt, Homo sapiens
guugugagaaaccuuaaua

SEQ ID NO: 883326 - RNA, 19 nt, Homo sapiens
aacagucucuugaugguuu

SEQ ID NO: 883327 - RNA, 19 nt, Homo sapiens
gauggcguguauaucagua

SEQ ID NO: 883328 - RNA, 19 nt, Homo sapiens
ucaggagucugugcuuaaa

SEQ ID NO: 883329 - RNA, 19 nt, Homo sapiens
cuaugaagccaucaaguuu

SEQ ID NO: 883330 - RNA, 19 nt, Homo sapiens
cugcuugaguauccuaaua

SEQ ID NO: 883331 - RNA, 19 nt, Homo sapiens
caccagagguucaacaaac

SEQ ID NO: 883332 - RNA, 19 nt, Homo sapiens
caaucagaccaaaguauuu

SEQ ID NO: 883333 - RNA, 19 nt, Homo sapiens
ugaagagccucaguccauu

SEQ ID NO: 883334 - RNA, 19 nt, Homo sapiens
uaaugaugaugacagcaaa

SEQ ID NO: 883335 - RNA, 19 nt, Homo sapiens
guaacaguccuauuagugu

SEQ ID NO: 883336 - RNA, 19 nt, Homo sapiens
ggaggcugaugcaggagaa

SEQ ID NO: 883337 - RNA, 19 nt, Homo sapiens
cagcggagacuuuaagaau

SEQ ID NO: 883338 - RNA, 19 nt, Homo sapiens
gaagagccucaguccauug

SEQ ID NO: 883339 - RNA, 19 nt, Homo sapiens
uaagagacacuucauaggu

SEQ ID NO: 883340 - RNA, 19 nt, Homo sapiens
aauaguagaggaucaugua

SEQ ID NO: 883341 - RNA, 19 nt, Homo sapiens
caaaauggcagaucucuug

SEQ ID NO: 883342 - RNA, 19 nt, Homo sapiens
caacauagcaagaccucau

SEQ ID NO: 883343 - RNA, 19 nt, Homo sapiens
uguaggcaccuuaccaaua

SEQ ID NO: 883344 - RNA, 19 nt, Homo sapiens
aaaugaaaguccugcugaa

SEQ ID NO: 883345 - RNA, 19 nt, Homo sapiens
aggcacaacuccagauguu

SEQ ID NO: 883346 - RNA, 19 nt, Homo sapiens
gguguaagcucuagcaauu

SEQ ID NO: 883347 - RNA, 19 nt, Homo sapiens
ggaaacagcuacauugaag

SEQ ID NO: 883348 - RNA, 19 nt, Homo sapiens
caauggagguccugaugua

SEQ ID NO: 883349 - RNA, 19 nt, Homo sapiens
uguaagcucuagcaauuua

SEQ ID NO: 883350 - RNA, 19 nt, Homo sapiens
aaauggagcucucuaugaa

SEQ ID NO: 883351 - RNA, 19 nt, Homo sapiens
gcagucagauucacauauc

SEQ ID NO: 883352 - RNA, 19 nt, Homo sapiens
caucauucuugucacauua

SEQ ID NO: 883353 - RNA, 19 nt, Homo sapiens
ggcaccaaguggaauauua

SEQ ID NO: 883354 - RNA, 19 nt, Homo sapiens
ggcagaagcuguauuaaac

SEQ ID NO: 883355 - RNA, 19 nt, Homo sapiens
uggcagaucucuuguccua

SEQ ID NO: 883356 - RNA, 19 nt, Homo sapiens
gaagauugucauucugaua

SEQ ID NO: 883357 - RNA, 19 nt, Homo sapiens
aaacucaucuggauacauc

SEQ ID NO: 883358 - RNA, 19 nt, Homo sapiens
caacaaacucaucuggaua

SEQ ID NO: 883359 - RNA, 19 nt, Homo sapiens
gggcagaagcuguauuaaa

SEQ ID NO: 883360 - RNA, 19 nt, Homo sapiens
gaagcuguauuaaacuugu

SEQ ID NO: 883361 - RNA, 19 nt, Homo sapiens
caaaucaacuggugagacu

SEQ ID NO: 883362 - RNA, 19 nt, Homo sapiens
acagcuacauugaagauaa

SEQ ID NO: 883363 - RNA, 19 nt, Homo sapiens
cagagcagaugaugaugaa

SEQ ID NO: 883364 - RNA, 19 nt, Homo sapiens
ccacuugacuauaaauaca

SEQ ID NO: 883365 - RNA, 19 nt, Homo sapiens
uaccaggacugaugcaauu

SEQ ID NO: 883366 - RNA, 19 nt, Homo sapiens
ccagagacccugaaauaug

SEQ ID NO: 883367 - RNA, 19 nt, Homo sapiens
ugaaaguccugcugaaaca

SEQ ID NO: 883368 - RNA, 19 nt, Homo sapiens
ucaacaaacucaucuggau

SEQ ID NO: 883369 - RNA, 19 nt, Homo sapiens
gcagaucucuuguccuacu

SEQ ID NO: 883370 - RNA, 19 nt, Homo sapiens
ggaacagucucuugauggu

SEQ ID NO: 883371 - RNA, 19 nt, Homo sapiens
gauggguggugucuaguga

SEQ ID NO: 883372 - RNA, 19 nt, Homo sapiens
gagcagaugaugaugaaga

SEQ ID NO: 883373 - RNA, 19 nt, Homo sapiens
guugagaaauuucacuguu

SEQ ID NO: 883374 - RNA, 19 nt, Homo sapiens
cagagacccugaaauaugg

SEQ ID NO: 883375 - RNA, 19 nt, Homo sapiens
ugaggaagauugucauucu

SEQ ID NO: 883376 - RNA, 19 nt, Homo sapiens
cagaagcuguauuaaacuu

SEQ ID NO: 883377 - RNA, 19 nt, Homo sapiens
ugccagagacccugaaaua

SEQ ID NO: 883378 - RNA, 19 nt, Homo sapiens
ggcagaagcugaggaagau

SEQ ID NO: 883379 - RNA, 19 nt, Homo sapiens
caaguccaguccucuauca

SEQ ID NO: 883380 - RNA, 19 nt, Homo sapiens
gaacuugcuccagguguaa

SEQ ID NO: 883381 - RNA, 19 nt, Homo sapiens
ugaacuugcuccaggugua

SEQ ID NO: 883382 - RNA, 19 nt, Homo sapiens
gguggugucuagugacuug

SEQ ID NO: 883383 - RNA, 19 nt, Homo sapiens
ggauacaucauucuuguca

SEQ ID NO: 883384 - RNA, 19 nt, Homo sapiens
uaucagugcugccaaugga

SEQ ID NO: 883385 - RNA, 19 nt, Homo sapiens
guccauuguuccacguuua

SEQ ID NO: 883386 - RNA, 19 nt, Homo sapiens
gagccucaguccauuguuc

SEQ ID NO: 883387 - RNA, 19 nt, Homo sapiens
ggaagauugucauucugau

SEQ ID NO: 883388 - RNA, 19 nt, Homo sapiens
aacagucucuugaugguuu

SEQ ID NO: 883389 - RNA, 19 nt, Homo sapiens
gauggcguguauaucagua

SEQ ID NO: 883390 - RNA, 19 nt, Homo sapiens
ucaggagucugugcuuaaa

SEQ ID NO: 883391 - RNA, 19 nt, Homo sapiens
cuaugaagccaucaaguuu

SEQ ID NO: 883392 - RNA, 19 nt, Homo sapiens
caccagagguucaacaaac

SEQ ID NO: 883393 - RNA, 19 nt, Homo sapiens
caaucagaccaaaguauuu

SEQ ID NO: 883394 - RNA, 19 nt, Homo sapiens
ugaagagccucaguccauu

SEQ ID NO: 883395 - RNA, 19 nt, Homo sapiens
uaaugaugaugacagcaaa

SEQ ID NO: 883396 - RNA, 19 nt, Homo sapiens
gaagagccucaguccauug

SEQ ID NO: 883397 - RNA, 19 nt, Homo sapiens
caaaauggcagaucucuug

SEQ ID NO: 883398 - RNA, 19 nt, Homo sapiens
ucagaucauuggagcaguu

SEQ ID NO: 883399 - RNA, 19 nt, Homo sapiens
gcaacuuguaccugauaua

SEQ ID NO: 883400 - RNA, 19 nt, Homo sapiens
aggcacaacuccagauguu

SEQ ID NO: 883401 - RNA, 19 nt, Homo sapiens
aaaugaaaguccugcugaa

SEQ ID NO: 883402 - RNA, 19 nt, Homo sapiens
ggaauauuacagguacaua

SEQ ID NO: 883403 - RNA, 19 nt, Homo sapiens
guagggcuaugcaacuugu

SEQ ID NO: 883404 - RNA, 19 nt, Homo sapiens
gcucgagaacucuuccuaa

SEQ ID NO: 883405 - RNA, 19 nt, Homo sapiens
acaaucagaccaaaguauu

SEQ ID NO: 883406 - RNA, 19 nt, Homo sapiens
cagcuacauugaagauaau

SEQ ID NO: 883407 - RNA, 19 nt, Homo sapiens
cucgagaacucuuccuaaa

SEQ ID NO: 883408 - RNA, 19 nt, Homo sapiens
gaggaagauugucauucug

SEQ ID NO: 883409 - RNA, 19 nt, Homo sapiens
gagcucaguggauguuuga

SEQ ID NO: 883410 - RNA, 19 nt, Homo sapiens
gacaaucagaccaaaguau

SEQ ID NO: 883411 - RNA, 19 nt, Homo sapiens
gagcagucagauucacaua

SEQ ID NO: 883412 - RNA, 19 nt, Homo sapiens
caacuuguaccugauauag

SEQ ID NO: 883413 - RNA, 19 nt, Homo sapiens
cagaaaacaucggcagaua

SEQ ID NO: 883414 - RNA, 19 nt, Homo sapiens
guauauagcgcaaaagaaa

SEQ ID NO: 883415 - RNA, 19 nt, Homo sapiens
caggacugaugcaauucua

SEQ ID NO: 883416 - RNA, 19 nt, Homo sapiens
gaaacagcuacauugaaga

SEQ ID NO: 883417 - RNA, 19 nt, Homo sapiens
acaagaagcagaucagagu

SEQ ID NO: 883418 - RNA, 19 nt, Homo sapiens
ugacuuggaccucagauca

SEQ ID NO: 883419 - RNA, 19 nt, Homo sapiens
cggcagauaccaaaggaaa

SEQ ID NO: 883420 - RNA, 19 nt, Homo sapiens
cguuuaagaacuaggaaua

SEQ ID NO: 883421 - RNA, 19 nt, Homo sapiens
guuggaaacagcuacauug

SEQ ID NO: 883422 - RNA, 19 nt, Homo sapiens
gcaccaaguggaauauuac

SEQ ID NO: 883423 - RNA, 19 nt, Homo sapiens
gaacagucucuugaugguu

SEQ ID NO: 883424 - RNA, 19 nt, Homo sapiens
cgagaacucuuccuaaaag

SEQ ID NO: 883425 - RNA, 19 nt, Homo sapiens
aaacaucggcagauaccaa

SEQ ID NO: 883426 - RNA, 19 nt, Homo sapiens
uuucaggagucugugcuua

SEQ ID NO: 883427 - RNA, 19 nt, Homo sapiens
aaacagcuacauugaagau

SEQ ID NO: 883428 - RNA, 19 nt, Homo sapiens
uaaaagcaguagaagaaga

SEQ ID NO: 883429 - RNA, 19 nt, Homo sapiens
cgagcucaguggauguuug

SEQ ID NO: 883430 - RNA, 19 nt, Homo sapiens
gugcagaggauucuacauc

SEQ ID NO: 883431 - RNA, 19 nt, Homo sapiens
cagcagcaacucacauuuc

SEQ ID NO: 883432 - RNA, 19 nt, Homo sapiens
ucuaugaagccaucaaguu

SEQ ID NO: 883433 - RNA, 19 nt, Homo sapiens
caguggauguuugaacuug

SEQ ID NO: 883434 - RNA, 19 nt, Homo sapiens
cuggauacaucauucuugu

SEQ ID NO: 883435 - RNA, 19 nt, Homo sapiens
cacaagacacagacaauca

SEQ ID NO: 883436 - RNA, 19 nt, Homo sapiens
cagaagcugaggaagauug

SEQ ID NO: 883437 - RNA, 19 nt, Homo sapiens
cgucuggccugcuugaaag

SEQ ID NO: 883438 - RNA, 19 nt, Homo sapiens
ugucagagcagaugaugau

SEQ ID NO: 883439 - RNA, 19 nt, Homo sapiens
guccaguccucuaucacuu

SEQ ID NO: 883440 - RNA, 19 nt, Homo sapiens
auacaucauucuugucaca

SEQ ID NO: 883441 - RNA, 19 nt, Homo sapiens
aagaagcagaucagaguuu

SEQ ID NO: 883442 - RNA, 19 nt, Homo sapiens
ucagagcagaugaugauga

SEQ ID NO: 883443 - RNA, 19 nt, Homo sapiens
guacaagaagcagaucaga

SEQ ID NO: 883444 - RNA, 19 nt, Homo sapiens
ucgugucccuguacaagaa

SEQ ID NO: 883445 - RNA, 19 nt, Homo sapiens
caagacacagacaaucaga

SEQ ID NO: 883446 - RNA, 19 nt, Homo sapiens
gaagaguguugauuuguua

SEQ ID NO: 883447 - RNA, 19 nt, Homo sapiens
gaacccaccuuuaggauuu

SEQ ID NO: 883448 - RNA, 19 nt, Homo sapiens
gaacaggaaggauucauua

SEQ ID NO: 883449 - RNA, 19 nt, Homo sapiens
ggagagaugucuuggauga

SEQ ID NO: 883450 - RNA, 19 nt, Homo sapiens
gaaaucaguucuugccaaa

SEQ ID NO: 883451 - RNA, 19 nt, Homo sapiens
ggagugaacuacuuuaugu

SEQ ID NO: 883452 - RNA, 19 nt, Homo sapiens
uaacaaaguucucacauag

SEQ ID NO: 883453 - RNA, 19 nt, Homo sapiens
caaaggaaauagcaaaguu

SEQ ID NO: 883454 - RNA, 19 nt, Homo sapiens
gagaaucuaucuugaugaa

SEQ ID NO: 883455 - RNA, 19 nt, Homo sapiens
caggaaggauucauuaauu

SEQ ID NO: 883456 - RNA, 19 nt, Homo sapiens
caagaacacuaaauuggaa

SEQ ID NO: 883457 - RNA, 19 nt, Homo sapiens
caaaugcacugagagaauu

SEQ ID NO: 883458 - RNA, 19 nt, Homo sapiens
ggcaggaccuugcgaauga

SEQ ID NO: 883459 - RNA, 19 nt, Homo sapiens
gaaucuaucuugaugaaag

SEQ ID NO: 883460 - RNA, 19 nt, Homo sapiens
guacugugcuacucuuuga

SEQ ID NO: 883461 - RNA, 19 nt, Homo sapiens
gcaaggaaaucgaaagaac

SEQ ID NO: 883462 - RNA, 19 nt, Homo sapiens
gcccucaugugaagaauaa

SEQ ID NO: 883463 - RNA, 19 nt, Homo sapiens
gaaagaacaggaaggauuc

SEQ ID NO: 883464 - RNA, 19 nt, Homo sapiens
uggaugaccuuguaacauu

SEQ ID NO: 883465 - RNA, 19 nt, Homo sapiens
uaacaccaaucaucguaaa

SEQ ID NO: 883466 - RNA, 19 nt, Homo sapiens
ccaaggaggcauugacaua

SEQ ID NO: 883467 - RNA, 19 nt, Homo sapiens
gacuaaagcuacccaagga

SEQ ID NO: 883468 - RNA, 19 nt, Homo sapiens
gagcagagcaggagaaugg

SEQ ID NO: 883469 - RNA, 19 nt, Homo sapiens
guacaagaacacuaaauug

SEQ ID NO: 883470 - RNA, 19 nt, Homo sapiens
guaaguccuuuaaaccauu

SEQ ID NO: 883471 - RNA, 19 nt, Homo sapiens
gaaacuauugucuucguaa

SEQ ID NO: 883472 - RNA, 19 nt, Homo sapiens
cgaaagaacaggaaggauu

SEQ ID NO: 883473 - RNA, 19 nt, Homo sapiens
caacauuucuaacaccaau

SEQ ID NO: 883474 - RNA, 19 nt, Homo sapiens
caucagugcuggucauugu

SEQ ID NO: 883475 - RNA, 19 nt, Homo sapiens
aaacugagaaucuaucuug

SEQ ID NO: 883476 - RNA, 19 nt, Homo sapiens
ggaaauagcaaaguuuauc

SEQ ID NO: 883477 - RNA, 19 nt, Homo sapiens
caauaagaacccaccuuua

SEQ ID NO: 883478 - RNA, 19 nt, Homo sapiens
ggaaggauucauuaauuug

SEQ ID NO: 883479 - RNA, 19 nt, Homo sapiens
ugaagaguguugauuuguu

SEQ ID NO: 883480 - RNA, 19 nt, Homo sapiens
gcauuagauuugccugaaa

SEQ ID NO: 883481 - RNA, 19 nt, Homo sapiens
aagcagagccacugucuaa

SEQ ID NO: 883482 - RNA, 19 nt, Homo sapiens
gagguacccugaguucuga

SEQ ID NO: 883483 - RNA, 19 nt, Homo sapiens
acaaaguucucacauagau

SEQ ID NO: 883484 - RNA, 19 nt, Homo sapiens
aaggaggcauugacauaua

SEQ ID NO: 883485 - RNA, 19 nt, Homo sapiens
acacagcuguuaacgaaug

SEQ ID NO: 883486 - RNA, 19 nt, Homo sapiens
ggaugaccuuguaacauug

SEQ ID NO: 883487 - RNA, 19 nt, Homo sapiens
ccaaggacuuagcagauau

SEQ ID NO: 883488 - RNA, 19 nt, Homo sapiens
ugucuuggaugaccuugua

SEQ ID NO: 883489 - RNA, 19 nt, Homo sapiens
ugaagagcguggagaguau

SEQ ID NO: 883490 - RNA, 19 nt, Homo sapiens
aaucaguucuugccaaaug

SEQ ID NO: 883491 - RNA, 19 nt, Homo sapiens
uagcaaaguuuaucuucug

SEQ ID NO: 883492 - RNA, 19 nt, Homo sapiens
gcuaagcuuuaccaucuug

SEQ ID NO: 883493 - RNA, 19 nt, Homo sapiens
guagugcuguuucugguau

SEQ ID NO: 883494 - RNA, 19 nt, Homo sapiens
gggcaucuuuaugacaaua

SEQ ID NO: 883495 - RNA, 19 nt, Homo sapiens
uugcaacccugauuuaaug

SEQ ID NO: 883496 - RNA, 19 nt, Homo sapiens
caaaguuuaucuucuguac

SEQ ID NO: 883497 - RNA, 19 nt, Homo sapiens
cccaaggacuuagcagaua

SEQ ID NO: 883498 - RNA, 19 nt, Homo sapiens
gcauugacauauaucaucu

SEQ ID NO: 883499 - RNA, 19 nt, Homo sapiens
gguaaguccuuuaaaccau

SEQ ID NO: 883500 - RNA, 19 nt, Homo sapiens
cuaccgguguggacaagua

SEQ ID NO: 883501 - RNA, 19 nt, Homo sapiens
gugcuacucuuugauucua

SEQ ID NO: 883502 - RNA, 19 nt, Homo sapiens
gaaaucgaaagaacaggaa

SEQ ID NO: 883503 - RNA, 19 nt, Homo sapiens
gaucugaaacuauugucuu

SEQ ID NO: 883504 - RNA, 19 nt, Homo sapiens
gcagagccacugucuaaca

SEQ ID NO: 883505 - RNA, 19 nt, Homo sapiens
acaauaagaacccaccuuu

SEQ ID NO: 883506 - RNA, 19 nt, Homo sapiens
ugaaacuauugucuucgua

SEQ ID NO: 883507 - RNA, 19 nt, Homo sapiens
ggacaaguaaaguuugaau

SEQ ID NO: 883508 - RNA, 19 nt, Homo sapiens
gaguguugauuuguuacua

SEQ ID NO: 883509 - RNA, 19 nt, Homo sapiens
gaugguguauuugugcauu

SEQ ID NO: 883510 - RNA, 19 nt, Homo sapiens
aaggagagaugucuuggau

SEQ ID NO: 883511 - RNA, 19 nt, Homo sapiens
aauaagaacccaccuuuag

SEQ ID NO: 883512 - RNA, 19 nt, Homo sapiens
guggacaaguaaaguuuga

SEQ ID NO: 883513 - RNA, 19 nt, Homo sapiens
ggagguacccugaguucug

SEQ ID NO: 883514 - RNA, 19 nt, Homo sapiens
gcuguuaacgaaugauaaa

SEQ ID NO: 883515 - RNA, 19 nt, Homo sapiens
ccaaaugcacugagagaau

SEQ ID NO: 883516 - RNA, 19 nt, Homo sapiens
cugagaaucuaucuugaug

SEQ ID NO: 883517 - RNA, 19 nt, Homo sapiens
uaagaacccaccuuuagga

SEQ ID NO: 883518 - RNA, 19 nt, Homo sapiens
uggcaaggguugugcaaau

SEQ ID NO: 883519 - RNA, 19 nt, Homo sapiens
ccauuuccauucuuuauac

SEQ ID NO: 883520 - RNA, 19 nt, Homo sapiens
gcaaaguuuaucuucugua

SEQ ID NO: 883521 - RNA, 19 nt, Homo sapiens
ugaacuacuuuauguccaa

SEQ ID NO: 883522 - RNA, 19 nt, Homo sapiens
guuaacgaaugauaaacug

SEQ ID NO: 883523 - RNA, 19 nt, Homo sapiens
gcaacaagaaggcuacagu

SEQ ID NO: 883524 - RNA, 19 nt, Homo sapiens
uagggcaucuuuaugacaa

SEQ ID NO: 883525 - RNA, 19 nt, Homo sapiens
gcuuuaccaucuuguccua

SEQ ID NO: 883526 - RNA, 19 nt, Homo sapiens
gaaggauucauuaauuugg

SEQ ID NO: 883527 - RNA, 19 nt, Homo sapiens
aaacuggguuaaucaaguc

SEQ ID NO: 883528 - RNA, 19 nt, Homo sapiens
gcgagaacuuggccuuagu

SEQ ID NO: 883529 - RNA, 19 nt, Homo sapiens
gaccuuguaacauugcaua

SEQ ID NO: 883530 - RNA, 19 nt, Homo sapiens
aauguugccuccugagcua

SEQ ID NO: 883531 - RNA, 19 nt, Homo sapiens
caaggaggcauugacauau

SEQ ID NO: 883532 - RNA, 19 nt, Homo sapiens
ugaaaggagagaugucuug

SEQ ID NO: 883533 - RNA, 19 nt, Homo sapiens
ggucacugguccauauaca

SEQ ID NO: 883534 - RNA, 19 nt, Homo sapiens
cauuguagccugaguauac

SEQ ID NO: 883535 - RNA, 19 nt, Homo sapiens
aaagcuacccaaggacuua

SEQ ID NO: 883536 - RNA, 19 nt, Homo sapiens
cagaugagggagugaacua

SEQ ID NO: 883537 - RNA, 19 nt, Homo sapiens
gaaggcaaggaaaucgaaa

SEQ ID NO: 883538 - RNA, 19 nt, Homo sapiens
caccaaucaucguaaacaa

SEQ ID NO: 883539 - RNA, 19 nt, Homo sapiens
guuaaucaagucucgguaa

SEQ ID NO: 883540 - RNA, 19 nt, Homo sapiens
caaguaaaguuugaaucag

SEQ ID NO: 883541 - RNA, 19 nt, Homo sapiens
gcgagcaacauuucuaaca

SEQ ID NO: 883542 - RNA, 19 nt, Homo sapiens
gagcguggagaguaucuug

SEQ ID NO: 883543 - RNA, 19 nt, Homo sapiens
acaagaacacuaaauugga

SEQ ID NO: 883544 - RNA, 19 nt, Homo sapiens
caucuuguccuaccugaau

SEQ ID NO: 883545 - RNA, 19 nt, Homo sapiens
ggagaauggcugcgagcaa

SEQ ID NO: 883546 - RNA, 19 nt, Homo sapiens
gaaacccugucucuacuaa

SEQ ID NO: 883547 - RNA, 19 nt, Homo sapiens
gcgagacucuggcucauaa

SEQ ID NO: 883548 - RNA, 19 nt, Homo sapiens
ggacagaggucuccuacac

SEQ ID NO: 883549 - RNA, 19 nt, Homo sapiens
uuaacgagcugcccgagaa

SEQ ID NO: 883550 - RNA, 19 nt, Homo sapiens
ggaggcugaugcagaagaa

SEQ ID NO: 883551 - RNA, 19 nt, Homo sapiens
ggccggacaucgugguuaa

SEQ ID NO: 883552 - RNA, 19 nt, Homo sapiens
ccaaagucaagaaguauuu

SEQ ID NO: 883553 - RNA, 19 nt, Homo sapiens
gcagaagaauggcgugaac

SEQ ID NO: 883554 - RNA, 19 nt, Homo sapiens
cuacggagccugcauagga

SEQ ID NO: 883555 - RNA, 19 nt, Homo sapiens
ggccucggcugacuacuuc

SEQ ID NO: 883556 - RNA, 19 nt, Homo sapiens
guacugggcaggcugguau

SEQ ID NO: 883557 - RNA, 19 nt, Homo sapiens
gagagggcuucaucaccaa

SEQ ID NO: 883558 - RNA, 19 nt, Homo sapiens
gacucuggcucauaaaaua

SEQ ID NO: 883559 - RNA, 19 nt, Homo sapiens
ggugaaacccugucucuac

SEQ ID NO: 883560 - RNA, 19 nt, Homo sapiens
gaaaaucuucuacuuccua

SEQ ID NO: 883561 - RNA, 19 nt, Homo sapiens
gcaccuaccaacucaaagu

SEQ ID NO: 883562 - RNA, 19 nt, Homo sapiens
ugucacauccuacgaaaug

SEQ ID NO: 883563 - RNA, 19 nt, Homo sapiens
ucgggaggcugaugcagaa

SEQ ID NO: 883564 - RNA, 19 nt, Homo sapiens
gcagggacacccaguacug

SEQ ID NO: 883565 - RNA, 19 nt, Homo sapiens
ccucaugacccucuggaaa

SEQ ID NO: 883566 - RNA, 19 nt, Homo sapiens
gugaaacccugucucuacu

SEQ ID NO: 883567 - RNA, 19 nt, Homo sapiens
caagaaguauuuugucaca

SEQ ID NO: 883568 - RNA, 19 nt, Homo sapiens
gagcuguuguccagauuuu

SEQ ID NO: 883569 - RNA, 19 nt, Homo sapiens
gaccgaggcagguggauca

SEQ ID NO: 883570 - RNA, 19 nt, Homo sapiens
uacgaaaugugccucaagu

SEQ ID NO: 883571 - RNA, 19 nt, Homo sapiens
ccuguaaucccagcacuuu

SEQ ID NO: 883572 - RNA, 19 nt, Homo sapiens
gagcccacgggacagauuu

SEQ ID NO: 883573 - RNA, 19 nt, Homo sapiens
gaagaggauauguuugcau

SEQ ID NO: 883574 - RNA, 19 nt, Homo sapiens
gcgcaacccgugugcugaa

SEQ ID NO: 883575 - RNA, 19 nt, Homo sapiens
uacggagccugcauaggaa

SEQ ID NO: 883576 - RNA, 19 nt, Homo sapiens
aagcagcccuggacagcau

SEQ ID NO: 883577 - RNA, 19 nt, Homo sapiens
caacccgugugcugaagag

SEQ ID NO: 883578 - RNA, 19 nt, Homo sapiens
ggaccucaucgaccucaug

SEQ ID NO: 883579 - RNA, 19 nt, Homo sapiens
gggcagugaggucccugua

SEQ ID NO: 883580 - RNA, 19 nt, Homo sapiens
ggagcuacuagacacauuc

SEQ ID NO: 883581 - RNA, 19 nt, Homo sapiens
gugcugaagaggauauguu

SEQ ID NO: 883582 - RNA, 19 nt, Homo sapiens
ugaagaggauauguuugca

SEQ ID NO: 883583 - RNA, 19 nt, Homo sapiens
ugaaacccugucucuacua

SEQ ID NO: 883584 - RNA, 19 nt, Homo sapiens
gcagcccuggacagcauua

SEQ ID NO: 883585 - RNA, 19 nt, Homo sapiens
ggagcccacgggacagauu

SEQ ID NO: 883586 - RNA, 19 nt, Homo sapiens
ccuacaccuucucagacua

SEQ ID NO: 883587 - RNA, 19 nt, Homo sapiens
gggaggcugaugcagaaga

SEQ ID NO: 883588 - RNA, 19 nt, Homo sapiens
cuacugggaggagcuacua

SEQ ID NO: 883589 - RNA, 19 nt, Homo sapiens
gaaaggcugucauguauug

SEQ ID NO: 883590 - RNA, 19 nt, Homo sapiens
ggaagaagauccuagaaga

SEQ ID NO: 883591 - RNA, 19 nt, Homo sapiens
gaauaugucucuuguaugu

SEQ ID NO: 883592 - RNA, 19 nt, Homo sapiens
cgaagugucucuguaauua

SEQ ID NO: 883593 - RNA, 19 nt, Homo sapiens
caacagacacuuaauagua

SEQ ID NO: 883594 - RNA, 19 nt, Homo sapiens
caacagaaauaucaacuuc

SEQ ID NO: 883595 - RNA, 19 nt, Homo sapiens
gaauuucggugacagucua

SEQ ID NO: 883596 - RNA, 19 nt, Homo sapiens
gaaauuauagccagaggaa

SEQ ID NO: 883597 - RNA, 19 nt, Homo sapiens
ggaaacccaugcaauuuua

SEQ ID NO: 883598 - RNA, 19 nt, Homo sapiens
gaucaugaauguuaguuag

SEQ ID NO: 883599 - RNA, 19 nt, Homo sapiens
gacauggacuuaaucaaug

SEQ ID NO: 883600 - RNA, 19 nt, Homo sapiens
gaaagguucuacuuauagu

SEQ ID NO: 883601 - RNA, 19 nt, Homo sapiens
ccaguagacuuuaugaaga

SEQ ID NO: 883602 - RNA, 19 nt, Homo sapiens
cgagaaggcuguggauuug

SEQ ID NO: 883603 - RNA, 19 nt, Homo sapiens
cagagaauauguuauguuc

SEQ ID NO: 883604 - RNA, 19 nt, Homo sapiens
uaaaguagaucgggagaug

SEQ ID NO: 883605 - RNA, 19 nt, Homo sapiens
gagaauauguuauguucag

SEQ ID NO: 883606 - RNA, 19 nt, Homo sapiens
gguaaaaccugaugacauu

SEQ ID NO: 883607 - RNA, 19 nt, Homo sapiens
caacuucuggagucuauua

SEQ ID NO: 883608 - RNA, 19 nt, Homo sapiens
ccuagaauguguagauauu

SEQ ID NO: 883609 - RNA, 19 nt, Homo sapiens
uaaauguguugucaccuuu

SEQ ID NO: 883610 - RNA, 19 nt, Homo sapiens
guacgaagugucucuguaa

SEQ ID NO: 883611 - RNA, 19 nt, Homo sapiens
gaaauagaagcacuagaga

SEQ ID NO: 883612 - RNA, 19 nt, Homo sapiens
guaaagacugcauuaaaga

SEQ ID NO: 883613 - RNA, 19 nt, Homo sapiens
aaaggaaacccaugcaauu

SEQ ID NO: 883614 - RNA, 19 nt, Homo sapiens
guaaagcaauacaaagagu

SEQ ID NO: 883615 - RNA, 19 nt, Homo sapiens
gcauuccaguuguacagua

SEQ ID NO: 883616 - RNA, 19 nt, Homo sapiens
gggagaugcugaaggaaau

SEQ ID NO: 883617 - RNA, 19 nt, Homo sapiens
caaagccaguuguaaaaua

SEQ ID NO: 883618 - RNA, 19 nt, Homo sapiens
gagcacaacuuggaagaag

SEQ ID NO: 883619 - RNA, 19 nt, Homo sapiens
agaccaauaucccaacaaa

SEQ ID NO: 883620 - RNA, 19 nt, Homo sapiens
ggauagacaaccucuuaaa

SEQ ID NO: 883621 - RNA, 19 nt, Homo sapiens
gcuguggauuugauuauug

SEQ ID NO: 883622 - RNA, 19 nt, Homo sapiens
aaaccaaguuauccaauca

SEQ ID NO: 883623 - RNA, 19 nt, Homo sapiens
ggauaguuguaaagaagaa

SEQ ID NO: 883624 - RNA, 19 nt, Homo sapiens
uguaaagacugcauuaaag

SEQ ID NO: 883625 - RNA, 19 nt, Homo sapiens
guaauucaccugcaaaaua

SEQ ID NO: 883626 - RNA, 19 nt, Homo sapiens
cuagagaccaguagacuuu

SEQ ID NO: 883627 - RNA, 19 nt, Homo sapiens
gaagguuccuguaaagacu

SEQ ID NO: 883628 - RNA, 19 nt, Homo sapiens
caauugauaccaacagaaa

SEQ ID NO: 883629 - RNA, 19 nt, Homo sapiens
caaaccaaguuauccaauc

SEQ ID NO: 883630 - RNA, 19 nt, Homo sapiens
gaagaagauccuagaagau

SEQ ID NO: 883631 - RNA, 19 nt, Homo sapiens
ugacauggacuuaaucaau

SEQ ID NO: 883632 - RNA, 19 nt, Homo sapiens
ucagugacauggacuuaau

SEQ ID NO: 883633 - RNA, 19 nt, Homo sapiens
gugcaacagacacuuaaua

SEQ ID NO: 883634 - RNA, 19 nt, Homo sapiens
gacauuggaagacuaguuu

SEQ ID NO: 883635 - RNA, 19 nt, Homo sapiens
ugaaaucgguguaguaucc

SEQ ID NO: 883636 - RNA, 19 nt, Homo sapiens
ccucaaagccaguuguaaa

SEQ ID NO: 883637 - RNA, 19 nt, Homo sapiens
acuaaagacuguucagaug

SEQ ID NO: 883638 - RNA, 19 nt, Homo sapiens
guuguacaguaaagcaaua

SEQ ID NO: 883639 - RNA, 19 nt, Homo sapiens
gaaaucagcagcccagacu

SEQ ID NO: 883640 - RNA, 19 nt, Homo sapiens
ggccuagaauguguagaua

SEQ ID NO: 883641 - RNA, 19 nt, Homo sapiens
uuaaauguguugucaccuu

SEQ ID NO: 883642 - RNA, 19 nt, Homo sapiens
uguauugggucaccgauug

SEQ ID NO: 883643 - RNA, 19 nt, Homo sapiens
agaagauccuagaagauga

SEQ ID NO: 883644 - RNA, 19 nt, Homo sapiens
acaaagcccagaccaauau

SEQ ID NO: 883645 - RNA, 19 nt, Homo sapiens
gguguaguauccugagguu

SEQ ID NO: 883646 - RNA, 19 nt, Homo sapiens
gagaugcugaaggaaauua

SEQ ID NO: 883647 - RNA, 19 nt, Homo sapiens
caaaguggccucagugaac

SEQ ID NO: 883648 - RNA, 19 nt, Homo sapiens
uaaaggaaacccaugcaau

SEQ ID NO: 883649 - RNA, 19 nt, Homo sapiens
caaguuauccaaucaaggu

SEQ ID NO: 883650 - RNA, 19 nt, Homo sapiens
ucaaccagagaauauguua

SEQ ID NO: 883651 - RNA, 19 nt, Homo sapiens
caguaaagcaauacaaaga

SEQ ID NO: 883652 - RNA, 19 nt, Homo sapiens
caguggcuauuccucauuu

SEQ ID NO: 883653 - RNA, 19 nt, Homo sapiens
ugaaauagaagcacuagag

SEQ ID NO: 883654 - RNA, 19 nt, Homo sapiens
guucuacccuuucugucaa

SEQ ID NO: 883655 - RNA, 19 nt, Homo sapiens
gaagugucucuguaauuau

SEQ ID NO: 883656 - RNA, 19 nt, Homo sapiens
cauguucauuccggacuua

SEQ ID NO: 883657 - RNA, 19 nt, Homo sapiens
auacaaagaguuaccgaaa

SEQ ID NO: 883658 - RNA, 19 nt, Homo sapiens
gcacaacuuggaagaagau

SEQ ID NO: 883659 - RNA, 19 nt, Homo sapiens
guuagcauuucagacauuu

SEQ ID NO: 883660 - RNA, 19 nt, Homo sapiens
gaugcugaaggaaauuaua

SEQ ID NO: 883661 - RNA, 19 nt, Homo sapiens
gaggagaauuucggugaca

SEQ ID NO: 883662 - RNA, 19 nt, Homo sapiens
aaacgaaauccuaaaguag

SEQ ID NO: 883663 - RNA, 19 nt, Homo sapiens
uacaaagcccagaccaaua

SEQ ID NO: 883664 - RNA, 19 nt, Homo sapiens
gcaacagacacuuaauagu

SEQ ID NO: 883665 - RNA, 19 nt, Homo sapiens
cuucuggagucuauuaaau

SEQ ID NO: 883666 - RNA, 19 nt, Homo sapiens
ggaaaaguagauagugaua

SEQ ID NO: 883667 - RNA, 19 nt, Homo sapiens
uguacgaagugucucugua

SEQ ID NO: 883668 - RNA, 19 nt, Homo sapiens
acgagaaggcuguggauuu

SEQ ID NO: 883669 - RNA, 19 nt, Homo sapiens
cauuccaguuguacaguaa

SEQ ID NO: 883670 - RNA, 19 nt, Homo sapiens
guacaacuugaaacugaaa

SEQ ID NO: 883671 - RNA, 19 nt, Homo sapiens
uuguacaacuugaaacuga

SEQ ID NO: 883672 - RNA, 19 nt, Homo sapiens
uggagucuauuaaaugugu

SEQ ID NO: 883673 - RNA, 19 nt, Homo sapiens
guaaaggaaacccaugcaa

SEQ ID NO: 883674 - RNA, 19 nt, Homo sapiens
ggauuugauuauuguacga

SEQ ID NO: 883675 - RNA, 19 nt, Homo sapiens
ccagagaauauguuauguu

SEQ ID NO: 883676 - RNA, 19 nt, Homo sapiens
guacaguaaagcaauacaa

SEQ ID NO: 883677 - RNA, 19 nt, Homo sapiens
gauccuagaagaugauaag

SEQ ID NO: 883678 - RNA, 19 nt, Homo sapiens
gaagauccuagaagaugau

SEQ ID NO: 883679 - RNA, 19 nt, Homo sapiens
ggacuuaaucaaugugucu

SEQ ID NO: 883680 - RNA, 19 nt, Homo sapiens
gacaguggcuauuccucau

SEQ ID NO: 883681 - RNA, 19 nt, Homo sapiens
ucggauaguuguaaagaag

SEQ ID NO: 883682 - RNA, 19 nt, Homo sapiens
ucuggagucuauuaaaugu

SEQ ID NO: 883683 - RNA, 19 nt, Homo sapiens
aaggaaacccaugcaauuu

SEQ ID NO: 883684 - RNA, 19 nt, Homo sapiens
uaaagaggauagacaaccu

SEQ ID NO: 883685 - RNA, 19 nt, Homo sapiens
gaagacuaguuuccuacac

SEQ ID NO: 883686 - RNA, 19 nt, Homo sapiens
aagacugcauuaaagacua

SEQ ID NO: 883687 - RNA, 19 nt, Homo sapiens
agacugcauuaaagacuau

SEQ ID NO: 883688 - RNA, 19 nt, Homo sapiens
caugugcaacagacacuua

SEQ ID NO: 883689 - RNA, 19 nt, Homo sapiens
gaacugaaaccauuugaaa

SEQ ID NO: 883690 - RNA, 19 nt, Homo sapiens
gaaugaaacuguaagagau

SEQ ID NO: 883691 - RNA, 19 nt, Homo sapiens
gcagauaggcuuucauuug

SEQ ID NO: 883692 - RNA, 19 nt, Homo sapiens
gaacaaccaacauaaauuc

SEQ ID NO: 883693 - RNA, 19 nt, Homo sapiens
gaaccacgauuugcuaugu

SEQ ID NO: 883694 - RNA, 19 nt, Homo sapiens
ugagggaucuuccuucuug

SEQ ID NO: 883695 - RNA, 19 nt, Homo sapiens
ggaaugaaacuguaagaga

SEQ ID NO: 883696 - RNA, 19 nt, Homo sapiens
gaauaccucuuugguguug

SEQ ID NO: 883697 - RNA, 19 nt, Homo sapiens
gcagauugaugguauugga

SEQ ID NO: 883698 - RNA, 19 nt, Homo sapiens
gagcauacaagugcaguua

SEQ ID NO: 883699 - RNA, 19 nt, Homo sapiens
ggaagccgguacaguguga

SEQ ID NO: 883700 - RNA, 19 nt, Homo sapiens
uugaagaaguggaaucuaa

SEQ ID NO: 883701 - RNA, 19 nt, Homo sapiens
ggucacugauggugcauuu

SEQ ID NO: 883702 - RNA, 19 nt, Homo sapiens
cagauaggcuuucauuugg

SEQ ID NO: 883703 - RNA, 19 nt, Homo sapiens
gaccagguuuggaagaauu

SEQ ID NO: 883704 - RNA, 19 nt, Homo sapiens
caagugcaguuaacaagau

SEQ ID NO: 883705 - RNA, 19 nt, Homo sapiens
gugaauauuugcucaguca

SEQ ID NO: 883706 - RNA, 19 nt, Homo sapiens
guucaucuauguugcaaau

SEQ ID NO: 883707 - RNA, 19 nt, Homo sapiens
gcaucugaaucuucuaaau

SEQ ID NO: 883708 - RNA, 19 nt, Homo sapiens
agacaugaauggcaagaug

SEQ ID NO: 883709 - RNA, 19 nt, Homo sapiens
cgauugauguacagcuaua

SEQ ID NO: 883710 - RNA, 19 nt, Homo sapiens
ggucuucuguugacuggaa

SEQ ID NO: 883711 - RNA, 19 nt, Homo sapiens
uuacuaaggucgugaugug

SEQ ID NO: 883712 - RNA, 19 nt, Homo sapiens
guauggagcugucacuucu

SEQ ID NO: 883713 - RNA, 19 nt, Homo sapiens
aaugacagauccagccuuu

SEQ ID NO: 883714 - RNA, 19 nt, Homo sapiens
gauguucagucgacacaau

SEQ ID NO: 883715 - RNA, 19 nt, Homo sapiens
ggcauugaguggauucuug

SEQ ID NO: 883716 - RNA, 19 nt, Homo sapiens
uguaagagauccaauucug

SEQ ID NO: 883717 - RNA, 19 nt, Homo sapiens
ugaauggcaagaugaauuu

SEQ ID NO: 883718 - RNA, 19 nt, Homo sapiens
gaguuucaguccuaguauu

SEQ ID NO: 883719 - RNA, 19 nt, Homo sapiens
cuacauggcagucuauaga

SEQ ID NO: 883720 - RNA, 19 nt, Homo sapiens
gguauuggaucaggaguca

SEQ ID NO: 883721 - RNA, 19 nt, Homo sapiens
gucgugaugugaauauuug

SEQ ID NO: 883722 - RNA, 19 nt, Homo sapiens
caaaugcugaagcucauaa

SEQ ID NO: 883723 - RNA, 19 nt, Homo sapiens
gcauacaagugcaguuaac

SEQ ID NO: 883724 - RNA, 19 nt, Homo sapiens
caaccaacauaaauucaac

SEQ ID NO: 883725 - RNA, 19 nt, Homo sapiens
agcuauaacugcuguguuu

SEQ ID NO: 883726 - RNA, 19 nt, Homo sapiens
agaaugugcuguccauaca

SEQ ID NO: 883727 - RNA, 19 nt, Homo sapiens
gccgauugauguacagcua

SEQ ID NO: 883728 - RNA, 19 nt, Homo sapiens
agaggcagauugaugguau

SEQ ID NO: 883729 - RNA, 19 nt, Homo sapiens
cagaaugaaccacgauuug

SEQ ID NO: 883730 - RNA, 19 nt, Homo sapiens
cuugggaacugaaaccauu

SEQ ID NO: 883731 - RNA, 19 nt, Homo sapiens
gaucaggagucaauuuuca

SEQ ID NO: 883732 - RNA, 19 nt, Homo sapiens
guguugagcuugaugucuu

SEQ ID NO: 883733 - RNA, 19 nt, Homo sapiens
ggaccagguuuggaagaau

SEQ ID NO: 883734 - RNA, 19 nt, Homo sapiens
ggucgugaugugaauauuu

SEQ ID NO: 883735 - RNA, 19 nt, Homo sapiens
cuugaugucuucagaggaa

SEQ ID NO: 883736 - RNA, 19 nt, Homo sapiens
agaauugaauaccucuuug

SEQ ID NO: 883737 - RNA, 19 nt, Homo sapiens
cucaugagcugcaucugaa

SEQ ID NO: 883738 - RNA, 19 nt, Homo sapiens
gaucuuccuucuuggucuu

SEQ ID NO: 883739 - RNA, 19 nt, Homo sapiens
gcauugaguggauucuuga

SEQ ID NO: 883740 - RNA, 19 nt, Homo sapiens
aaaagugugugaaguugua

SEQ ID NO: 883741 - RNA, 19 nt, Homo sapiens
ggaacugaaaccauuugaa

SEQ ID NO: 883742 - RNA, 19 nt, Homo sapiens
gcaaaugcugaagcucaua

SEQ ID NO: 883743 - RNA, 19 nt, Homo sapiens
ucaacuaccagaaaggaaa

SEQ ID NO: 883744 - RNA, 19 nt, Homo sapiens
ccaauucuguggagauacu

SEQ ID NO: 883745 - RNA, 19 nt, Homo sapiens
uauagaaugugcuguccau

SEQ ID NO: 883746 - RNA, 19 nt, Homo sapiens
ucagaaugaaccacgauuu

SEQ ID NO: 883747 - RNA, 19 nt, Homo sapiens
caucugaaucuucuaaauc

SEQ ID NO: 883748 - RNA, 19 nt, Homo sapiens
ugacagauccagccuuugg

SEQ ID NO: 883749 - RNA, 19 nt, Homo sapiens
gacaugaauggcaagauga

SEQ ID NO: 883750 - RNA, 19 nt, Homo sapiens
gaggcagauugaugguauu

SEQ ID NO: 883751 - RNA, 19 nt, Homo sapiens
gcugaaacucugacugguu

SEQ ID NO: 883752 - RNA, 19 nt, Homo sapiens
caacaaggaagccgguaca

SEQ ID NO: 883753 - RNA, 19 nt, Homo sapiens
ugggaaguacaaaucauua

SEQ ID NO: 883754 - RNA, 19 nt, Homo sapiens
guaagagauccaauucugu

SEQ ID NO: 883755 - RNA, 19 nt, Homo sapiens
gcaagggaagagcauacaa

SEQ ID NO: 883756 - RNA, 19 nt, Homo sapiens
gccccaaaaugaaccuuua

SEQ ID NO: 883757 - RNA, 19 nt, Homo sapiens
gcuuucauuuggacagcua

SEQ ID NO: 883758 - RNA, 19 nt, Homo sapiens
gagcugcaucugaaucuuc

SEQ ID NO: 883759 - RNA, 19 nt, Homo sapiens
gggaaguacaaaucauuau

SEQ ID NO: 883760 - RNA, 19 nt, Homo sapiens
cuaaggucgugaugugaau

SEQ ID NO: 883761 - RNA, 19 nt, Homo sapiens
guugagggaucuuccuucu

SEQ ID NO: 883762 - RNA, 19 nt, Homo sapiens
gaggaacuuugcccaacag

SEQ ID NO: 883763 - RNA, 19 nt, Homo sapiens
ugagcuugaugucuucaga

SEQ ID NO: 883764 - RNA, 19 nt, Homo sapiens
uuucagaucuugggaacug

SEQ ID NO: 883765 - RNA, 19 nt, Homo sapiens
gauccagccuuugggucuu

SEQ ID NO: 883766 - RNA, 19 nt, Homo sapiens
cagaaaggaaagagauaga

SEQ ID NO: 883767 - RNA, 19 nt, Homo sapiens
gaaugaaccacgauuugcu

SEQ ID NO: 883768 - RNA, 19 nt, Homo sapiens
uacacucccugaucauuca

SEQ ID NO: 883769 - RNA, 19 nt, Homo sapiens
ggauacagaggcugaaacu

SEQ ID NO: 883770 - RNA, 19 nt, Homo sapiens
gaauugaauaccucuuugg

SEQ ID NO: 883771 - RNA, 19 nt, Homo sapiens
auggagcugucacuucuuu

SEQ ID NO: 883772 - RNA, 19 nt, Homo sapiens
gaagaaguggaaucuaagc

SEQ ID NO: 883773 - RNA, 19 nt, Homo sapiens
caagggaagagcauacaag

SEQ ID NO: 883774 - RNA, 19 nt, Homo sapiens
agaggaacuuugcccaaca

SEQ ID NO: 883775 - RNA, 19 nt, Homo sapiens
ccucuuugguguugagcuu

SEQ ID NO: 883776 - RNA, 19 nt, Homo sapiens
cucaugaucugugucaguu

SEQ ID NO: 883777 - RNA, 19 nt, Homo sapiens
aagaguuucaguccuagua

SEQ ID NO: 883778 - RNA, 19 nt, Homo sapiens
gcgcuagcguggcucuaag

SEQ ID NO: 883779 - RNA, 19 nt, Homo sapiens
ucaucuauguugcaaaugc

SEQ ID NO: 883780 - RNA, 19 nt, Homo sapiens
gaaacuguaagagauccaa

SEQ ID NO: 883781 - RNA, 19 nt, Homo sapiens
gagcaagggaagagcauac

SEQ ID NO: 883782 - RNA, 19 nt, Homo sapiens
aaauccagccguccuaugu

SEQ ID NO: 883783 - RNA, 19 nt, Homo sapiens
acauggcagucuauagaau

SEQ ID NO: 883784 - RNA, 19 nt, Homo sapiens
gugauuccacagauucaaa

SEQ ID NO: 883785 - RNA, 19 nt, Homo sapiens
accacgauuugcuauguuu

SEQ ID NO: 883786 - RNA, 19 nt, Homo sapiens
guuucaguccuaguauuua

SEQ ID NO: 883787 - RNA, 19 nt, Homo sapiens
agauaggcuuucauuugga

SEQ ID NO: 883788 - RNA, 19 nt, Homo sapiens
ggcagucagugagcaagga

SEQ ID NO: 883789 - RNA, 19 nt, Homo sapiens
guaaagagaugugauggua

SEQ ID NO: 883790 - RNA, 19 nt, Homo sapiens
gccaugagcuaguauuaua

SEQ ID NO: 883791 - RNA, 19 nt, Homo sapiens
gaaugaaacuguaagagau

SEQ ID NO: 883792 - RNA, 19 nt, Homo sapiens
gaacaaccaacauaaauuc

SEQ ID NO: 883793 - RNA, 19 nt, Homo sapiens
uuacagggcuaucuauaaa

SEQ ID NO: 883794 - RNA, 19 nt, Homo sapiens
gaaccacgauuugcuaugu

SEQ ID NO: 883795 - RNA, 19 nt, Homo sapiens
ugagggaucuuccuucuug

SEQ ID NO: 883796 - RNA, 19 nt, Homo sapiens
ggaaugaaacuguaagaga

SEQ ID NO: 883797 - RNA, 19 nt, Homo sapiens
guacuagagcuauacaaua

SEQ ID NO: 883798 - RNA, 19 nt, Homo sapiens
gaauaccucuuugguguug

SEQ ID NO: 883799 - RNA, 19 nt, Homo sapiens
gaaagcaguugcaauuacu

SEQ ID NO: 883800 - RNA, 19 nt, Homo sapiens
gaugguaggguguuaagua

SEQ ID NO: 883801 - RNA, 19 nt, Homo sapiens
gcagauugaugguauugga

SEQ ID NO: 883802 - RNA, 19 nt, Homo sapiens
gagcauacaagugcaguua

SEQ ID NO: 883803 - RNA, 19 nt, Homo sapiens
ggaagccgguacaguguga

SEQ ID NO: 883804 - RNA, 19 nt, Homo sapiens
cuaauacacugguuugaau

SEQ ID NO: 883805 - RNA, 19 nt, Homo sapiens
guugagaacacuauucaua

SEQ ID NO: 883806 - RNA, 19 nt, Homo sapiens
uuucugacccuuacuauua

SEQ ID NO: 883807 - RNA, 19 nt, Homo sapiens
ggucacugauggugcauuu

SEQ ID NO: 883808 - RNA, 19 nt, Homo sapiens
caugaaagcaguugcaauu

SEQ ID NO: 883809 - RNA, 19 nt, Homo sapiens
gguguuaaguagauuaguu

SEQ ID NO: 883810 - RNA, 19 nt, Homo sapiens
gaccagguuuggaagaauu

SEQ ID NO: 883811 - RNA, 19 nt, Homo sapiens
gcuucuggcuuuauucaaa

SEQ ID NO: 883812 - RNA, 19 nt, Homo sapiens
caagugcaguuaacaagau

SEQ ID NO: 883813 - RNA, 19 nt, Homo sapiens
guucaucuauguugcaaau

SEQ ID NO: 883814 - RNA, 19 nt, Homo sapiens
cgauugauguacagcuaua

SEQ ID NO: 883815 - RNA, 19 nt, Homo sapiens
ggucuucuguugacuggaa

SEQ ID NO: 883816 - RNA, 19 nt, Homo sapiens
gcacauuguucuuuucaaa

SEQ ID NO: 883817 - RNA, 19 nt, Homo sapiens
guauggagcugucacuucu

SEQ ID NO: 883818 - RNA, 19 nt, Homo sapiens
ugaaagcaguugcaauuac

SEQ ID NO: 883819 - RNA, 19 nt, Homo sapiens
gguaggguguuaaguagau

SEQ ID NO: 883820 - RNA, 19 nt, Homo sapiens
gauguucagucgacacaau

SEQ ID NO: 883821 - RNA, 19 nt, Homo sapiens
uguaagagauccaauucug

SEQ ID NO: 883822 - RNA, 19 nt, Homo sapiens
cuacauggcagucuauaga

SEQ ID NO: 883823 - RNA, 19 nt, Homo sapiens
gguauuggaucaggaguca

SEQ ID NO: 883824 - RNA, 19 nt, Homo sapiens
acacugguuugaauuucua

SEQ ID NO: 883825 - RNA, 19 nt, Homo sapiens
caaaugcugaagcucauaa

SEQ ID NO: 883826 - RNA, 19 nt, Homo sapiens
gcauacaagugcaguuaac

SEQ ID NO: 883827 - RNA, 19 nt, Homo sapiens
caaccaacauaaauucaac

SEQ ID NO: 883828 - RNA, 19 nt, Homo sapiens
agaaugugcuguccauaca

SEQ ID NO: 883829 - RNA, 19 nt, Homo sapiens
gccgauugauguacagcua

SEQ ID NO: 883830 - RNA, 19 nt, Homo sapiens
agaggcagauugaugguau

SEQ ID NO: 883831 - RNA, 19 nt, Homo sapiens
cagaaugaaccacgauuug

SEQ ID NO: 883832 - RNA, 19 nt, Homo sapiens
gggccaugagcuaguauua

SEQ ID NO: 883833 - RNA, 19 nt, Homo sapiens
ucugaugcauuccaaaguu

SEQ ID NO: 883834 - RNA, 19 nt, Homo sapiens
gaucaggagucaauuuuca

SEQ ID NO: 883835 - RNA, 19 nt, Homo sapiens
guguugagcuugaugucuu

SEQ ID NO: 883836 - RNA, 19 nt, Homo sapiens
ggaccagguuuggaagaau

SEQ ID NO: 883837 - RNA, 19 nt, Homo sapiens
cuugaugucuucagaggaa

SEQ ID NO: 883838 - RNA, 19 nt, Homo sapiens
agaauugaauaccucuuug

SEQ ID NO: 883839 - RNA, 19 nt, Homo sapiens
guuaacaagcugauuccua

SEQ ID NO: 883840 - RNA, 19 nt, Homo sapiens
gaucuuccuucuuggucuu

SEQ ID NO: 883841 - RNA, 19 nt, Homo sapiens
aaaagugugugaaguugua

SEQ ID NO: 883842 - RNA, 19 nt, Homo sapiens
caaagcaaauggaaaauac

SEQ ID NO: 883843 - RNA, 19 nt, Homo sapiens
gcaaaugcugaagcucaua

SEQ ID NO: 883844 - RNA, 19 nt, Homo sapiens
ucaacuaccagaaaggaaa

SEQ ID NO: 883845 - RNA, 19 nt, Homo sapiens
ccaauucuguggagauacu

SEQ ID NO: 883846 - RNA, 19 nt, Homo sapiens
uauagaaugugcuguccau

SEQ ID NO: 883847 - RNA, 19 nt, Homo sapiens
gguacuagagcuauacaau

SEQ ID NO: 883848 - RNA, 19 nt, Homo sapiens
cugaugcauuccaaaguuu

SEQ ID NO: 883849 - RNA, 19 nt, Homo sapiens
acuuuacuguggcuucuua

SEQ ID NO: 883850 - RNA, 19 nt, Homo sapiens
ucagaaugaaccacgauuu

SEQ ID NO: 883851 - RNA, 19 nt, Homo sapiens
agauuuggguugugugaau

SEQ ID NO: 883852 - RNA, 19 nt, Homo sapiens
gcaaauggaaaauaccuuu

SEQ ID NO: 883853 - RNA, 19 nt, Homo sapiens
gaggcagauugaugguauu

SEQ ID NO: 883854 - RNA, 19 nt, Homo sapiens
caacaaggaagccgguaca

SEQ ID NO: 883855 - RNA, 19 nt, Homo sapiens
ugggaaguacaaaucauua

SEQ ID NO: 883856 - RNA, 19 nt, Homo sapiens
guaagagauccaauucugu

SEQ ID NO: 883857 - RNA, 19 nt, Homo sapiens
guuauuacagggcuaucua

SEQ ID NO: 883858 - RNA, 19 nt, Homo sapiens
gugaacaagguagaauaua

SEQ ID NO: 883859 - RNA, 19 nt, Homo sapiens
uuccuacccugguggauuu

SEQ ID NO: 883860 - RNA, 19 nt, Homo sapiens
ucaccugggaagcuuguua

SEQ ID NO: 883861 - RNA, 19 nt, Homo sapiens
gcaagggaagagcauacaa

SEQ ID NO: 883862 - RNA, 19 nt, Homo sapiens
gggaaguacaaaucauuau

SEQ ID NO: 883863 - RNA, 19 nt, Homo sapiens
guugagggaucuuccuucu

SEQ ID NO: 883864 - RNA, 19 nt, Homo sapiens
gaggaacuuugcccaacag

SEQ ID NO: 883865 - RNA, 19 nt, Homo sapiens
ugagcuugaugucuucaga

SEQ ID NO: 883866 - RNA, 19 nt, Homo sapiens
cagaaaggaaagagauaga

SEQ ID NO: 883867 - RNA, 19 nt, Homo sapiens
gaaugaaccacgauuugcu

SEQ ID NO: 883868 - RNA, 19 nt, Homo sapiens
uacacucccugaucauuca

SEQ ID NO: 883869 - RNA, 19 nt, Homo sapiens
uauuacagggcuaucuaua

SEQ ID NO: 883870 - RNA, 19 nt, Homo sapiens
ccaugagcuaguauuauaa

SEQ ID NO: 883871 - RNA, 19 nt, Homo sapiens
guagauuaguugagaacac

SEQ ID NO: 883872 - RNA, 19 nt, Homo sapiens
gaauugaauaccucuuugg

SEQ ID NO: 883873 - RNA, 19 nt, Homo sapiens
auggagcugucacuucuuu

SEQ ID NO: 883874 - RNA, 19 nt, Homo sapiens
guuugguacuagagcuaua

SEQ ID NO: 883875 - RNA, 19 nt, Homo sapiens
uuacuguggcuucuuaaga

SEQ ID NO: 883876 - RNA, 19 nt, Homo sapiens
gcaguugcaauuacuuucu

SEQ ID NO: 883877 - RNA, 19 nt, Homo sapiens
ugugaucuguuaggcauga

SEQ ID NO: 883878 - RNA, 19 nt, Homo sapiens
uaauaucuuucccaaaucc

SEQ ID NO: 883879 - RNA, 19 nt, Homo sapiens
guaggguguuaaguagauu

SEQ ID NO: 883880 - RNA, 19 nt, Homo sapiens
caaauaguaaagagaugug

SEQ ID NO: 883881 - RNA, 19 nt, Homo sapiens
ccaaauaguaaagagaugu

SEQ ID NO: 883882 - RNA, 19 nt, Homo sapiens
caagggaagagcauacaag

SEQ ID NO: 883883 - RNA, 19 nt, Homo sapiens
agaggaacuuugcccaaca

SEQ ID NO: 883884 - RNA, 19 nt, Homo sapiens
ccucuuugguguugagcuu

SEQ ID NO: 883885 - RNA, 19 nt, Homo sapiens
gaaacuguaagagauccaa

SEQ ID NO: 883886 - RNA, 19 nt, Homo sapiens
cucaugaucugugucaguu

SEQ ID NO: 883887 - RNA, 19 nt, Homo sapiens
acauggcagucuauagaau

SEQ ID NO: 883888 - RNA, 19 nt, Homo sapiens
gcaugaaagcaguugcaau

SEQ ID NO: 883889 - RNA, 19 nt, Homo sapiens
gaagauacauugaccauua

SEQ ID NO: 883890 - RNA, 19 nt, Homo sapiens
gggaugaucucaagaaaua

SEQ ID NO: 883891 - RNA, 19 nt, Homo sapiens
gaaauacugucucccuuua

SEQ ID NO: 883892 - RNA, 19 nt, Homo sapiens
gcuaagaccuugacuuuaa

SEQ ID NO: 883893 - RNA, 19 nt, Homo sapiens
gacaagaucuuuaauguug

SEQ ID NO: 883894 - RNA, 19 nt, Homo sapiens
ggaaaucucucuucauaga

SEQ ID NO: 883895 - RNA, 19 nt, Homo sapiens
gaacuuagcucuguacauc

SEQ ID NO: 883896 - RNA, 19 nt, Homo sapiens
gcacaaggauagagagaaa

SEQ ID NO: 883897 - RNA, 19 nt, Homo sapiens
ggaaauggguccugaugaa

SEQ ID NO: 883898 - RNA, 19 nt, Homo sapiens
gaaacuaugugacucauuc

SEQ ID NO: 883899 - RNA, 19 nt, Homo sapiens
gaacggacauaccuuuguu

SEQ ID NO: 883900 - RNA, 19 nt, Homo sapiens
guaacgugcuguuuauuaa

SEQ ID NO: 883901 - RNA, 19 nt, Homo sapiens
ggacauaccuuuguuuuaa

SEQ ID NO: 883902 - RNA, 19 nt, Homo sapiens
ucaaggaccuggaguaguu

SEQ ID NO: 883903 - RNA, 19 nt, Homo sapiens
caggauacauggaaggaua

SEQ ID NO: 883904 - RNA, 19 nt, Homo sapiens
gcauggcacugucuaauca

SEQ ID NO: 883905 - RNA, 19 nt, Homo sapiens
acagagaacuaauugacua

SEQ ID NO: 883906 - RNA, 19 nt, Homo sapiens
uuggaaaucucucuucaua

SEQ ID NO: 883907 - RNA, 19 nt, Homo sapiens
uggaguaguuggugaauuu

SEQ ID NO: 883908 - RNA, 19 nt, Homo sapiens
gauucuaggcuguuaaaua

SEQ ID NO: 883909 - RNA, 19 nt, Homo sapiens
gcaagcuuccugacgauua

SEQ ID NO: 883910 - RNA, 19 nt, Homo sapiens
guaaauacugcuucuguuu

SEQ ID NO: 883911 - RNA, 19 nt, Homo sapiens
uaaaauaccugcacaagga

SEQ ID NO: 883912 - RNA, 19 nt, Homo sapiens
gauggaagcacuaggauga

SEQ ID NO: 883913 - RNA, 19 nt, Homo sapiens
gacagucgcuauuggagaa

SEQ ID NO: 883914 - RNA, 19 nt, Homo sapiens
ccaaauggcucgaaaucca

SEQ ID NO: 883915 - RNA, 19 nt, Homo sapiens
cuaaauuguucucugcaua

SEQ ID NO: 883916 - RNA, 19 nt, Homo sapiens
gaugaugauucagcagaua

SEQ ID NO: 883917 - RNA, 19 nt, Homo sapiens
ccauuaugcugcuauuaaa

SEQ ID NO: 883918 - RNA, 19 nt, Homo sapiens
ggaggagagucuuugaugu

SEQ ID NO: 883919 - RNA, 19 nt, Homo sapiens
cagcagauauggaugaauc

SEQ ID NO: 883920 - RNA, 19 nt, Homo sapiens
gaaauccagcugcuauuga

SEQ ID NO: 883921 - RNA, 19 nt, Homo sapiens
guuagugguuccuggguua

SEQ ID NO: 883922 - RNA, 19 nt, Homo sapiens
guauguaacgugcuguuua

SEQ ID NO: 883923 - RNA, 19 nt, Homo sapiens
ucacuacaaccuugaauuu

SEQ ID NO: 883924 - RNA, 19 nt, Homo sapiens
gcagagacagggacugaaa

SEQ ID NO: 883925 - RNA, 19 nt, Homo sapiens
gaauaguucucuagcuaag

SEQ ID NO: 883926 - RNA, 19 nt, Homo sapiens
aauacuggcugauaucuga

SEQ ID NO: 883927 - RNA, 19 nt, Homo sapiens
gacacuacauuaggaauug

SEQ ID NO: 883928 - RNA, 19 nt, Homo sapiens
ggaugauucuaggcuguua

SEQ ID NO: 883929 - RNA, 19 nt, Homo sapiens
gacagggacugaaauacug

SEQ ID NO: 883930 - RNA, 19 nt, Homo sapiens
ggaaaacuagcaugaaaua

SEQ ID NO: 883931 - RNA, 19 nt, Homo sapiens
gaggagagucuuugauguu

SEQ ID NO: 883932 - RNA, 19 nt, Homo sapiens
ugagaaggccugucaguug

SEQ ID NO: 883933 - RNA, 19 nt, Homo sapiens
caugaugaccuuggauuua

SEQ ID NO: 883934 - RNA, 19 nt, Homo sapiens
uuucaggucuucaacauga

SEQ ID NO: 883935 - RNA, 19 nt, Homo sapiens
agacgaggaugaugauuca

SEQ ID NO: 883936 - RNA, 19 nt, Homo sapiens
uauguaacgugcuguuuau

SEQ ID NO: 883937 - RNA, 19 nt, Homo sapiens
cuaagaccuugacuuuaaa

SEQ ID NO: 883938 - RNA, 19 nt, Homo sapiens
acacuugacugucuuugug

SEQ ID NO: 883939 - RNA, 19 nt, Homo sapiens
gcugauaucugaggaagag

SEQ ID NO: 883940 - RNA, 19 nt, Homo sapiens
ugaugaauaugaagagaug

SEQ ID NO: 883941 - RNA, 19 nt, Homo sapiens
caagcuuccugacgauuau

SEQ ID NO: 883942 - RNA, 19 nt, Homo sapiens
uguaacgugcuguuuauua

SEQ ID NO: 883943 - RNA, 19 nt, Homo sapiens
gcauauagcaggaaaacua

SEQ ID NO: 883944 - RNA, 19 nt, Homo sapiens
guuuaccucuuaugucaaa

SEQ ID NO: 883945 - RNA, 19 nt, Homo sapiens
ggaugaaucagaugaagau

SEQ ID NO: 883946 - RNA, 19 nt, Homo sapiens
augaagagauggaagaaga

SEQ ID NO: 883947 - RNA, 19 nt, Homo sapiens
aaauggguccugaugaaua

SEQ ID NO: 883948 - RNA, 19 nt, Homo sapiens
aagaugcacuuccugagaa

SEQ ID NO: 883949 - RNA, 19 nt, Homo sapiens
cagcugcuauugacauguu

SEQ ID NO: 883950 - RNA, 19 nt, Homo sapiens
ucgcuaagaccuugacuuu

SEQ ID NO: 883951 - RNA, 19 nt, Homo sapiens
caggucggguauaugaaua

SEQ ID NO: 883952 - RNA, 19 nt, Homo sapiens
ggagaauaacaaaugcuaa

SEQ ID NO: 883953 - RNA, 19 nt, Homo sapiens
gagaccaaauuuucagaua

SEQ ID NO: 883954 - RNA, 19 nt, Homo sapiens
ucauagauacuuacucuga

SEQ ID NO: 883955 - RNA, 19 nt, Homo sapiens
gaagaaucaguguuggaaa

SEQ ID NO: 883956 - RNA, 19 nt, Homo sapiens
ugugauaagugacaugaau

SEQ ID NO: 883957 - RNA, 19 nt, Homo sapiens
auucuaggcuguuaaauag

SEQ ID NO: 883958 - RNA, 19 nt, Homo sapiens
gcagagggccgaaacaaaa

SEQ ID NO: 883959 - RNA, 19 nt, Homo sapiens
aagaaucaguguuggaaau

SEQ ID NO: 883960 - RNA, 19 nt, Homo sapiens
gagaacuaauugacuaaac

SEQ ID NO: 883961 - RNA, 19 nt, Homo sapiens
aggagucaguggaagaaua

SEQ ID NO: 883962 - RNA, 19 nt, Homo sapiens
gaaauggguccugaugaau

SEQ ID NO: 883963 - RNA, 19 nt, Homo sapiens
ggcccuggguucuauguga

SEQ ID NO: 883964 - RNA, 19 nt, Homo sapiens
gagaauaacaaaugcuaag

SEQ ID NO: 883965 - RNA, 19 nt, Homo sapiens
caucaucagagaccaaauu

SEQ ID NO: 883966 - RNA, 19 nt, Homo sapiens
cugacugguuuaccucuua

SEQ ID NO: 883967 - RNA, 19 nt, Homo sapiens
ugaaauacugucucccuuu

SEQ ID NO: 883968 - RNA, 19 nt, Homo sapiens
augaugaccuuggauuuaa

SEQ ID NO: 883969 - RNA, 19 nt, Homo sapiens
gcuagugguuuguccuuag

SEQ ID NO: 883970 - RNA, 19 nt, Homo sapiens
ggaugaugauucagcagau

SEQ ID NO: 883971 - RNA, 19 nt, Homo sapiens
gcccaggucggguauauga

SEQ ID NO: 883972 - RNA, 19 nt, Homo sapiens
gaagcauggcacugucuaa

SEQ ID NO: 883973 - RNA, 19 nt, Homo sapiens
ugagguagaggaagaaaug

SEQ ID NO: 883974 - RNA, 19 nt, Homo sapiens
ggaagacgaggaugaugau

SEQ ID NO: 883975 - RNA, 19 nt, Homo sapiens
cacauucucuacaacauca

SEQ ID NO: 883976 - RNA, 19 nt, Homo sapiens
cccacuauuucuucacaua

SEQ ID NO: 883977 - RNA, 19 nt, Homo sapiens
ucacaauggacagaaguua

SEQ ID NO: 883978 - RNA, 19 nt, Homo sapiens
agauauggaugaaucagau

SEQ ID NO: 883979 - RNA, 19 nt, Homo sapiens
gaccaaauggcucgaaauc

SEQ ID NO: 883980 - RNA, 19 nt, Homo sapiens
agagacagggacugaaaua

SEQ ID NO: 883981 - RNA, 19 nt, Homo sapiens
cuucauagauacuuacucu

SEQ ID NO: 883982 - RNA, 19 nt, Homo sapiens
uguaaauacugcuucuguu

SEQ ID NO: 883983 - RNA, 19 nt, Homo sapiens
ggaacggacauaccuuugu

SEQ ID NO: 883984 - RNA, 19 nt, Homo sapiens
caggaaaacuagcaugaaa

SEQ ID NO: 883985 - RNA, 19 nt, Homo sapiens
agaugaagaugaugaagag

SEQ ID NO: 883986 - RNA, 19 nt, Homo sapiens
ggcacugucuaaucacuau

SEQ ID NO: 883987 - RNA, 19 nt, Homo sapiens
agaccucgaugcuguggaa

SEQ ID NO: 883988 - RNA, 19 nt, Homo sapiens
gauacuuacucugauguag

SEQ ID NO: 883989 - RNA, 19 nt, Homo sapiens
gaagauacauugaccauua

SEQ ID NO: 883990 - RNA, 19 nt, Homo sapiens
gggaugaucucaagaaaua

SEQ ID NO: 883991 - RNA, 19 nt, Homo sapiens
gaaauacugucucccuuua

SEQ ID NO: 883992 - RNA, 19 nt, Homo sapiens
gacaagaucuuuaauguug

SEQ ID NO: 883993 - RNA, 19 nt, Homo sapiens
ggaaaucucucuucauaga

SEQ ID NO: 883994 - RNA, 19 nt, Homo sapiens
gaacuuagcucuguacauc

SEQ ID NO: 883995 - RNA, 19 nt, Homo sapiens
gcucaaacuuccaauuuaa

SEQ ID NO: 883996 - RNA, 19 nt, Homo sapiens
ugagagaaauggacaagua

SEQ ID NO: 883997 - RNA, 19 nt, Homo sapiens
ucaaggaccuggaguaguu

SEQ ID NO: 883998 - RNA, 19 nt, Homo sapiens
caggauacauggaaggaua

SEQ ID NO: 883999 - RNA, 19 nt, Homo sapiens
gcauggcacugucuaauca

SEQ ID NO: 884000 - RNA, 19 nt, Homo sapiens
gaaaacaacuucuuacagu

SEQ ID NO: 884001 - RNA, 19 nt, Homo sapiens
uaaauaguguuccagagaa

SEQ ID NO: 884002 - RNA, 19 nt, Homo sapiens
uuggaaaucucucuucaua

SEQ ID NO: 884003 - RNA, 19 nt, Homo sapiens
uggaguaguuggugaauuu

SEQ ID NO: 884004 - RNA, 19 nt, Homo sapiens
gcaagcuuccugacgauua

SEQ ID NO: 884005 - RNA, 19 nt, Homo sapiens
ccagagaacccuagagauu

SEQ ID NO: 884006 - RNA, 19 nt, Homo sapiens
gacagucgcuauuggagaa

SEQ ID NO: 884007 - RNA, 19 nt, Homo sapiens
ccaaauggcucgaaaucca

SEQ ID NO: 884008 - RNA, 19 nt, Homo sapiens
ccauuaugcugcuauuaaa

SEQ ID NO: 884009 - RNA, 19 nt, Homo sapiens
gaaauccagcugcuauuga

SEQ ID NO: 884010 - RNA, 19 nt, Homo sapiens
guuagugguuccuggguua

SEQ ID NO: 884011 - RNA, 19 nt, Homo sapiens
cagauaagccaggcaaaua

SEQ ID NO: 884012 - RNA, 19 nt, Homo sapiens
gcagagacagggacugaaa

SEQ ID NO: 884013 - RNA, 19 nt, Homo sapiens
ccaggcaaauaguuaguuu

SEQ ID NO: 884014 - RNA, 19 nt, Homo sapiens
aauacuggcugauaucuga

SEQ ID NO: 884015 - RNA, 19 nt, Homo sapiens
gccuaaauguagauuauga

SEQ ID NO: 884016 - RNA, 19 nt, Homo sapiens
gaaauggacaaguaaaugg

SEQ ID NO: 884017 - RNA, 19 nt, Homo sapiens
gagagaaauggacaaguaa

SEQ ID NO: 884018 - RNA, 19 nt, Homo sapiens
gacagggacugaaauacug

SEQ ID NO: 884019 - RNA, 19 nt, Homo sapiens
gugaauuuguugagagaaa

SEQ ID NO: 884020 - RNA, 19 nt, Homo sapiens
ugagaaggccugucaguug

SEQ ID NO: 884021 - RNA, 19 nt, Homo sapiens
ccaguagaaucagcuuuaa

SEQ ID NO: 884022 - RNA, 19 nt, Homo sapiens
cagagaacccuagagauuu

SEQ ID NO: 884023 - RNA, 19 nt, Homo sapiens
caagcuuccugacgauuau

SEQ ID NO: 884024 - RNA, 19 nt, Homo sapiens
gcugauaucugaggaagag

SEQ ID NO: 884025 - RNA, 19 nt, Homo sapiens
ugagaaauaccacauuaga

SEQ ID NO: 884026 - RNA, 19 nt, Homo sapiens
gagaaauggacaaguaaau

SEQ ID NO: 884027 - RNA, 19 nt, Homo sapiens
uaagccaggcaaauaguua

SEQ ID NO: 884028 - RNA, 19 nt, Homo sapiens
guuuaccucuuaugucaaa

SEQ ID NO: 884029 - RNA, 19 nt, Homo sapiens
aagaugcacuuccugagaa

SEQ ID NO: 884030 - RNA, 19 nt, Homo sapiens
cagcugcuauugacauguu

SEQ ID NO: 884031 - RNA, 19 nt, Homo sapiens
caggucggguauaugaaua

SEQ ID NO: 884032 - RNA, 19 nt, Homo sapiens
ggagaauaacaaaugcuaa

SEQ ID NO: 884033 - RNA, 19 nt, Homo sapiens
gagaccaaauuuucagaua

SEQ ID NO: 884034 - RNA, 19 nt, Homo sapiens
ucauagauacuuacucuga

SEQ ID NO: 884035 - RNA, 19 nt, Homo sapiens
gaagaaucaguguuggaaa

SEQ ID NO: 884036 - RNA, 19 nt, Homo sapiens
ugcucaaacuuccaauuua

SEQ ID NO: 884037 - RNA, 19 nt, Homo sapiens
gguuaacacugcagauaag

SEQ ID NO: 884038 - RNA, 19 nt, Homo sapiens
gcagagggccgaaacaaaa

SEQ ID NO: 884039 - RNA, 19 nt, Homo sapiens
aagaaucaguguuggaaau

SEQ ID NO: 884040 - RNA, 19 nt, Homo sapiens
gcagauaagccaggcaaau

SEQ ID NO: 884041 - RNA, 19 nt, Homo sapiens
gucuauagcccgauuggua

SEQ ID NO: 884042 - RNA, 19 nt, Homo sapiens
gagaauaacaaaugcuaag

SEQ ID NO: 884043 - RNA, 19 nt, Homo sapiens
caucaucagagaccaaauu

SEQ ID NO: 884044 - RNA, 19 nt, Homo sapiens
cugacugguuuaccucuua

SEQ ID NO: 884045 - RNA, 19 nt, Homo sapiens
ugaaauacugucucccuuu

SEQ ID NO: 884046 - RNA, 19 nt, Homo sapiens
ggguuaacacugcagauaa

SEQ ID NO: 884047 - RNA, 19 nt, Homo sapiens
gcccaggucggguauauga

SEQ ID NO: 884048 - RNA, 19 nt, Homo sapiens
gaagcauggcacugucuaa

SEQ ID NO: 884049 - RNA, 19 nt, Homo sapiens
uggccuaaauguagauuau

SEQ ID NO: 884050 - RNA, 19 nt, Homo sapiens
cacauucucuacaacauca

SEQ ID NO: 884051 - RNA, 19 nt, Homo sapiens
cccacuauuucuucacaua

SEQ ID NO: 884052 - RNA, 19 nt, Homo sapiens
ucacaauggacagaaguua

SEQ ID NO: 884053 - RNA, 19 nt, Homo sapiens
guucaguggccuaaaugua

SEQ ID NO: 884054 - RNA, 19 nt, Homo sapiens
gaccaaauggcucgaaauc

SEQ ID NO: 884055 - RNA, 19 nt, Homo sapiens
agagacagggacugaaaua

SEQ ID NO: 884056 - RNA, 19 nt, Homo sapiens
cuucauagauacuuacucu

SEQ ID NO: 884057 - RNA, 19 nt, Homo sapiens
cauuagaccaguagaauca

SEQ ID NO: 884058 - RNA, 19 nt, Homo sapiens
acaugacuuuguaggguua

SEQ ID NO: 884059 - RNA, 19 nt, Homo sapiens
ggcacugucuaaucacuau

SEQ ID NO: 884060 - RNA, 19 nt, Homo sapiens
agaccucgaugcuguggaa

SEQ ID NO: 884061 - RNA, 19 nt, Homo sapiens
ucaguggccuaaauguaga

SEQ ID NO: 884062 - RNA, 19 nt, Homo sapiens
caacauucagggugucuau

SEQ ID NO: 884063 - RNA, 19 nt, Homo sapiens
ugguuuaccucuuauguca

SEQ ID NO: 884064 - RNA, 19 nt, Homo sapiens
cuaccaauguccagaccaa

SEQ ID NO: 884065 - RNA, 19 nt, Homo sapiens
ucacuaucguucugaagau

SEQ ID NO: 884066 - RNA, 19 nt, Homo sapiens
gauacuuacucugauguag

SEQ ID NO: 884067 - RNA, 19 nt, Homo sapiens
gaccaaauuuucagauaug

SEQ ID NO: 884068 - RNA, 19 nt, Homo sapiens
gaagagaaaacacagaaga

SEQ ID NO: 884069 - RNA, 19 nt, Homo sapiens
ggaagcauggcacugucua

SEQ ID NO: 884070 - RNA, 19 nt, Homo sapiens
agagggugcucgagaggaa

SEQ ID NO: 884071 - RNA, 19 nt, Homo sapiens
aaacaacuucuuacagugu

SEQ ID NO: 884072 - RNA, 19 nt, Homo sapiens
gaaucaguguuggaaaucu

SEQ ID NO: 884073 - RNA, 19 nt, Homo sapiens
uagcccgauugguaaguua

SEQ ID NO: 884074 - RNA, 19 nt, Homo sapiens
uuucagauauguucacgau

SEQ ID NO: 884075 - RNA, 19 nt, Homo sapiens
cagaccaaauggcucgaaa

SEQ ID NO: 884076 - RNA, 19 nt, Homo sapiens
guacauagcaguggaagcu

SEQ ID NO: 884077 - RNA, 19 nt, Homo sapiens
cacagaagaaucaguguug

SEQ ID NO: 884078 - RNA, 19 nt, Homo sapiens
cauagauacuuacucugau

SEQ ID NO: 884079 - RNA, 19 nt, Homo sapiens
aaagaugcacuuccugaga

SEQ ID NO: 884080 - RNA, 19 nt, Homo sapiens
cgaaauccagcugcuauug

SEQ ID NO: 884081 - RNA, 19 nt, Homo sapiens
ggccugggaugaucucaag

SEQ ID NO: 884082 - RNA, 19 nt, Homo sapiens
gauacauggaaggauauua

SEQ ID NO: 884083 - RNA, 19 nt, Homo sapiens
aguagaaucagcuuuaaga

SEQ ID NO: 884084 - RNA, 19 nt, Homo sapiens
ccacauuagaccaguagaa

SEQ ID NO: 884085 - RNA, 19 nt, Homo sapiens
gauaagccaggcaaauagu

SEQ ID NO: 884086 - RNA, 19 nt, Homo sapiens
ucuauagcccgauugguaa

SEQ ID NO: 884087 - RNA, 19 nt, Homo sapiens
cacaagcuguaccacauuc

SEQ ID NO: 884088 - RNA, 19 nt, Homo sapiens
cagcccaggucggguauau

SEQ ID NO: 884089 - RNA, 19 nt, Homo sapiens
gcacacagaugcagcagaa

SEQ ID NO: 884090 - RNA, 19 nt, Homo sapiens
gaagauagcuccaguuuuc

SEQ ID NO: 884091 - RNA, 19 nt, Homo sapiens
gaaaccagcugaucuaaaa

SEQ ID NO: 884092 - RNA, 19 nt, Homo sapiens
gcacugacucuuaauauga

SEQ ID NO: 884093 - RNA, 19 nt, Homo sapiens
ucaaugcacugacucuuaa

SEQ ID NO: 884094 - RNA, 19 nt, Homo sapiens
gggaagcagugauuugaaa

SEQ ID NO: 884095 - RNA, 19 nt, Homo sapiens
ucaaagaccuugcaagaag

SEQ ID NO: 884096 - RNA, 19 nt, Homo sapiens
ggguggagguuauuucuuu

SEQ ID NO: 884097 - RNA, 19 nt, Homo sapiens
ggaacaagauccugaaacu

SEQ ID NO: 884098 - RNA, 19 nt, Homo sapiens
cagaagaggugcuauugga

SEQ ID NO: 884099 - RNA, 19 nt, Homo sapiens
gcagauuuauccacagcua

SEQ ID NO: 884100 - RNA, 19 nt, Homo sapiens
gccagaaacugcaauagga

SEQ ID NO: 884101 - RNA, 19 nt, Homo sapiens
ccagaaaccuuauguugca

SEQ ID NO: 884102 - RNA, 19 nt, Homo sapiens
gaauaaugcuguugguucu

SEQ ID NO: 884103 - RNA, 19 nt, Homo sapiens
gaagaggugcuauuggaaa

SEQ ID NO: 884104 - RNA, 19 nt, Homo sapiens
caaaaggacuaauaccaua

SEQ ID NO: 884105 - RNA, 19 nt, Homo sapiens
gaagauuuguuagccuuga

SEQ ID NO: 884106 - RNA, 19 nt, Homo sapiens
cuagagcaauugaagguaa

SEQ ID NO: 884107 - RNA, 19 nt, Homo sapiens
gaccaaaguuccucaaugc

SEQ ID NO: 884108 - RNA, 19 nt, Homo sapiens
ccaauacuguggaagaaau

SEQ ID NO: 884109 - RNA, 19 nt, Homo sapiens
gagguuuaaugcauucaaa

SEQ ID NO: 884110 - RNA, 19 nt, Homo sapiens
guuagaggaagauuuguua

SEQ ID NO: 884111 - RNA, 19 nt, Homo sapiens
aacaagauccugaaacuuu

SEQ ID NO: 884112 - RNA, 19 nt, Homo sapiens
gaaaucuccuucaaaagaa

SEQ ID NO: 884113 - RNA, 19 nt, Homo sapiens
ggaaaccagcugaucuaaa

SEQ ID NO: 884114 - RNA, 19 nt, Homo sapiens
cagaagauagcuccaguuu

SEQ ID NO: 884115 - RNA, 19 nt, Homo sapiens
gcaagaaguacuaacuaug

SEQ ID NO: 884116 - RNA, 19 nt, Homo sapiens
uaagauugaucgagacaag

SEQ ID NO: 884117 - RNA, 19 nt, Homo sapiens
aggaauugcuacacacuuu

SEQ ID NO: 884118 - RNA, 19 nt, Homo sapiens
gaacaagauccugaaacuu

SEQ ID NO: 884119 - RNA, 19 nt, Homo sapiens
cguuagagcuguuuuaauu

SEQ ID NO: 884120 - RNA, 19 nt, Homo sapiens
gaacacauggacaaaauaa

SEQ ID NO: 884121 - RNA, 19 nt, Homo sapiens
cauacagagucuaagauug

SEQ ID NO: 884122 - RNA, 19 nt, Homo sapiens
gauaaagaccagaguccaa

SEQ ID NO: 884123 - RNA, 19 nt, Homo sapiens
caagaaguacuaacuaugg

SEQ ID NO: 884124 - RNA, 19 nt, Homo sapiens
caaagaccuugcaagaagu

SEQ ID NO: 884125 - RNA, 19 nt, Homo sapiens
uauugcaucugucuuagaa

SEQ ID NO: 884126 - RNA, 19 nt, Homo sapiens
auacagagucuaagauuga

SEQ ID NO: 884127 - RNA, 19 nt, Homo sapiens
uaaagaagugggaacaaga

SEQ ID NO: 884128 - RNA, 19 nt, Homo sapiens
gaaaccuuauguugcacuu

SEQ ID NO: 884129 - RNA, 19 nt, Homo sapiens
agaccaaaguuccucaaug

SEQ ID NO: 884130 - RNA, 19 nt, Homo sapiens
gagaagaauauaugcugaa

SEQ ID NO: 884131 - RNA, 19 nt, Homo sapiens
ucuccaacaucucuaaaga

SEQ ID NO: 884132 - RNA, 19 nt, Homo sapiens
auuaacggauucagacuaa

SEQ ID NO: 884133 - RNA, 19 nt, Homo sapiens
aagucaagcuuguaugaga

SEQ ID NO: 884134 - RNA, 19 nt, Homo sapiens
aggcucaugucgagguuua

SEQ ID NO: 884135 - RNA, 19 nt, Homo sapiens
cauguuagaggaagauuug

SEQ ID NO: 884136 - RNA, 19 nt, Homo sapiens
aggaagagauguguacaga

SEQ ID NO: 884137 - RNA, 19 nt, Homo sapiens
cuaaagaagugggaacaag

SEQ ID NO: 884138 - RNA, 19 nt, Homo sapiens
gcgggagucauaacacuaa

SEQ ID NO: 884139 - RNA, 19 nt, Homo sapiens
ugcaagaaguacuaacuau

SEQ ID NO: 884140 - RNA, 19 nt, Homo sapiens
ccauacagagucuaagauu

SEQ ID NO: 884141 - RNA, 19 nt, Homo sapiens
auaccauacugcaccauuu

SEQ ID NO: 884142 - RNA, 19 nt, Homo sapiens
cuucaaagaccuugcaaga

SEQ ID NO: 884143 - RNA, 19 nt, Homo sapiens
uaauaugauucggcagauu

SEQ ID NO: 884144 - RNA, 19 nt, Homo sapiens
ggagucauaacacuaaaca

SEQ ID NO: 884145 - RNA, 19 nt, Homo sapiens
cugaggaagauuugaauaa

SEQ ID NO: 884146 - RNA, 19 nt, Homo sapiens
cuaagucaagcuuguauga

SEQ ID NO: 884147 - RNA, 19 nt, Homo sapiens
gguggagguuauuucuuug

SEQ ID NO: 884148 - RNA, 19 nt, Homo sapiens
aaccuuauguugcacuuau

SEQ ID NO: 884149 - RNA, 19 nt, Homo sapiens
acacuaaacagaccaaagu

SEQ ID NO: 884150 - RNA, 19 nt, Homo sapiens
ugucgagguuuaaugcauu

SEQ ID NO: 884151 - RNA, 19 nt, Homo sapiens
ggaauugcuacacacuuug

SEQ ID NO: 884152 - RNA, 19 nt, Homo sapiens
aauaugauucggcagauuu

SEQ ID NO: 884153 - RNA, 19 nt, Homo sapiens
uagcauggguuggcaaucu

SEQ ID NO: 884154 - RNA, 19 nt, Homo sapiens
gugacaggcuuuuaaggua

SEQ ID NO: 884155 - RNA, 19 nt, Homo sapiens
gaccuugcaagaaguacua

SEQ ID NO: 884156 - RNA, 19 nt, Homo sapiens
ucucuaaagaucacacuaa

SEQ ID NO: 884157 - RNA, 19 nt, Homo sapiens
ugauguggguggagguuau

SEQ ID NO: 884158 - RNA, 19 nt, Homo sapiens
agucauaacacuaaacaga

SEQ ID NO: 884159 - RNA, 19 nt, Homo sapiens
ucgcucugcugcuuuaguu

SEQ ID NO: 884160 - RNA, 19 nt, Homo sapiens
ggaggcucaugucgagguu

SEQ ID NO: 884161 - RNA, 19 nt, Homo sapiens
gaauguccaagcacacaga

SEQ ID NO: 884162 - RNA, 19 nt, Homo sapiens
gaauugcuacacacuuugu

SEQ ID NO: 884163 - RNA, 19 nt, Homo sapiens
uuauauacccuguaagcaa

SEQ ID NO: 884164 - RNA, 19 nt, Homo sapiens
gaaguuacugaggaagauu

SEQ ID NO: 884165 - RNA, 19 nt, Homo sapiens
ugagaggucaugacuuuca

SEQ ID NO: 884166 - RNA, 19 nt, Homo sapiens
aagaaguacuaacuaugga

SEQ ID NO: 884167 - RNA, 19 nt, Homo sapiens
acacagaugcagcagaaga

SEQ ID NO: 884168 - RNA, 19 nt, Homo sapiens
cucaaugcacugacucuua

SEQ ID NO: 884169 - RNA, 19 nt, Homo sapiens
ugaaggcguuagagcuguu

SEQ ID NO: 884170 - RNA, 19 nt, Homo sapiens
aaagggagcaggaggaaag

SEQ ID NO: 884171 - RNA, 19 nt, Homo sapiens
gcagaagaggugcuauugg

SEQ ID NO: 884172 - RNA, 19 nt, Homo sapiens
aaaagaaguuacugaggaa

SEQ ID NO: 884173 - RNA, 19 nt, Homo sapiens
gaguaucggcuaagucaag

SEQ ID NO: 884174 - RNA, 19 nt, Homo sapiens
gcaucugucuuagaaaauu

SEQ ID NO: 884175 - RNA, 19 nt, Homo sapiens
auaaugcuguugguucuug

SEQ ID NO: 884176 - RNA, 19 nt, Homo sapiens
agaaguuacugaggaagau

SEQ ID NO: 884177 - RNA, 19 nt, Homo sapiens
ugccagaaaccuuauguug

SEQ ID NO: 884178 - RNA, 19 nt, Homo sapiens
gagaauguccaagcacaca

SEQ ID NO: 884179 - RNA, 19 nt, Homo sapiens
gauucucgcucugcugcuu

SEQ ID NO: 884180 - RNA, 19 nt, Homo sapiens
gacaggcuuuuaagguaua

SEQ ID NO: 884181 - RNA, 19 nt, Homo sapiens
uuacugaggaagauuugaa

SEQ ID NO: 884182 - RNA, 19 nt, Homo sapiens
aaagaccuugcaagaagua

SEQ ID NO: 884183 - RNA, 19 nt, Homo sapiens
uagagcaauugaagguaau

SEQ ID NO: 884184 - RNA, 19 nt, Homo sapiens
cagccaauacuguggaaga

SEQ ID NO: 884185 - RNA, 19 nt, Homo sapiens
gaaaauauugcaucugucu

SEQ ID NO: 884186 - RNA, 19 nt, Homo sapiens
ugccacgacuccaaggaaa

SEQ ID NO: 884187 - RNA, 19 nt, Homo sapiens
gcauucaaaaggacuaaua

SEQ ID NO: 884188 - RNA, 19 nt, Homo sapiens
ugcacugacucuuaauaug

SEQ ID NO: 884189 - RNA, 19 nt, Homo sapiens
ggacagagauguggacuuu

SEQ ID NO: 884190 - RNA, 19 nt, Homo sapiens
ggagaggcauggacauuaa

SEQ ID NO: 884191 - RNA, 19 nt, Homo sapiens
gaagaggcauccuuugcua

SEQ ID NO: 884192 - RNA, 19 nt, Homo sapiens
aaacagcgcucgccuuaug

SEQ ID NO: 884193 - RNA, 19 nt, Homo sapiens
caagauggcauaugaauug

SEQ ID NO: 884194 - RNA, 19 nt, Homo sapiens
ucacagauaugacuaagga

SEQ ID NO: 884195 - RNA, 19 nt, Homo sapiens
gcauggaacuaccagaauu

SEQ ID NO: 884196 - RNA, 19 nt, Homo sapiens
gagaaaggcuacagguuca

SEQ ID NO: 884197 - RNA, 19 nt, Homo sapiens
gcacuucuccaaugucuuu

SEQ ID NO: 884198 - RNA, 19 nt, Homo sapiens
cgacaaggcugcaggaaag

SEQ ID NO: 884199 - RNA, 19 nt, Homo sapiens
ucacagccguggagaguaa

SEQ ID NO: 884200 - RNA, 19 nt, Homo sapiens
gaugugagcugugaugaau

SEQ ID NO: 884201 - RNA, 19 nt, Homo sapiens
gcuaaauccuguuugaaug

SEQ ID NO: 884202 - RNA, 19 nt, Homo sapiens
caucuucccugaacacauu

SEQ ID NO: 884203 - RNA, 19 nt, Homo sapiens
gacaagguguuuaaugaga

SEQ ID NO: 884204 - RNA, 19 nt, Homo sapiens
gagaccagcucaucuaucu

SEQ ID NO: 884205 - RNA, 19 nt, Homo sapiens
gugaauccaucaugaagaa

SEQ ID NO: 884206 - RNA, 19 nt, Homo sapiens
caaauuggcuggccgaacu

SEQ ID NO: 884207 - RNA, 19 nt, Homo sapiens
cacaguaucugcagagcua

SEQ ID NO: 884208 - RNA, 19 nt, Homo sapiens
guacaacccaugcugcuaa

SEQ ID NO: 884209 - RNA, 19 nt, Homo sapiens
uagagaacauuaucugaga

SEQ ID NO: 884210 - RNA, 19 nt, Homo sapiens
acaaacagcgcucgccuua

SEQ ID NO: 884211 - RNA, 19 nt, Homo sapiens
ggccagagauuggacauau

SEQ ID NO: 884212 - RNA, 19 nt, Homo sapiens
gcucccaagugguuuauga

SEQ ID NO: 884213 - RNA, 19 nt, Homo sapiens
gacuuugcauucacagaua

SEQ ID NO: 884214 - RNA, 19 nt, Homo sapiens
ggagagcaccagcuacauu

SEQ ID NO: 884215 - RNA, 19 nt, Homo sapiens
gcauggacauuaagcagau

SEQ ID NO: 884216 - RNA, 19 nt, Homo sapiens
ggaacgagcacuucuccaa

SEQ ID NO: 884217 - RNA, 19 nt, Homo sapiens
aggacaagguguuuaauga

SEQ ID NO: 884218 - RNA, 19 nt, Homo sapiens
ccaaacugcuauggaauug

SEQ ID NO: 884219 - RNA, 19 nt, Homo sapiens
uauacaagguggagaacaa

SEQ ID NO: 884220 - RNA, 19 nt, Homo sapiens
gaacuugcaggcccaguau

SEQ ID NO: 884221 - RNA, 19 nt, Homo sapiens
caagguguuuaaugagauu

SEQ ID NO: 884222 - RNA, 19 nt, Homo sapiens
acagagauguggacuuugu

SEQ ID NO: 884223 - RNA, 19 nt, Homo sapiens
gaaugggccuucucuuugc

SEQ ID NO: 884224 - RNA, 19 nt, Homo sapiens
gcaaauacaaagugaucuu

SEQ ID NO: 884225 - RNA, 19 nt, Homo sapiens
gcaggugucgccuauagaa

SEQ ID NO: 884226 - RNA, 19 nt, Homo sapiens
gagcauggaacuaccagaa

SEQ ID NO: 884227 - RNA, 19 nt, Homo sapiens
gaacgagcacuucuccaau

SEQ ID NO: 884228 - RNA, 19 nt, Homo sapiens
ugaaugggccuucucuuug

SEQ ID NO: 884229 - RNA, 19 nt, Homo sapiens
gcccaggccugaaggauag

SEQ ID NO: 884230 - RNA, 19 nt, Homo sapiens
gcacccagcugcuauaacc

SEQ ID NO: 884231 - RNA, 19 nt, Homo sapiens
cacuguagcucaggccuua

SEQ ID NO: 884232 - RNA, 19 nt, Homo sapiens
gagaacauuaucugagaaa

SEQ ID NO: 884233 - RNA, 19 nt, Homo sapiens
cauggaacguguugggauu

SEQ ID NO: 884234 - RNA, 19 nt, Homo sapiens
gcaggaaagauuacugaug

SEQ ID NO: 884235 - RNA, 19 nt, Homo sapiens
gagagcaccagcuacauug

SEQ ID NO: 884236 - RNA, 19 nt, Homo sapiens
aagaauaugcgauacauug

SEQ ID NO: 884237 - RNA, 19 nt, Homo sapiens
caaugucuuuggcuucuug

SEQ ID NO: 884238 - RNA, 19 nt, Homo sapiens
cgugugagauggugcuuga

SEQ ID NO: 884239 - RNA, 19 nt, Homo sapiens
gaacguguugggauuuaga

SEQ ID NO: 884240 - RNA, 19 nt, Homo sapiens
gcaagcuggugaccgacaa

SEQ ID NO: 884241 - RNA, 19 nt, Homo sapiens
cuacauugaggaacacaua

SEQ ID NO: 884242 - RNA, 19 nt, Homo sapiens
ggaacuugcaggcccagua

SEQ ID NO: 884243 - RNA, 19 nt, Homo sapiens
gagcacuucuccaaugucu

SEQ ID NO: 884244 - RNA, 19 nt, Homo sapiens
gaaaggcuacagguucauu

SEQ ID NO: 884245 - RNA, 19 nt, Homo sapiens
gcucaacugcagugacuuu

SEQ ID NO: 884246 - RNA, 19 nt, Homo sapiens
cggcgaguaugaucugaaa

SEQ ID NO: 884247 - RNA, 19 nt, Homo sapiens
uagacaagcuauacaaggu

SEQ ID NO: 884248 - RNA, 19 nt, Homo sapiens
cgacagcagucacaaacag

SEQ ID NO: 884249 - RNA, 19 nt, Homo sapiens
gagagaaaggcuacagguu

SEQ ID NO: 884250 - RNA, 19 nt, Homo sapiens
ucucagcacucucuaugga

SEQ ID NO: 884251 - RNA, 19 nt, Homo sapiens
ggugaaagccugauguuuu

SEQ ID NO: 884252 - RNA, 19 nt, Homo sapiens
acauuaagcagaugaagaa

SEQ ID NO: 884253 - RNA, 19 nt, Homo sapiens
uuaaugagauucggaacga

SEQ ID NO: 884254 - RNA, 19 nt, Homo sapiens
gaggacaagguguuuaaug

SEQ ID NO: 884255 - RNA, 19 nt, Homo sapiens
ucaagaauaugcgauacau

SEQ ID NO: 884256 - RNA, 19 nt, Homo sapiens
uggaacguguugggauuua

SEQ ID NO: 884257 - RNA, 19 nt, Homo sapiens
ugaacacauuccucaguga

SEQ ID NO: 884258 - RNA, 19 nt, Homo sapiens
ggccaugagugaggugaaa

SEQ ID NO: 884259 - RNA, 19 nt, Homo sapiens
cugcuaaccuucuccaauc

SEQ ID NO: 884260 - RNA, 19 nt, Homo sapiens
gaaagccugcgccucaugu

SEQ ID NO: 884261 - RNA, 19 nt, Homo sapiens
gaauccaucaugaagaaga

SEQ ID NO: 884262 - RNA, 19 nt, Homo sapiens
gaaguagacaagcuauaca

SEQ ID NO: 884263 - RNA, 19 nt, Homo sapiens
aauaaagccucugcucuca

SEQ ID NO: 884264 - RNA, 19 nt, Homo sapiens
cggcaggugucgccuauag

SEQ ID NO: 884265 - RNA, 19 nt, Homo sapiens
ccagcuacauugaggaaca

SEQ ID NO: 884266 - RNA, 19 nt, Homo sapiens
cauaugaauuguggaggaa

SEQ ID NO: 884267 - RNA, 19 nt, Homo sapiens
ucucuuugcugccucuuga

SEQ ID NO: 884268 - RNA, 19 nt, Homo sapiens
ggagaugugagcugugaug

SEQ ID NO: 884269 - RNA, 19 nt, Homo sapiens
gcccucagcuccaaugaac

SEQ ID NO: 884270 - RNA, 19 nt, Homo sapiens
gacauuaagcagaugaaga

SEQ ID NO: 884271 - RNA, 19 nt, Homo sapiens
ugaggaagagggaaucuau

SEQ ID NO: 884272 - RNA, 19 nt, Homo sapiens
ggacaagguguuuaaugag

SEQ ID NO: 884273 - RNA, 19 nt, Homo sapiens
gacaaggcuuccagugagu

SEQ ID NO: 884274 - RNA, 19 nt, Homo sapiens
cggagaggcauggacauua

SEQ ID NO: 884275 - RNA, 19 nt, Homo sapiens
ugaaggugcuacucaaugc

SEQ ID NO: 884276 - RNA, 19 nt, Homo sapiens
ggaggaggauggcgaaacc

SEQ ID NO: 884277 - RNA, 19 nt, Homo sapiens
gcuaagaugcgagcaggaa

SEQ ID NO: 884278 - RNA, 19 nt, Homo sapiens
ggauuuagagaacauuauc

SEQ ID NO: 884279 - RNA, 19 nt, Homo sapiens
cagcugcuauaaccaagug

SEQ ID NO: 884280 - RNA, 19 nt, Homo sapiens
guugacaucuucccugaac

SEQ ID NO: 884281 - RNA, 19 nt, Homo sapiens
ggccaguguugacaucuuc

SEQ ID NO: 884282 - RNA, 19 nt, Homo sapiens
guucuugggugguuguaca

SEQ ID NO: 884283 - RNA, 19 nt, Homo sapiens
ccaagauggcauaugaauu

SEQ ID NO: 884284 - RNA, 19 nt, Homo sapiens
cauggaacuaccagaauuu

SEQ ID NO: 884285 - RNA, 19 nt, Homo sapiens
ggaagagggaaucuaugga

SEQ ID NO: 884286 - RNA, 19 nt, Homo sapiens
gaggugaaagccugauguu

SEQ ID NO: 884287 - RNA, 19 nt, Homo sapiens
gaaagugccccgagacaug

SEQ ID NO: 884288 - RNA, 19 nt, Homo sapiens
ggauuaccgaucucugaaa

SEQ ID NO: 884289 - RNA, 19 nt, Homo sapiens
gaacagaguugcuucuuaa

SEQ ID NO: 884290 - RNA, 19 nt, Homo sapiens
ggaacagaguugcuucuua

SEQ ID NO: 884291 - RNA, 19 nt, Homo sapiens
ggaauugcuuggauugaua

SEQ ID NO: 884292 - RNA, 19 nt, Homo sapiens
gaagggcucugaaggagaa

SEQ ID NO: 884293 - RNA, 19 nt, Homo sapiens
caacccaggucauaucuaa

SEQ ID NO: 884294 - RNA, 19 nt, Homo sapiens
gcaaguaguuuaguaggaa

SEQ ID NO: 884295 - RNA, 19 nt, Homo sapiens
ggaaugguuucggauagua

SEQ ID NO: 884296 - RNA, 19 nt, Homo sapiens
gaacaagacugagaaaucc

SEQ ID NO: 884297 - RNA, 19 nt, Homo sapiens
ggaagaacaugcgauauac

SEQ ID NO: 884298 - RNA, 19 nt, Homo sapiens
cagaguugcuucuuaauag

SEQ ID NO: 884299 - RNA, 19 nt, Homo sapiens
gaacuaaaaugcucucugu

SEQ ID NO: 884300 - RNA, 19 nt, Homo sapiens
cgagucagaucgcgaggua

SEQ ID NO: 884301 - RNA, 19 nt, Homo sapiens
caaggaagaacaugcgaua

SEQ ID NO: 884302 - RNA, 19 nt, Homo sapiens
gcucucaccucaggaauug

SEQ ID NO: 884303 - RNA, 19 nt, Homo sapiens
ggagaacccaguugacuug

SEQ ID NO: 884304 - RNA, 19 nt, Homo sapiens
guucuagaccuuugugaua

SEQ ID NO: 884305 - RNA, 19 nt, Homo sapiens
gaaauccacaugcuucaga

SEQ ID NO: 884306 - RNA, 19 nt, Homo sapiens
aaacaguucuagaccuuug

SEQ ID NO: 884307 - RNA, 19 nt, Homo sapiens
ucaacagccuccucucuug

SEQ ID NO: 884308 - RNA, 19 nt, Homo sapiens
gauucugguuucccucaua

SEQ ID NO: 884309 - RNA, 19 nt, Homo sapiens
ggaaguauaaggguccaua

SEQ ID NO: 884310 - RNA, 19 nt, Homo sapiens
gaagggagccgagucagau

SEQ ID NO: 884311 - RNA, 19 nt, Homo sapiens
gucaugcuguuucccuuua

SEQ ID NO: 884312 - RNA, 19 nt, Homo sapiens
ucuaucaccucuucucuug

SEQ ID NO: 884313 - RNA, 19 nt, Homo sapiens
gauauacacagcagaccua

SEQ ID NO: 884314 - RNA, 19 nt, Homo sapiens
ccugagacuaucauuauua

SEQ ID NO: 884315 - RNA, 19 nt, Homo sapiens
gaagaguucagucccaaug

SEQ ID NO: 884316 - RNA, 19 nt, Homo sapiens
cacagcagcuucaggaugu

SEQ ID NO: 884317 - RNA, 19 nt, Homo sapiens
guaguuugauucugguuuc

SEQ ID NO: 884318 - RNA, 19 nt, Homo sapiens
aggaagaacaugcgauaua

SEQ ID NO: 884319 - RNA, 19 nt, Homo sapiens
cagaggcuccuguggauuu

SEQ ID NO: 884320 - RNA, 19 nt, Homo sapiens
auacaggaaucucuggaaa

SEQ ID NO: 884321 - RNA, 19 nt, Homo sapiens
caagagcacccuccaaugg

SEQ ID NO: 884322 - RNA, 19 nt, Homo sapiens
caaagcaggaucugaggaa

SEQ ID NO: 884323 - RNA, 19 nt, Homo sapiens
gagccuguguucaucuaga

SEQ ID NO: 884324 - RNA, 19 nt, Homo sapiens
ggaagggagccgagucaga

SEQ ID NO: 884325 - RNA, 19 nt, Homo sapiens
ccagguagguagucugagu

SEQ ID NO: 884326 - RNA, 19 nt, Homo sapiens
acagaguugcuucuuaaua

SEQ ID NO: 884327 - RNA, 19 nt, Homo sapiens
aaucaccacuuuccagaau

SEQ ID NO: 884328 - RNA, 19 nt, Homo sapiens
cgacagggaguugccauaa

SEQ ID NO: 884329 - RNA, 19 nt, Homo sapiens
ccucgaagcugcaggaacu

SEQ ID NO: 884330 - RNA, 19 nt, Homo sapiens
ccacaugcuucagaauuca

SEQ ID NO: 884331 - RNA, 19 nt, Homo sapiens
aauaggagcacauucuuug

SEQ ID NO: 884332 - RNA, 19 nt, Homo sapiens
ugaaggagaacccaguuga

SEQ ID NO: 884333 - RNA, 19 nt, Homo sapiens
uaucuaauccugagagcaa

SEQ ID NO: 884334 - RNA, 19 nt, Homo sapiens
ggagaaagcacugccuaca

SEQ ID NO: 884335 - RNA, 19 nt, Homo sapiens
gaaacaguucuagaccuuu

SEQ ID NO: 884336 - RNA, 19 nt, Homo sapiens
gaaguaguaguuugauucu

SEQ ID NO: 884337 - RNA, 19 nt, Homo sapiens
ccaggaagccagguaggua

SEQ ID NO: 884338 - RNA, 19 nt, Homo sapiens
uaauaggagcacauucuuu

SEQ ID NO: 884339 - RNA, 19 nt, Homo sapiens
gaagaacaugcgauauaca

SEQ ID NO: 884340 - RNA, 19 nt, Homo sapiens
gguagaacaagacugagaa

SEQ ID NO: 884341 - RNA, 19 nt, Homo sapiens
ucaagagccuguguucauc

SEQ ID NO: 884342 - RNA, 19 nt, Homo sapiens
agaacaagacugagaaauc

SEQ ID NO: 884343 - RNA, 19 nt, Homo sapiens
uuuagacucugaugaggaa

SEQ ID NO: 884344 - RNA, 19 nt, Homo sapiens
gcacaagagcacccuccaa

SEQ ID NO: 884345 - RNA, 19 nt, Homo sapiens
aaaguuugacaccuugaua

SEQ ID NO: 884346 - RNA, 19 nt, Homo sapiens
gacagggaguugccauaag

SEQ ID NO: 884347 - RNA, 19 nt, Homo sapiens
ccacgaacgccuuuguaug

SEQ ID NO: 884348 - RNA, 19 nt, Homo sapiens
uaguaggaaugaaguggaa

SEQ ID NO: 884349 - RNA, 19 nt, Homo sapiens
caaguaguuuaguaggaau

SEQ ID NO: 884350 - RNA, 19 nt, Homo sapiens
acaccuugauacccacuuu

SEQ ID NO: 884351 - RNA, 19 nt, Homo sapiens
gggaaugguuucggauagu

SEQ ID NO: 884352 - RNA, 19 nt, Homo sapiens
guagaacaagacugagaaa

SEQ ID NO: 884353 - RNA, 19 nt, Homo sapiens
cugugcagcuccgucauua

SEQ ID NO: 884354 - RNA, 19 nt, Homo sapiens
gaaucaccacuuuccagaa

SEQ ID NO: 884355 - RNA, 19 nt, Homo sapiens
ccucaggaauugcuuggau

SEQ ID NO: 884356 - RNA, 19 nt, Homo sapiens
cagggaccaucuucaagga

SEQ ID NO: 884357 - RNA, 19 nt, Homo sapiens
acagaauccuccucagcaa

SEQ ID NO: 884358 - RNA, 19 nt, Homo sapiens
gaugcagccuggagucucu

SEQ ID NO: 884359 - RNA, 19 nt, Homo sapiens
gucagaggcuccuguggau

SEQ ID NO: 884360 - RNA, 19 nt, Homo sapiens
gagaaauccacaugcuuca

SEQ ID NO: 884361 - RNA, 19 nt, Homo sapiens
gaucaacagccuccucucu

SEQ ID NO: 884362 - RNA, 19 nt, Homo sapiens
uugcuuggauugauacaug

SEQ ID NO: 884363 - RNA, 19 nt, Homo sapiens
agaaguaguaguuugauuc

SEQ ID NO: 884364 - RNA, 19 nt, Homo sapiens
cauccuauccucuuugcuu

SEQ ID NO: 884365 - RNA, 19 nt, Homo sapiens
ccuccaaugggaaguauaa

SEQ ID NO: 884366 - RNA, 19 nt, Homo sapiens
gaagcugcaggaacuugaa

SEQ ID NO: 884367 - RNA, 19 nt, Homo sapiens
ggaaaacuaucagaagaca

SEQ ID NO: 884368 - RNA, 19 nt, Homo sapiens
gaaaggugagugggaagga

SEQ ID NO: 884369 - RNA, 19 nt, Homo sapiens
gcagcuccgucauuaccau

SEQ ID NO: 884370 - RNA, 19 nt, Homo sapiens
ggagugaguggaacagagu

SEQ ID NO: 884371 - RNA, 19 nt, Homo sapiens
cacaagagcacccuccaau

SEQ ID NO: 884372 - RNA, 19 nt, Homo sapiens
gagucucuaucaccucuuc

SEQ ID NO: 884373 - RNA, 19 nt, Homo sapiens
cagggaaugguuucggaua

SEQ ID NO: 884374 - RNA, 19 nt, Homo sapiens
ucagaggguucagggaaug

SEQ ID NO: 884375 - RNA, 19 nt, Homo sapiens
ggacuugguuuuagacucu

SEQ ID NO: 884376 - RNA, 19 nt, Homo sapiens
gcaccacgaacgccuuugu

SEQ ID NO: 884377 - RNA, 19 nt, Homo sapiens
gcaaaaggagugaguggaa

SEQ ID NO: 884378 - RNA, 19 nt, Homo sapiens
cacgaacgccuuuguaugg

SEQ ID NO: 884379 - RNA, 19 nt, Homo sapiens
gaagccagguagguagucu

SEQ ID NO: 884380 - RNA, 19 nt, Homo sapiens
aggaaucucuggaaaacua

SEQ ID NO: 884381 - RNA, 19 nt, Homo sapiens
aaauccacaugcuucagaa

SEQ ID NO: 884382 - RNA, 19 nt, Homo sapiens
gacuagcacuccacaaucc

SEQ ID NO: 884383 - RNA, 19 nt, Homo sapiens
ucuagaaguaguaguuuga

SEQ ID NO: 884384 - RNA, 19 nt, Homo sapiens
aagagccuguguucaucua

SEQ ID NO: 884385 - RNA, 19 nt, Homo sapiens
ugccuucccuucauccuau

SEQ ID NO: 884386 - RNA, 19 nt, Homo sapiens
gcgacagggaguugccaua

SEQ ID NO: 884387 - RNA, 19 nt, Homo sapiens
acaauaugguguggacaug

SEQ ID NO: 884388 - RNA, 19 nt, Homo sapiens
uugccuaacuacacugcua

SEQ ID NO: 884389 - RNA, 19 nt, Homo sapiens
ggaaagaacugaccaaagu

SEQ ID NO: 884390 - RNA, 19 nt, Homo sapiens
gaaagaagaucaggaagaa

SEQ ID NO: 884391 - RNA, 19 nt, Homo sapiens
gaacacaccugucuuaagu

SEQ ID NO: 884392 - RNA, 19 nt, Homo sapiens
gaucauauuuccaugguua

SEQ ID NO: 884393 - RNA, 19 nt, Homo sapiens
gcaaagcauuucuaugaua

SEQ ID NO: 884394 - RNA, 19 nt, Homo sapiens
ggaaaggccuccaaauuau

SEQ ID NO: 884395 - RNA, 19 nt, Homo sapiens
gaaaggagaucucuguaau

SEQ ID NO: 884396 - RNA, 19 nt, Homo sapiens
gaaagguuguaaagucuua

SEQ ID NO: 884397 - RNA, 19 nt, Homo sapiens
gaaauggcauccugacaaa

SEQ ID NO: 884398 - RNA, 19 nt, Homo sapiens
gcaaagacuuguuuaugaa

SEQ ID NO: 884399 - RNA, 19 nt, Homo sapiens
gaacaaagcaaauaacaga

SEQ ID NO: 884400 - RNA, 19 nt, Homo sapiens
ggagugaucucgagaaugu

SEQ ID NO: 884401 - RNA, 19 nt, Homo sapiens
gcaaugacauccuguguau

SEQ ID NO: 884402 - RNA, 19 nt, Homo sapiens
gcaaacagauacuacuuga

SEQ ID NO: 884403 - RNA, 19 nt, Homo sapiens
ggacacaggcuuaucauuu

SEQ ID NO: 884404 - RNA, 19 nt, Homo sapiens
ggacaaagagagccacuua

SEQ ID NO: 884405 - RNA, 19 nt, Homo sapiens
agagaaagcuacacccuua

SEQ ID NO: 884406 - RNA, 19 nt, Homo sapiens
gaggaaagcucucaaagca

SEQ ID NO: 884407 - RNA, 19 nt, Homo sapiens
gguccaaacuucaacauuu

SEQ ID NO: 884408 - RNA, 19 nt, Homo sapiens
gaaggaauauggagucuca

SEQ ID NO: 884409 - RNA, 19 nt, Homo sapiens
gaacuuagagauccuuuaa

SEQ ID NO: 884410 - RNA, 19 nt, Homo sapiens
gaucauaccagccaacaua

SEQ ID NO: 884411 - RNA, 19 nt, Homo sapiens
gaacugcacuuuauauaac

SEQ ID NO: 884412 - RNA, 19 nt, Homo sapiens
gcuacacccuuaagcauua

SEQ ID NO: 884413 - RNA, 19 nt, Homo sapiens
caaauaaccuauacuaugg

SEQ ID NO: 884414 - RNA, 19 nt, Homo sapiens
gaacuuccuucuucgguaa

SEQ ID NO: 884415 - RNA, 19 nt, Homo sapiens
ggacagacuuacucucaaa

SEQ ID NO: 884416 - RNA, 19 nt, Homo sapiens
gcaaugauauuuacaggau

SEQ ID NO: 884417 - RNA, 19 nt, Homo sapiens
ggacgcauguuuagagauu

SEQ ID NO: 884418 - RNA, 19 nt, Homo sapiens
ugaagaagcuggcugcaaa

SEQ ID NO: 884419 - RNA, 19 nt, Homo sapiens
gaagcuggcugcaaacaga

SEQ ID NO: 884420 - RNA, 19 nt, Homo sapiens
caaaauagcuggauggauu

SEQ ID NO: 884421 - RNA, 19 nt, Homo sapiens
gcagauauuuauucucuug

SEQ ID NO: 884422 - RNA, 19 nt, Homo sapiens
uaaaggugcugcaguuaaa

SEQ ID NO: 884423 - RNA, 19 nt, Homo sapiens
gaagagacucccaaaguuu

SEQ ID NO: 884424 - RNA, 19 nt, Homo sapiens
gaaaaucucucuuaugaug

SEQ ID NO: 884425 - RNA, 19 nt, Homo sapiens
gcaaauaacagaagagaau

SEQ ID NO: 884426 - RNA, 19 nt, Homo sapiens
cagaacauguugaaacuuu

SEQ ID NO: 884427 - RNA, 19 nt, Homo sapiens
caacugcacuugcucagaa

SEQ ID NO: 884428 - RNA, 19 nt, Homo sapiens
gguagaagaugguuggaaa

SEQ ID NO: 884429 - RNA, 19 nt, Homo sapiens
ggacacaguucucagaugu

SEQ ID NO: 884430 - RNA, 19 nt, Homo sapiens
gaucugcgacuuucuauuu

SEQ ID NO: 884431 - RNA, 19 nt, Homo sapiens
gaccauggauuucacacua

SEQ ID NO: 884432 - RNA, 19 nt, Homo sapiens
ugaaacaccucuuaccaaa

SEQ ID NO: 884433 - RNA, 19 nt, Homo sapiens
cuacguggcuaauuuguaa

SEQ ID NO: 884434 - RNA, 19 nt, Homo sapiens
acacaaagccuuagaaaga

SEQ ID NO: 884435 - RNA, 19 nt, Homo sapiens
gaacaagaaagcaaacaaa

SEQ ID NO: 884436 - RNA, 19 nt, Homo sapiens
gcaaucaucugaaggaaag

SEQ ID NO: 884437 - RNA, 19 nt, Homo sapiens
caaaugugcuugagugguu

SEQ ID NO: 884438 - RNA, 19 nt, Homo sapiens
aaagguagaucuugaaugu

SEQ ID NO: 884439 - RNA, 19 nt, Homo sapiens
gggaaagucugauaaagau

SEQ ID NO: 884440 - RNA, 19 nt, Homo sapiens
gaccagaaguggacaguga

SEQ ID NO: 884441 - RNA, 19 nt, Homo sapiens
cagaaggauugcugauuua

SEQ ID NO: 884442 - RNA, 19 nt, Homo sapiens
gaaugcaguuucuugauug

SEQ ID NO: 884443 - RNA, 19 nt, Homo sapiens
ggaauuaagucuuuguagu

SEQ ID NO: 884444 - RNA, 19 nt, Homo sapiens
ugaaggagcuaaugaaaca

SEQ ID NO: 884445 - RNA, 19 nt, Homo sapiens
ggcaaugacucuuaaauca

SEQ ID NO: 884446 - RNA, 19 nt, Homo sapiens
guccaaacuucaacauuua

SEQ ID NO: 884447 - RNA, 19 nt, Homo sapiens
gccaagacaacauuuauua

SEQ ID NO: 884448 - RNA, 19 nt, Homo sapiens
gauaagagucuauguaugu

SEQ ID NO: 884449 - RNA, 19 nt, Homo sapiens
ggagaauucuggaguuguu

SEQ ID NO: 884450 - RNA, 19 nt, Homo sapiens
gcaauauguugaaguguug

SEQ ID NO: 884451 - RNA, 19 nt, Homo sapiens
caagcuaccuuuagaacuu

SEQ ID NO: 884452 - RNA, 19 nt, Homo sapiens
gagcacagguaaauccaaa

SEQ ID NO: 884453 - RNA, 19 nt, Homo sapiens
gaacacuuccucuuauaaa

SEQ ID NO: 884454 - RNA, 19 nt, Homo sapiens
ggaacaugcuacguacuua

SEQ ID NO: 884455 - RNA, 19 nt, Homo sapiens
gggagaaguugacaaaguu

SEQ ID NO: 884456 - RNA, 19 nt, Homo sapiens
uaaggucugugguucaaua

SEQ ID NO: 884457 - RNA, 19 nt, Homo sapiens
gaagagguaacacagcuua

SEQ ID NO: 884458 - RNA, 19 nt, Homo sapiens
ucaaauaacuucgcuacuu

SEQ ID NO: 884459 - RNA, 19 nt, Homo sapiens
ccaaguuucuaacaacaua

SEQ ID NO: 884460 - RNA, 19 nt, Homo sapiens
caccauaccuuuaucaguu

SEQ ID NO: 884461 - RNA, 19 nt, Homo sapiens
gaaauugaagcagaacuua

SEQ ID NO: 884462 - RNA, 19 nt, Homo sapiens
caaauaacuucgcuacuuc

SEQ ID NO: 884463 - RNA, 19 nt, Homo sapiens
caacuugguuuauaacugu

SEQ ID NO: 884464 - RNA, 19 nt, Homo sapiens
ggaauauggagucucauua

SEQ ID NO: 884465 - RNA, 19 nt, Homo sapiens
gcagagaauugauuguuca

SEQ ID NO: 884466 - RNA, 19 nt, Homo sapiens
ggacagugcuccuucuaca

SEQ ID NO: 884467 - RNA, 19 nt, Homo sapiens
gagaagaugcugacaauuc

SEQ ID NO: 884468 - RNA, 19 nt, Homo sapiens
ugaagagacucccaaaguu

SEQ ID NO: 884469 - RNA, 19 nt, Homo sapiens
gaagauauagcucauggaa

SEQ ID NO: 884470 - RNA, 19 nt, Homo sapiens
ugacccagcugcucucuuu

SEQ ID NO: 884471 - RNA, 19 nt, Homo sapiens
gaggaauuaucagagauua

SEQ ID NO: 884472 - RNA, 19 nt, Homo sapiens
ugaaggcucuacauuauau

SEQ ID NO: 884473 - RNA, 19 nt, Homo sapiens
cgaagugacuggaauaaca

SEQ ID NO: 884474 - RNA, 19 nt, Homo sapiens
cauaccaguucaacaaaua

SEQ ID NO: 884475 - RNA, 19 nt, Homo sapiens
ggaagaauuucaccaugug

SEQ ID NO: 884476 - RNA, 19 nt, Homo sapiens
caacacaccaguuccuaua

SEQ ID NO: 884477 - RNA, 19 nt, Homo sapiens
ggaaaggagaucucuguaa

SEQ ID NO: 884478 - RNA, 19 nt, Homo sapiens
ggaaagaugacauugaaga

SEQ ID NO: 884479 - RNA, 19 nt, Homo sapiens
ugaacaggaugcaaucuuu

SEQ ID NO: 884480 - RNA, 19 nt, Homo sapiens
ggauggauuugaaugauug

SEQ ID NO: 884481 - RNA, 19 nt, Homo sapiens
ggacugauuagaauuauga

SEQ ID NO: 884482 - RNA, 19 nt, Homo sapiens
uacgagaccuugcgcuuua

SEQ ID NO: 884483 - RNA, 19 nt, Homo sapiens
uaucagagauuaaggaaca

SEQ ID NO: 884484 - RNA, 19 nt, Homo sapiens
cgcaaagacuuguuuauga

SEQ ID NO: 884485 - RNA, 19 nt, Homo sapiens
cgaaagagggaaauccuua

SEQ ID NO: 884486 - RNA, 19 nt, Homo sapiens
gcacagaauuugggcagaa

SEQ ID NO: 884487 - RNA, 19 nt, Homo sapiens
gaaagaggaacaaagcaaa

SEQ ID NO: 884488 - RNA, 19 nt, Homo sapiens
ugaaauaccucaagaagac

SEQ ID NO: 884489 - RNA, 19 nt, Homo sapiens
gaaugacacucucaaauug

SEQ ID NO: 884490 - RNA, 19 nt, Homo sapiens
ggugauggcuggugugauu

SEQ ID NO: 884491 - RNA, 19 nt, Homo sapiens
agaaggagcuccauaaauc

SEQ ID NO: 884492 - RNA, 19 nt, Homo sapiens
cuccauaccuucucaauuu

SEQ ID NO: 884493 - RNA, 19 nt, Homo sapiens
gcaaauggaacuucucuga

SEQ ID NO: 884494 - RNA, 19 nt, Homo sapiens
caugugaaguggugucaua

SEQ ID NO: 884495 - RNA, 19 nt, Homo sapiens
guaaagcauuugcacaaga

SEQ ID NO: 884496 - RNA, 19 nt, Homo sapiens
uaagauaaagccucucaua

SEQ ID NO: 884497 - RNA, 19 nt, Homo sapiens
gaaguggugucauaggaau

SEQ ID NO: 884498 - RNA, 19 nt, Homo sapiens
uaaagcauuugcacaagaa

SEQ ID NO: 884499 - RNA, 19 nt, Homo sapiens
cauacuaggugcucaauuc

SEQ ID NO: 884500 - RNA, 19 nt, Homo sapiens
ugaaugacacucucaaauu

SEQ ID NO: 884501 - RNA, 19 nt, Homo sapiens
ccaagaaggagcuccauaa

SEQ ID NO: 884502 - RNA, 19 nt, Homo sapiens
gcaucuacaaggacuauua

SEQ ID NO: 884503 - RNA, 19 nt, Homo sapiens
ccuguaaucccaacacuua

SEQ ID NO: 884504 - RNA, 19 nt, Homo sapiens
gagauguggugacucaugu

SEQ ID NO: 884505 - RNA, 19 nt, Homo sapiens
caagaaggagcuccauaaa

SEQ ID NO: 884506 - RNA, 19 nt, Homo sapiens
aaauggaacuucucugauc

SEQ ID NO: 884507 - RNA, 19 nt, Homo sapiens
ugaacaagauggucaagca

SEQ ID NO: 884508 - RNA, 19 nt, Homo sapiens
ccuccaagcucccacaaug

SEQ ID NO: 884509 - RNA, 19 nt, Homo sapiens
gaauggcuauuacuuucau

SEQ ID NO: 884510 - RNA, 19 nt, Homo sapiens
caaggacuauuacagauac

SEQ ID NO: 884511 - RNA, 19 nt, Homo sapiens
cuacaaggacuauuacaga

SEQ ID NO: 884512 - RNA, 19 nt, Homo sapiens
gugaaguggugucauagga

SEQ ID NO: 884513 - RNA, 19 nt, Homo sapiens
ggccaugccugucuuaaac

SEQ ID NO: 884514 - RNA, 19 nt, Homo sapiens
gaacaagauggucaagcaa

SEQ ID NO: 884515 - RNA, 19 nt, Homo sapiens
ccagagccuugaguacuuu

SEQ ID NO: 884516 - RNA, 19 nt, Homo sapiens
ggaaaucuccauaccuucu

SEQ ID NO: 884517 - RNA, 19 nt, Homo sapiens
ccuccacuguccuaagaua

SEQ ID NO: 884518 - RNA, 19 nt, Homo sapiens
gcccuccacuguccuaaga

SEQ ID NO: 884519 - RNA, 19 nt, Homo sapiens
gcagaggccaacccaaaga

SEQ ID NO: 884520 - RNA, 19 nt, Homo sapiens
cugaauggcuauuacuuuc

SEQ ID NO: 884521 - RNA, 19 nt, Homo sapiens
gcaagugacugggaaaaug

SEQ ID NO: 884522 - RNA, 19 nt, Homo sapiens
cuauaaagggcaauauuga

SEQ ID NO: 884523 - RNA, 19 nt, Homo sapiens
ccggaacccucuaccaaug

SEQ ID NO: 884524 - RNA, 19 nt, Homo sapiens
agggaaaucuccauaccuu

SEQ ID NO: 884525 - RNA, 19 nt, Homo sapiens
ggaacaggguagggaaauc

SEQ ID NO: 884526 - RNA, 19 nt, Homo sapiens
acaaggacuauuacagaua

SEQ ID NO: 884527 - RNA, 19 nt, Homo sapiens
gaccaugucugugccaucu

SEQ ID NO: 884528 - RNA, 19 nt, Homo sapiens
gcccaaagcaacaccagaa

SEQ ID NO: 884529 - RNA, 19 nt, Homo sapiens
caguagcuguguccucuga

SEQ ID NO: 884530 - RNA, 19 nt, Homo sapiens
auacugcccuggucuagug

SEQ ID NO: 884531 - RNA, 19 nt, Homo sapiens
gcucaauucaugccuguga

SEQ ID NO: 884532 - RNA, 19 nt, Homo sapiens
uuacuuucaucacgacuga

SEQ ID NO: 884533 - RNA, 19 nt, Homo sapiens
gaacaggguagggaaaucu

SEQ ID NO: 884534 - RNA, 19 nt, Homo sapiens
uaaggaaagagacugaaga

SEQ ID NO: 884535 - RNA, 19 nt, Homo sapiens
caguaaagcauuugcacaa

SEQ ID NO: 884536 - RNA, 19 nt, Homo sapiens
uaaauacugcccuggucua

SEQ ID NO: 884537 - RNA, 19 nt, Homo sapiens
caauauagucucggagcua

SEQ ID NO: 884538 - RNA, 19 nt, Homo sapiens
ggcauuggcucagggugaa

SEQ ID NO: 884539 - RNA, 19 nt, Homo sapiens
ccauguggcucuaucuuuu

SEQ ID NO: 884540 - RNA, 19 nt, Homo sapiens
gcaauauugaucuuucugu

SEQ ID NO: 884541 - RNA, 19 nt, Homo sapiens
gaggguggaugggaaucuu

SEQ ID NO: 884542 - RNA, 19 nt, Homo sapiens
uacaaggacuauuacagau

SEQ ID NO: 884543 - RNA, 19 nt, Homo sapiens
uaugaggacucccaaucug

SEQ ID NO: 884544 - RNA, 19 nt, Homo sapiens
acuaggugcucaauucaug

SEQ ID NO: 884545 - RNA, 19 nt, Homo sapiens
gguucaaauuccaguucua

SEQ ID NO: 884546 - RNA, 19 nt, Homo sapiens
gcaggauugucuggguuga

SEQ ID NO: 884547 - RNA, 19 nt, Homo sapiens
gcuacugaauggcuauuac

SEQ ID NO: 884548 - RNA, 19 nt, Homo sapiens
ccucaaggcccuccacugu

SEQ ID NO: 884549 - RNA, 19 nt, Homo sapiens
cugguucccucacagguuu

SEQ ID NO: 884550 - RNA, 19 nt, Homo sapiens
caaauggaacuucucugau

SEQ ID NO: 884551 - RNA, 19 nt, Homo sapiens
ggccuagaguggcaaaugg

SEQ ID NO: 884552 - RNA, 19 nt, Homo sapiens
ggugaagccuagacaaagc

SEQ ID NO: 884553 - RNA, 19 nt, Homo sapiens
aaagggcaauauugaucuu

SEQ ID NO: 884554 - RNA, 19 nt, Homo sapiens
gauguggugacucauguga

SEQ ID NO: 884555 - RNA, 19 nt, Homo sapiens
gauugucuggguugaauga

SEQ ID NO: 884556 - RNA, 19 nt, Homo sapiens
acaagauggucaagcaagu

SEQ ID NO: 884557 - RNA, 19 nt, Homo sapiens
ggugcagcaucuacaagga

SEQ ID NO: 884558 - RNA, 19 nt, Homo sapiens
guaccucacccagauauca

SEQ ID NO: 884559 - RNA, 19 nt, Homo sapiens
gggcaauauugaucuuucu

SEQ ID NO: 884560 - RNA, 19 nt, Homo sapiens
gagcccagaucgcgacacu

SEQ ID NO: 884561 - RNA, 19 nt, Homo sapiens
caccauggaggguacaauu

SEQ ID NO: 884562 - RNA, 19 nt, Homo sapiens
gcgggauccugaaccugaa

SEQ ID NO: 884563 - RNA, 19 nt, Homo sapiens
caaagcaacaccagaacca

SEQ ID NO: 884564 - RNA, 19 nt, Homo sapiens
gcaacaccagaaccaagaa

SEQ ID NO: 884565 - RNA, 19 nt, Homo sapiens
guucaaauuccaguucuau

SEQ ID NO: 884566 - RNA, 19 nt, Homo sapiens
ugugggcgcuggguucaaa

SEQ ID NO: 884567 - RNA, 19 nt, Homo sapiens
ggacucccaaucugccauu

SEQ ID NO: 884568 - RNA, 19 nt, Homo sapiens
aagaaggagcuccauaaau

SEQ ID NO: 884569 - RNA, 19 nt, Homo sapiens
agauaaagccucucauagg

SEQ ID NO: 884570 - RNA, 19 nt, Homo sapiens
ccacuguccuaagauaaag

SEQ ID NO: 884571 - RNA, 19 nt, Homo sapiens
acuauaaagggcaauauug

SEQ ID NO: 884572 - RNA, 19 nt, Homo sapiens
ccgcagcagccacuauaaa

SEQ ID NO: 884573 - RNA, 19 nt, Homo sapiens
caaaaccucgucucuacua

SEQ ID NO: 884574 - RNA, 19 nt, Homo sapiens
ggcaaaaccucgucucuac

SEQ ID NO: 884575 - RNA, 19 nt, Homo sapiens
guagggaaaucuccauacc

SEQ ID NO: 884576 - RNA, 19 nt, Homo sapiens
gugcugggaucauggaacu

SEQ ID NO: 884577 - RNA, 19 nt, Homo sapiens
aaaccucgucucuacuaaa

SEQ ID NO: 884578 - RNA, 19 nt, Homo sapiens
caaauuccaguucuaugca

SEQ ID NO: 884579 - RNA, 19 nt, Homo sapiens
gcgcuggguucaaauucca

SEQ ID NO: 884580 - RNA, 19 nt, Homo sapiens
guucugagauguggugacu

SEQ ID NO: 884581 - RNA, 19 nt, Homo sapiens
ugagugaggccagguguug

SEQ ID NO: 884582 - RNA, 19 nt, Homo sapiens
gcugggaucauggaacuug

SEQ ID NO: 884583 - RNA, 19 nt, Homo sapiens
agaccagccugcccaacau

SEQ ID NO: 884584 - RNA, 19 nt, Homo sapiens
aaaugcccauccucuccua

SEQ ID NO: 884585 - RNA, 19 nt, Homo sapiens
aagauaaagccucucauag

SEQ ID NO: 884586 - RNA, 19 nt, Homo sapiens
accaaugccuucugaccuu

SEQ ID NO: 884587 - RNA, 19 nt, Homo sapiens
ugaaguggugucauaggaa

SEQ ID NO: 884588 - RNA, 19 nt, Homo sapiens
uaauggauacacagagguu

SEQ ID NO: 884589 - RNA, 19 nt, Homo sapiens
gaacaaagcagaagacuua

SEQ ID NO: 884590 - RNA, 19 nt, Homo sapiens
gaacauacauggaagaucu

SEQ ID NO: 884591 - RNA, 19 nt, Homo sapiens
gcaguuugcucuugaagua

SEQ ID NO: 884592 - RNA, 19 nt, Homo sapiens
caaagcagaagacuuauua

SEQ ID NO: 884593 - RNA, 19 nt, Homo sapiens
aagcugaccuggcgaauua

SEQ ID NO: 884594 - RNA, 19 nt, Homo sapiens
gaaagugaauugccaggaa

SEQ ID NO: 884595 - RNA, 19 nt, Homo sapiens
cuacggagcugaguaauuu

SEQ ID NO: 884596 - RNA, 19 nt, Homo sapiens
ccaagaaguucaagaagaa

SEQ ID NO: 884597 - RNA, 19 nt, Homo sapiens
ccaaugaucuacuggauga

SEQ ID NO: 884598 - RNA, 19 nt, Homo sapiens
gaaaggaaaugcucuucug

SEQ ID NO: 884599 - RNA, 19 nt, Homo sapiens
aaauaaggcuucucaaaga

SEQ ID NO: 884600 - RNA, 19 nt, Homo sapiens
gagaaucagccaaguguua

SEQ ID NO: 884601 - RNA, 19 nt, Homo sapiens
gaacuggcaggucacauua

SEQ ID NO: 884602 - RNA, 19 nt, Homo sapiens
gcauaaaguacaccuaaua

SEQ ID NO: 884603 - RNA, 19 nt, Homo sapiens
gaaauaaggcuucucaaag

SEQ ID NO: 884604 - RNA, 19 nt, Homo sapiens
agacauggaugacuuuaaa

SEQ ID NO: 884605 - RNA, 19 nt, Homo sapiens
gcaaagcauucuucggauu

SEQ ID NO: 884606 - RNA, 19 nt, Homo sapiens
agacucagcugucaagaaa

SEQ ID NO: 884607 - RNA, 19 nt, Homo sapiens
ggaagcacuuaguauauga

SEQ ID NO: 884608 - RNA, 19 nt, Homo sapiens
gauugaguguacagaauua

SEQ ID NO: 884609 - RNA, 19 nt, Homo sapiens
gaaaugcucuucugaucca

SEQ ID NO: 884610 - RNA, 19 nt, Homo sapiens
caaagaggaagauucaaua

SEQ ID NO: 884611 - RNA, 19 nt, Homo sapiens
gaaagauacccaggaauuu

SEQ ID NO: 884612 - RNA, 19 nt, Homo sapiens
gaaagcagacuccauaaca

SEQ ID NO: 884613 - RNA, 19 nt, Homo sapiens
gaauuccucugaacagcua

SEQ ID NO: 884614 - RNA, 19 nt, Homo sapiens
caaggaauaugaugccuau

SEQ ID NO: 884615 - RNA, 19 nt, Homo sapiens
caguggaucucaagacaua

SEQ ID NO: 884616 - RNA, 19 nt, Homo sapiens
gcacuuaguauaugaaaug

SEQ ID NO: 884617 - RNA, 19 nt, Homo sapiens
gaaagagaccugauuccaa

SEQ ID NO: 884618 - RNA, 19 nt, Homo sapiens
gaacagcuagauaagcaua

SEQ ID NO: 884619 - RNA, 19 nt, Homo sapiens
gcacugggcucaggcuuau

SEQ ID NO: 884620 - RNA, 19 nt, Homo sapiens
gcagaagacuuauuaucgu

SEQ ID NO: 884621 - RNA, 19 nt, Homo sapiens
agaagaagauggaggaaau

SEQ ID NO: 884622 - RNA, 19 nt, Homo sapiens
gcaaagaggaagauucaau

SEQ ID NO: 884623 - RNA, 19 nt, Homo sapiens
gagcaaagaggaagauuca

SEQ ID NO: 884624 - RNA, 19 nt, Homo sapiens
cauggaagaucucacaaga

SEQ ID NO: 884625 - RNA, 19 nt, Homo sapiens
ggagaagcauaauaauaca

SEQ ID NO: 884626 - RNA, 19 nt, Homo sapiens
ugaaagauacccaggaauu

SEQ ID NO: 884627 - RNA, 19 nt, Homo sapiens
gcaaccaccauacuuauug

SEQ ID NO: 884628 - RNA, 19 nt, Homo sapiens
ugaauuggcacucaucuuu

SEQ ID NO: 884629 - RNA, 19 nt, Homo sapiens
acgaacaacugaauugaaa

SEQ ID NO: 884630 - RNA, 19 nt, Homo sapiens
aauaacacccugaaagaua

SEQ ID NO: 884631 - RNA, 19 nt, Homo sapiens
gaaguugaauuggcacuca

SEQ ID NO: 884632 - RNA, 19 nt, Homo sapiens
cauuagagaaggugaaaua

SEQ ID NO: 884633 - RNA, 19 nt, Homo sapiens
ccaagauacuuuagacugu

SEQ ID NO: 884634 - RNA, 19 nt, Homo sapiens
gaagauggaggaaauuaca

SEQ ID NO: 884635 - RNA, 19 nt, Homo sapiens
gcaugaaggugucaauguc

SEQ ID NO: 884636 - RNA, 19 nt, Homo sapiens
caagaaaagugaaggauga

SEQ ID NO: 884637 - RNA, 19 nt, Homo sapiens
aauuauaccugccauguug

SEQ ID NO: 884638 - RNA, 19 nt, Homo sapiens
agaggaagauucaauaugg

SEQ ID NO: 884639 - RNA, 19 nt, Homo sapiens
ggaccaagauacuuuagac

SEQ ID NO: 884640 - RNA, 19 nt, Homo sapiens
ugaaauaaggcuucucaaa

SEQ ID NO: 884641 - RNA, 19 nt, Homo sapiens
gaagauggugucaaagaga

SEQ ID NO: 884642 - RNA, 19 nt, Homo sapiens
ggagcugaguaauuuagaa

SEQ ID NO: 884643 - RNA, 19 nt, Homo sapiens
aaaccgaaauggacggaaa

SEQ ID NO: 884644 - RNA, 19 nt, Homo sapiens
uaacuacggagcugaguaa

SEQ ID NO: 884645 - RNA, 19 nt, Homo sapiens
gauccaagaaguucaagaa

SEQ ID NO: 884646 - RNA, 19 nt, Homo sapiens
guggagaagcauaauaaua

SEQ ID NO: 884647 - RNA, 19 nt, Homo sapiens
gaacuaagggagacuugug

SEQ ID NO: 884648 - RNA, 19 nt, Homo sapiens
cgaaauggacggaaacaug

SEQ ID NO: 884649 - RNA, 19 nt, Homo sapiens
uagagaaggugaaauaagg

SEQ ID NO: 884650 - RNA, 19 nt, Homo sapiens
gaacaacugaauugaaagu

SEQ ID NO: 884651 - RNA, 19 nt, Homo sapiens
ggacagcuaccccuuaaua

SEQ ID NO: 884652 - RNA, 19 nt, Homo sapiens
aaacuucugucccugauca

SEQ ID NO: 884653 - RNA, 19 nt, Homo sapiens
gagcugaugaaacuaauga

SEQ ID NO: 884654 - RNA, 19 nt, Homo sapiens
cuacaacauugaauugaug

SEQ ID NO: 884655 - RNA, 19 nt, Homo sapiens
gaauuccacccuucagauu

SEQ ID NO: 884656 - RNA, 19 nt, Homo sapiens
aggcugaucucccugaauu

SEQ ID NO: 884657 - RNA, 19 nt, Homo sapiens
ugaaaugcccaucaagaaa

SEQ ID NO: 884658 - RNA, 19 nt, Homo sapiens
gcuagucaguggagaaauc

SEQ ID NO: 884659 - RNA, 19 nt, Homo sapiens
gcugaacucuagaaaucuu

SEQ ID NO: 884660 - RNA, 19 nt, Homo sapiens
uauaugaaaugcccaucaa

SEQ ID NO: 884661 - RNA, 19 nt, Homo sapiens
gcuacaacauugaauugau

SEQ ID NO: 884662 - RNA, 19 nt, Homo sapiens
cgagugaaaugugcccuuu

SEQ ID NO: 884663 - RNA, 19 nt, Homo sapiens
gaauuucacaggaacaguu

SEQ ID NO: 884664 - RNA, 19 nt, Homo sapiens
ggaauaugaugccuaucuc

SEQ ID NO: 884665 - RNA, 19 nt, Homo sapiens
ggagaaaaguuuauugaag

SEQ ID NO: 884666 - RNA, 19 nt, Homo sapiens
ggaggaaauuacacaugug

SEQ ID NO: 884667 - RNA, 19 nt, Homo sapiens
cugcugaacucuagaaauc

SEQ ID NO: 884668 - RNA, 19 nt, Homo sapiens
ugacaauccugaagaagag

SEQ ID NO: 884669 - RNA, 19 nt, Homo sapiens
gagcugaguaauuuagaaa

SEQ ID NO: 884670 - RNA, 19 nt, Homo sapiens
cagcaggauccgcuauuua

SEQ ID NO: 884671 - RNA, 19 nt, Homo sapiens
ccucugaacagcuagauaa

SEQ ID NO: 884672 - RNA, 19 nt, Homo sapiens
gcagagguuauaaacauga

SEQ ID NO: 884673 - RNA, 19 nt, Homo sapiens
ggacuccgcagaacaagga

SEQ ID NO: 884674 - RNA, 19 nt, Homo sapiens
gaggaaauuacacauguga

SEQ ID NO: 884675 - RNA, 19 nt, Homo sapiens
ggaagauucaauaugguuu

SEQ ID NO: 884676 - RNA, 19 nt, Homo sapiens
ccagugauauuugguagug

SEQ ID NO: 884677 - RNA, 19 nt, Homo sapiens
uagaaacccuccuuaacuc

SEQ ID NO: 884678 - RNA, 19 nt, Homo sapiens
gaagaagauggaggaaauu

SEQ ID NO: 884679 - RNA, 19 nt, Homo sapiens
caaccaccauacuuauugu

SEQ ID NO: 884680 - RNA, 19 nt, Homo sapiens
gaauuauaccugccauguu

SEQ ID NO: 884681 - RNA, 19 nt, Homo sapiens
gaaucagccaaguguuaua

SEQ ID NO: 884682 - RNA, 19 nt, Homo sapiens
gaauugaaaguuacagcuu

SEQ ID NO: 884683 - RNA, 19 nt, Homo sapiens
uccaagaaguucaagaaga

SEQ ID NO: 884684 - RNA, 19 nt, Homo sapiens
gauguugugugguauaagg

SEQ ID NO: 884685 - RNA, 19 nt, Homo sapiens
guucuuugcugccuuuauc

SEQ ID NO: 884686 - RNA, 19 nt, Homo sapiens
uuaauaacacccugaaaga

SEQ ID NO: 884687 - RNA, 19 nt, Homo sapiens
uugcagagguuauaaacau

SEQ ID NO: 884688 - RNA, 19 nt, Homo sapiens
gaaaugcccaucaagaaaa

SEQ ID NO: 884689 - RNA, 19 nt, Homo sapiens
gaagagaacugguauaaca

SEQ ID NO: 884690 - RNA, 19 nt, Homo sapiens
agaaagaguuccagaauug

SEQ ID NO: 884691 - RNA, 19 nt, Homo sapiens
gaagugcgauagugacauu

SEQ ID NO: 884692 - RNA, 19 nt, Homo sapiens
caagaggcaucagaaauuu

SEQ ID NO: 884693 - RNA, 19 nt, Homo sapiens
ccacaaccauucuuucuug

SEQ ID NO: 884694 - RNA, 19 nt, Homo sapiens
ugucauaguucccaucaua

SEQ ID NO: 884695 - RNA, 19 nt, Homo sapiens
gaacugguauaacaccuau

SEQ ID NO: 884696 - RNA, 19 nt, Homo sapiens
ggacaguggucucuaucuu

SEQ ID NO: 884697 - RNA, 19 nt, Homo sapiens
acaaggaccuacugaugua

SEQ ID NO: 884698 - RNA, 19 nt, Homo sapiens
cagaaagaguuccagaauu

SEQ ID NO: 884699 - RNA, 19 nt, Homo sapiens
caugaucacucuuuauaug

SEQ ID NO: 884700 - RNA, 19 nt, Homo sapiens
ccaagaggcaucagaaauu

SEQ ID NO: 884701 - RNA, 19 nt, Homo sapiens
gaaacuuacuuccgaaugc

SEQ ID NO: 884702 - RNA, 19 nt, Homo sapiens
ggauuaguccuuaccagua

SEQ ID NO: 884703 - RNA, 19 nt, Homo sapiens
gacuagaaauagaucauga

SEQ ID NO: 884704 - RNA, 19 nt, Homo sapiens
caaccauucuuucuuguca

SEQ ID NO: 884705 - RNA, 19 nt, Homo sapiens
guacaaggaccuacugaug

SEQ ID NO: 884706 - RNA, 19 nt, Homo sapiens
ugacaaaggagaacucuau

SEQ ID NO: 884707 - RNA, 19 nt, Homo sapiens
gagacuggauuuggaaaga

SEQ ID NO: 884708 - RNA, 19 nt, Homo sapiens
gaucagagaaacuuacuuc

SEQ ID NO: 884709 - RNA, 19 nt, Homo sapiens
agacggaacuccaagagau

SEQ ID NO: 884710 - RNA, 19 nt, Homo sapiens
gggagcaguuugaagagaa

SEQ ID NO: 884711 - RNA, 19 nt, Homo sapiens
caaaggagaacucuaugga

SEQ ID NO: 884712 - RNA, 19 nt, Homo sapiens
uacauuggauuaguccuua

SEQ ID NO: 884713 - RNA, 19 nt, Homo sapiens
cuacugauguacacuugaa

SEQ ID NO: 884714 - RNA, 19 nt, Homo sapiens
gcagguggguucgcauuuc

SEQ ID NO: 884715 - RNA, 19 nt, Homo sapiens
gauuaguccuuaccaguag

SEQ ID NO: 884716 - RNA, 19 nt, Homo sapiens
ccagaaagaguuccagaau

SEQ ID NO: 884717 - RNA, 19 nt, Homo sapiens
ggauuuggaaagaauauug

SEQ ID NO: 884718 - RNA, 19 nt, Homo sapiens
uggaaugaaugacaaagga

SEQ ID NO: 884719 - RNA, 19 nt, Homo sapiens
caaaccacaaccauucuuu

SEQ ID NO: 884720 - RNA, 19 nt, Homo sapiens
auagugacauuauggaaga

SEQ ID NO: 884721 - RNA, 19 nt, Homo sapiens
cuacugagagacuggauuu

SEQ ID NO: 884722 - RNA, 19 nt, Homo sapiens
gguauaacaccuauucauc

SEQ ID NO: 884723 - RNA, 19 nt, Homo sapiens
ccuuagauacauuggauua

SEQ ID NO: 884724 - RNA, 19 nt, Homo sapiens
aaagaguuccagaauugua

SEQ ID NO: 884725 - RNA, 19 nt, Homo sapiens
uaacaccuauucaucuaac

SEQ ID NO: 884726 - RNA, 19 nt, Homo sapiens
gaaagaguuccagaauugu

SEQ ID NO: 884727 - RNA, 19 nt, Homo sapiens
acacauuucuuaccuagac

SEQ ID NO: 884728 - RNA, 19 nt, Homo sapiens
guauaacaccuauucaucu

SEQ ID NO: 884729 - RNA, 19 nt, Homo sapiens
gacaguggucucuaucuug

SEQ ID NO: 884730 - RNA, 19 nt, Homo sapiens
ccucuucgguaucuuggaa

SEQ ID NO: 884731 - RNA, 19 nt, Homo sapiens
gacuggauuuggaaagaau

SEQ ID NO: 884732 - RNA, 19 nt, Homo sapiens
caaagacggaacuccaaga

SEQ ID NO: 884733 - RNA, 19 nt, Homo sapiens
uuagggagcaguuugaaga

SEQ ID NO: 884734 - RNA, 19 nt, Homo sapiens
gacacuggccgcagguauu

SEQ ID NO: 884735 - RNA, 19 nt, Homo sapiens
ugaucacucuuuauaugug

SEQ ID NO: 884736 - RNA, 19 nt, Homo sapiens
ucauaguucccaucauaaa

SEQ ID NO: 884737 - RNA, 19 nt, Homo sapiens
uugaagagaacugguauaa

SEQ ID NO: 884738 - RNA, 19 nt, Homo sapiens
ggagaacucuauggaucag

SEQ ID NO: 884739 - RNA, 19 nt, Homo sapiens
agacuggauuuggaaagaa

SEQ ID NO: 884740 - RNA, 19 nt, Homo sapiens
gguccaagaggcaucagaa

SEQ ID NO: 884741 - RNA, 19 nt, Homo sapiens
caccuauucaucuaacaua

SEQ ID NO: 884742 - RNA, 19 nt, Homo sapiens
uagauacauuggauuaguc

SEQ ID NO: 884743 - RNA, 19 nt, Homo sapiens
cugagagacuggauuugga

SEQ ID NO: 884744 - RNA, 19 nt, Homo sapiens
accauucuuucuugucaua

SEQ ID NO: 884745 - RNA, 19 nt, Homo sapiens
gugcgauagugacauuaug

SEQ ID NO: 884746 - RNA, 19 nt, Homo sapiens
accaguggauccagaaaga

SEQ ID NO: 884747 - RNA, 19 nt, Homo sapiens
agucaaaccacaaccauuc

SEQ ID NO: 884748 - RNA, 19 nt, Homo sapiens
uacaaggaccuacugaugu

SEQ ID NO: 884749 - RNA, 19 nt, Homo sapiens
acacuggccgcagguauuu

SEQ ID NO: 884750 - RNA, 19 nt, Homo sapiens
ggguucgcauuuccuguug

SEQ ID NO: 884751 - RNA, 19 nt, Homo sapiens
aaacuuacuuccgaaugca

SEQ ID NO: 884752 - RNA, 19 nt, Homo sapiens
gagagacuggauuuggaaa

SEQ ID NO: 884753 - RNA, 19 nt, Homo sapiens
gagucaaaccacaaccauu

SEQ ID NO: 884754 - RNA, 19 nt, Homo sapiens
gagaaacuuacuuccgaau

SEQ ID NO: 884755 - RNA, 19 nt, Homo sapiens
ugagagacuggauuuggaa

SEQ ID NO: 884756 - RNA, 19 nt, Homo sapiens
ggaagagucaaaccacaac

SEQ ID NO: 884757 - RNA, 19 nt, Homo sapiens
aagaggcaucagaaauuua

SEQ ID NO: 884758 - RNA, 19 nt, Homo sapiens
ggagcaguuugaagagaac

SEQ ID NO: 884759 - RNA, 19 nt, Homo sapiens
uauuagagguguggacagu

SEQ ID NO: 884760 - RNA, 19 nt, Homo sapiens
gacaaaggagaacucuaug

SEQ ID NO: 884761 - RNA, 19 nt, Homo sapiens
ucccuuagauacauuggau

SEQ ID NO: 884762 - RNA, 19 nt, Homo sapiens
uguggacaguggucucuau

SEQ ID NO: 884763 - RNA, 19 nt, Homo sapiens
uuccagaauuguacaagga

SEQ ID NO: 884764 - RNA, 19 nt, Homo sapiens
gcaggaccacagccucuuc

SEQ ID NO: 884765 - RNA, 19 nt, Homo sapiens
gucauaguucccaucauaa

SEQ ID NO: 884766 - RNA, 19 nt, Homo sapiens
gguauuuuguggcacuuaa

SEQ ID NO: 884767 - RNA, 19 nt, Homo sapiens
gaaugacaaaggagaacuc

SEQ ID NO: 884768 - RNA, 19 nt, Homo sapiens
aguggucucuaucuuggaa

SEQ ID NO: 884769 - RNA, 19 nt, Homo sapiens
gcgauagugacauuaugga

SEQ ID NO: 884770 - RNA, 19 nt, Homo sapiens
gacggaacuccaagagaug

SEQ ID NO: 884771 - RNA, 19 nt, Homo sapiens
auauaaacauggagacacu

SEQ ID NO: 884772 - RNA, 19 nt, Homo sapiens
cagcagguggguucgcauu

SEQ ID NO: 884773 - RNA, 19 nt, Homo sapiens
aaaccacaaccauucuuuc

SEQ ID NO: 884774 - RNA, 19 nt, Homo sapiens
cgauagugacauuauggaa

SEQ ID NO: 884775 - RNA, 19 nt, Homo sapiens
uaucuuggaaugaaugaca

SEQ ID NO: 884776 - RNA, 19 nt, Homo sapiens
aaaggagaacucuauggau

SEQ ID NO: 884777 - RNA, 19 nt, Homo sapiens
guccaagaggcaucagaaa

SEQ ID NO: 884778 - RNA, 19 nt, Homo sapiens
gagagaagcuccuagaaca

SEQ ID NO: 884779 - RNA, 19 nt, Homo sapiens
gaacagagaugagcaggau

SEQ ID NO: 884780 - RNA, 19 nt, Homo sapiens
gaagagaucugugccaaca

SEQ ID NO: 884781 - RNA, 19 nt, Homo sapiens
cgaaagguguucccuguuu

SEQ ID NO: 884782 - RNA, 19 nt, Homo sapiens
ucaaggagaucuucauguu

SEQ ID NO: 884783 - RNA, 19 nt, Homo sapiens
caagguagauuguuugaag

SEQ ID NO: 884784 - RNA, 19 nt, Homo sapiens
ggaaucugcugaucuuguu

SEQ ID NO: 884785 - RNA, 19 nt, Homo sapiens
ugagagacaugaacacuga

SEQ ID NO: 884786 - RNA, 19 nt, Homo sapiens
gggcuaggcuuguucaauc

SEQ ID NO: 884787 - RNA, 19 nt, Homo sapiens
ugacacaccuggcauuauc

SEQ ID NO: 884788 - RNA, 19 nt, Homo sapiens
gcagggaagucaacacucu

SEQ ID NO: 884789 - RNA, 19 nt, Homo sapiens
cuaaagcaauaccuucuga

SEQ ID NO: 884790 - RNA, 19 nt, Homo sapiens
acaaagguguagcuaagaa

SEQ ID NO: 884791 - RNA, 19 nt, Homo sapiens
cauggaaucugcugaucuu

SEQ ID NO: 884792 - RNA, 19 nt, Homo sapiens
ccaggaaggugcauacuac

SEQ ID NO: 884793 - RNA, 19 nt, Homo sapiens
gaaccugccuuagcucagu

SEQ ID NO: 884794 - RNA, 19 nt, Homo sapiens
agagaucugugccaacauu

SEQ ID NO: 884795 - RNA, 19 nt, Homo sapiens
gaaggagacccaggugauu

SEQ ID NO: 884796 - RNA, 19 nt, Homo sapiens
ggagcucucuuuguuggaa

SEQ ID NO: 884797 - RNA, 19 nt, Homo sapiens
aaggagaucuucauguugu

SEQ ID NO: 884798 - RNA, 19 nt, Homo sapiens
gcucugcccuggaccacuu

SEQ ID NO: 884799 - RNA, 19 nt, Homo sapiens
ggcauuaucaguccuggua

SEQ ID NO: 884800 - RNA, 19 nt, Homo sapiens
gacauccgccucucuguga

SEQ ID NO: 884801 - RNA, 19 nt, Homo sapiens
ccagcugugucuucuguug

SEQ ID NO: 884802 - RNA, 19 nt, Homo sapiens
gcccagcugugucuucugu

SEQ ID NO: 884803 - RNA, 19 nt, Homo sapiens
gaacacugacuggccacua

SEQ ID NO: 884804 - RNA, 19 nt, Homo sapiens
cauuaucaguccugguaaa

SEQ ID NO: 884805 - RNA, 19 nt, Homo sapiens
cccaggaggugccuuacaa

SEQ ID NO: 884806 - RNA, 19 nt, Homo sapiens
uagauuguuugaagcagaa

SEQ ID NO: 884807 - RNA, 19 nt, Homo sapiens
gagaucugugccaacauua

SEQ ID NO: 884808 - RNA, 19 nt, Homo sapiens
agcaauaccuucugacaca

SEQ ID NO: 884809 - RNA, 19 nt, Homo sapiens
caaggagaucuucauguug

SEQ ID NO: 884810 - RNA, 19 nt, Homo sapiens
guaaacagaagaggcauca

SEQ ID NO: 884811 - RNA, 19 nt, Homo sapiens
cugugaagcuccucaagug

SEQ ID NO: 884812 - RNA, 19 nt, Homo sapiens
cuaguguccuggucaugaa

SEQ ID NO: 884813 - RNA, 19 nt, Homo sapiens
ggaagucaacacucuccaa

SEQ ID NO: 884814 - RNA, 19 nt, Homo sapiens
uaugugaaacuccugauug

SEQ ID NO: 884815 - RNA, 19 nt, Homo sapiens
gaucugugccaacauuauc

SEQ ID NO: 884816 - RNA, 19 nt, Homo sapiens
ccuugaacuuggauaagaa

SEQ ID NO: 884817 - RNA, 19 nt, Homo sapiens
uuccugcccucacuucuuu

SEQ ID NO: 884818 - RNA, 19 nt, Homo sapiens
gcacuggugagagacauga

SEQ ID NO: 884819 - RNA, 19 nt, Homo sapiens
gcaguuaaggacccaaaca

SEQ ID NO: 884820 - RNA, 19 nt, Homo sapiens
uaucaguccugguaaacag

SEQ ID NO: 884821 - RNA, 19 nt, Homo sapiens
gaccaaguacucccagauc

SEQ ID NO: 884822 - RNA, 19 nt, Homo sapiens
gcaccacagcuacaaaggu

SEQ ID NO: 884823 - RNA, 19 nt, Homo sapiens
gggagcugguuauccaaca

SEQ ID NO: 884824 - RNA, 19 nt, Homo sapiens
ccagacaccagaagagauc

SEQ ID NO: 884825 - RNA, 19 nt, Homo sapiens
cugaagguguggucaaugg

SEQ ID NO: 884826 - RNA, 19 nt, Homo sapiens
ucacggcagcccucacuga

SEQ ID NO: 884827 - RNA, 19 nt, Homo sapiens
agucaacacucuccaacca

SEQ ID NO: 884828 - RNA, 19 nt, Homo sapiens
ucaccuugaacuuggauaa

SEQ ID NO: 884829 - RNA, 19 nt, Homo sapiens
gcuaugggcccagaguuuc

SEQ ID NO: 884830 - RNA, 19 nt, Homo sapiens
cgagagaagcuccuagaac

SEQ ID NO: 884831 - RNA, 19 nt, Homo sapiens
ggaccacuuccucggauuc

SEQ ID NO: 884832 - RNA, 19 nt, Homo sapiens
ggacccaaacacacaaucu

SEQ ID NO: 884833 - RNA, 19 nt, Homo sapiens
ucaugaacaagguagauug

SEQ ID NO: 884834 - RNA, 19 nt, Homo sapiens
accuggagcucucuuuguu

SEQ ID NO: 884835 - RNA, 19 nt, Homo sapiens
acccugauaugccugagaa

SEQ ID NO: 884836 - RNA, 19 nt, Homo sapiens
ucucucagcccgacaguuc

SEQ ID NO: 884837 - RNA, 19 nt, Homo sapiens
cccaggugauucuacuuga

SEQ ID NO: 884838 - RNA, 19 nt, Homo sapiens
guugcuagcagggagauuu

SEQ ID NO: 884839 - RNA, 19 nt, Homo sapiens
gagcugguuauccaacaga

SEQ ID NO: 884840 - RNA, 19 nt, Homo sapiens
cugauaugccugagaauuc

SEQ ID NO: 884841 - RNA, 19 nt, Homo sapiens
caacauuauccgagagaag

SEQ ID NO: 884842 - RNA, 19 nt, Homo sapiens
uuaaggacccaaacacaca

SEQ ID NO: 884843 - RNA, 19 nt, Homo sapiens
gcauuaucaguccugguaa

SEQ ID NO: 884844 - RNA, 19 nt, Homo sapiens
ccugauaugccugagaauu

SEQ ID NO: 884845 - RNA, 19 nt, Homo sapiens
caggaggugccuuacaaug

SEQ ID NO: 884846 - RNA, 19 nt, Homo sapiens
ccaacauuauccgagagaa

SEQ ID NO: 884847 - RNA, 19 nt, Homo sapiens
aaagguguagcuaagaaga

SEQ ID NO: 884848 - RNA, 19 nt, Homo sapiens
ggagcugguuauccaacag

SEQ ID NO: 884849 - RNA, 19 nt, Homo sapiens
gcauggaaucugcugaucu

SEQ ID NO: 884850 - RNA, 19 nt, Homo sapiens
agaaggagacccaggugau

SEQ ID NO: 884851 - RNA, 19 nt, Homo sapiens
acagagaugagcaggaugu

SEQ ID NO: 884852 - RNA, 19 nt, Homo sapiens
aaagcaauaccuucugaca

SEQ ID NO: 884853 - RNA, 19 nt, Homo sapiens
ggagaucuucauguuguca

SEQ ID NO: 884854 - RNA, 19 nt, Homo sapiens
ccuaguguccuggucauga

SEQ ID NO: 884855 - RNA, 19 nt, Homo sapiens
gaucuuguugugguucuug

SEQ ID NO: 884856 - RNA, 19 nt, Homo sapiens
ccagggcauuccagcucaa

SEQ ID NO: 884857 - RNA, 19 nt, Homo sapiens
caagugaccacccucuacu

SEQ ID NO: 884858 - RNA, 19 nt, Homo sapiens
gacccaaacacacaaucug

SEQ ID NO: 884859 - RNA, 19 nt, Homo sapiens
ggagacccaggugauucua

SEQ ID NO: 884860 - RNA, 19 nt, Homo sapiens
gaagggcucuggaugaauu

SEQ ID NO: 884861 - RNA, 19 nt, Homo sapiens
acagauaagcgaagaaaua

SEQ ID NO: 884862 - RNA, 19 nt, Homo sapiens
gcaacauuauugucuuuga

SEQ ID NO: 884863 - RNA, 19 nt, Homo sapiens
ccacauaggucagaaacga

SEQ ID NO: 884864 - RNA, 19 nt, Homo sapiens
caucagagauuucuacaac

SEQ ID NO: 884865 - RNA, 19 nt, Homo sapiens
gggaagggcucuggaugaa

SEQ ID NO: 884866 - RNA, 19 nt, Homo sapiens
agaaauacgacaaugcuua

SEQ ID NO: 884867 - RNA, 19 nt, Homo sapiens
gaagcaaggguacagauau

SEQ ID NO: 884868 - RNA, 19 nt, Homo sapiens
caacccagccauccacaua

SEQ ID NO: 884869 - RNA, 19 nt, Homo sapiens
cagcaacauuauugucuuu

SEQ ID NO: 884870 - RNA, 19 nt, Homo sapiens
guaagaccuccaccaguua

SEQ ID NO: 884871 - RNA, 19 nt, Homo sapiens
auacgacaaugcuuaguaa

SEQ ID NO: 884872 - RNA, 19 nt, Homo sapiens
gaaauacgacaaugcuuag

SEQ ID NO: 884873 - RNA, 19 nt, Homo sapiens
gcagcaacauuauugucuu

SEQ ID NO: 884874 - RNA, 19 nt, Homo sapiens
aguaagaccuccaccaguu

SEQ ID NO: 884875 - RNA, 19 nt, Homo sapiens
ccaauauaaucaucagaga

SEQ ID NO: 884876 - RNA, 19 nt, Homo sapiens
gaagaaauacgacaaugcu

SEQ ID NO: 884877 - RNA, 19 nt, Homo sapiens
gcgaagaaauacgacaaug

SEQ ID NO: 884878 - RNA, 19 nt, Homo sapiens
gauaagcgaagaaauacga

SEQ ID NO: 884879 - RNA, 19 nt, Homo sapiens
caacauuauugucuuugag

SEQ ID NO: 884880 - RNA, 19 nt, Homo sapiens
acacacagauaagcgaaga

SEQ ID NO: 884881 - RNA, 19 nt, Homo sapiens
gaaagaagcaaggguacag

SEQ ID NO: 884882 - RNA, 19 nt, Homo sapiens
ggacagccaauauaaucau

SEQ ID NO: 884883 - RNA, 19 nt, Homo sapiens
gggcaucuucguucugauu

SEQ ID NO: 884884 - RNA, 19 nt, Homo sapiens
agaagcaaggguacagaua

SEQ ID NO: 884885 - RNA, 19 nt, Homo sapiens
ggccaaagcauaccuucug

SEQ ID NO: 884886 - RNA, 19 nt, Homo sapiens
aagcaaggguacagauauc

SEQ ID NO: 884887 - RNA, 19 nt, Homo sapiens
caaugcaaguucuauagcu

SEQ ID NO: 884888 - RNA, 19 nt, Homo sapiens
cuccaccaguuaugucuaa

SEQ ID NO: 884889 - RNA, 19 nt, Homo sapiens
acacagauaagcgaagaaa

SEQ ID NO: 884890 - RNA, 19 nt, Homo sapiens
aauacgacaaugcuuagua

SEQ ID NO: 884891 - RNA, 19 nt, Homo sapiens
gcugcuguccucuucauug

SEQ ID NO: 884892 - RNA, 19 nt, Homo sapiens
cgagagggccaaagcauac

SEQ ID NO: 884893 - RNA, 19 nt, Homo sapiens
gacagccaauauaaucauc

SEQ ID NO: 884894 - RNA, 19 nt, Homo sapiens
gggucugcuuuguggauuu

SEQ ID NO: 884895 - RNA, 19 nt, Homo sapiens
gcgcugcuguccucuucau

SEQ ID NO: 884896 - RNA, 19 nt, Homo sapiens
gagaguaucagcuuuuguu

SEQ ID NO: 884897 - RNA, 19 nt, Homo sapiens
uaagaccuccaccaguuau

SEQ ID NO: 884898 - RNA, 19 nt, Homo sapiens
cagauaagcgaagaaauac

SEQ ID NO: 884899 - RNA, 19 nt, Homo sapiens
ugacgggcaucuucguucu

SEQ ID NO: 884900 - RNA, 19 nt, Homo sapiens
uggcaucuguggcaugaag

SEQ ID NO: 884901 - RNA, 19 nt, Homo sapiens
aagcgcugcuguccucuuc

SEQ ID NO: 884902 - RNA, 19 nt, Homo sapiens
ugggaagggcucuggauga

SEQ ID NO: 884903 - RNA, 19 nt, Homo sapiens
acgagagggccaaagcaua

SEQ ID NO: 884904 - RNA, 19 nt, Homo sapiens
gcaaugcaaguucuauagc

SEQ ID NO: 884905 - RNA, 19 nt, Homo sapiens
cgaagaaauacgacaaugc

SEQ ID NO: 884906 - RNA, 19 nt, Homo sapiens
ggaagggcucuggaugaau

SEQ ID NO: 884907 - RNA, 19 nt, Homo sapiens
ccucauguguguggcuguu

SEQ ID NO: 884908 - RNA, 19 nt, Homo sapiens
guucuauagcuccuuguug

SEQ ID NO: 884909 - RNA, 19 nt, Homo sapiens
gcaaggguacagauaucca

SEQ ID NO: 884910 - RNA, 19 nt, Homo sapiens
cuggacagccaauauaauc

SEQ ID NO: 884911 - RNA, 19 nt, Homo sapiens
gagcaggaaucacccauua

SEQ ID NO: 884912 - RNA, 19 nt, Homo sapiens
gcaaacacaugcuuuaaug

SEQ ID NO: 884913 - RNA, 19 nt, Homo sapiens
ggaaugagguaagaagaua

SEQ ID NO: 884914 - RNA, 19 nt, Homo sapiens
ggaaauugcagaaguguua

SEQ ID NO: 884915 - RNA, 19 nt, Homo sapiens
ccuaagaguucucauaaua

SEQ ID NO: 884916 - RNA, 19 nt, Homo sapiens
uaaggugacugccaaauaa

SEQ ID NO: 884917 - RNA, 19 nt, Homo sapiens
gaugagaaauggaagauga

SEQ ID NO: 884918 - RNA, 19 nt, Homo sapiens
gaagucaucugucucuuug

SEQ ID NO: 884919 - RNA, 19 nt, Homo sapiens
gaaaccaaaucaagcuaaa

SEQ ID NO: 884920 - RNA, 19 nt, Homo sapiens
gaaagguguugcuguuuga

SEQ ID NO: 884921 - RNA, 19 nt, Homo sapiens
gcacugaucuguggcuuga

SEQ ID NO: 884922 - RNA, 19 nt, Homo sapiens
gaaauuaccgaauguguau

SEQ ID NO: 884923 - RNA, 19 nt, Homo sapiens
gaagauacagcuacagaaa

SEQ ID NO: 884924 - RNA, 19 nt, Homo sapiens
ucaaaucgcucgccucuca

SEQ ID NO: 884925 - RNA, 19 nt, Homo sapiens
gaugagaacucccuaagag

SEQ ID NO: 884926 - RNA, 19 nt, Homo sapiens
gaacagucauuguaauugg

SEQ ID NO: 884927 - RNA, 19 nt, Homo sapiens
gaagucaugauguguauuu

SEQ ID NO: 884928 - RNA, 19 nt, Homo sapiens
gcagaaguguuauuucaca

SEQ ID NO: 884929 - RNA, 19 nt, Homo sapiens
ggugguaucuaaagaagaa

SEQ ID NO: 884930 - RNA, 19 nt, Homo sapiens
gcucaaauuuguagacuuc

SEQ ID NO: 884931 - RNA, 19 nt, Homo sapiens
ggagaaauuccucuuuaaa

SEQ ID NO: 884932 - RNA, 19 nt, Homo sapiens
gaaguguuauuucacauuc

SEQ ID NO: 884933 - RNA, 19 nt, Homo sapiens
cagcaaagauacugaaaca

SEQ ID NO: 884934 - RNA, 19 nt, Homo sapiens
aaagagaccagcaaagaua

SEQ ID NO: 884935 - RNA, 19 nt, Homo sapiens
ggagaacagucauuguaau

SEQ ID NO: 884936 - RNA, 19 nt, Homo sapiens
gggaauuaauguuaucuug

SEQ ID NO: 884937 - RNA, 19 nt, Homo sapiens
aaacaacacucaccacaca

SEQ ID NO: 884938 - RNA, 19 nt, Homo sapiens
gcucagggcugccagaauc

SEQ ID NO: 884939 - RNA, 19 nt, Homo sapiens
guaaggugacugccaaaua

SEQ ID NO: 884940 - RNA, 19 nt, Homo sapiens
ugacagauugcuucauuua

SEQ ID NO: 884941 - RNA, 19 nt, Homo sapiens
gccaagggaauuaauguua

SEQ ID NO: 884942 - RNA, 19 nt, Homo sapiens
gcagugaaguccagauagu

SEQ ID NO: 884943 - RNA, 19 nt, Homo sapiens
gagaacagucauuguaauu

SEQ ID NO: 884944 - RNA, 19 nt, Homo sapiens
ccaagggaauuaauguuau

SEQ ID NO: 884945 - RNA, 19 nt, Homo sapiens
guaagaagauacagcuaca

SEQ ID NO: 884946 - RNA, 19 nt, Homo sapiens
ugaaagguguugcuguuug

SEQ ID NO: 884947 - RNA, 19 nt, Homo sapiens
cuggagaaauuccucuuua

SEQ ID NO: 884948 - RNA, 19 nt, Homo sapiens
acagauugcuucauuuaug

SEQ ID NO: 884949 - RNA, 19 nt, Homo sapiens
ugagaucgguugcuggaaa

SEQ ID NO: 884950 - RNA, 19 nt, Homo sapiens
gaagaaguuuggcaauguc

SEQ ID NO: 884951 - RNA, 19 nt, Homo sapiens
cuacgguucuuaauacuga

SEQ ID NO: 884952 - RNA, 19 nt, Homo sapiens
uguggaaggucuuaaugua

SEQ ID NO: 884953 - RNA, 19 nt, Homo sapiens
gaaauucugaguucugaug

SEQ ID NO: 884954 - RNA, 19 nt, Homo sapiens
ggaugggccugcagaaaca

SEQ ID NO: 884955 - RNA, 19 nt, Homo sapiens
gcaggaaucacccauuaug

SEQ ID NO: 884956 - RNA, 19 nt, Homo sapiens
gaagaaagacgaaaagaug

SEQ ID NO: 884957 - RNA, 19 nt, Homo sapiens
gguguucacuugaguuuua

SEQ ID NO: 884958 - RNA, 19 nt, Homo sapiens
ugacuggugucucguguga

SEQ ID NO: 884959 - RNA, 19 nt, Homo sapiens
uggagaaauuccucuuuaa

SEQ ID NO: 884960 - RNA, 19 nt, Homo sapiens
uggccaaggugguaucuaa

SEQ ID NO: 884961 - RNA, 19 nt, Homo sapiens
gggagaacagucauuguaa

SEQ ID NO: 884962 - RNA, 19 nt, Homo sapiens
gaauugaugagaaauggaa

SEQ ID NO: 884963 - RNA, 19 nt, Homo sapiens
ucaaggccauuucaucaga

SEQ ID NO: 884964 - RNA, 19 nt, Homo sapiens
cagaagaaguuuggcaaug

SEQ ID NO: 884965 - RNA, 19 nt, Homo sapiens
ccaaggugguaucuaaaga

SEQ ID NO: 884966 - RNA, 19 nt, Homo sapiens
ccgaauguguauaaacaaa

SEQ ID NO: 884967 - RNA, 19 nt, Homo sapiens
gaaaauaguugcguguaug

SEQ ID NO: 884968 - RNA, 19 nt, Homo sapiens
gaagaugagaacucccuaa

SEQ ID NO: 884969 - RNA, 19 nt, Homo sapiens
ugugacagauugcuucauu

SEQ ID NO: 884970 - RNA, 19 nt, Homo sapiens
gcaaggaccaaguguggaa

SEQ ID NO: 884971 - RNA, 19 nt, Homo sapiens
gcaaguuccuccauaagcu

SEQ ID NO: 884972 - RNA, 19 nt, Homo sapiens
uaaugaagguggacaagag

SEQ ID NO: 884973 - RNA, 19 nt, Homo sapiens
caccaaaggaggaagauuu

SEQ ID NO: 884974 - RNA, 19 nt, Homo sapiens
auacagaguuaaaguggaa

SEQ ID NO: 884975 - RNA, 19 nt, Homo sapiens
ggaguguuccuuugcauug

SEQ ID NO: 884976 - RNA, 19 nt, Homo sapiens
cagaugaggcccagaagaa

SEQ ID NO: 884977 - RNA, 19 nt, Homo sapiens
agucaucugucucuuugua

SEQ ID NO: 884978 - RNA, 19 nt, Homo sapiens
cagauugcuucauuuaugu

SEQ ID NO: 884979 - RNA, 19 nt, Homo sapiens
gaugaacauuaguggcaaa

SEQ ID NO: 884980 - RNA, 19 nt, Homo sapiens
caagggaauuaauguuauc

SEQ ID NO: 884981 - RNA, 19 nt, Homo sapiens
agaagaaguuuggcaaugu

SEQ ID NO: 884982 - RNA, 19 nt, Homo sapiens
gaaaccacuuuggaaaaua

SEQ ID NO: 884983 - RNA, 19 nt, Homo sapiens
cacacacacuuccuucaaa

SEQ ID NO: 884984 - RNA, 19 nt, Homo sapiens
gagaggcugucggcaaguu

SEQ ID NO: 884985 - RNA, 19 nt, Homo sapiens
uaccgaauguguauaaaca

SEQ ID NO: 884986 - RNA, 19 nt, Homo sapiens
ugugaaagguguugcuguu

SEQ ID NO: 884987 - RNA, 19 nt, Homo sapiens
ggaaaacucuccgucuuug

SEQ ID NO: 884988 - RNA, 19 nt, Homo sapiens
gaaccaucuucuuuaacau

SEQ ID NO: 884989 - RNA, 19 nt, Homo sapiens
caggacaucuugaccaucu

SEQ ID NO: 884990 - RNA, 19 nt, Homo sapiens
aauguuaucuugugaaagg

SEQ ID NO: 884991 - RNA, 19 nt, Homo sapiens
gaaccaggaggcuucaugu

SEQ ID NO: 884992 - RNA, 19 nt, Homo sapiens
acagugacgauucauauuu

SEQ ID NO: 884993 - RNA, 19 nt, Homo sapiens
uugcagaaguguuauuuca

SEQ ID NO: 884994 - RNA, 19 nt, Homo sapiens
ucauuacgauuagccuaua

SEQ ID NO: 884995 - RNA, 19 nt, Homo sapiens
acugaucuguggcuugaua

SEQ ID NO: 884996 - RNA, 19 nt, Homo sapiens
agaaauuaccgaaugugua

SEQ ID NO: 884997 - RNA, 19 nt, Homo sapiens
ugacagugacgauucauau

SEQ ID NO: 884998 - RNA, 19 nt, Homo sapiens
ggaaaccacuuuggaaaau

SEQ ID NO: 884999 - RNA, 19 nt, Homo sapiens
aaaguggaaugagguaaga

SEQ ID NO: 885000 - RNA, 19 nt, Homo sapiens
gugacagauugcuucauuu

SEQ ID NO: 885001 - RNA, 19 nt, Homo sapiens
gaccauagagcaggaauca

SEQ ID NO: 885002 - RNA, 19 nt, Homo sapiens
gaaacgcuagugcaucuuc

SEQ ID NO: 885003 - RNA, 19 nt, Homo sapiens
ucaucugucucuuuguaaa

SEQ ID NO: 885004 - RNA, 19 nt, Homo sapiens
gaacaaguaaccacaucuc

SEQ ID NO: 885005 - RNA, 19 nt, Homo sapiens
auacugaagucaugaugug

SEQ ID NO: 885006 - RNA, 19 nt, Homo sapiens
caaggugguaucuaaagaa

SEQ ID NO: 885007 - RNA, 19 nt, Homo sapiens
caaacacaugcuuuaauga

SEQ ID NO: 885008 - RNA, 19 nt, Homo sapiens
ugaagucaucugucucuuu

SEQ ID NO: 885009 - RNA, 19 nt, Homo sapiens
aagcucggcugaucuguuc

SEQ ID NO: 885010 - RNA, 19 nt, Homo sapiens
uagcugggaugacaguuca

SEQ ID NO: 885011 - RNA, 19 nt, Homo sapiens
ccacaaacuaccacaaaua

SEQ ID NO: 885012 - RNA, 19 nt, Homo sapiens
ggaagaaacgcaagcagaa

SEQ ID NO: 885013 - RNA, 19 nt, Homo sapiens
gagcacauaccacaaacua

SEQ ID NO: 885014 - RNA, 19 nt, Homo sapiens
gccagaagcugcccaugga

SEQ ID NO: 885015 - RNA, 19 nt, Homo sapiens
cacaaacuaccacaaauaa

SEQ ID NO: 885016 - RNA, 19 nt, Homo sapiens
gggcugacaugaugaccaa

SEQ ID NO: 885017 - RNA, 19 nt, Homo sapiens
ggacagggcagguggagau

SEQ ID NO: 885018 - RNA, 19 nt, Homo sapiens
gaaggucauugagaaguuc

SEQ ID NO: 885019 - RNA, 19 nt, Homo sapiens
ugaaggucauugagaaguu

SEQ ID NO: 885020 - RNA, 19 nt, Homo sapiens
acaccaaugugagggauaa

SEQ ID NO: 885021 - RNA, 19 nt, Homo sapiens
ggcgggagaucaucgaugu

SEQ ID NO: 885022 - RNA, 19 nt, Homo sapiens
ucacuggcccuguggauga

SEQ ID NO: 885023 - RNA, 19 nt, Homo sapiens
ggaggaggagaaugagaaa

SEQ ID NO: 885024 - RNA, 19 nt, Homo sapiens
ggagcagacaccaauguga

SEQ ID NO: 885025 - RNA, 19 nt, Homo sapiens
ucaucgagcugcggaagaa

SEQ ID NO: 885026 - RNA, 19 nt, Homo sapiens
acauggaaauccuggagaa

SEQ ID NO: 885027 - RNA, 19 nt, Homo sapiens
cacaggaggaggagaauga

SEQ ID NO: 885028 - RNA, 19 nt, Homo sapiens
gaaaucaaugccagagaca

SEQ ID NO: 885029 - RNA, 19 nt, Homo sapiens
cagggcagguggagauugu

SEQ ID NO: 885030 - RNA, 19 nt, Homo sapiens
caggagcacauaccacaaa

SEQ ID NO: 885031 - RNA, 19 nt, Homo sapiens
gggauacugcccugcauga

SEQ ID NO: 885032 - RNA, 19 nt, Homo sapiens
gaagaaacgcaagcagaag

SEQ ID NO: 885033 - RNA, 19 nt, Homo sapiens
ggaggagaaugagaaacuc

SEQ ID NO: 885034 - RNA, 19 nt, Homo sapiens
gccggaggguccuaagaau

SEQ ID NO: 885035 - RNA, 19 nt, Homo sapiens
uaccacaaacuaccacaaa

SEQ ID NO: 885036 - RNA, 19 nt, Homo sapiens
gauuguggagcacuuucua

SEQ ID NO: 885037 - RNA, 19 nt, Homo sapiens
ggagauuguggagcacuuu

SEQ ID NO: 885038 - RNA, 19 nt, Homo sapiens
gaagcugcccauggacuug

SEQ ID NO: 885039 - RNA, 19 nt, Homo sapiens
guggugaaacuucugcaaa

SEQ ID NO: 885040 - RNA, 19 nt, Homo sapiens
gaggcucaaccgcuacaaa

SEQ ID NO: 885041 - RNA, 19 nt, Homo sapiens
gaaggugaagggccaagag

SEQ ID NO: 885042 - RNA, 19 nt, Homo sapiens
ccauggagcagacaccaau

SEQ ID NO: 885043 - RNA, 19 nt, Homo sapiens
uggugaaacuucugcaaag

SEQ ID NO: 885044 - RNA, 19 nt, Homo sapiens
aagaaacgcaagcagaaga

SEQ ID NO: 885045 - RNA, 19 nt, Homo sapiens
gcugacaugaugaccaaga

SEQ ID NO: 885046 - RNA, 19 nt, Homo sapiens
cgacacgugcgaccaguuc

SEQ ID NO: 885047 - RNA, 19 nt, Homo sapiens
ccuggaaggccacauggaa

SEQ ID NO: 885048 - RNA, 19 nt, Homo sapiens
cugacaugaugaccaagaa

SEQ ID NO: 885049 - RNA, 19 nt, Homo sapiens
acuuagagguggugaaacu

SEQ ID NO: 885050 - RNA, 19 nt, Homo sapiens
ggaaggccacauggaaauc

SEQ ID NO: 885051 - RNA, 19 nt, Homo sapiens
ggugaaacuucugcaaagc

SEQ ID NO: 885052 - RNA, 19 nt, Homo sapiens
gaggagacacacgccagaa

SEQ ID NO: 885053 - RNA, 19 nt, Homo sapiens
agaaacgcaagcagaagaa

SEQ ID NO: 885054 - RNA, 19 nt, Homo sapiens
caugauccaggagcacaua

SEQ ID NO: 885055 - RNA, 19 nt, Homo sapiens
ggaaauccuggagaagcuu

SEQ ID NO: 885056 - RNA, 19 nt, Homo sapiens
gcacaggaggaggagaaug

SEQ ID NO: 885057 - RNA, 19 nt, Homo sapiens
cggaggguccuaagaaugg

SEQ ID NO: 885058 - RNA, 19 nt, Homo sapiens
gaucacuggcccuguggau

SEQ ID NO: 885059 - RNA, 19 nt, Homo sapiens
ggaggggccuaaugauagu

SEQ ID NO: 885060 - RNA, 19 nt, Homo sapiens
uagagguggugaaacuucu

SEQ ID NO: 885061 - RNA, 19 nt, Homo sapiens
ucaguaaccuucucuauua

SEQ ID NO: 885062 - RNA, 19 nt, Homo sapiens
gcaaauaccugaugaagag

SEQ ID NO: 885063 - RNA, 19 nt, Homo sapiens
gaaagaagauccacaguac

SEQ ID NO: 885064 - RNA, 19 nt, Homo sapiens
gggcacauaucaaauuaua

SEQ ID NO: 885065 - RNA, 19 nt, Homo sapiens
gcacagcuauugacucuau

SEQ ID NO: 885066 - RNA, 19 nt, Homo sapiens
ucacggagauccuuucuaa

SEQ ID NO: 885067 - RNA, 19 nt, Homo sapiens
gaaagaagcaaauugauca

SEQ ID NO: 885068 - RNA, 19 nt, Homo sapiens
gaccuuaccuccacuaaau

SEQ ID NO: 885069 - RNA, 19 nt, Homo sapiens
aauaggaaauggagucuua

SEQ ID NO: 885070 - RNA, 19 nt, Homo sapiens
ggagacagcuuggaagaga

SEQ ID NO: 885071 - RNA, 19 nt, Homo sapiens
gaagagggcauuguuauug

SEQ ID NO: 885072 - RNA, 19 nt, Homo sapiens
ccacaggaaacaacaauua

SEQ ID NO: 885073 - RNA, 19 nt, Homo sapiens
agacugauaucguaaacua

SEQ ID NO: 885074 - RNA, 19 nt, Homo sapiens
aaacacagcuacacaagau

SEQ ID NO: 885075 - RNA, 19 nt, Homo sapiens
aaucaugcaugguguauuu

SEQ ID NO: 885076 - RNA, 19 nt, Homo sapiens
gaagcaaauugaucagaga

SEQ ID NO: 885077 - RNA, 19 nt, Homo sapiens
gaaaacggauagacugaua

SEQ ID NO: 885078 - RNA, 19 nt, Homo sapiens
gcacacacacuuuguauca

SEQ ID NO: 885079 - RNA, 19 nt, Homo sapiens
gaaauccauucacugcaaa

SEQ ID NO: 885080 - RNA, 19 nt, Homo sapiens
gcuaagagaacaaaucuga

SEQ ID NO: 885081 - RNA, 19 nt, Homo sapiens
gaucagagacauuauggaa

SEQ ID NO: 885082 - RNA, 19 nt, Homo sapiens
gcccgaagauccaguagaa

SEQ ID NO: 885083 - RNA, 19 nt, Homo sapiens
ggacugauguguucuaagc

SEQ ID NO: 885084 - RNA, 19 nt, Homo sapiens
gaaaggagaaauccauuca

SEQ ID NO: 885085 - RNA, 19 nt, Homo sapiens
gaaugaaccuuggucuguu

SEQ ID NO: 885086 - RNA, 19 nt, Homo sapiens
gaugaccaguuaaauguau

SEQ ID NO: 885087 - RNA, 19 nt, Homo sapiens
ugaauggacugauguguuc

SEQ ID NO: 885088 - RNA, 19 nt, Homo sapiens
ggucacccauguauuuauu

SEQ ID NO: 885089 - RNA, 19 nt, Homo sapiens
ucagggugaugaccaguua

SEQ ID NO: 885090 - RNA, 19 nt, Homo sapiens
gacaacaaguuauuuccaa

SEQ ID NO: 885091 - RNA, 19 nt, Homo sapiens
gugaggaacuggcaucaga

SEQ ID NO: 885092 - RNA, 19 nt, Homo sapiens
aggaugagguguucuauga

SEQ ID NO: 885093 - RNA, 19 nt, Homo sapiens
gaugaagagggcauuguua

SEQ ID NO: 885094 - RNA, 19 nt, Homo sapiens
gaaacaacaauuacagaga

SEQ ID NO: 885095 - RNA, 19 nt, Homo sapiens
gcucugcgcuuucgcugaa

SEQ ID NO: 885096 - RNA, 19 nt, Homo sapiens
gugaaaagcugguggaaaa

SEQ ID NO: 885097 - RNA, 19 nt, Homo sapiens
gagguuucauggaagauuu

SEQ ID NO: 885098 - RNA, 19 nt, Homo sapiens
uacaggaucugauuaugaa

SEQ ID NO: 885099 - RNA, 19 nt, Homo sapiens
uaagugguguguucaaugu

SEQ ID NO: 885100 - RNA, 19 nt, Homo sapiens
gggacuauaucaaccuauu

SEQ ID NO: 885101 - RNA, 19 nt, Homo sapiens
aguaaagacucgaaacuga

SEQ ID NO: 885102 - RNA, 19 nt, Homo sapiens
ccgaagauccaguagaaua

SEQ ID NO: 885103 - RNA, 19 nt, Homo sapiens
gcauuaaaccagugaaguu

SEQ ID NO: 885104 - RNA, 19 nt, Homo sapiens
aaucagagacucaaagaaa

SEQ ID NO: 885105 - RNA, 19 nt, Homo sapiens
cagaguugauugaggagua

SEQ ID NO: 885106 - RNA, 19 nt, Homo sapiens
gaugagguguucuaugaca

SEQ ID NO: 885107 - RNA, 19 nt, Homo sapiens
gagacucaaagaaagauua

SEQ ID NO: 885108 - RNA, 19 nt, Homo sapiens
uaagcgagcucugaaagga

SEQ ID NO: 885109 - RNA, 19 nt, Homo sapiens
ggaaugaaccuuggucugu

SEQ ID NO: 885110 - RNA, 19 nt, Homo sapiens
gccauaagguggguugauu

SEQ ID NO: 885111 - RNA, 19 nt, Homo sapiens
guucauuccuuaacacaau

SEQ ID NO: 885112 - RNA, 19 nt, Homo sapiens
uaugggagguuucauggaa

SEQ ID NO: 885113 - RNA, 19 nt, Homo sapiens
ccagguuagucaucaguaa

SEQ ID NO: 885114 - RNA, 19 nt, Homo sapiens
gaaauguaaugccugaaaa

SEQ ID NO: 885115 - RNA, 19 nt, Homo sapiens
uaaagcaccacuugagaaa

SEQ ID NO: 885116 - RNA, 19 nt, Homo sapiens
gaagauuugagaaagugua

SEQ ID NO: 885117 - RNA, 19 nt, Homo sapiens
aaaggagacuaaugaacuu

SEQ ID NO: 885118 - RNA, 19 nt, Homo sapiens
ugugagaggugucuggaaa

SEQ ID NO: 885119 - RNA, 19 nt, Homo sapiens
gcaaauugaucagagacau

SEQ ID NO: 885120 - RNA, 19 nt, Homo sapiens
gauacaggaucugauuaug

SEQ ID NO: 885121 - RNA, 19 nt, Homo sapiens
caaaggagacuaaugaacu

SEQ ID NO: 885122 - RNA, 19 nt, Homo sapiens
gucaagauuuccagccuuu

SEQ ID NO: 885123 - RNA, 19 nt, Homo sapiens
agaaauccauucacugcaa

SEQ ID NO: 885124 - RNA, 19 nt, Homo sapiens
gaucacaggccuugcuaga

SEQ ID NO: 885125 - RNA, 19 nt, Homo sapiens
ggaaaucaugcauggugua

SEQ ID NO: 885126 - RNA, 19 nt, Homo sapiens
cuucaacucugcacagcua

SEQ ID NO: 885127 - RNA, 19 nt, Homo sapiens
gcauuguuauugauggauu

SEQ ID NO: 885128 - RNA, 19 nt, Homo sapiens
agaaagaagauccacagua

SEQ ID NO: 885129 - RNA, 19 nt, Homo sapiens
gugggagaauuauuaagaa

SEQ ID NO: 885130 - RNA, 19 nt, Homo sapiens
uaaauuguguaaccuaguc

SEQ ID NO: 885131 - RNA, 19 nt, Homo sapiens
gaaaauugcagaacgauau

SEQ ID NO: 885132 - RNA, 19 nt, Homo sapiens
agaggaggcucgaggaaug

SEQ ID NO: 885133 - RNA, 19 nt, Homo sapiens
acacacacuuuguaucaug

SEQ ID NO: 885134 - RNA, 19 nt, Homo sapiens
gaagagagggaugaagaug

SEQ ID NO: 885135 - RNA, 19 nt, Homo sapiens
ugaugcauuucagcaauua

SEQ ID NO: 885136 - RNA, 19 nt, Homo sapiens
gcuagacccugaucaucug

SEQ ID NO: 885137 - RNA, 19 nt, Homo sapiens
gagcuagucaguacaugaa

SEQ ID NO: 885138 - RNA, 19 nt, Homo sapiens
gauuggagacccacaguug

SEQ ID NO: 885139 - RNA, 19 nt, Homo sapiens
ggaacuggcaucagaaucu

SEQ ID NO: 885140 - RNA, 19 nt, Homo sapiens
ggaaauggagucuuauugc

SEQ ID NO: 885141 - RNA, 19 nt, Homo sapiens
ggaggacagucacggagau

SEQ ID NO: 885142 - RNA, 19 nt, Homo sapiens
gcagauaaggauccauuuc

SEQ ID NO: 885143 - RNA, 19 nt, Homo sapiens
ggugaugcauuucagcaau

SEQ ID NO: 885144 - RNA, 19 nt, Homo sapiens
ccauaagguggguugauua

SEQ ID NO: 885145 - RNA, 19 nt, Homo sapiens
aagagggcauuguuauuga

SEQ ID NO: 885146 - RNA, 19 nt, Homo sapiens
cacaguaccagcagcaaua

SEQ ID NO: 885147 - RNA, 19 nt, Homo sapiens
cuaaaggucaugaggguuu

SEQ ID NO: 885148 - RNA, 19 nt, Homo sapiens
gugaugcauuucagcaauu

SEQ ID NO: 885149 - RNA, 19 nt, Homo sapiens
gaaaucaugcaugguguau

SEQ ID NO: 885150 - RNA, 19 nt, Homo sapiens
caaagaaagauuacugaag

SEQ ID NO: 885151 - RNA, 19 nt, Homo sapiens
uucaauggcugugcagaua

SEQ ID NO: 885152 - RNA, 19 nt, Homo sapiens
ucacccauguauuuauuug

SEQ ID NO: 885153 - RNA, 19 nt, Homo sapiens
guauagcuuucccaagaug

SEQ ID NO: 885154 - RNA, 19 nt, Homo sapiens
gugaugaccaguuaaaugu

SEQ ID NO: 885155 - RNA, 19 nt, Homo sapiens
ggugaugaccaguuaaaug

SEQ ID NO: 885156 - RNA, 19 nt, Homo sapiens
gaccagacgacaauguaaa

SEQ ID NO: 885157 - RNA, 19 nt, Homo sapiens
uaaauggaagacaggauaa

SEQ ID NO: 885158 - RNA, 19 nt, Homo sapiens
acucagagcuagucaguac

SEQ ID NO: 885159 - RNA, 19 nt, Homo sapiens
gucaguaagugguguguuc

SEQ ID NO: 885160 - RNA, 19 nt, Homo sapiens
acacagcuacacaagauaa

SEQ ID NO: 885161 - RNA, 19 nt, Homo sapiens
ucaguaaccuucucuauua

SEQ ID NO: 885162 - RNA, 19 nt, Homo sapiens
gcaaauaccugaugaagag

SEQ ID NO: 885163 - RNA, 19 nt, Homo sapiens
gaaagaagauccacaguac

SEQ ID NO: 885164 - RNA, 19 nt, Homo sapiens
gggcacauaucaaauuaua

SEQ ID NO: 885165 - RNA, 19 nt, Homo sapiens
gcacagcuauugacucuau

SEQ ID NO: 885166 - RNA, 19 nt, Homo sapiens
ucacggagauccuuucuaa

SEQ ID NO: 885167 - RNA, 19 nt, Homo sapiens
gaaagaagcaaauugauca

SEQ ID NO: 885168 - RNA, 19 nt, Homo sapiens
gaccuuaccuccacuaaau

SEQ ID NO: 885169 - RNA, 19 nt, Homo sapiens
aauaggaaauggagucuua

SEQ ID NO: 885170 - RNA, 19 nt, Homo sapiens
gaagagggcauuguuauug

SEQ ID NO: 885171 - RNA, 19 nt, Homo sapiens
ccacaggaaacaacaauua

SEQ ID NO: 885172 - RNA, 19 nt, Homo sapiens
aaacacagcuacacaagau

SEQ ID NO: 885173 - RNA, 19 nt, Homo sapiens
gcacagccaugaacaccaa

SEQ ID NO: 885174 - RNA, 19 nt, Homo sapiens
aaucaugcaugguguauuu

SEQ ID NO: 885175 - RNA, 19 nt, Homo sapiens
gaagcaaauugaucagaga

SEQ ID NO: 885176 - RNA, 19 nt, Homo sapiens
gcacacacacuuuguauca

SEQ ID NO: 885177 - RNA, 19 nt, Homo sapiens
gcuaagagaacaaaucuga

SEQ ID NO: 885178 - RNA, 19 nt, Homo sapiens
gaucagagacauuauggaa

SEQ ID NO: 885179 - RNA, 19 nt, Homo sapiens
gcccgaagauccaguagaa

SEQ ID NO: 885180 - RNA, 19 nt, Homo sapiens
ggacugauguguucuaagc

SEQ ID NO: 885181 - RNA, 19 nt, Homo sapiens
gaugaccaguuaaauguau

SEQ ID NO: 885182 - RNA, 19 nt, Homo sapiens
ugaauggacugauguguuc

SEQ ID NO: 885183 - RNA, 19 nt, Homo sapiens
ggucacccauguauuuauu

SEQ ID NO: 885184 - RNA, 19 nt, Homo sapiens
ucagggugaugaccaguua

SEQ ID NO: 885185 - RNA, 19 nt, Homo sapiens
gacaacaaguuauuuccaa

SEQ ID NO: 885186 - RNA, 19 nt, Homo sapiens
gugaggaacuggcaucaga

SEQ ID NO: 885187 - RNA, 19 nt, Homo sapiens
aggaugagguguucuauga

SEQ ID NO: 885188 - RNA, 19 nt, Homo sapiens
gaugaagagggcauuguua

SEQ ID NO: 885189 - RNA, 19 nt, Homo sapiens
gaaacaacaauuacagaga

SEQ ID NO: 885190 - RNA, 19 nt, Homo sapiens
gugaaaagcugguggaaaa

SEQ ID NO: 885191 - RNA, 19 nt, Homo sapiens
gagguuucauggaagauuu

SEQ ID NO: 885192 - RNA, 19 nt, Homo sapiens
uacaggaucugauuaugaa

SEQ ID NO: 885193 - RNA, 19 nt, Homo sapiens
uaagugguguguucaaugu

SEQ ID NO: 885194 - RNA, 19 nt, Homo sapiens
gggacuauaucaaccuauu

SEQ ID NO: 885195 - RNA, 19 nt, Homo sapiens
ccgaagauccaguagaaua

SEQ ID NO: 885196 - RNA, 19 nt, Homo sapiens
gcauuaaaccagugaaguu

SEQ ID NO: 885197 - RNA, 19 nt, Homo sapiens
aaucagagacucaaagaaa

SEQ ID NO: 885198 - RNA, 19 nt, Homo sapiens
cagaguugauugaggagua

SEQ ID NO: 885199 - RNA, 19 nt, Homo sapiens
gaugagguguucuaugaca

SEQ ID NO: 885200 - RNA, 19 nt, Homo sapiens
gagacucaaagaaagauua

SEQ ID NO: 885201 - RNA, 19 nt, Homo sapiens
gccauaagguggguugauu

SEQ ID NO: 885202 - RNA, 19 nt, Homo sapiens
guucauuccuuaacacaau

SEQ ID NO: 885203 - RNA, 19 nt, Homo sapiens
uaugggagguuucauggaa

SEQ ID NO: 885204 - RNA, 19 nt, Homo sapiens
ccagguuagucaucaguaa

SEQ ID NO: 885205 - RNA, 19 nt, Homo sapiens
gaaauguaaugccugaaaa

SEQ ID NO: 885206 - RNA, 19 nt, Homo sapiens
gaagauuugagaaagugua

SEQ ID NO: 885207 - RNA, 19 nt, Homo sapiens
aaaggagacuaaugaacuu

SEQ ID NO: 885208 - RNA, 19 nt, Homo sapiens
ugugagaggugucuggaaa

SEQ ID NO: 885209 - RNA, 19 nt, Homo sapiens
gcaaauugaucagagacau

SEQ ID NO: 885210 - RNA, 19 nt, Homo sapiens
gauacaggaucugauuaug

SEQ ID NO: 885211 - RNA, 19 nt, Homo sapiens
caaaggagacuaaugaacu

SEQ ID NO: 885212 - RNA, 19 nt, Homo sapiens
gaucacaggccuugcuaga

SEQ ID NO: 885213 - RNA, 19 nt, Homo sapiens
ggaaaucaugcauggugua

SEQ ID NO: 885214 - RNA, 19 nt, Homo sapiens
cuucaacucugcacagcua

SEQ ID NO: 885215 - RNA, 19 nt, Homo sapiens
gcauuguuauugauggauu

SEQ ID NO: 885216 - RNA, 19 nt, Homo sapiens
agaaagaagauccacagua

SEQ ID NO: 885217 - RNA, 19 nt, Homo sapiens
gugggagaauuauuaagaa

SEQ ID NO: 885218 - RNA, 19 nt, Homo sapiens
uaaauuguguaaccuaguc

SEQ ID NO: 885219 - RNA, 19 nt, Homo sapiens
gaaaauugcagaacgauau

SEQ ID NO: 885220 - RNA, 19 nt, Homo sapiens
acacacacuuuguaucaug

SEQ ID NO: 885221 - RNA, 19 nt, Homo sapiens
ugaugcauuucagcaauua

SEQ ID NO: 885222 - RNA, 19 nt, Homo sapiens
gcuagacccugaucaucug

SEQ ID NO: 885223 - RNA, 19 nt, Homo sapiens
gagcuagucaguacaugaa

SEQ ID NO: 885224 - RNA, 19 nt, Homo sapiens
gauuggagacccacaguug

SEQ ID NO: 885225 - RNA, 19 nt, Homo sapiens
ggaacuggcaucagaaucu

SEQ ID NO: 885226 - RNA, 19 nt, Homo sapiens
ggaaauggagucuuauugc

SEQ ID NO: 885227 - RNA, 19 nt, Homo sapiens
ggaggacagucacggagau

SEQ ID NO: 885228 - RNA, 19 nt, Homo sapiens
gcagauaaggauccauuuc

SEQ ID NO: 885229 - RNA, 19 nt, Homo sapiens
ggugaugcauuucagcaau

SEQ ID NO: 885230 - RNA, 19 nt, Homo sapiens
ccauaagguggguugauua

SEQ ID NO: 885231 - RNA, 19 nt, Homo sapiens
aagagggcauuguuauuga

SEQ ID NO: 885232 - RNA, 19 nt, Homo sapiens
cacaguaccagcagcaaua

SEQ ID NO: 885233 - RNA, 19 nt, Homo sapiens
gugaugcauuucagcaauu

SEQ ID NO: 885234 - RNA, 19 nt, Homo sapiens
ccaacgaugccaaggagua

SEQ ID NO: 885235 - RNA, 19 nt, Homo sapiens
gaaaucaugcaugguguau

SEQ ID NO: 885236 - RNA, 19 nt, Homo sapiens
caaagaaagauuacugaag

SEQ ID NO: 885237 - RNA, 19 nt, Homo sapiens
uucaauggcugugcagaua

SEQ ID NO: 885238 - RNA, 19 nt, Homo sapiens
ucacccauguauuuauuug

SEQ ID NO: 885239 - RNA, 19 nt, Homo sapiens
guauagcuuucccaagaug

SEQ ID NO: 885240 - RNA, 19 nt, Homo sapiens
gugaugaccaguuaaaugu

SEQ ID NO: 885241 - RNA, 19 nt, Homo sapiens
ggugaugaccaguuaaaug

SEQ ID NO: 885242 - RNA, 19 nt, Homo sapiens
gaccagacgacaauguaaa

SEQ ID NO: 885243 - RNA, 19 nt, Homo sapiens
uaaauggaagacaggauaa

SEQ ID NO: 885244 - RNA, 19 nt, Homo sapiens
acucagagcuagucaguac

SEQ ID NO: 885245 - RNA, 19 nt, Homo sapiens
gucaguaagugguguguuc

SEQ ID NO: 885246 - RNA, 19 nt, Homo sapiens
acacagcuacacaagauaa

SEQ ID NO: 885247 - RNA, 19 nt, Homo sapiens
auaaauggaagacaggaua

SEQ ID NO: 885248 - RNA, 19 nt, Homo sapiens
uugggcacauaucaaauua

SEQ ID NO: 885249 - RNA, 19 nt, Homo sapiens
ccuagucucuucucuacau

SEQ ID NO: 885250 - RNA, 19 nt, Homo sapiens
uaaccuagucucuucucua

SEQ ID NO: 885251 - RNA, 19 nt, Homo sapiens
uuagaaacuuggaauacug

SEQ ID NO: 885252 - RNA, 19 nt, Homo sapiens
auguauagcuuucccaaga

SEQ ID NO: 885253 - RNA, 19 nt, Homo sapiens
caaauugaucagagacauu

SEQ ID NO: 885254 - RNA, 19 nt, Homo sapiens
aagcauaguuucaguuugc

SEQ ID NO: 885255 - RNA, 19 nt, Homo sapiens
ugaaagaagcaaauugauc

SEQ ID NO: 885256 - RNA, 19 nt, Homo sapiens
ugaagagggcauuguuauu

SEQ ID NO: 885257 - RNA, 19 nt, Homo sapiens
gauaauuacaacuggagaa

SEQ ID NO: 885258 - RNA, 19 nt, Homo sapiens
cauggaagauuugagaaag

SEQ ID NO: 885259 - RNA, 19 nt, Homo sapiens
agaaauguaaugccugaaa

SEQ ID NO: 885260 - RNA, 19 nt, Homo sapiens
caguaaccuucucuauuau

SEQ ID NO: 885261 - RNA, 19 nt, Homo sapiens
gaacauaccucuccagaac

SEQ ID NO: 885262 - RNA, 19 nt, Homo sapiens
gcauguguaugucuguuua

SEQ ID NO: 885263 - RNA, 19 nt, Homo sapiens
ggauugaucugcaugaugu

SEQ ID NO: 885264 - RNA, 19 nt, Homo sapiens
ggaagaagaugauguuuug

SEQ ID NO: 885265 - RNA, 19 nt, Homo sapiens
gauugugucuccuguguuu

SEQ ID NO: 885266 - RNA, 19 nt, Homo sapiens
gggaggagcugucauaaac

SEQ ID NO: 885267 - RNA, 19 nt, Homo sapiens
ggaauggcuucuacuccua

SEQ ID NO: 885268 - RNA, 19 nt, Homo sapiens
ggagagaacguggagcuua

SEQ ID NO: 885269 - RNA, 19 nt, Homo sapiens
aaagaaagcauguguaugu

SEQ ID NO: 885270 - RNA, 19 nt, Homo sapiens
ccacaagccuggauugauc

SEQ ID NO: 885271 - RNA, 19 nt, Homo sapiens
gcacaaaacccaaaugaaa

SEQ ID NO: 885272 - RNA, 19 nt, Homo sapiens
gagcuuccuuuacaucuga

SEQ ID NO: 885273 - RNA, 19 nt, Homo sapiens
gcaaccagcugccucucaa

SEQ ID NO: 885274 - RNA, 19 nt, Homo sapiens
gaagagggcgaaagaugaa

SEQ ID NO: 885275 - RNA, 19 nt, Homo sapiens
ccagaaguauccaggacua

SEQ ID NO: 885276 - RNA, 19 nt, Homo sapiens
gaagcucuguccauuauac

SEQ ID NO: 885277 - RNA, 19 nt, Homo sapiens
ccacagggagcuuccuuua

SEQ ID NO: 885278 - RNA, 19 nt, Homo sapiens
gaugagaagauuaagcuuu

SEQ ID NO: 885279 - RNA, 19 nt, Homo sapiens
cagcucaaauggagaacua

SEQ ID NO: 885280 - RNA, 19 nt, Homo sapiens
ggaucugggucaucaauuc

SEQ ID NO: 885281 - RNA, 19 nt, Homo sapiens
gagagaacguggagcuuag

SEQ ID NO: 885282 - RNA, 19 nt, Homo sapiens
ggagaagcccaccuuagaa

SEQ ID NO: 885283 - RNA, 19 nt, Homo sapiens
cacagaaugucuacuauca

SEQ ID NO: 885284 - RNA, 19 nt, Homo sapiens
uaaaggcaauggaaaccaa

SEQ ID NO: 885285 - RNA, 19 nt, Homo sapiens
gaucugaaagaaaguauga

SEQ ID NO: 885286 - RNA, 19 nt, Homo sapiens
acaaacacauggucuacuu

SEQ ID NO: 885287 - RNA, 19 nt, Homo sapiens
acagggagcuuccuuuaca

SEQ ID NO: 885288 - RNA, 19 nt, Homo sapiens
caaggcagcuaagaauaga

SEQ ID NO: 885289 - RNA, 19 nt, Homo sapiens
gcucacagaaugucuacua

SEQ ID NO: 885290 - RNA, 19 nt, Homo sapiens
gagggaaggucgagauuuu

SEQ ID NO: 885291 - RNA, 19 nt, Homo sapiens
ccuucaaacuggauaagua

SEQ ID NO: 885292 - RNA, 19 nt, Homo sapiens
ggaauugcaggaucugaaa

SEQ ID NO: 885293 - RNA, 19 nt, Homo sapiens
gaaugucuacuaucaccua

SEQ ID NO: 885294 - RNA, 19 nt, Homo sapiens
caacgggccaucaccagua

SEQ ID NO: 885295 - RNA, 19 nt, Homo sapiens
gagaaagaaagcaugugua

SEQ ID NO: 885296 - RNA, 19 nt, Homo sapiens
gcuaagaauagacugcaua

SEQ ID NO: 885297 - RNA, 19 nt, Homo sapiens
gcacgcaagugugggaaau

SEQ ID NO: 885298 - RNA, 19 nt, Homo sapiens
acacuuggaugagaagauu

SEQ ID NO: 885299 - RNA, 19 nt, Homo sapiens
gcucugaggcaacaagaaa

SEQ ID NO: 885300 - RNA, 19 nt, Homo sapiens
cuacuuggccuggaacaua

SEQ ID NO: 885301 - RNA, 19 nt, Homo sapiens
agauuaagcuuuacaacca

SEQ ID NO: 885302 - RNA, 19 nt, Homo sapiens
caaacuggauaaguaugaa

SEQ ID NO: 885303 - RNA, 19 nt, Homo sapiens
ugaaggaaaucaucuuggu

SEQ ID NO: 885304 - RNA, 19 nt, Homo sapiens
guggaaugcucaucuaugg

SEQ ID NO: 885305 - RNA, 19 nt, Homo sapiens
ugaagagggcgaaagauga

SEQ ID NO: 885306 - RNA, 19 nt, Homo sapiens
agaaagaaagcauguguau

SEQ ID NO: 885307 - RNA, 19 nt, Homo sapiens
caaguggaauggcuucuac

SEQ ID NO: 885308 - RNA, 19 nt, Homo sapiens
gaaaccaaggugaaugaga

SEQ ID NO: 885309 - RNA, 19 nt, Homo sapiens
gaaagaaagcauguguaug

SEQ ID NO: 885310 - RNA, 19 nt, Homo sapiens
ggaccgcacugugauugug

SEQ ID NO: 885311 - RNA, 19 nt, Homo sapiens
gaauggcuucuacuccuaa

SEQ ID NO: 885312 - RNA, 19 nt, Homo sapiens
cugcauauauauugggauu

SEQ ID NO: 885313 - RNA, 19 nt, Homo sapiens
aaauggagaacuaaaggua

SEQ ID NO: 885314 - RNA, 19 nt, Homo sapiens
cggagaagcccaccuuaga

SEQ ID NO: 885315 - RNA, 19 nt, Homo sapiens
ucaaucuccuucugguauu

SEQ ID NO: 885316 - RNA, 19 nt, Homo sapiens
ucagugucauucucauauu

SEQ ID NO: 885317 - RNA, 19 nt, Homo sapiens
gugaacagcacacugaaga

SEQ ID NO: 885318 - RNA, 19 nt, Homo sapiens
ggaacauaccucuccagaa

SEQ ID NO: 885319 - RNA, 19 nt, Homo sapiens
ggagggaaggucgagauuu

SEQ ID NO: 885320 - RNA, 19 nt, Homo sapiens
aaggaaaggucuugcucaa

SEQ ID NO: 885321 - RNA, 19 nt, Homo sapiens
uaaagguacacuuggauga

SEQ ID NO: 885322 - RNA, 19 nt, Homo sapiens
uaacacucccagcuucuuu

SEQ ID NO: 885323 - RNA, 19 nt, Homo sapiens
gcaaguggaauggcuucua

SEQ ID NO: 885324 - RNA, 19 nt, Homo sapiens
ccaggaagaagaugauguu

SEQ ID NO: 885325 - RNA, 19 nt, Homo sapiens
augaagcucuguccauuau

SEQ ID NO: 885326 - RNA, 19 nt, Homo sapiens
gcaaggggacuuuacaaaa

SEQ ID NO: 885327 - RNA, 19 nt, Homo sapiens
ccaaggcagcuaagaauag

SEQ ID NO: 885328 - RNA, 19 nt, Homo sapiens
gcucaaauggagaacuaaa

SEQ ID NO: 885329 - RNA, 19 nt, Homo sapiens
gaaacucuucccacacuca

SEQ ID NO: 885330 - RNA, 19 nt, Homo sapiens
gaaauccagcacacuguca

SEQ ID NO: 885331 - RNA, 19 nt, Homo sapiens
ucaaacuggauaaguauga

SEQ ID NO: 885332 - RNA, 19 nt, Homo sapiens
gugauugugucuccugugu

SEQ ID NO: 885333 - RNA, 19 nt, Homo sapiens
caaucuccuucugguauuu

SEQ ID NO: 885334 - RNA, 19 nt, Homo sapiens
ggagcuuccuuuacaucug

SEQ ID NO: 885335 - RNA, 19 nt, Homo sapiens
aguaugaaauuagcucuga

SEQ ID NO: 885336 - RNA, 19 nt, Homo sapiens
gcuccaaggcagcuaagaa

SEQ ID NO: 885337 - RNA, 19 nt, Homo sapiens
aaauguuuauccacucuug

SEQ ID NO: 885338 - RNA, 19 nt, Homo sapiens
caggaggaccgcacuguga

SEQ ID NO: 885339 - RNA, 19 nt, Homo sapiens
agacauauccuucccaacu

SEQ ID NO: 885340 - RNA, 19 nt, Homo sapiens
ugaaugagacaaagaagca

SEQ ID NO: 885341 - RNA, 19 nt, Homo sapiens
gcacaaacacauggucuac

SEQ ID NO: 885342 - RNA, 19 nt, Homo sapiens
aagcuaggcugguucugau

SEQ ID NO: 885343 - RNA, 19 nt, Homo sapiens
gacauauccuucccaacuc

SEQ ID NO: 885344 - RNA, 19 nt, Homo sapiens
aaacccaaaugaaacucuu

SEQ ID NO: 885345 - RNA, 19 nt, Homo sapiens
guauuacugccaugaauuc

SEQ ID NO: 885346 - RNA, 19 nt, Homo sapiens
gaucgggucucuggauggu

SEQ ID NO: 885347 - RNA, 19 nt, Homo sapiens
gacgcccucucgauuguug

SEQ ID NO: 885348 - RNA, 19 nt, Homo sapiens
caaggugaaugagacaaag

SEQ ID NO: 885349 - RNA, 19 nt, Homo sapiens
ccaaggugaaugagacaaa

SEQ ID NO: 885350 - RNA, 19 nt, Homo sapiens
ugcaggaucugaaagaaag

SEQ ID NO: 885351 - RNA, 19 nt, Homo sapiens
ccagcuucuuucucaauga

SEQ ID NO: 885352 - RNA, 19 nt, Homo sapiens
acucccagcuucuuucuca

SEQ ID NO: 885353 - RNA, 19 nt, Homo sapiens
gucuggagaugaagaagga

SEQ ID NO: 885354 - RNA, 19 nt, Homo sapiens
caucgugggcuauggaaga

SEQ ID NO: 885355 - RNA, 19 nt, Homo sapiens
ggaggaccgcacugugauu

SEQ ID NO: 885356 - RNA, 19 nt, Homo sapiens
ggcugguucugauucuuaa

SEQ ID NO: 885357 - RNA, 19 nt, Homo sapiens
caauggaaaccaaggugaa

SEQ ID NO: 885358 - RNA, 19 nt, Homo sapiens
ugagaaagaaagcaugugu

SEQ ID NO: 885359 - RNA, 19 nt, Homo sapiens
ggauggaugagcacaaaca

SEQ ID NO: 885360 - RNA, 19 nt, Homo sapiens
ucucaccgcugccuugaag

SEQ ID NO: 885361 - RNA, 19 nt, Homo sapiens
gaggacggauacaauguuu

SEQ ID NO: 885362 - RNA, 19 nt, Homo sapiens
ccaguccucuccugcaauu

SEQ ID NO: 885363 - RNA, 19 nt, Homo sapiens
gggaguuauucaaaucuug

SEQ ID NO: 885364 - RNA, 19 nt, Homo sapiens
ggacggauacaauguuuac

SEQ ID NO: 885365 - RNA, 19 nt, Homo sapiens
uccgggagcugcuucuuga

SEQ ID NO: 885366 - RNA, 19 nt, Homo sapiens
auucaaaucuugggaguca

SEQ ID NO: 885367 - RNA, 19 nt, Homo sapiens
gccgggaguuauucaaauc

SEQ ID NO: 885368 - RNA, 19 nt, Homo sapiens
aaagucuccugcagcugaa

SEQ ID NO: 885369 - RNA, 19 nt, Homo sapiens
agcgguaccucuacacaga

SEQ ID NO: 885370 - RNA, 19 nt, Homo sapiens
gaagccgggaguuauucaa

SEQ ID NO: 885371 - RNA, 19 nt, Homo sapiens
ugaggacggauacaauguu

SEQ ID NO: 885372 - RNA, 19 nt, Homo sapiens
cgggaguuauucaaaucuu

SEQ ID NO: 885373 - RNA, 19 nt, Homo sapiens
gagucaagacauccagguu

SEQ ID NO: 885374 - RNA, 19 nt, Homo sapiens
gaagcccaccuggagauca

SEQ ID NO: 885375 - RNA, 19 nt, Homo sapiens
cagaagcccaccuggagau

SEQ ID NO: 885376 - RNA, 19 nt, Homo sapiens
cggcagcgguaccucuaca

SEQ ID NO: 885377 - RNA, 19 nt, Homo sapiens
acucaggacuguggguuuc

SEQ ID NO: 885378 - RNA, 19 nt, Homo sapiens
gccuugaagccgggaguua

SEQ ID NO: 885379 - RNA, 19 nt, Homo sapiens
gcagcgguaccucuacaca

SEQ ID NO: 885380 - RNA, 19 nt, Homo sapiens
gaacacagguacagucauu

SEQ ID NO: 885381 - RNA, 19 nt, Homo sapiens
guaaagcacuauauucuug

SEQ ID NO: 885382 - RNA, 19 nt, Homo sapiens
caaaguaaauccugaacaa

SEQ ID NO: 885383 - RNA, 19 nt, Homo sapiens
gcaggagaauccaaaguaa

SEQ ID NO: 885384 - RNA, 19 nt, Homo sapiens
guaugaagcuauuguagaa

SEQ ID NO: 885385 - RNA, 19 nt, Homo sapiens
gaagaggggugcugaauuu

SEQ ID NO: 885386 - RNA, 19 nt, Homo sapiens
caaaugagaauguauguga

SEQ ID NO: 885387 - RNA, 19 nt, Homo sapiens
ggacagaggcaauauacaa

SEQ ID NO: 885388 - RNA, 19 nt, Homo sapiens
gaacuacucugagauuuac

SEQ ID NO: 885389 - RNA, 19 nt, Homo sapiens
gaagaggaaugagccauau

SEQ ID NO: 885390 - RNA, 19 nt, Homo sapiens
ggagaagcgugcugaauag

SEQ ID NO: 885391 - RNA, 19 nt, Homo sapiens
ggccaaagacugauauuaa

SEQ ID NO: 885392 - RNA, 19 nt, Homo sapiens
uaaaucagcccuguuagua

SEQ ID NO: 885393 - RNA, 19 nt, Homo sapiens
gccaaagacugauauuaau

SEQ ID NO: 885394 - RNA, 19 nt, Homo sapiens
gauaaagaggaaugacuua

SEQ ID NO: 885395 - RNA, 19 nt, Homo sapiens
ggaaugagccauauauugg

SEQ ID NO: 885396 - RNA, 19 nt, Homo sapiens
gaacagaugcuauagaacu

SEQ ID NO: 885397 - RNA, 19 nt, Homo sapiens
ucaaauacaguguggguua

SEQ ID NO: 885398 - RNA, 19 nt, Homo sapiens
gcacaggacagaggcaaua

SEQ ID NO: 885399 - RNA, 19 nt, Homo sapiens
gaaguaggugggacaagua

SEQ ID NO: 885400 - RNA, 19 nt, Homo sapiens
gagaauguaugugaaagau

SEQ ID NO: 885401 - RNA, 19 nt, Homo sapiens
gagauuuacugucuucauc

SEQ ID NO: 885402 - RNA, 19 nt, Homo sapiens
gaagcgugcugaauaggau

SEQ ID NO: 885403 - RNA, 19 nt, Homo sapiens
gaaguaugaagcuauugua

SEQ ID NO: 885404 - RNA, 19 nt, Homo sapiens
uagagaaccuaucuuuguu

SEQ ID NO: 885405 - RNA, 19 nt, Homo sapiens
cugaacagaugcuauagaa

SEQ ID NO: 885406 - RNA, 19 nt, Homo sapiens
gaagaucauucccuugcau

SEQ ID NO: 885407 - RNA, 19 nt, Homo sapiens
guaggugggacaaguauaa

SEQ ID NO: 885408 - RNA, 19 nt, Homo sapiens
acagccaucuaacucauua

SEQ ID NO: 885409 - RNA, 19 nt, Homo sapiens
gcacuauauucuuguuugu

SEQ ID NO: 885410 - RNA, 19 nt, Homo sapiens
gagaugagaagaggaauga

SEQ ID NO: 885411 - RNA, 19 nt, Homo sapiens
uaacuuucuuugggucuua

SEQ ID NO: 885412 - RNA, 19 nt, Homo sapiens
ggaaugacuuaauuaugag

SEQ ID NO: 885413 - RNA, 19 nt, Homo sapiens
gaaaugaaagagaaguaug

SEQ ID NO: 885414 - RNA, 19 nt, Homo sapiens
gaccuacagucagauguuu

SEQ ID NO: 885415 - RNA, 19 nt, Homo sapiens
ugaacuacucugagauuua

SEQ ID NO: 885416 - RNA, 19 nt, Homo sapiens
gaacucugacaccacauuu

SEQ ID NO: 885417 - RNA, 19 nt, Homo sapiens
gacauucuguuuauuaguc

SEQ ID NO: 885418 - RNA, 19 nt, Homo sapiens
uguagagccuugggcauua

SEQ ID NO: 885419 - RNA, 19 nt, Homo sapiens
gggcagcaguggacuaagu

SEQ ID NO: 885420 - RNA, 19 nt, Homo sapiens
guugguagccuuauaugaa

SEQ ID NO: 885421 - RNA, 19 nt, Homo sapiens
agagaaguaugaagcuauu

SEQ ID NO: 885422 - RNA, 19 nt, Homo sapiens
uaacagugcuuuggauuuu

SEQ ID NO: 885423 - RNA, 19 nt, Homo sapiens
aaagagaaguaugaagcua

SEQ ID NO: 885424 - RNA, 19 nt, Homo sapiens
gauaaucuugcauugcuuu

SEQ ID NO: 885425 - RNA, 19 nt, Homo sapiens
ccaugaaucuucugcucuu

SEQ ID NO: 885426 - RNA, 19 nt, Homo sapiens
ccaucuaacucauuaccuu

SEQ ID NO: 885427 - RNA, 19 nt, Homo sapiens
gaggaaugacuuaauuaug

SEQ ID NO: 885428 - RNA, 19 nt, Homo sapiens
uugcauugcuuuccucuga

SEQ ID NO: 885429 - RNA, 19 nt, Homo sapiens
gugacacuguucuguauau

SEQ ID NO: 885430 - RNA, 19 nt, Homo sapiens
caagacaguuuagcaugga

SEQ ID NO: 885431 - RNA, 19 nt, Homo sapiens
gccuagaacuggccgaaau

SEQ ID NO: 885432 - RNA, 19 nt, Homo sapiens
uauauucucucccuguugu

SEQ ID NO: 885433 - RNA, 19 nt, Homo sapiens
ccuaaacacagccaucuaa

SEQ ID NO: 885434 - RNA, 19 nt, Homo sapiens
uuagagaaccuaucuuugu

SEQ ID NO: 885435 - RNA, 19 nt, Homo sapiens
gguagacugucguuuuaua

SEQ ID NO: 885436 - RNA, 19 nt, Homo sapiens
guacagucauucuuugaac

SEQ ID NO: 885437 - RNA, 19 nt, Homo sapiens
caucuaacucauuaccuua

SEQ ID NO: 885438 - RNA, 19 nt, Homo sapiens
uaaagcaggagaauccaaa

SEQ ID NO: 885439 - RNA, 19 nt, Homo sapiens
auaggauucuucucaguuu

SEQ ID NO: 885440 - RNA, 19 nt, Homo sapiens
aggagaagcgugcugaaua

SEQ ID NO: 885441 - RNA, 19 nt, Homo sapiens
gagaaccuaucuuuguuuu

SEQ ID NO: 885442 - RNA, 19 nt, Homo sapiens
cauauauucucucccuguu

SEQ ID NO: 885443 - RNA, 19 nt, Homo sapiens
gugaacuacucugagauuu

SEQ ID NO: 885444 - RNA, 19 nt, Homo sapiens
ugaaguaggugggacaagu

SEQ ID NO: 885445 - RNA, 19 nt, Homo sapiens
agaacuggccgaaaugaaa

SEQ ID NO: 885446 - RNA, 19 nt, Homo sapiens
gcuauuccuuggugcaguu

SEQ ID NO: 885447 - RNA, 19 nt, Homo sapiens
ugauggcacugguuguauu

SEQ ID NO: 885448 - RNA, 19 nt, Homo sapiens
caaauacaguguggguuag

SEQ ID NO: 885449 - RNA, 19 nt, Homo sapiens
gcuggugccucuucuaguc

SEQ ID NO: 885450 - RNA, 19 nt, Homo sapiens
gguaaagcacuauauucuu

SEQ ID NO: 885451 - RNA, 19 nt, Homo sapiens
cacacaagcugagaugaga

SEQ ID NO: 885452 - RNA, 19 nt, Homo sapiens
ugaaucuucugcucuuguu

SEQ ID NO: 885453 - RNA, 19 nt, Homo sapiens
gaacuggccgaaaugaaag

SEQ ID NO: 885454 - RNA, 19 nt, Homo sapiens
ggucaaaugagaauguaug

SEQ ID NO: 885455 - RNA, 19 nt, Homo sapiens
gaggaaugagccauauauu

SEQ ID NO: 885456 - RNA, 19 nt, Homo sapiens
cagguacagucauucuuug

SEQ ID NO: 885457 - RNA, 19 nt, Homo sapiens
gaccuguggcagaccauua

SEQ ID NO: 885458 - RNA, 19 nt, Homo sapiens
caaagcuugcucaguauga

SEQ ID NO: 885459 - RNA, 19 nt, Homo sapiens
gaaagagaaguaugaagcu

SEQ ID NO: 885460 - RNA, 19 nt, Homo sapiens
uguaaaugguaaagcacua

SEQ ID NO: 885461 - RNA, 19 nt, Homo sapiens
uuacugucuucaucuguuu

SEQ ID NO: 885462 - RNA, 19 nt, Homo sapiens
guagagccuugggcauuau

SEQ ID NO: 885463 - RNA, 19 nt, Homo sapiens
gauggcacugguuguauuu

SEQ ID NO: 885464 - RNA, 19 nt, Homo sapiens
aaacacagccaucuaacuc

SEQ ID NO: 885465 - RNA, 19 nt, Homo sapiens
uuuaaagcaucacuuagga

SEQ ID NO: 885466 - RNA, 19 nt, Homo sapiens
gaucauucccuugcauaga

SEQ ID NO: 885467 - RNA, 19 nt, Homo sapiens
acucugagauuuacugucu

SEQ ID NO: 885468 - RNA, 19 nt, Homo sapiens
agaagaggaaugagccaua

SEQ ID NO: 885469 - RNA, 19 nt, Homo sapiens
cuucugcucuuguuugugu

SEQ ID NO: 885470 - RNA, 19 nt, Homo sapiens
gaagcuauuguagaagaaa

SEQ ID NO: 885471 - RNA, 19 nt, Homo sapiens
acagguacagucauucuuu

SEQ ID NO: 885472 - RNA, 19 nt, Homo sapiens
acagucagauguuuuguuu

SEQ ID NO: 885473 - RNA, 19 nt, Homo sapiens
gcugagaugagaagaggaa

SEQ ID NO: 885474 - RNA, 19 nt, Homo sapiens
ugccuuauuugcuuacuga

SEQ ID NO: 885475 - RNA, 19 nt, Homo sapiens
uaauagcaguuacccugau

SEQ ID NO: 885476 - RNA, 19 nt, Homo sapiens
guggcagaccauuauaaua

SEQ ID NO: 885477 - RNA, 19 nt, Homo sapiens
uggccgaaaugaaagagaa

SEQ ID NO: 885478 - RNA, 19 nt, Homo sapiens
cuaacagugcuuuggauuu

SEQ ID NO: 885479 - RNA, 19 nt, Homo sapiens
gauuuacugucuucaucug

SEQ ID NO: 885480 - RNA, 19 nt, Homo sapiens
gagagaaacuggaaggaaa

SEQ ID NO: 885481 - RNA, 19 nt, Homo sapiens
gagcauaauuuggcaauaa

SEQ ID NO: 885482 - RNA, 19 nt, Homo sapiens
gaacaaagaugggcaacug

SEQ ID NO: 885483 - RNA, 19 nt, Homo sapiens
ccauugagcuccauaaaga

SEQ ID NO: 885484 - RNA, 19 nt, Homo sapiens
ccacucagcuucauuaaca

SEQ ID NO: 885485 - RNA, 19 nt, Homo sapiens
gaaagacaaucagaaacuu

SEQ ID NO: 885486 - RNA, 19 nt, Homo sapiens
gacagaaacuggcaagaug

SEQ ID NO: 885487 - RNA, 19 nt, Homo sapiens
ugacaggucuagagaauuc

SEQ ID NO: 885488 - RNA, 19 nt, Homo sapiens
caggagagguguauguuug

SEQ ID NO: 885489 - RNA, 19 nt, Homo sapiens
aagagaagguuguuuguau

SEQ ID NO: 885490 - RNA, 19 nt, Homo sapiens
uaaggaagaugugcuguug

SEQ ID NO: 885491 - RNA, 19 nt, Homo sapiens
agaaagccauggacaaaga

SEQ ID NO: 885492 - RNA, 19 nt, Homo sapiens
gcaacugaaugacuucugu

SEQ ID NO: 885493 - RNA, 19 nt, Homo sapiens
gaaggaaagacaaucagaa

SEQ ID NO: 885494 - RNA, 19 nt, Homo sapiens
uaugaaggcuggaaacuag

SEQ ID NO: 885495 - RNA, 19 nt, Homo sapiens
ggacugguuuggcaucaug

SEQ ID NO: 885496 - RNA, 19 nt, Homo sapiens
ucagaaacuucaacccaaa

SEQ ID NO: 885497 - RNA, 19 nt, Homo sapiens
gcagacucuuccauuguuu

SEQ ID NO: 885498 - RNA, 19 nt, Homo sapiens
acacagaggauaucccaua

SEQ ID NO: 885499 - RNA, 19 nt, Homo sapiens
ggacugugauagagaaucu

SEQ ID NO: 885500 - RNA, 19 nt, Homo sapiens
uaaugaggcugcuuuccuu

SEQ ID NO: 885501 - RNA, 19 nt, Homo sapiens
ggaaagacaaucagaaacu

SEQ ID NO: 885502 - RNA, 19 nt, Homo sapiens
gaaaauagaagcacauugu

SEQ ID NO: 885503 - RNA, 19 nt, Homo sapiens
ggcagacucuuccauuguu

SEQ ID NO: 885504 - RNA, 19 nt, Homo sapiens
gagaagguuguuuguauug

SEQ ID NO: 885505 - RNA, 19 nt, Homo sapiens
caaguucuaucauguggau

SEQ ID NO: 885506 - RNA, 19 nt, Homo sapiens
agagaagguuguuuguauu

SEQ ID NO: 885507 - RNA, 19 nt, Homo sapiens
ggagaccucuuuguuugug

SEQ ID NO: 885508 - RNA, 19 nt, Homo sapiens
gcaggagagguguauguuu

SEQ ID NO: 885509 - RNA, 19 nt, Homo sapiens
ucauggaccucgaagaugu

SEQ ID NO: 885510 - RNA, 19 nt, Homo sapiens
ggaaggaaagacaaucaga

SEQ ID NO: 885511 - RNA, 19 nt, Homo sapiens
caacaagcaugggcaacug

SEQ ID NO: 885512 - RNA, 19 nt, Homo sapiens
ucagaaagccauggacaaa

SEQ ID NO: 885513 - RNA, 19 nt, Homo sapiens
gaaacuggaaggaaagaca

SEQ ID NO: 885514 - RNA, 19 nt, Homo sapiens
gagcaacugaggucucuug

SEQ ID NO: 885515 - RNA, 19 nt, Homo sapiens
agaccacucagcuucauua

SEQ ID NO: 885516 - RNA, 19 nt, Homo sapiens
aaagcaauguguguucuug

SEQ ID NO: 885517 - RNA, 19 nt, Homo sapiens
cugaaugacuucuguaaac

SEQ ID NO: 885518 - RNA, 19 nt, Homo sapiens
aauaauugguggagugugu

SEQ ID NO: 885519 - RNA, 19 nt, Homo sapiens
agagaauucuaaagcaaug

SEQ ID NO: 885520 - RNA, 19 nt, Homo sapiens
acaaagagagaaacuggaa

SEQ ID NO: 885521 - RNA, 19 nt, Homo sapiens
aaagcaagauucauuucuc

SEQ ID NO: 885522 - RNA, 19 nt, Homo sapiens
auaaagagaagguuguuug

SEQ ID NO: 885523 - RNA, 19 nt, Homo sapiens
aaggaaagacaaucagaaa

SEQ ID NO: 885524 - RNA, 19 nt, Homo sapiens
gaacagcaugccuucaucu

SEQ ID NO: 885525 - RNA, 19 nt, Homo sapiens
gaagguuguuuguauugcu

SEQ ID NO: 885526 - RNA, 19 nt, Homo sapiens
aaagagaagguuguuugua

SEQ ID NO: 885527 - RNA, 19 nt, Homo sapiens
caacugaaugacuucugua

SEQ ID NO: 885528 - RNA, 19 nt, Homo sapiens
aauagaagcacauuguuuc

SEQ ID NO: 885529 - RNA, 19 nt, Homo sapiens
cgaacagcaugccuucauc

SEQ ID NO: 885530 - RNA, 19 nt, Homo sapiens
gggcagacucuuccauugu

SEQ ID NO: 885531 - RNA, 19 nt, Homo sapiens
caacccaaagccaaucuga

SEQ ID NO: 885532 - RNA, 19 nt, Homo sapiens
uaaagagaagguuguuugu

SEQ ID NO: 885533 - RNA, 19 nt, Homo sapiens
agugacaggucuagagaau

SEQ ID NO: 885534 - RNA, 19 nt, Homo sapiens
uuacgauuaugcucacaga

SEQ ID NO: 885535 - RNA, 19 nt, Homo sapiens
uaauugguggaguguguua

SEQ ID NO: 885536 - RNA, 19 nt, Homo sapiens
aaauagcuaugggcaacuu

SEQ ID NO: 885537 - RNA, 19 nt, Homo sapiens
caaaggaaccaagcagagu

SEQ ID NO: 885538 - RNA, 19 nt, Homo sapiens
cccagcaacugaaugacuu

SEQ ID NO: 885539 - RNA, 19 nt, Homo sapiens
gggccacucugcaguuguc

SEQ ID NO: 885540 - RNA, 19 nt, Homo sapiens
augggcaacuggcuaauga

SEQ ID NO: 885541 - RNA, 19 nt, Homo sapiens
gaaggcuggaaacuagaaa

SEQ ID NO: 885542 - RNA, 19 nt, Homo sapiens
cagaaacuggcaagauguu

SEQ ID NO: 885543 - RNA, 19 nt, Homo sapiens
ccucauggaccucgaagau

SEQ ID NO: 885544 - RNA, 19 nt, Homo sapiens
ggucaaguucuaucaugug

SEQ ID NO: 885545 - RNA, 19 nt, Homo sapiens
cgauuaugcucacagaaaa

SEQ ID NO: 885546 - RNA, 19 nt, Homo sapiens
acgauuaugcucacagaaa

SEQ ID NO: 885547 - RNA, 19 nt, Homo sapiens
gagaaacuggaaggaaaga

SEQ ID NO: 885548 - RNA, 19 nt, Homo sapiens
ugggcagacucuuccauug

SEQ ID NO: 885549 - RNA, 19 nt, Homo sapiens
cacagaaaauggucaaguu

SEQ ID NO: 885550 - RNA, 19 nt, Homo sapiens
agacagaaacuggcaagau

SEQ ID NO: 885551 - RNA, 19 nt, Homo sapiens
gcaacaagcaugggcaacu

SEQ ID NO: 885552 - RNA, 19 nt, Homo sapiens
ggccauugagcuccauaaa

SEQ ID NO: 885553 - RNA, 19 nt, Homo sapiens
caagaccaccgaacagcau

SEQ ID NO: 885554 - RNA, 19 nt, Homo sapiens
gaccacucagcuucauuaa

SEQ ID NO: 885555 - RNA, 19 nt, Homo sapiens
cuaaagcaauguguguucu

SEQ ID NO: 885556 - RNA, 19 nt, Homo sapiens
gaaaauggucaaguucuau

SEQ ID NO: 885557 - RNA, 19 nt, Homo sapiens
agagcauaauuuggcaaua

SEQ ID NO: 885558 - RNA, 19 nt, Homo sapiens
ucagcuucauuaacagaug

SEQ ID NO: 885559 - RNA, 19 nt, Homo sapiens
aaacuggaaggaaagacaa

SEQ ID NO: 885560 - RNA, 19 nt, Homo sapiens
agagagaaacuggaaggaa

SEQ ID NO: 885561 - RNA, 19 nt, Homo sapiens
gcaacugaggucucuugug

SEQ ID NO: 885562 - RNA, 19 nt, Homo sapiens
gcugggauuuuacgauuau

SEQ ID NO: 885563 - RNA, 19 nt, Homo sapiens
cauaaagagaagguuguuu

SEQ ID NO: 885564 - RNA, 19 nt, Homo sapiens
gaaagccauggacaaagag

SEQ ID NO: 885565 - RNA, 19 nt, Homo sapiens
aaagacaaucagaaacuuc

SEQ ID NO: 885566 - RNA, 19 nt, Homo sapiens
ugaaggcuggaaacuagaa

SEQ ID NO: 885567 - RNA, 19 nt, Homo sapiens
uuaugaaggcuggaaacua

SEQ ID NO: 885568 - RNA, 19 nt, Homo sapiens
uaaagcaauguguguucuu

SEQ ID NO: 885569 - RNA, 19 nt, Homo sapiens
gccuguggcugggauuuua

SEQ ID NO: 885570 - RNA, 19 nt, Homo sapiens
ucgaggacacugaaucuca

SEQ ID NO: 885571 - RNA, 19 nt, Homo sapiens
gcuggaaacuagaaaagca

SEQ ID NO: 885572 - RNA, 19 nt, Homo sapiens
uguaaacccaggaguguca

SEQ ID NO: 885573 - RNA, 19 nt, Homo sapiens
ggaaccaagcagagugaca

SEQ ID NO: 885574 - RNA, 19 nt, Homo sapiens
ccauggacaaagagagaaa

SEQ ID NO: 885575 - RNA, 19 nt, Homo sapiens
caucgaggacacugaaucu

SEQ ID NO: 885576 - RNA, 19 nt, Homo sapiens
cuucaucuccgcauugcuu

SEQ ID NO: 885577 - RNA, 19 nt, Homo sapiens
uggcuaaugaggcugcuuu

SEQ ID NO: 885578 - RNA, 19 nt, Homo sapiens
cgaguggcaucguguucca

SEQ ID NO: 885579 - RNA, 19 nt, Homo sapiens
gccauugagcuccauaaag

SEQ ID NO: 885580 - RNA, 19 nt, Homo sapiens
ggaaauggcugaagaguuu

SEQ ID NO: 885581 - RNA, 19 nt, Homo sapiens
ggaaggaggugguguaaug

SEQ ID NO: 885582 - RNA, 19 nt, Homo sapiens
gaaauaugaugcuguaugu

SEQ ID NO: 885583 - RNA, 19 nt, Homo sapiens
gacgaagacugguauauaa

SEQ ID NO: 885584 - RNA, 19 nt, Homo sapiens
gcauuuaucuucacucuga

SEQ ID NO: 885585 - RNA, 19 nt, Homo sapiens
ggaaagacgagaacuauuu

SEQ ID NO: 885586 - RNA, 19 nt, Homo sapiens
gaaagacgagaacuauuua

SEQ ID NO: 885587 - RNA, 19 nt, Homo sapiens
uauaggagcuggugagauu

SEQ ID NO: 885588 - RNA, 19 nt, Homo sapiens
ggacgaagacugguauaua

SEQ ID NO: 885589 - RNA, 19 nt, Homo sapiens
caagaacccaggauuaaua

SEQ ID NO: 885590 - RNA, 19 nt, Homo sapiens
gcucagaucuccaugacaa

SEQ ID NO: 885591 - RNA, 19 nt, Homo sapiens
gagcaccucugcagcauga

SEQ ID NO: 885592 - RNA, 19 nt, Homo sapiens
caagggaggugaacauugu

SEQ ID NO: 885593 - RNA, 19 nt, Homo sapiens
gaaacacuacagucgauua

SEQ ID NO: 885594 - RNA, 19 nt, Homo sapiens
ggacguaaauauuucaaag

SEQ ID NO: 885595 - RNA, 19 nt, Homo sapiens
gacgagaacuauuuauaug

SEQ ID NO: 885596 - RNA, 19 nt, Homo sapiens
gcucacuucuagcuauuua

SEQ ID NO: 885597 - RNA, 19 nt, Homo sapiens
gcacaauugucaccaagga

SEQ ID NO: 885598 - RNA, 19 nt, Homo sapiens
gagagccaaugucagauaa

SEQ ID NO: 885599 - RNA, 19 nt, Homo sapiens
agacauguauccauaagaa

SEQ ID NO: 885600 - RNA, 19 nt, Homo sapiens
gaaaggaaagaaaggauga

SEQ ID NO: 885601 - RNA, 19 nt, Homo sapiens
caguuuagcuagucaauau

SEQ ID NO: 885602 - RNA, 19 nt, Homo sapiens
caaauuugcccuugauuga

SEQ ID NO: 885603 - RNA, 19 nt, Homo sapiens
uguaagauguucagcagua

SEQ ID NO: 885604 - RNA, 19 nt, Homo sapiens
cgaaguauguccuauaugg

SEQ ID NO: 885605 - RNA, 19 nt, Homo sapiens
gagagggacucacuuaugg

SEQ ID NO: 885606 - RNA, 19 nt, Homo sapiens
caacuaugguagcacagua

SEQ ID NO: 885607 - RNA, 19 nt, Homo sapiens
gaagacauguauccauaag

SEQ ID NO: 885608 - RNA, 19 nt, Homo sapiens
ggaagcacaggaauaagua

SEQ ID NO: 885609 - RNA, 19 nt, Homo sapiens
gaucccaggugaacgguuu

SEQ ID NO: 885610 - RNA, 19 nt, Homo sapiens
gaugagagccaaugucaga

SEQ ID NO: 885611 - RNA, 19 nt, Homo sapiens
gacaagaacccaggauuaa

SEQ ID NO: 885612 - RNA, 19 nt, Homo sapiens
gccgagcuaugagauauua

SEQ ID NO: 885613 - RNA, 19 nt, Homo sapiens
ugaauguucucaucccuuu

SEQ ID NO: 885614 - RNA, 19 nt, Homo sapiens
gaacuacaauagaagacau

SEQ ID NO: 885615 - RNA, 19 nt, Homo sapiens
gaugcauccuccucacaua

SEQ ID NO: 885616 - RNA, 19 nt, Homo sapiens
agacaagaacccaggauua

SEQ ID NO: 885617 - RNA, 19 nt, Homo sapiens
agagucaccugauaugaaa

SEQ ID NO: 885618 - RNA, 19 nt, Homo sapiens
uggauuaucuguuuacugu

SEQ ID NO: 885619 - RNA, 19 nt, Homo sapiens
caaccucaaccuaucuuua

SEQ ID NO: 885620 - RNA, 19 nt, Homo sapiens
gagagaaaaugaaaacuga

SEQ ID NO: 885621 - RNA, 19 nt, Homo sapiens
gccaaugucagauaaagua

SEQ ID NO: 885622 - RNA, 19 nt, Homo sapiens
gggacaauaaguugaaaua

SEQ ID NO: 885623 - RNA, 19 nt, Homo sapiens
gcuaugagauauuacuaca

SEQ ID NO: 885624 - RNA, 19 nt, Homo sapiens
ggagugcucuucaucaacu

SEQ ID NO: 885625 - RNA, 19 nt, Homo sapiens
gaugguuggugaaauacuu

SEQ ID NO: 885626 - RNA, 19 nt, Homo sapiens
gacaauaaguugaaauagc

SEQ ID NO: 885627 - RNA, 19 nt, Homo sapiens
ugugaaauaugaugcugua

SEQ ID NO: 885628 - RNA, 19 nt, Homo sapiens
gcccgaggauggagagaaa

SEQ ID NO: 885629 - RNA, 19 nt, Homo sapiens
augaagacauguauccaua

SEQ ID NO: 885630 - RNA, 19 nt, Homo sapiens
ggauuugaauguucucauc

SEQ ID NO: 885631 - RNA, 19 nt, Homo sapiens
ggauggugguuuauucuca

SEQ ID NO: 885632 - RNA, 19 nt, Homo sapiens
uauaaucucugcauaacca

SEQ ID NO: 885633 - RNA, 19 nt, Homo sapiens
guuaaaagcuucuucuuca

SEQ ID NO: 885634 - RNA, 19 nt, Homo sapiens
aaacucagcucaggcacaa

SEQ ID NO: 885635 - RNA, 19 nt, Homo sapiens
gcacaggaauaaguagaca

SEQ ID NO: 885636 - RNA, 19 nt, Homo sapiens
gaucaugauucuggaagga

SEQ ID NO: 885637 - RNA, 19 nt, Homo sapiens
agccacagcuauuggauuu

SEQ ID NO: 885638 - RNA, 19 nt, Homo sapiens
uuggaugguuggugaaaua

SEQ ID NO: 885639 - RNA, 19 nt, Homo sapiens
ccuggagacuuaccauuga

SEQ ID NO: 885640 - RNA, 19 nt, Homo sapiens
gauuaucuguuuacugucu

SEQ ID NO: 885641 - RNA, 19 nt, Homo sapiens
gcuauaaucucugcauaac

SEQ ID NO: 885642 - RNA, 19 nt, Homo sapiens
ccucuauugugaauucuuu

SEQ ID NO: 885643 - RNA, 19 nt, Homo sapiens
aaacacacaccaaauaauc

SEQ ID NO: 885644 - RNA, 19 nt, Homo sapiens
gaacugaucccaggugaac

SEQ ID NO: 885645 - RNA, 19 nt, Homo sapiens
gaaggaaacaccaagaaaa

SEQ ID NO: 885646 - RNA, 19 nt, Homo sapiens
ucacuggaauuacaaagca

SEQ ID NO: 885647 - RNA, 19 nt, Homo sapiens
gaagacauuuucacuggaa

SEQ ID NO: 885648 - RNA, 19 nt, Homo sapiens
ugaggauggugguuuauuc

SEQ ID NO: 885649 - RNA, 19 nt, Homo sapiens
gaagaagaaacacuacagu

SEQ ID NO: 885650 - RNA, 19 nt, Homo sapiens
ggacucacuuaugggaauu

SEQ ID NO: 885651 - RNA, 19 nt, Homo sapiens
aaacugagccuuccaucau

SEQ ID NO: 885652 - RNA, 19 nt, Homo sapiens
gagccaaugucagauaaag

SEQ ID NO: 885653 - RNA, 19 nt, Homo sapiens
auaugaggauggugguuua

SEQ ID NO: 885654 - RNA, 19 nt, Homo sapiens
ccaaaacacacaccaaaua

SEQ ID NO: 885655 - RNA, 19 nt, Homo sapiens
gcucuuguaucccuauagu

SEQ ID NO: 885656 - RNA, 19 nt, Homo sapiens
aagaguaacaggauuugua

SEQ ID NO: 885657 - RNA, 19 nt, Homo sapiens
cagccgagcuaugagauau

SEQ ID NO: 885658 - RNA, 19 nt, Homo sapiens
gaacuccuggacguaaaua

SEQ ID NO: 885659 - RNA, 19 nt, Homo sapiens
gaaggaggugguguaauga

SEQ ID NO: 885660 - RNA, 19 nt, Homo sapiens
gggacucacuuaugggaau

SEQ ID NO: 885661 - RNA, 19 nt, Homo sapiens
gcaugaguuugcaggaguu

SEQ ID NO: 885662 - RNA, 19 nt, Homo sapiens
guaagauguucagcaguau

SEQ ID NO: 885663 - RNA, 19 nt, Homo sapiens
gcuuaaaucagcaagaaga

SEQ ID NO: 885664 - RNA, 19 nt, Homo sapiens
caaagaacuccuggacgua

SEQ ID NO: 885665 - RNA, 19 nt, Homo sapiens
ugucaagacugaacaaacu

SEQ ID NO: 885666 - RNA, 19 nt, Homo sapiens
ccaggugaacgguuuauug

SEQ ID NO: 885667 - RNA, 19 nt, Homo sapiens
gcuuuccugugcauuguaa

SEQ ID NO: 885668 - RNA, 19 nt, Homo sapiens
aaacacuacagucgauuaa

SEQ ID NO: 885669 - RNA, 19 nt, Homo sapiens
caaaacacacaccaaauaa

SEQ ID NO: 885670 - RNA, 19 nt, Homo sapiens
gaacccaggauuaauaaaa

SEQ ID NO: 885671 - RNA, 19 nt, Homo sapiens
cgagagggacucacuuaug

SEQ ID NO: 885672 - RNA, 19 nt, Homo sapiens
ugagagccaaugucagaua

SEQ ID NO: 885673 - RNA, 19 nt, Homo sapiens
ugacuuggaaugcuuaaau

SEQ ID NO: 885674 - RNA, 19 nt, Homo sapiens
aaguuuaaccugagccuua

SEQ ID NO: 885675 - RNA, 19 nt, Homo sapiens
gccuugugcuucuugcuaa

SEQ ID NO: 885676 - RNA, 19 nt, Homo sapiens
ugaaauaugaugcuguaug

SEQ ID NO: 885677 - RNA, 19 nt, Homo sapiens
aaacugaagcugccaauac

SEQ ID NO: 885678 - RNA, 19 nt, Homo sapiens
cagagucaccugauaugaa

SEQ ID NO: 885679 - RNA, 19 nt, Homo sapiens
guugcagagucaccugaua

SEQ ID NO: 885680 - RNA, 19 nt, Homo sapiens
ggaaauggcugaagaguuu

SEQ ID NO: 885681 - RNA, 19 nt, Homo sapiens
ggaaggaggugguguaaug

SEQ ID NO: 885682 - RNA, 19 nt, Homo sapiens
gaaauaugaugcuguaugu

SEQ ID NO: 885683 - RNA, 19 nt, Homo sapiens
gacgaagacugguauauaa

SEQ ID NO: 885684 - RNA, 19 nt, Homo sapiens
gcauuuaucuucacucuga

SEQ ID NO: 885685 - RNA, 19 nt, Homo sapiens
ggaaagacgagaacuauuu

SEQ ID NO: 885686 - RNA, 19 nt, Homo sapiens
gaaagacgagaacuauuua

SEQ ID NO: 885687 - RNA, 19 nt, Homo sapiens
uauaggagcuggugagauu

SEQ ID NO: 885688 - RNA, 19 nt, Homo sapiens
ggacgaagacugguauaua

SEQ ID NO: 885689 - RNA, 19 nt, Homo sapiens
caagaacccaggauuaaua

SEQ ID NO: 885690 - RNA, 19 nt, Homo sapiens
gagcaccucugcagcauga

SEQ ID NO: 885691 - RNA, 19 nt, Homo sapiens
caagggaggugaacauugu

SEQ ID NO: 885692 - RNA, 19 nt, Homo sapiens
gaaacacuacagucgauua

SEQ ID NO: 885693 - RNA, 19 nt, Homo sapiens
ggacguaaauauuucaaag

SEQ ID NO: 885694 - RNA, 19 nt, Homo sapiens
gacgagaacuauuuauaug

SEQ ID NO: 885695 - RNA, 19 nt, Homo sapiens
gcucacuucuagcuauuua

SEQ ID NO: 885696 - RNA, 19 nt, Homo sapiens
gcacaauugucaccaagga

SEQ ID NO: 885697 - RNA, 19 nt, Homo sapiens
gagagccaaugucagauaa

SEQ ID NO: 885698 - RNA, 19 nt, Homo sapiens
agacauguauccauaagaa

SEQ ID NO: 885699 - RNA, 19 nt, Homo sapiens
gaaaggaaagaaaggauga

SEQ ID NO: 885700 - RNA, 19 nt, Homo sapiens
caguuuagcuagucaauau

SEQ ID NO: 885701 - RNA, 19 nt, Homo sapiens
caaauuugcccuugauuga

SEQ ID NO: 885702 - RNA, 19 nt, Homo sapiens
uguaagauguucagcagua

SEQ ID NO: 885703 - RNA, 19 nt, Homo sapiens
cgaaguauguccuauaugg

SEQ ID NO: 885704 - RNA, 19 nt, Homo sapiens
gagagggacucacuuaugg

SEQ ID NO: 885705 - RNA, 19 nt, Homo sapiens
caacuaugguagcacagua

SEQ ID NO: 885706 - RNA, 19 nt, Homo sapiens
gaagacauguauccauaag

SEQ ID NO: 885707 - RNA, 19 nt, Homo sapiens
ggaagcacaggaauaagua

SEQ ID NO: 885708 - RNA, 19 nt, Homo sapiens
gaucccaggugaacgguuu

SEQ ID NO: 885709 - RNA, 19 nt, Homo sapiens
gaugagagccaaugucaga

SEQ ID NO: 885710 - RNA, 19 nt, Homo sapiens
gacaagaacccaggauuaa

SEQ ID NO: 885711 - RNA, 19 nt, Homo sapiens
gccgagcuaugagauauua

SEQ ID NO: 885712 - RNA, 19 nt, Homo sapiens
ugaauguucucaucccuuu

SEQ ID NO: 885713 - RNA, 19 nt, Homo sapiens
gaacuacaauagaagacau

SEQ ID NO: 885714 - RNA, 19 nt, Homo sapiens
gaugcauccuccucacaua

SEQ ID NO: 885715 - RNA, 19 nt, Homo sapiens
agacaagaacccaggauua

SEQ ID NO: 885716 - RNA, 19 nt, Homo sapiens
agagucaccugauaugaaa

SEQ ID NO: 885717 - RNA, 19 nt, Homo sapiens
guagcagagucaccugaua

SEQ ID NO: 885718 - RNA, 19 nt, Homo sapiens
uggauuaucuguuuacugu

SEQ ID NO: 885719 - RNA, 19 nt, Homo sapiens
caaccucaaccuaucuuua

SEQ ID NO: 885720 - RNA, 19 nt, Homo sapiens
gagagaaaaugaaaacuga

SEQ ID NO: 885721 - RNA, 19 nt, Homo sapiens
gccaaugucagauaaagua

SEQ ID NO: 885722 - RNA, 19 nt, Homo sapiens
gggacaauaaguugaaaua

SEQ ID NO: 885723 - RNA, 19 nt, Homo sapiens
gcuaugagauauuacuaca

SEQ ID NO: 885724 - RNA, 19 nt, Homo sapiens
ggagugcucuucaucaacu

SEQ ID NO: 885725 - RNA, 19 nt, Homo sapiens
gaugguuggugaaauacuu

SEQ ID NO: 885726 - RNA, 19 nt, Homo sapiens
gacaauaaguugaaauagc

SEQ ID NO: 885727 - RNA, 19 nt, Homo sapiens
ugugaaauaugaugcugua

SEQ ID NO: 885728 - RNA, 19 nt, Homo sapiens
gcccgaggauggagagaaa

SEQ ID NO: 885729 - RNA, 19 nt, Homo sapiens
augaagacauguauccaua

SEQ ID NO: 885730 - RNA, 19 nt, Homo sapiens
ggauuugaauguucucauc

SEQ ID NO: 885731 - RNA, 19 nt, Homo sapiens
ggauggugguuuauucuca

SEQ ID NO: 885732 - RNA, 19 nt, Homo sapiens
uauaaucucugcauaacca

SEQ ID NO: 885733 - RNA, 19 nt, Homo sapiens
guuaaaagcuucuucuuca

SEQ ID NO: 885734 - RNA, 19 nt, Homo sapiens
aaacucagcucaggcacaa

SEQ ID NO: 885735 - RNA, 19 nt, Homo sapiens
gcacaggaauaaguagaca

SEQ ID NO: 885736 - RNA, 19 nt, Homo sapiens
gaucaugauucuggaagga

SEQ ID NO: 885737 - RNA, 19 nt, Homo sapiens
agccacagcuauuggauuu

SEQ ID NO: 885738 - RNA, 19 nt, Homo sapiens
uuggaugguuggugaaaua

SEQ ID NO: 885739 - RNA, 19 nt, Homo sapiens
ccuggagacuuaccauuga

SEQ ID NO: 885740 - RNA, 19 nt, Homo sapiens
gauuaucuguuuacugucu

SEQ ID NO: 885741 - RNA, 19 nt, Homo sapiens
gcuauaaucucugcauaac

SEQ ID NO: 885742 - RNA, 19 nt, Homo sapiens
ccucuauugugaauucuuu

SEQ ID NO: 885743 - RNA, 19 nt, Homo sapiens
aaacacacaccaaauaauc

SEQ ID NO: 885744 - RNA, 19 nt, Homo sapiens
gaacugaucccaggugaac

SEQ ID NO: 885745 - RNA, 19 nt, Homo sapiens
gaaggaaacaccaagaaaa

SEQ ID NO: 885746 - RNA, 19 nt, Homo sapiens
ucacuggaauuacaaagca

SEQ ID NO: 885747 - RNA, 19 nt, Homo sapiens
gaagacauuuucacuggaa

SEQ ID NO: 885748 - RNA, 19 nt, Homo sapiens
ugaggauggugguuuauuc

SEQ ID NO: 885749 - RNA, 19 nt, Homo sapiens
gaagaagaaacacuacagu

SEQ ID NO: 885750 - RNA, 19 nt, Homo sapiens
ggacucacuuaugggaauu

SEQ ID NO: 885751 - RNA, 19 nt, Homo sapiens
aaacugagccuuccaucau

SEQ ID NO: 885752 - RNA, 19 nt, Homo sapiens
gagccaaugucagauaaag

SEQ ID NO: 885753 - RNA, 19 nt, Homo sapiens
auaugaggauggugguuua

SEQ ID NO: 885754 - RNA, 19 nt, Homo sapiens
ccaaaacacacaccaaaua

SEQ ID NO: 885755 - RNA, 19 nt, Homo sapiens
gcucuuguaucccuauagu

SEQ ID NO: 885756 - RNA, 19 nt, Homo sapiens
aagaguaacaggauuugua

SEQ ID NO: 885757 - RNA, 19 nt, Homo sapiens
cagccgagcuaugagauau

SEQ ID NO: 885758 - RNA, 19 nt, Homo sapiens
gaacuccuggacguaaaua

SEQ ID NO: 885759 - RNA, 19 nt, Homo sapiens
gaaggaggugguguaauga

SEQ ID NO: 885760 - RNA, 19 nt, Homo sapiens
gggacucacuuaugggaau

SEQ ID NO: 885761 - RNA, 19 nt, Homo sapiens
gcaugaguuugcaggaguu

SEQ ID NO: 885762 - RNA, 19 nt, Homo sapiens
guaagauguucagcaguau

SEQ ID NO: 885763 - RNA, 19 nt, Homo sapiens
gcuuaaaucagcaagaaga

SEQ ID NO: 885764 - RNA, 19 nt, Homo sapiens
caaagaacuccuggacgua

SEQ ID NO: 885765 - RNA, 19 nt, Homo sapiens
ugucaagacugaacaaacu

SEQ ID NO: 885766 - RNA, 19 nt, Homo sapiens
ccaggugaacgguuuauug

SEQ ID NO: 885767 - RNA, 19 nt, Homo sapiens
gcuuuccugugcauuguaa

SEQ ID NO: 885768 - RNA, 19 nt, Homo sapiens
aaacacuacagucgauuaa

SEQ ID NO: 885769 - RNA, 19 nt, Homo sapiens
caaaacacacaccaaauaa

SEQ ID NO: 885770 - RNA, 19 nt, Homo sapiens
gaacccaggauuaauaaaa

SEQ ID NO: 885771 - RNA, 19 nt, Homo sapiens
cgagagggacucacuuaug

SEQ ID NO: 885772 - RNA, 19 nt, Homo sapiens
ugagagccaaugucagaua

SEQ ID NO: 885773 - RNA, 19 nt, Homo sapiens
ugacuuggaaugcuuaaau

SEQ ID NO: 885774 - RNA, 19 nt, Homo sapiens
aaguuuaaccugagccuua

SEQ ID NO: 885775 - RNA, 19 nt, Homo sapiens
gccuugugcuucuugcuaa

SEQ ID NO: 885776 - RNA, 19 nt, Homo sapiens
ugaaauaugaugcuguaug

SEQ ID NO: 885777 - RNA, 19 nt, Homo sapiens
aaacugaagcugccaauac

SEQ ID NO: 885778 - RNA, 19 nt, Homo sapiens
cagagucaccugauaugaa

SEQ ID NO: 885779 - RNA, 19 nt, Homo sapiens
cgagaacuauuuauaugac

SEQ ID NO: 885780 - RNA, 19 nt, Homo sapiens
ccagagaucuucaacauga

SEQ ID NO: 885781 - RNA, 19 nt, Homo sapiens
gaaguacacucauuucauc

SEQ ID NO: 885782 - RNA, 19 nt, Homo sapiens
ccacugaaccugaccauug

SEQ ID NO: 885783 - RNA, 19 nt, Homo sapiens
gcccagagaucuucaacau

SEQ ID NO: 885784 - RNA, 19 nt, Homo sapiens
gaacccaauucuuacacuu

SEQ ID NO: 885785 - RNA, 19 nt, Homo sapiens
acaugaagcugcacuacaa

SEQ ID NO: 885786 - RNA, 19 nt, Homo sapiens
caaacaagccguccaaggu

SEQ ID NO: 885787 - RNA, 19 nt, Homo sapiens
auaaguaacugcugaacug

SEQ ID NO: 885788 - RNA, 19 nt, Homo sapiens
ggaaguacacucauuucau

SEQ ID NO: 885789 - RNA, 19 nt, Homo sapiens
ggguguaucuugagaacug

SEQ ID NO: 885790 - RNA, 19 nt, Homo sapiens
cucaugaacccaauucuua

SEQ ID NO: 885791 - RNA, 19 nt, Homo sapiens
gguaccgggugcacuacua

SEQ ID NO: 885792 - RNA, 19 nt, Homo sapiens
gcagguggccaggguauau

SEQ ID NO: 885793 - RNA, 19 nt, Homo sapiens
uaugagcgcaggcguguuu

SEQ ID NO: 885794 - RNA, 19 nt, Homo sapiens
ggagucagccgaggaguuc

SEQ ID NO: 885795 - RNA, 19 nt, Homo sapiens
gccaggguauaugaguuua

SEQ ID NO: 885796 - RNA, 19 nt, Homo sapiens
acuacuacaucuucacuga

SEQ ID NO: 885797 - RNA, 19 nt, Homo sapiens
gaaccgucacuucaucuca

SEQ ID NO: 885798 - RNA, 19 nt, Homo sapiens
ggccaggguauaugaguuu

SEQ ID NO: 885799 - RNA, 19 nt, Homo sapiens
uuucuacacuggacaagga

SEQ ID NO: 885800 - RNA, 19 nt, Homo sapiens
ucuccuauguccccuauua

SEQ ID NO: 885801 - RNA, 19 nt, Homo sapiens
gggaaguacacucauuuca

SEQ ID NO: 885802 - RNA, 19 nt, Homo sapiens
ggaggaaagccaccugaac

SEQ ID NO: 885803 - RNA, 19 nt, Homo sapiens
gaccaucagccagcacauu

SEQ ID NO: 885804 - RNA, 19 nt, Homo sapiens
ggguauaugaguuuacuag

SEQ ID NO: 885805 - RNA, 19 nt, Homo sapiens
uacuacaucuucacugaca

SEQ ID NO: 885806 - RNA, 19 nt, Homo sapiens
uaacugcugaacugaguau

SEQ ID NO: 885807 - RNA, 19 nt, Homo sapiens
ucaguguccugugggugua

SEQ ID NO: 885808 - RNA, 19 nt, Homo sapiens
gcacuacuacaucuucacu

SEQ ID NO: 885809 - RNA, 19 nt, Homo sapiens
cacugaaccugaccauugg

SEQ ID NO: 885810 - RNA, 19 nt, Homo sapiens
aaccgucacuucaucucaa

SEQ ID NO: 885811 - RNA, 19 nt, Homo sapiens
gggaggaaagccaccugaa

SEQ ID NO: 885812 - RNA, 19 nt, Homo sapiens
gugcacuacuacaucuuca

SEQ ID NO: 885813 - RNA, 19 nt, Homo sapiens
aguaacugcugaacugagu

SEQ ID NO: 885814 - RNA, 19 nt, Homo sapiens
uaaguaacugcugaacuga

SEQ ID NO: 885815 - RNA, 19 nt, Homo sapiens
guggguaccgggugcacua

SEQ ID NO: 885816 - RNA, 19 nt, Homo sapiens
ccucaugaacccaauucuu

SEQ ID NO: 885817 - RNA, 19 nt, Homo sapiens
ccaccugaaccgucacuuc

SEQ ID NO: 885818 - RNA, 19 nt, Homo sapiens
gccagcaguuccccuauga

SEQ ID NO: 885819 - RNA, 19 nt, Homo sapiens
caacaugaagcugcacuac

SEQ ID NO: 885820 - RNA, 19 nt, Homo sapiens
caggguauaugaguuuacu

SEQ ID NO: 885821 - RNA, 19 nt, Homo sapiens
uggccaggguauaugaguu

SEQ ID NO: 885822 - RNA, 19 nt, Homo sapiens
gcaaagagcccaaacagau

SEQ ID NO: 885823 - RNA, 19 nt, Homo sapiens
caacgaauauggcuacagu

SEQ ID NO: 885824 - RNA, 19 nt, Homo sapiens
cgaaagcugugaccaaagu

SEQ ID NO: 885825 - RNA, 19 nt, Homo sapiens
caagggaaguguggaauuc

SEQ ID NO: 885826 - RNA, 19 nt, Homo sapiens
gcccauggcuggcauccuu

SEQ ID NO: 885827 - RNA, 19 nt, Homo sapiens
gggcaucaauggauuugga

SEQ ID NO: 885828 - RNA, 19 nt, Homo sapiens
ggacaaccaugagaucucu

SEQ ID NO: 885829 - RNA, 19 nt, Homo sapiens
gcacgcaccucgguaacau

SEQ ID NO: 885830 - RNA, 19 nt, Homo sapiens
uauaagaggccaugucgaa

SEQ ID NO: 885831 - RNA, 19 nt, Homo sapiens
gcaccucgguaacaucaca

SEQ ID NO: 885832 - RNA, 19 nt, Homo sapiens
ugguguacauguuuaagua

SEQ ID NO: 885833 - RNA, 19 nt, Homo sapiens
ccaugaacauugugagcaa

SEQ ID NO: 885834 - RNA, 19 nt, Homo sapiens
ugaccacaguccauuccua

SEQ ID NO: 885835 - RNA, 19 nt, Homo sapiens
caaugacaauuucgugaag

SEQ ID NO: 885836 - RNA, 19 nt, Homo sapiens
caugguacgacaacgaaua

SEQ ID NO: 885837 - RNA, 19 nt, Homo sapiens
caaagagcccaaacagauc

SEQ ID NO: 885838 - RNA, 19 nt, Homo sapiens
ucaccaaugucaccguugu

SEQ ID NO: 885839 - RNA, 19 nt, Homo sapiens
caaggaggcuguaaaagca

SEQ ID NO: 885840 - RNA, 19 nt, Homo sapiens
ugcgaaagcugugaccaaa

SEQ ID NO: 885841 - RNA, 19 nt, Homo sapiens
gauacccacucguccaucu

SEQ ID NO: 885842 - RNA, 19 nt, Homo sapiens
gacaacuggucguggacaa

SEQ ID NO: 885843 - RNA, 19 nt, Homo sapiens
ggugguggcugugaaugau

SEQ ID NO: 885844 - RNA, 19 nt, Homo sapiens
gcauggagaaggguguuaa

SEQ ID NO: 885845 - RNA, 19 nt, Homo sapiens
aggaaggccuggcgagaug

SEQ ID NO: 885846 - RNA, 19 nt, Homo sapiens
ucaaugacaauuucgugaa

SEQ ID NO: 885847 - RNA, 19 nt, Homo sapiens
ggucgucucuacggacuuc

SEQ ID NO: 885848 - RNA, 19 nt, Homo sapiens
accaugagaucucugucua

SEQ ID NO: 885849 - RNA, 19 nt, Homo sapiens
gaaguguggaauucaggaa

SEQ ID NO: 885850 - RNA, 19 nt, Homo sapiens
guguacauguuuaaguaug

SEQ ID NO: 885851 - RNA, 19 nt, Homo sapiens
cuccuaagauggugucugu

SEQ ID NO: 885852 - RNA, 19 nt, Homo sapiens
ugucaccguuguccaguug

SEQ ID NO: 885853 - RNA, 19 nt, Homo sapiens
cgacaucguccucaccaau

SEQ ID NO: 885854 - RNA, 19 nt, Homo sapiens
ccgcuacuccuccuccuaa

SEQ ID NO: 885855 - RNA, 19 nt, Homo sapiens
aggaugaggucgucucuac

SEQ ID NO: 885856 - RNA, 19 nt, Homo sapiens
ccaggccaaugauaaccuu

SEQ ID NO: 885857 - RNA, 19 nt, Homo sapiens
gacaucguccucaccaaug

SEQ ID NO: 885858 - RNA, 19 nt, Homo sapiens
gguccauggugaaauaaaa

SEQ ID NO: 885859 - RNA, 19 nt, Homo sapiens
ccagagcccacaccaguca

SEQ ID NO: 885860 - RNA, 19 nt, Homo sapiens
uuaaggugguggcugugaa

SEQ ID NO: 885861 - RNA, 19 nt, Homo sapiens
guucagccgagacaaguga

SEQ ID NO: 885862 - RNA, 19 nt, Homo sapiens
ccagucagggaggaaauaa

SEQ ID NO: 885863 - RNA, 19 nt, Homo sapiens
gaucguggaaggguugaug

SEQ ID NO: 885864 - RNA, 19 nt, Homo sapiens
acaagggaaguguggaauu

SEQ ID NO: 885865 - RNA, 19 nt, Homo sapiens
ucauugacccggaauacau

SEQ ID NO: 885866 - RNA, 19 nt, Homo sapiens
gaccuccuccgcuacaugu

SEQ ID NO: 885867 - RNA, 19 nt, Homo sapiens
cuacuccuccuccuaagau

SEQ ID NO: 885868 - RNA, 19 nt, Homo sapiens
gguacgacaacgaauaugg

SEQ ID NO: 885869 - RNA, 19 nt, Homo sapiens
caucaaggaggcuguaaaa

SEQ ID NO: 885870 - RNA, 19 nt, Homo sapiens
aacccuggcuccaugaaca

SEQ ID NO: 885871 - RNA, 19 nt, Homo sapiens
gugcaaagagcccaaacag

SEQ ID NO: 885872 - RNA, 19 nt, Homo sapiens
gguguacauguuuaaguau

SEQ ID NO: 885873 - RNA, 19 nt, Homo sapiens
guacauguuuaaguaugac

SEQ ID NO: 885874 - RNA, 19 nt, Homo sapiens
ucacaaagcuuaaugguau

SEQ ID NO: 885875 - RNA, 19 nt, Homo sapiens
uaagauaguuuccuccaua

SEQ ID NO: 885876 - RNA, 19 nt, Homo sapiens
acacagggauuucagaauu

SEQ ID NO: 885877 - RNA, 19 nt, Homo sapiens
caaagaugcucauuaacau

SEQ ID NO: 885878 - RNA, 19 nt, Homo sapiens
ucccaaagaugcucauuaa

SEQ ID NO: 885879 - RNA, 19 nt, Homo sapiens
gaugauugcugcccugaau

SEQ ID NO: 885880 - RNA, 19 nt, Homo sapiens
ccaaagaugcucauuaaca

SEQ ID NO: 885881 - RNA, 19 nt, Homo sapiens
ccucucaguugucucuuua

SEQ ID NO: 885882 - RNA, 19 nt, Homo sapiens
caucacaccucucaguugu

SEQ ID NO: 885883 - RNA, 19 nt, Homo sapiens
ccacuacaaucccaaagau

SEQ ID NO: 885884 - RNA, 19 nt, Homo sapiens
ucugacaccuuucuuaaug

SEQ ID NO: 885885 - RNA, 19 nt, Homo sapiens
gcacuacacagucaucaug

SEQ ID NO: 885886 - RNA, 19 nt, Homo sapiens
gagaaugacacagggauuu

SEQ ID NO: 885887 - RNA, 19 nt, Homo sapiens
ccauguaccuggucacugu

SEQ ID NO: 885888 - RNA, 19 nt, Homo sapiens
ggaauaaagacauaaagag

SEQ ID NO: 885889 - RNA, 19 nt, Homo sapiens
gcaacagccucagugaugu

SEQ ID NO: 885890 - RNA, 19 nt, Homo sapiens
cacagggauuucagaauuu

SEQ ID NO: 885891 - RNA, 19 nt, Homo sapiens
gauggccuaugaucgguuu

SEQ ID NO: 885892 - RNA, 19 nt, Homo sapiens
ucugaggaauaaagacaua

SEQ ID NO: 885893 - RNA, 19 nt, Homo sapiens
gagcagagucaucaccuau

SEQ ID NO: 885894 - RNA, 19 nt, Homo sapiens
guucugacaccuuucuuaa

SEQ ID NO: 885895 - RNA, 19 nt, Homo sapiens
gcagagucaucaccuaugc

SEQ ID NO: 885896 - RNA, 19 nt, Homo sapiens
guacgggccuaggugugua

SEQ ID NO: 885897 - RNA, 19 nt, Homo sapiens
ucuacagucugaggaauaa

SEQ ID NO: 885898 - RNA, 19 nt, Homo sapiens
caacagccucagugaugua

SEQ ID NO: 885899 - RNA, 19 nt, Homo sapiens
ucucaguugucucuuuauu

SEQ ID NO: 885900 - RNA, 19 nt, Homo sapiens
gcaucacaccucucaguug

SEQ ID NO: 885901 - RNA, 19 nt, Homo sapiens
uggcugugauggccuauga

SEQ ID NO: 885902 - RNA, 19 nt, Homo sapiens
ucauuaacauccagacaca

SEQ ID NO: 885903 - RNA, 19 nt, Homo sapiens
acacagagcagagucauca

SEQ ID NO: 885904 - RNA, 19 nt, Homo sapiens
ccacaacucacacacaagu

SEQ ID NO: 885905 - RNA, 19 nt, Homo sapiens
caccuugccuguucugaca

SEQ ID NO: 885906 - RNA, 19 nt, Homo sapiens
uugcagcccuuccucuuug

SEQ ID NO: 885907 - RNA, 19 nt, Homo sapiens
ggaaucugcucaucauccu

SEQ ID NO: 885908 - RNA, 19 nt, Homo sapiens
ccucugcacuacacaguca

SEQ ID NO: 885909 - RNA, 19 nt, Homo sapiens
cuccauacgugcaaucuca

SEQ ID NO: 885910 - RNA, 19 nt, Homo sapiens
caugaacccucggcucugu

SEQ ID NO: 885911 - RNA, 19 nt, Homo sapiens
acagggauuucagaauuug

SEQ ID NO: 885912 - RNA, 19 nt, Homo sapiens
ggcuguuucuguccaugua

SEQ ID NO: 885913 - RNA, 19 nt, Homo sapiens
ucacugugcucgggaaucu

SEQ ID NO: 885914 - RNA, 19 nt, Homo sapiens
ugacacagggauuucagaa

SEQ ID NO: 885915 - RNA, 19 nt, Homo sapiens
cacaaagcuuaaugguauu

SEQ ID NO: 885916 - RNA, 19 nt, Homo sapiens
cccuuuaucuacagucuga

SEQ ID NO: 885917 - RNA, 19 nt, Homo sapiens
ucacaccucucaguugucu

SEQ ID NO: 885918 - RNA, 19 nt, Homo sapiens
gaaugacacagggauuuca

SEQ ID NO: 885919 - RNA, 19 nt, Homo sapiens
gucacaaagcuuaauggua

SEQ ID NO: 885920 - RNA, 19 nt, Homo sapiens
uguuucaucuccacuacaa

SEQ ID NO: 885921 - RNA, 19 nt, Homo sapiens
ucauccaccuugccuguuc

SEQ ID NO: 885922 - RNA, 19 nt, Homo sapiens
agagcagagucaucaccua

SEQ ID NO: 885923 - RNA, 19 nt, Homo sapiens
cuucagaggaaagcaauaa

SEQ ID NO: 885924 - RNA, 19 nt, Homo sapiens
acccacaacucacacacaa

SEQ ID NO: 885925 - RNA, 19 nt, Homo sapiens
cugacaccuuucuuaauga

SEQ ID NO: 885926 - RNA, 19 nt, Homo sapiens
ugcaacagccucagugaug

SEQ ID NO: 885927 - RNA, 19 nt, Homo sapiens
gauaguuuccuccauacgu

SEQ ID NO: 885928 - RNA, 19 nt, Homo sapiens
ugccuguucugacaccuuu

SEQ ID NO: 885929 - RNA, 19 nt, Homo sapiens
uauuguggcuguccuucug

SEQ ID NO: 885930 - RNA, 19 nt, Homo sapiens
ucgggaaucugcucaucau

SEQ ID NO: 885931 - RNA, 19 nt, Homo sapiens
gaggaauaaagacauaaag

SEQ ID NO: 885932 - RNA, 19 nt, Homo sapiens
gcucgggaaucugcucauc

SEQ ID NO: 885933 - RNA, 19 nt, Homo sapiens
ggaaguacaaggcauuuuc

SEQ ID NO: 885934 - RNA, 19 nt, Homo sapiens
ggaaccagagaaugacaca

SEQ ID NO: 885935 - RNA, 19 nt, Homo sapiens
ucugggacuuucugaggaa

SEQ ID NO: 885936 - RNA, 19 nt, Homo sapiens
acaccuuucuuaaugacau

SEQ ID NO: 885937 - RNA, 19 nt, Homo sapiens
uugcugcccugaauuccuu

SEQ ID NO: 885938 - RNA, 19 nt, Homo sapiens
cauccuggccacaaucuca

SEQ ID NO: 885939 - RNA, 19 nt, Homo sapiens
aaagcuuaaugguauugug

SEQ ID NO: 885940 - RNA, 19 nt, Homo sapiens
cuaagauaguuuccuccau

SEQ ID NO: 885941 - RNA, 19 nt, Homo sapiens
ucuccaaccuguccuuugc

SEQ ID NO: 885942 - RNA, 19 nt, Homo sapiens
uaucuacagucugaggaau

SEQ ID NO: 885943 - RNA, 19 nt, Homo sapiens
gacacagggauuucagaau

SEQ ID NO: 885944 - RNA, 19 nt, Homo sapiens
gugcaucacaccucucagu

SEQ ID NO: 885945 - RNA, 19 nt, Homo sapiens
aagauaguuuccuccauac

SEQ ID NO: 885946 - RNA, 19 nt, Homo sapiens
ugacaccuuucuuaaugac

SEQ ID NO: 885947 - RNA, 19 nt, Homo sapiens
gcaagaagguggcauuguu

SEQ ID NO: 885948 - RNA, 19 nt, Homo sapiens
gaacucagauuuagugcaa

SEQ ID NO: 885949 - RNA, 19 nt, Homo sapiens
ccagauagccugacagaua

SEQ ID NO: 885950 - RNA, 19 nt, Homo sapiens
uaaaggagcugacguucuu

SEQ ID NO: 885951 - RNA, 19 nt, Homo sapiens
ucucaaaguuuccacauua

SEQ ID NO: 885952 - RNA, 19 nt, Homo sapiens
ggacgugugugucauuauu

SEQ ID NO: 885953 - RNA, 19 nt, Homo sapiens
ucuaagaacuucacaaaga

SEQ ID NO: 885954 - RNA, 19 nt, Homo sapiens
ggacuuaacauuucacguu

SEQ ID NO: 885955 - RNA, 19 nt, Homo sapiens
gcacgaggcccuggguuua

SEQ ID NO: 885956 - RNA, 19 nt, Homo sapiens
ggagagagcaguuucaaca

SEQ ID NO: 885957 - RNA, 19 nt, Homo sapiens
gcugggagccugucaguuu

SEQ ID NO: 885958 - RNA, 19 nt, Homo sapiens
cuaagaacuucacaaagaa

SEQ ID NO: 885959 - RNA, 19 nt, Homo sapiens
uggcaaacaugaagagaaa

SEQ ID NO: 885960 - RNA, 19 nt, Homo sapiens
cauuucacguuguaucuua

SEQ ID NO: 885961 - RNA, 19 nt, Homo sapiens
gaaagugugugugaaugug

SEQ ID NO: 885962 - RNA, 19 nt, Homo sapiens
ggaggugucuggcaaacau

SEQ ID NO: 885963 - RNA, 19 nt, Homo sapiens
gaaggagccagaagaaguu

SEQ ID NO: 885964 - RNA, 19 nt, Homo sapiens
ggugaggacugaccacaga

SEQ ID NO: 885965 - RNA, 19 nt, Homo sapiens
ugaguuaugcuguuguuua

SEQ ID NO: 885966 - RNA, 19 nt, Homo sapiens
cagauaggcuagugguauu

SEQ ID NO: 885967 - RNA, 19 nt, Homo sapiens
uucggaagcugaagaauaa

SEQ ID NO: 885968 - RNA, 19 nt, Homo sapiens
cuagugguauuguguauau

SEQ ID NO: 885969 - RNA, 19 nt, Homo sapiens
ccacaugccuggccuaaaa

SEQ ID NO: 885970 - RNA, 19 nt, Homo sapiens
gcagugaaugcaaggguua

SEQ ID NO: 885971 - RNA, 19 nt, Homo sapiens
gaccacagauucccuggau

SEQ ID NO: 885972 - RNA, 19 nt, Homo sapiens
gaagguggcauuguuucua

SEQ ID NO: 885973 - RNA, 19 nt, Homo sapiens
cagauagccugacagauag

SEQ ID NO: 885974 - RNA, 19 nt, Homo sapiens
cagauucccuggauagugu

SEQ ID NO: 885975 - RNA, 19 nt, Homo sapiens
guucaucaccuccgaauau

SEQ ID NO: 885976 - RNA, 19 nt, Homo sapiens
gaguuaugcuguuguuuag

SEQ ID NO: 885977 - RNA, 19 nt, Homo sapiens
caagaagguggcauuguuu

SEQ ID NO: 885978 - RNA, 19 nt, Homo sapiens
gaagagaaacagcaagaag

SEQ ID NO: 885979 - RNA, 19 nt, Homo sapiens
guagauuucuccacaggau

SEQ ID NO: 885980 - RNA, 19 nt, Homo sapiens
ccaggucccuccuuacuca

SEQ ID NO: 885981 - RNA, 19 nt, Homo sapiens
cagaggaguugauggugaa

SEQ ID NO: 885982 - RNA, 19 nt, Homo sapiens
gacaggagacgcuugcaaa

SEQ ID NO: 885983 - RNA, 19 nt, Homo sapiens
gacaguauuugccucacuu

SEQ ID NO: 885984 - RNA, 19 nt, Homo sapiens
ggaaagugugugugaaugu

SEQ ID NO: 885985 - RNA, 19 nt, Homo sapiens
uaucuuacuugcagugaau

SEQ ID NO: 885986 - RNA, 19 nt, Homo sapiens
cuuaacauuucacguugua

SEQ ID NO: 885987 - RNA, 19 nt, Homo sapiens
aagguggcauuguuucuaa

SEQ ID NO: 885988 - RNA, 19 nt, Homo sapiens
gcaaacaugaagagaaaca

SEQ ID NO: 885989 - RNA, 19 nt, Homo sapiens
uaauaaaggagcugacguu

SEQ ID NO: 885990 - RNA, 19 nt, Homo sapiens
cugggagccugucaguuua

SEQ ID NO: 885991 - RNA, 19 nt, Homo sapiens
ccagcacguucucaaaguu

SEQ ID NO: 885992 - RNA, 19 nt, Homo sapiens
ggauagcgcaauuggcaaa

SEQ ID NO: 885993 - RNA, 19 nt, Homo sapiens
cagcagcaaauaaauagaa

SEQ ID NO: 885994 - RNA, 19 nt, Homo sapiens
ccagaaggagccagaagaa

SEQ ID NO: 885995 - RNA, 19 nt, Homo sapiens
ugaaugcaaggguuacuuu

SEQ ID NO: 885996 - RNA, 19 nt, Homo sapiens
cccuagggcuucucugauu

SEQ ID NO: 885997 - RNA, 19 nt, Homo sapiens
gacgugugugucauuauua

SEQ ID NO: 885998 - RNA, 19 nt, Homo sapiens
ccacagauucccuggauag

SEQ ID NO: 885999 - RNA, 19 nt, Homo sapiens
aaugaaacccaguagcuaa

SEQ ID NO: 886000 - RNA, 19 nt, Homo sapiens
ccgcaugguuugguuaaug

SEQ ID NO: 886001 - RNA, 19 nt, Homo sapiens
uagcgcaauuggcaaauca

SEQ ID NO: 886002 - RNA, 19 nt, Homo sapiens
caggauacauuacuuuagc

SEQ ID NO: 886003 - RNA, 19 nt, Homo sapiens
guacuggcccauccuuguu

SEQ ID NO: 886004 - RNA, 19 nt, Homo sapiens
ccucucgccugcuggauga

SEQ ID NO: 886005 - RNA, 19 nt, Homo sapiens
uaaugaaacccaguagcua

SEQ ID NO: 886006 - RNA, 19 nt, Homo sapiens
gagagagcaguuucaacaa

SEQ ID NO: 886007 - RNA, 19 nt, Homo sapiens
uaaaaugggugauauacag

SEQ ID NO: 886008 - RNA, 19 nt, Homo sapiens
cgcaugguuugguuaauga

SEQ ID NO: 886009 - RNA, 19 nt, Homo sapiens
cacauucuauaguugcaaa

SEQ ID NO: 886010 - RNA, 19 nt, Homo sapiens
gcaaaucaugcuugguugu

SEQ ID NO: 886011 - RNA, 19 nt, Homo sapiens
ccuccuuacucaacauuug

SEQ ID NO: 886012 - RNA, 19 nt, Homo sapiens
gcagagguggauccuguga

SEQ ID NO: 886013 - RNA, 19 nt, Homo sapiens
cgggacgugugugucauua

SEQ ID NO: 886014 - RNA, 19 nt, Homo sapiens
uggcaaaucaugcuugguu

SEQ ID NO: 886015 - RNA, 19 nt, Homo sapiens
auaguguagugguagauuu

SEQ ID NO: 886016 - RNA, 19 nt, Homo sapiens
gaagaccaaagauggauac

SEQ ID NO: 886017 - RNA, 19 nt, Homo sapiens
agaaggagccagaagaagu

SEQ ID NO: 886018 - RNA, 19 nt, Homo sapiens
uuucggaagcugaagaaua

SEQ ID NO: 886019 - RNA, 19 nt, Homo sapiens
ucacccagguuccuacucu

SEQ ID NO: 886020 - RNA, 19 nt, Homo sapiens
aaaaggggacuuaacauuu

SEQ ID NO: 886021 - RNA, 19 nt, Homo sapiens
ucagauuuagugcaaguaa

SEQ ID NO: 886022 - RNA, 19 nt, Homo sapiens
agagguggauccugugaca

SEQ ID NO: 886023 - RNA, 19 nt, Homo sapiens
gcuguucccuccgcggauu

SEQ ID NO: 886024 - RNA, 19 nt, Homo sapiens
ccugcuggaugauggcuuu

SEQ ID NO: 886025 - RNA, 19 nt, Homo sapiens
caaaguuuccacauuagca

SEQ ID NO: 886026 - RNA, 19 nt, Homo sapiens
cagcacguucucaaaguuu

SEQ ID NO: 886027 - RNA, 19 nt, Homo sapiens
gauaguguagugguagauu

SEQ ID NO: 886028 - RNA, 19 nt, Homo sapiens
aaacaaacagugccuucug

SEQ ID NO: 886029 - RNA, 19 nt, Homo sapiens
guaucuuacuugcagugaa

SEQ ID NO: 886030 - RNA, 19 nt, Homo sapiens
uaacauuucacguuguauc

SEQ ID NO: 886031 - RNA, 19 nt, Homo sapiens
uaaaaggggacuuaacauu

SEQ ID NO: 886032 - RNA, 19 nt, Homo sapiens
aaucaugcuugguuguguu

SEQ ID NO: 886033 - RNA, 19 nt, Homo sapiens
gcaauuggcaaaucaugcu

SEQ ID NO: 886034 - RNA, 19 nt, Homo sapiens
cugauuccaggauacauua

SEQ ID NO: 886035 - RNA, 19 nt, Homo sapiens
acagauaggcuagugguau

SEQ ID NO: 886036 - RNA, 19 nt, Homo sapiens
ggccagauagccugacaga

SEQ ID NO: 886037 - RNA, 19 nt, Homo sapiens
cgaggcccuggguuuauua

SEQ ID NO: 886038 - RNA, 19 nt, Homo sapiens
aaaggggacuuaacauuuc

SEQ ID NO: 886039 - RNA, 19 nt, Homo sapiens
ccuggauaguguaguggua

SEQ ID NO: 886040 - RNA, 19 nt, Homo sapiens
agagagcaguuucaacaac

SEQ ID NO: 886041 - RNA, 19 nt, Homo sapiens
ggugaagaccaaagaugga

SEQ ID NO: 886042 - RNA, 19 nt, Homo sapiens
ucucugagccucuguuucu

SEQ ID NO: 886043 - RNA, 19 nt, Homo sapiens
ucccauggcucccaaacca

SEQ ID NO: 886044 - RNA, 19 nt, Homo sapiens
guugcacauucuauaguug

SEQ ID NO: 886045 - RNA, 19 nt, Homo sapiens
uguugcacauucuauaguu

SEQ ID NO: 886046 - RNA, 19 nt, Homo sapiens
uccaggauacauuacuuua

SEQ ID NO: 886047 - RNA, 19 nt, Homo sapiens
ggacauacaugaagaauug

SEQ ID NO: 886048 - RNA, 19 nt, Homo sapiens
gcaaacagaauucaaagaa

SEQ ID NO: 886049 - RNA, 19 nt, Homo sapiens
ccaggaaacuguugaugaa

SEQ ID NO: 886050 - RNA, 19 nt, Homo sapiens
ggacuccuccuccauauuu

SEQ ID NO: 886051 - RNA, 19 nt, Homo sapiens
guggacaggugccucauua

SEQ ID NO: 886052 - RNA, 19 nt, Homo sapiens
gcuaaacuguucucuguau

SEQ ID NO: 886053 - RNA, 19 nt, Homo sapiens
ggaaacuguugaugaagaa

SEQ ID NO: 886054 - RNA, 19 nt, Homo sapiens
aaucagaucugguaccaaa

SEQ ID NO: 886055 - RNA, 19 nt, Homo sapiens
caucguaucuccacuuaau

SEQ ID NO: 886056 - RNA, 19 nt, Homo sapiens
ggaaguaguuaucuggaau

SEQ ID NO: 886057 - RNA, 19 nt, Homo sapiens
caucaaauguggaaccuau

SEQ ID NO: 886058 - RNA, 19 nt, Homo sapiens
gauauuaagccaucaaaug

SEQ ID NO: 886059 - RNA, 19 nt, Homo sapiens
cagauuauguguaacagaa

SEQ ID NO: 886060 - RNA, 19 nt, Homo sapiens
caaagacagugaccaggaa

SEQ ID NO: 886061 - RNA, 19 nt, Homo sapiens
uuggagagcuggcuaaauu

SEQ ID NO: 886062 - RNA, 19 nt, Homo sapiens
ggaugaugcuuaugacuuc

SEQ ID NO: 886063 - RNA, 19 nt, Homo sapiens
ggaaacagaggcuugaaga

SEQ ID NO: 886064 - RNA, 19 nt, Homo sapiens
gaaguaguuaucuggaaua

SEQ ID NO: 886065 - RNA, 19 nt, Homo sapiens
ugaagaggaugaugcuuau

SEQ ID NO: 886066 - RNA, 19 nt, Homo sapiens
gaaaacagcucaggcaugu

SEQ ID NO: 886067 - RNA, 19 nt, Homo sapiens
gaagagguaugcaccaaaa

SEQ ID NO: 886068 - RNA, 19 nt, Homo sapiens
aaacagugcucccuuuaag

SEQ ID NO: 886069 - RNA, 19 nt, Homo sapiens
gagaagagguaugcaccaa

SEQ ID NO: 886070 - RNA, 19 nt, Homo sapiens
gacagguaguacugaaaua

SEQ ID NO: 886071 - RNA, 19 nt, Homo sapiens
aaacagaucacaaucauag

SEQ ID NO: 886072 - RNA, 19 nt, Homo sapiens
ggagagggaggaugacaaa

SEQ ID NO: 886073 - RNA, 19 nt, Homo sapiens
cuacaggaauucucuggaa

SEQ ID NO: 886074 - RNA, 19 nt, Homo sapiens
gaagugaagucugcuuugg

SEQ ID NO: 886075 - RNA, 19 nt, Homo sapiens
caacaaaaccaaaggauaa

SEQ ID NO: 886076 - RNA, 19 nt, Homo sapiens
ugcaugagcuguguaaauu

SEQ ID NO: 886077 - RNA, 19 nt, Homo sapiens
gguggaaucccaaauguug

SEQ ID NO: 886078 - RNA, 19 nt, Homo sapiens
gaagaaagaauugccaaca

SEQ ID NO: 886079 - RNA, 19 nt, Homo sapiens
gcagauguccucagguaga

SEQ ID NO: 886080 - RNA, 19 nt, Homo sapiens
ccaaacagugcucccuuua

SEQ ID NO: 886081 - RNA, 19 nt, Homo sapiens
caacuuggaaucccuaaau

SEQ ID NO: 886082 - RNA, 19 nt, Homo sapiens
ccaaacugcuguggucuga

SEQ ID NO: 886083 - RNA, 19 nt, Homo sapiens
gauugaagccuccgauguu

SEQ ID NO: 886084 - RNA, 19 nt, Homo sapiens
caaacagaauucaaagaag

SEQ ID NO: 886085 - RNA, 19 nt, Homo sapiens
acaaggagcaugcaaguug

SEQ ID NO: 886086 - RNA, 19 nt, Homo sapiens
gaaacagaggcuugaagaa

SEQ ID NO: 886087 - RNA, 19 nt, Homo sapiens
acaaacagaucacaaucau

SEQ ID NO: 886088 - RNA, 19 nt, Homo sapiens
gauguguaauguuggugua

SEQ ID NO: 886089 - RNA, 19 nt, Homo sapiens
caaacagugcucccuuuaa

SEQ ID NO: 886090 - RNA, 19 nt, Homo sapiens
cuaaacuguucucuguaua

SEQ ID NO: 886091 - RNA, 19 nt, Homo sapiens
ugacuucaguacagauuau

SEQ ID NO: 886092 - RNA, 19 nt, Homo sapiens
acaagaagccuaggaaaga

SEQ ID NO: 886093 - RNA, 19 nt, Homo sapiens
uaaguuaugguaugcauga

SEQ ID NO: 886094 - RNA, 19 nt, Homo sapiens
uaaugagaguauuguggua

SEQ ID NO: 886095 - RNA, 19 nt, Homo sapiens
ggagagcuggcuaaauuau

SEQ ID NO: 886096 - RNA, 19 nt, Homo sapiens
uugcagauguccucaggua

SEQ ID NO: 886097 - RNA, 19 nt, Homo sapiens
gaagcuguacugccaagaa

SEQ ID NO: 886098 - RNA, 19 nt, Homo sapiens
cugcuaaacuguucucugu

SEQ ID NO: 886099 - RNA, 19 nt, Homo sapiens
ggacaaacagaucacaauc

SEQ ID NO: 886100 - RNA, 19 nt, Homo sapiens
aagaacagauguguaaugu

SEQ ID NO: 886101 - RNA, 19 nt, Homo sapiens
caagaacagauguguaaug

SEQ ID NO: 886102 - RNA, 19 nt, Homo sapiens
agaaagaauugccaacagu

SEQ ID NO: 886103 - RNA, 19 nt, Homo sapiens
caucaagggcccucauuug

SEQ ID NO: 886104 - RNA, 19 nt, Homo sapiens
ugaaggugcugccaaacug

SEQ ID NO: 886105 - RNA, 19 nt, Homo sapiens
aacaagaacagauguguaa

SEQ ID NO: 886106 - RNA, 19 nt, Homo sapiens
acagaggcuugaagaacua

SEQ ID NO: 886107 - RNA, 19 nt, Homo sapiens
gaaaaggccuaaguuaaag

SEQ ID NO: 886108 - RNA, 19 nt, Homo sapiens
caaggagcaugcaaguugu

SEQ ID NO: 886109 - RNA, 19 nt, Homo sapiens
aaagcagcauuaucaauag

SEQ ID NO: 886110 - RNA, 19 nt, Homo sapiens
cagguaguacugaaauaua

SEQ ID NO: 886111 - RNA, 19 nt, Homo sapiens
gcaaguauugaaguaguaa

SEQ ID NO: 886112 - RNA, 19 nt, Homo sapiens
cagaucacaaucauagaua

SEQ ID NO: 886113 - RNA, 19 nt, Homo sapiens
ccaagcgugugaaggcaaa

SEQ ID NO: 886114 - RNA, 19 nt, Homo sapiens
guacugccaagaacuuaaa

SEQ ID NO: 886115 - RNA, 19 nt, Homo sapiens
acuguucucuguauaaguu

SEQ ID NO: 886116 - RNA, 19 nt, Homo sapiens
uugaagaggaugaugcuua

SEQ ID NO: 886117 - RNA, 19 nt, Homo sapiens
ggugaacagucuacaaggu

SEQ ID NO: 886118 - RNA, 19 nt, Homo sapiens
uggaagaacuggaaaagaa

SEQ ID NO: 886119 - RNA, 19 nt, Homo sapiens
cagcaaguauugaaguagu

SEQ ID NO: 886120 - RNA, 19 nt, Homo sapiens
aaacaagaacagaugugua

SEQ ID NO: 886121 - RNA, 19 nt, Homo sapiens
uaaaucagaucugguacca

SEQ ID NO: 886122 - RNA, 19 nt, Homo sapiens
ugaaaaggccuaaguuaaa

SEQ ID NO: 886123 - RNA, 19 nt, Homo sapiens
gcaugagcuguguaaauuu

SEQ ID NO: 886124 - RNA, 19 nt, Homo sapiens
gauuauguguaacagaaca

SEQ ID NO: 886125 - RNA, 19 nt, Homo sapiens
gagggaggaugacaaagac

SEQ ID NO: 886126 - RNA, 19 nt, Homo sapiens
cgaaguccagcaaguauug

SEQ ID NO: 886127 - RNA, 19 nt, Homo sapiens
aguccgagcuucaucguau

SEQ ID NO: 886128 - RNA, 19 nt, Homo sapiens
caaacagaucacaaucaua

SEQ ID NO: 886129 - RNA, 19 nt, Homo sapiens
gacaaacagaucacaauca

SEQ ID NO: 886130 - RNA, 19 nt, Homo sapiens
gagcauaagagccaucaag

SEQ ID NO: 886131 - RNA, 19 nt, Homo sapiens
aaacugcuguggucugagu

SEQ ID NO: 886132 - RNA, 19 nt, Homo sapiens
gggaaaagcagcauuauca

SEQ ID NO: 886133 - RNA, 19 nt, Homo sapiens
guucagagccucaacaaaa

SEQ ID NO: 886134 - RNA, 19 nt, Homo sapiens
gguguuggaugccagagau

SEQ ID NO: 886135 - RNA, 19 nt, Homo sapiens
gcuuaugacuucaguacag

SEQ ID NO: 886136 - RNA, 19 nt, Homo sapiens
aggaaacuguugaugaaga

SEQ ID NO: 886137 - RNA, 19 nt, Homo sapiens
cgagggugcuuccuucuac

SEQ ID NO: 886138 - RNA, 19 nt, Homo sapiens
gcagcauuaucaauagcuu

SEQ ID NO: 886139 - RNA, 19 nt, Homo sapiens
gagagcuggcuaaauuauu

SEQ ID NO: 886140 - RNA, 19 nt, Homo sapiens
agaaggaacuagaaaagaa

SEQ ID NO: 886141 - RNA, 19 nt, Homo sapiens
aaacagcagcagaaacuug

SEQ ID NO: 886142 - RNA, 19 nt, Homo sapiens
acaggugccucauuagcuu

SEQ ID NO: 886143 - RNA, 19 nt, Homo sapiens
uaggaaagacccaggaguu

SEQ ID NO: 886144 - RNA, 19 nt, Homo sapiens
aaggauaaagggaagauaa

SEQ ID NO: 886145 - RNA, 19 nt, Homo sapiens
ggcugaugcucgacaggua

SEQ ID NO: 886146 - RNA, 19 nt, Homo sapiens
cagauguccucagguagaa

SEQ ID NO: 886147 - RNA, 19 nt, Homo sapiens
caacacaagucaccucuua

SEQ ID NO: 886148 - RNA, 19 nt, Homo sapiens
aaagaaagcucgucugaaa

SEQ ID NO: 886149 - RNA, 19 nt, Homo sapiens
gcccaaaccuguaccauuu

SEQ ID NO: 886150 - RNA, 19 nt, Homo sapiens
gaaggccaguugaguauau

SEQ ID NO: 886151 - RNA, 19 nt, Homo sapiens
cagagugccuuuacacaaa

SEQ ID NO: 886152 - RNA, 19 nt, Homo sapiens
gaggauccauuucauaaag

SEQ ID NO: 886153 - RNA, 19 nt, Homo sapiens
gaaggaagcagcuaugaag

SEQ ID NO: 886154 - RNA, 19 nt, Homo sapiens
uuacuucucuucccauuau

SEQ ID NO: 886155 - RNA, 19 nt, Homo sapiens
ggauccauuucauaaagua

SEQ ID NO: 886156 - RNA, 19 nt, Homo sapiens
uaacgugccuguauuaaaa

SEQ ID NO: 886157 - RNA, 19 nt, Homo sapiens
gaaagaaggaagcagcuau

SEQ ID NO: 886158 - RNA, 19 nt, Homo sapiens
cagagaagcagguaccaua

SEQ ID NO: 886159 - RNA, 19 nt, Homo sapiens
uaaccagcuuggaccuuua

SEQ ID NO: 886160 - RNA, 19 nt, Homo sapiens
caaauguccugguguacug

SEQ ID NO: 886161 - RNA, 19 nt, Homo sapiens
ucucaaauguccuggugua

SEQ ID NO: 886162 - RNA, 19 nt, Homo sapiens
gcuggcagauggaggcuuu

SEQ ID NO: 886163 - RNA, 19 nt, Homo sapiens
uaccauaucuuacuucucu

SEQ ID NO: 886164 - RNA, 19 nt, Homo sapiens
gaagaugaaaucccagaga

SEQ ID NO: 886165 - RNA, 19 nt, Homo sapiens
gggccagccuucucaaaug

SEQ ID NO: 886166 - RNA, 19 nt, Homo sapiens
gcaggaagcuguuuuaggu

SEQ ID NO: 886167 - RNA, 19 nt, Homo sapiens
gaaagcucgucugaaagaa

SEQ ID NO: 886168 - RNA, 19 nt, Homo sapiens
aagcagguaccauaucuua

SEQ ID NO: 886169 - RNA, 19 nt, Homo sapiens
uaggaugcaucuuucauug

SEQ ID NO: 886170 - RNA, 19 nt, Homo sapiens
gaaaagaaagcucgucuga

SEQ ID NO: 886171 - RNA, 19 nt, Homo sapiens
ggaugcaucuuucauuggu

SEQ ID NO: 886172 - RNA, 19 nt, Homo sapiens
ggugguaggaugcaucuuu

SEQ ID NO: 886173 - RNA, 19 nt, Homo sapiens
caacuugaauaccaacucu

SEQ ID NO: 886174 - RNA, 19 nt, Homo sapiens
gaagcagccagaccacauu

SEQ ID NO: 886175 - RNA, 19 nt, Homo sapiens
caaaacagauuaccaaagg

SEQ ID NO: 886176 - RNA, 19 nt, Homo sapiens
cagcuuggaccuuuagaaa

SEQ ID NO: 886177 - RNA, 19 nt, Homo sapiens
gguaugaggauccauuuca

SEQ ID NO: 886178 - RNA, 19 nt, Homo sapiens
agaaagcucgucugaaaga

SEQ ID NO: 886179 - RNA, 19 nt, Homo sapiens
uuaaccagcuuggaccuuu

SEQ ID NO: 886180 - RNA, 19 nt, Homo sapiens
guaggaugcaucuuucauu

SEQ ID NO: 886181 - RNA, 19 nt, Homo sapiens
gcagccagaccacauucua

SEQ ID NO: 886182 - RNA, 19 nt, Homo sapiens
gauaaggaaggccaguuga

SEQ ID NO: 886183 - RNA, 19 nt, Homo sapiens
gaacaugcuggcagaugga

SEQ ID NO: 886184 - RNA, 19 nt, Homo sapiens
ggccagccuucucaaaugu

SEQ ID NO: 886185 - RNA, 19 nt, Homo sapiens
gaaaauccaggaauuaugu

SEQ ID NO: 886186 - RNA, 19 nt, Homo sapiens
caucuuucauugguuauug

SEQ ID NO: 886187 - RNA, 19 nt, Homo sapiens
cagaccacauucuauaauc

SEQ ID NO: 886188 - RNA, 19 nt, Homo sapiens
gaacaagaugcgagugaag

SEQ ID NO: 886189 - RNA, 19 nt, Homo sapiens
uagguuaugugaaagagau

SEQ ID NO: 886190 - RNA, 19 nt, Homo sapiens
ggaaggccaguugaguaua

SEQ ID NO: 886191 - RNA, 19 nt, Homo sapiens
augcaucuuucauugguua

SEQ ID NO: 886192 - RNA, 19 nt, Homo sapiens
gcagguaccauaucuuacu

SEQ ID NO: 886193 - RNA, 19 nt, Homo sapiens
agaagcagguaccauaucu

SEQ ID NO: 886194 - RNA, 19 nt, Homo sapiens
acacaaaccuacggauugg

SEQ ID NO: 886195 - RNA, 19 nt, Homo sapiens
gccagaccacauucuauaa

SEQ ID NO: 886196 - RNA, 19 nt, Homo sapiens
gacaagguccagccaggaa

SEQ ID NO: 886197 - RNA, 19 nt, Homo sapiens
gugguaggaugcaucuuuc

SEQ ID NO: 886198 - RNA, 19 nt, Homo sapiens
aaggaaggccaguugagua

SEQ ID NO: 886199 - RNA, 19 nt, Homo sapiens
agaacaagaugcgagugaa

SEQ ID NO: 886200 - RNA, 19 nt, Homo sapiens
gagaagcagguaccauauc

SEQ ID NO: 886201 - RNA, 19 nt, Homo sapiens
aaagguauccguguugguu

SEQ ID NO: 886202 - RNA, 19 nt, Homo sapiens
cagguaccauaucuuacuu

SEQ ID NO: 886203 - RNA, 19 nt, Homo sapiens
gcuguagaaguagaaauaa

SEQ ID NO: 886204 - RNA, 19 nt, Homo sapiens
uuacacaaaccuacggauu

SEQ ID NO: 886205 - RNA, 19 nt, Homo sapiens
caagguccagccaggaauu

SEQ ID NO: 886206 - RNA, 19 nt, Homo sapiens
gaccacauucuauaaucuu

SEQ ID NO: 886207 - RNA, 19 nt, Homo sapiens
ccuguaccauuuccguauu

SEQ ID NO: 886208 - RNA, 19 nt, Homo sapiens
ucaggucgcuucaaaagga

SEQ ID NO: 886209 - RNA, 19 nt, Homo sapiens
acaagucaccucuuagcuu

SEQ ID NO: 886210 - RNA, 19 nt, Homo sapiens
uacacaaaccuacggauug

SEQ ID NO: 886211 - RNA, 19 nt, Homo sapiens
gcacaaaaccacaggaaag

SEQ ID NO: 886212 - RNA, 19 nt, Homo sapiens
caacagagugccuuuacac

SEQ ID NO: 886213 - RNA, 19 nt, Homo sapiens
ucagcuaucuaaugauugc

SEQ ID NO: 886214 - RNA, 19 nt, Homo sapiens
ccagaccacauucuauaau

SEQ ID NO: 886215 - RNA, 19 nt, Homo sapiens
gguaccauaucuuacuucu

SEQ ID NO: 886216 - RNA, 19 nt, Homo sapiens
gaugcuugaugcugcaaag

SEQ ID NO: 886217 - RNA, 19 nt, Homo sapiens
agccagaccacauucuaua

SEQ ID NO: 886218 - RNA, 19 nt, Homo sapiens
acagagugccuuuacacaa

SEQ ID NO: 886219 - RNA, 19 nt, Homo sapiens
gagcuccauucccgcacuu

SEQ ID NO: 886220 - RNA, 19 nt, Homo sapiens
gagauaaggaaggccaguu

SEQ ID NO: 886221 - RNA, 19 nt, Homo sapiens
gaagcagguaccauaucuu

SEQ ID NO: 886222 - RNA, 19 nt, Homo sapiens
aaagaaggaagcagcuaug

SEQ ID NO: 886223 - RNA, 19 nt, Homo sapiens
gaugcaucuuucauugguu

SEQ ID NO: 886224 - RNA, 19 nt, Homo sapiens
cuuaccaccugagaaacua

SEQ ID NO: 886225 - RNA, 19 nt, Homo sapiens
auucucaacugggcuguuu

SEQ ID NO: 886226 - RNA, 19 nt, Homo sapiens
agccaggaauuucuaagga

SEQ ID NO: 886227 - RNA, 19 nt, Homo sapiens
agaccacauucuauaaucu

SEQ ID NO: 886228 - RNA, 19 nt, Homo sapiens
acaacagagugccuuuaca

SEQ ID NO: 886229 - RNA, 19 nt, Homo sapiens
ugaggauccauuucauaaa

SEQ ID NO: 886230 - RNA, 19 nt, Homo sapiens
aggaagcuguuuuagguua

SEQ ID NO: 886231 - RNA, 19 nt, Homo sapiens
agaaggaagcagcuaugaa

SEQ ID NO: 886232 - RNA, 19 nt, Homo sapiens
uuacaacagagugccuuua

SEQ ID NO: 886233 - RNA, 19 nt, Homo sapiens
gcuugaugcugcaaagaac

SEQ ID NO: 886234 - RNA, 19 nt, Homo sapiens
gaaagucccggagcuccau

SEQ ID NO: 886235 - RNA, 19 nt, Homo sapiens
ugcuguagaaguagaaaua

SEQ ID NO: 886236 - RNA, 19 nt, Homo sapiens
cuucaugccuuagaauucu

SEQ ID NO: 886237 - RNA, 19 nt, Homo sapiens
gagggccagccuucucaaa

SEQ ID NO: 886238 - RNA, 19 nt, Homo sapiens
uaaggaaggccaguugagu

SEQ ID NO: 886239 - RNA, 19 nt, Homo sapiens
aagaacaagaugcgaguga

SEQ ID NO: 886240 - RNA, 19 nt, Homo sapiens
ccacauucuauaaucuuug

SEQ ID NO: 886241 - RNA, 19 nt, Homo sapiens
gcuucaugccuuagaauuc

SEQ ID NO: 886242 - RNA, 19 nt, Homo sapiens
cuguaccauuuccguauuu

SEQ ID NO: 886243 - RNA, 19 nt, Homo sapiens
ugaaagaaggaagcagcua

SEQ ID NO: 886244 - RNA, 19 nt, Homo sapiens
agagaagcagguaccauau

SEQ ID NO: 886245 - RNA, 19 nt, Homo sapiens
agucaaguguagccucuca

SEQ ID NO: 886246 - RNA, 19 nt, Homo sapiens
auggucaggucgcuucaaa

SEQ ID NO: 886247 - RNA, 19 nt, Homo sapiens
ggaaagcuauguucuaauu

SEQ ID NO: 886248 - RNA, 19 nt, Homo sapiens
gaacagagcccagugaaau

SEQ ID NO: 886249 - RNA, 19 nt, Homo sapiens
ccaacggccuucucauuua

SEQ ID NO: 886250 - RNA, 19 nt, Homo sapiens
gagcucaaaucuuuccuuu

SEQ ID NO: 886251 - RNA, 19 nt, Homo sapiens
cagaacagcugcuacauca

SEQ ID NO: 886252 - RNA, 19 nt, Homo sapiens
ccacauuggccuuuauuua

SEQ ID NO: 886253 - RNA, 19 nt, Homo sapiens
ccucugagcuucccaauca

SEQ ID NO: 886254 - RNA, 19 nt, Homo sapiens
ccuuggagcucaaaucuuu

SEQ ID NO: 886255 - RNA, 19 nt, Homo sapiens
ggaaagcaaguucauggua

SEQ ID NO: 886256 - RNA, 19 nt, Homo sapiens
ggauaagguuucagaguuc

SEQ ID NO: 886257 - RNA, 19 nt, Homo sapiens
ggaaggagacucuaagaca

SEQ ID NO: 886258 - RNA, 19 nt, Homo sapiens
aaggaaagcuauguucuaa

SEQ ID NO: 886259 - RNA, 19 nt, Homo sapiens
aaacauagcagcgauggua

SEQ ID NO: 886260 - RNA, 19 nt, Homo sapiens
gaagaggcacuagccauuu

SEQ ID NO: 886261 - RNA, 19 nt, Homo sapiens
cggaacagcugcagguuau

SEQ ID NO: 886262 - RNA, 19 nt, Homo sapiens
acaaggagaucuucugcaa

SEQ ID NO: 886263 - RNA, 19 nt, Homo sapiens
gaaauggcagucagaaugu

SEQ ID NO: 886264 - RNA, 19 nt, Homo sapiens
gaacagcugcuacaucaag

SEQ ID NO: 886265 - RNA, 19 nt, Homo sapiens
uggcagacauugcuaauca

SEQ ID NO: 886266 - RNA, 19 nt, Homo sapiens
uggauaagguuucagaguu

SEQ ID NO: 886267 - RNA, 19 nt, Homo sapiens
gucccaagcuuauccugua

SEQ ID NO: 886268 - RNA, 19 nt, Homo sapiens
cagcauauauguaagaaac

SEQ ID NO: 886269 - RNA, 19 nt, Homo sapiens
aaccaucucugaauucuga

SEQ ID NO: 886270 - RNA, 19 nt, Homo sapiens
ggaguccucuucaacuuca

SEQ ID NO: 886271 - RNA, 19 nt, Homo sapiens
guacaggccaucaagacua

SEQ ID NO: 886272 - RNA, 19 nt, Homo sapiens
ccaugacucuucugaaugu

SEQ ID NO: 886273 - RNA, 19 nt, Homo sapiens
agagggcggugacauauug

SEQ ID NO: 886274 - RNA, 19 nt, Homo sapiens
cacuagagguugcuaauca

SEQ ID NO: 886275 - RNA, 19 nt, Homo sapiens
uaacauccauccugcuaca

SEQ ID NO: 886276 - RNA, 19 nt, Homo sapiens
ggccaggucuucucaaugg

SEQ ID NO: 886277 - RNA, 19 nt, Homo sapiens
gagaagagacagugaccaa

SEQ ID NO: 886278 - RNA, 19 nt, Homo sapiens
gaaagagaagagacaguga

SEQ ID NO: 886279 - RNA, 19 nt, Homo sapiens
gcuaggcgcugacauuaac

SEQ ID NO: 886280 - RNA, 19 nt, Homo sapiens
gcaaguucaugguacauac

SEQ ID NO: 886281 - RNA, 19 nt, Homo sapiens
ccaagcuuauccuguaauu

SEQ ID NO: 886282 - RNA, 19 nt, Homo sapiens
acacgaccaugauuuaugu

SEQ ID NO: 886283 - RNA, 19 nt, Homo sapiens
ugaaauggcagucagaaug

SEQ ID NO: 886284 - RNA, 19 nt, Homo sapiens
caggagcucuggacaagga

SEQ ID NO: 886285 - RNA, 19 nt, Homo sapiens
gccaacggccuucucauuu

SEQ ID NO: 886286 - RNA, 19 nt, Homo sapiens
caacuucagcugauuacaa

SEQ ID NO: 886287 - RNA, 19 nt, Homo sapiens
ucaaacaugucuccacuac

SEQ ID NO: 886288 - RNA, 19 nt, Homo sapiens
aggcagaacucccugaaau

SEQ ID NO: 886289 - RNA, 19 nt, Homo sapiens
gaacguacaggccaucaag

SEQ ID NO: 886290 - RNA, 19 nt, Homo sapiens
gauaucugcucaaggucaa

SEQ ID NO: 886291 - RNA, 19 nt, Homo sapiens
gaaagccuauaggucauuc

SEQ ID NO: 886292 - RNA, 19 nt, Homo sapiens
gcugcuacaucaagaacaa

SEQ ID NO: 886293 - RNA, 19 nt, Homo sapiens
ggaaccaucucugaauucu

SEQ ID NO: 886294 - RNA, 19 nt, Homo sapiens
cuggauccaucucuaagua

SEQ ID NO: 886295 - RNA, 19 nt, Homo sapiens
ggagagggcggugacauau

SEQ ID NO: 886296 - RNA, 19 nt, Homo sapiens
ccucaaagccgauauggau

SEQ ID NO: 886297 - RNA, 19 nt, Homo sapiens
ugucuccacuacccuguua

SEQ ID NO: 886298 - RNA, 19 nt, Homo sapiens
agacacagcugcguaacau

SEQ ID NO: 886299 - RNA, 19 nt, Homo sapiens
ggaacagagcccagugaaa

SEQ ID NO: 886300 - RNA, 19 nt, Homo sapiens
aaaggaaagcuauguucua

SEQ ID NO: 886301 - RNA, 19 nt, Homo sapiens
gcggaacagcugcagguua

SEQ ID NO: 886302 - RNA, 19 nt, Homo sapiens
gagcaggcaccacucagaa

SEQ ID NO: 886303 - RNA, 19 nt, Homo sapiens
guacauacgcagccauugu

SEQ ID NO: 886304 - RNA, 19 nt, Homo sapiens
gauaagguuucagaguuca

SEQ ID NO: 886305 - RNA, 19 nt, Homo sapiens
gagagagggugcccauugc

SEQ ID NO: 886306 - RNA, 19 nt, Homo sapiens
ugacucuucugaauguuug

SEQ ID NO: 886307 - RNA, 19 nt, Homo sapiens
ggaccgauaucugcucaag

SEQ ID NO: 886308 - RNA, 19 nt, Homo sapiens
ccaauguuauccacucugu

SEQ ID NO: 886309 - RNA, 19 nt, Homo sapiens
caacggccuucucauuuac

SEQ ID NO: 886310 - RNA, 19 nt, Homo sapiens
ggucaggccuccccaugua

SEQ ID NO: 886311 - RNA, 19 nt, Homo sapiens
uagcagcgaugguauucga

SEQ ID NO: 886312 - RNA, 19 nt, Homo sapiens
gcagaacucccugaaaucu

SEQ ID NO: 886313 - RNA, 19 nt, Homo sapiens
gaaggcagaacucccugaa

SEQ ID NO: 886314 - RNA, 19 nt, Homo sapiens
gagcaaccagggcccaauu

SEQ ID NO: 886315 - RNA, 19 nt, Homo sapiens
gugcuaggcgcugacauua

SEQ ID NO: 886316 - RNA, 19 nt, Homo sapiens
ccacuacgacaccaugauu

SEQ ID NO: 886317 - RNA, 19 nt, Homo sapiens
gcuugacguuggcacuuaa

SEQ ID NO: 886318 - RNA, 19 nt, Homo sapiens
caaguuaauucagaaagag

SEQ ID NO: 886319 - RNA, 19 nt, Homo sapiens
ccaacacacucugccuuga

SEQ ID NO: 886320 - RNA, 19 nt, Homo sapiens
cuacacacgaccaugauuu

SEQ ID NO: 886321 - RNA, 19 nt, Homo sapiens
uuucagaguucaaaugcuu

SEQ ID NO: 886322 - RNA, 19 nt, Homo sapiens
ggcaggagcucuggacaag

SEQ ID NO: 886323 - RNA, 19 nt, Homo sapiens
ugccaugacucuucugaau

SEQ ID NO: 886324 - RNA, 19 nt, Homo sapiens
ccaaaggaaagcuauguuc

SEQ ID NO: 886325 - RNA, 19 nt, Homo sapiens
uacacacgaccaugauuua

SEQ ID NO: 886326 - RNA, 19 nt, Homo sapiens
ucgagauccuggaccgaua

SEQ ID NO: 886327 - RNA, 19 nt, Homo sapiens
cauuggccuuuauuuacua

SEQ ID NO: 886328 - RNA, 19 nt, Homo sapiens
accaaugucuguuuuguua

SEQ ID NO: 886329 - RNA, 19 nt, Homo sapiens
uuaaggagaggaaagagaa

SEQ ID NO: 886330 - RNA, 19 nt, Homo sapiens
agagagagggugcccauug

SEQ ID NO: 886331 - RNA, 19 nt, Homo sapiens
gcgaugguauucgaucugu

SEQ ID NO: 886332 - RNA, 19 nt, Homo sapiens
gagagggcggugacauauu

SEQ ID NO: 886333 - RNA, 19 nt, Homo sapiens
cuucagcugauuacaauaa

SEQ ID NO: 886334 - RNA, 19 nt, Homo sapiens
gcugagauccaguguccaa

SEQ ID NO: 886335 - RNA, 19 nt, Homo sapiens
uacaggccaucaagacuau

SEQ ID NO: 886336 - RNA, 19 nt, Homo sapiens
gccguagcauguuacaguu

SEQ ID NO: 886337 - RNA, 19 nt, Homo sapiens
gacguuggcacuuaacaug

SEQ ID NO: 886338 - RNA, 19 nt, Homo sapiens
agaagaggcacuagccauu

SEQ ID NO: 886339 - RNA, 19 nt, Homo sapiens
cguuggcacuuaacaugaa

SEQ ID NO: 886340 - RNA, 19 nt, Homo sapiens
aaagcaaguucaugguaca

SEQ ID NO: 886341 - RNA, 19 nt, Homo sapiens
ucugcaagauggacuacuu

SEQ ID NO: 886342 - RNA, 19 nt, Homo sapiens
caaaggaaagcuauguucu

SEQ ID NO: 886343 - RNA, 19 nt, Homo sapiens
cguagcauguuacaguuca

SEQ ID NO: 886344 - RNA, 19 nt, Homo sapiens
cugguuaugucaaguuaau

SEQ ID NO: 886345 - RNA, 19 nt, Homo sapiens
cugcacggcuacauugaga

SEQ ID NO: 886346 - RNA, 19 nt, Homo sapiens
gaaaacacacacacggaaa

SEQ ID NO: 886347 - RNA, 19 nt, Homo sapiens
ggacacagcgacuacauua

SEQ ID NO: 886348 - RNA, 19 nt, Homo sapiens
gcacagagcagauucaaga

SEQ ID NO: 886349 - RNA, 19 nt, Homo sapiens
guacacaucuccagcuauu

SEQ ID NO: 886350 - RNA, 19 nt, Homo sapiens
acaaagacgugcugccuua

SEQ ID NO: 886351 - RNA, 19 nt, Homo sapiens
agccaaagcuucagagaua

SEQ ID NO: 886352 - RNA, 19 nt, Homo sapiens
ggaagaaccgcuacaaaga

SEQ ID NO: 886353 - RNA, 19 nt, Homo sapiens
ggagguagcuaggguauag

SEQ ID NO: 886354 - RNA, 19 nt, Homo sapiens
ggacacgucucugugcaaa

SEQ ID NO: 886355 - RNA, 19 nt, Homo sapiens
ucagauuacuagacagaua

SEQ ID NO: 886356 - RNA, 19 nt, Homo sapiens
ucacacagccugccgagua

SEQ ID NO: 886357 - RNA, 19 nt, Homo sapiens
caagaaagaagaucaggaa

SEQ ID NO: 886358 - RNA, 19 nt, Homo sapiens
gacaugauccuccagauug

SEQ ID NO: 886359 - RNA, 19 nt, Homo sapiens
gggccuggaucaaaguuaa

SEQ ID NO: 886360 - RNA, 19 nt, Homo sapiens
gauggccugucgagagaua

SEQ ID NO: 886361 - RNA, 19 nt, Homo sapiens
gaugugguccuuaagauga

SEQ ID NO: 886362 - RNA, 19 nt, Homo sapiens
gaguacacaucuccagcua

SEQ ID NO: 886363 - RNA, 19 nt, Homo sapiens
ggaucaaaguuaaaguuuc

SEQ ID NO: 886364 - RNA, 19 nt, Homo sapiens
cuagacagauauaaacaga

SEQ ID NO: 886365 - RNA, 19 nt, Homo sapiens
agacagauauaaacagauc

SEQ ID NO: 886366 - RNA, 19 nt, Homo sapiens
ccaccaaccuggacagaca

SEQ ID NO: 886367 - RNA, 19 nt, Homo sapiens
ccaaagugcugagauuaca

SEQ ID NO: 886368 - RNA, 19 nt, Homo sapiens
ggacagacagccaaagcuu

SEQ ID NO: 886369 - RNA, 19 nt, Homo sapiens
gcagacaucaguccacaug

SEQ ID NO: 886370 - RNA, 19 nt, Homo sapiens
ccagagagaccaccaaaca

SEQ ID NO: 886371 - RNA, 19 nt, Homo sapiens
ggacccggguguaagucua

SEQ ID NO: 886372 - RNA, 19 nt, Homo sapiens
caaccagacugaccccuua

SEQ ID NO: 886373 - RNA, 19 nt, Homo sapiens
gaacaucaaagagaauugu

SEQ ID NO: 886374 - RNA, 19 nt, Homo sapiens
ccuaagauuugaaacacuu

SEQ ID NO: 886375 - RNA, 19 nt, Homo sapiens
ccacagccaagcagauuaa

SEQ ID NO: 886376 - RNA, 19 nt, Homo sapiens
gaggaagaaccgcuacaaa

SEQ ID NO: 886377 - RNA, 19 nt, Homo sapiens
cagagaacgugaggaagaa

SEQ ID NO: 886378 - RNA, 19 nt, Homo sapiens
gggacuacaggucuaauuu

SEQ ID NO: 886379 - RNA, 19 nt, Homo sapiens
gcaaaucaggaccuaucua

SEQ ID NO: 886380 - RNA, 19 nt, Homo sapiens
gaacuaagccaggcauaac

SEQ ID NO: 886381 - RNA, 19 nt, Homo sapiens
cagagcagauucaagaaag

SEQ ID NO: 886382 - RNA, 19 nt, Homo sapiens
ccagagaacgugaggaaga

SEQ ID NO: 886383 - RNA, 19 nt, Homo sapiens
cuacgacgaugcccucuuc

SEQ ID NO: 886384 - RNA, 19 nt, Homo sapiens
gauagagaaugggcggaaa

SEQ ID NO: 886385 - RNA, 19 nt, Homo sapiens
cagcaguccugaccacaug

SEQ ID NO: 886386 - RNA, 19 nt, Homo sapiens
cuacauuaauggcaacuuc

SEQ ID NO: 886387 - RNA, 19 nt, Homo sapiens
caaaucaggaccuaucuag

SEQ ID NO: 886388 - RNA, 19 nt, Homo sapiens
aagacgugcugccuuauga

SEQ ID NO: 886389 - RNA, 19 nt, Homo sapiens
ccaaaguccugccggaucu

SEQ ID NO: 886390 - RNA, 19 nt, Homo sapiens
cagaggagcaguacagguu

SEQ ID NO: 886391 - RNA, 19 nt, Homo sapiens
ccaggcacuucucgccaua

SEQ ID NO: 886392 - RNA, 19 nt, Homo sapiens
gccagacucucaucuugau

SEQ ID NO: 886393 - RNA, 19 nt, Homo sapiens
aaggagaaguggcugaaug

SEQ ID NO: 886394 - RNA, 19 nt, Homo sapiens
gaagaaccgcuacaaagac

SEQ ID NO: 886395 - RNA, 19 nt, Homo sapiens
acacagcgacuacauuaau

SEQ ID NO: 886396 - RNA, 19 nt, Homo sapiens
cagacagacuccuaaccaa

SEQ ID NO: 886397 - RNA, 19 nt, Homo sapiens
gggcaugaccccugaguua

SEQ ID NO: 886398 - RNA, 19 nt, Homo sapiens
gaugaucccaccugacuuc

SEQ ID NO: 886399 - RNA, 19 nt, Homo sapiens
cggccagacucucaucuug

SEQ ID NO: 886400 - RNA, 19 nt, Homo sapiens
gauauacagaguucucaga

SEQ ID NO: 886401 - RNA, 19 nt, Homo sapiens
gagcagauucaagaaagaa

SEQ ID NO: 886402 - RNA, 19 nt, Homo sapiens
gcagauucaagaaagaaga

SEQ ID NO: 886403 - RNA, 19 nt, Homo sapiens
gcuccacacuccagaaugc

SEQ ID NO: 886404 - RNA, 19 nt, Homo sapiens
gucgagagauagagaaugg

SEQ ID NO: 886405 - RNA, 19 nt, Homo sapiens
agagagaccaccaaacaga

SEQ ID NO: 886406 - RNA, 19 nt, Homo sapiens
ggccagagaacgugaggaa

SEQ ID NO: 886407 - RNA, 19 nt, Homo sapiens
uaccagaacaucaaagaga

SEQ ID NO: 886408 - RNA, 19 nt, Homo sapiens
ggagucccguucuguguac

SEQ ID NO: 886409 - RNA, 19 nt, Homo sapiens
ccaaaugaguacacaucuc

SEQ ID NO: 886410 - RNA, 19 nt, Homo sapiens
ccacacagcacuaguccau

SEQ ID NO: 886411 - RNA, 19 nt, Homo sapiens
ggaaacagugggccuggau

SEQ ID NO: 886412 - RNA, 19 nt, Homo sapiens
ucuuugaugugguccuuaa

SEQ ID NO: 886413 - RNA, 19 nt, Homo sapiens
cacagcgacuacauuaaug

SEQ ID NO: 886414 - RNA, 19 nt, Homo sapiens
ggaagccuggccuacauug

SEQ ID NO: 886415 - RNA, 19 nt, Homo sapiens
ccagauaggcagacagaca

SEQ ID NO: 886416 - RNA, 19 nt, Homo sapiens
acacaucuccagcuauuca

SEQ ID NO: 886417 - RNA, 19 nt, Homo sapiens
acaugauccuccagauuga

SEQ ID NO: 886418 - RNA, 19 nt, Homo sapiens
cagcaaaucaggaccuauc

SEQ ID NO: 886419 - RNA, 19 nt, Homo sapiens
cugauggccugucgagaga

SEQ ID NO: 886420 - RNA, 19 nt, Homo sapiens
ucacucugauaaaggagaa

SEQ ID NO: 886421 - RNA, 19 nt, Homo sapiens
ggacuacaggucuaauuuu

SEQ ID NO: 886422 - RNA, 19 nt, Homo sapiens
agacaugauccuccagauu

SEQ ID NO: 886423 - RNA, 19 nt, Homo sapiens
guaagucuaacgccaguuc

SEQ ID NO: 886424 - RNA, 19 nt, Homo sapiens
accagaacaucaaagagaa

SEQ ID NO: 886425 - RNA, 19 nt, Homo sapiens
caugguaggguuccugcua

SEQ ID NO: 886426 - RNA, 19 nt, Homo sapiens
ggccagacucucaucuuga

SEQ ID NO: 886427 - RNA, 19 nt, Homo sapiens
cagauuacuagacagauau

SEQ ID NO: 886428 - RNA, 19 nt, Homo sapiens
uaaaggagaaguggcugaa

SEQ ID NO: 886429 - RNA, 19 nt, Homo sapiens
gaacucccaaccucaagca

SEQ ID NO: 886430 - RNA, 19 nt, Homo sapiens
cugaacagauauacagagu

SEQ ID NO: 886431 - RNA, 19 nt, Homo sapiens
cugcuaggauaaaacauua

SEQ ID NO: 886432 - RNA, 19 nt, Homo sapiens
cacauggaauccugacauc

SEQ ID NO: 886433 - RNA, 19 nt, Homo sapiens
agagcagauucaagaaaga

SEQ ID NO: 886434 - RNA, 19 nt, Homo sapiens
ccuacgcgguggugcagaa

SEQ ID NO: 886435 - RNA, 19 nt, Homo sapiens
gacacagcgacuacauuaa

SEQ ID NO: 886436 - RNA, 19 nt, Homo sapiens
ccacuaccagaacaucaaa

SEQ ID NO: 886437 - RNA, 19 nt, Homo sapiens
caaggucacauuccagaag

SEQ ID NO: 886438 - RNA, 19 nt, Homo sapiens
gauggaagccuggccuaca

SEQ ID NO: 886439 - RNA, 19 nt, Homo sapiens
ccacauggaauccugacau

SEQ ID NO: 886440 - RNA, 19 nt, Homo sapiens
ccagacagacuccuaacca

SEQ ID NO: 886441 - RNA, 19 nt, Homo sapiens
acagagcagauucaagaaa

SEQ ID NO: 886442 - RNA, 19 nt, Homo sapiens
gaggagguagcuaggguau

SEQ ID NO: 886443 - RNA, 19 nt, Homo sapiens
uaugaucagacgcgaguaa

SEQ ID NO: 886444 - RNA, 19 nt, Homo sapiens
cagaacaucaaagagaauu

SEQ ID NO: 886445 - RNA, 19 nt, Homo sapiens
cacgguggcucagauguuc

SEQ ID NO: 886446 - RNA, 19 nt, Homo sapiens
agaacuaagccaggcauaa

SEQ ID NO: 886447 - RNA, 19 nt, Homo sapiens
ucaaagaggucccgaggaa

SEQ ID NO: 886448 - RNA, 19 nt, Homo sapiens
guaugaaguuuccaucuga

SEQ ID NO: 886449 - RNA, 19 nt, Homo sapiens
gcaguggcguuuacaucua

SEQ ID NO: 886450 - RNA, 19 nt, Homo sapiens
uaugagggcuuugagcuua

SEQ ID NO: 886451 - RNA, 19 nt, Homo sapiens
acaccaagcuucagggaaa

SEQ ID NO: 886452 - RNA, 19 nt, Homo sapiens
ccaaaugcgccuugaagua

SEQ ID NO: 886453 - RNA, 19 nt, Homo sapiens
gcccaguucuguguaauaa

SEQ ID NO: 886454 - RNA, 19 nt, Homo sapiens
gcuccgacauucucacuug

SEQ ID NO: 886455 - RNA, 19 nt, Homo sapiens
gcuccaaguugagauauug

SEQ ID NO: 886456 - RNA, 19 nt, Homo sapiens
cgacaacuguuaccacuac

SEQ ID NO: 886457 - RNA, 19 nt, Homo sapiens
ccaaugccaucgaaugugu

SEQ ID NO: 886458 - RNA, 19 nt, Homo sapiens
gcuguuaagccuucgauuu

SEQ ID NO: 886459 - RNA, 19 nt, Homo sapiens
ccaguucuguguaauaaca

SEQ ID NO: 886460 - RNA, 19 nt, Homo sapiens
gcagccagauuacuuagag

SEQ ID NO: 886461 - RNA, 19 nt, Homo sapiens
gaaggaggaggagauauug

SEQ ID NO: 886462 - RNA, 19 nt, Homo sapiens
gagauccuacaguaaauaa

SEQ ID NO: 886463 - RNA, 19 nt, Homo sapiens
gcacuuacagcauccaugu

SEQ ID NO: 886464 - RNA, 19 nt, Homo sapiens
gccaaaagaucaugacuug

SEQ ID NO: 886465 - RNA, 19 nt, Homo sapiens
ggagauccuacaguaaaua

SEQ ID NO: 886466 - RNA, 19 nt, Homo sapiens
ccucuaggcuuggucauug

SEQ ID NO: 886467 - RNA, 19 nt, Homo sapiens
ugaaggaggaggagauauu

SEQ ID NO: 886468 - RNA, 19 nt, Homo sapiens
ucucgugccucccaggaua

SEQ ID NO: 886469 - RNA, 19 nt, Homo sapiens
guuaagccuucgauuugaa

SEQ ID NO: 886470 - RNA, 19 nt, Homo sapiens
gaucuaugauucggacaug

SEQ ID NO: 886471 - RNA, 19 nt, Homo sapiens
cagccaugcucaccugcua

SEQ ID NO: 886472 - RNA, 19 nt, Homo sapiens
caaaugcgccuugaaguac

SEQ ID NO: 886473 - RNA, 19 nt, Homo sapiens
acacccaaguggagcgaua

SEQ ID NO: 886474 - RNA, 19 nt, Homo sapiens
gcuucaggauccacuauca

SEQ ID NO: 886475 - RNA, 19 nt, Homo sapiens
ccagcccaguucuguguaa

SEQ ID NO: 886476 - RNA, 19 nt, Homo sapiens
gggacaugcugacgcuguu

SEQ ID NO: 886477 - RNA, 19 nt, Homo sapiens
cccuggagauccuacagua

SEQ ID NO: 886478 - RNA, 19 nt, Homo sapiens
gggccagggcuucguauug

SEQ ID NO: 886479 - RNA, 19 nt, Homo sapiens
caaguugagauauugaaug

SEQ ID NO: 886480 - RNA, 19 nt, Homo sapiens
ccacggacccugaguaucg

SEQ ID NO: 886481 - RNA, 19 nt, Homo sapiens
ggacaaugaccggcugaug

SEQ ID NO: 886482 - RNA, 19 nt, Homo sapiens
ggcccuggcugaacugcuu

SEQ ID NO: 886483 - RNA, 19 nt, Homo sapiens
cucccuggcuguguaaaua

SEQ ID NO: 886484 - RNA, 19 nt, Homo sapiens
gcgagucucugcgcuucuu

SEQ ID NO: 886485 - RNA, 19 nt, Homo sapiens
gcugcuaggcuccgacauu

SEQ ID NO: 886486 - RNA, 19 nt, Homo sapiens
ccuccucccuggcugugua

SEQ ID NO: 886487 - RNA, 19 nt, Homo sapiens
ggucggagacggaggaaag

SEQ ID NO: 886488 - RNA, 19 nt, Homo sapiens
caaaagaucaugacuugug

SEQ ID NO: 886489 - RNA, 19 nt, Homo sapiens
uaugaaguuuccaucugaa

SEQ ID NO: 886490 - RNA, 19 nt, Homo sapiens
gaccagcccaguucugugu

SEQ ID NO: 886491 - RNA, 19 nt, Homo sapiens
gauccuacaguaaauaaac

SEQ ID NO: 886492 - RNA, 19 nt, Homo sapiens
cuggagauccuacaguaaa

SEQ ID NO: 886493 - RNA, 19 nt, Homo sapiens
gcgauaggguccccaaaug

SEQ ID NO: 886494 - RNA, 19 nt, Homo sapiens
acguggagcugcugucaga

SEQ ID NO: 886495 - RNA, 19 nt, Homo sapiens
ggccagggcuucguauugc

SEQ ID NO: 886496 - RNA, 19 nt, Homo sapiens
ccacagaaccccacuggaa

SEQ ID NO: 886497 - RNA, 19 nt, Homo sapiens
uguuaagccuucgauuuga

SEQ ID NO: 886498 - RNA, 19 nt, Homo sapiens
gcuaccagacgcuguacaa

SEQ ID NO: 886499 - RNA, 19 nt, Homo sapiens
cuguuaagccuucgauuug

SEQ ID NO: 886500 - RNA, 19 nt, Homo sapiens
uggagauccuacaguaaau

SEQ ID NO: 886501 - RNA, 19 nt, Homo sapiens
gcacguccaggaagagaag

SEQ ID NO: 886502 - RNA, 19 nt, Homo sapiens
aguaugaaguuuccaucug

SEQ ID NO: 886503 - RNA, 19 nt, Homo sapiens
cugcuaggcuccgacauuc

SEQ ID NO: 886504 - RNA, 19 nt, Homo sapiens
gcgugcacguccaggaaga

SEQ ID NO: 886505 - RNA, 19 nt, Homo sapiens
cgaaggguauguggagucu

SEQ ID NO: 886506 - RNA, 19 nt, Homo sapiens
gagacgacgaccaccauca

SEQ ID NO: 886507 - RNA, 19 nt, Homo sapiens
ccagaccacagauccauca

SEQ ID NO: 886508 - RNA, 19 nt, Homo sapiens
gagaggcacagaggagaga

SEQ ID NO: 886509 - RNA, 19 nt, Homo sapiens
cgaccucacacugcaguuu

SEQ ID NO: 886510 - RNA, 19 nt, Homo sapiens
gcguuuacaucuacuacac

SEQ ID NO: 886511 - RNA, 19 nt, Homo sapiens
accagacgcuguacaagca

SEQ ID NO: 886512 - RNA, 19 nt, Homo sapiens
ggccaacucauccaugcuu

SEQ ID NO: 886513 - RNA, 19 nt, Homo sapiens
acccucaucugccucaaug

SEQ ID NO: 886514 - RNA, 19 nt, Homo sapiens
caaccaaccggcugcuucu

SEQ ID NO: 886515 - RNA, 19 nt, Homo sapiens
caucugaaccccaagacua

SEQ ID NO: 886516 - RNA, 19 nt, Homo sapiens
gccagugggaccugucuug

SEQ ID NO: 886517 - RNA, 19 nt, Homo sapiens
gaccucacacugcaguuuc

SEQ ID NO: 886518 - RNA, 19 nt, Homo sapiens
caccugccguugggucauu

SEQ ID NO: 886519 - RNA, 19 nt, Homo sapiens
ggcaguggcguuuacaucu

SEQ ID NO: 886520 - RNA, 19 nt, Homo sapiens
cagccagauuacuuagaga

SEQ ID NO: 886521 - RNA, 19 nt, Homo sapiens
ccaaguugagauauugaau

SEQ ID NO: 886522 - RNA, 19 nt, Homo sapiens
cuaccacggacccugagua

SEQ ID NO: 886523 - RNA, 19 nt, Homo sapiens
ccugaaggaggaggagaua

SEQ ID NO: 886524 - RNA, 19 nt, Homo sapiens
cuucugcuaugagggcuuu

SEQ ID NO: 886525 - RNA, 19 nt, Homo sapiens
aaagaaagcuacagaagaa

SEQ ID NO: 886526 - RNA, 19 nt, Homo sapiens
ggaugaaucugaccucuau

SEQ ID NO: 886527 - RNA, 19 nt, Homo sapiens
ugaccaagcugcagaauuc

SEQ ID NO: 886528 - RNA, 19 nt, Homo sapiens
agacagagcuggagaugag

SEQ ID NO: 886529 - RNA, 19 nt, Homo sapiens
gaaagcagagacagacaaa

SEQ ID NO: 886530 - RNA, 19 nt, Homo sapiens
agacaaagcguuaggagaa

SEQ ID NO: 886531 - RNA, 19 nt, Homo sapiens
gacacuacacccagcaaua

SEQ ID NO: 886532 - RNA, 19 nt, Homo sapiens
ggaaaggucgcaccaagag

SEQ ID NO: 886533 - RNA, 19 nt, Homo sapiens
cagcaacaauaaauagaca

SEQ ID NO: 886534 - RNA, 19 nt, Homo sapiens
ggaaagcagagacagacaa

SEQ ID NO: 886535 - RNA, 19 nt, Homo sapiens
agagacagacaaagcguua

SEQ ID NO: 886536 - RNA, 19 nt, Homo sapiens
caggguggcagcaacaaua

SEQ ID NO: 886537 - RNA, 19 nt, Homo sapiens
ggagugagaggcugggaau

SEQ ID NO: 886538 - RNA, 19 nt, Homo sapiens
ucuauagccuggcccauuc

SEQ ID NO: 886539 - RNA, 19 nt, Homo sapiens
gaaaagaaagcuacagaag

SEQ ID NO: 886540 - RNA, 19 nt, Homo sapiens
gugagaggcugggaaugga

SEQ ID NO: 886541 - RNA, 19 nt, Homo sapiens
gaaaggucgcaccaagaga

SEQ ID NO: 886542 - RNA, 19 nt, Homo sapiens
gacaaagcguuaggagaag

SEQ ID NO: 886543 - RNA, 19 nt, Homo sapiens
gaaagcuacagaagaaacu

SEQ ID NO: 886544 - RNA, 19 nt, Homo sapiens
gguggcagcaacaauaaau

SEQ ID NO: 886545 - RNA, 19 nt, Homo sapiens
gggcagagccaggaagauc

SEQ ID NO: 886546 - RNA, 19 nt, Homo sapiens
agacgggacugcggaggaa

SEQ ID NO: 886547 - RNA, 19 nt, Homo sapiens
gaagagaggcagggaagac

SEQ ID NO: 886548 - RNA, 19 nt, Homo sapiens
gaugaggccagaccaugga

SEQ ID NO: 886549 - RNA, 19 nt, Homo sapiens
acaaagcguuaggagaaga

SEQ ID NO: 886550 - RNA, 19 nt, Homo sapiens
cagcuuggguguguguuca

SEQ ID NO: 886551 - RNA, 19 nt, Homo sapiens
ggccagaccauggacacua

SEQ ID NO: 886552 - RNA, 19 nt, Homo sapiens
caaagcguuaggagaagaa

SEQ ID NO: 886553 - RNA, 19 nt, Homo sapiens
ggaggacccaggacaggau

SEQ ID NO: 886554 - RNA, 19 nt, Homo sapiens
ggacacuacacccagcaau

SEQ ID NO: 886555 - RNA, 19 nt, Homo sapiens
gccagaccauggacacuac

SEQ ID NO: 886556 - RNA, 19 nt, Homo sapiens
ccaagcugcagaauucaga

SEQ ID NO: 886557 - RNA, 19 nt, Homo sapiens
ccaggaaagcagagacaga

SEQ ID NO: 886558 - RNA, 19 nt, Homo sapiens
guguguucauccuuguuaa

SEQ ID NO: 886559 - RNA, 19 nt, Homo sapiens
guggcagcaacaauaaaua

SEQ ID NO: 886560 - RNA, 19 nt, Homo sapiens
uguguguucauccuuguua

SEQ ID NO: 886561 - RNA, 19 nt, Homo sapiens
gcagcaacaauaaauagac

SEQ ID NO: 886562 - RNA, 19 nt, Homo sapiens
acacuacacccagcaauag

SEQ ID NO: 886563 - RNA, 19 nt, Homo sapiens
gguguguguucauccuugu

SEQ ID NO: 886564 - RNA, 19 nt, Homo sapiens
gagacagagcuggagauga

SEQ ID NO: 886565 - RNA, 19 nt, Homo sapiens
ggcagcaacaauaaauaga

SEQ ID NO: 886566 - RNA, 19 nt, Homo sapiens
aaaagaaagcuacagaaga

SEQ ID NO: 886567 - RNA, 19 nt, Homo sapiens
cggaaaggucgcaccaaga

SEQ ID NO: 886568 - RNA, 19 nt, Homo sapiens
caggcacgauggccaccuu

SEQ ID NO: 886569 - RNA, 19 nt, Homo sapiens
ggagaugaggccagaccau

SEQ ID NO: 886570 - RNA, 19 nt, Homo sapiens
gagaagcugcugccaacac

SEQ ID NO: 886571 - RNA, 19 nt, Homo sapiens
gaaggucaccgucaaguau

SEQ ID NO: 886572 - RNA, 19 nt, Homo sapiens
ccacagaggccuucauuuc

SEQ ID NO: 886573 - RNA, 19 nt, Homo sapiens
ggaagcgccucaaccuaga

SEQ ID NO: 886574 - RNA, 19 nt, Homo sapiens
ggaaggucaccgucaagua

SEQ ID NO: 886575 - RNA, 19 nt, Homo sapiens
ccucguagcaacagcaaua

SEQ ID NO: 886576 - RNA, 19 nt, Homo sapiens
ccacgcgucuacuuucaga

SEQ ID NO: 886577 - RNA, 19 nt, Homo sapiens
gaccacgcgucuacuuuca

SEQ ID NO: 886578 - RNA, 19 nt, Homo sapiens
ggaagaggagaucccagaa

SEQ ID NO: 886579 - RNA, 19 nt, Homo sapiens
ggaccacgcgucuacuuuc

SEQ ID NO: 886580 - RNA, 19 nt, Homo sapiens
ggauacgccuuuggugcaa

SEQ ID NO: 886581 - RNA, 19 nt, Homo sapiens
ggacauggagagugacgau

SEQ ID NO: 886582 - RNA, 19 nt, Homo sapiens
gcugguugacuguuacaaa

SEQ ID NO: 886583 - RNA, 19 nt, Homo sapiens
aagaggagaucccagaacu

SEQ ID NO: 886584 - RNA, 19 nt, Homo sapiens
gaagaggagaucccagaac

SEQ ID NO: 886585 - RNA, 19 nt, Homo sapiens
aagggaaggucaccgucaa

SEQ ID NO: 886586 - RNA, 19 nt, Homo sapiens
gcuaggauacgccuuuggu

SEQ ID NO: 886587 - RNA, 19 nt, Homo sapiens
cacagaggccuucauuucu

SEQ ID NO: 886588 - RNA, 19 nt, Homo sapiens
ggucaaggagcugcugguu

SEQ ID NO: 886589 - RNA, 19 nt, Homo sapiens
ccucuacgacugccaggaa

SEQ ID NO: 886590 - RNA, 19 nt, Homo sapiens
uuucuggccugcuggacaa

SEQ ID NO: 886591 - RNA, 19 nt, Homo sapiens
gaauugaucuucaucuuca

SEQ ID NO: 886592 - RNA, 19 nt, Homo sapiens
ucaaugaaauccugacuuu

SEQ ID NO: 886593 - RNA, 19 nt, Homo sapiens
gaaauaaagaggucaaaga

SEQ ID NO: 886594 - RNA, 19 nt, Homo sapiens
guauacacccugagaaaua

SEQ ID NO: 886595 - RNA, 19 nt, Homo sapiens
gaacuuuacucucaucacu

SEQ ID NO: 886596 - RNA, 19 nt, Homo sapiens
gcaagugacaucuguauuc

SEQ ID NO: 886597 - RNA, 19 nt, Homo sapiens
ucacagcaaugggauauga

SEQ ID NO: 886598 - RNA, 19 nt, Homo sapiens
caagauugcuucaguugag

SEQ ID NO: 886599 - RNA, 19 nt, Homo sapiens
gaacaugaccagcugaucu

SEQ ID NO: 886600 - RNA, 19 nt, Homo sapiens
uaacgcaagugacaucugu

SEQ ID NO: 886601 - RNA, 19 nt, Homo sapiens
caagugacaucuguauuca

SEQ ID NO: 886602 - RNA, 19 nt, Homo sapiens
uauacacccugagaaauaa

SEQ ID NO: 886603 - RNA, 19 nt, Homo sapiens
guauauacauuggucauuc

SEQ ID NO: 886604 - RNA, 19 nt, Homo sapiens
ucucaucacugacuuuguu

SEQ ID NO: 886605 - RNA, 19 nt, Homo sapiens
ugacaucuguauucagguu

SEQ ID NO: 886606 - RNA, 19 nt, Homo sapiens
aaugaaauccugacuuuga

SEQ ID NO: 886607 - RNA, 19 nt, Homo sapiens
cuacagcugugccuccauu

SEQ ID NO: 886608 - RNA, 19 nt, Homo sapiens
gguaugagccagcccaugu

SEQ ID NO: 886609 - RNA, 19 nt, Homo sapiens
cuauacaucuuaaccuuag

SEQ ID NO: 886610 - RNA, 19 nt, Homo sapiens
gagcagcagaucacccuuu

SEQ ID NO: 886611 - RNA, 19 nt, Homo sapiens
ugaugaagcucuccugcau

SEQ ID NO: 886612 - RNA, 19 nt, Homo sapiens
gcguguuccuugcacuaua

SEQ ID NO: 886613 - RNA, 19 nt, Homo sapiens
gaccuacacugucaucacu

SEQ ID NO: 886614 - RNA, 19 nt, Homo sapiens
ccacuucagagacuguaua

SEQ ID NO: 886615 - RNA, 19 nt, Homo sapiens
ccgaauugaucuucaucuu

SEQ ID NO: 886616 - RNA, 19 nt, Homo sapiens
ccucaagauugcuucaguu

SEQ ID NO: 886617 - RNA, 19 nt, Homo sapiens
guaccuaugggucugguuu

SEQ ID NO: 886618 - RNA, 19 nt, Homo sapiens
augaagcucuccugcauug

SEQ ID NO: 886619 - RNA, 19 nt, Homo sapiens
gagaacaccagagaacaug

SEQ ID NO: 886620 - RNA, 19 nt, Homo sapiens
cacuauacaucuuaaccuu

SEQ ID NO: 886621 - RNA, 19 nt, Homo sapiens
cuucagagacuguauauac

SEQ ID NO: 886622 - RNA, 19 nt, Homo sapiens
ucagugugcuggugcuugu

SEQ ID NO: 886623 - RNA, 19 nt, Homo sapiens
ugagcaugcuguccacuuc

SEQ ID NO: 886624 - RNA, 19 nt, Homo sapiens
acacacccauguacuucuu

SEQ ID NO: 886625 - RNA, 19 nt, Homo sapiens
acaccacugucaaugaaau

SEQ ID NO: 886626 - RNA, 19 nt, Homo sapiens
guauucagguuacccuucu

SEQ ID NO: 886627 - RNA, 19 nt, Homo sapiens
guagcaauaacgcaaguga

SEQ ID NO: 886628 - RNA, 19 nt, Homo sapiens
aaugggauaugaccgcuau

SEQ ID NO: 886629 - RNA, 19 nt, Homo sapiens
ugagccagcccaugucauu

SEQ ID NO: 886630 - RNA, 19 nt, Homo sapiens
cgaauugaucuucaucuuc

SEQ ID NO: 886631 - RNA, 19 nt, Homo sapiens
ucucuacaauccucaagau

SEQ ID NO: 886632 - RNA, 19 nt, Homo sapiens
gaugaagcucuccugcauu

SEQ ID NO: 886633 - RNA, 19 nt, Homo sapiens
gagauacaugguuauuaug

SEQ ID NO: 886634 - RNA, 19 nt, Homo sapiens
acuuuacucucaucacuga

SEQ ID NO: 886635 - RNA, 19 nt, Homo sapiens
caauaacgcaagugacauc

SEQ ID NO: 886636 - RNA, 19 nt, Homo sapiens
gcucacagcaaugggauau

SEQ ID NO: 886637 - RNA, 19 nt, Homo sapiens
gggaaccaauccaugaaaa

SEQ ID NO: 886638 - RNA, 19 nt, Homo sapiens
gagaaauaaagaggucaaa

SEQ ID NO: 886639 - RNA, 19 nt, Homo sapiens
gguauacacccugagaaau

SEQ ID NO: 886640 - RNA, 19 nt, Homo sapiens
cuacugaacccugugguau

SEQ ID NO: 886641 - RNA, 19 nt, Homo sapiens
gaaccaauccaugaaaaga

SEQ ID NO: 886642 - RNA, 19 nt, Homo sapiens
gaggcugcguauccaacuu

SEQ ID NO: 886643 - RNA, 19 nt, Homo sapiens
gaacaagaggcugcguauc

SEQ ID NO: 886644 - RNA, 19 nt, Homo sapiens
ugaacaagaggcugcguau

SEQ ID NO: 886645 - RNA, 19 nt, Homo sapiens
uaaccuuuggcaucacuaa

SEQ ID NO: 886646 - RNA, 19 nt, Homo sapiens
gugaccaucauccgaauug

SEQ ID NO: 886647 - RNA, 19 nt, Homo sapiens
gaaaggugccccacuucuu

SEQ ID NO: 886648 - RNA, 19 nt, Homo sapiens
uacugaacccugugguaua

SEQ ID NO: 886649 - RNA, 19 nt, Homo sapiens
gaagcucuccugcauugac

SEQ ID NO: 886650 - RNA, 19 nt, Homo sapiens
ucuccagccucguagguau

SEQ ID NO: 886651 - RNA, 19 nt, Homo sapiens
caucuucacacacccaugu

SEQ ID NO: 886652 - RNA, 19 nt, Homo sapiens
gaacaccagagaacaugac

SEQ ID NO: 886653 - RNA, 19 nt, Homo sapiens
ucagagaacaccagagaac

SEQ ID NO: 886654 - RNA, 19 nt, Homo sapiens
agucagagaacaccagaga

SEQ ID NO: 886655 - RNA, 19 nt, Homo sapiens
cucauuaucucuacaaucc

SEQ ID NO: 886656 - RNA, 19 nt, Homo sapiens
ugugacauccgcccuguga

SEQ ID NO: 886657 - RNA, 19 nt, Homo sapiens
gacaucuguauucagguua

SEQ ID NO: 886658 - RNA, 19 nt, Homo sapiens
ccccugagauacaugguua

SEQ ID NO: 886659 - RNA, 19 nt, Homo sapiens
ucacacacccauguacuuc

SEQ ID NO: 886660 - RNA, 19 nt, Homo sapiens
cauccgaauugaucuucau

SEQ ID NO: 886661 - RNA, 19 nt, Homo sapiens
gagaacaugaccagcugau

SEQ ID NO: 886662 - RNA, 19 nt, Homo sapiens
gugcaucccaccucacugu

SEQ ID NO: 886663 - RNA, 19 nt, Homo sapiens
cuagaaaggugccccacuu

SEQ ID NO: 886664 - RNA, 19 nt, Homo sapiens
gcaauaacgcaagugacau

SEQ ID NO: 886665 - RNA, 19 nt, Homo sapiens
acaagaggcugcguaucca

SEQ ID NO: 886666 - RNA, 19 nt, Homo sapiens
uuuguaaccuuuggcauca

SEQ ID NO: 886667 - RNA, 19 nt, Homo sapiens
gcuguccacuucagagacu

SEQ ID NO: 886668 - RNA, 19 nt, Homo sapiens
aauaaagaggucaaagaug

SEQ ID NO: 886669 - RNA, 19 nt, Homo sapiens
cugagauacaugguuauua

SEQ ID NO: 886670 - RNA, 19 nt, Homo sapiens
ugaccaucauccgaauuga

SEQ ID NO: 886671 - RNA, 19 nt, Homo sapiens
ugguauacacccugagaaa

SEQ ID NO: 886672 - RNA, 19 nt, Homo sapiens
gcacuauacaucuuaaccu

SEQ ID NO: 886673 - RNA, 19 nt, Homo sapiens
agguuacccuucugugcua

SEQ ID NO: 886674 - RNA, 19 nt, Homo sapiens
gcuauguggccaucugcaa

SEQ ID NO: 886675 - RNA, 19 nt, Homo sapiens
gagcaugcuguccacuuca

SEQ ID NO: 886676 - RNA, 19 nt, Homo sapiens
ccacuucuucugugacauc

SEQ ID NO: 886677 - RNA, 19 nt, Homo sapiens
gggauaugaccgcuaugug

SEQ ID NO: 886678 - RNA, 19 nt, Homo sapiens
aaccuuagcaggcaauauc

SEQ ID NO: 886679 - RNA, 19 nt, Homo sapiens
caaugaaauccugacuuug

SEQ ID NO: 886680 - RNA, 19 nt, Homo sapiens
gagccagcccaugucauug

SEQ ID NO: 886681 - RNA, 19 nt, Homo sapiens
caaaguugcucuaaagaaa

SEQ ID NO: 886682 - RNA, 19 nt, Homo sapiens
ugaaugagcuuguaguguu

SEQ ID NO: 886683 - RNA, 19 nt, Homo sapiens
caaggugucuucccuauuc

SEQ ID NO: 886684 - RNA, 19 nt, Homo sapiens
gaauaaggacgucaaaguu

SEQ ID NO: 886685 - RNA, 19 nt, Homo sapiens
gaaugagcuuguaguguuu

SEQ ID NO: 886686 - RNA, 19 nt, Homo sapiens
ccaauaaccuugucaacca

SEQ ID NO: 886687 - RNA, 19 nt, Homo sapiens
ugacucagcucuucuucuu

SEQ ID NO: 886688 - RNA, 19 nt, Homo sapiens
ggaauaaggacgucaaagu

SEQ ID NO: 886689 - RNA, 19 nt, Homo sapiens
gcugaugagcuuugucuua

SEQ ID NO: 886690 - RNA, 19 nt, Homo sapiens
ugauaaggcucaacucuca

SEQ ID NO: 886691 - RNA, 19 nt, Homo sapiens
ccacauaauugcaguuucu

SEQ ID NO: 886692 - RNA, 19 nt, Homo sapiens
cugaugagcuuugucuuaa

SEQ ID NO: 886693 - RNA, 19 nt, Homo sapiens
cgucaaaguugcucuaaag

SEQ ID NO: 886694 - RNA, 19 nt, Homo sapiens
gcucaacccauuaauuuau

SEQ ID NO: 886695 - RNA, 19 nt, Homo sapiens
cagcucuucuucuuucuuu

SEQ ID NO: 886696 - RNA, 19 nt, Homo sapiens
uaacuuguccuucauagau

SEQ ID NO: 886697 - RNA, 19 nt, Homo sapiens
ugucagcaauggcguauga

SEQ ID NO: 886698 - RNA, 19 nt, Homo sapiens
ccacacagcgugcaugaug

SEQ ID NO: 886699 - RNA, 19 nt, Homo sapiens
gagcauucauguaccucaa

SEQ ID NO: 886700 - RNA, 19 nt, Homo sapiens
ggcaaggugucuucccuau

SEQ ID NO: 886701 - RNA, 19 nt, Homo sapiens
gcuauguggccaucuguaa

SEQ ID NO: 886702 - RNA, 19 nt, Homo sapiens
gagcuuguaguguuuguug

SEQ ID NO: 886703 - RNA, 19 nt, Homo sapiens
guaacccacuguuguacau

SEQ ID NO: 886704 - RNA, 19 nt, Homo sapiens
ucaaaguugcucuaaagaa

SEQ ID NO: 886705 - RNA, 19 nt, Homo sapiens
ggucaggagcauucaugua

SEQ ID NO: 886706 - RNA, 19 nt, Homo sapiens
auuuauagccugaggaaua

SEQ ID NO: 886707 - RNA, 19 nt, Homo sapiens
uaauugcaguuucucuguu

SEQ ID NO: 886708 - RNA, 19 nt, Homo sapiens
ggacgucaaaguugcucua

SEQ ID NO: 886709 - RNA, 19 nt, Homo sapiens
acucagcucuucuucuuuc

SEQ ID NO: 886710 - RNA, 19 nt, Homo sapiens
gcaaggugucuucccuauu

SEQ ID NO: 886711 - RNA, 19 nt, Homo sapiens
cugcagcucccacauaauu

SEQ ID NO: 886712 - RNA, 19 nt, Homo sapiens
uccagcaucuuccacauug

SEQ ID NO: 886713 - RNA, 19 nt, Homo sapiens
aauaaggacgucaaaguug

SEQ ID NO: 886714 - RNA, 19 nt, Homo sapiens
ccaaaaugcugaugagcuu

SEQ ID NO: 886715 - RNA, 19 nt, Homo sapiens
caaacccuuuucucuuuua

SEQ ID NO: 886716 - RNA, 19 nt, Homo sapiens
acagucaccaucuucauuu

SEQ ID NO: 886717 - RNA, 19 nt, Homo sapiens
ugaugagcuuugucuuaaa

SEQ ID NO: 886718 - RNA, 19 nt, Homo sapiens
gaauuccuccuucgugaca

SEQ ID NO: 886719 - RNA, 19 nt, Homo sapiens
gggaaccugggcuugauaa

SEQ ID NO: 886720 - RNA, 19 nt, Homo sapiens
augcucaacccauuaauuu

SEQ ID NO: 886721 - RNA, 19 nt, Homo sapiens
gcccaugcucaacccauua

SEQ ID NO: 886722 - RNA, 19 nt, Homo sapiens
ugucuucccuauucuauac

SEQ ID NO: 886723 - RNA, 19 nt, Homo sapiens
gcaccagcaccuaugugaa

SEQ ID NO: 886724 - RNA, 19 nt, Homo sapiens
gaccuucugugccaauaac

SEQ ID NO: 886725 - RNA, 19 nt, Homo sapiens
agaagaacagcaucuccua

SEQ ID NO: 886726 - RNA, 19 nt, Homo sapiens
gaggaauaaggacgucaaa

SEQ ID NO: 886727 - RNA, 19 nt, Homo sapiens
uaauuuauagccugaggaa

SEQ ID NO: 886728 - RNA, 19 nt, Homo sapiens
caguuucucuguucuuugg

SEQ ID NO: 886729 - RNA, 19 nt, Homo sapiens
caccagcaccuaugugaau

SEQ ID NO: 886730 - RNA, 19 nt, Homo sapiens
uauaacuuguccuucauag

SEQ ID NO: 886731 - RNA, 19 nt, Homo sapiens
cuauguacuucuuccucua

SEQ ID NO: 886732 - RNA, 19 nt, Homo sapiens
cauuuccuaugcucucauu

SEQ ID NO: 886733 - RNA, 19 nt, Homo sapiens
gcauucauguaccucaaac

SEQ ID NO: 886734 - RNA, 19 nt, Homo sapiens
gcuucuacguggucacugu

SEQ ID NO: 886735 - RNA, 19 nt, Homo sapiens
cuaugugaaugagcuugua

SEQ ID NO: 886736 - RNA, 19 nt, Homo sapiens
guguaugacucagcucuuc

SEQ ID NO: 886737 - RNA, 19 nt, Homo sapiens
uguacuucuuccucuauaa

SEQ ID NO: 886738 - RNA, 19 nt, Homo sapiens
accugcagcucccacauaa

SEQ ID NO: 886739 - RNA, 19 nt, Homo sapiens
caccugcagcucccacaua

SEQ ID NO: 886740 - RNA, 19 nt, Homo sapiens
ucaccaucuucauuuccua

SEQ ID NO: 886741 - RNA, 19 nt, Homo sapiens
guugugggcauugauauug

SEQ ID NO: 886742 - RNA, 19 nt, Homo sapiens
ucuguaacccacuguugua

SEQ ID NO: 886743 - RNA, 19 nt, Homo sapiens
caugcucaacccauuaauu

SEQ ID NO: 886744 - RNA, 19 nt, Homo sapiens
cacagucaccaucuucauu

SEQ ID NO: 886745 - RNA, 19 nt, Homo sapiens
guuguugugggcauugaua

SEQ ID NO: 886746 - RNA, 19 nt, Homo sapiens
gcaguuucucuguucuuug

SEQ ID NO: 886747 - RNA, 19 nt, Homo sapiens
cucuauaacuuguccuuca

SEQ ID NO: 886748 - RNA, 19 nt, Homo sapiens
cucaaacccuuuucucuuu

SEQ ID NO: 886749 - RNA, 19 nt, Homo sapiens
ugcaguuucucuguucuuu

SEQ ID NO: 886750 - RNA, 19 nt, Homo sapiens
cuauaacuuguccuucaua

SEQ ID NO: 886751 - RNA, 19 nt, Homo sapiens
ggcuugauaacccugauaa

SEQ ID NO: 886752 - RNA, 19 nt, Homo sapiens
gucaggagcauucauguac

SEQ ID NO: 886753 - RNA, 19 nt, Homo sapiens
ccagcaucuuccacauuga

SEQ ID NO: 886754 - RNA, 19 nt, Homo sapiens
gugaccuucugugccaaua

SEQ ID NO: 886755 - RNA, 19 nt, Homo sapiens
gggcuugauaacccugaua

SEQ ID NO: 886756 - RNA, 19 nt, Homo sapiens
ucaaacccuuuucucuuuu

SEQ ID NO: 886757 - RNA, 19 nt, Homo sapiens
gcacaccccuauguacuuc

SEQ ID NO: 886758 - RNA, 19 nt, Homo sapiens
gcuuguaguguuuguuguu

SEQ ID NO: 886759 - RNA, 19 nt, Homo sapiens
ucuauaacuuguccuucau

SEQ ID NO: 886760 - RNA, 19 nt, Homo sapiens
gcccacacagcgugcauga

SEQ ID NO: 886761 - RNA, 19 nt, Homo sapiens
guuuauccucgcaggcuua

SEQ ID NO: 886762 - RNA, 19 nt, Homo sapiens
caucuguaacccacuguug

SEQ ID NO: 886763 - RNA, 19 nt, Homo sapiens
ggugucuucccuauucuau

SEQ ID NO: 886764 - RNA, 19 nt, Homo sapiens
aauugcaguuucucuguuc

SEQ ID NO: 886765 - RNA, 19 nt, Homo sapiens
uguaguguuuguuguugug

SEQ ID NO: 886766 - RNA, 19 nt, Homo sapiens
acuuguccuucauagauuu

SEQ ID NO: 886767 - RNA, 19 nt, Homo sapiens
cagucaccaucuucauuuc

SEQ ID NO: 886768 - RNA, 19 nt, Homo sapiens
guacuucuuccucuauaac

SEQ ID NO: 886769 - RNA, 19 nt, Homo sapiens
ugucaaccacuacaugugu

SEQ ID NO: 886770 - RNA, 19 nt, Homo sapiens
guaugacucagcucuucuu

SEQ ID NO: 886771 - RNA, 19 nt, Homo sapiens
ggaaaccucuucaaaguga

SEQ ID NO: 886772 - RNA, 19 nt, Homo sapiens
gacaagaguuccuggagaa

SEQ ID NO: 886773 - RNA, 19 nt, Homo sapiens
gccaagaguuccucagauu

SEQ ID NO: 886774 - RNA, 19 nt, Homo sapiens
gaaggugcgucgcuuuguu

SEQ ID NO: 886775 - RNA, 19 nt, Homo sapiens
ucauuaagcugaagacuca

SEQ ID NO: 886776 - RNA, 19 nt, Homo sapiens
ucaaagugauuacuaagga

SEQ ID NO: 886777 - RNA, 19 nt, Homo sapiens
gugcgucgcuuuguucuaa

SEQ ID NO: 886778 - RNA, 19 nt, Homo sapiens
aaacagcaguggugccauu

SEQ ID NO: 886779 - RNA, 19 nt, Homo sapiens
guacugcuuuggagaguga

SEQ ID NO: 886780 - RNA, 19 nt, Homo sapiens
ugucugcucuggaagauaa

SEQ ID NO: 886781 - RNA, 19 nt, Homo sapiens
cagcuuuccugcauuacua

SEQ ID NO: 886782 - RNA, 19 nt, Homo sapiens
gagcagggaagcaccuaua

SEQ ID NO: 886783 - RNA, 19 nt, Homo sapiens
ccugagcacuguggaguua

SEQ ID NO: 886784 - RNA, 19 nt, Homo sapiens
ccaagaguuccucagauua

SEQ ID NO: 886785 - RNA, 19 nt, Homo sapiens
ugacacacacuauuacauu

SEQ ID NO: 886786 - RNA, 19 nt, Homo sapiens
uaaggaaggauccagcuuu

SEQ ID NO: 886787 - RNA, 19 nt, Homo sapiens
gcagggaagcaccuauaaa

SEQ ID NO: 886788 - RNA, 19 nt, Homo sapiens
gacacacacuauuacauuc

SEQ ID NO: 886789 - RNA, 19 nt, Homo sapiens
cuaugacccuuccaaagaa

SEQ ID NO: 886790 - RNA, 19 nt, Homo sapiens
ccagggaaaccucuucaaa

SEQ ID NO: 886791 - RNA, 19 nt, Homo sapiens
agggaaaccucuucaaagu

SEQ ID NO: 886792 - RNA, 19 nt, Homo sapiens
ccgaguggauugaagcuau

SEQ ID NO: 886793 - RNA, 19 nt, Homo sapiens
caaagugauuacuaaggau

SEQ ID NO: 886794 - RNA, 19 nt, Homo sapiens
ggauccagcuuuccugcau

SEQ ID NO: 886795 - RNA, 19 nt, Homo sapiens
aggaugacacacacuauua

SEQ ID NO: 886796 - RNA, 19 nt, Homo sapiens
gauccagcuuuccugcauu

SEQ ID NO: 886797 - RNA, 19 nt, Homo sapiens
aaacauccacggaguacuu

SEQ ID NO: 886798 - RNA, 19 nt, Homo sapiens
gaagauaagccccaaggaa

SEQ ID NO: 886799 - RNA, 19 nt, Homo sapiens
ccgagcaguuccuggauga

SEQ ID NO: 886800 - RNA, 19 nt, Homo sapiens
aaaccgaccgcuccucauu

SEQ ID NO: 886801 - RNA, 19 nt, Homo sapiens
acuaugacccuuccaaaga

SEQ ID NO: 886802 - RNA, 19 nt, Homo sapiens
uggacaagaugcacgauag

SEQ ID NO: 886803 - RNA, 19 nt, Homo sapiens
gccaugccauaauguugaa

SEQ ID NO: 886804 - RNA, 19 nt, Homo sapiens
caagaguuccucagauuac

SEQ ID NO: 886805 - RNA, 19 nt, Homo sapiens
aagggaauguccagggaaa

SEQ ID NO: 886806 - RNA, 19 nt, Homo sapiens
ggccaugccauaauguuga

SEQ ID NO: 886807 - RNA, 19 nt, Homo sapiens
aaggaaggauccagcuuuc

SEQ ID NO: 886808 - RNA, 19 nt, Homo sapiens
accgaccgcuccucauuaa

SEQ ID NO: 886809 - RNA, 19 nt, Homo sapiens
gcaguggugccauuuccuu

SEQ ID NO: 886810 - RNA, 19 nt, Homo sapiens
cuaaggaugacacacacua

SEQ ID NO: 886811 - RNA, 19 nt, Homo sapiens
acucgugucugcucuggaa

SEQ ID NO: 886812 - RNA, 19 nt, Homo sapiens
aaagcuaacaugacaagga

SEQ ID NO: 886813 - RNA, 19 nt, Homo sapiens
gagcgagccgaguggauug

SEQ ID NO: 886814 - RNA, 19 nt, Homo sapiens
gggaaaccucuucaaagug

SEQ ID NO: 886815 - RNA, 19 nt, Homo sapiens
ugaaugcugccaagaguuc

SEQ ID NO: 886816 - RNA, 19 nt, Homo sapiens
caagaguuccuggagaaug

SEQ ID NO: 886817 - RNA, 19 nt, Homo sapiens
cagggaaaccucuucaaag

SEQ ID NO: 886818 - RNA, 19 nt, Homo sapiens
auccagcuuuccugcauua

SEQ ID NO: 886819 - RNA, 19 nt, Homo sapiens
aaauuagccugagcacugu

SEQ ID NO: 886820 - RNA, 19 nt, Homo sapiens
gaguuccucagauuacaaa

SEQ ID NO: 886821 - RNA, 19 nt, Homo sapiens
aagaguuccuggagaaugg

SEQ ID NO: 886822 - RNA, 19 nt, Homo sapiens
gaugacacacacuauuaca

SEQ ID NO: 886823 - RNA, 19 nt, Homo sapiens
ggaugacacacacuauuac

SEQ ID NO: 886824 - RNA, 19 nt, Homo sapiens
ggaaggugcgucgcuuugu

SEQ ID NO: 886825 - RNA, 19 nt, Homo sapiens
gcagggacacaagaggaaa

SEQ ID NO: 886826 - RNA, 19 nt, Homo sapiens
caucacaaacagccauuuc

SEQ ID NO: 886827 - RNA, 19 nt, Homo sapiens
gaugacacagacaagaguu

SEQ ID NO: 886828 - RNA, 19 nt, Homo sapiens
uuacuaaggaugacacaca

SEQ ID NO: 886829 - RNA, 19 nt, Homo sapiens
gaaaccucuucaaagugau

SEQ ID NO: 886830 - RNA, 19 nt, Homo sapiens
caugccauaauguugaaua

SEQ ID NO: 886831 - RNA, 19 nt, Homo sapiens
guagguucccuuuguugga

SEQ ID NO: 886832 - RNA, 19 nt, Homo sapiens
ccagaugacacagacaaga

SEQ ID NO: 886833 - RNA, 19 nt, Homo sapiens
uaaggaugacacacacuau

SEQ ID NO: 886834 - RNA, 19 nt, Homo sapiens
gcucauggaggagaacuuc

SEQ ID NO: 886835 - RNA, 19 nt, Homo sapiens
cagggaagcaccuauaaaa

SEQ ID NO: 886836 - RNA, 19 nt, Homo sapiens
cgaguggauugaagcuauc

SEQ ID NO: 886837 - RNA, 19 nt, Homo sapiens
guggcacgguggugaaaca

SEQ ID NO: 886838 - RNA, 19 nt, Homo sapiens
aaccgaccgcuccucauua

SEQ ID NO: 886839 - RNA, 19 nt, Homo sapiens
guggacaagaugcacgaua

SEQ ID NO: 886840 - RNA, 19 nt, Homo sapiens
agugaaugcugccaagagu

SEQ ID NO: 886841 - RNA, 19 nt, Homo sapiens
uuacuaugacccuuccaaa

SEQ ID NO: 886842 - RNA, 19 nt, Homo sapiens
cagccugcaucgcauugug

SEQ ID NO: 886843 - RNA, 19 nt, Homo sapiens
ugagcgagccgaguggauu

SEQ ID NO: 886844 - RNA, 19 nt, Homo sapiens
aaggcuaccuggccaagca

SEQ ID NO: 886845 - RNA, 19 nt, Homo sapiens
gagugaaugcugccaagag

SEQ ID NO: 886846 - RNA, 19 nt, Homo sapiens
acacacacuauuacauuca

SEQ ID NO: 886847 - RNA, 19 nt, Homo sapiens
aaggaugacacacacuauu

SEQ ID NO: 886848 - RNA, 19 nt, Homo sapiens
uaaguggcacgguggugaa

SEQ ID NO: 886849 - RNA, 19 nt, Homo sapiens
ggaucuggccgagcaguuc

SEQ ID NO: 886850 - RNA, 19 nt, Homo sapiens
cugcacagccugagaaacu

SEQ ID NO: 886851 - RNA, 19 nt, Homo sapiens
acaagaugcacgauagcaa

SEQ ID NO: 886852 - RNA, 19 nt, Homo sapiens
ugagcacuguggaguuaag

SEQ ID NO: 886853 - RNA, 19 nt, Homo sapiens
gcacacaucuucagacaug

SEQ ID NO: 886854 - RNA, 19 nt, Homo sapiens
gaacggagaggugguguua

SEQ ID NO: 886855 - RNA, 19 nt, Homo sapiens
ccaaggagcuguucaacga

SEQ ID NO: 886856 - RNA, 19 nt, Homo sapiens
gcucuuuggugaaggauua

SEQ ID NO: 886857 - RNA, 19 nt, Homo sapiens
caaggaauguaguaagaaa

SEQ ID NO: 886858 - RNA, 19 nt, Homo sapiens
gaaaugugauaccucaaag

SEQ ID NO: 886859 - RNA, 19 nt, Homo sapiens
gcuggaggaugcuuaaaug

SEQ ID NO: 886860 - RNA, 19 nt, Homo sapiens
gcuggaggcucuucaggaa

SEQ ID NO: 886861 - RNA, 19 nt, Homo sapiens
gaaacaaagacuuccaaga

SEQ ID NO: 886862 - RNA, 19 nt, Homo sapiens
cgaaacauccagaacauga

SEQ ID NO: 886863 - RNA, 19 nt, Homo sapiens
ggugaaauugcucaaauaa

SEQ ID NO: 886864 - RNA, 19 nt, Homo sapiens
gaggaaggaguccaacuuu

SEQ ID NO: 886865 - RNA, 19 nt, Homo sapiens
aaacaaagacuuccaagag

SEQ ID NO: 886866 - RNA, 19 nt, Homo sapiens
guuaacaucaggugaaauu

SEQ ID NO: 886867 - RNA, 19 nt, Homo sapiens
gaagggagaauuccacaag

SEQ ID NO: 886868 - RNA, 19 nt, Homo sapiens
gccuauggcuuucgaaaca

SEQ ID NO: 886869 - RNA, 19 nt, Homo sapiens
uaaauucaaccucagugua

SEQ ID NO: 886870 - RNA, 19 nt, Homo sapiens
gaggugguguuacgcuuug

SEQ ID NO: 886871 - RNA, 19 nt, Homo sapiens
caggugaaauugcucaaau

SEQ ID NO: 886872 - RNA, 19 nt, Homo sapiens
gcaugugacagcuguauga

SEQ ID NO: 886873 - RNA, 19 nt, Homo sapiens
aacaugauccugaagcuua

SEQ ID NO: 886874 - RNA, 19 nt, Homo sapiens
gacgauagcugcggauuuu

SEQ ID NO: 886875 - RNA, 19 nt, Homo sapiens
aaauucaaccucaguguaa

SEQ ID NO: 886876 - RNA, 19 nt, Homo sapiens
gcacugcacgcgcaaggaa

SEQ ID NO: 886877 - RNA, 19 nt, Homo sapiens
gcaccuggcacacaucuuc

SEQ ID NO: 886878 - RNA, 19 nt, Homo sapiens
gaaauugcucaaauaaugg

SEQ ID NO: 886879 - RNA, 19 nt, Homo sapiens
ggaguauuaaagacacuua

SEQ ID NO: 886880 - RNA, 19 nt, Homo sapiens
cgcaaggaauguaguaaga

SEQ ID NO: 886881 - RNA, 19 nt, Homo sapiens
gacaucaaguggugaaguc

SEQ ID NO: 886882 - RNA, 19 nt, Homo sapiens
gcaaggaauguaguaagaa

SEQ ID NO: 886883 - RNA, 19 nt, Homo sapiens
cucaaucuuugccuuauuu

SEQ ID NO: 886884 - RNA, 19 nt, Homo sapiens
gggagaauuccacaaguug

SEQ ID NO: 886885 - RNA, 19 nt, Homo sapiens
ugcccugaguggaguauua

SEQ ID NO: 886886 - RNA, 19 nt, Homo sapiens
gcagauggaaggcauuuac

SEQ ID NO: 886887 - RNA, 19 nt, Homo sapiens
gaagggcaaguucccauuc

SEQ ID NO: 886888 - RNA, 19 nt, Homo sapiens
gaacaugauccugaagcuu

SEQ ID NO: 886889 - RNA, 19 nt, Homo sapiens
gagaaacaaagacuuccaa

SEQ ID NO: 886890 - RNA, 19 nt, Homo sapiens
aggugaaauugcucaaaua

SEQ ID NO: 886891 - RNA, 19 nt, Homo sapiens
aaacugaugaccaagagaa

SEQ ID NO: 886892 - RNA, 19 nt, Homo sapiens
agaaaugugauaccucaaa

SEQ ID NO: 886893 - RNA, 19 nt, Homo sapiens
acaugauccugaagcuuaa

SEQ ID NO: 886894 - RNA, 19 nt, Homo sapiens
gggcgcugacugcguguua

SEQ ID NO: 886895 - RNA, 19 nt, Homo sapiens
ccucaaucuuugccuuauu

SEQ ID NO: 886896 - RNA, 19 nt, Homo sapiens
gaaacauccagaacaugau

SEQ ID NO: 886897 - RNA, 19 nt, Homo sapiens
cgacgauagcugcggauuu

SEQ ID NO: 886898 - RNA, 19 nt, Homo sapiens
agggagaauuccacaaguu

SEQ ID NO: 886899 - RNA, 19 nt, Homo sapiens
acacacagccuggacauca

SEQ ID NO: 886900 - RNA, 19 nt, Homo sapiens
guguuaacaucaggugaaa

SEQ ID NO: 886901 - RNA, 19 nt, Homo sapiens
acucugugguuuccucaaa

SEQ ID NO: 886902 - RNA, 19 nt, Homo sapiens
guccaacuuucccagcaaa

SEQ ID NO: 886903 - RNA, 19 nt, Homo sapiens
uggcacacaucuucagaca

SEQ ID NO: 886904 - RNA, 19 nt, Homo sapiens
uuaguauccuggagaguca

SEQ ID NO: 886905 - RNA, 19 nt, Homo sapiens
uaacugaugcauccagaag

SEQ ID NO: 886906 - RNA, 19 nt, Homo sapiens
gaaggcauuuacgcugaca

SEQ ID NO: 886907 - RNA, 19 nt, Homo sapiens
cagacggacaugcggauaa

SEQ ID NO: 886908 - RNA, 19 nt, Homo sapiens
ggugcacuauguauuugau

SEQ ID NO: 886909 - RNA, 19 nt, Homo sapiens
gcacacacagccuggacau

SEQ ID NO: 886910 - RNA, 19 nt, Homo sapiens
gaggucacccuugagaaga

SEQ ID NO: 886911 - RNA, 19 nt, Homo sapiens
uggaggcucuucaggaaag

SEQ ID NO: 886912 - RNA, 19 nt, Homo sapiens
cuguaugacugcagaggaa

SEQ ID NO: 886913 - RNA, 19 nt, Homo sapiens
ggacaucaaguggugaagu

SEQ ID NO: 886914 - RNA, 19 nt, Homo sapiens
cccgagaggugcugcauac

SEQ ID NO: 886915 - RNA, 19 nt, Homo sapiens
uccagaacaugauccugaa

SEQ ID NO: 886916 - RNA, 19 nt, Homo sapiens
gcuaucgccagcacaguga

SEQ ID NO: 886917 - RNA, 19 nt, Homo sapiens
ucugaaccuuaacaagaaa

SEQ ID NO: 886918 - RNA, 19 nt, Homo sapiens
cacacagccuggacaucaa

SEQ ID NO: 886919 - RNA, 19 nt, Homo sapiens
acgcuuugcugcagccuau

SEQ ID NO: 886920 - RNA, 19 nt, Homo sapiens
uaacaucaggugaaauugc

SEQ ID NO: 886921 - RNA, 19 nt, Homo sapiens
gaaugugucagccgaugca

SEQ ID NO: 886922 - RNA, 19 nt, Homo sapiens
aggaaggaguccaacuuuc

SEQ ID NO: 886923 - RNA, 19 nt, Homo sapiens
cgucgacacucuguuugga

SEQ ID NO: 886924 - RNA, 19 nt, Homo sapiens
gaaccuuaacaagaaaugu

SEQ ID NO: 886925 - RNA, 19 nt, Homo sapiens
gcccugaguggaguauuaa

SEQ ID NO: 886926 - RNA, 19 nt, Homo sapiens
agacggacaugcggauaag

SEQ ID NO: 886927 - RNA, 19 nt, Homo sapiens
gcgcaaggaauguaguaag

SEQ ID NO: 886928 - RNA, 19 nt, Homo sapiens
ucagacaugcggccaagga

SEQ ID NO: 886929 - RNA, 19 nt, Homo sapiens
agaggaaggaguccaacuu

SEQ ID NO: 886930 - RNA, 19 nt, Homo sapiens
guccucaaucuuugccuua

SEQ ID NO: 886931 - RNA, 19 nt, Homo sapiens
uguguguccucaaucuuug

SEQ ID NO: 886932 - RNA, 19 nt, Homo sapiens
ugacugcguguuaacauca

SEQ ID NO: 886933 - RNA, 19 nt, Homo sapiens
gcacgcgcaaggaauguag

SEQ ID NO: 886934 - RNA, 19 nt, Homo sapiens
gaguggaguauuaaagaca

SEQ ID NO: 886935 - RNA, 19 nt, Homo sapiens
ggacuucuuccgcguucug

SEQ ID NO: 886936 - RNA, 19 nt, Homo sapiens
ggcgcugacugcguguuaa

SEQ ID NO: 886937 - RNA, 19 nt, Homo sapiens
cugaguggaguauuaaaga

SEQ ID NO: 886938 - RNA, 19 nt, Homo sapiens
ccugagaaacaaagacuuc

SEQ ID NO: 886939 - RNA, 19 nt, Homo sapiens
caugggcucuuuggugaag

SEQ ID NO: 886940 - RNA, 19 nt, Homo sapiens
gcugguagugucugugugu

SEQ ID NO: 886941 - RNA, 19 nt, Homo sapiens
aaacauccagaacaugauc

SEQ ID NO: 886942 - RNA, 19 nt, Homo sapiens
gagagaagggagaauucca

SEQ ID NO: 886943 - RNA, 19 nt, Homo sapiens
gaagauuuuccacgucauu

SEQ ID NO: 886944 - RNA, 19 nt, Homo sapiens
aggauuauuucgccagaca

SEQ ID NO: 886945 - RNA, 19 nt, Homo sapiens
gcaggucaugggcucuuug

SEQ ID NO: 886946 - RNA, 19 nt, Homo sapiens
ugaguggaguauuaaagac

SEQ ID NO: 886947 - RNA, 19 nt, Homo sapiens
cguguuaacaucaggugaa

SEQ ID NO: 886948 - RNA, 19 nt, Homo sapiens
gcacacaucuucagacaug

SEQ ID NO: 886949 - RNA, 19 nt, Homo sapiens
gaacggagaggugguguua

SEQ ID NO: 886950 - RNA, 19 nt, Homo sapiens
ccaaggagcuguucaacga

SEQ ID NO: 886951 - RNA, 19 nt, Homo sapiens
gcucuuuggugaaggauua

SEQ ID NO: 886952 - RNA, 19 nt, Homo sapiens
caaggaauguaguaagaaa

SEQ ID NO: 886953 - RNA, 19 nt, Homo sapiens
gaggugaaauugcucaaau

SEQ ID NO: 886954 - RNA, 19 nt, Homo sapiens
gaaaugugauaccucaaag

SEQ ID NO: 886955 - RNA, 19 nt, Homo sapiens
gcuggaggaugcuuaaaug

SEQ ID NO: 886956 - RNA, 19 nt, Homo sapiens
gcuggaggcucuucaggaa

SEQ ID NO: 886957 - RNA, 19 nt, Homo sapiens
gaaacaaagacuuccaaga

SEQ ID NO: 886958 - RNA, 19 nt, Homo sapiens
cgaaacauccagaacauga

SEQ ID NO: 886959 - RNA, 19 nt, Homo sapiens
ggugaaauugcucaaauaa

SEQ ID NO: 886960 - RNA, 19 nt, Homo sapiens
gaggaaggaguccaacuuu

SEQ ID NO: 886961 - RNA, 19 nt, Homo sapiens
aaacaaagacuuccaagag

SEQ ID NO: 886962 - RNA, 19 nt, Homo sapiens
gaagggagaauuccacaag

SEQ ID NO: 886963 - RNA, 19 nt, Homo sapiens
gccuauggcuuucgaaaca

SEQ ID NO: 886964 - RNA, 19 nt, Homo sapiens
uaaauucaaccucagugua

SEQ ID NO: 886965 - RNA, 19 nt, Homo sapiens
gaggugguguuacgcuuug

SEQ ID NO: 886966 - RNA, 19 nt, Homo sapiens
gcaugugacagcuguauga

SEQ ID NO: 886967 - RNA, 19 nt, Homo sapiens
aacaugauccugaagcuua

SEQ ID NO: 886968 - RNA, 19 nt, Homo sapiens
gacgauagcugcggauuuu

SEQ ID NO: 886969 - RNA, 19 nt, Homo sapiens
aaauucaaccucaguguaa

SEQ ID NO: 886970 - RNA, 19 nt, Homo sapiens
gcaccuggcacacaucuuc

SEQ ID NO: 886971 - RNA, 19 nt, Homo sapiens
gaaauugcucaaauaaugg

SEQ ID NO: 886972 - RNA, 19 nt, Homo sapiens
gcacugcacgcgcaaggaa

SEQ ID NO: 886973 - RNA, 19 nt, Homo sapiens
ggaguauuaaagacacuua

SEQ ID NO: 886974 - RNA, 19 nt, Homo sapiens
cgcaaggaauguaguaaga

SEQ ID NO: 886975 - RNA, 19 nt, Homo sapiens
gacaucaaguggugaaguc

SEQ ID NO: 886976 - RNA, 19 nt, Homo sapiens
gcaaggaauguaguaagaa

SEQ ID NO: 886977 - RNA, 19 nt, Homo sapiens
cguguuaacaucagaaauu

SEQ ID NO: 886978 - RNA, 19 nt, Homo sapiens
cucaaucuuugccuuauuu

SEQ ID NO: 886979 - RNA, 19 nt, Homo sapiens
gggagaauuccacaaguug

SEQ ID NO: 886980 - RNA, 19 nt, Homo sapiens
ugcccugaguggaguauua

SEQ ID NO: 886981 - RNA, 19 nt, Homo sapiens
gcagauggaaggcauuuac

SEQ ID NO: 886982 - RNA, 19 nt, Homo sapiens
gaagggcaaguucccauuc

SEQ ID NO: 886983 - RNA, 19 nt, Homo sapiens
gaacaugauccugaagcuu

SEQ ID NO: 886984 - RNA, 19 nt, Homo sapiens
gagaaacaaagacuuccaa

SEQ ID NO: 886985 - RNA, 19 nt, Homo sapiens
aaacugaugaccaagagaa

SEQ ID NO: 886986 - RNA, 19 nt, Homo sapiens
aggugaaauugcucaaaua

SEQ ID NO: 886987 - RNA, 19 nt, Homo sapiens
agaaaugugauaccucaaa

SEQ ID NO: 886988 - RNA, 19 nt, Homo sapiens
acaugauccugaagcuuaa

SEQ ID NO: 886989 - RNA, 19 nt, Homo sapiens
gggcgcugacugcguguua

SEQ ID NO: 886990 - RNA, 19 nt, Homo sapiens
ccucaaucuuugccuuauu

SEQ ID NO: 886991 - RNA, 19 nt, Homo sapiens
gaaacauccagaacaugau

SEQ ID NO: 886992 - RNA, 19 nt, Homo sapiens
cgacgauagcugcggauuu

SEQ ID NO: 886993 - RNA, 19 nt, Homo sapiens
agggagaauuccacaaguu

SEQ ID NO: 886994 - RNA, 19 nt, Homo sapiens
acacacagccuggacauca

SEQ ID NO: 886995 - RNA, 19 nt, Homo sapiens
acucugugguuuccucaaa

SEQ ID NO: 886996 - RNA, 19 nt, Homo sapiens
guccaacuuucccagcaaa

SEQ ID NO: 886997 - RNA, 19 nt, Homo sapiens
uggcacacaucuucagaca

SEQ ID NO: 886998 - RNA, 19 nt, Homo sapiens
ggaggugaaauugcucaaa

SEQ ID NO: 886999 - RNA, 19 nt, Homo sapiens
uuaguauccuggagaguca

SEQ ID NO: 887000 - RNA, 19 nt, Homo sapiens
uaacugaugcauccagaag

SEQ ID NO: 887001 - RNA, 19 nt, Homo sapiens
gaaggcauuuacgcugaca

SEQ ID NO: 887002 - RNA, 19 nt, Homo sapiens
cagacggacaugcggauaa

SEQ ID NO: 887003 - RNA, 19 nt, Homo sapiens
ggugcacuauguauuugau

SEQ ID NO: 887004 - RNA, 19 nt, Homo sapiens
gcacacacagccuggacau

SEQ ID NO: 887005 - RNA, 19 nt, Homo sapiens
gaggucacccuugagaaga

SEQ ID NO: 887006 - RNA, 19 nt, Homo sapiens
uggaggcucuucaggaaag

SEQ ID NO: 887007 - RNA, 19 nt, Homo sapiens
cuguaugacugcagaggaa

SEQ ID NO: 887008 - RNA, 19 nt, Homo sapiens
ggacaucaaguggugaagu

SEQ ID NO: 887009 - RNA, 19 nt, Homo sapiens
cccgagaggugcugcauac

SEQ ID NO: 887010 - RNA, 19 nt, Homo sapiens
uccagaacaugauccugaa

SEQ ID NO: 887011 - RNA, 19 nt, Homo sapiens
uuacagcgagacaagauug

SEQ ID NO: 887012 - RNA, 19 nt, Homo sapiens
gcuaucgccagcacaguga

SEQ ID NO: 887013 - RNA, 19 nt, Homo sapiens
ucugaaccuuaacaagaaa

SEQ ID NO: 887014 - RNA, 19 nt, Homo sapiens
cacacagccuggacaucaa

SEQ ID NO: 887015 - RNA, 19 nt, Homo sapiens
acgcuuugcugcagccuau

SEQ ID NO: 887016 - RNA, 19 nt, Homo sapiens
gaaugugucagccgaugca

SEQ ID NO: 887017 - RNA, 19 nt, Homo sapiens
cgucgacacucuguuugga

SEQ ID NO: 887018 - RNA, 19 nt, Homo sapiens
ggaggcugcggcaagagaa

SEQ ID NO: 887019 - RNA, 19 nt, Homo sapiens
gaaccuuaacaagaaaugu

SEQ ID NO: 887020 - RNA, 19 nt, Homo sapiens
aggaaggaguccaacuuuc

SEQ ID NO: 887021 - RNA, 19 nt, Homo sapiens
gcccugaguggaguauuaa

SEQ ID NO: 887022 - RNA, 19 nt, Homo sapiens
agacggacaugcggauaag

SEQ ID NO: 887023 - RNA, 19 nt, Homo sapiens
gcgcaaggaauguaguaag

SEQ ID NO: 887024 - RNA, 19 nt, Homo sapiens
ucagacaugcggccaagga

SEQ ID NO: 887025 - RNA, 19 nt, Homo sapiens
cggcggaggugaaauugcu

SEQ ID NO: 887026 - RNA, 19 nt, Homo sapiens
agaggaaggaguccaacuu

SEQ ID NO: 887027 - RNA, 19 nt, Homo sapiens
guccucaaucuuugccuua

SEQ ID NO: 887028 - RNA, 19 nt, Homo sapiens
uguguguccucaaucuuug

SEQ ID NO: 887029 - RNA, 19 nt, Homo sapiens
gcacgcgcaaggaauguag

SEQ ID NO: 887030 - RNA, 19 nt, Homo sapiens
ugacugcguguuaacauca

SEQ ID NO: 887031 - RNA, 19 nt, Homo sapiens
gaguggaguauuaaagaca

SEQ ID NO: 887032 - RNA, 19 nt, Homo sapiens
gagguuacagcgagacaag

SEQ ID NO: 887033 - RNA, 19 nt, Homo sapiens
ggcgcugacugcguguuaa

SEQ ID NO: 887034 - RNA, 19 nt, Homo sapiens
ggacuucuuccgcguucug

SEQ ID NO: 887035 - RNA, 19 nt, Homo sapiens
cugaguggaguauuaaaga

SEQ ID NO: 887036 - RNA, 19 nt, Homo sapiens
ccugagaaacaaagacuuc

SEQ ID NO: 887037 - RNA, 19 nt, Homo sapiens
gguuacagcgagacaagau

SEQ ID NO: 887038 - RNA, 19 nt, Homo sapiens
caugggcucuuuggugaag

SEQ ID NO: 887039 - RNA, 19 nt, Homo sapiens
gcugguagugucugugugu

SEQ ID NO: 887040 - RNA, 19 nt, Homo sapiens
aaacauccagaacaugauc

SEQ ID NO: 887041 - RNA, 19 nt, Homo sapiens
gagagaagggagaauucca

SEQ ID NO: 887042 - RNA, 19 nt, Homo sapiens
gaagauuuuccacgucauu

SEQ ID NO: 887043 - RNA, 19 nt, Homo sapiens
aggauuauuucgccagaca

SEQ ID NO: 887044 - RNA, 19 nt, Homo sapiens
gcaggucaugggcucuuug

SEQ ID NO: 887045 - RNA, 19 nt, Homo sapiens
ugaguggaguauuaaagac

SEQ ID NO: 887046 - RNA, 19 nt, Homo sapiens
caaagugccuucuguauug

SEQ ID NO: 887047 - RNA, 19 nt, Homo sapiens
ggacuuaugucuucuacuu

SEQ ID NO: 887048 - RNA, 19 nt, Homo sapiens
ucacauggaucacaguaua

SEQ ID NO: 887049 - RNA, 19 nt, Homo sapiens
gaauuggacuuaugucuuc

SEQ ID NO: 887050 - RNA, 19 nt, Homo sapiens
ucaagcugcugacaauuua

SEQ ID NO: 887051 - RNA, 19 nt, Homo sapiens
caagagaauuucccauuau

SEQ ID NO: 887052 - RNA, 19 nt, Homo sapiens
acaagagaauuucccauua

SEQ ID NO: 887053 - RNA, 19 nt, Homo sapiens
gaacaccuauguggcuuaa

SEQ ID NO: 887054 - RNA, 19 nt, Homo sapiens
caugaaauaucacuaguug

SEQ ID NO: 887055 - RNA, 19 nt, Homo sapiens
gaaucugaguguugcguua

SEQ ID NO: 887056 - RNA, 19 nt, Homo sapiens
uaaauaauccugccucuau

SEQ ID NO: 887057 - RNA, 19 nt, Homo sapiens
gaguacaccugcucacgua

SEQ ID NO: 887058 - RNA, 19 nt, Homo sapiens
gauuggaccugcaguauuc

SEQ ID NO: 887059 - RNA, 19 nt, Homo sapiens
gccauccacuguauaauuu

SEQ ID NO: 887060 - RNA, 19 nt, Homo sapiens
ggauauugcuccuucguau

SEQ ID NO: 887061 - RNA, 19 nt, Homo sapiens
ugacauuauugccuacuua

SEQ ID NO: 887062 - RNA, 19 nt, Homo sapiens
uaucguaguugcacacuuu

SEQ ID NO: 887063 - RNA, 19 nt, Homo sapiens
ugaaacagaccuccugaua

SEQ ID NO: 887064 - RNA, 19 nt, Homo sapiens
ggccuauaaucaugaaaua

SEQ ID NO: 887065 - RNA, 19 nt, Homo sapiens
aaacugggcucucaaugau

SEQ ID NO: 887066 - RNA, 19 nt, Homo sapiens
caaaccguguucuauauug

SEQ ID NO: 887067 - RNA, 19 nt, Homo sapiens
ggcaaaccguguucuauau

SEQ ID NO: 887068 - RNA, 19 nt, Homo sapiens
ucccauugcugcagauuua

SEQ ID NO: 887069 - RNA, 19 nt, Homo sapiens
acuuagaccucaaacuuua

SEQ ID NO: 887070 - RNA, 19 nt, Homo sapiens
gagcugccauccacuguau

SEQ ID NO: 887071 - RNA, 19 nt, Homo sapiens
gcuauggucuugauacauc

SEQ ID NO: 887072 - RNA, 19 nt, Homo sapiens
ggaaaaugcugcuaggauu

SEQ ID NO: 887073 - RNA, 19 nt, Homo sapiens
gagcacagcuugggacagu

SEQ ID NO: 887074 - RNA, 19 nt, Homo sapiens
gcaaacuucuuagcauuuc

SEQ ID NO: 887075 - RNA, 19 nt, Homo sapiens
gcuggugccuuuccucuga

SEQ ID NO: 887076 - RNA, 19 nt, Homo sapiens
gagaauuucccauuaugaa

SEQ ID NO: 887077 - RNA, 19 nt, Homo sapiens
guguugcaguuuaaaguua

SEQ ID NO: 887078 - RNA, 19 nt, Homo sapiens
guagauaaagcccugagua

SEQ ID NO: 887079 - RNA, 19 nt, Homo sapiens
ggacacagacacugaagga

SEQ ID NO: 887080 - RNA, 19 nt, Homo sapiens
gagcgagacuccaacucaa

SEQ ID NO: 887081 - RNA, 19 nt, Homo sapiens
uaaagggaaugagcugaaa

SEQ ID NO: 887082 - RNA, 19 nt, Homo sapiens
cgccaaaggugaaguacaa

SEQ ID NO: 887083 - RNA, 19 nt, Homo sapiens
cccagucaaucacaaauaa

SEQ ID NO: 887084 - RNA, 19 nt, Homo sapiens
guaagcauucuaugucuuu

SEQ ID NO: 887085 - RNA, 19 nt, Homo sapiens
gguagcugcuggcuucauu

SEQ ID NO: 887086 - RNA, 19 nt, Homo sapiens
cuacuuauaugaaggagau

SEQ ID NO: 887087 - RNA, 19 nt, Homo sapiens
gcacagcuugggacaguaa

SEQ ID NO: 887088 - RNA, 19 nt, Homo sapiens
ugauacauccucaaacuuu

SEQ ID NO: 887089 - RNA, 19 nt, Homo sapiens
gcuaggacuucuacuuuag

SEQ ID NO: 887090 - RNA, 19 nt, Homo sapiens
gcaaaccguguucuauauu

SEQ ID NO: 887091 - RNA, 19 nt, Homo sapiens
cguuacaacuuagcaauuu

SEQ ID NO: 887092 - RNA, 19 nt, Homo sapiens
uuguggaucugguuaguua

SEQ ID NO: 887093 - RNA, 19 nt, Homo sapiens
uaauuucucuuccucuuuc

SEQ ID NO: 887094 - RNA, 19 nt, Homo sapiens
ccaaugggaugcagaaacu

SEQ ID NO: 887095 - RNA, 19 nt, Homo sapiens
gaaacagaccuccugauac

SEQ ID NO: 887096 - RNA, 19 nt, Homo sapiens
ucaaagugccuucuguauu

SEQ ID NO: 887097 - RNA, 19 nt, Homo sapiens
caucaaccaucuggauauu

SEQ ID NO: 887098 - RNA, 19 nt, Homo sapiens
aagcaaacuucuuagcauu

SEQ ID NO: 887099 - RNA, 19 nt, Homo sapiens
cuauguggcuuaaaacuua

SEQ ID NO: 887100 - RNA, 19 nt, Homo sapiens
ccacaucaccugagacuag

SEQ ID NO: 887101 - RNA, 19 nt, Homo sapiens
aauaagaucauccugguuu

SEQ ID NO: 887102 - RNA, 19 nt, Homo sapiens
aauauuggcuggcaugcaa

SEQ ID NO: 887103 - RNA, 19 nt, Homo sapiens
aggagaggguguuacauuu

SEQ ID NO: 887104 - RNA, 19 nt, Homo sapiens
ggacuaggagaggguguua

SEQ ID NO: 887105 - RNA, 19 nt, Homo sapiens
gauacauccucaaacuuuc

SEQ ID NO: 887106 - RNA, 19 nt, Homo sapiens
cuaguugccagaauaauaa

SEQ ID NO: 887107 - RNA, 19 nt, Homo sapiens
uaaaaucccugccacuuug

SEQ ID NO: 887108 - RNA, 19 nt, Homo sapiens
aaagugcgaugcccaguca

SEQ ID NO: 887109 - RNA, 19 nt, Homo sapiens
acacuuagaccucaaacuu

SEQ ID NO: 887110 - RNA, 19 nt, Homo sapiens
cugaaggaaccaauaaaua

SEQ ID NO: 887111 - RNA, 19 nt, Homo sapiens
cuauauugcugcugcuauu

SEQ ID NO: 887112 - RNA, 19 nt, Homo sapiens
caucuaaguuuguguugca

SEQ ID NO: 887113 - RNA, 19 nt, Homo sapiens
gguaggagaaucacuugaa

SEQ ID NO: 887114 - RNA, 19 nt, Homo sapiens
aaacagaccuccugauacc

SEQ ID NO: 887115 - RNA, 19 nt, Homo sapiens
uuauuuaggcucuugguua

SEQ ID NO: 887116 - RNA, 19 nt, Homo sapiens
auaagaucauccugguuua

SEQ ID NO: 887117 - RNA, 19 nt, Homo sapiens
gauggaaguugcagugaac

SEQ ID NO: 887118 - RNA, 19 nt, Homo sapiens
gaaaccccaucucuacuaa

SEQ ID NO: 887119 - RNA, 19 nt, Homo sapiens
ccugauaccuuugcuuaau

SEQ ID NO: 887120 - RNA, 19 nt, Homo sapiens
aauccugccucuauuaaug

SEQ ID NO: 887121 - RNA, 19 nt, Homo sapiens
uggcaaaccguguucuaua

SEQ ID NO: 887122 - RNA, 19 nt, Homo sapiens
uauuuaggcucuugguuau

SEQ ID NO: 887123 - RNA, 19 nt, Homo sapiens
ucugguuccugaaaucaua

SEQ ID NO: 887124 - RNA, 19 nt, Homo sapiens
ccacugcuauggucuugau

SEQ ID NO: 887125 - RNA, 19 nt, Homo sapiens
gagccagugucgacucuuc

SEQ ID NO: 887126 - RNA, 19 nt, Homo sapiens
gaaacucaaggauggauuc

SEQ ID NO: 887127 - RNA, 19 nt, Homo sapiens
gcuauggcaauguuucuuu

SEQ ID NO: 887128 - RNA, 19 nt, Homo sapiens
guuuaaaucuacucucaca

SEQ ID NO: 887129 - RNA, 19 nt, Homo sapiens
guacaaaacugggcucuca

SEQ ID NO: 887130 - RNA, 19 nt, Homo sapiens
gagaauggcaaaccguguu

SEQ ID NO: 887131 - RNA, 19 nt, Homo sapiens
ggaucugguuaguuaguga

SEQ ID NO: 887132 - RNA, 19 nt, Homo sapiens
gggaaugagcugaaacaga

SEQ ID NO: 887133 - RNA, 19 nt, Homo sapiens
guguaugcauuacguguga

SEQ ID NO: 887134 - RNA, 19 nt, Homo sapiens
guucaauguucaagagaau

SEQ ID NO: 887135 - RNA, 19 nt, Homo sapiens
ggagaggguguuacauuuc

SEQ ID NO: 887136 - RNA, 19 nt, Homo sapiens
aagcuaggacuucuacuuu

SEQ ID NO: 887137 - RNA, 19 nt, Homo sapiens
acacugaaggaaccaauaa

SEQ ID NO: 887138 - RNA, 19 nt, Homo sapiens
gcaucaaccaucuggauau

SEQ ID NO: 887139 - RNA, 19 nt, Homo sapiens
gguucaauguucaagagaa

SEQ ID NO: 887140 - RNA, 19 nt, Homo sapiens
aagagaauuucccauuaug

SEQ ID NO: 887141 - RNA, 19 nt, Homo sapiens
guaauuucucuuccucuuu

SEQ ID NO: 887142 - RNA, 19 nt, Homo sapiens
aaguuuguguugcaguuua

SEQ ID NO: 887143 - RNA, 19 nt, Homo sapiens
ggaucacaguauaaauuuc

SEQ ID NO: 887144 - RNA, 19 nt, Homo sapiens
cacaagagaauuucccauu

SEQ ID NO: 887145 - RNA, 19 nt, Homo sapiens
agacuaggguaaucaucuu

SEQ ID NO: 887146 - RNA, 19 nt, Homo sapiens
gaaaggauacggauagaua

SEQ ID NO: 887147 - RNA, 19 nt, Homo sapiens
gcacacaccuccacaguga

SEQ ID NO: 887148 - RNA, 19 nt, Homo sapiens
ggaagcagguucuuuaugu

SEQ ID NO: 887149 - RNA, 19 nt, Homo sapiens
gaagagagggaaccuguua

SEQ ID NO: 887150 - RNA, 19 nt, Homo sapiens
gaucaucccuucucacaga

SEQ ID NO: 887151 - RNA, 19 nt, Homo sapiens
ucacagagggucaucauua

SEQ ID NO: 887152 - RNA, 19 nt, Homo sapiens
gaacaagcgugacuucucu

SEQ ID NO: 887153 - RNA, 19 nt, Homo sapiens
ugacggagcccuauaauga

SEQ ID NO: 887154 - RNA, 19 nt, Homo sapiens
acaaugagcucaaagugaa

SEQ ID NO: 887155 - RNA, 19 nt, Homo sapiens
ggaaggagaacaugaaguu

SEQ ID NO: 887156 - RNA, 19 nt, Homo sapiens
gggagaagcugauggagau

SEQ ID NO: 887157 - RNA, 19 nt, Homo sapiens
ccacaacucuucucaacga

SEQ ID NO: 887158 - RNA, 19 nt, Homo sapiens
caacggacauaaucuguuc

SEQ ID NO: 887159 - RNA, 19 nt, Homo sapiens
ggaaagcccuuagucuugu

SEQ ID NO: 887160 - RNA, 19 nt, Homo sapiens
auaaugaccucgugaaaga

SEQ ID NO: 887161 - RNA, 19 nt, Homo sapiens
gcaaagggcauccaaaugg

SEQ ID NO: 887162 - RNA, 19 nt, Homo sapiens
uaagagcucugcccucaug

SEQ ID NO: 887163 - RNA, 19 nt, Homo sapiens
ggaagcgggugucugagaa

SEQ ID NO: 887164 - RNA, 19 nt, Homo sapiens
ugacagggcugacucaagu

SEQ ID NO: 887165 - RNA, 19 nt, Homo sapiens
gacgagcaguccaauauug

SEQ ID NO: 887166 - RNA, 19 nt, Homo sapiens
gaaagcccuuagucuugua

SEQ ID NO: 887167 - RNA, 19 nt, Homo sapiens
gaaagaggagcucaauaug

SEQ ID NO: 887168 - RNA, 19 nt, Homo sapiens
ugaaagaggagcucaauau

SEQ ID NO: 887169 - RNA, 19 nt, Homo sapiens
ggagaacagcccucaguuu

SEQ ID NO: 887170 - RNA, 19 nt, Homo sapiens
caacugcuguacccagaaa

SEQ ID NO: 887171 - RNA, 19 nt, Homo sapiens
ccacgagaaugccaucuga

SEQ ID NO: 887172 - RNA, 19 nt, Homo sapiens
guucucaacuguaaggaaa

SEQ ID NO: 887173 - RNA, 19 nt, Homo sapiens
gagaacagcccucaguuuc

SEQ ID NO: 887174 - RNA, 19 nt, Homo sapiens
gcuaaacgauauauggaau

SEQ ID NO: 887175 - RNA, 19 nt, Homo sapiens
gacuaucacucgcuucuau

SEQ ID NO: 887176 - RNA, 19 nt, Homo sapiens
aagaggagcucaauaugau

SEQ ID NO: 887177 - RNA, 19 nt, Homo sapiens
gggaaagcccuuagucuug

SEQ ID NO: 887178 - RNA, 19 nt, Homo sapiens
gcucugcccucaugugaau

SEQ ID NO: 887179 - RNA, 19 nt, Homo sapiens
gaagacgagcaguccaaua

SEQ ID NO: 887180 - RNA, 19 nt, Homo sapiens
ggccuuauccacccacuua

SEQ ID NO: 887181 - RNA, 19 nt, Homo sapiens
ucacaauccuucuagacaa

SEQ ID NO: 887182 - RNA, 19 nt, Homo sapiens
cagagggucaucauuauuu

SEQ ID NO: 887183 - RNA, 19 nt, Homo sapiens
cauggguucucaacuguaa

SEQ ID NO: 887184 - RNA, 19 nt, Homo sapiens
gcaccugcgcuguagcuua

SEQ ID NO: 887185 - RNA, 19 nt, Homo sapiens
ggaagcaacggacauaauc

SEQ ID NO: 887186 - RNA, 19 nt, Homo sapiens
ucaaggaugcggacaauga

SEQ ID NO: 887187 - RNA, 19 nt, Homo sapiens
gcgagagcaugaagcugua

SEQ ID NO: 887188 - RNA, 19 nt, Homo sapiens
uuaugacucuugugucuuu

SEQ ID NO: 887189 - RNA, 19 nt, Homo sapiens
gaccacaacucuucucaac

SEQ ID NO: 887190 - RNA, 19 nt, Homo sapiens
ggcaacaucuccagcaauc

SEQ ID NO: 887191 - RNA, 19 nt, Homo sapiens
ggucaucauuauuuccaaa

SEQ ID NO: 887192 - RNA, 19 nt, Homo sapiens
ggauagauagccugucuga

SEQ ID NO: 887193 - RNA, 19 nt, Homo sapiens
ccagcaaucugaucuccuu

SEQ ID NO: 887194 - RNA, 19 nt, Homo sapiens
aaagaggagcucaauauga

SEQ ID NO: 887195 - RNA, 19 nt, Homo sapiens
gcucagccucccucaguua

SEQ ID NO: 887196 - RNA, 19 nt, Homo sapiens
gacaaugagcucaaaguga

SEQ ID NO: 887197 - RNA, 19 nt, Homo sapiens
cacagagggucaucauuau

SEQ ID NO: 887198 - RNA, 19 nt, Homo sapiens
gaccagggauugucuugca

SEQ ID NO: 887199 - RNA, 19 nt, Homo sapiens
gaagcagguucuuuauguc

SEQ ID NO: 887200 - RNA, 19 nt, Homo sapiens
ugacuucucugccuucaag

SEQ ID NO: 887201 - RNA, 19 nt, Homo sapiens
gaacuggcccacccacugu

SEQ ID NO: 887202 - RNA, 19 nt, Homo sapiens
gaugagccauacccuggaa

SEQ ID NO: 887203 - RNA, 19 nt, Homo sapiens
caccugcgcuguagcuuau

SEQ ID NO: 887204 - RNA, 19 nt, Homo sapiens
ggaagggaagacaggguua

SEQ ID NO: 887205 - RNA, 19 nt, Homo sapiens
ggacaaugagcucaaagug

SEQ ID NO: 887206 - RNA, 19 nt, Homo sapiens
caucauccuucucaccaaa

SEQ ID NO: 887207 - RNA, 19 nt, Homo sapiens
aggagaacaugaaguuuga

SEQ ID NO: 887208 - RNA, 19 nt, Homo sapiens
caaguacccagaugucauu

SEQ ID NO: 887209 - RNA, 19 nt, Homo sapiens
ccucuucccuggcccauug

SEQ ID NO: 887210 - RNA, 19 nt, Homo sapiens
cacggaagcagguucuuua

SEQ ID NO: 887211 - RNA, 19 nt, Homo sapiens
ggucucaggccuuugauug

SEQ ID NO: 887212 - RNA, 19 nt, Homo sapiens
gaaggagaacaugaaguuu

SEQ ID NO: 887213 - RNA, 19 nt, Homo sapiens
gccuuccgccugauuauua

SEQ ID NO: 887214 - RNA, 19 nt, Homo sapiens
gaagggaagacaggguuaa

SEQ ID NO: 887215 - RNA, 19 nt, Homo sapiens
gccaguacaucucugacuu

SEQ ID NO: 887216 - RNA, 19 nt, Homo sapiens
caacuggcccuuugugaca

SEQ ID NO: 887217 - RNA, 19 nt, Homo sapiens
ggaagacaggguuaaggaa

SEQ ID NO: 887218 - RNA, 19 nt, Homo sapiens
gcaguccaauauuguagau

SEQ ID NO: 887219 - RNA, 19 nt, Homo sapiens
ucacagaagcaaagaacaa

SEQ ID NO: 887220 - RNA, 19 nt, Homo sapiens
aguggaggcuuaucuguug

SEQ ID NO: 887221 - RNA, 19 nt, Homo sapiens
ggguuaaggaacuuuauuu

SEQ ID NO: 887222 - RNA, 19 nt, Homo sapiens
ccagaaaggauacggauag

SEQ ID NO: 887223 - RNA, 19 nt, Homo sapiens
gauauucucuacgucaaag

SEQ ID NO: 887224 - RNA, 19 nt, Homo sapiens
caacaccucccucacaauc

SEQ ID NO: 887225 - RNA, 19 nt, Homo sapiens
cugcacauucuccuaauua

SEQ ID NO: 887226 - RNA, 19 nt, Homo sapiens
gacaugauaaucugagcua

SEQ ID NO: 887227 - RNA, 19 nt, Homo sapiens
cagcuugugucccugauuc

SEQ ID NO: 887228 - RNA, 19 nt, Homo sapiens
ucgaggagaucaucaaguc

SEQ ID NO: 887229 - RNA, 19 nt, Homo sapiens
gaccaaaacuguagaggau

SEQ ID NO: 887230 - RNA, 19 nt, Homo sapiens
ugauggagauguugaaggu

SEQ ID NO: 887231 - RNA, 19 nt, Homo sapiens
uuagcaagcuccuggacuu

SEQ ID NO: 887232 - RNA, 19 nt, Homo sapiens
gagcucugcccucauguga

SEQ ID NO: 887233 - RNA, 19 nt, Homo sapiens
agggcugacucaaguguua

SEQ ID NO: 887234 - RNA, 19 nt, Homo sapiens
gggaagacaggguuaagga

SEQ ID NO: 887235 - RNA, 19 nt, Homo sapiens
cagaaaggauacggauaga

SEQ ID NO: 887236 - RNA, 19 nt, Homo sapiens
gaaccuguuaguccagaaa

SEQ ID NO: 887237 - RNA, 19 nt, Homo sapiens
ccacccacauggagaacuu

SEQ ID NO: 887238 - RNA, 19 nt, Homo sapiens
gucaacaccucccucacaa

SEQ ID NO: 887239 - RNA, 19 nt, Homo sapiens
gcgcuaugcccgcaagauu

SEQ ID NO: 887240 - RNA, 19 nt, Homo sapiens
gacgagaccacaacucuuc

SEQ ID NO: 887241 - RNA, 19 nt, Homo sapiens
gcugcacauucuccuaauu

SEQ ID NO: 887242 - RNA, 19 nt, Homo sapiens
gcagggaaggagaacauga

SEQ ID NO: 887243 - RNA, 19 nt, Homo sapiens
cuccaggacugcuucauga

SEQ ID NO: 887244 - RNA, 19 nt, Homo sapiens
caggagauucgcacuguuu

SEQ ID NO: 887245 - RNA, 19 nt, Homo sapiens
gcuaugcccgcaagauuga

SEQ ID NO: 887246 - RNA, 19 nt, Homo sapiens
gaaagagggucugaaguuu

SEQ ID NO: 887247 - RNA, 19 nt, Homo sapiens
ggaaagagggucugaaguu

SEQ ID NO: 887248 - RNA, 19 nt, Homo sapiens
ccagguggauccucuuuaa

SEQ ID NO: 887249 - RNA, 19 nt, Homo sapiens
caaggugucugaugaugaa

SEQ ID NO: 887250 - RNA, 19 nt, Homo sapiens
gcagccagccgguggauua

SEQ ID NO: 887251 - RNA, 19 nt, Homo sapiens
ggaaugccaucaucucuag

SEQ ID NO: 887252 - RNA, 19 nt, Homo sapiens
ggaggcugcucuucugauu

SEQ ID NO: 887253 - RNA, 19 nt, Homo sapiens
ggagugagcugagcagaag

SEQ ID NO: 887254 - RNA, 19 nt, Homo sapiens
ggacuuggccuucguggau

SEQ ID NO: 887255 - RNA, 19 nt, Homo sapiens
ucugagagcuggccuagug

SEQ ID NO: 887256 - RNA, 19 nt, Homo sapiens
gccgugaccucuauuuguu

SEQ ID NO: 887257 - RNA, 19 nt, Homo sapiens
ggacagugcggcauauuca

SEQ ID NO: 887258 - RNA, 19 nt, Homo sapiens
aagagggucugaaguuuga

SEQ ID NO: 887259 - RNA, 19 nt, Homo sapiens
ugaaaggaaugccaucauc

SEQ ID NO: 887260 - RNA, 19 nt, Homo sapiens
ccucagaacuagacaucaa

SEQ ID NO: 887261 - RNA, 19 nt, Homo sapiens
ggucugaaguuugagaaug

SEQ ID NO: 887262 - RNA, 19 nt, Homo sapiens
gccgguggauuacuucauu

SEQ ID NO: 887263 - RNA, 19 nt, Homo sapiens
gcauucaucugcguauugu

SEQ ID NO: 887264 - RNA, 19 nt, Homo sapiens
gcagggacagugcggcaua

SEQ ID NO: 887265 - RNA, 19 nt, Homo sapiens
uuagauggcccuuguaguu

SEQ ID NO: 887266 - RNA, 19 nt, Homo sapiens
ccacacaccacuaccugua

SEQ ID NO: 887267 - RNA, 19 nt, Homo sapiens
ggugucugaugaugaauau

SEQ ID NO: 887268 - RNA, 19 nt, Homo sapiens
guggauuacuucauucuca

SEQ ID NO: 887269 - RNA, 19 nt, Homo sapiens
caccaucacucguuucuac

SEQ ID NO: 887270 - RNA, 19 nt, Homo sapiens
gaaaggaaugccaucaucu

SEQ ID NO: 887271 - RNA, 19 nt, Homo sapiens
gguccuggguguccucaga

SEQ ID NO: 887272 - RNA, 19 nt, Homo sapiens
gcggaacccaggcguuuaa

SEQ ID NO: 887273 - RNA, 19 nt, Homo sapiens
cgacugcaguaccucaaug

SEQ ID NO: 887274 - RNA, 19 nt, Homo sapiens
ugagggcgcucucugaucu

SEQ ID NO: 887275 - RNA, 19 nt, Homo sapiens
ggagaguagcugccuguug

SEQ ID NO: 887276 - RNA, 19 nt, Homo sapiens
ucagaucgauggccuuguc

SEQ ID NO: 887277 - RNA, 19 nt, Homo sapiens
ggaggaagggaucgucaug

SEQ ID NO: 887278 - RNA, 19 nt, Homo sapiens
gagcugagcagaaguuuug

SEQ ID NO: 887279 - RNA, 19 nt, Homo sapiens
ggaaggaaugaaaggaaug

SEQ ID NO: 887280 - RNA, 19 nt, Homo sapiens
ggacaugcucuaccucaag

SEQ ID NO: 887281 - RNA, 19 nt, Homo sapiens
ucagcaccaucacucguuu

SEQ ID NO: 887282 - RNA, 19 nt, Homo sapiens
cccgagaaguggauguauu

SEQ ID NO: 887283 - RNA, 19 nt, Homo sapiens
cugcagcucaucaagguua

SEQ ID NO: 887284 - RNA, 19 nt, Homo sapiens
cccguaggcugucccugua

SEQ ID NO: 887285 - RNA, 19 nt, Homo sapiens
aaagagggucugaaguuug

SEQ ID NO: 887286 - RNA, 19 nt, Homo sapiens
gccagccgguggauuacuu

SEQ ID NO: 887287 - RNA, 19 nt, Homo sapiens
gcccagaaccugccacagu

SEQ ID NO: 887288 - RNA, 19 nt, Homo sapiens
ugcagaaggugaacaacga

SEQ ID NO: 887289 - RNA, 19 nt, Homo sapiens
uguucaaggugucugauga

SEQ ID NO: 887290 - RNA, 19 nt, Homo sapiens
cgugaccucuauuuguuug

SEQ ID NO: 887291 - RNA, 19 nt, Homo sapiens
guugucaguucccguguuc

SEQ ID NO: 887292 - RNA, 19 nt, Homo sapiens
caggaaggaaugaaaggaa

SEQ ID NO: 887293 - RNA, 19 nt, Homo sapiens
aggaaggaaugaaaggaau

SEQ ID NO: 887294 - RNA, 19 nt, Homo sapiens
ucaaggugucugaugauga

SEQ ID NO: 887295 - RNA, 19 nt, Homo sapiens
cugauggugucauguuuca

SEQ ID NO: 887296 - RNA, 19 nt, Homo sapiens
ggccgugaccucuauuugu

SEQ ID NO: 887297 - RNA, 19 nt, Homo sapiens
ucucugaucugcagcucau

SEQ ID NO: 887298 - RNA, 19 nt, Homo sapiens
ccuggaggcugcucuucug

SEQ ID NO: 887299 - RNA, 19 nt, Homo sapiens
aaguggagaucgggaaaga

SEQ ID NO: 887300 - RNA, 19 nt, Homo sapiens
gcagggcaggguugaagug

SEQ ID NO: 887301 - RNA, 19 nt, Homo sapiens
ccgagaaguggauguauuc

SEQ ID NO: 887302 - RNA, 19 nt, Homo sapiens
cugcccaccugcugaguug

SEQ ID NO: 887303 - RNA, 19 nt, Homo sapiens
gaaccagguggauccucuu

SEQ ID NO: 887304 - RNA, 19 nt, Homo sapiens
aagccgagagcacccauuu

SEQ ID NO: 887305 - RNA, 19 nt, Homo sapiens
gggacagugcggcauauuc

SEQ ID NO: 887306 - RNA, 19 nt, Homo sapiens
uagauggcccuuguaguug

SEQ ID NO: 887307 - RNA, 19 nt, Homo sapiens
gagugucggcccuaacugu

SEQ ID NO: 887308 - RNA, 19 nt, Homo sapiens
gucugaaguuugagaaugg

SEQ ID NO: 887309 - RNA, 19 nt, Homo sapiens
ucugaagacuaccgagaca

SEQ ID NO: 887310 - RNA, 19 nt, Homo sapiens
aggcugcucuucugauucu

SEQ ID NO: 887311 - RNA, 19 nt, Homo sapiens
ccaggugacggcacgcauu

SEQ ID NO: 887312 - RNA, 19 nt, Homo sapiens
cggcauauucagauucaga

SEQ ID NO: 887313 - RNA, 19 nt, Homo sapiens
gaaggaaugaaaggaaugc

SEQ ID NO: 887314 - RNA, 19 nt, Homo sapiens
caucaaugccuggauccuu

SEQ ID NO: 887315 - RNA, 19 nt, Homo sapiens
uauggagugucggcccuaa

SEQ ID NO: 887316 - RNA, 19 nt, Homo sapiens
ugaaguggagaucgggaaa

SEQ ID NO: 887317 - RNA, 19 nt, Homo sapiens
guguggccgugaccucuau

SEQ ID NO: 887318 - RNA, 19 nt, Homo sapiens
cagggacagugcggcauau

SEQ ID NO: 887319 - RNA, 19 nt, Homo sapiens
ggcggaacccaggcguuua

SEQ ID NO: 887320 - RNA, 19 nt, Homo sapiens
gggaaagagggucugaagu

SEQ ID NO: 887321 - RNA, 19 nt, Homo sapiens
cccugauggugucauguuu

SEQ ID NO: 887322 - RNA, 19 nt, Homo sapiens
caaccauccgcuccacuuc

SEQ ID NO: 887323 - RNA, 19 nt, Homo sapiens
gaggacaacuccaauuuaa

SEQ ID NO: 887324 - RNA, 19 nt, Homo sapiens
guagauaacuucacaguca

SEQ ID NO: 887325 - RNA, 19 nt, Homo sapiens
ggaaguaagugaaauuugu

SEQ ID NO: 887326 - RNA, 19 nt, Homo sapiens
aaacugaucucuacacuga

SEQ ID NO: 887327 - RNA, 19 nt, Homo sapiens
gaaagaaugugagauggaa

SEQ ID NO: 887328 - RNA, 19 nt, Homo sapiens
gcaagaagcugcugagaac

SEQ ID NO: 887329 - RNA, 19 nt, Homo sapiens
gauagaacaugcuagaaau

SEQ ID NO: 887330 - RNA, 19 nt, Homo sapiens
gaucuucugucuuucuaaa

SEQ ID NO: 887331 - RNA, 19 nt, Homo sapiens
uaacaccucugaucacaug

SEQ ID NO: 887332 - RNA, 19 nt, Homo sapiens
gaauaacuaucucccuuuc

SEQ ID NO: 887333 - RNA, 19 nt, Homo sapiens
gauggaacuucaggucuua

SEQ ID NO: 887334 - RNA, 19 nt, Homo sapiens
ggaugaaacugaucucuac

SEQ ID NO: 887335 - RNA, 19 nt, Homo sapiens
cauuaaagcuuucauaagg

SEQ ID NO: 887336 - RNA, 19 nt, Homo sapiens
ggacaacuccaauuuaaca

SEQ ID NO: 887337 - RNA, 19 nt, Homo sapiens
acacaggaauguugaagaa

SEQ ID NO: 887338 - RNA, 19 nt, Homo sapiens
cuacaugccugacuacuca

SEQ ID NO: 887339 - RNA, 19 nt, Homo sapiens
ggucuuaagugcaaaucaa

SEQ ID NO: 887340 - RNA, 19 nt, Homo sapiens
uaacacauuucaugcauag

SEQ ID NO: 887341 - RNA, 19 nt, Homo sapiens
gagcugaaguuugaugaga

SEQ ID NO: 887342 - RNA, 19 nt, Homo sapiens
ggagggagacugaucauuc

SEQ ID NO: 887343 - RNA, 19 nt, Homo sapiens
ccacacccauugagucauu

SEQ ID NO: 887344 - RNA, 19 nt, Homo sapiens
caauaauucugcucuggaa

SEQ ID NO: 887345 - RNA, 19 nt, Homo sapiens
guaggaggucugaagauua

SEQ ID NO: 887346 - RNA, 19 nt, Homo sapiens
gaagaggucaccagaagga

SEQ ID NO: 887347 - RNA, 19 nt, Homo sapiens
ggcuggaucuucugucuuu

SEQ ID NO: 887348 - RNA, 19 nt, Homo sapiens
gaaccucaagucacuguuu

SEQ ID NO: 887349 - RNA, 19 nt, Homo sapiens
uccaggagcugaaguuuga

SEQ ID NO: 887350 - RNA, 19 nt, Homo sapiens
caugacuucuccuuguuua

SEQ ID NO: 887351 - RNA, 19 nt, Homo sapiens
guacuuagacccaaaccaa

SEQ ID NO: 887352 - RNA, 19 nt, Homo sapiens
uagaggagauuaucaaguc

SEQ ID NO: 887353 - RNA, 19 nt, Homo sapiens
gaacaagaacuaccaucau

SEQ ID NO: 887354 - RNA, 19 nt, Homo sapiens
caugacuucucguagauaa

SEQ ID NO: 887355 - RNA, 19 nt, Homo sapiens
gugcaugacuucucguaga

SEQ ID NO: 887356 - RNA, 19 nt, Homo sapiens
gagcauuaaagcuuucaua

SEQ ID NO: 887357 - RNA, 19 nt, Homo sapiens
gauggaaccucaagucacu

SEQ ID NO: 887358 - RNA, 19 nt, Homo sapiens
gaagaucucaccacagcuu

SEQ ID NO: 887359 - RNA, 19 nt, Homo sapiens
acagugaccuggugaagga

SEQ ID NO: 887360 - RNA, 19 nt, Homo sapiens
gaucauuccucuggguuau

SEQ ID NO: 887361 - RNA, 19 nt, Homo sapiens
gcauuacacccaucccuuu

SEQ ID NO: 887362 - RNA, 19 nt, Homo sapiens
caccugcucuugccuggua

SEQ ID NO: 887363 - RNA, 19 nt, Homo sapiens
ugucucagcuggaauggaa

SEQ ID NO: 887364 - RNA, 19 nt, Homo sapiens
ugacauggccauaacagaa

SEQ ID NO: 887365 - RNA, 19 nt, Homo sapiens
agaaguugcuggagacguu

SEQ ID NO: 887366 - RNA, 19 nt, Homo sapiens
gcucagcagugcaugacuu

SEQ ID NO: 887367 - RNA, 19 nt, Homo sapiens
agucuucaaucgaucaaua

SEQ ID NO: 887368 - RNA, 19 nt, Homo sapiens
gagauaagcaccuucuaca

SEQ ID NO: 887369 - RNA, 19 nt, Homo sapiens
ugaggacaacuccaauuua

SEQ ID NO: 887370 - RNA, 19 nt, Homo sapiens
ccucagcgaugugcaguuu

SEQ ID NO: 887371 - RNA, 19 nt, Homo sapiens
ggaaagaaugugagaugga

SEQ ID NO: 887372 - RNA, 19 nt, Homo sapiens
caucagauagugaauguug

SEQ ID NO: 887373 - RNA, 19 nt, Homo sapiens
guggaaguccucagaaauu

SEQ ID NO: 887374 - RNA, 19 nt, Homo sapiens
uaggaggucugaagauuag

SEQ ID NO: 887375 - RNA, 19 nt, Homo sapiens
aacaagaacuaccaucaug

SEQ ID NO: 887376 - RNA, 19 nt, Homo sapiens
ugauagaacaugcuagaaa

SEQ ID NO: 887377 - RNA, 19 nt, Homo sapiens
uuaagucucuguaccuuuc

SEQ ID NO: 887378 - RNA, 19 nt, Homo sapiens
gaaguggagcccuuuaagu

SEQ ID NO: 887379 - RNA, 19 nt, Homo sapiens
ccacugcuguugcauuaca

SEQ ID NO: 887380 - RNA, 19 nt, Homo sapiens
ccucaauguuggguacuua

SEQ ID NO: 887381 - RNA, 19 nt, Homo sapiens
gcaaccacagccagccuua

SEQ ID NO: 887382 - RNA, 19 nt, Homo sapiens
ccaagaaagauacauaauc

SEQ ID NO: 887383 - RNA, 19 nt, Homo sapiens
cuaacacauuucaugcaua

SEQ ID NO: 887384 - RNA, 19 nt, Homo sapiens
agccacugcuguugcauua

SEQ ID NO: 887385 - RNA, 19 nt, Homo sapiens
gaaguggaaguccucagaa

SEQ ID NO: 887386 - RNA, 19 nt, Homo sapiens
uaaguggucuuuucaaaug

SEQ ID NO: 887387 - RNA, 19 nt, Homo sapiens
gcccagcguuucugcaaug

SEQ ID NO: 887388 - RNA, 19 nt, Homo sapiens
caggaauguugaagaauca

SEQ ID NO: 887389 - RNA, 19 nt, Homo sapiens
cagcuggaauggaaagaau

SEQ ID NO: 887390 - RNA, 19 nt, Homo sapiens
ccaucacgcuccucaacaa

SEQ ID NO: 887391 - RNA, 19 nt, Homo sapiens
ggcacacccuagaguauug

SEQ ID NO: 887392 - RNA, 19 nt, Homo sapiens
acaggaauguugaagaauc

SEQ ID NO: 887393 - RNA, 19 nt, Homo sapiens
ucacacggcagcaauauca

SEQ ID NO: 887394 - RNA, 19 nt, Homo sapiens
gaccacugcuugcucagau

SEQ ID NO: 887395 - RNA, 19 nt, Homo sapiens
gaaaauggagccuuuacuu

SEQ ID NO: 887396 - RNA, 19 nt, Homo sapiens
cggcaugacuucuccuugu

SEQ ID NO: 887397 - RNA, 19 nt, Homo sapiens
gaaggaggagcucaacauc

SEQ ID NO: 887398 - RNA, 19 nt, Homo sapiens
ucucagaccuacaaagagu

SEQ ID NO: 887399 - RNA, 19 nt, Homo sapiens
gaucgagugcugucugcua

SEQ ID NO: 887400 - RNA, 19 nt, Homo sapiens
gcaggagaaucgcuugaac

SEQ ID NO: 887401 - RNA, 19 nt, Homo sapiens
ugaguguacuuuauuccaa

SEQ ID NO: 887402 - RNA, 19 nt, Homo sapiens
gaucagcugaguguacuuu

SEQ ID NO: 887403 - RNA, 19 nt, Homo sapiens
aaagcaaguuuagccauga

SEQ ID NO: 887404 - RNA, 19 nt, Homo sapiens
cuucaggucuuaagugcaa

SEQ ID NO: 887405 - RNA, 19 nt, Homo sapiens
ugacugguuuccuguuaga

SEQ ID NO: 887406 - RNA, 19 nt, Homo sapiens
ggaguaggaggucugaaga

SEQ ID NO: 887407 - RNA, 19 nt, Homo sapiens
gaugugcaguuugugaaga

SEQ ID NO: 887408 - RNA, 19 nt, Homo sapiens
gguggagguugguaaggaa

SEQ ID NO: 887409 - RNA, 19 nt, Homo sapiens
gaaguuugaugagaagaac

SEQ ID NO: 887410 - RNA, 19 nt, Homo sapiens
ggcaugacuucuccuuguu

SEQ ID NO: 887411 - RNA, 19 nt, Homo sapiens
gauaucauagaggagauua

SEQ ID NO: 887412 - RNA, 19 nt, Homo sapiens
ggaggagcucaacaucaua

SEQ ID NO: 887413 - RNA, 19 nt, Homo sapiens
gcauuaaagcuuucauaag

SEQ ID NO: 887414 - RNA, 19 nt, Homo sapiens
gagagcagcaucagauagu

SEQ ID NO: 887415 - RNA, 19 nt, Homo sapiens
aggaagaaaugacugacuu

SEQ ID NO: 887416 - RNA, 19 nt, Homo sapiens
ggagauaagcaccuucuac

SEQ ID NO: 887417 - RNA, 19 nt, Homo sapiens
cuaaaucuccaaaccauuc

SEQ ID NO: 887418 - RNA, 19 nt, Homo sapiens
guaagugaaauuugucuuc

SEQ ID NO: 887419 - RNA, 19 nt, Homo sapiens
gagauggaaccucaaguca

SEQ ID NO: 887420 - RNA, 19 nt, Homo sapiens
gaauggaaagaaugugaga

SEQ ID NO: 887421 - RNA, 19 nt, Homo sapiens
ugacauuacagcacagaaa

SEQ ID NO: 887422 - RNA, 19 nt, Homo sapiens
cugaugcucuucuuuguuc

SEQ ID NO: 887423 - RNA, 19 nt, Homo sapiens
gcacacagcuggccuggua

SEQ ID NO: 887424 - RNA, 19 nt, Homo sapiens
ggacuugcaucuuguguuu

SEQ ID NO: 887425 - RNA, 19 nt, Homo sapiens
gcagagggaucauagagaa

SEQ ID NO: 887426 - RNA, 19 nt, Homo sapiens
gaaaugagaugggaaugau

SEQ ID NO: 887427 - RNA, 19 nt, Homo sapiens
ggacauccaauaaagauuu

SEQ ID NO: 887428 - RNA, 19 nt, Homo sapiens
ccaagaggcuggaacauag

SEQ ID NO: 887429 - RNA, 19 nt, Homo sapiens
ggagaaagccgaggucuug

SEQ ID NO: 887430 - RNA, 19 nt, Homo sapiens
ggacagaggagguaacaga

SEQ ID NO: 887431 - RNA, 19 nt, Homo sapiens
gauguagucuugcaguuug

SEQ ID NO: 887432 - RNA, 19 nt, Homo sapiens
ggucagugauguagucuug

SEQ ID NO: 887433 - RNA, 19 nt, Homo sapiens
gcaugcaacuccaaagaau

SEQ ID NO: 887434 - RNA, 19 nt, Homo sapiens
ucaaagaaguggauaagag

SEQ ID NO: 887435 - RNA, 19 nt, Homo sapiens
gcucagaagccauuucauu

SEQ ID NO: 887436 - RNA, 19 nt, Homo sapiens
ggagagacccucagagauc

SEQ ID NO: 887437 - RNA, 19 nt, Homo sapiens
gacgguggaucacuugaaa

SEQ ID NO: 887438 - RNA, 19 nt, Homo sapiens
ucacuguuaucccagcuua

SEQ ID NO: 887439 - RNA, 19 nt, Homo sapiens
acaguagccuuucugaauu

SEQ ID NO: 887440 - RNA, 19 nt, Homo sapiens
ggagguaacagaaggcaaa

SEQ ID NO: 887441 - RNA, 19 nt, Homo sapiens
ggaauaaggaagguucuuu

SEQ ID NO: 887442 - RNA, 19 nt, Homo sapiens
ggaaugauccagcucuuuc

SEQ ID NO: 887443 - RNA, 19 nt, Homo sapiens
gccgaggucuugcagauga

SEQ ID NO: 887444 - RNA, 19 nt, Homo sapiens
gcagaaaccuuggggaaaa

SEQ ID NO: 887445 - RNA, 19 nt, Homo sapiens
gagccaggguugagcaaug

SEQ ID NO: 887446 - RNA, 19 nt, Homo sapiens
gggacaggauucuuugaug

SEQ ID NO: 887447 - RNA, 19 nt, Homo sapiens
gaaggaaaggugacugugu

SEQ ID NO: 887448 - RNA, 19 nt, Homo sapiens
gccaagaggcuggaacaua

SEQ ID NO: 887449 - RNA, 19 nt, Homo sapiens
gaaaggugacugugugauc

SEQ ID NO: 887450 - RNA, 19 nt, Homo sapiens
gcucauuccacacugguua

SEQ ID NO: 887451 - RNA, 19 nt, Homo sapiens
aaggagagauaaagaggaa

SEQ ID NO: 887452 - RNA, 19 nt, Homo sapiens
uaacagaggaaacaaaugg

SEQ ID NO: 887453 - RNA, 19 nt, Homo sapiens
uggacuggcucauauguga

SEQ ID NO: 887454 - RNA, 19 nt, Homo sapiens
gcaacuuccuagccugaga

SEQ ID NO: 887455 - RNA, 19 nt, Homo sapiens
cgucugugcugccugguuu

SEQ ID NO: 887456 - RNA, 19 nt, Homo sapiens
gaagacagaacucacacau

SEQ ID NO: 887457 - RNA, 19 nt, Homo sapiens
gcaagagaaaggaugauuc

SEQ ID NO: 887458 - RNA, 19 nt, Homo sapiens
cgagaccgcaucaacagua

SEQ ID NO: 887459 - RNA, 19 nt, Homo sapiens
ucucugaaaucacugaaau

SEQ ID NO: 887460 - RNA, 19 nt, Homo sapiens
cuacagggucggcugcuua

SEQ ID NO: 887461 - RNA, 19 nt, Homo sapiens
gggauauuguggaaggaaa

SEQ ID NO: 887462 - RNA, 19 nt, Homo sapiens
ccacugccuuugagaaaca

SEQ ID NO: 887463 - RNA, 19 nt, Homo sapiens
gaaacgcagagggaucaua

SEQ ID NO: 887464 - RNA, 19 nt, Homo sapiens
gcaagcaugcaacuccaaa

SEQ ID NO: 887465 - RNA, 19 nt, Homo sapiens
gauaccaggucagugaugu

SEQ ID NO: 887466 - RNA, 19 nt, Homo sapiens
caguagccuuucugaauug

SEQ ID NO: 887467 - RNA, 19 nt, Homo sapiens
gcagacacccacccucuca

SEQ ID NO: 887468 - RNA, 19 nt, Homo sapiens
gugacugugugaucugauu

SEQ ID NO: 887469 - RNA, 19 nt, Homo sapiens
caacccaucucuccuucuc

SEQ ID NO: 887470 - RNA, 19 nt, Homo sapiens
ucagaggcuugguuccauu

SEQ ID NO: 887471 - RNA, 19 nt, Homo sapiens
ccacacugguuagauacuu

SEQ ID NO: 887472 - RNA, 19 nt, Homo sapiens
ggacuccuacgaucugguu

SEQ ID NO: 887473 - RNA, 19 nt, Homo sapiens
uguacucguugguaaauau

SEQ ID NO: 887474 - RNA, 19 nt, Homo sapiens
gcacugccuuuucugcuuu

SEQ ID NO: 887475 - RNA, 19 nt, Homo sapiens
gcaaccagcucgccauccu

SEQ ID NO: 887476 - RNA, 19 nt, Homo sapiens
ccaggucagugauguaguc

SEQ ID NO: 887477 - RNA, 19 nt, Homo sapiens
caacaguagccuuucugaa

SEQ ID NO: 887478 - RNA, 19 nt, Homo sapiens
auuccacacugguuagaua

SEQ ID NO: 887479 - RNA, 19 nt, Homo sapiens
cuucuguacucguugguaa

SEQ ID NO: 887480 - RNA, 19 nt, Homo sapiens
gaaccuugggucugggaaa

SEQ ID NO: 887481 - RNA, 19 nt, Homo sapiens
gaugcaagccaggaagaaa

SEQ ID NO: 887482 - RNA, 19 nt, Homo sapiens
ugaugccacugaaaugaga

SEQ ID NO: 887483 - RNA, 19 nt, Homo sapiens
ggagagauaaagaggaaag

SEQ ID NO: 887484 - RNA, 19 nt, Homo sapiens
gauaagagggaggagauca

SEQ ID NO: 887485 - RNA, 19 nt, Homo sapiens
ggccacaccaucacacuga

SEQ ID NO: 887486 - RNA, 19 nt, Homo sapiens
aacaguagccuuucugaau

SEQ ID NO: 887487 - RNA, 19 nt, Homo sapiens
ugaaaugagaugggaauga

SEQ ID NO: 887488 - RNA, 19 nt, Homo sapiens
gagaccgcaucaacaguag

SEQ ID NO: 887489 - RNA, 19 nt, Homo sapiens
gaauaaggaagguucuuuu

SEQ ID NO: 887490 - RNA, 19 nt, Homo sapiens
gcggacauccaauaaagau

SEQ ID NO: 887491 - RNA, 19 nt, Homo sapiens
gaaggcaaaggccaguuuc

SEQ ID NO: 887492 - RNA, 19 nt, Homo sapiens
gacagaggagguaacagaa

SEQ ID NO: 887493 - RNA, 19 nt, Homo sapiens
uaagagggaggagaucauu

SEQ ID NO: 887494 - RNA, 19 nt, Homo sapiens
gaaaagugaguuugcagaa

SEQ ID NO: 887495 - RNA, 19 nt, Homo sapiens
cugguuagauacuucaguu

SEQ ID NO: 887496 - RNA, 19 nt, Homo sapiens
ccacaggacagacccuuuc

SEQ ID NO: 887497 - RNA, 19 nt, Homo sapiens
uuucucaccugaacagaug

SEQ ID NO: 887498 - RNA, 19 nt, Homo sapiens
caucaacaguagccuuucu

SEQ ID NO: 887499 - RNA, 19 nt, Homo sapiens
gaucugauucuguggucaa

SEQ ID NO: 887500 - RNA, 19 nt, Homo sapiens
gaaugauccagcucuuuca

SEQ ID NO: 887501 - RNA, 19 nt, Homo sapiens
gugauguagucuugcaguu

SEQ ID NO: 887502 - RNA, 19 nt, Homo sapiens
ucugagaugugcaguagca

SEQ ID NO: 887503 - RNA, 19 nt, Homo sapiens
ggaggagaucauugaguga

SEQ ID NO: 887504 - RNA, 19 nt, Homo sapiens
agagggaggagaucauuga

SEQ ID NO: 887505 - RNA, 19 nt, Homo sapiens
ucucccaccuccucccuuu

SEQ ID NO: 887506 - RNA, 19 nt, Homo sapiens
uuagauacuucaguuguca

SEQ ID NO: 887507 - RNA, 19 nt, Homo sapiens
guuagauacuucaguuguc

SEQ ID NO: 887508 - RNA, 19 nt, Homo sapiens
aaacccuucuguacucguu

SEQ ID NO: 887509 - RNA, 19 nt, Homo sapiens
ucucccaccucaacagcua

SEQ ID NO: 887510 - RNA, 19 nt, Homo sapiens
gggaaugauccagcucuuu

SEQ ID NO: 887511 - RNA, 19 nt, Homo sapiens
ccacaccaguugauaaaau

SEQ ID NO: 887512 - RNA, 19 nt, Homo sapiens
caucucuccuucucacugu

SEQ ID NO: 887513 - RNA, 19 nt, Homo sapiens
aaaggugacugugugaucu

SEQ ID NO: 887514 - RNA, 19 nt, Homo sapiens
gaaucugugaugccacuga

SEQ ID NO: 887515 - RNA, 19 nt, Homo sapiens
cacacaugcucccaggauu

SEQ ID NO: 887516 - RNA, 19 nt, Homo sapiens
caagagaaaggaugauucg

SEQ ID NO: 887517 - RNA, 19 nt, Homo sapiens
aaacgcagagggaucauag

SEQ ID NO: 887518 - RNA, 19 nt, Homo sapiens
gguuagauacuucaguugu

SEQ ID NO: 887519 - RNA, 19 nt, Homo sapiens
uugcggacauccaauaaag

SEQ ID NO: 887520 - RNA, 19 nt, Homo sapiens
ucagugauguagucuugca

SEQ ID NO: 887521 - RNA, 19 nt, Homo sapiens
ugggauaccaggucaguga

SEQ ID NO: 887522 - RNA, 19 nt, Homo sapiens
gagacuccacagacugaaa

SEQ ID NO: 887523 - RNA, 19 nt, Homo sapiens
ggaauaugcuucucuaauu

SEQ ID NO: 887524 - RNA, 19 nt, Homo sapiens
ggacuggcuugauaaauua

SEQ ID NO: 887525 - RNA, 19 nt, Homo sapiens
gcugauagaugaaguuaua

SEQ ID NO: 887526 - RNA, 19 nt, Homo sapiens
gaacugagcugcuacuuac

SEQ ID NO: 887527 - RNA, 19 nt, Homo sapiens
gaaaguggcuucuucucaa

SEQ ID NO: 887528 - RNA, 19 nt, Homo sapiens
gagcauuucuggaguauug

SEQ ID NO: 887529 - RNA, 19 nt, Homo sapiens
ccagaaaccucuuggcuuu

SEQ ID NO: 887530 - RNA, 19 nt, Homo sapiens
gaauaugcuucucuaauug

SEQ ID NO: 887531 - RNA, 19 nt, Homo sapiens
ugaaagagcugugcauuau

SEQ ID NO: 887532 - RNA, 19 nt, Homo sapiens
aaagagcugugcauuauaa

SEQ ID NO: 887533 - RNA, 19 nt, Homo sapiens
ggaagacaccaaaccauua

SEQ ID NO: 887534 - RNA, 19 nt, Homo sapiens
ccacaggaaugcacgguua

SEQ ID NO: 887535 - RNA, 19 nt, Homo sapiens
ggaaggaguugccuacaga

SEQ ID NO: 887536 - RNA, 19 nt, Homo sapiens
ggacaucguuaucgaaaug

SEQ ID NO: 887537 - RNA, 19 nt, Homo sapiens
gaaggagaguggauaguug

SEQ ID NO: 887538 - RNA, 19 nt, Homo sapiens
gaacaucuggcuaggcuua

SEQ ID NO: 887539 - RNA, 19 nt, Homo sapiens
gagaagacaccaccagaua

SEQ ID NO: 887540 - RNA, 19 nt, Homo sapiens
gaacggcugcaaacaaaua

SEQ ID NO: 887541 - RNA, 19 nt, Homo sapiens
ggaaauauuuggaggcaau

SEQ ID NO: 887542 - RNA, 19 nt, Homo sapiens
ggaagaagaugaaggugau

SEQ ID NO: 887543 - RNA, 19 nt, Homo sapiens
ccacaaccauugcuauauu

SEQ ID NO: 887544 - RNA, 19 nt, Homo sapiens
ccacugagaucauccauuc

SEQ ID NO: 887545 - RNA, 19 nt, Homo sapiens
aaaucaagcucucauguuu

SEQ ID NO: 887546 - RNA, 19 nt, Homo sapiens
gaagauaccaguucagguu

SEQ ID NO: 887547 - RNA, 19 nt, Homo sapiens
gagaaaggcugggaauaug

SEQ ID NO: 887548 - RNA, 19 nt, Homo sapiens
ggaaucaggucgucaaucu

SEQ ID NO: 887549 - RNA, 19 nt, Homo sapiens
gaagacagguuggacaaug

SEQ ID NO: 887550 - RNA, 19 nt, Homo sapiens
caagguggcugguuccauu

SEQ ID NO: 887551 - RNA, 19 nt, Homo sapiens
ggacaacaauggccugugu

SEQ ID NO: 887552 - RNA, 19 nt, Homo sapiens
gaugaugccuucucacaga

SEQ ID NO: 887553 - RNA, 19 nt, Homo sapiens
ggaaaugagugacaucuac

SEQ ID NO: 887554 - RNA, 19 nt, Homo sapiens
caacacagcugcuucaaaa

SEQ ID NO: 887555 - RNA, 19 nt, Homo sapiens
gauaguugauccugaaaga

SEQ ID NO: 887556 - RNA, 19 nt, Homo sapiens
cagaacggcugcaaacaaa

SEQ ID NO: 887557 - RNA, 19 nt, Homo sapiens
gaagacaccaccagauaaa

SEQ ID NO: 887558 - RNA, 19 nt, Homo sapiens
gagcagaaguccaugaaag

SEQ ID NO: 887559 - RNA, 19 nt, Homo sapiens
gugaugauguggagaguaa

SEQ ID NO: 887560 - RNA, 19 nt, Homo sapiens
gaagaugggaguagaauca

SEQ ID NO: 887561 - RNA, 19 nt, Homo sapiens
ccagauggcuucuaucaca

SEQ ID NO: 887562 - RNA, 19 nt, Homo sapiens
gauggcaacuacuauuauu

SEQ ID NO: 887563 - RNA, 19 nt, Homo sapiens
ggucaaaguucacgucugu

SEQ ID NO: 887564 - RNA, 19 nt, Homo sapiens
ggcaaaggcuucauuucaa

SEQ ID NO: 887565 - RNA, 19 nt, Homo sapiens
ggaaagccaagaaauacua

SEQ ID NO: 887566 - RNA, 19 nt, Homo sapiens
caagagggcugggaauaug

SEQ ID NO: 887567 - RNA, 19 nt, Homo sapiens
cuuguuaccugaaucuuua

SEQ ID NO: 887568 - RNA, 19 nt, Homo sapiens
ggaaugagauuuuggaguu

SEQ ID NO: 887569 - RNA, 19 nt, Homo sapiens
gaaagagcugugcauuaua

SEQ ID NO: 887570 - RNA, 19 nt, Homo sapiens
gaaacaacguaguucagau

SEQ ID NO: 887571 - RNA, 19 nt, Homo sapiens
cuacuuggguuuccuagaa

SEQ ID NO: 887572 - RNA, 19 nt, Homo sapiens
gcaaaggcuucauuucaag

SEQ ID NO: 887573 - RNA, 19 nt, Homo sapiens
gaugaugcauggucuuaug

SEQ ID NO: 887574 - RNA, 19 nt, Homo sapiens
uaaugcagcugacugaaga

SEQ ID NO: 887575 - RNA, 19 nt, Homo sapiens
ggcugaagcugauagauga

SEQ ID NO: 887576 - RNA, 19 nt, Homo sapiens
ggcggaugcugucaaauaa

SEQ ID NO: 887577 - RNA, 19 nt, Homo sapiens
cagauacguucaaguugua

SEQ ID NO: 887578 - RNA, 19 nt, Homo sapiens
cagaauccacccaaaguua

SEQ ID NO: 887579 - RNA, 19 nt, Homo sapiens
aagcugaucucccugcuaa

SEQ ID NO: 887580 - RNA, 19 nt, Homo sapiens
gaaaacagauguccauuac

SEQ ID NO: 887581 - RNA, 19 nt, Homo sapiens
cagcuuggaugaauuugaa

SEQ ID NO: 887582 - RNA, 19 nt, Homo sapiens
agaccgagaucacuacauu

SEQ ID NO: 887583 - RNA, 19 nt, Homo sapiens
ggacaucacacccaaacuu

SEQ ID NO: 887584 - RNA, 19 nt, Homo sapiens
acacggaguucacugauga

SEQ ID NO: 887585 - RNA, 19 nt, Homo sapiens
caaaccaucuuucugaagu

SEQ ID NO: 887586 - RNA, 19 nt, Homo sapiens
caaauaagccacaggacuu

SEQ ID NO: 887587 - RNA, 19 nt, Homo sapiens
cgaugaaguugaaaucuau

SEQ ID NO: 887588 - RNA, 19 nt, Homo sapiens
aaagagcauuucuggagua

SEQ ID NO: 887589 - RNA, 19 nt, Homo sapiens
ccagaggaguacuguguuu

SEQ ID NO: 887590 - RNA, 19 nt, Homo sapiens
auuccaagcucaagauaua

SEQ ID NO: 887591 - RNA, 19 nt, Homo sapiens
uaagaagacacccaacuuu

SEQ ID NO: 887592 - RNA, 19 nt, Homo sapiens
ggaccaaacaauuauauuc

SEQ ID NO: 887593 - RNA, 19 nt, Homo sapiens
caagggccauggaggaauu

SEQ ID NO: 887594 - RNA, 19 nt, Homo sapiens
uaagugcuguggagaagaa

SEQ ID NO: 887595 - RNA, 19 nt, Homo sapiens
gcaaacaaauauagaagcu

SEQ ID NO: 887596 - RNA, 19 nt, Homo sapiens
aaacagauguccauuacag

SEQ ID NO: 887597 - RNA, 19 nt, Homo sapiens
uuacauuguucgaggcuua

SEQ ID NO: 887598 - RNA, 19 nt, Homo sapiens
ucacaguucucgauacuca

SEQ ID NO: 887599 - RNA, 19 nt, Homo sapiens
cauaaggccuguggucaaa

SEQ ID NO: 887600 - RNA, 19 nt, Homo sapiens
ggaaaguggagaugacauu

SEQ ID NO: 887601 - RNA, 19 nt, Homo sapiens
gacaguauauucagaaagg

SEQ ID NO: 887602 - RNA, 19 nt, Homo sapiens
aaacaacguaguucagaua

SEQ ID NO: 887603 - RNA, 19 nt, Homo sapiens
cgaacuauuugucaaugaa

SEQ ID NO: 887604 - RNA, 19 nt, Homo sapiens
ggacugguggaguaaauuu

SEQ ID NO: 887605 - RNA, 19 nt, Homo sapiens
gcugccaucuuuaaacuug

SEQ ID NO: 887606 - RNA, 19 nt, Homo sapiens
gauguuggauuuguuuaug

SEQ ID NO: 887607 - RNA, 19 nt, Homo sapiens
ggaaugcacgguuaggauu

SEQ ID NO: 887608 - RNA, 19 nt, Homo sapiens
ucagauacguucaaguugu

SEQ ID NO: 887609 - RNA, 19 nt, Homo sapiens
ggcgaaggcugguccgaaa

SEQ ID NO: 887610 - RNA, 19 nt, Homo sapiens
ggaaggagaguggauaguu

SEQ ID NO: 887611 - RNA, 19 nt, Homo sapiens
cgucuuugcugaaauguau

SEQ ID NO: 887612 - RNA, 19 nt, Homo sapiens
agaagaaguuuaacagcuu

SEQ ID NO: 887613 - RNA, 19 nt, Homo sapiens
cagcaugccugacaucauc

SEQ ID NO: 887614 - RNA, 19 nt, Homo sapiens
caaguuuccuucagugugu

SEQ ID NO: 887615 - RNA, 19 nt, Homo sapiens
ugcaucauguuaucucuua

SEQ ID NO: 887616 - RNA, 19 nt, Homo sapiens
gcaagaaagauuuaacaca

SEQ ID NO: 887617 - RNA, 19 nt, Homo sapiens
aguaggacgucauaaguuu

SEQ ID NO: 887618 - RNA, 19 nt, Homo sapiens
aaucagggauacaagguaa

SEQ ID NO: 887619 - RNA, 19 nt, Homo sapiens
cagccugucugccguguuu

SEQ ID NO: 887620 - RNA, 19 nt, Homo sapiens
ggaaguggaagauuucuca

SEQ ID NO: 887621 - RNA, 19 nt, Homo sapiens
gauugagggccgacaguua

SEQ ID NO: 887622 - RNA, 19 nt, Homo sapiens
cacaaccauugcuauauuu

SEQ ID NO: 887623 - RNA, 19 nt, Homo sapiens
ggaauaugcuucucuaauu

SEQ ID NO: 887624 - RNA, 19 nt, Homo sapiens
ggacuggcuugauaaauua

SEQ ID NO: 887625 - RNA, 19 nt, Homo sapiens
gcugauagaugaaguuaua

SEQ ID NO: 887626 - RNA, 19 nt, Homo sapiens
gaacugagcugcuacuuac

SEQ ID NO: 887627 - RNA, 19 nt, Homo sapiens
gaaaguggcuucuucucaa

SEQ ID NO: 887628 - RNA, 19 nt, Homo sapiens
gagcauuucuggaguauug

SEQ ID NO: 887629 - RNA, 19 nt, Homo sapiens
ccagaaaccucuuggcuuu

SEQ ID NO: 887630 - RNA, 19 nt, Homo sapiens
gaauaugcuucucuaauug

SEQ ID NO: 887631 - RNA, 19 nt, Homo sapiens
ugaaagagcugugcauuau

SEQ ID NO: 887632 - RNA, 19 nt, Homo sapiens
aaagagcugugcauuauaa

SEQ ID NO: 887633 - RNA, 19 nt, Homo sapiens
ggaagacaccaaaccauua

SEQ ID NO: 887634 - RNA, 19 nt, Homo sapiens
ccacaggaaugcacgguua

SEQ ID NO: 887635 - RNA, 19 nt, Homo sapiens
ggaaggaguugccuacaga

SEQ ID NO: 887636 - RNA, 19 nt, Homo sapiens
ggacaucguuaucgaaaug

SEQ ID NO: 887637 - RNA, 19 nt, Homo sapiens
gaaggagaguggauaguug

SEQ ID NO: 887638 - RNA, 19 nt, Homo sapiens
gaacaucuggcuaggcuua

SEQ ID NO: 887639 - RNA, 19 nt, Homo sapiens
gagaagacaccaccagaua

SEQ ID NO: 887640 - RNA, 19 nt, Homo sapiens
gaacggcugcaaacaaaua

SEQ ID NO: 887641 - RNA, 19 nt, Homo sapiens
ggaaauauuuggaggcaau

SEQ ID NO: 887642 - RNA, 19 nt, Homo sapiens
ggaagaagaugaaggugau

SEQ ID NO: 887643 - RNA, 19 nt, Homo sapiens
ccacaaccauugcuauauu

SEQ ID NO: 887644 - RNA, 19 nt, Homo sapiens
ccacugagaucauccauuc

SEQ ID NO: 887645 - RNA, 19 nt, Homo sapiens
aaaucaagcucucauguuu

SEQ ID NO: 887646 - RNA, 19 nt, Homo sapiens
gaagauaccaguucagguu

SEQ ID NO: 887647 - RNA, 19 nt, Homo sapiens
gagaaaggcugggaauaug

SEQ ID NO: 887648 - RNA, 19 nt, Homo sapiens
ggaaucaggucgucaaucu

SEQ ID NO: 887649 - RNA, 19 nt, Homo sapiens
gaagacagguuggacaaug

SEQ ID NO: 887650 - RNA, 19 nt, Homo sapiens
caagguggcugguuccauu

SEQ ID NO: 887651 - RNA, 19 nt, Homo sapiens
ggacaacaauggccugugu

SEQ ID NO: 887652 - RNA, 19 nt, Homo sapiens
gaugaugccuucucacaga

SEQ ID NO: 887653 - RNA, 19 nt, Homo sapiens
ggaaaugagugacaucuac

SEQ ID NO: 887654 - RNA, 19 nt, Homo sapiens
caacacagcugcuucaaaa

SEQ ID NO: 887655 - RNA, 19 nt, Homo sapiens
gauaguugauccugaaaga

SEQ ID NO: 887656 - RNA, 19 nt, Homo sapiens
cagaacggcugcaaacaaa

SEQ ID NO: 887657 - RNA, 19 nt, Homo sapiens
gaagacaccaccagauaaa

SEQ ID NO: 887658 - RNA, 19 nt, Homo sapiens
gagcagaaguccaugaaag

SEQ ID NO: 887659 - RNA, 19 nt, Homo sapiens
gugaugauguggagaguaa

SEQ ID NO: 887660 - RNA, 19 nt, Homo sapiens
gaagaugggaguagaauca

SEQ ID NO: 887661 - RNA, 19 nt, Homo sapiens
ccagauggcuucuaucaca

SEQ ID NO: 887662 - RNA, 19 nt, Homo sapiens
gauggcaacuacuauuauu

SEQ ID NO: 887663 - RNA, 19 nt, Homo sapiens
ggucaaaguucacgucugu

SEQ ID NO: 887664 - RNA, 19 nt, Homo sapiens
ggcaaaggcuucauuucaa

SEQ ID NO: 887665 - RNA, 19 nt, Homo sapiens
ggaaagccaagaaauacua

SEQ ID NO: 887666 - RNA, 19 nt, Homo sapiens
caagagggcugggaauaug

SEQ ID NO: 887667 - RNA, 19 nt, Homo sapiens
cuuguuaccugaaucuuua

SEQ ID NO: 887668 - RNA, 19 nt, Homo sapiens
ggaaugagauuuuggaguu

SEQ ID NO: 887669 - RNA, 19 nt, Homo sapiens
gaaagagcugugcauuaua

SEQ ID NO: 887670 - RNA, 19 nt, Homo sapiens
gaaacaacguaguucagau

SEQ ID NO: 887671 - RNA, 19 nt, Homo sapiens
cuacuuggguuuccuagaa

SEQ ID NO: 887672 - RNA, 19 nt, Homo sapiens
gcaaaggcuucauuucaag

SEQ ID NO: 887673 - RNA, 19 nt, Homo sapiens
gaugaugcauggucuuaug

SEQ ID NO: 887674 - RNA, 19 nt, Homo sapiens
uaaugcagcugacugaaga

SEQ ID NO: 887675 - RNA, 19 nt, Homo sapiens
ggcugaagcugauagauga

SEQ ID NO: 887676 - RNA, 19 nt, Homo sapiens
gaaguaaacacaggagaaa

SEQ ID NO: 887677 - RNA, 19 nt, Homo sapiens
ggcggaugcugucaaauaa

SEQ ID NO: 887678 - RNA, 19 nt, Homo sapiens
cagauacguucaaguugua

SEQ ID NO: 887679 - RNA, 19 nt, Homo sapiens
cagaauccacccaaaguua

SEQ ID NO: 887680 - RNA, 19 nt, Homo sapiens
aagcugaucucccugcuaa

SEQ ID NO: 887681 - RNA, 19 nt, Homo sapiens
gaaaacagauguccauuac

SEQ ID NO: 887682 - RNA, 19 nt, Homo sapiens
cagcuuggaugaauuugaa

SEQ ID NO: 887683 - RNA, 19 nt, Homo sapiens
agaccgagaucacuacauu

SEQ ID NO: 887684 - RNA, 19 nt, Homo sapiens
ggacaucacacccaaacuu

SEQ ID NO: 887685 - RNA, 19 nt, Homo sapiens
acacggaguucacugauga

SEQ ID NO: 887686 - RNA, 19 nt, Homo sapiens
caaaccaucuuucugaagu

SEQ ID NO: 887687 - RNA, 19 nt, Homo sapiens
caaauaagccacaggacuu

SEQ ID NO: 887688 - RNA, 19 nt, Homo sapiens
cgaugaaguugaaaucuau

SEQ ID NO: 887689 - RNA, 19 nt, Homo sapiens
aaagagcauuucuggagua

SEQ ID NO: 887690 - RNA, 19 nt, Homo sapiens
ccagaggaguacuguguuu

SEQ ID NO: 887691 - RNA, 19 nt, Homo sapiens
auuccaagcucaagauaua

SEQ ID NO: 887692 - RNA, 19 nt, Homo sapiens
uaagaagacacccaacuuu

SEQ ID NO: 887693 - RNA, 19 nt, Homo sapiens
ggaccaaacaauuauauuc

SEQ ID NO: 887694 - RNA, 19 nt, Homo sapiens
caagggccauggaggaauu

SEQ ID NO: 887695 - RNA, 19 nt, Homo sapiens
uaagugcuguggagaagaa

SEQ ID NO: 887696 - RNA, 19 nt, Homo sapiens
gcaaacaaauauagaagcu

SEQ ID NO: 887697 - RNA, 19 nt, Homo sapiens
aaacagauguccauuacag

SEQ ID NO: 887698 - RNA, 19 nt, Homo sapiens
uuacauuguucgaggcuua

SEQ ID NO: 887699 - RNA, 19 nt, Homo sapiens
ucacaguucucgauacuca

SEQ ID NO: 887700 - RNA, 19 nt, Homo sapiens
cauaaggccuguggucaaa

SEQ ID NO: 887701 - RNA, 19 nt, Homo sapiens
ggaaaguggagaugacauu

SEQ ID NO: 887702 - RNA, 19 nt, Homo sapiens
gacaguauauucagaaagg

SEQ ID NO: 887703 - RNA, 19 nt, Homo sapiens
aaacaacguaguucagaua

SEQ ID NO: 887704 - RNA, 19 nt, Homo sapiens
cgaacuauuugucaaugaa

SEQ ID NO: 887705 - RNA, 19 nt, Homo sapiens
ggacugguggaguaaauuu

SEQ ID NO: 887706 - RNA, 19 nt, Homo sapiens
gcugccaucuuuaaacuug

SEQ ID NO: 887707 - RNA, 19 nt, Homo sapiens
ggaaguaaacacaggagaa

SEQ ID NO: 887708 - RNA, 19 nt, Homo sapiens
gauguuggauuuguuuaug

SEQ ID NO: 887709 - RNA, 19 nt, Homo sapiens
ggaaugcacgguuaggauu

SEQ ID NO: 887710 - RNA, 19 nt, Homo sapiens
ucagauacguucaaguugu

SEQ ID NO: 887711 - RNA, 19 nt, Homo sapiens
ggcgaaggcugguccgaaa

SEQ ID NO: 887712 - RNA, 19 nt, Homo sapiens
ggaaggagaguggauaguu

SEQ ID NO: 887713 - RNA, 19 nt, Homo sapiens
cgucuuugcugaaauguau

SEQ ID NO: 887714 - RNA, 19 nt, Homo sapiens
agaagaaguuuaacagcuu

SEQ ID NO: 887715 - RNA, 19 nt, Homo sapiens
cagcaugccugacaucauc

SEQ ID NO: 887716 - RNA, 19 nt, Homo sapiens
caaguuuccuucagugugu

SEQ ID NO: 887717 - RNA, 19 nt, Homo sapiens
ugcaucauguuaucucuua

SEQ ID NO: 887718 - RNA, 19 nt, Homo sapiens
gcaagaaagauuuaacaca

SEQ ID NO: 887719 - RNA, 19 nt, Homo sapiens
aguaggacgucauaaguuu

SEQ ID NO: 887720 - RNA, 19 nt, Homo sapiens
aaucagggauacaagguaa

SEQ ID NO: 887721 - RNA, 19 nt, Homo sapiens
cagccugucugccguguuu

SEQ ID NO: 887722 - RNA, 19 nt, Homo sapiens
gauugagggccgacaguua

SEQ ID NO: 887723 - RNA, 19 nt, Homo sapiens
gaagaucgauugagaaguu

SEQ ID NO: 887724 - RNA, 19 nt, Homo sapiens
cgaauaacaugauggaaua

SEQ ID NO: 887725 - RNA, 19 nt, Homo sapiens
gaaccuuccuguuaaugua

SEQ ID NO: 887726 - RNA, 19 nt, Homo sapiens
gcaacaaauuugaaucuga

SEQ ID NO: 887727 - RNA, 19 nt, Homo sapiens
ggacugagcaacaaauuug

SEQ ID NO: 887728 - RNA, 19 nt, Homo sapiens
ggaaaugugaaacgaauaa

SEQ ID NO: 887729 - RNA, 19 nt, Homo sapiens
acacgaagaucgauugaga

SEQ ID NO: 887730 - RNA, 19 nt, Homo sapiens
aaaaguagcuccugaagaa

SEQ ID NO: 887731 - RNA, 19 nt, Homo sapiens
gaauucccuucuucauuaa

SEQ ID NO: 887732 - RNA, 19 nt, Homo sapiens
uaaauaaccgcauguucua

SEQ ID NO: 887733 - RNA, 19 nt, Homo sapiens
ccaguuauuugccucagua

SEQ ID NO: 887734 - RNA, 19 nt, Homo sapiens
agaguuaacaguugucuua

SEQ ID NO: 887735 - RNA, 19 nt, Homo sapiens
gacauuguguuguuguuau

SEQ ID NO: 887736 - RNA, 19 nt, Homo sapiens
ugcaguauguggccaguua

SEQ ID NO: 887737 - RNA, 19 nt, Homo sapiens
caacaguuauuucauacag

SEQ ID NO: 887738 - RNA, 19 nt, Homo sapiens
uaacaguugucuuaagaag

SEQ ID NO: 887739 - RNA, 19 nt, Homo sapiens
cacauuagguugcaguaug

SEQ ID NO: 887740 - RNA, 19 nt, Homo sapiens
gaacacgaagaucgauuga

SEQ ID NO: 887741 - RNA, 19 nt, Homo sapiens
gaauuuaaagccagcauca

SEQ ID NO: 887742 - RNA, 19 nt, Homo sapiens
ugacauaacauugguucua

SEQ ID NO: 887743 - RNA, 19 nt, Homo sapiens
ugaaacgaauaacaugaug

SEQ ID NO: 887744 - RNA, 19 nt, Homo sapiens
uauguugucuuuccaaugg

SEQ ID NO: 887745 - RNA, 19 nt, Homo sapiens
ucgaccagauuagcauuua

SEQ ID NO: 887746 - RNA, 19 nt, Homo sapiens
aauguacguuggcuacuuu

SEQ ID NO: 887747 - RNA, 19 nt, Homo sapiens
gagcaacaaauuugaaucu

SEQ ID NO: 887748 - RNA, 19 nt, Homo sapiens
gacauaacauugguucuac

SEQ ID NO: 887749 - RNA, 19 nt, Homo sapiens
ccaaguauguugucuuucc

SEQ ID NO: 887750 - RNA, 19 nt, Homo sapiens
cgaaaucuaugaggaagag

SEQ ID NO: 887751 - RNA, 19 nt, Homo sapiens
aaggaaaugugaaacgaau

SEQ ID NO: 887752 - RNA, 19 nt, Homo sapiens
guauguggccaguuauuug

SEQ ID NO: 887753 - RNA, 19 nt, Homo sapiens
cgacgaaaucuaugaggaa

SEQ ID NO: 887754 - RNA, 19 nt, Homo sapiens
uuccaaguauguugucuuu

SEQ ID NO: 887755 - RNA, 19 nt, Homo sapiens
gcugugguuuccugaguug

SEQ ID NO: 887756 - RNA, 19 nt, Homo sapiens
uaauguacguuggcuacuu

SEQ ID NO: 887757 - RNA, 19 nt, Homo sapiens
gccagcaucaacagaguua

SEQ ID NO: 887758 - RNA, 19 nt, Homo sapiens
aaucugaauucccuucuuc

SEQ ID NO: 887759 - RNA, 19 nt, Homo sapiens
aguagcuccugaagaauuu

SEQ ID NO: 887760 - RNA, 19 nt, Homo sapiens
uuaaauaaccgcauguucu

SEQ ID NO: 887761 - RNA, 19 nt, Homo sapiens
cgauugagaaguuauuaga

SEQ ID NO: 887762 - RNA, 19 nt, Homo sapiens
gucaaucuuugcaacaguu

SEQ ID NO: 887763 - RNA, 19 nt, Homo sapiens
ccagauuagcauuuacuuu

SEQ ID NO: 887764 - RNA, 19 nt, Homo sapiens
ugacauuguguuguuguua

SEQ ID NO: 887765 - RNA, 19 nt, Homo sapiens
aaacgaauaacaugaugga

SEQ ID NO: 887766 - RNA, 19 nt, Homo sapiens
acaauagguuauaccacaa

SEQ ID NO: 887767 - RNA, 19 nt, Homo sapiens
gaucgauugagaaguuauu

SEQ ID NO: 887768 - RNA, 19 nt, Homo sapiens
ucacgucaccguauuugga

SEQ ID NO: 887769 - RNA, 19 nt, Homo sapiens
gcucuuuucuguuauguau

SEQ ID NO: 887770 - RNA, 19 nt, Homo sapiens
acagaaucgugugguguuu

SEQ ID NO: 887771 - RNA, 19 nt, Homo sapiens
aagaucgauugagaaguua

SEQ ID NO: 887772 - RNA, 19 nt, Homo sapiens
gcacauuagguugcaguau

SEQ ID NO: 887773 - RNA, 19 nt, Homo sapiens
uggaauaugucauccucau

SEQ ID NO: 887774 - RNA, 19 nt, Homo sapiens
guacguuggcuacuuugug

SEQ ID NO: 887775 - RNA, 19 nt, Homo sapiens
ggcucaggauggcggauuu

SEQ ID NO: 887776 - RNA, 19 nt, Homo sapiens
ggaaaacaauagguuauac

SEQ ID NO: 887777 - RNA, 19 nt, Homo sapiens
gaaaaguagcuccugaaga

SEQ ID NO: 887778 - RNA, 19 nt, Homo sapiens
uuaccaaagacaccgauuu

SEQ ID NO: 887779 - RNA, 19 nt, Homo sapiens
ugucauccucauagaauuu

SEQ ID NO: 887780 - RNA, 19 nt, Homo sapiens
gugaaacgaauaacaugau

SEQ ID NO: 887781 - RNA, 19 nt, Homo sapiens
caaguauguugucuuucca

SEQ ID NO: 887782 - RNA, 19 nt, Homo sapiens
cuuuguggcugccuuuguu

SEQ ID NO: 887783 - RNA, 19 nt, Homo sapiens
guauuuggacugagcaaca

SEQ ID NO: 887784 - RNA, 19 nt, Homo sapiens
uguuauugcugaugguaau

SEQ ID NO: 887785 - RNA, 19 nt, Homo sapiens
aaaggaaaugugaaacgaa

SEQ ID NO: 887786 - RNA, 19 nt, Homo sapiens
aaguagcuccugaagaauu

SEQ ID NO: 887787 - RNA, 19 nt, Homo sapiens
acgaauaacaugauggaau

SEQ ID NO: 887788 - RNA, 19 nt, Homo sapiens
gcaacaguuauuucauaca

SEQ ID NO: 887789 - RNA, 19 nt, Homo sapiens
ucaaucuuugcaacaguua

SEQ ID NO: 887790 - RNA, 19 nt, Homo sapiens
gggaaaacaauagguuaua

SEQ ID NO: 887791 - RNA, 19 nt, Homo sapiens
uauuuggacugagcaacaa

SEQ ID NO: 887792 - RNA, 19 nt, Homo sapiens
agaacacgaagaucgauug

SEQ ID NO: 887793 - RNA, 19 nt, Homo sapiens
aaccgcauguucuaagugu

SEQ ID NO: 887794 - RNA, 19 nt, Homo sapiens
ggucacgucaccguauuug

SEQ ID NO: 887795 - RNA, 19 nt, Homo sapiens
guuauuugccucaguaaaa

SEQ ID NO: 887796 - RNA, 19 nt, Homo sapiens
caucaacagaguuaacagu

SEQ ID NO: 887797 - RNA, 19 nt, Homo sapiens
uaaagccagcaucaacaga

SEQ ID NO: 887798 - RNA, 19 nt, Homo sapiens
aaauaaccgcauguucuaa

SEQ ID NO: 887799 - RNA, 19 nt, Homo sapiens
auugugcucuuuucuguua

SEQ ID NO: 887800 - RNA, 19 nt, Homo sapiens
guggugacauaacauuggu

SEQ ID NO: 887801 - RNA, 19 nt, Homo sapiens
ugugaaacgaauaacauga

SEQ ID NO: 887802 - RNA, 19 nt, Homo sapiens
aaaaggaaaugugaaacga

SEQ ID NO: 887803 - RNA, 19 nt, Homo sapiens
gcaguauguggccaguuau

SEQ ID NO: 887804 - RNA, 19 nt, Homo sapiens
gaagagcacucgcagauuu

SEQ ID NO: 887805 - RNA, 19 nt, Homo sapiens
ggaaagaaauugaugcauu

SEQ ID NO: 887806 - RNA, 19 nt, Homo sapiens
gaaagaaauugaugcauug

SEQ ID NO: 887807 - RNA, 19 nt, Homo sapiens
gcaaguaccuucuccacua

SEQ ID NO: 887808 - RNA, 19 nt, Homo sapiens
gagcuucauuuaccucuua

SEQ ID NO: 887809 - RNA, 19 nt, Homo sapiens
ccaaaucucuugcuuguca

SEQ ID NO: 887810 - RNA, 19 nt, Homo sapiens
aaagaagcaucaagguuua

SEQ ID NO: 887811 - RNA, 19 nt, Homo sapiens
gggagcaccuaaccuaaua

SEQ ID NO: 887812 - RNA, 19 nt, Homo sapiens
gguauaugcuggucacuuu

SEQ ID NO: 887813 - RNA, 19 nt, Homo sapiens
gaugauagaugaagcagau

SEQ ID NO: 887814 - RNA, 19 nt, Homo sapiens
ccucuuagaugacuuguuu

SEQ ID NO: 887815 - RNA, 19 nt, Homo sapiens
gaagugaauugaccaagga

SEQ ID NO: 887816 - RNA, 19 nt, Homo sapiens
uaaagaagcaucaagguuu

SEQ ID NO: 887817 - RNA, 19 nt, Homo sapiens
gaacauaccagcaucuuca

SEQ ID NO: 887818 - RNA, 19 nt, Homo sapiens
gcacagccagaucuuauua

SEQ ID NO: 887819 - RNA, 19 nt, Homo sapiens
gacagucauuugaaaguua

SEQ ID NO: 887820 - RNA, 19 nt, Homo sapiens
ccaaucagaucaaccauau

SEQ ID NO: 887821 - RNA, 19 nt, Homo sapiens
ggaaaucuccucaaacaug

SEQ ID NO: 887822 - RNA, 19 nt, Homo sapiens
aauagaauguggccacuua

SEQ ID NO: 887823 - RNA, 19 nt, Homo sapiens
ggacuuaguuacaguguca

SEQ ID NO: 887824 - RNA, 19 nt, Homo sapiens
gacaaugccucccuacuau

SEQ ID NO: 887825 - RNA, 19 nt, Homo sapiens
gaagaugggcagccagaua

SEQ ID NO: 887826 - RNA, 19 nt, Homo sapiens
gcacaaauaaugaaagaga

SEQ ID NO: 887827 - RNA, 19 nt, Homo sapiens
caucagacauuacaccaaa

SEQ ID NO: 887828 - RNA, 19 nt, Homo sapiens
caacuuucaucagacauua

SEQ ID NO: 887829 - RNA, 19 nt, Homo sapiens
gaaaucuccucaaacaugu

SEQ ID NO: 887830 - RNA, 19 nt, Homo sapiens
uaucaaggcuggauggaaa

SEQ ID NO: 887831 - RNA, 19 nt, Homo sapiens
caaguugcuuugcugaaua

SEQ ID NO: 887832 - RNA, 19 nt, Homo sapiens
gaacggccaaccaaucaua

SEQ ID NO: 887833 - RNA, 19 nt, Homo sapiens
uaagaaggguaugaugaua

SEQ ID NO: 887834 - RNA, 19 nt, Homo sapiens
gccaagagauaaagaacaa

SEQ ID NO: 887835 - RNA, 19 nt, Homo sapiens
gauaagaaggguaugauga

SEQ ID NO: 887836 - RNA, 19 nt, Homo sapiens
gaacugugucaacuuauuu

SEQ ID NO: 887837 - RNA, 19 nt, Homo sapiens
gcacauacauuaaaacuag

SEQ ID NO: 887838 - RNA, 19 nt, Homo sapiens
ggaaagacccagacagugu

SEQ ID NO: 887839 - RNA, 19 nt, Homo sapiens
gaacuucuuggaugaaauu

SEQ ID NO: 887840 - RNA, 19 nt, Homo sapiens
ccacgaagguugcauacau

SEQ ID NO: 887841 - RNA, 19 nt, Homo sapiens
caaguaccuucuccacuaa

SEQ ID NO: 887842 - RNA, 19 nt, Homo sapiens
uagaacaacuggagaacuu

SEQ ID NO: 887843 - RNA, 19 nt, Homo sapiens
ccuuuaagcuggauaagaa

SEQ ID NO: 887844 - RNA, 19 nt, Homo sapiens
ugacaaauaugaguuggaa

SEQ ID NO: 887845 - RNA, 19 nt, Homo sapiens
uaacuggcauagacaacua

SEQ ID NO: 887846 - RNA, 19 nt, Homo sapiens
gcagaauccuguuguaaac

SEQ ID NO: 887847 - RNA, 19 nt, Homo sapiens
caacaaaggaaagaaauug

SEQ ID NO: 887848 - RNA, 19 nt, Homo sapiens
gagccgaucacaugguuua

SEQ ID NO: 887849 - RNA, 19 nt, Homo sapiens
ucacaugguuuaucaaugg

SEQ ID NO: 887850 - RNA, 19 nt, Homo sapiens
gcacaguguuccuauagca

SEQ ID NO: 887851 - RNA, 19 nt, Homo sapiens
gaauauggacuuaguuaca

SEQ ID NO: 887852 - RNA, 19 nt, Homo sapiens
gcacugaacugugucaacu

SEQ ID NO: 887853 - RNA, 19 nt, Homo sapiens
ccacuuauuucacuaucuu

SEQ ID NO: 887854 - RNA, 19 nt, Homo sapiens
gaagagaacauaccagcau

SEQ ID NO: 887855 - RNA, 19 nt, Homo sapiens
gaaaggacaggacgaagau

SEQ ID NO: 887856 - RNA, 19 nt, Homo sapiens
guuacagugucauuucaua

SEQ ID NO: 887857 - RNA, 19 nt, Homo sapiens
ucagaaaccacuaaugauu

SEQ ID NO: 887858 - RNA, 19 nt, Homo sapiens
ugaagcagaugaauuugug

SEQ ID NO: 887859 - RNA, 19 nt, Homo sapiens
ugacaggugugccuuuaga

SEQ ID NO: 887860 - RNA, 19 nt, Homo sapiens
guguaugucuccacuacua

SEQ ID NO: 887861 - RNA, 19 nt, Homo sapiens
gaugggagcaccuaaccua

SEQ ID NO: 887862 - RNA, 19 nt, Homo sapiens
gaaagacccagacaguguu

SEQ ID NO: 887863 - RNA, 19 nt, Homo sapiens
augaagaggucaauacuga

SEQ ID NO: 887864 - RNA, 19 nt, Homo sapiens
agaugaagcagaugaauuu

SEQ ID NO: 887865 - RNA, 19 nt, Homo sapiens
acugaacugugucaacuua

SEQ ID NO: 887866 - RNA, 19 nt, Homo sapiens
gucacaaacucauauaugu

SEQ ID NO: 887867 - RNA, 19 nt, Homo sapiens
aaggacagcuuuugauuua

SEQ ID NO: 887868 - RNA, 19 nt, Homo sapiens
gaauguggccacuuauuuc

SEQ ID NO: 887869 - RNA, 19 nt, Homo sapiens
guugacaggugugccuuua

SEQ ID NO: 887870 - RNA, 19 nt, Homo sapiens
ggacagcuuuugauuuauu

SEQ ID NO: 887871 - RNA, 19 nt, Homo sapiens
cauuggaucuguaggcaaa

SEQ ID NO: 887872 - RNA, 19 nt, Homo sapiens
uagcagacaguauggaaua

SEQ ID NO: 887873 - RNA, 19 nt, Homo sapiens
ugugaugccuuacaauuau

SEQ ID NO: 887874 - RNA, 19 nt, Homo sapiens
ugaacugugucaacuuauu

SEQ ID NO: 887875 - RNA, 19 nt, Homo sapiens
gugcaaggcaguuuacaaa

SEQ ID NO: 887876 - RNA, 19 nt, Homo sapiens
ggucaauacugaacuaaaa

SEQ ID NO: 887877 - RNA, 19 nt, Homo sapiens
uggcauagcugucacaaac

SEQ ID NO: 887878 - RNA, 19 nt, Homo sapiens
ucacuuuacugaagcaugu

SEQ ID NO: 887879 - RNA, 19 nt, Homo sapiens
cagaccaacuuucaucaga

SEQ ID NO: 887880 - RNA, 19 nt, Homo sapiens
ugugucaacuuauuuguga

SEQ ID NO: 887881 - RNA, 19 nt, Homo sapiens
ggacgaaccgacagacaga

SEQ ID NO: 887882 - RNA, 19 nt, Homo sapiens
caucuucacucaacaaagg

SEQ ID NO: 887883 - RNA, 19 nt, Homo sapiens
agacaaugccucccuacua

SEQ ID NO: 887884 - RNA, 19 nt, Homo sapiens
caauuucccucagguucua

SEQ ID NO: 887885 - RNA, 19 nt, Homo sapiens
acagccagaucuuauuaaa

SEQ ID NO: 887886 - RNA, 19 nt, Homo sapiens
agaaggguaugaugauaga

SEQ ID NO: 887887 - RNA, 19 nt, Homo sapiens
ccaaguugcuuugcugaau

SEQ ID NO: 887888 - RNA, 19 nt, Homo sapiens
guacaggagacuggaauaa

SEQ ID NO: 887889 - RNA, 19 nt, Homo sapiens
gaugggagcaaguugacua

SEQ ID NO: 887890 - RNA, 19 nt, Homo sapiens
gaggaaagacccagacagu

SEQ ID NO: 887891 - RNA, 19 nt, Homo sapiens
gaaccaaugaccucacugu

SEQ ID NO: 887892 - RNA, 19 nt, Homo sapiens
gaagagccaaucagaucaa

SEQ ID NO: 887893 - RNA, 19 nt, Homo sapiens
aggaauaccucaagcaagu

SEQ ID NO: 887894 - RNA, 19 nt, Homo sapiens
uuggaucacuuaacaagaa

SEQ ID NO: 887895 - RNA, 19 nt, Homo sapiens
gacgaaaucuuuuggauca

SEQ ID NO: 887896 - RNA, 19 nt, Homo sapiens
gaucacaugguuuaucaau

SEQ ID NO: 887897 - RNA, 19 nt, Homo sapiens
gcauagcugucacaaacuc

SEQ ID NO: 887898 - RNA, 19 nt, Homo sapiens
agaauguggccacuuauuu

SEQ ID NO: 887899 - RNA, 19 nt, Homo sapiens
caaaggaaagaaauugaug

SEQ ID NO: 887900 - RNA, 19 nt, Homo sapiens
ccgaucacaugguuuauca

SEQ ID NO: 887901 - RNA, 19 nt, Homo sapiens
uuagaugacucugcaauca

SEQ ID NO: 887902 - RNA, 19 nt, Homo sapiens
caagagauaaagaacaaug

SEQ ID NO: 887903 - RNA, 19 nt, Homo sapiens
gaccaacuuucaucagaca

SEQ ID NO: 887904 - RNA, 19 nt, Homo sapiens
gaugaaaccuguaagaagu

SEQ ID NO: 887905 - RNA, 19 nt, Homo sapiens
gcucaugccugcccuggua

SEQ ID NO: 887906 - RNA, 19 nt, Homo sapiens
gaagcaagauuccagaaag

SEQ ID NO: 887907 - RNA, 19 nt, Homo sapiens
gaaaggaggagcuaucgaa

SEQ ID NO: 887908 - RNA, 19 nt, Homo sapiens
ugacuucaguggcucauaa

SEQ ID NO: 887909 - RNA, 19 nt, Homo sapiens
gguaauaugucaugcucuu

SEQ ID NO: 887910 - RNA, 19 nt, Homo sapiens
gaaacugaagggagaagua

SEQ ID NO: 887911 - RNA, 19 nt, Homo sapiens
aggaggagcuaucgaagua

SEQ ID NO: 887912 - RNA, 19 nt, Homo sapiens
ggauggacccucagauuga

SEQ ID NO: 887913 - RNA, 19 nt, Homo sapiens
ggaaguuaguggccacaga

SEQ ID NO: 887914 - RNA, 19 nt, Homo sapiens
guauuagccucacuuaaca

SEQ ID NO: 887915 - RNA, 19 nt, Homo sapiens
ccagguuguuacuuucuua

SEQ ID NO: 887916 - RNA, 19 nt, Homo sapiens
guucauaacuguuguuuug

SEQ ID NO: 887917 - RNA, 19 nt, Homo sapiens
gaaguuaguggccacagaa

SEQ ID NO: 887918 - RNA, 19 nt, Homo sapiens
gcaggcaucugguuaaagc

SEQ ID NO: 887919 - RNA, 19 nt, Homo sapiens
gagaugaaaccuguaagaa

SEQ ID NO: 887920 - RNA, 19 nt, Homo sapiens
gaaaguaccagaaggucau

SEQ ID NO: 887921 - RNA, 19 nt, Homo sapiens
uuagucaucuucacaacaa

SEQ ID NO: 887922 - RNA, 19 nt, Homo sapiens
gauggacccucagauugaa

SEQ ID NO: 887923 - RNA, 19 nt, Homo sapiens
ucacuuaacagaugaggaa

SEQ ID NO: 887924 - RNA, 19 nt, Homo sapiens
gguauuagccucacuuaac

SEQ ID NO: 887925 - RNA, 19 nt, Homo sapiens
agaaguagauggcaauggu

SEQ ID NO: 887926 - RNA, 19 nt, Homo sapiens
cuucgggacuucuuuaaug

SEQ ID NO: 887927 - RNA, 19 nt, Homo sapiens
gggucuguguguacaauuu

SEQ ID NO: 887928 - RNA, 19 nt, Homo sapiens
caaauccgaggaagagaaa

SEQ ID NO: 887929 - RNA, 19 nt, Homo sapiens
gaggagcuaucgaaguaca

SEQ ID NO: 887930 - RNA, 19 nt, Homo sapiens
ugggagcucugucuaguug

SEQ ID NO: 887931 - RNA, 19 nt, Homo sapiens
ccuggcagcugagaaauug

SEQ ID NO: 887932 - RNA, 19 nt, Homo sapiens
caaggaagcuuugccuacu

SEQ ID NO: 887933 - RNA, 19 nt, Homo sapiens
ggugaauccuaaacagaga

SEQ ID NO: 887934 - RNA, 19 nt, Homo sapiens
cugggaagcugauccauuc

SEQ ID NO: 887935 - RNA, 19 nt, Homo sapiens
uugaguacauucugugauu

SEQ ID NO: 887936 - RNA, 19 nt, Homo sapiens
gggaccauauucugcaaug

SEQ ID NO: 887937 - RNA, 19 nt, Homo sapiens
uagccucacuuaacagaug

SEQ ID NO: 887938 - RNA, 19 nt, Homo sapiens
uaaauccagcuuucuauca

SEQ ID NO: 887939 - RNA, 19 nt, Homo sapiens
cuucuuuaaugcuacguua

SEQ ID NO: 887940 - RNA, 19 nt, Homo sapiens
ccacagaagagagaugaaa

SEQ ID NO: 887941 - RNA, 19 nt, Homo sapiens
aagccaauauacccaguuu

SEQ ID NO: 887942 - RNA, 19 nt, Homo sapiens
ugaguacauucugugauuu

SEQ ID NO: 887943 - RNA, 19 nt, Homo sapiens
gauggcaaugguuaugaua

SEQ ID NO: 887944 - RNA, 19 nt, Homo sapiens
aggaagcuuugccuacuuu

SEQ ID NO: 887945 - RNA, 19 nt, Homo sapiens
ucuagaaacuccuaaaucc

SEQ ID NO: 887946 - RNA, 19 nt, Homo sapiens
uuacaugucuagaguucug

SEQ ID NO: 887947 - RNA, 19 nt, Homo sapiens
gaaguagauggcaaugguu

SEQ ID NO: 887948 - RNA, 19 nt, Homo sapiens
guaauaugucaugcucuua

SEQ ID NO: 887949 - RNA, 19 nt, Homo sapiens
gaagcuuugccuacuuuau

SEQ ID NO: 887950 - RNA, 19 nt, Homo sapiens
ccaaauccgaggaagagaa

SEQ ID NO: 887951 - RNA, 19 nt, Homo sapiens
ugucuuacaugucuagagu

SEQ ID NO: 887952 - RNA, 19 nt, Homo sapiens
guuguucugucguuuagug

SEQ ID NO: 887953 - RNA, 19 nt, Homo sapiens
acagagagaauucgagguu

SEQ ID NO: 887954 - RNA, 19 nt, Homo sapiens
uuucacugcucgucuagaa

SEQ ID NO: 887955 - RNA, 19 nt, Homo sapiens
ggagcucugucuaguuguc

SEQ ID NO: 887956 - RNA, 19 nt, Homo sapiens
cagaugaggaagcaagauu

SEQ ID NO: 887957 - RNA, 19 nt, Homo sapiens
uaaagcagggucugugugu

SEQ ID NO: 887958 - RNA, 19 nt, Homo sapiens
aagcuuugccuacuuuauu

SEQ ID NO: 887959 - RNA, 19 nt, Homo sapiens
agagagaugaaaccuguaa

SEQ ID NO: 887960 - RNA, 19 nt, Homo sapiens
gaaguacaacggaucaaaa

SEQ ID NO: 887961 - RNA, 19 nt, Homo sapiens
caucaggcagcuagccaua

SEQ ID NO: 887962 - RNA, 19 nt, Homo sapiens
aaauccagcuuucuaucau

SEQ ID NO: 887963 - RNA, 19 nt, Homo sapiens
cgggacuucuuuaaugcua

SEQ ID NO: 887964 - RNA, 19 nt, Homo sapiens
gaugagcaguaaaaccuuu

SEQ ID NO: 887965 - RNA, 19 nt, Homo sapiens
cgaaguacaacggaucaaa

SEQ ID NO: 887966 - RNA, 19 nt, Homo sapiens
uaguuguccuuaagucuga

SEQ ID NO: 887967 - RNA, 19 nt, Homo sapiens
gcaagauuccagaaaguac

SEQ ID NO: 887968 - RNA, 19 nt, Homo sapiens
aagcaagauuccagaaagu

SEQ ID NO: 887969 - RNA, 19 nt, Homo sapiens
aauucgagguugccugaaa

SEQ ID NO: 887970 - RNA, 19 nt, Homo sapiens
cuuaguauguacagucuuc

SEQ ID NO: 887971 - RNA, 19 nt, Homo sapiens
gcugggaagcugauccauu

SEQ ID NO: 887972 - RNA, 19 nt, Homo sapiens
ggaagcuuugccuacuuua

SEQ ID NO: 887973 - RNA, 19 nt, Homo sapiens
guacauucugugauuucua

SEQ ID NO: 887974 - RNA, 19 nt, Homo sapiens
cuagaguucugcuggaucu

SEQ ID NO: 887975 - RNA, 19 nt, Homo sapiens
uaaaacggguaauauguca

SEQ ID NO: 887976 - RNA, 19 nt, Homo sapiens
aaagcagggucugugugua

SEQ ID NO: 887977 - RNA, 19 nt, Homo sapiens
ggucuacaaucggaugaca

SEQ ID NO: 887978 - RNA, 19 nt, Homo sapiens
ggagagagcuggggaccau

SEQ ID NO: 887979 - RNA, 19 nt, Homo sapiens
caacaaaacuaugaguaag

SEQ ID NO: 887980 - RNA, 19 nt, Homo sapiens
guagauggcaaugguuaug

SEQ ID NO: 887981 - RNA, 19 nt, Homo sapiens
aaguagauggcaaugguua

SEQ ID NO: 887982 - RNA, 19 nt, Homo sapiens
gcgguauuagccucacuua

SEQ ID NO: 887983 - RNA, 19 nt, Homo sapiens
accagaaggucauuuuaua

SEQ ID NO: 887984 - RNA, 19 nt, Homo sapiens
gcucuuagucaucuucaca

SEQ ID NO: 887985 - RNA, 19 nt, Homo sapiens
uaauaugucaugcucuuag

SEQ ID NO: 887986 - RNA, 19 nt, Homo sapiens
aaacggguaauaugucaug

SEQ ID NO: 887987 - RNA, 19 nt, Homo sapiens
gaguacauucugugauuuc

SEQ ID NO: 887988 - RNA, 19 nt, Homo sapiens
gugacuuccuguuggucua

SEQ ID NO: 887989 - RNA, 19 nt, Homo sapiens
aaucuucgggacuucuuua

SEQ ID NO: 887990 - RNA, 19 nt, Homo sapiens
gccaggcguugcugcugaa

SEQ ID NO: 887991 - RNA, 19 nt, Homo sapiens
agagaugaaaccuguaaga

SEQ ID NO: 887992 - RNA, 19 nt, Homo sapiens
ccagaaaguaccagaaggu

SEQ ID NO: 887993 - RNA, 19 nt, Homo sapiens
aaugcuacguuaauguuuc

SEQ ID NO: 887994 - RNA, 19 nt, Homo sapiens
gcaccgagaagcugaaacg

SEQ ID NO: 887995 - RNA, 19 nt, Homo sapiens
ucuuacaugucuagaguuc

SEQ ID NO: 887996 - RNA, 19 nt, Homo sapiens
uggauggacccucagauug

SEQ ID NO: 887997 - RNA, 19 nt, Homo sapiens
gaagccaauauacccaguu

SEQ ID NO: 887998 - RNA, 19 nt, Homo sapiens
ccuaaauccagcuuucuau

SEQ ID NO: 887999 - RNA, 19 nt, Homo sapiens
acaaucggaugacagaacu

SEQ ID NO: 888000 - RNA, 19 nt, Homo sapiens
gcaaucaggaagggagaga

SEQ ID NO: 888001 - RNA, 19 nt, Homo sapiens
uguaagaagucuggagucu

SEQ ID NO: 888002 - RNA, 19 nt, Homo sapiens
ggaaaggaggagcuaucga

SEQ ID NO: 888003 - RNA, 19 nt, Homo sapiens
aaccgugagccaaguauuu

SEQ ID NO: 888004 - RNA, 19 nt, Homo sapiens
ggaacgagccaacauguga

SEQ ID NO: 888005 - RNA, 19 nt, Homo sapiens
ccauaaacgugcuuugaga

SEQ ID NO: 888006 - RNA, 19 nt, Homo sapiens
gaacaaagggugguaccaa

SEQ ID NO: 888007 - RNA, 19 nt, Homo sapiens
gagcgugaguacaaaguga

SEQ ID NO: 888008 - RNA, 19 nt, Homo sapiens
caaagguggcagacauuua

SEQ ID NO: 888009 - RNA, 19 nt, Homo sapiens
gcaaagguggcagacauuu

SEQ ID NO: 888010 - RNA, 19 nt, Homo sapiens
cagcagcccuugggucauu

SEQ ID NO: 888011 - RNA, 19 nt, Homo sapiens
aaacggcuguggaguggaa

SEQ ID NO: 888012 - RNA, 19 nt, Homo sapiens
aaaaugggcucaaugcaaa

SEQ ID NO: 888013 - RNA, 19 nt, Homo sapiens
gcggaugggcaaauaaauu

SEQ ID NO: 888014 - RNA, 19 nt, Homo sapiens
gguggucacuccuggaugu

SEQ ID NO: 888015 - RNA, 19 nt, Homo sapiens
ggaugacggacaaguguuu

SEQ ID NO: 888016 - RNA, 19 nt, Homo sapiens
gaaaaugggcucaaugcaa

SEQ ID NO: 888017 - RNA, 19 nt, Homo sapiens
aacaaagggugguaccaaa

SEQ ID NO: 888018 - RNA, 19 nt, Homo sapiens
aaagguggcagacauuuau

SEQ ID NO: 888019 - RNA, 19 nt, Homo sapiens
ggacccagggcucauaaug

SEQ ID NO: 888020 - RNA, 19 nt, Homo sapiens
gagugacccuagugacuuc

SEQ ID NO: 888021 - RNA, 19 nt, Homo sapiens
ggagugacccuagugacuu

SEQ ID NO: 888022 - RNA, 19 nt, Homo sapiens
gugcugagccagugagcua

SEQ ID NO: 888023 - RNA, 19 nt, Homo sapiens
ggacaacuccgagcagaag

SEQ ID NO: 888024 - RNA, 19 nt, Homo sapiens
uaauggagcaggugaaagu

SEQ ID NO: 888025 - RNA, 19 nt, Homo sapiens
gcaccuccuucaggccuuu

SEQ ID NO: 888026 - RNA, 19 nt, Homo sapiens
gaggaugacggacaagugu

SEQ ID NO: 888027 - RNA, 19 nt, Homo sapiens
gacaaguguuuccggaagu

SEQ ID NO: 888028 - RNA, 19 nt, Homo sapiens
gguggaggacggagagaaa

SEQ ID NO: 888029 - RNA, 19 nt, Homo sapiens
cggaugggcaaauaaauug

SEQ ID NO: 888030 - RNA, 19 nt, Homo sapiens
gcuuugacccugcuucguu

SEQ ID NO: 888031 - RNA, 19 nt, Homo sapiens
ugggagaaguccaucuuuc

SEQ ID NO: 888032 - RNA, 19 nt, Homo sapiens
gcccaagucagccucauau

SEQ ID NO: 888033 - RNA, 19 nt, Homo sapiens
acccagggcucauaaugga

SEQ ID NO: 888034 - RNA, 19 nt, Homo sapiens
aggcagagcgugaguacaa

SEQ ID NO: 888035 - RNA, 19 nt, Homo sapiens
ggcagagcgugaguacaaa

SEQ ID NO: 888036 - RNA, 19 nt, Homo sapiens
agaagugcaucgccaugug

SEQ ID NO: 888037 - RNA, 19 nt, Homo sapiens
ggguagcucguguagguaa

SEQ ID NO: 888038 - RNA, 19 nt, Homo sapiens
cauaauggagcaggugaaa

SEQ ID NO: 888039 - RNA, 19 nt, Homo sapiens
acggguagcucguguaggu

SEQ ID NO: 888040 - RNA, 19 nt, Homo sapiens
gcugcugagucacgaggaa

SEQ ID NO: 888041 - RNA, 19 nt, Homo sapiens
ccggaaguguauagggaaa

SEQ ID NO: 888042 - RNA, 19 nt, Homo sapiens
ggaggcagagcgugaguac

SEQ ID NO: 888043 - RNA, 19 nt, Homo sapiens
augcaaagguggcagacau

SEQ ID NO: 888044 - RNA, 19 nt, Homo sapiens
cugcugcuccuguugcuuu

SEQ ID NO: 888045 - RNA, 19 nt, Homo sapiens
gacccagggcucauaaugg

SEQ ID NO: 888046 - RNA, 19 nt, Homo sapiens
ccaaaaugcauccccauga

SEQ ID NO: 888047 - RNA, 19 nt, Homo sapiens
ugcagaggaugacggacaa

SEQ ID NO: 888048 - RNA, 19 nt, Homo sapiens
gcagagcgugaguacaaag

SEQ ID NO: 888049 - RNA, 19 nt, Homo sapiens
ggaaguguauagggaaacc

SEQ ID NO: 888050 - RNA, 19 nt, Homo sapiens
acaaguguuuccggaagug

SEQ ID NO: 888051 - RNA, 19 nt, Homo sapiens
gaaugugacugugugugua

SEQ ID NO: 888052 - RNA, 19 nt, Homo sapiens
ugaggucccugucaguaua

SEQ ID NO: 888053 - RNA, 19 nt, Homo sapiens
ggguaacguuauaguauuu

SEQ ID NO: 888054 - RNA, 19 nt, Homo sapiens
gaugauggccgauauguac

SEQ ID NO: 888055 - RNA, 19 nt, Homo sapiens
ggccuaggcucucuguaga

SEQ ID NO: 888056 - RNA, 19 nt, Homo sapiens
ggaccgaugugucucuaag

SEQ ID NO: 888057 - RNA, 19 nt, Homo sapiens
gccgauauguacaacagaa

SEQ ID NO: 888058 - RNA, 19 nt, Homo sapiens
ggaaugugacugugugugu

SEQ ID NO: 888059 - RNA, 19 nt, Homo sapiens
gaugaagagcugaugaaga

SEQ ID NO: 888060 - RNA, 19 nt, Homo sapiens
ucacggagcggguaacguu

SEQ ID NO: 888061 - RNA, 19 nt, Homo sapiens
augaagagcugaugaagag

SEQ ID NO: 888062 - RNA, 19 nt, Homo sapiens
cggguaacguuauaguauu

SEQ ID NO: 888063 - RNA, 19 nt, Homo sapiens
gcggguaacguuauaguau

SEQ ID NO: 888064 - RNA, 19 nt, Homo sapiens
gauauguacaacagaauga

SEQ ID NO: 888065 - RNA, 19 nt, Homo sapiens
cggagcggguaacguuaua

SEQ ID NO: 888066 - RNA, 19 nt, Homo sapiens
ggugaaggaguauuuguca

SEQ ID NO: 888067 - RNA, 19 nt, Homo sapiens
ucaagaucccggaguggua

SEQ ID NO: 888068 - RNA, 19 nt, Homo sapiens
accgaugugucucuaagua

SEQ ID NO: 888069 - RNA, 19 nt, Homo sapiens
gugcuaggcugagauggau

SEQ ID NO: 888070 - RNA, 19 nt, Homo sapiens
guguguguauguaugugua

SEQ ID NO: 888071 - RNA, 19 nt, Homo sapiens
ccuguugggugucaucugu

SEQ ID NO: 888072 - RNA, 19 nt, Homo sapiens
gagaugauggccgauaugu

SEQ ID NO: 888073 - RNA, 19 nt, Homo sapiens
caugaggucccugucagua

SEQ ID NO: 888074 - RNA, 19 nt, Homo sapiens
ccacggugcuaggcugaga

SEQ ID NO: 888075 - RNA, 19 nt, Homo sapiens
gugacuguguguguaugua

SEQ ID NO: 888076 - RNA, 19 nt, Homo sapiens
ggagaugauggccgauaug

SEQ ID NO: 888077 - RNA, 19 nt, Homo sapiens
uggagaugauggccgauau

SEQ ID NO: 888078 - RNA, 19 nt, Homo sapiens
guguguauguauguguaua

SEQ ID NO: 888079 - RNA, 19 nt, Homo sapiens
gacuguguguguauguaug

SEQ ID NO: 888080 - RNA, 19 nt, Homo sapiens
ugaaggaguauuugucaca

SEQ ID NO: 888081 - RNA, 19 nt, Homo sapiens
cgucccaggcaguggauua

SEQ ID NO: 888082 - RNA, 19 nt, Homo sapiens
ggugucaucugugaagacu

SEQ ID NO: 888083 - RNA, 19 nt, Homo sapiens
cgauauguacaacagaaug

SEQ ID NO: 888084 - RNA, 19 nt, Homo sapiens
cccaggcaguggauuagga

SEQ ID NO: 888085 - RNA, 19 nt, Homo sapiens
ggugcuaggcugagaugga

SEQ ID NO: 888086 - RNA, 19 nt, Homo sapiens
gagcggguaacguuauagu

SEQ ID NO: 888087 - RNA, 19 nt, Homo sapiens
gauuaggaggccagaagga

SEQ ID NO: 888088 - RNA, 19 nt, Homo sapiens
gagcuggagguggagauga

SEQ ID NO: 888089 - RNA, 19 nt, Homo sapiens
guauuugucacacuggaau

SEQ ID NO: 888090 - RNA, 19 nt, Homo sapiens
uguugggugucaucuguga

SEQ ID NO: 888091 - RNA, 19 nt, Homo sapiens
ggaugaagagcugaugaag

SEQ ID NO: 888092 - RNA, 19 nt, Homo sapiens
gagcucugggccugcauga

SEQ ID NO: 888093 - RNA, 19 nt, Homo sapiens
cguuauaguauuugucaga

SEQ ID NO: 888094 - RNA, 19 nt, Homo sapiens
gaauauggcugcacaaaua

SEQ ID NO: 888095 - RNA, 19 nt, Homo sapiens
gaacauugcuuacagaaau

SEQ ID NO: 888096 - RNA, 19 nt, Homo sapiens
ggaaaccgcuggagaaaca

SEQ ID NO: 888097 - RNA, 19 nt, Homo sapiens
gccaacagcugcuuuauug

SEQ ID NO: 888098 - RNA, 19 nt, Homo sapiens
caacuuauguguucgauca

SEQ ID NO: 888099 - RNA, 19 nt, Homo sapiens
ggacucaucugauagaauc

SEQ ID NO: 888100 - RNA, 19 nt, Homo sapiens
gaagagcucccgacuugua

SEQ ID NO: 888101 - RNA, 19 nt, Homo sapiens
uaaagcaacuuauguguuc

SEQ ID NO: 888102 - RNA, 19 nt, Homo sapiens
gagaaguccugauggauga

SEQ ID NO: 888103 - RNA, 19 nt, Homo sapiens
caaagaauauccaugagau

SEQ ID NO: 888104 - RNA, 19 nt, Homo sapiens
cagaaaaggugacuaauaa

SEQ ID NO: 888105 - RNA, 19 nt, Homo sapiens
guuaaagacuucacaacaa

SEQ ID NO: 888106 - RNA, 19 nt, Homo sapiens
aaaggaaacucaugcauca

SEQ ID NO: 888107 - RNA, 19 nt, Homo sapiens
gagagccugugcuuaagua

SEQ ID NO: 888108 - RNA, 19 nt, Homo sapiens
gaugaaagauugccaacag

SEQ ID NO: 888109 - RNA, 19 nt, Homo sapiens
uaauaaagguaccagaaga

SEQ ID NO: 888110 - RNA, 19 nt, Homo sapiens
ggaauaaucacaauagaag

SEQ ID NO: 888111 - RNA, 19 nt, Homo sapiens
uugaagagcucccgacuug

SEQ ID NO: 888112 - RNA, 19 nt, Homo sapiens
gaauauccaugagauuuca

SEQ ID NO: 888113 - RNA, 19 nt, Homo sapiens
ggaaacucaugcaucagaa

SEQ ID NO: 888114 - RNA, 19 nt, Homo sapiens
uagauuuccucgcguuaua

SEQ ID NO: 888115 - RNA, 19 nt, Homo sapiens
uagaaggucuuauuguuca

SEQ ID NO: 888116 - RNA, 19 nt, Homo sapiens
acacaaagaauauccauga

SEQ ID NO: 888117 - RNA, 19 nt, Homo sapiens
gcagcuuggucacuugauu

SEQ ID NO: 888118 - RNA, 19 nt, Homo sapiens
guugaggccuuaugauuca

SEQ ID NO: 888119 - RNA, 19 nt, Homo sapiens
aaagguaccagaagaauau

SEQ ID NO: 888120 - RNA, 19 nt, Homo sapiens
uaaagguaccagaagaaua

SEQ ID NO: 888121 - RNA, 19 nt, Homo sapiens
ccaugagauuucaggaaua

SEQ ID NO: 888122 - RNA, 19 nt, Homo sapiens
ggacuguguuaaagacuuc

SEQ ID NO: 888123 - RNA, 19 nt, Homo sapiens
gaacagaaaggaaacucau

SEQ ID NO: 888124 - RNA, 19 nt, Homo sapiens
caugagauuucaggaauau

SEQ ID NO: 888125 - RNA, 19 nt, Homo sapiens
ggacgugggauuagauuuc

SEQ ID NO: 888126 - RNA, 19 nt, Homo sapiens
caacagcugcuuuauugga

SEQ ID NO: 888127 - RNA, 19 nt, Homo sapiens
guucaaccaucugucauga

SEQ ID NO: 888128 - RNA, 19 nt, Homo sapiens
gcucuacagucucauccaa

SEQ ID NO: 888129 - RNA, 19 nt, Homo sapiens
ucagaacauugcuuacaga

SEQ ID NO: 888130 - RNA, 19 nt, Homo sapiens
caaccacgauagagaaguc

SEQ ID NO: 888131 - RNA, 19 nt, Homo sapiens
uuaaagacuucacaacaag

SEQ ID NO: 888132 - RNA, 19 nt, Homo sapiens
gagcucccgacuuguaaua

SEQ ID NO: 888133 - RNA, 19 nt, Homo sapiens
gaaacucaugcaucagaaa

SEQ ID NO: 888134 - RNA, 19 nt, Homo sapiens
gaagagaccaccuguucag

SEQ ID NO: 888135 - RNA, 19 nt, Homo sapiens
cagcuuggucacuugauua

SEQ ID NO: 888136 - RNA, 19 nt, Homo sapiens
ucuaaggguuuaaguguca

SEQ ID NO: 888137 - RNA, 19 nt, Homo sapiens
cuuggucacuugauuagaa

SEQ ID NO: 888138 - RNA, 19 nt, Homo sapiens
caggaauaaucacaauaga

SEQ ID NO: 888139 - RNA, 19 nt, Homo sapiens
aaaggugacuaauaaaggu

SEQ ID NO: 888140 - RNA, 19 nt, Homo sapiens
cgacuuguaauacuacuug

SEQ ID NO: 888141 - RNA, 19 nt, Homo sapiens
gaccuacaauaaacuuaca

SEQ ID NO: 888142 - RNA, 19 nt, Homo sapiens
cuucaauugugacuguuaa

SEQ ID NO: 888143 - RNA, 19 nt, Homo sapiens
ccaggaauaaucacaauag

SEQ ID NO: 888144 - RNA, 19 nt, Homo sapiens
auagagaaguccugaugga

SEQ ID NO: 888145 - RNA, 19 nt, Homo sapiens
caucugucaugacuguuug

SEQ ID NO: 888146 - RNA, 19 nt, Homo sapiens
cgauagagaaguccugaug

SEQ ID NO: 888147 - RNA, 19 nt, Homo sapiens
uuggagacauucaagcaaa

SEQ ID NO: 888148 - RNA, 19 nt, Homo sapiens
ucuacagucucauccaaga

SEQ ID NO: 888149 - RNA, 19 nt, Homo sapiens
uccaugagauuucaggaau

SEQ ID NO: 888150 - RNA, 19 nt, Homo sapiens
ugcgagagccugugcuuaa

SEQ ID NO: 888151 - RNA, 19 nt, Homo sapiens
gcaguagccaccauguuca

SEQ ID NO: 888152 - RNA, 19 nt, Homo sapiens
gaggacucaucugauagaa

SEQ ID NO: 888153 - RNA, 19 nt, Homo sapiens
ucaaccaucugucaugacu

SEQ ID NO: 888154 - RNA, 19 nt, Homo sapiens
ugagauuucaggaauauca

SEQ ID NO: 888155 - RNA, 19 nt, Homo sapiens
acaaagaauauccaugaga

SEQ ID NO: 888156 - RNA, 19 nt, Homo sapiens
gaaaaggugacuaauaaag

SEQ ID NO: 888157 - RNA, 19 nt, Homo sapiens
ucagaaaaggugacuaaua

SEQ ID NO: 888158 - RNA, 19 nt, Homo sapiens
gcgagagccugugcuuaag

SEQ ID NO: 888159 - RNA, 19 nt, Homo sapiens
uaccaggaauaaucacaau

SEQ ID NO: 888160 - RNA, 19 nt, Homo sapiens
cugaagagaccaccuguuc

SEQ ID NO: 888161 - RNA, 19 nt, Homo sapiens
ggaccuacaauaaacuuac

SEQ ID NO: 888162 - RNA, 19 nt, Homo sapiens
aaccaucugucaugacugu

SEQ ID NO: 888163 - RNA, 19 nt, Homo sapiens
uggaugaacuuuugaugaa

SEQ ID NO: 888164 - RNA, 19 nt, Homo sapiens
cgucuaaggguuuaagugu

SEQ ID NO: 888165 - RNA, 19 nt, Homo sapiens
ugaaagcaguagccaccau

SEQ ID NO: 888166 - RNA, 19 nt, Homo sapiens
ggccaaccacgauagagaa

SEQ ID NO: 888167 - RNA, 19 nt, Homo sapiens
agaaucaggccuuauugga

SEQ ID NO: 888168 - RNA, 19 nt, Homo sapiens
gcugcuuuauuggaaauga

SEQ ID NO: 888169 - RNA, 19 nt, Homo sapiens
cagcugcuuuauuggaaau

SEQ ID NO: 888170 - RNA, 19 nt, Homo sapiens
ucacaacaagagaaguaaa

SEQ ID NO: 888171 - RNA, 19 nt, Homo sapiens
uaaagacuucacaacaaga

SEQ ID NO: 888172 - RNA, 19 nt, Homo sapiens
aauaaagguaccagaagaa

SEQ ID NO: 888173 - RNA, 19 nt, Homo sapiens
aauggaaaccgcuggagaa

SEQ ID NO: 888174 - RNA, 19 nt, Homo sapiens
aacagcugcuuuauuggaa

SEQ ID NO: 888175 - RNA, 19 nt, Homo sapiens
gaagaauauggcugcacaa

SEQ ID NO: 888176 - RNA, 19 nt, Homo sapiens
ccaucugucaugacuguuu

SEQ ID NO: 888177 - RNA, 19 nt, Homo sapiens
uuacugcucccacguguuc

SEQ ID NO: 888178 - RNA, 19 nt, Homo sapiens
uuucuucaauugugacugu

SEQ ID NO: 888179 - RNA, 19 nt, Homo sapiens
ucagcagcuuggucacuug

SEQ ID NO: 888180 - RNA, 19 nt, Homo sapiens
ggaugaacuuuugaugaaa

SEQ ID NO: 888181 - RNA, 19 nt, Homo sapiens
ccugauggaugaacuuuug

SEQ ID NO: 888182 - RNA, 19 nt, Homo sapiens
uuagggacgugggauuaga

SEQ ID NO: 888183 - RNA, 19 nt, Homo sapiens
agagaccaccuguucagaa

SEQ ID NO: 888184 - RNA, 19 nt, Homo sapiens
acuaauaaagguaccagaa

SEQ ID NO: 888185 - RNA, 19 nt, Homo sapiens
caucagaaaaggugacuaa

SEQ ID NO: 888186 - RNA, 19 nt, Homo sapiens
cguuagggacgugggauua

SEQ ID NO: 888187 - RNA, 19 nt, Homo sapiens
cagaacauugcuuacagaa

SEQ ID NO: 888188 - RNA, 19 nt, Homo sapiens
gaaguaaaaccugaagaga

SEQ ID NO: 888189 - RNA, 19 nt, Homo sapiens
gacaacuacuuuuccagaa

SEQ ID NO: 888190 - RNA, 19 nt, Homo sapiens
gcucccgacuuguaauacu

SEQ ID NO: 888191 - RNA, 19 nt, Homo sapiens
gggaccuacaauaaacuua

SEQ ID NO: 888192 - RNA, 19 nt, Homo sapiens
cuaauaaagguaccagaag

SEQ ID NO: 888193 - RNA, 19 nt, Homo sapiens
acagcugcuuuauuggaaa

SEQ ID NO: 888194 - RNA, 19 nt, Homo sapiens
gcaaaggacuuguuacuaa

SEQ ID NO: 888195 - RNA, 19 nt, Homo sapiens
ggaaggcuaucaacccauu

SEQ ID NO: 888196 - RNA, 19 nt, Homo sapiens
guagaccgcuucauugaca

SEQ ID NO: 888197 - RNA, 19 nt, Homo sapiens
caaaggacuuguuacuaag

SEQ ID NO: 888198 - RNA, 19 nt, Homo sapiens
gcaucaggcuguuaucaag

SEQ ID NO: 888199 - RNA, 19 nt, Homo sapiens
cagcagaaggcgcaguuua

SEQ ID NO: 888200 - RNA, 19 nt, Homo sapiens
ggauaaauguguggagaag

SEQ ID NO: 888201 - RNA, 19 nt, Homo sapiens
ucaagucuguuggugcuaa

SEQ ID NO: 888202 - RNA, 19 nt, Homo sapiens
agaagcaaaggacuuguua

SEQ ID NO: 888203 - RNA, 19 nt, Homo sapiens
gagaaugacagaagcaaag

SEQ ID NO: 888204 - RNA, 19 nt, Homo sapiens
ggagaaugacagaagcaaa

SEQ ID NO: 888205 - RNA, 19 nt, Homo sapiens
ccuagacucucgcacugaa

SEQ ID NO: 888206 - RNA, 19 nt, Homo sapiens
uuacuaagcagauuuaagg

SEQ ID NO: 888207 - RNA, 19 nt, Homo sapiens
gcuguuaucaagucuguug

SEQ ID NO: 888208 - RNA, 19 nt, Homo sapiens
caagucuguuggugcuaaa

SEQ ID NO: 888209 - RNA, 19 nt, Homo sapiens
gacagaagcaaaggacuug

SEQ ID NO: 888210 - RNA, 19 nt, Homo sapiens
acaggugcaucacuucaug

SEQ ID NO: 888211 - RNA, 19 nt, Homo sapiens
ugacagaagcaaaggacuu

SEQ ID NO: 888212 - RNA, 19 nt, Homo sapiens
guguagaccgcuucauuga

SEQ ID NO: 888213 - RNA, 19 nt, Homo sapiens
gggauaaauguguggagaa

SEQ ID NO: 888214 - RNA, 19 nt, Homo sapiens
cagaagcaaaggacuuguu

SEQ ID NO: 888215 - RNA, 19 nt, Homo sapiens
gaaugacagaagcaaagga

SEQ ID NO: 888216 - RNA, 19 nt, Homo sapiens
gcagaaggcgcaguuuacu

SEQ ID NO: 888217 - RNA, 19 nt, Homo sapiens
uugcccagauuguacagaa

SEQ ID NO: 888218 - RNA, 19 nt, Homo sapiens
ucaacccauugucagauca

SEQ ID NO: 888219 - RNA, 19 nt, Homo sapiens
ccagucgguuugcccagau

SEQ ID NO: 888220 - RNA, 19 nt, Homo sapiens
uguguagaccgcuucauug

SEQ ID NO: 888221 - RNA, 19 nt, Homo sapiens
gaagcaaaggacuuguuac

SEQ ID NO: 888222 - RNA, 19 nt, Homo sapiens
gccaucaccagucgguuug

SEQ ID NO: 888223 - RNA, 19 nt, Homo sapiens
gaacuuaggcuuaacauaa

SEQ ID NO: 888224 - RNA, 19 nt, Homo sapiens
gagaagaggugcucaagaa

SEQ ID NO: 888225 - RNA, 19 nt, Homo sapiens
gaagguaccuagaaauuug

SEQ ID NO: 888226 - RNA, 19 nt, Homo sapiens
gcacaaacauucauuaugg

SEQ ID NO: 888227 - RNA, 19 nt, Homo sapiens
ggucaagucucuuauguuu

SEQ ID NO: 888228 - RNA, 19 nt, Homo sapiens
ggagagcacuguucuuuga

SEQ ID NO: 888229 - RNA, 19 nt, Homo sapiens
caucaggacuguugaguaa

SEQ ID NO: 888230 - RNA, 19 nt, Homo sapiens
caacugaccugcccaacuu

SEQ ID NO: 888231 - RNA, 19 nt, Homo sapiens
gcacuguccugcacucuuu

SEQ ID NO: 888232 - RNA, 19 nt, Homo sapiens
ggaaacaguucuacaaugg

SEQ ID NO: 888233 - RNA, 19 nt, Homo sapiens
caacuuagaucccuacauc

SEQ ID NO: 888234 - RNA, 19 nt, Homo sapiens
ggacuagauuuguuuaaga

SEQ ID NO: 888235 - RNA, 19 nt, Homo sapiens
gcuguuaccucacuggaua

SEQ ID NO: 888236 - RNA, 19 nt, Homo sapiens
caacaucacccacccauuu

SEQ ID NO: 888237 - RNA, 19 nt, Homo sapiens
gcuaaagacucaugcuuga

SEQ ID NO: 888238 - RNA, 19 nt, Homo sapiens
ggaaguaccgcguguguaa

SEQ ID NO: 888239 - RNA, 19 nt, Homo sapiens
cgaagaagguaccuagaaa

SEQ ID NO: 888240 - RNA, 19 nt, Homo sapiens
ggacugcccucaagcuuau

SEQ ID NO: 888241 - RNA, 19 nt, Homo sapiens
ggcaagagaucauugaaga

SEQ ID NO: 888242 - RNA, 19 nt, Homo sapiens
ggaaggaucgaaucuuuaa

SEQ ID NO: 888243 - RNA, 19 nt, Homo sapiens
caagaucaaugucaaacuu

SEQ ID NO: 888244 - RNA, 19 nt, Homo sapiens
uaccauaacuugaguguau

SEQ ID NO: 888245 - RNA, 19 nt, Homo sapiens
gaaagcaucaggacuguug

SEQ ID NO: 888246 - RNA, 19 nt, Homo sapiens
gaccuggaaucauguguaa

SEQ ID NO: 888247 - RNA, 19 nt, Homo sapiens
ucaagcuccuggccaauua

SEQ ID NO: 888248 - RNA, 19 nt, Homo sapiens
ucaagucucuuauguuuca

SEQ ID NO: 888249 - RNA, 19 nt, Homo sapiens
gaaaaggacuagauuuguu

SEQ ID NO: 888250 - RNA, 19 nt, Homo sapiens
cuagaggucuguaacauug

SEQ ID NO: 888251 - RNA, 19 nt, Homo sapiens
gcacaguggcacaguauuu

SEQ ID NO: 888252 - RNA, 19 nt, Homo sapiens
gagauacacucuugggaau

SEQ ID NO: 888253 - RNA, 19 nt, Homo sapiens
gaacagggccagcaagaca

SEQ ID NO: 888254 - RNA, 19 nt, Homo sapiens
cuauagaggugguguaaga

SEQ ID NO: 888255 - RNA, 19 nt, Homo sapiens
gggaaacaguucuacaaug

SEQ ID NO: 888256 - RNA, 19 nt, Homo sapiens
ggaucaaagugaaggauga

SEQ ID NO: 888257 - RNA, 19 nt, Homo sapiens
gggcagcgcuguauuaaaa

SEQ ID NO: 888258 - RNA, 19 nt, Homo sapiens
aguccaaccugauccauua

SEQ ID NO: 888259 - RNA, 19 nt, Homo sapiens
gcaaugaucccacuguuag

SEQ ID NO: 888260 - RNA, 19 nt, Homo sapiens
gagauugucuuaggguuga

SEQ ID NO: 888261 - RNA, 19 nt, Homo sapiens
uaacuggggugucuuauaa

SEQ ID NO: 888262 - RNA, 19 nt, Homo sapiens
gacaaaagcugguuagguu

SEQ ID NO: 888263 - RNA, 19 nt, Homo sapiens
caagaauugugcaaguaaa

SEQ ID NO: 888264 - RNA, 19 nt, Homo sapiens
uaacaagguuggacguuuc

SEQ ID NO: 888265 - RNA, 19 nt, Homo sapiens
gcacuguucuuugauuguu

SEQ ID NO: 888266 - RNA, 19 nt, Homo sapiens
ggaagaugaugcucaacau

SEQ ID NO: 888267 - RNA, 19 nt, Homo sapiens
guacuuguuugcauuuguu

SEQ ID NO: 888268 - RNA, 19 nt, Homo sapiens
gcccauaggauaucuguaa

SEQ ID NO: 888269 - RNA, 19 nt, Homo sapiens
gcugggaacuuaggcuuaa

SEQ ID NO: 888270 - RNA, 19 nt, Homo sapiens
gagcugguuucucucauug

SEQ ID NO: 888271 - RNA, 19 nt, Homo sapiens
ggagcugguuucucucauu

SEQ ID NO: 888272 - RNA, 19 nt, Homo sapiens
gcaugcagauggagaagug

SEQ ID NO: 888273 - RNA, 19 nt, Homo sapiens
cuaaagagagugaugcuaa

SEQ ID NO: 888274 - RNA, 19 nt, Homo sapiens
uuacacaagugccuaaaga

SEQ ID NO: 888275 - RNA, 19 nt, Homo sapiens
aaacguagcacaaacauuc

SEQ ID NO: 888276 - RNA, 19 nt, Homo sapiens
gucaagaccucaccucaga

SEQ ID NO: 888277 - RNA, 19 nt, Homo sapiens
gaaugccagcuacaacuua

SEQ ID NO: 888278 - RNA, 19 nt, Homo sapiens
agaagaacauuuacacugu

SEQ ID NO: 888279 - RNA, 19 nt, Homo sapiens
gaagaagggucuaaauccu

SEQ ID NO: 888280 - RNA, 19 nt, Homo sapiens
caugauuacuuuagaccua

SEQ ID NO: 888281 - RNA, 19 nt, Homo sapiens
agacaacaguggcuucuau

SEQ ID NO: 888282 - RNA, 19 nt, Homo sapiens
uagcuaagcagcaguguuu

SEQ ID NO: 888283 - RNA, 19 nt, Homo sapiens
gagcacuguucuuugauug

SEQ ID NO: 888284 - RNA, 19 nt, Homo sapiens
ucacagugcuaaagacuca

SEQ ID NO: 888285 - RNA, 19 nt, Homo sapiens
gaguuugacuucuaucugu

SEQ ID NO: 888286 - RNA, 19 nt, Homo sapiens
aaccagaccucgaccauga

SEQ ID NO: 888287 - RNA, 19 nt, Homo sapiens
caacgaacgggucgacuuu

SEQ ID NO: 888288 - RNA, 19 nt, Homo sapiens
gcacaagcccagcugaaga

SEQ ID NO: 888289 - RNA, 19 nt, Homo sapiens
gcuuugagcuguaccuugu

SEQ ID NO: 888290 - RNA, 19 nt, Homo sapiens
gaggccagcuggaggaaga

SEQ ID NO: 888291 - RNA, 19 nt, Homo sapiens
ugacaagaaugagcgaauu

SEQ ID NO: 888292 - RNA, 19 nt, Homo sapiens
ugauugaguucauguguga

SEQ ID NO: 888293 - RNA, 19 nt, Homo sapiens
gaagaugaugcucaacauu

SEQ ID NO: 888294 - RNA, 19 nt, Homo sapiens
gaaagaagaacauuuacac

SEQ ID NO: 888295 - RNA, 19 nt, Homo sapiens
caaguaaagacauuuguug

SEQ ID NO: 888296 - RNA, 19 nt, Homo sapiens
ggaaacccuccaagaauug

SEQ ID NO: 888297 - RNA, 19 nt, Homo sapiens
gagaauggagagaauuuga

SEQ ID NO: 888298 - RNA, 19 nt, Homo sapiens
gguuuggguuugauacuuu

SEQ ID NO: 888299 - RNA, 19 nt, Homo sapiens
agaaaucucugauaucaac

SEQ ID NO: 888300 - RNA, 19 nt, Homo sapiens
gauaaaggccacagcuaga

SEQ ID NO: 888301 - RNA, 19 nt, Homo sapiens
aggaaacccuccaagaauu

SEQ ID NO: 888302 - RNA, 19 nt, Homo sapiens
ggaaucauguguaacuaac

SEQ ID NO: 888303 - RNA, 19 nt, Homo sapiens
gaagaagguaccuagaaau

SEQ ID NO: 888304 - RNA, 19 nt, Homo sapiens
ggugaugaagccaugauua

SEQ ID NO: 888305 - RNA, 19 nt, Homo sapiens
ucccaugccugaugaguuu

SEQ ID NO: 888306 - RNA, 19 nt, Homo sapiens
ggaguuacuuucauagcau

SEQ ID NO: 888307 - RNA, 19 nt, Homo sapiens
ccauugacauuugcacuuu

SEQ ID NO: 888308 - RNA, 19 nt, Homo sapiens
ggaagacgccgguguaugc

SEQ ID NO: 888309 - RNA, 19 nt, Homo sapiens
gcagaaauauaaccuucag

SEQ ID NO: 888310 - RNA, 19 nt, Homo sapiens
gggaaggaucgaaucuuua

SEQ ID NO: 888311 - RNA, 19 nt, Homo sapiens
caacaguggcuucuauuuc

SEQ ID NO: 888312 - RNA, 19 nt, Homo sapiens
gcaaguaaagacauuuguu

SEQ ID NO: 888313 - RNA, 19 nt, Homo sapiens
gaaaggagagcacuguucu

SEQ ID NO: 888314 - RNA, 19 nt, Homo sapiens
ggagagccuacauuccuua

SEQ ID NO: 888315 - RNA, 19 nt, Homo sapiens
gagaaagcaucaggacugu

SEQ ID NO: 888316 - RNA, 19 nt, Homo sapiens
gaaaccagacccagaucaa

SEQ ID NO: 888317 - RNA, 19 nt, Homo sapiens
guggacagaugaagaggaa

SEQ ID NO: 888318 - RNA, 19 nt, Homo sapiens
ucacagcacugcccauugg

SEQ ID NO: 888319 - RNA, 19 nt, Homo sapiens
ccaguccauugugaaauua

SEQ ID NO: 888320 - RNA, 19 nt, Homo sapiens
gaagagaauggagagaauu

SEQ ID NO: 888321 - RNA, 19 nt, Homo sapiens
ggaaagaagaacauuuaca

SEQ ID NO: 888322 - RNA, 19 nt, Homo sapiens
ccaagaauugugcaaguaa

SEQ ID NO: 888323 - RNA, 19 nt, Homo sapiens
gaagaacauugaugagaaa

SEQ ID NO: 888324 - RNA, 19 nt, Homo sapiens
uaaauuaguccgucgauua

SEQ ID NO: 888325 - RNA, 19 nt, Homo sapiens
gaaacuggacuaacaauga

SEQ ID NO: 888326 - RNA, 19 nt, Homo sapiens
agaaaucucugugcaauaa

SEQ ID NO: 888327 - RNA, 19 nt, Homo sapiens
gaaaucagauauuccuugu

SEQ ID NO: 888328 - RNA, 19 nt, Homo sapiens
gaacauugaugagaaaucu

SEQ ID NO: 888329 - RNA, 19 nt, Homo sapiens
guucggaccuuaucagaaa

SEQ ID NO: 888330 - RNA, 19 nt, Homo sapiens
ggacucacaauuccaaaua

SEQ ID NO: 888331 - RNA, 19 nt, Homo sapiens
gaaagagucuaauuacaac

SEQ ID NO: 888332 - RNA, 19 nt, Homo sapiens
ggccaaagcuggacucugu

SEQ ID NO: 888333 - RNA, 19 nt, Homo sapiens
ggaagauccucuaccagaa

SEQ ID NO: 888334 - RNA, 19 nt, Homo sapiens
ugaagaacauugaugagaa

SEQ ID NO: 888335 - RNA, 19 nt, Homo sapiens
acacucaccucgcccaaua

SEQ ID NO: 888336 - RNA, 19 nt, Homo sapiens
aaaggaaacuggacuaaca

SEQ ID NO: 888337 - RNA, 19 nt, Homo sapiens
aaucagauauuccuuguug

SEQ ID NO: 888338 - RNA, 19 nt, Homo sapiens
ggacaaaggcggaaaggau

SEQ ID NO: 888339 - RNA, 19 nt, Homo sapiens
cagaaagccuugagggaaa

SEQ ID NO: 888340 - RNA, 19 nt, Homo sapiens
gauauuccuuguugccuuu

SEQ ID NO: 888341 - RNA, 19 nt, Homo sapiens
gacaaaggcggaaaggaua

SEQ ID NO: 888342 - RNA, 19 nt, Homo sapiens
ggagaagugugccuugcuu

SEQ ID NO: 888343 - RNA, 19 nt, Homo sapiens
gaagauccucuaccagaaa

SEQ ID NO: 888344 - RNA, 19 nt, Homo sapiens
gaagugaaccggcaaaugc

SEQ ID NO: 888345 - RNA, 19 nt, Homo sapiens
gaaagggagccaugucaga

SEQ ID NO: 888346 - RNA, 19 nt, Homo sapiens
caacaaacugauacuauug

SEQ ID NO: 888347 - RNA, 19 nt, Homo sapiens
cagcaucgcuuucaauagg

SEQ ID NO: 888348 - RNA, 19 nt, Homo sapiens
ccagggaccucaucaccaa

SEQ ID NO: 888349 - RNA, 19 nt, Homo sapiens
gagcucagauuuagaaagc

SEQ ID NO: 888350 - RNA, 19 nt, Homo sapiens
gggaugaugugucuaacug

SEQ ID NO: 888351 - RNA, 19 nt, Homo sapiens
gaagugugccuugcuugua

SEQ ID NO: 888352 - RNA, 19 nt, Homo sapiens
cagaaagagucuaauuaca

SEQ ID NO: 888353 - RNA, 19 nt, Homo sapiens
gcgauucguuugcguccua

SEQ ID NO: 888354 - RNA, 19 nt, Homo sapiens
gaucuggauggucacauua

SEQ ID NO: 888355 - RNA, 19 nt, Homo sapiens
gagcugacuuuggccauug

SEQ ID NO: 888356 - RNA, 19 nt, Homo sapiens
gaccuucacugcauuaaaa

SEQ ID NO: 888357 - RNA, 19 nt, Homo sapiens
gaagguucuuugaugacaa

SEQ ID NO: 888358 - RNA, 19 nt, Homo sapiens
cugauacuauugacaguuu

SEQ ID NO: 888359 - RNA, 19 nt, Homo sapiens
gggccaagauggacaaguc

SEQ ID NO: 888360 - RNA, 19 nt, Homo sapiens
gcagcaagucggagcagua

SEQ ID NO: 888361 - RNA, 19 nt, Homo sapiens
ugagggaaaucagauauuc

SEQ ID NO: 888362 - RNA, 19 nt, Homo sapiens
ccauggacaccucgaauuu

SEQ ID NO: 888363 - RNA, 19 nt, Homo sapiens
gaucggugccuuuggagaa

SEQ ID NO: 888364 - RNA, 19 nt, Homo sapiens
aaacagccauccaagucuu

SEQ ID NO: 888365 - RNA, 19 nt, Homo sapiens
caaaucaugcugcuguuau

SEQ ID NO: 888366 - RNA, 19 nt, Homo sapiens
ccauugacuucuccaguga

SEQ ID NO: 888367 - RNA, 19 nt, Homo sapiens
gagaacacgcuccacauuc

SEQ ID NO: 888368 - RNA, 19 nt, Homo sapiens
gcaccuacucccacagaaa

SEQ ID NO: 888369 - RNA, 19 nt, Homo sapiens
ggagagagugauaaucuuc

SEQ ID NO: 888370 - RNA, 19 nt, Homo sapiens
ccauagcacuuauucacau

SEQ ID NO: 888371 - RNA, 19 nt, Homo sapiens
ccacagaaacccagcugaa

SEQ ID NO: 888372 - RNA, 19 nt, Homo sapiens
aaaucaugcugcuguuauu

SEQ ID NO: 888373 - RNA, 19 nt, Homo sapiens
gauggacaagucuauguuu

SEQ ID NO: 888374 - RNA, 19 nt, Homo sapiens
ggacucagcaucgcuuuca

SEQ ID NO: 888375 - RNA, 19 nt, Homo sapiens
cgagggcuguuuuguuuua

SEQ ID NO: 888376 - RNA, 19 nt, Homo sapiens
aaacccagcugaaggugau

SEQ ID NO: 888377 - RNA, 19 nt, Homo sapiens
gccauacgccuuuaaguuc

SEQ ID NO: 888378 - RNA, 19 nt, Homo sapiens
gacaaaucaugcugcuguu

SEQ ID NO: 888379 - RNA, 19 nt, Homo sapiens
gccgagggcuguuuuguuu

SEQ ID NO: 888380 - RNA, 19 nt, Homo sapiens
aagugugccuugcuuguaa

SEQ ID NO: 888381 - RNA, 19 nt, Homo sapiens
ccagaaagagucuaauuac

SEQ ID NO: 888382 - RNA, 19 nt, Homo sapiens
cauagcacuuauucacauu

SEQ ID NO: 888383 - RNA, 19 nt, Homo sapiens
gaacgaugccagcgaaggu

SEQ ID NO: 888384 - RNA, 19 nt, Homo sapiens
cacauuaaacucacagauu

SEQ ID NO: 888385 - RNA, 19 nt, Homo sapiens
caugaagacccuaaggaaa

SEQ ID NO: 888386 - RNA, 19 nt, Homo sapiens
gcacgcauuuuacgaauuc

SEQ ID NO: 888387 - RNA, 19 nt, Homo sapiens
ggaaacuggacuaacaaug

SEQ ID NO: 888388 - RNA, 19 nt, Homo sapiens
gacucacaauuccaaauau

SEQ ID NO: 888389 - RNA, 19 nt, Homo sapiens
gauggucacauuaaacuca

SEQ ID NO: 888390 - RNA, 19 nt, Homo sapiens
uaaagagggccaagaugga

SEQ ID NO: 888391 - RNA, 19 nt, Homo sapiens
cagcagagacgaagagaag

SEQ ID NO: 888392 - RNA, 19 nt, Homo sapiens
aaacuggacuaacaaugag

SEQ ID NO: 888393 - RNA, 19 nt, Homo sapiens
ucaccucgcccaauaacaa

SEQ ID NO: 888394 - RNA, 19 nt, Homo sapiens
cguggagaaugucaucaaa

SEQ ID NO: 888395 - RNA, 19 nt, Homo sapiens
gcaagucggagcaguacga

SEQ ID NO: 888396 - RNA, 19 nt, Homo sapiens
caacguggaccuguaugaa

SEQ ID NO: 888397 - RNA, 19 nt, Homo sapiens
ggaccuucacugcauuaaa

SEQ ID NO: 888398 - RNA, 19 nt, Homo sapiens
acaaugaggccaaagacuu

SEQ ID NO: 888399 - RNA, 19 nt, Homo sapiens
ccaugaagacccuaaggaa

SEQ ID NO: 888400 - RNA, 19 nt, Homo sapiens
agaaagagcacuuauuuug

SEQ ID NO: 888401 - RNA, 19 nt, Homo sapiens
agaaagcccuuggaacgau

SEQ ID NO: 888402 - RNA, 19 nt, Homo sapiens
gcagcuggagcaagaaaug

SEQ ID NO: 888403 - RNA, 19 nt, Homo sapiens
ucagguggacucacaauuc

SEQ ID NO: 888404 - RNA, 19 nt, Homo sapiens
cuuguaagguggacacuca

SEQ ID NO: 888405 - RNA, 19 nt, Homo sapiens
ggcugcagcuggagcaaga

SEQ ID NO: 888406 - RNA, 19 nt, Homo sapiens
acguggaccuguaugaauu

SEQ ID NO: 888407 - RNA, 19 nt, Homo sapiens
cagauugugcgggucauua

SEQ ID NO: 888408 - RNA, 19 nt, Homo sapiens
ggcaaaugcugcaggaacu

SEQ ID NO: 888409 - RNA, 19 nt, Homo sapiens
cgaagguucuuugaugaca

SEQ ID NO: 888410 - RNA, 19 nt, Homo sapiens
guggaguguuggagugauu

SEQ ID NO: 888411 - RNA, 19 nt, Homo sapiens
accagaaagagucuaauua

SEQ ID NO: 888412 - RNA, 19 nt, Homo sapiens
gaaagagcacuuauuuugu

SEQ ID NO: 888413 - RNA, 19 nt, Homo sapiens
gagacgaagagaagagaga

SEQ ID NO: 888414 - RNA, 19 nt, Homo sapiens
ccaaauauuaccagaaagg

SEQ ID NO: 888415 - RNA, 19 nt, Homo sapiens
agaucuggauggucacauu

SEQ ID NO: 888416 - RNA, 19 nt, Homo sapiens
gcacguggagaaugucauc

SEQ ID NO: 888417 - RNA, 19 nt, Homo sapiens
gagcagcacguggagaaug

SEQ ID NO: 888418 - RNA, 19 nt, Homo sapiens
cgccauacgccuuuaaguu

SEQ ID NO: 888419 - RNA, 19 nt, Homo sapiens
aaacugaagaacauugaug

SEQ ID NO: 888420 - RNA, 19 nt, Homo sapiens
gcacuuauucacauuuagg

SEQ ID NO: 888421 - RNA, 19 nt, Homo sapiens
ucaggaccuucacugcauu

SEQ ID NO: 888422 - RNA, 19 nt, Homo sapiens
uccgaagguucuuugauga

SEQ ID NO: 888423 - RNA, 19 nt, Homo sapiens
gagaagaccuacuuacaaa

SEQ ID NO: 888424 - RNA, 19 nt, Homo sapiens
gaagaugaauuccuuguau

SEQ ID NO: 888425 - RNA, 19 nt, Homo sapiens
uaaagagacuuacguggua

SEQ ID NO: 888426 - RNA, 19 nt, Homo sapiens
gaauaaauuucggcuguuu

SEQ ID NO: 888427 - RNA, 19 nt, Homo sapiens
gauaaucgauguuuguugu

SEQ ID NO: 888428 - RNA, 19 nt, Homo sapiens
ggaagacuauguaaagaug

SEQ ID NO: 888429 - RNA, 19 nt, Homo sapiens
gcuaugagcaggccuauaa

SEQ ID NO: 888430 - RNA, 19 nt, Homo sapiens
uaaggucucugcagaugua

SEQ ID NO: 888431 - RNA, 19 nt, Homo sapiens
gauaacggcucugcugaaa

SEQ ID NO: 888432 - RNA, 19 nt, Homo sapiens
gagcaggccuauaaagaga

SEQ ID NO: 888433 - RNA, 19 nt, Homo sapiens
uaagaaggcugcuguacug

SEQ ID NO: 888434 - RNA, 19 nt, Homo sapiens
gcgcugugcuuccgaauga

SEQ ID NO: 888435 - RNA, 19 nt, Homo sapiens
caaugaagaugaauuccuu

SEQ ID NO: 888436 - RNA, 19 nt, Homo sapiens
gauaaggucucugcagaug

SEQ ID NO: 888437 - RNA, 19 nt, Homo sapiens
gaaggcugcuguacugguu

SEQ ID NO: 888438 - RNA, 19 nt, Homo sapiens
cugcagauguaguuaguua

SEQ ID NO: 888439 - RNA, 19 nt, Homo sapiens
gaauauggcagaagugaug

SEQ ID NO: 888440 - RNA, 19 nt, Homo sapiens
caauaugacugguuuccuu

SEQ ID NO: 888441 - RNA, 19 nt, Homo sapiens
uaagaaacaccaaggauug

SEQ ID NO: 888442 - RNA, 19 nt, Homo sapiens
gcaugccacuuccaagauu

SEQ ID NO: 888443 - RNA, 19 nt, Homo sapiens
caaauucacauccuucuug

SEQ ID NO: 888444 - RNA, 19 nt, Homo sapiens
gucaguagcucuccacaug

SEQ ID NO: 888445 - RNA, 19 nt, Homo sapiens
ggagccgacucuaacacua

SEQ ID NO: 888446 - RNA, 19 nt, Homo sapiens
ucacccagcuucccgagaa

SEQ ID NO: 888447 - RNA, 19 nt, Homo sapiens
cauuaaaggugaagagauc

SEQ ID NO: 888448 - RNA, 19 nt, Homo sapiens
gaagaggcaaagaagaauu

SEQ ID NO: 888449 - RNA, 19 nt, Homo sapiens
uaauacagcugcuaaaaug

SEQ ID NO: 888450 - RNA, 19 nt, Homo sapiens
gaaggucauuaaaggugaa

SEQ ID NO: 888451 - RNA, 19 nt, Homo sapiens
cagcagcucuaggaaacua

SEQ ID NO: 888452 - RNA, 19 nt, Homo sapiens
cggcucugcugaaaccuua

SEQ ID NO: 888453 - RNA, 19 nt, Homo sapiens
agagggagguggucauaga

SEQ ID NO: 888454 - RNA, 19 nt, Homo sapiens
gaguuuacuucaauuguag

SEQ ID NO: 888455 - RNA, 19 nt, Homo sapiens
ggagagggagguggucaua

SEQ ID NO: 888456 - RNA, 19 nt, Homo sapiens
ccaagagcuucaccuucua

SEQ ID NO: 888457 - RNA, 19 nt, Homo sapiens
ccacauuagugaaccuaga

SEQ ID NO: 888458 - RNA, 19 nt, Homo sapiens
aaacuaauacagcugcuaa

SEQ ID NO: 888459 - RNA, 19 nt, Homo sapiens
cauaauaaccagcuucuag

SEQ ID NO: 888460 - RNA, 19 nt, Homo sapiens
gaaggugcuuuaucugcau

SEQ ID NO: 888461 - RNA, 19 nt, Homo sapiens
cuuccaagauuagguuaua

SEQ ID NO: 888462 - RNA, 19 nt, Homo sapiens
caaaguggcauauauugca

SEQ ID NO: 888463 - RNA, 19 nt, Homo sapiens
cauugaaggugcuuuaucu

SEQ ID NO: 888464 - RNA, 19 nt, Homo sapiens
ugagaagaccuacuuacaa

SEQ ID NO: 888465 - RNA, 19 nt, Homo sapiens
caguagcucuccacaugaa

SEQ ID NO: 888466 - RNA, 19 nt, Homo sapiens
caucacagacuucuacuuc

SEQ ID NO: 888467 - RNA, 19 nt, Homo sapiens
gggcaggagccgacucuaa

SEQ ID NO: 888468 - RNA, 19 nt, Homo sapiens
cagggaaggucauuaaagg

SEQ ID NO: 888469 - RNA, 19 nt, Homo sapiens
caugccacuuccaagauua

SEQ ID NO: 888470 - RNA, 19 nt, Homo sapiens
ggagacccauggcggacaa

SEQ ID NO: 888471 - RNA, 19 nt, Homo sapiens
ucagggugguggcaguaua

SEQ ID NO: 888472 - RNA, 19 nt, Homo sapiens
cuuacaaaguggcauauau

SEQ ID NO: 888473 - RNA, 19 nt, Homo sapiens
cuaagaaacaccaaggauu

SEQ ID NO: 888474 - RNA, 19 nt, Homo sapiens
ucacauccuucuuggaauc

SEQ ID NO: 888475 - RNA, 19 nt, Homo sapiens
gaacaucauggagcucuau

SEQ ID NO: 888476 - RNA, 19 nt, Homo sapiens
aauagaauauggcagaagu

SEQ ID NO: 888477 - RNA, 19 nt, Homo sapiens
ccugaacgaagaaagaaua

SEQ ID NO: 888478 - RNA, 19 nt, Homo sapiens
gcagggaaggucauuaaag

SEQ ID NO: 888479 - RNA, 19 nt, Homo sapiens
ggauaacggcucugcugaa

SEQ ID NO: 888480 - RNA, 19 nt, Homo sapiens
uaugacugguuuccuugua

SEQ ID NO: 888481 - RNA, 19 nt, Homo sapiens
gugaguuuauuuggagaua

SEQ ID NO: 888482 - RNA, 19 nt, Homo sapiens
uaugcuaccuuuccuaucu

SEQ ID NO: 888483 - RNA, 19 nt, Homo sapiens
gaaggacucggcauugaag

SEQ ID NO: 888484 - RNA, 19 nt, Homo sapiens
gaaccuagaagcagagacu

SEQ ID NO: 888485 - RNA, 19 nt, Homo sapiens
aaacugggaauaacaugaa

SEQ ID NO: 888486 - RNA, 19 nt, Homo sapiens
gaaggcagagaucggaguu

SEQ ID NO: 888487 - RNA, 19 nt, Homo sapiens
gagaggacacagagacaga

SEQ ID NO: 888488 - RNA, 19 nt, Homo sapiens
aaagugcucaugacauauu

SEQ ID NO: 888489 - RNA, 19 nt, Homo sapiens
cgagaaugguggcuggaau

SEQ ID NO: 888490 - RNA, 19 nt, Homo sapiens
uccaagagcuucaccuucu

SEQ ID NO: 888491 - RNA, 19 nt, Homo sapiens
gagauaaucgauguuuguu

SEQ ID NO: 888492 - RNA, 19 nt, Homo sapiens
gagacucugugagauaauc

SEQ ID NO: 888493 - RNA, 19 nt, Homo sapiens
cacugcagcuucuacuuga

SEQ ID NO: 888494 - RNA, 19 nt, Homo sapiens
ccaauagaauauggcagaa

SEQ ID NO: 888495 - RNA, 19 nt, Homo sapiens
uaacggcucugcugaaacc

SEQ ID NO: 888496 - RNA, 19 nt, Homo sapiens
uggaagaggcaaagaagaa

SEQ ID NO: 888497 - RNA, 19 nt, Homo sapiens
gcagauguaguuaguuaag

SEQ ID NO: 888498 - RNA, 19 nt, Homo sapiens
gcucagaagauaaaagaua

SEQ ID NO: 888499 - RNA, 19 nt, Homo sapiens
ucacagacuucuacuucca

SEQ ID NO: 888500 - RNA, 19 nt, Homo sapiens
gagaaugguggcuggaaug

SEQ ID NO: 888501 - RNA, 19 nt, Homo sapiens
gaaacuaauacagcugcua

SEQ ID NO: 888502 - RNA, 19 nt, Homo sapiens
ggaagaggcaaagaagaau

SEQ ID NO: 888503 - RNA, 19 nt, Homo sapiens
gaagacuauguaaagauga

SEQ ID NO: 888504 - RNA, 19 nt, Homo sapiens
aacccaagauacaaucaaa

SEQ ID NO: 888505 - RNA, 19 nt, Homo sapiens
guguuuacauucugugugu

SEQ ID NO: 888506 - RNA, 19 nt, Homo sapiens
gaccuaaauucaauaugac

SEQ ID NO: 888507 - RNA, 19 nt, Homo sapiens
cauuggauccagucucuaa

SEQ ID NO: 888508 - RNA, 19 nt, Homo sapiens
ggcauuggauccagucucu

SEQ ID NO: 888509 - RNA, 19 nt, Homo sapiens
uggaaucucuggguaagga

SEQ ID NO: 888510 - RNA, 19 nt, Homo sapiens
ugaagaugaauuccuugua

SEQ ID NO: 888511 - RNA, 19 nt, Homo sapiens
cuacaaugaagaugaauuc

SEQ ID NO: 888512 - RNA, 19 nt, Homo sapiens
ucucuucccucaucaucuu

SEQ ID NO: 888513 - RNA, 19 nt, Homo sapiens
ugagauaaucgauguuugu

SEQ ID NO: 888514 - RNA, 19 nt, Homo sapiens
gugagauaaucgauguuug

SEQ ID NO: 888515 - RNA, 19 nt, Homo sapiens
gcccacagccacauuagug

SEQ ID NO: 888516 - RNA, 19 nt, Homo sapiens
gggaagacuauguaaagau

SEQ ID NO: 888517 - RNA, 19 nt, Homo sapiens
ugacugguuuccuuguaug

SEQ ID NO: 888518 - RNA, 19 nt, Homo sapiens
cagauguaguuaguuaaga

SEQ ID NO: 888519 - RNA, 19 nt, Homo sapiens
aaaguggcauauauugcaa

SEQ ID NO: 888520 - RNA, 19 nt, Homo sapiens
ucugugagauaaucgaugu

SEQ ID NO: 888521 - RNA, 19 nt, Homo sapiens
gcuaagaaacaccaaggau

SEQ ID NO: 888522 - RNA, 19 nt, Homo sapiens
cugcuguacugguugaauu

SEQ ID NO: 888523 - RNA, 19 nt, Homo sapiens
gagaagaccuacuuacaaa

SEQ ID NO: 888524 - RNA, 19 nt, Homo sapiens
gaagaugaauuccuuguau

SEQ ID NO: 888525 - RNA, 19 nt, Homo sapiens
uaaagagacuuacguggua

SEQ ID NO: 888526 - RNA, 19 nt, Homo sapiens
gaauaaauuucggcuguuu

SEQ ID NO: 888527 - RNA, 19 nt, Homo sapiens
gauaaucgauguuuguugu

SEQ ID NO: 888528 - RNA, 19 nt, Homo sapiens
ggaagacuauguaaagaug

SEQ ID NO: 888529 - RNA, 19 nt, Homo sapiens
gcuaugagcaggccuauaa

SEQ ID NO: 888530 - RNA, 19 nt, Homo sapiens
uaaggucucugcagaugua

SEQ ID NO: 888531 - RNA, 19 nt, Homo sapiens
gauaacggcucugcugaaa

SEQ ID NO: 888532 - RNA, 19 nt, Homo sapiens
gagcaggccuauaaagaga

SEQ ID NO: 888533 - RNA, 19 nt, Homo sapiens
uaagaaggcugcuguacug

SEQ ID NO: 888534 - RNA, 19 nt, Homo sapiens
gcgcugugcuuccgaauga

SEQ ID NO: 888535 - RNA, 19 nt, Homo sapiens
caaugaagaugaauuccuu

SEQ ID NO: 888536 - RNA, 19 nt, Homo sapiens
gauaaggucucugcagaug

SEQ ID NO: 888537 - RNA, 19 nt, Homo sapiens
gaaggcugcuguacugguu

SEQ ID NO: 888538 - RNA, 19 nt, Homo sapiens
cugcagauguaguuaguua

SEQ ID NO: 888539 - RNA, 19 nt, Homo sapiens
gaauauggcagaagugaug

SEQ ID NO: 888540 - RNA, 19 nt, Homo sapiens
caauaugacugguuuccuu

SEQ ID NO: 888541 - RNA, 19 nt, Homo sapiens
uaagaaacaccaaggauug

SEQ ID NO: 888542 - RNA, 19 nt, Homo sapiens
gcaugccacuuccaagauu

SEQ ID NO: 888543 - RNA, 19 nt, Homo sapiens
caaauucacauccuucuug

SEQ ID NO: 888544 - RNA, 19 nt, Homo sapiens
gucaguagcucuccacaug

SEQ ID NO: 888545 - RNA, 19 nt, Homo sapiens
ggagccgacucuaacacua

SEQ ID NO: 888546 - RNA, 19 nt, Homo sapiens
ucacccagcuucccgagaa

SEQ ID NO: 888547 - RNA, 19 nt, Homo sapiens
cauuaaaggugaagagauc

SEQ ID NO: 888548 - RNA, 19 nt, Homo sapiens
gaagaggcaaagaagaauu

SEQ ID NO: 888549 - RNA, 19 nt, Homo sapiens
uaauacagcugcuaaaaug

SEQ ID NO: 888550 - RNA, 19 nt, Homo sapiens
gaaggucauuaaaggugaa

SEQ ID NO: 888551 - RNA, 19 nt, Homo sapiens
cagcagcucuaggaaacua

SEQ ID NO: 888552 - RNA, 19 nt, Homo sapiens
cggcucugcugaaaccuua

SEQ ID NO: 888553 - RNA, 19 nt, Homo sapiens
agagggagguggucauaga

SEQ ID NO: 888554 - RNA, 19 nt, Homo sapiens
gaguuuacuucaauuguag

SEQ ID NO: 888555 - RNA, 19 nt, Homo sapiens
ggagagggagguggucaua

SEQ ID NO: 888556 - RNA, 19 nt, Homo sapiens
ccaagagcuucaccuucua

SEQ ID NO: 888557 - RNA, 19 nt, Homo sapiens
ccacauuagugaaccuaga

SEQ ID NO: 888558 - RNA, 19 nt, Homo sapiens
aaacuaauacagcugcuaa

SEQ ID NO: 888559 - RNA, 19 nt, Homo sapiens
cauaauaaccagcuucuag

SEQ ID NO: 888560 - RNA, 19 nt, Homo sapiens
gaaggugcuuuaucugcau

SEQ ID NO: 888561 - RNA, 19 nt, Homo sapiens
cuuccaagauuagguuaua

SEQ ID NO: 888562 - RNA, 19 nt, Homo sapiens
caaaguggcauauauugca

SEQ ID NO: 888563 - RNA, 19 nt, Homo sapiens
ugagaagaccuacuuacaa

SEQ ID NO: 888564 - RNA, 19 nt, Homo sapiens
caguagcucuccacaugaa

SEQ ID NO: 888565 - RNA, 19 nt, Homo sapiens
caucacagacuucuacuuc

SEQ ID NO: 888566 - RNA, 19 nt, Homo sapiens
gggcaggagccgacucuaa

SEQ ID NO: 888567 - RNA, 19 nt, Homo sapiens
cagggaaggucauuaaagg

SEQ ID NO: 888568 - RNA, 19 nt, Homo sapiens
cauugaaggugcuuuaucu

SEQ ID NO: 888569 - RNA, 19 nt, Homo sapiens
caugccacuuccaagauua

SEQ ID NO: 888570 - RNA, 19 nt, Homo sapiens
ggagacccauggcggacaa

SEQ ID NO: 888571 - RNA, 19 nt, Homo sapiens
ccucuaacaucuccuguag

SEQ ID NO: 888572 - RNA, 19 nt, Homo sapiens
ucagggugguggcaguaua

SEQ ID NO: 888573 - RNA, 19 nt, Homo sapiens
cuuacaaaguggcauauau

SEQ ID NO: 888574 - RNA, 19 nt, Homo sapiens
cuaagaaacaccaaggauu

SEQ ID NO: 888575 - RNA, 19 nt, Homo sapiens
ucacauccuucuuggaauc

SEQ ID NO: 888576 - RNA, 19 nt, Homo sapiens
gaacaucauggagcucuau

SEQ ID NO: 888577 - RNA, 19 nt, Homo sapiens
aauagaauauggcagaagu

SEQ ID NO: 888578 - RNA, 19 nt, Homo sapiens
ccugaacgaagaaagaaua

SEQ ID NO: 888579 - RNA, 19 nt, Homo sapiens
ggauaacggcucugcugaa

SEQ ID NO: 888580 - RNA, 19 nt, Homo sapiens
gaagggaaggagugaagga

SEQ ID NO: 888581 - RNA, 19 nt, Homo sapiens
uaugacugguuuccuugua

SEQ ID NO: 888582 - RNA, 19 nt, Homo sapiens
gugaguuuauuuggagaua

SEQ ID NO: 888583 - RNA, 19 nt, Homo sapiens
uaugcuaccuuuccuaucu

SEQ ID NO: 888584 - RNA, 19 nt, Homo sapiens
gaaggacucggcauugaag

SEQ ID NO: 888585 - RNA, 19 nt, Homo sapiens
gcagggaaggucauuaaag

SEQ ID NO: 888586 - RNA, 19 nt, Homo sapiens
gaaccuagaagcagagacu

SEQ ID NO: 888587 - RNA, 19 nt, Homo sapiens
aaacugggaauaacaugaa

SEQ ID NO: 888588 - RNA, 19 nt, Homo sapiens
gaaggcagagaucggaguu

SEQ ID NO: 888589 - RNA, 19 nt, Homo sapiens
gagaggacacagagacaga

SEQ ID NO: 888590 - RNA, 19 nt, Homo sapiens
aaagugcucaugacauauu

SEQ ID NO: 888591 - RNA, 19 nt, Homo sapiens
cgagaaugguggcuggaau

SEQ ID NO: 888592 - RNA, 19 nt, Homo sapiens
uccaagagcuucaccuucu

SEQ ID NO: 888593 - RNA, 19 nt, Homo sapiens
gagauaaucgauguuuguu

SEQ ID NO: 888594 - RNA, 19 nt, Homo sapiens
gagacucugugagauaauc

SEQ ID NO: 888595 - RNA, 19 nt, Homo sapiens
cacugcagcuucuacuuga

SEQ ID NO: 888596 - RNA, 19 nt, Homo sapiens
ccaauagaauauggcagaa

SEQ ID NO: 888597 - RNA, 19 nt, Homo sapiens
uaacggcucugcugaaacc

SEQ ID NO: 888598 - RNA, 19 nt, Homo sapiens
uggaagaggcaaagaagaa

SEQ ID NO: 888599 - RNA, 19 nt, Homo sapiens
ggaaagacagaggaaggaa

SEQ ID NO: 888600 - RNA, 19 nt, Homo sapiens
gcagauguaguuaguuaag

SEQ ID NO: 888601 - RNA, 19 nt, Homo sapiens
gcucagaagauaaaagaua

SEQ ID NO: 888602 - RNA, 19 nt, Homo sapiens
ucacagacuucuacuucca

SEQ ID NO: 888603 - RNA, 19 nt, Homo sapiens
gagaaugguggcuggaaug

SEQ ID NO: 888604 - RNA, 19 nt, Homo sapiens
ggcaauggcaggcaggaaa

SEQ ID NO: 888605 - RNA, 19 nt, Homo sapiens
gaaacuaauacagcugcua

SEQ ID NO: 888606 - RNA, 19 nt, Homo sapiens
ggaagaggcaaagaagaau

SEQ ID NO: 888607 - RNA, 19 nt, Homo sapiens
gaagacuauguaaagauga

SEQ ID NO: 888608 - RNA, 19 nt, Homo sapiens
aacccaagauacaaucaaa

SEQ ID NO: 888609 - RNA, 19 nt, Homo sapiens
guguuuacauucugugugu

SEQ ID NO: 888610 - RNA, 19 nt, Homo sapiens
gagaagggaaggagugaag

SEQ ID NO: 888611 - RNA, 19 nt, Homo sapiens
gaccuaaauucaauaugac

SEQ ID NO: 888612 - RNA, 19 nt, Homo sapiens
cauuggauccagucucuaa

SEQ ID NO: 888613 - RNA, 19 nt, Homo sapiens
ggcauuggauccagucucu

SEQ ID NO: 888614 - RNA, 19 nt, Homo sapiens
uggaaucucuggguaagga

SEQ ID NO: 888615 - RNA, 19 nt, Homo sapiens
ugaagaugaauuccuugua

SEQ ID NO: 888616 - RNA, 19 nt, Homo sapiens
cuacaaugaagaugaauuc

SEQ ID NO: 888617 - RNA, 19 nt, Homo sapiens
ucucuucccucaucaucuu

SEQ ID NO: 888618 - RNA, 19 nt, Homo sapiens
ugagauaaucgauguuugu

SEQ ID NO: 888619 - RNA, 19 nt, Homo sapiens
gugagauaaucgauguuug

SEQ ID NO: 888620 - RNA, 19 nt, Homo sapiens
gcccacagccacauuagug

SEQ ID NO: 888621 - RNA, 19 nt, Homo sapiens
gggaagacuauguaaagau

SEQ ID NO: 888622 - RNA, 19 nt, Homo sapiens
ugacugguuuccuuguaug

SEQ ID NO: 888623 - RNA, 19 nt, Homo sapiens
ucaggaagauguuaacuua

SEQ ID NO: 888624 - RNA, 19 nt, Homo sapiens
cagaagggcuguuuccaua

SEQ ID NO: 888625 - RNA, 19 nt, Homo sapiens
gaagggcuguuuccauaaa

SEQ ID NO: 888626 - RNA, 19 nt, Homo sapiens
gagaggagcugucccugaa

SEQ ID NO: 888627 - RNA, 19 nt, Homo sapiens
gugaauaacuacacagauu

SEQ ID NO: 888628 - RNA, 19 nt, Homo sapiens
ucugggagcugcagugaua

SEQ ID NO: 888629 - RNA, 19 nt, Homo sapiens
gcccagagguucaggaaga

SEQ ID NO: 888630 - RNA, 19 nt, Homo sapiens
ggaacuuggucauggagaa

SEQ ID NO: 888631 - RNA, 19 nt, Homo sapiens
guaaauccaucggaagugu

SEQ ID NO: 888632 - RNA, 19 nt, Homo sapiens
ggaagaauuacagagguua

SEQ ID NO: 888633 - RNA, 19 nt, Homo sapiens
gaaauccacacuccguauu

SEQ ID NO: 888634 - RNA, 19 nt, Homo sapiens
gggccucucugacgaaugu

SEQ ID NO: 888635 - RNA, 19 nt, Homo sapiens
gaggagcugucccugaauc

SEQ ID NO: 888636 - RNA, 19 nt, Homo sapiens
gcagagcaagucagcauug

SEQ ID NO: 888637 - RNA, 19 nt, Homo sapiens
caacgagccagacgacuau

SEQ ID NO: 888638 - RNA, 19 nt, Homo sapiens
caaacgucauccaccagaa

SEQ ID NO: 888639 - RNA, 19 nt, Homo sapiens
gacgcgaugugucuccaaa

SEQ ID NO: 888640 - RNA, 19 nt, Homo sapiens
gguauggagcgacuaaaga

SEQ ID NO: 888641 - RNA, 19 nt, Homo sapiens
cccaggaguugcuguaaau

SEQ ID NO: 888642 - RNA, 19 nt, Homo sapiens
gcaggcuggucuugaacug

SEQ ID NO: 888643 - RNA, 19 nt, Homo sapiens
ugacaacgggccacaccua

SEQ ID NO: 888644 - RNA, 19 nt, Homo sapiens
ccuaucaucuugggaaaca

SEQ ID NO: 888645 - RNA, 19 nt, Homo sapiens
ucggaaguguguccuguga

SEQ ID NO: 888646 - RNA, 19 nt, Homo sapiens
gaggcacgcucuuguuuug

SEQ ID NO: 888647 - RNA, 19 nt, Homo sapiens
gccuaggccucccaaagug

SEQ ID NO: 888648 - RNA, 19 nt, Homo sapiens
acaacgagccagacgacua

SEQ ID NO: 888649 - RNA, 19 nt, Homo sapiens
gcuguggggugaauaacua

SEQ ID NO: 888650 - RNA, 19 nt, Homo sapiens
ucaccaagacucagagcuu

SEQ ID NO: 888651 - RNA, 19 nt, Homo sapiens
ugacccugaggaagaauua

SEQ ID NO: 888652 - RNA, 19 nt, Homo sapiens
ugcauccugucaaugguua

SEQ ID NO: 888653 - RNA, 19 nt, Homo sapiens
gggcagagcaagucagcau

SEQ ID NO: 888654 - RNA, 19 nt, Homo sapiens
aggaagaauuacagagguu

SEQ ID NO: 888655 - RNA, 19 nt, Homo sapiens
gagguucaggaagauguua

SEQ ID NO: 888656 - RNA, 19 nt, Homo sapiens
ggugguauggagcgacuaa

SEQ ID NO: 888657 - RNA, 19 nt, Homo sapiens
aaacaguagcccagagguu

SEQ ID NO: 888658 - RNA, 19 nt, Homo sapiens
gagccagacgacuauucua

SEQ ID NO: 888659 - RNA, 19 nt, Homo sapiens
gagauguggccuuggaaca

SEQ ID NO: 888660 - RNA, 19 nt, Homo sapiens
guccucaucauggaaguua

SEQ ID NO: 888661 - RNA, 19 nt, Homo sapiens
ugaaauccacacuccguau

SEQ ID NO: 888662 - RNA, 19 nt, Homo sapiens
gaagaauuacagagguuac

SEQ ID NO: 888663 - RNA, 19 nt, Homo sapiens
gaaacuguuaucuuuacuc

SEQ ID NO: 888664 - RNA, 19 nt, Homo sapiens
ccagaagggcuguuuccau

SEQ ID NO: 888665 - RNA, 19 nt, Homo sapiens
gaacuuggucauggagaag

SEQ ID NO: 888666 - RNA, 19 nt, Homo sapiens
ucauggagaagcuaaagug

SEQ ID NO: 888667 - RNA, 19 nt, Homo sapiens
guauggagcgacuaaagag

SEQ ID NO: 888668 - RNA, 19 nt, Homo sapiens
cuaguuggccugggcauug

SEQ ID NO: 888669 - RNA, 19 nt, Homo sapiens
ggagcugcagugauacaga

SEQ ID NO: 888670 - RNA, 19 nt, Homo sapiens
agaagggcuguuuccauaa

SEQ ID NO: 888671 - RNA, 19 nt, Homo sapiens
ccagacgacuauucuacac

SEQ ID NO: 888672 - RNA, 19 nt, Homo sapiens
ggccugggcauugguggua

SEQ ID NO: 888673 - RNA, 19 nt, Homo sapiens
ggcugugucuggcaucauc

SEQ ID NO: 888674 - RNA, 19 nt, Homo sapiens
ccaaagugcuggguuuacc

SEQ ID NO: 888675 - RNA, 19 nt, Homo sapiens
uugaacugcuggccuaaag

SEQ ID NO: 888676 - RNA, 19 nt, Homo sapiens
ugacggacgcgaugugucu

SEQ ID NO: 888677 - RNA, 19 nt, Homo sapiens
gaauuacagagguuacaac

SEQ ID NO: 888678 - RNA, 19 nt, Homo sapiens
gggugaauaacuacacaga

SEQ ID NO: 888679 - RNA, 19 nt, Homo sapiens
uuggagauguggccuugga

SEQ ID NO: 888680 - RNA, 19 nt, Homo sapiens
gcucuuccuucgaaaugac

SEQ ID NO: 888681 - RNA, 19 nt, Homo sapiens
gaagaaaucuacugagugu

SEQ ID NO: 888682 - RNA, 19 nt, Homo sapiens
agacagagcucagggaaua

SEQ ID NO: 888683 - RNA, 19 nt, Homo sapiens
gauguauacuggcuuauuu

SEQ ID NO: 888684 - RNA, 19 nt, Homo sapiens
gagaagugcguuuggauua

SEQ ID NO: 888685 - RNA, 19 nt, Homo sapiens
ggaccaggcugucaacaug

SEQ ID NO: 888686 - RNA, 19 nt, Homo sapiens
caaccagucucgaggcuuu

SEQ ID NO: 888687 - RNA, 19 nt, Homo sapiens
gaaaucuacugaguguauu

SEQ ID NO: 888688 - RNA, 19 nt, Homo sapiens
gaagugcguuuggauuaga

SEQ ID NO: 888689 - RNA, 19 nt, Homo sapiens
ucacaaacuuggcggcaaa

SEQ ID NO: 888690 - RNA, 19 nt, Homo sapiens
uaacccaucagcacaauaa

SEQ ID NO: 888691 - RNA, 19 nt, Homo sapiens
gaaccgaaccgaguaggaa

SEQ ID NO: 888692 - RNA, 19 nt, Homo sapiens
gaaggaaggauggcagaaa

SEQ ID NO: 888693 - RNA, 19 nt, Homo sapiens
gaagucguagauuguguua

SEQ ID NO: 888694 - RNA, 19 nt, Homo sapiens
ccacguggcagcaaggaua

SEQ ID NO: 888695 - RNA, 19 nt, Homo sapiens
gcgauaacaguaaaucaaa

SEQ ID NO: 888696 - RNA, 19 nt, Homo sapiens
gggcagcaccucuggcuuu

SEQ ID NO: 888697 - RNA, 19 nt, Homo sapiens
gacccaggauuccaaacuu

SEQ ID NO: 888698 - RNA, 19 nt, Homo sapiens
caggagcgauaacaguaaa

SEQ ID NO: 888699 - RNA, 19 nt, Homo sapiens
ucacggagguagucaugau

SEQ ID NO: 888700 - RNA, 19 nt, Homo sapiens
gagaagucguagauugugu

SEQ ID NO: 888701 - RNA, 19 nt, Homo sapiens
ucagggcguuucccauuga

SEQ ID NO: 888702 - RNA, 19 nt, Homo sapiens
aaagagaagugcguuugga

SEQ ID NO: 888703 - RNA, 19 nt, Homo sapiens
agaaaucuacugaguguau

SEQ ID NO: 888704 - RNA, 19 nt, Homo sapiens
gcagcuacuuuucccaaua

SEQ ID NO: 888705 - RNA, 19 nt, Homo sapiens
uacgauguauacuggcuua

SEQ ID NO: 888706 - RNA, 19 nt, Homo sapiens
gauauuugucgguggaauu

SEQ ID NO: 888707 - RNA, 19 nt, Homo sapiens
agucguagauuguguuauc

SEQ ID NO: 888708 - RNA, 19 nt, Homo sapiens
uuaaagacccaaacugugu

SEQ ID NO: 888709 - RNA, 19 nt, Homo sapiens
gacccugguuugaauaaag

SEQ ID NO: 888710 - RNA, 19 nt, Homo sapiens
gccagcagccuccuuccua

SEQ ID NO: 888711 - RNA, 19 nt, Homo sapiens
ccaauauggagaagucgua

SEQ ID NO: 888712 - RNA, 19 nt, Homo sapiens
ggaaggauggcagaaagga

SEQ ID NO: 888713 - RNA, 19 nt, Homo sapiens
gcagaccgcacacgcuaga

SEQ ID NO: 888714 - RNA, 19 nt, Homo sapiens
guagauuguguuaucauga

SEQ ID NO: 888715 - RNA, 19 nt, Homo sapiens
gucuucagcuuuaauucaa

SEQ ID NO: 888716 - RNA, 19 nt, Homo sapiens
ggagguagucaugaucuau

SEQ ID NO: 888717 - RNA, 19 nt, Homo sapiens
gcggcaaaguggcgacuca

SEQ ID NO: 888718 - RNA, 19 nt, Homo sapiens
guuugacccugguuugaau

SEQ ID NO: 888719 - RNA, 19 nt, Homo sapiens
auggagaagucguagauug

SEQ ID NO: 888720 - RNA, 19 nt, Homo sapiens
cgacagcucagccagacuu

SEQ ID NO: 888721 - RNA, 19 nt, Homo sapiens
ccaggagcgauaacaguaa

SEQ ID NO: 888722 - RNA, 19 nt, Homo sapiens
aaaggacccaggagcgaua

SEQ ID NO: 888723 - RNA, 19 nt, Homo sapiens
ggagaagucguagauugug

SEQ ID NO: 888724 - RNA, 19 nt, Homo sapiens
ucucgaggcuuuggguuug

SEQ ID NO: 888725 - RNA, 19 nt, Homo sapiens
gcagaaccacaacgugcaa

SEQ ID NO: 888726 - RNA, 19 nt, Homo sapiens
gccccgagguuuuggauuu

SEQ ID NO: 888727 - RNA, 19 nt, Homo sapiens
gagguagucaugaucuaug

SEQ ID NO: 888728 - RNA, 19 nt, Homo sapiens
gcucagggaauacuucaag

SEQ ID NO: 888729 - RNA, 19 nt, Homo sapiens
cguagauuguguuaucaug

SEQ ID NO: 888730 - RNA, 19 nt, Homo sapiens
aaggaaggauggcagaaag

SEQ ID NO: 888731 - RNA, 19 nt, Homo sapiens
cuacugaguguauuucugu

SEQ ID NO: 888732 - RNA, 19 nt, Homo sapiens
gaaacucugggagcuucua

SEQ ID NO: 888733 - RNA, 19 nt, Homo sapiens
gacgagggcagaaccacaa

SEQ ID NO: 888734 - RNA, 19 nt, Homo sapiens
gagcgauaacaguaaauca

SEQ ID NO: 888735 - RNA, 19 nt, Homo sapiens
gguagugucugaggugaac

SEQ ID NO: 888736 - RNA, 19 nt, Homo sapiens
aaaagucacugguucaaca

SEQ ID NO: 888737 - RNA, 19 nt, Homo sapiens
cggagguagucaugaucua

SEQ ID NO: 888738 - RNA, 19 nt, Homo sapiens
cccaggagcgauaacagua

SEQ ID NO: 888739 - RNA, 19 nt, Homo sapiens
agaagugcguuuggauuag

SEQ ID NO: 888740 - RNA, 19 nt, Homo sapiens
ggcgauugguggcuaugga

SEQ ID NO: 888741 - RNA, 19 nt, Homo sapiens
ggaugcagccggagagaac

SEQ ID NO: 888742 - RNA, 19 nt, Homo sapiens
agagaagugcguuuggauu

SEQ ID NO: 888743 - RNA, 19 nt, Homo sapiens
ggucacggagguagucaug

SEQ ID NO: 888744 - RNA, 19 nt, Homo sapiens
ucagggaauacuucaagaa

SEQ ID NO: 888745 - RNA, 19 nt, Homo sapiens
cgauguauacuggcuuauu

SEQ ID NO: 888746 - RNA, 19 nt, Homo sapiens
guucaacaacaggguuuaa

SEQ ID NO: 888747 - RNA, 19 nt, Homo sapiens
gagcacgacccaagagacu

SEQ ID NO: 888748 - RNA, 19 nt, Homo sapiens
gaucuaugacgccgagaag

SEQ ID NO: 888749 - RNA, 19 nt, Homo sapiens
cuucagggcguuucccauu

SEQ ID NO: 888750 - RNA, 19 nt, Homo sapiens
gagcucagggaauacuuca

SEQ ID NO: 888751 - RNA, 19 nt, Homo sapiens
ugacccugguuugaauaaa

SEQ ID NO: 888752 - RNA, 19 nt, Homo sapiens
ggcagcaccucuggcuuuc

SEQ ID NO: 888753 - RNA, 19 nt, Homo sapiens
uaaagagaagugcguuugg

SEQ ID NO: 888754 - RNA, 19 nt, Homo sapiens
gagaacacggccgaaggaa

SEQ ID NO: 888755 - RNA, 19 nt, Homo sapiens
auaaagagaagugcguuug

SEQ ID NO: 888756 - RNA, 19 nt, Homo sapiens
ugugaacucgugacaauca

SEQ ID NO: 888757 - RNA, 19 nt, Homo sapiens
ggagcgauaacaguaaauc

SEQ ID NO: 888758 - RNA, 19 nt, Homo sapiens
agagaacacggccgaagga

SEQ ID NO: 888759 - RNA, 19 nt, Homo sapiens
cagcuacuuuucccaauau

SEQ ID NO: 888760 - RNA, 19 nt, Homo sapiens
ucgacugaccugcuuggua

SEQ ID NO: 888761 - RNA, 19 nt, Homo sapiens
uggagaagucguagauugu

SEQ ID NO: 888762 - RNA, 19 nt, Homo sapiens
acccaggauuccaaacuug

SEQ ID NO: 888763 - RNA, 19 nt, Homo sapiens
acaauuguggugagacaga

SEQ ID NO: 888764 - RNA, 19 nt, Homo sapiens
ggacccaggagcgauaaca

SEQ ID NO: 888765 - RNA, 19 nt, Homo sapiens
gaagaaaucuacugagugu

SEQ ID NO: 888766 - RNA, 19 nt, Homo sapiens
agacagagcucagggaaua

SEQ ID NO: 888767 - RNA, 19 nt, Homo sapiens
gauguauacuggcuuauuu

SEQ ID NO: 888768 - RNA, 19 nt, Homo sapiens
gagaagugcguuuggauua

SEQ ID NO: 888769 - RNA, 19 nt, Homo sapiens
ggaccaggcugucaacaug

SEQ ID NO: 888770 - RNA, 19 nt, Homo sapiens
gauguggccuagcagguua

SEQ ID NO: 888771 - RNA, 19 nt, Homo sapiens
caaccagucucgaggcuuu

SEQ ID NO: 888772 - RNA, 19 nt, Homo sapiens
gaaaucuacugaguguauu

SEQ ID NO: 888773 - RNA, 19 nt, Homo sapiens
gaagugcguuuggauuaga

SEQ ID NO: 888774 - RNA, 19 nt, Homo sapiens
ucacaaacuuggcggcaaa

SEQ ID NO: 888775 - RNA, 19 nt, Homo sapiens
gcagugauguggccuagca

SEQ ID NO: 888776 - RNA, 19 nt, Homo sapiens
uaacccaucagcacaauaa

SEQ ID NO: 888777 - RNA, 19 nt, Homo sapiens
gaaccgaaccgaguaggaa

SEQ ID NO: 888778 - RNA, 19 nt, Homo sapiens
gaaggaaggauggcagaaa

SEQ ID NO: 888779 - RNA, 19 nt, Homo sapiens
gaagucguagauuguguua

SEQ ID NO: 888780 - RNA, 19 nt, Homo sapiens
ccacguggcagcaaggaua

SEQ ID NO: 888781 - RNA, 19 nt, Homo sapiens
gcgauaacaguaaaucaaa

SEQ ID NO: 888782 - RNA, 19 nt, Homo sapiens
gggcagcaccucuggcuuu

SEQ ID NO: 888783 - RNA, 19 nt, Homo sapiens
gacccaggauuccaaacuu

SEQ ID NO: 888784 - RNA, 19 nt, Homo sapiens
caggagcgauaacaguaaa

SEQ ID NO: 888785 - RNA, 19 nt, Homo sapiens
ucacggagguagucaugau

SEQ ID NO: 888786 - RNA, 19 nt, Homo sapiens
gagaagucguagauugugu

SEQ ID NO: 888787 - RNA, 19 nt, Homo sapiens
ucagggcguuucccauuga

SEQ ID NO: 888788 - RNA, 19 nt, Homo sapiens
aaagagaagugcguuugga

SEQ ID NO: 888789 - RNA, 19 nt, Homo sapiens
agaaaucuacugaguguau

SEQ ID NO: 888790 - RNA, 19 nt, Homo sapiens
gcagcuacuuuucccaaua

SEQ ID NO: 888791 - RNA, 19 nt, Homo sapiens
uacgauguauacuggcuua

SEQ ID NO: 888792 - RNA, 19 nt, Homo sapiens
gauauuugucgguggaauu

SEQ ID NO: 888793 - RNA, 19 nt, Homo sapiens
agucguagauuguguuauc

SEQ ID NO: 888794 - RNA, 19 nt, Homo sapiens
uuaaagacccaaacugugu

SEQ ID NO: 888795 - RNA, 19 nt, Homo sapiens
gacccugguuugaauaaag

SEQ ID NO: 888796 - RNA, 19 nt, Homo sapiens
ccaauauggagaagucgua

SEQ ID NO: 888797 - RNA, 19 nt, Homo sapiens
gccagcagccuccuuccua

SEQ ID NO: 888798 - RNA, 19 nt, Homo sapiens
ggaaggauggcagaaagga

SEQ ID NO: 888799 - RNA, 19 nt, Homo sapiens
gcagaccgcacacgcuaga

SEQ ID NO: 888800 - RNA, 19 nt, Homo sapiens
guagauuguguuaucauga

SEQ ID NO: 888801 - RNA, 19 nt, Homo sapiens
gucuucagcuuuaauucaa

SEQ ID NO: 888802 - RNA, 19 nt, Homo sapiens
ggagguagucaugaucuau

SEQ ID NO: 888803 - RNA, 19 nt, Homo sapiens
gcggcaaaguggcgacuca

SEQ ID NO: 888804 - RNA, 19 nt, Homo sapiens
auggagaagucguagauug

SEQ ID NO: 888805 - RNA, 19 nt, Homo sapiens
guuugacccugguuugaau

SEQ ID NO: 888806 - RNA, 19 nt, Homo sapiens
ggagaagucguagauugug

SEQ ID NO: 888807 - RNA, 19 nt, Homo sapiens
cgacagcucagccagacuu

SEQ ID NO: 888808 - RNA, 19 nt, Homo sapiens
ccaggagcgauaacaguaa

SEQ ID NO: 888809 - RNA, 19 nt, Homo sapiens
aaaggacccaggagcgaua

SEQ ID NO: 888810 - RNA, 19 nt, Homo sapiens
ucucgaggcuuuggguuug

SEQ ID NO: 888811 - RNA, 19 nt, Homo sapiens
gcagaaccacaacgugcaa

SEQ ID NO: 888812 - RNA, 19 nt, Homo sapiens
cguagauuguguuaucaug

SEQ ID NO: 888813 - RNA, 19 nt, Homo sapiens
cacuuuguuuacagucuua

SEQ ID NO: 888814 - RNA, 19 nt, Homo sapiens
gccccgagguuuuggauuu

SEQ ID NO: 888815 - RNA, 19 nt, Homo sapiens
gagguagucaugaucuaug

SEQ ID NO: 888816 - RNA, 19 nt, Homo sapiens
gcucagggaauacuucaag

SEQ ID NO: 888817 - RNA, 19 nt, Homo sapiens
aaggaaggauggcagaaag

SEQ ID NO: 888818 - RNA, 19 nt, Homo sapiens
cuacugaguguauuucugu

SEQ ID NO: 888819 - RNA, 19 nt, Homo sapiens
gaaacucugggagcuucua

SEQ ID NO: 888820 - RNA, 19 nt, Homo sapiens
gacgagggcagaaccacaa

SEQ ID NO: 888821 - RNA, 19 nt, Homo sapiens
gagcgauaacaguaaauca

SEQ ID NO: 888822 - RNA, 19 nt, Homo sapiens
gguagugucugaggugaac

SEQ ID NO: 888823 - RNA, 19 nt, Homo sapiens
aaaagucacugguucaaca

SEQ ID NO: 888824 - RNA, 19 nt, Homo sapiens
cggagguagucaugaucua

SEQ ID NO: 888825 - RNA, 19 nt, Homo sapiens
cccaggagcgauaacagua

SEQ ID NO: 888826 - RNA, 19 nt, Homo sapiens
agaagugcguuuggauuag

SEQ ID NO: 888827 - RNA, 19 nt, Homo sapiens
ggcgauugguggcuaugga

SEQ ID NO: 888828 - RNA, 19 nt, Homo sapiens
ggaugcagccggagagaac

SEQ ID NO: 888829 - RNA, 19 nt, Homo sapiens
agagaagugcguuuggauu

SEQ ID NO: 888830 - RNA, 19 nt, Homo sapiens
ggucacggagguagucaug

SEQ ID NO: 888831 - RNA, 19 nt, Homo sapiens
ucagggaauacuucaagaa

SEQ ID NO: 888832 - RNA, 19 nt, Homo sapiens
cgauguauacuggcuuauu

SEQ ID NO: 888833 - RNA, 19 nt, Homo sapiens
guucaacaacaggguuuaa

SEQ ID NO: 888834 - RNA, 19 nt, Homo sapiens
gagcacgacccaagagacu

SEQ ID NO: 888835 - RNA, 19 nt, Homo sapiens
acacuuuguuuacagucuu

SEQ ID NO: 888836 - RNA, 19 nt, Homo sapiens
gaucuaugacgccgagaag

SEQ ID NO: 888837 - RNA, 19 nt, Homo sapiens
cuucagggcguuucccauu

SEQ ID NO: 888838 - RNA, 19 nt, Homo sapiens
gcccacacuuuguuuacag

SEQ ID NO: 888839 - RNA, 19 nt, Homo sapiens
gagcucagggaauacuuca

SEQ ID NO: 888840 - RNA, 19 nt, Homo sapiens
ugacccugguuugaauaaa

SEQ ID NO: 888841 - RNA, 19 nt, Homo sapiens
ggcagcaccucuggcuuuc

SEQ ID NO: 888842 - RNA, 19 nt, Homo sapiens
uaaagagaagugcguuugg

SEQ ID NO: 888843 - RNA, 19 nt, Homo sapiens
auaaagagaagugcguuug

SEQ ID NO: 888844 - RNA, 19 nt, Homo sapiens
gagaacacggccgaaggaa

SEQ ID NO: 888845 - RNA, 19 nt, Homo sapiens
ugugaacucgugacaauca

SEQ ID NO: 888846 - RNA, 19 nt, Homo sapiens
aguauggccuggguuccua

SEQ ID NO: 888847 - RNA, 19 nt, Homo sapiens
ggagcgauaacaguaaauc

SEQ ID NO: 888848 - RNA, 19 nt, Homo sapiens
cagcuacuuuucccaauau

SEQ ID NO: 888849 - RNA, 19 nt, Homo sapiens
agagaacacggccgaagga

SEQ ID NO: 888850 - RNA, 19 nt, Homo sapiens
ucgacugaccugcuuggua

SEQ ID NO: 888851 - RNA, 19 nt, Homo sapiens
uggagaagucguagauugu

SEQ ID NO: 888852 - RNA, 19 nt, Homo sapiens
acccaggauuccaaacuug

SEQ ID NO: 888853 - RNA, 19 nt, Homo sapiens
ggcccacacuuuguuuaca

SEQ ID NO: 888854 - RNA, 19 nt, Homo sapiens
ggacccaggagcgauaaca

SEQ ID NO: 888855 - RNA, 19 nt, Homo sapiens
acaauuguggugagacaga

SEQ ID NO: 888856 - RNA, 19 nt, Homo sapiens
guaaagcacuguccacuug

SEQ ID NO: 888857 - RNA, 19 nt, Homo sapiens
ccacugaucuauacuuuga

SEQ ID NO: 888858 - RNA, 19 nt, Homo sapiens
ucacuuaucucuucuucaa

SEQ ID NO: 888859 - RNA, 19 nt, Homo sapiens
ugacacuucucuccuauuu

SEQ ID NO: 888860 - RNA, 19 nt, Homo sapiens
gauauuaagccauugcuaa

SEQ ID NO: 888861 - RNA, 19 nt, Homo sapiens
gaauggagccguucugaug

SEQ ID NO: 888862 - RNA, 19 nt, Homo sapiens
guaaugacuucucgcuuga

SEQ ID NO: 888863 - RNA, 19 nt, Homo sapiens
ccacuucgcuacacuguca

SEQ ID NO: 888864 - RNA, 19 nt, Homo sapiens
caaccucagucaccgaauu

SEQ ID NO: 888865 - RNA, 19 nt, Homo sapiens
gcacggaguccauguuguu

SEQ ID NO: 888866 - RNA, 19 nt, Homo sapiens
cuauauccauccugcguua

SEQ ID NO: 888867 - RNA, 19 nt, Homo sapiens
cauuaucacuuaucucuuc

SEQ ID NO: 888868 - RNA, 19 nt, Homo sapiens
ugacagacauucaagaacu

SEQ ID NO: 888869 - RNA, 19 nt, Homo sapiens
guacuaaacccacugaucu

SEQ ID NO: 888870 - RNA, 19 nt, Homo sapiens
gaccaggaccggauuguug

SEQ ID NO: 888871 - RNA, 19 nt, Homo sapiens
ccaaccguauccaucauuu

SEQ ID NO: 888872 - RNA, 19 nt, Homo sapiens
cuggauaucuguuacucua

SEQ ID NO: 888873 - RNA, 19 nt, Homo sapiens
uaaacccacugaucuauac

SEQ ID NO: 888874 - RNA, 19 nt, Homo sapiens
uucaagaacugcagccuuu

SEQ ID NO: 888875 - RNA, 19 nt, Homo sapiens
acacuucucuccuauuucu

SEQ ID NO: 888876 - RNA, 19 nt, Homo sapiens
gagccguucugaugauugu

SEQ ID NO: 888877 - RNA, 19 nt, Homo sapiens
uguggucacuccuguacua

SEQ ID NO: 888878 - RNA, 19 nt, Homo sapiens
caccgaauuucuccucuug

SEQ ID NO: 888879 - RNA, 19 nt, Homo sapiens
ucugugauauuaagccauu

SEQ ID NO: 888880 - RNA, 19 nt, Homo sapiens
ucgcuacacugucaucaug

SEQ ID NO: 888881 - RNA, 19 nt, Homo sapiens
ggaacacugagcuuaauca

SEQ ID NO: 888882 - RNA, 19 nt, Homo sapiens
cuaaacccacugaucuaua

SEQ ID NO: 888883 - RNA, 19 nt, Homo sapiens
ggucacuccuguacuaaac

SEQ ID NO: 888884 - RNA, 19 nt, Homo sapiens
agagugaucagaaggcuuu

SEQ ID NO: 888885 - RNA, 19 nt, Homo sapiens
gacagacauucaagaacug

SEQ ID NO: 888886 - RNA, 19 nt, Homo sapiens
cuuaaucaguggcuacuca

SEQ ID NO: 888887 - RNA, 19 nt, Homo sapiens
caugaacccucagcucugu

SEQ ID NO: 888888 - RNA, 19 nt, Homo sapiens
cuuguagcaugcucuguaa

SEQ ID NO: 888889 - RNA, 19 nt, Homo sapiens
ucucuccuauuucuacauu

SEQ ID NO: 888890 - RNA, 19 nt, Homo sapiens
ggauuguugccaucaugua

SEQ ID NO: 888891 - RNA, 19 nt, Homo sapiens
ugacuucucgcuugaacuu

SEQ ID NO: 888892 - RNA, 19 nt, Homo sapiens
cugcugcacuccguaauga

SEQ ID NO: 888893 - RNA, 19 nt, Homo sapiens
uaucacuuaucucuucuuc

SEQ ID NO: 888894 - RNA, 19 nt, Homo sapiens
gugggaacacugagcuuaa

SEQ ID NO: 888895 - RNA, 19 nt, Homo sapiens
gauggcauuugaccucucu

SEQ ID NO: 888896 - RNA, 19 nt, Homo sapiens
ggaauggagccguucugau

SEQ ID NO: 888897 - RNA, 19 nt, Homo sapiens
ccacuucaugguaguuauu

SEQ ID NO: 888898 - RNA, 19 nt, Homo sapiens
cgcuugaacuucugugguu

SEQ ID NO: 888899 - RNA, 19 nt, Homo sapiens
gggaauggagccguucuga

SEQ ID NO: 888900 - RNA, 19 nt, Homo sapiens
ggaccaggaccggauuguu

SEQ ID NO: 888901 - RNA, 19 nt, Homo sapiens
ggccuuggguagagugauc

SEQ ID NO: 888902 - RNA, 19 nt, Homo sapiens
acccacugaucuauacuuu

SEQ ID NO: 888903 - RNA, 19 nt, Homo sapiens
gggagugacagacauucaa

SEQ ID NO: 888904 - RNA, 19 nt, Homo sapiens
ccaucuacuucaucagugu

SEQ ID NO: 888905 - RNA, 19 nt, Homo sapiens
ucaccgaauuucuccucuu

SEQ ID NO: 888906 - RNA, 19 nt, Homo sapiens
gcaagccacuucgcuacac

SEQ ID NO: 888907 - RNA, 19 nt, Homo sapiens
uguccuaccuggauaucug

SEQ ID NO: 888908 - RNA, 19 nt, Homo sapiens
cagcacggaguccauguug

SEQ ID NO: 888909 - RNA, 19 nt, Homo sapiens
gcagcacggaguccauguu

SEQ ID NO: 888910 - RNA, 19 nt, Homo sapiens
aaagcacuguccacuugug

SEQ ID NO: 888911 - RNA, 19 nt, Homo sapiens
ugggaacacugagcuuaau

SEQ ID NO: 888912 - RNA, 19 nt, Homo sapiens
ggagugacagacauucaag

SEQ ID NO: 888913 - RNA, 19 nt, Homo sapiens
guuccaaccguauccauca

SEQ ID NO: 888914 - RNA, 19 nt, Homo sapiens
acacacaaagcaauuucuu

SEQ ID NO: 888915 - RNA, 19 nt, Homo sapiens
ugucaucuccgauccuaga

SEQ ID NO: 888916 - RNA, 19 nt, Homo sapiens
gaggaacaaggaagugaag

SEQ ID NO: 888917 - RNA, 19 nt, Homo sapiens
ccacuugugccucccacuu

SEQ ID NO: 888918 - RNA, 19 nt, Homo sapiens
ccggauuguugccaucaug

SEQ ID NO: 888919 - RNA, 19 nt, Homo sapiens
aaccuguccuaccuggaua

SEQ ID NO: 888920 - RNA, 19 nt, Homo sapiens
aaaccuguccuaccuggau

SEQ ID NO: 888921 - RNA, 19 nt, Homo sapiens
ugggaaaccuguccuaccu

SEQ ID NO: 888922 - RNA, 19 nt, Homo sapiens
ugaucuauacuuugaggaa

SEQ ID NO: 888923 - RNA, 19 nt, Homo sapiens
ucuuguagcaugcucugua

SEQ ID NO: 888924 - RNA, 19 nt, Homo sapiens
ucugacacuucucuccuau

SEQ ID NO: 888925 - RNA, 19 nt, Homo sapiens
ucgccgugauggcauuuga

SEQ ID NO: 888926 - RNA, 19 nt, Homo sapiens
caucacaaucugggucauu

SEQ ID NO: 888927 - RNA, 19 nt, Homo sapiens
ugaggaacaaggaagugaa

SEQ ID NO: 888928 - RNA, 19 nt, Homo sapiens
uacuaaacccacugaucua

SEQ ID NO: 888929 - RNA, 19 nt, Homo sapiens
ugugggaacacugagcuua

SEQ ID NO: 888930 - RNA, 19 nt, Homo sapiens
cuacacacaaagcaauuuc

SEQ ID NO: 888931 - RNA, 19 nt, Homo sapiens
cuaccuggauaucuguuac

SEQ ID NO: 888932 - RNA, 19 nt, Homo sapiens
gaaauugucuccacaggaa

SEQ ID NO: 888933 - RNA, 19 nt, Homo sapiens
ggaguaacuuugucuuauu

SEQ ID NO: 888934 - RNA, 19 nt, Homo sapiens
caaacaaacugaaacacuu

SEQ ID NO: 888935 - RNA, 19 nt, Homo sapiens
gaaacgaaacuauuacuga

SEQ ID NO: 888936 - RNA, 19 nt, Homo sapiens
gaucuaaggauauguguuu

SEQ ID NO: 888937 - RNA, 19 nt, Homo sapiens
uaauuuagcucccacuuau

SEQ ID NO: 888938 - RNA, 19 nt, Homo sapiens
caaccuggcucucuggauu

SEQ ID NO: 888939 - RNA, 19 nt, Homo sapiens
gcagagacaugcuaaaauu

SEQ ID NO: 888940 - RNA, 19 nt, Homo sapiens
caaguuggaucauggaguu

SEQ ID NO: 888941 - RNA, 19 nt, Homo sapiens
gcaccuaaauugcaagauc

SEQ ID NO: 888942 - RNA, 19 nt, Homo sapiens
gcaaauuccagauguugua

SEQ ID NO: 888943 - RNA, 19 nt, Homo sapiens
caaguaggauucagugugu

SEQ ID NO: 888944 - RNA, 19 nt, Homo sapiens
ggagaguaaugaagauguu

SEQ ID NO: 888945 - RNA, 19 nt, Homo sapiens
gaaggagaguaaugaagau

SEQ ID NO: 888946 - RNA, 19 nt, Homo sapiens
gacugauucugacaucuua

SEQ ID NO: 888947 - RNA, 19 nt, Homo sapiens
caaccacauugaccaguuu

SEQ ID NO: 888948 - RNA, 19 nt, Homo sapiens
agccacagcugaaugcuua

SEQ ID NO: 888949 - RNA, 19 nt, Homo sapiens
ugaacugcauuucuuguuu

SEQ ID NO: 888950 - RNA, 19 nt, Homo sapiens
gaggaguaacuuugucuua

SEQ ID NO: 888951 - RNA, 19 nt, Homo sapiens
gaagggcuuucuccacaug

SEQ ID NO: 888952 - RNA, 19 nt, Homo sapiens
uagguaaacuugugucaug

SEQ ID NO: 888953 - RNA, 19 nt, Homo sapiens
acaggaaacgaaacuauua

SEQ ID NO: 888954 - RNA, 19 nt, Homo sapiens
gaguaacuuugucuuauuc

SEQ ID NO: 888955 - RNA, 19 nt, Homo sapiens
gaucauggaguuuguaauc

SEQ ID NO: 888956 - RNA, 19 nt, Homo sapiens
uauagaagaugcagagaca

SEQ ID NO: 888957 - RNA, 19 nt, Homo sapiens
gaacgcucaugaucuuuua

SEQ ID NO: 888958 - RNA, 19 nt, Homo sapiens
gaagauucucuguaucaaa

SEQ ID NO: 888959 - RNA, 19 nt, Homo sapiens
ggaagauucucuguaucaa

SEQ ID NO: 888960 - RNA, 19 nt, Homo sapiens
cacaaacccauguauauuu

SEQ ID NO: 888961 - RNA, 19 nt, Homo sapiens
gaacugcauuucuuguuuu

SEQ ID NO: 888962 - RNA, 19 nt, Homo sapiens
gcaagaagcaacuaucucu

SEQ ID NO: 888963 - RNA, 19 nt, Homo sapiens
aaugauagggcaacaauuu

SEQ ID NO: 888964 - RNA, 19 nt, Homo sapiens
ccacaaacccauguauauu

SEQ ID NO: 888965 - RNA, 19 nt, Homo sapiens
ccugugaucuauaccauga

SEQ ID NO: 888966 - RNA, 19 nt, Homo sapiens
uagggaauaugcugauuau

SEQ ID NO: 888967 - RNA, 19 nt, Homo sapiens
uguauucacugcugucuau

SEQ ID NO: 888968 - RNA, 19 nt, Homo sapiens
ugacaucccugaacugcau

SEQ ID NO: 888969 - RNA, 19 nt, Homo sapiens
gcuccuuguuuguuaguuu

SEQ ID NO: 888970 - RNA, 19 nt, Homo sapiens
ggugacaacucucauucug

SEQ ID NO: 888971 - RNA, 19 nt, Homo sapiens
caaccuccacccucaagua

SEQ ID NO: 888972 - RNA, 19 nt, Homo sapiens
uacagcuccuuguuuguua

SEQ ID NO: 888973 - RNA, 19 nt, Homo sapiens
ugaaggagaguaaugaaga

SEQ ID NO: 888974 - RNA, 19 nt, Homo sapiens
aaacugaaacacuugauug

SEQ ID NO: 888975 - RNA, 19 nt, Homo sapiens
ggaacaaggaggugcauca

SEQ ID NO: 888976 - RNA, 19 nt, Homo sapiens
ggacugauucugacaucuu

SEQ ID NO: 888977 - RNA, 19 nt, Homo sapiens
ccauccagcuucaacauca

SEQ ID NO: 888978 - RNA, 19 nt, Homo sapiens
uuccauccaugucaaauaa

SEQ ID NO: 888979 - RNA, 19 nt, Homo sapiens
ggagaggaguaacuuuguc

SEQ ID NO: 888980 - RNA, 19 nt, Homo sapiens
ccaauuccauccaugucaa

SEQ ID NO: 888981 - RNA, 19 nt, Homo sapiens
gauaguagccuccaauucc

SEQ ID NO: 888982 - RNA, 19 nt, Homo sapiens
ccaaccacauugaccaguu

SEQ ID NO: 888983 - RNA, 19 nt, Homo sapiens
aaucuguccuuccuggaua

SEQ ID NO: 888984 - RNA, 19 nt, Homo sapiens
aaagagaagagcacaguga

SEQ ID NO: 888985 - RNA, 19 nt, Homo sapiens
cuucugggcuucaucguau

SEQ ID NO: 888986 - RNA, 19 nt, Homo sapiens
guauuaagccuaguacuca

SEQ ID NO: 888987 - RNA, 19 nt, Homo sapiens
gcagguuuguuacauaggu

SEQ ID NO: 888988 - RNA, 19 nt, Homo sapiens
gagaguaaugaagauguua

SEQ ID NO: 888989 - RNA, 19 nt, Homo sapiens
gaaggauaguagccuccaa

SEQ ID NO: 888990 - RNA, 19 nt, Homo sapiens
gccuaguacucauuaauca

SEQ ID NO: 888991 - RNA, 19 nt, Homo sapiens
ccacaggaaacgaaacuau

SEQ ID NO: 888992 - RNA, 19 nt, Homo sapiens
uuucaucacccagguauua

SEQ ID NO: 888993 - RNA, 19 nt, Homo sapiens
cugaaacacuugauugaag

SEQ ID NO: 888994 - RNA, 19 nt, Homo sapiens
caacucucauucugucugu

SEQ ID NO: 888995 - RNA, 19 nt, Homo sapiens
ugugguagauggacugguu

SEQ ID NO: 888996 - RNA, 19 nt, Homo sapiens
gugcagguuuguuacauag

SEQ ID NO: 888997 - RNA, 19 nt, Homo sapiens
caaacugaaacacuugauu

SEQ ID NO: 888998 - RNA, 19 nt, Homo sapiens
ucaauccugugaucuauac

SEQ ID NO: 888999 - RNA, 19 nt, Homo sapiens
guagugaccacauucuaug

SEQ ID NO: 889000 - RNA, 19 nt, Homo sapiens
gacaucuuaugccagaauu

SEQ ID NO: 889001 - RNA, 19 nt, Homo sapiens
ggaaacgaaacuauuacug

SEQ ID NO: 889002 - RNA, 19 nt, Homo sapiens
ggguacaugugcagguuug

SEQ ID NO: 889003 - RNA, 19 nt, Homo sapiens
gauugaaggagaguaauga

SEQ ID NO: 889004 - RNA, 19 nt, Homo sapiens
ggguuuacuguacagauua

SEQ ID NO: 889005 - RNA, 19 nt, Homo sapiens
uacaugugcagguuuguua

SEQ ID NO: 889006 - RNA, 19 nt, Homo sapiens
aaacaaacugaaacacuug

SEQ ID NO: 889007 - RNA, 19 nt, Homo sapiens
cagaguggcucaggugaca

SEQ ID NO: 889008 - RNA, 19 nt, Homo sapiens
uacugugacuuuaugcuuu

SEQ ID NO: 889009 - RNA, 19 nt, Homo sapiens
gucuaugucuucaucauca

SEQ ID NO: 889010 - RNA, 19 nt, Homo sapiens
ucacugcugucuaugucuu

SEQ ID NO: 889011 - RNA, 19 nt, Homo sapiens
uguguuaguuugcgaagga

SEQ ID NO: 889012 - RNA, 19 nt, Homo sapiens
aggaguaacuuugucuuau

SEQ ID NO: 889013 - RNA, 19 nt, Homo sapiens
cgaucgacauggaaauugu

SEQ ID NO: 889014 - RNA, 19 nt, Homo sapiens
ucccugaacugcauuucuu

SEQ ID NO: 889015 - RNA, 19 nt, Homo sapiens
gggcaaauuccagauguug

SEQ ID NO: 889016 - RNA, 19 nt, Homo sapiens
ggauaguagccuccaauuc

SEQ ID NO: 889017 - RNA, 19 nt, Homo sapiens
gguuuacuguacagauuau

SEQ ID NO: 889018 - RNA, 19 nt, Homo sapiens
ugugcagguuuguuacaua

SEQ ID NO: 889019 - RNA, 19 nt, Homo sapiens
cuucugcaguuauacuaaa

SEQ ID NO: 889020 - RNA, 19 nt, Homo sapiens
aagauucucuguaucaaac

SEQ ID NO: 889021 - RNA, 19 nt, Homo sapiens
cggaagauucucuguauca

SEQ ID NO: 889022 - RNA, 19 nt, Homo sapiens
gugaccacauucuauggaa

SEQ ID NO: 889023 - RNA, 19 nt, Homo sapiens
uagcuguagugaccacauu

SEQ ID NO: 889024 - RNA, 19 nt, Homo sapiens
caagaucuaaggauaugug

SEQ ID NO: 889025 - RNA, 19 nt, Homo sapiens
auugcaagaucuaaggaua

SEQ ID NO: 889026 - RNA, 19 nt, Homo sapiens
auaauuuagcucccacuua

SEQ ID NO: 889027 - RNA, 19 nt, Homo sapiens
ccuccacccucaaguagga

SEQ ID NO: 889028 - RNA, 19 nt, Homo sapiens
uaacguuaggcuugguaua

SEQ ID NO: 889029 - RNA, 19 nt, Homo sapiens
uuaagccuaguacucauua

SEQ ID NO: 889030 - RNA, 19 nt, Homo sapiens
guaacuuugucuuauucga

SEQ ID NO: 889031 - RNA, 19 nt, Homo sapiens
cuacagcuccuuguuuguu

SEQ ID NO: 889032 - RNA, 19 nt, Homo sapiens
acaaggagauccaccauuu

SEQ ID NO: 889033 - RNA, 19 nt, Homo sapiens
guggugaccucggccauuu

SEQ ID NO: 889034 - RNA, 19 nt, Homo sapiens
aguaaacucuacccagaaa

SEQ ID NO: 889035 - RNA, 19 nt, Homo sapiens
cagauguucuucuccuuca

SEQ ID NO: 889036 - RNA, 19 nt, Homo sapiens
ggaacaaggagcugaaggu

SEQ ID NO: 889037 - RNA, 19 nt, Homo sapiens
ggucgugcacuauggcuuu

SEQ ID NO: 889038 - RNA, 19 nt, Homo sapiens
ggcgugggcuuggugugua

SEQ ID NO: 889039 - RNA, 19 nt, Homo sapiens
ugccaccucuguugaaguu

SEQ ID NO: 889040 - RNA, 19 nt, Homo sapiens
ccagucagauguucuucuc

SEQ ID NO: 889041 - RNA, 19 nt, Homo sapiens
gaaggucgccaugaagaag

SEQ ID NO: 889042 - RNA, 19 nt, Homo sapiens
gcuacaacgugcucaugag

SEQ ID NO: 889043 - RNA, 19 nt, Homo sapiens
gagcugaaggucgccauga

SEQ ID NO: 889044 - RNA, 19 nt, Homo sapiens
ggcuuugccuccgucauuu

SEQ ID NO: 889045 - RNA, 19 nt, Homo sapiens
gagccaaucacuccacagu

SEQ ID NO: 889046 - RNA, 19 nt, Homo sapiens
gcuuugccuccgucauuua

SEQ ID NO: 889047 - RNA, 19 nt, Homo sapiens
ugaaggucgccaugaagaa

SEQ ID NO: 889048 - RNA, 19 nt, Homo sapiens
ccacagugacccaauucau

SEQ ID NO: 889049 - RNA, 19 nt, Homo sapiens
uggcuuugccuccgucauu

SEQ ID NO: 889050 - RNA, 19 nt, Homo sapiens
gcgugggcuugguguguau

SEQ ID NO: 889051 - RNA, 19 nt, Homo sapiens
caguaaacucuacccagaa

SEQ ID NO: 889052 - RNA, 19 nt, Homo sapiens
ccaugugccaccucuguug

SEQ ID NO: 889053 - RNA, 19 nt, Homo sapiens
cacagugacccaauucauc

SEQ ID NO: 889054 - RNA, 19 nt, Homo sapiens
acuccacagugacccaauu

SEQ ID NO: 889055 - RNA, 19 nt, Homo sapiens
gauaggaccucaaugauuc

SEQ ID NO: 889056 - RNA, 19 nt, Homo sapiens
ccagacagauuccuuagua

SEQ ID NO: 889057 - RNA, 19 nt, Homo sapiens
gaaagcgaacuguagauuu

SEQ ID NO: 889058 - RNA, 19 nt, Homo sapiens
ggacagaggaggaggaaga

SEQ ID NO: 889059 - RNA, 19 nt, Homo sapiens
ggagcacccugaugcacua

SEQ ID NO: 889060 - RNA, 19 nt, Homo sapiens
gcaccagacagauuccuua

SEQ ID NO: 889061 - RNA, 19 nt, Homo sapiens
aaagcgaacuguagauuuc

SEQ ID NO: 889062 - RNA, 19 nt, Homo sapiens
agauuucucugaguucuua

SEQ ID NO: 889063 - RNA, 19 nt, Homo sapiens
cuagauaggaccucaauga

SEQ ID NO: 889064 - RNA, 19 nt, Homo sapiens
gaacuguagauuucucuga

SEQ ID NO: 889065 - RNA, 19 nt, Homo sapiens
gacuguauauggccagauu

SEQ ID NO: 889066 - RNA, 19 nt, Homo sapiens
ggaagaggaggaagcaaug

SEQ ID NO: 889067 - RNA, 19 nt, Homo sapiens
cacauugucuuugauggua

SEQ ID NO: 889068 - RNA, 19 nt, Homo sapiens
agagauggaugaggaagaa

SEQ ID NO: 889069 - RNA, 19 nt, Homo sapiens
gaaggaauuagaccaggaa

SEQ ID NO: 889070 - RNA, 19 nt, Homo sapiens
ccucaaugauucccuuaga

SEQ ID NO: 889071 - RNA, 19 nt, Homo sapiens
gggagaggcccaagucaga

SEQ ID NO: 889072 - RNA, 19 nt, Homo sapiens
auaccaaccuuccugauuc

SEQ ID NO: 889073 - RNA, 19 nt, Homo sapiens
gcuacaagcaguucacuuc

SEQ ID NO: 889074 - RNA, 19 nt, Homo sapiens
ugaagcugcugccgcuaaa

SEQ ID NO: 889075 - RNA, 19 nt, Homo sapiens
gucccaaucuuccaugaug

SEQ ID NO: 889076 - RNA, 19 nt, Homo sapiens
ucucuacucugucguaaca

SEQ ID NO: 889077 - RNA, 19 nt, Homo sapiens
ggauauuguuggccaugug

SEQ ID NO: 889078 - RNA, 19 nt, Homo sapiens
uaguaguggugacuguaua

SEQ ID NO: 889079 - RNA, 19 nt, Homo sapiens
cgaaagcgaacuguagauu

SEQ ID NO: 889080 - RNA, 19 nt, Homo sapiens
ggcagcacuuugacccuaa

SEQ ID NO: 889081 - RNA, 19 nt, Homo sapiens
ucucugaguucuuaaacau

SEQ ID NO: 889082 - RNA, 19 nt, Homo sapiens
aaccaacgcuuccaugucu

SEQ ID NO: 889083 - RNA, 19 nt, Homo sapiens
cugaugcacuagcuaagaa

SEQ ID NO: 889084 - RNA, 19 nt, Homo sapiens
caggaugugaugcuguuua

SEQ ID NO: 889085 - RNA, 19 nt, Homo sapiens
ucugaguucuuaaacauca

SEQ ID NO: 889086 - RNA, 19 nt, Homo sapiens
agauaggaccucaaugauu

SEQ ID NO: 889087 - RNA, 19 nt, Homo sapiens
ucaguaaucauucaaccaa

SEQ ID NO: 889088 - RNA, 19 nt, Homo sapiens
aagcugcugccgcuaaaua

SEQ ID NO: 889089 - RNA, 19 nt, Homo sapiens
caucaagggcuguacuaug

SEQ ID NO: 889090 - RNA, 19 nt, Homo sapiens
uuagauaccaggauauugu

SEQ ID NO: 889091 - RNA, 19 nt, Homo sapiens
ggaauagugacaccagaca

SEQ ID NO: 889092 - RNA, 19 nt, Homo sapiens
gcaucuugccgccaugauu

SEQ ID NO: 889093 - RNA, 19 nt, Homo sapiens
gcugcugccgcuaaauaua

SEQ ID NO: 889094 - RNA, 19 nt, Homo sapiens
gggcagggguuguguuaga

SEQ ID NO: 889095 - RNA, 19 nt, Homo sapiens
gacagauuccuuaguagug

SEQ ID NO: 889096 - RNA, 19 nt, Homo sapiens
caucuugccgccaugauug

SEQ ID NO: 889097 - RNA, 19 nt, Homo sapiens
ucuacucugucguaacaaa

SEQ ID NO: 889098 - RNA, 19 nt, Homo sapiens
cauuggaacagaaggaauu

SEQ ID NO: 889099 - RNA, 19 nt, Homo sapiens
gcagcacuuugacccuaau

SEQ ID NO: 889100 - RNA, 19 nt, Homo sapiens
gaugugaugcuguuuacca

SEQ ID NO: 889101 - RNA, 19 nt, Homo sapiens
guagauuucucugaguucu

SEQ ID NO: 889102 - RNA, 19 nt, Homo sapiens
aaucuuccaugaugcacuu

SEQ ID NO: 889103 - RNA, 19 nt, Homo sapiens
gauuccacuuccugcguuu

SEQ ID NO: 889104 - RNA, 19 nt, Homo sapiens
gauuggcaccagacagauu

SEQ ID NO: 889105 - RNA, 19 nt, Homo sapiens
ggaauuagaccaggaaccu

SEQ ID NO: 889106 - RNA, 19 nt, Homo sapiens
ccaaggcccugagagugau

SEQ ID NO: 889107 - RNA, 19 nt, Homo sapiens
acacugugcugagaagcuu

SEQ ID NO: 889108 - RNA, 19 nt, Homo sapiens
cucaaugauucccuuagaa

SEQ ID NO: 889109 - RNA, 19 nt, Homo sapiens
uuccaugucucuacucugu

SEQ ID NO: 889110 - RNA, 19 nt, Homo sapiens
aucaagggcuguacuaugg

SEQ ID NO: 889111 - RNA, 19 nt, Homo sapiens
ggugaaggccagucaaacu

SEQ ID NO: 889112 - RNA, 19 nt, Homo sapiens
caaccaacgcuuccauguc

SEQ ID NO: 889113 - RNA, 19 nt, Homo sapiens
cccaggaugugaugcuguu

SEQ ID NO: 889114 - RNA, 19 nt, Homo sapiens
caaagucagcagagaccuu

SEQ ID NO: 889115 - RNA, 19 nt, Homo sapiens
ggaggaagaggaggaagca

SEQ ID NO: 889116 - RNA, 19 nt, Homo sapiens
cagacagauuccuuaguag

SEQ ID NO: 889117 - RNA, 19 nt, Homo sapiens
gccgaaagcgaacuguaga

SEQ ID NO: 889118 - RNA, 19 nt, Homo sapiens
aauaccaaccuuccugauu

SEQ ID NO: 889119 - RNA, 19 nt, Homo sapiens
gaccucaaugauucccuua

SEQ ID NO: 889120 - RNA, 19 nt, Homo sapiens
uggaacagaaggaauuaga

SEQ ID NO: 889121 - RNA, 19 nt, Homo sapiens
ggaggaggaagaggaggaa

SEQ ID NO: 889122 - RNA, 19 nt, Homo sapiens
ugaggaagaaucugacgau

SEQ ID NO: 889123 - RNA, 19 nt, Homo sapiens
ugaaaucucccuggucaag

SEQ ID NO: 889124 - RNA, 19 nt, Homo sapiens
caaccugaaggcccugcua

SEQ ID NO: 889125 - RNA, 19 nt, Homo sapiens
uagauaggaccucaaugau

SEQ ID NO: 889126 - RNA, 19 nt, Homo sapiens
caguugaugucuagauagg

SEQ ID NO: 889127 - RNA, 19 nt, Homo sapiens
cuguagauuucucugaguu

SEQ ID NO: 889128 - RNA, 19 nt, Homo sapiens
caucucggguugaaaucuc

SEQ ID NO: 889129 - RNA, 19 nt, Homo sapiens
uggaugaggaagaaucuga

SEQ ID NO: 889130 - RNA, 19 nt, Homo sapiens
gcacccugaugcacuagcu

SEQ ID NO: 889131 - RNA, 19 nt, Homo sapiens
gcagagucgguagacauga

SEQ ID NO: 889132 - RNA, 19 nt, Homo sapiens
gccagaacccaggauguga

SEQ ID NO: 889133 - RNA, 19 nt, Homo sapiens
gaagaggaggaagcaaugg

SEQ ID NO: 889134 - RNA, 19 nt, Homo sapiens
agacagauuccuuaguagu

SEQ ID NO: 889135 - RNA, 19 nt, Homo sapiens
acauugucuuugaugguaa

SEQ ID NO: 889136 - RNA, 19 nt, Homo sapiens
gugcagagucgguagacau

SEQ ID NO: 889137 - RNA, 19 nt, Homo sapiens
gaacccaggaugugaugcu

SEQ ID NO: 889138 - RNA, 19 nt, Homo sapiens
cuacaagcaguucacuuca

SEQ ID NO: 889139 - RNA, 19 nt, Homo sapiens
gaaggaggggagaacaaaa

SEQ ID NO: 889140 - RNA, 19 nt, Homo sapiens
uagauaccaggauauuguu

SEQ ID NO: 889141 - RNA, 19 nt, Homo sapiens
gauggaugaggaagaaucu

SEQ ID NO: 889142 - RNA, 19 nt, Homo sapiens
ucaaccaacgcuuccaugu

SEQ ID NO: 889143 - RNA, 19 nt, Homo sapiens
gagcucugucuucuugaug

SEQ ID NO: 889144 - RNA, 19 nt, Homo sapiens
gggucccaaucuuccauga

SEQ ID NO: 889145 - RNA, 19 nt, Homo sapiens
ggaacagaaggaauuagac

SEQ ID NO: 889146 - RNA, 19 nt, Homo sapiens
cugcugccgcuaaauauau

SEQ ID NO: 889147 - RNA, 19 nt, Homo sapiens
ggaaauaucugaugaggaa

SEQ ID NO: 889148 - RNA, 19 nt, Homo sapiens
ggacaaagguggcccagaa

SEQ ID NO: 889149 - RNA, 19 nt, Homo sapiens
ggacuuggaugaagaaauc

SEQ ID NO: 889150 - RNA, 19 nt, Homo sapiens
aaagagagauuacuucgaa

SEQ ID NO: 889151 - RNA, 19 nt, Homo sapiens
ggaagggucuggagaugaa

SEQ ID NO: 889152 - RNA, 19 nt, Homo sapiens
gaacuguaccgcucucuuu

SEQ ID NO: 889153 - RNA, 19 nt, Homo sapiens
gugaggagauuucuaguga

SEQ ID NO: 889154 - RNA, 19 nt, Homo sapiens
ggaaaccagugacuuuaug

SEQ ID NO: 889155 - RNA, 19 nt, Homo sapiens
ggaggaaaccagugacuuu

SEQ ID NO: 889156 - RNA, 19 nt, Homo sapiens
agacagggcuggagauaga

SEQ ID NO: 889157 - RNA, 19 nt, Homo sapiens
ggaaggaucaaacuacaaa

SEQ ID NO: 889158 - RNA, 19 nt, Homo sapiens
ggacaaagagagauuacuu

SEQ ID NO: 889159 - RNA, 19 nt, Homo sapiens
ugacucagaucgaccauau

SEQ ID NO: 889160 - RNA, 19 nt, Homo sapiens
gugaugaccuucucuagug

SEQ ID NO: 889161 - RNA, 19 nt, Homo sapiens
ucagugacuuugagaaauu

SEQ ID NO: 889162 - RNA, 19 nt, Homo sapiens
gaacaggaguguggugauc

SEQ ID NO: 889163 - RNA, 19 nt, Homo sapiens
ggagauuucuagugaagau

SEQ ID NO: 889164 - RNA, 19 nt, Homo sapiens
gaagugaggagauuucuag

SEQ ID NO: 889165 - RNA, 19 nt, Homo sapiens
gaccuucucuagugucaaa

SEQ ID NO: 889166 - RNA, 19 nt, Homo sapiens
gaaggugauuuccuaguag

SEQ ID NO: 889167 - RNA, 19 nt, Homo sapiens
gcacuuaaagcauuguuga

SEQ ID NO: 889168 - RNA, 19 nt, Homo sapiens
caaagguggcccagaauuu

SEQ ID NO: 889169 - RNA, 19 nt, Homo sapiens
gaagagccgugaagaacca

SEQ ID NO: 889170 - RNA, 19 nt, Homo sapiens
gaagacagggcuggagaua

SEQ ID NO: 889171 - RNA, 19 nt, Homo sapiens
gaggaaaccagugacuuua

SEQ ID NO: 889172 - RNA, 19 nt, Homo sapiens
acaaggcacuuaaagcauu

SEQ ID NO: 889173 - RNA, 19 nt, Homo sapiens
ggaaggcaguggcuugcaa

SEQ ID NO: 889174 - RNA, 19 nt, Homo sapiens
cuucagaaauggcacgaua

SEQ ID NO: 889175 - RNA, 19 nt, Homo sapiens
gaaccgcacacuucagaaa

SEQ ID NO: 889176 - RNA, 19 nt, Homo sapiens
gacugggucuggaggaaua

SEQ ID NO: 889177 - RNA, 19 nt, Homo sapiens
ggaaggaaggaucaaacua

SEQ ID NO: 889178 - RNA, 19 nt, Homo sapiens
agaggaagcuggagaugga

SEQ ID NO: 889179 - RNA, 19 nt, Homo sapiens
ugucaaaguuucugaggaa

SEQ ID NO: 889180 - RNA, 19 nt, Homo sapiens
gaggagauuucuagugaag

SEQ ID NO: 889181 - RNA, 19 nt, Homo sapiens
gaaggaaggaucaaacuac

SEQ ID NO: 889182 - RNA, 19 nt, Homo sapiens
ugaaggacuuggaugaaga

SEQ ID NO: 889183 - RNA, 19 nt, Homo sapiens
gaucgaccauauucugaug

SEQ ID NO: 889184 - RNA, 19 nt, Homo sapiens
caaacuggcuucuggaaaa

SEQ ID NO: 889185 - RNA, 19 nt, Homo sapiens
gaccagcucuuggaaggaa

SEQ ID NO: 889186 - RNA, 19 nt, Homo sapiens
cgaagagaguggcauggaa

SEQ ID NO: 889187 - RNA, 19 nt, Homo sapiens
gaagaagcagcaacgaaga

SEQ ID NO: 889188 - RNA, 19 nt, Homo sapiens
caaaguuucugaggaagug

SEQ ID NO: 889189 - RNA, 19 nt, Homo sapiens
gagaagaagcagcaacgaa

SEQ ID NO: 889190 - RNA, 19 nt, Homo sapiens
ggaggaagacgaagagagu

SEQ ID NO: 889191 - RNA, 19 nt, Homo sapiens
gaggaagggucuggagaug

SEQ ID NO: 889192 - RNA, 19 nt, Homo sapiens
ccacaaauaaagagcauug

SEQ ID NO: 889193 - RNA, 19 nt, Homo sapiens
gcagugaggaggaggaaga

SEQ ID NO: 889194 - RNA, 19 nt, Homo sapiens
gagcauuguuaccgccaaa

SEQ ID NO: 889195 - RNA, 19 nt, Homo sapiens
augaugagcugguagaaga

SEQ ID NO: 889196 - RNA, 19 nt, Homo sapiens
gaaaggaagagccgugaag

SEQ ID NO: 889197 - RNA, 19 nt, Homo sapiens
caaggcacuuaaagcauug

SEQ ID NO: 889198 - RNA, 19 nt, Homo sapiens
gaacucauagaacggaaga

SEQ ID NO: 889199 - RNA, 19 nt, Homo sapiens
ugaagaugaugagcuggua

SEQ ID NO: 889200 - RNA, 19 nt, Homo sapiens
gaaggacuuggaugaagaa

SEQ ID NO: 889201 - RNA, 19 nt, Homo sapiens
ucacaaggcacuuaaagca

SEQ ID NO: 889202 - RNA, 19 nt, Homo sapiens
ggaaguggagaaaggaaga

SEQ ID NO: 889203 - RNA, 19 nt, Homo sapiens
ccuuuaaacgccacaaaua

SEQ ID NO: 889204 - RNA, 19 nt, Homo sapiens
ccagggugauugacagguu

SEQ ID NO: 889205 - RNA, 19 nt, Homo sapiens
ggcaucagccucccucuug

SEQ ID NO: 889206 - RNA, 19 nt, Homo sapiens
gauggacaaagagagauua

SEQ ID NO: 889207 - RNA, 19 nt, Homo sapiens
gaaauuuaccaagggaaug

SEQ ID NO: 889208 - RNA, 19 nt, Homo sapiens
uaucagugacuuugagaaa

SEQ ID NO: 889209 - RNA, 19 nt, Homo sapiens
ggaagugaggagauuucua

SEQ ID NO: 889210 - RNA, 19 nt, Homo sapiens
gcaaaaccaccucuagaaa

SEQ ID NO: 889211 - RNA, 19 nt, Homo sapiens
gaucacagggagagcaaga

SEQ ID NO: 889212 - RNA, 19 nt, Homo sapiens
gaugaggaaauaucugaug

SEQ ID NO: 889213 - RNA, 19 nt, Homo sapiens
gaccauacuacaaugaaug

SEQ ID NO: 889214 - RNA, 19 nt, Homo sapiens
gcaccuauugaccauacua

SEQ ID NO: 889215 - RNA, 19 nt, Homo sapiens
ggacuaucccagcuucaug

SEQ ID NO: 889216 - RNA, 19 nt, Homo sapiens
cuuuaaacgccacaaauaa

SEQ ID NO: 889217 - RNA, 19 nt, Homo sapiens
gaagaccagcuccuuggau

SEQ ID NO: 889218 - RNA, 19 nt, Homo sapiens
gacaaagagagauuacuuc

SEQ ID NO: 889219 - RNA, 19 nt, Homo sapiens
cuaguaguggguagcauua

SEQ ID NO: 889220 - RNA, 19 nt, Homo sapiens
caaaaccaccucuagaaaa

SEQ ID NO: 889221 - RNA, 19 nt, Homo sapiens
gaguaucagugacuuugag

SEQ ID NO: 889222 - RNA, 19 nt, Homo sapiens
gggcuucaguguccagagu

SEQ ID NO: 889223 - RNA, 19 nt, Homo sapiens
ggaagccccuggaaagaug

SEQ ID NO: 889224 - RNA, 19 nt, Homo sapiens
guacccagacacuagauau

SEQ ID NO: 889225 - RNA, 19 nt, Homo sapiens
cagggugauugacagguuu

SEQ ID NO: 889226 - RNA, 19 nt, Homo sapiens
ggcaguggcuugcaaucca

SEQ ID NO: 889227 - RNA, 19 nt, Homo sapiens
caaagaggaagcuggagau

SEQ ID NO: 889228 - RNA, 19 nt, Homo sapiens
guaguggguagcauuagaa

SEQ ID NO: 889229 - RNA, 19 nt, Homo sapiens
uaaacgccacaaauaaaga

SEQ ID NO: 889230 - RNA, 19 nt, Homo sapiens
gauaggaaagccagcaaag

SEQ ID NO: 889231 - RNA, 19 nt, Homo sapiens
gagagauuacuucgaagga

SEQ ID NO: 889232 - RNA, 19 nt, Homo sapiens
ugaccauacuacaaugaau

SEQ ID NO: 889233 - RNA, 19 nt, Homo sapiens
ccaaacuggcuucuggaaa

SEQ ID NO: 889234 - RNA, 19 nt, Homo sapiens
aaggaaggaucaaacuaca

SEQ ID NO: 889235 - RNA, 19 nt, Homo sapiens
ggaugaugguguggugaug

SEQ ID NO: 889236 - RNA, 19 nt, Homo sapiens
cagugacuuugagaaauuu

SEQ ID NO: 889237 - RNA, 19 nt, Homo sapiens
gaaaccagugacuuuaugg

SEQ ID NO: 889238 - RNA, 19 nt, Homo sapiens
gguuucauguccuuagcaa

SEQ ID NO: 889239 - RNA, 19 nt, Homo sapiens
ggaagaccagcuccuugga

SEQ ID NO: 889240 - RNA, 19 nt, Homo sapiens
cuaaugcucaucugaagga

SEQ ID NO: 889241 - RNA, 19 nt, Homo sapiens
ugaggagauuucuagugaa

SEQ ID NO: 889242 - RNA, 19 nt, Homo sapiens
gaucgucugaugaggaaau

SEQ ID NO: 889243 - RNA, 19 nt, Homo sapiens
gcaagcuacugaguuucau

SEQ ID NO: 889244 - RNA, 19 nt, Homo sapiens
ggcuugcaauccagaaguu

SEQ ID NO: 889245 - RNA, 19 nt, Homo sapiens
gaaggcaguggcuugcaau

SEQ ID NO: 889246 - RNA, 19 nt, Homo sapiens
cuaucgaguucuuggcaaa

SEQ ID NO: 889247 - RNA, 19 nt, Homo sapiens
ccacauaguuguuguaaua

SEQ ID NO: 889248 - RNA, 19 nt, Homo sapiens
gcaauauggucuuaagaaa

SEQ ID NO: 889249 - RNA, 19 nt, Homo sapiens
gggcugagaugggaaauaa

SEQ ID NO: 889250 - RNA, 19 nt, Homo sapiens
gagaggugaucaauagaaa

SEQ ID NO: 889251 - RNA, 19 nt, Homo sapiens
ccaacuggguccugaagua

SEQ ID NO: 889252 - RNA, 19 nt, Homo sapiens
uuagagaggugaucaauag

SEQ ID NO: 889253 - RNA, 19 nt, Homo sapiens
guaugaagaugcccaacuu

SEQ ID NO: 889254 - RNA, 19 nt, Homo sapiens
gaaaauaccacacaaaaca

SEQ ID NO: 889255 - RNA, 19 nt, Homo sapiens
uaucagauguccaauacug

SEQ ID NO: 889256 - RNA, 19 nt, Homo sapiens
gcucuucuucugaaucuua

SEQ ID NO: 889257 - RNA, 19 nt, Homo sapiens
ggaagacccacacacacua

SEQ ID NO: 889258 - RNA, 19 nt, Homo sapiens
gauguccaauacuguaauu

SEQ ID NO: 889259 - RNA, 19 nt, Homo sapiens
ugaacagucuccucgugua

SEQ ID NO: 889260 - RNA, 19 nt, Homo sapiens
aggcuaggaugauauauga

SEQ ID NO: 889261 - RNA, 19 nt, Homo sapiens
uaaagaaggagcagaacaa

SEQ ID NO: 889262 - RNA, 19 nt, Homo sapiens
uauaucagauguccaauac

SEQ ID NO: 889263 - RNA, 19 nt, Homo sapiens
uauccuaucucaaugacaa

SEQ ID NO: 889264 - RNA, 19 nt, Homo sapiens
gaacagaauacagugaaga

SEQ ID NO: 889265 - RNA, 19 nt, Homo sapiens
gaacagucuccucguguau

SEQ ID NO: 889266 - RNA, 19 nt, Homo sapiens
gcacagagauucuuuucca

SEQ ID NO: 889267 - RNA, 19 nt, Homo sapiens
caauagaaaucuguuggau

SEQ ID NO: 889268 - RNA, 19 nt, Homo sapiens
gugaagacuuaaagaagga

SEQ ID NO: 889269 - RNA, 19 nt, Homo sapiens
gaaaccagaggcccaacaa

SEQ ID NO: 889270 - RNA, 19 nt, Homo sapiens
guauauaucagauguccaa

SEQ ID NO: 889271 - RNA, 19 nt, Homo sapiens
ggauuccucugguuguuca

SEQ ID NO: 889272 - RNA, 19 nt, Homo sapiens
gagaaaauaccacacaaaa

SEQ ID NO: 889273 - RNA, 19 nt, Homo sapiens
ccaauccucacauguauga

SEQ ID NO: 889274 - RNA, 19 nt, Homo sapiens
agucuugauucucgaguua

SEQ ID NO: 889275 - RNA, 19 nt, Homo sapiens
gccaauauuucuguacaug

SEQ ID NO: 889276 - RNA, 19 nt, Homo sapiens
gcaaaccggcuccgcuaga

SEQ ID NO: 889277 - RNA, 19 nt, Homo sapiens
cagaauacagugaagagaa

SEQ ID NO: 889278 - RNA, 19 nt, Homo sapiens
ugugaggaaugaagaaaga

SEQ ID NO: 889279 - RNA, 19 nt, Homo sapiens
gaagaaaaggcuaggauga

SEQ ID NO: 889280 - RNA, 19 nt, Homo sapiens
ugaagccaauauuucugua

SEQ ID NO: 889281 - RNA, 19 nt, Homo sapiens
ucagauguccaauacugua

SEQ ID NO: 889282 - RNA, 19 nt, Homo sapiens
caaccguuauggucuuugu

SEQ ID NO: 889283 - RNA, 19 nt, Homo sapiens
gaggugaucaauagaaauc

SEQ ID NO: 889284 - RNA, 19 nt, Homo sapiens
acacaaccguuauggucuu

SEQ ID NO: 889285 - RNA, 19 nt, Homo sapiens
agaaaaggcuaggaugaua

SEQ ID NO: 889286 - RNA, 19 nt, Homo sapiens
gcuugcuugugaagacuua

SEQ ID NO: 889287 - RNA, 19 nt, Homo sapiens
guuagagaggugaucaaua

SEQ ID NO: 889288 - RNA, 19 nt, Homo sapiens
augcccaacuucagauaua

SEQ ID NO: 889289 - RNA, 19 nt, Homo sapiens
ggagaguuuacuaugcuaa

SEQ ID NO: 889290 - RNA, 19 nt, Homo sapiens
uaaggacuuuugugcaaua

SEQ ID NO: 889291 - RNA, 19 nt, Homo sapiens
gaagaaagaggggaaaaug

SEQ ID NO: 889292 - RNA, 19 nt, Homo sapiens
cggccaugguucugcauuu

SEQ ID NO: 889293 - RNA, 19 nt, Homo sapiens
gcccaacuucagauauaua

SEQ ID NO: 889294 - RNA, 19 nt, Homo sapiens
gaucaauagaaaucuguug

SEQ ID NO: 889295 - RNA, 19 nt, Homo sapiens
ggugaucaauagaaaucug

SEQ ID NO: 889296 - RNA, 19 nt, Homo sapiens
gagcuauuuaucucuguuu

SEQ ID NO: 889297 - RNA, 19 nt, Homo sapiens
guaacaaugguauucaaca

SEQ ID NO: 889298 - RNA, 19 nt, Homo sapiens
ucccaauccucacauguau

SEQ ID NO: 889299 - RNA, 19 nt, Homo sapiens
cuaggaugauauaugaaga

SEQ ID NO: 889300 - RNA, 19 nt, Homo sapiens
caggagaguuuacuaugcu

SEQ ID NO: 889301 - RNA, 19 nt, Homo sapiens
ccaauauuucuguacauga

SEQ ID NO: 889302 - RNA, 19 nt, Homo sapiens
guaguccuaugaacagucu

SEQ ID NO: 889303 - RNA, 19 nt, Homo sapiens
aaagaaggagcagaacaaa

SEQ ID NO: 889304 - RNA, 19 nt, Homo sapiens
agaauacagugaagagaac

SEQ ID NO: 889305 - RNA, 19 nt, Homo sapiens
guccugaaguagcugaaau

SEQ ID NO: 889306 - RNA, 19 nt, Homo sapiens
cuaucucaaugacaaauca

SEQ ID NO: 889307 - RNA, 19 nt, Homo sapiens
caaaccggcuccgcuagag

SEQ ID NO: 889308 - RNA, 19 nt, Homo sapiens
gcuaggaugauauaugaag

SEQ ID NO: 889309 - RNA, 19 nt, Homo sapiens
guccuggucucaaaauuuu

SEQ ID NO: 889310 - RNA, 19 nt, Homo sapiens
gacccacacacacuacaaa

SEQ ID NO: 889311 - RNA, 19 nt, Homo sapiens
uuacaggagaguuuacuau

SEQ ID NO: 889312 - RNA, 19 nt, Homo sapiens
ggagggcugagaugggaaa

SEQ ID NO: 889313 - RNA, 19 nt, Homo sapiens
guacugcuggcucuucuuc

SEQ ID NO: 889314 - RNA, 19 nt, Homo sapiens
auacuuuaaugcacagaga

SEQ ID NO: 889315 - RNA, 19 nt, Homo sapiens
ggacuuuugugcaauaugg

SEQ ID NO: 889316 - RNA, 19 nt, Homo sapiens
aauccaguagcauaacuua

SEQ ID NO: 889317 - RNA, 19 nt, Homo sapiens
aaguguauuuguaguccua

SEQ ID NO: 889318 - RNA, 19 nt, Homo sapiens
gaaaaggcuaggaugauau

SEQ ID NO: 889319 - RNA, 19 nt, Homo sapiens
cgaacagaauacagugaag

SEQ ID NO: 889320 - RNA, 19 nt, Homo sapiens
acaggagaguuuacuaugc

SEQ ID NO: 889321 - RNA, 19 nt, Homo sapiens
ugcaauauggucuuaagaa

SEQ ID NO: 889322 - RNA, 19 nt, Homo sapiens
augcuucauuugccacaua

SEQ ID NO: 889323 - RNA, 19 nt, Homo sapiens
gagaugggaaauaaaagua

SEQ ID NO: 889324 - RNA, 19 nt, Homo sapiens
gcgggaagacccacacaca

SEQ ID NO: 889325 - RNA, 19 nt, Homo sapiens
gggaagacccacacacacu

SEQ ID NO: 889326 - RNA, 19 nt, Homo sapiens
gagauucuuuuccaagguu

SEQ ID NO: 889327 - RNA, 19 nt, Homo sapiens
agagaggugaucaauagaa

SEQ ID NO: 889328 - RNA, 19 nt, Homo sapiens
cagauguccaauacuguaa

SEQ ID NO: 889329 - RNA, 19 nt, Homo sapiens
ugacaaaucaaaagaguga

SEQ ID NO: 889330 - RNA, 19 nt, Homo sapiens
uaucucuguuuguuggaaa

SEQ ID NO: 889331 - RNA, 19 nt, Homo sapiens
aagccaauauuucuguaca

SEQ ID NO: 889332 - RNA, 19 nt, Homo sapiens
gaagacccacacacacuac

SEQ ID NO: 889333 - RNA, 19 nt, Homo sapiens
ggagaaaauaccacacaaa

SEQ ID NO: 889334 - RNA, 19 nt, Homo sapiens
ggaaaccagaggcccaaca

SEQ ID NO: 889335 - RNA, 19 nt, Homo sapiens
cacaaccguuauggucuuu

SEQ ID NO: 889336 - RNA, 19 nt, Homo sapiens
ccagcaggaagaaaccuuu

SEQ ID NO: 889337 - RNA, 19 nt, Homo sapiens
caacuggguccugaaguag

SEQ ID NO: 889338 - RNA, 19 nt, Homo sapiens
gcugagaugggaaauaaaa

SEQ ID NO: 889339 - RNA, 19 nt, Homo sapiens
gaaaguacugcuggcucuu

SEQ ID NO: 889340 - RNA, 19 nt, Homo sapiens
ccucacauguaugaagaug

SEQ ID NO: 889341 - RNA, 19 nt, Homo sapiens
agaggucagucuugauucu

SEQ ID NO: 889342 - RNA, 19 nt, Homo sapiens
guauuuguaguccuaugaa

SEQ ID NO: 889343 - RNA, 19 nt, Homo sapiens
uaaugcacagagauucuuu

SEQ ID NO: 889344 - RNA, 19 nt, Homo sapiens
ucaauagaaaucuguugga

SEQ ID NO: 889345 - RNA, 19 nt, Homo sapiens
ccgaacagaauacagugaa

SEQ ID NO: 889346 - RNA, 19 nt, Homo sapiens
gugaagagaaccuacuuuu

SEQ ID NO: 889347 - RNA, 19 nt, Homo sapiens
ccacaucgcucacauagug

SEQ ID NO: 889348 - RNA, 19 nt, Homo sapiens
gaaaguguguguauuccuu

SEQ ID NO: 889349 - RNA, 19 nt, Homo sapiens
ucaaauggaucaucaaguc

SEQ ID NO: 889350 - RNA, 19 nt, Homo sapiens
ggagaaaguguguguauuc

SEQ ID NO: 889351 - RNA, 19 nt, Homo sapiens
gaagaucggcgacguguuc

SEQ ID NO: 889352 - RNA, 19 nt, Homo sapiens
agaucaagcuccugaaaug

SEQ ID NO: 889353 - RNA, 19 nt, Homo sapiens
ggagacagcuguggaugag

SEQ ID NO: 889354 - RNA, 19 nt, Homo sapiens
gccaccagcuccucaaaug

SEQ ID NO: 889355 - RNA, 19 nt, Homo sapiens
uuaauaaaguguggacuga

SEQ ID NO: 889356 - RNA, 19 nt, Homo sapiens
gaggagagcugcggcacau

SEQ ID NO: 889357 - RNA, 19 nt, Homo sapiens
ugaggacucuggcuugaga

SEQ ID NO: 889358 - RNA, 19 nt, Homo sapiens
ggaccacaucgcucacaua

SEQ ID NO: 889359 - RNA, 19 nt, Homo sapiens
ccucgaaccuccuggugaa

SEQ ID NO: 889360 - RNA, 19 nt, Homo sapiens
gcugaggacucuggcuuga

SEQ ID NO: 889361 - RNA, 19 nt, Homo sapiens
ccacaccggugccucagau

SEQ ID NO: 889362 - RNA, 19 nt, Homo sapiens
gcaaacggaaacagcagaa

SEQ ID NO: 889363 - RNA, 19 nt, Homo sapiens
gagaucaagcuccugaaau

SEQ ID NO: 889364 - RNA, 19 nt, Homo sapiens
agacagcuguggaugagau

SEQ ID NO: 889365 - RNA, 19 nt, Homo sapiens
gcacauccacaaucucaag

SEQ ID NO: 889366 - RNA, 19 nt, Homo sapiens
gagcaggccacacaguuca

SEQ ID NO: 889367 - RNA, 19 nt, Homo sapiens
ucaagcuccugaaaugugu

SEQ ID NO: 889368 - RNA, 19 nt, Homo sapiens
gaccacaucgcucacauag

SEQ ID NO: 889369 - RNA, 19 nt, Homo sapiens
gacucuggcuugagacuag

SEQ ID NO: 889370 - RNA, 19 nt, Homo sapiens
cggagaaaguguguguauu

SEQ ID NO: 889371 - RNA, 19 nt, Homo sapiens
gaucucaggagucaaugga

SEQ ID NO: 889372 - RNA, 19 nt, Homo sapiens
uguguguauuccuuucuua

SEQ ID NO: 889373 - RNA, 19 nt, Homo sapiens
gaucaucaaguccaacuac

SEQ ID NO: 889374 - RNA, 19 nt, Homo sapiens
cgacgacgaggaacaggaa

SEQ ID NO: 889375 - RNA, 19 nt, Homo sapiens
gaucaagcuccugaaaugu

SEQ ID NO: 889376 - RNA, 19 nt, Homo sapiens
gagaaaguguguguauucc

SEQ ID NO: 889377 - RNA, 19 nt, Homo sapiens
ugagaucaagcuccugaaa

SEQ ID NO: 889378 - RNA, 19 nt, Homo sapiens
gaugaggcgcaaacggaaa

SEQ ID NO: 889379 - RNA, 19 nt, Homo sapiens
gaucggcgacguguucaau

SEQ ID NO: 889380 - RNA, 19 nt, Homo sapiens
ggacaucaagcccgagaac

SEQ ID NO: 889381 - RNA, 19 nt, Homo sapiens
gagcguguucugccugaga

SEQ ID NO: 889382 - RNA, 19 nt, Homo sapiens
gcuaccacccugugaagau

SEQ ID NO: 889383 - RNA, 19 nt, Homo sapiens
gcuggccacuggugacuac

SEQ ID NO: 889384 - RNA, 19 nt, Homo sapiens
caccagcuccucaaaugga

SEQ ID NO: 889385 - RNA, 19 nt, Homo sapiens
cuccgugccuuaagggaaa

SEQ ID NO: 889386 - RNA, 19 nt, Homo sapiens
uagagcaggccacacaguu

SEQ ID NO: 889387 - RNA, 19 nt, Homo sapiens
gcuauucccgggaguucuu

SEQ ID NO: 889388 - RNA, 19 nt, Homo sapiens
ggacucuggcuugagacua

SEQ ID NO: 889389 - RNA, 19 nt, Homo sapiens
aacaagaggaagaagauga

SEQ ID NO: 889390 - RNA, 19 nt, Homo sapiens
cacaccaagugcaagauca

SEQ ID NO: 889391 - RNA, 19 nt, Homo sapiens
caggaucucaggagucaau

SEQ ID NO: 889392 - RNA, 19 nt, Homo sapiens
cggcacauccacaaucuca

SEQ ID NO: 889393 - RNA, 19 nt, Homo sapiens
guguguauuccuuucuuaa

SEQ ID NO: 889394 - RNA, 19 nt, Homo sapiens
cuaccacccugugaagauc

SEQ ID NO: 889395 - RNA, 19 nt, Homo sapiens
guguguguauuccuuucuu

SEQ ID NO: 889396 - RNA, 19 nt, Homo sapiens
caaccacagggcagagaga

SEQ ID NO: 889397 - RNA, 19 nt, Homo sapiens
caucaagcccgagaacauc

SEQ ID NO: 889398 - RNA, 19 nt, Homo sapiens
cggagacagcuguggauga

SEQ ID NO: 889399 - RNA, 19 nt, Homo sapiens
ucggagaaaguguguguau

SEQ ID NO: 889400 - RNA, 19 nt, Homo sapiens
gaagaagaugaggcgcaaa

SEQ ID NO: 889401 - RNA, 19 nt, Homo sapiens
gaccauuguccagcucauu

SEQ ID NO: 889402 - RNA, 19 nt, Homo sapiens
ccaaacagcuuuaucauga

SEQ ID NO: 889403 - RNA, 19 nt, Homo sapiens
gcagcuaucugauuggaaa

SEQ ID NO: 889404 - RNA, 19 nt, Homo sapiens
gaagaggucuaaauuacau

SEQ ID NO: 889405 - RNA, 19 nt, Homo sapiens
caacgaugcuagaagaauu

SEQ ID NO: 889406 - RNA, 19 nt, Homo sapiens
cagaagaggucuaaauuac

SEQ ID NO: 889407 - RNA, 19 nt, Homo sapiens
ucauagaccucgagaguga

SEQ ID NO: 889408 - RNA, 19 nt, Homo sapiens
ggaaaguauuguggugaua

SEQ ID NO: 889409 - RNA, 19 nt, Homo sapiens
gaucuauguucucucagua

SEQ ID NO: 889410 - RNA, 19 nt, Homo sapiens
uaagcaauguuaacaguga

SEQ ID NO: 889411 - RNA, 19 nt, Homo sapiens
gcagugcccucuccucaga

SEQ ID NO: 889412 - RNA, 19 nt, Homo sapiens
caaagaaucagcuuauaga

SEQ ID NO: 889413 - RNA, 19 nt, Homo sapiens
uuggaaaccugccgacuua

SEQ ID NO: 889414 - RNA, 19 nt, Homo sapiens
gaauugaguugugugaaga

SEQ ID NO: 889415 - RNA, 19 nt, Homo sapiens
ccaaauagcaaauguacuu

SEQ ID NO: 889416 - RNA, 19 nt, Homo sapiens
ucagaagaggucuaaauua

SEQ ID NO: 889417 - RNA, 19 nt, Homo sapiens
gauaacuacugccgauaug

SEQ ID NO: 889418 - RNA, 19 nt, Homo sapiens
aaagaucuauguucucuca

SEQ ID NO: 889419 - RNA, 19 nt, Homo sapiens
cuagaagaauuggaaagua

SEQ ID NO: 889420 - RNA, 19 nt, Homo sapiens
uagcaaauguacuuggaaa

SEQ ID NO: 889421 - RNA, 19 nt, Homo sapiens
gaucaucaacaucuacaaa

SEQ ID NO: 889422 - RNA, 19 nt, Homo sapiens
guuuauuggucacuacaua

SEQ ID NO: 889423 - RNA, 19 nt, Homo sapiens
agugaacuguguccauuua

SEQ ID NO: 889424 - RNA, 19 nt, Homo sapiens
gcuaugacuuuguggaugu

SEQ ID NO: 889425 - RNA, 19 nt, Homo sapiens
uggagagucuggauuuauu

SEQ ID NO: 889426 - RNA, 19 nt, Homo sapiens
gcccugagguguuacaauc

SEQ ID NO: 889427 - RNA, 19 nt, Homo sapiens
gaagaauuggaaaguauug

SEQ ID NO: 889428 - RNA, 19 nt, Homo sapiens
ugaaagaucuauguucucu

SEQ ID NO: 889429 - RNA, 19 nt, Homo sapiens
guauuagccggcacuguua

SEQ ID NO: 889430 - RNA, 19 nt, Homo sapiens
gagcagcuaucugauugga

SEQ ID NO: 889431 - RNA, 19 nt, Homo sapiens
aaacagcuuuaucaugaug

SEQ ID NO: 889432 - RNA, 19 nt, Homo sapiens
gaggagcagcuaucugauu

SEQ ID NO: 889433 - RNA, 19 nt, Homo sapiens
gaguguacccuccaaauag

SEQ ID NO: 889434 - RNA, 19 nt, Homo sapiens
ucaucaacaucuacaaaga

SEQ ID NO: 889435 - RNA, 19 nt, Homo sapiens
ccaauugugucugagagaa

SEQ ID NO: 889436 - RNA, 19 nt, Homo sapiens
agucaacgaugcuagaaga

SEQ ID NO: 889437 - RNA, 19 nt, Homo sapiens
ggaagucaacgaugcuaga

SEQ ID NO: 889438 - RNA, 19 nt, Homo sapiens
gaaaccugccgacuuagug

SEQ ID NO: 889439 - RNA, 19 nt, Homo sapiens
uaagcuguauucugccauu

SEQ ID NO: 889440 - RNA, 19 nt, Homo sapiens
gcacuguuaucacaaccau

SEQ ID NO: 889441 - RNA, 19 nt, Homo sapiens
ccaaagaaucagcuuauag

SEQ ID NO: 889442 - RNA, 19 nt, Homo sapiens
uggaagcguuuauuuauac

SEQ ID NO: 889443 - RNA, 19 nt, Homo sapiens
cccaaagaaucagcuuaua

SEQ ID NO: 889444 - RNA, 19 nt, Homo sapiens
caaacagcuuuaucaugau

SEQ ID NO: 889445 - RNA, 19 nt, Homo sapiens
ggacucuggagggcaauua

SEQ ID NO: 889446 - RNA, 19 nt, Homo sapiens
ggaagcguuuauuuauaca

SEQ ID NO: 889447 - RNA, 19 nt, Homo sapiens
aggagcagcuaucugauug

SEQ ID NO: 889448 - RNA, 19 nt, Homo sapiens
gaaaguauuguggugauag

SEQ ID NO: 889449 - RNA, 19 nt, Homo sapiens
aaaguagucguucucaauu

SEQ ID NO: 889450 - RNA, 19 nt, Homo sapiens
aaucacaguucccgaagga

SEQ ID NO: 889451 - RNA, 19 nt, Homo sapiens
gaugcuagaagaauuggaa

SEQ ID NO: 889452 - RNA, 19 nt, Homo sapiens
gaagucaacgaugcuagaa

SEQ ID NO: 889453 - RNA, 19 nt, Homo sapiens
gaaagaugggacugguuga

SEQ ID NO: 889454 - RNA, 19 nt, Homo sapiens
gaagcuccuggaugccuua

SEQ ID NO: 889455 - RNA, 19 nt, Homo sapiens
gagggaaauuuggcgauuc

SEQ ID NO: 889456 - RNA, 19 nt, Homo sapiens
gcaggagucacuugugugu

SEQ ID NO: 889457 - RNA, 19 nt, Homo sapiens
agaauugaguugugugaag

SEQ ID NO: 889458 - RNA, 19 nt, Homo sapiens
ggagagucuggauuuauug

SEQ ID NO: 889459 - RNA, 19 nt, Homo sapiens
aaguagucguucucaauuu

SEQ ID NO: 889460 - RNA, 19 nt, Homo sapiens
ccuuugcccugagguguua

SEQ ID NO: 889461 - RNA, 19 nt, Homo sapiens
gguugacucuucacaugau

SEQ ID NO: 889462 - RNA, 19 nt, Homo sapiens
gaaaaguagucguucucaa

SEQ ID NO: 889463 - RNA, 19 nt, Homo sapiens
guucucaauuuccgauuca

SEQ ID NO: 889464 - RNA, 19 nt, Homo sapiens
ggaaaccugccgacuuagu

SEQ ID NO: 889465 - RNA, 19 nt, Homo sapiens
aauagcaaauguacuugga

SEQ ID NO: 889466 - RNA, 19 nt, Homo sapiens
gacaaccugugccgcuaug

SEQ ID NO: 889467 - RNA, 19 nt, Homo sapiens
gcuccuggaugccuuaaaa

SEQ ID NO: 889468 - RNA, 19 nt, Homo sapiens
gccaaacagcuuuaucaug

SEQ ID NO: 889469 - RNA, 19 nt, Homo sapiens
uguauuagccggcacuguu

SEQ ID NO: 889470 - RNA, 19 nt, Homo sapiens
gaacuguguccauuuaagc

SEQ ID NO: 889471 - RNA, 19 nt, Homo sapiens
ugaacuguguccauuuaag

SEQ ID NO: 889472 - RNA, 19 nt, Homo sapiens
agagggaaauuuggcgauu

SEQ ID NO: 889473 - RNA, 19 nt, Homo sapiens
gagauaacuacugccgaua

SEQ ID NO: 889474 - RNA, 19 nt, Homo sapiens
ccugagguguuacaaucuu

SEQ ID NO: 889475 - RNA, 19 nt, Homo sapiens
cuuggaagcguuuauuuau

SEQ ID NO: 889476 - RNA, 19 nt, Homo sapiens
gauuauguggcuguguuua

SEQ ID NO: 889477 - RNA, 19 nt, Homo sapiens
uaacuacugccgauaugau

SEQ ID NO: 889478 - RNA, 19 nt, Homo sapiens
acaagaugauggugcagau

SEQ ID NO: 889479 - RNA, 19 nt, Homo sapiens
gggacugguugacucuuca

SEQ ID NO: 889480 - RNA, 19 nt, Homo sapiens
gcuagaagaauuggaaagu

SEQ ID NO: 889481 - RNA, 19 nt, Homo sapiens
guuauuuguuucaccuuca

SEQ ID NO: 889482 - RNA, 19 nt, Homo sapiens
uuucacaugugguggcauu

SEQ ID NO: 889483 - RNA, 19 nt, Homo sapiens
ugaguugugugaagauguc

SEQ ID NO: 889484 - RNA, 19 nt, Homo sapiens
cugguugacucuucacaug

SEQ ID NO: 889485 - RNA, 19 nt, Homo sapiens
uuauguggcuguguuuaau

SEQ ID NO: 889486 - RNA, 19 nt, Homo sapiens
aguagucguucucaauuuc

SEQ ID NO: 889487 - RNA, 19 nt, Homo sapiens
acuggagagucuggauuua

SEQ ID NO: 889488 - RNA, 19 nt, Homo sapiens
gaagaugggcgaggcaaaa

SEQ ID NO: 889489 - RNA, 19 nt, Homo sapiens
aaaguauuguggugauagu

SEQ ID NO: 889490 - RNA, 19 nt, Homo sapiens
agagagaccuguuuucaca

SEQ ID NO: 889491 - RNA, 19 nt, Homo sapiens
cugcaggagucacuugugu

SEQ ID NO: 889492 - RNA, 19 nt, Homo sapiens
cgaaagaggggaucaguau

SEQ ID NO: 889493 - RNA, 19 nt, Homo sapiens
gaugauggugcagaugauu

SEQ ID NO: 889494 - RNA, 19 nt, Homo sapiens
caaauagcaaauguacuug

SEQ ID NO: 889495 - RNA, 19 nt, Homo sapiens
gcggugauaggaagcuaaa

SEQ ID NO: 889496 - RNA, 19 nt, Homo sapiens
ucaagaccaagaaucagaa

SEQ ID NO: 889497 - RNA, 19 nt, Homo sapiens
caauugugucugagagaaa

SEQ ID NO: 889498 - RNA, 19 nt, Homo sapiens
uggaaaguauuguggugau

SEQ ID NO: 889499 - RNA, 19 nt, Homo sapiens
gcaaauguacuuggaaaau

SEQ ID NO: 889500 - RNA, 19 nt, Homo sapiens
caaauguacuuggaaaauc

SEQ ID NO: 889501 - RNA, 19 nt, Homo sapiens
aaucaugccaaacagcuuu

SEQ ID NO: 889502 - RNA, 19 nt, Homo sapiens
guaagugacuggauucuug

SEQ ID NO: 889503 - RNA, 19 nt, Homo sapiens
gcacuguguuugaguagaa

SEQ ID NO: 889504 - RNA, 19 nt, Homo sapiens
gaacuccagaugaauuaua

SEQ ID NO: 889505 - RNA, 19 nt, Homo sapiens
gaguagaacguguaaauga

SEQ ID NO: 889506 - RNA, 19 nt, Homo sapiens
ccagaugaauuauacuuug

SEQ ID NO: 889507 - RNA, 19 nt, Homo sapiens
gaacugaaccagcagaaca

SEQ ID NO: 889508 - RNA, 19 nt, Homo sapiens
gaacagacuuaagaaacau

SEQ ID NO: 889509 - RNA, 19 nt, Homo sapiens
caaaguagaacaagaagau

SEQ ID NO: 889510 - RNA, 19 nt, Homo sapiens
cagaacaaguugggagaua

SEQ ID NO: 889511 - RNA, 19 nt, Homo sapiens
ucagagcccuguauacguu

SEQ ID NO: 889512 - RNA, 19 nt, Homo sapiens
gaaaaguguugguaacuau

SEQ ID NO: 889513 - RNA, 19 nt, Homo sapiens
aggcaggacuggacuaauu

SEQ ID NO: 889514 - RNA, 19 nt, Homo sapiens
agaugcaguucgaacauua

SEQ ID NO: 889515 - RNA, 19 nt, Homo sapiens
gcagauaucguccaguugu

SEQ ID NO: 889516 - RNA, 19 nt, Homo sapiens
gaaggguuaugcagauauc

SEQ ID NO: 889517 - RNA, 19 nt, Homo sapiens
gacaugagcgauaccaauu

SEQ ID NO: 889518 - RNA, 19 nt, Homo sapiens
ggugagggagggcaaguua

SEQ ID NO: 889519 - RNA, 19 nt, Homo sapiens
guuaauggcuuagacaaag

SEQ ID NO: 889520 - RNA, 19 nt, Homo sapiens
agaacagacuuaagaaaca

SEQ ID NO: 889521 - RNA, 19 nt, Homo sapiens
cagaacuccagaugaauua

SEQ ID NO: 889522 - RNA, 19 nt, Homo sapiens
ccagaacuccagaugaauu

SEQ ID NO: 889523 - RNA, 19 nt, Homo sapiens
gaacccagaacuccagaug

SEQ ID NO: 889524 - RNA, 19 nt, Homo sapiens
ucaccaaaguagaacaaga

SEQ ID NO: 889525 - RNA, 19 nt, Homo sapiens
uggaagcacugccuuauac

SEQ ID NO: 889526 - RNA, 19 nt, Homo sapiens
cgacauggcuaccaaugcu

SEQ ID NO: 889527 - RNA, 19 nt, Homo sapiens
gaacaaguugggagauaca

SEQ ID NO: 889528 - RNA, 19 nt, Homo sapiens
aguagaacguguaaaugaa

SEQ ID NO: 889529 - RNA, 19 nt, Homo sapiens
ggaaaggcaccuccaaagg

SEQ ID NO: 889530 - RNA, 19 nt, Homo sapiens
acccagaacuccagaugaa

SEQ ID NO: 889531 - RNA, 19 nt, Homo sapiens
guugggagauacagcuuug

SEQ ID NO: 889532 - RNA, 19 nt, Homo sapiens
gagggcaaguuaaagucuu

SEQ ID NO: 889533 - RNA, 19 nt, Homo sapiens
cagaugcaguucgaacauu

SEQ ID NO: 889534 - RNA, 19 nt, Homo sapiens
ggaaggguuaugcagauau

SEQ ID NO: 889535 - RNA, 19 nt, Homo sapiens
ugaaccagcagaacaaguu

SEQ ID NO: 889536 - RNA, 19 nt, Homo sapiens
caccaaaguagaacaagaa

SEQ ID NO: 889537 - RNA, 19 nt, Homo sapiens
ugagggagggcaaguuaaa

SEQ ID NO: 889538 - RNA, 19 nt, Homo sapiens
gcaguucgaacauuaagca

SEQ ID NO: 889539 - RNA, 19 nt, Homo sapiens
gcuagaacagacuuaagaa

SEQ ID NO: 889540 - RNA, 19 nt, Homo sapiens
gaaccagcagaacaaguug

SEQ ID NO: 889541 - RNA, 19 nt, Homo sapiens
guagaacguguaaaugaau

SEQ ID NO: 889542 - RNA, 19 nt, Homo sapiens
guugcacuguguuugagua

SEQ ID NO: 889543 - RNA, 19 nt, Homo sapiens
gcaaguuaaagucuucaga

SEQ ID NO: 889544 - RNA, 19 nt, Homo sapiens
ggacuaauuccaagcaacu

SEQ ID NO: 889545 - RNA, 19 nt, Homo sapiens
cagauaucguccaguuguu

SEQ ID NO: 889546 - RNA, 19 nt, Homo sapiens
gagcaggcagaauccauug

SEQ ID NO: 889547 - RNA, 19 nt, Homo sapiens
augcagauaucguccaguu

SEQ ID NO: 889548 - RNA, 19 nt, Homo sapiens
uggaaggguuaugcagaua

SEQ ID NO: 889549 - RNA, 19 nt, Homo sapiens
gaagcacugccuuauacug

SEQ ID NO: 889550 - RNA, 19 nt, Homo sapiens
caugagcgauaccaauugg

SEQ ID NO: 889551 - RNA, 19 nt, Homo sapiens
gcaaugccgaggacuaucu

SEQ ID NO: 889552 - RNA, 19 nt, Homo sapiens
uaagcaaugccgaggacua

SEQ ID NO: 889553 - RNA, 19 nt, Homo sapiens
gaugcaguucgaacauuaa

SEQ ID NO: 889554 - RNA, 19 nt, Homo sapiens
cuagaacagacuuaagaaa

SEQ ID NO: 889555 - RNA, 19 nt, Homo sapiens
gaacguguaaaugaauugu

SEQ ID NO: 889556 - RNA, 19 nt, Homo sapiens
gcuuugagaucuaaaacuu

SEQ ID NO: 889557 - RNA, 19 nt, Homo sapiens
ggcaaaaggugcuagaaca

SEQ ID NO: 889558 - RNA, 19 nt, Homo sapiens
gaauuguucccaccuuugg

SEQ ID NO: 889559 - RNA, 19 nt, Homo sapiens
ugacaugagcgauaccaau

SEQ ID NO: 889560 - RNA, 19 nt, Homo sapiens
caccuuugguuugccagua

SEQ ID NO: 889561 - RNA, 19 nt, Homo sapiens
aaagaaacagggaacagau

SEQ ID NO: 889562 - RNA, 19 nt, Homo sapiens
caaccaaauauugaacuga

SEQ ID NO: 889563 - RNA, 19 nt, Homo sapiens
gagagaguguuuggacaac

SEQ ID NO: 889564 - RNA, 19 nt, Homo sapiens
uagaacagacuuaagaaac

SEQ ID NO: 889565 - RNA, 19 nt, Homo sapiens
gauaucguccaguuguuuc

SEQ ID NO: 889566 - RNA, 19 nt, Homo sapiens
agauauaguggaaaugcua

SEQ ID NO: 889567 - RNA, 19 nt, Homo sapiens
ugagagaguguuuggacaa

SEQ ID NO: 889568 - RNA, 19 nt, Homo sapiens
uaucuacauuacugacaug

SEQ ID NO: 889569 - RNA, 19 nt, Homo sapiens
guugagauauuuugaaugg

SEQ ID NO: 889570 - RNA, 19 nt, Homo sapiens
acagggaacagaugcaguu

SEQ ID NO: 889571 - RNA, 19 nt, Homo sapiens
caaaggcaggacuggacua

SEQ ID NO: 889572 - RNA, 19 nt, Homo sapiens
cugugcaucucuccugaaa

SEQ ID NO: 889573 - RNA, 19 nt, Homo sapiens
gaggcaacuugagcugguu

SEQ ID NO: 889574 - RNA, 19 nt, Homo sapiens
uuacugacaugagcgauac

SEQ ID NO: 889575 - RNA, 19 nt, Homo sapiens
acguguaaaugaauuguuc

SEQ ID NO: 889576 - RNA, 19 nt, Homo sapiens
agaaaaguguugguaacua

SEQ ID NO: 889577 - RNA, 19 nt, Homo sapiens
cuggaaggguuaugcagau

SEQ ID NO: 889578 - RNA, 19 nt, Homo sapiens
gcuggaagcacugccuuau

SEQ ID NO: 889579 - RNA, 19 nt, Homo sapiens
gaaacagggaacagaugca

SEQ ID NO: 889580 - RNA, 19 nt, Homo sapiens
ugaauuguucccaccuuug

SEQ ID NO: 889581 - RNA, 19 nt, Homo sapiens
ggagggcaaguuaaagucu

SEQ ID NO: 889582 - RNA, 19 nt, Homo sapiens
ggauuugcagcuccaggaa

SEQ ID NO: 889583 - RNA, 19 nt, Homo sapiens
gacuuaagaaacauugaga

SEQ ID NO: 889584 - RNA, 19 nt, Homo sapiens
cuggaagcacugccuuaua

SEQ ID NO: 889585 - RNA, 19 nt, Homo sapiens
aaaggcaggacuggacuaa

SEQ ID NO: 889586 - RNA, 19 nt, Homo sapiens
augaauuguucccaccuuu

SEQ ID NO: 889587 - RNA, 19 nt, Homo sapiens
ugagcaggcagaauccauu

SEQ ID NO: 889588 - RNA, 19 nt, Homo sapiens
cuggauucuuggcacauuu

SEQ ID NO: 889589 - RNA, 19 nt, Homo sapiens
uugaguagaacguguaaau

SEQ ID NO: 889590 - RNA, 19 nt, Homo sapiens
ggugcuagaacagacuuaa

SEQ ID NO: 889591 - RNA, 19 nt, Homo sapiens
agaacaaguugggagauac

SEQ ID NO: 889592 - RNA, 19 nt, Homo sapiens
ccaaaguagaacaagaaga

SEQ ID NO: 889593 - RNA, 19 nt, Homo sapiens
cuggagcuuugagaucuaa

SEQ ID NO: 889594 - RNA, 19 nt, Homo sapiens
acagaaaauugucagcuau

SEQ ID NO: 889595 - RNA, 19 nt, Homo sapiens
aaugaauuguucccaccuu

SEQ ID NO: 889596 - RNA, 19 nt, Homo sapiens
ugaguagaacguguaaaug

SEQ ID NO: 889597 - RNA, 19 nt, Homo sapiens
ucuggagcuuugagaucua

SEQ ID NO: 889598 - RNA, 19 nt, Homo sapiens
uggcugagcaggcagaauc

SEQ ID NO: 889599 - RNA, 19 nt, Homo sapiens
gcagaacaaguugggagau

SEQ ID NO: 889600 - RNA, 19 nt, Homo sapiens
caggcagaauccauugaca

SEQ ID NO: 889601 - RNA, 19 nt, Homo sapiens
ggcaggacuggacuaauuc

SEQ ID NO: 889602 - RNA, 19 nt, Homo sapiens
uagagaagcucaacaaguu

SEQ ID NO: 889603 - RNA, 19 nt, Homo sapiens
gaaauuaugugggcgcaaa

SEQ ID NO: 889604 - RNA, 19 nt, Homo sapiens
gcugaugucugauuuauuc

SEQ ID NO: 889605 - RNA, 19 nt, Homo sapiens
gaacccacaucccuacaaa

SEQ ID NO: 889606 - RNA, 19 nt, Homo sapiens
ccaguaaccucuucucuug

SEQ ID NO: 889607 - RNA, 19 nt, Homo sapiens
guacaggcauggagaguga

SEQ ID NO: 889608 - RNA, 19 nt, Homo sapiens
gagcugcccugacuaugaa

SEQ ID NO: 889609 - RNA, 19 nt, Homo sapiens
ugaagagucuggaguuuau

SEQ ID NO: 889610 - RNA, 19 nt, Homo sapiens
cuacaaagcaggaaaguau

SEQ ID NO: 889611 - RNA, 19 nt, Homo sapiens
gcugagcucugugugauuu

SEQ ID NO: 889612 - RNA, 19 nt, Homo sapiens
uaacaccucuaacaacuuc

SEQ ID NO: 889613 - RNA, 19 nt, Homo sapiens
uaacagaugaggaaacuga

SEQ ID NO: 889614 - RNA, 19 nt, Homo sapiens
ggucacagaugcaccacaa

SEQ ID NO: 889615 - RNA, 19 nt, Homo sapiens
caggaaaguucaucucaga

SEQ ID NO: 889616 - RNA, 19 nt, Homo sapiens
gaaucgagcugcccugacu

SEQ ID NO: 889617 - RNA, 19 nt, Homo sapiens
gcaggccggauguaaguua

SEQ ID NO: 889618 - RNA, 19 nt, Homo sapiens
ccacuuaacagaugaggaa

SEQ ID NO: 889619 - RNA, 19 nt, Homo sapiens
ggacccuguuucucucuuu

SEQ ID NO: 889620 - RNA, 19 nt, Homo sapiens
cccaaccaauucaguauuu

SEQ ID NO: 889621 - RNA, 19 nt, Homo sapiens
gcaugacccuggcagaauc

SEQ ID NO: 889622 - RNA, 19 nt, Homo sapiens
gagaggagcauuugugucu

SEQ ID NO: 889623 - RNA, 19 nt, Homo sapiens
gcuuucaccagccauauua

SEQ ID NO: 889624 - RNA, 19 nt, Homo sapiens
gcauggcccucccaaccaa

SEQ ID NO: 889625 - RNA, 19 nt, Homo sapiens
gcucauggcccucagaauc

SEQ ID NO: 889626 - RNA, 19 nt, Homo sapiens
gcucucagucaccacauua

SEQ ID NO: 889627 - RNA, 19 nt, Homo sapiens
uccaugagguagcuacuaa

SEQ ID NO: 889628 - RNA, 19 nt, Homo sapiens
gguccuggcugacuguugu

SEQ ID NO: 889629 - RNA, 19 nt, Homo sapiens
gugaagagucuggaguuua

SEQ ID NO: 889630 - RNA, 19 nt, Homo sapiens
agacaagggugcccagaca

SEQ ID NO: 889631 - RNA, 19 nt, Homo sapiens
gagcaggccggauguaagu

SEQ ID NO: 889632 - RNA, 19 nt, Homo sapiens
gaaacugaggccuagagaa

SEQ ID NO: 889633 - RNA, 19 nt, Homo sapiens
ugaaaugcauccagacacu

SEQ ID NO: 889634 - RNA, 19 nt, Homo sapiens
aaacugaggccuagagaag

SEQ ID NO: 889635 - RNA, 19 nt, Homo sapiens
ugacuguugugacuguuga

SEQ ID NO: 889636 - RNA, 19 nt, Homo sapiens
gcacugggaacaggaauuc

SEQ ID NO: 889637 - RNA, 19 nt, Homo sapiens
caaguugccuaaguuccaa

SEQ ID NO: 889638 - RNA, 19 nt, Homo sapiens
gaggagcauuugugucucu

SEQ ID NO: 889639 - RNA, 19 nt, Homo sapiens
uucccuaacuagacaauuu

SEQ ID NO: 889640 - RNA, 19 nt, Homo sapiens
uugccuaaguuccaaguuu

SEQ ID NO: 889641 - RNA, 19 nt, Homo sapiens
agaaugacuccaugaggua

SEQ ID NO: 889642 - RNA, 19 nt, Homo sapiens
gggacucguugcucauguu

SEQ ID NO: 889643 - RNA, 19 nt, Homo sapiens
ucuaaggcgucagaaugua

SEQ ID NO: 889644 - RNA, 19 nt, Homo sapiens
uauaugcccagccucauuu

SEQ ID NO: 889645 - RNA, 19 nt, Homo sapiens
cgagcugcccugacuauga

SEQ ID NO: 889646 - RNA, 19 nt, Homo sapiens
ccuguacugucuuucugua

SEQ ID NO: 889647 - RNA, 19 nt, Homo sapiens
ggaaacugaggccuagaga

SEQ ID NO: 889648 - RNA, 19 nt, Homo sapiens
gaaugccaccugcugaugu

SEQ ID NO: 889649 - RNA, 19 nt, Homo sapiens
aaucuaaggcgucagaaug

SEQ ID NO: 889650 - RNA, 19 nt, Homo sapiens
ggaagcguguugcaaucca

SEQ ID NO: 889651 - RNA, 19 nt, Homo sapiens
guucaucucagacccuaaa

SEQ ID NO: 889652 - RNA, 19 nt, Homo sapiens
ggccggauguaaguuauca

SEQ ID NO: 889653 - RNA, 19 nt, Homo sapiens
ggugagaggagcauuugug

SEQ ID NO: 889654 - RNA, 19 nt, Homo sapiens
uuucuugucuguagucugu

SEQ ID NO: 889655 - RNA, 19 nt, Homo sapiens
cuguuucucucuuugcuuu

SEQ ID NO: 889656 - RNA, 19 nt, Homo sapiens
cuaaggcgucagaauguaa

SEQ ID NO: 889657 - RNA, 19 nt, Homo sapiens
gccaccugcugaugucuga

SEQ ID NO: 889658 - RNA, 19 nt, Homo sapiens
caacuuccccuggcacuua

SEQ ID NO: 889659 - RNA, 19 nt, Homo sapiens
cuuaacaccucuaacaacu

SEQ ID NO: 889660 - RNA, 19 nt, Homo sapiens
gacccuguuucucucuuug

SEQ ID NO: 889661 - RNA, 19 nt, Homo sapiens
uguacugucuuucuguaga

SEQ ID NO: 889662 - RNA, 19 nt, Homo sapiens
gaagcguguugcaauccau

SEQ ID NO: 889663 - RNA, 19 nt, Homo sapiens
gagaaacaagggagacaag

SEQ ID NO: 889664 - RNA, 19 nt, Homo sapiens
ccacgucaugccacgcuua

SEQ ID NO: 889665 - RNA, 19 nt, Homo sapiens
ccucuucccuaacuagaca

SEQ ID NO: 889666 - RNA, 19 nt, Homo sapiens
cugcugaugucugauuuau

SEQ ID NO: 889667 - RNA, 19 nt, Homo sapiens
gggaggacacgcaaguuca

SEQ ID NO: 889668 - RNA, 19 nt, Homo sapiens
ucaucauccucacuuguug

SEQ ID NO: 889669 - RNA, 19 nt, Homo sapiens
gggcucuccauggaaauua

SEQ ID NO: 889670 - RNA, 19 nt, Homo sapiens
ggacagcgucuggcuccuu

SEQ ID NO: 889671 - RNA, 19 nt, Homo sapiens
cacauuagcucagggguuu

SEQ ID NO: 889672 - RNA, 19 nt, Homo sapiens
cuagagaagcucaacaagu

SEQ ID NO: 889673 - RNA, 19 nt, Homo sapiens
aaccaagacuuccguucug

SEQ ID NO: 889674 - RNA, 19 nt, Homo sapiens
ggagcaggccggauguaag

SEQ ID NO: 889675 - RNA, 19 nt, Homo sapiens
cagggaagcguguugcaau

SEQ ID NO: 889676 - RNA, 19 nt, Homo sapiens
ugugccaagugguuuauau

SEQ ID NO: 889677 - RNA, 19 nt, Homo sapiens
uaaauccagccacgucaug

SEQ ID NO: 889678 - RNA, 19 nt, Homo sapiens
agugaagagucuggaguuu

SEQ ID NO: 889679 - RNA, 19 nt, Homo sapiens
agaaaucuaaggcgucaga

SEQ ID NO: 889680 - RNA, 19 nt, Homo sapiens
caugauaacccagcuccuu

SEQ ID NO: 889681 - RNA, 19 nt, Homo sapiens
ugccuaaguuccaaguuuc

SEQ ID NO: 889682 - RNA, 19 nt, Homo sapiens
gcguugagcaggccauuag

SEQ ID NO: 889683 - RNA, 19 nt, Homo sapiens
gaaucugcgucacauacac

SEQ ID NO: 889684 - RNA, 19 nt, Homo sapiens
gccaggagggucacagaug

SEQ ID NO: 889685 - RNA, 19 nt, Homo sapiens
aaaccaagacuuccguucu

SEQ ID NO: 889686 - RNA, 19 nt, Homo sapiens
gcaccacaaggcacucugu

SEQ ID NO: 889687 - RNA, 19 nt, Homo sapiens
ccuuugggcucagugaaga

SEQ ID NO: 889688 - RNA, 19 nt, Homo sapiens
ugaggcgccuguacugucu

SEQ ID NO: 889689 - RNA, 19 nt, Homo sapiens
gguagccccuggagacauu

SEQ ID NO: 889690 - RNA, 19 nt, Homo sapiens
gccuagagaagcucaacaa

SEQ ID NO: 889691 - RNA, 19 nt, Homo sapiens
ucaccugggagaagccuuu

SEQ ID NO: 889692 - RNA, 19 nt, Homo sapiens
cgucaugccacgcuuaaca

SEQ ID NO: 889693 - RNA, 19 nt, Homo sapiens
caggccggauguaaguuau

SEQ ID NO: 889694 - RNA, 19 nt, Homo sapiens
cugcugagcucugugugau

SEQ ID NO: 889695 - RNA, 19 nt, Homo sapiens
cuuaacagaugaggaaacu

SEQ ID NO: 889696 - RNA, 19 nt, Homo sapiens
gcggugagaggagcauuug

SEQ ID NO: 889697 - RNA, 19 nt, Homo sapiens
ucucuugggugggugaaug

SEQ ID NO: 889698 - RNA, 19 nt, Homo sapiens
ggagagugaggcgccugua

SEQ ID NO: 889699 - RNA, 19 nt, Homo sapiens
cuccuacccucuccucuuc

SEQ ID NO: 889700 - RNA, 19 nt, Homo sapiens
gagagaaacaagggagaca

SEQ ID NO: 889701 - RNA, 19 nt, Homo sapiens
ggacucguugcucauguuc

SEQ ID NO: 889702 - RNA, 19 nt, Homo sapiens
ggacagccguaucguguua

SEQ ID NO: 889703 - RNA, 19 nt, Homo sapiens
ucagauaccugcuauacaa

SEQ ID NO: 889704 - RNA, 19 nt, Homo sapiens
gcagaucuauugcuugaug

SEQ ID NO: 889705 - RNA, 19 nt, Homo sapiens
gcucagaccugcuccagau

SEQ ID NO: 889706 - RNA, 19 nt, Homo sapiens
ucaggaagaugucuacaga

SEQ ID NO: 889707 - RNA, 19 nt, Homo sapiens
gcacuucacugggcucaga

SEQ ID NO: 889708 - RNA, 19 nt, Homo sapiens
gccaaugucucgcugacua

SEQ ID NO: 889709 - RNA, 19 nt, Homo sapiens
cgaaucaucuccacuucuu

SEQ ID NO: 889710 - RNA, 19 nt, Homo sapiens
gcaagcgcauccagcugua

SEQ ID NO: 889711 - RNA, 19 nt, Homo sapiens
cuauacaacuucccgauga

SEQ ID NO: 889712 - RNA, 19 nt, Homo sapiens
ucaaaggaccggacaaaga

SEQ ID NO: 889713 - RNA, 19 nt, Homo sapiens
aggaagaugucuacagaaa

SEQ ID NO: 889714 - RNA, 19 nt, Homo sapiens
uggcagaucuauugcuuga

SEQ ID NO: 889715 - RNA, 19 nt, Homo sapiens
cgaaggaucucugcucauc

SEQ ID NO: 889716 - RNA, 19 nt, Homo sapiens
gaucaaaggaccggacaaa

SEQ ID NO: 889717 - RNA, 19 nt, Homo sapiens
gaagaugucuacagaaaag

SEQ ID NO: 889718 - RNA, 19 nt, Homo sapiens
cgacaccgcuucucuuugc

SEQ ID NO: 889719 - RNA, 19 nt, Homo sapiens
ugucuagccugcauugauu

SEQ ID NO: 889720 - RNA, 19 nt, Homo sapiens
gugaucgggugcugaugua

SEQ ID NO: 889721 - RNA, 19 nt, Homo sapiens
ggguauggcagaucuauug

SEQ ID NO: 889722 - RNA, 19 nt, Homo sapiens
ucauugagauccacagcaa

SEQ ID NO: 889723 - RNA, 19 nt, Homo sapiens
gggcucagauaccugcuau

SEQ ID NO: 889724 - RNA, 19 nt, Homo sapiens
cagaaaagguagaccaaaa

SEQ ID NO: 889725 - RNA, 19 nt, Homo sapiens
ggaacucuacgcagacuau

SEQ ID NO: 889726 - RNA, 19 nt, Homo sapiens
caaaggaccggacaaagag

SEQ ID NO: 889727 - RNA, 19 nt, Homo sapiens
gauaccugcuauacaacuu

SEQ ID NO: 889728 - RNA, 19 nt, Homo sapiens
cuggaugacuuuauucuuc

SEQ ID NO: 889729 - RNA, 19 nt, Homo sapiens
caacgacccuccaguaccu

SEQ ID NO: 889730 - RNA, 19 nt, Homo sapiens
ccacuggagcgaucauuga

SEQ ID NO: 889731 - RNA, 19 nt, Homo sapiens
gccguaucguguuaccuua

SEQ ID NO: 889732 - RNA, 19 nt, Homo sapiens
aacagaggcucgucaggaa

SEQ ID NO: 889733 - RNA, 19 nt, Homo sapiens
gaacucuacgcagacuaua

SEQ ID NO: 889734 - RNA, 19 nt, Homo sapiens
gcucuucgcagccucuuga

SEQ ID NO: 889735 - RNA, 19 nt, Homo sapiens
ggacaaagaggaggaacca

SEQ ID NO: 889736 - RNA, 19 nt, Homo sapiens
uauggcagaucuauugcuu

SEQ ID NO: 889737 - RNA, 19 nt, Homo sapiens
gaucgccacuucacguuuu

SEQ ID NO: 889738 - RNA, 19 nt, Homo sapiens
gggcagacuccucacauuc

SEQ ID NO: 889739 - RNA, 19 nt, Homo sapiens
ggugagagcccugaagauc

SEQ ID NO: 889740 - RNA, 19 nt, Homo sapiens
gagcggagaagaggagcua

SEQ ID NO: 889741 - RNA, 19 nt, Homo sapiens
ccucagcccugugcauuuc

SEQ ID NO: 889742 - RNA, 19 nt, Homo sapiens
ggaugacuuuauucuucaa

SEQ ID NO: 889743 - RNA, 19 nt, Homo sapiens
gcagacuccucacauucca

SEQ ID NO: 889744 - RNA, 19 nt, Homo sapiens
cugggaagaugcagcuuug

SEQ ID NO: 889745 - RNA, 19 nt, Homo sapiens
gaguuccucugcuguacga

SEQ ID NO: 889746 - RNA, 19 nt, Homo sapiens
acacacuggucuucucuag

SEQ ID NO: 889747 - RNA, 19 nt, Homo sapiens
cuucuacuauuccuauaug

SEQ ID NO: 889748 - RNA, 19 nt, Homo sapiens
gagcgucuuuuguacuuaa

SEQ ID NO: 889749 - RNA, 19 nt, Homo sapiens
gcucagauaccugcuauac

SEQ ID NO: 889750 - RNA, 19 nt, Homo sapiens
guccugaggcucuggauga

SEQ ID NO: 889751 - RNA, 19 nt, Homo sapiens
caacuccgcaaucagaugu

SEQ ID NO: 889752 - RNA, 19 nt, Homo sapiens
ucaucgugcucuucagcua

SEQ ID NO: 889753 - RNA, 19 nt, Homo sapiens
gcccugugcauuucuacua

SEQ ID NO: 889754 - RNA, 19 nt, Homo sapiens
uggaugacuuuauucuuca

SEQ ID NO: 889755 - RNA, 19 nt, Homo sapiens
ccgcuucucuuugcagguu

SEQ ID NO: 889756 - RNA, 19 nt, Homo sapiens
gaucgggugcugauguaug

SEQ ID NO: 889757 - RNA, 19 nt, Homo sapiens
gugcggagaccagaucaaa

SEQ ID NO: 889758 - RNA, 19 nt, Homo sapiens
ggcucuggaugacuuuauu

SEQ ID NO: 889759 - RNA, 19 nt, Homo sapiens
gacgaugucuagccugcau

SEQ ID NO: 889760 - RNA, 19 nt, Homo sapiens
cguaucguguuaccuuaga

SEQ ID NO: 889761 - RNA, 19 nt, Homo sapiens
gaaggaucucugcucauca

SEQ ID NO: 889762 - RNA, 19 nt, Homo sapiens
gaaguccaacgaaggaucu

SEQ ID NO: 889763 - RNA, 19 nt, Homo sapiens
gacuaaggguggacgugau

SEQ ID NO: 889764 - RNA, 19 nt, Homo sapiens
ccaaugucucgcugacuaa

SEQ ID NO: 889765 - RNA, 19 nt, Homo sapiens
ccaccucacucugcuccuu

SEQ ID NO: 889766 - RNA, 19 nt, Homo sapiens
gcggagaccagaucaaagg

SEQ ID NO: 889767 - RNA, 19 nt, Homo sapiens
gggugucugucuuccucua

SEQ ID NO: 889768 - RNA, 19 nt, Homo sapiens
caagugacucaguggaaga

SEQ ID NO: 889769 - RNA, 19 nt, Homo sapiens
cagaucuauugcuugauga

SEQ ID NO: 889770 - RNA, 19 nt, Homo sapiens
acuccgcaaucagauguua

SEQ ID NO: 889771 - RNA, 19 nt, Homo sapiens
ccgaugaccugcgccuuca

SEQ ID NO: 889772 - RNA, 19 nt, Homo sapiens
ggacacacuggucuucucu

SEQ ID NO: 889773 - RNA, 19 nt, Homo sapiens
gccgaaucaucuccacuuc

SEQ ID NO: 889774 - RNA, 19 nt, Homo sapiens
uggcuucguugcacguuug

SEQ ID NO: 889775 - RNA, 19 nt, Homo sapiens
ggaucgccacuucacguuu

SEQ ID NO: 889776 - RNA, 19 nt, Homo sapiens
cugaggcucuggaugacuu

SEQ ID NO: 889777 - RNA, 19 nt, Homo sapiens
gagccuaccuccgcaucca

SEQ ID NO: 889778 - RNA, 19 nt, Homo sapiens
agucaacuccgcaaucaga

SEQ ID NO: 889779 - RNA, 19 nt, Homo sapiens
gcuucucuuugcagguuaa

SEQ ID NO: 889780 - RNA, 19 nt, Homo sapiens
ucacugggcucagauaccu

SEQ ID NO: 889781 - RNA, 19 nt, Homo sapiens
cuggagcgaucauugagau

SEQ ID NO: 889782 - RNA, 19 nt, Homo sapiens
ggccgaaucaucuccacuu

SEQ ID NO: 889783 - RNA, 19 nt, Homo sapiens
gauccuugacgaugucuag

SEQ ID NO: 889784 - RNA, 19 nt, Homo sapiens
uauggcuccuucuacuauu

SEQ ID NO: 889785 - RNA, 19 nt, Homo sapiens
cuauggcuccuucuacuau

SEQ ID NO: 889786 - RNA, 19 nt, Homo sapiens
cugcauugauuggcccuuu

SEQ ID NO: 889787 - RNA, 19 nt, Homo sapiens
cagaggcucgucaggaaga

SEQ ID NO: 889788 - RNA, 19 nt, Homo sapiens
gaagauccagagucaacag

SEQ ID NO: 889789 - RNA, 19 nt, Homo sapiens
gcgucuggaucgccacuuc

SEQ ID NO: 889790 - RNA, 19 nt, Homo sapiens
ucagcccugugcauuucua

SEQ ID NO: 889791 - RNA, 19 nt, Homo sapiens
gcggagaagaggagcuaga

SEQ ID NO: 889792 - RNA, 19 nt, Homo sapiens
ggaagaugucuacagaaaa

SEQ ID NO: 889793 - RNA, 19 nt, Homo sapiens
cacaagugacucaguggaa

SEQ ID NO: 889794 - RNA, 19 nt, Homo sapiens
agagguggccgaaucaucu

SEQ ID NO: 889795 - RNA, 19 nt, Homo sapiens
guugcacguuugugugugu

SEQ ID NO: 889796 - RNA, 19 nt, Homo sapiens
gacuuuauucuucaaaugg

SEQ ID NO: 889797 - RNA, 19 nt, Homo sapiens
ugaggccagugaugguuca

SEQ ID NO: 889798 - RNA, 19 nt, Homo sapiens
aaggaucucugcucaucag

SEQ ID NO: 889799 - RNA, 19 nt, Homo sapiens
gcucugggugucugucuuc

SEQ ID NO: 889800 - RNA, 19 nt, Homo sapiens
gaacgcaaggccugaaccu

SEQ ID NO: 889801 - RNA, 19 nt, Homo sapiens
ggaagauccagagucaaca

SEQ ID NO: 889802 - RNA, 19 nt, Homo sapiens
gggaagagcuggccagaga

SEQ ID NO: 889803 - RNA, 19 nt, Homo sapiens
gcaagcauccggugcaaug

SEQ ID NO: 889804 - RNA, 19 nt, Homo sapiens
gagagaucaugccaguuga

SEQ ID NO: 889805 - RNA, 19 nt, Homo sapiens
ggauucagaucugguuuca

SEQ ID NO: 889806 - RNA, 19 nt, Homo sapiens
ugagagaucaugccaguug

SEQ ID NO: 889807 - RNA, 19 nt, Homo sapiens
cagauuugguuucagaaug

SEQ ID NO: 889808 - RNA, 19 nt, Homo sapiens
agauuugguuucagaauga

SEQ ID NO: 889809 - RNA, 19 nt, Homo sapiens
gaagagcuggccagagaga

SEQ ID NO: 889810 - RNA, 19 nt, Homo sapiens
ggaccgggaaggcgaauga

SEQ ID NO: 889811 - RNA, 19 nt, Homo sapiens
guccagauuugguuucaga

SEQ ID NO: 889812 - RNA, 19 nt, Homo sapiens
gagcccaggguccagauuu

SEQ ID NO: 889813 - RNA, 19 nt, Homo sapiens
gcuuugagcggaaccugua

SEQ ID NO: 889814 - RNA, 19 nt, Homo sapiens
ugagaaggaucgcuuucca

SEQ ID NO: 889815 - RNA, 19 nt, Homo sapiens
gcauugccaccaaagaaga

SEQ ID NO: 889816 - RNA, 19 nt, Homo sapiens
ggaucgcuuuccaggcauu

SEQ ID NO: 889817 - RNA, 19 nt, Homo sapiens
cgaaagcggacugccauca

SEQ ID NO: 889818 - RNA, 19 nt, Homo sapiens
ccuccgagccuuugagaag

SEQ ID NO: 889819 - RNA, 19 nt, Homo sapiens
ggcgaaugauacuccuuuc

SEQ ID NO: 889820 - RNA, 19 nt, Homo sapiens
gccaucaccggaucccaaa

SEQ ID NO: 889821 - RNA, 19 nt, Homo sapiens
gaaagcggacugccaucac

SEQ ID NO: 889822 - RNA, 19 nt, Homo sapiens
gggaagagcuggccagaga

SEQ ID NO: 889823 - RNA, 19 nt, Homo sapiens
gcaagcauccggugcaaug

SEQ ID NO: 889824 - RNA, 19 nt, Homo sapiens
ggauucagcucugguuuca

SEQ ID NO: 889825 - RNA, 19 nt, Homo sapiens
gagagaucaugccaguuga

SEQ ID NO: 889826 - RNA, 19 nt, Homo sapiens
ugagagaucaugccaguug

SEQ ID NO: 889827 - RNA, 19 nt, Homo sapiens
cagauuugguuucagaaug

SEQ ID NO: 889828 - RNA, 19 nt, Homo sapiens
agauuugguuucagaauga

SEQ ID NO: 889829 - RNA, 19 nt, Homo sapiens
gaagagcuggccagagaga

SEQ ID NO: 889830 - RNA, 19 nt, Homo sapiens
ggaccgggaaggcgaauga

SEQ ID NO: 889831 - RNA, 19 nt, Homo sapiens
guccagauuugguuucaga

SEQ ID NO: 889832 - RNA, 19 nt, Homo sapiens
gagcccaggguccagauuu

SEQ ID NO: 889833 - RNA, 19 nt, Homo sapiens
gcuuugagcggaaccugua

SEQ ID NO: 889834 - RNA, 19 nt, Homo sapiens
ugagaaggaucgcuuucca

SEQ ID NO: 889835 - RNA, 19 nt, Homo sapiens
ggaucgcuuuccaggcauu

SEQ ID NO: 889836 - RNA, 19 nt, Homo sapiens
gcauugccaccaaagaaca

SEQ ID NO: 889837 - RNA, 19 nt, Homo sapiens
cgaaagcggacugccauca

SEQ ID NO: 889838 - RNA, 19 nt, Homo sapiens
ccuccgagccuuugagaag

SEQ ID NO: 889839 - RNA, 19 nt, Homo sapiens
ggcgaaugauacuccuuuc

SEQ ID NO: 889840 - RNA, 19 nt, Homo sapiens
gccaucaccggaucccaaa

SEQ ID NO: 889841 - RNA, 19 nt, Homo sapiens
gaaagcggacugccaucac

SEQ ID NO: 889842 - RNA, 19 nt, Homo sapiens
cagcgaaggagacucguuu

SEQ ID NO: 889843 - RNA, 19 nt, Homo sapiens
ugaggcagcacuggcauua

SEQ ID NO: 889844 - RNA, 19 nt, Homo sapiens
gggcaucaccaccagagaa

SEQ ID NO: 889845 - RNA, 19 nt, Homo sapiens
ccaaagcaaggcccuacaa

SEQ ID NO: 889846 - RNA, 19 nt, Homo sapiens
cgaaggagacucguuugga

SEQ ID NO: 889847 - RNA, 19 nt, Homo sapiens
gagcccaggguccagauuc

SEQ ID NO: 889848 - RNA, 19 nt, Homo sapiens
caaagcaaggcccuacaag

SEQ ID NO: 889849 - RNA, 19 nt, Homo sapiens
gaggcagcacuggcauuaa

SEQ ID NO: 889850 - RNA, 19 nt, Homo sapiens
gggaagagcuggccagaga

SEQ ID NO: 889851 - RNA, 19 nt, Homo sapiens
gcaagcauccggugcaaug

SEQ ID NO: 889852 - RNA, 19 nt, Homo sapiens
gagagaucaugccaguuga

SEQ ID NO: 889853 - RNA, 19 nt, Homo sapiens
ggauucagaucugguuuca

SEQ ID NO: 889854 - RNA, 19 nt, Homo sapiens
ugagagaucaugccaguug

SEQ ID NO: 889855 - RNA, 19 nt, Homo sapiens
cagauuugguuucagaaug

SEQ ID NO: 889856 - RNA, 19 nt, Homo sapiens
agauuugguuucagaauga

SEQ ID NO: 889857 - RNA, 19 nt, Homo sapiens
gaagagcuggccagagaga

SEQ ID NO: 889858 - RNA, 19 nt, Homo sapiens
ggaccgggaaggcgaauga

SEQ ID NO: 889859 - RNA, 19 nt, Homo sapiens
guccagauuugguuucaga

SEQ ID NO: 889860 - RNA, 19 nt, Homo sapiens
gagcccaggguccagauuu

SEQ ID NO: 889861 - RNA, 19 nt, Homo sapiens
gcuuugagcggaaccugua

SEQ ID NO: 889862 - RNA, 19 nt, Homo sapiens
ugagaaggaucgcuuucca

SEQ ID NO: 889863 - RNA, 19 nt, Homo sapiens
ugagauggcccuccugaca

SEQ ID NO: 889864 - RNA, 19 nt, Homo sapiens
gcauugccaccaaagaaga

SEQ ID NO: 889865 - RNA, 19 nt, Homo sapiens
ggaucgcuuuccaggcauu

SEQ ID NO: 889866 - RNA, 19 nt, Homo sapiens
cgucugcacuccacuccau

SEQ ID NO: 889867 - RNA, 19 nt, Homo sapiens
cgaaagcggacugccauca

SEQ ID NO: 889868 - RNA, 19 nt, Homo sapiens
ccuccgagccuuugagaag

SEQ ID NO: 889869 - RNA, 19 nt, Homo sapiens
cgugucaguccgugaaauu

SEQ ID NO: 889870 - RNA, 19 nt, Homo sapiens
ggcgaaugauacuccuuuc

SEQ ID NO: 889871 - RNA, 19 nt, Homo sapiens
gccaucaccggaucccaaa

SEQ ID NO: 889872 - RNA, 19 nt, Homo sapiens
gaaagcggacugccaucac

SEQ ID NO: 889873 - RNA, 19 nt, Homo sapiens
gaaaugagauugccagaaa

SEQ ID NO: 889874 - RNA, 19 nt, Homo sapiens
ggaaauaucuguucuucuu

SEQ ID NO: 889875 - RNA, 19 nt, Homo sapiens
gaaagaagcugaaaaugua

SEQ ID NO: 889876 - RNA, 19 nt, Homo sapiens
gaaaguaguucuauugaca

SEQ ID NO: 889877 - RNA, 19 nt, Homo sapiens
gagaguaaguuagguguua

SEQ ID NO: 889878 - RNA, 19 nt, Homo sapiens
ggacauaacuauuguaacu

SEQ ID NO: 889879 - RNA, 19 nt, Homo sapiens
gaaauucacuaccaugaug

SEQ ID NO: 889880 - RNA, 19 nt, Homo sapiens
gaacagaggagaaaugaga

SEQ ID NO: 889881 - RNA, 19 nt, Homo sapiens
gcacagaguggauuuaauu

SEQ ID NO: 889882 - RNA, 19 nt, Homo sapiens
ccacuaacuugauugauaa

SEQ ID NO: 889883 - RNA, 19 nt, Homo sapiens
gcaaucugcucaaaccuaa

SEQ ID NO: 889884 - RNA, 19 nt, Homo sapiens
ccuaauaccuuuccuuuau

SEQ ID NO: 889885 - RNA, 19 nt, Homo sapiens
gauaugaccucccuuucuu

SEQ ID NO: 889886 - RNA, 19 nt, Homo sapiens
gccacuaacuugauugaua

SEQ ID NO: 889887 - RNA, 19 nt, Homo sapiens
uauacaaacucccugaaua

SEQ ID NO: 889888 - RNA, 19 nt, Homo sapiens
aaagagagguaguuuagaa

SEQ ID NO: 889889 - RNA, 19 nt, Homo sapiens
gcucaaaccuaacaccaaa

SEQ ID NO: 889890 - RNA, 19 nt, Homo sapiens
cacaauccaucucuucuua

SEQ ID NO: 889891 - RNA, 19 nt, Homo sapiens
gcauaucacuagccaaaga

SEQ ID NO: 889892 - RNA, 19 nt, Homo sapiens
gaucaaggcucuggcauuc

SEQ ID NO: 889893 - RNA, 19 nt, Homo sapiens
gaagcagugucguugcaua

SEQ ID NO: 889894 - RNA, 19 nt, Homo sapiens
ugacauuccucaagauauu

SEQ ID NO: 889895 - RNA, 19 nt, Homo sapiens
ccagugcucucccaucuaa

SEQ ID NO: 889896 - RNA, 19 nt, Homo sapiens
guuuagaacucucugcaua

SEQ ID NO: 889897 - RNA, 19 nt, Homo sapiens
guacaaauguggugugucu

SEQ ID NO: 889898 - RNA, 19 nt, Homo sapiens
guaaggaaauaaagggauu

SEQ ID NO: 889899 - RNA, 19 nt, Homo sapiens
gacaguaagucuaaagaug

SEQ ID NO: 889900 - RNA, 19 nt, Homo sapiens
ugagguaccuugcugugua

SEQ ID NO: 889901 - RNA, 19 nt, Homo sapiens
uguggaaugugaauaguua

SEQ ID NO: 889902 - RNA, 19 nt, Homo sapiens
ggaagucuguaaguuguuu

SEQ ID NO: 889903 - RNA, 19 nt, Homo sapiens
gguaggcacuguccucuga

SEQ ID NO: 889904 - RNA, 19 nt, Homo sapiens
agaauuuccucaacacuaa

SEQ ID NO: 889905 - RNA, 19 nt, Homo sapiens
gcacuguccucugauuaaa

SEQ ID NO: 889906 - RNA, 19 nt, Homo sapiens
gagaagacgacgagaguaa

SEQ ID NO: 889907 - RNA, 19 nt, Homo sapiens
caaguuagcuaaaccaaac

SEQ ID NO: 889908 - RNA, 19 nt, Homo sapiens
ugccaagguuccuaaauua

SEQ ID NO: 889909 - RNA, 19 nt, Homo sapiens
uaauggagaugacuuaagu

SEQ ID NO: 889910 - RNA, 19 nt, Homo sapiens
gucuaaagaugaagaguuu

SEQ ID NO: 889911 - RNA, 19 nt, Homo sapiens
gaugacuaguucacacaua

SEQ ID NO: 889912 - RNA, 19 nt, Homo sapiens
ggauuugguuaaccuguuu

SEQ ID NO: 889913 - RNA, 19 nt, Homo sapiens
gcuaaagagcaacuaauaa

SEQ ID NO: 889914 - RNA, 19 nt, Homo sapiens
uaauuuggcuucaaguuuc

SEQ ID NO: 889915 - RNA, 19 nt, Homo sapiens
caagaaugcaauuucguua

SEQ ID NO: 889916 - RNA, 19 nt, Homo sapiens
gagagccacuaacuugauu

SEQ ID NO: 889917 - RNA, 19 nt, Homo sapiens
gggaguugauagucucaua

SEQ ID NO: 889918 - RNA, 19 nt, Homo sapiens
gcauguauacaaacgaaua

SEQ ID NO: 889919 - RNA, 19 nt, Homo sapiens
caacuaaacaggagccauu

SEQ ID NO: 889920 - RNA, 19 nt, Homo sapiens
gagauucaguugccgauca

SEQ ID NO: 889921 - RNA, 19 nt, Homo sapiens
ggacauugcagaagcuuga

SEQ ID NO: 889922 - RNA, 19 nt, Homo sapiens
uaacuucacugggauaauc

SEQ ID NO: 889923 - RNA, 19 nt, Homo sapiens
gagaauuuccucaacacua

SEQ ID NO: 889924 - RNA, 19 nt, Homo sapiens
gaauagcagauaaugauga

SEQ ID NO: 889925 - RNA, 19 nt, Homo sapiens
gacuuacgaugcauguaua

SEQ ID NO: 889926 - RNA, 19 nt, Homo sapiens
cuguaggucuucaaaguua

SEQ ID NO: 889927 - RNA, 19 nt, Homo sapiens
caagaggcccugcauguga

SEQ ID NO: 889928 - RNA, 19 nt, Homo sapiens
guagaaauguaagggauau

SEQ ID NO: 889929 - RNA, 19 nt, Homo sapiens
cgacgagaguaaggaaaua

SEQ ID NO: 889930 - RNA, 19 nt, Homo sapiens
caaaccaacuccucugcuu

SEQ ID NO: 889931 - RNA, 19 nt, Homo sapiens
caagagaccuguuuuagug

SEQ ID NO: 889932 - RNA, 19 nt, Homo sapiens
caaguuucaugaaucugua

SEQ ID NO: 889933 - RNA, 19 nt, Homo sapiens
gaacuuuauuguacuuugg

SEQ ID NO: 889934 - RNA, 19 nt, Homo sapiens
gugcaacucuuucuacauc

SEQ ID NO: 889935 - RNA, 19 nt, Homo sapiens
caaacucccugaauacucu

SEQ ID NO: 889936 - RNA, 19 nt, Homo sapiens
ucaugaaucuguaacuaga

SEQ ID NO: 889937 - RNA, 19 nt, Homo sapiens
ucgagucacugaugaugua

SEQ ID NO: 889938 - RNA, 19 nt, Homo sapiens
guaaagagaauuuccucaa

SEQ ID NO: 889939 - RNA, 19 nt, Homo sapiens
ggauggacauaacuauugu

SEQ ID NO: 889940 - RNA, 19 nt, Homo sapiens
acaaccagauucuuacuug

SEQ ID NO: 889941 - RNA, 19 nt, Homo sapiens
caacugcccugaacuacag

SEQ ID NO: 889942 - RNA, 19 nt, Homo sapiens
acaaacgaauagcagauaa

SEQ ID NO: 889943 - RNA, 19 nt, Homo sapiens
gggauaaucagcagcguaa

SEQ ID NO: 889944 - RNA, 19 nt, Homo sapiens
cuucuuaaguugauaguga

SEQ ID NO: 889945 - RNA, 19 nt, Homo sapiens
aaagagaauuuccucaaca

SEQ ID NO: 889946 - RNA, 19 nt, Homo sapiens
gaaugcaauuucguuaaug

SEQ ID NO: 889947 - RNA, 19 nt, Homo sapiens
cagaguggauuuaauuaag

SEQ ID NO: 889948 - RNA, 19 nt, Homo sapiens
uguauuagcuguucaucug

SEQ ID NO: 889949 - RNA, 19 nt, Homo sapiens
uaacagaacccaagugaac

SEQ ID NO: 889950 - RNA, 19 nt, Homo sapiens
caaaucagguccagcaaaa

SEQ ID NO: 889951 - RNA, 19 nt, Homo sapiens
aaacacacauccuggaagu

SEQ ID NO: 889952 - RNA, 19 nt, Homo sapiens
acacugaauuucucuuguu

SEQ ID NO: 889953 - RNA, 19 nt, Homo sapiens
aacaaacacugcagacuug

SEQ ID NO: 889954 - RNA, 19 nt, Homo sapiens
ugaccucccuuucuuuaug

SEQ ID NO: 889955 - RNA, 19 nt, Homo sapiens
uaaccaugaugcaaauguu

SEQ ID NO: 889956 - RNA, 19 nt, Homo sapiens
aaacuaauuuggcuucaag

SEQ ID NO: 889957 - RNA, 19 nt, Homo sapiens
gagugaaaguaguucuauu

SEQ ID NO: 889958 - RNA, 19 nt, Homo sapiens
gcucaaguaaagagaauuu

SEQ ID NO: 889959 - RNA, 19 nt, Homo sapiens
ggcaauggcuacuuaggau

SEQ ID NO: 889960 - RNA, 19 nt, Homo sapiens
gaaaagagagguaguuuag

SEQ ID NO: 889961 - RNA, 19 nt, Homo sapiens
caaagaagaagcugacaca

SEQ ID NO: 889962 - RNA, 19 nt, Homo sapiens
ccacauucuccaacaauaa

SEQ ID NO: 889963 - RNA, 19 nt, Homo sapiens
acaccaaacugaaaacaua

SEQ ID NO: 889964 - RNA, 19 nt, Homo sapiens
guuaagaguguaagugaaa

SEQ ID NO: 889965 - RNA, 19 nt, Homo sapiens
uaaagagaauuuccucaac

SEQ ID NO: 889966 - RNA, 19 nt, Homo sapiens
gcagauuuggcucaaguaa

SEQ ID NO: 889967 - RNA, 19 nt, Homo sapiens
ggaaagaagcugaaaaugu

SEQ ID NO: 889968 - RNA, 19 nt, Homo sapiens
aaacaaacacugcagacuu

SEQ ID NO: 889969 - RNA, 19 nt, Homo sapiens
caaguccuauguaauaugg

SEQ ID NO: 889970 - RNA, 19 nt, Homo sapiens
cagggugggugaacuuuau

SEQ ID NO: 889971 - RNA, 19 nt, Homo sapiens
gcaggauaguggagugaga

SEQ ID NO: 889972 - RNA, 19 nt, Homo sapiens
uaacuacccuaaaagcaua

SEQ ID NO: 889973 - RNA, 19 nt, Homo sapiens
gcagugagcuccuuuacua

SEQ ID NO: 889974 - RNA, 19 nt, Homo sapiens
gaagauacuuuguguaaga

SEQ ID NO: 889975 - RNA, 19 nt, Homo sapiens
caaaugaacuaaccaauuc

SEQ ID NO: 889976 - RNA, 19 nt, Homo sapiens
gaaauuugcuacuucaaga

SEQ ID NO: 889977 - RNA, 19 nt, Homo sapiens
gagaagauacuuuguguaa

SEQ ID NO: 889978 - RNA, 19 nt, Homo sapiens
gaagagaaacugaugcuuu

SEQ ID NO: 889979 - RNA, 19 nt, Homo sapiens
gaacauaucauacugaaca

SEQ ID NO: 889980 - RNA, 19 nt, Homo sapiens
gaaagaacauaucauacug

SEQ ID NO: 889981 - RNA, 19 nt, Homo sapiens
ccaagaagguuuacuuaau

SEQ ID NO: 889982 - RNA, 19 nt, Homo sapiens
guacaguaaugaugcauaa

SEQ ID NO: 889983 - RNA, 19 nt, Homo sapiens
gaggacaaguugcuuaauu

SEQ ID NO: 889984 - RNA, 19 nt, Homo sapiens
agaagaagaugaacaaaga

SEQ ID NO: 889985 - RNA, 19 nt, Homo sapiens
gaaauaagacucuaucaag

SEQ ID NO: 889986 - RNA, 19 nt, Homo sapiens
aguaauagauccuccaaua

SEQ ID NO: 889987 - RNA, 19 nt, Homo sapiens
ggauaugucuugcacuuau

SEQ ID NO: 889988 - RNA, 19 nt, Homo sapiens
gguuuagccugcuuucuua

SEQ ID NO: 889989 - RNA, 19 nt, Homo sapiens
cauagcaucugaaguugua

SEQ ID NO: 889990 - RNA, 19 nt, Homo sapiens
ggacuaaagugcugaaacu

SEQ ID NO: 889991 - RNA, 19 nt, Homo sapiens
guggaaagcuggcaaagga

SEQ ID NO: 889992 - RNA, 19 nt, Homo sapiens
gaaccaaucacaaguccua

SEQ ID NO: 889993 - RNA, 19 nt, Homo sapiens
ggacuaccauggcagaaga

SEQ ID NO: 889994 - RNA, 19 nt, Homo sapiens
gagaguaaacuucauagaa

SEQ ID NO: 889995 - RNA, 19 nt, Homo sapiens
gaaugacucacuucgaaua

SEQ ID NO: 889996 - RNA, 19 nt, Homo sapiens
guaccucccugccuuuaaa

SEQ ID NO: 889997 - RNA, 19 nt, Homo sapiens
uagaaugacucacuucgaa

SEQ ID NO: 889998 - RNA, 19 nt, Homo sapiens
ggacaaguugcuuaauuaa

SEQ ID NO: 889999 - RNA, 19 nt, Homo sapiens
aggacaaguugcuuaauua

SEQ ID NO: 890000 - RNA, 19 nt, Homo sapiens
gaagacauacugcaggaaa

SEQ ID NO: 890001 - RNA, 19 nt, Homo sapiens
aaacaaggcaucaguagaa

SEQ ID NO: 890002 - RNA, 19 nt, Homo sapiens
aauccuaccuugucaguuu

SEQ ID NO: 890003 - RNA, 19 nt, Homo sapiens
gaaaagcaauuguugauag

SEQ ID NO: 890004 - RNA, 19 nt, Homo sapiens
aaugagauguuauccagua

SEQ ID NO: 890005 - RNA, 19 nt, Homo sapiens
uaaccacagugaaugaauu

SEQ ID NO: 890006 - RNA, 19 nt, Homo sapiens
gaucacaugcuuagucauu

SEQ ID NO: 890007 - RNA, 19 nt, Homo sapiens
guaagguuccaaacuaaua

SEQ ID NO: 890008 - RNA, 19 nt, Homo sapiens
uaagucaugucccuugaaa

SEQ ID NO: 890009 - RNA, 19 nt, Homo sapiens
auacuacccuguucacuuu

SEQ ID NO: 890010 - RNA, 19 nt, Homo sapiens
gcucuuaggucuggaguug

SEQ ID NO: 890011 - RNA, 19 nt, Homo sapiens
aaagaaaccucggaagaga

SEQ ID NO: 890012 - RNA, 19 nt, Homo sapiens
acacauaaaccuaaggaua

SEQ ID NO: 890013 - RNA, 19 nt, Homo sapiens
ggaaagaacauaucauacu

SEQ ID NO: 890014 - RNA, 19 nt, Homo sapiens
agaaacaaaugacuacaga

SEQ ID NO: 890015 - RNA, 19 nt, Homo sapiens
gaacuaaccaauucaacug

SEQ ID NO: 890016 - RNA, 19 nt, Homo sapiens
caacauaagggaaauaaag

SEQ ID NO: 890017 - RNA, 19 nt, Homo sapiens
guaaucaaacuccgcauuu

SEQ ID NO: 890018 - RNA, 19 nt, Homo sapiens
gaaauaaagcucuguuagg

SEQ ID NO: 890019 - RNA, 19 nt, Homo sapiens
gacacacgauuguagauau

SEQ ID NO: 890020 - RNA, 19 nt, Homo sapiens
gagaaaagcucgucugagu

SEQ ID NO: 890021 - RNA, 19 nt, Homo sapiens
gcaggaaaaugagauguua

SEQ ID NO: 890022 - RNA, 19 nt, Homo sapiens
gaagaucacaugcuuaguc

SEQ ID NO: 890023 - RNA, 19 nt, Homo sapiens
ggaaauaaagcucuguuag

SEQ ID NO: 890024 - RNA, 19 nt, Homo sapiens
ucagagaagucaguauuga

SEQ ID NO: 890025 - RNA, 19 nt, Homo sapiens
gaauggaguuagggaaaga

SEQ ID NO: 890026 - RNA, 19 nt, Homo sapiens
gaaauggagaguaaacuuc

SEQ ID NO: 890027 - RNA, 19 nt, Homo sapiens
ggaaagggccucaugaaaa

SEQ ID NO: 890028 - RNA, 19 nt, Homo sapiens
uaauagauccuccaauaug

SEQ ID NO: 890029 - RNA, 19 nt, Homo sapiens
ccguguaccugauauauau

SEQ ID NO: 890030 - RNA, 19 nt, Homo sapiens
ugacucacuucgaauacua

SEQ ID NO: 890031 - RNA, 19 nt, Homo sapiens
cauagaaauuugcuacuuc

SEQ ID NO: 890032 - RNA, 19 nt, Homo sapiens
ggaaauggagaguaaacuu

SEQ ID NO: 890033 - RNA, 19 nt, Homo sapiens
ccaaagaaaccucggaaga

SEQ ID NO: 890034 - RNA, 19 nt, Homo sapiens
gaucagcucagcccaaaga

SEQ ID NO: 890035 - RNA, 19 nt, Homo sapiens
gaaacaaggcaucaguaga

SEQ ID NO: 890036 - RNA, 19 nt, Homo sapiens
ccacuaaaguuguuuugua

SEQ ID NO: 890037 - RNA, 19 nt, Homo sapiens
gaagucaguauugaagaua

SEQ ID NO: 890038 - RNA, 19 nt, Homo sapiens
aauagauccuccaauauga

SEQ ID NO: 890039 - RNA, 19 nt, Homo sapiens
uaacggaguugggaagaga

SEQ ID NO: 890040 - RNA, 19 nt, Homo sapiens
gauaugucuugcacuuauu

SEQ ID NO: 890041 - RNA, 19 nt, Homo sapiens
ugccugaacuugauuaaug

SEQ ID NO: 890042 - RNA, 19 nt, Homo sapiens
guaguuucguggccucuuu

SEQ ID NO: 890043 - RNA, 19 nt, Homo sapiens
aagaaaagaugccacauuu

SEQ ID NO: 890044 - RNA, 19 nt, Homo sapiens
gcaugagccugcaggacaa

SEQ ID NO: 890045 - RNA, 19 nt, Homo sapiens
gggaaauaaagcucuguua

SEQ ID NO: 890046 - RNA, 19 nt, Homo sapiens
gaagauacagguguugaug

SEQ ID NO: 890047 - RNA, 19 nt, Homo sapiens
caaggaagaagucagagaa

SEQ ID NO: 890048 - RNA, 19 nt, Homo sapiens
gaugagaguucugcagcaa

SEQ ID NO: 890049 - RNA, 19 nt, Homo sapiens
gaaaagaugccacauuuag

SEQ ID NO: 890050 - RNA, 19 nt, Homo sapiens
aaugagguauucuagguaa

SEQ ID NO: 890051 - RNA, 19 nt, Homo sapiens
gaagaagucagagaaguca

SEQ ID NO: 890052 - RNA, 19 nt, Homo sapiens
aaucacaaguccuauugaa

SEQ ID NO: 890053 - RNA, 19 nt, Homo sapiens
uagaaccucugccaauguu

SEQ ID NO: 890054 - RNA, 19 nt, Homo sapiens
guaauagauccuccaauau

SEQ ID NO: 890055 - RNA, 19 nt, Homo sapiens
uggaacagcuaacggaguu

SEQ ID NO: 890056 - RNA, 19 nt, Homo sapiens
gaaaagcucgucugaguga

SEQ ID NO: 890057 - RNA, 19 nt, Homo sapiens
gacugccacuacuaaauuu

SEQ ID NO: 890058 - RNA, 19 nt, Homo sapiens
ucaucagucuacuuacaua

SEQ ID NO: 890059 - RNA, 19 nt, Homo sapiens
aagagaagauacuuugugu

SEQ ID NO: 890060 - RNA, 19 nt, Homo sapiens
cuaagacacaggagguuua

SEQ ID NO: 890061 - RNA, 19 nt, Homo sapiens
gagaaaauauggagaaguc

SEQ ID NO: 890062 - RNA, 19 nt, Homo sapiens
ugacugccacuacuaaauu

SEQ ID NO: 890063 - RNA, 19 nt, Homo sapiens
gccagauuguucagucuaa

SEQ ID NO: 890064 - RNA, 19 nt, Homo sapiens
ccaggcauuucaccuuaaa

SEQ ID NO: 890065 - RNA, 19 nt, Homo sapiens
caugauaguuacauacaca

SEQ ID NO: 890066 - RNA, 19 nt, Homo sapiens
caccaagaagguuuacuua

SEQ ID NO: 890067 - RNA, 19 nt, Homo sapiens
cugaggaaguucuaucuug

SEQ ID NO: 890068 - RNA, 19 nt, Homo sapiens
ggaaagcuaauccuaccuu

SEQ ID NO: 890069 - RNA, 19 nt, Homo sapiens
ccuugaaacaugauaguua

SEQ ID NO: 890070 - RNA, 19 nt, Homo sapiens
acacacgauuguagauauu

SEQ ID NO: 890071 - RNA, 19 nt, Homo sapiens
gccugaacuugauuaauga

SEQ ID NO: 890072 - RNA, 19 nt, Homo sapiens
uagaucagcucagcccaaa

SEQ ID NO: 890073 - RNA, 19 nt, Homo sapiens
gcuauuaacuggagacuuu

SEQ ID NO: 890074 - RNA, 19 nt, Homo sapiens
gcagcaaacuaaauucuga

SEQ ID NO: 890075 - RNA, 19 nt, Homo sapiens
ucaaggacauugugugauu

SEQ ID NO: 890076 - RNA, 19 nt, Homo sapiens
caaguuaggagguuuguuu

SEQ ID NO: 890077 - RNA, 19 nt, Homo sapiens
ugaagaagaugaacaggau

SEQ ID NO: 890078 - RNA, 19 nt, Homo sapiens
gagccaagguguucuucuu

SEQ ID NO: 890079 - RNA, 19 nt, Homo sapiens
ggaauaagggccaucaugu

SEQ ID NO: 890080 - RNA, 19 nt, Homo sapiens
gcgcaagauuuggaagaua

SEQ ID NO: 890081 - RNA, 19 nt, Homo sapiens
agagaagccuguauucaga

SEQ ID NO: 890082 - RNA, 19 nt, Homo sapiens
gcacuacacauucaaguuc

SEQ ID NO: 890083 - RNA, 19 nt, Homo sapiens
agaccaggauguuuggaua

SEQ ID NO: 890084 - RNA, 19 nt, Homo sapiens
acaggaagcuagacaggaa

SEQ ID NO: 890085 - RNA, 19 nt, Homo sapiens
gaagaugaacaggauauau

SEQ ID NO: 890086 - RNA, 19 nt, Homo sapiens
caaaauaccuggcccaagu

SEQ ID NO: 890087 - RNA, 19 nt, Homo sapiens
caacauggaagccaaguuc

SEQ ID NO: 890088 - RNA, 19 nt, Homo sapiens
ucaagcagcaaacuaaauu

SEQ ID NO: 890089 - RNA, 19 nt, Homo sapiens
gaauaagggccaucaugug

SEQ ID NO: 890090 - RNA, 19 nt, Homo sapiens
gguaauaucaagcagcaaa

SEQ ID NO: 890091 - RNA, 19 nt, Homo sapiens
gaccgaacaucccugaaca

SEQ ID NO: 890092 - RNA, 19 nt, Homo sapiens
aaacuuggagcucgcauaa

SEQ ID NO: 890093 - RNA, 19 nt, Homo sapiens
gaagaagaugaacaggaua

SEQ ID NO: 890094 - RNA, 19 nt, Homo sapiens
ggacggugcucagacaagu

SEQ ID NO: 890095 - RNA, 19 nt, Homo sapiens
gagagaagccuguauucag

SEQ ID NO: 890096 - RNA, 19 nt, Homo sapiens
ugagcugggugacuauuug

SEQ ID NO: 890097 - RNA, 19 nt, Homo sapiens
gcaaugcggacagagagua

SEQ ID NO: 890098 - RNA, 19 nt, Homo sapiens
cgcaagauuuggaagauau

SEQ ID NO: 890099 - RNA, 19 nt, Homo sapiens
caucaugugugggucacua

SEQ ID NO: 890100 - RNA, 19 nt, Homo sapiens
caaggacauugugugauug

SEQ ID NO: 890101 - RNA, 19 nt, Homo sapiens
gggauuagagccucaagga

SEQ ID NO: 890102 - RNA, 19 nt, Homo sapiens
gccaagguguucuucuuca

SEQ ID NO: 890103 - RNA, 19 nt, Homo sapiens
aggaugagcugggugacua

SEQ ID NO: 890104 - RNA, 19 nt, Homo sapiens
uaacagaagcugaugaaaa

SEQ ID NO: 890105 - RNA, 19 nt, Homo sapiens
gagaaauaaacgagucuau

SEQ ID NO: 890106 - RNA, 19 nt, Homo sapiens
gggaauaagggccaucaug

SEQ ID NO: 890107 - RNA, 19 nt, Homo sapiens
caagguguucuucuucaaa

SEQ ID NO: 890108 - RNA, 19 nt, Homo sapiens
cauaacagaagcugaugaa

SEQ ID NO: 890109 - RNA, 19 nt, Homo sapiens
ccaagguguucuucuucaa

SEQ ID NO: 890110 - RNA, 19 nt, Homo sapiens
gaaagcugaccuucaugau

SEQ ID NO: 890111 - RNA, 19 nt, Homo sapiens
ggagacccuucgaggaaca

SEQ ID NO: 890112 - RNA, 19 nt, Homo sapiens
uuaggagguuuguuucaga

SEQ ID NO: 890113 - RNA, 19 nt, Homo sapiens
gcagauugagauagagaga

SEQ ID NO: 890114 - RNA, 19 nt, Homo sapiens
acuuggagcucgcauaaca

SEQ ID NO: 890115 - RNA, 19 nt, Homo sapiens
ccucaaggacauuguguga

SEQ ID NO: 890116 - RNA, 19 nt, Homo sapiens
gcauaacagaagcugauga

SEQ ID NO: 890117 - RNA, 19 nt, Homo sapiens
caaacuuggagcucgcaua

SEQ ID NO: 890118 - RNA, 19 nt, Homo sapiens
agaaagcugaccuucauga

SEQ ID NO: 890119 - RNA, 19 nt, Homo sapiens
gcugggugacuauuugaaa

SEQ ID NO: 890120 - RNA, 19 nt, Homo sapiens
ugcagcagauugagauaga

SEQ ID NO: 890121 - RNA, 19 nt, Homo sapiens
aauaagggccaucaugugu

SEQ ID NO: 890122 - RNA, 19 nt, Homo sapiens
ggagcucgcauaacagaag

SEQ ID NO: 890123 - RNA, 19 nt, Homo sapiens
aaauaccuggcccaaguua

SEQ ID NO: 890124 - RNA, 19 nt, Homo sapiens
gagcugggugacuauuuga

SEQ ID NO: 890125 - RNA, 19 nt, Homo sapiens
agauugagauagagagaag

SEQ ID NO: 890126 - RNA, 19 nt, Homo sapiens
caaugcggacagagaguaa

SEQ ID NO: 890127 - RNA, 19 nt, Homo sapiens
gaaguuuggagaccaggau

SEQ ID NO: 890128 - RNA, 19 nt, Homo sapiens
gaagcuagacaggaaccuu

SEQ ID NO: 890129 - RNA, 19 nt, Homo sapiens
agaugaacaggauauauug

SEQ ID NO: 890130 - RNA, 19 nt, Homo sapiens
gauagagagaagccuguau

SEQ ID NO: 890131 - RNA, 19 nt, Homo sapiens
uaucaagcagcaaacuaaa

SEQ ID NO: 890132 - RNA, 19 nt, Homo sapiens
auaucaagcagcaaacuaa

SEQ ID NO: 890133 - RNA, 19 nt, Homo sapiens
ccucacauuugcagguaau

SEQ ID NO: 890134 - RNA, 19 nt, Homo sapiens
auagagagaagccuguauu

SEQ ID NO: 890135 - RNA, 19 nt, Homo sapiens
ggaaccuuguccuguuagu

SEQ ID NO: 890136 - RNA, 19 nt, Homo sapiens
gcaagauuuggaagauaug

SEQ ID NO: 890137 - RNA, 19 nt, Homo sapiens
aaagcugaccuucaugaug

SEQ ID NO: 890138 - RNA, 19 nt, Homo sapiens
guuaggagguuuguuucag

SEQ ID NO: 890139 - RNA, 19 nt, Homo sapiens
ggcgcaagauuuggaagau

SEQ ID NO: 890140 - RNA, 19 nt, Homo sapiens
guaaggcggacgcuguuag

SEQ ID NO: 890141 - RNA, 19 nt, Homo sapiens
guauucagaccacgagcuu

SEQ ID NO: 890142 - RNA, 19 nt, Homo sapiens
aagaagaugaacaggauau

SEQ ID NO: 890143 - RNA, 19 nt, Homo sapiens
ugaaaagaaugaccgaaca

SEQ ID NO: 890144 - RNA, 19 nt, Homo sapiens
aacagaagcugaugaaaag

SEQ ID NO: 890145 - RNA, 19 nt, Homo sapiens
uaugugggagcagaaauuu

SEQ ID NO: 890146 - RNA, 19 nt, Homo sapiens
aauaucaagcagcaaacua

SEQ ID NO: 890147 - RNA, 19 nt, Homo sapiens
ggcccaaguuaggagguuu

SEQ ID NO: 890148 - RNA, 19 nt, Homo sapiens
agaagaugaacaggauaua

SEQ ID NO: 890149 - RNA, 19 nt, Homo sapiens
ggcacuacacauucaaguu

SEQ ID NO: 890150 - RNA, 19 nt, Homo sapiens
cagcagauugagauagaga

SEQ ID NO: 890151 - RNA, 19 nt, Homo sapiens
ggugacuauuugaaaccaa

SEQ ID NO: 890152 - RNA, 19 nt, Homo sapiens
aaagaagaaagcugaccuu

SEQ ID NO: 890153 - RNA, 19 nt, Homo sapiens
gagaccaggauguuuggau

SEQ ID NO: 890154 - RNA, 19 nt, Homo sapiens
uagagagaagccuguauuc

SEQ ID NO: 890155 - RNA, 19 nt, Homo sapiens
agagagaagccuguauuca

SEQ ID NO: 890156 - RNA, 19 nt, Homo sapiens
caagcagcaaacuaaauuc

SEQ ID NO: 890157 - RNA, 19 nt, Homo sapiens
ucacauuugcagguaauau

SEQ ID NO: 890158 - RNA, 19 nt, Homo sapiens
gauaugugggagcagaaau

SEQ ID NO: 890159 - RNA, 19 nt, Homo sapiens
gcagcagauugagauagag

SEQ ID NO: 890160 - RNA, 19 nt, Homo sapiens
aagguguucuucuucaaag

SEQ ID NO: 890161 - RNA, 19 nt, Homo sapiens
gagaacaccugaguacuaa

SEQ ID NO: 890162 - RNA, 19 nt, Homo sapiens
gaugauaucuuguuuaagg

SEQ ID NO: 890163 - RNA, 19 nt, Homo sapiens
ccaagaagcagaaacaaua

SEQ ID NO: 890164 - RNA, 19 nt, Homo sapiens
gaaccagugugcuuugaaa

SEQ ID NO: 890165 - RNA, 19 nt, Homo sapiens
ugacaucacuggccgcuuu

SEQ ID NO: 890166 - RNA, 19 nt, Homo sapiens
gaaacaauaucagcggauu

SEQ ID NO: 890167 - RNA, 19 nt, Homo sapiens
aaacuacucuugucuacuu

SEQ ID NO: 890168 - RNA, 19 nt, Homo sapiens
gaauaauccucucugugaa

SEQ ID NO: 890169 - RNA, 19 nt, Homo sapiens
gcaguaguauucaucucua

SEQ ID NO: 890170 - RNA, 19 nt, Homo sapiens
gaagacaggccgcuuugaa

SEQ ID NO: 890171 - RNA, 19 nt, Homo sapiens
gauaugaggcuaagagaau

SEQ ID NO: 890172 - RNA, 19 nt, Homo sapiens
gaugguacauggaaacugu

SEQ ID NO: 890173 - RNA, 19 nt, Homo sapiens
gggacuugaucauacauuu

SEQ ID NO: 890174 - RNA, 19 nt, Homo sapiens
agaauaauccucucuguga

SEQ ID NO: 890175 - RNA, 19 nt, Homo sapiens
acagggaaguuuaucauga

SEQ ID NO: 890176 - RNA, 19 nt, Homo sapiens
ucaucaaguucaucagaua

SEQ ID NO: 890177 - RNA, 19 nt, Homo sapiens
ggccucaguucuauuugua

SEQ ID NO: 890178 - RNA, 19 nt, Homo sapiens
ggagagagagagagaaugu

SEQ ID NO: 890179 - RNA, 19 nt, Homo sapiens
gcacaaggcgccugucauc

SEQ ID NO: 890180 - RNA, 19 nt, Homo sapiens
caagugcugucuaccauca

SEQ ID NO: 890181 - RNA, 19 nt, Homo sapiens
ggagaagccucaacaacac

SEQ ID NO: 890182 - RNA, 19 nt, Homo sapiens
caacacacacgcugcugua

SEQ ID NO: 890183 - RNA, 19 nt, Homo sapiens
gcuaacacagggaaguuua

SEQ ID NO: 890184 - RNA, 19 nt, Homo sapiens
cuacuuaggucucucucuu

SEQ ID NO: 890185 - RNA, 19 nt, Homo sapiens
gcuaagagaauaucaaguc

SEQ ID NO: 890186 - RNA, 19 nt, Homo sapiens
uuaggucucucucuucuug

SEQ ID NO: 890187 - RNA, 19 nt, Homo sapiens
ggaaggagaagccucaaca

SEQ ID NO: 890188 - RNA, 19 nt, Homo sapiens
gauguggaauacaagaaga

SEQ ID NO: 890189 - RNA, 19 nt, Homo sapiens
gugcgagccuucgaacuaa

SEQ ID NO: 890190 - RNA, 19 nt, Homo sapiens
ggugcgagccuucgaacua

SEQ ID NO: 890191 - RNA, 19 nt, Homo sapiens
ccagaggacuucccuaaaa

SEQ ID NO: 890192 - RNA, 19 nt, Homo sapiens
gaagaaaaguagaaaagag

SEQ ID NO: 890193 - RNA, 19 nt, Homo sapiens
ucugugaacuccuugcaaa

SEQ ID NO: 890194 - RNA, 19 nt, Homo sapiens
agagaacaccugaguacua

SEQ ID NO: 890195 - RNA, 19 nt, Homo sapiens
caaggaugguacauggaaa

SEQ ID NO: 890196 - RNA, 19 nt, Homo sapiens
cgagagcaccgcagcauga

SEQ ID NO: 890197 - RNA, 19 nt, Homo sapiens
gcugugcacucguuugcuu

SEQ ID NO: 890198 - RNA, 19 nt, Homo sapiens
uagcagcaauggcaaauac

SEQ ID NO: 890199 - RNA, 19 nt, Homo sapiens
caagaagcagaaacaauau

SEQ ID NO: 890200 - RNA, 19 nt, Homo sapiens
gaacuccuugcaaagauga

SEQ ID NO: 890201 - RNA, 19 nt, Homo sapiens
guuuguaaauguuccagaa

SEQ ID NO: 890202 - RNA, 19 nt, Homo sapiens
gaaggagaagccucaacaa

SEQ ID NO: 890203 - RNA, 19 nt, Homo sapiens
gguugggacuucucucuuc

SEQ ID NO: 890204 - RNA, 19 nt, Homo sapiens
gguggaagccuuucagaag

SEQ ID NO: 890205 - RNA, 19 nt, Homo sapiens
ugggaagucugcuuuggaa

SEQ ID NO: 890206 - RNA, 19 nt, Homo sapiens
gauccaagaagcagaaaca

SEQ ID NO: 890207 - RNA, 19 nt, Homo sapiens
ggagaccucuuuucaguuc

SEQ ID NO: 890208 - RNA, 19 nt, Homo sapiens
ugaaacuacucuugucuac

SEQ ID NO: 890209 - RNA, 19 nt, Homo sapiens
acauggagcucucgcagau

SEQ ID NO: 890210 - RNA, 19 nt, Homo sapiens
gggaaccagugugcuuuga

SEQ ID NO: 890211 - RNA, 19 nt, Homo sapiens
guacuaagcagcaguuuug

SEQ ID NO: 890212 - RNA, 19 nt, Homo sapiens
gagaggagagagagagaga

SEQ ID NO: 890213 - RNA, 19 nt, Homo sapiens
uaucuugcauggacuuuag

SEQ ID NO: 890214 - RNA, 19 nt, Homo sapiens
gaaaccaaauuagaaacac

SEQ ID NO: 890215 - RNA, 19 nt, Homo sapiens
ccaaggaugguacauggaa

SEQ ID NO: 890216 - RNA, 19 nt, Homo sapiens
gggccucaguucuauuugu

SEQ ID NO: 890217 - RNA, 19 nt, Homo sapiens
gcacauccucacacccaaa

SEQ ID NO: 890218 - RNA, 19 nt, Homo sapiens
gaggagagagagagagaau

SEQ ID NO: 890219 - RNA, 19 nt, Homo sapiens
aauaugagcuggggauuaa

SEQ ID NO: 890220 - RNA, 19 nt, Homo sapiens
cccacucugugcccaaaua

SEQ ID NO: 890221 - RNA, 19 nt, Homo sapiens
gugaacuccuugcaaagau

SEQ ID NO: 890222 - RNA, 19 nt, Homo sapiens
agagagagagaaugugauu

SEQ ID NO: 890223 - RNA, 19 nt, Homo sapiens
gcugaagacaggccgcuuu

SEQ ID NO: 890224 - RNA, 19 nt, Homo sapiens
cacacacgcugcuguaucu

SEQ ID NO: 890225 - RNA, 19 nt, Homo sapiens
auaugaggcuaagagaaua

SEQ ID NO: 890226 - RNA, 19 nt, Homo sapiens
gaugauaugaggcuaagag

SEQ ID NO: 890227 - RNA, 19 nt, Homo sapiens
agagagagagagaauguga

SEQ ID NO: 890228 - RNA, 19 nt, Homo sapiens
gcagaugucggagcucaug

SEQ ID NO: 890229 - RNA, 19 nt, Homo sapiens
guagagaggagaggagaga

SEQ ID NO: 890230 - RNA, 19 nt, Homo sapiens
ggaaccagugugcuuugaa

SEQ ID NO: 890231 - RNA, 19 nt, Homo sapiens
gcauggacuuuagcagcaa

SEQ ID NO: 890232 - RNA, 19 nt, Homo sapiens
ccucacacccaaagaaguu

SEQ ID NO: 890233 - RNA, 19 nt, Homo sapiens
caaguucaucagauauuug

SEQ ID NO: 890234 - RNA, 19 nt, Homo sapiens
uguccaaugucaugaaagu

SEQ ID NO: 890235 - RNA, 19 nt, Homo sapiens
ugaacuccuugcaaagaug

SEQ ID NO: 890236 - RNA, 19 nt, Homo sapiens
gaaggaggagugcuuugag

SEQ ID NO: 890237 - RNA, 19 nt, Homo sapiens
agacaggccgcuuugaaga

SEQ ID NO: 890238 - RNA, 19 nt, Homo sapiens
gauagcuucccaucacaga

SEQ ID NO: 890239 - RNA, 19 nt, Homo sapiens
gaacaccugaguacuaagc

SEQ ID NO: 890240 - RNA, 19 nt, Homo sapiens
gagccaugguggaggagau

SEQ ID NO: 890241 - RNA, 19 nt, Homo sapiens
aaagaugauaugaggcuaa

SEQ ID NO: 890242 - RNA, 19 nt, Homo sapiens
cauugaaacuacucuuguc

SEQ ID NO: 890243 - RNA, 19 nt, Homo sapiens
gcgagaaggaggagugcuu

SEQ ID NO: 890244 - RNA, 19 nt, Homo sapiens
ccaaccagaugaacaacac

SEQ ID NO: 890245 - RNA, 19 nt, Homo sapiens
gucaagugcugucuaccau

SEQ ID NO: 890246 - RNA, 19 nt, Homo sapiens
guucaucaaguucaucaga

SEQ ID NO: 890247 - RNA, 19 nt, Homo sapiens
aaaagacacuaagggauuu

SEQ ID NO: 890248 - RNA, 19 nt, Homo sapiens
gacauuggcauugcuaaca

SEQ ID NO: 890249 - RNA, 19 nt, Homo sapiens
ucgccaacuuguccuuuga

SEQ ID NO: 890250 - RNA, 19 nt, Homo sapiens
gagaaggaggagugcuuug

SEQ ID NO: 890251 - RNA, 19 nt, Homo sapiens
gagccacagcgggaacaua

SEQ ID NO: 890252 - RNA, 19 nt, Homo sapiens
uggcuucugucuccaagga

SEQ ID NO: 890253 - RNA, 19 nt, Homo sapiens
acaccaaccagaugaacaa

SEQ ID NO: 890254 - RNA, 19 nt, Homo sapiens
caucaaguucaucagauau

SEQ ID NO: 890255 - RNA, 19 nt, Homo sapiens
caaauuagaaacacauucc

SEQ ID NO: 890256 - RNA, 19 nt, Homo sapiens
cuucugggccucaguucua

SEQ ID NO: 890257 - RNA, 19 nt, Homo sapiens
cuagagaacaccugaguac

SEQ ID NO: 890258 - RNA, 19 nt, Homo sapiens
gagagagagaaugugauuu

SEQ ID NO: 890259 - RNA, 19 nt, Homo sapiens
gcgggaacauaucuugcau

SEQ ID NO: 890260 - RNA, 19 nt, Homo sapiens
agaagcagaaacaauauca

SEQ ID NO: 890261 - RNA, 19 nt, Homo sapiens
gcacaggacucaacagaug

SEQ ID NO: 890262 - RNA, 19 nt, Homo sapiens
gagaacaccugaguacuaa

SEQ ID NO: 890263 - RNA, 19 nt, Homo sapiens
gaugauaucuuguuuaagg

SEQ ID NO: 890264 - RNA, 19 nt, Homo sapiens
ccaagaagcagaaacaaua

SEQ ID NO: 890265 - RNA, 19 nt, Homo sapiens
gaaccagugugcuuugaaa

SEQ ID NO: 890266 - RNA, 19 nt, Homo sapiens
ugacaucacuggccgcuuu

SEQ ID NO: 890267 - RNA, 19 nt, Homo sapiens
gaaacaauaucagcggauu

SEQ ID NO: 890268 - RNA, 19 nt, Homo sapiens
aaacuacucuugucuacuu

SEQ ID NO: 890269 - RNA, 19 nt, Homo sapiens
gaauaauccucucugugaa

SEQ ID NO: 890270 - RNA, 19 nt, Homo sapiens
gggagcaucugcagucauu

SEQ ID NO: 890271 - RNA, 19 nt, Homo sapiens
gcaguaguauucaucucua

SEQ ID NO: 890272 - RNA, 19 nt, Homo sapiens
gaagacaggccgcuuugaa

SEQ ID NO: 890273 - RNA, 19 nt, Homo sapiens
gagcaucugcagucauuua

SEQ ID NO: 890274 - RNA, 19 nt, Homo sapiens
gauaugaggcuaagagaau

SEQ ID NO: 890275 - RNA, 19 nt, Homo sapiens
gaugguacauggaaacugu

SEQ ID NO: 890276 - RNA, 19 nt, Homo sapiens
gggacuugaucauacauuu

SEQ ID NO: 890277 - RNA, 19 nt, Homo sapiens
agaauaauccucucuguga

SEQ ID NO: 890278 - RNA, 19 nt, Homo sapiens
acagggaaguuuaucauga

SEQ ID NO: 890279 - RNA, 19 nt, Homo sapiens
ucaucaaguucaucagaua

SEQ ID NO: 890280 - RNA, 19 nt, Homo sapiens
ggccucaguucuauuugua

SEQ ID NO: 890281 - RNA, 19 nt, Homo sapiens
ggagagagagagagaaugu

SEQ ID NO: 890282 - RNA, 19 nt, Homo sapiens
gcacaaggcgccugucauc

SEQ ID NO: 890283 - RNA, 19 nt, Homo sapiens
caagugcugucuaccauca

SEQ ID NO: 890284 - RNA, 19 nt, Homo sapiens
ggagaagccucaacaacac

SEQ ID NO: 890285 - RNA, 19 nt, Homo sapiens
caacacacacgcugcugua

SEQ ID NO: 890286 - RNA, 19 nt, Homo sapiens
gcuaacacagggaaguuua

SEQ ID NO: 890287 - RNA, 19 nt, Homo sapiens
cuacuuaggucucucucuu

SEQ ID NO: 890288 - RNA, 19 nt, Homo sapiens
gcuaagagaauaucaaguc

SEQ ID NO: 890289 - RNA, 19 nt, Homo sapiens
uuaggucucucucuucuug

SEQ ID NO: 890290 - RNA, 19 nt, Homo sapiens
ggaaggagaagccucaaca

SEQ ID NO: 890291 - RNA, 19 nt, Homo sapiens
gauguggaauacaagaaga

SEQ ID NO: 890292 - RNA, 19 nt, Homo sapiens
gugcgagccuucgaacuaa

SEQ ID NO: 890293 - RNA, 19 nt, Homo sapiens
ggugcgagccuucgaacua

SEQ ID NO: 890294 - RNA, 19 nt, Homo sapiens
ccagaggacuucccuaaaa

SEQ ID NO: 890295 - RNA, 19 nt, Homo sapiens
gaagaaaaguagaaaagag

SEQ ID NO: 890296 - RNA, 19 nt, Homo sapiens
ucugugaacuccuugcaaa

SEQ ID NO: 890297 - RNA, 19 nt, Homo sapiens
agagaacaccugaguacua

SEQ ID NO: 890298 - RNA, 19 nt, Homo sapiens
caaggaugguacauggaaa

SEQ ID NO: 890299 - RNA, 19 nt, Homo sapiens
cgagagcaccgcagcauga

SEQ ID NO: 890300 - RNA, 19 nt, Homo sapiens
gcugugcacucguuugcuu

SEQ ID NO: 890301 - RNA, 19 nt, Homo sapiens
uagcagcaauggcaaauac

SEQ ID NO: 890302 - RNA, 19 nt, Homo sapiens
caagaagcagaaacaauau

SEQ ID NO: 890303 - RNA, 19 nt, Homo sapiens
gaacuccuugcaaagauga

SEQ ID NO: 890304 - RNA, 19 nt, Homo sapiens
guuuguaaauguuccagaa

SEQ ID NO: 890305 - RNA, 19 nt, Homo sapiens
gaaggagaagccucaacaa

SEQ ID NO: 890306 - RNA, 19 nt, Homo sapiens
gguugggacuucucucuuc

SEQ ID NO: 890307 - RNA, 19 nt, Homo sapiens
gguggaagccuuucagaag

SEQ ID NO: 890308 - RNA, 19 nt, Homo sapiens
ugggaagucugcuuuggaa

SEQ ID NO: 890309 - RNA, 19 nt, Homo sapiens
gauccaagaagcagaaaca

SEQ ID NO: 890310 - RNA, 19 nt, Homo sapiens
ggagaccucuuuucaguuc

SEQ ID NO: 890311 - RNA, 19 nt, Homo sapiens
acauggagcucucgcagau

SEQ ID NO: 890312 - RNA, 19 nt, Homo sapiens
ugaaacuacucuugucuac

SEQ ID NO: 890313 - RNA, 19 nt, Homo sapiens
gggaaccagugugcuuuga

SEQ ID NO: 890314 - RNA, 19 nt, Homo sapiens
guacuaagcagcaguuuug

SEQ ID NO: 890315 - RNA, 19 nt, Homo sapiens
gagaggagagagagagaga

SEQ ID NO: 890316 - RNA, 19 nt, Homo sapiens
uaucuugcauggacuuuag

SEQ ID NO: 890317 - RNA, 19 nt, Homo sapiens
gaaaccaaauuagaaacac

SEQ ID NO: 890318 - RNA, 19 nt, Homo sapiens
ccaaggaugguacauggaa

SEQ ID NO: 890319 - RNA, 19 nt, Homo sapiens
gggccucaguucuauuugu

SEQ ID NO: 890320 - RNA, 19 nt, Homo sapiens
gcacauccucacacccaaa

SEQ ID NO: 890321 - RNA, 19 nt, Homo sapiens
gaggagagagagagagaau

SEQ ID NO: 890322 - RNA, 19 nt, Homo sapiens
aauaugagcuggggauuaa

SEQ ID NO: 890323 - RNA, 19 nt, Homo sapiens
cccacucugugcccaaaua

SEQ ID NO: 890324 - RNA, 19 nt, Homo sapiens
gugaacuccuugcaaagau

SEQ ID NO: 890325 - RNA, 19 nt, Homo sapiens
agagagagagaaugugauu

SEQ ID NO: 890326 - RNA, 19 nt, Homo sapiens
gcugaagacaggccgcuuu

SEQ ID NO: 890327 - RNA, 19 nt, Homo sapiens
cacacacgcugcuguaucu

SEQ ID NO: 890328 - RNA, 19 nt, Homo sapiens
auaugaggcuaagagaaua

SEQ ID NO: 890329 - RNA, 19 nt, Homo sapiens
gaugauaugaggcuaagag

SEQ ID NO: 890330 - RNA, 19 nt, Homo sapiens
agagagagagagaauguga

SEQ ID NO: 890331 - RNA, 19 nt, Homo sapiens
guagagaggagaggagaga

SEQ ID NO: 890332 - RNA, 19 nt, Homo sapiens
gcagaugucggagcucaug

SEQ ID NO: 890333 - RNA, 19 nt, Homo sapiens
gugacucaauuaaguaucu

SEQ ID NO: 890334 - RNA, 19 nt, Homo sapiens
ccagcuuugugacucaauu

SEQ ID NO: 890335 - RNA, 19 nt, Homo sapiens
ggaaccagugugcuuugaa

SEQ ID NO: 890336 - RNA, 19 nt, Homo sapiens
ccucacacccaaagaaguu

SEQ ID NO: 890337 - RNA, 19 nt, Homo sapiens
caucugcagucauuuacca

SEQ ID NO: 890338 - RNA, 19 nt, Homo sapiens
gcauggacuuuagcagcaa

SEQ ID NO: 890339 - RNA, 19 nt, Homo sapiens
caaguucaucagauauuug

SEQ ID NO: 890340 - RNA, 19 nt, Homo sapiens
uguccaaugucaugaaagu

SEQ ID NO: 890341 - RNA, 19 nt, Homo sapiens
cagcuuugugacucaauua

SEQ ID NO: 890342 - RNA, 19 nt, Homo sapiens
ugaacuccuugcaaagaug

SEQ ID NO: 890343 - RNA, 19 nt, Homo sapiens
gaaggaggagugcuuugag

SEQ ID NO: 890344 - RNA, 19 nt, Homo sapiens
agacaggccgcuuugaaga

SEQ ID NO: 890345 - RNA, 19 nt, Homo sapiens
gauagcuucccaucacaga

SEQ ID NO: 890346 - RNA, 19 nt, Homo sapiens
gaacaccugaguacuaagc

SEQ ID NO: 890347 - RNA, 19 nt, Homo sapiens
gagccaugguggaggagau

SEQ ID NO: 890348 - RNA, 19 nt, Homo sapiens
aaagaugauaugaggcuaa

SEQ ID NO: 890349 - RNA, 19 nt, Homo sapiens
cauugaaacuacucuuguc

SEQ ID NO: 890350 - RNA, 19 nt, Homo sapiens
gcgagaaggaggagugcuu

SEQ ID NO: 890351 - RNA, 19 nt, Homo sapiens
ccaaccagaugaacaacac

SEQ ID NO: 890352 - RNA, 19 nt, Homo sapiens
gucaagugcugucuaccau

SEQ ID NO: 890353 - RNA, 19 nt, Homo sapiens
guucaucaaguucaucaga

SEQ ID NO: 890354 - RNA, 19 nt, Homo sapiens
aaaagacacuaagggauuu

SEQ ID NO: 890355 - RNA, 19 nt, Homo sapiens
gacauuggcauugcuaaca

SEQ ID NO: 890356 - RNA, 19 nt, Homo sapiens
ucgccaacuuguccuuuga

SEQ ID NO: 890357 - RNA, 19 nt, Homo sapiens
gagaaggaggagugcuuug

SEQ ID NO: 890358 - RNA, 19 nt, Homo sapiens
uggcuucugucuccaagga

SEQ ID NO: 890359 - RNA, 19 nt, Homo sapiens
acaccaaccagaugaacaa

SEQ ID NO: 890360 - RNA, 19 nt, Homo sapiens
gagccacagcgggaacaua

SEQ ID NO: 890361 - RNA, 19 nt, Homo sapiens
gaaacuaacccauuguaua

SEQ ID NO: 890362 - RNA, 19 nt, Homo sapiens
gcucuuagguggagguuua

SEQ ID NO: 890363 - RNA, 19 nt, Homo sapiens
ggaauuugaugaagaugua

SEQ ID NO: 890364 - RNA, 19 nt, Homo sapiens
gagagaaacuaacccauug

SEQ ID NO: 890365 - RNA, 19 nt, Homo sapiens
gacaagagaggaacauuua

SEQ ID NO: 890366 - RNA, 19 nt, Homo sapiens
ggucuggaaucauuuauug

SEQ ID NO: 890367 - RNA, 19 nt, Homo sapiens
ucaaagagaacaagucuaa

SEQ ID NO: 890368 - RNA, 19 nt, Homo sapiens
gcauuugccuccagacuug

SEQ ID NO: 890369 - RNA, 19 nt, Homo sapiens
uuaaugagcuuccuugcaa

SEQ ID NO: 890370 - RNA, 19 nt, Homo sapiens
gauauuugcugugcagaaa

SEQ ID NO: 890371 - RNA, 19 nt, Homo sapiens
caccauuacuugaugauaa

SEQ ID NO: 890372 - RNA, 19 nt, Homo sapiens
caagauuuggucacuauua

SEQ ID NO: 890373 - RNA, 19 nt, Homo sapiens
caccuuugcucuucaagua

SEQ ID NO: 890374 - RNA, 19 nt, Homo sapiens
gcaagaagcaccuggacuu

SEQ ID NO: 890375 - RNA, 19 nt, Homo sapiens
uaaagugggugcaagacaa

SEQ ID NO: 890376 - RNA, 19 nt, Homo sapiens
aaucuuggcucaccuuuau

SEQ ID NO: 890377 - RNA, 19 nt, Homo sapiens
gaaaauagcuuggcguuac

SEQ ID NO: 890378 - RNA, 19 nt, Homo sapiens
ccaaagugcuggaauugca

SEQ ID NO: 890379 - RNA, 19 nt, Homo sapiens
gagaaacuaacccauugua

SEQ ID NO: 890380 - RNA, 19 nt, Homo sapiens
ggaccaguaucaucuucaa

SEQ ID NO: 890381 - RNA, 19 nt, Homo sapiens
gaagguucuuuacagcauu

SEQ ID NO: 890382 - RNA, 19 nt, Homo sapiens
gauggagauuggaccagua

SEQ ID NO: 890383 - RNA, 19 nt, Homo sapiens
aaucagaugucaaagacuu

SEQ ID NO: 890384 - RNA, 19 nt, Homo sapiens
uaaggauuaucauggauug

SEQ ID NO: 890385 - RNA, 19 nt, Homo sapiens
ggccuagggcuuuguauuu

SEQ ID NO: 890386 - RNA, 19 nt, Homo sapiens
aaaggaagcuauucaccau

SEQ ID NO: 890387 - RNA, 19 nt, Homo sapiens
gcagauuccucggcuuaau

SEQ ID NO: 890388 - RNA, 19 nt, Homo sapiens
ggaagcuauucaccauuga

SEQ ID NO: 890389 - RNA, 19 nt, Homo sapiens
gaacuagcacagcagaaau

SEQ ID NO: 890390 - RNA, 19 nt, Homo sapiens
agaauucuaugacacucua

SEQ ID NO: 890391 - RNA, 19 nt, Homo sapiens
gaaucuuggcucaccuuua

SEQ ID NO: 890392 - RNA, 19 nt, Homo sapiens
gaggaaggauuugauggau

SEQ ID NO: 890393 - RNA, 19 nt, Homo sapiens
gauuuggucacuauuauga

SEQ ID NO: 890394 - RNA, 19 nt, Homo sapiens
agagcaacgucaccaguuu

SEQ ID NO: 890395 - RNA, 19 nt, Homo sapiens
ugaaucagaugucaaagac

SEQ ID NO: 890396 - RNA, 19 nt, Homo sapiens
gauccagaauaaagccauu

SEQ ID NO: 890397 - RNA, 19 nt, Homo sapiens
uuaccaaguuccucuaugu

SEQ ID NO: 890398 - RNA, 19 nt, Homo sapiens
cuaugacacucuaauuaug

SEQ ID NO: 890399 - RNA, 19 nt, Homo sapiens
cuucaacucucaaaguaga

SEQ ID NO: 890400 - RNA, 19 nt, Homo sapiens
caaugggcauacuuuguug

SEQ ID NO: 890401 - RNA, 19 nt, Homo sapiens
ucaaugggcauacuuuguu

SEQ ID NO: 890402 - RNA, 19 nt, Homo sapiens
gugccgccauuucucauuu

SEQ ID NO: 890403 - RNA, 19 nt, Homo sapiens
uguaguaguuggucuggaa

SEQ ID NO: 890404 - RNA, 19 nt, Homo sapiens
ggagauuggaccaguauca

SEQ ID NO: 890405 - RNA, 19 nt, Homo sapiens
uagcacagcagaaauacuu

SEQ ID NO: 890406 - RNA, 19 nt, Homo sapiens
cagauuccucggcuuaaua

SEQ ID NO: 890407 - RNA, 19 nt, Homo sapiens
uaguuggucuggaaucauu

SEQ ID NO: 890408 - RNA, 19 nt, Homo sapiens
gagaaaauaucuucaacuc

SEQ ID NO: 890409 - RNA, 19 nt, Homo sapiens
caagagaggaacauuuauc

SEQ ID NO: 890410 - RNA, 19 nt, Homo sapiens
aggaagcuauucaccauug

SEQ ID NO: 890411 - RNA, 19 nt, Homo sapiens
cauacuuacucaagcagaa

SEQ ID NO: 890412 - RNA, 19 nt, Homo sapiens
agacaagagaggaacauuu

SEQ ID NO: 890413 - RNA, 19 nt, Homo sapiens
ggaaucauuuauugguucu

SEQ ID NO: 890414 - RNA, 19 nt, Homo sapiens
gaacuuccagcaccauuac

SEQ ID NO: 890415 - RNA, 19 nt, Homo sapiens
cggcagauuccucggcuua

SEQ ID NO: 890416 - RNA, 19 nt, Homo sapiens
agagagaaacuaacccauu

SEQ ID NO: 890417 - RNA, 19 nt, Homo sapiens
cuugucagauguaguaguu

SEQ ID NO: 890418 - RNA, 19 nt, Homo sapiens
aagaaugccacaagaacua

SEQ ID NO: 890419 - RNA, 19 nt, Homo sapiens
agaggauccugccaacauu

SEQ ID NO: 890420 - RNA, 19 nt, Homo sapiens
aaagagaacaagucuaaag

SEQ ID NO: 890421 - RNA, 19 nt, Homo sapiens
ccaccacgcccagcuaauu

SEQ ID NO: 890422 - RNA, 19 nt, Homo sapiens
ccaaguuccucuauguucu

SEQ ID NO: 890423 - RNA, 19 nt, Homo sapiens
gucacagccuuaccaaguu

SEQ ID NO: 890424 - RNA, 19 nt, Homo sapiens
gcaccauuacuugaugaua

SEQ ID NO: 890425 - RNA, 19 nt, Homo sapiens
gccuagggcuuuguauuuc

SEQ ID NO: 890426 - RNA, 19 nt, Homo sapiens
gaauugcaggcaugagcua

SEQ ID NO: 890427 - RNA, 19 nt, Homo sapiens
uaacuugaucugugaugaa

SEQ ID NO: 890428 - RNA, 19 nt, Homo sapiens
uuacucaccuuugcucuuc

SEQ ID NO: 890429 - RNA, 19 nt, Homo sapiens
ucacagccuuaccaaguuc

SEQ ID NO: 890430 - RNA, 19 nt, Homo sapiens
ccagcaccauuacuugaug

SEQ ID NO: 890431 - RNA, 19 nt, Homo sapiens
gaggauccugccaacauuu

SEQ ID NO: 890432 - RNA, 19 nt, Homo sapiens
uaaugagcuuccuugcaaa

SEQ ID NO: 890433 - RNA, 19 nt, Homo sapiens
ggcaacagucacagccuua

SEQ ID NO: 890434 - RNA, 19 nt, Homo sapiens
gagccagcgugaccaacga

SEQ ID NO: 890435 - RNA, 19 nt, Homo sapiens
ccuuugcucuucaaguauu

SEQ ID NO: 890436 - RNA, 19 nt, Homo sapiens
cagcaccauuacuugauga

SEQ ID NO: 890437 - RNA, 19 nt, Homo sapiens
gguugcaucugcuaaagag

SEQ ID NO: 890438 - RNA, 19 nt, Homo sapiens
ccugguagcugggauuaca

SEQ ID NO: 890439 - RNA, 19 nt, Homo sapiens
uuuacagcauuccacauuu

SEQ ID NO: 890440 - RNA, 19 nt, Homo sapiens
caccacgcccagcuaauuu

SEQ ID NO: 890441 - RNA, 19 nt, Homo sapiens
cagccugcaucaucacaau

SEQ ID NO: 890442 - RNA, 19 nt, Homo sapiens
uaccaguuauuacccaaga

SEQ ID NO: 890443 - RNA, 19 nt, Homo sapiens
uagcuuggcguuaccaguu

SEQ ID NO: 890444 - RNA, 19 nt, Homo sapiens
agaacuagcacagcagaaa

SEQ ID NO: 890445 - RNA, 19 nt, Homo sapiens
uucaagauuuggucacuau

SEQ ID NO: 890446 - RNA, 19 nt, Homo sapiens
uucuagggauuccuccuua

SEQ ID NO: 890447 - RNA, 19 nt, Homo sapiens
gagcaacgucaccaguuuc

SEQ ID NO: 890448 - RNA, 19 nt, Homo sapiens
caaagagaacaagucuaaa

SEQ ID NO: 890449 - RNA, 19 nt, Homo sapiens
ccuagggcuuuguauuuca

SEQ ID NO: 890450 - RNA, 19 nt, Homo sapiens
gacacucuaauuaugauug

SEQ ID NO: 890451 - RNA, 19 nt, Homo sapiens
aaccuugucagauguagua

SEQ ID NO: 890452 - RNA, 19 nt, Homo sapiens
ugaggaaggauuugaugga

SEQ ID NO: 890453 - RNA, 19 nt, Homo sapiens
ccuucaugcucuagagaaa

SEQ ID NO: 890454 - RNA, 19 nt, Homo sapiens
uuacagcauuccacauuuu

SEQ ID NO: 890455 - RNA, 19 nt, Homo sapiens
ucucauacuuacucaagca

SEQ ID NO: 890456 - RNA, 19 nt, Homo sapiens
gagacaagagaggaacauu

SEQ ID NO: 890457 - RNA, 19 nt, Homo sapiens
cuagggcuuuguauuucaa

SEQ ID NO: 890458 - RNA, 19 nt, Homo sapiens
ucacaaugccaacacaucu

SEQ ID NO: 890459 - RNA, 19 nt, Homo sapiens
gauuggaccaguaucaucu

SEQ ID NO: 890460 - RNA, 19 nt, Homo sapiens
gaugaagauguauacaauc

SEQ ID NO: 890461 - RNA, 19 nt, Homo sapiens
ggccaauucuguaguauua

SEQ ID NO: 890462 - RNA, 19 nt, Homo sapiens
ugaagaaacugaugagauu

SEQ ID NO: 890463 - RNA, 19 nt, Homo sapiens
gaaacaacauucuggauca

SEQ ID NO: 890464 - RNA, 19 nt, Homo sapiens
gaaauaaggacaugaagga

SEQ ID NO: 890465 - RNA, 19 nt, Homo sapiens
gaugagauuucaccacaaa

SEQ ID NO: 890466 - RNA, 19 nt, Homo sapiens
uauguaagcccuugcauua

SEQ ID NO: 890467 - RNA, 19 nt, Homo sapiens
uaacagggcuuccaaagac

SEQ ID NO: 890468 - RNA, 19 nt, Homo sapiens
gaccaaagcaauuauaguu

SEQ ID NO: 890469 - RNA, 19 nt, Homo sapiens
guaagcccuugcauuauuu

SEQ ID NO: 890470 - RNA, 19 nt, Homo sapiens
gaucauuucuugugugagu

SEQ ID NO: 890471 - RNA, 19 nt, Homo sapiens
aucaugaucuggaguauua

SEQ ID NO: 890472 - RNA, 19 nt, Homo sapiens
gaucucaucuuacuguagu

SEQ ID NO: 890473 - RNA, 19 nt, Homo sapiens
uguaagcccuugcauuauu

SEQ ID NO: 890474 - RNA, 19 nt, Homo sapiens
gccaucuucuacuuaauua

SEQ ID NO: 890475 - RNA, 19 nt, Homo sapiens
ccucucauccuuauucuua

SEQ ID NO: 890476 - RNA, 19 nt, Homo sapiens
ucauccaacucuauguuua

SEQ ID NO: 890477 - RNA, 19 nt, Homo sapiens
gauaagaccaucagcuaug

SEQ ID NO: 890478 - RNA, 19 nt, Homo sapiens
ucacaccucucauccuuau

SEQ ID NO: 890479 - RNA, 19 nt, Homo sapiens
gaucuggaguauuaguuug

SEQ ID NO: 890480 - RNA, 19 nt, Homo sapiens
aaagaggaauugcaaguca

SEQ ID NO: 890481 - RNA, 19 nt, Homo sapiens
ccaaagcaauuauaguucu

SEQ ID NO: 890482 - RNA, 19 nt, Homo sapiens
acaacauucuggaucauuu

SEQ ID NO: 890483 - RNA, 19 nt, Homo sapiens
ccaauucuguaguauuaug

SEQ ID NO: 890484 - RNA, 19 nt, Homo sapiens
uaacacagccaucauucuu

SEQ ID NO: 890485 - RNA, 19 nt, Homo sapiens
gaaggaugcccugaagaaa

SEQ ID NO: 890486 - RNA, 19 nt, Homo sapiens
gcaaguuccucacccucuu

SEQ ID NO: 890487 - RNA, 19 nt, Homo sapiens
guacacucacucugaauuu

SEQ ID NO: 890488 - RNA, 19 nt, Homo sapiens
gaagaaacugaugagauuu

SEQ ID NO: 890489 - RNA, 19 nt, Homo sapiens
gcuguuauguccuaugauc

SEQ ID NO: 890490 - RNA, 19 nt, Homo sapiens
gcuuuaggcauuauaauug

SEQ ID NO: 890491 - RNA, 19 nt, Homo sapiens
guaguauuauguacacuca

SEQ ID NO: 890492 - RNA, 19 nt, Homo sapiens
cuagaucuauguuucacaa

SEQ ID NO: 890493 - RNA, 19 nt, Homo sapiens
ugaaggaugcccugaagaa

SEQ ID NO: 890494 - RNA, 19 nt, Homo sapiens
guaacagggcuuccaaaga

SEQ ID NO: 890495 - RNA, 19 nt, Homo sapiens
ccucacaccucucauccuu

SEQ ID NO: 890496 - RNA, 19 nt, Homo sapiens
ccaaagaccagggcaaguu

SEQ ID NO: 890497 - RNA, 19 nt, Homo sapiens
guauuaguuuggccaauuc

SEQ ID NO: 890498 - RNA, 19 nt, Homo sapiens
ccaaagcugugcugagaac

SEQ ID NO: 890499 - RNA, 19 nt, Homo sapiens
uauauccuauggcuacauu

SEQ ID NO: 890500 - RNA, 19 nt, Homo sapiens
ugccaaagcugugcugaga

SEQ ID NO: 890501 - RNA, 19 nt, Homo sapiens
caugaaggaugcccugaag

SEQ ID NO: 890502 - RNA, 19 nt, Homo sapiens
uauguacacucacucugaa

SEQ ID NO: 890503 - RNA, 19 nt, Homo sapiens
ggaacuauuaucuacaugu

SEQ ID NO: 890504 - RNA, 19 nt, Homo sapiens
cauucuggaucauuucuug

SEQ ID NO: 890505 - RNA, 19 nt, Homo sapiens
gucaugaacccacaucuau

SEQ ID NO: 890506 - RNA, 19 nt, Homo sapiens
gaucuauguuucacaacca

SEQ ID NO: 890507 - RNA, 19 nt, Homo sapiens
uugcaucucuccuggauuc

SEQ ID NO: 890508 - RNA, 19 nt, Homo sapiens
gaauaccuguggaucucau

SEQ ID NO: 890509 - RNA, 19 nt, Homo sapiens
cauuauaauuguccucaca

SEQ ID NO: 890510 - RNA, 19 nt, Homo sapiens
cuauggaacuauuaucuac

SEQ ID NO: 890511 - RNA, 19 nt, Homo sapiens
gcaaugaauaccuguggau

SEQ ID NO: 890512 - RNA, 19 nt, Homo sapiens
ggaccaaagcaauuauagu

SEQ ID NO: 890513 - RNA, 19 nt, Homo sapiens
uggaucauuucuuguguga

SEQ ID NO: 890514 - RNA, 19 nt, Homo sapiens
aguauuaguuuggccaauu

SEQ ID NO: 890515 - RNA, 19 nt, Homo sapiens
uggcuguuauguccuauga

SEQ ID NO: 890516 - RNA, 19 nt, Homo sapiens
gucgccaucuucuacuuaa

SEQ ID NO: 890517 - RNA, 19 nt, Homo sapiens
caaagaccagggcaaguuc

SEQ ID NO: 890518 - RNA, 19 nt, Homo sapiens
uuacuguagugucuauguu

SEQ ID NO: 890519 - RNA, 19 nt, Homo sapiens
gguaacacagccaucauuc

SEQ ID NO: 890520 - RNA, 19 nt, Homo sapiens
gcucauuuacaccuuaaga

SEQ ID NO: 890521 - RNA, 19 nt, Homo sapiens
accuguggaucucaucuua

SEQ ID NO: 890522 - RNA, 19 nt, Homo sapiens
ucagcuauguggguuguau

SEQ ID NO: 890523 - RNA, 19 nt, Homo sapiens
agaggaauugcaagucaua

SEQ ID NO: 890524 - RNA, 19 nt, Homo sapiens
ggguaacacagccaucauu

SEQ ID NO: 890525 - RNA, 19 nt, Homo sapiens
cuauguggguuguaucauc

SEQ ID NO: 890526 - RNA, 19 nt, Homo sapiens
uuuccuagaucuauguuuc

SEQ ID NO: 890527 - RNA, 19 nt, Homo sapiens
caaguuccucacccucuuu

SEQ ID NO: 890528 - RNA, 19 nt, Homo sapiens
gugucuauguucuauggaa

SEQ ID NO: 890529 - RNA, 19 nt, Homo sapiens
agucucaacccgcucauuu

SEQ ID NO: 890530 - RNA, 19 nt, Homo sapiens
gguaacagggcuuccaaag

SEQ ID NO: 890531 - RNA, 19 nt, Homo sapiens
uguagugucuauguucuau

SEQ ID NO: 890532 - RNA, 19 nt, Homo sapiens
caucagcuauguggguugu

SEQ ID NO: 890533 - RNA, 19 nt, Homo sapiens
ccgcucauuuacaccuuaa

SEQ ID NO: 890534 - RNA, 19 nt, Homo sapiens
gucucaacccgcucauuua

SEQ ID NO: 890535 - RNA, 19 nt, Homo sapiens
caacauucuggaucauuuc

SEQ ID NO: 890536 - RNA, 19 nt, Homo sapiens
gcccuugcauuauuuugua

SEQ ID NO: 890537 - RNA, 19 nt, Homo sapiens
aagcugugcugagaacgaa

SEQ ID NO: 890538 - RNA, 19 nt, Homo sapiens
uacacucacucugaauuug

SEQ ID NO: 890539 - RNA, 19 nt, Homo sapiens
aaacaacauucuggaucau

SEQ ID NO: 890540 - RNA, 19 nt, Homo sapiens
uaucauccaacucuauguu

SEQ ID NO: 890541 - RNA, 19 nt, Homo sapiens
auaagaccaucagcuaugu

SEQ ID NO: 890542 - RNA, 19 nt, Homo sapiens
cgccaucuucuacuuaauu

SEQ ID NO: 890543 - RNA, 19 nt, Homo sapiens
ucaacccgcucauuuacac

SEQ ID NO: 890544 - RNA, 19 nt, Homo sapiens
guggaucucaucuuacugu

SEQ ID NO: 890545 - RNA, 19 nt, Homo sapiens
acaccucucauccuuauuc

SEQ ID NO: 890546 - RNA, 19 nt, Homo sapiens
uuauguacacucacucuga

SEQ ID NO: 890547 - RNA, 19 nt, Homo sapiens
ggaguugucgccaucuucu

SEQ ID NO: 890548 - RNA, 19 nt, Homo sapiens
uuuggccaauucuguagua

SEQ ID NO: 890549 - RNA, 19 nt, Homo sapiens
ugaucuggaguauuaguuu

SEQ ID NO: 890550 - RNA, 19 nt, Homo sapiens
uagugucuauguucuaugg

SEQ ID NO: 890551 - RNA, 19 nt, Homo sapiens
cucagaugcuggucaacuu

SEQ ID NO: 890552 - RNA, 19 nt, Homo sapiens
uaaagaggaauugcaaguc

SEQ ID NO: 890553 - RNA, 19 nt, Homo sapiens
gcccugaagaaacugauga

SEQ ID NO: 890554 - RNA, 19 nt, Homo sapiens
aggaugcccugaagaaacu

SEQ ID NO: 890555 - RNA, 19 nt, Homo sapiens
caggaguugucgccaucuu

SEQ ID NO: 890556 - RNA, 19 nt, Homo sapiens
caguugaaaugucuguuuu

SEQ ID NO: 890557 - RNA, 19 nt, Homo sapiens
guuauguccuaugaucguu

SEQ ID NO: 890558 - RNA, 19 nt, Homo sapiens
ugaugagauuucaccacaa

SEQ ID NO: 890559 - RNA, 19 nt, Homo sapiens
cugaagaaacugaugagau

SEQ ID NO: 890560 - RNA, 19 nt, Homo sapiens
cagcgaaaagcaaugaaua

SEQ ID NO: 890561 - RNA, 19 nt, Homo sapiens
gcacuucauuccuccuuua

SEQ ID NO: 890562 - RNA, 19 nt, Homo sapiens
ggaaguaguucucuuugug

SEQ ID NO: 890563 - RNA, 19 nt, Homo sapiens
guaguucucuuugugguua

SEQ ID NO: 890564 - RNA, 19 nt, Homo sapiens
ggaaaccuguucaucauca

SEQ ID NO: 890565 - RNA, 19 nt, Homo sapiens
ccacugggcuucagaaagu

SEQ ID NO: 890566 - RNA, 19 nt, Homo sapiens
ccaauguacuucuuccuuu

SEQ ID NO: 890567 - RNA, 19 nt, Homo sapiens
caacuuuacuuuguucuug

SEQ ID NO: 890568 - RNA, 19 nt, Homo sapiens
gcauuacacuguccucaug

SEQ ID NO: 890569 - RNA, 19 nt, Homo sapiens
caaguucauugcccucuuu

SEQ ID NO: 890570 - RNA, 19 nt, Homo sapiens
gaucagggcaaguucauug

SEQ ID NO: 890571 - RNA, 19 nt, Homo sapiens
guacugagcaugcaaucaa

SEQ ID NO: 890572 - RNA, 19 nt, Homo sapiens
ccucuaaucuacacucuca

SEQ ID NO: 890573 - RNA, 19 nt, Homo sapiens
gaaaguguuuaggacaugu

SEQ ID NO: 890574 - RNA, 19 nt, Homo sapiens
ggacucccaucuccacaca

SEQ ID NO: 890575 - RNA, 19 nt, Homo sapiens
gaaaagaccaucucguaug

SEQ ID NO: 890576 - RNA, 19 nt, Homo sapiens
caauguacuucuuccuuuc

SEQ ID NO: 890577 - RNA, 19 nt, Homo sapiens
ugaugacacugacaggaaa

SEQ ID NO: 890578 - RNA, 19 nt, Homo sapiens
uguguagaccuuugcauua

SEQ ID NO: 890579 - RNA, 19 nt, Homo sapiens
uuucaaaccucucauuucu

SEQ ID NO: 890580 - RNA, 19 nt, Homo sapiens
cagaaaguguuuaggacau

SEQ ID NO: 890581 - RNA, 19 nt, Homo sapiens
gcuggaaguaguucucuuu

SEQ ID NO: 890582 - RNA, 19 nt, Homo sapiens
gugguuaucuugaucuucu

SEQ ID NO: 890583 - RNA, 19 nt, Homo sapiens
ucagaaacaagcauguaaa

SEQ ID NO: 890584 - RNA, 19 nt, Homo sapiens
ggccucagcuggaaguagu

SEQ ID NO: 890585 - RNA, 19 nt, Homo sapiens
guucaacuuuacuuuguuc

SEQ ID NO: 890586 - RNA, 19 nt, Homo sapiens
guugucacaccgagucuua

SEQ ID NO: 890587 - RNA, 19 nt, Homo sapiens
cuucauuccuccuuuacuu

SEQ ID NO: 890588 - RNA, 19 nt, Homo sapiens
cuucuuggguaauugguuu

SEQ ID NO: 890589 - RNA, 19 nt, Homo sapiens
acacaccaauguacuucuu

SEQ ID NO: 890590 - RNA, 19 nt, Homo sapiens
gacaucgccuaguggauca

SEQ ID NO: 890591 - RNA, 19 nt, Homo sapiens
gaaacaagcauguaaaagg

SEQ ID NO: 890592 - RNA, 19 nt, Homo sapiens
gcacuucugcguuuaucau

SEQ ID NO: 890593 - RNA, 19 nt, Homo sapiens
uaauuggccucagcuggaa

SEQ ID NO: 890594 - RNA, 19 nt, Homo sapiens
uaaucuacacucucagaaa

SEQ ID NO: 890595 - RNA, 19 nt, Homo sapiens
uuccagcacuucugcguuu

SEQ ID NO: 890596 - RNA, 19 nt, Homo sapiens
uuauguagcuguguguaga

SEQ ID NO: 890597 - RNA, 19 nt, Homo sapiens
guagcuguguguagaccuu

SEQ ID NO: 890598 - RNA, 19 nt, Homo sapiens
ccagcucuaucccucaguu

SEQ ID NO: 890599 - RNA, 19 nt, Homo sapiens
gaaaccuguucaucaucau

SEQ ID NO: 890600 - RNA, 19 nt, Homo sapiens
gguucaacuuuacuuuguu

SEQ ID NO: 890601 - RNA, 19 nt, Homo sapiens
aaucuacacucucagaaac

SEQ ID NO: 890602 - RNA, 19 nt, Homo sapiens
ucaucaucauccugucaua

SEQ ID NO: 890603 - RNA, 19 nt, Homo sapiens
acauguggagcccaucuua

SEQ ID NO: 890604 - RNA, 19 nt, Homo sapiens
agaaaguguuuaggacaug

SEQ ID NO: 890605 - RNA, 19 nt, Homo sapiens
gaccuuugcauuacacugu

SEQ ID NO: 890606 - RNA, 19 nt, Homo sapiens
guguagaccuuugcauuac

SEQ ID NO: 890607 - RNA, 19 nt, Homo sapiens
ggaaaagaccaucucguau

SEQ ID NO: 890608 - RNA, 19 nt, Homo sapiens
ugacacccaugcaaaugag

SEQ ID NO: 890609 - RNA, 19 nt, Homo sapiens
uggaaguaguucucuuugu

SEQ ID NO: 890610 - RNA, 19 nt, Homo sapiens
ugguucaacuuuacuuugu

SEQ ID NO: 890611 - RNA, 19 nt, Homo sapiens
gucuuaauccucuaaucua

SEQ ID NO: 890612 - RNA, 19 nt, Homo sapiens
guguguagaccuuugcauu

SEQ ID NO: 890613 - RNA, 19 nt, Homo sapiens
cggaaaagaccaucucgua

SEQ ID NO: 890614 - RNA, 19 nt, Homo sapiens
gagucuuaauccucuaauc

SEQ ID NO: 890615 - RNA, 19 nt, Homo sapiens
guucucauaccucucauuc

SEQ ID NO: 890616 - RNA, 19 nt, Homo sapiens
cuucagaaaguguuuagga

SEQ ID NO: 890617 - RNA, 19 nt, Homo sapiens
caaccacugggcuucagaa

SEQ ID NO: 890618 - RNA, 19 nt, Homo sapiens
cugcguuuaucauguguug

SEQ ID NO: 890619 - RNA, 19 nt, Homo sapiens
gggcagcgaagagacuauu

SEQ ID NO: 890620 - RNA, 19 nt, Homo sapiens
ucuacacucucagaaacaa

SEQ ID NO: 890621 - RNA, 19 nt, Homo sapiens
ggacauguggagcccaucu

SEQ ID NO: 890622 - RNA, 19 nt, Homo sapiens
ccucguuucugccacuugu

SEQ ID NO: 890623 - RNA, 19 nt, Homo sapiens
gaucuucuaccugaugaca

SEQ ID NO: 890624 - RNA, 19 nt, Homo sapiens
cuucugcguuuaucaugug

SEQ ID NO: 890625 - RNA, 19 nt, Homo sapiens
uuuacuaucucagcacuuc

SEQ ID NO: 890626 - RNA, 19 nt, Homo sapiens
uugcaugguucaacuuuac

SEQ ID NO: 890627 - RNA, 19 nt, Homo sapiens
ccacacaccaauguacuuc

SEQ ID NO: 890628 - RNA, 19 nt, Homo sapiens
gcagcgaagagacuauugg

SEQ ID NO: 890629 - RNA, 19 nt, Homo sapiens
ucucagaaacaagcaugua

SEQ ID NO: 890630 - RNA, 19 nt, Homo sapiens
caucuccacacaccaaugu

SEQ ID NO: 890631 - RNA, 19 nt, Homo sapiens
gggcuucagaaaguguuua

SEQ ID NO: 890632 - RNA, 19 nt, Homo sapiens
cagcacuucugcguuuauc

SEQ ID NO: 890633 - RNA, 19 nt, Homo sapiens
guacuucuuccuuucaaac

SEQ ID NO: 890634 - RNA, 19 nt, Homo sapiens
cucagaaacaagcauguaa

SEQ ID NO: 890635 - RNA, 19 nt, Homo sapiens
guagaccuuugcauuacac

SEQ ID NO: 890636 - RNA, 19 nt, Homo sapiens
caugguucaacuuuacuuu

SEQ ID NO: 890637 - RNA, 19 nt, Homo sapiens
aaaccucucauuucuggau

SEQ ID NO: 890638 - RNA, 19 nt, Homo sapiens
ccuuucaaaccucucauuu

SEQ ID NO: 890639 - RNA, 19 nt, Homo sapiens
gcacaugucuucuuuccua

SEQ ID NO: 890640 - RNA, 19 nt, Homo sapiens
gaaagagacuccagggaaa

SEQ ID NO: 890641 - RNA, 19 nt, Homo sapiens
gcaaaucuauaaucacaug

SEQ ID NO: 890642 - RNA, 19 nt, Homo sapiens
agaaggagcugcuggauga

SEQ ID NO: 890643 - RNA, 19 nt, Homo sapiens
cuacuacccuucccacaua

SEQ ID NO: 890644 - RNA, 19 nt, Homo sapiens
gguuuaggauuucaacaua

SEQ ID NO: 890645 - RNA, 19 nt, Homo sapiens
cuggagagcugcuuaauau

SEQ ID NO: 890646 - RNA, 19 nt, Homo sapiens
gaaagggacuaccaacucu

SEQ ID NO: 890647 - RNA, 19 nt, Homo sapiens
gaacagggaacgagaagga

SEQ ID NO: 890648 - RNA, 19 nt, Homo sapiens
ugaccaggcugaucucaaa

SEQ ID NO: 890649 - RNA, 19 nt, Homo sapiens
uaagacagguugaaucaca

SEQ ID NO: 890650 - RNA, 19 nt, Homo sapiens
gauaagacagguugaauca

SEQ ID NO: 890651 - RNA, 19 nt, Homo sapiens
ugacagugauggccuuuga

SEQ ID NO: 890652 - RNA, 19 nt, Homo sapiens
caaagaagaccaucagcuu

SEQ ID NO: 890653 - RNA, 19 nt, Homo sapiens
ggaaggacauaagcauuca

SEQ ID NO: 890654 - RNA, 19 nt, Homo sapiens
gcagauuucaugccuauug

SEQ ID NO: 890655 - RNA, 19 nt, Homo sapiens
cguguuagcuuaguucauu

SEQ ID NO: 890656 - RNA, 19 nt, Homo sapiens
aagaacagcuaaucugaga

SEQ ID NO: 890657 - RNA, 19 nt, Homo sapiens
agacaacguuugaucagaa

SEQ ID NO: 890658 - RNA, 19 nt, Homo sapiens
gccuauuucugguuauaua

SEQ ID NO: 890659 - RNA, 19 nt, Homo sapiens
caaauacacagaauggauu

SEQ ID NO: 890660 - RNA, 19 nt, Homo sapiens
gcaaauacacagaauggau

SEQ ID NO: 890661 - RNA, 19 nt, Homo sapiens
gaacuacuccaucauagca

SEQ ID NO: 890662 - RNA, 19 nt, Homo sapiens
gaggaaaggaggaacuaaa

SEQ ID NO: 890663 - RNA, 19 nt, Homo sapiens
ugucaucacuucuauagau

SEQ ID NO: 890664 - RNA, 19 nt, Homo sapiens
gcaaggccgugaagagagu

SEQ ID NO: 890665 - RNA, 19 nt, Homo sapiens
caagaacaggccaugguua

SEQ ID NO: 890666 - RNA, 19 nt, Homo sapiens
uagcagccuuucaaaugua

SEQ ID NO: 890667 - RNA, 19 nt, Homo sapiens
aaugcaggcucuauuguuu

SEQ ID NO: 890668 - RNA, 19 nt, Homo sapiens
aauaagccaucuaagugua

SEQ ID NO: 890669 - RNA, 19 nt, Homo sapiens
guggcuauguuaucuauga

SEQ ID NO: 890670 - RNA, 19 nt, Homo sapiens
acacauaaauugggugguu

SEQ ID NO: 890671 - RNA, 19 nt, Homo sapiens
ccagggaauuggcacguuu

SEQ ID NO: 890672 - RNA, 19 nt, Homo sapiens
gaggaugggaggcccuuua

SEQ ID NO: 890673 - RNA, 19 nt, Homo sapiens
gcaaaggcuugaagaacag

SEQ ID NO: 890674 - RNA, 19 nt, Homo sapiens
uacacagaauggauuguua

SEQ ID NO: 890675 - RNA, 19 nt, Homo sapiens
ucacuguccauucuuaaua

SEQ ID NO: 890676 - RNA, 19 nt, Homo sapiens
gaaauccaguuggcugugu

SEQ ID NO: 890677 - RNA, 19 nt, Homo sapiens
uaucacaagcuacacauaa

SEQ ID NO: 890678 - RNA, 19 nt, Homo sapiens
ggagagcugcuuaauauac

SEQ ID NO: 890679 - RNA, 19 nt, Homo sapiens
ucacuuaacccucucguau

SEQ ID NO: 890680 - RNA, 19 nt, Homo sapiens
ccucuucccucaugaccua

SEQ ID NO: 890681 - RNA, 19 nt, Homo sapiens
ccacacccuuuaggauaua

SEQ ID NO: 890682 - RNA, 19 nt, Homo sapiens
gagauagguagcuccauaa

SEQ ID NO: 890683 - RNA, 19 nt, Homo sapiens
caaguucuuuggucucuuc

SEQ ID NO: 890684 - RNA, 19 nt, Homo sapiens
gagauaccuccuacaauga

SEQ ID NO: 890685 - RNA, 19 nt, Homo sapiens
gaagucagaggcaccaaug

SEQ ID NO: 890686 - RNA, 19 nt, Homo sapiens
gauuaaggcagauuucaug

SEQ ID NO: 890687 - RNA, 19 nt, Homo sapiens
ccaugccuauuucugguua

SEQ ID NO: 890688 - RNA, 19 nt, Homo sapiens
gcuggagagcugcuuaaua

SEQ ID NO: 890689 - RNA, 19 nt, Homo sapiens
cagcucccaugcaaaguuu

SEQ ID NO: 890690 - RNA, 19 nt, Homo sapiens
guucuuuggucucuucuau

SEQ ID NO: 890691 - RNA, 19 nt, Homo sapiens
caauuuagcagccuuucaa

SEQ ID NO: 890692 - RNA, 19 nt, Homo sapiens
gccaucaucuuggugguuu

SEQ ID NO: 890693 - RNA, 19 nt, Homo sapiens
cagauuucaugccuauuga

SEQ ID NO: 890694 - RNA, 19 nt, Homo sapiens
ggccuugccuugcuucuca

SEQ ID NO: 890695 - RNA, 19 nt, Homo sapiens
aaaaguggcucauaucuuc

SEQ ID NO: 890696 - RNA, 19 nt, Homo sapiens
cuacguaggucauguaagc

SEQ ID NO: 890697 - RNA, 19 nt, Homo sapiens
gggaacuacuccaucauag

SEQ ID NO: 890698 - RNA, 19 nt, Homo sapiens
cuaucacuguccauucuua

SEQ ID NO: 890699 - RNA, 19 nt, Homo sapiens
ccauaaggcacacaaauuc

SEQ ID NO: 890700 - RNA, 19 nt, Homo sapiens
gagucugguucaaucgaua

SEQ ID NO: 890701 - RNA, 19 nt, Homo sapiens
agacugaaauaaaggugaa

SEQ ID NO: 890702 - RNA, 19 nt, Homo sapiens
ugaagaacagcuaaucuga

SEQ ID NO: 890703 - RNA, 19 nt, Homo sapiens
gcacucaggagguuacuag

SEQ ID NO: 890704 - RNA, 19 nt, Homo sapiens
gcucagucauugcugucua

SEQ ID NO: 890705 - RNA, 19 nt, Homo sapiens
ggacaaggagccagggaau

SEQ ID NO: 890706 - RNA, 19 nt, Homo sapiens
gagagcugcuuaauauacu

SEQ ID NO: 890707 - RNA, 19 nt, Homo sapiens
ccuaaucacugcccaaagg

SEQ ID NO: 890708 - RNA, 19 nt, Homo sapiens
caauugucaugucagugua

SEQ ID NO: 890709 - RNA, 19 nt, Homo sapiens
ggacagagagauaaaagaa

SEQ ID NO: 890710 - RNA, 19 nt, Homo sapiens
gagagggacagagagauaa

SEQ ID NO: 890711 - RNA, 19 nt, Homo sapiens
agaaagagagggacagaga

SEQ ID NO: 890712 - RNA, 19 nt, Homo sapiens
ucucugaccucuccuucuu

SEQ ID NO: 890713 - RNA, 19 nt, Homo sapiens
gauaccuccuacaaugaaa

SEQ ID NO: 890714 - RNA, 19 nt, Homo sapiens
gaccucugcuuuaccacaa

SEQ ID NO: 890715 - RNA, 19 nt, Homo sapiens
auaauaagccaucuaagug

SEQ ID NO: 890716 - RNA, 19 nt, Homo sapiens
cuggacaccuugcauguau

SEQ ID NO: 890717 - RNA, 19 nt, Homo sapiens
caucacuucuauagauuuc

SEQ ID NO: 890718 - RNA, 19 nt, Homo sapiens
uaaaagaaauugggugaga

SEQ ID NO: 890719 - RNA, 19 nt, Homo sapiens
gacgagguuucaccauguu

SEQ ID NO: 890720 - RNA, 19 nt, Homo sapiens
gcuccacucuccaauguac

SEQ ID NO: 890721 - RNA, 19 nt, Homo sapiens
aagaacaggccaugguuaa

SEQ ID NO: 890722 - RNA, 19 nt, Homo sapiens
uuagcagccuuucaaaugu

SEQ ID NO: 890723 - RNA, 19 nt, Homo sapiens
caaguuacagccagaggaa

SEQ ID NO: 890724 - RNA, 19 nt, Homo sapiens
cuucuucuauugacccuuu

SEQ ID NO: 890725 - RNA, 19 nt, Homo sapiens
acaaggagccagggaauug

SEQ ID NO: 890726 - RNA, 19 nt, Homo sapiens
agacgagguuucaccaugu

SEQ ID NO: 890727 - RNA, 19 nt, Homo sapiens
agagagggacagagagaua

SEQ ID NO: 890728 - RNA, 19 nt, Homo sapiens
ucuaugagagggagaauga

SEQ ID NO: 890729 - RNA, 19 nt, Homo sapiens
aggcagugcugaggauuaa

SEQ ID NO: 890730 - RNA, 19 nt, Homo sapiens
gaggucccaucucugauuc

SEQ ID NO: 890731 - RNA, 19 nt, Homo sapiens
gcagcucccaugcaaaguu

SEQ ID NO: 890732 - RNA, 19 nt, Homo sapiens
ggccugcuuucugauuaua

SEQ ID NO: 890733 - RNA, 19 nt, Homo sapiens
caccgucacucuaucuuca

SEQ ID NO: 890734 - RNA, 19 nt, Homo sapiens
cauaucuucuccagccaaa

SEQ ID NO: 890735 - RNA, 19 nt, Homo sapiens
ccaauugucaugucagugu

SEQ ID NO: 890736 - RNA, 19 nt, Homo sapiens
gcaacacacucaucauccu

SEQ ID NO: 890737 - RNA, 19 nt, Homo sapiens
gagcagagacagaaaagaa

SEQ ID NO: 890738 - RNA, 19 nt, Homo sapiens
agcaaaggcuugaagaaca

SEQ ID NO: 890739 - RNA, 19 nt, Homo sapiens
gaagauagguuuagcagua

SEQ ID NO: 890740 - RNA, 19 nt, Homo sapiens
ggauuuagcuuguuaauug

SEQ ID NO: 890741 - RNA, 19 nt, Homo sapiens
gaaauuaucugccuuauac

SEQ ID NO: 890742 - RNA, 19 nt, Homo sapiens
ucacaacuaucaaacguua

SEQ ID NO: 890743 - RNA, 19 nt, Homo sapiens
gaagagaggagcaguauug

SEQ ID NO: 890744 - RNA, 19 nt, Homo sapiens
gcugauagcuccuccaugu

SEQ ID NO: 890745 - RNA, 19 nt, Homo sapiens
ugaagaagaucaaguuaga

SEQ ID NO: 890746 - RNA, 19 nt, Homo sapiens
ggucaaagccuuccucuga

SEQ ID NO: 890747 - RNA, 19 nt, Homo sapiens
gcagagaaauacagccauu

SEQ ID NO: 890748 - RNA, 19 nt, Homo sapiens
uaaauaaggccaugucuga

SEQ ID NO: 890749 - RNA, 19 nt, Homo sapiens
gcaagaaucacaaauggaa

SEQ ID NO: 890750 - RNA, 19 nt, Homo sapiens
gauguuaaagcaacuguua

SEQ ID NO: 890751 - RNA, 19 nt, Homo sapiens
aaacaaacccuaagaggaa

SEQ ID NO: 890752 - RNA, 19 nt, Homo sapiens
uaauauagccuguaugguu

SEQ ID NO: 890753 - RNA, 19 nt, Homo sapiens
gaacacaccauccauaucu

SEQ ID NO: 890754 - RNA, 19 nt, Homo sapiens
gaaaggaagaagaaguuaa

SEQ ID NO: 890755 - RNA, 19 nt, Homo sapiens
ugaagcaugugaaacagua

SEQ ID NO: 890756 - RNA, 19 nt, Homo sapiens
aaaggaagauguucuguag

SEQ ID NO: 890757 - RNA, 19 nt, Homo sapiens
gaagaaacucccaucaaga

SEQ ID NO: 890758 - RNA, 19 nt, Homo sapiens
gcccuaugcucacuaauga

SEQ ID NO: 890759 - RNA, 19 nt, Homo sapiens
cuacauuccuaucuuauug

SEQ ID NO: 890760 - RNA, 19 nt, Homo sapiens
ggaaauuaucugccuuaua

SEQ ID NO: 890761 - RNA, 19 nt, Homo sapiens
cuaguuagcauacacauuu

SEQ ID NO: 890762 - RNA, 19 nt, Homo sapiens
gaagaaagguaagaaagcu

SEQ ID NO: 890763 - RNA, 19 nt, Homo sapiens
cagaagguuucgaaaugua

SEQ ID NO: 890764 - RNA, 19 nt, Homo sapiens
caagaacacaccauccaua

SEQ ID NO: 890765 - RNA, 19 nt, Homo sapiens
cgagcugacucccacguua

SEQ ID NO: 890766 - RNA, 19 nt, Homo sapiens
gaggagaaaccacaacauu

SEQ ID NO: 890767 - RNA, 19 nt, Homo sapiens
aauauagccuguaugguuu

SEQ ID NO: 890768 - RNA, 19 nt, Homo sapiens
caucugguguuucagcaua

SEQ ID NO: 890769 - RNA, 19 nt, Homo sapiens
ugaaagcuauugagaucuu

SEQ ID NO: 890770 - RNA, 19 nt, Homo sapiens
cgacuuacauagcucaaau

SEQ ID NO: 890771 - RNA, 19 nt, Homo sapiens
cagcuuaccucccaguaga

SEQ ID NO: 890772 - RNA, 19 nt, Homo sapiens
aauuugagcuuguguucua

SEQ ID NO: 890773 - RNA, 19 nt, Homo sapiens
guauuguucucauguaaga

SEQ ID NO: 890774 - RNA, 19 nt, Homo sapiens
agaagaaacucccaucaag

SEQ ID NO: 890775 - RNA, 19 nt, Homo sapiens
cgacaauucuagacagaga

SEQ ID NO: 890776 - RNA, 19 nt, Homo sapiens
ggagcaguauugacaacaa

SEQ ID NO: 890777 - RNA, 19 nt, Homo sapiens
gcaugaagaagaucaaguu

SEQ ID NO: 890778 - RNA, 19 nt, Homo sapiens
uggaacaccuggcauguga

SEQ ID NO: 890779 - RNA, 19 nt, Homo sapiens
aaugaaagcuauugagauc

SEQ ID NO: 890780 - RNA, 19 nt, Homo sapiens
gauguuguguuaguuaaga

SEQ ID NO: 890781 - RNA, 19 nt, Homo sapiens
gagaggagcaguauugaca

SEQ ID NO: 890782 - RNA, 19 nt, Homo sapiens
cuucaacccugcaguuaaa

SEQ ID NO: 890783 - RNA, 19 nt, Homo sapiens
ucacagaccugagaugaag

SEQ ID NO: 890784 - RNA, 19 nt, Homo sapiens
ugacugauguuguguuagu

SEQ ID NO: 890785 - RNA, 19 nt, Homo sapiens
gacugugucuguauuguug

SEQ ID NO: 890786 - RNA, 19 nt, Homo sapiens
uaggauguauguuggaauu

SEQ ID NO: 890787 - RNA, 19 nt, Homo sapiens
guuagacacuccagaggaa

SEQ ID NO: 890788 - RNA, 19 nt, Homo sapiens
aaugacugauguuguguua

SEQ ID NO: 890789 - RNA, 19 nt, Homo sapiens
aaaguugggcagagaaaua

SEQ ID NO: 890790 - RNA, 19 nt, Homo sapiens
guauaggcaucugguguuu

SEQ ID NO: 890791 - RNA, 19 nt, Homo sapiens
uguguucgguacaucauua

SEQ ID NO: 890792 - RNA, 19 nt, Homo sapiens
aaacucccaucaagacuga

SEQ ID NO: 890793 - RNA, 19 nt, Homo sapiens
cuucuacauuccuaucuua

SEQ ID NO: 890794 - RNA, 19 nt, Homo sapiens
aagaaugacugauguugug

SEQ ID NO: 890795 - RNA, 19 nt, Homo sapiens
ggagaagagaggagcagua

SEQ ID NO: 890796 - RNA, 19 nt, Homo sapiens
cacacugccuuaagguaua

SEQ ID NO: 890797 - RNA, 19 nt, Homo sapiens
guaccucuauugugccuau

SEQ ID NO: 890798 - RNA, 19 nt, Homo sapiens
aaacagugauucugagucu

SEQ ID NO: 890799 - RNA, 19 nt, Homo sapiens
gagaagagaggagcaguau

SEQ ID NO: 890800 - RNA, 19 nt, Homo sapiens
ggccaugucugacuucaag

SEQ ID NO: 890801 - RNA, 19 nt, Homo sapiens
ggacauucgacaugaaaga

SEQ ID NO: 890802 - RNA, 19 nt, Homo sapiens
gcaaaugcagauccucuug

SEQ ID NO: 890803 - RNA, 19 nt, Homo sapiens
cagaaguccuggcaagaau

SEQ ID NO: 890804 - RNA, 19 nt, Homo sapiens
acaaacacaugucugaaca

SEQ ID NO: 890805 - RNA, 19 nt, Homo sapiens
uaauggguauuucagauuc

SEQ ID NO: 890806 - RNA, 19 nt, Homo sapiens
gugccuauauuaaagguau

SEQ ID NO: 890807 - RNA, 19 nt, Homo sapiens
gcaaaguugggcagagaaa

SEQ ID NO: 890808 - RNA, 19 nt, Homo sapiens
cgagaagauuguccaguuc

SEQ ID NO: 890809 - RNA, 19 nt, Homo sapiens
acgagaagauuguccaguu

SEQ ID NO: 890810 - RNA, 19 nt, Homo sapiens
caaacuuucugccuucuac

SEQ ID NO: 890811 - RNA, 19 nt, Homo sapiens
ccuguaugguuucuacuuu

SEQ ID NO: 890812 - RNA, 19 nt, Homo sapiens
ggauacuaauucugcgaaa

SEQ ID NO: 890813 - RNA, 19 nt, Homo sapiens
gaaaagaaaggaaccaguu

SEQ ID NO: 890814 - RNA, 19 nt, Homo sapiens
ucaugaaucuugcugucaa

SEQ ID NO: 890815 - RNA, 19 nt, Homo sapiens
ucacaaauggcaaagauca

SEQ ID NO: 890816 - RNA, 19 nt, Homo sapiens
gcuauggugacuauuguuu

SEQ ID NO: 890817 - RNA, 19 nt, Homo sapiens
ggaauuugagcuuguguuc

SEQ ID NO: 890818 - RNA, 19 nt, Homo sapiens
ucagaagguuucgaaaugu

SEQ ID NO: 890819 - RNA, 19 nt, Homo sapiens
gcuucuagcuccggacauu

SEQ ID NO: 890820 - RNA, 19 nt, Homo sapiens
cuguaugguuucuacuuua

SEQ ID NO: 890821 - RNA, 19 nt, Homo sapiens
ccaaccaacucaggaugaa

SEQ ID NO: 890822 - RNA, 19 nt, Homo sapiens
gcuccuccauguugguaaa

SEQ ID NO: 890823 - RNA, 19 nt, Homo sapiens
guuaagaauugaagauagg

SEQ ID NO: 890824 - RNA, 19 nt, Homo sapiens
ccaccgccaccaccacuua

SEQ ID NO: 890825 - RNA, 19 nt, Homo sapiens
gaagguuucgaaauguaaa

SEQ ID NO: 890826 - RNA, 19 nt, Homo sapiens
ggaagauguucuguagcaa

SEQ ID NO: 890827 - RNA, 19 nt, Homo sapiens
aagauagguuuagcaguaa

SEQ ID NO: 890828 - RNA, 19 nt, Homo sapiens
gaagugacaccagcccuau

SEQ ID NO: 890829 - RNA, 19 nt, Homo sapiens
gcagauccucuugguguuu

SEQ ID NO: 890830 - RNA, 19 nt, Homo sapiens
caacucuggccaauauuga

SEQ ID NO: 890831 - RNA, 19 nt, Homo sapiens
caugaagaagaucaaguua

SEQ ID NO: 890832 - RNA, 19 nt, Homo sapiens
ccagugagccccauauuuu

SEQ ID NO: 890833 - RNA, 19 nt, Homo sapiens
gcuaaaagggacuaaauuu

SEQ ID NO: 890834 - RNA, 19 nt, Homo sapiens
uauaauaccagggaauuug

SEQ ID NO: 890835 - RNA, 19 nt, Homo sapiens
guaagaaugacugauguug

SEQ ID NO: 890836 - RNA, 19 nt, Homo sapiens
cagaagaaacucccaucaa

SEQ ID NO: 890837 - RNA, 19 nt, Homo sapiens
ccacacugccuuaagguau

SEQ ID NO: 890838 - RNA, 19 nt, Homo sapiens
ggaagaaagguaagaaagc

SEQ ID NO: 890839 - RNA, 19 nt, Homo sapiens
gaagaucgaccuauuauug

SEQ ID NO: 890840 - RNA, 19 nt, Homo sapiens
gaggaagaucgaccuauua

SEQ ID NO: 890841 - RNA, 19 nt, Homo sapiens
cgaggaagaucgaccuauu

SEQ ID NO: 890842 - RNA, 19 nt, Homo sapiens
gcuccuauguuggaaauuu

SEQ ID NO: 890843 - RNA, 19 nt, Homo sapiens
gaaggcacguugaaaugau

SEQ ID NO: 890844 - RNA, 19 nt, Homo sapiens
gaaaagcaaucacaguguu

SEQ ID NO: 890845 - RNA, 19 nt, Homo sapiens
gaaaacgccugaagaaggu

SEQ ID NO: 890846 - RNA, 19 nt, Homo sapiens
aauaugaguuggcgaggaa

SEQ ID NO: 890847 - RNA, 19 nt, Homo sapiens
gagauggacccgccaaauc

SEQ ID NO: 890848 - RNA, 19 nt, Homo sapiens
aaagaaggcacguugaaau

SEQ ID NO: 890849 - RNA, 19 nt, Homo sapiens
gggagcaucugcaggucaa

SEQ ID NO: 890850 - RNA, 19 nt, Homo sapiens
ggaagaucgaccuauuauu

SEQ ID NO: 890851 - RNA, 19 nt, Homo sapiens
ugaagaaggugaaaagcaa

SEQ ID NO: 890852 - RNA, 19 nt, Homo sapiens
ggagauggacccgccaaau

SEQ ID NO: 890853 - RNA, 19 nt, Homo sapiens
ggaaccagcaacaccugaa

SEQ ID NO: 890854 - RNA, 19 nt, Homo sapiens
ggcccgagcaguucaguga

SEQ ID NO: 890855 - RNA, 19 nt, Homo sapiens
gaccaaggcgcuauguaca

SEQ ID NO: 890856 - RNA, 19 nt, Homo sapiens
uuacagccuucugcaaaga

SEQ ID NO: 890857 - RNA, 19 nt, Homo sapiens
aagaaggcacguugaaaug

SEQ ID NO: 890858 - RNA, 19 nt, Homo sapiens
agaaggcacguugaaauga

SEQ ID NO: 890859 - RNA, 19 nt, Homo sapiens
ccgagcaguucagugauga

SEQ ID NO: 890860 - RNA, 19 nt, Homo sapiens
aaagcaaucacaguguuaa

SEQ ID NO: 890861 - RNA, 19 nt, Homo sapiens
gaaccagcaacaccugaag

SEQ ID NO: 890862 - RNA, 19 nt, Homo sapiens
gugugaagaugguccugau

SEQ ID NO: 890863 - RNA, 19 nt, Homo sapiens
aggaagaucgaccuauuau

SEQ ID NO: 890864 - RNA, 19 nt, Homo sapiens
uaaaagaaggcacguugaa

SEQ ID NO: 890865 - RNA, 19 nt, Homo sapiens
ggugaaaacgccugaagaa

SEQ ID NO: 890866 - RNA, 19 nt, Homo sapiens
ggaaccagcaacucaacgu

SEQ ID NO: 890867 - RNA, 19 nt, Homo sapiens
cuuuacagccuucugcaaa

SEQ ID NO: 890868 - RNA, 19 nt, Homo sapiens
gaccuauuauuggccuaga

SEQ ID NO: 890869 - RNA, 19 nt, Homo sapiens
caaucacaguguuaaaaga

SEQ ID NO: 890870 - RNA, 19 nt, Homo sapiens
ugaaguggaaccagcaaca

SEQ ID NO: 890871 - RNA, 19 nt, Homo sapiens
cccgagcaguucagugaug

SEQ ID NO: 890872 - RNA, 19 nt, Homo sapiens
agacugggugugaguguga

SEQ ID NO: 890873 - RNA, 19 nt, Homo sapiens
agaccaaggcgcuauguac

SEQ ID NO: 890874 - RNA, 19 nt, Homo sapiens
caaauccagaggaggugaa

SEQ ID NO: 890875 - RNA, 19 nt, Homo sapiens
gaagacacguugaaaugau

SEQ ID NO: 890876 - RNA, 19 nt, Homo sapiens
gcuccuauguuggaaauuu

SEQ ID NO: 890877 - RNA, 19 nt, Homo sapiens
gaaaagcaaucacaguguu

SEQ ID NO: 890878 - RNA, 19 nt, Homo sapiens
cguagagccuccugaaaug

SEQ ID NO: 890879 - RNA, 19 nt, Homo sapiens
cgaggaagaucgaccuauc

SEQ ID NO: 890880 - RNA, 19 nt, Homo sapiens
gaaaacgccugaagaaggu

SEQ ID NO: 890881 - RNA, 19 nt, Homo sapiens
aauaugaguuggcgaggaa

SEQ ID NO: 890882 - RNA, 19 nt, Homo sapiens
gagauggacccgccaaauc

SEQ ID NO: 890883 - RNA, 19 nt, Homo sapiens
gggagcaucugcaggucaa

SEQ ID NO: 890884 - RNA, 19 nt, Homo sapiens
aagaagacacguugaaaug

SEQ ID NO: 890885 - RNA, 19 nt, Homo sapiens
gaaaugauugggccuaugc

SEQ ID NO: 890886 - RNA, 19 nt, Homo sapiens
aaagaagacacguugaaau

SEQ ID NO: 890887 - RNA, 19 nt, Homo sapiens
ugaagaaggugaaaagcaa

SEQ ID NO: 890888 - RNA, 19 nt, Homo sapiens
ggagauggacccgccaaau

SEQ ID NO: 890889 - RNA, 19 nt, Homo sapiens
ggaaccagcaacaccugaa

SEQ ID NO: 890890 - RNA, 19 nt, Homo sapiens
ggcccgagcaguucaguga

SEQ ID NO: 890891 - RNA, 19 nt, Homo sapiens
gaccaagacgcuacguaga

SEQ ID NO: 890892 - RNA, 19 nt, Homo sapiens
uuacagccuucugcaaaga

SEQ ID NO: 890893 - RNA, 19 nt, Homo sapiens
agaagacacguugaaauga

SEQ ID NO: 890894 - RNA, 19 nt, Homo sapiens
guagagccuccugaaauga

SEQ ID NO: 890895 - RNA, 19 nt, Homo sapiens
ugaaaugauugggccuaug

SEQ ID NO: 890896 - RNA, 19 nt, Homo sapiens
aagacacguugaaaugaug

SEQ ID NO: 890897 - RNA, 19 nt, Homo sapiens
ccgagcaguucagugauga

SEQ ID NO: 890898 - RNA, 19 nt, Homo sapiens
aaagcaaucacaguguuaa

SEQ ID NO: 890899 - RNA, 19 nt, Homo sapiens
gaaccagcaacaccugaag

SEQ ID NO: 890900 - RNA, 19 nt, Homo sapiens
cuacguagagccuccugaa

SEQ ID NO: 890901 - RNA, 19 nt, Homo sapiens
uaaaagaagacacguugaa

SEQ ID NO: 890902 - RNA, 19 nt, Homo sapiens
gugugaagaugguccugau

SEQ ID NO: 890903 - RNA, 19 nt, Homo sapiens
ggugaaaacgccugaagaa

SEQ ID NO: 890904 - RNA, 19 nt, Homo sapiens
ggaaccagcaacucaacgu

SEQ ID NO: 890905 - RNA, 19 nt, Homo sapiens
agagccuccugaaaugauu

SEQ ID NO: 890906 - RNA, 19 nt, Homo sapiens
cuuuacagccuucugcaaa

SEQ ID NO: 890907 - RNA, 19 nt, Homo sapiens
caaucacaguguuaaaaga

SEQ ID NO: 890908 - RNA, 19 nt, Homo sapiens
ugaaguggaaccagcaaca

SEQ ID NO: 890909 - RNA, 19 nt, Homo sapiens
cccgagcaguucagugaug

SEQ ID NO: 890910 - RNA, 19 nt, Homo sapiens
acguagagccuccugaaau

SEQ ID NO: 890911 - RNA, 19 nt, Homo sapiens
agacugggugugaguguga

SEQ ID NO: 890912 - RNA, 19 nt, Homo sapiens
caaauccagaggaggugaa

SEQ ID NO: 890913 - RNA, 19 nt, Homo sapiens
ggagaaagcaggagaauua

SEQ ID NO: 890914 - RNA, 19 nt, Homo sapiens
gaagaaguauugcuguuua

SEQ ID NO: 890915 - RNA, 19 nt, Homo sapiens
gaagaaagcuuugacauca

SEQ ID NO: 890916 - RNA, 19 nt, Homo sapiens
gaagaagaauguacuacua

SEQ ID NO: 890917 - RNA, 19 nt, Homo sapiens
caagauagcucuccaaagu

SEQ ID NO: 890918 - RNA, 19 nt, Homo sapiens
gaaagcaggagaauuaaua

SEQ ID NO: 890919 - RNA, 19 nt, Homo sapiens
guaaacagcuugaagacuu

SEQ ID NO: 890920 - RNA, 19 nt, Homo sapiens
gaaagcuuauuccguauuu

SEQ ID NO: 890921 - RNA, 19 nt, Homo sapiens
ggaaccaacuucuuuauuc

SEQ ID NO: 890922 - RNA, 19 nt, Homo sapiens
ggaaugguguugauacaaa

SEQ ID NO: 890923 - RNA, 19 nt, Homo sapiens
ucaagaaguuccucugaua

SEQ ID NO: 890924 - RNA, 19 nt, Homo sapiens
gcaagacucugguugaaug

SEQ ID NO: 890925 - RNA, 19 nt, Homo sapiens
ggagugagguugaagauuc

SEQ ID NO: 890926 - RNA, 19 nt, Homo sapiens
aaacagaaguccugaagaa

SEQ ID NO: 890927 - RNA, 19 nt, Homo sapiens
ccagagggcugcauucaaa

SEQ ID NO: 890928 - RNA, 19 nt, Homo sapiens
gggcagaacugaugagaug

SEQ ID NO: 890929 - RNA, 19 nt, Homo sapiens
ggacuaagaaaucaugaua

SEQ ID NO: 890930 - RNA, 19 nt, Homo sapiens
gaccugaucuucuuguaaa

SEQ ID NO: 890931 - RNA, 19 nt, Homo sapiens
ggacuugacuuuggagaaa

SEQ ID NO: 890932 - RNA, 19 nt, Homo sapiens
gaaccagggucuuugaaug

SEQ ID NO: 890933 - RNA, 19 nt, Homo sapiens
caacacagaagaaagcuua

SEQ ID NO: 890934 - RNA, 19 nt, Homo sapiens
caacagcucuugcaguuca

SEQ ID NO: 890935 - RNA, 19 nt, Homo sapiens
ugaauguggucccagauua

SEQ ID NO: 890936 - RNA, 19 nt, Homo sapiens
cagcucagauccuaaguuu

SEQ ID NO: 890937 - RNA, 19 nt, Homo sapiens
ggaagggagugcuuauuuc

SEQ ID NO: 890938 - RNA, 19 nt, Homo sapiens
ggugugaucugaauuuaau

SEQ ID NO: 890939 - RNA, 19 nt, Homo sapiens
gaacccaaacaacaucuua

SEQ ID NO: 890940 - RNA, 19 nt, Homo sapiens
ggagauaugucuuuguuac

SEQ ID NO: 890941 - RNA, 19 nt, Homo sapiens
ggcaaacuguggucauaua

SEQ ID NO: 890942 - RNA, 19 nt, Homo sapiens
gagaacaauucguuuacaa

SEQ ID NO: 890943 - RNA, 19 nt, Homo sapiens
ggacagcaguagcuuugaa

SEQ ID NO: 890944 - RNA, 19 nt, Homo sapiens
gaaacuacacaaagaacua

SEQ ID NO: 890945 - RNA, 19 nt, Homo sapiens
ggaauugugugccgcgauu

SEQ ID NO: 890946 - RNA, 19 nt, Homo sapiens
ggaagaagaagacgacuau

SEQ ID NO: 890947 - RNA, 19 nt, Homo sapiens
agagaaggguucauauaaa

SEQ ID NO: 890948 - RNA, 19 nt, Homo sapiens
caaccaaggugugaucuga

SEQ ID NO: 890949 - RNA, 19 nt, Homo sapiens
uaaagaccguuauaggaaa

SEQ ID NO: 890950 - RNA, 19 nt, Homo sapiens
ucacucagauucccucauu

SEQ ID NO: 890951 - RNA, 19 nt, Homo sapiens
ggaaauggcuaaaagagaa

SEQ ID NO: 890952 - RNA, 19 nt, Homo sapiens
ugaguuagaugauggaaug

SEQ ID NO: 890953 - RNA, 19 nt, Homo sapiens
gaagagagaagacaaugug

SEQ ID NO: 890954 - RNA, 19 nt, Homo sapiens
aaagaacuauggcaaauuc

SEQ ID NO: 890955 - RNA, 19 nt, Homo sapiens
cauaguaguucaggagaua

SEQ ID NO: 890956 - RNA, 19 nt, Homo sapiens
ggaagccccugauguuuua

SEQ ID NO: 890957 - RNA, 19 nt, Homo sapiens
gaauacagcaggaacagaa

SEQ ID NO: 890958 - RNA, 19 nt, Homo sapiens
gagaaggguucauauaaac

SEQ ID NO: 890959 - RNA, 19 nt, Homo sapiens
gaaagaguuccuucaagaa

SEQ ID NO: 890960 - RNA, 19 nt, Homo sapiens
gcaguucaauccucuggaa

SEQ ID NO: 890961 - RNA, 19 nt, Homo sapiens
ugaaagugguuuagugcua

SEQ ID NO: 890962 - RNA, 19 nt, Homo sapiens
gcucagauccuaaguuuca

SEQ ID NO: 890963 - RNA, 19 nt, Homo sapiens
aaagcaagguagaguuuaa

SEQ ID NO: 890964 - RNA, 19 nt, Homo sapiens
ggaagaugauggccaagau

SEQ ID NO: 890965 - RNA, 19 nt, Homo sapiens
acauucagcuaacguauuu

SEQ ID NO: 890966 - RNA, 19 nt, Homo sapiens
ccaaacaacaucuuauuga

SEQ ID NO: 890967 - RNA, 19 nt, Homo sapiens
aagagaagcugcagcaaug

SEQ ID NO: 890968 - RNA, 19 nt, Homo sapiens
gaagaugauggccaagaua

SEQ ID NO: 890969 - RNA, 19 nt, Homo sapiens
gggaagggagugcuuauuu

SEQ ID NO: 890970 - RNA, 19 nt, Homo sapiens
ggagaaaggcauagaggaa

SEQ ID NO: 890971 - RNA, 19 nt, Homo sapiens
aaacuguggucauauauca

SEQ ID NO: 890972 - RNA, 19 nt, Homo sapiens
gaagaacgggaaagucgua

SEQ ID NO: 890973 - RNA, 19 nt, Homo sapiens
ugaugaaacuguuaucgaa

SEQ ID NO: 890974 - RNA, 19 nt, Homo sapiens
gcaaacaacacagaagaaa

SEQ ID NO: 890975 - RNA, 19 nt, Homo sapiens
caggagauaugucuuuguu

SEQ ID NO: 890976 - RNA, 19 nt, Homo sapiens
gaaagcaagguagaguuua

SEQ ID NO: 890977 - RNA, 19 nt, Homo sapiens
uagagaaggguucauauaa

SEQ ID NO: 890978 - RNA, 19 nt, Homo sapiens
guacccugaugcuguauaa

SEQ ID NO: 890979 - RNA, 19 nt, Homo sapiens
gggcccaaauccuauagua

SEQ ID NO: 890980 - RNA, 19 nt, Homo sapiens
ggaaaccucagcuugauga

SEQ ID NO: 890981 - RNA, 19 nt, Homo sapiens
uaaacagcuugaagacuuu

SEQ ID NO: 890982 - RNA, 19 nt, Homo sapiens
uggaagagauacagugauu

SEQ ID NO: 890983 - RNA, 19 nt, Homo sapiens
gaauaaauacucacacuac

SEQ ID NO: 890984 - RNA, 19 nt, Homo sapiens
auaaguacaucaucucuga

SEQ ID NO: 890985 - RNA, 19 nt, Homo sapiens
gagaagcugugaagagaag

SEQ ID NO: 890986 - RNA, 19 nt, Homo sapiens
ccaauauuccugcucuuua

SEQ ID NO: 890987 - RNA, 19 nt, Homo sapiens
ccuagaagguguucaagga

SEQ ID NO: 890988 - RNA, 19 nt, Homo sapiens
uuucaaggguggaauaauu

SEQ ID NO: 890989 - RNA, 19 nt, Homo sapiens
cuacaguucucugccaaua

SEQ ID NO: 890990 - RNA, 19 nt, Homo sapiens
gaggcucgcucacucauuc

SEQ ID NO: 890991 - RNA, 19 nt, Homo sapiens
ggaauaaauacucacacua

SEQ ID NO: 890992 - RNA, 19 nt, Homo sapiens
gcaaugggaccuacuaagu

SEQ ID NO: 890993 - RNA, 19 nt, Homo sapiens
ggacagaacagacuuucau

SEQ ID NO: 890994 - RNA, 19 nt, Homo sapiens
gaucugguaucucuuacug

SEQ ID NO: 890995 - RNA, 19 nt, Homo sapiens
acaguucucugccaauauu

SEQ ID NO: 890996 - RNA, 19 nt, Homo sapiens
gaacagaaagaccaucauc

SEQ ID NO: 890997 - RNA, 19 nt, Homo sapiens
cugaagaccugcuacaguu

SEQ ID NO: 890998 - RNA, 19 nt, Homo sapiens
gcacuagccuccagguuuu

SEQ ID NO: 890999 - RNA, 19 nt, Homo sapiens
aaugggaccuacuaaguuu

SEQ ID NO: 891000 - RNA, 19 nt, Homo sapiens
caaugaauaugggcaagaa

SEQ ID NO: 891001 - RNA, 19 nt, Homo sapiens
auaggaagcuagaagugua

SEQ ID NO: 891002 - RNA, 19 nt, Homo sapiens
ccuacuaaguuuacacaaa

SEQ ID NO: 891003 - RNA, 19 nt, Homo sapiens
gaauuggagucaacaagag

SEQ ID NO: 891004 - RNA, 19 nt, Homo sapiens
ggaagggaguugauuuacu

SEQ ID NO: 891005 - RNA, 19 nt, Homo sapiens
ccucuuuccuggcaguuua

SEQ ID NO: 891006 - RNA, 19 nt, Homo sapiens
caaggugugaucugaauuu

SEQ ID NO: 891007 - RNA, 19 nt, Homo sapiens
gauaucaaaucucauccau

SEQ ID NO: 891008 - RNA, 19 nt, Homo sapiens
ugacagcgaugccauagag

SEQ ID NO: 891009 - RNA, 19 nt, Homo sapiens
cagaagaaguauugcuguu

SEQ ID NO: 891010 - RNA, 19 nt, Homo sapiens
acaaagaacuauggcaaau

SEQ ID NO: 891011 - RNA, 19 nt, Homo sapiens
gaacaaugccaagcacaug

SEQ ID NO: 891012 - RNA, 19 nt, Homo sapiens
gcaggagaauuaauaaagc

SEQ ID NO: 891013 - RNA, 19 nt, Homo sapiens
gaagggagcuguuugauug

SEQ ID NO: 891014 - RNA, 19 nt, Homo sapiens
gaaauaacuuccagaaaug

SEQ ID NO: 891015 - RNA, 19 nt, Homo sapiens
gcucauaguucucuuguga

SEQ ID NO: 891016 - RNA, 19 nt, Homo sapiens
cagcuuaaaugagguauua

SEQ ID NO: 891017 - RNA, 19 nt, Homo sapiens
ugacaggauuuacuaguua

SEQ ID NO: 891018 - RNA, 19 nt, Homo sapiens
ggagacagaaucacaguua

SEQ ID NO: 891019 - RNA, 19 nt, Homo sapiens
gaucauuccugcucacgua

SEQ ID NO: 891020 - RNA, 19 nt, Homo sapiens
gaaauggaccugauaagau

SEQ ID NO: 891021 - RNA, 19 nt, Homo sapiens
ccgaagaucuuuaugaaau

SEQ ID NO: 891022 - RNA, 19 nt, Homo sapiens
uauccgagcuuaugacauu

SEQ ID NO: 891023 - RNA, 19 nt, Homo sapiens
ugagagaguuggcaauuug

SEQ ID NO: 891024 - RNA, 19 nt, Homo sapiens
aaacaucgcuaagcauuug

SEQ ID NO: 891025 - RNA, 19 nt, Homo sapiens
ugacuaccaugucuuuaaa

SEQ ID NO: 891026 - RNA, 19 nt, Homo sapiens
gggcuacauuuguucauuu

SEQ ID NO: 891027 - RNA, 19 nt, Homo sapiens
cauuugaucuggccaugua

SEQ ID NO: 891028 - RNA, 19 nt, Homo sapiens
uauggcaucucucaacuuu

SEQ ID NO: 891029 - RNA, 19 nt, Homo sapiens
gcuaaagaauuaccuccaa

SEQ ID NO: 891030 - RNA, 19 nt, Homo sapiens
ugagacacauuuacagcua

SEQ ID NO: 891031 - RNA, 19 nt, Homo sapiens
gcaauucugucugugauca

SEQ ID NO: 891032 - RNA, 19 nt, Homo sapiens
gacaggauuuacuaguuaa

SEQ ID NO: 891033 - RNA, 19 nt, Homo sapiens
ggacaacgaaucaaugcaa

SEQ ID NO: 891034 - RNA, 19 nt, Homo sapiens
gucaagauauccgagcuua

SEQ ID NO: 891035 - RNA, 19 nt, Homo sapiens
gaaggacaacgaaucaaug

SEQ ID NO: 891036 - RNA, 19 nt, Homo sapiens
cuaaagaauuaccuccaaa

SEQ ID NO: 891037 - RNA, 19 nt, Homo sapiens
caagauauccgagcuuaug

SEQ ID NO: 891038 - RNA, 19 nt, Homo sapiens
cuaaaggccuugcaauucu

SEQ ID NO: 891039 - RNA, 19 nt, Homo sapiens
gcuaaaggccuugcaauuc

SEQ ID NO: 891040 - RNA, 19 nt, Homo sapiens
gagacagaaucacaguuau

SEQ ID NO: 891041 - RNA, 19 nt, Homo sapiens
ccaauugucuaucaacagu

SEQ ID NO: 891042 - RNA, 19 nt, Homo sapiens
aaauggaccugauaagauc

SEQ ID NO: 891043 - RNA, 19 nt, Homo sapiens
caaagcaacagaaaugaau

SEQ ID NO: 891044 - RNA, 19 nt, Homo sapiens
guacuaacuuuaucacacu

SEQ ID NO: 891045 - RNA, 19 nt, Homo sapiens
cagaaucacaguuauauca

SEQ ID NO: 891046 - RNA, 19 nt, Homo sapiens
gaauugagacacauuuaca

SEQ ID NO: 891047 - RNA, 19 nt, Homo sapiens
gaucugugcagcaauuuga

SEQ ID NO: 891048 - RNA, 19 nt, Homo sapiens
gugaauaacccuauaccuu

SEQ ID NO: 891049 - RNA, 19 nt, Homo sapiens
gcaaaaggcggaaaucuga

SEQ ID NO: 891050 - RNA, 19 nt, Homo sapiens
ccaacuacguaaccaugaa

SEQ ID NO: 891051 - RNA, 19 nt, Homo sapiens
gcuguuugauugaaaggaa

SEQ ID NO: 891052 - RNA, 19 nt, Homo sapiens
gacagaaucacaguuauau

SEQ ID NO: 891053 - RNA, 19 nt, Homo sapiens
agacagaaucacaguuaua

SEQ ID NO: 891054 - RNA, 19 nt, Homo sapiens
gcugaacucuggcucucaa

SEQ ID NO: 891055 - RNA, 19 nt, Homo sapiens
cccuauaccuuccaauuug

SEQ ID NO: 891056 - RNA, 19 nt, Homo sapiens
aaacauauggcaucucuca

SEQ ID NO: 891057 - RNA, 19 nt, Homo sapiens
ucaaacaucgcuaagcauu

SEQ ID NO: 891058 - RNA, 19 nt, Homo sapiens
ccaaagccauugucaagac

SEQ ID NO: 891059 - RNA, 19 nt, Homo sapiens
gaaucaacccauagaagug

SEQ ID NO: 891060 - RNA, 19 nt, Homo sapiens
caacgaaucaaugcaagaa

SEQ ID NO: 891061 - RNA, 19 nt, Homo sapiens
gaauuaugaccgugcugua

SEQ ID NO: 891062 - RNA, 19 nt, Homo sapiens
cauauucccucugagcauu

SEQ ID NO: 891063 - RNA, 19 nt, Homo sapiens
ccagaaauggaccugauaa

SEQ ID NO: 891064 - RNA, 19 nt, Homo sapiens
aaauuuccauuccguaugu

SEQ ID NO: 891065 - RNA, 19 nt, Homo sapiens
cuacguaaccaugaauuaa

SEQ ID NO: 891066 - RNA, 19 nt, Homo sapiens
gaauaccaguuggcaguca

SEQ ID NO: 891067 - RNA, 19 nt, Homo sapiens
ucucaguaauuucauguga

SEQ ID NO: 891068 - RNA, 19 nt, Homo sapiens
ggaggcagcgggauuguag

SEQ ID NO: 891069 - RNA, 19 nt, Homo sapiens
caacccaauugucuaucaa

SEQ ID NO: 891070 - RNA, 19 nt, Homo sapiens
cagcaguagcauaaacuua

SEQ ID NO: 891071 - RNA, 19 nt, Homo sapiens
uuaaacauauggcaucucu

SEQ ID NO: 891072 - RNA, 19 nt, Homo sapiens
cuuacugugucauagaaua

SEQ ID NO: 891073 - RNA, 19 nt, Homo sapiens
ucucaaagcaacagaaaug

SEQ ID NO: 891074 - RNA, 19 nt, Homo sapiens
caaacaucgcuaagcauuu

SEQ ID NO: 891075 - RNA, 19 nt, Homo sapiens
acacugacaggauuuacua

SEQ ID NO: 891076 - RNA, 19 nt, Homo sapiens
ggacuuuccagcuaucaug

SEQ ID NO: 891077 - RNA, 19 nt, Homo sapiens
cuugauuccuuuacugaaa

SEQ ID NO: 891078 - RNA, 19 nt, Homo sapiens
ccuauaccuuccaauuuga

SEQ ID NO: 891079 - RNA, 19 nt, Homo sapiens
aaauaggaauugagacaca

SEQ ID NO: 891080 - RNA, 19 nt, Homo sapiens
guauaugguagcuguguuu

SEQ ID NO: 891081 - RNA, 19 nt, Homo sapiens
gcuggaaacaacccaauug

SEQ ID NO: 891082 - RNA, 19 nt, Homo sapiens
gggagcuguuugauugaaa

SEQ ID NO: 891083 - RNA, 19 nt, Homo sapiens
cuucaaacaucgcuaagca

SEQ ID NO: 891084 - RNA, 19 nt, Homo sapiens
ucaugugaauaacccuaua

SEQ ID NO: 891085 - RNA, 19 nt, Homo sapiens
cacauuagaauaccaguug

SEQ ID NO: 891086 - RNA, 19 nt, Homo sapiens
agccgaagaucuuuaugaa

SEQ ID NO: 891087 - RNA, 19 nt, Homo sapiens
gcaggcgugucuuuagaag

SEQ ID NO: 891088 - RNA, 19 nt, Homo sapiens
ccgcugccgucuucacgua

SEQ ID NO: 891089 - RNA, 19 nt, Homo sapiens
agaaauggaccugauaaga

SEQ ID NO: 891090 - RNA, 19 nt, Homo sapiens
uaugguagcuguguuuuaa

SEQ ID NO: 891091 - RNA, 19 nt, Homo sapiens
cagaaauaacuuccagaaa

SEQ ID NO: 891092 - RNA, 19 nt, Homo sapiens
ggcuaaaggccuugcaauu

SEQ ID NO: 891093 - RNA, 19 nt, Homo sapiens
ugaaauaggaauugagaca

SEQ ID NO: 891094 - RNA, 19 nt, Homo sapiens
ugacuggaaggacaaauug

SEQ ID NO: 891095 - RNA, 19 nt, Homo sapiens
cugacaggauuuacuaguu

SEQ ID NO: 891096 - RNA, 19 nt, Homo sapiens
ggaauugagacacauuuac

SEQ ID NO: 891097 - RNA, 19 nt, Homo sapiens
ugggauagcuggccuuggu

SEQ ID NO: 891098 - RNA, 19 nt, Homo sapiens
uaaaggccuugcaauucug

SEQ ID NO: 891099 - RNA, 19 nt, Homo sapiens
uuucuacacugacaggauu

SEQ ID NO: 891100 - RNA, 19 nt, Homo sapiens
ugaaucaacccauagaagu

SEQ ID NO: 891101 - RNA, 19 nt, Homo sapiens
ucaaagcaacagaaaugaa

SEQ ID NO: 891102 - RNA, 19 nt, Homo sapiens
gaaaaugaaggacaacgaa

SEQ ID NO: 891103 - RNA, 19 nt, Homo sapiens
ggagcuguuugauugaaag

SEQ ID NO: 891104 - RNA, 19 nt, Homo sapiens
ucaaucuaaugguaucaga

SEQ ID NO: 891105 - RNA, 19 nt, Homo sapiens
caacuuuucuuccuuaugg

SEQ ID NO: 891106 - RNA, 19 nt, Homo sapiens
gcucucaaagcaacagaaa

SEQ ID NO: 891107 - RNA, 19 nt, Homo sapiens
acacauuuacagcuacaua

SEQ ID NO: 891108 - RNA, 19 nt, Homo sapiens
acagaaauaacuuccagaa

SEQ ID NO: 891109 - RNA, 19 nt, Homo sapiens
gagagaguuggcaauuuga

SEQ ID NO: 891110 - RNA, 19 nt, Homo sapiens
uaagcucuauccuggacuu

SEQ ID NO: 891111 - RNA, 19 nt, Homo sapiens
gcugacugacauaucuuua

SEQ ID NO: 891112 - RNA, 19 nt, Homo sapiens
gcucaagccgaagaucuuu

SEQ ID NO: 891113 - RNA, 19 nt, Homo sapiens
gcagaagacugaacaggua

SEQ ID NO: 891114 - RNA, 19 nt, Homo sapiens
gcagaaccaugaaccagua

SEQ ID NO: 891115 - RNA, 19 nt, Homo sapiens
caugaacacuuuagaauug

SEQ ID NO: 891116 - RNA, 19 nt, Homo sapiens
caacaacggucucuaccuu

SEQ ID NO: 891117 - RNA, 19 nt, Homo sapiens
gaacgcugaucccauaaug

SEQ ID NO: 891118 - RNA, 19 nt, Homo sapiens
ucucaaacaugaacacuuu

SEQ ID NO: 891119 - RNA, 19 nt, Homo sapiens
ucagauggccuuuggaaua

SEQ ID NO: 891120 - RNA, 19 nt, Homo sapiens
gcucaccauuguacucuua

SEQ ID NO: 891121 - RNA, 19 nt, Homo sapiens
gaacagguaucagcacauc

SEQ ID NO: 891122 - RNA, 19 nt, Homo sapiens
cagauggccuuuggaauaa

SEQ ID NO: 891123 - RNA, 19 nt, Homo sapiens
ggaugucucuuugaccaua

SEQ ID NO: 891124 - RNA, 19 nt, Homo sapiens
ggacacacgcuauaagcua

SEQ ID NO: 891125 - RNA, 19 nt, Homo sapiens
caaucaaacucaacuguuc

SEQ ID NO: 891126 - RNA, 19 nt, Homo sapiens
aaacucaacuguuccuaga

SEQ ID NO: 891127 - RNA, 19 nt, Homo sapiens
ucugaacgcugaucccaua

SEQ ID NO: 891128 - RNA, 19 nt, Homo sapiens
gaaaaucaccguaucauug

SEQ ID NO: 891129 - RNA, 19 nt, Homo sapiens
ggaauaacaaucaaacuca

SEQ ID NO: 891130 - RNA, 19 nt, Homo sapiens
uuuagcagccuucaaauua

SEQ ID NO: 891131 - RNA, 19 nt, Homo sapiens
ggaaugacaccgugacaga

SEQ ID NO: 891132 - RNA, 19 nt, Homo sapiens
aaaggagguucaacaacua

SEQ ID NO: 891133 - RNA, 19 nt, Homo sapiens
ggucacgacuacuccaauu

SEQ ID NO: 891134 - RNA, 19 nt, Homo sapiens
ggaaggacacacgcuauaa

SEQ ID NO: 891135 - RNA, 19 nt, Homo sapiens
cauaaugcauccucaagug

SEQ ID NO: 891136 - RNA, 19 nt, Homo sapiens
gaagggaugucucuuugac

SEQ ID NO: 891137 - RNA, 19 nt, Homo sapiens
caucauuaauguaguccua

SEQ ID NO: 891138 - RNA, 19 nt, Homo sapiens
uagucaaccucaucauuaa

SEQ ID NO: 891139 - RNA, 19 nt, Homo sapiens
caguggagcugucacauca

SEQ ID NO: 891140 - RNA, 19 nt, Homo sapiens
uagcagccuucaaauuaaa

SEQ ID NO: 891141 - RNA, 19 nt, Homo sapiens
uuagcagccuucaaauuaa

SEQ ID NO: 891142 - RNA, 19 nt, Homo sapiens
gcagaaacccacccuacga

SEQ ID NO: 891143 - RNA, 19 nt, Homo sapiens
gacacacgcuauaagcuau

SEQ ID NO: 891144 - RNA, 19 nt, Homo sapiens
gaacccacgucaccuaucg

SEQ ID NO: 891145 - RNA, 19 nt, Homo sapiens
ucaaugugcuggaauagag

SEQ ID NO: 891146 - RNA, 19 nt, Homo sapiens
auagucaaccucaucauua

SEQ ID NO: 891147 - RNA, 19 nt, Homo sapiens
cgacgacaaugacuguuuc

SEQ ID NO: 891148 - RNA, 19 nt, Homo sapiens
gccaauaccacuaaaggaa

SEQ ID NO: 891149 - RNA, 19 nt, Homo sapiens
guauauuguugccguguug

SEQ ID NO: 891150 - RNA, 19 nt, Homo sapiens
caacgagcauuccaacaac

SEQ ID NO: 891151 - RNA, 19 nt, Homo sapiens
caucuggcauuccaacaug

SEQ ID NO: 891152 - RNA, 19 nt, Homo sapiens
ucauuuagcagccuucaaa

SEQ ID NO: 891153 - RNA, 19 nt, Homo sapiens
gacaguggcguauauuguu

SEQ ID NO: 891154 - RNA, 19 nt, Homo sapiens
gcucaauccuucugaucau

SEQ ID NO: 891155 - RNA, 19 nt, Homo sapiens
caauaccacuaaaggaauc

SEQ ID NO: 891156 - RNA, 19 nt, Homo sapiens
caucuuaagccucauccua

SEQ ID NO: 891157 - RNA, 19 nt, Homo sapiens
acaacggucucuaccuuug

SEQ ID NO: 891158 - RNA, 19 nt, Homo sapiens
guaacucucccacuccaaa

SEQ ID NO: 891159 - RNA, 19 nt, Homo sapiens
gaaggacacacgcuauaag

SEQ ID NO: 891160 - RNA, 19 nt, Homo sapiens
gcuggagucuguauuucug

SEQ ID NO: 891161 - RNA, 19 nt, Homo sapiens
gccuucaaauuaaagcuuu

SEQ ID NO: 891162 - RNA, 19 nt, Homo sapiens
aaucuaugcuggagucugu

SEQ ID NO: 891163 - RNA, 19 nt, Homo sapiens
gcccaugacugcagaagac

SEQ ID NO: 891164 - RNA, 19 nt, Homo sapiens
aaaggaaguccaagcagaa

SEQ ID NO: 891165 - RNA, 19 nt, Homo sapiens
acaacgagcauuccaacaa

SEQ ID NO: 891166 - RNA, 19 nt, Homo sapiens
guggagcugucacaucaau

SEQ ID NO: 891167 - RNA, 19 nt, Homo sapiens
cggaaggacacacgcuaua

SEQ ID NO: 891168 - RNA, 19 nt, Homo sapiens
acacuacccugccacuaca

SEQ ID NO: 891169 - RNA, 19 nt, Homo sapiens
caaccucaucauuaaugua

SEQ ID NO: 891170 - RNA, 19 nt, Homo sapiens
uauagucaaccucaucauu

SEQ ID NO: 891171 - RNA, 19 nt, Homo sapiens
gcagaagacaauaucuaca

SEQ ID NO: 891172 - RNA, 19 nt, Homo sapiens
aagcagaagacaauaucua

SEQ ID NO: 891173 - RNA, 19 nt, Homo sapiens
ugacggccaauaccacuaa

SEQ ID NO: 891174 - RNA, 19 nt, Homo sapiens
gauggccuuuggaauaaca

SEQ ID NO: 891175 - RNA, 19 nt, Homo sapiens
acaguggcguauauuguug

SEQ ID NO: 891176 - RNA, 19 nt, Homo sapiens
uccaaacuguguauaguca

SEQ ID NO: 891177 - RNA, 19 nt, Homo sapiens
cagaagacaauaucuacau

SEQ ID NO: 891178 - RNA, 19 nt, Homo sapiens
ugacaguggcguauauugu

SEQ ID NO: 891179 - RNA, 19 nt, Homo sapiens
caaacuguguauagucaac

SEQ ID NO: 891180 - RNA, 19 nt, Homo sapiens
ccaauaccacuaaaggaau

SEQ ID NO: 891181 - RNA, 19 nt, Homo sapiens
caaacaugaacacuuuaga

SEQ ID NO: 891182 - RNA, 19 nt, Homo sapiens
gaagacugaacagguauca

SEQ ID NO: 891183 - RNA, 19 nt, Homo sapiens
ccaagcagaagacaauauc

SEQ ID NO: 891184 - RNA, 19 nt, Homo sapiens
gugacagagucuucagaug

SEQ ID NO: 891185 - RNA, 19 nt, Homo sapiens
aaaaugcaguugaaaagga

SEQ ID NO: 891186 - RNA, 19 nt, Homo sapiens
gcaaaaugcaguugaaaag

SEQ ID NO: 891187 - RNA, 19 nt, Homo sapiens
ucaaccucaucauuaaugu

SEQ ID NO: 891188 - RNA, 19 nt, Homo sapiens
uucuguagcugguucugua

SEQ ID NO: 891189 - RNA, 19 nt, Homo sapiens
gaacccaccagcucaccau

SEQ ID NO: 891190 - RNA, 19 nt, Homo sapiens
cgacuguuccgacgacaau

SEQ ID NO: 891191 - RNA, 19 nt, Homo sapiens
ucacgacuacuccaauugu

SEQ ID NO: 891192 - RNA, 19 nt, Homo sapiens
cacccaaggucacgacuac

SEQ ID NO: 891193 - RNA, 19 nt, Homo sapiens
ccucaaguggucaucuuaa

SEQ ID NO: 891194 - RNA, 19 nt, Homo sapiens
uaugcuggagucuguauuu

SEQ ID NO: 891195 - RNA, 19 nt, Homo sapiens
cccaccagcucaccauugu

SEQ ID NO: 891196 - RNA, 19 nt, Homo sapiens
gacacugcagggagcaaua

SEQ ID NO: 891197 - RNA, 19 nt, Homo sapiens
ugacaacaacggucucuac

SEQ ID NO: 891198 - RNA, 19 nt, Homo sapiens
cgacaaugacuguuucaac

SEQ ID NO: 891199 - RNA, 19 nt, Homo sapiens
uacccagcauugugaguga

SEQ ID NO: 891200 - RNA, 19 nt, Homo sapiens
ccaguggugcucuuugaga

SEQ ID NO: 891201 - RNA, 19 nt, Homo sapiens
gagguucaacaacuaagug

SEQ ID NO: 891202 - RNA, 19 nt, Homo sapiens
aaaaggagguucaacaacu

SEQ ID NO: 891203 - RNA, 19 nt, Homo sapiens
ccucaucauuaauguaguc

SEQ ID NO: 891204 - RNA, 19 nt, Homo sapiens
acaaucaaacucaacuguu

SEQ ID NO: 891205 - RNA, 19 nt, Homo sapiens
acacaacagaugggaauga

SEQ ID NO: 891206 - RNA, 19 nt, Homo sapiens
gucaaccucaucauuaaug

SEQ ID NO: 891207 - RNA, 19 nt, Homo sapiens
gagucuguauuucugucuu

SEQ ID NO: 891208 - RNA, 19 nt, Homo sapiens
gagaggcagguccaucugu

SEQ ID NO: 891209 - RNA, 19 nt, Homo sapiens
uuacacaacagaugggaau

SEQ ID NO: 891210 - RNA, 19 nt, Homo sapiens
guagccacuucaccaucuu

SEQ ID NO: 891211 - RNA, 19 nt, Homo sapiens
gagcauuccaacaacaaca

SEQ ID NO: 891212 - RNA, 19 nt, Homo sapiens
ccaacgacaacgagcauuc

SEQ ID NO: 891213 - RNA, 19 nt, Homo sapiens
ggaaguaauucacccuuua

SEQ ID NO: 891214 - RNA, 19 nt, Homo sapiens
ggagagaauuucacuauau

SEQ ID NO: 891215 - RNA, 19 nt, Homo sapiens
ggaagaagauacugaagau

SEQ ID NO: 891216 - RNA, 19 nt, Homo sapiens
uaaagaagaugccuggauu

SEQ ID NO: 891217 - RNA, 19 nt, Homo sapiens
gcaauuguccaacuucaua

SEQ ID NO: 891218 - RNA, 19 nt, Homo sapiens
uggaauaaguggauagaua

SEQ ID NO: 891219 - RNA, 19 nt, Homo sapiens
ggagaaauuuagaagaaga

SEQ ID NO: 891220 - RNA, 19 nt, Homo sapiens
ucaccaacauuucaaguuu

SEQ ID NO: 891221 - RNA, 19 nt, Homo sapiens
caacuucccaucaacaaua

SEQ ID NO: 891222 - RNA, 19 nt, Homo sapiens
gaagacgauuauuugcaua

SEQ ID NO: 891223 - RNA, 19 nt, Homo sapiens
ugagauauguucccaguug

SEQ ID NO: 891224 - RNA, 19 nt, Homo sapiens
ggagagaccagcaugcuaa

SEQ ID NO: 891225 - RNA, 19 nt, Homo sapiens
guucccaguuguagaauua

SEQ ID NO: 891226 - RNA, 19 nt, Homo sapiens
ggaauaaguggauagauau

SEQ ID NO: 891227 - RNA, 19 nt, Homo sapiens
gaaccaaguauaagaaguu

SEQ ID NO: 891228 - RNA, 19 nt, Homo sapiens
gcacacacaggaacucuuu

SEQ ID NO: 891229 - RNA, 19 nt, Homo sapiens
gaagaacuuuggaaaauga

SEQ ID NO: 891230 - RNA, 19 nt, Homo sapiens
gaauuacuguuuacacaca

SEQ ID NO: 891231 - RNA, 19 nt, Homo sapiens
gguauacaccuccaacuuu

SEQ ID NO: 891232 - RNA, 19 nt, Homo sapiens
ugacaucuauuccaucugu

SEQ ID NO: 891233 - RNA, 19 nt, Homo sapiens
gggaaguaauucacccuuu

SEQ ID NO: 891234 - RNA, 19 nt, Homo sapiens
ugacugcccuucagaacuu

SEQ ID NO: 891235 - RNA, 19 nt, Homo sapiens
gaagacgucaccaaaauua

SEQ ID NO: 891236 - RNA, 19 nt, Homo sapiens
ggauugagcaugauguuug

SEQ ID NO: 891237 - RNA, 19 nt, Homo sapiens
auaagaaguuuccacauug

SEQ ID NO: 891238 - RNA, 19 nt, Homo sapiens
agaagaagacgauuauuug

SEQ ID NO: 891239 - RNA, 19 nt, Homo sapiens
gaaaagacaucacaaacca

SEQ ID NO: 891240 - RNA, 19 nt, Homo sapiens
cauaauggaaccaaguaua

SEQ ID NO: 891241 - RNA, 19 nt, Homo sapiens
caacagguccaacaaaaua

SEQ ID NO: 891242 - RNA, 19 nt, Homo sapiens
caacaaagucuugccaaug

SEQ ID NO: 891243 - RNA, 19 nt, Homo sapiens
guaauucacccuuuagcaa

SEQ ID NO: 891244 - RNA, 19 nt, Homo sapiens
uggagagaauuucacuaua

SEQ ID NO: 891245 - RNA, 19 nt, Homo sapiens
ggagaauggagauuuaugu

SEQ ID NO: 891246 - RNA, 19 nt, Homo sapiens
guacugcaugcaauuuaua

SEQ ID NO: 891247 - RNA, 19 nt, Homo sapiens
caauuguuguccugauauu

SEQ ID NO: 891248 - RNA, 19 nt, Homo sapiens
gaauuugacugcccuucag

SEQ ID NO: 891249 - RNA, 19 nt, Homo sapiens
caucacaaaccaagaagaa

SEQ ID NO: 891250 - RNA, 19 nt, Homo sapiens
agaagauacugaagauuag

SEQ ID NO: 891251 - RNA, 19 nt, Homo sapiens
gauaaguggauguuaacaa

SEQ ID NO: 891252 - RNA, 19 nt, Homo sapiens
ggaaccaaguauaagaagu

SEQ ID NO: 891253 - RNA, 19 nt, Homo sapiens
uuggauaaguggauguuaa

SEQ ID NO: 891254 - RNA, 19 nt, Homo sapiens
ccacauugguuggauaagu

SEQ ID NO: 891255 - RNA, 19 nt, Homo sapiens
gcacuugccaauuaaaaua

SEQ ID NO: 891256 - RNA, 19 nt, Homo sapiens
ucaacaaagucuugccaau

SEQ ID NO: 891257 - RNA, 19 nt, Homo sapiens
gaaguaauucacccuuuag

SEQ ID NO: 891258 - RNA, 19 nt, Homo sapiens
gaccugugcuuuugcauuu

SEQ ID NO: 891259 - RNA, 19 nt, Homo sapiens
gaauuaauggaaagcagaa

SEQ ID NO: 891260 - RNA, 19 nt, Homo sapiens
uuuggagaauggagauuua

SEQ ID NO: 891261 - RNA, 19 nt, Homo sapiens
uaagaaguuuccacauugg

SEQ ID NO: 891262 - RNA, 19 nt, Homo sapiens
agaagacgauuauuugcau

SEQ ID NO: 891263 - RNA, 19 nt, Homo sapiens
gggaagacgucaccaaaau

SEQ ID NO: 891264 - RNA, 19 nt, Homo sapiens
gaagaagauacugaagauu

SEQ ID NO: 891265 - RNA, 19 nt, Homo sapiens
guauacaccuccaacuuuu

SEQ ID NO: 891266 - RNA, 19 nt, Homo sapiens
aguuugggcuucucaguuu

SEQ ID NO: 891267 - RNA, 19 nt, Homo sapiens
aaaugaagccuaggagaaa

SEQ ID NO: 891268 - RNA, 19 nt, Homo sapiens
gagauauguucccaguugu

SEQ ID NO: 891269 - RNA, 19 nt, Homo sapiens
aacaaagucuugccaaugg

SEQ ID NO: 891270 - RNA, 19 nt, Homo sapiens
ggucaucaacaaagucuug

SEQ ID NO: 891271 - RNA, 19 nt, Homo sapiens
gaagaagacgauuauuugc

SEQ ID NO: 891272 - RNA, 19 nt, Homo sapiens
caccaacauuucaaguuug

SEQ ID NO: 891273 - RNA, 19 nt, Homo sapiens
uaugauagcuguuuuccuu

SEQ ID NO: 891274 - RNA, 19 nt, Homo sapiens
gcugugacaucuauuccau

SEQ ID NO: 891275 - RNA, 19 nt, Homo sapiens
aaguggauguuaacaagaa

SEQ ID NO: 891276 - RNA, 19 nt, Homo sapiens
uccaauuguuguccugaua

SEQ ID NO: 891277 - RNA, 19 nt, Homo sapiens
gagaauggagauuuaugug

SEQ ID NO: 891278 - RNA, 19 nt, Homo sapiens
auaaguggauguuaacaag

SEQ ID NO: 891279 - RNA, 19 nt, Homo sapiens
gauagcagcaauuguccaa

SEQ ID NO: 891280 - RNA, 19 nt, Homo sapiens
cacauugguuggauaagug

SEQ ID NO: 891281 - RNA, 19 nt, Homo sapiens
ccaucacucucuuggcauu

SEQ ID NO: 891282 - RNA, 19 nt, Homo sapiens
gaagauacugaagauuaga

SEQ ID NO: 891283 - RNA, 19 nt, Homo sapiens
ccaaugaggcgauccuaca

SEQ ID NO: 891284 - RNA, 19 nt, Homo sapiens
agacaucacaaaccaagaa

SEQ ID NO: 891285 - RNA, 19 nt, Homo sapiens
caugauguuuggagaaugg

SEQ ID NO: 891286 - RNA, 19 nt, Homo sapiens
gagcaugauguuuggagaa

SEQ ID NO: 891287 - RNA, 19 nt, Homo sapiens
cagcaauuguccaacuuca

SEQ ID NO: 891288 - RNA, 19 nt, Homo sapiens
gagacucacggucaagcua

SEQ ID NO: 891289 - RNA, 19 nt, Homo sapiens
gauugagcaugauguuugg

SEQ ID NO: 891290 - RNA, 19 nt, Homo sapiens
gcagaaaagacaucacaaa

SEQ ID NO: 891291 - RNA, 19 nt, Homo sapiens
gauccuacagauacaaguu

SEQ ID NO: 891292 - RNA, 19 nt, Homo sapiens
agcccaugcugaugaauuu

SEQ ID NO: 891293 - RNA, 19 nt, Homo sapiens
gagagaccagcaugcuaaa

SEQ ID NO: 891294 - RNA, 19 nt, Homo sapiens
gagcaagcuaggaauuguu

SEQ ID NO: 891295 - RNA, 19 nt, Homo sapiens
acagauacaaguugcuaaa

SEQ ID NO: 891296 - RNA, 19 nt, Homo sapiens
gggagagaccagcaugcua

SEQ ID NO: 891297 - RNA, 19 nt, Homo sapiens
ugacauggagagaauuuca

SEQ ID NO: 891298 - RNA, 19 nt, Homo sapiens
uaucaacagguccaacaaa

SEQ ID NO: 891299 - RNA, 19 nt, Homo sapiens
uaacaagaaagcaguuugg

SEQ ID NO: 891300 - RNA, 19 nt, Homo sapiens
ugaggaagaagauacugaa

SEQ ID NO: 891301 - RNA, 19 nt, Homo sapiens
gaggcgauccuacagauac

SEQ ID NO: 891302 - RNA, 19 nt, Homo sapiens
uguacugcaugcaauuuau

SEQ ID NO: 891303 - RNA, 19 nt, Homo sapiens
gaagccuaggagaaauuua

SEQ ID NO: 891304 - RNA, 19 nt, Homo sapiens
ucagagcaagcuaggaauu

SEQ ID NO: 891305 - RNA, 19 nt, Homo sapiens
uggcaauacuggcucuguu

SEQ ID NO: 891306 - RNA, 19 nt, Homo sapiens
uagcagcaauuguccaacu

SEQ ID NO: 891307 - RNA, 19 nt, Homo sapiens
caaagucuugccaaugguu

SEQ ID NO: 891308 - RNA, 19 nt, Homo sapiens
caagaagaacuuuggaaaa

SEQ ID NO: 891309 - RNA, 19 nt, Homo sapiens
agagcaagcuaggaauugu

SEQ ID NO: 891310 - RNA, 19 nt, Homo sapiens
gcaugauguuuggagaaug

SEQ ID NO: 891311 - RNA, 19 nt, Homo sapiens
gcuaaacugggcauaucaa

SEQ ID NO: 891312 - RNA, 19 nt, Homo sapiens
cuacagauacaaguugcua

SEQ ID NO: 891313 - RNA, 19 nt, Homo sapiens
cagggagaauucaaucaca

SEQ ID NO: 891314 - RNA, 19 nt, Homo sapiens
uguaaauucuccaacugau

SEQ ID NO: 891315 - RNA, 19 nt, Homo sapiens
guaaauucuccaacugauc

SEQ ID NO: 891316 - RNA, 19 nt, Homo sapiens
ccuguaaauucuccaacug

SEQ ID NO: 891317 - RNA, 19 nt, Homo sapiens
gagaauucaaucacacucu

SEQ ID NO: 891318 - RNA, 19 nt, Homo sapiens
ccaccacguuuuccuuuug

SEQ ID NO: 891319 - RNA, 19 nt, Homo sapiens
acuuggaucuugggccuuu

SEQ ID NO: 891320 - RNA, 19 nt, Homo sapiens
gcucuugcagcguguuuca

SEQ ID NO: 891321 - RNA, 19 nt, Homo sapiens
gauccugcccucccuacuc

SEQ ID NO: 891322 - RNA, 19 nt, Homo sapiens
gguccagggagaauucaau

SEQ ID NO: 891323 - RNA, 19 nt, Homo sapiens
ccaagaagauguuugcaua

SEQ ID NO: 891324 - RNA, 19 nt, Homo sapiens
gaaccagggugaacacuuu

SEQ ID NO: 891325 - RNA, 19 nt, Homo sapiens
gagagcugcuugcgaaaua

SEQ ID NO: 891326 - RNA, 19 nt, Homo sapiens
ggauaaaguuuccagugua

SEQ ID NO: 891327 - RNA, 19 nt, Homo sapiens
ccacauauaucuuuaaugg

SEQ ID NO: 891328 - RNA, 19 nt, Homo sapiens
gaagaugaaugacuuugga

SEQ ID NO: 891329 - RNA, 19 nt, Homo sapiens
gaagagaacccugagagua

SEQ ID NO: 891330 - RNA, 19 nt, Homo sapiens
agacagagcuaccuucuau

SEQ ID NO: 891331 - RNA, 19 nt, Homo sapiens
ccaagaagcugcaucaagu

SEQ ID NO: 891332 - RNA, 19 nt, Homo sapiens
gauaagcuaugaugugguu

SEQ ID NO: 891333 - RNA, 19 nt, Homo sapiens
gaaaguccacuguuugauu

SEQ ID NO: 891334 - RNA, 19 nt, Homo sapiens
gauaaaguuuccaguguau

SEQ ID NO: 891335 - RNA, 19 nt, Homo sapiens
caaugaaacuccaaucaau

SEQ ID NO: 891336 - RNA, 19 nt, Homo sapiens
guuaagcgcuggaucaaug

SEQ ID NO: 891337 - RNA, 19 nt, Homo sapiens
cuaaagacaugacuggaaa

SEQ ID NO: 891338 - RNA, 19 nt, Homo sapiens
uaucuuagcuucuguugga

SEQ ID NO: 891339 - RNA, 19 nt, Homo sapiens
gaagauaagcuaugaugug

SEQ ID NO: 891340 - RNA, 19 nt, Homo sapiens
ugaagaggcugucaacaau

SEQ ID NO: 891341 - RNA, 19 nt, Homo sapiens
gaucaccgauggaacaaug

SEQ ID NO: 891342 - RNA, 19 nt, Homo sapiens
gaacagaaagcagaaauca

SEQ ID NO: 891343 - RNA, 19 nt, Homo sapiens
gcacuaaaugccacauaua

SEQ ID NO: 891344 - RNA, 19 nt, Homo sapiens
ggagaagagugcuguuuua

SEQ ID NO: 891345 - RNA, 19 nt, Homo sapiens
gcaccaacacucucaauga

SEQ ID NO: 891346 - RNA, 19 nt, Homo sapiens
cuacuaagauucuacacuu

SEQ ID NO: 891347 - RNA, 19 nt, Homo sapiens
aaaguccacuguuugauuu

SEQ ID NO: 891348 - RNA, 19 nt, Homo sapiens
gaagauguuugcauauucu

SEQ ID NO: 891349 - RNA, 19 nt, Homo sapiens
agaaaguacugaagccuaa

SEQ ID NO: 891350 - RNA, 19 nt, Homo sapiens
ccaugaaaguccacuguuu

SEQ ID NO: 891351 - RNA, 19 nt, Homo sapiens
gaagaggcugucaacaaua

SEQ ID NO: 891352 - RNA, 19 nt, Homo sapiens
gaauauaggacccuuguuc

SEQ ID NO: 891353 - RNA, 19 nt, Homo sapiens
gguaguggcuccaauccuu

SEQ ID NO: 891354 - RNA, 19 nt, Homo sapiens
ggaauauguuacacucuug

SEQ ID NO: 891355 - RNA, 19 nt, Homo sapiens
aagcauccuuguacucuua

SEQ ID NO: 891356 - RNA, 19 nt, Homo sapiens
ugagagguccgauaaagua

SEQ ID NO: 891357 - RNA, 19 nt, Homo sapiens
gcuggaagaucucgaagug

SEQ ID NO: 891358 - RNA, 19 nt, Homo sapiens
gcagauaucuucuuuugug

SEQ ID NO: 891359 - RNA, 19 nt, Homo sapiens
ugaacaagguggcaaugaa

SEQ ID NO: 891360 - RNA, 19 nt, Homo sapiens
ggaguccuguaucaccuua

SEQ ID NO: 891361 - RNA, 19 nt, Homo sapiens
guucagcacugguaucuuc

SEQ ID NO: 891362 - RNA, 19 nt, Homo sapiens
acaggaggcucguauauuc

SEQ ID NO: 891363 - RNA, 19 nt, Homo sapiens
uaaaguaccugagaacaag

SEQ ID NO: 891364 - RNA, 19 nt, Homo sapiens
caaauacuauccuauacuc

SEQ ID NO: 891365 - RNA, 19 nt, Homo sapiens
aagcagagacagaauauuu

SEQ ID NO: 891366 - RNA, 19 nt, Homo sapiens
ggauacugaugacgaggua

SEQ ID NO: 891367 - RNA, 19 nt, Homo sapiens
acacuguucuggcuacuaa

SEQ ID NO: 891368 - RNA, 19 nt, Homo sapiens
ccaagauguugaauaaguu

SEQ ID NO: 891369 - RNA, 19 nt, Homo sapiens
gaacaacggaagcuacaga

SEQ ID NO: 891370 - RNA, 19 nt, Homo sapiens
agagcuaccuucuaucuga

SEQ ID NO: 891371 - RNA, 19 nt, Homo sapiens
ggacgauagugcagcuuug

SEQ ID NO: 891372 - RNA, 19 nt, Homo sapiens
ggaaacugaugcacacuac

SEQ ID NO: 891373 - RNA, 19 nt, Homo sapiens
guuacacucuuguucguuu

SEQ ID NO: 891374 - RNA, 19 nt, Homo sapiens
ucaagucacaguuugcuua

SEQ ID NO: 891375 - RNA, 19 nt, Homo sapiens
aggagaaugugcuaccuua

SEQ ID NO: 891376 - RNA, 19 nt, Homo sapiens
ccugaaagcuccuggcaau

SEQ ID NO: 891377 - RNA, 19 nt, Homo sapiens
ccuaugaagugcugucuug

SEQ ID NO: 891378 - RNA, 19 nt, Homo sapiens
gccaucagauuccuaugaa

SEQ ID NO: 891379 - RNA, 19 nt, Homo sapiens
cuacuaagccagagaaguu

SEQ ID NO: 891380 - RNA, 19 nt, Homo sapiens
guacugaagccuaacuuug

SEQ ID NO: 891381 - RNA, 19 nt, Homo sapiens
gggaagucguccaagauga

SEQ ID NO: 891382 - RNA, 19 nt, Homo sapiens
ggucucaagucacaguuug

SEQ ID NO: 891383 - RNA, 19 nt, Homo sapiens
ggugaacacuuuggaacaa

SEQ ID NO: 891384 - RNA, 19 nt, Homo sapiens
gauguuaucuuagcuucug

SEQ ID NO: 891385 - RNA, 19 nt, Homo sapiens
gacugugucugaccauauu

SEQ ID NO: 891386 - RNA, 19 nt, Homo sapiens
gaagugcugucuuguaucc

SEQ ID NO: 891387 - RNA, 19 nt, Homo sapiens
aagagaacccugagaguaa

SEQ ID NO: 891388 - RNA, 19 nt, Homo sapiens
ugcaagccauugaaagaua

SEQ ID NO: 891389 - RNA, 19 nt, Homo sapiens
ucaagcaaaugucuaucuu

SEQ ID NO: 891390 - RNA, 19 nt, Homo sapiens
cagagguggcuaugauuua

SEQ ID NO: 891391 - RNA, 19 nt, Homo sapiens
gggaagaggugggagauac

SEQ ID NO: 891392 - RNA, 19 nt, Homo sapiens
gcaguugcaggcuccuuua

SEQ ID NO: 891393 - RNA, 19 nt, Homo sapiens
gaaaucaauuccucuugcu

SEQ ID NO: 891394 - RNA, 19 nt, Homo sapiens
ugagugcuuuggcuaaauu

SEQ ID NO: 891395 - RNA, 19 nt, Homo sapiens
gaacaagguggcaaugaag

SEQ ID NO: 891396 - RNA, 19 nt, Homo sapiens
gcugggaagucguccaaga

SEQ ID NO: 891397 - RNA, 19 nt, Homo sapiens
ucuguuggauaaaugcuua

SEQ ID NO: 891398 - RNA, 19 nt, Homo sapiens
uaaccaaccaggaauaugu

SEQ ID NO: 891399 - RNA, 19 nt, Homo sapiens
ucaagcacauguuuaccaa

SEQ ID NO: 891400 - RNA, 19 nt, Homo sapiens
gaaagcagaaaucacacuu

SEQ ID NO: 891401 - RNA, 19 nt, Homo sapiens
gagcuaccuucuaucugaa

SEQ ID NO: 891402 - RNA, 19 nt, Homo sapiens
uaaaucuggucucaaguca

SEQ ID NO: 891403 - RNA, 19 nt, Homo sapiens
uagaaagaaugaucgacuu

SEQ ID NO: 891404 - RNA, 19 nt, Homo sapiens
ugaugaagauaagcuauga

SEQ ID NO: 891405 - RNA, 19 nt, Homo sapiens
gccagcagaucaagcaaau

SEQ ID NO: 891406 - RNA, 19 nt, Homo sapiens
aagaggcugucaacaauau

SEQ ID NO: 891407 - RNA, 19 nt, Homo sapiens
gcaaagagggcccuagaac

SEQ ID NO: 891408 - RNA, 19 nt, Homo sapiens
gaucaaugaagcccaagaa

SEQ ID NO: 891409 - RNA, 19 nt, Homo sapiens
gaaugacuuuggagaagca

SEQ ID NO: 891410 - RNA, 19 nt, Homo sapiens
ggaaaccuuugcccucagu

SEQ ID NO: 891411 - RNA, 19 nt, Homo sapiens
aagcagaaaucacacuugu

SEQ ID NO: 891412 - RNA, 19 nt, Homo sapiens
ggucagcuuugggacgaua

SEQ ID NO: 891413 - RNA, 19 nt, Homo sapiens
agaagauguuugcauauuc

SEQ ID NO: 891414 - RNA, 19 nt, Homo sapiens
gaugaaugacuuuggagaa

SEQ ID NO: 891415 - RNA, 19 nt, Homo sapiens
ugucagaaguaaagagaga

SEQ ID NO: 891416 - RNA, 19 nt, Homo sapiens
gaggauggguaugaugaug

SEQ ID NO: 891417 - RNA, 19 nt, Homo sapiens
ucacaucguguuccaguuu

SEQ ID NO: 891418 - RNA, 19 nt, Homo sapiens
cagaagcagagacagaaua

SEQ ID NO: 891419 - RNA, 19 nt, Homo sapiens
ccaccuuugugaauucauu

SEQ ID NO: 891420 - RNA, 19 nt, Homo sapiens
gcaagacauuuuccaagaa

SEQ ID NO: 891421 - RNA, 19 nt, Homo sapiens
ggguuguccuggagaauga

SEQ ID NO: 891422 - RNA, 19 nt, Homo sapiens
ccaacaugcuccgagauga

SEQ ID NO: 891423 - RNA, 19 nt, Homo sapiens
gaacagaaacguuuaaauc

SEQ ID NO: 891424 - RNA, 19 nt, Homo sapiens
ggauauaacuccugugaug

SEQ ID NO: 891425 - RNA, 19 nt, Homo sapiens
gcauauacauugacucuug

SEQ ID NO: 891426 - RNA, 19 nt, Homo sapiens
ggcaagauguugaagauuu

SEQ ID NO: 891427 - RNA, 19 nt, Homo sapiens
caagugguguuucugguua

SEQ ID NO: 891428 - RNA, 19 nt, Homo sapiens
ucacagcucucuuccaauu

SEQ ID NO: 891429 - RNA, 19 nt, Homo sapiens
gaagaaaguguaucauuug

SEQ ID NO: 891430 - RNA, 19 nt, Homo sapiens
gaggagaaguguauacaug

SEQ ID NO: 891431 - RNA, 19 nt, Homo sapiens
ggauuugcuuucuccauua

SEQ ID NO: 891432 - RNA, 19 nt, Homo sapiens
ggaagaaaaugaagaauga

SEQ ID NO: 891433 - RNA, 19 nt, Homo sapiens
gaaacuacuuaccgugaaa

SEQ ID NO: 891434 - RNA, 19 nt, Homo sapiens
caagagagccucaggaaug

SEQ ID NO: 891435 - RNA, 19 nt, Homo sapiens
gagcuacaaucauggcuuu

SEQ ID NO: 891436 - RNA, 19 nt, Homo sapiens
ggaccacccuuucuauguu

SEQ ID NO: 891437 - RNA, 19 nt, Homo sapiens
cagcagccauccguuauua

SEQ ID NO: 891438 - RNA, 19 nt, Homo sapiens
caucacagcucucuuccaa

SEQ ID NO: 891439 - RNA, 19 nt, Homo sapiens
gaccacccuuucuauguua

SEQ ID NO: 891440 - RNA, 19 nt, Homo sapiens
gaaccagccuucccucauc

SEQ ID NO: 891441 - RNA, 19 nt, Homo sapiens
ggagaaguguauacauguu

SEQ ID NO: 891442 - RNA, 19 nt, Homo sapiens
gaucaaggucucaccauuu

SEQ ID NO: 891443 - RNA, 19 nt, Homo sapiens
caaaucagaugccuaaugc

SEQ ID NO: 891444 - RNA, 19 nt, Homo sapiens
gcugaaggcugugauaaug

SEQ ID NO: 891445 - RNA, 19 nt, Homo sapiens
ccaauucuuuguaugcuaa

SEQ ID NO: 891446 - RNA, 19 nt, Homo sapiens
ucagaugccuaaugcagua

SEQ ID NO: 891447 - RNA, 19 nt, Homo sapiens
gaagaacagaaacguuuaa

SEQ ID NO: 891448 - RNA, 19 nt, Homo sapiens
acacgacugugcuuucaua

SEQ ID NO: 891449 - RNA, 19 nt, Homo sapiens
ggaggaaacaccaguaaga

SEQ ID NO: 891450 - RNA, 19 nt, Homo sapiens
gcuccuuacugcuuauuaa

SEQ ID NO: 891451 - RNA, 19 nt, Homo sapiens
gaagagagaagaauguaca

SEQ ID NO: 891452 - RNA, 19 nt, Homo sapiens
gauuugggauggugcaauu

SEQ ID NO: 891453 - RNA, 19 nt, Homo sapiens
gaagugaagacaaaucaga

SEQ ID NO: 891454 - RNA, 19 nt, Homo sapiens
caucauagccacuagcaaa

SEQ ID NO: 891455 - RNA, 19 nt, Homo sapiens
agacaaaucagaugccuaa

SEQ ID NO: 891456 - RNA, 19 nt, Homo sapiens
gcagguggcugguguuggu

SEQ ID NO: 891457 - RNA, 19 nt, Homo sapiens
ggucaagacuuugcaagau

SEQ ID NO: 891458 - RNA, 19 nt, Homo sapiens
guagaagaugguuuacuua

SEQ ID NO: 891459 - RNA, 19 nt, Homo sapiens
ccucagccauguaucuuaa

SEQ ID NO: 891460 - RNA, 19 nt, Homo sapiens
gcacuucgcggcagucaga

SEQ ID NO: 891461 - RNA, 19 nt, Homo sapiens
ccaagaggcuaccagaaca

SEQ ID NO: 891462 - RNA, 19 nt, Homo sapiens
gugcuaaaguacaguagaa

SEQ ID NO: 891463 - RNA, 19 nt, Homo sapiens
ggaaagacuuaagaagauc

SEQ ID NO: 891464 - RNA, 19 nt, Homo sapiens
uggaaagacuuaagaagau

SEQ ID NO: 891465 - RNA, 19 nt, Homo sapiens
aaaccaggaugcuuauguu

SEQ ID NO: 891466 - RNA, 19 nt, Homo sapiens
gaaagauaacagagccaua

SEQ ID NO: 891467 - RNA, 19 nt, Homo sapiens
ggauauagucacuguaaug

SEQ ID NO: 891468 - RNA, 19 nt, Homo sapiens
gauauccuguggugcuaaa

SEQ ID NO: 891469 - RNA, 19 nt, Homo sapiens
gauaacagagccauaagug

SEQ ID NO: 891470 - RNA, 19 nt, Homo sapiens
gcuaugacuucacaccuau

SEQ ID NO: 891471 - RNA, 19 nt, Homo sapiens
aaauaaagguuggucauca

SEQ ID NO: 891472 - RNA, 19 nt, Homo sapiens
cgacugugcuuucauaagg

SEQ ID NO: 891473 - RNA, 19 nt, Homo sapiens
gcaaauagugagucagaau

SEQ ID NO: 891474 - RNA, 19 nt, Homo sapiens
aaucacagcuguaaaauug

SEQ ID NO: 891475 - RNA, 19 nt, Homo sapiens
gcagccauccguuauuauu

SEQ ID NO: 891476 - RNA, 19 nt, Homo sapiens
cauuaaaccaggaugcuua

SEQ ID NO: 891477 - RNA, 19 nt, Homo sapiens
aaagauaacagagccauaa

SEQ ID NO: 891478 - RNA, 19 nt, Homo sapiens
ucagauguauccagggaaa

SEQ ID NO: 891479 - RNA, 19 nt, Homo sapiens
gaaggaggaaacaccagua

SEQ ID NO: 891480 - RNA, 19 nt, Homo sapiens
cuaacagaauuggcaaaua

SEQ ID NO: 891481 - RNA, 19 nt, Homo sapiens
uggaguugcugcaguguaa

SEQ ID NO: 891482 - RNA, 19 nt, Homo sapiens
gaucaucacagcucucuuc

SEQ ID NO: 891483 - RNA, 19 nt, Homo sapiens
gagaaguguauacauguuu

SEQ ID NO: 891484 - RNA, 19 nt, Homo sapiens
aaagagaggagaaguguau

SEQ ID NO: 891485 - RNA, 19 nt, Homo sapiens
ccaggaugcuuauguucuu

SEQ ID NO: 891486 - RNA, 19 nt, Homo sapiens
guuaauagcauugggauau

SEQ ID NO: 891487 - RNA, 19 nt, Homo sapiens
ccacauggcucagcaucug

SEQ ID NO: 891488 - RNA, 19 nt, Homo sapiens
gguaauaauaggcuugaaa

SEQ ID NO: 891489 - RNA, 19 nt, Homo sapiens
ggauucuucugcaguuuau

SEQ ID NO: 891490 - RNA, 19 nt, Homo sapiens
ucacaccuauggauucuuc

SEQ ID NO: 891491 - RNA, 19 nt, Homo sapiens
cuaaaguuguuaucacaug

SEQ ID NO: 891492 - RNA, 19 nt, Homo sapiens
gcaagauguugaagauuuu

SEQ ID NO: 891493 - RNA, 19 nt, Homo sapiens
gaacacauggagcuugaug

SEQ ID NO: 891494 - RNA, 19 nt, Homo sapiens
caucuucaccuggauauaa

SEQ ID NO: 891495 - RNA, 19 nt, Homo sapiens
ucacacuucuucaugaugu

SEQ ID NO: 891496 - RNA, 19 nt, Homo sapiens
guacacaugaugaaaugaa

SEQ ID NO: 891497 - RNA, 19 nt, Homo sapiens
gaaagagaggagaagugua

SEQ ID NO: 891498 - RNA, 19 nt, Homo sapiens
gacaagagagccucaggaa

SEQ ID NO: 891499 - RNA, 19 nt, Homo sapiens
gaaugaagagagaagaaug

SEQ ID NO: 891500 - RNA, 19 nt, Homo sapiens
gcgagucuguacugaaguu

SEQ ID NO: 891501 - RNA, 19 nt, Homo sapiens
gcaguguaaugagaauuug

SEQ ID NO: 891502 - RNA, 19 nt, Homo sapiens
uaauaugagugaggauuug

SEQ ID NO: 891503 - RNA, 19 nt, Homo sapiens
ugaagaacagaaacguuua

SEQ ID NO: 891504 - RNA, 19 nt, Homo sapiens
ggaaacaccaguaagacau

SEQ ID NO: 891505 - RNA, 19 nt, Homo sapiens
cauauacauugacucuuga

SEQ ID NO: 891506 - RNA, 19 nt, Homo sapiens
guuuaaauccugacuguug

SEQ ID NO: 891507 - RNA, 19 nt, Homo sapiens
caagaucuggauucaguaa

SEQ ID NO: 891508 - RNA, 19 nt, Homo sapiens
guuaucacaugaagaaagu

SEQ ID NO: 891509 - RNA, 19 nt, Homo sapiens
aauaaggaauggcaagaug

SEQ ID NO: 891510 - RNA, 19 nt, Homo sapiens
gaucaucuccuguacacau

SEQ ID NO: 891511 - RNA, 19 nt, Homo sapiens
aaaaguugcuuaucucuga

SEQ ID NO: 891512 - RNA, 19 nt, Homo sapiens
cuuccaaacuucauauaug

SEQ ID NO: 891513 - RNA, 19 nt, Homo sapiens
cauugacucuugauggaaa

SEQ ID NO: 891514 - RNA, 19 nt, Homo sapiens
gagagcugcuggugguguu

SEQ ID NO: 891515 - RNA, 19 nt, Homo sapiens
uacaguagaagaugguuua

SEQ ID NO: 891516 - RNA, 19 nt, Homo sapiens
ggaauggcaagauguugaa

SEQ ID NO: 891517 - RNA, 19 nt, Homo sapiens
caucaagaauacccaagau

SEQ ID NO: 891518 - RNA, 19 nt, Homo sapiens
ggagucggccuuuccucua

SEQ ID NO: 891519 - RNA, 19 nt, Homo sapiens
gggcaaauagugagucaga

SEQ ID NO: 891520 - RNA, 19 nt, Homo sapiens
gaaacaccaguaagacaug

SEQ ID NO: 891521 - RNA, 19 nt, Homo sapiens
caaaauaccucagacauac

SEQ ID NO: 891522 - RNA, 19 nt, Homo sapiens
ucaagaauacccaagauca

SEQ ID NO: 891523 - RNA, 19 nt, Homo sapiens
gaaauucgguguuauguua

SEQ ID NO: 891524 - RNA, 19 nt, Homo sapiens
gauaagagcuucagaguuu

SEQ ID NO: 891525 - RNA, 19 nt, Homo sapiens
ggacacagcuuguaugaaa

SEQ ID NO: 891526 - RNA, 19 nt, Homo sapiens
caagagagcuuaacugaaa

SEQ ID NO: 891527 - RNA, 19 nt, Homo sapiens
gaacagauacugaagauaa

SEQ ID NO: 891528 - RNA, 19 nt, Homo sapiens
gaaccaauauccaguguuu

SEQ ID NO: 891529 - RNA, 19 nt, Homo sapiens
gaaauugacucagauugua

SEQ ID NO: 891530 - RNA, 19 nt, Homo sapiens
gcugaaagcugcaauagaa

SEQ ID NO: 891531 - RNA, 19 nt, Homo sapiens
ucaagcaacuguacauuua

SEQ ID NO: 891532 - RNA, 19 nt, Homo sapiens
ggaagaagauguaguaaag

SEQ ID NO: 891533 - RNA, 19 nt, Homo sapiens
gaaacugagucuucuagua

SEQ ID NO: 891534 - RNA, 19 nt, Homo sapiens
gaaccucaguuauguuuaa

SEQ ID NO: 891535 - RNA, 19 nt, Homo sapiens
caaaucagcugaaacagaa

SEQ ID NO: 891536 - RNA, 19 nt, Homo sapiens
gaacagcgacgccaguuua

SEQ ID NO: 891537 - RNA, 19 nt, Homo sapiens
gauaauggguucuuuguau

SEQ ID NO: 891538 - RNA, 19 nt, Homo sapiens
gaagggaaauuucaaacuu

SEQ ID NO: 891539 - RNA, 19 nt, Homo sapiens
gcacagauauuugcaauuc

SEQ ID NO: 891540 - RNA, 19 nt, Homo sapiens
ugaaacagcugauacuaaa

SEQ ID NO: 891541 - RNA, 19 nt, Homo sapiens
ggaaguucgucguuuauuu

SEQ ID NO: 891542 - RNA, 19 nt, Homo sapiens
gaauaagggugaucuacaa

SEQ ID NO: 891543 - RNA, 19 nt, Homo sapiens
cagaauggcuucaccuuaa

SEQ ID NO: 891544 - RNA, 19 nt, Homo sapiens
caaguaucgugacauauua

SEQ ID NO: 891545 - RNA, 19 nt, Homo sapiens
ggaaguacaugaucuuuua

SEQ ID NO: 891546 - RNA, 19 nt, Homo sapiens
gauagaagaucuuucacaa

SEQ ID NO: 891547 - RNA, 19 nt, Homo sapiens
gaaauggucuacaauaucu

SEQ ID NO: 891548 - RNA, 19 nt, Homo sapiens
gauggaaguucgucguuua

SEQ ID NO: 891549 - RNA, 19 nt, Homo sapiens
gaaagaaauugacaaccuu

SEQ ID NO: 891550 - RNA, 19 nt, Homo sapiens
gauagcagaucuucuaguu

SEQ ID NO: 891551 - RNA, 19 nt, Homo sapiens
gcaaucacauuauuccaaa

SEQ ID NO: 891552 - RNA, 19 nt, Homo sapiens
gcagaaauauggagcaugu

SEQ ID NO: 891553 - RNA, 19 nt, Homo sapiens
aagaguaccuucaaguuua

SEQ ID NO: 891554 - RNA, 19 nt, Homo sapiens
cgucauagauguacauauu

SEQ ID NO: 891555 - RNA, 19 nt, Homo sapiens
ggcaguaccucuaauauau

SEQ ID NO: 891556 - RNA, 19 nt, Homo sapiens
caaaauaccuugaugguuu

SEQ ID NO: 891557 - RNA, 19 nt, Homo sapiens
gauauggcuuggcauguua

SEQ ID NO: 891558 - RNA, 19 nt, Homo sapiens
gaaggccacuguaucauau

SEQ ID NO: 891559 - RNA, 19 nt, Homo sapiens
agaaacaccugcugcauuu

SEQ ID NO: 891560 - RNA, 19 nt, Homo sapiens
gguaaccuuucuccuauua

SEQ ID NO: 891561 - RNA, 19 nt, Homo sapiens
gaacgagggcgauucagua

SEQ ID NO: 891562 - RNA, 19 nt, Homo sapiens
agaaagaucuguccaagga

SEQ ID NO: 891563 - RNA, 19 nt, Homo sapiens
gagagauacuucugaugua

SEQ ID NO: 891564 - RNA, 19 nt, Homo sapiens
caaagucuguaauggauuu

SEQ ID NO: 891565 - RNA, 19 nt, Homo sapiens
gaacagaagauuaccgaaa

SEQ ID NO: 891566 - RNA, 19 nt, Homo sapiens
gcauuuaggucacaagaga

SEQ ID NO: 891567 - RNA, 19 nt, Homo sapiens
cuacaacucuggaaacuga

SEQ ID NO: 891568 - RNA, 19 nt, Homo sapiens
guacaucauuucucuuuga

SEQ ID NO: 891569 - RNA, 19 nt, Homo sapiens
ggaacaguauuacagcuaa

SEQ ID NO: 891570 - RNA, 19 nt, Homo sapiens
uagcagaucuucuaguuga

SEQ ID NO: 891571 - RNA, 19 nt, Homo sapiens
gcaaaccgaaccucaguua

SEQ ID NO: 891572 - RNA, 19 nt, Homo sapiens
ggacuacaauguuucguau

SEQ ID NO: 891573 - RNA, 19 nt, Homo sapiens
gagaaaggcugauguugca

SEQ ID NO: 891574 - RNA, 19 nt, Homo sapiens
ggaccuggauauaagagua

SEQ ID NO: 891575 - RNA, 19 nt, Homo sapiens
gaaauauggagcauguuua

SEQ ID NO: 891576 - RNA, 19 nt, Homo sapiens
gcccuacccugcauaauuu

SEQ ID NO: 891577 - RNA, 19 nt, Homo sapiens
ggaaagaaagggaauguga

SEQ ID NO: 891578 - RNA, 19 nt, Homo sapiens
gcauugccuuuacauauaa

SEQ ID NO: 891579 - RNA, 19 nt, Homo sapiens
gaacaaguauugcugaaaa

SEQ ID NO: 891580 - RNA, 19 nt, Homo sapiens
ucaagaagaucgacacgaa

SEQ ID NO: 891581 - RNA, 19 nt, Homo sapiens
caaacaagcacaguucuua

SEQ ID NO: 891582 - RNA, 19 nt, Homo sapiens
gaauuugacuuggagauga

SEQ ID NO: 891583 - RNA, 19 nt, Homo sapiens
gauacuuucugaagcauuu

SEQ ID NO: 891584 - RNA, 19 nt, Homo sapiens
gagaugaacuuuauuaucc

SEQ ID NO: 891585 - RNA, 19 nt, Homo sapiens
uaacacaauucaccucauu

SEQ ID NO: 891586 - RNA, 19 nt, Homo sapiens
gaaguaaagcucgaugaua

SEQ ID NO: 891587 - RNA, 19 nt, Homo sapiens
gaagacaaguucauuucau

SEQ ID NO: 891588 - RNA, 19 nt, Homo sapiens
acacgaaaguucuugcaua

SEQ ID NO: 891589 - RNA, 19 nt, Homo sapiens
gcauuuggcuccacucaug

SEQ ID NO: 891590 - RNA, 19 nt, Homo sapiens
cauuacaccuaaaggauua

SEQ ID NO: 891591 - RNA, 19 nt, Homo sapiens
cgagggcgauucaguaauu

SEQ ID NO: 891592 - RNA, 19 nt, Homo sapiens
gaaauucgcaguguugauu

SEQ ID NO: 891593 - RNA, 19 nt, Homo sapiens
ccacauacaacacacuuua

SEQ ID NO: 891594 - RNA, 19 nt, Homo sapiens
gaucagcauuguccacauu

SEQ ID NO: 891595 - RNA, 19 nt, Homo sapiens
caaaguggccuuaucagaa

SEQ ID NO: 891596 - RNA, 19 nt, Homo sapiens
cagagaagaugaaguagug

SEQ ID NO: 891597 - RNA, 19 nt, Homo sapiens
gagugaaauuugcucauaa

SEQ ID NO: 891598 - RNA, 19 nt, Homo sapiens
ggacggacauauaaugauc

SEQ ID NO: 891599 - RNA, 19 nt, Homo sapiens
ccaauaugcugcugauaga

SEQ ID NO: 891600 - RNA, 19 nt, Homo sapiens
uagaaggccuuguuuguau

SEQ ID NO: 891601 - RNA, 19 nt, Homo sapiens
gugcagagcugauggaagu

SEQ ID NO: 891602 - RNA, 19 nt, Homo sapiens
uaagggugaucuacaaauu

SEQ ID NO: 891603 - RNA, 19 nt, Homo sapiens
gcaaagaagggaaauuuca

SEQ ID NO: 891604 - RNA, 19 nt, Homo sapiens
aaacacugcuuuggaagua

SEQ ID NO: 891605 - RNA, 19 nt, Homo sapiens
caaaugaagcugaguuuau

SEQ ID NO: 891606 - RNA, 19 nt, Homo sapiens
ggauguggaugauagcaaa

SEQ ID NO: 891607 - RNA, 19 nt, Homo sapiens
cagaugauauucuuggaaa

SEQ ID NO: 891608 - RNA, 19 nt, Homo sapiens
caacaaaagugucagauga

SEQ ID NO: 891609 - RNA, 19 nt, Homo sapiens
ucaaagaaauggaauaagg

SEQ ID NO: 891610 - RNA, 19 nt, Homo sapiens
gagaguauaacauguauga

SEQ ID NO: 891611 - RNA, 19 nt, Homo sapiens
gcagauaaucgcuauauuc

SEQ ID NO: 891612 - RNA, 19 nt, Homo sapiens
gcaacaggaugugauaaug

SEQ ID NO: 891613 - RNA, 19 nt, Homo sapiens
aaauaaaucuucccaugga

SEQ ID NO: 891614 - RNA, 19 nt, Homo sapiens
ggaaguguugguaucauua

SEQ ID NO: 891615 - RNA, 19 nt, Homo sapiens
aaguaaagcucgaugauau

SEQ ID NO: 891616 - RNA, 19 nt, Homo sapiens
gaaaggcugauguugcaua

SEQ ID NO: 891617 - RNA, 19 nt, Homo sapiens
gugaauagauggcacaaca

SEQ ID NO: 891618 - RNA, 19 nt, Homo sapiens
ggacauauaaugaucugaa

SEQ ID NO: 891619 - RNA, 19 nt, Homo sapiens
cgacagaaaucuacuucga

SEQ ID NO: 891620 - RNA, 19 nt, Homo sapiens
gcaaaucagcugaaacaga

SEQ ID NO: 891621 - RNA, 19 nt, Homo sapiens
aaacaucaggcaagaaaua

SEQ ID NO: 891622 - RNA, 19 nt, Homo sapiens
gaaaguggaagcaacagaa

SEQ ID NO: 891623 - RNA, 19 nt, Homo sapiens
gcaaauagcacauuguuaa

SEQ ID NO: 891624 - RNA, 19 nt, Homo sapiens
ggaaggcuauuacauuauu

SEQ ID NO: 891625 - RNA, 19 nt, Homo sapiens
gaaggaaggcuauuacauu

SEQ ID NO: 891626 - RNA, 19 nt, Homo sapiens
ggaaacacauguggacuaa

SEQ ID NO: 891627 - RNA, 19 nt, Homo sapiens
ggaaauacauuaggauauc

SEQ ID NO: 891628 - RNA, 19 nt, Homo sapiens
gaaaguagcccauaaccau

SEQ ID NO: 891629 - RNA, 19 nt, Homo sapiens
aaggaaggcuauuacauua

SEQ ID NO: 891630 - RNA, 19 nt, Homo sapiens
gaaguuaccauuucaguau

SEQ ID NO: 891631 - RNA, 19 nt, Homo sapiens
gcaauaaucuuaacaaccu

SEQ ID NO: 891632 - RNA, 19 nt, Homo sapiens
uaaggaggauuaauucuga

SEQ ID NO: 891633 - RNA, 19 nt, Homo sapiens
gaagaagucuguguauauc

SEQ ID NO: 891634 - RNA, 19 nt, Homo sapiens
guaaagcgaaguuauguaa

SEQ ID NO: 891635 - RNA, 19 nt, Homo sapiens
caagcaguaugauguuaua

SEQ ID NO: 891636 - RNA, 19 nt, Homo sapiens
uuacagagguaucaauuug

SEQ ID NO: 891637 - RNA, 19 nt, Homo sapiens
ccucuuuccugaauauuua

SEQ ID NO: 891638 - RNA, 19 nt, Homo sapiens
gaaagaagaagacaaugau

SEQ ID NO: 891639 - RNA, 19 nt, Homo sapiens
gcaguaugauguuauagga

SEQ ID NO: 891640 - RNA, 19 nt, Homo sapiens
gaggauuaauucugaggua

SEQ ID NO: 891641 - RNA, 19 nt, Homo sapiens
ugaagaggcuggaaaguag

SEQ ID NO: 891642 - RNA, 19 nt, Homo sapiens
gaacuuagccgaguagaag

SEQ ID NO: 891643 - RNA, 19 nt, Homo sapiens
agacaugacuugcaucaga

SEQ ID NO: 891644 - RNA, 19 nt, Homo sapiens
gaggugaaguuaccauuuc

SEQ ID NO: 891645 - RNA, 19 nt, Homo sapiens
gaaccauaguuguguccua

SEQ ID NO: 891646 - RNA, 19 nt, Homo sapiens
ggaguugcuuuaugacuau

SEQ ID NO: 891647 - RNA, 19 nt, Homo sapiens
gauuaauucugagguagua

SEQ ID NO: 891648 - RNA, 19 nt, Homo sapiens
uaugugggaugauuacuuu

SEQ ID NO: 891649 - RNA, 19 nt, Homo sapiens
uagaagaagucuguguaua

SEQ ID NO: 891650 - RNA, 19 nt, Homo sapiens
caaccucuuuccugaauau

SEQ ID NO: 891651 - RNA, 19 nt, Homo sapiens
aaagcaagaugaaauguca

SEQ ID NO: 891652 - RNA, 19 nt, Homo sapiens
gcuggaaaguagcccauaa

SEQ ID NO: 891653 - RNA, 19 nt, Homo sapiens
agaugaagcucugcaguuu

SEQ ID NO: 891654 - RNA, 19 nt, Homo sapiens
guauuucucuguuaagcaa

SEQ ID NO: 891655 - RNA, 19 nt, Homo sapiens
uguaugguguuaugacuaa

SEQ ID NO: 891656 - RNA, 19 nt, Homo sapiens
gccaagcaguaugauguua

SEQ ID NO: 891657 - RNA, 19 nt, Homo sapiens
gaagaagacaaugaugaaa

SEQ ID NO: 891658 - RNA, 19 nt, Homo sapiens
gaugaaccaaugacaaauu

SEQ ID NO: 891659 - RNA, 19 nt, Homo sapiens
gauggaaggaaggcuauua

SEQ ID NO: 891660 - RNA, 19 nt, Homo sapiens
gagaugaagcucugcaguu

SEQ ID NO: 891661 - RNA, 19 nt, Homo sapiens
ggaggugaaguuaccauuu

SEQ ID NO: 891662 - RNA, 19 nt, Homo sapiens
agaagaagucuguguauau

SEQ ID NO: 891663 - RNA, 19 nt, Homo sapiens
gauuuguguucuuacagua

SEQ ID NO: 891664 - RNA, 19 nt, Homo sapiens
cgacgaugcuugcacauac

SEQ ID NO: 891665 - RNA, 19 nt, Homo sapiens
ucauggauuuguguucuua

SEQ ID NO: 891666 - RNA, 19 nt, Homo sapiens
gcuguaaucuuuuguuuug

SEQ ID NO: 891667 - RNA, 19 nt, Homo sapiens
uaacuaugacugcaacaaa

SEQ ID NO: 891668 - RNA, 19 nt, Homo sapiens
aaacacauguggacuaaaa

SEQ ID NO: 891669 - RNA, 19 nt, Homo sapiens
uacuggagcuguuguagaa

SEQ ID NO: 891670 - RNA, 19 nt, Homo sapiens
cagaugaaccaaugacaaa

SEQ ID NO: 891671 - RNA, 19 nt, Homo sapiens
caagagggcuguacaaaag

SEQ ID NO: 891672 - RNA, 19 nt, Homo sapiens
uggaguugcuuuaugacua

SEQ ID NO: 891673 - RNA, 19 nt, Homo sapiens
auucugagguaguauagua

SEQ ID NO: 891674 - RNA, 19 nt, Homo sapiens
ggauuuguguucuuacagu

SEQ ID NO: 891675 - RNA, 19 nt, Homo sapiens
gcuugcugcuguaaucuuu

SEQ ID NO: 891676 - RNA, 19 nt, Homo sapiens
gauguaaagcgaaguuaug

SEQ ID NO: 891677 - RNA, 19 nt, Homo sapiens
gauuacagagguaucaauu

SEQ ID NO: 891678 - RNA, 19 nt, Homo sapiens
gggaaacacauguggacua

SEQ ID NO: 891679 - RNA, 19 nt, Homo sapiens
auauggaguugcuuuauga

SEQ ID NO: 891680 - RNA, 19 nt, Homo sapiens
uauauggaguugcuuuaug

SEQ ID NO: 891681 - RNA, 19 nt, Homo sapiens
gagagaaggaauuugauca

SEQ ID NO: 891682 - RNA, 19 nt, Homo sapiens
aaacucacuuccagaacuu

SEQ ID NO: 891683 - RNA, 19 nt, Homo sapiens
agucaaaccugaagucaag

SEQ ID NO: 891684 - RNA, 19 nt, Homo sapiens
cuaaauauauggaguugcu

SEQ ID NO: 891685 - RNA, 19 nt, Homo sapiens
ggaaggaaggcuauuacau

SEQ ID NO: 891686 - RNA, 19 nt, Homo sapiens
agaagcaaauagcacauug

SEQ ID NO: 891687 - RNA, 19 nt, Homo sapiens
agaaagaagaagacaauga

SEQ ID NO: 891688 - RNA, 19 nt, Homo sapiens
ucugauuucuuaagcauug

SEQ ID NO: 891689 - RNA, 19 nt, Homo sapiens
agagguaucaauuugguua

SEQ ID NO: 891690 - RNA, 19 nt, Homo sapiens
ccauuucaguauaugcuaa

SEQ ID NO: 891691 - RNA, 19 nt, Homo sapiens
gcaucagacuggaggugaa

SEQ ID NO: 891692 - RNA, 19 nt, Homo sapiens
gaaauuauggggugugauu

SEQ ID NO: 891693 - RNA, 19 nt, Homo sapiens
aauggaggguguucaaaga

SEQ ID NO: 891694 - RNA, 19 nt, Homo sapiens
guggaaauacauuaggaua

SEQ ID NO: 891695 - RNA, 19 nt, Homo sapiens
gguuaacauuagguucuua

SEQ ID NO: 891696 - RNA, 19 nt, Homo sapiens
cauuucaggguuaacauua

SEQ ID NO: 891697 - RNA, 19 nt, Homo sapiens
gagaagaacaacugauuuu

SEQ ID NO: 891698 - RNA, 19 nt, Homo sapiens
gaauggaggguguucaaag

SEQ ID NO: 891699 - RNA, 19 nt, Homo sapiens
ucaagacuacugagaagaa

SEQ ID NO: 891700 - RNA, 19 nt, Homo sapiens
aaaguagcccauaaccaua

SEQ ID NO: 891701 - RNA, 19 nt, Homo sapiens
ugaaggagagaaggaauuu

SEQ ID NO: 891702 - RNA, 19 nt, Homo sapiens
aaagguagacauaauagug

SEQ ID NO: 891703 - RNA, 19 nt, Homo sapiens
agaagaagacaaugaugaa

SEQ ID NO: 891704 - RNA, 19 nt, Homo sapiens
guucuuacaguacuugaaa

SEQ ID NO: 891705 - RNA, 19 nt, Homo sapiens
guuguuguguuacugaaug

SEQ ID NO: 891706 - RNA, 19 nt, Homo sapiens
ggagagaaggaauuugauc

SEQ ID NO: 891707 - RNA, 19 nt, Homo sapiens
aagaagaagacaaugauga

SEQ ID NO: 891708 - RNA, 19 nt, Homo sapiens
aagagaagaacaacugauu

SEQ ID NO: 891709 - RNA, 19 nt, Homo sapiens
uguauaucauucuggagua

SEQ ID NO: 891710 - RNA, 19 nt, Homo sapiens
gguaggaaccauaguugug

SEQ ID NO: 891711 - RNA, 19 nt, Homo sapiens
gcauuucaggguuaacauu

SEQ ID NO: 891712 - RNA, 19 nt, Homo sapiens
uaacaaccucuuuccugaa

SEQ ID NO: 891713 - RNA, 19 nt, Homo sapiens
ucauuucucccuacuggua

SEQ ID NO: 891714 - RNA, 19 nt, Homo sapiens
aaggagagaaggaauuuga

SEQ ID NO: 891715 - RNA, 19 nt, Homo sapiens
guaagagaagaacaacuga

SEQ ID NO: 891716 - RNA, 19 nt, Homo sapiens
gaagucuguguauaucauu

SEQ ID NO: 891717 - RNA, 19 nt, Homo sapiens
guuugggccuugccuguga

SEQ ID NO: 891718 - RNA, 19 nt, Homo sapiens
auugggaccucauguaaga

SEQ ID NO: 891719 - RNA, 19 nt, Homo sapiens
agagaagaacaacugauuu

SEQ ID NO: 891720 - RNA, 19 nt, Homo sapiens
gaagcaaauagcacauugu

SEQ ID NO: 891721 - RNA, 19 nt, Homo sapiens
gguguuaugacuaauuguu

SEQ ID NO: 891722 - RNA, 19 nt, Homo sapiens
gaaauacuggagcuguugu

SEQ ID NO: 891723 - RNA, 19 nt, Homo sapiens
uaucauaacugcacuguga

SEQ ID NO: 891724 - RNA, 19 nt, Homo sapiens
caacauguaucucuaugaa

SEQ ID NO: 891725 - RNA, 19 nt, Homo sapiens
gggcaaggcucccgauuau

SEQ ID NO: 891726 - RNA, 19 nt, Homo sapiens
uaaaggugcugguaagauu

SEQ ID NO: 891727 - RNA, 19 nt, Homo sapiens
gcaaggcucccgauuauga

SEQ ID NO: 891728 - RNA, 19 nt, Homo sapiens
gcagaaauuggaaaguuua

SEQ ID NO: 891729 - RNA, 19 nt, Homo sapiens
cagaaggaguucauuacua

SEQ ID NO: 891730 - RNA, 19 nt, Homo sapiens
ccaggucucuuucaacaaa

SEQ ID NO: 891731 - RNA, 19 nt, Homo sapiens
ggaccaagcagcgauauaa

SEQ ID NO: 891732 - RNA, 19 nt, Homo sapiens
ccugauagauguacacuga

SEQ ID NO: 891733 - RNA, 19 nt, Homo sapiens
gaacaucacaaguaucgaa

SEQ ID NO: 891734 - RNA, 19 nt, Homo sapiens
ccaagcagcgauauaauaa

SEQ ID NO: 891735 - RNA, 19 nt, Homo sapiens
ggucuucucuguugguuga

SEQ ID NO: 891736 - RNA, 19 nt, Homo sapiens
gaacaaagcacaggaaugc

SEQ ID NO: 891737 - RNA, 19 nt, Homo sapiens
gaggaaacuugcucaacuu

SEQ ID NO: 891738 - RNA, 19 nt, Homo sapiens
gagauggacugccacuuuc

SEQ ID NO: 891739 - RNA, 19 nt, Homo sapiens
gaacagucauaugccauug

SEQ ID NO: 891740 - RNA, 19 nt, Homo sapiens
ggcggaaugucaaaucuuu

SEQ ID NO: 891741 - RNA, 19 nt, Homo sapiens
ggugugaaauugguucuuu

SEQ ID NO: 891742 - RNA, 19 nt, Homo sapiens
aguaauggauguuuccuuu

SEQ ID NO: 891743 - RNA, 19 nt, Homo sapiens
gcagagugauggugaugau

SEQ ID NO: 891744 - RNA, 19 nt, Homo sapiens
gauaaaucuuucugacaug

SEQ ID NO: 891745 - RNA, 19 nt, Homo sapiens
ccaagauggugugaaauug

SEQ ID NO: 891746 - RNA, 19 nt, Homo sapiens
ugauagauguacacugaaa

SEQ ID NO: 891747 - RNA, 19 nt, Homo sapiens
guggagcucugaauuuaau

SEQ ID NO: 891748 - RNA, 19 nt, Homo sapiens
gcugaggccuccuuaucaa

SEQ ID NO: 891749 - RNA, 19 nt, Homo sapiens
gggagcauuuguuacacua

SEQ ID NO: 891750 - RNA, 19 nt, Homo sapiens
ugucagggauuguaggauu

SEQ ID NO: 891751 - RNA, 19 nt, Homo sapiens
gcaacucugucagggauug

SEQ ID NO: 891752 - RNA, 19 nt, Homo sapiens
gaagaauguuggccaugag

SEQ ID NO: 891753 - RNA, 19 nt, Homo sapiens
agaagaauguuggccauga

SEQ ID NO: 891754 - RNA, 19 nt, Homo sapiens
cgaggaaacuugcucaacu

SEQ ID NO: 891755 - RNA, 19 nt, Homo sapiens
aaacuucagucucuuuagu

SEQ ID NO: 891756 - RNA, 19 nt, Homo sapiens
gcacugugaugaagaagcu

SEQ ID NO: 891757 - RNA, 19 nt, Homo sapiens
ggauaaggagggaacauau

SEQ ID NO: 891758 - RNA, 19 nt, Homo sapiens
ggaguucauuacuacuuau

SEQ ID NO: 891759 - RNA, 19 nt, Homo sapiens
agaaggaguucauuacuac

SEQ ID NO: 891760 - RNA, 19 nt, Homo sapiens
ccaaacuucagucucuuua

SEQ ID NO: 891761 - RNA, 19 nt, Homo sapiens
aaucuuaacucuggaaauc

SEQ ID NO: 891762 - RNA, 19 nt, Homo sapiens
gcauuaguauagaccaaau

SEQ ID NO: 891763 - RNA, 19 nt, Homo sapiens
gagcauuuguuacacuaca

SEQ ID NO: 891764 - RNA, 19 nt, Homo sapiens
aagcagcgauauaauaauc

SEQ ID NO: 891765 - RNA, 19 nt, Homo sapiens
guacuacgaguuuauaaag

SEQ ID NO: 891766 - RNA, 19 nt, Homo sapiens
uaacugcacugugaugaag

SEQ ID NO: 891767 - RNA, 19 nt, Homo sapiens
gggauaaggagggaacaua

SEQ ID NO: 891768 - RNA, 19 nt, Homo sapiens
gaggccuccuuaucaaauu

SEQ ID NO: 891769 - RNA, 19 nt, Homo sapiens
gaaacuugcucaacuuccu

SEQ ID NO: 891770 - RNA, 19 nt, Homo sapiens
gagggaacauaucauaacu

SEQ ID NO: 891771 - RNA, 19 nt, Homo sapiens
agagauggacugccacuuu

SEQ ID NO: 891772 - RNA, 19 nt, Homo sapiens
gaccauacuguuucauuga

SEQ ID NO: 891773 - RNA, 19 nt, Homo sapiens
aggaguucauuacuacuua

SEQ ID NO: 891774 - RNA, 19 nt, Homo sapiens
gaaaauuacccaaauguuc

SEQ ID NO: 891775 - RNA, 19 nt, Homo sapiens
uaauggauguuuccuuucu

SEQ ID NO: 891776 - RNA, 19 nt, Homo sapiens
agaccauacuguuucauug

SEQ ID NO: 891777 - RNA, 19 nt, Homo sapiens
aguccaagauggugugaaa

SEQ ID NO: 891778 - RNA, 19 nt, Homo sapiens
ugcagaaauuggaaaguuu

SEQ ID NO: 891779 - RNA, 19 nt, Homo sapiens
cugcagaaauuggaaaguu

SEQ ID NO: 891780 - RNA, 19 nt, Homo sapiens
aauaaucccaggucucuuu

SEQ ID NO: 891781 - RNA, 19 nt, Homo sapiens
ggacugccacuuucugcuu

SEQ ID NO: 891782 - RNA, 19 nt, Homo sapiens
caaauguucucgccuucuc

SEQ ID NO: 891783 - RNA, 19 nt, Homo sapiens
ggagggaacauaucauaac

SEQ ID NO: 891784 - RNA, 19 nt, Homo sapiens
gcaacauguaucucuauga

SEQ ID NO: 891785 - RNA, 19 nt, Homo sapiens
auucgaggcuuucaugcua

SEQ ID NO: 891786 - RNA, 19 nt, Homo sapiens
auguggagcucugaauuua

SEQ ID NO: 891787 - RNA, 19 nt, Homo sapiens
ucaacuuccugauagaugu

SEQ ID NO: 891788 - RNA, 19 nt, Homo sapiens
uucagucucuuuaguacua

SEQ ID NO: 891789 - RNA, 19 nt, Homo sapiens
caccugauguagaagaaga

SEQ ID NO: 891790 - RNA, 19 nt, Homo sapiens
gguacuacgaguuuauaaa

SEQ ID NO: 891791 - RNA, 19 nt, Homo sapiens
caaccugaguuugccuuug

SEQ ID NO: 891792 - RNA, 19 nt, Homo sapiens
aaagucuccugcagaguga

SEQ ID NO: 891793 - RNA, 19 nt, Homo sapiens
gauguuuccuuucuaaucc

SEQ ID NO: 891794 - RNA, 19 nt, Homo sapiens
gucagggauuguaggauuu

SEQ ID NO: 891795 - RNA, 19 nt, Homo sapiens
ggaaccagcaacucuguca

SEQ ID NO: 891796 - RNA, 19 nt, Homo sapiens
ggauguuuccuuucuaauc

SEQ ID NO: 891797 - RNA, 19 nt, Homo sapiens
acaccauccuucagaucua

SEQ ID NO: 891798 - RNA, 19 nt, Homo sapiens
cgcaaccucuggcagcuuu

SEQ ID NO: 891799 - RNA, 19 nt, Homo sapiens
gaacuggggucagccaaug

SEQ ID NO: 891800 - RNA, 19 nt, Homo sapiens
aaggagggaacauaucaua

SEQ ID NO: 891801 - RNA, 19 nt, Homo sapiens
uaugcaacauguaucucua

SEQ ID NO: 891802 - RNA, 19 nt, Homo sapiens
agagugauggugaugauuu

SEQ ID NO: 891803 - RNA, 19 nt, Homo sapiens
gcaggagugcagaaaguau

SEQ ID NO: 891804 - RNA, 19 nt, Homo sapiens
uauguggagcucugaauuu

SEQ ID NO: 891805 - RNA, 19 nt, Homo sapiens
acauguaucucuaugaacu

SEQ ID NO: 891806 - RNA, 19 nt, Homo sapiens
ucgaggcuuucaugcuaua

SEQ ID NO: 891807 - RNA, 19 nt, Homo sapiens
uuaaaaugcuuucgaggaa

SEQ ID NO: 891808 - RNA, 19 nt, Homo sapiens
ggcuuaaucugucuaugca

SEQ ID NO: 891809 - RNA, 19 nt, Homo sapiens
caacuuccugauagaugua

SEQ ID NO: 891810 - RNA, 19 nt, Homo sapiens
guaaaggugcugguaagau

SEQ ID NO: 891811 - RNA, 19 nt, Homo sapiens
ggagucacaucagcauuuu

SEQ ID NO: 891812 - RNA, 19 nt, Homo sapiens
accaagcagcgauauaaua

SEQ ID NO: 891813 - RNA, 19 nt, Homo sapiens
aaccugaguuugccuuugu

SEQ ID NO: 891814 - RNA, 19 nt, Homo sapiens
acagucauaugccauugga

SEQ ID NO: 891815 - RNA, 19 nt, Homo sapiens
ucccaggucucuuucaaca

SEQ ID NO: 891816 - RNA, 19 nt, Homo sapiens
auacugcugucagaccaua

SEQ ID NO: 891817 - RNA, 19 nt, Homo sapiens
uaccaguguuauuuacuug

SEQ ID NO: 891818 - RNA, 19 nt, Homo sapiens
uugcucaacuuccugauag

SEQ ID NO: 891819 - RNA, 19 nt, Homo sapiens
gggagugagcuacaugaug

SEQ ID NO: 891820 - RNA, 19 nt, Homo sapiens
ccuuucuaauccacauuua

SEQ ID NO: 891821 - RNA, 19 nt, Homo sapiens
auacaguaauggauguuuc

SEQ ID NO: 891822 - RNA, 19 nt, Homo sapiens
caagauggugugaaauugg

SEQ ID NO: 891823 - RNA, 19 nt, Homo sapiens
gcagaaagcuguagugaua

SEQ ID NO: 891824 - RNA, 19 nt, Homo sapiens
ggagaaagacugaaaguua

SEQ ID NO: 891825 - RNA, 19 nt, Homo sapiens
gagaaagacugaaaguuaa

SEQ ID NO: 891826 - RNA, 19 nt, Homo sapiens
gauaagcucuucuuuguau

SEQ ID NO: 891827 - RNA, 19 nt, Homo sapiens
gaagcuaucuuaaaucugu

SEQ ID NO: 891828 - RNA, 19 nt, Homo sapiens
gaagaaauguuagacaaug

SEQ ID NO: 891829 - RNA, 19 nt, Homo sapiens
gggauaagcucuucuuugu

SEQ ID NO: 891830 - RNA, 19 nt, Homo sapiens
gaaagcugcugauguugaa

SEQ ID NO: 891831 - RNA, 19 nt, Homo sapiens
gaagaaauagacgcaauua

SEQ ID NO: 891832 - RNA, 19 nt, Homo sapiens
caaggcagcuauacauuug

SEQ ID NO: 891833 - RNA, 19 nt, Homo sapiens
gaaauagacgcaauuauag

SEQ ID NO: 891834 - RNA, 19 nt, Homo sapiens
agagaaagcugcugauguu

SEQ ID NO: 891835 - RNA, 19 nt, Homo sapiens
gugauaaccucucuccuaa

SEQ ID NO: 891836 - RNA, 19 nt, Homo sapiens
caaguagaauguuuccuuu

SEQ ID NO: 891837 - RNA, 19 nt, Homo sapiens
ucccaaagcuauagucaua

SEQ ID NO: 891838 - RNA, 19 nt, Homo sapiens
gaacauuacuucugcuuuu

SEQ ID NO: 891839 - RNA, 19 nt, Homo sapiens
ggaccuugcugcaguaaau

SEQ ID NO: 891840 - RNA, 19 nt, Homo sapiens
ugaagaaacuaaucucaga

SEQ ID NO: 891841 - RNA, 19 nt, Homo sapiens
gcaaaugcuuuauuaaggu

SEQ ID NO: 891842 - RNA, 19 nt, Homo sapiens
cacgaaagcuggaaaguuc

SEQ ID NO: 891843 - RNA, 19 nt, Homo sapiens
guucagaggcugcaauuaa

SEQ ID NO: 891844 - RNA, 19 nt, Homo sapiens
gaaacaaaauccucgguaa

SEQ ID NO: 891845 - RNA, 19 nt, Homo sapiens
gaaacauaguaucagcuuu

SEQ ID NO: 891846 - RNA, 19 nt, Homo sapiens
gcauuaaacuaucuggaau

SEQ ID NO: 891847 - RNA, 19 nt, Homo sapiens
caaaagcucccaagucuua

SEQ ID NO: 891848 - RNA, 19 nt, Homo sapiens
ggaagugaguuauaaugag

SEQ ID NO: 891849 - RNA, 19 nt, Homo sapiens
acacaccgcuaacaaaguu

SEQ ID NO: 891850 - RNA, 19 nt, Homo sapiens
caagugucauuacgaugua

SEQ ID NO: 891851 - RNA, 19 nt, Homo sapiens
ggugacauauuucuagaga

SEQ ID NO: 891852 - RNA, 19 nt, Homo sapiens
gagaacauuugcuuugcuu

SEQ ID NO: 891853 - RNA, 19 nt, Homo sapiens
gauaaccucucuccuaaaa

SEQ ID NO: 891854 - RNA, 19 nt, Homo sapiens
cacagucuauuucucauaa

SEQ ID NO: 891855 - RNA, 19 nt, Homo sapiens
gaauuacagugacaguuca

SEQ ID NO: 891856 - RNA, 19 nt, Homo sapiens
gauuaaaccaccaacaauu

SEQ ID NO: 891857 - RNA, 19 nt, Homo sapiens
ggacuacuuuggugagugu

SEQ ID NO: 891858 - RNA, 19 nt, Homo sapiens
guaauugaguuccuacauc

SEQ ID NO: 891859 - RNA, 19 nt, Homo sapiens
ccaccucucuuuguaauug

SEQ ID NO: 891860 - RNA, 19 nt, Homo sapiens
uccagaaacuauugucaua

SEQ ID NO: 891861 - RNA, 19 nt, Homo sapiens
cagaagcuaucuuaaaucu

SEQ ID NO: 891862 - RNA, 19 nt, Homo sapiens
cagcagaagcuaucuuaaa

SEQ ID NO: 891863 - RNA, 19 nt, Homo sapiens
caacauacaguuuaagauc

SEQ ID NO: 891864 - RNA, 19 nt, Homo sapiens
ggaauuacagugacaguuc

SEQ ID NO: 891865 - RNA, 19 nt, Homo sapiens
gcuagaauccaguaaauca

SEQ ID NO: 891866 - RNA, 19 nt, Homo sapiens
gaacauuugcuuugcuuuc

SEQ ID NO: 891867 - RNA, 19 nt, Homo sapiens
ggcaaaugcuuuauuaagg

SEQ ID NO: 891868 - RNA, 19 nt, Homo sapiens
ggugguccuugcccaguua

SEQ ID NO: 891869 - RNA, 19 nt, Homo sapiens
uuaaaucugugauguguca

SEQ ID NO: 891870 - RNA, 19 nt, Homo sapiens
caaacaaugaagccuauuu

SEQ ID NO: 891871 - RNA, 19 nt, Homo sapiens
gauaauguggucauaguau

SEQ ID NO: 891872 - RNA, 19 nt, Homo sapiens
uaucuucucuucuauccaa

SEQ ID NO: 891873 - RNA, 19 nt, Homo sapiens
auauaaagcuuacccaaca

SEQ ID NO: 891874 - RNA, 19 nt, Homo sapiens
ucauuacgauguaucacua

SEQ ID NO: 891875 - RNA, 19 nt, Homo sapiens
ucaaauacgucacgaaagc

SEQ ID NO: 891876 - RNA, 19 nt, Homo sapiens
gccagucugucugugauua

SEQ ID NO: 891877 - RNA, 19 nt, Homo sapiens
gucaaaauguugccaaaua

SEQ ID NO: 891878 - RNA, 19 nt, Homo sapiens
ucaaguguuugccuuauuc

SEQ ID NO: 891879 - RNA, 19 nt, Homo sapiens
agaguuaacuggucucauc

SEQ ID NO: 891880 - RNA, 19 nt, Homo sapiens
gcuaccgaaucuaacauuu

SEQ ID NO: 891881 - RNA, 19 nt, Homo sapiens
aaacuguuccggugacaua

SEQ ID NO: 891882 - RNA, 19 nt, Homo sapiens
ucaccaagguacuaacaug

SEQ ID NO: 891883 - RNA, 19 nt, Homo sapiens
cggcagauuugauauaaca

SEQ ID NO: 891884 - RNA, 19 nt, Homo sapiens
acauggaagugaguuauaa

SEQ ID NO: 891885 - RNA, 19 nt, Homo sapiens
ucaaucuucucagcuuaua

SEQ ID NO: 891886 - RNA, 19 nt, Homo sapiens
uaaggauaauguggucaua

SEQ ID NO: 891887 - RNA, 19 nt, Homo sapiens
gaagugccaccucucuuug

SEQ ID NO: 891888 - RNA, 19 nt, Homo sapiens
cgaagugccaccucucuuu

SEQ ID NO: 891889 - RNA, 19 nt, Homo sapiens
ggauaagcucuucuuugua

SEQ ID NO: 891890 - RNA, 19 nt, Homo sapiens
uuuaaugucuugacucuuc

SEQ ID NO: 891891 - RNA, 19 nt, Homo sapiens
ggauagcccuuacacucau

SEQ ID NO: 891892 - RNA, 19 nt, Homo sapiens
acuauuagguaccaaguga

SEQ ID NO: 891893 - RNA, 19 nt, Homo sapiens
ggaaaacuauugaaggaau

SEQ ID NO: 891894 - RNA, 19 nt, Homo sapiens
guaaaguacacaaacaaug

SEQ ID NO: 891895 - RNA, 19 nt, Homo sapiens
gaauaagaaaggcaacguu

SEQ ID NO: 891896 - RNA, 19 nt, Homo sapiens
ggagcccacucagcaguuu

SEQ ID NO: 891897 - RNA, 19 nt, Homo sapiens
gggcaaaugcuuuauuaag

SEQ ID NO: 891898 - RNA, 19 nt, Homo sapiens
gcuccaugcuccauucuca

SEQ ID NO: 891899 - RNA, 19 nt, Homo sapiens
cacaaacaaugaagccuau

SEQ ID NO: 891900 - RNA, 19 nt, Homo sapiens
caacaauucuacgcucugu

SEQ ID NO: 891901 - RNA, 19 nt, Homo sapiens
ccaaguagaauguuuccuu

SEQ ID NO: 891902 - RNA, 19 nt, Homo sapiens
ccaaauaucacaccuucug

SEQ ID NO: 891903 - RNA, 19 nt, Homo sapiens
uggcacagguguugggaaa

SEQ ID NO: 891904 - RNA, 19 nt, Homo sapiens
agcagaagcuaucuuaaau

SEQ ID NO: 891905 - RNA, 19 nt, Homo sapiens
ccacucagcaguuuucuua

SEQ ID NO: 891906 - RNA, 19 nt, Homo sapiens
gaucuuagccaucccaaac

SEQ ID NO: 891907 - RNA, 19 nt, Homo sapiens
gggcagcuguccaacauac

SEQ ID NO: 891908 - RNA, 19 nt, Homo sapiens
ggauaauguggucauagua

SEQ ID NO: 891909 - RNA, 19 nt, Homo sapiens
aggcugcaauuaaggauaa

SEQ ID NO: 891910 - RNA, 19 nt, Homo sapiens
gcuccauucuucuuucaau

SEQ ID NO: 891911 - RNA, 19 nt, Homo sapiens
ucauguuuccuucuuguua

SEQ ID NO: 891912 - RNA, 19 nt, Homo sapiens
aauguaggauucuuaagga

SEQ ID NO: 891913 - RNA, 19 nt, Homo sapiens
gcucccaagucuuaaagga

SEQ ID NO: 891914 - RNA, 19 nt, Homo sapiens
ugugcuaucuucucuucua

SEQ ID NO: 891915 - RNA, 19 nt, Homo sapiens
ggaaagucagucaacaguu

SEQ ID NO: 891916 - RNA, 19 nt, Homo sapiens
ggaacauuacuucugcuuu

SEQ ID NO: 891917 - RNA, 19 nt, Homo sapiens
uuaaagcauuugugucuag

SEQ ID NO: 891918 - RNA, 19 nt, Homo sapiens
acaaggcagcuauacauuu

SEQ ID NO: 891919 - RNA, 19 nt, Homo sapiens
gaaccugacacccacacaa

SEQ ID NO: 891920 - RNA, 19 nt, Homo sapiens
ucccuaaucucaacaaucu

SEQ ID NO: 891921 - RNA, 19 nt, Homo sapiens
uauaaccgucuuucccuua

SEQ ID NO: 891922 - RNA, 19 nt, Homo sapiens
cauguuuccuucuuguuau

SEQ ID NO: 891923 - RNA, 19 nt, Homo sapiens
gaaaggagcucaauggaaa

SEQ ID NO: 891924 - RNA, 19 nt, Homo sapiens
gaacggcuguuuccucuua

SEQ ID NO: 891925 - RNA, 19 nt, Homo sapiens
gaaaugaacgguagaauug

SEQ ID NO: 891926 - RNA, 19 nt, Homo sapiens
gagaagacauggaugauga

SEQ ID NO: 891927 - RNA, 19 nt, Homo sapiens
gaacagaugaaacaagaua

SEQ ID NO: 891928 - RNA, 19 nt, Homo sapiens
uaaagaggcugcccagaaa

SEQ ID NO: 891929 - RNA, 19 nt, Homo sapiens
gaacuuaagcgcaaauuug

SEQ ID NO: 891930 - RNA, 19 nt, Homo sapiens
gaaccgugcugcauacuau

SEQ ID NO: 891931 - RNA, 19 nt, Homo sapiens
ggacaaauccauugauaau

SEQ ID NO: 891932 - RNA, 19 nt, Homo sapiens
uaaauaugcugcaggaguu

SEQ ID NO: 891933 - RNA, 19 nt, Homo sapiens
gcaggaagcagcugaaaga

SEQ ID NO: 891934 - RNA, 19 nt, Homo sapiens
ggagauugauaauucagaa

SEQ ID NO: 891935 - RNA, 19 nt, Homo sapiens
cauguaaggugguuuguga

SEQ ID NO: 891936 - RNA, 19 nt, Homo sapiens
guaggcaacauauucauua

SEQ ID NO: 891937 - RNA, 19 nt, Homo sapiens
gcuccuagaccaccauuua

SEQ ID NO: 891938 - RNA, 19 nt, Homo sapiens
gccauuguauguagcuuua

SEQ ID NO: 891939 - RNA, 19 nt, Homo sapiens
gugcaaagguuaugaugga

SEQ ID NO: 891940 - RNA, 19 nt, Homo sapiens
ccuaaaugaucgcaaagua

SEQ ID NO: 891941 - RNA, 19 nt, Homo sapiens
gcuaacacaucaacacaga

SEQ ID NO: 891942 - RNA, 19 nt, Homo sapiens
gcgcaaauuugaacagaug

SEQ ID NO: 891943 - RNA, 19 nt, Homo sapiens
cuacggauuuguacacuuu

SEQ ID NO: 891944 - RNA, 19 nt, Homo sapiens
uaaagcaguuacagaaaug

SEQ ID NO: 891945 - RNA, 19 nt, Homo sapiens
ugaaaguaaugacugauga

SEQ ID NO: 891946 - RNA, 19 nt, Homo sapiens
ggaaaggagcucaauggaa

SEQ ID NO: 891947 - RNA, 19 nt, Homo sapiens
uaaaaucacuggcauguug

SEQ ID NO: 891948 - RNA, 19 nt, Homo sapiens
ggaaugcuccuaaaugauc

SEQ ID NO: 891949 - RNA, 19 nt, Homo sapiens
cuaaagcaguuacagaaau

SEQ ID NO: 891950 - RNA, 19 nt, Homo sapiens
gaacgucuccggaaagagu

SEQ ID NO: 891951 - RNA, 19 nt, Homo sapiens
gaacggcagacggaacuua

SEQ ID NO: 891952 - RNA, 19 nt, Homo sapiens
gcugaaagagcuauugaaa

SEQ ID NO: 891953 - RNA, 19 nt, Homo sapiens
gcucgagucuccagaguca

SEQ ID NO: 891954 - RNA, 19 nt, Homo sapiens
gcuccuaaaugaucgcaaa

SEQ ID NO: 891955 - RNA, 19 nt, Homo sapiens
aguccuagauuacuuauug

SEQ ID NO: 891956 - RNA, 19 nt, Homo sapiens
uaagguugaugaagcugua

SEQ ID NO: 891957 - RNA, 19 nt, Homo sapiens
gggccugccuuaaguguga

SEQ ID NO: 891958 - RNA, 19 nt, Homo sapiens
gcaaggaaacguaauuugg

SEQ ID NO: 891959 - RNA, 19 nt, Homo sapiens
caaaagaauucaccaaugu

SEQ ID NO: 891960 - RNA, 19 nt, Homo sapiens
gcaaaagaauucaccaaug

SEQ ID NO: 891961 - RNA, 19 nt, Homo sapiens
ugaauggaaugcuccuaaa

SEQ ID NO: 891962 - RNA, 19 nt, Homo sapiens
uaaggugguuugugaugaa

SEQ ID NO: 891963 - RNA, 19 nt, Homo sapiens
uggaugagaugaacggaaa

SEQ ID NO: 891964 - RNA, 19 nt, Homo sapiens
guaaggugguuugugauga

SEQ ID NO: 891965 - RNA, 19 nt, Homo sapiens
gauaauaaagcacuguaug

SEQ ID NO: 891966 - RNA, 19 nt, Homo sapiens
ucggaacacacauuuauua

SEQ ID NO: 891967 - RNA, 19 nt, Homo sapiens
guaacagaauugauaacug

SEQ ID NO: 891968 - RNA, 19 nt, Homo sapiens
ggaggguggucgcagcaaa

SEQ ID NO: 891969 - RNA, 19 nt, Homo sapiens
gaaaguaaugacugaugaa

SEQ ID NO: 891970 - RNA, 19 nt, Homo sapiens
gagcaaggaaacguaauuu

SEQ ID NO: 891971 - RNA, 19 nt, Homo sapiens
gcaaaugccaggucuagca

SEQ ID NO: 891972 - RNA, 19 nt, Homo sapiens
ccagaaagcaguuaacagu

SEQ ID NO: 891973 - RNA, 19 nt, Homo sapiens
cuaaagaggcugcccagaa

SEQ ID NO: 891974 - RNA, 19 nt, Homo sapiens
gcauguuguuggagauuga

SEQ ID NO: 891975 - RNA, 19 nt, Homo sapiens
gcaccguuccacaguauaa

SEQ ID NO: 891976 - RNA, 19 nt, Homo sapiens
gcucggaacacacauuuau

SEQ ID NO: 891977 - RNA, 19 nt, Homo sapiens
caaggaaacguaauuugga

SEQ ID NO: 891978 - RNA, 19 nt, Homo sapiens
agaccaccauuuaguacua

SEQ ID NO: 891979 - RNA, 19 nt, Homo sapiens
gcagagaauggcaagugua

SEQ ID NO: 891980 - RNA, 19 nt, Homo sapiens
aguaaugacugaugaaagu

SEQ ID NO: 891981 - RNA, 19 nt, Homo sapiens
acgagaagcugaacuugga

SEQ ID NO: 891982 - RNA, 19 nt, Homo sapiens
uguuggagauugauaauuc

SEQ ID NO: 891983 - RNA, 19 nt, Homo sapiens
ugccagaccucauccauuc

SEQ ID NO: 891984 - RNA, 19 nt, Homo sapiens
agaaaugaacgguagaauu

SEQ ID NO: 891985 - RNA, 19 nt, Homo sapiens
uugaacagaugaaacaaga

SEQ ID NO: 891986 - RNA, 19 nt, Homo sapiens
ggaacuuaagcgcaaauuu

SEQ ID NO: 891987 - RNA, 19 nt, Homo sapiens
caagggcuacggauuugua

SEQ ID NO: 891988 - RNA, 19 nt, Homo sapiens
aaacauaaugcuaguccua

SEQ ID NO: 891989 - RNA, 19 nt, Homo sapiens
ucaccucacuaaccaguau

SEQ ID NO: 891990 - RNA, 19 nt, Homo sapiens
ggaguaggcaacauauuca

SEQ ID NO: 891991 - RNA, 19 nt, Homo sapiens
ccucauccauuccaaaaua

SEQ ID NO: 891992 - RNA, 19 nt, Homo sapiens
gagaauggcaaguguacga

SEQ ID NO: 891993 - RNA, 19 nt, Homo sapiens
gaacgagaagcugaacuug

SEQ ID NO: 891994 - RNA, 19 nt, Homo sapiens
uggaauagcucagaauguc

SEQ ID NO: 891995 - RNA, 19 nt, Homo sapiens
gguguuaaucuuuauguga

SEQ ID NO: 891996 - RNA, 19 nt, Homo sapiens
gaacggaaaggagcucaau

SEQ ID NO: 891997 - RNA, 19 nt, Homo sapiens
agaaagcuguggaugagau

SEQ ID NO: 891998 - RNA, 19 nt, Homo sapiens
aaaagaaacuugugcuuca

SEQ ID NO: 891999 - RNA, 19 nt, Homo sapiens
ucacuggcauguuguugga

SEQ ID NO: 892000 - RNA, 19 nt, Homo sapiens
gcuguuuccucuuauucaa

SEQ ID NO: 892001 - RNA, 19 nt, Homo sapiens
gaauggaaugcuccuaaau

SEQ ID NO: 892002 - RNA, 19 nt, Homo sapiens
ugaugaacgucuccggaaa

SEQ ID NO: 892003 - RNA, 19 nt, Homo sapiens
auggaaugcuccuaaauga

SEQ ID NO: 892004 - RNA, 19 nt, Homo sapiens
ccacuaaagcaguuacaga

SEQ ID NO: 892005 - RNA, 19 nt, Homo sapiens
ggauuuguaagcuuugaaa

SEQ ID NO: 892006 - RNA, 19 nt, Homo sapiens
gagcaaaugccaggucuag

SEQ ID NO: 892007 - RNA, 19 nt, Homo sapiens
ugccuuaagugugaaagua

SEQ ID NO: 892008 - RNA, 19 nt, Homo sapiens
ggagaagacauggaugaug

SEQ ID NO: 892009 - RNA, 19 nt, Homo sapiens
ccuagaccaccauuuagua

SEQ ID NO: 892010 - RNA, 19 nt, Homo sapiens
agaagaagccacuaaagca

SEQ ID NO: 892011 - RNA, 19 nt, Homo sapiens
uaaagaacgagaagcugaa

SEQ ID NO: 892012 - RNA, 19 nt, Homo sapiens
ccaggucuagcaaacauaa

SEQ ID NO: 892013 - RNA, 19 nt, Homo sapiens
accaggguguuaaucuuua

SEQ ID NO: 892014 - RNA, 19 nt, Homo sapiens
gcaaauuugaacagaugaa

SEQ ID NO: 892015 - RNA, 19 nt, Homo sapiens
ccaagaaggaaccaagaga

SEQ ID NO: 892016 - RNA, 19 nt, Homo sapiens
gugugaaaguaaugacuga

SEQ ID NO: 892017 - RNA, 19 nt, Homo sapiens
guauuuguuggacgauuua

SEQ ID NO: 892018 - RNA, 19 nt, Homo sapiens
ccaccgguguuccaacugu

SEQ ID NO: 892019 - RNA, 19 nt, Homo sapiens
agaagccacuaaagcaguu

SEQ ID NO: 892020 - RNA, 19 nt, Homo sapiens
cuaaaugaucgcaaaguau

SEQ ID NO: 892021 - RNA, 19 nt, Homo sapiens
cuacaagcccaccaagcua

SEQ ID NO: 892022 - RNA, 19 nt, Homo sapiens
gccaugcacccuacucuug

SEQ ID NO: 892023 - RNA, 19 nt, Homo sapiens
gcaccaagcucccuaagca

SEQ ID NO: 892024 - RNA, 19 nt, Homo sapiens
gcaaauaccggaccuucua

SEQ ID NO: 892025 - RNA, 19 nt, Homo sapiens
gaaaggauccaguuugugu

SEQ ID NO: 892026 - RNA, 19 nt, Homo sapiens
gcaaagaggauccagagaa

SEQ ID NO: 892027 - RNA, 19 nt, Homo sapiens
gagaaagguaugacucuua

SEQ ID NO: 892028 - RNA, 19 nt, Homo sapiens
gcaguauucucaacaacaa

SEQ ID NO: 892029 - RNA, 19 nt, Homo sapiens
caaagaggauccagagaag

SEQ ID NO: 892030 - RNA, 19 nt, Homo sapiens
ggccgaagcuggaaaccaa

SEQ ID NO: 892031 - RNA, 19 nt, Homo sapiens
gcaauggcaugaagcagau

SEQ ID NO: 892032 - RNA, 19 nt, Homo sapiens
acaacaagcucaucagcaa

SEQ ID NO: 892033 - RNA, 19 nt, Homo sapiens
ccaagaagaagaagagaaa

SEQ ID NO: 892034 - RNA, 19 nt, Homo sapiens
caacagcgacucagacaau

SEQ ID NO: 892035 - RNA, 19 nt, Homo sapiens
gcaagaagagucaggacaa

SEQ ID NO: 892036 - RNA, 19 nt, Homo sapiens
ggaaaccaaaccuaauaaa

SEQ ID NO: 892037 - RNA, 19 nt, Homo sapiens
agaaagguaugacucuuau

SEQ ID NO: 892038 - RNA, 19 nt, Homo sapiens
gaaaccaaaccuaauaaag

SEQ ID NO: 892039 - RNA, 19 nt, Homo sapiens
ggagaaagguaugacucuu

SEQ ID NO: 892040 - RNA, 19 nt, Homo sapiens
caagaaguccucccucaug

SEQ ID NO: 892041 - RNA, 19 nt, Homo sapiens
gcaccgaggcuguggagaa

SEQ ID NO: 892042 - RNA, 19 nt, Homo sapiens
gaaccaagaagaagaagag

SEQ ID NO: 892043 - RNA, 19 nt, Homo sapiens
ccacuuugcagucgacaua

SEQ ID NO: 892044 - RNA, 19 nt, Homo sapiens
gaucugacccaggaaauug

SEQ ID NO: 892045 - RNA, 19 nt, Homo sapiens
agauggaaauggccuauga

SEQ ID NO: 892046 - RNA, 19 nt, Homo sapiens
uagauauggugccgcauuu

SEQ ID NO: 892047 - RNA, 19 nt, Homo sapiens
gaaauugccauggagcauu

SEQ ID NO: 892048 - RNA, 19 nt, Homo sapiens
gguaugguauggccacuuc

SEQ ID NO: 892049 - RNA, 19 nt, Homo sapiens
uguguucucugugcaaaua

SEQ ID NO: 892050 - RNA, 19 nt, Homo sapiens
aaagguaugacucuuauga

SEQ ID NO: 892051 - RNA, 19 nt, Homo sapiens
ugaagaccauggaucacaa

SEQ ID NO: 892052 - RNA, 19 nt, Homo sapiens
ucacuaacaagaccaagaa

SEQ ID NO: 892053 - RNA, 19 nt, Homo sapiens
ugacacaaaugcaaacacu

SEQ ID NO: 892054 - RNA, 19 nt, Homo sapiens
gauuauggauauggaacuu

SEQ ID NO: 892055 - RNA, 19 nt, Homo sapiens
gcucagcccaccugugauu

SEQ ID NO: 892056 - RNA, 19 nt, Homo sapiens
ggauccaguuuguguguuc

SEQ ID NO: 892057 - RNA, 19 nt, Homo sapiens
gaauuaaccagcgcuuaga

SEQ ID NO: 892058 - RNA, 19 nt, Homo sapiens
gagagaagaaggcaaagag

SEQ ID NO: 892059 - RNA, 19 nt, Homo sapiens
ugagugagcgcgaccugua

SEQ ID NO: 892060 - RNA, 19 nt, Homo sapiens
caccugugauuauggauau

SEQ ID NO: 892061 - RNA, 19 nt, Homo sapiens
gagaggaugaggagggaaa

SEQ ID NO: 892062 - RNA, 19 nt, Homo sapiens
gggaaaugccuagcucuga

SEQ ID NO: 892063 - RNA, 19 nt, Homo sapiens
agaagcaucugaagaccau

SEQ ID NO: 892064 - RNA, 19 nt, Homo sapiens
gaucugaaaccacuuugca

SEQ ID NO: 892065 - RNA, 19 nt, Homo sapiens
agacagaggagcuccgaaa

SEQ ID NO: 892066 - RNA, 19 nt, Homo sapiens
ccagccaucuugacagcaa

SEQ ID NO: 892067 - RNA, 19 nt, Homo sapiens
caagaagagucaggacaag

SEQ ID NO: 892068 - RNA, 19 nt, Homo sapiens
gccuagcucugacacaaau

SEQ ID NO: 892069 - RNA, 19 nt, Homo sapiens
cuggaaaccaaaccuaaua

SEQ ID NO: 892070 - RNA, 19 nt, Homo sapiens
ccgcuuugguuucggguuu

SEQ ID NO: 892071 - RNA, 19 nt, Homo sapiens
aggaguacgucacuaacaa

SEQ ID NO: 892072 - RNA, 19 nt, Homo sapiens
guacggcucagguggagaa

SEQ ID NO: 892073 - RNA, 19 nt, Homo sapiens
gcucugacacaaaugcaaa

SEQ ID NO: 892074 - RNA, 19 nt, Homo sapiens
ccacaaggaacacuuuaag

SEQ ID NO: 892075 - RNA, 19 nt, Homo sapiens
ggaacucugggacaaauag

SEQ ID NO: 892076 - RNA, 19 nt, Homo sapiens
gaaccgcaggcucaugaug

SEQ ID NO: 892077 - RNA, 19 nt, Homo sapiens
uaagcagacggcugacuuu

SEQ ID NO: 892078 - RNA, 19 nt, Homo sapiens
acagcaaguuccacaagga

SEQ ID NO: 892079 - RNA, 19 nt, Homo sapiens
ggagagaagaaggcaaaga

SEQ ID NO: 892080 - RNA, 19 nt, Homo sapiens
gaaaagaggaugggagaga

SEQ ID NO: 892081 - RNA, 19 nt, Homo sapiens
acacaaaugcaaacacuag

SEQ ID NO: 892082 - RNA, 19 nt, Homo sapiens
aaccagcgcuuagauaugg

SEQ ID NO: 892083 - RNA, 19 nt, Homo sapiens
gaaaugccuagcucugaca

SEQ ID NO: 892084 - RNA, 19 nt, Homo sapiens
ggaucugacccaggaaauu

SEQ ID NO: 892085 - RNA, 19 nt, Homo sapiens
caaauaccggaccuucuau

SEQ ID NO: 892086 - RNA, 19 nt, Homo sapiens
gcccaccugugauuaugga

SEQ ID NO: 892087 - RNA, 19 nt, Homo sapiens
gaacucugggacaaauaga

SEQ ID NO: 892088 - RNA, 19 nt, Homo sapiens
ccaccugugauuauggaua

SEQ ID NO: 892089 - RNA, 19 nt, Homo sapiens
ggacaaauagaggcuacga

SEQ ID NO: 892090 - RNA, 19 nt, Homo sapiens
gcucagguggagaaaggua

SEQ ID NO: 892091 - RNA, 19 nt, Homo sapiens
uaacaagaccaagaagaca

SEQ ID NO: 892092 - RNA, 19 nt, Homo sapiens
gacaacagcgacucagaca

SEQ ID NO: 892093 - RNA, 19 nt, Homo sapiens
ggagacagacaugaugcaa

SEQ ID NO: 892094 - RNA, 19 nt, Homo sapiens
uggaaaccaaaccuaauaa

SEQ ID NO: 892095 - RNA, 19 nt, Homo sapiens
ggaaaggauccaguuugug

SEQ ID NO: 892096 - RNA, 19 nt, Homo sapiens
gcacggacugcucggacaa

SEQ ID NO: 892097 - RNA, 19 nt, Homo sapiens
gcuugacccugagauggaa

SEQ ID NO: 892098 - RNA, 19 nt, Homo sapiens
uaaccagcgcuuagauaug

SEQ ID NO: 892099 - RNA, 19 nt, Homo sapiens
uuaaccagcgcuuagauau

SEQ ID NO: 892100 - RNA, 19 nt, Homo sapiens
cagaauuaaccagcgcuua

SEQ ID NO: 892101 - RNA, 19 nt, Homo sapiens
gcuggaaaccaaaccuaau

SEQ ID NO: 892102 - RNA, 19 nt, Homo sapiens
cccaggaaauugccaugga

SEQ ID NO: 892103 - RNA, 19 nt, Homo sapiens
cuacgagggcuauggcuau

SEQ ID NO: 892104 - RNA, 19 nt, Homo sapiens
cagcccaccugugauuaug

SEQ ID NO: 892105 - RNA, 19 nt, Homo sapiens
gauauggugccgcauuugg

SEQ ID NO: 892106 - RNA, 19 nt, Homo sapiens
cagucgacauacucggaua

SEQ ID NO: 892107 - RNA, 19 nt, Homo sapiens
gaguacgucacuaacaaga

SEQ ID NO: 892108 - RNA, 19 nt, Homo sapiens
caguuuguguguucucugu

SEQ ID NO: 892109 - RNA, 19 nt, Homo sapiens
cggcucagguggagaaagg

SEQ ID NO: 892110 - RNA, 19 nt, Homo sapiens
agaauuaaccagcgcuuag

SEQ ID NO: 892111 - RNA, 19 nt, Homo sapiens
cggaaccgcaggcucauga

SEQ ID NO: 892112 - RNA, 19 nt, Homo sapiens
ggaaauugccauggagcau

SEQ ID NO: 892113 - RNA, 19 nt, Homo sapiens
cugacuuucugcaggagua

SEQ ID NO: 892114 - RNA, 19 nt, Homo sapiens
gagcuacacaggcuuuguc

SEQ ID NO: 892115 - RNA, 19 nt, Homo sapiens
gucgucggauguuguguug

SEQ ID NO: 892116 - RNA, 19 nt, Homo sapiens
ggauauggaacuuggaacu

SEQ ID NO: 892117 - RNA, 19 nt, Homo sapiens
agaagaaggcaaagaggau

SEQ ID NO: 892118 - RNA, 19 nt, Homo sapiens
gaaagguaugacucuuaug

SEQ ID NO: 892119 - RNA, 19 nt, Homo sapiens
uccagcaaaucuacagaga

SEQ ID NO: 892120 - RNA, 19 nt, Homo sapiens
cuaagcagacggcugacuu

SEQ ID NO: 892121 - RNA, 19 nt, Homo sapiens
gagaccgcaugguggaaag

SEQ ID NO: 892122 - RNA, 19 nt, Homo sapiens
gggcuauggcuauggcuau

SEQ ID NO: 892123 - RNA, 19 nt, Homo sapiens
uaggauagcucaaagaaua

SEQ ID NO: 892124 - RNA, 19 nt, Homo sapiens
ggaauuguguaaaguguua

SEQ ID NO: 892125 - RNA, 19 nt, Homo sapiens
caagaaaccaacucuauua

SEQ ID NO: 892126 - RNA, 19 nt, Homo sapiens
gcacacaaacgcagaauuu

SEQ ID NO: 892127 - RNA, 19 nt, Homo sapiens
gauacugcaucucucauua

SEQ ID NO: 892128 - RNA, 19 nt, Homo sapiens
gaauaggucuuauacaaca

SEQ ID NO: 892129 - RNA, 19 nt, Homo sapiens
gaauuaagaucgugcacaa

SEQ ID NO: 892130 - RNA, 19 nt, Homo sapiens
ggaaagacuuaaagaugaa

SEQ ID NO: 892131 - RNA, 19 nt, Homo sapiens
ggaaagguaucuauuacau

SEQ ID NO: 892132 - RNA, 19 nt, Homo sapiens
gaaaccaacucuauuaagg

SEQ ID NO: 892133 - RNA, 19 nt, Homo sapiens
gcagggagaauaaagauaa

SEQ ID NO: 892134 - RNA, 19 nt, Homo sapiens
ggugagaccuaaugagaaa

SEQ ID NO: 892135 - RNA, 19 nt, Homo sapiens
gcacaaaaguuuccuuaaa

SEQ ID NO: 892136 - RNA, 19 nt, Homo sapiens
acucaaaggugacuuauug

SEQ ID NO: 892137 - RNA, 19 nt, Homo sapiens
ucagugauauuacagcuaa

SEQ ID NO: 892138 - RNA, 19 nt, Homo sapiens
uggaaagacuuaaagauga

SEQ ID NO: 892139 - RNA, 19 nt, Homo sapiens
agaaauaguuacucaguug

SEQ ID NO: 892140 - RNA, 19 nt, Homo sapiens
gagaaauaguuacucaguu

SEQ ID NO: 892141 - RNA, 19 nt, Homo sapiens
gagauggucuaguaaagau

SEQ ID NO: 892142 - RNA, 19 nt, Homo sapiens
guuaggaaaugcagaauuc

SEQ ID NO: 892143 - RNA, 19 nt, Homo sapiens
ccucuugucuugaaccaua

SEQ ID NO: 892144 - RNA, 19 nt, Homo sapiens
aaacuaagcagggagaaua

SEQ ID NO: 892145 - RNA, 19 nt, Homo sapiens
uggaagagauggaucagaa

SEQ ID NO: 892146 - RNA, 19 nt, Homo sapiens
ccaaguacauaaagcaaau

SEQ ID NO: 892147 - RNA, 19 nt, Homo sapiens
gaaaaguggucucaaccua

SEQ ID NO: 892148 - RNA, 19 nt, Homo sapiens
gccagggucucuuaucuga

SEQ ID NO: 892149 - RNA, 19 nt, Homo sapiens
auagaugacugguugauga

SEQ ID NO: 892150 - RNA, 19 nt, Homo sapiens
caaauuaggauagcucaaa

SEQ ID NO: 892151 - RNA, 19 nt, Homo sapiens
gaagaggaacaaauuagga

SEQ ID NO: 892152 - RNA, 19 nt, Homo sapiens
gggagugugugaucuguau

SEQ ID NO: 892153 - RNA, 19 nt, Homo sapiens
gauaauggaaagucaaguu

SEQ ID NO: 892154 - RNA, 19 nt, Homo sapiens
ggaauucauugccuuaggu

SEQ ID NO: 892155 - RNA, 19 nt, Homo sapiens
gcacugcuuucauccuaug

SEQ ID NO: 892156 - RNA, 19 nt, Homo sapiens
gugcugagguuauugaagu

SEQ ID NO: 892157 - RNA, 19 nt, Homo sapiens
aaacugagaugcacuaucc

SEQ ID NO: 892158 - RNA, 19 nt, Homo sapiens
gcagcuguauuuguuuaaa

SEQ ID NO: 892159 - RNA, 19 nt, Homo sapiens
uaaagcaaauuuggaggaa

SEQ ID NO: 892160 - RNA, 19 nt, Homo sapiens
ccauuuagcauguguuuau

SEQ ID NO: 892161 - RNA, 19 nt, Homo sapiens
agccagggauuaggaauua

SEQ ID NO: 892162 - RNA, 19 nt, Homo sapiens
gagccagggucucuuaucu

SEQ ID NO: 892163 - RNA, 19 nt, Homo sapiens
guacauaaagcaaauuugg

SEQ ID NO: 892164 - RNA, 19 nt, Homo sapiens
caaccuaacaucagaagug

SEQ ID NO: 892165 - RNA, 19 nt, Homo sapiens
gaauuaugccaccacguuu

SEQ ID NO: 892166 - RNA, 19 nt, Homo sapiens
gaauuucuccuuuguuucu

SEQ ID NO: 892167 - RNA, 19 nt, Homo sapiens
ucaagaaaccaacucuauu

SEQ ID NO: 892168 - RNA, 19 nt, Homo sapiens
guauccauauguugcuuaa

SEQ ID NO: 892169 - RNA, 19 nt, Homo sapiens
caaaggugacuuauugguu

SEQ ID NO: 892170 - RNA, 19 nt, Homo sapiens
gaccuaaugagaaauaguu

SEQ ID NO: 892171 - RNA, 19 nt, Homo sapiens
gcaguuaggaaaugcagaa

SEQ ID NO: 892172 - RNA, 19 nt, Homo sapiens
ucucuuaucugacuucaag

SEQ ID NO: 892173 - RNA, 19 nt, Homo sapiens
ucuaucaccuggacuguau

SEQ ID NO: 892174 - RNA, 19 nt, Homo sapiens
caacuguaguauccauaug

SEQ ID NO: 892175 - RNA, 19 nt, Homo sapiens
gggagaauaaagauaauug

SEQ ID NO: 892176 - RNA, 19 nt, Homo sapiens
gguuuaauauuacccuuuc

SEQ ID NO: 892177 - RNA, 19 nt, Homo sapiens
ugaaguugcuggcauuugg

SEQ ID NO: 892178 - RNA, 19 nt, Homo sapiens
caccuggacuguauagaug

SEQ ID NO: 892179 - RNA, 19 nt, Homo sapiens
cagguucuguuaaauuguu

SEQ ID NO: 892180 - RNA, 19 nt, Homo sapiens
cugcaucucucauuacugu

SEQ ID NO: 892181 - RNA, 19 nt, Homo sapiens
gaaaugcagaauucaaagu

SEQ ID NO: 892182 - RNA, 19 nt, Homo sapiens
ggaagagauggaucagaaa

SEQ ID NO: 892183 - RNA, 19 nt, Homo sapiens
auagaggaauguaguaugu

SEQ ID NO: 892184 - RNA, 19 nt, Homo sapiens
ccaaagagccagggauuag

SEQ ID NO: 892185 - RNA, 19 nt, Homo sapiens
ucauaguugugaucucaaa

SEQ ID NO: 892186 - RNA, 19 nt, Homo sapiens
ugagaccuaaugagaaaua

SEQ ID NO: 892187 - RNA, 19 nt, Homo sapiens
ugaauuaugccaccacguu

SEQ ID NO: 892188 - RNA, 19 nt, Homo sapiens
aaggugggguuuaauauua

SEQ ID NO: 892189 - RNA, 19 nt, Homo sapiens
cuggauggcugcagauguu

SEQ ID NO: 892190 - RNA, 19 nt, Homo sapiens
gacugaagaggaacaaauu

SEQ ID NO: 892191 - RNA, 19 nt, Homo sapiens
gcaguuaauguaagaauac

SEQ ID NO: 892192 - RNA, 19 nt, Homo sapiens
ccugcuagcugacugacaa

SEQ ID NO: 892193 - RNA, 19 nt, Homo sapiens
gaaagguaucuauuacauc

SEQ ID NO: 892194 - RNA, 19 nt, Homo sapiens
cuuggaaagguaucuauua

SEQ ID NO: 892195 - RNA, 19 nt, Homo sapiens
gaaauaguuacucaguugu

SEQ ID NO: 892196 - RNA, 19 nt, Homo sapiens
gagaugcacuaucccuuuu

SEQ ID NO: 892197 - RNA, 19 nt, Homo sapiens
gcauuugggucaagguuuu

SEQ ID NO: 892198 - RNA, 19 nt, Homo sapiens
gaugacugguugaugagau

SEQ ID NO: 892199 - RNA, 19 nt, Homo sapiens
uacaacaucugccuaaagg

SEQ ID NO: 892200 - RNA, 19 nt, Homo sapiens
gauuaucagguucuguuaa

SEQ ID NO: 892201 - RNA, 19 nt, Homo sapiens
gauggaaagacuuaaagau

SEQ ID NO: 892202 - RNA, 19 nt, Homo sapiens
agaggaauguaguauguca

SEQ ID NO: 892203 - RNA, 19 nt, Homo sapiens
cacagugucaugaagguua

SEQ ID NO: 892204 - RNA, 19 nt, Homo sapiens
ggauacugcaucucucauu

SEQ ID NO: 892205 - RNA, 19 nt, Homo sapiens
gucaagaaaccaacucuau

SEQ ID NO: 892206 - RNA, 19 nt, Homo sapiens
ugagaugcacuaucccuuu

SEQ ID NO: 892207 - RNA, 19 nt, Homo sapiens
agacucggcuagcaacuca

SEQ ID NO: 892208 - RNA, 19 nt, Homo sapiens
gcaaaaggauacugcaucu

SEQ ID NO: 892209 - RNA, 19 nt, Homo sapiens
guuaauauggugauaaugg

SEQ ID NO: 892210 - RNA, 19 nt, Homo sapiens
uuagaaacuuagugggaaa

SEQ ID NO: 892211 - RNA, 19 nt, Homo sapiens
gugaucuccuagcuuguaa

SEQ ID NO: 892212 - RNA, 19 nt, Homo sapiens
ucaaagugaucuccuagcu

SEQ ID NO: 892213 - RNA, 19 nt, Homo sapiens
ggaaaugcagaauucaaag

SEQ ID NO: 892214 - RNA, 19 nt, Homo sapiens
cauaggaauuguguaaagu

SEQ ID NO: 892215 - RNA, 19 nt, Homo sapiens
acauaggaauuguguaaag

SEQ ID NO: 892216 - RNA, 19 nt, Homo sapiens
aaccuugacccaauguuua

SEQ ID NO: 892217 - RNA, 19 nt, Homo sapiens
gagccagggauuaggaauu

SEQ ID NO: 892218 - RNA, 19 nt, Homo sapiens
ggacccaauucgauuucug

SEQ ID NO: 892219 - RNA, 19 nt, Homo sapiens
auauuacccuuuccuaugu

SEQ ID NO: 892220 - RNA, 19 nt, Homo sapiens
aauauuacccuuuccuaug

SEQ ID NO: 892221 - RNA, 19 nt, Homo sapiens
gcacuaucccuuuucuaua

SEQ ID NO: 892222 - RNA, 19 nt, Homo sapiens
gcccaaagagccagggauu

SEQ ID NO: 892223 - RNA, 19 nt, Homo sapiens
ggcaguggauggauaaaua

SEQ ID NO: 892224 - RNA, 19 nt, Homo sapiens
agaaagagcugcggaaguu

SEQ ID NO: 892225 - RNA, 19 nt, Homo sapiens
ggaaguugguucaugaaau

SEQ ID NO: 892226 - RNA, 19 nt, Homo sapiens
gcuaugagcuggaccugau

SEQ ID NO: 892227 - RNA, 19 nt, Homo sapiens
uaaacuaugugcccacgaa

SEQ ID NO: 892228 - RNA, 19 nt, Homo sapiens
ggacuugacccaacugaga

SEQ ID NO: 892229 - RNA, 19 nt, Homo sapiens
agaaggcccuggugaugua

SEQ ID NO: 892230 - RNA, 19 nt, Homo sapiens
gaaaagacaguaaacauga

SEQ ID NO: 892231 - RNA, 19 nt, Homo sapiens
gggcaaagcuacagaugac

SEQ ID NO: 892232 - RNA, 19 nt, Homo sapiens
acacaaaacucaagcugua

SEQ ID NO: 892233 - RNA, 19 nt, Homo sapiens
ggaagccucccgcuccuaa

SEQ ID NO: 892234 - RNA, 19 nt, Homo sapiens
caugacagacugauagaaa

SEQ ID NO: 892235 - RNA, 19 nt, Homo sapiens
cugcagagcuggagaagag

SEQ ID NO: 892236 - RNA, 19 nt, Homo sapiens
uagagaagacaaccuauga

SEQ ID NO: 892237 - RNA, 19 nt, Homo sapiens
gcaggcuccucaccgauau

SEQ ID NO: 892238 - RNA, 19 nt, Homo sapiens
ggaagcaccugcgggauac

SEQ ID NO: 892239 - RNA, 19 nt, Homo sapiens
uaacagaaaggucaaugga

SEQ ID NO: 892240 - RNA, 19 nt, Homo sapiens
gaauagccacugcacucua

SEQ ID NO: 892241 - RNA, 19 nt, Homo sapiens
gcacuuguaaucccagcua

SEQ ID NO: 892242 - RNA, 19 nt, Homo sapiens
gcaaagcuacagaugacuu

SEQ ID NO: 892243 - RNA, 19 nt, Homo sapiens
guacaaugcucaucuuacc

SEQ ID NO: 892244 - RNA, 19 nt, Homo sapiens
aaacaugacagacugauag

SEQ ID NO: 892245 - RNA, 19 nt, Homo sapiens
ccaggaggccuaugagaug

SEQ ID NO: 892246 - RNA, 19 nt, Homo sapiens
ccaccagcguacccucuuu

SEQ ID NO: 892247 - RNA, 19 nt, Homo sapiens
ucaccgauauguacaaugc

SEQ ID NO: 892248 - RNA, 19 nt, Homo sapiens
uaaacaugacagacugaua

SEQ ID NO: 892249 - RNA, 19 nt, Homo sapiens
ggauggauaaauagaagaa

SEQ ID NO: 892250 - RNA, 19 nt, Homo sapiens
agacugauagaaaguauug

SEQ ID NO: 892251 - RNA, 19 nt, Homo sapiens
ggaaaagacaguaaacaug

SEQ ID NO: 892252 - RNA, 19 nt, Homo sapiens
guagagaagacaaccuaug

SEQ ID NO: 892253 - RNA, 19 nt, Homo sapiens
cagcguacccucuuucauc

SEQ ID NO: 892254 - RNA, 19 nt, Homo sapiens
ugacccaacugagaaggaa

SEQ ID NO: 892255 - RNA, 19 nt, Homo sapiens
guggauggauaaauagaag

SEQ ID NO: 892256 - RNA, 19 nt, Homo sapiens
uggaagcaccugcgggaua

SEQ ID NO: 892257 - RNA, 19 nt, Homo sapiens
ggaaggcagcgaagagaag

SEQ ID NO: 892258 - RNA, 19 nt, Homo sapiens
gggauacaguggagcuaca

SEQ ID NO: 892259 - RNA, 19 nt, Homo sapiens
aaacuucuguauggaggaa

SEQ ID NO: 892260 - RNA, 19 nt, Homo sapiens
gcaguggauggauaaauag

SEQ ID NO: 892261 - RNA, 19 nt, Homo sapiens
gaaagagcugcggaaguug

SEQ ID NO: 892262 - RNA, 19 nt, Homo sapiens
acagacugauagaaaguau

SEQ ID NO: 892263 - RNA, 19 nt, Homo sapiens
gacagacugauagaaagua

SEQ ID NO: 892264 - RNA, 19 nt, Homo sapiens
ccaaggcucccaucagaag

SEQ ID NO: 892265 - RNA, 19 nt, Homo sapiens
acgggaggcugguagagaa

SEQ ID NO: 892266 - RNA, 19 nt, Homo sapiens
uauguacaaugcucaucuu

SEQ ID NO: 892267 - RNA, 19 nt, Homo sapiens
gaccagcauucgcccaucu

SEQ ID NO: 892268 - RNA, 19 nt, Homo sapiens
aauagccacugcacucuag

SEQ ID NO: 892269 - RNA, 19 nt, Homo sapiens
ugcggaaguugguucauga

SEQ ID NO: 892270 - RNA, 19 nt, Homo sapiens
gaagcuggaccgcauucug

SEQ ID NO: 892271 - RNA, 19 nt, Homo sapiens
ucagaaggcccuggugaug

SEQ ID NO: 892272 - RNA, 19 nt, Homo sapiens
auccaaggcucccaucaga

SEQ ID NO: 892273 - RNA, 19 nt, Homo sapiens
caguggagcuacaacuucu

SEQ ID NO: 892274 - RNA, 19 nt, Homo sapiens
gaugcuauccgggcugcua

SEQ ID NO: 892275 - RNA, 19 nt, Homo sapiens
augcucaucuuaccaagga

SEQ ID NO: 892276 - RNA, 19 nt, Homo sapiens
ccaggaguuuaagguugua

SEQ ID NO: 892277 - RNA, 19 nt, Homo sapiens
cccaggaguuuaagguugu

SEQ ID NO: 892278 - RNA, 19 nt, Homo sapiens
caauggacuugacccaacu

SEQ ID NO: 892279 - RNA, 19 nt, Homo sapiens
ugcaugagacgcagaaaga

SEQ ID NO: 892280 - RNA, 19 nt, Homo sapiens
caaagcuacagaugacuuc

SEQ ID NO: 892281 - RNA, 19 nt, Homo sapiens
ggaguuuaagguuguagug

SEQ ID NO: 892282 - RNA, 19 nt, Homo sapiens
acuccaaccucgaccugaa

SEQ ID NO: 892283 - RNA, 19 nt, Homo sapiens
gcucaucuuaccaaggauu

SEQ ID NO: 892284 - RNA, 19 nt, Homo sapiens
gacuugacccaacugagaa

SEQ ID NO: 892285 - RNA, 19 nt, Homo sapiens
gagaagcuggaccgcauuc

SEQ ID NO: 892286 - RNA, 19 nt, Homo sapiens
acaaugcucaucuuaccaa

SEQ ID NO: 892287 - RNA, 19 nt, Homo sapiens
gaagccucccgcuccuaaa

SEQ ID NO: 892288 - RNA, 19 nt, Homo sapiens
ggcugaggcaggagaauug

SEQ ID NO: 892289 - RNA, 19 nt, Homo sapiens
cuugagcccaggaguuuaa

SEQ ID NO: 892290 - RNA, 19 nt, Homo sapiens
ugacagacugauagaaagu

SEQ ID NO: 892291 - RNA, 19 nt, Homo sapiens
gcaugcaugagacgcagaa

SEQ ID NO: 892292 - RNA, 19 nt, Homo sapiens
cagaaggcccuggugaugu

SEQ ID NO: 892293 - RNA, 19 nt, Homo sapiens
guaacagaaaggucaaugg

SEQ ID NO: 892294 - RNA, 19 nt, Homo sapiens
cagaaagagcugcggaagu

SEQ ID NO: 892295 - RNA, 19 nt, Homo sapiens
agacccaggaggccuauga

SEQ ID NO: 892296 - RNA, 19 nt, Homo sapiens
ccacgugaccagagagaag

SEQ ID NO: 892297 - RNA, 19 nt, Homo sapiens
gcuccucaccgauauguac

SEQ ID NO: 892298 - RNA, 19 nt, Homo sapiens
guggagcuacaacuucuga

SEQ ID NO: 892299 - RNA, 19 nt, Homo sapiens
cagaaaggucaauggacuu

SEQ ID NO: 892300 - RNA, 19 nt, Homo sapiens
gaccgcauucuggccguua

SEQ ID NO: 892301 - RNA, 19 nt, Homo sapiens
gacgggaggcugguagaga

SEQ ID NO: 892302 - RNA, 19 nt, Homo sapiens
uaugugcccacgaaaauua

SEQ ID NO: 892303 - RNA, 19 nt, Homo sapiens
ggauacaguggagcuacaa

SEQ ID NO: 892304 - RNA, 19 nt, Homo sapiens
agaaaggucaauggacuug

SEQ ID NO: 892305 - RNA, 19 nt, Homo sapiens
cugcggaaguugguucaug

SEQ ID NO: 892306 - RNA, 19 nt, Homo sapiens
ccucaccgauauguacaau

SEQ ID NO: 892307 - RNA, 19 nt, Homo sapiens
caaccaagcuuucauuuaa

SEQ ID NO: 892308 - RNA, 19 nt, Homo sapiens
gcaaaugucuccgagcuua

SEQ ID NO: 892309 - RNA, 19 nt, Homo sapiens
gaugcaaacuguuauguaa

SEQ ID NO: 892310 - RNA, 19 nt, Homo sapiens
agaaagaacucaggacaua

SEQ ID NO: 892311 - RNA, 19 nt, Homo sapiens
uaccacaucugccuauuua

SEQ ID NO: 892312 - RNA, 19 nt, Homo sapiens
gaacucaggacauauuaaa

SEQ ID NO: 892313 - RNA, 19 nt, Homo sapiens
ggauuucaguccuugcuua

SEQ ID NO: 892314 - RNA, 19 nt, Homo sapiens
cagcauauauugagaugaa

SEQ ID NO: 892315 - RNA, 19 nt, Homo sapiens
gaucaucagucaaggaaga

SEQ ID NO: 892316 - RNA, 19 nt, Homo sapiens
gauaagaguuaacauuugg

SEQ ID NO: 892317 - RNA, 19 nt, Homo sapiens
ucacauagcauauugguau

SEQ ID NO: 892318 - RNA, 19 nt, Homo sapiens
gaugaauauucccugguua

SEQ ID NO: 892319 - RNA, 19 nt, Homo sapiens
cagcaggucuucuugaaau

SEQ ID NO: 892320 - RNA, 19 nt, Homo sapiens
ugacugcucucucuucaga

SEQ ID NO: 892321 - RNA, 19 nt, Homo sapiens
gaagggcuauaccaguuau

SEQ ID NO: 892322 - RNA, 19 nt, Homo sapiens
caggucuucuugaaauuua

SEQ ID NO: 892323 - RNA, 19 nt, Homo sapiens
agauuucacugacaacuuu

SEQ ID NO: 892324 - RNA, 19 nt, Homo sapiens
gaguuaacauuuggcuaua

SEQ ID NO: 892325 - RNA, 19 nt, Homo sapiens
cagcuuguauagauuauug

SEQ ID NO: 892326 - RNA, 19 nt, Homo sapiens
gaucauacuugggaaaaua

SEQ ID NO: 892327 - RNA, 19 nt, Homo sapiens
ccugacagcuuguauagau

SEQ ID NO: 892328 - RNA, 19 nt, Homo sapiens
gacguuaacuaucugcuau

SEQ ID NO: 892329 - RNA, 19 nt, Homo sapiens
gguuauacuuugucaauag

SEQ ID NO: 892330 - RNA, 19 nt, Homo sapiens
ugacagcuuguauagauua

SEQ ID NO: 892331 - RNA, 19 nt, Homo sapiens
gacauuggauuaccuuugg

SEQ ID NO: 892332 - RNA, 19 nt, Homo sapiens
ugaaggcacagaaugcuua

SEQ ID NO: 892333 - RNA, 19 nt, Homo sapiens
guucaaauguaagcaagaa

SEQ ID NO: 892334 - RNA, 19 nt, Homo sapiens
guuauacugugagaucuaa

SEQ ID NO: 892335 - RNA, 19 nt, Homo sapiens
ggaugcaaacuguuaugua

SEQ ID NO: 892336 - RNA, 19 nt, Homo sapiens
ccaagcucauugucuguuu

SEQ ID NO: 892337 - RNA, 19 nt, Homo sapiens
uuacucacauagcauauug

SEQ ID NO: 892338 - RNA, 19 nt, Homo sapiens
aaagaacucaggacauauu

SEQ ID NO: 892339 - RNA, 19 nt, Homo sapiens
aguuacagcugucauaaga

SEQ ID NO: 892340 - RNA, 19 nt, Homo sapiens
auaggaagaucaucaguca

SEQ ID NO: 892341 - RNA, 19 nt, Homo sapiens
uaucugcuauucuugauca

SEQ ID NO: 892342 - RNA, 19 nt, Homo sapiens
gaaagaacucaggacauau

SEQ ID NO: 892343 - RNA, 19 nt, Homo sapiens
acaaccaagcuuucauuua

SEQ ID NO: 892344 - RNA, 19 nt, Homo sapiens
aaacaaccaagcuuucauu

SEQ ID NO: 892345 - RNA, 19 nt, Homo sapiens
aaauaugacugcucucucu

SEQ ID NO: 892346 - RNA, 19 nt, Homo sapiens
gcaggucuucuugaaauuu

SEQ ID NO: 892347 - RNA, 19 nt, Homo sapiens
cagggacacuauauuacaa

SEQ ID NO: 892348 - RNA, 19 nt, Homo sapiens
uuacagcugucauaagauc

SEQ ID NO: 892349 - RNA, 19 nt, Homo sapiens
cacauagcauauugguaua

SEQ ID NO: 892350 - RNA, 19 nt, Homo sapiens
gaagaucaucagucaagga

SEQ ID NO: 892351 - RNA, 19 nt, Homo sapiens
ccaguuacgucaaacaaac

SEQ ID NO: 892352 - RNA, 19 nt, Homo sapiens
uaacauuuggcuauacuga

SEQ ID NO: 892353 - RNA, 19 nt, Homo sapiens
ccacuuacaauuccuaauc

SEQ ID NO: 892354 - RNA, 19 nt, Homo sapiens
gggcuauaccaguuauuaa

SEQ ID NO: 892355 - RNA, 19 nt, Homo sapiens
ggauaacuuccuauaugaa

SEQ ID NO: 892356 - RNA, 19 nt, Homo sapiens
gcaaacuguuauguaaauc

SEQ ID NO: 892357 - RNA, 19 nt, Homo sapiens
acauuuggcuauacugaug

SEQ ID NO: 892358 - RNA, 19 nt, Homo sapiens
auucagggacacuauauua

SEQ ID NO: 892359 - RNA, 19 nt, Homo sapiens
ggcuauaccaguuauuaaa

SEQ ID NO: 892360 - RNA, 19 nt, Homo sapiens
uugaagggcuauaccaguu

SEQ ID NO: 892361 - RNA, 19 nt, Homo sapiens
agaugaauauucccugguu

SEQ ID NO: 892362 - RNA, 19 nt, Homo sapiens
aaguucagauuccagcaua

SEQ ID NO: 892363 - RNA, 19 nt, Homo sapiens
ucaucccacuccaguuaua

SEQ ID NO: 892364 - RNA, 19 nt, Homo sapiens
ugaauauucccugguuaua

SEQ ID NO: 892365 - RNA, 19 nt, Homo sapiens
guucagauuccagcauaua

SEQ ID NO: 892366 - RNA, 19 nt, Homo sapiens
cauaaccuguugggaagaa

SEQ ID NO: 892367 - RNA, 19 nt, Homo sapiens
ugaagggcuauaccaguua

SEQ ID NO: 892368 - RNA, 19 nt, Homo sapiens
guccuacacuugcgcaaau

SEQ ID NO: 892369 - RNA, 19 nt, Homo sapiens
gggacacuauauuacaaau

SEQ ID NO: 892370 - RNA, 19 nt, Homo sapiens
gauuaccuuuggauccauu

SEQ ID NO: 892371 - RNA, 19 nt, Homo sapiens
cagauuccagcauauauug

SEQ ID NO: 892372 - RNA, 19 nt, Homo sapiens
uuucaucccacuccaguua

SEQ ID NO: 892373 - RNA, 19 nt, Homo sapiens
gaauauucccugguuauac

SEQ ID NO: 892374 - RNA, 19 nt, Homo sapiens
ucacuguccuuucuauguc

SEQ ID NO: 892375 - RNA, 19 nt, Homo sapiens
acacuaggaaugagaagaa

SEQ ID NO: 892376 - RNA, 19 nt, Homo sapiens
gaagcaguguuuuaucaug

SEQ ID NO: 892377 - RNA, 19 nt, Homo sapiens
ucacugacaacuuuaagau

SEQ ID NO: 892378 - RNA, 19 nt, Homo sapiens
ugaaaugcaaggaaccaaa

SEQ ID NO: 892379 - RNA, 19 nt, Homo sapiens
uuccuaaucuugagcaaau

SEQ ID NO: 892380 - RNA, 19 nt, Homo sapiens
uuucaguccuugcuuaugu

SEQ ID NO: 892381 - RNA, 19 nt, Homo sapiens
gauuauugccugaauuucu

SEQ ID NO: 892382 - RNA, 19 nt, Homo sapiens
caguaccaguuacgucaaa

SEQ ID NO: 892383 - RNA, 19 nt, Homo sapiens
gagauuucacugacaacuu

SEQ ID NO: 892384 - RNA, 19 nt, Homo sapiens
aaaguuacagcugucauaa

SEQ ID NO: 892385 - RNA, 19 nt, Homo sapiens
gaaaugcaaggaaccaaaa

SEQ ID NO: 892386 - RNA, 19 nt, Homo sapiens
agaguuaacauuuggcuau

SEQ ID NO: 892387 - RNA, 19 nt, Homo sapiens
ucuccgagcuuacucacau

SEQ ID NO: 892388 - RNA, 19 nt, Homo sapiens
ucagauuccagcauauauu

SEQ ID NO: 892389 - RNA, 19 nt, Homo sapiens
cagcugucauaagaucaua

SEQ ID NO: 892390 - RNA, 19 nt, Homo sapiens
aauauucccugguuauacu

SEQ ID NO: 892391 - RNA, 19 nt, Homo sapiens
gaaggcacagaaugcuuau

SEQ ID NO: 892392 - RNA, 19 nt, Homo sapiens
gcauuucacuagcauucgu

SEQ ID NO: 892393 - RNA, 19 nt, Homo sapiens
ucugagauuucacugacaa

SEQ ID NO: 892394 - RNA, 19 nt, Homo sapiens
uggcuauacugauguuugu

SEQ ID NO: 892395 - RNA, 19 nt, Homo sapiens
cauaauugaaggcaguaaa

SEQ ID NO: 892396 - RNA, 19 nt, Homo sapiens
cuacuuugguacaggcuau

SEQ ID NO: 892397 - RNA, 19 nt, Homo sapiens
ccacuggagaggacagaaa

SEQ ID NO: 892398 - RNA, 19 nt, Homo sapiens
uaugacugcucucucuuca

SEQ ID NO: 892399 - RNA, 19 nt, Homo sapiens
guuauucagggacacuaua

SEQ ID NO: 892400 - RNA, 19 nt, Homo sapiens
aagaacucaggacauauua

SEQ ID NO: 892401 - RNA, 19 nt, Homo sapiens
cuacuucagguaaucauug

SEQ ID NO: 892402 - RNA, 19 nt, Homo sapiens
guuaccauuuguacuacuu

SEQ ID NO: 892403 - RNA, 19 nt, Homo sapiens
ucacuagcauucguugauc

SEQ ID NO: 892404 - RNA, 19 nt, Homo sapiens
guuaacauuuggcuauacu

SEQ ID NO: 892405 - RNA, 19 nt, Homo sapiens
uagcuuucauaaccuguug

SEQ ID NO: 892406 - RNA, 19 nt, Homo sapiens
gacagcuuguauagauuau

SEQ ID NO: 892407 - RNA, 19 nt, Homo sapiens
ggagaaacccuggauauuu

SEQ ID NO: 892408 - RNA, 19 nt, Homo sapiens
gcaguauucucucuucaaa

SEQ ID NO: 892409 - RNA, 19 nt, Homo sapiens
ggaucucuguucuaucuua

SEQ ID NO: 892410 - RNA, 19 nt, Homo sapiens
ccgagucucuugcgaaaua

SEQ ID NO: 892411 - RNA, 19 nt, Homo sapiens
ugacugggauuggaaauaa

SEQ ID NO: 892412 - RNA, 19 nt, Homo sapiens
gcuuauaacuguacucuuc

SEQ ID NO: 892413 - RNA, 19 nt, Homo sapiens
aagaggaucuguccaauau

SEQ ID NO: 892414 - RNA, 19 nt, Homo sapiens
guauauaugugcugaaauc

SEQ ID NO: 892415 - RNA, 19 nt, Homo sapiens
gcucaagucugccuuaaag

SEQ ID NO: 892416 - RNA, 19 nt, Homo sapiens
ggaagaaucccagcagaaa

SEQ ID NO: 892417 - RNA, 19 nt, Homo sapiens
ugaaagcauugcaugagua

SEQ ID NO: 892418 - RNA, 19 nt, Homo sapiens
gaaagcauugcaugaguaa

SEQ ID NO: 892419 - RNA, 19 nt, Homo sapiens
ccacucacuuauaaagaua

SEQ ID NO: 892420 - RNA, 19 nt, Homo sapiens
ccagaaaccuacaaaccuu

SEQ ID NO: 892421 - RNA, 19 nt, Homo sapiens
gaacaacccaaguagaguu

SEQ ID NO: 892422 - RNA, 19 nt, Homo sapiens
gaaucaccauguacuaaau

SEQ ID NO: 892423 - RNA, 19 nt, Homo sapiens
gaacacauccaagcaguau

SEQ ID NO: 892424 - RNA, 19 nt, Homo sapiens
gaggaucuguccaauaucu

SEQ ID NO: 892425 - RNA, 19 nt, Homo sapiens
caagaggaucuguccaaua

SEQ ID NO: 892426 - RNA, 19 nt, Homo sapiens
cgaaauacaacaaugagaa

SEQ ID NO: 892427 - RNA, 19 nt, Homo sapiens
gaaagaaggcauggcaaga

SEQ ID NO: 892428 - RNA, 19 nt, Homo sapiens
gaacgacgcccaggaauac

SEQ ID NO: 892429 - RNA, 19 nt, Homo sapiens
cagaaaggauggcuaugug

SEQ ID NO: 892430 - RNA, 19 nt, Homo sapiens
uauaugugcugaaaucuca

SEQ ID NO: 892431 - RNA, 19 nt, Homo sapiens
uaacaaagacagaaaggau

SEQ ID NO: 892432 - RNA, 19 nt, Homo sapiens
cuucuuacuucguggaaua

SEQ ID NO: 892433 - RNA, 19 nt, Homo sapiens
uagaguggcuagugaagga

SEQ ID NO: 892434 - RNA, 19 nt, Homo sapiens
uggcaagacuguggaauga

SEQ ID NO: 892435 - RNA, 19 nt, Homo sapiens
uccaauaucuuccugacuu

SEQ ID NO: 892436 - RNA, 19 nt, Homo sapiens
caagcaguauucucucuuc

SEQ ID NO: 892437 - RNA, 19 nt, Homo sapiens
caguauauaugugcugaaa

SEQ ID NO: 892438 - RNA, 19 nt, Homo sapiens
cuauuuagcugcuuauaac

SEQ ID NO: 892439 - RNA, 19 nt, Homo sapiens
uauaugaacaacccaagua

SEQ ID NO: 892440 - RNA, 19 nt, Homo sapiens
gccacucacuuauaaagau

SEQ ID NO: 892441 - RNA, 19 nt, Homo sapiens
gggagaaacccuggauauu

SEQ ID NO: 892442 - RNA, 19 nt, Homo sapiens
gcuggcaguugcaggcuuu

SEQ ID NO: 892443 - RNA, 19 nt, Homo sapiens
ccaauaucuuccugacuug

SEQ ID NO: 892444 - RNA, 19 nt, Homo sapiens
caccgagucucuugcgaaa

SEQ ID NO: 892445 - RNA, 19 nt, Homo sapiens
ugaaucaguuuauggucaa

SEQ ID NO: 892446 - RNA, 19 nt, Homo sapiens
ggauauuuccuuccucuuc

SEQ ID NO: 892447 - RNA, 19 nt, Homo sapiens
gcuguuaaccagaaaccua

SEQ ID NO: 892448 - RNA, 19 nt, Homo sapiens
gccaugugcucagaaagaa

SEQ ID NO: 892449 - RNA, 19 nt, Homo sapiens
ugaacgacgcccaggaaua

SEQ ID NO: 892450 - RNA, 19 nt, Homo sapiens
ccacugacucuuccaauca

SEQ ID NO: 892451 - RNA, 19 nt, Homo sapiens
gaaauacaacaaugagaac

SEQ ID NO: 892452 - RNA, 19 nt, Homo sapiens
ccaagaggaucuguccaau

SEQ ID NO: 892453 - RNA, 19 nt, Homo sapiens
gggaaaaguuugucucugu

SEQ ID NO: 892454 - RNA, 19 nt, Homo sapiens
aguauucucucuucaaagu

SEQ ID NO: 892455 - RNA, 19 nt, Homo sapiens
caagcuccauacccacuga

SEQ ID NO: 892456 - RNA, 19 nt, Homo sapiens
ccugggaucucuguucuau

SEQ ID NO: 892457 - RNA, 19 nt, Homo sapiens
aaagaaucaccauguacua

SEQ ID NO: 892458 - RNA, 19 nt, Homo sapiens
ugucggcccuucuuacuuc

SEQ ID NO: 892459 - RNA, 19 nt, Homo sapiens
ugggaucucuguucuaucu

SEQ ID NO: 892460 - RNA, 19 nt, Homo sapiens
cagaaugccagcccucuug

SEQ ID NO: 892461 - RNA, 19 nt, Homo sapiens
gaaggcauggcaagacugu

SEQ ID NO: 892462 - RNA, 19 nt, Homo sapiens
uucagccacucacuuauaa

SEQ ID NO: 892463 - RNA, 19 nt, Homo sapiens
uggaugugcuagagacuga

SEQ ID NO: 892464 - RNA, 19 nt, Homo sapiens
ggauggcuaugugcugaga

SEQ ID NO: 892465 - RNA, 19 nt, Homo sapiens
ugaaaucucagcaugaaag

SEQ ID NO: 892466 - RNA, 19 nt, Homo sapiens
cuccaaagcugggccaaga

SEQ ID NO: 892467 - RNA, 19 nt, Homo sapiens
ugcgggauauuaacaaaga

SEQ ID NO: 892468 - RNA, 19 nt, Homo sapiens
cuucagccacucacuuaua

SEQ ID NO: 892469 - RNA, 19 nt, Homo sapiens
gccaugagaaucacacaga

SEQ ID NO: 892470 - RNA, 19 nt, Homo sapiens
agaaucaccauguacuaaa

SEQ ID NO: 892471 - RNA, 19 nt, Homo sapiens
cuuccugacuuggaugaua

SEQ ID NO: 892472 - RNA, 19 nt, Homo sapiens
ugacuugugacuucuuuga

SEQ ID NO: 892473 - RNA, 19 nt, Homo sapiens
agacagaaaggauggcuau

SEQ ID NO: 892474 - RNA, 19 nt, Homo sapiens
acaaugagaacacauccaa

SEQ ID NO: 892475 - RNA, 19 nt, Homo sapiens
gauuggaaauaaugagacu

SEQ ID NO: 892476 - RNA, 19 nt, Homo sapiens
cacguagaguggcuaguga

SEQ ID NO: 892477 - RNA, 19 nt, Homo sapiens
gccaagaggaucuguccaa

SEQ ID NO: 892478 - RNA, 19 nt, Homo sapiens
uaaagaaucaccauguacu

SEQ ID NO: 892479 - RNA, 19 nt, Homo sapiens
cuuacuucguggaauauuu

SEQ ID NO: 892480 - RNA, 19 nt, Homo sapiens
ugacugccaugugcucaga

SEQ ID NO: 892481 - RNA, 19 nt, Homo sapiens
uaacaaaaccgcucaaguc

SEQ ID NO: 892482 - RNA, 19 nt, Homo sapiens
ugagcugcaucaccuccua

SEQ ID NO: 892483 - RNA, 19 nt, Homo sapiens
agugaaaacucugcuguua

SEQ ID NO: 892484 - RNA, 19 nt, Homo sapiens
aagaaucaccauguacuaa

SEQ ID NO: 892485 - RNA, 19 nt, Homo sapiens
acacauccaagcaguauuc

SEQ ID NO: 892486 - RNA, 19 nt, Homo sapiens
ggucaaugcaaagcaauau

SEQ ID NO: 892487 - RNA, 19 nt, Homo sapiens
gggauuggaaauaaugaga

SEQ ID NO: 892488 - RNA, 19 nt, Homo sapiens
uuccugacuuggaugauaa

SEQ ID NO: 892489 - RNA, 19 nt, Homo sapiens
uugcaaagguucucugacu

SEQ ID NO: 892490 - RNA, 19 nt, Homo sapiens
uauggucaaugcaaagcaa

SEQ ID NO: 892491 - RNA, 19 nt, Homo sapiens
ggauauuaacaaagacaga

SEQ ID NO: 892492 - RNA, 19 nt, Homo sapiens
gaacacacugggaaaaguu

SEQ ID NO: 892493 - RNA, 19 nt, Homo sapiens
uauucucucuucaaaguca

SEQ ID NO: 892494 - RNA, 19 nt, Homo sapiens
ugacugcccaagcuccaua

SEQ ID NO: 892495 - RNA, 19 nt, Homo sapiens
gucuucagccacucacuua

SEQ ID NO: 892496 - RNA, 19 nt, Homo sapiens
cauguugacugggauugga

SEQ ID NO: 892497 - RNA, 19 nt, Homo sapiens
gacgauggacagagacaga

SEQ ID NO: 892498 - RNA, 19 nt, Homo sapiens
gaagaaucccagcagaaaa

SEQ ID NO: 892499 - RNA, 19 nt, Homo sapiens
gcuuugcccugcgggauau

SEQ ID NO: 892500 - RNA, 19 nt, Homo sapiens
cauccaagcaguauucucu

SEQ ID NO: 892501 - RNA, 19 nt, Homo sapiens
gcgaaauacaacaaugaga

SEQ ID NO: 892502 - RNA, 19 nt, Homo sapiens
ccugcgggauauuaacaaa

SEQ ID NO: 892503 - RNA, 19 nt, Homo sapiens
gagcugcaucaccuccuaa

SEQ ID NO: 892504 - RNA, 19 nt, Homo sapiens
ggaucuguccaauaucuuc

SEQ ID NO: 892505 - RNA, 19 nt, Homo sapiens
ugugacuugugacuucuuu

SEQ ID NO: 892506 - RNA, 19 nt, Homo sapiens
gaucucuguucuaucuuac

SEQ ID NO: 892507 - RNA, 19 nt, Homo sapiens
caaagaaccuuccaugaug

SEQ ID NO: 892508 - RNA, 19 nt, Homo sapiens
gaacugaacuuugacuuuc

SEQ ID NO: 892509 - RNA, 19 nt, Homo sapiens
gagcugaguguaagaauua

SEQ ID NO: 892510 - RNA, 19 nt, Homo sapiens
agauagagcuggccagaua

SEQ ID NO: 892511 - RNA, 19 nt, Homo sapiens
ggaaggacuuugucucuga

SEQ ID NO: 892512 - RNA, 19 nt, Homo sapiens
gcacacagcuguacauggu

SEQ ID NO: 892513 - RNA, 19 nt, Homo sapiens
ucaccaagcucaugaaguu

SEQ ID NO: 892514 - RNA, 19 nt, Homo sapiens
uaucagaucuugaacaaug

SEQ ID NO: 892515 - RNA, 19 nt, Homo sapiens
ugaaggacaucauugagua

SEQ ID NO: 892516 - RNA, 19 nt, Homo sapiens
gcaguguccuguuggauaa

SEQ ID NO: 892517 - RNA, 19 nt, Homo sapiens
gaagaagaauguccucauc

SEQ ID NO: 892518 - RNA, 19 nt, Homo sapiens
gaaccauucuccaguaugu

SEQ ID NO: 892519 - RNA, 19 nt, Homo sapiens
ggaaguaucagaucuugaa

SEQ ID NO: 892520 - RNA, 19 nt, Homo sapiens
cagaccagaucuuugcuua

SEQ ID NO: 892521 - RNA, 19 nt, Homo sapiens
gagccacacgcuacaauua

SEQ ID NO: 892522 - RNA, 19 nt, Homo sapiens
gcaaguucaucaacauguu

SEQ ID NO: 892523 - RNA, 19 nt, Homo sapiens
caugaaagccugcggauga

SEQ ID NO: 892524 - RNA, 19 nt, Homo sapiens
ggauggaccuggaaacaag

SEQ ID NO: 892525 - RNA, 19 nt, Homo sapiens
ggaacugaacuuugacuuu

SEQ ID NO: 892526 - RNA, 19 nt, Homo sapiens
gauagaagcugaggugaac

SEQ ID NO: 892527 - RNA, 19 nt, Homo sapiens
ucacacaucugcucaacau

SEQ ID NO: 892528 - RNA, 19 nt, Homo sapiens
gggcaucgcuguggucaug

SEQ ID NO: 892529 - RNA, 19 nt, Homo sapiens
ccaaagaaccuuccaugau

SEQ ID NO: 892530 - RNA, 19 nt, Homo sapiens
agacagagcagcacaguga

SEQ ID NO: 892531 - RNA, 19 nt, Homo sapiens
gcugguugcuccaucauug

SEQ ID NO: 892532 - RNA, 19 nt, Homo sapiens
ucauggagguguacucuug

SEQ ID NO: 892533 - RNA, 19 nt, Homo sapiens
ggaggaaggacaugaguau

SEQ ID NO: 892534 - RNA, 19 nt, Homo sapiens
ucacgggcauugcaaggua

SEQ ID NO: 892535 - RNA, 19 nt, Homo sapiens
gacuugaacagacucauua

SEQ ID NO: 892536 - RNA, 19 nt, Homo sapiens
aaacaguccuucuucuuca

SEQ ID NO: 892537 - RNA, 19 nt, Homo sapiens
gaacugcuaaagauuguga

SEQ ID NO: 892538 - RNA, 19 nt, Homo sapiens
gaagagaacaaguccaagu

SEQ ID NO: 892539 - RNA, 19 nt, Homo sapiens
gcaaugccauccucuucug

SEQ ID NO: 892540 - RNA, 19 nt, Homo sapiens
ucugggaacugaacuuuga

SEQ ID NO: 892541 - RNA, 19 nt, Homo sapiens
gcuguuggguagaucaauu

SEQ ID NO: 892542 - RNA, 19 nt, Homo sapiens
caaacuggaugccaagaag

SEQ ID NO: 892543 - RNA, 19 nt, Homo sapiens
gaggaacugcuaaagauug

SEQ ID NO: 892544 - RNA, 19 nt, Homo sapiens
cagcuucgaugccauguuc

SEQ ID NO: 892545 - RNA, 19 nt, Homo sapiens
gcuaucagccgcuuugaga

SEQ ID NO: 892546 - RNA, 19 nt, Homo sapiens
aaagguggauuugauauca

SEQ ID NO: 892547 - RNA, 19 nt, Homo sapiens
uggaggaacugcuaaagau

SEQ ID NO: 892548 - RNA, 19 nt, Homo sapiens
gauccaagccucucaacau

SEQ ID NO: 892549 - RNA, 19 nt, Homo sapiens
gaauuauggcgucaucauu

SEQ ID NO: 892550 - RNA, 19 nt, Homo sapiens
gagaauucuuccuggaguu

SEQ ID NO: 892551 - RNA, 19 nt, Homo sapiens
guucacagcugagcagugu

SEQ ID NO: 892552 - RNA, 19 nt, Homo sapiens
ggaccaugcuugaaucacu

SEQ ID NO: 892553 - RNA, 19 nt, Homo sapiens
gcaccgcggaggaauauga

SEQ ID NO: 892554 - RNA, 19 nt, Homo sapiens
gaagucagacgaggaguau

SEQ ID NO: 892555 - RNA, 19 nt, Homo sapiens
caacaucuguguggauuac

SEQ ID NO: 892556 - RNA, 19 nt, Homo sapiens
caagagggcagcacaguuc

SEQ ID NO: 892557 - RNA, 19 nt, Homo sapiens
gcuuugaccuguucgacuu

SEQ ID NO: 892558 - RNA, 19 nt, Homo sapiens
gcuguggccuguccauguu

SEQ ID NO: 892559 - RNA, 19 nt, Homo sapiens
gaccagaucuuugcuuacu

SEQ ID NO: 892560 - RNA, 19 nt, Homo sapiens
caaacaguccuucuucuuc

SEQ ID NO: 892561 - RNA, 19 nt, Homo sapiens
cauagaggacuuucacaaa

SEQ ID NO: 892562 - RNA, 19 nt, Homo sapiens
gcgagcagaugguucagau

SEQ ID NO: 892563 - RNA, 19 nt, Homo sapiens
gaagugaucccaggcuaug

SEQ ID NO: 892564 - RNA, 19 nt, Homo sapiens
gcagacuccuggguuauca

SEQ ID NO: 892565 - RNA, 19 nt, Homo sapiens
cgcagaaccuuuccauguu

SEQ ID NO: 892566 - RNA, 19 nt, Homo sapiens
gaagugcagcgucaagaau

SEQ ID NO: 892567 - RNA, 19 nt, Homo sapiens
ugaaguccguggagacaga

SEQ ID NO: 892568 - RNA, 19 nt, Homo sapiens
gaggugaugcccaagauau

SEQ ID NO: 892569 - RNA, 19 nt, Homo sapiens
aaggaaccauucuccagua

SEQ ID NO: 892570 - RNA, 19 nt, Homo sapiens
uaaagauugugaagagcuu

SEQ ID NO: 892571 - RNA, 19 nt, Homo sapiens
ccaacguccagccuuauua

SEQ ID NO: 892572 - RNA, 19 nt, Homo sapiens
cgagcugaguguaagaauu

SEQ ID NO: 892573 - RNA, 19 nt, Homo sapiens
caaaacaucuugccuagag

SEQ ID NO: 892574 - RNA, 19 nt, Homo sapiens
ggaggaacugcuaaagauu

SEQ ID NO: 892575 - RNA, 19 nt, Homo sapiens
cgcaucggcugcucuguaa

SEQ ID NO: 892576 - RNA, 19 nt, Homo sapiens
uggaugagcuaaagaacau

SEQ ID NO: 892577 - RNA, 19 nt, Homo sapiens
gcggaugagugcagaauac

SEQ ID NO: 892578 - RNA, 19 nt, Homo sapiens
acuaugcucugaccaaguu

SEQ ID NO: 892579 - RNA, 19 nt, Homo sapiens
caacgacagcgccuacuau

SEQ ID NO: 892580 - RNA, 19 nt, Homo sapiens
gaugagugcagaauacaga

SEQ ID NO: 892581 - RNA, 19 nt, Homo sapiens
ggaggaggucugcgauuug

SEQ ID NO: 892582 - RNA, 19 nt, Homo sapiens
ggucauggaggaacugcua

SEQ ID NO: 892583 - RNA, 19 nt, Homo sapiens
ccaccucauuucaagacua

SEQ ID NO: 892584 - RNA, 19 nt, Homo sapiens
uaagaauuauggcgucauc

SEQ ID NO: 892585 - RNA, 19 nt, Homo sapiens
uagaggacuuucacaaaca

SEQ ID NO: 892586 - RNA, 19 nt, Homo sapiens
ccuaauggauggaaauguc

SEQ ID NO: 892587 - RNA, 19 nt, Homo sapiens
agaaacauaugcuccucaa

SEQ ID NO: 892588 - RNA, 19 nt, Homo sapiens
cuccauagcauaaaugaaa

SEQ ID NO: 892589 - RNA, 19 nt, Homo sapiens
aguaucagaucuugaacaa

SEQ ID NO: 892590 - RNA, 19 nt, Homo sapiens
gcaccucugccgccaugua

SEQ ID NO: 892591 - RNA, 19 nt, Homo sapiens
ggcaguguccuguuggaua

SEQ ID NO: 892592 - RNA, 19 nt, Homo sapiens
gauggaguauguccucuac

SEQ ID NO: 892593 - RNA, 19 nt, Homo sapiens
ucacaaacaguccuucuuc

SEQ ID NO: 892594 - RNA, 19 nt, Homo sapiens
caggaaguaucagaucuug

SEQ ID NO: 892595 - RNA, 19 nt, Homo sapiens
ucacagcugagcaguguuu

SEQ ID NO: 892596 - RNA, 19 nt, Homo sapiens
ggauggaaaugucaguaac

SEQ ID NO: 892597 - RNA, 19 nt, Homo sapiens
ggaccugcuugaagagcuu

SEQ ID NO: 892598 - RNA, 19 nt, Homo sapiens
ccaagaagagaauuaaucu

SEQ ID NO: 892599 - RNA, 19 nt, Homo sapiens
gaugccaagaagagaauua

SEQ ID NO: 892600 - RNA, 19 nt, Homo sapiens
acaguccacuccagcauga

SEQ ID NO: 892601 - RNA, 19 nt, Homo sapiens
ggacgggaaggaugaaauc

SEQ ID NO: 892602 - RNA, 19 nt, Homo sapiens
aggaggaggucugcgauuu

SEQ ID NO: 892603 - RNA, 19 nt, Homo sapiens
gcuacaauggguccacuaa

SEQ ID NO: 892604 - RNA, 19 nt, Homo sapiens
ggaccugaccuccauugug

SEQ ID NO: 892605 - RNA, 19 nt, Homo sapiens
ccagaucuuugcuuacuac

SEQ ID NO: 892606 - RNA, 19 nt, Homo sapiens
gucaacaucuguguggauu

SEQ ID NO: 892607 - RNA, 19 nt, Homo sapiens
caauguagcugaaauaaga

SEQ ID NO: 892608 - RNA, 19 nt, Homo sapiens
caaagaggcuccagaaaug

SEQ ID NO: 892609 - RNA, 19 nt, Homo sapiens
caacaaaucucuaaaucga

SEQ ID NO: 892610 - RNA, 19 nt, Homo sapiens
caagugacauccugaagua

SEQ ID NO: 892611 - RNA, 19 nt, Homo sapiens
gauggaggcugaaauuaaa

SEQ ID NO: 892612 - RNA, 19 nt, Homo sapiens
ggagucaccuguaaauuga

SEQ ID NO: 892613 - RNA, 19 nt, Homo sapiens
gaaguaugaucacaaaugu

SEQ ID NO: 892614 - RNA, 19 nt, Homo sapiens
gaacccaggucucgucuga

SEQ ID NO: 892615 - RNA, 19 nt, Homo sapiens
gaagaggacuuagugagaa

SEQ ID NO: 892616 - RNA, 19 nt, Homo sapiens
gcagagagacaacagauuu

SEQ ID NO: 892617 - RNA, 19 nt, Homo sapiens
gcacgugccugucucauuc

SEQ ID NO: 892618 - RNA, 19 nt, Homo sapiens
ucagauacuucuugguuua

SEQ ID NO: 892619 - RNA, 19 nt, Homo sapiens
gagaccagcugcucuagaa

SEQ ID NO: 892620 - RNA, 19 nt, Homo sapiens
cagaaagccugccaaugua

SEQ ID NO: 892621 - RNA, 19 nt, Homo sapiens
ggaauagggucuccucugu

SEQ ID NO: 892622 - RNA, 19 nt, Homo sapiens
ugacagagguacaaguaaa

SEQ ID NO: 892623 - RNA, 19 nt, Homo sapiens
ccacagggcugggcuacua

SEQ ID NO: 892624 - RNA, 19 nt, Homo sapiens
gcugagcacuaguugauaa

SEQ ID NO: 892625 - RNA, 19 nt, Homo sapiens
gagaauaaguggcuugucu

SEQ ID NO: 892626 - RNA, 19 nt, Homo sapiens
gggaagaucacgggaauua

SEQ ID NO: 892627 - RNA, 19 nt, Homo sapiens
gcaccaggccucauaacua

SEQ ID NO: 892628 - RNA, 19 nt, Homo sapiens
gcagaaaggacguggauga

SEQ ID NO: 892629 - RNA, 19 nt, Homo sapiens
ucaaauaucugugccaugu

SEQ ID NO: 892630 - RNA, 19 nt, Homo sapiens
cuacacaccugcaaucaga

SEQ ID NO: 892631 - RNA, 19 nt, Homo sapiens
gaugugaucuggcuacagu

SEQ ID NO: 892632 - RNA, 19 nt, Homo sapiens
agagaaagauccucacuca

SEQ ID NO: 892633 - RNA, 19 nt, Homo sapiens
ccacuucacuccagcauca

SEQ ID NO: 892634 - RNA, 19 nt, Homo sapiens
ccaaguagcugggauuaca

SEQ ID NO: 892635 - RNA, 19 nt, Homo sapiens
gaaagagaaaccugaguga

SEQ ID NO: 892636 - RNA, 19 nt, Homo sapiens
gcacaacaaaucucuaaau

SEQ ID NO: 892637 - RNA, 19 nt, Homo sapiens
ggaagaggacuuagugaga

SEQ ID NO: 892638 - RNA, 19 nt, Homo sapiens
gaaagauccucacucaacu

SEQ ID NO: 892639 - RNA, 19 nt, Homo sapiens
caagauggaggcugaaauu

SEQ ID NO: 892640 - RNA, 19 nt, Homo sapiens
acacaccgcugucucuuug

SEQ ID NO: 892641 - RNA, 19 nt, Homo sapiens
gagcuagaauucugguguu

SEQ ID NO: 892642 - RNA, 19 nt, Homo sapiens
gaaagcagcaaaggaaaga

SEQ ID NO: 892643 - RNA, 19 nt, Homo sapiens
guuuggagcccacauauuu

SEQ ID NO: 892644 - RNA, 19 nt, Homo sapiens
caacuuccgugaugugauc

SEQ ID NO: 892645 - RNA, 19 nt, Homo sapiens
gaagaucacgggaauuaca

SEQ ID NO: 892646 - RNA, 19 nt, Homo sapiens
acagaaagccugccaaugu

SEQ ID NO: 892647 - RNA, 19 nt, Homo sapiens
gagaguggauggccaaguc

SEQ ID NO: 892648 - RNA, 19 nt, Homo sapiens
caaagugggagcccgauaa

SEQ ID NO: 892649 - RNA, 19 nt, Homo sapiens
agaaauguuugcugaguga

SEQ ID NO: 892650 - RNA, 19 nt, Homo sapiens
ucaaagaggcuccagaaau

SEQ ID NO: 892651 - RNA, 19 nt, Homo sapiens
gaggugacacagaguauuu

SEQ ID NO: 892652 - RNA, 19 nt, Homo sapiens
ggucaccuuuguccuguuu

SEQ ID NO: 892653 - RNA, 19 nt, Homo sapiens
cuagaauucugguguuuau

SEQ ID NO: 892654 - RNA, 19 nt, Homo sapiens
ggacagagggagagaauac

SEQ ID NO: 892655 - RNA, 19 nt, Homo sapiens
gcacaagucauaccuacau

SEQ ID NO: 892656 - RNA, 19 nt, Homo sapiens
aaauuaagccuuccugcua

SEQ ID NO: 892657 - RNA, 19 nt, Homo sapiens
gauccucacucaacucaca

SEQ ID NO: 892658 - RNA, 19 nt, Homo sapiens
ccacaugugucaagucagu

SEQ ID NO: 892659 - RNA, 19 nt, Homo sapiens
gaaauguagcaagcacuua

SEQ ID NO: 892660 - RNA, 19 nt, Homo sapiens
aagcaaggcacaagucaua

SEQ ID NO: 892661 - RNA, 19 nt, Homo sapiens
gaagacacagcaagugaga

SEQ ID NO: 892662 - RNA, 19 nt, Homo sapiens
uaaaagagcagguuaagaa

SEQ ID NO: 892663 - RNA, 19 nt, Homo sapiens
ugacuaaucuuugcugaag

SEQ ID NO: 892664 - RNA, 19 nt, Homo sapiens
aaacccaacuuccgugaug

SEQ ID NO: 892665 - RNA, 19 nt, Homo sapiens
ggucucgucugacuccaaa

SEQ ID NO: 892666 - RNA, 19 nt, Homo sapiens
cacaacaaaucucuaaauc

SEQ ID NO: 892667 - RNA, 19 nt, Homo sapiens
agugggagcccgauaaaua

SEQ ID NO: 892668 - RNA, 19 nt, Homo sapiens
ccugaaguaugaucacaaa

SEQ ID NO: 892669 - RNA, 19 nt, Homo sapiens
gagcuggcauccccauuua

SEQ ID NO: 892670 - RNA, 19 nt, Homo sapiens
cacaaggaaucaauugaga

SEQ ID NO: 892671 - RNA, 19 nt, Homo sapiens
ggagaggugacacagagua

SEQ ID NO: 892672 - RNA, 19 nt, Homo sapiens
aggauaaacugcagagaga

SEQ ID NO: 892673 - RNA, 19 nt, Homo sapiens
gggcugggcuacuaagcuu

SEQ ID NO: 892674 - RNA, 19 nt, Homo sapiens
cauccuacguuacuauuca

SEQ ID NO: 892675 - RNA, 19 nt, Homo sapiens
acauguauaucucgaguga

SEQ ID NO: 892676 - RNA, 19 nt, Homo sapiens
ccaaagugcugggauuaca

SEQ ID NO: 892677 - RNA, 19 nt, Homo sapiens
caggaaagcagcaaaggaa

SEQ ID NO: 892678 - RNA, 19 nt, Homo sapiens
guagcaagcacuuauuguu

SEQ ID NO: 892679 - RNA, 19 nt, Homo sapiens
ccaaagugcugggauuaca

SEQ ID NO: 892680 - RNA, 19 nt, Homo sapiens
aggaaucaauugagagaaa

SEQ ID NO: 892681 - RNA, 19 nt, Homo sapiens
cagagagacaacagauuua

SEQ ID NO: 892682 - RNA, 19 nt, Homo sapiens
uguauggagucaccuguaa

SEQ ID NO: 892683 - RNA, 19 nt, Homo sapiens
gaagaagacacagcaagug

SEQ ID NO: 892684 - RNA, 19 nt, Homo sapiens
gcacauccuacguuacuau

SEQ ID NO: 892685 - RNA, 19 nt, Homo sapiens
aauuaagccuuccugcuaa

SEQ ID NO: 892686 - RNA, 19 nt, Homo sapiens
gugacauccugaaguauga

SEQ ID NO: 892687 - RNA, 19 nt, Homo sapiens
ggacagcaauuuggaacag

SEQ ID NO: 892688 - RNA, 19 nt, Homo sapiens
gccaagagcagcugccauu

SEQ ID NO: 892689 - RNA, 19 nt, Homo sapiens
gcucuugucucugguguuc

SEQ ID NO: 892690 - RNA, 19 nt, Homo sapiens
gcccacaugugucaaguca

SEQ ID NO: 892691 - RNA, 19 nt, Homo sapiens
ggccuggucuugcagaaau

SEQ ID NO: 892692 - RNA, 19 nt, Homo sapiens
uuaauugcauucagaagug

SEQ ID NO: 892693 - RNA, 19 nt, Homo sapiens
aagagcagguuaagaacuu

SEQ ID NO: 892694 - RNA, 19 nt, Homo sapiens
ccaguuucaugucuuguga

SEQ ID NO: 892695 - RNA, 19 nt, Homo sapiens
gaauucugguguuuauaag

SEQ ID NO: 892696 - RNA, 19 nt, Homo sapiens
cuaagcagccucuuuguuc

SEQ ID NO: 892697 - RNA, 19 nt, Homo sapiens
ugaaguaugaucacaaaug

SEQ ID NO: 892698 - RNA, 19 nt, Homo sapiens
cuucguauaugaaauguuc

SEQ ID NO: 892699 - RNA, 19 nt, Homo sapiens
gcaccuggccucaaacaag

SEQ ID NO: 892700 - RNA, 19 nt, Homo sapiens
caccaugccaggcuaauuu

SEQ ID NO: 892701 - RNA, 19 nt, Homo sapiens
caaggaaucaauugagaga

SEQ ID NO: 892702 - RNA, 19 nt, Homo sapiens
caccacacccagcuaauuu

SEQ ID NO: 892703 - RNA, 19 nt, Homo sapiens
ucgcagcucuggccuccua

SEQ ID NO: 892704 - RNA, 19 nt, Homo sapiens
ccagaaauguuugcugagu

SEQ ID NO: 892705 - RNA, 19 nt, Homo sapiens
cuggacugcuguuuguuua

SEQ ID NO: 892706 - RNA, 19 nt, Homo sapiens
ggucuccucuguccucugu

SEQ ID NO: 892707 - RNA, 19 nt, Homo sapiens
acaaagaccuugcugauaa

SEQ ID NO: 892708 - RNA, 19 nt, Homo sapiens
caauguagcugaaauaaga

SEQ ID NO: 892709 - RNA, 19 nt, Homo sapiens
caaagaggcuccagaaaug

SEQ ID NO: 892710 - RNA, 19 nt, Homo sapiens
caacaaaucucuaaaucga

SEQ ID NO: 892711 - RNA, 19 nt, Homo sapiens
caagugacauccugaagua

SEQ ID NO: 892712 - RNA, 19 nt, Homo sapiens
gauggaggcugaaauuaaa

SEQ ID NO: 892713 - RNA, 19 nt, Homo sapiens
ggagucaccuguaaauuga

SEQ ID NO: 892714 - RNA, 19 nt, Homo sapiens
gaaguaugaucacaaaugu

SEQ ID NO: 892715 - RNA, 19 nt, Homo sapiens
gaacccaggucucgucuga

SEQ ID NO: 892716 - RNA, 19 nt, Homo sapiens
gaagaggacuuagugagaa

SEQ ID NO: 892717 - RNA, 19 nt, Homo sapiens
gcacgugccugucucauuc

SEQ ID NO: 892718 - RNA, 19 nt, Homo sapiens
ucagauacuucuugguuua

SEQ ID NO: 892719 - RNA, 19 nt, Homo sapiens
gagaccagcugcucuagaa

SEQ ID NO: 892720 - RNA, 19 nt, Homo sapiens
cagaaagccugccaaugua

SEQ ID NO: 892721 - RNA, 19 nt, Homo sapiens
ggaauagggucuccucugu

SEQ ID NO: 892722 - RNA, 19 nt, Homo sapiens
ugacagagguacaaguaaa

SEQ ID NO: 892723 - RNA, 19 nt, Homo sapiens
ccacagggcugggcuacua

SEQ ID NO: 892724 - RNA, 19 nt, Homo sapiens
gcugagcacuaguugauaa

SEQ ID NO: 892725 - RNA, 19 nt, Homo sapiens
caaaugacauggacacauc

SEQ ID NO: 892726 - RNA, 19 nt, Homo sapiens
aaaccaagauggcgacaaa

SEQ ID NO: 892727 - RNA, 19 nt, Homo sapiens
gagaauaaguggcuugucu

SEQ ID NO: 892728 - RNA, 19 nt, Homo sapiens
gggaagaucacgggaauua

SEQ ID NO: 892729 - RNA, 19 nt, Homo sapiens
gcaccaggccucauaacua

SEQ ID NO: 892730 - RNA, 19 nt, Homo sapiens
gaaguuacccuauaugucu

SEQ ID NO: 892731 - RNA, 19 nt, Homo sapiens
caaagaccuugcugauaaa

SEQ ID NO: 892732 - RNA, 19 nt, Homo sapiens
gaauagggguugaguaaaa

SEQ ID NO: 892733 - RNA, 19 nt, Homo sapiens
gcagaaaggacguggauga

SEQ ID NO: 892734 - RNA, 19 nt, Homo sapiens
ucaaauaucugugccaugu

SEQ ID NO: 892735 - RNA, 19 nt, Homo sapiens
cuacacaccugcaaucaga

SEQ ID NO: 892736 - RNA, 19 nt, Homo sapiens
gaugugaucuggcuacagu

SEQ ID NO: 892737 - RNA, 19 nt, Homo sapiens
agagaaagauccucacuca

SEQ ID NO: 892738 - RNA, 19 nt, Homo sapiens
gaguagccauucuauauuc

SEQ ID NO: 892739 - RNA, 19 nt, Homo sapiens
ccacuucacuccagcauca

SEQ ID NO: 892740 - RNA, 19 nt, Homo sapiens
ccaaguagcugggauuaca

SEQ ID NO: 892741 - RNA, 19 nt, Homo sapiens
gaaagagaaaccugaguga

SEQ ID NO: 892742 - RNA, 19 nt, Homo sapiens
gcacaacaaaucucuaaau

SEQ ID NO: 892743 - RNA, 19 nt, Homo sapiens
ggaagaggacuuagugaga

SEQ ID NO: 892744 - RNA, 19 nt, Homo sapiens
gaaagauccucacucaacu

SEQ ID NO: 892745 - RNA, 19 nt, Homo sapiens
caagauggaggcugaaauu

SEQ ID NO: 892746 - RNA, 19 nt, Homo sapiens
gccauucuauauuccuuua

SEQ ID NO: 892747 - RNA, 19 nt, Homo sapiens
cgugacaguuuacaaauga

SEQ ID NO: 892748 - RNA, 19 nt, Homo sapiens
gaguuacacuggaagaaga

SEQ ID NO: 892749 - RNA, 19 nt, Homo sapiens
acacaccgcugucucuuug

SEQ ID NO: 892750 - RNA, 19 nt, Homo sapiens
ggaguagccauucuauauu

SEQ ID NO: 892751 - RNA, 19 nt, Homo sapiens
gagcuagaauucugguguu

SEQ ID NO: 892752 - RNA, 19 nt, Homo sapiens
gaaagcagcaaaggaaaga

SEQ ID NO: 892753 - RNA, 19 nt, Homo sapiens
guuuggagcccacauauuu

SEQ ID NO: 892754 - RNA, 19 nt, Homo sapiens
caacuuccgugaugugauc

SEQ ID NO: 892755 - RNA, 19 nt, Homo sapiens
gaagaucacgggaauuaca

SEQ ID NO: 892756 - RNA, 19 nt, Homo sapiens
acagaaagccugccaaugu

SEQ ID NO: 892757 - RNA, 19 nt, Homo sapiens
gagaguggauggccaaguc

SEQ ID NO: 892758 - RNA, 19 nt, Homo sapiens
ucaggaaguuacccuauau

SEQ ID NO: 892759 - RNA, 19 nt, Homo sapiens
aaacagcucucccucucuu

SEQ ID NO: 892760 - RNA, 19 nt, Homo sapiens
caaagugggagcccgauaa

SEQ ID NO: 892761 - RNA, 19 nt, Homo sapiens
agaaauguuugcugaguga

SEQ ID NO: 892762 - RNA, 19 nt, Homo sapiens
ucaaagaggcuccagaaau

SEQ ID NO: 892763 - RNA, 19 nt, Homo sapiens
gaggugacacagaguauuu

SEQ ID NO: 892764 - RNA, 19 nt, Homo sapiens
ccacuucaguuuauaccuu

SEQ ID NO: 892765 - RNA, 19 nt, Homo sapiens
ggucaccuuuguccuguuu

SEQ ID NO: 892766 - RNA, 19 nt, Homo sapiens
cuagaauucugguguuuau

SEQ ID NO: 892767 - RNA, 19 nt, Homo sapiens
gcacaagucauaccuacau

SEQ ID NO: 892768 - RNA, 19 nt, Homo sapiens
aaauuaagccuuccugcua

SEQ ID NO: 892769 - RNA, 19 nt, Homo sapiens
ccacaugugucaagucagu

SEQ ID NO: 892770 - RNA, 19 nt, Homo sapiens
gaaauguagcaagcacuua

SEQ ID NO: 892771 - RNA, 19 nt, Homo sapiens
gauccucacucaacucaca

SEQ ID NO: 892772 - RNA, 19 nt, Homo sapiens
guuuauaccuugccuguag

SEQ ID NO: 892773 - RNA, 19 nt, Homo sapiens
aagcaaggcacaagucaua

SEQ ID NO: 892774 - RNA, 19 nt, Homo sapiens
gaagacacagcaagugaga

SEQ ID NO: 892775 - RNA, 19 nt, Homo sapiens
uaaaagagcagguuaagaa

SEQ ID NO: 892776 - RNA, 19 nt, Homo sapiens
ccagcaccgugacaguuua

SEQ ID NO: 892777 - RNA, 19 nt, Homo sapiens
ugacuaaucuuugcugaag

SEQ ID NO: 892778 - RNA, 19 nt, Homo sapiens
aaacccaacuuccgugaug

SEQ ID NO: 892779 - RNA, 19 nt, Homo sapiens
ggucucgucugacuccaaa

SEQ ID NO: 892780 - RNA, 19 nt, Homo sapiens
cacaacaaaucucuaaauc

SEQ ID NO: 892781 - RNA, 19 nt, Homo sapiens
agugggagcccgauaaaua

SEQ ID NO: 892782 - RNA, 19 nt, Homo sapiens
ccugaaguaugaucacaaa

SEQ ID NO: 892783 - RNA, 19 nt, Homo sapiens
gagcuggcauccccauuua

SEQ ID NO: 892784 - RNA, 19 nt, Homo sapiens
cacaaggaaucaauugaga

SEQ ID NO: 892785 - RNA, 19 nt, Homo sapiens
ggagaggugacacagagua

SEQ ID NO: 892786 - RNA, 19 nt, Homo sapiens
ggccaaugcuacuuucaga

SEQ ID NO: 892787 - RNA, 19 nt, Homo sapiens
gggcugggcuacuaagcuu

SEQ ID NO: 892788 - RNA, 19 nt, Homo sapiens
cauccuacguuacuauuca

SEQ ID NO: 892789 - RNA, 19 nt, Homo sapiens
gcucucaccacuucaguuu

SEQ ID NO: 892790 - RNA, 19 nt, Homo sapiens
ccaaagugcugggauuaca

SEQ ID NO: 892791 - RNA, 19 nt, Homo sapiens
caggaaagcagcaaaggaa

SEQ ID NO: 892792 - RNA, 19 nt, Homo sapiens
guagcaagcacuuauuguu

SEQ ID NO: 892793 - RNA, 19 nt, Homo sapiens
ccaaagugcugggauuaca

SEQ ID NO: 892794 - RNA, 19 nt, Homo sapiens
aggaaucaauugagagaaa

SEQ ID NO: 892795 - RNA, 19 nt, Homo sapiens
caagauacacgucacaaag

SEQ ID NO: 892796 - RNA, 19 nt, Homo sapiens
ucaauuccaucagcacaaa

SEQ ID NO: 892797 - RNA, 19 nt, Homo sapiens
ucucaccacuucaguuuau

SEQ ID NO: 892798 - RNA, 19 nt, Homo sapiens
uguauggagucaccuguaa

SEQ ID NO: 892799 - RNA, 19 nt, Homo sapiens
gaagaagacacagcaagug

SEQ ID NO: 892800 - RNA, 19 nt, Homo sapiens
gcacauccuacguuacuau

SEQ ID NO: 892801 - RNA, 19 nt, Homo sapiens
aauuaagccuuccugcuaa

SEQ ID NO: 892802 - RNA, 19 nt, Homo sapiens
gugacauccugaaguauga

SEQ ID NO: 892803 - RNA, 19 nt, Homo sapiens
ggacagcaauuuggaacag

SEQ ID NO: 892804 - RNA, 19 nt, Homo sapiens
uggaguagccauucuauau

SEQ ID NO: 892805 - RNA, 19 nt, Homo sapiens
cuggaaaacucaugaauaa

SEQ ID NO: 892806 - RNA, 19 nt, Homo sapiens
cagaggcguuugaaucaga

SEQ ID NO: 892807 - RNA, 19 nt, Homo sapiens
acaaagaccuugcugauaa

SEQ ID NO: 892808 - RNA, 19 nt, Homo sapiens
caauguagcugaaauaaga

SEQ ID NO: 892809 - RNA, 19 nt, Homo sapiens
caaagaggcuccagaaaug

SEQ ID NO: 892810 - RNA, 19 nt, Homo sapiens
caacaaaucucuaaaucga

SEQ ID NO: 892811 - RNA, 19 nt, Homo sapiens
caagugacauccugaagua

SEQ ID NO: 892812 - RNA, 19 nt, Homo sapiens
gauggaggcugaaauuaaa

SEQ ID NO: 892813 - RNA, 19 nt, Homo sapiens
gaaguaugaucacaaaugu

SEQ ID NO: 892814 - RNA, 19 nt, Homo sapiens
gaacccaggucucgucuga

SEQ ID NO: 892815 - RNA, 19 nt, Homo sapiens
gaagaggacuuagugagaa

SEQ ID NO: 892816 - RNA, 19 nt, Homo sapiens
gcagagagacaacagauuu

SEQ ID NO: 892817 - RNA, 19 nt, Homo sapiens
gcacgugccugucucauuc

SEQ ID NO: 892818 - RNA, 19 nt, Homo sapiens
ucagauacuucuugguuua

SEQ ID NO: 892819 - RNA, 19 nt, Homo sapiens
agaaauguuugcugaguua

SEQ ID NO: 892820 - RNA, 19 nt, Homo sapiens
gagaccagcugcucuagaa

SEQ ID NO: 892821 - RNA, 19 nt, Homo sapiens
cagaaagccugccaaugua

SEQ ID NO: 892822 - RNA, 19 nt, Homo sapiens
ggaauagggucuccucugu

SEQ ID NO: 892823 - RNA, 19 nt, Homo sapiens
caaaugacauggacacauc

SEQ ID NO: 892824 - RNA, 19 nt, Homo sapiens
aaaccaagauggcgacaaa

SEQ ID NO: 892825 - RNA, 19 nt, Homo sapiens
gggaagaucacgggaauua

SEQ ID NO: 892826 - RNA, 19 nt, Homo sapiens
gcaccaggccucauaacua

SEQ ID NO: 892827 - RNA, 19 nt, Homo sapiens
gaaguuacccuauaugucu

SEQ ID NO: 892828 - RNA, 19 nt, Homo sapiens
caaagaccuugcugauaaa

SEQ ID NO: 892829 - RNA, 19 nt, Homo sapiens
gaauagggguugaguaaaa

SEQ ID NO: 892830 - RNA, 19 nt, Homo sapiens
ucaaauaucugugccaugu

SEQ ID NO: 892831 - RNA, 19 nt, Homo sapiens
cuacacaccugcaaucaga

SEQ ID NO: 892832 - RNA, 19 nt, Homo sapiens
gaugugaucuggcuacagu

SEQ ID NO: 892833 - RNA, 19 nt, Homo sapiens
agagaaagauccucacuca

SEQ ID NO: 892834 - RNA, 19 nt, Homo sapiens
gaguagccauucuauauuc

SEQ ID NO: 892835 - RNA, 19 nt, Homo sapiens
ccaaguagcugggauuaca

SEQ ID NO: 892836 - RNA, 19 nt, Homo sapiens
gcacaacaaaucucuaaau

SEQ ID NO: 892837 - RNA, 19 nt, Homo sapiens
ggaagaggacuuagugaga

SEQ ID NO: 892838 - RNA, 19 nt, Homo sapiens
gaaagauccucacucaacu

SEQ ID NO: 892839 - RNA, 19 nt, Homo sapiens
caagauggaggcugaaauu

SEQ ID NO: 892840 - RNA, 19 nt, Homo sapiens
gccauucuauauuccuuua

SEQ ID NO: 892841 - RNA, 19 nt, Homo sapiens
cgugacaguuuacaaauga

SEQ ID NO: 892842 - RNA, 19 nt, Homo sapiens
gaguuacacuggaagaaga

SEQ ID NO: 892843 - RNA, 19 nt, Homo sapiens
ggaguagccauucuauauu

SEQ ID NO: 892844 - RNA, 19 nt, Homo sapiens
guuuggagcccacauauuu

SEQ ID NO: 892845 - RNA, 19 nt, Homo sapiens
caacuuccgugaugugauc

SEQ ID NO: 892846 - RNA, 19 nt, Homo sapiens
gaagaucacgggaauuaca

SEQ ID NO: 892847 - RNA, 19 nt, Homo sapiens
acagaaagccugccaaugu

SEQ ID NO: 892848 - RNA, 19 nt, Homo sapiens
gagaguggauggccaaguc

SEQ ID NO: 892849 - RNA, 19 nt, Homo sapiens
ucaggaaguuacccuauau

SEQ ID NO: 892850 - RNA, 19 nt, Homo sapiens
aaacagcucucccucucuu

SEQ ID NO: 892851 - RNA, 19 nt, Homo sapiens
caaagugggagcccgauaa

SEQ ID NO: 892852 - RNA, 19 nt, Homo sapiens
ucaaagaggcuccagaaau

SEQ ID NO: 892853 - RNA, 19 nt, Homo sapiens
gaggugacacagaguauuu

SEQ ID NO: 892854 - RNA, 19 nt, Homo sapiens
ccacuucaguuuauaccuu

SEQ ID NO: 892855 - RNA, 19 nt, Homo sapiens
gcacaagucauaccuacau

SEQ ID NO: 892856 - RNA, 19 nt, Homo sapiens
aaauuaagccuuccugcua

SEQ ID NO: 892857 - RNA, 19 nt, Homo sapiens
gauccucacucaacucaca

SEQ ID NO: 892858 - RNA, 19 nt, Homo sapiens
ccacaugugucaagucagu

SEQ ID NO: 892859 - RNA, 19 nt, Homo sapiens
gaaauguagcaagcacuua

SEQ ID NO: 892860 - RNA, 19 nt, Homo sapiens
guuuauaccuugccuguag

SEQ ID NO: 892861 - RNA, 19 nt, Homo sapiens
aagcaaggcacaagucaua

SEQ ID NO: 892862 - RNA, 19 nt, Homo sapiens
gaagacacagcaagugaga

SEQ ID NO: 892863 - RNA, 19 nt, Homo sapiens
uaaaagagcagguuaagaa

SEQ ID NO: 892864 - RNA, 19 nt, Homo sapiens
ccagcaccgugacaguuua

SEQ ID NO: 892865 - RNA, 19 nt, Homo sapiens
gaggugagagugcuagaaa

SEQ ID NO: 892866 - RNA, 19 nt, Homo sapiens
aaacccaacuuccgugaug

SEQ ID NO: 892867 - RNA, 19 nt, Homo sapiens
ggucucgucugacuccaaa

SEQ ID NO: 892868 - RNA, 19 nt, Homo sapiens
cacaacaaaucucuaaauc

SEQ ID NO: 892869 - RNA, 19 nt, Homo sapiens
agugggagcccgauaaaua

SEQ ID NO: 892870 - RNA, 19 nt, Homo sapiens
ccugaaguaugaucacaaa

SEQ ID NO: 892871 - RNA, 19 nt, Homo sapiens
gagcuggcauccccauuua

SEQ ID NO: 892872 - RNA, 19 nt, Homo sapiens
cacaaggaaucaauugaga

SEQ ID NO: 892873 - RNA, 19 nt, Homo sapiens
ggagaggugacacagagua

SEQ ID NO: 892874 - RNA, 19 nt, Homo sapiens
ggccaaugcuacuuucaga

SEQ ID NO: 892875 - RNA, 19 nt, Homo sapiens
aggauaaacugcagagaga

SEQ ID NO: 892876 - RNA, 19 nt, Homo sapiens
cauccuacguuacuauuca

SEQ ID NO: 892877 - RNA, 19 nt, Homo sapiens
gcucucaccacuucaguuu

SEQ ID NO: 892878 - RNA, 19 nt, Homo sapiens
guagcaagcacuuauuguu

SEQ ID NO: 892879 - RNA, 19 nt, Homo sapiens
ccaaagugcugggauuaca

SEQ ID NO: 892880 - RNA, 19 nt, Homo sapiens
aggaaucaauugagagaaa

SEQ ID NO: 892881 - RNA, 19 nt, Homo sapiens
caagauacacgucacaaag

SEQ ID NO: 892882 - RNA, 19 nt, Homo sapiens
ucaauuccaucagcacaaa

SEQ ID NO: 892883 - RNA, 19 nt, Homo sapiens
ucucaccacuucaguuuau

SEQ ID NO: 892884 - RNA, 19 nt, Homo sapiens
cagagagacaacagauuua

SEQ ID NO: 892885 - RNA, 19 nt, Homo sapiens
cagaaauguuugcugaguu

SEQ ID NO: 892886 - RNA, 19 nt, Homo sapiens
gaagaagacacagcaagug

SEQ ID NO: 892887 - RNA, 19 nt, Homo sapiens
gcacauccuacguuacuau

SEQ ID NO: 892888 - RNA, 19 nt, Homo sapiens
aauuaagccuuccugcuaa

SEQ ID NO: 892889 - RNA, 19 nt, Homo sapiens
gugacauccugaaguauga

SEQ ID NO: 892890 - RNA, 19 nt, Homo sapiens
ggacagcaauuuggaacag

SEQ ID NO: 892891 - RNA, 19 nt, Homo sapiens
uggaguagccauucuauau

SEQ ID NO: 892892 - RNA, 19 nt, Homo sapiens
cuggaaaacucaugaauaa

SEQ ID NO: 892893 - RNA, 19 nt, Homo sapiens
cagaggcguuugaaucaga

SEQ ID NO: 892894 - RNA, 19 nt, Homo sapiens
gccaagagcagcugccauu

SEQ ID NO: 892895 - RNA, 19 nt, Homo sapiens
gcccacaugugucaaguca

SEQ ID NO: 892896 - RNA, 19 nt, Homo sapiens
ggccuggucuugcagaaau

SEQ ID NO: 892897 - RNA, 19 nt, Homo sapiens
uuaauugcauucagaagug

SEQ ID NO: 892898 - RNA, 19 nt, Homo sapiens
aagagcagguuaagaacuu

SEQ ID NO: 892899 - RNA, 19 nt, Homo sapiens
ccaguuucaugucuuguga

SEQ ID NO: 892900 - RNA, 19 nt, Homo sapiens
ugaaguaugaucacaaaug

SEQ ID NO: 892901 - RNA, 19 nt, Homo sapiens
cuucguauaugaaauguuc

SEQ ID NO: 892902 - RNA, 19 nt, Homo sapiens
gcaccuggccucaaacaag

SEQ ID NO: 892903 - RNA, 19 nt, Homo sapiens
caccaugccaggcuaauuu

SEQ ID NO: 892904 - RNA, 19 nt, Homo sapiens
caaggaaucaauugagaga

SEQ ID NO: 892905 - RNA, 19 nt, Homo sapiens
ggacacaucaggaaguuac

SEQ ID NO: 892906 - RNA, 19 nt, Homo sapiens
ccucacugcugauuauuca

SEQ ID NO: 892907 - RNA, 19 nt, Homo sapiens
gaagaaagcucagaguuga

SEQ ID NO: 892908 - RNA, 19 nt, Homo sapiens
caauguagcugaaauaaga

SEQ ID NO: 892909 - RNA, 19 nt, Homo sapiens
caacaaaucucuaaaucga

SEQ ID NO: 892910 - RNA, 19 nt, Homo sapiens
gauggaggcugaaauuaaa

SEQ ID NO: 892911 - RNA, 19 nt, Homo sapiens
gaacccaggucucgucuga

SEQ ID NO: 892912 - RNA, 19 nt, Homo sapiens
gaagaggacuuagugagaa

SEQ ID NO: 892913 - RNA, 19 nt, Homo sapiens
gcaggucccuauagcauaa

SEQ ID NO: 892914 - RNA, 19 nt, Homo sapiens
gcagagagacaacagauuu

SEQ ID NO: 892915 - RNA, 19 nt, Homo sapiens
gaauuuggcucuucugaca

SEQ ID NO: 892916 - RNA, 19 nt, Homo sapiens
gcacgugccugucucauuc

SEQ ID NO: 892917 - RNA, 19 nt, Homo sapiens
ucagauacuucuugguuua

SEQ ID NO: 892918 - RNA, 19 nt, Homo sapiens
aaacaaagguacgguaauu

SEQ ID NO: 892919 - RNA, 19 nt, Homo sapiens
gagaccagcugcucuagaa

SEQ ID NO: 892920 - RNA, 19 nt, Homo sapiens
cagaaagccugccaaugua

SEQ ID NO: 892921 - RNA, 19 nt, Homo sapiens
guacgguaauuucuucaua

SEQ ID NO: 892922 - RNA, 19 nt, Homo sapiens
ggaauagggucuccucugu

SEQ ID NO: 892923 - RNA, 19 nt, Homo sapiens
aaagauggauggcuguuaa

SEQ ID NO: 892924 - RNA, 19 nt, Homo sapiens
caaaaggccuuacaaauau

SEQ ID NO: 892925 - RNA, 19 nt, Homo sapiens
gcaccaggccucauaacua

SEQ ID NO: 892926 - RNA, 19 nt, Homo sapiens
guacacagcugagcaaucu

SEQ ID NO: 892927 - RNA, 19 nt, Homo sapiens
gaucugaguugagaccuuu

SEQ ID NO: 892928 - RNA, 19 nt, Homo sapiens
gcagaaaggacguggauga

SEQ ID NO: 892929 - RNA, 19 nt, Homo sapiens
ucaaauaucugugccaugu

SEQ ID NO: 892930 - RNA, 19 nt, Homo sapiens
cuacacaccugcaaucaga

SEQ ID NO: 892931 - RNA, 19 nt, Homo sapiens
aaucuagucugguggauaa

SEQ ID NO: 892932 - RNA, 19 nt, Homo sapiens
ccaaaaggccuuacaaaua

SEQ ID NO: 892933 - RNA, 19 nt, Homo sapiens
agagaaagauccucacuca

SEQ ID NO: 892934 - RNA, 19 nt, Homo sapiens
ccaaguagcugggauuaca

SEQ ID NO: 892935 - RNA, 19 nt, Homo sapiens
gaguugagaccuuugauuu

SEQ ID NO: 892936 - RNA, 19 nt, Homo sapiens
gugaguauguguaugugua

SEQ ID NO: 892937 - RNA, 19 nt, Homo sapiens
gaguugagaccuuugauuu

SEQ ID NO: 892938 - RNA, 19 nt, Homo sapiens
gcacaacaaaucucuaaau

SEQ ID NO: 892939 - RNA, 19 nt, Homo sapiens
ggaagaggacuuagugaga

SEQ ID NO: 892940 - RNA, 19 nt, Homo sapiens
gaaagauccucacucaacu

SEQ ID NO: 892941 - RNA, 19 nt, Homo sapiens
caagauggaggcugaaauu

SEQ ID NO: 892942 - RNA, 19 nt, Homo sapiens
gcauguauguguaagaucu

SEQ ID NO: 892943 - RNA, 19 nt, Homo sapiens
acagaaagccugccaaugu

SEQ ID NO: 892944 - RNA, 19 nt, Homo sapiens
gagaguggauggccaaguc

SEQ ID NO: 892945 - RNA, 19 nt, Homo sapiens
ccagcuaacauacuauaua

SEQ ID NO: 892946 - RNA, 19 nt, Homo sapiens
gcacacacuuccauauguc

SEQ ID NO: 892947 - RNA, 19 nt, Homo sapiens
cagcuaacacacuuuauaa

SEQ ID NO: 892948 - RNA, 19 nt, Homo sapiens
caaagugggagcccgauaa

SEQ ID NO: 892949 - RNA, 19 nt, Homo sapiens
gaggugacacagaguauuu

SEQ ID NO: 892950 - RNA, 19 nt, Homo sapiens
gcaaagggguugaggaaug

SEQ ID NO: 892951 - RNA, 19 nt, Homo sapiens
gcacaagucauaccuacau

SEQ ID NO: 892952 - RNA, 19 nt, Homo sapiens
ccacaugugucaagucagu

SEQ ID NO: 892953 - RNA, 19 nt, Homo sapiens
gaaauguagcaagcacuua

SEQ ID NO: 892954 - RNA, 19 nt, Homo sapiens
gauccucacucaacucaca

SEQ ID NO: 892955 - RNA, 19 nt, Homo sapiens
uguaagaucugaguugaga

SEQ ID NO: 892956 - RNA, 19 nt, Homo sapiens
ccagcuaacacacuuuaua

SEQ ID NO: 892957 - RNA, 19 nt, Homo sapiens
aagcaaggcacaagucaua

SEQ ID NO: 892958 - RNA, 19 nt, Homo sapiens
uaaaagagcagguuaagaa

SEQ ID NO: 892959 - RNA, 19 nt, Homo sapiens
cacaacaaaucucuaaauc

SEQ ID NO: 892960 - RNA, 19 nt, Homo sapiens
ggucucgucugacuccaaa

SEQ ID NO: 892961 - RNA, 19 nt, Homo sapiens
ucacaggacuauggacuug

SEQ ID NO: 892962 - RNA, 19 nt, Homo sapiens
ugaugaaccuggcaaguca

SEQ ID NO: 892963 - RNA, 19 nt, Homo sapiens
agugggagcccgauaaaua

SEQ ID NO: 892964 - RNA, 19 nt, Homo sapiens
gagcuggcauccccauuua

SEQ ID NO: 892965 - RNA, 19 nt, Homo sapiens
cacaaggaaucaauugaga

SEQ ID NO: 892966 - RNA, 19 nt, Homo sapiens
ggagaggugacacagagua

SEQ ID NO: 892967 - RNA, 19 nt, Homo sapiens
aggauaaacugcagagaga

SEQ ID NO: 892968 - RNA, 19 nt, Homo sapiens
guagcaagcacuuauuguu

SEQ ID NO: 892969 - RNA, 19 nt, Homo sapiens
ccaaagugcugggauuaca

SEQ ID NO: 892970 - RNA, 19 nt, Homo sapiens
aggaaucaauugagagaaa

SEQ ID NO: 892971 - RNA, 19 nt, Homo sapiens
cagagagacaacagauuua

SEQ ID NO: 892972 - RNA, 19 nt, Homo sapiens
ggacagcaauuuggaacag

SEQ ID NO: 892973 - RNA, 19 nt, Homo sapiens
gccaagagcagcugccauu

SEQ ID NO: 892974 - RNA, 19 nt, Homo sapiens
gcccacaugugucaaguca

SEQ ID NO: 892975 - RNA, 19 nt, Homo sapiens
ggccuggucuugcagaaau

SEQ ID NO: 892976 - RNA, 19 nt, Homo sapiens
uuaauugcauucagaagug

SEQ ID NO: 892977 - RNA, 19 nt, Homo sapiens
aagagcagguuaagaacuu

SEQ ID NO: 892978 - RNA, 19 nt, Homo sapiens
ccaguuucaugucuuguga

SEQ ID NO: 892979 - RNA, 19 nt, Homo sapiens
gcaaaggaugcgugaguau

SEQ ID NO: 892980 - RNA, 19 nt, Homo sapiens
cuucguauaugaaauguuc

SEQ ID NO: 892981 - RNA, 19 nt, Homo sapiens
gcaccuggccucaaacaag

SEQ ID NO: 892982 - RNA, 19 nt, Homo sapiens
caccaugccaggcuaauuu

SEQ ID NO: 892983 - RNA, 19 nt, Homo sapiens
caaggaaucaauugagaga

SEQ ID NO: 892984 - RNA, 19 nt, Homo sapiens
gaaaguccagcuaacauac

SEQ ID NO: 892985 - RNA, 19 nt, Homo sapiens
agaaaguccagcuaacaua

SEQ ID NO: 892986 - RNA, 19 nt, Homo sapiens
ggcuggaguugcugaauug

SEQ ID NO: 892987 - RNA, 19 nt, Homo sapiens
uuccauaugucauugcuaa

SEQ ID NO: 892988 - RNA, 19 nt, Homo sapiens
aggcugaaauuaaagagaa

SEQ ID NO: 892989 - RNA, 19 nt, Homo sapiens
gcccagagaguccagcuaa

SEQ ID NO: 892990 - RNA, 19 nt, Homo sapiens
cuggacugcuguuuguuua

SEQ ID NO: 892991 - RNA, 19 nt, Homo sapiens
ggucuccucuguccucugu

SEQ ID NO: 892992 - RNA, 19 nt, Homo sapiens
caacagaaagccugccaau

SEQ ID NO: 892993 - RNA, 19 nt, Homo sapiens
caccgcaccuggccucaaa

SEQ ID NO: 892994 - RNA, 19 nt, Homo sapiens
uauguugcauguaugugua

SEQ ID NO: 892995 - RNA, 19 nt, Homo sapiens
ucccugaacuguugguauu

SEQ ID NO: 892996 - RNA, 19 nt, Homo sapiens
ggaggggaguuauaauauu

SEQ ID NO: 892997 - RNA, 19 nt, Homo sapiens
agaagaaagcucagaguug

SEQ ID NO: 892998 - RNA, 19 nt, Homo sapiens
agauggaggcugaaauuaa

SEQ ID NO: 892999 - RNA, 19 nt, Homo sapiens
gcaaucagaaacagaaagu

SEQ ID NO: 893000 - RNA, 19 nt, Homo sapiens
ccugaacuguugguauuaa

SEQ ID NO: 893001 - RNA, 19 nt, Homo sapiens
ggugaaaacucagaagaaa

SEQ ID NO: 893002 - RNA, 19 nt, Homo sapiens
gucagcaccuuguuggauu

SEQ ID NO: 893003 - RNA, 19 nt, Homo sapiens
aaucuuaaguggacagcaa

SEQ ID NO: 893004 - RNA, 19 nt, Homo sapiens
uaaagauggauggcuguua

SEQ ID NO: 893005 - RNA, 19 nt, Homo sapiens
gaaucuagucugguggaua

SEQ ID NO: 893006 - RNA, 19 nt, Homo sapiens
ucacagaggagcagaaugg

SEQ ID NO: 893007 - RNA, 19 nt, Homo sapiens
gaagaaagcucagaguuga

SEQ ID NO: 893008 - RNA, 19 nt, Homo sapiens
ggaagagggagaauauuua

SEQ ID NO: 893009 - RNA, 19 nt, Homo sapiens
gcaggucccuauagcauaa

SEQ ID NO: 893010 - RNA, 19 nt, Homo sapiens
gcagagagacaacagauuu

SEQ ID NO: 893011 - RNA, 19 nt, Homo sapiens
gaauuuggcucuucugaca

SEQ ID NO: 893012 - RNA, 19 nt, Homo sapiens
gcacgugccugucucauuc

SEQ ID NO: 893013 - RNA, 19 nt, Homo sapiens
aaacaaagguacgguaauu

SEQ ID NO: 893014 - RNA, 19 nt, Homo sapiens
uaaugaagaucaacaguga

SEQ ID NO: 893015 - RNA, 19 nt, Homo sapiens
guacgguaauuucuucaua

SEQ ID NO: 893016 - RNA, 19 nt, Homo sapiens
aaagauggauggcuguuaa

SEQ ID NO: 893017 - RNA, 19 nt, Homo sapiens
gaucaacagugaagaggaa

SEQ ID NO: 893018 - RNA, 19 nt, Homo sapiens
caaaaggccuuacaaauau

SEQ ID NO: 893019 - RNA, 19 nt, Homo sapiens
gaaagagggaguuaaucua

SEQ ID NO: 893020 - RNA, 19 nt, Homo sapiens
gcaaagacauuuaguaacc

SEQ ID NO: 893021 - RNA, 19 nt, Homo sapiens
guacacagcugagcaaucu

SEQ ID NO: 893022 - RNA, 19 nt, Homo sapiens
gcagaaagcaaagacauuu

SEQ ID NO: 893023 - RNA, 19 nt, Homo sapiens
gaucugaguugagaccuuu

SEQ ID NO: 893024 - RNA, 19 nt, Homo sapiens
gcagaaaggacguggauga

SEQ ID NO: 893025 - RNA, 19 nt, Homo sapiens
aaucuagucugguggauaa

SEQ ID NO: 893026 - RNA, 19 nt, Homo sapiens
ccaaaaggccuuacaaaua

SEQ ID NO: 893027 - RNA, 19 nt, Homo sapiens
cuggaacgcuucagucaua

SEQ ID NO: 893028 - RNA, 19 nt, Homo sapiens
gggaguuaaucuauaauga

SEQ ID NO: 893029 - RNA, 19 nt, Homo sapiens
agagggaguuaaucuauaa

SEQ ID NO: 893030 - RNA, 19 nt, Homo sapiens
gcucugugcuuauaucuca

SEQ ID NO: 893031 - RNA, 19 nt, Homo sapiens
caagagauccucccacuuc

SEQ ID NO: 893032 - RNA, 19 nt, Homo sapiens
uuuaaucggucucacuuua

SEQ ID NO: 893033 - RNA, 19 nt, Homo sapiens
gaguugagaccuuugauuu

SEQ ID NO: 893034 - RNA, 19 nt, Homo sapiens
gugaguauguguaugugua

SEQ ID NO: 893035 - RNA, 19 nt, Homo sapiens
gaguugagaccuuugauuu

SEQ ID NO: 893036 - RNA, 19 nt, Homo sapiens
caucugcucugugcuuaua

SEQ ID NO: 893037 - RNA, 19 nt, Homo sapiens
gcagcuaagacuacaguua

SEQ ID NO: 893038 - RNA, 19 nt, Homo sapiens
gaacaucugcucugugcuu

SEQ ID NO: 893039 - RNA, 19 nt, Homo sapiens
gcaguuaguccuucccuuu

SEQ ID NO: 893040 - RNA, 19 nt, Homo sapiens
ggaauggccaucugagaaa

SEQ ID NO: 893041 - RNA, 19 nt, Homo sapiens
gcagacaaccacacaaaga

SEQ ID NO: 893042 - RNA, 19 nt, Homo sapiens
augcaaggcugguuuauga

SEQ ID NO: 893043 - RNA, 19 nt, Homo sapiens
guuaaagucuugcuuacau

SEQ ID NO: 893044 - RNA, 19 nt, Homo sapiens
uaacaggcauuccuugaag

SEQ ID NO: 893045 - RNA, 19 nt, Homo sapiens
ggaaagagggaguuaaucu

SEQ ID NO: 893046 - RNA, 19 nt, Homo sapiens
gcauguauguguaagaucu

SEQ ID NO: 893047 - RNA, 19 nt, Homo sapiens
ggagguaugugugggagaa

SEQ ID NO: 893048 - RNA, 19 nt, Homo sapiens
ccagcuaacauacuauaua

SEQ ID NO: 893049 - RNA, 19 nt, Homo sapiens
gcacacacuuccauauguc

SEQ ID NO: 893050 - RNA, 19 nt, Homo sapiens
cagcuaacacacuuuauaa

SEQ ID NO: 893051 - RNA, 19 nt, Homo sapiens
caaagugggagcccgauaa

SEQ ID NO: 893052 - RNA, 19 nt, Homo sapiens
aaacacagacucuaggaaa

SEQ ID NO: 893053 - RNA, 19 nt, Homo sapiens
gcaaagggguugaggaaug

SEQ ID NO: 893054 - RNA, 19 nt, Homo sapiens
gcacaagucauaccuacau

SEQ ID NO: 893055 - RNA, 19 nt, Homo sapiens
uaaucggucucacuuuauu

SEQ ID NO: 893056 - RNA, 19 nt, Homo sapiens
uguaagaucugaguugaga

SEQ ID NO: 893057 - RNA, 19 nt, Homo sapiens
ccagcuaacacacuuuaua

SEQ ID NO: 893058 - RNA, 19 nt, Homo sapiens
aagcaaggcacaagucaua

SEQ ID NO: 893059 - RNA, 19 nt, Homo sapiens
gcccugaaguuaaaaguua

SEQ ID NO: 893060 - RNA, 19 nt, Homo sapiens
ggagaagauuccagaaggu

SEQ ID NO: 893061 - RNA, 19 nt, Homo sapiens
aagagggaguuaaucuaua

SEQ ID NO: 893062 - RNA, 19 nt, Homo sapiens
uuaguaaccuuguagaaca

SEQ ID NO: 893063 - RNA, 19 nt, Homo sapiens
ucacaggacuauggacuug

SEQ ID NO: 893064 - RNA, 19 nt, Homo sapiens
ugaugaaccuggcaaguca

SEQ ID NO: 893065 - RNA, 19 nt, Homo sapiens
agugggagcccgauaaaua

SEQ ID NO: 893066 - RNA, 19 nt, Homo sapiens
gaggaaagagggaguuaau

SEQ ID NO: 893067 - RNA, 19 nt, Homo sapiens
aggauaaacugcagagaga

SEQ ID NO: 893068 - RNA, 19 nt, Homo sapiens
caaaugcucaucugacuuc

SEQ ID NO: 893069 - RNA, 19 nt, Homo sapiens
uaauggaccuguguaagga

SEQ ID NO: 893070 - RNA, 19 nt, Homo sapiens
gggaauggccaucugagaa

SEQ ID NO: 893071 - RNA, 19 nt, Homo sapiens
ugucucagcuucucaaagu

SEQ ID NO: 893072 - RNA, 19 nt, Homo sapiens
cagagagacaacagauuua

SEQ ID NO: 893073 - RNA, 19 nt, Homo sapiens
gcuaagacuacaguuauuu

SEQ ID NO: 893074 - RNA, 19 nt, Homo sapiens
cagcuaagacuacaguuau

SEQ ID NO: 893075 - RNA, 19 nt, Homo sapiens
gacauuuaguaaccuugua

SEQ ID NO: 893076 - RNA, 19 nt, Homo sapiens
cagaaagcaaagacauuua

SEQ ID NO: 893077 - RNA, 19 nt, Homo sapiens
gaauggaccuuuuccuuuc

SEQ ID NO: 893078 - RNA, 19 nt, Homo sapiens
gccaagagcagcugccauu

SEQ ID NO: 893079 - RNA, 19 nt, Homo sapiens
gcaaaggaugcgugaguau

SEQ ID NO: 893080 - RNA, 19 nt, Homo sapiens
gaagagggagaauauuuac

SEQ ID NO: 893081 - RNA, 19 nt, Homo sapiens
acaaugugauggucaugaa

SEQ ID NO: 893082 - RNA, 19 nt, Homo sapiens
caaggcugguuuaugaguu

SEQ ID NO: 893083 - RNA, 19 nt, Homo sapiens
gaaaguccagcuaacauac

SEQ ID NO: 893084 - RNA, 19 nt, Homo sapiens
agaaaguccagcuaacaua

SEQ ID NO: 893085 - RNA, 19 nt, Homo sapiens
ggcuggaguugcugaauug

SEQ ID NO: 893086 - RNA, 19 nt, Homo sapiens
uuccauaugucauugcuaa

SEQ ID NO: 893087 - RNA, 19 nt, Homo sapiens
gcccagagaguccagcuaa

SEQ ID NO: 893088 - RNA, 19 nt, Homo sapiens
gcaaucacggcucacugua

SEQ ID NO: 893089 - RNA, 19 nt, Homo sapiens
aaagagggaguuaaucuau

SEQ ID NO: 893090 - RNA, 19 nt, Homo sapiens
guuuaugaguuacaaccua

SEQ ID NO: 893091 - RNA, 19 nt, Homo sapiens
aaggcugguuuaugaguua

SEQ ID NO: 893092 - RNA, 19 nt, Homo sapiens
gaaacacagacucuaggaa

SEQ ID NO: 893093 - RNA, 19 nt, Homo sapiens
ucaaagugcugggauuaca

SEQ ID NO: 893094 - RNA, 19 nt, Homo sapiens
uauguugcauguaugugua

SEQ ID NO: 893095 - RNA, 19 nt, Homo sapiens
ucccugaacuguugguauu

SEQ ID NO: 893096 - RNA, 19 nt, Homo sapiens
ggauugugcuucagcuaag

SEQ ID NO: 893097 - RNA, 19 nt, Homo sapiens
ggaggggaguuauaauauu

SEQ ID NO: 893098 - RNA, 19 nt, Homo sapiens
agaagaaagcucagaguug

SEQ ID NO: 893099 - RNA, 19 nt, Homo sapiens
gagaggaaagagggaguua

SEQ ID NO: 893100 - RNA, 19 nt, Homo sapiens
uaagugauuucuccugucu

SEQ ID NO: 893101 - RNA, 19 nt, Homo sapiens
ccugaacuguugguauuaa

SEQ ID NO: 893102 - RNA, 19 nt, Homo sapiens
ggugaaaacucagaagaaa

SEQ ID NO: 893103 - RNA, 19 nt, Homo sapiens
caauaauggaccuguguaa

SEQ ID NO: 893104 - RNA, 19 nt, Homo sapiens
gaagaucaacagugaagag

SEQ ID NO: 893105 - RNA, 19 nt, Homo sapiens
cuccugggcuuaagugauu

SEQ ID NO: 893106 - RNA, 19 nt, Homo sapiens
cagcacccauaguagaauu

SEQ ID NO: 893107 - RNA, 19 nt, Homo sapiens
caacaaaucucuaaaucga

SEQ ID NO: 893108 - RNA, 19 nt, Homo sapiens
gauggaggcugaaauuaaa

SEQ ID NO: 893109 - RNA, 19 nt, Homo sapiens
gaagaggacuuagugagaa

SEQ ID NO: 893110 - RNA, 19 nt, Homo sapiens
gcagagagacaacagauuu

SEQ ID NO: 893111 - RNA, 19 nt, Homo sapiens
gcacgugccugucucauuc

SEQ ID NO: 893112 - RNA, 19 nt, Homo sapiens
ucagauacuucuugguuua

SEQ ID NO: 893113 - RNA, 19 nt, Homo sapiens
uaaugaagaucaacaguga

SEQ ID NO: 893114 - RNA, 19 nt, Homo sapiens
gaucaacagugaagaggaa

SEQ ID NO: 893115 - RNA, 19 nt, Homo sapiens
gaaagagggaguuaaucua

SEQ ID NO: 893116 - RNA, 19 nt, Homo sapiens
gcaaagacauuuaguaacc

SEQ ID NO: 893117 - RNA, 19 nt, Homo sapiens
gcagaaagcaaagacauuu

SEQ ID NO: 893118 - RNA, 19 nt, Homo sapiens
gcagaaaggacguggauga

SEQ ID NO: 893119 - RNA, 19 nt, Homo sapiens
ggacagcagugguuagaag

SEQ ID NO: 893120 - RNA, 19 nt, Homo sapiens
cuacacaccugcaaucaga

SEQ ID NO: 893121 - RNA, 19 nt, Homo sapiens
agagaaagauccucacuca

SEQ ID NO: 893122 - RNA, 19 nt, Homo sapiens
cuggaacgcuucagucaua

SEQ ID NO: 893123 - RNA, 19 nt, Homo sapiens
gggaguuaaucuauaauga

SEQ ID NO: 893124 - RNA, 19 nt, Homo sapiens
agagggaguuaaucuauaa

SEQ ID NO: 893125 - RNA, 19 nt, Homo sapiens
caagagauccucccacuuc

SEQ ID NO: 893126 - RNA, 19 nt, Homo sapiens
uuuaaucggucucacuuua

SEQ ID NO: 893127 - RNA, 19 nt, Homo sapiens
ggaagaggacuuagugaga

SEQ ID NO: 893128 - RNA, 19 nt, Homo sapiens
gaaagauccucacucaacu

SEQ ID NO: 893129 - RNA, 19 nt, Homo sapiens
gcacaacaaaucucuaaau

SEQ ID NO: 893130 - RNA, 19 nt, Homo sapiens
gcaguuaguccuucccuuu

SEQ ID NO: 893131 - RNA, 19 nt, Homo sapiens
caagauggaggcugaaauu

SEQ ID NO: 893132 - RNA, 19 nt, Homo sapiens
ggaauggccaucugagaaa

SEQ ID NO: 893133 - RNA, 19 nt, Homo sapiens
augcaaggcugguuuauga

SEQ ID NO: 893134 - RNA, 19 nt, Homo sapiens
guuaaagucuugcuuacau

SEQ ID NO: 893135 - RNA, 19 nt, Homo sapiens
uaacaggcauuccuugaag

SEQ ID NO: 893136 - RNA, 19 nt, Homo sapiens
ggaaagagggaguuaaucu

SEQ ID NO: 893137 - RNA, 19 nt, Homo sapiens
gagaguggauggccaaguc

SEQ ID NO: 893138 - RNA, 19 nt, Homo sapiens
ggagguaugugugggagaa

SEQ ID NO: 893139 - RNA, 19 nt, Homo sapiens
caaagugggagcccgauaa

SEQ ID NO: 893140 - RNA, 19 nt, Homo sapiens
aaacacagacucuaggaaa

SEQ ID NO: 893141 - RNA, 19 nt, Homo sapiens
ggacagagggagagaauac

SEQ ID NO: 893142 - RNA, 19 nt, Homo sapiens
gcacaagucauaccuacau

SEQ ID NO: 893143 - RNA, 19 nt, Homo sapiens
gauccucacucaacucaca

SEQ ID NO: 893144 - RNA, 19 nt, Homo sapiens
uaaucggucucacuuuauu

SEQ ID NO: 893145 - RNA, 19 nt, Homo sapiens
aagcaaggcacaagucaua

SEQ ID NO: 893146 - RNA, 19 nt, Homo sapiens
gcccugaaguuaaaaguua

SEQ ID NO: 893147 - RNA, 19 nt, Homo sapiens
cacaacaaaucucuaaauc

SEQ ID NO: 893148 - RNA, 19 nt, Homo sapiens
ggagaagauuccagaaggu

SEQ ID NO: 893149 - RNA, 19 nt, Homo sapiens
aagagggaguuaaucuaua

SEQ ID NO: 893150 - RNA, 19 nt, Homo sapiens
uuaguaaccuuguagaaca

SEQ ID NO: 893151 - RNA, 19 nt, Homo sapiens
agugggagcccgauaaaua

SEQ ID NO: 893152 - RNA, 19 nt, Homo sapiens
gaggaaagagggaguuaau

SEQ ID NO: 893153 - RNA, 19 nt, Homo sapiens
aggauaaacugcagagaga

SEQ ID NO: 893154 - RNA, 19 nt, Homo sapiens
uaauggaccuguguaagga

SEQ ID NO: 893155 - RNA, 19 nt, Homo sapiens
gggaauggccaucugagaa

SEQ ID NO: 893156 - RNA, 19 nt, Homo sapiens
ugucucagcuucucaaagu

SEQ ID NO: 893157 - RNA, 19 nt, Homo sapiens
acauguauaucucgaguga

SEQ ID NO: 893158 - RNA, 19 nt, Homo sapiens
cagagagacaacagauuua

SEQ ID NO: 893159 - RNA, 19 nt, Homo sapiens
cuacagacauguccuuaac

SEQ ID NO: 893160 - RNA, 19 nt, Homo sapiens
gaauggaccuuuuccuuuc

SEQ ID NO: 893161 - RNA, 19 nt, Homo sapiens
gacauuuaguaaccuugua

SEQ ID NO: 893162 - RNA, 19 nt, Homo sapiens
cagaaagcaaagacauuua

SEQ ID NO: 893163 - RNA, 19 nt, Homo sapiens
gccaagagcagcugccauu

SEQ ID NO: 893164 - RNA, 19 nt, Homo sapiens
acaaugugauggucaugaa

SEQ ID NO: 893165 - RNA, 19 nt, Homo sapiens
caaggcugguuuaugaguu

SEQ ID NO: 893166 - RNA, 19 nt, Homo sapiens
aggcugaaauuaaagagaa

SEQ ID NO: 893167 - RNA, 19 nt, Homo sapiens
gcaaucacggcucacugua

SEQ ID NO: 893168 - RNA, 19 nt, Homo sapiens
aaagagggaguuaaucuau

SEQ ID NO: 893169 - RNA, 19 nt, Homo sapiens
guuuaugaguuacaaccua

SEQ ID NO: 893170 - RNA, 19 nt, Homo sapiens
aaggcugguuuaugaguua

SEQ ID NO: 893171 - RNA, 19 nt, Homo sapiens
gaaacacagacucuaggaa

SEQ ID NO: 893172 - RNA, 19 nt, Homo sapiens
ucaaagugcugggauuaca

SEQ ID NO: 893173 - RNA, 19 nt, Homo sapiens
guauaucucgagugaguaa

SEQ ID NO: 893174 - RNA, 19 nt, Homo sapiens
gcaaucagaaacagaaagu

SEQ ID NO: 893175 - RNA, 19 nt, Homo sapiens
agauggaggcugaaauuaa

SEQ ID NO: 893176 - RNA, 19 nt, Homo sapiens
gagaggaaagagggaguua

SEQ ID NO: 893177 - RNA, 19 nt, Homo sapiens
uaagugauuucuccugucu

SEQ ID NO: 893178 - RNA, 19 nt, Homo sapiens
ggauugugcuucagcuaag

SEQ ID NO: 893179 - RNA, 19 nt, Homo sapiens
caauaauggaccuguguaa

SEQ ID NO: 893180 - RNA, 19 nt, Homo sapiens
gaagaucaacagugaagag

SEQ ID NO: 893181 - RNA, 19 nt, Homo sapiens
cuccugggcuuaagugauu

SEQ ID NO: 893182 - RNA, 19 nt, Homo sapiens
cagcacccauaguagaauu

SEQ ID NO: 893183 - RNA, 19 nt, Homo sapiens
caccguagcucuggaaucu

SEQ ID NO: 893184 - RNA, 19 nt, Homo sapiens
ucacagaggagcagaaugg

SEQ ID NO: 893185 - RNA, 19 nt, Homo sapiens
gggauugugcuucagcuaa

SEQ ID NO: 893186 - RNA, 19 nt, Homo sapiens
ggaacgcuucagucauaua

SEQ ID NO: 893187 - RNA, 19 nt, Homo sapiens
guaauugaaaggaucagaa

SEQ ID NO: 893188 - RNA, 19 nt, Homo sapiens
caagucauaccuacauuca

SEQ ID NO: 893189 - RNA, 19 nt, Homo sapiens
gaguguguguggagccaaa

SEQ ID NO: 893190 - RNA, 19 nt, Homo sapiens
ugugaacucucggcuguuu

SEQ ID NO: 893191 - RNA, 19 nt, Homo sapiens
gggcagcacccauaguaga

SEQ ID NO: 893192 - RNA, 19 nt, Homo sapiens
ggucagcccugugcuuuac

SEQ ID NO: 893193 - RNA, 19 nt, Homo sapiens
cgagugaguaaauguguaa

SEQ ID NO: 893194 - RNA, 19 nt, Homo sapiens
agucauaccuacauucaag

SEQ ID NO: 893195 - RNA, 19 nt, Homo sapiens
guaaccuuguagaacauuu

SEQ ID NO: 893196 - RNA, 19 nt, Homo sapiens
gaaagcaaagacauuuagu

SEQ ID NO: 893197 - RNA, 19 nt, Homo sapiens
agaaaugaaaggugacaaa

SEQ ID NO: 893198 - RNA, 19 nt, Homo sapiens
agaaagauccucacucaac

SEQ ID NO: 893199 - RNA, 19 nt, Homo sapiens
gauacuucuugguuuacaa

SEQ ID NO: 893200 - RNA, 19 nt, Homo sapiens
ucagucauauacgacauuu

SEQ ID NO: 893201 - RNA, 19 nt, Homo sapiens
gaacgcuucagucauauac

SEQ ID NO: 893202 - RNA, 19 nt, Homo sapiens
gaacuccugggcuuaagug

SEQ ID NO: 893203 - RNA, 19 nt, Homo sapiens
ucagcuaaguaaaguggaa

SEQ ID NO: 893204 - RNA, 19 nt, Homo sapiens
gggagcccgauaaauauuu

SEQ ID NO: 893205 - RNA, 19 nt, Homo sapiens
ucaguucaccuuccagcua

SEQ ID NO: 893206 - RNA, 19 nt, Homo sapiens
agaaugggaagaggacuua

SEQ ID NO: 893207 - RNA, 19 nt, Homo sapiens
guacaaagauucccucgaa

SEQ ID NO: 893208 - RNA, 19 nt, Homo sapiens
gguuguagcuccauuauuu

SEQ ID NO: 893209 - RNA, 19 nt, Homo sapiens
gaaccugaguuaagugaug

SEQ ID NO: 893210 - RNA, 19 nt, Homo sapiens
gcuagaagaaccugaguua

SEQ ID NO: 893211 - RNA, 19 nt, Homo sapiens
gagcugucuuccagaaaua

SEQ ID NO: 893212 - RNA, 19 nt, Homo sapiens
gagccaaccuaauguggaa

SEQ ID NO: 893213 - RNA, 19 nt, Homo sapiens
agaaauauguucccuccuu

SEQ ID NO: 893214 - RNA, 19 nt, Homo sapiens
gagcagcacucgaccucuu

SEQ ID NO: 893215 - RNA, 19 nt, Homo sapiens
gagagccaccuguuaauau

SEQ ID NO: 893216 - RNA, 19 nt, Homo sapiens
gauccaagcuaccauuugc

SEQ ID NO: 893217 - RNA, 19 nt, Homo sapiens
gcaagauuguggaccuguu

SEQ ID NO: 893218 - RNA, 19 nt, Homo sapiens
agaagaaccugaguuaagu

SEQ ID NO: 893219 - RNA, 19 nt, Homo sapiens
guuggcaugucuacaauga

SEQ ID NO: 893220 - RNA, 19 nt, Homo sapiens
uucaguagguguagacuuu

SEQ ID NO: 893221 - RNA, 19 nt, Homo sapiens
ggccugagccacccacuuu

SEQ ID NO: 893222 - RNA, 19 nt, Homo sapiens
cgagagccaccuguuaaua

SEQ ID NO: 893223 - RNA, 19 nt, Homo sapiens
gcaggaugcccaagaguuc

SEQ ID NO: 893224 - RNA, 19 nt, Homo sapiens
cgagcugucuuccagaaau

SEQ ID NO: 893225 - RNA, 19 nt, Homo sapiens
ccacccacuuugagacgua

SEQ ID NO: 893226 - RNA, 19 nt, Homo sapiens
gagcuagagucggagaaug

SEQ ID NO: 893227 - RNA, 19 nt, Homo sapiens
uagaagaaccugaguuaag

SEQ ID NO: 893228 - RNA, 19 nt, Homo sapiens
cgagaggacagcaagauug

SEQ ID NO: 893229 - RNA, 19 nt, Homo sapiens
ugaccgagccaaccuaaug

SEQ ID NO: 893230 - RNA, 19 nt, Homo sapiens
agagcucacugaagccuuu

SEQ ID NO: 893231 - RNA, 19 nt, Homo sapiens
cuucgggacuucugucuga

SEQ ID NO: 893232 - RNA, 19 nt, Homo sapiens
aaaguugacaguacaaaga

SEQ ID NO: 893233 - RNA, 19 nt, Homo sapiens
caagauuguggaccuguuu

SEQ ID NO: 893234 - RNA, 19 nt, Homo sapiens
gagaggacagcaagauugu

SEQ ID NO: 893235 - RNA, 19 nt, Homo sapiens
gagccuuucuacucugaug

SEQ ID NO: 893236 - RNA, 19 nt, Homo sapiens
gugcuguucuaccaacuga

SEQ ID NO: 893237 - RNA, 19 nt, Homo sapiens
uacaaugacucucgugucu

SEQ ID NO: 893238 - RNA, 19 nt, Homo sapiens
aaccuaauguggaaacguu

SEQ ID NO: 893239 - RNA, 19 nt, Homo sapiens
gaugaccgagccaaccuaa

SEQ ID NO: 893240 - RNA, 19 nt, Homo sapiens
gcaccugugaagcccuuua

SEQ ID NO: 893241 - RNA, 19 nt, Homo sapiens
cgggauuguuucaaccuuu

SEQ ID NO: 893242 - RNA, 19 nt, Homo sapiens
gcgagaggacagcaagauu

SEQ ID NO: 893243 - RNA, 19 nt, Homo sapiens
gaagaaccugaguuaagug

SEQ ID NO: 893244 - RNA, 19 nt, Homo sapiens
gagcggcuacaccuugaaa

SEQ ID NO: 893245 - RNA, 19 nt, Homo sapiens
gaaacacgugcuuccugaa

SEQ ID NO: 893246 - RNA, 19 nt, Homo sapiens
cuacucugaugacaagaug

SEQ ID NO: 893247 - RNA, 19 nt, Homo sapiens
gaugaacggcucaagaaac

SEQ ID NO: 893248 - RNA, 19 nt, Homo sapiens
gcuacgugcuguucuacca

SEQ ID NO: 893249 - RNA, 19 nt, Homo sapiens
ugaguuaagugaugaugac

SEQ ID NO: 893250 - RNA, 19 nt, Homo sapiens
ccucugagccuuucuacuc

SEQ ID NO: 893251 - RNA, 19 nt, Homo sapiens
ccucagagacgucuauuuu

SEQ ID NO: 893252 - RNA, 19 nt, Homo sapiens
gcagcaaggagcgcagaaa

SEQ ID NO: 893253 - RNA, 19 nt, Homo sapiens
agagccaccuguuaauauc

SEQ ID NO: 893254 - RNA, 19 nt, Homo sapiens
cccgagagccaccuguuaa

SEQ ID NO: 893255 - RNA, 19 nt, Homo sapiens
ggauccaagcuaccauuug

SEQ ID NO: 893256 - RNA, 19 nt, Homo sapiens
ucugggcucuggucauguu

SEQ ID NO: 893257 - RNA, 19 nt, Homo sapiens
ggugguuguagcuccauua

SEQ ID NO: 893258 - RNA, 19 nt, Homo sapiens
gaggggcucugcuagaaga

SEQ ID NO: 893259 - RNA, 19 nt, Homo sapiens
caccgauacuugccaaugg

SEQ ID NO: 893260 - RNA, 19 nt, Homo sapiens
gggauccaagcuaccauuu

SEQ ID NO: 893261 - RNA, 19 nt, Homo sapiens
aaacacgugcuuccugaau

SEQ ID NO: 893262 - RNA, 19 nt, Homo sapiens
ccaagccccugcccaugua

SEQ ID NO: 893263 - RNA, 19 nt, Homo sapiens
cugaugaacggcucaagaa

SEQ ID NO: 893264 - RNA, 19 nt, Homo sapiens
guuucaaccuuuucacuaa

SEQ ID NO: 893265 - RNA, 19 nt, Homo sapiens
ccagcaggaugcccaagag

SEQ ID NO: 893266 - RNA, 19 nt, Homo sapiens
cuucugggcucuggucaug

SEQ ID NO: 893267 - RNA, 19 nt, Homo sapiens
uuucuacucugaugacaag

SEQ ID NO: 893268 - RNA, 19 nt, Homo sapiens
gcuguucuaccaacugaug

SEQ ID NO: 893269 - RNA, 19 nt, Homo sapiens
caaagccggaaguccugua

SEQ ID NO: 893270 - RNA, 19 nt, Homo sapiens
gggauuguuucaaccuuuu

SEQ ID NO: 893271 - RNA, 19 nt, Homo sapiens
gcgggauuguuucaaccuu

SEQ ID NO: 893272 - RNA, 19 nt, Homo sapiens
uggagcggcuacaccuuga

SEQ ID NO: 893273 - RNA, 19 nt, Homo sapiens
cuagaagaaccugaguuaa

SEQ ID NO: 893274 - RNA, 19 nt, Homo sapiens
ugaugaacggcucaagaaa

SEQ ID NO: 893275 - RNA, 19 nt, Homo sapiens
uggcaugucuacaaugacu

SEQ ID NO: 893276 - RNA, 19 nt, Homo sapiens
gaccgagccaaccuaaugu

SEQ ID NO: 893277 - RNA, 19 nt, Homo sapiens
uccugaagcuccucaugga

SEQ ID NO: 893278 - RNA, 19 nt, Homo sapiens
cccaagaguuccugaagcu

SEQ ID NO: 893279 - RNA, 19 nt, Homo sapiens
ccacuauggccacuacaca

SEQ ID NO: 893280 - RNA, 19 nt, Homo sapiens
aaccugaguuaagugauga

SEQ ID NO: 893281 - RNA, 19 nt, Homo sapiens
ugaagccuuugcagaugug

SEQ ID NO: 893282 - RNA, 19 nt, Homo sapiens
cugaagccuuugcagaugu

SEQ ID NO: 893283 - RNA, 19 nt, Homo sapiens
ggucauguuggccuucgaa

SEQ ID NO: 893284 - RNA, 19 nt, Homo sapiens
augaacggcucaagaaacu

SEQ ID NO: 893285 - RNA, 19 nt, Homo sapiens
gcggcuacaccuugaaauc

SEQ ID NO: 893286 - RNA, 19 nt, Homo sapiens
acugaagccuuugcagaug

SEQ ID NO: 893287 - RNA, 19 nt, Homo sapiens
cugugaagcccuuuaaaca

SEQ ID NO: 893288 - RNA, 19 nt, Homo sapiens
ucaggcagcguccacuaug

SEQ ID NO: 893289 - RNA, 19 nt, Homo sapiens
ggagaaugccccagugugu

SEQ ID NO: 893290 - RNA, 19 nt, Homo sapiens
gugccaggccuguggguau

SEQ ID NO: 893291 - RNA, 19 nt, Homo sapiens
cggcuacaccuugaaauca

SEQ ID NO: 893292 - RNA, 19 nt, Homo sapiens
acacgugcuuccugaaugc

SEQ ID NO: 893293 - RNA, 19 nt, Homo sapiens
aacacgugcuuccugaaug

SEQ ID NO: 893294 - RNA, 19 nt, Homo sapiens
uaccagcuguaugcccuuu

SEQ ID NO: 893295 - RNA, 19 nt, Homo sapiens
guugacaguacaaagauuc

SEQ ID NO: 893296 - RNA, 19 nt, Homo sapiens
ccaccgauacuugccaaug

SEQ ID NO: 893297 - RNA, 19 nt, Homo sapiens
ccugagccacccacuuuga

SEQ ID NO: 893298 - RNA, 19 nt, Homo sapiens
guacaaagauucccucgaa

SEQ ID NO: 893299 - RNA, 19 nt, Homo sapiens
gguuguagcuccauuauuu

SEQ ID NO: 893300 - RNA, 19 nt, Homo sapiens
gaaccugaguuaagugaug

SEQ ID NO: 893301 - RNA, 19 nt, Homo sapiens
gcuagaagaaccugaguua

SEQ ID NO: 893302 - RNA, 19 nt, Homo sapiens
gagcugucuuccagaaaua

SEQ ID NO: 893303 - RNA, 19 nt, Homo sapiens
gagccaaccuaauguggaa

SEQ ID NO: 893304 - RNA, 19 nt, Homo sapiens
agaaauauguucccuccuu

SEQ ID NO: 893305 - RNA, 19 nt, Homo sapiens
gagcagcacucgaccucuu

SEQ ID NO: 893306 - RNA, 19 nt, Homo sapiens
gagagccaccuguuaauau

SEQ ID NO: 893307 - RNA, 19 nt, Homo sapiens
gauccaagcuaccauuugc

SEQ ID NO: 893308 - RNA, 19 nt, Homo sapiens
gcaagauuguggaccuguu

SEQ ID NO: 893309 - RNA, 19 nt, Homo sapiens
agaagaaccugaguuaagu

SEQ ID NO: 893310 - RNA, 19 nt, Homo sapiens
guuggcaugucuacaauga

SEQ ID NO: 893311 - RNA, 19 nt, Homo sapiens
uucaguagguguagacuuu

SEQ ID NO: 893312 - RNA, 19 nt, Homo sapiens
ggccugagccacccacuuu

SEQ ID NO: 893313 - RNA, 19 nt, Homo sapiens
cgagagccaccuguuaaua

SEQ ID NO: 893314 - RNA, 19 nt, Homo sapiens
gcaggaugcccaagaguuc

SEQ ID NO: 893315 - RNA, 19 nt, Homo sapiens
cgagcugucuuccagaaau

SEQ ID NO: 893316 - RNA, 19 nt, Homo sapiens
ccacccacuuugagacgua

SEQ ID NO: 893317 - RNA, 19 nt, Homo sapiens
gagcuagagucggagaaug

SEQ ID NO: 893318 - RNA, 19 nt, Homo sapiens
uagaagaaccugaguuaag

SEQ ID NO: 893319 - RNA, 19 nt, Homo sapiens
cgagaggacagcaagauug

SEQ ID NO: 893320 - RNA, 19 nt, Homo sapiens
ugaccgagccaaccuaaug

SEQ ID NO: 893321 - RNA, 19 nt, Homo sapiens
agagcucacugaagccuuu

SEQ ID NO: 893322 - RNA, 19 nt, Homo sapiens
cuucgggacuucugucuga

SEQ ID NO: 893323 - RNA, 19 nt, Homo sapiens
aaaguugacaguacaaaga

SEQ ID NO: 893324 - RNA, 19 nt, Homo sapiens
caagauuguggaccuguuu

SEQ ID NO: 893325 - RNA, 19 nt, Homo sapiens
gagaggacagcaagauugu

SEQ ID NO: 893326 - RNA, 19 nt, Homo sapiens
gagccuuucuacucugaug

SEQ ID NO: 893327 - RNA, 19 nt, Homo sapiens
gugcuguucuaccaacuga

SEQ ID NO: 893328 - RNA, 19 nt, Homo sapiens
uacaaugacucucgugucu

SEQ ID NO: 893329 - RNA, 19 nt, Homo sapiens
aaccuaauguggaaacguu

SEQ ID NO: 893330 - RNA, 19 nt, Homo sapiens
gaugaccgagccaaccuaa

SEQ ID NO: 893331 - RNA, 19 nt, Homo sapiens
gcaccugugaagcccuuua

SEQ ID NO: 893332 - RNA, 19 nt, Homo sapiens
cgggauuguuucaaccuuu

SEQ ID NO: 893333 - RNA, 19 nt, Homo sapiens
gcgagaggacagcaagauu

SEQ ID NO: 893334 - RNA, 19 nt, Homo sapiens
gaagaaccugaguuaagug

SEQ ID NO: 893335 - RNA, 19 nt, Homo sapiens
gagcggcuacaccuugaaa

SEQ ID NO: 893336 - RNA, 19 nt, Homo sapiens
gaaacacgugcuuccugaa

SEQ ID NO: 893337 - RNA, 19 nt, Homo sapiens
cuacucugaugacaagaug

SEQ ID NO: 893338 - RNA, 19 nt, Homo sapiens
gaugaacggcucaagaaac

SEQ ID NO: 893339 - RNA, 19 nt, Homo sapiens
gcuacgugcuguucuacca

SEQ ID NO: 893340 - RNA, 19 nt, Homo sapiens
ugaguuaagugaugaugac

SEQ ID NO: 893341 - RNA, 19 nt, Homo sapiens
ccucugagccuuucuacuc

SEQ ID NO: 893342 - RNA, 19 nt, Homo sapiens
ccucagagacgucuauuuu

SEQ ID NO: 893343 - RNA, 19 nt, Homo sapiens
gcagcaaggagcgcagaaa

SEQ ID NO: 893344 - RNA, 19 nt, Homo sapiens
agagccaccuguuaauauc

SEQ ID NO: 893345 - RNA, 19 nt, Homo sapiens
cccgagagccaccuguuaa

SEQ ID NO: 893346 - RNA, 19 nt, Homo sapiens
ggauccaagcuaccauuug

SEQ ID NO: 893347 - RNA, 19 nt, Homo sapiens
ucugggcucuggucauguu

SEQ ID NO: 893348 - RNA, 19 nt, Homo sapiens
ggugguuguagcuccauua

SEQ ID NO: 893349 - RNA, 19 nt, Homo sapiens
gaggggcucugcuagaaga

SEQ ID NO: 893350 - RNA, 19 nt, Homo sapiens
caccgauacuugccaaugg

SEQ ID NO: 893351 - RNA, 19 nt, Homo sapiens
gggauccaagcuaccauuu

SEQ ID NO: 893352 - RNA, 19 nt, Homo sapiens
aaacacgugcuuccugaau

SEQ ID NO: 893353 - RNA, 19 nt, Homo sapiens
ccaagccccugcccaugua

SEQ ID NO: 893354 - RNA, 19 nt, Homo sapiens
cugaugaacggcucaagaa

SEQ ID NO: 893355 - RNA, 19 nt, Homo sapiens
guuucaaccuuuucacuaa

SEQ ID NO: 893356 - RNA, 19 nt, Homo sapiens
ccagcaggaugcccaagag

SEQ ID NO: 893357 - RNA, 19 nt, Homo sapiens
cuucugggcucuggucaug

SEQ ID NO: 893358 - RNA, 19 nt, Homo sapiens
uuucuacucugaugacaag

SEQ ID NO: 893359 - RNA, 19 nt, Homo sapiens
gcuguucuaccaacugaug

SEQ ID NO: 893360 - RNA, 19 nt, Homo sapiens
gggauuguuucaaccuuuu

SEQ ID NO: 893361 - RNA, 19 nt, Homo sapiens
gcgggauuguuucaaccuu

SEQ ID NO: 893362 - RNA, 19 nt, Homo sapiens
uggagcggcuacaccuuga

SEQ ID NO: 893363 - RNA, 19 nt, Homo sapiens
cuagaagaaccugaguuaa

SEQ ID NO: 893364 - RNA, 19 nt, Homo sapiens
ugaugaacggcucaagaaa

SEQ ID NO: 893365 - RNA, 19 nt, Homo sapiens
uggcaugucuacaaugacu

SEQ ID NO: 893366 - RNA, 19 nt, Homo sapiens
gaccgagccaaccuaaugu

SEQ ID NO: 893367 - RNA, 19 nt, Homo sapiens
uccugaagcuccucaugga

SEQ ID NO: 893368 - RNA, 19 nt, Homo sapiens
cccaagaguuccugaagcu

SEQ ID NO: 893369 - RNA, 19 nt, Homo sapiens
ccacuauggccacuacaca

SEQ ID NO: 893370 - RNA, 19 nt, Homo sapiens
aaccugaguuaagugauga

SEQ ID NO: 893371 - RNA, 19 nt, Homo sapiens
ugaagccuuugcagaugug

SEQ ID NO: 893372 - RNA, 19 nt, Homo sapiens
cugaagccuuugcagaugu

SEQ ID NO: 893373 - RNA, 19 nt, Homo sapiens
ggucauguuggccuucgaa

SEQ ID NO: 893374 - RNA, 19 nt, Homo sapiens
augaacggcucaagaaacu

SEQ ID NO: 893375 - RNA, 19 nt, Homo sapiens
gcggcuacaccuugaaauc

SEQ ID NO: 893376 - RNA, 19 nt, Homo sapiens
acugaagccuuugcagaug

SEQ ID NO: 893377 - RNA, 19 nt, Homo sapiens
cugugaagcccuuuaaaca

SEQ ID NO: 893378 - RNA, 19 nt, Homo sapiens
ggagaaugccccagugugu

SEQ ID NO: 893379 - RNA, 19 nt, Homo sapiens
gugccaggccuguggguau

SEQ ID NO: 893380 - RNA, 19 nt, Homo sapiens
cggcuacaccuugaaauca

SEQ ID NO: 893381 - RNA, 19 nt, Homo sapiens
acacgugcuuccugaaugc

SEQ ID NO: 893382 - RNA, 19 nt, Homo sapiens
aacacgugcuuccugaaug

SEQ ID NO: 893383 - RNA, 19 nt, Homo sapiens
guugacaguacaaagauuc

SEQ ID NO: 893384 - RNA, 19 nt, Homo sapiens
ccaccgauacuugccaaug

SEQ ID NO: 893385 - RNA, 19 nt, Homo sapiens
ccugagccacccacuuuga

SEQ ID NO: 893386 - RNA, 19 nt, Homo sapiens
gaagagaacggccacaaca

SEQ ID NO: 893387 - RNA, 19 nt, Homo sapiens
gggagcgcaucgaagagaa

SEQ ID NO: 893388 - RNA, 19 nt, Homo sapiens
gcuucuacguggccaugaa

SEQ ID NO: 893389 - RNA, 19 nt, Homo sapiens
gggcgucguggucaucaaa

SEQ ID NO: 893390 - RNA, 19 nt, Homo sapiens
ggacagcauccuggagauc

SEQ ID NO: 893391 - RNA, 19 nt, Homo sapiens
gcaguguccucaggcuucu

SEQ ID NO: 893392 - RNA, 19 nt, Homo sapiens
ggagauccgcucuguacac

SEQ ID NO: 893393 - RNA, 19 nt, Homo sapiens
caaaugaugugcuugcuuu

SEQ ID NO: 893394 - RNA, 19 nt, Homo sapiens
gccaaccgcuuauaugaua

SEQ ID NO: 893395 - RNA, 19 nt, Homo sapiens
agaggaaacuuaagcauaa

SEQ ID NO: 893396 - RNA, 19 nt, Homo sapiens
gaccggaaguugaggcuua

SEQ ID NO: 893397 - RNA, 19 nt, Homo sapiens
ugaauucguuucugacaua

SEQ ID NO: 893398 - RNA, 19 nt, Homo sapiens
guacacaaaucccuauguu

SEQ ID NO: 893399 - RNA, 19 nt, Homo sapiens
gaacauuggucaguacuuc

SEQ ID NO: 893400 - RNA, 19 nt, Homo sapiens
guucauugcucaacaagaa

SEQ ID NO: 893401 - RNA, 19 nt, Homo sapiens
gaaguacugccuuguaauu

SEQ ID NO: 893402 - RNA, 19 nt, Homo sapiens
gaugugagcucauuucaac

SEQ ID NO: 893403 - RNA, 19 nt, Homo sapiens
gaaccuguccaacauguuu

SEQ ID NO: 893404 - RNA, 19 nt, Homo sapiens
caacaagggcuaccucuga

SEQ ID NO: 893405 - RNA, 19 nt, Homo sapiens
gaaagcaaauaagcucuau

SEQ ID NO: 893406 - RNA, 19 nt, Homo sapiens
gaaagauacaugcuaagaa

SEQ ID NO: 893407 - RNA, 19 nt, Homo sapiens
gagaccaucuucuaucuuc

SEQ ID NO: 893408 - RNA, 19 nt, Homo sapiens
gagaauacuaugcuacuaa

SEQ ID NO: 893409 - RNA, 19 nt, Homo sapiens
ugacauaccuuagacugaa

SEQ ID NO: 893410 - RNA, 19 nt, Homo sapiens
gagcccuacucacacauua

SEQ ID NO: 893411 - RNA, 19 nt, Homo sapiens
guaacagucugcaucauca

SEQ ID NO: 893412 - RNA, 19 nt, Homo sapiens
cgacucacaucacuccuuu

SEQ ID NO: 893413 - RNA, 19 nt, Homo sapiens
ccagaaguguauucauauu

SEQ ID NO: 893414 - RNA, 19 nt, Homo sapiens
ggaaagagaaaugauguga

SEQ ID NO: 893415 - RNA, 19 nt, Homo sapiens
ggaaagauacaugcuaaga

SEQ ID NO: 893416 - RNA, 19 nt, Homo sapiens
gagaaaugaugugaaagau

SEQ ID NO: 893417 - RNA, 19 nt, Homo sapiens
gaacgauucaccuggguuu

SEQ ID NO: 893418 - RNA, 19 nt, Homo sapiens
ccacugggaauuugaagua

SEQ ID NO: 893419 - RNA, 19 nt, Homo sapiens
gagaaccuguccaacaugu

SEQ ID NO: 893420 - RNA, 19 nt, Homo sapiens
ucauagggcugauaauaca

SEQ ID NO: 893421 - RNA, 19 nt, Homo sapiens
ucuagaacauccuuaaaug

SEQ ID NO: 893422 - RNA, 19 nt, Homo sapiens
ccacuggguuuaaagaugu

SEQ ID NO: 893423 - RNA, 19 nt, Homo sapiens
ggaagcgguuggacugaug

SEQ ID NO: 893424 - RNA, 19 nt, Homo sapiens
aguggaaccucacaaauga

SEQ ID NO: 893425 - RNA, 19 nt, Homo sapiens
cagaggaaacuuaagcaua

SEQ ID NO: 893426 - RNA, 19 nt, Homo sapiens
gaaagagaaaugaugugaa

SEQ ID NO: 893427 - RNA, 19 nt, Homo sapiens
ugggaaagauacaugcuaa

SEQ ID NO: 893428 - RNA, 19 nt, Homo sapiens
uaagggaugugagcucauu

SEQ ID NO: 893429 - RNA, 19 nt, Homo sapiens
gaaaauguuaccaguguua

SEQ ID NO: 893430 - RNA, 19 nt, Homo sapiens
guaggccaauaauccguua

SEQ ID NO: 893431 - RNA, 19 nt, Homo sapiens
gaggaaacuuaagcauaaa

SEQ ID NO: 893432 - RNA, 19 nt, Homo sapiens
gaacuucauauacuaagga

SEQ ID NO: 893433 - RNA, 19 nt, Homo sapiens
agaaagcugugcagaggaa

SEQ ID NO: 893434 - RNA, 19 nt, Homo sapiens
caagaggaaucgcugaucu

SEQ ID NO: 893435 - RNA, 19 nt, Homo sapiens
ugucuuugguauugucuua

SEQ ID NO: 893436 - RNA, 19 nt, Homo sapiens
cgacgggucugguguugug

SEQ ID NO: 893437 - RNA, 19 nt, Homo sapiens
ggugauugguguggccuua

SEQ ID NO: 893438 - RNA, 19 nt, Homo sapiens
gcagucauagggcugauaa

SEQ ID NO: 893439 - RNA, 19 nt, Homo sapiens
caaccuaaauggagaaagc

SEQ ID NO: 893440 - RNA, 19 nt, Homo sapiens
caagaaucauugaccuaau

SEQ ID NO: 893441 - RNA, 19 nt, Homo sapiens
guacugccuuguaauucuu

SEQ ID NO: 893442 - RNA, 19 nt, Homo sapiens
acucugaccuuauuacugu

SEQ ID NO: 893443 - RNA, 19 nt, Homo sapiens
ugacuggcauccauaagug

SEQ ID NO: 893444 - RNA, 19 nt, Homo sapiens
gaaagcacagguugcaugu

SEQ ID NO: 893445 - RNA, 19 nt, Homo sapiens
ccaugugacuguggcauuu

SEQ ID NO: 893446 - RNA, 19 nt, Homo sapiens
cagguugucuguagagaau

SEQ ID NO: 893447 - RNA, 19 nt, Homo sapiens
acaaaucccuauguugcua

SEQ ID NO: 893448 - RNA, 19 nt, Homo sapiens
auccagaaguguauucaua

SEQ ID NO: 893449 - RNA, 19 nt, Homo sapiens
gcaauagguggaaagagaa

SEQ ID NO: 893450 - RNA, 19 nt, Homo sapiens
uauaguagugggaaagaua

SEQ ID NO: 893451 - RNA, 19 nt, Homo sapiens
uugaaguacugccuuguaa

SEQ ID NO: 893452 - RNA, 19 nt, Homo sapiens
ugccuuaucucauuucuca

SEQ ID NO: 893453 - RNA, 19 nt, Homo sapiens
ggucugguguugugacugu

SEQ ID NO: 893454 - RNA, 19 nt, Homo sapiens
aagcacagguugcauguag

SEQ ID NO: 893455 - RNA, 19 nt, Homo sapiens
agcaauagguggaaagaga

SEQ ID NO: 893456 - RNA, 19 nt, Homo sapiens
ggaaguugaggcuuagcua

SEQ ID NO: 893457 - RNA, 19 nt, Homo sapiens
gaaaaugaguuugucuaug

SEQ ID NO: 893458 - RNA, 19 nt, Homo sapiens
gacauaccuuagacugaaa

SEQ ID NO: 893459 - RNA, 19 nt, Homo sapiens
caagggcuaccucugagua

SEQ ID NO: 893460 - RNA, 19 nt, Homo sapiens
gauuauggcaucugugaau

SEQ ID NO: 893461 - RNA, 19 nt, Homo sapiens
gaaguugaggcuuagcuau

SEQ ID NO: 893462 - RNA, 19 nt, Homo sapiens
ugacauacaaaccaugauu

SEQ ID NO: 893463 - RNA, 19 nt, Homo sapiens
ucucauuucucaacaguuc

SEQ ID NO: 893464 - RNA, 19 nt, Homo sapiens
auucaucaauggagacuuu

SEQ ID NO: 893465 - RNA, 19 nt, Homo sapiens
gcuccuaccagccauugua

SEQ ID NO: 893466 - RNA, 19 nt, Homo sapiens
gcauguagacacuggaaug

SEQ ID NO: 893467 - RNA, 19 nt, Homo sapiens
caagaccacacugacuuua

SEQ ID NO: 893468 - RNA, 19 nt, Homo sapiens
gguugucuguagagaauga

SEQ ID NO: 893469 - RNA, 19 nt, Homo sapiens
gauggugucugagguucuu

SEQ ID NO: 893470 - RNA, 19 nt, Homo sapiens
gaagucagagaauacuaug

SEQ ID NO: 893471 - RNA, 19 nt, Homo sapiens
ggagacuuugauucuauua

SEQ ID NO: 893472 - RNA, 19 nt, Homo sapiens
cugauaauacacacaguua

SEQ ID NO: 893473 - RNA, 19 nt, Homo sapiens
gcugugcagaggaaacuua

SEQ ID NO: 893474 - RNA, 19 nt, Homo sapiens
agagaaaugaugugaaaga

SEQ ID NO: 893475 - RNA, 19 nt, Homo sapiens
ucaccuggguuugcaagaa

SEQ ID NO: 893476 - RNA, 19 nt, Homo sapiens
gugccaaccgcuuauauga

SEQ ID NO: 893477 - RNA, 19 nt, Homo sapiens
ccuggugcaucgaaaugua

SEQ ID NO: 893478 - RNA, 19 nt, Homo sapiens
agucauagggcugauaaua

SEQ ID NO: 893479 - RNA, 19 nt, Homo sapiens
agagaaaacuguugagguu

SEQ ID NO: 893480 - RNA, 19 nt, Homo sapiens
ucaaguggaaccucacaaa

SEQ ID NO: 893481 - RNA, 19 nt, Homo sapiens
uuaaucagccuuuggacaa

SEQ ID NO: 893482 - RNA, 19 nt, Homo sapiens
gcgugauuguggcauuuaa

SEQ ID NO: 893483 - RNA, 19 nt, Homo sapiens
gauaauacacacaguuacu

SEQ ID NO: 893484 - RNA, 19 nt, Homo sapiens
caucaucacaaccuaaaug

SEQ ID NO: 893485 - RNA, 19 nt, Homo sapiens
ccuuaaaugucuaacaaca

SEQ ID NO: 893486 - RNA, 19 nt, Homo sapiens
caauggagacuuugauucu

SEQ ID NO: 893487 - RNA, 19 nt, Homo sapiens
ugauugguguggccuuauu

SEQ ID NO: 893488 - RNA, 19 nt, Homo sapiens
gcaucaucaucacaaccua

SEQ ID NO: 893489 - RNA, 19 nt, Homo sapiens
guuggaaccuaaugggaau

SEQ ID NO: 893490 - RNA, 19 nt, Homo sapiens
cauuucaacuccugaucaa

SEQ ID NO: 893491 - RNA, 19 nt, Homo sapiens
aaaaugaguuugucuaugg

SEQ ID NO: 893492 - RNA, 19 nt, Homo sapiens
gagucuagaacauccuuaa

SEQ ID NO: 893493 - RNA, 19 nt, Homo sapiens
uaaagaagcuuaccaagaa

SEQ ID NO: 893494 - RNA, 19 nt, Homo sapiens
caaaugaacugaucucugu

SEQ ID NO: 893495 - RNA, 19 nt, Homo sapiens
guacugcucaucuuaauua

SEQ ID NO: 893496 - RNA, 19 nt, Homo sapiens
guacaugagucuacacaaa

SEQ ID NO: 893497 - RNA, 19 nt, Homo sapiens
cuacaucacucuucuggua

SEQ ID NO: 893498 - RNA, 19 nt, Homo sapiens
ggaaagagcugagugaaac

SEQ ID NO: 893499 - RNA, 19 nt, Homo sapiens
acaaagacuucaacaauug

SEQ ID NO: 893500 - RNA, 19 nt, Homo sapiens
gauauguccugcacuacua

SEQ ID NO: 893501 - RNA, 19 nt, Homo sapiens
gaauauagccacugacuca

SEQ ID NO: 893502 - RNA, 19 nt, Homo sapiens
uaagaaaggugccaaacau

SEQ ID NO: 893503 - RNA, 19 nt, Homo sapiens
cacaaagacuucaacaauu

SEQ ID NO: 893504 - RNA, 19 nt, Homo sapiens
gagugaaacuuuagacuuc

SEQ ID NO: 893505 - RNA, 19 nt, Homo sapiens
ccaagaauauagccacuga

SEQ ID NO: 893506 - RNA, 19 nt, Homo sapiens
guagugaacauccuaaauu

SEQ ID NO: 893507 - RNA, 19 nt, Homo sapiens
gaugaugagucucuucaga

SEQ ID NO: 893508 - RNA, 19 nt, Homo sapiens
gagcaaagcauuccugaca

SEQ ID NO: 893509 - RNA, 19 nt, Homo sapiens
gcugauauauugcuucauc

SEQ ID NO: 893510 - RNA, 19 nt, Homo sapiens
gacacaaccuucacaagug

SEQ ID NO: 893511 - RNA, 19 nt, Homo sapiens
gcaaagcauuccugacaca

SEQ ID NO: 893512 - RNA, 19 nt, Homo sapiens
caccugauccucucucuua

SEQ ID NO: 893513 - RNA, 19 nt, Homo sapiens
auacuuagcuuuacaagag

SEQ ID NO: 893514 - RNA, 19 nt, Homo sapiens
aaauacaacugggccaaua

SEQ ID NO: 893515 - RNA, 19 nt, Homo sapiens
gaaggaaagagcugaguga

SEQ ID NO: 893516 - RNA, 19 nt, Homo sapiens
ggacaacgaguacuucuuc

SEQ ID NO: 893517 - RNA, 19 nt, Homo sapiens
gggagaugauuucugguuu

SEQ ID NO: 893518 - RNA, 19 nt, Homo sapiens
gcagugauguggauuucug

SEQ ID NO: 893519 - RNA, 19 nt, Homo sapiens
ggacagcuuucugauuguu

SEQ ID NO: 893520 - RNA, 19 nt, Homo sapiens
caaggaagcagcuguuaga

SEQ ID NO: 893521 - RNA, 19 nt, Homo sapiens
guggugguguccaucauua

SEQ ID NO: 893522 - RNA, 19 nt, Homo sapiens
ggacacagaagaccaggaa

SEQ ID NO: 893523 - RNA, 19 nt, Homo sapiens
ggucacaaaugaacugauc

SEQ ID NO: 893524 - RNA, 19 nt, Homo sapiens
acacaaagacuucaacaau

SEQ ID NO: 893525 - RNA, 19 nt, Homo sapiens
gauguggauuucuguauuc

SEQ ID NO: 893526 - RNA, 19 nt, Homo sapiens
guggauuucuguauucuga

SEQ ID NO: 893527 - RNA, 19 nt, Homo sapiens
gaaagagcaaguacuagga

SEQ ID NO: 893528 - RNA, 19 nt, Homo sapiens
ccaauuaacacaaccaaau

SEQ ID NO: 893529 - RNA, 19 nt, Homo sapiens
gaauaucagauggucuuua

SEQ ID NO: 893530 - RNA, 19 nt, Homo sapiens
gaauauuucacaucaccua

SEQ ID NO: 893531 - RNA, 19 nt, Homo sapiens
ugacaaucacccaguguua

SEQ ID NO: 893532 - RNA, 19 nt, Homo sapiens
caacacaauuccuagacau

SEQ ID NO: 893533 - RNA, 19 nt, Homo sapiens
caucauaacaacacaauuc

SEQ ID NO: 893534 - RNA, 19 nt, Homo sapiens
ggaugaacuugaagaucuu

SEQ ID NO: 893535 - RNA, 19 nt, Homo sapiens
cuaaauuucuacacuggaa

SEQ ID NO: 893536 - RNA, 19 nt, Homo sapiens
ccaacugaguguaguaugu

SEQ ID NO: 893537 - RNA, 19 nt, Homo sapiens
gcccagagaaagauaagua

SEQ ID NO: 893538 - RNA, 19 nt, Homo sapiens
gccacugacucauauauca

SEQ ID NO: 893539 - RNA, 19 nt, Homo sapiens
agagaaagagcaaguacua

SEQ ID NO: 893540 - RNA, 19 nt, Homo sapiens
cuaaagaagcuuaccaaga

SEQ ID NO: 893541 - RNA, 19 nt, Homo sapiens
cauaacaacacaauuccua

SEQ ID NO: 893542 - RNA, 19 nt, Homo sapiens
gaguacugcucaucuuaau

SEQ ID NO: 893543 - RNA, 19 nt, Homo sapiens
gccaaaaccucuaaagcua

SEQ ID NO: 893544 - RNA, 19 nt, Homo sapiens
cagauggucuuuaaauguc

SEQ ID NO: 893545 - RNA, 19 nt, Homo sapiens
ggauuucuguauucugaug

SEQ ID NO: 893546 - RNA, 19 nt, Homo sapiens
uauagccacugacucauau

SEQ ID NO: 893547 - RNA, 19 nt, Homo sapiens
gggccaauauaaacauguu

SEQ ID NO: 893548 - RNA, 19 nt, Homo sapiens
ugauguggauuucuguauu

SEQ ID NO: 893549 - RNA, 19 nt, Homo sapiens
agagcugagugaaacuuua

SEQ ID NO: 893550 - RNA, 19 nt, Homo sapiens
aaagugagguagugaacau

SEQ ID NO: 893551 - RNA, 19 nt, Homo sapiens
gcagagauuauaucccuau

SEQ ID NO: 893552 - RNA, 19 nt, Homo sapiens
caacugggccaauauaaac

SEQ ID NO: 893553 - RNA, 19 nt, Homo sapiens
cagaguacugcucaucuua

SEQ ID NO: 893554 - RNA, 19 nt, Homo sapiens
uggaugaacuugaagaucu

SEQ ID NO: 893555 - RNA, 19 nt, Homo sapiens
cgacugaaaggcagagaaa

SEQ ID NO: 893556 - RNA, 19 nt, Homo sapiens
gugggaaucucuauauuuu

SEQ ID NO: 893557 - RNA, 19 nt, Homo sapiens
cuacugcuccuauuucuau

SEQ ID NO: 893558 - RNA, 19 nt, Homo sapiens
cagaagaccaggaaaguca

SEQ ID NO: 893559 - RNA, 19 nt, Homo sapiens
uaaauuacuccguucucua

SEQ ID NO: 893560 - RNA, 19 nt, Homo sapiens
gccaccaccucuaugacua

SEQ ID NO: 893561 - RNA, 19 nt, Homo sapiens
gcucgcaggcguuccgaua

SEQ ID NO: 893562 - RNA, 19 nt, Homo sapiens
auggacagcuuucugauug

SEQ ID NO: 893563 - RNA, 19 nt, Homo sapiens
caagagaaaacccauauuu

SEQ ID NO: 893564 - RNA, 19 nt, Homo sapiens
ggagaugauuucugguuuu

SEQ ID NO: 893565 - RNA, 19 nt, Homo sapiens
aguguuaacuugagagaug

SEQ ID NO: 893566 - RNA, 19 nt, Homo sapiens
uggaaauccuggaguaugu

SEQ ID NO: 893567 - RNA, 19 nt, Homo sapiens
ggaauauccuggagaaacc

SEQ ID NO: 893568 - RNA, 19 nt, Homo sapiens
ucaagaaggacacagaaga

SEQ ID NO: 893569 - RNA, 19 nt, Homo sapiens
gauuauaucccuaucuucu

SEQ ID NO: 893570 - RNA, 19 nt, Homo sapiens
gcuuggaccucaccugauc

SEQ ID NO: 893571 - RNA, 19 nt, Homo sapiens
ucagaguacugcucaucuu

SEQ ID NO: 893572 - RNA, 19 nt, Homo sapiens
ggccuugccuauugcuauu

SEQ ID NO: 893573 - RNA, 19 nt, Homo sapiens
ggccuucauguguauauua

SEQ ID NO: 893574 - RNA, 19 nt, Homo sapiens
ccaccucuaugacuacugu

SEQ ID NO: 893575 - RNA, 19 nt, Homo sapiens
gcagacauuccacaggauu

SEQ ID NO: 893576 - RNA, 19 nt, Homo sapiens
gaaaggugccaaacaucau

SEQ ID NO: 893577 - RNA, 19 nt, Homo sapiens
caaaaccucuaaagcuaaa

SEQ ID NO: 893578 - RNA, 19 nt, Homo sapiens
ucagauggucuuuaaaugu

SEQ ID NO: 893579 - RNA, 19 nt, Homo sapiens
gaagcuuaccaagaauaua

SEQ ID NO: 893580 - RNA, 19 nt, Homo sapiens
ugacacaaccuucacaagu

SEQ ID NO: 893581 - RNA, 19 nt, Homo sapiens
gaugucagcugaguuaagc

SEQ ID NO: 893582 - RNA, 19 nt, Homo sapiens
uaacaacacaauuccuaga

SEQ ID NO: 893583 - RNA, 19 nt, Homo sapiens
ugaccucccuggacucuag

SEQ ID NO: 893584 - RNA, 19 nt, Homo sapiens
ugaucucuguaucccauua

SEQ ID NO: 893585 - RNA, 19 nt, Homo sapiens
uaacuugagagaugucuau

SEQ ID NO: 893586 - RNA, 19 nt, Homo sapiens
ugacucauauaucaguguu

SEQ ID NO: 893587 - RNA, 19 nt, Homo sapiens
ccaggaaagucaacaugag

SEQ ID NO: 893588 - RNA, 19 nt, Homo sapiens
ggcgucaucuccauuaucu

SEQ ID NO: 893589 - RNA, 19 nt, Homo sapiens
aaagucaacaugagaguga

SEQ ID NO: 893590 - RNA, 19 nt, Homo sapiens
gaacauccuaaauuucuac

SEQ ID NO: 893591 - RNA, 19 nt, Homo sapiens
acaugagucuacacaaaga

SEQ ID NO: 893592 - RNA, 19 nt, Homo sapiens
uaacacaaccaaauacaac

SEQ ID NO: 893593 - RNA, 19 nt, Homo sapiens
gaacugagguuucaauaaa

SEQ ID NO: 893594 - RNA, 19 nt, Homo sapiens
gagcaaagcuugauucaga

SEQ ID NO: 893595 - RNA, 19 nt, Homo sapiens
guaaguaccucuaugauga

SEQ ID NO: 893596 - RNA, 19 nt, Homo sapiens
gaaggaggcucuacuaugg

SEQ ID NO: 893597 - RNA, 19 nt, Homo sapiens
gaguauaggugggagauaa

SEQ ID NO: 893598 - RNA, 19 nt, Homo sapiens
aaagcugucuugccuguua

SEQ ID NO: 893599 - RNA, 19 nt, Homo sapiens
gcagaaggacugaagguaa

SEQ ID NO: 893600 - RNA, 19 nt, Homo sapiens
cuucauaacugccaccuuu

SEQ ID NO: 893601 - RNA, 19 nt, Homo sapiens
uaagaggguuugggaguuu

SEQ ID NO: 893602 - RNA, 19 nt, Homo sapiens
cagaaggacugaagguaau

SEQ ID NO: 893603 - RNA, 19 nt, Homo sapiens
gaggagaaaggaaauguug

SEQ ID NO: 893604 - RNA, 19 nt, Homo sapiens
agaaauacguagcucaugu

SEQ ID NO: 893605 - RNA, 19 nt, Homo sapiens
ccucagcaauguucccuuu

SEQ ID NO: 893606 - RNA, 19 nt, Homo sapiens
gaagaaauacguagcucau

SEQ ID NO: 893607 - RNA, 19 nt, Homo sapiens
ccuguuagcuguggcauau

SEQ ID NO: 893608 - RNA, 19 nt, Homo sapiens
cguaauacaucagucuuug

SEQ ID NO: 893609 - RNA, 19 nt, Homo sapiens
ccaguaaguaccucuauga

SEQ ID NO: 893610 - RNA, 19 nt, Homo sapiens
gaaauacguagcucaugug

SEQ ID NO: 893611 - RNA, 19 nt, Homo sapiens
cgaaggaggcucuacuaug

SEQ ID NO: 893612 - RNA, 19 nt, Homo sapiens
ggugagaggagaaaggaaa

SEQ ID NO: 893613 - RNA, 19 nt, Homo sapiens
ugugaggaaugcauuaaga

SEQ ID NO: 893614 - RNA, 19 nt, Homo sapiens
uggcucgccucaagucuuu

SEQ ID NO: 893615 - RNA, 19 nt, Homo sapiens
gcaugggccugugugaugu

SEQ ID NO: 893616 - RNA, 19 nt, Homo sapiens
ucccuaggauggaagagua

SEQ ID NO: 893617 - RNA, 19 nt, Homo sapiens
ccacucuucuucauaacug

SEQ ID NO: 893618 - RNA, 19 nt, Homo sapiens
ggacugggaagccgacugu

SEQ ID NO: 893619 - RNA, 19 nt, Homo sapiens
uuaagaggguuugggaguu

SEQ ID NO: 893620 - RNA, 19 nt, Homo sapiens
gccaguaaguaccucuaug

SEQ ID NO: 893621 - RNA, 19 nt, Homo sapiens
gcaccgaaacccagacuac

SEQ ID NO: 893622 - RNA, 19 nt, Homo sapiens
agaacugagguuucaauaa

SEQ ID NO: 893623 - RNA, 19 nt, Homo sapiens
ggcaugggccugugugaug

SEQ ID NO: 893624 - RNA, 19 nt, Homo sapiens
cgccucaagucuuucguuu

SEQ ID NO: 893625 - RNA, 19 nt, Homo sapiens
cucccacucuucuucauaa

SEQ ID NO: 893626 - RNA, 19 nt, Homo sapiens
aggaggaggucuucaacga

SEQ ID NO: 893627 - RNA, 19 nt, Homo sapiens
guagaacugagguuucaau

SEQ ID NO: 893628 - RNA, 19 nt, Homo sapiens
gagaggagaaaggaaaugu

SEQ ID NO: 893629 - RNA, 19 nt, Homo sapiens
gcugguacaccuacacaga

SEQ ID NO: 893630 - RNA, 19 nt, Homo sapiens
ggauuggcaucucuacacu

SEQ ID NO: 893631 - RNA, 19 nt, Homo sapiens
cagacuacuugcagcaugu

SEQ ID NO: 893632 - RNA, 19 nt, Homo sapiens
uagaacugagguuucaaua

SEQ ID NO: 893633 - RNA, 19 nt, Homo sapiens
gaggagcaaagcuugauuc

SEQ ID NO: 893634 - RNA, 19 nt, Homo sapiens
ccgaaacccagacuacuug

SEQ ID NO: 893635 - RNA, 19 nt, Homo sapiens
gaugcuggcucugguguac

SEQ ID NO: 893636 - RNA, 19 nt, Homo sapiens
uggcauaugugagcagugu

SEQ ID NO: 893637 - RNA, 19 nt, Homo sapiens
gucuuccagucuucucuua

SEQ ID NO: 893638 - RNA, 19 nt, Homo sapiens
ggacugcugggaccuucaa

SEQ ID NO: 893639 - RNA, 19 nt, Homo sapiens
ggaggagcaaagcuugauu

SEQ ID NO: 893640 - RNA, 19 nt, Homo sapiens
uggcaucgguggccguaau

SEQ ID NO: 893641 - RNA, 19 nt, Homo sapiens
gaugguggccaguaaguac

SEQ ID NO: 893642 - RNA, 19 nt, Homo sapiens
uaaguaccucuaugaugaa

SEQ ID NO: 893643 - RNA, 19 nt, Homo sapiens
gcaaagcuugauucagauc

SEQ ID NO: 893644 - RNA, 19 nt, Homo sapiens
ccucaagucuuucguuuuc

SEQ ID NO: 893645 - RNA, 19 nt, Homo sapiens
gaaggacugaagguaauuc

SEQ ID NO: 893646 - RNA, 19 nt, Homo sapiens
ggcagaaggacugaaggua

SEQ ID NO: 893647 - RNA, 19 nt, Homo sapiens
gcugugaggaaugcauuaa

SEQ ID NO: 893648 - RNA, 19 nt, Homo sapiens
auuggcaucucuacacuga

SEQ ID NO: 893649 - RNA, 19 nt, Homo sapiens
ggucuucaacgacgaaugg

SEQ ID NO: 893650 - RNA, 19 nt, Homo sapiens
ucuggccacugcuuuguau

SEQ ID NO: 893651 - RNA, 19 nt, Homo sapiens
ggugggagauaagggaagu

SEQ ID NO: 893652 - RNA, 19 nt, Homo sapiens
gaaugcauuaagaggguuu

SEQ ID NO: 893653 - RNA, 19 nt, Homo sapiens
gcagucuucuggccucacu

SEQ ID NO: 893654 - RNA, 19 nt, Homo sapiens
uguuagcuguggcauaugu

SEQ ID NO: 893655 - RNA, 19 nt, Homo sapiens
gccgacuccagaagaaaua

SEQ ID NO: 893656 - RNA, 19 nt, Homo sapiens
guucuucucccagguauuc

SEQ ID NO: 893657 - RNA, 19 nt, Homo sapiens
ugaugucccugaggcagaa

SEQ ID NO: 893658 - RNA, 19 nt, Homo sapiens
gcucugguguacauugaac

SEQ ID NO: 893659 - RNA, 19 nt, Homo sapiens
gguaauucacuccuagauc

SEQ ID NO: 893660 - RNA, 19 nt, Homo sapiens
cuucaacccugaucuuuug

SEQ ID NO: 893661 - RNA, 19 nt, Homo sapiens
cuggagcccugcauaccuu

SEQ ID NO: 893662 - RNA, 19 nt, Homo sapiens
uggcucugguguacauuga

SEQ ID NO: 893663 - RNA, 19 nt, Homo sapiens
gaccuucaacccugaucuu

SEQ ID NO: 893664 - RNA, 19 nt, Homo sapiens
ggcaucgguggccguaaua

SEQ ID NO: 893665 - RNA, 19 nt, Homo sapiens
ggaggucuucaacgacgaa

SEQ ID NO: 893666 - RNA, 19 nt, Homo sapiens
cccuacaacucguuuccuu

SEQ ID NO: 893667 - RNA, 19 nt, Homo sapiens
guagggcugugaggaaugc

SEQ ID NO: 893668 - RNA, 19 nt, Homo sapiens
ggaggaggaggucuucaac

SEQ ID NO: 893669 - RNA, 19 nt, Homo sapiens
ggaggaggaggaggucuuc

SEQ ID NO: 893670 - RNA, 19 nt, Homo sapiens
ccucugacuuguuccugau

SEQ ID NO: 893671 - RNA, 19 nt, Homo sapiens
uuguagaacugagguuuca

SEQ ID NO: 893672 - RNA, 19 nt, Homo sapiens
gggaggaggaggaggucuu

SEQ ID NO: 893673 - RNA, 19 nt, Homo sapiens
ucucccagguauucucuuc

SEQ ID NO: 893674 - RNA, 19 nt, Homo sapiens
cuuccagucuucucuuagu

SEQ ID NO: 893675 - RNA, 19 nt, Homo sapiens
ucacucccauuccuuagcu

SEQ ID NO: 893676 - RNA, 19 nt, Homo sapiens
gggcugugaggaaugcauu

SEQ ID NO: 893677 - RNA, 19 nt, Homo sapiens
gcaaagcucugggaaagaa

SEQ ID NO: 893678 - RNA, 19 nt, Homo sapiens
gcaguaguuucacccauuu

SEQ ID NO: 893679 - RNA, 19 nt, Homo sapiens
gagcugcaguugaggaauu

SEQ ID NO: 893680 - RNA, 19 nt, Homo sapiens
ccaauaggcagaucaauga

SEQ ID NO: 893681 - RNA, 19 nt, Homo sapiens
ugagagaaaucagaagaaa

SEQ ID NO: 893682 - RNA, 19 nt, Homo sapiens
uaauaugccuuuacugauc

SEQ ID NO: 893683 - RNA, 19 nt, Homo sapiens
ggucagagcaccaagcauu

SEQ ID NO: 893684 - RNA, 19 nt, Homo sapiens
gcaaauauucaccaggaaa

SEQ ID NO: 893685 - RNA, 19 nt, Homo sapiens
gaacuucuaaggugggaaa

SEQ ID NO: 893686 - RNA, 19 nt, Homo sapiens
guugccagcuucuauuuga

SEQ ID NO: 893687 - RNA, 19 nt, Homo sapiens
ccuaauaugccuuuacuga

SEQ ID NO: 893688 - RNA, 19 nt, Homo sapiens
gagaugagagaaaucagaa

SEQ ID NO: 893689 - RNA, 19 nt, Homo sapiens
gaugagagaaaucagaaga

SEQ ID NO: 893690 - RNA, 19 nt, Homo sapiens
cuauaccgguccuccauuu

SEQ ID NO: 893691 - RNA, 19 nt, Homo sapiens
ggagaugagagaaaucaga

SEQ ID NO: 893692 - RNA, 19 nt, Homo sapiens
ccaccagccugcaggaaau

SEQ ID NO: 893693 - RNA, 19 nt, Homo sapiens
ugugaacccuauguuauuu

SEQ ID NO: 893694 - RNA, 19 nt, Homo sapiens
gcugugaacccuauguuau

SEQ ID NO: 893695 - RNA, 19 nt, Homo sapiens
gaaagaaucccgggaaacg

SEQ ID NO: 893696 - RNA, 19 nt, Homo sapiens
ggucuuguguugccagcuu

SEQ ID NO: 893697 - RNA, 19 nt, Homo sapiens
caugaugaauuuugccuua

SEQ ID NO: 893698 - RNA, 19 nt, Homo sapiens
uuagggagcugcaguugag

SEQ ID NO: 893699 - RNA, 19 nt, Homo sapiens
cugcaaagcucugggaaag

SEQ ID NO: 893700 - RNA, 19 nt, Homo sapiens
ggagcucucuaaucaccau

SEQ ID NO: 893701 - RNA, 19 nt, Homo sapiens
gaggagaugagagaaauca

SEQ ID NO: 893702 - RNA, 19 nt, Homo sapiens
ucuccuugccuuugucuua

SEQ ID NO: 893703 - RNA, 19 nt, Homo sapiens
uggagaugauauggaaaua

SEQ ID NO: 893704 - RNA, 19 nt, Homo sapiens
gccuuugucuuacuugugu

SEQ ID NO: 893705 - RNA, 19 nt, Homo sapiens
ccuugacuccugccauuua

SEQ ID NO: 893706 - RNA, 19 nt, Homo sapiens
ggaauugucugcguauccu

SEQ ID NO: 893707 - RNA, 19 nt, Homo sapiens
uggaggagaugagagaaau

SEQ ID NO: 893708 - RNA, 19 nt, Homo sapiens
ggagggaggggcuuuaauu

SEQ ID NO: 893709 - RNA, 19 nt, Homo sapiens
gaggaagaccgcccuuugg

SEQ ID NO: 893710 - RNA, 19 nt, Homo sapiens
ggcaaauauucaccaggaa

SEQ ID NO: 893711 - RNA, 19 nt, Homo sapiens
gggaggggcuuuaauugga

SEQ ID NO: 893712 - RNA, 19 nt, Homo sapiens
aaucucaucauggcaaaua

SEQ ID NO: 893713 - RNA, 19 nt, Homo sapiens
ugucuuacuuguguucaaa

SEQ ID NO: 893714 - RNA, 19 nt, Homo sapiens
ggagcagccuaugcagaau

SEQ ID NO: 893715 - RNA, 19 nt, Homo sapiens
aagauugccuuugcacuca

SEQ ID NO: 893716 - RNA, 19 nt, Homo sapiens
ugccauuuaucaugagauu

SEQ ID NO: 893717 - RNA, 19 nt, Homo sapiens
caccaagcauucagucucu

SEQ ID NO: 893718 - RNA, 19 nt, Homo sapiens
ugccuuuacugauccguuu

SEQ ID NO: 893719 - RNA, 19 nt, Homo sapiens
cuaaucaccaugaccauca

SEQ ID NO: 893720 - RNA, 19 nt, Homo sapiens
gagaggaagaccgcccuuu

SEQ ID NO: 893721 - RNA, 19 nt, Homo sapiens
uggagcagccuaugcagaa

SEQ ID NO: 893722 - RNA, 19 nt, Homo sapiens
gauucccgcuguuuucuuu

SEQ ID NO: 893723 - RNA, 19 nt, Homo sapiens
ugccuugacuccugccauu

SEQ ID NO: 893724 - RNA, 19 nt, Homo sapiens
agaggaagaccgcccuuug

SEQ ID NO: 893725 - RNA, 19 nt, Homo sapiens
gagcagccuaugcagaaug

SEQ ID NO: 893726 - RNA, 19 nt, Homo sapiens
agcaguaguuucacccauu

SEQ ID NO: 893727 - RNA, 19 nt, Homo sapiens
cuccugccauuuaucauga

SEQ ID NO: 893728 - RNA, 19 nt, Homo sapiens
ugacuccugccauuuauca

SEQ ID NO: 893729 - RNA, 19 nt, Homo sapiens
aaauauucauggaggagau

SEQ ID NO: 893730 - RNA, 19 nt, Homo sapiens
ggaaagaaucccgggaaac

SEQ ID NO: 893731 - RNA, 19 nt, Homo sapiens
gcauucagucucucuccuu

SEQ ID NO: 893732 - RNA, 19 nt, Homo sapiens
aagaaucccgggaaacgaa

SEQ ID NO: 893733 - RNA, 19 nt, Homo sapiens
cuaauaugccuuuacugau

SEQ ID NO: 893734 - RNA, 19 nt, Homo sapiens
cccaauaggcagaucaaug

SEQ ID NO: 893735 - RNA, 19 nt, Homo sapiens
gccaccagccugcaggaaa

SEQ ID NO: 893736 - RNA, 19 nt, Homo sapiens
ccuauguuauuuccaugug

SEQ ID NO: 893737 - RNA, 19 nt, Homo sapiens
uaugcagaauggagaggaa

SEQ ID NO: 893738 - RNA, 19 nt, Homo sapiens
cugugaacccuauguuauu

SEQ ID NO: 893739 - RNA, 19 nt, Homo sapiens
cuugacuccugccauuuau

SEQ ID NO: 893740 - RNA, 19 nt, Homo sapiens
gaggaauugucugcguauc

SEQ ID NO: 893741 - RNA, 19 nt, Homo sapiens
caaauauucaccaggaaaa

SEQ ID NO: 893742 - RNA, 19 nt, Homo sapiens
aauugucugcguauccuua

SEQ ID NO: 893743 - RNA, 19 nt, Homo sapiens
caaauaaaccuguguagaa

SEQ ID NO: 893744 - RNA, 19 nt, Homo sapiens
ugaggaagcugacaucuau

SEQ ID NO: 893745 - RNA, 19 nt, Homo sapiens
gaucuaugaugccuaugua

SEQ ID NO: 893746 - RNA, 19 nt, Homo sapiens
ggagaucuaugaugccuau

SEQ ID NO: 893747 - RNA, 19 nt, Homo sapiens
ggaagagaguccagauuuc

SEQ ID NO: 893748 - RNA, 19 nt, Homo sapiens
gaaagcugguucacauaga

SEQ ID NO: 893749 - RNA, 19 nt, Homo sapiens
ucaaagaaggcacauauaa

SEQ ID NO: 893750 - RNA, 19 nt, Homo sapiens
acaaagagauugacuacau

SEQ ID NO: 893751 - RNA, 19 nt, Homo sapiens
caggaaaccucgaagaaga

SEQ ID NO: 893752 - RNA, 19 nt, Homo sapiens
gcauuaccgcgaugaauua

SEQ ID NO: 893753 - RNA, 19 nt, Homo sapiens
ggauauggcucuuaugacu

SEQ ID NO: 893754 - RNA, 19 nt, Homo sapiens
ggaaggcccacauauuuga

SEQ ID NO: 893755 - RNA, 19 nt, Homo sapiens
caaagagauugacuacaug

SEQ ID NO: 893756 - RNA, 19 nt, Homo sapiens
agagaaagcucacuaacca

SEQ ID NO: 893757 - RNA, 19 nt, Homo sapiens
agagaaagcugguucacau

SEQ ID NO: 893758 - RNA, 19 nt, Homo sapiens
ugacaucuauggagucuca

SEQ ID NO: 893759 - RNA, 19 nt, Homo sapiens
cgacggcugucccuaaaga

SEQ ID NO: 893760 - RNA, 19 nt, Homo sapiens
ucagggaguuggauucuau

SEQ ID NO: 893761 - RNA, 19 nt, Homo sapiens
ugacgaugcugcugaugaa

SEQ ID NO: 893762 - RNA, 19 nt, Homo sapiens
ugacauugcucaagauuuu

SEQ ID NO: 893763 - RNA, 19 nt, Homo sapiens
caacgacggcugucccuaa

SEQ ID NO: 893764 - RNA, 19 nt, Homo sapiens
uagaggaacuugagaagca

SEQ ID NO: 893765 - RNA, 19 nt, Homo sapiens
aagaauugaugacuccuaa

SEQ ID NO: 893766 - RNA, 19 nt, Homo sapiens
gcacauauaagccuauugg

SEQ ID NO: 893767 - RNA, 19 nt, Homo sapiens
gagaaagcugguucacaua

SEQ ID NO: 893768 - RNA, 19 nt, Homo sapiens
caacagcggcgucaugugu

SEQ ID NO: 893769 - RNA, 19 nt, Homo sapiens
gccaauuccucgacaccua

SEQ ID NO: 893770 - RNA, 19 nt, Homo sapiens
caaagacucagaugaagga

SEQ ID NO: 893771 - RNA, 19 nt, Homo sapiens
ugaaugggcccaauccaaa

SEQ ID NO: 893772 - RNA, 19 nt, Homo sapiens
ucaaguggcagaaggauga

SEQ ID NO: 893773 - RNA, 19 nt, Homo sapiens
gaagaauugaugacuccua

SEQ ID NO: 893774 - RNA, 19 nt, Homo sapiens
caaagaaggcacauauaag

SEQ ID NO: 893775 - RNA, 19 nt, Homo sapiens
cccagaacauugucaggua

SEQ ID NO: 893776 - RNA, 19 nt, Homo sapiens
aaaagugacugaagaagaa

SEQ ID NO: 893777 - RNA, 19 nt, Homo sapiens
guugaccgaugcggaguua

SEQ ID NO: 893778 - RNA, 19 nt, Homo sapiens
ggaagauggccaugaggaa

SEQ ID NO: 893779 - RNA, 19 nt, Homo sapiens
gggaaggcccacauauuug

SEQ ID NO: 893780 - RNA, 19 nt, Homo sapiens
gaagagaguccagauuucu

SEQ ID NO: 893781 - RNA, 19 nt, Homo sapiens
ggaagagagaugaagauuc

SEQ ID NO: 893782 - RNA, 19 nt, Homo sapiens
gaacuugagaagcaggaaa

SEQ ID NO: 893783 - RNA, 19 nt, Homo sapiens
cgaagagcccaaggaguua

SEQ ID NO: 893784 - RNA, 19 nt, Homo sapiens
ggagaaggcacagaugaau

SEQ ID NO: 893785 - RNA, 19 nt, Homo sapiens
aaacugagccugggaguca

SEQ ID NO: 893786 - RNA, 19 nt, Homo sapiens
gaaccaggaagagagauga

SEQ ID NO: 893787 - RNA, 19 nt, Homo sapiens
ugacuuagccaucaacaag

SEQ ID NO: 893788 - RNA, 19 nt, Homo sapiens
gaacucagccgugggugau

SEQ ID NO: 893789 - RNA, 19 nt, Homo sapiens
gaaccguugcgacugguaa

SEQ ID NO: 893790 - RNA, 19 nt, Homo sapiens
ucaaccagaauacauauga

SEQ ID NO: 893791 - RNA, 19 nt, Homo sapiens
cucaagcucucacccaauu

SEQ ID NO: 893792 - RNA, 19 nt, Homo sapiens
acugguaacugaaguggaa

SEQ ID NO: 893793 - RNA, 19 nt, Homo sapiens
caaccagaauacauaugau

SEQ ID NO: 893794 - RNA, 19 nt, Homo sapiens
gucccaagcugcuaagauc

SEQ ID NO: 893795 - RNA, 19 nt, Homo sapiens
gaguccagauuucuugugu

SEQ ID NO: 893796 - RNA, 19 nt, Homo sapiens
caucuucccuucuuguucu

SEQ ID NO: 893797 - RNA, 19 nt, Homo sapiens
guccagauuucuugugugu

SEQ ID NO: 893798 - RNA, 19 nt, Homo sapiens
ucacugcccucugcuggaa

SEQ ID NO: 893799 - RNA, 19 nt, Homo sapiens
cagaauacauaugaugaca

SEQ ID NO: 893800 - RNA, 19 nt, Homo sapiens
gaaagcucacuaaccaguu

SEQ ID NO: 893801 - RNA, 19 nt, Homo sapiens
acgaagagcccaaggaguu

SEQ ID NO: 893802 - RNA, 19 nt, Homo sapiens
cagcuucccugaguacaug

SEQ ID NO: 893803 - RNA, 19 nt, Homo sapiens
uuaccgcgaugaauuagug

SEQ ID NO: 893804 - RNA, 19 nt, Homo sapiens
gagaaggcacagaugaaug

SEQ ID NO: 893805 - RNA, 19 nt, Homo sapiens
gggagaaggcacagaugaa

SEQ ID NO: 893806 - RNA, 19 nt, Homo sapiens
aagcagagcaucagcauag

SEQ ID NO: 893807 - RNA, 19 nt, Homo sapiens
ccacaaagagauugacuac

SEQ ID NO: 893808 - RNA, 19 nt, Homo sapiens
gcaacguggccauuuacaa

SEQ ID NO: 893809 - RNA, 19 nt, Homo sapiens
caaggagacggacaaacuu

SEQ ID NO: 893810 - RNA, 19 nt, Homo sapiens
auaaacagccucauaagca

SEQ ID NO: 893811 - RNA, 19 nt, Homo sapiens
acaccaaggucuucauguc

SEQ ID NO: 893812 - RNA, 19 nt, Homo sapiens
caacguggccauuuacaac

SEQ ID NO: 893813 - RNA, 19 nt, Homo sapiens
cccauaaacagccucauaa

SEQ ID NO: 893814 - RNA, 19 nt, Homo sapiens
gcacugccuuugacuucca

SEQ ID NO: 893815 - RNA, 19 nt, Homo sapiens
acggcaacguggccauuua

SEQ ID NO: 893816 - RNA, 19 nt, Homo sapiens
gaugacauugcucaagauu

SEQ ID NO: 893817 - RNA, 19 nt, Homo sapiens
aaagcucacuaaccaguuc

SEQ ID NO: 893818 - RNA, 19 nt, Homo sapiens
gaucaggucccagcaucuu

SEQ ID NO: 893819 - RNA, 19 nt, Homo sapiens
ccucacagaccuacaacaa

SEQ ID NO: 893820 - RNA, 19 nt, Homo sapiens
ugaccgaugcggaguuaaa

SEQ ID NO: 893821 - RNA, 19 nt, Homo sapiens
caauccaaagccacaguua

SEQ ID NO: 893822 - RNA, 19 nt, Homo sapiens
ucaaggagacggacaaacu

SEQ ID NO: 893823 - RNA, 19 nt, Homo sapiens
caagcucucacccaauuug

SEQ ID NO: 893824 - RNA, 19 nt, Homo sapiens
aaagcugguucacauagau

SEQ ID NO: 893825 - RNA, 19 nt, Homo sapiens
aaacaggaaaccucgaaga

SEQ ID NO: 893826 - RNA, 19 nt, Homo sapiens
ucgcagcagucaccacaga

SEQ ID NO: 893827 - RNA, 19 nt, Homo sapiens
uaacuucuucucuguguca

SEQ ID NO: 893828 - RNA, 19 nt, Homo sapiens
cagggaagauggccaugag

SEQ ID NO: 893829 - RNA, 19 nt, Homo sapiens
ucagguacagcuucaaaga

SEQ ID NO: 893830 - RNA, 19 nt, Homo sapiens
ccauuuacaaccucaagaa

SEQ ID NO: 893831 - RNA, 19 nt, Homo sapiens
ggucaaccagaauacauau

SEQ ID NO: 893832 - RNA, 19 nt, Homo sapiens
ucccaucgcuugaauacag

SEQ ID NO: 893833 - RNA, 19 nt, Homo sapiens
gcgccauacucuucuacug

SEQ ID NO: 893834 - RNA, 19 nt, Homo sapiens
ugacuuccacaaagagauu

SEQ ID NO: 893835 - RNA, 19 nt, Homo sapiens
gauauggcucuuaugacuu

SEQ ID NO: 893836 - RNA, 19 nt, Homo sapiens
cgaugcugcugaugaauac

SEQ ID NO: 893837 - RNA, 19 nt, Homo sapiens
ccaaucagugggagaucua

SEQ ID NO: 893838 - RNA, 19 nt, Homo sapiens
aaagaaggcacauauaagc

SEQ ID NO: 893839 - RNA, 19 nt, Homo sapiens
gaggaaccaggaagagaga

SEQ ID NO: 893840 - RNA, 19 nt, Homo sapiens
ggaguuaaaggaggaguuc

SEQ ID NO: 893841 - RNA, 19 nt, Homo sapiens
acaaauaaaccuguguaga

SEQ ID NO: 893842 - RNA, 19 nt, Homo sapiens
uugcgaaacuggacaaacu

SEQ ID NO: 893843 - RNA, 19 nt, Homo sapiens
gaagugcaaugauguauaa

SEQ ID NO: 893844 - RNA, 19 nt, Homo sapiens
ccaaugaccuugaaauguu

SEQ ID NO: 893845 - RNA, 19 nt, Homo sapiens
uaaugcagcuguuaaauug

SEQ ID NO: 893846 - RNA, 19 nt, Homo sapiens
ggaagacccuggcgaguau

SEQ ID NO: 893847 - RNA, 19 nt, Homo sapiens
gaaauguuauagcauggua

SEQ ID NO: 893848 - RNA, 19 nt, Homo sapiens
ugacaucacuggccauaaa

SEQ ID NO: 893849 - RNA, 19 nt, Homo sapiens
gaaagccgcuccugacauc

SEQ ID NO: 893850 - RNA, 19 nt, Homo sapiens
gaauggguauaaugaauug

SEQ ID NO: 893851 - RNA, 19 nt, Homo sapiens
gaauugcaguauauacgua

SEQ ID NO: 893852 - RNA, 19 nt, Homo sapiens
ggagugagaacaagaauga

SEQ ID NO: 893853 - RNA, 19 nt, Homo sapiens
caaugaccuugaaauguua

SEQ ID NO: 893854 - RNA, 19 nt, Homo sapiens
gggcuuaaccugugacuuu

SEQ ID NO: 893855 - RNA, 19 nt, Homo sapiens
gaucaugcaugcgccauuu

SEQ ID NO: 893856 - RNA, 19 nt, Homo sapiens
ucuaaagcaugccuuauuu

SEQ ID NO: 893857 - RNA, 19 nt, Homo sapiens
gugcaguucugguacauaa

SEQ ID NO: 893858 - RNA, 19 nt, Homo sapiens
ucacauugauuuacugguu

SEQ ID NO: 893859 - RNA, 19 nt, Homo sapiens
ccaacaaucacaaagauaa

SEQ ID NO: 893860 - RNA, 19 nt, Homo sapiens
gaucuagccagguacauuu

SEQ ID NO: 893861 - RNA, 19 nt, Homo sapiens
ccagagaaacacaaauuaa

SEQ ID NO: 893862 - RNA, 19 nt, Homo sapiens
gaagaggccagaugagguu

SEQ ID NO: 893863 - RNA, 19 nt, Homo sapiens
ccuuugagcuguacuguga

SEQ ID NO: 893864 - RNA, 19 nt, Homo sapiens
ugaaccagcuggaccaaug

SEQ ID NO: 893865 - RNA, 19 nt, Homo sapiens
gcuguugggucuucugcua

SEQ ID NO: 893866 - RNA, 19 nt, Homo sapiens
guacauucauucaaucaag

SEQ ID NO: 893867 - RNA, 19 nt, Homo sapiens
gcacugauguguugaaccu

SEQ ID NO: 893868 - RNA, 19 nt, Homo sapiens
acacugaguugaacauugu

SEQ ID NO: 893869 - RNA, 19 nt, Homo sapiens
aaaguggauucaccuguuu

SEQ ID NO: 893870 - RNA, 19 nt, Homo sapiens
ggugaucauuguuguguau

SEQ ID NO: 893871 - RNA, 19 nt, Homo sapiens
gugaagaggucauuauucg

SEQ ID NO: 893872 - RNA, 19 nt, Homo sapiens
ggcuuaaccugugacuuua

SEQ ID NO: 893873 - RNA, 19 nt, Homo sapiens
uauuuagccucuccuguaa

SEQ ID NO: 893874 - RNA, 19 nt, Homo sapiens
ggauauggcgcaagaagga

SEQ ID NO: 893875 - RNA, 19 nt, Homo sapiens
gccagagaaacacaaauua

SEQ ID NO: 893876 - RNA, 19 nt, Homo sapiens
gccgagagcugaggauuca

SEQ ID NO: 893877 - RNA, 19 nt, Homo sapiens
gcucucacacccuuacaua

SEQ ID NO: 893878 - RNA, 19 nt, Homo sapiens
gaaacugguggcaacauga

SEQ ID NO: 893879 - RNA, 19 nt, Homo sapiens
acugauguguugaaccuua

SEQ ID NO: 893880 - RNA, 19 nt, Homo sapiens
ucaagucgcccaugucaga

SEQ ID NO: 893881 - RNA, 19 nt, Homo sapiens
uaaauuggcaaagcucuaa

SEQ ID NO: 893882 - RNA, 19 nt, Homo sapiens
ugucagcgcuccuaaagca

SEQ ID NO: 893883 - RNA, 19 nt, Homo sapiens
aggaaugacuugaggcaaa

SEQ ID NO: 893884 - RNA, 19 nt, Homo sapiens
guugucagaugaggaaauu

SEQ ID NO: 893885 - RNA, 19 nt, Homo sapiens
ccauaagcguccuucagaa

SEQ ID NO: 893886 - RNA, 19 nt, Homo sapiens
gaaccuuauucuuguacau

SEQ ID NO: 893887 - RNA, 19 nt, Homo sapiens
gugagugugcugagaauaa

SEQ ID NO: 893888 - RNA, 19 nt, Homo sapiens
gguauaaugaauugcagua

SEQ ID NO: 893889 - RNA, 19 nt, Homo sapiens
gcaggaugccacuauguau

SEQ ID NO: 893890 - RNA, 19 nt, Homo sapiens
uaacccggcucaccuugga

SEQ ID NO: 893891 - RNA, 19 nt, Homo sapiens
cugcugccaucuagugaua

SEQ ID NO: 893892 - RNA, 19 nt, Homo sapiens
ugaaacugguggcaacaug

SEQ ID NO: 893893 - RNA, 19 nt, Homo sapiens
gaaccagcuggaccaauga

SEQ ID NO: 893894 - RNA, 19 nt, Homo sapiens
ccacugcguauaucacuuu

SEQ ID NO: 893895 - RNA, 19 nt, Homo sapiens
caguauauacguaugauug

SEQ ID NO: 893896 - RNA, 19 nt, Homo sapiens
gaauaacccggcucaccuu

SEQ ID NO: 893897 - RNA, 19 nt, Homo sapiens
guugaaccuuauucuugua

SEQ ID NO: 893898 - RNA, 19 nt, Homo sapiens
caagugagcaacaccacaa

SEQ ID NO: 893899 - RNA, 19 nt, Homo sapiens
caacaugaccugcuaaaau

SEQ ID NO: 893900 - RNA, 19 nt, Homo sapiens
uaccaacaaucacaaagau

SEQ ID NO: 893901 - RNA, 19 nt, Homo sapiens
uuauuuagccucuccugua

SEQ ID NO: 893902 - RNA, 19 nt, Homo sapiens
cacaaugacugucuaaagc

SEQ ID NO: 893903 - RNA, 19 nt, Homo sapiens
ccacaaugacugucuaaag

SEQ ID NO: 893904 - RNA, 19 nt, Homo sapiens
gacuggauauggcgcaaga

SEQ ID NO: 893905 - RNA, 19 nt, Homo sapiens
uaaagcaaacgccaccauu

SEQ ID NO: 893906 - RNA, 19 nt, Homo sapiens
ugaagugcaaugauguaua

SEQ ID NO: 893907 - RNA, 19 nt, Homo sapiens
uauuguauguugucagaug

SEQ ID NO: 893908 - RNA, 19 nt, Homo sapiens
ugggagaaauccaaaauaa

SEQ ID NO: 893909 - RNA, 19 nt, Homo sapiens
ggccauaaacggagugaga

SEQ ID NO: 893910 - RNA, 19 nt, Homo sapiens
uggaguacaggaucaauaa

SEQ ID NO: 893911 - RNA, 19 nt, Homo sapiens
acauacagcuacuggacaa

SEQ ID NO: 893912 - RNA, 19 nt, Homo sapiens
ugcauguacuuguguguuu

SEQ ID NO: 893913 - RNA, 19 nt, Homo sapiens
guguugaaccuuauucuug

SEQ ID NO: 893914 - RNA, 19 nt, Homo sapiens
cugaauggguauaaugaau

SEQ ID NO: 893915 - RNA, 19 nt, Homo sapiens
ccacugaauggguauaaug

SEQ ID NO: 893916 - RNA, 19 nt, Homo sapiens
gugagcaacaccacaauga

SEQ ID NO: 893917 - RNA, 19 nt, Homo sapiens
gcaaacgccaccauugaag

SEQ ID NO: 893918 - RNA, 19 nt, Homo sapiens
aagcaaacgccaccauuga

SEQ ID NO: 893919 - RNA, 19 nt, Homo sapiens
uaagaaugccagcaacaug

SEQ ID NO: 893920 - RNA, 19 nt, Homo sapiens
gcaaaaccccuccauaaca

SEQ ID NO: 893921 - RNA, 19 nt, Homo sapiens
ucagaacgcuggguuuguc

SEQ ID NO: 893922 - RNA, 19 nt, Homo sapiens
ggagaaauccaaaauaaag

SEQ ID NO: 893923 - RNA, 19 nt, Homo sapiens
ggaaugacuugaggcaaaa

SEQ ID NO: 893924 - RNA, 19 nt, Homo sapiens
cuuauuguauguugucaga

SEQ ID NO: 893925 - RNA, 19 nt, Homo sapiens
ccagguacauuuuaaacaa

SEQ ID NO: 893926 - RNA, 19 nt, Homo sapiens
cagagaaacacaaauuaag

SEQ ID NO: 893927 - RNA, 19 nt, Homo sapiens
ggaggacucugggacuuac

SEQ ID NO: 893928 - RNA, 19 nt, Homo sapiens
acugguugaugauagauuu

SEQ ID NO: 893929 - RNA, 19 nt, Homo sapiens
uugauuuacugguugauga

SEQ ID NO: 893930 - RNA, 19 nt, Homo sapiens
cugcugauauucauuccuu

SEQ ID NO: 893931 - RNA, 19 nt, Homo sapiens
agggugaucuagccaggua

SEQ ID NO: 893932 - RNA, 19 nt, Homo sapiens
cggaagacccuggcgagua

SEQ ID NO: 893933 - RNA, 19 nt, Homo sapiens
ggaugcccauggacauugu

SEQ ID NO: 893934 - RNA, 19 nt, Homo sapiens
gcaguucugguacauaaag

SEQ ID NO: 893935 - RNA, 19 nt, Homo sapiens
ggucaaacggcgugagugu

SEQ ID NO: 893936 - RNA, 19 nt, Homo sapiens
gcucagaacgcuggguuug

SEQ ID NO: 893937 - RNA, 19 nt, Homo sapiens
gucuaaagcaugccuuauu

SEQ ID NO: 893938 - RNA, 19 nt, Homo sapiens
caaugacugucuaaagcau

SEQ ID NO: 893939 - RNA, 19 nt, Homo sapiens
aacaugaccugcuaaaauu

SEQ ID NO: 893940 - RNA, 19 nt, Homo sapiens
guggcaacaugaccugcua

SEQ ID NO: 893941 - RNA, 19 nt, Homo sapiens
ccaacucuaccaacaauca

SEQ ID NO: 893942 - RNA, 19 nt, Homo sapiens
caaaaccccuccauaacau

SEQ ID NO: 893943 - RNA, 19 nt, Homo sapiens
gaagugcaaugauguauaa

SEQ ID NO: 893944 - RNA, 19 nt, Homo sapiens
ccaaugaccuugaaauguu

SEQ ID NO: 893945 - RNA, 19 nt, Homo sapiens
uaaugcagcuguuaaauug

SEQ ID NO: 893946 - RNA, 19 nt, Homo sapiens
ggaagacccuggcgaguau

SEQ ID NO: 893947 - RNA, 19 nt, Homo sapiens
gaaauguuauagcauggua

SEQ ID NO: 893948 - RNA, 19 nt, Homo sapiens
ugacaucacuggccauaaa

SEQ ID NO: 893949 - RNA, 19 nt, Homo sapiens
gaaagccgcuccugacauc

SEQ ID NO: 893950 - RNA, 19 nt, Homo sapiens
gaauggguauaaugaauug

SEQ ID NO: 893951 - RNA, 19 nt, Homo sapiens
gaauugcaguauauacgua

SEQ ID NO: 893952 - RNA, 19 nt, Homo sapiens
ggagugagaacaagaauga

SEQ ID NO: 893953 - RNA, 19 nt, Homo sapiens
caaugaccuugaaauguua

SEQ ID NO: 893954 - RNA, 19 nt, Homo sapiens
gggcuuaaccugugacuuu

SEQ ID NO: 893955 - RNA, 19 nt, Homo sapiens
gaucaugcaugcgccauuu

SEQ ID NO: 893956 - RNA, 19 nt, Homo sapiens
ucuaaagcaugccuuauuu

SEQ ID NO: 893957 - RNA, 19 nt, Homo sapiens
gugcaguucugguacauaa

SEQ ID NO: 893958 - RNA, 19 nt, Homo sapiens
ucacauugauuuacugguu

SEQ ID NO: 893959 - RNA, 19 nt, Homo sapiens
ccaacaaucacaaagauaa

SEQ ID NO: 893960 - RNA, 19 nt, Homo sapiens
gaucuagccagguacauuu

SEQ ID NO: 893961 - RNA, 19 nt, Homo sapiens
ccagagaaacacaaauuaa

SEQ ID NO: 893962 - RNA, 19 nt, Homo sapiens
gaagaggccagaugagguu

SEQ ID NO: 893963 - RNA, 19 nt, Homo sapiens
ugaaccagcuggaccaaug

SEQ ID NO: 893964 - RNA, 19 nt, Homo sapiens
gcuguugggucuucugcua

SEQ ID NO: 893965 - RNA, 19 nt, Homo sapiens
guacauucauucaaucaag

SEQ ID NO: 893966 - RNA, 19 nt, Homo sapiens
gcacugauguguugaaccu

SEQ ID NO: 893967 - RNA, 19 nt, Homo sapiens
acacugaguugaacauugu

SEQ ID NO: 893968 - RNA, 19 nt, Homo sapiens
aaaguggauucaccuguuu

SEQ ID NO: 893969 - RNA, 19 nt, Homo sapiens
ggugaucauuguuguguau

SEQ ID NO: 893970 - RNA, 19 nt, Homo sapiens
ggcuuaaccugugacuuua

SEQ ID NO: 893971 - RNA, 19 nt, Homo sapiens
uauuuagccucuccuguaa

SEQ ID NO: 893972 - RNA, 19 nt, Homo sapiens
ggauauggcgcaagaagga

SEQ ID NO: 893973 - RNA, 19 nt, Homo sapiens
gccagagaaacacaaauua

SEQ ID NO: 893974 - RNA, 19 nt, Homo sapiens
gcucucacacccuuacaua

SEQ ID NO: 893975 - RNA, 19 nt, Homo sapiens
gccgagagcugaggauuca

SEQ ID NO: 893976 - RNA, 19 nt, Homo sapiens
gaaacugguggcaacauga

SEQ ID NO: 893977 - RNA, 19 nt, Homo sapiens
acugauguguugaaccuua

SEQ ID NO: 893978 - RNA, 19 nt, Homo sapiens
uaaauuggcaaagcucuaa

SEQ ID NO: 893979 - RNA, 19 nt, Homo sapiens
ugucagcgcuccuaaagca

SEQ ID NO: 893980 - RNA, 19 nt, Homo sapiens
guugucagaugaggaaauu

SEQ ID NO: 893981 - RNA, 19 nt, Homo sapiens
gaaccuuauucuuguacau

SEQ ID NO: 893982 - RNA, 19 nt, Homo sapiens
gguauaaugaauugcagua

SEQ ID NO: 893983 - RNA, 19 nt, Homo sapiens
gcaggaugccacuauguau

SEQ ID NO: 893984 - RNA, 19 nt, Homo sapiens
cugcugccaucuagugaua

SEQ ID NO: 893985 - RNA, 19 nt, Homo sapiens
ugaaacugguggcaacaug

SEQ ID NO: 893986 - RNA, 19 nt, Homo sapiens
gaaccagcuggaccaauga

SEQ ID NO: 893987 - RNA, 19 nt, Homo sapiens
ccacugcguauaucacuuu

SEQ ID NO: 893988 - RNA, 19 nt, Homo sapiens
caguauauacguaugauug

SEQ ID NO: 893989 - RNA, 19 nt, Homo sapiens
guugaaccuuauucuugua

SEQ ID NO: 893990 - RNA, 19 nt, Homo sapiens
caagugagcaacaccacaa

SEQ ID NO: 893991 - RNA, 19 nt, Homo sapiens
caacaugaccugcuaaaau

SEQ ID NO: 893992 - RNA, 19 nt, Homo sapiens
uaccaacaaucacaaagau

SEQ ID NO: 893993 - RNA, 19 nt, Homo sapiens
uuauuuagccucuccugua

SEQ ID NO: 893994 - RNA, 19 nt, Homo sapiens
cacaaugacugucuaaagc

SEQ ID NO: 893995 - RNA, 19 nt, Homo sapiens
ccacaaugacugucuaaag

SEQ ID NO: 893996 - RNA, 19 nt, Homo sapiens
gacuggauauggcgcaaga

SEQ ID NO: 893997 - RNA, 19 nt, Homo sapiens
uaaagcaaacgccaccauu

SEQ ID NO: 893998 - RNA, 19 nt, Homo sapiens
ugaagugcaaugauguaua

SEQ ID NO: 893999 - RNA, 19 nt, Homo sapiens
acauacagcuacuggacaa

SEQ ID NO: 894000 - RNA, 19 nt, Homo sapiens
uauuguauguugucagaug

SEQ ID NO: 894001 - RNA, 19 nt, Homo sapiens
ugggagaaauccaaaauaa

SEQ ID NO: 894002 - RNA, 19 nt, Homo sapiens
ggccauaaacggagugaga

SEQ ID NO: 894003 - RNA, 19 nt, Homo sapiens
uggaguacaggaucaauaa

SEQ ID NO: 894004 - RNA, 19 nt, Homo sapiens
ugcauguacuuguguguuu

SEQ ID NO: 894005 - RNA, 19 nt, Homo sapiens
guguugaaccuuauucuug

SEQ ID NO: 894006 - RNA, 19 nt, Homo sapiens
cugaauggguauaaugaau

SEQ ID NO: 894007 - RNA, 19 nt, Homo sapiens
ccacugaauggguauaaug

SEQ ID NO: 894008 - RNA, 19 nt, Homo sapiens
gugagcaacaccacaauga

SEQ ID NO: 894009 - RNA, 19 nt, Homo sapiens
gcaaacgccaccauugaag

SEQ ID NO: 894010 - RNA, 19 nt, Homo sapiens
aagcaaacgccaccauuga

SEQ ID NO: 894011 - RNA, 19 nt, Homo sapiens
uaagaaugccagcaacaug

SEQ ID NO: 894012 - RNA, 19 nt, Homo sapiens
ggagaaauccaaaauaaag

SEQ ID NO: 894013 - RNA, 19 nt, Homo sapiens
cuuauuguauguugucaga

SEQ ID NO: 894014 - RNA, 19 nt, Homo sapiens
ccagguacauuuuaaacaa

SEQ ID NO: 894015 - RNA, 19 nt, Homo sapiens
cagagaaacacaaauuaag

SEQ ID NO: 894016 - RNA, 19 nt, Homo sapiens
acugguugaugauagauuu

SEQ ID NO: 894017 - RNA, 19 nt, Homo sapiens
uugauuuacugguugauga

SEQ ID NO: 894018 - RNA, 19 nt, Homo sapiens
cugcugauauucauuccuu

SEQ ID NO: 894019 - RNA, 19 nt, Homo sapiens
agggugaucuagccaggua

SEQ ID NO: 894020 - RNA, 19 nt, Homo sapiens
cggaagacccuggcgagua

SEQ ID NO: 894021 - RNA, 19 nt, Homo sapiens
ggaugcccauggacauugu

SEQ ID NO: 894022 - RNA, 19 nt, Homo sapiens
gcaguucugguacauaaag

SEQ ID NO: 894023 - RNA, 19 nt, Homo sapiens
gucuaaagcaugccuuauu

SEQ ID NO: 894024 - RNA, 19 nt, Homo sapiens
caaugacugucuaaagcau

SEQ ID NO: 894025 - RNA, 19 nt, Homo sapiens
aacaugaccugcuaaaauu

SEQ ID NO: 894026 - RNA, 19 nt, Homo sapiens
guggcaacaugaccugcua

SEQ ID NO: 894027 - RNA, 19 nt, Homo sapiens
ccaacucuaccaacaauca

SEQ ID NO: 894028 - RNA, 19 nt, Homo sapiens
aaccaacucuaccaacaau

SEQ ID NO: 894029 - RNA, 19 nt, Homo sapiens
aaagcaaacgccaccauug

SEQ ID NO: 894030 - RNA, 19 nt, Homo sapiens
guacuuguguguuuugugu

SEQ ID NO: 894031 - RNA, 19 nt, Homo sapiens
gguaauauucuaugcaacu

SEQ ID NO: 894032 - RNA, 19 nt, Homo sapiens
uguugaaccuuauucuugu

SEQ ID NO: 894033 - RNA, 19 nt, Homo sapiens
acaccacaaugacugucua

SEQ ID NO: 894034 - RNA, 19 nt, Homo sapiens
cuacagguauauacagcau

SEQ ID NO: 894035 - RNA, 19 nt, Homo sapiens
uggcaaagcucuaaaaugc

SEQ ID NO: 894036 - RNA, 19 nt, Homo sapiens
gagcaacaccacaaugacu

SEQ ID NO: 894037 - RNA, 19 nt, Homo sapiens
cgccagagaaacacaaauu

SEQ ID NO: 894038 - RNA, 19 nt, Homo sapiens
agaggaagaggccagauga

SEQ ID NO: 894039 - RNA, 19 nt, Homo sapiens
uacacugaguugaacauug

SEQ ID NO: 894040 - RNA, 19 nt, Homo sapiens
ugaggaaauugugcaguuc

SEQ ID NO: 894041 - RNA, 19 nt, Homo sapiens
uuacuuaaugcagcuguua

SEQ ID NO: 894042 - RNA, 19 nt, Homo sapiens
ucagaacgagccaaggauu

SEQ ID NO: 894043 - RNA, 19 nt, Homo sapiens
gaaaggaacucagaaauug

SEQ ID NO: 894044 - RNA, 19 nt, Homo sapiens
ggaaagcggcuaccucuua

SEQ ID NO: 894045 - RNA, 19 nt, Homo sapiens
ggaaaggaacucagaaauu

SEQ ID NO: 894046 - RNA, 19 nt, Homo sapiens
gccacgaaaucccguauua

SEQ ID NO: 894047 - RNA, 19 nt, Homo sapiens
cucagaaucuugaaaguua

SEQ ID NO: 894048 - RNA, 19 nt, Homo sapiens
uaacagggcuccgucuauu

SEQ ID NO: 894049 - RNA, 19 nt, Homo sapiens
gaacuucucccucccuauu

SEQ ID NO: 894050 - RNA, 19 nt, Homo sapiens
gagcaaggaucugggcuuu

SEQ ID NO: 894051 - RNA, 19 nt, Homo sapiens
gccagaaccucucgucuug

SEQ ID NO: 894052 - RNA, 19 nt, Homo sapiens
gcagaagguugucaagcaa

SEQ ID NO: 894053 - RNA, 19 nt, Homo sapiens
gcaccacuauccaucaaau

SEQ ID NO: 894054 - RNA, 19 nt, Homo sapiens
gagaugagcccguccuuuc

SEQ ID NO: 894055 - RNA, 19 nt, Homo sapiens
gaaagcggcuaccucuuac

SEQ ID NO: 894056 - RNA, 19 nt, Homo sapiens
ccacgaagaacgcgacuaa

SEQ ID NO: 894057 - RNA, 19 nt, Homo sapiens
gaaggcagugcgauacuuu

SEQ ID NO: 894058 - RNA, 19 nt, Homo sapiens
gaucgcauucuuuagauuu

SEQ ID NO: 894059 - RNA, 19 nt, Homo sapiens
gaaauuggacaccaugaag

SEQ ID NO: 894060 - RNA, 19 nt, Homo sapiens
gugauuggccuaucccuaa

SEQ ID NO: 894061 - RNA, 19 nt, Homo sapiens
cacgaaaucccguauuaaa

SEQ ID NO: 894062 - RNA, 19 nt, Homo sapiens
ucucaaagacggaugauug

SEQ ID NO: 894063 - RNA, 19 nt, Homo sapiens
ccaagcaugccacccguua

SEQ ID NO: 894064 - RNA, 19 nt, Homo sapiens
aaacgaaacagacgaaauc

SEQ ID NO: 894065 - RNA, 19 nt, Homo sapiens
gggagaaggcagugcgaua

SEQ ID NO: 894066 - RNA, 19 nt, Homo sapiens
gccacaaccucacaaucaa

SEQ ID NO: 894067 - RNA, 19 nt, Homo sapiens
ccagcuauuuaacagagua

SEQ ID NO: 894068 - RNA, 19 nt, Homo sapiens
ggaucgcauucuuuagauu

SEQ ID NO: 894069 - RNA, 19 nt, Homo sapiens
gcgcacaaccuaggcagua

SEQ ID NO: 894070 - RNA, 19 nt, Homo sapiens
gggaagcgcaguccuaaag

SEQ ID NO: 894071 - RNA, 19 nt, Homo sapiens
gccuaucccuaaauaucua

SEQ ID NO: 894072 - RNA, 19 nt, Homo sapiens
caggaucgcauucuuuaga

SEQ ID NO: 894073 - RNA, 19 nt, Homo sapiens
gcguuuugcuucuccauua

SEQ ID NO: 894074 - RNA, 19 nt, Homo sapiens
ccacgaaaucccguauuaa

SEQ ID NO: 894075 - RNA, 19 nt, Homo sapiens
cgcaggaucgcauucuuua

SEQ ID NO: 894076 - RNA, 19 nt, Homo sapiens
gcacacgcccaccagcuau

SEQ ID NO: 894077 - RNA, 19 nt, Homo sapiens
guucuaggaauuacucauu

SEQ ID NO: 894078 - RNA, 19 nt, Homo sapiens
aggcaguaauccuaaacua

SEQ ID NO: 894079 - RNA, 19 nt, Homo sapiens
caggaaaggaacucagaaa

SEQ ID NO: 894080 - RNA, 19 nt, Homo sapiens
gcaggaaaggaacucagaa

SEQ ID NO: 894081 - RNA, 19 nt, Homo sapiens
gcgcaggaucucagguuaa

SEQ ID NO: 894082 - RNA, 19 nt, Homo sapiens
gaacagcauccgccacaac

SEQ ID NO: 894083 - RNA, 19 nt, Homo sapiens
gcucagggacagcaggaaa

SEQ ID NO: 894084 - RNA, 19 nt, Homo sapiens
cgcagaagguugucaagca

SEQ ID NO: 894085 - RNA, 19 nt, Homo sapiens
ugauuggccuaucccuaaa

SEQ ID NO: 894086 - RNA, 19 nt, Homo sapiens
gugcaccacuauccaucaa

SEQ ID NO: 894087 - RNA, 19 nt, Homo sapiens
gacgaaaucugggcguuuu

SEQ ID NO: 894088 - RNA, 19 nt, Homo sapiens
ggagaaggcagugcgauac

SEQ ID NO: 894089 - RNA, 19 nt, Homo sapiens
ggccagaaccucucgucuu

SEQ ID NO: 894090 - RNA, 19 nt, Homo sapiens
caacgacugcuuccucaag

SEQ ID NO: 894091 - RNA, 19 nt, Homo sapiens
gugguaccgugaaggaaga

SEQ ID NO: 894092 - RNA, 19 nt, Homo sapiens
ccaacccucuaccgcagaa

SEQ ID NO: 894093 - RNA, 19 nt, Homo sapiens
gcuggagccugcuacaacu

SEQ ID NO: 894094 - RNA, 19 nt, Homo sapiens
ccaccuacccggcuuacau

SEQ ID NO: 894095 - RNA, 19 nt, Homo sapiens
gcgucggacucuccaccua

SEQ ID NO: 894096 - RNA, 19 nt, Homo sapiens
gcacaaccuaggcaguaau

SEQ ID NO: 894097 - RNA, 19 nt, Homo sapiens
cccgagucuuggaaucuua

SEQ ID NO: 894098 - RNA, 19 nt, Homo sapiens
cgcgcaggaucucagguua

SEQ ID NO: 894099 - RNA, 19 nt, Homo sapiens
caacgcggaggacauguuc

SEQ ID NO: 894100 - RNA, 19 nt, Homo sapiens
cgccacaaccucacaauca

SEQ ID NO: 894101 - RNA, 19 nt, Homo sapiens
caggaucucagguuaagga

SEQ ID NO: 894102 - RNA, 19 nt, Homo sapiens
uuacugagagccacgaaau

SEQ ID NO: 894103 - RNA, 19 nt, Homo sapiens
cgaagccggagguguggua

SEQ ID NO: 894104 - RNA, 19 nt, Homo sapiens
uggaaaccauccugaaagg

SEQ ID NO: 894105 - RNA, 19 nt, Homo sapiens
gaaucucagaaucuugaaa

SEQ ID NO: 894106 - RNA, 19 nt, Homo sapiens
gucuuggaaucuuagaauu

SEQ ID NO: 894107 - RNA, 19 nt, Homo sapiens
agaaggcagugcgauacuu

SEQ ID NO: 894108 - RNA, 19 nt, Homo sapiens
gcuauuuaacagaguagaa

SEQ ID NO: 894109 - RNA, 19 nt, Homo sapiens
ccaugaagcaaacgugugu

SEQ ID NO: 894110 - RNA, 19 nt, Homo sapiens
gaaucuugaaaguuacuga

SEQ ID NO: 894111 - RNA, 19 nt, Homo sapiens
cgcacaaccuaggcaguaa

SEQ ID NO: 894112 - RNA, 19 nt, Homo sapiens
caucaaauagagacagauc

SEQ ID NO: 894113 - RNA, 19 nt, Homo sapiens
agaaauuggacaccaugaa

SEQ ID NO: 894114 - RNA, 19 nt, Homo sapiens
cuccgucuauucaggcuaa

SEQ ID NO: 894115 - RNA, 19 nt, Homo sapiens
cuaacagggcuccgucuau

SEQ ID NO: 894116 - RNA, 19 nt, Homo sapiens
ggcggcaucuacaaguuca

SEQ ID NO: 894117 - RNA, 19 nt, Homo sapiens
ggcaguaauccuaaacuag

SEQ ID NO: 894118 - RNA, 19 nt, Homo sapiens
caccuucccuuucgguucu

SEQ ID NO: 894119 - RNA, 19 nt, Homo sapiens
auuggccuaucccuaaaua

SEQ ID NO: 894120 - RNA, 19 nt, Homo sapiens
gauccugggccucucaaag

SEQ ID NO: 894121 - RNA, 19 nt, Homo sapiens
gaaaucccguauuaaaagg

SEQ ID NO: 894122 - RNA, 19 nt, Homo sapiens
gcgcgcaggaucucagguu

SEQ ID NO: 894123 - RNA, 19 nt, Homo sapiens
gaggugugguaccgugaag

SEQ ID NO: 894124 - RNA, 19 nt, Homo sapiens
ggaggugugguaccgugaa

SEQ ID NO: 894125 - RNA, 19 nt, Homo sapiens
cuuggaaucuuagaauuac

SEQ ID NO: 894126 - RNA, 19 nt, Homo sapiens
ucgcaggaucgcauucuuu

SEQ ID NO: 894127 - RNA, 19 nt, Homo sapiens
agaagguugucaagcaaag

SEQ ID NO: 894128 - RNA, 19 nt, Homo sapiens
guugggaagcgcaguccua

SEQ ID NO: 894129 - RNA, 19 nt, Homo sapiens
ggcuaccucuuaccacaca

SEQ ID NO: 894130 - RNA, 19 nt, Homo sapiens
caccacuauccaucaaaua

SEQ ID NO: 894131 - RNA, 19 nt, Homo sapiens
acagggcuccgucuauuca

SEQ ID NO: 894132 - RNA, 19 nt, Homo sapiens
aacgacugcuuccucaaga

SEQ ID NO: 894133 - RNA, 19 nt, Homo sapiens
uucaauccgugcaccacua

SEQ ID NO: 894134 - RNA, 19 nt, Homo sapiens
ucucagaaucuugaaaguu

SEQ ID NO: 894135 - RNA, 19 nt, Homo sapiens
cagcucaccgccacgaaga

SEQ ID NO: 894136 - RNA, 19 nt, Homo sapiens
cagaagguugucaagcaaa

SEQ ID NO: 894137 - RNA, 19 nt, Homo sapiens
ggugugguaccgugaagga

SEQ ID NO: 894138 - RNA, 19 nt, Homo sapiens
cgcaggaucucagguuaag

SEQ ID NO: 894139 - RNA, 19 nt, Homo sapiens
ccaacgcggaggacauguu

SEQ ID NO: 894140 - RNA, 19 nt, Homo sapiens
ugagaugagcccguccuuu

SEQ ID NO: 894141 - RNA, 19 nt, Homo sapiens
ggccuaucccuaaauaucu

SEQ ID NO: 894142 - RNA, 19 nt, Homo sapiens
cugcgucguucuuucaauc

SEQ ID NO: 894143 - RNA, 19 nt, Homo sapiens
ugaagccgccuuacucgua

SEQ ID NO: 894144 - RNA, 19 nt, Homo sapiens
cagcaucgagaacaucaua

SEQ ID NO: 894145 - RNA, 19 nt, Homo sapiens
gcagacggcgcucaugaug

SEQ ID NO: 894146 - RNA, 19 nt, Homo sapiens
ccgcgucgcucaucaaguc

SEQ ID NO: 894147 - RNA, 19 nt, Homo sapiens
agacggcgcucaugaugca

SEQ ID NO: 894148 - RNA, 19 nt, Homo sapiens
gcacggcgcagucguuucu

SEQ ID NO: 894149 - RNA, 19 nt, Homo sapiens
ccgaggacauguucgacaa

SEQ ID NO: 894150 - RNA, 19 nt, Homo sapiens
gccacaaccucucacucaa

SEQ ID NO: 894151 - RNA, 19 nt, Homo sapiens
gcucauggccacccaccaa

SEQ ID NO: 894152 - RNA, 19 nt, Homo sapiens
gaacagcauccgccacaac

SEQ ID NO: 894153 - RNA, 19 nt, Homo sapiens
caagaacagccuagugaag

SEQ ID NO: 894154 - RNA, 19 nt, Homo sapiens
cccaagaacagccuaguga

SEQ ID NO: 894155 - RNA, 19 nt, Homo sapiens
ccaagaacagccuagugaa

SEQ ID NO: 894156 - RNA, 19 nt, Homo sapiens
gccacucuccggacaguuu

SEQ ID NO: 894157 - RNA, 19 nt, Homo sapiens
acgacgggcuggaagagaa

SEQ ID NO: 894158 - RNA, 19 nt, Homo sapiens
ccgaggacguggacaucga

SEQ ID NO: 894159 - RNA, 19 nt, Homo sapiens
cgagcaagcccaagaacag

SEQ ID NO: 894160 - RNA, 19 nt, Homo sapiens
gagcggcaucugcgaguuc

SEQ ID NO: 894161 - RNA, 19 nt, Homo sapiens
gcagagcccgcagaagaag

SEQ ID NO: 894162 - RNA, 19 nt, Homo sapiens
cagcacggcgcagucguuu

SEQ ID NO: 894163 - RNA, 19 nt, Homo sapiens
cgccacaaccucucacuca

SEQ ID NO: 894164 - RNA, 19 nt, Homo sapiens
gcacgcaccugccacagau

SEQ ID NO: 894165 - RNA, 19 nt, Homo sapiens
ugagcgagaucuacaaguu

SEQ ID NO: 894166 - RNA, 19 nt, Homo sapiens
gccacaaccucuccuucaa

SEQ ID NO: 894167 - RNA, 19 nt, Homo sapiens
cagaagagggcgaggaaga

SEQ ID NO: 894168 - RNA, 19 nt, Homo sapiens
gaucuacaaguucaucaug

SEQ ID NO: 894169 - RNA, 19 nt, Homo sapiens
gcuucaaggugcuuaaguc

SEQ ID NO: 894170 - RNA, 19 nt, Homo sapiens
acgcagcgcuggcagaaca

SEQ ID NO: 894171 - RNA, 19 nt, Homo sapiens
caaacagccaccagccaaa

SEQ ID NO: 894172 - RNA, 19 nt, Homo sapiens
caacgacugcuucaucaag

SEQ ID NO: 894173 - RNA, 19 nt, Homo sapiens
ccaccuugcucucgaacuc

SEQ ID NO: 894174 - RNA, 19 nt, Homo sapiens
gagcgagaucuacaaguuc

SEQ ID NO: 894175 - RNA, 19 nt, Homo sapiens
gaagagggcgaggaagaag

SEQ ID NO: 894176 - RNA, 19 nt, Homo sapiens
ucuacaaguucaucaugga

SEQ ID NO: 894177 - RNA, 19 nt, Homo sapiens
acaucucgcugaccgcuau

SEQ ID NO: 894178 - RNA, 19 nt, Homo sapiens
aacgacugcuucaucaaga

SEQ ID NO: 894179 - RNA, 19 nt, Homo sapiens
acacguacagcgaccagaa

SEQ ID NO: 894180 - RNA, 19 nt, Homo sapiens
agaagagggcgaggaagaa

SEQ ID NO: 894181 - RNA, 19 nt, Homo sapiens
gcugcaagcgcuucaaggu

SEQ ID NO: 894182 - RNA, 19 nt, Homo sapiens
uucaacgacugcuucauca

SEQ ID NO: 894183 - RNA, 19 nt, Homo sapiens
agaacagucugcgccacaa

SEQ ID NO: 894184 - RNA, 19 nt, Homo sapiens
agcgagaucuacaaguuca

SEQ ID NO: 894185 - RNA, 19 nt, Homo sapiens
gcggggacauguucgagaa

SEQ ID NO: 894186 - RNA, 19 nt, Homo sapiens
gaacguagcucuuuagaaa

SEQ ID NO: 894187 - RNA, 19 nt, Homo sapiens
gcaaguagauaacaaguuu

SEQ ID NO: 894188 - RNA, 19 nt, Homo sapiens
uaaagaaucuggucaauug

SEQ ID NO: 894189 - RNA, 19 nt, Homo sapiens
gcugagagcuuagcaguua

SEQ ID NO: 894190 - RNA, 19 nt, Homo sapiens
gaagucaucugaaucacua

SEQ ID NO: 894191 - RNA, 19 nt, Homo sapiens
ccaaagagauuuaaagaug

SEQ ID NO: 894192 - RNA, 19 nt, Homo sapiens
ggacaaagcuacauaaacu

SEQ ID NO: 894193 - RNA, 19 nt, Homo sapiens
ggaguuaucucucuuuaau

SEQ ID NO: 894194 - RNA, 19 nt, Homo sapiens
ggaugaagauuguuuagaa

SEQ ID NO: 894195 - RNA, 19 nt, Homo sapiens
ggagaggccuuggcaaaua

SEQ ID NO: 894196 - RNA, 19 nt, Homo sapiens
gcagaacgaauauaaguua

SEQ ID NO: 894197 - RNA, 19 nt, Homo sapiens
ggaaauagaacacgucauu

SEQ ID NO: 894198 - RNA, 19 nt, Homo sapiens
gaacuugcccucaacagua

SEQ ID NO: 894199 - RNA, 19 nt, Homo sapiens
gaagguugcuauauaguau

SEQ ID NO: 894200 - RNA, 19 nt, Homo sapiens
gaaaguugccgccuuauug

SEQ ID NO: 894201 - RNA, 19 nt, Homo sapiens
gaacaaaggagacucuuau

SEQ ID NO: 894202 - RNA, 19 nt, Homo sapiens
gcaauuauuuccagucaga

SEQ ID NO: 894203 - RNA, 19 nt, Homo sapiens
caggaagcauguaauaaua

SEQ ID NO: 894204 - RNA, 19 nt, Homo sapiens
cacagaagguugcuauaua

SEQ ID NO: 894205 - RNA, 19 nt, Homo sapiens
gcacuaagacugaagagaa

SEQ ID NO: 894206 - RNA, 19 nt, Homo sapiens
gaacucugauguuuguaaa

SEQ ID NO: 894207 - RNA, 19 nt, Homo sapiens
cuaaagaccugacaacugu

SEQ ID NO: 894208 - RNA, 19 nt, Homo sapiens
gaaccuacagcaacuuaua

SEQ ID NO: 894209 - RNA, 19 nt, Homo sapiens
caaaugaauucaagucuuc

SEQ ID NO: 894210 - RNA, 19 nt, Homo sapiens
gcaaaugaauucaagucuu

SEQ ID NO: 894211 - RNA, 19 nt, Homo sapiens
ggaaagagaagccaaugaa

SEQ ID NO: 894212 - RNA, 19 nt, Homo sapiens
caacagaugccuaguuuga

SEQ ID NO: 894213 - RNA, 19 nt, Homo sapiens
gaagaaugguuuaugucaa

SEQ ID NO: 894214 - RNA, 19 nt, Homo sapiens
caggaaaguugccgccuua

SEQ ID NO: 894215 - RNA, 19 nt, Homo sapiens
caagggacauugccacuga

SEQ ID NO: 894216 - RNA, 19 nt, Homo sapiens
ucacuagccucuaaauuau

SEQ ID NO: 894217 - RNA, 19 nt, Homo sapiens
ggacucagcacauucauug

SEQ ID NO: 894218 - RNA, 19 nt, Homo sapiens
caacaagaauaugcaguuu

SEQ ID NO: 894219 - RNA, 19 nt, Homo sapiens
guuaugggcuagagaauga

SEQ ID NO: 894220 - RNA, 19 nt, Homo sapiens
agacguauguucccgauuu

SEQ ID NO: 894221 - RNA, 19 nt, Homo sapiens
gaacaacagaugccuaguu

SEQ ID NO: 894222 - RNA, 19 nt, Homo sapiens
gcuaggaucuuuagagaag

SEQ ID NO: 894223 - RNA, 19 nt, Homo sapiens
gugaggauauuaaggaauu

SEQ ID NO: 894224 - RNA, 19 nt, Homo sapiens
gcacggcccugacugaauc

SEQ ID NO: 894225 - RNA, 19 nt, Homo sapiens
gcacauuacaacaagaaua

SEQ ID NO: 894226 - RNA, 19 nt, Homo sapiens
agaggaagaucuacuguga

SEQ ID NO: 894227 - RNA, 19 nt, Homo sapiens
caacagauaggaagucuug

SEQ ID NO: 894228 - RNA, 19 nt, Homo sapiens
gagcauagugauucagaua

SEQ ID NO: 894229 - RNA, 19 nt, Homo sapiens
gaacacgucauucaguuga

SEQ ID NO: 894230 - RNA, 19 nt, Homo sapiens
acacagaguucuagggauu

SEQ ID NO: 894231 - RNA, 19 nt, Homo sapiens
aagagaaacucaaacaaug

SEQ ID NO: 894232 - RNA, 19 nt, Homo sapiens
agacagcucuugcucagaa

SEQ ID NO: 894233 - RNA, 19 nt, Homo sapiens
gaacugggacacucucuug

SEQ ID NO: 894234 - RNA, 19 nt, Homo sapiens
aaagggauguucacuguau

SEQ ID NO: 894235 - RNA, 19 nt, Homo sapiens
gaauuuguauuuccagaca

SEQ ID NO: 894236 - RNA, 19 nt, Homo sapiens
gacaagaaccgcuuagaga

SEQ ID NO: 894237 - RNA, 19 nt, Homo sapiens
guucacagcuaggaucuuu

SEQ ID NO: 894238 - RNA, 19 nt, Homo sapiens
ccaaaccaaucguccguaa

SEQ ID NO: 894239 - RNA, 19 nt, Homo sapiens
ugacauagaccacuuggaa

SEQ ID NO: 894240 - RNA, 19 nt, Homo sapiens
ggaacaaaggagacucuua

SEQ ID NO: 894241 - RNA, 19 nt, Homo sapiens
uaucagagccucagaacaa

SEQ ID NO: 894242 - RNA, 19 nt, Homo sapiens
uaaagaugcuacugaagug

SEQ ID NO: 894243 - RNA, 19 nt, Homo sapiens
gagaggccuuggcaaauau

SEQ ID NO: 894244 - RNA, 19 nt, Homo sapiens
gcacagaagguugcuauau

SEQ ID NO: 894245 - RNA, 19 nt, Homo sapiens
acaaagggauguucacugu

SEQ ID NO: 894246 - RNA, 19 nt, Homo sapiens
gcagcggcauuucgaugua

SEQ ID NO: 894247 - RNA, 19 nt, Homo sapiens
gaaagagaaacucaaacaa

SEQ ID NO: 894248 - RNA, 19 nt, Homo sapiens
ccaaaacucugauugaauu

SEQ ID NO: 894249 - RNA, 19 nt, Homo sapiens
gaacagaaucacuggucua

SEQ ID NO: 894250 - RNA, 19 nt, Homo sapiens
ggaagaaugguuuauguca

SEQ ID NO: 894251 - RNA, 19 nt, Homo sapiens
ugaggaaucuaaagcaaga

SEQ ID NO: 894252 - RNA, 19 nt, Homo sapiens
aacaacagaugccuaguuu

SEQ ID NO: 894253 - RNA, 19 nt, Homo sapiens
cagcuaggaucuuuagaga

SEQ ID NO: 894254 - RNA, 19 nt, Homo sapiens
ggaggaauuuauccgagaa

SEQ ID NO: 894255 - RNA, 19 nt, Homo sapiens
gaaccaguuuagaaauguu

SEQ ID NO: 894256 - RNA, 19 nt, Homo sapiens
caaaagcugugaaaagaaa

SEQ ID NO: 894257 - RNA, 19 nt, Homo sapiens
guacaggacuuggagaauc

SEQ ID NO: 894258 - RNA, 19 nt, Homo sapiens
gaagaucuacugugaccaa

SEQ ID NO: 894259 - RNA, 19 nt, Homo sapiens
guaauggagucacuaccaa

SEQ ID NO: 894260 - RNA, 19 nt, Homo sapiens
ggaauuaucaggugaggau

SEQ ID NO: 894261 - RNA, 19 nt, Homo sapiens
agagguugcuguugaugua

SEQ ID NO: 894262 - RNA, 19 nt, Homo sapiens
ggacuccaggcaauuauuu

SEQ ID NO: 894263 - RNA, 19 nt, Homo sapiens
gaacuuccaaauucagauu

SEQ ID NO: 894264 - RNA, 19 nt, Homo sapiens
gaaugaaccuacagcaacu

SEQ ID NO: 894265 - RNA, 19 nt, Homo sapiens
ggcaggaucuagaaauaug

SEQ ID NO: 894266 - RNA, 19 nt, Homo sapiens
ggaaccaguuuagaaaugu

SEQ ID NO: 894267 - RNA, 19 nt, Homo sapiens
acagagccaucuuuacaaa

SEQ ID NO: 894268 - RNA, 19 nt, Homo sapiens
gaggagaggccuuggcaaa

SEQ ID NO: 894269 - RNA, 19 nt, Homo sapiens
ggaaagacagcaaguugug

SEQ ID NO: 894270 - RNA, 19 nt, Homo sapiens
agacacguuuccaaugaua

SEQ ID NO: 894271 - RNA, 19 nt, Homo sapiens
ccaaauugcguucugguuu

SEQ ID NO: 894272 - RNA, 19 nt, Homo sapiens
cagcagggcucucuguauc

SEQ ID NO: 894273 - RNA, 19 nt, Homo sapiens
cagaaucacuggucuaaaa

SEQ ID NO: 894274 - RNA, 19 nt, Homo sapiens
gagaacaacuggagcuacu

SEQ ID NO: 894275 - RNA, 19 nt, Homo sapiens
gaucugggccuugaauuug

SEQ ID NO: 894276 - RNA, 19 nt, Homo sapiens
gagcuuagcaguuaaaauu

SEQ ID NO: 894277 - RNA, 19 nt, Homo sapiens
gagauacuguggaugauac

SEQ ID NO: 894278 - RNA, 19 nt, Homo sapiens
ccaguggaauguuaaugaa

SEQ ID NO: 894279 - RNA, 19 nt, Homo sapiens
caaguugugcaguguguua

SEQ ID NO: 894280 - RNA, 19 nt, Homo sapiens
cuccagacaucaaagauuu

SEQ ID NO: 894281 - RNA, 19 nt, Homo sapiens
ggccagugcuguggaaauu

SEQ ID NO: 894282 - RNA, 19 nt, Homo sapiens
ggaaaguugccgccuuauu

SEQ ID NO: 894283 - RNA, 19 nt, Homo sapiens
acaaguuuauugccuguuu

SEQ ID NO: 894284 - RNA, 19 nt, Homo sapiens
gcagagaggacugugauga

SEQ ID NO: 894285 - RNA, 19 nt, Homo sapiens
cugaaucacuagccucuaa

SEQ ID NO: 894286 - RNA, 19 nt, Homo sapiens
gggcagaccuugacacuua

SEQ ID NO: 894287 - RNA, 19 nt, Homo sapiens
gaaguaacauugccuuuau

SEQ ID NO: 894288 - RNA, 19 nt, Homo sapiens
uaaagcauauggucaguua

SEQ ID NO: 894289 - RNA, 19 nt, Homo sapiens
gaaaggugcuuacgaacaa

SEQ ID NO: 894290 - RNA, 19 nt, Homo sapiens
gaucuugcaucgagaagua

SEQ ID NO: 894291 - RNA, 19 nt, Homo sapiens
caacaagacuacaucagaa

SEQ ID NO: 894292 - RNA, 19 nt, Homo sapiens
guacagauguuugcaaaga

SEQ ID NO: 894293 - RNA, 19 nt, Homo sapiens
gacaggagauggaguaaau

SEQ ID NO: 894294 - RNA, 19 nt, Homo sapiens
ggaguuggcuauaaucaau

SEQ ID NO: 894295 - RNA, 19 nt, Homo sapiens
gcauggaccucuuaggaaa

SEQ ID NO: 894296 - RNA, 19 nt, Homo sapiens
gcaagugaauuaccaguca

SEQ ID NO: 894297 - RNA, 19 nt, Homo sapiens
cauaaugucugcaaucgaa

SEQ ID NO: 894298 - RNA, 19 nt, Homo sapiens
gaacacugacgaagaauga

SEQ ID NO: 894299 - RNA, 19 nt, Homo sapiens
gaaaagauauccuggaaau

SEQ ID NO: 894300 - RNA, 19 nt, Homo sapiens
gaaccaccuucugcacuua

SEQ ID NO: 894301 - RNA, 19 nt, Homo sapiens
gcagagagauguguaccaa

SEQ ID NO: 894302 - RNA, 19 nt, Homo sapiens
agaaauagaugcaauggau

SEQ ID NO: 894303 - RNA, 19 nt, Homo sapiens
gugauugagugaaacuuua

SEQ ID NO: 894304 - RNA, 19 nt, Homo sapiens
gagaagaaauagaugcaau

SEQ ID NO: 894305 - RNA, 19 nt, Homo sapiens
uaugaaaggugcuuacgaa

SEQ ID NO: 894306 - RNA, 19 nt, Homo sapiens
gugcaaugaugcuguaauu

SEQ ID NO: 894307 - RNA, 19 nt, Homo sapiens
uagaguuccugcugacuua

SEQ ID NO: 894308 - RNA, 19 nt, Homo sapiens
aaaugaagguugcacguuu

SEQ ID NO: 894309 - RNA, 19 nt, Homo sapiens
gcauauggucaguuauuua

SEQ ID NO: 894310 - RNA, 19 nt, Homo sapiens
gcaaugaugcuguaauuag

SEQ ID NO: 894311 - RNA, 19 nt, Homo sapiens
cauaguggcagaaauuaua

SEQ ID NO: 894312 - RNA, 19 nt, Homo sapiens
caaugaugcuguaauuaga

SEQ ID NO: 894313 - RNA, 19 nt, Homo sapiens
gagauuggacucugcagua

SEQ ID NO: 894314 - RNA, 19 nt, Homo sapiens
ggauaaagaugucauucgu

SEQ ID NO: 894315 - RNA, 19 nt, Homo sapiens
ucagaauggucuaaacaaa

SEQ ID NO: 894316 - RNA, 19 nt, Homo sapiens
gcacgaguauagcagcauu

SEQ ID NO: 894317 - RNA, 19 nt, Homo sapiens
uuaagucgcuacagaagaa

SEQ ID NO: 894318 - RNA, 19 nt, Homo sapiens
uaccaaagguugcaguauu

SEQ ID NO: 894319 - RNA, 19 nt, Homo sapiens
gcuguaaugugauuuguuc

SEQ ID NO: 894320 - RNA, 19 nt, Homo sapiens
gaguagaaccaguggauaa

SEQ ID NO: 894321 - RNA, 19 nt, Homo sapiens
gacuguuacucacauauuu

SEQ ID NO: 894322 - RNA, 19 nt, Homo sapiens
ggucagauguggcaaagca

SEQ ID NO: 894323 - RNA, 19 nt, Homo sapiens
guggauggcuguuaagugu

SEQ ID NO: 894324 - RNA, 19 nt, Homo sapiens
agaauggucuaaacaaaug

SEQ ID NO: 894325 - RNA, 19 nt, Homo sapiens
aagaggauaugaagauuug

SEQ ID NO: 894326 - RNA, 19 nt, Homo sapiens
ggucucaccucaucagugu

SEQ ID NO: 894327 - RNA, 19 nt, Homo sapiens
ggacagcugacauuucuug

SEQ ID NO: 894328 - RNA, 19 nt, Homo sapiens
gaaaagggccauugugaaa

SEQ ID NO: 894329 - RNA, 19 nt, Homo sapiens
ucaggaauaucguucagaa

SEQ ID NO: 894330 - RNA, 19 nt, Homo sapiens
ggccguggcugacacuaaa

SEQ ID NO: 894331 - RNA, 19 nt, Homo sapiens
gcuguuagcagaauuguug

SEQ ID NO: 894332 - RNA, 19 nt, Homo sapiens
gagcauggaccucuuagga

SEQ ID NO: 894333 - RNA, 19 nt, Homo sapiens
gcucagauaccaugugcua

SEQ ID NO: 894334 - RNA, 19 nt, Homo sapiens
ggagauggaguaaaugaug

SEQ ID NO: 894335 - RNA, 19 nt, Homo sapiens
cauguugguuggcugguua

SEQ ID NO: 894336 - RNA, 19 nt, Homo sapiens
agacaaugauuccuguauu

SEQ ID NO: 894337 - RNA, 19 nt, Homo sapiens
cgaagaggguaaagggauu

SEQ ID NO: 894338 - RNA, 19 nt, Homo sapiens
gaagaauugaguaaacuug

SEQ ID NO: 894339 - RNA, 19 nt, Homo sapiens
gauuacaccucgagacaca

SEQ ID NO: 894340 - RNA, 19 nt, Homo sapiens
ggacagaccagagauuugu

SEQ ID NO: 894341 - RNA, 19 nt, Homo sapiens
caaaggguguugucauugg

SEQ ID NO: 894342 - RNA, 19 nt, Homo sapiens
gaaggaaaauuggagcaua

SEQ ID NO: 894343 - RNA, 19 nt, Homo sapiens
caacaaugaccuucacaug

SEQ ID NO: 894344 - RNA, 19 nt, Homo sapiens
gauaaagaugucauucgua

SEQ ID NO: 894345 - RNA, 19 nt, Homo sapiens
caaagaggcagcagacaug

SEQ ID NO: 894346 - RNA, 19 nt, Homo sapiens
guaaugugauuuguucaga

SEQ ID NO: 894347 - RNA, 19 nt, Homo sapiens
gacgcuagcucuugguguu

SEQ ID NO: 894348 - RNA, 19 nt, Homo sapiens
gcaauacuuaucguuguua

SEQ ID NO: 894349 - RNA, 19 nt, Homo sapiens
guaagcagcucagauacca

SEQ ID NO: 894350 - RNA, 19 nt, Homo sapiens
caucaugggacaauuacua

SEQ ID NO: 894351 - RNA, 19 nt, Homo sapiens
ggacucugcaguaauagaa

SEQ ID NO: 894352 - RNA, 19 nt, Homo sapiens
cagcagcuuucacaaauag

SEQ ID NO: 894353 - RNA, 19 nt, Homo sapiens
ucagcagcuuucacaaaua

SEQ ID NO: 894354 - RNA, 19 nt, Homo sapiens
gaaaugacuguuacucaca

SEQ ID NO: 894355 - RNA, 19 nt, Homo sapiens
aaagauauccuggaaaugu

SEQ ID NO: 894356 - RNA, 19 nt, Homo sapiens
aauguaagcagcucagaua

SEQ ID NO: 894357 - RNA, 19 nt, Homo sapiens
cauacuggaucuguuguuu

SEQ ID NO: 894358 - RNA, 19 nt, Homo sapiens
uagaaccaguggauaaaga

SEQ ID NO: 894359 - RNA, 19 nt, Homo sapiens
ccagagauuuguuuuauga

SEQ ID NO: 894360 - RNA, 19 nt, Homo sapiens
ggauggcuguuaagugugu

SEQ ID NO: 894361 - RNA, 19 nt, Homo sapiens
uuacuggaguuggcuauaa

SEQ ID NO: 894362 - RNA, 19 nt, Homo sapiens
uuucauggcuggaauaagu

SEQ ID NO: 894363 - RNA, 19 nt, Homo sapiens
cagcuacuguauuuccuuu

SEQ ID NO: 894364 - RNA, 19 nt, Homo sapiens
caagaggauaugaagauuu

SEQ ID NO: 894365 - RNA, 19 nt, Homo sapiens
ucaagaggauaugaagauu

SEQ ID NO: 894366 - RNA, 19 nt, Homo sapiens
gcagucugaggaucauuua

SEQ ID NO: 894367 - RNA, 19 nt, Homo sapiens
ccaagucuguguuugagau

SEQ ID NO: 894368 - RNA, 19 nt, Homo sapiens
gcaaagaggcagcagacau

SEQ ID NO: 894369 - RNA, 19 nt, Homo sapiens
gggcugcuguaaugugauu

SEQ ID NO: 894370 - RNA, 19 nt, Homo sapiens
ucccaggagugccauauuu

SEQ ID NO: 894371 - RNA, 19 nt, Homo sapiens
gugcauaguggcagaaauu

SEQ ID NO: 894372 - RNA, 19 nt, Homo sapiens
ggacuuuguuugucuucug

SEQ ID NO: 894373 - RNA, 19 nt, Homo sapiens
cagcugagcacgaguauag

SEQ ID NO: 894374 - RNA, 19 nt, Homo sapiens
accaaagguugcaguauuu

SEQ ID NO: 894375 - RNA, 19 nt, Homo sapiens
ccucaggaguaucaauaaa

SEQ ID NO: 894376 - RNA, 19 nt, Homo sapiens
agagagauguguaccaaca

SEQ ID NO: 894377 - RNA, 19 nt, Homo sapiens
ggaagugauuguugauggu

SEQ ID NO: 894378 - RNA, 19 nt, Homo sapiens
acucugggcugcuguaaug

SEQ ID NO: 894379 - RNA, 19 nt, Homo sapiens
agaaguaacauugccuuua

SEQ ID NO: 894380 - RNA, 19 nt, Homo sapiens
uaaagaagucuaacaguac

SEQ ID NO: 894381 - RNA, 19 nt, Homo sapiens
ucagagccuuggaguagaa

SEQ ID NO: 894382 - RNA, 19 nt, Homo sapiens
cagcagacaugauccuagu

SEQ ID NO: 894383 - RNA, 19 nt, Homo sapiens
uggaguaaaugaugcaguu

SEQ ID NO: 894384 - RNA, 19 nt, Homo sapiens
gcagcuuucacaaauagua

SEQ ID NO: 894385 - RNA, 19 nt, Homo sapiens
ggcaauacuuaucguuguu

SEQ ID NO: 894386 - RNA, 19 nt, Homo sapiens
gaaaugagaugagauguuc

SEQ ID NO: 894387 - RNA, 19 nt, Homo sapiens
gagcgaagguuaacaguag

SEQ ID NO: 894388 - RNA, 19 nt, Homo sapiens
gaacagguuucuagaacug

SEQ ID NO: 894389 - RNA, 19 nt, Homo sapiens
gaucucaucaccauaauaa

SEQ ID NO: 894390 - RNA, 19 nt, Homo sapiens
gagaaacccucaaggaauc

SEQ ID NO: 894391 - RNA, 19 nt, Homo sapiens
gaaacaaccauaccacuga

SEQ ID NO: 894392 - RNA, 19 nt, Homo sapiens
caucagcccuucuaccuuu

SEQ ID NO: 894393 - RNA, 19 nt, Homo sapiens
caaaugaggcuugaaauga

SEQ ID NO: 894394 - RNA, 19 nt, Homo sapiens
gauauggcauucccuucua

SEQ ID NO: 894395 - RNA, 19 nt, Homo sapiens
gaaugcuacuguguacuua

SEQ ID NO: 894396 - RNA, 19 nt, Homo sapiens
ggcauucccuucuaccaua

SEQ ID NO: 894397 - RNA, 19 nt, Homo sapiens
gcaggaggcucagcaggaa

SEQ ID NO: 894398 - RNA, 19 nt, Homo sapiens
gggugucgguagcgucuua

SEQ ID NO: 894399 - RNA, 19 nt, Homo sapiens
ccaagaguccaauuaaaga

SEQ ID NO: 894400 - RNA, 19 nt, Homo sapiens
uuacaaaccacacucauau

SEQ ID NO: 894401 - RNA, 19 nt, Homo sapiens
cagagaaacccucaaggaa

SEQ ID NO: 894402 - RNA, 19 nt, Homo sapiens
aaacaaccauaccacugaa

SEQ ID NO: 894403 - RNA, 19 nt, Homo sapiens
ggagcgaagguuaacagua

SEQ ID NO: 894404 - RNA, 19 nt, Homo sapiens
ccaaaugaggcuugaaaug

SEQ ID NO: 894405 - RNA, 19 nt, Homo sapiens
gcacacaggcgcacuugca

SEQ ID NO: 894406 - RNA, 19 nt, Homo sapiens
ccagagaaacccucaagga

SEQ ID NO: 894407 - RNA, 19 nt, Homo sapiens
cacaagcacucgccaccaa

SEQ ID NO: 894408 - RNA, 19 nt, Homo sapiens
aaaugaggcuugaaaugag

SEQ ID NO: 894409 - RNA, 19 nt, Homo sapiens
caagaguccaauuaaagaa

SEQ ID NO: 894410 - RNA, 19 nt, Homo sapiens
gccaagaguccaauuaaag

SEQ ID NO: 894411 - RNA, 19 nt, Homo sapiens
ggaucccacugucccuaaa

SEQ ID NO: 894412 - RNA, 19 nt, Homo sapiens
ggagugcucacgugguuga

SEQ ID NO: 894413 - RNA, 19 nt, Homo sapiens
gcugcagccuggagagcua

SEQ ID NO: 894414 - RNA, 19 nt, Homo sapiens
uagccaagaguccaauuaa

SEQ ID NO: 894415 - RNA, 19 nt, Homo sapiens
cgucaucucuaagaaacaa

SEQ ID NO: 894416 - RNA, 19 nt, Homo sapiens
ucauauucgucacgucauu

SEQ ID NO: 894417 - RNA, 19 nt, Homo sapiens
agagaaacccucaaggaau

SEQ ID NO: 894418 - RNA, 19 nt, Homo sapiens
ucacgucauuucaucuuca

SEQ ID NO: 894419 - RNA, 19 nt, Homo sapiens
gcccagcuccugaacuuug

SEQ ID NO: 894420 - RNA, 19 nt, Homo sapiens
ugaaaugagaugagauguu

SEQ ID NO: 894421 - RNA, 19 nt, Homo sapiens
ccaagcaccugcggacaca

SEQ ID NO: 894422 - RNA, 19 nt, Homo sapiens
acaaaccacacucauauuc

SEQ ID NO: 894423 - RNA, 19 nt, Homo sapiens
gugcaggagcgaagguuaa

SEQ ID NO: 894424 - RNA, 19 nt, Homo sapiens
agccaagaguccaauuaaa

SEQ ID NO: 894425 - RNA, 19 nt, Homo sapiens
ugaaugcuacuguguacuu

SEQ ID NO: 894426 - RNA, 19 nt, Homo sapiens
aaaccacacucauauucgu

SEQ ID NO: 894427 - RNA, 19 nt, Homo sapiens
gucgaucucaucaccauaa

SEQ ID NO: 894428 - RNA, 19 nt, Homo sapiens
ucucuaagaaacaaccaua

SEQ ID NO: 894429 - RNA, 19 nt, Homo sapiens
gauccaggccugaagaaac

SEQ ID NO: 894430 - RNA, 19 nt, Homo sapiens
cuuacaaaccacacucaua

SEQ ID NO: 894431 - RNA, 19 nt, Homo sapiens
ggccagcacucugugauac

SEQ ID NO: 894432 - RNA, 19 nt, Homo sapiens
cacuguggacuuccucuua

SEQ ID NO: 894433 - RNA, 19 nt, Homo sapiens
gcauucccuucuaccauag

SEQ ID NO: 894434 - RNA, 19 nt, Homo sapiens
aaugaggcuugaaaugaga

SEQ ID NO: 894435 - RNA, 19 nt, Homo sapiens
ccagcgagcccuacagagu

SEQ ID NO: 894436 - RNA, 19 nt, Homo sapiens
gcuccugaacuuuguguau

SEQ ID NO: 894437 - RNA, 19 nt, Homo sapiens
gcacuaccgaguccacaca

SEQ ID NO: 894438 - RNA, 19 nt, Homo sapiens
uuagccaagaguccaauua

SEQ ID NO: 894439 - RNA, 19 nt, Homo sapiens
ccacugaaugcuacugugu

SEQ ID NO: 894440 - RNA, 19 nt, Homo sapiens
gaacuggugggagagaaca

SEQ ID NO: 894441 - RNA, 19 nt, Homo sapiens
ucaggaggagccagagaaa

SEQ ID NO: 894442 - RNA, 19 nt, Homo sapiens
ucucaucaccauaauaaag

SEQ ID NO: 894443 - RNA, 19 nt, Homo sapiens
uugcccagcuccugaacuu

SEQ ID NO: 894444 - RNA, 19 nt, Homo sapiens
gcucugaucggcugguaca

SEQ ID NO: 894445 - RNA, 19 nt, Homo sapiens
gggagcagaugggaagcau

SEQ ID NO: 894446 - RNA, 19 nt, Homo sapiens
caagcacucgccaccaaga

SEQ ID NO: 894447 - RNA, 19 nt, Homo sapiens
ggcuugaaaugagaugaga

SEQ ID NO: 894448 - RNA, 19 nt, Homo sapiens
gcaucagcccuucuaccuu

SEQ ID NO: 894449 - RNA, 19 nt, Homo sapiens
ccagauccaggccugaaga

SEQ ID NO: 894450 - RNA, 19 nt, Homo sapiens
caaccugugcgggucauga

SEQ ID NO: 894451 - RNA, 19 nt, Homo sapiens
cauauucgucacgucauuu

SEQ ID NO: 894452 - RNA, 19 nt, Homo sapiens
uacaaaccacacucauauu

SEQ ID NO: 894453 - RNA, 19 nt, Homo sapiens
gauggaagagucugaucag

SEQ ID NO: 894454 - RNA, 19 nt, Homo sapiens
ggagauggaagagucugau

SEQ ID NO: 894455 - RNA, 19 nt, Homo sapiens
uagaacuggugggagagaa

SEQ ID NO: 894456 - RNA, 19 nt, Homo sapiens
auccaggccugaagaaaca

SEQ ID NO: 894457 - RNA, 19 nt, Homo sapiens
cuccugaacuuuguguaug

SEQ ID NO: 894458 - RNA, 19 nt, Homo sapiens
gcacucugugauacucuga

SEQ ID NO: 894459 - RNA, 19 nt, Homo sapiens
cggccagcacucugugaua

SEQ ID NO: 894460 - RNA, 19 nt, Homo sapiens
gcacaccucugaauguaaa

SEQ ID NO: 894461 - RNA, 19 nt, Homo sapiens
ggagugcuauucaguguuu

SEQ ID NO: 894462 - RNA, 19 nt, Homo sapiens
gagcuggacugaugagaaa

SEQ ID NO: 894463 - RNA, 19 nt, Homo sapiens
gggcagggcuuccucauug

SEQ ID NO: 894464 - RNA, 19 nt, Homo sapiens
gcaaugaagugaugaggau

SEQ ID NO: 894465 - RNA, 19 nt, Homo sapiens
ggaaugcccuccugucugu

SEQ ID NO: 894466 - RNA, 19 nt, Homo sapiens
gauguaggguguauuucua

SEQ ID NO: 894467 - RNA, 19 nt, Homo sapiens
cggaagagcuggacugaug

SEQ ID NO: 894468 - RNA, 19 nt, Homo sapiens
ccagaagggugaccaguga

SEQ ID NO: 894469 - RNA, 19 nt, Homo sapiens
ggagggaggaucaauauug

SEQ ID NO: 894470 - RNA, 19 nt, Homo sapiens
gaacagaggcacaaauuuu

SEQ ID NO: 894471 - RNA, 19 nt, Homo sapiens
agagauggcuccaaauaug

SEQ ID NO: 894472 - RNA, 19 nt, Homo sapiens
gaagugaugaggauacuga

SEQ ID NO: 894473 - RNA, 19 nt, Homo sapiens
cgagagauggcuccaaaua

SEQ ID NO: 894474 - RNA, 19 nt, Homo sapiens
gaagaacacauacuaccuu

SEQ ID NO: 894475 - RNA, 19 nt, Homo sapiens
gaagguagcaaugaaguga

SEQ ID NO: 894476 - RNA, 19 nt, Homo sapiens
gaugcugccucucuucuga

SEQ ID NO: 894477 - RNA, 19 nt, Homo sapiens
uagcacaccucugaaugua

SEQ ID NO: 894478 - RNA, 19 nt, Homo sapiens
ggaacagaggcacaaauuu

SEQ ID NO: 894479 - RNA, 19 nt, Homo sapiens
cuucuggacugccucaaua

SEQ ID NO: 894480 - RNA, 19 nt, Homo sapiens
gcucuuugcuacagaugaa

SEQ ID NO: 894481 - RNA, 19 nt, Homo sapiens
uaucaagggcugagacuuu

SEQ ID NO: 894482 - RNA, 19 nt, Homo sapiens
agaaacagggagaucauua

SEQ ID NO: 894483 - RNA, 19 nt, Homo sapiens
ccaugggacuuaaugaaga

SEQ ID NO: 894484 - RNA, 19 nt, Homo sapiens
cuugauaccucugucauuu

SEQ ID NO: 894485 - RNA, 19 nt, Homo sapiens
gcuauucaguguuucuguu

SEQ ID NO: 894486 - RNA, 19 nt, Homo sapiens
acggcuaccugaaggauua

SEQ ID NO: 894487 - RNA, 19 nt, Homo sapiens
gagagauggcuccaaauau

SEQ ID NO: 894488 - RNA, 19 nt, Homo sapiens
uuuggaaacuuacuccuaa

SEQ ID NO: 894489 - RNA, 19 nt, Homo sapiens
acagggagaucauuacauc

SEQ ID NO: 894490 - RNA, 19 nt, Homo sapiens
ggaguagaacccacacuug

SEQ ID NO: 894491 - RNA, 19 nt, Homo sapiens
gaauauucguuggguuuca

SEQ ID NO: 894492 - RNA, 19 nt, Homo sapiens
gauccacuuuaucuugauu

SEQ ID NO: 894493 - RNA, 19 nt, Homo sapiens
gaaggcguucagacucuua

SEQ ID NO: 894494 - RNA, 19 nt, Homo sapiens
ucuagaagguagcaaugaa

SEQ ID NO: 894495 - RNA, 19 nt, Homo sapiens
gcaccagcaucgggucuug

SEQ ID NO: 894496 - RNA, 19 nt, Homo sapiens
gagggaggaucaauauugc

SEQ ID NO: 894497 - RNA, 19 nt, Homo sapiens
guguuucuguuccugauaa

SEQ ID NO: 894498 - RNA, 19 nt, Homo sapiens
cuacagaugcagaagguuu

SEQ ID NO: 894499 - RNA, 19 nt, Homo sapiens
ggccucagcuuuggcaaga

SEQ ID NO: 894500 - RNA, 19 nt, Homo sapiens
gaguagaacccacacuugu

SEQ ID NO: 894501 - RNA, 19 nt, Homo sapiens
cagcaccacagccuauaua

SEQ ID NO: 894502 - RNA, 19 nt, Homo sapiens
cugaagcuguuccuccuuu

SEQ ID NO: 894503 - RNA, 19 nt, Homo sapiens
cccgagagauggcuccaaa

SEQ ID NO: 894504 - RNA, 19 nt, Homo sapiens
gauagcacaccucugaaug

SEQ ID NO: 894505 - RNA, 19 nt, Homo sapiens
gaaacagggagaucauuac

SEQ ID NO: 894506 - RNA, 19 nt, Homo sapiens
auugauagcuucggaaaug

SEQ ID NO: 894507 - RNA, 19 nt, Homo sapiens
uauauaagcauccacaaca

SEQ ID NO: 894508 - RNA, 19 nt, Homo sapiens
uaauaaaacucucguccaa

SEQ ID NO: 894509 - RNA, 19 nt, Homo sapiens
caggagugcuauucagugu

SEQ ID NO: 894510 - RNA, 19 nt, Homo sapiens
uucguuggguuucauguua

SEQ ID NO: 894511 - RNA, 19 nt, Homo sapiens
cacuuuaucuugauuaguc

SEQ ID NO: 894512 - RNA, 19 nt, Homo sapiens
ggauacugaucucuagaag

SEQ ID NO: 894513 - RNA, 19 nt, Homo sapiens
ggaggggucuacauacaaa

SEQ ID NO: 894514 - RNA, 19 nt, Homo sapiens
ugaagagcagaaagaauuu

SEQ ID NO: 894515 - RNA, 19 nt, Homo sapiens
ggauagcacaccucugaau

SEQ ID NO: 894516 - RNA, 19 nt, Homo sapiens
uuucuuggauccacuuuau

SEQ ID NO: 894517 - RNA, 19 nt, Homo sapiens
ggaagagcuggacugauga

SEQ ID NO: 894518 - RNA, 19 nt, Homo sapiens
ugaggauacugaucucuag

SEQ ID NO: 894519 - RNA, 19 nt, Homo sapiens
ccugaaggauuacgcuguu

SEQ ID NO: 894520 - RNA, 19 nt, Homo sapiens
gaacggagggaggaucaau

SEQ ID NO: 894521 - RNA, 19 nt, Homo sapiens
uggauccacuuuaucuuga

SEQ ID NO: 894522 - RNA, 19 nt, Homo sapiens
augaagagcagaaagaauu

SEQ ID NO: 894523 - RNA, 19 nt, Homo sapiens
cugaugcucuuccugauuc

SEQ ID NO: 894524 - RNA, 19 nt, Homo sapiens
cuucugaccuccgcuaaga

SEQ ID NO: 894525 - RNA, 19 nt, Homo sapiens
gugccuggaugauugauag

SEQ ID NO: 894526 - RNA, 19 nt, Homo sapiens
uaggguguauuucuacuuc

SEQ ID NO: 894527 - RNA, 19 nt, Homo sapiens
auaaaacucucguccaauu

SEQ ID NO: 894528 - RNA, 19 nt, Homo sapiens
caccucugguucuacuaua

SEQ ID NO: 894529 - RNA, 19 nt, Homo sapiens
uuaaugaagagcagaaaga

SEQ ID NO: 894530 - RNA, 19 nt, Homo sapiens
ucucaugcauaguuguuga

SEQ ID NO: 894531 - RNA, 19 nt, Homo sapiens
ggagugaugcugccucucu

SEQ ID NO: 894532 - RNA, 19 nt, Homo sapiens
gggcugucacgucuugaua

SEQ ID NO: 894533 - RNA, 19 nt, Homo sapiens
caaccaggccuugcagaug

SEQ ID NO: 894534 - RNA, 19 nt, Homo sapiens
caacacgagcugugaucuu

SEQ ID NO: 894535 - RNA, 19 nt, Homo sapiens
gcugugauguaggguguau

SEQ ID NO: 894536 - RNA, 19 nt, Homo sapiens
cuggauagcacaccucuga

SEQ ID NO: 894537 - RNA, 19 nt, Homo sapiens
ugagaaacaucagaagaac

SEQ ID NO: 894538 - RNA, 19 nt, Homo sapiens
aaccaguacuugcaauuca

SEQ ID NO: 894539 - RNA, 19 nt, Homo sapiens
guaaccaguacuugcaauu

SEQ ID NO: 894540 - RNA, 19 nt, Homo sapiens
gagugaugcugccucucuu

SEQ ID NO: 894541 - RNA, 19 nt, Homo sapiens
uaaugaagagcagaaagaa

SEQ ID NO: 894542 - RNA, 19 nt, Homo sapiens
gacuuucacugaugcucuu

SEQ ID NO: 894543 - RNA, 19 nt, Homo sapiens
gaagggugaccagugaaga

SEQ ID NO: 894544 - RNA, 19 nt, Homo sapiens
ugcuacagaugaaugcuuu

SEQ ID NO: 894545 - RNA, 19 nt, Homo sapiens
caauucacacuggcugaua

SEQ ID NO: 894546 - RNA, 19 nt, Homo sapiens
gaagguuucucuggauagc

SEQ ID NO: 894547 - RNA, 19 nt, Homo sapiens
gggaggaucaauauugcuu

SEQ ID NO: 894548 - RNA, 19 nt, Homo sapiens
ucuguaccauggagaaguu

SEQ ID NO: 894549 - RNA, 19 nt, Homo sapiens
uggcugauauggcaacaag

SEQ ID NO: 894550 - RNA, 19 nt, Homo sapiens
gcaccacagccuauauaag

SEQ ID NO: 894551 - RNA, 19 nt, Homo sapiens
acacuuaacuggauuuugg

SEQ ID NO: 894552 - RNA, 19 nt, Homo sapiens
gagauggcuccaaauaugg

SEQ ID NO: 894553 - RNA, 19 nt, Homo sapiens
cuccuaagcugugauguag

SEQ ID NO: 894554 - RNA, 19 nt, Homo sapiens
aacaucagaagaacacaua

SEQ ID NO: 894555 - RNA, 19 nt, Homo sapiens
ggaccugcacccugugugu

SEQ ID NO: 894556 - RNA, 19 nt, Homo sapiens
caagcucuuugcuacagau

SEQ ID NO: 894557 - RNA, 19 nt, Homo sapiens
aggaacagaggcacaaauu

SEQ ID NO: 894558 - RNA, 19 nt, Homo sapiens
gggucuacauacaaacaga

SEQ ID NO: 894559 - RNA, 19 nt, Homo sapiens
gaagcuguuccuccuuuua

SEQ ID NO: 894560 - RNA, 19 nt, Homo sapiens
gcaaagagccugcgcaaau

SEQ ID NO: 894561 - RNA, 19 nt, Homo sapiens
gaacaacaauauucaccaa

SEQ ID NO: 894562 - RNA, 19 nt, Homo sapiens
cauaagggcuuucgaacaa

SEQ ID NO: 894563 - RNA, 19 nt, Homo sapiens
gaucgugacucccacugua

SEQ ID NO: 894564 - RNA, 19 nt, Homo sapiens
gcacaccuguuuaacuuug

SEQ ID NO: 894565 - RNA, 19 nt, Homo sapiens
caaaugcugucaccgauau

SEQ ID NO: 894566 - RNA, 19 nt, Homo sapiens
gaaagcaauuggaucacaa

SEQ ID NO: 894567 - RNA, 19 nt, Homo sapiens
ggcaguauaucuuuguuaa

SEQ ID NO: 894568 - RNA, 19 nt, Homo sapiens
ggaaggcggaauaaacuua

SEQ ID NO: 894569 - RNA, 19 nt, Homo sapiens
caacaauauucaccaauuc

SEQ ID NO: 894570 - RNA, 19 nt, Homo sapiens
ugaaggaccucuccagaau

SEQ ID NO: 894571 - RNA, 19 nt, Homo sapiens
ugaaguggauggucccuuu

SEQ ID NO: 894572 - RNA, 19 nt, Homo sapiens
caaagagccugcgcaaaug

SEQ ID NO: 894573 - RNA, 19 nt, Homo sapiens
gaggagagcaugaaugaga

SEQ ID NO: 894574 - RNA, 19 nt, Homo sapiens
caaaccaccucuugacaau

SEQ ID NO: 894575 - RNA, 19 nt, Homo sapiens
gcaccggucauucuuuaua

SEQ ID NO: 894576 - RNA, 19 nt, Homo sapiens
ggagugaucaugacaauag

SEQ ID NO: 894577 - RNA, 19 nt, Homo sapiens
acagaagauuuccuaagua

SEQ ID NO: 894578 - RNA, 19 nt, Homo sapiens
gaaacacgacaguggagua

SEQ ID NO: 894579 - RNA, 19 nt, Homo sapiens
gaaggaaggcggaauaaac

SEQ ID NO: 894580 - RNA, 19 nt, Homo sapiens
guuaccaucuccugaguuu

SEQ ID NO: 894581 - RNA, 19 nt, Homo sapiens
acaauagccuugauucuca

SEQ ID NO: 894582 - RNA, 19 nt, Homo sapiens
cagaagauuuccuaaguag

SEQ ID NO: 894583 - RNA, 19 nt, Homo sapiens
gauuucuucuccauucaua

SEQ ID NO: 894584 - RNA, 19 nt, Homo sapiens
cacagaagauuuccuaagu

SEQ ID NO: 894585 - RNA, 19 nt, Homo sapiens
gguuugagcagucacuuua

SEQ ID NO: 894586 - RNA, 19 nt, Homo sapiens
gaaaggauccuccgguuuu

SEQ ID NO: 894587 - RNA, 19 nt, Homo sapiens
gcccauggauccuuucuca

SEQ ID NO: 894588 - RNA, 19 nt, Homo sapiens
gcauucaacuucguuacuu

SEQ ID NO: 894589 - RNA, 19 nt, Homo sapiens
ggacagcaauauuguuggu

SEQ ID NO: 894590 - RNA, 19 nt, Homo sapiens
gcaagugugcagagucuuu

SEQ ID NO: 894591 - RNA, 19 nt, Homo sapiens
caaauacuacuacacaaga

SEQ ID NO: 894592 - RNA, 19 nt, Homo sapiens
gcaaaugcugucaccgaua

SEQ ID NO: 894593 - RNA, 19 nt, Homo sapiens
cgacaaauacuacuacaca

SEQ ID NO: 894594 - RNA, 19 nt, Homo sapiens
uagcagagguuuggugguu

SEQ ID NO: 894595 - RNA, 19 nt, Homo sapiens
gagcagucacuuuaggaua

SEQ ID NO: 894596 - RNA, 19 nt, Homo sapiens
ugaaguggcugugcugguu

SEQ ID NO: 894597 - RNA, 19 nt, Homo sapiens
cagaggagagcaugaauga

SEQ ID NO: 894598 - RNA, 19 nt, Homo sapiens
gcagagguuuggugguuca

SEQ ID NO: 894599 - RNA, 19 nt, Homo sapiens
aacaggagauggaggaauu

SEQ ID NO: 894600 - RNA, 19 nt, Homo sapiens
gacaaauacuacuacacaa

SEQ ID NO: 894601 - RNA, 19 nt, Homo sapiens
cagcagaagguugugauua

SEQ ID NO: 894602 - RNA, 19 nt, Homo sapiens
caucauugcacaccuguuu

SEQ ID NO: 894603 - RNA, 19 nt, Homo sapiens
gcucucugcuugaauuuua

SEQ ID NO: 894604 - RNA, 19 nt, Homo sapiens
ggaugggacagcaauauug

SEQ ID NO: 894605 - RNA, 19 nt, Homo sapiens
ugaaauccaucugguacaa

SEQ ID NO: 894606 - RNA, 19 nt, Homo sapiens
guggaugccuuccugaaau

SEQ ID NO: 894607 - RNA, 19 nt, Homo sapiens
guuuggugguucagaguua

SEQ ID NO: 894608 - RNA, 19 nt, Homo sapiens
gaauaaggacgguaaucug

SEQ ID NO: 894609 - RNA, 19 nt, Homo sapiens
gaauaaggacgguaaucug

SEQ ID NO: 894610 - RNA, 19 nt, Homo sapiens
gaaagguucaauucuacuu

SEQ ID NO: 894611 - RNA, 19 nt, Homo sapiens
gagaaggaaggcggaauaa

SEQ ID NO: 894612 - RNA, 19 nt, Homo sapiens
uggaugccuuccugaaaua

SEQ ID NO: 894613 - RNA, 19 nt, Homo sapiens
caaucucucuccuggaaug

SEQ ID NO: 894614 - RNA, 19 nt, Homo sapiens
uugcaccggucauucuuua

SEQ ID NO: 894615 - RNA, 19 nt, Homo sapiens
agcagucacuuuaggauaa

SEQ ID NO: 894616 - RNA, 19 nt, Homo sapiens
ggucauucuuuauaucugu

SEQ ID NO: 894617 - RNA, 19 nt, Homo sapiens
ucacggcauugguggaauu

SEQ ID NO: 894618 - RNA, 19 nt, Homo sapiens
acacgacaguggaguaugu

SEQ ID NO: 894619 - RNA, 19 nt, Homo sapiens
ugagaaagcaauuggauca

SEQ ID NO: 894620 - RNA, 19 nt, Homo sapiens
ugagaaggccgacaaauac

SEQ ID NO: 894621 - RNA, 19 nt, Homo sapiens
gauaagaaugugccucuca

SEQ ID NO: 894622 - RNA, 19 nt, Homo sapiens
ggaauaaggacgguaaucu

SEQ ID NO: 894623 - RNA, 19 nt, Homo sapiens
ggaauaaggacgguaaucu

SEQ ID NO: 894624 - RNA, 19 nt, Homo sapiens
gcaggggacuggacagaaa

SEQ ID NO: 894625 - RNA, 19 nt, Homo sapiens
uugcacaccuguuuaacuu

SEQ ID NO: 894626 - RNA, 19 nt, Homo sapiens
gcacagccagugaggaugu

SEQ ID NO: 894627 - RNA, 19 nt, Homo sapiens
gagcuucagcaacuuaaga

SEQ ID NO: 894628 - RNA, 19 nt, Homo sapiens
gggcaguauaucuuuguua

SEQ ID NO: 894629 - RNA, 19 nt, Homo sapiens
acauacagcuauucacauc

SEQ ID NO: 894630 - RNA, 19 nt, Homo sapiens
gguuagggcugaauguuuu

SEQ ID NO: 894631 - RNA, 19 nt, Homo sapiens
ccauggauccuuucucaga

SEQ ID NO: 894632 - RNA, 19 nt, Homo sapiens
guucugaaguucuuaaagc

SEQ ID NO: 894633 - RNA, 19 nt, Homo sapiens
agagaaggaaggcggaaua

SEQ ID NO: 894634 - RNA, 19 nt, Homo sapiens
gugauuaccaagguuguua

SEQ ID NO: 894635 - RNA, 19 nt, Homo sapiens
guucaauucuacuucaaca

SEQ ID NO: 894636 - RNA, 19 nt, Homo sapiens
gaaauccaucugguacaaa

SEQ ID NO: 894637 - RNA, 19 nt, Homo sapiens
ccaaaccaccucuugacaa

SEQ ID NO: 894638 - RNA, 19 nt, Homo sapiens
augagaaggccgacaaaua

SEQ ID NO: 894639 - RNA, 19 nt, Homo sapiens
aaauccaucugguacaaau

SEQ ID NO: 894640 - RNA, 19 nt, Homo sapiens
caccggucauucuuuauau

SEQ ID NO: 894641 - RNA, 19 nt, Homo sapiens
aaacagaggagagcaugaa

SEQ ID NO: 894642 - RNA, 19 nt, Homo sapiens
acaagcugguggccuauau

SEQ ID NO: 894643 - RNA, 19 nt, Homo sapiens
gacaaugaguuuucuacaa

SEQ ID NO: 894644 - RNA, 19 nt, Homo sapiens
ggagaccaaugugggacaa

SEQ ID NO: 894645 - RNA, 19 nt, Homo sapiens
ugacaaggccacugacauc

SEQ ID NO: 894646 - RNA, 19 nt, Homo sapiens
gauggaggaauuaggcaaa

SEQ ID NO: 894647 - RNA, 19 nt, Homo sapiens
guuucugguuguuugguua

SEQ ID NO: 894648 - RNA, 19 nt, Homo sapiens
uuaccaagguuguuaugca

SEQ ID NO: 894649 - RNA, 19 nt, Homo sapiens
gacaauagccuugauucuc

SEQ ID NO: 894650 - RNA, 19 nt, Homo sapiens
gcacacugagaaagcaauu

SEQ ID NO: 894651 - RNA, 19 nt, Homo sapiens
guguacauguuuacuguca

SEQ ID NO: 894652 - RNA, 19 nt, Homo sapiens
cucaaucucucuccuggaa

SEQ ID NO: 894653 - RNA, 19 nt, Homo sapiens
guacauguuuacugucacu

SEQ ID NO: 894654 - RNA, 19 nt, Homo sapiens
caucgugacaggucugaaa

SEQ ID NO: 894655 - RNA, 19 nt, Homo sapiens
ggaggaauuaggcaaagug

SEQ ID NO: 894656 - RNA, 19 nt, Homo sapiens
gugaggauguuuuccagua

SEQ ID NO: 894657 - RNA, 19 nt, Homo sapiens
ugaaaggauccuccgguuu

SEQ ID NO: 894658 - RNA, 19 nt, Homo sapiens
caugguaacuucagcuacu

SEQ ID NO: 894659 - RNA, 19 nt, Homo sapiens
gcugguggccuauaugauc

SEQ ID NO: 894660 - RNA, 19 nt, Homo sapiens
gcacaccuguuuaacuuug

SEQ ID NO: 894661 - RNA, 19 nt, Homo sapiens
gaaagcaauuggaucacaa

SEQ ID NO: 894662 - RNA, 19 nt, Homo sapiens
caaaccaccucuugacaau

SEQ ID NO: 894663 - RNA, 19 nt, Homo sapiens
caaauacuacuacacaaga

SEQ ID NO: 894664 - RNA, 19 nt, Homo sapiens
cgacaaauacuacuacaca

SEQ ID NO: 894665 - RNA, 19 nt, Homo sapiens
gacaaauacuacuacacaa

SEQ ID NO: 894666 - RNA, 19 nt, Homo sapiens
caucauugcacaccuguuu

SEQ ID NO: 894667 - RNA, 19 nt, Homo sapiens
gcucucugcuugaauuuua

SEQ ID NO: 894668 - RNA, 19 nt, Homo sapiens
guggaugccuuccugaaau

SEQ ID NO: 894669 - RNA, 19 nt, Homo sapiens
uggaugccuuccugaaaua

SEQ ID NO: 894670 - RNA, 19 nt, Homo sapiens
ugagaaagcaauuggauca

SEQ ID NO: 894671 - RNA, 19 nt, Homo sapiens
ugagaaggccgacaaauac

SEQ ID NO: 894672 - RNA, 19 nt, Homo sapiens
uugcacaccuguuuaacuu

SEQ ID NO: 894673 - RNA, 19 nt, Homo sapiens
acauacagcuauucacauc

SEQ ID NO: 894674 - RNA, 19 nt, Homo sapiens
gguuagggcugaauguuuu

SEQ ID NO: 894675 - RNA, 19 nt, Homo sapiens
augagaaggccgacaaaua

SEQ ID NO: 894676 - RNA, 19 nt, Homo sapiens
ccaaaccaccucuugacaa

SEQ ID NO: 894677 - RNA, 19 nt, Homo sapiens
acaagcugguggccuauau

SEQ ID NO: 894678 - RNA, 19 nt, Homo sapiens
gcacacugagaaagcaauu

SEQ ID NO: 894679 - RNA, 19 nt, Homo sapiens
guuucugguuguuugguua

SEQ ID NO: 894680 - RNA, 19 nt, Homo sapiens
guguacauguuuacuguca

SEQ ID NO: 894681 - RNA, 19 nt, Homo sapiens
guacauguuuacugucacu

SEQ ID NO: 894682 - RNA, 19 nt, Homo sapiens
gcugguggccuauaugauc

SEQ ID NO: 894683 - RNA, 19 nt, Homo sapiens
gauccugcuuccugugugu

SEQ ID NO: 894684 - RNA, 19 nt, Homo sapiens
agaaagcaauuggaucaca

SEQ ID NO: 894685 - RNA, 19 nt, Homo sapiens
cuacauacagcuauucaca

SEQ ID NO: 894686 - RNA, 19 nt, Homo sapiens
ucauugcacaccuguuuaa

SEQ ID NO: 894687 - RNA, 19 nt, Homo sapiens
caaccucaccuuccacaag

SEQ ID NO: 894688 - RNA, 19 nt, Homo sapiens
gcaaucugcuguccuuccu

SEQ ID NO: 894689 - RNA, 19 nt, Homo sapiens
ucugcucucugcuugaauu

SEQ ID NO: 894690 - RNA, 19 nt, Homo sapiens
gcuccaaaccaccucuuga

SEQ ID NO: 894691 - RNA, 19 nt, Homo sapiens
cgucugcucucugcuugaa

SEQ ID NO: 894692 - RNA, 19 nt, Homo sapiens
auacagcuauucacaucau

SEQ ID NO: 894693 - RNA, 19 nt, Homo sapiens
ugcugaaucuucccuguug

SEQ ID NO: 894694 - RNA, 19 nt, Homo sapiens
augggaaacugggugguua

SEQ ID NO: 894695 - RNA, 19 nt, Homo sapiens
gaaggccgacaaauacuac

SEQ ID NO: 894696 - RNA, 19 nt, Homo sapiens
ucuccagccuaucucauga

SEQ ID NO: 894697 - RNA, 19 nt, Homo sapiens
gcugaauguuuuccuguuu

SEQ ID NO: 894698 - RNA, 19 nt, Homo sapiens
uccauucucuccagccuau

SEQ ID NO: 894699 - RNA, 19 nt, Homo sapiens
guuuaacuuugacugcuau

SEQ ID NO: 894700 - RNA, 19 nt, Homo sapiens
aaccaccucuugacaaugg

SEQ ID NO: 894701 - RNA, 19 nt, Homo sapiens
cagugugaacagcaauuua

SEQ ID NO: 894702 - RNA, 19 nt, Homo sapiens
ggucuuauccagugugaac

SEQ ID NO: 894703 - RNA, 19 nt, Homo sapiens
agaaggccgacaaauacua

SEQ ID NO: 894704 - RNA, 19 nt, Homo sapiens
uguuuaacuuugacugcua

SEQ ID NO: 894705 - RNA, 19 nt, Homo sapiens
uauccagugugaacagcaa

SEQ ID NO: 894706 - RNA, 19 nt, Homo sapiens
gaagccgacaggccacaga

SEQ ID NO: 894707 - RNA, 19 nt, Homo sapiens
ccagugugaacagcaauuu

SEQ ID NO: 894708 - RNA, 19 nt, Homo sapiens
gucgcaaucugcuguccuu

SEQ ID NO: 894709 - RNA, 19 nt, Homo sapiens
acaaauacuacuacacaag

SEQ ID NO: 894710 - RNA, 19 nt, Homo sapiens
gagaaggccgacaaauacu

SEQ ID NO: 894711 - RNA, 19 nt, Homo sapiens
augccuuccugaaauauga

SEQ ID NO: 894712 - RNA, 19 nt, Homo sapiens
cauguuuacugucacuuuu

SEQ ID NO: 894713 - RNA, 19 nt, Homo sapiens
gaggggcaccugcucauuu

SEQ ID NO: 894714 - RNA, 19 nt, Homo sapiens
gugugaacagcaauuuauu

SEQ ID NO: 894715 - RNA, 19 nt, Homo sapiens
agugugaacagcaauuuau

SEQ ID NO: 894716 - RNA, 19 nt, Homo sapiens
gccgacaaauacuacuaca

SEQ ID NO: 894717 - RNA, 19 nt, Homo sapiens
aauaugagaaggccgacaa

SEQ ID NO: 894718 - RNA, 19 nt, Homo sapiens
aagcugguggccuauauga

SEQ ID NO: 894719 - RNA, 19 nt, Homo sapiens
gcaaagagccugcgcaaau

SEQ ID NO: 894720 - RNA, 19 nt, Homo sapiens
gaacaacaauauucaccaa

SEQ ID NO: 894721 - RNA, 19 nt, Homo sapiens
cauaagggcuuucgaacaa

SEQ ID NO: 894722 - RNA, 19 nt, Homo sapiens
gaucgugacucccacugua

SEQ ID NO: 894723 - RNA, 19 nt, Homo sapiens
gcacaccuguuuaacuuug

SEQ ID NO: 894724 - RNA, 19 nt, Homo sapiens
caaaugcugucaccgauau

SEQ ID NO: 894725 - RNA, 19 nt, Homo sapiens
gaaagcaauuggaucacaa

SEQ ID NO: 894726 - RNA, 19 nt, Homo sapiens
ggcaguauaucuuuguuaa

SEQ ID NO: 894727 - RNA, 19 nt, Homo sapiens
caacaauauucaccaauuc

SEQ ID NO: 894728 - RNA, 19 nt, Homo sapiens
ugaaguggauggucccuuu

SEQ ID NO: 894729 - RNA, 19 nt, Homo sapiens
caaagagccugcgcaaaug

SEQ ID NO: 894730 - RNA, 19 nt, Homo sapiens
gaggagagcaugaaugaga

SEQ ID NO: 894731 - RNA, 19 nt, Homo sapiens
caaaccaccucuugacaau

SEQ ID NO: 894732 - RNA, 19 nt, Homo sapiens
gcaccggucauucuuuaua

SEQ ID NO: 894733 - RNA, 19 nt, Homo sapiens
ggagugaucaugacaauag

SEQ ID NO: 894734 - RNA, 19 nt, Homo sapiens
gaaacacgacaguggagua

SEQ ID NO: 894735 - RNA, 19 nt, Homo sapiens
acaauagccuugauucuca

SEQ ID NO: 894736 - RNA, 19 nt, Homo sapiens
gauuucuucuccauucaua

SEQ ID NO: 894737 - RNA, 19 nt, Homo sapiens
gguuugagcagucacuuua

SEQ ID NO: 894738 - RNA, 19 nt, Homo sapiens
gaaaggauccuccgguuuu

SEQ ID NO: 894739 - RNA, 19 nt, Homo sapiens
gcaagugugcagagucuuu

SEQ ID NO: 894740 - RNA, 19 nt, Homo sapiens
caaauacuacuacacaaga

SEQ ID NO: 894741 - RNA, 19 nt, Homo sapiens
gcaaaugcugucaccgaua

SEQ ID NO: 894742 - RNA, 19 nt, Homo sapiens
cgacaaauacuacuacaca

SEQ ID NO: 894743 - RNA, 19 nt, Homo sapiens
gagcagucacuuuaggaua

SEQ ID NO: 894744 - RNA, 19 nt, Homo sapiens
ugaaguggcugugcugguu

SEQ ID NO: 894745 - RNA, 19 nt, Homo sapiens
cagaggagagcaugaauga

SEQ ID NO: 894746 - RNA, 19 nt, Homo sapiens
gacaaauacuacuacacaa

SEQ ID NO: 894747 - RNA, 19 nt, Homo sapiens
cagcagaagguugugauua

SEQ ID NO: 894748 - RNA, 19 nt, Homo sapiens
caucauugcacaccuguuu

SEQ ID NO: 894749 - RNA, 19 nt, Homo sapiens
gcucucugcuugaauuuua

SEQ ID NO: 894750 - RNA, 19 nt, Homo sapiens
ugaaauccaucugguacaa

SEQ ID NO: 894751 - RNA, 19 nt, Homo sapiens
guggaugccuuccugaaau

SEQ ID NO: 894752 - RNA, 19 nt, Homo sapiens
gaauaaggacgguaaucug

SEQ ID NO: 894753 - RNA, 19 nt, Homo sapiens
gaaagguucaauucuacuu

SEQ ID NO: 894754 - RNA, 19 nt, Homo sapiens
uggaugccuuccugaaaua

SEQ ID NO: 894755 - RNA, 19 nt, Homo sapiens
caaucucucuccuggaaug

SEQ ID NO: 894756 - RNA, 19 nt, Homo sapiens
uugcaccggucauucuuua

SEQ ID NO: 894757 - RNA, 19 nt, Homo sapiens
agcagucacuuuaggauaa

SEQ ID NO: 894758 - RNA, 19 nt, Homo sapiens
ggucauucuuuauaucugu

SEQ ID NO: 894759 - RNA, 19 nt, Homo sapiens
ucacggcauugguggaauu

SEQ ID NO: 894760 - RNA, 19 nt, Homo sapiens
acacgacaguggaguaugu

SEQ ID NO: 894761 - RNA, 19 nt, Homo sapiens
ugagaaagcaauuggauca

SEQ ID NO: 894762 - RNA, 19 nt, Homo sapiens
ugagaaggccgacaaauac

SEQ ID NO: 894763 - RNA, 19 nt, Homo sapiens
gauaagaaugugccucuca

SEQ ID NO: 894764 - RNA, 19 nt, Homo sapiens
ggaauaaggacgguaaucu

SEQ ID NO: 894765 - RNA, 19 nt, Homo sapiens
gcaggggacuggacagaaa

SEQ ID NO: 894766 - RNA, 19 nt, Homo sapiens
uugcacaccuguuuaacuu

SEQ ID NO: 894767 - RNA, 19 nt, Homo sapiens
gcacagccagugaggaugu

SEQ ID NO: 894768 - RNA, 19 nt, Homo sapiens
gguuagggcugaauguuuu

SEQ ID NO: 894769 - RNA, 19 nt, Homo sapiens
gggcaguauaucuuuguua

SEQ ID NO: 894770 - RNA, 19 nt, Homo sapiens
acauacagcuauucacauc

SEQ ID NO: 894771 - RNA, 19 nt, Homo sapiens
gugauuaccaagguuguua

SEQ ID NO: 894772 - RNA, 19 nt, Homo sapiens
guucaauucuacuucaaca

SEQ ID NO: 894773 - RNA, 19 nt, Homo sapiens
gaaauccaucugguacaaa

SEQ ID NO: 894774 - RNA, 19 nt, Homo sapiens
ccaaaccaccucuugacaa

SEQ ID NO: 894775 - RNA, 19 nt, Homo sapiens
augagaaggccgacaaaua

SEQ ID NO: 894776 - RNA, 19 nt, Homo sapiens
aaauccaucugguacaaau

SEQ ID NO: 894777 - RNA, 19 nt, Homo sapiens
caccggucauucuuuauau

SEQ ID NO: 894778 - RNA, 19 nt, Homo sapiens
aaacagaggagagcaugaa

SEQ ID NO: 894779 - RNA, 19 nt, Homo sapiens
acaagcugguggccuauau

SEQ ID NO: 894780 - RNA, 19 nt, Homo sapiens
gacaaugaguuuucuacaa

SEQ ID NO: 894781 - RNA, 19 nt, Homo sapiens
ggagaccaaugugggacaa

SEQ ID NO: 894782 - RNA, 19 nt, Homo sapiens
ugacaaggccacugacauc

SEQ ID NO: 894783 - RNA, 19 nt, Homo sapiens
uuaccaagguuguuaugca

SEQ ID NO: 894784 - RNA, 19 nt, Homo sapiens
guuucugguuguuugguua

SEQ ID NO: 894785 - RNA, 19 nt, Homo sapiens
gacaauagccuugauucuc

SEQ ID NO: 894786 - RNA, 19 nt, Homo sapiens
gcacacugagaaagcaauu

SEQ ID NO: 894787 - RNA, 19 nt, Homo sapiens
cucaaucucucuccuggaa

SEQ ID NO: 894788 - RNA, 19 nt, Homo sapiens
caucgugacaggucugaaa

SEQ ID NO: 894789 - RNA, 19 nt, Homo sapiens
gugaggauguuuuccagua

SEQ ID NO: 894790 - RNA, 19 nt, Homo sapiens
ugaaaggauccuccgguuu

SEQ ID NO: 894791 - RNA, 19 nt, Homo sapiens
caugguaacuucagcuacu

SEQ ID NO: 894792 - RNA, 19 nt, Homo sapiens
gcugguggccuauaugauc

SEQ ID NO: 894793 - RNA, 19 nt, Homo sapiens
gauccugcuuccugugugu

SEQ ID NO: 894794 - RNA, 19 nt, Homo sapiens
auaagaaugugccucucaa

SEQ ID NO: 894795 - RNA, 19 nt, Homo sapiens
uaagggcuuucgaacaaca

SEQ ID NO: 894796 - RNA, 19 nt, Homo sapiens
agaaagcaauuggaucaca

SEQ ID NO: 894797 - RNA, 19 nt, Homo sapiens
uaaggacgguaaucugcau

SEQ ID NO: 894798 - RNA, 19 nt, Homo sapiens
caauucuacuucaacaaag

SEQ ID NO: 894799 - RNA, 19 nt, Homo sapiens
gaccaaugugggacaauga

SEQ ID NO: 894800 - RNA, 19 nt, Homo sapiens
cuacauacagcuauucaca

SEQ ID NO: 894801 - RNA, 19 nt, Homo sapiens
gcuccaaaccaccucuuga

SEQ ID NO: 894802 - RNA, 19 nt, Homo sapiens
ucauugcacaccuguuuaa

SEQ ID NO: 894803 - RNA, 19 nt, Homo sapiens
caaccucaccuuccacaag

SEQ ID NO: 894804 - RNA, 19 nt, Homo sapiens
gcaaucugcuguccuuccu

SEQ ID NO: 894805 - RNA, 19 nt, Homo sapiens
ucugcucucugcuugaauu

SEQ ID NO: 894806 - RNA, 19 nt, Homo sapiens
gcagucacuuuaggauaag

SEQ ID NO: 894807 - RNA, 19 nt, Homo sapiens
gaaguggauggucccuuug

SEQ ID NO: 894808 - RNA, 19 nt, Homo sapiens
gaguucauccggaggaguu

SEQ ID NO: 894809 - RNA, 19 nt, Homo sapiens
cgucugcucucugcuugaa

SEQ ID NO: 894810 - RNA, 19 nt, Homo sapiens
ugcugaaucuucccuguug

SEQ ID NO: 894811 - RNA, 19 nt, Homo sapiens
gaaggccgacaaauacuac

SEQ ID NO: 894812 - RNA, 19 nt, Homo sapiens
agaagguugugauuaccaa

SEQ ID NO: 894813 - RNA, 19 nt, Homo sapiens
augggaaacugggugguua

SEQ ID NO: 894814 - RNA, 19 nt, Homo sapiens
auacagcuauucacaucau

SEQ ID NO: 894815 - RNA, 19 nt, Homo sapiens
ggacgguaaucugcauuuu

SEQ ID NO: 894816 - RNA, 19 nt, Homo sapiens
gcugaauguuuuccuguuu

SEQ ID NO: 894817 - RNA, 19 nt, Homo sapiens
caaugugggacaaugaguu

SEQ ID NO: 894818 - RNA, 19 nt, Homo sapiens
gcuucuaucuugaaaucca

SEQ ID NO: 894819 - RNA, 19 nt, Homo sapiens
gggaacagcucaucucuuu

SEQ ID NO: 894820 - RNA, 19 nt, Homo sapiens
ccucagaacuugacuguga

SEQ ID NO: 894821 - RNA, 19 nt, Homo sapiens
ggaggagucugacccugua

SEQ ID NO: 894822 - RNA, 19 nt, Homo sapiens
gaacagcucaucucuuuca

SEQ ID NO: 894823 - RNA, 19 nt, Homo sapiens
gaaaaugcaugccugauga

SEQ ID NO: 894824 - RNA, 19 nt, Homo sapiens
ggaaagagagauccaguau

SEQ ID NO: 894825 - RNA, 19 nt, Homo sapiens
gggagauacuucuuucgua

SEQ ID NO: 894826 - RNA, 19 nt, Homo sapiens
ggaaugauauaagcuggaa

SEQ ID NO: 894827 - RNA, 19 nt, Homo sapiens
aaagagagauccaguaugc

SEQ ID NO: 894828 - RNA, 19 nt, Homo sapiens
gcaccagccucaccuguca

SEQ ID NO: 894829 - RNA, 19 nt, Homo sapiens
caagacaucagaacuuauu

SEQ ID NO: 894830 - RNA, 19 nt, Homo sapiens
aacaagacaucagaacuua

SEQ ID NO: 894831 - RNA, 19 nt, Homo sapiens
caacaagacaucagaacuu

SEQ ID NO: 894832 - RNA, 19 nt, Homo sapiens
agaguaaccggaaggauua

SEQ ID NO: 894833 - RNA, 19 nt, Homo sapiens
gaacuuauuccucuugucu

SEQ ID NO: 894834 - RNA, 19 nt, Homo sapiens
ugaccaaacucucccuuuc

SEQ ID NO: 894835 - RNA, 19 nt, Homo sapiens
ucaaugcugugcaacaaga

SEQ ID NO: 894836 - RNA, 19 nt, Homo sapiens
gaacaggaccauccaacuc

SEQ ID NO: 894837 - RNA, 19 nt, Homo sapiens
cgaauauagugagauugua

SEQ ID NO: 894838 - RNA, 19 nt, Homo sapiens
caagaagccaccaacaaug

SEQ ID NO: 894839 - RNA, 19 nt, Homo sapiens
gaaagagagauccaguaug

SEQ ID NO: 894840 - RNA, 19 nt, Homo sapiens
agaauuagcagcccucaau

SEQ ID NO: 894841 - RNA, 19 nt, Homo sapiens
gaggcugauuccaguagaa

SEQ ID NO: 894842 - RNA, 19 nt, Homo sapiens
ggaugacuacuuuagauuc

SEQ ID NO: 894843 - RNA, 19 nt, Homo sapiens
ccucaaugcugugcaacaa

SEQ ID NO: 894844 - RNA, 19 nt, Homo sapiens
aaggaugacuacuuuagau

SEQ ID NO: 894845 - RNA, 19 nt, Homo sapiens
aagaagccaccaacaauga

SEQ ID NO: 894846 - RNA, 19 nt, Homo sapiens
uggaaggacagaagaguaa

SEQ ID NO: 894847 - RNA, 19 nt, Homo sapiens
aagaguaaccggaaggauu

SEQ ID NO: 894848 - RNA, 19 nt, Homo sapiens
gacugugacugucuuccaa

SEQ ID NO: 894849 - RNA, 19 nt, Homo sapiens
acuuauuccucuugucuaa

SEQ ID NO: 894850 - RNA, 19 nt, Homo sapiens
cagaggcucgggcuuguuu

SEQ ID NO: 894851 - RNA, 19 nt, Homo sapiens
ugugucaucuucauuguag

SEQ ID NO: 894852 - RNA, 19 nt, Homo sapiens
uaaggaugacuacuuuaga

SEQ ID NO: 894853 - RNA, 19 nt, Homo sapiens
cucuaaggaugacuacuuu

SEQ ID NO: 894854 - RNA, 19 nt, Homo sapiens
gcaacaagacaucagaacu

SEQ ID NO: 894855 - RNA, 19 nt, Homo sapiens
gcucagccucucaggguaa

SEQ ID NO: 894856 - RNA, 19 nt, Homo sapiens
gaauuagcagcccucaaug

SEQ ID NO: 894857 - RNA, 19 nt, Homo sapiens
gugagauuguaacgugaaa

SEQ ID NO: 894858 - RNA, 19 nt, Homo sapiens
guggaaggacagaagagua

SEQ ID NO: 894859 - RNA, 19 nt, Homo sapiens
ccacagcccuggucuuccu

SEQ ID NO: 894860 - RNA, 19 nt, Homo sapiens
caugugcgcugcuccuucu

SEQ ID NO: 894861 - RNA, 19 nt, Homo sapiens
ccacaggcccaacauccuu

SEQ ID NO: 894862 - RNA, 19 nt, Homo sapiens
ccaccauucuccucuguac

SEQ ID NO: 894863 - RNA, 19 nt, Homo sapiens
gagaugccagaaugaguga

SEQ ID NO: 894864 - RNA, 19 nt, Homo sapiens
ccgaauauagugagauugu

SEQ ID NO: 894865 - RNA, 19 nt, Homo sapiens
gggcagggaaugauauaag

SEQ ID NO: 894866 - RNA, 19 nt, Homo sapiens
gaugacuacuuuagauucc

SEQ ID NO: 894867 - RNA, 19 nt, Homo sapiens
ggaccgauuccaccuccuu

SEQ ID NO: 894868 - RNA, 19 nt, Homo sapiens
gcccucaaacccucuggua

SEQ ID NO: 894869 - RNA, 19 nt, Homo sapiens
cagaacuuauuccucuugu

SEQ ID NO: 894870 - RNA, 19 nt, Homo sapiens
ucucuaaggaugacuacuu

SEQ ID NO: 894871 - RNA, 19 nt, Homo sapiens
ccucuguacuucucuaagg

SEQ ID NO: 894872 - RNA, 19 nt, Homo sapiens
augcaugccugaugaccaa

SEQ ID NO: 894873 - RNA, 19 nt, Homo sapiens
guauggagaaaggaaauau

SEQ ID NO: 894874 - RNA, 19 nt, Homo sapiens
guacuucucuaaggaugac

SEQ ID NO: 894875 - RNA, 19 nt, Homo sapiens
gaggcucgggcuuguuuga

SEQ ID NO: 894876 - RNA, 19 nt, Homo sapiens
aauaugaccagcucucugu

SEQ ID NO: 894877 - RNA, 19 nt, Homo sapiens
ggcagggaaugauauaagc

SEQ ID NO: 894878 - RNA, 19 nt, Homo sapiens
uuccgaauauagugagauu

SEQ ID NO: 894879 - RNA, 19 nt, Homo sapiens
ucagaacuuauuccucuug

SEQ ID NO: 894880 - RNA, 19 nt, Homo sapiens
ggaccauccaacucaaugu

SEQ ID NO: 894881 - RNA, 19 nt, Homo sapiens
ggacagccagacugacucu

SEQ ID NO: 894882 - RNA, 19 nt, Homo sapiens
gaagaguaaccggaaggau

SEQ ID NO: 894883 - RNA, 19 nt, Homo sapiens
gaagccaccaacaaugagu

SEQ ID NO: 894884 - RNA, 19 nt, Homo sapiens
gaaccucucccugcaacag

SEQ ID NO: 894885 - RNA, 19 nt, Homo sapiens
gaccauccaacucaaugug

SEQ ID NO: 894886 - RNA, 19 nt, Homo sapiens
ccucagugcucacccucau

SEQ ID NO: 894887 - RNA, 19 nt, Homo sapiens
cacaggcccaacauccuua

SEQ ID NO: 894888 - RNA, 19 nt, Homo sapiens
gaugccagaaugagugaug

SEQ ID NO: 894889 - RNA, 19 nt, Homo sapiens
aaaggagucugaggcugau

SEQ ID NO: 894890 - RNA, 19 nt, Homo sapiens
caaaaugaggccuguauca

SEQ ID NO: 894891 - RNA, 19 nt, Homo sapiens
ccucuugucuaacugaaaa

SEQ ID NO: 894892 - RNA, 19 nt, Homo sapiens
ugaggcugauuccaguaga

SEQ ID NO: 894893 - RNA, 19 nt, Homo sapiens
ggaguacacaggcaaaaug

SEQ ID NO: 894894 - RNA, 19 nt, Homo sapiens
acaggaccauccaacucaa

SEQ ID NO: 894895 - RNA, 19 nt, Homo sapiens
gcgcuuggucugugcuguu

SEQ ID NO: 894896 - RNA, 19 nt, Homo sapiens
ggagaaggcacagcaucca

SEQ ID NO: 894897 - RNA, 19 nt, Homo sapiens
uguccuacccuccucagaa

SEQ ID NO: 894898 - RNA, 19 nt, Homo sapiens
agacauaggcaugaaggau

SEQ ID NO: 894899 - RNA, 19 nt, Homo sapiens
guccuacccuccucagaac

SEQ ID NO: 894900 - RNA, 19 nt, Homo sapiens
gggaacagcucaucucuuu

SEQ ID NO: 894901 - RNA, 19 nt, Homo sapiens
ccucagaacuugacuguga

SEQ ID NO: 894902 - RNA, 19 nt, Homo sapiens
ggaggagucugacccugua

SEQ ID NO: 894903 - RNA, 19 nt, Homo sapiens
gaacagcucaucucuuuca

SEQ ID NO: 894904 - RNA, 19 nt, Homo sapiens
gaaaaugcaugccugauga

SEQ ID NO: 894905 - RNA, 19 nt, Homo sapiens
ggaaagagagauccaguau

SEQ ID NO: 894906 - RNA, 19 nt, Homo sapiens
gggagauacuucuuucgua

SEQ ID NO: 894907 - RNA, 19 nt, Homo sapiens
ggaaugauauaagcuggaa

SEQ ID NO: 894908 - RNA, 19 nt, Homo sapiens
aaagagagauccaguaugc

SEQ ID NO: 894909 - RNA, 19 nt, Homo sapiens
caagacaucagaacuuauu

SEQ ID NO: 894910 - RNA, 19 nt, Homo sapiens
aacaagacaucagaacuua

SEQ ID NO: 894911 - RNA, 19 nt, Homo sapiens
caacaagacaucagaacuu

SEQ ID NO: 894912 - RNA, 19 nt, Homo sapiens
ugacagacccuccucagaa

SEQ ID NO: 894913 - RNA, 19 nt, Homo sapiens
agaguaaccggaaggauua

SEQ ID NO: 894914 - RNA, 19 nt, Homo sapiens
gaacuuauuccucuugucu

SEQ ID NO: 894915 - RNA, 19 nt, Homo sapiens
ugaccaaacucucccuuuc

SEQ ID NO: 894916 - RNA, 19 nt, Homo sapiens
ucaaugcugugcaacaaga

SEQ ID NO: 894917 - RNA, 19 nt, Homo sapiens
cgaauauagugagauugua

SEQ ID NO: 894918 - RNA, 19 nt, Homo sapiens
caagaagccaccaacaaug

SEQ ID NO: 894919 - RNA, 19 nt, Homo sapiens
gaaagagagauccaguaug

SEQ ID NO: 894920 - RNA, 19 nt, Homo sapiens
agaauuagcagcccucaau

SEQ ID NO: 894921 - RNA, 19 nt, Homo sapiens
gaggcugauuccaguagaa

SEQ ID NO: 894922 - RNA, 19 nt, Homo sapiens
ggaugacuacuuuagauuc

SEQ ID NO: 894923 - RNA, 19 nt, Homo sapiens
ccucaaugcugugcaacaa

SEQ ID NO: 894924 - RNA, 19 nt, Homo sapiens
aaggaugacuacuuuagau

SEQ ID NO: 894925 - RNA, 19 nt, Homo sapiens
uggaaggacagaagaguaa

SEQ ID NO: 894926 - RNA, 19 nt, Homo sapiens
aagaagccaccaacaauga

SEQ ID NO: 894927 - RNA, 19 nt, Homo sapiens
gacagacccuccucagaac

SEQ ID NO: 894928 - RNA, 19 nt, Homo sapiens
aagaguaaccggaaggauu

SEQ ID NO: 894929 - RNA, 19 nt, Homo sapiens
gacugugacugucuuccaa

SEQ ID NO: 894930 - RNA, 19 nt, Homo sapiens
acuuauuccucuugucuaa

SEQ ID NO: 894931 - RNA, 19 nt, Homo sapiens
cagaggcucgggcuuguuu

SEQ ID NO: 894932 - RNA, 19 nt, Homo sapiens
ugugucaucuucauuguag

SEQ ID NO: 894933 - RNA, 19 nt, Homo sapiens
uaaggaugacuacuuuaga

SEQ ID NO: 894934 - RNA, 19 nt, Homo sapiens
cucuaaggaugacuacuuu

SEQ ID NO: 894935 - RNA, 19 nt, Homo sapiens
gcaacaagacaucagaacu

SEQ ID NO: 894936 - RNA, 19 nt, Homo sapiens
gaauuagcagcccucaaug

SEQ ID NO: 894937 - RNA, 19 nt, Homo sapiens
gugagauuguaacgugaaa

SEQ ID NO: 894938 - RNA, 19 nt, Homo sapiens
caugugcgcugcuccuucu

SEQ ID NO: 894939 - RNA, 19 nt, Homo sapiens
guggaaggacagaagagua

SEQ ID NO: 894940 - RNA, 19 nt, Homo sapiens
ccacagcccuggucuuccu

SEQ ID NO: 894941 - RNA, 19 nt, Homo sapiens
ccaccauucuccucuguac

SEQ ID NO: 894942 - RNA, 19 nt, Homo sapiens
gagaugccagaaugaguga

SEQ ID NO: 894943 - RNA, 19 nt, Homo sapiens
ccgaauauagugagauugu

SEQ ID NO: 894944 - RNA, 19 nt, Homo sapiens
gggcagggaaugauauaag

SEQ ID NO: 894945 - RNA, 19 nt, Homo sapiens
gaugacuacuuuagauucc

SEQ ID NO: 894946 - RNA, 19 nt, Homo sapiens
ggaccgauuccaccuccuu

SEQ ID NO: 894947 - RNA, 19 nt, Homo sapiens
gcccucaaacccucuggua

SEQ ID NO: 894948 - RNA, 19 nt, Homo sapiens
cagaacuuauuccucuugu

SEQ ID NO: 894949 - RNA, 19 nt, Homo sapiens
gcucagcucucaggguaac

SEQ ID NO: 894950 - RNA, 19 nt, Homo sapiens
ucucuaaggaugacuacuu

SEQ ID NO: 894951 - RNA, 19 nt, Homo sapiens
ccucuguacuucucuaagg

SEQ ID NO: 894952 - RNA, 19 nt, Homo sapiens
augcaugccugaugaccaa

SEQ ID NO: 894953 - RNA, 19 nt, Homo sapiens
guauggagaaaggaaauau

SEQ ID NO: 894954 - RNA, 19 nt, Homo sapiens
guacuucucuaaggaugac

SEQ ID NO: 894955 - RNA, 19 nt, Homo sapiens
gaggcucgggcuuguuuga

SEQ ID NO: 894956 - RNA, 19 nt, Homo sapiens
ggcagggaaugauauaagc

SEQ ID NO: 894957 - RNA, 19 nt, Homo sapiens
aauaugaccagcucucugu

SEQ ID NO: 894958 - RNA, 19 nt, Homo sapiens
uuccgaauauagugagauu

SEQ ID NO: 894959 - RNA, 19 nt, Homo sapiens
ucagaacuuauuccucuug

SEQ ID NO: 894960 - RNA, 19 nt, Homo sapiens
ggacagccagacugacucu

SEQ ID NO: 894961 - RNA, 19 nt, Homo sapiens
gaagccaccaacaaugagu

SEQ ID NO: 894962 - RNA, 19 nt, Homo sapiens
gaagaguaaccggaaggau

SEQ ID NO: 894963 - RNA, 19 nt, Homo sapiens
gaaccucucccugcaacag

SEQ ID NO: 894964 - RNA, 19 nt, Homo sapiens
gaugccagaaugagugaug

SEQ ID NO: 894965 - RNA, 19 nt, Homo sapiens
aaaggagucugaggcugau

SEQ ID NO: 894966 - RNA, 19 nt, Homo sapiens
caaaaugaggccuguauca

SEQ ID NO: 894967 - RNA, 19 nt, Homo sapiens
ccucuugucuaacugaaaa

SEQ ID NO: 894968 - RNA, 19 nt, Homo sapiens
ugaggcugauuccaguaga

SEQ ID NO: 894969 - RNA, 19 nt, Homo sapiens
ggaguacacaggcaaaaug

SEQ ID NO: 894970 - RNA, 19 nt, Homo sapiens
gcgcuuggucugugcuguu

SEQ ID NO: 894971 - RNA, 19 nt, Homo sapiens
ggagaaggcacagcaucca

SEQ ID NO: 894972 - RNA, 19 nt, Homo sapiens
agacauaggcaugaaggau

SEQ ID NO: 894973 - RNA, 19 nt, Homo sapiens
gauaacacccuacaagaaa

SEQ ID NO: 894974 - RNA, 19 nt, Homo sapiens
gacaaugaguugaguaaug

SEQ ID NO: 894975 - RNA, 19 nt, Homo sapiens
gccaggauauucagaggua

SEQ ID NO: 894976 - RNA, 19 nt, Homo sapiens
ggacugggcccaauuggau

SEQ ID NO: 894977 - RNA, 19 nt, Homo sapiens
cagacugaguaucguaaua

SEQ ID NO: 894978 - RNA, 19 nt, Homo sapiens
gcugugagggccagaauaa

SEQ ID NO: 894979 - RNA, 19 nt, Homo sapiens
uggaggagguggagaaaga

SEQ ID NO: 894980 - RNA, 19 nt, Homo sapiens
gugagaaccucgacaacga

SEQ ID NO: 894981 - RNA, 19 nt, Homo sapiens
ccacagcccuccagcucaa

SEQ ID NO: 894982 - RNA, 19 nt, Homo sapiens
gggcugaccuuccggaucu

SEQ ID NO: 894983 - RNA, 19 nt, Homo sapiens
gagagugagccaccaguaa

SEQ ID NO: 894984 - RNA, 19 nt, Homo sapiens
ggagugaccugccucuacu

SEQ ID NO: 894985 - RNA, 19 nt, Homo sapiens
acaaugaguugaguaaugu

SEQ ID NO: 894986 - RNA, 19 nt, Homo sapiens
ggacagcgaaagacuccua

SEQ ID NO: 894987 - RNA, 19 nt, Homo sapiens
gcaaccacccugcgccuuu

SEQ ID NO: 894988 - RNA, 19 nt, Homo sapiens
gaggugcucuacacaguca

SEQ ID NO: 894989 - RNA, 19 nt, Homo sapiens
ccucugagaucuuuaaacu

SEQ ID NO: 894990 - RNA, 19 nt, Homo sapiens
gcugucggcucggcaagua

SEQ ID NO: 894991 - RNA, 19 nt, Homo sapiens
gacaaggcccugcgcguuu

SEQ ID NO: 894992 - RNA, 19 nt, Homo sapiens
gacaggagggugagaguga

SEQ ID NO: 894993 - RNA, 19 nt, Homo sapiens
ccacaaaaccaaacucuuu

SEQ ID NO: 894994 - RNA, 19 nt, Homo sapiens
gccagaagccaggaucaua

SEQ ID NO: 894995 - RNA, 19 nt, Homo sapiens
gaagccaggaucauagaga

SEQ ID NO: 894996 - RNA, 19 nt, Homo sapiens
gaggagggacagcgaaaga

SEQ ID NO: 894997 - RNA, 19 nt, Homo sapiens
caaccacccugcgccuuug

SEQ ID NO: 894998 - RNA, 19 nt, Homo sapiens
cagauaacacccuacaaga

SEQ ID NO: 894999 - RNA, 19 nt, Homo sapiens
cguaauaagugugaguuuc

SEQ ID NO: 895000 - RNA, 19 nt, Homo sapiens
agacugaguaucguaauaa

SEQ ID NO: 895001 - RNA, 19 nt, Homo sapiens
ccagauaacacccuacaag

SEQ ID NO: 895002 - RNA, 19 nt, Homo sapiens
gaagguaaagagggucauu

SEQ ID NO: 895003 - RNA, 19 nt, Homo sapiens
guaauaagugugaguuucu

SEQ ID NO: 895004 - RNA, 19 nt, Homo sapiens
agauaacacccuacaagaa

SEQ ID NO: 895005 - RNA, 19 nt, Homo sapiens
guuuaccucugagaucuuu

SEQ ID NO: 895006 - RNA, 19 nt, Homo sapiens
ccagggccuuuguggacua

SEQ ID NO: 895007 - RNA, 19 nt, Homo sapiens
gggcagccaugggcaacuu

SEQ ID NO: 895008 - RNA, 19 nt, Homo sapiens
gcauggugcccucuggaaa

SEQ ID NO: 895009 - RNA, 19 nt, Homo sapiens
ccauggccauugccuacuu

SEQ ID NO: 895010 - RNA, 19 nt, Homo sapiens
ccagaagccaggaucauag

SEQ ID NO: 895011 - RNA, 19 nt, Homo sapiens
ugaacgcccaggacaauga

SEQ ID NO: 895012 - RNA, 19 nt, Homo sapiens
ucugagcacuucccuugug

SEQ ID NO: 895013 - RNA, 19 nt, Homo sapiens
ggacaaugaguugaguaau

SEQ ID NO: 895014 - RNA, 19 nt, Homo sapiens
ggugaacgcccaggacaau

SEQ ID NO: 895015 - RNA, 19 nt, Homo sapiens
ccgaggugcucuacacagu

SEQ ID NO: 895016 - RNA, 19 nt, Homo sapiens
cagcagacugaguaucgua

SEQ ID NO: 895017 - RNA, 19 nt, Homo sapiens
uaauaagugugaguuucug

SEQ ID NO: 895018 - RNA, 19 nt, Homo sapiens
gacugaguaucguaauaag

SEQ ID NO: 895019 - RNA, 19 nt, Homo sapiens
gagcacuucccuugugaca

SEQ ID NO: 895020 - RNA, 19 nt, Homo sapiens
cagaagccaggaucauaga

SEQ ID NO: 895021 - RNA, 19 nt, Homo sapiens
cugaguaucguaauaagug

SEQ ID NO: 895022 - RNA, 19 nt, Homo sapiens
ugagagugagccaccagua

SEQ ID NO: 895023 - RNA, 19 nt, Homo sapiens
gaauaaacaacugcucaac

SEQ ID NO: 895024 - RNA, 19 nt, Homo sapiens
gggccagaauaaacaacug

SEQ ID NO: 895025 - RNA, 19 nt, Homo sapiens
ugagugagaaccucgacaa

SEQ ID NO: 895026 - RNA, 19 nt, Homo sapiens
ucaggcggcugcuguacgu

SEQ ID NO: 895027 - RNA, 19 nt, Homo sapiens
uaagugugaguuucugguu

SEQ ID NO: 895028 - RNA, 19 nt, Homo sapiens
ugaguaucguaauaagugu

SEQ ID NO: 895029 - RNA, 19 nt, Homo sapiens
gugcuggcuugcauuccaa

SEQ ID NO: 895030 - RNA, 19 nt, Homo sapiens
ccaggacaaugaguugagu

SEQ ID NO: 895031 - RNA, 19 nt, Homo sapiens
gugagggccagaauaaaca

SEQ ID NO: 895032 - RNA, 19 nt, Homo sapiens
acaggccacuucccuugug

SEQ ID NO: 895033 - RNA, 19 nt, Homo sapiens
ugaccugccucuacuucgu

SEQ ID NO: 895034 - RNA, 19 nt, Homo sapiens
cugagcacuucccuuguga

SEQ ID NO: 895035 - RNA, 19 nt, Homo sapiens
gcagacugaguaucguaau

SEQ ID NO: 895036 - RNA, 19 nt, Homo sapiens
agaauaaacaacugcucaa

SEQ ID NO: 895037 - RNA, 19 nt, Homo sapiens
gugagcaccuccccucuga

SEQ ID NO: 895038 - RNA, 19 nt, Homo sapiens
uuaccucugagaucuuuaa

SEQ ID NO: 895039 - RNA, 19 nt, Homo sapiens
cagccgaggugcucuacac

SEQ ID NO: 895040 - RNA, 19 nt, Homo sapiens
gcagccaaagggcacagaa

SEQ ID NO: 895041 - RNA, 19 nt, Homo sapiens
ggagggacagcgaaagacu

SEQ ID NO: 895042 - RNA, 19 nt, Homo sapiens
caggccacuucccuuguga

SEQ ID NO: 895043 - RNA, 19 nt, Homo sapiens
gagugagccaccaguaaca

SEQ ID NO: 895044 - RNA, 19 nt, Homo sapiens
ucagagguaggcagccaaa

SEQ ID NO: 895045 - RNA, 19 nt, Homo sapiens
gcagccaugggcaacuuug

SEQ ID NO: 895046 - RNA, 19 nt, Homo sapiens
ccugggcgaugagugagaa

SEQ ID NO: 895047 - RNA, 19 nt, Homo sapiens
gaacguaucuuauauggau

SEQ ID NO: 895048 - RNA, 19 nt, Homo sapiens
gaauacaacugacuuuaug

SEQ ID NO: 895049 - RNA, 19 nt, Homo sapiens
gaugauagcuucaaggaau

SEQ ID NO: 895050 - RNA, 19 nt, Homo sapiens
gcaaauauacuucugcaaa

SEQ ID NO: 895051 - RNA, 19 nt, Homo sapiens
gaaaggaaguagaaauuac

SEQ ID NO: 895052 - RNA, 19 nt, Homo sapiens
ggagauauucuacuucuaa

SEQ ID NO: 895053 - RNA, 19 nt, Homo sapiens
caaggaacguaucuuauau

SEQ ID NO: 895054 - RNA, 19 nt, Homo sapiens
gaacagcagucgcaucuac

SEQ ID NO: 895055 - RNA, 19 nt, Homo sapiens
caaccacacuucaggaauu

SEQ ID NO: 895056 - RNA, 19 nt, Homo sapiens
caacugacuuuaugauaug

SEQ ID NO: 895057 - RNA, 19 nt, Homo sapiens
ggaaagagaggcuugagaa

SEQ ID NO: 895058 - RNA, 19 nt, Homo sapiens
augaagaccucucuaauuu

SEQ ID NO: 895059 - RNA, 19 nt, Homo sapiens
caagaagaauuucgagaug

SEQ ID NO: 895060 - RNA, 19 nt, Homo sapiens
gcaacuggaggaauacuua

SEQ ID NO: 895061 - RNA, 19 nt, Homo sapiens
ggacagcuguugaaaagua

SEQ ID NO: 895062 - RNA, 19 nt, Homo sapiens
cgaaacauaaguugcauua

SEQ ID NO: 895063 - RNA, 19 nt, Homo sapiens
ucaaggaacguaucuuaua

SEQ ID NO: 895064 - RNA, 19 nt, Homo sapiens
cuucaucacuuucaucuuu

SEQ ID NO: 895065 - RNA, 19 nt, Homo sapiens
gaauuguucuuggagauuu

SEQ ID NO: 895066 - RNA, 19 nt, Homo sapiens
uaaacaagguuaugucauc

SEQ ID NO: 895067 - RNA, 19 nt, Homo sapiens
gcagucgcaucuacuauga

SEQ ID NO: 895068 - RNA, 19 nt, Homo sapiens
gaaauuacaaccacacuuc

SEQ ID NO: 895069 - RNA, 19 nt, Homo sapiens
gaggaauacuuacuucaug

SEQ ID NO: 895070 - RNA, 19 nt, Homo sapiens
caaaugaagaccucucuaa

SEQ ID NO: 895071 - RNA, 19 nt, Homo sapiens
gaauuuaagucugccuauu

SEQ ID NO: 895072 - RNA, 19 nt, Homo sapiens
gaacuuggcaaaaugauua

SEQ ID NO: 895073 - RNA, 19 nt, Homo sapiens
ucagauauguuagcuacua

SEQ ID NO: 895074 - RNA, 19 nt, Homo sapiens
ggaauacaacugacuuuau

SEQ ID NO: 895075 - RNA, 19 nt, Homo sapiens
gaaagagaggcuugagaaa

SEQ ID NO: 895076 - RNA, 19 nt, Homo sapiens
gaagaccucucuaauuuug

SEQ ID NO: 895077 - RNA, 19 nt, Homo sapiens
ccauuuacuucaucacuuu

SEQ ID NO: 895078 - RNA, 19 nt, Homo sapiens
gaaggucuguacugggauu

SEQ ID NO: 895079 - RNA, 19 nt, Homo sapiens
gaacaagccagaagagaag

SEQ ID NO: 895080 - RNA, 19 nt, Homo sapiens
gagugaauguuauggcaaa

SEQ ID NO: 895081 - RNA, 19 nt, Homo sapiens
gagacauacuguuacuaaa

SEQ ID NO: 895082 - RNA, 19 nt, Homo sapiens
caguuaggauuucuuguuu

SEQ ID NO: 895083 - RNA, 19 nt, Homo sapiens
ggaacacgauccucuuucu

SEQ ID NO: 895084 - RNA, 19 nt, Homo sapiens
caugcuggcacauuuauua

SEQ ID NO: 895085 - RNA, 19 nt, Homo sapiens
cugugaagcuccucagaua

SEQ ID NO: 895086 - RNA, 19 nt, Homo sapiens
cagaaaggaaguagaaauu

SEQ ID NO: 895087 - RNA, 19 nt, Homo sapiens
ggaauuguuacucuacuuu

SEQ ID NO: 895088 - RNA, 19 nt, Homo sapiens
ucagauugguggcagaauu

SEQ ID NO: 895089 - RNA, 19 nt, Homo sapiens
cuauggaaauucaagauga

SEQ ID NO: 895090 - RNA, 19 nt, Homo sapiens
gguuaugucaucucuauuu

SEQ ID NO: 895091 - RNA, 19 nt, Homo sapiens
ugagacauacuguuacuaa

SEQ ID NO: 895092 - RNA, 19 nt, Homo sapiens
agagaaggcuuugacgaaa

SEQ ID NO: 895093 - RNA, 19 nt, Homo sapiens
gguaaacccacauauguau

SEQ ID NO: 895094 - RNA, 19 nt, Homo sapiens
ggggauacauuuucacuuu

SEQ ID NO: 895095 - RNA, 19 nt, Homo sapiens
caacacaugcaaagucuau

SEQ ID NO: 895096 - RNA, 19 nt, Homo sapiens
gcuggcacauuuauuacaa

SEQ ID NO: 895097 - RNA, 19 nt, Homo sapiens
acaagagggacuagaguua

SEQ ID NO: 895098 - RNA, 19 nt, Homo sapiens
gaacagcuggaucacaaga

SEQ ID NO: 895099 - RNA, 19 nt, Homo sapiens
caacaacacaugcaaaguc

SEQ ID NO: 895100 - RNA, 19 nt, Homo sapiens
uggcuagaauugcuacuuu

SEQ ID NO: 895101 - RNA, 19 nt, Homo sapiens
gaacuggcuagaauugcua

SEQ ID NO: 895102 - RNA, 19 nt, Homo sapiens
cugaacagcuggaucacaa

SEQ ID NO: 895103 - RNA, 19 nt, Homo sapiens
uaaguugcauuacagaaag

SEQ ID NO: 895104 - RNA, 19 nt, Homo sapiens
gcagcuguauaauuuaaag

SEQ ID NO: 895105 - RNA, 19 nt, Homo sapiens
aagguuaugucaucucuau

SEQ ID NO: 895106 - RNA, 19 nt, Homo sapiens
gaugguaaacccacauaug

SEQ ID NO: 895107 - RNA, 19 nt, Homo sapiens
aaugaagaccucucuaauu

SEQ ID NO: 895108 - RNA, 19 nt, Homo sapiens
gaagugaaagcugacuauu

SEQ ID NO: 895109 - RNA, 19 nt, Homo sapiens
ggaacuggcuagaauugcu

SEQ ID NO: 895110 - RNA, 19 nt, Homo sapiens
gauauguuagcuacuauga

SEQ ID NO: 895111 - RNA, 19 nt, Homo sapiens
aagagggacuagaguuauu

SEQ ID NO: 895112 - RNA, 19 nt, Homo sapiens
cgacugaacagcuggauca

SEQ ID NO: 895113 - RNA, 19 nt, Homo sapiens
uuacagaaaggaaguagaa

SEQ ID NO: 895114 - RNA, 19 nt, Homo sapiens
ugaacaagccagaagagaa

SEQ ID NO: 895115 - RNA, 19 nt, Homo sapiens
uaccuauucugaagugaaa

SEQ ID NO: 895116 - RNA, 19 nt, Homo sapiens
ggacccauuuacuucauca

SEQ ID NO: 895117 - RNA, 19 nt, Homo sapiens
ccaguuaggauuucuuguu

SEQ ID NO: 895118 - RNA, 19 nt, Homo sapiens
uaagucugccuauuucaaa

SEQ ID NO: 895119 - RNA, 19 nt, Homo sapiens
uaaguccauucgcagcaua

SEQ ID NO: 895120 - RNA, 19 nt, Homo sapiens
ccaaguacacacgaugaua

SEQ ID NO: 895121 - RNA, 19 nt, Homo sapiens
gccugucacucaagaagaa

SEQ ID NO: 895122 - RNA, 19 nt, Homo sapiens
gcggagauuuggcugaaca

SEQ ID NO: 895123 - RNA, 19 nt, Homo sapiens
aaugauaccuauucugaag

SEQ ID NO: 895124 - RNA, 19 nt, Homo sapiens
gggauucaugguacaauaa

SEQ ID NO: 895125 - RNA, 19 nt, Homo sapiens
uuucaaggaacguaucuua

SEQ ID NO: 895126 - RNA, 19 nt, Homo sapiens
gcaccacaaccaaguacaa

SEQ ID NO: 895127 - RNA, 19 nt, Homo sapiens
gaauauguucuuggcaauu

SEQ ID NO: 895128 - RNA, 19 nt, Homo sapiens
ggaggaauacuuacuucau

SEQ ID NO: 895129 - RNA, 19 nt, Homo sapiens
gccuucaaauuaauacuga

SEQ ID NO: 895130 - RNA, 19 nt, Homo sapiens
gcaaaugaagaccucucua

SEQ ID NO: 895131 - RNA, 19 nt, Homo sapiens
ugggauucaugguacaaua

SEQ ID NO: 895132 - RNA, 19 nt, Homo sapiens
uauguuagcuacuaugacu

SEQ ID NO: 895133 - RNA, 19 nt, Homo sapiens
gugaagcuccucagauaug

SEQ ID NO: 895134 - RNA, 19 nt, Homo sapiens
ucuaggaguucccagaguu

SEQ ID NO: 895135 - RNA, 19 nt, Homo sapiens
guaauguucuagagaucau

SEQ ID NO: 895136 - RNA, 19 nt, Homo sapiens
gagaaggcuuugacgaaaa

SEQ ID NO: 895137 - RNA, 19 nt, Homo sapiens
gggauacauuuucacuuua

SEQ ID NO: 895138 - RNA, 19 nt, Homo sapiens
caaguacacacgaugauag

SEQ ID NO: 895139 - RNA, 19 nt, Homo sapiens
ucaagaagaauuucgagau

SEQ ID NO: 895140 - RNA, 19 nt, Homo sapiens
gcagaaggccagauuuuga

SEQ ID NO: 895141 - RNA, 19 nt, Homo sapiens
caagagggacuagaguuau

SEQ ID NO: 895142 - RNA, 19 nt, Homo sapiens
agucgcaucuacuaugaaa

SEQ ID NO: 895143 - RNA, 19 nt, Homo sapiens
aagagaaggcuuugacgaa

SEQ ID NO: 895144 - RNA, 19 nt, Homo sapiens
gaaguagaaauuacaacca

SEQ ID NO: 895145 - RNA, 19 nt, Homo sapiens
caaguucauugaccuucga

SEQ ID NO: 895146 - RNA, 19 nt, Homo sapiens
guaaacccacauauguauu

SEQ ID NO: 895147 - RNA, 19 nt, Homo sapiens
gacagcacauccucagaua

SEQ ID NO: 895148 - RNA, 19 nt, Homo sapiens
guucuuaccucuugugguu

SEQ ID NO: 895149 - RNA, 19 nt, Homo sapiens
ugacgcagccugagaauga

SEQ ID NO: 895150 - RNA, 19 nt, Homo sapiens
gacaacagccugagaaauc

SEQ ID NO: 895151 - RNA, 19 nt, Homo sapiens
gcacauccucagauaguuu

SEQ ID NO: 895152 - RNA, 19 nt, Homo sapiens
cagaggaaguggaggaaga

SEQ ID NO: 895153 - RNA, 19 nt, Homo sapiens
ggccgagucuguccuggaa

SEQ ID NO: 895154 - RNA, 19 nt, Homo sapiens
ccaacaguguggcgagcua

SEQ ID NO: 895155 - RNA, 19 nt, Homo sapiens
gcccuacucuguguaauag

SEQ ID NO: 895156 - RNA, 19 nt, Homo sapiens
agucagagauuuggagaug

SEQ ID NO: 895157 - RNA, 19 nt, Homo sapiens
ccuacucuguguaauagaa

SEQ ID NO: 895158 - RNA, 19 nt, Homo sapiens
ucagagauuuggagauguc

SEQ ID NO: 895159 - RNA, 19 nt, Homo sapiens
aauaaaggccugcgugugu

SEQ ID NO: 895160 - RNA, 19 nt, Homo sapiens
ggaguccauugaugauuac

SEQ ID NO: 895161 - RNA, 19 nt, Homo sapiens
gcugcuggcugugacaaug

SEQ ID NO: 895162 - RNA, 19 nt, Homo sapiens
cagcacauccucagauagu

SEQ ID NO: 895163 - RNA, 19 nt, Homo sapiens
cgacagcacauccucagau

SEQ ID NO: 895164 - RNA, 19 nt, Homo sapiens
caagggaugggaccugaug

SEQ ID NO: 895165 - RNA, 19 nt, Homo sapiens
cgaacgcucugcaccuucu

SEQ ID NO: 895166 - RNA, 19 nt, Homo sapiens
ccucuugugguucucaaua

SEQ ID NO: 895167 - RNA, 19 nt, Homo sapiens
ugaccugggaggacucuuu

SEQ ID NO: 895168 - RNA, 19 nt, Homo sapiens
gaaugugucccaggaacug

SEQ ID NO: 895169 - RNA, 19 nt, Homo sapiens
ucuugugguucucaauaaa

SEQ ID NO: 895170 - RNA, 19 nt, Homo sapiens
ggaggacucuuuuaguucu

SEQ ID NO: 895171 - RNA, 19 nt, Homo sapiens
ggaugcagaugaggaugag

SEQ ID NO: 895172 - RNA, 19 nt, Homo sapiens
gaugaggacgacuaucaca

SEQ ID NO: 895173 - RNA, 19 nt, Homo sapiens
ccugugaggaugcagauga

SEQ ID NO: 895174 - RNA, 19 nt, Homo sapiens
agaugucucuguguguuug

SEQ ID NO: 895175 - RNA, 19 nt, Homo sapiens
gauggcagccgggaguaug

SEQ ID NO: 895176 - RNA, 19 nt, Homo sapiens
ugacaacagccugagaaau

SEQ ID NO: 895177 - RNA, 19 nt, Homo sapiens
gcucugggguccucacaug

SEQ ID NO: 895178 - RNA, 19 nt, Homo sapiens
cucuugugguucucaauaa

SEQ ID NO: 895179 - RNA, 19 nt, Homo sapiens
gcugaccccugugucguua

SEQ ID NO: 895180 - RNA, 19 nt, Homo sapiens
ugggaggacucuuuuaguu

SEQ ID NO: 895181 - RNA, 19 nt, Homo sapiens
aggaugaggacgacuauca

SEQ ID NO: 895182 - RNA, 19 nt, Homo sapiens
agaaccagccugugaggau

SEQ ID NO: 895183 - RNA, 19 nt, Homo sapiens
ucuguguguuuguguguau

SEQ ID NO: 895184 - RNA, 19 nt, Homo sapiens
ccagcccuacucuguguaa

SEQ ID NO: 895185 - RNA, 19 nt, Homo sapiens
ggcuccagauuacgagaau

SEQ ID NO: 895186 - RNA, 19 nt, Homo sapiens
ccauugaugauuacgugaa

SEQ ID NO: 895187 - RNA, 19 nt, Homo sapiens
ggagacaacucuucuuuga

SEQ ID NO: 895188 - RNA, 19 nt, Homo sapiens
gaagagagauuuugacuuu

SEQ ID NO: 895189 - RNA, 19 nt, Homo sapiens
aaaccuagcuucagugauu

SEQ ID NO: 895190 - RNA, 19 nt, Homo sapiens
gaagaaggacugauacaaa

SEQ ID NO: 895191 - RNA, 19 nt, Homo sapiens
gagcuuaaauggccuauuc

SEQ ID NO: 895192 - RNA, 19 nt, Homo sapiens
gaagaggccugaggauuau

SEQ ID NO: 895193 - RNA, 19 nt, Homo sapiens
agacaacucuucuuugaaa

SEQ ID NO: 895194 - RNA, 19 nt, Homo sapiens
gagguuagcugccgugguu

SEQ ID NO: 895195 - RNA, 19 nt, Homo sapiens
ggaaaggacugcucugaag

SEQ ID NO: 895196 - RNA, 19 nt, Homo sapiens
ggaagaagacaguauugua

SEQ ID NO: 895197 - RNA, 19 nt, Homo sapiens
gaaggacucugagaaguug

SEQ ID NO: 895198 - RNA, 19 nt, Homo sapiens
gaagagauccgccaugugu

SEQ ID NO: 895199 - RNA, 19 nt, Homo sapiens
ugaagaggccugaggauua

SEQ ID NO: 895200 - RNA, 19 nt, Homo sapiens
ucacagagcgcuuccauuu

SEQ ID NO: 895201 - RNA, 19 nt, Homo sapiens
gagcaucccuucuaugaca

SEQ ID NO: 895202 - RNA, 19 nt, Homo sapiens
gaugaccacuucaggauug

SEQ ID NO: 895203 - RNA, 19 nt, Homo sapiens
gaagugguauuuggcauga

SEQ ID NO: 895204 - RNA, 19 nt, Homo sapiens
gagcauguccugcauuuga

SEQ ID NO: 895205 - RNA, 19 nt, Homo sapiens
gaagcaaagccacagauuu

SEQ ID NO: 895206 - RNA, 19 nt, Homo sapiens
cagacuacuugcuacauua

SEQ ID NO: 895207 - RNA, 19 nt, Homo sapiens
gaaagugcaugaggcaaug

SEQ ID NO: 895208 - RNA, 19 nt, Homo sapiens
ggagagaccacccaacuug

SEQ ID NO: 895209 - RNA, 19 nt, Homo sapiens
cccaaaggauauugacuua

SEQ ID NO: 895210 - RNA, 19 nt, Homo sapiens
gaagaagacaguauuguag

SEQ ID NO: 895211 - RNA, 19 nt, Homo sapiens
gcacuguucucuacuccaa

SEQ ID NO: 895212 - RNA, 19 nt, Homo sapiens
gaagaaaacucccacuugu

SEQ ID NO: 895213 - RNA, 19 nt, Homo sapiens
gcgcuuccauuucuacaaa

SEQ ID NO: 895214 - RNA, 19 nt, Homo sapiens
gggagcauguccugcauuu

SEQ ID NO: 895215 - RNA, 19 nt, Homo sapiens
gauggaagcugaaaaccua

SEQ ID NO: 895216 - RNA, 19 nt, Homo sapiens
ccucuaaguuucagaaguu

SEQ ID NO: 895217 - RNA, 19 nt, Homo sapiens
caaguacugugucaacaug

SEQ ID NO: 895218 - RNA, 19 nt, Homo sapiens
guaaaucccaucuuucaga

SEQ ID NO: 895219 - RNA, 19 nt, Homo sapiens
gaaagccucucaagaucca

SEQ ID NO: 895220 - RNA, 19 nt, Homo sapiens
uaaaucccaucuuucagaa

SEQ ID NO: 895221 - RNA, 19 nt, Homo sapiens
gagagaagaagagagauuu

SEQ ID NO: 895222 - RNA, 19 nt, Homo sapiens
caauauugaugaccacuuc

SEQ ID NO: 895223 - RNA, 19 nt, Homo sapiens
gggaagagauccgccaugu

SEQ ID NO: 895224 - RNA, 19 nt, Homo sapiens
gaaggacugauacaaagaa

SEQ ID NO: 895225 - RNA, 19 nt, Homo sapiens
gccgacauauccacacuuu

SEQ ID NO: 895226 - RNA, 19 nt, Homo sapiens
gggagaauauggaucagau

SEQ ID NO: 895227 - RNA, 19 nt, Homo sapiens
acccaauucugauuacuua

SEQ ID NO: 895228 - RNA, 19 nt, Homo sapiens
cgacauauccacacuuuua

SEQ ID NO: 895229 - RNA, 19 nt, Homo sapiens
ggauguggagccucaauaa

SEQ ID NO: 895230 - RNA, 19 nt, Homo sapiens
gaaaugaacgaugaagaug

SEQ ID NO: 895231 - RNA, 19 nt, Homo sapiens
ggacugauacaaagaaagu

SEQ ID NO: 895232 - RNA, 19 nt, Homo sapiens
gaaaggacugcucugaaga

SEQ ID NO: 895233 - RNA, 19 nt, Homo sapiens
acauuuaccugaugcagaa

SEQ ID NO: 895234 - RNA, 19 nt, Homo sapiens
cuucagagaccaaggguua

SEQ ID NO: 895235 - RNA, 19 nt, Homo sapiens
gcgaggagcaucccuucua

SEQ ID NO: 895236 - RNA, 19 nt, Homo sapiens
ggagagaagaagagagauu

SEQ ID NO: 895237 - RNA, 19 nt, Homo sapiens
caucauugguggagaagga

SEQ ID NO: 895238 - RNA, 19 nt, Homo sapiens
acagagcgcuuccauuucu

SEQ ID NO: 895239 - RNA, 19 nt, Homo sapiens
ggaagcaaagccacagauu

SEQ ID NO: 895240 - RNA, 19 nt, Homo sapiens
uauuguagaugaugcagaa

SEQ ID NO: 895241 - RNA, 19 nt, Homo sapiens
gaccugcacuguucucuac

SEQ ID NO: 895242 - RNA, 19 nt, Homo sapiens
gcugagagccaccaacaga

SEQ ID NO: 895243 - RNA, 19 nt, Homo sapiens
cgaggagcaucccuucuau

SEQ ID NO: 895244 - RNA, 19 nt, Homo sapiens
aagaaggacugauacaaag

SEQ ID NO: 895245 - RNA, 19 nt, Homo sapiens
caagaaggaggaauugaau

SEQ ID NO: 895246 - RNA, 19 nt, Homo sapiens
caaguacuaucgccagaca

SEQ ID NO: 895247 - RNA, 19 nt, Homo sapiens
agagauggcugcagagucu

SEQ ID NO: 895248 - RNA, 19 nt, Homo sapiens
gaguucagauucuucagau

SEQ ID NO: 895249 - RNA, 19 nt, Homo sapiens
gaggcaaugucaguauuau

SEQ ID NO: 895250 - RNA, 19 nt, Homo sapiens
ggauuaugaagccguauuu

SEQ ID NO: 895251 - RNA, 19 nt, Homo sapiens
ugaucaagcugacauuuac

SEQ ID NO: 895252 - RNA, 19 nt, Homo sapiens
uaaaucacauccucaaagc

SEQ ID NO: 895253 - RNA, 19 nt, Homo sapiens
augcagaaaugaacgauga

SEQ ID NO: 895254 - RNA, 19 nt, Homo sapiens
ggaagaagaggaagaugag

SEQ ID NO: 895255 - RNA, 19 nt, Homo sapiens
gcuagaaggacucugagaa

SEQ ID NO: 895256 - RNA, 19 nt, Homo sapiens
agugaaaucuguaauaugc

SEQ ID NO: 895257 - RNA, 19 nt, Homo sapiens
gagugaaccacaacaaguu

SEQ ID NO: 895258 - RNA, 19 nt, Homo sapiens
uuugguaaaucccaucuuu

SEQ ID NO: 895259 - RNA, 19 nt, Homo sapiens
ccaaugacaggcucuauca

SEQ ID NO: 895260 - RNA, 19 nt, Homo sapiens
ggagaaggagagaagaaga

SEQ ID NO: 895261 - RNA, 19 nt, Homo sapiens
gagaagcauccgacucuau

SEQ ID NO: 895262 - RNA, 19 nt, Homo sapiens
gauaaaucacauccucaaa

SEQ ID NO: 895263 - RNA, 19 nt, Homo sapiens
aaacuacccacgagcuuaa

SEQ ID NO: 895264 - RNA, 19 nt, Homo sapiens
cagagaauguagcuuuauc

SEQ ID NO: 895265 - RNA, 19 nt, Homo sapiens
uccagagaauguagcuuua

SEQ ID NO: 895266 - RNA, 19 nt, Homo sapiens
acagacuacuugcuacauu

SEQ ID NO: 895267 - RNA, 19 nt, Homo sapiens
ucagagaguucagauucuu

SEQ ID NO: 895268 - RNA, 19 nt, Homo sapiens
uacagaagaaggacugaua

SEQ ID NO: 895269 - RNA, 19 nt, Homo sapiens
gaagacaguauuguagaug

SEQ ID NO: 895270 - RNA, 19 nt, Homo sapiens
uaucgagcuucucaucauu

SEQ ID NO: 895271 - RNA, 19 nt, Homo sapiens
gaaaguccagagaauguag

SEQ ID NO: 895272 - RNA, 19 nt, Homo sapiens
gcugcagagucuacugaaa

SEQ ID NO: 895273 - RNA, 19 nt, Homo sapiens
gaagaggaagaagacagua

SEQ ID NO: 895274 - RNA, 19 nt, Homo sapiens
ggaagaggaagaagacagu

SEQ ID NO: 895275 - RNA, 19 nt, Homo sapiens
cugagaaguugguagaaga

SEQ ID NO: 895276 - RNA, 19 nt, Homo sapiens
ugaggcaaugucaguauua

SEQ ID NO: 895277 - RNA, 19 nt, Homo sapiens
agugguauuuggcaugaua

SEQ ID NO: 895278 - RNA, 19 nt, Homo sapiens
gugaugcagucaugucuca

SEQ ID NO: 895279 - RNA, 19 nt, Homo sapiens
gccagacacugcuauuugg

SEQ ID NO: 895280 - RNA, 19 nt, Homo sapiens
guccagagaauguagcuuu

SEQ ID NO: 895281 - RNA, 19 nt, Homo sapiens
cuacucaacacccuaacua

SEQ ID NO: 895282 - RNA, 19 nt, Homo sapiens
ggcaggaagugguauuugg

SEQ ID NO: 895283 - RNA, 19 nt, Homo sapiens
gagagaccacccaacuuga

SEQ ID NO: 895284 - RNA, 19 nt, Homo sapiens
uaacaaggcccaagguacu

SEQ ID NO: 895285 - RNA, 19 nt, Homo sapiens
guggagacaacucuucuuu

SEQ ID NO: 895286 - RNA, 19 nt, Homo sapiens
gaaaguggagacaacucuu

SEQ ID NO: 895287 - RNA, 19 nt, Homo sapiens
gaagaggauuugacaguua

SEQ ID NO: 895288 - RNA, 19 nt, Homo sapiens
ggaagaagaaggugaguua

SEQ ID NO: 895289 - RNA, 19 nt, Homo sapiens
ggaagaggaugaagaggaa

SEQ ID NO: 895290 - RNA, 19 nt, Homo sapiens
caagguguaugcgauauua

SEQ ID NO: 895291 - RNA, 19 nt, Homo sapiens
ccacagagccugacuccua

SEQ ID NO: 895292 - RNA, 19 nt, Homo sapiens
ggaagaauuugaggaagaa

SEQ ID NO: 895293 - RNA, 19 nt, Homo sapiens
gaaagugacucugaugaca

SEQ ID NO: 895294 - RNA, 19 nt, Homo sapiens
ggaaugaaggcuuguauga

SEQ ID NO: 895295 - RNA, 19 nt, Homo sapiens
ggaggagccugaagaacuu

SEQ ID NO: 895296 - RNA, 19 nt, Homo sapiens
ggaagaggauuugacaguu

SEQ ID NO: 895297 - RNA, 19 nt, Homo sapiens
ggaagaagaguuugaggaa

SEQ ID NO: 895298 - RNA, 19 nt, Homo sapiens
ggaagaggaggaagacuuu

SEQ ID NO: 895299 - RNA, 19 nt, Homo sapiens
ggaagaagaagaagaggaa

SEQ ID NO: 895300 - RNA, 19 nt, Homo sapiens
ggccgaagcucuccaggaa

SEQ ID NO: 895301 - RNA, 19 nt, Homo sapiens
aagaagagauggagacaga

SEQ ID NO: 895302 - RNA, 19 nt, Homo sapiens
ggaggaagacuuugaggaa

SEQ ID NO: 895303 - RNA, 19 nt, Homo sapiens
gucaguagcaagaauauua

SEQ ID NO: 895304 - RNA, 19 nt, Homo sapiens
caacagcagugaugaagag

SEQ ID NO: 895305 - RNA, 19 nt, Homo sapiens
agagacaccugcagaagaa

SEQ ID NO: 895306 - RNA, 19 nt, Homo sapiens
ggagaguguuucugguuug

SEQ ID NO: 895307 - RNA, 19 nt, Homo sapiens
aagaagaguuugaggaaga

SEQ ID NO: 895308 - RNA, 19 nt, Homo sapiens
gaaggaggagccugaagaa

SEQ ID NO: 895309 - RNA, 19 nt, Homo sapiens
gcccucagcuccaacaguu

SEQ ID NO: 895310 - RNA, 19 nt, Homo sapiens
cccaggagcuuguugaaga

SEQ ID NO: 895311 - RNA, 19 nt, Homo sapiens
ggaagaagaggaggaagaa

SEQ ID NO: 895312 - RNA, 19 nt, Homo sapiens
ggaggaagaagaacuggaa

SEQ ID NO: 895313 - RNA, 19 nt, Homo sapiens
gaagagauggagacagaga

SEQ ID NO: 895314 - RNA, 19 nt, Homo sapiens
gaccagccuuuguccacua

SEQ ID NO: 895315 - RNA, 19 nt, Homo sapiens
aggcuuguaugaccuauuu

SEQ ID NO: 895316 - RNA, 19 nt, Homo sapiens
gcacgucucaguuccauca

SEQ ID NO: 895317 - RNA, 19 nt, Homo sapiens
uggaagaccuggaguuugg

SEQ ID NO: 895318 - RNA, 19 nt, Homo sapiens
ccaggagcuuguugaagaa

SEQ ID NO: 895319 - RNA, 19 nt, Homo sapiens
ugaguuagaggaagaagaa

SEQ ID NO: 895320 - RNA, 19 nt, Homo sapiens
gaggauuugacaguuauua

SEQ ID NO: 895321 - RNA, 19 nt, Homo sapiens
guaaugcacgucucaguuc

SEQ ID NO: 895322 - RNA, 19 nt, Homo sapiens
gaccaagguguaugcgaua

SEQ ID NO: 895323 - RNA, 19 nt, Homo sapiens
cgaaggaggagccugaaga

SEQ ID NO: 895324 - RNA, 19 nt, Homo sapiens
gcgagaagauagccuugag

SEQ ID NO: 895325 - RNA, 19 nt, Homo sapiens
gaaggaaugaaggcuugua

SEQ ID NO: 895326 - RNA, 19 nt, Homo sapiens
gguggaagaccuggaguuu

SEQ ID NO: 895327 - RNA, 19 nt, Homo sapiens
agaagaaggugaguuagag

SEQ ID NO: 895328 - RNA, 19 nt, Homo sapiens
aggaagaauuugaggaaga

SEQ ID NO: 895329 - RNA, 19 nt, Homo sapiens
uggagaguguuucugguuu

SEQ ID NO: 895330 - RNA, 19 nt, Homo sapiens
ggaagaaggggaagaagaa

SEQ ID NO: 895331 - RNA, 19 nt, Homo sapiens
ccagcugccugcacuguuc

SEQ ID NO: 895332 - RNA, 19 nt, Homo sapiens
gagcauucagcagguguua

SEQ ID NO: 895333 - RNA, 19 nt, Homo sapiens
ugaggaagaauuugaggaa

SEQ ID NO: 895334 - RNA, 19 nt, Homo sapiens
aagaggauuugacaguuau

SEQ ID NO: 895335 - RNA, 19 nt, Homo sapiens
acaaggaggaggcaucuga

SEQ ID NO: 895336 - RNA, 19 nt, Homo sapiens
gagcaucgguagagauucc

SEQ ID NO: 895337 - RNA, 19 nt, Homo sapiens
gcagucagcauuggaagga

SEQ ID NO: 895338 - RNA, 19 nt, Homo sapiens
ggaagaagaacuggaagag

SEQ ID NO: 895339 - RNA, 19 nt, Homo sapiens
gaagaggaauauuuugaag

SEQ ID NO: 895340 - RNA, 19 nt, Homo sapiens
ggaagaggaagaggaugaa

SEQ ID NO: 895341 - RNA, 19 nt, Homo sapiens
ggaagacuuugaggaagag

SEQ ID NO: 895342 - RNA, 19 nt, Homo sapiens
aggaagacuuugaggaaga

SEQ ID NO: 895343 - RNA, 19 nt, Homo sapiens
cagccuuuguccacuauga

SEQ ID NO: 895344 - RNA, 19 nt, Homo sapiens
ggaagaggagccugaggau

SEQ ID NO: 895345 - RNA, 19 nt, Homo sapiens
cagagacaccugcagaaga

SEQ ID NO: 895346 - RNA, 19 nt, Homo sapiens
guuagaggaagaagaagaa

SEQ ID NO: 895347 - RNA, 19 nt, Homo sapiens
gcauucagcagguguuaca

SEQ ID NO: 895348 - RNA, 19 nt, Homo sapiens
aagaagaggaggaagaaga

SEQ ID NO: 895349 - RNA, 19 nt, Homo sapiens
ggaugaagaggaauauuuu

SEQ ID NO: 895350 - RNA, 19 nt, Homo sapiens
gagaucuccuuggaaagug

SEQ ID NO: 895351 - RNA, 19 nt, Homo sapiens
aggaugaagaggaauauuu

SEQ ID NO: 895352 - RNA, 19 nt, Homo sapiens
guagcaagaauauuagcuu

SEQ ID NO: 895353 - RNA, 19 nt, Homo sapiens
ggaggaggaagaagaacug

SEQ ID NO: 895354 - RNA, 19 nt, Homo sapiens
aagaagaagaggaggauga

SEQ ID NO: 895355 - RNA, 19 nt, Homo sapiens
ggaggaggaagaggaagaa

SEQ ID NO: 895356 - RNA, 19 nt, Homo sapiens
cagcagcacugugugucuu

SEQ ID NO: 895357 - RNA, 19 nt, Homo sapiens
agaguuugaggaagaauuu

SEQ ID NO: 895358 - RNA, 19 nt, Homo sapiens
agaagaguuugaggaagaa

SEQ ID NO: 895359 - RNA, 19 nt, Homo sapiens
agaagaagaagaggaagaa

SEQ ID NO: 895360 - RNA, 19 nt, Homo sapiens
ccagaaccuuucagcucuu

SEQ ID NO: 895361 - RNA, 19 nt, Homo sapiens
ggaaagugacucugaugac

SEQ ID NO: 895362 - RNA, 19 nt, Homo sapiens
caccacagccaaccaccua

SEQ ID NO: 895363 - RNA, 19 nt, Homo sapiens
agaggaggaagaagaguuu

SEQ ID NO: 895364 - RNA, 19 nt, Homo sapiens
gagcugugggugcagguuu

SEQ ID NO: 895365 - RNA, 19 nt, Homo sapiens
cagcgucaguagcaagaau

SEQ ID NO: 895366 - RNA, 19 nt, Homo sapiens
ccgaagcucuccaggaaaa

SEQ ID NO: 895367 - RNA, 19 nt, Homo sapiens
ggagcuuguugaagaagag

SEQ ID NO: 895368 - RNA, 19 nt, Homo sapiens
gaagaagaaggugaguuag

SEQ ID NO: 895369 - RNA, 19 nt, Homo sapiens
ugaggaggaggaagaagaa

SEQ ID NO: 895370 - RNA, 19 nt, Homo sapiens
aagaagaaggugaguuaga

SEQ ID NO: 895371 - RNA, 19 nt, Homo sapiens
ggaauauuuugaagaggaa

SEQ ID NO: 895372 - RNA, 19 nt, Homo sapiens
gggcucaugugccuauugc

SEQ ID NO: 895373 - RNA, 19 nt, Homo sapiens
aagaagaagaggaagaaga

SEQ ID NO: 895374 - RNA, 19 nt, Homo sapiens
gugggccucucaucaagga

SEQ ID NO: 895375 - RNA, 19 nt, Homo sapiens
gaccugcugucugcacuca

SEQ ID NO: 895376 - RNA, 19 nt, Homo sapiens
aaggugaguuagaggaaga

SEQ ID NO: 895377 - RNA, 19 nt, Homo sapiens
agaauuugaggaagaagaa

SEQ ID NO: 895378 - RNA, 19 nt, Homo sapiens
ggcuugugguucucucaaa

SEQ ID NO: 895379 - RNA, 19 nt, Homo sapiens
cagaaccuuucagcucuug

SEQ ID NO: 895380 - RNA, 19 nt, Homo sapiens
aagaggaugaagaggaaua

SEQ ID NO: 895381 - RNA, 19 nt, Homo sapiens
gaagaggaggaagacuuug

SEQ ID NO: 895382 - RNA, 19 nt, Homo sapiens
agaagaggaagaagaggaa

SEQ ID NO: 895383 - RNA, 19 nt, Homo sapiens
agaagaagaggaagaagag

SEQ ID NO: 895384 - RNA, 19 nt, Homo sapiens
uggccgacuucaucgauug

SEQ ID NO: 895385 - RNA, 19 nt, Homo sapiens
gaaugaaggcuuguaugac

SEQ ID NO: 895386 - RNA, 19 nt, Homo sapiens
gaaggcuuguaugaccuau

SEQ ID NO: 895387 - RNA, 19 nt, Homo sapiens
gaagaaacaucaaagacua

SEQ ID NO: 895388 - RNA, 19 nt, Homo sapiens
ggaagucuguuucacgaua

SEQ ID NO: 895389 - RNA, 19 nt, Homo sapiens
gaacgcagcuccuacuaca

SEQ ID NO: 895390 - RNA, 19 nt, Homo sapiens
ucacagagcuccuccugaa

SEQ ID NO: 895391 - RNA, 19 nt, Homo sapiens
agaaagugaucacagaaua

SEQ ID NO: 895392 - RNA, 19 nt, Homo sapiens
gaauacgucuucagugguu

SEQ ID NO: 895393 - RNA, 19 nt, Homo sapiens
ggaagcagauggcagugaa

SEQ ID NO: 895394 - RNA, 19 nt, Homo sapiens
ggccagagcuauuaagaau

SEQ ID NO: 895395 - RNA, 19 nt, Homo sapiens
gcagaggccagagcuauua

SEQ ID NO: 895396 - RNA, 19 nt, Homo sapiens
gcaaaggucuagccacagu

SEQ ID NO: 895397 - RNA, 19 nt, Homo sapiens
caucaaagacuauguccua

SEQ ID NO: 895398 - RNA, 19 nt, Homo sapiens
ggagaaacaguuccagaaa

SEQ ID NO: 895399 - RNA, 19 nt, Homo sapiens
ucagagagauguucagauc

SEQ ID NO: 895400 - RNA, 19 nt, Homo sapiens
gaucucaaguauaccauug

SEQ ID NO: 895401 - RNA, 19 nt, Homo sapiens
gaaccggcuuucagaaugu

SEQ ID NO: 895402 - RNA, 19 nt, Homo sapiens
gagaaggcaugagagcuaa

SEQ ID NO: 895403 - RNA, 19 nt, Homo sapiens
gagaaacaguuccagaaag

SEQ ID NO: 895404 - RNA, 19 nt, Homo sapiens
aaacuugccuuaucaccuu

SEQ ID NO: 895405 - RNA, 19 nt, Homo sapiens
gaccagagaucaucacacu

SEQ ID NO: 895406 - RNA, 19 nt, Homo sapiens
gaacucaggcgauuacaag

SEQ ID NO: 895407 - RNA, 19 nt, Homo sapiens
caacauucgugcuggaaau

SEQ ID NO: 895408 - RNA, 19 nt, Homo sapiens
guucugcauugccaaauuu

SEQ ID NO: 895409 - RNA, 19 nt, Homo sapiens
gcaggaugaugaccagaga

SEQ ID NO: 895410 - RNA, 19 nt, Homo sapiens
gagcgcaggcugagaauau

SEQ ID NO: 895411 - RNA, 19 nt, Homo sapiens
ccacacaaccugaugcaaa

SEQ ID NO: 895412 - RNA, 19 nt, Homo sapiens
ccagagcuauuaagaaugg

SEQ ID NO: 895413 - RNA, 19 nt, Homo sapiens
gagaguuccuucgaaagaa

SEQ ID NO: 895414 - RNA, 19 nt, Homo sapiens
ccgcaaagcagaagaaaga

SEQ ID NO: 895415 - RNA, 19 nt, Homo sapiens
gggagaacacccaggauaa

SEQ ID NO: 895416 - RNA, 19 nt, Homo sapiens
gaaggcaugagagcuaaua

SEQ ID NO: 895417 - RNA, 19 nt, Homo sapiens
ggcaugaucuaccuuggaa

SEQ ID NO: 895418 - RNA, 19 nt, Homo sapiens
agaaagggauguggaguga

SEQ ID NO: 895419 - RNA, 19 nt, Homo sapiens
cuaauaauccugagcagaa

SEQ ID NO: 895420 - RNA, 19 nt, Homo sapiens
agaaacaguuccagaaagu

SEQ ID NO: 895421 - RNA, 19 nt, Homo sapiens
guaccauccuucauccaaa

SEQ ID NO: 895422 - RNA, 19 nt, Homo sapiens
gccagcccauucuguauuu

SEQ ID NO: 895423 - RNA, 19 nt, Homo sapiens
gaucacagaauaccugaau

SEQ ID NO: 895424 - RNA, 19 nt, Homo sapiens
caaagcagaagaaagagaa

SEQ ID NO: 895425 - RNA, 19 nt, Homo sapiens
cugaagcugugguggaaua

SEQ ID NO: 895426 - RNA, 19 nt, Homo sapiens
gggaagaaggucaauguga

SEQ ID NO: 895427 - RNA, 19 nt, Homo sapiens
ggaagaaacaucaaagacu

SEQ ID NO: 895428 - RNA, 19 nt, Homo sapiens
cagcuuugcuucagugugu

SEQ ID NO: 895429 - RNA, 19 nt, Homo sapiens
caaaauacaugucuucuac

SEQ ID NO: 895430 - RNA, 19 nt, Homo sapiens
cugaugaccugcacuucua

SEQ ID NO: 895431 - RNA, 19 nt, Homo sapiens
gagaaggagcgaucugcua

SEQ ID NO: 895432 - RNA, 19 nt, Homo sapiens
gagaauauggagagacuau

SEQ ID NO: 895433 - RNA, 19 nt, Homo sapiens
ggaaaacauugcagaauca

SEQ ID NO: 895434 - RNA, 19 nt, Homo sapiens
ccaccguguugcagauaua

SEQ ID NO: 895435 - RNA, 19 nt, Homo sapiens
gaauauggagagacuaugu

SEQ ID NO: 895436 - RNA, 19 nt, Homo sapiens
gagaguauggcaugaucua

SEQ ID NO: 895437 - RNA, 19 nt, Homo sapiens
gcaagaaggaagugccuau

SEQ ID NO: 895438 - RNA, 19 nt, Homo sapiens
uagccacagugaucagaua

SEQ ID NO: 895439 - RNA, 19 nt, Homo sapiens
gaagucuguuucacgauag

SEQ ID NO: 895440 - RNA, 19 nt, Homo sapiens
acacuacgaugaacugcuu

SEQ ID NO: 895441 - RNA, 19 nt, Homo sapiens
ucagauaccggcaggauga

SEQ ID NO: 895442 - RNA, 19 nt, Homo sapiens
gagagauguucagaucauu

SEQ ID NO: 895443 - RNA, 19 nt, Homo sapiens
cugcagcccuuauugauca

SEQ ID NO: 895444 - RNA, 19 nt, Homo sapiens
guacauuggguccagcuuu

SEQ ID NO: 895445 - RNA, 19 nt, Homo sapiens
gcaaagcagaagaaagaga

SEQ ID NO: 895446 - RNA, 19 nt, Homo sapiens
caacaccgacacccacauu

SEQ ID NO: 895447 - RNA, 19 nt, Homo sapiens
gagaacacccaggauaaga

SEQ ID NO: 895448 - RNA, 19 nt, Homo sapiens
ucugauacguccauucuca

SEQ ID NO: 895449 - RNA, 19 nt, Homo sapiens
gaaagugaucacagaauac

SEQ ID NO: 895450 - RNA, 19 nt, Homo sapiens
aaacaguuccagaaaguga

SEQ ID NO: 895451 - RNA, 19 nt, Homo sapiens
gaaggaagggcuggucaug

SEQ ID NO: 895452 - RNA, 19 nt, Homo sapiens
guucucgucucaaacucua

SEQ ID NO: 895453 - RNA, 19 nt, Homo sapiens
agaaccggcuuucagaaug

SEQ ID NO: 895454 - RNA, 19 nt, Homo sapiens
gcgagaguauggcaugauc

SEQ ID NO: 895455 - RNA, 19 nt, Homo sapiens
cgagaguuccuucgaaaga

SEQ ID NO: 895456 - RNA, 19 nt, Homo sapiens
gagaacaugcgcaaugaca

SEQ ID NO: 895457 - RNA, 19 nt, Homo sapiens
aaacauugcugaggcucuu

SEQ ID NO: 895458 - RNA, 19 nt, Homo sapiens
gcagaaccggcuuucagaa

SEQ ID NO: 895459 - RNA, 19 nt, Homo sapiens
uggagaacaugcgcaauga

SEQ ID NO: 895460 - RNA, 19 nt, Homo sapiens
gaaggucugggcccacuau

SEQ ID NO: 895461 - RNA, 19 nt, Homo sapiens
aaagagcgcaggcugagaa

SEQ ID NO: 895462 - RNA, 19 nt, Homo sapiens
agagagauguucagaucau

SEQ ID NO: 895463 - RNA, 19 nt, Homo sapiens
ccagaagccuguuaaugcu

SEQ ID NO: 895464 - RNA, 19 nt, Homo sapiens
gagcagaaccggcuuucag

SEQ ID NO: 895465 - RNA, 19 nt, Homo sapiens
ugucaccauuggaggaaua

SEQ ID NO: 895466 - RNA, 19 nt, Homo sapiens
gaucaaccucagcaacauu

SEQ ID NO: 895467 - RNA, 19 nt, Homo sapiens
caaauggcaacaucacaga

SEQ ID NO: 895468 - RNA, 19 nt, Homo sapiens
gcgggcaggucguucugaa

SEQ ID NO: 895469 - RNA, 19 nt, Homo sapiens
uauuaagaauggcaaagga

SEQ ID NO: 895470 - RNA, 19 nt, Homo sapiens
ccagagaucaucacacuac

SEQ ID NO: 895471 - RNA, 19 nt, Homo sapiens
guaugacauuccuuacaug

SEQ ID NO: 895472 - RNA, 19 nt, Homo sapiens
gaaacugcguccccuguau

SEQ ID NO: 895473 - RNA, 19 nt, Homo sapiens
gaagcugauugggaaggaa

SEQ ID NO: 895474 - RNA, 19 nt, Homo sapiens
gugaaacuccagagccuuu

SEQ ID NO: 895475 - RNA, 19 nt, Homo sapiens
gcaaaggcagccaagaaag

SEQ ID NO: 895476 - RNA, 19 nt, Homo sapiens
caugagagcuaauaauccu

SEQ ID NO: 895477 - RNA, 19 nt, Homo sapiens
agagaaggcaugagagcua

SEQ ID NO: 895478 - RNA, 19 nt, Homo sapiens
uacauuggguccagcuuug

SEQ ID NO: 895479 - RNA, 19 nt, Homo sapiens
uaagaauggcaaaggauug

SEQ ID NO: 895480 - RNA, 19 nt, Homo sapiens
gauaccggcaggaugauga

SEQ ID NO: 895481 - RNA, 19 nt, Homo sapiens
uguguggacuggucgauug

SEQ ID NO: 895482 - RNA, 19 nt, Homo sapiens
aagcaaaggcagccaagaa

SEQ ID NO: 895483 - RNA, 19 nt, Homo sapiens
gaguaugccuucgccuuca

SEQ ID NO: 895484 - RNA, 19 nt, Homo sapiens
cgaggaagcuacacuuuuc

SEQ ID NO: 895485 - RNA, 19 nt, Homo sapiens
gagaucaucacacuacgau

SEQ ID NO: 895486 - RNA, 19 nt, Homo sapiens
cacacaaccugaugcaaag

SEQ ID NO: 895487 - RNA, 19 nt, Homo sapiens
gagcagagcuucauuugua

SEQ ID NO: 895488 - RNA, 19 nt, Homo sapiens
ggaaagugauucugugaaa

SEQ ID NO: 895489 - RNA, 19 nt, Homo sapiens
gacagacucuuaaucagua

SEQ ID NO: 895490 - RNA, 19 nt, Homo sapiens
gauccaagcuugaaaauuu

SEQ ID NO: 895491 - RNA, 19 nt, Homo sapiens
gaauggaaccaaagcaaua

SEQ ID NO: 895492 - RNA, 19 nt, Homo sapiens
ggaaggacauuuggcaauu

SEQ ID NO: 895493 - RNA, 19 nt, Homo sapiens
gaagagacacuagccauaa

SEQ ID NO: 895494 - RNA, 19 nt, Homo sapiens
gugaagauguaccuaauga

SEQ ID NO: 895495 - RNA, 19 nt, Homo sapiens
ucgcauagcuacauucuga

SEQ ID NO: 895496 - RNA, 19 nt, Homo sapiens
agagagaacuccuacaaga

SEQ ID NO: 895497 - RNA, 19 nt, Homo sapiens
aggcagagcucccaaagaa

SEQ ID NO: 895498 - RNA, 19 nt, Homo sapiens
gcgcggaucucaacaucaa

SEQ ID NO: 895499 - RNA, 19 nt, Homo sapiens
gaaggacauuuggcaauug

SEQ ID NO: 895500 - RNA, 19 nt, Homo sapiens
gucauucgcucauguaaga

SEQ ID NO: 895501 - RNA, 19 nt, Homo sapiens
gcacaggguuauagguguu

SEQ ID NO: 895502 - RNA, 19 nt, Homo sapiens
gcaaacgacagacucuuaa

SEQ ID NO: 895503 - RNA, 19 nt, Homo sapiens
ggugaggacuggccacuau

SEQ ID NO: 895504 - RNA, 19 nt, Homo sapiens
gagaacgucaugaguguaa

SEQ ID NO: 895505 - RNA, 19 nt, Homo sapiens
gaagauguaccuaaugaag

SEQ ID NO: 895506 - RNA, 19 nt, Homo sapiens
cuacaagaccucucgcaua

SEQ ID NO: 895507 - RNA, 19 nt, Homo sapiens
cagaucgaauuccgugaua

SEQ ID NO: 895508 - RNA, 19 nt, Homo sapiens
aggcugcucuggagaauaa

SEQ ID NO: 895509 - RNA, 19 nt, Homo sapiens
uuucagagauggagaguau

SEQ ID NO: 895510 - RNA, 19 nt, Homo sapiens
gaaagaagaauggcaaugg

SEQ ID NO: 895511 - RNA, 19 nt, Homo sapiens
ggcaaacgacagacucuua

SEQ ID NO: 895512 - RNA, 19 nt, Homo sapiens
uacaagaccucucgcauag

SEQ ID NO: 895513 - RNA, 19 nt, Homo sapiens
agacugaaccgcuauaaga

SEQ ID NO: 895514 - RNA, 19 nt, Homo sapiens
gaacuggucacuggaaaga

SEQ ID NO: 895515 - RNA, 19 nt, Homo sapiens
ggaaggaaagugauucugu

SEQ ID NO: 895516 - RNA, 19 nt, Homo sapiens
ggaagacgccgauggaucu

SEQ ID NO: 895517 - RNA, 19 nt, Homo sapiens
aaacggacagcucuucaua

SEQ ID NO: 895518 - RNA, 19 nt, Homo sapiens
ccucugaguuggcuccuaa

SEQ ID NO: 895519 - RNA, 19 nt, Homo sapiens
cgaauuccgugauaugcuu

SEQ ID NO: 895520 - RNA, 19 nt, Homo sapiens
agauguaccuaaugaaguu

SEQ ID NO: 895521 - RNA, 19 nt, Homo sapiens
ggacaggaaaggaaacaau

SEQ ID NO: 895522 - RNA, 19 nt, Homo sapiens
gauuaucacagcccucuuu

SEQ ID NO: 895523 - RNA, 19 nt, Homo sapiens
uuuaagagagggcugauua

SEQ ID NO: 895524 - RNA, 19 nt, Homo sapiens
gugcuacacuggcagaaug

SEQ ID NO: 895525 - RNA, 19 nt, Homo sapiens
gcagagcuucauuuguaua

SEQ ID NO: 895526 - RNA, 19 nt, Homo sapiens
caacaugaugguacugaaa

SEQ ID NO: 895527 - RNA, 19 nt, Homo sapiens
auucagaccuucaugauca

SEQ ID NO: 895528 - RNA, 19 nt, Homo sapiens
gaaggcugcucuggagaau

SEQ ID NO: 895529 - RNA, 19 nt, Homo sapiens
accagaaccugaaaucauu

SEQ ID NO: 895530 - RNA, 19 nt, Homo sapiens
gauauucagaccuucauga

SEQ ID NO: 895531 - RNA, 19 nt, Homo sapiens
gcaauuguggagaaguuaa

SEQ ID NO: 895532 - RNA, 19 nt, Homo sapiens
gcaggaggaucugaagaca

SEQ ID NO: 895533 - RNA, 19 nt, Homo sapiens
uuacuucgguucccagguu

SEQ ID NO: 895534 - RNA, 19 nt, Homo sapiens
aagagacacuagccauaaa

SEQ ID NO: 895535 - RNA, 19 nt, Homo sapiens
cugaaccgcuauaagauga

SEQ ID NO: 895536 - RNA, 19 nt, Homo sapiens
acccauagguaguucuuaa

SEQ ID NO: 895537 - RNA, 19 nt, Homo sapiens
gagaaagcacaggguuaua

SEQ ID NO: 895538 - RNA, 19 nt, Homo sapiens
gaucgaauuccgugauaug

SEQ ID NO: 895539 - RNA, 19 nt, Homo sapiens
ucauagagcaugcuuggaa

SEQ ID NO: 895540 - RNA, 19 nt, Homo sapiens
acggacagcucuucauaga

SEQ ID NO: 895541 - RNA, 19 nt, Homo sapiens
gacaagaacaauccagaug

SEQ ID NO: 895542 - RNA, 19 nt, Homo sapiens
gaaccagaaccugaaauca

SEQ ID NO: 895543 - RNA, 19 nt, Homo sapiens
aagagaacgucaugagugu

SEQ ID NO: 895544 - RNA, 19 nt, Homo sapiens
caagaccucucgcauagcu

SEQ ID NO: 895545 - RNA, 19 nt, Homo sapiens
ucagagagaacuccuacaa

SEQ ID NO: 895546 - RNA, 19 nt, Homo sapiens
gaaccaaagcaauauucga

SEQ ID NO: 895547 - RNA, 19 nt, Homo sapiens
ggacagugaagccagcuau

SEQ ID NO: 895548 - RNA, 19 nt, Homo sapiens
gaaagugauucugugaaaa

SEQ ID NO: 895549 - RNA, 19 nt, Homo sapiens
agaagaccuugaaauaauc

SEQ ID NO: 895550 - RNA, 19 nt, Homo sapiens
acacagaguacccaaguga

SEQ ID NO: 895551 - RNA, 19 nt, Homo sapiens
cgauggaucuggugcuaca

SEQ ID NO: 895552 - RNA, 19 nt, Homo sapiens
gaaccgcuauaagaugauc

SEQ ID NO: 895553 - RNA, 19 nt, Homo sapiens
ggaaccagaaccugaaauc

SEQ ID NO: 895554 - RNA, 19 nt, Homo sapiens
acugggacaugcagaauug

SEQ ID NO: 895555 - RNA, 19 nt, Homo sapiens
aggaaacaauggaaggaaa

SEQ ID NO: 895556 - RNA, 19 nt, Homo sapiens
ggaaagaagaauggcaaug

SEQ ID NO: 895557 - RNA, 19 nt, Homo sapiens
ccaacaugaugguacugaa

SEQ ID NO: 895558 - RNA, 19 nt, Homo sapiens
agaagagacacuagccaua

SEQ ID NO: 895559 - RNA, 19 nt, Homo sapiens
ccagaaccugaaaucauua

SEQ ID NO: 895560 - RNA, 19 nt, Homo sapiens
gcagagcucccaaagaaaa

SEQ ID NO: 895561 - RNA, 19 nt, Homo sapiens
cgacagacucuuaaucagu

SEQ ID NO: 895562 - RNA, 19 nt, Homo sapiens
gaugauccgacuccugauu

SEQ ID NO: 895563 - RNA, 19 nt, Homo sapiens
aagcugcuguuacuuuaga

SEQ ID NO: 895564 - RNA, 19 nt, Homo sapiens
ggugagcagagcuucauuu

SEQ ID NO: 895565 - RNA, 19 nt, Homo sapiens
caaagauccaagcuugaaa

SEQ ID NO: 895566 - RNA, 19 nt, Homo sapiens
gacaggaaaggaaacaaug

SEQ ID NO: 895567 - RNA, 19 nt, Homo sapiens
gaaagagcaaaguucaagu

SEQ ID NO: 895568 - RNA, 19 nt, Homo sapiens
uuacggaaccuguggaugu

SEQ ID NO: 895569 - RNA, 19 nt, Homo sapiens
gaagaccuugaaauaauca

SEQ ID NO: 895570 - RNA, 19 nt, Homo sapiens
caaacugggacaugcagaa

SEQ ID NO: 895571 - RNA, 19 nt, Homo sapiens
ggaaacaauggaaggaaag

SEQ ID NO: 895572 - RNA, 19 nt, Homo sapiens
guagggacaggaaaggaaa

SEQ ID NO: 895573 - RNA, 19 nt, Homo sapiens
ugagaaagcacaggguuau

SEQ ID NO: 895574 - RNA, 19 nt, Homo sapiens
gccgauggaucuggugcua

SEQ ID NO: 895575 - RNA, 19 nt, Homo sapiens
uggcaauuguggagaaguu

SEQ ID NO: 895576 - RNA, 19 nt, Homo sapiens
gaaagcacaggguuauagg

SEQ ID NO: 895577 - RNA, 19 nt, Homo sapiens
ccucaacgccaaagacaga

SEQ ID NO: 895578 - RNA, 19 nt, Homo sapiens
acaaagauccaagcuugaa

SEQ ID NO: 895579 - RNA, 19 nt, Homo sapiens
acagugaagccagcuauuu

SEQ ID NO: 895580 - RNA, 19 nt, Homo sapiens
caauccagauguuugugau

SEQ ID NO: 895581 - RNA, 19 nt, Homo sapiens
guacccaagugaagagaac

SEQ ID NO: 895582 - RNA, 19 nt, Homo sapiens
aaaggaaccagaaccugaa

SEQ ID NO: 895583 - RNA, 19 nt, Homo sapiens
uaaaguuccaguuguaaag

SEQ ID NO: 895584 - RNA, 19 nt, Homo sapiens
gaguguaagugcaaaucag

SEQ ID NO: 895585 - RNA, 19 nt, Homo sapiens
gaacgucaugaguguaagu

SEQ ID NO: 895586 - RNA, 19 nt, Homo sapiens
gaggaacuggucacuggaa

SEQ ID NO: 895587 - RNA, 19 nt, Homo sapiens
aaacuaagaccgaguauga

SEQ ID NO: 895588 - RNA, 19 nt, Homo sapiens
ggaacaauuucgcagagaa

SEQ ID NO: 895589 - RNA, 19 nt, Homo sapiens
gaaccugaccgcaagaaag

SEQ ID NO: 895590 - RNA, 19 nt, Homo sapiens
cggauaagguggucgugaa

SEQ ID NO: 895591 - RNA, 19 nt, Homo sapiens
gguuuaaggucuccguguu

SEQ ID NO: 895592 - RNA, 19 nt, Homo sapiens
cagaaggcuuggagagcua

SEQ ID NO: 895593 - RNA, 19 nt, Homo sapiens
ugaagcggcugagaaguca

SEQ ID NO: 895594 - RNA, 19 nt, Homo sapiens
ggauaagguggucgugaaa

SEQ ID NO: 895595 - RNA, 19 nt, Homo sapiens
gaacaauuucgcagagaag

SEQ ID NO: 895596 - RNA, 19 nt, Homo sapiens
acacagucauaaaccacua

SEQ ID NO: 895597 - RNA, 19 nt, Homo sapiens
gggaacaauuucgcagaga

SEQ ID NO: 895598 - RNA, 19 nt, Homo sapiens
agacugaagcggcugagaa

SEQ ID NO: 895599 - RNA, 19 nt, Homo sapiens
gcuacuacgcggagcaaga

SEQ ID NO: 895600 - RNA, 19 nt, Homo sapiens
uguccgagcaggagacuga

SEQ ID NO: 895601 - RNA, 19 nt, Homo sapiens
acuacaaccuggccaagca

SEQ ID NO: 895602 - RNA, 19 nt, Homo sapiens
cagagaagggcaccaagca

SEQ ID NO: 895603 - RNA, 19 nt, Homo sapiens
ucaagaacacccagugcau

SEQ ID NO: 895604 - RNA, 19 nt, Homo sapiens
gauggguucguccucaaga

SEQ ID NO: 895605 - RNA, 19 nt, Homo sapiens
acaagguguacaaguauga

SEQ ID NO: 895606 - RNA, 19 nt, Homo sapiens
gaguucaccgucagcauca

SEQ ID NO: 895607 - RNA, 19 nt, Homo sapiens
ucaccgagagguuuaaggu

SEQ ID NO: 895608 - RNA, 19 nt, Homo sapiens
gacugaagcggcugagaag

SEQ ID NO: 895609 - RNA, 19 nt, Homo sapiens
gggagaaauuuuacacagu

SEQ ID NO: 895610 - RNA, 19 nt, Homo sapiens
guuuaaggucuccguguug

SEQ ID NO: 895611 - RNA, 19 nt, Homo sapiens
gaaaggauauggaugauga

SEQ ID NO: 895612 - RNA, 19 nt, Homo sapiens
ggaaauaucugugucuuga

SEQ ID NO: 895613 - RNA, 19 nt, Homo sapiens
uaacauaucuucacuguag

SEQ ID NO: 895614 - RNA, 19 nt, Homo sapiens
gaguaacacugcauucuua

SEQ ID NO: 895615 - RNA, 19 nt, Homo sapiens
gaaauaugccugucaguuu

SEQ ID NO: 895616 - RNA, 19 nt, Homo sapiens
ggauauggaugaugacaaa

SEQ ID NO: 895617 - RNA, 19 nt, Homo sapiens
gcaaugcuguuacaacuug

SEQ ID NO: 895618 - RNA, 19 nt, Homo sapiens
caaagccauucccaaauua

SEQ ID NO: 895619 - RNA, 19 nt, Homo sapiens
ggacuguaguuuagaaauu

SEQ ID NO: 895620 - RNA, 19 nt, Homo sapiens
gcacuacucuaggcuauuu

SEQ ID NO: 895621 - RNA, 19 nt, Homo sapiens
gcaaauaagucugagauca

SEQ ID NO: 895622 - RNA, 19 nt, Homo sapiens
ccacuaaucuucaggauca

SEQ ID NO: 895623 - RNA, 19 nt, Homo sapiens
ccaaagccauucccaaauu

SEQ ID NO: 895624 - RNA, 19 nt, Homo sapiens
ccaaaucuguguauuguga

SEQ ID NO: 895625 - RNA, 19 nt, Homo sapiens
ccagaaagaucuccucaga

SEQ ID NO: 895626 - RNA, 19 nt, Homo sapiens
ccacaaggacuuuagcuua

SEQ ID NO: 895627 - RNA, 19 nt, Homo sapiens
gaaccaaggcucagaaguu

SEQ ID NO: 895628 - RNA, 19 nt, Homo sapiens
ugaaugagcugguauugau

SEQ ID NO: 895629 - RNA, 19 nt, Homo sapiens
uagaagaucuguauugugu

SEQ ID NO: 895630 - RNA, 19 nt, Homo sapiens
gaaaugcucuagaagaucu

SEQ ID NO: 895631 - RNA, 19 nt, Homo sapiens
ugacaaagaugcaaauaag

SEQ ID NO: 895632 - RNA, 19 nt, Homo sapiens
agaaagaucuccucagaau

SEQ ID NO: 895633 - RNA, 19 nt, Homo sapiens
caauaaagcuuugacugaa

SEQ ID NO: 895634 - RNA, 19 nt, Homo sapiens
gaaggcagcaguauaaaga

SEQ ID NO: 895635 - RNA, 19 nt, Homo sapiens
gaagaucuguauuguguag

SEQ ID NO: 895636 - RNA, 19 nt, Homo sapiens
gcaccugccucagauagua

SEQ ID NO: 895637 - RNA, 19 nt, Homo sapiens
acacaaugcugcaaugaaa

SEQ ID NO: 895638 - RNA, 19 nt, Homo sapiens
ugaaugggcuugcuaugaa

SEQ ID NO: 895639 - RNA, 19 nt, Homo sapiens
aagaagcuguuaccaguua

SEQ ID NO: 895640 - RNA, 19 nt, Homo sapiens
ucuauuaccuuaggaguua

SEQ ID NO: 895641 - RNA, 19 nt, Homo sapiens
gaagguaggcaaugaaguu

SEQ ID NO: 895642 - RNA, 19 nt, Homo sapiens
gagaucagcuuaguguuug

SEQ ID NO: 895643 - RNA, 19 nt, Homo sapiens
ccagggaacuccuuaugaa

SEQ ID NO: 895644 - RNA, 19 nt, Homo sapiens
gagcugguauugauguaaa

SEQ ID NO: 895645 - RNA, 19 nt, Homo sapiens
cagauacuguugcuuauug

SEQ ID NO: 895646 - RNA, 19 nt, Homo sapiens
uaaaucagauguucucagu

SEQ ID NO: 895647 - RNA, 19 nt, Homo sapiens
gaagguucuuugugguuaa

SEQ ID NO: 895648 - RNA, 19 nt, Homo sapiens
aaaagaaggucauguguuu

SEQ ID NO: 895649 - RNA, 19 nt, Homo sapiens
gcauaacaauguguauuug

SEQ ID NO: 895650 - RNA, 19 nt, Homo sapiens
gaaugggcuugcuaugaaa

SEQ ID NO: 895651 - RNA, 19 nt, Homo sapiens
gcaguuuggucaauauugu

SEQ ID NO: 895652 - RNA, 19 nt, Homo sapiens
gcauagcccaucuucauaa

SEQ ID NO: 895653 - RNA, 19 nt, Homo sapiens
aagaagaacucaaagauac

SEQ ID NO: 895654 - RNA, 19 nt, Homo sapiens
cuucagacauuugguguua

SEQ ID NO: 895655 - RNA, 19 nt, Homo sapiens
ccaauaaagcuuugacuga

SEQ ID NO: 895656 - RNA, 19 nt, Homo sapiens
gauacaacauucuagaagu

SEQ ID NO: 895657 - RNA, 19 nt, Homo sapiens
ugauucagguacaccauua

SEQ ID NO: 895658 - RNA, 19 nt, Homo sapiens
aaaguaaucucuggcacua

SEQ ID NO: 895659 - RNA, 19 nt, Homo sapiens
gaaauuacaggaccagcuu

SEQ ID NO: 895660 - RNA, 19 nt, Homo sapiens
uaucggcucugucaucuga

SEQ ID NO: 895661 - RNA, 19 nt, Homo sapiens
gaacucaaagauacacaaa

SEQ ID NO: 895662 - RNA, 19 nt, Homo sapiens
cagcacuccuuuauggaua

SEQ ID NO: 895663 - RNA, 19 nt, Homo sapiens
gaacacaaaggacagacaa

SEQ ID NO: 895664 - RNA, 19 nt, Homo sapiens
caacuggaauauuuagcaa

SEQ ID NO: 895665 - RNA, 19 nt, Homo sapiens
gaacugaaugggcuugcua

SEQ ID NO: 895666 - RNA, 19 nt, Homo sapiens
cuagagccauuguauguga

SEQ ID NO: 895667 - RNA, 19 nt, Homo sapiens
cuaccagaaugucuuaauu

SEQ ID NO: 895668 - RNA, 19 nt, Homo sapiens
gcuuggagcuguuguuaca

SEQ ID NO: 895669 - RNA, 19 nt, Homo sapiens
ccauuaagauacaacauuc

SEQ ID NO: 895670 - RNA, 19 nt, Homo sapiens
gacauuugguguuaguauu

SEQ ID NO: 895671 - RNA, 19 nt, Homo sapiens
uuacaggaccagcuuguua

SEQ ID NO: 895672 - RNA, 19 nt, Homo sapiens
uaauuggacuguaguuuag

SEQ ID NO: 895673 - RNA, 19 nt, Homo sapiens
aaacaaagcacaaauugca

SEQ ID NO: 895674 - RNA, 19 nt, Homo sapiens
uaacuugacuggaugaacu

SEQ ID NO: 895675 - RNA, 19 nt, Homo sapiens
gaauaguucagcuacaauu

SEQ ID NO: 895676 - RNA, 19 nt, Homo sapiens
uauaaagcauccacuaauc

SEQ ID NO: 895677 - RNA, 19 nt, Homo sapiens
gcagaaggagaaggaaaua

SEQ ID NO: 895678 - RNA, 19 nt, Homo sapiens
uuagaaaugucugagagua

SEQ ID NO: 895679 - RNA, 19 nt, Homo sapiens
ccagguaguuguuaguguu

SEQ ID NO: 895680 - RNA, 19 nt, Homo sapiens
gaacccuucugauucuuuc

SEQ ID NO: 895681 - RNA, 19 nt, Homo sapiens
gaauauggccaagggauga

SEQ ID NO: 895682 - RNA, 19 nt, Homo sapiens
uccaagcacugcagaauga

SEQ ID NO: 895683 - RNA, 19 nt, Homo sapiens
ugugacagcuauauuguau

SEQ ID NO: 895684 - RNA, 19 nt, Homo sapiens
aaccaaggcucagaaguuu

SEQ ID NO: 895685 - RNA, 19 nt, Homo sapiens
ucacuguagucaacaugua

SEQ ID NO: 895686 - RNA, 19 nt, Homo sapiens
ucuaagcucuuggcaauga

SEQ ID NO: 895687 - RNA, 19 nt, Homo sapiens
uauaaucuccguaggauga

SEQ ID NO: 895688 - RNA, 19 nt, Homo sapiens
ggcauaacaauguguauuu

SEQ ID NO: 895689 - RNA, 19 nt, Homo sapiens
uuacugugcuucuuugguu

SEQ ID NO: 895690 - RNA, 19 nt, Homo sapiens
gcucugucaucugaaauuu

SEQ ID NO: 895691 - RNA, 19 nt, Homo sapiens
ugaacuaguuugcuugugu

SEQ ID NO: 895692 - RNA, 19 nt, Homo sapiens
aaucagcacuccuuuaugg

SEQ ID NO: 895693 - RNA, 19 nt, Homo sapiens
aaauugcucugaagcgaaa

SEQ ID NO: 895694 - RNA, 19 nt, Homo sapiens
gaacuguaaccgcuaacuu

SEQ ID NO: 895695 - RNA, 19 nt, Homo sapiens
ggaaaagccaaaacuauuu

SEQ ID NO: 895696 - RNA, 19 nt, Homo sapiens
cagcuuaguguuugaaauu

SEQ ID NO: 895697 - RNA, 19 nt, Homo sapiens
caauaacccaggcaguaua

SEQ ID NO: 895698 - RNA, 19 nt, Homo sapiens
guaacccucucagguauau

SEQ ID NO: 895699 - RNA, 19 nt, Homo sapiens
uagcccaucuucauaaugu

SEQ ID NO: 895700 - RNA, 19 nt, Homo sapiens
gagcagaaucuccgggaaa

SEQ ID NO: 895701 - RNA, 19 nt, Homo sapiens
gccugucucuucuccauuu

SEQ ID NO: 895702 - RNA, 19 nt, Homo sapiens
ugagaucagcuuaguguuu

SEQ ID NO: 895703 - RNA, 19 nt, Homo sapiens
gcauguacaaucagaggua

SEQ ID NO: 895704 - RNA, 19 nt, Homo sapiens
cacguuauauguuuccaaa

SEQ ID NO: 895705 - RNA, 19 nt, Homo sapiens
gagucugcuucccucauua

SEQ ID NO: 895706 - RNA, 19 nt, Homo sapiens
guuucuaauuggacucuua

SEQ ID NO: 895707 - RNA, 19 nt, Homo sapiens
gguagcaccugccucagau

SEQ ID NO: 895708 - RNA, 19 nt, Homo sapiens
caggaaaggauauggauga

SEQ ID NO: 895709 - RNA, 19 nt, Homo sapiens
ggucaauauugucuuaaca

SEQ ID NO: 895710 - RNA, 19 nt, Homo sapiens
uaacacugcauucuuauag

SEQ ID NO: 895711 - RNA, 19 nt, Homo sapiens
gaagcaagaucauuaguug

SEQ ID NO: 895712 - RNA, 19 nt, Homo sapiens
gcgaauaucuucccuuaca

SEQ ID NO: 895713 - RNA, 19 nt, Homo sapiens
gaagaaagcacgaaaugau

SEQ ID NO: 895714 - RNA, 19 nt, Homo sapiens
gaauguaacuggucacuac

SEQ ID NO: 895715 - RNA, 19 nt, Homo sapiens
uaaauccacucaucaaugu

SEQ ID NO: 895716 - RNA, 19 nt, Homo sapiens
ccucaaaguuucaugauau

SEQ ID NO: 895717 - RNA, 19 nt, Homo sapiens
gguaucaucuucaccaaau

SEQ ID NO: 895718 - RNA, 19 nt, Homo sapiens
ugaaacaucugaaauucug

SEQ ID NO: 895719 - RNA, 19 nt, Homo sapiens
gugaagauccuuggaauuu

SEQ ID NO: 895720 - RNA, 19 nt, Homo sapiens
gaaauucugcugucaagau

SEQ ID NO: 895721 - RNA, 19 nt, Homo sapiens
uggcgaauaucuucccuua

SEQ ID NO: 895722 - RNA, 19 nt, Homo sapiens
uuacaaggguuauauaugg

SEQ ID NO: 895723 - RNA, 19 nt, Homo sapiens
gaauuaccgccucuucuuu

SEQ ID NO: 895724 - RNA, 19 nt, Homo sapiens
uguaaaggauggaaagcua

SEQ ID NO: 895725 - RNA, 19 nt, Homo sapiens
agaggaagcaagaucauua

SEQ ID NO: 895726 - RNA, 19 nt, Homo sapiens
gcaagugauugaaacaucu

SEQ ID NO: 895727 - RNA, 19 nt, Homo sapiens
ggaagcaagaucauuaguu

SEQ ID NO: 895728 - RNA, 19 nt, Homo sapiens
guggagaaguuauucaugu

SEQ ID NO: 895729 - RNA, 19 nt, Homo sapiens
uuacugacuuccuguuaaa

SEQ ID NO: 895730 - RNA, 19 nt, Homo sapiens
guuauuaaauccacucauc

SEQ ID NO: 895731 - RNA, 19 nt, Homo sapiens
aagcuacucuuaauugguu

SEQ ID NO: 895732 - RNA, 19 nt, Homo sapiens
ggaagcuacucuuaauugg

SEQ ID NO: 895733 - RNA, 19 nt, Homo sapiens
gaagauccuuggaauuuug

SEQ ID NO: 895734 - RNA, 19 nt, Homo sapiens
gcaagaucauuaguugaau

SEQ ID NO: 895735 - RNA, 19 nt, Homo sapiens
aaauggagauugccaccaa

SEQ ID NO: 895736 - RNA, 19 nt, Homo sapiens
ccuggaagcuacucuuaau

SEQ ID NO: 895737 - RNA, 19 nt, Homo sapiens
gccucaaaguuucaugaua

SEQ ID NO: 895738 - RNA, 19 nt, Homo sapiens
ggagaaguuauucauguga

SEQ ID NO: 895739 - RNA, 19 nt, Homo sapiens
caagaucauuaguugaauc

SEQ ID NO: 895740 - RNA, 19 nt, Homo sapiens
gaaagcacgaaaugaugaa

SEQ ID NO: 895741 - RNA, 19 nt, Homo sapiens
aaauucugcugucaagauu

SEQ ID NO: 895742 - RNA, 19 nt, Homo sapiens
ugaugaaggugaaacagau

SEQ ID NO: 895743 - RNA, 19 nt, Homo sapiens
uaacuggucacuacauuuc

SEQ ID NO: 895744 - RNA, 19 nt, Homo sapiens
gaaauaccucgguggacaa

SEQ ID NO: 895745 - RNA, 19 nt, Homo sapiens
ggcaagugauugaaacauc

SEQ ID NO: 895746 - RNA, 19 nt, Homo sapiens
guaucaucuucaccaaaua

SEQ ID NO: 895747 - RNA, 19 nt, Homo sapiens
ccugaagccucaaaguuuc

SEQ ID NO: 895748 - RNA, 19 nt, Homo sapiens
gcuauaaauugcacaaacg

SEQ ID NO: 895749 - RNA, 19 nt, Homo sapiens
uaauggaggagcuauaaau

SEQ ID NO: 895750 - RNA, 19 nt, Homo sapiens
aaacaaggcuuuugcucuu

SEQ ID NO: 895751 - RNA, 19 nt, Homo sapiens
cgaauaucuucccuuacaa

SEQ ID NO: 895752 - RNA, 19 nt, Homo sapiens
cacgaaaugaugaauauga

SEQ ID NO: 895753 - RNA, 19 nt, Homo sapiens
guaacuggucacuacauuu

SEQ ID NO: 895754 - RNA, 19 nt, Homo sapiens
ucccucagauucuuucuug

SEQ ID NO: 895755 - RNA, 19 nt, Homo sapiens
ggacaaaugcuaaaaugga

SEQ ID NO: 895756 - RNA, 19 nt, Homo sapiens
uggaagcuacucuuaauug

SEQ ID NO: 895757 - RNA, 19 nt, Homo sapiens
agaaagcacgaaaugauga

SEQ ID NO: 895758 - RNA, 19 nt, Homo sapiens
uuuacugacuuccuguuaa

SEQ ID NO: 895759 - RNA, 19 nt, Homo sapiens
gcagaauuaccgccucuuc

SEQ ID NO: 895760 - RNA, 19 nt, Homo sapiens
uggaggagcuauaaauugc

SEQ ID NO: 895761 - RNA, 19 nt, Homo sapiens
aauuaccgccucuucuuua

SEQ ID NO: 895762 - RNA, 19 nt, Homo sapiens
gaauaucuucccuuacaag

SEQ ID NO: 895763 - RNA, 19 nt, Homo sapiens
gauggaaagcuacgcuaug

SEQ ID NO: 895764 - RNA, 19 nt, Homo sapiens
auaccucgguggacaaaug

SEQ ID NO: 895765 - RNA, 19 nt, Homo sapiens
uuaaauccacucaucaaug

SEQ ID NO: 895766 - RNA, 19 nt, Homo sapiens
gaugaaggugaaacagauu

SEQ ID NO: 895767 - RNA, 19 nt, Homo sapiens
ugaagaaagcacgaaauga

SEQ ID NO: 895768 - RNA, 19 nt, Homo sapiens
guaauggaggagcuauaaa

SEQ ID NO: 895769 - RNA, 19 nt, Homo sapiens
cucugaaggugaacucuaa

SEQ ID NO: 895770 - RNA, 19 nt, Homo sapiens
ccaaggagccaaugaaucc

SEQ ID NO: 895771 - RNA, 19 nt, Homo sapiens
ccaccaaggagccaaugaa

SEQ ID NO: 895772 - RNA, 19 nt, Homo sapiens
agcacgaaaugaugaauau

SEQ ID NO: 895773 - RNA, 19 nt, Homo sapiens
uugaaucgguaucaucuuc

SEQ ID NO: 895774 - RNA, 19 nt, Homo sapiens
uguaauggaggagcuauaa

SEQ ID NO: 895775 - RNA, 19 nt, Homo sapiens
caaugcgaaugauccugaa

SEQ ID NO: 895776 - RNA, 19 nt, Homo sapiens
caaggguuauauauggaau

SEQ ID NO: 895777 - RNA, 19 nt, Homo sapiens
uacgcuauguggcgaauau

SEQ ID NO: 895778 - RNA, 19 nt, Homo sapiens
ggauggaaagcuacgcuau

SEQ ID NO: 895779 - RNA, 19 nt, Homo sapiens
uaugagcauuuacugacuu

SEQ ID NO: 895780 - RNA, 19 nt, Homo sapiens
gaggaagcaagaucauuag

SEQ ID NO: 895781 - RNA, 19 nt, Homo sapiens
ucaagaggaagcaagauca

SEQ ID NO: 895782 - RNA, 19 nt, Homo sapiens
gaagcuacucuuaauuggu

SEQ ID NO: 895783 - RNA, 19 nt, Homo sapiens
ugaaggugaacucuaaaga

SEQ ID NO: 895784 - RNA, 19 nt, Homo sapiens
caucaauguuggaaagcau

SEQ ID NO: 895785 - RNA, 19 nt, Homo sapiens
uaugguacccucccucaga

SEQ ID NO: 895786 - RNA, 19 nt, Homo sapiens
gugauugaaacaucugaaa

SEQ ID NO: 895787 - RNA, 19 nt, Homo sapiens
gccgugcuauggcccugua

SEQ ID NO: 895788 - RNA, 19 nt, Homo sapiens
uccugaagccucaaaguuu

SEQ ID NO: 895789 - RNA, 19 nt, Homo sapiens
uggagaaguuauucaugug

SEQ ID NO: 895790 - RNA, 19 nt, Homo sapiens
uacaaggguuauauaugga

SEQ ID NO: 895791 - RNA, 19 nt, Homo sapiens
gcauuccuaugaagaaagc

SEQ ID NO: 895792 - RNA, 19 nt, Homo sapiens
ccguugcacucaagaggaa

SEQ ID NO: 895793 - RNA, 19 nt, Homo sapiens
acucaucaauguuggaaag

SEQ ID NO: 895794 - RNA, 19 nt, Homo sapiens
uaccuggaagcuacucuua

SEQ ID NO: 895795 - RNA, 19 nt, Homo sapiens
gugaaacagauuggaaauu

SEQ ID NO: 895796 - RNA, 19 nt, Homo sapiens
aagcacgaaaugaugaaua

SEQ ID NO: 895797 - RNA, 19 nt, Homo sapiens
aagaaagcacgaaaugaug

SEQ ID NO: 895798 - RNA, 19 nt, Homo sapiens
aauggaggagcuauaaauu

SEQ ID NO: 895799 - RNA, 19 nt, Homo sapiens
ggugaaacagauuggaaau

SEQ ID NO: 895800 - RNA, 19 nt, Homo sapiens
cgaaaugaugaauaugaga

SEQ ID NO: 895801 - RNA, 19 nt, Homo sapiens
cugaaauucugcugucaag

SEQ ID NO: 895802 - RNA, 19 nt, Homo sapiens
uggcauuccuaugaagaaa

SEQ ID NO: 895803 - RNA, 19 nt, Homo sapiens
gcacgaaaugaugaauaug

SEQ ID NO: 895804 - RNA, 19 nt, Homo sapiens
ccaguuugcuuuuaaugga

SEQ ID NO: 895805 - RNA, 19 nt, Homo sapiens
auggaaagcuacgcuaugu

SEQ ID NO: 895806 - RNA, 19 nt, Homo sapiens
gaaggugaaacagauugga

SEQ ID NO: 895807 - RNA, 19 nt, Homo sapiens
gcuauguggcgaauaucuu

SEQ ID NO: 895808 - RNA, 19 nt, Homo sapiens
agcaagaucauuaguugaa

SEQ ID NO: 895809 - RNA, 19 nt, Homo sapiens
ggagcuauaaauugcacaa

SEQ ID NO: 895810 - RNA, 19 nt, Homo sapiens
uaagguaccagauggaaaa

SEQ ID NO: 895811 - RNA, 19 nt, Homo sapiens
gaacuuagcacuuguguua

SEQ ID NO: 895812 - RNA, 19 nt, Homo sapiens
gcacuuguguuauugauua

SEQ ID NO: 895813 - RNA, 19 nt, Homo sapiens
guaauccucucccaaauaa

SEQ ID NO: 895814 - RNA, 19 nt, Homo sapiens
ggagucaccugcagucuuu

SEQ ID NO: 895815 - RNA, 19 nt, Homo sapiens
gaauacagcuugcucuugu

SEQ ID NO: 895816 - RNA, 19 nt, Homo sapiens
gggcagauaugcauuaaau

SEQ ID NO: 895817 - RNA, 19 nt, Homo sapiens
ggagaacugugcucuuuga

SEQ ID NO: 895818 - RNA, 19 nt, Homo sapiens
gcagaaguaucaccaaugu

SEQ ID NO: 895819 - RNA, 19 nt, Homo sapiens
gagaauccuugauggaauu

SEQ ID NO: 895820 - RNA, 19 nt, Homo sapiens
gcauguuccuucuguauga

SEQ ID NO: 895821 - RNA, 19 nt, Homo sapiens
uaucaagcgugcagaagua

SEQ ID NO: 895822 - RNA, 19 nt, Homo sapiens
caauauagauguggucaug

SEQ ID NO: 895823 - RNA, 19 nt, Homo sapiens
uuacacugcuacaccauua

SEQ ID NO: 895824 - RNA, 19 nt, Homo sapiens
gcagauaugcauuaaauag

SEQ ID NO: 895825 - RNA, 19 nt, Homo sapiens
uaagaaacaucuggguauu

SEQ ID NO: 895826 - RNA, 19 nt, Homo sapiens
gcacacacauuuucaauuc

SEQ ID NO: 895827 - RNA, 19 nt, Homo sapiens
agaaacaucuggguauuug

SEQ ID NO: 895828 - RNA, 19 nt, Homo sapiens
gcuugggacugucuaauga

SEQ ID NO: 895829 - RNA, 19 nt, Homo sapiens
gaagauaagaaacauguca

SEQ ID NO: 895830 - RNA, 19 nt, Homo sapiens
guaaguccuuugauacaga

SEQ ID NO: 895831 - RNA, 19 nt, Homo sapiens
ccaaauaagcacacacauu

SEQ ID NO: 895832 - RNA, 19 nt, Homo sapiens
cagcuuucguugaaguuua

SEQ ID NO: 895833 - RNA, 19 nt, Homo sapiens
caaagaggcagcauuggaa

SEQ ID NO: 895834 - RNA, 19 nt, Homo sapiens
aagaaucaauggcuguuaa

SEQ ID NO: 895835 - RNA, 19 nt, Homo sapiens
acaguauacucaugaauug

SEQ ID NO: 895836 - RNA, 19 nt, Homo sapiens
guaagaaacaucuggguau

SEQ ID NO: 895837 - RNA, 19 nt, Homo sapiens
uaagugauuuggagcuuug

SEQ ID NO: 895838 - RNA, 19 nt, Homo sapiens
ggcaauguacgguggauua

SEQ ID NO: 895839 - RNA, 19 nt, Homo sapiens
gggccugggucucgucuuu

SEQ ID NO: 895840 - RNA, 19 nt, Homo sapiens
gagauuggagcuauugaaa

SEQ ID NO: 895841 - RNA, 19 nt, Homo sapiens
ugggagaacuggccaagaa

SEQ ID NO: 895842 - RNA, 19 nt, Homo sapiens
agaauuccaucacgaagaa

SEQ ID NO: 895843 - RNA, 19 nt, Homo sapiens
ccggagaacugugcucuuu

SEQ ID NO: 895844 - RNA, 19 nt, Homo sapiens
uaaaguuugugucaugaga

SEQ ID NO: 895845 - RNA, 19 nt, Homo sapiens
gaagaaucaauggcuguua

SEQ ID NO: 895846 - RNA, 19 nt, Homo sapiens
caaacaguauacucaugaa

SEQ ID NO: 895847 - RNA, 19 nt, Homo sapiens
ugacuuguacagaauguua

SEQ ID NO: 895848 - RNA, 19 nt, Homo sapiens
cuaaugagauuggagcuau

SEQ ID NO: 895849 - RNA, 19 nt, Homo sapiens
gggacugucuaaugagauu

SEQ ID NO: 895850 - RNA, 19 nt, Homo sapiens
caauggcuguuaacaccua

SEQ ID NO: 895851 - RNA, 19 nt, Homo sapiens
gacaauuggugugaccuuu

SEQ ID NO: 895852 - RNA, 19 nt, Homo sapiens
agaaagaaaugaagugacu

SEQ ID NO: 895853 - RNA, 19 nt, Homo sapiens
caccauuacuuucuugaga

SEQ ID NO: 895854 - RNA, 19 nt, Homo sapiens
ugucaccucuucaagcuuu

SEQ ID NO: 895855 - RNA, 19 nt, Homo sapiens
uagauguggucauguuuga

SEQ ID NO: 895856 - RNA, 19 nt, Homo sapiens
gcucuugggugacaauugg

SEQ ID NO: 895857 - RNA, 19 nt, Homo sapiens
uaauuuggccucaguaugu

SEQ ID NO: 895858 - RNA, 19 nt, Homo sapiens
cagggaauaugccaccaaa

SEQ ID NO: 895859 - RNA, 19 nt, Homo sapiens
agaaguaucaccaauguau

SEQ ID NO: 895860 - RNA, 19 nt, Homo sapiens
uuaguagguucacugagua

SEQ ID NO: 895861 - RNA, 19 nt, Homo sapiens
gcagggaguauugguuuaa

SEQ ID NO: 895862 - RNA, 19 nt, Homo sapiens
uuaggaggcuuuaaugaag

SEQ ID NO: 895863 - RNA, 19 nt, Homo sapiens
cagaagaguuauauuuagg

SEQ ID NO: 895864 - RNA, 19 nt, Homo sapiens
cuaguucugucuuaaugaa

SEQ ID NO: 895865 - RNA, 19 nt, Homo sapiens
gcuucuggcuucucugcua

SEQ ID NO: 895866 - RNA, 19 nt, Homo sapiens
aauguacgguggauuaguu

SEQ ID NO: 895867 - RNA, 19 nt, Homo sapiens
ucagugcucucuuuccaau

SEQ ID NO: 895868 - RNA, 19 nt, Homo sapiens
guaaagggaccagagagaa

SEQ ID NO: 895869 - RNA, 19 nt, Homo sapiens
ggagugcagaauauuguaa

SEQ ID NO: 895870 - RNA, 19 nt, Homo sapiens
ggaggcaacagaaagaaau

SEQ ID NO: 895871 - RNA, 19 nt, Homo sapiens
ggcuuacacuggaaauuau

SEQ ID NO: 895872 - RNA, 19 nt, Homo sapiens
uggcuuacacuggaaauua

SEQ ID NO: 895873 - RNA, 19 nt, Homo sapiens
gaaacaggcacaggugaug

SEQ ID NO: 895874 - RNA, 19 nt, Homo sapiens
uagguucacugaguaacua

SEQ ID NO: 895875 - RNA, 19 nt, Homo sapiens
acacuaccuucuaggguuu

SEQ ID NO: 895876 - RNA, 19 nt, Homo sapiens
gauaagaaacaugucauca

SEQ ID NO: 895877 - RNA, 19 nt, Homo sapiens
caacagaaagaaaugaagu

SEQ ID NO: 895878 - RNA, 19 nt, Homo sapiens
caacuggaggcaacagaaa

SEQ ID NO: 895879 - RNA, 19 nt, Homo sapiens
gugcagaaguaucaccaau

SEQ ID NO: 895880 - RNA, 19 nt, Homo sapiens
ugaaaaggcuguaauuugg

SEQ ID NO: 895881 - RNA, 19 nt, Homo sapiens
gcaugaaauauguugcuuu

SEQ ID NO: 895882 - RNA, 19 nt, Homo sapiens
caaagcaugaaauauguug

SEQ ID NO: 895883 - RNA, 19 nt, Homo sapiens
caugagaauguaagucuuu

SEQ ID NO: 895884 - RNA, 19 nt, Homo sapiens
cguugaaguuuagaagaua

SEQ ID NO: 895885 - RNA, 19 nt, Homo sapiens
gcuacauucuggugugaug

SEQ ID NO: 895886 - RNA, 19 nt, Homo sapiens
uacgaucaauaccauauga

SEQ ID NO: 895887 - RNA, 19 nt, Homo sapiens
gcuacaccauuacuuucuu

SEQ ID NO: 895888 - RNA, 19 nt, Homo sapiens
guauacucaugaauugcua

SEQ ID NO: 895889 - RNA, 19 nt, Homo sapiens
uggcuucucugcuacauca

SEQ ID NO: 895890 - RNA, 19 nt, Homo sapiens
gcaacuggaggcaacagaa

SEQ ID NO: 895891 - RNA, 19 nt, Homo sapiens
gcaucuugcuugguugcua

SEQ ID NO: 895892 - RNA, 19 nt, Homo sapiens
ucaaagaggcagcauugga

SEQ ID NO: 895893 - RNA, 19 nt, Homo sapiens
uaaguccuuugauacagaa

SEQ ID NO: 895894 - RNA, 19 nt, Homo sapiens
cgcauugccucucagacua

SEQ ID NO: 895895 - RNA, 19 nt, Homo sapiens
acaaacaguauacucauga

SEQ ID NO: 895896 - RNA, 19 nt, Homo sapiens
auauagauguggucauguu

SEQ ID NO: 895897 - RNA, 19 nt, Homo sapiens
acuuagcacuuguguuauu

SEQ ID NO: 895898 - RNA, 19 nt, Homo sapiens
gguaaagggaccagagaga

SEQ ID NO: 895899 - RNA, 19 nt, Homo sapiens
uggcuccucugacaauauu

SEQ ID NO: 895900 - RNA, 19 nt, Homo sapiens
gcauugccucucagacuaa

SEQ ID NO: 895901 - RNA, 19 nt, Homo sapiens
acucaugaauugcuaagug

SEQ ID NO: 895902 - RNA, 19 nt, Homo sapiens
aggcacaggugaugcauuc

SEQ ID NO: 895903 - RNA, 19 nt, Homo sapiens
aaccuguguuugcauauuu

SEQ ID NO: 895904 - RNA, 19 nt, Homo sapiens
gaaguaucaccaauguaug

SEQ ID NO: 895905 - RNA, 19 nt, Homo sapiens
ucauugggaucuauguuuc

SEQ ID NO: 895906 - RNA, 19 nt, Homo sapiens
gaacuggccaagaacucaa

SEQ ID NO: 895907 - RNA, 19 nt, Homo sapiens
guauugguuuaacagcuuu

SEQ ID NO: 895908 - RNA, 19 nt, Homo sapiens
uagcagggaguauugguuu

SEQ ID NO: 895909 - RNA, 19 nt, Homo sapiens
agagaauccuugauggaau

SEQ ID NO: 895910 - RNA, 19 nt, Homo sapiens
cagagaauccuugauggaa

SEQ ID NO: 895911 - RNA, 19 nt, Homo sapiens
gagaaagggugauaaagua

SEQ ID NO: 895912 - RNA, 19 nt, Homo sapiens
ggaaugaacugaaauacuu

SEQ ID NO: 895913 - RNA, 19 nt, Homo sapiens
gaagacugaucacaaauaa

SEQ ID NO: 895914 - RNA, 19 nt, Homo sapiens
ggagaagacugaucacaaa

SEQ ID NO: 895915 - RNA, 19 nt, Homo sapiens
gaagaacccuccauuuaug

SEQ ID NO: 895916 - RNA, 19 nt, Homo sapiens
ccaaagggauaccugauua

SEQ ID NO: 895917 - RNA, 19 nt, Homo sapiens
gcacaggaaugaacugaaa

SEQ ID NO: 895918 - RNA, 19 nt, Homo sapiens
caaggacaguguauuauaa

SEQ ID NO: 895919 - RNA, 19 nt, Homo sapiens
ggagcaagguggaauguuu

SEQ ID NO: 895920 - RNA, 19 nt, Homo sapiens
ggccaaagauucuguuaaa

SEQ ID NO: 895921 - RNA, 19 nt, Homo sapiens
ucacggauauguauaguuu

SEQ ID NO: 895922 - RNA, 19 nt, Homo sapiens
ggaagaacccuccauuuau

SEQ ID NO: 895923 - RNA, 19 nt, Homo sapiens
gaugaaaccuugucuuuac

SEQ ID NO: 895924 - RNA, 19 nt, Homo sapiens
gcaaagcuaugauauaaac

SEQ ID NO: 895925 - RNA, 19 nt, Homo sapiens
gauauaaacugcucuugca

SEQ ID NO: 895926 - RNA, 19 nt, Homo sapiens
ggucguucaucuuuaaaua

SEQ ID NO: 895927 - RNA, 19 nt, Homo sapiens
ggaaauuggucaaggacaa

SEQ ID NO: 895928 - RNA, 19 nt, Homo sapiens
gcacuaaguuaucuuuauc

SEQ ID NO: 895929 - RNA, 19 nt, Homo sapiens
gaaaccuugucuuuacuaa

SEQ ID NO: 895930 - RNA, 19 nt, Homo sapiens
cugcaaagcuaugauauaa

SEQ ID NO: 895931 - RNA, 19 nt, Homo sapiens
aaacaucccuacccaagaa

SEQ ID NO: 895932 - RNA, 19 nt, Homo sapiens
gcaaauagaagaaugagau

SEQ ID NO: 895933 - RNA, 19 nt, Homo sapiens
guaauaauguguuccaaag

SEQ ID NO: 895934 - RNA, 19 nt, Homo sapiens
gcagguccuuugcuucuaa

SEQ ID NO: 895935 - RNA, 19 nt, Homo sapiens
ccaaauggacugaaagaaa

SEQ ID NO: 895936 - RNA, 19 nt, Homo sapiens
gaugacuucugcaggauuu

SEQ ID NO: 895937 - RNA, 19 nt, Homo sapiens
acagauacuuggaggcuua

SEQ ID NO: 895938 - RNA, 19 nt, Homo sapiens
gaagcaaucaccauucuga

SEQ ID NO: 895939 - RNA, 19 nt, Homo sapiens
caaauggacugaaagaaac

SEQ ID NO: 895940 - RNA, 19 nt, Homo sapiens
gcuuaaaccaccacucuua

SEQ ID NO: 895941 - RNA, 19 nt, Homo sapiens
gauguccuaugggcaauua

SEQ ID NO: 895942 - RNA, 19 nt, Homo sapiens
gaacagaagaugaccuugu

SEQ ID NO: 895943 - RNA, 19 nt, Homo sapiens
gcacucugaugguucuaaa

SEQ ID NO: 895944 - RNA, 19 nt, Homo sapiens
ggucaggaguucaacauca

SEQ ID NO: 895945 - RNA, 19 nt, Homo sapiens
agggauaccugauuaaaga

SEQ ID NO: 895946 - RNA, 19 nt, Homo sapiens
gaauaaggaggcaaauaga

SEQ ID NO: 895947 - RNA, 19 nt, Homo sapiens
ucaaggacaguguauuaua

SEQ ID NO: 895948 - RNA, 19 nt, Homo sapiens
gauauuacgcuggaaauug

SEQ ID NO: 895949 - RNA, 19 nt, Homo sapiens
uugaagagccugagaguaa

SEQ ID NO: 895950 - RNA, 19 nt, Homo sapiens
ggaggcaaauagaagaaug

SEQ ID NO: 895951 - RNA, 19 nt, Homo sapiens
ugagaacacugaagcaauc

SEQ ID NO: 895952 - RNA, 19 nt, Homo sapiens
gaaaaccgacuaaggauuu

SEQ ID NO: 895953 - RNA, 19 nt, Homo sapiens
cauccagguugugcuauua

SEQ ID NO: 895954 - RNA, 19 nt, Homo sapiens
caagaaaggguaaacuguu

SEQ ID NO: 895955 - RNA, 19 nt, Homo sapiens
gauccuagaccuaacagaa

SEQ ID NO: 895956 - RNA, 19 nt, Homo sapiens
gacggcagcuaccuucuga

SEQ ID NO: 895957 - RNA, 19 nt, Homo sapiens
gggaguaacacuaaagcua

SEQ ID NO: 895958 - RNA, 19 nt, Homo sapiens
agacugaucacaaauaaga

SEQ ID NO: 895959 - RNA, 19 nt, Homo sapiens
ucucaucuuugaaggauuu

SEQ ID NO: 895960 - RNA, 19 nt, Homo sapiens
cacuaaagcuacaagaaau

SEQ ID NO: 895961 - RNA, 19 nt, Homo sapiens
gcucuucuccucucaaaug

SEQ ID NO: 895962 - RNA, 19 nt, Homo sapiens
gauagaaagugcuuaaacc

SEQ ID NO: 895963 - RNA, 19 nt, Homo sapiens
aaacaaaucagaagcagau

SEQ ID NO: 895964 - RNA, 19 nt, Homo sapiens
acacuaaagcuacaagaaa

SEQ ID NO: 895965 - RNA, 19 nt, Homo sapiens
ggauaaagcaaaugucaag

SEQ ID NO: 895966 - RNA, 19 nt, Homo sapiens
ugaagagccugagaguaaa

SEQ ID NO: 895967 - RNA, 19 nt, Homo sapiens
uauccaacauuucuccaaa

SEQ ID NO: 895968 - RNA, 19 nt, Homo sapiens
gaaagggugauaaaguaau

SEQ ID NO: 895969 - RNA, 19 nt, Homo sapiens
gaaauuggucaaggacaaa

SEQ ID NO: 895970 - RNA, 19 nt, Homo sapiens
gcugcaaagcuaugauaua

SEQ ID NO: 895971 - RNA, 19 nt, Homo sapiens
gauagguaauaauguguuc

SEQ ID NO: 895972 - RNA, 19 nt, Homo sapiens
ggacaguguauuauaacaa

SEQ ID NO: 895973 - RNA, 19 nt, Homo sapiens
gggcaauuagguaguauaa

SEQ ID NO: 895974 - RNA, 19 nt, Homo sapiens
uuucaaggacaguguauua

SEQ ID NO: 895975 - RNA, 19 nt, Homo sapiens
aaagguaaaugaagguaca

SEQ ID NO: 895976 - RNA, 19 nt, Homo sapiens
agaagacugaucacaaaua

SEQ ID NO: 895977 - RNA, 19 nt, Homo sapiens
gcuggaaauuggucaagga

SEQ ID NO: 895978 - RNA, 19 nt, Homo sapiens
gguuuacucugcacaggaa

SEQ ID NO: 895979 - RNA, 19 nt, Homo sapiens
gcaggagaauugcuugaac

SEQ ID NO: 895980 - RNA, 19 nt, Homo sapiens
caaagggauaccugauuaa

SEQ ID NO: 895981 - RNA, 19 nt, Homo sapiens
aacaaucccuuucccagaa

SEQ ID NO: 895982 - RNA, 19 nt, Homo sapiens
gcaaagaccggaguagaag

SEQ ID NO: 895983 - RNA, 19 nt, Homo sapiens
ugaugaaaccuugucuuua

SEQ ID NO: 895984 - RNA, 19 nt, Homo sapiens
gaagaaugagauacugaug

SEQ ID NO: 895985 - RNA, 19 nt, Homo sapiens
gguaauaauguguuccaaa

SEQ ID NO: 895986 - RNA, 19 nt, Homo sapiens
gguaaaugaagguacaauu

SEQ ID NO: 895987 - RNA, 19 nt, Homo sapiens
uaaccaagaaggaaacaga

SEQ ID NO: 895988 - RNA, 19 nt, Homo sapiens
ccaccgggcuguacucucu

SEQ ID NO: 895989 - RNA, 19 nt, Homo sapiens
gcuguacaauucgauuauu

SEQ ID NO: 895990 - RNA, 19 nt, Homo sapiens
gacaggcacucugaugguu

SEQ ID NO: 895991 - RNA, 19 nt, Homo sapiens
gaauacucacggauaugua

SEQ ID NO: 895992 - RNA, 19 nt, Homo sapiens
aaugaauacucacggauau

SEQ ID NO: 895993 - RNA, 19 nt, Homo sapiens
aaaugaauacucacggaua

SEQ ID NO: 895994 - RNA, 19 nt, Homo sapiens
agaaugagauacugauguc

SEQ ID NO: 895995 - RNA, 19 nt, Homo sapiens
caagauauuacgcuggaaa

SEQ ID NO: 895996 - RNA, 19 nt, Homo sapiens
agauuaugcugcaaagcua

SEQ ID NO: 895997 - RNA, 19 nt, Homo sapiens
agaauaaggaggcaaauag

SEQ ID NO: 895998 - RNA, 19 nt, Homo sapiens
gaguaacacuaaagcuaca

SEQ ID NO: 895999 - RNA, 19 nt, Homo sapiens
ugagaaagggugauaaagu

SEQ ID NO: 896000 - RNA, 19 nt, Homo sapiens
gaaauuuggcagguccuuu

SEQ ID NO: 896001 - RNA, 19 nt, Homo sapiens
ccaagccuauugacacuag

SEQ ID NO: 896002 - RNA, 19 nt, Homo sapiens
ggucugcucacucuuagaa

SEQ ID NO: 896003 - RNA, 19 nt, Homo sapiens
gcagacaggaagaacagaa

SEQ ID NO: 896004 - RNA, 19 nt, Homo sapiens
gguggguaauauuguguuu

SEQ ID NO: 896005 - RNA, 19 nt, Homo sapiens
agagcuagauguccuaugg

SEQ ID NO: 896006 - RNA, 19 nt, Homo sapiens
guugugcuauuaaccaaga

SEQ ID NO: 896007 - RNA, 19 nt, Homo sapiens
aaagagcaacuucuauuuc

SEQ ID NO: 896008 - RNA, 19 nt, Homo sapiens
gagcacuuguaagcacuaa

SEQ ID NO: 896009 - RNA, 19 nt, Homo sapiens
uaugggcaauuagguagua

SEQ ID NO: 896010 - RNA, 19 nt, Homo sapiens
ucccagaauuaguuguaua

SEQ ID NO: 896011 - RNA, 19 nt, Homo sapiens
gaacauaucuucacauuag

SEQ ID NO: 896012 - RNA, 19 nt, Homo sapiens
ggaaggcucuuuguuauua

SEQ ID NO: 896013 - RNA, 19 nt, Homo sapiens
gcaaugcucuggaaauaua

SEQ ID NO: 896014 - RNA, 19 nt, Homo sapiens
gaacaucacucagaaguuu

SEQ ID NO: 896015 - RNA, 19 nt, Homo sapiens
gaacagagcauaucauaga

SEQ ID NO: 896016 - RNA, 19 nt, Homo sapiens
ggaagaagcugcuacuguu

SEQ ID NO: 896017 - RNA, 19 nt, Homo sapiens
gcaccgaacucaaaugaaa

SEQ ID NO: 896018 - RNA, 19 nt, Homo sapiens
gaagaaauaugaagaagca

SEQ ID NO: 896019 - RNA, 19 nt, Homo sapiens
gaaauagugucucaguuug

SEQ ID NO: 896020 - RNA, 19 nt, Homo sapiens
gagaaugaauguagagauu

SEQ ID NO: 896021 - RNA, 19 nt, Homo sapiens
gacauaagauucuggauau

SEQ ID NO: 896022 - RNA, 19 nt, Homo sapiens
caaaugcaguuaagaauuc

SEQ ID NO: 896023 - RNA, 19 nt, Homo sapiens
gacaaaccaccauuuauua

SEQ ID NO: 896024 - RNA, 19 nt, Homo sapiens
gaagaaagauagucagaac

SEQ ID NO: 896025 - RNA, 19 nt, Homo sapiens
cuggagaucuguauaauaa

SEQ ID NO: 896026 - RNA, 19 nt, Homo sapiens
gaaacugaauucuacauca

SEQ ID NO: 896027 - RNA, 19 nt, Homo sapiens
agagaaagcuguugacaug

SEQ ID NO: 896028 - RNA, 19 nt, Homo sapiens
cagauuagcuuggaugaaa

SEQ ID NO: 896029 - RNA, 19 nt, Homo sapiens
gagcugagaucgcgccauu

SEQ ID NO: 896030 - RNA, 19 nt, Homo sapiens
gaauaaauguuagcucuuc

SEQ ID NO: 896031 - RNA, 19 nt, Homo sapiens
gaccagagcuacagcaugu

SEQ ID NO: 896032 - RNA, 19 nt, Homo sapiens
gcaccauuauguuuacuaa

SEQ ID NO: 896033 - RNA, 19 nt, Homo sapiens
gaauggagauccccaauuu

SEQ ID NO: 896034 - RNA, 19 nt, Homo sapiens
ggaagaagaucugauaaac

SEQ ID NO: 896035 - RNA, 19 nt, Homo sapiens
gaagugcccugaagaugau

SEQ ID NO: 896036 - RNA, 19 nt, Homo sapiens
gagcagcaguucauuuaau

SEQ ID NO: 896037 - RNA, 19 nt, Homo sapiens
gcagguauuuggacuguau

SEQ ID NO: 896038 - RNA, 19 nt, Homo sapiens
cagaacauaucuucacauu

SEQ ID NO: 896039 - RNA, 19 nt, Homo sapiens
gcacacauguugacccaau

SEQ ID NO: 896040 - RNA, 19 nt, Homo sapiens
gacaucaucucaaagcaaa

SEQ ID NO: 896041 - RNA, 19 nt, Homo sapiens
cuaaugauguuuccucuug

SEQ ID NO: 896042 - RNA, 19 nt, Homo sapiens
gccaagaggugauccaguu

SEQ ID NO: 896043 - RNA, 19 nt, Homo sapiens
gacaguccaugacaaguuu

SEQ ID NO: 896044 - RNA, 19 nt, Homo sapiens
gcacaguucugcaacaucu

SEQ ID NO: 896045 - RNA, 19 nt, Homo sapiens
guacuaaugguuucucuuu

SEQ ID NO: 896046 - RNA, 19 nt, Homo sapiens
gaaacugggucccuugaag

SEQ ID NO: 896047 - RNA, 19 nt, Homo sapiens
caacuaugguuauccucua

SEQ ID NO: 896048 - RNA, 19 nt, Homo sapiens
ugaaagguguucuuguuga

SEQ ID NO: 896049 - RNA, 19 nt, Homo sapiens
ugacaaaccaccauuuauu

SEQ ID NO: 896050 - RNA, 19 nt, Homo sapiens
gaaauaugaagaagcauug

SEQ ID NO: 896051 - RNA, 19 nt, Homo sapiens
agaccaagaugaucacauu

SEQ ID NO: 896052 - RNA, 19 nt, Homo sapiens
gcaguucauuuaauuguca

SEQ ID NO: 896053 - RNA, 19 nt, Homo sapiens
gaaagguguucuuguugau

SEQ ID NO: 896054 - RNA, 19 nt, Homo sapiens
ugaaauagugucucaguuu

SEQ ID NO: 896055 - RNA, 19 nt, Homo sapiens
ggucuuggaugaacagaug

SEQ ID NO: 896056 - RNA, 19 nt, Homo sapiens
gaaaucauagggccaaguu

SEQ ID NO: 896057 - RNA, 19 nt, Homo sapiens
gauauauggucauccucua

SEQ ID NO: 896058 - RNA, 19 nt, Homo sapiens
ucucguagcugacucuuug

SEQ ID NO: 896059 - RNA, 19 nt, Homo sapiens
cagcauguguauuugcaua

SEQ ID NO: 896060 - RNA, 19 nt, Homo sapiens
gacaaugugacacugauua

SEQ ID NO: 896061 - RNA, 19 nt, Homo sapiens
gaaaugcacagaacauauc

SEQ ID NO: 896062 - RNA, 19 nt, Homo sapiens
caaaggaaaugcacagaac

SEQ ID NO: 896063 - RNA, 19 nt, Homo sapiens
gaacaaauacagcuuucug

SEQ ID NO: 896064 - RNA, 19 nt, Homo sapiens
ggaaaccagugacccugaa

SEQ ID NO: 896065 - RNA, 19 nt, Homo sapiens
aaagagaguucaacaccuu

SEQ ID NO: 896066 - RNA, 19 nt, Homo sapiens
aacccaagcugaaguauga

SEQ ID NO: 896067 - RNA, 19 nt, Homo sapiens
aaugaaagguguucuuguu

SEQ ID NO: 896068 - RNA, 19 nt, Homo sapiens
ggagagcugugggaagauu

SEQ ID NO: 896069 - RNA, 19 nt, Homo sapiens
aaacagaucagucuuuaug

SEQ ID NO: 896070 - RNA, 19 nt, Homo sapiens
uaaagaaauuggacagcuu

SEQ ID NO: 896071 - RNA, 19 nt, Homo sapiens
ugacauagcagcacgcaaa

SEQ ID NO: 896072 - RNA, 19 nt, Homo sapiens
ggaaaugcacagaacauau

SEQ ID NO: 896073 - RNA, 19 nt, Homo sapiens
ccaggaagaagaucugaua

SEQ ID NO: 896074 - RNA, 19 nt, Homo sapiens
uggcaaugcucuggaaaua

SEQ ID NO: 896075 - RNA, 19 nt, Homo sapiens
gacaagaacuauggcaaug

SEQ ID NO: 896076 - RNA, 19 nt, Homo sapiens
cagaacaagacuuuacuua

SEQ ID NO: 896077 - RNA, 19 nt, Homo sapiens
gaagaagcugcuacuguuu

SEQ ID NO: 896078 - RNA, 19 nt, Homo sapiens
gcacccacauuucgugaga

SEQ ID NO: 896079 - RNA, 19 nt, Homo sapiens
gggaucauuugaagaaaga

SEQ ID NO: 896080 - RNA, 19 nt, Homo sapiens
uaauaugggugugaagauu

SEQ ID NO: 896081 - RNA, 19 nt, Homo sapiens
cgugaaggcugcaagaaga

SEQ ID NO: 896082 - RNA, 19 nt, Homo sapiens
gagaaacuuuguagaagag

SEQ ID NO: 896083 - RNA, 19 nt, Homo sapiens
caacagagaaacuuuguag

SEQ ID NO: 896084 - RNA, 19 nt, Homo sapiens
gggcagcguuaccaugaaa

SEQ ID NO: 896085 - RNA, 19 nt, Homo sapiens
guuaagaauucucuagcaa

SEQ ID NO: 896086 - RNA, 19 nt, Homo sapiens
gggccaaguucaaaggaaa

SEQ ID NO: 896087 - RNA, 19 nt, Homo sapiens
agagaaacuuuguagaaga

SEQ ID NO: 896088 - RNA, 19 nt, Homo sapiens
ccaagucgauauguugaaa

SEQ ID NO: 896089 - RNA, 19 nt, Homo sapiens
uaaguccugugaagauaaa

SEQ ID NO: 896090 - RNA, 19 nt, Homo sapiens
agaauucucuagcaaacaa

SEQ ID NO: 896091 - RNA, 19 nt, Homo sapiens
uauuguuccugaucucuua

SEQ ID NO: 896092 - RNA, 19 nt, Homo sapiens
cuacugauucaccguauua

SEQ ID NO: 896093 - RNA, 19 nt, Homo sapiens
gaagaugauuauggaggaa

SEQ ID NO: 896094 - RNA, 19 nt, Homo sapiens
cgaagugcccugaagauga

SEQ ID NO: 896095 - RNA, 19 nt, Homo sapiens
caagagagaccaccauaag

SEQ ID NO: 896096 - RNA, 19 nt, Homo sapiens
agacauaagauucuggaua

SEQ ID NO: 896097 - RNA, 19 nt, Homo sapiens
gaucucuucugaugcuuug

SEQ ID NO: 896098 - RNA, 19 nt, Homo sapiens
gaacauaaggagugugaag

SEQ ID NO: 896099 - RNA, 19 nt, Homo sapiens
gcuuucugcuucuuucuuu

SEQ ID NO: 896100 - RNA, 19 nt, Homo sapiens
gaaggacggacuaaugaug

SEQ ID NO: 896101 - RNA, 19 nt, Homo sapiens
ggauaaacaaaugcaguua

SEQ ID NO: 896102 - RNA, 19 nt, Homo sapiens
uuacugggauaaacaaaug

SEQ ID NO: 896103 - RNA, 19 nt, Homo sapiens
gaaauuggacagcuuaagg

SEQ ID NO: 896104 - RNA, 19 nt, Homo sapiens
aaagaaauuggacagcuua

SEQ ID NO: 896105 - RNA, 19 nt, Homo sapiens
acucagaaguuugauguaa

SEQ ID NO: 896106 - RNA, 19 nt, Homo sapiens
ccaauaauaugggugugaa

SEQ ID NO: 896107 - RNA, 19 nt, Homo sapiens
gaagucugcuguucugcau

SEQ ID NO: 896108 - RNA, 19 nt, Homo sapiens
gaaggcucuuuguuauuau

SEQ ID NO: 896109 - RNA, 19 nt, Homo sapiens
gcaaaacuccgucucaaaa

SEQ ID NO: 896110 - RNA, 19 nt, Homo sapiens
gcaaaacacauccuuauug

SEQ ID NO: 896111 - RNA, 19 nt, Homo sapiens
gcaaugcucuggaaauaua

SEQ ID NO: 896112 - RNA, 19 nt, Homo sapiens
gaacaucacucagaaguuu

SEQ ID NO: 896113 - RNA, 19 nt, Homo sapiens
ggaagaagcugcuacuguu

SEQ ID NO: 896114 - RNA, 19 nt, Homo sapiens
gcaccgaacucaaaugaaa

SEQ ID NO: 896115 - RNA, 19 nt, Homo sapiens
gaagaaauaugaagaagca

SEQ ID NO: 896116 - RNA, 19 nt, Homo sapiens
gaaauagugucucaguuug

SEQ ID NO: 896117 - RNA, 19 nt, Homo sapiens
gagaaugaauguagagauu

SEQ ID NO: 896118 - RNA, 19 nt, Homo sapiens
gacauaagauucuggauau

SEQ ID NO: 896119 - RNA, 19 nt, Homo sapiens
gacaaaccaccauuuauua

SEQ ID NO: 896120 - RNA, 19 nt, Homo sapiens
gaagaaagauagucagaac

SEQ ID NO: 896121 - RNA, 19 nt, Homo sapiens
cuggagaucuguauaauaa

SEQ ID NO: 896122 - RNA, 19 nt, Homo sapiens
gaaacugaauucuacauca

SEQ ID NO: 896123 - RNA, 19 nt, Homo sapiens
agagaaagcuguugacaug

SEQ ID NO: 896124 - RNA, 19 nt, Homo sapiens
gaauaaauguuagcucuuc

SEQ ID NO: 896125 - RNA, 19 nt, Homo sapiens
gaccagagcuacagcaugu

SEQ ID NO: 896126 - RNA, 19 nt, Homo sapiens
gcaccauuauguuuacuaa

SEQ ID NO: 896127 - RNA, 19 nt, Homo sapiens
gaauggagauccccaauuu

SEQ ID NO: 896128 - RNA, 19 nt, Homo sapiens
gauaagaacuauggcaaug

SEQ ID NO: 896129 - RNA, 19 nt, Homo sapiens
gaagugcccugaagaugau

SEQ ID NO: 896130 - RNA, 19 nt, Homo sapiens
gcagguauuuggacuguau

SEQ ID NO: 896131 - RNA, 19 nt, Homo sapiens
gcacacauguugacccaau

SEQ ID NO: 896132 - RNA, 19 nt, Homo sapiens
gacaucaucucaaagcaaa

SEQ ID NO: 896133 - RNA, 19 nt, Homo sapiens
gccaagaggugauccaguu

SEQ ID NO: 896134 - RNA, 19 nt, Homo sapiens
gacaguccaugacaaguuu

SEQ ID NO: 896135 - RNA, 19 nt, Homo sapiens
gcacaguucugcaacaucu

SEQ ID NO: 896136 - RNA, 19 nt, Homo sapiens
guacuaaugguuucucuuu

SEQ ID NO: 896137 - RNA, 19 nt, Homo sapiens
caacuaugguuauccucua

SEQ ID NO: 896138 - RNA, 19 nt, Homo sapiens
ugaaagguguucuuguuga

SEQ ID NO: 896139 - RNA, 19 nt, Homo sapiens
ugacaaaccaccauuuauu

SEQ ID NO: 896140 - RNA, 19 nt, Homo sapiens
gaaauaugaagaagcauug

SEQ ID NO: 896141 - RNA, 19 nt, Homo sapiens
agaccaagaugaucacauu

SEQ ID NO: 896142 - RNA, 19 nt, Homo sapiens
gaaagguguucuuguugau

SEQ ID NO: 896143 - RNA, 19 nt, Homo sapiens
ugaaauagugucucaguuu

SEQ ID NO: 896144 - RNA, 19 nt, Homo sapiens
ggucuuggaugaacagaug

SEQ ID NO: 896145 - RNA, 19 nt, Homo sapiens
ucucguagcugacucuuug

SEQ ID NO: 896146 - RNA, 19 nt, Homo sapiens
cagcauguguauuugcaua

SEQ ID NO: 896147 - RNA, 19 nt, Homo sapiens
gacaaugugacacugauua

SEQ ID NO: 896148 - RNA, 19 nt, Homo sapiens
aaugaaagguguucuuguu

SEQ ID NO: 896149 - RNA, 19 nt, Homo sapiens
ggagagcugugggaagauu

SEQ ID NO: 896150 - RNA, 19 nt, Homo sapiens
aaacagaucagucuuuaug

SEQ ID NO: 896151 - RNA, 19 nt, Homo sapiens
uaaagaaauuggacagcuu

SEQ ID NO: 896152 - RNA, 19 nt, Homo sapiens
ugacauagcagcacgcaaa

SEQ ID NO: 896153 - RNA, 19 nt, Homo sapiens
aacccaagcugaaguauga

SEQ ID NO: 896154 - RNA, 19 nt, Homo sapiens
uggcaaugcucuggaaaua

SEQ ID NO: 896155 - RNA, 19 nt, Homo sapiens
cagaacaagacuuuacuua

SEQ ID NO: 896156 - RNA, 19 nt, Homo sapiens
gaagaagcugcuacuguuu

SEQ ID NO: 896157 - RNA, 19 nt, Homo sapiens
gcacccacauuucgugaga

SEQ ID NO: 896158 - RNA, 19 nt, Homo sapiens
gaauuguacaccuaugaua

SEQ ID NO: 896159 - RNA, 19 nt, Homo sapiens
gggaucauuugaagaaaga

SEQ ID NO: 896160 - RNA, 19 nt, Homo sapiens
uaauaugggugugaagauu

SEQ ID NO: 896161 - RNA, 19 nt, Homo sapiens
cgugaaggcugcaagaaga

SEQ ID NO: 896162 - RNA, 19 nt, Homo sapiens
gagaaacuuuguagaagag

SEQ ID NO: 896163 - RNA, 19 nt, Homo sapiens
caacagagaaacuuuguag

SEQ ID NO: 896164 - RNA, 19 nt, Homo sapiens
gggcagcguuaccaugaaa

SEQ ID NO: 896165 - RNA, 19 nt, Homo sapiens
agagaaacuuuguagaaga

SEQ ID NO: 896166 - RNA, 19 nt, Homo sapiens
ccaagucgauauguugaaa

SEQ ID NO: 896167 - RNA, 19 nt, Homo sapiens
cuacugauucaccguauua

SEQ ID NO: 896168 - RNA, 19 nt, Homo sapiens
gaagaugauuauggaggaa

SEQ ID NO: 896169 - RNA, 19 nt, Homo sapiens
cgaagugcccugaagauga

SEQ ID NO: 896170 - RNA, 19 nt, Homo sapiens
caagagagaccaccauaag

SEQ ID NO: 896171 - RNA, 19 nt, Homo sapiens
agacauaagauucuggaua

SEQ ID NO: 896172 - RNA, 19 nt, Homo sapiens
gaucucuucugaugcuuug

SEQ ID NO: 896173 - RNA, 19 nt, Homo sapiens
gaacauaaggagugugaag

SEQ ID NO: 896174 - RNA, 19 nt, Homo sapiens
gaaauuggacagcuuaagg

SEQ ID NO: 896175 - RNA, 19 nt, Homo sapiens
aaagaaauuggacagcuua

SEQ ID NO: 896176 - RNA, 19 nt, Homo sapiens
ccaauaauaugggugugaa

SEQ ID NO: 896177 - RNA, 19 nt, Homo sapiens
gaagucugcuguucugcau

SEQ ID NO: 896178 - RNA, 19 nt, Homo sapiens
ggacagcuuaaggcuauua

SEQ ID NO: 896179 - RNA, 19 nt, Homo sapiens
cugauguccugcaccauua

SEQ ID NO: 896180 - RNA, 19 nt, Homo sapiens
acagagaaacuuuguagaa

SEQ ID NO: 896181 - RNA, 19 nt, Homo sapiens
ggaacgagaccaagaugau

SEQ ID NO: 896182 - RNA, 19 nt, Homo sapiens
gaacggucuuggaugaaca

SEQ ID NO: 896183 - RNA, 19 nt, Homo sapiens
gcuguuaagagauuuguuu

SEQ ID NO: 896184 - RNA, 19 nt, Homo sapiens
cagagaaacuuuguagaag

SEQ ID NO: 896185 - RNA, 19 nt, Homo sapiens
ggaagaauuggaagacaga

SEQ ID NO: 896186 - RNA, 19 nt, Homo sapiens
gaaagauagucagaacaag

SEQ ID NO: 896187 - RNA, 19 nt, Homo sapiens
agucauaguucaagcaguu

SEQ ID NO: 896188 - RNA, 19 nt, Homo sapiens
gauggcagcugaaauuagc

SEQ ID NO: 896189 - RNA, 19 nt, Homo sapiens
ggaacggcaugccagugaa

SEQ ID NO: 896190 - RNA, 19 nt, Homo sapiens
uuguuuggcucauucuuua

SEQ ID NO: 896191 - RNA, 19 nt, Homo sapiens
gcacgcaaaugccagaaaa

SEQ ID NO: 896192 - RNA, 19 nt, Homo sapiens
guuguacuuucguauguaa

SEQ ID NO: 896193 - RNA, 19 nt, Homo sapiens
cagcauuuguugauugaau

SEQ ID NO: 896194 - RNA, 19 nt, Homo sapiens
ggaccaggaagugcaauuu

SEQ ID NO: 896195 - RNA, 19 nt, Homo sapiens
guacaccuaugauaagaac

SEQ ID NO: 896196 - RNA, 19 nt, Homo sapiens
uggcagaauuguacaccua

SEQ ID NO: 896197 - RNA, 19 nt, Homo sapiens
gaacggcaugccagugaaa

SEQ ID NO: 896198 - RNA, 19 nt, Homo sapiens
gcaaagaaucaccaaugug

SEQ ID NO: 896199 - RNA, 19 nt, Homo sapiens
uggcaagguuuauuuacuu

SEQ ID NO: 896200 - RNA, 19 nt, Homo sapiens
caaaugaaagguguucuug

SEQ ID NO: 896201 - RNA, 19 nt, Homo sapiens
gagacaguuuaucuucuga

SEQ ID NO: 896202 - RNA, 19 nt, Homo sapiens
caaacuuacuucccuuucu

SEQ ID NO: 896203 - RNA, 19 nt, Homo sapiens
ucagaaguuugauguagug

SEQ ID NO: 896204 - RNA, 19 nt, Homo sapiens
gcagcacucugggaauaug

SEQ ID NO: 896205 - RNA, 19 nt, Homo sapiens
gacaucauccagccacuuu

SEQ ID NO: 896206 - RNA, 19 nt, Homo sapiens
gggaagaagcugcuacugu

SEQ ID NO: 896207 - RNA, 19 nt, Homo sapiens
uuugagagauuccuugguu

SEQ ID NO: 896208 - RNA, 19 nt, Homo sapiens
aaagguaguggaagaauug

SEQ ID NO: 896209 - RNA, 19 nt, Homo sapiens
gcagaauuguacaccuaug

SEQ ID NO: 896210 - RNA, 19 nt, Homo sapiens
gucaaggugugcucaguga

SEQ ID NO: 896211 - RNA, 19 nt, Homo sapiens
gcuaagcacuuuaucuaua

SEQ ID NO: 896212 - RNA, 19 nt, Homo sapiens
gaacagagccuccaguugu

SEQ ID NO: 896213 - RNA, 19 nt, Homo sapiens
gaacuaagucaggauguua

SEQ ID NO: 896214 - RNA, 19 nt, Homo sapiens
ggauacagcugauuguuca

SEQ ID NO: 896215 - RNA, 19 nt, Homo sapiens
ccacauaacccuagaauuc

SEQ ID NO: 896216 - RNA, 19 nt, Homo sapiens
ggaacugaaucacuuaaau

SEQ ID NO: 896217 - RNA, 19 nt, Homo sapiens
gcaaccaccagcccaauua

SEQ ID NO: 896218 - RNA, 19 nt, Homo sapiens
aaggagagcuuugcagaua

SEQ ID NO: 896219 - RNA, 19 nt, Homo sapiens
uaagggaacugaaucacuu

SEQ ID NO: 896220 - RNA, 19 nt, Homo sapiens
acacacagcuccuccaguu

SEQ ID NO: 896221 - RNA, 19 nt, Homo sapiens
ugacuuuccucauguguuu

SEQ ID NO: 896222 - RNA, 19 nt, Homo sapiens
ggucauaucaccuuucaaa

SEQ ID NO: 896223 - RNA, 19 nt, Homo sapiens
gaacugaaucacuuaaaug

SEQ ID NO: 896224 - RNA, 19 nt, Homo sapiens
agaauuagguggcuacaga

SEQ ID NO: 896225 - RNA, 19 nt, Homo sapiens
gcaagcaccucaccaaacu

SEQ ID NO: 896226 - RNA, 19 nt, Homo sapiens
caaguuaccuacaagaaca

SEQ ID NO: 896227 - RNA, 19 nt, Homo sapiens
cagaauugcuagacuaaga

SEQ ID NO: 896228 - RNA, 19 nt, Homo sapiens
gaagaugaccacuuuggaa

SEQ ID NO: 896229 - RNA, 19 nt, Homo sapiens
ugaguaaacugagacuuaa

SEQ ID NO: 896230 - RNA, 19 nt, Homo sapiens
ggauggauguugggaaauu

SEQ ID NO: 896231 - RNA, 19 nt, Homo sapiens
ggagauacuucaacaucga

SEQ ID NO: 896232 - RNA, 19 nt, Homo sapiens
ggguaugggugucuauaaa

SEQ ID NO: 896233 - RNA, 19 nt, Homo sapiens
aaccaagggucaauuguaa

SEQ ID NO: 896234 - RNA, 19 nt, Homo sapiens
ugaagugagucauguguga

SEQ ID NO: 896235 - RNA, 19 nt, Homo sapiens
gaagugggagccuauuuga

SEQ ID NO: 896236 - RNA, 19 nt, Homo sapiens
gcaagguccugacuuuagu

SEQ ID NO: 896237 - RNA, 19 nt, Homo sapiens
ggaacuaagucaggauguu

SEQ ID NO: 896238 - RNA, 19 nt, Homo sapiens
caacuguucuuucuugagu

SEQ ID NO: 896239 - RNA, 19 nt, Homo sapiens
uagcugggcuguaaagaug

SEQ ID NO: 896240 - RNA, 19 nt, Homo sapiens
gcaagagacaauaauaaug

SEQ ID NO: 896241 - RNA, 19 nt, Homo sapiens
uagagaccauguugacuuu

SEQ ID NO: 896242 - RNA, 19 nt, Homo sapiens
caauaauaauggcccuuaa

SEQ ID NO: 896243 - RNA, 19 nt, Homo sapiens
ucaaacagcggccacagua

SEQ ID NO: 896244 - RNA, 19 nt, Homo sapiens
aaacuucgcuaaccaacug

SEQ ID NO: 896245 - RNA, 19 nt, Homo sapiens
uaccacgccuggcuaauuu

SEQ ID NO: 896246 - RNA, 19 nt, Homo sapiens
gaugaccacuuuggaaaug

SEQ ID NO: 896247 - RNA, 19 nt, Homo sapiens
uaccaaggaugaagaauca

SEQ ID NO: 896248 - RNA, 19 nt, Homo sapiens
gaacaacauaucucagguu

SEQ ID NO: 896249 - RNA, 19 nt, Homo sapiens
caggauggauguugggaaa

SEQ ID NO: 896250 - RNA, 19 nt, Homo sapiens
caaccgauguccaacuuca

SEQ ID NO: 896251 - RNA, 19 nt, Homo sapiens
gucaggauguuaacagaaa

SEQ ID NO: 896252 - RNA, 19 nt, Homo sapiens
ucaggcagcacaucaauuu

SEQ ID NO: 896253 - RNA, 19 nt, Homo sapiens
caacaguacaggacauaaa

SEQ ID NO: 896254 - RNA, 19 nt, Homo sapiens
cugaaucacuuaaauguca

SEQ ID NO: 896255 - RNA, 19 nt, Homo sapiens
aaaccaccaucuucuauuc

SEQ ID NO: 896256 - RNA, 19 nt, Homo sapiens
gcagucaaaugagagcaaa

SEQ ID NO: 896257 - RNA, 19 nt, Homo sapiens
caagagacaauaauaaugg

SEQ ID NO: 896258 - RNA, 19 nt, Homo sapiens
ccagagaaucuaauuguug

SEQ ID NO: 896259 - RNA, 19 nt, Homo sapiens
uugcuuagcugggcuguaa

SEQ ID NO: 896260 - RNA, 19 nt, Homo sapiens
uaucucagguugucuaagu

SEQ ID NO: 896261 - RNA, 19 nt, Homo sapiens
ggcaucaaauaaacucaaa

SEQ ID NO: 896262 - RNA, 19 nt, Homo sapiens
ccaggaucaugagacauua

SEQ ID NO: 896263 - RNA, 19 nt, Homo sapiens
ugaaggcucacaccucaua

SEQ ID NO: 896264 - RNA, 19 nt, Homo sapiens
ggucugacaucaaggucuu

SEQ ID NO: 896265 - RNA, 19 nt, Homo sapiens
gaugguagaacuaaacaau

SEQ ID NO: 896266 - RNA, 19 nt, Homo sapiens
ccaaagugcugggauuaca

SEQ ID NO: 896267 - RNA, 19 nt, Homo sapiens
guuaucaaauggacuuuca

SEQ ID NO: 896268 - RNA, 19 nt, Homo sapiens
aaaccaagggucaauugua

SEQ ID NO: 896269 - RNA, 19 nt, Homo sapiens
ggcagcacaucaauuucua

SEQ ID NO: 896270 - RNA, 19 nt, Homo sapiens
ugagucaugugugauuuaa

SEQ ID NO: 896271 - RNA, 19 nt, Homo sapiens
guaaaccaccaucuucuau

SEQ ID NO: 896272 - RNA, 19 nt, Homo sapiens
gcaagccucugggaacugu

SEQ ID NO: 896273 - RNA, 19 nt, Homo sapiens
uccagcaacuuuaucgaua

SEQ ID NO: 896274 - RNA, 19 nt, Homo sapiens
aaacagcggccacaguaaa

SEQ ID NO: 896275 - RNA, 19 nt, Homo sapiens
ccucauguguuuccuuaug

SEQ ID NO: 896276 - RNA, 19 nt, Homo sapiens
gaugacuccugcuccagaa

SEQ ID NO: 896277 - RNA, 19 nt, Homo sapiens
aagggucaauuguaacuaa

SEQ ID NO: 896278 - RNA, 19 nt, Homo sapiens
ccacucaaagucaacauuu

SEQ ID NO: 896279 - RNA, 19 nt, Homo sapiens
gugaaugaguaaacugaga

SEQ ID NO: 896280 - RNA, 19 nt, Homo sapiens
gaugagugcucgucugacu

SEQ ID NO: 896281 - RNA, 19 nt, Homo sapiens
agagacaguuuaccaagga

SEQ ID NO: 896282 - RNA, 19 nt, Homo sapiens
gcaaccagcuaagcaagca

SEQ ID NO: 896283 - RNA, 19 nt, Homo sapiens
ccagaaaccagagauuauu

SEQ ID NO: 896284 - RNA, 19 nt, Homo sapiens
gaaaacaaccgauguccaa

SEQ ID NO: 896285 - RNA, 19 nt, Homo sapiens
cauaucaccuuucaaacag

SEQ ID NO: 896286 - RNA, 19 nt, Homo sapiens
guggcacgaucucggcuua

SEQ ID NO: 896287 - RNA, 19 nt, Homo sapiens
aaccaacuguucuuucuug

SEQ ID NO: 896288 - RNA, 19 nt, Homo sapiens
ggagagcuuugcagauaac

SEQ ID NO: 896289 - RNA, 19 nt, Homo sapiens
ggucaauuguaacuaauac

SEQ ID NO: 896290 - RNA, 19 nt, Homo sapiens
gauauagugagcuguuuau

SEQ ID NO: 896291 - RNA, 19 nt, Homo sapiens
gauaccagagaaucuaauu

SEQ ID NO: 896292 - RNA, 19 nt, Homo sapiens
uaacagaaaaguccacaua

SEQ ID NO: 896293 - RNA, 19 nt, Homo sapiens
uuaaaugucaccuggcuaa

SEQ ID NO: 896294 - RNA, 19 nt, Homo sapiens
gcacuuaacuccuuuucca

SEQ ID NO: 896295 - RNA, 19 nt, Homo sapiens
gugugugcauugaagauuu

SEQ ID NO: 896296 - RNA, 19 nt, Homo sapiens
gacauuaggguagaugaaa

SEQ ID NO: 896297 - RNA, 19 nt, Homo sapiens
gcacgauggcagucaaaug

SEQ ID NO: 896298 - RNA, 19 nt, Homo sapiens
cacgauggcagucaaauga

SEQ ID NO: 896299 - RNA, 19 nt, Homo sapiens
ccgaguagcugggauuaca

SEQ ID NO: 896300 - RNA, 19 nt, Homo sapiens
cuaaagaaaggaacuaagu

SEQ ID NO: 896301 - RNA, 19 nt, Homo sapiens
ggauggucauaucaccuuu

SEQ ID NO: 896302 - RNA, 19 nt, Homo sapiens
caacugggaacaccacuca

SEQ ID NO: 896303 - RNA, 19 nt, Homo sapiens
cauaacccuagaauucuua

SEQ ID NO: 896304 - RNA, 19 nt, Homo sapiens
aaagaaaggaacuaaguca

SEQ ID NO: 896305 - RNA, 19 nt, Homo sapiens
acaauaagcaagagacaau

SEQ ID NO: 896306 - RNA, 19 nt, Homo sapiens
caauugugcuuccugugau

SEQ ID NO: 896307 - RNA, 19 nt, Homo sapiens
ucacauuuaccaaggauga

SEQ ID NO: 896308 - RNA, 19 nt, Homo sapiens
gacuggaauuuaucagguu

SEQ ID NO: 896309 - RNA, 19 nt, Homo sapiens
cuaaccaacuguucuuucu

SEQ ID NO: 896310 - RNA, 19 nt, Homo sapiens
caugagacauuaggguaga

SEQ ID NO: 896311 - RNA, 19 nt, Homo sapiens
gaaaugacauccagagaaa

SEQ ID NO: 896312 - RNA, 19 nt, Homo sapiens
gaaaguaauggaagaauug

SEQ ID NO: 896313 - RNA, 19 nt, Homo sapiens
gagguugguuggaacaaua

SEQ ID NO: 896314 - RNA, 19 nt, Homo sapiens
gccaugugcuccaaucaua

SEQ ID NO: 896315 - RNA, 19 nt, Homo sapiens
gaagauuuccuuucguauu

SEQ ID NO: 896316 - RNA, 19 nt, Homo sapiens
caugaaaguucucaguauu

SEQ ID NO: 896317 - RNA, 19 nt, Homo sapiens
cuuaggaaauugugguuua

SEQ ID NO: 896318 - RNA, 19 nt, Homo sapiens
guacaucucacugguauaa

SEQ ID NO: 896319 - RNA, 19 nt, Homo sapiens
gaaaguaugagauccuguu

SEQ ID NO: 896320 - RNA, 19 nt, Homo sapiens
gaucucccauaauuugaaa

SEQ ID NO: 896321 - RNA, 19 nt, Homo sapiens
uggaagaauugaucgauga

SEQ ID NO: 896322 - RNA, 19 nt, Homo sapiens
agaauaugcuggagagguu

SEQ ID NO: 896323 - RNA, 19 nt, Homo sapiens
ucaugaaaguucucaguau

SEQ ID NO: 896324 - RNA, 19 nt, Homo sapiens
ugaguaaucaggaaguaua

SEQ ID NO: 896325 - RNA, 19 nt, Homo sapiens
gagauuuguugguggcauu

SEQ ID NO: 896326 - RNA, 19 nt, Homo sapiens
gaaguguuaacccaaauga

SEQ ID NO: 896327 - RNA, 19 nt, Homo sapiens
cgaaaugacauccagagaa

SEQ ID NO: 896328 - RNA, 19 nt, Homo sapiens
ugucaaaccuaagcauauu

SEQ ID NO: 896329 - RNA, 19 nt, Homo sapiens
acaccaauguauucuagaa

SEQ ID NO: 896330 - RNA, 19 nt, Homo sapiens
uaugagauccuguuauguu

SEQ ID NO: 896331 - RNA, 19 nt, Homo sapiens
aguaugagauccuguuaug

SEQ ID NO: 896332 - RNA, 19 nt, Homo sapiens
caucucacugguauaauua

SEQ ID NO: 896333 - RNA, 19 nt, Homo sapiens
gcaccuggaauuuacugua

SEQ ID NO: 896334 - RNA, 19 nt, Homo sapiens
gaaaguucucaguauugua

SEQ ID NO: 896335 - RNA, 19 nt, Homo sapiens
guguaugcauguuugaauu

SEQ ID NO: 896336 - RNA, 19 nt, Homo sapiens
ugaaaguucucaguauugu

SEQ ID NO: 896337 - RNA, 19 nt, Homo sapiens
ggagaagugguuucaugaa

SEQ ID NO: 896338 - RNA, 19 nt, Homo sapiens
ccuguuauguuaagggaaa

SEQ ID NO: 896339 - RNA, 19 nt, Homo sapiens
acaucucacugguauaauu

SEQ ID NO: 896340 - RNA, 19 nt, Homo sapiens
gcauuccuuugaugagaaa

SEQ ID NO: 896341 - RNA, 19 nt, Homo sapiens
aaggagaagugguuucaug

SEQ ID NO: 896342 - RNA, 19 nt, Homo sapiens
gagauccuguuauguuaag

SEQ ID NO: 896343 - RNA, 19 nt, Homo sapiens
augagauccuguuauguua

SEQ ID NO: 896344 - RNA, 19 nt, Homo sapiens
ccacuguguugguuauaug

SEQ ID NO: 896345 - RNA, 19 nt, Homo sapiens
ugaaacuuguggucucuga

SEQ ID NO: 896346 - RNA, 19 nt, Homo sapiens
gaacgaguuuugaguaauc

SEQ ID NO: 896347 - RNA, 19 nt, Homo sapiens
caccuggaauuuacuguau

SEQ ID NO: 896348 - RNA, 19 nt, Homo sapiens
acagagauccuggguguuu

SEQ ID NO: 896349 - RNA, 19 nt, Homo sapiens
gagaaaacaaggaagauuu

SEQ ID NO: 896350 - RNA, 19 nt, Homo sapiens
cguauuguguggcucugua

SEQ ID NO: 896351 - RNA, 19 nt, Homo sapiens
caaaggagaagugguuuca

SEQ ID NO: 896352 - RNA, 19 nt, Homo sapiens
guuaagggaaauccaaauu

SEQ ID NO: 896353 - RNA, 19 nt, Homo sapiens
guuauauggugaaucugaa

SEQ ID NO: 896354 - RNA, 19 nt, Homo sapiens
gauacaggaaccagaaaga

SEQ ID NO: 896355 - RNA, 19 nt, Homo sapiens
ggagguugguuggaacaau

SEQ ID NO: 896356 - RNA, 19 nt, Homo sapiens
caucagguguugcuauuuu

SEQ ID NO: 896357 - RNA, 19 nt, Homo sapiens
gcagugggcaucuucuugu

SEQ ID NO: 896358 - RNA, 19 nt, Homo sapiens
gaagaauugaucgaugaaa

SEQ ID NO: 896359 - RNA, 19 nt, Homo sapiens
ggaagaauugaucgaugaa

SEQ ID NO: 896360 - RNA, 19 nt, Homo sapiens
gugcaaaggagaagugguu

SEQ ID NO: 896361 - RNA, 19 nt, Homo sapiens
aggaaacacuaucuggaaa

SEQ ID NO: 896362 - RNA, 19 nt, Homo sapiens
ggagagguuuugagauuug

SEQ ID NO: 896363 - RNA, 19 nt, Homo sapiens
gguuauauggugaaucuga

SEQ ID NO: 896364 - RNA, 19 nt, Homo sapiens
gugcauuccuuugaugaga

SEQ ID NO: 896365 - RNA, 19 nt, Homo sapiens
ggccuguucuucaguuuua

SEQ ID NO: 896366 - RNA, 19 nt, Homo sapiens
gauuggagcuguaaaacau

SEQ ID NO: 896367 - RNA, 19 nt, Homo sapiens
gcauuggccuguucuucag

SEQ ID NO: 896368 - RNA, 19 nt, Homo sapiens
aaaguaugagauccuguua

SEQ ID NO: 896369 - RNA, 19 nt, Homo sapiens
gcaacagggucagcuucug

SEQ ID NO: 896370 - RNA, 19 nt, Homo sapiens
ggcucuguauauucuguua

SEQ ID NO: 896371 - RNA, 19 nt, Homo sapiens
guaacagcaacuugucaaa

SEQ ID NO: 896372 - RNA, 19 nt, Homo sapiens
gcaagugcucgaaaugaca

SEQ ID NO: 896373 - RNA, 19 nt, Homo sapiens
guaaucaggaaguauaucu

SEQ ID NO: 896374 - RNA, 19 nt, Homo sapiens
gcaaaggagaagugguuuc

SEQ ID NO: 896375 - RNA, 19 nt, Homo sapiens
gaaauaguuaugucuuagg

SEQ ID NO: 896376 - RNA, 19 nt, Homo sapiens
uauggugaaucugaacgua

SEQ ID NO: 896377 - RNA, 19 nt, Homo sapiens
ucaaccugcuuuacaccuu

SEQ ID NO: 896378 - RNA, 19 nt, Homo sapiens
uggcugaccuacagauaca

SEQ ID NO: 896379 - RNA, 19 nt, Homo sapiens
ggcauuggccuguucuuca

SEQ ID NO: 896380 - RNA, 19 nt, Homo sapiens
gacauccagagaaaucuaa

SEQ ID NO: 896381 - RNA, 19 nt, Homo sapiens
aaucugaacguacaucuca

SEQ ID NO: 896382 - RNA, 19 nt, Homo sapiens
gauuuccuuucguauuaug

SEQ ID NO: 896383 - RNA, 19 nt, Homo sapiens
ggcaagugcucgaaaugac

SEQ ID NO: 896384 - RNA, 19 nt, Homo sapiens
caucagaauggaacgaguu

SEQ ID NO: 896385 - RNA, 19 nt, Homo sapiens
aaggaaacacuaucuggaa

SEQ ID NO: 896386 - RNA, 19 nt, Homo sapiens
cuagugcauuccuuugaug

SEQ ID NO: 896387 - RNA, 19 nt, Homo sapiens
gaguaaucaggaaguauau

SEQ ID NO: 896388 - RNA, 19 nt, Homo sapiens
ccuuauugauaguggaauu

SEQ ID NO: 896389 - RNA, 19 nt, Homo sapiens
aacacuaucuggaaaagua

SEQ ID NO: 896390 - RNA, 19 nt, Homo sapiens
aagcuccauuugccaguuu

SEQ ID NO: 896391 - RNA, 19 nt, Homo sapiens
ccuagugcauuccuuugau

SEQ ID NO: 896392 - RNA, 19 nt, Homo sapiens
acagauacaggaaccagaa

SEQ ID NO: 896393 - RNA, 19 nt, Homo sapiens
caaaggcaaggacaaagca

SEQ ID NO: 896394 - RNA, 19 nt, Homo sapiens
ugagauccuguuauguuaa

SEQ ID NO: 896395 - RNA, 19 nt, Homo sapiens
gaauaugcuggagagguuu

SEQ ID NO: 896396 - RNA, 19 nt, Homo sapiens
ugacauccagagaaaucua

SEQ ID NO: 896397 - RNA, 19 nt, Homo sapiens
aaaccuuucuuuguguaug

SEQ ID NO: 896398 - RNA, 19 nt, Homo sapiens
ggaaaaguaccuuauugau

SEQ ID NO: 896399 - RNA, 19 nt, Homo sapiens
uaagcuccauuugccaguu

SEQ ID NO: 896400 - RNA, 19 nt, Homo sapiens
cagagauccuggguguuug

SEQ ID NO: 896401 - RNA, 19 nt, Homo sapiens
cagugggcaucuucuuguu

SEQ ID NO: 896402 - RNA, 19 nt, Homo sapiens
gaaacuuguggucucugaa

SEQ ID NO: 896403 - RNA, 19 nt, Homo sapiens
gaaacacuaucuggaaaag

SEQ ID NO: 896404 - RNA, 19 nt, Homo sapiens
ggucugauuggagcuguaa

SEQ ID NO: 896405 - RNA, 19 nt, Homo sapiens
caucaucagguguugcuau

SEQ ID NO: 896406 - RNA, 19 nt, Homo sapiens
uguggguuccgaaguguua

SEQ ID NO: 896407 - RNA, 19 nt, Homo sapiens
aaucagaaaguaugagauc

SEQ ID NO: 896408 - RNA, 19 nt, Homo sapiens
acguacaucucacugguau

SEQ ID NO: 896409 - RNA, 19 nt, Homo sapiens
gaucuuguucacuuucugu

SEQ ID NO: 896410 - RNA, 19 nt, Homo sapiens
guuccugauugcuuuagug

SEQ ID NO: 896411 - RNA, 19 nt, Homo sapiens
gcacauaaaugccucaaua

SEQ ID NO: 896412 - RNA, 19 nt, Homo sapiens
ccauaugucuuccuuacua

SEQ ID NO: 896413 - RNA, 19 nt, Homo sapiens
gaaauuucccucucaccua

SEQ ID NO: 896414 - RNA, 19 nt, Homo sapiens
gagagaggaugcuaagcuu

SEQ ID NO: 896415 - RNA, 19 nt, Homo sapiens
ccacaucugucaccacuuc

SEQ ID NO: 896416 - RNA, 19 nt, Homo sapiens
cgaacaagaugaagacagu

SEQ ID NO: 896417 - RNA, 19 nt, Homo sapiens
gaccgugccuuaugucugu

SEQ ID NO: 896418 - RNA, 19 nt, Homo sapiens
cauaaaugccucaauaaag

SEQ ID NO: 896419 - RNA, 19 nt, Homo sapiens
gcagggaccgugccuuaug

SEQ ID NO: 896420 - RNA, 19 nt, Homo sapiens
uaagcuuccuacucacuuu

SEQ ID NO: 896421 - RNA, 19 nt, Homo sapiens
augcuaagcuuccuacuca

SEQ ID NO: 896422 - RNA, 19 nt, Homo sapiens
ugagagaagucagcuguca

SEQ ID NO: 896423 - RNA, 19 nt, Homo sapiens
gaccauccacggacaauuc

SEQ ID NO: 896424 - RNA, 19 nt, Homo sapiens
ggacagagugagagaaguc

SEQ ID NO: 896425 - RNA, 19 nt, Homo sapiens
ccaacggcguggagugcua

SEQ ID NO: 896426 - RNA, 19 nt, Homo sapiens
gcaacaagaccuacuucuc

SEQ ID NO: 896427 - RNA, 19 nt, Homo sapiens
cacauaaaugccucaauaa

SEQ ID NO: 896428 - RNA, 19 nt, Homo sapiens
ucauccagcugcagcaaug

SEQ ID NO: 896429 - RNA, 19 nt, Homo sapiens
gcagggguguucuagcuuu

SEQ ID NO: 896430 - RNA, 19 nt, Homo sapiens
gaugaggagcccagguuga

SEQ ID NO: 896431 - RNA, 19 nt, Homo sapiens
gaucaguuucuggcacaua

SEQ ID NO: 896432 - RNA, 19 nt, Homo sapiens
cagggaccgugccuuaugu

SEQ ID NO: 896433 - RNA, 19 nt, Homo sapiens
gggaugaggagcccagguu

SEQ ID NO: 896434 - RNA, 19 nt, Homo sapiens
gacaauggcuccccacucu

SEQ ID NO: 896435 - RNA, 19 nt, Homo sapiens
gacggcagcuaaugugacu

SEQ ID NO: 896436 - RNA, 19 nt, Homo sapiens
ccagcgaucaugucuacaa

SEQ ID NO: 896437 - RNA, 19 nt, Homo sapiens
gucugugugugaucaguuu

SEQ ID NO: 896438 - RNA, 19 nt, Homo sapiens
ggaaauaaaauaccguugu

SEQ ID NO: 896439 - RNA, 19 nt, Homo sapiens
acucugaccuccgcaacaa

SEQ ID NO: 896440 - RNA, 19 nt, Homo sapiens
cgccagcgaucaugucuac

SEQ ID NO: 896441 - RNA, 19 nt, Homo sapiens
cauaugucuuccuuacuag

SEQ ID NO: 896442 - RNA, 19 nt, Homo sapiens
gcagcaaugcgcucaggau

SEQ ID NO: 896443 - RNA, 19 nt, Homo sapiens
ugagagagaggaugcuaag

SEQ ID NO: 896444 - RNA, 19 nt, Homo sapiens
ucucuccgcuuguccucuu

SEQ ID NO: 896445 - RNA, 19 nt, Homo sapiens
cuccagagcccacgacugu

SEQ ID NO: 896446 - RNA, 19 nt, Homo sapiens
gcagcuaaugugacugugu

SEQ ID NO: 896447 - RNA, 19 nt, Homo sapiens
cagcgaucaugucuacaag

SEQ ID NO: 896448 - RNA, 19 nt, Homo sapiens
aucaguuucuggcacauaa

SEQ ID NO: 896449 - RNA, 19 nt, Homo sapiens
gguuugcggcuuugggaaa

SEQ ID NO: 896450 - RNA, 19 nt, Homo sapiens
cguggcugcugguguccua

SEQ ID NO: 896451 - RNA, 19 nt, Homo sapiens
guaacaggcccaggguuca

SEQ ID NO: 896452 - RNA, 19 nt, Homo sapiens
cuacaacgccagcgaucau

SEQ ID NO: 896453 - RNA, 19 nt, Homo sapiens
gugagagagaggaugcuaa

SEQ ID NO: 896454 - RNA, 19 nt, Homo sapiens
ggugagagagaggaugcua

SEQ ID NO: 896455 - RNA, 19 nt, Homo sapiens
cuuguccucuugugauguu

SEQ ID NO: 896456 - RNA, 19 nt, Homo sapiens
gcuguguccaggaugaauu

SEQ ID NO: 896457 - RNA, 19 nt, Homo sapiens
ucaccuugacggcagcuaa

SEQ ID NO: 896458 - RNA, 19 nt, Homo sapiens
gcgcugguuugcggcuuug

SEQ ID NO: 896459 - RNA, 19 nt, Homo sapiens
ggagaccauccacggacaa

SEQ ID NO: 896460 - RNA, 19 nt, Homo sapiens
gaugcuaagcuuccuacuc

SEQ ID NO: 896461 - RNA, 19 nt, Homo sapiens
uugcggcuuugggaaauaa

SEQ ID NO: 896462 - RNA, 19 nt, Homo sapiens
ccagugagacccacaucca

SEQ ID NO: 896463 - RNA, 19 nt, Homo sapiens
caagaugaagacagugaag

SEQ ID NO: 896464 - RNA, 19 nt, Homo sapiens
cagguaaugagagugcaua

SEQ ID NO: 896465 - RNA, 19 nt, Homo sapiens
ccauugaugucaccuuuaa

SEQ ID NO: 896466 - RNA, 19 nt, Homo sapiens
ugaggaaacugggcuauga

SEQ ID NO: 896467 - RNA, 19 nt, Homo sapiens
ggcaagcacugguguggaa

SEQ ID NO: 896468 - RNA, 19 nt, Homo sapiens
gcacagucucugauaauga

SEQ ID NO: 896469 - RNA, 19 nt, Homo sapiens
ucacagaucacauccaaga

SEQ ID NO: 896470 - RNA, 19 nt, Homo sapiens
cacagucucugauaaugaa

SEQ ID NO: 896471 - RNA, 19 nt, Homo sapiens
gcaaguacugcuuugugua

SEQ ID NO: 896472 - RNA, 19 nt, Homo sapiens
gcugcacagucucugauaa

SEQ ID NO: 896473 - RNA, 19 nt, Homo sapiens
gcgcccaguuuccagagua

SEQ ID NO: 896474 - RNA, 19 nt, Homo sapiens
gacacugggccuucugaua

SEQ ID NO: 896475 - RNA, 19 nt, Homo sapiens
ucucacagaucacauccaa

SEQ ID NO: 896476 - RNA, 19 nt, Homo sapiens
gaugaccucuacugcaagu

SEQ ID NO: 896477 - RNA, 19 nt, Homo sapiens
gaaacugggcuaugacacu

SEQ ID NO: 896478 - RNA, 19 nt, Homo sapiens
ccaaggacaugaggaaacu

SEQ ID NO: 896479 - RNA, 19 nt, Homo sapiens
gcgcuacgccgucuguuuc

SEQ ID NO: 896480 - RNA, 19 nt, Homo sapiens
ccuagcgucuuucuacuca

SEQ ID NO: 896481 - RNA, 19 nt, Homo sapiens
ggugguggcucagggugaa

SEQ ID NO: 896482 - RNA, 19 nt, Homo sapiens
gaaggugucgcugccaaga

SEQ ID NO: 896483 - RNA, 19 nt, Homo sapiens
guauggaccagauguguuc

SEQ ID NO: 896484 - RNA, 19 nt, Homo sapiens
cagcguguauggaccagau

SEQ ID NO: 896485 - RNA, 19 nt, Homo sapiens
uagcgucuuucuacucaug

SEQ ID NO: 896486 - RNA, 19 nt, Homo sapiens
cgaugugguucgaggcuau

SEQ ID NO: 896487 - RNA, 19 nt, Homo sapiens
augaugaccucuacugcaa

SEQ ID NO: 896488 - RNA, 19 nt, Homo sapiens
acacugggccuucugauac

SEQ ID NO: 896489 - RNA, 19 nt, Homo sapiens
ugaccaaggacaugaggaa

SEQ ID NO: 896490 - RNA, 19 nt, Homo sapiens
aggugucgcugccaagaaa

SEQ ID NO: 896491 - RNA, 19 nt, Homo sapiens
gguggagagcgcccaguuu

SEQ ID NO: 896492 - RNA, 19 nt, Homo sapiens
gcuacgccgucuguuucua

SEQ ID NO: 896493 - RNA, 19 nt, Homo sapiens
guggagagcgcccaguuuc

SEQ ID NO: 896494 - RNA, 19 nt, Homo sapiens
cugcagaaguuuacaagcu

SEQ ID NO: 896495 - RNA, 19 nt, Homo sapiens
cagaaucuacgucuaaacu

SEQ ID NO: 896496 - RNA, 19 nt, Homo sapiens
cccagaaucuacgucuaaa

SEQ ID NO: 896497 - RNA, 19 nt, Homo sapiens
ucccagaaucuacgucuaa

SEQ ID NO: 896498 - RNA, 19 nt, Homo sapiens
ugcaaguacugcuuugugu

SEQ ID NO: 896499 - RNA, 19 nt, Homo sapiens
ggagagcgcccaguuucca

SEQ ID NO: 896500 - RNA, 19 nt, Homo sapiens
gaccaaggacaugaggaaa

SEQ ID NO: 896501 - RNA, 19 nt, Homo sapiens
cgcgaguccuagcgucuuu

SEQ ID NO: 896502 - RNA, 19 nt, Homo sapiens
gaucgugcucagcguguau

SEQ ID NO: 896503 - RNA, 19 nt, Homo sapiens
gaacgaagauguggugguu

SEQ ID NO: 896504 - RNA, 19 nt, Homo sapiens
aaacagaugucaugaauca

SEQ ID NO: 896505 - RNA, 19 nt, Homo sapiens
gaagugaccuguaaagaac

SEQ ID NO: 896506 - RNA, 19 nt, Homo sapiens
ggaagugaccuguaaagaa

SEQ ID NO: 896507 - RNA, 19 nt, Homo sapiens
ugaaacagaugucaugaau

SEQ ID NO: 896508 - RNA, 19 nt, Homo sapiens
gaugagcacuuugcagaaa

SEQ ID NO: 896509 - RNA, 19 nt, Homo sapiens
gaaggcaguugaaacagau

SEQ ID NO: 896510 - RNA, 19 nt, Homo sapiens
agacaagccuuccuccauu

SEQ ID NO: 896511 - RNA, 19 nt, Homo sapiens
ggacgggcuucuaaagaga

SEQ ID NO: 896512 - RNA, 19 nt, Homo sapiens
cuaaagagaccugcucaua

SEQ ID NO: 896513 - RNA, 19 nt, Homo sapiens
gcaaggagcaccaacucaa

SEQ ID NO: 896514 - RNA, 19 nt, Homo sapiens
aaagagaccugcucauacu

SEQ ID NO: 896515 - RNA, 19 nt, Homo sapiens
ugacaaggaugggcuauag

SEQ ID NO: 896516 - RNA, 19 nt, Homo sapiens
cuacaugcccuacgcuaua

SEQ ID NO: 896517 - RNA, 19 nt, Homo sapiens
gugggaauuuggagacuuu

SEQ ID NO: 896518 - RNA, 19 nt, Homo sapiens
aguggugucuuacaaagua

SEQ ID NO: 896519 - RNA, 19 nt, Homo sapiens
cugaggaagugaccuguaa

SEQ ID NO: 896520 - RNA, 19 nt, Homo sapiens
agaaaccaguuauuacuuc

SEQ ID NO: 896521 - RNA, 19 nt, Homo sapiens
ggacuuggaguggcgauaa

SEQ ID NO: 896522 - RNA, 19 nt, Homo sapiens
gcagaaaccaguuauuacu

SEQ ID NO: 896523 - RNA, 19 nt, Homo sapiens
gcaaggacgaccuggaaga

SEQ ID NO: 896524 - RNA, 19 nt, Homo sapiens
agaaggcaguugaaacaga

SEQ ID NO: 896525 - RNA, 19 nt, Homo sapiens
gacaagccuuccuccauuc

SEQ ID NO: 896526 - RNA, 19 nt, Homo sapiens
caucagagaaggcaguuga

SEQ ID NO: 896527 - RNA, 19 nt, Homo sapiens
caauagccuuggcaucaga

SEQ ID NO: 896528 - RNA, 19 nt, Homo sapiens
gaggacgggcuucuaaaga

SEQ ID NO: 896529 - RNA, 19 nt, Homo sapiens
cuucggagaugagcacuuu

SEQ ID NO: 896530 - RNA, 19 nt, Homo sapiens
uugcagaaaccaguuauua

SEQ ID NO: 896531 - RNA, 19 nt, Homo sapiens
gggcaaggacgaccuggaa

SEQ ID NO: 896532 - RNA, 19 nt, Homo sapiens
ccaucuuaguggugucuua

SEQ ID NO: 896533 - RNA, 19 nt, Homo sapiens
gcucaaggacaaugauuuc

SEQ ID NO: 896534 - RNA, 19 nt, Homo sapiens
uaaagagaccugcucauac

SEQ ID NO: 896535 - RNA, 19 nt, Homo sapiens
gaagauggaggaaguagcu

SEQ ID NO: 896536 - RNA, 19 nt, Homo sapiens
gugcuuauguuugccaaga

SEQ ID NO: 896537 - RNA, 19 nt, Homo sapiens
cagaugucaugaaucaaga

SEQ ID NO: 896538 - RNA, 19 nt, Homo sapiens
gcucaggguucuuggacau

SEQ ID NO: 896539 - RNA, 19 nt, Homo sapiens
cacaauagccuuggcauca

SEQ ID NO: 896540 - RNA, 19 nt, Homo sapiens
ccaaacagagccuggaugu

SEQ ID NO: 896541 - RNA, 19 nt, Homo sapiens
uacaugcccuacgcuauaa

SEQ ID NO: 896542 - RNA, 19 nt, Homo sapiens
gagccuggaugugcuagau

SEQ ID NO: 896543 - RNA, 19 nt, Homo sapiens
cauuggcgcuacgaccuua

SEQ ID NO: 896544 - RNA, 19 nt, Homo sapiens
caacacagucaucuucauc

SEQ ID NO: 896545 - RNA, 19 nt, Homo sapiens
gaccugcucauacuugcua

SEQ ID NO: 896546 - RNA, 19 nt, Homo sapiens
ggccaggcuuugaguacuu

SEQ ID NO: 896547 - RNA, 19 nt, Homo sapiens
caagacaaacgaggaguug

SEQ ID NO: 896548 - RNA, 19 nt, Homo sapiens
gaaugaggacgggcuucua

SEQ ID NO: 896549 - RNA, 19 nt, Homo sapiens
ccucagaguugggcaagga

SEQ ID NO: 896550 - RNA, 19 nt, Homo sapiens
acacaacacagucaucuuc

SEQ ID NO: 896551 - RNA, 19 nt, Homo sapiens
agagaaggcaguugaaaca

SEQ ID NO: 896552 - RNA, 19 nt, Homo sapiens
ggacgaccuggaagaguug

SEQ ID NO: 896553 - RNA, 19 nt, Homo sapiens
gaguccaccuucaguucuu

SEQ ID NO: 896554 - RNA, 19 nt, Homo sapiens
gaagauguggugguuguag

SEQ ID NO: 896555 - RNA, 19 nt, Homo sapiens
cagaaaccaguuauuacuu

SEQ ID NO: 896556 - RNA, 19 nt, Homo sapiens
cccagaagauggaggaagu

SEQ ID NO: 896557 - RNA, 19 nt, Homo sapiens
ccugcuagcugagaacgaa

SEQ ID NO: 896558 - RNA, 19 nt, Homo sapiens
gccugcaacucaacgagaa

SEQ ID NO: 896559 - RNA, 19 nt, Homo sapiens
gccaggcuuugaguacuuu

SEQ ID NO: 896560 - RNA, 19 nt, Homo sapiens
ucaggguucuuggacauug

SEQ ID NO: 896561 - RNA, 19 nt, Homo sapiens
aggacgaccuggaagaguu

SEQ ID NO: 896562 - RNA, 19 nt, Homo sapiens
gcuacauucccaagacaaa

SEQ ID NO: 896563 - RNA, 19 nt, Homo sapiens
acgaagauguggugguugu

SEQ ID NO: 896564 - RNA, 19 nt, Homo sapiens
gaaacagaugucaugaauc

SEQ ID NO: 896565 - RNA, 19 nt, Homo sapiens
ucaaggacaaugauuucuu

SEQ ID NO: 896566 - RNA, 19 nt, Homo sapiens
aaugaggacgggcuucuaa

SEQ ID NO: 896567 - RNA, 19 nt, Homo sapiens
gcacaggaugacuggcaaa

SEQ ID NO: 896568 - RNA, 19 nt, Homo sapiens
gacaaacgaggaguugcua

SEQ ID NO: 896569 - RNA, 19 nt, Homo sapiens
gcggauggcucaggguucu

SEQ ID NO: 896570 - RNA, 19 nt, Homo sapiens
auggagggauugcuucuug

SEQ ID NO: 896571 - RNA, 19 nt, Homo sapiens
uagcugagaacgaagaugu

SEQ ID NO: 896572 - RNA, 19 nt, Homo sapiens
aaugauuucuugcggaaca

SEQ ID NO: 896573 - RNA, 19 nt, Homo sapiens
gaggaagugaccuguaaag

SEQ ID NO: 896574 - RNA, 19 nt, Homo sapiens
gcuuauguuugccaagaca

SEQ ID NO: 896575 - RNA, 19 nt, Homo sapiens
ucagagaaggcaguugaaa

SEQ ID NO: 896576 - RNA, 19 nt, Homo sapiens
ccaagacaaacgaggaguu

SEQ ID NO: 896577 - RNA, 19 nt, Homo sapiens
ucaacaucgugcucaagga

SEQ ID NO: 896578 - RNA, 19 nt, Homo sapiens
gagcaccaggccaaacaga

SEQ ID NO: 896579 - RNA, 19 nt, Homo sapiens
aagauguggugguuguaga

SEQ ID NO: 896580 - RNA, 19 nt, Homo sapiens
uuaguggugucuuacaaag

SEQ ID NO: 896581 - RNA, 19 nt, Homo sapiens
ucaggaguuggacacaaua

SEQ ID NO: 896582 - RNA, 19 nt, Homo sapiens
cgucuucaguaccgaguuc

SEQ ID NO: 896583 - RNA, 19 nt, Homo sapiens
gccaucccauucucaacga

SEQ ID NO: 896584 - RNA, 19 nt, Homo sapiens
ucuuaguggugucuuacaa

SEQ ID NO: 896585 - RNA, 19 nt, Homo sapiens
gagaauucacgagcagguu

SEQ ID NO: 896586 - RNA, 19 nt, Homo sapiens
aacagugucuacccagguu

SEQ ID NO: 896587 - RNA, 19 nt, Homo sapiens
caaggagcaccaacucaag

SEQ ID NO: 896588 - RNA, 19 nt, Homo sapiens
ggaaugaggacgggcuucu

SEQ ID NO: 896589 - RNA, 19 nt, Homo sapiens
gcaguugaaacagauguca

SEQ ID NO: 896590 - RNA, 19 nt, Homo sapiens
cucaggaguuggacacaau

SEQ ID NO: 896591 - RNA, 19 nt, Homo sapiens
ccucaggaguuggacacaa

SEQ ID NO: 896592 - RNA, 19 nt, Homo sapiens
ccagaagauggaggaagua

SEQ ID NO: 896593 - RNA, 19 nt, Homo sapiens
ggauggcucaggguucuug

SEQ ID NO: 896594 - RNA, 19 nt, Homo sapiens
uagacaagccuuccuccau

SEQ ID NO: 896595 - RNA, 19 nt, Homo sapiens
aggacgggcuucuaaagag

SEQ ID NO: 896596 - RNA, 19 nt, Homo sapiens
gaugucaugaaucaagaga

SEQ ID NO: 896597 - RNA, 19 nt, Homo sapiens
acagaugucaugaaucaag

SEQ ID NO: 896598 - RNA, 19 nt, Homo sapiens
ggggugagcuucggagaug

SEQ ID NO: 896599 - RNA, 19 nt, Homo sapiens
gcggcuacauucccaagac

SEQ ID NO: 896600 - RNA, 19 nt, Homo sapiens
gcaugagccaccagucaca

SEQ ID NO: 896601 - RNA, 19 nt, Homo sapiens
acacagugcacaggcauga

SEQ ID NO: 896602 - RNA, 19 nt, Homo sapiens
agagaccugcucauacuug

SEQ ID NO: 896603 - RNA, 19 nt, Homo sapiens
ggaaagagauggaggauuu

SEQ ID NO: 896604 - RNA, 19 nt, Homo sapiens
gaacuucagucucgucuua

SEQ ID NO: 896605 - RNA, 19 nt, Homo sapiens
gaagaucucagaaauguua

SEQ ID NO: 896606 - RNA, 19 nt, Homo sapiens
gaaagaaaguuuggauuug

SEQ ID NO: 896607 - RNA, 19 nt, Homo sapiens
ggaaagaaaguuuggauuu

SEQ ID NO: 896608 - RNA, 19 nt, Homo sapiens
gaacgguccuuaccaguga

SEQ ID NO: 896609 - RNA, 19 nt, Homo sapiens
gaacugaaguaucccgauu

SEQ ID NO: 896610 - RNA, 19 nt, Homo sapiens
gaucuacccuccugcuaua

SEQ ID NO: 896611 - RNA, 19 nt, Homo sapiens
caaagauccuccuaaauug

SEQ ID NO: 896612 - RNA, 19 nt, Homo sapiens
ugacaaagauccuccuaaa

SEQ ID NO: 896613 - RNA, 19 nt, Homo sapiens
cuaaagaauugcugaagua

SEQ ID NO: 896614 - RNA, 19 nt, Homo sapiens
uaaauuggauggagcuauu

SEQ ID NO: 896615 - RNA, 19 nt, Homo sapiens
gcuauuaucucuuguuaca

SEQ ID NO: 896616 - RNA, 19 nt, Homo sapiens
acaaagauccuccuaaauu

SEQ ID NO: 896617 - RNA, 19 nt, Homo sapiens
gaagaagaagacaguaaua

SEQ ID NO: 896618 - RNA, 19 nt, Homo sapiens
guauugccauguaccauua

SEQ ID NO: 896619 - RNA, 19 nt, Homo sapiens
gagucacacuuaagaauuu

SEQ ID NO: 896620 - RNA, 19 nt, Homo sapiens
ggaaaccaauccucuggaa

SEQ ID NO: 896621 - RNA, 19 nt, Homo sapiens
uaaagggagucacacuuaa

SEQ ID NO: 896622 - RNA, 19 nt, Homo sapiens
aaacgaauaucgaagaaug

SEQ ID NO: 896623 - RNA, 19 nt, Homo sapiens
gggaugcuauguuaaugua

SEQ ID NO: 896624 - RNA, 19 nt, Homo sapiens
guagagcaaugguagauau

SEQ ID NO: 896625 - RNA, 19 nt, Homo sapiens
gagagaaacaguuagcuaa

SEQ ID NO: 896626 - RNA, 19 nt, Homo sapiens
gagaaacaguuagcuaaug

SEQ ID NO: 896627 - RNA, 19 nt, Homo sapiens
gaaccuaauuccucaaguc

SEQ ID NO: 896628 - RNA, 19 nt, Homo sapiens
uagaagaucucagaaaugu

SEQ ID NO: 896629 - RNA, 19 nt, Homo sapiens
ccuaauuccucaagucuaa

SEQ ID NO: 896630 - RNA, 19 nt, Homo sapiens
ugaaguaucccgauugaaa

SEQ ID NO: 896631 - RNA, 19 nt, Homo sapiens
gaauuugaguuaggauuga

SEQ ID NO: 896632 - RNA, 19 nt, Homo sapiens
gaaagacuauuuaccuacu

SEQ ID NO: 896633 - RNA, 19 nt, Homo sapiens
ggagaguguucuagcuauu

SEQ ID NO: 896634 - RNA, 19 nt, Homo sapiens
ggaaggaauauauagcuaa

SEQ ID NO: 896635 - RNA, 19 nt, Homo sapiens
gaucugaauugccuuuauc

SEQ ID NO: 896636 - RNA, 19 nt, Homo sapiens
gagcaaugguagauauaau

SEQ ID NO: 896637 - RNA, 19 nt, Homo sapiens
gaagaagacaguaauagca

SEQ ID NO: 896638 - RNA, 19 nt, Homo sapiens
uuugagggaugcuauguua

SEQ ID NO: 896639 - RNA, 19 nt, Homo sapiens
gaaucaagaucacagaaac

SEQ ID NO: 896640 - RNA, 19 nt, Homo sapiens
ucacauuguuggaugcuaa

SEQ ID NO: 896641 - RNA, 19 nt, Homo sapiens
cugcuaauguuguaucuuu

SEQ ID NO: 896642 - RNA, 19 nt, Homo sapiens
gaauaucgaagaauguuug

SEQ ID NO: 896643 - RNA, 19 nt, Homo sapiens
ccagaaagccacaaacaga

SEQ ID NO: 896644 - RNA, 19 nt, Homo sapiens
gaagaagccaaauugaguu

SEQ ID NO: 896645 - RNA, 19 nt, Homo sapiens
gacagaagaagccaaauug

SEQ ID NO: 896646 - RNA, 19 nt, Homo sapiens
gaucauaccaucaaaggau

SEQ ID NO: 896647 - RNA, 19 nt, Homo sapiens
uuaaagggagucacacuua

SEQ ID NO: 896648 - RNA, 19 nt, Homo sapiens
gagcuauuauucacuacuu

SEQ ID NO: 896649 - RNA, 19 nt, Homo sapiens
ggucuuaccuuuugagaaa

SEQ ID NO: 896650 - RNA, 19 nt, Homo sapiens
ugaaguacuuuaccucaga

SEQ ID NO: 896651 - RNA, 19 nt, Homo sapiens
aagaauugcugaaguacuu

SEQ ID NO: 896652 - RNA, 19 nt, Homo sapiens
gcuaaagaauugcugaagu

SEQ ID NO: 896653 - RNA, 19 nt, Homo sapiens
acaguuagcuaauguucaa

SEQ ID NO: 896654 - RNA, 19 nt, Homo sapiens
ugucggauauugaauuuga

SEQ ID NO: 896655 - RNA, 19 nt, Homo sapiens
ugaagaagcugcagaaaau

SEQ ID NO: 896656 - RNA, 19 nt, Homo sapiens
ggaaucaagaucacagaaa

SEQ ID NO: 896657 - RNA, 19 nt, Homo sapiens
gcauuagugcuucaauuaa

SEQ ID NO: 896658 - RNA, 19 nt, Homo sapiens
gaaaggcauguucuucaaa

SEQ ID NO: 896659 - RNA, 19 nt, Homo sapiens
gaguuaggauugacaaaca

SEQ ID NO: 896660 - RNA, 19 nt, Homo sapiens
ggagucacacuuaagaauu

SEQ ID NO: 896661 - RNA, 19 nt, Homo sapiens
uggcugaucucuaugaaga

SEQ ID NO: 896662 - RNA, 19 nt, Homo sapiens
cugaagaaacacaguauua

SEQ ID NO: 896663 - RNA, 19 nt, Homo sapiens
caaggcaaauuaaggaauc

SEQ ID NO: 896664 - RNA, 19 nt, Homo sapiens
ucagacaacugguaauagu

SEQ ID NO: 896665 - RNA, 19 nt, Homo sapiens
caaagcagccugaaacagu

SEQ ID NO: 896666 - RNA, 19 nt, Homo sapiens
acagagagagaaacaguua

SEQ ID NO: 896667 - RNA, 19 nt, Homo sapiens
gagaguguucuagcuauua

SEQ ID NO: 896668 - RNA, 19 nt, Homo sapiens
gaauuugugcagaugauaa

SEQ ID NO: 896669 - RNA, 19 nt, Homo sapiens
uuggagaucuucaaccuuu

SEQ ID NO: 896670 - RNA, 19 nt, Homo sapiens
gauaugggaaagaaaguuu

SEQ ID NO: 896671 - RNA, 19 nt, Homo sapiens
gacgaaaguuggcaaagca

SEQ ID NO: 896672 - RNA, 19 nt, Homo sapiens
agaaacaguuagcuaaugu

SEQ ID NO: 896673 - RNA, 19 nt, Homo sapiens
ucaaacgaauaucgaagaa

SEQ ID NO: 896674 - RNA, 19 nt, Homo sapiens
gagaaagccucaguauguc

SEQ ID NO: 896675 - RNA, 19 nt, Homo sapiens
auacagauaugggaaagaa

SEQ ID NO: 896676 - RNA, 19 nt, Homo sapiens
cagcaaagaucacuauagc

SEQ ID NO: 896677 - RNA, 19 nt, Homo sapiens
ucacagcagcaaauguuua

SEQ ID NO: 896678 - RNA, 19 nt, Homo sapiens
aaacacacacggauacuga

SEQ ID NO: 896679 - RNA, 19 nt, Homo sapiens
guuggaugcuaaagaauug

SEQ ID NO: 896680 - RNA, 19 nt, Homo sapiens
ggugauugacuggguauua

SEQ ID NO: 896681 - RNA, 19 nt, Homo sapiens
acacacggauacugaaaga

SEQ ID NO: 896682 - RNA, 19 nt, Homo sapiens
gcaaauuaaggaaucaaga

SEQ ID NO: 896683 - RNA, 19 nt, Homo sapiens
agucucgucuuauucguua

SEQ ID NO: 896684 - RNA, 19 nt, Homo sapiens
ggacuucacagcagcaaau

SEQ ID NO: 896685 - RNA, 19 nt, Homo sapiens
agacaagcaagaaaugaua

SEQ ID NO: 896686 - RNA, 19 nt, Homo sapiens
gaauugcugaaguacuuua

SEQ ID NO: 896687 - RNA, 19 nt, Homo sapiens
aaacaacaaugcuguacag

SEQ ID NO: 896688 - RNA, 19 nt, Homo sapiens
gaaguacuuuaccucagau

SEQ ID NO: 896689 - RNA, 19 nt, Homo sapiens
ugccaaagguuuuccauua

SEQ ID NO: 896690 - RNA, 19 nt, Homo sapiens
gaauaccuuucugcuaaug

SEQ ID NO: 896691 - RNA, 19 nt, Homo sapiens
gcaggaaaucauugugaaa

SEQ ID NO: 896692 - RNA, 19 nt, Homo sapiens
gcagccagcgucucuuuga

SEQ ID NO: 896693 - RNA, 19 nt, Homo sapiens
cugaaacccugaagaaaca

SEQ ID NO: 896694 - RNA, 19 nt, Homo sapiens
agacaacugguaauaguaa

SEQ ID NO: 896695 - RNA, 19 nt, Homo sapiens
aaagcagccugaaacaguu

SEQ ID NO: 896696 - RNA, 19 nt, Homo sapiens
gagggaugcuauguuaaug

SEQ ID NO: 896697 - RNA, 19 nt, Homo sapiens
uaccgagacucaugaaugu

SEQ ID NO: 896698 - RNA, 19 nt, Homo sapiens
aaagacuugugaaaucuga

SEQ ID NO: 896699 - RNA, 19 nt, Homo sapiens
aaaccaauccucuggaaug

SEQ ID NO: 896700 - RNA, 19 nt, Homo sapiens
ggauggagcuauuauucac

SEQ ID NO: 896701 - RNA, 19 nt, Homo sapiens
aaaaugaacuucgaacuga

SEQ ID NO: 896702 - RNA, 19 nt, Homo sapiens
ugggaaacuucaggucuua

SEQ ID NO: 896703 - RNA, 19 nt, Homo sapiens
ccacagagcuuaccucaua

SEQ ID NO: 896704 - RNA, 19 nt, Homo sapiens
gaaguuagaccaccauuua

SEQ ID NO: 896705 - RNA, 19 nt, Homo sapiens
gcgcugaguuuauacauua

SEQ ID NO: 896706 - RNA, 19 nt, Homo sapiens
gcaauuagaguauccaaua

SEQ ID NO: 896707 - RNA, 19 nt, Homo sapiens
gaagauugcuuuacagaag

SEQ ID NO: 896708 - RNA, 19 nt, Homo sapiens
gaacugcuccuucaucgua

SEQ ID NO: 896709 - RNA, 19 nt, Homo sapiens
caacuuagccagcgcaaua

SEQ ID NO: 896710 - RNA, 19 nt, Homo sapiens
uaaaggagcuacagaagga

SEQ ID NO: 896711 - RNA, 19 nt, Homo sapiens
gaagccaaauauccucuua

SEQ ID NO: 896712 - RNA, 19 nt, Homo sapiens
gcagcaaguuaguggauua

SEQ ID NO: 896713 - RNA, 19 nt, Homo sapiens
gcacaguacugcauguuga

SEQ ID NO: 896714 - RNA, 19 nt, Homo sapiens
ugacagagauuacgaagau

SEQ ID NO: 896715 - RNA, 19 nt, Homo sapiens
uccaagaccuccuuaauaa

SEQ ID NO: 896716 - RNA, 19 nt, Homo sapiens
cagaaaagcuuccauaauu

SEQ ID NO: 896717 - RNA, 19 nt, Homo sapiens
gguaacccuucccuuauua

SEQ ID NO: 896718 - RNA, 19 nt, Homo sapiens
uuacgaagaugaaccagua

SEQ ID NO: 896719 - RNA, 19 nt, Homo sapiens
ccaaagauauuacacaaag

SEQ ID NO: 896720 - RNA, 19 nt, Homo sapiens
ccacaugccucuaccaaug

SEQ ID NO: 896721 - RNA, 19 nt, Homo sapiens
ugacaacucugaaaugugu

SEQ ID NO: 896722 - RNA, 19 nt, Homo sapiens
ucacacgaauguuugcuua

SEQ ID NO: 896723 - RNA, 19 nt, Homo sapiens
gacaguggaugaaguagaa

SEQ ID NO: 896724 - RNA, 19 nt, Homo sapiens
caagaggaaugacaaacaa

SEQ ID NO: 896725 - RNA, 19 nt, Homo sapiens
gcauauauccuucaguuug

SEQ ID NO: 896726 - RNA, 19 nt, Homo sapiens
aaagagaacugcuccuuca

SEQ ID NO: 896727 - RNA, 19 nt, Homo sapiens
gcagaaaugugaugguuac

SEQ ID NO: 896728 - RNA, 19 nt, Homo sapiens
gagacaaacucuaggaaca

SEQ ID NO: 896729 - RNA, 19 nt, Homo sapiens
gaugacaccucaaguuauc

SEQ ID NO: 896730 - RNA, 19 nt, Homo sapiens
caacagcagcagcaaguua

SEQ ID NO: 896731 - RNA, 19 nt, Homo sapiens
cagcagauauugcgcagaa

SEQ ID NO: 896732 - RNA, 19 nt, Homo sapiens
ucacucugcuuucuguaua

SEQ ID NO: 896733 - RNA, 19 nt, Homo sapiens
gauaauggaaccaaaguug

SEQ ID NO: 896734 - RNA, 19 nt, Homo sapiens
ccacuuuccugucauuuau

SEQ ID NO: 896735 - RNA, 19 nt, Homo sapiens
uaaaacaucucaacaguga

SEQ ID NO: 896736 - RNA, 19 nt, Homo sapiens
cauagaagauaucauguag

SEQ ID NO: 896737 - RNA, 19 nt, Homo sapiens
gcagugcgucauaaucuua

SEQ ID NO: 896738 - RNA, 19 nt, Homo sapiens
gagagccuuucgaagcuua

SEQ ID NO: 896739 - RNA, 19 nt, Homo sapiens
uauaagaacgcagaaguua

SEQ ID NO: 896740 - RNA, 19 nt, Homo sapiens
gaagugacaagugcucaua

SEQ ID NO: 896741 - RNA, 19 nt, Homo sapiens
ccagaaagagaaugaauga

SEQ ID NO: 896742 - RNA, 19 nt, Homo sapiens
gaaaagcagcuaacacuaa

SEQ ID NO: 896743 - RNA, 19 nt, Homo sapiens
caagaccuccuuaauaaug

SEQ ID NO: 896744 - RNA, 19 nt, Homo sapiens
caaauuugguacugcaguu

SEQ ID NO: 896745 - RNA, 19 nt, Homo sapiens
gcagcaaccauuaauaaau

SEQ ID NO: 896746 - RNA, 19 nt, Homo sapiens
ccacguuucucuaaaguca

SEQ ID NO: 896747 - RNA, 19 nt, Homo sapiens
caccuaagcugcagaccaa

SEQ ID NO: 896748 - RNA, 19 nt, Homo sapiens
caucaguguuguaaauuug

SEQ ID NO: 896749 - RNA, 19 nt, Homo sapiens
gcagcagcuucaagaguuu

SEQ ID NO: 896750 - RNA, 19 nt, Homo sapiens
gcuccuucaucguaaauuu

SEQ ID NO: 896751 - RNA, 19 nt, Homo sapiens
ccgagcagcugcccugaaa

SEQ ID NO: 896752 - RNA, 19 nt, Homo sapiens
ggaaggccuuugugugugu

SEQ ID NO: 896753 - RNA, 19 nt, Homo sapiens
uggauggacuuguuuggua

SEQ ID NO: 896754 - RNA, 19 nt, Homo sapiens
gaaauguguuaacucuuag

SEQ ID NO: 896755 - RNA, 19 nt, Homo sapiens
gcaacaaucacagcaguuu

SEQ ID NO: 896756 - RNA, 19 nt, Homo sapiens
uggcauauauccuucaguu

SEQ ID NO: 896757 - RNA, 19 nt, Homo sapiens
gguaaauuauguucucugu

SEQ ID NO: 896758 - RNA, 19 nt, Homo sapiens
gagaaugaaugacagaaaa

SEQ ID NO: 896759 - RNA, 19 nt, Homo sapiens
auacaaagcugaaugucau

SEQ ID NO: 896760 - RNA, 19 nt, Homo sapiens
uaagaacgcagaaguuaga

SEQ ID NO: 896761 - RNA, 19 nt, Homo sapiens
gccaaggccuucugacaau

SEQ ID NO: 896762 - RNA, 19 nt, Homo sapiens
gaacugugcugugaucacu

SEQ ID NO: 896763 - RNA, 19 nt, Homo sapiens
uaagaacugugcugugauc

SEQ ID NO: 896764 - RNA, 19 nt, Homo sapiens
uagaagaccaaguagauaa

SEQ ID NO: 896765 - RNA, 19 nt, Homo sapiens
aaaguuagcagugaaauug

SEQ ID NO: 896766 - RNA, 19 nt, Homo sapiens
gaagcagugugcgaagauu

SEQ ID NO: 896767 - RNA, 19 nt, Homo sapiens
cagcagcucuggaaagaag

SEQ ID NO: 896768 - RNA, 19 nt, Homo sapiens
gcccuugaaucuaguauca

SEQ ID NO: 896769 - RNA, 19 nt, Homo sapiens
ccucagcccuugaaucuag

SEQ ID NO: 896770 - RNA, 19 nt, Homo sapiens
gcaaguuaguggauuaaaa

SEQ ID NO: 896771 - RNA, 19 nt, Homo sapiens
gacuauaacugaagauugc

SEQ ID NO: 896772 - RNA, 19 nt, Homo sapiens
acacucccauccacucaua

SEQ ID NO: 896773 - RNA, 19 nt, Homo sapiens
cauauauccuucaguuugu

SEQ ID NO: 896774 - RNA, 19 nt, Homo sapiens
uaauggaaccaaaguugua

SEQ ID NO: 896775 - RNA, 19 nt, Homo sapiens
ucacugccuuuacuccuuu

SEQ ID NO: 896776 - RNA, 19 nt, Homo sapiens
aaaggaauuuguacucugu

SEQ ID NO: 896777 - RNA, 19 nt, Homo sapiens
gaagaaaccacaggcaaca

SEQ ID NO: 896778 - RNA, 19 nt, Homo sapiens
uuuaagaacugugcuguga

SEQ ID NO: 896779 - RNA, 19 nt, Homo sapiens
ucaacuacauuugggauga

SEQ ID NO: 896780 - RNA, 19 nt, Homo sapiens
gcaguccuguggcauuaug

SEQ ID NO: 896781 - RNA, 19 nt, Homo sapiens
ccaauaaaggagacaguuu

SEQ ID NO: 896782 - RNA, 19 nt, Homo sapiens
caucguaaauuuagaagac

SEQ ID NO: 896783 - RNA, 19 nt, Homo sapiens
gacaaacucuaggaacaau

SEQ ID NO: 896784 - RNA, 19 nt, Homo sapiens
gauuaucacugccuuuacu

SEQ ID NO: 896785 - RNA, 19 nt, Homo sapiens
uguacagucuggaggauuu

SEQ ID NO: 896786 - RNA, 19 nt, Homo sapiens
aggcagaucuccuaugcaa

SEQ ID NO: 896787 - RNA, 19 nt, Homo sapiens
ccaaaaggcuucccucugu

SEQ ID NO: 896788 - RNA, 19 nt, Homo sapiens
gcaaguggccaggcuguga

SEQ ID NO: 896789 - RNA, 19 nt, Homo sapiens
gcucaaggcaugauuccaa

SEQ ID NO: 896790 - RNA, 19 nt, Homo sapiens
gguaagacgugaccuuuug

SEQ ID NO: 896791 - RNA, 19 nt, Homo sapiens
cucauaagcuugguacaaa

SEQ ID NO: 896792 - RNA, 19 nt, Homo sapiens
guaugccacugcaauuaga

SEQ ID NO: 896793 - RNA, 19 nt, Homo sapiens
aaacauaggcagcacugaa

SEQ ID NO: 896794 - RNA, 19 nt, Homo sapiens
ggacauggagugacuaucg

SEQ ID NO: 896795 - RNA, 19 nt, Homo sapiens
agaaugcagugcgucauaa

SEQ ID NO: 896796 - RNA, 19 nt, Homo sapiens
ugguuuaucuuggcauaua

SEQ ID NO: 896797 - RNA, 19 nt, Homo sapiens
gaaaagcuuccauaauuga

SEQ ID NO: 896798 - RNA, 19 nt, Homo sapiens
ggacagaaaagcuuccaua

SEQ ID NO: 896799 - RNA, 19 nt, Homo sapiens
gaauguaugccacugcaau

SEQ ID NO: 896800 - RNA, 19 nt, Homo sapiens
gcaguuuguuaugcaauau

SEQ ID NO: 896801 - RNA, 19 nt, Homo sapiens
caucaccacguuucucuaa

SEQ ID NO: 896802 - RNA, 19 nt, Homo sapiens
cuucagacaucaccacguu

SEQ ID NO: 896803 - RNA, 19 nt, Homo sapiens
gcacacugcuuuggaaauu

SEQ ID NO: 896804 - RNA, 19 nt, Homo sapiens
gggaaugaguuuguuauaa

SEQ ID NO: 896805 - RNA, 19 nt, Homo sapiens
gaacaaaggacagagaauu

SEQ ID NO: 896806 - RNA, 19 nt, Homo sapiens
gcauaaggcugucuuggau

SEQ ID NO: 896807 - RNA, 19 nt, Homo sapiens
uagcauugguugccuauuu

SEQ ID NO: 896808 - RNA, 19 nt, Homo sapiens
ggacuuugauaaugaacaa

SEQ ID NO: 896809 - RNA, 19 nt, Homo sapiens
caauagacauggcuggauu

SEQ ID NO: 896810 - RNA, 19 nt, Homo sapiens
gaagggaggcuaccaggaa

SEQ ID NO: 896811 - RNA, 19 nt, Homo sapiens
gaugcuaggucaguuguuu

SEQ ID NO: 896812 - RNA, 19 nt, Homo sapiens
ggacucugcucaucacugu

SEQ ID NO: 896813 - RNA, 19 nt, Homo sapiens
gaagagacgggacauccua

SEQ ID NO: 896814 - RNA, 19 nt, Homo sapiens
caaguuggaagcacaauuu

SEQ ID NO: 896815 - RNA, 19 nt, Homo sapiens
caaaggacagagaauuuaa

SEQ ID NO: 896816 - RNA, 19 nt, Homo sapiens
gagcuuaugugugggcauu

SEQ ID NO: 896817 - RNA, 19 nt, Homo sapiens
gggcacagguggugagcuu

SEQ ID NO: 896818 - RNA, 19 nt, Homo sapiens
acaaaggacagagaauuua

SEQ ID NO: 896819 - RNA, 19 nt, Homo sapiens
guacugaagagguguuuau

SEQ ID NO: 896820 - RNA, 19 nt, Homo sapiens
gcuggaagacgguguuuga

SEQ ID NO: 896821 - RNA, 19 nt, Homo sapiens
caaaccugcuuccgcaaug

SEQ ID NO: 896822 - RNA, 19 nt, Homo sapiens
caucuggucuguuuuaauu

SEQ ID NO: 896823 - RNA, 19 nt, Homo sapiens
caccuaauauccucuuuua

SEQ ID NO: 896824 - RNA, 19 nt, Homo sapiens
gacugcagccuucaucuuu

SEQ ID NO: 896825 - RNA, 19 nt, Homo sapiens
ugccugaccuggacuaaga

SEQ ID NO: 896826 - RNA, 19 nt, Homo sapiens
ggaaggugguccgcuggaa

SEQ ID NO: 896827 - RNA, 19 nt, Homo sapiens
ggacuucuuugggcagaug

SEQ ID NO: 896828 - RNA, 19 nt, Homo sapiens
gcacagguggugagcuuau

SEQ ID NO: 896829 - RNA, 19 nt, Homo sapiens
cugaagagguguuuauuuu

SEQ ID NO: 896830 - RNA, 19 nt, Homo sapiens
acacugcuuuggaaauuau

SEQ ID NO: 896831 - RNA, 19 nt, Homo sapiens
gagaauuuaagcacagaaa

SEQ ID NO: 896832 - RNA, 19 nt, Homo sapiens
ccagagaccuaacauucag

SEQ ID NO: 896833 - RNA, 19 nt, Homo sapiens
ccaccggccauuugcaaua

SEQ ID NO: 896834 - RNA, 19 nt, Homo sapiens
ucaggagcaugcagagcua

SEQ ID NO: 896835 - RNA, 19 nt, Homo sapiens
ccaucacccuccuuucuau

SEQ ID NO: 896836 - RNA, 19 nt, Homo sapiens
ggacugcagccuucaucuu

SEQ ID NO: 896837 - RNA, 19 nt, Homo sapiens
ucaggacuuugauaaugaa

SEQ ID NO: 896838 - RNA, 19 nt, Homo sapiens
agaaaucccagaccuguug

SEQ ID NO: 896839 - RNA, 19 nt, Homo sapiens
ggaaagcagccuccuucga

SEQ ID NO: 896840 - RNA, 19 nt, Homo sapiens
uuucaggacuuugauaaug

SEQ ID NO: 896841 - RNA, 19 nt, Homo sapiens
guccagagaccuaacauuc

SEQ ID NO: 896842 - RNA, 19 nt, Homo sapiens
ccaaggccauucccuaacu

SEQ ID NO: 896843 - RNA, 19 nt, Homo sapiens
gcaaguuggaagcacaauu

SEQ ID NO: 896844 - RNA, 19 nt, Homo sapiens
cacacugcuuuggaaauua

SEQ ID NO: 896845 - RNA, 19 nt, Homo sapiens
aacaaaggacagagaauuu

SEQ ID NO: 896846 - RNA, 19 nt, Homo sapiens
acugcagccuucaucuuua

SEQ ID NO: 896847 - RNA, 19 nt, Homo sapiens
gcagaugcuaggucaguug

SEQ ID NO: 896848 - RNA, 19 nt, Homo sapiens
gaacagugugccucaaacu

SEQ ID NO: 896849 - RNA, 19 nt, Homo sapiens
uucaggacuuugauaauga

SEQ ID NO: 896850 - RNA, 19 nt, Homo sapiens
gagcuagcccaccucaugu

SEQ ID NO: 896851 - RNA, 19 nt, Homo sapiens
gagagagcccagccugaug

SEQ ID NO: 896852 - RNA, 19 nt, Homo sapiens
gagaacuugucacccucaa

SEQ ID NO: 896853 - RNA, 19 nt, Homo sapiens
cgcaauggguggguuguga

SEQ ID NO: 896854 - RNA, 19 nt, Homo sapiens
aagggaggcuaccaggaaa

SEQ ID NO: 896855 - RNA, 19 nt, Homo sapiens
ucuuuuagcugcauguaua

SEQ ID NO: 896856 - RNA, 19 nt, Homo sapiens
cacccuggaugucacuuug

SEQ ID NO: 896857 - RNA, 19 nt, Homo sapiens
cugcagccuucaucuuuau

SEQ ID NO: 896858 - RNA, 19 nt, Homo sapiens
cacagaagccagccaagug

SEQ ID NO: 896859 - RNA, 19 nt, Homo sapiens
cagaacaaaggacagagaa

SEQ ID NO: 896860 - RNA, 19 nt, Homo sapiens
gcagccagccuuggagaug

SEQ ID NO: 896861 - RNA, 19 nt, Homo sapiens
gcagcugcaucuggucugu

SEQ ID NO: 896862 - RNA, 19 nt, Homo sapiens
gcagccuucaucuuuauug

SEQ ID NO: 896863 - RNA, 19 nt, Homo sapiens
guggugauccggcucauuc

SEQ ID NO: 896864 - RNA, 19 nt, Homo sapiens
agagcuagcccaccucaug

SEQ ID NO: 896865 - RNA, 19 nt, Homo sapiens
cagagaauuuaagcacaga

SEQ ID NO: 896866 - RNA, 19 nt, Homo sapiens
gcaauagacauggcuggau

SEQ ID NO: 896867 - RNA, 19 nt, Homo sapiens
gaugaccacuguuuuccaa

SEQ ID NO: 896868 - RNA, 19 nt, Homo sapiens
gggaguacugcacgucuga

SEQ ID NO: 896869 - RNA, 19 nt, Homo sapiens
ggacagcgaccccuucuca

SEQ ID NO: 896870 - RNA, 19 nt, Homo sapiens
ccagaacaaaggacagaga

SEQ ID NO: 896871 - RNA, 19 nt, Homo sapiens
uuuaaucucccacaguauu

SEQ ID NO: 896872 - RNA, 19 nt, Homo sapiens
cuccaaggccgacuccuaa

SEQ ID NO: 896873 - RNA, 19 nt, Homo sapiens
aaagaacagugugccucaa

SEQ ID NO: 896874 - RNA, 19 nt, Homo sapiens
ugggaaugaguuuguuaua

SEQ ID NO: 896875 - RNA, 19 nt, Homo sapiens
ggucaguuguuuucaccua

SEQ ID NO: 896876 - RNA, 19 nt, Homo sapiens
acugaagagguguuuauuu

SEQ ID NO: 896877 - RNA, 19 nt, Homo sapiens
ucccagaccuguuguucuc

SEQ ID NO: 896878 - RNA, 19 nt, Homo sapiens
gcacacacggacagagaag

SEQ ID NO: 896879 - RNA, 19 nt, Homo sapiens
gcaaagggguaggcucuag

SEQ ID NO: 896880 - RNA, 19 nt, Homo sapiens
cgacaccggccucaacuac

SEQ ID NO: 896881 - RNA, 19 nt, Homo sapiens
ggcagaugcuaggucaguu

SEQ ID NO: 896882 - RNA, 19 nt, Homo sapiens
ggaugucacuuuggaaacc

SEQ ID NO: 896883 - RNA, 19 nt, Homo sapiens
aagaacagugugccucaaa

SEQ ID NO: 896884 - RNA, 19 nt, Homo sapiens
gcccuggacucugcucauc

SEQ ID NO: 896885 - RNA, 19 nt, Homo sapiens
gguugugagugcugguaau

SEQ ID NO: 896886 - RNA, 19 nt, Homo sapiens
ccuuggagaugccgaagag

SEQ ID NO: 896887 - RNA, 19 nt, Homo sapiens
ccucuuacacccuggaugu

SEQ ID NO: 896888 - RNA, 19 nt, Homo sapiens
gccagggaauucugaagac

SEQ ID NO: 896889 - RNA, 19 nt, Homo sapiens
ggacacccagccagggaau

SEQ ID NO: 896890 - RNA, 19 nt, Homo sapiens
ugagagagcccagccugau

SEQ ID NO: 896891 - RNA, 19 nt, Homo sapiens
ccuccaaggccgacuccua

SEQ ID NO: 896892 - RNA, 19 nt, Homo sapiens
cagccuccuucgagaacuu

SEQ ID NO: 896893 - RNA, 19 nt, Homo sapiens
ugugagugcugguaaugag

SEQ ID NO: 896894 - RNA, 19 nt, Homo sapiens
gggcagaugcuaggucagu

SEQ ID NO: 896895 - RNA, 19 nt, Homo sapiens
ccaaaccugcuuccgcaau

SEQ ID NO: 896896 - RNA, 19 nt, Homo sapiens
gaccuguuguucucuccau

SEQ ID NO: 896897 - RNA, 19 nt, Homo sapiens
caccggccauuugcaauag

SEQ ID NO: 896898 - RNA, 19 nt, Homo sapiens
gaaaucccagaccuguugu

SEQ ID NO: 896899 - RNA, 19 nt, Homo sapiens
agcugcaucuggucuguuu

SEQ ID NO: 896900 - RNA, 19 nt, Homo sapiens
ucacagaagccagccaagu

SEQ ID NO: 896901 - RNA, 19 nt, Homo sapiens
cuccucugguucaccuuua

SEQ ID NO: 896902 - RNA, 19 nt, Homo sapiens
caaggccauucccuaacuc

SEQ ID NO: 896903 - RNA, 19 nt, Homo sapiens
gcacacugcuuuggaaauu

SEQ ID NO: 896904 - RNA, 19 nt, Homo sapiens
gggaaugaguuuguuauaa

SEQ ID NO: 896905 - RNA, 19 nt, Homo sapiens
gaacaaaggacagagaauu

SEQ ID NO: 896906 - RNA, 19 nt, Homo sapiens
gcauaaggcugucuuggau

SEQ ID NO: 896907 - RNA, 19 nt, Homo sapiens
uagcauugguugccuauuu

SEQ ID NO: 896908 - RNA, 19 nt, Homo sapiens
ggacuuugauaaugaacaa

SEQ ID NO: 896909 - RNA, 19 nt, Homo sapiens
caauagacauggcuggauu

SEQ ID NO: 896910 - RNA, 19 nt, Homo sapiens
gaagggaggcuaccaggaa

SEQ ID NO: 896911 - RNA, 19 nt, Homo sapiens
gaugcuaggucaguuguuu

SEQ ID NO: 896912 - RNA, 19 nt, Homo sapiens
ggacucugcucaucacugu

SEQ ID NO: 896913 - RNA, 19 nt, Homo sapiens
gaagagacgggacauccua

SEQ ID NO: 896914 - RNA, 19 nt, Homo sapiens
caaguuggaagcacaauuu

SEQ ID NO: 896915 - RNA, 19 nt, Homo sapiens
caaaggacagagaauuuaa

SEQ ID NO: 896916 - RNA, 19 nt, Homo sapiens
gggcacagguggugagcuu

SEQ ID NO: 896917 - RNA, 19 nt, Homo sapiens
acaaaggacagagaauuua

SEQ ID NO: 896918 - RNA, 19 nt, Homo sapiens
gcuggaagacgguguuuga

SEQ ID NO: 896919 - RNA, 19 nt, Homo sapiens
caaaccugcuuccgcaaug

SEQ ID NO: 896920 - RNA, 19 nt, Homo sapiens
caucuggucuguuuuaauu

SEQ ID NO: 896921 - RNA, 19 nt, Homo sapiens
caccuaauauccucuuuua

SEQ ID NO: 896922 - RNA, 19 nt, Homo sapiens
gacugcagccuucaucuuu

SEQ ID NO: 896923 - RNA, 19 nt, Homo sapiens
ugccugaccuggacuaaga

SEQ ID NO: 896924 - RNA, 19 nt, Homo sapiens
ggaagguggucggcuggaa

SEQ ID NO: 896925 - RNA, 19 nt, Homo sapiens
ggacuucuuugggcagaug

SEQ ID NO: 896926 - RNA, 19 nt, Homo sapiens
gcacagguggugagcuuau

SEQ ID NO: 896927 - RNA, 19 nt, Homo sapiens
cugaagagguguuuauuuu

SEQ ID NO: 896928 - RNA, 19 nt, Homo sapiens
acacugcuuuggaaauuau

SEQ ID NO: 896929 - RNA, 19 nt, Homo sapiens
gagaauuuaagcacagaaa

SEQ ID NO: 896930 - RNA, 19 nt, Homo sapiens
ccagagaccuaacauucag

SEQ ID NO: 896931 - RNA, 19 nt, Homo sapiens
ccaccggccauuugcaaua

SEQ ID NO: 896932 - RNA, 19 nt, Homo sapiens
ucaggagcaugcagagcua

SEQ ID NO: 896933 - RNA, 19 nt, Homo sapiens
ccaucacccuccuuucuau

SEQ ID NO: 896934 - RNA, 19 nt, Homo sapiens
ggacugcagccuucaucuu

SEQ ID NO: 896935 - RNA, 19 nt, Homo sapiens
ucaggacuuugauaaugaa

SEQ ID NO: 896936 - RNA, 19 nt, Homo sapiens
agaaaucccagaccuguug

SEQ ID NO: 896937 - RNA, 19 nt, Homo sapiens
ggaaagcagccuccuucga

SEQ ID NO: 896938 - RNA, 19 nt, Homo sapiens
uuucaggacuuugauaaug

SEQ ID NO: 896939 - RNA, 19 nt, Homo sapiens
guccagagaccuaacauuc

SEQ ID NO: 896940 - RNA, 19 nt, Homo sapiens
ccaaggccauucccuaacu

SEQ ID NO: 896941 - RNA, 19 nt, Homo sapiens
ggucugaggccaccuucuu

SEQ ID NO: 896942 - RNA, 19 nt, Homo sapiens
gcaaguuggaagcacaauu

SEQ ID NO: 896943 - RNA, 19 nt, Homo sapiens
cacacugcuuuggaaauua

SEQ ID NO: 896944 - RNA, 19 nt, Homo sapiens
aacaaaggacagagaauuu

SEQ ID NO: 896945 - RNA, 19 nt, Homo sapiens
acugcagccuucaucuuua

SEQ ID NO: 896946 - RNA, 19 nt, Homo sapiens
gcagaugcuaggucaguug

SEQ ID NO: 896947 - RNA, 19 nt, Homo sapiens
cuacugaagagguguuuau

SEQ ID NO: 896948 - RNA, 19 nt, Homo sapiens
gaacagugugccucaaacu

SEQ ID NO: 896949 - RNA, 19 nt, Homo sapiens
uucaggacuuugauaauga

SEQ ID NO: 896950 - RNA, 19 nt, Homo sapiens
gagcuagcccaccucaugu

SEQ ID NO: 896951 - RNA, 19 nt, Homo sapiens
gagagagcccagccugaug

SEQ ID NO: 896952 - RNA, 19 nt, Homo sapiens
gagaacuugucacccucaa

SEQ ID NO: 896953 - RNA, 19 nt, Homo sapiens
cgcaauggguggguuguga

SEQ ID NO: 896954 - RNA, 19 nt, Homo sapiens
aagggaggcuaccaggaaa

SEQ ID NO: 896955 - RNA, 19 nt, Homo sapiens
ucuuuuagcugcauguaua

SEQ ID NO: 896956 - RNA, 19 nt, Homo sapiens
cacccuggaugucacuuug

SEQ ID NO: 896957 - RNA, 19 nt, Homo sapiens
cugcagccuucaucuuuau

SEQ ID NO: 896958 - RNA, 19 nt, Homo sapiens
cacagaagccagccaagug

SEQ ID NO: 896959 - RNA, 19 nt, Homo sapiens
gcagccagccuuggagaug

SEQ ID NO: 896960 - RNA, 19 nt, Homo sapiens
cagaacaaaggacagagaa

SEQ ID NO: 896961 - RNA, 19 nt, Homo sapiens
gcagcugcaucuggucugu

SEQ ID NO: 896962 - RNA, 19 nt, Homo sapiens
gcagccuucaucuuuauug

SEQ ID NO: 896963 - RNA, 19 nt, Homo sapiens
guggugauccggcucauuc

SEQ ID NO: 896964 - RNA, 19 nt, Homo sapiens
agagcuagcccaccucaug

SEQ ID NO: 896965 - RNA, 19 nt, Homo sapiens
cagagaauuuaagcacaga

SEQ ID NO: 896966 - RNA, 19 nt, Homo sapiens
gcaauagacauggcuggau

SEQ ID NO: 896967 - RNA, 19 nt, Homo sapiens
gaugaccacuguuuuccaa

SEQ ID NO: 896968 - RNA, 19 nt, Homo sapiens
ggacagcgaccccuucuca

SEQ ID NO: 896969 - RNA, 19 nt, Homo sapiens
ccagaacaaaggacagaga

SEQ ID NO: 896970 - RNA, 19 nt, Homo sapiens
gggaguacugcacgucuga

SEQ ID NO: 896971 - RNA, 19 nt, Homo sapiens
gcccaugccuguucuuuuc

SEQ ID NO: 896972 - RNA, 19 nt, Homo sapiens
uuuaaucucccacaguauu

SEQ ID NO: 896973 - RNA, 19 nt, Homo sapiens
ucacguuuacagagcauaa

SEQ ID NO: 896974 - RNA, 19 nt, Homo sapiens
cuccaaggccgacuccuaa

SEQ ID NO: 896975 - RNA, 19 nt, Homo sapiens
aaagaacagugugccucaa

SEQ ID NO: 896976 - RNA, 19 nt, Homo sapiens
ugggaaugaguuuguuaua

SEQ ID NO: 896977 - RNA, 19 nt, Homo sapiens
ggucaguuguuuucaccua

SEQ ID NO: 896978 - RNA, 19 nt, Homo sapiens
gucugaggccaccuucuua

SEQ ID NO: 896979 - RNA, 19 nt, Homo sapiens
acugaagagguguuuauuu

SEQ ID NO: 896980 - RNA, 19 nt, Homo sapiens
ucccagaccuguuguucuc

SEQ ID NO: 896981 - RNA, 19 nt, Homo sapiens
gcacacacggacagagaag

SEQ ID NO: 896982 - RNA, 19 nt, Homo sapiens
gcaaagggguaggcucuag

SEQ ID NO: 896983 - RNA, 19 nt, Homo sapiens
cgacaccggccucaacuac

SEQ ID NO: 896984 - RNA, 19 nt, Homo sapiens
gcccuggacucugcucauc

SEQ ID NO: 896985 - RNA, 19 nt, Homo sapiens
ggcagaugcuaggucaguu

SEQ ID NO: 896986 - RNA, 19 nt, Homo sapiens
ggaugucacuuuggaaacc

SEQ ID NO: 896987 - RNA, 19 nt, Homo sapiens
aagaacagugugccucaaa

SEQ ID NO: 896988 - RNA, 19 nt, Homo sapiens
ccuuggagaugccgaagag

SEQ ID NO: 896989 - RNA, 19 nt, Homo sapiens
ccucuuacacccuggaugu

SEQ ID NO: 896990 - RNA, 19 nt, Homo sapiens
gccagggaauucugaagac

SEQ ID NO: 896991 - RNA, 19 nt, Homo sapiens
ggacacccagccagggaau

SEQ ID NO: 896992 - RNA, 19 nt, Homo sapiens
ugagagagcccagccugau

SEQ ID NO: 896993 - RNA, 19 nt, Homo sapiens
ccuccaaggccgacuccua

SEQ ID NO: 896994 - RNA, 19 nt, Homo sapiens
cagccuccuucgagaacuu

SEQ ID NO: 896995 - RNA, 19 nt, Homo sapiens
ccaaaccugcuuccgcaau

SEQ ID NO: 896996 - RNA, 19 nt, Homo sapiens
gggcagaugcuaggucagu

SEQ ID NO: 896997 - RNA, 19 nt, Homo sapiens
gaccuguuguucucuccau

SEQ ID NO: 896998 - RNA, 19 nt, Homo sapiens
gaaaucccagaccuguugu

SEQ ID NO: 896999 - RNA, 19 nt, Homo sapiens
caccggccauuugcaauag

SEQ ID NO: 897000 - RNA, 19 nt, Homo sapiens
agcugcaucuggucuguuu

SEQ ID NO: 897001 - RNA, 19 nt, Homo sapiens
ucacagaagccagccaagu

SEQ ID NO: 897002 - RNA, 19 nt, Homo sapiens
gaccugcuagccaacauuc

SEQ ID NO: 897003 - RNA, 19 nt, Homo sapiens
gaagaggagucugcauugu

SEQ ID NO: 897004 - RNA, 19 nt, Homo sapiens
ggauccagcugccuaugaa

SEQ ID NO: 897005 - RNA, 19 nt, Homo sapiens
ggaagaggagucugcauug

SEQ ID NO: 897006 - RNA, 19 nt, Homo sapiens
acaauaaacuuccuauggu

SEQ ID NO: 897007 - RNA, 19 nt, Homo sapiens
caaagacacaauaaacuuc

SEQ ID NO: 897008 - RNA, 19 nt, Homo sapiens
ggaugacgguucccugucu

SEQ ID NO: 897009 - RNA, 19 nt, Homo sapiens
agaggagucugcauuguag

SEQ ID NO: 897010 - RNA, 19 nt, Homo sapiens
ccgcacgucuucacuaaag

SEQ ID NO: 897011 - RNA, 19 nt, Homo sapiens
cacaauaaacuuccuaugg

SEQ ID NO: 897012 - RNA, 19 nt, Homo sapiens
cugaagaguucgagagauc

SEQ ID NO: 897013 - RNA, 19 nt, Homo sapiens
aagaggagucugcauugua

SEQ ID NO: 897014 - RNA, 19 nt, Homo sapiens
uaaacuuccuauggucuga

SEQ ID NO: 897015 - RNA, 19 nt, Homo sapiens
cgucuucacuaaaggaauc

SEQ ID NO: 897016 - RNA, 19 nt, Homo sapiens
gcauuguagugucucaaag

SEQ ID NO: 897017 - RNA, 19 nt, Homo sapiens
gcacgucuucacuaaagga

SEQ ID NO: 897018 - RNA, 19 nt, Homo sapiens
gaaaaugacaaaugagcaa

SEQ ID NO: 897019 - RNA, 19 nt, Homo sapiens
uggaagaggagucugcauu

SEQ ID NO: 897020 - RNA, 19 nt, Homo sapiens
gccgcaguuuguaguguuu

SEQ ID NO: 897021 - RNA, 19 nt, Homo sapiens
cuaaaggaauccccaaugu

SEQ ID NO: 897022 - RNA, 19 nt, Homo sapiens
ucucaaagacacaauaaac

SEQ ID NO: 897023 - RNA, 19 nt, Homo sapiens
gacugaagaguucgagaga

SEQ ID NO: 897024 - RNA, 19 nt, Homo sapiens
gacgguucccugucucuga

SEQ ID NO: 897025 - RNA, 19 nt, Homo sapiens
ggaggauccagcugccuau

SEQ ID NO: 897026 - RNA, 19 nt, Homo sapiens
cauuguagugucucaaaga

SEQ ID NO: 897027 - RNA, 19 nt, Homo sapiens
gcgccuauccgcacgucuu

SEQ ID NO: 897028 - RNA, 19 nt, Homo sapiens
gauccagcugccuaugaaa

SEQ ID NO: 897029 - RNA, 19 nt, Homo sapiens
caacucaccagcaucauga

SEQ ID NO: 897030 - RNA, 19 nt, Homo sapiens
gaagaggcccaucguguuc

SEQ ID NO: 897031 - RNA, 19 nt, Homo sapiens
gugaggagaucguggucua

SEQ ID NO: 897032 - RNA, 19 nt, Homo sapiens
gagacacgcucuacauggu

SEQ ID NO: 897033 - RNA, 19 nt, Homo sapiens
gcgcaacuauucacacuac

SEQ ID NO: 897034 - RNA, 19 nt, Homo sapiens
ggucuucucugccgucuac

SEQ ID NO: 897035 - RNA, 19 nt, Homo sapiens
cuagaugagugucagaugu

SEQ ID NO: 897036 - RNA, 19 nt, Homo sapiens
ggacagcgacagcaugaag

SEQ ID NO: 897037 - RNA, 19 nt, Homo sapiens
caacuauucacacuacuuc

SEQ ID NO: 897038 - RNA, 19 nt, Homo sapiens
uagaugagugucagaugua

SEQ ID NO: 897039 - RNA, 19 nt, Homo sapiens
gcaacuauucacacuacuu

SEQ ID NO: 897040 - RNA, 19 nt, Homo sapiens
cugaguaauucauggcauu

SEQ ID NO: 897041 - RNA, 19 nt, Homo sapiens
agaagaggcccaucguguu

SEQ ID NO: 897042 - RNA, 19 nt, Homo sapiens
ucaccagcaucaugaccuu

SEQ ID NO: 897043 - RNA, 19 nt, Homo sapiens
gaggagaucguggucuaug

SEQ ID NO: 897044 - RNA, 19 nt, Homo sapiens
ggacgagacgggcaagaac

SEQ ID NO: 897045 - RNA, 19 nt, Homo sapiens
guccagcuccggccaaaug

SEQ ID NO: 897046 - RNA, 19 nt, Homo sapiens
gagaugcggcaguggaauc

SEQ ID NO: 897047 - RNA, 19 nt, Homo sapiens
ucaggaacguacggguaaa

SEQ ID NO: 897048 - RNA, 19 nt, Homo sapiens
ggucggcucgugcucauca

SEQ ID NO: 897049 - RNA, 19 nt, Homo sapiens
gggagaugcggcaguggaa

SEQ ID NO: 897050 - RNA, 19 nt, Homo sapiens
ggagcugugugaggagauc

SEQ ID NO: 897051 - RNA, 19 nt, Homo sapiens
ccaacucaccagcaucaug

SEQ ID NO: 897052 - RNA, 19 nt, Homo sapiens
ugccuuaccacuacuuuga

SEQ ID NO: 897053 - RNA, 19 nt, Homo sapiens
ucacugagaaggcggucuu

SEQ ID NO: 897054 - RNA, 19 nt, Homo sapiens
gcuagaugagugucagaug

SEQ ID NO: 897055 - RNA, 19 nt, Homo sapiens
ccuuaccacuacuuugaga

SEQ ID NO: 897056 - RNA, 19 nt, Homo sapiens
ugaguaauucauggcauuu

SEQ ID NO: 897057 - RNA, 19 nt, Homo sapiens
gaguaauucauggcauuug

SEQ ID NO: 897058 - RNA, 19 nt, Homo sapiens
gacagcagccccuagacua

SEQ ID NO: 897059 - RNA, 19 nt, Homo sapiens
caacucaccagcaucauga

SEQ ID NO: 897060 - RNA, 19 nt, Homo sapiens
gaagaggcccaucguguuc

SEQ ID NO: 897061 - RNA, 19 nt, Homo sapiens
gugaggagaucguggucua

SEQ ID NO: 897062 - RNA, 19 nt, Homo sapiens
gagacacgcucuacauggu

SEQ ID NO: 897063 - RNA, 19 nt, Homo sapiens
gcgcaacuauucacacuac

SEQ ID NO: 897064 - RNA, 19 nt, Homo sapiens
ggucuucucugccgucuac

SEQ ID NO: 897065 - RNA, 19 nt, Homo sapiens
cuagaugagugucagaugu

SEQ ID NO: 897066 - RNA, 19 nt, Homo sapiens
ggacagcgacagcaugaag

SEQ ID NO: 897067 - RNA, 19 nt, Homo sapiens
caacuauucacacuacuuc

SEQ ID NO: 897068 - RNA, 19 nt, Homo sapiens
uagaugagugucagaugua

SEQ ID NO: 897069 - RNA, 19 nt, Homo sapiens
gcaacuauucacacuacuu

SEQ ID NO: 897070 - RNA, 19 nt, Homo sapiens
cugaguaauucauggcauu

SEQ ID NO: 897071 - RNA, 19 nt, Homo sapiens
agaagaggcccaucguguu

SEQ ID NO: 897072 - RNA, 19 nt, Homo sapiens
ucaccagcaucaugaccuu

SEQ ID NO: 897073 - RNA, 19 nt, Homo sapiens
gaggagaucguggucuaug

SEQ ID NO: 897074 - RNA, 19 nt, Homo sapiens
ggacgagacgggcaagaac

SEQ ID NO: 897075 - RNA, 19 nt, Homo sapiens
guccagcuccggccaaaug

SEQ ID NO: 897076 - RNA, 19 nt, Homo sapiens
gagaugcggcaguggaauc

SEQ ID NO: 897077 - RNA, 19 nt, Homo sapiens
ucaggaacguacggguaaa

SEQ ID NO: 897078 - RNA, 19 nt, Homo sapiens
ggucggcucgugcucauca

SEQ ID NO: 897079 - RNA, 19 nt, Homo sapiens
gggagaugcggcaguggaa

SEQ ID NO: 897080 - RNA, 19 nt, Homo sapiens
ggagcugugugaggagauc

SEQ ID NO: 897081 - RNA, 19 nt, Homo sapiens
ccaacucaccagcaucaug

SEQ ID NO: 897082 - RNA, 19 nt, Homo sapiens
ugccuuaccacuacuuuga

SEQ ID NO: 897083 - RNA, 19 nt, Homo sapiens
ucacugagaaggcggucuu

SEQ ID NO: 897084 - RNA, 19 nt, Homo sapiens
gcuagaugagugucagaug

SEQ ID NO: 897085 - RNA, 19 nt, Homo sapiens
ccuuaccacuacuuugaga

SEQ ID NO: 897086 - RNA, 19 nt, Homo sapiens
ugaguaauucauggcauuu

SEQ ID NO: 897087 - RNA, 19 nt, Homo sapiens
gaguaauucauggcauuug

SEQ ID NO: 897088 - RNA, 19 nt, Homo sapiens
gacagcagccccuagacua

SEQ ID NO: 897089 - RNA, 19 nt, Homo sapiens
caacucaccagcaucauga

SEQ ID NO: 897090 - RNA, 19 nt, Homo sapiens
gaagaggcccaucguguuc

SEQ ID NO: 897091 - RNA, 19 nt, Homo sapiens
gugaggagaucguggucua

SEQ ID NO: 897092 - RNA, 19 nt, Homo sapiens
gagacacgcucuacauggu

SEQ ID NO: 897093 - RNA, 19 nt, Homo sapiens
gcgcaacuauucacacuac

SEQ ID NO: 897094 - RNA, 19 nt, Homo sapiens
ggucuucucugccgucuac

SEQ ID NO: 897095 - RNA, 19 nt, Homo sapiens
cuagaugagugucagaugu

SEQ ID NO: 897096 - RNA, 19 nt, Homo sapiens
caacuauucacacuacuuc

SEQ ID NO: 897097 - RNA, 19 nt, Homo sapiens
uagaugagugucagaugua

SEQ ID NO: 897098 - RNA, 19 nt, Homo sapiens
gcaacuauucacacuacuu

SEQ ID NO: 897099 - RNA, 19 nt, Homo sapiens
cugaguaauucauggcauu

SEQ ID NO: 897100 - RNA, 19 nt, Homo sapiens
agaagaggcccaucguguu

SEQ ID NO: 897101 - RNA, 19 nt, Homo sapiens
ucaccagcaucaugaccuu

SEQ ID NO: 897102 - RNA, 19 nt, Homo sapiens
gaggagaucguggucuaug

SEQ ID NO: 897103 - RNA, 19 nt, Homo sapiens
ggacgagacgggcaagaac

SEQ ID NO: 897104 - RNA, 19 nt, Homo sapiens
guccagcuccggccaaaug

SEQ ID NO: 897105 - RNA, 19 nt, Homo sapiens
gagaugcggcaguggaauc

SEQ ID NO: 897106 - RNA, 19 nt, Homo sapiens
ucaggaacguacggguaaa

SEQ ID NO: 897107 - RNA, 19 nt, Homo sapiens
ggucggcucgugcucauca

SEQ ID NO: 897108 - RNA, 19 nt, Homo sapiens
gggagaugcggcaguggaa

SEQ ID NO: 897109 - RNA, 19 nt, Homo sapiens
ggagcugugugaggagauc

SEQ ID NO: 897110 - RNA, 19 nt, Homo sapiens
ccaacucaccagcaucaug

SEQ ID NO: 897111 - RNA, 19 nt, Homo sapiens
ugccuuaccacuacuuuga

SEQ ID NO: 897112 - RNA, 19 nt, Homo sapiens
ucacugagaaggcggucuu

SEQ ID NO: 897113 - RNA, 19 nt, Homo sapiens
gcuagaugagugucagaug

SEQ ID NO: 897114 - RNA, 19 nt, Homo sapiens
ccuuaccacuacuuugaga

SEQ ID NO: 897115 - RNA, 19 nt, Homo sapiens
ugaguaauucauggcauuu

SEQ ID NO: 897116 - RNA, 19 nt, Homo sapiens
gaguaauucauggcauuug

SEQ ID NO: 897117 - RNA, 19 nt, Homo sapiens
ggacauuccacaaccauuu

SEQ ID NO: 897118 - RNA, 19 nt, Homo sapiens
gcagagaccuacuucaacu

SEQ ID NO: 897119 - RNA, 19 nt, Homo sapiens
ggacgauacuggccuuugu

SEQ ID NO: 897120 - RNA, 19 nt, Homo sapiens
gcaccgagaucaagauguc

SEQ ID NO: 897121 - RNA, 19 nt, Homo sapiens
ggucaauguucuaaagaug

SEQ ID NO: 897122 - RNA, 19 nt, Homo sapiens
gaacaacaucggacacauc

SEQ ID NO: 897123 - RNA, 19 nt, Homo sapiens
gaauaugugaugcccauga

SEQ ID NO: 897124 - RNA, 19 nt, Homo sapiens
gggcguugcuucaccauag

SEQ ID NO: 897125 - RNA, 19 nt, Homo sapiens
ggaggagggugugauugug

SEQ ID NO: 897126 - RNA, 19 nt, Homo sapiens
cagaaugugucacugucuu

SEQ ID NO: 897127 - RNA, 19 nt, Homo sapiens
gagaagggacauuccacaa

SEQ ID NO: 897128 - RNA, 19 nt, Homo sapiens
agaccuacuucaacuacaa

SEQ ID NO: 897129 - RNA, 19 nt, Homo sapiens
gauacuggccuuugucucu

SEQ ID NO: 897130 - RNA, 19 nt, Homo sapiens
ucucuggcaucuucuuuau

SEQ ID NO: 897131 - RNA, 19 nt, Homo sapiens
ggaccacccacucuacuuc

SEQ ID NO: 897132 - RNA, 19 nt, Homo sapiens
ccaaggaugcagagaccua

SEQ ID NO: 897133 - RNA, 19 nt, Homo sapiens
caagaugucccugcacuca

SEQ ID NO: 897134 - RNA, 19 nt, Homo sapiens
gccgccaucuccuuccuuu

SEQ ID NO: 897135 - RNA, 19 nt, Homo sapiens
aauaugugaugcccaugaa

SEQ ID NO: 897136 - RNA, 19 nt, Homo sapiens
gcuugggccuccuggguau

SEQ ID NO: 897137 - RNA, 19 nt, Homo sapiens
agaaugugucacugucuua

SEQ ID NO: 897138 - RNA, 19 nt, Homo sapiens
aaguauggguggucguuug

SEQ ID NO: 897139 - RNA, 19 nt, Homo sapiens
caucuucuuuauccucuca

SEQ ID NO: 897140 - RNA, 19 nt, Homo sapiens
ggguuuauccugaacaaca

SEQ ID NO: 897141 - RNA, 19 nt, Homo sapiens
ucauuggguuuauccugaa

SEQ ID NO: 897142 - RNA, 19 nt, Homo sapiens
gucagccucuucuucaugu

SEQ ID NO: 897143 - RNA, 19 nt, Homo sapiens
ggucagccucuucuucaug

SEQ ID NO: 897144 - RNA, 19 nt, Homo sapiens
gguuuauccugaacaacau

SEQ ID NO: 897145 - RNA, 19 nt, Homo sapiens
gucaauguucuaaagauga

SEQ ID NO: 897146 - RNA, 19 nt, Homo sapiens
gagaccuacuucaacuaca

SEQ ID NO: 897147 - RNA, 19 nt, Homo sapiens
gagcaccgagaucaagaug

SEQ ID NO: 897148 - RNA, 19 nt, Homo sapiens
gaaccagagcaccgagauc

SEQ ID NO: 897149 - RNA, 19 nt, Homo sapiens
cacggucaauguucuaaag

SEQ ID NO: 897150 - RNA, 19 nt, Homo sapiens
gugucacugucuuaccuuu

SEQ ID NO: 897151 - RNA, 19 nt, Homo sapiens
cccauccucugcugucuuc

SEQ ID NO: 897152 - RNA, 19 nt, Homo sapiens
gucacugucuuaccuuucu

SEQ ID NO: 897153 - RNA, 19 nt, Homo sapiens
ggcguugcuucaccauaga

SEQ ID NO: 897154 - RNA, 19 nt, Homo sapiens
cagagaccuacuucaacua

SEQ ID NO: 897155 - RNA, 19 nt, Homo sapiens
ggaugcagagaccuacuuc

SEQ ID NO: 897156 - RNA, 19 nt, Homo sapiens
caacaggaccaaggaugca

SEQ ID NO: 897157 - RNA, 19 nt, Homo sapiens
cggucaauguucuaaagau

SEQ ID NO: 897158 - RNA, 19 nt, Homo sapiens
cgccaucuccuuccuuuua

SEQ ID NO: 897159 - RNA, 19 nt, Homo sapiens
ugaacaacaucggacacau

SEQ ID NO: 897160 - RNA, 19 nt, Homo sapiens
cuuugucucuggcaucuuc

SEQ ID NO: 897161 - RNA, 19 nt, Homo sapiens
ccgcucagccacaccauuc

SEQ ID NO: 897162 - RNA, 19 nt, Homo sapiens
uugcuucaccauagaauau

SEQ ID NO: 897163 - RNA, 19 nt, Homo sapiens
gcagagaccuacuucaacu

SEQ ID NO: 897164 - RNA, 19 nt, Homo sapiens
ggacgauacuggccuuugu

SEQ ID NO: 897165 - RNA, 19 nt, Homo sapiens
gcaccgagaucaagauguc

SEQ ID NO: 897166 - RNA, 19 nt, Homo sapiens
caacugcuccgauuacuca

SEQ ID NO: 897167 - RNA, 19 nt, Homo sapiens
ggucaauguucuaaagaug

SEQ ID NO: 897168 - RNA, 19 nt, Homo sapiens
gaacaacaucggacacauc

SEQ ID NO: 897169 - RNA, 19 nt, Homo sapiens
gaauaugugaugcccauga

SEQ ID NO: 897170 - RNA, 19 nt, Homo sapiens
gggcguugcuucaccauag

SEQ ID NO: 897171 - RNA, 19 nt, Homo sapiens
gaucagauguccucuucac

SEQ ID NO: 897172 - RNA, 19 nt, Homo sapiens
ggaggagggugugauugug

SEQ ID NO: 897173 - RNA, 19 nt, Homo sapiens
agaccuacuucaacuacaa

SEQ ID NO: 897174 - RNA, 19 nt, Homo sapiens
gauacuggccuuugucucu

SEQ ID NO: 897175 - RNA, 19 nt, Homo sapiens
ucucuggcaucuucuuuau

SEQ ID NO: 897176 - RNA, 19 nt, Homo sapiens
ccaaggaugcagagaccua

SEQ ID NO: 897177 - RNA, 19 nt, Homo sapiens
caagaugucccugcacuca

SEQ ID NO: 897178 - RNA, 19 nt, Homo sapiens
gccgccaucuccuuccuuu

SEQ ID NO: 897179 - RNA, 19 nt, Homo sapiens
cuguguaccuguuuaugaa

SEQ ID NO: 897180 - RNA, 19 nt, Homo sapiens
aauaugugaugcccaugaa

SEQ ID NO: 897181 - RNA, 19 nt, Homo sapiens
gcuugggccuccuggguau

SEQ ID NO: 897182 - RNA, 19 nt, Homo sapiens
gcagaugaacagcaacuac

SEQ ID NO: 897183 - RNA, 19 nt, Homo sapiens
aaguauggguggucguuug

SEQ ID NO: 897184 - RNA, 19 nt, Homo sapiens
caucuucuuuauccucuca

SEQ ID NO: 897185 - RNA, 19 nt, Homo sapiens
ggguuuauccugaacaaca

SEQ ID NO: 897186 - RNA, 19 nt, Homo sapiens
ucauuggguuuauccugaa

SEQ ID NO: 897187 - RNA, 19 nt, Homo sapiens
gucagccucuucuucaugu

SEQ ID NO: 897188 - RNA, 19 nt, Homo sapiens
ggucagccucuucuucaug

SEQ ID NO: 897189 - RNA, 19 nt, Homo sapiens
gguuuauccugaacaacau

SEQ ID NO: 897190 - RNA, 19 nt, Homo sapiens
gucaauguucuaaagauga

SEQ ID NO: 897191 - RNA, 19 nt, Homo sapiens
guacaccgcggaggacaug

SEQ ID NO: 897192 - RNA, 19 nt, Homo sapiens
gagaccuacuucaacuaca

SEQ ID NO: 897193 - RNA, 19 nt, Homo sapiens
gagcaccgagaucaagaug

SEQ ID NO: 897194 - RNA, 19 nt, Homo sapiens
ugaugucuguguaccuguu

SEQ ID NO: 897195 - RNA, 19 nt, Homo sapiens
cacggucaauguucuaaag

SEQ ID NO: 897196 - RNA, 19 nt, Homo sapiens
gaaccagagcaccgagauc

SEQ ID NO: 897197 - RNA, 19 nt, Homo sapiens
augaucagauguccucuuc

SEQ ID NO: 897198 - RNA, 19 nt, Homo sapiens
ucuguguaccuguuuauga

SEQ ID NO: 897199 - RNA, 19 nt, Homo sapiens
ggcguugcuucaccauaga

SEQ ID NO: 897200 - RNA, 19 nt, Homo sapiens
ucaagugccccgacuauga

SEQ ID NO: 897201 - RNA, 19 nt, Homo sapiens
cagagaccuacuucaacua

SEQ ID NO: 897202 - RNA, 19 nt, Homo sapiens
ggaugcagagaccuacuuc

SEQ ID NO: 897203 - RNA, 19 nt, Homo sapiens
caacaggaccaaggaugca

SEQ ID NO: 897204 - RNA, 19 nt, Homo sapiens
cggucaauguucuaaagau

SEQ ID NO: 897205 - RNA, 19 nt, Homo sapiens
cgccaucuccuuccuuuua

SEQ ID NO: 897206 - RNA, 19 nt, Homo sapiens
ugaacaacaucggacacau

SEQ ID NO: 897207 - RNA, 19 nt, Homo sapiens
aggccucccugcagaugaa

SEQ ID NO: 897208 - RNA, 19 nt, Homo sapiens
gaugucuguguaccuguuu

SEQ ID NO: 897209 - RNA, 19 nt, Homo sapiens
cuuugucucuggcaucuuc

SEQ ID NO: 897210 - RNA, 19 nt, Homo sapiens
ccgcucagccacaccauuc

SEQ ID NO: 897211 - RNA, 19 nt, Homo sapiens
uugcuucaccauagaauau

SEQ ID NO: 897212 - RNA, 19 nt, Homo sapiens
ggaagugguuucuguguuu

SEQ ID NO: 897213 - RNA, 19 nt, Homo sapiens
caacuuaccuucauuucuu

SEQ ID NO: 897214 - RNA, 19 nt, Homo sapiens
aaacgaaucuugccagaaa

SEQ ID NO: 897215 - RNA, 19 nt, Homo sapiens
gaagaacucuccagaacau

SEQ ID NO: 897216 - RNA, 19 nt, Homo sapiens
ggagaaagcuguguuccaa

SEQ ID NO: 897217 - RNA, 19 nt, Homo sapiens
ggugaacaguggccaauaa

SEQ ID NO: 897218 - RNA, 19 nt, Homo sapiens
aaucauaacuuccugcaaa

SEQ ID NO: 897219 - RNA, 19 nt, Homo sapiens
gaacaaacauccauuuccu

SEQ ID NO: 897220 - RNA, 19 nt, Homo sapiens
gcaccaaccugaccaugga

SEQ ID NO: 897221 - RNA, 19 nt, Homo sapiens
gaagaagaacucuccagaa

SEQ ID NO: 897222 - RNA, 19 nt, Homo sapiens
acaaugaacuaaagccaaa

SEQ ID NO: 897223 - RNA, 19 nt, Homo sapiens
ggagcucugucuuucauug

SEQ ID NO: 897224 - RNA, 19 nt, Homo sapiens
caaugaauccuaccucuug

SEQ ID NO: 897225 - RNA, 19 nt, Homo sapiens
gcagccaacuggugcuuug

SEQ ID NO: 897226 - RNA, 19 nt, Homo sapiens
gccauuaucuccucuugga

SEQ ID NO: 897227 - RNA, 19 nt, Homo sapiens
gagagcaacuuaccuucau

SEQ ID NO: 897228 - RNA, 19 nt, Homo sapiens
gcugaaggcugacuuuguc

SEQ ID NO: 897229 - RNA, 19 nt, Homo sapiens
ucaagacgacgaacaauga

SEQ ID NO: 897230 - RNA, 19 nt, Homo sapiens
gguaucaucgucuacauuu

SEQ ID NO: 897231 - RNA, 19 nt, Homo sapiens
caagaaagaguaggaagaa

SEQ ID NO: 897232 - RNA, 19 nt, Homo sapiens
aaacauccauuuccuaggu

SEQ ID NO: 897233 - RNA, 19 nt, Homo sapiens
agaaagcuguguuccaaug

SEQ ID NO: 897234 - RNA, 19 nt, Homo sapiens
cguccuggcuguaaacauu

SEQ ID NO: 897235 - RNA, 19 nt, Homo sapiens
ucaguaacaucaucgguau

SEQ ID NO: 897236 - RNA, 19 nt, Homo sapiens
gaacuuaacccucuuuugu

SEQ ID NO: 897237 - RNA, 19 nt, Homo sapiens
gacgaacaaugaacuaaag

SEQ ID NO: 897238 - RNA, 19 nt, Homo sapiens
gagcaacuuaccuucauuu

SEQ ID NO: 897239 - RNA, 19 nt, Homo sapiens
ccugguagcuguugugcuu

SEQ ID NO: 897240 - RNA, 19 nt, Homo sapiens
ggagaucucagcacuuugu

SEQ ID NO: 897241 - RNA, 19 nt, Homo sapiens
aaagaaccauuacaacuac

SEQ ID NO: 897242 - RNA, 19 nt, Homo sapiens
gcaucgaagggaucuauaa

SEQ ID NO: 897243 - RNA, 19 nt, Homo sapiens
gggcacugcuuccggauca

SEQ ID NO: 897244 - RNA, 19 nt, Homo sapiens
gaacaacaucguccucagu

SEQ ID NO: 897245 - RNA, 19 nt, Homo sapiens
aagaagaacucuccagaac

SEQ ID NO: 897246 - RNA, 19 nt, Homo sapiens
gcaagaaagggagaccuaa

SEQ ID NO: 897247 - RNA, 19 nt, Homo sapiens
gaaagcuguguuccaauga

SEQ ID NO: 897248 - RNA, 19 nt, Homo sapiens
guugcuggcuauccucuuu

SEQ ID NO: 897249 - RNA, 19 nt, Homo sapiens
gaagcugaaggcugacuuu

SEQ ID NO: 897250 - RNA, 19 nt, Homo sapiens
gagccauuaucuccucuug

SEQ ID NO: 897251 - RNA, 19 nt, Homo sapiens
gagaacaaacauccauuuc

SEQ ID NO: 897252 - RNA, 19 nt, Homo sapiens
caucaggguuggcaucauc

SEQ ID NO: 897253 - RNA, 19 nt, Homo sapiens
ggagagcaacuuaccuuca

SEQ ID NO: 897254 - RNA, 19 nt, Homo sapiens
cgacgaacaaugaacuaaa

SEQ ID NO: 897255 - RNA, 19 nt, Homo sapiens
aaacgggaauuccuuaagg

SEQ ID NO: 897256 - RNA, 19 nt, Homo sapiens
ggaccaagaaagaguagga

SEQ ID NO: 897257 - RNA, 19 nt, Homo sapiens
caucguccaucccaucuuc

SEQ ID NO: 897258 - RNA, 19 nt, Homo sapiens
ccuaggugguuacaaauca

SEQ ID NO: 897259 - RNA, 19 nt, Homo sapiens
ccaagaaagaguaggaaga

SEQ ID NO: 897260 - RNA, 19 nt, Homo sapiens
gagcugggcuucucuuccu

SEQ ID NO: 897261 - RNA, 19 nt, Homo sapiens
uuuccuaggugguuacaaa

SEQ ID NO: 897262 - RNA, 19 nt, Homo sapiens
caacuggcauuuggcaaca

SEQ ID NO: 897263 - RNA, 19 nt, Homo sapiens
gaaacgaaucuugccagaa

SEQ ID NO: 897264 - RNA, 19 nt, Homo sapiens
agacaaaauugagccauua

SEQ ID NO: 897265 - RNA, 19 nt, Homo sapiens
ucgaagggaucuauaaagg

SEQ ID NO: 897266 - RNA, 19 nt, Homo sapiens
caucgaagggaucuauaaa

SEQ ID NO: 897267 - RNA, 19 nt, Homo sapiens
ggggagaucucagcacuuu

SEQ ID NO: 897268 - RNA, 19 nt, Homo sapiens
ggaguggagugaguuugga

SEQ ID NO: 897269 - RNA, 19 nt, Homo sapiens
caacuccugucauuguaag

SEQ ID NO: 897270 - RNA, 19 nt, Homo sapiens
gauggcaugugauccucaa

SEQ ID NO: 897271 - RNA, 19 nt, Homo sapiens
caagcgggacgaagacaaa

SEQ ID NO: 897272 - RNA, 19 nt, Homo sapiens
gguugguuguucugucuuu

SEQ ID NO: 897273 - RNA, 19 nt, Homo sapiens
aaagcuguguuccaaugaa

SEQ ID NO: 897274 - RNA, 19 nt, Homo sapiens
gugcaggcuuggaagaaga

SEQ ID NO: 897275 - RNA, 19 nt, Homo sapiens
guccggagcugaggaagug

SEQ ID NO: 897276 - RNA, 19 nt, Homo sapiens
gcuguugugcuuggaaaua

SEQ ID NO: 897277 - RNA, 19 nt, Homo sapiens
gacggucucugggcucuug

SEQ ID NO: 897278 - RNA, 19 nt, Homo sapiens
agagaacaaacauccauuu

SEQ ID NO: 897279 - RNA, 19 nt, Homo sapiens
ggaggaggcccagguaaag

SEQ ID NO: 897280 - RNA, 19 nt, Homo sapiens
uaacaucaucgguaucauc

SEQ ID NO: 897281 - RNA, 19 nt, Homo sapiens
cuccugucauuguaaguua

SEQ ID NO: 897282 - RNA, 19 nt, Homo sapiens
cauaacuuccugcaaauca

SEQ ID NO: 897283 - RNA, 19 nt, Homo sapiens
cauuaucuccucuuggaaa

SEQ ID NO: 897284 - RNA, 19 nt, Homo sapiens
ccaaacgggaauuccuuaa

SEQ ID NO: 897285 - RNA, 19 nt, Homo sapiens
gaccaaacgggaauuccuu

SEQ ID NO: 897286 - RNA, 19 nt, Homo sapiens
cugaggaagugguuucugu

SEQ ID NO: 897287 - RNA, 19 nt, Homo sapiens
ggacggaguggagugaguu

SEQ ID NO: 897288 - RNA, 19 nt, Homo sapiens
gcaacuuaccuucauuucu

SEQ ID NO: 897289 - RNA, 19 nt, Homo sapiens
ccaccuagggaccaagaaa

SEQ ID NO: 897290 - RNA, 19 nt, Homo sapiens
gagcugaggaagugguuuc

SEQ ID NO: 897291 - RNA, 19 nt, Homo sapiens
gugaacaguggccaauaaa

SEQ ID NO: 897292 - RNA, 19 nt, Homo sapiens
gcaggccucaguaacauca

SEQ ID NO: 897293 - RNA, 19 nt, Homo sapiens
uagcuguugugcuuggaaa

SEQ ID NO: 897294 - RNA, 19 nt, Homo sapiens
gaggaagugguuucugugu

SEQ ID NO: 897295 - RNA, 19 nt, Homo sapiens
caggagagcaacuuaccuu

SEQ ID NO: 897296 - RNA, 19 nt, Homo sapiens
gacagacaccucccuccaa

SEQ ID NO: 897297 - RNA, 19 nt, Homo sapiens
caagacgacgaacaaugaa

SEQ ID NO: 897298 - RNA, 19 nt, Homo sapiens
uaaggcgucuuccucuucu

SEQ ID NO: 897299 - RNA, 19 nt, Homo sapiens
guccaucccaucuuccuuu

SEQ ID NO: 897300 - RNA, 19 nt, Homo sapiens
gaagugguuucuguguuuu

SEQ ID NO: 897301 - RNA, 19 nt, Homo sapiens
gaucaacuugggaagacaa

SEQ ID NO: 897302 - RNA, 19 nt, Homo sapiens
ggaugccgagcuacaggua

SEQ ID NO: 897303 - RNA, 19 nt, Homo sapiens
gugacaagcgggacgaaga

SEQ ID NO: 897304 - RNA, 19 nt, Homo sapiens
cuguugugcuuggaaauaa

SEQ ID NO: 897305 - RNA, 19 nt, Homo sapiens
uggagugaguuuggauaaa

SEQ ID NO: 897306 - RNA, 19 nt, Homo sapiens
guggagugaguuuggauaa

SEQ ID NO: 897307 - RNA, 19 nt, Homo sapiens
caagaaagggagaccuaag

SEQ ID NO: 897308 - RNA, 19 nt, Homo sapiens
gcugcaggccucaguaaca

SEQ ID NO: 897309 - RNA, 19 nt, Homo sapiens
agagcaacuuaccuucauu

SEQ ID NO: 897310 - RNA, 19 nt, Homo sapiens
cgucuuccucuucuccuua

SEQ ID NO: 897311 - RNA, 19 nt, Homo sapiens
ccaaugaauccuaccucuu

SEQ ID NO: 897312 - RNA, 19 nt, Homo sapiens
gcaaauggccacaguguua

SEQ ID NO: 897313 - RNA, 19 nt, Homo sapiens
uaaaggaagcgaucaauua

SEQ ID NO: 897314 - RNA, 19 nt, Homo sapiens
gaacugaagggauaauaaa

SEQ ID NO: 897315 - RNA, 19 nt, Homo sapiens
gcuagcagcugcaggaauu

SEQ ID NO: 897316 - RNA, 19 nt, Homo sapiens
gacuguagaugaaaucgua

SEQ ID NO: 897317 - RNA, 19 nt, Homo sapiens
gcucgugacuguagaugaa

SEQ ID NO: 897318 - RNA, 19 nt, Homo sapiens
agucaaagcccaaggauuu

SEQ ID NO: 897319 - RNA, 19 nt, Homo sapiens
ggaacugaagggauaauaa

SEQ ID NO: 897320 - RNA, 19 nt, Homo sapiens
ggcagagaaugcaggcuua

SEQ ID NO: 897321 - RNA, 19 nt, Homo sapiens
aggaagcgaucaauuacua

SEQ ID NO: 897322 - RNA, 19 nt, Homo sapiens
ugugggaacugaagggaua

SEQ ID NO: 897323 - RNA, 19 nt, Homo sapiens
ggagaucauuuaccugagu

SEQ ID NO: 897324 - RNA, 19 nt, Homo sapiens
gcugaucuagcucaauuua

SEQ ID NO: 897325 - RNA, 19 nt, Homo sapiens
gcaagugccagaggguuua

SEQ ID NO: 897326 - RNA, 19 nt, Homo sapiens
guaaaggaagcgaucaauu

SEQ ID NO: 897327 - RNA, 19 nt, Homo sapiens
gggaagcucugugggcaaa

SEQ ID NO: 897328 - RNA, 19 nt, Homo sapiens
gaacuagacggcagcuuca

SEQ ID NO: 897329 - RNA, 19 nt, Homo sapiens
ggacaaacccaggcagaga

SEQ ID NO: 897330 - RNA, 19 nt, Homo sapiens
ccaagaagacaaagaaaca

SEQ ID NO: 897331 - RNA, 19 nt, Homo sapiens
gaagcucugugggcaaaug

SEQ ID NO: 897332 - RNA, 19 nt, Homo sapiens
ggauggagaucauuuaccu

SEQ ID NO: 897333 - RNA, 19 nt, Homo sapiens
gaucuagcucaauuuagua

SEQ ID NO: 897334 - RNA, 19 nt, Homo sapiens
ugaucuagcucaauuuagu

SEQ ID NO: 897335 - RNA, 19 nt, Homo sapiens
caagaucccagacugauuc

SEQ ID NO: 897336 - RNA, 19 nt, Homo sapiens
guauuugaaugggaaugua

SEQ ID NO: 897337 - RNA, 19 nt, Homo sapiens
cugcugaucuagcucaauu

SEQ ID NO: 897338 - RNA, 19 nt, Homo sapiens
cugaagggauaauaaaugu

SEQ ID NO: 897339 - RNA, 19 nt, Homo sapiens
uaaaggaagcagauuggaa

SEQ ID NO: 897340 - RNA, 19 nt, Homo sapiens
gcacagccuucgugguucu

SEQ ID NO: 897341 - RNA, 19 nt, Homo sapiens
ggucuuggauggagaucau

SEQ ID NO: 897342 - RNA, 19 nt, Homo sapiens
gaagcgaucaauuacuaga

SEQ ID NO: 897343 - RNA, 19 nt, Homo sapiens
gauaaaggaagcagauugg

SEQ ID NO: 897344 - RNA, 19 nt, Homo sapiens
gcaaguaggccagcuagca

SEQ ID NO: 897345 - RNA, 19 nt, Homo sapiens
caaauggccacaguguuaa

SEQ ID NO: 897346 - RNA, 19 nt, Homo sapiens
ugguuuggcugugguauuu

SEQ ID NO: 897347 - RNA, 19 nt, Homo sapiens
ggaauccugacuccaagaa

SEQ ID NO: 897348 - RNA, 19 nt, Homo sapiens
gacaaacccaggcagagaa

SEQ ID NO: 897349 - RNA, 19 nt, Homo sapiens
gugcagagcaggccgucua

SEQ ID NO: 897350 - RNA, 19 nt, Homo sapiens
ucacacuggcggacaagua

SEQ ID NO: 897351 - RNA, 19 nt, Homo sapiens
aauccugacuccaagaaga

SEQ ID NO: 897352 - RNA, 19 nt, Homo sapiens
ggugggaaccuccuaaugg

SEQ ID NO: 897353 - RNA, 19 nt, Homo sapiens
gcacaccugcccucacugu

SEQ ID NO: 897354 - RNA, 19 nt, Homo sapiens
cggcacagccuucgugguu

SEQ ID NO: 897355 - RNA, 19 nt, Homo sapiens
cagugggccugcauuccua

SEQ ID NO: 897356 - RNA, 19 nt, Homo sapiens
gacggaagccuugcuggaa

SEQ ID NO: 897357 - RNA, 19 nt, Homo sapiens
gggcaaauggccacagugu

SEQ ID NO: 897358 - RNA, 19 nt, Homo sapiens
cugcugggcuaucaaggaa

SEQ ID NO: 897359 - RNA, 19 nt, Homo sapiens
guuuggcugugguauuuga

SEQ ID NO: 897360 - RNA, 19 nt, Homo sapiens
caccuccuguggaaacaaa

SEQ ID NO: 897361 - RNA, 19 nt, Homo sapiens
uaaugggugugggaacuga

SEQ ID NO: 897362 - RNA, 19 nt, Homo sapiens
ugauaaaggaagcagauug

SEQ ID NO: 897363 - RNA, 19 nt, Homo sapiens
ggacacccuaauagucaaa

SEQ ID NO: 897364 - RNA, 19 nt, Homo sapiens
gggaacugaagggauaaua

SEQ ID NO: 897365 - RNA, 19 nt, Homo sapiens
gcagcugcaggaauuaaug

SEQ ID NO: 897366 - RNA, 19 nt, Homo sapiens
gaccaugaaaggagaaaca

SEQ ID NO: 897367 - RNA, 19 nt, Homo sapiens
gggacacccuaauagucaa

SEQ ID NO: 897368 - RNA, 19 nt, Homo sapiens
ggccugcauuccuagcauu

SEQ ID NO: 897369 - RNA, 19 nt, Homo sapiens
agcgaucaauuacuagaaa

SEQ ID NO: 897370 - RNA, 19 nt, Homo sapiens
aaaggaagcgaucaauuac

SEQ ID NO: 897371 - RNA, 19 nt, Homo sapiens
ccacacaucaggagaucug

SEQ ID NO: 897372 - RNA, 19 nt, Homo sapiens
caagaaaagucccacacau

SEQ ID NO: 897373 - RNA, 19 nt, Homo sapiens
ccugggcccuccauucugu

SEQ ID NO: 897374 - RNA, 19 nt, Homo sapiens
gaaaucguaguggccaaga

SEQ ID NO: 897375 - RNA, 19 nt, Homo sapiens
uggcugagguggugcuaca

SEQ ID NO: 897376 - RNA, 19 nt, Homo sapiens
cagacgugauggcagaaau

SEQ ID NO: 897377 - RNA, 19 nt, Homo sapiens
ccugggcccugaaguaucu

SEQ ID NO: 897378 - RNA, 19 nt, Homo sapiens
ucaagaucccagacugauu

SEQ ID NO: 897379 - RNA, 19 nt, Homo sapiens
ugaugccuauuuccagcua

SEQ ID NO: 897380 - RNA, 19 nt, Homo sapiens
ggagcugggagaugguuug

SEQ ID NO: 897381 - RNA, 19 nt, Homo sapiens
ggcccuccauucugugaug

SEQ ID NO: 897382 - RNA, 19 nt, Homo sapiens
aaucguaguggccaagaaa

SEQ ID NO: 897383 - RNA, 19 nt, Homo sapiens
gacgugauggcagaaauga

SEQ ID NO: 897384 - RNA, 19 nt, Homo sapiens
caggguggcucucuuugcu

SEQ ID NO: 897385 - RNA, 19 nt, Homo sapiens
gguccugcccauccaaaug

SEQ ID NO: 897386 - RNA, 19 nt, Homo sapiens
uaauguggcagugguguug

SEQ ID NO: 897387 - RNA, 19 nt, Homo sapiens
aaacccaggcagagaauag

SEQ ID NO: 897388 - RNA, 19 nt, Homo sapiens
gcugggcuaucaaggaacu

SEQ ID NO: 897389 - RNA, 19 nt, Homo sapiens
cggaagccuugcuggaaca

SEQ ID NO: 897390 - RNA, 19 nt, Homo sapiens
ggaagcgaucaauuacuag

SEQ ID NO: 897391 - RNA, 19 nt, Homo sapiens
ugggacacccuaauaguca

SEQ ID NO: 897392 - RNA, 19 nt, Homo sapiens
ccauggaccacuugaccaa

SEQ ID NO: 897393 - RNA, 19 nt, Homo sapiens
cuucaagccugagcguguu

SEQ ID NO: 897394 - RNA, 19 nt, Homo sapiens
aaaucguaguggccaagaa

SEQ ID NO: 897395 - RNA, 19 nt, Homo sapiens
acugaagggauaauaaaug

SEQ ID NO: 897396 - RNA, 19 nt, Homo sapiens
cuaaaacuuuggcagagaa

SEQ ID NO: 897397 - RNA, 19 nt, Homo sapiens
uggcugugguauuugaaug

SEQ ID NO: 897398 - RNA, 19 nt, Homo sapiens
cgugauggcagaaaugagu

SEQ ID NO: 897399 - RNA, 19 nt, Homo sapiens
gggccugcauuccuagcau

SEQ ID NO: 897400 - RNA, 19 nt, Homo sapiens
caaacccaggcagagaaua

SEQ ID NO: 897401 - RNA, 19 nt, Homo sapiens
uagcagcugcaggaauuaa

SEQ ID NO: 897402 - RNA, 19 nt, Homo sapiens
gcgaucaauuacuagaaaa

SEQ ID NO: 897403 - RNA, 19 nt, Homo sapiens
agaaagcucuccuacauua

SEQ ID NO: 897404 - RNA, 19 nt, Homo sapiens
gaauguaucucauccuuug

SEQ ID NO: 897405 - RNA, 19 nt, Homo sapiens
ugaagaggcuguccagaua

SEQ ID NO: 897406 - RNA, 19 nt, Homo sapiens
caacagugcucuggacaua

SEQ ID NO: 897407 - RNA, 19 nt, Homo sapiens
ucagaaagcucuccuacau

SEQ ID NO: 897408 - RNA, 19 nt, Homo sapiens
gaacugggauuucauuuug

SEQ ID NO: 897409 - RNA, 19 nt, Homo sapiens
acacaucacuuuagcuuau

SEQ ID NO: 897410 - RNA, 19 nt, Homo sapiens
aaacagaucucuacagacu

SEQ ID NO: 897411 - RNA, 19 nt, Homo sapiens
gcacugccauccacacaga

SEQ ID NO: 897412 - RNA, 19 nt, Homo sapiens
uuaaacagaucucuacaga

SEQ ID NO: 897413 - RNA, 19 nt, Homo sapiens
caaaggagaauguaaacaa

SEQ ID NO: 897414 - RNA, 19 nt, Homo sapiens
gaaaugaagggacacuuau

SEQ ID NO: 897415 - RNA, 19 nt, Homo sapiens
caacugaggaccuaauuau

SEQ ID NO: 897416 - RNA, 19 nt, Homo sapiens
gagcagagaaaucuuaaga

SEQ ID NO: 897417 - RNA, 19 nt, Homo sapiens
uuaagacgguggccaaauu

SEQ ID NO: 897418 - RNA, 19 nt, Homo sapiens
ccugaaagauaacaaaguu

SEQ ID NO: 897419 - RNA, 19 nt, Homo sapiens
cauacaacauucucuaguu

SEQ ID NO: 897420 - RNA, 19 nt, Homo sapiens
caacaccuguccuuacugu

SEQ ID NO: 897421 - RNA, 19 nt, Homo sapiens
gcaacugaggaccuaauua

SEQ ID NO: 897422 - RNA, 19 nt, Homo sapiens
gagaugagguagguggaaa

SEQ ID NO: 897423 - RNA, 19 nt, Homo sapiens
gaagaggcuguccagauaa

SEQ ID NO: 897424 - RNA, 19 nt, Homo sapiens
caaaggaagagcagagaaa

SEQ ID NO: 897425 - RNA, 19 nt, Homo sapiens
acagugcucuggacauaaa

SEQ ID NO: 897426 - RNA, 19 nt, Homo sapiens
ggagagaggagagaagaaa

SEQ ID NO: 897427 - RNA, 19 nt, Homo sapiens
agaaaugaagggacacuua

SEQ ID NO: 897428 - RNA, 19 nt, Homo sapiens
ggaagaagagagagacaga

SEQ ID NO: 897429 - RNA, 19 nt, Homo sapiens
acagaucucuacagacuug

SEQ ID NO: 897430 - RNA, 19 nt, Homo sapiens
uaagacgguggccaaauua

SEQ ID NO: 897431 - RNA, 19 nt, Homo sapiens
gcacuguagucagagauga

SEQ ID NO: 897432 - RNA, 19 nt, Homo sapiens
caacauuucuuaggcuugu

SEQ ID NO: 897433 - RNA, 19 nt, Homo sapiens
gcaaagaagccaugacaac

SEQ ID NO: 897434 - RNA, 19 nt, Homo sapiens
gagacagacuacagugaug

SEQ ID NO: 897435 - RNA, 19 nt, Homo sapiens
gaaauucuggugguggaua

SEQ ID NO: 897436 - RNA, 19 nt, Homo sapiens
gagcaaagaagccaugaca

SEQ ID NO: 897437 - RNA, 19 nt, Homo sapiens
gaagagagagacagacuac

SEQ ID NO: 897438 - RNA, 19 nt, Homo sapiens
ugagguagguggaaaagua

SEQ ID NO: 897439 - RNA, 19 nt, Homo sapiens
gcuagguggugcccugauu

SEQ ID NO: 897440 - RNA, 19 nt, Homo sapiens
ccaccaagauagaaaugau

SEQ ID NO: 897441 - RNA, 19 nt, Homo sapiens
aaagcucuccuacauuaua

SEQ ID NO: 897442 - RNA, 19 nt, Homo sapiens
caugaggcaacauuucuua

SEQ ID NO: 897443 - RNA, 19 nt, Homo sapiens
ggagggacgugcaauaucc

SEQ ID NO: 897444 - RNA, 19 nt, Homo sapiens
gagaggagagaagaaauga

SEQ ID NO: 897445 - RNA, 19 nt, Homo sapiens
gaggagagaagaaaugaag

SEQ ID NO: 897446 - RNA, 19 nt, Homo sapiens
gcuguuaauuccaaaugug

SEQ ID NO: 897447 - RNA, 19 nt, Homo sapiens
uaacacaacaccuguccuu

SEQ ID NO: 897448 - RNA, 19 nt, Homo sapiens
uccaacaggugaauaugaa

SEQ ID NO: 897449 - RNA, 19 nt, Homo sapiens
gcaaaggaagagcagagaa

SEQ ID NO: 897450 - RNA, 19 nt, Homo sapiens
ggacgcuguuaauuccaaa

SEQ ID NO: 897451 - RNA, 19 nt, Homo sapiens
ggaaaaguaccuuauauag

SEQ ID NO: 897452 - RNA, 19 nt, Homo sapiens
ccuaagugccaccaagaua

SEQ ID NO: 897453 - RNA, 19 nt, Homo sapiens
aagaggcuguccagauaaa

SEQ ID NO: 897454 - RNA, 19 nt, Homo sapiens
gauggagacccacuagaug

SEQ ID NO: 897455 - RNA, 19 nt, Homo sapiens
ccagagaggaggagaagga

SEQ ID NO: 897456 - RNA, 19 nt, Homo sapiens
ggacacuuaugcagaacca

SEQ ID NO: 897457 - RNA, 19 nt, Homo sapiens
aauuaugccugucugcaaa

SEQ ID NO: 897458 - RNA, 19 nt, Homo sapiens
uucaaacugugcauuauga

SEQ ID NO: 897459 - RNA, 19 nt, Homo sapiens
aagcucuccuacauuauaa

SEQ ID NO: 897460 - RNA, 19 nt, Homo sapiens
gagagacagacuacaguga

SEQ ID NO: 897461 - RNA, 19 nt, Homo sapiens
gaauaagucaaacccuguu

SEQ ID NO: 897462 - RNA, 19 nt, Homo sapiens
aagggacacuuaugcagaa

SEQ ID NO: 897463 - RNA, 19 nt, Homo sapiens
auauagcacuguagucaga

SEQ ID NO: 897464 - RNA, 19 nt, Homo sapiens
ggaacaaccauucuaaagc

SEQ ID NO: 897465 - RNA, 19 nt, Homo sapiens
caacauucucuaguuauug

SEQ ID NO: 897466 - RNA, 19 nt, Homo sapiens
aaagaagccaugacaacuu

SEQ ID NO: 897467 - RNA, 19 nt, Homo sapiens
gcucagcauucagagagaa

SEQ ID NO: 897468 - RNA, 19 nt, Homo sapiens
gcucggaacaaccauucua

SEQ ID NO: 897469 - RNA, 19 nt, Homo sapiens
gggcuucucaguccuaaug

SEQ ID NO: 897470 - RNA, 19 nt, Homo sapiens
gguggugcccugauuguug

SEQ ID NO: 897471 - RNA, 19 nt, Homo sapiens
gauaaaucccaagugcuuu

SEQ ID NO: 897472 - RNA, 19 nt, Homo sapiens
aaauauagcacuguaguca

SEQ ID NO: 897473 - RNA, 19 nt, Homo sapiens
gacaacuucauaauucuga

SEQ ID NO: 897474 - RNA, 19 nt, Homo sapiens
gaaagcucuccuacauuau

SEQ ID NO: 897475 - RNA, 19 nt, Homo sapiens
ucaggagggacgugcaaua

SEQ ID NO: 897476 - RNA, 19 nt, Homo sapiens
cacaacaccuguccuuacu

SEQ ID NO: 897477 - RNA, 19 nt, Homo sapiens
cagaaagcucuccuacauu

SEQ ID NO: 897478 - RNA, 19 nt, Homo sapiens
caaagaagccaugacaacu

SEQ ID NO: 897479 - RNA, 19 nt, Homo sapiens
ucaggacgcuguuaauucc

SEQ ID NO: 897480 - RNA, 19 nt, Homo sapiens
guucaggacgcuguuaauu

SEQ ID NO: 897481 - RNA, 19 nt, Homo sapiens
agauaaaucccaagugcuu

SEQ ID NO: 897482 - RNA, 19 nt, Homo sapiens
gagagagacagacuacagu

SEQ ID NO: 897483 - RNA, 19 nt, Homo sapiens
gugcuggccuucagauguc

SEQ ID NO: 897484 - RNA, 19 nt, Homo sapiens
uaagugccaccaagauaga

SEQ ID NO: 897485 - RNA, 19 nt, Homo sapiens
gauuacacaucacuuuagc

SEQ ID NO: 897486 - RNA, 19 nt, Homo sapiens
augccugucugcaaacuaa

SEQ ID NO: 897487 - RNA, 19 nt, Homo sapiens
gagagaggagagaagaaau

SEQ ID NO: 897488 - RNA, 19 nt, Homo sapiens
ggugagaggagcaaagaag

SEQ ID NO: 897489 - RNA, 19 nt, Homo sapiens
agaauucuucgaucacaaa

SEQ ID NO: 897490 - RNA, 19 nt, Homo sapiens
uuacacaucacuuuagcuu

SEQ ID NO: 897491 - RNA, 19 nt, Homo sapiens
uuaaagugcuggccuucag

SEQ ID NO: 897492 - RNA, 19 nt, Homo sapiens
gacgguggccaaauuaaag

SEQ ID NO: 897493 - RNA, 19 nt, Homo sapiens
agacgguggccaaauuaaa

SEQ ID NO: 897494 - RNA, 19 nt, Homo sapiens
gaggaggagcaaaggaaga

SEQ ID NO: 897495 - RNA, 19 nt, Homo sapiens
guggaaaaguaccuuauau

SEQ ID NO: 897496 - RNA, 19 nt, Homo sapiens
ugguggauaugcugccuuu

SEQ ID NO: 897497 - RNA, 19 nt, Homo sapiens
caacaggugaauaugaaag

SEQ ID NO: 897498 - RNA, 19 nt, Homo sapiens
gcaugaggcaacauuucuu

SEQ ID NO: 897499 - RNA, 19 nt, Homo sapiens
aaauucuggugguggauau

SEQ ID NO: 897500 - RNA, 19 nt, Homo sapiens
guucaaacugugcauuaug

SEQ ID NO: 897501 - RNA, 19 nt, Homo sapiens
aaccaugaguggccagaga

SEQ ID NO: 897502 - RNA, 19 nt, Homo sapiens
uaauuaugccugucugcaa

SEQ ID NO: 897503 - RNA, 19 nt, Homo sapiens
agaaagcucuccuacauua

SEQ ID NO: 897504 - RNA, 19 nt, Homo sapiens
ugaagaggcuguccagaua

SEQ ID NO: 897505 - RNA, 19 nt, Homo sapiens
caacagugcucuggacaua

SEQ ID NO: 897506 - RNA, 19 nt, Homo sapiens
ucagaaagcucuccuacau

SEQ ID NO: 897507 - RNA, 19 nt, Homo sapiens
gcacugccauccacacaga

SEQ ID NO: 897508 - RNA, 19 nt, Homo sapiens
caacugaggaccuaauuau

SEQ ID NO: 897509 - RNA, 19 nt, Homo sapiens
gagcagagaaaucuuaaga

SEQ ID NO: 897510 - RNA, 19 nt, Homo sapiens
uuaagacgguggccaaauu

SEQ ID NO: 897511 - RNA, 19 nt, Homo sapiens
gggcaugacucaggugaaa

SEQ ID NO: 897512 - RNA, 19 nt, Homo sapiens
ccacgcagguccuucuuga

SEQ ID NO: 897513 - RNA, 19 nt, Homo sapiens
caacaccuguccuuacugu

SEQ ID NO: 897514 - RNA, 19 nt, Homo sapiens
gcaacugaggaccuaauua

SEQ ID NO: 897515 - RNA, 19 nt, Homo sapiens
gagaugagguagguggaaa

SEQ ID NO: 897516 - RNA, 19 nt, Homo sapiens
gaagaggcuguccagauaa

SEQ ID NO: 897517 - RNA, 19 nt, Homo sapiens
ugucuaagcuucaccuuuc

SEQ ID NO: 897518 - RNA, 19 nt, Homo sapiens
caaaggaagagcagagaaa

SEQ ID NO: 897519 - RNA, 19 nt, Homo sapiens
acagugcucuggacauaaa

SEQ ID NO: 897520 - RNA, 19 nt, Homo sapiens
ggaagaagagagagacaga

SEQ ID NO: 897521 - RNA, 19 nt, Homo sapiens
uaagacgguggccaaauua

SEQ ID NO: 897522 - RNA, 19 nt, Homo sapiens
gcacuguagucagagauga

SEQ ID NO: 897523 - RNA, 19 nt, Homo sapiens
gagacagacuacagugaug

SEQ ID NO: 897524 - RNA, 19 nt, Homo sapiens
gaagagagagacagacuac

SEQ ID NO: 897525 - RNA, 19 nt, Homo sapiens
guucucaccucuccaggaa

SEQ ID NO: 897526 - RNA, 19 nt, Homo sapiens
ugagguagguggaaaagua

SEQ ID NO: 897527 - RNA, 19 nt, Homo sapiens
gcuagguggugcccugauu

SEQ ID NO: 897528 - RNA, 19 nt, Homo sapiens
ccaccaagauagaaaugau

SEQ ID NO: 897529 - RNA, 19 nt, Homo sapiens
aaagcucuccuacauuaua

SEQ ID NO: 897530 - RNA, 19 nt, Homo sapiens
uaacacaacaccuguccuu

SEQ ID NO: 897531 - RNA, 19 nt, Homo sapiens
gcaaaggaagagcagagaa

SEQ ID NO: 897532 - RNA, 19 nt, Homo sapiens
ggaaaaguaccuuauauag

SEQ ID NO: 897533 - RNA, 19 nt, Homo sapiens
ccuaagugccaccaagaua

SEQ ID NO: 897534 - RNA, 19 nt, Homo sapiens
aagaggcuguccagauaaa

SEQ ID NO: 897535 - RNA, 19 nt, Homo sapiens
gauggagacccacuagaug

SEQ ID NO: 897536 - RNA, 19 nt, Homo sapiens
aauuaugccugucugcaaa

SEQ ID NO: 897537 - RNA, 19 nt, Homo sapiens
uucaaacugugcauuauga

SEQ ID NO: 897538 - RNA, 19 nt, Homo sapiens
aagcucuccuacauuauaa

SEQ ID NO: 897539 - RNA, 19 nt, Homo sapiens
gagagacagacuacaguga

SEQ ID NO: 897540 - RNA, 19 nt, Homo sapiens
auauagcacuguagucaga

SEQ ID NO: 897541 - RNA, 19 nt, Homo sapiens
ggaacaaccauucuaaagc

SEQ ID NO: 897542 - RNA, 19 nt, Homo sapiens
gcucagcauucagagagaa

SEQ ID NO: 897543 - RNA, 19 nt, Homo sapiens
gcucggaacaaccauucua

SEQ ID NO: 897544 - RNA, 19 nt, Homo sapiens
gggcuucucaguccuaaug

SEQ ID NO: 897545 - RNA, 19 nt, Homo sapiens
ccaggagucugcagaacca

SEQ ID NO: 897546 - RNA, 19 nt, Homo sapiens
gguggugcccugauuguug

SEQ ID NO: 897547 - RNA, 19 nt, Homo sapiens
gauaaaucccaagugcuuu

SEQ ID NO: 897548 - RNA, 19 nt, Homo sapiens
aaauauagcacuguaguca

SEQ ID NO: 897549 - RNA, 19 nt, Homo sapiens
gaaagcucuccuacauuau

SEQ ID NO: 897550 - RNA, 19 nt, Homo sapiens
gcagguccuucuugaucau

SEQ ID NO: 897551 - RNA, 19 nt, Homo sapiens
cacaacaccuguccuuacu

SEQ ID NO: 897552 - RNA, 19 nt, Homo sapiens
cagaaagcucuccuacauu

SEQ ID NO: 897553 - RNA, 19 nt, Homo sapiens
agauaaaucccaagugcuu

SEQ ID NO: 897554 - RNA, 19 nt, Homo sapiens
gagagagacagacuacagu

SEQ ID NO: 897555 - RNA, 19 nt, Homo sapiens
gugcuggccuucagauguc

SEQ ID NO: 897556 - RNA, 19 nt, Homo sapiens
uaagugccaccaagauaga

SEQ ID NO: 897557 - RNA, 19 nt, Homo sapiens
augccugucugcaaacuaa

SEQ ID NO: 897558 - RNA, 19 nt, Homo sapiens
agaauucuucgaucacaaa

SEQ ID NO: 897559 - RNA, 19 nt, Homo sapiens
uuaaagugcuggccuucag

SEQ ID NO: 897560 - RNA, 19 nt, Homo sapiens
gacgguggccaaauuaaag

SEQ ID NO: 897561 - RNA, 19 nt, Homo sapiens
agacgguggccaaauuaaa

SEQ ID NO: 897562 - RNA, 19 nt, Homo sapiens
gaggaggagcaaaggaaga

SEQ ID NO: 897563 - RNA, 19 nt, Homo sapiens
guggaaaaguaccuuauau

SEQ ID NO: 897564 - RNA, 19 nt, Homo sapiens
guucaaacugugcauuaug

SEQ ID NO: 897565 - RNA, 19 nt, Homo sapiens
uaauuaugccugucugcaa

SEQ ID NO: 897566 - RNA, 19 nt, Homo sapiens
agucagagaugagguaggu

SEQ ID NO: 897567 - RNA, 19 nt, Homo sapiens
gguccuucuugaucaucua

SEQ ID NO: 897568 - RNA, 19 nt, Homo sapiens
cggaacaaccauucuaaag

SEQ ID NO: 897569 - RNA, 19 nt, Homo sapiens
gcuucucaguccuaauguu

SEQ ID NO: 897570 - RNA, 19 nt, Homo sapiens
ugauggagacccacuagau

SEQ ID NO: 897571 - RNA, 19 nt, Homo sapiens
gcaaaccacgcagguccuu

SEQ ID NO: 897572 - RNA, 19 nt, Homo sapiens
acacaacaccuguccuuac

SEQ ID NO: 897573 - RNA, 19 nt, Homo sapiens
uggcuaucuuccacuguuu

SEQ ID NO: 897574 - RNA, 19 nt, Homo sapiens
ucucaguccuaauguucuu

SEQ ID NO: 897575 - RNA, 19 nt, Homo sapiens
gaugggcuucucaguccua

SEQ ID NO: 897576 - RNA, 19 nt, Homo sapiens
cacuagaugugcacaagag

SEQ ID NO: 897577 - RNA, 19 nt, Homo sapiens
uggcuagccugccugaagu

SEQ ID NO: 897578 - RNA, 19 nt, Homo sapiens
ggcuaucuuccacuguuua

SEQ ID NO: 897579 - RNA, 19 nt, Homo sapiens
cuaagugccaccaagauag

SEQ ID NO: 897580 - RNA, 19 nt, Homo sapiens
gcggaaacacaggugauga

SEQ ID NO: 897581 - RNA, 19 nt, Homo sapiens
ccucagggaagaagagaga

SEQ ID NO: 897582 - RNA, 19 nt, Homo sapiens
auauagaacagcaucaguu

SEQ ID NO: 897583 - RNA, 19 nt, Homo sapiens
gugcaaagagagagaagca

SEQ ID NO: 897584 - RNA, 19 nt, Homo sapiens
gaggcuguccagauaaauc

SEQ ID NO: 897585 - RNA, 19 nt, Homo sapiens
aaaggaagagcagagaaau

SEQ ID NO: 897586 - RNA, 19 nt, Homo sapiens
gcaugacucaggugaaagg

SEQ ID NO: 897587 - RNA, 19 nt, Homo sapiens
guuggcauggugagauuaa

SEQ ID NO: 897588 - RNA, 19 nt, Homo sapiens
cgcagguccuucuugauca

SEQ ID NO: 897589 - RNA, 19 nt, Homo sapiens
gccugucugcaaacuaaua

SEQ ID NO: 897590 - RNA, 19 nt, Homo sapiens
uaaagugcuggccuucaga

SEQ ID NO: 897591 - RNA, 19 nt, Homo sapiens
caccaagauagaaaugauu

SEQ ID NO: 897592 - RNA, 19 nt, Homo sapiens
cauccacacagauaucaug

SEQ ID NO: 897593 - RNA, 19 nt, Homo sapiens
agaagagagagacagacua

SEQ ID NO: 897594 - RNA, 19 nt, Homo sapiens
gcuaucuuccacuguuuau

SEQ ID NO: 897595 - RNA, 19 nt, Homo sapiens
ccacuagaugugcacaaga

SEQ ID NO: 897596 - RNA, 19 nt, Homo sapiens
gguggaaaaguaccuuaua

SEQ ID NO: 897597 - RNA, 19 nt, Homo sapiens
gaacacagauuuaagugaa

SEQ ID NO: 897598 - RNA, 19 nt, Homo sapiens
agaaagcucuccuacauua

SEQ ID NO: 897599 - RNA, 19 nt, Homo sapiens
ugaagaggcuguccagaua

SEQ ID NO: 897600 - RNA, 19 nt, Homo sapiens
caacagugcucuggacaua

SEQ ID NO: 897601 - RNA, 19 nt, Homo sapiens
ucagaaagcucuccuacau

SEQ ID NO: 897602 - RNA, 19 nt, Homo sapiens
gcacugccauccacacaga

SEQ ID NO: 897603 - RNA, 19 nt, Homo sapiens
gguaaagucuacugacaga

SEQ ID NO: 897604 - RNA, 19 nt, Homo sapiens
ccagaaagcagagaagaua

SEQ ID NO: 897605 - RNA, 19 nt, Homo sapiens
agaauuagaugaagguguu

SEQ ID NO: 897606 - RNA, 19 nt, Homo sapiens
uagaaacccuuaaagaugu

SEQ ID NO: 897607 - RNA, 19 nt, Homo sapiens
caacugaggaccuaauuau

SEQ ID NO: 897608 - RNA, 19 nt, Homo sapiens
gagcagagaaaucuuaaga

SEQ ID NO: 897609 - RNA, 19 nt, Homo sapiens
guagagacacauuagauuu

SEQ ID NO: 897610 - RNA, 19 nt, Homo sapiens
uuaagacgguggccaaauu

SEQ ID NO: 897611 - RNA, 19 nt, Homo sapiens
uuaaagcaauccugaagaa

SEQ ID NO: 897612 - RNA, 19 nt, Homo sapiens
uaacuuaucagaacacaga

SEQ ID NO: 897613 - RNA, 19 nt, Homo sapiens
caacaccuguccuuacugu

SEQ ID NO: 897614 - RNA, 19 nt, Homo sapiens
ccaagaaggcaaugaugua

SEQ ID NO: 897615 - RNA, 19 nt, Homo sapiens
gcaacugaggaccuaauua

SEQ ID NO: 897616 - RNA, 19 nt, Homo sapiens
gagaugagguagguggaaa

SEQ ID NO: 897617 - RNA, 19 nt, Homo sapiens
gaagaggcuguccagauaa

SEQ ID NO: 897618 - RNA, 19 nt, Homo sapiens
ggaaagcuuuagacagcaa

SEQ ID NO: 897619 - RNA, 19 nt, Homo sapiens
caaaggaagagcagagaaa

SEQ ID NO: 897620 - RNA, 19 nt, Homo sapiens
acagugcucuggacauaaa

SEQ ID NO: 897621 - RNA, 19 nt, Homo sapiens
ggaagaagagagagacaga

SEQ ID NO: 897622 - RNA, 19 nt, Homo sapiens
ggacuucaauccagaaagc

SEQ ID NO: 897623 - RNA, 19 nt, Homo sapiens
uaaagucuacugacagaaa

SEQ ID NO: 897624 - RNA, 19 nt, Homo sapiens
uaagacgguggccaaauua

SEQ ID NO: 897625 - RNA, 19 nt, Homo sapiens
gcacuguagucagagauga

SEQ ID NO: 897626 - RNA, 19 nt, Homo sapiens
cauagaaacccuuaaagau

SEQ ID NO: 897627 - RNA, 19 nt, Homo sapiens
aaaugaaguuggauggaaa

SEQ ID NO: 897628 - RNA, 19 nt, Homo sapiens
gagacagacuacagugaug

SEQ ID NO: 897629 - RNA, 19 nt, Homo sapiens
ggcugguggugaagaauua

SEQ ID NO: 897630 - RNA, 19 nt, Homo sapiens
caagaaggcaaugauguaa

SEQ ID NO: 897631 - RNA, 19 nt, Homo sapiens
gaagagcagguaaagucua

SEQ ID NO: 897632 - RNA, 19 nt, Homo sapiens
gaagagagagacagacuac

SEQ ID NO: 897633 - RNA, 19 nt, Homo sapiens
ccauagaaacccuuaaaga

SEQ ID NO: 897634 - RNA, 19 nt, Homo sapiens
ugagguagguggaaaagua

SEQ ID NO: 897635 - RNA, 19 nt, Homo sapiens
gcuagguggugcccugauu

SEQ ID NO: 897636 - RNA, 19 nt, Homo sapiens
ccaccaagauagaaaugau

SEQ ID NO: 897637 - RNA, 19 nt, Homo sapiens
aaagcucuccuacauuaua

SEQ ID NO: 897638 - RNA, 19 nt, Homo sapiens
agaguuaacuuaucagaac

SEQ ID NO: 897639 - RNA, 19 nt, Homo sapiens
gguagagacacauuagauu

SEQ ID NO: 897640 - RNA, 19 nt, Homo sapiens
caagucagaccaucaggaa

SEQ ID NO: 897641 - RNA, 19 nt, Homo sapiens
gcacaggaagucugagugu

SEQ ID NO: 897642 - RNA, 19 nt, Homo sapiens
gagcgaagaugcagaucac

SEQ ID NO: 897643 - RNA, 19 nt, Homo sapiens
ggaagaagagcagguaaag

SEQ ID NO: 897644 - RNA, 19 nt, Homo sapiens
uaacacaacaccuguccuu

SEQ ID NO: 897645 - RNA, 19 nt, Homo sapiens
ugucacaguucaaucauca

SEQ ID NO: 897646 - RNA, 19 nt, Homo sapiens
ggaugucacaguucaauca

SEQ ID NO: 897647 - RNA, 19 nt, Homo sapiens
auagaaacccuuaaagaug

SEQ ID NO: 897648 - RNA, 19 nt, Homo sapiens
gcaaaggaagagcagagaa

SEQ ID NO: 897649 - RNA, 19 nt, Homo sapiens
cagguaaagucuacugaca

SEQ ID NO: 897650 - RNA, 19 nt, Homo sapiens
aaagaagaccguaccaugu

SEQ ID NO: 897651 - RNA, 19 nt, Homo sapiens
ggugugggaugucagaaca

SEQ ID NO: 897652 - RNA, 19 nt, Homo sapiens
aaaacgaggugacugaaaa

SEQ ID NO: 897653 - RNA, 19 nt, Homo sapiens
ggaaaaguaccuuauauag

SEQ ID NO: 897654 - RNA, 19 nt, Homo sapiens
ccuaagugccaccaagaua

SEQ ID NO: 897655 - RNA, 19 nt, Homo sapiens
aagaggcuguccagauaaa

SEQ ID NO: 897656 - RNA, 19 nt, Homo sapiens
gauggagacccacuagaug

SEQ ID NO: 897657 - RNA, 19 nt, Homo sapiens
gaccaucaggaaagcuuua

SEQ ID NO: 897658 - RNA, 19 nt, Homo sapiens
acagagaggugugggaugu

SEQ ID NO: 897659 - RNA, 19 nt, Homo sapiens
aauuaugccugucugcaaa

SEQ ID NO: 897660 - RNA, 19 nt, Homo sapiens
uucaaacugugcauuauga

SEQ ID NO: 897661 - RNA, 19 nt, Homo sapiens
aagcucuccuacauuauaa

SEQ ID NO: 897662 - RNA, 19 nt, Homo sapiens
gagagacagacuacaguga

SEQ ID NO: 897663 - RNA, 19 nt, Homo sapiens
aaauagcuggugccacuua

SEQ ID NO: 897664 - RNA, 19 nt, Homo sapiens
gagggcugguggugaagaa

SEQ ID NO: 897665 - RNA, 19 nt, Homo sapiens
auauagcacuguagucaga

SEQ ID NO: 897666 - RNA, 19 nt, Homo sapiens
ggaacaaccauucuaaagc

SEQ ID NO: 897667 - RNA, 19 nt, Homo sapiens
uaaggaagaagagcaggua

SEQ ID NO: 897668 - RNA, 19 nt, Homo sapiens
aagaagagcagguaaaguc

SEQ ID NO: 897669 - RNA, 19 nt, Homo sapiens
gcucagcauucagagagaa

SEQ ID NO: 897670 - RNA, 19 nt, Homo sapiens
gcucggaacaaccauucua

SEQ ID NO: 897671 - RNA, 19 nt, Homo sapiens
gggcuucucaguccuaaug

SEQ ID NO: 897672 - RNA, 19 nt, Homo sapiens
ucacugcaccguacccaaa

SEQ ID NO: 897673 - RNA, 19 nt, Homo sapiens
cagaaagucagcaguggaa

SEQ ID NO: 897674 - RNA, 19 nt, Homo sapiens
gguggugcccugauuguug

SEQ ID NO: 897675 - RNA, 19 nt, Homo sapiens
gauaaaucccaagugcuuu

SEQ ID NO: 897676 - RNA, 19 nt, Homo sapiens
gcagaaagcagugaaaaug

SEQ ID NO: 897677 - RNA, 19 nt, Homo sapiens
aaauauagcacuguaguca

SEQ ID NO: 897678 - RNA, 19 nt, Homo sapiens
gaaagcucuccuacauuau

SEQ ID NO: 897679 - RNA, 19 nt, Homo sapiens
ucagaacacagauuuaagu

SEQ ID NO: 897680 - RNA, 19 nt, Homo sapiens
gaagcagaaaguacagaga

SEQ ID NO: 897681 - RNA, 19 nt, Homo sapiens
gaggagguacuagcuggua

SEQ ID NO: 897682 - RNA, 19 nt, Homo sapiens
gaagaagagcagguaaagu

SEQ ID NO: 897683 - RNA, 19 nt, Homo sapiens
cacaacaccuguccuuacu

SEQ ID NO: 897684 - RNA, 19 nt, Homo sapiens
cagaaagcucuccuacauu

SEQ ID NO: 897685 - RNA, 19 nt, Homo sapiens
ggugaagaauuagaugaag

SEQ ID NO: 897686 - RNA, 19 nt, Homo sapiens
agaaggcaaugauguaaaa

SEQ ID NO: 897687 - RNA, 19 nt, Homo sapiens
gaguuaacuuaucagaaca

SEQ ID NO: 897688 - RNA, 19 nt, Homo sapiens
agauaaaucccaagugcuu

SEQ ID NO: 897689 - RNA, 19 nt, Homo sapiens
gagagagacagacuacagu

SEQ ID NO: 897690 - RNA, 19 nt, Homo sapiens
acaggaagucugaguguga

SEQ ID NO: 897691 - RNA, 19 nt, Homo sapiens
guacccauagaaacccuua

SEQ ID NO: 897692 - RNA, 19 nt, Homo sapiens
ugucagaacauccaaguca

SEQ ID NO: 897693 - RNA, 19 nt, Homo sapiens
gugcuggccuucagauguc

SEQ ID NO: 897694 - RNA, 19 nt, Homo sapiens
uaagugccaccaagauaga

SEQ ID NO: 897695 - RNA, 19 nt, Homo sapiens
augccugucugcaaacuaa

SEQ ID NO: 897696 - RNA, 19 nt, Homo sapiens
gcagcagaaagcagugaaa

SEQ ID NO: 897697 - RNA, 19 nt, Homo sapiens
agaaagcucuccuacauua

SEQ ID NO: 897698 - RNA, 19 nt, Homo sapiens
gaauguaucucauccuuug

SEQ ID NO: 897699 - RNA, 19 nt, Homo sapiens
ugaagaggcuguccagaua

SEQ ID NO: 897700 - RNA, 19 nt, Homo sapiens
caacagugcucuggacaua

SEQ ID NO: 897701 - RNA, 19 nt, Homo sapiens
ucagaaagcucuccuacau

SEQ ID NO: 897702 - RNA, 19 nt, Homo sapiens
gaacugggauuucauuuug

SEQ ID NO: 897703 - RNA, 19 nt, Homo sapiens
acacaucacuuuagcuuau

SEQ ID NO: 897704 - RNA, 19 nt, Homo sapiens
aaacagaucucuacagacu

SEQ ID NO: 897705 - RNA, 19 nt, Homo sapiens
gcacugccauccacacaga

SEQ ID NO: 897706 - RNA, 19 nt, Homo sapiens
uuaaacagaucucuacaga

SEQ ID NO: 897707 - RNA, 19 nt, Homo sapiens
caaaggagaauguaaacaa

SEQ ID NO: 897708 - RNA, 19 nt, Homo sapiens
gaaaugaagggacacuuau

SEQ ID NO: 897709 - RNA, 19 nt, Homo sapiens
caacugaggaccuaauuau

SEQ ID NO: 897710 - RNA, 19 nt, Homo sapiens
gagcagagaaaucuuaaga

SEQ ID NO: 897711 - RNA, 19 nt, Homo sapiens
uuaagacgguggccaaauu

SEQ ID NO: 897712 - RNA, 19 nt, Homo sapiens
ccugaaagauaacaaaguu

SEQ ID NO: 897713 - RNA, 19 nt, Homo sapiens
cauacaacauucucuaguu

SEQ ID NO: 897714 - RNA, 19 nt, Homo sapiens
caacaccuguccuuacugu

SEQ ID NO: 897715 - RNA, 19 nt, Homo sapiens
gcaacugaggaccuaauua

SEQ ID NO: 897716 - RNA, 19 nt, Homo sapiens
gagaugagguagguggaaa

SEQ ID NO: 897717 - RNA, 19 nt, Homo sapiens
gaagaggcuguccagauaa

SEQ ID NO: 897718 - RNA, 19 nt, Homo sapiens
caaaggaagagcagagaaa

SEQ ID NO: 897719 - RNA, 19 nt, Homo sapiens
acagugcucuggacauaaa

SEQ ID NO: 897720 - RNA, 19 nt, Homo sapiens
ggagagaggagagaagaaa

SEQ ID NO: 897721 - RNA, 19 nt, Homo sapiens
ggaagaagagagagacaga

SEQ ID NO: 897722 - RNA, 19 nt, Homo sapiens
acagaucucuacagacuug

SEQ ID NO: 897723 - RNA, 19 nt, Homo sapiens
agaaaugaagggacacuua

SEQ ID NO: 897724 - RNA, 19 nt, Homo sapiens
uaagacgguggccaaauua

SEQ ID NO: 897725 - RNA, 19 nt, Homo sapiens
gcacuguagucagagauga

SEQ ID NO: 897726 - RNA, 19 nt, Homo sapiens
caacauuucuuaggcuugu

SEQ ID NO: 897727 - RNA, 19 nt, Homo sapiens
gcaaagaagccaugacaac

SEQ ID NO: 897728 - RNA, 19 nt, Homo sapiens
gagacagacuacagugaug

SEQ ID NO: 897729 - RNA, 19 nt, Homo sapiens
gaaauucuggugguggaua

SEQ ID NO: 897730 - RNA, 19 nt, Homo sapiens
gagcaaagaagccaugaca

SEQ ID NO: 897731 - RNA, 19 nt, Homo sapiens
gaagagagagacagacuac

SEQ ID NO: 897732 - RNA, 19 nt, Homo sapiens
ugagguagguggaaaagua

SEQ ID NO: 897733 - RNA, 19 nt, Homo sapiens
cgacagagaaggccaaaca

SEQ ID NO: 897734 - RNA, 19 nt, Homo sapiens
gcuagguggugcccugauu

SEQ ID NO: 897735 - RNA, 19 nt, Homo sapiens
ccaccaagauagaaaugau

SEQ ID NO: 897736 - RNA, 19 nt, Homo sapiens
aaagcucuccuacauuaua

SEQ ID NO: 897737 - RNA, 19 nt, Homo sapiens
caugaggcaacauuucuua

SEQ ID NO: 897738 - RNA, 19 nt, Homo sapiens
ggagggacgugcaauaucc

SEQ ID NO: 897739 - RNA, 19 nt, Homo sapiens
gagaggagagaagaaauga

SEQ ID NO: 897740 - RNA, 19 nt, Homo sapiens
cggaggagguugcagugaa

SEQ ID NO: 897741 - RNA, 19 nt, Homo sapiens
gcuguuaauuccaaaugug

SEQ ID NO: 897742 - RNA, 19 nt, Homo sapiens
gaggagagaagaaaugaag

SEQ ID NO: 897743 - RNA, 19 nt, Homo sapiens
uaacacaacaccuguccuu

SEQ ID NO: 897744 - RNA, 19 nt, Homo sapiens
uccaacaggugaauaugaa

SEQ ID NO: 897745 - RNA, 19 nt, Homo sapiens
gcaaaggaagagcagagaa

SEQ ID NO: 897746 - RNA, 19 nt, Homo sapiens
guaggcagcaaaugagauu

SEQ ID NO: 897747 - RNA, 19 nt, Homo sapiens
gcaggagaaucgcuugaac

SEQ ID NO: 897748 - RNA, 19 nt, Homo sapiens
ggacgcuguuaauuccaaa

SEQ ID NO: 897749 - RNA, 19 nt, Homo sapiens
ggaaaaguaccuuauauag

SEQ ID NO: 897750 - RNA, 19 nt, Homo sapiens
ccuaagugccaccaagaua

SEQ ID NO: 897751 - RNA, 19 nt, Homo sapiens
aagaggcuguccagauaaa

SEQ ID NO: 897752 - RNA, 19 nt, Homo sapiens
gauggagacccacuagaug

SEQ ID NO: 897753 - RNA, 19 nt, Homo sapiens
ccagagaggaggagaagga

SEQ ID NO: 897754 - RNA, 19 nt, Homo sapiens
ggacacuuaugcagaacca

SEQ ID NO: 897755 - RNA, 19 nt, Homo sapiens
aauuaugccugucugcaaa

SEQ ID NO: 897756 - RNA, 19 nt, Homo sapiens
uucaaacugugcauuauga

SEQ ID NO: 897757 - RNA, 19 nt, Homo sapiens
aagcucuccuacauuauaa

SEQ ID NO: 897758 - RNA, 19 nt, Homo sapiens
gagagacagacuacaguga

SEQ ID NO: 897759 - RNA, 19 nt, Homo sapiens
gaauaagucaaacccuguu

SEQ ID NO: 897760 - RNA, 19 nt, Homo sapiens
auauagcacuguagucaga

SEQ ID NO: 897761 - RNA, 19 nt, Homo sapiens
ggaacaaccauucuaaagc

SEQ ID NO: 897762 - RNA, 19 nt, Homo sapiens
caacauucucuaguuauug

SEQ ID NO: 897763 - RNA, 19 nt, Homo sapiens
ggaggagguugcagugaac

SEQ ID NO: 897764 - RNA, 19 nt, Homo sapiens
aagggacacuuaugcagaa

SEQ ID NO: 897765 - RNA, 19 nt, Homo sapiens
gcucagcauucagagagaa

SEQ ID NO: 897766 - RNA, 19 nt, Homo sapiens
gcucggaacaaccauucua

SEQ ID NO: 897767 - RNA, 19 nt, Homo sapiens
gggcuucucaguccuaaug

SEQ ID NO: 897768 - RNA, 19 nt, Homo sapiens
acagguaggcagcaaauga

SEQ ID NO: 897769 - RNA, 19 nt, Homo sapiens
aaagaagccaugacaacuu

SEQ ID NO: 897770 - RNA, 19 nt, Homo sapiens
gguggugcccugauuguug

SEQ ID NO: 897771 - RNA, 19 nt, Homo sapiens
gauaaaucccaagugcuuu

SEQ ID NO: 897772 - RNA, 19 nt, Homo sapiens
aaauauagcacuguaguca

SEQ ID NO: 897773 - RNA, 19 nt, Homo sapiens
gaaagcucuccuacauuau

SEQ ID NO: 897774 - RNA, 19 nt, Homo sapiens
gacaacuucauaauucuga

SEQ ID NO: 897775 - RNA, 19 nt, Homo sapiens
acagagaaggccaaacaaa

SEQ ID NO: 897776 - RNA, 19 nt, Homo sapiens
ugagcucacugcaguaucu

SEQ ID NO: 897777 - RNA, 19 nt, Homo sapiens
ucaggagggacgugcaaua

SEQ ID NO: 897778 - RNA, 19 nt, Homo sapiens
guguuggacucuucuguuc

SEQ ID NO: 897779 - RNA, 19 nt, Homo sapiens
cacaacaccuguccuuacu

SEQ ID NO: 897780 - RNA, 19 nt, Homo sapiens
cagaaagcucuccuacauu

SEQ ID NO: 897781 - RNA, 19 nt, Homo sapiens
ucaggacgcuguuaauucc

SEQ ID NO: 897782 - RNA, 19 nt, Homo sapiens
guucaggacgcuguuaauu

SEQ ID NO: 897783 - RNA, 19 nt, Homo sapiens
caaagaagccaugacaacu

SEQ ID NO: 897784 - RNA, 19 nt, Homo sapiens
agauaaaucccaagugcuu

SEQ ID NO: 897785 - RNA, 19 nt, Homo sapiens
gagagagacagacuacagu

SEQ ID NO: 897786 - RNA, 19 nt, Homo sapiens
gugcuggccuucagauguc

SEQ ID NO: 897787 - RNA, 19 nt, Homo sapiens
uaagugccaccaagauaga

SEQ ID NO: 897788 - RNA, 19 nt, Homo sapiens
gauuacacaucacuuuagc

SEQ ID NO: 897789 - RNA, 19 nt, Homo sapiens
augccugucugcaaacuaa

SEQ ID NO: 897790 - RNA, 19 nt, Homo sapiens
gagagaggagagaagaaau

SEQ ID NO: 897791 - RNA, 19 nt, Homo sapiens
agaauucuucgaucacaaa

SEQ ID NO: 897792 - RNA, 19 nt, Homo sapiens
uuacacaucacuuuagcuu

SEQ ID NO: 897793 - RNA, 19 nt, Homo sapiens
ggugagaggagcaaagaag

SEQ ID NO: 897794 - RNA, 19 nt, Homo sapiens
uuaaagugcuggccuucag

SEQ ID NO: 897795 - RNA, 19 nt, Homo sapiens
gacgguggccaaauuaaag

SEQ ID NO: 897796 - RNA, 19 nt, Homo sapiens
agacgguggccaaauuaaa

SEQ ID NO: 897797 - RNA, 19 nt, Homo sapiens
gauaaccacucaucccuua

SEQ ID NO: 897798 - RNA, 19 nt, Homo sapiens
agaaagagcucaaaccauu

SEQ ID NO: 897799 - RNA, 19 nt, Homo sapiens
gggcaucacuccaagcauu

SEQ ID NO: 897800 - RNA, 19 nt, Homo sapiens
gaaaggagacggugugaca

SEQ ID NO: 897801 - RNA, 19 nt, Homo sapiens
ggaauaaccaucccuacaa

SEQ ID NO: 897802 - RNA, 19 nt, Homo sapiens
gagcccagcuggugaugaa

SEQ ID NO: 897803 - RNA, 19 nt, Homo sapiens
gaaagagcucaaaccauuu

SEQ ID NO: 897804 - RNA, 19 nt, Homo sapiens
acucaucccuuauuuauuc

SEQ ID NO: 897805 - RNA, 19 nt, Homo sapiens
cuuauaaccuguuuccauu

SEQ ID NO: 897806 - RNA, 19 nt, Homo sapiens
ccacucaucccuuauuuau

SEQ ID NO: 897807 - RNA, 19 nt, Homo sapiens
ggaaacugcggaugucauu

SEQ ID NO: 897808 - RNA, 19 nt, Homo sapiens
gaauaaccaucccuacaac

SEQ ID NO: 897809 - RNA, 19 nt, Homo sapiens
guaaucaccuuugguugga

SEQ ID NO: 897810 - RNA, 19 nt, Homo sapiens
ggaaucagcaggccucugu

SEQ ID NO: 897811 - RNA, 19 nt, Homo sapiens
gacacauucuugagugaaa

SEQ ID NO: 897812 - RNA, 19 nt, Homo sapiens
gauguaaucaccuuugguu

SEQ ID NO: 897813 - RNA, 19 nt, Homo sapiens
gaauaaacagcuggacaaa

SEQ ID NO: 897814 - RNA, 19 nt, Homo sapiens
gcaagaaaaugagcucuga

SEQ ID NO: 897815 - RNA, 19 nt, Homo sapiens
caggagcacuguuggaauc

SEQ ID NO: 897816 - RNA, 19 nt, Homo sapiens
gagacggugugacagaaau

SEQ ID NO: 897817 - RNA, 19 nt, Homo sapiens
caagguggcguucaagaug

SEQ ID NO: 897818 - RNA, 19 nt, Homo sapiens
gaacucagugacucuugaa

SEQ ID NO: 897819 - RNA, 19 nt, Homo sapiens
ugaauaaacagcuggacaa

SEQ ID NO: 897820 - RNA, 19 nt, Homo sapiens
ggaggaauugcuagcugua

SEQ ID NO: 897821 - RNA, 19 nt, Homo sapiens
uaaccacucaucccuuauu

SEQ ID NO: 897822 - RNA, 19 nt, Homo sapiens
gaguccggcugauugaaga

SEQ ID NO: 897823 - RNA, 19 nt, Homo sapiens
auaaacagcuggacaaaau

SEQ ID NO: 897824 - RNA, 19 nt, Homo sapiens
gcucaaaccauuuuacauu

SEQ ID NO: 897825 - RNA, 19 nt, Homo sapiens
ggacuagaaagagcucaaa

SEQ ID NO: 897826 - RNA, 19 nt, Homo sapiens
ggcaucacuccaagcauua

SEQ ID NO: 897827 - RNA, 19 nt, Homo sapiens
uacagaggguacauccuuu

SEQ ID NO: 897828 - RNA, 19 nt, Homo sapiens
acagaaauccggaugagau

SEQ ID NO: 897829 - RNA, 19 nt, Homo sapiens
ggagacggugugacagaaa

SEQ ID NO: 897830 - RNA, 19 nt, Homo sapiens
auugcuagcuguaguguga

SEQ ID NO: 897831 - RNA, 19 nt, Homo sapiens
gagaggggcuggauguaau

SEQ ID NO: 897832 - RNA, 19 nt, Homo sapiens
agaacucagugacucuuga

SEQ ID NO: 897833 - RNA, 19 nt, Homo sapiens
ucacccagcuauguaagga

SEQ ID NO: 897834 - RNA, 19 nt, Homo sapiens
ugacagaaauccggaugag

SEQ ID NO: 897835 - RNA, 19 nt, Homo sapiens
uccauucuccauucaaaua

SEQ ID NO: 897836 - RNA, 19 nt, Homo sapiens
uuacagaggguacauccuu

SEQ ID NO: 897837 - RNA, 19 nt, Homo sapiens
ggaauugcuagcuguagug

SEQ ID NO: 897838 - RNA, 19 nt, Homo sapiens
gcaagccuggcacaucuau

SEQ ID NO: 897839 - RNA, 19 nt, Homo sapiens
aaccacucaucccuuauuu

SEQ ID NO: 897840 - RNA, 19 nt, Homo sapiens
uauaaccuguuuccauucu

SEQ ID NO: 897841 - RNA, 19 nt, Homo sapiens
ucacuccaagcauuacuaa

SEQ ID NO: 897842 - RNA, 19 nt, Homo sapiens
ucaggcggauugaggacaa

SEQ ID NO: 897843 - RNA, 19 nt, Homo sapiens
ccagcuauguaaggacuau

SEQ ID NO: 897844 - RNA, 19 nt, Homo sapiens
ggaagccacccaggucuca

SEQ ID NO: 897845 - RNA, 19 nt, Homo sapiens
gagccagucaugccggaaa

SEQ ID NO: 897846 - RNA, 19 nt, Homo sapiens
ccauucuccauucaaauaa

SEQ ID NO: 897847 - RNA, 19 nt, Homo sapiens
guugggaggugccaugacu

SEQ ID NO: 897848 - RNA, 19 nt, Homo sapiens
agaaagccauuugccucaa

SEQ ID NO: 897849 - RNA, 19 nt, Homo sapiens
gcccagcuggugaugaauu

SEQ ID NO: 897850 - RNA, 19 nt, Homo sapiens
ggaguccggcugauugaag

SEQ ID NO: 897851 - RNA, 19 nt, Homo sapiens
ccaagguggcguucaagau

SEQ ID NO: 897852 - RNA, 19 nt, Homo sapiens
uguaguguuugccaggaaa

SEQ ID NO: 897853 - RNA, 19 nt, Homo sapiens
acugcgauauaguccauuu

SEQ ID NO: 897854 - RNA, 19 nt, Homo sapiens
guaaggacuaugaaaauga

SEQ ID NO: 897855 - RNA, 19 nt, Homo sapiens
ugaaaaugaugaagaugug

SEQ ID NO: 897856 - RNA, 19 nt, Homo sapiens
cuagaaagagcucaaacca

SEQ ID NO: 897857 - RNA, 19 nt, Homo sapiens
uuuccauucuccauucaaa

SEQ ID NO: 897858 - RNA, 19 nt, Homo sapiens
gccaucaggagcacuguug

SEQ ID NO: 897859 - RNA, 19 nt, Homo sapiens
uuucuuggcucggucaaau

SEQ ID NO: 897860 - RNA, 19 nt, Homo sapiens
gcucuucacccugaccuau

SEQ ID NO: 897861 - RNA, 19 nt, Homo sapiens
gcaccgagagcaagaaaau

SEQ ID NO: 897862 - RNA, 19 nt, Homo sapiens
gaaacugcggaugucauug

SEQ ID NO: 897863 - RNA, 19 nt, Homo sapiens
gaugaagaugugaauaaac

SEQ ID NO: 897864 - RNA, 19 nt, Homo sapiens
cccuacaacucgaggauag

SEQ ID NO: 897865 - RNA, 19 nt, Homo sapiens
ugaauucucccucauuuug

SEQ ID NO: 897866 - RNA, 19 nt, Homo sapiens
gcggggagcuuuggagaug

SEQ ID NO: 897867 - RNA, 19 nt, Homo sapiens
aagguggcguucaagaugu

SEQ ID NO: 897868 - RNA, 19 nt, Homo sapiens
ugggaggugccaugacuuu

SEQ ID NO: 897869 - RNA, 19 nt, Homo sapiens
acacauucuugagugaaau

SEQ ID NO: 897870 - RNA, 19 nt, Homo sapiens
ggaggugccaugacuuucg

SEQ ID NO: 897871 - RNA, 19 nt, Homo sapiens
gguggacuuuguggaacuu

SEQ ID NO: 897872 - RNA, 19 nt, Homo sapiens
gaauugcuagcuguagugu

SEQ ID NO: 897873 - RNA, 19 nt, Homo sapiens
gcuauguaaggacuaugaa

SEQ ID NO: 897874 - RNA, 19 nt, Homo sapiens
cucagugacucuugaacau

SEQ ID NO: 897875 - RNA, 19 nt, Homo sapiens
gacagaaauccggaugaga

SEQ ID NO: 897876 - RNA, 19 nt, Homo sapiens
gcacuucucuuaauaauuc

SEQ ID NO: 897877 - RNA, 19 nt, Homo sapiens
gaugagugaucaagaauua

SEQ ID NO: 897878 - RNA, 19 nt, Homo sapiens
gaacgaggcugcccuagag

SEQ ID NO: 897879 - RNA, 19 nt, Homo sapiens
ggacaugccuauccugugu

SEQ ID NO: 897880 - RNA, 19 nt, Homo sapiens
gaagacauguccaucagau

SEQ ID NO: 897881 - RNA, 19 nt, Homo sapiens
gcacggagaugaagauacu

SEQ ID NO: 897882 - RNA, 19 nt, Homo sapiens
gagaggcaaugaugaguga

SEQ ID NO: 897883 - RNA, 19 nt, Homo sapiens
ccauuuggcuugugauauu

SEQ ID NO: 897884 - RNA, 19 nt, Homo sapiens
gcaaaguccucaccuuaca

SEQ ID NO: 897885 - RNA, 19 nt, Homo sapiens
gagcauuccuagauaacaa

SEQ ID NO: 897886 - RNA, 19 nt, Homo sapiens
aaacuaugcucugaggaua

SEQ ID NO: 897887 - RNA, 19 nt, Homo sapiens
gcucaggguugcucucuug

SEQ ID NO: 897888 - RNA, 19 nt, Homo sapiens
gcaauaugaaguacaguuu

SEQ ID NO: 897889 - RNA, 19 nt, Homo sapiens
caaagcugcacuucucuua

SEQ ID NO: 897890 - RNA, 19 nt, Homo sapiens
gcagugagaacaacgguuu

SEQ ID NO: 897891 - RNA, 19 nt, Homo sapiens
uuugacaacuccuguauaa

SEQ ID NO: 897892 - RNA, 19 nt, Homo sapiens
ggaggaggaugaugaggau

SEQ ID NO: 897893 - RNA, 19 nt, Homo sapiens
gugcaaaguccucaccuua

SEQ ID NO: 897894 - RNA, 19 nt, Homo sapiens
cacccuggcugacauguuu

SEQ ID NO: 897895 - RNA, 19 nt, Homo sapiens
uuacagagaaccaggauuu

SEQ ID NO: 897896 - RNA, 19 nt, Homo sapiens
ugacuggaauuacacaaga

SEQ ID NO: 897897 - RNA, 19 nt, Homo sapiens
gcagaaugcuagccagaag

SEQ ID NO: 897898 - RNA, 19 nt, Homo sapiens
ggaguaauaaguaacaaga

SEQ ID NO: 897899 - RNA, 19 nt, Homo sapiens
gcaaauagucuuuccuuuu

SEQ ID NO: 897900 - RNA, 19 nt, Homo sapiens
gcaugauccuggcaaauag

SEQ ID NO: 897901 - RNA, 19 nt, Homo sapiens
guugaacacugcagaaauc

SEQ ID NO: 897902 - RNA, 19 nt, Homo sapiens
ggcaugauccuggcaaaua

SEQ ID NO: 897903 - RNA, 19 nt, Homo sapiens
ggacguacccgcugaggau

SEQ ID NO: 897904 - RNA, 19 nt, Homo sapiens
gcauuaagcgcgucaagga

SEQ ID NO: 897905 - RNA, 19 nt, Homo sapiens
gaggauaaagcaaguucua

SEQ ID NO: 897906 - RNA, 19 nt, Homo sapiens
gaaacaaaucguaaguaug

SEQ ID NO: 897907 - RNA, 19 nt, Homo sapiens
caaauagucuuuccuuuuc

SEQ ID NO: 897908 - RNA, 19 nt, Homo sapiens
ggaaauuucgggugacaga

SEQ ID NO: 897909 - RNA, 19 nt, Homo sapiens
ggcaaauagucuuuccuuu

SEQ ID NO: 897910 - RNA, 19 nt, Homo sapiens
guccucaccuuacauauuc

SEQ ID NO: 897911 - RNA, 19 nt, Homo sapiens
ggauaaagcaaguucuaau

SEQ ID NO: 897912 - RNA, 19 nt, Homo sapiens
gagggcaccuucucugcuu

SEQ ID NO: 897913 - RNA, 19 nt, Homo sapiens
gcaauaccagucuaaugaa

SEQ ID NO: 897914 - RNA, 19 nt, Homo sapiens
ccagacagcggcuugauug

SEQ ID NO: 897915 - RNA, 19 nt, Homo sapiens
gauguggacugugucaaau

SEQ ID NO: 897916 - RNA, 19 nt, Homo sapiens
ggcaguacguggacucaga

SEQ ID NO: 897917 - RNA, 19 nt, Homo sapiens
ccucugggacccuuuauaa

SEQ ID NO: 897918 - RNA, 19 nt, Homo sapiens
ccagaaggaugucauugag

SEQ ID NO: 897919 - RNA, 19 nt, Homo sapiens
cuucgagcauuccuagaua

SEQ ID NO: 897920 - RNA, 19 nt, Homo sapiens
cagcauagccacgaaguga

SEQ ID NO: 897921 - RNA, 19 nt, Homo sapiens
ccagucuaaugaacacuuu

SEQ ID NO: 897922 - RNA, 19 nt, Homo sapiens
aagcugcacuucucuuaau

SEQ ID NO: 897923 - RNA, 19 nt, Homo sapiens
gaaguggguggguggguuu

SEQ ID NO: 897924 - RNA, 19 nt, Homo sapiens
ggacauccuaucuaacuuc

SEQ ID NO: 897925 - RNA, 19 nt, Homo sapiens
guucauggccuguaaccuu

SEQ ID NO: 897926 - RNA, 19 nt, Homo sapiens
gcugcuugcugcuggguuu

SEQ ID NO: 897927 - RNA, 19 nt, Homo sapiens
gaagagcacaguggaaagu

SEQ ID NO: 897928 - RNA, 19 nt, Homo sapiens
uggcagauguggacugugu

SEQ ID NO: 897929 - RNA, 19 nt, Homo sapiens
gccaggcuguggucauuug

SEQ ID NO: 897930 - RNA, 19 nt, Homo sapiens
caggguugcucucuuguuc

SEQ ID NO: 897931 - RNA, 19 nt, Homo sapiens
cauccuaucuaacuucaag

SEQ ID NO: 897932 - RNA, 19 nt, Homo sapiens
ugcaauaccagucuaauga

SEQ ID NO: 897933 - RNA, 19 nt, Homo sapiens
gcacugguuuugauacuug

SEQ ID NO: 897934 - RNA, 19 nt, Homo sapiens
gaacaggagagaggcaaug

SEQ ID NO: 897935 - RNA, 19 nt, Homo sapiens
gcauccauuuggcuuguga

SEQ ID NO: 897936 - RNA, 19 nt, Homo sapiens
gcuucuaugccuucuauaa

SEQ ID NO: 897937 - RNA, 19 nt, Homo sapiens
guaccgagcagauucagau

SEQ ID NO: 897938 - RNA, 19 nt, Homo sapiens
acagacugcugaagagaug

SEQ ID NO: 897939 - RNA, 19 nt, Homo sapiens
cuaaugaacacuuugugaa

SEQ ID NO: 897940 - RNA, 19 nt, Homo sapiens
ggagagaggcaaugaugag

SEQ ID NO: 897941 - RNA, 19 nt, Homo sapiens
gaaagccuccaguugcaau

SEQ ID NO: 897942 - RNA, 19 nt, Homo sapiens
gguugaagcugugggacuu

SEQ ID NO: 897943 - RNA, 19 nt, Homo sapiens
ugacaacuccuguauaaaa

SEQ ID NO: 897944 - RNA, 19 nt, Homo sapiens
ucacuaccaucugcuucua

SEQ ID NO: 897945 - RNA, 19 nt, Homo sapiens
gccagaaggaugucauuga

SEQ ID NO: 897946 - RNA, 19 nt, Homo sapiens
agagcacaguggaaaguuu

SEQ ID NO: 897947 - RNA, 19 nt, Homo sapiens
aagaagacagcuacaacua

SEQ ID NO: 897948 - RNA, 19 nt, Homo sapiens
aaaguccucaccuuacaua

SEQ ID NO: 897949 - RNA, 19 nt, Homo sapiens
gacauccuaucuaacuuca

SEQ ID NO: 897950 - RNA, 19 nt, Homo sapiens
agugaugccucuccucuau

SEQ ID NO: 897951 - RNA, 19 nt, Homo sapiens
gcauagccacgaagugaug

SEQ ID NO: 897952 - RNA, 19 nt, Homo sapiens
caaguucuaauuuguggaa

SEQ ID NO: 897953 - RNA, 19 nt, Homo sapiens
caaacuaugcucugaggau

SEQ ID NO: 897954 - RNA, 19 nt, Homo sapiens
guaccaaggacaugccuau

SEQ ID NO: 897955 - RNA, 19 nt, Homo sapiens
ccuuacauauucaucuuga

SEQ ID NO: 897956 - RNA, 19 nt, Homo sapiens
gauucugauucccagcaua

SEQ ID NO: 897957 - RNA, 19 nt, Homo sapiens
ugacauguuucuggaagug

SEQ ID NO: 897958 - RNA, 19 nt, Homo sapiens
ccugggauguucagucaug

SEQ ID NO: 897959 - RNA, 19 nt, Homo sapiens
gacuggaauuacacaagaa

SEQ ID NO: 897960 - RNA, 19 nt, Homo sapiens
cguacccgcugaggauaua

SEQ ID NO: 897961 - RNA, 19 nt, Homo sapiens
caccuuacauauucaucuu

SEQ ID NO: 897962 - RNA, 19 nt, Homo sapiens
ccuccaaagugacaacaau

SEQ ID NO: 897963 - RNA, 19 nt, Homo sapiens
ucuccucuauccucucuuu

SEQ ID NO: 897964 - RNA, 19 nt, Homo sapiens
caauaugaaguacaguuug

SEQ ID NO: 897965 - RNA, 19 nt, Homo sapiens
gcagugauggugggaaaga

SEQ ID NO: 897966 - RNA, 19 nt, Homo sapiens
ccaagaaguuaaaaucaga

SEQ ID NO: 897967 - RNA, 19 nt, Homo sapiens
caagagaacagacuaucag

SEQ ID NO: 897968 - RNA, 19 nt, Homo sapiens
caaagugacaacaauacug

SEQ ID NO: 897969 - RNA, 19 nt, Homo sapiens
guucagggaauucagagaa

SEQ ID NO: 897970 - RNA, 19 nt, Homo sapiens
caggagagaggcaaugaug

SEQ ID NO: 897971 - RNA, 19 nt, Homo sapiens
aaucauugacugugaaaga

SEQ ID NO: 897972 - RNA, 19 nt, Homo sapiens
ggaggaugaugaggaugau

SEQ ID NO: 897973 - RNA, 19 nt, Homo sapiens
ggaguuuacgauccaagaa

SEQ ID NO: 897974 - RNA, 19 nt, Homo sapiens
ugacaugcccagcccuauu

SEQ ID NO: 897975 - RNA, 19 nt, Homo sapiens
ccaagagaacagacuauca

SEQ ID NO: 897976 - RNA, 19 nt, Homo sapiens
ggagauagaugcagaugaa

SEQ ID NO: 897977 - RNA, 19 nt, Homo sapiens
gaaaauaacugcaugagaa

SEQ ID NO: 897978 - RNA, 19 nt, Homo sapiens
caaacaagaugaaacaaug

SEQ ID NO: 897979 - RNA, 19 nt, Homo sapiens
gaugugaauucucucuuua

SEQ ID NO: 897980 - RNA, 19 nt, Homo sapiens
gaacacaccaaucuaauga

SEQ ID NO: 897981 - RNA, 19 nt, Homo sapiens
ugaggaagaugcacaauug

SEQ ID NO: 897982 - RNA, 19 nt, Homo sapiens
acaugucacuuccuaauua

SEQ ID NO: 897983 - RNA, 19 nt, Homo sapiens
cuaaagagccgaugacaaa

SEQ ID NO: 897984 - RNA, 19 nt, Homo sapiens
uugaauggcuuagcuauua

SEQ ID NO: 897985 - RNA, 19 nt, Homo sapiens
gaagaaaugcagagaagaa

SEQ ID NO: 897986 - RNA, 19 nt, Homo sapiens
ggaugugaauucucucuuu

SEQ ID NO: 897987 - RNA, 19 nt, Homo sapiens
guaagaagaucuaaugcau

SEQ ID NO: 897988 - RNA, 19 nt, Homo sapiens
gaaggcaauagaagauuua

SEQ ID NO: 897989 - RNA, 19 nt, Homo sapiens
uaacuucauuggcuacgua

SEQ ID NO: 897990 - RNA, 19 nt, Homo sapiens
aagcagaucuugagcaaug

SEQ ID NO: 897991 - RNA, 19 nt, Homo sapiens
gaacuugaccagaauuugu

SEQ ID NO: 897992 - RNA, 19 nt, Homo sapiens
caaaagcucuacagcauuu

SEQ ID NO: 897993 - RNA, 19 nt, Homo sapiens
ugaagacuguccugaugua

SEQ ID NO: 897994 - RNA, 19 nt, Homo sapiens
gaccagaauuugucaagau

SEQ ID NO: 897995 - RNA, 19 nt, Homo sapiens
acaaacaugucacuuccua

SEQ ID NO: 897996 - RNA, 19 nt, Homo sapiens
gaagaucuaaugcauccua

SEQ ID NO: 897997 - RNA, 19 nt, Homo sapiens
ugaaggcaauagaagauuu

SEQ ID NO: 897998 - RNA, 19 nt, Homo sapiens
gaucuaaugcauccuauau

SEQ ID NO: 897999 - RNA, 19 nt, Homo sapiens
ucaccuaucugaagacugu

SEQ ID NO: 898000 - RNA, 19 nt, Homo sapiens
agaauuaucucuucaucug

SEQ ID NO: 898001 - RNA, 19 nt, Homo sapiens
gaagaugagagggcaauuu

SEQ ID NO: 898002 - RNA, 19 nt, Homo sapiens
ucagacagaugcagcaaga

SEQ ID NO: 898003 - RNA, 19 nt, Homo sapiens
aaacaaugaugacagacuu

SEQ ID NO: 898004 - RNA, 19 nt, Homo sapiens
gaaggaacacaccaaucua

SEQ ID NO: 898005 - RNA, 19 nt, Homo sapiens
uaucacaucuacaaacaug

SEQ ID NO: 898006 - RNA, 19 nt, Homo sapiens
gaugacagacuuaagcauu

SEQ ID NO: 898007 - RNA, 19 nt, Homo sapiens
uauacaaccugccaaccua

SEQ ID NO: 898008 - RNA, 19 nt, Homo sapiens
ggucuugccuggaaaauaa

SEQ ID NO: 898009 - RNA, 19 nt, Homo sapiens
aagaacaucuggaggaaga

SEQ ID NO: 898010 - RNA, 19 nt, Homo sapiens
guacauuaguaguucuuug

SEQ ID NO: 898011 - RNA, 19 nt, Homo sapiens
uaaacacaguugcaggaaa

SEQ ID NO: 898012 - RNA, 19 nt, Homo sapiens
gaaagugucagugaaacaa

SEQ ID NO: 898013 - RNA, 19 nt, Homo sapiens
ugacugguauuaagcaaau

SEQ ID NO: 898014 - RNA, 19 nt, Homo sapiens
caagaugaaacaaugauga

SEQ ID NO: 898015 - RNA, 19 nt, Homo sapiens
ugaauggcuuagcuauuaa

SEQ ID NO: 898016 - RNA, 19 nt, Homo sapiens
aaacacaguugcaggaaag

SEQ ID NO: 898017 - RNA, 19 nt, Homo sapiens
ugaagaaagugcugagagu

SEQ ID NO: 898018 - RNA, 19 nt, Homo sapiens
ugaauucucucuuuaacag

SEQ ID NO: 898019 - RNA, 19 nt, Homo sapiens
ggaacacaccaaucuaaug

SEQ ID NO: 898020 - RNA, 19 nt, Homo sapiens
caugucacuuccuaauuaa

SEQ ID NO: 898021 - RNA, 19 nt, Homo sapiens
gcuuagcuauuaauacuca

SEQ ID NO: 898022 - RNA, 19 nt, Homo sapiens
gaagaaagugcugagaguu

SEQ ID NO: 898023 - RNA, 19 nt, Homo sapiens
ggaaaguauguuagcuaua

SEQ ID NO: 898024 - RNA, 19 nt, Homo sapiens
guagaauuaucucuucauc

SEQ ID NO: 898025 - RNA, 19 nt, Homo sapiens
cagaauuugucaagauguu

SEQ ID NO: 898026 - RNA, 19 nt, Homo sapiens
ggacauucccaacuucuuc

SEQ ID NO: 898027 - RNA, 19 nt, Homo sapiens
ucaagaacaucuggaggaa

SEQ ID NO: 898028 - RNA, 19 nt, Homo sapiens
cauccuauauccaguaagu

SEQ ID NO: 898029 - RNA, 19 nt, Homo sapiens
acagguaguuccaaggauu

SEQ ID NO: 898030 - RNA, 19 nt, Homo sapiens
cccugaaacuucugaauga

SEQ ID NO: 898031 - RNA, 19 nt, Homo sapiens
ugagcacccugaagaaaug

SEQ ID NO: 898032 - RNA, 19 nt, Homo sapiens
cuaaugagcacccugaaga

SEQ ID NO: 898033 - RNA, 19 nt, Homo sapiens
aagcgcaucuuaggaauga

SEQ ID NO: 898034 - RNA, 19 nt, Homo sapiens
gaugcacaauugacccaaa

SEQ ID NO: 898035 - RNA, 19 nt, Homo sapiens
gcauucugccuuccucuaa

SEQ ID NO: 898036 - RNA, 19 nt, Homo sapiens
gaucagguuggucaaugua

SEQ ID NO: 898037 - RNA, 19 nt, Homo sapiens
cuaagaugcugaaggcaau

SEQ ID NO: 898038 - RNA, 19 nt, Homo sapiens
ccaaauggaggauguguuc

SEQ ID NO: 898039 - RNA, 19 nt, Homo sapiens
aagaaggcuuugacuggua

SEQ ID NO: 898040 - RNA, 19 nt, Homo sapiens
gcgaucagguuggucaaug

SEQ ID NO: 898041 - RNA, 19 nt, Homo sapiens
gcaugagaauuuauacaac

SEQ ID NO: 898042 - RNA, 19 nt, Homo sapiens
cuggaaauccugaaauaaa

SEQ ID NO: 898043 - RNA, 19 nt, Homo sapiens
ccgccuaucugguggagaa

SEQ ID NO: 898044 - RNA, 19 nt, Homo sapiens
ggccugauuucaaagaugu

SEQ ID NO: 898045 - RNA, 19 nt, Homo sapiens
acggaggccugauuucaaa

SEQ ID NO: 898046 - RNA, 19 nt, Homo sapiens
gcaagaguuugaccagacu

SEQ ID NO: 898047 - RNA, 19 nt, Homo sapiens
ucugaagacuguccugaug

SEQ ID NO: 898048 - RNA, 19 nt, Homo sapiens
ccaaacaagaugaaacaau

SEQ ID NO: 898049 - RNA, 19 nt, Homo sapiens
gggagucuuuggcagauuc

SEQ ID NO: 898050 - RNA, 19 nt, Homo sapiens
aaacaugucacuuccuaau

SEQ ID NO: 898051 - RNA, 19 nt, Homo sapiens
caugguacauuaguaguuc

SEQ ID NO: 898052 - RNA, 19 nt, Homo sapiens
uggcuuagcuauuaauacu

SEQ ID NO: 898053 - RNA, 19 nt, Homo sapiens
gcacucaagcgcaucuuag

SEQ ID NO: 898054 - RNA, 19 nt, Homo sapiens
aggaaaguauguuagcuau

SEQ ID NO: 898055 - RNA, 19 nt, Homo sapiens
ccgccacucuugguguuua

SEQ ID NO: 898056 - RNA, 19 nt, Homo sapiens
ggaccuggaaauccugaaa

SEQ ID NO: 898057 - RNA, 19 nt, Homo sapiens
gaaagugcugagaguucua

SEQ ID NO: 898058 - RNA, 19 nt, Homo sapiens
ucuauuuccuuuccaugaa

SEQ ID NO: 898059 - RNA, 19 nt, Homo sapiens
ucuaucacaucuacaaaca

SEQ ID NO: 898060 - RNA, 19 nt, Homo sapiens
caggaaaguauguuagcua

SEQ ID NO: 898061 - RNA, 19 nt, Homo sapiens
gaaacaaugaugacagacu

SEQ ID NO: 898062 - RNA, 19 nt, Homo sapiens
ggccagauucuccagauga

SEQ ID NO: 898063 - RNA, 19 nt, Homo sapiens
gaccacggaggccugauuu

SEQ ID NO: 898064 - RNA, 19 nt, Homo sapiens
uaugaaagugucagugaaa

SEQ ID NO: 898065 - RNA, 19 nt, Homo sapiens
cagugucucuauuuaugaa

SEQ ID NO: 898066 - RNA, 19 nt, Homo sapiens
caacuucuuccagcuguuu

SEQ ID NO: 898067 - RNA, 19 nt, Homo sapiens
cagaugaagaggugaagaa

SEQ ID NO: 898068 - RNA, 19 nt, Homo sapiens
uagcugguccucugugaaa

SEQ ID NO: 898069 - RNA, 19 nt, Homo sapiens
cugaagaaaugcagagaag

SEQ ID NO: 898070 - RNA, 19 nt, Homo sapiens
ugucugaacuggcaaacca

SEQ ID NO: 898071 - RNA, 19 nt, Homo sapiens
ucagcaguauggccagauu

SEQ ID NO: 898072 - RNA, 19 nt, Homo sapiens
gcaauagaagauuuaccaa

SEQ ID NO: 898073 - RNA, 19 nt, Homo sapiens
accuggaaauccugaaaua

SEQ ID NO: 898074 - RNA, 19 nt, Homo sapiens
gaauuugucaagauguuuc

SEQ ID NO: 898075 - RNA, 19 nt, Homo sapiens
ugacccaaauggaggaugu

SEQ ID NO: 898076 - RNA, 19 nt, Homo sapiens
gauaaccucuccaacuuua

SEQ ID NO: 898077 - RNA, 19 nt, Homo sapiens
agacaaaucugacugugua

SEQ ID NO: 898078 - RNA, 19 nt, Homo sapiens
ggaagaaggccuguuauuu

SEQ ID NO: 898079 - RNA, 19 nt, Homo sapiens
gaacauagucugcaaaucu

SEQ ID NO: 898080 - RNA, 19 nt, Homo sapiens
gaauggaccuguuauacug

SEQ ID NO: 898081 - RNA, 19 nt, Homo sapiens
uggcuuagcuugacuguuu

SEQ ID NO: 898082 - RNA, 19 nt, Homo sapiens
cuaaauaagcgaagaguua

SEQ ID NO: 898083 - RNA, 19 nt, Homo sapiens
gaggaaaacuguugaagua

SEQ ID NO: 898084 - RNA, 19 nt, Homo sapiens
gcucauguaugucuauauu

SEQ ID NO: 898085 - RNA, 19 nt, Homo sapiens
gccaguauauuuaaaggua

SEQ ID NO: 898086 - RNA, 19 nt, Homo sapiens
gaaaguggcaucacaagga

SEQ ID NO: 898087 - RNA, 19 nt, Homo sapiens
acacauggcugcuaauuca

SEQ ID NO: 898088 - RNA, 19 nt, Homo sapiens
gcauagaauugcauccauu

SEQ ID NO: 898089 - RNA, 19 nt, Homo sapiens
gaagaaggccuguuauuuu

SEQ ID NO: 898090 - RNA, 19 nt, Homo sapiens
cauccauucuucugaaaua

SEQ ID NO: 898091 - RNA, 19 nt, Homo sapiens
gagauaaugaugaguguuu

SEQ ID NO: 898092 - RNA, 19 nt, Homo sapiens
aaaccugacugugcacuua

SEQ ID NO: 898093 - RNA, 19 nt, Homo sapiens
ccucaaggauguaauucua

SEQ ID NO: 898094 - RNA, 19 nt, Homo sapiens
ccucugggauaaagucuua

SEQ ID NO: 898095 - RNA, 19 nt, Homo sapiens
caggauggcuguugggauu

SEQ ID NO: 898096 - RNA, 19 nt, Homo sapiens
gcuaauaggugccaauacu

SEQ ID NO: 898097 - RNA, 19 nt, Homo sapiens
guaaugagauaaugaugag

SEQ ID NO: 898098 - RNA, 19 nt, Homo sapiens
ucagguagacuuacacuuu

SEQ ID NO: 898099 - RNA, 19 nt, Homo sapiens
gaaugugucccuacuauag

SEQ ID NO: 898100 - RNA, 19 nt, Homo sapiens
gaacuuucauagccaguca

SEQ ID NO: 898101 - RNA, 19 nt, Homo sapiens
gagacgggcuguuccugaa

SEQ ID NO: 898102 - RNA, 19 nt, Homo sapiens
caagagauuuggccuccuu

SEQ ID NO: 898103 - RNA, 19 nt, Homo sapiens
gacgggcuguuccugaaua

SEQ ID NO: 898104 - RNA, 19 nt, Homo sapiens
ggaaaacuguugaaguauu

SEQ ID NO: 898105 - RNA, 19 nt, Homo sapiens
gcacuuaccaauaguauac

SEQ ID NO: 898106 - RNA, 19 nt, Homo sapiens
ggaaugaggaauaguuuag

SEQ ID NO: 898107 - RNA, 19 nt, Homo sapiens
ggaaugugucccuacuaua

SEQ ID NO: 898108 - RNA, 19 nt, Homo sapiens
guuguuaucugucuauuac

SEQ ID NO: 898109 - RNA, 19 nt, Homo sapiens
guaggugcauuuguuuaaa

SEQ ID NO: 898110 - RNA, 19 nt, Homo sapiens
ggaguggaaugaggaauag

SEQ ID NO: 898111 - RNA, 19 nt, Homo sapiens
caagugagcucagcagcau

SEQ ID NO: 898112 - RNA, 19 nt, Homo sapiens
guugugcacuuaccaauag

SEQ ID NO: 898113 - RNA, 19 nt, Homo sapiens
uaucagaauggaccuguua

SEQ ID NO: 898114 - RNA, 19 nt, Homo sapiens
ucagaaagccuagagagaa

SEQ ID NO: 898115 - RNA, 19 nt, Homo sapiens
gguaaugagauaaugauga

SEQ ID NO: 898116 - RNA, 19 nt, Homo sapiens
ggacacauggcugcuaauu

SEQ ID NO: 898117 - RNA, 19 nt, Homo sapiens
ggaaccauguuuugucuuu

SEQ ID NO: 898118 - RNA, 19 nt, Homo sapiens
cuuguaagcuccucacaga

SEQ ID NO: 898119 - RNA, 19 nt, Homo sapiens
gggaagaaggccuguuauu

SEQ ID NO: 898120 - RNA, 19 nt, Homo sapiens
cuucguaauucgugccuua

SEQ ID NO: 898121 - RNA, 19 nt, Homo sapiens
cuacugggcuuccucuauc

SEQ ID NO: 898122 - RNA, 19 nt, Homo sapiens
uccagugccuaguauauaa

SEQ ID NO: 898123 - RNA, 19 nt, Homo sapiens
acuaauugauuccuuguga

SEQ ID NO: 898124 - RNA, 19 nt, Homo sapiens
gaaguucaggucaacaaau

SEQ ID NO: 898125 - RNA, 19 nt, Homo sapiens
uucaucagcuuaucauuga

SEQ ID NO: 898126 - RNA, 19 nt, Homo sapiens
uauuaagacuggacacaug

SEQ ID NO: 898127 - RNA, 19 nt, Homo sapiens
uugauaaccucuccaacuu

SEQ ID NO: 898128 - RNA, 19 nt, Homo sapiens
ggagaaaaguggagguaga

SEQ ID NO: 898129 - RNA, 19 nt, Homo sapiens
cagaaagccuagagagaag

SEQ ID NO: 898130 - RNA, 19 nt, Homo sapiens
aaguucaggucaacaaauu

SEQ ID NO: 898131 - RNA, 19 nt, Homo sapiens
ugacugugcacuuacuaua

SEQ ID NO: 898132 - RNA, 19 nt, Homo sapiens
cagguagacuuacacuuuc

SEQ ID NO: 898133 - RNA, 19 nt, Homo sapiens
gggauuaggaguggaauga

SEQ ID NO: 898134 - RNA, 19 nt, Homo sapiens
caccauauauaccauuaca

SEQ ID NO: 898135 - RNA, 19 nt, Homo sapiens
guauacaagggaucuauga

SEQ ID NO: 898136 - RNA, 19 nt, Homo sapiens
cccauuugcucauguaugu

SEQ ID NO: 898137 - RNA, 19 nt, Homo sapiens
cguaauucgugccuuauca

SEQ ID NO: 898138 - RNA, 19 nt, Homo sapiens
aaaugaaaguggcaucaca

SEQ ID NO: 898139 - RNA, 19 nt, Homo sapiens
aaguggagguagaaaugua

SEQ ID NO: 898140 - RNA, 19 nt, Homo sapiens
gcgaagaguuaauuuugaa

SEQ ID NO: 898141 - RNA, 19 nt, Homo sapiens
ucagaauggaccuguuaua

SEQ ID NO: 898142 - RNA, 19 nt, Homo sapiens
guaggaaggccucaaggau

SEQ ID NO: 898143 - RNA, 19 nt, Homo sapiens
uagaugagauguccuucca

SEQ ID NO: 898144 - RNA, 19 nt, Homo sapiens
aggaaggccucaaggaugu

SEQ ID NO: 898145 - RNA, 19 nt, Homo sapiens
guagcugagucuccaguca

SEQ ID NO: 898146 - RNA, 19 nt, Homo sapiens
gcugacugguguagguuug

SEQ ID NO: 898147 - RNA, 19 nt, Homo sapiens
gcuugacuguuucccuauu

SEQ ID NO: 898148 - RNA, 19 nt, Homo sapiens
ucacagacaggaaccaugu

SEQ ID NO: 898149 - RNA, 19 nt, Homo sapiens
gaaggccuguuauuuuguu

SEQ ID NO: 898150 - RNA, 19 nt, Homo sapiens
ccagucaagcauagaauug

SEQ ID NO: 898151 - RNA, 19 nt, Homo sapiens
uguccuuuaugguucuuua

SEQ ID NO: 898152 - RNA, 19 nt, Homo sapiens
ccuauucacuccuguucug

SEQ ID NO: 898153 - RNA, 19 nt, Homo sapiens
gcccuugcuugcuuuccua

SEQ ID NO: 898154 - RNA, 19 nt, Homo sapiens
gaaggccucaaggauguaa

SEQ ID NO: 898155 - RNA, 19 nt, Homo sapiens
uaaccucuccaacuuuaug

SEQ ID NO: 898156 - RNA, 19 nt, Homo sapiens
gguuguuaucugucuauua

SEQ ID NO: 898157 - RNA, 19 nt, Homo sapiens
aagaaggccuguuauuuug

SEQ ID NO: 898158 - RNA, 19 nt, Homo sapiens
aaugaggaauaguuuagga

SEQ ID NO: 898159 - RNA, 19 nt, Homo sapiens
cauagccagucaagcauag

SEQ ID NO: 898160 - RNA, 19 nt, Homo sapiens
uguaggugcauuuguuuaa

SEQ ID NO: 898161 - RNA, 19 nt, Homo sapiens
ucuccagccaguauauuua

SEQ ID NO: 898162 - RNA, 19 nt, Homo sapiens
caucagcuuaucauugaaa

SEQ ID NO: 898163 - RNA, 19 nt, Homo sapiens
gcuaauucaucagcuuauc

SEQ ID NO: 898164 - RNA, 19 nt, Homo sapiens
ggauggcuguugggauuag

SEQ ID NO: 898165 - RNA, 19 nt, Homo sapiens
uggcaguucaccauauaua

SEQ ID NO: 898166 - RNA, 19 nt, Homo sapiens
guucaaauagaaaccauuc

SEQ ID NO: 898167 - RNA, 19 nt, Homo sapiens
cuggacacauggcugcuaa

SEQ ID NO: 898168 - RNA, 19 nt, Homo sapiens
agucuuaucucaguuuaca

SEQ ID NO: 898169 - RNA, 19 nt, Homo sapiens
guggaaugaggaauaguuu

SEQ ID NO: 898170 - RNA, 19 nt, Homo sapiens
ugggauuccucucugcaaa

SEQ ID NO: 898171 - RNA, 19 nt, Homo sapiens
uaauaggugccaauacugu

SEQ ID NO: 898172 - RNA, 19 nt, Homo sapiens
gugcuaauaggugccaaua

SEQ ID NO: 898173 - RNA, 19 nt, Homo sapiens
cucccucucugguauguuu

SEQ ID NO: 898174 - RNA, 19 nt, Homo sapiens
caucgcccuugcuugcuuu

SEQ ID NO: 898175 - RNA, 19 nt, Homo sapiens
gagauuuggccuccuugga

SEQ ID NO: 898176 - RNA, 19 nt, Homo sapiens
caacagaaaucacagaaga

SEQ ID NO: 898177 - RNA, 19 nt, Homo sapiens
cagaagagcuacagaaaga

SEQ ID NO: 898178 - RNA, 19 nt, Homo sapiens
uuacauagccuucuaagua

SEQ ID NO: 898179 - RNA, 19 nt, Homo sapiens
gauaugaagcgaaccauua

SEQ ID NO: 898180 - RNA, 19 nt, Homo sapiens
gaaagcccgucuauuccua

SEQ ID NO: 898181 - RNA, 19 nt, Homo sapiens
gacaggauuccaauaauua

SEQ ID NO: 898182 - RNA, 19 nt, Homo sapiens
caaugaauguggaauagaa

SEQ ID NO: 898183 - RNA, 19 nt, Homo sapiens
guaaagguguugcuggaaa

SEQ ID NO: 898184 - RNA, 19 nt, Homo sapiens
uaaagaugcucaccuuguu

SEQ ID NO: 898185 - RNA, 19 nt, Homo sapiens
ggaagaagugguaggauuu

SEQ ID NO: 898186 - RNA, 19 nt, Homo sapiens
gaaaaggagugcaaagaaa

SEQ ID NO: 898187 - RNA, 19 nt, Homo sapiens
agacagaaaucaagaacaa

SEQ ID NO: 898188 - RNA, 19 nt, Homo sapiens
ugacaggauuccaauaauu

SEQ ID NO: 898189 - RNA, 19 nt, Homo sapiens
gcagugagcuaugaugaug

SEQ ID NO: 898190 - RNA, 19 nt, Homo sapiens
uggaucagaugguuuauaa

SEQ ID NO: 898191 - RNA, 19 nt, Homo sapiens
gagaagcccuccuaugaca

SEQ ID NO: 898192 - RNA, 19 nt, Homo sapiens
gaagcgaaccauuaauaaa

SEQ ID NO: 898193 - RNA, 19 nt, Homo sapiens
gaagaagugguaggauuua

SEQ ID NO: 898194 - RNA, 19 nt, Homo sapiens
ucacagguguuucuaucua

SEQ ID NO: 898195 - RNA, 19 nt, Homo sapiens
uuggugagcugcauauaua

SEQ ID NO: 898196 - RNA, 19 nt, Homo sapiens
gaacaagaugcaacagaaa

SEQ ID NO: 898197 - RNA, 19 nt, Homo sapiens
gaucagagaaagcaauuga

SEQ ID NO: 898198 - RNA, 19 nt, Homo sapiens
uacauagccuucuaaguaa

SEQ ID NO: 898199 - RNA, 19 nt, Homo sapiens
gaugggaucagucagauaa

SEQ ID NO: 898200 - RNA, 19 nt, Homo sapiens
ggaaaaggcuacuaggaaa

SEQ ID NO: 898201 - RNA, 19 nt, Homo sapiens
caaaggagacacggaauuu

SEQ ID NO: 898202 - RNA, 19 nt, Homo sapiens
gcauacaaauacuagaaga

SEQ ID NO: 898203 - RNA, 19 nt, Homo sapiens
gcagacacaaugcauauga

SEQ ID NO: 898204 - RNA, 19 nt, Homo sapiens
cagaauagcagacacaaug

SEQ ID NO: 898205 - RNA, 19 nt, Homo sapiens
gaauuuggaagaaguggua

SEQ ID NO: 898206 - RNA, 19 nt, Homo sapiens
agaacaagaugcaacagaa

SEQ ID NO: 898207 - RNA, 19 nt, Homo sapiens
acagaaagaucuagaagag

SEQ ID NO: 898208 - RNA, 19 nt, Homo sapiens
gcuaagaauuggaaaagua

SEQ ID NO: 898209 - RNA, 19 nt, Homo sapiens
aagagaagcccuccuauga

SEQ ID NO: 898210 - RNA, 19 nt, Homo sapiens
gguauuagccaacacaguu

SEQ ID NO: 898211 - RNA, 19 nt, Homo sapiens
gaagauggagacgaugaua

SEQ ID NO: 898212 - RNA, 19 nt, Homo sapiens
gaacagaauagcagacaca

SEQ ID NO: 898213 - RNA, 19 nt, Homo sapiens
gaaggguuauauugcauuc

SEQ ID NO: 898214 - RNA, 19 nt, Homo sapiens
uagaagagguaaagguguu

SEQ ID NO: 898215 - RNA, 19 nt, Homo sapiens
gaaggguaaacuaaacuaa

SEQ ID NO: 898216 - RNA, 19 nt, Homo sapiens
gugaugugauguggaaaua

SEQ ID NO: 898217 - RNA, 19 nt, Homo sapiens
gagaggucauuugaucuuu

SEQ ID NO: 898218 - RNA, 19 nt, Homo sapiens
ccugugaucuccauuacuu

SEQ ID NO: 898219 - RNA, 19 nt, Homo sapiens
guaaagaugcucaccuugu

SEQ ID NO: 898220 - RNA, 19 nt, Homo sapiens
uggaagaagugguaggauu

SEQ ID NO: 898221 - RNA, 19 nt, Homo sapiens
cagcuuggguaacagauug

SEQ ID NO: 898222 - RNA, 19 nt, Homo sapiens
ucaaggaaggguuauauug

SEQ ID NO: 898223 - RNA, 19 nt, Homo sapiens
aaacacuccugcaaagaug

SEQ ID NO: 898224 - RNA, 19 nt, Homo sapiens
gaugugauguggaaauacu

SEQ ID NO: 898225 - RNA, 19 nt, Homo sapiens
ugaagcgaaccauuaauaa

SEQ ID NO: 898226 - RNA, 19 nt, Homo sapiens
gcuugaagguugcuguaga

SEQ ID NO: 898227 - RNA, 19 nt, Homo sapiens
uaauaaagccuggguggaa

SEQ ID NO: 898228 - RNA, 19 nt, Homo sapiens
caccauaacccaaggcaaa

SEQ ID NO: 898229 - RNA, 19 nt, Homo sapiens
gccugacgaucuaauugua

SEQ ID NO: 898230 - RNA, 19 nt, Homo sapiens
ccagaaggguaaacuaaac

SEQ ID NO: 898231 - RNA, 19 nt, Homo sapiens
gguaacagauugagaaccu

SEQ ID NO: 898232 - RNA, 19 nt, Homo sapiens
gaaagaucuagaagaggua

SEQ ID NO: 898233 - RNA, 19 nt, Homo sapiens
ugugaacaaucucuugaaa

SEQ ID NO: 898234 - RNA, 19 nt, Homo sapiens
ggaggaaaacgacauuaua

SEQ ID NO: 898235 - RNA, 19 nt, Homo sapiens
gaagagcuacagaaagauc

SEQ ID NO: 898236 - RNA, 19 nt, Homo sapiens
gaagagaauaaaccagugu

SEQ ID NO: 898237 - RNA, 19 nt, Homo sapiens
guauuagccaacacaguua

SEQ ID NO: 898238 - RNA, 19 nt, Homo sapiens
ggaucagucagauaaguuu

SEQ ID NO: 898239 - RNA, 19 nt, Homo sapiens
caagccgccugacgaucua

SEQ ID NO: 898240 - RNA, 19 nt, Homo sapiens
guugacacaugaacagaau

SEQ ID NO: 898241 - RNA, 19 nt, Homo sapiens
ccuaugcucaauaaaguua

SEQ ID NO: 898242 - RNA, 19 nt, Homo sapiens
gcauaugaaaguuacagaa

SEQ ID NO: 898243 - RNA, 19 nt, Homo sapiens
gaaucuaaaugggaagagu

SEQ ID NO: 898244 - RNA, 19 nt, Homo sapiens
gaaaguuacagaauauggu

SEQ ID NO: 898245 - RNA, 19 nt, Homo sapiens
cagacacaaugcauaugaa

SEQ ID NO: 898246 - RNA, 19 nt, Homo sapiens
aaucacagguguuucuauc

SEQ ID NO: 898247 - RNA, 19 nt, Homo sapiens
ccaaaggagacacggaauu

SEQ ID NO: 898248 - RNA, 19 nt, Homo sapiens
uaaacacuccugcaaagau

SEQ ID NO: 898249 - RNA, 19 nt, Homo sapiens
gaaagaaaguggaaaacac

SEQ ID NO: 898250 - RNA, 19 nt, Homo sapiens
uuugaaagcccgucuauuc

SEQ ID NO: 898251 - RNA, 19 nt, Homo sapiens
ggaaggguuauauugcauu

SEQ ID NO: 898252 - RNA, 19 nt, Homo sapiens
cuacuggaggauuuauuua

SEQ ID NO: 898253 - RNA, 19 nt, Homo sapiens
ugacagauagcuauuuaca

SEQ ID NO: 898254 - RNA, 19 nt, Homo sapiens
gagagaagcaagccaaagg

SEQ ID NO: 898255 - RNA, 19 nt, Homo sapiens
ugaacaaucucuugaaacc

SEQ ID NO: 898256 - RNA, 19 nt, Homo sapiens
agaagaaaauggaggaaaa

SEQ ID NO: 898257 - RNA, 19 nt, Homo sapiens
ugugaucuccauuacuuua

SEQ ID NO: 898258 - RNA, 19 nt, Homo sapiens
gugagggauugaugaaugu

SEQ ID NO: 898259 - RNA, 19 nt, Homo sapiens
acagaaaucacagaagaaa

SEQ ID NO: 898260 - RNA, 19 nt, Homo sapiens
caaugcauaugaaaguuac

SEQ ID NO: 898261 - RNA, 19 nt, Homo sapiens
uacuaaggcuggaggauca

SEQ ID NO: 898262 - RNA, 19 nt, Homo sapiens
uagagcaucugaccccuua

SEQ ID NO: 898263 - RNA, 19 nt, Homo sapiens
cugcaaagaugguuuuauu

SEQ ID NO: 898264 - RNA, 19 nt, Homo sapiens
gaauauuggugagcugcau

SEQ ID NO: 898265 - RNA, 19 nt, Homo sapiens
cugacgaucuaauuguaaa

SEQ ID NO: 898266 - RNA, 19 nt, Homo sapiens
uagcagacacaaugcauau

SEQ ID NO: 898267 - RNA, 19 nt, Homo sapiens
gcaaagaugguuuuauuag

SEQ ID NO: 898268 - RNA, 19 nt, Homo sapiens
agugagggauugaugaaug

SEQ ID NO: 898269 - RNA, 19 nt, Homo sapiens
acagaaaucaagaacaaga

SEQ ID NO: 898270 - RNA, 19 nt, Homo sapiens
acacaaugcauaugaaagu

SEQ ID NO: 898271 - RNA, 19 nt, Homo sapiens
gaagugguaggauuuaaaa

SEQ ID NO: 898272 - RNA, 19 nt, Homo sapiens
aagaagugguaggauuuaa

SEQ ID NO: 898273 - RNA, 19 nt, Homo sapiens
acaguuagaucagagaaag

SEQ ID NO: 898274 - RNA, 19 nt, Homo sapiens
ccaacacaguuagaucaga

SEQ ID NO: 898275 - RNA, 19 nt, Homo sapiens
ggugagcugcauauauaaa

SEQ ID NO: 898276 - RNA, 19 nt, Homo sapiens
guaguuaacuggaauguaa

SEQ ID NO: 898277 - RNA, 19 nt, Homo sapiens
gcacagacauccuacagaa

SEQ ID NO: 898278 - RNA, 19 nt, Homo sapiens
gcagcgaucugaugaauug

SEQ ID NO: 898279 - RNA, 19 nt, Homo sapiens
gaaggacgccucaucauuu

SEQ ID NO: 898280 - RNA, 19 nt, Homo sapiens
gaaguacaccaccaauuua

SEQ ID NO: 898281 - RNA, 19 nt, Homo sapiens
gaucugaagccaagaaaua

SEQ ID NO: 898282 - RNA, 19 nt, Homo sapiens
aguagcagcucauccauua

SEQ ID NO: 898283 - RNA, 19 nt, Homo sapiens
gaaccaaacccacuucguu

SEQ ID NO: 898284 - RNA, 19 nt, Homo sapiens
gauaaaagcucaacuucuu

SEQ ID NO: 898285 - RNA, 19 nt, Homo sapiens
ggaaggaucugaguaugau

SEQ ID NO: 898286 - RNA, 19 nt, Homo sapiens
gauuaagggugcaacuaaa

SEQ ID NO: 898287 - RNA, 19 nt, Homo sapiens
gaacuugccaucuuaggaa

SEQ ID NO: 898288 - RNA, 19 nt, Homo sapiens
gaacuaaagaagcagcuaa

SEQ ID NO: 898289 - RNA, 19 nt, Homo sapiens
ugaaguacaccaccaauuu

SEQ ID NO: 898290 - RNA, 19 nt, Homo sapiens
gagacuacaucacaacaga

SEQ ID NO: 898291 - RNA, 19 nt, Homo sapiens
gaaaauggcuuggcugguu

SEQ ID NO: 898292 - RNA, 19 nt, Homo sapiens
uauacaaggucaggaauaa

SEQ ID NO: 898293 - RNA, 19 nt, Homo sapiens
gcacaaacuucacguuacu

SEQ ID NO: 898294 - RNA, 19 nt, Homo sapiens
agacagagcugccauugag

SEQ ID NO: 898295 - RNA, 19 nt, Homo sapiens
aagagaaucuggugaacuu

SEQ ID NO: 898296 - RNA, 19 nt, Homo sapiens
gaaaguagcagcucaucca

SEQ ID NO: 898297 - RNA, 19 nt, Homo sapiens
gcagaaauccagguguuaa

SEQ ID NO: 898298 - RNA, 19 nt, Homo sapiens
caucacaacagagcuauua

SEQ ID NO: 898299 - RNA, 19 nt, Homo sapiens
cacgguagauggcguauga

SEQ ID NO: 898300 - RNA, 19 nt, Homo sapiens
gguacuuccuccuuuauug

SEQ ID NO: 898301 - RNA, 19 nt, Homo sapiens
gaaauugcagaacuaaaga

SEQ ID NO: 898302 - RNA, 19 nt, Homo sapiens
gaagagaacaccaacacau

SEQ ID NO: 898303 - RNA, 19 nt, Homo sapiens
cgaagaaaaugucaacuuu

SEQ ID NO: 898304 - RNA, 19 nt, Homo sapiens
caaggucaggaauaaauua

SEQ ID NO: 898305 - RNA, 19 nt, Homo sapiens
caccaccaauuuagucaua

SEQ ID NO: 898306 - RNA, 19 nt, Homo sapiens
cagcagaaauccagguguu

SEQ ID NO: 898307 - RNA, 19 nt, Homo sapiens
ggaaguagccuuggaagca

SEQ ID NO: 898308 - RNA, 19 nt, Homo sapiens
caagacagguguuuaagcu

SEQ ID NO: 898309 - RNA, 19 nt, Homo sapiens
ggguauaguugguacaaug

SEQ ID NO: 898310 - RNA, 19 nt, Homo sapiens
agagagcaaugugguguua

SEQ ID NO: 898311 - RNA, 19 nt, Homo sapiens
ggucaggaauaaauuagau

SEQ ID NO: 898312 - RNA, 19 nt, Homo sapiens
ccauaugccuagucucuga

SEQ ID NO: 898313 - RNA, 19 nt, Homo sapiens
gugaggauauuucucguau

SEQ ID NO: 898314 - RNA, 19 nt, Homo sapiens
gaccucauccucaauuauu

SEQ ID NO: 898315 - RNA, 19 nt, Homo sapiens
gaagauaauagagcaagaa

SEQ ID NO: 898316 - RNA, 19 nt, Homo sapiens
ccaauuuagucauaagaga

SEQ ID NO: 898317 - RNA, 19 nt, Homo sapiens
guucaagacagguguuuaa

SEQ ID NO: 898318 - RNA, 19 nt, Homo sapiens
gaaguucuaacagguuuaa

SEQ ID NO: 898319 - RNA, 19 nt, Homo sapiens
ugacgaaucugauguucca

SEQ ID NO: 898320 - RNA, 19 nt, Homo sapiens
caacagaaacgggaagaga

SEQ ID NO: 898321 - RNA, 19 nt, Homo sapiens
gaauaugacgaaucugaug

SEQ ID NO: 898322 - RNA, 19 nt, Homo sapiens
gaggagaguuucacaucca

SEQ ID NO: 898323 - RNA, 19 nt, Homo sapiens
uggagaaucugacacugaa

SEQ ID NO: 898324 - RNA, 19 nt, Homo sapiens
uaagguaguuaacuggaau

SEQ ID NO: 898325 - RNA, 19 nt, Homo sapiens
gggcugcugucuucuuuca

SEQ ID NO: 898326 - RNA, 19 nt, Homo sapiens
gguagauggcguaugauuu

SEQ ID NO: 898327 - RNA, 19 nt, Homo sapiens
cauacucacuggacuguuc

SEQ ID NO: 898328 - RNA, 19 nt, Homo sapiens
aagagaacaccaacacaua

SEQ ID NO: 898329 - RNA, 19 nt, Homo sapiens
gcucauccauuaucuuugc

SEQ ID NO: 898330 - RNA, 19 nt, Homo sapiens
cagcucauccauuaucuuu

SEQ ID NO: 898331 - RNA, 19 nt, Homo sapiens
agagcaaugugguguuaaa

SEQ ID NO: 898332 - RNA, 19 nt, Homo sapiens
ugaaggacgccucaucauu

SEQ ID NO: 898333 - RNA, 19 nt, Homo sapiens
ggugagggaugacggaaag

SEQ ID NO: 898334 - RNA, 19 nt, Homo sapiens
gagaaucuggugaacuuga

SEQ ID NO: 898335 - RNA, 19 nt, Homo sapiens
guauacaaggucaggaaua

SEQ ID NO: 898336 - RNA, 19 nt, Homo sapiens
aagcacaaacuucacguua

SEQ ID NO: 898337 - RNA, 19 nt, Homo sapiens
cauaagagaaucuggugaa

SEQ ID NO: 898338 - RNA, 19 nt, Homo sapiens
acaaacuucacguuacuua

SEQ ID NO: 898339 - RNA, 19 nt, Homo sapiens
uuaaugaggucugcuaaag

SEQ ID NO: 898340 - RNA, 19 nt, Homo sapiens
cuacuuugccagacguuua

SEQ ID NO: 898341 - RNA, 19 nt, Homo sapiens
gcgaucugaugaauugguu

SEQ ID NO: 898342 - RNA, 19 nt, Homo sapiens
uaaaccuccuuucucaaga

SEQ ID NO: 898343 - RNA, 19 nt, Homo sapiens
caacacauacguccagagu

SEQ ID NO: 898344 - RNA, 19 nt, Homo sapiens
ugauuaagggugcaacuaa

SEQ ID NO: 898345 - RNA, 19 nt, Homo sapiens
gauggucaguauuaugcaa

SEQ ID NO: 898346 - RNA, 19 nt, Homo sapiens
agagagaguucgucaggau

SEQ ID NO: 898347 - RNA, 19 nt, Homo sapiens
agucagauauguacagcuu

SEQ ID NO: 898348 - RNA, 19 nt, Homo sapiens
ggaagaggacagagagcaa

SEQ ID NO: 898349 - RNA, 19 nt, Homo sapiens
gaggucugcuaaagagaga

SEQ ID NO: 898350 - RNA, 19 nt, Homo sapiens
acagagcuauuacucacuu

SEQ ID NO: 898351 - RNA, 19 nt, Homo sapiens
guagauggcguaugauuuu

SEQ ID NO: 898352 - RNA, 19 nt, Homo sapiens
ucugcugccucuaagauaa

SEQ ID NO: 898353 - RNA, 19 nt, Homo sapiens
ccaaaauucuggaaauguu

SEQ ID NO: 898354 - RNA, 19 nt, Homo sapiens
auacauaacaugggaauug

SEQ ID NO: 898355 - RNA, 19 nt, Homo sapiens
ugaguaugaugccaaguca

SEQ ID NO: 898356 - RNA, 19 nt, Homo sapiens
gagucugccuguccuuaug

SEQ ID NO: 898357 - RNA, 19 nt, Homo sapiens
ugacgaguuuagcucauug

SEQ ID NO: 898358 - RNA, 19 nt, Homo sapiens
uaaagaagcagcuaaaccu

SEQ ID NO: 898359 - RNA, 19 nt, Homo sapiens
uaaccucacccuacagaug

SEQ ID NO: 898360 - RNA, 19 nt, Homo sapiens
acagacauccuacagaaga

SEQ ID NO: 898361 - RNA, 19 nt, Homo sapiens
ccgaauaugacgaaucuga

SEQ ID NO: 898362 - RNA, 19 nt, Homo sapiens
caaacuucacguuacuuaa

SEQ ID NO: 898363 - RNA, 19 nt, Homo sapiens
ggaccucauccucaauuau

SEQ ID NO: 898364 - RNA, 19 nt, Homo sapiens
ucuaacagguuuaagaacu

SEQ ID NO: 898365 - RNA, 19 nt, Homo sapiens
gaagaggacagagagcaau

SEQ ID NO: 898366 - RNA, 19 nt, Homo sapiens
ccuccuuucucaagacaaa

SEQ ID NO: 898367 - RNA, 19 nt, Homo sapiens
uugcagaacuaaagaagca

SEQ ID NO: 898368 - RNA, 19 nt, Homo sapiens
ugaagauaauagagcaaga

SEQ ID NO: 898369 - RNA, 19 nt, Homo sapiens
cuacagaugaagauaauag

SEQ ID NO: 898370 - RNA, 19 nt, Homo sapiens
gaagguguguuuuacauac

SEQ ID NO: 898371 - RNA, 19 nt, Homo sapiens
cagaaauccagguguuaaa

SEQ ID NO: 898372 - RNA, 19 nt, Homo sapiens
gaguauacaaggucaggaa

SEQ ID NO: 898373 - RNA, 19 nt, Homo sapiens
aaugaggucugcuaaagag

SEQ ID NO: 898374 - RNA, 19 nt, Homo sapiens
gugacgaguuuagcucauu

SEQ ID NO: 898375 - RNA, 19 nt, Homo sapiens
ccaggcagcucagaucucu

SEQ ID NO: 898376 - RNA, 19 nt, Homo sapiens
ccgagagacuguuuaauaa

SEQ ID NO: 898377 - RNA, 19 nt, Homo sapiens
guuaaacgaugaagaauuc

SEQ ID NO: 898378 - RNA, 19 nt, Homo sapiens
caaggaagguguucacugu

SEQ ID NO: 898379 - RNA, 19 nt, Homo sapiens
gcagacgaaugaggaauaa

SEQ ID NO: 898380 - RNA, 19 nt, Homo sapiens
gaaccaagucucagaguga

SEQ ID NO: 898381 - RNA, 19 nt, Homo sapiens
acacugggcucccuguuaa

SEQ ID NO: 898382 - RNA, 19 nt, Homo sapiens
ugauaugccuuaagaauuc

SEQ ID NO: 898383 - RNA, 19 nt, Homo sapiens
ggacaggcaagaccagaua

SEQ ID NO: 898384 - RNA, 19 nt, Homo sapiens
aaacagagccagacauaga

SEQ ID NO: 898385 - RNA, 19 nt, Homo sapiens
ggacagaggucagccuaag

SEQ ID NO: 898386 - RNA, 19 nt, Homo sapiens
gcaggugccucagaguuga

SEQ ID NO: 898387 - RNA, 19 nt, Homo sapiens
caagacagugacagcauua

SEQ ID NO: 898388 - RNA, 19 nt, Homo sapiens
gaagaauucaagacaguga

SEQ ID NO: 898389 - RNA, 19 nt, Homo sapiens
ucacagaaccagaagaaga

SEQ ID NO: 898390 - RNA, 19 nt, Homo sapiens
agaaacagagccagacaua

SEQ ID NO: 898391 - RNA, 19 nt, Homo sapiens
ucaagacagugacagcauu

SEQ ID NO: 898392 - RNA, 19 nt, Homo sapiens
uagcugaggcuuuggagua

SEQ ID NO: 898393 - RNA, 19 nt, Homo sapiens
uccgagagacuguuuaaua

SEQ ID NO: 898394 - RNA, 19 nt, Homo sapiens
ggaauaaaggucagagaag

SEQ ID NO: 898395 - RNA, 19 nt, Homo sapiens
caucacagaaccagaagaa

SEQ ID NO: 898396 - RNA, 19 nt, Homo sapiens
aaaguaaacguguggagaa

SEQ ID NO: 898397 - RNA, 19 nt, Homo sapiens
ccagauacccaaugugcaa

SEQ ID NO: 898398 - RNA, 19 nt, Homo sapiens
ggcagacgaaugaggaaua

SEQ ID NO: 898399 - RNA, 19 nt, Homo sapiens
gagagacuguuuaauaacc

SEQ ID NO: 898400 - RNA, 19 nt, Homo sapiens
ggccugggacucagcauuu

SEQ ID NO: 898401 - RNA, 19 nt, Homo sapiens
uacccaaugugcaaaguga

SEQ ID NO: 898402 - RNA, 19 nt, Homo sapiens
gcuggaaucugacuuaccu

SEQ ID NO: 898403 - RNA, 19 nt, Homo sapiens
gcccgauccugguacugua

SEQ ID NO: 898404 - RNA, 19 nt, Homo sapiens
cagcaucacagaaccagaa

SEQ ID NO: 898405 - RNA, 19 nt, Homo sapiens
guucuucgccuacauccaa

SEQ ID NO: 898406 - RNA, 19 nt, Homo sapiens
ggagaggucaucccugucu

SEQ ID NO: 898407 - RNA, 19 nt, Homo sapiens
gauaugccuuaagaauuca

SEQ ID NO: 898408 - RNA, 19 nt, Homo sapiens
ggaagguguucacugucau

SEQ ID NO: 898409 - RNA, 19 nt, Homo sapiens
ccuguuaaacgaugaagaa

SEQ ID NO: 898410 - RNA, 19 nt, Homo sapiens
ucagcaggcagacgaauga

SEQ ID NO: 898411 - RNA, 19 nt, Homo sapiens
auagacaguuccagcauca

SEQ ID NO: 898412 - RNA, 19 nt, Homo sapiens
caaggucuguguggauauc

SEQ ID NO: 898413 - RNA, 19 nt, Homo sapiens
gaaacagagccagacauag

SEQ ID NO: 898414 - RNA, 19 nt, Homo sapiens
ggagaaacagagccagaca

SEQ ID NO: 898415 - RNA, 19 nt, Homo sapiens
cucaaggucuguguggaua

SEQ ID NO: 898416 - RNA, 19 nt, Homo sapiens
acgcagagcuacagugaac

SEQ ID NO: 898417 - RNA, 19 nt, Homo sapiens
aaguaaacguguggagaaa

SEQ ID NO: 898418 - RNA, 19 nt, Homo sapiens
agagcuauguggagucugu

SEQ ID NO: 898419 - RNA, 19 nt, Homo sapiens
agaagagaccugcaacugu

SEQ ID NO: 898420 - RNA, 19 nt, Homo sapiens
gaagaagagaccugcaacu

SEQ ID NO: 898421 - RNA, 19 nt, Homo sapiens
gagaggucaucccugucuu

SEQ ID NO: 898422 - RNA, 19 nt, Homo sapiens
aggaagguguucacuguca

SEQ ID NO: 898423 - RNA, 19 nt, Homo sapiens
ggauaucacaugggacaga

SEQ ID NO: 898424 - RNA, 19 nt, Homo sapiens
ucgccuacauccaagaguu

SEQ ID NO: 898425 - RNA, 19 nt, Homo sapiens
cagaagaagagaccugcaa

SEQ ID NO: 898426 - RNA, 19 nt, Homo sapiens
uauccgagagacuguuuaa

SEQ ID NO: 898427 - RNA, 19 nt, Homo sapiens
acacgcagagcuacaguga

SEQ ID NO: 898428 - RNA, 19 nt, Homo sapiens
caucgagccuguggacauc

SEQ ID NO: 898429 - RNA, 19 nt, Homo sapiens
gcuauucgacaaggugaaa

SEQ ID NO: 898430 - RNA, 19 nt, Homo sapiens
cagagcugccuggguguua

SEQ ID NO: 898431 - RNA, 19 nt, Homo sapiens
aagaccagauacccaaugu

SEQ ID NO: 898432 - RNA, 19 nt, Homo sapiens
ggauccaaacccacucuug

SEQ ID NO: 898433 - RNA, 19 nt, Homo sapiens
gaggucaucccugucuuug

SEQ ID NO: 898434 - RNA, 19 nt, Homo sapiens
cggcuuacacgcagagcua

SEQ ID NO: 898435 - RNA, 19 nt, Homo sapiens
agacgaaugaggaauaaag

SEQ ID NO: 898436 - RNA, 19 nt, Homo sapiens
gauacccaaugugcaaagu

SEQ ID NO: 898437 - RNA, 19 nt, Homo sapiens
caagaccagauacccaaug

SEQ ID NO: 898438 - RNA, 19 nt, Homo sapiens
ugaaaggacccaggaacga

SEQ ID NO: 898439 - RNA, 19 nt, Homo sapiens
gaauccaccccguuuauug

SEQ ID NO: 898440 - RNA, 19 nt, Homo sapiens
caagguugcacaccagcuu

SEQ ID NO: 898441 - RNA, 19 nt, Homo sapiens
gccaugaguuccuguucag

SEQ ID NO: 898442 - RNA, 19 nt, Homo sapiens
gaagguguucacugucauc

SEQ ID NO: 898443 - RNA, 19 nt, Homo sapiens
gaggaauaaaggucagaga

SEQ ID NO: 898444 - RNA, 19 nt, Homo sapiens
ccagacaggaagcagagaa

SEQ ID NO: 898445 - RNA, 19 nt, Homo sapiens
cgccaugaguuccuguuca

SEQ ID NO: 898446 - RNA, 19 nt, Homo sapiens
gcaagaccagauacccaau

SEQ ID NO: 898447 - RNA, 19 nt, Homo sapiens
gagaaacagagccagacau

SEQ ID NO: 898448 - RNA, 19 nt, Homo sapiens
ucagagcuauguggagucu

SEQ ID NO: 898449 - RNA, 19 nt, Homo sapiens
aggaauaaaggucagagaa

SEQ ID NO: 898450 - RNA, 19 nt, Homo sapiens
gcgucgagcccguguuuag

SEQ ID NO: 898451 - RNA, 19 nt, Homo sapiens
agccagacauagacaguuc

SEQ ID NO: 898452 - RNA, 19 nt, Homo sapiens
ccauucccuugcacccuuu

SEQ ID NO: 898453 - RNA, 19 nt, Homo sapiens
gugagaguccagacaggaa

SEQ ID NO: 898454 - RNA, 19 nt, Homo sapiens
ccggcuggaaucugacuua

SEQ ID NO: 898455 - RNA, 19 nt, Homo sapiens
aguguccgcuacuguauca

SEQ ID NO: 898456 - RNA, 19 nt, Homo sapiens
gcugagugacguuuggaau

SEQ ID NO: 898457 - RNA, 19 nt, Homo sapiens
ugaaugcccagugcaguau

SEQ ID NO: 898458 - RNA, 19 nt, Homo sapiens
uugaaugcccagugcagua

SEQ ID NO: 898459 - RNA, 19 nt, Homo sapiens
cgacccuggugacauccuu

SEQ ID NO: 898460 - RNA, 19 nt, Homo sapiens
aagaagagaccugcaacug

SEQ ID NO: 898461 - RNA, 19 nt, Homo sapiens
gagccagacauagacaguu

SEQ ID NO: 898462 - RNA, 19 nt, Homo sapiens
gugcagacacagacguuca

SEQ ID NO: 898463 - RNA, 19 nt, Homo sapiens
agaggucaucccugucuuu

SEQ ID NO: 898464 - RNA, 19 nt, Homo sapiens
guacaaagcucauaaaucu

SEQ ID NO: 898465 - RNA, 19 nt, Homo sapiens
gcaaguaaauugaccauga

SEQ ID NO: 898466 - RNA, 19 nt, Homo sapiens
ggaagaacauuaccuaaau

SEQ ID NO: 898467 - RNA, 19 nt, Homo sapiens
gaacaaccaugaaggaguu

SEQ ID NO: 898468 - RNA, 19 nt, Homo sapiens
gaagaagcaucucauaaau

SEQ ID NO: 898469 - RNA, 19 nt, Homo sapiens
gcaccaaccuaauauuuga

SEQ ID NO: 898470 - RNA, 19 nt, Homo sapiens
ugaagcaagucaaagauua

SEQ ID NO: 898471 - RNA, 19 nt, Homo sapiens
caugagagaugccacauuu

SEQ ID NO: 898472 - RNA, 19 nt, Homo sapiens
gcaagugguuaauuaugua

SEQ ID NO: 898473 - RNA, 19 nt, Homo sapiens
gaagagcgcucgccaaagg

SEQ ID NO: 898474 - RNA, 19 nt, Homo sapiens
gaaccaagcgggaauuuau

SEQ ID NO: 898475 - RNA, 19 nt, Homo sapiens
gaaauggagucuguugauu

SEQ ID NO: 898476 - RNA, 19 nt, Homo sapiens
gaaauuguacuacugguaa

SEQ ID NO: 898477 - RNA, 19 nt, Homo sapiens
gcaaagaaugaacaaguua

SEQ ID NO: 898478 - RNA, 19 nt, Homo sapiens
gaaacuaccacucaaagaa

SEQ ID NO: 898479 - RNA, 19 nt, Homo sapiens
ucaauaggaugcauaggua

SEQ ID NO: 898480 - RNA, 19 nt, Homo sapiens
gaagugacaucucuuguac

SEQ ID NO: 898481 - RNA, 19 nt, Homo sapiens
ggagucuguugauuuaaua

SEQ ID NO: 898482 - RNA, 19 nt, Homo sapiens
ugaaagagcuagagauuac

SEQ ID NO: 898483 - RNA, 19 nt, Homo sapiens
ggaaaauucuccuugauaa

SEQ ID NO: 898484 - RNA, 19 nt, Homo sapiens
caucuuagcucgucaucuu

SEQ ID NO: 898485 - RNA, 19 nt, Homo sapiens
guucugggcuguuugguaa

SEQ ID NO: 898486 - RNA, 19 nt, Homo sapiens
gaagcuaucugaaguugca

SEQ ID NO: 898487 - RNA, 19 nt, Homo sapiens
gaacauaugaguauucaca

SEQ ID NO: 898488 - RNA, 19 nt, Homo sapiens
gcucagaaguuaguucaaa

SEQ ID NO: 898489 - RNA, 19 nt, Homo sapiens
gauauaagcagaucacaug

SEQ ID NO: 898490 - RNA, 19 nt, Homo sapiens
gguauuagaagcuguuaua

SEQ ID NO: 898491 - RNA, 19 nt, Homo sapiens
agaagcagcuaacaguaua

SEQ ID NO: 898492 - RNA, 19 nt, Homo sapiens
gaucacauguaaaucauuc

SEQ ID NO: 898493 - RNA, 19 nt, Homo sapiens
agacagaacuagaaacuuc

SEQ ID NO: 898494 - RNA, 19 nt, Homo sapiens
aauggagucuguugauuua

SEQ ID NO: 898495 - RNA, 19 nt, Homo sapiens
ucagaagucuuagagauuu

SEQ ID NO: 898496 - RNA, 19 nt, Homo sapiens
gcauagguauauuacguuu

SEQ ID NO: 898497 - RNA, 19 nt, Homo sapiens
cuacauagaugcucgaaca

SEQ ID NO: 898498 - RNA, 19 nt, Homo sapiens
cagaaggcauguaaagaaa

SEQ ID NO: 898499 - RNA, 19 nt, Homo sapiens
gauaagugcuauaguugga

SEQ ID NO: 898500 - RNA, 19 nt, Homo sapiens
caacaaguuuaccuacuga

SEQ ID NO: 898501 - RNA, 19 nt, Homo sapiens
gaaaguguacauaagcuaa

SEQ ID NO: 898502 - RNA, 19 nt, Homo sapiens
gaagcuauucaaacuguua

SEQ ID NO: 898503 - RNA, 19 nt, Homo sapiens
agaagcaucucauaaaugu

SEQ ID NO: 898504 - RNA, 19 nt, Homo sapiens
gcagaucacauguaaauca

SEQ ID NO: 898505 - RNA, 19 nt, Homo sapiens
gaaaacagaucuauuaggu

SEQ ID NO: 898506 - RNA, 19 nt, Homo sapiens
guucgaggcuaucauugua

SEQ ID NO: 898507 - RNA, 19 nt, Homo sapiens
gcacaucuuauucgucaua

SEQ ID NO: 898508 - RNA, 19 nt, Homo sapiens
acagguggcucagaaguua

SEQ ID NO: 898509 - RNA, 19 nt, Homo sapiens
gaaagccguucccaaguca

SEQ ID NO: 898510 - RNA, 19 nt, Homo sapiens
auaagcagaucacauguaa

SEQ ID NO: 898511 - RNA, 19 nt, Homo sapiens
gaagaaagauugguauucc

SEQ ID NO: 898512 - RNA, 19 nt, Homo sapiens
gcaagcacuucaagaaaca

SEQ ID NO: 898513 - RNA, 19 nt, Homo sapiens
gaacuuguguuuguugaca

SEQ ID NO: 898514 - RNA, 19 nt, Homo sapiens
gauguugaaucuuguugaa

SEQ ID NO: 898515 - RNA, 19 nt, Homo sapiens
ccacuaaauuguugaagau

SEQ ID NO: 898516 - RNA, 19 nt, Homo sapiens
gaacacaguuauuaaacac

SEQ ID NO: 898517 - RNA, 19 nt, Homo sapiens
guaaauugaccaugagaaa

SEQ ID NO: 898518 - RNA, 19 nt, Homo sapiens
gggaugcuuuauucuauuu

SEQ ID NO: 898519 - RNA, 19 nt, Homo sapiens
aaacauaggcagaaaguug

SEQ ID NO: 898520 - RNA, 19 nt, Homo sapiens
gaaaagaccguuuagugua

SEQ ID NO: 898521 - RNA, 19 nt, Homo sapiens
uaaguugccucucccaguu

SEQ ID NO: 898522 - RNA, 19 nt, Homo sapiens
gaaugugccuugauguaca

SEQ ID NO: 898523 - RNA, 19 nt, Homo sapiens
guaaaucauuccuaaagca

SEQ ID NO: 898524 - RNA, 19 nt, Homo sapiens
gagaaugaguauguuaaug

SEQ ID NO: 898525 - RNA, 19 nt, Homo sapiens
agaagaagcaucucauaaa

SEQ ID NO: 898526 - RNA, 19 nt, Homo sapiens
acacugaacucacagaaca

SEQ ID NO: 898527 - RNA, 19 nt, Homo sapiens
gaacacagaagaagcaucu

SEQ ID NO: 898528 - RNA, 19 nt, Homo sapiens
cgacaacguucuguuaaug

SEQ ID NO: 898529 - RNA, 19 nt, Homo sapiens
uacauaagcuaauggaaga

SEQ ID NO: 898530 - RNA, 19 nt, Homo sapiens
ucaaaguucugggcuguuu

SEQ ID NO: 898531 - RNA, 19 nt, Homo sapiens
guagagguagcacauauuu

SEQ ID NO: 898532 - RNA, 19 nt, Homo sapiens
gaacacuccguaaacauau

SEQ ID NO: 898533 - RNA, 19 nt, Homo sapiens
cgaacacuccguaaacaua

SEQ ID NO: 898534 - RNA, 19 nt, Homo sapiens
gcaagucaaagauuacauu

SEQ ID NO: 898535 - RNA, 19 nt, Homo sapiens
gaaaggaagagcaaagcaa

SEQ ID NO: 898536 - RNA, 19 nt, Homo sapiens
gagacgauacgcccuuaua

SEQ ID NO: 898537 - RNA, 19 nt, Homo sapiens
gaacuagaaacuucaaaca

SEQ ID NO: 898538 - RNA, 19 nt, Homo sapiens
gaucugugauucuugacuu

SEQ ID NO: 898539 - RNA, 19 nt, Homo sapiens
cagaagcuauucaaacugu

SEQ ID NO: 898540 - RNA, 19 nt, Homo sapiens
ugacuaaauuccacagaga

SEQ ID NO: 898541 - RNA, 19 nt, Homo sapiens
gaucuucgccagcacauga

SEQ ID NO: 898542 - RNA, 19 nt, Homo sapiens
cagaaauguuggaagaauu

SEQ ID NO: 898543 - RNA, 19 nt, Homo sapiens
gcacuuaugaguuacaugu

SEQ ID NO: 898544 - RNA, 19 nt, Homo sapiens
gcuuggaguuuacauauca

SEQ ID NO: 898545 - RNA, 19 nt, Homo sapiens
gcugaugcccgaucucuaa

SEQ ID NO: 898546 - RNA, 19 nt, Homo sapiens
ggagacacaugaacaacca

SEQ ID NO: 898547 - RNA, 19 nt, Homo sapiens
ugugauaagugcuauaguu

SEQ ID NO: 898548 - RNA, 19 nt, Homo sapiens
gagaagcagcuaacaguau

SEQ ID NO: 898549 - RNA, 19 nt, Homo sapiens
guaaugaaucggaagauga

SEQ ID NO: 898550 - RNA, 19 nt, Homo sapiens
cagggaugcuuuauucuau

SEQ ID NO: 898551 - RNA, 19 nt, Homo sapiens
gaggagaaugaguauguua

SEQ ID NO: 898552 - RNA, 19 nt, Homo sapiens
gagacuaugugccuugcaa

SEQ ID NO: 898553 - RNA, 19 nt, Homo sapiens
cagaagaagcaucucauaa

SEQ ID NO: 898554 - RNA, 19 nt, Homo sapiens
ucagguaauuucagaaugu

SEQ ID NO: 898555 - RNA, 19 nt, Homo sapiens
ugauuuauuugcccuguuu

SEQ ID NO: 898556 - RNA, 19 nt, Homo sapiens
ugaaggaguuaagccauuu

SEQ ID NO: 898557 - RNA, 19 nt, Homo sapiens
ucagaaggcauguaaagaa

SEQ ID NO: 898558 - RNA, 19 nt, Homo sapiens
ccaauuccacgucuaauga

SEQ ID NO: 898559 - RNA, 19 nt, Homo sapiens
gaauuugccuauacuucug

SEQ ID NO: 898560 - RNA, 19 nt, Homo sapiens
gagaagaaaguaaugaauc

SEQ ID NO: 898561 - RNA, 19 nt, Homo sapiens
acauacagcccauaacuuu

SEQ ID NO: 898562 - RNA, 19 nt, Homo sapiens
ccauguaauugucagguaa

SEQ ID NO: 898563 - RNA, 19 nt, Homo sapiens
gcaaaauuaugcuggaaaa

SEQ ID NO: 898564 - RNA, 19 nt, Homo sapiens
gcaguugacucacgauuau

SEQ ID NO: 898565 - RNA, 19 nt, Homo sapiens
gaaccgagauacaguuuua

SEQ ID NO: 898566 - RNA, 19 nt, Homo sapiens
ggacuaggguggugguugu

SEQ ID NO: 898567 - RNA, 19 nt, Homo sapiens
gcaguuguguggcguaaag

SEQ ID NO: 898568 - RNA, 19 nt, Homo sapiens
aaauugagguuacagacaa

SEQ ID NO: 898569 - RNA, 19 nt, Homo sapiens
caacaggcccucuggacaa

SEQ ID NO: 898570 - RNA, 19 nt, Homo sapiens
aaaugaugcuguuuggaaa

SEQ ID NO: 898571 - RNA, 19 nt, Homo sapiens
gauuugaucacauggguaa

SEQ ID NO: 898572 - RNA, 19 nt, Homo sapiens
caggcccucuggacaaaua

SEQ ID NO: 898573 - RNA, 19 nt, Homo sapiens
caccgacucuuguaucaug

SEQ ID NO: 898574 - RNA, 19 nt, Homo sapiens
cuuccuguguuucauauuu

SEQ ID NO: 898575 - RNA, 19 nt, Homo sapiens
guaaagaaacucccauggu

SEQ ID NO: 898576 - RNA, 19 nt, Homo sapiens
ucacggaggcucuuuguca

SEQ ID NO: 898577 - RNA, 19 nt, Homo sapiens
gcuauucauucagucauug

SEQ ID NO: 898578 - RNA, 19 nt, Homo sapiens
uuauaagucuguguccuuu

SEQ ID NO: 898579 - RNA, 19 nt, Homo sapiens
uaacuacccuaucguuuug

SEQ ID NO: 898580 - RNA, 19 nt, Homo sapiens
uaucaugagcauuggauuu

SEQ ID NO: 898581 - RNA, 19 nt, Homo sapiens
cgacucaccugugcagauc

SEQ ID NO: 898582 - RNA, 19 nt, Homo sapiens
gucauugauucgucuugua

SEQ ID NO: 898583 - RNA, 19 nt, Homo sapiens
gccaccgacucuuguauca

SEQ ID NO: 898584 - RNA, 19 nt, Homo sapiens
ucauugauucgucuuguaa

SEQ ID NO: 898585 - RNA, 19 nt, Homo sapiens
cauuggauuugaucacaug

SEQ ID NO: 898586 - RNA, 19 nt, Homo sapiens
gguugaaugcaguguuuaa

SEQ ID NO: 898587 - RNA, 19 nt, Homo sapiens
cugguugaaugcaguguuu

SEQ ID NO: 898588 - RNA, 19 nt, Homo sapiens
gcggugcuauucauucagu

SEQ ID NO: 898589 - RNA, 19 nt, Homo sapiens
guaacuacccuaucguuuu

SEQ ID NO: 898590 - RNA, 19 nt, Homo sapiens
gcauuggauuugaucacau

SEQ ID NO: 898591 - RNA, 19 nt, Homo sapiens
cagcaguuguguggcguaa

SEQ ID NO: 898592 - RNA, 19 nt, Homo sapiens
cgauuauagucauagguau

SEQ ID NO: 898593 - RNA, 19 nt, Homo sapiens
caugagcauuggauuugau

SEQ ID NO: 898594 - RNA, 19 nt, Homo sapiens
gaaugcaguguuuaauaag

SEQ ID NO: 898595 - RNA, 19 nt, Homo sapiens
uaaauugagguuacagaca

SEQ ID NO: 898596 - RNA, 19 nt, Homo sapiens
gauuugcagugaccauuuu

SEQ ID NO: 898597 - RNA, 19 nt, Homo sapiens
gaucgacgccaccgacucu

SEQ ID NO: 898598 - RNA, 19 nt, Homo sapiens
guacugaaccgagauacag

SEQ ID NO: 898599 - RNA, 19 nt, Homo sapiens
uagucaaguuuguuucuuc

SEQ ID NO: 898600 - RNA, 19 nt, Homo sapiens
acucacgauuauagucaua

SEQ ID NO: 898601 - RNA, 19 nt, Homo sapiens
ucaugagcauuggauuuga

SEQ ID NO: 898602 - RNA, 19 nt, Homo sapiens
gcacuggguaccggaagaa

SEQ ID NO: 898603 - RNA, 19 nt, Homo sapiens
agucgagcguccacuagaa

SEQ ID NO: 898604 - RNA, 19 nt, Homo sapiens
acgauuauagucauaggua

SEQ ID NO: 898605 - RNA, 19 nt, Homo sapiens
ggacaaauacaagauucag

SEQ ID NO: 898606 - RNA, 19 nt, Homo sapiens
agagguggcagaaggacua

SEQ ID NO: 898607 - RNA, 19 nt, Homo sapiens
gcccauuucauuauaguca

SEQ ID NO: 898608 - RNA, 19 nt, Homo sapiens
ggacuacaaccaccuucca

SEQ ID NO: 898609 - RNA, 19 nt, Homo sapiens
uggcggugcuauucauuca

SEQ ID NO: 898610 - RNA, 19 nt, Homo sapiens
ugcaguugacucacgauua

SEQ ID NO: 898611 - RNA, 19 nt, Homo sapiens
cuacaaccaccuuccaaca

SEQ ID NO: 898612 - RNA, 19 nt, Homo sapiens
ggauuacggugaaaauucu

SEQ ID NO: 898613 - RNA, 19 nt, Homo sapiens
ucaugugacuccagauacu

SEQ ID NO: 898614 - RNA, 19 nt, Homo sapiens
aacaggcccucuggacaaa

SEQ ID NO: 898615 - RNA, 19 nt, Homo sapiens
cuaggguggugguuguguu

SEQ ID NO: 898616 - RNA, 19 nt, Homo sapiens
cgagauacaguuuuaaaug

SEQ ID NO: 898617 - RNA, 19 nt, Homo sapiens
ggcacuggguaccggaaga

SEQ ID NO: 898618 - RNA, 19 nt, Homo sapiens
ugauuugcagugaccauuu

SEQ ID NO: 898619 - RNA, 19 nt, Homo sapiens
cuggacaaauacaagauuc

SEQ ID NO: 898620 - RNA, 19 nt, Homo sapiens
gguggcagaaggacuacaa

SEQ ID NO: 898621 - RNA, 19 nt, Homo sapiens
ugaguacugaaccgagaua

SEQ ID NO: 898622 - RNA, 19 nt, Homo sapiens
cugaaaaccuggcccuuug

SEQ ID NO: 898623 - RNA, 19 nt, Homo sapiens
guuuguuucuuccuguguu

SEQ ID NO: 898624 - RNA, 19 nt, Homo sapiens
uugaucacauggguaacua

SEQ ID NO: 898625 - RNA, 19 nt, Homo sapiens
guuguguggcguaaagaaa

SEQ ID NO: 898626 - RNA, 19 nt, Homo sapiens
caccugugcagaucaaaug

SEQ ID NO: 898627 - RNA, 19 nt, Homo sapiens
aauugagguuacagacaaa

SEQ ID NO: 898628 - RNA, 19 nt, Homo sapiens
ggugaaaauucuuguuugg

SEQ ID NO: 898629 - RNA, 19 nt, Homo sapiens
gauucgucuuguaaauaug

SEQ ID NO: 898630 - RNA, 19 nt, Homo sapiens
ggaaaacaguuacacauuu

SEQ ID NO: 898631 - RNA, 19 nt, Homo sapiens
gcaacgggcuccucaccaa

SEQ ID NO: 898632 - RNA, 19 nt, Homo sapiens
gcgauaagauugucauggu

SEQ ID NO: 898633 - RNA, 19 nt, Homo sapiens
gaccagcuccugcagauug

SEQ ID NO: 898634 - RNA, 19 nt, Homo sapiens
gauugucucucuggucaaa

SEQ ID NO: 898635 - RNA, 19 nt, Homo sapiens
agagcuacguucuuuguga

SEQ ID NO: 898636 - RNA, 19 nt, Homo sapiens
ggguggagcucgcacaaag

SEQ ID NO: 898637 - RNA, 19 nt, Homo sapiens
caaccacccucggaugaug

SEQ ID NO: 898638 - RNA, 19 nt, Homo sapiens
gggaccagcuccugcagau

SEQ ID NO: 898639 - RNA, 19 nt, Homo sapiens
gucacagacugcauaaguu

SEQ ID NO: 898640 - RNA, 19 nt, Homo sapiens
uggcuugacuugcucuuug

SEQ ID NO: 898641 - RNA, 19 nt, Homo sapiens
gaggcaggcuguuuaaacg

SEQ ID NO: 898642 - RNA, 19 nt, Homo sapiens
cccaucagguggugaagaa

SEQ ID NO: 898643 - RNA, 19 nt, Homo sapiens
gaaggcaucaggcgauaag

SEQ ID NO: 898644 - RNA, 19 nt, Homo sapiens
ggaggcaggcuguuuaaac

SEQ ID NO: 898645 - RNA, 19 nt, Homo sapiens
ggcaucaggcgauaagauu

SEQ ID NO: 898646 - RNA, 19 nt, Homo sapiens
aagaaggcaucaggcgaua

SEQ ID NO: 898647 - RNA, 19 nt, Homo sapiens
ggacggcuccauccuccuu

SEQ ID NO: 898648 - RNA, 19 nt, Homo sapiens
guggacgggcagaauguua

SEQ ID NO: 898649 - RNA, 19 nt, Homo sapiens
gcaucaggcgauaagauug

SEQ ID NO: 898650 - RNA, 19 nt, Homo sapiens
ccgauucucuugugcugau

SEQ ID NO: 898651 - RNA, 19 nt, Homo sapiens
ggcaaccacccucggauga

SEQ ID NO: 898652 - RNA, 19 nt, Homo sapiens
gcggcgagcugagaucaag

SEQ ID NO: 898653 - RNA, 19 nt, Homo sapiens
cacggaggcaggcuguuua

SEQ ID NO: 898654 - RNA, 19 nt, Homo sapiens
ggacugucaccaugcacaa

SEQ ID NO: 898655 - RNA, 19 nt, Homo sapiens
ggcagccgauucucuugug

SEQ ID NO: 898656 - RNA, 19 nt, Homo sapiens
acacacaggccuccuugga

SEQ ID NO: 898657 - RNA, 19 nt, Homo sapiens
ugucacagacugcauaagu

SEQ ID NO: 898658 - RNA, 19 nt, Homo sapiens
gagguggacgggcagaaug

SEQ ID NO: 898659 - RNA, 19 nt, Homo sapiens
ucucuugugcugauuuaaa

SEQ ID NO: 898660 - RNA, 19 nt, Homo sapiens
ggaccacuccaucccagau

SEQ ID NO: 898661 - RNA, 19 nt, Homo sapiens
gcuguuuaaacgcugcuua

SEQ ID NO: 898662 - RNA, 19 nt, Homo sapiens
acacggaggcaggcuguuu

SEQ ID NO: 898663 - RNA, 19 nt, Homo sapiens
gggauggcuuauacacaca

SEQ ID NO: 898664 - RNA, 19 nt, Homo sapiens
caucaggcgauaagauugu

SEQ ID NO: 898665 - RNA, 19 nt, Homo sapiens
auucucuugugcugauuua

SEQ ID NO: 898666 - RNA, 19 nt, Homo sapiens
uuaucgggcugaaggacaa

SEQ ID NO: 898667 - RNA, 19 nt, Homo sapiens
acagagcuacguucuuugu

SEQ ID NO: 898668 - RNA, 19 nt, Homo sapiens
ggacgggcagaauguuauc

SEQ ID NO: 898669 - RNA, 19 nt, Homo sapiens
ggcuugacuugcucuuugu

SEQ ID NO: 898670 - RNA, 19 nt, Homo sapiens
uaagagaacagagcuacgu

SEQ ID NO: 898671 - RNA, 19 nt, Homo sapiens
gcaaccacccucggaugau

SEQ ID NO: 898672 - RNA, 19 nt, Homo sapiens
gcaacgggcuccucaccaa

SEQ ID NO: 898673 - RNA, 19 nt, Homo sapiens
uggcagaacuggaaaauua

SEQ ID NO: 898674 - RNA, 19 nt, Homo sapiens
gcgauaagauugucauggu

SEQ ID NO: 898675 - RNA, 19 nt, Homo sapiens
gaccagcuccugcagauug

SEQ ID NO: 898676 - RNA, 19 nt, Homo sapiens
gauugucucucuggucaaa

SEQ ID NO: 898677 - RNA, 19 nt, Homo sapiens
aaacuuggcagaacuggaa

SEQ ID NO: 898678 - RNA, 19 nt, Homo sapiens
ggguggagcucgcacaaag

SEQ ID NO: 898679 - RNA, 19 nt, Homo sapiens
gggaccagcuccugcagau

SEQ ID NO: 898680 - RNA, 19 nt, Homo sapiens
cccaucagguggugaagaa

SEQ ID NO: 898681 - RNA, 19 nt, Homo sapiens
gaaggcaucaggcgauaag

SEQ ID NO: 898682 - RNA, 19 nt, Homo sapiens
ggagagccugcuucauauu

SEQ ID NO: 898683 - RNA, 19 nt, Homo sapiens
ggcaucaggcgauaagauu

SEQ ID NO: 898684 - RNA, 19 nt, Homo sapiens
aggagagccugcuucauau

SEQ ID NO: 898685 - RNA, 19 nt, Homo sapiens
aagaaggcaucaggcgaua

SEQ ID NO: 898686 - RNA, 19 nt, Homo sapiens
gagagccugcuucauauuc

SEQ ID NO: 898687 - RNA, 19 nt, Homo sapiens
gucagagccucacccaaga

SEQ ID NO: 898688 - RNA, 19 nt, Homo sapiens
guggacgggcagaauguua

SEQ ID NO: 898689 - RNA, 19 nt, Homo sapiens
gcaucaggcgauaagauug

SEQ ID NO: 898690 - RNA, 19 nt, Homo sapiens
gcggcgagcugagaucaag

SEQ ID NO: 898691 - RNA, 19 nt, Homo sapiens
ggacugucaccaugcacaa

SEQ ID NO: 898692 - RNA, 19 nt, Homo sapiens
gcagaacuggaaaauuaua

SEQ ID NO: 898693 - RNA, 19 nt, Homo sapiens
gagguggacgggcagaaug

SEQ ID NO: 898694 - RNA, 19 nt, Homo sapiens
ggaccacuccaucccagau

SEQ ID NO: 898695 - RNA, 19 nt, Homo sapiens
caucaggcgauaagauugu

SEQ ID NO: 898696 - RNA, 19 nt, Homo sapiens
uuaucgggcugaaggacaa

SEQ ID NO: 898697 - RNA, 19 nt, Homo sapiens
ggacgggcagaauguuauc

SEQ ID NO: 898698 - RNA, 19 nt, Homo sapiens
gagccugcuucauauucca

SEQ ID NO: 898699 - RNA, 19 nt, Homo sapiens
gaacuucacucucuccuuu

SEQ ID NO: 898700 - RNA, 19 nt, Homo sapiens
gcaaagacauuuccauuuc

SEQ ID NO: 898701 - RNA, 19 nt, Homo sapiens
gaagagugcuggcuccuuu

SEQ ID NO: 898702 - RNA, 19 nt, Homo sapiens
ggacgcagcuugcaccaaa

SEQ ID NO: 898703 - RNA, 19 nt, Homo sapiens
gcaccaaauugcaaucuuu

SEQ ID NO: 898704 - RNA, 19 nt, Homo sapiens
gguaagacuugaugauaaa

SEQ ID NO: 898705 - RNA, 19 nt, Homo sapiens
gaaguaaagggaaaccaua

SEQ ID NO: 898706 - RNA, 19 nt, Homo sapiens
caugggagguguaggauaa

SEQ ID NO: 898707 - RNA, 19 nt, Homo sapiens
aagauaaugugcugucaua

SEQ ID NO: 898708 - RNA, 19 nt, Homo sapiens
cagaaugaauggugaaaga

SEQ ID NO: 898709 - RNA, 19 nt, Homo sapiens
gagaugaggugcacacagu

SEQ ID NO: 898710 - RNA, 19 nt, Homo sapiens
acacugugcuucaugagua

SEQ ID NO: 898711 - RNA, 19 nt, Homo sapiens
ggcgauaaguguugaggua

SEQ ID NO: 898712 - RNA, 19 nt, Homo sapiens
aagaagacccuuugacuaa

SEQ ID NO: 898713 - RNA, 19 nt, Homo sapiens
caagaagacccuuugacua

SEQ ID NO: 898714 - RNA, 19 nt, Homo sapiens
ggaaagggguacagaauga

SEQ ID NO: 898715 - RNA, 19 nt, Homo sapiens
gagguaggcucgagaacug

SEQ ID NO: 898716 - RNA, 19 nt, Homo sapiens
ggacuuucuugcacuaguu

SEQ ID NO: 898717 - RNA, 19 nt, Homo sapiens
cgaagaagaagaagaaguu

SEQ ID NO: 898718 - RNA, 19 nt, Homo sapiens
caaagcgucuggaaaccaa

SEQ ID NO: 898719 - RNA, 19 nt, Homo sapiens
uugaagacauggccgaaua

SEQ ID NO: 898720 - RNA, 19 nt, Homo sapiens
gaggagaaauguggacaga

SEQ ID NO: 898721 - RNA, 19 nt, Homo sapiens
ggaaagagcacaggaacug

SEQ ID NO: 898722 - RNA, 19 nt, Homo sapiens
ugguaagacuugaugauaa

SEQ ID NO: 898723 - RNA, 19 nt, Homo sapiens
gcagcuuucuuaugccauu

SEQ ID NO: 898724 - RNA, 19 nt, Homo sapiens
ggagaugggcgauaagugu

SEQ ID NO: 898725 - RNA, 19 nt, Homo sapiens
guacaggguugcuggauac

SEQ ID NO: 898726 - RNA, 19 nt, Homo sapiens
gggcaaagacauuuccauu

SEQ ID NO: 898727 - RNA, 19 nt, Homo sapiens
gcaccucacuccaccucaa

SEQ ID NO: 898728 - RNA, 19 nt, Homo sapiens
ggcaaagacauuuccauuu

SEQ ID NO: 898729 - RNA, 19 nt, Homo sapiens
gaaagagaguggagauacg

SEQ ID NO: 898730 - RNA, 19 nt, Homo sapiens
ccucucugcucuuguuuaa

SEQ ID NO: 898731 - RNA, 19 nt, Homo sapiens
gcaagaagacccuuugacu

SEQ ID NO: 898732 - RNA, 19 nt, Homo sapiens
ccuagguacugccuucuaa

SEQ ID NO: 898733 - RNA, 19 nt, Homo sapiens
gaaugaauggugaaagaga

SEQ ID NO: 898734 - RNA, 19 nt, Homo sapiens
guaggacuuucuugcacua

SEQ ID NO: 898735 - RNA, 19 nt, Homo sapiens
gaaaagggacugggaagua

SEQ ID NO: 898736 - RNA, 19 nt, Homo sapiens
cugagaaacuguugaguca

SEQ ID NO: 898737 - RNA, 19 nt, Homo sapiens
ugucauaucuuggcugaga

SEQ ID NO: 898738 - RNA, 19 nt, Homo sapiens
gcaauuccaccacuccuau

SEQ ID NO: 898739 - RNA, 19 nt, Homo sapiens
ggacagagggcuugaagac

SEQ ID NO: 898740 - RNA, 19 nt, Homo sapiens
ccagacugauuacaugaga

SEQ ID NO: 898741 - RNA, 19 nt, Homo sapiens
ggacaucugaaugcugaua

SEQ ID NO: 898742 - RNA, 19 nt, Homo sapiens
agaagacccuuugacuaaa

SEQ ID NO: 898743 - RNA, 19 nt, Homo sapiens
acagagggcuugaagacau

SEQ ID NO: 898744 - RNA, 19 nt, Homo sapiens
ggagaggagaggagaaaug

SEQ ID NO: 898745 - RNA, 19 nt, Homo sapiens
aaagggagccagagcugua

SEQ ID NO: 898746 - RNA, 19 nt, Homo sapiens
aaaagcagcuccaacagaa

SEQ ID NO: 898747 - RNA, 19 nt, Homo sapiens
uauauguacugcuuucugu

SEQ ID NO: 898748 - RNA, 19 nt, Homo sapiens
cuaggucccagacugauua

SEQ ID NO: 898749 - RNA, 19 nt, Homo sapiens
gaaagagcacaggaacuga

SEQ ID NO: 898750 - RNA, 19 nt, Homo sapiens
ggaccgacacgcucaggaa

SEQ ID NO: 898751 - RNA, 19 nt, Homo sapiens
gacaagagaagaggcauug

SEQ ID NO: 898752 - RNA, 19 nt, Homo sapiens
cuagaggacuggacaagag

SEQ ID NO: 898753 - RNA, 19 nt, Homo sapiens
auaaugugcugucauaucu

SEQ ID NO: 898754 - RNA, 19 nt, Homo sapiens
aggagaaccugguggcauu

SEQ ID NO: 898755 - RNA, 19 nt, Homo sapiens
caggguugcuggauacuuc

SEQ ID NO: 898756 - RNA, 19 nt, Homo sapiens
gagaggagaggagaaaugu

SEQ ID NO: 898757 - RNA, 19 nt, Homo sapiens
ggacaagagaagaggcauu

SEQ ID NO: 898758 - RNA, 19 nt, Homo sapiens
uaucuuggcugagaaacug

SEQ ID NO: 898759 - RNA, 19 nt, Homo sapiens
ccaccacccuaggcaauga

SEQ ID NO: 898760 - RNA, 19 nt, Homo sapiens
uugccaagauccuuaauuc

SEQ ID NO: 898761 - RNA, 19 nt, Homo sapiens
agaagaagaaguucaagga

SEQ ID NO: 898762 - RNA, 19 nt, Homo sapiens
uguacaggguugcuggaua

SEQ ID NO: 898763 - RNA, 19 nt, Homo sapiens
ggaaguaaagggaaaccau

SEQ ID NO: 898764 - RNA, 19 nt, Homo sapiens
cgugcugcauaaauacuua

SEQ ID NO: 898765 - RNA, 19 nt, Homo sapiens
guaaagggaaaccauaugg

SEQ ID NO: 898766 - RNA, 19 nt, Homo sapiens
uaaagauaaugugcuguca

SEQ ID NO: 898767 - RNA, 19 nt, Homo sapiens
gaugggcgauaaguguuga

SEQ ID NO: 898768 - RNA, 19 nt, Homo sapiens
uaaaugguaagacuugaug

SEQ ID NO: 898769 - RNA, 19 nt, Homo sapiens
aaugugcugucauaucuug

SEQ ID NO: 898770 - RNA, 19 nt, Homo sapiens
gacugccgcugucugaaga

SEQ ID NO: 898771 - RNA, 19 nt, Homo sapiens
gagaugggcgauaaguguu

SEQ ID NO: 898772 - RNA, 19 nt, Homo sapiens
cucccaagcucccaucuau

SEQ ID NO: 898773 - RNA, 19 nt, Homo sapiens
ccaaaucagugagaauugc

SEQ ID NO: 898774 - RNA, 19 nt, Homo sapiens
gaugaggugcacacaguug

SEQ ID NO: 898775 - RNA, 19 nt, Homo sapiens
agaagaagaagaaguucaa

SEQ ID NO: 898776 - RNA, 19 nt, Homo sapiens
aaaagggacugggaaguaa

SEQ ID NO: 898777 - RNA, 19 nt, Homo sapiens
ucugaaugcugauacgaau

SEQ ID NO: 898778 - RNA, 19 nt, Homo sapiens
caaagacauuuccauuucc

SEQ ID NO: 898779 - RNA, 19 nt, Homo sapiens
uauguacugcuuucuguuu

SEQ ID NO: 898780 - RNA, 19 nt, Homo sapiens
ccgggcagcuuucuuaugc

SEQ ID NO: 898781 - RNA, 19 nt, Homo sapiens
cuuugggccuggucacaua

SEQ ID NO: 898782 - RNA, 19 nt, Homo sapiens
cagagggcuugaagacaug

SEQ ID NO: 898783 - RNA, 19 nt, Homo sapiens
ggaggcguguagcaacugu

SEQ ID NO: 898784 - RNA, 19 nt, Homo sapiens
guucucaugcuccuccaua

SEQ ID NO: 898785 - RNA, 19 nt, Homo sapiens
gaagaagaagaagaaguuc

SEQ ID NO: 898786 - RNA, 19 nt, Homo sapiens
ccugugaggcgaagaagaa

SEQ ID NO: 898787 - RNA, 19 nt, Homo sapiens
gcuggauacuucaccaaag

SEQ ID NO: 898788 - RNA, 19 nt, Homo sapiens
acaaugaggaaauggugua

SEQ ID NO: 898789 - RNA, 19 nt, Homo sapiens
gucccagacugauuacaug

SEQ ID NO: 898790 - RNA, 19 nt, Homo sapiens
ugauacgaauggacaggaa

SEQ ID NO: 898791 - RNA, 19 nt, Homo sapiens
agugagaauugcauuagga

SEQ ID NO: 898792 - RNA, 19 nt, Homo sapiens
gagaacugcuccccaaauc

SEQ ID NO: 898793 - RNA, 19 nt, Homo sapiens
gacacugccugcccuagag

SEQ ID NO: 898794 - RNA, 19 nt, Homo sapiens
cagcuaugauucaguuguc

SEQ ID NO: 898795 - RNA, 19 nt, Homo sapiens
ucuacacugugcuucauga

SEQ ID NO: 898796 - RNA, 19 nt, Homo sapiens
uuucggaacuucacucucu

SEQ ID NO: 898797 - RNA, 19 nt, Homo sapiens
guacagaaugaauggugaa

SEQ ID NO: 898798 - RNA, 19 nt, Homo sapiens
gcugcucgcugaccaucug

SEQ ID NO: 898799 - RNA, 19 nt, Homo sapiens
guagauaccggaaugaauu

SEQ ID NO: 898800 - RNA, 19 nt, Homo sapiens
uauaugcgcugcuguagau

SEQ ID NO: 898801 - RNA, 19 nt, Homo sapiens
gaagagcaaaugagccaaa

SEQ ID NO: 898802 - RNA, 19 nt, Homo sapiens
uugcauagguuuagagaga

SEQ ID NO: 898803 - RNA, 19 nt, Homo sapiens
ggaggguccuguacaaucu

SEQ ID NO: 898804 - RNA, 19 nt, Homo sapiens
gagccaaacgugaccacua

SEQ ID NO: 898805 - RNA, 19 nt, Homo sapiens
ccaccaccaucucaggaaa

SEQ ID NO: 898806 - RNA, 19 nt, Homo sapiens
gacuuucucugcaccaugu

SEQ ID NO: 898807 - RNA, 19 nt, Homo sapiens
gggauggcccagccuguaa

SEQ ID NO: 898808 - RNA, 19 nt, Homo sapiens
ggaaugaauuuucuguaca

SEQ ID NO: 898809 - RNA, 19 nt, Homo sapiens
uggcccagccuguaagaua

SEQ ID NO: 898810 - RNA, 19 nt, Homo sapiens
gagcaaaugagccaaacgu

SEQ ID NO: 898811 - RNA, 19 nt, Homo sapiens
ccgagauggagcccaauua

SEQ ID NO: 898812 - RNA, 19 nt, Homo sapiens
ccuggaggguccuguacaa

SEQ ID NO: 898813 - RNA, 19 nt, Homo sapiens
ggacucagcaucggaaggu

SEQ ID NO: 898814 - RNA, 19 nt, Homo sapiens
ccuguacaaucucaucaug

SEQ ID NO: 898815 - RNA, 19 nt, Homo sapiens
cgagauggagcccaauuag

SEQ ID NO: 898816 - RNA, 19 nt, Homo sapiens
uagauaccggaaugaauuu

SEQ ID NO: 898817 - RNA, 19 nt, Homo sapiens
gagagggacggcugaugga

SEQ ID NO: 898818 - RNA, 19 nt, Homo sapiens
uucuguacauguuugguua

SEQ ID NO: 898819 - RNA, 19 nt, Homo sapiens
ggcccagccuguaagauac

SEQ ID NO: 898820 - RNA, 19 nt, Homo sapiens
ugaccacuggcauucauuu

SEQ ID NO: 898821 - RNA, 19 nt, Homo sapiens
cugggucccuggccaagaa

SEQ ID NO: 898822 - RNA, 19 nt, Homo sapiens
agccaaacgugaccacuag

SEQ ID NO: 898823 - RNA, 19 nt, Homo sapiens
agauggagcccaauuaggu

SEQ ID NO: 898824 - RNA, 19 nt, Homo sapiens
guauaugcgcugcuguaga

SEQ ID NO: 898825 - RNA, 19 nt, Homo sapiens
uagagagagcgacguguga

SEQ ID NO: 898826 - RNA, 19 nt, Homo sapiens
gaccacuggcauucauuug

SEQ ID NO: 898827 - RNA, 19 nt, Homo sapiens
gagauggagcccaauuagg

SEQ ID NO: 898828 - RNA, 19 nt, Homo sapiens
gcaaaccuauaucagaaua

SEQ ID NO: 898829 - RNA, 19 nt, Homo sapiens
gcacaagucuucaugaaca

SEQ ID NO: 898830 - RNA, 19 nt, Homo sapiens
ggaaaucaguccucuuugu

SEQ ID NO: 898831 - RNA, 19 nt, Homo sapiens
gaaaucaguccucuuugua

SEQ ID NO: 898832 - RNA, 19 nt, Homo sapiens
gcacaggacaggcacuuua

SEQ ID NO: 898833 - RNA, 19 nt, Homo sapiens
gaaagggucugugaagaau

SEQ ID NO: 898834 - RNA, 19 nt, Homo sapiens
ucacagaacugccacuaug

SEQ ID NO: 898835 - RNA, 19 nt, Homo sapiens
gaacugccacuaugguuaa

SEQ ID NO: 898836 - RNA, 19 nt, Homo sapiens
gagcaacuccauucaguaa

SEQ ID NO: 898837 - RNA, 19 nt, Homo sapiens
ggcgaaaucuuguuugaga

SEQ ID NO: 898838 - RNA, 19 nt, Homo sapiens
aagcucaccuccacaauaa

SEQ ID NO: 898839 - RNA, 19 nt, Homo sapiens
gaacuugaacagaaauuug

SEQ ID NO: 898840 - RNA, 19 nt, Homo sapiens
gaaaugacacaggauauug

SEQ ID NO: 898841 - RNA, 19 nt, Homo sapiens
ggaugaaguugcuggauuc

SEQ ID NO: 898842 - RNA, 19 nt, Homo sapiens
gaagugugcugacauuugc

SEQ ID NO: 898843 - RNA, 19 nt, Homo sapiens
guacagaagccauuuguca

SEQ ID NO: 898844 - RNA, 19 nt, Homo sapiens
gaaacagccugguaacacu

SEQ ID NO: 898845 - RNA, 19 nt, Homo sapiens
caacaggcagaaugaauuu

SEQ ID NO: 898846 - RNA, 19 nt, Homo sapiens
cagcaccgcucagagauuu

SEQ ID NO: 898847 - RNA, 19 nt, Homo sapiens
ggaaaugacacaggauauu

SEQ ID NO: 898848 - RNA, 19 nt, Homo sapiens
aaucaucacuggcgaucua

SEQ ID NO: 898849 - RNA, 19 nt, Homo sapiens
gcugggagauauacgacua

SEQ ID NO: 898850 - RNA, 19 nt, Homo sapiens
cagcacaagucuucaugaa

SEQ ID NO: 898851 - RNA, 19 nt, Homo sapiens
acagaaauuugaacuggaa

SEQ ID NO: 898852 - RNA, 19 nt, Homo sapiens
aaggugaacuugaacagaa

SEQ ID NO: 898853 - RNA, 19 nt, Homo sapiens
ggacaggcacuuuaugcuu

SEQ ID NO: 898854 - RNA, 19 nt, Homo sapiens
gaagauuaccacagccaaa

SEQ ID NO: 898855 - RNA, 19 nt, Homo sapiens
caauacccauggacucauu

SEQ ID NO: 898856 - RNA, 19 nt, Homo sapiens
ucagagauuucacggcauu

SEQ ID NO: 898857 - RNA, 19 nt, Homo sapiens
caaagauacuuccaugcau

SEQ ID NO: 898858 - RNA, 19 nt, Homo sapiens
ggagugaaagggucuguga

SEQ ID NO: 898859 - RNA, 19 nt, Homo sapiens
cauucaccauuucaaguua

SEQ ID NO: 898860 - RNA, 19 nt, Homo sapiens
caaggcauaugcucuccaa

SEQ ID NO: 898861 - RNA, 19 nt, Homo sapiens
uugcaaaccuauaucagaa

SEQ ID NO: 898862 - RNA, 19 nt, Homo sapiens
ugaaagggucugugaagaa

SEQ ID NO: 898863 - RNA, 19 nt, Homo sapiens
ccuccacaauaaagacuua

SEQ ID NO: 898864 - RNA, 19 nt, Homo sapiens
cagcugggcuccuugaucu

SEQ ID NO: 898865 - RNA, 19 nt, Homo sapiens
ggcauaugcucuccaaagu

SEQ ID NO: 898866 - RNA, 19 nt, Homo sapiens
ggaugaagacuaccuugga

SEQ ID NO: 898867 - RNA, 19 nt, Homo sapiens
gcgaaaucuuguuugagaa

SEQ ID NO: 898868 - RNA, 19 nt, Homo sapiens
ccacuaugguuaaaugucu

SEQ ID NO: 898869 - RNA, 19 nt, Homo sapiens
gugaaagggucugugaaga

SEQ ID NO: 898870 - RNA, 19 nt, Homo sapiens
cagaaugccaaauguguuu

SEQ ID NO: 898871 - RNA, 19 nt, Homo sapiens
aaagauuccaucccuagua

SEQ ID NO: 898872 - RNA, 19 nt, Homo sapiens
aaagcucaccuccacaaua

SEQ ID NO: 898873 - RNA, 19 nt, Homo sapiens
ugagagguguggcgaaauc

SEQ ID NO: 898874 - RNA, 19 nt, Homo sapiens
guugagagguguggcgaaa

SEQ ID NO: 898875 - RNA, 19 nt, Homo sapiens
gcacuugucugggagaaaa

SEQ ID NO: 898876 - RNA, 19 nt, Homo sapiens
ugucugugcuggagaauca

SEQ ID NO: 898877 - RNA, 19 nt, Homo sapiens
guggcgaaaucuuguuuga

SEQ ID NO: 898878 - RNA, 19 nt, Homo sapiens
uggaugaaguugcuggauu

SEQ ID NO: 898879 - RNA, 19 nt, Homo sapiens
ucaacaggcagaaugaauu

SEQ ID NO: 898880 - RNA, 19 nt, Homo sapiens
gcaacuccauucaguaacg

SEQ ID NO: 898881 - RNA, 19 nt, Homo sapiens
aagauuccaucccuaguau

SEQ ID NO: 898882 - RNA, 19 nt, Homo sapiens
gcugcuucguggaauuaua

SEQ ID NO: 898883 - RNA, 19 nt, Homo sapiens
gcuccuacccauucauuga

SEQ ID NO: 898884 - RNA, 19 nt, Homo sapiens
gcugacauuugcaauccuu

SEQ ID NO: 898885 - RNA, 19 nt, Homo sapiens
ccacaauaaagacuuaaga

SEQ ID NO: 898886 - RNA, 19 nt, Homo sapiens
cacuggcgaucuacaauug

SEQ ID NO: 898887 - RNA, 19 nt, Homo sapiens
gagucucucuuucuaccuu

SEQ ID NO: 898888 - RNA, 19 nt, Homo sapiens
gcagcagcccagccacuuu

SEQ ID NO: 898889 - RNA, 19 nt, Homo sapiens
ucaguccucuuuguaauca

SEQ ID NO: 898890 - RNA, 19 nt, Homo sapiens
ugaagugugcugacauuug

SEQ ID NO: 898891 - RNA, 19 nt, Homo sapiens
ggaaacagccugguaacac

SEQ ID NO: 898892 - RNA, 19 nt, Homo sapiens
ucaaagauacuuccaugca

SEQ ID NO: 898893 - RNA, 19 nt, Homo sapiens
cuuucuaccuuccuucuuu

SEQ ID NO: 898894 - RNA, 19 nt, Homo sapiens
gaucagaaugccaaaugug

SEQ ID NO: 898895 - RNA, 19 nt, Homo sapiens
aaucaguccucuuuguaau

SEQ ID NO: 898896 - RNA, 19 nt, Homo sapiens
aaaucaguccucuuuguaa

SEQ ID NO: 898897 - RNA, 19 nt, Homo sapiens
ggacaagcaaggcauaugc

SEQ ID NO: 898898 - RNA, 19 nt, Homo sapiens
aaauugguuucaugagcua

SEQ ID NO: 898899 - RNA, 19 nt, Homo sapiens
gacauuugcaauccuugua

SEQ ID NO: 898900 - RNA, 19 nt, Homo sapiens
agaacugccacuaugguua

SEQ ID NO: 898901 - RNA, 19 nt, Homo sapiens
gggcccauuucacggguaa

SEQ ID NO: 898902 - RNA, 19 nt, Homo sapiens
cuggaaaucaguccucuuu

SEQ ID NO: 898903 - RNA, 19 nt, Homo sapiens
cuugaagugugcugacauu

SEQ ID NO: 898904 - RNA, 19 nt, Homo sapiens
gaucuuggcaacagacauc

SEQ ID NO: 898905 - RNA, 19 nt, Homo sapiens
ugacacaggauauugaaca

SEQ ID NO: 898906 - RNA, 19 nt, Homo sapiens
gaaagauuccaucccuagu

SEQ ID NO: 898907 - RNA, 19 nt, Homo sapiens
uggcaugcuucgagaauca

SEQ ID NO: 898908 - RNA, 19 nt, Homo sapiens
agucaugguucaagaagau

SEQ ID NO: 898909 - RNA, 19 nt, Homo sapiens
gagguguggcgaaaucuug

SEQ ID NO: 898910 - RNA, 19 nt, Homo sapiens
gccaucuuccucccacuua

SEQ ID NO: 898911 - RNA, 19 nt, Homo sapiens
gcagcacaagucuucauga

SEQ ID NO: 898912 - RNA, 19 nt, Homo sapiens
gcagcaccgcucagagauu

SEQ ID NO: 898913 - RNA, 19 nt, Homo sapiens
aagggucugugaagaauuc

SEQ ID NO: 898914 - RNA, 19 nt, Homo sapiens
gaaagcucaccuccacaau

SEQ ID NO: 898915 - RNA, 19 nt, Homo sapiens
ugaaagcucaccuccacaa

SEQ ID NO: 898916 - RNA, 19 nt, Homo sapiens
gacaucaacaggcagaaug

SEQ ID NO: 898917 - RNA, 19 nt, Homo sapiens
ggagaaaagugguguuacu

SEQ ID NO: 898918 - RNA, 19 nt, Homo sapiens
ggacucauucaccauuuca

SEQ ID NO: 898919 - RNA, 19 nt, Homo sapiens
cgaucagaaugccaaaugu

SEQ ID NO: 898920 - RNA, 19 nt, Homo sapiens
ucagaucgccuugaagugu

SEQ ID NO: 898921 - RNA, 19 nt, Homo sapiens
uaaccaccaucuugcaaac

SEQ ID NO: 898922 - RNA, 19 nt, Homo sapiens
uagauauggugaccuuaca

SEQ ID NO: 898923 - RNA, 19 nt, Homo sapiens
gcauaugcucuccaaagug

SEQ ID NO: 898924 - RNA, 19 nt, Homo sapiens
aaaugacacaggauauuga

SEQ ID NO: 898925 - RNA, 19 nt, Homo sapiens
aaggaaaugacacaggaua

SEQ ID NO: 898926 - RNA, 19 nt, Homo sapiens
acaacaaggcccaguggaa

SEQ ID NO: 898927 - RNA, 19 nt, Homo sapiens
caccauuucaaguuagaua

SEQ ID NO: 898928 - RNA, 19 nt, Homo sapiens
gggcuguggucuagcauaa

SEQ ID NO: 898929 - RNA, 19 nt, Homo sapiens
gggcauagacagcuuauuc

SEQ ID NO: 898930 - RNA, 19 nt, Homo sapiens
ggagaaggaggcccuggua

SEQ ID NO: 898931 - RNA, 19 nt, Homo sapiens
caagcaccauauggaaaua

SEQ ID NO: 898932 - RNA, 19 nt, Homo sapiens
ggacagcuuccacacagaa

SEQ ID NO: 898933 - RNA, 19 nt, Homo sapiens
gagcuucgagggugauuug

SEQ ID NO: 898934 - RNA, 19 nt, Homo sapiens
caagaugaccgacaacaag

SEQ ID NO: 898935 - RNA, 19 nt, Homo sapiens
gcuguggucuagcauaaag

SEQ ID NO: 898936 - RNA, 19 nt, Homo sapiens
cgagggugauuugaaggua

SEQ ID NO: 898937 - RNA, 19 nt, Homo sapiens
ccaagcaccauauggaaau

SEQ ID NO: 898938 - RNA, 19 nt, Homo sapiens
guggccuucuggaucauua

SEQ ID NO: 898939 - RNA, 19 nt, Homo sapiens
ucgacaagaugaccgacaa

SEQ ID NO: 898940 - RNA, 19 nt, Homo sapiens
cugcagcuccuauccauga

SEQ ID NO: 898941 - RNA, 19 nt, Homo sapiens
cggguggccuucuggauca

SEQ ID NO: 898942 - RNA, 19 nt, Homo sapiens
ccugggaacuaccacaaag

SEQ ID NO: 898943 - RNA, 19 nt, Homo sapiens
ccagccaccuccagaucga

SEQ ID NO: 898944 - RNA, 19 nt, Homo sapiens
ccauauggaaauaaaguuc

SEQ ID NO: 898945 - RNA, 19 nt, Homo sapiens
uacccaggauggaggagaa

SEQ ID NO: 898946 - RNA, 19 nt, Homo sapiens
gcauagacagcuuauucuc

SEQ ID NO: 898947 - RNA, 19 nt, Homo sapiens
acaagaugaccgacaacaa

SEQ ID NO: 898948 - RNA, 19 nt, Homo sapiens
gcaaggggacccacaagga

SEQ ID NO: 898949 - RNA, 19 nt, Homo sapiens
agaaugugguggcauccau

SEQ ID NO: 898950 - RNA, 19 nt, Homo sapiens
gaugaccgacaacaagaca

SEQ ID NO: 898951 - RNA, 19 nt, Homo sapiens
caccauauggaaauaaagu

SEQ ID NO: 898952 - RNA, 19 nt, Homo sapiens
uaaaggcggagcccagaag

SEQ ID NO: 898953 - RNA, 19 nt, Homo sapiens
gaugcugacgcccaagaga

SEQ ID NO: 898954 - RNA, 19 nt, Homo sapiens
aagaugaccgacaacaaga

SEQ ID NO: 898955 - RNA, 19 nt, Homo sapiens
cauagacagcuuauucucu

SEQ ID NO: 898956 - RNA, 19 nt, Homo sapiens
agcaccauauggaaauaaa

SEQ ID NO: 898957 - RNA, 19 nt, Homo sapiens
ggagaaaguugucugagaa

SEQ ID NO: 898958 - RNA, 19 nt, Homo sapiens
gcagcaugcucgauuaaga

SEQ ID NO: 898959 - RNA, 19 nt, Homo sapiens
gaagccaaguauuaagaaa

SEQ ID NO: 898960 - RNA, 19 nt, Homo sapiens
uaaagaagaauccacauug

SEQ ID NO: 898961 - RNA, 19 nt, Homo sapiens
gggagaaaguugucugaga

SEQ ID NO: 898962 - RNA, 19 nt, Homo sapiens
gaagaauccacauugcaaa

SEQ ID NO: 898963 - RNA, 19 nt, Homo sapiens
uaaagacacugcucaagcu

SEQ ID NO: 898964 - RNA, 19 nt, Homo sapiens
aaaggaagccaaguauuaa

SEQ ID NO: 898965 - RNA, 19 nt, Homo sapiens
aaaaggaagccaaguauua

SEQ ID NO: 898966 - RNA, 19 nt, Homo sapiens
ggacugcaauaccagaaag

SEQ ID NO: 898967 - RNA, 19 nt, Homo sapiens
uagaaaggcagcuugauga

SEQ ID NO: 898968 - RNA, 19 nt, Homo sapiens
gacaagagggagaaaguug

SEQ ID NO: 898969 - RNA, 19 nt, Homo sapiens
ggaagccaaguauuaagaa

SEQ ID NO: 898970 - RNA, 19 nt, Homo sapiens
caugcucgauuaagaguau

SEQ ID NO: 898971 - RNA, 19 nt, Homo sapiens
gaagccaauugaccagcaa

SEQ ID NO: 898972 - RNA, 19 nt, Homo sapiens
ggacaagagggagaaaguu

SEQ ID NO: 898973 - RNA, 19 nt, Homo sapiens
ggagagcagccucgcuuug

SEQ ID NO: 898974 - RNA, 19 nt, Homo sapiens
gcauaaagacacugcucaa

SEQ ID NO: 898975 - RNA, 19 nt, Homo sapiens
aaagaagaauccacauugc

SEQ ID NO: 898976 - RNA, 19 nt, Homo sapiens
cgauuaagaguaugccaaa

SEQ ID NO: 898977 - RNA, 19 nt, Homo sapiens
gaagggacaagagggagaa

SEQ ID NO: 898978 - RNA, 19 nt, Homo sapiens
uggcacacaugcagaagga

SEQ ID NO: 898979 - RNA, 19 nt, Homo sapiens
ccagaagagggcauaaaga

SEQ ID NO: 898980 - RNA, 19 nt, Homo sapiens
gagcucugcugaccugcau

SEQ ID NO: 898981 - RNA, 19 nt, Homo sapiens
agaagaauccacauugcaa

SEQ ID NO: 898982 - RNA, 19 nt, Homo sapiens
ucggcagcaugcucgauua

SEQ ID NO: 898983 - RNA, 19 nt, Homo sapiens
gacacggacugcaauacca

SEQ ID NO: 898984 - RNA, 19 nt, Homo sapiens
gagggagaaaguugucuga

SEQ ID NO: 898985 - RNA, 19 nt, Homo sapiens
ugagcaagauggcacacau

SEQ ID NO: 898986 - RNA, 19 nt, Homo sapiens
gaagaugcaaccccaauau

SEQ ID NO: 898987 - RNA, 19 nt, Homo sapiens
gaaaaccaacccaaaagga

SEQ ID NO: 898988 - RNA, 19 nt, Homo sapiens
agccaaguauuaagaaauc

SEQ ID NO: 898989 - RNA, 19 nt, Homo sapiens
uuagaaaggcagcuugaug

SEQ ID NO: 898990 - RNA, 19 nt, Homo sapiens
ugaacgauguuuguacuac

SEQ ID NO: 898991 - RNA, 19 nt, Homo sapiens
gagcaagauggcacacaug

SEQ ID NO: 898992 - RNA, 19 nt, Homo sapiens
gccguucugugcuacaugu

SEQ ID NO: 898993 - RNA, 19 nt, Homo sapiens
cgacuguggcccuggacua

SEQ ID NO: 898994 - RNA, 19 nt, Homo sapiens
cagaagagggcauaaagac

SEQ ID NO: 898995 - RNA, 19 nt, Homo sapiens
gagagcagccucgcuuugg

SEQ ID NO: 898996 - RNA, 19 nt, Homo sapiens
gggacaagagggagaaagu

SEQ ID NO: 898997 - RNA, 19 nt, Homo sapiens
ggaagaugcaaccccaaua

SEQ ID NO: 898998 - RNA, 19 nt, Homo sapiens
gacuguggcccuggacuuu

SEQ ID NO: 898999 - RNA, 19 nt, Homo sapiens
ucugagaacuuuugacugu

SEQ ID NO: 899000 - RNA, 19 nt, Homo sapiens
agaugcaaccccaauauua

SEQ ID NO: 899001 - RNA, 19 nt, Homo sapiens
gaccagcaaucggcagcau

SEQ ID NO: 899002 - RNA, 19 nt, Homo sapiens
ugcucaagcuccagaaauc

SEQ ID NO: 899003 - RNA, 19 nt, Homo sapiens
caagagggagaaaguuguc

SEQ ID NO: 899004 - RNA, 19 nt, Homo sapiens
ccaaaaggaagccaaguau

SEQ ID NO: 899005 - RNA, 19 nt, Homo sapiens
gcaagauggcacacaugca

SEQ ID NO: 899006 - RNA, 19 nt, Homo sapiens
cggcagcaugcucgauuaa

SEQ ID NO: 899007 - RNA, 19 nt, Homo sapiens
ugugaacgauguuuguacu

SEQ ID NO: 899008 - RNA, 19 nt, Homo sapiens
gugaacgauguuuguacua

SEQ ID NO: 899009 - RNA, 19 nt, Homo sapiens
gccaaguauuaagaaauca

SEQ ID NO: 899010 - RNA, 19 nt, Homo sapiens
caaaaggaagccaaguauu

SEQ ID NO: 899011 - RNA, 19 nt, Homo sapiens
gagcguagcauacagguua

SEQ ID NO: 899012 - RNA, 19 nt, Homo sapiens
cuacauggcuuugauaauu

SEQ ID NO: 899013 - RNA, 19 nt, Homo sapiens
gggcgaggauuauaaauga

SEQ ID NO: 899014 - RNA, 19 nt, Homo sapiens
ggaauuaaggucaaacuaa

SEQ ID NO: 899015 - RNA, 19 nt, Homo sapiens
gaaauaauaccauccaugu

SEQ ID NO: 899016 - RNA, 19 nt, Homo sapiens
agaagaagcugcugcuaaa

SEQ ID NO: 899017 - RNA, 19 nt, Homo sapiens
gaaacaugguuguaauaug

SEQ ID NO: 899018 - RNA, 19 nt, Homo sapiens
acacgaagguuggaaauaa

SEQ ID NO: 899019 - RNA, 19 nt, Homo sapiens
gcaugcacaucuggaauua

SEQ ID NO: 899020 - RNA, 19 nt, Homo sapiens
aaacuuaccucccagcuau

SEQ ID NO: 899021 - RNA, 19 nt, Homo sapiens
gcacaugauuguauaagca

SEQ ID NO: 899022 - RNA, 19 nt, Homo sapiens
gggaggagauggaaacaau

SEQ ID NO: 899023 - RNA, 19 nt, Homo sapiens
ggguagaugugcaauagaa

SEQ ID NO: 899024 - RNA, 19 nt, Homo sapiens
caugagguguugugcauuu

SEQ ID NO: 899025 - RNA, 19 nt, Homo sapiens
ccgagaaauucacaagaua

SEQ ID NO: 899026 - RNA, 19 nt, Homo sapiens
cagaaacaguacuuaggua

SEQ ID NO: 899027 - RNA, 19 nt, Homo sapiens
ucacaucccucuaaaagua

SEQ ID NO: 899028 - RNA, 19 nt, Homo sapiens
caacugaagacaauuauca

SEQ ID NO: 899029 - RNA, 19 nt, Homo sapiens
gagccugacugaagagaug

SEQ ID NO: 899030 - RNA, 19 nt, Homo sapiens
aaacaugguuguaauaugc

SEQ ID NO: 899031 - RNA, 19 nt, Homo sapiens
ggagaagagugcccugcuu

SEQ ID NO: 899032 - RNA, 19 nt, Homo sapiens
gagaagagugcccugcuuu

SEQ ID NO: 899033 - RNA, 19 nt, Homo sapiens
gagaggagccugacugaag

SEQ ID NO: 899034 - RNA, 19 nt, Homo sapiens
caagaucaauucccucucu

SEQ ID NO: 899035 - RNA, 19 nt, Homo sapiens
gcuaaagcaucaucagaag

SEQ ID NO: 899036 - RNA, 19 nt, Homo sapiens
gcauaaaucacuucaacug

SEQ ID NO: 899037 - RNA, 19 nt, Homo sapiens
cagaagaagcugcugcuaa

SEQ ID NO: 899038 - RNA, 19 nt, Homo sapiens
gagcagggcugugugaaac

SEQ ID NO: 899039 - RNA, 19 nt, Homo sapiens
cagcaacugaagacaauua

SEQ ID NO: 899040 - RNA, 19 nt, Homo sapiens
ggacacgcagcacaaauug

SEQ ID NO: 899041 - RNA, 19 nt, Homo sapiens
ggaccaggcuguggguaga

SEQ ID NO: 899042 - RNA, 19 nt, Homo sapiens
caaauggucuuuucagaga

SEQ ID NO: 899043 - RNA, 19 nt, Homo sapiens
cgagaaauucacaagauaa

SEQ ID NO: 899044 - RNA, 19 nt, Homo sapiens
gcagacagccguuuguucu

SEQ ID NO: 899045 - RNA, 19 nt, Homo sapiens
cuacgccacuccacaaaug

SEQ ID NO: 899046 - RNA, 19 nt, Homo sapiens
gaccagagcaguuucaucu

SEQ ID NO: 899047 - RNA, 19 nt, Homo sapiens
ucacuuagcagcaacugaa

SEQ ID NO: 899048 - RNA, 19 nt, Homo sapiens
gaaacaguacuuagguaau

SEQ ID NO: 899049 - RNA, 19 nt, Homo sapiens
gcagaaacaguacuuaggu

SEQ ID NO: 899050 - RNA, 19 nt, Homo sapiens
acaaugagaccaacacaga

SEQ ID NO: 899051 - RNA, 19 nt, Homo sapiens
gugaaacaugguuguaaua

SEQ ID NO: 899052 - RNA, 19 nt, Homo sapiens
gcagccguccuucuaauga

SEQ ID NO: 899053 - RNA, 19 nt, Homo sapiens
caaaagugcuccccaaaag

SEQ ID NO: 899054 - RNA, 19 nt, Homo sapiens
gaaauucacaagauaacca

SEQ ID NO: 899055 - RNA, 19 nt, Homo sapiens
uaaagcaucaucagaagug

SEQ ID NO: 899056 - RNA, 19 nt, Homo sapiens
gaagugaaccuggcaaacu

SEQ ID NO: 899057 - RNA, 19 nt, Homo sapiens
ccagauuauuggcugcuuu

SEQ ID NO: 899058 - RNA, 19 nt, Homo sapiens
gggcagccguccuucuaau

SEQ ID NO: 899059 - RNA, 19 nt, Homo sapiens
gcucagcuccuaccucugu

SEQ ID NO: 899060 - RNA, 19 nt, Homo sapiens
ggagagucaggcaggguua

SEQ ID NO: 899061 - RNA, 19 nt, Homo sapiens
agaggagccugacugaaga

SEQ ID NO: 899062 - RNA, 19 nt, Homo sapiens
ccagagagguccccgauga

SEQ ID NO: 899063 - RNA, 19 nt, Homo sapiens
aagcauaaaucacuucaac

SEQ ID NO: 899064 - RNA, 19 nt, Homo sapiens
ugaagacaauuaucaacca

SEQ ID NO: 899065 - RNA, 19 nt, Homo sapiens
gcagcgcgguggaagagau

SEQ ID NO: 899066 - RNA, 19 nt, Homo sapiens
guagggcgaggauuauaaa

SEQ ID NO: 899067 - RNA, 19 nt, Homo sapiens
cuucagcuguugcagauga

SEQ ID NO: 899068 - RNA, 19 nt, Homo sapiens
gagguguugugcauuuguu

SEQ ID NO: 899069 - RNA, 19 nt, Homo sapiens
uaaaguugcacaugauugu

SEQ ID NO: 899070 - RNA, 19 nt, Homo sapiens
gcgaggauuauaaaugaaa

SEQ ID NO: 899071 - RNA, 19 nt, Homo sapiens
gugaagaccagagcaguuu

SEQ ID NO: 899072 - RNA, 19 nt, Homo sapiens
uacauggcuuugauaauug

SEQ ID NO: 899073 - RNA, 19 nt, Homo sapiens
gaccucggcuccagucaag

SEQ ID NO: 899074 - RNA, 19 nt, Homo sapiens
guggguagaugugcaauag

SEQ ID NO: 899075 - RNA, 19 nt, Homo sapiens
cagagacaguuaucacauc

SEQ ID NO: 899076 - RNA, 19 nt, Homo sapiens
gccacagccugguguaugu

SEQ ID NO: 899077 - RNA, 19 nt, Homo sapiens
guuuaaaguugcacaugau

SEQ ID NO: 899078 - RNA, 19 nt, Homo sapiens
agaaacaguacuuagguaa

SEQ ID NO: 899079 - RNA, 19 nt, Homo sapiens
gaggagauggaaacaaugu

SEQ ID NO: 899080 - RNA, 19 nt, Homo sapiens
ugugaaacaugguuguaau

SEQ ID NO: 899081 - RNA, 19 nt, Homo sapiens
caaaaucacuuagcagcaa

SEQ ID NO: 899082 - RNA, 19 nt, Homo sapiens
caucuggaauuaaggucaa

SEQ ID NO: 899083 - RNA, 19 nt, Homo sapiens
gaagaccagagcaguuuca

SEQ ID NO: 899084 - RNA, 19 nt, Homo sapiens
uagguaagcugugccuuca

SEQ ID NO: 899085 - RNA, 19 nt, Homo sapiens
cuacaucuucuucccagua

SEQ ID NO: 899086 - RNA, 19 nt, Homo sapiens
cauccagaguucuuaaagu

SEQ ID NO: 899087 - RNA, 19 nt, Homo sapiens
uacaucuucuucccaguaa

SEQ ID NO: 899088 - RNA, 19 nt, Homo sapiens
caacacagacacgaagguu

SEQ ID NO: 899089 - RNA, 19 nt, Homo sapiens
caaacuuaccucccagcua

SEQ ID NO: 899090 - RNA, 19 nt, Homo sapiens
auccagaguucuuaaaguu

SEQ ID NO: 899091 - RNA, 19 nt, Homo sapiens
ucaaacuaauucucacauc

SEQ ID NO: 899092 - RNA, 19 nt, Homo sapiens
cacgaagguuggaaauaau

SEQ ID NO: 899093 - RNA, 19 nt, Homo sapiens
agagugcccugcuuugcaa

SEQ ID NO: 899094 - RNA, 19 nt, Homo sapiens
gggcugaccaggcuucuuc

SEQ ID NO: 899095 - RNA, 19 nt, Homo sapiens
gacacgaagguuggaaaua

SEQ ID NO: 899096 - RNA, 19 nt, Homo sapiens
guagaugugcaauagaaau

SEQ ID NO: 899097 - RNA, 19 nt, Homo sapiens
ccucccagcuaucacaaug

SEQ ID NO: 899098 - RNA, 19 nt, Homo sapiens
gcagggcugugugaaacau

SEQ ID NO: 899099 - RNA, 19 nt, Homo sapiens
uuuggcaguugcauuagua

SEQ ID NO: 899100 - RNA, 19 nt, Homo sapiens
cagccguccuucuaaugaa

SEQ ID NO: 899101 - RNA, 19 nt, Homo sapiens
gcacaucuggaauuaaggu

SEQ ID NO: 899102 - RNA, 19 nt, Homo sapiens
aguuuaaaguugcacauga

SEQ ID NO: 899103 - RNA, 19 nt, Homo sapiens
aauuguagggcgaggauua

SEQ ID NO: 899104 - RNA, 19 nt, Homo sapiens
ggaggacacgcagcacaaa

SEQ ID NO: 899105 - RNA, 19 nt, Homo sapiens
ggaaggagaaugggauuuu

SEQ ID NO: 899106 - RNA, 19 nt, Homo sapiens
ggagcuagagccugaugga

SEQ ID NO: 899107 - RNA, 19 nt, Homo sapiens
ccagagaggccugcuguuc

SEQ ID NO: 899108 - RNA, 19 nt, Homo sapiens
gacaaauggucuuuucaga

SEQ ID NO: 899109 - RNA, 19 nt, Homo sapiens
gcaccgagaaauucacaag

SEQ ID NO: 899110 - RNA, 19 nt, Homo sapiens
ggcaugcacaucuggaauu

SEQ ID NO: 899111 - RNA, 19 nt, Homo sapiens
gagcguagcauacagguua

SEQ ID NO: 899112 - RNA, 19 nt, Homo sapiens
cuacauggcuuugauaauu

SEQ ID NO: 899113 - RNA, 19 nt, Homo sapiens
gggcgaggauuauaaauga

SEQ ID NO: 899114 - RNA, 19 nt, Homo sapiens
ggaauuaaggucaaacuaa

SEQ ID NO: 899115 - RNA, 19 nt, Homo sapiens
gaaauaauaccauccaugu

SEQ ID NO: 899116 - RNA, 19 nt, Homo sapiens
agaagaagcugcugcuaaa

SEQ ID NO: 899117 - RNA, 19 nt, Homo sapiens
gaaacaugguuguaauaug

SEQ ID NO: 899118 - RNA, 19 nt, Homo sapiens
acacgaagguuggaaauaa

SEQ ID NO: 899119 - RNA, 19 nt, Homo sapiens
gcaugcacaucuggaauua

SEQ ID NO: 899120 - RNA, 19 nt, Homo sapiens
aaacuuaccucccagcuau

SEQ ID NO: 899121 - RNA, 19 nt, Homo sapiens
gcacaugauuguauaagca

SEQ ID NO: 899122 - RNA, 19 nt, Homo sapiens
gggaggagauggaaacaau

SEQ ID NO: 899123 - RNA, 19 nt, Homo sapiens
ggguagaugugcaauagaa

SEQ ID NO: 899124 - RNA, 19 nt, Homo sapiens
caugagguguugugcauuu

SEQ ID NO: 899125 - RNA, 19 nt, Homo sapiens
ccgagaaauucacaagaua

SEQ ID NO: 899126 - RNA, 19 nt, Homo sapiens
uaaaucacuucaacugcua

SEQ ID NO: 899127 - RNA, 19 nt, Homo sapiens
cagaaacaguacuuaggua

SEQ ID NO: 899128 - RNA, 19 nt, Homo sapiens
ucacaucccucuaaaagua

SEQ ID NO: 899129 - RNA, 19 nt, Homo sapiens
caacugaagacaauuauca

SEQ ID NO: 899130 - RNA, 19 nt, Homo sapiens
gagccugacugaagagaug

SEQ ID NO: 899131 - RNA, 19 nt, Homo sapiens
aaacaugguuguaauaugc

SEQ ID NO: 899132 - RNA, 19 nt, Homo sapiens
ggagaagagugcccugcuu

SEQ ID NO: 899133 - RNA, 19 nt, Homo sapiens
gagaagagugcccugcuuu

SEQ ID NO: 899134 - RNA, 19 nt, Homo sapiens
gagaggagccugacugaag

SEQ ID NO: 899135 - RNA, 19 nt, Homo sapiens
caagaucaauucccucucu

SEQ ID NO: 899136 - RNA, 19 nt, Homo sapiens
gcuaaagcaucaucagaag

SEQ ID NO: 899137 - RNA, 19 nt, Homo sapiens
gcauaaaucacuucaacug

SEQ ID NO: 899138 - RNA, 19 nt, Homo sapiens
cagaagaagcugcugcuaa

SEQ ID NO: 899139 - RNA, 19 nt, Homo sapiens
gagcagggcugugugaaac

SEQ ID NO: 899140 - RNA, 19 nt, Homo sapiens
cagcaacugaagacaauua

SEQ ID NO: 899141 - RNA, 19 nt, Homo sapiens
ggaccaggcuguggguaga

SEQ ID NO: 899142 - RNA, 19 nt, Homo sapiens
caaauggucuuuucagaga

SEQ ID NO: 899143 - RNA, 19 nt, Homo sapiens
ggacacgcagcacaaauug

SEQ ID NO: 899144 - RNA, 19 nt, Homo sapiens
cgagaaauucacaagauaa

SEQ ID NO: 899145 - RNA, 19 nt, Homo sapiens
gcagacagccguuuguucu

SEQ ID NO: 899146 - RNA, 19 nt, Homo sapiens
cuacgccacuccacaaaug

SEQ ID NO: 899147 - RNA, 19 nt, Homo sapiens
gaccagagcaguuucaucu

SEQ ID NO: 899148 - RNA, 19 nt, Homo sapiens
ucacuuagcagcaacugaa

SEQ ID NO: 899149 - RNA, 19 nt, Homo sapiens
gaaacaguacuuagguaau

SEQ ID NO: 899150 - RNA, 19 nt, Homo sapiens
gcagaaacaguacuuaggu

SEQ ID NO: 899151 - RNA, 19 nt, Homo sapiens
acaaugagaccaacacaga

SEQ ID NO: 899152 - RNA, 19 nt, Homo sapiens
gugaaacaugguuguaaua

SEQ ID NO: 899153 - RNA, 19 nt, Homo sapiens
gcagccguccuucuaauga

SEQ ID NO: 899154 - RNA, 19 nt, Homo sapiens
caaaagugcuccccaaaag

SEQ ID NO: 899155 - RNA, 19 nt, Homo sapiens
gaaauucacaagauaacca

SEQ ID NO: 899156 - RNA, 19 nt, Homo sapiens
gaagugaaccuggcaaacu

SEQ ID NO: 899157 - RNA, 19 nt, Homo sapiens
uaaagcaucaucagaagug

SEQ ID NO: 899158 - RNA, 19 nt, Homo sapiens
ccagauuauuggcugcuuu

SEQ ID NO: 899159 - RNA, 19 nt, Homo sapiens
gggcagccguccuucuaau

SEQ ID NO: 899160 - RNA, 19 nt, Homo sapiens
gcucagcuccuaccucugu

SEQ ID NO: 899161 - RNA, 19 nt, Homo sapiens
ggagagucaggcaggguua

SEQ ID NO: 899162 - RNA, 19 nt, Homo sapiens
agaggagccugacugaaga

SEQ ID NO: 899163 - RNA, 19 nt, Homo sapiens
ccagagagguccccgauga

SEQ ID NO: 899164 - RNA, 19 nt, Homo sapiens
aagcauaaaucacuucaac

SEQ ID NO: 899165 - RNA, 19 nt, Homo sapiens
gcagcgcgguggaagagau

SEQ ID NO: 899166 - RNA, 19 nt, Homo sapiens
ugaagacaauuaucaacca

SEQ ID NO: 899167 - RNA, 19 nt, Homo sapiens
guagggcgaggauuauaaa

SEQ ID NO: 899168 - RNA, 19 nt, Homo sapiens
cuucagcuguugcagauga

SEQ ID NO: 899169 - RNA, 19 nt, Homo sapiens
gagguguugugcauuuguu

SEQ ID NO: 899170 - RNA, 19 nt, Homo sapiens
uaaaguugcacaugauugu

SEQ ID NO: 899171 - RNA, 19 nt, Homo sapiens
gaccucggcuccagucaag

SEQ ID NO: 899172 - RNA, 19 nt, Homo sapiens
gcgaggauuauaaaugaaa

SEQ ID NO: 899173 - RNA, 19 nt, Homo sapiens
gugaagaccagagcaguuu

SEQ ID NO: 899174 - RNA, 19 nt, Homo sapiens
uacauggcuuugauaauug

SEQ ID NO: 899175 - RNA, 19 nt, Homo sapiens
guggguagaugugcaauag

SEQ ID NO: 899176 - RNA, 19 nt, Homo sapiens
cagagacaguuaucacauc

SEQ ID NO: 899177 - RNA, 19 nt, Homo sapiens
gccacagccugguguaugu

SEQ ID NO: 899178 - RNA, 19 nt, Homo sapiens
guuuaaaguugcacaugau

SEQ ID NO: 899179 - RNA, 19 nt, Homo sapiens
agaaacaguacuuagguaa

SEQ ID NO: 899180 - RNA, 19 nt, Homo sapiens
gaggagauggaaacaaugu

SEQ ID NO: 899181 - RNA, 19 nt, Homo sapiens
ugugaaacaugguuguaau

SEQ ID NO: 899182 - RNA, 19 nt, Homo sapiens
caaaaucacuuagcagcaa

SEQ ID NO: 899183 - RNA, 19 nt, Homo sapiens
caucuggaauuaaggucaa

SEQ ID NO: 899184 - RNA, 19 nt, Homo sapiens
gaagaccagagcaguuuca

SEQ ID NO: 899185 - RNA, 19 nt, Homo sapiens
uagguaagcugugccuuca

SEQ ID NO: 899186 - RNA, 19 nt, Homo sapiens
cuacaucuucuucccagua

SEQ ID NO: 899187 - RNA, 19 nt, Homo sapiens
cauccagaguucuuaaagu

SEQ ID NO: 899188 - RNA, 19 nt, Homo sapiens
caaacuuaccucccagcua

SEQ ID NO: 899189 - RNA, 19 nt, Homo sapiens
uacaucuucuucccaguaa

SEQ ID NO: 899190 - RNA, 19 nt, Homo sapiens
caacacagacacgaagguu

SEQ ID NO: 899191 - RNA, 19 nt, Homo sapiens
auccagaguucuuaaaguu

SEQ ID NO: 899192 - RNA, 19 nt, Homo sapiens
ucaaacuaauucucacauc

SEQ ID NO: 899193 - RNA, 19 nt, Homo sapiens
agagugcccugcuuugcaa

SEQ ID NO: 899194 - RNA, 19 nt, Homo sapiens
gggcugaccaggcuucuuc

SEQ ID NO: 899195 - RNA, 19 nt, Homo sapiens
cacgaagguuggaaauaau

SEQ ID NO: 899196 - RNA, 19 nt, Homo sapiens
guagaugugcaauagaaau

SEQ ID NO: 899197 - RNA, 19 nt, Homo sapiens
gacacgaagguuggaaaua

SEQ ID NO: 899198 - RNA, 19 nt, Homo sapiens
ccucccagcuaucacaaug

SEQ ID NO: 899199 - RNA, 19 nt, Homo sapiens
gcagggcugugugaaacau

SEQ ID NO: 899200 - RNA, 19 nt, Homo sapiens
uuuggcaguugcauuagua

SEQ ID NO: 899201 - RNA, 19 nt, Homo sapiens
cagccguccuucuaaugaa

SEQ ID NO: 899202 - RNA, 19 nt, Homo sapiens
gcacaucuggaauuaaggu

SEQ ID NO: 899203 - RNA, 19 nt, Homo sapiens
aguuuaaaguugcacauga

SEQ ID NO: 899204 - RNA, 19 nt, Homo sapiens
aauuguagggcgaggauua

SEQ ID NO: 899205 - RNA, 19 nt, Homo sapiens
gggcugaccugugcuuggu

SEQ ID NO: 899206 - RNA, 19 nt, Homo sapiens
ggaggacacgcagcacaaa

SEQ ID NO: 899207 - RNA, 19 nt, Homo sapiens
ggaaggagaaugggauuuu

SEQ ID NO: 899208 - RNA, 19 nt, Homo sapiens
ggagcuagagccugaugga

SEQ ID NO: 899209 - RNA, 19 nt, Homo sapiens
ccagagaggccugcuguuc

SEQ ID NO: 899210 - RNA, 19 nt, Homo sapiens
gacaaauggucuuuucaga

SEQ ID NO: 899211 - RNA, 19 nt, Homo sapiens
gacaguauaucucucuuua

SEQ ID NO: 899212 - RNA, 19 nt, Homo sapiens
gaaagcgccucgcauuuga

SEQ ID NO: 899213 - RNA, 19 nt, Homo sapiens
gaaaccacuuuacuacuuu

SEQ ID NO: 899214 - RNA, 19 nt, Homo sapiens
uaaccuacaugccagauuu

SEQ ID NO: 899215 - RNA, 19 nt, Homo sapiens
caacuucccacauauauuu

SEQ ID NO: 899216 - RNA, 19 nt, Homo sapiens
aaacaaacagccacaaaua

SEQ ID NO: 899217 - RNA, 19 nt, Homo sapiens
caauuugguuucugcaaua

SEQ ID NO: 899218 - RNA, 19 nt, Homo sapiens
gcuauaagcuuggugaaau

SEQ ID NO: 899219 - RNA, 19 nt, Homo sapiens
caucugcagucucaaauuu

SEQ ID NO: 899220 - RNA, 19 nt, Homo sapiens
gcauauugcuaaucuauag

SEQ ID NO: 899221 - RNA, 19 nt, Homo sapiens
caaguuggcuguucaucuu

SEQ ID NO: 899222 - RNA, 19 nt, Homo sapiens
acagagagaucauuauuuc

SEQ ID NO: 899223 - RNA, 19 nt, Homo sapiens
ugaggaacaucaucaauug

SEQ ID NO: 899224 - RNA, 19 nt, Homo sapiens
caguagagauugaguuuga

SEQ ID NO: 899225 - RNA, 19 nt, Homo sapiens
gggccugucuugcaaagua

SEQ ID NO: 899226 - RNA, 19 nt, Homo sapiens
gacuugagcuggaucugua

SEQ ID NO: 899227 - RNA, 19 nt, Homo sapiens
ugaaaccacuuuacuacuu

SEQ ID NO: 899228 - RNA, 19 nt, Homo sapiens
cauggagcauuguuaauuu

SEQ ID NO: 899229 - RNA, 19 nt, Homo sapiens
gcugauugcuuauacaaau

SEQ ID NO: 899230 - RNA, 19 nt, Homo sapiens
ccaauggcaucauccaauu

SEQ ID NO: 899231 - RNA, 19 nt, Homo sapiens
gcaaaccagugcuccauca

SEQ ID NO: 899232 - RNA, 19 nt, Homo sapiens
gauaaggagugugaaguug

SEQ ID NO: 899233 - RNA, 19 nt, Homo sapiens
ucuauaagcuucugacuag

SEQ ID NO: 899234 - RNA, 19 nt, Homo sapiens
ggaagucuguaccaaacaa

SEQ ID NO: 899235 - RNA, 19 nt, Homo sapiens
ucaauuaagaggagaguua

SEQ ID NO: 899236 - RNA, 19 nt, Homo sapiens
cagaauauauuugcagcua

SEQ ID NO: 899237 - RNA, 19 nt, Homo sapiens
gagccuguauaucuauuaa

SEQ ID NO: 899238 - RNA, 19 nt, Homo sapiens
gcuaacagagagaucauua

SEQ ID NO: 899239 - RNA, 19 nt, Homo sapiens
gcaauaauggcaucuguau

SEQ ID NO: 899240 - RNA, 19 nt, Homo sapiens
gggcaggccuacccuugua

SEQ ID NO: 899241 - RNA, 19 nt, Homo sapiens
caugggauuugcuaucaua

SEQ ID NO: 899242 - RNA, 19 nt, Homo sapiens
gaaguuguguauuuaaugc

SEQ ID NO: 899243 - RNA, 19 nt, Homo sapiens
gagaaagcgccucgcauuu

SEQ ID NO: 899244 - RNA, 19 nt, Homo sapiens
gaacaagcacacaguggaa

SEQ ID NO: 899245 - RNA, 19 nt, Homo sapiens
uacauacucugugguaaua

SEQ ID NO: 899246 - RNA, 19 nt, Homo sapiens
caguauaucucucuuuauc

SEQ ID NO: 899247 - RNA, 19 nt, Homo sapiens
aauaauggccaguuguuua

SEQ ID NO: 899248 - RNA, 19 nt, Homo sapiens
aaacucaacuccaucaagu

SEQ ID NO: 899249 - RNA, 19 nt, Homo sapiens
caccacaguuucuaaauuc

SEQ ID NO: 899250 - RNA, 19 nt, Homo sapiens
cuucagaucucgaggauuc

SEQ ID NO: 899251 - RNA, 19 nt, Homo sapiens
caggaaauguuaaugagau

SEQ ID NO: 899252 - RNA, 19 nt, Homo sapiens
aaaauggacuccugaagua

SEQ ID NO: 899253 - RNA, 19 nt, Homo sapiens
acugugaaguuguguauuu

SEQ ID NO: 899254 - RNA, 19 nt, Homo sapiens
cgaagggccugucuugcaa

SEQ ID NO: 899255 - RNA, 19 nt, Homo sapiens
acaccacaguuucuaaauu

SEQ ID NO: 899256 - RNA, 19 nt, Homo sapiens
gcacuggaguaagcaagaa

SEQ ID NO: 899257 - RNA, 19 nt, Homo sapiens
gcaugugacuuuccaagag

SEQ ID NO: 899258 - RNA, 19 nt, Homo sapiens
ggaaagaugccaccuacuc

SEQ ID NO: 899259 - RNA, 19 nt, Homo sapiens
gcagugauaaggaguguga

SEQ ID NO: 899260 - RNA, 19 nt, Homo sapiens
cuaaagcgccugcuaacuu

SEQ ID NO: 899261 - RNA, 19 nt, Homo sapiens
uaagcuuggugaaaugaaa

SEQ ID NO: 899262 - RNA, 19 nt, Homo sapiens
aauuucaacuucccacaua

SEQ ID NO: 899263 - RNA, 19 nt, Homo sapiens
aaacagccacaaauacuuu

SEQ ID NO: 899264 - RNA, 19 nt, Homo sapiens
ggagagguuuccuucagau

SEQ ID NO: 899265 - RNA, 19 nt, Homo sapiens
aaaccacggucauuacuca

SEQ ID NO: 899266 - RNA, 19 nt, Homo sapiens
gaaguagacagaguaguga

SEQ ID NO: 899267 - RNA, 19 nt, Homo sapiens
gaagaccacacacuaagau

SEQ ID NO: 899268 - RNA, 19 nt, Homo sapiens
ccaaaccucugcagcaucu

SEQ ID NO: 899269 - RNA, 19 nt, Homo sapiens
ggcaacacauagaucauau

SEQ ID NO: 899270 - RNA, 19 nt, Homo sapiens
gcagccaguguuuccauua

SEQ ID NO: 899271 - RNA, 19 nt, Homo sapiens
gcucacagaucggcaguuc

SEQ ID NO: 899272 - RNA, 19 nt, Homo sapiens
agaaagcuuuguagcagaa

SEQ ID NO: 899273 - RNA, 19 nt, Homo sapiens
gaugcacagucuaaaugaa

SEQ ID NO: 899274 - RNA, 19 nt, Homo sapiens
caaacaaacagccacaaau

SEQ ID NO: 899275 - RNA, 19 nt, Homo sapiens
uagaaugggugacaaaugc

SEQ ID NO: 899276 - RNA, 19 nt, Homo sapiens
gcagaagaauggcuaaaau

SEQ ID NO: 899277 - RNA, 19 nt, Homo sapiens
ggaagaccacacacuaaga

SEQ ID NO: 899278 - RNA, 19 nt, Homo sapiens
gaaaagagaggagagaaaa

SEQ ID NO: 899279 - RNA, 19 nt, Homo sapiens
ggaaugacaguauaucucu

SEQ ID NO: 899280 - RNA, 19 nt, Homo sapiens
auaaacagguugcuauaag

SEQ ID NO: 899281 - RNA, 19 nt, Homo sapiens
gccauaaccuguauuuuga

SEQ ID NO: 899282 - RNA, 19 nt, Homo sapiens
guauacccauaaauuguga

SEQ ID NO: 899283 - RNA, 19 nt, Homo sapiens
gcaaaauaauggccaguug

SEQ ID NO: 899284 - RNA, 19 nt, Homo sapiens
cauccaagaaccaaaguuu

SEQ ID NO: 899285 - RNA, 19 nt, Homo sapiens
aaacuaguccauccaagaa

SEQ ID NO: 899286 - RNA, 19 nt, Homo sapiens
ucugcagucucaaauuuaa

SEQ ID NO: 899287 - RNA, 19 nt, Homo sapiens
ccauaaauugugacuagua

SEQ ID NO: 899288 - RNA, 19 nt, Homo sapiens
uaaacuaguccauccaaga

SEQ ID NO: 899289 - RNA, 19 nt, Homo sapiens
aauuuaaguucucccagua

SEQ ID NO: 899290 - RNA, 19 nt, Homo sapiens
guccuauccucaaauuauu

SEQ ID NO: 899291 - RNA, 19 nt, Homo sapiens
gaauaucugcaugggauuu

SEQ ID NO: 899292 - RNA, 19 nt, Homo sapiens
aaacaguuccuucagauuc

SEQ ID NO: 899293 - RNA, 19 nt, Homo sapiens
aggaaggccuuuaggaaga

SEQ ID NO: 899294 - RNA, 19 nt, Homo sapiens
cuacaugccagauuucuau

SEQ ID NO: 899295 - RNA, 19 nt, Homo sapiens
gaucgaaaccacggucauu

SEQ ID NO: 899296 - RNA, 19 nt, Homo sapiens
guuugagccuguauaucua

SEQ ID NO: 899297 - RNA, 19 nt, Homo sapiens
ggaguaagcaagaaaauug

SEQ ID NO: 899298 - RNA, 19 nt, Homo sapiens
acacauaaaggauaggaaa

SEQ ID NO: 899299 - RNA, 19 nt, Homo sapiens
agacugcauugaaggguuu

SEQ ID NO: 899300 - RNA, 19 nt, Homo sapiens
cuacuaaagcgccugcuaa

SEQ ID NO: 899301 - RNA, 19 nt, Homo sapiens
gggccaaacucaacuccau

SEQ ID NO: 899302 - RNA, 19 nt, Homo sapiens
uuucuuauguccacccuuu

SEQ ID NO: 899303 - RNA, 19 nt, Homo sapiens
ggaugcacagucuaaauga

SEQ ID NO: 899304 - RNA, 19 nt, Homo sapiens
ggaccucgauucucuucag

SEQ ID NO: 899305 - RNA, 19 nt, Homo sapiens
uuaugcaacuugucuaugu

SEQ ID NO: 899306 - RNA, 19 nt, Homo sapiens
guagaccacaauucacuuu

SEQ ID NO: 899307 - RNA, 19 nt, Homo sapiens
ugaaguagacagaguagug

SEQ ID NO: 899308 - RNA, 19 nt, Homo sapiens
gggaugcacagucuaaaug

SEQ ID NO: 899309 - RNA, 19 nt, Homo sapiens
cauacucugugguaauaga

SEQ ID NO: 899310 - RNA, 19 nt, Homo sapiens
caaacagccacaaauacuu

SEQ ID NO: 899311 - RNA, 19 nt, Homo sapiens
ggagugagcuguucaugga

SEQ ID NO: 899312 - RNA, 19 nt, Homo sapiens
ggucauccauuaggaauua

SEQ ID NO: 899313 - RNA, 19 nt, Homo sapiens
gaccugaacuuccgcauug

SEQ ID NO: 899314 - RNA, 19 nt, Homo sapiens
gcuaugaccugcacuuugu

SEQ ID NO: 899315 - RNA, 19 nt, Homo sapiens
gaagaacgcagcccuagga

SEQ ID NO: 899316 - RNA, 19 nt, Homo sapiens
ggacagaccguauccuaug

SEQ ID NO: 899317 - RNA, 19 nt, Homo sapiens
gcaaggacuauguggcuua

SEQ ID NO: 899318 - RNA, 19 nt, Homo sapiens
gggacuggaucggcuuaua

SEQ ID NO: 899319 - RNA, 19 nt, Homo sapiens
gcucccaccuucaaguuug

SEQ ID NO: 899320 - RNA, 19 nt, Homo sapiens
caagggccauggagacuuc

SEQ ID NO: 899321 - RNA, 19 nt, Homo sapiens
aagaacaccuggcccauuc

SEQ ID NO: 899322 - RNA, 19 nt, Homo sapiens
gaagauguggaugggaaua

SEQ ID NO: 899323 - RNA, 19 nt, Homo sapiens
ccacuugccugcgcauaug

SEQ ID NO: 899324 - RNA, 19 nt, Homo sapiens
gcucagagggagaggauga

SEQ ID NO: 899325 - RNA, 19 nt, Homo sapiens
gaaccaagccccugacaug

SEQ ID NO: 899326 - RNA, 19 nt, Homo sapiens
ccuggcaccucaacuguga

SEQ ID NO: 899327 - RNA, 19 nt, Homo sapiens
ggcuggagguggcagauga

SEQ ID NO: 899328 - RNA, 19 nt, Homo sapiens
cgauaccagugccaagaaa

SEQ ID NO: 899329 - RNA, 19 nt, Homo sapiens
ugaacuccaugcucaacaa

SEQ ID NO: 899330 - RNA, 19 nt, Homo sapiens
cagcucagccuaccuggaa

SEQ ID NO: 899331 - RNA, 19 nt, Homo sapiens
ucacugaacccuuccagau

SEQ ID NO: 899332 - RNA, 19 nt, Homo sapiens
caaggacuauguggcuuau

SEQ ID NO: 899333 - RNA, 19 nt, Homo sapiens
gcuuauaccggguggguuu

SEQ ID NO: 899334 - RNA, 19 nt, Homo sapiens
gaaggaccagcucaacaug

SEQ ID NO: 899335 - RNA, 19 nt, Homo sapiens
ugauguggguaccaacaaa

SEQ ID NO: 899336 - RNA, 19 nt, Homo sapiens
gagaaggaccagcucaaca

SEQ ID NO: 899337 - RNA, 19 nt, Homo sapiens
caagaacaccuggcccauu

SEQ ID NO: 899338 - RNA, 19 nt, Homo sapiens
ggaccugaacuuccgcauu

SEQ ID NO: 899339 - RNA, 19 nt, Homo sapiens
gcuagggcccuucaacuuc

SEQ ID NO: 899340 - RNA, 19 nt, Homo sapiens
gcaccucaacugugacaau

SEQ ID NO: 899341 - RNA, 19 nt, Homo sapiens
ccaagguggacucaaguuu

SEQ ID NO: 899342 - RNA, 19 nt, Homo sapiens
gagcuaugaccugcacuuu

SEQ ID NO: 899343 - RNA, 19 nt, Homo sapiens
ggaggucauccauuaggaa

SEQ ID NO: 899344 - RNA, 19 nt, Homo sapiens
ggacuggaucggcuuauac

SEQ ID NO: 899345 - RNA, 19 nt, Homo sapiens
ccaccauucugccucaauc

SEQ ID NO: 899346 - RNA, 19 nt, Homo sapiens
gacagaccguauccuaugg

SEQ ID NO: 899347 - RNA, 19 nt, Homo sapiens
ccauucugccucaaucuuu

SEQ ID NO: 899348 - RNA, 19 nt, Homo sapiens
gguaccaacaaauacgaua

SEQ ID NO: 899349 - RNA, 19 nt, Homo sapiens
gucaccaccuccucuucua

SEQ ID NO: 899350 - RNA, 19 nt, Homo sapiens
ucaacaagcgacucaagga

SEQ ID NO: 899351 - RNA, 19 nt, Homo sapiens
ccauaggguugcaggaagu

SEQ ID NO: 899352 - RNA, 19 nt, Homo sapiens
cgacggcgcagacaugauc

SEQ ID NO: 899353 - RNA, 19 nt, Homo sapiens
aggacuauguggcuuaugu

SEQ ID NO: 899354 - RNA, 19 nt, Homo sapiens
gaacaccuggcccauucug

SEQ ID NO: 899355 - RNA, 19 nt, Homo sapiens
caacugugacaaucagcaa

SEQ ID NO: 899356 - RNA, 19 nt, Homo sapiens
ggugagguaccgcauggaa

SEQ ID NO: 899357 - RNA, 19 nt, Homo sapiens
gaggucauccauuaggaau

SEQ ID NO: 899358 - RNA, 19 nt, Homo sapiens
cacauggaauacacaguca

SEQ ID NO: 899359 - RNA, 19 nt, Homo sapiens
gaucaugaccucguguucu

SEQ ID NO: 899360 - RNA, 19 nt, Homo sapiens
ccaguggagugagcuguuc

SEQ ID NO: 899361 - RNA, 19 nt, Homo sapiens
gguaacauucagugaggaa

SEQ ID NO: 899362 - RNA, 19 nt, Homo sapiens
cagaccguauccuauggaa

SEQ ID NO: 899363 - RNA, 19 nt, Homo sapiens
caccucaacugugacaauc

SEQ ID NO: 899364 - RNA, 19 nt, Homo sapiens
gggcuacuauagucacaac

SEQ ID NO: 899365 - RNA, 19 nt, Homo sapiens
agcaggcgguggugaggua

SEQ ID NO: 899366 - RNA, 19 nt, Homo sapiens
gcagccacauggaauacac

SEQ ID NO: 899367 - RNA, 19 nt, Homo sapiens
caagguggacucaaguuuu

SEQ ID NO: 899368 - RNA, 19 nt, Homo sapiens
acaccuggcccauucugaa

SEQ ID NO: 899369 - RNA, 19 nt, Homo sapiens
agaaggaccagcucaacau

SEQ ID NO: 899370 - RNA, 19 nt, Homo sapiens
gggagaaggaccagcucaa

SEQ ID NO: 899371 - RNA, 19 nt, Homo sapiens
uccaucagcucugggagaa

SEQ ID NO: 899372 - RNA, 19 nt, Homo sapiens
caaguuugccaucgacagu

SEQ ID NO: 899373 - RNA, 19 nt, Homo sapiens
acugaacccuuccagaucu

SEQ ID NO: 899374 - RNA, 19 nt, Homo sapiens
cuacauccacccugucauc

SEQ ID NO: 899375 - RNA, 19 nt, Homo sapiens
gauguggguaccaacaaau

SEQ ID NO: 899376 - RNA, 19 nt, Homo sapiens
ggagaaggaccagcucaac

SEQ ID NO: 899377 - RNA, 19 nt, Homo sapiens
acagugaccagcuccauca

SEQ ID NO: 899378 - RNA, 19 nt, Homo sapiens
ccucgaagccugggccuau

SEQ ID NO: 899379 - RNA, 19 nt, Homo sapiens
gcagacaugaucgccauag

SEQ ID NO: 899380 - RNA, 19 nt, Homo sapiens
gaacuccaugcucaacaag

SEQ ID NO: 899381 - RNA, 19 nt, Homo sapiens
ccucaacugugacaaucag

SEQ ID NO: 899382 - RNA, 19 nt, Homo sapiens
ugucugggccaaacaugaa

SEQ ID NO: 899383 - RNA, 19 nt, Homo sapiens
cuaggacccucggaaccaa

SEQ ID NO: 899384 - RNA, 19 nt, Homo sapiens
aggcuuggcacccagagua

SEQ ID NO: 899385 - RNA, 19 nt, Homo sapiens
gcagcgcaaagacaacuuc

SEQ ID NO: 899386 - RNA, 19 nt, Homo sapiens
cggguggguuuccgccauu

SEQ ID NO: 899387 - RNA, 19 nt, Homo sapiens
cccaguuccuccugcaguu

SEQ ID NO: 899388 - RNA, 19 nt, Homo sapiens
gcucaacaagcgacucaag

SEQ ID NO: 899389 - RNA, 19 nt, Homo sapiens
gcucaggcaccagcucaga

SEQ ID NO: 899390 - RNA, 19 nt, Homo sapiens
gcuuaugucugggccaaac

SEQ ID NO: 899391 - RNA, 19 nt, Homo sapiens
gguaccgcauggaaacagu

SEQ ID NO: 899392 - RNA, 19 nt, Homo sapiens
gugagguaccgcauggaaa

SEQ ID NO: 899393 - RNA, 19 nt, Homo sapiens
cagcuuggacagaccguau

SEQ ID NO: 899394 - RNA, 19 nt, Homo sapiens
gggaauagcuacacugaua

SEQ ID NO: 899395 - RNA, 19 nt, Homo sapiens
gagaagaacuguaggcaaa

SEQ ID NO: 899396 - RNA, 19 nt, Homo sapiens
ugacagaucuaguucguua

SEQ ID NO: 899397 - RNA, 19 nt, Homo sapiens
ugagaaagcuguauacuau

SEQ ID NO: 899398 - RNA, 19 nt, Homo sapiens
gcagagccauacaaaguua

SEQ ID NO: 899399 - RNA, 19 nt, Homo sapiens
gaugacagguacccacuua

SEQ ID NO: 899400 - RNA, 19 nt, Homo sapiens
gaaaguaguuccagugaca

SEQ ID NO: 899401 - RNA, 19 nt, Homo sapiens
aaacagaaccuuccaaauu

SEQ ID NO: 899402 - RNA, 19 nt, Homo sapiens
caacgaauguucucuccua

SEQ ID NO: 899403 - RNA, 19 nt, Homo sapiens
gcaagugguucuucaguga

SEQ ID NO: 899404 - RNA, 19 nt, Homo sapiens
gaaaucaagggaaaucaua

SEQ ID NO: 899405 - RNA, 19 nt, Homo sapiens
gcacucaacucaaucuuuc

SEQ ID NO: 899406 - RNA, 19 nt, Homo sapiens
gaacaggauugugauaaga

SEQ ID NO: 899407 - RNA, 19 nt, Homo sapiens
ggagacagaucuauaccaa

SEQ ID NO: 899408 - RNA, 19 nt, Homo sapiens
gaaacgguccucaggcuua

SEQ ID NO: 899409 - RNA, 19 nt, Homo sapiens
ggaaguaacucugaaccuu

SEQ ID NO: 899410 - RNA, 19 nt, Homo sapiens
ccaaguagcuccucuaacu

SEQ ID NO: 899411 - RNA, 19 nt, Homo sapiens
ggaaagccuuacaaagaaa

SEQ ID NO: 899412 - RNA, 19 nt, Homo sapiens
caaggaaacccaauauaaa

SEQ ID NO: 899413 - RNA, 19 nt, Homo sapiens
aacagaaccuuccaaauuu

SEQ ID NO: 899414 - RNA, 19 nt, Homo sapiens
caaaugggcaccagucuaa

SEQ ID NO: 899415 - RNA, 19 nt, Homo sapiens
ucaaggaaacccaauauaa

SEQ ID NO: 899416 - RNA, 19 nt, Homo sapiens
aaccaaagcuguccucuga

SEQ ID NO: 899417 - RNA, 19 nt, Homo sapiens
caaaguuacuagcaaagaa

SEQ ID NO: 899418 - RNA, 19 nt, Homo sapiens
gaaagcagcucuggaucug

SEQ ID NO: 899419 - RNA, 19 nt, Homo sapiens
cgguggaucucaucaaaua

SEQ ID NO: 899420 - RNA, 19 nt, Homo sapiens
gagagaggcucagaaacaa

SEQ ID NO: 899421 - RNA, 19 nt, Homo sapiens
caggaaagccuuacaaaga

SEQ ID NO: 899422 - RNA, 19 nt, Homo sapiens
gaacaucaacgcuccaaau

SEQ ID NO: 899423 - RNA, 19 nt, Homo sapiens
guugauaucuugaacugaa

SEQ ID NO: 899424 - RNA, 19 nt, Homo sapiens
ugacagagcaccugaagaa

SEQ ID NO: 899425 - RNA, 19 nt, Homo sapiens
gaaaauaccuucccaacca

SEQ ID NO: 899426 - RNA, 19 nt, Homo sapiens
ccaauucaauguuacagaa

SEQ ID NO: 899427 - RNA, 19 nt, Homo sapiens
ggaaugcauuagagaagaa

SEQ ID NO: 899428 - RNA, 19 nt, Homo sapiens
ggaaugugcugcguaugaa

SEQ ID NO: 899429 - RNA, 19 nt, Homo sapiens
gggcagcacucaacucaau

SEQ ID NO: 899430 - RNA, 19 nt, Homo sapiens
caaauacacuaugaagcua

SEQ ID NO: 899431 - RNA, 19 nt, Homo sapiens
ggaggaagaagauagcuuu

SEQ ID NO: 899432 - RNA, 19 nt, Homo sapiens
acaaacaaauggcaacuug

SEQ ID NO: 899433 - RNA, 19 nt, Homo sapiens
gaucagaacacuccaaauc

SEQ ID NO: 899434 - RNA, 19 nt, Homo sapiens
ccaaagcgaucaugucagu

SEQ ID NO: 899435 - RNA, 19 nt, Homo sapiens
cagagcaccugaagaauuc

SEQ ID NO: 899436 - RNA, 19 nt, Homo sapiens
gcucugaaguacucaaaga

SEQ ID NO: 899437 - RNA, 19 nt, Homo sapiens
uaccaaagcuuguugcaau

SEQ ID NO: 899438 - RNA, 19 nt, Homo sapiens
gcaagaggaagcauaagaa

SEQ ID NO: 899439 - RNA, 19 nt, Homo sapiens
ggaacaggauugugauaag

SEQ ID NO: 899440 - RNA, 19 nt, Homo sapiens
gaacccacauaaaguguca

SEQ ID NO: 899441 - RNA, 19 nt, Homo sapiens
ggaaugaucaccauagcaa

SEQ ID NO: 899442 - RNA, 19 nt, Homo sapiens
acacuaagaaugaggaaua

SEQ ID NO: 899443 - RNA, 19 nt, Homo sapiens
aaguaaaucuucccagaaa

SEQ ID NO: 899444 - RNA, 19 nt, Homo sapiens
uaaaagagaugacgcauuc

SEQ ID NO: 899445 - RNA, 19 nt, Homo sapiens
gaaacccacugccuaugug

SEQ ID NO: 899446 - RNA, 19 nt, Homo sapiens
gaaacuacgaugaaaugaa

SEQ ID NO: 899447 - RNA, 19 nt, Homo sapiens
gacgguggaucucaucaaa

SEQ ID NO: 899448 - RNA, 19 nt, Homo sapiens
gcauaagaaugaagaugau

SEQ ID NO: 899449 - RNA, 19 nt, Homo sapiens
aaacuacgaugaaaugaag

SEQ ID NO: 899450 - RNA, 19 nt, Homo sapiens
gcacauugauaagaugguu

SEQ ID NO: 899451 - RNA, 19 nt, Homo sapiens
caccaacucuugauucuuc

SEQ ID NO: 899452 - RNA, 19 nt, Homo sapiens
gaaaucuccugcacagagu

SEQ ID NO: 899453 - RNA, 19 nt, Homo sapiens
gagcagggcacugggaaua

SEQ ID NO: 899454 - RNA, 19 nt, Homo sapiens
ccaccuagcucuccucucu

SEQ ID NO: 899455 - RNA, 19 nt, Homo sapiens
aauggcaacuugauaauug

SEQ ID NO: 899456 - RNA, 19 nt, Homo sapiens
gcaccagucuaaaucuaug

SEQ ID NO: 899457 - RNA, 19 nt, Homo sapiens
agacagaucuauaccaaag

SEQ ID NO: 899458 - RNA, 19 nt, Homo sapiens
ucaguuggcccuuuaauau

SEQ ID NO: 899459 - RNA, 19 nt, Homo sapiens
agaggaagcauaagaauga

SEQ ID NO: 899460 - RNA, 19 nt, Homo sapiens
aggaaagccuuacaaagaa

SEQ ID NO: 899461 - RNA, 19 nt, Homo sapiens
ggaaacccaauauaaagaa

SEQ ID NO: 899462 - RNA, 19 nt, Homo sapiens
gaaccuucacaccauaaua

SEQ ID NO: 899463 - RNA, 19 nt, Homo sapiens
acaaauggcaacuugauaa

SEQ ID NO: 899464 - RNA, 19 nt, Homo sapiens
gcaaagcacaucucaccaa

SEQ ID NO: 899465 - RNA, 19 nt, Homo sapiens
cauggaggcucucaucaga

SEQ ID NO: 899466 - RNA, 19 nt, Homo sapiens
caugucaguuggcccuuua

SEQ ID NO: 899467 - RNA, 19 nt, Homo sapiens
gcugugguaucuuucauug

SEQ ID NO: 899468 - RNA, 19 nt, Homo sapiens
ccaaggagguuaaggaaaa

SEQ ID NO: 899469 - RNA, 19 nt, Homo sapiens
caagggaaaucauagaaac

SEQ ID NO: 899470 - RNA, 19 nt, Homo sapiens
caagucguauucagaguau

SEQ ID NO: 899471 - RNA, 19 nt, Homo sapiens
gaagaaugcucaggaaucc

SEQ ID NO: 899472 - RNA, 19 nt, Homo sapiens
acacaaagcagccaccaaa

SEQ ID NO: 899473 - RNA, 19 nt, Homo sapiens
cuugauaauuggcugaaua

SEQ ID NO: 899474 - RNA, 19 nt, Homo sapiens
gggcaccagucuaaaucua

SEQ ID NO: 899475 - RNA, 19 nt, Homo sapiens
ggaaaacugccauaacaua

SEQ ID NO: 899476 - RNA, 19 nt, Homo sapiens
ugaacuggauaaaguaaug

SEQ ID NO: 899477 - RNA, 19 nt, Homo sapiens
uaaagugaacccacauaaa

SEQ ID NO: 899478 - RNA, 19 nt, Homo sapiens
ccaggcuguuucuucauua

SEQ ID NO: 899479 - RNA, 19 nt, Homo sapiens
gauaaacgacucacaguac

SEQ ID NO: 899480 - RNA, 19 nt, Homo sapiens
cgaauguucucuccuaugg

SEQ ID NO: 899481 - RNA, 19 nt, Homo sapiens
ccucuucaguggacaguaa

SEQ ID NO: 899482 - RNA, 19 nt, Homo sapiens
gauaauuggcugaauaaag

SEQ ID NO: 899483 - RNA, 19 nt, Homo sapiens
gaccgugagucauauaaca

SEQ ID NO: 899484 - RNA, 19 nt, Homo sapiens
uuacagaguggacauagua

SEQ ID NO: 899485 - RNA, 19 nt, Homo sapiens
gaaaggcggaaucaggaaa

SEQ ID NO: 899486 - RNA, 19 nt, Homo sapiens
gggaaugcauuagagaaga

SEQ ID NO: 899487 - RNA, 19 nt, Homo sapiens
aaacggaggacaagaauuc

SEQ ID NO: 899488 - RNA, 19 nt, Homo sapiens
cgagagaggcucagaaaca

SEQ ID NO: 899489 - RNA, 19 nt, Homo sapiens
cgugagcuaugauaagauu

SEQ ID NO: 899490 - RNA, 19 nt, Homo sapiens
gaagcuaaagaauuacuug

SEQ ID NO: 899491 - RNA, 19 nt, Homo sapiens
caacagagagucaucuaag

SEQ ID NO: 899492 - RNA, 19 nt, Homo sapiens
gcaacagagagucaucuaa

SEQ ID NO: 899493 - RNA, 19 nt, Homo sapiens
ggaagcauaagaaugaaga

SEQ ID NO: 899494 - RNA, 19 nt, Homo sapiens
guacacaacucacuccuuu

SEQ ID NO: 899495 - RNA, 19 nt, Homo sapiens
gcacagcacaaauuaguua

SEQ ID NO: 899496 - RNA, 19 nt, Homo sapiens
ggagagauguggaauaaca

SEQ ID NO: 899497 - RNA, 19 nt, Homo sapiens
ggaggaagaugaagaagau

SEQ ID NO: 899498 - RNA, 19 nt, Homo sapiens
guaaggcuguguaagauuu

SEQ ID NO: 899499 - RNA, 19 nt, Homo sapiens
ggacaaggcccauuacgaa

SEQ ID NO: 899500 - RNA, 19 nt, Homo sapiens
ugaagaagaugaagaugaa

SEQ ID NO: 899501 - RNA, 19 nt, Homo sapiens
ccgaaugugucuuuagaua

SEQ ID NO: 899502 - RNA, 19 nt, Homo sapiens
ccgcuaaccuugccuggua

SEQ ID NO: 899503 - RNA, 19 nt, Homo sapiens
ggaggaagaugaggaagau

SEQ ID NO: 899504 - RNA, 19 nt, Homo sapiens
gaaauguaaggcuguguaa

SEQ ID NO: 899505 - RNA, 19 nt, Homo sapiens
gaccaugucugcuaaagag

SEQ ID NO: 899506 - RNA, 19 nt, Homo sapiens
ugggagagauguggaauaa

SEQ ID NO: 899507 - RNA, 19 nt, Homo sapiens
gaaugugucuuuagauagc

SEQ ID NO: 899508 - RNA, 19 nt, Homo sapiens
ugaggaagaugaagaggau

SEQ ID NO: 899509 - RNA, 19 nt, Homo sapiens
gaagaaacugggagagaug

SEQ ID NO: 899510 - RNA, 19 nt, Homo sapiens
cgaagaaacugggagagau

SEQ ID NO: 899511 - RNA, 19 nt, Homo sapiens
caaggcccauuacgaaaga

SEQ ID NO: 899512 - RNA, 19 nt, Homo sapiens
ucuaagaagugcucagaga

SEQ ID NO: 899513 - RNA, 19 nt, Homo sapiens
ggaggaggaagaugaagaa

SEQ ID NO: 899514 - RNA, 19 nt, Homo sapiens
aaaaggauauugcugcaua

SEQ ID NO: 899515 - RNA, 19 nt, Homo sapiens
gcuguaaauuggcauggaa

SEQ ID NO: 899516 - RNA, 19 nt, Homo sapiens
gacaagcagccuuaugaaa

SEQ ID NO: 899517 - RNA, 19 nt, Homo sapiens
uaacuaaacaugagcaaag

SEQ ID NO: 899518 - RNA, 19 nt, Homo sapiens
gaagaugaugaauaaguug

SEQ ID NO: 899519 - RNA, 19 nt, Homo sapiens
agaugaagaugaagaagau

SEQ ID NO: 899520 - RNA, 19 nt, Homo sapiens
gggaggcgcauaagaagaa

SEQ ID NO: 899521 - RNA, 19 nt, Homo sapiens
gcauaucgagcuaaaggaa

SEQ ID NO: 899522 - RNA, 19 nt, Homo sapiens
gaugaugaauaaguugguu

SEQ ID NO: 899523 - RNA, 19 nt, Homo sapiens
ggaagaugaagaagaugaa

SEQ ID NO: 899524 - RNA, 19 nt, Homo sapiens
cagaugacaagcagccuua

SEQ ID NO: 899525 - RNA, 19 nt, Homo sapiens
aaccuugccugguacagua

SEQ ID NO: 899526 - RNA, 19 nt, Homo sapiens
uaccgaaugugucuuuaga

SEQ ID NO: 899527 - RNA, 19 nt, Homo sapiens
gaaggaagaggaggaagau

SEQ ID NO: 899528 - RNA, 19 nt, Homo sapiens
ggaagaugaggaagaugaa

SEQ ID NO: 899529 - RNA, 19 nt, Homo sapiens
gaaagccugaugcagcaaa

SEQ ID NO: 899530 - RNA, 19 nt, Homo sapiens
gacaaggcccauuacgaaa

SEQ ID NO: 899531 - RNA, 19 nt, Homo sapiens
agauagcccuguccugaug

SEQ ID NO: 899532 - RNA, 19 nt, Homo sapiens
ugaaauguaaggcugugua

SEQ ID NO: 899533 - RNA, 19 nt, Homo sapiens
caugucugcuaaagagaaa

SEQ ID NO: 899534 - RNA, 19 nt, Homo sapiens
uuaaagcggguucuuguug

SEQ ID NO: 899535 - RNA, 19 nt, Homo sapiens
gcccuguccugaugguauu

SEQ ID NO: 899536 - RNA, 19 nt, Homo sapiens
uuaacacacuaccgaaugu

SEQ ID NO: 899537 - RNA, 19 nt, Homo sapiens
aauguaaggcuguguaaga

SEQ ID NO: 899538 - RNA, 19 nt, Homo sapiens
cauccuggccuguccauug

SEQ ID NO: 899539 - RNA, 19 nt, Homo sapiens
gaaguucaaggauccgaau

SEQ ID NO: 899540 - RNA, 19 nt, Homo sapiens
gcgaagaaacugggagaga

SEQ ID NO: 899541 - RNA, 19 nt, Homo sapiens
guuaacacacuaccgaaug

SEQ ID NO: 899542 - RNA, 19 nt, Homo sapiens
gaagaugaagaagaugaug

SEQ ID NO: 899543 - RNA, 19 nt, Homo sapiens
cugcgaagcugaaggaaaa

SEQ ID NO: 899544 - RNA, 19 nt, Homo sapiens
acacaacucacuccuuuua

SEQ ID NO: 899545 - RNA, 19 nt, Homo sapiens
ggaagaggaggaagaugag

SEQ ID NO: 899546 - RNA, 19 nt, Homo sapiens
ugacaagcagccuuaugaa

SEQ ID NO: 899547 - RNA, 19 nt, Homo sapiens
aggaagaggaggaagauga

SEQ ID NO: 899548 - RNA, 19 nt, Homo sapiens
gcuaaaggaaagccugaug

SEQ ID NO: 899549 - RNA, 19 nt, Homo sapiens
uuggugauguugcgaagaa

SEQ ID NO: 899550 - RNA, 19 nt, Homo sapiens
gaugacaagcagccuuaug

SEQ ID NO: 899551 - RNA, 19 nt, Homo sapiens
guucaaggauccgaaugca

SEQ ID NO: 899552 - RNA, 19 nt, Homo sapiens
acaacucacuccuuuuaaa

SEQ ID NO: 899553 - RNA, 19 nt, Homo sapiens
ggaguugucaaggcugaaa

SEQ ID NO: 899554 - RNA, 19 nt, Homo sapiens
cgaaugugucuuuagauag

SEQ ID NO: 899555 - RNA, 19 nt, Homo sapiens
agaagaugaagaugaagaa

SEQ ID NO: 899556 - RNA, 19 nt, Homo sapiens
uaaaggaaagccugaugca

SEQ ID NO: 899557 - RNA, 19 nt, Homo sapiens
acaagcagccuuaugaaaa

SEQ ID NO: 899558 - RNA, 19 nt, Homo sapiens
aaacaugagcaaaggagau

SEQ ID NO: 899559 - RNA, 19 nt, Homo sapiens
aggaagaugaggaagauga

SEQ ID NO: 899560 - RNA, 19 nt, Homo sapiens
agaaggaagaggaggaaga

SEQ ID NO: 899561 - RNA, 19 nt, Homo sapiens
caagcagccuuaugaaaag

SEQ ID NO: 899562 - RNA, 19 nt, Homo sapiens
agaugaagaagaugaugaa

SEQ ID NO: 899563 - RNA, 19 nt, Homo sapiens
aagaugaagaugaagaaga

SEQ ID NO: 899564 - RNA, 19 nt, Homo sapiens
aggcggacaaggcccauua

SEQ ID NO: 899565 - RNA, 19 nt, Homo sapiens
gucgggaggcgcauaagaa

SEQ ID NO: 899566 - RNA, 19 nt, Homo sapiens
augaauaaguugguucuag

SEQ ID NO: 899567 - RNA, 19 nt, Homo sapiens
gaagaugaagaugaagaag

SEQ ID NO: 899568 - RNA, 19 nt, Homo sapiens
gaagaugaagaagaugaag

SEQ ID NO: 899569 - RNA, 19 nt, Homo sapiens
cauaucgagcuaaaggaaa

SEQ ID NO: 899570 - RNA, 19 nt, Homo sapiens
gcugcgaagcugaaggaaa

SEQ ID NO: 899571 - RNA, 19 nt, Homo sapiens
uaagaagaagcacccagau

SEQ ID NO: 899572 - RNA, 19 nt, Homo sapiens
aagaagaugaagaugaaga

SEQ ID NO: 899573 - RNA, 19 nt, Homo sapiens
ugaggaggaggaagaugaa

SEQ ID NO: 899574 - RNA, 19 nt, Homo sapiens
ccaugucugcuaaagagaa

SEQ ID NO: 899575 - RNA, 19 nt, Homo sapiens
gcccauuacgaaagagaaa

SEQ ID NO: 899576 - RNA, 19 nt, Homo sapiens
augacaagcagccuuauga

SEQ ID NO: 899577 - RNA, 19 nt, Homo sapiens
gauccgaaugcacccaaga

SEQ ID NO: 899578 - RNA, 19 nt, Homo sapiens
aagaugaagaagaugauga

SEQ ID NO: 899579 - RNA, 19 nt, Homo sapiens
aagaagaagcacccagaug

SEQ ID NO: 899580 - RNA, 19 nt, Homo sapiens
aaagaaggaagaggaggaa

SEQ ID NO: 899581 - RNA, 19 nt, Homo sapiens
augaagaagaugaagauga

SEQ ID NO: 899582 - RNA, 19 nt, Homo sapiens
agaugaagaagaugaagau

SEQ ID NO: 899583 - RNA, 19 nt, Homo sapiens
aagaugaggaagaugaaga

SEQ ID NO: 899584 - RNA, 19 nt, Homo sapiens
gaagaugaggaagaugaag

SEQ ID NO: 899585 - RNA, 19 nt, Homo sapiens
gaaaugaaaaccuauaucc

SEQ ID NO: 899586 - RNA, 19 nt, Homo sapiens
gaugaauaaguugguucua

SEQ ID NO: 899587 - RNA, 19 nt, Homo sapiens
auaucgagcuaaaggaaag

SEQ ID NO: 899588 - RNA, 19 nt, Homo sapiens
gaaauggucuuguuuguga

SEQ ID NO: 899589 - RNA, 19 nt, Homo sapiens
gaagacagaugaagaaaga

SEQ ID NO: 899590 - RNA, 19 nt, Homo sapiens
gaacgacaacgaagaauua

SEQ ID NO: 899591 - RNA, 19 nt, Homo sapiens
agacagagcuggcugauuu

SEQ ID NO: 899592 - RNA, 19 nt, Homo sapiens
agaagaagccuuugaaaua

SEQ ID NO: 899593 - RNA, 19 nt, Homo sapiens
gaaaguagcuacaaugacu

SEQ ID NO: 899594 - RNA, 19 nt, Homo sapiens
gaagaagccuuugaaauag

SEQ ID NO: 899595 - RNA, 19 nt, Homo sapiens
gaacagaaacgauuagaga

SEQ ID NO: 899596 - RNA, 19 nt, Homo sapiens
gauaaggucaugaauguua

SEQ ID NO: 899597 - RNA, 19 nt, Homo sapiens
gaaagaaaguagcuacaau

SEQ ID NO: 899598 - RNA, 19 nt, Homo sapiens
gaacauggaaugcuaacua

SEQ ID NO: 899599 - RNA, 19 nt, Homo sapiens
gaagaggccucaguacauu

SEQ ID NO: 899600 - RNA, 19 nt, Homo sapiens
cgaagaggaugcacaguuu

SEQ ID NO: 899601 - RNA, 19 nt, Homo sapiens
gaugggaacugaagcagaa

SEQ ID NO: 899602 - RNA, 19 nt, Homo sapiens
aaacacgacucaaauauuc

SEQ ID NO: 899603 - RNA, 19 nt, Homo sapiens
gcaaagcagcagcaacuua

SEQ ID NO: 899604 - RNA, 19 nt, Homo sapiens
ggaacaaucucaguuacaa

SEQ ID NO: 899605 - RNA, 19 nt, Homo sapiens
gaagaaagugauucaguuu

SEQ ID NO: 899606 - RNA, 19 nt, Homo sapiens
gaagaaagacuggcauuug

SEQ ID NO: 899607 - RNA, 19 nt, Homo sapiens
gaacuccagugccgagaaa

SEQ ID NO: 899608 - RNA, 19 nt, Homo sapiens
gcaaguagcaucccaggaa

SEQ ID NO: 899609 - RNA, 19 nt, Homo sapiens
gagaaagaguuaaagaauc

SEQ ID NO: 899610 - RNA, 19 nt, Homo sapiens
gagcaugucucaaucucaa

SEQ ID NO: 899611 - RNA, 19 nt, Homo sapiens
gauaguaaaucuacaaugc

SEQ ID NO: 899612 - RNA, 19 nt, Homo sapiens
uagauaaggucaugaaugu

SEQ ID NO: 899613 - RNA, 19 nt, Homo sapiens
gcuaagaaaucaauaaagg

SEQ ID NO: 899614 - RNA, 19 nt, Homo sapiens
acaagaagcucugcagaaa

SEQ ID NO: 899615 - RNA, 19 nt, Homo sapiens
gagcugaaccugagacauu

SEQ ID NO: 899616 - RNA, 19 nt, Homo sapiens
gaacuagagaugauuaaga

SEQ ID NO: 899617 - RNA, 19 nt, Homo sapiens
gaagaagcaaggcauauug

SEQ ID NO: 899618 - RNA, 19 nt, Homo sapiens
acaaagacaugcauggauu

SEQ ID NO: 899619 - RNA, 19 nt, Homo sapiens
gcucagaauuucgcuuuaa

SEQ ID NO: 899620 - RNA, 19 nt, Homo sapiens
caaagcagcagcaacuuaa

SEQ ID NO: 899621 - RNA, 19 nt, Homo sapiens
caagaccaguuucagauga

SEQ ID NO: 899622 - RNA, 19 nt, Homo sapiens
gaagugaauugcagaaugc

SEQ ID NO: 899623 - RNA, 19 nt, Homo sapiens
gaaagacuggcauuugaaa

SEQ ID NO: 899624 - RNA, 19 nt, Homo sapiens
aagaaagacuggcauuuga

SEQ ID NO: 899625 - RNA, 19 nt, Homo sapiens
gaaguucagggaaaucuaa

SEQ ID NO: 899626 - RNA, 19 nt, Homo sapiens
gaggaggcauggagaaguu

SEQ ID NO: 899627 - RNA, 19 nt, Homo sapiens
gaagaaacccaaagaaagg

SEQ ID NO: 899628 - RNA, 19 nt, Homo sapiens
ggaaaguggcgaagagaaa

SEQ ID NO: 899629 - RNA, 19 nt, Homo sapiens
guucaucacugccauuguu

SEQ ID NO: 899630 - RNA, 19 nt, Homo sapiens
aaaggaacauggaaugcua

SEQ ID NO: 899631 - RNA, 19 nt, Homo sapiens
gaagaggaugcacaguuua

SEQ ID NO: 899632 - RNA, 19 nt, Homo sapiens
cgacucaaauauucacaaa

SEQ ID NO: 899633 - RNA, 19 nt, Homo sapiens
guuacaaagugaacuacua

SEQ ID NO: 899634 - RNA, 19 nt, Homo sapiens
gccaaucaaugaaagacua

SEQ ID NO: 899635 - RNA, 19 nt, Homo sapiens
ucagggaacuguagaguca

SEQ ID NO: 899636 - RNA, 19 nt, Homo sapiens
uaacauaggcaaaguaagu

SEQ ID NO: 899637 - RNA, 19 nt, Homo sapiens
gaacuuaaagacugucaga

SEQ ID NO: 899638 - RNA, 19 nt, Homo sapiens
gcaaagugcaagacauuga

SEQ ID NO: 899639 - RNA, 19 nt, Homo sapiens
uccaagagcuaaaggguuu

SEQ ID NO: 899640 - RNA, 19 nt, Homo sapiens
gcagauugaggaagaaauu

SEQ ID NO: 899641 - RNA, 19 nt, Homo sapiens
ugaaggcucuacagucuga

SEQ ID NO: 899642 - RNA, 19 nt, Homo sapiens
caaacacgacucaaauauu

SEQ ID NO: 899643 - RNA, 19 nt, Homo sapiens
gaagacacuccgcaaagaa

SEQ ID NO: 899644 - RNA, 19 nt, Homo sapiens
gaacaaguaagaaagaaag

SEQ ID NO: 899645 - RNA, 19 nt, Homo sapiens
gaaaucgaggcccaccuua

SEQ ID NO: 899646 - RNA, 19 nt, Homo sapiens
gaaaguacccaggcaacaa

SEQ ID NO: 899647 - RNA, 19 nt, Homo sapiens
gaaauuggcguggaaaaua

SEQ ID NO: 899648 - RNA, 19 nt, Homo sapiens
ccaggaacaaucucaguua

SEQ ID NO: 899649 - RNA, 19 nt, Homo sapiens
ggaagaagcaaggcauauu

SEQ ID NO: 899650 - RNA, 19 nt, Homo sapiens
gcucuagauuaccuugaua

SEQ ID NO: 899651 - RNA, 19 nt, Homo sapiens
gaaaacauuugcaaggauu

SEQ ID NO: 899652 - RNA, 19 nt, Homo sapiens
ggaggaaaguggcgaagag

SEQ ID NO: 899653 - RNA, 19 nt, Homo sapiens
ucaaagagcaaacucaaga

SEQ ID NO: 899654 - RNA, 19 nt, Homo sapiens
gacgauaucuuccaacacu

SEQ ID NO: 899655 - RNA, 19 nt, Homo sapiens
uagagaaguuagaggagua

SEQ ID NO: 899656 - RNA, 19 nt, Homo sapiens
aaagauagauaaggucaug

SEQ ID NO: 899657 - RNA, 19 nt, Homo sapiens
gaaagugauucaguuugug

SEQ ID NO: 899658 - RNA, 19 nt, Homo sapiens
ccuagacaauacuaacaua

SEQ ID NO: 899659 - RNA, 19 nt, Homo sapiens
ggcaacaauugauaucuau

SEQ ID NO: 899660 - RNA, 19 nt, Homo sapiens
ugaagaaauuggcguggaa

SEQ ID NO: 899661 - RNA, 19 nt, Homo sapiens
gcagaaugcugggauugau

SEQ ID NO: 899662 - RNA, 19 nt, Homo sapiens
gugaagaaacccaaagaaa

SEQ ID NO: 899663 - RNA, 19 nt, Homo sapiens
cccuagaucuuucucagua

SEQ ID NO: 899664 - RNA, 19 nt, Homo sapiens
aagaagcucugcagaaaca

SEQ ID NO: 899665 - RNA, 19 nt, Homo sapiens
gaacugaagcagaaaguac

SEQ ID NO: 899666 - RNA, 19 nt, Homo sapiens
gcaagacauugagauaauc

SEQ ID NO: 899667 - RNA, 19 nt, Homo sapiens
gaacaaucucaguuacaaa

SEQ ID NO: 899668 - RNA, 19 nt, Homo sapiens
ugaagacacuccgcaaaga

SEQ ID NO: 899669 - RNA, 19 nt, Homo sapiens
agaaagugauucaguuugu

SEQ ID NO: 899670 - RNA, 19 nt, Homo sapiens
ccuaguggaugaaauugaa

SEQ ID NO: 899671 - RNA, 19 nt, Homo sapiens
caaagaaaggacccaguuu

SEQ ID NO: 899672 - RNA, 19 nt, Homo sapiens
ggaacgacaacgaagaauu

SEQ ID NO: 899673 - RNA, 19 nt, Homo sapiens
ggugauugaugucauaaag

SEQ ID NO: 899674 - RNA, 19 nt, Homo sapiens
ucagcuggaucguuauaaa

SEQ ID NO: 899675 - RNA, 19 nt, Homo sapiens
gaaaagauaggcauaauag

SEQ ID NO: 899676 - RNA, 19 nt, Homo sapiens
caacuacaacaaacagaaa

SEQ ID NO: 899677 - RNA, 19 nt, Homo sapiens
gcagagcgcagacaagcaa

SEQ ID NO: 899678 - RNA, 19 nt, Homo sapiens
gauuagagaagcauaacuu

SEQ ID NO: 899679 - RNA, 19 nt, Homo sapiens
gaagaggaacggaagaagu

SEQ ID NO: 899680 - RNA, 19 nt, Homo sapiens
gcagcaacuuaaggacaua

SEQ ID NO: 899681 - RNA, 19 nt, Homo sapiens
gaugagaaagaguuaaaga

SEQ ID NO: 899682 - RNA, 19 nt, Homo sapiens
aacaguagcucuugaugga

SEQ ID NO: 899683 - RNA, 19 nt, Homo sapiens
gggaacagaagacagauga

SEQ ID NO: 899684 - RNA, 19 nt, Homo sapiens
caaguuagagcaugugaau

SEQ ID NO: 899685 - RNA, 19 nt, Homo sapiens
agaagugaauugcagaaug

SEQ ID NO: 899686 - RNA, 19 nt, Homo sapiens
ggaacaaguaagaaagaaa

SEQ ID NO: 899687 - RNA, 19 nt, Homo sapiens
guucuaaacaggaagauga

SEQ ID NO: 899688 - RNA, 19 nt, Homo sapiens
gagaugggaucauggauuu

SEQ ID NO: 899689 - RNA, 19 nt, Homo sapiens
ccaaggguauccaguauuu

SEQ ID NO: 899690 - RNA, 19 nt, Homo sapiens
gcaagaaguucaacaugga

SEQ ID NO: 899691 - RNA, 19 nt, Homo sapiens
ggaauuauaccucuugaga

SEQ ID NO: 899692 - RNA, 19 nt, Homo sapiens
gcagaaguauuaucagagu

SEQ ID NO: 899693 - RNA, 19 nt, Homo sapiens
gagacccucugcagaagua

SEQ ID NO: 899694 - RNA, 19 nt, Homo sapiens
gaagauagaccggaugaug

SEQ ID NO: 899695 - RNA, 19 nt, Homo sapiens
gagaaggagcuguguauug

SEQ ID NO: 899696 - RNA, 19 nt, Homo sapiens
gcagucccauggugauaaa

SEQ ID NO: 899697 - RNA, 19 nt, Homo sapiens
ggccauggcuuuccugcaa

SEQ ID NO: 899698 - RNA, 19 nt, Homo sapiens
uccagaagcugaaggauga

SEQ ID NO: 899699 - RNA, 19 nt, Homo sapiens
ggagagggaucccaucaac

SEQ ID NO: 899700 - RNA, 19 nt, Homo sapiens
gaggaggaguccacuaaca

SEQ ID NO: 899701 - RNA, 19 nt, Homo sapiens
ggaguccacuaacaggaaa

SEQ ID NO: 899702 - RNA, 19 nt, Homo sapiens
ggacauccgcagauucuug

SEQ ID NO: 899703 - RNA, 19 nt, Homo sapiens
ggagaugggaucauggauu

SEQ ID NO: 899704 - RNA, 19 nt, Homo sapiens
gaauuauaccucuugagaa

SEQ ID NO: 899705 - RNA, 19 nt, Homo sapiens
gggcauaaguggcuguucu

SEQ ID NO: 899706 - RNA, 19 nt, Homo sapiens
gcucagaguccagcaauga

SEQ ID NO: 899707 - RNA, 19 nt, Homo sapiens
agaaggagcuguguauugg

SEQ ID NO: 899708 - RNA, 19 nt, Homo sapiens
gaaguauuaucagaguaga

SEQ ID NO: 899709 - RNA, 19 nt, Homo sapiens
ugagauugcagauguguuu

SEQ ID NO: 899710 - RNA, 19 nt, Homo sapiens
gcacgguuccuguauaaag

SEQ ID NO: 899711 - RNA, 19 nt, Homo sapiens
acaacugccucuacuacuu

SEQ ID NO: 899712 - RNA, 19 nt, Homo sapiens
gguauccaguauuucauug

SEQ ID NO: 899713 - RNA, 19 nt, Homo sapiens
gggagucauuccaaagaga

SEQ ID NO: 899714 - RNA, 19 nt, Homo sapiens
gaauaaaacuccugaucca

SEQ ID NO: 899715 - RNA, 19 nt, Homo sapiens
aggaugagauugcagaugu

SEQ ID NO: 899716 - RNA, 19 nt, Homo sapiens
guagagcugacuuccagua

SEQ ID NO: 899717 - RNA, 19 nt, Homo sapiens
cagaaguauuaucagagua

SEQ ID NO: 899718 - RNA, 19 nt, Homo sapiens
uaacacagagcucaugcuu

SEQ ID NO: 899719 - RNA, 19 nt, Homo sapiens
gaagcugaaggaugagauu

SEQ ID NO: 899720 - RNA, 19 nt, Homo sapiens
uaacaggaaacacuucuca

SEQ ID NO: 899721 - RNA, 19 nt, Homo sapiens
cugcagaaguauuaucaga

SEQ ID NO: 899722 - RNA, 19 nt, Homo sapiens
ggagaacaucccagacaga

SEQ ID NO: 899723 - RNA, 19 nt, Homo sapiens
agacagccauugguaccua

SEQ ID NO: 899724 - RNA, 19 nt, Homo sapiens
uugcacgguuccuguauaa

SEQ ID NO: 899725 - RNA, 19 nt, Homo sapiens
guauugggcgcaagaaguu

SEQ ID NO: 899726 - RNA, 19 nt, Homo sapiens
uaaaacuccugauccaaaa

SEQ ID NO: 899727 - RNA, 19 nt, Homo sapiens
acucacaccuucuucaauc

SEQ ID NO: 899728 - RNA, 19 nt, Homo sapiens
caucaagagugagccauuc

SEQ ID NO: 899729 - RNA, 19 nt, Homo sapiens
gaagaguuacagaggauca

SEQ ID NO: 899730 - RNA, 19 nt, Homo sapiens
gagcagucccauggugaua

SEQ ID NO: 899731 - RNA, 19 nt, Homo sapiens
caacaagacagccauuggu

SEQ ID NO: 899732 - RNA, 19 nt, Homo sapiens
ggagaaggagcuguguauu

SEQ ID NO: 899733 - RNA, 19 nt, Homo sapiens
gaggacauccgcagauucu

SEQ ID NO: 899734 - RNA, 19 nt, Homo sapiens
gagaacaucccagacagau

SEQ ID NO: 899735 - RNA, 19 nt, Homo sapiens
ggaugagauugcagaugug

SEQ ID NO: 899736 - RNA, 19 nt, Homo sapiens
ugcacuggcuacucccuua

SEQ ID NO: 899737 - RNA, 19 nt, Homo sapiens
cggaagaguuacagaggau

SEQ ID NO: 899738 - RNA, 19 nt, Homo sapiens
ucaagaaaaugacggagaa

SEQ ID NO: 899739 - RNA, 19 nt, Homo sapiens
gcaggugggacccucaaga

SEQ ID NO: 899740 - RNA, 19 nt, Homo sapiens
aauuauaccucuugagaac

SEQ ID NO: 899741 - RNA, 19 nt, Homo sapiens
caacugccucuacuacuuc

SEQ ID NO: 899742 - RNA, 19 nt, Homo sapiens
caacaccagccuccacaau

SEQ ID NO: 899743 - RNA, 19 nt, Homo sapiens
gaggagaugggaucaugga

SEQ ID NO: 899744 - RNA, 19 nt, Homo sapiens
ccacuaacaggaaacacuu

SEQ ID NO: 899745 - RNA, 19 nt, Homo sapiens
ccagacagaugggacucaa

SEQ ID NO: 899746 - RNA, 19 nt, Homo sapiens
gcaucaagagugagccauu

SEQ ID NO: 899747 - RNA, 19 nt, Homo sapiens
cagaagauagaccggauga

SEQ ID NO: 899748 - RNA, 19 nt, Homo sapiens
cgccaaggguauccaguau

SEQ ID NO: 899749 - RNA, 19 nt, Homo sapiens
gagcacgggucaucuuuuc

SEQ ID NO: 899750 - RNA, 19 nt, Homo sapiens
gcgcaagaaguucaacaug

SEQ ID NO: 899751 - RNA, 19 nt, Homo sapiens
uggaggagaugggaucaug

SEQ ID NO: 899752 - RNA, 19 nt, Homo sapiens
aaggcgcucucugcacuua

SEQ ID NO: 899753 - RNA, 19 nt, Homo sapiens
ggagagcagccagaggaaa

SEQ ID NO: 899754 - RNA, 19 nt, Homo sapiens
gcugaaggaugagauugca

SEQ ID NO: 899755 - RNA, 19 nt, Homo sapiens
cgacaacugccucuacuac

SEQ ID NO: 899756 - RNA, 19 nt, Homo sapiens
ggcaaugaccucacucaca

SEQ ID NO: 899757 - RNA, 19 nt, Homo sapiens
ggauggcccagaaggagaa

SEQ ID NO: 899758 - RNA, 19 nt, Homo sapiens
cgacggcaaugaccucacu

SEQ ID NO: 899759 - RNA, 19 nt, Homo sapiens
cuugucagccugugaacua

SEQ ID NO: 899760 - RNA, 19 nt, Homo sapiens
ucaugcccauucucuaguu

SEQ ID NO: 899761 - RNA, 19 nt, Homo sapiens
ggcgcucucugcacuuaga

SEQ ID NO: 899762 - RNA, 19 nt, Homo sapiens
gcgaggcccagaagauaga

SEQ ID NO: 899763 - RNA, 19 nt, Homo sapiens
gaccuugugggacaucuga

SEQ ID NO: 899764 - RNA, 19 nt, Homo sapiens
caggugggacccucaagaa

SEQ ID NO: 899765 - RNA, 19 nt, Homo sapiens
ggagagaaaagcaguauag

SEQ ID NO: 899766 - RNA, 19 nt, Homo sapiens
ucgacagcaucaagaguga

SEQ ID NO: 899767 - RNA, 19 nt, Homo sapiens
gaucaaguggcaccgaaag

SEQ ID NO: 899768 - RNA, 19 nt, Homo sapiens
gagaaaagcaguauagacu

SEQ ID NO: 899769 - RNA, 19 nt, Homo sapiens
ucucuucucucuggacuuc

SEQ ID NO: 899770 - RNA, 19 nt, Homo sapiens
ggguauccaguauuucauu

SEQ ID NO: 899771 - RNA, 19 nt, Homo sapiens
aacaagacagccauuggua

SEQ ID NO: 899772 - RNA, 19 nt, Homo sapiens
ccagaggcgucggaaugga

SEQ ID NO: 899773 - RNA, 19 nt, Homo sapiens
ccauggcuuuccugcaaga

SEQ ID NO: 899774 - RNA, 19 nt, Homo sapiens
cugaggacauccgcagauu

SEQ ID NO: 899775 - RNA, 19 nt, Homo sapiens
gagcucaugcuuggagaga

SEQ ID NO: 899776 - RNA, 19 nt, Homo sapiens
gagagcagccagaggaaaa

SEQ ID NO: 899777 - RNA, 19 nt, Homo sapiens
ucacucacaccuucuucaa

SEQ ID NO: 899778 - RNA, 19 nt, Homo sapiens
cuuccaggauguccauuuc

SEQ ID NO: 899779 - RNA, 19 nt, Homo sapiens
gcaguguuuggacuagaaa

SEQ ID NO: 899780 - RNA, 19 nt, Homo sapiens
caagucaugcccauucucu

SEQ ID NO: 899781 - RNA, 19 nt, Homo sapiens
gaaaaccagccccagaaug

SEQ ID NO: 899782 - RNA, 19 nt, Homo sapiens
ucucuacucggaagaagaa

SEQ ID NO: 899783 - RNA, 19 nt, Homo sapiens
ccgccaaggguauccagua

SEQ ID NO: 899784 - RNA, 19 nt, Homo sapiens
ggaucaaguggcaccgaaa

SEQ ID NO: 899785 - RNA, 19 nt, Homo sapiens
gaaggagaaggagcugugu

SEQ ID NO: 899786 - RNA, 19 nt, Homo sapiens
gcugcaacuucucuucucu

SEQ ID NO: 899787 - RNA, 19 nt, Homo sapiens
ggaaacggcgcugguucau

SEQ ID NO: 899788 - RNA, 19 nt, Homo sapiens
gaaccuguauacacaauaa

SEQ ID NO: 899789 - RNA, 19 nt, Homo sapiens
gaaggaagaucuaaagaac

SEQ ID NO: 899790 - RNA, 19 nt, Homo sapiens
caaacccucugaucuauga

SEQ ID NO: 899791 - RNA, 19 nt, Homo sapiens
caaggagccugcacacuga

SEQ ID NO: 899792 - RNA, 19 nt, Homo sapiens
ggaccauccucccaaacua

SEQ ID NO: 899793 - RNA, 19 nt, Homo sapiens
ggaaggaagaucuaaagaa

SEQ ID NO: 899794 - RNA, 19 nt, Homo sapiens
guacagccguggaggagaa

SEQ ID NO: 899795 - RNA, 19 nt, Homo sapiens
gaagggugggucucaguua

SEQ ID NO: 899796 - RNA, 19 nt, Homo sapiens
gacaaacccucugaucuau

SEQ ID NO: 899797 - RNA, 19 nt, Homo sapiens
cuucaaauacucagcauua

SEQ ID NO: 899798 - RNA, 19 nt, Homo sapiens
agacaaacccucugaucua

SEQ ID NO: 899799 - RNA, 19 nt, Homo sapiens
gcuggaaccuguauacaca

SEQ ID NO: 899800 - RNA, 19 nt, Homo sapiens
auucagagcuuucucaaau

SEQ ID NO: 899801 - RNA, 19 nt, Homo sapiens
ggacaucucagcccagguu

SEQ ID NO: 899802 - RNA, 19 nt, Homo sapiens
gcagucagcucuccaucca

SEQ ID NO: 899803 - RNA, 19 nt, Homo sapiens
ggagagaaguuuccauucc

SEQ ID NO: 899804 - RNA, 19 nt, Homo sapiens
gcagagccaugccacaucu

SEQ ID NO: 899805 - RNA, 19 nt, Homo sapiens
gugauaaacugcaugaaac

SEQ ID NO: 899806 - RNA, 19 nt, Homo sapiens
gagaaggcccugagcaugu

SEQ ID NO: 899807 - RNA, 19 nt, Homo sapiens
ucagagcuuucucaaauca

SEQ ID NO: 899808 - RNA, 19 nt, Homo sapiens
ggaccuuccaucagccuua

SEQ ID NO: 899809 - RNA, 19 nt, Homo sapiens
ggauagggaccuuccauca

SEQ ID NO: 899810 - RNA, 19 nt, Homo sapiens
ggaaacaaaacacacaaua

SEQ ID NO: 899811 - RNA, 19 nt, Homo sapiens
ugccacaucuguauauaga

SEQ ID NO: 899812 - RNA, 19 nt, Homo sapiens
ggacagucggccuuauaaa

SEQ ID NO: 899813 - RNA, 19 nt, Homo sapiens
gacaggaucaccuaacaga

SEQ ID NO: 899814 - RNA, 19 nt, Homo sapiens
cuagggcccuccacucuau

SEQ ID NO: 899815 - RNA, 19 nt, Homo sapiens
ggagacgccuaugaguuug

SEQ ID NO: 899816 - RNA, 19 nt, Homo sapiens
gaccuuccaucagccuuaa

SEQ ID NO: 899817 - RNA, 19 nt, Homo sapiens
gacacaugaugcccagauu

SEQ ID NO: 899818 - RNA, 19 nt, Homo sapiens
gcggagagaaguuuccauu

SEQ ID NO: 899819 - RNA, 19 nt, Homo sapiens
gggacagucggccuuauaa

SEQ ID NO: 899820 - RNA, 19 nt, Homo sapiens
cagacaggaucaccuaaca

SEQ ID NO: 899821 - RNA, 19 nt, Homo sapiens
cgugauaaacugcaugaaa

SEQ ID NO: 899822 - RNA, 19 nt, Homo sapiens
caaauucagagcuuucuca

SEQ ID NO: 899823 - RNA, 19 nt, Homo sapiens
caagggugccuaucuaagu

SEQ ID NO: 899824 - RNA, 19 nt, Homo sapiens
gagagaaguuuccauuccu

SEQ ID NO: 899825 - RNA, 19 nt, Homo sapiens
gucaacagcugcucucaac

SEQ ID NO: 899826 - RNA, 19 nt, Homo sapiens
ugagugcugugcuuuguca

SEQ ID NO: 899827 - RNA, 19 nt, Homo sapiens
uaucguuguccuucaaaua

SEQ ID NO: 899828 - RNA, 19 nt, Homo sapiens
gguggaccauccucccaaa

SEQ ID NO: 899829 - RNA, 19 nt, Homo sapiens
uacaacagcuccaggacau

SEQ ID NO: 899830 - RNA, 19 nt, Homo sapiens
caggaucaccuaacagaga

SEQ ID NO: 899831 - RNA, 19 nt, Homo sapiens
gcaccgucaugaacaccuu

SEQ ID NO: 899832 - RNA, 19 nt, Homo sapiens
aggagacgccuaugaguuu

SEQ ID NO: 899833 - RNA, 19 nt, Homo sapiens
ggaagggugggucucaguu

SEQ ID NO: 899834 - RNA, 19 nt, Homo sapiens
caaauacucagcauuacca

SEQ ID NO: 899835 - RNA, 19 nt, Homo sapiens
auacucagcauuaccauug

SEQ ID NO: 899836 - RNA, 19 nt, Homo sapiens
gacagucggccuuauaaag

SEQ ID NO: 899837 - RNA, 19 nt, Homo sapiens
caacagcugcucucaacuc

SEQ ID NO: 899838 - RNA, 19 nt, Homo sapiens
gaggccaaauucagagcuu

SEQ ID NO: 899839 - RNA, 19 nt, Homo sapiens
caugccacaucuguauaua

SEQ ID NO: 899840 - RNA, 19 nt, Homo sapiens
gaacaccuucgcucacaag

SEQ ID NO: 899841 - RNA, 19 nt, Homo sapiens
caacaucaagacccuagga

SEQ ID NO: 899842 - RNA, 19 nt, Homo sapiens
agaaggcccugagcauguu

SEQ ID NO: 899843 - RNA, 19 nt, Homo sapiens
ggaaccuguauacacaaua

SEQ ID NO: 899844 - RNA, 19 nt, Homo sapiens
cacugaagguuagaucuga

SEQ ID NO: 899845 - RNA, 19 nt, Homo sapiens
acagcugguucgugauaaa

SEQ ID NO: 899846 - RNA, 19 nt, Homo sapiens
gggaaggaagaucuaaaga

SEQ ID NO: 899847 - RNA, 19 nt, Homo sapiens
ucccuggccugacacauga

SEQ ID NO: 899848 - RNA, 19 nt, Homo sapiens
auggacaggccuaaauuua

SEQ ID NO: 899849 - RNA, 19 nt, Homo sapiens
auacagcugguucgugaua

SEQ ID NO: 899850 - RNA, 19 nt, Homo sapiens
gaucuaaagaacccacugu

SEQ ID NO: 899851 - RNA, 19 nt, Homo sapiens
caucucagcccagguucua

SEQ ID NO: 899852 - RNA, 19 nt, Homo sapiens
ccauggacaggccuaaauu

SEQ ID NO: 899853 - RNA, 19 nt, Homo sapiens
cauggacaggccuaaauuu

SEQ ID NO: 899854 - RNA, 19 nt, Homo sapiens
gcaagggugccuaucuaag

SEQ ID NO: 899855 - RNA, 19 nt, Homo sapiens
augcccagauuucagauuu

SEQ ID NO: 899856 - RNA, 19 nt, Homo sapiens
agagcuuucucaaaucaga

SEQ ID NO: 899857 - RNA, 19 nt, Homo sapiens
gagccaugccacaucugua

SEQ ID NO: 899858 - RNA, 19 nt, Homo sapiens
acacaugaugcccagauuu

SEQ ID NO: 899859 - RNA, 19 nt, Homo sapiens
gcugugcuuugucacugaa

SEQ ID NO: 899860 - RNA, 19 nt, Homo sapiens
gauuuggccuccgucacuu

SEQ ID NO: 899861 - RNA, 19 nt, Homo sapiens
ggacggcagccucacuauc

SEQ ID NO: 899862 - RNA, 19 nt, Homo sapiens
ugaucggccuggaauguca

SEQ ID NO: 899863 - RNA, 19 nt, Homo sapiens
ccucuuuaaucuaugaauc

SEQ ID NO: 899864 - RNA, 19 nt, Homo sapiens
gggaccagcaggacauaug

SEQ ID NO: 899865 - RNA, 19 nt, Homo sapiens
gcccagauuucagauuugg

SEQ ID NO: 899866 - RNA, 19 nt, Homo sapiens
gguugaggccaaauucaga

SEQ ID NO: 899867 - RNA, 19 nt, Homo sapiens
ggucagggaaggaagaucu

SEQ ID NO: 899868 - RNA, 19 nt, Homo sapiens
gauagggaccuuccaucag

SEQ ID NO: 899869 - RNA, 19 nt, Homo sapiens
ccagggacagucggccuua

SEQ ID NO: 899870 - RNA, 19 nt, Homo sapiens
gcugguucgugauaaacug

SEQ ID NO: 899871 - RNA, 19 nt, Homo sapiens
aagggugccuaucuaagug

SEQ ID NO: 899872 - RNA, 19 nt, Homo sapiens
ccucugaucuaugaagucu

SEQ ID NO: 899873 - RNA, 19 nt, Homo sapiens
cacaugaugcccagauuuc

SEQ ID NO: 899874 - RNA, 19 nt, Homo sapiens
gcuuugucacugaagguua

SEQ ID NO: 899875 - RNA, 19 nt, Homo sapiens
gaaggcccugagcauguuu

SEQ ID NO: 899876 - RNA, 19 nt, Homo sapiens
gccauggacaggccuaaau

SEQ ID NO: 899877 - RNA, 19 nt, Homo sapiens
gcagacaggaucaccuaac

SEQ ID NO: 899878 - RNA, 19 nt, Homo sapiens
cuaucuaaguggaacuaau

SEQ ID NO: 899879 - RNA, 19 nt, Homo sapiens
ucugaucuaugaagucucu

SEQ ID NO: 899880 - RNA, 19 nt, Homo sapiens
ggaccagcaggacauaugg

SEQ ID NO: 899881 - RNA, 19 nt, Homo sapiens
gaccauccucccaaacuag

SEQ ID NO: 899882 - RNA, 19 nt, Homo sapiens
caacagcuccaggacaucu

SEQ ID NO: 899883 - RNA, 19 nt, Homo sapiens
gugccucucccuucccuuu

SEQ ID NO: 899884 - RNA, 19 nt, Homo sapiens
gccuuaggguggccucuca

SEQ ID NO: 899885 - RNA, 19 nt, Homo sapiens
gccaugccacaucuguaua

SEQ ID NO: 899886 - RNA, 19 nt, Homo sapiens
ugaacaccuucgcucacaa

SEQ ID NO: 899887 - RNA, 19 nt, Homo sapiens
gguuucgucucccacauac

SEQ ID NO: 899888 - RNA, 19 nt, Homo sapiens
gaacaccacuuauguauug

SEQ ID NO: 899889 - RNA, 19 nt, Homo sapiens
uaacauggcugacaaauau

SEQ ID NO: 899890 - RNA, 19 nt, Homo sapiens
ggacauagauauuaacaug

SEQ ID NO: 899891 - RNA, 19 nt, Homo sapiens
ggaaggaacuggaacuaaa

SEQ ID NO: 899892 - RNA, 19 nt, Homo sapiens
gcacugggcagcuuuauua

SEQ ID NO: 899893 - RNA, 19 nt, Homo sapiens
guaggaaacucugcucuua

SEQ ID NO: 899894 - RNA, 19 nt, Homo sapiens
gaacuaugcugagcuuaaa

SEQ ID NO: 899895 - RNA, 19 nt, Homo sapiens
gaaaggaccugcauagacu

SEQ ID NO: 899896 - RNA, 19 nt, Homo sapiens
gcaagagucuacagcauug

SEQ ID NO: 899897 - RNA, 19 nt, Homo sapiens
gacauucucuucuacauug

SEQ ID NO: 899898 - RNA, 19 nt, Homo sapiens
gcaaacagcucugcauugg

SEQ ID NO: 899899 - RNA, 19 nt, Homo sapiens
ggagggcucuauucacauu

SEQ ID NO: 899900 - RNA, 19 nt, Homo sapiens
gaagaacagcuuugcauug

SEQ ID NO: 899901 - RNA, 19 nt, Homo sapiens
gaugauguccuuagaacua

SEQ ID NO: 899902 - RNA, 19 nt, Homo sapiens
gaagaucaguuugggagaa

SEQ ID NO: 899903 - RNA, 19 nt, Homo sapiens
gaaagaaaaugucagaaug

SEQ ID NO: 899904 - RNA, 19 nt, Homo sapiens
gaaauaagucuggaacuau

SEQ ID NO: 899905 - RNA, 19 nt, Homo sapiens
uggaagagaugacuccuuu

SEQ ID NO: 899906 - RNA, 19 nt, Homo sapiens
gcaaaucuaugguuguucu

SEQ ID NO: 899907 - RNA, 19 nt, Homo sapiens
aauccaagcugucuacaaa

SEQ ID NO: 899908 - RNA, 19 nt, Homo sapiens
cagaguaacuuugcugaaa

SEQ ID NO: 899909 - RNA, 19 nt, Homo sapiens
gcacuaugcugcucagagu

SEQ ID NO: 899910 - RNA, 19 nt, Homo sapiens
agaaauaagucuggaacua

SEQ ID NO: 899911 - RNA, 19 nt, Homo sapiens
ggagaacaccacuuaugua

SEQ ID NO: 899912 - RNA, 19 nt, Homo sapiens
gcagauaauucagagagaa

SEQ ID NO: 899913 - RNA, 19 nt, Homo sapiens
gcugcaauauaacgucuua

SEQ ID NO: 899914 - RNA, 19 nt, Homo sapiens
caacacagccugcacugaa

SEQ ID NO: 899915 - RNA, 19 nt, Homo sapiens
agacaaagaagaucaguuu

SEQ ID NO: 899916 - RNA, 19 nt, Homo sapiens
gaagugauccaguucaugu

SEQ ID NO: 899917 - RNA, 19 nt, Homo sapiens
ggaaaauaaugcucaagua

SEQ ID NO: 899918 - RNA, 19 nt, Homo sapiens
gaacuccucuucacuuugc

SEQ ID NO: 899919 - RNA, 19 nt, Homo sapiens
caacagagucuuuacugaa

SEQ ID NO: 899920 - RNA, 19 nt, Homo sapiens
gggaggaaaugcugauguu

SEQ ID NO: 899921 - RNA, 19 nt, Homo sapiens
gaaggcugauucaccuaaa

SEQ ID NO: 899922 - RNA, 19 nt, Homo sapiens
gaaaauacaucauccuaca

SEQ ID NO: 899923 - RNA, 19 nt, Homo sapiens
gagaacaccacuuauguau

SEQ ID NO: 899924 - RNA, 19 nt, Homo sapiens
gcacaaaguccaccaagca

SEQ ID NO: 899925 - RNA, 19 nt, Homo sapiens
gagaacagcccuccaucuu

SEQ ID NO: 899926 - RNA, 19 nt, Homo sapiens
ggaguucccucuguugaga

SEQ ID NO: 899927 - RNA, 19 nt, Homo sapiens
ugacaaauauggagguaca

SEQ ID NO: 899928 - RNA, 19 nt, Homo sapiens
caagcaugauucuaacauu

SEQ ID NO: 899929 - RNA, 19 nt, Homo sapiens
ggaagaacagcuuugcauu

SEQ ID NO: 899930 - RNA, 19 nt, Homo sapiens
ccaacagagucuuuacuga

SEQ ID NO: 899931 - RNA, 19 nt, Homo sapiens
ggaaaacaaugaagagaga

SEQ ID NO: 899932 - RNA, 19 nt, Homo sapiens
aggaaacucugcucuuaaa

SEQ ID NO: 899933 - RNA, 19 nt, Homo sapiens
caggagggcucuauucaca

SEQ ID NO: 899934 - RNA, 19 nt, Homo sapiens
gaggaaaugcugauguuug

SEQ ID NO: 899935 - RNA, 19 nt, Homo sapiens
ggaacuaucccaucugaca

SEQ ID NO: 899936 - RNA, 19 nt, Homo sapiens
gaccgugguugaugucuug

SEQ ID NO: 899937 - RNA, 19 nt, Homo sapiens
aagcagcccuccuguauca

SEQ ID NO: 899938 - RNA, 19 nt, Homo sapiens
cagcauguuuccucagauu

SEQ ID NO: 899939 - RNA, 19 nt, Homo sapiens
gauguuugccagauauuaa

SEQ ID NO: 899940 - RNA, 19 nt, Homo sapiens
cuaagaagacuaugaacaa

SEQ ID NO: 899941 - RNA, 19 nt, Homo sapiens
cguguuggcugacagauug

SEQ ID NO: 899942 - RNA, 19 nt, Homo sapiens
gcaaagugccugagugucu

SEQ ID NO: 899943 - RNA, 19 nt, Homo sapiens
gccaugaagugauccaguu

SEQ ID NO: 899944 - RNA, 19 nt, Homo sapiens
gcuuggagcuggagaugug

SEQ ID NO: 899945 - RNA, 19 nt, Homo sapiens
gagcuccgacugcagauaa

SEQ ID NO: 899946 - RNA, 19 nt, Homo sapiens
gcuguuugcugguucauca

SEQ ID NO: 899947 - RNA, 19 nt, Homo sapiens
uaagaucaauccaaauguc

SEQ ID NO: 899948 - RNA, 19 nt, Homo sapiens
gaaagaaauaagucuggaa

SEQ ID NO: 899949 - RNA, 19 nt, Homo sapiens
uggagugccuacuacaaua

SEQ ID NO: 899950 - RNA, 19 nt, Homo sapiens
ugagaacaguggaagauca

SEQ ID NO: 899951 - RNA, 19 nt, Homo sapiens
ggacauucucuucuacauu

SEQ ID NO: 899952 - RNA, 19 nt, Homo sapiens
gagcaaggguagaucuagu

SEQ ID NO: 899953 - RNA, 19 nt, Homo sapiens
ucagagaaccugcuguuug

SEQ ID NO: 899954 - RNA, 19 nt, Homo sapiens
gcacaggagcccuaagugu

SEQ ID NO: 899955 - RNA, 19 nt, Homo sapiens
ugaagcagcccuccuguau

SEQ ID NO: 899956 - RNA, 19 nt, Homo sapiens
gcugauguuugccagauau

SEQ ID NO: 899957 - RNA, 19 nt, Homo sapiens
gggcagcacugggaggaaa

SEQ ID NO: 899958 - RNA, 19 nt, Homo sapiens
caaaggcagugaugauguc

SEQ ID NO: 899959 - RNA, 19 nt, Homo sapiens
agagcaaacuggaugcaaa

SEQ ID NO: 899960 - RNA, 19 nt, Homo sapiens
gcauugcuccuccagguuu

SEQ ID NO: 899961 - RNA, 19 nt, Homo sapiens
gaguugaggucaggagcua

SEQ ID NO: 899962 - RNA, 19 nt, Homo sapiens
caaaugaaacagccagaga

SEQ ID NO: 899963 - RNA, 19 nt, Homo sapiens
ggaaggcggagcccagauu

SEQ ID NO: 899964 - RNA, 19 nt, Homo sapiens
gcaaaggcagugaugaugu

SEQ ID NO: 899965 - RNA, 19 nt, Homo sapiens
ggagugccuacuacaauaa

SEQ ID NO: 899966 - RNA, 19 nt, Homo sapiens
ugaccaagauggacauucu

SEQ ID NO: 899967 - RNA, 19 nt, Homo sapiens
gugaaguuauuacuggaaa

SEQ ID NO: 899968 - RNA, 19 nt, Homo sapiens
gucuugaccucauaugaaa

SEQ ID NO: 899969 - RNA, 19 nt, Homo sapiens
aagcaugauucuaacauug

SEQ ID NO: 899970 - RNA, 19 nt, Homo sapiens
gaaguggauacacaggaua

SEQ ID NO: 899971 - RNA, 19 nt, Homo sapiens
caggagaaguggauacaca

SEQ ID NO: 899972 - RNA, 19 nt, Homo sapiens
cagauuggauugugcagau

SEQ ID NO: 899973 - RNA, 19 nt, Homo sapiens
gaaacagccagagaacauu

SEQ ID NO: 899974 - RNA, 19 nt, Homo sapiens
gggagaacaccacuuaugu

SEQ ID NO: 899975 - RNA, 19 nt, Homo sapiens
cagagaaccugcuguuugc

SEQ ID NO: 899976 - RNA, 19 nt, Homo sapiens
aaauaagucuggaacuauc

SEQ ID NO: 899977 - RNA, 19 nt, Homo sapiens
ggaaugugaccgugguuga

SEQ ID NO: 899978 - RNA, 19 nt, Homo sapiens
aagcaaaucuaugguuguu

SEQ ID NO: 899979 - RNA, 19 nt, Homo sapiens
ugagacagcuggcgaugag

SEQ ID NO: 899980 - RNA, 19 nt, Homo sapiens
ccaaaccacugcaguaagc

SEQ ID NO: 899981 - RNA, 19 nt, Homo sapiens
ccaaggcccugagccaaga

SEQ ID NO: 899982 - RNA, 19 nt, Homo sapiens
acaauaacccugagcaugu

SEQ ID NO: 899983 - RNA, 19 nt, Homo sapiens
cuaggaggcuggagacauc

SEQ ID NO: 899984 - RNA, 19 nt, Homo sapiens
agauggacauucucuucua

SEQ ID NO: 899985 - RNA, 19 nt, Homo sapiens
gugauucagacacucauua

SEQ ID NO: 899986 - RNA, 19 nt, Homo sapiens
gagccacaccuuugcacua

SEQ ID NO: 899987 - RNA, 19 nt, Homo sapiens
ucgaacuccucuucacuuu

SEQ ID NO: 899988 - RNA, 19 nt, Homo sapiens
uaacagagcuccuccgaua

SEQ ID NO: 899989 - RNA, 19 nt, Homo sapiens
ggagguagaugacuucuuu

SEQ ID NO: 899990 - RNA, 19 nt, Homo sapiens
gaucgcaacuuucauguuu

SEQ ID NO: 899991 - RNA, 19 nt, Homo sapiens
gaagguugcugagcuauuu

SEQ ID NO: 899992 - RNA, 19 nt, Homo sapiens
ccaaagcccucauugacua

SEQ ID NO: 899993 - RNA, 19 nt, Homo sapiens
gagcaaagacgucaaguug

SEQ ID NO: 899994 - RNA, 19 nt, Homo sapiens
ugaaaugucugaacuggaa

SEQ ID NO: 899995 - RNA, 19 nt, Homo sapiens
gaagagaguggcagcauuu

SEQ ID NO: 899996 - RNA, 19 nt, Homo sapiens
caaauaauguggucugcuu

SEQ ID NO: 899997 - RNA, 19 nt, Homo sapiens
agagaaauaucuacaggua

SEQ ID NO: 899998 - RNA, 19 nt, Homo sapiens
gaaaguagagggucgaguu

SEQ ID NO: 899999 - RNA, 19 nt, Homo sapiens
aaacaaagcucuggauaag

SEQ ID NO: 900000 - RNA, 19 nt, Homo sapiens
gagagaagaugcagaaacu

SEQ ID NO: 900001 - RNA, 19 nt, Homo sapiens
gaugaagauuugaagcuaa

SEQ ID NO: 900002 - RNA, 19 nt, Homo sapiens
gcagagcuguauugacuug

SEQ ID NO: 900003 - RNA, 19 nt, Homo sapiens
ggaagagaguggcagcauu

SEQ ID NO: 900004 - RNA, 19 nt, Homo sapiens
ugucugaacuggaaauaaa

SEQ ID NO: 900005 - RNA, 19 nt, Homo sapiens
aauguggucugcuuuauaa

SEQ ID NO: 900006 - RNA, 19 nt, Homo sapiens
ccagaaauuugaacaacuu

SEQ ID NO: 900007 - RNA, 19 nt, Homo sapiens
caaacaaagcucuggauaa

SEQ ID NO: 900008 - RNA, 19 nt, Homo sapiens
ggccagaucuacauuagga

SEQ ID NO: 900009 - RNA, 19 nt, Homo sapiens
guagucaucugguguuugu

SEQ ID NO: 900010 - RNA, 19 nt, Homo sapiens
acaauaggaucaaagauuc

SEQ ID NO: 900011 - RNA, 19 nt, Homo sapiens
gaaaagugcugaugaaguc

SEQ ID NO: 900012 - RNA, 19 nt, Homo sapiens
gagagacaaagucaaauuu

SEQ ID NO: 900013 - RNA, 19 nt, Homo sapiens
cuacgaagcccgacuuuga

SEQ ID NO: 900014 - RNA, 19 nt, Homo sapiens
gagacaaagucaaauuuac

SEQ ID NO: 900015 - RNA, 19 nt, Homo sapiens
gaaggugaagggucuauga

SEQ ID NO: 900016 - RNA, 19 nt, Homo sapiens
uaacagaccuuccauuccu

SEQ ID NO: 900017 - RNA, 19 nt, Homo sapiens
cguaguucgucuuuaguua

SEQ ID NO: 900018 - RNA, 19 nt, Homo sapiens
gauaugccuucacucagaa

SEQ ID NO: 900019 - RNA, 19 nt, Homo sapiens
gcaccaaagcccucauuga

SEQ ID NO: 900020 - RNA, 19 nt, Homo sapiens
gauacuacaugcucaacau

SEQ ID NO: 900021 - RNA, 19 nt, Homo sapiens
cuacaugacacucuuauug

SEQ ID NO: 900022 - RNA, 19 nt, Homo sapiens
ugauaugccuucacucaga

SEQ ID NO: 900023 - RNA, 19 nt, Homo sapiens
uaacugauaugccuucacu

SEQ ID NO: 900024 - RNA, 19 nt, Homo sapiens
cuacagguauauauggaaa

SEQ ID NO: 900025 - RNA, 19 nt, Homo sapiens
uauuauugcuugcuacuug

SEQ ID NO: 900026 - RNA, 19 nt, Homo sapiens
gagaguggcagcauuuaga

SEQ ID NO: 900027 - RNA, 19 nt, Homo sapiens
gaacaacuuuccgaaucug

SEQ ID NO: 900028 - RNA, 19 nt, Homo sapiens
ugagagagacaaagucaaa

SEQ ID NO: 900029 - RNA, 19 nt, Homo sapiens
gguaacagaccuuccauuc

SEQ ID NO: 900030 - RNA, 19 nt, Homo sapiens
cacauuagccuucuggaaa

SEQ ID NO: 900031 - RNA, 19 nt, Homo sapiens
guugaucccucgcuucaga

SEQ ID NO: 900032 - RNA, 19 nt, Homo sapiens
cauugaagcugcuaaggau

SEQ ID NO: 900033 - RNA, 19 nt, Homo sapiens
gauguuugguggcuucuuc

SEQ ID NO: 900034 - RNA, 19 nt, Homo sapiens
gaugaaacaagaacuggaa

SEQ ID NO: 900035 - RNA, 19 nt, Homo sapiens
agaagaauuugccaagaug

SEQ ID NO: 900036 - RNA, 19 nt, Homo sapiens
ggagugcugccagaaauuu

SEQ ID NO: 900037 - RNA, 19 nt, Homo sapiens
uaccacggaagauauauua

SEQ ID NO: 900038 - RNA, 19 nt, Homo sapiens
caggagugcugccagaaau

SEQ ID NO: 900039 - RNA, 19 nt, Homo sapiens
ucaaacaaagcucuggaua

SEQ ID NO: 900040 - RNA, 19 nt, Homo sapiens
aagaagaauuugccaagau

SEQ ID NO: 900041 - RNA, 19 nt, Homo sapiens
aaagaagaauuugccaaga

SEQ ID NO: 900042 - RNA, 19 nt, Homo sapiens
uuaaggagguagaugacuu

SEQ ID NO: 900043 - RNA, 19 nt, Homo sapiens
uaauguggucugcuuuaua

SEQ ID NO: 900044 - RNA, 19 nt, Homo sapiens
aaacaugccaggaacaaug

SEQ ID NO: 900045 - RNA, 19 nt, Homo sapiens
gaguuaaggagguagauga

SEQ ID NO: 900046 - RNA, 19 nt, Homo sapiens
gaagaauuugccaagauga

SEQ ID NO: 900047 - RNA, 19 nt, Homo sapiens
agacuaugcugggcuuauu

SEQ ID NO: 900048 - RNA, 19 nt, Homo sapiens
acaugacacucuuauugaa

SEQ ID NO: 900049 - RNA, 19 nt, Homo sapiens
cacuugcacuuaaaucauu

SEQ ID NO: 900050 - RNA, 19 nt, Homo sapiens
gaagagcccacagucauca

SEQ ID NO: 900051 - RNA, 19 nt, Homo sapiens
gaaacugggagaaggugaa

SEQ ID NO: 900052 - RNA, 19 nt, Homo sapiens
aaggcaacaugaagacuuu

SEQ ID NO: 900053 - RNA, 19 nt, Homo sapiens
ucugguguuuguacuauaa

SEQ ID NO: 900054 - RNA, 19 nt, Homo sapiens
gagcuguauugacuuguuc

SEQ ID NO: 900055 - RNA, 19 nt, Homo sapiens
agaugaagauuugaagcua

SEQ ID NO: 900056 - RNA, 19 nt, Homo sapiens
ugugaaagcugacaaaaug

SEQ ID NO: 900057 - RNA, 19 nt, Homo sapiens
gauggccagaucuacauua

SEQ ID NO: 900058 - RNA, 19 nt, Homo sapiens
uugcagagcuguauugacu

SEQ ID NO: 900059 - RNA, 19 nt, Homo sapiens
caucugguguuuguacuau

SEQ ID NO: 900060 - RNA, 19 nt, Homo sapiens
gaguaucucgcuguguuua

SEQ ID NO: 900061 - RNA, 19 nt, Homo sapiens
cugaguaucucgcuguguu

SEQ ID NO: 900062 - RNA, 19 nt, Homo sapiens
aauaauguggucugcuuua

SEQ ID NO: 900063 - RNA, 19 nt, Homo sapiens
ugaacaacuuuccgaaucu

SEQ ID NO: 900064 - RNA, 19 nt, Homo sapiens
gcaggugauucagcuacuu

SEQ ID NO: 900065 - RNA, 19 nt, Homo sapiens
caacaugaagacuuugugu

SEQ ID NO: 900066 - RNA, 19 nt, Homo sapiens
uuuauaagauggccagauc

SEQ ID NO: 900067 - RNA, 19 nt, Homo sapiens
uugaacaacuuuccgaauc

SEQ ID NO: 900068 - RNA, 19 nt, Homo sapiens
agaccacacugcccacguu

SEQ ID NO: 900069 - RNA, 19 nt, Homo sapiens
gacuaugcugggcuuauua

SEQ ID NO: 900070 - RNA, 19 nt, Homo sapiens
ucagggaggugccaguuac

SEQ ID NO: 900071 - RNA, 19 nt, Homo sapiens
ugagggcgguguguuguau

SEQ ID NO: 900072 - RNA, 19 nt, Homo sapiens
gaaggugggguuuguguuu

SEQ ID NO: 900073 - RNA, 19 nt, Homo sapiens
uacaugacacucuuauuga

SEQ ID NO: 900074 - RNA, 19 nt, Homo sapiens
gggcagaauccaaauacug

SEQ ID NO: 900075 - RNA, 19 nt, Homo sapiens
agagagacaaagucaaauu

SEQ ID NO: 900076 - RNA, 19 nt, Homo sapiens
ggugaaaagugcugaugaa

SEQ ID NO: 900077 - RNA, 19 nt, Homo sapiens
uugccaagaugaaacaaga

SEQ ID NO: 900078 - RNA, 19 nt, Homo sapiens
gagaaauaucuacagguau

SEQ ID NO: 900079 - RNA, 19 nt, Homo sapiens
caaggcaacaugaagacuu

SEQ ID NO: 900080 - RNA, 19 nt, Homo sapiens
uuacaaggcaacaugaaga

SEQ ID NO: 900081 - RNA, 19 nt, Homo sapiens
gcaaaagaagaacugauaa

SEQ ID NO: 900082 - RNA, 19 nt, Homo sapiens
ccacacugcccacguuuca

SEQ ID NO: 900083 - RNA, 19 nt, Homo sapiens
cggcccagcuucuucuuuc

SEQ ID NO: 900084 - RNA, 19 nt, Homo sapiens
guccucccaugaagucuuu

SEQ ID NO: 900085 - RNA, 19 nt, Homo sapiens
caagaugaaacaagaacug

SEQ ID NO: 900086 - RNA, 19 nt, Homo sapiens
ccagaucuacauuaggaaa

SEQ ID NO: 900087 - RNA, 19 nt, Homo sapiens
guggucugcuuuauaagau

SEQ ID NO: 900088 - RNA, 19 nt, Homo sapiens
uaacagagcuccuccgaua

SEQ ID NO: 900089 - RNA, 19 nt, Homo sapiens
ggagguagaugacuucuuu

SEQ ID NO: 900090 - RNA, 19 nt, Homo sapiens
gaucgcaacuuucauguuu

SEQ ID NO: 900091 - RNA, 19 nt, Homo sapiens
gaagguugcugagcuauuu

SEQ ID NO: 900092 - RNA, 19 nt, Homo sapiens
ccaaagcccucauugacua

SEQ ID NO: 900093 - RNA, 19 nt, Homo sapiens
gagcaaagacgucaaguug

SEQ ID NO: 900094 - RNA, 19 nt, Homo sapiens
ugaaaugucugaacuggaa

SEQ ID NO: 900095 - RNA, 19 nt, Homo sapiens
gaagagaguggcagcauuu

SEQ ID NO: 900096 - RNA, 19 nt, Homo sapiens
caaauaauguggucugcuu

SEQ ID NO: 900097 - RNA, 19 nt, Homo sapiens
agagaaauaucuacaggua

SEQ ID NO: 900098 - RNA, 19 nt, Homo sapiens
gaaaguagagggucgaguu

SEQ ID NO: 900099 - RNA, 19 nt, Homo sapiens
aaacaaagcucuggauaag

SEQ ID NO: 900100 - RNA, 19 nt, Homo sapiens
gagagaagaugcagaaacu

SEQ ID NO: 900101 - RNA, 19 nt, Homo sapiens
gaugaagauuugaagcuaa

SEQ ID NO: 900102 - RNA, 19 nt, Homo sapiens
gcagagcuguauugacuug

SEQ ID NO: 900103 - RNA, 19 nt, Homo sapiens
ggaagagaguggcagcauu

SEQ ID NO: 900104 - RNA, 19 nt, Homo sapiens
ugucugaacuggaaauaaa

SEQ ID NO: 900105 - RNA, 19 nt, Homo sapiens
aauguggucugcuuuauaa

SEQ ID NO: 900106 - RNA, 19 nt, Homo sapiens
ccagaaauuugaacaacuu

SEQ ID NO: 900107 - RNA, 19 nt, Homo sapiens
caaacaaagcucuggauaa

SEQ ID NO: 900108 - RNA, 19 nt, Homo sapiens
ggccagaucuacauuagga

SEQ ID NO: 900109 - RNA, 19 nt, Homo sapiens
guagucaucugguguuugu

SEQ ID NO: 900110 - RNA, 19 nt, Homo sapiens
acaauaggaucaaagauuc

SEQ ID NO: 900111 - RNA, 19 nt, Homo sapiens
gaaaagugcugaugaaguc

SEQ ID NO: 900112 - RNA, 19 nt, Homo sapiens
gagagacaaagucaaauuu

SEQ ID NO: 900113 - RNA, 19 nt, Homo sapiens
cuacgaagcccgacuuuga

SEQ ID NO: 900114 - RNA, 19 nt, Homo sapiens
gagacaaagucaaauuuac

SEQ ID NO: 900115 - RNA, 19 nt, Homo sapiens
gaaggugaagggucuauga

SEQ ID NO: 900116 - RNA, 19 nt, Homo sapiens
uaacagaccuuccauuccu

SEQ ID NO: 900117 - RNA, 19 nt, Homo sapiens
cguaguucgucuuuaguua

SEQ ID NO: 900118 - RNA, 19 nt, Homo sapiens
gauaugccuucacucagaa

SEQ ID NO: 900119 - RNA, 19 nt, Homo sapiens
gcaccaaagcccucauuga

SEQ ID NO: 900120 - RNA, 19 nt, Homo sapiens
gauacuacaugcucaacau

SEQ ID NO: 900121 - RNA, 19 nt, Homo sapiens
cuacaugacacucuuauug

SEQ ID NO: 900122 - RNA, 19 nt, Homo sapiens
ugauaugccuucacucaga

SEQ ID NO: 900123 - RNA, 19 nt, Homo sapiens
uaacugauaugccuucacu

SEQ ID NO: 900124 - RNA, 19 nt, Homo sapiens
cuacagguauauauggaaa

SEQ ID NO: 900125 - RNA, 19 nt, Homo sapiens
uauuauugcuugcuacuug

SEQ ID NO: 900126 - RNA, 19 nt, Homo sapiens
gagaguggcagcauuuaga

SEQ ID NO: 900127 - RNA, 19 nt, Homo sapiens
gaacaacuuuccgaaucug

SEQ ID NO: 900128 - RNA, 19 nt, Homo sapiens
ugagagagacaaagucaaa

SEQ ID NO: 900129 - RNA, 19 nt, Homo sapiens
gguaacagaccuuccauuc

SEQ ID NO: 900130 - RNA, 19 nt, Homo sapiens
cacauuagccuucuggaaa

SEQ ID NO: 900131 - RNA, 19 nt, Homo sapiens
cauugaagcugcuaaggau

SEQ ID NO: 900132 - RNA, 19 nt, Homo sapiens
guugaucccucgcuucaga

SEQ ID NO: 900133 - RNA, 19 nt, Homo sapiens
gauguuugguggcuucuuc

SEQ ID NO: 900134 - RNA, 19 nt, Homo sapiens
gaugaaacaagaacuggaa

SEQ ID NO: 900135 - RNA, 19 nt, Homo sapiens
agaagaauuugccaagaug

SEQ ID NO: 900136 - RNA, 19 nt, Homo sapiens
ggagugcugccagaaauuu

SEQ ID NO: 900137 - RNA, 19 nt, Homo sapiens
uaccacggaagauauauua

SEQ ID NO: 900138 - RNA, 19 nt, Homo sapiens
caggagugcugccagaaau

SEQ ID NO: 900139 - RNA, 19 nt, Homo sapiens
ucaaacaaagcucuggaua

SEQ ID NO: 900140 - RNA, 19 nt, Homo sapiens
aagaagaauuugccaagau

SEQ ID NO: 900141 - RNA, 19 nt, Homo sapiens
aaagaagaauuugccaaga

SEQ ID NO: 900142 - RNA, 19 nt, Homo sapiens
uuaaggagguagaugacuu

SEQ ID NO: 900143 - RNA, 19 nt, Homo sapiens
uaauguggucugcuuuaua

SEQ ID NO: 900144 - RNA, 19 nt, Homo sapiens
aaacaugccaggaacaaug

SEQ ID NO: 900145 - RNA, 19 nt, Homo sapiens
gaguuaaggagguagauga

SEQ ID NO: 900146 - RNA, 19 nt, Homo sapiens
gaagaauuugccaagauga

SEQ ID NO: 900147 - RNA, 19 nt, Homo sapiens
agacuaugcugggcuuauu

SEQ ID NO: 900148 - RNA, 19 nt, Homo sapiens
acaugacacucuuauugaa

SEQ ID NO: 900149 - RNA, 19 nt, Homo sapiens
cacuugcacuuaaaucauu

SEQ ID NO: 900150 - RNA, 19 nt, Homo sapiens
gaagagcccacagucauca

SEQ ID NO: 900151 - RNA, 19 nt, Homo sapiens
gaaacugggagaaggugaa

SEQ ID NO: 900152 - RNA, 19 nt, Homo sapiens
aaggcaacaugaagacuuu

SEQ ID NO: 900153 - RNA, 19 nt, Homo sapiens
ucugguguuuguacuauaa

SEQ ID NO: 900154 - RNA, 19 nt, Homo sapiens
gagcuguauugacuuguuc

SEQ ID NO: 900155 - RNA, 19 nt, Homo sapiens
agaugaagauuugaagcua

SEQ ID NO: 900156 - RNA, 19 nt, Homo sapiens
ugugaaagcugacaaaaug

SEQ ID NO: 900157 - RNA, 19 nt, Homo sapiens
gauggccagaucuacauua

SEQ ID NO: 900158 - RNA, 19 nt, Homo sapiens
uugcagagcuguauugacu

SEQ ID NO: 900159 - RNA, 19 nt, Homo sapiens
caucugguguuuguacuau

SEQ ID NO: 900160 - RNA, 19 nt, Homo sapiens
gaguaucucgcuguguuua

SEQ ID NO: 900161 - RNA, 19 nt, Homo sapiens
cugaguaucucgcuguguu

SEQ ID NO: 900162 - RNA, 19 nt, Homo sapiens
aauaauguggucugcuuua

SEQ ID NO: 900163 - RNA, 19 nt, Homo sapiens
ugaacaacuuuccgaaucu

SEQ ID NO: 900164 - RNA, 19 nt, Homo sapiens
gcaggugauucagcuacuu

SEQ ID NO: 900165 - RNA, 19 nt, Homo sapiens
uuuauaagauggccagauc

SEQ ID NO: 900166 - RNA, 19 nt, Homo sapiens
caacaugaagacuuugugu

SEQ ID NO: 900167 - RNA, 19 nt, Homo sapiens
agaccacacugcccacguu

SEQ ID NO: 900168 - RNA, 19 nt, Homo sapiens
uugaacaacuuuccgaauc

SEQ ID NO: 900169 - RNA, 19 nt, Homo sapiens
gacuaugcugggcuuauua

SEQ ID NO: 900170 - RNA, 19 nt, Homo sapiens
ucagggaggugccaguuac

SEQ ID NO: 900171 - RNA, 19 nt, Homo sapiens
ugagggcgguguguuguau

SEQ ID NO: 900172 - RNA, 19 nt, Homo sapiens
gaaggugggguuuguguuu

SEQ ID NO: 900173 - RNA, 19 nt, Homo sapiens
gggcagaauccaaauacug

SEQ ID NO: 900174 - RNA, 19 nt, Homo sapiens
ggugaaaagugcugaugaa

SEQ ID NO: 900175 - RNA, 19 nt, Homo sapiens
agagagacaaagucaaauu

SEQ ID NO: 900176 - RNA, 19 nt, Homo sapiens
uugccaagaugaaacaaga

SEQ ID NO: 900177 - RNA, 19 nt, Homo sapiens
uacaugacacucuuauuga

SEQ ID NO: 900178 - RNA, 19 nt, Homo sapiens
uuacaaggcaacaugaaga

SEQ ID NO: 900179 - RNA, 19 nt, Homo sapiens
gagaaauaucuacagguau

SEQ ID NO: 900180 - RNA, 19 nt, Homo sapiens
gcaaaagaagaacugauaa

SEQ ID NO: 900181 - RNA, 19 nt, Homo sapiens
guccucccaugaagucuuu

SEQ ID NO: 900182 - RNA, 19 nt, Homo sapiens
caaggcaacaugaagacuu

SEQ ID NO: 900183 - RNA, 19 nt, Homo sapiens
caagaugaaacaagaacug

SEQ ID NO: 900184 - RNA, 19 nt, Homo sapiens
ccacacugcccacguuuca

SEQ ID NO: 900185 - RNA, 19 nt, Homo sapiens
ccagaucuacauuaggaaa

SEQ ID NO: 900186 - RNA, 19 nt, Homo sapiens
guggucugcuuuauaagau

SEQ ID NO: 900187 - RNA, 19 nt, Homo sapiens
guggcagcauuuagaaaga

SEQ ID NO: 900188 - RNA, 19 nt, Homo sapiens
ggacggagguggugaagaa

SEQ ID NO: 900189 - RNA, 19 nt, Homo sapiens
gaaagccucucaauacuac

SEQ ID NO: 900190 - RNA, 19 nt, Homo sapiens
cagaagagacgcaguuaua

SEQ ID NO: 900191 - RNA, 19 nt, Homo sapiens
cgaagcaggugguggagua

SEQ ID NO: 900192 - RNA, 19 nt, Homo sapiens
gagagugucuguugaugug

SEQ ID NO: 900193 - RNA, 19 nt, Homo sapiens
ggaaagccucucaauacua

SEQ ID NO: 900194 - RNA, 19 nt, Homo sapiens
ggagggagcugggaguuca

SEQ ID NO: 900195 - RNA, 19 nt, Homo sapiens
acaaggaccucuucagcaa

SEQ ID NO: 900196 - RNA, 19 nt, Homo sapiens
gauuacgacucucgaggaa

SEQ ID NO: 900197 - RNA, 19 nt, Homo sapiens
gggaaagccucucaauacu

SEQ ID NO: 900198 - RNA, 19 nt, Homo sapiens
aguaugaggugucccauga

SEQ ID NO: 900199 - RNA, 19 nt, Homo sapiens
gaagagacgcaguuauaag

SEQ ID NO: 900200 - RNA, 19 nt, Homo sapiens
agacaaggccucuaaagug

SEQ ID NO: 900201 - RNA, 19 nt, Homo sapiens
ggagggagggagaucauga

SEQ ID NO: 900202 - RNA, 19 nt, Homo sapiens
ggucugggauuacgacucu

SEQ ID NO: 900203 - RNA, 19 nt, Homo sapiens
gagacaaggccucuaaagu

SEQ ID NO: 900204 - RNA, 19 nt, Homo sapiens
ugaggugucccaugacuuu

SEQ ID NO: 900205 - RNA, 19 nt, Homo sapiens
ccggaucccucccaaguau

SEQ ID NO: 900206 - RNA, 19 nt, Homo sapiens
gccgaagggugacaaaaua

SEQ ID NO: 900207 - RNA, 19 nt, Homo sapiens
gaggaaagcacgacuucau

SEQ ID NO: 900208 - RNA, 19 nt, Homo sapiens
acgcagggauggcagauug

SEQ ID NO: 900209 - RNA, 19 nt, Homo sapiens
cgggaaagccucucaauac

SEQ ID NO: 900210 - RNA, 19 nt, Homo sapiens
gugaugagagugucuguug

SEQ ID NO: 900211 - RNA, 19 nt, Homo sapiens
agaagagacgcaguuauaa

SEQ ID NO: 900212 - RNA, 19 nt, Homo sapiens
gcagaagagacgcaguuau

SEQ ID NO: 900213 - RNA, 19 nt, Homo sapiens
ccaaauacaagcagaagag

SEQ ID NO: 900214 - RNA, 19 nt, Homo sapiens
uuacgacucucgaggaaag

SEQ ID NO: 900215 - RNA, 19 nt, Homo sapiens
aagagacgcaguuauaaga

SEQ ID NO: 900216 - RNA, 19 nt, Homo sapiens
ggacgacaaggaccucuuc

SEQ ID NO: 900217 - RNA, 19 nt, Homo sapiens
gcuggcaaguccaccauca

SEQ ID NO: 900218 - RNA, 19 nt, Homo sapiens
gcccgcugcugcucaaguu

SEQ ID NO: 900219 - RNA, 19 nt, Homo sapiens
gagacgcaguuauaagaac

SEQ ID NO: 900220 - RNA, 19 nt, Homo sapiens
ggagacaaggccucuaaag

SEQ ID NO: 900221 - RNA, 19 nt, Homo sapiens
uaauaaagugucacccuau

SEQ ID NO: 900222 - RNA, 19 nt, Homo sapiens
ggaucccucccaaguauga

SEQ ID NO: 900223 - RNA, 19 nt, Homo sapiens
gcugucaggaggacgauuu

SEQ ID NO: 900224 - RNA, 19 nt, Homo sapiens
acacugcgcuaagcacuuc

SEQ ID NO: 900225 - RNA, 19 nt, Homo sapiens
gaugagagugucuguugau

SEQ ID NO: 900226 - RNA, 19 nt, Homo sapiens
ccgggaaagccucucaaua

SEQ ID NO: 900227 - RNA, 19 nt, Homo sapiens
uucaaagucucucugaguu

SEQ ID NO: 900228 - RNA, 19 nt, Homo sapiens
ugaugagagugucuguuga

SEQ ID NO: 900229 - RNA, 19 nt, Homo sapiens
ccuaccagccgaacgagua

SEQ ID NO: 900230 - RNA, 19 nt, Homo sapiens
cgacuucaucggagaauuc

SEQ ID NO: 900231 - RNA, 19 nt, Homo sapiens
aaaaguggcuucugcaagu

SEQ ID NO: 900232 - RNA, 19 nt, Homo sapiens
aauaaagugucacccuauc

SEQ ID NO: 900233 - RNA, 19 nt, Homo sapiens
ugacuuugccaucaauuuc

SEQ ID NO: 900234 - RNA, 19 nt, Homo sapiens
ggaguacuacagccacaga

SEQ ID NO: 900235 - RNA, 19 nt, Homo sapiens
cggagguggugaagaacaa

SEQ ID NO: 900236 - RNA, 19 nt, Homo sapiens
gcuugcagcugguguacag

SEQ ID NO: 900237 - RNA, 19 nt, Homo sapiens
cuucaggaguaauaaagug

SEQ ID NO: 900238 - RNA, 19 nt, Homo sapiens
gcacgacuucaucggagaa

SEQ ID NO: 900239 - RNA, 19 nt, Homo sapiens
gaggagagcaccgggaaag

SEQ ID NO: 900240 - RNA, 19 nt, Homo sapiens
ugaggacgaugagugugaa

SEQ ID NO: 900241 - RNA, 19 nt, Homo sapiens
caaauacaagcagaagaga

SEQ ID NO: 900242 - RNA, 19 nt, Homo sapiens
caggaguaauaaaguguca

SEQ ID NO: 900243 - RNA, 19 nt, Homo sapiens
ggacuaugacagugacaag

SEQ ID NO: 900244 - RNA, 19 nt, Homo sapiens
gcugcucccugcacuacau

SEQ ID NO: 900245 - RNA, 19 nt, Homo sapiens
cguccuggcugaccucaag

SEQ ID NO: 900246 - RNA, 19 nt, Homo sapiens
gggcucugcuuugcgucua

SEQ ID NO: 900247 - RNA, 19 nt, Homo sapiens
ccaugacuuugccaucaau

SEQ ID NO: 900248 - RNA, 19 nt, Homo sapiens
ugacuucaccgccuccaau

SEQ ID NO: 900249 - RNA, 19 nt, Homo sapiens
ggugugggaggccuucaaa

SEQ ID NO: 900250 - RNA, 19 nt, Homo sapiens
cagccugcaucccguguuc

SEQ ID NO: 900251 - RNA, 19 nt, Homo sapiens
uggcugaccucaaguucca

SEQ ID NO: 900252 - RNA, 19 nt, Homo sapiens
ugggaggccuucaaagucu

SEQ ID NO: 900253 - RNA, 19 nt, Homo sapiens
ggcagauuguggcccagaa

SEQ ID NO: 900254 - RNA, 19 nt, Homo sapiens
acuccuuccuggacuauau

SEQ ID NO: 900255 - RNA, 19 nt, Homo sapiens
gugucacccuauccuugua

SEQ ID NO: 900256 - RNA, 19 nt, Homo sapiens
gggcuucaggaguaauaaa

SEQ ID NO: 900257 - RNA, 19 nt, Homo sapiens
ucccaugacuuugccauca

SEQ ID NO: 900258 - RNA, 19 nt, Homo sapiens
caagagguuuuccgcuuug

SEQ ID NO: 900259 - RNA, 19 nt, Homo sapiens
ggaagcuggacgacaagga

SEQ ID NO: 900260 - RNA, 19 nt, Homo sapiens
ggagaugcagaaggccuuu

SEQ ID NO: 900261 - RNA, 19 nt, Homo sapiens
aaggaccucuucagcaagu

SEQ ID NO: 900262 - RNA, 19 nt, Homo sapiens
ggugaucgccgaggacauc

SEQ ID NO: 900263 - RNA, 19 nt, Homo sapiens
gcaggaacgcuggcaaguc

SEQ ID NO: 900264 - RNA, 19 nt, Homo sapiens
gcccauguccaucaucauc

SEQ ID NO: 900265 - RNA, 19 nt, Homo sapiens
acaagagguuuuccgcuuu

SEQ ID NO: 900266 - RNA, 19 nt, Homo sapiens
cgagaucugccaggacuau

SEQ ID NO: 900267 - RNA, 19 nt, Homo sapiens
aagcagaagagacgcaguu

SEQ ID NO: 900268 - RNA, 19 nt, Homo sapiens
ucuucacgguggacuacua

SEQ ID NO: 900269 - RNA, 19 nt, Homo sapiens
aauacuacauccugcugau

SEQ ID NO: 900270 - RNA, 19 nt, Homo sapiens
gcaccgggaaagccucuca

SEQ ID NO: 900271 - RNA, 19 nt, Homo sapiens
cccaugacuuugccaucaa

SEQ ID NO: 900272 - RNA, 19 nt, Homo sapiens
gugggaggccuucaaaguc

SEQ ID NO: 900273 - RNA, 19 nt, Homo sapiens
ccaccuacccugugcuuuu

SEQ ID NO: 900274 - RNA, 19 nt, Homo sapiens
ugacagugacaagagguuu

SEQ ID NO: 900275 - RNA, 19 nt, Homo sapiens
gccaggacuaugacaguga

SEQ ID NO: 900276 - RNA, 19 nt, Homo sapiens
caccguggccauugacuuc

SEQ ID NO: 900277 - RNA, 19 nt, Homo sapiens
uccgggacaucguacaguu

SEQ ID NO: 900278 - RNA, 19 nt, Homo sapiens
gguggaggccuaccagaac

SEQ ID NO: 900279 - RNA, 19 nt, Homo sapiens
gacuuugccaucaauuuca

SEQ ID NO: 900280 - RNA, 19 nt, Homo sapiens
uaugaggugucccaugacu

SEQ ID NO: 900281 - RNA, 19 nt, Homo sapiens
cacggaauccucacaccuu

SEQ ID NO: 900282 - RNA, 19 nt, Homo sapiens
ucaaagucucucugaguuc

SEQ ID NO: 900283 - RNA, 19 nt, Homo sapiens
ggacggagguggugaagaa

SEQ ID NO: 900284 - RNA, 19 nt, Homo sapiens
gaaagccucucaauacuac

SEQ ID NO: 900285 - RNA, 19 nt, Homo sapiens
cagaagagacgcaguuaua

SEQ ID NO: 900286 - RNA, 19 nt, Homo sapiens
cgaagcaggugguggagua

SEQ ID NO: 900287 - RNA, 19 nt, Homo sapiens
ggaaagccucucaauacua

SEQ ID NO: 900288 - RNA, 19 nt, Homo sapiens
ggagggagcugggaguuca

SEQ ID NO: 900289 - RNA, 19 nt, Homo sapiens
acaaggaccucuucagcaa

SEQ ID NO: 900290 - RNA, 19 nt, Homo sapiens
gauuacgacucucgaggaa

SEQ ID NO: 900291 - RNA, 19 nt, Homo sapiens
gggaaagccucucaauacu

SEQ ID NO: 900292 - RNA, 19 nt, Homo sapiens
aguaugaggugucccauga

SEQ ID NO: 900293 - RNA, 19 nt, Homo sapiens
gaagagacgcaguuauaag

SEQ ID NO: 900294 - RNA, 19 nt, Homo sapiens
agacaaggccucuaaagug

SEQ ID NO: 900295 - RNA, 19 nt, Homo sapiens
ggagggagggagaucauga

SEQ ID NO: 900296 - RNA, 19 nt, Homo sapiens
ggucugggauuacgacucu

SEQ ID NO: 900297 - RNA, 19 nt, Homo sapiens
gagacaaggccucuaaagu

SEQ ID NO: 900298 - RNA, 19 nt, Homo sapiens
ugaggugucccaugacuuu

SEQ ID NO: 900299 - RNA, 19 nt, Homo sapiens
ccggaucccucccaaguau

SEQ ID NO: 900300 - RNA, 19 nt, Homo sapiens
gccgaagggugacaaaaua

SEQ ID NO: 900301 - RNA, 19 nt, Homo sapiens
gaggaaagcacgacuucau

SEQ ID NO: 900302 - RNA, 19 nt, Homo sapiens
cgggaaagccucucaauac

SEQ ID NO: 900303 - RNA, 19 nt, Homo sapiens
agaagagacgcaguuauaa

SEQ ID NO: 900304 - RNA, 19 nt, Homo sapiens
gcagaagagacgcaguuau

SEQ ID NO: 900305 - RNA, 19 nt, Homo sapiens
ccaaauacaagcagaagag

SEQ ID NO: 900306 - RNA, 19 nt, Homo sapiens
uuacgacucucgaggaaag

SEQ ID NO: 900307 - RNA, 19 nt, Homo sapiens
aagagacgcaguuauaaga

SEQ ID NO: 900308 - RNA, 19 nt, Homo sapiens
ggacgacaaggaccucuuc

SEQ ID NO: 900309 - RNA, 19 nt, Homo sapiens
gcuggcaaguccaccauca

SEQ ID NO: 900310 - RNA, 19 nt, Homo sapiens
gcccgcugcugcucaaguu

SEQ ID NO: 900311 - RNA, 19 nt, Homo sapiens
gagacgcaguuauaagaac

SEQ ID NO: 900312 - RNA, 19 nt, Homo sapiens
ggagacaaggccucuaaag

SEQ ID NO: 900313 - RNA, 19 nt, Homo sapiens
uaauaaagugucacccuau

SEQ ID NO: 900314 - RNA, 19 nt, Homo sapiens
ggaucccucccaaguauga

SEQ ID NO: 900315 - RNA, 19 nt, Homo sapiens
gcugucaggaggacgauuu

SEQ ID NO: 900316 - RNA, 19 nt, Homo sapiens
ccgggaaagccucucaaua

SEQ ID NO: 900317 - RNA, 19 nt, Homo sapiens
uucaaagucucucugaguu

SEQ ID NO: 900318 - RNA, 19 nt, Homo sapiens
ccuaccagccgaacgagua

SEQ ID NO: 900319 - RNA, 19 nt, Homo sapiens
cgacuucaucggagaauuc

SEQ ID NO: 900320 - RNA, 19 nt, Homo sapiens
aauaaagugucacccuauc

SEQ ID NO: 900321 - RNA, 19 nt, Homo sapiens
ugacuuugccaucaauuuc

SEQ ID NO: 900322 - RNA, 19 nt, Homo sapiens
ggaguacuacagccacaga

SEQ ID NO: 900323 - RNA, 19 nt, Homo sapiens
cggagguggugaagaacaa

SEQ ID NO: 900324 - RNA, 19 nt, Homo sapiens
gcuugcagcugguguacag

SEQ ID NO: 900325 - RNA, 19 nt, Homo sapiens
cuucaggaguaauaaagug

SEQ ID NO: 900326 - RNA, 19 nt, Homo sapiens
gcacgacuucaucggagaa

SEQ ID NO: 900327 - RNA, 19 nt, Homo sapiens
gaggagagcaccgggaaag

SEQ ID NO: 900328 - RNA, 19 nt, Homo sapiens
ugaggacgaugagugugaa

SEQ ID NO: 900329 - RNA, 19 nt, Homo sapiens
caaauacaagcagaagaga

SEQ ID NO: 900330 - RNA, 19 nt, Homo sapiens
caggaguaauaaaguguca

SEQ ID NO: 900331 - RNA, 19 nt, Homo sapiens
ggacuaugacagugacaag

SEQ ID NO: 900332 - RNA, 19 nt, Homo sapiens
gcugcucccugcacuacau

SEQ ID NO: 900333 - RNA, 19 nt, Homo sapiens
cguccuggcugaccucaag

SEQ ID NO: 900334 - RNA, 19 nt, Homo sapiens
gggcucugcuuugcgucua

SEQ ID NO: 900335 - RNA, 19 nt, Homo sapiens
ccaugacuuugccaucaau

SEQ ID NO: 900336 - RNA, 19 nt, Homo sapiens
ugacuucaccgccuccaau

SEQ ID NO: 900337 - RNA, 19 nt, Homo sapiens
ggugugggaggccuucaaa

SEQ ID NO: 900338 - RNA, 19 nt, Homo sapiens
cagccugcaucccguguuc

SEQ ID NO: 900339 - RNA, 19 nt, Homo sapiens
uggcugaccucaaguucca

SEQ ID NO: 900340 - RNA, 19 nt, Homo sapiens
ugggaggccuucaaagucu

SEQ ID NO: 900341 - RNA, 19 nt, Homo sapiens
acuccuuccuggacuauau

SEQ ID NO: 900342 - RNA, 19 nt, Homo sapiens
ggcagauuguggcccagaa

SEQ ID NO: 900343 - RNA, 19 nt, Homo sapiens
gugucacccuauccuugua

SEQ ID NO: 900344 - RNA, 19 nt, Homo sapiens
gggcuucaggaguaauaaa

SEQ ID NO: 900345 - RNA, 19 nt, Homo sapiens
ucccaugacuuugccauca

SEQ ID NO: 900346 - RNA, 19 nt, Homo sapiens
caagagguuuuccgcuuug

SEQ ID NO: 900347 - RNA, 19 nt, Homo sapiens
ggaagcuggacgacaagga

SEQ ID NO: 900348 - RNA, 19 nt, Homo sapiens
gcaggaacgcuggcaaguc

SEQ ID NO: 900349 - RNA, 19 nt, Homo sapiens
aaggaccucuucagcaagu

SEQ ID NO: 900350 - RNA, 19 nt, Homo sapiens
ggugaucgccgaggacauc

SEQ ID NO: 900351 - RNA, 19 nt, Homo sapiens
ggagaugcagaaggccuuu

SEQ ID NO: 900352 - RNA, 19 nt, Homo sapiens
gcccauguccaucaucauc

SEQ ID NO: 900353 - RNA, 19 nt, Homo sapiens
acaagagguuuuccgcuuu

SEQ ID NO: 900354 - RNA, 19 nt, Homo sapiens
cgagaucugccaggacuau

SEQ ID NO: 900355 - RNA, 19 nt, Homo sapiens
aagcagaagagacgcaguu

SEQ ID NO: 900356 - RNA, 19 nt, Homo sapiens
aauacuacauccugcugau

SEQ ID NO: 900357 - RNA, 19 nt, Homo sapiens
gcaccgggaaagccucuca

SEQ ID NO: 900358 - RNA, 19 nt, Homo sapiens
cccaugacuuugccaucaa

SEQ ID NO: 900359 - RNA, 19 nt, Homo sapiens
ucuucacgguggacuacua

SEQ ID NO: 900360 - RNA, 19 nt, Homo sapiens
gugggaggccuucaaaguc

SEQ ID NO: 900361 - RNA, 19 nt, Homo sapiens
ccaccuacccugugcuuuu

SEQ ID NO: 900362 - RNA, 19 nt, Homo sapiens
ugacagugacaagagguuu

SEQ ID NO: 900363 - RNA, 19 nt, Homo sapiens
gccaggacuaugacaguga

SEQ ID NO: 900364 - RNA, 19 nt, Homo sapiens
caccguggccauugacuuc

SEQ ID NO: 900365 - RNA, 19 nt, Homo sapiens
uccgggacaucguacaguu

SEQ ID NO: 900366 - RNA, 19 nt, Homo sapiens
gguggaggccuaccagaac

SEQ ID NO: 900367 - RNA, 19 nt, Homo sapiens
gacuuugccaucaauuuca

SEQ ID NO: 900368 - RNA, 19 nt, Homo sapiens
uaugaggugucccaugacu

SEQ ID NO: 900369 - RNA, 19 nt, Homo sapiens
ucaaagucucucugaguuc

SEQ ID NO: 900370 - RNA, 19 nt, Homo sapiens
aaacagaggugguccauaa

SEQ ID NO: 900371 - RNA, 19 nt, Homo sapiens
cuaggaaacuggaccauua

SEQ ID NO: 900372 - RNA, 19 nt, Homo sapiens
ucagaaagcucuuccagaa

SEQ ID NO: 900373 - RNA, 19 nt, Homo sapiens
acaaauagccgaaguguuu

SEQ ID NO: 900374 - RNA, 19 nt, Homo sapiens
ccaaagaagaugaugauua

SEQ ID NO: 900375 - RNA, 19 nt, Homo sapiens
caugagagcugauaucugu

SEQ ID NO: 900376 - RNA, 19 nt, Homo sapiens
ggaauugacugacaagaag

SEQ ID NO: 900377 - RNA, 19 nt, Homo sapiens
cauaggauuuggaaacaua

SEQ ID NO: 900378 - RNA, 19 nt, Homo sapiens
cagaaugacugcccuagaa

SEQ ID NO: 900379 - RNA, 19 nt, Homo sapiens
ggacgaaauuugcccgauu

SEQ ID NO: 900380 - RNA, 19 nt, Homo sapiens
caugcacacuuuacauuua

SEQ ID NO: 900381 - RNA, 19 nt, Homo sapiens
ggaauaaugucacuaaagc

SEQ ID NO: 900382 - RNA, 19 nt, Homo sapiens
guggagaggucauuucuga

SEQ ID NO: 900383 - RNA, 19 nt, Homo sapiens
ccauaaacauucaagacua

SEQ ID NO: 900384 - RNA, 19 nt, Homo sapiens
gagcugacgucaugcagaa

SEQ ID NO: 900385 - RNA, 19 nt, Homo sapiens
ggauuggccuguaguuuau

SEQ ID NO: 900386 - RNA, 19 nt, Homo sapiens
ucaaggauauuacguuguu

SEQ ID NO: 900387 - RNA, 19 nt, Homo sapiens
gaaacuggaccauuaccua

SEQ ID NO: 900388 - RNA, 19 nt, Homo sapiens
gugaaucccuuaagcagaa

SEQ ID NO: 900389 - RNA, 19 nt, Homo sapiens
gaagggugauguauuugga

SEQ ID NO: 900390 - RNA, 19 nt, Homo sapiens
ccaaaugccacuccaagua

SEQ ID NO: 900391 - RNA, 19 nt, Homo sapiens
ucagugaugugaagaaaga

SEQ ID NO: 900392 - RNA, 19 nt, Homo sapiens
ggaaccaacuccagguaga

SEQ ID NO: 900393 - RNA, 19 nt, Homo sapiens
caaggaaucucacucuuac

SEQ ID NO: 900394 - RNA, 19 nt, Homo sapiens
gaaauuugcccgauugaca

SEQ ID NO: 900395 - RNA, 19 nt, Homo sapiens
gauauuacguuguucaaac

SEQ ID NO: 900396 - RNA, 19 nt, Homo sapiens
agaaggagcugcggaauca

SEQ ID NO: 900397 - RNA, 19 nt, Homo sapiens
aaacggaucaucuuucgua

SEQ ID NO: 900398 - RNA, 19 nt, Homo sapiens
ucaaggaaucucacucuua

SEQ ID NO: 900399 - RNA, 19 nt, Homo sapiens
cagauaccaugucaggaua

SEQ ID NO: 900400 - RNA, 19 nt, Homo sapiens
caauaagaaugaagaaugg

SEQ ID NO: 900401 - RNA, 19 nt, Homo sapiens
accaugagaugcugaauaa

SEQ ID NO: 900402 - RNA, 19 nt, Homo sapiens
aaacaaagcagaacaacau

SEQ ID NO: 900403 - RNA, 19 nt, Homo sapiens
cagauauccuuccucagua

SEQ ID NO: 900404 - RNA, 19 nt, Homo sapiens
gacgaaauuugcccgauug

SEQ ID NO: 900405 - RNA, 19 nt, Homo sapiens
caagaagaccauugagaaa

SEQ ID NO: 900406 - RNA, 19 nt, Homo sapiens
caacggcggugcugaccaa

SEQ ID NO: 900407 - RNA, 19 nt, Homo sapiens
aaggaagacuggaauaaug

SEQ ID NO: 900408 - RNA, 19 nt, Homo sapiens
ccaauaagaaugaagaaug

SEQ ID NO: 900409 - RNA, 19 nt, Homo sapiens
agggaagggugauguauuu

SEQ ID NO: 900410 - RNA, 19 nt, Homo sapiens
gcugauaucuguguucauc

SEQ ID NO: 900411 - RNA, 19 nt, Homo sapiens
gugagcgagucauggauua

SEQ ID NO: 900412 - RNA, 19 nt, Homo sapiens
cagcaaggauucauuguac

SEQ ID NO: 900413 - RNA, 19 nt, Homo sapiens
caaagucaacagcccaaua

SEQ ID NO: 900414 - RNA, 19 nt, Homo sapiens
ggaaucagcagucucuuca

SEQ ID NO: 900415 - RNA, 19 nt, Homo sapiens
gcuuguauauuaugcaguu

SEQ ID NO: 900416 - RNA, 19 nt, Homo sapiens
agacgucucuggccuaugu

SEQ ID NO: 900417 - RNA, 19 nt, Homo sapiens
gacaagccuuacaaccaua

SEQ ID NO: 900418 - RNA, 19 nt, Homo sapiens
ugacaagccuuacaaccau

SEQ ID NO: 900419 - RNA, 19 nt, Homo sapiens
gcaugcacacuuuacauuu

SEQ ID NO: 900420 - RNA, 19 nt, Homo sapiens
uuuguaaacucucuggaua

SEQ ID NO: 900421 - RNA, 19 nt, Homo sapiens
gaucugcugucuuguuuac

SEQ ID NO: 900422 - RNA, 19 nt, Homo sapiens
aaagucaacagcccaauaa

SEQ ID NO: 900423 - RNA, 19 nt, Homo sapiens
gagcugauaucuguguuca

SEQ ID NO: 900424 - RNA, 19 nt, Homo sapiens
uggauuggccuguaguuua

SEQ ID NO: 900425 - RNA, 19 nt, Homo sapiens
gcagguggcagaaauuuua

SEQ ID NO: 900426 - RNA, 19 nt, Homo sapiens
ggccuguaguuuauaguaa

SEQ ID NO: 900427 - RNA, 19 nt, Homo sapiens
gucaacagcccaauaagaa

SEQ ID NO: 900428 - RNA, 19 nt, Homo sapiens
ugaaucaaguuucuuacug

SEQ ID NO: 900429 - RNA, 19 nt, Homo sapiens
ugauaucuguguucaucua

SEQ ID NO: 900430 - RNA, 19 nt, Homo sapiens
gguuggcucucuucuuuau

SEQ ID NO: 900431 - RNA, 19 nt, Homo sapiens
cauaaacauucaagacuag

SEQ ID NO: 900432 - RNA, 19 nt, Homo sapiens
gaugaccacacauggauuu

SEQ ID NO: 900433 - RNA, 19 nt, Homo sapiens
gaggaaacggaucaucuuu

SEQ ID NO: 900434 - RNA, 19 nt, Homo sapiens
acaagaagaccauugagaa

SEQ ID NO: 900435 - RNA, 19 nt, Homo sapiens
gagcagugauucagagaac

SEQ ID NO: 900436 - RNA, 19 nt, Homo sapiens
caaccgugaugccauggaa

SEQ ID NO: 900437 - RNA, 19 nt, Homo sapiens
uaaacucucuggauaucau

SEQ ID NO: 900438 - RNA, 19 nt, Homo sapiens
caaaaggcauugauacaga

SEQ ID NO: 900439 - RNA, 19 nt, Homo sapiens
gagcgagucauggauuaua

SEQ ID NO: 900440 - RNA, 19 nt, Homo sapiens
caugagaugcugaauaaug

SEQ ID NO: 900441 - RNA, 19 nt, Homo sapiens
ugaucgaucugcugucuug

SEQ ID NO: 900442 - RNA, 19 nt, Homo sapiens
gggaauugacugacaagaa

SEQ ID NO: 900443 - RNA, 19 nt, Homo sapiens
gauaccaugucaggauauu

SEQ ID NO: 900444 - RNA, 19 nt, Homo sapiens
caacagcccaauaagaaug

SEQ ID NO: 900445 - RNA, 19 nt, Homo sapiens
ucaucgagcugacgucaug

SEQ ID NO: 900446 - RNA, 19 nt, Homo sapiens
aaagugaccuucguuugga

SEQ ID NO: 900447 - RNA, 19 nt, Homo sapiens
uuaaugaacauccugcuuu

SEQ ID NO: 900448 - RNA, 19 nt, Homo sapiens
gaugaugguuggcucucuu

SEQ ID NO: 900449 - RNA, 19 nt, Homo sapiens
ggcugcgacucaagaauaa

SEQ ID NO: 900450 - RNA, 19 nt, Homo sapiens
ugaacuaucugaaaacuug

SEQ ID NO: 900451 - RNA, 19 nt, Homo sapiens
gcaggaagucaaacacgaa

SEQ ID NO: 900452 - RNA, 19 nt, Homo sapiens
cacuaaagcugagucaaug

SEQ ID NO: 900453 - RNA, 19 nt, Homo sapiens
gggaagccuugcucaaagu

SEQ ID NO: 900454 - RNA, 19 nt, Homo sapiens
caaccgauaccaugagaug

SEQ ID NO: 900455 - RNA, 19 nt, Homo sapiens
ggaccauuaccuagaauau

SEQ ID NO: 900456 - RNA, 19 nt, Homo sapiens
ucgaucugcugucuuguuu

SEQ ID NO: 900457 - RNA, 19 nt, Homo sapiens
cagcagcucacgccaauga

SEQ ID NO: 900458 - RNA, 19 nt, Homo sapiens
agaagaccauugagaaagu

SEQ ID NO: 900459 - RNA, 19 nt, Homo sapiens
gacaagaagaccauugaga

SEQ ID NO: 900460 - RNA, 19 nt, Homo sapiens
cagugaaucaaguuucuua

SEQ ID NO: 900461 - RNA, 19 nt, Homo sapiens
cguguccucucucuacuuu

SEQ ID NO: 900462 - RNA, 19 nt, Homo sapiens
ccauaucgcuacaauacca

SEQ ID NO: 900463 - RNA, 19 nt, Homo sapiens
ucagauauccuuccucagu

SEQ ID NO: 900464 - RNA, 19 nt, Homo sapiens
gaggugguccauaaacauu

SEQ ID NO: 900465 - RNA, 19 nt, Homo sapiens
cagcucacgccaaugaaua

SEQ ID NO: 900466 - RNA, 19 nt, Homo sapiens
gccaauagaggaugauuca

SEQ ID NO: 900467 - RNA, 19 nt, Homo sapiens
gcgggaagccuugcucaaa

SEQ ID NO: 900468 - RNA, 19 nt, Homo sapiens
ggacaugagagcugauauc

SEQ ID NO: 900469 - RNA, 19 nt, Homo sapiens
gguauagcaucggagacua

SEQ ID NO: 900470 - RNA, 19 nt, Homo sapiens
aaacagaggugguccauaa

SEQ ID NO: 900471 - RNA, 19 nt, Homo sapiens
cuaggaaacuggaccauua

SEQ ID NO: 900472 - RNA, 19 nt, Homo sapiens
ucagaaagcucuuccagaa

SEQ ID NO: 900473 - RNA, 19 nt, Homo sapiens
acaaauagccgaaguguuu

SEQ ID NO: 900474 - RNA, 19 nt, Homo sapiens
ccaaagaagaugaugauua

SEQ ID NO: 900475 - RNA, 19 nt, Homo sapiens
caugagagcugauaucugu

SEQ ID NO: 900476 - RNA, 19 nt, Homo sapiens
ggaauugacugacaagaag

SEQ ID NO: 900477 - RNA, 19 nt, Homo sapiens
cauaggauuuggaaacaua

SEQ ID NO: 900478 - RNA, 19 nt, Homo sapiens
cagaaugacugcccuagaa

SEQ ID NO: 900479 - RNA, 19 nt, Homo sapiens
ggacgaaauuugcccgauu

SEQ ID NO: 900480 - RNA, 19 nt, Homo sapiens
caugcacacuuuacauuua

SEQ ID NO: 900481 - RNA, 19 nt, Homo sapiens
ggaauaaugucacuaaagc

SEQ ID NO: 900482 - RNA, 19 nt, Homo sapiens
guggagaggucauuucuga

SEQ ID NO: 900483 - RNA, 19 nt, Homo sapiens
ccauaaacauucaagacua

SEQ ID NO: 900484 - RNA, 19 nt, Homo sapiens
gagcugacgucaugcagaa

SEQ ID NO: 900485 - RNA, 19 nt, Homo sapiens
ggauuggccuguaguuuau

SEQ ID NO: 900486 - RNA, 19 nt, Homo sapiens
ucaaggauauuacguuguu

SEQ ID NO: 900487 - RNA, 19 nt, Homo sapiens
gaaacuggaccauuaccua

SEQ ID NO: 900488 - RNA, 19 nt, Homo sapiens
gugaaucccuuaagcagaa

SEQ ID NO: 900489 - RNA, 19 nt, Homo sapiens
ccaaaugccacuccaagua

SEQ ID NO: 900490 - RNA, 19 nt, Homo sapiens
ucagugaugugaagaaaga

SEQ ID NO: 900491 - RNA, 19 nt, Homo sapiens
ggaaccaacuccagguaga

SEQ ID NO: 900492 - RNA, 19 nt, Homo sapiens
gaaauuugcccgauugaca

SEQ ID NO: 900493 - RNA, 19 nt, Homo sapiens
gauauuacguuguucaaac

SEQ ID NO: 900494 - RNA, 19 nt, Homo sapiens
agaaggagcugcggaauca

SEQ ID NO: 900495 - RNA, 19 nt, Homo sapiens
cagauaccaugucaggaua

SEQ ID NO: 900496 - RNA, 19 nt, Homo sapiens
caauaagaaugaagaaugg

SEQ ID NO: 900497 - RNA, 19 nt, Homo sapiens
accaugagaugcugaauaa

SEQ ID NO: 900498 - RNA, 19 nt, Homo sapiens
aaacaaagcagaacaacau

SEQ ID NO: 900499 - RNA, 19 nt, Homo sapiens
cagauauccuuccucagua

SEQ ID NO: 900500 - RNA, 19 nt, Homo sapiens
gacgaaauuugcccgauug

SEQ ID NO: 900501 - RNA, 19 nt, Homo sapiens
caagaagaccauugagaaa

SEQ ID NO: 900502 - RNA, 19 nt, Homo sapiens
caacggcggugcugaccaa

SEQ ID NO: 900503 - RNA, 19 nt, Homo sapiens
aaggaagacuggaauaaug

SEQ ID NO: 900504 - RNA, 19 nt, Homo sapiens
ccaauaagaaugaagaaug

SEQ ID NO: 900505 - RNA, 19 nt, Homo sapiens
gcugauaucuguguucauc

SEQ ID NO: 900506 - RNA, 19 nt, Homo sapiens
gugagcgagucauggauua

SEQ ID NO: 900507 - RNA, 19 nt, Homo sapiens
cagcaaggauucauuguac

SEQ ID NO: 900508 - RNA, 19 nt, Homo sapiens
caaagucaacagcccaaua

SEQ ID NO: 900509 - RNA, 19 nt, Homo sapiens
ggaaucagcagucucuuca

SEQ ID NO: 900510 - RNA, 19 nt, Homo sapiens
gcuuguauauuaugcaguu

SEQ ID NO: 900511 - RNA, 19 nt, Homo sapiens
agacgucucuggccuaugu

SEQ ID NO: 900512 - RNA, 19 nt, Homo sapiens
gacaagccuuacaaccaua

SEQ ID NO: 900513 - RNA, 19 nt, Homo sapiens
ugacaagccuuacaaccau

SEQ ID NO: 900514 - RNA, 19 nt, Homo sapiens
gcaugcacacuuuacauuu

SEQ ID NO: 900515 - RNA, 19 nt, Homo sapiens
uuuguaaacucucuggaua

SEQ ID NO: 900516 - RNA, 19 nt, Homo sapiens
gaucugcugucuuguuuac

SEQ ID NO: 900517 - RNA, 19 nt, Homo sapiens
aaagucaacagcccaauaa

SEQ ID NO: 900518 - RNA, 19 nt, Homo sapiens
uggauuggccuguaguuua

SEQ ID NO: 900519 - RNA, 19 nt, Homo sapiens
gagcugauaucuguguuca

SEQ ID NO: 900520 - RNA, 19 nt, Homo sapiens
gcagguggcagaaauuuua

SEQ ID NO: 900521 - RNA, 19 nt, Homo sapiens
gucaacagcccaauaagaa

SEQ ID NO: 900522 - RNA, 19 nt, Homo sapiens
ggccuguaguuuauaguaa

SEQ ID NO: 900523 - RNA, 19 nt, Homo sapiens
ugaaucaaguuucuuacug

SEQ ID NO: 900524 - RNA, 19 nt, Homo sapiens
ugauaucuguguucaucua

SEQ ID NO: 900525 - RNA, 19 nt, Homo sapiens
gguuggcucucuucuuuau

SEQ ID NO: 900526 - RNA, 19 nt, Homo sapiens
cauaaacauucaagacuag

SEQ ID NO: 900527 - RNA, 19 nt, Homo sapiens
gaugaccacacauggauuu

SEQ ID NO: 900528 - RNA, 19 nt, Homo sapiens
acaagaagaccauugagaa

SEQ ID NO: 900529 - RNA, 19 nt, Homo sapiens
gagcagugauucagagaac

SEQ ID NO: 900530 - RNA, 19 nt, Homo sapiens
caaccgugaugccauggaa

SEQ ID NO: 900531 - RNA, 19 nt, Homo sapiens
caaaaggcauugauacaga

SEQ ID NO: 900532 - RNA, 19 nt, Homo sapiens
gagcgagucauggauuaua

SEQ ID NO: 900533 - RNA, 19 nt, Homo sapiens
caugagaugcugaauaaug

SEQ ID NO: 900534 - RNA, 19 nt, Homo sapiens
uaaacucucuggauaucau

SEQ ID NO: 900535 - RNA, 19 nt, Homo sapiens
ugaucgaucugcugucuug

SEQ ID NO: 900536 - RNA, 19 nt, Homo sapiens
gggaauugacugacaagaa

SEQ ID NO: 900537 - RNA, 19 nt, Homo sapiens
gauaccaugucaggauauu

SEQ ID NO: 900538 - RNA, 19 nt, Homo sapiens
ucaucgagcugacgucaug

SEQ ID NO: 900539 - RNA, 19 nt, Homo sapiens
caacagcccaauaagaaug

SEQ ID NO: 900540 - RNA, 19 nt, Homo sapiens
aaagugaccuucguuugga

SEQ ID NO: 900541 - RNA, 19 nt, Homo sapiens
uuaaugaacauccugcuuu

SEQ ID NO: 900542 - RNA, 19 nt, Homo sapiens
gaugaugguuggcucucuu

SEQ ID NO: 900543 - RNA, 19 nt, Homo sapiens
ggcugcgacucaagaauaa

SEQ ID NO: 900544 - RNA, 19 nt, Homo sapiens
ugaacuaucugaaaacuug

SEQ ID NO: 900545 - RNA, 19 nt, Homo sapiens
gcaggaagucaaacacgaa

SEQ ID NO: 900546 - RNA, 19 nt, Homo sapiens
cacuaaagcugagucaaug

SEQ ID NO: 900547 - RNA, 19 nt, Homo sapiens
caaccgauaccaugagaug

SEQ ID NO: 900548 - RNA, 19 nt, Homo sapiens
ggaccauuaccuagaauau

SEQ ID NO: 900549 - RNA, 19 nt, Homo sapiens
ucgaucugcugucuuguuu

SEQ ID NO: 900550 - RNA, 19 nt, Homo sapiens
cagcagcucacgccaauga

SEQ ID NO: 900551 - RNA, 19 nt, Homo sapiens
agaagaccauugagaaagu

SEQ ID NO: 900552 - RNA, 19 nt, Homo sapiens
gacaagaagaccauugaga

SEQ ID NO: 900553 - RNA, 19 nt, Homo sapiens
cagugaaucaaguuucuua

SEQ ID NO: 900554 - RNA, 19 nt, Homo sapiens
cguguccucucucuacuuu

SEQ ID NO: 900555 - RNA, 19 nt, Homo sapiens
ccauaucgcuacaauacca

SEQ ID NO: 900556 - RNA, 19 nt, Homo sapiens
ucagauauccuuccucagu

SEQ ID NO: 900557 - RNA, 19 nt, Homo sapiens
gaggugguccauaaacauu

SEQ ID NO: 900558 - RNA, 19 nt, Homo sapiens
cagcucacgccaaugaaua

SEQ ID NO: 900559 - RNA, 19 nt, Homo sapiens
gccaauagaggaugauuca

SEQ ID NO: 900560 - RNA, 19 nt, Homo sapiens
ggacaugagagcugauauc

SEQ ID NO: 900561 - RNA, 19 nt, Homo sapiens
gguauagcaucggagacua

SEQ ID NO: 900562 - RNA, 19 nt, Homo sapiens
aauagaggaugauucaaca

SEQ ID NO: 900563 - RNA, 19 nt, Homo sapiens
ucacuaaagcugagucaau

SEQ ID NO: 900564 - RNA, 19 nt, Homo sapiens
ggaaucagggcucaacaca

SEQ ID NO: 900565 - RNA, 19 nt, Homo sapiens
uauauugucucaacauggu

SEQ ID NO: 900566 - RNA, 19 nt, Homo sapiens
gauuguggauuggccugua

SEQ ID NO: 900567 - RNA, 19 nt, Homo sapiens
augguuggcucucuucuuu

SEQ ID NO: 900568 - RNA, 19 nt, Homo sapiens
gaagaccauugagaaaguc

SEQ ID NO: 900569 - RNA, 19 nt, Homo sapiens
gucaggcgcuccagugaau

SEQ ID NO: 900570 - RNA, 19 nt, Homo sapiens
aaacagaggugguccauaa

SEQ ID NO: 900571 - RNA, 19 nt, Homo sapiens
cuaggaaacuggaccauua

SEQ ID NO: 900572 - RNA, 19 nt, Homo sapiens
acaaauagccgaaguguuu

SEQ ID NO: 900573 - RNA, 19 nt, Homo sapiens
caugagagcugauaucugu

SEQ ID NO: 900574 - RNA, 19 nt, Homo sapiens
ggaauugacugacaagaag

SEQ ID NO: 900575 - RNA, 19 nt, Homo sapiens
cauaggauuuggaaacaua

SEQ ID NO: 900576 - RNA, 19 nt, Homo sapiens
gaaaccacuuaaacucuuu

SEQ ID NO: 900577 - RNA, 19 nt, Homo sapiens
ggaaaccacuuaaacucuu

SEQ ID NO: 900578 - RNA, 19 nt, Homo sapiens
ggacgaaauuugcccgauu

SEQ ID NO: 900579 - RNA, 19 nt, Homo sapiens
ucaauuugcuucucuguga

SEQ ID NO: 900580 - RNA, 19 nt, Homo sapiens
ggaaucaaguuucuuacug

SEQ ID NO: 900581 - RNA, 19 nt, Homo sapiens
guggagaggucauuucuga

SEQ ID NO: 900582 - RNA, 19 nt, Homo sapiens
ccauaaacauucaagacua

SEQ ID NO: 900583 - RNA, 19 nt, Homo sapiens
gagcugacgucaugcagaa

SEQ ID NO: 900584 - RNA, 19 nt, Homo sapiens
ggauuggccuguaguuuau

SEQ ID NO: 900585 - RNA, 19 nt, Homo sapiens
acauaaagauucacacuug

SEQ ID NO: 900586 - RNA, 19 nt, Homo sapiens
ucaaggauauuacguuguu

SEQ ID NO: 900587 - RNA, 19 nt, Homo sapiens
gaaacuggaccauuaccua

SEQ ID NO: 900588 - RNA, 19 nt, Homo sapiens
gaagggugauguauuugga

SEQ ID NO: 900589 - RNA, 19 nt, Homo sapiens
caaggaaucucacucuuac

SEQ ID NO: 900590 - RNA, 19 nt, Homo sapiens
gaaauuugcccgauugaca

SEQ ID NO: 900591 - RNA, 19 nt, Homo sapiens
gauauuacguuguucaaac

SEQ ID NO: 900592 - RNA, 19 nt, Homo sapiens
ccacuuugcuauauacaga

SEQ ID NO: 900593 - RNA, 19 nt, Homo sapiens
ucaaggaaucucacucuua

SEQ ID NO: 900594 - RNA, 19 nt, Homo sapiens
gcaggagaguggaaugguu

SEQ ID NO: 900595 - RNA, 19 nt, Homo sapiens
accaugagaugcugaauaa

SEQ ID NO: 900596 - RNA, 19 nt, Homo sapiens
gaaacagauuaaucaggaa

SEQ ID NO: 900597 - RNA, 19 nt, Homo sapiens
agaauaauaugaccugugu

SEQ ID NO: 900598 - RNA, 19 nt, Homo sapiens
aaacaaagcagaacaacau

SEQ ID NO: 900599 - RNA, 19 nt, Homo sapiens
cagauauccuuccucagua

SEQ ID NO: 900600 - RNA, 19 nt, Homo sapiens
gacgaaauuugcccgauug

SEQ ID NO: 900601 - RNA, 19 nt, Homo sapiens
caagaagaccauugagaaa

SEQ ID NO: 900602 - RNA, 19 nt, Homo sapiens
ucaggaaucaaguuucuua

SEQ ID NO: 900603 - RNA, 19 nt, Homo sapiens
ccaugacacuuaaaugaga

SEQ ID NO: 900604 - RNA, 19 nt, Homo sapiens
agggaagggugauguauuu

SEQ ID NO: 900605 - RNA, 19 nt, Homo sapiens
gcugauaucuguguucauc

SEQ ID NO: 900606 - RNA, 19 nt, Homo sapiens
gugagcgagucauggauua

SEQ ID NO: 900607 - RNA, 19 nt, Homo sapiens
cagcaaggauucauuguac

SEQ ID NO: 900608 - RNA, 19 nt, Homo sapiens
cauaaagauucacacuuga

SEQ ID NO: 900609 - RNA, 19 nt, Homo sapiens
ggaaucagcagucucuuca

SEQ ID NO: 900610 - RNA, 19 nt, Homo sapiens
gacaagccuuacaaccaua

SEQ ID NO: 900611 - RNA, 19 nt, Homo sapiens
ugacaagccuuacaaccau

SEQ ID NO: 900612 - RNA, 19 nt, Homo sapiens
gaucugcugucuuguuuac

SEQ ID NO: 900613 - RNA, 19 nt, Homo sapiens
uuuguaaacucucuggaua

SEQ ID NO: 900614 - RNA, 19 nt, Homo sapiens
gagcugauaucuguguuca

SEQ ID NO: 900615 - RNA, 19 nt, Homo sapiens
uggauuggccuguaguuua

SEQ ID NO: 900616 - RNA, 19 nt, Homo sapiens
ugauaucuguguucaucua

SEQ ID NO: 900617 - RNA, 19 nt, Homo sapiens
gguuggcucucuucuuuau

SEQ ID NO: 900618 - RNA, 19 nt, Homo sapiens
cauaaacauucaagacuag

SEQ ID NO: 900619 - RNA, 19 nt, Homo sapiens
ggccuguaguuuauaguaa

SEQ ID NO: 900620 - RNA, 19 nt, Homo sapiens
gguuaagacuguuuggaau

SEQ ID NO: 900621 - RNA, 19 nt, Homo sapiens
caacaaaauccaacacaua

SEQ ID NO: 900622 - RNA, 19 nt, Homo sapiens
acaagaagaccauugagaa

SEQ ID NO: 900623 - RNA, 19 nt, Homo sapiens
gguccuagcucguaaaaug

SEQ ID NO: 900624 - RNA, 19 nt, Homo sapiens
uaauaugaccuguguccua

SEQ ID NO: 900625 - RNA, 19 nt, Homo sapiens
caaaaggcauugauacaga

SEQ ID NO: 900626 - RNA, 19 nt, Homo sapiens
gagcgagucauggauuaua

SEQ ID NO: 900627 - RNA, 19 nt, Homo sapiens
caugagaugcugaauaaug

SEQ ID NO: 900628 - RNA, 19 nt, Homo sapiens
ugaucgaucugcugucuug

SEQ ID NO: 900629 - RNA, 19 nt, Homo sapiens
gggaauugacugacaagaa

SEQ ID NO: 900630 - RNA, 19 nt, Homo sapiens
uaaacucucuggauaucau

SEQ ID NO: 900631 - RNA, 19 nt, Homo sapiens
ugaaacugcugcacgacuu

SEQ ID NO: 900632 - RNA, 19 nt, Homo sapiens
ucaucgagcugacgucaug

SEQ ID NO: 900633 - RNA, 19 nt, Homo sapiens
caggagaguggaaugguua

SEQ ID NO: 900634 - RNA, 19 nt, Homo sapiens
uuaaugaacauccugcuuu

SEQ ID NO: 900635 - RNA, 19 nt, Homo sapiens
gaugaugguuggcucucuu

SEQ ID NO: 900636 - RNA, 19 nt, Homo sapiens
ugaacuaucugaaaacuug

SEQ ID NO: 900637 - RNA, 19 nt, Homo sapiens
gugaccacuuugcuauaua

SEQ ID NO: 900638 - RNA, 19 nt, Homo sapiens
gggaagccuugcucaaagu

SEQ ID NO: 900639 - RNA, 19 nt, Homo sapiens
caaccgauaccaugagaug

SEQ ID NO: 900640 - RNA, 19 nt, Homo sapiens
ggaccauuaccuagaauau

SEQ ID NO: 900641 - RNA, 19 nt, Homo sapiens
ucgaucugcugucuuguuu

SEQ ID NO: 900642 - RNA, 19 nt, Homo sapiens
cagcagcucacgccaauga

SEQ ID NO: 900643 - RNA, 19 nt, Homo sapiens
agaagaccauugagaaagu

SEQ ID NO: 900644 - RNA, 19 nt, Homo sapiens
gacaagaagaccauugaga

SEQ ID NO: 900645 - RNA, 19 nt, Homo sapiens
cguguccucucucuacuuu

SEQ ID NO: 900646 - RNA, 19 nt, Homo sapiens
ccauaucgcuacaauacca

SEQ ID NO: 900647 - RNA, 19 nt, Homo sapiens
ucagauauccuuccucagu

SEQ ID NO: 900648 - RNA, 19 nt, Homo sapiens
gaggugguccauaaacauu

SEQ ID NO: 900649 - RNA, 19 nt, Homo sapiens
cagcucacgccaaugaaua

SEQ ID NO: 900650 - RNA, 19 nt, Homo sapiens
gccaauagaggaugauuca

SEQ ID NO: 900651 - RNA, 19 nt, Homo sapiens
ggaaugguuaagacuguuu

SEQ ID NO: 900652 - RNA, 19 nt, Homo sapiens
gcgggaagccuugcucaaa

SEQ ID NO: 900653 - RNA, 19 nt, Homo sapiens
ggacaugagagcugauauc

SEQ ID NO: 900654 - RNA, 19 nt, Homo sapiens
gguauagcaucggagacua

SEQ ID NO: 900655 - RNA, 19 nt, Homo sapiens
aauagaggaugauucaaca

SEQ ID NO: 900656 - RNA, 19 nt, Homo sapiens
ccauucaucuauccgaguu

SEQ ID NO: 900657 - RNA, 19 nt, Homo sapiens
uauauugucucaacauggu

SEQ ID NO: 900658 - RNA, 19 nt, Homo sapiens
augguuggcucucuucuuu

SEQ ID NO: 900659 - RNA, 19 nt, Homo sapiens
gauuguggauuggccugua

SEQ ID NO: 900660 - RNA, 19 nt, Homo sapiens
ccagcaaggauucauugua

SEQ ID NO: 900661 - RNA, 19 nt, Homo sapiens
ucacuaacaccauccaaau

SEQ ID NO: 900662 - RNA, 19 nt, Homo sapiens
ucagcagucucuucaguuc

SEQ ID NO: 900663 - RNA, 19 nt, Homo sapiens
aaacaagaagcgccaaaga

SEQ ID NO: 900664 - RNA, 19 nt, Homo sapiens
gaagaccauugagaaaguc

SEQ ID NO: 900665 - RNA, 19 nt, Homo sapiens
cagcuggcuuugagcauug

SEQ ID NO: 900666 - RNA, 19 nt, Homo sapiens
ccagcuggcuuugagcauu

SEQ ID NO: 900667 - RNA, 19 nt, Homo sapiens
cuaacaccauccaaauaga

SEQ ID NO: 900668 - RNA, 19 nt, Homo sapiens
ccaaagacgccaccacaca

SEQ ID NO: 900669 - RNA, 19 nt, Homo sapiens
cagaggugguccauaaaca

SEQ ID NO: 900670 - RNA, 19 nt, Homo sapiens
guacuuugcugguuauuua

SEQ ID NO: 900671 - RNA, 19 nt, Homo sapiens
gaagucagauugcuaauau

SEQ ID NO: 900672 - RNA, 19 nt, Homo sapiens
gaaagaagcacaaaucaaa

SEQ ID NO: 900673 - RNA, 19 nt, Homo sapiens
ggagaccgauuuacaauuu

SEQ ID NO: 900674 - RNA, 19 nt, Homo sapiens
ggaagaaccugcauuaagu

SEQ ID NO: 900675 - RNA, 19 nt, Homo sapiens
gagagucggucauaaagua

SEQ ID NO: 900676 - RNA, 19 nt, Homo sapiens
gaauaaaucuccuaagcau

SEQ ID NO: 900677 - RNA, 19 nt, Homo sapiens
caaagaagauauacugaug

SEQ ID NO: 900678 - RNA, 19 nt, Homo sapiens
gaaccagaguuggauguua

SEQ ID NO: 900679 - RNA, 19 nt, Homo sapiens
acacaucuguucuguauuu

SEQ ID NO: 900680 - RNA, 19 nt, Homo sapiens
uaagggagauucuucugua

SEQ ID NO: 900681 - RNA, 19 nt, Homo sapiens
caagaggaauacauaauga

SEQ ID NO: 900682 - RNA, 19 nt, Homo sapiens
gggagauucuucuguauuu

SEQ ID NO: 900683 - RNA, 19 nt, Homo sapiens
gcaaugauguucuagcaau

SEQ ID NO: 900684 - RNA, 19 nt, Homo sapiens
caagaacgcucucccuguu

SEQ ID NO: 900685 - RNA, 19 nt, Homo sapiens
ccaaugcccucaugguuaa

SEQ ID NO: 900686 - RNA, 19 nt, Homo sapiens
cuaaacaucuuugcuauug

SEQ ID NO: 900687 - RNA, 19 nt, Homo sapiens
gaacacgagugauucagau

SEQ ID NO: 900688 - RNA, 19 nt, Homo sapiens
gcugagagaucccagagaa

SEQ ID NO: 900689 - RNA, 19 nt, Homo sapiens
gacagaaccucuuuaucuu

SEQ ID NO: 900690 - RNA, 19 nt, Homo sapiens
auacuuacaugguccaaua

SEQ ID NO: 900691 - RNA, 19 nt, Homo sapiens
aaacaggaauuucucaaug

SEQ ID NO: 900692 - RNA, 19 nt, Homo sapiens
ggaaauugcaguccauuau

SEQ ID NO: 900693 - RNA, 19 nt, Homo sapiens
gaauuuggauaccagaaug

SEQ ID NO: 900694 - RNA, 19 nt, Homo sapiens
gaaaagacuucggaaaauu

SEQ ID NO: 900695 - RNA, 19 nt, Homo sapiens
gacauagacucccuuuaga

SEQ ID NO: 900696 - RNA, 19 nt, Homo sapiens
gaaccugcauuaaguugug

SEQ ID NO: 900697 - RNA, 19 nt, Homo sapiens
ggacacauagccagaguuu

SEQ ID NO: 900698 - RNA, 19 nt, Homo sapiens
ggaaccaucccauaauaaa

SEQ ID NO: 900699 - RNA, 19 nt, Homo sapiens
gaagaagcaguaaagauug

SEQ ID NO: 900700 - RNA, 19 nt, Homo sapiens
gagaccgauuuacaauuua

SEQ ID NO: 900701 - RNA, 19 nt, Homo sapiens
aaacaguugucaucaggua

SEQ ID NO: 900702 - RNA, 19 nt, Homo sapiens
aaagugggcucacaguuga

SEQ ID NO: 900703 - RNA, 19 nt, Homo sapiens
ccagaaauuugcaauggaa

SEQ ID NO: 900704 - RNA, 19 nt, Homo sapiens
ugaggaagcuucagacauc

SEQ ID NO: 900705 - RNA, 19 nt, Homo sapiens
gaugauggauguggcauga

SEQ ID NO: 900706 - RNA, 19 nt, Homo sapiens
ugagaaaacugaagucuaa

SEQ ID NO: 900707 - RNA, 19 nt, Homo sapiens
gaugagaacacgagugauu

SEQ ID NO: 900708 - RNA, 19 nt, Homo sapiens
guagaggaauguaagguau

SEQ ID NO: 900709 - RNA, 19 nt, Homo sapiens
gccacagccucaauuuaua

SEQ ID NO: 900710 - RNA, 19 nt, Homo sapiens
gcgaugacuugaagcauga

SEQ ID NO: 900711 - RNA, 19 nt, Homo sapiens
ucuaaguucuggacacaua

SEQ ID NO: 900712 - RNA, 19 nt, Homo sapiens
gagaaagagaagcaacuua

SEQ ID NO: 900713 - RNA, 19 nt, Homo sapiens
aaaugucacucaagcuuaa

SEQ ID NO: 900714 - RNA, 19 nt, Homo sapiens
gacugacacuuauuuagaa

SEQ ID NO: 900715 - RNA, 19 nt, Homo sapiens
ggagcagacugacacuuau

SEQ ID NO: 900716 - RNA, 19 nt, Homo sapiens
agaagaagcaguaaagauu

SEQ ID NO: 900717 - RNA, 19 nt, Homo sapiens
gugaaggacuacagaauca

SEQ ID NO: 900718 - RNA, 19 nt, Homo sapiens
ugacagaaccucuuuaucu

SEQ ID NO: 900719 - RNA, 19 nt, Homo sapiens
gcagacugacacuuauuua

SEQ ID NO: 900720 - RNA, 19 nt, Homo sapiens
gaaagagaagcaacuuaga

SEQ ID NO: 900721 - RNA, 19 nt, Homo sapiens
ccaagaguauaaucaucua

SEQ ID NO: 900722 - RNA, 19 nt, Homo sapiens
acagagagcuuuggaagau

SEQ ID NO: 900723 - RNA, 19 nt, Homo sapiens
agaaucaccuccucuugaa

SEQ ID NO: 900724 - RNA, 19 nt, Homo sapiens
gaagggugccugaagaaug

SEQ ID NO: 900725 - RNA, 19 nt, Homo sapiens
gaagacaagccauggguau

SEQ ID NO: 900726 - RNA, 19 nt, Homo sapiens
guaauaaccguuugaucaa

SEQ ID NO: 900727 - RNA, 19 nt, Homo sapiens
gaagcacaaaucaaaguaa

SEQ ID NO: 900728 - RNA, 19 nt, Homo sapiens
aggauaagcugaagaaucu

SEQ ID NO: 900729 - RNA, 19 nt, Homo sapiens
gaagaaccugcauuaaguu

SEQ ID NO: 900730 - RNA, 19 nt, Homo sapiens
cacgagugauucagauaua

SEQ ID NO: 900731 - RNA, 19 nt, Homo sapiens
gcaguuugaugugaucuau

SEQ ID NO: 900732 - RNA, 19 nt, Homo sapiens
guggagaaaccuuuaaauu

SEQ ID NO: 900733 - RNA, 19 nt, Homo sapiens
aaccagaguuggauguuaa

SEQ ID NO: 900734 - RNA, 19 nt, Homo sapiens
cagaauugaugcagcaguu

SEQ ID NO: 900735 - RNA, 19 nt, Homo sapiens
aagcacaccugucaaggaa

SEQ ID NO: 900736 - RNA, 19 nt, Homo sapiens
gcagagaauuccaguagcu

SEQ ID NO: 900737 - RNA, 19 nt, Homo sapiens
aagccaagcuggaauguuc

SEQ ID NO: 900738 - RNA, 19 nt, Homo sapiens
cuucagacaucauuuacuu

SEQ ID NO: 900739 - RNA, 19 nt, Homo sapiens
gaguggcaguuguaaaguu

SEQ ID NO: 900740 - RNA, 19 nt, Homo sapiens
aaaggagcauuuaaagaug

SEQ ID NO: 900741 - RNA, 19 nt, Homo sapiens
cauagacucccuuuagaaa

SEQ ID NO: 900742 - RNA, 19 nt, Homo sapiens
gcugugcaaugauguucua

SEQ ID NO: 900743 - RNA, 19 nt, Homo sapiens
aauguaagguauugacuga

SEQ ID NO: 900744 - RNA, 19 nt, Homo sapiens
caaugugaucuuugucuua

SEQ ID NO: 900745 - RNA, 19 nt, Homo sapiens
cuacagacccagaaaguau

SEQ ID NO: 900746 - RNA, 19 nt, Homo sapiens
agacauagacucccuuuag

SEQ ID NO: 900747 - RNA, 19 nt, Homo sapiens
gaaauugcaguccauuauc

SEQ ID NO: 900748 - RNA, 19 nt, Homo sapiens
gauacagaauacuuacaug

SEQ ID NO: 900749 - RNA, 19 nt, Homo sapiens
gcccagagcagaugaacaa

SEQ ID NO: 900750 - RNA, 19 nt, Homo sapiens
guuguaaaguugcuucuuc

SEQ ID NO: 900751 - RNA, 19 nt, Homo sapiens
gguauugacugaagaugag

SEQ ID NO: 900752 - RNA, 19 nt, Homo sapiens
gaauccauauugaaagaag

SEQ ID NO: 900753 - RNA, 19 nt, Homo sapiens
ugacaaagaagauauacug

SEQ ID NO: 900754 - RNA, 19 nt, Homo sapiens
aagaaacgaugaccugugu

SEQ ID NO: 900755 - RNA, 19 nt, Homo sapiens
guauaaaacuggcacuauu

SEQ ID NO: 900756 - RNA, 19 nt, Homo sapiens
gcacaccugucaaggaaac

SEQ ID NO: 900757 - RNA, 19 nt, Homo sapiens
ggagagcucaaccaacuga

SEQ ID NO: 900758 - RNA, 19 nt, Homo sapiens
gcaaugaauuuggauacca

SEQ ID NO: 900759 - RNA, 19 nt, Homo sapiens
gacaccggcaucaauaaua

SEQ ID NO: 900760 - RNA, 19 nt, Homo sapiens
ccagcgagguggucauuca

SEQ ID NO: 900761 - RNA, 19 nt, Homo sapiens
gaggauaagcugaagaauc

SEQ ID NO: 900762 - RNA, 19 nt, Homo sapiens
gaaucucuuucauccuuug

SEQ ID NO: 900763 - RNA, 19 nt, Homo sapiens
uggagaaaccuuuaaauuc

SEQ ID NO: 900764 - RNA, 19 nt, Homo sapiens
guaaaccagugugacagaa

SEQ ID NO: 900765 - RNA, 19 nt, Homo sapiens
cuggagcucuggaggauuu

SEQ ID NO: 900766 - RNA, 19 nt, Homo sapiens
gaaacgaugaccugugugu

SEQ ID NO: 900767 - RNA, 19 nt, Homo sapiens
cagaaucaccuccucuuga

SEQ ID NO: 900768 - RNA, 19 nt, Homo sapiens
uguauucccuaauccaauu

SEQ ID NO: 900769 - RNA, 19 nt, Homo sapiens
ucagauauaauccugguuu

SEQ ID NO: 900770 - RNA, 19 nt, Homo sapiens
gacagaaccuuucagcaua

SEQ ID NO: 900771 - RNA, 19 nt, Homo sapiens
gaagaugaccuaaguguga

SEQ ID NO: 900772 - RNA, 19 nt, Homo sapiens
gagagaagaugaccuaagu

SEQ ID NO: 900773 - RNA, 19 nt, Homo sapiens
ggaguggagugcugucaua

SEQ ID NO: 900774 - RNA, 19 nt, Homo sapiens
cuugagaucugucuucaua

SEQ ID NO: 900775 - RNA, 19 nt, Homo sapiens
ugacagcccucucugacuu

SEQ ID NO: 900776 - RNA, 19 nt, Homo sapiens
uagauaacccacccaauuu

SEQ ID NO: 900777 - RNA, 19 nt, Homo sapiens
cuagauaacccacccaauu

SEQ ID NO: 900778 - RNA, 19 nt, Homo sapiens
aauauaagcucggaguuug

SEQ ID NO: 900779 - RNA, 19 nt, Homo sapiens
caucacggcugcaacugaa

SEQ ID NO: 900780 - RNA, 19 nt, Homo sapiens
acagaaccuuucagcauaa

SEQ ID NO: 900781 - RNA, 19 nt, Homo sapiens
ggacacagcgcaccagaag

SEQ ID NO: 900782 - RNA, 19 nt, Homo sapiens
gcagggauuguguucauuu

SEQ ID NO: 900783 - RNA, 19 nt, Homo sapiens
ucccaagucuauacccuua

SEQ ID NO: 900784 - RNA, 19 nt, Homo sapiens
gacaguacaggcuagauaa

SEQ ID NO: 900785 - RNA, 19 nt, Homo sapiens
gagaagaugaccuaagugu

SEQ ID NO: 900786 - RNA, 19 nt, Homo sapiens
gaaagcagggauuguguuc

SEQ ID NO: 900787 - RNA, 19 nt, Homo sapiens
gaaaggccaagaucaagau

SEQ ID NO: 900788 - RNA, 19 nt, Homo sapiens
ucaggucaguaucuaauau

SEQ ID NO: 900789 - RNA, 19 nt, Homo sapiens
gagcaucagccgaaaggaa

SEQ ID NO: 900790 - RNA, 19 nt, Homo sapiens
ugacugcugcuacaucuaa

SEQ ID NO: 900791 - RNA, 19 nt, Homo sapiens
ggacagugaggacuucuuc

SEQ ID NO: 900792 - RNA, 19 nt, Homo sapiens
uaauauaagcucggaguuu

SEQ ID NO: 900793 - RNA, 19 nt, Homo sapiens
ugacagaaccuuucagcau

SEQ ID NO: 900794 - RNA, 19 nt, Homo sapiens
accagaagcuaaagucuug

SEQ ID NO: 900795 - RNA, 19 nt, Homo sapiens
ggaaagcagggauuguguu

SEQ ID NO: 900796 - RNA, 19 nt, Homo sapiens
ucuacgggcucuacucuau

SEQ ID NO: 900797 - RNA, 19 nt, Homo sapiens
guggagugcugucauaugg

SEQ ID NO: 900798 - RNA, 19 nt, Homo sapiens
gacuuuaccuugagaucug

SEQ ID NO: 900799 - RNA, 19 nt, Homo sapiens
agacaguacaggcuagaua

SEQ ID NO: 900800 - RNA, 19 nt, Homo sapiens
ccucacaucccaagucuau

SEQ ID NO: 900801 - RNA, 19 nt, Homo sapiens
ggagaaaagugagagaaga

SEQ ID NO: 900802 - RNA, 19 nt, Homo sapiens
ucaaauauuuaccgucaac

SEQ ID NO: 900803 - RNA, 19 nt, Homo sapiens
uaugacagcaucaaauuuc

SEQ ID NO: 900804 - RNA, 19 nt, Homo sapiens
ccgccuccauuccuacuaa

SEQ ID NO: 900805 - RNA, 19 nt, Homo sapiens
agucucagcuuccaugcaa

SEQ ID NO: 900806 - RNA, 19 nt, Homo sapiens
cagcauaacgccucacauc

SEQ ID NO: 900807 - RNA, 19 nt, Homo sapiens
gcaaagacuaugacagcau

SEQ ID NO: 900808 - RNA, 19 nt, Homo sapiens
gcaggcagcucuggaaaau

SEQ ID NO: 900809 - RNA, 19 nt, Homo sapiens
gcagcaggcagcucuggaa

SEQ ID NO: 900810 - RNA, 19 nt, Homo sapiens
uacgggcucuacucuauga

SEQ ID NO: 900811 - RNA, 19 nt, Homo sapiens
gggauuguguucauuuuga

SEQ ID NO: 900812 - RNA, 19 nt, Homo sapiens
ucuauacccuuaccugaag

SEQ ID NO: 900813 - RNA, 19 nt, Homo sapiens
gucaguaucuaauauaagc

SEQ ID NO: 900814 - RNA, 19 nt, Homo sapiens
caggucaguaucuaauaua

SEQ ID NO: 900815 - RNA, 19 nt, Homo sapiens
cgaccaaggaggaaggaaa

SEQ ID NO: 900816 - RNA, 19 nt, Homo sapiens
aagcagggauuguguucau

SEQ ID NO: 900817 - RNA, 19 nt, Homo sapiens
ugaaaggccaagaucaaga

SEQ ID NO: 900818 - RNA, 19 nt, Homo sapiens
ugagcgcgcacacguagua

SEQ ID NO: 900819 - RNA, 19 nt, Homo sapiens
caaugccuccugucccuaa

SEQ ID NO: 900820 - RNA, 19 nt, Homo sapiens
ugucaaagccacauucuac

SEQ ID NO: 900821 - RNA, 19 nt, Homo sapiens
gaaccacccagcccagaag

SEQ ID NO: 900822 - RNA, 19 nt, Homo sapiens
ggacauccccugccccauu

SEQ ID NO: 900823 - RNA, 19 nt, Homo sapiens
ccugaaaggccaagaucaa

SEQ ID NO: 900824 - RNA, 19 nt, Homo sapiens
gauucaccuuugacgugua

SEQ ID NO: 900825 - RNA, 19 nt, Homo sapiens
ggaugacacgugccugaug

SEQ ID NO: 900826 - RNA, 19 nt, Homo sapiens
gaaaagugagagaagauga

SEQ ID NO: 900827 - RNA, 19 nt, Homo sapiens
acaauucacaucucuguca

SEQ ID NO: 900828 - RNA, 19 nt, Homo sapiens
ucacaauucacaucucugu

SEQ ID NO: 900829 - RNA, 19 nt, Homo sapiens
caaccgacccacugcaaag

SEQ ID NO: 900830 - RNA, 19 nt, Homo sapiens
acagcccucucugacuuua

SEQ ID NO: 900831 - RNA, 19 nt, Homo sapiens
ucacaucccaagucuauac

SEQ ID NO: 900832 - RNA, 19 nt, Homo sapiens
acuaugacagcaucaaauu

SEQ ID NO: 900833 - RNA, 19 nt, Homo sapiens
uaugaguugugacuuucaa

SEQ ID NO: 900834 - RNA, 19 nt, Homo sapiens
ucaggaaggccacaaagag

SEQ ID NO: 900835 - RNA, 19 nt, Homo sapiens
gaccuuuccgugucuguga

SEQ ID NO: 900836 - RNA, 19 nt, Homo sapiens
gaccaaggaggaaggaaag

SEQ ID NO: 900837 - RNA, 19 nt, Homo sapiens
aggcagcucuggaaaauga

SEQ ID NO: 900838 - RNA, 19 nt, Homo sapiens
acccuuaccugaagaaugc

SEQ ID NO: 900839 - RNA, 19 nt, Homo sapiens
cuaugacagcaucaaauuu

SEQ ID NO: 900840 - RNA, 19 nt, Homo sapiens
gacuaugacagcaucaaau

SEQ ID NO: 900841 - RNA, 19 nt, Homo sapiens
cauauguugcugggaauuu

SEQ ID NO: 900842 - RNA, 19 nt, Homo sapiens
ucuaugaguugugacuuuc

SEQ ID NO: 900843 - RNA, 19 nt, Homo sapiens
cucuaugaguugugacuuu

SEQ ID NO: 900844 - RNA, 19 nt, Homo sapiens
cagcgcaccagaagcuaaa

SEQ ID NO: 900845 - RNA, 19 nt, Homo sapiens
gaguugugacuuucaagga

SEQ ID NO: 900846 - RNA, 19 nt, Homo sapiens
caggaaagcagggauugug

SEQ ID NO: 900847 - RNA, 19 nt, Homo sapiens
guucuuuccuagccaccuu

SEQ ID NO: 900848 - RNA, 19 nt, Homo sapiens
agacuaugacagcaucaaa

SEQ ID NO: 900849 - RNA, 19 nt, Homo sapiens
guagcagaccgacauccuu

SEQ ID NO: 900850 - RNA, 19 nt, Homo sapiens
ccacccagcccagaaguuc

SEQ ID NO: 900851 - RNA, 19 nt, Homo sapiens
caccagaagcuaaagucuu

SEQ ID NO: 900852 - RNA, 19 nt, Homo sapiens
gacagcccucucugacuuu

SEQ ID NO: 900853 - RNA, 19 nt, Homo sapiens
ccaaccgacccacugcaaa

SEQ ID NO: 900854 - RNA, 19 nt, Homo sapiens
uggagacccuacugcugaa

SEQ ID NO: 900855 - RNA, 19 nt, Homo sapiens
agugagagaagaugaccua

SEQ ID NO: 900856 - RNA, 19 nt, Homo sapiens
ggcaaaaggagaaaaguga

SEQ ID NO: 900857 - RNA, 19 nt, Homo sapiens
gcaggaaagcagggauugu

SEQ ID NO: 900858 - RNA, 19 nt, Homo sapiens
ccuuugacguguacaagca

SEQ ID NO: 900859 - RNA, 19 nt, Homo sapiens
uuugaggguuucacuguca

SEQ ID NO: 900860 - RNA, 19 nt, Homo sapiens
caccauggaguaccucuca

SEQ ID NO: 900861 - RNA, 19 nt, Homo sapiens
cagcaggcagcucuggaaa

SEQ ID NO: 900862 - RNA, 19 nt, Homo sapiens
gccgaaaggaagcacgaaa

SEQ ID NO: 900863 - RNA, 19 nt, Homo sapiens
ucugucacguccacuaauc

SEQ ID NO: 900864 - RNA, 19 nt, Homo sapiens
gcaccagaagcuaaagucu

SEQ ID NO: 900865 - RNA, 19 nt, Homo sapiens
ccugacugcugcuacaucu

SEQ ID NO: 900866 - RNA, 19 nt, Homo sapiens
gucuauacccuuaccugaa

SEQ ID NO: 900867 - RNA, 19 nt, Homo sapiens
gccauauguugcugggaau

SEQ ID NO: 900868 - RNA, 19 nt, Homo sapiens
gggccuacaggacacagaa

SEQ ID NO: 900869 - RNA, 19 nt, Homo sapiens
ccacuaaucggcaaaagga

SEQ ID NO: 900870 - RNA, 19 nt, Homo sapiens
gagauaagcugccaacuca

SEQ ID NO: 900871 - RNA, 19 nt, Homo sapiens
gaucuuagccucagaauug

SEQ ID NO: 900872 - RNA, 19 nt, Homo sapiens
ggauauaccuggagccauu

SEQ ID NO: 900873 - RNA, 19 nt, Homo sapiens
agaaggagcugaggaauuu

SEQ ID NO: 900874 - RNA, 19 nt, Homo sapiens
ggacagugaugaagacaga

SEQ ID NO: 900875 - RNA, 19 nt, Homo sapiens
gagcaggucuguuggcauu

SEQ ID NO: 900876 - RNA, 19 nt, Homo sapiens
ggccagaccucuuauauca

SEQ ID NO: 900877 - RNA, 19 nt, Homo sapiens
gaagaaacaucagaacaca

SEQ ID NO: 900878 - RNA, 19 nt, Homo sapiens
ggaagagucuacugaagug

SEQ ID NO: 900879 - RNA, 19 nt, Homo sapiens
gcaacgagagauugaaaua

SEQ ID NO: 900880 - RNA, 19 nt, Homo sapiens
ggucaugucaccauaauaa

SEQ ID NO: 900881 - RNA, 19 nt, Homo sapiens
ggaggcaucugcacaggaa

SEQ ID NO: 900882 - RNA, 19 nt, Homo sapiens
ucagaaauguggaccguuu

SEQ ID NO: 900883 - RNA, 19 nt, Homo sapiens
gcacaccacucuauauguc

SEQ ID NO: 900884 - RNA, 19 nt, Homo sapiens
ugacguugcuacucucuuu

SEQ ID NO: 900885 - RNA, 19 nt, Homo sapiens
gcauaugcuugacagcuuu

SEQ ID NO: 900886 - RNA, 19 nt, Homo sapiens
ugaaaccucugucauggaa

SEQ ID NO: 900887 - RNA, 19 nt, Homo sapiens
ccaaggagcaggucuguug

SEQ ID NO: 900888 - RNA, 19 nt, Homo sapiens
gcagugacguugcuacucu

SEQ ID NO: 900889 - RNA, 19 nt, Homo sapiens
gauccugaauggcaucuug

SEQ ID NO: 900890 - RNA, 19 nt, Homo sapiens
ccacugagccugugccuau

SEQ ID NO: 900891 - RNA, 19 nt, Homo sapiens
gcuaugagcaccaauacaa

SEQ ID NO: 900892 - RNA, 19 nt, Homo sapiens
gcuacucucuuuacccauu

SEQ ID NO: 900893 - RNA, 19 nt, Homo sapiens
ggccauugcugcccaguug

SEQ ID NO: 900894 - RNA, 19 nt, Homo sapiens
guacaagggucgaagaaaa

SEQ ID NO: 900895 - RNA, 19 nt, Homo sapiens
uaaugugccuuuaacucua

SEQ ID NO: 900896 - RNA, 19 nt, Homo sapiens
gagcuaaagagacuagaaa

SEQ ID NO: 900897 - RNA, 19 nt, Homo sapiens
gaaguauccucauguccau

SEQ ID NO: 900898 - RNA, 19 nt, Homo sapiens
gagaggagccagacaagug

SEQ ID NO: 900899 - RNA, 19 nt, Homo sapiens
gagaaggagcugaggaauu

SEQ ID NO: 900900 - RNA, 19 nt, Homo sapiens
gaacaagaaacuagaagag

SEQ ID NO: 900901 - RNA, 19 nt, Homo sapiens
uggaaucccuguuuauguu

SEQ ID NO: 900902 - RNA, 19 nt, Homo sapiens
cuucauggcuugacaguuc

SEQ ID NO: 900903 - RNA, 19 nt, Homo sapiens
gugauucuguugccuugua

SEQ ID NO: 900904 - RNA, 19 nt, Homo sapiens
ggagggugcuucccacauc

SEQ ID NO: 900905 - RNA, 19 nt, Homo sapiens
ccaauaaugugccuuuaac

SEQ ID NO: 900906 - RNA, 19 nt, Homo sapiens
gcugagagcuaaagagacu

SEQ ID NO: 900907 - RNA, 19 nt, Homo sapiens
ccaccucucucaaccaguu

SEQ ID NO: 900908 - RNA, 19 nt, Homo sapiens
acaagaaacuagaagagau

SEQ ID NO: 900909 - RNA, 19 nt, Homo sapiens
ggacagccuuaugugcuuu

SEQ ID NO: 900910 - RNA, 19 nt, Homo sapiens
gagggcagauccugaaugg

SEQ ID NO: 900911 - RNA, 19 nt, Homo sapiens
caagaaacuagaagagauu

SEQ ID NO: 900912 - RNA, 19 nt, Homo sapiens
aaaccugccuuguggaaug

SEQ ID NO: 900913 - RNA, 19 nt, Homo sapiens
gcaggucuguuggcauuug

SEQ ID NO: 900914 - RNA, 19 nt, Homo sapiens
gcaucaagcucugugacuu

SEQ ID NO: 900915 - RNA, 19 nt, Homo sapiens
guauguguguguguguuua

SEQ ID NO: 900916 - RNA, 19 nt, Homo sapiens
ucagggauauguccaguuc

SEQ ID NO: 900917 - RNA, 19 nt, Homo sapiens
caacgagagauugaaauaa

SEQ ID NO: 900918 - RNA, 19 nt, Homo sapiens
ccucucaccuugcugugua

SEQ ID NO: 900919 - RNA, 19 nt, Homo sapiens
uaaucagucucgcaucuug

SEQ ID NO: 900920 - RNA, 19 nt, Homo sapiens
caaaggcacaccacucuau

SEQ ID NO: 900921 - RNA, 19 nt, Homo sapiens
ugccagcucuuucuuauuc

SEQ ID NO: 900922 - RNA, 19 nt, Homo sapiens
gguaaucagucucgcaucu

SEQ ID NO: 900923 - RNA, 19 nt, Homo sapiens
ucuguuggcugcauacuau

SEQ ID NO: 900924 - RNA, 19 nt, Homo sapiens
caacugagaacaagaaacu

SEQ ID NO: 900925 - RNA, 19 nt, Homo sapiens
gaacugucccuggaucuau

SEQ ID NO: 900926 - RNA, 19 nt, Homo sapiens
gguccagccuccaacuuug

SEQ ID NO: 900927 - RNA, 19 nt, Homo sapiens
gaaacuauccuugcucucu

SEQ ID NO: 900928 - RNA, 19 nt, Homo sapiens
gcagcagccugucuauugg

SEQ ID NO: 900929 - RNA, 19 nt, Homo sapiens
gaagcuaggcagugacguu

SEQ ID NO: 900930 - RNA, 19 nt, Homo sapiens
gaaucccuguuuauguuga

SEQ ID NO: 900931 - RNA, 19 nt, Homo sapiens
ucaggaggcugccaaccuu

SEQ ID NO: 900932 - RNA, 19 nt, Homo sapiens
caccaguucuagcgaguaa

SEQ ID NO: 900933 - RNA, 19 nt, Homo sapiens
caucagcucugggcaacuu

SEQ ID NO: 900934 - RNA, 19 nt, Homo sapiens
ggauauguccaguucagaa

SEQ ID NO: 900935 - RNA, 19 nt, Homo sapiens
caugucgucucucuuguga

SEQ ID NO: 900936 - RNA, 19 nt, Homo sapiens
cagcagcaaucuugguaug

SEQ ID NO: 900937 - RNA, 19 nt, Homo sapiens
gcucugugacuuuggauuu

SEQ ID NO: 900938 - RNA, 19 nt, Homo sapiens
gauaugaagccucagaaca

SEQ ID NO: 900939 - RNA, 19 nt, Homo sapiens
gagagcagagugaggauau

SEQ ID NO: 900940 - RNA, 19 nt, Homo sapiens
ccacuuguccuuuauccaa

SEQ ID NO: 900941 - RNA, 19 nt, Homo sapiens
cuagaaccaucgucucguu

SEQ ID NO: 900942 - RNA, 19 nt, Homo sapiens
gauauguccaguucagaaa

SEQ ID NO: 900943 - RNA, 19 nt, Homo sapiens
agggagagcucuuucagau

SEQ ID NO: 900944 - RNA, 19 nt, Homo sapiens
gaauuugcaacgagagauu

SEQ ID NO: 900945 - RNA, 19 nt, Homo sapiens
caucagucccuguuauuga

SEQ ID NO: 900946 - RNA, 19 nt, Homo sapiens
gaaccaucgucucguuucu

SEQ ID NO: 900947 - RNA, 19 nt, Homo sapiens
gggacagccuuaugugcuu

SEQ ID NO: 900948 - RNA, 19 nt, Homo sapiens
gagcgccuuuguccucuga

SEQ ID NO: 900949 - RNA, 19 nt, Homo sapiens
gagcagcugggcuaaauca

SEQ ID NO: 900950 - RNA, 19 nt, Homo sapiens
ugucagcccuguacuaucu

SEQ ID NO: 900951 - RNA, 19 nt, Homo sapiens
gauuaucccuuagccaaca

SEQ ID NO: 900952 - RNA, 19 nt, Homo sapiens
guugccagcucuuucuuau

SEQ ID NO: 900953 - RNA, 19 nt, Homo sapiens
cagcugcagugcccaguau

SEQ ID NO: 900954 - RNA, 19 nt, Homo sapiens
gcggugcagugccagcuuu

SEQ ID NO: 900955 - RNA, 19 nt, Homo sapiens
cccagccacuuguccuuua

SEQ ID NO: 900956 - RNA, 19 nt, Homo sapiens
gcuaccaucuuccguugau

SEQ ID NO: 900957 - RNA, 19 nt, Homo sapiens
caacugaaggcuccucuca

SEQ ID NO: 900958 - RNA, 19 nt, Homo sapiens
gaagagcagcugggcuaaa

SEQ ID NO: 900959 - RNA, 19 nt, Homo sapiens
ucuacuuucuuccuucuaa

SEQ ID NO: 900960 - RNA, 19 nt, Homo sapiens
gccaaacacugcaggaaac

SEQ ID NO: 900961 - RNA, 19 nt, Homo sapiens
uggagaagcuaggcaguga

SEQ ID NO: 900962 - RNA, 19 nt, Homo sapiens
gggaagagucuacugaagu

SEQ ID NO: 900963 - RNA, 19 nt, Homo sapiens
gccuuggaaucccuguuua

SEQ ID NO: 900964 - RNA, 19 nt, Homo sapiens
gaacuucagguccuaaagg

SEQ ID NO: 900965 - RNA, 19 nt, Homo sapiens
gugcugacauccaucaaag

SEQ ID NO: 900966 - RNA, 19 nt, Homo sapiens
caucaagcucugugacuuu

SEQ ID NO: 900967 - RNA, 19 nt, Homo sapiens
gcucuuucuuauucuacua

SEQ ID NO: 900968 - RNA, 19 nt, Homo sapiens
caguugcccuccugaguga

SEQ ID NO: 900969 - RNA, 19 nt, Homo sapiens
aagagcagcugggcuaaau

SEQ ID NO: 900970 - RNA, 19 nt, Homo sapiens
gcaaacacccugaggagaa

SEQ ID NO: 900971 - RNA, 19 nt, Homo sapiens
gcgcugagguguacaugaa

SEQ ID NO: 900972 - RNA, 19 nt, Homo sapiens
caacaagucuuuugaaguu

SEQ ID NO: 900973 - RNA, 19 nt, Homo sapiens
gagagaggcuccacugaca

SEQ ID NO: 900974 - RNA, 19 nt, Homo sapiens
aaacauggauuuggcauug

SEQ ID NO: 900975 - RNA, 19 nt, Homo sapiens
gggaugaccuggcuucugu

SEQ ID NO: 900976 - RNA, 19 nt, Homo sapiens
gccaagcgcuucugaaagu

SEQ ID NO: 900977 - RNA, 19 nt, Homo sapiens
gaauacacguuacugaucu

SEQ ID NO: 900978 - RNA, 19 nt, Homo sapiens
gagcugacaccaaaggaua

SEQ ID NO: 900979 - RNA, 19 nt, Homo sapiens
gcacaggcucgcagcuuua

SEQ ID NO: 900980 - RNA, 19 nt, Homo sapiens
aggcagagcugacaccaaa

SEQ ID NO: 900981 - RNA, 19 nt, Homo sapiens
caacaucagugacccaucu

SEQ ID NO: 900982 - RNA, 19 nt, Homo sapiens
cgagugcucuucuacuuug

SEQ ID NO: 900983 - RNA, 19 nt, Homo sapiens
ggacgucccugagcacuuc

SEQ ID NO: 900984 - RNA, 19 nt, Homo sapiens
gaggaggguuuauggaugu

SEQ ID NO: 900985 - RNA, 19 nt, Homo sapiens
ggacacagcaggcaugauc

SEQ ID NO: 900986 - RNA, 19 nt, Homo sapiens
acaugucccugcaacuuua

SEQ ID NO: 900987 - RNA, 19 nt, Homo sapiens
ggauaaagggacaaucaaa

SEQ ID NO: 900988 - RNA, 19 nt, Homo sapiens
agaaaacucugguaaauga

SEQ ID NO: 900989 - RNA, 19 nt, Homo sapiens
ggaagauuaugauguuucu

SEQ ID NO: 900990 - RNA, 19 nt, Homo sapiens
caugcagggucuuccaaua

SEQ ID NO: 900991 - RNA, 19 nt, Homo sapiens
gcugugcccugacuaccua

SEQ ID NO: 900992 - RNA, 19 nt, Homo sapiens
gcccugagguggagagaga

SEQ ID NO: 900993 - RNA, 19 nt, Homo sapiens
gggugacgguccagauuaa

SEQ ID NO: 900994 - RNA, 19 nt, Homo sapiens
ugaucuuacucacauguua

SEQ ID NO: 900995 - RNA, 19 nt, Homo sapiens
aaugaucacuccaggauau

SEQ ID NO: 900996 - RNA, 19 nt, Homo sapiens
gauugcagcucccucuguu

SEQ ID NO: 900997 - RNA, 19 nt, Homo sapiens
guccagagccauccaauga

SEQ ID NO: 900998 - RNA, 19 nt, Homo sapiens
gggaugaauucagaacauu

SEQ ID NO: 900999 - RNA, 19 nt, Homo sapiens
gcuggugccuuaacgauca

SEQ ID NO: 901000 - RNA, 19 nt, Homo sapiens
uuacugaucuuacucacau

SEQ ID NO: 901001 - RNA, 19 nt, Homo sapiens
aguuugagcuucugauuga

SEQ ID NO: 901002 - RNA, 19 nt, Homo sapiens
gaucuuacucacauguuaa

SEQ ID NO: 901003 - RNA, 19 nt, Homo sapiens
gaugggagguccagcaaac

SEQ ID NO: 901004 - RNA, 19 nt, Homo sapiens
ccaagggcauccaguuugu

SEQ ID NO: 901005 - RNA, 19 nt, Homo sapiens
ggugguugcucuccuggaa

SEQ ID NO: 901006 - RNA, 19 nt, Homo sapiens
caacgucuuugucuugaag

SEQ ID NO: 901007 - RNA, 19 nt, Homo sapiens
gaacuggaagauuaugaug

SEQ ID NO: 901008 - RNA, 19 nt, Homo sapiens
gccgagugcucuucuacuu

SEQ ID NO: 901009 - RNA, 19 nt, Homo sapiens
gagaggcuccacugacaaa

SEQ ID NO: 901010 - RNA, 19 nt, Homo sapiens
gggccaagcgcuucugaaa

SEQ ID NO: 901011 - RNA, 19 nt, Homo sapiens
gaacaugauccacuuugca

SEQ ID NO: 901012 - RNA, 19 nt, Homo sapiens
caaacacccugaggagaau

SEQ ID NO: 901013 - RNA, 19 nt, Homo sapiens
uaaaugaucacuccaggau

SEQ ID NO: 901014 - RNA, 19 nt, Homo sapiens
ccaccaaccuggacuacca

SEQ ID NO: 901015 - RNA, 19 nt, Homo sapiens
ugauguuucugauuccuuu

SEQ ID NO: 901016 - RNA, 19 nt, Homo sapiens
gcacaggaccaaccagaag

SEQ ID NO: 901017 - RNA, 19 nt, Homo sapiens
agagagagaccaccgacua

SEQ ID NO: 901018 - RNA, 19 nt, Homo sapiens
aguaugaguuccaguaugu

SEQ ID NO: 901019 - RNA, 19 nt, Homo sapiens
gaaacauggauuuggcauu

SEQ ID NO: 901020 - RNA, 19 nt, Homo sapiens
ggguuugccuucaccgaaa

SEQ ID NO: 901021 - RNA, 19 nt, Homo sapiens
acuggaagauuaugauguu

SEQ ID NO: 901022 - RNA, 19 nt, Homo sapiens
ccaaggugauggcacugaa

SEQ ID NO: 901023 - RNA, 19 nt, Homo sapiens
caccaaaggauaacaucua

SEQ ID NO: 901024 - RNA, 19 nt, Homo sapiens
aauaugccaucuuguccua

SEQ ID NO: 901025 - RNA, 19 nt, Homo sapiens
ccagagccauccaaugagu

SEQ ID NO: 901026 - RNA, 19 nt, Homo sapiens
gcaaacgccaugugaccaa

SEQ ID NO: 901027 - RNA, 19 nt, Homo sapiens
gcaacuuuacccuguacua

SEQ ID NO: 901028 - RNA, 19 nt, Homo sapiens
ggcugaauaugccaucuug

SEQ ID NO: 901029 - RNA, 19 nt, Homo sapiens
ucacagccuuuguccugaa

SEQ ID NO: 901030 - RNA, 19 nt, Homo sapiens
ccagagguccaguucauug

SEQ ID NO: 901031 - RNA, 19 nt, Homo sapiens
caccagagguccaguucau

SEQ ID NO: 901032 - RNA, 19 nt, Homo sapiens
acaaguaugaguuccagua

SEQ ID NO: 901033 - RNA, 19 nt, Homo sapiens
aaacgggacugguggugau

SEQ ID NO: 901034 - RNA, 19 nt, Homo sapiens
agauugaugucaccuacaa

SEQ ID NO: 901035 - RNA, 19 nt, Homo sapiens
cacuggagccugucaaauu

SEQ ID NO: 901036 - RNA, 19 nt, Homo sapiens
gcagaacaugauccacuuu

SEQ ID NO: 901037 - RNA, 19 nt, Homo sapiens
cagcaggcaugaucgagau

SEQ ID NO: 901038 - RNA, 19 nt, Homo sapiens
ugacguauucagcaaauga

SEQ ID NO: 901039 - RNA, 19 nt, Homo sapiens
ggaagguggagcuauccua

SEQ ID NO: 901040 - RNA, 19 nt, Homo sapiens
gaucacuccaggauauuga

SEQ ID NO: 901041 - RNA, 19 nt, Homo sapiens
gugguuaacaucucagaaa

SEQ ID NO: 901042 - RNA, 19 nt, Homo sapiens
gauaaagggacaaucaaac

SEQ ID NO: 901043 - RNA, 19 nt, Homo sapiens
guccaccucucagggcuua

SEQ ID NO: 901044 - RNA, 19 nt, Homo sapiens
ggaugaagagguaugaagu

SEQ ID NO: 901045 - RNA, 19 nt, Homo sapiens
ccagaacagagaagagaaa

SEQ ID NO: 901046 - RNA, 19 nt, Homo sapiens
caccaaggacucuggguuu

SEQ ID NO: 901047 - RNA, 19 nt, Homo sapiens
ucagugacguauucagcaa

SEQ ID NO: 901048 - RNA, 19 nt, Homo sapiens
gccgacagccuucaguuug

SEQ ID NO: 901049 - RNA, 19 nt, Homo sapiens
ccacaugucccugcaacuu

SEQ ID NO: 901050 - RNA, 19 nt, Homo sapiens
caaguuugagcuucugauu

SEQ ID NO: 901051 - RNA, 19 nt, Homo sapiens
gaugaagagguaugaagug

SEQ ID NO: 901052 - RNA, 19 nt, Homo sapiens
ccuacgcccuucugaccua

SEQ ID NO: 901053 - RNA, 19 nt, Homo sapiens
ggaacuggaagauuaugau

SEQ ID NO: 901054 - RNA, 19 nt, Homo sapiens
ugugugaccucucuucauc

SEQ ID NO: 901055 - RNA, 19 nt, Homo sapiens
caucuacaccagugaaguu

SEQ ID NO: 901056 - RNA, 19 nt, Homo sapiens
cgaauacacguuacugauc

SEQ ID NO: 901057 - RNA, 19 nt, Homo sapiens
aaacucugguaaaugauca

SEQ ID NO: 901058 - RNA, 19 nt, Homo sapiens
gcagggucuuccaauaugg

SEQ ID NO: 901059 - RNA, 19 nt, Homo sapiens
cgcacaggcucgcagcuuu

SEQ ID NO: 901060 - RNA, 19 nt, Homo sapiens
cucaguaccugcccagcua

SEQ ID NO: 901061 - RNA, 19 nt, Homo sapiens
cuacaccagugaaguugug

SEQ ID NO: 901062 - RNA, 19 nt, Homo sapiens
uaacaucuacaccagugaa

SEQ ID NO: 901063 - RNA, 19 nt, Homo sapiens
gaaguucagaaguaugugu

SEQ ID NO: 901064 - RNA, 19 nt, Homo sapiens
uccaggauauugacacgaa

SEQ ID NO: 901065 - RNA, 19 nt, Homo sapiens
caaguaugaguuccaguau

SEQ ID NO: 901066 - RNA, 19 nt, Homo sapiens
acuggagccugucaaauuc

SEQ ID NO: 901067 - RNA, 19 nt, Homo sapiens
gagcagcgggaaccuggaa

SEQ ID NO: 901068 - RNA, 19 nt, Homo sapiens
ugacaaagcgaggcacuuc

SEQ ID NO: 901069 - RNA, 19 nt, Homo sapiens
guggagagcagaacaugau

SEQ ID NO: 901070 - RNA, 19 nt, Homo sapiens
agaaggagcucuacaagaa

SEQ ID NO: 901071 - RNA, 19 nt, Homo sapiens
caaggucccugucacauuu

SEQ ID NO: 901072 - RNA, 19 nt, Homo sapiens
gauaugaggccaguaugua

SEQ ID NO: 901073 - RNA, 19 nt, Homo sapiens
gacgagggcucagaaaguu

SEQ ID NO: 901074 - RNA, 19 nt, Homo sapiens
gaugggaucgugauuaaga

SEQ ID NO: 901075 - RNA, 19 nt, Homo sapiens
gaagaucaaccucaucauc

SEQ ID NO: 901076 - RNA, 19 nt, Homo sapiens
ggagauaugaggccaguau

SEQ ID NO: 901077 - RNA, 19 nt, Homo sapiens
cggcagcaauggagaaguu

SEQ ID NO: 901078 - RNA, 19 nt, Homo sapiens
gcccuaagcccuacaagug

SEQ ID NO: 901079 - RNA, 19 nt, Homo sapiens
ggacuaugcaauuuccaaa

SEQ ID NO: 901080 - RNA, 19 nt, Homo sapiens
auacugugguucuauuuga

SEQ ID NO: 901081 - RNA, 19 nt, Homo sapiens
ggaacaagacgaggaggaa

SEQ ID NO: 901082 - RNA, 19 nt, Homo sapiens
gcuguuaauuuccuugaca

SEQ ID NO: 901083 - RNA, 19 nt, Homo sapiens
ggaaggcuccagcgaguuc

SEQ ID NO: 901084 - RNA, 19 nt, Homo sapiens
aaccagaccucaugucaca

SEQ ID NO: 901085 - RNA, 19 nt, Homo sapiens
caaaccagaccucauguca

SEQ ID NO: 901086 - RNA, 19 nt, Homo sapiens
caacuacgagucccugguu

SEQ ID NO: 901087 - RNA, 19 nt, Homo sapiens
gaucaagacagaggaacaa

SEQ ID NO: 901088 - RNA, 19 nt, Homo sapiens
caacgacgagggcucagaa

SEQ ID NO: 901089 - RNA, 19 nt, Homo sapiens
ugauuaagaucgagguaca

SEQ ID NO: 901090 - RNA, 19 nt, Homo sapiens
gcagaaggagcucuacaag

SEQ ID NO: 901091 - RNA, 19 nt, Homo sapiens
ccaaggucccugucacauu

SEQ ID NO: 901092 - RNA, 19 nt, Homo sapiens
ggauacugugguucuauuu

SEQ ID NO: 901093 - RNA, 19 nt, Homo sapiens
gauacugugguucuauuug

SEQ ID NO: 901094 - RNA, 19 nt, Homo sapiens
uggauacugugguucuauu

SEQ ID NO: 901095 - RNA, 19 nt, Homo sapiens
guguagggcccaucuaguu

SEQ ID NO: 901096 - RNA, 19 nt, Homo sapiens
gcaagagcuuccgccugaa

SEQ ID NO: 901097 - RNA, 19 nt, Homo sapiens
cgacgagggcucagaaagu

SEQ ID NO: 901098 - RNA, 19 nt, Homo sapiens
cagaaggagcucuacaaga

SEQ ID NO: 901099 - RNA, 19 nt, Homo sapiens
uccauggacuaugcaauuu

SEQ ID NO: 901100 - RNA, 19 nt, Homo sapiens
ggcagaaggagcucuacaa

SEQ ID NO: 901101 - RNA, 19 nt, Homo sapiens
aagaggaggaggaggauga

SEQ ID NO: 901102 - RNA, 19 nt, Homo sapiens
caagacagaggaacaagac

SEQ ID NO: 901103 - RNA, 19 nt, Homo sapiens
gucccuugcugccgcguuu

SEQ ID NO: 901104 - RNA, 19 nt, Homo sapiens
agaggcggcuggagaacau

SEQ ID NO: 901105 - RNA, 19 nt, Homo sapiens
gcagcuguccgggagauau

SEQ ID NO: 901106 - RNA, 19 nt, Homo sapiens
cgagggcucagaaaguuug

SEQ ID NO: 901107 - RNA, 19 nt, Homo sapiens
ccagaccucaugucacaga

SEQ ID NO: 901108 - RNA, 19 nt, Homo sapiens
gaacccuuucgggcuguua

SEQ ID NO: 901109 - RNA, 19 nt, Homo sapiens
caagccgcgucccaaguca

SEQ ID NO: 901110 - RNA, 19 nt, Homo sapiens
gaaggagcucuacaagaac

SEQ ID NO: 901111 - RNA, 19 nt, Homo sapiens
ucaagacagaggaacaaga

SEQ ID NO: 901112 - RNA, 19 nt, Homo sapiens
ugauguugcugugcacuuc

SEQ ID NO: 901113 - RNA, 19 nt, Homo sapiens
gagauaugaggccaguaug

SEQ ID NO: 901114 - RNA, 19 nt, Homo sapiens
ccuuucgggcuguuaauuu

SEQ ID NO: 901115 - RNA, 19 nt, Homo sapiens
cugugguucuauuugauaa

SEQ ID NO: 901116 - RNA, 19 nt, Homo sapiens
cuuucgggcuguuaauuuc

SEQ ID NO: 901117 - RNA, 19 nt, Homo sapiens
aguccagccugaccaaaca

SEQ ID NO: 901118 - RNA, 19 nt, Homo sapiens
cugaagaucaaccucauca

SEQ ID NO: 901119 - RNA, 19 nt, Homo sapiens
gccugaagaucaaccucau

SEQ ID NO: 901120 - RNA, 19 nt, Homo sapiens
uuccauggacuaugcaauu

SEQ ID NO: 901121 - RNA, 19 nt, Homo sapiens
ggaaaggccucuguaguug

SEQ ID NO: 901122 - RNA, 19 nt, Homo sapiens
ccauggagguggagacuua

SEQ ID NO: 901123 - RNA, 19 nt, Homo sapiens
gaauaaaugugcuaagucu

SEQ ID NO: 901124 - RNA, 19 nt, Homo sapiens
ucaaguggccgaagccuua

SEQ ID NO: 901125 - RNA, 19 nt, Homo sapiens
agaaacaggugugucauuu

SEQ ID NO: 901126 - RNA, 19 nt, Homo sapiens
gcaagaaacagguguguca

SEQ ID NO: 901127 - RNA, 19 nt, Homo sapiens
ccuuggagcuucccauuaa

SEQ ID NO: 901128 - RNA, 19 nt, Homo sapiens
uggagaaccugaaagcuuu

SEQ ID NO: 901129 - RNA, 19 nt, Homo sapiens
cugcagagcuucauuugga

SEQ ID NO: 901130 - RNA, 19 nt, Homo sapiens
gcagauacgccuuucuaga

SEQ ID NO: 901131 - RNA, 19 nt, Homo sapiens
gaugucgccuggcaacuga

SEQ ID NO: 901132 - RNA, 19 nt, Homo sapiens
gggcagauacgccuuucua

SEQ ID NO: 901133 - RNA, 19 nt, Homo sapiens
ugaaagcuuugcugaagga

SEQ ID NO: 901134 - RNA, 19 nt, Homo sapiens
gugaauaaaugugcuaagu

SEQ ID NO: 901135 - RNA, 19 nt, Homo sapiens
agacgcacgugcccacuuu

SEQ ID NO: 901136 - RNA, 19 nt, Homo sapiens
caagagaucaucagcaaag

SEQ ID NO: 901137 - RNA, 19 nt, Homo sapiens
cuacaaggccaugaacaua

SEQ ID NO: 901138 - RNA, 19 nt, Homo sapiens
aggaggagcugcagucaga

SEQ ID NO: 901139 - RNA, 19 nt, Homo sapiens
cccaagagaucaucagcaa

SEQ ID NO: 901140 - RNA, 19 nt, Homo sapiens
uggagcaugugaagucuaa

SEQ ID NO: 901141 - RNA, 19 nt, Homo sapiens
gagcuucccauuaacauca

SEQ ID NO: 901142 - RNA, 19 nt, Homo sapiens
uggaaaggccucuguaguu

SEQ ID NO: 901143 - RNA, 19 nt, Homo sapiens
ggagucgccuggcaacgau

SEQ ID NO: 901144 - RNA, 19 nt, Homo sapiens
gcuccuuaaugucagcaua

SEQ ID NO: 901145 - RNA, 19 nt, Homo sapiens
ccugaaagcuuugcugaag

SEQ ID NO: 901146 - RNA, 19 nt, Homo sapiens
gcugaaggauagcaacagu

SEQ ID NO: 901147 - RNA, 19 nt, Homo sapiens
ccuggcaacugaauagguu

SEQ ID NO: 901148 - RNA, 19 nt, Homo sapiens
aaacaggugugucauuuug

SEQ ID NO: 901149 - RNA, 19 nt, Homo sapiens
ugaaggauagcaacaguau

SEQ ID NO: 901150 - RNA, 19 nt, Homo sapiens
aagcuuugcugaaggauag

SEQ ID NO: 901151 - RNA, 19 nt, Homo sapiens
gccauagcgugggcagaua

SEQ ID NO: 901152 - RNA, 19 nt, Homo sapiens
caucaaugccacccagauu

SEQ ID NO: 901153 - RNA, 19 nt, Homo sapiens
ugugcuaagucucuuuaaa

SEQ ID NO: 901154 - RNA, 19 nt, Homo sapiens
gcagagcuucauuuggaaa

SEQ ID NO: 901155 - RNA, 19 nt, Homo sapiens
cccgugcgcuccuuaaugu

SEQ ID NO: 901156 - RNA, 19 nt, Homo sapiens
cagauacgccuuucuagag

SEQ ID NO: 901157 - RNA, 19 nt, Homo sapiens
ggccuugugugaccucaug

SEQ ID NO: 901158 - RNA, 19 nt, Homo sapiens
uaaaugugcuaagucucuu

SEQ ID NO: 901159 - RNA, 19 nt, Homo sapiens
gauguucgccacagugauc

SEQ ID NO: 901160 - RNA, 19 nt, Homo sapiens
uguccuuccugcugaauga

SEQ ID NO: 901161 - RNA, 19 nt, Homo sapiens
ggagguggagacuuacgaa

SEQ ID NO: 901162 - RNA, 19 nt, Homo sapiens
cagcaaaggucugauuucc

SEQ ID NO: 901163 - RNA, 19 nt, Homo sapiens
aggaggaguuccaggaguu

SEQ ID NO: 901164 - RNA, 19 nt, Homo sapiens
gaaggaggagcugcaguca

SEQ ID NO: 901165 - RNA, 19 nt, Homo sapiens
gaaacaggugugucauuuu

SEQ ID NO: 901166 - RNA, 19 nt, Homo sapiens
ccaugaacauaggcuguau

SEQ ID NO: 901167 - RNA, 19 nt, Homo sapiens
gcccuucauucaccucugu

SEQ ID NO: 901168 - RNA, 19 nt, Homo sapiens
ccaucagugucaucgaguu

SEQ ID NO: 901169 - RNA, 19 nt, Homo sapiens
gaaagacccaguggagcau

SEQ ID NO: 901170 - RNA, 19 nt, Homo sapiens
gagguggagacuuacgaaa

SEQ ID NO: 901171 - RNA, 19 nt, Homo sapiens
aagaaacaggugugucauu

SEQ ID NO: 901172 - RNA, 19 nt, Homo sapiens
cugauuuccucacugguau

SEQ ID NO: 901173 - RNA, 19 nt, Homo sapiens
gaaggauagcaacaguaug

SEQ ID NO: 901174 - RNA, 19 nt, Homo sapiens
gccaugaacauaggcugua

SEQ ID NO: 901175 - RNA, 19 nt, Homo sapiens
acaaggccaugaacauagg

SEQ ID NO: 901176 - RNA, 19 nt, Homo sapiens
gugcuaagucucuuuaaaa

SEQ ID NO: 901177 - RNA, 19 nt, Homo sapiens
ugaauaaaugugcuaaguc

SEQ ID NO: 901178 - RNA, 19 nt, Homo sapiens
ucagugucaucgaguucaa

SEQ ID NO: 901179 - RNA, 19 nt, Homo sapiens
cggaggcagugagugguuu

SEQ ID NO: 901180 - RNA, 19 nt, Homo sapiens
ucugauuuccucacuggua

SEQ ID NO: 901181 - RNA, 19 nt, Homo sapiens
aaggauagcaacaguaugg

SEQ ID NO: 901182 - RNA, 19 nt, Homo sapiens
ggagaaccugaaagcuuug

SEQ ID NO: 901183 - RNA, 19 nt, Homo sapiens
aaugugcuaagucucuuua

SEQ ID NO: 901184 - RNA, 19 nt, Homo sapiens
ccagauuaccacugccuau

SEQ ID NO: 901185 - RNA, 19 nt, Homo sapiens
gguggagacuuacgaaaag

SEQ ID NO: 901186 - RNA, 19 nt, Homo sapiens
ucacugaagggaaguaugc

SEQ ID NO: 901187 - RNA, 19 nt, Homo sapiens
ccaagagaucaucagcaaa

SEQ ID NO: 901188 - RNA, 19 nt, Homo sapiens
ggaaccuguacaaggcaua

SEQ ID NO: 901189 - RNA, 19 nt, Homo sapiens
aucaaugccacccagauua

SEQ ID NO: 901190 - RNA, 19 nt, Homo sapiens
acccugagcccuucauuca

SEQ ID NO: 901191 - RNA, 19 nt, Homo sapiens
ugguccaucugcugaaaga

SEQ ID NO: 901192 - RNA, 19 nt, Homo sapiens
gcccgugcgcuccuuaaug

SEQ ID NO: 901193 - RNA, 19 nt, Homo sapiens
gaucacugaagggaaguau

SEQ ID NO: 901194 - RNA, 19 nt, Homo sapiens
caguggagcaugugaaguc

SEQ ID NO: 901195 - RNA, 19 nt, Homo sapiens
ccugguccaucugcugaaa

SEQ ID NO: 901196 - RNA, 19 nt, Homo sapiens
uacaaggccaugaacauag

SEQ ID NO: 901197 - RNA, 19 nt, Homo sapiens
gggagaagcugcuggaguu

SEQ ID NO: 901198 - RNA, 19 nt, Homo sapiens
aggaggagcucuuugaaua

SEQ ID NO: 901199 - RNA, 19 nt, Homo sapiens
gaacaggagcagaaaguau

SEQ ID NO: 901200 - RNA, 19 nt, Homo sapiens
caacucggcugcccauguc

SEQ ID NO: 901201 - RNA, 19 nt, Homo sapiens
gaacuucuggagguuuaua

SEQ ID NO: 901202 - RNA, 19 nt, Homo sapiens
gauugaguuugacaucuug

SEQ ID NO: 901203 - RNA, 19 nt, Homo sapiens
ggaacaggagcagaaagua

SEQ ID NO: 901204 - RNA, 19 nt, Homo sapiens
gagaagcgggacugucuga

SEQ ID NO: 901205 - RNA, 19 nt, Homo sapiens
gaacuccuggccugucuau

SEQ ID NO: 901206 - RNA, 19 nt, Homo sapiens
ugauugaguuugacaucuu

SEQ ID NO: 901207 - RNA, 19 nt, Homo sapiens
gguggccucugggugguua

SEQ ID NO: 901208 - RNA, 19 nt, Homo sapiens
aacaggagcagaaaguaua

SEQ ID NO: 901209 - RNA, 19 nt, Homo sapiens
gaggagcucuuugaauacu

SEQ ID NO: 901210 - RNA, 19 nt, Homo sapiens
gauauuuguuugugcaacu

SEQ ID NO: 901211 - RNA, 19 nt, Homo sapiens
ccuccucgcugcugacuca

SEQ ID NO: 901212 - RNA, 19 nt, Homo sapiens
gugauguggugcugauuca

SEQ ID NO: 901213 - RNA, 19 nt, Homo sapiens
gggaacaggagcagaaagu

SEQ ID NO: 901214 - RNA, 19 nt, Homo sapiens
gccaggaggagcucuuuga

SEQ ID NO: 901215 - RNA, 19 nt, Homo sapiens
ggcaucagcagcccaguga

SEQ ID NO: 901216 - RNA, 19 nt, Homo sapiens
cggaagcccugauguccau

SEQ ID NO: 901217 - RNA, 19 nt, Homo sapiens
ccaggacguucggcugauu

SEQ ID NO: 901218 - RNA, 19 nt, Homo sapiens
ucaacuucguggccaagaa

SEQ ID NO: 901219 - RNA, 19 nt, Homo sapiens
ugagaugccaguuccuuga

SEQ ID NO: 901220 - RNA, 19 nt, Homo sapiens
cagcagcacauuccaguca

SEQ ID NO: 901221 - RNA, 19 nt, Homo sapiens
uggcauagggcacccauga

SEQ ID NO: 901222 - RNA, 19 nt, Homo sapiens
cugacaacaugaagaacuu

SEQ ID NO: 901223 - RNA, 19 nt, Homo sapiens
ggaggagcucuuugaauac

SEQ ID NO: 901224 - RNA, 19 nt, Homo sapiens
uagcacccaugaucuccaa

SEQ ID NO: 901225 - RNA, 19 nt, Homo sapiens
caaguucacccugcuguuc

SEQ ID NO: 901226 - RNA, 19 nt, Homo sapiens
ccucauacgccaaguucaa

SEQ ID NO: 901227 - RNA, 19 nt, Homo sapiens
ggaggugcucugugacuuc

SEQ ID NO: 901228 - RNA, 19 nt, Homo sapiens
ccgccagggugcauacuuc

SEQ ID NO: 901229 - RNA, 19 nt, Homo sapiens
gagcuggggucgcuugugu

SEQ ID NO: 901230 - RNA, 19 nt, Homo sapiens
guuccagacucgccucaag

SEQ ID NO: 901231 - RNA, 19 nt, Homo sapiens
gcagauccucguggcugua

SEQ ID NO: 901232 - RNA, 19 nt, Homo sapiens
ccaggaggagcucuuugaa

SEQ ID NO: 901233 - RNA, 19 nt, Homo sapiens
gagaagcugcuggaguuca

SEQ ID NO: 901234 - RNA, 19 nt, Homo sapiens
gggacugucugacccucau

SEQ ID NO: 901235 - RNA, 19 nt, Homo sapiens
uccuggaggugcucuguga

SEQ ID NO: 901236 - RNA, 19 nt, Homo sapiens
ccaacucggcugcccaugu

SEQ ID NO: 901237 - RNA, 19 nt, Homo sapiens
agguuuauauuccggaaga

SEQ ID NO: 901238 - RNA, 19 nt, Homo sapiens
caggaggagcucuuugaau

SEQ ID NO: 901239 - RNA, 19 nt, Homo sapiens
ggugauguggugcugauuc

SEQ ID NO: 901240 - RNA, 19 nt, Homo sapiens
gcagcacauuccagucacu

SEQ ID NO: 901241 - RNA, 19 nt, Homo sapiens
ggagcagaaaguauaugug

SEQ ID NO: 901242 - RNA, 19 nt, Homo sapiens
agacuggaaacuucuuguu

SEQ ID NO: 901243 - RNA, 19 nt, Homo sapiens
gacguucggcugauugagu

SEQ ID NO: 901244 - RNA, 19 nt, Homo sapiens
gucaagagcuucgauauua

SEQ ID NO: 901245 - RNA, 19 nt, Homo sapiens
ggaagugccuuaugccuau

SEQ ID NO: 901246 - RNA, 19 nt, Homo sapiens
uaccuaaaguccugcaaua

SEQ ID NO: 901247 - RNA, 19 nt, Homo sapiens
ucaagagcuucgauauuaa

SEQ ID NO: 901248 - RNA, 19 nt, Homo sapiens
caauguggauuaugucaug

SEQ ID NO: 901249 - RNA, 19 nt, Homo sapiens
uggauuaugucaugaacua

SEQ ID NO: 901250 - RNA, 19 nt, Homo sapiens
ggacaagcaucucuucacu

SEQ ID NO: 901251 - RNA, 19 nt, Homo sapiens
ggaaaugcgugaagcuuuu

SEQ ID NO: 901252 - RNA, 19 nt, Homo sapiens
ucaccucagucaucaaauu

SEQ ID NO: 901253 - RNA, 19 nt, Homo sapiens
ccauugaucuggaugacuu

SEQ ID NO: 901254 - RNA, 19 nt, Homo sapiens
acaagcaucucuucacugu

SEQ ID NO: 901255 - RNA, 19 nt, Homo sapiens
ugacuucacuggcacuuuc

SEQ ID NO: 901256 - RNA, 19 nt, Homo sapiens
ucaaauuccugcgccagua

SEQ ID NO: 901257 - RNA, 19 nt, Homo sapiens
gaucuguaccuuccugaaa

SEQ ID NO: 901258 - RNA, 19 nt, Homo sapiens
ccuaaaguccugcaauaaa

SEQ ID NO: 901259 - RNA, 19 nt, Homo sapiens
cagcaacgccuaccucaau

SEQ ID NO: 901260 - RNA, 19 nt, Homo sapiens
cacaguaccuggacuacau

SEQ ID NO: 901261 - RNA, 19 nt, Homo sapiens
ggcuuaagcacaacaaauu

SEQ ID NO: 901262 - RNA, 19 nt, Homo sapiens
gagaaccgccagacuuuca

SEQ ID NO: 901263 - RNA, 19 nt, Homo sapiens
cuaaaguccugcaauaaaa

SEQ ID NO: 901264 - RNA, 19 nt, Homo sapiens
gggaggcaguggauucugu

SEQ ID NO: 901265 - RNA, 19 nt, Homo sapiens
gcuuaagcacaacaaauuu

SEQ ID NO: 901266 - RNA, 19 nt, Homo sapiens
cucaauggcuuaagcacaa

SEQ ID NO: 901267 - RNA, 19 nt, Homo sapiens
gggcuacacuggagagaac

SEQ ID NO: 901268 - RNA, 19 nt, Homo sapiens
gcugcuggcaucuccaaua

SEQ ID NO: 901269 - RNA, 19 nt, Homo sapiens
ggugaauccuccauagucu

SEQ ID NO: 901270 - RNA, 19 nt, Homo sapiens
gguggugaauccuccauag

SEQ ID NO: 901271 - RNA, 19 nt, Homo sapiens
ucacugccaugguuucuac

SEQ ID NO: 901272 - RNA, 19 nt, Homo sapiens
caucaccucagucaucaaa

SEQ ID NO: 901273 - RNA, 19 nt, Homo sapiens
cugcuggcaucuccaauau

SEQ ID NO: 901274 - RNA, 19 nt, Homo sapiens
cgucaagagcuucgauauu

SEQ ID NO: 901275 - RNA, 19 nt, Homo sapiens
agucugggaucugggcuua

SEQ ID NO: 901276 - RNA, 19 nt, Homo sapiens
ugaauggagucacguacca

SEQ ID NO: 901277 - RNA, 19 nt, Homo sapiens
gcuggcaucuccaauaucc

SEQ ID NO: 901278 - RNA, 19 nt, Homo sapiens
uugacgggcuggacuuuga

SEQ ID NO: 901279 - RNA, 19 nt, Homo sapiens
gaagcucaucguuggauuc

SEQ ID NO: 901280 - RNA, 19 nt, Homo sapiens
ucacguaccagcagaacug

SEQ ID NO: 901281 - RNA, 19 nt, Homo sapiens
caagagcuucgauauuaag

SEQ ID NO: 901282 - RNA, 19 nt, Homo sapiens
caaauuccugcgccaguau

SEQ ID NO: 901283 - RNA, 19 nt, Homo sapiens
cugagaaccgccagacuuu

SEQ ID NO: 901284 - RNA, 19 nt, Homo sapiens
cuaccucaauguggauuau

SEQ ID NO: 901285 - RNA, 19 nt, Homo sapiens
gagaagcucaucguuggau

SEQ ID NO: 901286 - RNA, 19 nt, Homo sapiens
ccugagaaccgccagacuu

SEQ ID NO: 901287 - RNA, 19 nt, Homo sapiens
aaacucuccuggccauugg

SEQ ID NO: 901288 - RNA, 19 nt, Homo sapiens
gaacuacuggaaggacaau

SEQ ID NO: 901289 - RNA, 19 nt, Homo sapiens
uggauucccuaccuaugga

SEQ ID NO: 901290 - RNA, 19 nt, Homo sapiens
caacgccuaccucaaugug

SEQ ID NO: 901291 - RNA, 19 nt, Homo sapiens
gcagcaacgccuaccucaa

SEQ ID NO: 901292 - RNA, 19 nt, Homo sapiens
uauauucccuagaguucca

SEQ ID NO: 901293 - RNA, 19 nt, Homo sapiens
ucacuggcacuuucugcaa

SEQ ID NO: 901294 - RNA, 19 nt, Homo sapiens
ggucugggccauugaucug

SEQ ID NO: 901295 - RNA, 19 nt, Homo sapiens
gaagugccuuaugccuauc

SEQ ID NO: 901296 - RNA, 19 nt, Homo sapiens
ggaucugggcuuacuacga

SEQ ID NO: 901297 - RNA, 19 nt, Homo sapiens
agacuuucaucaccucagu

SEQ ID NO: 901298 - RNA, 19 nt, Homo sapiens
agaagcucaucguuggauu

SEQ ID NO: 901299 - RNA, 19 nt, Homo sapiens
gcaacgccuaccucaaugu

SEQ ID NO: 901300 - RNA, 19 nt, Homo sapiens
gcaggaggccaagcagauc

SEQ ID NO: 901301 - RNA, 19 nt, Homo sapiens
aggaaaugcgugaagcuuu

SEQ ID NO: 901302 - RNA, 19 nt, Homo sapiens
cuuaagcacaacaaauuug

SEQ ID NO: 901303 - RNA, 19 nt, Homo sapiens
cguggcaaauaacagaaau

SEQ ID NO: 901304 - RNA, 19 nt, Homo sapiens
gaaccgccagacuuucauc

SEQ ID NO: 901305 - RNA, 19 nt, Homo sapiens
ggacuuugacugggaguac

SEQ ID NO: 901306 - RNA, 19 nt, Homo sapiens
uaaucuccacccugaagaa

SEQ ID NO: 901307 - RNA, 19 nt, Homo sapiens
gcaaagcccuugagaaguc

SEQ ID NO: 901308 - RNA, 19 nt, Homo sapiens
ggacaugcgucuaauagug

SEQ ID NO: 901309 - RNA, 19 nt, Homo sapiens
gcccagaccucuaagaaga

SEQ ID NO: 901310 - RNA, 19 nt, Homo sapiens
ggaaagaacgaugggcaaa

SEQ ID NO: 901311 - RNA, 19 nt, Homo sapiens
agagcgagacuccaucuua

SEQ ID NO: 901312 - RNA, 19 nt, Homo sapiens
ccaguguguugauuacauu

SEQ ID NO: 901313 - RNA, 19 nt, Homo sapiens
agaaagcccagaccucuaa

SEQ ID NO: 901314 - RNA, 19 nt, Homo sapiens
gaaaccccgucucuacuaa

SEQ ID NO: 901315 - RNA, 19 nt, Homo sapiens
gacaugcgucuaauaguga

SEQ ID NO: 901316 - RNA, 19 nt, Homo sapiens
uaagccaguguguugauua

SEQ ID NO: 901317 - RNA, 19 nt, Homo sapiens
gcuuauaacagguaguuug

SEQ ID NO: 901318 - RNA, 19 nt, Homo sapiens
gaaagaacgaugggcaaag

SEQ ID NO: 901319 - RNA, 19 nt, Homo sapiens
ugauuacauugccaccuuu

SEQ ID NO: 901320 - RNA, 19 nt, Homo sapiens
gccaguguguugauuacau

SEQ ID NO: 901321 - RNA, 19 nt, Homo sapiens
aaaauaagccaguguguug

SEQ ID NO: 901322 - RNA, 19 nt, Homo sapiens
cgacagagcgagacuccau

SEQ ID NO: 901323 - RNA, 19 nt, Homo sapiens
gcacgcccaaggagaagaa

SEQ ID NO: 901324 - RNA, 19 nt, Homo sapiens
gcaggaaguguaaaaugua

SEQ ID NO: 901325 - RNA, 19 nt, Homo sapiens
ccuguaaucccagcacuuu

SEQ ID NO: 901326 - RNA, 19 nt, Homo sapiens
gggcuuauaacagguaguu

SEQ ID NO: 901327 - RNA, 19 nt, Homo sapiens
uugauuacauugccaccuu

SEQ ID NO: 901328 - RNA, 19 nt, Homo sapiens
ggcggcagcgcaacaacua

SEQ ID NO: 901329 - RNA, 19 nt, Homo sapiens
aaagaacgaugggcaaagc

SEQ ID NO: 901330 - RNA, 19 nt, Homo sapiens
caacuagaaccgugagaac

SEQ ID NO: 901331 - RNA, 19 nt, Homo sapiens
ugaggugcaggaaguguaa

SEQ ID NO: 901332 - RNA, 19 nt, Homo sapiens
gauccgcugcgacaacgaa

SEQ ID NO: 901333 - RNA, 19 nt, Homo sapiens
uugcugaggugcaggaagu

SEQ ID NO: 901334 - RNA, 19 nt, Homo sapiens
aagcgcaagugguacuguu

SEQ ID NO: 901335 - RNA, 19 nt, Homo sapiens
cgucuaauagugaggagaa

SEQ ID NO: 901336 - RNA, 19 nt, Homo sapiens
ucucaaccauaaaccaaag

SEQ ID NO: 901337 - RNA, 19 nt, Homo sapiens
gagaccauccuggcuaaca

SEQ ID NO: 901338 - RNA, 19 nt, Homo sapiens
gaacaaaauaagccagugu

SEQ ID NO: 901339 - RNA, 19 nt, Homo sapiens
cuaauagugaggagaacaa

SEQ ID NO: 901340 - RNA, 19 nt, Homo sapiens
ccagaccucuaagaagaag

SEQ ID NO: 901341 - RNA, 19 nt, Homo sapiens
gugagaacgcguccagcaa

SEQ ID NO: 901342 - RNA, 19 nt, Homo sapiens
aagcccagaccucuaagaa

SEQ ID NO: 901343 - RNA, 19 nt, Homo sapiens
auaagccaguguguugauu

SEQ ID NO: 901344 - RNA, 19 nt, Homo sapiens
aagaaagcccagaccucua

SEQ ID NO: 901345 - RNA, 19 nt, Homo sapiens
guacuuugcuugacauguu

SEQ ID NO: 901346 - RNA, 19 nt, Homo sapiens
aaucagaccucaaccauga

SEQ ID NO: 901347 - RNA, 19 nt, Homo sapiens
gcacggaaguccaucugaa

SEQ ID NO: 901348 - RNA, 19 nt, Homo sapiens
ggaaauaugguuugcuaaa

SEQ ID NO: 901349 - RNA, 19 nt, Homo sapiens
gcaggacaaagauguauua

SEQ ID NO: 901350 - RNA, 19 nt, Homo sapiens
ggagaacaaucaaauuaca

SEQ ID NO: 901351 - RNA, 19 nt, Homo sapiens
caaacuagcugugaaucuu

SEQ ID NO: 901352 - RNA, 19 nt, Homo sapiens
gaagagauuagcaaauuga

SEQ ID NO: 901353 - RNA, 19 nt, Homo sapiens
gcagacaagugccauuuua

SEQ ID NO: 901354 - RNA, 19 nt, Homo sapiens
gcacgacuguggacacgaa

SEQ ID NO: 901355 - RNA, 19 nt, Homo sapiens
gaacugcagaccuguauga

SEQ ID NO: 901356 - RNA, 19 nt, Homo sapiens
caucagauuuguccuauag

SEQ ID NO: 901357 - RNA, 19 nt, Homo sapiens
ggaaaaugaugcugaauau

SEQ ID NO: 901358 - RNA, 19 nt, Homo sapiens
ggcaggagaucauacaaga

SEQ ID NO: 901359 - RNA, 19 nt, Homo sapiens
ggugauaaauacaguacaa

SEQ ID NO: 901360 - RNA, 19 nt, Homo sapiens
uaggaaauaugguuugcua

SEQ ID NO: 901361 - RNA, 19 nt, Homo sapiens
gcacgguggcccaguauuu

SEQ ID NO: 901362 - RNA, 19 nt, Homo sapiens
gaaguaccgugucugcaau

SEQ ID NO: 901363 - RNA, 19 nt, Homo sapiens
gaaauuaaaggucuaaagg

SEQ ID NO: 901364 - RNA, 19 nt, Homo sapiens
gcaagaagagauuagcaaa

SEQ ID NO: 901365 - RNA, 19 nt, Homo sapiens
gagaccagcuacacucaga

SEQ ID NO: 901366 - RNA, 19 nt, Homo sapiens
ggaagaagcccuccauugc

SEQ ID NO: 901367 - RNA, 19 nt, Homo sapiens
gcaaggaucgcaucuucaa

SEQ ID NO: 901368 - RNA, 19 nt, Homo sapiens
cugcagaccuguaugagaa

SEQ ID NO: 901369 - RNA, 19 nt, Homo sapiens
cgggagaacaaucaaauua

SEQ ID NO: 901370 - RNA, 19 nt, Homo sapiens
ccaccgaguucgacuucua

SEQ ID NO: 901371 - RNA, 19 nt, Homo sapiens
ggaaguaccgugucugcaa

SEQ ID NO: 901372 - RNA, 19 nt, Homo sapiens
uaaucgaguuuguuuguga

SEQ ID NO: 901373 - RNA, 19 nt, Homo sapiens
gggaagaagcccuccauug

SEQ ID NO: 901374 - RNA, 19 nt, Homo sapiens
ggaaaucguggaacacaug

SEQ ID NO: 901375 - RNA, 19 nt, Homo sapiens
cuauaggacugugacauuu

SEQ ID NO: 901376 - RNA, 19 nt, Homo sapiens
ccaguaaucgaguuuguuu

SEQ ID NO: 901377 - RNA, 19 nt, Homo sapiens
ggucuguggugauaaauac

SEQ ID NO: 901378 - RNA, 19 nt, Homo sapiens
gauguugucacuaaaguug

SEQ ID NO: 901379 - RNA, 19 nt, Homo sapiens
uuuaaagccuugaacauuc

SEQ ID NO: 901380 - RNA, 19 nt, Homo sapiens
ucuaugaacucagggcuuu

SEQ ID NO: 901381 - RNA, 19 nt, Homo sapiens
ccaaggcgguccagguuca

SEQ ID NO: 901382 - RNA, 19 nt, Homo sapiens
uaccgugucugcaauguga

SEQ ID NO: 901383 - RNA, 19 nt, Homo sapiens
cgaguuuguuugugaaguu

SEQ ID NO: 901384 - RNA, 19 nt, Homo sapiens
ccagagagguuggcagaca

SEQ ID NO: 901385 - RNA, 19 nt, Homo sapiens
auucugauguugucacuaa

SEQ ID NO: 901386 - RNA, 19 nt, Homo sapiens
gaacgagcggguugggaaa

SEQ ID NO: 901387 - RNA, 19 nt, Homo sapiens
ggaaucauggucaaagaug

SEQ ID NO: 901388 - RNA, 19 nt, Homo sapiens
auacgggucuguggugaua

SEQ ID NO: 901389 - RNA, 19 nt, Homo sapiens
ucacuaaaguugauuucca

SEQ ID NO: 901390 - RNA, 19 nt, Homo sapiens
gaacaugacagugcugaag

SEQ ID NO: 901391 - RNA, 19 nt, Homo sapiens
ucaaagaugagaugacaga

SEQ ID NO: 901392 - RNA, 19 nt, Homo sapiens
gaugcgaagugcaaguuuc

SEQ ID NO: 901393 - RNA, 19 nt, Homo sapiens
agaagagauuagcaaauug

SEQ ID NO: 901394 - RNA, 19 nt, Homo sapiens
ggaggucuguaacauugug

SEQ ID NO: 901395 - RNA, 19 nt, Homo sapiens
uauaggacugugacauuua

SEQ ID NO: 901396 - RNA, 19 nt, Homo sapiens
caagcaggccuucgcacua

SEQ ID NO: 901397 - RNA, 19 nt, Homo sapiens
gugcaaguuucaacacaga

SEQ ID NO: 901398 - RNA, 19 nt, Homo sapiens
cuggaggucuguaacauug

SEQ ID NO: 901399 - RNA, 19 nt, Homo sapiens
gcagaaacacaccuaccuu

SEQ ID NO: 901400 - RNA, 19 nt, Homo sapiens
caggaagaaucuauacaca

SEQ ID NO: 901401 - RNA, 19 nt, Homo sapiens
gaaauggacauccccaaaa

SEQ ID NO: 901402 - RNA, 19 nt, Homo sapiens
gaguuuguuugugaaguuu

SEQ ID NO: 901403 - RNA, 19 nt, Homo sapiens
guuacacgaugcacuuuca

SEQ ID NO: 901404 - RNA, 19 nt, Homo sapiens
cagccagcaucgaacauga

SEQ ID NO: 901405 - RNA, 19 nt, Homo sapiens
caagaagagauuagcaaau

SEQ ID NO: 901406 - RNA, 19 nt, Homo sapiens
gugggcagaugaagaggaa

SEQ ID NO: 901407 - RNA, 19 nt, Homo sapiens
gacaagugccauuuuaaua

SEQ ID NO: 901408 - RNA, 19 nt, Homo sapiens
gaugagcugcagauccuaa

SEQ ID NO: 901409 - RNA, 19 nt, Homo sapiens
uaacagggaaaucguggaa

SEQ ID NO: 901410 - RNA, 19 nt, Homo sapiens
cgucccagauuucaaacuu

SEQ ID NO: 901411 - RNA, 19 nt, Homo sapiens
uaaccuaccagcuguguca

SEQ ID NO: 901412 - RNA, 19 nt, Homo sapiens
ggacaggagcagaaacaca

SEQ ID NO: 901413 - RNA, 19 nt, Homo sapiens
ggucuaaagguggagauaa

SEQ ID NO: 901414 - RNA, 19 nt, Homo sapiens
aggcaaggaucgcaucuuc

SEQ ID NO: 901415 - RNA, 19 nt, Homo sapiens
ccaaugucauaggaaauau

SEQ ID NO: 901416 - RNA, 19 nt, Homo sapiens
aagcaggccuucgcacuau

SEQ ID NO: 901417 - RNA, 19 nt, Homo sapiens
ucaaggacaggcacaaguu

SEQ ID NO: 901418 - RNA, 19 nt, Homo sapiens
acagggaaaucguggaaca

SEQ ID NO: 901419 - RNA, 19 nt, Homo sapiens
ccuauaggacugugacauu

SEQ ID NO: 901420 - RNA, 19 nt, Homo sapiens
cagagagguuggcagacaa

SEQ ID NO: 901421 - RNA, 19 nt, Homo sapiens
gaacccaaugucauaggaa

SEQ ID NO: 901422 - RNA, 19 nt, Homo sapiens
ccagcagcccgucaucuuu

SEQ ID NO: 901423 - RNA, 19 nt, Homo sapiens
cagccgugcuucugcaaau

SEQ ID NO: 901424 - RNA, 19 nt, Homo sapiens
gaucggcaagaagagauua

SEQ ID NO: 901425 - RNA, 19 nt, Homo sapiens
cuucaagccuccaccuaga

SEQ ID NO: 901426 - RNA, 19 nt, Homo sapiens
gcugaauauugauguguca

SEQ ID NO: 901427 - RNA, 19 nt, Homo sapiens
ccacccgcaucaucuucua

SEQ ID NO: 901428 - RNA, 19 nt, Homo sapiens
gcgagcuccucauccaguu

SEQ ID NO: 901429 - RNA, 19 nt, Homo sapiens
uauaucugguuugcaguaa

SEQ ID NO: 901430 - RNA, 19 nt, Homo sapiens
auaggacugugacauuuau

SEQ ID NO: 901431 - RNA, 19 nt, Homo sapiens
ggauaaggaacaugacagu

SEQ ID NO: 901432 - RNA, 19 nt, Homo sapiens
aaucguuucuccucugaug

SEQ ID NO: 901433 - RNA, 19 nt, Homo sapiens
acaaucguuucuccucuga

SEQ ID NO: 901434 - RNA, 19 nt, Homo sapiens
guaaucgaguuuguuugug

SEQ ID NO: 901435 - RNA, 19 nt, Homo sapiens
uuacaaggcacagccagua

SEQ ID NO: 901436 - RNA, 19 nt, Homo sapiens
cacaugguccagcacuuua

SEQ ID NO: 901437 - RNA, 19 nt, Homo sapiens
cccaaugucauaggaaaua

SEQ ID NO: 901438 - RNA, 19 nt, Homo sapiens
ccauguacuuugcuugaca

SEQ ID NO: 901439 - RNA, 19 nt, Homo sapiens
uuaaagccuugaacauucu

SEQ ID NO: 901440 - RNA, 19 nt, Homo sapiens
gugaaucuucugagaguga

SEQ ID NO: 901441 - RNA, 19 nt, Homo sapiens
gcucaaacuagcugugaau

SEQ ID NO: 901442 - RNA, 19 nt, Homo sapiens
aaaccagucuaugaacuca

SEQ ID NO: 901443 - RNA, 19 nt, Homo sapiens
acacucagaccaacagaug

SEQ ID NO: 901444 - RNA, 19 nt, Homo sapiens
gcaggaagaaucuauacac

SEQ ID NO: 901445 - RNA, 19 nt, Homo sapiens
gaaguucucugaaauguuc

SEQ ID NO: 901446 - RNA, 19 nt, Homo sapiens
ugaaagagcugccuucuca

SEQ ID NO: 901447 - RNA, 19 nt, Homo sapiens
gcaaguaccugucaguaau

SEQ ID NO: 901448 - RNA, 19 nt, Homo sapiens
cgagaacucugcaaucuuu

SEQ ID NO: 901449 - RNA, 19 nt, Homo sapiens
ggaacgaguuacagacaaa

SEQ ID NO: 901450 - RNA, 19 nt, Homo sapiens
ggacaaagcgagcucagaa

SEQ ID NO: 901451 - RNA, 19 nt, Homo sapiens
agacaaacaucaccguaaa

SEQ ID NO: 901452 - RNA, 19 nt, Homo sapiens
gaaguucuguugggaaaga

SEQ ID NO: 901453 - RNA, 19 nt, Homo sapiens
ccaaugcuguguaucauga

SEQ ID NO: 901454 - RNA, 19 nt, Homo sapiens
gccgagagguggucuugua

SEQ ID NO: 901455 - RNA, 19 nt, Homo sapiens
ugaauuaguuagacacuug

SEQ ID NO: 901456 - RNA, 19 nt, Homo sapiens
gguaucaacuagccaguga

SEQ ID NO: 901457 - RNA, 19 nt, Homo sapiens
gcccugaaguucucugaaa

SEQ ID NO: 901458 - RNA, 19 nt, Homo sapiens
agagcugccuucucaguua

SEQ ID NO: 901459 - RNA, 19 nt, Homo sapiens
ggagauugguaucaacuag

SEQ ID NO: 901460 - RNA, 19 nt, Homo sapiens
ggacgacgcugagcugaag

SEQ ID NO: 901461 - RNA, 19 nt, Homo sapiens
gcggguaacagacaauaua

SEQ ID NO: 901462 - RNA, 19 nt, Homo sapiens
gacacuaucuucgucugua

SEQ ID NO: 901463 - RNA, 19 nt, Homo sapiens
cagugaaacucauuugaug

SEQ ID NO: 901464 - RNA, 19 nt, Homo sapiens
ccaagccacuccuguccua

SEQ ID NO: 901465 - RNA, 19 nt, Homo sapiens
gaaaugcugcgccgaguuc

SEQ ID NO: 901466 - RNA, 19 nt, Homo sapiens
gugaaguucuguugggaaa

SEQ ID NO: 901467 - RNA, 19 nt, Homo sapiens
caucaggccuccgaccuuu

SEQ ID NO: 901468 - RNA, 19 nt, Homo sapiens
cagcuacgaugacgacaug

SEQ ID NO: 901469 - RNA, 19 nt, Homo sapiens
gcuccacuauggguaauuu

SEQ ID NO: 901470 - RNA, 19 nt, Homo sapiens
uggagaacaucgacaagaa

SEQ ID NO: 901471 - RNA, 19 nt, Homo sapiens
aaacgaagcuuuuguacug

SEQ ID NO: 901472 - RNA, 19 nt, Homo sapiens
gcugcuauguggacaguug

SEQ ID NO: 901473 - RNA, 19 nt, Homo sapiens
caaguaccugucaguaaua

SEQ ID NO: 901474 - RNA, 19 nt, Homo sapiens
gauaacaaggagauuggua

SEQ ID NO: 901475 - RNA, 19 nt, Homo sapiens
cuaacgggcucgccaugaa

SEQ ID NO: 901476 - RNA, 19 nt, Homo sapiens
gaccauguccacuuccuuu

SEQ ID NO: 901477 - RNA, 19 nt, Homo sapiens
gagcugccuucucaguuau

SEQ ID NO: 901478 - RNA, 19 nt, Homo sapiens
gcauggcgcucccuucaac

SEQ ID NO: 901479 - RNA, 19 nt, Homo sapiens
acaaggagauugguaucaa

SEQ ID NO: 901480 - RNA, 19 nt, Homo sapiens
gcgccgaguucuucaagug

SEQ ID NO: 901481 - RNA, 19 nt, Homo sapiens
gagaacaucgacaagaaga

SEQ ID NO: 901482 - RNA, 19 nt, Homo sapiens
guuaagauaaugcggguaa

SEQ ID NO: 901483 - RNA, 19 nt, Homo sapiens
caggaaaucccgcucaaga

SEQ ID NO: 901484 - RNA, 19 nt, Homo sapiens
gcaguucaaggcccaguuu

SEQ ID NO: 901485 - RNA, 19 nt, Homo sapiens
gggaacgaguuacagacaa

SEQ ID NO: 901486 - RNA, 19 nt, Homo sapiens
gcaagagcgcguuggaaau

SEQ ID NO: 901487 - RNA, 19 nt, Homo sapiens
gcucagaccauguccacuu

SEQ ID NO: 901488 - RNA, 19 nt, Homo sapiens
cauuacacuuucacccaua

SEQ ID NO: 901489 - RNA, 19 nt, Homo sapiens
cgagggugcuccacuaugg

SEQ ID NO: 901490 - RNA, 19 nt, Homo sapiens
caccguaaaugacucacaa

SEQ ID NO: 901491 - RNA, 19 nt, Homo sapiens
caaacaucaccguaaauga

SEQ ID NO: 901492 - RNA, 19 nt, Homo sapiens
cagcaagccugacuguucu

SEQ ID NO: 901493 - RNA, 19 nt, Homo sapiens
gaacgucgaccccaguuuu

SEQ ID NO: 901494 - RNA, 19 nt, Homo sapiens
gagaaccagaugaagauga

SEQ ID NO: 901495 - RNA, 19 nt, Homo sapiens
ccacuuccuuucuccugaa

SEQ ID NO: 901496 - RNA, 19 nt, Homo sapiens
ccacuauggguaauuuaaa

SEQ ID NO: 901497 - RNA, 19 nt, Homo sapiens
cagacaaacaucaccguaa

SEQ ID NO: 901498 - RNA, 19 nt, Homo sapiens
ggacaguuguuuucuagug

SEQ ID NO: 901499 - RNA, 19 nt, Homo sapiens
gaaaaccgccuuaggaaca

SEQ ID NO: 901500 - RNA, 19 nt, Homo sapiens
gaggauaacaaggagauug

SEQ ID NO: 901501 - RNA, 19 nt, Homo sapiens
caagagcgcguuggaaauc

SEQ ID NO: 901502 - RNA, 19 nt, Homo sapiens
cugcuagacucgaugcaaa

SEQ ID NO: 901503 - RNA, 19 nt, Homo sapiens
gaaccgcuucuccaccaaa

SEQ ID NO: 901504 - RNA, 19 nt, Homo sapiens
gaaagagcucagaccaugu

SEQ ID NO: 901505 - RNA, 19 nt, Homo sapiens
gagagguggucuuguaagc

SEQ ID NO: 901506 - RNA, 19 nt, Homo sapiens
gacaaagcgagcucagaaa

SEQ ID NO: 901507 - RNA, 19 nt, Homo sapiens
ucggucaucuccagcauug

SEQ ID NO: 901508 - RNA, 19 nt, Homo sapiens
acaucuggcugugugauuu

SEQ ID NO: 901509 - RNA, 19 nt, Homo sapiens
agaaccagaugaagaugau

SEQ ID NO: 901510 - RNA, 19 nt, Homo sapiens
ugggaaagauagcaugcuu

SEQ ID NO: 901511 - RNA, 19 nt, Homo sapiens
cucauuugaugguuucuuu

SEQ ID NO: 901512 - RNA, 19 nt, Homo sapiens
gccagugacucgcucaucu

SEQ ID NO: 901513 - RNA, 19 nt, Homo sapiens
gcacuuacugacacacaga

SEQ ID NO: 901514 - RNA, 19 nt, Homo sapiens
ccgaguaccuggacaacgu

SEQ ID NO: 901515 - RNA, 19 nt, Homo sapiens
uauaauagccccgaccuua

SEQ ID NO: 901516 - RNA, 19 nt, Homo sapiens
gaauuaguuagacacuuga

SEQ ID NO: 901517 - RNA, 19 nt, Homo sapiens
ccagugaaacucauuugau

SEQ ID NO: 901518 - RNA, 19 nt, Homo sapiens
ccugaaaccuaauaaucuc

SEQ ID NO: 901519 - RNA, 19 nt, Homo sapiens
ccagugggauggacaaagc

SEQ ID NO: 901520 - RNA, 19 nt, Homo sapiens
aaacaucaccguaaaugac

SEQ ID NO: 901521 - RNA, 19 nt, Homo sapiens
caaggagauugguaucaac

SEQ ID NO: 901522 - RNA, 19 nt, Homo sapiens
caaagcgagcucagaaaca

SEQ ID NO: 901523 - RNA, 19 nt, Homo sapiens
gaccagcgugugcgagaaa

SEQ ID NO: 901524 - RNA, 19 nt, Homo sapiens
ugacacacagauugaaaga

SEQ ID NO: 901525 - RNA, 19 nt, Homo sapiens
ggagaacaucgacaagaag

SEQ ID NO: 901526 - RNA, 19 nt, Homo sapiens
acaaacaucaccguaaaug

SEQ ID NO: 901527 - RNA, 19 nt, Homo sapiens
aaagcgagcucagaaacag

SEQ ID NO: 901528 - RNA, 19 nt, Homo sapiens
ccacuaagggcaaccucaa

SEQ ID NO: 901529 - RNA, 19 nt, Homo sapiens
gcugccuucucaguuauuu

SEQ ID NO: 901530 - RNA, 19 nt, Homo sapiens
uuacugacacacagauuga

SEQ ID NO: 901531 - RNA, 19 nt, Homo sapiens
gaacucugcaaucuuuuaa

SEQ ID NO: 901532 - RNA, 19 nt, Homo sapiens
uguggucuguagcccaaua

SEQ ID NO: 901533 - RNA, 19 nt, Homo sapiens
uuauuucaaugcaggcaaa

SEQ ID NO: 901534 - RNA, 19 nt, Homo sapiens
ugaaacucauuugaugguu

SEQ ID NO: 901535 - RNA, 19 nt, Homo sapiens
ggaaccgcuucuccaccaa

SEQ ID NO: 901536 - RNA, 19 nt, Homo sapiens
ugcaagagcgcguuggaaa

SEQ ID NO: 901537 - RNA, 19 nt, Homo sapiens
cggagacccugagcagcua

SEQ ID NO: 901538 - RNA, 19 nt, Homo sapiens
acuccgagcuggccuacga

SEQ ID NO: 901539 - RNA, 19 nt, Homo sapiens
gacaaacaucaccguaaau

SEQ ID NO: 901540 - RNA, 19 nt, Homo sapiens
gcaaaauugugaaguucug

SEQ ID NO: 901541 - RNA, 19 nt, Homo sapiens
cggguaacagacaauauaa

SEQ ID NO: 901542 - RNA, 19 nt, Homo sapiens
uaacaaggagauugguauc

SEQ ID NO: 901543 - RNA, 19 nt, Homo sapiens
cugaaguucucugaaaugu

SEQ ID NO: 901544 - RNA, 19 nt, Homo sapiens
gugaugcccugaaguucuc

SEQ ID NO: 901545 - RNA, 19 nt, Homo sapiens
ucaaacugcuucaagauua

SEQ ID NO: 901546 - RNA, 19 nt, Homo sapiens
gaucgaggcuugcaaagug

SEQ ID NO: 901547 - RNA, 19 nt, Homo sapiens
gaacuuagaaagcauggua

SEQ ID NO: 901548 - RNA, 19 nt, Homo sapiens
uaacaaagcagagaaguuu

SEQ ID NO: 901549 - RNA, 19 nt, Homo sapiens
gggaauggcuauauacaug

SEQ ID NO: 901550 - RNA, 19 nt, Homo sapiens
ccacacauguaauccauaa

SEQ ID NO: 901551 - RNA, 19 nt, Homo sapiens
ugacuucucuggccaguuu

SEQ ID NO: 901552 - RNA, 19 nt, Homo sapiens
caucgaaguuguuaaauuc

SEQ ID NO: 901553 - RNA, 19 nt, Homo sapiens
gaaagaaguuugucauucc

SEQ ID NO: 901554 - RNA, 19 nt, Homo sapiens
gcaccaggaucaugauuca

SEQ ID NO: 901555 - RNA, 19 nt, Homo sapiens
gaacaagacuguggucaac

SEQ ID NO: 901556 - RNA, 19 nt, Homo sapiens
caagauggacuguaacaaa

SEQ ID NO: 901557 - RNA, 19 nt, Homo sapiens
ggacacaucgaaguuguua

SEQ ID NO: 901558 - RNA, 19 nt, Homo sapiens
cgaaagaaguuugucauuc

SEQ ID NO: 901559 - RNA, 19 nt, Homo sapiens
cgagaucucuuccgaaagu

SEQ ID NO: 901560 - RNA, 19 nt, Homo sapiens
gcgcacagcucugcauguu

SEQ ID NO: 901561 - RNA, 19 nt, Homo sapiens
gcuauuaucucaaggaaaa

SEQ ID NO: 901562 - RNA, 19 nt, Homo sapiens
ugaucaagauggacuguaa

SEQ ID NO: 901563 - RNA, 19 nt, Homo sapiens
ccauguggaucgcaucuuu

SEQ ID NO: 901564 - RNA, 19 nt, Homo sapiens
auacauggcuuuaguaguc

SEQ ID NO: 901565 - RNA, 19 nt, Homo sapiens
aaagagaacuuagaaagca

SEQ ID NO: 901566 - RNA, 19 nt, Homo sapiens
gaaagugugugagcagcaa

SEQ ID NO: 901567 - RNA, 19 nt, Homo sapiens
gcagaaauucggaacaaga

SEQ ID NO: 901568 - RNA, 19 nt, Homo sapiens
gggcagaaauucggaacaa

SEQ ID NO: 901569 - RNA, 19 nt, Homo sapiens
ggaaugaauacauggguuu

SEQ ID NO: 901570 - RNA, 19 nt, Homo sapiens
gaaaccaucaugagagaga

SEQ ID NO: 901571 - RNA, 19 nt, Homo sapiens
gagcuggccacacauguaa

SEQ ID NO: 901572 - RNA, 19 nt, Homo sapiens
gcagacagaguacagagaa

SEQ ID NO: 901573 - RNA, 19 nt, Homo sapiens
gaaguuugauuuuguguug

SEQ ID NO: 901574 - RNA, 19 nt, Homo sapiens
aagcagagaaguuugauuu

SEQ ID NO: 901575 - RNA, 19 nt, Homo sapiens
ccacuggacugcagacauc

SEQ ID NO: 901576 - RNA, 19 nt, Homo sapiens
gcauguugcugcagcugaa

SEQ ID NO: 901577 - RNA, 19 nt, Homo sapiens
caugauggcugcccuugau

SEQ ID NO: 901578 - RNA, 19 nt, Homo sapiens
ccaaagagaacuuagaaag

SEQ ID NO: 901579 - RNA, 19 nt, Homo sapiens
caaaauggcugggaaugaa

SEQ ID NO: 901580 - RNA, 19 nt, Homo sapiens
gaagugggaauggcuauau

SEQ ID NO: 901581 - RNA, 19 nt, Homo sapiens
acaacaagcucucccucaa

SEQ ID NO: 901582 - RNA, 19 nt, Homo sapiens
gaaucccuauccacaaguu

SEQ ID NO: 901583 - RNA, 19 nt, Homo sapiens
uggugucucucuucaauuu

SEQ ID NO: 901584 - RNA, 19 nt, Homo sapiens
gcagagaaguuugauuuug

SEQ ID NO: 901585 - RNA, 19 nt, Homo sapiens
gagaaaguauuuuguguuc

SEQ ID NO: 901586 - RNA, 19 nt, Homo sapiens
aagaaaccaucaugagaga

SEQ ID NO: 901587 - RNA, 19 nt, Homo sapiens
ugaagaaaccaucaugaga

SEQ ID NO: 901588 - RNA, 19 nt, Homo sapiens
ggaacaagacuguggucaa

SEQ ID NO: 901589 - RNA, 19 nt, Homo sapiens
gcuaacagccaauuuuaua

SEQ ID NO: 901590 - RNA, 19 nt, Homo sapiens
acacaucgaaguuguuaaa

SEQ ID NO: 901591 - RNA, 19 nt, Homo sapiens
gaaggacacaucgaaguug

SEQ ID NO: 901592 - RNA, 19 nt, Homo sapiens
gaacagaaagacuaugacu

SEQ ID NO: 901593 - RNA, 19 nt, Homo sapiens
caaguggccugcgcuacaa

SEQ ID NO: 901594 - RNA, 19 nt, Homo sapiens
guucaccacugcacuaaag

SEQ ID NO: 901595 - RNA, 19 nt, Homo sapiens
uuaguagucuggagaaauc

SEQ ID NO: 901596 - RNA, 19 nt, Homo sapiens
caaaguggcagccuacauc

SEQ ID NO: 901597 - RNA, 19 nt, Homo sapiens
ugacuuaggcuagugcuuu

SEQ ID NO: 901598 - RNA, 19 nt, Homo sapiens
guuauuugcugccuauagu

SEQ ID NO: 901599 - RNA, 19 nt, Homo sapiens
auacauggguuucagcaau

SEQ ID NO: 901600 - RNA, 19 nt, Homo sapiens
ggaugaugcugugcaguuc

SEQ ID NO: 901601 - RNA, 19 nt, Homo sapiens
guuggugucucucuucaau

SEQ ID NO: 901602 - RNA, 19 nt, Homo sapiens
cuauauacauggcuuuagu

SEQ ID NO: 901603 - RNA, 19 nt, Homo sapiens
ucaauuuccacaacuauga

SEQ ID NO: 901604 - RNA, 19 nt, Homo sapiens
guaacaaagcagagaaguu

SEQ ID NO: 901605 - RNA, 19 nt, Homo sapiens
ucacccaggucuccucuuc

SEQ ID NO: 901606 - RNA, 19 nt, Homo sapiens
gcuucaagguacagccuaa

SEQ ID NO: 901607 - RNA, 19 nt, Homo sapiens
aagaagugcuuuccuaagg

SEQ ID NO: 901608 - RNA, 19 nt, Homo sapiens
gccaucggcuauuaucuca

SEQ ID NO: 901609 - RNA, 19 nt, Homo sapiens
aacaagcucucccucaaug

SEQ ID NO: 901610 - RNA, 19 nt, Homo sapiens
caaguucaccacugcacua

SEQ ID NO: 901611 - RNA, 19 nt, Homo sapiens
ucagaggacaccugcagua

SEQ ID NO: 901612 - RNA, 19 nt, Homo sapiens
caaacugcuucaagauuac

SEQ ID NO: 901613 - RNA, 19 nt, Homo sapiens
gaauuaugccaucggcuau

SEQ ID NO: 901614 - RNA, 19 nt, Homo sapiens
aagauggacuguaacaaag

SEQ ID NO: 901615 - RNA, 19 nt, Homo sapiens
caacaagcucucccucaau

SEQ ID NO: 901616 - RNA, 19 nt, Homo sapiens
cugaggcccuguccaaaga

SEQ ID NO: 901617 - RNA, 19 nt, Homo sapiens
ugaaggacacaucgaaguu

SEQ ID NO: 901618 - RNA, 19 nt, Homo sapiens
caucggcuauuaucucaag

SEQ ID NO: 901619 - RNA, 19 nt, Homo sapiens
caugaaggcucugcagaag

SEQ ID NO: 901620 - RNA, 19 nt, Homo sapiens
ggaagugggaauggcuaua

SEQ ID NO: 901621 - RNA, 19 nt, Homo sapiens
gccagaaguuggugucucu

SEQ ID NO: 901622 - RNA, 19 nt, Homo sapiens
gauggacuguaacaaagca

SEQ ID NO: 901623 - RNA, 19 nt, Homo sapiens
ugacuacgugcacaaguuu

SEQ ID NO: 901624 - RNA, 19 nt, Homo sapiens
aagugggaauggcuauaua

SEQ ID NO: 901625 - RNA, 19 nt, Homo sapiens
gauuugcucuuuuacacua

SEQ ID NO: 901626 - RNA, 19 nt, Homo sapiens
accgagaucucuuccgaaa

SEQ ID NO: 901627 - RNA, 19 nt, Homo sapiens
guccaagaguccaguagug

SEQ ID NO: 901628 - RNA, 19 nt, Homo sapiens
gacuuaggcuagugcuuuc

SEQ ID NO: 901629 - RNA, 19 nt, Homo sapiens
uggcugcccuugaucucua

SEQ ID NO: 901630 - RNA, 19 nt, Homo sapiens
auuaugccaucggcuauua

SEQ ID NO: 901631 - RNA, 19 nt, Homo sapiens
ccacauuccagucagagaa

SEQ ID NO: 901632 - RNA, 19 nt, Homo sapiens
ccaugaaggcucugcagaa

SEQ ID NO: 901633 - RNA, 19 nt, Homo sapiens
guccaaagagaacuuagaa

SEQ ID NO: 901634 - RNA, 19 nt, Homo sapiens
guggucaaccuguuauuug

SEQ ID NO: 901635 - RNA, 19 nt, Homo sapiens
gagggacucuagcuaccau

SEQ ID NO: 901636 - RNA, 19 nt, Homo sapiens
aaaauacuauggagagcua

SEQ ID NO: 901637 - RNA, 19 nt, Homo sapiens
ggccacacauguaauccau

SEQ ID NO: 901638 - RNA, 19 nt, Homo sapiens
caaagagaacuuagaaagc

SEQ ID NO: 901639 - RNA, 19 nt, Homo sapiens
caguagugguggccucuug

SEQ ID NO: 901640 - RNA, 19 nt, Homo sapiens
ggucaaacugcuucaagau

SEQ ID NO: 901641 - RNA, 19 nt, Homo sapiens
ggugguacccaaugucaug

SEQ ID NO: 901642 - RNA, 19 nt, Homo sapiens
cggcauguaugacuucucu

SEQ ID NO: 901643 - RNA, 19 nt, Homo sapiens
agagcucacuggaggcaaa

SEQ ID NO: 901644 - RNA, 19 nt, Homo sapiens
ggacugcagacaucagauc

SEQ ID NO: 901645 - RNA, 19 nt, Homo sapiens
ucaaacugcuucaagauua

SEQ ID NO: 901646 - RNA, 19 nt, Homo sapiens
gaucgaggcuugcaaagug

SEQ ID NO: 901647 - RNA, 19 nt, Homo sapiens
gaacuuagaaagcauggua

SEQ ID NO: 901648 - RNA, 19 nt, Homo sapiens
uaacaaagcagagaaguuu

SEQ ID NO: 901649 - RNA, 19 nt, Homo sapiens
gggaauggcuauauacaug

SEQ ID NO: 901650 - RNA, 19 nt, Homo sapiens
ccacacauguaauccauaa

SEQ ID NO: 901651 - RNA, 19 nt, Homo sapiens
ugacuucucuggccaguuu

SEQ ID NO: 901652 - RNA, 19 nt, Homo sapiens
caucgaaguuguuaaauuc

SEQ ID NO: 901653 - RNA, 19 nt, Homo sapiens
gcaccaggaucaugauuca

SEQ ID NO: 901654 - RNA, 19 nt, Homo sapiens
gaacaagacuguggucaac

SEQ ID NO: 901655 - RNA, 19 nt, Homo sapiens
caagauggacuguaacaaa

SEQ ID NO: 901656 - RNA, 19 nt, Homo sapiens
ggacacaucgaaguuguua

SEQ ID NO: 901657 - RNA, 19 nt, Homo sapiens
cgagaucucuuccgaaagu

SEQ ID NO: 901658 - RNA, 19 nt, Homo sapiens
gaaaguggcagccuacauc

SEQ ID NO: 901659 - RNA, 19 nt, Homo sapiens
gcgcacagcucugcauguu

SEQ ID NO: 901660 - RNA, 19 nt, Homo sapiens
gcuauuaucucaaggaaaa

SEQ ID NO: 901661 - RNA, 19 nt, Homo sapiens
ugaucaagauggacuguaa

SEQ ID NO: 901662 - RNA, 19 nt, Homo sapiens
auacauggcuuuaguaguc

SEQ ID NO: 901663 - RNA, 19 nt, Homo sapiens
aaagagaacuuagaaagca

SEQ ID NO: 901664 - RNA, 19 nt, Homo sapiens
gcagaaauucggaacaaga

SEQ ID NO: 901665 - RNA, 19 nt, Homo sapiens
gggcagaaauucggaacaa

SEQ ID NO: 901666 - RNA, 19 nt, Homo sapiens
ggaaugaauacauggguuu

SEQ ID NO: 901667 - RNA, 19 nt, Homo sapiens
gaaaccaucaugagagaga

SEQ ID NO: 901668 - RNA, 19 nt, Homo sapiens
gagcuggccacacauguaa

SEQ ID NO: 901669 - RNA, 19 nt, Homo sapiens
gcagacagaguacagagaa

SEQ ID NO: 901670 - RNA, 19 nt, Homo sapiens
gaaguuugauuuuguguug

SEQ ID NO: 901671 - RNA, 19 nt, Homo sapiens
aagcagagaaguuugauuu

SEQ ID NO: 901672 - RNA, 19 nt, Homo sapiens
ccacuggacugcagacauc

SEQ ID NO: 901673 - RNA, 19 nt, Homo sapiens
gcauguugcugcagcugaa

SEQ ID NO: 901674 - RNA, 19 nt, Homo sapiens
caugauggcugcccuugau

SEQ ID NO: 901675 - RNA, 19 nt, Homo sapiens
ccaaagagaacuuagaaag

SEQ ID NO: 901676 - RNA, 19 nt, Homo sapiens
caaaauggcugggaaugaa

SEQ ID NO: 901677 - RNA, 19 nt, Homo sapiens
gaagugggaauggcuauau

SEQ ID NO: 901678 - RNA, 19 nt, Homo sapiens
acaacaagcucucccucaa

SEQ ID NO: 901679 - RNA, 19 nt, Homo sapiens
gaaucccuauccacaaguu

SEQ ID NO: 901680 - RNA, 19 nt, Homo sapiens
uggugucucucuucaauuu

SEQ ID NO: 901681 - RNA, 19 nt, Homo sapiens
gcagagaaguuugauuuug

SEQ ID NO: 901682 - RNA, 19 nt, Homo sapiens
gagaaaguauuuuguguuc

SEQ ID NO: 901683 - RNA, 19 nt, Homo sapiens
aagaaaccaucaugagaga

SEQ ID NO: 901684 - RNA, 19 nt, Homo sapiens
ugaagaaaccaucaugaga

SEQ ID NO: 901685 - RNA, 19 nt, Homo sapiens
ggaacaagacuguggucaa

SEQ ID NO: 901686 - RNA, 19 nt, Homo sapiens
gcuaacagccaauuuuaua

SEQ ID NO: 901687 - RNA, 19 nt, Homo sapiens
acacaucgaaguuguuaaa

SEQ ID NO: 901688 - RNA, 19 nt, Homo sapiens
gaaggacacaucgaaguug

SEQ ID NO: 901689 - RNA, 19 nt, Homo sapiens
gaacagaaagacuaugacu

SEQ ID NO: 901690 - RNA, 19 nt, Homo sapiens
caaguggccugcgcuacaa

SEQ ID NO: 901691 - RNA, 19 nt, Homo sapiens
guucaccacugcacuaaag

SEQ ID NO: 901692 - RNA, 19 nt, Homo sapiens
uuaguagucuggagaaauc

SEQ ID NO: 901693 - RNA, 19 nt, Homo sapiens
ugacuuaggcuagugcuuu

SEQ ID NO: 901694 - RNA, 19 nt, Homo sapiens
guuauuugcugccuauagu

SEQ ID NO: 901695 - RNA, 19 nt, Homo sapiens
auacauggguuucagcaau

SEQ ID NO: 901696 - RNA, 19 nt, Homo sapiens
ggaugaugcugugcaguuc

SEQ ID NO: 901697 - RNA, 19 nt, Homo sapiens
guuggugucucucuucaau

SEQ ID NO: 901698 - RNA, 19 nt, Homo sapiens
cuauauacauggcuuuagu

SEQ ID NO: 901699 - RNA, 19 nt, Homo sapiens
ucaauuuccacaacuauga

SEQ ID NO: 901700 - RNA, 19 nt, Homo sapiens
guaacaaagcagagaaguu

SEQ ID NO: 901701 - RNA, 19 nt, Homo sapiens
ucacccaggucuccucuuc

SEQ ID NO: 901702 - RNA, 19 nt, Homo sapiens
gcuucaagguacagccuaa

SEQ ID NO: 901703 - RNA, 19 nt, Homo sapiens
aagaagugcuuuccuaagg

SEQ ID NO: 901704 - RNA, 19 nt, Homo sapiens
gccaucggcuauuaucuca

SEQ ID NO: 901705 - RNA, 19 nt, Homo sapiens
aacaagcucucccucaaug

SEQ ID NO: 901706 - RNA, 19 nt, Homo sapiens
caaguucaccacugcacua

SEQ ID NO: 901707 - RNA, 19 nt, Homo sapiens
ucagaggacaccugcagua

SEQ ID NO: 901708 - RNA, 19 nt, Homo sapiens
caaacugcuucaagauuac

SEQ ID NO: 901709 - RNA, 19 nt, Homo sapiens
gaauuaugccaucggcuau

SEQ ID NO: 901710 - RNA, 19 nt, Homo sapiens
aagauggacuguaacaaag

SEQ ID NO: 901711 - RNA, 19 nt, Homo sapiens
caacaagcucucccucaau

SEQ ID NO: 901712 - RNA, 19 nt, Homo sapiens
caugaaggcucugcagaag

SEQ ID NO: 901713 - RNA, 19 nt, Homo sapiens
cugaggcccuguccaaaga

SEQ ID NO: 901714 - RNA, 19 nt, Homo sapiens
ugaaggacacaucgaaguu

SEQ ID NO: 901715 - RNA, 19 nt, Homo sapiens
caucggcuauuaucucaag

SEQ ID NO: 901716 - RNA, 19 nt, Homo sapiens
ggaagugggaauggcuaua

SEQ ID NO: 901717 - RNA, 19 nt, Homo sapiens
gccagaaguuggugucucu

SEQ ID NO: 901718 - RNA, 19 nt, Homo sapiens
gauggacuguaacaaagca

SEQ ID NO: 901719 - RNA, 19 nt, Homo sapiens
ugacuacgugcacaaguuu

SEQ ID NO: 901720 - RNA, 19 nt, Homo sapiens
aagugggaauggcuauaua

SEQ ID NO: 901721 - RNA, 19 nt, Homo sapiens
gauuugcucuuuuacacua

SEQ ID NO: 901722 - RNA, 19 nt, Homo sapiens
accgagaucucuuccgaaa

SEQ ID NO: 901723 - RNA, 19 nt, Homo sapiens
guccaagaguccaguagug

SEQ ID NO: 901724 - RNA, 19 nt, Homo sapiens
ccaugaaggcucugcagaa

SEQ ID NO: 901725 - RNA, 19 nt, Homo sapiens
gacuuaggcuagugcuuuc

SEQ ID NO: 901726 - RNA, 19 nt, Homo sapiens
uggcugcccuugaucucua

SEQ ID NO: 901727 - RNA, 19 nt, Homo sapiens
auuaugccaucggcuauua

SEQ ID NO: 901728 - RNA, 19 nt, Homo sapiens
ccacauuccagucagagaa

SEQ ID NO: 901729 - RNA, 19 nt, Homo sapiens
guccaaagagaacuuagaa

SEQ ID NO: 901730 - RNA, 19 nt, Homo sapiens
guggucaaccuguuauuug

SEQ ID NO: 901731 - RNA, 19 nt, Homo sapiens
gagggacucuagcuaccau

SEQ ID NO: 901732 - RNA, 19 nt, Homo sapiens
aaaauacuauggagagcua

SEQ ID NO: 901733 - RNA, 19 nt, Homo sapiens
ggccacacauguaauccau

SEQ ID NO: 901734 - RNA, 19 nt, Homo sapiens
caaagagaacuuagaaagc

SEQ ID NO: 901735 - RNA, 19 nt, Homo sapiens
ggucaaacugcuucaagau

SEQ ID NO: 901736 - RNA, 19 nt, Homo sapiens
ggugguacccaaugucaug

SEQ ID NO: 901737 - RNA, 19 nt, Homo sapiens
cggcauguaugacuucucu

SEQ ID NO: 901738 - RNA, 19 nt, Homo sapiens
caguagugguggccucuug

SEQ ID NO: 901739 - RNA, 19 nt, Homo sapiens
ggacugcagacaucagauc

SEQ ID NO: 901740 - RNA, 19 nt, Homo sapiens
gaauaugggaagugggaau

SEQ ID NO: 901741 - RNA, 19 nt, Homo sapiens
ggacagccccugcucaaga

SEQ ID NO: 901742 - RNA, 19 nt, Homo sapiens
gucaaacugcuucaagauu

SEQ ID NO: 901743 - RNA, 19 nt, Homo sapiens
agacuguggucaaccuguu

SEQ ID NO: 901744 - RNA, 19 nt, Homo sapiens
ccaaguggccugcgcuaca

SEQ ID NO: 901745 - RNA, 19 nt, Homo sapiens
ggacgauggugaaguauuu

SEQ ID NO: 901746 - RNA, 19 nt, Homo sapiens
gguaagugcuagacuguaa

SEQ ID NO: 901747 - RNA, 19 nt, Homo sapiens
ggaacgauguguuuacugu

SEQ ID NO: 901748 - RNA, 19 nt, Homo sapiens
ccaagacuaugaaggguuu

SEQ ID NO: 901749 - RNA, 19 nt, Homo sapiens
ggucuccucuagcuuauuu

SEQ ID NO: 901750 - RNA, 19 nt, Homo sapiens
gaauauaucuuggcuaagc

SEQ ID NO: 901751 - RNA, 19 nt, Homo sapiens
ccaaggaccucgccagcaa

SEQ ID NO: 901752 - RNA, 19 nt, Homo sapiens
ccagagcuguccaggaauu

SEQ ID NO: 901753 - RNA, 19 nt, Homo sapiens
gggcagggcuuuugguuuu

SEQ ID NO: 901754 - RNA, 19 nt, Homo sapiens
ccgggacgauggugaagua

SEQ ID NO: 901755 - RNA, 19 nt, Homo sapiens
cuccagagcuguccaggaa

SEQ ID NO: 901756 - RNA, 19 nt, Homo sapiens
ccucugcccucccuucauu

SEQ ID NO: 901757 - RNA, 19 nt, Homo sapiens
cucaguaucuagcacauaa

SEQ ID NO: 901758 - RNA, 19 nt, Homo sapiens
gacacucaauaaauacuug

SEQ ID NO: 901759 - RNA, 19 nt, Homo sapiens
gcacauaauagacacucaa

SEQ ID NO: 901760 - RNA, 19 nt, Homo sapiens
ccaaggagaaggcaaagga

SEQ ID NO: 901761 - RNA, 19 nt, Homo sapiens
ccaaggaagccaaggagaa

SEQ ID NO: 901762 - RNA, 19 nt, Homo sapiens
ccacagaaucagaccauga

SEQ ID NO: 901763 - RNA, 19 nt, Homo sapiens
cuacagagaaggccaagga

SEQ ID NO: 901764 - RNA, 19 nt, Homo sapiens
gcaacgugaccaagacuau

SEQ ID NO: 901765 - RNA, 19 nt, Homo sapiens
caguaucuagcacauaaua

SEQ ID NO: 901766 - RNA, 19 nt, Homo sapiens
ugacuaccuucaccuggaa

SEQ ID NO: 901767 - RNA, 19 nt, Homo sapiens
guacaccaagcacaugauu

SEQ ID NO: 901768 - RNA, 19 nt, Homo sapiens
cagguuaacuggcgguaag

SEQ ID NO: 901769 - RNA, 19 nt, Homo sapiens
gcacuggcagcuacagaga

SEQ ID NO: 901770 - RNA, 19 nt, Homo sapiens
gaggaacgauguguuuacu

SEQ ID NO: 901771 - RNA, 19 nt, Homo sapiens
ugaugugucucaguaucua

SEQ ID NO: 901772 - RNA, 19 nt, Homo sapiens
acaccaagcacaugauuca

SEQ ID NO: 901773 - RNA, 19 nt, Homo sapiens
gcagcagcagcaacaguuu

SEQ ID NO: 901774 - RNA, 19 nt, Homo sapiens
guggaggaacgauguguuu

SEQ ID NO: 901775 - RNA, 19 nt, Homo sapiens
gagccaggucugcuuauuc

SEQ ID NO: 901776 - RNA, 19 nt, Homo sapiens
ugugaacucugacaacagu

SEQ ID NO: 901777 - RNA, 19 nt, Homo sapiens
uaacuggcgguaagugcua

SEQ ID NO: 901778 - RNA, 19 nt, Homo sapiens
ggaggaacgauguguuuac

SEQ ID NO: 901779 - RNA, 19 nt, Homo sapiens
gcgacuauuuccugccaau

SEQ ID NO: 901780 - RNA, 19 nt, Homo sapiens
gcagcaacaguuuguguag

SEQ ID NO: 901781 - RNA, 19 nt, Homo sapiens
guccaggaauuuggucuug

SEQ ID NO: 901782 - RNA, 19 nt, Homo sapiens
cagaaucagaccaugacua

SEQ ID NO: 901783 - RNA, 19 nt, Homo sapiens
uaucuuggcuaagcugcaa

SEQ ID NO: 901784 - RNA, 19 nt, Homo sapiens
ugagccaggucugcuuauu

SEQ ID NO: 901785 - RNA, 19 nt, Homo sapiens
caguuuggcaucugcagua

SEQ ID NO: 901786 - RNA, 19 nt, Homo sapiens
ccgaaucccuauagcaaac

SEQ ID NO: 901787 - RNA, 19 nt, Homo sapiens
gguggugacugagcuacga

SEQ ID NO: 901788 - RNA, 19 nt, Homo sapiens
caaggaagccaaggagaag

SEQ ID NO: 901789 - RNA, 19 nt, Homo sapiens
cgauguguuuacuguguga

SEQ ID NO: 901790 - RNA, 19 nt, Homo sapiens
acuauuuccugccaauguu

SEQ ID NO: 901791 - RNA, 19 nt, Homo sapiens
ugaccaagaccaacaggau

SEQ ID NO: 901792 - RNA, 19 nt, Homo sapiens
gcaguacaccaagcacaug

SEQ ID NO: 901793 - RNA, 19 nt, Homo sapiens
gacuauuuccugccaaugu

SEQ ID NO: 901794 - RNA, 19 nt, Homo sapiens
gaaucccuauagcaaacau

SEQ ID NO: 901795 - RNA, 19 nt, Homo sapiens
aaagcaacgugaccaagac

SEQ ID NO: 901796 - RNA, 19 nt, Homo sapiens
cugggucuccucuagcuua

SEQ ID NO: 901797 - RNA, 19 nt, Homo sapiens
aacgauguguuuacugugu

SEQ ID NO: 901798 - RNA, 19 nt, Homo sapiens
agaaucagaccaugacuac

SEQ ID NO: 901799 - RNA, 19 nt, Homo sapiens
ggugaccccugaccagaaa

SEQ ID NO: 901800 - RNA, 19 nt, Homo sapiens
acagaggugcggugacuug

SEQ ID NO: 901801 - RNA, 19 nt, Homo sapiens
gggacgauggugaaguauu

SEQ ID NO: 901802 - RNA, 19 nt, Homo sapiens
caacgugaccaagacuaug

SEQ ID NO: 901803 - RNA, 19 nt, Homo sapiens
ugugugaacucugacaaca

SEQ ID NO: 901804 - RNA, 19 nt, Homo sapiens
uuuacugugugaacucuga

SEQ ID NO: 901805 - RNA, 19 nt, Homo sapiens
gcagguuaacuggcgguaa

SEQ ID NO: 901806 - RNA, 19 nt, Homo sapiens
ucccuucauuguacuuuau

SEQ ID NO: 901807 - RNA, 19 nt, Homo sapiens
aagccugggucuccucuag

SEQ ID NO: 901808 - RNA, 19 nt, Homo sapiens
gcgguaagugcuagacugu

SEQ ID NO: 901809 - RNA, 19 nt, Homo sapiens
cagcagcaacaguuugugu

SEQ ID NO: 901810 - RNA, 19 nt, Homo sapiens
cagcagcagcaacaguuug

SEQ ID NO: 901811 - RNA, 19 nt, Homo sapiens
uggcagcgguacccgaauc

SEQ ID NO: 901812 - RNA, 19 nt, Homo sapiens
cggcgacuccugaccaaga

SEQ ID NO: 901813 - RNA, 19 nt, Homo sapiens
agccaggucugcuuauucu

SEQ ID NO: 901814 - RNA, 19 nt, Homo sapiens
gaaggguuuugaauauauc

SEQ ID NO: 901815 - RNA, 19 nt, Homo sapiens
uggaggaacgauguguuua

SEQ ID NO: 901816 - RNA, 19 nt, Homo sapiens
cuauagcaaacaugucuug

SEQ ID NO: 901817 - RNA, 19 nt, Homo sapiens
ggaagacacuugacugcua

SEQ ID NO: 901818 - RNA, 19 nt, Homo sapiens
ucaagucgcuagagacaua

SEQ ID NO: 901819 - RNA, 19 nt, Homo sapiens
gcuggcaccuuucucuaua

SEQ ID NO: 901820 - RNA, 19 nt, Homo sapiens
gguaagcgccagaauauga

SEQ ID NO: 901821 - RNA, 19 nt, Homo sapiens
gcauagggacauauucuuu

SEQ ID NO: 901822 - RNA, 19 nt, Homo sapiens
cauggcagcuggcaccuuu

SEQ ID NO: 901823 - RNA, 19 nt, Homo sapiens
gaucucugauugcuccuaa

SEQ ID NO: 901824 - RNA, 19 nt, Homo sapiens
cauagggacauauucuuua

SEQ ID NO: 901825 - RNA, 19 nt, Homo sapiens
ggucauaaaccuagaguca

SEQ ID NO: 901826 - RNA, 19 nt, Homo sapiens
aaucagagguuggacacua

SEQ ID NO: 901827 - RNA, 19 nt, Homo sapiens
ggccugcucuucauccaaa

SEQ ID NO: 901828 - RNA, 19 nt, Homo sapiens
aaaguucucugggagcuaa

SEQ ID NO: 901829 - RNA, 19 nt, Homo sapiens
acacuugacugcuagaauc

SEQ ID NO: 901830 - RNA, 19 nt, Homo sapiens
ucugauugcuccuaacuga

SEQ ID NO: 901831 - RNA, 19 nt, Homo sapiens
ggaccuguuacccaaauaa

SEQ ID NO: 901832 - RNA, 19 nt, Homo sapiens
uagagucaguguccuguug

SEQ ID NO: 901833 - RNA, 19 nt, Homo sapiens
ucauaaaccuagagucagu

SEQ ID NO: 901834 - RNA, 19 nt, Homo sapiens
gguuggacacuauacauaa

SEQ ID NO: 901835 - RNA, 19 nt, Homo sapiens
aacaagagauggucaaguc

SEQ ID NO: 901836 - RNA, 19 nt, Homo sapiens
ucugggagcuaaagauaga

SEQ ID NO: 901837 - RNA, 19 nt, Homo sapiens
gcacgugacgcuccaguuc

SEQ ID NO: 901838 - RNA, 19 nt, Homo sapiens
gcgccuacccucauaccua

SEQ ID NO: 901839 - RNA, 19 nt, Homo sapiens
ggagcuaccagaagcauca

SEQ ID NO: 901840 - RNA, 19 nt, Homo sapiens
gcuccuaacugacgucacu

SEQ ID NO: 901841 - RNA, 19 nt, Homo sapiens
acacugagcugccaaaaca

SEQ ID NO: 901842 - RNA, 19 nt, Homo sapiens
ccugcuuacuccucuauuu

SEQ ID NO: 901843 - RNA, 19 nt, Homo sapiens
ggggcuaucugacuaauga

SEQ ID NO: 901844 - RNA, 19 nt, Homo sapiens
gggaaauacugaggaccaa

SEQ ID NO: 901845 - RNA, 19 nt, Homo sapiens
ggucucucccugccaauuu

SEQ ID NO: 901846 - RNA, 19 nt, Homo sapiens
ucacuggccugcucuucau

SEQ ID NO: 901847 - RNA, 19 nt, Homo sapiens
gaacaagagauggucaagu

SEQ ID NO: 901848 - RNA, 19 nt, Homo sapiens
caaggucauucugcuccua

SEQ ID NO: 901849 - RNA, 19 nt, Homo sapiens
gaaagcccugagccuagua

SEQ ID NO: 901850 - RNA, 19 nt, Homo sapiens
guaagcgccagaauaugaa

SEQ ID NO: 901851 - RNA, 19 nt, Homo sapiens
ucucaaagcacaguaaugu

SEQ ID NO: 901852 - RNA, 19 nt, Homo sapiens
ggaagugggcagacaagag

SEQ ID NO: 901853 - RNA, 19 nt, Homo sapiens
gggaccuguuacccaaaua

SEQ ID NO: 901854 - RNA, 19 nt, Homo sapiens
ggucaagucgcuagagaca

SEQ ID NO: 901855 - RNA, 19 nt, Homo sapiens
gaaauacugaggaccaaaa

SEQ ID NO: 901856 - RNA, 19 nt, Homo sapiens
cuauaucaccuuucuggaa

SEQ ID NO: 901857 - RNA, 19 nt, Homo sapiens
gccaucuacugcugcugua

SEQ ID NO: 901858 - RNA, 19 nt, Homo sapiens
gggccugcuugcucuuuau

SEQ ID NO: 901859 - RNA, 19 nt, Homo sapiens
uuaaagugccaaacaaauc

SEQ ID NO: 901860 - RNA, 19 nt, Homo sapiens
cgccuacccucauaccuau

SEQ ID NO: 901861 - RNA, 19 nt, Homo sapiens
ggaggagagucaggccaau

SEQ ID NO: 901862 - RNA, 19 nt, Homo sapiens
ucucugggagcuaaagaua

SEQ ID NO: 901863 - RNA, 19 nt, Homo sapiens
ggaaauacugaggaccaaa

SEQ ID NO: 901864 - RNA, 19 nt, Homo sapiens
gaccuguuacccaaauaaa

SEQ ID NO: 901865 - RNA, 19 nt, Homo sapiens
cuuagcgccuacccucaua

SEQ ID NO: 901866 - RNA, 19 nt, Homo sapiens
gcaccuuucucuauaucac

SEQ ID NO: 901867 - RNA, 19 nt, Homo sapiens
gcuguacccuaggaauaug

SEQ ID NO: 901868 - RNA, 19 nt, Homo sapiens
ccgcagcauuggcaugaug

SEQ ID NO: 901869 - RNA, 19 nt, Homo sapiens
guuggacacuauacauaag

SEQ ID NO: 901870 - RNA, 19 nt, Homo sapiens
uggcuuugcugcuccacaa

SEQ ID NO: 901871 - RNA, 19 nt, Homo sapiens
auagggacauauucuuuag

SEQ ID NO: 901872 - RNA, 19 nt, Homo sapiens
cuacccagcaccucaguga

SEQ ID NO: 901873 - RNA, 19 nt, Homo sapiens
acaaauccccuuccucuuu

SEQ ID NO: 901874 - RNA, 19 nt, Homo sapiens
ggaaaggggaagggaaaua

SEQ ID NO: 901875 - RNA, 19 nt, Homo sapiens
agaucacacuggcuuacaa

SEQ ID NO: 901876 - RNA, 19 nt, Homo sapiens
ccgaggcgguagcuucaga

SEQ ID NO: 901877 - RNA, 19 nt, Homo sapiens
caaauccccuuccucuuuc

SEQ ID NO: 901878 - RNA, 19 nt, Homo sapiens
gcucugcugggaacaguga

SEQ ID NO: 901879 - RNA, 19 nt, Homo sapiens
agaaagcccugagccuagu

SEQ ID NO: 901880 - RNA, 19 nt, Homo sapiens
ccgggaagcugggagaaag

SEQ ID NO: 901881 - RNA, 19 nt, Homo sapiens
gcagcuggcaccuuucucu

SEQ ID NO: 901882 - RNA, 19 nt, Homo sapiens
cccagaugauaaacacuga

SEQ ID NO: 901883 - RNA, 19 nt, Homo sapiens
ggugucccaugcccagaug

SEQ ID NO: 901884 - RNA, 19 nt, Homo sapiens
ucagagguuggacacuaua

SEQ ID NO: 901885 - RNA, 19 nt, Homo sapiens
gcuagaaucagagguugga

SEQ ID NO: 901886 - RNA, 19 nt, Homo sapiens
ucacacuggcuuacaagga

SEQ ID NO: 901887 - RNA, 19 nt, Homo sapiens
ucccaugcccagaugauaa

SEQ ID NO: 901888 - RNA, 19 nt, Homo sapiens
gagguuggacacuauacau

SEQ ID NO: 901889 - RNA, 19 nt, Homo sapiens
gcucuucauccaaaucuag

SEQ ID NO: 901890 - RNA, 19 nt, Homo sapiens
cugcuguacccuaggaaua

SEQ ID NO: 901891 - RNA, 19 nt, Homo sapiens
gguaggaggaagguuguug

SEQ ID NO: 901892 - RNA, 19 nt, Homo sapiens
gggguaagcgccagaauau

SEQ ID NO: 901893 - RNA, 19 nt, Homo sapiens
gagggaagugggcagacaa

SEQ ID NO: 901894 - RNA, 19 nt, Homo sapiens
uaaacacugagcugccaaa

SEQ ID NO: 901895 - RNA, 19 nt, Homo sapiens
gcuggccaguucugagcaa

SEQ ID NO: 901896 - RNA, 19 nt, Homo sapiens
gaucacacuggcuuacaag

SEQ ID NO: 901897 - RNA, 19 nt, Homo sapiens
gugcauagggacauauucu

SEQ ID NO: 901898 - RNA, 19 nt, Homo sapiens
gaggagagucaggccaaug

SEQ ID NO: 901899 - RNA, 19 nt, Homo sapiens
ccaaggaacaagagauggu

SEQ ID NO: 901900 - RNA, 19 nt, Homo sapiens
agcaaaggauccucaaggu

SEQ ID NO: 901901 - RNA, 19 nt, Homo sapiens
aaaggauccucaaggucau

SEQ ID NO: 901902 - RNA, 19 nt, Homo sapiens
cagcuggcaccuuucucua

SEQ ID NO: 901903 - RNA, 19 nt, Homo sapiens
cauaaggacaggcucacau

SEQ ID NO: 901904 - RNA, 19 nt, Homo sapiens
ggccaguucugagcaaagg

SEQ ID NO: 901905 - RNA, 19 nt, Homo sapiens
ggccgcagcauuggcauga

SEQ ID NO: 901906 - RNA, 19 nt, Homo sapiens
gcagaucacacuggcuuac

SEQ ID NO: 901907 - RNA, 19 nt, Homo sapiens
guucagcucuaauaaagua

SEQ ID NO: 901908 - RNA, 19 nt, Homo sapiens
ggacaacuuugaugagaug

SEQ ID NO: 901909 - RNA, 19 nt, Homo sapiens
uaauaaagcuugguuguca

SEQ ID NO: 901910 - RNA, 19 nt, Homo sapiens
gcagacuuauucaguguuu

SEQ ID NO: 901911 - RNA, 19 nt, Homo sapiens
agacaucuuugacaucaua

SEQ ID NO: 901912 - RNA, 19 nt, Homo sapiens
ucaagaggcugacgcagaa

SEQ ID NO: 901913 - RNA, 19 nt, Homo sapiens
ggacaggucuagggagguu

SEQ ID NO: 901914 - RNA, 19 nt, Homo sapiens
gaugagcgacguagugguu

SEQ ID NO: 901915 - RNA, 19 nt, Homo sapiens
agaagcuagugcagacuua

SEQ ID NO: 901916 - RNA, 19 nt, Homo sapiens
guaaggaggacauguucaa

SEQ ID NO: 901917 - RNA, 19 nt, Homo sapiens
gaaaauucaugaagacauc

SEQ ID NO: 901918 - RNA, 19 nt, Homo sapiens
caucauagaccgagaagca

SEQ ID NO: 901919 - RNA, 19 nt, Homo sapiens
cggcuccacuuucucauga

SEQ ID NO: 901920 - RNA, 19 nt, Homo sapiens
ccggcuacaugaacaauga

SEQ ID NO: 901921 - RNA, 19 nt, Homo sapiens
gcacccaggagcagugauu

SEQ ID NO: 901922 - RNA, 19 nt, Homo sapiens
cagcaucuccucgcucuuu

SEQ ID NO: 901923 - RNA, 19 nt, Homo sapiens
gugcagacuuauucagugu

SEQ ID NO: 901924 - RNA, 19 nt, Homo sapiens
gaggaauucuuggaugaca

SEQ ID NO: 901925 - RNA, 19 nt, Homo sapiens
ggacaacacagcccugaac

SEQ ID NO: 901926 - RNA, 19 nt, Homo sapiens
acaauucacuccugacacu

SEQ ID NO: 901927 - RNA, 19 nt, Homo sapiens
agauggaagugacaguuug

SEQ ID NO: 901928 - RNA, 19 nt, Homo sapiens
gcagauggaagugacaguu

SEQ ID NO: 901929 - RNA, 19 nt, Homo sapiens
acgaggaauucuuggauga

SEQ ID NO: 901930 - RNA, 19 nt, Homo sapiens
aaggacaacuuugaugaga

SEQ ID NO: 901931 - RNA, 19 nt, Homo sapiens
aggaggacauguucaagga

SEQ ID NO: 901932 - RNA, 19 nt, Homo sapiens
ccacccagguccacaagag

SEQ ID NO: 901933 - RNA, 19 nt, Homo sapiens
ugaaccggauugccacaga

SEQ ID NO: 901934 - RNA, 19 nt, Homo sapiens
cagauggaagugacaguuu

SEQ ID NO: 901935 - RNA, 19 nt, Homo sapiens
gagaagcagauggaaguga

SEQ ID NO: 901936 - RNA, 19 nt, Homo sapiens
ggucagcgggcucaugaug

SEQ ID NO: 901937 - RNA, 19 nt, Homo sapiens
ugacgcagaacgcagauug

SEQ ID NO: 901938 - RNA, 19 nt, Homo sapiens
guucuggccugggcuccua

SEQ ID NO: 901939 - RNA, 19 nt, Homo sapiens
ccucaucgccucgcucauu

SEQ ID NO: 901940 - RNA, 19 nt, Homo sapiens
ugacccagcuucaccucau

SEQ ID NO: 901941 - RNA, 19 nt, Homo sapiens
ccacagaccgccugcacau

SEQ ID NO: 901942 - RNA, 19 nt, Homo sapiens
gugagaaaauucaugaaga

SEQ ID NO: 901943 - RNA, 19 nt, Homo sapiens
aggaggagcuggcaacaac

SEQ ID NO: 901944 - RNA, 19 nt, Homo sapiens
guucaggagcucauugaug

SEQ ID NO: 901945 - RNA, 19 nt, Homo sapiens
gaugagauggacaggucua

SEQ ID NO: 901946 - RNA, 19 nt, Homo sapiens
ccacggcuccacuuucuca

SEQ ID NO: 901947 - RNA, 19 nt, Homo sapiens
cgagaugagcgacguagug

SEQ ID NO: 901948 - RNA, 19 nt, Homo sapiens
cauguucaaggacaacuuu

SEQ ID NO: 901949 - RNA, 19 nt, Homo sapiens
gaccaaccacugcuacauc

SEQ ID NO: 901950 - RNA, 19 nt, Homo sapiens
ggacgagaugagcgacgua

SEQ ID NO: 901951 - RNA, 19 nt, Homo sapiens
guaauaaagcuugguuguc

SEQ ID NO: 901952 - RNA, 19 nt, Homo sapiens
gaagcuagugcagacuuau

SEQ ID NO: 901953 - RNA, 19 nt, Homo sapiens
ccagugcggcaaccagauu

SEQ ID NO: 901954 - RNA, 19 nt, Homo sapiens
acaucuaccugucggaaca

SEQ ID NO: 901955 - RNA, 19 nt, Homo sapiens
uuguucagcucuaauaaag

SEQ ID NO: 901956 - RNA, 19 nt, Homo sapiens
ccgagaagcagauggaagu

SEQ ID NO: 901957 - RNA, 19 nt, Homo sapiens
gacccagcuucaccucaug

SEQ ID NO: 901958 - RNA, 19 nt, Homo sapiens
ccacgguccuggaugucau

SEQ ID NO: 901959 - RNA, 19 nt, Homo sapiens
cuacaucgccauccucaac

SEQ ID NO: 901960 - RNA, 19 nt, Homo sapiens
ugacaucauagaccgagaa

SEQ ID NO: 901961 - RNA, 19 nt, Homo sapiens
ggucuagggagguuguuca

SEQ ID NO: 901962 - RNA, 19 nt, Homo sapiens
caaggacaacuuugaugag

SEQ ID NO: 901963 - RNA, 19 nt, Homo sapiens
ccagauuggguucgaguuc

SEQ ID NO: 901964 - RNA, 19 nt, Homo sapiens
gcuuguucagcucuaauaa

SEQ ID NO: 901965 - RNA, 19 nt, Homo sapiens
ggcagacgaugagcacuac

SEQ ID NO: 901966 - RNA, 19 nt, Homo sapiens
cagauuggguucgaguucu

SEQ ID NO: 901967 - RNA, 19 nt, Homo sapiens
gaggaggagcuggcaacaa

SEQ ID NO: 901968 - RNA, 19 nt, Homo sapiens
agaaaaugaugcccagguu

SEQ ID NO: 901969 - RNA, 19 nt, Homo sapiens
gccagcaguuugacaagcu

SEQ ID NO: 901970 - RNA, 19 nt, Homo sapiens
gugguucagcccuacaauu

SEQ ID NO: 901971 - RNA, 19 nt, Homo sapiens
gaggagcuggcaacaacug

SEQ ID NO: 901972 - RNA, 19 nt, Homo sapiens
ucauggacaacccuucuug

SEQ ID NO: 901973 - RNA, 19 nt, Homo sapiens
ccacccagccagacuacau

SEQ ID NO: 901974 - RNA, 19 nt, Homo sapiens
caucuccucgcucuuugaa

SEQ ID NO: 901975 - RNA, 19 nt, Homo sapiens
guucagcccuacaauucac

SEQ ID NO: 901976 - RNA, 19 nt, Homo sapiens
ugguucagcccuacaauuc

SEQ ID NO: 901977 - RNA, 19 nt, Homo sapiens
ugagcgacguagugguuca

SEQ ID NO: 901978 - RNA, 19 nt, Homo sapiens
ggaauaaguugcagaaauu

SEQ ID NO: 901979 - RNA, 19 nt, Homo sapiens
ggaagaaacagcagaauua

SEQ ID NO: 901980 - RNA, 19 nt, Homo sapiens
caacauugcuccugaauuc

SEQ ID NO: 901981 - RNA, 19 nt, Homo sapiens
caggaaggauguagaaaua

SEQ ID NO: 901982 - RNA, 19 nt, Homo sapiens
gaaggacacuugcuggaaa

SEQ ID NO: 901983 - RNA, 19 nt, Homo sapiens
ggaagaaggacaaagauuu

SEQ ID NO: 901984 - RNA, 19 nt, Homo sapiens
ggaauucacacaugcauaa

SEQ ID NO: 901985 - RNA, 19 nt, Homo sapiens
ccucuuagccgcagcauua

SEQ ID NO: 901986 - RNA, 19 nt, Homo sapiens
cuucagggcucccaagaua

SEQ ID NO: 901987 - RNA, 19 nt, Homo sapiens
agaaagaaguggaagaguu

SEQ ID NO: 901988 - RNA, 19 nt, Homo sapiens
ggaaggauguagaaauaag

SEQ ID NO: 901989 - RNA, 19 nt, Homo sapiens
gaaagaaguggaagaguuc

SEQ ID NO: 901990 - RNA, 19 nt, Homo sapiens
gaauaggaguggguagaaa

SEQ ID NO: 901991 - RNA, 19 nt, Homo sapiens
gcacccaaauccuaugcua

SEQ ID NO: 901992 - RNA, 19 nt, Homo sapiens
gaagaaggacaaagauuuc

SEQ ID NO: 901993 - RNA, 19 nt, Homo sapiens
gggaagaucagacaacauu

SEQ ID NO: 901994 - RNA, 19 nt, Homo sapiens
caucugaucuaucuuguuc

SEQ ID NO: 901995 - RNA, 19 nt, Homo sapiens
acaaggacacuauguauuu

SEQ ID NO: 901996 - RNA, 19 nt, Homo sapiens
gccugucacucuucauuua

SEQ ID NO: 901997 - RNA, 19 nt, Homo sapiens
gaagaaacagcagaauuau

SEQ ID NO: 901998 - RNA, 19 nt, Homo sapiens
uggaauaaguugcagaaau

SEQ ID NO: 901999 - RNA, 19 nt, Homo sapiens
gaagaguuccuuucaacau

SEQ ID NO: 902000 - RNA, 19 nt, Homo sapiens
gaaacuaguuggaauucac

SEQ ID NO: 902001 - RNA, 19 nt, Homo sapiens
ggaaaaggguaauaugguu

SEQ ID NO: 902002 - RNA, 19 nt, Homo sapiens
gcauuaagccugucacucu

SEQ ID NO: 902003 - RNA, 19 nt, Homo sapiens
guacagggguuaaguccua

SEQ ID NO: 902004 - RNA, 19 nt, Homo sapiens
aaacaaggacacuauguau

SEQ ID NO: 902005 - RNA, 19 nt, Homo sapiens
agaauucagugacaaggaa

SEQ ID NO: 902006 - RNA, 19 nt, Homo sapiens
gaaaugcuacaaauggaau

SEQ ID NO: 902007 - RNA, 19 nt, Homo sapiens
ucccaucucuacaaucuuu

SEQ ID NO: 902008 - RNA, 19 nt, Homo sapiens
gcuggaaacuaguuggaau

SEQ ID NO: 902009 - RNA, 19 nt, Homo sapiens
uacuagagcucaaucuguu

SEQ ID NO: 902010 - RNA, 19 nt, Homo sapiens
gaaggacaaagauuucuca

SEQ ID NO: 902011 - RNA, 19 nt, Homo sapiens
ggaaacuaguuggaauuca

SEQ ID NO: 902012 - RNA, 19 nt, Homo sapiens
uuaauagccuguagagaca

SEQ ID NO: 902013 - RNA, 19 nt, Homo sapiens
ggaauaggaguggguagaa

SEQ ID NO: 902014 - RNA, 19 nt, Homo sapiens
gacacuugcuggaaacuag

SEQ ID NO: 902015 - RNA, 19 nt, Homo sapiens
ggaaggacacuugcuggaa

SEQ ID NO: 902016 - RNA, 19 nt, Homo sapiens
gaucuaucuuguucucuuc

SEQ ID NO: 902017 - RNA, 19 nt, Homo sapiens
acaaagauuucucauccau

SEQ ID NO: 902018 - RNA, 19 nt, Homo sapiens
cuacaaauggaauaaguug

SEQ ID NO: 902019 - RNA, 19 nt, Homo sapiens
ucaggaagaaggacaaaga

SEQ ID NO: 902020 - RNA, 19 nt, Homo sapiens
gcuccugaauucccacaga

SEQ ID NO: 902021 - RNA, 19 nt, Homo sapiens
uuaauagcagcuccucuua

SEQ ID NO: 902022 - RNA, 19 nt, Homo sapiens
gguuugcuaucaaugaaau

SEQ ID NO: 902023 - RNA, 19 nt, Homo sapiens
gguuaaguccuauggaaga

SEQ ID NO: 902024 - RNA, 19 nt, Homo sapiens
agagcucaaucuguuauuu

SEQ ID NO: 902025 - RNA, 19 nt, Homo sapiens
agacaacauugcuccugaa

SEQ ID NO: 902026 - RNA, 19 nt, Homo sapiens
ugggaacccuugaccaaug

SEQ ID NO: 902027 - RNA, 19 nt, Homo sapiens
gagagagagcugcuucaug

SEQ ID NO: 902028 - RNA, 19 nt, Homo sapiens
guuaaguccuauggaagaa

SEQ ID NO: 902029 - RNA, 19 nt, Homo sapiens
gagcucaaucuguuauuuc

SEQ ID NO: 902030 - RNA, 19 nt, Homo sapiens
gcucugaagacaucaugaa

SEQ ID NO: 902031 - RNA, 19 nt, Homo sapiens
ccaggaaggauguagaaau

SEQ ID NO: 902032 - RNA, 19 nt, Homo sapiens
ggaaugccaggaaggaugu

SEQ ID NO: 902033 - RNA, 19 nt, Homo sapiens
acacagaauucagugacaa

SEQ ID NO: 902034 - RNA, 19 nt, Homo sapiens
gaagaucagacaacauugc

SEQ ID NO: 902035 - RNA, 19 nt, Homo sapiens
agagaaggucggagucuuu

SEQ ID NO: 902036 - RNA, 19 nt, Homo sapiens
ugaguggguuugcuaucaa

SEQ ID NO: 902037 - RNA, 19 nt, Homo sapiens
ugaucuaucuuguucucuu

SEQ ID NO: 902038 - RNA, 19 nt, Homo sapiens
cauaaccuguaaauguguu

SEQ ID NO: 902039 - RNA, 19 nt, Homo sapiens
gacacagaauucagugaca

SEQ ID NO: 902040 - RNA, 19 nt, Homo sapiens
cauuaagccugucacucuu

SEQ ID NO: 902041 - RNA, 19 nt, Homo sapiens
caaauccuaugcuauucgu

SEQ ID NO: 902042 - RNA, 19 nt, Homo sapiens
caaugaaaugcuacaaaug

SEQ ID NO: 902043 - RNA, 19 nt, Homo sapiens
gaaaaggguaauaugguuu

SEQ ID NO: 902044 - RNA, 19 nt, Homo sapiens
gugcaauuauucacuagag

SEQ ID NO: 902045 - RNA, 19 nt, Homo sapiens
caaggacacuauguauuuu

SEQ ID NO: 902046 - RNA, 19 nt, Homo sapiens
gacaaagauuucucaucca

SEQ ID NO: 902047 - RNA, 19 nt, Homo sapiens
ggacacuugcuggaaacua

SEQ ID NO: 902048 - RNA, 19 nt, Homo sapiens
gaguggguuugcuaucaau

SEQ ID NO: 902049 - RNA, 19 nt, Homo sapiens
ucucaccucuccuucacuu

SEQ ID NO: 902050 - RNA, 19 nt, Homo sapiens
gggaacccuugaccaaugg

SEQ ID NO: 902051 - RNA, 19 nt, Homo sapiens
gaauucacacaugcauaaa

SEQ ID NO: 902052 - RNA, 19 nt, Homo sapiens
auuauucacuagagcauga

SEQ ID NO: 902053 - RNA, 19 nt, Homo sapiens
uggaagaaacagcagaauu

SEQ ID NO: 902054 - RNA, 19 nt, Homo sapiens
ggaagaucagacaacauug

SEQ ID NO: 902055 - RNA, 19 nt, Homo sapiens
gcuacaaauggaauaaguu

SEQ ID NO: 902056 - RNA, 19 nt, Homo sapiens
gggcucccaagauaacaua

SEQ ID NO: 902057 - RNA, 19 nt, Homo sapiens
ucaccaccaucugaucuau

SEQ ID NO: 902058 - RNA, 19 nt, Homo sapiens
cuuggguucuggagaguuu

SEQ ID NO: 902059 - RNA, 19 nt, Homo sapiens
agaguuccuuucaacauca

SEQ ID NO: 902060 - RNA, 19 nt, Homo sapiens
aagaguuccuuucaacauc

SEQ ID NO: 902061 - RNA, 19 nt, Homo sapiens
caugggaacccuugaccaa

SEQ ID NO: 902062 - RNA, 19 nt, Homo sapiens
gaauucagugacaaggaaa

SEQ ID NO: 902063 - RNA, 19 nt, Homo sapiens
acccaaauccuaugcuauu

SEQ ID NO: 902064 - RNA, 19 nt, Homo sapiens
gguccugaguggaaauucu

SEQ ID NO: 902065 - RNA, 19 nt, Homo sapiens
uagagaaggucggagucuu

SEQ ID NO: 902066 - RNA, 19 nt, Homo sapiens
cuguaaagcuagagaaggu

SEQ ID NO: 902067 - RNA, 19 nt, Homo sapiens
ugaaaugcuacaaauggaa

SEQ ID NO: 902068 - RNA, 19 nt, Homo sapiens
aaugaaaugcuacaaaugg

SEQ ID NO: 902069 - RNA, 19 nt, Homo sapiens
guagaaagaaguggaagag

SEQ ID NO: 902070 - RNA, 19 nt, Homo sapiens
gagcagcaagcuacuagag

SEQ ID NO: 902071 - RNA, 19 nt, Homo sapiens
gguagaaagaaguggaaga

SEQ ID NO: 902072 - RNA, 19 nt, Homo sapiens
gggaauaggaguggguaga

SEQ ID NO: 902073 - RNA, 19 nt, Homo sapiens
aauagcagcuccucuuagc

SEQ ID NO: 902074 - RNA, 19 nt, Homo sapiens
uaaguccuauggaagaaac

SEQ ID NO: 902075 - RNA, 19 nt, Homo sapiens
aaaaggcucugaagacauc

SEQ ID NO: 902076 - RNA, 19 nt, Homo sapiens
uggguuugcuaucaaugaa

SEQ ID NO: 902077 - RNA, 19 nt, Homo sapiens
ggaggcagcacccaaaucc

SEQ ID NO: 902078 - RNA, 19 nt, Homo sapiens
gagagaggcauaacuaaua

SEQ ID NO: 902079 - RNA, 19 nt, Homo sapiens
cuacuuagauucuguggaa

SEQ ID NO: 902080 - RNA, 19 nt, Homo sapiens
ccucuuagccgcagcauua

SEQ ID NO: 902081 - RNA, 19 nt, Homo sapiens
gaaugucacuaucccaaga

SEQ ID NO: 902082 - RNA, 19 nt, Homo sapiens
gcacccaaauccuaugcua

SEQ ID NO: 902083 - RNA, 19 nt, Homo sapiens
caucugaucuaucuuguuc

SEQ ID NO: 902084 - RNA, 19 nt, Homo sapiens
agagaggcauaacuaauaa

SEQ ID NO: 902085 - RNA, 19 nt, Homo sapiens
gccugucacucuucauuua

SEQ ID NO: 902086 - RNA, 19 nt, Homo sapiens
ggacagcccaucuuucuca

SEQ ID NO: 902087 - RNA, 19 nt, Homo sapiens
ccaaacauccauuucugua

SEQ ID NO: 902088 - RNA, 19 nt, Homo sapiens
ccaagacccucacucgaau

SEQ ID NO: 902089 - RNA, 19 nt, Homo sapiens
auccauagcuuaccucauu

SEQ ID NO: 902090 - RNA, 19 nt, Homo sapiens
ggaaaaggguaauaugguu

SEQ ID NO: 902091 - RNA, 19 nt, Homo sapiens
cagcugccaugcccaguuu

SEQ ID NO: 902092 - RNA, 19 nt, Homo sapiens
ggagagaggcauaacuaau

SEQ ID NO: 902093 - RNA, 19 nt, Homo sapiens
gcaguucagcccauccaua

SEQ ID NO: 902094 - RNA, 19 nt, Homo sapiens
gcauuaagccugucacucu

SEQ ID NO: 902095 - RNA, 19 nt, Homo sapiens
agaauucagugacaaggaa

SEQ ID NO: 902096 - RNA, 19 nt, Homo sapiens
uagcuuaccucauucuuac

SEQ ID NO: 902097 - RNA, 19 nt, Homo sapiens
gacccucacucgaauguca

SEQ ID NO: 902098 - RNA, 19 nt, Homo sapiens
uuaauagccuguagagaca

SEQ ID NO: 902099 - RNA, 19 nt, Homo sapiens
gaucuaucuuguucucuuc

SEQ ID NO: 902100 - RNA, 19 nt, Homo sapiens
ucagagucaucuuaacaga

SEQ ID NO: 902101 - RNA, 19 nt, Homo sapiens
caaaugcugcuucaugcaa

SEQ ID NO: 902102 - RNA, 19 nt, Homo sapiens
uuaauagcagcuccucuua

SEQ ID NO: 902103 - RNA, 19 nt, Homo sapiens
guuccaggauagagaauca

SEQ ID NO: 902104 - RNA, 19 nt, Homo sapiens
aggcuccacuucugucuuu

SEQ ID NO: 902105 - RNA, 19 nt, Homo sapiens
aaggagagaggcauaacua

SEQ ID NO: 902106 - RNA, 19 nt, Homo sapiens
acacagaauucagugacaa

SEQ ID NO: 902107 - RNA, 19 nt, Homo sapiens
gcucugaagacaucaugaa

SEQ ID NO: 902108 - RNA, 19 nt, Homo sapiens
ugaguucacuagcaguuca

SEQ ID NO: 902109 - RNA, 19 nt, Homo sapiens
gcugucagagucaucuuaa

SEQ ID NO: 902110 - RNA, 19 nt, Homo sapiens
ugaucuaucuuguucucuu

SEQ ID NO: 902111 - RNA, 19 nt, Homo sapiens
gacacagaauucagugaca

SEQ ID NO: 902112 - RNA, 19 nt, Homo sapiens
cauuaagccugucacucuu

SEQ ID NO: 902113 - RNA, 19 nt, Homo sapiens
caaauccuaugcuauucgu

SEQ ID NO: 902114 - RNA, 19 nt, Homo sapiens
gaaaaggguaauaugguuu

SEQ ID NO: 902115 - RNA, 19 nt, Homo sapiens
caaccuuccauuccuauuc

SEQ ID NO: 902116 - RNA, 19 nt, Homo sapiens
aggcauaacuaauaacacu

SEQ ID NO: 902117 - RNA, 19 nt, Homo sapiens
ggaccuguauguggagaag

SEQ ID NO: 902118 - RNA, 19 nt, Homo sapiens
ucucaccucuccuucacuu

SEQ ID NO: 902119 - RNA, 19 nt, Homo sapiens
uacccuggcugguucauag

SEQ ID NO: 902120 - RNA, 19 nt, Homo sapiens
ggagaagaaagcacagaag

SEQ ID NO: 902121 - RNA, 19 nt, Homo sapiens
gcuuaccucauucuuacua

SEQ ID NO: 902122 - RNA, 19 nt, Homo sapiens
gcgacugaguucacuagca

SEQ ID NO: 902123 - RNA, 19 nt, Homo sapiens
cacuuuccauucuuucuug

SEQ ID NO: 902124 - RNA, 19 nt, Homo sapiens
ucaccaccaucugaucuau

SEQ ID NO: 902125 - RNA, 19 nt, Homo sapiens
caggacagcccaucuuucu

SEQ ID NO: 902126 - RNA, 19 nt, Homo sapiens
gaauucagugacaaggaaa

SEQ ID NO: 902127 - RNA, 19 nt, Homo sapiens
gguccugaguggaaauucu

SEQ ID NO: 902128 - RNA, 19 nt, Homo sapiens
acccaaauccuaugcuauu

SEQ ID NO: 902129 - RNA, 19 nt, Homo sapiens
cuacuuugcagcuuaagga

SEQ ID NO: 902130 - RNA, 19 nt, Homo sapiens
aauagcagcuccucuuagc

SEQ ID NO: 902131 - RNA, 19 nt, Homo sapiens
gccaacccaugauguagag

SEQ ID NO: 902132 - RNA, 19 nt, Homo sapiens
ucacucgaaugucacuauc

SEQ ID NO: 902133 - RNA, 19 nt, Homo sapiens
aaaaggcucugaagacauc

SEQ ID NO: 902134 - RNA, 19 nt, Homo sapiens
ccaucuuucucaccaagga

SEQ ID NO: 902135 - RNA, 19 nt, Homo sapiens
aucccaagaugaaaccuaa

SEQ ID NO: 902136 - RNA, 19 nt, Homo sapiens
gucacuaucccaagaugaa

SEQ ID NO: 902137 - RNA, 19 nt, Homo sapiens
ggaggcagcacccaaaucc

SEQ ID NO: 902138 - RNA, 19 nt, Homo sapiens
auagcuuaccucauucuua

SEQ ID NO: 902139 - RNA, 19 nt, Homo sapiens
ccuaugcuauucgugauuc

SEQ ID NO: 902140 - RNA, 19 nt, Homo sapiens
aggcagcacccaaauccua

SEQ ID NO: 902141 - RNA, 19 nt, Homo sapiens
caucaggacagcccaucuu

SEQ ID NO: 902142 - RNA, 19 nt, Homo sapiens
caccaucugaucuaucuug

SEQ ID NO: 902143 - RNA, 19 nt, Homo sapiens
cuccaaacauccauuucug

SEQ ID NO: 902144 - RNA, 19 nt, Homo sapiens
ugucagagucaucuuaaca

SEQ ID NO: 902145 - RNA, 19 nt, Homo sapiens
caccaaggagagaggcaua

SEQ ID NO: 902146 - RNA, 19 nt, Homo sapiens
gagacacagaauucaguga

SEQ ID NO: 902147 - RNA, 19 nt, Homo sapiens
gcaaccuuccauuccuauu

SEQ ID NO: 902148 - RNA, 19 nt, Homo sapiens
accaagacccucacucgaa

SEQ ID NO: 902149 - RNA, 19 nt, Homo sapiens
caguucagcccauccauag

SEQ ID NO: 902150 - RNA, 19 nt, Homo sapiens
uuaagccugucacucuuca

SEQ ID NO: 902151 - RNA, 19 nt, Homo sapiens
gccaugcccaguuuaguca

SEQ ID NO: 902152 - RNA, 19 nt, Homo sapiens
acaaaaggcucugaagaca

SEQ ID NO: 902153 - RNA, 19 nt, Homo sapiens
aaaauaucauggaccugua

SEQ ID NO: 902154 - RNA, 19 nt, Homo sapiens
uuuaauagcagcuccucuu

SEQ ID NO: 902155 - RNA, 19 nt, Homo sapiens
ucacuuuccauucuuucuu

SEQ ID NO: 902156 - RNA, 19 nt, Homo sapiens
caaacauccauuucuguac

SEQ ID NO: 902157 - RNA, 19 nt, Homo sapiens
ccugucacucuucauuuaa

SEQ ID NO: 902158 - RNA, 19 nt, Homo sapiens
uaauagcagcuccucuuag

SEQ ID NO: 902159 - RNA, 19 nt, Homo sapiens
augcaaccuuccauuccua

SEQ ID NO: 902160 - RNA, 19 nt, Homo sapiens
cagaucauuaugcgacuga

SEQ ID NO: 902161 - RNA, 19 nt, Homo sapiens
cccaaauccuaugcuauuc

SEQ ID NO: 902162 - RNA, 19 nt, Homo sapiens
guagagacacagaauucag

SEQ ID NO: 902163 - RNA, 19 nt, Homo sapiens
cugaguggaaauucuuuaa

SEQ ID NO: 902164 - RNA, 19 nt, Homo sapiens
ccugaguggaaauucuuua

SEQ ID NO: 902165 - RNA, 19 nt, Homo sapiens
caccaaaccugcucacuaa

SEQ ID NO: 902166 - RNA, 19 nt, Homo sapiens
ccagugaggucagcgauua

SEQ ID NO: 902167 - RNA, 19 nt, Homo sapiens
gaacuuaaacccgaagaaa

SEQ ID NO: 902168 - RNA, 19 nt, Homo sapiens
ugaccaggaucacaaagua

SEQ ID NO: 902169 - RNA, 19 nt, Homo sapiens
gaacaggaaacacauugaa

SEQ ID NO: 902170 - RNA, 19 nt, Homo sapiens
gcauuagccucauccuuga

SEQ ID NO: 902171 - RNA, 19 nt, Homo sapiens
ccagagaucuucuuugcau

SEQ ID NO: 902172 - RNA, 19 nt, Homo sapiens
guccaaaggugaagaacuu

SEQ ID NO: 902173 - RNA, 19 nt, Homo sapiens
ucauagcaguuccagauaa

SEQ ID NO: 902174 - RNA, 19 nt, Homo sapiens
ccgaagaaauucagcauuc

SEQ ID NO: 902175 - RNA, 19 nt, Homo sapiens
cauagcaguuccagauaaa

SEQ ID NO: 902176 - RNA, 19 nt, Homo sapiens
ugacaaggauaaaggacaa

SEQ ID NO: 902177 - RNA, 19 nt, Homo sapiens
caggaaacacauugaauuu

SEQ ID NO: 902178 - RNA, 19 nt, Homo sapiens
gaagaaggagaaacugaug

SEQ ID NO: 902179 - RNA, 19 nt, Homo sapiens
gaaaggaaguccgauucuc

SEQ ID NO: 902180 - RNA, 19 nt, Homo sapiens
ggagaaaggaaguccgauu

SEQ ID NO: 902181 - RNA, 19 nt, Homo sapiens
gagaacaggaaacacauug

SEQ ID NO: 902182 - RNA, 19 nt, Homo sapiens
gagaaaggaaguccgauuc

SEQ ID NO: 902183 - RNA, 19 nt, Homo sapiens
gcccagagaucuucuuugc

SEQ ID NO: 902184 - RNA, 19 nt, Homo sapiens
gauaaaggacaaagucauc

SEQ ID NO: 902185 - RNA, 19 nt, Homo sapiens
agagaucuucuuugcauua

SEQ ID NO: 902186 - RNA, 19 nt, Homo sapiens
caaaggugaagaacuuaaa

SEQ ID NO: 902187 - RNA, 19 nt, Homo sapiens
cgaagaaauucagcauuca

SEQ ID NO: 902188 - RNA, 19 nt, Homo sapiens
ggucagcgauuaggaaacu

SEQ ID NO: 902189 - RNA, 19 nt, Homo sapiens
acaggaaacacauugaauu

SEQ ID NO: 902190 - RNA, 19 nt, Homo sapiens
gaagaaauucagcauucau

SEQ ID NO: 902191 - RNA, 19 nt, Homo sapiens
ggugacagauaaauuugag

SEQ ID NO: 902192 - RNA, 19 nt, Homo sapiens
gaagcuggcugcccaaaag

SEQ ID NO: 902193 - RNA, 19 nt, Homo sapiens
acaccaaaccugcucacua

SEQ ID NO: 902194 - RNA, 19 nt, Homo sapiens
cagauaaauuugagaacag

SEQ ID NO: 902195 - RNA, 19 nt, Homo sapiens
gcaccuccugcaauuguaa

SEQ ID NO: 902196 - RNA, 19 nt, Homo sapiens
ccaaaggugaagaacuuaa

SEQ ID NO: 902197 - RNA, 19 nt, Homo sapiens
gagaucuucuuugcauuag

SEQ ID NO: 902198 - RNA, 19 nt, Homo sapiens
ggacucugggaaucucaua

SEQ ID NO: 902199 - RNA, 19 nt, Homo sapiens
acuuaaacccgaagaaauu

SEQ ID NO: 902200 - RNA, 19 nt, Homo sapiens
gaggucagcgauuaggaaa

SEQ ID NO: 902201 - RNA, 19 nt, Homo sapiens
ugaacgccuuccucgcuaa

SEQ ID NO: 902202 - RNA, 19 nt, Homo sapiens
ggauaaaggacaaagucau

SEQ ID NO: 902203 - RNA, 19 nt, Homo sapiens
cuacauacgcccagagauc

SEQ ID NO: 902204 - RNA, 19 nt, Homo sapiens
ucucauagcaguuccagau

SEQ ID NO: 902205 - RNA, 19 nt, Homo sapiens
acgccuuccucgcuaauuu

SEQ ID NO: 902206 - RNA, 19 nt, Homo sapiens
cagcauucaugaccaggau

SEQ ID NO: 902207 - RNA, 19 nt, Homo sapiens
gaaauucagcauucaugac

SEQ ID NO: 902208 - RNA, 19 nt, Homo sapiens
cagagaucuucuuugcauu

SEQ ID NO: 902209 - RNA, 19 nt, Homo sapiens
acacaaguccaaaggugaa

SEQ ID NO: 902210 - RNA, 19 nt, Homo sapiens
aggagaaacugaugaagcu

SEQ ID NO: 902211 - RNA, 19 nt, Homo sapiens
agaaggagaaacugaugaa

SEQ ID NO: 902212 - RNA, 19 nt, Homo sapiens
gggaaucucauagcaguuc

SEQ ID NO: 902213 - RNA, 19 nt, Homo sapiens
ugaagaaggagaaacugau

SEQ ID NO: 902214 - RNA, 19 nt, Homo sapiens
agaaauucagcauucauga

SEQ ID NO: 902215 - RNA, 19 nt, Homo sapiens
uuaggaaacugccccauug

SEQ ID NO: 902216 - RNA, 19 nt, Homo sapiens
caaguccaaaggugaagaa

SEQ ID NO: 902217 - RNA, 19 nt, Homo sapiens
gaacgccuuccucgcuaau

SEQ ID NO: 902218 - RNA, 19 nt, Homo sapiens
gcucagccucugcggagaa

SEQ ID NO: 902219 - RNA, 19 nt, Homo sapiens
ugagaacaggaaacacauu

SEQ ID NO: 902220 - RNA, 19 nt, Homo sapiens
ucucuacugugacaaggau

SEQ ID NO: 902221 - RNA, 19 nt, Homo sapiens
gcauucaugaccaggauca

SEQ ID NO: 902222 - RNA, 19 nt, Homo sapiens
ugaggucagcgauuaggaa

SEQ ID NO: 902223 - RNA, 19 nt, Homo sapiens
ucaaccaguuugcaaagcu

SEQ ID NO: 902224 - RNA, 19 nt, Homo sapiens
ccucgcuaauuugaacuaa

SEQ ID NO: 902225 - RNA, 19 nt, Homo sapiens
gaaggagaaacugaugaag

SEQ ID NO: 902226 - RNA, 19 nt, Homo sapiens
ccaaaccugcucacuaaaa

SEQ ID NO: 902227 - RNA, 19 nt, Homo sapiens
aagaaauucagcauucaug

SEQ ID NO: 902228 - RNA, 19 nt, Homo sapiens
ggaguuuugucucuacugu

SEQ ID NO: 902229 - RNA, 19 nt, Homo sapiens
gggugacagauaaauuuga

SEQ ID NO: 902230 - RNA, 19 nt, Homo sapiens
aaagucauccaucccuuca

SEQ ID NO: 902231 - RNA, 19 nt, Homo sapiens
caccaaaccugcucacuaa

SEQ ID NO: 902232 - RNA, 19 nt, Homo sapiens
ccagugaggucagcgauua

SEQ ID NO: 902233 - RNA, 19 nt, Homo sapiens
gaacuuaaacccgaagaaa

SEQ ID NO: 902234 - RNA, 19 nt, Homo sapiens
ugaccaggaucacaaagua

SEQ ID NO: 902235 - RNA, 19 nt, Homo sapiens
gaacaggaaacacauugaa

SEQ ID NO: 902236 - RNA, 19 nt, Homo sapiens
gcauuagccucauccuuga

SEQ ID NO: 902237 - RNA, 19 nt, Homo sapiens
ccagagaucuucuuugcau

SEQ ID NO: 902238 - RNA, 19 nt, Homo sapiens
guccaaaggugaagaacuu

SEQ ID NO: 902239 - RNA, 19 nt, Homo sapiens
ucauagcaguuccagauaa

SEQ ID NO: 902240 - RNA, 19 nt, Homo sapiens
ccgaagaaauucagcauuc

SEQ ID NO: 902241 - RNA, 19 nt, Homo sapiens
cauagcaguuccagauaaa

SEQ ID NO: 902242 - RNA, 19 nt, Homo sapiens
ugacaaggauaaaggacaa

SEQ ID NO: 902243 - RNA, 19 nt, Homo sapiens
caggaaacacauugaauuu

SEQ ID NO: 902244 - RNA, 19 nt, Homo sapiens
gaagaaggagaaacugaug

SEQ ID NO: 902245 - RNA, 19 nt, Homo sapiens
gaaaggaaguccgauucuc

SEQ ID NO: 902246 - RNA, 19 nt, Homo sapiens
ggagaaaggaaguccgauu

SEQ ID NO: 902247 - RNA, 19 nt, Homo sapiens
gagaacaggaaacacauug

SEQ ID NO: 902248 - RNA, 19 nt, Homo sapiens
gagaaaggaaguccgauuc

SEQ ID NO: 902249 - RNA, 19 nt, Homo sapiens
gcccagagaucuucuuugc

SEQ ID NO: 902250 - RNA, 19 nt, Homo sapiens
gauaaaggacaaagucauc

SEQ ID NO: 902251 - RNA, 19 nt, Homo sapiens
agagaucuucuuugcauua

SEQ ID NO: 902252 - RNA, 19 nt, Homo sapiens
caaaggugaagaacuuaaa

SEQ ID NO: 902253 - RNA, 19 nt, Homo sapiens
cgaagaaauucagcauuca

SEQ ID NO: 902254 - RNA, 19 nt, Homo sapiens
ggucagcgauuaggaaacu

SEQ ID NO: 902255 - RNA, 19 nt, Homo sapiens
acaggaaacacauugaauu

SEQ ID NO: 902256 - RNA, 19 nt, Homo sapiens
gaagaaauucagcauucau

SEQ ID NO: 902257 - RNA, 19 nt, Homo sapiens
ggugacagauaaauuugag

SEQ ID NO: 902258 - RNA, 19 nt, Homo sapiens
gaagcuggcugcccaaaag

SEQ ID NO: 902259 - RNA, 19 nt, Homo sapiens
acaccaaaccugcucacua

SEQ ID NO: 902260 - RNA, 19 nt, Homo sapiens
cagauaaauuugagaacag

SEQ ID NO: 902261 - RNA, 19 nt, Homo sapiens
gcaccuccugcaauuguaa

SEQ ID NO: 902262 - RNA, 19 nt, Homo sapiens
ccaaaggugaagaacuuaa

SEQ ID NO: 902263 - RNA, 19 nt, Homo sapiens
gagaucuucuuugcauuag

SEQ ID NO: 902264 - RNA, 19 nt, Homo sapiens
ggacucugggaaucucaua

SEQ ID NO: 902265 - RNA, 19 nt, Homo sapiens
acuuaaacccgaagaaauu

SEQ ID NO: 902266 - RNA, 19 nt, Homo sapiens
gaggucagcgauuaggaaa

SEQ ID NO: 902267 - RNA, 19 nt, Homo sapiens
ugaacgccuuccucgcuaa

SEQ ID NO: 902268 - RNA, 19 nt, Homo sapiens
ggauaaaggacaaagucau

SEQ ID NO: 902269 - RNA, 19 nt, Homo sapiens
cuacauacgcccagagauc

SEQ ID NO: 902270 - RNA, 19 nt, Homo sapiens
ucucauagcaguuccagau

SEQ ID NO: 902271 - RNA, 19 nt, Homo sapiens
acgccuuccucgcuaauuu

SEQ ID NO: 902272 - RNA, 19 nt, Homo sapiens
cagcauucaugaccaggau

SEQ ID NO: 902273 - RNA, 19 nt, Homo sapiens
gaaauucagcauucaugac

SEQ ID NO: 902274 - RNA, 19 nt, Homo sapiens
cagagaucuucuuugcauu

SEQ ID NO: 902275 - RNA, 19 nt, Homo sapiens
aggagaaacugaugaagcu

SEQ ID NO: 902276 - RNA, 19 nt, Homo sapiens
agaaggagaaacugaugaa

SEQ ID NO: 902277 - RNA, 19 nt, Homo sapiens
gggaaucucauagcaguuc

SEQ ID NO: 902278 - RNA, 19 nt, Homo sapiens
ugaagaaggagaaacugau

SEQ ID NO: 902279 - RNA, 19 nt, Homo sapiens
agaaauucagcauucauga

SEQ ID NO: 902280 - RNA, 19 nt, Homo sapiens
uuaggaaacugccccauug

SEQ ID NO: 902281 - RNA, 19 nt, Homo sapiens
gaacgccuuccucgcuaau

SEQ ID NO: 902282 - RNA, 19 nt, Homo sapiens
uagaagguccaaaggugaa

SEQ ID NO: 902283 - RNA, 19 nt, Homo sapiens
gcucagccucugcggagaa

SEQ ID NO: 902284 - RNA, 19 nt, Homo sapiens
ugagaacaggaaacacauu

SEQ ID NO: 902285 - RNA, 19 nt, Homo sapiens
ucucuacugugacaaggau

SEQ ID NO: 902286 - RNA, 19 nt, Homo sapiens
gcauucaugaccaggauca

SEQ ID NO: 902287 - RNA, 19 nt, Homo sapiens
ugaggucagcgauuaggaa

SEQ ID NO: 902288 - RNA, 19 nt, Homo sapiens
ucaaccaguuugcaaagcu

SEQ ID NO: 902289 - RNA, 19 nt, Homo sapiens
ccucgcuaauuugaacuaa

SEQ ID NO: 902290 - RNA, 19 nt, Homo sapiens
gaaggagaaacugaugaag

SEQ ID NO: 902291 - RNA, 19 nt, Homo sapiens
ccaaaccugcucacuaaaa

SEQ ID NO: 902292 - RNA, 19 nt, Homo sapiens
aagaaauucagcauucaug

SEQ ID NO: 902293 - RNA, 19 nt, Homo sapiens
ggaguuuugucucuacugu

SEQ ID NO: 902294 - RNA, 19 nt, Homo sapiens
gaagguccaaaggugaaga

SEQ ID NO: 902295 - RNA, 19 nt, Homo sapiens
gggugacagauaaauuuga

SEQ ID NO: 902296 - RNA, 19 nt, Homo sapiens
aaagucauccaucccuuca

SEQ ID NO: 902297 - RNA, 19 nt, Homo sapiens
caccaaaccugcucacuaa

SEQ ID NO: 902298 - RNA, 19 nt, Homo sapiens
ccagugaggucagcgauua

SEQ ID NO: 902299 - RNA, 19 nt, Homo sapiens
gaacaggaaacacauugaa

SEQ ID NO: 902300 - RNA, 19 nt, Homo sapiens
gcauuagccucauccuuga

SEQ ID NO: 902301 - RNA, 19 nt, Homo sapiens
ugacaaggauaaaggacaa

SEQ ID NO: 902302 - RNA, 19 nt, Homo sapiens
caggaaacacauugaauuu

SEQ ID NO: 902303 - RNA, 19 nt, Homo sapiens
gaagaaggagaaacugaug

SEQ ID NO: 902304 - RNA, 19 nt, Homo sapiens
gaaaggaaguccgauucuc

SEQ ID NO: 902305 - RNA, 19 nt, Homo sapiens
ggagaaaggaaguccgauu

SEQ ID NO: 902306 - RNA, 19 nt, Homo sapiens
gagaacaggaaacacauug

SEQ ID NO: 902307 - RNA, 19 nt, Homo sapiens
gagaaaggaaguccgauuc

SEQ ID NO: 902308 - RNA, 19 nt, Homo sapiens
gauaaaggacaaagucauc

SEQ ID NO: 902309 - RNA, 19 nt, Homo sapiens
agagaucuucuuugcauua

SEQ ID NO: 902310 - RNA, 19 nt, Homo sapiens
ggucagcgauuaggaaacu

SEQ ID NO: 902311 - RNA, 19 nt, Homo sapiens
acaggaaacacauugaauu

SEQ ID NO: 902312 - RNA, 19 nt, Homo sapiens
ggugacagauaaauuugag

SEQ ID NO: 902313 - RNA, 19 nt, Homo sapiens
gaagcuggcugcccaaaag

SEQ ID NO: 902314 - RNA, 19 nt, Homo sapiens
acaccaaaccugcucacua

SEQ ID NO: 902315 - RNA, 19 nt, Homo sapiens
cagauaaauuugagaacag

SEQ ID NO: 902316 - RNA, 19 nt, Homo sapiens
gcaccuccugcaauuguaa

SEQ ID NO: 902317 - RNA, 19 nt, Homo sapiens
gagaucuucuuugcauuag

SEQ ID NO: 902318 - RNA, 19 nt, Homo sapiens
gaggucagcgauuaggaaa

SEQ ID NO: 902319 - RNA, 19 nt, Homo sapiens
ugaacgccuuccucgcuaa

SEQ ID NO: 902320 - RNA, 19 nt, Homo sapiens
ggauaaaggacaaagucau

SEQ ID NO: 902321 - RNA, 19 nt, Homo sapiens
acgccuuccucgcuaauuu

SEQ ID NO: 902322 - RNA, 19 nt, Homo sapiens
aggagaaacugaugaagcu

SEQ ID NO: 902323 - RNA, 19 nt, Homo sapiens
agaaggagaaacugaugaa

SEQ ID NO: 902324 - RNA, 19 nt, Homo sapiens
ugaagaaggagaaacugau

SEQ ID NO: 902325 - RNA, 19 nt, Homo sapiens
uuaggaaacugccccauug

SEQ ID NO: 902326 - RNA, 19 nt, Homo sapiens
gaacgccuuccucgcuaau

SEQ ID NO: 902327 - RNA, 19 nt, Homo sapiens
gcucagccucugcggagaa

SEQ ID NO: 902328 - RNA, 19 nt, Homo sapiens
ugagaacaggaaacacauu

SEQ ID NO: 902329 - RNA, 19 nt, Homo sapiens
ucucuacugugacaaggau

SEQ ID NO: 902330 - RNA, 19 nt, Homo sapiens
ugaggucagcgauuaggaa

SEQ ID NO: 902331 - RNA, 19 nt, Homo sapiens
ucaaccaguuugcaaagcu

SEQ ID NO: 902332 - RNA, 19 nt, Homo sapiens
ccucgcuaauuugaacuaa

SEQ ID NO: 902333 - RNA, 19 nt, Homo sapiens
gaaggagaaacugaugaag

SEQ ID NO: 902334 - RNA, 19 nt, Homo sapiens
ccaaaccugcucacuaaaa

SEQ ID NO: 902335 - RNA, 19 nt, Homo sapiens
ggaguuuugucucuacugu

SEQ ID NO: 902336 - RNA, 19 nt, Homo sapiens
gggugacagauaaauuuga

SEQ ID NO: 902337 - RNA, 19 nt, Homo sapiens
aaagucauccaucccuuca

SEQ ID NO: 902338 - RNA, 19 nt, Homo sapiens
caccaaaccugcucacuaa

SEQ ID NO: 902339 - RNA, 19 nt, Homo sapiens
ccagugaggucagcgauua

SEQ ID NO: 902340 - RNA, 19 nt, Homo sapiens
gaacaggaaacacauugaa

SEQ ID NO: 902341 - RNA, 19 nt, Homo sapiens
gcauuagccucauccuuga

SEQ ID NO: 902342 - RNA, 19 nt, Homo sapiens
ugacaaggauaaaggacaa

SEQ ID NO: 902343 - RNA, 19 nt, Homo sapiens
caggaaacacauugaauuu

SEQ ID NO: 902344 - RNA, 19 nt, Homo sapiens
gaagaaggagaaacugaug

SEQ ID NO: 902345 - RNA, 19 nt, Homo sapiens
gaaaggaaguccgauucuc

SEQ ID NO: 902346 - RNA, 19 nt, Homo sapiens
ggagaaaggaaguccgauu

SEQ ID NO: 902347 - RNA, 19 nt, Homo sapiens
gagaacaggaaacacauug

SEQ ID NO: 902348 - RNA, 19 nt, Homo sapiens
gagaaaggaaguccgauuc

SEQ ID NO: 902349 - RNA, 19 nt, Homo sapiens
gauaaaggacaaagucauc

SEQ ID NO: 902350 - RNA, 19 nt, Homo sapiens
ggucagcgauuaggaaacu

SEQ ID NO: 902351 - RNA, 19 nt, Homo sapiens
acaggaaacacauugaauu

SEQ ID NO: 902352 - RNA, 19 nt, Homo sapiens
ggugacagauaaauuugag

SEQ ID NO: 902353 - RNA, 19 nt, Homo sapiens
gaagcuggcugcccaaaag

SEQ ID NO: 902354 - RNA, 19 nt, Homo sapiens
acaccaaaccugcucacua

SEQ ID NO: 902355 - RNA, 19 nt, Homo sapiens
cagauaaauuugagaacag

SEQ ID NO: 902356 - RNA, 19 nt, Homo sapiens
gcaccuccugcaauuguaa

SEQ ID NO: 902357 - RNA, 19 nt, Homo sapiens
gaggucagcgauuaggaaa

SEQ ID NO: 902358 - RNA, 19 nt, Homo sapiens
ugaacgccuuccucgcuaa

SEQ ID NO: 902359 - RNA, 19 nt, Homo sapiens
ggauaaaggacaaagucau

SEQ ID NO: 902360 - RNA, 19 nt, Homo sapiens
acgccuuccucgcuaauuu

SEQ ID NO: 902361 - RNA, 19 nt, Homo sapiens
aggagaaacugaugaagcu

SEQ ID NO: 902362 - RNA, 19 nt, Homo sapiens
agaaggagaaacugaugaa

SEQ ID NO: 902363 - RNA, 19 nt, Homo sapiens
ugaagaaggagaaacugau

SEQ ID NO: 902364 - RNA, 19 nt, Homo sapiens
uuaggaaacugccccauug

SEQ ID NO: 902365 - RNA, 19 nt, Homo sapiens
gaacgccuuccucgcuaau

SEQ ID NO: 902366 - RNA, 19 nt, Homo sapiens
gcucagccucugcggagaa

SEQ ID NO: 902367 - RNA, 19 nt, Homo sapiens
ugagaacaggaaacacauu

SEQ ID NO: 902368 - RNA, 19 nt, Homo sapiens
ucucuacugugacaaggau

SEQ ID NO: 902369 - RNA, 19 nt, Homo sapiens
ugaggucagcgauuaggaa

SEQ ID NO: 902370 - RNA, 19 nt, Homo sapiens
ucaaccaguuugcaaagcu

SEQ ID NO: 902371 - RNA, 19 nt, Homo sapiens
ccucgcuaauuugaacuaa

SEQ ID NO: 902372 - RNA, 19 nt, Homo sapiens
gaaggagaaacugaugaag

SEQ ID NO: 902373 - RNA, 19 nt, Homo sapiens
ccaaaccugcucacuaaaa

SEQ ID NO: 902374 - RNA, 19 nt, Homo sapiens
ggaguuuugucucuacugu

SEQ ID NO: 902375 - RNA, 19 nt, Homo sapiens
gggugacagauaaauuuga

SEQ ID NO: 902376 - RNA, 19 nt, Homo sapiens
aaagucauccaucccuuca

SEQ ID NO: 902377 - RNA, 19 nt, Homo sapiens
caccaaaccugcucacuaa

SEQ ID NO: 902378 - RNA, 19 nt, Homo sapiens
ccagugaggucagcgauua

SEQ ID NO: 902379 - RNA, 19 nt, Homo sapiens
gaacuuaaacccgaagaaa

SEQ ID NO: 902380 - RNA, 19 nt, Homo sapiens
ugaccaggaucacaaagua

SEQ ID NO: 902381 - RNA, 19 nt, Homo sapiens
gaacaggaaacacauugaa

SEQ ID NO: 902382 - RNA, 19 nt, Homo sapiens
gcauuagccucauccuuga

SEQ ID NO: 902383 - RNA, 19 nt, Homo sapiens
ccagagaucuucuuugcau

SEQ ID NO: 902384 - RNA, 19 nt, Homo sapiens
guccaaaggugaagaacuu

SEQ ID NO: 902385 - RNA, 19 nt, Homo sapiens
aaacagaaaccaaaggaaa

SEQ ID NO: 902386 - RNA, 19 nt, Homo sapiens
ucauagcaguuccagauaa

SEQ ID NO: 902387 - RNA, 19 nt, Homo sapiens
ccgaagaaauucagcauuc

SEQ ID NO: 902388 - RNA, 19 nt, Homo sapiens
cauagcaguuccagauaaa

SEQ ID NO: 902389 - RNA, 19 nt, Homo sapiens
ugacaaggauaaaggacaa

SEQ ID NO: 902390 - RNA, 19 nt, Homo sapiens
caggaaacacauugaauuu

SEQ ID NO: 902391 - RNA, 19 nt, Homo sapiens
gaagaaggagaaacugaug

SEQ ID NO: 902392 - RNA, 19 nt, Homo sapiens
ggaaacagaaaccaaagga

SEQ ID NO: 902393 - RNA, 19 nt, Homo sapiens
gaaaggaaguccgauucuc

SEQ ID NO: 902394 - RNA, 19 nt, Homo sapiens
gauaggagggaaacagaaa

SEQ ID NO: 902395 - RNA, 19 nt, Homo sapiens
ggagaaaggaaguccgauu

SEQ ID NO: 902396 - RNA, 19 nt, Homo sapiens
gagaacaggaaacacauug

SEQ ID NO: 902397 - RNA, 19 nt, Homo sapiens
gagaaaggaaguccgauuc

SEQ ID NO: 902398 - RNA, 19 nt, Homo sapiens
gcccagagaucuucuuugc

SEQ ID NO: 902399 - RNA, 19 nt, Homo sapiens
gagggaaacagaaaccaaa

SEQ ID NO: 902400 - RNA, 19 nt, Homo sapiens
gaaacagaaaccaaaggaa

SEQ ID NO: 902401 - RNA, 19 nt, Homo sapiens
gauaaaggacaaagucauc

SEQ ID NO: 902402 - RNA, 19 nt, Homo sapiens
agagaucuucuuugcauua

SEQ ID NO: 902403 - RNA, 19 nt, Homo sapiens
caaaggugaagaacuuaaa

SEQ ID NO: 902404 - RNA, 19 nt, Homo sapiens
cgaagaaauucagcauuca

SEQ ID NO: 902405 - RNA, 19 nt, Homo sapiens
ggucagcgauuaggaaacu

SEQ ID NO: 902406 - RNA, 19 nt, Homo sapiens
acaggaaacacauugaauu

SEQ ID NO: 902407 - RNA, 19 nt, Homo sapiens
gaagaaauucagcauucau

SEQ ID NO: 902408 - RNA, 19 nt, Homo sapiens
ggugacagauaaauuugag

SEQ ID NO: 902409 - RNA, 19 nt, Homo sapiens
gaagcuggcugcccaaaag

SEQ ID NO: 902410 - RNA, 19 nt, Homo sapiens
gaaaccaaaggaaagaaca

SEQ ID NO: 902411 - RNA, 19 nt, Homo sapiens
acaccaaaccugcucacua

SEQ ID NO: 902412 - RNA, 19 nt, Homo sapiens
cagauaaauuugagaacag

SEQ ID NO: 902413 - RNA, 19 nt, Homo sapiens
gcaccuccugcaauuguaa

SEQ ID NO: 902414 - RNA, 19 nt, Homo sapiens
ccaaaggugaagaacuuaa

SEQ ID NO: 902415 - RNA, 19 nt, Homo sapiens
gagaucuucuuugcauuag

SEQ ID NO: 902416 - RNA, 19 nt, Homo sapiens
ggacucugggaaucucaua

SEQ ID NO: 902417 - RNA, 19 nt, Homo sapiens
ggagggaaacagaaaccaa

SEQ ID NO: 902418 - RNA, 19 nt, Homo sapiens
acuuaaacccgaagaaauu

SEQ ID NO: 902419 - RNA, 19 nt, Homo sapiens
gaggucagcgauuaggaaa

SEQ ID NO: 902420 - RNA, 19 nt, Homo sapiens
uaagagguccaaaggugaa

SEQ ID NO: 902421 - RNA, 19 nt, Homo sapiens
ugaacgccuuccucgcuaa

SEQ ID NO: 902422 - RNA, 19 nt, Homo sapiens
ggauaaaggacaaagucau

SEQ ID NO: 902423 - RNA, 19 nt, Homo sapiens
cuacauacgcccagagauc

SEQ ID NO: 902424 - RNA, 19 nt, Homo sapiens
ucucauagcaguuccagau

SEQ ID NO: 902425 - RNA, 19 nt, Homo sapiens
acgccuuccucgcuaauuu

SEQ ID NO: 902426 - RNA, 19 nt, Homo sapiens
ccaaaggaaagaacagcuu

SEQ ID NO: 902427 - RNA, 19 nt, Homo sapiens
cagcauucaugaccaggau

SEQ ID NO: 902428 - RNA, 19 nt, Homo sapiens
gaaauucagcauucaugac

SEQ ID NO: 902429 - RNA, 19 nt, Homo sapiens
cagagaucuucuuugcauu

SEQ ID NO: 902430 - RNA, 19 nt, Homo sapiens
aggagaaacugaugaagcu

SEQ ID NO: 902431 - RNA, 19 nt, Homo sapiens
agaaggagaaacugaugaa

SEQ ID NO: 902432 - RNA, 19 nt, Homo sapiens
gggaaucucauagcaguuc

SEQ ID NO: 902433 - RNA, 19 nt, Homo sapiens
ugaagaaggagaaacugau

SEQ ID NO: 902434 - RNA, 19 nt, Homo sapiens
agaaauucagcauucauga

SEQ ID NO: 902435 - RNA, 19 nt, Homo sapiens
uuaggaaacugccccauug

SEQ ID NO: 902436 - RNA, 19 nt, Homo sapiens
gaacgccuuccucgcuaau

SEQ ID NO: 902437 - RNA, 19 nt, Homo sapiens
gugauaggagggaaacaga

SEQ ID NO: 902438 - RNA, 19 nt, Homo sapiens
acagaaaccaaaggaaaga

SEQ ID NO: 902439 - RNA, 19 nt, Homo sapiens
gcucagccucugcggagaa

SEQ ID NO: 902440 - RNA, 19 nt, Homo sapiens
gcauucaugaccaggauca

SEQ ID NO: 902441 - RNA, 19 nt, Homo sapiens
ugagaacaggaaacacauu

SEQ ID NO: 902442 - RNA, 19 nt, Homo sapiens
ucucuacugugacaaggau

SEQ ID NO: 902443 - RNA, 19 nt, Homo sapiens
ugaggucagcgauuaggaa

SEQ ID NO: 902444 - RNA, 19 nt, Homo sapiens
ucaaccaguuugcaaagcu

SEQ ID NO: 902445 - RNA, 19 nt, Homo sapiens
ccucgcuaauuugaacuaa

SEQ ID NO: 902446 - RNA, 19 nt, Homo sapiens
gagguccaaaggugaagaa

SEQ ID NO: 902447 - RNA, 19 nt, Homo sapiens
gaaggagaaacugaugaag

SEQ ID NO: 902448 - RNA, 19 nt, Homo sapiens
gcgcuuaagagguccaaag

SEQ ID NO: 902449 - RNA, 19 nt, Homo sapiens
ccaaaccugcucacuaaaa

SEQ ID NO: 902450 - RNA, 19 nt, Homo sapiens
aagaaauucagcauucaug

SEQ ID NO: 902451 - RNA, 19 nt, Homo sapiens
ggaguuuugucucuacugu

SEQ ID NO: 902452 - RNA, 19 nt, Homo sapiens
gggugacagauaaauuuga

SEQ ID NO: 902453 - RNA, 19 nt, Homo sapiens
aaagucauccaucccuuca

SEQ ID NO: 902454 - RNA, 19 nt, Homo sapiens
ggaaagccaacacuacuga

SEQ ID NO: 902455 - RNA, 19 nt, Homo sapiens
gaccguaugucuccaguca

SEQ ID NO: 902456 - RNA, 19 nt, Homo sapiens
uggagacccuugagaaaga

SEQ ID NO: 902457 - RNA, 19 nt, Homo sapiens
ggaaaaggauauaauggau

SEQ ID NO: 902458 - RNA, 19 nt, Homo sapiens
gguuaacuaugcuguuuua

SEQ ID NO: 902459 - RNA, 19 nt, Homo sapiens
gcauucaggauaucaauca

SEQ ID NO: 902460 - RNA, 19 nt, Homo sapiens
uccagucacuauugccuua

SEQ ID NO: 902461 - RNA, 19 nt, Homo sapiens
agccaacacuacugacuuu

SEQ ID NO: 902462 - RNA, 19 nt, Homo sapiens
uggguuaacuaugcuguuu

SEQ ID NO: 902463 - RNA, 19 nt, Homo sapiens
gaaggaaaaggauauaaug

SEQ ID NO: 902464 - RNA, 19 nt, Homo sapiens
ucauagcagucccgaggaa

SEQ ID NO: 902465 - RNA, 19 nt, Homo sapiens
gggccugaauggacucaau

SEQ ID NO: 902466 - RNA, 19 nt, Homo sapiens
gaggaaggaccguaugucu

SEQ ID NO: 902467 - RNA, 19 nt, Homo sapiens
gacuuuggguuaacuaugc

SEQ ID NO: 902468 - RNA, 19 nt, Homo sapiens
uaauggauuuguacaacca

SEQ ID NO: 902469 - RNA, 19 nt, Homo sapiens
ggauauaauggauuuguac

SEQ ID NO: 902470 - RNA, 19 nt, Homo sapiens
cucaaucucugccugaugu

SEQ ID NO: 902471 - RNA, 19 nt, Homo sapiens
gagcauucaggauaucaau

SEQ ID NO: 902472 - RNA, 19 nt, Homo sapiens
ccugaugugugcuaaaguc

SEQ ID NO: 902473 - RNA, 19 nt, Homo sapiens
ggaccagacgcucauagca

SEQ ID NO: 902474 - RNA, 19 nt, Homo sapiens
ucucauccuuacccaagaa

SEQ ID NO: 902475 - RNA, 19 nt, Homo sapiens
guaugucuccagucacuau

SEQ ID NO: 902476 - RNA, 19 nt, Homo sapiens
ccacacugcagcugaagga

SEQ ID NO: 902477 - RNA, 19 nt, Homo sapiens
ccugugaaguccuuucucu

SEQ ID NO: 902478 - RNA, 19 nt, Homo sapiens
gcuguccucucauccuuac

SEQ ID NO: 902479 - RNA, 19 nt, Homo sapiens
gcaggaacuccaccuucga

SEQ ID NO: 902480 - RNA, 19 nt, Homo sapiens
caucggguguggguucuuc

SEQ ID NO: 902481 - RNA, 19 nt, Homo sapiens
acuacugacuuuggguuaa

SEQ ID NO: 902482 - RNA, 19 nt, Homo sapiens
acacugcagcugaaggaaa

SEQ ID NO: 902483 - RNA, 19 nt, Homo sapiens
gggaaagccaacacuacug

SEQ ID NO: 902484 - RNA, 19 nt, Homo sapiens
ccaucuaccugggccugaa

SEQ ID NO: 902485 - RNA, 19 nt, Homo sapiens
uguggagacccuugagaaa

SEQ ID NO: 902486 - RNA, 19 nt, Homo sapiens
acuauugccuuaaucucau

SEQ ID NO: 902487 - RNA, 19 nt, Homo sapiens
ggagcauucaggauaucaa

SEQ ID NO: 902488 - RNA, 19 nt, Homo sapiens
cacuauugccuuaaucuca

SEQ ID NO: 902489 - RNA, 19 nt, Homo sapiens
ggaaauggcucaucucugu

SEQ ID NO: 902490 - RNA, 19 nt, Homo sapiens
ccucagaacuugaccauga

SEQ ID NO: 902491 - RNA, 19 nt, Homo sapiens
ugaauuaugugcagaguga

SEQ ID NO: 902492 - RNA, 19 nt, Homo sapiens
caaguaaacugcugacgau

SEQ ID NO: 902493 - RNA, 19 nt, Homo sapiens
gggagauacuucuuucgua

SEQ ID NO: 902494 - RNA, 19 nt, Homo sapiens
gaccaugacugucuuccaa

SEQ ID NO: 902495 - RNA, 19 nt, Homo sapiens
gcaccagccucaccuguca

SEQ ID NO: 902496 - RNA, 19 nt, Homo sapiens
ccaaggagacggcacagua

SEQ ID NO: 902497 - RNA, 19 nt, Homo sapiens
uaacagcccucaacgugau

SEQ ID NO: 902498 - RNA, 19 nt, Homo sapiens
gaagaacccugaggaacag

SEQ ID NO: 902499 - RNA, 19 nt, Homo sapiens
gaacaagaccguccaucuc

SEQ ID NO: 902500 - RNA, 19 nt, Homo sapiens
gaaaggaaguauaaaaugg

SEQ ID NO: 902501 - RNA, 19 nt, Homo sapiens
gugaugagcuaugauaaca

SEQ ID NO: 902502 - RNA, 19 nt, Homo sapiens
guaaacugcugacgaugca

SEQ ID NO: 902503 - RNA, 19 nt, Homo sapiens
gaugagcuaugauaacacu

SEQ ID NO: 902504 - RNA, 19 nt, Homo sapiens
gagcuaugauaacacuaug

SEQ ID NO: 902505 - RNA, 19 nt, Homo sapiens
gcggaaggacagacaagua

SEQ ID NO: 902506 - RNA, 19 nt, Homo sapiens
ggaaggacagacaaguaaa

SEQ ID NO: 902507 - RNA, 19 nt, Homo sapiens
gcagagacucacccugauu

SEQ ID NO: 902508 - RNA, 19 nt, Homo sapiens
cacacaggcuuuagaguca

SEQ ID NO: 902509 - RNA, 19 nt, Homo sapiens
aaagacagacaaauuccua

SEQ ID NO: 902510 - RNA, 19 nt, Homo sapiens
gcuaugauaacacuaugaa

SEQ ID NO: 902511 - RNA, 19 nt, Homo sapiens
ggagaaaggaaguauaaaa

SEQ ID NO: 902512 - RNA, 19 nt, Homo sapiens
cggaaggacagacaaguaa

SEQ ID NO: 902513 - RNA, 19 nt, Homo sapiens
aaaccugaauccacacugu

SEQ ID NO: 902514 - RNA, 19 nt, Homo sapiens
caaggagacggcacaguau

SEQ ID NO: 902515 - RNA, 19 nt, Homo sapiens
ucaacgugaugagcuauga

SEQ ID NO: 902516 - RNA, 19 nt, Homo sapiens
gagaaacugcagagacuca

SEQ ID NO: 902517 - RNA, 19 nt, Homo sapiens
caagauccacagaugagaa

SEQ ID NO: 902518 - RNA, 19 nt, Homo sapiens
gcagagcaaagccacauca

SEQ ID NO: 902519 - RNA, 19 nt, Homo sapiens
gacugaaccuugggcagaa

SEQ ID NO: 902520 - RNA, 19 nt, Homo sapiens
agaagaacccugaggaaca

SEQ ID NO: 902521 - RNA, 19 nt, Homo sapiens
gagggaugcagcugaauuc

SEQ ID NO: 902522 - RNA, 19 nt, Homo sapiens
gaaggacagacaaguaaac

SEQ ID NO: 902523 - RNA, 19 nt, Homo sapiens
ggacaggaggccacugaca

SEQ ID NO: 902524 - RNA, 19 nt, Homo sapiens
ccugagggaugcagcugaa

SEQ ID NO: 902525 - RNA, 19 nt, Homo sapiens
cacaguauccacagucuug

SEQ ID NO: 902526 - RNA, 19 nt, Homo sapiens
cagagacucacccugauug

SEQ ID NO: 902527 - RNA, 19 nt, Homo sapiens
ccacagcccuggucuuccu

SEQ ID NO: 902528 - RNA, 19 nt, Homo sapiens
uauccacagucuugggaaa

SEQ ID NO: 902529 - RNA, 19 nt, Homo sapiens
agacagacaaauuccuaaa

SEQ ID NO: 902530 - RNA, 19 nt, Homo sapiens
gaagugaugcggggagaua

SEQ ID NO: 902531 - RNA, 19 nt, Homo sapiens
cgaacaagaccguccaucu

SEQ ID NO: 902532 - RNA, 19 nt, Homo sapiens
cgugggagauacgggcaua

SEQ ID NO: 902533 - RNA, 19 nt, Homo sapiens
acaagaccguccaucucaa

SEQ ID NO: 902534 - RNA, 19 nt, Homo sapiens
ggaccgauuccaccuccuu

SEQ ID NO: 902535 - RNA, 19 nt, Homo sapiens
ugagggaugcagcugaauu

SEQ ID NO: 902536 - RNA, 19 nt, Homo sapiens
cacaggcuuuagagucaaa

SEQ ID NO: 902537 - RNA, 19 nt, Homo sapiens
ccacugacaccgaguacuc

SEQ ID NO: 902538 - RNA, 19 nt, Homo sapiens
aaagccacaucaggaguga

SEQ ID NO: 902539 - RNA, 19 nt, Homo sapiens
caccggcucucugugaaug

SEQ ID NO: 902540 - RNA, 19 nt, Homo sapiens
auggagaaaggaaguauaa

SEQ ID NO: 902541 - RNA, 19 nt, Homo sapiens
agagaugccagaagaagug

SEQ ID NO: 902542 - RNA, 19 nt, Homo sapiens
ugagcuaugauaacacuau

SEQ ID NO: 902543 - RNA, 19 nt, Homo sapiens
agagaagaacccugaggaa

SEQ ID NO: 902544 - RNA, 19 nt, Homo sapiens
gcacaguauccacagucuu

SEQ ID NO: 902545 - RNA, 19 nt, Homo sapiens
agagucaaaguaucucaaa

SEQ ID NO: 902546 - RNA, 19 nt, Homo sapiens
caugugcccugcuccuucu

SEQ ID NO: 902547 - RNA, 19 nt, Homo sapiens
ugaugcaguugacagcaau

SEQ ID NO: 902548 - RNA, 19 nt, Homo sapiens
gaugccagaagaagugaug

SEQ ID NO: 902549 - RNA, 19 nt, Homo sapiens
aacaagaccguccaucuca

SEQ ID NO: 902550 - RNA, 19 nt, Homo sapiens
ucgcauggcuggauuuacc

SEQ ID NO: 902551 - RNA, 19 nt, Homo sapiens
cgccuggucugugcaguug

SEQ ID NO: 902552 - RNA, 19 nt, Homo sapiens
ccacagucuugggaaaugg

SEQ ID NO: 902553 - RNA, 19 nt, Homo sapiens
cuacccgccucagaacuug

SEQ ID NO: 902554 - RNA, 19 nt, Homo sapiens
gagucaaaguaucucaaac

SEQ ID NO: 902555 - RNA, 19 nt, Homo sapiens
agaauuaacagcccucaac

SEQ ID NO: 902556 - RNA, 19 nt, Homo sapiens
uauggagaaaggaaguaua

SEQ ID NO: 902557 - RNA, 19 nt, Homo sapiens
cuaaaagacagacaaauuc

SEQ ID NO: 902558 - RNA, 19 nt, Homo sapiens
gucaaaguaucucaaaccu

SEQ ID NO: 902559 - RNA, 19 nt, Homo sapiens
aacgugaugagcuaugaua

SEQ ID NO: 902560 - RNA, 19 nt, Homo sapiens
ggaaauggcucaucucuuu

SEQ ID NO: 902561 - RNA, 19 nt, Homo sapiens
ggacagggcuggaauuuaa

SEQ ID NO: 902562 - RNA, 19 nt, Homo sapiens
gaaauggaguuacaaauca

SEQ ID NO: 902563 - RNA, 19 nt, Homo sapiens
ucacaucucuccuccauuu

SEQ ID NO: 902564 - RNA, 19 nt, Homo sapiens
gcacccagcuugcauugaa

SEQ ID NO: 902565 - RNA, 19 nt, Homo sapiens
ggacaccucugacaggauu

SEQ ID NO: 902566 - RNA, 19 nt, Homo sapiens
gguaucaugucucaauuaa

SEQ ID NO: 902567 - RNA, 19 nt, Homo sapiens
gcagguuguuuguuugaua

SEQ ID NO: 902568 - RNA, 19 nt, Homo sapiens
cagcuugcauugaauauuu

SEQ ID NO: 902569 - RNA, 19 nt, Homo sapiens
gcaauggccuagagucuca

SEQ ID NO: 902570 - RNA, 19 nt, Homo sapiens
caauuacacucuuuccauu

SEQ ID NO: 902571 - RNA, 19 nt, Homo sapiens
ggcgggaccugauuucuuu

SEQ ID NO: 902572 - RNA, 19 nt, Homo sapiens
gaccaugacugucuuccaa

SEQ ID NO: 902573 - RNA, 19 nt, Homo sapiens
aagaauagcuggcaucucu

SEQ ID NO: 902574 - RNA, 19 nt, Homo sapiens
ggagggagacagacaauau

SEQ ID NO: 902575 - RNA, 19 nt, Homo sapiens
gcaccagccucaccuguca

SEQ ID NO: 902576 - RNA, 19 nt, Homo sapiens
acccaaaucuuaucuagaa

SEQ ID NO: 902577 - RNA, 19 nt, Homo sapiens
ggucagguaucaugucuca

SEQ ID NO: 902578 - RNA, 19 nt, Homo sapiens
ugacagcccugacccauag

SEQ ID NO: 902579 - RNA, 19 nt, Homo sapiens
cuaagcagcugucuguguu

SEQ ID NO: 902580 - RNA, 19 nt, Homo sapiens
uaucaugucucaauuaagg

SEQ ID NO: 902581 - RNA, 19 nt, Homo sapiens
gagcagcaauggccuagag

SEQ ID NO: 902582 - RNA, 19 nt, Homo sapiens
cccaugaucuccuggauug

SEQ ID NO: 902583 - RNA, 19 nt, Homo sapiens
aaacuaagcagcugucugu

SEQ ID NO: 902584 - RNA, 19 nt, Homo sapiens
uauugcagguuguuuguuu

SEQ ID NO: 902585 - RNA, 19 nt, Homo sapiens
cccguuguaucauaauuua

SEQ ID NO: 902586 - RNA, 19 nt, Homo sapiens
ggaucgcucucuuugguau

SEQ ID NO: 902587 - RNA, 19 nt, Homo sapiens
ccacagcccugggaaaugg

SEQ ID NO: 902588 - RNA, 19 nt, Homo sapiens
ccuuggaacuugaccauga

SEQ ID NO: 902589 - RNA, 19 nt, Homo sapiens
uggcgggucuguacuuauu

SEQ ID NO: 902590 - RNA, 19 nt, Homo sapiens
ugaaauggaguuacaaauc

SEQ ID NO: 902591 - RNA, 19 nt, Homo sapiens
caaacaacccagacagaga

SEQ ID NO: 902592 - RNA, 19 nt, Homo sapiens
gaacugugagucaauuaca

SEQ ID NO: 902593 - RNA, 19 nt, Homo sapiens
ccacccaaaucuuaucuag

SEQ ID NO: 902594 - RNA, 19 nt, Homo sapiens
ucaaggagcuaaaagaaga

SEQ ID NO: 902595 - RNA, 19 nt, Homo sapiens
caggaucgcucucuuuggu

SEQ ID NO: 902596 - RNA, 19 nt, Homo sapiens
aaacaacccagacagagaa

SEQ ID NO: 902597 - RNA, 19 nt, Homo sapiens
gcacugaguaggaguuauc

SEQ ID NO: 902598 - RNA, 19 nt, Homo sapiens
cuagagagaggaagcauga

SEQ ID NO: 902599 - RNA, 19 nt, Homo sapiens
gcacugagucaagcaauca

SEQ ID NO: 902600 - RNA, 19 nt, Homo sapiens
caccaggccaggcuaauuu

SEQ ID NO: 902601 - RNA, 19 nt, Homo sapiens
cucaagaccuguaucacaa

SEQ ID NO: 902602 - RNA, 19 nt, Homo sapiens
ggugugaccacgaccagua

SEQ ID NO: 902603 - RNA, 19 nt, Homo sapiens
uuuaaagccuguccgauuc

SEQ ID NO: 902604 - RNA, 19 nt, Homo sapiens
gcuaaucauugugccuuga

SEQ ID NO: 902605 - RNA, 19 nt, Homo sapiens
ucccaaaguguuaggauua

SEQ ID NO: 902606 - RNA, 19 nt, Homo sapiens
acauguagauacucauuuc

SEQ ID NO: 902607 - RNA, 19 nt, Homo sapiens
gaauagcuggcaucucuuc

SEQ ID NO: 902608 - RNA, 19 nt, Homo sapiens
ccgccaugauuguaaguuu

SEQ ID NO: 902609 - RNA, 19 nt, Homo sapiens
cagguuguuuguuugauau

SEQ ID NO: 902610 - RNA, 19 nt, Homo sapiens
ggaguuacaaaucacaguu

SEQ ID NO: 902611 - RNA, 19 nt, Homo sapiens
gagagaggaagcaugaaau

SEQ ID NO: 902612 - RNA, 19 nt, Homo sapiens
gauaaggggucauauuucu

SEQ ID NO: 902613 - RNA, 19 nt, Homo sapiens
caggauggcuggacugacu

SEQ ID NO: 902614 - RNA, 19 nt, Homo sapiens
uauggcgggucuguacuua

SEQ ID NO: 902615 - RNA, 19 nt, Homo sapiens
uaaauuccuugagggcauu

SEQ ID NO: 902616 - RNA, 19 nt, Homo sapiens
gcagcugucuguguuugug

SEQ ID NO: 902617 - RNA, 19 nt, Homo sapiens
ggucucuucucucaucuag

SEQ ID NO: 902618 - RNA, 19 nt, Homo sapiens
cuguaauucucucucauuu

SEQ ID NO: 902619 - RNA, 19 nt, Homo sapiens
cagguaucaugucucaauu

SEQ ID NO: 902620 - RNA, 19 nt, Homo sapiens
guggaacugugagucaauu

SEQ ID NO: 902621 - RNA, 19 nt, Homo sapiens
ucucuucucucaucuagca

SEQ ID NO: 902622 - RNA, 19 nt, Homo sapiens
acagaugggugugcuaauc

SEQ ID NO: 902623 - RNA, 19 nt, Homo sapiens
uuacgccacuaaccuguga

SEQ ID NO: 902624 - RNA, 19 nt, Homo sapiens
caagaccuguaucacaagu

SEQ ID NO: 902625 - RNA, 19 nt, Homo sapiens
gggauaaggggucauauuu

SEQ ID NO: 902626 - RNA, 19 nt, Homo sapiens
cacgagaucugaugguuuu

SEQ ID NO: 902627 - RNA, 19 nt, Homo sapiens
ucagguaucaugucucaau

SEQ ID NO: 902628 - RNA, 19 nt, Homo sapiens
ggaacuugaccaugacugu

SEQ ID NO: 902629 - RNA, 19 nt, Homo sapiens
gaagcaugaaauggaguua

SEQ ID NO: 902630 - RNA, 19 nt, Homo sapiens
ggaagcaugaaauggaguu

SEQ ID NO: 902631 - RNA, 19 nt, Homo sapiens
ccuagagucucaggaacaa

SEQ ID NO: 902632 - RNA, 19 nt, Homo sapiens
gagggagacagacaauaug

SEQ ID NO: 902633 - RNA, 19 nt, Homo sapiens
ugcaucaucuucaucauag

SEQ ID NO: 902634 - RNA, 19 nt, Homo sapiens
caugaaauggaguuacaaa

SEQ ID NO: 902635 - RNA, 19 nt, Homo sapiens
gagaucugaugguuuugua

SEQ ID NO: 902636 - RNA, 19 nt, Homo sapiens
ucugauagugagugaguua

SEQ ID NO: 902637 - RNA, 19 nt, Homo sapiens
gagacagaccauaccaaga

SEQ ID NO: 902638 - RNA, 19 nt, Homo sapiens
gccucucccugcagaauga

SEQ ID NO: 902639 - RNA, 19 nt, Homo sapiens
agaggaagcaugaaaugga

SEQ ID NO: 902640 - RNA, 19 nt, Homo sapiens
agagagaggaagcaugaaa

SEQ ID NO: 902641 - RNA, 19 nt, Homo sapiens
ugccucagccucccaagua

SEQ ID NO: 902642 - RNA, 19 nt, Homo sapiens
gggcacaggcaccucaaga

SEQ ID NO: 902643 - RNA, 19 nt, Homo sapiens
gacaauauggggaugguua

SEQ ID NO: 902644 - RNA, 19 nt, Homo sapiens
ucaauuacacucuuuccau

SEQ ID NO: 902645 - RNA, 19 nt, Homo sapiens
ccaaguagccgggauugca

SEQ ID NO: 902646 - RNA, 19 nt, Homo sapiens
gauguguccuacccuccuu

SEQ ID NO: 902647 - RNA, 19 nt, Homo sapiens
auuacacucuuuccauuga

SEQ ID NO: 902648 - RNA, 19 nt, Homo sapiens
caacccagacagagaagug

SEQ ID NO: 902649 - RNA, 19 nt, Homo sapiens
ucacgagaucugaugguuu

SEQ ID NO: 902650 - RNA, 19 nt, Homo sapiens
uuaaggcccuguaauucuc

SEQ ID NO: 902651 - RNA, 19 nt, Homo sapiens
gagugcacgugagggauga

SEQ ID NO: 902652 - RNA, 19 nt, Homo sapiens
ccucagugcucacccuuac

SEQ ID NO: 902653 - RNA, 19 nt, Homo sapiens
ggucuguacuuauuuuguu

SEQ ID NO: 902654 - RNA, 19 nt, Homo sapiens
caggacagggcuggaauuu

SEQ ID NO: 902655 - RNA, 19 nt, Homo sapiens
gcccuguaauucucucuca

SEQ ID NO: 902656 - RNA, 19 nt, Homo sapiens
gaccggcuugucauccuua

SEQ ID NO: 902657 - RNA, 19 nt, Homo sapiens
cugcaucaucuucaucaua

SEQ ID NO: 902658 - RNA, 19 nt, Homo sapiens
ccucaagaccuguaucaca

SEQ ID NO: 902659 - RNA, 19 nt, Homo sapiens
caggugcacugaggagaug

SEQ ID NO: 902660 - RNA, 19 nt, Homo sapiens
ccgagaagcugaaggauua

SEQ ID NO: 902661 - RNA, 19 nt, Homo sapiens
gcaagaagccagucaaaga

SEQ ID NO: 902662 - RNA, 19 nt, Homo sapiens
gaaauggucuaauaaaucc

SEQ ID NO: 902663 - RNA, 19 nt, Homo sapiens
ggaaauggucuaauaaauc

SEQ ID NO: 902664 - RNA, 19 nt, Homo sapiens
gaaauucucagaggacuuu

SEQ ID NO: 902665 - RNA, 19 nt, Homo sapiens
gggaggagauggugucguu

SEQ ID NO: 902666 - RNA, 19 nt, Homo sapiens
gaagcugaaggauuauuua

SEQ ID NO: 902667 - RNA, 19 nt, Homo sapiens
gcugaaggauuauuuacga

SEQ ID NO: 902668 - RNA, 19 nt, Homo sapiens
gaggagauggugucguuua

SEQ ID NO: 902669 - RNA, 19 nt, Homo sapiens
ucaaagaccgagugacaua

SEQ ID NO: 902670 - RNA, 19 nt, Homo sapiens
gagauggugucguuuagau

SEQ ID NO: 902671 - RNA, 19 nt, Homo sapiens
gugaaaagcuggucaagaa

SEQ ID NO: 902672 - RNA, 19 nt, Homo sapiens
ccauugaucuggugacgaa

SEQ ID NO: 902673 - RNA, 19 nt, Homo sapiens
ccaaagccguggcaacaga

SEQ ID NO: 902674 - RNA, 19 nt, Homo sapiens
ucaaagagaaccagaguga

SEQ ID NO: 902675 - RNA, 19 nt, Homo sapiens
ggagaugacuuggauggau

SEQ ID NO: 902676 - RNA, 19 nt, Homo sapiens
gcacaagcccuccaucauc

SEQ ID NO: 902677 - RNA, 19 nt, Homo sapiens
gaaggugggagguugauug

SEQ ID NO: 902678 - RNA, 19 nt, Homo sapiens
ggacaaagccaagaacuac

SEQ ID NO: 902679 - RNA, 19 nt, Homo sapiens
caacagaggccaacaacuc

SEQ ID NO: 902680 - RNA, 19 nt, Homo sapiens
acacugcucuuccuacuuc

SEQ ID NO: 902681 - RNA, 19 nt, Homo sapiens
caacaacuccaccuucuuc

SEQ ID NO: 902682 - RNA, 19 nt, Homo sapiens
gagagcagauuggcugaug

SEQ ID NO: 902683 - RNA, 19 nt, Homo sapiens
gcagugacagugacaguga

SEQ ID NO: 902684 - RNA, 19 nt, Homo sapiens
cagacgaccuccugaaagu

SEQ ID NO: 902685 - RNA, 19 nt, Homo sapiens
caaauucccacacuuguuc

SEQ ID NO: 902686 - RNA, 19 nt, Homo sapiens
ggacacugcucuuccuacu

SEQ ID NO: 902687 - RNA, 19 nt, Homo sapiens
gaaaugaaaaugagaguga

SEQ ID NO: 902688 - RNA, 19 nt, Homo sapiens
ccauggagaugacuuggau

SEQ ID NO: 902689 - RNA, 19 nt, Homo sapiens
ccagcaugaugauugauga

SEQ ID NO: 902690 - RNA, 19 nt, Homo sapiens
ccucaaagaagcugucauu

SEQ ID NO: 902691 - RNA, 19 nt, Homo sapiens
gcaagggcagugacaguga

SEQ ID NO: 902692 - RNA, 19 nt, Homo sapiens
ggacccaggagaugaaaug

SEQ ID NO: 902693 - RNA, 19 nt, Homo sapiens
gggcuugucccagucaaua

SEQ ID NO: 902694 - RNA, 19 nt, Homo sapiens
caacgucaacccuccagaa

SEQ ID NO: 902695 - RNA, 19 nt, Homo sapiens
gauggagaagcccaacaua

SEQ ID NO: 902696 - RNA, 19 nt, Homo sapiens
aaaagaaacugcaagaaca

SEQ ID NO: 902697 - RNA, 19 nt, Homo sapiens
uccuggaaauggucuaaua

SEQ ID NO: 902698 - RNA, 19 nt, Homo sapiens
ccuccacgcuaucaaguau

SEQ ID NO: 902699 - RNA, 19 nt, Homo sapiens
aauuaaugcugcuuggauu

SEQ ID NO: 902700 - RNA, 19 nt, Homo sapiens
cacaagcccuccaucaucu

SEQ ID NO: 902701 - RNA, 19 nt, Homo sapiens
gccaacaacuccaccuucu

SEQ ID NO: 902702 - RNA, 19 nt, Homo sapiens
ccaaucaaauucccacacu

SEQ ID NO: 902703 - RNA, 19 nt, Homo sapiens
gauggugucguuuagauca

SEQ ID NO: 902704 - RNA, 19 nt, Homo sapiens
caaagaccgagugacauaa

SEQ ID NO: 902705 - RNA, 19 nt, Homo sapiens
ucaaagaagcugucauuuu

SEQ ID NO: 902706 - RNA, 19 nt, Homo sapiens
cccaggagaugaaaugaca

SEQ ID NO: 902707 - RNA, 19 nt, Homo sapiens
gagccaagugcgugcagua

SEQ ID NO: 902708 - RNA, 19 nt, Homo sapiens
gacgaccuccugaaaguga

SEQ ID NO: 902709 - RNA, 19 nt, Homo sapiens
gcagacgaccuccugaaag

SEQ ID NO: 902710 - RNA, 19 nt, Homo sapiens
gaaauccuaccuggccaaa

SEQ ID NO: 902711 - RNA, 19 nt, Homo sapiens
agaagccagucaaagagaa

SEQ ID NO: 902712 - RNA, 19 nt, Homo sapiens
caagaagccagucaaagag

SEQ ID NO: 902713 - RNA, 19 nt, Homo sapiens
aaucaaauucccacacuug

SEQ ID NO: 902714 - RNA, 19 nt, Homo sapiens
caaucaaauucccacacuu

SEQ ID NO: 902715 - RNA, 19 nt, Homo sapiens
ccagggcugugucuuccuu

SEQ ID NO: 902716 - RNA, 19 nt, Homo sapiens
ccucaaagaccgagugaca

SEQ ID NO: 902717 - RNA, 19 nt, Homo sapiens
ucccauggguguuggauuc

SEQ ID NO: 902718 - RNA, 19 nt, Homo sapiens
cgagugacauaagccauuc

SEQ ID NO: 902719 - RNA, 19 nt, Homo sapiens
uccugaaagugaagaaauu

SEQ ID NO: 902720 - RNA, 19 nt, Homo sapiens
caacuccaccuucuucucu

SEQ ID NO: 902721 - RNA, 19 nt, Homo sapiens
cgucaacccuccagaaagc

SEQ ID NO: 902722 - RNA, 19 nt, Homo sapiens
cagaucugauguccaagug

SEQ ID NO: 902723 - RNA, 19 nt, Homo sapiens
gaugggugccgucgugaug

SEQ ID NO: 902724 - RNA, 19 nt, Homo sapiens
ucuuagagccugugguuug

SEQ ID NO: 902725 - RNA, 19 nt, Homo sapiens
ccacagaggaggacaaagc

SEQ ID NO: 902726 - RNA, 19 nt, Homo sapiens
ucaaauucccacacuuguu

SEQ ID NO: 902727 - RNA, 19 nt, Homo sapiens
cccaagcucugccucaaag

SEQ ID NO: 902728 - RNA, 19 nt, Homo sapiens
cagaggacuuugggcaaga

SEQ ID NO: 902729 - RNA, 19 nt, Homo sapiens
gccgagaagcugaaggauu

SEQ ID NO: 902730 - RNA, 19 nt, Homo sapiens
ccuggaaauggucuaauaa

SEQ ID NO: 902731 - RNA, 19 nt, Homo sapiens
ggagauggugucguuuaga

SEQ ID NO: 902732 - RNA, 19 nt, Homo sapiens
ccacugcccguuccuuuua

SEQ ID NO: 902733 - RNA, 19 nt, Homo sapiens
agaagcugaaggauuauuu

SEQ ID NO: 902734 - RNA, 19 nt, Homo sapiens
ggagaugaaaugacaacgu

SEQ ID NO: 902735 - RNA, 19 nt, Homo sapiens
gaucaaaacggaguucuug

SEQ ID NO: 902736 - RNA, 19 nt, Homo sapiens
gagaagcugaaggauuauu

SEQ ID NO: 902737 - RNA, 19 nt, Homo sapiens
gauaaaaucaccuggaagu

SEQ ID NO: 902738 - RNA, 19 nt, Homo sapiens
ggacuuugggcaagagagu

SEQ ID NO: 902739 - RNA, 19 nt, Homo sapiens
cagcacaagcccuccauca

SEQ ID NO: 902740 - RNA, 19 nt, Homo sapiens
uccacgcuaucaaguauga

SEQ ID NO: 902741 - RNA, 19 nt, Homo sapiens
ucaugcagcccgugaggaa

SEQ ID NO: 902742 - RNA, 19 nt, Homo sapiens
gggccgagaagcugaagga

SEQ ID NO: 902743 - RNA, 19 nt, Homo sapiens
cugaaggauuauuuacgaa

SEQ ID NO: 902744 - RNA, 19 nt, Homo sapiens
cuggaaauggucuaauaaa

SEQ ID NO: 902745 - RNA, 19 nt, Homo sapiens
gcgcggacaucagcaucau

SEQ ID NO: 902746 - RNA, 19 nt, Homo sapiens
gaugggacucugguucuug

SEQ ID NO: 902747 - RNA, 19 nt, Homo sapiens
gcccaagcucugccucaaa

SEQ ID NO: 902748 - RNA, 19 nt, Homo sapiens
ccaagugcgugcaguaccu

SEQ ID NO: 902749 - RNA, 19 nt, Homo sapiens
gagccauggagaugacuug

SEQ ID NO: 902750 - RNA, 19 nt, Homo sapiens
ggaguucuugguccagaug

SEQ ID NO: 902751 - RNA, 19 nt, Homo sapiens
aauccuaccuggccaaagc

SEQ ID NO: 902752 - RNA, 19 nt, Homo sapiens
agagaaacacggcaagaag

SEQ ID NO: 902753 - RNA, 19 nt, Homo sapiens
aagauaaaaucaccuggaa

SEQ ID NO: 902754 - RNA, 19 nt, Homo sapiens
aaauuaaugcugcuuggau

SEQ ID NO: 902755 - RNA, 19 nt, Homo sapiens
gaugaccuccugacuccau

SEQ ID NO: 902756 - RNA, 19 nt, Homo sapiens
cggcaagaagccagucaaa

SEQ ID NO: 902757 - RNA, 19 nt, Homo sapiens
cugggucccuguccuggaa

SEQ ID NO: 902758 - RNA, 19 nt, Homo sapiens
gcagucaggcggguguuca

SEQ ID NO: 902759 - RNA, 19 nt, Homo sapiens
ccuccuagguucacaucca

SEQ ID NO: 902760 - RNA, 19 nt, Homo sapiens
gcaagaagcuauuguacuu

SEQ ID NO: 902761 - RNA, 19 nt, Homo sapiens
ggaagaaaguuaacgauau

SEQ ID NO: 902762 - RNA, 19 nt, Homo sapiens
uaacucaucuguugucuuu

SEQ ID NO: 902763 - RNA, 19 nt, Homo sapiens
gcaaugcaaugcucaguaa

SEQ ID NO: 902764 - RNA, 19 nt, Homo sapiens
caagagagguuagggcuua

SEQ ID NO: 902765 - RNA, 19 nt, Homo sapiens
gcacagagcugguaaaaug

SEQ ID NO: 902766 - RNA, 19 nt, Homo sapiens
uaaggaaacucacuugauu

SEQ ID NO: 902767 - RNA, 19 nt, Homo sapiens
gcagugaauugcuuaguaa

SEQ ID NO: 902768 - RNA, 19 nt, Homo sapiens
uaagaugccugaaucaauu

SEQ ID NO: 902769 - RNA, 19 nt, Homo sapiens
cagaaguguuccaauauua

SEQ ID NO: 902770 - RNA, 19 nt, Homo sapiens
gaaggcaucuggugcuuug

SEQ ID NO: 902771 - RNA, 19 nt, Homo sapiens
guaaauacaccauaccaua

SEQ ID NO: 902772 - RNA, 19 nt, Homo sapiens
ugauaaagcugagacguua

SEQ ID NO: 902773 - RNA, 19 nt, Homo sapiens
gcacaagccugaggaguga

SEQ ID NO: 902774 - RNA, 19 nt, Homo sapiens
ccauagaucuaguauugua

SEQ ID NO: 902775 - RNA, 19 nt, Homo sapiens
gcagugcagugcucaguaa

SEQ ID NO: 902776 - RNA, 19 nt, Homo sapiens
guguugagcuuaauaacua

SEQ ID NO: 902777 - RNA, 19 nt, Homo sapiens
gcugagacguuacaacaaa

SEQ ID NO: 902778 - RNA, 19 nt, Homo sapiens
agacugauuugcugaauuu

SEQ ID NO: 902779 - RNA, 19 nt, Homo sapiens
uagaagaccuggaacaaga

SEQ ID NO: 902780 - RNA, 19 nt, Homo sapiens
gaaguaauagugaaccuaa

SEQ ID NO: 902781 - RNA, 19 nt, Homo sapiens
gugcuucuguucucauuua

SEQ ID NO: 902782 - RNA, 19 nt, Homo sapiens
gaagaaaggaucccugaga

SEQ ID NO: 902783 - RNA, 19 nt, Homo sapiens
gaaaggugguucauguuca

SEQ ID NO: 902784 - RNA, 19 nt, Homo sapiens
ggaagguguuuguagauga

SEQ ID NO: 902785 - RNA, 19 nt, Homo sapiens
gaauugauccuucuccaaa

SEQ ID NO: 902786 - RNA, 19 nt, Homo sapiens
aaauaaggguucuuuggua

SEQ ID NO: 902787 - RNA, 19 nt, Homo sapiens
uaacugccuugaauuguuu

SEQ ID NO: 902788 - RNA, 19 nt, Homo sapiens
ccacagauugguaaauuua

SEQ ID NO: 902789 - RNA, 19 nt, Homo sapiens
gcagauggaugacuuagag

SEQ ID NO: 902790 - RNA, 19 nt, Homo sapiens
auaagacucugucaucaua

SEQ ID NO: 902791 - RNA, 19 nt, Homo sapiens
uaaggaagguguuuguaga

SEQ ID NO: 902792 - RNA, 19 nt, Homo sapiens
gguuagggcuuagauuuaa

SEQ ID NO: 902793 - RNA, 19 nt, Homo sapiens
gagguaauauccuuaagau

SEQ ID NO: 902794 - RNA, 19 nt, Homo sapiens
gucaaugccuucuuguaua

SEQ ID NO: 902795 - RNA, 19 nt, Homo sapiens
gcacuucuguccucaguca

SEQ ID NO: 902796 - RNA, 19 nt, Homo sapiens
guacagcacugcauucucu

SEQ ID NO: 902797 - RNA, 19 nt, Homo sapiens
ucccauagaucuaguauug

SEQ ID NO: 902798 - RNA, 19 nt, Homo sapiens
gaaaccacacucacacuuu

SEQ ID NO: 902799 - RNA, 19 nt, Homo sapiens
ugagagagaacuuauagua

SEQ ID NO: 902800 - RNA, 19 nt, Homo sapiens
acaauacaguacucaguua

SEQ ID NO: 902801 - RNA, 19 nt, Homo sapiens
gccuuuaccucaagcuuua

SEQ ID NO: 902802 - RNA, 19 nt, Homo sapiens
agacagggcuucaccaugu

SEQ ID NO: 902803 - RNA, 19 nt, Homo sapiens
guagauaguguguucauuu

SEQ ID NO: 902804 - RNA, 19 nt, Homo sapiens
cagacaccaucaugaaaua

SEQ ID NO: 902805 - RNA, 19 nt, Homo sapiens
gagagagaacuuauaguaa

SEQ ID NO: 902806 - RNA, 19 nt, Homo sapiens
ccagugauaugccaccuuu

SEQ ID NO: 902807 - RNA, 19 nt, Homo sapiens
gcugggaaguguuaaagaa

SEQ ID NO: 902808 - RNA, 19 nt, Homo sapiens
uuucagaaguguuccaaua

SEQ ID NO: 902809 - RNA, 19 nt, Homo sapiens
caccuuaucuaaucuuuga

SEQ ID NO: 902810 - RNA, 19 nt, Homo sapiens
ucagaaguguuccaauauu

SEQ ID NO: 902811 - RNA, 19 nt, Homo sapiens
gaaaugaugaguuagaauc

SEQ ID NO: 902812 - RNA, 19 nt, Homo sapiens
ggcagugaauugcuuagua

SEQ ID NO: 902813 - RNA, 19 nt, Homo sapiens
gaaccuguuucacucaaug

SEQ ID NO: 902814 - RNA, 19 nt, Homo sapiens
caacuugucacuuaaagaa

SEQ ID NO: 902815 - RNA, 19 nt, Homo sapiens
uaucuaaccucaaacuuuc

SEQ ID NO: 902816 - RNA, 19 nt, Homo sapiens
ggaaagcagugcaguacuc

SEQ ID NO: 902817 - RNA, 19 nt, Homo sapiens
gugggaagcugacuuggaa

SEQ ID NO: 902818 - RNA, 19 nt, Homo sapiens
gagguuagggcuuagauuu

SEQ ID NO: 902819 - RNA, 19 nt, Homo sapiens
caacaaccucccagugaua

SEQ ID NO: 902820 - RNA, 19 nt, Homo sapiens
ccacaggauuugagaauag

SEQ ID NO: 902821 - RNA, 19 nt, Homo sapiens
ugaagauccucauccaauu

SEQ ID NO: 902822 - RNA, 19 nt, Homo sapiens
gaaauaaggguucuuuggu

SEQ ID NO: 902823 - RNA, 19 nt, Homo sapiens
uaagagagcuaauuaaccu

SEQ ID NO: 902824 - RNA, 19 nt, Homo sapiens
gcauaagacucugucauca

SEQ ID NO: 902825 - RNA, 19 nt, Homo sapiens
gcaggugagucauguuuua

SEQ ID NO: 902826 - RNA, 19 nt, Homo sapiens
ggagagagagacugauuug

SEQ ID NO: 902827 - RNA, 19 nt, Homo sapiens
gaaacaagugugaaggaaa

SEQ ID NO: 902828 - RNA, 19 nt, Homo sapiens
cgaggagauuagaucauua

SEQ ID NO: 902829 - RNA, 19 nt, Homo sapiens
ucccucaacuugucacuua

SEQ ID NO: 902830 - RNA, 19 nt, Homo sapiens
ucaaugccuucuuguauau

SEQ ID NO: 902831 - RNA, 19 nt, Homo sapiens
gcagcaugcucuuaacuag

SEQ ID NO: 902832 - RNA, 19 nt, Homo sapiens
guacuuauauaggcaaugu

SEQ ID NO: 902833 - RNA, 19 nt, Homo sapiens
acagugcagugcucaauaa

SEQ ID NO: 902834 - RNA, 19 nt, Homo sapiens
guggaaaggugguucaugu

SEQ ID NO: 902835 - RNA, 19 nt, Homo sapiens
gacguuacaacaaagauua

SEQ ID NO: 902836 - RNA, 19 nt, Homo sapiens
ggaggcagauggagguaau

SEQ ID NO: 902837 - RNA, 19 nt, Homo sapiens
gaaaagcaaccaugcauuu

SEQ ID NO: 902838 - RNA, 19 nt, Homo sapiens
gaagauccucauccaauug

SEQ ID NO: 902839 - RNA, 19 nt, Homo sapiens
gaagguguuuguagaugau

SEQ ID NO: 902840 - RNA, 19 nt, Homo sapiens
gcccaaguguuuuguauua

SEQ ID NO: 902841 - RNA, 19 nt, Homo sapiens
guaaaucagugcaguacuc

SEQ ID NO: 902842 - RNA, 19 nt, Homo sapiens
guacucaggcagugcaaua

SEQ ID NO: 902843 - RNA, 19 nt, Homo sapiens
ggucaaugccuucuuguau

SEQ ID NO: 902844 - RNA, 19 nt, Homo sapiens
gcacauacuggaaaugaug

SEQ ID NO: 902845 - RNA, 19 nt, Homo sapiens
ugaaugugcugauuguguu

SEQ ID NO: 902846 - RNA, 19 nt, Homo sapiens
guaaggcagugaauugcuu

SEQ ID NO: 902847 - RNA, 19 nt, Homo sapiens
gacaacaaccucccaguga

SEQ ID NO: 902848 - RNA, 19 nt, Homo sapiens
cuuggaagcuugucgauug

SEQ ID NO: 902849 - RNA, 19 nt, Homo sapiens
ccaggagacugccuaugaa

SEQ ID NO: 902850 - RNA, 19 nt, Homo sapiens
gaggagauuagaucauuaa

SEQ ID NO: 902851 - RNA, 19 nt, Homo sapiens
acacugggcugacuuucuu

SEQ ID NO: 902852 - RNA, 19 nt, Homo sapiens
gugaggucaugauguauuu

SEQ ID NO: 902853 - RNA, 19 nt, Homo sapiens
ucugugaggucaugaugua

SEQ ID NO: 902854 - RNA, 19 nt, Homo sapiens
gaagcucucuaaacaaagg

SEQ ID NO: 902855 - RNA, 19 nt, Homo sapiens
aaucgaagcucuccaagca

SEQ ID NO: 902856 - RNA, 19 nt, Homo sapiens
gggacugccugcugagaaa

SEQ ID NO: 902857 - RNA, 19 nt, Homo sapiens
uacuggaaaugaugaguua

SEQ ID NO: 902858 - RNA, 19 nt, Homo sapiens
agccauaacucaucuguug

SEQ ID NO: 902859 - RNA, 19 nt, Homo sapiens
gauaugccaccuuucaauu

SEQ ID NO: 902860 - RNA, 19 nt, Homo sapiens
gaaguaccccuguuucuua

SEQ ID NO: 902861 - RNA, 19 nt, Homo sapiens
gaggaccgcuauccacaga

SEQ ID NO: 902862 - RNA, 19 nt, Homo sapiens
ugaccuggcugcacacaug

SEQ ID NO: 902863 - RNA, 19 nt, Homo sapiens
ggaccgcuauccacagaag

SEQ ID NO: 902864 - RNA, 19 nt, Homo sapiens
gugcagaggcuguaucgau

SEQ ID NO: 902865 - RNA, 19 nt, Homo sapiens
cgagacagcugcgcucaac

SEQ ID NO: 902866 - RNA, 19 nt, Homo sapiens
gcaccucuuccagcccuua

SEQ ID NO: 902867 - RNA, 19 nt, Homo sapiens
ccacuguucuccucaucuc

SEQ ID NO: 902868 - RNA, 19 nt, Homo sapiens
cggcuucccuuacccuauc

SEQ ID NO: 902869 - RNA, 19 nt, Homo sapiens
cuacucggcugaggaacug

SEQ ID NO: 902870 - RNA, 19 nt, Homo sapiens
ccuuaaagcugcagaaaag

SEQ ID NO: 902871 - RNA, 19 nt, Homo sapiens
gagcucagcaccucuucca

SEQ ID NO: 902872 - RNA, 19 nt, Homo sapiens
ucuccagccucaguaguug

SEQ ID NO: 902873 - RNA, 19 nt, Homo sapiens
ggaaguaccccuguuucuu

SEQ ID NO: 902874 - RNA, 19 nt, Homo sapiens
ggaauggacuggccucaca

SEQ ID NO: 902875 - RNA, 19 nt, Homo sapiens
gcaccugcaucuucugaau

SEQ ID NO: 902876 - RNA, 19 nt, Homo sapiens
gaccuggugucacggauga

SEQ ID NO: 902877 - RNA, 19 nt, Homo sapiens
aaccugcuguuucuucuua

SEQ ID NO: 902878 - RNA, 19 nt, Homo sapiens
ccaagaaaggccuaugaaa

SEQ ID NO: 902879 - RNA, 19 nt, Homo sapiens
caagaaaggccuaugaaaa

SEQ ID NO: 902880 - RNA, 19 nt, Homo sapiens
gagaaagugugaggucaac

SEQ ID NO: 902881 - RNA, 19 nt, Homo sapiens
gaaaggccuaugaaaagua

SEQ ID NO: 902882 - RNA, 19 nt, Homo sapiens
agaggaacaucgaggagau

SEQ ID NO: 902883 - RNA, 19 nt, Homo sapiens
gccaagaaaggccuaugaa

SEQ ID NO: 902884 - RNA, 19 nt, Homo sapiens
aguaaacacugacuuuuga

SEQ ID NO: 902885 - RNA, 19 nt, Homo sapiens
gcuguuucuucuuaccauu

SEQ ID NO: 902886 - RNA, 19 nt, Homo sapiens
ccucacaaccugcuguuuc

SEQ ID NO: 902887 - RNA, 19 nt, Homo sapiens
aaaggccuaugaaaaguaa

SEQ ID NO: 902888 - RNA, 19 nt, Homo sapiens
gaauggacuggccucacaa

SEQ ID NO: 902889 - RNA, 19 nt, Homo sapiens
cauccuccuugcaccuuug

SEQ ID NO: 902890 - RNA, 19 nt, Homo sapiens
ccauccuccuugcaccuuu

SEQ ID NO: 902891 - RNA, 19 nt, Homo sapiens
agugugaggucaacuugca

SEQ ID NO: 902892 - RNA, 19 nt, Homo sapiens
caacaagaggagccugucu

SEQ ID NO: 902893 - RNA, 19 nt, Homo sapiens
gaaacacucucucucaaug

SEQ ID NO: 902894 - RNA, 19 nt, Homo sapiens
gaacaacaauacaacaugu

SEQ ID NO: 902895 - RNA, 19 nt, Homo sapiens
gaagagagccuaugcuaca

SEQ ID NO: 902896 - RNA, 19 nt, Homo sapiens
gaaccacauuuauuggauu

SEQ ID NO: 902897 - RNA, 19 nt, Homo sapiens
ggcauaaucauuccaguua

SEQ ID NO: 902898 - RNA, 19 nt, Homo sapiens
ggagaaagauuugacuuac

SEQ ID NO: 902899 - RNA, 19 nt, Homo sapiens
gagaagagagccuaugcua

SEQ ID NO: 902900 - RNA, 19 nt, Homo sapiens
agagauaacugucagcaau

SEQ ID NO: 902901 - RNA, 19 nt, Homo sapiens
gagaaagauuugacuuaca

SEQ ID NO: 902902 - RNA, 19 nt, Homo sapiens
gaauaucaaucugcucaau

SEQ ID NO: 902903 - RNA, 19 nt, Homo sapiens
gcacagaccccauuauauu

SEQ ID NO: 902904 - RNA, 19 nt, Homo sapiens
cauccagauucuacuaaua

SEQ ID NO: 902905 - RNA, 19 nt, Homo sapiens
ccuugugacugcaaacuua

SEQ ID NO: 902906 - RNA, 19 nt, Homo sapiens
ggaaccacauuuauuggau

SEQ ID NO: 902907 - RNA, 19 nt, Homo sapiens
cauagaggcuacagaagga

SEQ ID NO: 902908 - RNA, 19 nt, Homo sapiens
gaaccuguacguccauuau

SEQ ID NO: 902909 - RNA, 19 nt, Homo sapiens
guacugggcauaaucauuc

SEQ ID NO: 902910 - RNA, 19 nt, Homo sapiens
guacuaacaucauacuacu

SEQ ID NO: 902911 - RNA, 19 nt, Homo sapiens
uaaguuggauugccauaag

SEQ ID NO: 902912 - RNA, 19 nt, Homo sapiens
uaugcuaccuuaaugcaaa

SEQ ID NO: 902913 - RNA, 19 nt, Homo sapiens
caacuuugcuagaaaacua

SEQ ID NO: 902914 - RNA, 19 nt, Homo sapiens
ggaaacacucucucucaau

SEQ ID NO: 902915 - RNA, 19 nt, Homo sapiens
gacaaaacauucaagaaga

SEQ ID NO: 902916 - RNA, 19 nt, Homo sapiens
gaacuaggagccaugaucu

SEQ ID NO: 902917 - RNA, 19 nt, Homo sapiens
aaacaucaacgcacaucua

SEQ ID NO: 902918 - RNA, 19 nt, Homo sapiens
gagacuacuucaugcuaug

SEQ ID NO: 902919 - RNA, 19 nt, Homo sapiens
gagauaacugucagcaauu

SEQ ID NO: 902920 - RNA, 19 nt, Homo sapiens
guucuacaccaaagagaua

SEQ ID NO: 902921 - RNA, 19 nt, Homo sapiens
ucauuuacauccuccuuug

SEQ ID NO: 902922 - RNA, 19 nt, Homo sapiens
uggagaaagauuugacuua

SEQ ID NO: 902923 - RNA, 19 nt, Homo sapiens
gauugcaggucucauugga

SEQ ID NO: 902924 - RNA, 19 nt, Homo sapiens
guuugucagucucuuaauu

SEQ ID NO: 902925 - RNA, 19 nt, Homo sapiens
agaaagauuugacuuacag

SEQ ID NO: 902926 - RNA, 19 nt, Homo sapiens
gagagccuaugcuacaauc

SEQ ID NO: 902927 - RNA, 19 nt, Homo sapiens
ggaguuguacugggcauaa

SEQ ID NO: 902928 - RNA, 19 nt, Homo sapiens
ggaacuaggagccaugauc

SEQ ID NO: 902929 - RNA, 19 nt, Homo sapiens
cguauacuacucagucaua

SEQ ID NO: 902930 - RNA, 19 nt, Homo sapiens
ccgcuaugcuaccuuaaug

SEQ ID NO: 902931 - RNA, 19 nt, Homo sapiens
gcagugccaugccuuucau

SEQ ID NO: 902932 - RNA, 19 nt, Homo sapiens
aagccgcuaugcuaccuua

SEQ ID NO: 902933 - RNA, 19 nt, Homo sapiens
cagcccaacuuugcuagaa

SEQ ID NO: 902934 - RNA, 19 nt, Homo sapiens
aaugcagaguggucaauuu

SEQ ID NO: 902935 - RNA, 19 nt, Homo sapiens
uggaaacacucucucucaa

SEQ ID NO: 902936 - RNA, 19 nt, Homo sapiens
agauaacugucagcaauug

SEQ ID NO: 902937 - RNA, 19 nt, Homo sapiens
ucagauugcaggucucauu

SEQ ID NO: 902938 - RNA, 19 nt, Homo sapiens
uaggagccaugaucucuca

SEQ ID NO: 902939 - RNA, 19 nt, Homo sapiens
gcauaaucauuccaguuac

SEQ ID NO: 902940 - RNA, 19 nt, Homo sapiens
caaguauguuugucagucu

SEQ ID NO: 902941 - RNA, 19 nt, Homo sapiens
ggucauccagauucuacua

SEQ ID NO: 902942 - RNA, 19 nt, Homo sapiens
aaccaucuaugaucucuuc

SEQ ID NO: 902943 - RNA, 19 nt, Homo sapiens
ucauuccaguuaccguaua

SEQ ID NO: 902944 - RNA, 19 nt, Homo sapiens
ccaaugggaauaucaaucu

SEQ ID NO: 902945 - RNA, 19 nt, Homo sapiens
uaguuugcuuccuuccuua

SEQ ID NO: 902946 - RNA, 19 nt, Homo sapiens
gggcauaaucauuccaguu

SEQ ID NO: 902947 - RNA, 19 nt, Homo sapiens
gcuagaaaacuaugcauuu

SEQ ID NO: 902948 - RNA, 19 nt, Homo sapiens
uuauggccauuuacugaaa

SEQ ID NO: 902949 - RNA, 19 nt, Homo sapiens
cgcaagagacuacuucaug

SEQ ID NO: 902950 - RNA, 19 nt, Homo sapiens
uguauucaaccaucuauga

SEQ ID NO: 902951 - RNA, 19 nt, Homo sapiens
agagacuacuucaugcuau

SEQ ID NO: 902952 - RNA, 19 nt, Homo sapiens
uaauucagcacauaugcaa

SEQ ID NO: 902953 - RNA, 19 nt, Homo sapiens
cauuggaaccacauuuauu

SEQ ID NO: 902954 - RNA, 19 nt, Homo sapiens
uuccauggcuuuaccaauc

SEQ ID NO: 902955 - RNA, 19 nt, Homo sapiens
cacucucucucaauggaua

SEQ ID NO: 902956 - RNA, 19 nt, Homo sapiens
uggcuuuaccaaucauuua

SEQ ID NO: 902957 - RNA, 19 nt, Homo sapiens
caucuaugaucucuuccau

SEQ ID NO: 902958 - RNA, 19 nt, Homo sapiens
cauccuccuuuguauuguu

SEQ ID NO: 902959 - RNA, 19 nt, Homo sapiens
gauaacugucagcaauuga

SEQ ID NO: 902960 - RNA, 19 nt, Homo sapiens
auaguuugcuuccuuccuu

SEQ ID NO: 902961 - RNA, 19 nt, Homo sapiens
gaaggagaagagagccuau

SEQ ID NO: 902962 - RNA, 19 nt, Homo sapiens
acugcaaacuuacuugugu

SEQ ID NO: 902963 - RNA, 19 nt, Homo sapiens
gaagacacuauauaaucuc

SEQ ID NO: 902964 - RNA, 19 nt, Homo sapiens
agucauagaggcuacagaa

SEQ ID NO: 902965 - RNA, 19 nt, Homo sapiens
cauucaagaagacacuaua

SEQ ID NO: 902966 - RNA, 19 nt, Homo sapiens
ucauccagauucuacuaau

SEQ ID NO: 902967 - RNA, 19 nt, Homo sapiens
gcuacaaucggcagaugga

SEQ ID NO: 902968 - RNA, 19 nt, Homo sapiens
guauacuacucagucauag

SEQ ID NO: 902969 - RNA, 19 nt, Homo sapiens
gcagaguggucaauuuucu

SEQ ID NO: 902970 - RNA, 19 nt, Homo sapiens
caaugggaauaucaaucug

SEQ ID NO: 902971 - RNA, 19 nt, Homo sapiens
gaucucuuccauggcuuua

SEQ ID NO: 902972 - RNA, 19 nt, Homo sapiens
cucauuggaaccacauuua

SEQ ID NO: 902973 - RNA, 19 nt, Homo sapiens
uagcacagaccccauuaua

SEQ ID NO: 902974 - RNA, 19 nt, Homo sapiens
gauuugacuuacaguucug

SEQ ID NO: 902975 - RNA, 19 nt, Homo sapiens
agauuugacuuacaguucu

SEQ ID NO: 902976 - RNA, 19 nt, Homo sapiens
cagauugcaggucucauug

SEQ ID NO: 902977 - RNA, 19 nt, Homo sapiens
gaguuguacugggcauaau

SEQ ID NO: 902978 - RNA, 19 nt, Homo sapiens
cuuccuuccuuauaguauu

SEQ ID NO: 902979 - RNA, 19 nt, Homo sapiens
aagagacuacuucaugcua

SEQ ID NO: 902980 - RNA, 19 nt, Homo sapiens
ggaauaucaaucugcucaa

SEQ ID NO: 902981 - RNA, 19 nt, Homo sapiens
uaacugucagcaauugaau

SEQ ID NO: 902982 - RNA, 19 nt, Homo sapiens
cauuauggagaaagauuug

SEQ ID NO: 902983 - RNA, 19 nt, Homo sapiens
ucauuggaaccacauuuau

SEQ ID NO: 902984 - RNA, 19 nt, Homo sapiens
ggagccaugaucucucaga

SEQ ID NO: 902985 - RNA, 19 nt, Homo sapiens
aagagagccuaugcuacaa

SEQ ID NO: 902986 - RNA, 19 nt, Homo sapiens
uauguuugucagucucuua

SEQ ID NO: 902987 - RNA, 19 nt, Homo sapiens
caaugcagaguggucaauu

SEQ ID NO: 902988 - RNA, 19 nt, Homo sapiens
guauucaaccaucuaugau

SEQ ID NO: 902989 - RNA, 19 nt, Homo sapiens
gcccaacuuugcuagaaaa

SEQ ID NO: 902990 - RNA, 19 nt, Homo sapiens
gcuaugcuaccuuaaugca

SEQ ID NO: 902991 - RNA, 19 nt, Homo sapiens
auucucaccugucuugcuu

SEQ ID NO: 902992 - RNA, 19 nt, Homo sapiens
aacacucucucucaaugga

SEQ ID NO: 902993 - RNA, 19 nt, Homo sapiens
gaaugaggcucuuuagauu

SEQ ID NO: 902994 - RNA, 19 nt, Homo sapiens
gaccuuaaaucauuccuua

SEQ ID NO: 902995 - RNA, 19 nt, Homo sapiens
caacacacccggcuaauuu

SEQ ID NO: 902996 - RNA, 19 nt, Homo sapiens
ggacagguauuucaaagug

SEQ ID NO: 902997 - RNA, 19 nt, Homo sapiens
guucucaacuccuuaauuu

SEQ ID NO: 902998 - RNA, 19 nt, Homo sapiens
gaagugaguuggcugcauu

SEQ ID NO: 902999 - RNA, 19 nt, Homo sapiens
guuaagagcuuucauccuu

SEQ ID NO: 903000 - RNA, 19 nt, Homo sapiens
ggucauuagucaacucuua

SEQ ID NO: 903001 - RNA, 19 nt, Homo sapiens
gcucugaccuucuucaaau

SEQ ID NO: 903002 - RNA, 19 nt, Homo sapiens
gagacgggcuccagagaaa

SEQ ID NO: 903003 - RNA, 19 nt, Homo sapiens
ccucugaccuuaaaucauu

SEQ ID NO: 903004 - RNA, 19 nt, Homo sapiens
guaaauggguauauguguu

SEQ ID NO: 903005 - RNA, 19 nt, Homo sapiens
caacaacacugaggaagau

SEQ ID NO: 903006 - RNA, 19 nt, Homo sapiens
gaaauucacacaacuauac

SEQ ID NO: 903007 - RNA, 19 nt, Homo sapiens
ggcaguaagugcucaauau

SEQ ID NO: 903008 - RNA, 19 nt, Homo sapiens
gaagaggaccugcacauag

SEQ ID NO: 903009 - RNA, 19 nt, Homo sapiens
uuaagaaccuugccaacuu

SEQ ID NO: 903010 - RNA, 19 nt, Homo sapiens
cggaagagaugccaauuuc

SEQ ID NO: 903011 - RNA, 19 nt, Homo sapiens
uuagagcgcuuaaguuguu

SEQ ID NO: 903012 - RNA, 19 nt, Homo sapiens
aagauagaguggugacuua

SEQ ID NO: 903013 - RNA, 19 nt, Homo sapiens
gaacugcauccuucucauu

SEQ ID NO: 903014 - RNA, 19 nt, Homo sapiens
gaagagaugccaauuucga

SEQ ID NO: 903015 - RNA, 19 nt, Homo sapiens
uuaaguuguuccucuguua

SEQ ID NO: 903016 - RNA, 19 nt, Homo sapiens
guacgucugucaucauugu

SEQ ID NO: 903017 - RNA, 19 nt, Homo sapiens
ggguauauguguuugaaug

SEQ ID NO: 903018 - RNA, 19 nt, Homo sapiens
gcgcaugccuauagucuca

SEQ ID NO: 903019 - RNA, 19 nt, Homo sapiens
uuagucaacucuuauguga

SEQ ID NO: 903020 - RNA, 19 nt, Homo sapiens
gcaguaagugcucaauauu

SEQ ID NO: 903021 - RNA, 19 nt, Homo sapiens
gaguggugacuuagaauua

SEQ ID NO: 903022 - RNA, 19 nt, Homo sapiens
caguaagugcucaauauua

SEQ ID NO: 903023 - RNA, 19 nt, Homo sapiens
gcauagcgccuggcaguaa

SEQ ID NO: 903024 - RNA, 19 nt, Homo sapiens
ggccaacucuagcuccuuu

SEQ ID NO: 903025 - RNA, 19 nt, Homo sapiens
gaaaccucgucucuacuga

SEQ ID NO: 903026 - RNA, 19 nt, Homo sapiens
cacaugaguuucccaaaug

SEQ ID NO: 903027 - RNA, 19 nt, Homo sapiens
cgaaugaggcucuuuagau

SEQ ID NO: 903028 - RNA, 19 nt, Homo sapiens
gacagacuauuaccucaga

SEQ ID NO: 903029 - RNA, 19 nt, Homo sapiens
aggauacucuacccacuua

SEQ ID NO: 903030 - RNA, 19 nt, Homo sapiens
acacaugaguuucccaaau

SEQ ID NO: 903031 - RNA, 19 nt, Homo sapiens
ccaagaagaacaacaacaa

SEQ ID NO: 903032 - RNA, 19 nt, Homo sapiens
gcacaugaacugcauccuu

SEQ ID NO: 903033 - RNA, 19 nt, Homo sapiens
agaauuaacucgugcuaag

SEQ ID NO: 903034 - RNA, 19 nt, Homo sapiens
gaagauagaguggugacuu

SEQ ID NO: 903035 - RNA, 19 nt, Homo sapiens
guacauuccugaggcauca

SEQ ID NO: 903036 - RNA, 19 nt, Homo sapiens
cuagaccgauucuguguga

SEQ ID NO: 903037 - RNA, 19 nt, Homo sapiens
gaaguuaagagcuuucauc

SEQ ID NO: 903038 - RNA, 19 nt, Homo sapiens
acagagaaguuaagagcuu

SEQ ID NO: 903039 - RNA, 19 nt, Homo sapiens
gggagcaucguguuccuua

SEQ ID NO: 903040 - RNA, 19 nt, Homo sapiens
gcccagcacuguuuaccuu

SEQ ID NO: 903041 - RNA, 19 nt, Homo sapiens
uaagaaccuugccaacuuc

SEQ ID NO: 903042 - RNA, 19 nt, Homo sapiens
caagaagaacaacaacaaa

SEQ ID NO: 903043 - RNA, 19 nt, Homo sapiens
ccgaguagcugggauuaga

SEQ ID NO: 903044 - RNA, 19 nt, Homo sapiens
gcagcugggugagugcuaa

SEQ ID NO: 903045 - RNA, 19 nt, Homo sapiens
aaucauuccuuaucucaga

SEQ ID NO: 903046 - RNA, 19 nt, Homo sapiens
gcugauuuccuccuuauga

SEQ ID NO: 903047 - RNA, 19 nt, Homo sapiens
cuaaguaaauggguauaug

SEQ ID NO: 903048 - RNA, 19 nt, Homo sapiens
ccuauccucugaccuuaaa

SEQ ID NO: 903049 - RNA, 19 nt, Homo sapiens
ggaagcccagcacuguuua

SEQ ID NO: 903050 - RNA, 19 nt, Homo sapiens
caaccucagugugucauug

SEQ ID NO: 903051 - RNA, 19 nt, Homo sapiens
uaagagcuuucauccuuuc

SEQ ID NO: 903052 - RNA, 19 nt, Homo sapiens
gggcauguucacucucuua

SEQ ID NO: 903053 - RNA, 19 nt, Homo sapiens
gcaucaguguggcaaauag

SEQ ID NO: 903054 - RNA, 19 nt, Homo sapiens
guuuagagcgcuuaaguug

SEQ ID NO: 903055 - RNA, 19 nt, Homo sapiens
uguaaagcauuaagcauag

SEQ ID NO: 903056 - RNA, 19 nt, Homo sapiens
gcuacaaaguggugaacau

SEQ ID NO: 903057 - RNA, 19 nt, Homo sapiens
uuaagagcuuucauccuuu

SEQ ID NO: 903058 - RNA, 19 nt, Homo sapiens
cagagaaguuaagagcuuu

SEQ ID NO: 903059 - RNA, 19 nt, Homo sapiens
caacucuuaugugacagua

SEQ ID NO: 903060 - RNA, 19 nt, Homo sapiens
ccugguagcccaagaagaa

SEQ ID NO: 903061 - RNA, 19 nt, Homo sapiens
acucuuaugugacaguaaa

SEQ ID NO: 903062 - RNA, 19 nt, Homo sapiens
gauaagcaucugugccauu

SEQ ID NO: 903063 - RNA, 19 nt, Homo sapiens
ugaacaagcagaccaacaa

SEQ ID NO: 903064 - RNA, 19 nt, Homo sapiens
ucacacaacuauaccuuuu

SEQ ID NO: 903065 - RNA, 19 nt, Homo sapiens
uaauacaaccucagugugu

SEQ ID NO: 903066 - RNA, 19 nt, Homo sapiens
gucuugaucuccugacuug

SEQ ID NO: 903067 - RNA, 19 nt, Homo sapiens
gaaaccgggcucagucaau

SEQ ID NO: 903068 - RNA, 19 nt, Homo sapiens
auagaguggugacuuagaa

SEQ ID NO: 903069 - RNA, 19 nt, Homo sapiens
gcggacagguauuucaaag

SEQ ID NO: 903070 - RNA, 19 nt, Homo sapiens
gaagaguaaaggcaagaau

SEQ ID NO: 903071 - RNA, 19 nt, Homo sapiens
gguuucugcuuccacauga

SEQ ID NO: 903072 - RNA, 19 nt, Homo sapiens
caaagugcuuggauuacag

SEQ ID NO: 903073 - RNA, 19 nt, Homo sapiens
ucaugugacugugaauuga

SEQ ID NO: 903074 - RNA, 19 nt, Homo sapiens
ggagguuccaguugauuga

SEQ ID NO: 903075 - RNA, 19 nt, Homo sapiens
ugaccuucuucaaaucuuu

SEQ ID NO: 903076 - RNA, 19 nt, Homo sapiens
agaauucuuaccagcauua

SEQ ID NO: 903077 - RNA, 19 nt, Homo sapiens
caugguggcucgcgcuugu

SEQ ID NO: 903078 - RNA, 19 nt, Homo sapiens
aaucugcucugaccuucuu

SEQ ID NO: 903079 - RNA, 19 nt, Homo sapiens
ggccgaaugaggcucuuua

SEQ ID NO: 903080 - RNA, 19 nt, Homo sapiens
gaguggagcaugugugugu

SEQ ID NO: 903081 - RNA, 19 nt, Homo sapiens
auaagcaucugugccauug

SEQ ID NO: 903082 - RNA, 19 nt, Homo sapiens
gacaggcucggaugaagaa

SEQ ID NO: 903083 - RNA, 19 nt, Homo sapiens
aagugcauguaaagcauua

SEQ ID NO: 903084 - RNA, 19 nt, Homo sapiens
uuacugaauucguauuugg

SEQ ID NO: 903085 - RNA, 19 nt, Homo sapiens
ccaacaacacugaggaaga

SEQ ID NO: 903086 - RNA, 19 nt, Homo sapiens
cucaguaaauguuuguuga

SEQ ID NO: 903087 - RNA, 19 nt, Homo sapiens
aaaccgggcucagucaauc

SEQ ID NO: 903088 - RNA, 19 nt, Homo sapiens
gauagaguggugacuuaga

SEQ ID NO: 903089 - RNA, 19 nt, Homo sapiens
agaagaggaccugcacaua

SEQ ID NO: 903090 - RNA, 19 nt, Homo sapiens
gcaagacucccucauacac

SEQ ID NO: 903091 - RNA, 19 nt, Homo sapiens
ccaaaguggugggaucaca

SEQ ID NO: 903092 - RNA, 19 nt, Homo sapiens
aguggugacuuagaauuaa

SEQ ID NO: 903093 - RNA, 19 nt, Homo sapiens
acagugagaugcaaaguaa

SEQ ID NO: 903094 - RNA, 19 nt, Homo sapiens
gaucgaaucucgccugcuu

SEQ ID NO: 903095 - RNA, 19 nt, Homo sapiens
gaaaggagacaaccaugaa

SEQ ID NO: 903096 - RNA, 19 nt, Homo sapiens
ccaugaagcuuacaucguu

SEQ ID NO: 903097 - RNA, 19 nt, Homo sapiens
caauggaacuccugguaaa

SEQ ID NO: 903098 - RNA, 19 nt, Homo sapiens
gggcagagcuucuaguucu

SEQ ID NO: 903099 - RNA, 19 nt, Homo sapiens
agaaugggaugcauguaua

SEQ ID NO: 903100 - RNA, 19 nt, Homo sapiens
gcacgaaggcuaaccauuc

SEQ ID NO: 903101 - RNA, 19 nt, Homo sapiens
cggaugaacucaauacuau

SEQ ID NO: 903102 - RNA, 19 nt, Homo sapiens
caucguuucuagaccauua

SEQ ID NO: 903103 - RNA, 19 nt, Homo sapiens
caaacaacccuugaaauau

SEQ ID NO: 903104 - RNA, 19 nt, Homo sapiens
ccgaugaccuucuugauca

SEQ ID NO: 903105 - RNA, 19 nt, Homo sapiens
gcugugguguggaucauuu

SEQ ID NO: 903106 - RNA, 19 nt, Homo sapiens
ggaaauugcacugaugaaa

SEQ ID NO: 903107 - RNA, 19 nt, Homo sapiens
gcucugaacaccuuuggua

SEQ ID NO: 903108 - RNA, 19 nt, Homo sapiens
ugaaugagccacuagacua

SEQ ID NO: 903109 - RNA, 19 nt, Homo sapiens
ccacuagacuauuuagcaa

SEQ ID NO: 903110 - RNA, 19 nt, Homo sapiens
caaguaaucaugugccaaa

SEQ ID NO: 903111 - RNA, 19 nt, Homo sapiens
ccuaagauguucaggaugu

SEQ ID NO: 903112 - RNA, 19 nt, Homo sapiens
gaagagcagcaccaucauu

SEQ ID NO: 903113 - RNA, 19 nt, Homo sapiens
gcaaugcaguagugauauc

SEQ ID NO: 903114 - RNA, 19 nt, Homo sapiens
caaacugacagcugccuua

SEQ ID NO: 903115 - RNA, 19 nt, Homo sapiens
caggaugucucccucaaug

SEQ ID NO: 903116 - RNA, 19 nt, Homo sapiens
gaaccuggccugcacagau

SEQ ID NO: 903117 - RNA, 19 nt, Homo sapiens
cuaccucccuguuauuuau

SEQ ID NO: 903118 - RNA, 19 nt, Homo sapiens
caacaggaccaacagauca

SEQ ID NO: 903119 - RNA, 19 nt, Homo sapiens
gaaaacaucccacucaaga

SEQ ID NO: 903120 - RNA, 19 nt, Homo sapiens
aagagcagcaccaucauua

SEQ ID NO: 903121 - RNA, 19 nt, Homo sapiens
gcauguauaucagcaaagu

SEQ ID NO: 903122 - RNA, 19 nt, Homo sapiens
guggaucauuucauuggua

SEQ ID NO: 903123 - RNA, 19 nt, Homo sapiens
gaaugagccacuagacuau

SEQ ID NO: 903124 - RNA, 19 nt, Homo sapiens
gagauuucauguguaaguu

SEQ ID NO: 903125 - RNA, 19 nt, Homo sapiens
gagcagcaccaucauuaug

SEQ ID NO: 903126 - RNA, 19 nt, Homo sapiens
agcaaaguauucagacaua

SEQ ID NO: 903127 - RNA, 19 nt, Homo sapiens
gcugauacuuuaccuagca

SEQ ID NO: 903128 - RNA, 19 nt, Homo sapiens
gaaaaucaguuacucaaac

SEQ ID NO: 903129 - RNA, 19 nt, Homo sapiens
gcacuaccucccuguuauu

SEQ ID NO: 903130 - RNA, 19 nt, Homo sapiens
gcaaaguauucagacauag

SEQ ID NO: 903131 - RNA, 19 nt, Homo sapiens
aagcuuacaucguuucuag

SEQ ID NO: 903132 - RNA, 19 nt, Homo sapiens
gcaccaucauuaugcugaa

SEQ ID NO: 903133 - RNA, 19 nt, Homo sapiens
gaaauugcacugaugaaaa

SEQ ID NO: 903134 - RNA, 19 nt, Homo sapiens
gcagagcuucuaguucuuu

SEQ ID NO: 903135 - RNA, 19 nt, Homo sapiens
guuguuccauugagaauca

SEQ ID NO: 903136 - RNA, 19 nt, Homo sapiens
gaaucucgccugcuuucaa

SEQ ID NO: 903137 - RNA, 19 nt, Homo sapiens
cccauggacugcaaacuga

SEQ ID NO: 903138 - RNA, 19 nt, Homo sapiens
gcuacugugugaucauuca

SEQ ID NO: 903139 - RNA, 19 nt, Homo sapiens
ggagauuucauguguaagu

SEQ ID NO: 903140 - RNA, 19 nt, Homo sapiens
uuggagauuucauguguaa

SEQ ID NO: 903141 - RNA, 19 nt, Homo sapiens
uagcugcucugaacaccuu

SEQ ID NO: 903142 - RNA, 19 nt, Homo sapiens
cagaaagcacgaaggcuaa

SEQ ID NO: 903143 - RNA, 19 nt, Homo sapiens
cuucugaucuccccgauua

SEQ ID NO: 903144 - RNA, 19 nt, Homo sapiens
ucaauggaacuccugguaa

SEQ ID NO: 903145 - RNA, 19 nt, Homo sapiens
acaaauacuugcugauacu

SEQ ID NO: 903146 - RNA, 19 nt, Homo sapiens
uaagugguacaaccuaauu

SEQ ID NO: 903147 - RNA, 19 nt, Homo sapiens
gaaugggaugcauguauau

SEQ ID NO: 903148 - RNA, 19 nt, Homo sapiens
ugaaaggagacaaccauga

SEQ ID NO: 903149 - RNA, 19 nt, Homo sapiens
caugaagcuuacaucguuu

SEQ ID NO: 903150 - RNA, 19 nt, Homo sapiens
gauauccacuuacauuuuc

SEQ ID NO: 903151 - RNA, 19 nt, Homo sapiens
ccuguuauuuauggcauua

SEQ ID NO: 903152 - RNA, 19 nt, Homo sapiens
gaacuccugguaaauacug

SEQ ID NO: 903153 - RNA, 19 nt, Homo sapiens
uggaagagcagcaccauca

SEQ ID NO: 903154 - RNA, 19 nt, Homo sapiens
guauaucagcaaaguauuc

SEQ ID NO: 903155 - RNA, 19 nt, Homo sapiens
ggaugucucccucaaugga

SEQ ID NO: 903156 - RNA, 19 nt, Homo sapiens
gguggucagcgacaacuuu

SEQ ID NO: 903157 - RNA, 19 nt, Homo sapiens
guucuuugcaaucccuuua

SEQ ID NO: 903158 - RNA, 19 nt, Homo sapiens
ucagauccaugaagcuuac

SEQ ID NO: 903159 - RNA, 19 nt, Homo sapiens
gugauauccacuuacauuu

SEQ ID NO: 903160 - RNA, 19 nt, Homo sapiens
caaaguauucagacauagu

SEQ ID NO: 903161 - RNA, 19 nt, Homo sapiens
guauucaaguaaucaugug

SEQ ID NO: 903162 - RNA, 19 nt, Homo sapiens
caaaguaagcgggaaccuu

SEQ ID NO: 903163 - RNA, 19 nt, Homo sapiens
gagaaucagauccaugaag

SEQ ID NO: 903164 - RNA, 19 nt, Homo sapiens
ugguguggaucauuucauu

SEQ ID NO: 903165 - RNA, 19 nt, Homo sapiens
ccaaugagcugcuuuucca

SEQ ID NO: 903166 - RNA, 19 nt, Homo sapiens
ggcgaaaacuggaucuuug

SEQ ID NO: 903167 - RNA, 19 nt, Homo sapiens
aaucucgccugcuuucaau

SEQ ID NO: 903168 - RNA, 19 nt, Homo sapiens
cacgaaggcuaaccauucu

SEQ ID NO: 903169 - RNA, 19 nt, Homo sapiens
aggcaaugcaguagugaua

SEQ ID NO: 903170 - RNA, 19 nt, Homo sapiens
uuaccuagcauccuaagau

SEQ ID NO: 903171 - RNA, 19 nt, Homo sapiens
uacuuuaccuagcauccua

SEQ ID NO: 903172 - RNA, 19 nt, Homo sapiens
ccacgauuauccacacucu

SEQ ID NO: 903173 - RNA, 19 nt, Homo sapiens
aagaaugggaugcauguau

SEQ ID NO: 903174 - RNA, 19 nt, Homo sapiens
gcuucuaguucuuugcaau

SEQ ID NO: 903175 - RNA, 19 nt, Homo sapiens
cuuuggagauuucaugugu

SEQ ID NO: 903176 - RNA, 19 nt, Homo sapiens
augagccacuagacuauuu

SEQ ID NO: 903177 - RNA, 19 nt, Homo sapiens
ccgcuacugugugaucauu

SEQ ID NO: 903178 - RNA, 19 nt, Homo sapiens
ucagcaaaguauucagaca

SEQ ID NO: 903179 - RNA, 19 nt, Homo sapiens
uaucagcaaaguauucaga

SEQ ID NO: 903180 - RNA, 19 nt, Homo sapiens
gauauaagaaugggaugca

SEQ ID NO: 903181 - RNA, 19 nt, Homo sapiens
aacaaauacuugcugauac

SEQ ID NO: 903182 - RNA, 19 nt, Homo sapiens
cagagcuucuaguucuuug

SEQ ID NO: 903183 - RNA, 19 nt, Homo sapiens
ugcacuaccucccuguuau

SEQ ID NO: 903184 - RNA, 19 nt, Homo sapiens
gccacuagacuauuuagca

SEQ ID NO: 903185 - RNA, 19 nt, Homo sapiens
accauuagcugcucugaac

SEQ ID NO: 903186 - RNA, 19 nt, Homo sapiens
acgauuauccacacucuga

SEQ ID NO: 903187 - RNA, 19 nt, Homo sapiens
ucggaugaacucaauacua

SEQ ID NO: 903188 - RNA, 19 nt, Homo sapiens
cgcuucagcuuccauuuca

SEQ ID NO: 903189 - RNA, 19 nt, Homo sapiens
ucuuugcaaucccuuuauu

SEQ ID NO: 903190 - RNA, 19 nt, Homo sapiens
uggaacuccugguaaauac

SEQ ID NO: 903191 - RNA, 19 nt, Homo sapiens
gaagcuuacaucguuucua

SEQ ID NO: 903192 - RNA, 19 nt, Homo sapiens
uugagaaucagauccauga

SEQ ID NO: 903193 - RNA, 19 nt, Homo sapiens
gcaagugccugaccuacag

SEQ ID NO: 903194 - RNA, 19 nt, Homo sapiens
gaagauuggcauugcuauu

SEQ ID NO: 903195 - RNA, 19 nt, Homo sapiens
gcauugcuauugcgaccuu

SEQ ID NO: 903196 - RNA, 19 nt, Homo sapiens
ugacagcucucuggaugug

SEQ ID NO: 903197 - RNA, 19 nt, Homo sapiens
gacagucgcuggccuucuc

SEQ ID NO: 903198 - RNA, 19 nt, Homo sapiens
cgaccuuccucaucugcuu

SEQ ID NO: 903199 - RNA, 19 nt, Homo sapiens
ccaggaagauuggcauugc

SEQ ID NO: 903200 - RNA, 19 nt, Homo sapiens
gcucguggcuuggcuacag

SEQ ID NO: 903201 - RNA, 19 nt, Homo sapiens
ggaagauuggcauugcuau

SEQ ID NO: 903202 - RNA, 19 nt, Homo sapiens
aagauuggcauugcuauug

SEQ ID NO: 903203 - RNA, 19 nt, Homo sapiens
cacuggugcugcuuuguug

SEQ ID NO: 903204 - RNA, 19 nt, Homo sapiens
uggccgacccguucacgua

SEQ ID NO: 903205 - RNA, 19 nt, Homo sapiens
ccguggcgcugcuauccaa

SEQ ID NO: 903206 - RNA, 19 nt, Homo sapiens
ggacaccgucaccaugaag

SEQ ID NO: 903207 - RNA, 19 nt, Homo sapiens
gcccagcauccacccauga

SEQ ID NO: 903208 - RNA, 19 nt, Homo sapiens
gugcaccggcugcugaaga

SEQ ID NO: 903209 - RNA, 19 nt, Homo sapiens
gaccuuccucaucugcuuu

SEQ ID NO: 903210 - RNA, 19 nt, Homo sapiens
acaccuuccuggcguccaa

SEQ ID NO: 903211 - RNA, 19 nt, Homo sapiens
gcucacagcugccucaauc

SEQ ID NO: 903212 - RNA, 19 nt, Homo sapiens
aagacuggcuucaggcaua

SEQ ID NO: 903213 - RNA, 19 nt, Homo sapiens
ggagcucaaugaugucuuc

SEQ ID NO: 903214 - RNA, 19 nt, Homo sapiens
guggguguguaucuucuua

SEQ ID NO: 903215 - RNA, 19 nt, Homo sapiens
gguguaggcuggagagaca

SEQ ID NO: 903216 - RNA, 19 nt, Homo sapiens
cuucuuaucucauuucaca

SEQ ID NO: 903217 - RNA, 19 nt, Homo sapiens
uccaggagcucaaugaugu

SEQ ID NO: 903218 - RNA, 19 nt, Homo sapiens
ggaacgauucugucagcua

SEQ ID NO: 903219 - RNA, 19 nt, Homo sapiens
uuuaggcacuagagauaua

SEQ ID NO: 903220 - RNA, 19 nt, Homo sapiens
cggauuugcugugcuguuu

SEQ ID NO: 903221 - RNA, 19 nt, Homo sapiens
gaaaguguggacagcaaga

SEQ ID NO: 903222 - RNA, 19 nt, Homo sapiens
gauuugcugugcuguuugu

SEQ ID NO: 903223 - RNA, 19 nt, Homo sapiens
cccaugcucuuccuguauu

SEQ ID NO: 903224 - RNA, 19 nt, Homo sapiens
ggauccaggagcucaauga

SEQ ID NO: 903225 - RNA, 19 nt, Homo sapiens
gccacgugcuggacaaauc

SEQ ID NO: 903226 - RNA, 19 nt, Homo sapiens
agauauccaucaugcacuu

SEQ ID NO: 903227 - RNA, 19 nt, Homo sapiens
guguguaucuucuuaucuc

SEQ ID NO: 903228 - RNA, 19 nt, Homo sapiens
ggguguguaucuucuuauc

SEQ ID NO: 903229 - RNA, 19 nt, Homo sapiens
gagacauugugggugugua

SEQ ID NO: 903230 - RNA, 19 nt, Homo sapiens
ccaugcucuuccuguauuu

SEQ ID NO: 903231 - RNA, 19 nt, Homo sapiens
ucauccugcugaccaugua

SEQ ID NO: 903232 - RNA, 19 nt, Homo sapiens
agauauagcagugaccaaa

SEQ ID NO: 903233 - RNA, 19 nt, Homo sapiens
caucaugcacuugcuaugu

SEQ ID NO: 903234 - RNA, 19 nt, Homo sapiens
uuccuucauucaacagaua

SEQ ID NO: 903235 - RNA, 19 nt, Homo sapiens
acgaaaguguggacagcaa

SEQ ID NO: 903236 - RNA, 19 nt, Homo sapiens
agaaauccaccagccauga

SEQ ID NO: 903237 - RNA, 19 nt, Homo sapiens
gaccaaaacagacacaaau

SEQ ID NO: 903238 - RNA, 19 nt, Homo sapiens
gaaauccaccagccaugac

SEQ ID NO: 903239 - RNA, 19 nt, Homo sapiens
ggugacugccauccgguuu

SEQ ID NO: 903240 - RNA, 19 nt, Homo sapiens
gauccaggagcucaaugau

SEQ ID NO: 903241 - RNA, 19 nt, Homo sapiens
ugcagugugugguggacua

SEQ ID NO: 903242 - RNA, 19 nt, Homo sapiens
uuuauuccuuccuucauuc

SEQ ID NO: 903243 - RNA, 19 nt, Homo sapiens
uaucucauuucacaagacu

SEQ ID NO: 903244 - RNA, 19 nt, Homo sapiens
gagcaucucuggaaguuga

SEQ ID NO: 903245 - RNA, 19 nt, Homo sapiens
gaacugcucuuggcucuga

SEQ ID NO: 903246 - RNA, 19 nt, Homo sapiens
gcaagcaccucaagucgaa

SEQ ID NO: 903247 - RNA, 19 nt, Homo sapiens
ugacacagcucaacacaug

SEQ ID NO: 903248 - RNA, 19 nt, Homo sapiens
gcaaucaaguggcgccuaa

SEQ ID NO: 903249 - RNA, 19 nt, Homo sapiens
gaaccagacugaugcaauc

SEQ ID NO: 903250 - RNA, 19 nt, Homo sapiens
ggaaguugaugguagaaga

SEQ ID NO: 903251 - RNA, 19 nt, Homo sapiens
uggauaaucuucaguacua

SEQ ID NO: 903252 - RNA, 19 nt, Homo sapiens
gaaacagucuacaaacaca

SEQ ID NO: 903253 - RNA, 19 nt, Homo sapiens
ggaccagcaugaagaauuc

SEQ ID NO: 903254 - RNA, 19 nt, Homo sapiens
caagguggguuacauggaa

SEQ ID NO: 903255 - RNA, 19 nt, Homo sapiens
caacuacuguuacgacuag

SEQ ID NO: 903256 - RNA, 19 nt, Homo sapiens
gcucaauccuuuauccuau

SEQ ID NO: 903257 - RNA, 19 nt, Homo sapiens
ugagagaacugcaggacuu

SEQ ID NO: 903258 - RNA, 19 nt, Homo sapiens
uaagaaaucacauggcauu

SEQ ID NO: 903259 - RNA, 19 nt, Homo sapiens
uaacugagcaugaugugaa

SEQ ID NO: 903260 - RNA, 19 nt, Homo sapiens
ugaaugaaauccuagaucu

SEQ ID NO: 903261 - RNA, 19 nt, Homo sapiens
ucaguacuaucuccaggua

SEQ ID NO: 903262 - RNA, 19 nt, Homo sapiens
caccaucucugaagcaguu

SEQ ID NO: 903263 - RNA, 19 nt, Homo sapiens
uaucacaugucaacuacuu

SEQ ID NO: 903264 - RNA, 19 nt, Homo sapiens
uauauucgcuucacugagu

SEQ ID NO: 903265 - RNA, 19 nt, Homo sapiens
gaaccuaggcccacuggau

SEQ ID NO: 903266 - RNA, 19 nt, Homo sapiens
ggaguggccugcagguauc

SEQ ID NO: 903267 - RNA, 19 nt, Homo sapiens
gcacuugacaaucgaguau

SEQ ID NO: 903268 - RNA, 19 nt, Homo sapiens
ggucagcugaagaucauua

SEQ ID NO: 903269 - RNA, 19 nt, Homo sapiens
caacucagauuuggcucaa

SEQ ID NO: 903270 - RNA, 19 nt, Homo sapiens
caucagaucaacucagauu

SEQ ID NO: 903271 - RNA, 19 nt, Homo sapiens
ucaaguggcgccuaagaaa

SEQ ID NO: 903272 - RNA, 19 nt, Homo sapiens
ucaagauucucuccagugu

SEQ ID NO: 903273 - RNA, 19 nt, Homo sapiens
gaaguugaugguagaagaa

SEQ ID NO: 903274 - RNA, 19 nt, Homo sapiens
aagauucucuccaguguuc

SEQ ID NO: 903275 - RNA, 19 nt, Homo sapiens
cacaagguauugcuagaug

SEQ ID NO: 903276 - RNA, 19 nt, Homo sapiens
gcuagaugaugacaaccuu

SEQ ID NO: 903277 - RNA, 19 nt, Homo sapiens
gaauguggccuuucaacag

SEQ ID NO: 903278 - RNA, 19 nt, Homo sapiens
ccauaucacaugucaacua

SEQ ID NO: 903279 - RNA, 19 nt, Homo sapiens
gaaccugacuagaaaagga

SEQ ID NO: 903280 - RNA, 19 nt, Homo sapiens
ugugaugguuguaguagaa

SEQ ID NO: 903281 - RNA, 19 nt, Homo sapiens
ggaaucaucagaucaacuc

SEQ ID NO: 903282 - RNA, 19 nt, Homo sapiens
uggaaacagucuacaaaca

SEQ ID NO: 903283 - RNA, 19 nt, Homo sapiens
ucagaucaacucagauuug

SEQ ID NO: 903284 - RNA, 19 nt, Homo sapiens
ucacuccuguucaagauuc

SEQ ID NO: 903285 - RNA, 19 nt, Homo sapiens
gaccaguuccagcuucuuu

SEQ ID NO: 903286 - RNA, 19 nt, Homo sapiens
cauaucacaugucaacuac

SEQ ID NO: 903287 - RNA, 19 nt, Homo sapiens
agauuuggcucaacuacug

SEQ ID NO: 903288 - RNA, 19 nt, Homo sapiens
gcucggcacagacuauauu

SEQ ID NO: 903289 - RNA, 19 nt, Homo sapiens
gaaaacaacugagagaacu

SEQ ID NO: 903290 - RNA, 19 nt, Homo sapiens
aaugugaaccugacuagaa

SEQ ID NO: 903291 - RNA, 19 nt, Homo sapiens
ggaaacagucuacaaacac

SEQ ID NO: 903292 - RNA, 19 nt, Homo sapiens
ggauaaucuucaguacuau

SEQ ID NO: 903293 - RNA, 19 nt, Homo sapiens
acagucagcacacaaggua

SEQ ID NO: 903294 - RNA, 19 nt, Homo sapiens
ucgcuucacugaguucauu

SEQ ID NO: 903295 - RNA, 19 nt, Homo sapiens
ucucccagcugcuucauca

SEQ ID NO: 903296 - RNA, 19 nt, Homo sapiens
cgaggaggaucugggcauu

SEQ ID NO: 903297 - RNA, 19 nt, Homo sapiens
gcagguaucgcaggacuuc

SEQ ID NO: 903298 - RNA, 19 nt, Homo sapiens
cagaucaacucagauuugg

SEQ ID NO: 903299 - RNA, 19 nt, Homo sapiens
gccacuacauauucucuuc

SEQ ID NO: 903300 - RNA, 19 nt, Homo sapiens
acaagguauugcuagauga

SEQ ID NO: 903301 - RNA, 19 nt, Homo sapiens
gaacaugcuggcaccaucu

SEQ ID NO: 903302 - RNA, 19 nt, Homo sapiens
guacacgggccaugugcaa

SEQ ID NO: 903303 - RNA, 19 nt, Homo sapiens
gaccacuuccugagcaauu

SEQ ID NO: 903304 - RNA, 19 nt, Homo sapiens
ugagaccaguguccugaau

SEQ ID NO: 903305 - RNA, 19 nt, Homo sapiens
gcacugcugggcccuacaa

SEQ ID NO: 903306 - RNA, 19 nt, Homo sapiens
ucagcuugguggacuuuga

SEQ ID NO: 903307 - RNA, 19 nt, Homo sapiens
aaagauucaugguugucaa

SEQ ID NO: 903308 - RNA, 19 nt, Homo sapiens
uuucaggccuucauugaca

SEQ ID NO: 903309 - RNA, 19 nt, Homo sapiens
aauccuauuuguuggagaa

SEQ ID NO: 903310 - RNA, 19 nt, Homo sapiens
aguacuaucuccagguaga

SEQ ID NO: 903311 - RNA, 19 nt, Homo sapiens
caaguggcgccuaagaaau

SEQ ID NO: 903312 - RNA, 19 nt, Homo sapiens
ggacguggagaacuguuuc

SEQ ID NO: 903313 - RNA, 19 nt, Homo sapiens
ccuggaaacagucuacaaa

SEQ ID NO: 903314 - RNA, 19 nt, Homo sapiens
agucuucacuccuguucaa

SEQ ID NO: 903315 - RNA, 19 nt, Homo sapiens
gcuggucagucagaaccua

SEQ ID NO: 903316 - RNA, 19 nt, Homo sapiens
uuugcuggcucaauccuuu

SEQ ID NO: 903317 - RNA, 19 nt, Homo sapiens
caauucuacccgagacuuu

SEQ ID NO: 903318 - RNA, 19 nt, Homo sapiens
cagcuguccuggaaaagua

SEQ ID NO: 903319 - RNA, 19 nt, Homo sapiens
cacacaagguauugcuaga

SEQ ID NO: 903320 - RNA, 19 nt, Homo sapiens
agcugaagaucauuaaaga

SEQ ID NO: 903321 - RNA, 19 nt, Homo sapiens
guccagauguuugagaauc

SEQ ID NO: 903322 - RNA, 19 nt, Homo sapiens
gucaaauccuggaaacagu

SEQ ID NO: 903323 - RNA, 19 nt, Homo sapiens
gcugagcauucucgugaag

SEQ ID NO: 903324 - RNA, 19 nt, Homo sapiens
uuuguucgcuggucaguca

SEQ ID NO: 903325 - RNA, 19 nt, Homo sapiens
gggccaagguggguuacau

SEQ ID NO: 903326 - RNA, 19 nt, Homo sapiens
uggcugagcaucucuggaa

SEQ ID NO: 903327 - RNA, 19 nt, Homo sapiens
gcacuguggcugagcaucu

SEQ ID NO: 903328 - RNA, 19 nt, Homo sapiens
cagcugaagaucauuaaag

SEQ ID NO: 903329 - RNA, 19 nt, Homo sapiens
ucuggaaguugaugguaga

SEQ ID NO: 903330 - RNA, 19 nt, Homo sapiens
cugagcaucucuggaaguu

SEQ ID NO: 903331 - RNA, 19 nt, Homo sapiens
augugaaccugacuagaaa

SEQ ID NO: 903332 - RNA, 19 nt, Homo sapiens
ccagugaggguugcugaaa

SEQ ID NO: 903333 - RNA, 19 nt, Homo sapiens
gcauccgauuggcucauga

SEQ ID NO: 903334 - RNA, 19 nt, Homo sapiens
uagauguguuggagucuca

SEQ ID NO: 903335 - RNA, 19 nt, Homo sapiens
aauguggccuuucaacagu

SEQ ID NO: 903336 - RNA, 19 nt, Homo sapiens
gaaugaaauccuagaucuc

SEQ ID NO: 903337 - RNA, 19 nt, Homo sapiens
cugcugggcccuacaaaug

SEQ ID NO: 903338 - RNA, 19 nt, Homo sapiens
uaucgcaggacuucccuuu

SEQ ID NO: 903339 - RNA, 19 nt, Homo sapiens
cggaguggccugcagguau

SEQ ID NO: 903340 - RNA, 19 nt, Homo sapiens
agguauugcuagaugauga

SEQ ID NO: 903341 - RNA, 19 nt, Homo sapiens
ugaugugaauguggccuuu

SEQ ID NO: 903342 - RNA, 19 nt, Homo sapiens
cuacuguuacgacuagauu

SEQ ID NO: 903343 - RNA, 19 nt, Homo sapiens
gguggauaaucuucaguac

SEQ ID NO: 903344 - RNA, 19 nt, Homo sapiens
gaacuuaacuauucuggaa

SEQ ID NO: 903345 - RNA, 19 nt, Homo sapiens
gcaguuagcuuaaauuaca

SEQ ID NO: 903346 - RNA, 19 nt, Homo sapiens
ccacaugaauaaagcaaua

SEQ ID NO: 903347 - RNA, 19 nt, Homo sapiens
gaaagcacacucccuuaua

SEQ ID NO: 903348 - RNA, 19 nt, Homo sapiens
ccaauuaagugcaguuuau

SEQ ID NO: 903349 - RNA, 19 nt, Homo sapiens
ugacugaccuuaagauguu

SEQ ID NO: 903350 - RNA, 19 nt, Homo sapiens
gccaagaccucgagaaaug

SEQ ID NO: 903351 - RNA, 19 nt, Homo sapiens
gcaggugccuuauucuuug

SEQ ID NO: 903352 - RNA, 19 nt, Homo sapiens
gagcagugucuauguauua

SEQ ID NO: 903353 - RNA, 19 nt, Homo sapiens
guuauuggcucucuucauu

SEQ ID NO: 903354 - RNA, 19 nt, Homo sapiens
aaacgaaagcugugucuua

SEQ ID NO: 903355 - RNA, 19 nt, Homo sapiens
ucauguaacuguccuguaa

SEQ ID NO: 903356 - RNA, 19 nt, Homo sapiens
gauuaugcauguuuaggua

SEQ ID NO: 903357 - RNA, 19 nt, Homo sapiens
aaaguucccugaauauuug

SEQ ID NO: 903358 - RNA, 19 nt, Homo sapiens
gcgaaguuauccuuaguuu

SEQ ID NO: 903359 - RNA, 19 nt, Homo sapiens
cgaaagcugugucuuacuu

SEQ ID NO: 903360 - RNA, 19 nt, Homo sapiens
gaaguuauccuuaguuugc

SEQ ID NO: 903361 - RNA, 19 nt, Homo sapiens
cauagcaggugccuuauuc

SEQ ID NO: 903362 - RNA, 19 nt, Homo sapiens
gcagagugguuaaggacuu

SEQ ID NO: 903363 - RNA, 19 nt, Homo sapiens
uaaaguggcaucuggaauu

SEQ ID NO: 903364 - RNA, 19 nt, Homo sapiens
ggaauugaauggauuuacu

SEQ ID NO: 903365 - RNA, 19 nt, Homo sapiens
gaaaucugcuaccuagucu

SEQ ID NO: 903366 - RNA, 19 nt, Homo sapiens
gggaagguuuguuuauguu

SEQ ID NO: 903367 - RNA, 19 nt, Homo sapiens
gcuuguguuugcuuuguua

SEQ ID NO: 903368 - RNA, 19 nt, Homo sapiens
ggaagguuuguuuauguua

SEQ ID NO: 903369 - RNA, 19 nt, Homo sapiens
uuauauagcuaggcacuuu

SEQ ID NO: 903370 - RNA, 19 nt, Homo sapiens
gaacucauuccugauguuu

SEQ ID NO: 903371 - RNA, 19 nt, Homo sapiens
gaagagaaggcgucuguag

SEQ ID NO: 903372 - RNA, 19 nt, Homo sapiens
gauauuuggcuuuaaguug

SEQ ID NO: 903373 - RNA, 19 nt, Homo sapiens
uaagggagcagagugguua

SEQ ID NO: 903374 - RNA, 19 nt, Homo sapiens
uuaaugcguuggaaagaaa

SEQ ID NO: 903375 - RNA, 19 nt, Homo sapiens
ggaaaucugcuaccuaguc

SEQ ID NO: 903376 - RNA, 19 nt, Homo sapiens
gcuaggcacuuuauuacuc

SEQ ID NO: 903377 - RNA, 19 nt, Homo sapiens
uaacuguccuguaauaagg

SEQ ID NO: 903378 - RNA, 19 nt, Homo sapiens
ugaagugacugaccuuaag

SEQ ID NO: 903379 - RNA, 19 nt, Homo sapiens
gucaaaccauuccauauca

SEQ ID NO: 903380 - RNA, 19 nt, Homo sapiens
ggagcagagugguuaagga

SEQ ID NO: 903381 - RNA, 19 nt, Homo sapiens
gaagauggucgccaagcaa

SEQ ID NO: 903382 - RNA, 19 nt, Homo sapiens
gaagguuuguuuauguuac

SEQ ID NO: 903383 - RNA, 19 nt, Homo sapiens
gcuuuaaguuguuguuugu

SEQ ID NO: 903384 - RNA, 19 nt, Homo sapiens
aaagcacacucccuuauag

SEQ ID NO: 903385 - RNA, 19 nt, Homo sapiens
guaggacccugguuauugg

SEQ ID NO: 903386 - RNA, 19 nt, Homo sapiens
uuaauugccucaggauauu

SEQ ID NO: 903387 - RNA, 19 nt, Homo sapiens
gcacacucccuuauagguu

SEQ ID NO: 903388 - RNA, 19 nt, Homo sapiens
uaacccaaauguauaacug

SEQ ID NO: 903389 - RNA, 19 nt, Homo sapiens
guuggauuaugcauguuua

SEQ ID NO: 903390 - RNA, 19 nt, Homo sapiens
guuaauugccucaggauau

SEQ ID NO: 903391 - RNA, 19 nt, Homo sapiens
ccugagcagugucuaugua

SEQ ID NO: 903392 - RNA, 19 nt, Homo sapiens
cagguuggauuaugcaugu

SEQ ID NO: 903393 - RNA, 19 nt, Homo sapiens
gcaaguauuggcuauuugu

SEQ ID NO: 903394 - RNA, 19 nt, Homo sapiens
ccacaaccuuuagcaucua

SEQ ID NO: 903395 - RNA, 19 nt, Homo sapiens
gcuagcgucuggccugaga

SEQ ID NO: 903396 - RNA, 19 nt, Homo sapiens
uucaggaacuuaacuauuc

SEQ ID NO: 903397 - RNA, 19 nt, Homo sapiens
cugcaaguauuggcuauuu

SEQ ID NO: 903398 - RNA, 19 nt, Homo sapiens
auucauagcaggugccuua

SEQ ID NO: 903399 - RNA, 19 nt, Homo sapiens
aaaguggcaucuggaauug

SEQ ID NO: 903400 - RNA, 19 nt, Homo sapiens
cagggaagguuuguuuaug

SEQ ID NO: 903401 - RNA, 19 nt, Homo sapiens
gcaugagugaguauaguaa

SEQ ID NO: 903402 - RNA, 19 nt, Homo sapiens
acucauuccugauguuuga

SEQ ID NO: 903403 - RNA, 19 nt, Homo sapiens
gaagugacugaccuuaaga

SEQ ID NO: 903404 - RNA, 19 nt, Homo sapiens
gagaagcacagcaagaaca

SEQ ID NO: 903405 - RNA, 19 nt, Homo sapiens
uuacugugguuucacuaaa

SEQ ID NO: 903406 - RNA, 19 nt, Homo sapiens
ggaugggcaugugaaguga

SEQ ID NO: 903407 - RNA, 19 nt, Homo sapiens
aaauugcauucccuuugua

SEQ ID NO: 903408 - RNA, 19 nt, Homo sapiens
gaaugaaucaacugaccuu

SEQ ID NO: 903409 - RNA, 19 nt, Homo sapiens
caaacauggagaacaguaa

SEQ ID NO: 903410 - RNA, 19 nt, Homo sapiens
cagugucuauguauuaaug

SEQ ID NO: 903411 - RNA, 19 nt, Homo sapiens
gcuuauaaauggaacaacu

SEQ ID NO: 903412 - RNA, 19 nt, Homo sapiens
auagcuaggcacuuuauua

SEQ ID NO: 903413 - RNA, 19 nt, Homo sapiens
gauguuugauacccugguu

SEQ ID NO: 903414 - RNA, 19 nt, Homo sapiens
gaauaaggaaugaaucaac

SEQ ID NO: 903415 - RNA, 19 nt, Homo sapiens
caucuggaauugaauggau

SEQ ID NO: 903416 - RNA, 19 nt, Homo sapiens
ccaauauuguuuccauuac

SEQ ID NO: 903417 - RNA, 19 nt, Homo sapiens
gccacaaccuuuagcaucu

SEQ ID NO: 903418 - RNA, 19 nt, Homo sapiens
ggcuuuaaguuguuguuug

SEQ ID NO: 903419 - RNA, 19 nt, Homo sapiens
gaagggaaaucugcuaccu

SEQ ID NO: 903420 - RNA, 19 nt, Homo sapiens
guugaaaacugcaaguauu

SEQ ID NO: 903421 - RNA, 19 nt, Homo sapiens
aaagggagaugcuuauagc

SEQ ID NO: 903422 - RNA, 19 nt, Homo sapiens
cuuaagauguuuccauucu

SEQ ID NO: 903423 - RNA, 19 nt, Homo sapiens
aaagcugugucuuacuuga

SEQ ID NO: 903424 - RNA, 19 nt, Homo sapiens
gaaagcugugucuuacuug

SEQ ID NO: 903425 - RNA, 19 nt, Homo sapiens
ggaauaaggaaugaaucaa

SEQ ID NO: 903426 - RNA, 19 nt, Homo sapiens
agucuucccuuuguuauau

SEQ ID NO: 903427 - RNA, 19 nt, Homo sapiens
uaaucagucucuguacuug

SEQ ID NO: 903428 - RNA, 19 nt, Homo sapiens
ccucaaacauggagaacag

SEQ ID NO: 903429 - RNA, 19 nt, Homo sapiens
cgaagauggucgccaagca

SEQ ID NO: 903430 - RNA, 19 nt, Homo sapiens
ugaaagcacacucccuuau

SEQ ID NO: 903431 - RNA, 19 nt, Homo sapiens
gcauucccuuuguauuuca

SEQ ID NO: 903432 - RNA, 19 nt, Homo sapiens
uaaggaaugaaucaacuga

SEQ ID NO: 903433 - RNA, 19 nt, Homo sapiens
cagagugguuaaggacuuu

SEQ ID NO: 903434 - RNA, 19 nt, Homo sapiens
gugaagugacugaccuuaa

SEQ ID NO: 903435 - RNA, 19 nt, Homo sapiens
ugaucagucuuuagucuuc

SEQ ID NO: 903436 - RNA, 19 nt, Homo sapiens
uaaagggagaugcuuauag

SEQ ID NO: 903437 - RNA, 19 nt, Homo sapiens
ugguugugcuaaauucaua

SEQ ID NO: 903438 - RNA, 19 nt, Homo sapiens
gguuaaggacuuucaggaa

SEQ ID NO: 903439 - RNA, 19 nt, Homo sapiens
ucaaacauggagaacagua

SEQ ID NO: 903440 - RNA, 19 nt, Homo sapiens
guguuugcuuuguuaauug

SEQ ID NO: 903441 - RNA, 19 nt, Homo sapiens
gguuuuggguuuucuagua

SEQ ID NO: 903442 - RNA, 19 nt, Homo sapiens
gaauugaauggauuuacug

SEQ ID NO: 903443 - RNA, 19 nt, Homo sapiens
ugucugugguucugcaauu

SEQ ID NO: 903444 - RNA, 19 nt, Homo sapiens
uaaccucgcugcagcuuca

SEQ ID NO: 903445 - RNA, 19 nt, Homo sapiens
ggacagcaugugagcguuu

SEQ ID NO: 903446 - RNA, 19 nt, Homo sapiens
guagcaaacuggguccuau

SEQ ID NO: 903447 - RNA, 19 nt, Homo sapiens
gaaccgcucccaggaauca

SEQ ID NO: 903448 - RNA, 19 nt, Homo sapiens
gagcagcccgcagaaguuu

SEQ ID NO: 903449 - RNA, 19 nt, Homo sapiens
ucagagcccugcccaacug

SEQ ID NO: 903450 - RNA, 19 nt, Homo sapiens
gcaagaccacgcugaccaa

SEQ ID NO: 903451 - RNA, 19 nt, Homo sapiens
caugugagcguuucccuau

SEQ ID NO: 903452 - RNA, 19 nt, Homo sapiens
uggaagacauucagaacuc

SEQ ID NO: 903453 - RNA, 19 nt, Homo sapiens
gcuacaagccccagaagua

SEQ ID NO: 903454 - RNA, 19 nt, Homo sapiens
ggccaacgguguggaagug

SEQ ID NO: 903455 - RNA, 19 nt, Homo sapiens
gcuggagucucuggacaug

SEQ ID NO: 903456 - RNA, 19 nt, Homo sapiens
uggagucucuggacaugga

SEQ ID NO: 903457 - RNA, 19 nt, Homo sapiens
gugaaguccuggaagacau

SEQ ID NO: 903458 - RNA, 19 nt, Homo sapiens
ccacauccuccuccuggaa

SEQ ID NO: 903459 - RNA, 19 nt, Homo sapiens
agaccacgcugaccaacag

SEQ ID NO: 903460 - RNA, 19 nt, Homo sapiens
gggacgugcuggagucucu

SEQ ID NO: 903461 - RNA, 19 nt, Homo sapiens
cugaaccgcucccaggaau

SEQ ID NO: 903462 - RNA, 19 nt, Homo sapiens
gacagcaugugagcguuuc

SEQ ID NO: 903463 - RNA, 19 nt, Homo sapiens
gcugaaccgcucccaggaa

SEQ ID NO: 903464 - RNA, 19 nt, Homo sapiens
ggaggccaacgguguggaa

SEQ ID NO: 903465 - RNA, 19 nt, Homo sapiens
ugugagcguuucccuaugg

SEQ ID NO: 903466 - RNA, 19 nt, Homo sapiens
gcaaacuggguccuauuuu

SEQ ID NO: 903467 - RNA, 19 nt, Homo sapiens
gcuuccugcucuacagcua

SEQ ID NO: 903468 - RNA, 19 nt, Homo sapiens
uagcaaacuggguccuauu

SEQ ID NO: 903469 - RNA, 19 nt, Homo sapiens
ugagcagcccgcagaaguu

SEQ ID NO: 903470 - RNA, 19 nt, Homo sapiens
caagaccaaauagcaguug

SEQ ID NO: 903471 - RNA, 19 nt, Homo sapiens
ugaaguccuggaagacauu

SEQ ID NO: 903472 - RNA, 19 nt, Homo sapiens
gaccaacagccugcucaga

SEQ ID NO: 903473 - RNA, 19 nt, Homo sapiens
uccgugaaguccuggaaga

SEQ ID NO: 903474 - RNA, 19 nt, Homo sapiens
ccaagaccaaauagcaguu

SEQ ID NO: 903475 - RNA, 19 nt, Homo sapiens
ccagcaggacagcauguga

SEQ ID NO: 903476 - RNA, 19 nt, Homo sapiens
gcccugaccucguuggaaa

SEQ ID NO: 903477 - RNA, 19 nt, Homo sapiens
uaaccucgcugcagcuuca

SEQ ID NO: 903478 - RNA, 19 nt, Homo sapiens
ggacagcaugugagcguuu

SEQ ID NO: 903479 - RNA, 19 nt, Homo sapiens
gaaccgcucccaggaauca

SEQ ID NO: 903480 - RNA, 19 nt, Homo sapiens
gagcagcccgcagaaguuu

SEQ ID NO: 903481 - RNA, 19 nt, Homo sapiens
ggagaaguacccgcaacua

SEQ ID NO: 903482 - RNA, 19 nt, Homo sapiens
cgcugcagcuucaguagua

SEQ ID NO: 903483 - RNA, 19 nt, Homo sapiens
ucagagcccugcccaacug

SEQ ID NO: 903484 - RNA, 19 nt, Homo sapiens
cuauaaaggcgccagguuu

SEQ ID NO: 903485 - RNA, 19 nt, Homo sapiens
gagugcaaguggaggagaa

SEQ ID NO: 903486 - RNA, 19 nt, Homo sapiens
gcaagaccacgcugaccaa

SEQ ID NO: 903487 - RNA, 19 nt, Homo sapiens
caugugagcguuucccuau

SEQ ID NO: 903488 - RNA, 19 nt, Homo sapiens
uggaagacauucagaacuc

SEQ ID NO: 903489 - RNA, 19 nt, Homo sapiens
ggccaacgguguggaagug

SEQ ID NO: 903490 - RNA, 19 nt, Homo sapiens
ccauguaccagaaguauag

SEQ ID NO: 903491 - RNA, 19 nt, Homo sapiens
gagaaguacccgcaacuac

SEQ ID NO: 903492 - RNA, 19 nt, Homo sapiens
gcuggagucucuggacaug

SEQ ID NO: 903493 - RNA, 19 nt, Homo sapiens
uggagucucuggacaugga

SEQ ID NO: 903494 - RNA, 19 nt, Homo sapiens
gugaaguccuggaagacau

SEQ ID NO: 903495 - RNA, 19 nt, Homo sapiens
ccacauccuccuccuggaa

SEQ ID NO: 903496 - RNA, 19 nt, Homo sapiens
caacuacacagucccugau

SEQ ID NO: 903497 - RNA, 19 nt, Homo sapiens
agaaguacccgcaacuaca

SEQ ID NO: 903498 - RNA, 19 nt, Homo sapiens
gggacgugcuggagucucu

SEQ ID NO: 903499 - RNA, 19 nt, Homo sapiens
agaccacgcugaccaacag

SEQ ID NO: 903500 - RNA, 19 nt, Homo sapiens
cugaaccgcucccaggaau

SEQ ID NO: 903501 - RNA, 19 nt, Homo sapiens
gaaguacccgcaacuacac

SEQ ID NO: 903502 - RNA, 19 nt, Homo sapiens
gacagcaugugagcguuuc

SEQ ID NO: 903503 - RNA, 19 nt, Homo sapiens
gcugcagcuucaguaguaa

SEQ ID NO: 903504 - RNA, 19 nt, Homo sapiens
gcugaaccgcucccaggaa

SEQ ID NO: 903505 - RNA, 19 nt, Homo sapiens
ggaggccaacgguguggaa

SEQ ID NO: 903506 - RNA, 19 nt, Homo sapiens
gcaaguggaggagaaguac

SEQ ID NO: 903507 - RNA, 19 nt, Homo sapiens
ccaagacgccucuguaacc

SEQ ID NO: 903508 - RNA, 19 nt, Homo sapiens
ugugagcguuucccuaugg

SEQ ID NO: 903509 - RNA, 19 nt, Homo sapiens
gcuuccugcucuacagcua

SEQ ID NO: 903510 - RNA, 19 nt, Homo sapiens
ugagcagcccgcagaaguu

SEQ ID NO: 903511 - RNA, 19 nt, Homo sapiens
caagacgccucuguaaccu

SEQ ID NO: 903512 - RNA, 19 nt, Homo sapiens
ugaaguccuggaagacauu

SEQ ID NO: 903513 - RNA, 19 nt, Homo sapiens
caagaccaaauagcaguug

SEQ ID NO: 903514 - RNA, 19 nt, Homo sapiens
uccgugaaguccuggaaga

SEQ ID NO: 903515 - RNA, 19 nt, Homo sapiens
gcccauguaccagaaguau

SEQ ID NO: 903516 - RNA, 19 nt, Homo sapiens
gaccaacagccugcucaga

SEQ ID NO: 903517 - RNA, 19 nt, Homo sapiens
ccaagaccaaauagcaguu

SEQ ID NO: 903518 - RNA, 19 nt, Homo sapiens
ccagcaggacagcauguga

SEQ ID NO: 903519 - RNA, 19 nt, Homo sapiens
ggaagaacaucuacuauaa

SEQ ID NO: 903520 - RNA, 19 nt, Homo sapiens
ggaugacucuggacaaaga

SEQ ID NO: 903521 - RNA, 19 nt, Homo sapiens
gugacaagaugcugaagua

SEQ ID NO: 903522 - RNA, 19 nt, Homo sapiens
gggaagaacaucuacuaua

SEQ ID NO: 903523 - RNA, 19 nt, Homo sapiens
gaacaucuacuauaagagu

SEQ ID NO: 903524 - RNA, 19 nt, Homo sapiens
gaagaagccaacuggauga

SEQ ID NO: 903525 - RNA, 19 nt, Homo sapiens
aaaccuacauucccugcua

SEQ ID NO: 903526 - RNA, 19 nt, Homo sapiens
gaacaacaaggcccacaug

SEQ ID NO: 903527 - RNA, 19 nt, Homo sapiens
ccaaggacgucacaacauc

SEQ ID NO: 903528 - RNA, 19 nt, Homo sapiens
gacggaaggguaaacaaua

SEQ ID NO: 903529 - RNA, 19 nt, Homo sapiens
gcugucaucugccuuggaa

SEQ ID NO: 903530 - RNA, 19 nt, Homo sapiens
acaagugggucaucgaaga

SEQ ID NO: 903531 - RNA, 19 nt, Homo sapiens
gaagaacaucuacuauaag

SEQ ID NO: 903532 - RNA, 19 nt, Homo sapiens
caagcagccuucggaggua

SEQ ID NO: 903533 - RNA, 19 nt, Homo sapiens
ccauuaugcugguggaaga

SEQ ID NO: 903534 - RNA, 19 nt, Homo sapiens
gacaagaugcugaaguaug

SEQ ID NO: 903535 - RNA, 19 nt, Homo sapiens
acaagaugcugaaguaugc

SEQ ID NO: 903536 - RNA, 19 nt, Homo sapiens
ggaaggguaaacaauauag

SEQ ID NO: 903537 - RNA, 19 nt, Homo sapiens
cagggaagaacaucuacua

SEQ ID NO: 903538 - RNA, 19 nt, Homo sapiens
ggaugccagugacaagaug

SEQ ID NO: 903539 - RNA, 19 nt, Homo sapiens
acggaaggguaaacaauau

SEQ ID NO: 903540 - RNA, 19 nt, Homo sapiens
gaccaaggacgucacaaca

SEQ ID NO: 903541 - RNA, 19 nt, Homo sapiens
gcagaggguggcuuugaug

SEQ ID NO: 903542 - RNA, 19 nt, Homo sapiens
ucuccuggcuugaguaagu

SEQ ID NO: 903543 - RNA, 19 nt, Homo sapiens
guacaaggcauggcugcuu

SEQ ID NO: 903544 - RNA, 19 nt, Homo sapiens
uacauucccugcuacuuca

SEQ ID NO: 903545 - RNA, 19 nt, Homo sapiens
cgacaagugggucaucgaa

SEQ ID NO: 903546 - RNA, 19 nt, Homo sapiens
caagugggucaucgaagaa

SEQ ID NO: 903547 - RNA, 19 nt, Homo sapiens
cuacauucccugcuacuuc

SEQ ID NO: 903548 - RNA, 19 nt, Homo sapiens
guaaguuccggcucuccua

SEQ ID NO: 903549 - RNA, 19 nt, Homo sapiens
cagcagaggguggcuuuga

SEQ ID NO: 903550 - RNA, 19 nt, Homo sapiens
gcguguggcagcuguauau

SEQ ID NO: 903551 - RNA, 19 nt, Homo sapiens
gcaaaggggaccagaguga

SEQ ID NO: 903552 - RNA, 19 nt, Homo sapiens
gaccacauccucaguacag

SEQ ID NO: 903553 - RNA, 19 nt, Homo sapiens
cuggaugacucuggacaaa

SEQ ID NO: 903554 - RNA, 19 nt, Homo sapiens
cggaaggguaaacaauaua

SEQ ID NO: 903555 - RNA, 19 nt, Homo sapiens
gaaggguaaacaauauagu

SEQ ID NO: 903556 - RNA, 19 nt, Homo sapiens
gcucaagaggacagacuga

SEQ ID NO: 903557 - RNA, 19 nt, Homo sapiens
ugggcgacuucaagccuua

SEQ ID NO: 903558 - RNA, 19 nt, Homo sapiens
cacacugucuggcauccuu

SEQ ID NO: 903559 - RNA, 19 nt, Homo sapiens
gcucuccuggcuugaguaa

SEQ ID NO: 903560 - RNA, 19 nt, Homo sapiens
caucugccuuggaaacagu

SEQ ID NO: 903561 - RNA, 19 nt, Homo sapiens
gcacugcuaggcucugucu

SEQ ID NO: 903562 - RNA, 19 nt, Homo sapiens
caaggacgucacaacauca

SEQ ID NO: 903563 - RNA, 19 nt, Homo sapiens
ucauugaucaucgcaacua

SEQ ID NO: 903564 - RNA, 19 nt, Homo sapiens
agacggaaggguaaacaau

SEQ ID NO: 903565 - RNA, 19 nt, Homo sapiens
ccagugacaagaugcugaa

SEQ ID NO: 903566 - RNA, 19 nt, Homo sapiens
aagcagccuucggagguaa

SEQ ID NO: 903567 - RNA, 19 nt, Homo sapiens
ggguaaacaauauagucuu

SEQ ID NO: 903568 - RNA, 19 nt, Homo sapiens
ccacagacggaaggguaaa

SEQ ID NO: 903569 - RNA, 19 nt, Homo sapiens
ucgaagaagccaacuggau

SEQ ID NO: 903570 - RNA, 19 nt, Homo sapiens
gugcugauagugaacaaca

SEQ ID NO: 903571 - RNA, 19 nt, Homo sapiens
ggaacaagcucaugcaaug

SEQ ID NO: 903572 - RNA, 19 nt, Homo sapiens
gaacaaagcgcuuaagugu

SEQ ID NO: 903573 - RNA, 19 nt, Homo sapiens
ggagauaguggaauuaaua

SEQ ID NO: 903574 - RNA, 19 nt, Homo sapiens
gagggaagcucaauaaauc

SEQ ID NO: 903575 - RNA, 19 nt, Homo sapiens
gaacaugggaagaguauuu

SEQ ID NO: 903576 - RNA, 19 nt, Homo sapiens
guacaauccugguaucauu

SEQ ID NO: 903577 - RNA, 19 nt, Homo sapiens
gauaaucuauguagcaaga

SEQ ID NO: 903578 - RNA, 19 nt, Homo sapiens
gauaucagauuccaguuau

SEQ ID NO: 903579 - RNA, 19 nt, Homo sapiens
aaacacaucuucccuuuca

SEQ ID NO: 903580 - RNA, 19 nt, Homo sapiens
acaaagcgcuuaaguguca

SEQ ID NO: 903581 - RNA, 19 nt, Homo sapiens
gaaaacacaucuucccuuu

SEQ ID NO: 903582 - RNA, 19 nt, Homo sapiens
cagaauaguuuacuguguu

SEQ ID NO: 903583 - RNA, 19 nt, Homo sapiens
acaacaugguguccuauua

SEQ ID NO: 903584 - RNA, 19 nt, Homo sapiens
ggaagaaauuagaugacaa

SEQ ID NO: 903585 - RNA, 19 nt, Homo sapiens
gaagcucaauaaaucacua

SEQ ID NO: 903586 - RNA, 19 nt, Homo sapiens
gaagcuggcagaauuuauu

SEQ ID NO: 903587 - RNA, 19 nt, Homo sapiens
ccaguuaucagaauaguuu

SEQ ID NO: 903588 - RNA, 19 nt, Homo sapiens
caagaaaucccaaggacaa

SEQ ID NO: 903589 - RNA, 19 nt, Homo sapiens
cagacuaacuuuccacuuc

SEQ ID NO: 903590 - RNA, 19 nt, Homo sapiens
gaugacaaaguucuagaua

SEQ ID NO: 903591 - RNA, 19 nt, Homo sapiens
gaacccaaagcaugaaauu

SEQ ID NO: 903592 - RNA, 19 nt, Homo sapiens
gggauaagaucuggaacuu

SEQ ID NO: 903593 - RNA, 19 nt, Homo sapiens
cuagagggcuggauagugu

SEQ ID NO: 903594 - RNA, 19 nt, Homo sapiens
ggcaaacuauucaucgauu

SEQ ID NO: 903595 - RNA, 19 nt, Homo sapiens
gagauuugaugaagauuac

SEQ ID NO: 903596 - RNA, 19 nt, Homo sapiens
ggacaaagucauaaacaag

SEQ ID NO: 903597 - RNA, 19 nt, Homo sapiens
cucaauaaaucacuaggua

SEQ ID NO: 903598 - RNA, 19 nt, Homo sapiens
ugagagauuugaugaagau

SEQ ID NO: 903599 - RNA, 19 nt, Homo sapiens
gggaagaaauuagaugaca

SEQ ID NO: 903600 - RNA, 19 nt, Homo sapiens
cuucaguccucacaugaua

SEQ ID NO: 903601 - RNA, 19 nt, Homo sapiens
gcaaacuauucaucgauuc

SEQ ID NO: 903602 - RNA, 19 nt, Homo sapiens
caaacaccguauucucuau

SEQ ID NO: 903603 - RNA, 19 nt, Homo sapiens
gcgcuuaagugucaacuac

SEQ ID NO: 903604 - RNA, 19 nt, Homo sapiens
gaugaagauuacaagaaga

SEQ ID NO: 903605 - RNA, 19 nt, Homo sapiens
gacaaagucauaaacaaga

SEQ ID NO: 903606 - RNA, 19 nt, Homo sapiens
cuuaggaucugguuuggaa

SEQ ID NO: 903607 - RNA, 19 nt, Homo sapiens
caacauggacucaggagau

SEQ ID NO: 903608 - RNA, 19 nt, Homo sapiens
ccugaugaccugcuuauuu

SEQ ID NO: 903609 - RNA, 19 nt, Homo sapiens
ggaacaaagcgcuuaagug

SEQ ID NO: 903610 - RNA, 19 nt, Homo sapiens
gccauaugcugacugaaga

SEQ ID NO: 903611 - RNA, 19 nt, Homo sapiens
cugaugaccugcuuauuuc

SEQ ID NO: 903612 - RNA, 19 nt, Homo sapiens
gagagagggaagcucaaua

SEQ ID NO: 903613 - RNA, 19 nt, Homo sapiens
ugaugaagauuacaagaag

SEQ ID NO: 903614 - RNA, 19 nt, Homo sapiens
agaauccaauggcaaacua

SEQ ID NO: 903615 - RNA, 19 nt, Homo sapiens
uucagaagcuggcagaauu

SEQ ID NO: 903616 - RNA, 19 nt, Homo sapiens
ccucugauuucuuacacua

SEQ ID NO: 903617 - RNA, 19 nt, Homo sapiens
agagagggaagcucaauaa

SEQ ID NO: 903618 - RNA, 19 nt, Homo sapiens
caaaugauaucagauucca

SEQ ID NO: 903619 - RNA, 19 nt, Homo sapiens
ccacuuccaguucuaguaa

SEQ ID NO: 903620 - RNA, 19 nt, Homo sapiens
agaagaacccaaagcauga

SEQ ID NO: 903621 - RNA, 19 nt, Homo sapiens
gaagaagaacccaaagcau

SEQ ID NO: 903622 - RNA, 19 nt, Homo sapiens
uaaacaagaguuccaguuc

SEQ ID NO: 903623 - RNA, 19 nt, Homo sapiens
ugauaucagauuccaguua

SEQ ID NO: 903624 - RNA, 19 nt, Homo sapiens
cagaauuuauugggaagaa

SEQ ID NO: 903625 - RNA, 19 nt, Homo sapiens
gagagggaagcucaauaaa

SEQ ID NO: 903626 - RNA, 19 nt, Homo sapiens
ucagaauaguuuacugugu

SEQ ID NO: 903627 - RNA, 19 nt, Homo sapiens
cuauuaccauuuccaaaga

SEQ ID NO: 903628 - RNA, 19 nt, Homo sapiens
ccaccauccuugcuagaga

SEQ ID NO: 903629 - RNA, 19 nt, Homo sapiens
gaaugagagauuugaugaa

SEQ ID NO: 903630 - RNA, 19 nt, Homo sapiens
agaaugagagauuugauga

SEQ ID NO: 903631 - RNA, 19 nt, Homo sapiens
gacaaacaccguauucucu

SEQ ID NO: 903632 - RNA, 19 nt, Homo sapiens
gugggaagccaaagacaaa

SEQ ID NO: 903633 - RNA, 19 nt, Homo sapiens
ugaaggugauguggagaaa

SEQ ID NO: 903634 - RNA, 19 nt, Homo sapiens
ucaacuacgugaagggaau

SEQ ID NO: 903635 - RNA, 19 nt, Homo sapiens
uaaacaagagcuccaguuc

SEQ ID NO: 903636 - RNA, 19 nt, Homo sapiens
cuacaaucaugugcuuauu

SEQ ID NO: 903637 - RNA, 19 nt, Homo sapiens
caauaaaucacuagguaca

SEQ ID NO: 903638 - RNA, 19 nt, Homo sapiens
gcucuuauucacucuacua

SEQ ID NO: 903639 - RNA, 19 nt, Homo sapiens
gaagaacccaaagcaugaa

SEQ ID NO: 903640 - RNA, 19 nt, Homo sapiens
caaagacaaacaccguauu

SEQ ID NO: 903641 - RNA, 19 nt, Homo sapiens
gaugaccugcuuauuucua

SEQ ID NO: 903642 - RNA, 19 nt, Homo sapiens
gacugaagauaacuuugug

SEQ ID NO: 903643 - RNA, 19 nt, Homo sapiens
ccacaacgcagccauaugc

SEQ ID NO: 903644 - RNA, 19 nt, Homo sapiens
gccaguggacaaagucaua

SEQ ID NO: 903645 - RNA, 19 nt, Homo sapiens
caucaacgauuuccuuucc

SEQ ID NO: 903646 - RNA, 19 nt, Homo sapiens
aacauggacucaggagaua

SEQ ID NO: 903647 - RNA, 19 nt, Homo sapiens
uggacaaagucauaaacaa

SEQ ID NO: 903648 - RNA, 19 nt, Homo sapiens
ccugugacaucugggauaa

SEQ ID NO: 903649 - RNA, 19 nt, Homo sapiens
guagugugguggauagagu

SEQ ID NO: 903650 - RNA, 19 nt, Homo sapiens
cagaagcuggcagaauuua

SEQ ID NO: 903651 - RNA, 19 nt, Homo sapiens
acaaacaccguauucucua

SEQ ID NO: 903652 - RNA, 19 nt, Homo sapiens
ugugacaucugggauaaga

SEQ ID NO: 903653 - RNA, 19 nt, Homo sapiens
aaugagagauuugaugaag

SEQ ID NO: 903654 - RNA, 19 nt, Homo sapiens
ccacuccauuucuccauuc

SEQ ID NO: 903655 - RNA, 19 nt, Homo sapiens
augaggacaugaagaagaa

SEQ ID NO: 903656 - RNA, 19 nt, Homo sapiens
gguguccuauuaccauuuc

SEQ ID NO: 903657 - RNA, 19 nt, Homo sapiens
caacaugguguccuauuac

SEQ ID NO: 903658 - RNA, 19 nt, Homo sapiens
ccaaagacaaacaccguau

SEQ ID NO: 903659 - RNA, 19 nt, Homo sapiens
caccauccuugcuagagaa

SEQ ID NO: 903660 - RNA, 19 nt, Homo sapiens
ugacugaagauaacuuugu

SEQ ID NO: 903661 - RNA, 19 nt, Homo sapiens
ucagaagcuggcagaauuu

SEQ ID NO: 903662 - RNA, 19 nt, Homo sapiens
ugaagaagaacccaaagca

SEQ ID NO: 903663 - RNA, 19 nt, Homo sapiens
ucuaugaggacaugaagaa

SEQ ID NO: 903664 - RNA, 19 nt, Homo sapiens
cucaggagauaguggaauu

SEQ ID NO: 903665 - RNA, 19 nt, Homo sapiens
gauggaacaaagcgcuuaa

SEQ ID NO: 903666 - RNA, 19 nt, Homo sapiens
agagggaagcucaauaaau

SEQ ID NO: 903667 - RNA, 19 nt, Homo sapiens
aaagacaaacaccguauuc

SEQ ID NO: 903668 - RNA, 19 nt, Homo sapiens
caggagauaguggaauuaa

SEQ ID NO: 903669 - RNA, 19 nt, Homo sapiens
cauuacacuucguuugaug

SEQ ID NO: 903670 - RNA, 19 nt, Homo sapiens
gaaaucccaaggacaacau

SEQ ID NO: 903671 - RNA, 19 nt, Homo sapiens
gaagcgagaagacuuauaa

SEQ ID NO: 903672 - RNA, 19 nt, Homo sapiens
aacaauaccucacgauaua

SEQ ID NO: 903673 - RNA, 19 nt, Homo sapiens
ggaaggagcccaccuggaa

SEQ ID NO: 903674 - RNA, 19 nt, Homo sapiens
ggccaaagguuuaguuguu

SEQ ID NO: 903675 - RNA, 19 nt, Homo sapiens
ugaaauaccugugaaagug

SEQ ID NO: 903676 - RNA, 19 nt, Homo sapiens
aaacuugcauccaacauga

SEQ ID NO: 903677 - RNA, 19 nt, Homo sapiens
caaacaauaccucacgaua

SEQ ID NO: 903678 - RNA, 19 nt, Homo sapiens
acaaggagauugagagcuu

SEQ ID NO: 903679 - RNA, 19 nt, Homo sapiens
caaaagaaaugcaaguuca

SEQ ID NO: 903680 - RNA, 19 nt, Homo sapiens
aaacaauaccucacgauau

SEQ ID NO: 903681 - RNA, 19 nt, Homo sapiens
ccaaauaggaggcauucaa

SEQ ID NO: 903682 - RNA, 19 nt, Homo sapiens
ucuccuuccuuuacucuua

SEQ ID NO: 903683 - RNA, 19 nt, Homo sapiens
gcaccuacagugucucauu

SEQ ID NO: 903684 - RNA, 19 nt, Homo sapiens
aaacucaaauggugcuuca

SEQ ID NO: 903685 - RNA, 19 nt, Homo sapiens
caaauaggaggcauucaau

SEQ ID NO: 903686 - RNA, 19 nt, Homo sapiens
guaacaauccaaacaauac

SEQ ID NO: 903687 - RNA, 19 nt, Homo sapiens
guuguuauuuccucuguau

SEQ ID NO: 903688 - RNA, 19 nt, Homo sapiens
gccaaagguuuaguuguug

SEQ ID NO: 903689 - RNA, 19 nt, Homo sapiens
uggugucgcuggagaagua

SEQ ID NO: 903690 - RNA, 19 nt, Homo sapiens
ggaagcucauccuacugaa

SEQ ID NO: 903691 - RNA, 19 nt, Homo sapiens
caaggagauugagagcuuu

SEQ ID NO: 903692 - RNA, 19 nt, Homo sapiens
caauaccucacgauauaaa

SEQ ID NO: 903693 - RNA, 19 nt, Homo sapiens
ggauuaggaugaaauaccu

SEQ ID NO: 903694 - RNA, 19 nt, Homo sapiens
ggacuucuacgacuucaag

SEQ ID NO: 903695 - RNA, 19 nt, Homo sapiens
gcugaccaaugcaaacuca

SEQ ID NO: 903696 - RNA, 19 nt, Homo sapiens
ccaaagguuuaguuguugu

SEQ ID NO: 903697 - RNA, 19 nt, Homo sapiens
gcgagaagacuuauaacca

SEQ ID NO: 903698 - RNA, 19 nt, Homo sapiens
gaauuuccagccgaugaua

SEQ ID NO: 903699 - RNA, 19 nt, Homo sapiens
gcucuugaccagugaauca

SEQ ID NO: 903700 - RNA, 19 nt, Homo sapiens
gaacuccuggccaaugaga

SEQ ID NO: 903701 - RNA, 19 nt, Homo sapiens
ggaugaaauaccugugaaa

SEQ ID NO: 903702 - RNA, 19 nt, Homo sapiens
ccuuuacucuuaugccauu

SEQ ID NO: 903703 - RNA, 19 nt, Homo sapiens
gagcccaccuggaacuucu

SEQ ID NO: 903704 - RNA, 19 nt, Homo sapiens
guugugaggauuaggauga

SEQ ID NO: 903705 - RNA, 19 nt, Homo sapiens
cacugacucuccuuccuuu

SEQ ID NO: 903706 - RNA, 19 nt, Homo sapiens
caccuacagugucucauuc

SEQ ID NO: 903707 - RNA, 19 nt, Homo sapiens
gcaaccaguuuggccaaca

SEQ ID NO: 903708 - RNA, 19 nt, Homo sapiens
gagagcucuugaccaguga

SEQ ID NO: 903709 - RNA, 19 nt, Homo sapiens
aauccaggccaaagguuua

SEQ ID NO: 903710 - RNA, 19 nt, Homo sapiens
gaugaaauaccugugaaag

SEQ ID NO: 903711 - RNA, 19 nt, Homo sapiens
ugaggauuaggaugaaaua

SEQ ID NO: 903712 - RNA, 19 nt, Homo sapiens
acgaacgucuugccaacaa

SEQ ID NO: 903713 - RNA, 19 nt, Homo sapiens
gaugauaauccaggccaaa

SEQ ID NO: 903714 - RNA, 19 nt, Homo sapiens
ugaccaaugcaaacucaaa

SEQ ID NO: 903715 - RNA, 19 nt, Homo sapiens
gcaggacuucuacgacuuc

SEQ ID NO: 903716 - RNA, 19 nt, Homo sapiens
gauaauccaggccaaaggu

SEQ ID NO: 903717 - RNA, 19 nt, Homo sapiens
uguggcaaauagaaguaua

SEQ ID NO: 903718 - RNA, 19 nt, Homo sapiens
cgaacgucuugccaacaaa

SEQ ID NO: 903719 - RNA, 19 nt, Homo sapiens
ugccauuggucccaucauu

SEQ ID NO: 903720 - RNA, 19 nt, Homo sapiens
gaccaaugcaaacucaaau

SEQ ID NO: 903721 - RNA, 19 nt, Homo sapiens
cauccaacaugaauuucca

SEQ ID NO: 903722 - RNA, 19 nt, Homo sapiens
aaagggagagacccacuga

SEQ ID NO: 903723 - RNA, 19 nt, Homo sapiens
uaauccaggccaaagguuu

SEQ ID NO: 903724 - RNA, 19 nt, Homo sapiens
ccucauagggcuguuguga

SEQ ID NO: 903725 - RNA, 19 nt, Homo sapiens
acucaaauggugcuucaaa

SEQ ID NO: 903726 - RNA, 19 nt, Homo sapiens
uugcauccaacaugaauuu

SEQ ID NO: 903727 - RNA, 19 nt, Homo sapiens
ccacugacucuccuuccuu

SEQ ID NO: 903728 - RNA, 19 nt, Homo sapiens
ccaaugcaaacucaaaugg

SEQ ID NO: 903729 - RNA, 19 nt, Homo sapiens
uuacagcaacaaauaggaa

SEQ ID NO: 903730 - RNA, 19 nt, Homo sapiens
gaaucuuacagcaacaaau

SEQ ID NO: 903731 - RNA, 19 nt, Homo sapiens
caaccaguuuggccaacag

SEQ ID NO: 903732 - RNA, 19 nt, Homo sapiens
aggaugaaauaccugugaa

SEQ ID NO: 903733 - RNA, 19 nt, Homo sapiens
uaggaugaaauaccuguga

SEQ ID NO: 903734 - RNA, 19 nt, Homo sapiens
ccaccuggaacuucuggaa

SEQ ID NO: 903735 - RNA, 19 nt, Homo sapiens
acugaagcgagaagacuua

SEQ ID NO: 903736 - RNA, 19 nt, Homo sapiens
caaagguuuaguuguuguu

SEQ ID NO: 903737 - RNA, 19 nt, Homo sapiens
gaacgucuugccaacaaaa

SEQ ID NO: 903738 - RNA, 19 nt, Homo sapiens
ucaaauggugcuucaaagg

SEQ ID NO: 903739 - RNA, 19 nt, Homo sapiens
ugacagcaacaaggagauu

SEQ ID NO: 903740 - RNA, 19 nt, Homo sapiens
ugaagcgagaagacuuaua

SEQ ID NO: 903741 - RNA, 19 nt, Homo sapiens
gaagcucauccuacugaag

SEQ ID NO: 903742 - RNA, 19 nt, Homo sapiens
aaauguguggcaaauagaa

SEQ ID NO: 903743 - RNA, 19 nt, Homo sapiens
gccauuggucccaucauuc

SEQ ID NO: 903744 - RNA, 19 nt, Homo sapiens
ugacucuccuuccuuuacu

SEQ ID NO: 903745 - RNA, 19 nt, Homo sapiens
acaauaccucacgauauaa

SEQ ID NO: 903746 - RNA, 19 nt, Homo sapiens
ccaaacaauaccucacgau

SEQ ID NO: 903747 - RNA, 19 nt, Homo sapiens
gcaggagcaggacuucuac

SEQ ID NO: 903748 - RNA, 19 nt, Homo sapiens
gggcuguugugaggauuag

SEQ ID NO: 903749 - RNA, 19 nt, Homo sapiens
gaaccuggcuucuguauuu

SEQ ID NO: 903750 - RNA, 19 nt, Homo sapiens
ggagcaggcuguacuauua

SEQ ID NO: 903751 - RNA, 19 nt, Homo sapiens
gagauggccuugaguauuu

SEQ ID NO: 903752 - RNA, 19 nt, Homo sapiens
ggaguuauguggacacuaa

SEQ ID NO: 903753 - RNA, 19 nt, Homo sapiens
gcaggauccuuacuucuug

SEQ ID NO: 903754 - RNA, 19 nt, Homo sapiens
uuaagaaccugaagaugaa

SEQ ID NO: 903755 - RNA, 19 nt, Homo sapiens
gccuugggcuugacauuua

SEQ ID NO: 903756 - RNA, 19 nt, Homo sapiens
gagcauauuuaccuggauu

SEQ ID NO: 903757 - RNA, 19 nt, Homo sapiens
ccacagaccugaggauugu

SEQ ID NO: 903758 - RNA, 19 nt, Homo sapiens
caaagaaggguauagagaa

SEQ ID NO: 903759 - RNA, 19 nt, Homo sapiens
guucuucugugucuaaauu

SEQ ID NO: 903760 - RNA, 19 nt, Homo sapiens
ccauguaccuggagcauug

SEQ ID NO: 903761 - RNA, 19 nt, Homo sapiens
ggucuuacauaaaugaaug

SEQ ID NO: 903762 - RNA, 19 nt, Homo sapiens
cagggacucuucaggauuu

SEQ ID NO: 903763 - RNA, 19 nt, Homo sapiens
agaaggguauagagaauaa

SEQ ID NO: 903764 - RNA, 19 nt, Homo sapiens
gggaauuuguggaaagaaa

SEQ ID NO: 903765 - RNA, 19 nt, Homo sapiens
ggauuguccuugggaauuu

SEQ ID NO: 903766 - RNA, 19 nt, Homo sapiens
gaggauuguuggaauaaau

SEQ ID NO: 903767 - RNA, 19 nt, Homo sapiens
ggaccaggacuaugauaaa

SEQ ID NO: 903768 - RNA, 19 nt, Homo sapiens
ggagcaggauccuuacuuc

SEQ ID NO: 903769 - RNA, 19 nt, Homo sapiens
gaugaagauuuagagcaua

SEQ ID NO: 903770 - RNA, 19 nt, Homo sapiens
gaauuaagaaccugaagau

SEQ ID NO: 903771 - RNA, 19 nt, Homo sapiens
cuggagacauuucaacuuu

SEQ ID NO: 903772 - RNA, 19 nt, Homo sapiens
aaagaaggguauagagaau

SEQ ID NO: 903773 - RNA, 19 nt, Homo sapiens
uuacuuggauggucugcua

SEQ ID NO: 903774 - RNA, 19 nt, Homo sapiens
gauuuacacucuagacauc

SEQ ID NO: 903775 - RNA, 19 nt, Homo sapiens
guacaugcucucccucuuu

SEQ ID NO: 903776 - RNA, 19 nt, Homo sapiens
ccugaggauuguuggaaua

SEQ ID NO: 903777 - RNA, 19 nt, Homo sapiens
gcucugcgguucggagaaa

SEQ ID NO: 903778 - RNA, 19 nt, Homo sapiens
aauagccgcuggagacauu

SEQ ID NO: 903779 - RNA, 19 nt, Homo sapiens
gagcaggcuguacuauuaa

SEQ ID NO: 903780 - RNA, 19 nt, Homo sapiens
accugaagaugaagauuua

SEQ ID NO: 903781 - RNA, 19 nt, Homo sapiens
uguggacacuaauauauga

SEQ ID NO: 903782 - RNA, 19 nt, Homo sapiens
gucaucaccuacccacuaa

SEQ ID NO: 903783 - RNA, 19 nt, Homo sapiens
gauuugagauggccuugag

SEQ ID NO: 903784 - RNA, 19 nt, Homo sapiens
aaacaaagaaggguauaga

SEQ ID NO: 903785 - RNA, 19 nt, Homo sapiens
auuaagaaccugaagauga

SEQ ID NO: 903786 - RNA, 19 nt, Homo sapiens
acaaagaaggguauagaga

SEQ ID NO: 903787 - RNA, 19 nt, Homo sapiens
gaaaagaagacagacaaaa

SEQ ID NO: 903788 - RNA, 19 nt, Homo sapiens
ucugggagcaggauccuua

SEQ ID NO: 903789 - RNA, 19 nt, Homo sapiens
uacaugcucucccucuuug

SEQ ID NO: 903790 - RNA, 19 nt, Homo sapiens
guaccuggagcauugguuu

SEQ ID NO: 903791 - RNA, 19 nt, Homo sapiens
gacagacugcucccuacua

SEQ ID NO: 903792 - RNA, 19 nt, Homo sapiens
ugagauggccuugaguauu

SEQ ID NO: 903793 - RNA, 19 nt, Homo sapiens
ggaaagaaaagaagacaga

SEQ ID NO: 903794 - RNA, 19 nt, Homo sapiens
gcucagcggcuucaguguu

SEQ ID NO: 903795 - RNA, 19 nt, Homo sapiens
gcacuggguguucuucugu

SEQ ID NO: 903796 - RNA, 19 nt, Homo sapiens
gggaccaggacuaugauaa

SEQ ID NO: 903797 - RNA, 19 nt, Homo sapiens
cacuggagcuauucugaug

SEQ ID NO: 903798 - RNA, 19 nt, Homo sapiens
gggauuguccuugggaauu

SEQ ID NO: 903799 - RNA, 19 nt, Homo sapiens
gagaugauguuuugauugg

SEQ ID NO: 903800 - RNA, 19 nt, Homo sapiens
cuguuugccugccucuuua

SEQ ID NO: 903801 - RNA, 19 nt, Homo sapiens
ggagacauuucaacuuuuc

SEQ ID NO: 903802 - RNA, 19 nt, Homo sapiens
gcuguacuauuaaugacau

SEQ ID NO: 903803 - RNA, 19 nt, Homo sapiens
agaugaagauuuagagcau

SEQ ID NO: 903804 - RNA, 19 nt, Homo sapiens
ggacaaaagagaugauguu

SEQ ID NO: 903805 - RNA, 19 nt, Homo sapiens
caccagauuuacacucuag

SEQ ID NO: 903806 - RNA, 19 nt, Homo sapiens
cggcuucaguguugcaaug

SEQ ID NO: 903807 - RNA, 19 nt, Homo sapiens
ugucaucaccuacccacua

SEQ ID NO: 903808 - RNA, 19 nt, Homo sapiens
gaacagccaaucguccaau

SEQ ID NO: 903809 - RNA, 19 nt, Homo sapiens
gaccaggacuaugauaaaa

SEQ ID NO: 903810 - RNA, 19 nt, Homo sapiens
gcacuggagcuauucugau

SEQ ID NO: 903811 - RNA, 19 nt, Homo sapiens
caaccgaacacugggacua

SEQ ID NO: 903812 - RNA, 19 nt, Homo sapiens
gguacaugcucucccucuu

SEQ ID NO: 903813 - RNA, 19 nt, Homo sapiens
ucaccuacccacuaaugaa

SEQ ID NO: 903814 - RNA, 19 nt, Homo sapiens
gguguucuucugugucuaa

SEQ ID NO: 903815 - RNA, 19 nt, Homo sapiens
ccgaacacugggacuaaua

SEQ ID NO: 903816 - RNA, 19 nt, Homo sapiens
ucaccagauuuacacucua

SEQ ID NO: 903817 - RNA, 19 nt, Homo sapiens
aacagccaaucguccaaua

SEQ ID NO: 903818 - RNA, 19 nt, Homo sapiens
uggauggucugcuaucaag

SEQ ID NO: 903819 - RNA, 19 nt, Homo sapiens
gauccuuacuucuugucau

SEQ ID NO: 903820 - RNA, 19 nt, Homo sapiens
uacauucuucugcccauua

SEQ ID NO: 903821 - RNA, 19 nt, Homo sapiens
ugauuggucuuaagucaac

SEQ ID NO: 903822 - RNA, 19 nt, Homo sapiens
caucaccuacccacuaaug

SEQ ID NO: 903823 - RNA, 19 nt, Homo sapiens
auucucaccugaaguuaug

SEQ ID NO: 903824 - RNA, 19 nt, Homo sapiens
auaauucucaccugaaguu

SEQ ID NO: 903825 - RNA, 19 nt, Homo sapiens
gaaccugaagaugaagauu

SEQ ID NO: 903826 - RNA, 19 nt, Homo sapiens
ugaggauuguuggaauaaa

SEQ ID NO: 903827 - RNA, 19 nt, Homo sapiens
gggagcaggauccuuacuu

SEQ ID NO: 903828 - RNA, 19 nt, Homo sapiens
gcuggagacauuucaacuu

SEQ ID NO: 903829 - RNA, 19 nt, Homo sapiens
aaccuggcuucuguauuua

SEQ ID NO: 903830 - RNA, 19 nt, Homo sapiens
gauuguccuugggaauuug

SEQ ID NO: 903831 - RNA, 19 nt, Homo sapiens
gaccugaggauuguuggaa

SEQ ID NO: 903832 - RNA, 19 nt, Homo sapiens
gcuguaggagcccaucuga

SEQ ID NO: 903833 - RNA, 19 nt, Homo sapiens
guuauguggacacuaauau

SEQ ID NO: 903834 - RNA, 19 nt, Homo sapiens
gggcuugacauuuaauugg

SEQ ID NO: 903835 - RNA, 19 nt, Homo sapiens
caccuacccacuaaugaaa

SEQ ID NO: 903836 - RNA, 19 nt, Homo sapiens
caggcuguacuauuaauga

SEQ ID NO: 903837 - RNA, 19 nt, Homo sapiens
gcacggguuuuggcacuuu

SEQ ID NO: 903838 - RNA, 19 nt, Homo sapiens
gcuucuguauuuaccaugu

SEQ ID NO: 903839 - RNA, 19 nt, Homo sapiens
acagacugcucccuacuac

SEQ ID NO: 903840 - RNA, 19 nt, Homo sapiens
cucagcggcuucaguguug

SEQ ID NO: 903841 - RNA, 19 nt, Homo sapiens
ggaaccuggcuucuguauu

SEQ ID NO: 903842 - RNA, 19 nt, Homo sapiens
ccagggacucuucaggauu

SEQ ID NO: 903843 - RNA, 19 nt, Homo sapiens
aaccugaagaugaagauuu

SEQ ID NO: 903844 - RNA, 19 nt, Homo sapiens
ugugggaccaggacuauga

SEQ ID NO: 903845 - RNA, 19 nt, Homo sapiens
ccuugggcuugacauuuaa

SEQ ID NO: 903846 - RNA, 19 nt, Homo sapiens
uaaaagcaacuauggcaaa

SEQ ID NO: 903847 - RNA, 19 nt, Homo sapiens
uuauaauucucaccugaag

SEQ ID NO: 903848 - RNA, 19 nt, Homo sapiens
agaauuaagaaccugaaga

SEQ ID NO: 903849 - RNA, 19 nt, Homo sapiens
caaagaggguguuauugaa

SEQ ID NO: 903850 - RNA, 19 nt, Homo sapiens
gaaauuccagugacuagua

SEQ ID NO: 903851 - RNA, 19 nt, Homo sapiens
gaacagacacuuaaacagu

SEQ ID NO: 903852 - RNA, 19 nt, Homo sapiens
gcaaugauguuucugucaa

SEQ ID NO: 903853 - RNA, 19 nt, Homo sapiens
gaaagucgcguuguuauau

SEQ ID NO: 903854 - RNA, 19 nt, Homo sapiens
ucucauggcuuugacaaua

SEQ ID NO: 903855 - RNA, 19 nt, Homo sapiens
ccaaagaggguguuauuga

SEQ ID NO: 903856 - RNA, 19 nt, Homo sapiens
caaacacucugccaaagau

SEQ ID NO: 903857 - RNA, 19 nt, Homo sapiens
gaacuugaagcucagauug

SEQ ID NO: 903858 - RNA, 19 nt, Homo sapiens
gaaagugccaggauugaau

SEQ ID NO: 903859 - RNA, 19 nt, Homo sapiens
uaaguguacucgacagauu

SEQ ID NO: 903860 - RNA, 19 nt, Homo sapiens
ugaacacuuuggugaauaa

SEQ ID NO: 903861 - RNA, 19 nt, Homo sapiens
ggacuuggucucucagaaa

SEQ ID NO: 903862 - RNA, 19 nt, Homo sapiens
aaagaaagucgcguuguua

SEQ ID NO: 903863 - RNA, 19 nt, Homo sapiens
gcaaacacucugccaaaga

SEQ ID NO: 903864 - RNA, 19 nt, Homo sapiens
gugccaggauugaauauga

SEQ ID NO: 903865 - RNA, 19 nt, Homo sapiens
aaaccaaccuaacaagaau

SEQ ID NO: 903866 - RNA, 19 nt, Homo sapiens
gcacugauuuggaagaacu

SEQ ID NO: 903867 - RNA, 19 nt, Homo sapiens
uaaaccaaccuaacaagaa

SEQ ID NO: 903868 - RNA, 19 nt, Homo sapiens
guaugaaagugccaggauu

SEQ ID NO: 903869 - RNA, 19 nt, Homo sapiens
uaccauggcucaagaaucu

SEQ ID NO: 903870 - RNA, 19 nt, Homo sapiens
ugauguuucugucaaauug

SEQ ID NO: 903871 - RNA, 19 nt, Homo sapiens
caugaagaauuuggcuaua

SEQ ID NO: 903872 - RNA, 19 nt, Homo sapiens
caaugauguuucugucaaa

SEQ ID NO: 903873 - RNA, 19 nt, Homo sapiens
gugaacacuuuggugaaua

SEQ ID NO: 903874 - RNA, 19 nt, Homo sapiens
aauuacaucucauggcuuu

SEQ ID NO: 903875 - RNA, 19 nt, Homo sapiens
cuuaaacaguuccauauca

SEQ ID NO: 903876 - RNA, 19 nt, Homo sapiens
aaacccaaauuacaucuca

SEQ ID NO: 903877 - RNA, 19 nt, Homo sapiens
aaagucgcguuguuauauu

SEQ ID NO: 903878 - RNA, 19 nt, Homo sapiens
acaguuccauaucaaauug

SEQ ID NO: 903879 - RNA, 19 nt, Homo sapiens
ggccguggcucaagaacug

SEQ ID NO: 903880 - RNA, 19 nt, Homo sapiens
gaagaauuuggcuauaaug

SEQ ID NO: 903881 - RNA, 19 nt, Homo sapiens
gcaacuuggagaugcauuu

SEQ ID NO: 903882 - RNA, 19 nt, Homo sapiens
aaauuccagugacuaguaa

SEQ ID NO: 903883 - RNA, 19 nt, Homo sapiens
gcagaaauuccagugacua

SEQ ID NO: 903884 - RNA, 19 nt, Homo sapiens
gaaaaccccuggaguggau

SEQ ID NO: 903885 - RNA, 19 nt, Homo sapiens
gcuaggccguggcucaaga

SEQ ID NO: 903886 - RNA, 19 nt, Homo sapiens
acacuuaaacaguuccaua

SEQ ID NO: 903887 - RNA, 19 nt, Homo sapiens
cagcuugaacagacacuua

SEQ ID NO: 903888 - RNA, 19 nt, Homo sapiens
aaaacuggcucaaacauug

SEQ ID NO: 903889 - RNA, 19 nt, Homo sapiens
aacagacacuuaaacaguu

SEQ ID NO: 903890 - RNA, 19 nt, Homo sapiens
agaaagucgcguuguuaua

SEQ ID NO: 903891 - RNA, 19 nt, Homo sapiens
acaaucagcugguccuuuu

SEQ ID NO: 903892 - RNA, 19 nt, Homo sapiens
uauugaagcaggagcauuu

SEQ ID NO: 903893 - RNA, 19 nt, Homo sapiens
gcucaagaaucucccaaaa

SEQ ID NO: 903894 - RNA, 19 nt, Homo sapiens
gacuaguaauggagaaguu

SEQ ID NO: 903895 - RNA, 19 nt, Homo sapiens
gaagaacaguaaaaucaca

SEQ ID NO: 903896 - RNA, 19 nt, Homo sapiens
uaccaaagaggguguuauu

SEQ ID NO: 903897 - RNA, 19 nt, Homo sapiens
aaagugccaggauugaaua

SEQ ID NO: 903898 - RNA, 19 nt, Homo sapiens
ggagucuaaacaccuauaa

SEQ ID NO: 903899 - RNA, 19 nt, Homo sapiens
ucagaaacccaaauuacau

SEQ ID NO: 903900 - RNA, 19 nt, Homo sapiens
uaaugccgauacccagaaa

SEQ ID NO: 903901 - RNA, 19 nt, Homo sapiens
caagaauuaagcagaguug

SEQ ID NO: 903902 - RNA, 19 nt, Homo sapiens
gaagcucagauugauauau

SEQ ID NO: 903903 - RNA, 19 nt, Homo sapiens
aaaagaaagucgcguuguu

SEQ ID NO: 903904 - RNA, 19 nt, Homo sapiens
gauaaaaugcgcaaugaug

SEQ ID NO: 903905 - RNA, 19 nt, Homo sapiens
aauggagucuaaacaccua

SEQ ID NO: 903906 - RNA, 19 nt, Homo sapiens
guaauggagaaguugauga

SEQ ID NO: 903907 - RNA, 19 nt, Homo sapiens
guugaugacucucgugaac

SEQ ID NO: 903908 - RNA, 19 nt, Homo sapiens
caaccuaacaagaauuaag

SEQ ID NO: 903909 - RNA, 19 nt, Homo sapiens
augcauaucgcacugauuu

SEQ ID NO: 903910 - RNA, 19 nt, Homo sapiens
gugaacauagcuuuaauag

SEQ ID NO: 903911 - RNA, 19 nt, Homo sapiens
uaauagggauuugaagcau

SEQ ID NO: 903912 - RNA, 19 nt, Homo sapiens
ugaugacucucgugaacau

SEQ ID NO: 903913 - RNA, 19 nt, Homo sapiens
aagucgcguuguuauauuu

SEQ ID NO: 903914 - RNA, 19 nt, Homo sapiens
gcagcagaaauuccaguga

SEQ ID NO: 903915 - RNA, 19 nt, Homo sapiens
gcagucacagcaucucuuc

SEQ ID NO: 903916 - RNA, 19 nt, Homo sapiens
ggccagagaacacagacaa

SEQ ID NO: 903917 - RNA, 19 nt, Homo sapiens
gaagcaggagcauuucaag

SEQ ID NO: 903918 - RNA, 19 nt, Homo sapiens
aauagggauuugaagcauu

SEQ ID NO: 903919 - RNA, 19 nt, Homo sapiens
cgugaacauagcuuuaaua

SEQ ID NO: 903920 - RNA, 19 nt, Homo sapiens
uggagaaguugaugacucu

SEQ ID NO: 903921 - RNA, 19 nt, Homo sapiens
uaugaaagugccaggauug

SEQ ID NO: 903922 - RNA, 19 nt, Homo sapiens
gugaaacaguaugaaagug

SEQ ID NO: 903923 - RNA, 19 nt, Homo sapiens
cuaaaccaaccuaacaaga

SEQ ID NO: 903924 - RNA, 19 nt, Homo sapiens
ugccauugccgcuuacuuu

SEQ ID NO: 903925 - RNA, 19 nt, Homo sapiens
caacuuggagaugcauuug

SEQ ID NO: 903926 - RNA, 19 nt, Homo sapiens
caaaggcaacuuggagaug

SEQ ID NO: 903927 - RNA, 19 nt, Homo sapiens
cuguggaccuugaacuuga

SEQ ID NO: 903928 - RNA, 19 nt, Homo sapiens
caguuauucuagcagauga

SEQ ID NO: 903929 - RNA, 19 nt, Homo sapiens
auagggauuugaagcauuc

SEQ ID NO: 903930 - RNA, 19 nt, Homo sapiens
acagacacuuaaacaguuc

SEQ ID NO: 903931 - RNA, 19 nt, Homo sapiens
gaacacuuuggugaauaaa

SEQ ID NO: 903932 - RNA, 19 nt, Homo sapiens
ugugaacacuuuggugaau

SEQ ID NO: 903933 - RNA, 19 nt, Homo sapiens
uugcugaccugaguuugaa

SEQ ID NO: 903934 - RNA, 19 nt, Homo sapiens
guuggucagugugaauuug

SEQ ID NO: 903935 - RNA, 19 nt, Homo sapiens
gcauaucgcacugauuugg

SEQ ID NO: 903936 - RNA, 19 nt, Homo sapiens
gaguuugaagucacuagaa

SEQ ID NO: 903937 - RNA, 19 nt, Homo sapiens
gaacuguggaccuugaacu

SEQ ID NO: 903938 - RNA, 19 nt, Homo sapiens
gauacauuaaugacuguga

SEQ ID NO: 903939 - RNA, 19 nt, Homo sapiens
ucaugaagaauuuggcuau

SEQ ID NO: 903940 - RNA, 19 nt, Homo sapiens
uuacaucucauggcuuuga

SEQ ID NO: 903941 - RNA, 19 nt, Homo sapiens
aagaaagucgcguuguuau

SEQ ID NO: 903942 - RNA, 19 nt, Homo sapiens
gccaaagauugagcaguca

SEQ ID NO: 903943 - RNA, 19 nt, Homo sapiens
ucauuaccaucuggacuug

SEQ ID NO: 903944 - RNA, 19 nt, Homo sapiens
gacuuggucucucagaaac

SEQ ID NO: 903945 - RNA, 19 nt, Homo sapiens
aaguguacucgacagauua

SEQ ID NO: 903946 - RNA, 19 nt, Homo sapiens
gcuuuaauagggauuugaa

SEQ ID NO: 903947 - RNA, 19 nt, Homo sapiens
gaagcauucauuaccaucu

SEQ ID NO: 903948 - RNA, 19 nt, Homo sapiens
agucuaccauggcucaaga

SEQ ID NO: 903949 - RNA, 19 nt, Homo sapiens
gaacccagccagccucaua

SEQ ID NO: 903950 - RNA, 19 nt, Homo sapiens
gcggagagcuguucuuagu

SEQ ID NO: 903951 - RNA, 19 nt, Homo sapiens
gauacgcucugccucaaga

SEQ ID NO: 903952 - RNA, 19 nt, Homo sapiens
guucaacgauguccugguu

SEQ ID NO: 903953 - RNA, 19 nt, Homo sapiens
gcagggagauuucgguuuu

SEQ ID NO: 903954 - RNA, 19 nt, Homo sapiens
gaggauggguggcucuaug

SEQ ID NO: 903955 - RNA, 19 nt, Homo sapiens
ccaacgaggucuaccaaca

SEQ ID NO: 903956 - RNA, 19 nt, Homo sapiens
gcacaggaggcaccaauag

SEQ ID NO: 903957 - RNA, 19 nt, Homo sapiens
ggucgugccuggcucuaga

SEQ ID NO: 903958 - RNA, 19 nt, Homo sapiens
gcgcggagagcuguucuua

SEQ ID NO: 903959 - RNA, 19 nt, Homo sapiens
ggacuuugcccgcuucauc

SEQ ID NO: 903960 - RNA, 19 nt, Homo sapiens
acacacagcuggacuucag

SEQ ID NO: 903961 - RNA, 19 nt, Homo sapiens
ggagcacgcugagaaguac

SEQ ID NO: 903962 - RNA, 19 nt, Homo sapiens
gagaggcccugagagagau

SEQ ID NO: 903963 - RNA, 19 nt, Homo sapiens
gaggaaacgugggcacaag

SEQ ID NO: 903964 - RNA, 19 nt, Homo sapiens
ucaagucccucccacugau

SEQ ID NO: 903965 - RNA, 19 nt, Homo sapiens
cgagaggcccugagagaga

SEQ ID NO: 903966 - RNA, 19 nt, Homo sapiens
ucccggaggugguggaauu

SEQ ID NO: 903967 - RNA, 19 nt, Homo sapiens
ggaaggaagaucacauguc

SEQ ID NO: 903968 - RNA, 19 nt, Homo sapiens
cggccaacgugcuaccuuu

SEQ ID NO: 903969 - RNA, 19 nt, Homo sapiens
ccauuguggucaagagcua

SEQ ID NO: 903970 - RNA, 19 nt, Homo sapiens
ucaaggacccagcaugguu

SEQ ID NO: 903971 - RNA, 19 nt, Homo sapiens
gaucacauguccccagaga

SEQ ID NO: 903972 - RNA, 19 nt, Homo sapiens
ccagggagcccagccuauu

SEQ ID NO: 903973 - RNA, 19 nt, Homo sapiens
ggacuacgcccagaugaac

SEQ ID NO: 903974 - RNA, 19 nt, Homo sapiens
caccaccucuucuccaaca

SEQ ID NO: 903975 - RNA, 19 nt, Homo sapiens
ggacccggcagggagauuu

SEQ ID NO: 903976 - RNA, 19 nt, Homo sapiens
ggaggcaccaauagcgauu

SEQ ID NO: 903977 - RNA, 19 nt, Homo sapiens
gcaagcagacgaggucaca

SEQ ID NO: 903978 - RNA, 19 nt, Homo sapiens
ugaaccacauccagguaga

SEQ ID NO: 903979 - RNA, 19 nt, Homo sapiens
gcacacacagcuggacuuc

SEQ ID NO: 903980 - RNA, 19 nt, Homo sapiens
ggaggaaacgugggcacaa

SEQ ID NO: 903981 - RNA, 19 nt, Homo sapiens
ggguggagacggacgugua

SEQ ID NO: 903982 - RNA, 19 nt, Homo sapiens
uguacacgcugcacacaca

SEQ ID NO: 903983 - RNA, 19 nt, Homo sapiens
ccauccagcuaagcccuaa

SEQ ID NO: 903984 - RNA, 19 nt, Homo sapiens
gaucaccaaggccuucuuc

SEQ ID NO: 903985 - RNA, 19 nt, Homo sapiens
gcauggagcagauguacac

SEQ ID NO: 903986 - RNA, 19 nt, Homo sapiens
uggaggagcacgcugagaa

SEQ ID NO: 903987 - RNA, 19 nt, Homo sapiens
gcagggccucuccagcaaa

SEQ ID NO: 903988 - RNA, 19 nt, Homo sapiens
gagcgaggagagcuacaug

SEQ ID NO: 903989 - RNA, 19 nt, Homo sapiens
ggcacaggaggcaccaaua

SEQ ID NO: 903990 - RNA, 19 nt, Homo sapiens
gaacaccagccaggagucu

SEQ ID NO: 903991 - RNA, 19 nt, Homo sapiens
gaggcaccaauagcgauua

SEQ ID NO: 903992 - RNA, 19 nt, Homo sapiens
caacgaggucuaccaacag

SEQ ID NO: 903993 - RNA, 19 nt, Homo sapiens
ggaggagcacgcugagaag

SEQ ID NO: 903994 - RNA, 19 nt, Homo sapiens
ggagcaccaccaccucuuc

SEQ ID NO: 903995 - RNA, 19 nt, Homo sapiens
ccacauccagguagagaag

SEQ ID NO: 903996 - RNA, 19 nt, Homo sapiens
gggcacaggaggcaccaau

SEQ ID NO: 903997 - RNA, 19 nt, Homo sapiens
gcccugagagagauugaga

SEQ ID NO: 903998 - RNA, 19 nt, Homo sapiens
gcgaggagagcuacauggu

SEQ ID NO: 903999 - RNA, 19 nt, Homo sapiens
gucaagucccucccacuga

SEQ ID NO: 904000 - RNA, 19 nt, Homo sapiens
ccagccaggagucugauga

SEQ ID NO: 904001 - RNA, 19 nt, Homo sapiens
gacuuugcccgcuucauca

SEQ ID NO: 904002 - RNA, 19 nt, Homo sapiens
ggcaggaggccauguucga

SEQ ID NO: 904003 - RNA, 19 nt, Homo sapiens
guugugaccaagaagaaga

SEQ ID NO: 904004 - RNA, 19 nt, Homo sapiens
uggauacgcucugccucaa

SEQ ID NO: 904005 - RNA, 19 nt, Homo sapiens
cagggccucuccagcaaag

SEQ ID NO: 904006 - RNA, 19 nt, Homo sapiens
ccaggacuacgcccagaug

SEQ ID NO: 904007 - RNA, 19 nt, Homo sapiens
aaaggcaggaggccauguu

SEQ ID NO: 904008 - RNA, 19 nt, Homo sapiens
aggagcacgcugagaagua

SEQ ID NO: 904009 - RNA, 19 nt, Homo sapiens
gaacggaacugccucauca

SEQ ID NO: 904010 - RNA, 19 nt, Homo sapiens
caagauggcugacuccaaa

SEQ ID NO: 904011 - RNA, 19 nt, Homo sapiens
ggagggagcugcagagugu

SEQ ID NO: 904012 - RNA, 19 nt, Homo sapiens
ugacacagaugaugacuga

SEQ ID NO: 904013 - RNA, 19 nt, Homo sapiens
guacaaaggaggccaauau

SEQ ID NO: 904014 - RNA, 19 nt, Homo sapiens
ggaagacccucuggaauca

SEQ ID NO: 904015 - RNA, 19 nt, Homo sapiens
acaccaagaugauaauuga

SEQ ID NO: 904016 - RNA, 19 nt, Homo sapiens
uagggaagcuagaaacaaa

SEQ ID NO: 904017 - RNA, 19 nt, Homo sapiens
ugagaaaguugccuucaga

SEQ ID NO: 904018 - RNA, 19 nt, Homo sapiens
cagaggaggcuaauuauga

SEQ ID NO: 904019 - RNA, 19 nt, Homo sapiens
acaaaggaggccaauauua

SEQ ID NO: 904020 - RNA, 19 nt, Homo sapiens
gcuagaaacaaacccaaua

SEQ ID NO: 904021 - RNA, 19 nt, Homo sapiens
gaacucgucaucccuuuga

SEQ ID NO: 904022 - RNA, 19 nt, Homo sapiens
gaugauaauugaagauguc

SEQ ID NO: 904023 - RNA, 19 nt, Homo sapiens
caaaggaggccaauauuac

SEQ ID NO: 904024 - RNA, 19 nt, Homo sapiens
ccaguucuguaccauauga

SEQ ID NO: 904025 - RNA, 19 nt, Homo sapiens
ccaagaugauaauugaaga

SEQ ID NO: 904026 - RNA, 19 nt, Homo sapiens
gauaauugaagauguccua

SEQ ID NO: 904027 - RNA, 19 nt, Homo sapiens
gcaagagaaagauaaggaa

SEQ ID NO: 904028 - RNA, 19 nt, Homo sapiens
ugccagaggaggcuaauua

SEQ ID NO: 904029 - RNA, 19 nt, Homo sapiens
gaaggugggaagaucauug

SEQ ID NO: 904030 - RNA, 19 nt, Homo sapiens
gagcuguggugguucuuuc

SEQ ID NO: 904031 - RNA, 19 nt, Homo sapiens
ccaagaagucucuggaaga

SEQ ID NO: 904032 - RNA, 19 nt, Homo sapiens
ggacaacauguacaaagga

SEQ ID NO: 904033 - RNA, 19 nt, Homo sapiens
uaccaguucuguaccauau

SEQ ID NO: 904034 - RNA, 19 nt, Homo sapiens
ggaccugcgugugcgguuu

SEQ ID NO: 904035 - RNA, 19 nt, Homo sapiens
uaaggaagaucagccucaa

SEQ ID NO: 904036 - RNA, 19 nt, Homo sapiens
gaggagcaagagaaagaua

SEQ ID NO: 904037 - RNA, 19 nt, Homo sapiens
agagaaagauaaggaagau

SEQ ID NO: 904038 - RNA, 19 nt, Homo sapiens
agggaugggugaaccagua

SEQ ID NO: 904039 - RNA, 19 nt, Homo sapiens
gaaucaagaacucuacauc

SEQ ID NO: 904040 - RNA, 19 nt, Homo sapiens
cagcaggaguuugacaaga

SEQ ID NO: 904041 - RNA, 19 nt, Homo sapiens
uggaggagcuguggugguu

SEQ ID NO: 904042 - RNA, 19 nt, Homo sapiens
agaaagauaaggaagauca

SEQ ID NO: 904043 - RNA, 19 nt, Homo sapiens
ccugggccauccacagaua

SEQ ID NO: 904044 - RNA, 19 nt, Homo sapiens
uuacaacaccaagaugaua

SEQ ID NO: 904045 - RNA, 19 nt, Homo sapiens
gcaagauggcugacuccaa

SEQ ID NO: 904046 - RNA, 19 nt, Homo sapiens
aagaacaccuuggaucuca

SEQ ID NO: 904047 - RNA, 19 nt, Homo sapiens
gaccagaugaggagcaaga

SEQ ID NO: 904048 - RNA, 19 nt, Homo sapiens
caccuucaaucaaguagug

SEQ ID NO: 904049 - RNA, 19 nt, Homo sapiens
gugcaacugccaagagaaa

SEQ ID NO: 904050 - RNA, 19 nt, Homo sapiens
ggaggccaauauuacaaca

SEQ ID NO: 904051 - RNA, 19 nt, Homo sapiens
cagaugaggagcaagagaa

SEQ ID NO: 904052 - RNA, 19 nt, Homo sapiens
ggccgcaccuucaaucaag

SEQ ID NO: 904053 - RNA, 19 nt, Homo sapiens
caaacccaauauuuaccaa

SEQ ID NO: 904054 - RNA, 19 nt, Homo sapiens
gagaaaguugccuucagaa

SEQ ID NO: 904055 - RNA, 19 nt, Homo sapiens
gcaggaguuugacaagaac

SEQ ID NO: 904056 - RNA, 19 nt, Homo sapiens
gaggagcuguggugguucu

SEQ ID NO: 904057 - RNA, 19 nt, Homo sapiens
cuagaaacaaacccaauau

SEQ ID NO: 904058 - RNA, 19 nt, Homo sapiens
cggaagacccucuggaauc

SEQ ID NO: 904059 - RNA, 19 nt, Homo sapiens
agcaggaguuugacaagaa

SEQ ID NO: 904060 - RNA, 19 nt, Homo sapiens
ugguggagcuucacuacga

SEQ ID NO: 904061 - RNA, 19 nt, Homo sapiens
gcagagggugaccguguga

SEQ ID NO: 904062 - RNA, 19 nt, Homo sapiens
uacaacaccaagaugauaa

SEQ ID NO: 904063 - RNA, 19 nt, Homo sapiens
guagggaagcuagaaacaa

SEQ ID NO: 904064 - RNA, 19 nt, Homo sapiens
ggacaaggacaagggaaag

SEQ ID NO: 904065 - RNA, 19 nt, Homo sapiens
gggacaaggacaagggaaa

SEQ ID NO: 904066 - RNA, 19 nt, Homo sapiens
cuggaagggugggacauuu

SEQ ID NO: 904067 - RNA, 19 nt, Homo sapiens
gauguccuaagcccagaua

SEQ ID NO: 904068 - RNA, 19 nt, Homo sapiens
caacaccaagaugauaauu

SEQ ID NO: 904069 - RNA, 19 nt, Homo sapiens
uggaaggccugagggaaga

SEQ ID NO: 904070 - RNA, 19 nt, Homo sapiens
aaaggaggccaauauuaca

SEQ ID NO: 904071 - RNA, 19 nt, Homo sapiens
gaagucagcacugguugca

SEQ ID NO: 904072 - RNA, 19 nt, Homo sapiens
agaggaggcuaauuaugag

SEQ ID NO: 904073 - RNA, 19 nt, Homo sapiens
uacaaaggaggccaauauu

SEQ ID NO: 904074 - RNA, 19 nt, Homo sapiens
gccuugauccugacaaugu

SEQ ID NO: 904075 - RNA, 19 nt, Homo sapiens
ggaacucgucaucccuuug

SEQ ID NO: 904076 - RNA, 19 nt, Homo sapiens
cuagugacacagaugauga

SEQ ID NO: 904077 - RNA, 19 nt, Homo sapiens
uauuacaacaccaagauga

SEQ ID NO: 904078 - RNA, 19 nt, Homo sapiens
ggaaucaagaacucuacau

SEQ ID NO: 904079 - RNA, 19 nt, Homo sapiens
ccagaggaggcuaauuaug

SEQ ID NO: 904080 - RNA, 19 nt, Homo sapiens
ggugggaagaucauuguuc

SEQ ID NO: 904081 - RNA, 19 nt, Homo sapiens
ggagcaagagaaagauaag

SEQ ID NO: 904082 - RNA, 19 nt, Homo sapiens
gccagaggaggcuaauuau

SEQ ID NO: 904083 - RNA, 19 nt, Homo sapiens
ccaguagggaagcuagaaa

SEQ ID NO: 904084 - RNA, 19 nt, Homo sapiens
aagcccagauaccugugua

SEQ ID NO: 904085 - RNA, 19 nt, Homo sapiens
gaaagggaugggugaacca

SEQ ID NO: 904086 - RNA, 19 nt, Homo sapiens
caugggcccuagugacaca

SEQ ID NO: 904087 - RNA, 19 nt, Homo sapiens
caauauuacaacaccaaga

SEQ ID NO: 904088 - RNA, 19 nt, Homo sapiens
cagcaggacaacucagaga

SEQ ID NO: 904089 - RNA, 19 nt, Homo sapiens
aagagaaagauaaggaaga

SEQ ID NO: 904090 - RNA, 19 nt, Homo sapiens
ccaauuucauucggcuuca

SEQ ID NO: 904091 - RNA, 19 nt, Homo sapiens
gccaauauuacaacaccaa

SEQ ID NO: 904092 - RNA, 19 nt, Homo sapiens
uggacaacauguacaaagg

SEQ ID NO: 904093 - RNA, 19 nt, Homo sapiens
ccucuggaaucaagaacuc

SEQ ID NO: 904094 - RNA, 19 nt, Homo sapiens
gguggagcuucacuacgau

SEQ ID NO: 904095 - RNA, 19 nt, Homo sapiens
aauugaagauguccuaagc

SEQ ID NO: 904096 - RNA, 19 nt, Homo sapiens
ggccugcagccaagaguga

SEQ ID NO: 904097 - RNA, 19 nt, Homo sapiens
cacggaagacccucuggaa

SEQ ID NO: 904098 - RNA, 19 nt, Homo sapiens
uguaccauaugagaaaguu

SEQ ID NO: 904099 - RNA, 19 nt, Homo sapiens
uggugcaacugccaagaga

SEQ ID NO: 904100 - RNA, 19 nt, Homo sapiens
gcugugaaggagcucauug

SEQ ID NO: 904101 - RNA, 19 nt, Homo sapiens
ggagcuguggugguucuuu

SEQ ID NO: 904102 - RNA, 19 nt, Homo sapiens
gaaagauaaggaagaucag

SEQ ID NO: 904103 - RNA, 19 nt, Homo sapiens
ucagaaggugggaagauca

SEQ ID NO: 904104 - RNA, 19 nt, Homo sapiens
ggaagggugggacauuugc

SEQ ID NO: 904105 - RNA, 19 nt, Homo sapiens
ccuugauccugacaauguu

SEQ ID NO: 904106 - RNA, 19 nt, Homo sapiens
gcccuagugacacagauga

SEQ ID NO: 904107 - RNA, 19 nt, Homo sapiens
gaagacccucuggaaucaa

SEQ ID NO: 904108 - RNA, 19 nt, Homo sapiens
gagaaagccugagugagua

SEQ ID NO: 904109 - RNA, 19 nt, Homo sapiens
ggagaaagccugagugagu

SEQ ID NO: 904110 - RNA, 19 nt, Homo sapiens
gagcagagccguuggacuu

SEQ ID NO: 904111 - RNA, 19 nt, Homo sapiens
ugagagaguccacuacuua

SEQ ID NO: 904112 - RNA, 19 nt, Homo sapiens
ggacuuccuuugggacuaa

SEQ ID NO: 904113 - RNA, 19 nt, Homo sapiens
ccucauaguugggaaagua

SEQ ID NO: 904114 - RNA, 19 nt, Homo sapiens
gggaggagaucaccaccuu

SEQ ID NO: 904115 - RNA, 19 nt, Homo sapiens
agacaaacaucuucucuac

SEQ ID NO: 904116 - RNA, 19 nt, Homo sapiens
gggccgaguuugcaaaguu

SEQ ID NO: 904117 - RNA, 19 nt, Homo sapiens
auuaaagucugaaguguug

SEQ ID NO: 904118 - RNA, 19 nt, Homo sapiens
gaggagaaagccugaguga

SEQ ID NO: 904119 - RNA, 19 nt, Homo sapiens
ggacgaggaggacgaggaa

SEQ ID NO: 904120 - RNA, 19 nt, Homo sapiens
guauuaaagucugaagugu

SEQ ID NO: 904121 - RNA, 19 nt, Homo sapiens
gcagcugccuccagacucu

SEQ ID NO: 904122 - RNA, 19 nt, Homo sapiens
ggagaucaccaccuucauc

SEQ ID NO: 904123 - RNA, 19 nt, Homo sapiens
gaggagaucaccaccuuca

SEQ ID NO: 904124 - RNA, 19 nt, Homo sapiens
guaugaaagcugaggauug

SEQ ID NO: 904125 - RNA, 19 nt, Homo sapiens
ucaauugcagggaugcuua

SEQ ID NO: 904126 - RNA, 19 nt, Homo sapiens
gaucaccaccuucaucgau

SEQ ID NO: 904127 - RNA, 19 nt, Homo sapiens
gcucuucccuccucuugag

SEQ ID NO: 904128 - RNA, 19 nt, Homo sapiens
caucaugucugaggaggau

SEQ ID NO: 904129 - RNA, 19 nt, Homo sapiens
uaugaaagcugaggauugc

SEQ ID NO: 904130 - RNA, 19 nt, Homo sapiens
ccagccagccucauaguug

SEQ ID NO: 904131 - RNA, 19 nt, Homo sapiens
ggccagccuucgccaauuc

SEQ ID NO: 904132 - RNA, 19 nt, Homo sapiens
gcaaugcguggccaucaug

SEQ ID NO: 904133 - RNA, 19 nt, Homo sapiens
uugcagggaugcuuaagga

SEQ ID NO: 904134 - RNA, 19 nt, Homo sapiens
cagaugcccuacucagcuu

SEQ ID NO: 904135 - RNA, 19 nt, Homo sapiens
gcguggccaucaugucuga

SEQ ID NO: 904136 - RNA, 19 nt, Homo sapiens
gcuccuuccugcacaagug

SEQ ID NO: 904137 - RNA, 19 nt, Homo sapiens
gcagagggccgaguuugca

SEQ ID NO: 904138 - RNA, 19 nt, Homo sapiens
gcacugggguggugagcuu

SEQ ID NO: 904139 - RNA, 19 nt, Homo sapiens
gucaagaaccagaggcaaa

SEQ ID NO: 904140 - RNA, 19 nt, Homo sapiens
ggccgaguuugcaaaguuc

SEQ ID NO: 904141 - RNA, 19 nt, Homo sapiens
cggcgucugucccaugaug

SEQ ID NO: 904142 - RNA, 19 nt, Homo sapiens
caauugcagggaugcuuaa

SEQ ID NO: 904143 - RNA, 19 nt, Homo sapiens
gagcaaugcguggccauca

SEQ ID NO: 904144 - RNA, 19 nt, Homo sapiens
ggacgaggaagaggcugaa

SEQ ID NO: 904145 - RNA, 19 nt, Homo sapiens
gagagaguccacuacuuac

SEQ ID NO: 904146 - RNA, 19 nt, Homo sapiens
gugaagcugcugccuggaa

SEQ ID NO: 904147 - RNA, 19 nt, Homo sapiens
gagaguccacuacuuacag

SEQ ID NO: 904148 - RNA, 19 nt, Homo sapiens
ugagacaccucugccuucu

SEQ ID NO: 904149 - RNA, 19 nt, Homo sapiens
cgaggaagaggcugaaggu

SEQ ID NO: 904150 - RNA, 19 nt, Homo sapiens
uguauuaaagucugaagug

SEQ ID NO: 904151 - RNA, 19 nt, Homo sapiens
ugaggaggauggagaugac

SEQ ID NO: 904152 - RNA, 19 nt, Homo sapiens
agaaagccugagugaguaa

SEQ ID NO: 904153 - RNA, 19 nt, Homo sapiens
gacaaagacacagguugga

SEQ ID NO: 904154 - RNA, 19 nt, Homo sapiens
caaguggucauccucugau

SEQ ID NO: 904155 - RNA, 19 nt, Homo sapiens
acaaguggucauccucuga

SEQ ID NO: 904156 - RNA, 19 nt, Homo sapiens
uugagagaguccacuacuu

SEQ ID NO: 904157 - RNA, 19 nt, Homo sapiens
gugaccagaugcccuacuc

SEQ ID NO: 904158 - RNA, 19 nt, Homo sapiens
caaaagagaccuggaaguc

SEQ ID NO: 904159 - RNA, 19 nt, Homo sapiens
cugaguaccugggacaaag

SEQ ID NO: 904160 - RNA, 19 nt, Homo sapiens
cugcugcccuccuucaucu

SEQ ID NO: 904161 - RNA, 19 nt, Homo sapiens
gagcuucuucucccucaag

SEQ ID NO: 904162 - RNA, 19 nt, Homo sapiens
gagaaagccugagugagua

SEQ ID NO: 904163 - RNA, 19 nt, Homo sapiens
ggagaaagccugagugagu

SEQ ID NO: 904164 - RNA, 19 nt, Homo sapiens
gagcagagccguuggacuu

SEQ ID NO: 904165 - RNA, 19 nt, Homo sapiens
ugagagaguccacuacuua

SEQ ID NO: 904166 - RNA, 19 nt, Homo sapiens
ggacuuccuuugggacuaa

SEQ ID NO: 904167 - RNA, 19 nt, Homo sapiens
ccucauaguugggaaagua

SEQ ID NO: 904168 - RNA, 19 nt, Homo sapiens
gggaggagaucaccaccuu

SEQ ID NO: 904169 - RNA, 19 nt, Homo sapiens
ggucagcgccaucgucuuu

SEQ ID NO: 904170 - RNA, 19 nt, Homo sapiens
agacaaacaucuucucuac

SEQ ID NO: 904171 - RNA, 19 nt, Homo sapiens
gggccgaguuugcaaaguu

SEQ ID NO: 904172 - RNA, 19 nt, Homo sapiens
caagaucggccucggcuuu

SEQ ID NO: 904173 - RNA, 19 nt, Homo sapiens
auuaaagucugaaguguug

SEQ ID NO: 904174 - RNA, 19 nt, Homo sapiens
gaggagaaagccugaguga

SEQ ID NO: 904175 - RNA, 19 nt, Homo sapiens
ggaacgagaguaucugcaa

SEQ ID NO: 904176 - RNA, 19 nt, Homo sapiens
ggacgaggaggacgaggaa

SEQ ID NO: 904177 - RNA, 19 nt, Homo sapiens
guauuaaagucugaagugu

SEQ ID NO: 904178 - RNA, 19 nt, Homo sapiens
gcagcugccuccagacucu

SEQ ID NO: 904179 - RNA, 19 nt, Homo sapiens
ggagaucaccaccuucauc

SEQ ID NO: 904180 - RNA, 19 nt, Homo sapiens
gaggagaucaccaccuuca

SEQ ID NO: 904181 - RNA, 19 nt, Homo sapiens
caacggcgagcgcuacuau

SEQ ID NO: 904182 - RNA, 19 nt, Homo sapiens
guaugaaagcugaggauug

SEQ ID NO: 904183 - RNA, 19 nt, Homo sapiens
ucaauugcagggaugcuua

SEQ ID NO: 904184 - RNA, 19 nt, Homo sapiens
gaucaccaccuucaucgau

SEQ ID NO: 904185 - RNA, 19 nt, Homo sapiens
gcucuucccuccucuugag

SEQ ID NO: 904186 - RNA, 19 nt, Homo sapiens
caucaugucugaggaggau

SEQ ID NO: 904187 - RNA, 19 nt, Homo sapiens
uaugaaagcugaggauugc

SEQ ID NO: 904188 - RNA, 19 nt, Homo sapiens
ccagccagccucauaguug

SEQ ID NO: 904189 - RNA, 19 nt, Homo sapiens
ggccagccuucgccaauuc

SEQ ID NO: 904190 - RNA, 19 nt, Homo sapiens
ccaagcagcagaagcacaa

SEQ ID NO: 904191 - RNA, 19 nt, Homo sapiens
gcaaugcguggccaucaug

SEQ ID NO: 904192 - RNA, 19 nt, Homo sapiens
uugcagggaugcuuaagga

SEQ ID NO: 904193 - RNA, 19 nt, Homo sapiens
cagaugcccuacucagcuu

SEQ ID NO: 904194 - RNA, 19 nt, Homo sapiens
gcguggccaucaugucuga

SEQ ID NO: 904195 - RNA, 19 nt, Homo sapiens
gccaucgucuuucucuaug

SEQ ID NO: 904196 - RNA, 19 nt, Homo sapiens
ggccucggcuuuggcguuu

SEQ ID NO: 904197 - RNA, 19 nt, Homo sapiens
guucauagucuccaagauc

SEQ ID NO: 904198 - RNA, 19 nt, Homo sapiens
gcuccuuccugcacaagug

SEQ ID NO: 904199 - RNA, 19 nt, Homo sapiens
ucaugggucuggucugugu

SEQ ID NO: 904200 - RNA, 19 nt, Homo sapiens
gcagagggccgaguuugca

SEQ ID NO: 904201 - RNA, 19 nt, Homo sapiens
gucaagaaccagaggcaaa

SEQ ID NO: 904202 - RNA, 19 nt, Homo sapiens
gcugacagggcgaggauug

SEQ ID NO: 904203 - RNA, 19 nt, Homo sapiens
ggccgaguuugcaaaguuc

SEQ ID NO: 904204 - RNA, 19 nt, Homo sapiens
uccauuggcuggcacaaca

SEQ ID NO: 904205 - RNA, 19 nt, Homo sapiens
cggcgucugucccaugaug

SEQ ID NO: 904206 - RNA, 19 nt, Homo sapiens
gagcaaugcguggccauca

SEQ ID NO: 904207 - RNA, 19 nt, Homo sapiens
caauugcagggaugcuuaa

SEQ ID NO: 904208 - RNA, 19 nt, Homo sapiens
gggcacacacauacucaug

SEQ ID NO: 904209 - RNA, 19 nt, Homo sapiens
gaucaugggaguguuugug

SEQ ID NO: 904210 - RNA, 19 nt, Homo sapiens
ugucaugggucuggucugu

SEQ ID NO: 904211 - RNA, 19 nt, Homo sapiens
ggacgaggaagaggcugaa

SEQ ID NO: 904212 - RNA, 19 nt, Homo sapiens
gagagaguccacuacuuac

SEQ ID NO: 904213 - RNA, 19 nt, Homo sapiens
gugaagcugcugccuggaa

SEQ ID NO: 904214 - RNA, 19 nt, Homo sapiens
gagaguccacuacuuacag

SEQ ID NO: 904215 - RNA, 19 nt, Homo sapiens
gcgccaucgucuuucucua

SEQ ID NO: 904216 - RNA, 19 nt, Homo sapiens
ugagacaccucugccuucu

SEQ ID NO: 904217 - RNA, 19 nt, Homo sapiens
cgaggaagaggcugaaggu

SEQ ID NO: 904218 - RNA, 19 nt, Homo sapiens
ccaucgucuuucucuauga

SEQ ID NO: 904219 - RNA, 19 nt, Homo sapiens
guguggccaucaccuucua

SEQ ID NO: 904220 - RNA, 19 nt, Homo sapiens
ccacacugcccuccauugg

SEQ ID NO: 904221 - RNA, 19 nt, Homo sapiens
ucaacuaccgccucagcaa

SEQ ID NO: 904222 - RNA, 19 nt, Homo sapiens
uguauuaaagucugaagug

SEQ ID NO: 904223 - RNA, 19 nt, Homo sapiens
ugaggaggauggagaugac

SEQ ID NO: 904224 - RNA, 19 nt, Homo sapiens
agaaagccugagugaguaa

SEQ ID NO: 904225 - RNA, 19 nt, Homo sapiens
gacaaagacacagguugga

SEQ ID NO: 904226 - RNA, 19 nt, Homo sapiens
caaguggucauccucugau

SEQ ID NO: 904227 - RNA, 19 nt, Homo sapiens
acaaguggucauccucuga

SEQ ID NO: 904228 - RNA, 19 nt, Homo sapiens
uugagagaguccacuacuu

SEQ ID NO: 904229 - RNA, 19 nt, Homo sapiens
ucacaggggugcccaucuu

SEQ ID NO: 904230 - RNA, 19 nt, Homo sapiens
gugaccagaugcccuacuc

SEQ ID NO: 904231 - RNA, 19 nt, Homo sapiens
cugaguaccugggacaaag

SEQ ID NO: 904232 - RNA, 19 nt, Homo sapiens
caaaagagaccuggaaguc

SEQ ID NO: 904233 - RNA, 19 nt, Homo sapiens
cugcugcccuccuucaucu

SEQ ID NO: 904234 - RNA, 19 nt, Homo sapiens
gagcuucuucucccucaag

SEQ ID NO: 904235 - RNA, 19 nt, Homo sapiens
cgccaucgucuuucucuau

SEQ ID NO: 904236 - RNA, 19 nt, Homo sapiens
gggcaaagcuuucgugaug

SEQ ID NO: 904237 - RNA, 19 nt, Homo sapiens
cagaggaggugaugugcua

SEQ ID NO: 904238 - RNA, 19 nt, Homo sapiens
gcaaagcuuucgugaugga

SEQ ID NO: 904239 - RNA, 19 nt, Homo sapiens
ggaguggaccuggaacuua

SEQ ID NO: 904240 - RNA, 19 nt, Homo sapiens
ggagcucuaugccucagua

SEQ ID NO: 904241 - RNA, 19 nt, Homo sapiens
gaagaggucccgcuguaug

SEQ ID NO: 904242 - RNA, 19 nt, Homo sapiens
uggaagaggucccgcugua

SEQ ID NO: 904243 - RNA, 19 nt, Homo sapiens
gaaccugcauuaucuacag

SEQ ID NO: 904244 - RNA, 19 nt, Homo sapiens
gaguggaccuggaacuuag

SEQ ID NO: 904245 - RNA, 19 nt, Homo sapiens
caggacggcugucucaaga

SEQ ID NO: 904246 - RNA, 19 nt, Homo sapiens
gaggugaugugcuauacca

SEQ ID NO: 904247 - RNA, 19 nt, Homo sapiens
aguaagaagugcuguggaa

SEQ ID NO: 904248 - RNA, 19 nt, Homo sapiens
gaucaggccuaugccaaca

SEQ ID NO: 904249 - RNA, 19 nt, Homo sapiens
gcucuaugccucaguaugu

SEQ ID NO: 904250 - RNA, 19 nt, Homo sapiens
gaggaggugaugugcuaua

SEQ ID NO: 904251 - RNA, 19 nt, Homo sapiens
ccaaagacgggcugccauu

SEQ ID NO: 904252 - RNA, 19 nt, Homo sapiens
ggaggaggcaaagacagua

SEQ ID NO: 904253 - RNA, 19 nt, Homo sapiens
gaaaccgucaggccaugaa

SEQ ID NO: 904254 - RNA, 19 nt, Homo sapiens
uguaugggaaccugcauua

SEQ ID NO: 904255 - RNA, 19 nt, Homo sapiens
gggcugccauugccaaguc

SEQ ID NO: 904256 - RNA, 19 nt, Homo sapiens
gguucucacuuccuucuuc

SEQ ID NO: 904257 - RNA, 19 nt, Homo sapiens
ggagggaugggaguaagaa

SEQ ID NO: 904258 - RNA, 19 nt, Homo sapiens
caucucagggcaaagcuuu

SEQ ID NO: 904259 - RNA, 19 nt, Homo sapiens
ggaagaggucccgcuguau

SEQ ID NO: 904260 - RNA, 19 nt, Homo sapiens
gaggagggaugggaguaag

SEQ ID NO: 904261 - RNA, 19 nt, Homo sapiens
caaagacgggcugccauug

SEQ ID NO: 904262 - RNA, 19 nt, Homo sapiens
guaagaagugcuguggaaa

SEQ ID NO: 904263 - RNA, 19 nt, Homo sapiens
gggaugggaguaagaagug

SEQ ID NO: 904264 - RNA, 19 nt, Homo sapiens
gcugugacgcugcuauuuc

SEQ ID NO: 904265 - RNA, 19 nt, Homo sapiens
gucccaaguuuucaaauaa

SEQ ID NO: 904266 - RNA, 19 nt, Homo sapiens
guggguggguggguauauu

SEQ ID NO: 904267 - RNA, 19 nt, Homo sapiens
cagcaggauccaacucuug

SEQ ID NO: 904268 - RNA, 19 nt, Homo sapiens
ccagcaggauccaacucuu

SEQ ID NO: 904269 - RNA, 19 nt, Homo sapiens
ggaaaccgucaggccauga

SEQ ID NO: 904270 - RNA, 19 nt, Homo sapiens
uaugggaaccugcauuauc

SEQ ID NO: 904271 - RNA, 19 nt, Homo sapiens
ggacuuccuaucugagcuu

SEQ ID NO: 904272 - RNA, 19 nt, Homo sapiens
ucuguccugucccaaguuu

SEQ ID NO: 904273 - RNA, 19 nt, Homo sapiens
gcuggacucugagccaaag

SEQ ID NO: 904274 - RNA, 19 nt, Homo sapiens
gauggaggaggcaaagaca

SEQ ID NO: 904275 - RNA, 19 nt, Homo sapiens
gagcuucaagggagacauc

SEQ ID NO: 904276 - RNA, 19 nt, Homo sapiens
gggcugugacgcugcuauu

SEQ ID NO: 904277 - RNA, 19 nt, Homo sapiens
uaagaagugcuguggaaac

SEQ ID NO: 904278 - RNA, 19 nt, Homo sapiens
augggaaccugcauuaucu

SEQ ID NO: 904279 - RNA, 19 nt, Homo sapiens
ugucccaaguuuucaaaua

SEQ ID NO: 904280 - RNA, 19 nt, Homo sapiens
gaacccuagcaggagaaua

SEQ ID NO: 904281 - RNA, 19 nt, Homo sapiens
acucccagguucucacuuc

SEQ ID NO: 904282 - RNA, 19 nt, Homo sapiens
cuuccuaucugagcuucaa

SEQ ID NO: 904283 - RNA, 19 nt, Homo sapiens
gcaggggcaugacuguuuc

SEQ ID NO: 904284 - RNA, 19 nt, Homo sapiens
caaggaagcuaguacauua

SEQ ID NO: 904285 - RNA, 19 nt, Homo sapiens
ugagagagcuguacaauuu

SEQ ID NO: 904286 - RNA, 19 nt, Homo sapiens
gaagaugacuugaacguuu

SEQ ID NO: 904287 - RNA, 19 nt, Homo sapiens
gaagaucuuuggcucauaa

SEQ ID NO: 904288 - RNA, 19 nt, Homo sapiens
caacaaaucuccagucagu

SEQ ID NO: 904289 - RNA, 19 nt, Homo sapiens
gagaugacaugcauagaaa

SEQ ID NO: 904290 - RNA, 19 nt, Homo sapiens
gaacaagacucuacagaac

SEQ ID NO: 904291 - RNA, 19 nt, Homo sapiens
caaauucgauucaugaaga

SEQ ID NO: 904292 - RNA, 19 nt, Homo sapiens
gaacauaaucuucagagaa

SEQ ID NO: 904293 - RNA, 19 nt, Homo sapiens
ggaaaggaauugaagacuu

SEQ ID NO: 904294 - RNA, 19 nt, Homo sapiens
gaacguuucugucgugguu

SEQ ID NO: 904295 - RNA, 19 nt, Homo sapiens
ggauuggacucuaaauauu

SEQ ID NO: 904296 - RNA, 19 nt, Homo sapiens
gccaacaaguggaaaguua

SEQ ID NO: 904297 - RNA, 19 nt, Homo sapiens
gaaccaaugucagaugaaa

SEQ ID NO: 904298 - RNA, 19 nt, Homo sapiens
gaauuacaguugugagauu

SEQ ID NO: 904299 - RNA, 19 nt, Homo sapiens
ggacaaauucgauucauga

SEQ ID NO: 904300 - RNA, 19 nt, Homo sapiens
gaagggaaguuuucuagua

SEQ ID NO: 904301 - RNA, 19 nt, Homo sapiens
gaacauacccaaagacaca

SEQ ID NO: 904302 - RNA, 19 nt, Homo sapiens
gaauugggcugggaagaaa

SEQ ID NO: 904303 - RNA, 19 nt, Homo sapiens
ccacauuccuguagcagua

SEQ ID NO: 904304 - RNA, 19 nt, Homo sapiens
ggucauccaucugcuaaua

SEQ ID NO: 904305 - RNA, 19 nt, Homo sapiens
gaagaaagaucaguagaac

SEQ ID NO: 904306 - RNA, 19 nt, Homo sapiens
agaagacacucaagaauug

SEQ ID NO: 904307 - RNA, 19 nt, Homo sapiens
cuagcaagauucaaagaua

SEQ ID NO: 904308 - RNA, 19 nt, Homo sapiens
gagaacagccugcaauaug

SEQ ID NO: 904309 - RNA, 19 nt, Homo sapiens
gaacuaaacuaugaugaac

SEQ ID NO: 904310 - RNA, 19 nt, Homo sapiens
gagagaagaugacuugaac

SEQ ID NO: 904311 - RNA, 19 nt, Homo sapiens
ggccgucucugccuaagua

SEQ ID NO: 904312 - RNA, 19 nt, Homo sapiens
gcaggagacugaacagcaa

SEQ ID NO: 904313 - RNA, 19 nt, Homo sapiens
uaaagcaucucauugucaa

SEQ ID NO: 904314 - RNA, 19 nt, Homo sapiens
ggaaguaguugccuuuggu

SEQ ID NO: 904315 - RNA, 19 nt, Homo sapiens
ggagaugacaugcauagaa

SEQ ID NO: 904316 - RNA, 19 nt, Homo sapiens
gaaguaggaaaguuuguuu

SEQ ID NO: 904317 - RNA, 19 nt, Homo sapiens
gcaucucauugucaaauaa

SEQ ID NO: 904318 - RNA, 19 nt, Homo sapiens
caaguagaguuguuugguu

SEQ ID NO: 904319 - RNA, 19 nt, Homo sapiens
gauaucgcauucagaguga

SEQ ID NO: 904320 - RNA, 19 nt, Homo sapiens
guuccaagcuccaaacguu

SEQ ID NO: 904321 - RNA, 19 nt, Homo sapiens
gaagagugccacccauuug

SEQ ID NO: 904322 - RNA, 19 nt, Homo sapiens
agaacagccugcaauauga

SEQ ID NO: 904323 - RNA, 19 nt, Homo sapiens
uaacauccccuuuucauua

SEQ ID NO: 904324 - RNA, 19 nt, Homo sapiens
acagugaaaugacauaguu

SEQ ID NO: 904325 - RNA, 19 nt, Homo sapiens
gcaaccaccauuagaauug

SEQ ID NO: 904326 - RNA, 19 nt, Homo sapiens
gaacagagugauauugcaa

SEQ ID NO: 904327 - RNA, 19 nt, Homo sapiens
caacaaguggaaaguuaua

SEQ ID NO: 904328 - RNA, 19 nt, Homo sapiens
gggaaccaaugucagauga

SEQ ID NO: 904329 - RNA, 19 nt, Homo sapiens
gaaaggaaaggaauugaag

SEQ ID NO: 904330 - RNA, 19 nt, Homo sapiens
gcaaagauucagauccaaa

SEQ ID NO: 904331 - RNA, 19 nt, Homo sapiens
caagccaacugaagaaaca

SEQ ID NO: 904332 - RNA, 19 nt, Homo sapiens
gcaaucuguuccagucauu

SEQ ID NO: 904333 - RNA, 19 nt, Homo sapiens
cagaugaaauugauguaug

SEQ ID NO: 904334 - RNA, 19 nt, Homo sapiens
ggaaaggaaaggaauugaa

SEQ ID NO: 904335 - RNA, 19 nt, Homo sapiens
gagcucaagccgaagauuu

SEQ ID NO: 904336 - RNA, 19 nt, Homo sapiens
gaugaucaggugaauguaa

SEQ ID NO: 904337 - RNA, 19 nt, Homo sapiens
cauuagaauugacuuguga

SEQ ID NO: 904338 - RNA, 19 nt, Homo sapiens
ucaggaaccuuggguaaug

SEQ ID NO: 904339 - RNA, 19 nt, Homo sapiens
ccaaggagucucggaauaa

SEQ ID NO: 904340 - RNA, 19 nt, Homo sapiens
agaaagaucaguagaacaa

SEQ ID NO: 904341 - RNA, 19 nt, Homo sapiens
aaacagggagucaaagauu

SEQ ID NO: 904342 - RNA, 19 nt, Homo sapiens
caaccaccauuagaauuga

SEQ ID NO: 904343 - RNA, 19 nt, Homo sapiens
cuuaggaggugcucgaauu

SEQ ID NO: 904344 - RNA, 19 nt, Homo sapiens
caagguguuuggcccauga

SEQ ID NO: 904345 - RNA, 19 nt, Homo sapiens
gaacuugauguagaaauga

SEQ ID NO: 904346 - RNA, 19 nt, Homo sapiens
gguaagacuugaaugugau

SEQ ID NO: 904347 - RNA, 19 nt, Homo sapiens
caaggagucucggaauaau

SEQ ID NO: 904348 - RNA, 19 nt, Homo sapiens
aaagaucaguagaacaaga

SEQ ID NO: 904349 - RNA, 19 nt, Homo sapiens
cgaguuauccaauguaaau

SEQ ID NO: 904350 - RNA, 19 nt, Homo sapiens
ugaacuugauguagaaaug

SEQ ID NO: 904351 - RNA, 19 nt, Homo sapiens
gcauauuuaucaagaugug

SEQ ID NO: 904352 - RNA, 19 nt, Homo sapiens
uaauuugcauccagucuau

SEQ ID NO: 904353 - RNA, 19 nt, Homo sapiens
caauaugaccuauggauca

SEQ ID NO: 904354 - RNA, 19 nt, Homo sapiens
caaguucgaauuacaguug

SEQ ID NO: 904355 - RNA, 19 nt, Homo sapiens
caacugaagaaacauauca

SEQ ID NO: 904356 - RNA, 19 nt, Homo sapiens
ugagagagaagaugacuug

SEQ ID NO: 904357 - RNA, 19 nt, Homo sapiens
uggcuaauguugacaauag

SEQ ID NO: 904358 - RNA, 19 nt, Homo sapiens
ggaugcugaugguauuuga

SEQ ID NO: 904359 - RNA, 19 nt, Homo sapiens
caagaagacacucaagaau

SEQ ID NO: 904360 - RNA, 19 nt, Homo sapiens
gcuuagugcugaccagguu

SEQ ID NO: 904361 - RNA, 19 nt, Homo sapiens
ugaugaacuugauguagaa

SEQ ID NO: 904362 - RNA, 19 nt, Homo sapiens
cucgagaacuaaacuauga

SEQ ID NO: 904363 - RNA, 19 nt, Homo sapiens
gauaauggacaaauucgau

SEQ ID NO: 904364 - RNA, 19 nt, Homo sapiens
cuaaggagcaggcuuugaa

SEQ ID NO: 904365 - RNA, 19 nt, Homo sapiens
aagaagacacucaagaauu

SEQ ID NO: 904366 - RNA, 19 nt, Homo sapiens
gauuggacucuaaauauug

SEQ ID NO: 904367 - RNA, 19 nt, Homo sapiens
ugguaagacuugaauguga

SEQ ID NO: 904368 - RNA, 19 nt, Homo sapiens
uccaaggagucucggaaua

SEQ ID NO: 904369 - RNA, 19 nt, Homo sapiens
acaagaagacacucaagaa

SEQ ID NO: 904370 - RNA, 19 nt, Homo sapiens
ggauaccuaaggaucuuua

SEQ ID NO: 904371 - RNA, 19 nt, Homo sapiens
ggugggaacugaccuuguc

SEQ ID NO: 904372 - RNA, 19 nt, Homo sapiens
gcccaugacugagagagaa

SEQ ID NO: 904373 - RNA, 19 nt, Homo sapiens
cagagaacagccugcaaua

SEQ ID NO: 904374 - RNA, 19 nt, Homo sapiens
gaugacaugcauagaaaga

SEQ ID NO: 904375 - RNA, 19 nt, Homo sapiens
gaaccugugugaaccucau

SEQ ID NO: 904376 - RNA, 19 nt, Homo sapiens
ugacaauaguggaaaugga

SEQ ID NO: 904377 - RNA, 19 nt, Homo sapiens
gcagaacagagugauauug

SEQ ID NO: 904378 - RNA, 19 nt, Homo sapiens
cgugguuucuccuaacuuu

SEQ ID NO: 904379 - RNA, 19 nt, Homo sapiens
aaauaugccuuugccaguu

SEQ ID NO: 904380 - RNA, 19 nt, Homo sapiens
ggaauugaagacuuugcua

SEQ ID NO: 904381 - RNA, 19 nt, Homo sapiens
agugauugcucuacauuau

SEQ ID NO: 904382 - RNA, 19 nt, Homo sapiens
uagagggauuuaugaguga

SEQ ID NO: 904383 - RNA, 19 nt, Homo sapiens
agaauacagugaaaugaca

SEQ ID NO: 904384 - RNA, 19 nt, Homo sapiens
uaagaacccuugucugaua

SEQ ID NO: 904385 - RNA, 19 nt, Homo sapiens
gaaacgauguuguggagaa

SEQ ID NO: 904386 - RNA, 19 nt, Homo sapiens
gcuggaaacugacaaacua

SEQ ID NO: 904387 - RNA, 19 nt, Homo sapiens
gcaacuaugcucccauuua

SEQ ID NO: 904388 - RNA, 19 nt, Homo sapiens
ggaagccaguggaaagaua

SEQ ID NO: 904389 - RNA, 19 nt, Homo sapiens
gggauuccuucaccaauua

SEQ ID NO: 904390 - RNA, 19 nt, Homo sapiens
gauuugagcuguucuggaa

SEQ ID NO: 904391 - RNA, 19 nt, Homo sapiens
caucaggauuugcuauuua

SEQ ID NO: 904392 - RNA, 19 nt, Homo sapiens
guagaaugcuugauuacuu

SEQ ID NO: 904393 - RNA, 19 nt, Homo sapiens
gcucugggcuggagaaaug

SEQ ID NO: 904394 - RNA, 19 nt, Homo sapiens
ggacagagacugaggaugu

SEQ ID NO: 904395 - RNA, 19 nt, Homo sapiens
gaccggcuauucgaaauua

SEQ ID NO: 904396 - RNA, 19 nt, Homo sapiens
guaaugcaauucaacuuug

SEQ ID NO: 904397 - RNA, 19 nt, Homo sapiens
ccacccagcuggaaacuga

SEQ ID NO: 904398 - RNA, 19 nt, Homo sapiens
gaaaugccaugacuguagu

SEQ ID NO: 904399 - RNA, 19 nt, Homo sapiens
caacuaugcucccauuuac

SEQ ID NO: 904400 - RNA, 19 nt, Homo sapiens
guguaacuguugugaaaua

SEQ ID NO: 904401 - RNA, 19 nt, Homo sapiens
ggcaugaacucaacagaau

SEQ ID NO: 904402 - RNA, 19 nt, Homo sapiens
uaccauaaaugcaguguga

SEQ ID NO: 904403 - RNA, 19 nt, Homo sapiens
gaaauacccaccacuaaag

SEQ ID NO: 904404 - RNA, 19 nt, Homo sapiens
gaauauggccagugcuuga

SEQ ID NO: 904405 - RNA, 19 nt, Homo sapiens
cagaaggccucgaaucuca

SEQ ID NO: 904406 - RNA, 19 nt, Homo sapiens
cguguagaaugcuugauua

SEQ ID NO: 904407 - RNA, 19 nt, Homo sapiens
gaacagaaggccucgaauc

SEQ ID NO: 904408 - RNA, 19 nt, Homo sapiens
caacugggccaccaaagaa

SEQ ID NO: 904409 - RNA, 19 nt, Homo sapiens
agaaauggaucuacuacug

SEQ ID NO: 904410 - RNA, 19 nt, Homo sapiens
gaacaagacccucccaaac

SEQ ID NO: 904411 - RNA, 19 nt, Homo sapiens
agagggagguugcugcuuu

SEQ ID NO: 904412 - RNA, 19 nt, Homo sapiens
caacagaauccaacucuuc

SEQ ID NO: 904413 - RNA, 19 nt, Homo sapiens
ccacuuauguucccaaagg

SEQ ID NO: 904414 - RNA, 19 nt, Homo sapiens
ugaaauacccaccacuaaa

SEQ ID NO: 904415 - RNA, 19 nt, Homo sapiens
cugggaaguugguuuauaa

SEQ ID NO: 904416 - RNA, 19 nt, Homo sapiens
gaacauagggauacugcau

SEQ ID NO: 904417 - RNA, 19 nt, Homo sapiens
acgcgaaacuugagaauuc

SEQ ID NO: 904418 - RNA, 19 nt, Homo sapiens
acccuugucugauauauuu

SEQ ID NO: 904419 - RNA, 19 nt, Homo sapiens
uuaaguggcuugacaacug

SEQ ID NO: 904420 - RNA, 19 nt, Homo sapiens
uagaaugcuugauuacuug

SEQ ID NO: 904421 - RNA, 19 nt, Homo sapiens
gacagaaccuacacaagca

SEQ ID NO: 904422 - RNA, 19 nt, Homo sapiens
gaaggaccgauaucagaaa

SEQ ID NO: 904423 - RNA, 19 nt, Homo sapiens
gaacacauugcugcacuuu

SEQ ID NO: 904424 - RNA, 19 nt, Homo sapiens
gauacugcauucuggaaau

SEQ ID NO: 904425 - RNA, 19 nt, Homo sapiens
ggaaggaagacgugaacaa

SEQ ID NO: 904426 - RNA, 19 nt, Homo sapiens
uguaagaacccuugucuga

SEQ ID NO: 904427 - RNA, 19 nt, Homo sapiens
gcuggaagcuucgcuaugg

SEQ ID NO: 904428 - RNA, 19 nt, Homo sapiens
aaacuugaccacacuauug

SEQ ID NO: 904429 - RNA, 19 nt, Homo sapiens
gaaacuugaccacacuauu

SEQ ID NO: 904430 - RNA, 19 nt, Homo sapiens
gaugugccuucuaguguga

SEQ ID NO: 904431 - RNA, 19 nt, Homo sapiens
gguccaaucugcucucaag

SEQ ID NO: 904432 - RNA, 19 nt, Homo sapiens
gacagucccugacaacaca

SEQ ID NO: 904433 - RNA, 19 nt, Homo sapiens
gacaugcuccacuuucuaa

SEQ ID NO: 904434 - RNA, 19 nt, Homo sapiens
gaagauucgugggcugaug

SEQ ID NO: 904435 - RNA, 19 nt, Homo sapiens
acacauugcugcacuuugg

SEQ ID NO: 904436 - RNA, 19 nt, Homo sapiens
gaaauuauuggagucaaga

SEQ ID NO: 904437 - RNA, 19 nt, Homo sapiens
aggcagggcugaagaaauc

SEQ ID NO: 904438 - RNA, 19 nt, Homo sapiens
gagaauggcauagagaaau

SEQ ID NO: 904439 - RNA, 19 nt, Homo sapiens
gaacccuugucugauauau

SEQ ID NO: 904440 - RNA, 19 nt, Homo sapiens
ccaucaggauuugcuauuu

SEQ ID NO: 904441 - RNA, 19 nt, Homo sapiens
gcuaaccugugacaagugu

SEQ ID NO: 904442 - RNA, 19 nt, Homo sapiens
gugaggcucuuaacuucuu

SEQ ID NO: 904443 - RNA, 19 nt, Homo sapiens
ggccagugcuugaguucuu

SEQ ID NO: 904444 - RNA, 19 nt, Homo sapiens
guacucuucuuaugcuaau

SEQ ID NO: 904445 - RNA, 19 nt, Homo sapiens
aaaguauaauggcaucuug

SEQ ID NO: 904446 - RNA, 19 nt, Homo sapiens
gugaaauacccaccacuaa

SEQ ID NO: 904447 - RNA, 19 nt, Homo sapiens
gaaggaagacgugaacaag

SEQ ID NO: 904448 - RNA, 19 nt, Homo sapiens
ccaaaggcaugaacucaac

SEQ ID NO: 904449 - RNA, 19 nt, Homo sapiens
uaacauucacaccuacuuu

SEQ ID NO: 904450 - RNA, 19 nt, Homo sapiens
caaacuagaccggcuauuc

SEQ ID NO: 904451 - RNA, 19 nt, Homo sapiens
cauuugcccuggaugauug

SEQ ID NO: 904452 - RNA, 19 nt, Homo sapiens
caacucuucugccucuguu

SEQ ID NO: 904453 - RNA, 19 nt, Homo sapiens
ucucagaugugccuucuag

SEQ ID NO: 904454 - RNA, 19 nt, Homo sapiens
ggaacacauugcugcacuu

SEQ ID NO: 904455 - RNA, 19 nt, Homo sapiens
gagaauauggccagugcuu

SEQ ID NO: 904456 - RNA, 19 nt, Homo sapiens
caccacagcucagccagaa

SEQ ID NO: 904457 - RNA, 19 nt, Homo sapiens
agaauggcauagagaaaug

SEQ ID NO: 904458 - RNA, 19 nt, Homo sapiens
gccuucaaguguacuaauu

SEQ ID NO: 904459 - RNA, 19 nt, Homo sapiens
gugaaggaccgauaucaga

SEQ ID NO: 904460 - RNA, 19 nt, Homo sapiens
gagcauuugcccuggauga

SEQ ID NO: 904461 - RNA, 19 nt, Homo sapiens
ggaccaaggagacagacaa

SEQ ID NO: 904462 - RNA, 19 nt, Homo sapiens
gcaugagaauggcauagag

SEQ ID NO: 904463 - RNA, 19 nt, Homo sapiens
ccucaagccaucaggauuu

SEQ ID NO: 904464 - RNA, 19 nt, Homo sapiens
uauaauggcaucuugugaa

SEQ ID NO: 904465 - RNA, 19 nt, Homo sapiens
gcgggugauugaagagauu

SEQ ID NO: 904466 - RNA, 19 nt, Homo sapiens
gaagaaagggacagagacu

SEQ ID NO: 904467 - RNA, 19 nt, Homo sapiens
agguguaacuguugugaaa

SEQ ID NO: 904468 - RNA, 19 nt, Homo sapiens
ucugggaaguugguuuaua

SEQ ID NO: 904469 - RNA, 19 nt, Homo sapiens
gaaggccucgaaucucauu

SEQ ID NO: 904470 - RNA, 19 nt, Homo sapiens
gagaaaugccaugacugua

SEQ ID NO: 904471 - RNA, 19 nt, Homo sapiens
caccaaagaacuugaacuu

SEQ ID NO: 904472 - RNA, 19 nt, Homo sapiens
cgaaucucauuggcacaua

SEQ ID NO: 904473 - RNA, 19 nt, Homo sapiens
gagggagguugcugcuuuc

SEQ ID NO: 904474 - RNA, 19 nt, Homo sapiens
gaagccaguggaaagauau

SEQ ID NO: 904475 - RNA, 19 nt, Homo sapiens
gggagaaauggaucuacua

SEQ ID NO: 904476 - RNA, 19 nt, Homo sapiens
ugaacaagacccucccaaa

SEQ ID NO: 904477 - RNA, 19 nt, Homo sapiens
ugggauuccuucaccaauu

SEQ ID NO: 904478 - RNA, 19 nt, Homo sapiens
cgaaauuauuggagucaag

SEQ ID NO: 904479 - RNA, 19 nt, Homo sapiens
cuucuagugugaugaaaug

SEQ ID NO: 904480 - RNA, 19 nt, Homo sapiens
agaaagggacagagacuga

SEQ ID NO: 904481 - RNA, 19 nt, Homo sapiens
gugcuaaccugugacaagu

SEQ ID NO: 904482 - RNA, 19 nt, Homo sapiens
gagaauuugcccagcuuug

SEQ ID NO: 904483 - RNA, 19 nt, Homo sapiens
gaccugcuguagaacauag

SEQ ID NO: 904484 - RNA, 19 nt, Homo sapiens
gaacagacagcugaaguug

SEQ ID NO: 904485 - RNA, 19 nt, Homo sapiens
gaaaaucauugcagacauu

SEQ ID NO: 904486 - RNA, 19 nt, Homo sapiens
aggaggagaugaugaauga

SEQ ID NO: 904487 - RNA, 19 nt, Homo sapiens
aggcagagaucauggauau

SEQ ID NO: 904488 - RNA, 19 nt, Homo sapiens
gcgcaaguuuguauugaug

SEQ ID NO: 904489 - RNA, 19 nt, Homo sapiens
uuaagaagauggccaagca

SEQ ID NO: 904490 - RNA, 19 nt, Homo sapiens
ccacaaccccucuguaaua

SEQ ID NO: 904491 - RNA, 19 nt, Homo sapiens
cagaugagcugucgaaccu

SEQ ID NO: 904492 - RNA, 19 nt, Homo sapiens
caucauggaccuauuguuc

SEQ ID NO: 904493 - RNA, 19 nt, Homo sapiens
gaggagaugaugaaugaug

SEQ ID NO: 904494 - RNA, 19 nt, Homo sapiens
caaccccucuguaauaaaa

SEQ ID NO: 904495 - RNA, 19 nt, Homo sapiens
ugaaggaggagaugaugaa

SEQ ID NO: 904496 - RNA, 19 nt, Homo sapiens
uugcagacauuaagaagau

SEQ ID NO: 904497 - RNA, 19 nt, Homo sapiens
ggaccgcgagcgacagaaa

SEQ ID NO: 904498 - RNA, 19 nt, Homo sapiens
gaagaucaugauggaguuu

SEQ ID NO: 904499 - RNA, 19 nt, Homo sapiens
gugcgcaaguuuguauuga

SEQ ID NO: 904500 - RNA, 19 nt, Homo sapiens
agaagaucaugauggaguu

SEQ ID NO: 904501 - RNA, 19 nt, Homo sapiens
ugccaugggugaugaggaa

SEQ ID NO: 904502 - RNA, 19 nt, Homo sapiens
uggaugagcugggacuuag

SEQ ID NO: 904503 - RNA, 19 nt, Homo sapiens
ggcguuaugugcgcaaguu

SEQ ID NO: 904504 - RNA, 19 nt, Homo sapiens
uggaggaacggcuuaagaa

SEQ ID NO: 904505 - RNA, 19 nt, Homo sapiens
gauaugaaggaggagauga

SEQ ID NO: 904506 - RNA, 19 nt, Homo sapiens
ugaacagacagcugaaguu

SEQ ID NO: 904507 - RNA, 19 nt, Homo sapiens
uagagacccaggagaagaa

SEQ ID NO: 904508 - RNA, 19 nt, Homo sapiens
gaaggaggagaugaugaau

SEQ ID NO: 904509 - RNA, 19 nt, Homo sapiens
gugaugaggaagaugaaga

SEQ ID NO: 904510 - RNA, 19 nt, Homo sapiens
gaugaugccaugggugaug

SEQ ID NO: 904511 - RNA, 19 nt, Homo sapiens
acacucaaguccaacaacu

SEQ ID NO: 904512 - RNA, 19 nt, Homo sapiens
ggaggaacggcuuaagaac

SEQ ID NO: 904513 - RNA, 19 nt, Homo sapiens
gaccuggaggaacggcuua

SEQ ID NO: 904514 - RNA, 19 nt, Homo sapiens
aagaugaagaggagaguga

SEQ ID NO: 904515 - RNA, 19 nt, Homo sapiens
caacaacucgauggcacaa

SEQ ID NO: 904516 - RNA, 19 nt, Homo sapiens
uccagacacucaaguccaa

SEQ ID NO: 904517 - RNA, 19 nt, Homo sapiens
agaucaugauggaguuuga

SEQ ID NO: 904518 - RNA, 19 nt, Homo sapiens
cacaaccccucuguaauaa

SEQ ID NO: 904519 - RNA, 19 nt, Homo sapiens
gaugaagaggagagugaug

SEQ ID NO: 904520 - RNA, 19 nt, Homo sapiens
gagcgacagaaacuagaga

SEQ ID NO: 904521 - RNA, 19 nt, Homo sapiens
caggcugugucccucaaga

SEQ ID NO: 904522 - RNA, 19 nt, Homo sapiens
gcaggcagagaucauggau

SEQ ID NO: 904523 - RNA, 19 nt, Homo sapiens
uaugugcgcaaguuuguau

SEQ ID NO: 904524 - RNA, 19 nt, Homo sapiens
guuaugugcgcaaguuugu

SEQ ID NO: 904525 - RNA, 19 nt, Homo sapiens
gugagcuucuaccaucaug

SEQ ID NO: 904526 - RNA, 19 nt, Homo sapiens
cuagagacccaggagaaga

SEQ ID NO: 904527 - RNA, 19 nt, Homo sapiens
guggaugcccaggaucuuu

SEQ ID NO: 904528 - RNA, 19 nt, Homo sapiens
ggaccgaggggccuuaguu

SEQ ID NO: 904529 - RNA, 19 nt, Homo sapiens
ggauaugaaggaggagaug

SEQ ID NO: 904530 - RNA, 19 nt, Homo sapiens
gaucguagcuuuaaaguuu

SEQ ID NO: 904531 - RNA, 19 nt, Homo sapiens
ggacuuggauaaugacuua

SEQ ID NO: 904532 - RNA, 19 nt, Homo sapiens
gaacauugcuacuaucuga

SEQ ID NO: 904533 - RNA, 19 nt, Homo sapiens
gcaaauggaugggccguua

SEQ ID NO: 904534 - RNA, 19 nt, Homo sapiens
gcagcugucuugugcauua

SEQ ID NO: 904535 - RNA, 19 nt, Homo sapiens
ggaaugaucagcagauaua

SEQ ID NO: 904536 - RNA, 19 nt, Homo sapiens
ccaaguggcucaaugguuu

SEQ ID NO: 904537 - RNA, 19 nt, Homo sapiens
gaacuuggcauuagaauuc

SEQ ID NO: 904538 - RNA, 19 nt, Homo sapiens
uauaugaccugaugccuuu

SEQ ID NO: 904539 - RNA, 19 nt, Homo sapiens
cauagaccuuggcuuauua

SEQ ID NO: 904540 - RNA, 19 nt, Homo sapiens
acagaugcaugcuuuauuu

SEQ ID NO: 904541 - RNA, 19 nt, Homo sapiens
gcacaaagauguugauacc

SEQ ID NO: 904542 - RNA, 19 nt, Homo sapiens
gaaugggacuuggauaaug

SEQ ID NO: 904543 - RNA, 19 nt, Homo sapiens
gaaauuaaccagcuauugg

SEQ ID NO: 904544 - RNA, 19 nt, Homo sapiens
uaagaggugucccuucaaa

SEQ ID NO: 904545 - RNA, 19 nt, Homo sapiens
gcccauagaccuuggcuua

SEQ ID NO: 904546 - RNA, 19 nt, Homo sapiens
gaagacaggcugccauuca

SEQ ID NO: 904547 - RNA, 19 nt, Homo sapiens
guccagaaauucauuguga

SEQ ID NO: 904548 - RNA, 19 nt, Homo sapiens
gaaccugcauguaaaugau

SEQ ID NO: 904549 - RNA, 19 nt, Homo sapiens
gcagcuccuuaaauaauaa

SEQ ID NO: 904550 - RNA, 19 nt, Homo sapiens
ucacacagcucagcaacaa

SEQ ID NO: 904551 - RNA, 19 nt, Homo sapiens
aauaguaacucuccaaauc

SEQ ID NO: 904552 - RNA, 19 nt, Homo sapiens
ccauagaccuuggcuuauu

SEQ ID NO: 904553 - RNA, 19 nt, Homo sapiens
cagcagauauagucuacaa

SEQ ID NO: 904554 - RNA, 19 nt, Homo sapiens
ggaacuauauucacugcau

SEQ ID NO: 904555 - RNA, 19 nt, Homo sapiens
guaagugauucuuucuuug

SEQ ID NO: 904556 - RNA, 19 nt, Homo sapiens
gcucaaugguuuagagaau

SEQ ID NO: 904557 - RNA, 19 nt, Homo sapiens
ucaaagaugugagagagaa

SEQ ID NO: 904558 - RNA, 19 nt, Homo sapiens
ucaggguucuggauauuaa

SEQ ID NO: 904559 - RNA, 19 nt, Homo sapiens
cuacauacauaacuugugu

SEQ ID NO: 904560 - RNA, 19 nt, Homo sapiens
gccauuacccgcuauauga

SEQ ID NO: 904561 - RNA, 19 nt, Homo sapiens
cugagaagguucauguuaa

SEQ ID NO: 904562 - RNA, 19 nt, Homo sapiens
uauauucacugcauguuug

SEQ ID NO: 904563 - RNA, 19 nt, Homo sapiens
aaagauuucucuagacaug

SEQ ID NO: 904564 - RNA, 19 nt, Homo sapiens
auagauggcuguuucaguu

SEQ ID NO: 904565 - RNA, 19 nt, Homo sapiens
gaaauccauugugccauga

SEQ ID NO: 904566 - RNA, 19 nt, Homo sapiens
gcaagcagaacuccuuuau

SEQ ID NO: 904567 - RNA, 19 nt, Homo sapiens
ggaauugguacaugcagua

SEQ ID NO: 904568 - RNA, 19 nt, Homo sapiens
gagccuacauacauaacuu

SEQ ID NO: 904569 - RNA, 19 nt, Homo sapiens
caauggcaaugcacaaaga

SEQ ID NO: 904570 - RNA, 19 nt, Homo sapiens
gauacuaguuauggcuaua

SEQ ID NO: 904571 - RNA, 19 nt, Homo sapiens
gcuggucccuugcggaauu

SEQ ID NO: 904572 - RNA, 19 nt, Homo sapiens
cugugcagcuccuuaaaua

SEQ ID NO: 904573 - RNA, 19 nt, Homo sapiens
ggauaaugacuuaagcuuu

SEQ ID NO: 904574 - RNA, 19 nt, Homo sapiens
uuuggcagcuucaaguuua

SEQ ID NO: 904575 - RNA, 19 nt, Homo sapiens
aagcagaacuccuuuaugc

SEQ ID NO: 904576 - RNA, 19 nt, Homo sapiens
gaucaugguuauucuuugg

SEQ ID NO: 904577 - RNA, 19 nt, Homo sapiens
ucagacgggcuuucaaaua

SEQ ID NO: 904578 - RNA, 19 nt, Homo sapiens
gauuaugacuauggugaaa

SEQ ID NO: 904579 - RNA, 19 nt, Homo sapiens
cauguuaaucugcuucuua

SEQ ID NO: 904580 - RNA, 19 nt, Homo sapiens
ugagaagguucauguuaau

SEQ ID NO: 904581 - RNA, 19 nt, Homo sapiens
gagagaguauguuugucuu

SEQ ID NO: 904582 - RNA, 19 nt, Homo sapiens
ggacagggaccaagcagau

SEQ ID NO: 904583 - RNA, 19 nt, Homo sapiens
uagaauuccucgaccacua

SEQ ID NO: 904584 - RNA, 19 nt, Homo sapiens
ggaagaucaugguuauucu

SEQ ID NO: 904585 - RNA, 19 nt, Homo sapiens
uuagugaaccugcauguaa

SEQ ID NO: 904586 - RNA, 19 nt, Homo sapiens
caucagugcuccuacuuag

SEQ ID NO: 904587 - RNA, 19 nt, Homo sapiens
gcucaucugcuuaugcuuu

SEQ ID NO: 904588 - RNA, 19 nt, Homo sapiens
cagacgggcuuucaaauac

SEQ ID NO: 904589 - RNA, 19 nt, Homo sapiens
gcaaauaguaacucuccaa

SEQ ID NO: 904590 - RNA, 19 nt, Homo sapiens
gaaagaaacaccucaucgu

SEQ ID NO: 904591 - RNA, 19 nt, Homo sapiens
gaagguucauguuaaucug

SEQ ID NO: 904592 - RNA, 19 nt, Homo sapiens
gcacagaugcaugcuuuau

SEQ ID NO: 904593 - RNA, 19 nt, Homo sapiens
uuagucggguuaucaaauu

SEQ ID NO: 904594 - RNA, 19 nt, Homo sapiens
cagcagagauucaacuacu

SEQ ID NO: 904595 - RNA, 19 nt, Homo sapiens
ucuaagaggugucccuuca

SEQ ID NO: 904596 - RNA, 19 nt, Homo sapiens
gggaagaucaugguuauuc

SEQ ID NO: 904597 - RNA, 19 nt, Homo sapiens
uuacaggaaugucgagaug

SEQ ID NO: 904598 - RNA, 19 nt, Homo sapiens
acgcacagaugcaugcuuu

SEQ ID NO: 904599 - RNA, 19 nt, Homo sapiens
ccaggaacuuggcauuaga

SEQ ID NO: 904600 - RNA, 19 nt, Homo sapiens
aaagagagaguauguuugu

SEQ ID NO: 904601 - RNA, 19 nt, Homo sapiens
acaggaaugucgagaugaa

SEQ ID NO: 904602 - RNA, 19 nt, Homo sapiens
uagugaaccugcauguaaa

SEQ ID NO: 904603 - RNA, 19 nt, Homo sapiens
aauaauggcugcggcaaga

SEQ ID NO: 904604 - RNA, 19 nt, Homo sapiens
gcaaagaaugggacuugga

SEQ ID NO: 904605 - RNA, 19 nt, Homo sapiens
gaacuccuuuaugcucuga

SEQ ID NO: 904606 - RNA, 19 nt, Homo sapiens
uaucgucacuacauuggaa

SEQ ID NO: 904607 - RNA, 19 nt, Homo sapiens
aaugggacuuggauaauga

SEQ ID NO: 904608 - RNA, 19 nt, Homo sapiens
caaauaguaacucuccaaa

SEQ ID NO: 904609 - RNA, 19 nt, Homo sapiens
uaucugagccuacauacau

SEQ ID NO: 904610 - RNA, 19 nt, Homo sapiens
uauagaagcuaggaugcaa

SEQ ID NO: 904611 - RNA, 19 nt, Homo sapiens
gcaauuuggaacuauauuc

SEQ ID NO: 904612 - RNA, 19 nt, Homo sapiens
gcugggaagaucaugguua

SEQ ID NO: 904613 - RNA, 19 nt, Homo sapiens
gccaugauuccuuuaguuu

SEQ ID NO: 904614 - RNA, 19 nt, Homo sapiens
gaucagcagauauagucua

SEQ ID NO: 904615 - RNA, 19 nt, Homo sapiens
ucugagaagguucauguua

SEQ ID NO: 904616 - RNA, 19 nt, Homo sapiens
gagaguauguuugucuucu

SEQ ID NO: 904617 - RNA, 19 nt, Homo sapiens
caucagacgggcuuucaaa

SEQ ID NO: 904618 - RNA, 19 nt, Homo sapiens
gguugaagcccucauggaa

SEQ ID NO: 904619 - RNA, 19 nt, Homo sapiens
gcuuugggccguuuggaua

SEQ ID NO: 904620 - RNA, 19 nt, Homo sapiens
gcuacuugcucaucugcuu

SEQ ID NO: 904621 - RNA, 19 nt, Homo sapiens
gcagagauucaacuacuag

SEQ ID NO: 904622 - RNA, 19 nt, Homo sapiens
gugcagcuccuuaaauaau

SEQ ID NO: 904623 - RNA, 19 nt, Homo sapiens
guuuagagcugugaagaca

SEQ ID NO: 904624 - RNA, 19 nt, Homo sapiens
guuaaucugcuucuuauag

SEQ ID NO: 904625 - RNA, 19 nt, Homo sapiens
caagcacucugagaagguu

SEQ ID NO: 904626 - RNA, 19 nt, Homo sapiens
gcaacuacugcaucuguga

SEQ ID NO: 904627 - RNA, 19 nt, Homo sapiens
gaacacauugagggacuuu

SEQ ID NO: 904628 - RNA, 19 nt, Homo sapiens
gaauuuaggagaacuuaac

SEQ ID NO: 904629 - RNA, 19 nt, Homo sapiens
acgcuaacuuuguuugaaa

SEQ ID NO: 904630 - RNA, 19 nt, Homo sapiens
ggacaucuccaacuacaca

SEQ ID NO: 904631 - RNA, 19 nt, Homo sapiens
gcaagggcacagccuauug

SEQ ID NO: 904632 - RNA, 19 nt, Homo sapiens
uggagaaacugaugaugga

SEQ ID NO: 904633 - RNA, 19 nt, Homo sapiens
caucugggcuucccgacau

SEQ ID NO: 904634 - RNA, 19 nt, Homo sapiens
cgacaaggagccacuggaa

SEQ ID NO: 904635 - RNA, 19 nt, Homo sapiens
acaaggagccacuggaaau

SEQ ID NO: 904636 - RNA, 19 nt, Homo sapiens
cuacagguacccaggcuuu

SEQ ID NO: 904637 - RNA, 19 nt, Homo sapiens
gacaaggagccacuggaaa

SEQ ID NO: 904638 - RNA, 19 nt, Homo sapiens
caacagcgaggccucaagu

SEQ ID NO: 904639 - RNA, 19 nt, Homo sapiens
aaccagcaauuguaaauac

SEQ ID NO: 904640 - RNA, 19 nt, Homo sapiens
cgacagcacccaguucaau

SEQ ID NO: 904641 - RNA, 19 nt, Homo sapiens
cgacuggaccgcgagguuu

SEQ ID NO: 904642 - RNA, 19 nt, Homo sapiens
ggacuggaacgaggcauca

SEQ ID NO: 904643 - RNA, 19 nt, Homo sapiens
ggacacauucaccgucaca

SEQ ID NO: 904644 - RNA, 19 nt, Homo sapiens
caaggagccacuggaaaug

SEQ ID NO: 904645 - RNA, 19 nt, Homo sapiens
ggccaaagccaaguucauc

SEQ ID NO: 904646 - RNA, 19 nt, Homo sapiens
ugucaccacugcccucaca

SEQ ID NO: 904647 - RNA, 19 nt, Homo sapiens
ccaacuacacaccgcagaa

SEQ ID NO: 904648 - RNA, 19 nt, Homo sapiens
uauggcugcccacuccuua

SEQ ID NO: 904649 - RNA, 19 nt, Homo sapiens
gccuuccgauggcaccuuu

SEQ ID NO: 904650 - RNA, 19 nt, Homo sapiens
cagcgaggccucaaguagu

SEQ ID NO: 904651 - RNA, 19 nt, Homo sapiens
gacagcacccaguucaauc

SEQ ID NO: 904652 - RNA, 19 nt, Homo sapiens
caagggcacagccuauugg

SEQ ID NO: 904653 - RNA, 19 nt, Homo sapiens
ccaacgugauccuggacau

SEQ ID NO: 904654 - RNA, 19 nt, Homo sapiens
guucgaggccucacaucug

SEQ ID NO: 904655 - RNA, 19 nt, Homo sapiens
gaaaaccaacgccaagauc

SEQ ID NO: 904656 - RNA, 19 nt, Homo sapiens
ccagcaauuguaaauacuu

SEQ ID NO: 904657 - RNA, 19 nt, Homo sapiens
caacuacacaccgcagaag

SEQ ID NO: 904658 - RNA, 19 nt, Homo sapiens
cagggcugcuggcugacuu

SEQ ID NO: 904659 - RNA, 19 nt, Homo sapiens
agcgaggccucaaguagug

SEQ ID NO: 904660 - RNA, 19 nt, Homo sapiens
ggaaacaccuucaggagaa

SEQ ID NO: 904661 - RNA, 19 nt, Homo sapiens
ugaagaagaugaugaaguu

SEQ ID NO: 904662 - RNA, 19 nt, Homo sapiens
ccagugagauacauguuua

SEQ ID NO: 904663 - RNA, 19 nt, Homo sapiens
cugaggaacuugaagauua

SEQ ID NO: 904664 - RNA, 19 nt, Homo sapiens
gaaguuguggcaaugauua

SEQ ID NO: 904665 - RNA, 19 nt, Homo sapiens
uagaacagguuauggauga

SEQ ID NO: 904666 - RNA, 19 nt, Homo sapiens
ugaggaacuugaagauuaa

SEQ ID NO: 904667 - RNA, 19 nt, Homo sapiens
aagaauccauacaccauua

SEQ ID NO: 904668 - RNA, 19 nt, Homo sapiens
gaaaccagauauuuaugca

SEQ ID NO: 904669 - RNA, 19 nt, Homo sapiens
gaccagauuucaucacugu

SEQ ID NO: 904670 - RNA, 19 nt, Homo sapiens
agacuggaauuuacugaaa

SEQ ID NO: 904671 - RNA, 19 nt, Homo sapiens
ggagguagaaggcguagaa

SEQ ID NO: 904672 - RNA, 19 nt, Homo sapiens
caacaaucauggacuucuu

SEQ ID NO: 904673 - RNA, 19 nt, Homo sapiens
cgaggcggguucugucaua

SEQ ID NO: 904674 - RNA, 19 nt, Homo sapiens
gcuaggcaguuauuuagga

SEQ ID NO: 904675 - RNA, 19 nt, Homo sapiens
agacaaggaccauggauuu

SEQ ID NO: 904676 - RNA, 19 nt, Homo sapiens
gaagaauccauacaccauu

SEQ ID NO: 904677 - RNA, 19 nt, Homo sapiens
ugcccuaguucaaucauua

SEQ ID NO: 904678 - RNA, 19 nt, Homo sapiens
uggcaaugauuaaggaauu

SEQ ID NO: 904679 - RNA, 19 nt, Homo sapiens
agaaacagccucugcauca

SEQ ID NO: 904680 - RNA, 19 nt, Homo sapiens
ugucauauguugaagaauc

SEQ ID NO: 904681 - RNA, 19 nt, Homo sapiens
gcaguuauuuaggauugaa

SEQ ID NO: 904682 - RNA, 19 nt, Homo sapiens
ggccaacugugcaggaaga

SEQ ID NO: 904683 - RNA, 19 nt, Homo sapiens
gaagcaggaucugaagaag

SEQ ID NO: 904684 - RNA, 19 nt, Homo sapiens
uguaccagcugcccuaguu

SEQ ID NO: 904685 - RNA, 19 nt, Homo sapiens
cuuugaagauggcauugua

SEQ ID NO: 904686 - RNA, 19 nt, Homo sapiens
cauacaccauuaagaaaca

SEQ ID NO: 904687 - RNA, 19 nt, Homo sapiens
gaaggcguagaacagguua

SEQ ID NO: 904688 - RNA, 19 nt, Homo sapiens
ccagauauuuaugcaacaa

SEQ ID NO: 904689 - RNA, 19 nt, Homo sapiens
gagacaaggaccauggauu

SEQ ID NO: 904690 - RNA, 19 nt, Homo sapiens
uuaauaugcugaggaacuu

SEQ ID NO: 904691 - RNA, 19 nt, Homo sapiens
agaacaugcugcaguuuua

SEQ ID NO: 904692 - RNA, 19 nt, Homo sapiens
cccacuaccugcagccuuu

SEQ ID NO: 904693 - RNA, 19 nt, Homo sapiens
gaacagguuauggaugaug

SEQ ID NO: 904694 - RNA, 19 nt, Homo sapiens
ucugucauauguugaagaa

SEQ ID NO: 904695 - RNA, 19 nt, Homo sapiens
agaagaugaugaaguugug

SEQ ID NO: 904696 - RNA, 19 nt, Homo sapiens
ccaaauccaaacagcuuaa

SEQ ID NO: 904697 - RNA, 19 nt, Homo sapiens
gaaacagccucugcaucag

SEQ ID NO: 904698 - RNA, 19 nt, Homo sapiens
cagcugcccuaguucaauc

SEQ ID NO: 904699 - RNA, 19 nt, Homo sapiens
ggaauuguuagauacuaga

SEQ ID NO: 904700 - RNA, 19 nt, Homo sapiens
cggguucugucauauguug

SEQ ID NO: 904701 - RNA, 19 nt, Homo sapiens
uuucaucacugucacaaag

SEQ ID NO: 904702 - RNA, 19 nt, Homo sapiens
cuaguucaaucauuacucu

SEQ ID NO: 904703 - RNA, 19 nt, Homo sapiens
agaagcaggaucugaagaa

SEQ ID NO: 904704 - RNA, 19 nt, Homo sapiens
ggcggguucugucauaugu

SEQ ID NO: 904705 - RNA, 19 nt, Homo sapiens
aggcaguuauuuaggauug

SEQ ID NO: 904706 - RNA, 19 nt, Homo sapiens
gguagaaggcguagaacag

SEQ ID NO: 904707 - RNA, 19 nt, Homo sapiens
gagaagcaggaucugaaga

SEQ ID NO: 904708 - RNA, 19 nt, Homo sapiens
caagauaccccaaauccaa

SEQ ID NO: 904709 - RNA, 19 nt, Homo sapiens
gaaacuccaggguucuugu

SEQ ID NO: 904710 - RNA, 19 nt, Homo sapiens
gaagaagaugaugaaguug

SEQ ID NO: 904711 - RNA, 19 nt, Homo sapiens
gaagauggaggggauguaa

SEQ ID NO: 904712 - RNA, 19 nt, Homo sapiens
ggagaagcaggaucugaag

SEQ ID NO: 904713 - RNA, 19 nt, Homo sapiens
gcguagaacagguuaugga

SEQ ID NO: 904714 - RNA, 19 nt, Homo sapiens
ugaugaaguuguggcaaug

SEQ ID NO: 904715 - RNA, 19 nt, Homo sapiens
ugaagaauccauacaccau

SEQ ID NO: 904716 - RNA, 19 nt, Homo sapiens
gcugaggaacuugaagauu

SEQ ID NO: 904717 - RNA, 19 nt, Homo sapiens
gaggcggguucugucauau

SEQ ID NO: 904718 - RNA, 19 nt, Homo sapiens
aaauggaauucagaacaug

SEQ ID NO: 904719 - RNA, 19 nt, Homo sapiens
ccagauuucaucacuguca

SEQ ID NO: 904720 - RNA, 19 nt, Homo sapiens
gaugaaguuguggcaauga

SEQ ID NO: 904721 - RNA, 19 nt, Homo sapiens
cuucuuugcaucuggcuua

SEQ ID NO: 904722 - RNA, 19 nt, Homo sapiens
gugagauacauguuuauuc

SEQ ID NO: 904723 - RNA, 19 nt, Homo sapiens
aaacuccaggguucuugua

SEQ ID NO: 904724 - RNA, 19 nt, Homo sapiens
caaauccaaacagcuuaaa

SEQ ID NO: 904725 - RNA, 19 nt, Homo sapiens
uaagaaacagccucugcau

SEQ ID NO: 904726 - RNA, 19 nt, Homo sapiens
ggaaaaccaguucuugaga

SEQ ID NO: 904727 - RNA, 19 nt, Homo sapiens
aacagguuauggaugauga

SEQ ID NO: 904728 - RNA, 19 nt, Homo sapiens
ucaucacugucacaaagga

SEQ ID NO: 904729 - RNA, 19 nt, Homo sapiens
cuggcuaggcaguuauuua

SEQ ID NO: 904730 - RNA, 19 nt, Homo sapiens
aacagccucugcaucaguu

SEQ ID NO: 904731 - RNA, 19 nt, Homo sapiens
gcaacaaucauggacuucu

SEQ ID NO: 904732 - RNA, 19 nt, Homo sapiens
gaauuuacugaaaccagau

SEQ ID NO: 904733 - RNA, 19 nt, Homo sapiens
uucagaacaugcugcaguu

SEQ ID NO: 904734 - RNA, 19 nt, Homo sapiens
gacuggaauuuacugaaac

SEQ ID NO: 904735 - RNA, 19 nt, Homo sapiens
augaagaauuagacuggaa

SEQ ID NO: 904736 - RNA, 19 nt, Homo sapiens
cuaggcaguuauuuaggau

SEQ ID NO: 904737 - RNA, 19 nt, Homo sapiens
caccccagcugcagcauuu

SEQ ID NO: 904738 - RNA, 19 nt, Homo sapiens
ugaaguuguggcaaugauu

SEQ ID NO: 904739 - RNA, 19 nt, Homo sapiens
aagaagaugaugaaguugu

SEQ ID NO: 904740 - RNA, 19 nt, Homo sapiens
aaucauggacuucuuugca

SEQ ID NO: 904741 - RNA, 19 nt, Homo sapiens
uggcuaggcaguuauuuag

SEQ ID NO: 904742 - RNA, 19 nt, Homo sapiens
aaacagccucugcaucagu

SEQ ID NO: 904743 - RNA, 19 nt, Homo sapiens
aggagaagcaggaucugaa

SEQ ID NO: 904744 - RNA, 19 nt, Homo sapiens
aauccaaacagcuuaaagu

SEQ ID NO: 904745 - RNA, 19 nt, Homo sapiens
augcaacaaucauggacuu

SEQ ID NO: 904746 - RNA, 19 nt, Homo sapiens
ugaagaauuagacuggaau

SEQ ID NO: 904747 - RNA, 19 nt, Homo sapiens
ggcaguuauuuaggauuga

SEQ ID NO: 904748 - RNA, 19 nt, Homo sapiens
augaugaaguuguggcaau

SEQ ID NO: 904749 - RNA, 19 nt, Homo sapiens
gaaagaaacuggucagaaa

SEQ ID NO: 904750 - RNA, 19 nt, Homo sapiens
guaaguagcuaaugaagua

SEQ ID NO: 904751 - RNA, 19 nt, Homo sapiens
caaaugagauucccacuaa

SEQ ID NO: 904752 - RNA, 19 nt, Homo sapiens
gcaaacauguacaucaaua

SEQ ID NO: 904753 - RNA, 19 nt, Homo sapiens
guacuugccuacuguaaua

SEQ ID NO: 904754 - RNA, 19 nt, Homo sapiens
ggacaaggauagugggaaa

SEQ ID NO: 904755 - RNA, 19 nt, Homo sapiens
caacugcucucugcaagua

SEQ ID NO: 904756 - RNA, 19 nt, Homo sapiens
guacauaugucauccugaa

SEQ ID NO: 904757 - RNA, 19 nt, Homo sapiens
gagcaucuccugugaauga

SEQ ID NO: 904758 - RNA, 19 nt, Homo sapiens
gcaguaccaugaagagaaa

SEQ ID NO: 904759 - RNA, 19 nt, Homo sapiens
ucagaaugguuuacucuaa

SEQ ID NO: 904760 - RNA, 19 nt, Homo sapiens
ggaauauguuggccaagaa

SEQ ID NO: 904761 - RNA, 19 nt, Homo sapiens
caugacaacugcacauaaa

SEQ ID NO: 904762 - RNA, 19 nt, Homo sapiens
gagccacuauuuaaacaaa

SEQ ID NO: 904763 - RNA, 19 nt, Homo sapiens
ggaaauaugaauucugcua

SEQ ID NO: 904764 - RNA, 19 nt, Homo sapiens
gcagucauccuaaauauag

SEQ ID NO: 904765 - RNA, 19 nt, Homo sapiens
uauaauagguugcuucucu

SEQ ID NO: 904766 - RNA, 19 nt, Homo sapiens
gaaguaaagaucaugaaga

SEQ ID NO: 904767 - RNA, 19 nt, Homo sapiens
uaaaugagagaccauguaa

SEQ ID NO: 904768 - RNA, 19 nt, Homo sapiens
caacccacauauccaaauu

SEQ ID NO: 904769 - RNA, 19 nt, Homo sapiens
uaaaggcccuaauccaaga

SEQ ID NO: 904770 - RNA, 19 nt, Homo sapiens
ggacauggaaccaagaaga

SEQ ID NO: 904771 - RNA, 19 nt, Homo sapiens
guaaagaucaugaagaaag

SEQ ID NO: 904772 - RNA, 19 nt, Homo sapiens
gaauacugcuagagcuuau

SEQ ID NO: 904773 - RNA, 19 nt, Homo sapiens
gggaauauguuggccaaga

SEQ ID NO: 904774 - RNA, 19 nt, Homo sapiens
ccuacagaauugagucuua

SEQ ID NO: 904775 - RNA, 19 nt, Homo sapiens
gaaccaagaagagcauauu

SEQ ID NO: 904776 - RNA, 19 nt, Homo sapiens
gaaaacacauucggcagua

SEQ ID NO: 904777 - RNA, 19 nt, Homo sapiens
guaaaugagagaccaugua

SEQ ID NO: 904778 - RNA, 19 nt, Homo sapiens
ggacaacccacauauccaa

SEQ ID NO: 904779 - RNA, 19 nt, Homo sapiens
gagccucacuccugucaau

SEQ ID NO: 904780 - RNA, 19 nt, Homo sapiens
ccucacuccugucaauaua

SEQ ID NO: 904781 - RNA, 19 nt, Homo sapiens
ugauauaacugacaaacca

SEQ ID NO: 904782 - RNA, 19 nt, Homo sapiens
ucaggauggugucacauuu

SEQ ID NO: 904783 - RNA, 19 nt, Homo sapiens
ccaagaagagcauauugaa

SEQ ID NO: 904784 - RNA, 19 nt, Homo sapiens
ccacauauccaaauugaca

SEQ ID NO: 904785 - RNA, 19 nt, Homo sapiens
ucacuccugucaauauauu

SEQ ID NO: 904786 - RNA, 19 nt, Homo sapiens
gccaggaucuccauuuaag

SEQ ID NO: 904787 - RNA, 19 nt, Homo sapiens
cagagcaucuccugugaau

SEQ ID NO: 904788 - RNA, 19 nt, Homo sapiens
gugcagucauccuaaauau

SEQ ID NO: 904789 - RNA, 19 nt, Homo sapiens
uaucugauguagacaguug

SEQ ID NO: 904790 - RNA, 19 nt, Homo sapiens
gaagaaagaaauugauagg

SEQ ID NO: 904791 - RNA, 19 nt, Homo sapiens
aagaagagcauauugaaug

SEQ ID NO: 904792 - RNA, 19 nt, Homo sapiens
aaauauagguucagagcau

SEQ ID NO: 904793 - RNA, 19 nt, Homo sapiens
caaagcaguuguuccuaca

SEQ ID NO: 904794 - RNA, 19 nt, Homo sapiens
ucuaguaccugaaauccuu

SEQ ID NO: 904795 - RNA, 19 nt, Homo sapiens
caacuaaagaagagagauu

SEQ ID NO: 904796 - RNA, 19 nt, Homo sapiens
uaagaagaauacugcuaga

SEQ ID NO: 904797 - RNA, 19 nt, Homo sapiens
ggagaaauaaagaggaaga

SEQ ID NO: 904798 - RNA, 19 nt, Homo sapiens
gagagaccauguaaaauau

SEQ ID NO: 904799 - RNA, 19 nt, Homo sapiens
gguugaaucuccagugauc

SEQ ID NO: 904800 - RNA, 19 nt, Homo sapiens
uaggagaaauaaagaggaa

SEQ ID NO: 904801 - RNA, 19 nt, Homo sapiens
ggagcagcaggaagaaaua

SEQ ID NO: 904802 - RNA, 19 nt, Homo sapiens
cugccaggaucuccauuua

SEQ ID NO: 904803 - RNA, 19 nt, Homo sapiens
cgaaguaugucauggaaaa

SEQ ID NO: 904804 - RNA, 19 nt, Homo sapiens
cauuggaccucuucuaaag

SEQ ID NO: 904805 - RNA, 19 nt, Homo sapiens
uggcaaacauguacaucaa

SEQ ID NO: 904806 - RNA, 19 nt, Homo sapiens
gaacgagaagcagaagaaa

SEQ ID NO: 904807 - RNA, 19 nt, Homo sapiens
uauaaaggcccuaauccaa

SEQ ID NO: 904808 - RNA, 19 nt, Homo sapiens
gccauuggaccucuucuaa

SEQ ID NO: 904809 - RNA, 19 nt, Homo sapiens
ggaaagaaaagaucauuga

SEQ ID NO: 904810 - RNA, 19 nt, Homo sapiens
ugaaugggcuaagaagaau

SEQ ID NO: 904811 - RNA, 19 nt, Homo sapiens
caaauugacagaugaccaa

SEQ ID NO: 904812 - RNA, 19 nt, Homo sapiens
uauccaaauugacagauga

SEQ ID NO: 904813 - RNA, 19 nt, Homo sapiens
gcagcaggaagaaauacua

SEQ ID NO: 904814 - RNA, 19 nt, Homo sapiens
gucccacugugucucauua

SEQ ID NO: 904815 - RNA, 19 nt, Homo sapiens
uaugucauccugaaucuaa

SEQ ID NO: 904816 - RNA, 19 nt, Homo sapiens
agaauugagucuuauugga

SEQ ID NO: 904817 - RNA, 19 nt, Homo sapiens
cauauugaaugggcuaaga

SEQ ID NO: 904818 - RNA, 19 nt, Homo sapiens
acaagucgauugcuauugg

SEQ ID NO: 904819 - RNA, 19 nt, Homo sapiens
cuacagaauugagucuuau

SEQ ID NO: 904820 - RNA, 19 nt, Homo sapiens
ugagagaccauguaaaaua

SEQ ID NO: 904821 - RNA, 19 nt, Homo sapiens
aaucuccagugaucuguaa

SEQ ID NO: 904822 - RNA, 19 nt, Homo sapiens
gcuaagaagaauacugcua

SEQ ID NO: 904823 - RNA, 19 nt, Homo sapiens
gcuaaugaaguaaagauca

SEQ ID NO: 904824 - RNA, 19 nt, Homo sapiens
gacaacugcacauaaagaa

SEQ ID NO: 904825 - RNA, 19 nt, Homo sapiens
ugacaacugcacauaaaga

SEQ ID NO: 904826 - RNA, 19 nt, Homo sapiens
gaugguacccagacaguca

SEQ ID NO: 904827 - RNA, 19 nt, Homo sapiens
ucagaugacaccauacuau

SEQ ID NO: 904828 - RNA, 19 nt, Homo sapiens
gaguaucuaucugauguag

SEQ ID NO: 904829 - RNA, 19 nt, Homo sapiens
caagaagagcauauugaau

SEQ ID NO: 904830 - RNA, 19 nt, Homo sapiens
ccacaagucgauugcuauu

SEQ ID NO: 904831 - RNA, 19 nt, Homo sapiens
ccagugaucuguaaaaucu

SEQ ID NO: 904832 - RNA, 19 nt, Homo sapiens
ugcuagagcuuaucaucuu

SEQ ID NO: 904833 - RNA, 19 nt, Homo sapiens
ucaaaugagauucccacua

SEQ ID NO: 904834 - RNA, 19 nt, Homo sapiens
guacuaccuugggaauaug

SEQ ID NO: 904835 - RNA, 19 nt, Homo sapiens
gaaacuggucagaaaauaa

SEQ ID NO: 904836 - RNA, 19 nt, Homo sapiens
guaauauggauuucacuuc

SEQ ID NO: 904837 - RNA, 19 nt, Homo sapiens
gaaaagaucauugaaaguc

SEQ ID NO: 904838 - RNA, 19 nt, Homo sapiens
gggaaaugguacaccuugu

SEQ ID NO: 904839 - RNA, 19 nt, Homo sapiens
aaacugggcacaugguaga

SEQ ID NO: 904840 - RNA, 19 nt, Homo sapiens
cccacugugucucauuaua

SEQ ID NO: 904841 - RNA, 19 nt, Homo sapiens
gcuagagcuuaucaucuuc

SEQ ID NO: 904842 - RNA, 19 nt, Homo sapiens
gaaugggcuaagaagaaua

SEQ ID NO: 904843 - RNA, 19 nt, Homo sapiens
ugaauucugcuauggcaaa

SEQ ID NO: 904844 - RNA, 19 nt, Homo sapiens
gcaggaagaaauacuaagg

SEQ ID NO: 904845 - RNA, 19 nt, Homo sapiens
cagcaggaagaaauacuaa

SEQ ID NO: 904846 - RNA, 19 nt, Homo sapiens
aguacuaccuugggaauau

SEQ ID NO: 904847 - RNA, 19 nt, Homo sapiens
ggcaguaccaugaagagaa

SEQ ID NO: 904848 - RNA, 19 nt, Homo sapiens
cagaaugguuuacucuaac

SEQ ID NO: 904849 - RNA, 19 nt, Homo sapiens
gcagaaauauccauucauu

SEQ ID NO: 904850 - RNA, 19 nt, Homo sapiens
gggaguaucuucacuaaug

SEQ ID NO: 904851 - RNA, 19 nt, Homo sapiens
gaacauagguuuugauugu

SEQ ID NO: 904852 - RNA, 19 nt, Homo sapiens
gguaugaucugcuauuguu

SEQ ID NO: 904853 - RNA, 19 nt, Homo sapiens
gaacacauccacauuguau

SEQ ID NO: 904854 - RNA, 19 nt, Homo sapiens
gcagaaacuuacuuugaaa

SEQ ID NO: 904855 - RNA, 19 nt, Homo sapiens
gaugaacgcuaccgacauu

SEQ ID NO: 904856 - RNA, 19 nt, Homo sapiens
gaaauuaacagugcagaaa

SEQ ID NO: 904857 - RNA, 19 nt, Homo sapiens
gaaccuuuaucaagugaaa

SEQ ID NO: 904858 - RNA, 19 nt, Homo sapiens
uauaaacacugucagacua

SEQ ID NO: 904859 - RNA, 19 nt, Homo sapiens
gaaauuagcagaaauaucc

SEQ ID NO: 904860 - RNA, 19 nt, Homo sapiens
agaaguagcuaauggcaaa

SEQ ID NO: 904861 - RNA, 19 nt, Homo sapiens
acaaacauguccagaauug

SEQ ID NO: 904862 - RNA, 19 nt, Homo sapiens
ccagauauaugcucucgaa

SEQ ID NO: 904863 - RNA, 19 nt, Homo sapiens
gaucugcuauuguuauuuc

SEQ ID NO: 904864 - RNA, 19 nt, Homo sapiens
gaaauuugcuaugcucuuc

SEQ ID NO: 904865 - RNA, 19 nt, Homo sapiens
gugaagaaguagaaauuga

SEQ ID NO: 904866 - RNA, 19 nt, Homo sapiens
gcagaaccuuuaucaagug

SEQ ID NO: 904867 - RNA, 19 nt, Homo sapiens
ggauuuugcucuuuaguua

SEQ ID NO: 904868 - RNA, 19 nt, Homo sapiens
gcuaauggcaaacuaauga

SEQ ID NO: 904869 - RNA, 19 nt, Homo sapiens
agaaugauaugacuguuug

SEQ ID NO: 904870 - RNA, 19 nt, Homo sapiens
cagcggagauggccaaugu

SEQ ID NO: 904871 - RNA, 19 nt, Homo sapiens
gagaagugcucuuagaaaa

SEQ ID NO: 904872 - RNA, 19 nt, Homo sapiens
gaauacacguugaacacau

SEQ ID NO: 904873 - RNA, 19 nt, Homo sapiens
cagaguagagugugcaaua

SEQ ID NO: 904874 - RNA, 19 nt, Homo sapiens
gaccuuggaugcuguaaag

SEQ ID NO: 904875 - RNA, 19 nt, Homo sapiens
caucaauggugcuaaggaa

SEQ ID NO: 904876 - RNA, 19 nt, Homo sapiens
gagugaagaaguagaaauu

SEQ ID NO: 904877 - RNA, 19 nt, Homo sapiens
auacaaacauguccagaau

SEQ ID NO: 904878 - RNA, 19 nt, Homo sapiens
gauauaugcucucgaacag

SEQ ID NO: 904879 - RNA, 19 nt, Homo sapiens
uauaggaugugguaauuag

SEQ ID NO: 904880 - RNA, 19 nt, Homo sapiens
uagcagaaauauccauuca

SEQ ID NO: 904881 - RNA, 19 nt, Homo sapiens
guaaagugauucgucauag

SEQ ID NO: 904882 - RNA, 19 nt, Homo sapiens
uuauugggcugacuuuauu

SEQ ID NO: 904883 - RNA, 19 nt, Homo sapiens
gugcagaaacuuacuuuga

SEQ ID NO: 904884 - RNA, 19 nt, Homo sapiens
gaacaguguggccugauga

SEQ ID NO: 904885 - RNA, 19 nt, Homo sapiens
ugaaagacaugaguuugug

SEQ ID NO: 904886 - RNA, 19 nt, Homo sapiens
agaaaagccugguucauaa

SEQ ID NO: 904887 - RNA, 19 nt, Homo sapiens
gaaacuaugggacccuuug

SEQ ID NO: 904888 - RNA, 19 nt, Homo sapiens
ggagauggccaaugugcuu

SEQ ID NO: 904889 - RNA, 19 nt, Homo sapiens
uagggaguaucuucacuaa

SEQ ID NO: 904890 - RNA, 19 nt, Homo sapiens
ugcagaaacuuacuuugaa

SEQ ID NO: 904891 - RNA, 19 nt, Homo sapiens
ggcaagugauuugggauuu

SEQ ID NO: 904892 - RNA, 19 nt, Homo sapiens
gcuguacuauuuguaugua

SEQ ID NO: 904893 - RNA, 19 nt, Homo sapiens
cauuuaggauucucuguug

SEQ ID NO: 904894 - RNA, 19 nt, Homo sapiens
cuaaugauucugacuguaa

SEQ ID NO: 904895 - RNA, 19 nt, Homo sapiens
acaccagacagccauauua

SEQ ID NO: 904896 - RNA, 19 nt, Homo sapiens
uggccaaugugcuuuguaa

SEQ ID NO: 904897 - RNA, 19 nt, Homo sapiens
cuaccgacauuuaggauuc

SEQ ID NO: 904898 - RNA, 19 nt, Homo sapiens
caauggugcuaaggaaauu

SEQ ID NO: 904899 - RNA, 19 nt, Homo sapiens
uguauaggaugugguaauu

SEQ ID NO: 904900 - RNA, 19 nt, Homo sapiens
guggaaauuagcagaaaua

SEQ ID NO: 904901 - RNA, 19 nt, Homo sapiens
gaaagacaugaguuuguga

SEQ ID NO: 904902 - RNA, 19 nt, Homo sapiens
uaaagugauucgucauagu

SEQ ID NO: 904903 - RNA, 19 nt, Homo sapiens
ugaacgcuaccgacauuua

SEQ ID NO: 904904 - RNA, 19 nt, Homo sapiens
gguggugacugaaauaacu

SEQ ID NO: 904905 - RNA, 19 nt, Homo sapiens
caagugauuugggauuuua

SEQ ID NO: 904906 - RNA, 19 nt, Homo sapiens
caacauuggcaagugauuu

SEQ ID NO: 904907 - RNA, 19 nt, Homo sapiens
ccauucauuugcuguacua

SEQ ID NO: 904908 - RNA, 19 nt, Homo sapiens
gaacgcuaccgacauuuag

SEQ ID NO: 904909 - RNA, 19 nt, Homo sapiens
guaaugaugcaccuguuga

SEQ ID NO: 904910 - RNA, 19 nt, Homo sapiens
uagcagaaccuuuaucaag

SEQ ID NO: 904911 - RNA, 19 nt, Homo sapiens
caaugugcuuuguaacaga

SEQ ID NO: 904912 - RNA, 19 nt, Homo sapiens
gauucugacuguaacacaa

SEQ ID NO: 904913 - RNA, 19 nt, Homo sapiens
gaaucacuguuuccagaag

SEQ ID NO: 904914 - RNA, 19 nt, Homo sapiens
ggguacccauguaguugua

SEQ ID NO: 904915 - RNA, 19 nt, Homo sapiens
uaaacacugucagacuaaa

SEQ ID NO: 904916 - RNA, 19 nt, Homo sapiens
guccagaauugcugcgaaa

SEQ ID NO: 904917 - RNA, 19 nt, Homo sapiens
uaucuucacuaaugcaaca

SEQ ID NO: 904918 - RNA, 19 nt, Homo sapiens
guagggaguaucuucacua

SEQ ID NO: 904919 - RNA, 19 nt, Homo sapiens
guuauugggcugacuuuau

SEQ ID NO: 904920 - RNA, 19 nt, Homo sapiens
ggaaauuugcuaugcucuu

SEQ ID NO: 904921 - RNA, 19 nt, Homo sapiens
gaagugcucuuagaaaagu

SEQ ID NO: 904922 - RNA, 19 nt, Homo sapiens
gaauuucaggguaaugaug

SEQ ID NO: 904923 - RNA, 19 nt, Homo sapiens
cgaacaguguggccugaug

SEQ ID NO: 904924 - RNA, 19 nt, Homo sapiens
guauaggaugugguaauua

SEQ ID NO: 904925 - RNA, 19 nt, Homo sapiens
ggaaauuagcagaaauauc

SEQ ID NO: 904926 - RNA, 19 nt, Homo sapiens
cagaaccuuuaucaaguga

SEQ ID NO: 904927 - RNA, 19 nt, Homo sapiens
guugaucuauaaacacugu

SEQ ID NO: 904928 - RNA, 19 nt, Homo sapiens
cuuggaugcuguaaaguga

SEQ ID NO: 904929 - RNA, 19 nt, Homo sapiens
gaaagugccagaguagagu

SEQ ID NO: 904930 - RNA, 19 nt, Homo sapiens
ugugguaauuagcuuguaa

SEQ ID NO: 904931 - RNA, 19 nt, Homo sapiens
uguaaagugauucgucaua

SEQ ID NO: 904932 - RNA, 19 nt, Homo sapiens
cuaaggaaauuugcuaugc

SEQ ID NO: 904933 - RNA, 19 nt, Homo sapiens
ggagugaagaaguagaaau

SEQ ID NO: 904934 - RNA, 19 nt, Homo sapiens
ggcaaacuaaugauucuga

SEQ ID NO: 904935 - RNA, 19 nt, Homo sapiens
gcaagugauuugggauuuu

SEQ ID NO: 904936 - RNA, 19 nt, Homo sapiens
cagcauuuaugaauuugca

SEQ ID NO: 904937 - RNA, 19 nt, Homo sapiens
ccaaugugcuuuguaacag

SEQ ID NO: 904938 - RNA, 19 nt, Homo sapiens
guucaucaauggugcuaag

SEQ ID NO: 904939 - RNA, 19 nt, Homo sapiens
uguuuggagugaagaagua

SEQ ID NO: 904940 - RNA, 19 nt, Homo sapiens
guagcuaauggcaaacuaa

SEQ ID NO: 904941 - RNA, 19 nt, Homo sapiens
guugaacacauccacauug

SEQ ID NO: 904942 - RNA, 19 nt, Homo sapiens
ggaguaucuucacuaaugc

SEQ ID NO: 904943 - RNA, 19 nt, Homo sapiens
ugggacagcuggagacagu

SEQ ID NO: 904944 - RNA, 19 nt, Homo sapiens
gugaaagacaugaguuugu

SEQ ID NO: 904945 - RNA, 19 nt, Homo sapiens
caagugaaagacaugaguu

SEQ ID NO: 904946 - RNA, 19 nt, Homo sapiens
guagagugugcaauacaaa

SEQ ID NO: 904947 - RNA, 19 nt, Homo sapiens
uaacagugcagaaacuuac

SEQ ID NO: 904948 - RNA, 19 nt, Homo sapiens
gccaaugugcuuuguaaca

SEQ ID NO: 904949 - RNA, 19 nt, Homo sapiens
caucuaagcuucuuucuga

SEQ ID NO: 904950 - RNA, 19 nt, Homo sapiens
ccagagagcuacugaauau

SEQ ID NO: 904951 - RNA, 19 nt, Homo sapiens
caaaggaacuguagauugu

SEQ ID NO: 904952 - RNA, 19 nt, Homo sapiens
gaaaagagguuaugagaga

SEQ ID NO: 904953 - RNA, 19 nt, Homo sapiens
ugaaagaucuaccugaauu

SEQ ID NO: 904954 - RNA, 19 nt, Homo sapiens
guaagugccauguuuauua

SEQ ID NO: 904955 - RNA, 19 nt, Homo sapiens
ugaaagauccuaacuauga

SEQ ID NO: 904956 - RNA, 19 nt, Homo sapiens
gagcagauacugaauguaa

SEQ ID NO: 904957 - RNA, 19 nt, Homo sapiens
ggagaacuguguuuaugaa

SEQ ID NO: 904958 - RNA, 19 nt, Homo sapiens
ucaaucaccuuguuaaaga

SEQ ID NO: 904959 - RNA, 19 nt, Homo sapiens
gcggaaauguuaagagauu

SEQ ID NO: 904960 - RNA, 19 nt, Homo sapiens
ggagauggaggucgucuua

SEQ ID NO: 904961 - RNA, 19 nt, Homo sapiens
agacauaucugaagcugaa

SEQ ID NO: 904962 - RNA, 19 nt, Homo sapiens
gagaagacuuuaacaccaa

SEQ ID NO: 904963 - RNA, 19 nt, Homo sapiens
ggagaaaguacauuuaaga

SEQ ID NO: 904964 - RNA, 19 nt, Homo sapiens
gaaagaucuaccugaauua

SEQ ID NO: 904965 - RNA, 19 nt, Homo sapiens
gaaagggcauuugagaaga

SEQ ID NO: 904966 - RNA, 19 nt, Homo sapiens
gcauggagauacuaaugaa

SEQ ID NO: 904967 - RNA, 19 nt, Homo sapiens
gaaagauccuaacuaugau

SEQ ID NO: 904968 - RNA, 19 nt, Homo sapiens
gaagauuuccauuagguaa

SEQ ID NO: 904969 - RNA, 19 nt, Homo sapiens
accaugagcuuguauauga

SEQ ID NO: 904970 - RNA, 19 nt, Homo sapiens
guaaugagcacaacugaug

SEQ ID NO: 904971 - RNA, 19 nt, Homo sapiens
ggacugaggaaauaaagaa

SEQ ID NO: 904972 - RNA, 19 nt, Homo sapiens
caagcgaaauuaagggaaa

SEQ ID NO: 904973 - RNA, 19 nt, Homo sapiens
aaaguaaccucuucuuaag

SEQ ID NO: 904974 - RNA, 19 nt, Homo sapiens
ugugaaagauccuaacuau

SEQ ID NO: 904975 - RNA, 19 nt, Homo sapiens
gaacuggaaguaccucauu

SEQ ID NO: 904976 - RNA, 19 nt, Homo sapiens
ggauaaggcuaccgugcuu

SEQ ID NO: 904977 - RNA, 19 nt, Homo sapiens
guugaaagaucuaccugaa

SEQ ID NO: 904978 - RNA, 19 nt, Homo sapiens
ugaaguugcggaaauguua

SEQ ID NO: 904979 - RNA, 19 nt, Homo sapiens
gaaaaguaaccucuucuua

SEQ ID NO: 904980 - RNA, 19 nt, Homo sapiens
cuaaugaaguugcggaaau

SEQ ID NO: 904981 - RNA, 19 nt, Homo sapiens
gaugaaagggcauuugaga

SEQ ID NO: 904982 - RNA, 19 nt, Homo sapiens
gguggaaagcguaaagaua

SEQ ID NO: 904983 - RNA, 19 nt, Homo sapiens
uaaaacaugugaagcagua

SEQ ID NO: 904984 - RNA, 19 nt, Homo sapiens
guacaaggcauuucugaca

SEQ ID NO: 904985 - RNA, 19 nt, Homo sapiens
caggagaacuguguuuaug

SEQ ID NO: 904986 - RNA, 19 nt, Homo sapiens
aagggaagguugcuggaua

SEQ ID NO: 904987 - RNA, 19 nt, Homo sapiens
gauccuaacuaugaugaug

SEQ ID NO: 904988 - RNA, 19 nt, Homo sapiens
ggagguggaugugaaagau

SEQ ID NO: 904989 - RNA, 19 nt, Homo sapiens
agagagcuacugaauauaa

SEQ ID NO: 904990 - RNA, 19 nt, Homo sapiens
agauggaggucgucuuaaa

SEQ ID NO: 904991 - RNA, 19 nt, Homo sapiens
gagguuaugagagaauuua

SEQ ID NO: 904992 - RNA, 19 nt, Homo sapiens
gagggauucugaaggaaga

SEQ ID NO: 904993 - RNA, 19 nt, Homo sapiens
gaagcugaacauugccuua

SEQ ID NO: 904994 - RNA, 19 nt, Homo sapiens
cuucuuaaguggaauauuc

SEQ ID NO: 904995 - RNA, 19 nt, Homo sapiens
caaggcauuucugacauuu

SEQ ID NO: 904996 - RNA, 19 nt, Homo sapiens
ccaaacaacucagagaucu

SEQ ID NO: 904997 - RNA, 19 nt, Homo sapiens
ggcaguauccuuagcauug

SEQ ID NO: 904998 - RNA, 19 nt, Homo sapiens
gacuuuaacaccaaucaua

SEQ ID NO: 904999 - RNA, 19 nt, Homo sapiens
aaagguggcuggaacaucu

SEQ ID NO: 905000 - RNA, 19 nt, Homo sapiens
ggagcgguuuguagaagaa

SEQ ID NO: 905001 - RNA, 19 nt, Homo sapiens
aaacaacucagagaucuuu

SEQ ID NO: 905002 - RNA, 19 nt, Homo sapiens
gagcauggagauacuaaug

SEQ ID NO: 905003 - RNA, 19 nt, Homo sapiens
cugaggaaauaaagaauga

SEQ ID NO: 905004 - RNA, 19 nt, Homo sapiens
ugcagauccugauaacuua

SEQ ID NO: 905005 - RNA, 19 nt, Homo sapiens
agacuagacaguuaaguaa

SEQ ID NO: 905006 - RNA, 19 nt, Homo sapiens
gaaggggacuaccaaagaa

SEQ ID NO: 905007 - RNA, 19 nt, Homo sapiens
ccagggaacauacugauug

SEQ ID NO: 905008 - RNA, 19 nt, Homo sapiens
cauguuggcugcugcuguu

SEQ ID NO: 905009 - RNA, 19 nt, Homo sapiens
guaguaaaaucacugguuu

SEQ ID NO: 905010 - RNA, 19 nt, Homo sapiens
gacugccacuccuuucuuu

SEQ ID NO: 905011 - RNA, 19 nt, Homo sapiens
gaaauuccggacauuaauc

SEQ ID NO: 905012 - RNA, 19 nt, Homo sapiens
gaaguugcggaaauguuaa

SEQ ID NO: 905013 - RNA, 19 nt, Homo sapiens
uaaugaaguugcggaaaug

SEQ ID NO: 905014 - RNA, 19 nt, Homo sapiens
acaaggcauuucugacauu

SEQ ID NO: 905015 - RNA, 19 nt, Homo sapiens
cuaccgugcuucugaguau

SEQ ID NO: 905016 - RNA, 19 nt, Homo sapiens
ccugauaacuuaagugacu

SEQ ID NO: 905017 - RNA, 19 nt, Homo sapiens
cuagaagaauguacaccaa

SEQ ID NO: 905018 - RNA, 19 nt, Homo sapiens
gagagcuacugaauauaag

SEQ ID NO: 905019 - RNA, 19 nt, Homo sapiens
gaauguaaacccugcagau

SEQ ID NO: 905020 - RNA, 19 nt, Homo sapiens
agagucaacuggagaaagu

SEQ ID NO: 905021 - RNA, 19 nt, Homo sapiens
guggaaagcguaaagauag

SEQ ID NO: 905022 - RNA, 19 nt, Homo sapiens
acaaaggaacuguagauug

SEQ ID NO: 905023 - RNA, 19 nt, Homo sapiens
ggaaggcuagucauagaga

SEQ ID NO: 905024 - RNA, 19 nt, Homo sapiens
caccaaucauacaggaaua

SEQ ID NO: 905025 - RNA, 19 nt, Homo sapiens
gggcaaggagggacagaaa

SEQ ID NO: 905026 - RNA, 19 nt, Homo sapiens
gauaugcugcugaaagaau

SEQ ID NO: 905027 - RNA, 19 nt, Homo sapiens
gaacauacugauuggucuu

SEQ ID NO: 905028 - RNA, 19 nt, Homo sapiens
uaucugaagcugaacauug

SEQ ID NO: 905029 - RNA, 19 nt, Homo sapiens
gcagcaaucugucaaucac

SEQ ID NO: 905030 - RNA, 19 nt, Homo sapiens
cauacugauuggucuuaaa

SEQ ID NO: 905031 - RNA, 19 nt, Homo sapiens
gaaaaugagcagauacuga

SEQ ID NO: 905032 - RNA, 19 nt, Homo sapiens
acaaugaaauuccggacau

SEQ ID NO: 905033 - RNA, 19 nt, Homo sapiens
ugaaagggcauuugagaag

SEQ ID NO: 905034 - RNA, 19 nt, Homo sapiens
uugauaugcugcugaaaga

SEQ ID NO: 905035 - RNA, 19 nt, Homo sapiens
ggagauggaauuuuaugua

SEQ ID NO: 905036 - RNA, 19 nt, Homo sapiens
uggaggagguggaugugaa

SEQ ID NO: 905037 - RNA, 19 nt, Homo sapiens
cuaauaagcuaccuuuugu

SEQ ID NO: 905038 - RNA, 19 nt, Homo sapiens
aguaaccucuucuuaagug

SEQ ID NO: 905039 - RNA, 19 nt, Homo sapiens
ggaggagguggaugugaaa

SEQ ID NO: 905040 - RNA, 19 nt, Homo sapiens
aagacuagacaguuaagua

SEQ ID NO: 905041 - RNA, 19 nt, Homo sapiens
gagcuacugaauauaagaa

SEQ ID NO: 905042 - RNA, 19 nt, Homo sapiens
cugcagauccugauaacuu

SEQ ID NO: 905043 - RNA, 19 nt, Homo sapiens
gcugaaagaauauuuacuc

SEQ ID NO: 905044 - RNA, 19 nt, Homo sapiens
gcugcugaaagaauauuua

SEQ ID NO: 905045 - RNA, 19 nt, Homo sapiens
guaccaguguuggcaguau

SEQ ID NO: 905046 - RNA, 19 nt, Homo sapiens
auaugcugcugaaagaaua

SEQ ID NO: 905047 - RNA, 19 nt, Homo sapiens
gcagauccugauaacuuaa

SEQ ID NO: 905048 - RNA, 19 nt, Homo sapiens
gcaguauccuuagcauugg

SEQ ID NO: 905049 - RNA, 19 nt, Homo sapiens
caucuaagcuucuuucuga

SEQ ID NO: 905050 - RNA, 19 nt, Homo sapiens
uggaauagaugaccaaaua

SEQ ID NO: 905051 - RNA, 19 nt, Homo sapiens
ccagagagcuacugaauau

SEQ ID NO: 905052 - RNA, 19 nt, Homo sapiens
caaaggaacuguagauugu

SEQ ID NO: 905053 - RNA, 19 nt, Homo sapiens
gaaaagagguuaugagaga

SEQ ID NO: 905054 - RNA, 19 nt, Homo sapiens
ugaaagaucuaccugaauu

SEQ ID NO: 905055 - RNA, 19 nt, Homo sapiens
guaagugccauguuuauua

SEQ ID NO: 905056 - RNA, 19 nt, Homo sapiens
ugaaagauccuaacuauga

SEQ ID NO: 905057 - RNA, 19 nt, Homo sapiens
gagcagauacugaauguaa

SEQ ID NO: 905058 - RNA, 19 nt, Homo sapiens
ggagaacuguguuuaugaa

SEQ ID NO: 905059 - RNA, 19 nt, Homo sapiens
ucaaucaccuuguuaaaga

SEQ ID NO: 905060 - RNA, 19 nt, Homo sapiens
gcggaaauguuaagagauu

SEQ ID NO: 905061 - RNA, 19 nt, Homo sapiens
ggagauggaggucgucuua

SEQ ID NO: 905062 - RNA, 19 nt, Homo sapiens
agacauaucugaagcugaa

SEQ ID NO: 905063 - RNA, 19 nt, Homo sapiens
gagaagacuuuaacaccaa

SEQ ID NO: 905064 - RNA, 19 nt, Homo sapiens
ggagaaaguacauuuaaga

SEQ ID NO: 905065 - RNA, 19 nt, Homo sapiens
gaaagaucuaccugaauua

SEQ ID NO: 905066 - RNA, 19 nt, Homo sapiens
gaaagggcauuugagaaga

SEQ ID NO: 905067 - RNA, 19 nt, Homo sapiens
gcauggagauacuaaugaa

SEQ ID NO: 905068 - RNA, 19 nt, Homo sapiens
gaaagauccuaacuaugau

SEQ ID NO: 905069 - RNA, 19 nt, Homo sapiens
gaagauuuccauuagguaa

SEQ ID NO: 905070 - RNA, 19 nt, Homo sapiens
accaugagcuuguauauga

SEQ ID NO: 905071 - RNA, 19 nt, Homo sapiens
guaaugagcacaacugaug

SEQ ID NO: 905072 - RNA, 19 nt, Homo sapiens
ggacugaggaaauaaagaa

SEQ ID NO: 905073 - RNA, 19 nt, Homo sapiens
caagcgaaauuaagggaaa

SEQ ID NO: 905074 - RNA, 19 nt, Homo sapiens
aaaguaaccucuucuuaag

SEQ ID NO: 905075 - RNA, 19 nt, Homo sapiens
ugugaaagauccuaacuau

SEQ ID NO: 905076 - RNA, 19 nt, Homo sapiens
gaacuggaaguaccucauu

SEQ ID NO: 905077 - RNA, 19 nt, Homo sapiens
ggauaaggcuaccgugcuu

SEQ ID NO: 905078 - RNA, 19 nt, Homo sapiens
guugaaagaucuaccugaa

SEQ ID NO: 905079 - RNA, 19 nt, Homo sapiens
ugaaguugcggaaauguua

SEQ ID NO: 905080 - RNA, 19 nt, Homo sapiens
gaaaaguaaccucuucuua

SEQ ID NO: 905081 - RNA, 19 nt, Homo sapiens
cuaaugaaguugcggaaau

SEQ ID NO: 905082 - RNA, 19 nt, Homo sapiens
gaugaaagggcauuugaga

SEQ ID NO: 905083 - RNA, 19 nt, Homo sapiens
gguggaaagcguaaagaua

SEQ ID NO: 905084 - RNA, 19 nt, Homo sapiens
uaaaacaugugaagcagua

SEQ ID NO: 905085 - RNA, 19 nt, Homo sapiens
guacaaggcauuucugaca

SEQ ID NO: 905086 - RNA, 19 nt, Homo sapiens
caggagaacuguguuuaug

SEQ ID NO: 905087 - RNA, 19 nt, Homo sapiens
aagggaagguugcuggaua

SEQ ID NO: 905088 - RNA, 19 nt, Homo sapiens
gauccuaacuaugaugaug

SEQ ID NO: 905089 - RNA, 19 nt, Homo sapiens
ggagguggaugugaaagau

SEQ ID NO: 905090 - RNA, 19 nt, Homo sapiens
gagggauucugaaggaaga

SEQ ID NO: 905091 - RNA, 19 nt, Homo sapiens
agagagcuacugaauauaa

SEQ ID NO: 905092 - RNA, 19 nt, Homo sapiens
agauggaggucgucuuaaa

SEQ ID NO: 905093 - RNA, 19 nt, Homo sapiens
gagguuaugagagaauuua

SEQ ID NO: 905094 - RNA, 19 nt, Homo sapiens
gaagcugaacauugccuua

SEQ ID NO: 905095 - RNA, 19 nt, Homo sapiens
cuucuuaaguggaauauuc

SEQ ID NO: 905096 - RNA, 19 nt, Homo sapiens
caaggcauuucugacauuu

SEQ ID NO: 905097 - RNA, 19 nt, Homo sapiens
ccaaacaacucagagaucu

SEQ ID NO: 905098 - RNA, 19 nt, Homo sapiens
ggcaguauccuuagcauug

SEQ ID NO: 905099 - RNA, 19 nt, Homo sapiens
gacuuuaacaccaaucaua

SEQ ID NO: 905100 - RNA, 19 nt, Homo sapiens
gaauagaugaccaaauauc

SEQ ID NO: 905101 - RNA, 19 nt, Homo sapiens
aaagguggcuggaacaucu

SEQ ID NO: 905102 - RNA, 19 nt, Homo sapiens
ggagcgguuuguagaagaa

SEQ ID NO: 905103 - RNA, 19 nt, Homo sapiens
aaacaacucagagaucuuu

SEQ ID NO: 905104 - RNA, 19 nt, Homo sapiens
gagcauggagauacuaaug

SEQ ID NO: 905105 - RNA, 19 nt, Homo sapiens
cugaggaaauaaagaauga

SEQ ID NO: 905106 - RNA, 19 nt, Homo sapiens
agacuagacaguuaaguaa

SEQ ID NO: 905107 - RNA, 19 nt, Homo sapiens
gaaggggacuaccaaagaa

SEQ ID NO: 905108 - RNA, 19 nt, Homo sapiens
ccagggaacauacugauug

SEQ ID NO: 905109 - RNA, 19 nt, Homo sapiens
cauguuggcugcugcuguu

SEQ ID NO: 905110 - RNA, 19 nt, Homo sapiens
guaguaaaaucacugguuu

SEQ ID NO: 905111 - RNA, 19 nt, Homo sapiens
gacugccacuccuuucuuu

SEQ ID NO: 905112 - RNA, 19 nt, Homo sapiens
gaaauuccggacauuaauc

SEQ ID NO: 905113 - RNA, 19 nt, Homo sapiens
gaaguugcggaaauguuaa

SEQ ID NO: 905114 - RNA, 19 nt, Homo sapiens
uaaugaaguugcggaaaug

SEQ ID NO: 905115 - RNA, 19 nt, Homo sapiens
acaaggcauuucugacauu

SEQ ID NO: 905116 - RNA, 19 nt, Homo sapiens
cuaccgugcuucugaguau

SEQ ID NO: 905117 - RNA, 19 nt, Homo sapiens
ccugauaacuuaagugacu

SEQ ID NO: 905118 - RNA, 19 nt, Homo sapiens
cuagaagaauguacaccaa

SEQ ID NO: 905119 - RNA, 19 nt, Homo sapiens
gagagcuacugaauauaag

SEQ ID NO: 905120 - RNA, 19 nt, Homo sapiens
agagucaacuggagaaagu

SEQ ID NO: 905121 - RNA, 19 nt, Homo sapiens
guggaaagcguaaagauag

SEQ ID NO: 905122 - RNA, 19 nt, Homo sapiens
acaaaggaacuguagauug

SEQ ID NO: 905123 - RNA, 19 nt, Homo sapiens
ggaaggcuagucauagaga

SEQ ID NO: 905124 - RNA, 19 nt, Homo sapiens
caccaaucauacaggaaua

SEQ ID NO: 905125 - RNA, 19 nt, Homo sapiens
gggcaaggagggacagaaa

SEQ ID NO: 905126 - RNA, 19 nt, Homo sapiens
gauaugcugcugaaagaau

SEQ ID NO: 905127 - RNA, 19 nt, Homo sapiens
gaacauacugauuggucuu

SEQ ID NO: 905128 - RNA, 19 nt, Homo sapiens
uaucugaagcugaacauug

SEQ ID NO: 905129 - RNA, 19 nt, Homo sapiens
gcagcaaucugucaaucac

SEQ ID NO: 905130 - RNA, 19 nt, Homo sapiens
ggaauagaugaccaaauau

SEQ ID NO: 905131 - RNA, 19 nt, Homo sapiens
gaaaaugagcagauacuga

SEQ ID NO: 905132 - RNA, 19 nt, Homo sapiens
cauacugauuggucuuaaa

SEQ ID NO: 905133 - RNA, 19 nt, Homo sapiens
acaaugaaauuccggacau

SEQ ID NO: 905134 - RNA, 19 nt, Homo sapiens
ugaaagggcauuugagaag

SEQ ID NO: 905135 - RNA, 19 nt, Homo sapiens
uugauaugcugcugaaaga

SEQ ID NO: 905136 - RNA, 19 nt, Homo sapiens
ggagauggaauuuuaugua

SEQ ID NO: 905137 - RNA, 19 nt, Homo sapiens
uggaggagguggaugugaa

SEQ ID NO: 905138 - RNA, 19 nt, Homo sapiens
cuaauaagcuaccuuuugu

SEQ ID NO: 905139 - RNA, 19 nt, Homo sapiens
aguaaccucuucuuaagug

SEQ ID NO: 905140 - RNA, 19 nt, Homo sapiens
ggaggagguggaugugaaa

SEQ ID NO: 905141 - RNA, 19 nt, Homo sapiens
aagacuagacaguuaagua

SEQ ID NO: 905142 - RNA, 19 nt, Homo sapiens
gagcuacugaauauaagaa

SEQ ID NO: 905143 - RNA, 19 nt, Homo sapiens
gcugaaagaauauuuacuc

SEQ ID NO: 905144 - RNA, 19 nt, Homo sapiens
gcugcugaaagaauauuua

SEQ ID NO: 905145 - RNA, 19 nt, Homo sapiens
guaccaguguuggcaguau

SEQ ID NO: 905146 - RNA, 19 nt, Homo sapiens
ucuccauggugcuucaaua

SEQ ID NO: 905147 - RNA, 19 nt, Homo sapiens
auaugcugcugaaagaaua

SEQ ID NO: 905148 - RNA, 19 nt, Homo sapiens
gcaguauccuuagcauugg

SEQ ID NO: 905149 - RNA, 19 nt, Homo sapiens
ggaaagacguccucaauua

SEQ ID NO: 905150 - RNA, 19 nt, Homo sapiens
cgagagggcuauggaauua

SEQ ID NO: 905151 - RNA, 19 nt, Homo sapiens
gcagagacuugguagauga

SEQ ID NO: 905152 - RNA, 19 nt, Homo sapiens
gcaagaugcacaauaauuu

SEQ ID NO: 905153 - RNA, 19 nt, Homo sapiens
gaagauauaugcccaucga

SEQ ID NO: 905154 - RNA, 19 nt, Homo sapiens
cgacaaaccuuggaaguga

SEQ ID NO: 905155 - RNA, 19 nt, Homo sapiens
gaaguacucuuugcaguug

SEQ ID NO: 905156 - RNA, 19 nt, Homo sapiens
gcguauaccucccagauaa

SEQ ID NO: 905157 - RNA, 19 nt, Homo sapiens
gaaaguacuucaccugcaa

SEQ ID NO: 905158 - RNA, 19 nt, Homo sapiens
gaaaacagauggcacacua

SEQ ID NO: 905159 - RNA, 19 nt, Homo sapiens
ggaaauacaauccaaugaa

SEQ ID NO: 905160 - RNA, 19 nt, Homo sapiens
gcuauggaauuacugauug

SEQ ID NO: 905161 - RNA, 19 nt, Homo sapiens
ggagaaugguggcuucaau

SEQ ID NO: 905162 - RNA, 19 nt, Homo sapiens
caacauacuugaagaccau

SEQ ID NO: 905163 - RNA, 19 nt, Homo sapiens
ccucuuaucucaauagugu

SEQ ID NO: 905164 - RNA, 19 nt, Homo sapiens
gccaauacauggagguuau

SEQ ID NO: 905165 - RNA, 19 nt, Homo sapiens
ucaacacaguggaacguua

SEQ ID NO: 905166 - RNA, 19 nt, Homo sapiens
ggacucggguagcuucuau

SEQ ID NO: 905167 - RNA, 19 nt, Homo sapiens
gcaagaacgaccacuaaug

SEQ ID NO: 905168 - RNA, 19 nt, Homo sapiens
ggacaugaucuaugcugua

SEQ ID NO: 905169 - RNA, 19 nt, Homo sapiens
aaacagauggcacacuaua

SEQ ID NO: 905170 - RNA, 19 nt, Homo sapiens
guacuuggaggcuuucuuu

SEQ ID NO: 905171 - RNA, 19 nt, Homo sapiens
gagaugccauuuccagugu

SEQ ID NO: 905172 - RNA, 19 nt, Homo sapiens
ggaauuacugauugacuuu

SEQ ID NO: 905173 - RNA, 19 nt, Homo sapiens
cauugugaaucccauauuu

SEQ ID NO: 905174 - RNA, 19 nt, Homo sapiens
gguaugauccgaaggagaa

SEQ ID NO: 905175 - RNA, 19 nt, Homo sapiens
ggaaguacucuuugcaguu

SEQ ID NO: 905176 - RNA, 19 nt, Homo sapiens
gcuaaacguucgcagugaa

SEQ ID NO: 905177 - RNA, 19 nt, Homo sapiens
gacaagcacccucgacaaa

SEQ ID NO: 905178 - RNA, 19 nt, Homo sapiens
gauggauccucuuaucuca

SEQ ID NO: 905179 - RNA, 19 nt, Homo sapiens
gcgcagguguaccaacauu

SEQ ID NO: 905180 - RNA, 19 nt, Homo sapiens
guacuucaccugcaagaug

SEQ ID NO: 905181 - RNA, 19 nt, Homo sapiens
gaaagacguccucaauuac

SEQ ID NO: 905182 - RNA, 19 nt, Homo sapiens
cauauuuggugaacacaga

SEQ ID NO: 905183 - RNA, 19 nt, Homo sapiens
caugaucuaugcuguagga

SEQ ID NO: 905184 - RNA, 19 nt, Homo sapiens
caggacaaguguuggugua

SEQ ID NO: 905185 - RNA, 19 nt, Homo sapiens
caugauggauccucuuauc

SEQ ID NO: 905186 - RNA, 19 nt, Homo sapiens
gauaugauccacagaccaa

SEQ ID NO: 905187 - RNA, 19 nt, Homo sapiens
gacaaguucacccaacaua

SEQ ID NO: 905188 - RNA, 19 nt, Homo sapiens
gaaagcaccgggagcuaug

SEQ ID NO: 905189 - RNA, 19 nt, Homo sapiens
gcuuugaccuuggagcuuu

SEQ ID NO: 905190 - RNA, 19 nt, Homo sapiens
guuaggaggguucuuauau

SEQ ID NO: 905191 - RNA, 19 nt, Homo sapiens
uauauggcgggaugaauua

SEQ ID NO: 905192 - RNA, 19 nt, Homo sapiens
gacaugaucuaugcuguag

SEQ ID NO: 905193 - RNA, 19 nt, Homo sapiens
guucuuauaugcuguaggu

SEQ ID NO: 905194 - RNA, 19 nt, Homo sapiens
caauaguguugaaagguau

SEQ ID NO: 905195 - RNA, 19 nt, Homo sapiens
gaagagggcaauguucaga

SEQ ID NO: 905196 - RNA, 19 nt, Homo sapiens
ccuaggcugugcaguauau

SEQ ID NO: 905197 - RNA, 19 nt, Homo sapiens
guagugauccgagacauug

SEQ ID NO: 905198 - RNA, 19 nt, Homo sapiens
gccggugccucaacaaaug

SEQ ID NO: 905199 - RNA, 19 nt, Homo sapiens
gacgggacaucuccucuca

SEQ ID NO: 905200 - RNA, 19 nt, Homo sapiens
acaagcaccugcaggacaa

SEQ ID NO: 905201 - RNA, 19 nt, Homo sapiens
gaugaagaaugcagagacu

SEQ ID NO: 905202 - RNA, 19 nt, Homo sapiens
ggaagccugcugugaauuc

SEQ ID NO: 905203 - RNA, 19 nt, Homo sapiens
ggacaucuccucucaacac

SEQ ID NO: 905204 - RNA, 19 nt, Homo sapiens
uuaggaggguucuuauaug

SEQ ID NO: 905205 - RNA, 19 nt, Homo sapiens
caagaacgaccacuaaugc

SEQ ID NO: 905206 - RNA, 19 nt, Homo sapiens
acauaacuuucaagaggua

SEQ ID NO: 905207 - RNA, 19 nt, Homo sapiens
ucggguagcuucuaugagu

SEQ ID NO: 905208 - RNA, 19 nt, Homo sapiens
caccuaggcugugcaguau

SEQ ID NO: 905209 - RNA, 19 nt, Homo sapiens
gagaaugguggcuucaaug

SEQ ID NO: 905210 - RNA, 19 nt, Homo sapiens
agccugcugugaauucuua

SEQ ID NO: 905211 - RNA, 19 nt, Homo sapiens
ccagauaacaguagaagag

SEQ ID NO: 905212 - RNA, 19 nt, Homo sapiens
gaauuaccgucggcuaugg

SEQ ID NO: 905213 - RNA, 19 nt, Homo sapiens
acaccuaggcugugcagua

SEQ ID NO: 905214 - RNA, 19 nt, Homo sapiens
ugucuugccucaacauugu

SEQ ID NO: 905215 - RNA, 19 nt, Homo sapiens
cuuggaggcuuucuuuaug

SEQ ID NO: 905216 - RNA, 19 nt, Homo sapiens
ggucaguguucuugaugau

SEQ ID NO: 905217 - RNA, 19 nt, Homo sapiens
gaugccauuuccaguguug

SEQ ID NO: 905218 - RNA, 19 nt, Homo sapiens
ucuguuauaugcaguagga

SEQ ID NO: 905219 - RNA, 19 nt, Homo sapiens
uugaugaucuguuauaugc

SEQ ID NO: 905220 - RNA, 19 nt, Homo sapiens
ugaagaaugcagagacuug

SEQ ID NO: 905221 - RNA, 19 nt, Homo sapiens
cugauugacuuugcguaua

SEQ ID NO: 905222 - RNA, 19 nt, Homo sapiens
uggaauuacugauugacuu

SEQ ID NO: 905223 - RNA, 19 nt, Homo sapiens
gcuaugugauguggugcua

SEQ ID NO: 905224 - RNA, 19 nt, Homo sapiens
ggacagcucauggcaguag

SEQ ID NO: 905225 - RNA, 19 nt, Homo sapiens
gacaaguguugguguagca

SEQ ID NO: 905226 - RNA, 19 nt, Homo sapiens
gcaguaggaggccaugaug

SEQ ID NO: 905227 - RNA, 19 nt, Homo sapiens
ccgcaagaacgaccacuaa

SEQ ID NO: 905228 - RNA, 19 nt, Homo sapiens
cagacaaguucacccaaca

SEQ ID NO: 905229 - RNA, 19 nt, Homo sapiens
aaggauagcagacaaguuc

SEQ ID NO: 905230 - RNA, 19 nt, Homo sapiens
ggcacaacauacuugaaga

SEQ ID NO: 905231 - RNA, 19 nt, Homo sapiens
caucuccucucaacacagu

SEQ ID NO: 905232 - RNA, 19 nt, Homo sapiens
uaauggagagugaagaguu

SEQ ID NO: 905233 - RNA, 19 nt, Homo sapiens
gacaaaccuuggaagugau

SEQ ID NO: 905234 - RNA, 19 nt, Homo sapiens
ggagguagagaugacacua

SEQ ID NO: 905235 - RNA, 19 nt, Homo sapiens
gagacuggaauggauguaa

SEQ ID NO: 905236 - RNA, 19 nt, Homo sapiens
gguaugaccccaaaacaaa

SEQ ID NO: 905237 - RNA, 19 nt, Homo sapiens
caaaagugaugaagaaugc

SEQ ID NO: 905238 - RNA, 19 nt, Homo sapiens
gaaguagugauccgagaca

SEQ ID NO: 905239 - RNA, 19 nt, Homo sapiens
uggcguaggaguuauuaaa

SEQ ID NO: 905240 - RNA, 19 nt, Homo sapiens
ccgcaugcccuauaucuca

SEQ ID NO: 905241 - RNA, 19 nt, Homo sapiens
uggauccucuuaucucaau

SEQ ID NO: 905242 - RNA, 19 nt, Homo sapiens
ucaguguucuugaugaucu

SEQ ID NO: 905243 - RNA, 19 nt, Homo sapiens
gagaaagcaccgggagcua

SEQ ID NO: 905244 - RNA, 19 nt, Homo sapiens
uagaagagggcaauguuca

SEQ ID NO: 905245 - RNA, 19 nt, Homo sapiens
ugauugacuuugcguauac

SEQ ID NO: 905246 - RNA, 19 nt, Homo sapiens
cuauggaauuacugauuga

SEQ ID NO: 905247 - RNA, 19 nt, Homo sapiens
uuauauggcgggaugaauu

SEQ ID NO: 905248 - RNA, 19 nt, Homo sapiens
uguucuugaugaucuguua

SEQ ID NO: 905249 - RNA, 19 nt, Homo sapiens
gcacacacguagacuaauu

SEQ ID NO: 905250 - RNA, 19 nt, Homo sapiens
ugacuuaacuguuuaccua

SEQ ID NO: 905251 - RNA, 19 nt, Homo sapiens
caccaaacauuaacacaua

SEQ ID NO: 905252 - RNA, 19 nt, Homo sapiens
ugugagaacugaaguauuu

SEQ ID NO: 905253 - RNA, 19 nt, Homo sapiens
caauaucugucaccuagua

SEQ ID NO: 905254 - RNA, 19 nt, Homo sapiens
gugaagugcucuacucuuu

SEQ ID NO: 905255 - RNA, 19 nt, Homo sapiens
gaagugcucuacucuuuca

SEQ ID NO: 905256 - RNA, 19 nt, Homo sapiens
acaaggagauccgcacuua

SEQ ID NO: 905257 - RNA, 19 nt, Homo sapiens
caaagcagggucauaauuu

SEQ ID NO: 905258 - RNA, 19 nt, Homo sapiens
gaacugaaguauuucugau

SEQ ID NO: 905259 - RNA, 19 nt, Homo sapiens
gcaaaacacugccugaaaa

SEQ ID NO: 905260 - RNA, 19 nt, Homo sapiens
uuacagggaugaagaaaga

SEQ ID NO: 905261 - RNA, 19 nt, Homo sapiens
caagcuacaccaaacauua

SEQ ID NO: 905262 - RNA, 19 nt, Homo sapiens
gaccaaacuuguauuagga

SEQ ID NO: 905263 - RNA, 19 nt, Homo sapiens
gagcagcaaguaagaauuu

SEQ ID NO: 905264 - RNA, 19 nt, Homo sapiens
gaauuucacuuucggaucu

SEQ ID NO: 905265 - RNA, 19 nt, Homo sapiens
gaaaagaccuugcaguagu

SEQ ID NO: 905266 - RNA, 19 nt, Homo sapiens
gaucugugguggauuucua

SEQ ID NO: 905267 - RNA, 19 nt, Homo sapiens
gagagaaauugauaagcuu

SEQ ID NO: 905268 - RNA, 19 nt, Homo sapiens
caacgacgaccaccuguuu

SEQ ID NO: 905269 - RNA, 19 nt, Homo sapiens
agacgagauuuccuucuua

SEQ ID NO: 905270 - RNA, 19 nt, Homo sapiens
gaacauuccauaucauuag

SEQ ID NO: 905271 - RNA, 19 nt, Homo sapiens
ggucggaggugauguaucu

SEQ ID NO: 905272 - RNA, 19 nt, Homo sapiens
ucagggaacuugagcagaa

SEQ ID NO: 905273 - RNA, 19 nt, Homo sapiens
gggaggcacucaagaugaa

SEQ ID NO: 905274 - RNA, 19 nt, Homo sapiens
gcaagaagaagaagaucaa

SEQ ID NO: 905275 - RNA, 19 nt, Homo sapiens
ccagaagaguguguuaauu

SEQ ID NO: 905276 - RNA, 19 nt, Homo sapiens
uucaguagcuccacguuua

SEQ ID NO: 905277 - RNA, 19 nt, Homo sapiens
gaagggcaaucuggacuau

SEQ ID NO: 905278 - RNA, 19 nt, Homo sapiens
gaaccagaagaguguguua

SEQ ID NO: 905279 - RNA, 19 nt, Homo sapiens
ucaagaaccucaacuacuc

SEQ ID NO: 905280 - RNA, 19 nt, Homo sapiens
ucacaggcuucuacugaaa

SEQ ID NO: 905281 - RNA, 19 nt, Homo sapiens
gaagaagaagaucaacaaa

SEQ ID NO: 905282 - RNA, 19 nt, Homo sapiens
gaagugcccacaaguaugu

SEQ ID NO: 905283 - RNA, 19 nt, Homo sapiens
gaccaaugcugcuuuaagg

SEQ ID NO: 905284 - RNA, 19 nt, Homo sapiens
cagaggaaguugugagaga

SEQ ID NO: 905285 - RNA, 19 nt, Homo sapiens
aagcuaauguugagacuga

SEQ ID NO: 905286 - RNA, 19 nt, Homo sapiens
cgugauuuaugcugacuua

SEQ ID NO: 905287 - RNA, 19 nt, Homo sapiens
cagaagaguguguuaauug

SEQ ID NO: 905288 - RNA, 19 nt, Homo sapiens
ggucauaauuugugaucug

SEQ ID NO: 905289 - RNA, 19 nt, Homo sapiens
aaagcagggucauaauuug

SEQ ID NO: 905290 - RNA, 19 nt, Homo sapiens
uaugcugacuuaacuguuu

SEQ ID NO: 905291 - RNA, 19 nt, Homo sapiens
ggacaagggacuaaugcaa

SEQ ID NO: 905292 - RNA, 19 nt, Homo sapiens
gacgagauuuccuucuuau

SEQ ID NO: 905293 - RNA, 19 nt, Homo sapiens
aaaguuaccugacacacau

SEQ ID NO: 905294 - RNA, 19 nt, Homo sapiens
gaagguaugcagugugaga

SEQ ID NO: 905295 - RNA, 19 nt, Homo sapiens
ggagaagaauuaccuuuug

SEQ ID NO: 905296 - RNA, 19 nt, Homo sapiens
gcagcaagcagacauuuca

SEQ ID NO: 905297 - RNA, 19 nt, Homo sapiens
guacaguggucaucgaucu

SEQ ID NO: 905298 - RNA, 19 nt, Homo sapiens
caucacaggcuucuacuga

SEQ ID NO: 905299 - RNA, 19 nt, Homo sapiens
gcagggucauaauuuguga

SEQ ID NO: 905300 - RNA, 19 nt, Homo sapiens
aggaugaggagaagaauua

SEQ ID NO: 905301 - RNA, 19 nt, Homo sapiens
ugucucuucuguugauuua

SEQ ID NO: 905302 - RNA, 19 nt, Homo sapiens
gaacuacgacaacuucuac

SEQ ID NO: 905303 - RNA, 19 nt, Homo sapiens
ggagaacuacgacaacuuc

SEQ ID NO: 905304 - RNA, 19 nt, Homo sapiens
ggucugggauguaccuuuc

SEQ ID NO: 905305 - RNA, 19 nt, Homo sapiens
ggacagaauuaaugaugcu

SEQ ID NO: 905306 - RNA, 19 nt, Homo sapiens
ugagaugggugcuguucuu

SEQ ID NO: 905307 - RNA, 19 nt, Homo sapiens
agaaagagccagccugaga

SEQ ID NO: 905308 - RNA, 19 nt, Homo sapiens
ccacucggauguccauaau

SEQ ID NO: 905309 - RNA, 19 nt, Homo sapiens
gcaagggcaagaagaagaa

SEQ ID NO: 905310 - RNA, 19 nt, Homo sapiens
agccagcaaugcaagauua

SEQ ID NO: 905311 - RNA, 19 nt, Homo sapiens
cagacgagauuuccuucuu

SEQ ID NO: 905312 - RNA, 19 nt, Homo sapiens
gaaaaccuacugauucuuu

SEQ ID NO: 905313 - RNA, 19 nt, Homo sapiens
ugaccaaacuuguauuagg

SEQ ID NO: 905314 - RNA, 19 nt, Homo sapiens
gauaacaaugguuucguuu

SEQ ID NO: 905315 - RNA, 19 nt, Homo sapiens
ugagagaaauugauaagcu

SEQ ID NO: 905316 - RNA, 19 nt, Homo sapiens
ugacagugcuagacgugaa

SEQ ID NO: 905317 - RNA, 19 nt, Homo sapiens
gaccaaggcuuuugaguuc

SEQ ID NO: 905318 - RNA, 19 nt, Homo sapiens
ugacacacauauaaacaca

SEQ ID NO: 905319 - RNA, 19 nt, Homo sapiens
auacaaagcagggucauaa

SEQ ID NO: 905320 - RNA, 19 nt, Homo sapiens
gaaguugugagagaaauug

SEQ ID NO: 905321 - RNA, 19 nt, Homo sapiens
gcacaucggcgacgugucu

SEQ ID NO: 905322 - RNA, 19 nt, Homo sapiens
ugugaucugugguggauuu

SEQ ID NO: 905323 - RNA, 19 nt, Homo sapiens
gauuuaugcugacuuaacu

SEQ ID NO: 905324 - RNA, 19 nt, Homo sapiens
aaacuuguauuaggacaga

SEQ ID NO: 905325 - RNA, 19 nt, Homo sapiens
uaacaaugguuucguuuug

SEQ ID NO: 905326 - RNA, 19 nt, Homo sapiens
ucagagauaacaaugguuu

SEQ ID NO: 905327 - RNA, 19 nt, Homo sapiens
gaacaagaaccagaagagu

SEQ ID NO: 905328 - RNA, 19 nt, Homo sapiens
agaaugggcuccgcaccua

SEQ ID NO: 905329 - RNA, 19 nt, Homo sapiens
uagacuaauucacgucaaa

SEQ ID NO: 905330 - RNA, 19 nt, Homo sapiens
gagaagaauuaccuuuuga

SEQ ID NO: 905331 - RNA, 19 nt, Homo sapiens
gaggagaagaauuaccuuu

SEQ ID NO: 905332 - RNA, 19 nt, Homo sapiens
ccaagucguucgcgaucaa

SEQ ID NO: 905333 - RNA, 19 nt, Homo sapiens
caagagacccucccuucau

SEQ ID NO: 905334 - RNA, 19 nt, Homo sapiens
gcugugacaugucuguuag

SEQ ID NO: 905335 - RNA, 19 nt, Homo sapiens
gagcaacagaaucaccaua

SEQ ID NO: 905336 - RNA, 19 nt, Homo sapiens
uuucuugucucuucuguug

SEQ ID NO: 905337 - RNA, 19 nt, Homo sapiens
uugccaacguuaaaccuua

SEQ ID NO: 905338 - RNA, 19 nt, Homo sapiens
gcaggcagcaguuuguuca

SEQ ID NO: 905339 - RNA, 19 nt, Homo sapiens
acucggauguccauaauuc

SEQ ID NO: 905340 - RNA, 19 nt, Homo sapiens
gcccugcgcuccuuuaacu

SEQ ID NO: 905341 - RNA, 19 nt, Homo sapiens
aaccuuuggucauuuguaa

SEQ ID NO: 905342 - RNA, 19 nt, Homo sapiens
gcccacaaguauguucuuu

SEQ ID NO: 905343 - RNA, 19 nt, Homo sapiens
caucugaagugcccacaag

SEQ ID NO: 905344 - RNA, 19 nt, Homo sapiens
uaccuacaguugaagcuaa

SEQ ID NO: 905345 - RNA, 19 nt, Homo sapiens
ccgcagagcccaauuacau

SEQ ID NO: 905346 - RNA, 19 nt, Homo sapiens
agaagaagaagaucaacaa

SEQ ID NO: 905347 - RNA, 19 nt, Homo sapiens
ugaaggugauugacuccaa

SEQ ID NO: 905348 - RNA, 19 nt, Homo sapiens
gaacuugagcagaauaagg

SEQ ID NO: 905349 - RNA, 19 nt, Homo sapiens
ccacugcccuggcugauga

SEQ ID NO: 905350 - RNA, 19 nt, Homo sapiens
gaggacaucuucguacaug

SEQ ID NO: 905351 - RNA, 19 nt, Homo sapiens
cgucugugcuuguggcuau

SEQ ID NO: 905352 - RNA, 19 nt, Homo sapiens
gcuccuaggcugagugguu

SEQ ID NO: 905353 - RNA, 19 nt, Homo sapiens
ccuggacccuucccucaga

SEQ ID NO: 905354 - RNA, 19 nt, Homo sapiens
ccuacaagaugugcccuau

SEQ ID NO: 905355 - RNA, 19 nt, Homo sapiens
ccgaggacaucuucguaca

SEQ ID NO: 905356 - RNA, 19 nt, Homo sapiens
ccugagcugucccguguca

SEQ ID NO: 905357 - RNA, 19 nt, Homo sapiens
uacaagaugugcccuaucc

SEQ ID NO: 905358 - RNA, 19 nt, Homo sapiens
ccauggagaggcaggaaga

SEQ ID NO: 905359 - RNA, 19 nt, Homo sapiens
ucucugugcuacuuacauc

SEQ ID NO: 905360 - RNA, 19 nt, Homo sapiens
gcccuaucccucccaagaa

SEQ ID NO: 905361 - RNA, 19 nt, Homo sapiens
ucaagggcgucuguaagca

SEQ ID NO: 905362 - RNA, 19 nt, Homo sapiens
gggcgucuguaagcaguuc

SEQ ID NO: 905363 - RNA, 19 nt, Homo sapiens
aagcggaccaggaccuauu

SEQ ID NO: 905364 - RNA, 19 nt, Homo sapiens
guccuucgguggccucagu

SEQ ID NO: 905365 - RNA, 19 nt, Homo sapiens
acagggccauggcuucauc

SEQ ID NO: 905366 - RNA, 19 nt, Homo sapiens
caggcucucugugcuacuu

SEQ ID NO: 905367 - RNA, 19 nt, Homo sapiens
uggagguggugcucacuca

SEQ ID NO: 905368 - RNA, 19 nt, Homo sapiens
guucaagggcgucuguaag

SEQ ID NO: 905369 - RNA, 19 nt, Homo sapiens
ucacagggccauggcuuca

SEQ ID NO: 905370 - RNA, 19 nt, Homo sapiens
gaagaagacuacuuaauug

SEQ ID NO: 905371 - RNA, 19 nt, Homo sapiens
caacuacacuugcuuuaua

SEQ ID NO: 905372 - RNA, 19 nt, Homo sapiens
gaaaugagguugcuaugga

SEQ ID NO: 905373 - RNA, 19 nt, Homo sapiens
gcauggaccuucaaugaua

SEQ ID NO: 905374 - RNA, 19 nt, Homo sapiens
gaaagcaaaucauucugua

SEQ ID NO: 905375 - RNA, 19 nt, Homo sapiens
gcaaaggauucaucuguaa

SEQ ID NO: 905376 - RNA, 19 nt, Homo sapiens
ggagaaggaucccugagua

SEQ ID NO: 905377 - RNA, 19 nt, Homo sapiens
ggagagaauucaaauagaa

SEQ ID NO: 905378 - RNA, 19 nt, Homo sapiens
gaagacauuuccaguacua

SEQ ID NO: 905379 - RNA, 19 nt, Homo sapiens
gaauaugaauuucguguug

SEQ ID NO: 905380 - RNA, 19 nt, Homo sapiens
gaagagugcugggcuauga

SEQ ID NO: 905381 - RNA, 19 nt, Homo sapiens
ccacacagaucaagauauu

SEQ ID NO: 905382 - RNA, 19 nt, Homo sapiens
gcugagagcuugaaacaga

SEQ ID NO: 905383 - RNA, 19 nt, Homo sapiens
guaaagaucccgagacauu

SEQ ID NO: 905384 - RNA, 19 nt, Homo sapiens
acaagaagaugaaggcuuu

SEQ ID NO: 905385 - RNA, 19 nt, Homo sapiens
gcugacaaacucuaaauua

SEQ ID NO: 905386 - RNA, 19 nt, Homo sapiens
ggaaugcuauugccuggaa

SEQ ID NO: 905387 - RNA, 19 nt, Homo sapiens
cagaagaacugcagaaugg

SEQ ID NO: 905388 - RNA, 19 nt, Homo sapiens
gagcaggcccagauaauaa

SEQ ID NO: 905389 - RNA, 19 nt, Homo sapiens
guuaagaacuaaagcauca

SEQ ID NO: 905390 - RNA, 19 nt, Homo sapiens
ggacagaugacuccaaaga

SEQ ID NO: 905391 - RNA, 19 nt, Homo sapiens
gcuaugaggucuuauacug

SEQ ID NO: 905392 - RNA, 19 nt, Homo sapiens
gauaauaacagucccauuc

SEQ ID NO: 905393 - RNA, 19 nt, Homo sapiens
gaacggagacccuuagaca

SEQ ID NO: 905394 - RNA, 19 nt, Homo sapiens
uaacagucccauucaaaua

SEQ ID NO: 905395 - RNA, 19 nt, Homo sapiens
gauauuaguuggagaaggu

SEQ ID NO: 905396 - RNA, 19 nt, Homo sapiens
gaaagugucaucuguggaa

SEQ ID NO: 905397 - RNA, 19 nt, Homo sapiens
gcaaagggucaacucauuu

SEQ ID NO: 905398 - RNA, 19 nt, Homo sapiens
gaauaugaaccaaagauug

SEQ ID NO: 905399 - RNA, 19 nt, Homo sapiens
gaaggcaaagcuccaauuu

SEQ ID NO: 905400 - RNA, 19 nt, Homo sapiens
gaaaaugagucugaaguuu

SEQ ID NO: 905401 - RNA, 19 nt, Homo sapiens
ggagucaauuccagaagaa

SEQ ID NO: 905402 - RNA, 19 nt, Homo sapiens
cuacuuugcuuccguaaga

SEQ ID NO: 905403 - RNA, 19 nt, Homo sapiens
ggucugaacucgucauuac

SEQ ID NO: 905404 - RNA, 19 nt, Homo sapiens
guacaaacaacccuagaaa

SEQ ID NO: 905405 - RNA, 19 nt, Homo sapiens
ccauaaaucuuugagaguu

SEQ ID NO: 905406 - RNA, 19 nt, Homo sapiens
cauuauagguggaagcaaa

SEQ ID NO: 905407 - RNA, 19 nt, Homo sapiens
gauacugacuggaagauag

SEQ ID NO: 905408 - RNA, 19 nt, Homo sapiens
gguaagacauacaaugcaa

SEQ ID NO: 905409 - RNA, 19 nt, Homo sapiens
aaagagagaacugucauua

SEQ ID NO: 905410 - RNA, 19 nt, Homo sapiens
guaccaaugugcugcagaa

SEQ ID NO: 905411 - RNA, 19 nt, Homo sapiens
gaggagagaauucaaauag

SEQ ID NO: 905412 - RNA, 19 nt, Homo sapiens
gcaagcaaccuucgaggaa

SEQ ID NO: 905413 - RNA, 19 nt, Homo sapiens
gcuaauaccaucuacuuug

SEQ ID NO: 905414 - RNA, 19 nt, Homo sapiens
caaaguggguguguauaau

SEQ ID NO: 905415 - RNA, 19 nt, Homo sapiens
ggauuuggauauaucauca

SEQ ID NO: 905416 - RNA, 19 nt, Homo sapiens
caagugaaccaucagaauu

SEQ ID NO: 905417 - RNA, 19 nt, Homo sapiens
gaaaauaucucugcacagu

SEQ ID NO: 905418 - RNA, 19 nt, Homo sapiens
caaaauggauguuacaguu

SEQ ID NO: 905419 - RNA, 19 nt, Homo sapiens
auacacaccucucuaucua

SEQ ID NO: 905420 - RNA, 19 nt, Homo sapiens
gacaaacucuaaauuaugc

SEQ ID NO: 905421 - RNA, 19 nt, Homo sapiens
aaauggagguuucauggaa

SEQ ID NO: 905422 - RNA, 19 nt, Homo sapiens
gaaagcaucaucccacugu

SEQ ID NO: 905423 - RNA, 19 nt, Homo sapiens
ggagggauuuggauauauc

SEQ ID NO: 905424 - RNA, 19 nt, Homo sapiens
gggcagcuaucucuuggaa

SEQ ID NO: 905425 - RNA, 19 nt, Homo sapiens
gaaagucaaguacagcaaa

SEQ ID NO: 905426 - RNA, 19 nt, Homo sapiens
ggaaacaaacaauacauca

SEQ ID NO: 905427 - RNA, 19 nt, Homo sapiens
aagaauccaugauagguaa

SEQ ID NO: 905428 - RNA, 19 nt, Homo sapiens
uaacaaagaggcccagaga

SEQ ID NO: 905429 - RNA, 19 nt, Homo sapiens
gcuccaauuugcauauauu

SEQ ID NO: 905430 - RNA, 19 nt, Homo sapiens
gaauagaaacacuggaaga

SEQ ID NO: 905431 - RNA, 19 nt, Homo sapiens
caagguuugucuacagaaa

SEQ ID NO: 905432 - RNA, 19 nt, Homo sapiens
gggauuugaugauaaggaa

SEQ ID NO: 905433 - RNA, 19 nt, Homo sapiens
gauggcagccucaagauau

SEQ ID NO: 905434 - RNA, 19 nt, Homo sapiens
ucauaacgaugcugaaugu

SEQ ID NO: 905435 - RNA, 19 nt, Homo sapiens
gaagauagacuguuuuguu

SEQ ID NO: 905436 - RNA, 19 nt, Homo sapiens
acagaugacuccaaagaau

SEQ ID NO: 905437 - RNA, 19 nt, Homo sapiens
gaaaguuuaucugcaguag

SEQ ID NO: 905438 - RNA, 19 nt, Homo sapiens
ccagagaaguguucaaggu

SEQ ID NO: 905439 - RNA, 19 nt, Homo sapiens
cgagacauuucccugguaa

SEQ ID NO: 905440 - RNA, 19 nt, Homo sapiens
ugaaccaucagaauuguua

SEQ ID NO: 905441 - RNA, 19 nt, Homo sapiens
guccuuggguggaauauga

SEQ ID NO: 905442 - RNA, 19 nt, Homo sapiens
ggucagaugcuggaucaua

SEQ ID NO: 905443 - RNA, 19 nt, Homo sapiens
uauacaagcugcaaaggau

SEQ ID NO: 905444 - RNA, 19 nt, Homo sapiens
ggaauaugaaccaaagauu

SEQ ID NO: 905445 - RNA, 19 nt, Homo sapiens
gaauugugcugcuaauggu

SEQ ID NO: 905446 - RNA, 19 nt, Homo sapiens
gggagucaauuccagaaga

SEQ ID NO: 905447 - RNA, 19 nt, Homo sapiens
gaaauucucaaugguaaga

SEQ ID NO: 905448 - RNA, 19 nt, Homo sapiens
caaacaacccuagaaaguu

SEQ ID NO: 905449 - RNA, 19 nt, Homo sapiens
gagaugucauagacuuaaa

SEQ ID NO: 905450 - RNA, 19 nt, Homo sapiens
gcagcuaucucuuggaaaa

SEQ ID NO: 905451 - RNA, 19 nt, Homo sapiens
gcacagacauugauuuuac

SEQ ID NO: 905452 - RNA, 19 nt, Homo sapiens
ucaaaguggguguguauaa

SEQ ID NO: 905453 - RNA, 19 nt, Homo sapiens
ggagaugucauagacuuaa

SEQ ID NO: 905454 - RNA, 19 nt, Homo sapiens
gcugggcuaugaggucuua

SEQ ID NO: 905455 - RNA, 19 nt, Homo sapiens
ggagagcaggcccagauaa

SEQ ID NO: 905456 - RNA, 19 nt, Homo sapiens
ugaaaggauuggaggagaa

SEQ ID NO: 905457 - RNA, 19 nt, Homo sapiens
auacagacuuguuugcaaa

SEQ ID NO: 905458 - RNA, 19 nt, Homo sapiens
caauggagaugucauagac

SEQ ID NO: 905459 - RNA, 19 nt, Homo sapiens
gaauguaaagcuaguggaa

SEQ ID NO: 905460 - RNA, 19 nt, Homo sapiens
guacauugccaaaguggaa

SEQ ID NO: 905461 - RNA, 19 nt, Homo sapiens
agacuuguuugcaaagaaa

SEQ ID NO: 905462 - RNA, 19 nt, Homo sapiens
ggaauauucaguuacauca

SEQ ID NO: 905463 - RNA, 19 nt, Homo sapiens
ccauugaagugguauuugu

SEQ ID NO: 905464 - RNA, 19 nt, Homo sapiens
ggacacucaucauaacgau

SEQ ID NO: 905465 - RNA, 19 nt, Homo sapiens
gaugcguucuuaauacaga

SEQ ID NO: 905466 - RNA, 19 nt, Homo sapiens
guggaaaugucacaaccaa

SEQ ID NO: 905467 - RNA, 19 nt, Homo sapiens
uaauaacagucccauucaa

SEQ ID NO: 905468 - RNA, 19 nt, Homo sapiens
cauggaccuucaaugauaa

SEQ ID NO: 905469 - RNA, 19 nt, Homo sapiens
ggaaggcaaagcuccaauu

SEQ ID NO: 905470 - RNA, 19 nt, Homo sapiens
gcaaguauccauugaagaa

SEQ ID NO: 905471 - RNA, 19 nt, Homo sapiens
gagcagauacucuugauga

SEQ ID NO: 905472 - RNA, 19 nt, Homo sapiens
cagggacagucuucauuua

SEQ ID NO: 905473 - RNA, 19 nt, Homo sapiens
ggacagucuucauuuacuu

SEQ ID NO: 905474 - RNA, 19 nt, Homo sapiens
cgagauggaaggacacuua

SEQ ID NO: 905475 - RNA, 19 nt, Homo sapiens
cagcaacuacuucuuuaua

SEQ ID NO: 905476 - RNA, 19 nt, Homo sapiens
ggagaaauagacuuggaaa

SEQ ID NO: 905477 - RNA, 19 nt, Homo sapiens
gauggaaggacacuuauag

SEQ ID NO: 905478 - RNA, 19 nt, Homo sapiens
uuaaagaaacaguggcaua

SEQ ID NO: 905479 - RNA, 19 nt, Homo sapiens
cagcaaguauccauugaag

SEQ ID NO: 905480 - RNA, 19 nt, Homo sapiens
caaacuuagugcuacauca

SEQ ID NO: 905481 - RNA, 19 nt, Homo sapiens
cuucauaucccaaauuaga

SEQ ID NO: 905482 - RNA, 19 nt, Homo sapiens
ucacgcauuugaucacaga

SEQ ID NO: 905483 - RNA, 19 nt, Homo sapiens
gaaauagacuuggaaaagg

SEQ ID NO: 905484 - RNA, 19 nt, Homo sapiens
caccagcaacuacuucuuu

SEQ ID NO: 905485 - RNA, 19 nt, Homo sapiens
ugauauuccucgagggauu

SEQ ID NO: 905486 - RNA, 19 nt, Homo sapiens
gcacuugguucugcuucga

SEQ ID NO: 905487 - RNA, 19 nt, Homo sapiens
accagcaacuacuucuuua

SEQ ID NO: 905488 - RNA, 19 nt, Homo sapiens
uaaagaaacaguggcauag

SEQ ID NO: 905489 - RNA, 19 nt, Homo sapiens
uaugcaacaugaagaaauc

SEQ ID NO: 905490 - RNA, 19 nt, Homo sapiens
ggaagcagagaaguugaaa

SEQ ID NO: 905491 - RNA, 19 nt, Homo sapiens
uaggagaaauagacuugga

SEQ ID NO: 905492 - RNA, 19 nt, Homo sapiens
gcagcauuauuucaguuca

SEQ ID NO: 905493 - RNA, 19 nt, Homo sapiens
gggacagucuucauuuacu

SEQ ID NO: 905494 - RNA, 19 nt, Homo sapiens
gcuggaagcagagaaguug

SEQ ID NO: 905495 - RNA, 19 nt, Homo sapiens
caucgaggacauugacaaa

SEQ ID NO: 905496 - RNA, 19 nt, Homo sapiens
gcauagacuccuucacaca

SEQ ID NO: 905497 - RNA, 19 nt, Homo sapiens
gaugaguacuaaucuuuug

SEQ ID NO: 905498 - RNA, 19 nt, Homo sapiens
cagcauuauuucaguucaa

SEQ ID NO: 905499 - RNA, 19 nt, Homo sapiens
gauauuccucgagggauuu

SEQ ID NO: 905500 - RNA, 19 nt, Homo sapiens
acagggacagucuucauuu

SEQ ID NO: 905501 - RNA, 19 nt, Homo sapiens
aagcagagaaguugaaagu

SEQ ID NO: 905502 - RNA, 19 nt, Homo sapiens
gagauggaaggacacuuau

SEQ ID NO: 905503 - RNA, 19 nt, Homo sapiens
uggcauagacuccuucaca

SEQ ID NO: 905504 - RNA, 19 nt, Homo sapiens
gaaaaugugguccuacuag

SEQ ID NO: 905505 - RNA, 19 nt, Homo sapiens
caaguauccauugaagaaa

SEQ ID NO: 905506 - RNA, 19 nt, Homo sapiens
augaagaaaucguguaggu

SEQ ID NO: 905507 - RNA, 19 nt, Homo sapiens
gcauugcagcauuauuuca

SEQ ID NO: 905508 - RNA, 19 nt, Homo sapiens
ucaauuugcaaacuuagug

SEQ ID NO: 905509 - RNA, 19 nt, Homo sapiens
aagaaacaguggcauagac

SEQ ID NO: 905510 - RNA, 19 nt, Homo sapiens
aaggacacuuauaggcuuu

SEQ ID NO: 905511 - RNA, 19 nt, Homo sapiens
cuggccaccucacgcauuu

SEQ ID NO: 905512 - RNA, 19 nt, Homo sapiens
gacagucuucauuuacuug

SEQ ID NO: 905513 - RNA, 19 nt, Homo sapiens
guucuucauaucccaaauu

SEQ ID NO: 905514 - RNA, 19 nt, Homo sapiens
aaagaaacaguggcauaga

SEQ ID NO: 905515 - RNA, 19 nt, Homo sapiens
uuacauaugcaacaugaag

SEQ ID NO: 905516 - RNA, 19 nt, Homo sapiens
gagaaaaugugguccuacu

SEQ ID NO: 905517 - RNA, 19 nt, Homo sapiens
gcaaacuuagugcuacauc

SEQ ID NO: 905518 - RNA, 19 nt, Homo sapiens
cagucuucauuuacuugua

SEQ ID NO: 905519 - RNA, 19 nt, Homo sapiens
gguaggagggaagagguuu

SEQ ID NO: 905520 - RNA, 19 nt, Homo sapiens
gcaccagcaacuacuucuu

SEQ ID NO: 905521 - RNA, 19 nt, Homo sapiens
ggccaccucacgcauuuga

SEQ ID NO: 905522 - RNA, 19 nt, Homo sapiens
cauagacuccuucacacau

SEQ ID NO: 905523 - RNA, 19 nt, Homo sapiens
ccagcaaguauccauugaa

SEQ ID NO: 905524 - RNA, 19 nt, Homo sapiens
uagacuccuucacacauca

SEQ ID NO: 905525 - RNA, 19 nt, Homo sapiens
ucgagcagauacucuugau

SEQ ID NO: 905526 - RNA, 19 nt, Homo sapiens
aaauagacuuggaaaagga

SEQ ID NO: 905527 - RNA, 19 nt, Homo sapiens
uacagggacagucuucauu

SEQ ID NO: 905528 - RNA, 19 nt, Homo sapiens
acauaugcaacaugaagaa

SEQ ID NO: 905529 - RNA, 19 nt, Homo sapiens
uccagcaaguauccauuga

SEQ ID NO: 905530 - RNA, 19 nt, Homo sapiens
agauggaaggacacuuaua

SEQ ID NO: 905531 - RNA, 19 nt, Homo sapiens
ccaccucacgcauuugauc

SEQ ID NO: 905532 - RNA, 19 nt, Homo sapiens
gaucaauuugcaaacuuag

SEQ ID NO: 905533 - RNA, 19 nt, Homo sapiens
gcuggucucggucgggauu

SEQ ID NO: 905534 - RNA, 19 nt, Homo sapiens
gcagauaacucacaacuuc

SEQ ID NO: 905535 - RNA, 19 nt, Homo sapiens
agagaaaccugcauacauu

SEQ ID NO: 905536 - RNA, 19 nt, Homo sapiens
gaagaaacauaugaagaga

SEQ ID NO: 905537 - RNA, 19 nt, Homo sapiens
gaagaaacugugacuacua

SEQ ID NO: 905538 - RNA, 19 nt, Homo sapiens
caauaaauaugaccaccaa

SEQ ID NO: 905539 - RNA, 19 nt, Homo sapiens
gcagauuacaugcuuauga

SEQ ID NO: 905540 - RNA, 19 nt, Homo sapiens
gaauuuguccuguauggaa

SEQ ID NO: 905541 - RNA, 19 nt, Homo sapiens
aaacauggcggacgacgua

SEQ ID NO: 905542 - RNA, 19 nt, Homo sapiens
gaugagcgaauuuauguga

SEQ ID NO: 905543 - RNA, 19 nt, Homo sapiens
gcaacaaacuaccaacacu

SEQ ID NO: 905544 - RNA, 19 nt, Homo sapiens
ugaguugauuugcagauaa

SEQ ID NO: 905545 - RNA, 19 nt, Homo sapiens
ggaagaaacugugacuacu

SEQ ID NO: 905546 - RNA, 19 nt, Homo sapiens
cagauuacaugcuuaugau

SEQ ID NO: 905547 - RNA, 19 nt, Homo sapiens
aagaaacugugacuacuau

SEQ ID NO: 905548 - RNA, 19 nt, Homo sapiens
gagaaaccugcauacauuu

SEQ ID NO: 905549 - RNA, 19 nt, Homo sapiens
cauaagagaaaccugcaua

SEQ ID NO: 905550 - RNA, 19 nt, Homo sapiens
gauaacucacaacuucuua

SEQ ID NO: 905551 - RNA, 19 nt, Homo sapiens
gaaacugugacuacuauag

SEQ ID NO: 905552 - RNA, 19 nt, Homo sapiens
cgaggcagauuacaugcuu

SEQ ID NO: 905553 - RNA, 19 nt, Homo sapiens
gggaaagggcgcaggguuu

SEQ ID NO: 905554 - RNA, 19 nt, Homo sapiens
ggaaagggcgcaggguuug

SEQ ID NO: 905555 - RNA, 19 nt, Homo sapiens
gagaguuggcugaaacaaa

SEQ ID NO: 905556 - RNA, 19 nt, Homo sapiens
agaguuggcugaaacaaag

SEQ ID NO: 905557 - RNA, 19 nt, Homo sapiens
ugagcgaauuuaugugaaa

SEQ ID NO: 905558 - RNA, 19 nt, Homo sapiens
cagccuagaugagcgaauu

SEQ ID NO: 905559 - RNA, 19 nt, Homo sapiens
caagcucuccaauaaauau

SEQ ID NO: 905560 - RNA, 19 nt, Homo sapiens
ucacaacuucuuaagcuaa

SEQ ID NO: 905561 - RNA, 19 nt, Homo sapiens
guacaguggccucucuaaa

SEQ ID NO: 905562 - RNA, 19 nt, Homo sapiens
gaggcagauuacaugcuua

SEQ ID NO: 905563 - RNA, 19 nt, Homo sapiens
cucaagcucuccaauaaau

SEQ ID NO: 905564 - RNA, 19 nt, Homo sapiens
uagaugagcgaauuuaugu

SEQ ID NO: 905565 - RNA, 19 nt, Homo sapiens
cacaacuucuuaagcuaaa

SEQ ID NO: 905566 - RNA, 19 nt, Homo sapiens
ucaacgaaacggaauauuc

SEQ ID NO: 905567 - RNA, 19 nt, Homo sapiens
gaaaacgggagacuuugua

SEQ ID NO: 905568 - RNA, 19 nt, Homo sapiens
ugaagaaacauaugaagag

SEQ ID NO: 905569 - RNA, 19 nt, Homo sapiens
uggcugaaacaaagaauuu

SEQ ID NO: 905570 - RNA, 19 nt, Homo sapiens
gauuacaugcuuaugauca

SEQ ID NO: 905571 - RNA, 19 nt, Homo sapiens
gagaaaugaccgagagcuu

SEQ ID NO: 905572 - RNA, 19 nt, Homo sapiens
cgacguagaccagcaacaa

SEQ ID NO: 905573 - RNA, 19 nt, Homo sapiens
uucucaagcucuccaauaa

SEQ ID NO: 905574 - RNA, 19 nt, Homo sapiens
cuucuuaagcuaaauggua

SEQ ID NO: 905575 - RNA, 19 nt, Homo sapiens
gaauauuccaaugcucuuu

SEQ ID NO: 905576 - RNA, 19 nt, Homo sapiens
aaacugugacuacuauaga

SEQ ID NO: 905577 - RNA, 19 nt, Homo sapiens
gaaagggcgcaggguuuga

SEQ ID NO: 905578 - RNA, 19 nt, Homo sapiens
guagaccagcaacaaacua

SEQ ID NO: 905579 - RNA, 19 nt, Homo sapiens
caacuucuuaagcuaaaug

SEQ ID NO: 905580 - RNA, 19 nt, Homo sapiens
gaguugauuugcagauaac

SEQ ID NO: 905581 - RNA, 19 nt, Homo sapiens
aagaauuuguccuguaugg

SEQ ID NO: 905582 - RNA, 19 nt, Homo sapiens
gaugaagaaacauaugaag

SEQ ID NO: 905583 - RNA, 19 nt, Homo sapiens
gacguagaccagcaacaaa

SEQ ID NO: 905584 - RNA, 19 nt, Homo sapiens
ucaagcucuccaauaaaua

SEQ ID NO: 905585 - RNA, 19 nt, Homo sapiens
ggacgacguagaccagcaa

SEQ ID NO: 905586 - RNA, 19 nt, Homo sapiens
acucacaacuucuuaagcu

SEQ ID NO: 905587 - RNA, 19 nt, Homo sapiens
uaagagaaaccugcauaca

SEQ ID NO: 905588 - RNA, 19 nt, Homo sapiens
cuugggagauguggaagaa

SEQ ID NO: 905589 - RNA, 19 nt, Homo sapiens
cuagaugagcgaauuuaug

SEQ ID NO: 905590 - RNA, 19 nt, Homo sapiens
aagagaaaccugcauacau

SEQ ID NO: 905591 - RNA, 19 nt, Homo sapiens
uaaaucaacgaaacggaau

SEQ ID NO: 905592 - RNA, 19 nt, Homo sapiens
gagcuucgaggcagauuac

SEQ ID NO: 905593 - RNA, 19 nt, Homo sapiens
gaggagccccuggaucuua

SEQ ID NO: 905594 - RNA, 19 nt, Homo sapiens
uaacucacaacuucuuaag

SEQ ID NO: 905595 - RNA, 19 nt, Homo sapiens
gccuagaugagcgaauuua

SEQ ID NO: 905596 - RNA, 19 nt, Homo sapiens
gauguggaagaaacuguga

SEQ ID NO: 905597 - RNA, 19 nt, Homo sapiens
cuccugaaaugaguugauu

SEQ ID NO: 905598 - RNA, 19 nt, Homo sapiens
ccacugagaguuggcugaa

SEQ ID NO: 905599 - RNA, 19 nt, Homo sapiens
uuucucaagcucuccaaua

SEQ ID NO: 905600 - RNA, 19 nt, Homo sapiens
aauuuguccuguauggaaa

SEQ ID NO: 905601 - RNA, 19 nt, Homo sapiens
gagcgaauuuaugugaaaa

SEQ ID NO: 905602 - RNA, 19 nt, Homo sapiens
ugggagauguggaagaaac

SEQ ID NO: 905603 - RNA, 19 nt, Homo sapiens
ucucaagcucuccaauaaa

SEQ ID NO: 905604 - RNA, 19 nt, Homo sapiens
augaguugauuugcagaua

SEQ ID NO: 905605 - RNA, 19 nt, Homo sapiens
uggaagaaacugugacuac

SEQ ID NO: 905606 - RNA, 19 nt, Homo sapiens
agauggcguuguccugguu

SEQ ID NO: 905607 - RNA, 19 nt, Homo sapiens
aacugugacuacuauagaa

SEQ ID NO: 905608 - RNA, 19 nt, Homo sapiens
gaaaccugcauacauuuug

SEQ ID NO: 905609 - RNA, 19 nt, Homo sapiens
cagcaacaaacuaccaaca

SEQ ID NO: 905610 - RNA, 19 nt, Homo sapiens
acaaacuaccaacacugua

SEQ ID NO: 905611 - RNA, 19 nt, Homo sapiens
aaaucaacgaaacggaaua

SEQ ID NO: 905612 - RNA, 19 nt, Homo sapiens
gaaauaauuccggggauuc

SEQ ID NO: 905613 - RNA, 19 nt, Homo sapiens
gagauguggaagaaacugu

SEQ ID NO: 905614 - RNA, 19 nt, Homo sapiens
gaagagggaucaguaauua

SEQ ID NO: 905615 - RNA, 19 nt, Homo sapiens
caacgaaacugagauaaug

SEQ ID NO: 905616 - RNA, 19 nt, Homo sapiens
ggacagcaauggaaauguu

SEQ ID NO: 905617 - RNA, 19 nt, Homo sapiens
gcaagguacucgauucaaa

SEQ ID NO: 905618 - RNA, 19 nt, Homo sapiens
gggcaauacuguagaaauu

SEQ ID NO: 905619 - RNA, 19 nt, Homo sapiens
gggaaugacuuuagaagau

SEQ ID NO: 905620 - RNA, 19 nt, Homo sapiens
ucaaagauggucaacauua

SEQ ID NO: 905621 - RNA, 19 nt, Homo sapiens
caaagauggucaacauuau

SEQ ID NO: 905622 - RNA, 19 nt, Homo sapiens
gaauggcuauuucaggauu

SEQ ID NO: 905623 - RNA, 19 nt, Homo sapiens
gagcaugaaugaaaugaca

SEQ ID NO: 905624 - RNA, 19 nt, Homo sapiens
gcacaagggcagaaagaaa

SEQ ID NO: 905625 - RNA, 19 nt, Homo sapiens
ugaaaugacagcuucuuua

SEQ ID NO: 905626 - RNA, 19 nt, Homo sapiens
ggauggagaagcaguauuu

SEQ ID NO: 905627 - RNA, 19 nt, Homo sapiens
gaugaaccauaacauauca

SEQ ID NO: 905628 - RNA, 19 nt, Homo sapiens
ggaaugacuuuagaagaug

SEQ ID NO: 905629 - RNA, 19 nt, Homo sapiens
gcacagaauuacagccaau

SEQ ID NO: 905630 - RNA, 19 nt, Homo sapiens
ucucuuaucuuacuacaga

SEQ ID NO: 905631 - RNA, 19 nt, Homo sapiens
gcacaaauaaagaaucaga

SEQ ID NO: 905632 - RNA, 19 nt, Homo sapiens
cauguuaccagcacaaaua

SEQ ID NO: 905633 - RNA, 19 nt, Homo sapiens
gagaaaacguggacuggua

SEQ ID NO: 905634 - RNA, 19 nt, Homo sapiens
ucagacacaugcagucaaa

SEQ ID NO: 905635 - RNA, 19 nt, Homo sapiens
cagcacaaauaaagaauca

SEQ ID NO: 905636 - RNA, 19 nt, Homo sapiens
gaaauguucccagcaugua

SEQ ID NO: 905637 - RNA, 19 nt, Homo sapiens
aaagagaaguggaccuaga

SEQ ID NO: 905638 - RNA, 19 nt, Homo sapiens
gaagcaguauuuaucucaa

SEQ ID NO: 905639 - RNA, 19 nt, Homo sapiens
gaaaugacagcuucuuuac

SEQ ID NO: 905640 - RNA, 19 nt, Homo sapiens
gauggacagcacagaauua

SEQ ID NO: 905641 - RNA, 19 nt, Homo sapiens
caagggcaauacuguagaa

SEQ ID NO: 905642 - RNA, 19 nt, Homo sapiens
cgucauggaugcaauagug

SEQ ID NO: 905643 - RNA, 19 nt, Homo sapiens
gggauauacagacauguua

SEQ ID NO: 905644 - RNA, 19 nt, Homo sapiens
gugcuacugugauaaauuc

SEQ ID NO: 905645 - RNA, 19 nt, Homo sapiens
gggagagaauggcuauuuc

SEQ ID NO: 905646 - RNA, 19 nt, Homo sapiens
ggaccuagaggcuuauuuc

SEQ ID NO: 905647 - RNA, 19 nt, Homo sapiens
ggucaugccuuuaaguaac

SEQ ID NO: 905648 - RNA, 19 nt, Homo sapiens
cuaacaggaucuaucaaug

SEQ ID NO: 905649 - RNA, 19 nt, Homo sapiens
gcguugugcuacugugaua

SEQ ID NO: 905650 - RNA, 19 nt, Homo sapiens
uaacaggaucuaucaaugu

SEQ ID NO: 905651 - RNA, 19 nt, Homo sapiens
cuucaaagauggucaacau

SEQ ID NO: 905652 - RNA, 19 nt, Homo sapiens
ugaagagggaucaguaauu

SEQ ID NO: 905653 - RNA, 19 nt, Homo sapiens
gaaccgucauggaugcaau

SEQ ID NO: 905654 - RNA, 19 nt, Homo sapiens
ggagagaauggcuauuuca

SEQ ID NO: 905655 - RNA, 19 nt, Homo sapiens
gagcacaagggcagaaaga

SEQ ID NO: 905656 - RNA, 19 nt, Homo sapiens
agacagggauauacagaca

SEQ ID NO: 905657 - RNA, 19 nt, Homo sapiens
ggacagcacagaauuacag

SEQ ID NO: 905658 - RNA, 19 nt, Homo sapiens
caauaaaggagacuaugga

SEQ ID NO: 905659 - RNA, 19 nt, Homo sapiens
ggagaagcaguauuuaucu

SEQ ID NO: 905660 - RNA, 19 nt, Homo sapiens
aaguggaccuagaggcuua

SEQ ID NO: 905661 - RNA, 19 nt, Homo sapiens
agagggaucaguaauuaaa

SEQ ID NO: 905662 - RNA, 19 nt, Homo sapiens
agaauggccuccucacaca

SEQ ID NO: 905663 - RNA, 19 nt, Homo sapiens
ccuagaggcuuauuucacu

SEQ ID NO: 905664 - RNA, 19 nt, Homo sapiens
ggauggacagcacagaauu

SEQ ID NO: 905665 - RNA, 19 nt, Homo sapiens
gcucaggacagcaauggaa

SEQ ID NO: 905666 - RNA, 19 nt, Homo sapiens
ugugauaaauucugugaca

SEQ ID NO: 905667 - RNA, 19 nt, Homo sapiens
ucaaagagaaguggaccua

SEQ ID NO: 905668 - RNA, 19 nt, Homo sapiens
ucaauguucuccuccauac

SEQ ID NO: 905669 - RNA, 19 nt, Homo sapiens
gaagccaugucccaacaac

SEQ ID NO: 905670 - RNA, 19 nt, Homo sapiens
gauggagaagcaguauuua

SEQ ID NO: 905671 - RNA, 19 nt, Homo sapiens
gaaacugagauaaugaaag

SEQ ID NO: 905672 - RNA, 19 nt, Homo sapiens
gccaagaaccgucauggau

SEQ ID NO: 905673 - RNA, 19 nt, Homo sapiens
ccucagaauuugaucucuu

SEQ ID NO: 905674 - RNA, 19 nt, Homo sapiens
ggcaauacuguagaaauuu

SEQ ID NO: 905675 - RNA, 19 nt, Homo sapiens
ucugaugaaccauaacaua

SEQ ID NO: 905676 - RNA, 19 nt, Homo sapiens
acagggauauacagacaug

SEQ ID NO: 905677 - RNA, 19 nt, Homo sapiens
ccaacgaaacugagauaau

SEQ ID NO: 905678 - RNA, 19 nt, Homo sapiens
cuacugugauaaauucugu

SEQ ID NO: 905679 - RNA, 19 nt, Homo sapiens
gaaaacggcaugccacgaa

SEQ ID NO: 905680 - RNA, 19 nt, Homo sapiens
caggauucuucgaggagua

SEQ ID NO: 905681 - RNA, 19 nt, Homo sapiens
uaagacagggauauacaga

SEQ ID NO: 905682 - RNA, 19 nt, Homo sapiens
cuagaggcuuauuucacua

SEQ ID NO: 905683 - RNA, 19 nt, Homo sapiens
uguggcugcugaccgaaua

SEQ ID NO: 905684 - RNA, 19 nt, Homo sapiens
gcacuuugccaccuagucu

SEQ ID NO: 905685 - RNA, 19 nt, Homo sapiens
ccaaaaugcuaccaacaau

SEQ ID NO: 905686 - RNA, 19 nt, Homo sapiens
caggaucuaucaauguucu

SEQ ID NO: 905687 - RNA, 19 nt, Homo sapiens
aaugacagcuucuuuaccu

SEQ ID NO: 905688 - RNA, 19 nt, Homo sapiens
aggcuuauuucacuaggaa

SEQ ID NO: 905689 - RNA, 19 nt, Homo sapiens
uggaccaguucaagccaua

SEQ ID NO: 905690 - RNA, 19 nt, Homo sapiens
uaugaagagggaucaguaa

SEQ ID NO: 905691 - RNA, 19 nt, Homo sapiens
cgaaugcguugugcuacug

SEQ ID NO: 905692 - RNA, 19 nt, Homo sapiens
gcgaaugcguugugcuacu

SEQ ID NO: 905693 - RNA, 19 nt, Homo sapiens
gaaguuuagcaauaugaca

SEQ ID NO: 905694 - RNA, 19 nt, Homo sapiens
cugaugaaccauaacauau

SEQ ID NO: 905695 - RNA, 19 nt, Homo sapiens
uggagaagcaguauuuauc

SEQ ID NO: 905696 - RNA, 19 nt, Homo sapiens
aauaguggaagcaucgaua

SEQ ID NO: 905697 - RNA, 19 nt, Homo sapiens
cucagaauuugaucucuug

SEQ ID NO: 905698 - RNA, 19 nt, Homo sapiens
gggaucaguaauuaaagaa

SEQ ID NO: 905699 - RNA, 19 nt, Homo sapiens
agggaucaguaauuaaaga

SEQ ID NO: 905700 - RNA, 19 nt, Homo sapiens
guagaaauuuuggcuguug

SEQ ID NO: 905701 - RNA, 19 nt, Homo sapiens
cgaaacugagauaaugaaa

SEQ ID NO: 905702 - RNA, 19 nt, Homo sapiens
aaucuaacaggaucuauca

SEQ ID NO: 905703 - RNA, 19 nt, Homo sapiens
ggucaauaaaggagacuau

SEQ ID NO: 905704 - RNA, 19 nt, Homo sapiens
gcaguauuuaucucaaaga

SEQ ID NO: 905705 - RNA, 19 nt, Homo sapiens
aaagauggucaacauuaug

SEQ ID NO: 905706 - RNA, 19 nt, Homo sapiens
uggugacaguggaaucuuu

SEQ ID NO: 905707 - RNA, 19 nt, Homo sapiens
ugacauucuuggugacagu

SEQ ID NO: 905708 - RNA, 19 nt, Homo sapiens
aucgaaagcuucagacaca

SEQ ID NO: 905709 - RNA, 19 nt, Homo sapiens
cuccugagcaugaaugaaa

SEQ ID NO: 905710 - RNA, 19 nt, Homo sapiens
uuaugaagagggaucagua

SEQ ID NO: 905711 - RNA, 19 nt, Homo sapiens
aagauggucaacauuauga

SEQ ID NO: 905712 - RNA, 19 nt, Homo sapiens
uggaaucuuugucucuuca

SEQ ID NO: 905713 - RNA, 19 nt, Homo sapiens
gcaauaugacauucuuggu

SEQ ID NO: 905714 - RNA, 19 nt, Homo sapiens
gcacagagauuuaaagugu

SEQ ID NO: 905715 - RNA, 19 nt, Homo sapiens
gaacaacugucaaucuauu

SEQ ID NO: 905716 - RNA, 19 nt, Homo sapiens
gaacaaagggauuaaauug

SEQ ID NO: 905717 - RNA, 19 nt, Homo sapiens
gaagaacacccaauacuuu

SEQ ID NO: 905718 - RNA, 19 nt, Homo sapiens
gagaacaacugucaaucua

SEQ ID NO: 905719 - RNA, 19 nt, Homo sapiens
cgacugaucuucuuccuaa

SEQ ID NO: 905720 - RNA, 19 nt, Homo sapiens
ggaagaauaucuggagaaa

SEQ ID NO: 905721 - RNA, 19 nt, Homo sapiens
agaagaaccugaaugauga

SEQ ID NO: 905722 - RNA, 19 nt, Homo sapiens
uaucuuagcugccuguaaa

SEQ ID NO: 905723 - RNA, 19 nt, Homo sapiens
gagaagaaccugaaugaug

SEQ ID NO: 905724 - RNA, 19 nt, Homo sapiens
ggacaauccuuugguaaau

SEQ ID NO: 905725 - RNA, 19 nt, Homo sapiens
gaugagaucuuggauagga

SEQ ID NO: 905726 - RNA, 19 nt, Homo sapiens
aaacacaucuaccgacuga

SEQ ID NO: 905727 - RNA, 19 nt, Homo sapiens
gagauugucuguaguugau

SEQ ID NO: 905728 - RNA, 19 nt, Homo sapiens
gaaauaagagauugucugu

SEQ ID NO: 905729 - RNA, 19 nt, Homo sapiens
ugaaguugguccaugguua

SEQ ID NO: 905730 - RNA, 19 nt, Homo sapiens
gaaaagaucugaaguuggu

SEQ ID NO: 905731 - RNA, 19 nt, Homo sapiens
aauaagagauugucuguag

SEQ ID NO: 905732 - RNA, 19 nt, Homo sapiens
ugauuuaucuggcucguaa

SEQ ID NO: 905733 - RNA, 19 nt, Homo sapiens
gaaccugaaugaugagauc

SEQ ID NO: 905734 - RNA, 19 nt, Homo sapiens
gaaaacaauugcaagauga

SEQ ID NO: 905735 - RNA, 19 nt, Homo sapiens
ggaagaacacccaauacuu

SEQ ID NO: 905736 - RNA, 19 nt, Homo sapiens
gcuggugacuggaagaauu

SEQ ID NO: 905737 - RNA, 19 nt, Homo sapiens
caaaagauauucugcgaaa

SEQ ID NO: 905738 - RNA, 19 nt, Homo sapiens
caaagggauuaaauuguga

SEQ ID NO: 905739 - RNA, 19 nt, Homo sapiens
gggcaguuaugaauugauu

SEQ ID NO: 905740 - RNA, 19 nt, Homo sapiens
cgagggcaguuaugaauug

SEQ ID NO: 905741 - RNA, 19 nt, Homo sapiens
gaaacgagggcaguuauga

SEQ ID NO: 905742 - RNA, 19 nt, Homo sapiens
ggauuaagaacaucaggua

SEQ ID NO: 905743 - RNA, 19 nt, Homo sapiens
caucagguauagaacaauu

SEQ ID NO: 905744 - RNA, 19 nt, Homo sapiens
caucacaccucauuugaag

SEQ ID NO: 905745 - RNA, 19 nt, Homo sapiens
caaaggaggaaaucaagaa

SEQ ID NO: 905746 - RNA, 19 nt, Homo sapiens
gaacaucagguauagaaca

SEQ ID NO: 905747 - RNA, 19 nt, Homo sapiens
gacaauccuuugguaaauu

SEQ ID NO: 905748 - RNA, 19 nt, Homo sapiens
aaaggaagaacacccaaua

SEQ ID NO: 905749 - RNA, 19 nt, Homo sapiens
gauuuaaagugucuaaguc

SEQ ID NO: 905750 - RNA, 19 nt, Homo sapiens
ugaaagagaauccaaagga

SEQ ID NO: 905751 - RNA, 19 nt, Homo sapiens
ggaaaacaauugcaagaug

SEQ ID NO: 905752 - RNA, 19 nt, Homo sapiens
uagaacaauuggagaagaa

SEQ ID NO: 905753 - RNA, 19 nt, Homo sapiens
aaacugaacaaagggauua

SEQ ID NO: 905754 - RNA, 19 nt, Homo sapiens
gggauuaaauugugagaac

SEQ ID NO: 905755 - RNA, 19 nt, Homo sapiens
gaaaugacucucccuggau

SEQ ID NO: 905756 - RNA, 19 nt, Homo sapiens
gaaguugguccaugguuau

SEQ ID NO: 905757 - RNA, 19 nt, Homo sapiens
gcaguuaugaauugauuug

SEQ ID NO: 905758 - RNA, 19 nt, Homo sapiens
uagagaagaaccugaauga

SEQ ID NO: 905759 - RNA, 19 nt, Homo sapiens
gccuaugguuccugguuua

SEQ ID NO: 905760 - RNA, 19 nt, Homo sapiens
gaggaaaucaagaagauca

SEQ ID NO: 905761 - RNA, 19 nt, Homo sapiens
uagcagaccagaugacauu

SEQ ID NO: 905762 - RNA, 19 nt, Homo sapiens
aaaugacucucccuggauu

SEQ ID NO: 905763 - RNA, 19 nt, Homo sapiens
ccuguaaacucagugauug

SEQ ID NO: 905764 - RNA, 19 nt, Homo sapiens
gauugucuguaguugauug

SEQ ID NO: 905765 - RNA, 19 nt, Homo sapiens
uaagagauugucuguaguu

SEQ ID NO: 905766 - RNA, 19 nt, Homo sapiens
caaggauguuucagucuca

SEQ ID NO: 905767 - RNA, 19 nt, Homo sapiens
uuaagaacaucagguauag

SEQ ID NO: 905768 - RNA, 19 nt, Homo sapiens
gcgaaaagaucugaaguug

SEQ ID NO: 905769 - RNA, 19 nt, Homo sapiens
cauagcaaauccccuuuua

SEQ ID NO: 905770 - RNA, 19 nt, Homo sapiens
cauuugaagugaugaagga

SEQ ID NO: 905771 - RNA, 19 nt, Homo sapiens
ggccuaugguuccugguuu

SEQ ID NO: 905772 - RNA, 19 nt, Homo sapiens
uauccuaaaucagguacua

SEQ ID NO: 905773 - RNA, 19 nt, Homo sapiens
ggaaaucaagaagaucauu

SEQ ID NO: 905774 - RNA, 19 nt, Homo sapiens
guauagaacaauuggagaa

SEQ ID NO: 905775 - RNA, 19 nt, Homo sapiens
gaagaaauaagagauuguc

SEQ ID NO: 905776 - RNA, 19 nt, Homo sapiens
gauucuaaaugauggagau

SEQ ID NO: 905777 - RNA, 19 nt, Homo sapiens
gacaugauucuaaaugaug

SEQ ID NO: 905778 - RNA, 19 nt, Homo sapiens
cuacuuggguuagugaaau

SEQ ID NO: 905779 - RNA, 19 nt, Homo sapiens
acauugugauagccacuua

SEQ ID NO: 905780 - RNA, 19 nt, Homo sapiens
uaaaaugcuuuccccaaaa

SEQ ID NO: 905781 - RNA, 19 nt, Homo sapiens
gacucucccuggauuaaga

SEQ ID NO: 905782 - RNA, 19 nt, Homo sapiens
ggauuaaauugugagaaca

SEQ ID NO: 905783 - RNA, 19 nt, Homo sapiens
aagaacaucagguauagaa

SEQ ID NO: 905784 - RNA, 19 nt, Homo sapiens
gagggcaguuaugaauuga

SEQ ID NO: 905785 - RNA, 19 nt, Homo sapiens
gaagauaugaaagagaauc

SEQ ID NO: 905786 - RNA, 19 nt, Homo sapiens
cuaaaucagguacuacuug

SEQ ID NO: 905787 - RNA, 19 nt, Homo sapiens
gggaagaauaucuggagaa

SEQ ID NO: 905788 - RNA, 19 nt, Homo sapiens
cagaccagaugacauugug

SEQ ID NO: 905789 - RNA, 19 nt, Homo sapiens
cugaagaaauaagagauug

SEQ ID NO: 905790 - RNA, 19 nt, Homo sapiens
auacacaucuaccaacuac

SEQ ID NO: 905791 - RNA, 19 nt, Homo sapiens
aggaggaaaucaagaagau

SEQ ID NO: 905792 - RNA, 19 nt, Homo sapiens
gauaugaaagagaauccaa

SEQ ID NO: 905793 - RNA, 19 nt, Homo sapiens
gaacaauuggagaagaauc

SEQ ID NO: 905794 - RNA, 19 nt, Homo sapiens
gccagaaccaccaccguuu

SEQ ID NO: 905795 - RNA, 19 nt, Homo sapiens
ggacggcuggugacuggaa

SEQ ID NO: 905796 - RNA, 19 nt, Homo sapiens
augaugagaucuuggauag

SEQ ID NO: 905797 - RNA, 19 nt, Homo sapiens
ugucuguaguugauugaaa

SEQ ID NO: 905798 - RNA, 19 nt, Homo sapiens
ucagguacuacuuggguua

SEQ ID NO: 905799 - RNA, 19 nt, Homo sapiens
cagaugacauugugauagc

SEQ ID NO: 905800 - RNA, 19 nt, Homo sapiens
aaacgagggcaguuaugaa

SEQ ID NO: 905801 - RNA, 19 nt, Homo sapiens
gaucuucuuccuaaaucuu

SEQ ID NO: 905802 - RNA, 19 nt, Homo sapiens
uuaaaaugcuuuccccaaa

SEQ ID NO: 905803 - RNA, 19 nt, Homo sapiens
ucacaccucauuugaagug

SEQ ID NO: 905804 - RNA, 19 nt, Homo sapiens
acucagugauugcuacguu

SEQ ID NO: 905805 - RNA, 19 nt, Homo sapiens
uuagcugccuguaaacuca

SEQ ID NO: 905806 - RNA, 19 nt, Homo sapiens
ggauguuucagucucauau

SEQ ID NO: 905807 - RNA, 19 nt, Homo sapiens
guuccugguuuacucaugu

SEQ ID NO: 905808 - RNA, 19 nt, Homo sapiens
acagagauuuaaagugucu

SEQ ID NO: 905809 - RNA, 19 nt, Homo sapiens
ugaaugaugagaucuugga

SEQ ID NO: 905810 - RNA, 19 nt, Homo sapiens
ccugaaugaugagaucuug

SEQ ID NO: 905811 - RNA, 19 nt, Homo sapiens
ccaaaggaggaaaucaaga

SEQ ID NO: 905812 - RNA, 19 nt, Homo sapiens
aacaucagguauagaacaa

SEQ ID NO: 905813 - RNA, 19 nt, Homo sapiens
caauuccgcacagagauuu

SEQ ID NO: 905814 - RNA, 19 nt, Homo sapiens
gaaaggagguggugucugu

SEQ ID NO: 905815 - RNA, 19 nt, Homo sapiens
ggaaggagaugcuggacaa

SEQ ID NO: 905816 - RNA, 19 nt, Homo sapiens
ggagagaaaugaauggaau

SEQ ID NO: 905817 - RNA, 19 nt, Homo sapiens
aggaugagcugcauaaaga

SEQ ID NO: 905818 - RNA, 19 nt, Homo sapiens
guggacaccuucacacgua

SEQ ID NO: 905819 - RNA, 19 nt, Homo sapiens
gagcucaaguggcaagaga

SEQ ID NO: 905820 - RNA, 19 nt, Homo sapiens
gcagugggaugacuucagu

SEQ ID NO: 905821 - RNA, 19 nt, Homo sapiens
gaaggagggaggagagaaa

SEQ ID NO: 905822 - RNA, 19 nt, Homo sapiens
gagcggaggcugagaugaa

SEQ ID NO: 905823 - RNA, 19 nt, Homo sapiens
cgacgagguucaccagcua

SEQ ID NO: 905824 - RNA, 19 nt, Homo sapiens
aagaaggccuugcaacaga

SEQ ID NO: 905825 - RNA, 19 nt, Homo sapiens
gaaccugccucuggaugug

SEQ ID NO: 905826 - RNA, 19 nt, Homo sapiens
uggagaaaguguacaguga

SEQ ID NO: 905827 - RNA, 19 nt, Homo sapiens
gaaggacccuguggaggau

SEQ ID NO: 905828 - RNA, 19 nt, Homo sapiens
gagagaaaugaauggaaua

SEQ ID NO: 905829 - RNA, 19 nt, Homo sapiens
ggagggaggagagaaauga

SEQ ID NO: 905830 - RNA, 19 nt, Homo sapiens
cgagaucgaugcccugaca

SEQ ID NO: 905831 - RNA, 19 nt, Homo sapiens
ggccacugcucuaacuauu

SEQ ID NO: 905832 - RNA, 19 nt, Homo sapiens
gagcuggccuagccuugga

SEQ ID NO: 905833 - RNA, 19 nt, Homo sapiens
uggaauaaaugcagaggau

SEQ ID NO: 905834 - RNA, 19 nt, Homo sapiens
ggaggccacugcucuaacu

SEQ ID NO: 905835 - RNA, 19 nt, Homo sapiens
gaaggagucagcagagcaa

SEQ ID NO: 905836 - RNA, 19 nt, Homo sapiens
ccaacaaccagaccauuug

SEQ ID NO: 905837 - RNA, 19 nt, Homo sapiens
gaauaaaugcagaggaucu

SEQ ID NO: 905838 - RNA, 19 nt, Homo sapiens
gcaacgagaccaacaacca

SEQ ID NO: 905839 - RNA, 19 nt, Homo sapiens
acuaacagcuaccugcuau

SEQ ID NO: 905840 - RNA, 19 nt, Homo sapiens
ucaaguggcaagagaagaa

SEQ ID NO: 905841 - RNA, 19 nt, Homo sapiens
caacggaauuugccuucag

SEQ ID NO: 905842 - RNA, 19 nt, Homo sapiens
ccacugcucuaacuauugc

SEQ ID NO: 905843 - RNA, 19 nt, Homo sapiens
agauuuagaugccgagauc

SEQ ID NO: 905844 - RNA, 19 nt, Homo sapiens
uggagaggauugauacugu

SEQ ID NO: 905845 - RNA, 19 nt, Homo sapiens
gccugaagcugucccauac

SEQ ID NO: 905846 - RNA, 19 nt, Homo sapiens
gagaguugcaacggaauuu

SEQ ID NO: 905847 - RNA, 19 nt, Homo sapiens
ggcaagagaagaauaccuu

SEQ ID NO: 905848 - RNA, 19 nt, Homo sapiens
gaggcugucucucucucaa

SEQ ID NO: 905849 - RNA, 19 nt, Homo sapiens
auaaagagguggaggucau

SEQ ID NO: 905850 - RNA, 19 nt, Homo sapiens
gaggaugagcugcauaaag

SEQ ID NO: 905851 - RNA, 19 nt, Homo sapiens
aggaggaucugcgcacaaa

SEQ ID NO: 905852 - RNA, 19 nt, Homo sapiens
acaucucgcugaagguuga

SEQ ID NO: 905853 - RNA, 19 nt, Homo sapiens
gggaggagagaaaugaaug

SEQ ID NO: 905854 - RNA, 19 nt, Homo sapiens
aaccaucgcugcccugaag

SEQ ID NO: 905855 - RNA, 19 nt, Homo sapiens
agaaggccuugcaacagaa

SEQ ID NO: 905856 - RNA, 19 nt, Homo sapiens
ggaaggagggaggagagaa

SEQ ID NO: 905857 - RNA, 19 nt, Homo sapiens
ucacacguaccacaaauag

SEQ ID NO: 905858 - RNA, 19 nt, Homo sapiens
ggagauggagaaaguguac

SEQ ID NO: 905859 - RNA, 19 nt, Homo sapiens
gagggaggccacugcucua

SEQ ID NO: 905860 - RNA, 19 nt, Homo sapiens
ucagucgguucaacaagga

SEQ ID NO: 905861 - RNA, 19 nt, Homo sapiens
aaacaucucgcugaagguu

SEQ ID NO: 905862 - RNA, 19 nt, Homo sapiens
uuucugacccuucugguuu

SEQ ID NO: 905863 - RNA, 19 nt, Homo sapiens
acacguaccacaaauagca

SEQ ID NO: 905864 - RNA, 19 nt, Homo sapiens
gaacaggccuagggguuuc

SEQ ID NO: 905865 - RNA, 19 nt, Homo sapiens
aggagaugcuggacaagug

SEQ ID NO: 905866 - RNA, 19 nt, Homo sapiens
ccauuugggaugaacauga

SEQ ID NO: 905867 - RNA, 19 nt, Homo sapiens
uaccugcuauccaccaaug

SEQ ID NO: 905868 - RNA, 19 nt, Homo sapiens
ucgaugcccugacacagau

SEQ ID NO: 905869 - RNA, 19 nt, Homo sapiens
ggagaugcuggacaagugu

SEQ ID NO: 905870 - RNA, 19 nt, Homo sapiens
gggaugaacaugacaacag

SEQ ID NO: 905871 - RNA, 19 nt, Homo sapiens
aaaugcagaggaucucaaa

SEQ ID NO: 905872 - RNA, 19 nt, Homo sapiens
gagguggugucugugaaca

SEQ ID NO: 905873 - RNA, 19 nt, Homo sapiens
agaauaccuuggaggagau

SEQ ID NO: 905874 - RNA, 19 nt, Homo sapiens
uggaggaugagcugcauaa

SEQ ID NO: 905875 - RNA, 19 nt, Homo sapiens
gagaggauugauacuguca

SEQ ID NO: 905876 - RNA, 19 nt, Homo sapiens
gaccaacaaccagaccauu

SEQ ID NO: 905877 - RNA, 19 nt, Homo sapiens
gggagauggagaaagugua

SEQ ID NO: 905878 - RNA, 19 nt, Homo sapiens
gaccaacaacgagcuugaa

SEQ ID NO: 905879 - RNA, 19 nt, Homo sapiens
uaacuauugcugagaccaa

SEQ ID NO: 905880 - RNA, 19 nt, Homo sapiens
gaggagagaaaugaaugga

SEQ ID NO: 905881 - RNA, 19 nt, Homo sapiens
gagggaggagagaaaugaa

SEQ ID NO: 905882 - RNA, 19 nt, Homo sapiens
ugacccuucugguuucugu

SEQ ID NO: 905883 - RNA, 19 nt, Homo sapiens
ugcgggagauggagaaagu

SEQ ID NO: 905884 - RNA, 19 nt, Homo sapiens
caacaaccagaccauuugg

SEQ ID NO: 905885 - RNA, 19 nt, Homo sapiens
ucaucgaggccaccaagaa

SEQ ID NO: 905886 - RNA, 19 nt, Homo sapiens
ggaggaugagcugcauaaa

SEQ ID NO: 905887 - RNA, 19 nt, Homo sapiens
cuucacacguaccacaaau

SEQ ID NO: 905888 - RNA, 19 nt, Homo sapiens
ccaugcugcuggacaccaa

SEQ ID NO: 905889 - RNA, 19 nt, Homo sapiens
aagagaagaauaccuugga

SEQ ID NO: 905890 - RNA, 19 nt, Homo sapiens
gacacuagagaucgacaga

SEQ ID NO: 905891 - RNA, 19 nt, Homo sapiens
ccagaccauuugggaugaa

SEQ ID NO: 905892 - RNA, 19 nt, Homo sapiens
uaaaugcagaggaucucaa

SEQ ID NO: 905893 - RNA, 19 nt, Homo sapiens
ggaggagagaaaugaaugg

SEQ ID NO: 905894 - RNA, 19 nt, Homo sapiens
gcuaccugcuauccaccaa

SEQ ID NO: 905895 - RNA, 19 nt, Homo sapiens
gaggaggaucugcgcacaa

SEQ ID NO: 905896 - RNA, 19 nt, Homo sapiens
gcucaaguggcaagagaag

SEQ ID NO: 905897 - RNA, 19 nt, Homo sapiens
caucgaggccaccaagaag

SEQ ID NO: 905898 - RNA, 19 nt, Homo sapiens
accaacaaccagaccauuu

SEQ ID NO: 905899 - RNA, 19 nt, Homo sapiens
cgacugguggagaggauug

SEQ ID NO: 905900 - RNA, 19 nt, Homo sapiens
gaaauugacugcucgagua

SEQ ID NO: 905901 - RNA, 19 nt, Homo sapiens
gaggaaaucuucacauuca

SEQ ID NO: 905902 - RNA, 19 nt, Homo sapiens
gagagcaugugauucguua

SEQ ID NO: 905903 - RNA, 19 nt, Homo sapiens
gcacuaccauucaucacua

SEQ ID NO: 905904 - RNA, 19 nt, Homo sapiens
gaugaaagcuacaaugaag

SEQ ID NO: 905905 - RNA, 19 nt, Homo sapiens
gacaaauccugcaguguuu

SEQ ID NO: 905906 - RNA, 19 nt, Homo sapiens
guugugagcucuccuguga

SEQ ID NO: 905907 - RNA, 19 nt, Homo sapiens
caaauggagugcuucuuga

SEQ ID NO: 905908 - RNA, 19 nt, Homo sapiens
ccgaugguguuauacauua

SEQ ID NO: 905909 - RNA, 19 nt, Homo sapiens
gggaaaagcuccucuaguu

SEQ ID NO: 905910 - RNA, 19 nt, Homo sapiens
uguaauaguuucccuagaa

SEQ ID NO: 905911 - RNA, 19 nt, Homo sapiens
gaaagauucugcugauggu

SEQ ID NO: 905912 - RNA, 19 nt, Homo sapiens
gaaacugggaccuaauaaa

SEQ ID NO: 905913 - RNA, 19 nt, Homo sapiens
gaagcuagguagggacuga

SEQ ID NO: 905914 - RNA, 19 nt, Homo sapiens
ggaaggaggucggugcaau

SEQ ID NO: 905915 - RNA, 19 nt, Homo sapiens
aacuauagcuucagggaua

SEQ ID NO: 905916 - RNA, 19 nt, Homo sapiens
gagcagagaggaaggagaa

SEQ ID NO: 905917 - RNA, 19 nt, Homo sapiens
ggugaaagauucugcugau

SEQ ID NO: 905918 - RNA, 19 nt, Homo sapiens
ccgaggaaaucuucacauu

SEQ ID NO: 905919 - RNA, 19 nt, Homo sapiens
aaacagaucccauauuucu

SEQ ID NO: 905920 - RNA, 19 nt, Homo sapiens
gaaaucuucacauucauug

SEQ ID NO: 905921 - RNA, 19 nt, Homo sapiens
ggaaaucuucacauucauu

SEQ ID NO: 905922 - RNA, 19 nt, Homo sapiens
ugacaaauccugcaguguu

SEQ ID NO: 905923 - RNA, 19 nt, Homo sapiens
gcacuuacaccugcacaaa

SEQ ID NO: 905924 - RNA, 19 nt, Homo sapiens
ccaccaaucugugcuccua

SEQ ID NO: 905925 - RNA, 19 nt, Homo sapiens
cgaaggagagcaugugauu

SEQ ID NO: 905926 - RNA, 19 nt, Homo sapiens
ugaaagcuacaaugaagua

SEQ ID NO: 905927 - RNA, 19 nt, Homo sapiens
gaugagaugccacgcacua

SEQ ID NO: 905928 - RNA, 19 nt, Homo sapiens
ucucuuggaucaauucuau

SEQ ID NO: 905929 - RNA, 19 nt, Homo sapiens
gugcuccuaugaagauuaa

SEQ ID NO: 905930 - RNA, 19 nt, Homo sapiens
gagagaggaauaacuauag

SEQ ID NO: 905931 - RNA, 19 nt, Homo sapiens
gggauaauauagcuuuaag

SEQ ID NO: 905932 - RNA, 19 nt, Homo sapiens
ucgaggagcucaggcaauu

SEQ ID NO: 905933 - RNA, 19 nt, Homo sapiens
ggaugaaagcuacaaugaa

SEQ ID NO: 905934 - RNA, 19 nt, Homo sapiens
cuaggaauguuaaaguaga

SEQ ID NO: 905935 - RNA, 19 nt, Homo sapiens
ugagagaggaauaacuaua

SEQ ID NO: 905936 - RNA, 19 nt, Homo sapiens
ggaaaagcuccucuaguua

SEQ ID NO: 905937 - RNA, 19 nt, Homo sapiens
aaacagcgacuccucauca

SEQ ID NO: 905938 - RNA, 19 nt, Homo sapiens
ccagucagcuaacucaaag

SEQ ID NO: 905939 - RNA, 19 nt, Homo sapiens
gaaagaggaggagagagaa

SEQ ID NO: 905940 - RNA, 19 nt, Homo sapiens
guaauaguuucccuagaag

SEQ ID NO: 905941 - RNA, 19 nt, Homo sapiens
ggagaaagaggaggagaga

SEQ ID NO: 905942 - RNA, 19 nt, Homo sapiens
ccacugugauggcgguuau

SEQ ID NO: 905943 - RNA, 19 nt, Homo sapiens
gaaggaggucggugcaaug

SEQ ID NO: 905944 - RNA, 19 nt, Homo sapiens
guuaauugauggcugacuu

SEQ ID NO: 905945 - RNA, 19 nt, Homo sapiens
uuaggacuguguaauaguu

SEQ ID NO: 905946 - RNA, 19 nt, Homo sapiens
aggaauaacuauagcuuca

SEQ ID NO: 905947 - RNA, 19 nt, Homo sapiens
auugauggcugacuucuga

SEQ ID NO: 905948 - RNA, 19 nt, Homo sapiens
gcccagcucuccaaagucu

SEQ ID NO: 905949 - RNA, 19 nt, Homo sapiens
acaaauggagugcuucuug

SEQ ID NO: 905950 - RNA, 19 nt, Homo sapiens
agaaagaggaggagagaga

SEQ ID NO: 905951 - RNA, 19 nt, Homo sapiens
gaaaagcuccucuaguuag

SEQ ID NO: 905952 - RNA, 19 nt, Homo sapiens
cagggauaauauagcuuua

SEQ ID NO: 905953 - RNA, 19 nt, Homo sapiens
cuaugaagauuaacgucaa

SEQ ID NO: 905954 - RNA, 19 nt, Homo sapiens
ccauauacaucuuuucuug

SEQ ID NO: 905955 - RNA, 19 nt, Homo sapiens
gggcaugguuaaagucaag

SEQ ID NO: 905956 - RNA, 19 nt, Homo sapiens
gcagaucucuaugcuacag

SEQ ID NO: 905957 - RNA, 19 nt, Homo sapiens
gcagagccagagaaauuga

SEQ ID NO: 905958 - RNA, 19 nt, Homo sapiens
ccauaauccucccuuucaa

SEQ ID NO: 905959 - RNA, 19 nt, Homo sapiens
gaggagcucaggcaauuuc

SEQ ID NO: 905960 - RNA, 19 nt, Homo sapiens
gugagacgcugcccaacuc

SEQ ID NO: 905961 - RNA, 19 nt, Homo sapiens
ucugagagaggaauaacua

SEQ ID NO: 905962 - RNA, 19 nt, Homo sapiens
ucagggauaauauagcuuu

SEQ ID NO: 905963 - RNA, 19 nt, Homo sapiens
gcaugugaccaucauugaa

SEQ ID NO: 905964 - RNA, 19 nt, Homo sapiens
gcuggucucuuggaucaau

SEQ ID NO: 905965 - RNA, 19 nt, Homo sapiens
ggcuuucgauugauuggaa

SEQ ID NO: 905966 - RNA, 19 nt, Homo sapiens
cgaugguguuauacauuaa

SEQ ID NO: 905967 - RNA, 19 nt, Homo sapiens
cggaugaaagcuacaauga

SEQ ID NO: 905968 - RNA, 19 nt, Homo sapiens
ggacauaugcgagugaacu

SEQ ID NO: 905969 - RNA, 19 nt, Homo sapiens
cguaacaucugggcagugu

SEQ ID NO: 905970 - RNA, 19 nt, Homo sapiens
uagcuucagggauaauaua

SEQ ID NO: 905971 - RNA, 19 nt, Homo sapiens
gccagggcaugguuaaagu

SEQ ID NO: 905972 - RNA, 19 nt, Homo sapiens
uuucaaggauggccaguca

SEQ ID NO: 905973 - RNA, 19 nt, Homo sapiens
gagcaugugauucguuaca

SEQ ID NO: 905974 - RNA, 19 nt, Homo sapiens
ggagagcaugugauucguu

SEQ ID NO: 905975 - RNA, 19 nt, Homo sapiens
acuuacaccugcacaaaug

SEQ ID NO: 905976 - RNA, 19 nt, Homo sapiens
gcuacuauccggaugaaag

SEQ ID NO: 905977 - RNA, 19 nt, Homo sapiens
cugaaacugggaccuaaua

SEQ ID NO: 905978 - RNA, 19 nt, Homo sapiens
cugcuggucucuuggauca

SEQ ID NO: 905979 - RNA, 19 nt, Homo sapiens
aaucugugcuccuaugaag

SEQ ID NO: 905980 - RNA, 19 nt, Homo sapiens
cagagaggaaggagaaaga

SEQ ID NO: 905981 - RNA, 19 nt, Homo sapiens
caccgaagggaggaaauua

SEQ ID NO: 905982 - RNA, 19 nt, Homo sapiens
uuucugcuguucuuccuaa

SEQ ID NO: 905983 - RNA, 19 nt, Homo sapiens
aaacugggaccuaauaaaa

SEQ ID NO: 905984 - RNA, 19 nt, Homo sapiens
ugaaacugggaccuaauaa

SEQ ID NO: 905985 - RNA, 19 nt, Homo sapiens
cgaggaaaucuucacauuc

SEQ ID NO: 905986 - RNA, 19 nt, Homo sapiens
ugaccgagaccgcuacaug

SEQ ID NO: 905987 - RNA, 19 nt, Homo sapiens
gagccacucguucuaggaa

SEQ ID NO: 905988 - RNA, 19 nt, Homo sapiens
ggugaucgcagccgaaucu

SEQ ID NO: 905989 - RNA, 19 nt, Homo sapiens
cauaugcgagugaacuuga

SEQ ID NO: 905990 - RNA, 19 nt, Homo sapiens
gggcaguguuaacagaauc

SEQ ID NO: 905991 - RNA, 19 nt, Homo sapiens
ucuaaucccuguguuccuu

SEQ ID NO: 905992 - RNA, 19 nt, Homo sapiens
gaaacagcgacuccucauc

SEQ ID NO: 905993 - RNA, 19 nt, Homo sapiens
gccagucagcuaacucaaa

SEQ ID NO: 905994 - RNA, 19 nt, Homo sapiens
ugguuaaagucaagggaaa

SEQ ID NO: 905995 - RNA, 19 nt, Homo sapiens
cuuccaaccgauauuauaa

SEQ ID NO: 905996 - RNA, 19 nt, Homo sapiens
uuggaucaauucuaugaga

SEQ ID NO: 905997 - RNA, 19 nt, Homo sapiens
gccacucguucuaggaaug

SEQ ID NO: 905998 - RNA, 19 nt, Homo sapiens
gugaaagauucugcugaug

SEQ ID NO: 905999 - RNA, 19 nt, Homo sapiens
auugaugacuaccuacuga

SEQ ID NO: 906000 - RNA, 19 nt, Homo sapiens
gaacaaaggugaacaugaa

SEQ ID NO: 906001 - RNA, 19 nt, Homo sapiens
ggacucaguuguucuguuu

SEQ ID NO: 906002 - RNA, 19 nt, Homo sapiens
ggagauuacuggagaauau

SEQ ID NO: 906003 - RNA, 19 nt, Homo sapiens
gaaugcagguguguuuaua

SEQ ID NO: 906004 - RNA, 19 nt, Homo sapiens
gaaagagucgguuuaggaa

SEQ ID NO: 906005 - RNA, 19 nt, Homo sapiens
ucucagagguccagauaaa

SEQ ID NO: 906006 - RNA, 19 nt, Homo sapiens
acacaaagguucuggagau

SEQ ID NO: 906007 - RNA, 19 nt, Homo sapiens
guuguaagcuuugugugua

SEQ ID NO: 906008 - RNA, 19 nt, Homo sapiens
gcugagggcugcucuucuu

SEQ ID NO: 906009 - RNA, 19 nt, Homo sapiens
gcacagccuucaccaugga

SEQ ID NO: 906010 - RNA, 19 nt, Homo sapiens
gcucguuucucccuuguug

SEQ ID NO: 906011 - RNA, 19 nt, Homo sapiens
cgaaagagucgguuuagga

SEQ ID NO: 906012 - RNA, 19 nt, Homo sapiens
ccaaguagcuaggauuaca

SEQ ID NO: 906013 - RNA, 19 nt, Homo sapiens
ggaacaaaggugaacauga

SEQ ID NO: 906014 - RNA, 19 nt, Homo sapiens
caaagguucuggagauuac

SEQ ID NO: 906015 - RNA, 19 nt, Homo sapiens
caguaaagguuguaagcuu

SEQ ID NO: 906016 - RNA, 19 nt, Homo sapiens
gaaagcaggagggaacaaa

SEQ ID NO: 906017 - RNA, 19 nt, Homo sapiens
ucaagucccucuuaacaag

SEQ ID NO: 906018 - RNA, 19 nt, Homo sapiens
ggagugcaaugacgcaauc

SEQ ID NO: 906019 - RNA, 19 nt, Homo sapiens
aaagccaccucuucacuga

SEQ ID NO: 906020 - RNA, 19 nt, Homo sapiens
gcacugauuuguggaugug

SEQ ID NO: 906021 - RNA, 19 nt, Homo sapiens
ggaaugcagguguguuuau

SEQ ID NO: 906022 - RNA, 19 nt, Homo sapiens
gcagcagccucgggacaaa

SEQ ID NO: 906023 - RNA, 19 nt, Homo sapiens
ggaaacgaagggucaguga

SEQ ID NO: 906024 - RNA, 19 nt, Homo sapiens
caacuggcaugugcuuuua

SEQ ID NO: 906025 - RNA, 19 nt, Homo sapiens
caugaaaccugagacaagu

SEQ ID NO: 906026 - RNA, 19 nt, Homo sapiens
gaaacgaagggucagugaa

SEQ ID NO: 906027 - RNA, 19 nt, Homo sapiens
gagauuacuggagaauaua

SEQ ID NO: 906028 - RNA, 19 nt, Homo sapiens
gcaugaaaccugagacaag

SEQ ID NO: 906029 - RNA, 19 nt, Homo sapiens
gcccugagaauauauuuau

SEQ ID NO: 906030 - RNA, 19 nt, Homo sapiens
guucaagucccucuuaaca

SEQ ID NO: 906031 - RNA, 19 nt, Homo sapiens
ggaaacaguaaagguugua

SEQ ID NO: 906032 - RNA, 19 nt, Homo sapiens
caagugcaauuccuuccau

SEQ ID NO: 906033 - RNA, 19 nt, Homo sapiens
gaaacaguaaagguuguaa

SEQ ID NO: 906034 - RNA, 19 nt, Homo sapiens
ucacugaaaguuaccgaaa

SEQ ID NO: 906035 - RNA, 19 nt, Homo sapiens
acaaagguucuggagauua

SEQ ID NO: 906036 - RNA, 19 nt, Homo sapiens
cacaaagguucuggagauu

SEQ ID NO: 906037 - RNA, 19 nt, Homo sapiens
agagucaaaugcagaagug

SEQ ID NO: 906038 - RNA, 19 nt, Homo sapiens
acugaaaguuaccgaaaga

SEQ ID NO: 906039 - RNA, 19 nt, Homo sapiens
gggaaugcagguguguuua

SEQ ID NO: 906040 - RNA, 19 nt, Homo sapiens
gaaacacaaacggcaaaug

SEQ ID NO: 906041 - RNA, 19 nt, Homo sapiens
cagaaucgccgcaugaaac

SEQ ID NO: 906042 - RNA, 19 nt, Homo sapiens
gagugacaaugugacagaa

SEQ ID NO: 906043 - RNA, 19 nt, Homo sapiens
uaacaagaacuccaaagcu

SEQ ID NO: 906044 - RNA, 19 nt, Homo sapiens
guuggaaacaguaaagguu

SEQ ID NO: 906045 - RNA, 19 nt, Homo sapiens
aaacacaaacggcaaaugc

SEQ ID NO: 906046 - RNA, 19 nt, Homo sapiens
cgagugacaaugugacaga

SEQ ID NO: 906047 - RNA, 19 nt, Homo sapiens
gugguucaagucccucuua

SEQ ID NO: 906048 - RNA, 19 nt, Homo sapiens
ugaguaaggagccaaauac

SEQ ID NO: 906049 - RNA, 19 nt, Homo sapiens
gagacaagugcaauuccuu

SEQ ID NO: 906050 - RNA, 19 nt, Homo sapiens
ccaaagugcugggauuacg

SEQ ID NO: 906051 - RNA, 19 nt, Homo sapiens
ucccaaguagcuaggauua

SEQ ID NO: 906052 - RNA, 19 nt, Homo sapiens
ggaggacucaguuguucug

SEQ ID NO: 906053 - RNA, 19 nt, Homo sapiens
uauuaaagccaccucuuca

SEQ ID NO: 906054 - RNA, 19 nt, Homo sapiens
guagcuaggauuacagaca

SEQ ID NO: 906055 - RNA, 19 nt, Homo sapiens
ggacucccgcguugaugga

SEQ ID NO: 906056 - RNA, 19 nt, Homo sapiens
agccucagccucccaagua

SEQ ID NO: 906057 - RNA, 19 nt, Homo sapiens
ggccuggacagcacugauu

SEQ ID NO: 906058 - RNA, 19 nt, Homo sapiens
gguuguaagcuuugugugu

SEQ ID NO: 906059 - RNA, 19 nt, Homo sapiens
ggcuuucggcguacgauaa

SEQ ID NO: 906060 - RNA, 19 nt, Homo sapiens
aaacgaagggucagugaac

SEQ ID NO: 906061 - RNA, 19 nt, Homo sapiens
caguuguucuguuuacauc

SEQ ID NO: 906062 - RNA, 19 nt, Homo sapiens
ucagaaucgccgcaugaaa

SEQ ID NO: 906063 - RNA, 19 nt, Homo sapiens
ggaaagcaggagggaacaa

SEQ ID NO: 906064 - RNA, 19 nt, Homo sapiens
uggaaacaguaaagguugu

SEQ ID NO: 906065 - RNA, 19 nt, Homo sapiens
gcuuucggcguacgauaaa

SEQ ID NO: 906066 - RNA, 19 nt, Homo sapiens
ggcccugagaauauauuua

SEQ ID NO: 906067 - RNA, 19 nt, Homo sapiens
ccuccuggguucaagcaau

SEQ ID NO: 906068 - RNA, 19 nt, Homo sapiens
ugguucaagucccucuuaa

SEQ ID NO: 906069 - RNA, 19 nt, Homo sapiens
cgaagggucagugaacaga

SEQ ID NO: 906070 - RNA, 19 nt, Homo sapiens
cuccuggguucaagcaauu

SEQ ID NO: 906071 - RNA, 19 nt, Homo sapiens
ucagugaacagagucaaau

SEQ ID NO: 906072 - RNA, 19 nt, Homo sapiens
ugaaaguuaccgaaagagu

SEQ ID NO: 906073 - RNA, 19 nt, Homo sapiens
uugaguaaggagccaaaua

SEQ ID NO: 906074 - RNA, 19 nt, Homo sapiens
cuggaggacucaguuguuc

SEQ ID NO: 906075 - RNA, 19 nt, Homo sapiens
cagaagugggcuugucaug

SEQ ID NO: 906076 - RNA, 19 nt, Homo sapiens
cacugaaaguuaccgaaag

SEQ ID NO: 906077 - RNA, 19 nt, Homo sapiens
ccucaggccgucagcauca

SEQ ID NO: 906078 - RNA, 19 nt, Homo sapiens
gggaacaaaggugaacaug

SEQ ID NO: 906079 - RNA, 19 nt, Homo sapiens
gugaacagagucaaaugca

SEQ ID NO: 906080 - RNA, 19 nt, Homo sapiens
gcaagucccuggaugguaa

SEQ ID NO: 906081 - RNA, 19 nt, Homo sapiens
guacuagucuucuuacauu

SEQ ID NO: 906082 - RNA, 19 nt, Homo sapiens
gcaaacaguucuaagaucu

SEQ ID NO: 906083 - RNA, 19 nt, Homo sapiens
cuucuucccuuguaaauuu

SEQ ID NO: 906084 - RNA, 19 nt, Homo sapiens
agaagaaccuguuguaugg

SEQ ID NO: 906085 - RNA, 19 nt, Homo sapiens
guuaagaucgucuccauuu

SEQ ID NO: 906086 - RNA, 19 nt, Homo sapiens
auaaacaucugcucaccua

SEQ ID NO: 906087 - RNA, 19 nt, Homo sapiens
uauaugaaccugaguacua

SEQ ID NO: 906088 - RNA, 19 nt, Homo sapiens
uaacguuucuuucaacaag

SEQ ID NO: 906089 - RNA, 19 nt, Homo sapiens
uaaaugaggcaaacaguuc

SEQ ID NO: 906090 - RNA, 19 nt, Homo sapiens
guagaaauucgauuaaugg

SEQ ID NO: 906091 - RNA, 19 nt, Homo sapiens
gaaccugaguacuagucuu

SEQ ID NO: 906092 - RNA, 19 nt, Homo sapiens
aagaaccuguuguauggua

SEQ ID NO: 906093 - RNA, 19 nt, Homo sapiens
ggcaaacaguucuaagauc

SEQ ID NO: 906094 - RNA, 19 nt, Homo sapiens
aaacaucugcucaccuaaa

SEQ ID NO: 906095 - RNA, 19 nt, Homo sapiens
gaggcaaacaguucuaaga

SEQ ID NO: 906096 - RNA, 19 nt, Homo sapiens
agaauuuccuguuaagauc

SEQ ID NO: 906097 - RNA, 19 nt, Homo sapiens
gaucuuugauaaacaucug

SEQ ID NO: 906098 - RNA, 19 nt, Homo sapiens
gagagcccuuugagagcua

SEQ ID NO: 906099 - RNA, 19 nt, Homo sapiens
aagaagaaccuguuguaug

SEQ ID NO: 906100 - RNA, 19 nt, Homo sapiens
gaucgugggcucucucugu

SEQ ID NO: 906101 - RNA, 19 nt, Homo sapiens
gaggaggccggagcagaua

SEQ ID NO: 906102 - RNA, 19 nt, Homo sapiens
ugaaagaccgagaaaccaa

SEQ ID NO: 906103 - RNA, 19 nt, Homo sapiens
gaacggcaagucccuggau

SEQ ID NO: 906104 - RNA, 19 nt, Homo sapiens
aagccgaguuuggcaagua

SEQ ID NO: 906105 - RNA, 19 nt, Homo sapiens
ucgaggugcuccugaugaa

SEQ ID NO: 906106 - RNA, 19 nt, Homo sapiens
gauaaaugaggcaaacagu

SEQ ID NO: 906107 - RNA, 19 nt, Homo sapiens
gaugaaagaccgagaaacc

SEQ ID NO: 906108 - RNA, 19 nt, Homo sapiens
caaggacuaguacaaggaa

SEQ ID NO: 906109 - RNA, 19 nt, Homo sapiens
guuaacguuucuuucaaca

SEQ ID NO: 906110 - RNA, 19 nt, Homo sapiens
gaggugcuccugaugaaag

SEQ ID NO: 906111 - RNA, 19 nt, Homo sapiens
aaaagaagaaccuguugua

SEQ ID NO: 906112 - RNA, 19 nt, Homo sapiens
acaguuacagcagcaguua

SEQ ID NO: 906113 - RNA, 19 nt, Homo sapiens
cugaguacuagucuucuua

SEQ ID NO: 906114 - RNA, 19 nt, Homo sapiens
ccaaggacuaguacaagga

SEQ ID NO: 906115 - RNA, 19 nt, Homo sapiens
aaagaagaaccuguuguau

SEQ ID NO: 906116 - RNA, 19 nt, Homo sapiens
caaacaguucuaagaucuu

SEQ ID NO: 906117 - RNA, 19 nt, Homo sapiens
aauggcuucuucccuugua

SEQ ID NO: 906118 - RNA, 19 nt, Homo sapiens
gaguacacccaccgcgauu

SEQ ID NO: 906119 - RNA, 19 nt, Homo sapiens
gaguacuagucuucuuaca

SEQ ID NO: 906120 - RNA, 19 nt, Homo sapiens
ccaccaaaccggcguucga

SEQ ID NO: 906121 - RNA, 19 nt, Homo sapiens
guaacuacccaaggacuag

SEQ ID NO: 906122 - RNA, 19 nt, Homo sapiens
agaaccuguuguaugguaa

SEQ ID NO: 906123 - RNA, 19 nt, Homo sapiens
caucgagagcccuuugaga

SEQ ID NO: 906124 - RNA, 19 nt, Homo sapiens
cuagucuucuuacauuuac

SEQ ID NO: 906125 - RNA, 19 nt, Homo sapiens
auaugaaccugaguacuag

SEQ ID NO: 906126 - RNA, 19 nt, Homo sapiens
gaagccgaguuuggcaagu

SEQ ID NO: 906127 - RNA, 19 nt, Homo sapiens
acaguucuaagaucuuuga

SEQ ID NO: 906128 - RNA, 19 nt, Homo sapiens
ccuguuguaugguaacuac

SEQ ID NO: 906129 - RNA, 19 nt, Homo sapiens
cuaagcaggaacagacuug

SEQ ID NO: 906130 - RNA, 19 nt, Homo sapiens
ucgcguucgucaccuuuga

SEQ ID NO: 906131 - RNA, 19 nt, Homo sapiens
auaaaugaggcaaacaguu

SEQ ID NO: 906132 - RNA, 19 nt, Homo sapiens
ccugaguacuagucuucuu

SEQ ID NO: 906133 - RNA, 19 nt, Homo sapiens
gauacuaagcaggaacaga

SEQ ID NO: 906134 - RNA, 19 nt, Homo sapiens
ggccggagcagauacuaag

SEQ ID NO: 906135 - RNA, 19 nt, Homo sapiens
gacaguuacagcagcaguu

SEQ ID NO: 906136 - RNA, 19 nt, Homo sapiens
guacacccaccgcgauuac

SEQ ID NO: 906137 - RNA, 19 nt, Homo sapiens
ggcaagucccuggauggua

SEQ ID NO: 906138 - RNA, 19 nt, Homo sapiens
gaccggcaaacaugguuga

SEQ ID NO: 906139 - RNA, 19 nt, Homo sapiens
cuaguacaaggaagaguug

SEQ ID NO: 906140 - RNA, 19 nt, Homo sapiens
cgacucggaugcaguauua

SEQ ID NO: 906141 - RNA, 19 nt, Homo sapiens
gaacagaccugaguacucu

SEQ ID NO: 906142 - RNA, 19 nt, Homo sapiens
gaacagaggguggagcuua

SEQ ID NO: 906143 - RNA, 19 nt, Homo sapiens
gccaaaagcuguuccauua

SEQ ID NO: 906144 - RNA, 19 nt, Homo sapiens
gaaggaaaccucaucuuug

SEQ ID NO: 906145 - RNA, 19 nt, Homo sapiens
gcucugaacucaucucuuc

SEQ ID NO: 906146 - RNA, 19 nt, Homo sapiens
gcgcaacccucccuucuga

SEQ ID NO: 906147 - RNA, 19 nt, Homo sapiens
gaacucaucucuucuaccu

SEQ ID NO: 906148 - RNA, 19 nt, Homo sapiens
gaggugacaucauacauuc

SEQ ID NO: 906149 - RNA, 19 nt, Homo sapiens
gaaaccucaucuuugcaua

SEQ ID NO: 906150 - RNA, 19 nt, Homo sapiens
gagcuuagucucugggaua

SEQ ID NO: 906151 - RNA, 19 nt, Homo sapiens
gggaggaugagacaauuua

SEQ ID NO: 906152 - RNA, 19 nt, Homo sapiens
ucacaugcuucucaccuaa

SEQ ID NO: 906153 - RNA, 19 nt, Homo sapiens
guacagcuggcauuuguuu

SEQ ID NO: 906154 - RNA, 19 nt, Homo sapiens
ugagcaggguugugcaaua

SEQ ID NO: 906155 - RNA, 19 nt, Homo sapiens
agacagaccugcgaacaga

SEQ ID NO: 906156 - RNA, 19 nt, Homo sapiens
gcagcugggugcagaaauc

SEQ ID NO: 906157 - RNA, 19 nt, Homo sapiens
gagcaggguugugcaauag

SEQ ID NO: 906158 - RNA, 19 nt, Homo sapiens
ggacagcgcacucaagaag

SEQ ID NO: 906159 - RNA, 19 nt, Homo sapiens
ggaucucccuacuacgaua

SEQ ID NO: 906160 - RNA, 19 nt, Homo sapiens
gagggaggaugagacaauu

SEQ ID NO: 906161 - RNA, 19 nt, Homo sapiens
auggagaggugacaucaua

SEQ ID NO: 906162 - RNA, 19 nt, Homo sapiens
agaaggaaaccucaucuuu

SEQ ID NO: 906163 - RNA, 19 nt, Homo sapiens
gagcauccacagcaucuuu

SEQ ID NO: 906164 - RNA, 19 nt, Homo sapiens
ggacacuggacaugaguuu

SEQ ID NO: 906165 - RNA, 19 nt, Homo sapiens
gcucagcuuucaccucaga

SEQ ID NO: 906166 - RNA, 19 nt, Homo sapiens
ggucagagccaaugagaag

SEQ ID NO: 906167 - RNA, 19 nt, Homo sapiens
gauaauguccguccacucu

SEQ ID NO: 906168 - RNA, 19 nt, Homo sapiens
uaguacagcuggcauuugu

SEQ ID NO: 906169 - RNA, 19 nt, Homo sapiens
caaaagcuguuccauuaug

SEQ ID NO: 906170 - RNA, 19 nt, Homo sapiens
gacaucagccguccagaga

SEQ ID NO: 906171 - RNA, 19 nt, Homo sapiens
caucauacauucacaugcu

SEQ ID NO: 906172 - RNA, 19 nt, Homo sapiens
ggaguguuucaaucuguua

SEQ ID NO: 906173 - RNA, 19 nt, Homo sapiens
uagcccaggugcuucguaa

SEQ ID NO: 906174 - RNA, 19 nt, Homo sapiens
acucuugucuuuggaauug

SEQ ID NO: 906175 - RNA, 19 nt, Homo sapiens
guucuguguuuaaugaaga

SEQ ID NO: 906176 - RNA, 19 nt, Homo sapiens
gggaguguuucaaucuguu

SEQ ID NO: 906177 - RNA, 19 nt, Homo sapiens
aaggaaaccucaucuuugc

SEQ ID NO: 906178 - RNA, 19 nt, Homo sapiens
gcaggguugugcaauagca

SEQ ID NO: 906179 - RNA, 19 nt, Homo sapiens
caucagccguccagagaca

SEQ ID NO: 906180 - RNA, 19 nt, Homo sapiens
ucuguuauauguucugugu

SEQ ID NO: 906181 - RNA, 19 nt, Homo sapiens
caagccaggcacuagauuu

SEQ ID NO: 906182 - RNA, 19 nt, Homo sapiens
ggagagggaggaugagaca

SEQ ID NO: 906183 - RNA, 19 nt, Homo sapiens
ggaaaccucaucuuugcau

SEQ ID NO: 906184 - RNA, 19 nt, Homo sapiens
gcuguuccauuaugugaag

SEQ ID NO: 906185 - RNA, 19 nt, Homo sapiens
gaccugacgcugagagaga

SEQ ID NO: 906186 - RNA, 19 nt, Homo sapiens
uaugugaaguggaaauugg

SEQ ID NO: 906187 - RNA, 19 nt, Homo sapiens
ccaccguguucgaaaauua

SEQ ID NO: 906188 - RNA, 19 nt, Homo sapiens
gagaaggaaaccucaucuu

SEQ ID NO: 906189 - RNA, 19 nt, Homo sapiens
gcaacccucccuucugaau

SEQ ID NO: 906190 - RNA, 19 nt, Homo sapiens
gguaguacagcuggcauuu

SEQ ID NO: 906191 - RNA, 19 nt, Homo sapiens
cagcgacucggaugcagua

SEQ ID NO: 906192 - RNA, 19 nt, Homo sapiens
ggagaggugacaucauaca

SEQ ID NO: 906193 - RNA, 19 nt, Homo sapiens
ggccagauguaagcucguu

SEQ ID NO: 906194 - RNA, 19 nt, Homo sapiens
ugagagagaaccaucauac

SEQ ID NO: 906195 - RNA, 19 nt, Homo sapiens
gaaguggaggacagaaauc

SEQ ID NO: 906196 - RNA, 19 nt, Homo sapiens
ggaagaccgcgauguugca

SEQ ID NO: 906197 - RNA, 19 nt, Homo sapiens
gaucucccuacuacgauaa

SEQ ID NO: 906198 - RNA, 19 nt, Homo sapiens
agaggugacaucauacauu

SEQ ID NO: 906199 - RNA, 19 nt, Homo sapiens
guggacagcgcacucaaga

SEQ ID NO: 906200 - RNA, 19 nt, Homo sapiens
agaccgcgauguugcaagu

SEQ ID NO: 906201 - RNA, 19 nt, Homo sapiens
gaagaccgcgauguugcaa

SEQ ID NO: 906202 - RNA, 19 nt, Homo sapiens
caagacagaccugcgaaca

SEQ ID NO: 906203 - RNA, 19 nt, Homo sapiens
caggaucucccuacuacga

SEQ ID NO: 906204 - RNA, 19 nt, Homo sapiens
gacaucauacauucacaug

SEQ ID NO: 906205 - RNA, 19 nt, Homo sapiens
cuggaaggcucagcuuuca

SEQ ID NO: 906206 - RNA, 19 nt, Homo sapiens
gcucauuggcugcaagaca

SEQ ID NO: 906207 - RNA, 19 nt, Homo sapiens
gugggaagaccgcgauguu

SEQ ID NO: 906208 - RNA, 19 nt, Homo sapiens
cccagucgcucugaacuca

SEQ ID NO: 906209 - RNA, 19 nt, Homo sapiens
gaaaaggccaaaagcuguu

SEQ ID NO: 906210 - RNA, 19 nt, Homo sapiens
ggagcugucccaccagaag

SEQ ID NO: 906211 - RNA, 19 nt, Homo sapiens
ggacacugcaaccaugaag

SEQ ID NO: 906212 - RNA, 19 nt, Homo sapiens
guaguacagcuggcauuug

SEQ ID NO: 906213 - RNA, 19 nt, Homo sapiens
acacugcaaccaugaagga

SEQ ID NO: 906214 - RNA, 19 nt, Homo sapiens
cucaggaucucccuacuac

SEQ ID NO: 906215 - RNA, 19 nt, Homo sapiens
ccucaggaucucccuacua

SEQ ID NO: 906216 - RNA, 19 nt, Homo sapiens
gacgugcagugugggaaga

SEQ ID NO: 906217 - RNA, 19 nt, Homo sapiens
ggcagggaaucuggcuuga

SEQ ID NO: 906218 - RNA, 19 nt, Homo sapiens
uuaggacacuggacaugag

SEQ ID NO: 906219 - RNA, 19 nt, Homo sapiens
ggagggaggcagggaaucu

SEQ ID NO: 906220 - RNA, 19 nt, Homo sapiens
cauccaugcugugucugaa

SEQ ID NO: 906221 - RNA, 19 nt, Homo sapiens
agaaguggaggacagaaau

SEQ ID NO: 906222 - RNA, 19 nt, Homo sapiens
cagagccaaugagaaggaa

SEQ ID NO: 906223 - RNA, 19 nt, Homo sapiens
ucugaacucaucucuucua

SEQ ID NO: 906224 - RNA, 19 nt, Homo sapiens
agaccugaguacucugaug

SEQ ID NO: 906225 - RNA, 19 nt, Homo sapiens
ucagagccaaugagaagga

SEQ ID NO: 906226 - RNA, 19 nt, Homo sapiens
ccaagccaggcacuagauu

SEQ ID NO: 906227 - RNA, 19 nt, Homo sapiens
aggaugagacaauuuagga

SEQ ID NO: 906228 - RNA, 19 nt, Homo sapiens
ggaggaugagacaauuuag

SEQ ID NO: 906229 - RNA, 19 nt, Homo sapiens
agagggaggaugagacaau

SEQ ID NO: 906230 - RNA, 19 nt, Homo sapiens
gagaggugacaucauacau

SEQ ID NO: 906231 - RNA, 19 nt, Homo sapiens
cgaacagaccugaguacuc

SEQ ID NO: 906232 - RNA, 19 nt, Homo sapiens
caaguguuagcgaaggauu

SEQ ID NO: 906233 - RNA, 19 nt, Homo sapiens
guccgaagccucuccaaac

SEQ ID NO: 906234 - RNA, 19 nt, Homo sapiens
aagaaguggaggacagaaa

SEQ ID NO: 906235 - RNA, 19 nt, Homo sapiens
gcgacucggaugcaguauu

SEQ ID NO: 906236 - RNA, 19 nt, Homo sapiens
gagaggauaugacaugaaa

SEQ ID NO: 906237 - RNA, 19 nt, Homo sapiens
gaggauaugacaugaaaua

SEQ ID NO: 906238 - RNA, 19 nt, Homo sapiens
gcacugaugggcucacaua

SEQ ID NO: 906239 - RNA, 19 nt, Homo sapiens
caagaaugcccaucuguga

SEQ ID NO: 906240 - RNA, 19 nt, Homo sapiens
gaacaguggugggcaugga

SEQ ID NO: 906241 - RNA, 19 nt, Homo sapiens
caugaaagauggcaaaugc

SEQ ID NO: 906242 - RNA, 19 nt, Homo sapiens
ucacauauacgaaugaaug

SEQ ID NO: 906243 - RNA, 19 nt, Homo sapiens
ggacauccagaucaugaaa

SEQ ID NO: 906244 - RNA, 19 nt, Homo sapiens
gaucaugaaagauggcaaa

SEQ ID NO: 906245 - RNA, 19 nt, Homo sapiens
aaacaggacauccagauca

SEQ ID NO: 906246 - RNA, 19 nt, Homo sapiens
gcucacauauacgaaugaa

SEQ ID NO: 906247 - RNA, 19 nt, Homo sapiens
gggcucacauauacgaaug

SEQ ID NO: 906248 - RNA, 19 nt, Homo sapiens
cugaugggcucacauauac

SEQ ID NO: 906249 - RNA, 19 nt, Homo sapiens
ggagaggauaugacaugaa

SEQ ID NO: 906250 - RNA, 19 nt, Homo sapiens
gcauggagaggauaugaca

SEQ ID NO: 906251 - RNA, 19 nt, Homo sapiens
acauccagaucaugaaaga

SEQ ID NO: 906252 - RNA, 19 nt, Homo sapiens
caggacauccagaucauga

SEQ ID NO: 906253 - RNA, 19 nt, Homo sapiens
ccaaacaggacauccagau

SEQ ID NO: 906254 - RNA, 19 nt, Homo sapiens
acugaugggcucacauaua

SEQ ID NO: 906255 - RNA, 19 nt, Homo sapiens
ugaagugucagcuggagaa

SEQ ID NO: 906256 - RNA, 19 nt, Homo sapiens
aaagauccagcccaacuga

SEQ ID NO: 906257 - RNA, 19 nt, Homo sapiens
gggcauggagaggauauga

SEQ ID NO: 906258 - RNA, 19 nt, Homo sapiens
gaugggcucacauauacga

SEQ ID NO: 906259 - RNA, 19 nt, Homo sapiens
gagcaccucaagccaugaa

SEQ ID NO: 906260 - RNA, 19 nt, Homo sapiens
gaaugcccaucugugaaca

SEQ ID NO: 906261 - RNA, 19 nt, Homo sapiens
uggagaggauaugacauga

SEQ ID NO: 906262 - RNA, 19 nt, Homo sapiens
caaacaggacauccagauc

SEQ ID NO: 906263 - RNA, 19 nt, Homo sapiens
uggcugcccuccuuguugu

SEQ ID NO: 906264 - RNA, 19 nt, Homo sapiens
ucucaagaaugcccaucug

SEQ ID NO: 906265 - RNA, 19 nt, Homo sapiens
cucaagccaugaaguguca

SEQ ID NO: 906266 - RNA, 19 nt, Homo sapiens
agauccagcccaacugaaa

SEQ ID NO: 906267 - RNA, 19 nt, Homo sapiens
aaagauggcaaaugcugau

SEQ ID NO: 906268 - RNA, 19 nt, Homo sapiens
gcaccucaagccaugaagu

SEQ ID NO: 906269 - RNA, 19 nt, Homo sapiens
uagagucuccaaccuguuc

SEQ ID NO: 906270 - RNA, 19 nt, Homo sapiens
aagaaugcccaucugugaa

SEQ ID NO: 906271 - RNA, 19 nt, Homo sapiens
caaagaagguggaguguuu

SEQ ID NO: 906272 - RNA, 19 nt, Homo sapiens
ucagagagaugcagaguua

SEQ ID NO: 906273 - RNA, 19 nt, Homo sapiens
gaaaggagcauaauuguag

SEQ ID NO: 906274 - RNA, 19 nt, Homo sapiens
gcacgaaccuccugauaca

SEQ ID NO: 906275 - RNA, 19 nt, Homo sapiens
uaagacaggugaugaagaa

SEQ ID NO: 906276 - RNA, 19 nt, Homo sapiens
uaguacagguuucaucuua

SEQ ID NO: 906277 - RNA, 19 nt, Homo sapiens
caacaaagcaugcaaacau

SEQ ID NO: 906278 - RNA, 19 nt, Homo sapiens
gaucaaacuugcguagauu

SEQ ID NO: 906279 - RNA, 19 nt, Homo sapiens
ggccugacauggcacuuua

SEQ ID NO: 906280 - RNA, 19 nt, Homo sapiens
ggagauacuauaugaguuu

SEQ ID NO: 906281 - RNA, 19 nt, Homo sapiens
gagcauaauuguagagaag

SEQ ID NO: 906282 - RNA, 19 nt, Homo sapiens
gagcacaaaugacacuguu

SEQ ID NO: 906283 - RNA, 19 nt, Homo sapiens
guacagguuucaucuuaga

SEQ ID NO: 906284 - RNA, 19 nt, Homo sapiens
ggaauucugugacuucagu

SEQ ID NO: 906285 - RNA, 19 nt, Homo sapiens
gcucgaagacuaaauauca

SEQ ID NO: 906286 - RNA, 19 nt, Homo sapiens
gaagaaagcugugguucac

SEQ ID NO: 906287 - RNA, 19 nt, Homo sapiens
gagaaugugagaagaauga

SEQ ID NO: 906288 - RNA, 19 nt, Homo sapiens
aaacuaagcucugauucug

SEQ ID NO: 906289 - RNA, 19 nt, Homo sapiens
caugaaaccugagaauaug

SEQ ID NO: 906290 - RNA, 19 nt, Homo sapiens
gacaggacaugagaggaua

SEQ ID NO: 906291 - RNA, 19 nt, Homo sapiens
gacaggugaugaagaagaa

SEQ ID NO: 906292 - RNA, 19 nt, Homo sapiens
caugagaggauacuucuuu

SEQ ID NO: 906293 - RNA, 19 nt, Homo sapiens
gaauugaaacugauaccaa

SEQ ID NO: 906294 - RNA, 19 nt, Homo sapiens
gcauaauuguagagaagaa

SEQ ID NO: 906295 - RNA, 19 nt, Homo sapiens
gauagaaaggagcauaauu

SEQ ID NO: 906296 - RNA, 19 nt, Homo sapiens
gcacaaaugacacuguuag

SEQ ID NO: 906297 - RNA, 19 nt, Homo sapiens
gaagguggaguguuuggaa

SEQ ID NO: 906298 - RNA, 19 nt, Homo sapiens
gaagaagaaagcugugguu

SEQ ID NO: 906299 - RNA, 19 nt, Homo sapiens
caugaaacacauagagaua

SEQ ID NO: 906300 - RNA, 19 nt, Homo sapiens
ucaugaaaccugagaauau

SEQ ID NO: 906301 - RNA, 19 nt, Homo sapiens
ggacaugagaggauacuuc

SEQ ID NO: 906302 - RNA, 19 nt, Homo sapiens
cagcuguccuugcucauga

SEQ ID NO: 906303 - RNA, 19 nt, Homo sapiens
gaggcucgaagacuaaaua

SEQ ID NO: 906304 - RNA, 19 nt, Homo sapiens
ccaaagugcugggauuaca

SEQ ID NO: 906305 - RNA, 19 nt, Homo sapiens
gggaagcauuugaagacaa

SEQ ID NO: 906306 - RNA, 19 nt, Homo sapiens
ugucagagagcacaaauga

SEQ ID NO: 906307 - RNA, 19 nt, Homo sapiens
ggugguauagccaauagua

SEQ ID NO: 906308 - RNA, 19 nt, Homo sapiens
cagauggugucuuugauca

SEQ ID NO: 906309 - RNA, 19 nt, Homo sapiens
uauaugaguuuccuagagu

SEQ ID NO: 906310 - RNA, 19 nt, Homo sapiens
ggagcauaauuguagagaa

SEQ ID NO: 906311 - RNA, 19 nt, Homo sapiens
guacaacaaagcaugcaaa

SEQ ID NO: 906312 - RNA, 19 nt, Homo sapiens
ucagagagcacaaaugaca

SEQ ID NO: 906313 - RNA, 19 nt, Homo sapiens
auagaaaggagcauaauug

SEQ ID NO: 906314 - RNA, 19 nt, Homo sapiens
cuaacucuguggugaaaga

SEQ ID NO: 906315 - RNA, 19 nt, Homo sapiens
gcagcaagaaucagagaga

SEQ ID NO: 906316 - RNA, 19 nt, Homo sapiens
ugaucaaacuugcguagau

SEQ ID NO: 906317 - RNA, 19 nt, Homo sapiens
acuaagcucugauucugaa

SEQ ID NO: 906318 - RNA, 19 nt, Homo sapiens
gaaaguucucucucccaaa

SEQ ID NO: 906319 - RNA, 19 nt, Homo sapiens
ggaggcaucaccacuacuu

SEQ ID NO: 906320 - RNA, 19 nt, Homo sapiens
gcagagacauuuuaaacca

SEQ ID NO: 906321 - RNA, 19 nt, Homo sapiens
gaaauccugagcucaagug

SEQ ID NO: 906322 - RNA, 19 nt, Homo sapiens
caucaccacuacuucuguu

SEQ ID NO: 906323 - RNA, 19 nt, Homo sapiens
aagcucugauucugaaauu

SEQ ID NO: 906324 - RNA, 19 nt, Homo sapiens
ccaagcaaaccauuccaaa

SEQ ID NO: 906325 - RNA, 19 nt, Homo sapiens
gaaccacugaauccaaaga

SEQ ID NO: 906326 - RNA, 19 nt, Homo sapiens
agaaaggagcauaauugua

SEQ ID NO: 906327 - RNA, 19 nt, Homo sapiens
uagagaaugugagaagaau

SEQ ID NO: 906328 - RNA, 19 nt, Homo sapiens
gagaauaugauuguaccaa

SEQ ID NO: 906329 - RNA, 19 nt, Homo sapiens
ugaaacugauaccaagguu

SEQ ID NO: 906330 - RNA, 19 nt, Homo sapiens
gagauacuauaugaguuuc

SEQ ID NO: 906331 - RNA, 19 nt, Homo sapiens
gauuagagaaugugagaag

SEQ ID NO: 906332 - RNA, 19 nt, Homo sapiens
caauaaaacuaagcucuga

SEQ ID NO: 906333 - RNA, 19 nt, Homo sapiens
cagcgaggcucaaguucca

SEQ ID NO: 906334 - RNA, 19 nt, Homo sapiens
aggaaccacugaauccaaa

SEQ ID NO: 906335 - RNA, 19 nt, Homo sapiens
gcucugauucugaaauugu

SEQ ID NO: 906336 - RNA, 19 nt, Homo sapiens
gguggaguguuuggaaguu

SEQ ID NO: 906337 - RNA, 19 nt, Homo sapiens
aaaguucucucucccaaaa

SEQ ID NO: 906338 - RNA, 19 nt, Homo sapiens
gaggaaccacugaauccaa

SEQ ID NO: 906339 - RNA, 19 nt, Homo sapiens
gacagucuaucggcauguu

SEQ ID NO: 906340 - RNA, 19 nt, Homo sapiens
aaaggagcauaauuguaga

SEQ ID NO: 906341 - RNA, 19 nt, Homo sapiens
gaaaucagcgaggcucaag

SEQ ID NO: 906342 - RNA, 19 nt, Homo sapiens
uaagagaggaaccacugaa

SEQ ID NO: 906343 - RNA, 19 nt, Homo sapiens
gcacugcugaugaguuaca

SEQ ID NO: 906344 - RNA, 19 nt, Homo sapiens
gcggaggcaucaccacuac

SEQ ID NO: 906345 - RNA, 19 nt, Homo sapiens
gaaaccugagaauaugauu

SEQ ID NO: 906346 - RNA, 19 nt, Homo sapiens
gaaggcagaauugaaacug

SEQ ID NO: 906347 - RNA, 19 nt, Homo sapiens
uauaacuaaugcaccuuug

SEQ ID NO: 906348 - RNA, 19 nt, Homo sapiens
uagaaaggagcauaauugu

SEQ ID NO: 906349 - RNA, 19 nt, Homo sapiens
gaaagcugugguucaccua

SEQ ID NO: 906350 - RNA, 19 nt, Homo sapiens
ugauacagcuguccuugcu

SEQ ID NO: 906351 - RNA, 19 nt, Homo sapiens
aaagauacagauuccauuc

SEQ ID NO: 906352 - RNA, 19 nt, Homo sapiens
cacugaauccaaagaagua

SEQ ID NO: 906353 - RNA, 19 nt, Homo sapiens
cagcaagaaucagagagau

SEQ ID NO: 906354 - RNA, 19 nt, Homo sapiens
gcaacuaugggucacaucu

SEQ ID NO: 906355 - RNA, 19 nt, Homo sapiens
ucagauggaauauugaauc

SEQ ID NO: 906356 - RNA, 19 nt, Homo sapiens
gucaugaaaccugagaaua

SEQ ID NO: 906357 - RNA, 19 nt, Homo sapiens
gauuuggaaggcagaauug

SEQ ID NO: 906358 - RNA, 19 nt, Homo sapiens
agaggauacuucuuucaca

SEQ ID NO: 906359 - RNA, 19 nt, Homo sapiens
aauuaagaauggacacaug

SEQ ID NO: 906360 - RNA, 19 nt, Homo sapiens
gugcaguacuccuuaagac

SEQ ID NO: 906361 - RNA, 19 nt, Homo sapiens
caguuugccuucagagaca

SEQ ID NO: 906362 - RNA, 19 nt, Homo sapiens
cugcucggcuuccaaagug

SEQ ID NO: 906363 - RNA, 19 nt, Homo sapiens
cuauaugaguuuccuagag

SEQ ID NO: 906364 - RNA, 19 nt, Homo sapiens
ccacugaauccaaagaagu

SEQ ID NO: 906365 - RNA, 19 nt, Homo sapiens
gagaggaaccacugaaucc

SEQ ID NO: 906366 - RNA, 19 nt, Homo sapiens
uguccuugcucaugaaaca

SEQ ID NO: 906367 - RNA, 19 nt, Homo sapiens
gaucaaaagauacagauuc

SEQ ID NO: 906368 - RNA, 19 nt, Homo sapiens
guaggugguauagccaaua

SEQ ID NO: 906369 - RNA, 19 nt, Homo sapiens
guccagauggugucuuuga

SEQ ID NO: 906370 - RNA, 19 nt, Homo sapiens
aaguccagauggugucuuu

SEQ ID NO: 906371 - RNA, 19 nt, Homo sapiens
ggaaugggauggucuagua

SEQ ID NO: 906372 - RNA, 19 nt, Homo sapiens
acgcacaacuuuacacuua

SEQ ID NO: 906373 - RNA, 19 nt, Homo sapiens
gcagagacgcacaacuuua

SEQ ID NO: 906374 - RNA, 19 nt, Homo sapiens
gauuugccauucuuugaua

SEQ ID NO: 906375 - RNA, 19 nt, Homo sapiens
gacacucucugcugcauuu

SEQ ID NO: 906376 - RNA, 19 nt, Homo sapiens
ugcagacucucaauuaaua

SEQ ID NO: 906377 - RNA, 19 nt, Homo sapiens
cuacuguugucaccauuua

SEQ ID NO: 906378 - RNA, 19 nt, Homo sapiens
aaacagauuugccauucuu

SEQ ID NO: 906379 - RNA, 19 nt, Homo sapiens
auacuuguguggcaaauuu

SEQ ID NO: 906380 - RNA, 19 nt, Homo sapiens
gcacaacuuuacacuuauc

SEQ ID NO: 906381 - RNA, 19 nt, Homo sapiens
gguccaaucuauucauaau

SEQ ID NO: 906382 - RNA, 19 nt, Homo sapiens
cagcauagcagauaaaaua

SEQ ID NO: 906383 - RNA, 19 nt, Homo sapiens
gggaaagaauaacuucaga

SEQ ID NO: 906384 - RNA, 19 nt, Homo sapiens
gaaaacagauuugccauuc

SEQ ID NO: 906385 - RNA, 19 nt, Homo sapiens
ggaaaguucuaaguaucaa

SEQ ID NO: 906386 - RNA, 19 nt, Homo sapiens
guuggaaaguucuaaguau

SEQ ID NO: 906387 - RNA, 19 nt, Homo sapiens
cccauaccauuucguguua

SEQ ID NO: 906388 - RNA, 19 nt, Homo sapiens
ucagauugcuacauggauu

SEQ ID NO: 906389 - RNA, 19 nt, Homo sapiens
caaauuugccuuaucagau

SEQ ID NO: 906390 - RNA, 19 nt, Homo sapiens
accagaagauuucagcaua

SEQ ID NO: 906391 - RNA, 19 nt, Homo sapiens
ggaauccaguguuguaagg

SEQ ID NO: 906392 - RNA, 19 nt, Homo sapiens
uaaugaaagugggaaagaa

SEQ ID NO: 906393 - RNA, 19 nt, Homo sapiens
gcaacaugacuguaaaguu

SEQ ID NO: 906394 - RNA, 19 nt, Homo sapiens
gugcuauacuuauguuuca

SEQ ID NO: 906395 - RNA, 19 nt, Homo sapiens
gaacuggcaacaugacugu

SEQ ID NO: 906396 - RNA, 19 nt, Homo sapiens
cccguaccauuucuuguua

SEQ ID NO: 906397 - RNA, 19 nt, Homo sapiens
ccagaagauuucagcauag

SEQ ID NO: 906398 - RNA, 19 nt, Homo sapiens
gauggucuaguaaggauaa

SEQ ID NO: 906399 - RNA, 19 nt, Homo sapiens
guaaggauagaaccuaaga

SEQ ID NO: 906400 - RNA, 19 nt, Homo sapiens
ugaaagugggaaagaauaa

SEQ ID NO: 906401 - RNA, 19 nt, Homo sapiens
aaauuugccuuaucagauc

SEQ ID NO: 906402 - RNA, 19 nt, Homo sapiens
guuauucacauguacagua

SEQ ID NO: 906403 - RNA, 19 nt, Homo sapiens
caccaccacccaucaauuu

SEQ ID NO: 906404 - RNA, 19 nt, Homo sapiens
gcacguguggaccaucuaa

SEQ ID NO: 906405 - RNA, 19 nt, Homo sapiens
gguuguugcuugugaacuu

SEQ ID NO: 906406 - RNA, 19 nt, Homo sapiens
gauuucagcauagcagaua

SEQ ID NO: 906407 - RNA, 19 nt, Homo sapiens
gggauggucuaguaaggau

SEQ ID NO: 906408 - RNA, 19 nt, Homo sapiens
gggauugggcagcacauuu

SEQ ID NO: 906409 - RNA, 19 nt, Homo sapiens
gaaugggauggucuaguaa

SEQ ID NO: 906410 - RNA, 19 nt, Homo sapiens
gauagaaccuaagaaucca

SEQ ID NO: 906411 - RNA, 19 nt, Homo sapiens
cauaccauuucguguuauu

SEQ ID NO: 906412 - RNA, 19 nt, Homo sapiens
guucaauacuacuacuguu

SEQ ID NO: 906413 - RNA, 19 nt, Homo sapiens
aaauaugcuucacuaguca

SEQ ID NO: 906414 - RNA, 19 nt, Homo sapiens
ggugugcuauacuuauguu

SEQ ID NO: 906415 - RNA, 19 nt, Homo sapiens
ccgcagagacgcacaacuu

SEQ ID NO: 906416 - RNA, 19 nt, Homo sapiens
uugcuuuacugagacauua

SEQ ID NO: 906417 - RNA, 19 nt, Homo sapiens
caggugugcuauacuuaug

SEQ ID NO: 906418 - RNA, 19 nt, Homo sapiens
cagauuugccauucuuuga

SEQ ID NO: 906419 - RNA, 19 nt, Homo sapiens
acugcagacucucaauuaa

SEQ ID NO: 906420 - RNA, 19 nt, Homo sapiens
uacugcagacucucaauua

SEQ ID NO: 906421 - RNA, 19 nt, Homo sapiens
aagaccaacugauguagug

SEQ ID NO: 906422 - RNA, 19 nt, Homo sapiens
uguggaccaucuaaugaaa

SEQ ID NO: 906423 - RNA, 19 nt, Homo sapiens
uaaugcugguccaaucuau

SEQ ID NO: 906424 - RNA, 19 nt, Homo sapiens
caccauuuaugauucugaa

SEQ ID NO: 906425 - RNA, 19 nt, Homo sapiens
acgcagaagguauucauuu

SEQ ID NO: 906426 - RNA, 19 nt, Homo sapiens
gugcaacaacucuuggaaa

SEQ ID NO: 906427 - RNA, 19 nt, Homo sapiens
acucucugcugcauuuaaa

SEQ ID NO: 906428 - RNA, 19 nt, Homo sapiens
cuuaagaccaacugaugua

SEQ ID NO: 906429 - RNA, 19 nt, Homo sapiens
ggauucaacgcagaaggua

SEQ ID NO: 906430 - RNA, 19 nt, Homo sapiens
ccauggacauagaugacuu

SEQ ID NO: 906431 - RNA, 19 nt, Homo sapiens
cguaccauuucuuguuauu

SEQ ID NO: 906432 - RNA, 19 nt, Homo sapiens
ccucuuugguccuccuuga

SEQ ID NO: 906433 - RNA, 19 nt, Homo sapiens
gcagauaaaauacagcaaa

SEQ ID NO: 906434 - RNA, 19 nt, Homo sapiens
uuucaggugugcuauacuu

SEQ ID NO: 906435 - RNA, 19 nt, Homo sapiens
cugguccaaucuauucaua

SEQ ID NO: 906436 - RNA, 19 nt, Homo sapiens
guugucaccauuuaugauu

SEQ ID NO: 906437 - RNA, 19 nt, Homo sapiens
ggugggugaugugcugaaa

SEQ ID NO: 906438 - RNA, 19 nt, Homo sapiens
aaaauaugcuucacuaguc

SEQ ID NO: 906439 - RNA, 19 nt, Homo sapiens
cuacuacuguugucaccau

SEQ ID NO: 906440 - RNA, 19 nt, Homo sapiens
cuggaggacucauguucaa

SEQ ID NO: 906441 - RNA, 19 nt, Homo sapiens
aaagguuguugcuugugaa

SEQ ID NO: 906442 - RNA, 19 nt, Homo sapiens
caacgcagaagguauucau

SEQ ID NO: 906443 - RNA, 19 nt, Homo sapiens
ccaccaccacccaucaauu

SEQ ID NO: 906444 - RNA, 19 nt, Homo sapiens
gccauucuuugauacuugu

SEQ ID NO: 906445 - RNA, 19 nt, Homo sapiens
auauaaugcugguccaauc

SEQ ID NO: 906446 - RNA, 19 nt, Homo sapiens
ucaauacuacuacuguugu

SEQ ID NO: 906447 - RNA, 19 nt, Homo sapiens
aaggauagaaccuaagaau

SEQ ID NO: 906448 - RNA, 19 nt, Homo sapiens
caauuaauacacagcuguu

SEQ ID NO: 906449 - RNA, 19 nt, Homo sapiens
uagcucuguuccuccagua

SEQ ID NO: 906450 - RNA, 19 nt, Homo sapiens
cagagacgcacaacuuuac

SEQ ID NO: 906451 - RNA, 19 nt, Homo sapiens
ggauugggcagcacauuuu

SEQ ID NO: 906452 - RNA, 19 nt, Homo sapiens
cuaaugaaagugggaaaga

SEQ ID NO: 906453 - RNA, 19 nt, Homo sapiens
gauguagugcuggaaguug

SEQ ID NO: 906454 - RNA, 19 nt, Homo sapiens
uuguaaggauagaaccuaa

SEQ ID NO: 906455 - RNA, 19 nt, Homo sapiens
cguguggaccaucuaauga

SEQ ID NO: 906456 - RNA, 19 nt, Homo sapiens
uggaaaguucuaaguauca

SEQ ID NO: 906457 - RNA, 19 nt, Homo sapiens
uuggaaaguucuaaguauc

SEQ ID NO: 906458 - RNA, 19 nt, Homo sapiens
caauacuacuacuguuguc

SEQ ID NO: 906459 - RNA, 19 nt, Homo sapiens
gaagauaaugcuuuugcuu

SEQ ID NO: 906460 - RNA, 19 nt, Homo sapiens
cgcagaagguauucauuuu

SEQ ID NO: 906461 - RNA, 19 nt, Homo sapiens
caucagauugcuacaugga

SEQ ID NO: 906462 - RNA, 19 nt, Homo sapiens
uucaucagauugcuacaug

SEQ ID NO: 906463 - RNA, 19 nt, Homo sapiens
gccuuaagaccaacugaug

SEQ ID NO: 906464 - RNA, 19 nt, Homo sapiens
ucagaucucuucgccuuuu

SEQ ID NO: 906465 - RNA, 19 nt, Homo sapiens
cucuguuccuccaguaaua

SEQ ID NO: 906466 - RNA, 19 nt, Homo sapiens
gagacauuauuuacuugac

SEQ ID NO: 906467 - RNA, 19 nt, Homo sapiens
cugagacauuauuuacuug

SEQ ID NO: 906468 - RNA, 19 nt, Homo sapiens
gaaagugggaaagaauaac

SEQ ID NO: 906469 - RNA, 19 nt, Homo sapiens
gcuggaggacucauguuca

SEQ ID NO: 906470 - RNA, 19 nt, Homo sapiens
uggaccaucuaaugaaagu

SEQ ID NO: 906471 - RNA, 19 nt, Homo sapiens
guaacaacaucuacaauca

SEQ ID NO: 906472 - RNA, 19 nt, Homo sapiens
agagaggucuuuccagaua

SEQ ID NO: 906473 - RNA, 19 nt, Homo sapiens
ugaccaagcucaucagaga

SEQ ID NO: 906474 - RNA, 19 nt, Homo sapiens
guccaucgcucucuucaaa

SEQ ID NO: 906475 - RNA, 19 nt, Homo sapiens
uggaaacccuggcuuagua

SEQ ID NO: 906476 - RNA, 19 nt, Homo sapiens
gaagcaucaucgcgucaua

SEQ ID NO: 906477 - RNA, 19 nt, Homo sapiens
gaaguaacaacaucuacaa

SEQ ID NO: 906478 - RNA, 19 nt, Homo sapiens
caacaccaaucuguacuau

SEQ ID NO: 906479 - RNA, 19 nt, Homo sapiens
acaccaaucuguacuauac

SEQ ID NO: 906480 - RNA, 19 nt, Homo sapiens
agaggcagcuguacuggaa

SEQ ID NO: 906481 - RNA, 19 nt, Homo sapiens
caucaacuccuccaucuau

SEQ ID NO: 906482 - RNA, 19 nt, Homo sapiens
gcugggagcucgaguacca

SEQ ID NO: 906483 - RNA, 19 nt, Homo sapiens
gcugaccgaugcauccaaa

SEQ ID NO: 906484 - RNA, 19 nt, Homo sapiens
gagccagacuucauucucu

SEQ ID NO: 906485 - RNA, 19 nt, Homo sapiens
gcuuucggaugcucuauga

SEQ ID NO: 906486 - RNA, 19 nt, Homo sapiens
ggaaacccuggcuuaguaa

SEQ ID NO: 906487 - RNA, 19 nt, Homo sapiens
ucgcugaccugcaccuuga

SEQ ID NO: 906488 - RNA, 19 nt, Homo sapiens
ggaaguaacaacaucuaca

SEQ ID NO: 906489 - RNA, 19 nt, Homo sapiens
cagcuguacuggaaauugu

SEQ ID NO: 906490 - RNA, 19 nt, Homo sapiens
gcugggccuuccaccauuu

SEQ ID NO: 906491 - RNA, 19 nt, Homo sapiens
gcuacuacgucuauaacuc

SEQ ID NO: 906492 - RNA, 19 nt, Homo sapiens
aacaacaucuacaaucaga

SEQ ID NO: 906493 - RNA, 19 nt, Homo sapiens
ccauccggguguucgaaua

SEQ ID NO: 906494 - RNA, 19 nt, Homo sapiens
gcacacugcagcgcuacua

SEQ ID NO: 906495 - RNA, 19 nt, Homo sapiens
ggacauggugaccuacuuc

SEQ ID NO: 906496 - RNA, 19 nt, Homo sapiens
ccaccacaccgacagcuuu

SEQ ID NO: 906497 - RNA, 19 nt, Homo sapiens
gugacuaccucugugauuc

SEQ ID NO: 906498 - RNA, 19 nt, Homo sapiens
gacccugacuacaagguau

SEQ ID NO: 906499 - RNA, 19 nt, Homo sapiens
ggaagccuguggugagaac

SEQ ID NO: 906500 - RNA, 19 nt, Homo sapiens
acuacaagguauccaaaga

SEQ ID NO: 906501 - RNA, 19 nt, Homo sapiens
caacagugccuggagaauc

SEQ ID NO: 906502 - RNA, 19 nt, Homo sapiens
gagcugggccuuccaccau

SEQ ID NO: 906503 - RNA, 19 nt, Homo sapiens
gggacaugguguacauugu

SEQ ID NO: 906504 - RNA, 19 nt, Homo sapiens
aacccuggcuuaguaauga

SEQ ID NO: 906505 - RNA, 19 nt, Homo sapiens
cuauggaaacccuggcuua

SEQ ID NO: 906506 - RNA, 19 nt, Homo sapiens
agguggacauugacgcuua

SEQ ID NO: 906507 - RNA, 19 nt, Homo sapiens
cugcucgccuggcugauuu

SEQ ID NO: 906508 - RNA, 19 nt, Homo sapiens
ccugaggagugaacugaau

SEQ ID NO: 906509 - RNA, 19 nt, Homo sapiens
gcagcgcuacuacgucuau

SEQ ID NO: 906510 - RNA, 19 nt, Homo sapiens
acagaaaacuacuuaggaa

SEQ ID NO: 906511 - RNA, 19 nt, Homo sapiens
gaauugugguccucaacac

SEQ ID NO: 906512 - RNA, 19 nt, Homo sapiens
uaggaagccuguggugaga

SEQ ID NO: 906513 - RNA, 19 nt, Homo sapiens
gcagcuguacuggaaauug

SEQ ID NO: 906514 - RNA, 19 nt, Homo sapiens
gcucaucagagaggucuuu

SEQ ID NO: 906515 - RNA, 19 nt, Homo sapiens
cuacuacgucuauaacuca

SEQ ID NO: 906516 - RNA, 19 nt, Homo sapiens
gaugcucuaugaugaugca

SEQ ID NO: 906517 - RNA, 19 nt, Homo sapiens
gggcugaaccagggaaguu

SEQ ID NO: 906518 - RNA, 19 nt, Homo sapiens
ggucuuuccagauacuaaa

SEQ ID NO: 906519 - RNA, 19 nt, Homo sapiens
gagaggucuuuccagauac

SEQ ID NO: 906520 - RNA, 19 nt, Homo sapiens
ggagucaccccauggaaaa

SEQ ID NO: 906521 - RNA, 19 nt, Homo sapiens
acaaucagauagcagaacu

SEQ ID NO: 906522 - RNA, 19 nt, Homo sapiens
gggagaggcagcuguacug

SEQ ID NO: 906523 - RNA, 19 nt, Homo sapiens
gccagagccagacuucauu

SEQ ID NO: 906524 - RNA, 19 nt, Homo sapiens
ggugacuaccucugugauu

SEQ ID NO: 906525 - RNA, 19 nt, Homo sapiens
ugacuacaagguauccaaa

SEQ ID NO: 906526 - RNA, 19 nt, Homo sapiens
auggugaccuacuucauga

SEQ ID NO: 906527 - RNA, 19 nt, Homo sapiens
cgucauagcagggcaguuc

SEQ ID NO: 906528 - RNA, 19 nt, Homo sapiens
ucaacaccaaucuguacua

SEQ ID NO: 906529 - RNA, 19 nt, Homo sapiens
cggaugcucuaugaugaug

SEQ ID NO: 906530 - RNA, 19 nt, Homo sapiens
cauaagcgccauguucauc

SEQ ID NO: 906531 - RNA, 19 nt, Homo sapiens
gaaacccuggcuuaguaau

SEQ ID NO: 906532 - RNA, 19 nt, Homo sapiens
caucagagaggucuuucca

SEQ ID NO: 906533 - RNA, 19 nt, Homo sapiens
ucuaugccaugaaggagau

SEQ ID NO: 906534 - RNA, 19 nt, Homo sapiens
uaccuggaguggucaaugg

SEQ ID NO: 906535 - RNA, 19 nt, Homo sapiens
gcaccuugacccugacuac

SEQ ID NO: 906536 - RNA, 19 nt, Homo sapiens
uaacaacaucuacaaucag

SEQ ID NO: 906537 - RNA, 19 nt, Homo sapiens
uccagauacuaaagucuau

SEQ ID NO: 906538 - RNA, 19 nt, Homo sapiens
cagcgcuacuacgucuaua

SEQ ID NO: 906539 - RNA, 19 nt, Homo sapiens
uucggaugcucuaugauga

SEQ ID NO: 906540 - RNA, 19 nt, Homo sapiens
cgaauugugguccucaaca

SEQ ID NO: 906541 - RNA, 19 nt, Homo sapiens
uagcagaacuauggaaacc

SEQ ID NO: 906542 - RNA, 19 nt, Homo sapiens
gccaggcucaccauucuuc

SEQ ID NO: 906543 - RNA, 19 nt, Homo sapiens
gcuuacaccaccugucugu

SEQ ID NO: 906544 - RNA, 19 nt, Homo sapiens
cccauaagcgccauguuca

SEQ ID NO: 906545 - RNA, 19 nt, Homo sapiens
ccaucuaugccaugaagga

SEQ ID NO: 906546 - RNA, 19 nt, Homo sapiens
gaaggaguuugcacagaaa

SEQ ID NO: 906547 - RNA, 19 nt, Homo sapiens
cgaaggaguuugcacagaa

SEQ ID NO: 906548 - RNA, 19 nt, Homo sapiens
ucacggugcuccugcagua

SEQ ID NO: 906549 - RNA, 19 nt, Homo sapiens
gcaaggguaugaaggaaag

SEQ ID NO: 906550 - RNA, 19 nt, Homo sapiens
cgaccgagcugguggugaa

SEQ ID NO: 906551 - RNA, 19 nt, Homo sapiens
gacaaacgcugauguaucc

SEQ ID NO: 906552 - RNA, 19 nt, Homo sapiens
caagacaaacgcugaugua

SEQ ID NO: 906553 - RNA, 19 nt, Homo sapiens
gggcaggcaugaguuauga

SEQ ID NO: 906554 - RNA, 19 nt, Homo sapiens
gggaaggcgucaugaaaca

SEQ ID NO: 906555 - RNA, 19 nt, Homo sapiens
gggcagaauuugggaagaa

SEQ ID NO: 906556 - RNA, 19 nt, Homo sapiens
ggacaucggcaucuacugu

SEQ ID NO: 906557 - RNA, 19 nt, Homo sapiens
gcuccuggcugacauccuu

SEQ ID NO: 906558 - RNA, 19 nt, Homo sapiens
ccgaauaaauaaagacauc

SEQ ID NO: 906559 - RNA, 19 nt, Homo sapiens
caucuggacccgcuucuuu

SEQ ID NO: 906560 - RNA, 19 nt, Homo sapiens
gcagaagccagagaagauu

SEQ ID NO: 906561 - RNA, 19 nt, Homo sapiens
gcgaaggaguuugcacaga

SEQ ID NO: 906562 - RNA, 19 nt, Homo sapiens
uggcugacauccuugaaga

SEQ ID NO: 906563 - RNA, 19 nt, Homo sapiens
gcugauguauccccgaaua

SEQ ID NO: 906564 - RNA, 19 nt, Homo sapiens
augaggagcuggccaagga

SEQ ID NO: 906565 - RNA, 19 nt, Homo sapiens
gugggaaggcgucaugaaa

SEQ ID NO: 906566 - RNA, 19 nt, Homo sapiens
ggcagaagccagagaagau

SEQ ID NO: 906567 - RNA, 19 nt, Homo sapiens
gaauuugggaagaaucuca

SEQ ID NO: 906568 - RNA, 19 nt, Homo sapiens
ggcggaaguucgcgagaug

SEQ ID NO: 906569 - RNA, 19 nt, Homo sapiens
gcguggagguggccuacau

SEQ ID NO: 906570 - RNA, 19 nt, Homo sapiens
cagaagccagagaagauuu

SEQ ID NO: 906571 - RNA, 19 nt, Homo sapiens
gggcagaagccagagaaga

SEQ ID NO: 906572 - RNA, 19 nt, Homo sapiens
gaagaaucucauccacguu

SEQ ID NO: 906573 - RNA, 19 nt, Homo sapiens
agacaaacgcugauguauc

SEQ ID NO: 906574 - RNA, 19 nt, Homo sapiens
cgagcccucuuccuuaugg

SEQ ID NO: 906575 - RNA, 19 nt, Homo sapiens
gagggcagaagccagagaa

SEQ ID NO: 906576 - RNA, 19 nt, Homo sapiens
ggcagaauuugggaagaau

SEQ ID NO: 906577 - RNA, 19 nt, Homo sapiens
cccgagcccucuuccuuau

SEQ ID NO: 906578 - RNA, 19 nt, Homo sapiens
ucccaaaggacugcaauuu

SEQ ID NO: 906579 - RNA, 19 nt, Homo sapiens
ugaaacagguguggaugac

SEQ ID NO: 906580 - RNA, 19 nt, Homo sapiens
ggacugcaauuuugacaac

SEQ ID NO: 906581 - RNA, 19 nt, Homo sapiens
ucaccuccauggucuuugg

SEQ ID NO: 906582 - RNA, 19 nt, Homo sapiens
ccaagacaaacgcugaugu

SEQ ID NO: 906583 - RNA, 19 nt, Homo sapiens
gaggcucugaggucuguuu

SEQ ID NO: 906584 - RNA, 19 nt, Homo sapiens
ucccgagcccucuuccuua

SEQ ID NO: 906585 - RNA, 19 nt, Homo sapiens
ccgaggcucugaggucugu

SEQ ID NO: 906586 - RNA, 19 nt, Homo sapiens
ccucaucuccagcgacuuc

SEQ ID NO: 906587 - RNA, 19 nt, Homo sapiens
gaggugaggaaggccauug

SEQ ID NO: 906588 - RNA, 19 nt, Homo sapiens
guucaccuccauggucuuu

SEQ ID NO: 906589 - RNA, 19 nt, Homo sapiens
gaaacagguguggaugaca

SEQ ID NO: 906590 - RNA, 19 nt, Homo sapiens
gcaaaugccugcuauguga

SEQ ID NO: 906591 - RNA, 19 nt, Homo sapiens
guacucagaugacaauauu

SEQ ID NO: 906592 - RNA, 19 nt, Homo sapiens
gaacacaagcauaauauuc

SEQ ID NO: 906593 - RNA, 19 nt, Homo sapiens
gauuguacaugcucaguuu

SEQ ID NO: 906594 - RNA, 19 nt, Homo sapiens
gggagaaacucacuuaugg

SEQ ID NO: 906595 - RNA, 19 nt, Homo sapiens
gcaguugucuguauguguu

SEQ ID NO: 906596 - RNA, 19 nt, Homo sapiens
gaaaguccauggcgguuca

SEQ ID NO: 906597 - RNA, 19 nt, Homo sapiens
gaacuacuuugaacacaag

SEQ ID NO: 906598 - RNA, 19 nt, Homo sapiens
gaaggacucuaauugucuu

SEQ ID NO: 906599 - RNA, 19 nt, Homo sapiens
guacaugcucaguuuaaua

SEQ ID NO: 906600 - RNA, 19 nt, Homo sapiens
gcccaaaccuuucgugauc

SEQ ID NO: 906601 - RNA, 19 nt, Homo sapiens
ggaacuacuuugaacacaa

SEQ ID NO: 906602 - RNA, 19 nt, Homo sapiens
cuuauggucuccacaagua

SEQ ID NO: 906603 - RNA, 19 nt, Homo sapiens
gauauuugaaggacucuaa

SEQ ID NO: 906604 - RNA, 19 nt, Homo sapiens
ugucauacuccacaauuua

SEQ ID NO: 906605 - RNA, 19 nt, Homo sapiens
ggacgggaacuacuuugaa

SEQ ID NO: 906606 - RNA, 19 nt, Homo sapiens
ucccaaagcuuaagucucu

SEQ ID NO: 906607 - RNA, 19 nt, Homo sapiens
gagcuccggugacgaaagu

SEQ ID NO: 906608 - RNA, 19 nt, Homo sapiens
agaagacauucauggcuuu

SEQ ID NO: 906609 - RNA, 19 nt, Homo sapiens
aaagggcuacuucuucaua

SEQ ID NO: 906610 - RNA, 19 nt, Homo sapiens
caaaagggcuacuucuuca

SEQ ID NO: 906611 - RNA, 19 nt, Homo sapiens
uaauacaccuaugcaguug

SEQ ID NO: 906612 - RNA, 19 nt, Homo sapiens
uaacauaaucugcaguugu

SEQ ID NO: 906613 - RNA, 19 nt, Homo sapiens
caacuuagaaucagaacca

SEQ ID NO: 906614 - RNA, 19 nt, Homo sapiens
cuuuagaccuuuauccuau

SEQ ID NO: 906615 - RNA, 19 nt, Homo sapiens
ucagagugcuccagggaau

SEQ ID NO: 906616 - RNA, 19 nt, Homo sapiens
cgaugcaacaaacauaaua

SEQ ID NO: 906617 - RNA, 19 nt, Homo sapiens
aaucugcaguugucuguau

SEQ ID NO: 906618 - RNA, 19 nt, Homo sapiens
gcaauugugguaaauagca

SEQ ID NO: 906619 - RNA, 19 nt, Homo sapiens
acuauuacagugcauguua

SEQ ID NO: 906620 - RNA, 19 nt, Homo sapiens
caaccuguguccuggagau

SEQ ID NO: 906621 - RNA, 19 nt, Homo sapiens
gcacuuacacgagaagaca

SEQ ID NO: 906622 - RNA, 19 nt, Homo sapiens
gcaaaagggcuacuucuuc

SEQ ID NO: 906623 - RNA, 19 nt, Homo sapiens
uuaauacaccuaugcaguu

SEQ ID NO: 906624 - RNA, 19 nt, Homo sapiens
cuaauugucuuuccuugac

SEQ ID NO: 906625 - RNA, 19 nt, Homo sapiens
ucccugaauuucuuuaguu

SEQ ID NO: 906626 - RNA, 19 nt, Homo sapiens
gcgcaggacaggauuaaag

SEQ ID NO: 906627 - RNA, 19 nt, Homo sapiens
gcuuuagaccuuuauccua

SEQ ID NO: 906628 - RNA, 19 nt, Homo sapiens
ggaugccgcucugugacaa

SEQ ID NO: 906629 - RNA, 19 nt, Homo sapiens
cggcuaagcuggccccuaa

SEQ ID NO: 906630 - RNA, 19 nt, Homo sapiens
gacgggaacuacuuugaac

SEQ ID NO: 906631 - RNA, 19 nt, Homo sapiens
aacauaaucugcaguuguc

SEQ ID NO: 906632 - RNA, 19 nt, Homo sapiens
caauugugguaaauagcaa

SEQ ID NO: 906633 - RNA, 19 nt, Homo sapiens
ugagagcuccggugacgaa

SEQ ID NO: 906634 - RNA, 19 nt, Homo sapiens
caaaugugggaguggcaua

SEQ ID NO: 906635 - RNA, 19 nt, Homo sapiens
gcuggaacgcggaguguga

SEQ ID NO: 906636 - RNA, 19 nt, Homo sapiens
acuccacaauuuacaugua

SEQ ID NO: 906637 - RNA, 19 nt, Homo sapiens
gggcuagcaauaaugauau

SEQ ID NO: 906638 - RNA, 19 nt, Homo sapiens
cccugaauuucuuuaguuu

SEQ ID NO: 906639 - RNA, 19 nt, Homo sapiens
gaccuuuauccuauuguuu

SEQ ID NO: 906640 - RNA, 19 nt, Homo sapiens
cuccaaaucuaaagucaag

SEQ ID NO: 906641 - RNA, 19 nt, Homo sapiens
uugaaggacucuaauuguc

SEQ ID NO: 906642 - RNA, 19 nt, Homo sapiens
uuagaccuuuauccuauug

SEQ ID NO: 906643 - RNA, 19 nt, Homo sapiens
gcuuugggcagaaggauug

SEQ ID NO: 906644 - RNA, 19 nt, Homo sapiens
gguggacgauggcucugau

SEQ ID NO: 906645 - RNA, 19 nt, Homo sapiens
cagaugacaauauuaugga

SEQ ID NO: 906646 - RNA, 19 nt, Homo sapiens
cuaugcaguuguacucaga

SEQ ID NO: 906647 - RNA, 19 nt, Homo sapiens
gggaacuacuuugaacaca

SEQ ID NO: 906648 - RNA, 19 nt, Homo sapiens
ugucaacuccaaaucuaaa

SEQ ID NO: 906649 - RNA, 19 nt, Homo sapiens
gaagacauucauggcuuug

SEQ ID NO: 906650 - RNA, 19 nt, Homo sapiens
gcauaauauucggcccaaa

SEQ ID NO: 906651 - RNA, 19 nt, Homo sapiens
ccuauuguuuauugaggaa

SEQ ID NO: 906652 - RNA, 19 nt, Homo sapiens
agaccuuuauccuauuguu

SEQ ID NO: 906653 - RNA, 19 nt, Homo sapiens
ggagaaacucacuuauggu

SEQ ID NO: 906654 - RNA, 19 nt, Homo sapiens
auugucaacuccaaaucua

SEQ ID NO: 906655 - RNA, 19 nt, Homo sapiens
ucacuuauggucuccacaa

SEQ ID NO: 906656 - RNA, 19 nt, Homo sapiens
caaccucaaccucaagcaa

SEQ ID NO: 906657 - RNA, 19 nt, Homo sapiens
uugcaauugugguaaauag

SEQ ID NO: 906658 - RNA, 19 nt, Homo sapiens
cuccacaauuuacauguau

SEQ ID NO: 906659 - RNA, 19 nt, Homo sapiens
ucagaugacaauauuaugg

SEQ ID NO: 906660 - RNA, 19 nt, Homo sapiens
gaugcgcaggacaggauua

SEQ ID NO: 906661 - RNA, 19 nt, Homo sapiens
ggacucuaauugucuuucc

SEQ ID NO: 906662 - RNA, 19 nt, Homo sapiens
uugcccaggugacuugaaa

SEQ ID NO: 906663 - RNA, 19 nt, Homo sapiens
caaguugauuuugcaauug

SEQ ID NO: 906664 - RNA, 19 nt, Homo sapiens
ugaaggacucuaauugucu

SEQ ID NO: 906665 - RNA, 19 nt, Homo sapiens
caaaugccugcuaugugaa

SEQ ID NO: 906666 - RNA, 19 nt, Homo sapiens
caacuccaaaucuaaaguc

SEQ ID NO: 906667 - RNA, 19 nt, Homo sapiens
gccgcucugugacaaaugu

SEQ ID NO: 906668 - RNA, 19 nt, Homo sapiens
gcucaccagcugugucuca

SEQ ID NO: 906669 - RNA, 19 nt, Homo sapiens
ggucuccacaaguaucuga

SEQ ID NO: 906670 - RNA, 19 nt, Homo sapiens
cuauuacagugcauguuag

SEQ ID NO: 906671 - RNA, 19 nt, Homo sapiens
ccagcugugucucaaaauu

SEQ ID NO: 906672 - RNA, 19 nt, Homo sapiens
acuuugaacacaagcauaa

SEQ ID NO: 906673 - RNA, 19 nt, Homo sapiens
gccacucgaugcaacaaac

SEQ ID NO: 906674 - RNA, 19 nt, Homo sapiens
uaacuauuacagugcaugu

SEQ ID NO: 906675 - RNA, 19 nt, Homo sapiens
cuaacauaaucugcaguug

SEQ ID NO: 906676 - RNA, 19 nt, Homo sapiens
cucuguaucccaaagcuua

SEQ ID NO: 906677 - RNA, 19 nt, Homo sapiens
ccacgacaaucggaaugag

SEQ ID NO: 906678 - RNA, 19 nt, Homo sapiens
cauaauauucggcccaaac

SEQ ID NO: 906679 - RNA, 19 nt, Homo sapiens
caccagcugugucucaaaa

SEQ ID NO: 906680 - RNA, 19 nt, Homo sapiens
ucaguuuaauacaccuaug

SEQ ID NO: 906681 - RNA, 19 nt, Homo sapiens
ucuaacauaaucugcaguu

SEQ ID NO: 906682 - RNA, 19 nt, Homo sapiens
ggucaucaccaggauuaca

SEQ ID NO: 906683 - RNA, 19 nt, Homo sapiens
gcccauccuuucaaaauca

SEQ ID NO: 906684 - RNA, 19 nt, Homo sapiens
ccagucgggcuccuucaga

SEQ ID NO: 906685 - RNA, 19 nt, Homo sapiens
gcaguuguacucagaugac

SEQ ID NO: 906686 - RNA, 19 nt, Homo sapiens
acaggacgggaacuacuuu

SEQ ID NO: 906687 - RNA, 19 nt, Homo sapiens
gaacucaaguccaagaaau

SEQ ID NO: 906688 - RNA, 19 nt, Homo sapiens
aauaagaucuuccauaugg

SEQ ID NO: 906689 - RNA, 19 nt, Homo sapiens
gcacugguguugcuccauu

SEQ ID NO: 906690 - RNA, 19 nt, Homo sapiens
caaagaagaggcccaagaa

SEQ ID NO: 906691 - RNA, 19 nt, Homo sapiens
agaaggaacucaaguccaa

SEQ ID NO: 906692 - RNA, 19 nt, Homo sapiens
aaacagugccugcaauaaa

SEQ ID NO: 906693 - RNA, 19 nt, Homo sapiens
gaaauucacgagucuacaa

SEQ ID NO: 906694 - RNA, 19 nt, Homo sapiens
gcaaugccacggaaagaaa

SEQ ID NO: 906695 - RNA, 19 nt, Homo sapiens
gcaaagaagaggcccaaga

SEQ ID NO: 906696 - RNA, 19 nt, Homo sapiens
gcucaguguuccaaagauu

SEQ ID NO: 906697 - RNA, 19 nt, Homo sapiens
gagcggaaccgucugagaa

SEQ ID NO: 906698 - RNA, 19 nt, Homo sapiens
aggaauggguggcgaaauu

SEQ ID NO: 906699 - RNA, 19 nt, Homo sapiens
gcauauagagccugagguu

SEQ ID NO: 906700 - RNA, 19 nt, Homo sapiens
cagcaggguuuccaagaug

SEQ ID NO: 906701 - RNA, 19 nt, Homo sapiens
cgaggcuacugucacauuu

SEQ ID NO: 906702 - RNA, 19 nt, Homo sapiens
gaaaacagugccugcaaua

SEQ ID NO: 906703 - RNA, 19 nt, Homo sapiens
caagaugcaagaugagaaa

SEQ ID NO: 906704 - RNA, 19 nt, Homo sapiens
ucacgagucuacaaauaag

SEQ ID NO: 906705 - RNA, 19 nt, Homo sapiens
cgagucaucuucauuaagc

SEQ ID NO: 906706 - RNA, 19 nt, Homo sapiens
auucacgagucuacaaaua

SEQ ID NO: 906707 - RNA, 19 nt, Homo sapiens
ggaacucaaguccaagaaa

SEQ ID NO: 906708 - RNA, 19 nt, Homo sapiens
gaugcaagaugagaaacug

SEQ ID NO: 906709 - RNA, 19 nt, Homo sapiens
uuuccaagaugcaagauga

SEQ ID NO: 906710 - RNA, 19 nt, Homo sapiens
ggaaagaaaagcauauaga

SEQ ID NO: 906711 - RNA, 19 nt, Homo sapiens
acucaaguccaagaaauua

SEQ ID NO: 906712 - RNA, 19 nt, Homo sapiens
ggaaaacagugccugcaau

SEQ ID NO: 906713 - RNA, 19 nt, Homo sapiens
gcaugaguccaucagcaaa

SEQ ID NO: 906714 - RNA, 19 nt, Homo sapiens
ggaugaggaacaaggagaa

SEQ ID NO: 906715 - RNA, 19 nt, Homo sapiens
cagagcagccugugagcaa

SEQ ID NO: 906716 - RNA, 19 nt, Homo sapiens
uccaagaacugcauaagcu

SEQ ID NO: 906717 - RNA, 19 nt, Homo sapiens
cccaagaacagcaggguuu

SEQ ID NO: 906718 - RNA, 19 nt, Homo sapiens
aagaagaggcccaagaaca

SEQ ID NO: 906719 - RNA, 19 nt, Homo sapiens
cccgagucaucuucauuaa

SEQ ID NO: 906720 - RNA, 19 nt, Homo sapiens
gaaagaaaagcauauagag

SEQ ID NO: 906721 - RNA, 19 nt, Homo sapiens
ucacuugaaaugccuaugu

SEQ ID NO: 906722 - RNA, 19 nt, Homo sapiens
ucaaguccaagaaauuaga

SEQ ID NO: 906723 - RNA, 19 nt, Homo sapiens
ccaagaugcaagaugagaa

SEQ ID NO: 906724 - RNA, 19 nt, Homo sapiens
acagcaggguuuccaagau

SEQ ID NO: 906725 - RNA, 19 nt, Homo sapiens
caaaagguguuggcauuca

SEQ ID NO: 906726 - RNA, 19 nt, Homo sapiens
gaugaggaacaaggagaaa

SEQ ID NO: 906727 - RNA, 19 nt, Homo sapiens
agucagggaugaggaacaa

SEQ ID NO: 906728 - RNA, 19 nt, Homo sapiens
aaacuugucgcucuugaag

SEQ ID NO: 906729 - RNA, 19 nt, Homo sapiens
gaaacugcgggacgagaca

SEQ ID NO: 906730 - RNA, 19 nt, Homo sapiens
ggaggaauggguggcgaaa

SEQ ID NO: 906731 - RNA, 19 nt, Homo sapiens
caggugcagucagggauga

SEQ ID NO: 906732 - RNA, 19 nt, Homo sapiens
aggcuacugucacauuuca

SEQ ID NO: 906733 - RNA, 19 nt, Homo sapiens
agugcuggcugaacugaga

SEQ ID NO: 906734 - RNA, 19 nt, Homo sapiens
augaagaguuccaggagau

SEQ ID NO: 906735 - RNA, 19 nt, Homo sapiens
cacuugaaaugccuaugug

SEQ ID NO: 906736 - RNA, 19 nt, Homo sapiens
ccugugagcaaaguaauug

SEQ ID NO: 906737 - RNA, 19 nt, Homo sapiens
agaagaggcccaagaacag

SEQ ID NO: 906738 - RNA, 19 nt, Homo sapiens
aacagugccugcaauaaaa

SEQ ID NO: 906739 - RNA, 19 nt, Homo sapiens
cuacaaauaagaucuucca

SEQ ID NO: 906740 - RNA, 19 nt, Homo sapiens
gcgaaauucacgagucuac

SEQ ID NO: 906741 - RNA, 19 nt, Homo sapiens
gaucgcgccaucagcugaa

SEQ ID NO: 906742 - RNA, 19 nt, Homo sapiens
ggauccaagaacugcauaa

SEQ ID NO: 906743 - RNA, 19 nt, Homo sapiens
cgucugagaacgguguuaa

SEQ ID NO: 906744 - RNA, 19 nt, Homo sapiens
cagccugugagcaaaguaa

SEQ ID NO: 906745 - RNA, 19 nt, Homo sapiens
aaauucacgagucuacaaa

SEQ ID NO: 906746 - RNA, 19 nt, Homo sapiens
ccugagugcuggcugaacu

SEQ ID NO: 906747 - RNA, 19 nt, Homo sapiens
uucacgagucuacaaauaa

SEQ ID NO: 906748 - RNA, 19 nt, Homo sapiens
uggcgaaauucacgagucu

SEQ ID NO: 906749 - RNA, 19 nt, Homo sapiens
gauccaagaacugcauaag

SEQ ID NO: 906750 - RNA, 19 nt, Homo sapiens
agagcagccugugagcaaa

SEQ ID NO: 906751 - RNA, 19 nt, Homo sapiens
caacagaacuugaacacua

SEQ ID NO: 906752 - RNA, 19 nt, Homo sapiens
gaacaacagagauaagaaa

SEQ ID NO: 906753 - RNA, 19 nt, Homo sapiens
gcaccagaguccugaaauu

SEQ ID NO: 906754 - RNA, 19 nt, Homo sapiens
gaccuuggcucaccuuaga

SEQ ID NO: 906755 - RNA, 19 nt, Homo sapiens
uaucaccuaugaaacguua

SEQ ID NO: 906756 - RNA, 19 nt, Homo sapiens
gaaagagcagcguaaagaa

SEQ ID NO: 906757 - RNA, 19 nt, Homo sapiens
ugaacacuaucaccuauga

SEQ ID NO: 906758 - RNA, 19 nt, Homo sapiens
ccucugugcuugaaagauu

SEQ ID NO: 906759 - RNA, 19 nt, Homo sapiens
ugagaggauuguuuauuug

SEQ ID NO: 906760 - RNA, 19 nt, Homo sapiens
ugaaagagcagcguaaaga

SEQ ID NO: 906761 - RNA, 19 nt, Homo sapiens
ccagagcacuguuggaagu

SEQ ID NO: 906762 - RNA, 19 nt, Homo sapiens
ggugggccauguccuaauu

SEQ ID NO: 906763 - RNA, 19 nt, Homo sapiens
gaagaaacauggugaaaac

SEQ ID NO: 906764 - RNA, 19 nt, Homo sapiens
gaagaggacccagcauaga

SEQ ID NO: 906765 - RNA, 19 nt, Homo sapiens
caacagagauaagaaaaga

SEQ ID NO: 906766 - RNA, 19 nt, Homo sapiens
guaaagaaaguggaaagaa

SEQ ID NO: 906767 - RNA, 19 nt, Homo sapiens
ggccauguccuaauuaguu

SEQ ID NO: 906768 - RNA, 19 nt, Homo sapiens
gagaacaacagagauaaga

SEQ ID NO: 906769 - RNA, 19 nt, Homo sapiens
gccauguccuaauuaguuu

SEQ ID NO: 906770 - RNA, 19 nt, Homo sapiens
gagaggauuguuuauuuga

SEQ ID NO: 906771 - RNA, 19 nt, Homo sapiens
cgagguauuucaguuacua

SEQ ID NO: 906772 - RNA, 19 nt, Homo sapiens
auucugcgcuucucaguaa

SEQ ID NO: 906773 - RNA, 19 nt, Homo sapiens
gagaagaaacauggugaaa

SEQ ID NO: 906774 - RNA, 19 nt, Homo sapiens
cagcaggccuggcuuugug

SEQ ID NO: 906775 - RNA, 19 nt, Homo sapiens
aaacagcaauguggcaaug

SEQ ID NO: 906776 - RNA, 19 nt, Homo sapiens
gaaaguggaaagaauaaac

SEQ ID NO: 906777 - RNA, 19 nt, Homo sapiens
gagcagaagaagaauacaa

SEQ ID NO: 906778 - RNA, 19 nt, Homo sapiens
cuacgagguauuucaguua

SEQ ID NO: 906779 - RNA, 19 nt, Homo sapiens
aaagagcagcguaaagaaa

SEQ ID NO: 906780 - RNA, 19 nt, Homo sapiens
ucacggaggagcagauuga

SEQ ID NO: 906781 - RNA, 19 nt, Homo sapiens
gaauuucucacagcauuga

SEQ ID NO: 906782 - RNA, 19 nt, Homo sapiens
ccagaguccugaaauuguc

SEQ ID NO: 906783 - RNA, 19 nt, Homo sapiens
ggagaagaaacauggugaa

SEQ ID NO: 906784 - RNA, 19 nt, Homo sapiens
gccauuuccuggacguuga

SEQ ID NO: 906785 - RNA, 19 nt, Homo sapiens
gaagugugagguucuuugu

SEQ ID NO: 906786 - RNA, 19 nt, Homo sapiens
gaagugaaggaugccaauu

SEQ ID NO: 906787 - RNA, 19 nt, Homo sapiens
gaauacaaacagcaaugug

SEQ ID NO: 906788 - RNA, 19 nt, Homo sapiens
gaagaauacaaacagcaau

SEQ ID NO: 906789 - RNA, 19 nt, Homo sapiens
gaaaacaggcugagguugu

SEQ ID NO: 906790 - RNA, 19 nt, Homo sapiens
cgaagaggacccagcauag

SEQ ID NO: 906791 - RNA, 19 nt, Homo sapiens
aggccuggcuuugugguua

SEQ ID NO: 906792 - RNA, 19 nt, Homo sapiens
guaacuacgagguauuuca

SEQ ID NO: 906793 - RNA, 19 nt, Homo sapiens
aacagaacuugaacacuau

SEQ ID NO: 906794 - RNA, 19 nt, Homo sapiens
gcugagcagaagaagaaua

SEQ ID NO: 906795 - RNA, 19 nt, Homo sapiens
gcccagagcacuguuggaa

SEQ ID NO: 906796 - RNA, 19 nt, Homo sapiens
ggaagugaaggaugccaau

SEQ ID NO: 906797 - RNA, 19 nt, Homo sapiens
caccagaguccugaaauug

SEQ ID NO: 906798 - RNA, 19 nt, Homo sapiens
guugagaggauuguuuauu

SEQ ID NO: 906799 - RNA, 19 nt, Homo sapiens
cagaagaagaauacaaaca

SEQ ID NO: 906800 - RNA, 19 nt, Homo sapiens
gaacacuaucaccuaugaa

SEQ ID NO: 906801 - RNA, 19 nt, Homo sapiens
aagaggacccagcauagaa

SEQ ID NO: 906802 - RNA, 19 nt, Homo sapiens
acgaagaggacccagcaua

SEQ ID NO: 906803 - RNA, 19 nt, Homo sapiens
gacguugagaggauuguuu

SEQ ID NO: 906804 - RNA, 19 nt, Homo sapiens
cuugaacacuaucaccuau

SEQ ID NO: 906805 - RNA, 19 nt, Homo sapiens
acuacgagguauuucaguu

SEQ ID NO: 906806 - RNA, 19 nt, Homo sapiens
uuaguuggguacaucacaa

SEQ ID NO: 906807 - RNA, 19 nt, Homo sapiens
acagcaauguggcaaugga

SEQ ID NO: 906808 - RNA, 19 nt, Homo sapiens
caguaacuacgagguauuu

SEQ ID NO: 906809 - RNA, 19 nt, Homo sapiens
agugugagguucuuugucu

SEQ ID NO: 906810 - RNA, 19 nt, Homo sapiens
agaagaauacaaacagcaa

SEQ ID NO: 906811 - RNA, 19 nt, Homo sapiens
gagguauuucaguuacuaa

SEQ ID NO: 906812 - RNA, 19 nt, Homo sapiens
ggcgggacgucauggaagu

SEQ ID NO: 906813 - RNA, 19 nt, Homo sapiens
agaagaagaauacaaacag

SEQ ID NO: 906814 - RNA, 19 nt, Homo sapiens
ucaccuaugaaacguuaaa

SEQ ID NO: 906815 - RNA, 19 nt, Homo sapiens
gaggcgggacgucauggaa

SEQ ID NO: 906816 - RNA, 19 nt, Homo sapiens
acacagcucugggcaacag

SEQ ID NO: 906817 - RNA, 19 nt, Homo sapiens
uuggaagucugguuagagu

SEQ ID NO: 906818 - RNA, 19 nt, Homo sapiens
agugaaggaugccaauucu

SEQ ID NO: 906819 - RNA, 19 nt, Homo sapiens
ggcguuucaugaagucaga

SEQ ID NO: 906820 - RNA, 19 nt, Homo sapiens
ugaagugugagguucuuug

SEQ ID NO: 906821 - RNA, 19 nt, Homo sapiens
cagcguaaagaaaguggaa

SEQ ID NO: 906822 - RNA, 19 nt, Homo sapiens
gugguuaguuggguacauc

SEQ ID NO: 906823 - RNA, 19 nt, Homo sapiens
gcagaagaagaauacaaac

SEQ ID NO: 906824 - RNA, 19 nt, Homo sapiens
gccacaaguugaccaaagc

SEQ ID NO: 906825 - RNA, 19 nt, Homo sapiens
agaacaacagagauaagaa

SEQ ID NO: 906826 - RNA, 19 nt, Homo sapiens
gcucaccuuagaggaauuu

SEQ ID NO: 906827 - RNA, 19 nt, Homo sapiens
gggacgucauggaagugaa

SEQ ID NO: 906828 - RNA, 19 nt, Homo sapiens
ucucaguaacuacgaggua

SEQ ID NO: 906829 - RNA, 19 nt, Homo sapiens
acguugagaggauuguuua

SEQ ID NO: 906830 - RNA, 19 nt, Homo sapiens
gaggacccagcauagaaga

SEQ ID NO: 906831 - RNA, 19 nt, Homo sapiens
ggacgucauggaagugaag

SEQ ID NO: 906832 - RNA, 19 nt, Homo sapiens
aagaauacaaacagcaaug

SEQ ID NO: 906833 - RNA, 19 nt, Homo sapiens
agcagaagaagaauacaaa

SEQ ID NO: 906834 - RNA, 19 nt, Homo sapiens
aacacuaucaccuaugaaa

SEQ ID NO: 906835 - RNA, 19 nt, Homo sapiens
uaacuacgagguauuucag

SEQ ID NO: 906836 - RNA, 19 nt, Homo sapiens
cucgagaacaacagagaua

SEQ ID NO: 906837 - RNA, 19 nt, Homo sapiens
gacauuggcucuuuguuua

SEQ ID NO: 906838 - RNA, 19 nt, Homo sapiens
ccaggaaucuugugaauuu

SEQ ID NO: 906839 - RNA, 19 nt, Homo sapiens
gaagagcacugacgggaaa

SEQ ID NO: 906840 - RNA, 19 nt, Homo sapiens
ggaaacauccuaaaugaaa

SEQ ID NO: 906841 - RNA, 19 nt, Homo sapiens
gauaagaagcuuuguguuu

SEQ ID NO: 906842 - RNA, 19 nt, Homo sapiens
ggaaacagguaaacagaug

SEQ ID NO: 906843 - RNA, 19 nt, Homo sapiens
caaagaaggcuuaaugauu

SEQ ID NO: 906844 - RNA, 19 nt, Homo sapiens
aaagagagaucaagaacaa

SEQ ID NO: 906845 - RNA, 19 nt, Homo sapiens
gcacagaaauacauugauc

SEQ ID NO: 906846 - RNA, 19 nt, Homo sapiens
gaaguucaauaucagauga

SEQ ID NO: 906847 - RNA, 19 nt, Homo sapiens
ggugaaggcuuuggcaaua

SEQ ID NO: 906848 - RNA, 19 nt, Homo sapiens
gagaggaaauuaccacgaa

SEQ ID NO: 906849 - RNA, 19 nt, Homo sapiens
gaaucuaacucugauaaga

SEQ ID NO: 906850 - RNA, 19 nt, Homo sapiens
gcaaacaccugaauuaacg

SEQ ID NO: 906851 - RNA, 19 nt, Homo sapiens
caccaaagauaccagauaa

SEQ ID NO: 906852 - RNA, 19 nt, Homo sapiens
caaguacuaugcuuuaaug

SEQ ID NO: 906853 - RNA, 19 nt, Homo sapiens
guacuaugcuuuaaugcuu

SEQ ID NO: 906854 - RNA, 19 nt, Homo sapiens
uuacuaguauggccuauaa

SEQ ID NO: 906855 - RNA, 19 nt, Homo sapiens
agacuacacugaaacauug

SEQ ID NO: 906856 - RNA, 19 nt, Homo sapiens
caccauagauguucaagug

SEQ ID NO: 906857 - RNA, 19 nt, Homo sapiens
gugaagcccuaacguguaa

SEQ ID NO: 906858 - RNA, 19 nt, Homo sapiens
guaccaaucucugcuguga

SEQ ID NO: 906859 - RNA, 19 nt, Homo sapiens
gaauuaacgcuccaugaaa

SEQ ID NO: 906860 - RNA, 19 nt, Homo sapiens
aaagcaaacaccugaauua

SEQ ID NO: 906861 - RNA, 19 nt, Homo sapiens
acacacaucuccuucauca

SEQ ID NO: 906862 - RNA, 19 nt, Homo sapiens
gaaccuacucaaugugaua

SEQ ID NO: 906863 - RNA, 19 nt, Homo sapiens
uaagaagcuuuguguuuga

SEQ ID NO: 906864 - RNA, 19 nt, Homo sapiens
gagaaucuaacucugauaa

SEQ ID NO: 906865 - RNA, 19 nt, Homo sapiens
aaacaaggcccaauucgaa

SEQ ID NO: 906866 - RNA, 19 nt, Homo sapiens
gaggauacuucacacauca

SEQ ID NO: 906867 - RNA, 19 nt, Homo sapiens
uaauguggcucuuguagga

SEQ ID NO: 906868 - RNA, 19 nt, Homo sapiens
gaacaugccgucuuuacau

SEQ ID NO: 906869 - RNA, 19 nt, Homo sapiens
gcaaagaggaaagguauga

SEQ ID NO: 906870 - RNA, 19 nt, Homo sapiens
gcccuaacguguaaacuga

SEQ ID NO: 906871 - RNA, 19 nt, Homo sapiens
ggagaagacugugauugug

SEQ ID NO: 906872 - RNA, 19 nt, Homo sapiens
gcaauagccauaaagcaaa

SEQ ID NO: 906873 - RNA, 19 nt, Homo sapiens
gcaccacguuugacaacuu

SEQ ID NO: 906874 - RNA, 19 nt, Homo sapiens
ggcaauagaaagaagaaua

SEQ ID NO: 906875 - RNA, 19 nt, Homo sapiens
gcaaagaaggcuuaaugau

SEQ ID NO: 906876 - RNA, 19 nt, Homo sapiens
aaagcagucuuccaucaaa

SEQ ID NO: 906877 - RNA, 19 nt, Homo sapiens
gaucaugaauuugugacuu

SEQ ID NO: 906878 - RNA, 19 nt, Homo sapiens
gcaagcaccuauuccuaca

SEQ ID NO: 906879 - RNA, 19 nt, Homo sapiens
auaagaagcuuuguguuug

SEQ ID NO: 906880 - RNA, 19 nt, Homo sapiens
gaaagcagucuuccaucaa

SEQ ID NO: 906881 - RNA, 19 nt, Homo sapiens
gaaccaagaacucuaacug

SEQ ID NO: 906882 - RNA, 19 nt, Homo sapiens
caagaaccaagaacucuaa

SEQ ID NO: 906883 - RNA, 19 nt, Homo sapiens
ggacuggcagcuucaaauu

SEQ ID NO: 906884 - RNA, 19 nt, Homo sapiens
gaaacaaggcccaauucga

SEQ ID NO: 906885 - RNA, 19 nt, Homo sapiens
gcaauagaaagaagaauag

SEQ ID NO: 906886 - RNA, 19 nt, Homo sapiens
ugacuuaguucugcccuuu

SEQ ID NO: 906887 - RNA, 19 nt, Homo sapiens
cagcaaagaaggcuuaaug

SEQ ID NO: 906888 - RNA, 19 nt, Homo sapiens
ucacuugucauucuacuuu

SEQ ID NO: 906889 - RNA, 19 nt, Homo sapiens
caucuucgguugcuguuau

SEQ ID NO: 906890 - RNA, 19 nt, Homo sapiens
uaauugagccagcaaagaa

SEQ ID NO: 906891 - RNA, 19 nt, Homo sapiens
agaaagcagucuuccauca

SEQ ID NO: 906892 - RNA, 19 nt, Homo sapiens
gcacagacgagaaagaaca

SEQ ID NO: 906893 - RNA, 19 nt, Homo sapiens
cagguaaacagauguaauu

SEQ ID NO: 906894 - RNA, 19 nt, Homo sapiens
gaagcuuuguguuugaugu

SEQ ID NO: 906895 - RNA, 19 nt, Homo sapiens
ucuugaaagugcaguauuu

SEQ ID NO: 906896 - RNA, 19 nt, Homo sapiens
ugaugaaccuacucaaugu

SEQ ID NO: 906897 - RNA, 19 nt, Homo sapiens
gauuguggcucuccuaagg

SEQ ID NO: 906898 - RNA, 19 nt, Homo sapiens
caaaggauuucaguacauc

SEQ ID NO: 906899 - RNA, 19 nt, Homo sapiens
ccaaaggauuucaguacau

SEQ ID NO: 906900 - RNA, 19 nt, Homo sapiens
uguucaaacucaagcaaua

SEQ ID NO: 906901 - RNA, 19 nt, Homo sapiens
gaaaagcacagacgagaaa

SEQ ID NO: 906902 - RNA, 19 nt, Homo sapiens
ugagaagucuacauugcuu

SEQ ID NO: 906903 - RNA, 19 nt, Homo sapiens
ugaauuaacgcuccaugaa

SEQ ID NO: 906904 - RNA, 19 nt, Homo sapiens
gggagaagacugugauugu

SEQ ID NO: 906905 - RNA, 19 nt, Homo sapiens
agaauaauguggcucuugu

SEQ ID NO: 906906 - RNA, 19 nt, Homo sapiens
guauggaaaucuggucuga

SEQ ID NO: 906907 - RNA, 19 nt, Homo sapiens
agacauuggcucuuuguuu

SEQ ID NO: 906908 - RNA, 19 nt, Homo sapiens
cauaauggucuuucacuug

SEQ ID NO: 906909 - RNA, 19 nt, Homo sapiens
aauuaacgcuccaugaaau

SEQ ID NO: 906910 - RNA, 19 nt, Homo sapiens
ucuauuuggugcuggauaa

SEQ ID NO: 906911 - RNA, 19 nt, Homo sapiens
gggccagacuacacugaaa

SEQ ID NO: 906912 - RNA, 19 nt, Homo sapiens
gugaugaaccuacucaaug

SEQ ID NO: 906913 - RNA, 19 nt, Homo sapiens
ccacgaaaccugagaacau

SEQ ID NO: 906914 - RNA, 19 nt, Homo sapiens
ggacaagaaccaagaacuc

SEQ ID NO: 906915 - RNA, 19 nt, Homo sapiens
gaauaauguggcucuugua

SEQ ID NO: 906916 - RNA, 19 nt, Homo sapiens
aguuaacacuccagaauug

SEQ ID NO: 906917 - RNA, 19 nt, Homo sapiens
aaagucugcuucacugaga

SEQ ID NO: 906918 - RNA, 19 nt, Homo sapiens
gagaagucuacauugcuua

SEQ ID NO: 906919 - RNA, 19 nt, Homo sapiens
aagcaccuauuccuacaaa

SEQ ID NO: 906920 - RNA, 19 nt, Homo sapiens
ugagauggcacaguucuaa

SEQ ID NO: 906921 - RNA, 19 nt, Homo sapiens
ucaccaaagauaccagaua

SEQ ID NO: 906922 - RNA, 19 nt, Homo sapiens
uaaagcaaacaccugaauu

SEQ ID NO: 906923 - RNA, 19 nt, Homo sapiens
ugaaggcuuuggcaauaga

SEQ ID NO: 906924 - RNA, 19 nt, Homo sapiens
cuugaugggugaaggcuuu

SEQ ID NO: 906925 - RNA, 19 nt, Homo sapiens
caucuugccgugcacauuu

SEQ ID NO: 906926 - RNA, 19 nt, Homo sapiens
ccacgaccaugcucagcuu

SEQ ID NO: 906927 - RNA, 19 nt, Homo sapiens
gcaagcaccacguuugaca

SEQ ID NO: 906928 - RNA, 19 nt, Homo sapiens
gcgcaagcaccacguuuga

SEQ ID NO: 906929 - RNA, 19 nt, Homo sapiens
cacgaaaccugagaacaug

SEQ ID NO: 906930 - RNA, 19 nt, Homo sapiens
gcucauuguucaaacucaa

SEQ ID NO: 906931 - RNA, 19 nt, Homo sapiens
cggcuaaacuauucagagu

SEQ ID NO: 906932 - RNA, 19 nt, Homo sapiens
auaauggucuuucacuugu

SEQ ID NO: 906933 - RNA, 19 nt, Homo sapiens
gggcacagaaauacauuga

SEQ ID NO: 906934 - RNA, 19 nt, Homo sapiens
cacaucaucaccaaagaua

SEQ ID NO: 906935 - RNA, 19 nt, Homo sapiens
caugaaauaguuuguccua

SEQ ID NO: 906936 - RNA, 19 nt, Homo sapiens
ggugcuggauaaugccuuu

SEQ ID NO: 906937 - RNA, 19 nt, Homo sapiens
gcaagaaacucuaugaaua

SEQ ID NO: 906938 - RNA, 19 nt, Homo sapiens
gcacugaaacuguguauua

SEQ ID NO: 906939 - RNA, 19 nt, Homo sapiens
gaaaagcccuucaaaugua

SEQ ID NO: 906940 - RNA, 19 nt, Homo sapiens
uaaccaagaugggaaauuu

SEQ ID NO: 906941 - RNA, 19 nt, Homo sapiens
ggaaaguccuucagccaaa

SEQ ID NO: 906942 - RNA, 19 nt, Homo sapiens
ggaaaguccuucagccaaa

SEQ ID NO: 906943 - RNA, 19 nt, Homo sapiens
gaaacccugucucuacuaa

SEQ ID NO: 906944 - RNA, 19 nt, Homo sapiens
gcagugagcugugaucaug

SEQ ID NO: 906945 - RNA, 19 nt, Homo sapiens
aaugaucgcucaacccuua

SEQ ID NO: 906946 - RNA, 19 nt, Homo sapiens
gauccaaacuuauuacaca

SEQ ID NO: 906947 - RNA, 19 nt, Homo sapiens
gagaaacccuaugaaugua

SEQ ID NO: 906948 - RNA, 19 nt, Homo sapiens
ggaaaccucuucagucaca

SEQ ID NO: 906949 - RNA, 19 nt, Homo sapiens
gcaaaacugucucuauuaa

SEQ ID NO: 906950 - RNA, 19 nt, Homo sapiens
gaucagagcaaccaguuaa

SEQ ID NO: 906951 - RNA, 19 nt, Homo sapiens
gagagaaaccguacgauug

SEQ ID NO: 906952 - RNA, 19 nt, Homo sapiens
acccagagauccaaacuua

SEQ ID NO: 906953 - RNA, 19 nt, Homo sapiens
gggagaagccguacaaaug

SEQ ID NO: 906954 - RNA, 19 nt, Homo sapiens
gaaaagcccuucgaaugua

SEQ ID NO: 906955 - RNA, 19 nt, Homo sapiens
gagagaaacccuaugaaug

SEQ ID NO: 906956 - RNA, 19 nt, Homo sapiens
guacaucagagaauucaua

SEQ ID NO: 906957 - RNA, 19 nt, Homo sapiens
gagaagcccugugaauguu

SEQ ID NO: 906958 - RNA, 19 nt, Homo sapiens
gggaaagccuucaaugauc

SEQ ID NO: 906959 - RNA, 19 nt, Homo sapiens
gaaguaugaccuuguugua

SEQ ID NO: 906960 - RNA, 19 nt, Homo sapiens
ggaaaagccuucaaucgaa

SEQ ID NO: 906961 - RNA, 19 nt, Homo sapiens
gaacagaagccagugcauu

SEQ ID NO: 906962 - RNA, 19 nt, Homo sapiens
ugccagaccuuguuuacua

SEQ ID NO: 906963 - RNA, 19 nt, Homo sapiens
gaaacucuaugaauaacca

SEQ ID NO: 906964 - RNA, 19 nt, Homo sapiens
ggagagaaaccguacgauu

SEQ ID NO: 906965 - RNA, 19 nt, Homo sapiens
ccaaagcuaugaguuaguu

SEQ ID NO: 906966 - RNA, 19 nt, Homo sapiens
gaagaaaagugaugacugu

SEQ ID NO: 906967 - RNA, 19 nt, Homo sapiens
gcaaaauccugucuacaaa

SEQ ID NO: 906968 - RNA, 19 nt, Homo sapiens
gaagcccugugaauguuaa

SEQ ID NO: 906969 - RNA, 19 nt, Homo sapiens
ggagagaaacccuaugaau

SEQ ID NO: 906970 - RNA, 19 nt, Homo sapiens
gaaaagcccuaugaaugua

SEQ ID NO: 906971 - RNA, 19 nt, Homo sapiens
ggaaauccuucagauggaa

SEQ ID NO: 906972 - RNA, 19 nt, Homo sapiens
gcucaacccuuaguaaaca

SEQ ID NO: 906973 - RNA, 19 nt, Homo sapiens
ccaaagcuaucgguuaguu

SEQ ID NO: 906974 - RNA, 19 nt, Homo sapiens
gagaaaagcccuucaaaug

SEQ ID NO: 906975 - RNA, 19 nt, Homo sapiens
ccagagauccaaacuuauu

SEQ ID NO: 906976 - RNA, 19 nt, Homo sapiens
gagaagccaucugugugua

SEQ ID NO: 906977 - RNA, 19 nt, Homo sapiens
ggaaaccuguucugagagu

SEQ ID NO: 906978 - RNA, 19 nt, Homo sapiens
gauugagacacucuaaaua

SEQ ID NO: 906979 - RNA, 19 nt, Homo sapiens
gaacucuaaccucgucaua

SEQ ID NO: 906980 - RNA, 19 nt, Homo sapiens
ccagaaguaugaccuuguu

SEQ ID NO: 906981 - RNA, 19 nt, Homo sapiens
gaguaaacuuggaaacguu

SEQ ID NO: 906982 - RNA, 19 nt, Homo sapiens
gaaauggaagcacguucua

SEQ ID NO: 906983 - RNA, 19 nt, Homo sapiens
agccaacggugucaacuua

SEQ ID NO: 906984 - RNA, 19 nt, Homo sapiens
gagccacccucuuugguau

SEQ ID NO: 906985 - RNA, 19 nt, Homo sapiens
gagagaagcccugugaaug

SEQ ID NO: 906986 - RNA, 19 nt, Homo sapiens
ggagagaagcccugugaau

SEQ ID NO: 906987 - RNA, 19 nt, Homo sapiens
gaacaucagaggacauauc

SEQ ID NO: 906988 - RNA, 19 nt, Homo sapiens
agagaaacccuaugaaugu

SEQ ID NO: 906989 - RNA, 19 nt, Homo sapiens
cgucauacaucagagaauu

SEQ ID NO: 906990 - RNA, 19 nt, Homo sapiens
gggaaauccuucagaugga

SEQ ID NO: 906991 - RNA, 19 nt, Homo sapiens
cagccaaagcuaugaguua

SEQ ID NO: 906992 - RNA, 19 nt, Homo sapiens
gaacucuaaccucauugua

SEQ ID NO: 906993 - RNA, 19 nt, Homo sapiens
gagaaaagcccuaugaaug

SEQ ID NO: 906994 - RNA, 19 nt, Homo sapiens
gagaccauccuggcuaaua

SEQ ID NO: 906995 - RNA, 19 nt, Homo sapiens
ggagagaaaccguaugagu

SEQ ID NO: 906996 - RNA, 19 nt, Homo sapiens
guggaacucuaaccucauu

SEQ ID NO: 906997 - RNA, 19 nt, Homo sapiens
gaaaauccuucacguggaa

SEQ ID NO: 906998 - RNA, 19 nt, Homo sapiens
gugcaucggcggacacaua

SEQ ID NO: 906999 - RNA, 19 nt, Homo sapiens
gcuaugaguuaguuacaca

SEQ ID NO: 907000 - RNA, 19 nt, Homo sapiens
ccuucuaccuacaacauua

SEQ ID NO: 907001 - RNA, 19 nt, Homo sapiens
gaaagcucaugggcaagaa

SEQ ID NO: 907002 - RNA, 19 nt, Homo sapiens
gacacacacuggaggcaaa

SEQ ID NO: 907003 - RNA, 19 nt, Homo sapiens
gagaaaagcccuacgaaug

SEQ ID NO: 907004 - RNA, 19 nt, Homo sapiens
gacacauacuggagagaaa

SEQ ID NO: 907005 - RNA, 19 nt, Homo sapiens
ccaaacuuauuacacauca

SEQ ID NO: 907006 - RNA, 19 nt, Homo sapiens
gagaaaagcccuucgaaug

SEQ ID NO: 907007 - RNA, 19 nt, Homo sapiens
gaagccaucuguguguaau

SEQ ID NO: 907008 - RNA, 19 nt, Homo sapiens
gccacccucuuugguauua

SEQ ID NO: 907009 - RNA, 19 nt, Homo sapiens
ggagccacccucuuuggua

SEQ ID NO: 907010 - RNA, 19 nt, Homo sapiens
gaauguaacgaguguggaa

SEQ ID NO: 907011 - RNA, 19 nt, Homo sapiens
ucagaguccuacaguggua

SEQ ID NO: 907012 - RNA, 19 nt, Homo sapiens
ggagagaagcccuaugagu

SEQ ID NO: 907013 - RNA, 19 nt, Homo sapiens
ggagagaagcccuaugagu

SEQ ID NO: 907014 - RNA, 19 nt, Homo sapiens
ucucucagcuggagcaaga

SEQ ID NO: 907015 - RNA, 19 nt, Homo sapiens
gaaacccuaugaauguagu

SEQ ID NO: 907016 - RNA, 19 nt, Homo sapiens
gagagucugugccuuguac

SEQ ID NO: 907017 - RNA, 19 nt, Homo sapiens
caacauuaccuacaaguac

SEQ ID NO: 907018 - RNA, 19 nt, Homo sapiens
aaucugaugugaucucuca

SEQ ID NO: 907019 - RNA, 19 nt, Homo sapiens
gaaaucagguggccaaaac

SEQ ID NO: 907020 - RNA, 19 nt, Homo sapiens
ggacauauccuggagaaaa

SEQ ID NO: 907021 - RNA, 19 nt, Homo sapiens
ggacacauacuggagagaa

SEQ ID NO: 907022 - RNA, 19 nt, Homo sapiens
ccaaacuuauuacgcauca

SEQ ID NO: 907023 - RNA, 19 nt, Homo sapiens
guacaaacagaaagaagug

SEQ ID NO: 907024 - RNA, 19 nt, Homo sapiens
agggaaaccuguucugaga

SEQ ID NO: 907025 - RNA, 19 nt, Homo sapiens
aagcagcgguugugacuca

SEQ ID NO: 907026 - RNA, 19 nt, Homo sapiens
gcuccuaccuugugaugca

SEQ ID NO: 907027 - RNA, 19 nt, Homo sapiens
gaaaguccuucagccaaag

SEQ ID NO: 907028 - RNA, 19 nt, Homo sapiens
gaaaguccuucagccaaag

SEQ ID NO: 907029 - RNA, 19 nt, Homo sapiens
cagagauccaaacuuauua

SEQ ID NO: 907030 - RNA, 19 nt, Homo sapiens
gugaugacuguaaggauua

SEQ ID NO: 907031 - RNA, 19 nt, Homo sapiens
ggauguggcuauggcauuc

SEQ ID NO: 907032 - RNA, 19 nt, Homo sapiens
gaggcaaacccuaugaaug

SEQ ID NO: 907033 - RNA, 19 nt, Homo sapiens
ucgguuaguugcacauaaa

SEQ ID NO: 907034 - RNA, 19 nt, Homo sapiens
cagccaaagcuaucgguua

SEQ ID NO: 907035 - RNA, 19 nt, Homo sapiens
agaccauccuggcuaauau

SEQ ID NO: 907036 - RNA, 19 nt, Homo sapiens
cgaggcagguggaucacuu

SEQ ID NO: 907037 - RNA, 19 nt, Homo sapiens
gagaagaccuugacccuaa

SEQ ID NO: 907038 - RNA, 19 nt, Homo sapiens
gaaaguguauuugugcaua

SEQ ID NO: 907039 - RNA, 19 nt, Homo sapiens
ccaagccucuccugacaua

SEQ ID NO: 907040 - RNA, 19 nt, Homo sapiens
guagggcccuucaucgaua

SEQ ID NO: 907041 - RNA, 19 nt, Homo sapiens
gguuauaacuccuauuuca

SEQ ID NO: 907042 - RNA, 19 nt, Homo sapiens
gcaaguggauggacagcuu

SEQ ID NO: 907043 - RNA, 19 nt, Homo sapiens
ccaggaaguugugugauuu

SEQ ID NO: 907044 - RNA, 19 nt, Homo sapiens
guggugagcuggaacauca

SEQ ID NO: 907045 - RNA, 19 nt, Homo sapiens
caagauccuucgcuuccua

SEQ ID NO: 907046 - RNA, 19 nt, Homo sapiens
gauguugguugcuauggaa

SEQ ID NO: 907047 - RNA, 19 nt, Homo sapiens
gugcauaaauaaagucugu

SEQ ID NO: 907048 - RNA, 19 nt, Homo sapiens
aagaugcgcuucuaucguu

SEQ ID NO: 907049 - RNA, 19 nt, Homo sapiens
gaacuccgggcucuggaua

SEQ ID NO: 907050 - RNA, 19 nt, Homo sapiens
gaccagggaugcacugaca

SEQ ID NO: 907051 - RNA, 19 nt, Homo sapiens
gcuggaaaguguauuugug

SEQ ID NO: 907052 - RNA, 19 nt, Homo sapiens
gcucccggcuugacuaugu

SEQ ID NO: 907053 - RNA, 19 nt, Homo sapiens
gugagcuucuugugccuua

SEQ ID NO: 907054 - RNA, 19 nt, Homo sapiens
ccaaagaugagaaggaguu

SEQ ID NO: 907055 - RNA, 19 nt, Homo sapiens
guacagacaugccaaaaca

SEQ ID NO: 907056 - RNA, 19 nt, Homo sapiens
cccaguggcugcugaagaa

SEQ ID NO: 907057 - RNA, 19 nt, Homo sapiens
auggacagcuugcucagua

SEQ ID NO: 907058 - RNA, 19 nt, Homo sapiens
uggaugaguuuacccaaga

SEQ ID NO: 907059 - RNA, 19 nt, Homo sapiens
cccaggaaguugugugauu

SEQ ID NO: 907060 - RNA, 19 nt, Homo sapiens
ggauguugguugcuaugga

SEQ ID NO: 907061 - RNA, 19 nt, Homo sapiens
uaaaucacuucugucuuug

SEQ ID NO: 907062 - RNA, 19 nt, Homo sapiens
uuacaccacuuuccaccuu

SEQ ID NO: 907063 - RNA, 19 nt, Homo sapiens
gaagccaggacccaacuug

SEQ ID NO: 907064 - RNA, 19 nt, Homo sapiens
gcacccagcucaagauccu

SEQ ID NO: 907065 - RNA, 19 nt, Homo sapiens
cgaaguacacggacacuag

SEQ ID NO: 907066 - RNA, 19 nt, Homo sapiens
gccaacuucugaacaggaa

SEQ ID NO: 907067 - RNA, 19 nt, Homo sapiens
caaagaugagaaggaguua

SEQ ID NO: 907068 - RNA, 19 nt, Homo sapiens
ggugcagucuugagugugu

SEQ ID NO: 907069 - RNA, 19 nt, Homo sapiens
gcagccaugugaucauucu

SEQ ID NO: 907070 - RNA, 19 nt, Homo sapiens
cugagcggcuagucuuuaa

SEQ ID NO: 907071 - RNA, 19 nt, Homo sapiens
uaucgucugucuccaggaa

SEQ ID NO: 907072 - RNA, 19 nt, Homo sapiens
gcauaaauaaagucugugu

SEQ ID NO: 907073 - RNA, 19 nt, Homo sapiens
cgaagacuccagaagagaa

SEQ ID NO: 907074 - RNA, 19 nt, Homo sapiens
gaaggcaguggccaaagug

SEQ ID NO: 907075 - RNA, 19 nt, Homo sapiens
caaccuggaaugcuuugaa

SEQ ID NO: 907076 - RNA, 19 nt, Homo sapiens
caaagucuccuacccuucu

SEQ ID NO: 907077 - RNA, 19 nt, Homo sapiens
gcaggcacccagcucaaga

SEQ ID NO: 907078 - RNA, 19 nt, Homo sapiens
gagguguuccagcccuuua

SEQ ID NO: 907079 - RNA, 19 nt, Homo sapiens
uggcuaucguugaggguua

SEQ ID NO: 907080 - RNA, 19 nt, Homo sapiens
agaaggcaguggccaaagu

SEQ ID NO: 907081 - RNA, 19 nt, Homo sapiens
gcuauggaaacauggauga

SEQ ID NO: 907082 - RNA, 19 nt, Homo sapiens
ggaugcggauaucgucugu

SEQ ID NO: 907083 - RNA, 19 nt, Homo sapiens
ucgcuuuccuuccuaccua

SEQ ID NO: 907084 - RNA, 19 nt, Homo sapiens
ccagucagguuggcucuag

SEQ ID NO: 907085 - RNA, 19 nt, Homo sapiens
ccagucugccucucaugua

SEQ ID NO: 907086 - RNA, 19 nt, Homo sapiens
gcacaugggaagguaagga

SEQ ID NO: 907087 - RNA, 19 nt, Homo sapiens
ggaguuacggaccucauuc

SEQ ID NO: 907088 - RNA, 19 nt, Homo sapiens
agucgacgcugcagcacaa

SEQ ID NO: 907089 - RNA, 19 nt, Homo sapiens
gcaggcagccaugugauca

SEQ ID NO: 907090 - RNA, 19 nt, Homo sapiens
cagucaaccuggaaugcuu

SEQ ID NO: 907091 - RNA, 19 nt, Homo sapiens
gaagacuccagaagagaag

SEQ ID NO: 907092 - RNA, 19 nt, Homo sapiens
cugccuagccuaccacuga

SEQ ID NO: 907093 - RNA, 19 nt, Homo sapiens
aaucaaacccggguacaga

SEQ ID NO: 907094 - RNA, 19 nt, Homo sapiens
auggaaacauggaugaguu

SEQ ID NO: 907095 - RNA, 19 nt, Homo sapiens
aggcccagcugaaccaaug

SEQ ID NO: 907096 - RNA, 19 nt, Homo sapiens
caaaucaggaacccagcaa

SEQ ID NO: 907097 - RNA, 19 nt, Homo sapiens
uuccagcccuuuaagaugu

SEQ ID NO: 907098 - RNA, 19 nt, Homo sapiens
ggaaaguguauuugugcau

SEQ ID NO: 907099 - RNA, 19 nt, Homo sapiens
ggaccucauucuggaaguc

SEQ ID NO: 907100 - RNA, 19 nt, Homo sapiens
cuuccuaguuccucucgaa

SEQ ID NO: 907101 - RNA, 19 nt, Homo sapiens
ccugagcggcuagucuuua

SEQ ID NO: 907102 - RNA, 19 nt, Homo sapiens
ucaggaacccagcaacugu

SEQ ID NO: 907103 - RNA, 19 nt, Homo sapiens
aaacccggguacagacaug

SEQ ID NO: 907104 - RNA, 19 nt, Homo sapiens
ggucauagacaccuuucag

SEQ ID NO: 907105 - RNA, 19 nt, Homo sapiens
guguagccaccuucuguaa

SEQ ID NO: 907106 - RNA, 19 nt, Homo sapiens
aggguuauaacuccuauuu

SEQ ID NO: 907107 - RNA, 19 nt, Homo sapiens
gauccuucgcuuccuaguu

SEQ ID NO: 907108 - RNA, 19 nt, Homo sapiens
uggacagcuugcucaguaa

SEQ ID NO: 907109 - RNA, 19 nt, Homo sapiens
agaagaccuugacccuaau

SEQ ID NO: 907110 - RNA, 19 nt, Homo sapiens
uccgggcucuggauaguga

SEQ ID NO: 907111 - RNA, 19 nt, Homo sapiens
aggcagccaugugaucauu

SEQ ID NO: 907112 - RNA, 19 nt, Homo sapiens
ugaguuuacccaagaggaa

SEQ ID NO: 907113 - RNA, 19 nt, Homo sapiens
guuccagcccuuuaagaug

SEQ ID NO: 907114 - RNA, 19 nt, Homo sapiens
ggaaguugugugauuuuaa

SEQ ID NO: 907115 - RNA, 19 nt, Homo sapiens
ccagggaugcacugacaga

SEQ ID NO: 907116 - RNA, 19 nt, Homo sapiens
auccuucgcuuccuaguuc

SEQ ID NO: 907117 - RNA, 19 nt, Homo sapiens
ugacccuaaucaacgugua

SEQ ID NO: 907118 - RNA, 19 nt, Homo sapiens
ggaugaguuuacccaagag

SEQ ID NO: 907119 - RNA, 19 nt, Homo sapiens
gagcuucuugugccuuaau

SEQ ID NO: 907120 - RNA, 19 nt, Homo sapiens
cccgaagacuccagaagag

SEQ ID NO: 907121 - RNA, 19 nt, Homo sapiens
aaaccugaagagcuacuuu

SEQ ID NO: 907122 - RNA, 19 nt, Homo sapiens
cagucugccucucauguag

SEQ ID NO: 907123 - RNA, 19 nt, Homo sapiens
ggccugagcggcuagucuu

SEQ ID NO: 907124 - RNA, 19 nt, Homo sapiens
ugaggguuauaacuccuau

SEQ ID NO: 907125 - RNA, 19 nt, Homo sapiens
ugugugaugcguacuguga

SEQ ID NO: 907126 - RNA, 19 nt, Homo sapiens
ggcccuucaucgauagcua

SEQ ID NO: 907127 - RNA, 19 nt, Homo sapiens
ggaugcagucaaccuggaa

SEQ ID NO: 907128 - RNA, 19 nt, Homo sapiens
gaagaccuugacccuaauc

SEQ ID NO: 907129 - RNA, 19 nt, Homo sapiens
ggagguguuccagcccuuu

SEQ ID NO: 907130 - RNA, 19 nt, Homo sapiens
caugggaagguaaggagaa

SEQ ID NO: 907131 - RNA, 19 nt, Homo sapiens
acagcuugcucaguaacuu

SEQ ID NO: 907132 - RNA, 19 nt, Homo sapiens
gcccuccucacacagcaua

SEQ ID NO: 907133 - RNA, 19 nt, Homo sapiens
cagaagccaaagaugagaa

SEQ ID NO: 907134 - RNA, 19 nt, Homo sapiens
cgacgcugcagcacaacaa

SEQ ID NO: 907135 - RNA, 19 nt, Homo sapiens
agcauaagauccgcacaug

SEQ ID NO: 907136 - RNA, 19 nt, Homo sapiens
gcaaagggaucguaugaua

SEQ ID NO: 907137 - RNA, 19 nt, Homo sapiens
gaauguggcuguagauaga

SEQ ID NO: 907138 - RNA, 19 nt, Homo sapiens
uaauaaggguguacaguaa

SEQ ID NO: 907139 - RNA, 19 nt, Homo sapiens
gaaauggacaggucaguuu

SEQ ID NO: 907140 - RNA, 19 nt, Homo sapiens
ggaacugaaugaaaugauu

SEQ ID NO: 907141 - RNA, 19 nt, Homo sapiens
ccacaaagcaugcaauuau

SEQ ID NO: 907142 - RNA, 19 nt, Homo sapiens
caacaaauuugcaacagau

SEQ ID NO: 907143 - RNA, 19 nt, Homo sapiens
aaaggaaacuacuguaaga

SEQ ID NO: 907144 - RNA, 19 nt, Homo sapiens
ggaaggaggaacugaauga

SEQ ID NO: 907145 - RNA, 19 nt, Homo sapiens
aaagggaucguaugauaua

SEQ ID NO: 907146 - RNA, 19 nt, Homo sapiens
gaaacaugcuggucuuggu

SEQ ID NO: 907147 - RNA, 19 nt, Homo sapiens
ggaacucuacaacaaauuu

SEQ ID NO: 907148 - RNA, 19 nt, Homo sapiens
ggaguagaccggaaaauua

SEQ ID NO: 907149 - RNA, 19 nt, Homo sapiens
gagcaugaaggaugaguuu

SEQ ID NO: 907150 - RNA, 19 nt, Homo sapiens
caucauggcugaacuuagg

SEQ ID NO: 907151 - RNA, 19 nt, Homo sapiens
agaagaguccuauggcuua

SEQ ID NO: 907152 - RNA, 19 nt, Homo sapiens
ccucaagaauucccagaaa

SEQ ID NO: 907153 - RNA, 19 nt, Homo sapiens
ccaaaggaaacuacuguaa

SEQ ID NO: 907154 - RNA, 19 nt, Homo sapiens
gauauacgauggaguagac

SEQ ID NO: 907155 - RNA, 19 nt, Homo sapiens
caagaaugaagaucuguuu

SEQ ID NO: 907156 - RNA, 19 nt, Homo sapiens
auaaggguguacaguaaua

SEQ ID NO: 907157 - RNA, 19 nt, Homo sapiens
gaagaguccuauggcuuau

SEQ ID NO: 907158 - RNA, 19 nt, Homo sapiens
ggacaggucaguuuguugu

SEQ ID NO: 907159 - RNA, 19 nt, Homo sapiens
acaaaggcgucgucaccua

SEQ ID NO: 907160 - RNA, 19 nt, Homo sapiens
agagagagaggaagaguuu

SEQ ID NO: 907161 - RNA, 19 nt, Homo sapiens
uggcugaacuuaggcuaua

SEQ ID NO: 907162 - RNA, 19 nt, Homo sapiens
uuaauaaggguguacagua

SEQ ID NO: 907163 - RNA, 19 nt, Homo sapiens
agaguccuauggcuuauuu

SEQ ID NO: 907164 - RNA, 19 nt, Homo sapiens
ccaucuccauccucuauuu

SEQ ID NO: 907165 - RNA, 19 nt, Homo sapiens
ccaaacuugucuccaguga

SEQ ID NO: 907166 - RNA, 19 nt, Homo sapiens
uaugauauacgauggagua

SEQ ID NO: 907167 - RNA, 19 nt, Homo sapiens
aaggaugaguuucuuaaga

SEQ ID NO: 907168 - RNA, 19 nt, Homo sapiens
aggaggaacugaaugaaau

SEQ ID NO: 907169 - RNA, 19 nt, Homo sapiens
ugaaggaugaguuucuuaa

SEQ ID NO: 907170 - RNA, 19 nt, Homo sapiens
ccuggcagcuuacuugguu

SEQ ID NO: 907171 - RNA, 19 nt, Homo sapiens
gugcaaagggaucguauga

SEQ ID NO: 907172 - RNA, 19 nt, Homo sapiens
caacagaucggaccuccau

SEQ ID NO: 907173 - RNA, 19 nt, Homo sapiens
ggaaauggacaggucaguu

SEQ ID NO: 907174 - RNA, 19 nt, Homo sapiens
gucgucaccuacaaguuua

SEQ ID NO: 907175 - RNA, 19 nt, Homo sapiens
ugaaugccgugguguuugu

SEQ ID NO: 907176 - RNA, 19 nt, Homo sapiens
gauacgaagccuaugaaug

SEQ ID NO: 907177 - RNA, 19 nt, Homo sapiens
caaagggaucguaugauau

SEQ ID NO: 907178 - RNA, 19 nt, Homo sapiens
gaacucuacaacaaauuug

SEQ ID NO: 907179 - RNA, 19 nt, Homo sapiens
caaaggaaacuacuguaag

SEQ ID NO: 907180 - RNA, 19 nt, Homo sapiens
gacaggagacauuuacguu

SEQ ID NO: 907181 - RNA, 19 nt, Homo sapiens
uuaggaguuucaagaauga

SEQ ID NO: 907182 - RNA, 19 nt, Homo sapiens
acaacaaauuugcaacaga

SEQ ID NO: 907183 - RNA, 19 nt, Homo sapiens
cgucgucaccuacaaguuu

SEQ ID NO: 907184 - RNA, 19 nt, Homo sapiens
gagcaucucacacccacaa

SEQ ID NO: 907185 - RNA, 19 nt, Homo sapiens
gggaagaggcuuuguugca

SEQ ID NO: 907186 - RNA, 19 nt, Homo sapiens
uuaaugggcuccgaaaaua

SEQ ID NO: 907187 - RNA, 19 nt, Homo sapiens
cacaaagcaugcaauuauc

SEQ ID NO: 907188 - RNA, 19 nt, Homo sapiens
guggacggcuagaaauaga

SEQ ID NO: 907189 - RNA, 19 nt, Homo sapiens
acauuuacguuccacaaga

SEQ ID NO: 907190 - RNA, 19 nt, Homo sapiens
ggaugaguuucuuaagaca

SEQ ID NO: 907191 - RNA, 19 nt, Homo sapiens
gcagucuccucuggaagaa

SEQ ID NO: 907192 - RNA, 19 nt, Homo sapiens
ccuacaaguuuaaauacga

SEQ ID NO: 907193 - RNA, 19 nt, Homo sapiens
gaaggaggaacugaaugaa

SEQ ID NO: 907194 - RNA, 19 nt, Homo sapiens
gauaaugagggagaaagaa

SEQ ID NO: 907195 - RNA, 19 nt, Homo sapiens
ggauaaugagggagaaaga

SEQ ID NO: 907196 - RNA, 19 nt, Homo sapiens
cauuaggaguuucaagaau

SEQ ID NO: 907197 - RNA, 19 nt, Homo sapiens
gcaguggacggcuagaaau

SEQ ID NO: 907198 - RNA, 19 nt, Homo sapiens
ggagggagagagagaggaa

SEQ ID NO: 907199 - RNA, 19 nt, Homo sapiens
cagaguacauguuggaacu

SEQ ID NO: 907200 - RNA, 19 nt, Homo sapiens
acacuaaaccucucugaca

SEQ ID NO: 907201 - RNA, 19 nt, Homo sapiens
gaggcuuuguugcagauga

SEQ ID NO: 907202 - RNA, 19 nt, Homo sapiens
gaggaaggaggaacugaau

SEQ ID NO: 907203 - RNA, 19 nt, Homo sapiens
guccauuccucaccaugaa

SEQ ID NO: 907204 - RNA, 19 nt, Homo sapiens
ccaacaucauuaggaguuu

SEQ ID NO: 907205 - RNA, 19 nt, Homo sapiens
caugaaggaugaguuucuu

SEQ ID NO: 907206 - RNA, 19 nt, Homo sapiens
ggcuguagauagaagaaga

SEQ ID NO: 907207 - RNA, 19 nt, Homo sapiens
caacaucauuaggaguuuc

SEQ ID NO: 907208 - RNA, 19 nt, Homo sapiens
caucuccauccucuauuua

SEQ ID NO: 907209 - RNA, 19 nt, Homo sapiens
ugacuccacugcccgaauc

SEQ ID NO: 907210 - RNA, 19 nt, Homo sapiens
gccaacaucauuaggaguu

SEQ ID NO: 907211 - RNA, 19 nt, Homo sapiens
auacgaagccuaugaaugc

SEQ ID NO: 907212 - RNA, 19 nt, Homo sapiens
gggugggacuccuggauca

SEQ ID NO: 907213 - RNA, 19 nt, Homo sapiens
ggaggaacugaaugaaaug

SEQ ID NO: 907214 - RNA, 19 nt, Homo sapiens
gaaggaugaguuucuuaag

SEQ ID NO: 907215 - RNA, 19 nt, Homo sapiens
ucaguuuguuguaggaaau

SEQ ID NO: 907216 - RNA, 19 nt, Homo sapiens
caguggacggcuagaaaua

SEQ ID NO: 907217 - RNA, 19 nt, Homo sapiens
uauauggaaccaacaguga

SEQ ID NO: 907218 - RNA, 19 nt, Homo sapiens
gcaugaaggaugaguuucu

SEQ ID NO: 907219 - RNA, 19 nt, Homo sapiens
gcccaucuccauccucuau

SEQ ID NO: 907220 - RNA, 19 nt, Homo sapiens
gagagagagaggaagaguu

SEQ ID NO: 907221 - RNA, 19 nt, Homo sapiens
uauacacacuggugcaaag

SEQ ID NO: 907222 - RNA, 19 nt, Homo sapiens
auuaggaguuucaagaaug

SEQ ID NO: 907223 - RNA, 19 nt, Homo sapiens
cacuaaaccucucugacau

SEQ ID NO: 907224 - RNA, 19 nt, Homo sapiens
gccgugguguuuguaacua

SEQ ID NO: 907225 - RNA, 19 nt, Homo sapiens
uaugaaugccgugguguuu

SEQ ID NO: 907226 - RNA, 19 nt, Homo sapiens
gugcccagaauaagcauaa

SEQ ID NO: 907227 - RNA, 19 nt, Homo sapiens
auaaugagggagaaagaaa

SEQ ID NO: 907228 - RNA, 19 nt, Homo sapiens
ccagugacaggagacauuu

SEQ ID NO: 907229 - RNA, 19 nt, Homo sapiens
cauuuacguuccacaagau

SEQ ID NO: 907230 - RNA, 19 nt, Homo sapiens
uagaagaagaguccuaugg

SEQ ID NO: 907231 - RNA, 19 nt, Homo sapiens
gaggaacugaaugaaauga

SEQ ID NO: 907232 - RNA, 19 nt, Homo sapiens
uccagagcaugaaggauga

SEQ ID NO: 907233 - RNA, 19 nt, Homo sapiens
ucauuaggaguuucaagaa

SEQ ID NO: 907234 - RNA, 19 nt, Homo sapiens
gucaguuuguuguaggaaa

SEQ ID NO: 907235 - RNA, 19 nt, Homo sapiens
aagauaaaacugccacuua

SEQ ID NO: 907236 - RNA, 19 nt, Homo sapiens
ggaccuacauuccucagua

SEQ ID NO: 907237 - RNA, 19 nt, Homo sapiens
cagcagagguguuggcuuu

SEQ ID NO: 907238 - RNA, 19 nt, Homo sapiens
cgacagcuguuucuauuga

SEQ ID NO: 907239 - RNA, 19 nt, Homo sapiens
gcaaauauacccagaaugg

SEQ ID NO: 907240 - RNA, 19 nt, Homo sapiens
caacaaaccuauacaucuc

SEQ ID NO: 907241 - RNA, 19 nt, Homo sapiens
caaaggcaauucuugacaa

SEQ ID NO: 907242 - RNA, 19 nt, Homo sapiens
gaucagccaucuugacauc

SEQ ID NO: 907243 - RNA, 19 nt, Homo sapiens
uagcaucucucaaggcaaa

SEQ ID NO: 907244 - RNA, 19 nt, Homo sapiens
ccacaagaauacuaagaga

SEQ ID NO: 907245 - RNA, 19 nt, Homo sapiens
caaaucagugcaaagguua

SEQ ID NO: 907246 - RNA, 19 nt, Homo sapiens
ggacaugucauuuccacaa

SEQ ID NO: 907247 - RNA, 19 nt, Homo sapiens
gcauggcuuugaccuauga

SEQ ID NO: 907248 - RNA, 19 nt, Homo sapiens
gaagugguaauucaacauu

SEQ ID NO: 907249 - RNA, 19 nt, Homo sapiens
ugacacagcagaugaauca

SEQ ID NO: 907250 - RNA, 19 nt, Homo sapiens
agcaggagcuugagaauau

SEQ ID NO: 907251 - RNA, 19 nt, Homo sapiens
acaaaucagugcaaagguu

SEQ ID NO: 907252 - RNA, 19 nt, Homo sapiens
agaauggagucuacugaaa

SEQ ID NO: 907253 - RNA, 19 nt, Homo sapiens
aaacacaaaucagugcaaa

SEQ ID NO: 907254 - RNA, 19 nt, Homo sapiens
gcacaacaggaacguauau

SEQ ID NO: 907255 - RNA, 19 nt, Homo sapiens
agacaucuaucacgccauu

SEQ ID NO: 907256 - RNA, 19 nt, Homo sapiens
gagcaggagcuugagaaua

SEQ ID NO: 907257 - RNA, 19 nt, Homo sapiens
gagauaaagauuccagcua

SEQ ID NO: 907258 - RNA, 19 nt, Homo sapiens
gcagaugaaucaccuuucg

SEQ ID NO: 907259 - RNA, 19 nt, Homo sapiens
gacagaaucaaagcaaaua

SEQ ID NO: 907260 - RNA, 19 nt, Homo sapiens
ugucaggaauagugguuua

SEQ ID NO: 907261 - RNA, 19 nt, Homo sapiens
gugcaaagguuaugguuuu

SEQ ID NO: 907262 - RNA, 19 nt, Homo sapiens
gauaaagauuccagcuaca

SEQ ID NO: 907263 - RNA, 19 nt, Homo sapiens
ggacacauccaacgaacau

SEQ ID NO: 907264 - RNA, 19 nt, Homo sapiens
gcaaccaaccgcaugauuc

SEQ ID NO: 907265 - RNA, 19 nt, Homo sapiens
aaaggcaauucuugacaaa

SEQ ID NO: 907266 - RNA, 19 nt, Homo sapiens
cuacaaaggcaauucuuga

SEQ ID NO: 907267 - RNA, 19 nt, Homo sapiens
gcaagacccaacaaaccua

SEQ ID NO: 907268 - RNA, 19 nt, Homo sapiens
gggcugugcuaagcucuuu

SEQ ID NO: 907269 - RNA, 19 nt, Homo sapiens
caggaauagugguuuaaga

SEQ ID NO: 907270 - RNA, 19 nt, Homo sapiens
gcgacagaaucaaagcaaa

SEQ ID NO: 907271 - RNA, 19 nt, Homo sapiens
aagcaaauauacccagaau

SEQ ID NO: 907272 - RNA, 19 nt, Homo sapiens
aaaccaaccuguacauucg

SEQ ID NO: 907273 - RNA, 19 nt, Homo sapiens
uccgacagcuguuucuauu

SEQ ID NO: 907274 - RNA, 19 nt, Homo sapiens
ccacagcugccauacagaa

SEQ ID NO: 907275 - RNA, 19 nt, Homo sapiens
aauagugguuuaagaggaa

SEQ ID NO: 907276 - RNA, 19 nt, Homo sapiens
ccacugacacagcagauga

SEQ ID NO: 907277 - RNA, 19 nt, Homo sapiens
ccucauccgccauacguua

SEQ ID NO: 907278 - RNA, 19 nt, Homo sapiens
uggcauggcuuugaccuau

SEQ ID NO: 907279 - RNA, 19 nt, Homo sapiens
ggagucagcagagguguug

SEQ ID NO: 907280 - RNA, 19 nt, Homo sapiens
caugucauuuccacaagaa

SEQ ID NO: 907281 - RNA, 19 nt, Homo sapiens
ccaacaaaccuauacaucu

SEQ ID NO: 907282 - RNA, 19 nt, Homo sapiens
acagauggcuaagcaacaa

SEQ ID NO: 907283 - RNA, 19 nt, Homo sapiens
gaagguguuguugcugaua

SEQ ID NO: 907284 - RNA, 19 nt, Homo sapiens
gcaggagcuugagaauaug

SEQ ID NO: 907285 - RNA, 19 nt, Homo sapiens
ggggaacaguugaguaaaa

SEQ ID NO: 907286 - RNA, 19 nt, Homo sapiens
gcacaaacagcagcagcaa

SEQ ID NO: 907287 - RNA, 19 nt, Homo sapiens
gggcacaacaggaacguau

SEQ ID NO: 907288 - RNA, 19 nt, Homo sapiens
gcagccagccaacaugaug

SEQ ID NO: 907289 - RNA, 19 nt, Homo sapiens
cgacagaaucaaagcaaau

SEQ ID NO: 907290 - RNA, 19 nt, Homo sapiens
gcugaaacccuuuggacau

SEQ ID NO: 907291 - RNA, 19 nt, Homo sapiens
agaaagcgguagcaucucu

SEQ ID NO: 907292 - RNA, 19 nt, Homo sapiens
cucauuaucuccaaaccaa

SEQ ID NO: 907293 - RNA, 19 nt, Homo sapiens
cagcagaugaaucaccuuu

SEQ ID NO: 907294 - RNA, 19 nt, Homo sapiens
gaaacccuuuggacauguc

SEQ ID NO: 907295 - RNA, 19 nt, Homo sapiens
gaauaugcugaaacccuuu

SEQ ID NO: 907296 - RNA, 19 nt, Homo sapiens
gacagcuguuucuauugaa

SEQ ID NO: 907297 - RNA, 19 nt, Homo sapiens
uggaucagccacaaaugua

SEQ ID NO: 907298 - RNA, 19 nt, Homo sapiens
gagaggcuggcauggcuuu

SEQ ID NO: 907299 - RNA, 19 nt, Homo sapiens
gaauggagucuacugaaaa

SEQ ID NO: 907300 - RNA, 19 nt, Homo sapiens
ugucauuuccacaagaaua

SEQ ID NO: 907301 - RNA, 19 nt, Homo sapiens
ccacugaccaggaccuaau

SEQ ID NO: 907302 - RNA, 19 nt, Homo sapiens
acaaacagcagcagcaaca

SEQ ID NO: 907303 - RNA, 19 nt, Homo sapiens
guaagucugggcugugcua

SEQ ID NO: 907304 - RNA, 19 nt, Homo sapiens
acaacaggaacguauauga

SEQ ID NO: 907305 - RNA, 19 nt, Homo sapiens
aagaagcgacagaaucaaa

SEQ ID NO: 907306 - RNA, 19 nt, Homo sapiens
gcagagguguuggcuuugc

SEQ ID NO: 907307 - RNA, 19 nt, Homo sapiens
acagaaagcgguagcaucu

SEQ ID NO: 907308 - RNA, 19 nt, Homo sapiens
cagaauggagucuacugaa

SEQ ID NO: 907309 - RNA, 19 nt, Homo sapiens
ccagaauggagucuacuga

SEQ ID NO: 907310 - RNA, 19 nt, Homo sapiens
uaaagauuccagcuacaug

SEQ ID NO: 907311 - RNA, 19 nt, Homo sapiens
aaaccaagcaguccuaugc

SEQ ID NO: 907312 - RNA, 19 nt, Homo sapiens
gcuaagcucuuuuccucaa

SEQ ID NO: 907313 - RNA, 19 nt, Homo sapiens
gaccuacauuccucaguac

SEQ ID NO: 907314 - RNA, 19 nt, Homo sapiens
caacaggaacguauaugac

SEQ ID NO: 907315 - RNA, 19 nt, Homo sapiens
cauaccagguccagaguac

SEQ ID NO: 907316 - RNA, 19 nt, Homo sapiens
gacaugucauuuccacaag

SEQ ID NO: 907317 - RNA, 19 nt, Homo sapiens
cugaaacccuuuggacaug

SEQ ID NO: 907318 - RNA, 19 nt, Homo sapiens
gagcaagacccaacaaacc

SEQ ID NO: 907319 - RNA, 19 nt, Homo sapiens
uggaugagcaggagcuuga

SEQ ID NO: 907320 - RNA, 19 nt, Homo sapiens
aggcacagauggcuaagca

SEQ ID NO: 907321 - RNA, 19 nt, Homo sapiens
caccgggacugucaggaau

SEQ ID NO: 907322 - RNA, 19 nt, Homo sapiens
acuaagagacgcuaaugga

SEQ ID NO: 907323 - RNA, 19 nt, Homo sapiens
gcaacaacagcagcaacaa

SEQ ID NO: 907324 - RNA, 19 nt, Homo sapiens
ccaacagucuaaguaaguc

SEQ ID NO: 907325 - RNA, 19 nt, Homo sapiens
gaccaucccaugucaaugc

SEQ ID NO: 907326 - RNA, 19 nt, Homo sapiens
caaaagaagcgacagaauc

SEQ ID NO: 907327 - RNA, 19 nt, Homo sapiens
cuacuauccucauuaucuc

SEQ ID NO: 907328 - RNA, 19 nt, Homo sapiens
gcacagaaagcgguagcau

SEQ ID NO: 907329 - RNA, 19 nt, Homo sapiens
gcaagggaccuacauuccu

SEQ ID NO: 907330 - RNA, 19 nt, Homo sapiens
acaaaccuauacaucucaa

SEQ ID NO: 907331 - RNA, 19 nt, Homo sapiens
caagagcaagacccaacaa

SEQ ID NO: 907332 - RNA, 19 nt, Homo sapiens
uaccaacagucuaaguaag

SEQ ID NO: 907333 - RNA, 19 nt, Homo sapiens
gcauauucuuaccaacagu

SEQ ID NO: 907334 - RNA, 19 nt, Homo sapiens
agauagcaguggacacauc

SEQ ID NO: 907335 - RNA, 19 nt, Homo sapiens
ggucagcagcaacagauag

SEQ ID NO: 907336 - RNA, 19 nt, Homo sapiens
gaaagagggucauucuauu

SEQ ID NO: 907337 - RNA, 19 nt, Homo sapiens
ggaaaugacucacagaaag

SEQ ID NO: 907338 - RNA, 19 nt, Homo sapiens
gguauagucugaugagaaa

SEQ ID NO: 907339 - RNA, 19 nt, Homo sapiens
guacugaggugacugguau

SEQ ID NO: 907340 - RNA, 19 nt, Homo sapiens
cauaauaccucaaagauac

SEQ ID NO: 907341 - RNA, 19 nt, Homo sapiens
ugacugaucugcuggacua

SEQ ID NO: 907342 - RNA, 19 nt, Homo sapiens
gauguggauugccauaaua

SEQ ID NO: 907343 - RNA, 19 nt, Homo sapiens
ugaauucgcugaagcagaa

SEQ ID NO: 907344 - RNA, 19 nt, Homo sapiens
gauggaaucucucucuguu

SEQ ID NO: 907345 - RNA, 19 nt, Homo sapiens
gaagcaaucugggaagaga

SEQ ID NO: 907346 - RNA, 19 nt, Homo sapiens
cccgagaucuuuaaaguuu

SEQ ID NO: 907347 - RNA, 19 nt, Homo sapiens
uagaauacauccuacagaa

SEQ ID NO: 907348 - RNA, 19 nt, Homo sapiens
gaauacauccuacagaaau

SEQ ID NO: 907349 - RNA, 19 nt, Homo sapiens
gauguaacgugacaggauu

SEQ ID NO: 907350 - RNA, 19 nt, Homo sapiens
caccacgccuggcuaauuu

SEQ ID NO: 907351 - RNA, 19 nt, Homo sapiens
ccucaaagauacacuuguu

SEQ ID NO: 907352 - RNA, 19 nt, Homo sapiens
gaaaccaccuuuguagucu

SEQ ID NO: 907353 - RNA, 19 nt, Homo sapiens
aaaucacagucuaccauua

SEQ ID NO: 907354 - RNA, 19 nt, Homo sapiens
gaugagauucugcgcuaua

SEQ ID NO: 907355 - RNA, 19 nt, Homo sapiens
gaagauccuccaguccuua

SEQ ID NO: 907356 - RNA, 19 nt, Homo sapiens
ggaaaccaccuuuguaguc

SEQ ID NO: 907357 - RNA, 19 nt, Homo sapiens
gacaggauuuugcauuuua

SEQ ID NO: 907358 - RNA, 19 nt, Homo sapiens
gugaauacguggacuccuu

SEQ ID NO: 907359 - RNA, 19 nt, Homo sapiens
gaacauuuccacaguacug

SEQ ID NO: 907360 - RNA, 19 nt, Homo sapiens
gcacacggaggaugucuug

SEQ ID NO: 907361 - RNA, 19 nt, Homo sapiens
gauuauaccguuucugaga

SEQ ID NO: 907362 - RNA, 19 nt, Homo sapiens
ccauaauaccucaaagaua

SEQ ID NO: 907363 - RNA, 19 nt, Homo sapiens
aucagcagcucaagaguua

SEQ ID NO: 907364 - RNA, 19 nt, Homo sapiens
ccauuuaugugauuugcaa

SEQ ID NO: 907365 - RNA, 19 nt, Homo sapiens
aaagagggucauucuauuu

SEQ ID NO: 907366 - RNA, 19 nt, Homo sapiens
gggaaaugacucacagaaa

SEQ ID NO: 907367 - RNA, 19 nt, Homo sapiens
cuucggaucuguuuacugu

SEQ ID NO: 907368 - RNA, 19 nt, Homo sapiens
gcucuuugaugcccugaga

SEQ ID NO: 907369 - RNA, 19 nt, Homo sapiens
gcagcuuguugcucuuuga

SEQ ID NO: 907370 - RNA, 19 nt, Homo sapiens
ggaggagguacucgccuua

SEQ ID NO: 907371 - RNA, 19 nt, Homo sapiens
gaagcagggcacacaagaa

SEQ ID NO: 907372 - RNA, 19 nt, Homo sapiens
gggcauuuccgcucuauuc

SEQ ID NO: 907373 - RNA, 19 nt, Homo sapiens
caaaucacagucuaccauu

SEQ ID NO: 907374 - RNA, 19 nt, Homo sapiens
uguauuggaugaaugacuu

SEQ ID NO: 907375 - RNA, 19 nt, Homo sapiens
ggagguacucgccuuacaa

SEQ ID NO: 907376 - RNA, 19 nt, Homo sapiens
ugaagauccuccaguccuu

SEQ ID NO: 907377 - RNA, 19 nt, Homo sapiens
gcuguccacuagcgcagua

SEQ ID NO: 907378 - RNA, 19 nt, Homo sapiens
ugagaaagauguggauugc

SEQ ID NO: 907379 - RNA, 19 nt, Homo sapiens
gggcugcuguccccauuua

SEQ ID NO: 907380 - RNA, 19 nt, Homo sapiens
acacaucccucugaaacau

SEQ ID NO: 907381 - RNA, 19 nt, Homo sapiens
uauaagcgacugcuggauu

SEQ ID NO: 907382 - RNA, 19 nt, Homo sapiens
cccacucgcuaccugguua

SEQ ID NO: 907383 - RNA, 19 nt, Homo sapiens
ccaccacgccuggcuaauu

SEQ ID NO: 907384 - RNA, 19 nt, Homo sapiens
gauuauauacuucggaucu

SEQ ID NO: 907385 - RNA, 19 nt, Homo sapiens
cugaucugcuggacuauga

SEQ ID NO: 907386 - RNA, 19 nt, Homo sapiens
gauacacuuguuugcauuu

SEQ ID NO: 907387 - RNA, 19 nt, Homo sapiens
gaaaugacucacagaaagc

SEQ ID NO: 907388 - RNA, 19 nt, Homo sapiens
uggauuauaccguuucuga

SEQ ID NO: 907389 - RNA, 19 nt, Homo sapiens
aagauacacuuguuugcau

SEQ ID NO: 907390 - RNA, 19 nt, Homo sapiens
gccauaauaccucaaagau

SEQ ID NO: 907391 - RNA, 19 nt, Homo sapiens
agauguggauugccauaau

SEQ ID NO: 907392 - RNA, 19 nt, Homo sapiens
ucaagaguuagacccuuua

SEQ ID NO: 907393 - RNA, 19 nt, Homo sapiens
cucaagaguuagacccuuu

SEQ ID NO: 907394 - RNA, 19 nt, Homo sapiens
gcaggaaccgcagccagaa

SEQ ID NO: 907395 - RNA, 19 nt, Homo sapiens
acaucccucugaaacauuu

SEQ ID NO: 907396 - RNA, 19 nt, Homo sapiens
ccaccuuuguagucugaaa

SEQ ID NO: 907397 - RNA, 19 nt, Homo sapiens
cugaguagcugggauuaca

SEQ ID NO: 907398 - RNA, 19 nt, Homo sapiens
ucggaucuguuuacuguuc

SEQ ID NO: 907399 - RNA, 19 nt, Homo sapiens
gccuuggccuuguggacua

SEQ ID NO: 907400 - RNA, 19 nt, Homo sapiens
caagaguuagacccuuuaa

SEQ ID NO: 907401 - RNA, 19 nt, Homo sapiens
uguggacuaugacguggua

SEQ ID NO: 907402 - RNA, 19 nt, Homo sapiens
cucgcuaccugguuaauga

SEQ ID NO: 907403 - RNA, 19 nt, Homo sapiens
agauacacuuguuugcauu

SEQ ID NO: 907404 - RNA, 19 nt, Homo sapiens
acagaaagccgugaagauc

SEQ ID NO: 907405 - RNA, 19 nt, Homo sapiens
auaagcgacugcuggauuc

SEQ ID NO: 907406 - RNA, 19 nt, Homo sapiens
aaucacagucuaccauuau

SEQ ID NO: 907407 - RNA, 19 nt, Homo sapiens
ccaaaucacagucuaccau

SEQ ID NO: 907408 - RNA, 19 nt, Homo sapiens
ugaauacguggacuccuuu

SEQ ID NO: 907409 - RNA, 19 nt, Homo sapiens
gucauucuauuuggccuuu

SEQ ID NO: 907410 - RNA, 19 nt, Homo sapiens
agaauacauccuacagaaa

SEQ ID NO: 907411 - RNA, 19 nt, Homo sapiens
gauagaauacauccuacag

SEQ ID NO: 907412 - RNA, 19 nt, Homo sapiens
cugcagaucauuuacaugu

SEQ ID NO: 907413 - RNA, 19 nt, Homo sapiens
aaagauguggauugccaua

SEQ ID NO: 907414 - RNA, 19 nt, Homo sapiens
uaucagcagcucaagaguu

SEQ ID NO: 907415 - RNA, 19 nt, Homo sapiens
aagaagcaaucugggaaga

SEQ ID NO: 907416 - RNA, 19 nt, Homo sapiens
gugacaggauuuugcauuu

SEQ ID NO: 907417 - RNA, 19 nt, Homo sapiens
guuauguauuggaugaaug

SEQ ID NO: 907418 - RNA, 19 nt, Homo sapiens
gaggagcguguuucuguca

SEQ ID NO: 907419 - RNA, 19 nt, Homo sapiens
gagggcauuuccgcucuau

SEQ ID NO: 907420 - RNA, 19 nt, Homo sapiens
guauuggaugaaugacuua

SEQ ID NO: 907421 - RNA, 19 nt, Homo sapiens
gauccuccaguccuuauca

SEQ ID NO: 907422 - RNA, 19 nt, Homo sapiens
uuugcaaacugggaaauga

SEQ ID NO: 907423 - RNA, 19 nt, Homo sapiens
agguggagguggacauuug

SEQ ID NO: 907424 - RNA, 19 nt, Homo sapiens
aagagggucauucuauuug

SEQ ID NO: 907425 - RNA, 19 nt, Homo sapiens
acuaugacgugguagagau

SEQ ID NO: 907426 - RNA, 19 nt, Homo sapiens
cuacacaucccucugaaac

SEQ ID NO: 907427 - RNA, 19 nt, Homo sapiens
gcccuacacaucccucuga

SEQ ID NO: 907428 - RNA, 19 nt, Homo sapiens
guguuucugucaccgacua

SEQ ID NO: 907429 - RNA, 19 nt, Homo sapiens
ucacagucuaccauuauga

SEQ ID NO: 907430 - RNA, 19 nt, Homo sapiens
uauagucugaugagaaaga

SEQ ID NO: 907431 - RNA, 19 nt, Homo sapiens
ccacaguacugaggugacu

SEQ ID NO: 907432 - RNA, 19 nt, Homo sapiens
cagcagcucaagaguuaga

SEQ ID NO: 907433 - RNA, 19 nt, Homo sapiens
caaacugggaaaugacuca

SEQ ID NO: 907434 - RNA, 19 nt, Homo sapiens
acgcguggguuccggaaga

SEQ ID NO: 907435 - RNA, 19 nt, Homo sapiens
ugugagauguaacgugaca

SEQ ID NO: 907436 - RNA, 19 nt, Homo sapiens
gagcagaaauuauucguua

SEQ ID NO: 907437 - RNA, 19 nt, Homo sapiens
gagaauggcuuauugguaa

SEQ ID NO: 907438 - RNA, 19 nt, Homo sapiens
gaagaaaguccaagccauu

SEQ ID NO: 907439 - RNA, 19 nt, Homo sapiens
gggcaucucucucaucaga

SEQ ID NO: 907440 - RNA, 19 nt, Homo sapiens
ugacuggccugaaaucaaa

SEQ ID NO: 907441 - RNA, 19 nt, Homo sapiens
ccacuaagauuuucacuuu

SEQ ID NO: 907442 - RNA, 19 nt, Homo sapiens
acacagaaauggaacaaug

SEQ ID NO: 907443 - RNA, 19 nt, Homo sapiens
gggagagaauggcuuauug

SEQ ID NO: 907444 - RNA, 19 nt, Homo sapiens
guaugaagaccacagaaua

SEQ ID NO: 907445 - RNA, 19 nt, Homo sapiens
aagagcagauguucaauga

SEQ ID NO: 907446 - RNA, 19 nt, Homo sapiens
caagcugacuggccugaaa

SEQ ID NO: 907447 - RNA, 19 nt, Homo sapiens
caaacuacaaacucacuua

SEQ ID NO: 907448 - RNA, 19 nt, Homo sapiens
uauaaugcgccucaucuua

SEQ ID NO: 907449 - RNA, 19 nt, Homo sapiens
gaaauggaacaaugucaug

SEQ ID NO: 907450 - RNA, 19 nt, Homo sapiens
acacagauuuggcuggaaa

SEQ ID NO: 907451 - RNA, 19 nt, Homo sapiens
cuuuaagccugaccuguua

SEQ ID NO: 907452 - RNA, 19 nt, Homo sapiens
agacuuggacacauauuua

SEQ ID NO: 907453 - RNA, 19 nt, Homo sapiens
cauguugccuucaaguuug

SEQ ID NO: 907454 - RNA, 19 nt, Homo sapiens
aaaccaaacucuagcugau

SEQ ID NO: 907455 - RNA, 19 nt, Homo sapiens
uggacacucuggaugauuu

SEQ ID NO: 907456 - RNA, 19 nt, Homo sapiens
uacaucagccugccagaua

SEQ ID NO: 907457 - RNA, 19 nt, Homo sapiens
auccaaggcuggugacuuu

SEQ ID NO: 907458 - RNA, 19 nt, Homo sapiens
aaucaacucucccauuugg

SEQ ID NO: 907459 - RNA, 19 nt, Homo sapiens
gauuuucacuuuagccaua

SEQ ID NO: 907460 - RNA, 19 nt, Homo sapiens
gcagaaauuauucguuaca

SEQ ID NO: 907461 - RNA, 19 nt, Homo sapiens
gagccuagcaauagcaaga

SEQ ID NO: 907462 - RNA, 19 nt, Homo sapiens
ucaaaucaacucucccauu

SEQ ID NO: 907463 - RNA, 19 nt, Homo sapiens
ccauguugccuucaaguuu

SEQ ID NO: 907464 - RNA, 19 nt, Homo sapiens
uaacuugggcagacuucua

SEQ ID NO: 907465 - RNA, 19 nt, Homo sapiens
gccuagcaauagcaagaua

SEQ ID NO: 907466 - RNA, 19 nt, Homo sapiens
uaaugcgccucaucuuaug

SEQ ID NO: 907467 - RNA, 19 nt, Homo sapiens
caccagagccuagcaauag

SEQ ID NO: 907468 - RNA, 19 nt, Homo sapiens
acaucagccugccagauaa

SEQ ID NO: 907469 - RNA, 19 nt, Homo sapiens
gcaccaugccaaacuacaa

SEQ ID NO: 907470 - RNA, 19 nt, Homo sapiens
gcuuauugguaacucugua

SEQ ID NO: 907471 - RNA, 19 nt, Homo sapiens
agauuuggcuggaaacaca

SEQ ID NO: 907472 - RNA, 19 nt, Homo sapiens
ugccgucgcuaacuggaua

SEQ ID NO: 907473 - RNA, 19 nt, Homo sapiens
ggccugaaaucaaaucaac

SEQ ID NO: 907474 - RNA, 19 nt, Homo sapiens
gaagaccacagaauagaac

SEQ ID NO: 907475 - RNA, 19 nt, Homo sapiens
agagaauggcuuauuggua

SEQ ID NO: 907476 - RNA, 19 nt, Homo sapiens
ucaccagagccuagcaaua

SEQ ID NO: 907477 - RNA, 19 nt, Homo sapiens
ggagagaauggcuuauugg

SEQ ID NO: 907478 - RNA, 19 nt, Homo sapiens
guugauggacuuacucuuc

SEQ ID NO: 907479 - RNA, 19 nt, Homo sapiens
ucaacucucccauuuggaa

SEQ ID NO: 907480 - RNA, 19 nt, Homo sapiens
aaagcaagaugugaaagag

SEQ ID NO: 907481 - RNA, 19 nt, Homo sapiens
cacuuuagccauauucuga

SEQ ID NO: 907482 - RNA, 19 nt, Homo sapiens
ggggagagcagaaauuauu

SEQ ID NO: 907483 - RNA, 19 nt, Homo sapiens
ugaagaccacagaauagaa

SEQ ID NO: 907484 - RNA, 19 nt, Homo sapiens
cagauaagacagcuacauc

SEQ ID NO: 907485 - RNA, 19 nt, Homo sapiens
gauaagacagcuacaucag

SEQ ID NO: 907486 - RNA, 19 nt, Homo sapiens
aaugucauguugaugcuau

SEQ ID NO: 907487 - RNA, 19 nt, Homo sapiens
agccugaccuguuagacaa

SEQ ID NO: 907488 - RNA, 19 nt, Homo sapiens
gagagaauggcuuauuggu

SEQ ID NO: 907489 - RNA, 19 nt, Homo sapiens
gaaagagcagauguucaau

SEQ ID NO: 907490 - RNA, 19 nt, Homo sapiens
uaugaagaccacagaauag

SEQ ID NO: 907491 - RNA, 19 nt, Homo sapiens
gauccauguugccuucaag

SEQ ID NO: 907492 - RNA, 19 nt, Homo sapiens
gauuugcaguaccacacuu

SEQ ID NO: 907493 - RNA, 19 nt, Homo sapiens
aaagagcagauguucaaug

SEQ ID NO: 907494 - RNA, 19 nt, Homo sapiens
gaaacacagaaauggaaca

SEQ ID NO: 907495 - RNA, 19 nt, Homo sapiens
uggaaacacagaaauggaa

SEQ ID NO: 907496 - RNA, 19 nt, Homo sapiens
uugauggacuuacucuuca

SEQ ID NO: 907497 - RNA, 19 nt, Homo sapiens
caacucucccauuuggaaa

SEQ ID NO: 907498 - RNA, 19 nt, Homo sapiens
caccaugccaaacuacaaa

SEQ ID NO: 907499 - RNA, 19 nt, Homo sapiens
ucauguugaugcuauugug

SEQ ID NO: 907500 - RNA, 19 nt, Homo sapiens
guauaaugcgccucaucuu

SEQ ID NO: 907501 - RNA, 19 nt, Homo sapiens
gaugugaaagagcagaugu

SEQ ID NO: 907502 - RNA, 19 nt, Homo sapiens
aacucuagcugauccaugu

SEQ ID NO: 907503 - RNA, 19 nt, Homo sapiens
gggagagcagaaauuauuc

SEQ ID NO: 907504 - RNA, 19 nt, Homo sapiens
aaacacagaaauggaacaa

SEQ ID NO: 907505 - RNA, 19 nt, Homo sapiens
gacuucuacugggagauuu

SEQ ID NO: 907506 - RNA, 19 nt, Homo sapiens
cuuuagccauauucugauu

SEQ ID NO: 907507 - RNA, 19 nt, Homo sapiens
ccacacuuuuggucuuuaa

SEQ ID NO: 907508 - RNA, 19 nt, Homo sapiens
agauaagacagcuacauca

SEQ ID NO: 907509 - RNA, 19 nt, Homo sapiens
ccacagaauagaacaagcu

SEQ ID NO: 907510 - RNA, 19 nt, Homo sapiens
cuggugacuuuacggaaga

SEQ ID NO: 907511 - RNA, 19 nt, Homo sapiens
uugcuuauuuggacauaca

SEQ ID NO: 907512 - RNA, 19 nt, Homo sapiens
auugguaacucuguaacuu

SEQ ID NO: 907513 - RNA, 19 nt, Homo sapiens
gcuggaaacacagaaaugg

SEQ ID NO: 907514 - RNA, 19 nt, Homo sapiens
ucuuuaagccugaccuguu

SEQ ID NO: 907515 - RNA, 19 nt, Homo sapiens
augccaaacuacaaacuca

SEQ ID NO: 907516 - RNA, 19 nt, Homo sapiens
aagacuuggacacauauuu

SEQ ID NO: 907517 - RNA, 19 nt, Homo sapiens
ggacacucuggaugauuuc

SEQ ID NO: 907518 - RNA, 19 nt, Homo sapiens
ccaaagacaugcaccacua

SEQ ID NO: 907519 - RNA, 19 nt, Homo sapiens
ccaaguagcugggaccaaa

SEQ ID NO: 907520 - RNA, 19 nt, Homo sapiens
caaauucaguaguaacaga

SEQ ID NO: 907521 - RNA, 19 nt, Homo sapiens
ugucaaaccugcaaauuca

SEQ ID NO: 907522 - RNA, 19 nt, Homo sapiens
gaagugcaguggugugauc

SEQ ID NO: 907523 - RNA, 19 nt, Homo sapiens
ggagugcaauggccaaauc

SEQ ID NO: 907524 - RNA, 19 nt, Homo sapiens
cacuacaccuggcuaauuu

SEQ ID NO: 907525 - RNA, 19 nt, Homo sapiens
ucacccagccggcuaauuu

SEQ ID NO: 907526 - RNA, 19 nt, Homo sapiens
caccacgccuagcuaauuu

SEQ ID NO: 907527 - RNA, 19 nt, Homo sapiens
ggagugcaauggcgcaauc

SEQ ID NO: 907528 - RNA, 19 nt, Homo sapiens
ucaaacuucuggcuucaug

SEQ ID NO: 907529 - RNA, 19 nt, Homo sapiens
ccaaagugcugggauuaca

SEQ ID NO: 907530 - RNA, 19 nt, Homo sapiens
ccaaagugcugggauuaca

SEQ ID NO: 907531 - RNA, 19 nt, Homo sapiens
ccaaagugcugggauuaca

SEQ ID NO: 907532 - RNA, 19 nt, Homo sapiens
caauaaacaugucaaaccu

SEQ ID NO: 907533 - RNA, 19 nt, Homo sapiens
ggagugcaguggcgcaauc

SEQ ID NO: 907534 - RNA, 19 nt, Homo sapiens
ccacuacaccuggcuaauu

SEQ ID NO: 907535 - RNA, 19 nt, Homo sapiens
aauggaaucucacucuguu

SEQ ID NO: 907536 - RNA, 19 nt, Homo sapiens
ccaccacgccuagcuaauu

SEQ ID NO: 907537 - RNA, 19 nt, Homo sapiens
ggcucugccuggcuaauuu

SEQ ID NO: 907538 - RNA, 19 nt, Homo sapiens
augcaauccuuccaaauga

SEQ ID NO: 907539 - RNA, 19 nt, Homo sapiens
uaguagagauggaguuucu

SEQ ID NO: 907540 - RNA, 19 nt, Homo sapiens
caugcaauccuuccaaaug

SEQ ID NO: 907541 - RNA, 19 nt, Homo sapiens
cacccacgcucggcuaauu

SEQ ID NO: 907542 - RNA, 19 nt, Homo sapiens
ucacugaugugcccaagcu

SEQ ID NO: 907543 - RNA, 19 nt, Homo sapiens
gaacucccgaccucagaug

SEQ ID NO: 907544 - RNA, 19 nt, Homo sapiens
ggccaaaucucggcucacu

SEQ ID NO: 907545 - RNA, 19 nt, Homo sapiens
ugccucagccucccaagua

SEQ ID NO: 907546 - RNA, 19 nt, Homo sapiens
aaacaugucaaaccugcaa

SEQ ID NO: 907547 - RNA, 19 nt, Homo sapiens
ugaaauggaaucucacucu

SEQ ID NO: 907548 - RNA, 19 nt, Homo sapiens
caaaccugcaaauucagua

SEQ ID NO: 907549 - RNA, 19 nt, Homo sapiens
aagcgauucuccugucuca

SEQ ID NO: 907550 - RNA, 19 nt, Homo sapiens
uguuugaaauggaaucuca

SEQ ID NO: 907551 - RNA, 19 nt, Homo sapiens
auacaggacuggccaccau

SEQ ID NO: 907552 - RNA, 19 nt, Homo sapiens
cacccagccggcuaauuua

SEQ ID NO: 907553 - RNA, 19 nt, Homo sapiens
ccaagcagcugggauuacg

SEQ ID NO: 907554 - RNA, 19 nt, Homo sapiens
gugcaguggcgcaaucuug

SEQ ID NO: 907555 - RNA, 19 nt, Homo sapiens
cuugaucucuggaccuugu

SEQ ID NO: 907556 - RNA, 19 nt, Homo sapiens
ccugcaaauucaguaguaa

SEQ ID NO: 907557 - RNA, 19 nt, Homo sapiens
acacccagccagucacauu

SEQ ID NO: 907558 - RNA, 19 nt, Homo sapiens
cuuccaaagugcugggauu

SEQ ID NO: 907559 - RNA, 19 nt, Homo sapiens
aguaguaacagaguucuuu

SEQ ID NO: 907560 - RNA, 19 nt, Homo sapiens
gccuucaacuccugagauc

SEQ ID NO: 907561 - RNA, 19 nt, Homo sapiens
cacaggugucccacucuua

SEQ ID NO: 907562 - RNA, 19 nt, Homo sapiens
gugcaauggcgcaaucuca

SEQ ID NO: 907563 - RNA, 19 nt, Homo sapiens
ucaccauguucgccagguu

SEQ ID NO: 907564 - RNA, 19 nt, Homo sapiens
gcccaccacgccuagcuaa

SEQ ID NO: 907565 - RNA, 19 nt, Homo sapiens
caugucaaaccugcaaauu

SEQ ID NO: 907566 - RNA, 19 nt, Homo sapiens
gguuucaccauauuuguca

SEQ ID NO: 907567 - RNA, 19 nt, Homo sapiens
cuucaacuccugagaucaa

SEQ ID NO: 907568 - RNA, 19 nt, Homo sapiens
caccacaccccgcuaauuu

SEQ ID NO: 907569 - RNA, 19 nt, Homo sapiens
caacacccagccagucaca

SEQ ID NO: 907570 - RNA, 19 nt, Homo sapiens
ucucaaacuucuggcuuca

SEQ ID NO: 907571 - RNA, 19 nt, Homo sapiens
accugcaaauucaguagua

SEQ ID NO: 907572 - RNA, 19 nt, Homo sapiens
gccucagccuuccaaagug

SEQ ID NO: 907573 - RNA, 19 nt, Homo sapiens
ccucccggguucaaguuau

SEQ ID NO: 907574 - RNA, 19 nt, Homo sapiens
ccacucuuacccaggauga

SEQ ID NO: 907575 - RNA, 19 nt, Homo sapiens
guacagaaguuaccaauuu

SEQ ID NO: 907576 - RNA, 19 nt, Homo sapiens
ggaauaggaugguaauaua

SEQ ID NO: 907577 - RNA, 19 nt, Homo sapiens
ggaagaaccuuucaucuga

SEQ ID NO: 907578 - RNA, 19 nt, Homo sapiens
gcaauaggguguagcguuu

SEQ ID NO: 907579 - RNA, 19 nt, Homo sapiens
gcagaagaauagagcauuu

SEQ ID NO: 907580 - RNA, 19 nt, Homo sapiens
gaucgaagcaauugaagua

SEQ ID NO: 907581 - RNA, 19 nt, Homo sapiens
gcaaaguguuuaagcaaga

SEQ ID NO: 907582 - RNA, 19 nt, Homo sapiens
gaagacuaguuacacuuaa

SEQ ID NO: 907583 - RNA, 19 nt, Homo sapiens
uugauaaggugacuaguua

SEQ ID NO: 907584 - RNA, 19 nt, Homo sapiens
gggaggaagugucucagua

SEQ ID NO: 907585 - RNA, 19 nt, Homo sapiens
caacuaagagcaucaagaa

SEQ ID NO: 907586 - RNA, 19 nt, Homo sapiens
caagccagcugccagguuu

SEQ ID NO: 907587 - RNA, 19 nt, Homo sapiens
caagaagcacuauagauuu

SEQ ID NO: 907588 - RNA, 19 nt, Homo sapiens
ucaagaagcacuauagauu

SEQ ID NO: 907589 - RNA, 19 nt, Homo sapiens
ggaaggaccuaugcuagug

SEQ ID NO: 907590 - RNA, 19 nt, Homo sapiens
cauaaagcaugcuggugua

SEQ ID NO: 907591 - RNA, 19 nt, Homo sapiens
caaagugcaugaugaaguc

SEQ ID NO: 907592 - RNA, 19 nt, Homo sapiens
gaagaaccuuucaucugau

SEQ ID NO: 907593 - RNA, 19 nt, Homo sapiens
cgaagcaauugaaguauca

SEQ ID NO: 907594 - RNA, 19 nt, Homo sapiens
ggaggaggaugaguaugaa

SEQ ID NO: 907595 - RNA, 19 nt, Homo sapiens
ggagcaaaguguuuaagca

SEQ ID NO: 907596 - RNA, 19 nt, Homo sapiens
gcacucaugucuccguugu

SEQ ID NO: 907597 - RNA, 19 nt, Homo sapiens
ggcagaauauucaguuguu

SEQ ID NO: 907598 - RNA, 19 nt, Homo sapiens
gcagaagacuaguuacacu

SEQ ID NO: 907599 - RNA, 19 nt, Homo sapiens
gaugaaggcagaaaggauu

SEQ ID NO: 907600 - RNA, 19 nt, Homo sapiens
cugugaagaugaucaauuu

SEQ ID NO: 907601 - RNA, 19 nt, Homo sapiens
gaaguaucauggauuggau

SEQ ID NO: 907602 - RNA, 19 nt, Homo sapiens
gcagaaaggauucagauac

SEQ ID NO: 907603 - RNA, 19 nt, Homo sapiens
ucaacacgcucccugaaau

SEQ ID NO: 907604 - RNA, 19 nt, Homo sapiens
gccauaacuuucucuguga

SEQ ID NO: 907605 - RNA, 19 nt, Homo sapiens
uggauuggauuguuacuga

SEQ ID NO: 907606 - RNA, 19 nt, Homo sapiens
agauggagcuucuggguau

SEQ ID NO: 907607 - RNA, 19 nt, Homo sapiens
gagcaaaguguuuaagcaa

SEQ ID NO: 907608 - RNA, 19 nt, Homo sapiens
gagugugugugcuugauga

SEQ ID NO: 907609 - RNA, 19 nt, Homo sapiens
gguaugaugcuuauuggaa

SEQ ID NO: 907610 - RNA, 19 nt, Homo sapiens
guacuggccuugcaauggu

SEQ ID NO: 907611 - RNA, 19 nt, Homo sapiens
aaacaaagugcaugaugaa

SEQ ID NO: 907612 - RNA, 19 nt, Homo sapiens
ugaguugucaugauaagua

SEQ ID NO: 907613 - RNA, 19 nt, Homo sapiens
uaucauggauuggauuguu

SEQ ID NO: 907614 - RNA, 19 nt, Homo sapiens
gaccauggaggcagaauau

SEQ ID NO: 907615 - RNA, 19 nt, Homo sapiens
agaagacuaguuacacuua

SEQ ID NO: 907616 - RNA, 19 nt, Homo sapiens
cagaaaggauucagauacu

SEQ ID NO: 907617 - RNA, 19 nt, Homo sapiens
aagaaccuuucaucugaua

SEQ ID NO: 907618 - RNA, 19 nt, Homo sapiens
gcacuauagauuuagcuaa

SEQ ID NO: 907619 - RNA, 19 nt, Homo sapiens
uaaaggaauaggaugguaa

SEQ ID NO: 907620 - RNA, 19 nt, Homo sapiens
gagaggagcaggagugagu

SEQ ID NO: 907621 - RNA, 19 nt, Homo sapiens
caaaguguuuaagcaagaa

SEQ ID NO: 907622 - RNA, 19 nt, Homo sapiens
acucaugucuccguuguaa

SEQ ID NO: 907623 - RNA, 19 nt, Homo sapiens
ggaggcagaauauucaguu

SEQ ID NO: 907624 - RNA, 19 nt, Homo sapiens
ugagagucauauguuguua

SEQ ID NO: 907625 - RNA, 19 nt, Homo sapiens
caagauaaaggaauaggau

SEQ ID NO: 907626 - RNA, 19 nt, Homo sapiens
gaccuaugcuaguggcuau

SEQ ID NO: 907627 - RNA, 19 nt, Homo sapiens
ugagucaucagauuuguuu

SEQ ID NO: 907628 - RNA, 19 nt, Homo sapiens
caacacgcucccugaaauu

SEQ ID NO: 907629 - RNA, 19 nt, Homo sapiens
gaggaagugucucaguaca

SEQ ID NO: 907630 - RNA, 19 nt, Homo sapiens
uguaaugccucaauggaau

SEQ ID NO: 907631 - RNA, 19 nt, Homo sapiens
caauugaaguaucauggau

SEQ ID NO: 907632 - RNA, 19 nt, Homo sapiens
cuuaaugggccaagcaaua

SEQ ID NO: 907633 - RNA, 19 nt, Homo sapiens
gcaauugaaguaucaugga

SEQ ID NO: 907634 - RNA, 19 nt, Homo sapiens
acaaggagcaaaguguuua

SEQ ID NO: 907635 - RNA, 19 nt, Homo sapiens
gaucauacaaggagcaaag

SEQ ID NO: 907636 - RNA, 19 nt, Homo sapiens
ggaccauggaggcagaaua

SEQ ID NO: 907637 - RNA, 19 nt, Homo sapiens
uacagaaguuaccaauuug

SEQ ID NO: 907638 - RNA, 19 nt, Homo sapiens
gaguugucaugauaaguau

SEQ ID NO: 907639 - RNA, 19 nt, Homo sapiens
ugugugugcuugaugaauu

SEQ ID NO: 907640 - RNA, 19 nt, Homo sapiens
ucugauaaguauggugaua

SEQ ID NO: 907641 - RNA, 19 nt, Homo sapiens
ccuuucaucugauaaguau

SEQ ID NO: 907642 - RNA, 19 nt, Homo sapiens
gaggcagaauauucaguug

SEQ ID NO: 907643 - RNA, 19 nt, Homo sapiens
gaagaugaaggcagaaagg

SEQ ID NO: 907644 - RNA, 19 nt, Homo sapiens
gcagaauauucaguuguuc

SEQ ID NO: 907645 - RNA, 19 nt, Homo sapiens
ugcaauaugugacuucugu

SEQ ID NO: 907646 - RNA, 19 nt, Homo sapiens
ucagugguaccuauuauug

SEQ ID NO: 907647 - RNA, 19 nt, Homo sapiens
gcaugaaacucaggagacu

SEQ ID NO: 907648 - RNA, 19 nt, Homo sapiens
cuaagagcaucaagaagca

SEQ ID NO: 907649 - RNA, 19 nt, Homo sapiens
gcaucaagaagcacuauag

SEQ ID NO: 907650 - RNA, 19 nt, Homo sapiens
caauaugugacuucuguga

SEQ ID NO: 907651 - RNA, 19 nt, Homo sapiens
aauggugggugcaauaugu

SEQ ID NO: 907652 - RNA, 19 nt, Homo sapiens
aaagcaugcugguguauac

SEQ ID NO: 907653 - RNA, 19 nt, Homo sapiens
cagaggcggcagaagaaua

SEQ ID NO: 907654 - RNA, 19 nt, Homo sapiens
uaaagcaugcugguguaua

SEQ ID NO: 907655 - RNA, 19 nt, Homo sapiens
gcauuuugcuacuuuugua

SEQ ID NO: 907656 - RNA, 19 nt, Homo sapiens
gcaauggugggugcaauau

SEQ ID NO: 907657 - RNA, 19 nt, Homo sapiens
aauggaaugugacaagugu

SEQ ID NO: 907658 - RNA, 19 nt, Homo sapiens
ccucagugguaccuauuau

SEQ ID NO: 907659 - RNA, 19 nt, Homo sapiens
cugaguguguugaauguga

SEQ ID NO: 907660 - RNA, 19 nt, Homo sapiens
aaaacaaagugcaugauga

SEQ ID NO: 907661 - RNA, 19 nt, Homo sapiens
cacaauguauguccucagu

SEQ ID NO: 907662 - RNA, 19 nt, Homo sapiens
cgaggaagaaggcugagaa

SEQ ID NO: 907663 - RNA, 19 nt, Homo sapiens
caaggagcaaaguguuuaa

SEQ ID NO: 907664 - RNA, 19 nt, Homo sapiens
ccauaacuuucucugugaa

SEQ ID NO: 907665 - RNA, 19 nt, Homo sapiens
auaaaggaauaggauggua

SEQ ID NO: 907666 - RNA, 19 nt, Homo sapiens
ggagugagugugugugcuu

SEQ ID NO: 907667 - RNA, 19 nt, Homo sapiens
ggcagaaaggauucagaua

SEQ ID NO: 907668 - RNA, 19 nt, Homo sapiens
ugaagaggaagaagaugaa

SEQ ID NO: 907669 - RNA, 19 nt, Homo sapiens
agaggaugaugaagaggaa

SEQ ID NO: 907670 - RNA, 19 nt, Homo sapiens
aagcagaggaugaugaaga

SEQ ID NO: 907671 - RNA, 19 nt, Homo sapiens
aaacucaggagacuaagga

SEQ ID NO: 907672 - RNA, 19 nt, Homo sapiens
gaaaacaaagugcaugaug

SEQ ID NO: 907673 - RNA, 19 nt, Homo sapiens
caugucaccuugaguuguc

SEQ ID NO: 907674 - RNA, 19 nt, Homo sapiens
gaaccuuucaucugauaag

SEQ ID NO: 907675 - RNA, 19 nt, Homo sapiens
gcacauccauuucuguuua

SEQ ID NO: 907676 - RNA, 19 nt, Homo sapiens
gcaacaaggucaucacugu

SEQ ID NO: 907677 - RNA, 19 nt, Homo sapiens
caaggaaucugauaaugug

SEQ ID NO: 907678 - RNA, 19 nt, Homo sapiens
gaaacucuuccuugacuua

SEQ ID NO: 907679 - RNA, 19 nt, Homo sapiens
caauguauccucacccuua

SEQ ID NO: 907680 - RNA, 19 nt, Homo sapiens
gaagcuguguaaaugagua

SEQ ID NO: 907681 - RNA, 19 nt, Homo sapiens
gagaaacucuuccuugacu

SEQ ID NO: 907682 - RNA, 19 nt, Homo sapiens
gcuaaugauuccgcuauuu

SEQ ID NO: 907683 - RNA, 19 nt, Homo sapiens
uauaaugguuucacccuuu

SEQ ID NO: 907684 - RNA, 19 nt, Homo sapiens
caagaacuuugggauguaa

SEQ ID NO: 907685 - RNA, 19 nt, Homo sapiens
ggaaaagcaucagcuauuu

SEQ ID NO: 907686 - RNA, 19 nt, Homo sapiens
ccuaugacauuaccuguga

SEQ ID NO: 907687 - RNA, 19 nt, Homo sapiens
guacacacccaucaaauca

SEQ ID NO: 907688 - RNA, 19 nt, Homo sapiens
uggagaaacucuuccuuga

SEQ ID NO: 907689 - RNA, 19 nt, Homo sapiens
ggacacagcaggucaagag

SEQ ID NO: 907690 - RNA, 19 nt, Homo sapiens
ggucaaggagccacaauug

SEQ ID NO: 907691 - RNA, 19 nt, Homo sapiens
ucaagaacuuugggaugua

SEQ ID NO: 907692 - RNA, 19 nt, Homo sapiens
ccacaggcacuuucaagaa

SEQ ID NO: 907693 - RNA, 19 nt, Homo sapiens
gauccucaccuaugacauu

SEQ ID NO: 907694 - RNA, 19 nt, Homo sapiens
uauacaagcuccauaacuc

SEQ ID NO: 907695 - RNA, 19 nt, Homo sapiens
gacauuaccugugaggaau

SEQ ID NO: 907696 - RNA, 19 nt, Homo sapiens
gcagaacauauaaugguuu

SEQ ID NO: 907697 - RNA, 19 nt, Homo sapiens
aagcucaggacauguauua

SEQ ID NO: 907698 - RNA, 19 nt, Homo sapiens
aaacugggaaggccaagua

SEQ ID NO: 907699 - RNA, 19 nt, Homo sapiens
gcacuaggcacuccaugau

SEQ ID NO: 907700 - RNA, 19 nt, Homo sapiens
guaaaugaguauggaagau

SEQ ID NO: 907701 - RNA, 19 nt, Homo sapiens
gaaaauugaagcuguguaa

SEQ ID NO: 907702 - RNA, 19 nt, Homo sapiens
gagagauuucgguccauua

SEQ ID NO: 907703 - RNA, 19 nt, Homo sapiens
ccaaggaaucugauaaugu

SEQ ID NO: 907704 - RNA, 19 nt, Homo sapiens
cagaagcucaggacaugua

SEQ ID NO: 907705 - RNA, 19 nt, Homo sapiens
caagcuccauaacuccuuu

SEQ ID NO: 907706 - RNA, 19 nt, Homo sapiens
cagaacauauaaugguuuc

SEQ ID NO: 907707 - RNA, 19 nt, Homo sapiens
gccaaggaaucugauaaug

SEQ ID NO: 907708 - RNA, 19 nt, Homo sapiens
aauugaagcuguguaaaug

SEQ ID NO: 907709 - RNA, 19 nt, Homo sapiens
gcauuagcagaacauauaa

SEQ ID NO: 907710 - RNA, 19 nt, Homo sapiens
ucagcuauuugacuuguug

SEQ ID NO: 907711 - RNA, 19 nt, Homo sapiens
caaggucaucacuguguua

SEQ ID NO: 907712 - RNA, 19 nt, Homo sapiens
uuucuugucuaccagauaa

SEQ ID NO: 907713 - RNA, 19 nt, Homo sapiens
ucaaggagccacaauugga

SEQ ID NO: 907714 - RNA, 19 nt, Homo sapiens
ugugggaacucuucuuuag

SEQ ID NO: 907715 - RNA, 19 nt, Homo sapiens
ggaguuggagcaaggagaa

SEQ ID NO: 907716 - RNA, 19 nt, Homo sapiens
cacagcaggucaagagaga

SEQ ID NO: 907717 - RNA, 19 nt, Homo sapiens
gauuaugauuuccuguuca

SEQ ID NO: 907718 - RNA, 19 nt, Homo sapiens
agcauuagcagaacauaua

SEQ ID NO: 907719 - RNA, 19 nt, Homo sapiens
ugcgggagauagaacaaua

SEQ ID NO: 907720 - RNA, 19 nt, Homo sapiens
gggcuucggugguaaucau

SEQ ID NO: 907721 - RNA, 19 nt, Homo sapiens
ugacauuaccugugaggaa

SEQ ID NO: 907722 - RNA, 19 nt, Homo sapiens
gcgcauuccuaaacagagu

SEQ ID NO: 907723 - RNA, 19 nt, Homo sapiens
gcuauuugacuuguuguaa

SEQ ID NO: 907724 - RNA, 19 nt, Homo sapiens
ucacagaccaaacguuuua

SEQ ID NO: 907725 - RNA, 19 nt, Homo sapiens
gaaaaggaaucagcaacug

SEQ ID NO: 907726 - RNA, 19 nt, Homo sapiens
ggagaccucagccaaggaa

SEQ ID NO: 907727 - RNA, 19 nt, Homo sapiens
gcucaggacauguauuauc

SEQ ID NO: 907728 - RNA, 19 nt, Homo sapiens
gagccacaauuggaguuga

SEQ ID NO: 907729 - RNA, 19 nt, Homo sapiens
gaccaacaguaacaaucau

SEQ ID NO: 907730 - RNA, 19 nt, Homo sapiens
cgaccacaggccagcauua

SEQ ID NO: 907731 - RNA, 19 nt, Homo sapiens
gcugaaaggagagagguuu

SEQ ID NO: 907732 - RNA, 19 nt, Homo sapiens
acacacccaucaaaucaca

SEQ ID NO: 907733 - RNA, 19 nt, Homo sapiens
caucagcuauuugacuugu

SEQ ID NO: 907734 - RNA, 19 nt, Homo sapiens
agauugaccuggcugaaag

SEQ ID NO: 907735 - RNA, 19 nt, Homo sapiens
gguccauuacccagaguua

SEQ ID NO: 907736 - RNA, 19 nt, Homo sapiens
gcuguacacacccaucaaa

SEQ ID NO: 907737 - RNA, 19 nt, Homo sapiens
caugugggaacucuucuuu

SEQ ID NO: 907738 - RNA, 19 nt, Homo sapiens
gcugaggcacggagaagaa

SEQ ID NO: 907739 - RNA, 19 nt, Homo sapiens
gggaaaagcaucagcuauu

SEQ ID NO: 907740 - RNA, 19 nt, Homo sapiens
aaguaaagcuacagaucug

SEQ ID NO: 907741 - RNA, 19 nt, Homo sapiens
caugccgacucaucaguga

SEQ ID NO: 907742 - RNA, 19 nt, Homo sapiens
cagccaaggaaucugauaa

SEQ ID NO: 907743 - RNA, 19 nt, Homo sapiens
gaacaauaugccagcaaca

SEQ ID NO: 907744 - RNA, 19 nt, Homo sapiens
ccacaauuggaguugauuu

SEQ ID NO: 907745 - RNA, 19 nt, Homo sapiens
ugaccaacaguaacaauca

SEQ ID NO: 907746 - RNA, 19 nt, Homo sapiens
gaacauauaaugguuucac

SEQ ID NO: 907747 - RNA, 19 nt, Homo sapiens
ccacaggccagcauuagca

SEQ ID NO: 907748 - RNA, 19 nt, Homo sapiens
gcacggagaagaaaaggaa

SEQ ID NO: 907749 - RNA, 19 nt, Homo sapiens
ccuugauccucaccuauga

SEQ ID NO: 907750 - RNA, 19 nt, Homo sapiens
agagagauuucgguccauu

SEQ ID NO: 907751 - RNA, 19 nt, Homo sapiens
cagcaggucaagagagauu

SEQ ID NO: 907752 - RNA, 19 nt, Homo sapiens
cuaaugauuccgcuauuuc

SEQ ID NO: 907753 - RNA, 19 nt, Homo sapiens
uagcagaacauauaauggu

SEQ ID NO: 907754 - RNA, 19 nt, Homo sapiens
gauuaagacaguggagauu

SEQ ID NO: 907755 - RNA, 19 nt, Homo sapiens
uuucacagaccaaacguuu

SEQ ID NO: 907756 - RNA, 19 nt, Homo sapiens
cuuuagggcuucgguggua

SEQ ID NO: 907757 - RNA, 19 nt, Homo sapiens
agauuaugauuuccuguuc

SEQ ID NO: 907758 - RNA, 19 nt, Homo sapiens
gaaaagcaucagcuauuug

SEQ ID NO: 907759 - RNA, 19 nt, Homo sapiens
guuagugggcaacaagauu

SEQ ID NO: 907760 - RNA, 19 nt, Homo sapiens
aaaguaaagcuacagaucu

SEQ ID NO: 907761 - RNA, 19 nt, Homo sapiens
gaccaaacguuuuaguaca

SEQ ID NO: 907762 - RNA, 19 nt, Homo sapiens
gaguauggaagauuaugau

SEQ ID NO: 907763 - RNA, 19 nt, Homo sapiens
cacaggcacuuucaagaac

SEQ ID NO: 907764 - RNA, 19 nt, Homo sapiens
cugauaauguggagaaacu

SEQ ID NO: 907765 - RNA, 19 nt, Homo sapiens
cucagaagcucaggacaug

SEQ ID NO: 907766 - RNA, 19 nt, Homo sapiens
gacuuagcaugccgacuca

SEQ ID NO: 907767 - RNA, 19 nt, Homo sapiens
ggagaaacucuuccuugac

SEQ ID NO: 907768 - RNA, 19 nt, Homo sapiens
uucaagaacuuugggaugu

SEQ ID NO: 907769 - RNA, 19 nt, Homo sapiens
ggaaggccaaguacagucu

SEQ ID NO: 907770 - RNA, 19 nt, Homo sapiens
cacauccauuucuguuuau

SEQ ID NO: 907771 - RNA, 19 nt, Homo sapiens
augaaaccuuuacccauga

SEQ ID NO: 907772 - RNA, 19 nt, Homo sapiens
ccagacagaacacacuugu

SEQ ID NO: 907773 - RNA, 19 nt, Homo sapiens
cucaggacauguauuaucu

SEQ ID NO: 907774 - RNA, 19 nt, Homo sapiens
acaaggucaucacuguguu

SEQ ID NO: 907775 - RNA, 19 nt, Homo sapiens
gcagagagcuccaccauuu

SEQ ID NO: 907776 - RNA, 19 nt, Homo sapiens
ggaguacacuguugucuua

SEQ ID NO: 907777 - RNA, 19 nt, Homo sapiens
ggacuaauguauuucauga

SEQ ID NO: 907778 - RNA, 19 nt, Homo sapiens
augcagaucucuacuguaa

SEQ ID NO: 907779 - RNA, 19 nt, Homo sapiens
gcagaucucuacuguaaaa

SEQ ID NO: 907780 - RNA, 19 nt, Homo sapiens
caagaaacacgauaccauu

SEQ ID NO: 907781 - RNA, 19 nt, Homo sapiens
gaaacacgauaccauucug

SEQ ID NO: 907782 - RNA, 19 nt, Homo sapiens
ugaaaguucuggcuuguag

SEQ ID NO: 907783 - RNA, 19 nt, Homo sapiens
gcaaagguaugggauagag

SEQ ID NO: 907784 - RNA, 19 nt, Homo sapiens
uaaaguugcucagguguuc

SEQ ID NO: 907785 - RNA, 19 nt, Homo sapiens
cagcggcucuucaucauca

SEQ ID NO: 907786 - RNA, 19 nt, Homo sapiens
ggcgcuggcugucuacuuu

SEQ ID NO: 907787 - RNA, 19 nt, Homo sapiens
ggguggaggugguguucua

SEQ ID NO: 907788 - RNA, 19 nt, Homo sapiens
ggaaacagcggcucuucau

SEQ ID NO: 907789 - RNA, 19 nt, Homo sapiens
ggacuucaccauccacgaa

SEQ ID NO: 907790 - RNA, 19 nt, Homo sapiens
uggguggacuguaugauuu

SEQ ID NO: 907791 - RNA, 19 nt, Homo sapiens
ccugguaucuccugucuuc

SEQ ID NO: 907792 - RNA, 19 nt, Homo sapiens
ccucaaacaucaccuuuac

SEQ ID NO: 907793 - RNA, 19 nt, Homo sapiens
aaacagcggcucuucauca

SEQ ID NO: 907794 - RNA, 19 nt, Homo sapiens
gaaacaagaaacacgauac

SEQ ID NO: 907795 - RNA, 19 nt, Homo sapiens
aggaugaccugcuccagaa

SEQ ID NO: 907796 - RNA, 19 nt, Homo sapiens
gaccaagaagcacacagua

SEQ ID NO: 907797 - RNA, 19 nt, Homo sapiens
gaaccucgcguugcuagug

SEQ ID NO: 907798 - RNA, 19 nt, Homo sapiens
ccaagaagcacacaguaag

SEQ ID NO: 907799 - RNA, 19 nt, Homo sapiens
gcgugggucugacaagaug

SEQ ID NO: 907800 - RNA, 19 nt, Homo sapiens
gaucuacugugcacaucca

SEQ ID NO: 907801 - RNA, 19 nt, Homo sapiens
ucucggcgcuggcugucua

SEQ ID NO: 907802 - RNA, 19 nt, Homo sapiens
caacuucaucuccuucuuc

SEQ ID NO: 907803 - RNA, 19 nt, Homo sapiens
aaaaugggcucccugguau

SEQ ID NO: 907804 - RNA, 19 nt, Homo sapiens
ccacugcccagaaacaaga

SEQ ID NO: 907805 - RNA, 19 nt, Homo sapiens
caacuucggccucaauguc

SEQ ID NO: 907806 - RNA, 19 nt, Homo sapiens
uaaaaugggcucccuggua

SEQ ID NO: 907807 - RNA, 19 nt, Homo sapiens
cuacugcuccaaacccuaa

SEQ ID NO: 907808 - RNA, 19 nt, Homo sapiens
uaaccaacauggcguucca

SEQ ID NO: 907809 - RNA, 19 nt, Homo sapiens
caucugagccucggugugu

SEQ ID NO: 907810 - RNA, 19 nt, Homo sapiens
ggaguguacaccaucuuug

SEQ ID NO: 907811 - RNA, 19 nt, Homo sapiens
caagaagcacacaguaagu

SEQ ID NO: 907812 - RNA, 19 nt, Homo sapiens
gcuccaaacccuaaauuuu

SEQ ID NO: 907813 - RNA, 19 nt, Homo sapiens
agaaacaagaaacacgaua

SEQ ID NO: 907814 - RNA, 19 nt, Homo sapiens
ggucugcuguccacuuguc

SEQ ID NO: 907815 - RNA, 19 nt, Homo sapiens
gcaccagcacagcauguau

SEQ ID NO: 907816 - RNA, 19 nt, Homo sapiens
gaaacagcggcucuucauc

SEQ ID NO: 907817 - RNA, 19 nt, Homo sapiens
caugaccaccauccaguuu

SEQ ID NO: 907818 - RNA, 19 nt, Homo sapiens
acacuguugucuuaaccaa

SEQ ID NO: 907819 - RNA, 19 nt, Homo sapiens
gacaacggccacacacugu

SEQ ID NO: 907820 - RNA, 19 nt, Homo sapiens
ugcauucucuggcgguuga

SEQ ID NO: 907821 - RNA, 19 nt, Homo sapiens
gugguguucuauaccuaaa

SEQ ID NO: 907822 - RNA, 19 nt, Homo sapiens
ggggauggguggacuguau

SEQ ID NO: 907823 - RNA, 19 nt, Homo sapiens
gaaaguucuggcuuguaga

SEQ ID NO: 907824 - RNA, 19 nt, Homo sapiens
uucuauaccuaaaggauga

SEQ ID NO: 907825 - RNA, 19 nt, Homo sapiens
gguguucuauaccuaaagg

SEQ ID NO: 907826 - RNA, 19 nt, Homo sapiens
ggugguguucuauaccuaa

SEQ ID NO: 907827 - RNA, 19 nt, Homo sapiens
ggucccugcucuuccacuu

SEQ ID NO: 907828 - RNA, 19 nt, Homo sapiens
ggauggguggacuguauga

SEQ ID NO: 907829 - RNA, 19 nt, Homo sapiens
ugacaaccacagccauuuc

SEQ ID NO: 907830 - RNA, 19 nt, Homo sapiens
gauguaccaggucccacua

SEQ ID NO: 907831 - RNA, 19 nt, Homo sapiens
ggagaaccucgcguugcua

SEQ ID NO: 907832 - RNA, 19 nt, Homo sapiens
caccagcacagcauguauu

SEQ ID NO: 907833 - RNA, 19 nt, Homo sapiens
ugaccaccauccaguuucu

SEQ ID NO: 907834 - RNA, 19 nt, Homo sapiens
ggugggacuucgggaacaa

SEQ ID NO: 907835 - RNA, 19 nt, Homo sapiens
aguacacgguggccacuga

SEQ ID NO: 907836 - RNA, 19 nt, Homo sapiens
ccgcgugggucugacaaga

SEQ ID NO: 907837 - RNA, 19 nt, Homo sapiens
guggaggugguguucuaua

SEQ ID NO: 907838 - RNA, 19 nt, Homo sapiens
ggugugugcccuaggguau

SEQ ID NO: 907839 - RNA, 19 nt, Homo sapiens
acaagaaacacgauaccau

SEQ ID NO: 907840 - RNA, 19 nt, Homo sapiens
ucaacuucaucuccuucuu

SEQ ID NO: 907841 - RNA, 19 nt, Homo sapiens
gcucugccgccucaacuuc

SEQ ID NO: 907842 - RNA, 19 nt, Homo sapiens
uggaggugguguucuauac

SEQ ID NO: 907843 - RNA, 19 nt, Homo sapiens
uuucuggccuuuacacagu

SEQ ID NO: 907844 - RNA, 19 nt, Homo sapiens
guaagaaggaaggguguag

SEQ ID NO: 907845 - RNA, 19 nt, Homo sapiens
gguaagaaggaagggugua

SEQ ID NO: 907846 - RNA, 19 nt, Homo sapiens
ucuuugccauccuggagua

SEQ ID NO: 907847 - RNA, 19 nt, Homo sapiens
gaucucuacuguaaaaugg

SEQ ID NO: 907848 - RNA, 19 nt, Homo sapiens
uugcaaagguaugggauag

SEQ ID NO: 907849 - RNA, 19 nt, Homo sapiens
ucuggugggccaucacuuu

SEQ ID NO: 907850 - RNA, 19 nt, Homo sapiens
caaccacagccauuucucu

SEQ ID NO: 907851 - RNA, 19 nt, Homo sapiens
guacacuguugucuuaacc

SEQ ID NO: 907852 - RNA, 19 nt, Homo sapiens
gccucaaugucguggagaa

SEQ ID NO: 907853 - RNA, 19 nt, Homo sapiens
ucuccugucuucccuacug

SEQ ID NO: 907854 - RNA, 19 nt, Homo sapiens
gaugcagaucucuacugua

SEQ ID NO: 907855 - RNA, 19 nt, Homo sapiens
uugcucagguguucuaguc

SEQ ID NO: 907856 - RNA, 19 nt, Homo sapiens
ucucuuggccuuacugaag

SEQ ID NO: 907857 - RNA, 19 nt, Homo sapiens
cacaguaagucaggaggau

SEQ ID NO: 907858 - RNA, 19 nt, Homo sapiens
ggaugaccugcuccagaaa

SEQ ID NO: 907859 - RNA, 19 nt, Homo sapiens
acuguaugauuuccaagga

SEQ ID NO: 907860 - RNA, 19 nt, Homo sapiens
uguauuucaugaucuacug

SEQ ID NO: 907861 - RNA, 19 nt, Homo sapiens
cagagagcuccaccauuug

SEQ ID NO: 907862 - RNA, 19 nt, Homo sapiens
aagaaacacgauaccauuc

SEQ ID NO: 907863 - RNA, 19 nt, Homo sapiens
ucaucaacuucaucuccuu

SEQ ID NO: 907864 - RNA, 19 nt, Homo sapiens
ucccugcucuuccacuuca

SEQ ID NO: 907865 - RNA, 19 nt, Homo sapiens
accaagaagcacacaguaa

SEQ ID NO: 907866 - RNA, 19 nt, Homo sapiens
ucugaaaguucuggcuugu

SEQ ID NO: 907867 - RNA, 19 nt, Homo sapiens
ggucauucauaggacuaau

SEQ ID NO: 907868 - RNA, 19 nt, Homo sapiens
ucaaacaucaccuuuaccu

SEQ ID NO: 907869 - RNA, 19 nt, Homo sapiens
gaacccuucaguccugcuu

SEQ ID NO: 907870 - RNA, 19 nt, Homo sapiens
gcuggaguguacaccaucu

SEQ ID NO: 907871 - RNA, 19 nt, Homo sapiens
ggucugacaagauguacca

SEQ ID NO: 907872 - RNA, 19 nt, Homo sapiens
ugaccaagaagcacacagu

SEQ ID NO: 907873 - RNA, 19 nt, Homo sapiens
uggagaaccucgcguugcu

SEQ ID NO: 907874 - RNA, 19 nt, Homo sapiens
ggaggaagccgaucugaua

SEQ ID NO: 907875 - RNA, 19 nt, Homo sapiens
caacugaaaucucaauguu

SEQ ID NO: 907876 - RNA, 19 nt, Homo sapiens
guacuaguguuguaacuuu

SEQ ID NO: 907877 - RNA, 19 nt, Homo sapiens
gaaguacucuugaugaaag

SEQ ID NO: 907878 - RNA, 19 nt, Homo sapiens
uaaauucccuguuaaguuc

SEQ ID NO: 907879 - RNA, 19 nt, Homo sapiens
caaacaagcuagcuauuag

SEQ ID NO: 907880 - RNA, 19 nt, Homo sapiens
gaugauggguauucuacua

SEQ ID NO: 907881 - RNA, 19 nt, Homo sapiens
ugagaaagcucuugaagca

SEQ ID NO: 907882 - RNA, 19 nt, Homo sapiens
uaagagaucugcaccuuca

SEQ ID NO: 907883 - RNA, 19 nt, Homo sapiens
uggcaaauauggacgaaua

SEQ ID NO: 907884 - RNA, 19 nt, Homo sapiens
gaaagucauuagauggaaa

SEQ ID NO: 907885 - RNA, 19 nt, Homo sapiens
ccagagacaugaauggaaa

SEQ ID NO: 907886 - RNA, 19 nt, Homo sapiens
gaauauagcgauagagaug

SEQ ID NO: 907887 - RNA, 19 nt, Homo sapiens
caggaaagcucuucauugg

SEQ ID NO: 907888 - RNA, 19 nt, Homo sapiens
uaucauaacuacccaagga

SEQ ID NO: 907889 - RNA, 19 nt, Homo sapiens
guagagauguuuauuuguc

SEQ ID NO: 907890 - RNA, 19 nt, Homo sapiens
gaaagcucuugaagcagua

SEQ ID NO: 907891 - RNA, 19 nt, Homo sapiens
cuacagagauucauaugag

SEQ ID NO: 907892 - RNA, 19 nt, Homo sapiens
ggaaagucauuagauggaa

SEQ ID NO: 907893 - RNA, 19 nt, Homo sapiens
gagaauauagcgauagaga

SEQ ID NO: 907894 - RNA, 19 nt, Homo sapiens
ucaagagaauauagcgaua

SEQ ID NO: 907895 - RNA, 19 nt, Homo sapiens
aaagacagcuauucaagca

SEQ ID NO: 907896 - RNA, 19 nt, Homo sapiens
ggagguuccuacagagauu

SEQ ID NO: 907897 - RNA, 19 nt, Homo sapiens
acaaacaagcuagcuauua

SEQ ID NO: 907898 - RNA, 19 nt, Homo sapiens
guuaagacuuguacuagug

SEQ ID NO: 907899 - RNA, 19 nt, Homo sapiens
gagauucauaugagaguua

SEQ ID NO: 907900 - RNA, 19 nt, Homo sapiens
gauuauacuuaccgugauu

SEQ ID NO: 907901 - RNA, 19 nt, Homo sapiens
agacaugaauggaaaguca

SEQ ID NO: 907902 - RNA, 19 nt, Homo sapiens
uaugguaacucacguagug

SEQ ID NO: 907903 - RNA, 19 nt, Homo sapiens
ucguagagauguuuauuug

SEQ ID NO: 907904 - RNA, 19 nt, Homo sapiens
cagggugucuuccaacuga

SEQ ID NO: 907905 - RNA, 19 nt, Homo sapiens
gcaggcaauucuagucuuc

SEQ ID NO: 907906 - RNA, 19 nt, Homo sapiens
gaagcagucgcuaugauga

SEQ ID NO: 907907 - RNA, 19 nt, Homo sapiens
aagcagagauuacccaagu

SEQ ID NO: 907908 - RNA, 19 nt, Homo sapiens
gaacaagccaccaaaccau

SEQ ID NO: 907909 - RNA, 19 nt, Homo sapiens
caaaacaucuagccaucua

SEQ ID NO: 907910 - RNA, 19 nt, Homo sapiens
ggaaacaaaugagaaagcu

SEQ ID NO: 907911 - RNA, 19 nt, Homo sapiens
caaaugagaaagcucuuga

SEQ ID NO: 907912 - RNA, 19 nt, Homo sapiens
gaaccgcugcccucucgua

SEQ ID NO: 907913 - RNA, 19 nt, Homo sapiens
ggaaguacucuugaugaaa

SEQ ID NO: 907914 - RNA, 19 nt, Homo sapiens
cgauagagauggauauggu

SEQ ID NO: 907915 - RNA, 19 nt, Homo sapiens
ugacggauaugguggaagu

SEQ ID NO: 907916 - RNA, 19 nt, Homo sapiens
ggaagcagucgcuaugaug

SEQ ID NO: 907917 - RNA, 19 nt, Homo sapiens
uacccaaguucucgugaua

SEQ ID NO: 907918 - RNA, 19 nt, Homo sapiens
uggaagagauaguuaugga

SEQ ID NO: 907919 - RNA, 19 nt, Homo sapiens
ugaaagaccgugaaaccaa

SEQ ID NO: 907920 - RNA, 19 nt, Homo sapiens
guaaggaaagugcuauuca

SEQ ID NO: 907921 - RNA, 19 nt, Homo sapiens
uuauuugacuucugcauug

SEQ ID NO: 907922 - RNA, 19 nt, Homo sapiens
caaaugaggcaggcaauuc

SEQ ID NO: 907923 - RNA, 19 nt, Homo sapiens
cagcucacgugacggauau

SEQ ID NO: 907924 - RNA, 19 nt, Homo sapiens
ccaggaaagcucuucauug

SEQ ID NO: 907925 - RNA, 19 nt, Homo sapiens
gcaaaugaggcaggcaauu

SEQ ID NO: 907926 - RNA, 19 nt, Homo sapiens
gcagaagcagauacuagaa

SEQ ID NO: 907927 - RNA, 19 nt, Homo sapiens
gcagagauuacccaaguuc

SEQ ID NO: 907928 - RNA, 19 nt, Homo sapiens
ccuaagagaucugcaccuu

SEQ ID NO: 907929 - RNA, 19 nt, Homo sapiens
ggaacaagccaccaaacca

SEQ ID NO: 907930 - RNA, 19 nt, Homo sapiens
uggaaguacucuugaugaa

SEQ ID NO: 907931 - RNA, 19 nt, Homo sapiens
ggaagccgaucugauagag

SEQ ID NO: 907932 - RNA, 19 nt, Homo sapiens
gcagucgcuaugaugauua

SEQ ID NO: 907933 - RNA, 19 nt, Homo sapiens
gacuauccaucaagagaau

SEQ ID NO: 907934 - RNA, 19 nt, Homo sapiens
aguggaaacuauucuauca

SEQ ID NO: 907935 - RNA, 19 nt, Homo sapiens
gcagcucacgugacggaua

SEQ ID NO: 907936 - RNA, 19 nt, Homo sapiens
aagagaauauagcgauaga

SEQ ID NO: 907937 - RNA, 19 nt, Homo sapiens
gcaccaccaccacgagauu

SEQ ID NO: 907938 - RNA, 19 nt, Homo sapiens
gcuauucaagcagagauua

SEQ ID NO: 907939 - RNA, 19 nt, Homo sapiens
ucaauguucucaguacgaa

SEQ ID NO: 907940 - RNA, 19 nt, Homo sapiens
aaacaucuagccaucuaaa

SEQ ID NO: 907941 - RNA, 19 nt, Homo sapiens
caagagaugauggguauuc

SEQ ID NO: 907942 - RNA, 19 nt, Homo sapiens
gcuccuguaucacguggaa

SEQ ID NO: 907943 - RNA, 19 nt, Homo sapiens
guaaaaguauccccuaaag

SEQ ID NO: 907944 - RNA, 19 nt, Homo sapiens
ucaagcagccgaagugauc

SEQ ID NO: 907945 - RNA, 19 nt, Homo sapiens
guggaagucgagacaguua

SEQ ID NO: 907946 - RNA, 19 nt, Homo sapiens
caaguucucgugauacuag

SEQ ID NO: 907947 - RNA, 19 nt, Homo sapiens
ugauggguauucuacuaaa

SEQ ID NO: 907948 - RNA, 19 nt, Homo sapiens
cagaagcagauacuagaaa

SEQ ID NO: 907949 - RNA, 19 nt, Homo sapiens
ggcagaagcagauacuaga

SEQ ID NO: 907950 - RNA, 19 nt, Homo sapiens
caaauauggacgaauagug

SEQ ID NO: 907951 - RNA, 19 nt, Homo sapiens
gccacuuccuaucugauuu

SEQ ID NO: 907952 - RNA, 19 nt, Homo sapiens
gacuuguacuaguguugua

SEQ ID NO: 907953 - RNA, 19 nt, Homo sapiens
caaaaucccaguucaaaga

SEQ ID NO: 907954 - RNA, 19 nt, Homo sapiens
cgagacaguuacucaagca

SEQ ID NO: 907955 - RNA, 19 nt, Homo sapiens
ggaugcagccagagacaug

SEQ ID NO: 907956 - RNA, 19 nt, Homo sapiens
gaaaccaacaaaucaagag

SEQ ID NO: 907957 - RNA, 19 nt, Homo sapiens
gagaugauggguauucuac

SEQ ID NO: 907958 - RNA, 19 nt, Homo sapiens
acugaaaucucaauguucu

SEQ ID NO: 907959 - RNA, 19 nt, Homo sapiens
cauucuaccuauacaaaca

SEQ ID NO: 907960 - RNA, 19 nt, Homo sapiens
ccaguucacgugaugacua

SEQ ID NO: 907961 - RNA, 19 nt, Homo sapiens
caccacgagauuauacuua

SEQ ID NO: 907962 - RNA, 19 nt, Homo sapiens
ggaccaccaccaagaagug

SEQ ID NO: 907963 - RNA, 19 nt, Homo sapiens
uaaaggccacuuccuaucu

SEQ ID NO: 907964 - RNA, 19 nt, Homo sapiens
gaugaaagaccgugaaacc

SEQ ID NO: 907965 - RNA, 19 nt, Homo sapiens
aaguggagguuccuacaga

SEQ ID NO: 907966 - RNA, 19 nt, Homo sapiens
uaaggaaagugcuauucac

SEQ ID NO: 907967 - RNA, 19 nt, Homo sapiens
ccuaaaggccacuuccuau

SEQ ID NO: 907968 - RNA, 19 nt, Homo sapiens
gguggaagcagucgcuaug

SEQ ID NO: 907969 - RNA, 19 nt, Homo sapiens
caguucacgugaugacuau

SEQ ID NO: 907970 - RNA, 19 nt, Homo sapiens
guggaaguacucuugauga

SEQ ID NO: 907971 - RNA, 19 nt, Homo sapiens
gauggguauucuacuaaag

SEQ ID NO: 907972 - RNA, 19 nt, Homo sapiens
aagcagaucgcccaggaaa

SEQ ID NO: 907973 - RNA, 19 nt, Homo sapiens
ggaccaaaaucccaguuca

SEQ ID NO: 907974 - RNA, 19 nt, Homo sapiens
gagaagugcgcccuguuua

SEQ ID NO: 907975 - RNA, 19 nt, Homo sapiens
ggagaagugcgcccuguuu

SEQ ID NO: 907976 - RNA, 19 nt, Homo sapiens
caagaaauccaaagagcaa

SEQ ID NO: 907977 - RNA, 19 nt, Homo sapiens
gcaaacagugcacggagaa

SEQ ID NO: 907978 - RNA, 19 nt, Homo sapiens
ugcgaaagcucuccaagau

SEQ ID NO: 907979 - RNA, 19 nt, Homo sapiens
agacgaagaagaagaagaa

SEQ ID NO: 907980 - RNA, 19 nt, Homo sapiens
gcagcaagaaauccaaaga

SEQ ID NO: 907981 - RNA, 19 nt, Homo sapiens
cgaagaagaagaagaagag

SEQ ID NO: 907982 - RNA, 19 nt, Homo sapiens
caagaacuacauccucaug

SEQ ID NO: 907983 - RNA, 19 nt, Homo sapiens
gaagugcgcccuguuuaac

SEQ ID NO: 907984 - RNA, 19 nt, Homo sapiens
agaagugcgcccuguuuaa

SEQ ID NO: 907985 - RNA, 19 nt, Homo sapiens
gcgcugcggcuuaacauca

SEQ ID NO: 907986 - RNA, 19 nt, Homo sapiens
caaaaggcgcugcggcuua

SEQ ID NO: 907987 - RNA, 19 nt, Homo sapiens
agaacuacauccucaugca

SEQ ID NO: 907988 - RNA, 19 nt, Homo sapiens
gugcgaaagcucuccaaga

SEQ ID NO: 907989 - RNA, 19 nt, Homo sapiens
aaaaggcgcugcggcuuaa

SEQ ID NO: 907990 - RNA, 19 nt, Homo sapiens
ggcuggagacgaagaagaa

SEQ ID NO: 907991 - RNA, 19 nt, Homo sapiens
cagcagcagcagcaagaaa

SEQ ID NO: 907992 - RNA, 19 nt, Homo sapiens
gagacgaagaagaagaaga

SEQ ID NO: 907993 - RNA, 19 nt, Homo sapiens
gcgaaagcucuccaagauc

SEQ ID NO: 907994 - RNA, 19 nt, Homo sapiens
uggagacgaagaagaagaa

SEQ ID NO: 907995 - RNA, 19 nt, Homo sapiens
gcagcagcagcaagaaauc

SEQ ID NO: 907996 - RNA, 19 nt, Homo sapiens
cagcagcaagaaauccaaa

SEQ ID NO: 907997 - RNA, 19 nt, Homo sapiens
accaucggcuggagacgaa

SEQ ID NO: 907998 - RNA, 19 nt, Homo sapiens
ggagaaacuucaaggaaua

SEQ ID NO: 907999 - RNA, 19 nt, Homo sapiens
caaauuggcuuguucuaaa

SEQ ID NO: 908000 - RNA, 19 nt, Homo sapiens
gaugaaagguggaaacaaa

SEQ ID NO: 908001 - RNA, 19 nt, Homo sapiens
gaaagcaaaucugaaagua

SEQ ID NO: 908002 - RNA, 19 nt, Homo sapiens
ggagaucagucguuucuuu

SEQ ID NO: 908003 - RNA, 19 nt, Homo sapiens
gaaaguagcaacaauagaa

SEQ ID NO: 908004 - RNA, 19 nt, Homo sapiens
gcaauaagauggaccuuuc

SEQ ID NO: 908005 - RNA, 19 nt, Homo sapiens
ggaguuggcuucagaaugu

SEQ ID NO: 908006 - RNA, 19 nt, Homo sapiens
gcacaaagccagucucuga

SEQ ID NO: 908007 - RNA, 19 nt, Homo sapiens
aaacagaacugacuuagau

SEQ ID NO: 908008 - RNA, 19 nt, Homo sapiens
ggaagagucuccauuuguu

SEQ ID NO: 908009 - RNA, 19 nt, Homo sapiens
gcaacaaucucgucaacuu

SEQ ID NO: 908010 - RNA, 19 nt, Homo sapiens
ucaagugccuccuccauua

SEQ ID NO: 908011 - RNA, 19 nt, Homo sapiens
gaauuucgcucugcaguuu

SEQ ID NO: 908012 - RNA, 19 nt, Homo sapiens
gaacacaucuuuggaucaa

SEQ ID NO: 908013 - RNA, 19 nt, Homo sapiens
gaaagguuauccaaacauu

SEQ ID NO: 908014 - RNA, 19 nt, Homo sapiens
gaaaugacuggaccaaaua

SEQ ID NO: 908015 - RNA, 19 nt, Homo sapiens
gcacugauacuacauauug

SEQ ID NO: 908016 - RNA, 19 nt, Homo sapiens
gaagaagcguggauaaauc

SEQ ID NO: 908017 - RNA, 19 nt, Homo sapiens
gaagaggacacaaauauau

SEQ ID NO: 908018 - RNA, 19 nt, Homo sapiens
ggagaaggcugcauggaau

SEQ ID NO: 908019 - RNA, 19 nt, Homo sapiens
gaauggagauagauaaaca

SEQ ID NO: 908020 - RNA, 19 nt, Homo sapiens
ggaacaaacugccuagcaa

SEQ ID NO: 908021 - RNA, 19 nt, Homo sapiens
gaaccucccucacggaaau

SEQ ID NO: 908022 - RNA, 19 nt, Homo sapiens
ggaagaggacacaaauaua

SEQ ID NO: 908023 - RNA, 19 nt, Homo sapiens
ggaagaggauguggagauu

SEQ ID NO: 908024 - RNA, 19 nt, Homo sapiens
acaaauggauggaaaucua

SEQ ID NO: 908025 - RNA, 19 nt, Homo sapiens
aaagauggccuucggaaua

SEQ ID NO: 908026 - RNA, 19 nt, Homo sapiens
gaacaagcaacaagacauu

SEQ ID NO: 908027 - RNA, 19 nt, Homo sapiens
gagcaugguucucaggaaa

SEQ ID NO: 908028 - RNA, 19 nt, Homo sapiens
gauguugccuaccuuauug

SEQ ID NO: 908029 - RNA, 19 nt, Homo sapiens
agaaugagcucgcuugugu

SEQ ID NO: 908030 - RNA, 19 nt, Homo sapiens
ugaaaugacuggaccaaau

SEQ ID NO: 908031 - RNA, 19 nt, Homo sapiens
uaagaaugcuguuguaagu

SEQ ID NO: 908032 - RNA, 19 nt, Homo sapiens
gaaaagguaucuacucuau

SEQ ID NO: 908033 - RNA, 19 nt, Homo sapiens
gcuaaaccguagagaauga

SEQ ID NO: 908034 - RNA, 19 nt, Homo sapiens
ggaggaauguuacaagaca

SEQ ID NO: 908035 - RNA, 19 nt, Homo sapiens
ccaaauagcgccauacaug

SEQ ID NO: 908036 - RNA, 19 nt, Homo sapiens
gggagaaacuucaaggaau

SEQ ID NO: 908037 - RNA, 19 nt, Homo sapiens
aaagggccaucaccaauaa

SEQ ID NO: 908038 - RNA, 19 nt, Homo sapiens
ccacaagcauuaagcaaau

SEQ ID NO: 908039 - RNA, 19 nt, Homo sapiens
uaauuacucuggagacaaa

SEQ ID NO: 908040 - RNA, 19 nt, Homo sapiens
gagauuggaauguggaaua

SEQ ID NO: 908041 - RNA, 19 nt, Homo sapiens
ggaaacaacauaaauccaa

SEQ ID NO: 908042 - RNA, 19 nt, Homo sapiens
gagagaaacaucacuauca

SEQ ID NO: 908043 - RNA, 19 nt, Homo sapiens
aaacaacgguggccugaau

SEQ ID NO: 908044 - RNA, 19 nt, Homo sapiens
ugauaaggauggcauugua

SEQ ID NO: 908045 - RNA, 19 nt, Homo sapiens
ccaaauaauucaucaggau

SEQ ID NO: 908046 - RNA, 19 nt, Homo sapiens
ccacaucucagacaaauga

SEQ ID NO: 908047 - RNA, 19 nt, Homo sapiens
ggaaaucuacugaggaaga

SEQ ID NO: 908048 - RNA, 19 nt, Homo sapiens
gaccaaauaacacuacuaa

SEQ ID NO: 908049 - RNA, 19 nt, Homo sapiens
uaaaccagcuuucucagau

SEQ ID NO: 908050 - RNA, 19 nt, Homo sapiens
gaagaugauucugcugcua

SEQ ID NO: 908051 - RNA, 19 nt, Homo sapiens
gaauagcacuggacuuggu

SEQ ID NO: 908052 - RNA, 19 nt, Homo sapiens
gccuaaauauuggugauua

SEQ ID NO: 908053 - RNA, 19 nt, Homo sapiens
ggagauagauaaacauagc

SEQ ID NO: 908054 - RNA, 19 nt, Homo sapiens
gauaugccauugccuggaa

SEQ ID NO: 908055 - RNA, 19 nt, Homo sapiens
ccaaagcauuguaaacaga

SEQ ID NO: 908056 - RNA, 19 nt, Homo sapiens
ggagagcgaugguaguaca

SEQ ID NO: 908057 - RNA, 19 nt, Homo sapiens
auaaugagcugccuaguag

SEQ ID NO: 908058 - RNA, 19 nt, Homo sapiens
ucaggaaacuugugaaucu

SEQ ID NO: 908059 - RNA, 19 nt, Homo sapiens
guacacagaagguuucauu

SEQ ID NO: 908060 - RNA, 19 nt, Homo sapiens
ggaccugugucuucuacaa

SEQ ID NO: 908061 - RNA, 19 nt, Homo sapiens
ugaauaggcuuuccauuuu

SEQ ID NO: 908062 - RNA, 19 nt, Homo sapiens
gaaaguguugcaccaguuu

SEQ ID NO: 908063 - RNA, 19 nt, Homo sapiens
ggccucagauuuccaaaga

SEQ ID NO: 908064 - RNA, 19 nt, Homo sapiens
caagugccaucucaaacaa

SEQ ID NO: 908065 - RNA, 19 nt, Homo sapiens
gaauggcacuucccuuucu

SEQ ID NO: 908066 - RNA, 19 nt, Homo sapiens
ccaguuacagcgauuguua

SEQ ID NO: 908067 - RNA, 19 nt, Homo sapiens
cagcacacauuacuccaaa

SEQ ID NO: 908068 - RNA, 19 nt, Homo sapiens
ggaaauggcgcaaauucug

SEQ ID NO: 908069 - RNA, 19 nt, Homo sapiens
gaaguaagugguacacaga

SEQ ID NO: 908070 - RNA, 19 nt, Homo sapiens
ggaccuuucuggaggaaug

SEQ ID NO: 908071 - RNA, 19 nt, Homo sapiens
gaucugcuguuaagguguu

SEQ ID NO: 908072 - RNA, 19 nt, Homo sapiens
gcaaauggcaaugguaaga

SEQ ID NO: 908073 - RNA, 19 nt, Homo sapiens
ggaaacuugugaaucugaa

SEQ ID NO: 908074 - RNA, 19 nt, Homo sapiens
acaauggacuugcccuaaa

SEQ ID NO: 908075 - RNA, 19 nt, Homo sapiens
gaauucagcuagcaaccau

SEQ ID NO: 908076 - RNA, 19 nt, Homo sapiens
ggacucacaucaagaucug

SEQ ID NO: 908077 - RNA, 19 nt, Homo sapiens
agaaugcuguuguaaguga

SEQ ID NO: 908078 - RNA, 19 nt, Homo sapiens
cuuugaaccuucuuguuua

SEQ ID NO: 908079 - RNA, 19 nt, Homo sapiens
ccauggagcgcaauccuua

SEQ ID NO: 908080 - RNA, 19 nt, Homo sapiens
ccaaagauaugcuuguaac

SEQ ID NO: 908081 - RNA, 19 nt, Homo sapiens
gcacaugucaggucucugu

SEQ ID NO: 908082 - RNA, 19 nt, Homo sapiens
gaaccuucuuguuuacaga

SEQ ID NO: 908083 - RNA, 19 nt, Homo sapiens
gcagugcuuuaacaaauca

SEQ ID NO: 908084 - RNA, 19 nt, Homo sapiens
gcaggccaauauuauaaug

SEQ ID NO: 908085 - RNA, 19 nt, Homo sapiens
caaacauggugcuauuuca

SEQ ID NO: 908086 - RNA, 19 nt, Homo sapiens
ugagcucgcuugugucuau

SEQ ID NO: 908087 - RNA, 19 nt, Homo sapiens
gcaaacauggugcuauuuc

SEQ ID NO: 908088 - RNA, 19 nt, Homo sapiens
gaauggcaaucccaguaug

SEQ ID NO: 908089 - RNA, 19 nt, Homo sapiens
caagaagaagcguggauaa

SEQ ID NO: 908090 - RNA, 19 nt, Homo sapiens
caaagaaaaugucaucgaa

SEQ ID NO: 908091 - RNA, 19 nt, Homo sapiens
ggaugaaucuucuaaaccu

SEQ ID NO: 908092 - RNA, 19 nt, Homo sapiens
gaacaaacugccuagcaau

SEQ ID NO: 908093 - RNA, 19 nt, Homo sapiens
guaaguucuucaucaaaug

SEQ ID NO: 908094 - RNA, 19 nt, Homo sapiens
ucagggagaauaacaaauu

SEQ ID NO: 908095 - RNA, 19 nt, Homo sapiens
cagcagggucgaccucuua

SEQ ID NO: 908096 - RNA, 19 nt, Homo sapiens
uacaggaugugauugguaa

SEQ ID NO: 908097 - RNA, 19 nt, Homo sapiens
gaugaaucuucuaaaccua

SEQ ID NO: 908098 - RNA, 19 nt, Homo sapiens
ggagaaacuucaaggaaua

SEQ ID NO: 908099 - RNA, 19 nt, Homo sapiens
caaauuggcuuguucuaaa

SEQ ID NO: 908100 - RNA, 19 nt, Homo sapiens
gaugaaagguggaaacaaa

SEQ ID NO: 908101 - RNA, 19 nt, Homo sapiens
gaaagcaaaucugaaagua

SEQ ID NO: 908102 - RNA, 19 nt, Homo sapiens
ggagaucagucguuucuuu

SEQ ID NO: 908103 - RNA, 19 nt, Homo sapiens
gaaaguagcaacaauagaa

SEQ ID NO: 908104 - RNA, 19 nt, Homo sapiens
gcaauaagauggaccuuuc

SEQ ID NO: 908105 - RNA, 19 nt, Homo sapiens
ggaguuggcuucagaaugu

SEQ ID NO: 908106 - RNA, 19 nt, Homo sapiens
ugaaguaccuccacgauuu

SEQ ID NO: 908107 - RNA, 19 nt, Homo sapiens
gcacaaagccagucucuga

SEQ ID NO: 908108 - RNA, 19 nt, Homo sapiens
aaacagaacugacuuagau

SEQ ID NO: 908109 - RNA, 19 nt, Homo sapiens
ggaagagucuccauuuguu

SEQ ID NO: 908110 - RNA, 19 nt, Homo sapiens
gcaacaaucucgucaacuu

SEQ ID NO: 908111 - RNA, 19 nt, Homo sapiens
ucaagugccuccuccauua

SEQ ID NO: 908112 - RNA, 19 nt, Homo sapiens
gaacacaucuuuggaucaa

SEQ ID NO: 908113 - RNA, 19 nt, Homo sapiens
gaaagguuauccaaacauu

SEQ ID NO: 908114 - RNA, 19 nt, Homo sapiens
gaaaugacuggaccaaaua

SEQ ID NO: 908115 - RNA, 19 nt, Homo sapiens
gcaaccagcacuaauaaua

SEQ ID NO: 908116 - RNA, 19 nt, Homo sapiens
gaagaagcguggauaaauc

SEQ ID NO: 908117 - RNA, 19 nt, Homo sapiens
ggagaaggcugcauggaau

SEQ ID NO: 908118 - RNA, 19 nt, Homo sapiens
gaacacaaacagcuucuaa

SEQ ID NO: 908119 - RNA, 19 nt, Homo sapiens
gaauggagauagauaaaca

SEQ ID NO: 908120 - RNA, 19 nt, Homo sapiens
ccaaagacguagaaagaaa

SEQ ID NO: 908121 - RNA, 19 nt, Homo sapiens
ggaacaaacugccuagcaa

SEQ ID NO: 908122 - RNA, 19 nt, Homo sapiens
gaaccucccucacggaaau

SEQ ID NO: 908123 - RNA, 19 nt, Homo sapiens
ggaagaggauguggagauu

SEQ ID NO: 908124 - RNA, 19 nt, Homo sapiens
acaaauggauggaaaucua

SEQ ID NO: 908125 - RNA, 19 nt, Homo sapiens
gcaagaagaagaacaguug

SEQ ID NO: 908126 - RNA, 19 nt, Homo sapiens
aaagauggccuucggaaua

SEQ ID NO: 908127 - RNA, 19 nt, Homo sapiens
gaacaagcaacaagacauu

SEQ ID NO: 908128 - RNA, 19 nt, Homo sapiens
ugaaaugacuggaccaaau

SEQ ID NO: 908129 - RNA, 19 nt, Homo sapiens
uaagaaugcuguuguaagu

SEQ ID NO: 908130 - RNA, 19 nt, Homo sapiens
ggaggaauguuacaagaca

SEQ ID NO: 908131 - RNA, 19 nt, Homo sapiens
gggagaaacuucaaggaau

SEQ ID NO: 908132 - RNA, 19 nt, Homo sapiens
acaaacagcuucuaaagag

SEQ ID NO: 908133 - RNA, 19 nt, Homo sapiens
caaagugccagaacagaua

SEQ ID NO: 908134 - RNA, 19 nt, Homo sapiens
gaaggaagcugcucaaaag

SEQ ID NO: 908135 - RNA, 19 nt, Homo sapiens
aaagggccaucaccaauaa

SEQ ID NO: 908136 - RNA, 19 nt, Homo sapiens
ccacaagcauuaagcaaau

SEQ ID NO: 908137 - RNA, 19 nt, Homo sapiens
uaauuacucuggagacaaa

SEQ ID NO: 908138 - RNA, 19 nt, Homo sapiens
gagauuggaauguggaaua

SEQ ID NO: 908139 - RNA, 19 nt, Homo sapiens
ggaaacaacauaaauccaa

SEQ ID NO: 908140 - RNA, 19 nt, Homo sapiens
gagagaaacaucacuauca

SEQ ID NO: 908141 - RNA, 19 nt, Homo sapiens
aaacaacgguggccugaau

SEQ ID NO: 908142 - RNA, 19 nt, Homo sapiens
ugauaaggauggcauugua

SEQ ID NO: 908143 - RNA, 19 nt, Homo sapiens
ccaaauaauucaucaggau

SEQ ID NO: 908144 - RNA, 19 nt, Homo sapiens
ccacaucucagacaaauga

SEQ ID NO: 908145 - RNA, 19 nt, Homo sapiens
ggaaaucuacugaggaaga

SEQ ID NO: 908146 - RNA, 19 nt, Homo sapiens
gaccaaauaacacuacuaa

SEQ ID NO: 908147 - RNA, 19 nt, Homo sapiens
caaccagcacuaauaauaa

SEQ ID NO: 908148 - RNA, 19 nt, Homo sapiens
uaaaccagcuuucucagau

SEQ ID NO: 908149 - RNA, 19 nt, Homo sapiens
gaagaugauucugcugcua

SEQ ID NO: 908150 - RNA, 19 nt, Homo sapiens
gaauagcacuggacuuggu

SEQ ID NO: 908151 - RNA, 19 nt, Homo sapiens
gccuaaauauuggugauua

SEQ ID NO: 908152 - RNA, 19 nt, Homo sapiens
ggagauagauaaacauagc

SEQ ID NO: 908153 - RNA, 19 nt, Homo sapiens
gauaugccauugccuggaa

SEQ ID NO: 908154 - RNA, 19 nt, Homo sapiens
ccaaagcauuguaaacaga

SEQ ID NO: 908155 - RNA, 19 nt, Homo sapiens
ggagagcgaugguaguaca

SEQ ID NO: 908156 - RNA, 19 nt, Homo sapiens
auaaugagcugccuaguag

SEQ ID NO: 908157 - RNA, 19 nt, Homo sapiens
ucaggaaacuugugaaucu

SEQ ID NO: 908158 - RNA, 19 nt, Homo sapiens
guacacagaagguuucauu

SEQ ID NO: 908159 - RNA, 19 nt, Homo sapiens
ggaccugugucuucuacaa

SEQ ID NO: 908160 - RNA, 19 nt, Homo sapiens
gauauaaaccacaguacuu

SEQ ID NO: 908161 - RNA, 19 nt, Homo sapiens
ggccucagauuuccaaaga

SEQ ID NO: 908162 - RNA, 19 nt, Homo sapiens
caagugccaucucaaacaa

SEQ ID NO: 908163 - RNA, 19 nt, Homo sapiens
gaauggcacuucccuuucu

SEQ ID NO: 908164 - RNA, 19 nt, Homo sapiens
ccaguuacagcgauuguua

SEQ ID NO: 908165 - RNA, 19 nt, Homo sapiens
cagcacacauuacuccaaa

SEQ ID NO: 908166 - RNA, 19 nt, Homo sapiens
ggaaauggcgcaaauucug

SEQ ID NO: 908167 - RNA, 19 nt, Homo sapiens
gaaguaagugguacacaga

SEQ ID NO: 908168 - RNA, 19 nt, Homo sapiens
ggaccuuucuggaggaaug

SEQ ID NO: 908169 - RNA, 19 nt, Homo sapiens
gcaaauggcaaugguaaga

SEQ ID NO: 908170 - RNA, 19 nt, Homo sapiens
ggaaacuugugaaucugaa

SEQ ID NO: 908171 - RNA, 19 nt, Homo sapiens
acaauggacuugcccuaaa

SEQ ID NO: 908172 - RNA, 19 nt, Homo sapiens
gaauucagcuagcaaccau

SEQ ID NO: 908173 - RNA, 19 nt, Homo sapiens
agaaugcuguuguaaguga

SEQ ID NO: 908174 - RNA, 19 nt, Homo sapiens
gaucugcuguuaagguguu

SEQ ID NO: 908175 - RNA, 19 nt, Homo sapiens
ccauggagcgcaauccuua

SEQ ID NO: 908176 - RNA, 19 nt, Homo sapiens
gcacaugucaggucucugu

SEQ ID NO: 908177 - RNA, 19 nt, Homo sapiens
caaacauggugcuauuuca

SEQ ID NO: 908178 - RNA, 19 nt, Homo sapiens
gcagggauuuagugcaaga

SEQ ID NO: 908179 - RNA, 19 nt, Homo sapiens
gcagugcuuuaacaaauca

SEQ ID NO: 908180 - RNA, 19 nt, Homo sapiens
gcaaacauggugcuauuuc

SEQ ID NO: 908181 - RNA, 19 nt, Homo sapiens
gaauggcaaucccaguaug

SEQ ID NO: 908182 - RNA, 19 nt, Homo sapiens
caagaagaagcguggauaa

SEQ ID NO: 908183 - RNA, 19 nt, Homo sapiens
caaagaaaaugucaucgaa

SEQ ID NO: 908184 - RNA, 19 nt, Homo sapiens
ggaugaaucuucuaaaccu

SEQ ID NO: 908185 - RNA, 19 nt, Homo sapiens
gaacaaacugccuagcaau

SEQ ID NO: 908186 - RNA, 19 nt, Homo sapiens
cagauaaagcccaguguaa

SEQ ID NO: 908187 - RNA, 19 nt, Homo sapiens
guaaguucuucaucaaaug

SEQ ID NO: 908188 - RNA, 19 nt, Homo sapiens
ucagggagaauaacaaauu

SEQ ID NO: 908189 - RNA, 19 nt, Homo sapiens
uagcagggauuuagugcaa

SEQ ID NO: 908190 - RNA, 19 nt, Homo sapiens
cagcagggucgaccucuua

SEQ ID NO: 908191 - RNA, 19 nt, Homo sapiens
gaugaaucuucuaaaccua

SEQ ID NO: 908192 - RNA, 19 nt, Homo sapiens
ccaaauaacacuacuaacu

SEQ ID NO: 908193 - RNA, 19 nt, Homo sapiens
guugguagcagcagcaaua

SEQ ID NO: 908194 - RNA, 19 nt, Homo sapiens
cagaaauagugauuccaaa

SEQ ID NO: 908195 - RNA, 19 nt, Homo sapiens
uaauucaucucaagagcuu

SEQ ID NO: 908196 - RNA, 19 nt, Homo sapiens
gcaagugccaucucaaaca

SEQ ID NO: 908197 - RNA, 19 nt, Homo sapiens
ggagauugaugauggaacu

SEQ ID NO: 908198 - RNA, 19 nt, Homo sapiens
ggaauacacuccugaaaua

SEQ ID NO: 908199 - RNA, 19 nt, Homo sapiens
gcccagagcugaagaaaug

SEQ ID NO: 908200 - RNA, 19 nt, Homo sapiens
caagagaucuguuugcaau

SEQ ID NO: 908201 - RNA, 19 nt, Homo sapiens
gaaauuaugugcugguauc

SEQ ID NO: 908202 - RNA, 19 nt, Homo sapiens
gaaauucagcaccaaguua

SEQ ID NO: 908203 - RNA, 19 nt, Homo sapiens
gaugguggcuuuccucaaa

SEQ ID NO: 908204 - RNA, 19 nt, Homo sapiens
caccauaacugucguugua

SEQ ID NO: 908205 - RNA, 19 nt, Homo sapiens
ggagaaaugugauguuaca

SEQ ID NO: 908206 - RNA, 19 nt, Homo sapiens
uauaugaggucucuggaua

SEQ ID NO: 908207 - RNA, 19 nt, Homo sapiens
ggagacaauucugcaguua

SEQ ID NO: 908208 - RNA, 19 nt, Homo sapiens
gcaaugcucuucaucaaag

SEQ ID NO: 908209 - RNA, 19 nt, Homo sapiens
gcaguuaugucaaucugaa

SEQ ID NO: 908210 - RNA, 19 nt, Homo sapiens
gguagaagaugagaacaaa

SEQ ID NO: 908211 - RNA, 19 nt, Homo sapiens
uaacuacaccuacuacuuu

SEQ ID NO: 908212 - RNA, 19 nt, Homo sapiens
gcuaacaucucauuuacug

SEQ ID NO: 908213 - RNA, 19 nt, Homo sapiens
ugaagaaacuagauagaga

SEQ ID NO: 908214 - RNA, 19 nt, Homo sapiens
ugaaagaccuuaacuuguc

SEQ ID NO: 908215 - RNA, 19 nt, Homo sapiens
ccaagaaacaggcaacaua

SEQ ID NO: 908216 - RNA, 19 nt, Homo sapiens
cagaugauguugacaguga

SEQ ID NO: 908217 - RNA, 19 nt, Homo sapiens
caagaaacaggcaacauaa

SEQ ID NO: 908218 - RNA, 19 nt, Homo sapiens
gcaguuacgcucuccauuu

SEQ ID NO: 908219 - RNA, 19 nt, Homo sapiens
gagauuauuucaccucaau

SEQ ID NO: 908220 - RNA, 19 nt, Homo sapiens
gaaaguaaagguugaagau

SEQ ID NO: 908221 - RNA, 19 nt, Homo sapiens
gaaacagagucacacuaga

SEQ ID NO: 908222 - RNA, 19 nt, Homo sapiens
gaccaaugcuacacugauu

SEQ ID NO: 908223 - RNA, 19 nt, Homo sapiens
ccacuggacuuaucacaau

SEQ ID NO: 908224 - RNA, 19 nt, Homo sapiens
gauguauccucaccaacua

SEQ ID NO: 908225 - RNA, 19 nt, Homo sapiens
gcauugaucgugagaaauu

SEQ ID NO: 908226 - RNA, 19 nt, Homo sapiens
caacauugccaggagauua

SEQ ID NO: 908227 - RNA, 19 nt, Homo sapiens
ggaauaaacggaguucaaa

SEQ ID NO: 908228 - RNA, 19 nt, Homo sapiens
aggguuggcuucuuaauaa

SEQ ID NO: 908229 - RNA, 19 nt, Homo sapiens
uaucaaugguggacacuuu

SEQ ID NO: 908230 - RNA, 19 nt, Homo sapiens
caucacugcuguaguaaga

SEQ ID NO: 908231 - RNA, 19 nt, Homo sapiens
uuucaucacugcuguagua

SEQ ID NO: 908232 - RNA, 19 nt, Homo sapiens
uaacugauccugauuaugg

SEQ ID NO: 908233 - RNA, 19 nt, Homo sapiens
gaagaaacuagauagagaa

SEQ ID NO: 908234 - RNA, 19 nt, Homo sapiens
uccaguaccuccaaagaua

SEQ ID NO: 908235 - RNA, 19 nt, Homo sapiens
gccagagaaugaaauauau

SEQ ID NO: 908236 - RNA, 19 nt, Homo sapiens
ugacacaguuguucuuuca

SEQ ID NO: 908237 - RNA, 19 nt, Homo sapiens
gguugaagaugguggcuuu

SEQ ID NO: 908238 - RNA, 19 nt, Homo sapiens
caacaguuaucaacauauc

SEQ ID NO: 908239 - RNA, 19 nt, Homo sapiens
gauaguuguuaccauguuu

SEQ ID NO: 908240 - RNA, 19 nt, Homo sapiens
uaacaagaaugggauuaga

SEQ ID NO: 908241 - RNA, 19 nt, Homo sapiens
ggugucauccgaccaaaua

SEQ ID NO: 908242 - RNA, 19 nt, Homo sapiens
caauggugcugguaaaugu

SEQ ID NO: 908243 - RNA, 19 nt, Homo sapiens
ggacuuaucacaaucaaag

SEQ ID NO: 908244 - RNA, 19 nt, Homo sapiens
ccacuucucuuucagcaau

SEQ ID NO: 908245 - RNA, 19 nt, Homo sapiens
gagaaauuaugugcuggua

SEQ ID NO: 908246 - RNA, 19 nt, Homo sapiens
ccauaaaugugguugaugu

SEQ ID NO: 908247 - RNA, 19 nt, Homo sapiens
ucauaacugugacggauaa

SEQ ID NO: 908248 - RNA, 19 nt, Homo sapiens
guuuaggguuggcuucuua

SEQ ID NO: 908249 - RNA, 19 nt, Homo sapiens
ggaaacagagucacacuag

SEQ ID NO: 908250 - RNA, 19 nt, Homo sapiens
ugacagugauggaaacaga

SEQ ID NO: 908251 - RNA, 19 nt, Homo sapiens
caaaguaaccauaaaugug

SEQ ID NO: 908252 - RNA, 19 nt, Homo sapiens
ccucaaagauccaguacug

SEQ ID NO: 908253 - RNA, 19 nt, Homo sapiens
gacaagaugccacaacuga

SEQ ID NO: 908254 - RNA, 19 nt, Homo sapiens
ucagaucccuacagcguuu

SEQ ID NO: 908255 - RNA, 19 nt, Homo sapiens
cacuagaccuuccuauuga

SEQ ID NO: 908256 - RNA, 19 nt, Homo sapiens
gaaaacaggcagaugauaa

SEQ ID NO: 908257 - RNA, 19 nt, Homo sapiens
acaguggucuuucagguaa

SEQ ID NO: 908258 - RNA, 19 nt, Homo sapiens
aaucuagucuccaacauug

SEQ ID NO: 908259 - RNA, 19 nt, Homo sapiens
ugaggucucuggauagcua

SEQ ID NO: 908260 - RNA, 19 nt, Homo sapiens
caagaacugccucucgaua

SEQ ID NO: 908261 - RNA, 19 nt, Homo sapiens
caaugacacuggcaugaau

SEQ ID NO: 908262 - RNA, 19 nt, Homo sapiens
ccaaagauauggaauacac

SEQ ID NO: 908263 - RNA, 19 nt, Homo sapiens
gaagucaguauaccagaaa

SEQ ID NO: 908264 - RNA, 19 nt, Homo sapiens
gggaagagaaggauaccua

SEQ ID NO: 908265 - RNA, 19 nt, Homo sapiens
caagaugccacaacugauu

SEQ ID NO: 908266 - RNA, 19 nt, Homo sapiens
uaacagagugucaauuaug

SEQ ID NO: 908267 - RNA, 19 nt, Homo sapiens
ccuuaaggcugcucagaaa

SEQ ID NO: 908268 - RNA, 19 nt, Homo sapiens
ugccacagaugcugacaua

SEQ ID NO: 908269 - RNA, 19 nt, Homo sapiens
guugaaagaccuuaacuug

SEQ ID NO: 908270 - RNA, 19 nt, Homo sapiens
ccaagagaauaauugcauu

SEQ ID NO: 908271 - RNA, 19 nt, Homo sapiens
cccaauagauauauggauu

SEQ ID NO: 908272 - RNA, 19 nt, Homo sapiens
ggaaaguacaauuggguaa

SEQ ID NO: 908273 - RNA, 19 nt, Homo sapiens
gauucucucuucaguguug

SEQ ID NO: 908274 - RNA, 19 nt, Homo sapiens
gaaugacaauagcccaguu

SEQ ID NO: 908275 - RNA, 19 nt, Homo sapiens
uaagauacaucgucaaucc

SEQ ID NO: 908276 - RNA, 19 nt, Homo sapiens
auuagucccuccuuuauaa

SEQ ID NO: 908277 - RNA, 19 nt, Homo sapiens
uaaguuugguagaagauga

SEQ ID NO: 908278 - RNA, 19 nt, Homo sapiens
gaaagccuacucauucuca

SEQ ID NO: 908279 - RNA, 19 nt, Homo sapiens
ccaaacuucucuucuucaa

SEQ ID NO: 908280 - RNA, 19 nt, Homo sapiens
gaaaaucuguggcuguuca

SEQ ID NO: 908281 - RNA, 19 nt, Homo sapiens
gaaaauuggaugcagaaua

SEQ ID NO: 908282 - RNA, 19 nt, Homo sapiens
ucucuucaguguuguaauu

SEQ ID NO: 908283 - RNA, 19 nt, Homo sapiens
ggcaagugaugguggauug

SEQ ID NO: 908284 - RNA, 19 nt, Homo sapiens
caauuaugcuaacaucuca

SEQ ID NO: 908285 - RNA, 19 nt, Homo sapiens
gauguacccaauagauaua

SEQ ID NO: 908286 - RNA, 19 nt, Homo sapiens
acacuagaccuuccuauug

SEQ ID NO: 908287 - RNA, 19 nt, Homo sapiens
gaguguuggucaaagcuaa

SEQ ID NO: 908288 - RNA, 19 nt, Homo sapiens
ugacaaccacccagucuuu

SEQ ID NO: 908289 - RNA, 19 nt, Homo sapiens
gagacaagaugccacaacu

SEQ ID NO: 908290 - RNA, 19 nt, Homo sapiens
cagccugccuuccaaauuc

SEQ ID NO: 908291 - RNA, 19 nt, Homo sapiens
uuacagaccuugguuuaca

SEQ ID NO: 908292 - RNA, 19 nt, Homo sapiens
gagguucguuacagcauug

SEQ ID NO: 908293 - RNA, 19 nt, Homo sapiens
ugacaugcuucacagauca

SEQ ID NO: 908294 - RNA, 19 nt, Homo sapiens
aaauugcucucauaacugu

SEQ ID NO: 908295 - RNA, 19 nt, Homo sapiens
guacaagaccggagaugug

SEQ ID NO: 908296 - RNA, 19 nt, Homo sapiens
guagauggcaguaugacaa

SEQ ID NO: 908297 - RNA, 19 nt, Homo sapiens
cagauguacccaauagaua

SEQ ID NO: 908298 - RNA, 19 nt, Homo sapiens
caacagccaugauguaaua

SEQ ID NO: 908299 - RNA, 19 nt, Homo sapiens
caagagaucuguuugcaau

SEQ ID NO: 908300 - RNA, 19 nt, Homo sapiens
gaaauuaugugcugguauc

SEQ ID NO: 908301 - RNA, 19 nt, Homo sapiens
gaugguggcuuuccucaaa

SEQ ID NO: 908302 - RNA, 19 nt, Homo sapiens
caccauaacugucguugua

SEQ ID NO: 908303 - RNA, 19 nt, Homo sapiens
ggagaaaugugauguuaca

SEQ ID NO: 908304 - RNA, 19 nt, Homo sapiens
ggagacaauucugcaguua

SEQ ID NO: 908305 - RNA, 19 nt, Homo sapiens
gcaaugcucuucaucaaag

SEQ ID NO: 908306 - RNA, 19 nt, Homo sapiens
gcagugagauauaacuuuc

SEQ ID NO: 908307 - RNA, 19 nt, Homo sapiens
uaacuacaccuacuacuuu

SEQ ID NO: 908308 - RNA, 19 nt, Homo sapiens
ugaagaaacuagauagaga

SEQ ID NO: 908309 - RNA, 19 nt, Homo sapiens
ugaaagaccuuaacuuguc

SEQ ID NO: 908310 - RNA, 19 nt, Homo sapiens
ccaagaaacaggcaacaua

SEQ ID NO: 908311 - RNA, 19 nt, Homo sapiens
cagaugauguugacaguga

SEQ ID NO: 908312 - RNA, 19 nt, Homo sapiens
caagaaacaggcaacauaa

SEQ ID NO: 908313 - RNA, 19 nt, Homo sapiens
gcaguuacgcucuccauuu

SEQ ID NO: 908314 - RNA, 19 nt, Homo sapiens
gagauuauuucaccucaau

SEQ ID NO: 908315 - RNA, 19 nt, Homo sapiens
gaaaguaaagguugaagau

SEQ ID NO: 908316 - RNA, 19 nt, Homo sapiens
gaaacagagucacacuaga

SEQ ID NO: 908317 - RNA, 19 nt, Homo sapiens
gaccaaugcuacacugauu

SEQ ID NO: 908318 - RNA, 19 nt, Homo sapiens
ccacuggacuuaucacaau

SEQ ID NO: 908319 - RNA, 19 nt, Homo sapiens
ucagauauuucaaguguug

SEQ ID NO: 908320 - RNA, 19 nt, Homo sapiens
gauguauccucaccaacua

SEQ ID NO: 908321 - RNA, 19 nt, Homo sapiens
gcauugaucgugagaaauu

SEQ ID NO: 908322 - RNA, 19 nt, Homo sapiens
caacauugccaggagauua

SEQ ID NO: 908323 - RNA, 19 nt, Homo sapiens
ggaauaaacggaguucaaa

SEQ ID NO: 908324 - RNA, 19 nt, Homo sapiens
cagccaugauguaauauaa

SEQ ID NO: 908325 - RNA, 19 nt, Homo sapiens
caucacugcuguaguaaga

SEQ ID NO: 908326 - RNA, 19 nt, Homo sapiens
uuucaucacugcuguagua

SEQ ID NO: 908327 - RNA, 19 nt, Homo sapiens
uaacugauccugauuaugg

SEQ ID NO: 908328 - RNA, 19 nt, Homo sapiens
gaagaaacuagauagagaa

SEQ ID NO: 908329 - RNA, 19 nt, Homo sapiens
uaagaaggauuccacagau

SEQ ID NO: 908330 - RNA, 19 nt, Homo sapiens
ugacacaguuguucuuuca

SEQ ID NO: 908331 - RNA, 19 nt, Homo sapiens
gguugaagaugguggcuuu

SEQ ID NO: 908332 - RNA, 19 nt, Homo sapiens
caacaguuaucaacauauc

SEQ ID NO: 908333 - RNA, 19 nt, Homo sapiens
gcuguaaucuggcaaugga

SEQ ID NO: 908334 - RNA, 19 nt, Homo sapiens
ggugucauccgaccaaaua

SEQ ID NO: 908335 - RNA, 19 nt, Homo sapiens
caauggugcugguaaaugu

SEQ ID NO: 908336 - RNA, 19 nt, Homo sapiens
ggacuuaucacaaucaaag

SEQ ID NO: 908337 - RNA, 19 nt, Homo sapiens
ccacuucucuuucagcaau

SEQ ID NO: 908338 - RNA, 19 nt, Homo sapiens
gagaaauuaugugcuggua

SEQ ID NO: 908339 - RNA, 19 nt, Homo sapiens
gagcugaacuagccaaacu

SEQ ID NO: 908340 - RNA, 19 nt, Homo sapiens
ccauaaaugugguugaugu

SEQ ID NO: 908341 - RNA, 19 nt, Homo sapiens
ucauaacugugacggauaa

SEQ ID NO: 908342 - RNA, 19 nt, Homo sapiens
ggaaacagagucacacuag

SEQ ID NO: 908343 - RNA, 19 nt, Homo sapiens
ugacagugauggaaacaga

SEQ ID NO: 908344 - RNA, 19 nt, Homo sapiens
caaaguaaccauaaaugug

SEQ ID NO: 908345 - RNA, 19 nt, Homo sapiens
ccucaaagauccaguacug

SEQ ID NO: 908346 - RNA, 19 nt, Homo sapiens
gacaagaugccacaacuga

SEQ ID NO: 908347 - RNA, 19 nt, Homo sapiens
gcagcacaauaacagagua

SEQ ID NO: 908348 - RNA, 19 nt, Homo sapiens
ucagaucccuacagcguuu

SEQ ID NO: 908349 - RNA, 19 nt, Homo sapiens
cacuagaccuuccuauuga

SEQ ID NO: 908350 - RNA, 19 nt, Homo sapiens
gaaaacaggcagaugauaa

SEQ ID NO: 908351 - RNA, 19 nt, Homo sapiens
acaguggucuuucagguaa

SEQ ID NO: 908352 - RNA, 19 nt, Homo sapiens
aaucuagucuccaacauug

SEQ ID NO: 908353 - RNA, 19 nt, Homo sapiens
caagaacugccucucgaua

SEQ ID NO: 908354 - RNA, 19 nt, Homo sapiens
caaugacacuggcaugaau

SEQ ID NO: 908355 - RNA, 19 nt, Homo sapiens
ucuaaaggcaucguuauua

SEQ ID NO: 908356 - RNA, 19 nt, Homo sapiens
gaagucaguauaccagaaa

SEQ ID NO: 908357 - RNA, 19 nt, Homo sapiens
gggaagagaaggauaccua

SEQ ID NO: 908358 - RNA, 19 nt, Homo sapiens
caagaugccacaacugauu

SEQ ID NO: 908359 - RNA, 19 nt, Homo sapiens
ccuuaaggcugcucagaaa

SEQ ID NO: 908360 - RNA, 19 nt, Homo sapiens
ugccacagaugcugacaua

SEQ ID NO: 908361 - RNA, 19 nt, Homo sapiens
guugaaagaccuuaacuug

SEQ ID NO: 908362 - RNA, 19 nt, Homo sapiens
ugacaagcuuggcugauug

SEQ ID NO: 908363 - RNA, 19 nt, Homo sapiens
ggaaaguacaauuggguaa

SEQ ID NO: 908364 - RNA, 19 nt, Homo sapiens
gauucucucuucaguguug

SEQ ID NO: 908365 - RNA, 19 nt, Homo sapiens
gaaugacaauagcccaguu

SEQ ID NO: 908366 - RNA, 19 nt, Homo sapiens
uaagauacaucgucaaucc

SEQ ID NO: 908367 - RNA, 19 nt, Homo sapiens
gaaccuugugcuuucuuua

SEQ ID NO: 908368 - RNA, 19 nt, Homo sapiens
acaacaaacuguaacaagu

SEQ ID NO: 908369 - RNA, 19 nt, Homo sapiens
cagcugcucucaacuuugu

SEQ ID NO: 908370 - RNA, 19 nt, Homo sapiens
ugaauagccucagaaacaa

SEQ ID NO: 908371 - RNA, 19 nt, Homo sapiens
ucucuucaguguuguaauu

SEQ ID NO: 908372 - RNA, 19 nt, Homo sapiens
ggcaagugaugguggauug

SEQ ID NO: 908373 - RNA, 19 nt, Homo sapiens
caacaaacuguaacaagug

SEQ ID NO: 908374 - RNA, 19 nt, Homo sapiens
uagccaaacuacucucuga

SEQ ID NO: 908375 - RNA, 19 nt, Homo sapiens
acacuagaccuuccuauug

SEQ ID NO: 908376 - RNA, 19 nt, Homo sapiens
gaguguuggucaaagcuaa

SEQ ID NO: 908377 - RNA, 19 nt, Homo sapiens
ugacaaccacccagucuuu

SEQ ID NO: 908378 - RNA, 19 nt, Homo sapiens
gagacaagaugccacaacu

SEQ ID NO: 908379 - RNA, 19 nt, Homo sapiens
gaacgacaguggguuuuaa

SEQ ID NO: 908380 - RNA, 19 nt, Homo sapiens
cagccugccuuccaaauuc

SEQ ID NO: 908381 - RNA, 19 nt, Homo sapiens
uuacagaccuugguuuaca

SEQ ID NO: 908382 - RNA, 19 nt, Homo sapiens
gagguucguuacagcauug

SEQ ID NO: 908383 - RNA, 19 nt, Homo sapiens
ugacaugcuucacagauca

SEQ ID NO: 908384 - RNA, 19 nt, Homo sapiens
aaauugcucucauaacugu

SEQ ID NO: 908385 - RNA, 19 nt, Homo sapiens
guacaagaccggagaugug

SEQ ID NO: 908386 - RNA, 19 nt, Homo sapiens
gcucucaacuuuguaaucu

SEQ ID NO: 908387 - RNA, 19 nt, Homo sapiens
ggaggaaacacaagagauc

SEQ ID NO: 908388 - RNA, 19 nt, Homo sapiens
ugaggauggugguagagua

SEQ ID NO: 908389 - RNA, 19 nt, Homo sapiens
uaaggccaguauucaguaa

SEQ ID NO: 908390 - RNA, 19 nt, Homo sapiens
ucaaagaaccacuggauag

SEQ ID NO: 908391 - RNA, 19 nt, Homo sapiens
ggaggagccgugagcagua

SEQ ID NO: 908392 - RNA, 19 nt, Homo sapiens
ccucuucauucuacucuaa

SEQ ID NO: 908393 - RNA, 19 nt, Homo sapiens
cagcaacaguuaucaacau

SEQ ID NO: 908394 - RNA, 19 nt, Homo sapiens
ggagaugugccacugauuc

SEQ ID NO: 908395 - RNA, 19 nt, Homo sapiens
augcuacacugauuaauga

SEQ ID NO: 908396 - RNA, 19 nt, Homo sapiens
gguagaguaucacguucuu

SEQ ID NO: 908397 - RNA, 19 nt, Homo sapiens
ggaguuagauagggaagag

SEQ ID NO: 908398 - RNA, 19 nt, Homo sapiens
aaagaaagcugcagaaaua

SEQ ID NO: 908399 - RNA, 19 nt, Homo sapiens
ggaauacacuccugaaaua

SEQ ID NO: 908400 - RNA, 19 nt, Homo sapiens
guaagaagguugacuauug

SEQ ID NO: 908401 - RNA, 19 nt, Homo sapiens
gaagauuccuccucuguga

SEQ ID NO: 908402 - RNA, 19 nt, Homo sapiens
gcccagagcugaagaaaug

SEQ ID NO: 908403 - RNA, 19 nt, Homo sapiens
gcaauaacugcccuaauua

SEQ ID NO: 908404 - RNA, 19 nt, Homo sapiens
caacugcacucaagaaugu

SEQ ID NO: 908405 - RNA, 19 nt, Homo sapiens
caagagaucuguuugcaau

SEQ ID NO: 908406 - RNA, 19 nt, Homo sapiens
gaaauuaugugcugguauc

SEQ ID NO: 908407 - RNA, 19 nt, Homo sapiens
caagagaagcugaaauaua

SEQ ID NO: 908408 - RNA, 19 nt, Homo sapiens
gaugguggcuuuccucaaa

SEQ ID NO: 908409 - RNA, 19 nt, Homo sapiens
gaaagagucuacaacuaug

SEQ ID NO: 908410 - RNA, 19 nt, Homo sapiens
caccauaacugucguugua

SEQ ID NO: 908411 - RNA, 19 nt, Homo sapiens
ggagaaaugugauguuaca

SEQ ID NO: 908412 - RNA, 19 nt, Homo sapiens
ccucauaucuggaaacuug

SEQ ID NO: 908413 - RNA, 19 nt, Homo sapiens
cagaauaaaucuacagcua

SEQ ID NO: 908414 - RNA, 19 nt, Homo sapiens
agaagagguugaaagauua

SEQ ID NO: 908415 - RNA, 19 nt, Homo sapiens
gcacacacacacacauuua

SEQ ID NO: 908416 - RNA, 19 nt, Homo sapiens
agaaacagauaccagaaua

SEQ ID NO: 908417 - RNA, 19 nt, Homo sapiens
aagaagagguugaaagauu

SEQ ID NO: 908418 - RNA, 19 nt, Homo sapiens
ggaaggaacuuuucaagaa

SEQ ID NO: 908419 - RNA, 19 nt, Homo sapiens
gcggaaaucugaagggaaa

SEQ ID NO: 908420 - RNA, 19 nt, Homo sapiens
ggagacaauucugcaguua

SEQ ID NO: 908421 - RNA, 19 nt, Homo sapiens
gcaaugcucuucaucaaag

SEQ ID NO: 908422 - RNA, 19 nt, Homo sapiens
ccagaaggcucucaggaaa

SEQ ID NO: 908423 - RNA, 19 nt, Homo sapiens
ucaggcaucucaaugguua

SEQ ID NO: 908424 - RNA, 19 nt, Homo sapiens
gcaaagaugaugugagauu

SEQ ID NO: 908425 - RNA, 19 nt, Homo sapiens
gcacaggccucugcucuau

SEQ ID NO: 908426 - RNA, 19 nt, Homo sapiens
gcaguuaugucaaucugaa

SEQ ID NO: 908427 - RNA, 19 nt, Homo sapiens
gaaguaagaagguugacua

SEQ ID NO: 908428 - RNA, 19 nt, Homo sapiens
caaagaaacaguacuauuc

SEQ ID NO: 908429 - RNA, 19 nt, Homo sapiens
gagaaacucaggaagauuu

SEQ ID NO: 908430 - RNA, 19 nt, Homo sapiens
gaaccaguauguagcaaau

SEQ ID NO: 908431 - RNA, 19 nt, Homo sapiens
ccaaugaguauucugauua

SEQ ID NO: 908432 - RNA, 19 nt, Homo sapiens
ucaagaaugucucaucuau

SEQ ID NO: 908433 - RNA, 19 nt, Homo sapiens
uaacuacaccuacuacuuu

SEQ ID NO: 908434 - RNA, 19 nt, Homo sapiens
gcuaacaucucauuuacug

SEQ ID NO: 908435 - RNA, 19 nt, Homo sapiens
gcuagacccuuagucaaua

SEQ ID NO: 908436 - RNA, 19 nt, Homo sapiens
ugaagaaacuagauagaga

SEQ ID NO: 908437 - RNA, 19 nt, Homo sapiens
ugaaagaccuuaacuuguc

SEQ ID NO: 908438 - RNA, 19 nt, Homo sapiens
uaucacacauggucauuaa

SEQ ID NO: 908439 - RNA, 19 nt, Homo sapiens
caaagaugaugugagauuu

SEQ ID NO: 908440 - RNA, 19 nt, Homo sapiens
ccaagaaacaggcaacaua

SEQ ID NO: 908441 - RNA, 19 nt, Homo sapiens
gcaaagaaacaguacuauu

SEQ ID NO: 908442 - RNA, 19 nt, Homo sapiens
ugcaauaacugcccuaauu

SEQ ID NO: 908443 - RNA, 19 nt, Homo sapiens
agacuuagauuguguuuag

SEQ ID NO: 908444 - RNA, 19 nt, Homo sapiens
caaauaggacucaaaguug

SEQ ID NO: 908445 - RNA, 19 nt, Homo sapiens
cagaugauguugacaguga

SEQ ID NO: 908446 - RNA, 19 nt, Homo sapiens
caagaaacaggcaacauaa

SEQ ID NO: 908447 - RNA, 19 nt, Homo sapiens
gcaguuacgcucuccauuu

SEQ ID NO: 908448 - RNA, 19 nt, Homo sapiens
gagauuauuucaccucaau

SEQ ID NO: 908449 - RNA, 19 nt, Homo sapiens
gaaaguaaagguugaagau

SEQ ID NO: 908450 - RNA, 19 nt, Homo sapiens
agaaauaacuguucaacca

SEQ ID NO: 908451 - RNA, 19 nt, Homo sapiens
gaaacagagucacacuaga

SEQ ID NO: 908452 - RNA, 19 nt, Homo sapiens
gaccaaugcuacacugauu

SEQ ID NO: 908453 - RNA, 19 nt, Homo sapiens
ccacuggacuuaucacaau

SEQ ID NO: 908454 - RNA, 19 nt, Homo sapiens
cagaagcaaacuuguauua

SEQ ID NO: 908455 - RNA, 19 nt, Homo sapiens
gacaacagcagaaacagua

SEQ ID NO: 908456 - RNA, 19 nt, Homo sapiens
ccgaaggacugaugauauu

SEQ ID NO: 908457 - RNA, 19 nt, Homo sapiens
gauguauccucaccaacua

SEQ ID NO: 908458 - RNA, 19 nt, Homo sapiens
gcauugaucgugagaaauu

SEQ ID NO: 908459 - RNA, 19 nt, Homo sapiens
ccucuuaacuggccauuau

SEQ ID NO: 908460 - RNA, 19 nt, Homo sapiens
ggagaaauaaggcacauga

SEQ ID NO: 908461 - RNA, 19 nt, Homo sapiens
caacauugccaggagauua

SEQ ID NO: 908462 - RNA, 19 nt, Homo sapiens
ggaauaaacggaguucaaa

SEQ ID NO: 908463 - RNA, 19 nt, Homo sapiens
gcagaggccuuaaaauauu

SEQ ID NO: 908464 - RNA, 19 nt, Homo sapiens
ucaaauaggacucaaaguu

SEQ ID NO: 908465 - RNA, 19 nt, Homo sapiens
aggguuggcuucuuaauaa

SEQ ID NO: 908466 - RNA, 19 nt, Homo sapiens
uaucaaugguggacacuuu

SEQ ID NO: 908467 - RNA, 19 nt, Homo sapiens
uaagaagguugacuauugu

SEQ ID NO: 908468 - RNA, 19 nt, Homo sapiens
gacaauugauguuuaaugg

SEQ ID NO: 908469 - RNA, 19 nt, Homo sapiens
ccaaagcacgagucacuua

SEQ ID NO: 908470 - RNA, 19 nt, Homo sapiens
uccaguaccuccaaagaua

SEQ ID NO: 908471 - RNA, 19 nt, Homo sapiens
caucacugcuguaguaaga

SEQ ID NO: 908472 - RNA, 19 nt, Homo sapiens
uuucaucacugcuguagua

SEQ ID NO: 908473 - RNA, 19 nt, Homo sapiens
uaacugauccugauuaugg

SEQ ID NO: 908474 - RNA, 19 nt, Homo sapiens
gaagaaacuagauagagaa

SEQ ID NO: 908475 - RNA, 19 nt, Homo sapiens
gguuagugcuauuguguaa

SEQ ID NO: 908476 - RNA, 19 nt, Homo sapiens
guauaacacuaaaccaaga

SEQ ID NO: 908477 - RNA, 19 nt, Homo sapiens
gaaacagauaccagaauaa

SEQ ID NO: 908478 - RNA, 19 nt, Homo sapiens
ugacacaguuguucuuuca

SEQ ID NO: 908479 - RNA, 19 nt, Homo sapiens
gauaguuguuaccauguuu

SEQ ID NO: 908480 - RNA, 19 nt, Homo sapiens
gguugaagaugguggcuuu

SEQ ID NO: 908481 - RNA, 19 nt, Homo sapiens
caacaguuaucaacauauc

SEQ ID NO: 908482 - RNA, 19 nt, Homo sapiens
guaacagccuagaaaauua

SEQ ID NO: 908483 - RNA, 19 nt, Homo sapiens
gcaaauggaaagccuagaa

SEQ ID NO: 908484 - RNA, 19 nt, Homo sapiens
ugaaagagucuacaacuau

SEQ ID NO: 908485 - RNA, 19 nt, Homo sapiens
ggugucauccgaccaaaua

SEQ ID NO: 908486 - RNA, 19 nt, Homo sapiens
caauggugcugguaaaugu

SEQ ID NO: 908487 - RNA, 19 nt, Homo sapiens
ggacuuaucacaaucaaag

SEQ ID NO: 908488 - RNA, 19 nt, Homo sapiens
ccacuucucuuucagcaau

SEQ ID NO: 908489 - RNA, 19 nt, Homo sapiens
gagaaauuaugugcuggua

SEQ ID NO: 908490 - RNA, 19 nt, Homo sapiens
gguauuagcccaguuauuc

SEQ ID NO: 908491 - RNA, 19 nt, Homo sapiens
gacccuuagucaauaguua

SEQ ID NO: 908492 - RNA, 19 nt, Homo sapiens
ccauaaaugugguugaugu

SEQ ID NO: 908493 - RNA, 19 nt, Homo sapiens
ucauaacugugacggauaa

SEQ ID NO: 908494 - RNA, 19 nt, Homo sapiens
guuuaggguuggcuucuua

SEQ ID NO: 908495 - RNA, 19 nt, Homo sapiens
cuagggagguucuuaaauc

SEQ ID NO: 908496 - RNA, 19 nt, Homo sapiens
cugcaaagaugaugugaga

SEQ ID NO: 908497 - RNA, 19 nt, Homo sapiens
ggacugaugauauuugaau

SEQ ID NO: 908498 - RNA, 19 nt, Homo sapiens
aaagaaagcugcagaaaua

SEQ ID NO: 908499 - RNA, 19 nt, Homo sapiens
ggaauacacuccugaaaua

SEQ ID NO: 908500 - RNA, 19 nt, Homo sapiens
guaagaagguugacuauug

SEQ ID NO: 908501 - RNA, 19 nt, Homo sapiens
gaagauuccuccucuguga

SEQ ID NO: 908502 - RNA, 19 nt, Homo sapiens
gcccagagcugaagaaaug

SEQ ID NO: 908503 - RNA, 19 nt, Homo sapiens
gcaauaacugcccuaauua

SEQ ID NO: 908504 - RNA, 19 nt, Homo sapiens
caacugcacucaagaaugu

SEQ ID NO: 908505 - RNA, 19 nt, Homo sapiens
caagagaucuguuugcaau

SEQ ID NO: 908506 - RNA, 19 nt, Homo sapiens
gaaauuaugugcugguauc

SEQ ID NO: 908507 - RNA, 19 nt, Homo sapiens
caagagaagcugaaauaua

SEQ ID NO: 908508 - RNA, 19 nt, Homo sapiens
gaugguggcuuuccucaaa

SEQ ID NO: 908509 - RNA, 19 nt, Homo sapiens
gaaagagucuacaacuaug

SEQ ID NO: 908510 - RNA, 19 nt, Homo sapiens
caccauaacugucguugua

SEQ ID NO: 908511 - RNA, 19 nt, Homo sapiens
ggagaaaugugauguuaca

SEQ ID NO: 908512 - RNA, 19 nt, Homo sapiens
ccucauaucuggaaacuug

SEQ ID NO: 908513 - RNA, 19 nt, Homo sapiens
cagaauaaaucuacagcua

SEQ ID NO: 908514 - RNA, 19 nt, Homo sapiens
agaagagguugaaagauua

SEQ ID NO: 908515 - RNA, 19 nt, Homo sapiens
gcacacacacacacauuua

SEQ ID NO: 908516 - RNA, 19 nt, Homo sapiens
agaaacagauaccagaaua

SEQ ID NO: 908517 - RNA, 19 nt, Homo sapiens
aagaagagguugaaagauu

SEQ ID NO: 908518 - RNA, 19 nt, Homo sapiens
ggaaggaacuuuucaagaa

SEQ ID NO: 908519 - RNA, 19 nt, Homo sapiens
ggagacaauucugcaguua

SEQ ID NO: 908520 - RNA, 19 nt, Homo sapiens
gcaaugcucuucaucaaag

SEQ ID NO: 908521 - RNA, 19 nt, Homo sapiens
ccagaaggcucucaggaaa

SEQ ID NO: 908522 - RNA, 19 nt, Homo sapiens
ucaggcaucucaaugguua

SEQ ID NO: 908523 - RNA, 19 nt, Homo sapiens
gcaaagaugaugugagauu

SEQ ID NO: 908524 - RNA, 19 nt, Homo sapiens
gcacaggccucugcucuau

SEQ ID NO: 908525 - RNA, 19 nt, Homo sapiens
gcaguuaugucaaucugaa

SEQ ID NO: 908526 - RNA, 19 nt, Homo sapiens
gaaguaagaagguugacua

SEQ ID NO: 908527 - RNA, 19 nt, Homo sapiens
caaagaaacaguacuauuc

SEQ ID NO: 908528 - RNA, 19 nt, Homo sapiens
gagaaacucaggaagauuu

SEQ ID NO: 908529 - RNA, 19 nt, Homo sapiens
gaaccaguauguagcaaau

SEQ ID NO: 908530 - RNA, 19 nt, Homo sapiens
ccaaugaguauucugauua

SEQ ID NO: 908531 - RNA, 19 nt, Homo sapiens
ucaagaaugucucaucuau

SEQ ID NO: 908532 - RNA, 19 nt, Homo sapiens
uaacuacaccuacuacuuu

SEQ ID NO: 908533 - RNA, 19 nt, Homo sapiens
gcuaacaucucauuuacug

SEQ ID NO: 908534 - RNA, 19 nt, Homo sapiens
gcuagacccuuagucaaua

SEQ ID NO: 908535 - RNA, 19 nt, Homo sapiens
ugaagaaacuagauagaga

SEQ ID NO: 908536 - RNA, 19 nt, Homo sapiens
ugaaagaccuuaacuuguc

SEQ ID NO: 908537 - RNA, 19 nt, Homo sapiens
uaucacacauggucauuaa

SEQ ID NO: 908538 - RNA, 19 nt, Homo sapiens
caaagaugaugugagauuu

SEQ ID NO: 908539 - RNA, 19 nt, Homo sapiens
ccaagaaacaggcaacaua

SEQ ID NO: 908540 - RNA, 19 nt, Homo sapiens
gcaaagaaacaguacuauu

SEQ ID NO: 908541 - RNA, 19 nt, Homo sapiens
ugcaauaacugcccuaauu

SEQ ID NO: 908542 - RNA, 19 nt, Homo sapiens
agacuuagauuguguuuag

SEQ ID NO: 908543 - RNA, 19 nt, Homo sapiens
caaauaggacucaaaguug

SEQ ID NO: 908544 - RNA, 19 nt, Homo sapiens
cagaugauguugacaguga

SEQ ID NO: 908545 - RNA, 19 nt, Homo sapiens
caagaaacaggcaacauaa

SEQ ID NO: 908546 - RNA, 19 nt, Homo sapiens
gcaguuacgcucuccauuu

SEQ ID NO: 908547 - RNA, 19 nt, Homo sapiens
gagauuauuucaccucaau

SEQ ID NO: 908548 - RNA, 19 nt, Homo sapiens
gaaaguaaagguugaagau

SEQ ID NO: 908549 - RNA, 19 nt, Homo sapiens
agaaauaacuguucaacca

SEQ ID NO: 908550 - RNA, 19 nt, Homo sapiens
gaaacagagucacacuaga

SEQ ID NO: 908551 - RNA, 19 nt, Homo sapiens
gaccaaugcuacacugauu

SEQ ID NO: 908552 - RNA, 19 nt, Homo sapiens
ccacuggacuuaucacaau

SEQ ID NO: 908553 - RNA, 19 nt, Homo sapiens
cagaagcaaacuuguauua

SEQ ID NO: 908554 - RNA, 19 nt, Homo sapiens
gacaacagcagaaacagua

SEQ ID NO: 908555 - RNA, 19 nt, Homo sapiens
ccgaaggacugaugauauu

SEQ ID NO: 908556 - RNA, 19 nt, Homo sapiens
gauguauccucaccaacua

SEQ ID NO: 908557 - RNA, 19 nt, Homo sapiens
gcauugaucgugagaaauu

SEQ ID NO: 908558 - RNA, 19 nt, Homo sapiens
ccucuuaacuggccauuau

SEQ ID NO: 908559 - RNA, 19 nt, Homo sapiens
ggagaaauaaggcacauga

SEQ ID NO: 908560 - RNA, 19 nt, Homo sapiens
caacauugccaggagauua

SEQ ID NO: 908561 - RNA, 19 nt, Homo sapiens
ggaauaaacggaguucaaa

SEQ ID NO: 908562 - RNA, 19 nt, Homo sapiens
gcagaggccuuaaaauauu

SEQ ID NO: 908563 - RNA, 19 nt, Homo sapiens
ucaaauaggacucaaaguu

SEQ ID NO: 908564 - RNA, 19 nt, Homo sapiens
aggguuggcuucuuaauaa

SEQ ID NO: 908565 - RNA, 19 nt, Homo sapiens
uaucaaugguggacacuuu

SEQ ID NO: 908566 - RNA, 19 nt, Homo sapiens
uaagaagguugacuauugu

SEQ ID NO: 908567 - RNA, 19 nt, Homo sapiens
gacaauugauguuuaaugg

SEQ ID NO: 908568 - RNA, 19 nt, Homo sapiens
ccaaagcacgagucacuua

SEQ ID NO: 908569 - RNA, 19 nt, Homo sapiens
uccaguaccuccaaagaua

SEQ ID NO: 908570 - RNA, 19 nt, Homo sapiens
caucacugcuguaguaaga

SEQ ID NO: 908571 - RNA, 19 nt, Homo sapiens
uuucaucacugcuguagua

SEQ ID NO: 908572 - RNA, 19 nt, Homo sapiens
uaacugauccugauuaugg

SEQ ID NO: 908573 - RNA, 19 nt, Homo sapiens
gaagaaacuagauagagaa

SEQ ID NO: 908574 - RNA, 19 nt, Homo sapiens
gguuagugcuauuguguaa

SEQ ID NO: 908575 - RNA, 19 nt, Homo sapiens
guauaacacuaaaccaaga

SEQ ID NO: 908576 - RNA, 19 nt, Homo sapiens
gaaacagauaccagaauaa

SEQ ID NO: 908577 - RNA, 19 nt, Homo sapiens
ugacacaguuguucuuuca

SEQ ID NO: 908578 - RNA, 19 nt, Homo sapiens
gguugaagaugguggcuuu

SEQ ID NO: 908579 - RNA, 19 nt, Homo sapiens
gauaguuguuaccauguuu

SEQ ID NO: 908580 - RNA, 19 nt, Homo sapiens
caacaguuaucaacauauc

SEQ ID NO: 908581 - RNA, 19 nt, Homo sapiens
guaacagccuagaaaauua

SEQ ID NO: 908582 - RNA, 19 nt, Homo sapiens
gcaaauggaaagccuagaa

SEQ ID NO: 908583 - RNA, 19 nt, Homo sapiens
ugaaagagucuacaacuau

SEQ ID NO: 908584 - RNA, 19 nt, Homo sapiens
ggugucauccgaccaaaua

SEQ ID NO: 908585 - RNA, 19 nt, Homo sapiens
caauggugcugguaaaugu

SEQ ID NO: 908586 - RNA, 19 nt, Homo sapiens
ggacuuaucacaaucaaag

SEQ ID NO: 908587 - RNA, 19 nt, Homo sapiens
ccacuucucuuucagcaau

SEQ ID NO: 908588 - RNA, 19 nt, Homo sapiens
gagaaauuaugugcuggua

SEQ ID NO: 908589 - RNA, 19 nt, Homo sapiens
gguauuagcccaguuauuc

SEQ ID NO: 908590 - RNA, 19 nt, Homo sapiens
gacccuuagucaauaguua

SEQ ID NO: 908591 - RNA, 19 nt, Homo sapiens
ccauaaaugugguugaugu

SEQ ID NO: 908592 - RNA, 19 nt, Homo sapiens
ucauaacugugacggauaa

SEQ ID NO: 908593 - RNA, 19 nt, Homo sapiens
guuuaggguuggcuucuua

SEQ ID NO: 908594 - RNA, 19 nt, Homo sapiens
cuagggagguucuuaaauc

SEQ ID NO: 908595 - RNA, 19 nt, Homo sapiens
cugcaaagaugaugugaga

SEQ ID NO: 908596 - RNA, 19 nt, Homo sapiens
ggacugaugauauuugaau

SEQ ID NO: 908597 - RNA, 19 nt, Homo sapiens
aaacugugguaauugcaua

SEQ ID NO: 908598 - RNA, 19 nt, Homo sapiens
ggaaagacaacaaacauua

SEQ ID NO: 908599 - RNA, 19 nt, Homo sapiens
gaacugaggcaaauuuaaa

SEQ ID NO: 908600 - RNA, 19 nt, Homo sapiens
gcaaaccagugaaaucaaa

SEQ ID NO: 908601 - RNA, 19 nt, Homo sapiens
uaacagaggugaacauaca

SEQ ID NO: 908602 - RNA, 19 nt, Homo sapiens
gaagauauacuccauagug

SEQ ID NO: 908603 - RNA, 19 nt, Homo sapiens
ucagaaagcuuugaaugaa

SEQ ID NO: 908604 - RNA, 19 nt, Homo sapiens
gaacucaacucaaaacuug

SEQ ID NO: 908605 - RNA, 19 nt, Homo sapiens
gagaagauauacuccauag

SEQ ID NO: 908606 - RNA, 19 nt, Homo sapiens
caacauauuugaucagucu

SEQ ID NO: 908607 - RNA, 19 nt, Homo sapiens
caagacaauucaucauuug

SEQ ID NO: 908608 - RNA, 19 nt, Homo sapiens
gaaaacaaccuaaauggua

SEQ ID NO: 908609 - RNA, 19 nt, Homo sapiens
gaacuacucccuuucuuca

SEQ ID NO: 908610 - RNA, 19 nt, Homo sapiens
ccaacagcauagucaaaua

SEQ ID NO: 908611 - RNA, 19 nt, Homo sapiens
gaacugagaagaacuacau

SEQ ID NO: 908612 - RNA, 19 nt, Homo sapiens
ccagugaaaucaaagaaga

SEQ ID NO: 908613 - RNA, 19 nt, Homo sapiens
caacagcauagucaaauaa

SEQ ID NO: 908614 - RNA, 19 nt, Homo sapiens
ccaauggccuccuucaguu

SEQ ID NO: 908615 - RNA, 19 nt, Homo sapiens
gaggcuugauggagaauuu

SEQ ID NO: 908616 - RNA, 19 nt, Homo sapiens
uagaagagcaacuaacuaa

SEQ ID NO: 908617 - RNA, 19 nt, Homo sapiens
caauuaagcuccuucuuuu

SEQ ID NO: 908618 - RNA, 19 nt, Homo sapiens
guuauuuccuccagaauug

SEQ ID NO: 908619 - RNA, 19 nt, Homo sapiens
ucaagaacccacagaaauu

SEQ ID NO: 908620 - RNA, 19 nt, Homo sapiens
ugaaugaacugaggcaaau

SEQ ID NO: 908621 - RNA, 19 nt, Homo sapiens
gugaagcaaucuaauuaug

SEQ ID NO: 908622 - RNA, 19 nt, Homo sapiens
ucgaauagauggaucacaa

SEQ ID NO: 908623 - RNA, 19 nt, Homo sapiens
caagaacccacagaaauuu

SEQ ID NO: 908624 - RNA, 19 nt, Homo sapiens
caauuaaaccaacagcaua

SEQ ID NO: 908625 - RNA, 19 nt, Homo sapiens
gaaaucacgaaaccaacua

SEQ ID NO: 908626 - RNA, 19 nt, Homo sapiens
gagcaacuaacuaacuuaa

SEQ ID NO: 908627 - RNA, 19 nt, Homo sapiens
gaaagccuccuagaagaaa

SEQ ID NO: 908628 - RNA, 19 nt, Homo sapiens
guaaagaauaugucacuug

SEQ ID NO: 908629 - RNA, 19 nt, Homo sapiens
gggccaaauuaaugacaua

SEQ ID NO: 908630 - RNA, 19 nt, Homo sapiens
ugucuacugugauguuaua

SEQ ID NO: 908631 - RNA, 19 nt, Homo sapiens
acaauuaagcuccuucuuu

SEQ ID NO: 908632 - RNA, 19 nt, Homo sapiens
cagaaggacuaguauucaa

SEQ ID NO: 908633 - RNA, 19 nt, Homo sapiens
gaagagcaacuaacuaacu

SEQ ID NO: 908634 - RNA, 19 nt, Homo sapiens
gaagagguaaagaauaugu

SEQ ID NO: 908635 - RNA, 19 nt, Homo sapiens
guugggacauggucuuaaa

SEQ ID NO: 908636 - RNA, 19 nt, Homo sapiens
ggaagaccaauauaaacaa

SEQ ID NO: 908637 - RNA, 19 nt, Homo sapiens
gaaggacuaguauucaaga

SEQ ID NO: 908638 - RNA, 19 nt, Homo sapiens
gaaaaggaacugagaagaa

SEQ ID NO: 908639 - RNA, 19 nt, Homo sapiens
agacgaagggccaaauuaa

SEQ ID NO: 908640 - RNA, 19 nt, Homo sapiens
ccaaguuaauguggucuaa

SEQ ID NO: 908641 - RNA, 19 nt, Homo sapiens
aauggaagguuauacucua

SEQ ID NO: 908642 - RNA, 19 nt, Homo sapiens
aagauauacuccauaguga

SEQ ID NO: 908643 - RNA, 19 nt, Homo sapiens
gacauuaauucaacaucga

SEQ ID NO: 908644 - RNA, 19 nt, Homo sapiens
gauguuauaucagguaguc

SEQ ID NO: 908645 - RNA, 19 nt, Homo sapiens
ccagaacacccagaaguaa

SEQ ID NO: 908646 - RNA, 19 nt, Homo sapiens
ugggagaacuacaaauaug

SEQ ID NO: 908647 - RNA, 19 nt, Homo sapiens
cgugggagaacuacaaaua

SEQ ID NO: 908648 - RNA, 19 nt, Homo sapiens
ccaagagcaccaagaacua

SEQ ID NO: 908649 - RNA, 19 nt, Homo sapiens
uaugaucuaucgcugcaaa

SEQ ID NO: 908650 - RNA, 19 nt, Homo sapiens
cgaagggccaaauuaauga

SEQ ID NO: 908651 - RNA, 19 nt, Homo sapiens
caacuauacgcuacaucua

SEQ ID NO: 908652 - RNA, 19 nt, Homo sapiens
cuaguuauuuccuccagaa

SEQ ID NO: 908653 - RNA, 19 nt, Homo sapiens
accaagaacuacucccuuu

SEQ ID NO: 908654 - RNA, 19 nt, Homo sapiens
cagcucagaaggacuagua

SEQ ID NO: 908655 - RNA, 19 nt, Homo sapiens
gaauaugucacuugaacuc

SEQ ID NO: 908656 - RNA, 19 nt, Homo sapiens
caacagauucagaaagcuu

SEQ ID NO: 908657 - RNA, 19 nt, Homo sapiens
gagaggagaagaggauuau

SEQ ID NO: 908658 - RNA, 19 nt, Homo sapiens
caugucuacugugauguua

SEQ ID NO: 908659 - RNA, 19 nt, Homo sapiens
uugaaagccuccuagaaga

SEQ ID NO: 908660 - RNA, 19 nt, Homo sapiens
aagaauaugucacuugaac

SEQ ID NO: 908661 - RNA, 19 nt, Homo sapiens
cugagaagaacuacauaua

SEQ ID NO: 908662 - RNA, 19 nt, Homo sapiens
cgaggaaaaucaagauaaa

SEQ ID NO: 908663 - RNA, 19 nt, Homo sapiens
caugaugaguguggagaaa

SEQ ID NO: 908664 - RNA, 19 nt, Homo sapiens
cuacaucuaguugcgauua

SEQ ID NO: 908665 - RNA, 19 nt, Homo sapiens
gaaaaucagcucagaagga

SEQ ID NO: 908666 - RNA, 19 nt, Homo sapiens
caagauuugcuauguuaga

SEQ ID NO: 908667 - RNA, 19 nt, Homo sapiens
cguggaagaccaauauaaa

SEQ ID NO: 908668 - RNA, 19 nt, Homo sapiens
aagagcaacuaacuaacuu

SEQ ID NO: 908669 - RNA, 19 nt, Homo sapiens
uauaacagaggugaacaua

SEQ ID NO: 908670 - RNA, 19 nt, Homo sapiens
gaccguggaagaccaauau

SEQ ID NO: 908671 - RNA, 19 nt, Homo sapiens
gaggagaagaggauuaucu

SEQ ID NO: 908672 - RNA, 19 nt, Homo sapiens
uagagaagauauacuccau

SEQ ID NO: 908673 - RNA, 19 nt, Homo sapiens
ucaacuguccagaggguua

SEQ ID NO: 908674 - RNA, 19 nt, Homo sapiens
gauauacuccauagugaag

SEQ ID NO: 908675 - RNA, 19 nt, Homo sapiens
aagacgaagggccaaauua

SEQ ID NO: 908676 - RNA, 19 nt, Homo sapiens
guaccaccauuuauaacag

SEQ ID NO: 908677 - RNA, 19 nt, Homo sapiens
ugaaagccuccuagaagaa

SEQ ID NO: 908678 - RNA, 19 nt, Homo sapiens
gacgaagggccaaauuaau

SEQ ID NO: 908679 - RNA, 19 nt, Homo sapiens
gguaaagaauaugucacuu

SEQ ID NO: 908680 - RNA, 19 nt, Homo sapiens
ggaaaucacgaaaccaacu

SEQ ID NO: 908681 - RNA, 19 nt, Homo sapiens
ccauggacauuaauucaac

SEQ ID NO: 908682 - RNA, 19 nt, Homo sapiens
ggagaaaacaaccuaaaug

SEQ ID NO: 908683 - RNA, 19 nt, Homo sapiens
gcucagaaggacuaguauu

SEQ ID NO: 908684 - RNA, 19 nt, Homo sapiens
caagauaauagcaucaaag

SEQ ID NO: 908685 - RNA, 19 nt, Homo sapiens
uaagacgaagggccaaauu

SEQ ID NO: 908686 - RNA, 19 nt, Homo sapiens
ccauagugaagcaaucuaa

SEQ ID NO: 908687 - RNA, 19 nt, Homo sapiens
aaacgugggagaacuacaa

SEQ ID NO: 908688 - RNA, 19 nt, Homo sapiens
uuucaugucuacugugaug

SEQ ID NO: 908689 - RNA, 19 nt, Homo sapiens
uaaaccaacagcauaguca

SEQ ID NO: 908690 - RNA, 19 nt, Homo sapiens
caaagaagaagaaaaggaa

SEQ ID NO: 908691 - RNA, 19 nt, Homo sapiens
ugaacugaggcaaauuuaa

SEQ ID NO: 908692 - RNA, 19 nt, Homo sapiens
cagaaagcuuugaaugaac

SEQ ID NO: 908693 - RNA, 19 nt, Homo sapiens
ccagagaggagaagaggau

SEQ ID NO: 908694 - RNA, 19 nt, Homo sapiens
gaucacaaaacuucaauga

SEQ ID NO: 908695 - RNA, 19 nt, Homo sapiens
aaugaacugaggcaaauuu

SEQ ID NO: 908696 - RNA, 19 nt, Homo sapiens
ccaaugcaaucccggaaaa

SEQ ID NO: 908697 - RNA, 19 nt, Homo sapiens
cgaauagauggaucacaaa

SEQ ID NO: 908698 - RNA, 19 nt, Homo sapiens
gcaaauguauuaccaauug

SEQ ID NO: 908699 - RNA, 19 nt, Homo sapiens
gaaaugagaccaugaauau

SEQ ID NO: 908700 - RNA, 19 nt, Homo sapiens
aaagaaggcuuacucauuu

SEQ ID NO: 908701 - RNA, 19 nt, Homo sapiens
caacuggccuguaagauuu

SEQ ID NO: 908702 - RNA, 19 nt, Homo sapiens
guauauggcuccugaagua

SEQ ID NO: 908703 - RNA, 19 nt, Homo sapiens
caacaucccaacauuauua

SEQ ID NO: 908704 - RNA, 19 nt, Homo sapiens
uuaaagcacucauggauaa

SEQ ID NO: 908705 - RNA, 19 nt, Homo sapiens
guauacugcugaacaaaua

SEQ ID NO: 908706 - RNA, 19 nt, Homo sapiens
ggacaacaucccaacauua

SEQ ID NO: 908707 - RNA, 19 nt, Homo sapiens
ccaaagagguucuguuuac

SEQ ID NO: 908708 - RNA, 19 nt, Homo sapiens
gaagggaaacuguacuuaa

SEQ ID NO: 908709 - RNA, 19 nt, Homo sapiens
ugaaggaguuguuaaagaa

SEQ ID NO: 908710 - RNA, 19 nt, Homo sapiens
gcacaaagucuucuaagga

SEQ ID NO: 908711 - RNA, 19 nt, Homo sapiens
ugaaggaugucuuugauga

SEQ ID NO: 908712 - RNA, 19 nt, Homo sapiens
cgagguaaauggucuuaaa

SEQ ID NO: 908713 - RNA, 19 nt, Homo sapiens
caaacuggaugaagaugaa

SEQ ID NO: 908714 - RNA, 19 nt, Homo sapiens
aaagagaaaugauguguca

SEQ ID NO: 908715 - RNA, 19 nt, Homo sapiens
gguggaaacugggacaaua

SEQ ID NO: 908716 - RNA, 19 nt, Homo sapiens
guagauauguuuaccuugu

SEQ ID NO: 908717 - RNA, 19 nt, Homo sapiens
ggacuucucuuaacuccau

SEQ ID NO: 908718 - RNA, 19 nt, Homo sapiens
gaacgggaggcuagugaua

SEQ ID NO: 908719 - RNA, 19 nt, Homo sapiens
gaaggaggauauugguguu

SEQ ID NO: 908720 - RNA, 19 nt, Homo sapiens
uaucacaagugcaaaugua

SEQ ID NO: 908721 - RNA, 19 nt, Homo sapiens
caacuucucugcacacaag

SEQ ID NO: 908722 - RNA, 19 nt, Homo sapiens
gagaccaguugccaaauga

SEQ ID NO: 908723 - RNA, 19 nt, Homo sapiens
gauaugaugcugcuuguga

SEQ ID NO: 908724 - RNA, 19 nt, Homo sapiens
gaaaauggacuucucuuaa

SEQ ID NO: 908725 - RNA, 19 nt, Homo sapiens
gcaaauagauugggaucag

SEQ ID NO: 908726 - RNA, 19 nt, Homo sapiens
ggaaugccucaauuucuua

SEQ ID NO: 908727 - RNA, 19 nt, Homo sapiens
uaaggaaggcuaugagaaa

SEQ ID NO: 908728 - RNA, 19 nt, Homo sapiens
guaagacaguugacuaucu

SEQ ID NO: 908729 - RNA, 19 nt, Homo sapiens
gagaguuacuugaccguau

SEQ ID NO: 908730 - RNA, 19 nt, Homo sapiens
gcaaauauugacugggaua

SEQ ID NO: 908731 - RNA, 19 nt, Homo sapiens
gcaguaguguucaaguguu

SEQ ID NO: 908732 - RNA, 19 nt, Homo sapiens
gacaacaucccaacauuau

SEQ ID NO: 908733 - RNA, 19 nt, Homo sapiens
uaaagauucucccgguuug

SEQ ID NO: 908734 - RNA, 19 nt, Homo sapiens
gggcagcucuaugcaauga

SEQ ID NO: 908735 - RNA, 19 nt, Homo sapiens
gaacaucaacuggccugua

SEQ ID NO: 908736 - RNA, 19 nt, Homo sapiens
gaaaggaggagaguuacuu

SEQ ID NO: 908737 - RNA, 19 nt, Homo sapiens
caucagcucuucaaaggau

SEQ ID NO: 908738 - RNA, 19 nt, Homo sapiens
agaaggaguugaagaaauc

SEQ ID NO: 908739 - RNA, 19 nt, Homo sapiens
gaugaaauaggacauauca

SEQ ID NO: 908740 - RNA, 19 nt, Homo sapiens
caaauugcacuaugccuuu

SEQ ID NO: 908741 - RNA, 19 nt, Homo sapiens
ggauucagcuuuguugcaa

SEQ ID NO: 908742 - RNA, 19 nt, Homo sapiens
cagaaggaguugaagaaau

SEQ ID NO: 908743 - RNA, 19 nt, Homo sapiens
gaugaugguagauauguuu

SEQ ID NO: 908744 - RNA, 19 nt, Homo sapiens
aggaagaugugaaauucua

SEQ ID NO: 908745 - RNA, 19 nt, Homo sapiens
gaagcagauucuugucaug

SEQ ID NO: 908746 - RNA, 19 nt, Homo sapiens
ggaaacugggacaauauuu

SEQ ID NO: 908747 - RNA, 19 nt, Homo sapiens
ugugauaucuggaguuuag

SEQ ID NO: 908748 - RNA, 19 nt, Homo sapiens
aaugaaaggaggagaguua

SEQ ID NO: 908749 - RNA, 19 nt, Homo sapiens
ggacauaucaaauuaacag

SEQ ID NO: 908750 - RNA, 19 nt, Homo sapiens
ucacaagauuauccaaaga

SEQ ID NO: 908751 - RNA, 19 nt, Homo sapiens
cacaagugcaaauguauua

SEQ ID NO: 908752 - RNA, 19 nt, Homo sapiens
gaaguucaaccuccuuuca

SEQ ID NO: 908753 - RNA, 19 nt, Homo sapiens
gcagauucuugucaugaug

SEQ ID NO: 908754 - RNA, 19 nt, Homo sapiens
gggaaacuguacuuaauac

SEQ ID NO: 908755 - RNA, 19 nt, Homo sapiens
uaaguaagacaguugacua

SEQ ID NO: 908756 - RNA, 19 nt, Homo sapiens
agaggaagaugugaaauuc

SEQ ID NO: 908757 - RNA, 19 nt, Homo sapiens
gaaacuguacuuaauacug

SEQ ID NO: 908758 - RNA, 19 nt, Homo sapiens
aacaucaacuggccuguaa

SEQ ID NO: 908759 - RNA, 19 nt, Homo sapiens
ugauacuccugaagagaua

SEQ ID NO: 908760 - RNA, 19 nt, Homo sapiens
ccaaugauacuccugaaga

SEQ ID NO: 908761 - RNA, 19 nt, Homo sapiens
acaguugacuaucuucauu

SEQ ID NO: 908762 - RNA, 19 nt, Homo sapiens
gauccugaauuuacugcaa

SEQ ID NO: 908763 - RNA, 19 nt, Homo sapiens
cacaaagucuucuaaggau

SEQ ID NO: 908764 - RNA, 19 nt, Homo sapiens
gguaaagacagaaaugaga

SEQ ID NO: 908765 - RNA, 19 nt, Homo sapiens
gcaaggagucaguagauca

SEQ ID NO: 908766 - RNA, 19 nt, Homo sapiens
uggaucaucugcaccaauu

SEQ ID NO: 908767 - RNA, 19 nt, Homo sapiens
gaaggaguuguuaaagaaa

SEQ ID NO: 908768 - RNA, 19 nt, Homo sapiens
caaaugaucagccaaagag

SEQ ID NO: 908769 - RNA, 19 nt, Homo sapiens
aagggaaacuguacuuaau

SEQ ID NO: 908770 - RNA, 19 nt, Homo sapiens
ucaacuggccuguaagauu

SEQ ID NO: 908771 - RNA, 19 nt, Homo sapiens
gcuaauggccccaaugaua

SEQ ID NO: 908772 - RNA, 19 nt, Homo sapiens
gugcaaauguauuaccaau

SEQ ID NO: 908773 - RNA, 19 nt, Homo sapiens
aaugagaccaugaauauga

SEQ ID NO: 908774 - RNA, 19 nt, Homo sapiens
agaaaugagaccaugaaua

SEQ ID NO: 908775 - RNA, 19 nt, Homo sapiens
gcugauugguggucauaug

SEQ ID NO: 908776 - RNA, 19 nt, Homo sapiens
ggaaggcuaugagaaagca

SEQ ID NO: 908777 - RNA, 19 nt, Homo sapiens
ucacagguccacaauauuc

SEQ ID NO: 908778 - RNA, 19 nt, Homo sapiens
aaagaaaucccuauuacuc

SEQ ID NO: 908779 - RNA, 19 nt, Homo sapiens
guaauaaguaagacaguug

SEQ ID NO: 908780 - RNA, 19 nt, Homo sapiens
caacuaccaacauggaauu

SEQ ID NO: 908781 - RNA, 19 nt, Homo sapiens
caaauagauugggaucaga

SEQ ID NO: 908782 - RNA, 19 nt, Homo sapiens
uggaaugccucaauuucuu

SEQ ID NO: 908783 - RNA, 19 nt, Homo sapiens
guaaauaggagaggccauu

SEQ ID NO: 908784 - RNA, 19 nt, Homo sapiens
cacacaagcuucuaaaauu

SEQ ID NO: 908785 - RNA, 19 nt, Homo sapiens
cagugaagaucauugacaa

SEQ ID NO: 908786 - RNA, 19 nt, Homo sapiens
uaaaaucacuccuaucaca

SEQ ID NO: 908787 - RNA, 19 nt, Homo sapiens
caaagagguucuguuuaca

SEQ ID NO: 908788 - RNA, 19 nt, Homo sapiens
auucacagguccacaauau

SEQ ID NO: 908789 - RNA, 19 nt, Homo sapiens
aucguugucugcuaaauua

SEQ ID NO: 908790 - RNA, 19 nt, Homo sapiens
ggauuugcuuucccauaug

SEQ ID NO: 908791 - RNA, 19 nt, Homo sapiens
gaccguauucucaaacaaa

SEQ ID NO: 908792 - RNA, 19 nt, Homo sapiens
gaucagaaggaguugaaga

SEQ ID NO: 908793 - RNA, 19 nt, Homo sapiens
ggucauaugguguucuuau

SEQ ID NO: 908794 - RNA, 19 nt, Homo sapiens
cagaggaagaugugaaauu

SEQ ID NO: 908795 - RNA, 19 nt, Homo sapiens
gaagaccgguccugaugcu

SEQ ID NO: 908796 - RNA, 19 nt, Homo sapiens
gaagaucauugacaaaagu

SEQ ID NO: 908797 - RNA, 19 nt, Homo sapiens
ggugaaguauaugaauuga

SEQ ID NO: 908798 - RNA, 19 nt, Homo sapiens
gaaagacacuuaacagcua

SEQ ID NO: 908799 - RNA, 19 nt, Homo sapiens
guaaacaggugucugauaa

SEQ ID NO: 908800 - RNA, 19 nt, Homo sapiens
ggaaagaauucacuagaaa

SEQ ID NO: 908801 - RNA, 19 nt, Homo sapiens
gaaagaagcucuaggugau

SEQ ID NO: 908802 - RNA, 19 nt, Homo sapiens
cagaauggaucuucaaaua

SEQ ID NO: 908803 - RNA, 19 nt, Homo sapiens
gaaugaggcugaagaaaga

SEQ ID NO: 908804 - RNA, 19 nt, Homo sapiens
uaacaaaccugugacuaua

SEQ ID NO: 908805 - RNA, 19 nt, Homo sapiens
ggaauuagacuuucuugua

SEQ ID NO: 908806 - RNA, 19 nt, Homo sapiens
ggaaaucaacucucaauaa

SEQ ID NO: 908807 - RNA, 19 nt, Homo sapiens
gaaagugaaugauguccua

SEQ ID NO: 908808 - RNA, 19 nt, Homo sapiens
gaaaucaacucucaauaag

SEQ ID NO: 908809 - RNA, 19 nt, Homo sapiens
gaaaggaaccucaaaggaa

SEQ ID NO: 908810 - RNA, 19 nt, Homo sapiens
caacaccucuuacgauaaa

SEQ ID NO: 908811 - RNA, 19 nt, Homo sapiens
gaaaugagggcaauagaaa

SEQ ID NO: 908812 - RNA, 19 nt, Homo sapiens
ucagugagaucaucagaua

SEQ ID NO: 908813 - RNA, 19 nt, Homo sapiens
cuaaugagcuugaagaaga

SEQ ID NO: 908814 - RNA, 19 nt, Homo sapiens
ggaaagaagucucuagaag

SEQ ID NO: 908815 - RNA, 19 nt, Homo sapiens
gagaggaggucaaagaaga

SEQ ID NO: 908816 - RNA, 19 nt, Homo sapiens
ccaagaauauuuccacauu

SEQ ID NO: 908817 - RNA, 19 nt, Homo sapiens
caucaggcauggagaaaua

SEQ ID NO: 908818 - RNA, 19 nt, Homo sapiens
ggaggaagauggagauaau

SEQ ID NO: 908819 - RNA, 19 nt, Homo sapiens
ggaagagccuugugaggaa

SEQ ID NO: 908820 - RNA, 19 nt, Homo sapiens
aaacaaaucuacagggaaa

SEQ ID NO: 908821 - RNA, 19 nt, Homo sapiens
gaacagucauugcauuaug

SEQ ID NO: 908822 - RNA, 19 nt, Homo sapiens
acaaaucacugcaagagua

SEQ ID NO: 908823 - RNA, 19 nt, Homo sapiens
guacagagccgcuauacaa

SEQ ID NO: 908824 - RNA, 19 nt, Homo sapiens
gcagaaagcagcaguaaau

SEQ ID NO: 908825 - RNA, 19 nt, Homo sapiens
gcccagagaucaaauaaau

SEQ ID NO: 908826 - RNA, 19 nt, Homo sapiens
gaacaaagaggugaagaaa

SEQ ID NO: 908827 - RNA, 19 nt, Homo sapiens
caaggcaauucuucaguua

SEQ ID NO: 908828 - RNA, 19 nt, Homo sapiens
gagcagaaauaaagaaaca

SEQ ID NO: 908829 - RNA, 19 nt, Homo sapiens
acacagaacugauccaaga

SEQ ID NO: 908830 - RNA, 19 nt, Homo sapiens
gaaagcagcaguaaauuca

SEQ ID NO: 908831 - RNA, 19 nt, Homo sapiens
ggacuucaguguguacuuu

SEQ ID NO: 908832 - RNA, 19 nt, Homo sapiens
gaagacguauuucgccaaa

SEQ ID NO: 908833 - RNA, 19 nt, Homo sapiens
caacaccaccuuauacuuu

SEQ ID NO: 908834 - RNA, 19 nt, Homo sapiens
uaacguacauguuggauca

SEQ ID NO: 908835 - RNA, 19 nt, Homo sapiens
gaacaacuaacuccugaaa

SEQ ID NO: 908836 - RNA, 19 nt, Homo sapiens
gggaaaguaugauggguuu

SEQ ID NO: 908837 - RNA, 19 nt, Homo sapiens
gaauuagacuuucuuguac

SEQ ID NO: 908838 - RNA, 19 nt, Homo sapiens
gagccauuauuuccauuua

SEQ ID NO: 908839 - RNA, 19 nt, Homo sapiens
gaauggaucuucaaauagg

SEQ ID NO: 908840 - RNA, 19 nt, Homo sapiens
gaaaucagcaaguucugua

SEQ ID NO: 908841 - RNA, 19 nt, Homo sapiens
ucaaguaucuuagcaaguu

SEQ ID NO: 908842 - RNA, 19 nt, Homo sapiens
caucaaggcuguuauaguc

SEQ ID NO: 908843 - RNA, 19 nt, Homo sapiens
caacuuguauugugacguu

SEQ ID NO: 908844 - RNA, 19 nt, Homo sapiens
caccauguauucauaagua

SEQ ID NO: 908845 - RNA, 19 nt, Homo sapiens
caaggcaucuguagccaaa

SEQ ID NO: 908846 - RNA, 19 nt, Homo sapiens
ccaguugauuuguguauuu

SEQ ID NO: 908847 - RNA, 19 nt, Homo sapiens
ggauucuucuguccaauuu

SEQ ID NO: 908848 - RNA, 19 nt, Homo sapiens
ccaaguggguccaguaaau

SEQ ID NO: 908849 - RNA, 19 nt, Homo sapiens
uaaagaggagccauuauuu

SEQ ID NO: 908850 - RNA, 19 nt, Homo sapiens
ucaaaggaauucuagaaga

SEQ ID NO: 908851 - RNA, 19 nt, Homo sapiens
caagaagacugaagacucu

SEQ ID NO: 908852 - RNA, 19 nt, Homo sapiens
gaagauggagauaaugauu

SEQ ID NO: 908853 - RNA, 19 nt, Homo sapiens
ugaaguaacugaagaggau

SEQ ID NO: 908854 - RNA, 19 nt, Homo sapiens
cagcagugauuugcauuua

SEQ ID NO: 908855 - RNA, 19 nt, Homo sapiens
uaaaggaaaugaaggagau

SEQ ID NO: 908856 - RNA, 19 nt, Homo sapiens
gaagaagaacuaaauaugg

SEQ ID NO: 908857 - RNA, 19 nt, Homo sapiens
ggaauuuggucugcuuaaa

SEQ ID NO: 908858 - RNA, 19 nt, Homo sapiens
gaggagaaggaauuuaaua

SEQ ID NO: 908859 - RNA, 19 nt, Homo sapiens
uaccagaggugcaaauuga

SEQ ID NO: 908860 - RNA, 19 nt, Homo sapiens
ggaucaccauguauucaua

SEQ ID NO: 908861 - RNA, 19 nt, Homo sapiens
gaugaggaagcuauauuua

SEQ ID NO: 908862 - RNA, 19 nt, Homo sapiens
gcaaauauggcuacacaga

SEQ ID NO: 908863 - RNA, 19 nt, Homo sapiens
gagagugccucaaguaucu

SEQ ID NO: 908864 - RNA, 19 nt, Homo sapiens
ucagguaacucaacacaga

SEQ ID NO: 908865 - RNA, 19 nt, Homo sapiens
gaaaggaaagaauucacua

SEQ ID NO: 908866 - RNA, 19 nt, Homo sapiens
agaacaagaucuccucaaa

SEQ ID NO: 908867 - RNA, 19 nt, Homo sapiens
ggauggaaaucaacucuca

SEQ ID NO: 908868 - RNA, 19 nt, Homo sapiens
gaacaaaaccaucaguuaa

SEQ ID NO: 908869 - RNA, 19 nt, Homo sapiens
gaaugagucagcagacaua

SEQ ID NO: 908870 - RNA, 19 nt, Homo sapiens
ugaccaagaugauugcauu

SEQ ID NO: 908871 - RNA, 19 nt, Homo sapiens
agaagaaucuccaucugaa

SEQ ID NO: 908872 - RNA, 19 nt, Homo sapiens
ugaaugauguccuaauugu

SEQ ID NO: 908873 - RNA, 19 nt, Homo sapiens
gaagcaguuucaaguaaug

SEQ ID NO: 908874 - RNA, 19 nt, Homo sapiens
gaagaaagaagcucuaggu

SEQ ID NO: 908875 - RNA, 19 nt, Homo sapiens
gaagagcuaccuuugaaug

SEQ ID NO: 908876 - RNA, 19 nt, Homo sapiens
guuauagucucuucuccua

SEQ ID NO: 908877 - RNA, 19 nt, Homo sapiens
ggaaacagaagaaaugugu

SEQ ID NO: 908878 - RNA, 19 nt, Homo sapiens
gaaguacauugaaacaaca

SEQ ID NO: 908879 - RNA, 19 nt, Homo sapiens
gauccaagauugaccaaag

SEQ ID NO: 908880 - RNA, 19 nt, Homo sapiens
uggaagagcuaccuuugaa

SEQ ID NO: 908881 - RNA, 19 nt, Homo sapiens
ccacgaagacguucucauu

SEQ ID NO: 908882 - RNA, 19 nt, Homo sapiens
ugaugucccugaggaauua

SEQ ID NO: 908883 - RNA, 19 nt, Homo sapiens
gaaaguacucccagcauuc

SEQ ID NO: 908884 - RNA, 19 nt, Homo sapiens
caaggaaacagaagaaaug

SEQ ID NO: 908885 - RNA, 19 nt, Homo sapiens
cuacaaagagugauucaaa

SEQ ID NO: 908886 - RNA, 19 nt, Homo sapiens
gagaggaugucaaggagau

SEQ ID NO: 908887 - RNA, 19 nt, Homo sapiens
aaaugaaacuccacgaaga

SEQ ID NO: 908888 - RNA, 19 nt, Homo sapiens
gaaaguaugauggguuuga

SEQ ID NO: 908889 - RNA, 19 nt, Homo sapiens
gaagauuucauuucuggaa

SEQ ID NO: 908890 - RNA, 19 nt, Homo sapiens
aaaggaaccucaaaggaau

SEQ ID NO: 908891 - RNA, 19 nt, Homo sapiens
aaagaacagucauugcauu

SEQ ID NO: 908892 - RNA, 19 nt, Homo sapiens
ggaaagaacagucauugca

SEQ ID NO: 908893 - RNA, 19 nt, Homo sapiens
gacauucuauucguuguaa

SEQ ID NO: 908894 - RNA, 19 nt, Homo sapiens
ccaagaauuugccaucguu

SEQ ID NO: 908895 - RNA, 19 nt, Homo sapiens
cugaugaggucgagaauga

SEQ ID NO: 908896 - RNA, 19 nt, Homo sapiens
gcagugauuugcauuuagu

SEQ ID NO: 908897 - RNA, 19 nt, Homo sapiens
gggaugacagcaacaauaa

SEQ ID NO: 908898 - RNA, 19 nt, Homo sapiens
gaacacagaucaagauuag

SEQ ID NO: 908899 - RNA, 19 nt, Homo sapiens
aaucauagcuguucuguuu

SEQ ID NO: 908900 - RNA, 19 nt, Homo sapiens
ggaaggagccuaugaaaga

SEQ ID NO: 908901 - RNA, 19 nt, Homo sapiens
gaagagaccuauggugaaa

SEQ ID NO: 908902 - RNA, 19 nt, Homo sapiens
gagaauggccuguuuacua

SEQ ID NO: 908903 - RNA, 19 nt, Homo sapiens
gaacagagaguacugcaaa

SEQ ID NO: 908904 - RNA, 19 nt, Homo sapiens
gagcacccauucucaauuu

SEQ ID NO: 908905 - RNA, 19 nt, Homo sapiens
aaagggaacuggagcauaa

SEQ ID NO: 908906 - RNA, 19 nt, Homo sapiens
gcaccaagaugaagcagaa

SEQ ID NO: 908907 - RNA, 19 nt, Homo sapiens
gaaagcacaccaagacaua

SEQ ID NO: 908908 - RNA, 19 nt, Homo sapiens
guauagcucugauagaauu

SEQ ID NO: 908909 - RNA, 19 nt, Homo sapiens
uaaagagaauggccuguuu

SEQ ID NO: 908910 - RNA, 19 nt, Homo sapiens
cuacugaacucuaggauau

SEQ ID NO: 908911 - RNA, 19 nt, Homo sapiens
gaagagaauagacaacuaa

SEQ ID NO: 908912 - RNA, 19 nt, Homo sapiens
agaauggccuguuuacuaa

SEQ ID NO: 908913 - RNA, 19 nt, Homo sapiens
uuggaaagcucauugauuu

SEQ ID NO: 908914 - RNA, 19 nt, Homo sapiens
uaacguaggucuagagcuu

SEQ ID NO: 908915 - RNA, 19 nt, Homo sapiens
ggaggugucucgaaauaau

SEQ ID NO: 908916 - RNA, 19 nt, Homo sapiens
gcagaaccaugaagcaguu

SEQ ID NO: 908917 - RNA, 19 nt, Homo sapiens
ggagugagaucuauguaca

SEQ ID NO: 908918 - RNA, 19 nt, Homo sapiens
ucgaagagcugaaauguag

SEQ ID NO: 908919 - RNA, 19 nt, Homo sapiens
caggaggugucucgaaaua

SEQ ID NO: 908920 - RNA, 19 nt, Homo sapiens
gcaacagcauaagaauuua

SEQ ID NO: 908921 - RNA, 19 nt, Homo sapiens
acauaaaucugccuacuga

SEQ ID NO: 908922 - RNA, 19 nt, Homo sapiens
ucaagcugcucaaacauaa

SEQ ID NO: 908923 - RNA, 19 nt, Homo sapiens
gcugagaaaucacaucgaa

SEQ ID NO: 908924 - RNA, 19 nt, Homo sapiens
ggaggacaauguugaugaa

SEQ ID NO: 908925 - RNA, 19 nt, Homo sapiens
agacucaaguugcagaaua

SEQ ID NO: 908926 - RNA, 19 nt, Homo sapiens
gagaauagacaacuaagga

SEQ ID NO: 908927 - RNA, 19 nt, Homo sapiens
gcagaugacccuaauaauc

SEQ ID NO: 908928 - RNA, 19 nt, Homo sapiens
gcaagagaauacagaagug

SEQ ID NO: 908929 - RNA, 19 nt, Homo sapiens
ccaagccaaugaucaaauu

SEQ ID NO: 908930 - RNA, 19 nt, Homo sapiens
uaaagaaacagcacaguga

SEQ ID NO: 908931 - RNA, 19 nt, Homo sapiens
auacacagcuucaagaugu

SEQ ID NO: 908932 - RNA, 19 nt, Homo sapiens
ucauagcuguucuguuuaa

SEQ ID NO: 908933 - RNA, 19 nt, Homo sapiens
gaauagacaacuaaggaaa

SEQ ID NO: 908934 - RNA, 19 nt, Homo sapiens
gcaguauccuggucuuaau

SEQ ID NO: 908935 - RNA, 19 nt, Homo sapiens
ugaaagauacucugaauag

SEQ ID NO: 908936 - RNA, 19 nt, Homo sapiens
ggaggaacauuuggugaug

SEQ ID NO: 908937 - RNA, 19 nt, Homo sapiens
cagaugacccuaauaauca

SEQ ID NO: 908938 - RNA, 19 nt, Homo sapiens
cagcagaugacccuaauaa

SEQ ID NO: 908939 - RNA, 19 nt, Homo sapiens
gaagaagccgagcaaguga

SEQ ID NO: 908940 - RNA, 19 nt, Homo sapiens
uuagagaaauccuugcaaa

SEQ ID NO: 908941 - RNA, 19 nt, Homo sapiens
gcaagaaguucgagaugac

SEQ ID NO: 908942 - RNA, 19 nt, Homo sapiens
gagacuguauacaauuuga

SEQ ID NO: 908943 - RNA, 19 nt, Homo sapiens
ggacacaucaacauauuca

SEQ ID NO: 908944 - RNA, 19 nt, Homo sapiens
cuucugaugucuuuaugua

SEQ ID NO: 908945 - RNA, 19 nt, Homo sapiens
ggaagaagaggaggaagaa

SEQ ID NO: 908946 - RNA, 19 nt, Homo sapiens
gaagaaaauuugccagaug

SEQ ID NO: 908947 - RNA, 19 nt, Homo sapiens
uaaguuagaagcacaagaa

SEQ ID NO: 908948 - RNA, 19 nt, Homo sapiens
gaaggagauccagguaaua

SEQ ID NO: 908949 - RNA, 19 nt, Homo sapiens
agacuucaguagaacauuu

SEQ ID NO: 908950 - RNA, 19 nt, Homo sapiens
ugagaucuauguacaaagu

SEQ ID NO: 908951 - RNA, 19 nt, Homo sapiens
gggcagcuguagaagauau

SEQ ID NO: 908952 - RNA, 19 nt, Homo sapiens
agaaggagauccagguaau

SEQ ID NO: 908953 - RNA, 19 nt, Homo sapiens
ggacuagugacuugguuaa

SEQ ID NO: 908954 - RNA, 19 nt, Homo sapiens
aagaggagguucaggaaga

SEQ ID NO: 908955 - RNA, 19 nt, Homo sapiens
gaaagauacucugaauagg

SEQ ID NO: 908956 - RNA, 19 nt, Homo sapiens
ggaagaggaacaucgcaaa

SEQ ID NO: 908957 - RNA, 19 nt, Homo sapiens
uagauuaugugauguugga

SEQ ID NO: 908958 - RNA, 19 nt, Homo sapiens
agauuugacugaagagaaa

SEQ ID NO: 908959 - RNA, 19 nt, Homo sapiens
gauauaaacccagcagaug

SEQ ID NO: 908960 - RNA, 19 nt, Homo sapiens
gcacaccaagacauacaua

SEQ ID NO: 908961 - RNA, 19 nt, Homo sapiens
agaagagaauagacaacua

SEQ ID NO: 908962 - RNA, 19 nt, Homo sapiens
gcagaaggagauccaggua

SEQ ID NO: 908963 - RNA, 19 nt, Homo sapiens
gaagagcagaagacacaaa

SEQ ID NO: 908964 - RNA, 19 nt, Homo sapiens
caacugaaagauacucuga

SEQ ID NO: 908965 - RNA, 19 nt, Homo sapiens
gaggaaggagccuaugaaa

SEQ ID NO: 908966 - RNA, 19 nt, Homo sapiens
ggaggaacacgauccauca

SEQ ID NO: 908967 - RNA, 19 nt, Homo sapiens
ccauaaggaggcagaauuu

SEQ ID NO: 908968 - RNA, 19 nt, Homo sapiens
agacauacauacacagcuu

SEQ ID NO: 908969 - RNA, 19 nt, Homo sapiens
gcacccaauuucuagacaa

SEQ ID NO: 908970 - RNA, 19 nt, Homo sapiens
ugagaaaucacaucgaaga

SEQ ID NO: 908971 - RNA, 19 nt, Homo sapiens
ccaaucacccuaugaggaa

SEQ ID NO: 908972 - RNA, 19 nt, Homo sapiens
gcgcgaugcucuacuacga

SEQ ID NO: 908973 - RNA, 19 nt, Homo sapiens
gaaggcaagauuccaauag

SEQ ID NO: 908974 - RNA, 19 nt, Homo sapiens
aaagagaauggccuguuua

SEQ ID NO: 908975 - RNA, 19 nt, Homo sapiens
gggcugcaguugcugagaa

SEQ ID NO: 908976 - RNA, 19 nt, Homo sapiens
gaaggagccuaugaaagag

SEQ ID NO: 908977 - RNA, 19 nt, Homo sapiens
gggaacaccaggaagcuuu

SEQ ID NO: 908978 - RNA, 19 nt, Homo sapiens
gacucaaguugcagaauau

SEQ ID NO: 908979 - RNA, 19 nt, Homo sapiens
agaggaacaucgcaaacaa

SEQ ID NO: 908980 - RNA, 19 nt, Homo sapiens
agaagcacaagaaacauua

SEQ ID NO: 908981 - RNA, 19 nt, Homo sapiens
guuagaagcacaagaaaca

SEQ ID NO: 908982 - RNA, 19 nt, Homo sapiens
uggaaggacuagugacuug

SEQ ID NO: 908983 - RNA, 19 nt, Homo sapiens
ucccuuagguggcaacaaa

SEQ ID NO: 908984 - RNA, 19 nt, Homo sapiens
gucuagagcuucuuuuaua

SEQ ID NO: 908985 - RNA, 19 nt, Homo sapiens
uagggcagcuguagaagau

SEQ ID NO: 908986 - RNA, 19 nt, Homo sapiens
gaaacagcacagugacuug

SEQ ID NO: 908987 - RNA, 19 nt, Homo sapiens
aaagugacauacaauugga

SEQ ID NO: 908988 - RNA, 19 nt, Homo sapiens
guacaaagugacauacaau

SEQ ID NO: 908989 - RNA, 19 nt, Homo sapiens
caugcagacuuuaaagaga

SEQ ID NO: 908990 - RNA, 19 nt, Homo sapiens
gcagccggcucugaaguau

SEQ ID NO: 908991 - RNA, 19 nt, Homo sapiens
gaaagagcagcaugagcaa

SEQ ID NO: 908992 - RNA, 19 nt, Homo sapiens
acgaggagcuaaagaaaca

SEQ ID NO: 908993 - RNA, 19 nt, Homo sapiens
gaagcacaagaaacauuaa

SEQ ID NO: 908994 - RNA, 19 nt, Homo sapiens
cuauguaucucuggaguga

SEQ ID NO: 908995 - RNA, 19 nt, Homo sapiens
ucccagguguucuuuguuu

SEQ ID NO: 908996 - RNA, 19 nt, Homo sapiens
auacagaaguggaggaaca

SEQ ID NO: 908997 - RNA, 19 nt, Homo sapiens
gagaggaaggagccuauga

SEQ ID NO: 908998 - RNA, 19 nt, Homo sapiens
ugaaguaucucaacaugua

SEQ ID NO: 908999 - RNA, 19 nt, Homo sapiens
gcaagucucugcugccuuu

SEQ ID NO: 909000 - RNA, 19 nt, Homo sapiens
caaauacacugaaacauuc

SEQ ID NO: 909001 - RNA, 19 nt, Homo sapiens
ugaccuugcucauguauua

SEQ ID NO: 909002 - RNA, 19 nt, Homo sapiens
gcacagacuuaaacaacaa

SEQ ID NO: 909003 - RNA, 19 nt, Homo sapiens
guaaaggaaaccaucauua

SEQ ID NO: 909004 - RNA, 19 nt, Homo sapiens
ggagagugguucaucaaug

SEQ ID NO: 909005 - RNA, 19 nt, Homo sapiens
gcucauguauuaucuuuac

SEQ ID NO: 909006 - RNA, 19 nt, Homo sapiens
gaaaccaucauuagcaguu

SEQ ID NO: 909007 - RNA, 19 nt, Homo sapiens
cuuuauggcuucagaguuu

SEQ ID NO: 909008 - RNA, 19 nt, Homo sapiens
caaggagagugguucauca

SEQ ID NO: 909009 - RNA, 19 nt, Homo sapiens
caacaacaaguccugcuuu

SEQ ID NO: 909010 - RNA, 19 nt, Homo sapiens
uaaaggaaaccaucauuag

SEQ ID NO: 909011 - RNA, 19 nt, Homo sapiens
caagauggguagcaacagu

SEQ ID NO: 909012 - RNA, 19 nt, Homo sapiens
uugcugagcuugcaggauu

SEQ ID NO: 909013 - RNA, 19 nt, Homo sapiens
gauuacaguugcugagcuu

SEQ ID NO: 909014 - RNA, 19 nt, Homo sapiens
uggcugaccuugcucaugu

SEQ ID NO: 909015 - RNA, 19 nt, Homo sapiens
ugacaaauacacugaaaca

SEQ ID NO: 909016 - RNA, 19 nt, Homo sapiens
gguaaaggaaaccaucauu

SEQ ID NO: 909017 - RNA, 19 nt, Homo sapiens
gagaagcacagacuuaaac

SEQ ID NO: 909018 - RNA, 19 nt, Homo sapiens
gaaucgcacuguauuucca

SEQ ID NO: 909019 - RNA, 19 nt, Homo sapiens
caugugugcugcagucuuc

SEQ ID NO: 909020 - RNA, 19 nt, Homo sapiens
ccugagaagcacagacuua

SEQ ID NO: 909021 - RNA, 19 nt, Homo sapiens
gagcuugcaggauuuguga

SEQ ID NO: 909022 - RNA, 19 nt, Homo sapiens
ccugaaguaucucaacaug

SEQ ID NO: 909023 - RNA, 19 nt, Homo sapiens
uucacucccuaucauauua

SEQ ID NO: 909024 - RNA, 19 nt, Homo sapiens
gcguuggucgggaugauua

SEQ ID NO: 909025 - RNA, 19 nt, Homo sapiens
gugcaucagucuucaaagg

SEQ ID NO: 909026 - RNA, 19 nt, Homo sapiens
gcaaggagagugguucauc

SEQ ID NO: 909027 - RNA, 19 nt, Homo sapiens
gauacaagcaaaugaaugc

SEQ ID NO: 909028 - RNA, 19 nt, Homo sapiens
gaagcacagacuuaaacaa

SEQ ID NO: 909029 - RNA, 19 nt, Homo sapiens
acuguaaugucacuaaugu

SEQ ID NO: 909030 - RNA, 19 nt, Homo sapiens
ggauacaagcaaaugaaug

SEQ ID NO: 909031 - RNA, 19 nt, Homo sapiens
caacaaguccugcuuugcu

SEQ ID NO: 909032 - RNA, 19 nt, Homo sapiens
gcacugcugagauuuacug

SEQ ID NO: 909033 - RNA, 19 nt, Homo sapiens
cggauuuacuauuacauca

SEQ ID NO: 909034 - RNA, 19 nt, Homo sapiens
gcugcagucuucuucaucu

SEQ ID NO: 909035 - RNA, 19 nt, Homo sapiens
aacaacaaguccugcuuug

SEQ ID NO: 909036 - RNA, 19 nt, Homo sapiens
aaccaccuauauccucaua

SEQ ID NO: 909037 - RNA, 19 nt, Homo sapiens
cuugacaaauacacugaaa

SEQ ID NO: 909038 - RNA, 19 nt, Homo sapiens
aaacuacuauauccuugag

SEQ ID NO: 909039 - RNA, 19 nt, Homo sapiens
uugcugaucuuggauacaa

SEQ ID NO: 909040 - RNA, 19 nt, Homo sapiens
gaaguaucucaacauguau

SEQ ID NO: 909041 - RNA, 19 nt, Homo sapiens
ggauccaauucuuuauuac

SEQ ID NO: 909042 - RNA, 19 nt, Homo sapiens
ggaaaacuacuauauccuu

SEQ ID NO: 909043 - RNA, 19 nt, Homo sapiens
ugaaugcaguugcguuggu

SEQ ID NO: 909044 - RNA, 19 nt, Homo sapiens
ugagaagcacagacuuaaa

SEQ ID NO: 909045 - RNA, 19 nt, Homo sapiens
ggacugccuguuugccauu

SEQ ID NO: 909046 - RNA, 19 nt, Homo sapiens
cccuccggauuuacuauua

SEQ ID NO: 909047 - RNA, 19 nt, Homo sapiens
gagcaaggagagugguuca

SEQ ID NO: 909048 - RNA, 19 nt, Homo sapiens
cgccauggcaguucuguga

SEQ ID NO: 909049 - RNA, 19 nt, Homo sapiens
ucaauacucccucuaugca

SEQ ID NO: 909050 - RNA, 19 nt, Homo sapiens
cacuguauuuccacccuuu

SEQ ID NO: 909051 - RNA, 19 nt, Homo sapiens
uuccuggucuucuggcuaa

SEQ ID NO: 909052 - RNA, 19 nt, Homo sapiens
cauauucauuccuggucuu

SEQ ID NO: 909053 - RNA, 19 nt, Homo sapiens
cugcuuugcugaucuugga

SEQ ID NO: 909054 - RNA, 19 nt, Homo sapiens
aaaccaucauuagcaguug

SEQ ID NO: 909055 - RNA, 19 nt, Homo sapiens
agaaagcacugcggauggu

SEQ ID NO: 909056 - RNA, 19 nt, Homo sapiens
ucuaugcaaccaccuauau

SEQ ID NO: 909057 - RNA, 19 nt, Homo sapiens
guucugugccgcuucauca

SEQ ID NO: 909058 - RNA, 19 nt, Homo sapiens
ugacgugcaucagucuuca

SEQ ID NO: 909059 - RNA, 19 nt, Homo sapiens
uaccugaaguaucucaaca

SEQ ID NO: 909060 - RNA, 19 nt, Homo sapiens
gauuugugaucccagugau

SEQ ID NO: 909061 - RNA, 19 nt, Homo sapiens
uuucaauacucccucuaug

SEQ ID NO: 909062 - RNA, 19 nt, Homo sapiens
gagacuggaagcguaggua

SEQ ID NO: 909063 - RNA, 19 nt, Homo sapiens
guccgaaucgcacuguauu

SEQ ID NO: 909064 - RNA, 19 nt, Homo sapiens
cugagaagcacagacuuaa

SEQ ID NO: 909065 - RNA, 19 nt, Homo sapiens
aaggaaaccaucauuagca

SEQ ID NO: 909066 - RNA, 19 nt, Homo sapiens
ucacucccuaucauauuaa

SEQ ID NO: 909067 - RNA, 19 nt, Homo sapiens
gugcugcagucuucuucau

SEQ ID NO: 909068 - RNA, 19 nt, Homo sapiens
gcacugcggaugguguuca

SEQ ID NO: 909069 - RNA, 19 nt, Homo sapiens
ccgaaucgcacuguauuuc

SEQ ID NO: 909070 - RNA, 19 nt, Homo sapiens
gcuucacucccuaucauau

SEQ ID NO: 909071 - RNA, 19 nt, Homo sapiens
agacuuaaacaacaacaag

SEQ ID NO: 909072 - RNA, 19 nt, Homo sapiens
ggcugaccuugcucaugua

SEQ ID NO: 909073 - RNA, 19 nt, Homo sapiens
ggcuaaccuugacaaauac

SEQ ID NO: 909074 - RNA, 19 nt, Homo sapiens
gaucagugagaggcagaaa

SEQ ID NO: 909075 - RNA, 19 nt, Homo sapiens
ccauuucccauccugagaa

SEQ ID NO: 909076 - RNA, 19 nt, Homo sapiens
gacugccuguuugccauuu

SEQ ID NO: 909077 - RNA, 19 nt, Homo sapiens
caauacucccucuaugcaa

SEQ ID NO: 909078 - RNA, 19 nt, Homo sapiens
gcuuugcugaucuuggaua

SEQ ID NO: 909079 - RNA, 19 nt, Homo sapiens
cauucaagauggguagcaa

SEQ ID NO: 909080 - RNA, 19 nt, Homo sapiens
cugcuucacucccuaucau

SEQ ID NO: 909081 - RNA, 19 nt, Homo sapiens
gcggaugguguucaugugu

SEQ ID NO: 909082 - RNA, 19 nt, Homo sapiens
aagcacagacuuaaacaac

SEQ ID NO: 909083 - RNA, 19 nt, Homo sapiens
gcuagagccuuucccuuua

SEQ ID NO: 909084 - RNA, 19 nt, Homo sapiens
ccaagaacauuguggagaa

SEQ ID NO: 909085 - RNA, 19 nt, Homo sapiens
uggagaagauugacuuuga

SEQ ID NO: 909086 - RNA, 19 nt, Homo sapiens
ucaaggguaucgacaggua

SEQ ID NO: 909087 - RNA, 19 nt, Homo sapiens
caaccuggcuguccugaag

SEQ ID NO: 909088 - RNA, 19 nt, Homo sapiens
gaaaguuuaucugccaugu

SEQ ID NO: 909089 - RNA, 19 nt, Homo sapiens
ugaaggcccucaccaacuu

SEQ ID NO: 909090 - RNA, 19 nt, Homo sapiens
ccaggcacaucaagaagaa

SEQ ID NO: 909091 - RNA, 19 nt, Homo sapiens
gaagauugacuuugacagu

SEQ ID NO: 909092 - RNA, 19 nt, Homo sapiens
aaacauggaccucuuggaa

SEQ ID NO: 909093 - RNA, 19 nt, Homo sapiens
ucacuuaccagcacauuga

SEQ ID NO: 909094 - RNA, 19 nt, Homo sapiens
ccaguaacuucagguguuu

SEQ ID NO: 909095 - RNA, 19 nt, Homo sapiens
gcauuaaacccaagaacau

SEQ ID NO: 909096 - RNA, 19 nt, Homo sapiens
ccaagaagagagcauuaaa

SEQ ID NO: 909097 - RNA, 19 nt, Homo sapiens
ugaagacucuguccgaaag

SEQ ID NO: 909098 - RNA, 19 nt, Homo sapiens
aaguuuaucugccauguug

SEQ ID NO: 909099 - RNA, 19 nt, Homo sapiens
gagccaacgugggcaaguu

SEQ ID NO: 909100 - RNA, 19 nt, Homo sapiens
gaacauuguggagaagauu

SEQ ID NO: 909101 - RNA, 19 nt, Homo sapiens
gaacggccaauccgacaga

SEQ ID NO: 909102 - RNA, 19 nt, Homo sapiens
guucaacccagccuucuuu

SEQ ID NO: 909103 - RNA, 19 nt, Homo sapiens
gaagucauggcgauguuug

SEQ ID NO: 909104 - RNA, 19 nt, Homo sapiens
cccaguaacuucagguguu

SEQ ID NO: 909105 - RNA, 19 nt, Homo sapiens
agguauaacuggcuuugaa

SEQ ID NO: 909106 - RNA, 19 nt, Homo sapiens
gaagguauaacuggcuuug

SEQ ID NO: 909107 - RNA, 19 nt, Homo sapiens
cgaccaggcacaucaagaa

SEQ ID NO: 909108 - RNA, 19 nt, Homo sapiens
ggagaagauugacuuugac

SEQ ID NO: 909109 - RNA, 19 nt, Homo sapiens
cgacgucgcuuccguuucc

SEQ ID NO: 909110 - RNA, 19 nt, Homo sapiens
cagaagucauggcgauguu

SEQ ID NO: 909111 - RNA, 19 nt, Homo sapiens
gaaggcgacagaagucaug

SEQ ID NO: 909112 - RNA, 19 nt, Homo sapiens
cagcuaaagguguggauga

SEQ ID NO: 909113 - RNA, 19 nt, Homo sapiens
ggcaagcccuggaugaaaa

SEQ ID NO: 909114 - RNA, 19 nt, Homo sapiens
gccaagaagagagcauuaa

SEQ ID NO: 909115 - RNA, 19 nt, Homo sapiens
cuucaucuguagccaagaa

SEQ ID NO: 909116 - RNA, 19 nt, Homo sapiens
gacucuguccgaaaguuua

SEQ ID NO: 909117 - RNA, 19 nt, Homo sapiens
caagaacauuguggagaag

SEQ ID NO: 909118 - RNA, 19 nt, Homo sapiens
uccugaagcuguaccaguu

SEQ ID NO: 909119 - RNA, 19 nt, Homo sapiens
gagaagauugacuuugaca

SEQ ID NO: 909120 - RNA, 19 nt, Homo sapiens
caagaagagagcauuaaac

SEQ ID NO: 909121 - RNA, 19 nt, Homo sapiens
uggcuguccugaagcugua

SEQ ID NO: 909122 - RNA, 19 nt, Homo sapiens
caaggaaaaugccuaugau

SEQ ID NO: 909123 - RNA, 19 nt, Homo sapiens
guauaacuggcuuugaaga

SEQ ID NO: 909124 - RNA, 19 nt, Homo sapiens
gcuggagaccugccauuuc

SEQ ID NO: 909125 - RNA, 19 nt, Homo sapiens
ccaacuugccgcacacaga

SEQ ID NO: 909126 - RNA, 19 nt, Homo sapiens
aaaugccuaugaucuggaa

SEQ ID NO: 909127 - RNA, 19 nt, Homo sapiens
agauugacuuugacagugu

SEQ ID NO: 909128 - RNA, 19 nt, Homo sapiens
ugcuagagccuuucccuuu

SEQ ID NO: 909129 - RNA, 19 nt, Homo sapiens
cauuaaacccaagaacauu

SEQ ID NO: 909130 - RNA, 19 nt, Homo sapiens
cauggccuccucccaguaa

SEQ ID NO: 909131 - RNA, 19 nt, Homo sapiens
agguguggaugagcaaaua

SEQ ID NO: 909132 - RNA, 19 nt, Homo sapiens
caacccagccuucuuucag

SEQ ID NO: 909133 - RNA, 19 nt, Homo sapiens
ggaaaaugccuaugaucug

SEQ ID NO: 909134 - RNA, 19 nt, Homo sapiens
uagagacgcaggccaagga

SEQ ID NO: 909135 - RNA, 19 nt, Homo sapiens
aacccagccuucuuucaga

SEQ ID NO: 909136 - RNA, 19 nt, Homo sapiens
cuagagccuuucccuuuac

SEQ ID NO: 909137 - RNA, 19 nt, Homo sapiens
ccaaggaaaaugccuauga

SEQ ID NO: 909138 - RNA, 19 nt, Homo sapiens
ggaaggcgacagaagucau

SEQ ID NO: 909139 - RNA, 19 nt, Homo sapiens
gaucgaccaggcacaucaa

SEQ ID NO: 909140 - RNA, 19 nt, Homo sapiens
gaaggcccucaccaacuug

SEQ ID NO: 909141 - RNA, 19 nt, Homo sapiens
agaacauuguggagaagau

SEQ ID NO: 909142 - RNA, 19 nt, Homo sapiens
caagaagaacggccaaucc

SEQ ID NO: 909143 - RNA, 19 nt, Homo sapiens
ggaagguauaacuggcuuu

SEQ ID NO: 909144 - RNA, 19 nt, Homo sapiens
ccgcccagauccugcugaa

SEQ ID NO: 909145 - RNA, 19 nt, Homo sapiens
uggcaagcccuggaugaaa

SEQ ID NO: 909146 - RNA, 19 nt, Homo sapiens
cuggagcgcuauguagaga

SEQ ID NO: 909147 - RNA, 19 nt, Homo sapiens
gguauaacuggcuuugaag

SEQ ID NO: 909148 - RNA, 19 nt, Homo sapiens
gaaagaggaugaagaauau

SEQ ID NO: 909149 - RNA, 19 nt, Homo sapiens
gaagaaggcugcccugaaa

SEQ ID NO: 909150 - RNA, 19 nt, Homo sapiens
gaaggcagcugcucccaaa

SEQ ID NO: 909151 - RNA, 19 nt, Homo sapiens
gaugaagacugcucugaaa

SEQ ID NO: 909152 - RNA, 19 nt, Homo sapiens
cuacauaucaggccaauua

SEQ ID NO: 909153 - RNA, 19 nt, Homo sapiens
ggaugaagaugaaauuaga

SEQ ID NO: 909154 - RNA, 19 nt, Homo sapiens
ggaagaaggugaugcagau

SEQ ID NO: 909155 - RNA, 19 nt, Homo sapiens
ggaaacuccuucucuuuga

SEQ ID NO: 909156 - RNA, 19 nt, Homo sapiens
gaaauuagaggcuacaaau

SEQ ID NO: 909157 - RNA, 19 nt, Homo sapiens
ggucuuugcuguuauuuga

SEQ ID NO: 909158 - RNA, 19 nt, Homo sapiens
gaacaugugcauaguggua

SEQ ID NO: 909159 - RNA, 19 nt, Homo sapiens
gaagauggcuccgaaagag

SEQ ID NO: 909160 - RNA, 19 nt, Homo sapiens
cgaaagagaauuugaagaa

SEQ ID NO: 909161 - RNA, 19 nt, Homo sapiens
gaagaagacagaaauacaa

SEQ ID NO: 909162 - RNA, 19 nt, Homo sapiens
caagauuacugaagauuuc

SEQ ID NO: 909163 - RNA, 19 nt, Homo sapiens
gaagaugacggcucugaaa

SEQ ID NO: 909164 - RNA, 19 nt, Homo sapiens
gaagaugacucagagaaag

SEQ ID NO: 909165 - RNA, 19 nt, Homo sapiens
gaagaaggcaaucccguaa

SEQ ID NO: 909166 - RNA, 19 nt, Homo sapiens
ucaaggaaaucuuaaagga

SEQ ID NO: 909167 - RNA, 19 nt, Homo sapiens
ugaagaauaugcagaugaa

SEQ ID NO: 909168 - RNA, 19 nt, Homo sapiens
agaaagaggaugaagaaua

SEQ ID NO: 909169 - RNA, 19 nt, Homo sapiens
gcaaagacuauaagaagaa

SEQ ID NO: 909170 - RNA, 19 nt, Homo sapiens
aaaaggagcuucaugaaaa

SEQ ID NO: 909171 - RNA, 19 nt, Homo sapiens
gggaugggacuacagauua

SEQ ID NO: 909172 - RNA, 19 nt, Homo sapiens
agaggaagcugauuauugu

SEQ ID NO: 909173 - RNA, 19 nt, Homo sapiens
ggaagcugauuauuguauu

SEQ ID NO: 909174 - RNA, 19 nt, Homo sapiens
ugacaaagaguuagaagaa

SEQ ID NO: 909175 - RNA, 19 nt, Homo sapiens
gaagacagaaauacaaaug

SEQ ID NO: 909176 - RNA, 19 nt, Homo sapiens
gagaauaugaugccucaaa

SEQ ID NO: 909177 - RNA, 19 nt, Homo sapiens
caaggaagaugaagaugca

SEQ ID NO: 909178 - RNA, 19 nt, Homo sapiens
ggcagcagcuuuauucuca

SEQ ID NO: 909179 - RNA, 19 nt, Homo sapiens
gaauauguuucauccuaug

SEQ ID NO: 909180 - RNA, 19 nt, Homo sapiens
gacaaagaguuagaagaaa

SEQ ID NO: 909181 - RNA, 19 nt, Homo sapiens
ugaaugagaucagagaaga

SEQ ID NO: 909182 - RNA, 19 nt, Homo sapiens
agaagaagcugucuaugca

SEQ ID NO: 909183 - RNA, 19 nt, Homo sapiens
caaagaagaagaagaagug

SEQ ID NO: 909184 - RNA, 19 nt, Homo sapiens
ccaaugagaaguuguuuga

SEQ ID NO: 909185 - RNA, 19 nt, Homo sapiens
gaugaugauuccaaugaga

SEQ ID NO: 909186 - RNA, 19 nt, Homo sapiens
ggaugggacuacagauuau

SEQ ID NO: 909187 - RNA, 19 nt, Homo sapiens
gaagaagugcaaagacuau

SEQ ID NO: 909188 - RNA, 19 nt, Homo sapiens
ccaauuauggcuucucuaa

SEQ ID NO: 909189 - RNA, 19 nt, Homo sapiens
gccaucagauuaaagcauu

SEQ ID NO: 909190 - RNA, 19 nt, Homo sapiens
aagaugaccucaacaagga

SEQ ID NO: 909191 - RNA, 19 nt, Homo sapiens
gaguauugauugaaguuug

SEQ ID NO: 909192 - RNA, 19 nt, Homo sapiens
agagagaguuugacgaaga

SEQ ID NO: 909193 - RNA, 19 nt, Homo sapiens
gaagcugauuauuguauuc

SEQ ID NO: 909194 - RNA, 19 nt, Homo sapiens
uaugaugccucaaagaaga

SEQ ID NO: 909195 - RNA, 19 nt, Homo sapiens
guuaaaugcaugcagaaua

SEQ ID NO: 909196 - RNA, 19 nt, Homo sapiens
ccgcaaauguugaagaugu

SEQ ID NO: 909197 - RNA, 19 nt, Homo sapiens
gaaguuguuugacgauucu

SEQ ID NO: 909198 - RNA, 19 nt, Homo sapiens
ugaugagucugaugagaaa

SEQ ID NO: 909199 - RNA, 19 nt, Homo sapiens
aagaagaggaggauacaua

SEQ ID NO: 909200 - RNA, 19 nt, Homo sapiens
gaaacuccuucucuuugau

SEQ ID NO: 909201 - RNA, 19 nt, Homo sapiens
gaaaagagaaucuguggaa

SEQ ID NO: 909202 - RNA, 19 nt, Homo sapiens
ggaacgaugaguuugauga

SEQ ID NO: 909203 - RNA, 19 nt, Homo sapiens
ugagaaagaggaugaagaa

SEQ ID NO: 909204 - RNA, 19 nt, Homo sapiens
cagaggaagcugauuauug

SEQ ID NO: 909205 - RNA, 19 nt, Homo sapiens
aaugagaaguuguuugaug

SEQ ID NO: 909206 - RNA, 19 nt, Homo sapiens
gaugaugagucugaugaga

SEQ ID NO: 909207 - RNA, 19 nt, Homo sapiens
gagagaguuugacgaagau

SEQ ID NO: 909208 - RNA, 19 nt, Homo sapiens
gaaaaggagcuucaugaaa

SEQ ID NO: 909209 - RNA, 19 nt, Homo sapiens
gagaagaaguuugaaaaga

SEQ ID NO: 909210 - RNA, 19 nt, Homo sapiens
guagaguguucgaaguuug

SEQ ID NO: 909211 - RNA, 19 nt, Homo sapiens
gaagcugucuaugcaacaa

SEQ ID NO: 909212 - RNA, 19 nt, Homo sapiens
cagaagaauuuaaggucaa

SEQ ID NO: 909213 - RNA, 19 nt, Homo sapiens
gaaaaugacucugaaaacu

SEQ ID NO: 909214 - RNA, 19 nt, Homo sapiens
agaaggcaaucccguaaga

SEQ ID NO: 909215 - RNA, 19 nt, Homo sapiens
ccucaaagaagaagaagaa

SEQ ID NO: 909216 - RNA, 19 nt, Homo sapiens
caggaugguuucauguuga

SEQ ID NO: 909217 - RNA, 19 nt, Homo sapiens
gaugaugacgaugauauuu

SEQ ID NO: 909218 - RNA, 19 nt, Homo sapiens
gagaaguuguuugacgauu

SEQ ID NO: 909219 - RNA, 19 nt, Homo sapiens
ccagugagaaguuguuuga

SEQ ID NO: 909220 - RNA, 19 nt, Homo sapiens
cgaagaugaugauuccaau

SEQ ID NO: 909221 - RNA, 19 nt, Homo sapiens
agaaagagucugaugaaga

SEQ ID NO: 909222 - RNA, 19 nt, Homo sapiens
gaugagaagaaguuugaaa

SEQ ID NO: 909223 - RNA, 19 nt, Homo sapiens
ugaagaaccuauagaugag

SEQ ID NO: 909224 - RNA, 19 nt, Homo sapiens
caacuuggaugggaacgau

SEQ ID NO: 909225 - RNA, 19 nt, Homo sapiens
gaugagcaguugcgaaugc

SEQ ID NO: 909226 - RNA, 19 nt, Homo sapiens
gagaaagagucugaugaag

SEQ ID NO: 909227 - RNA, 19 nt, Homo sapiens
aaacaaugcuaaggaaagu

SEQ ID NO: 909228 - RNA, 19 nt, Homo sapiens
gaggaaaggcugagaggau

SEQ ID NO: 909229 - RNA, 19 nt, Homo sapiens
ucaggaugguuucauguug

SEQ ID NO: 909230 - RNA, 19 nt, Homo sapiens
gaagauguccaugcuagga

SEQ ID NO: 909231 - RNA, 19 nt, Homo sapiens
gaagagaauggccuugcaa

SEQ ID NO: 909232 - RNA, 19 nt, Homo sapiens
aagaggaucugaagaggau

SEQ ID NO: 909233 - RNA, 19 nt, Homo sapiens
gggagaauuugaagaaggu

SEQ ID NO: 909234 - RNA, 19 nt, Homo sapiens
uugaagaaccuauagauga

SEQ ID NO: 909235 - RNA, 19 nt, Homo sapiens
ggaugggaacgaugaguuu

SEQ ID NO: 909236 - RNA, 19 nt, Homo sapiens
gagagauccucagacagaa

SEQ ID NO: 909237 - RNA, 19 nt, Homo sapiens
ccaagauuacugaagauuu

SEQ ID NO: 909238 - RNA, 19 nt, Homo sapiens
uagaugagaagaaguuuga

SEQ ID NO: 909239 - RNA, 19 nt, Homo sapiens
gugcaaagacuauaagaag

SEQ ID NO: 909240 - RNA, 19 nt, Homo sapiens
gaauaugaugccucaaaga

SEQ ID NO: 909241 - RNA, 19 nt, Homo sapiens
ggcuacaaauuacauguug

SEQ ID NO: 909242 - RNA, 19 nt, Homo sapiens
gauuaaagcauugaagugu

SEQ ID NO: 909243 - RNA, 19 nt, Homo sapiens
ugagagagaguuugacgaa

SEQ ID NO: 909244 - RNA, 19 nt, Homo sapiens
aaaauggucucgagaaaga

SEQ ID NO: 909245 - RNA, 19 nt, Homo sapiens
aagagaaucuguggaacuu

SEQ ID NO: 909246 - RNA, 19 nt, Homo sapiens
guacggagacggcaaggau

SEQ ID NO: 909247 - RNA, 19 nt, Homo sapiens
aagaggaggauacauauga

SEQ ID NO: 909248 - RNA, 19 nt, Homo sapiens
ggaggucuguuccgcauga

SEQ ID NO: 909249 - RNA, 19 nt, Homo sapiens
gcacugggaccuggauuug

SEQ ID NO: 909250 - RNA, 19 nt, Homo sapiens
ggagaacuacgaggaguau

SEQ ID NO: 909251 - RNA, 19 nt, Homo sapiens
acaaggaggugacgacacu

SEQ ID NO: 909252 - RNA, 19 nt, Homo sapiens
gcuacuuccugaccaagau

SEQ ID NO: 909253 - RNA, 19 nt, Homo sapiens
acugggaccuggauuuguu

SEQ ID NO: 909254 - RNA, 19 nt, Homo sapiens
ucaagugccugcugaucca

SEQ ID NO: 909255 - RNA, 19 nt, Homo sapiens
ccgcagccaugaacuccaa

SEQ ID NO: 909256 - RNA, 19 nt, Homo sapiens
ccuccaacucugucucuaa

SEQ ID NO: 909257 - RNA, 19 nt, Homo sapiens
guacugcugaccaucaagu

SEQ ID NO: 909258 - RNA, 19 nt, Homo sapiens
ucaaggucuuucccaacga

SEQ ID NO: 909259 - RNA, 19 nt, Homo sapiens
ggcacugggaccuggauuu

SEQ ID NO: 909260 - RNA, 19 nt, Homo sapiens
gacacguacugcugaccau

SEQ ID NO: 909261 - RNA, 19 nt, Homo sapiens
cagaagagcucagcaaaua

SEQ ID NO: 909262 - RNA, 19 nt, Homo sapiens
gcagugaucuaguuucauu

SEQ ID NO: 909263 - RNA, 19 nt, Homo sapiens
ggacggagauucuucacuu

SEQ ID NO: 909264 - RNA, 19 nt, Homo sapiens
gauaacaacuuugagguaa

SEQ ID NO: 909265 - RNA, 19 nt, Homo sapiens
gcacggauguccagaucua

SEQ ID NO: 909266 - RNA, 19 nt, Homo sapiens
guacuaauguggccaacuu

SEQ ID NO: 909267 - RNA, 19 nt, Homo sapiens
gcagcuggauaacaacuuu

SEQ ID NO: 909268 - RNA, 19 nt, Homo sapiens
ggacagaagccucaaguuc

SEQ ID NO: 909269 - RNA, 19 nt, Homo sapiens
gaaggaacguacuaaugug

SEQ ID NO: 909270 - RNA, 19 nt, Homo sapiens
caaaguugcucacccaauc

SEQ ID NO: 909271 - RNA, 19 nt, Homo sapiens
caacaggcauggacagaag

SEQ ID NO: 909272 - RNA, 19 nt, Homo sapiens
ggauaacaacuuugaggua

SEQ ID NO: 909273 - RNA, 19 nt, Homo sapiens
ugaaagcuuugcaggauga

SEQ ID NO: 909274 - RNA, 19 nt, Homo sapiens
agaaguacauugcggagaa

SEQ ID NO: 909275 - RNA, 19 nt, Homo sapiens
agacaaagccacugugcua

SEQ ID NO: 909276 - RNA, 19 nt, Homo sapiens
gagguaaagucacugaucu

SEQ ID NO: 909277 - RNA, 19 nt, Homo sapiens
ucagaagcuucaagacaaa

SEQ ID NO: 909278 - RNA, 19 nt, Homo sapiens
ggaaugaccccagagauua

SEQ ID NO: 909279 - RNA, 19 nt, Homo sapiens
ugaaggaacguacuaaugu

SEQ ID NO: 909280 - RNA, 19 nt, Homo sapiens
uguaagcagugaucuaguu

SEQ ID NO: 909281 - RNA, 19 nt, Homo sapiens
ggacucaucuuuggaacag

SEQ ID NO: 909282 - RNA, 19 nt, Homo sapiens
gacggagauucuucacuuu

SEQ ID NO: 909283 - RNA, 19 nt, Homo sapiens
gaucugcgcaagcuuaaga

SEQ ID NO: 909284 - RNA, 19 nt, Homo sapiens
ucaaaggccauaccaagaa

SEQ ID NO: 909285 - RNA, 19 nt, Homo sapiens
gcucaucgacaucaaaguu

SEQ ID NO: 909286 - RNA, 19 nt, Homo sapiens
ggagauucuucacuuuaca

SEQ ID NO: 909287 - RNA, 19 nt, Homo sapiens
ugagugggaugcagucaug

SEQ ID NO: 909288 - RNA, 19 nt, Homo sapiens
gaaguacauugcggagaau

SEQ ID NO: 909289 - RNA, 19 nt, Homo sapiens
gaagcugggccucaucuca

SEQ ID NO: 909290 - RNA, 19 nt, Homo sapiens
gggcacggauguccagauc

SEQ ID NO: 909291 - RNA, 19 nt, Homo sapiens
gcgcaagcuuaagaacuuu

SEQ ID NO: 909292 - RNA, 19 nt, Homo sapiens
caaaggccauaccaagaag

SEQ ID NO: 909293 - RNA, 19 nt, Homo sapiens
gcagacaacccgccaagag

SEQ ID NO: 909294 - RNA, 19 nt, Homo sapiens
cuaaucugcuccaucucua

SEQ ID NO: 909295 - RNA, 19 nt, Homo sapiens
aagcagugaucuaguuuca

SEQ ID NO: 909296 - RNA, 19 nt, Homo sapiens
guaagcagugaucuaguuu

SEQ ID NO: 909297 - RNA, 19 nt, Homo sapiens
ggacauucacaucauuuca

SEQ ID NO: 909298 - RNA, 19 nt, Homo sapiens
caggaaccauggacucuca

SEQ ID NO: 909299 - RNA, 19 nt, Homo sapiens
gggaacggauguggaagga

SEQ ID NO: 909300 - RNA, 19 nt, Homo sapiens
gaucaguacugggcuuucu

SEQ ID NO: 909301 - RNA, 19 nt, Homo sapiens
cgggugagccaauggauuu

SEQ ID NO: 909302 - RNA, 19 nt, Homo sapiens
agacuuugcagcuggauaa

SEQ ID NO: 909303 - RNA, 19 nt, Homo sapiens
aauccuggcuacccucaaa

SEQ ID NO: 909304 - RNA, 19 nt, Homo sapiens
ccacggagcgcaagaagag

SEQ ID NO: 909305 - RNA, 19 nt, Homo sapiens
uucagaagcuucaagacaa

SEQ ID NO: 909306 - RNA, 19 nt, Homo sapiens
ucugaaagcuuugcaggau

SEQ ID NO: 909307 - RNA, 19 nt, Homo sapiens
ucauuucacucuggucuga

SEQ ID NO: 909308 - RNA, 19 nt, Homo sapiens
gauggaagcugggccucau

SEQ ID NO: 909309 - RNA, 19 nt, Homo sapiens
gaucuacaucugcaaacaa

SEQ ID NO: 909310 - RNA, 19 nt, Homo sapiens
gaucugggacuugaaggaa

SEQ ID NO: 909311 - RNA, 19 nt, Homo sapiens
gaacugucacccucuuaag

SEQ ID NO: 909312 - RNA, 19 nt, Homo sapiens
ggugggacauucacaucau

SEQ ID NO: 909313 - RNA, 19 nt, Homo sapiens
ugggugagcuggugggaau

SEQ ID NO: 909314 - RNA, 19 nt, Homo sapiens
gacaaagccacugugcuaa

SEQ ID NO: 909315 - RNA, 19 nt, Homo sapiens
ugcgcaagcuuaagaacuu

SEQ ID NO: 909316 - RNA, 19 nt, Homo sapiens
gugggacauucacaucauu

SEQ ID NO: 909317 - RNA, 19 nt, Homo sapiens
cccaaugccucuuguguac

SEQ ID NO: 909318 - RNA, 19 nt, Homo sapiens
cggccauucugaaagcuuu

SEQ ID NO: 909319 - RNA, 19 nt, Homo sapiens
gcaaacaauggacggagau

SEQ ID NO: 909320 - RNA, 19 nt, Homo sapiens
ccagaagagcucagcaaau

SEQ ID NO: 909321 - RNA, 19 nt, Homo sapiens
gccagaagagcucagcaaa

SEQ ID NO: 909322 - RNA, 19 nt, Homo sapiens
gugccaaguucccaaccaa

SEQ ID NO: 909323 - RNA, 19 nt, Homo sapiens
gagggcuugugcaggguuu

SEQ ID NO: 909324 - RNA, 19 nt, Homo sapiens
cuuugcagcuggauaacaa

SEQ ID NO: 909325 - RNA, 19 nt, Homo sapiens
gcagcucaucgacaucaaa

SEQ ID NO: 909326 - RNA, 19 nt, Homo sapiens
caguagagggguagaauua

SEQ ID NO: 909327 - RNA, 19 nt, Homo sapiens
gggcaucacgccaaguuca

SEQ ID NO: 909328 - RNA, 19 nt, Homo sapiens
ucccuaaucugcuccaucu

SEQ ID NO: 909329 - RNA, 19 nt, Homo sapiens
caugggaacggauguggaa

SEQ ID NO: 909330 - RNA, 19 nt, Homo sapiens
acggagauucuucacuuua

SEQ ID NO: 909331 - RNA, 19 nt, Homo sapiens
caaugccucuuguguacag

SEQ ID NO: 909332 - RNA, 19 nt, Homo sapiens
cggagauucuucacuuuac

SEQ ID NO: 909333 - RNA, 19 nt, Homo sapiens
cgaugccacuaucaggauu

SEQ ID NO: 909334 - RNA, 19 nt, Homo sapiens
gaagagcucagcaaauacc

SEQ ID NO: 909335 - RNA, 19 nt, Homo sapiens
ccccagagauuauucagaa

SEQ ID NO: 909336 - RNA, 19 nt, Homo sapiens
gcucaucgagaaguacauu

SEQ ID NO: 909337 - RNA, 19 nt, Homo sapiens
gggaucugcgcaagcuuaa

SEQ ID NO: 909338 - RNA, 19 nt, Homo sapiens
gaaccauggacucucagau

SEQ ID NO: 909339 - RNA, 19 nt, Homo sapiens
ccaaguucaucgcuucaac

SEQ ID NO: 909340 - RNA, 19 nt, Homo sapiens
ugggaucugcgcaagcuua

SEQ ID NO: 909341 - RNA, 19 nt, Homo sapiens
gacggacucaucuuuggaa

SEQ ID NO: 909342 - RNA, 19 nt, Homo sapiens
ccggagcacccauguguau

SEQ ID NO: 909343 - RNA, 19 nt, Homo sapiens
ccaugagagugcugugaca

SEQ ID NO: 909344 - RNA, 19 nt, Homo sapiens
agaacugucacccucuuaa

SEQ ID NO: 909345 - RNA, 19 nt, Homo sapiens
cuccaucucuaacgaagug

SEQ ID NO: 909346 - RNA, 19 nt, Homo sapiens
gggaaugaccccagagauu

SEQ ID NO: 909347 - RNA, 19 nt, Homo sapiens
caaguucccaaccaagugu

SEQ ID NO: 909348 - RNA, 19 nt, Homo sapiens
agucacugcugcccgagaa

SEQ ID NO: 909349 - RNA, 19 nt, Homo sapiens
ucacuagcaucgccuucuc

SEQ ID NO: 909350 - RNA, 19 nt, Homo sapiens
cauggacucucagaucaag

SEQ ID NO: 909351 - RNA, 19 nt, Homo sapiens
accauggacucucagauca

SEQ ID NO: 909352 - RNA, 19 nt, Homo sapiens
aaaaugucguuguguuuga

SEQ ID NO: 909353 - RNA, 19 nt, Homo sapiens
gagccaagggaacugugaa

SEQ ID NO: 909354 - RNA, 19 nt, Homo sapiens
cuacaucugcaaacaaugg

SEQ ID NO: 909355 - RNA, 19 nt, Homo sapiens
ggcgugugcucaccaaggu

SEQ ID NO: 909356 - RNA, 19 nt, Homo sapiens
ggcggcucaucgagaagua

SEQ ID NO: 909357 - RNA, 19 nt, Homo sapiens
ucugagugguggccugaga

SEQ ID NO: 909358 - RNA, 19 nt, Homo sapiens
caaguucaucgcuucaaca

SEQ ID NO: 909359 - RNA, 19 nt, Homo sapiens
gcuccuccgaugaucagua

SEQ ID NO: 909360 - RNA, 19 nt, Homo sapiens
ccaaguucccaaccaagug

SEQ ID NO: 909361 - RNA, 19 nt, Homo sapiens
gaucauagcuccuuuguuu

SEQ ID NO: 909362 - RNA, 19 nt, Homo sapiens
gaacaugcaucuuuaaguu

SEQ ID NO: 909363 - RNA, 19 nt, Homo sapiens
gaacagagcccaagaaauc

SEQ ID NO: 909364 - RNA, 19 nt, Homo sapiens
gaaauggacuucuuugaga

SEQ ID NO: 909365 - RNA, 19 nt, Homo sapiens
ggagagcucugaccaaauu

SEQ ID NO: 909366 - RNA, 19 nt, Homo sapiens
gaaacaggcuaaugagaaa

SEQ ID NO: 909367 - RNA, 19 nt, Homo sapiens
gaauauacaugcaagaguu

SEQ ID NO: 909368 - RNA, 19 nt, Homo sapiens
gagaaagacuauagagaaa

SEQ ID NO: 909369 - RNA, 19 nt, Homo sapiens
ggacauaguugaugaccuu

SEQ ID NO: 909370 - RNA, 19 nt, Homo sapiens
cagcaacugugaaugauua

SEQ ID NO: 909371 - RNA, 19 nt, Homo sapiens
gcagaucuauuuccuauuc

SEQ ID NO: 909372 - RNA, 19 nt, Homo sapiens
gagcagaucuauuuccuau

SEQ ID NO: 909373 - RNA, 19 nt, Homo sapiens
gcaaaggaguuagaaauau

SEQ ID NO: 909374 - RNA, 19 nt, Homo sapiens
ccacaauacuuuccuguuu

SEQ ID NO: 909375 - RNA, 19 nt, Homo sapiens
agaauuacaucaugccuua

SEQ ID NO: 909376 - RNA, 19 nt, Homo sapiens
gauguuaacuaccuaauuc

SEQ ID NO: 909377 - RNA, 19 nt, Homo sapiens
gcacacuccuggcucauaa

SEQ ID NO: 909378 - RNA, 19 nt, Homo sapiens
acaagaagcuuuagaagau

SEQ ID NO: 909379 - RNA, 19 nt, Homo sapiens
ggaggaagauuaauucuac

SEQ ID NO: 909380 - RNA, 19 nt, Homo sapiens
gcaugaacuuucuggaaua

SEQ ID NO: 909381 - RNA, 19 nt, Homo sapiens
gaaagacuauagagaaauc

SEQ ID NO: 909382 - RNA, 19 nt, Homo sapiens
caacuaccauggauguuaa

SEQ ID NO: 909383 - RNA, 19 nt, Homo sapiens
ggaagaacaagaagcuuua

SEQ ID NO: 909384 - RNA, 19 nt, Homo sapiens
ucaaagaucagcaaguuua

SEQ ID NO: 909385 - RNA, 19 nt, Homo sapiens
gaggagagcugcagcaaag

SEQ ID NO: 909386 - RNA, 19 nt, Homo sapiens
ggacucuuguuuagauaua

SEQ ID NO: 909387 - RNA, 19 nt, Homo sapiens
guaaagagcuuggcauucu

SEQ ID NO: 909388 - RNA, 19 nt, Homo sapiens
agaaggaacuacagaauga

SEQ ID NO: 909389 - RNA, 19 nt, Homo sapiens
ggaaggcccuggaguuugu

SEQ ID NO: 909390 - RNA, 19 nt, Homo sapiens
agucaaagguugugaauga

SEQ ID NO: 909391 - RNA, 19 nt, Homo sapiens
gcgcauaccugccgaagau

SEQ ID NO: 909392 - RNA, 19 nt, Homo sapiens
gaauaagacugggaguaaa

SEQ ID NO: 909393 - RNA, 19 nt, Homo sapiens
gguguuaccucauauuaga

SEQ ID NO: 909394 - RNA, 19 nt, Homo sapiens
caaaggaguuagaaauaug

SEQ ID NO: 909395 - RNA, 19 nt, Homo sapiens
cagccaaagucuuguauuu

SEQ ID NO: 909396 - RNA, 19 nt, Homo sapiens
gaucuggacucuuguuuag

SEQ ID NO: 909397 - RNA, 19 nt, Homo sapiens
cacaauacuuuccuguuua

SEQ ID NO: 909398 - RNA, 19 nt, Homo sapiens
gccauagccugaaagauuu

SEQ ID NO: 909399 - RNA, 19 nt, Homo sapiens
gcaaaguuguucugucuuc

SEQ ID NO: 909400 - RNA, 19 nt, Homo sapiens
caucaccucuuacauuaaa

SEQ ID NO: 909401 - RNA, 19 nt, Homo sapiens
gcugguaacuggaugugua

SEQ ID NO: 909402 - RNA, 19 nt, Homo sapiens
agaaauugaugcuguguuu

SEQ ID NO: 909403 - RNA, 19 nt, Homo sapiens
agaaugauaugacagauga

SEQ ID NO: 909404 - RNA, 19 nt, Homo sapiens
ggucagcguauauguauua

SEQ ID NO: 909405 - RNA, 19 nt, Homo sapiens
gcaauucucucagcgaaga

SEQ ID NO: 909406 - RNA, 19 nt, Homo sapiens
ccaggaggcuuuaauggaa

SEQ ID NO: 909407 - RNA, 19 nt, Homo sapiens
ggacauuuaugauacuuca

SEQ ID NO: 909408 - RNA, 19 nt, Homo sapiens
caagaugaauccucacaga

SEQ ID NO: 909409 - RNA, 19 nt, Homo sapiens
ggaaacauaccuuauacuu

SEQ ID NO: 909410 - RNA, 19 nt, Homo sapiens
gaggaggacauuuaugaua

SEQ ID NO: 909411 - RNA, 19 nt, Homo sapiens
agucaagucuuaccagaua

SEQ ID NO: 909412 - RNA, 19 nt, Homo sapiens
acagugggauuaauuguaa

SEQ ID NO: 909413 - RNA, 19 nt, Homo sapiens
gcuaaucugccaaguauuu

SEQ ID NO: 909414 - RNA, 19 nt, Homo sapiens
gaacaucagcuaaagaauc

SEQ ID NO: 909415 - RNA, 19 nt, Homo sapiens
gcaugugccugaugaguau

SEQ ID NO: 909416 - RNA, 19 nt, Homo sapiens
ccaccgagcagaucuauuu

SEQ ID NO: 909417 - RNA, 19 nt, Homo sapiens
ugaguuauaucuucaguug

SEQ ID NO: 909418 - RNA, 19 nt, Homo sapiens
acacagaguuguuagaaug

SEQ ID NO: 909419 - RNA, 19 nt, Homo sapiens
gaaaagaucagguuacaaa

SEQ ID NO: 909420 - RNA, 19 nt, Homo sapiens
caaagguugugaaugauga

SEQ ID NO: 909421 - RNA, 19 nt, Homo sapiens
gagcagaaacgcaagauau

SEQ ID NO: 909422 - RNA, 19 nt, Homo sapiens
ggaaucauaucaguuuaga

SEQ ID NO: 909423 - RNA, 19 nt, Homo sapiens
uauuagaccucuugagaaa

SEQ ID NO: 909424 - RNA, 19 nt, Homo sapiens
aagauuggcuguuugauau

SEQ ID NO: 909425 - RNA, 19 nt, Homo sapiens
aaaccaacaugcacauauu

SEQ ID NO: 909426 - RNA, 19 nt, Homo sapiens
aaacucauccuuccauuaa

SEQ ID NO: 909427 - RNA, 19 nt, Homo sapiens
ugguacaacuuacucauua

SEQ ID NO: 909428 - RNA, 19 nt, Homo sapiens
gagaguggguuaaaauaua

SEQ ID NO: 909429 - RNA, 19 nt, Homo sapiens
acaaaguucuguacucauu

SEQ ID NO: 909430 - RNA, 19 nt, Homo sapiens
gagcacaagucaguaaaga

SEQ ID NO: 909431 - RNA, 19 nt, Homo sapiens
cacaauaggaggaagauua

SEQ ID NO: 909432 - RNA, 19 nt, Homo sapiens
gaucugagagucaauauuc

SEQ ID NO: 909433 - RNA, 19 nt, Homo sapiens
cagaaucaauggaggauga

SEQ ID NO: 909434 - RNA, 19 nt, Homo sapiens
cuacuuaccuuucacaauc

SEQ ID NO: 909435 - RNA, 19 nt, Homo sapiens
gaaacauaccuuauacuug

SEQ ID NO: 909436 - RNA, 19 nt, Homo sapiens
gaaaugugcaaaggaguua

SEQ ID NO: 909437 - RNA, 19 nt, Homo sapiens
gcaaagaagagaaagauag

SEQ ID NO: 909438 - RNA, 19 nt, Homo sapiens
gaacucaacagcaccuauu

SEQ ID NO: 909439 - RNA, 19 nt, Homo sapiens
gaacuuuauugugaggaua

SEQ ID NO: 909440 - RNA, 19 nt, Homo sapiens
gaaaugaucgccuaucucu

SEQ ID NO: 909441 - RNA, 19 nt, Homo sapiens
cagcguauauguauuacuu

SEQ ID NO: 909442 - RNA, 19 nt, Homo sapiens
caaaccaacuggaauucaa

SEQ ID NO: 909443 - RNA, 19 nt, Homo sapiens
gcaggauuauaccacaaua

SEQ ID NO: 909444 - RNA, 19 nt, Homo sapiens
gaauagagcacaagucagu

SEQ ID NO: 909445 - RNA, 19 nt, Homo sapiens
ggagauccagauauucuua

SEQ ID NO: 909446 - RNA, 19 nt, Homo sapiens
gaagagauagugcauuuua

SEQ ID NO: 909447 - RNA, 19 nt, Homo sapiens
gaugaauccucacagaaga

SEQ ID NO: 909448 - RNA, 19 nt, Homo sapiens
caaauucccagaaagagua

SEQ ID NO: 909449 - RNA, 19 nt, Homo sapiens
agacucaccugcaaguuaa

SEQ ID NO: 909450 - RNA, 19 nt, Homo sapiens
ccugaaagauuuagcaaug

SEQ ID NO: 909451 - RNA, 19 nt, Homo sapiens
uaaagcagauccucuccaa

SEQ ID NO: 909452 - RNA, 19 nt, Homo sapiens
aagcuaaucugccaaguau

SEQ ID NO: 909453 - RNA, 19 nt, Homo sapiens
gaagcuaaucugccaagua

SEQ ID NO: 909454 - RNA, 19 nt, Homo sapiens
guuagaagcauuccacuuu

SEQ ID NO: 909455 - RNA, 19 nt, Homo sapiens
guuaggagauaugaguuua

SEQ ID NO: 909456 - RNA, 19 nt, Homo sapiens
gcagaaacgcaagauauuu

SEQ ID NO: 909457 - RNA, 19 nt, Homo sapiens
caagcuuucugucauauau

SEQ ID NO: 909458 - RNA, 19 nt, Homo sapiens
ggauuugguuguacaguug

SEQ ID NO: 909459 - RNA, 19 nt, Homo sapiens
ggagucaugugcauucuca

SEQ ID NO: 909460 - RNA, 19 nt, Homo sapiens
gaaagugugugcccuacuc

SEQ ID NO: 909461 - RNA, 19 nt, Homo sapiens
gaagaucgcugaggaagaa

SEQ ID NO: 909462 - RNA, 19 nt, Homo sapiens
ccaaucaaguucucugaaa

SEQ ID NO: 909463 - RNA, 19 nt, Homo sapiens
gcaacaggcuucucacuac

SEQ ID NO: 909464 - RNA, 19 nt, Homo sapiens
ggaggcauaugaccagaag

SEQ ID NO: 909465 - RNA, 19 nt, Homo sapiens
cuacgcagcuauuccaauc

SEQ ID NO: 909466 - RNA, 19 nt, Homo sapiens
ggacugaggcagccagcuu

SEQ ID NO: 909467 - RNA, 19 nt, Homo sapiens
acaaguggaucagugacua

SEQ ID NO: 909468 - RNA, 19 nt, Homo sapiens
cguccagucuguagaguug

SEQ ID NO: 909469 - RNA, 19 nt, Homo sapiens
gcacacggcguucgacaag

SEQ ID NO: 909470 - RNA, 19 nt, Homo sapiens
acacguucauggaggcaua

SEQ ID NO: 909471 - RNA, 19 nt, Homo sapiens
ggguggaaguggacacguu

SEQ ID NO: 909472 - RNA, 19 nt, Homo sapiens
gaagaguggcauucacaag

SEQ ID NO: 909473 - RNA, 19 nt, Homo sapiens
caaguucucugaaaagcaa

SEQ ID NO: 909474 - RNA, 19 nt, Homo sapiens
ccucgggucuugugcuuca

SEQ ID NO: 909475 - RNA, 19 nt, Homo sapiens
agaguggcauucacaagug

SEQ ID NO: 909476 - RNA, 19 nt, Homo sapiens
ggagucaaggucgaaguuu

SEQ ID NO: 909477 - RNA, 19 nt, Homo sapiens
ggaaguggacacguucaug

SEQ ID NO: 909478 - RNA, 19 nt, Homo sapiens
cgaccguacugagcuguga

SEQ ID NO: 909479 - RNA, 19 nt, Homo sapiens
caaucaaguucucugaaaa

SEQ ID NO: 909480 - RNA, 19 nt, Homo sapiens
gagccacccugugaagagu

SEQ ID NO: 909481 - RNA, 19 nt, Homo sapiens
caaaggagucaaggucgaa

SEQ ID NO: 909482 - RNA, 19 nt, Homo sapiens
gcaaauuccgaccguacug

SEQ ID NO: 909483 - RNA, 19 nt, Homo sapiens
gagucaaggucgaaguuuu

SEQ ID NO: 909484 - RNA, 19 nt, Homo sapiens
caaauuccgaccguacuga

SEQ ID NO: 909485 - RNA, 19 nt, Homo sapiens
acgcagcuauuccaaucaa

SEQ ID NO: 909486 - RNA, 19 nt, Homo sapiens
cuguagaguugcaggagaa

SEQ ID NO: 909487 - RNA, 19 nt, Homo sapiens
gcagcuauuccaaucaagu

SEQ ID NO: 909488 - RNA, 19 nt, Homo sapiens
ccaccuggccucagaagag

SEQ ID NO: 909489 - RNA, 19 nt, Homo sapiens
cagcuauuccaaucaaguu

SEQ ID NO: 909490 - RNA, 19 nt, Homo sapiens
gaaguucgaggaggacaag

SEQ ID NO: 909491 - RNA, 19 nt, Homo sapiens
ccagaagaucgcugaggaa

SEQ ID NO: 909492 - RNA, 19 nt, Homo sapiens
cagcaucgagagagcaaga

SEQ ID NO: 909493 - RNA, 19 nt, Homo sapiens
gacggaagcgcagccgaaa

SEQ ID NO: 909494 - RNA, 19 nt, Homo sapiens
gagagccacccugugaaga

SEQ ID NO: 909495 - RNA, 19 nt, Homo sapiens
cugcugguguccacagaga

SEQ ID NO: 909496 - RNA, 19 nt, Homo sapiens
uccguucugugcuuccuuu

SEQ ID NO: 909497 - RNA, 19 nt, Homo sapiens
gagagcacacggcguucga

SEQ ID NO: 909498 - RNA, 19 nt, Homo sapiens
ucgcugaggaagaagcuaa

SEQ ID NO: 909499 - RNA, 19 nt, Homo sapiens
gaaagugccuccagaaaga

SEQ ID NO: 909500 - RNA, 19 nt, Homo sapiens
gcaggaugaucacaauuua

SEQ ID NO: 909501 - RNA, 19 nt, Homo sapiens
gaaauacacaguucguuua

SEQ ID NO: 909502 - RNA, 19 nt, Homo sapiens
gcaaaucucuauugaguuc

SEQ ID NO: 909503 - RNA, 19 nt, Homo sapiens
aaacuaugcuucuagcuua

SEQ ID NO: 909504 - RNA, 19 nt, Homo sapiens
gagaagacccgcaagguua

SEQ ID NO: 909505 - RNA, 19 nt, Homo sapiens
ggaagaagaugagccuuaa

SEQ ID NO: 909506 - RNA, 19 nt, Homo sapiens
cacagaaggugauaaguua

SEQ ID NO: 909507 - RNA, 19 nt, Homo sapiens
gguauggacucuugccuua

SEQ ID NO: 909508 - RNA, 19 nt, Homo sapiens
ugacucgucucuauaaaua

SEQ ID NO: 909509 - RNA, 19 nt, Homo sapiens
gaaaggaugugguuacuac

SEQ ID NO: 909510 - RNA, 19 nt, Homo sapiens
caaaguguauguucaagaa

SEQ ID NO: 909511 - RNA, 19 nt, Homo sapiens
gaacuuggaucucuugucu

SEQ ID NO: 909512 - RNA, 19 nt, Homo sapiens
gaucacagauaucauugaa

SEQ ID NO: 909513 - RNA, 19 nt, Homo sapiens
agaaagaucuugccauuca

SEQ ID NO: 909514 - RNA, 19 nt, Homo sapiens
ggaaauacacaguucguuu

SEQ ID NO: 909515 - RNA, 19 nt, Homo sapiens
gauaauggaucagauugaa

SEQ ID NO: 909516 - RNA, 19 nt, Homo sapiens
gaaagagucgagaagauaa

SEQ ID NO: 909517 - RNA, 19 nt, Homo sapiens
gcaaacgucuagacauguu

SEQ ID NO: 909518 - RNA, 19 nt, Homo sapiens
gauggaagacuuuaaacua

SEQ ID NO: 909519 - RNA, 19 nt, Homo sapiens
gaggauggcuacuauuuca

SEQ ID NO: 909520 - RNA, 19 nt, Homo sapiens
gcacagaaggugauaaguu

SEQ ID NO: 909521 - RNA, 19 nt, Homo sapiens
cagcaaaucucuauugagu

SEQ ID NO: 909522 - RNA, 19 nt, Homo sapiens
gcaaauguauaagaacuug

SEQ ID NO: 909523 - RNA, 19 nt, Homo sapiens
caucaugacucgucucuau

SEQ ID NO: 909524 - RNA, 19 nt, Homo sapiens
ggagguaucucauauuggu

SEQ ID NO: 909525 - RNA, 19 nt, Homo sapiens
cuaaggaguucauagaauu

SEQ ID NO: 909526 - RNA, 19 nt, Homo sapiens
cgagaaguguuuagacaaa

SEQ ID NO: 909527 - RNA, 19 nt, Homo sapiens
gaagauaauggaucagauu

SEQ ID NO: 909528 - RNA, 19 nt, Homo sapiens
gccaagaaaucuauaaaca

SEQ ID NO: 909529 - RNA, 19 nt, Homo sapiens
gaucaaagaaggaaauuca

SEQ ID NO: 909530 - RNA, 19 nt, Homo sapiens
gaaauuaagccuccgaauc

SEQ ID NO: 909531 - RNA, 19 nt, Homo sapiens
gaaauacccacuggaaauu

SEQ ID NO: 909532 - RNA, 19 nt, Homo sapiens
gagaggauggcuacuauuu

SEQ ID NO: 909533 - RNA, 19 nt, Homo sapiens
gcaguaacuuuggaauaaa

SEQ ID NO: 909534 - RNA, 19 nt, Homo sapiens
gaugcaaacucgugggaaa

SEQ ID NO: 909535 - RNA, 19 nt, Homo sapiens
uauggacucuugccuuaua

SEQ ID NO: 909536 - RNA, 19 nt, Homo sapiens
uuacuacacucaacugauu

SEQ ID NO: 909537 - RNA, 19 nt, Homo sapiens
ugaaggcgaucacagauau

SEQ ID NO: 909538 - RNA, 19 nt, Homo sapiens
caagagaaguucaagacau

SEQ ID NO: 909539 - RNA, 19 nt, Homo sapiens
gagcaguaacuuuggaaua

SEQ ID NO: 909540 - RNA, 19 nt, Homo sapiens
guaccacucuuccacaguu

SEQ ID NO: 909541 - RNA, 19 nt, Homo sapiens
caagaaaggaucaugaaug

SEQ ID NO: 909542 - RNA, 19 nt, Homo sapiens
gcaagcacaucuucaaugc

SEQ ID NO: 909543 - RNA, 19 nt, Homo sapiens
ucagugacauccacagauu

SEQ ID NO: 909544 - RNA, 19 nt, Homo sapiens
gaauucauguggaucaauc

SEQ ID NO: 909545 - RNA, 19 nt, Homo sapiens
aaaauucucuccagacaua

SEQ ID NO: 909546 - RNA, 19 nt, Homo sapiens
gagacaagcuggccugcau

SEQ ID NO: 909547 - RNA, 19 nt, Homo sapiens
ggaaggaaugcauuacaaa

SEQ ID NO: 909548 - RNA, 19 nt, Homo sapiens
ggaucuagaauguaacuaa

SEQ ID NO: 909549 - RNA, 19 nt, Homo sapiens
ccaucaagaucaccaagaa

SEQ ID NO: 909550 - RNA, 19 nt, Homo sapiens
gaaagaucuugccauucaa

SEQ ID NO: 909551 - RNA, 19 nt, Homo sapiens
caaaagggaucuaagcauu

SEQ ID NO: 909552 - RNA, 19 nt, Homo sapiens
cuauuaagcuugacacauc

SEQ ID NO: 909553 - RNA, 19 nt, Homo sapiens
auacacaguucguuuaguu

SEQ ID NO: 909554 - RNA, 19 nt, Homo sapiens
gcagagcaguaacuuugga

SEQ ID NO: 909555 - RNA, 19 nt, Homo sapiens
acagugugauguuaacuaa

SEQ ID NO: 909556 - RNA, 19 nt, Homo sapiens
aaauuaagccuccgaauca

SEQ ID NO: 909557 - RNA, 19 nt, Homo sapiens
ggaaagugccuccagaaag

SEQ ID NO: 909558 - RNA, 19 nt, Homo sapiens
caauaaaguuucacaaucc

SEQ ID NO: 909559 - RNA, 19 nt, Homo sapiens
ggaaccuucuauaaccuaa

SEQ ID NO: 909560 - RNA, 19 nt, Homo sapiens
uuaggaggcuugacagcua

SEQ ID NO: 909561 - RNA, 19 nt, Homo sapiens
gaagacaucccagaagugu

SEQ ID NO: 909562 - RNA, 19 nt, Homo sapiens
gagaaauacccacuggaaa

SEQ ID NO: 909563 - RNA, 19 nt, Homo sapiens
cagaaagagucgagaagau

SEQ ID NO: 909564 - RNA, 19 nt, Homo sapiens
aaagggaucuaagcauuga

SEQ ID NO: 909565 - RNA, 19 nt, Homo sapiens
caagacaggccaagaaauc

SEQ ID NO: 909566 - RNA, 19 nt, Homo sapiens
gaaggaaauucaggaagca

SEQ ID NO: 909567 - RNA, 19 nt, Homo sapiens
uugggucucuuacauauaa

SEQ ID NO: 909568 - RNA, 19 nt, Homo sapiens
gagggaagaguaccacaaa

SEQ ID NO: 909569 - RNA, 19 nt, Homo sapiens
gcccuucuuugguuuaauu

SEQ ID NO: 909570 - RNA, 19 nt, Homo sapiens
uaaaaugacucgagaagug

SEQ ID NO: 909571 - RNA, 19 nt, Homo sapiens
gcaauaagaagauguuggu

SEQ ID NO: 909572 - RNA, 19 nt, Homo sapiens
agcaguaacuuuggaauaa

SEQ ID NO: 909573 - RNA, 19 nt, Homo sapiens
gcaagaaaggaugugguua

SEQ ID NO: 909574 - RNA, 19 nt, Homo sapiens
cuauugaguucuucaguga

SEQ ID NO: 909575 - RNA, 19 nt, Homo sapiens
ucaaguuuaugcaggauga

SEQ ID NO: 909576 - RNA, 19 nt, Homo sapiens
uauaagaacuuggaucucu

SEQ ID NO: 909577 - RNA, 19 nt, Homo sapiens
gaagaugagccuuaagucu

SEQ ID NO: 909578 - RNA, 19 nt, Homo sapiens
agaaagagucgagaagaua

SEQ ID NO: 909579 - RNA, 19 nt, Homo sapiens
ccacaagacaggccaagaa

SEQ ID NO: 909580 - RNA, 19 nt, Homo sapiens
cagcuauacuugugaaauc

SEQ ID NO: 909581 - RNA, 19 nt, Homo sapiens
ggaaugaaugggccucuga

SEQ ID NO: 909582 - RNA, 19 nt, Homo sapiens
gagacuaugacaccacuaa

SEQ ID NO: 909583 - RNA, 19 nt, Homo sapiens
gagguucuauauagucaga

SEQ ID NO: 909584 - RNA, 19 nt, Homo sapiens
acaaaugaaugcuacaaag

SEQ ID NO: 909585 - RNA, 19 nt, Homo sapiens
ccacugcaaccucaaguuu

SEQ ID NO: 909586 - RNA, 19 nt, Homo sapiens
cagauggaauugcaagaga

SEQ ID NO: 909587 - RNA, 19 nt, Homo sapiens
ugauugggaucuagaaugu

SEQ ID NO: 909588 - RNA, 19 nt, Homo sapiens
cagaaacuacugaugauga

SEQ ID NO: 909589 - RNA, 19 nt, Homo sapiens
uuaccacagugaagaaauu

SEQ ID NO: 909590 - RNA, 19 nt, Homo sapiens
ucaguggaaccuucuauaa

SEQ ID NO: 909591 - RNA, 19 nt, Homo sapiens
gaacgccgaggaauucaug

SEQ ID NO: 909592 - RNA, 19 nt, Homo sapiens
ggaagacuuuaaacuaugc

SEQ ID NO: 909593 - RNA, 19 nt, Homo sapiens
aaucggaucuccugugcaa

SEQ ID NO: 909594 - RNA, 19 nt, Homo sapiens
gacaagaaaggaucaugaa

SEQ ID NO: 909595 - RNA, 19 nt, Homo sapiens
gcagcaagcacaucuucaa

SEQ ID NO: 909596 - RNA, 19 nt, Homo sapiens
agaugagccuuaagucuga

SEQ ID NO: 909597 - RNA, 19 nt, Homo sapiens
gauaugcggucuuaauucc

SEQ ID NO: 909598 - RNA, 19 nt, Homo sapiens
ccugagagguguuuguugu

SEQ ID NO: 909599 - RNA, 19 nt, Homo sapiens
gaacagccauuccacaugu

SEQ ID NO: 909600 - RNA, 19 nt, Homo sapiens
gggcagaacucuuugagaa

SEQ ID NO: 909601 - RNA, 19 nt, Homo sapiens
ggaggaggcuacagagauu

SEQ ID NO: 909602 - RNA, 19 nt, Homo sapiens
ccacauguguucccucuau

SEQ ID NO: 909603 - RNA, 19 nt, Homo sapiens
gcagguggcugguuugaag

SEQ ID NO: 909604 - RNA, 19 nt, Homo sapiens
ggaagcggauggcugagaa

SEQ ID NO: 909605 - RNA, 19 nt, Homo sapiens
gaccaagacugcccagaug

SEQ ID NO: 909606 - RNA, 19 nt, Homo sapiens
guaaagugcauuugacauu

SEQ ID NO: 909607 - RNA, 19 nt, Homo sapiens
gcugguaaguggucuauuc

SEQ ID NO: 909608 - RNA, 19 nt, Homo sapiens
ccaucggccugaagcauua

SEQ ID NO: 909609 - RNA, 19 nt, Homo sapiens
uaaagugcauuugacauug

SEQ ID NO: 909610 - RNA, 19 nt, Homo sapiens
gcucaucacucacccagau

SEQ ID NO: 909611 - RNA, 19 nt, Homo sapiens
gugacuagcuuggccagua

SEQ ID NO: 909612 - RNA, 19 nt, Homo sapiens
ucaaugcccucaagagcuu

SEQ ID NO: 909613 - RNA, 19 nt, Homo sapiens
ggccaaagccuacaguguu

SEQ ID NO: 909614 - RNA, 19 nt, Homo sapiens
aaagugcauuugacauuga

SEQ ID NO: 909615 - RNA, 19 nt, Homo sapiens
gccaaagccuacaguguuc

SEQ ID NO: 909616 - RNA, 19 nt, Homo sapiens
gugcucagcuggugaaguc

SEQ ID NO: 909617 - RNA, 19 nt, Homo sapiens
gagggaagagggagaagaa

SEQ ID NO: 909618 - RNA, 19 nt, Homo sapiens
gaaggguuccucacagaug

SEQ ID NO: 909619 - RNA, 19 nt, Homo sapiens
agaggaggcugguggaugu

SEQ ID NO: 909620 - RNA, 19 nt, Homo sapiens
caaaaguacuugcaaagau

SEQ ID NO: 909621 - RNA, 19 nt, Homo sapiens
gcacuccagcuuucuucua

SEQ ID NO: 909622 - RNA, 19 nt, Homo sapiens
ggaccaagacugcccagau

SEQ ID NO: 909623 - RNA, 19 nt, Homo sapiens
ggacagcagcccugaccaa

SEQ ID NO: 909624 - RNA, 19 nt, Homo sapiens
aaucacaaccuccauauca

SEQ ID NO: 909625 - RNA, 19 nt, Homo sapiens
gagaacagccauuccacau

SEQ ID NO: 909626 - RNA, 19 nt, Homo sapiens
ugcggaagcuggaccauau

SEQ ID NO: 909627 - RNA, 19 nt, Homo sapiens
gccagaaggcgaccaauca

SEQ ID NO: 909628 - RNA, 19 nt, Homo sapiens
uagugcagcugaucuggaa

SEQ ID NO: 909629 - RNA, 19 nt, Homo sapiens
gagaauggucagcaacaga

SEQ ID NO: 909630 - RNA, 19 nt, Homo sapiens
gaagcuggaccauaucagu

SEQ ID NO: 909631 - RNA, 19 nt, Homo sapiens
ggaagagggagaagaagca

SEQ ID NO: 909632 - RNA, 19 nt, Homo sapiens
gagcagacaguccagaaag

SEQ ID NO: 909633 - RNA, 19 nt, Homo sapiens
gcuggaaguucuggccaaa

SEQ ID NO: 909634 - RNA, 19 nt, Homo sapiens
augaaggcauggacuauga

SEQ ID NO: 909635 - RNA, 19 nt, Homo sapiens
caccggcucugcacacuuc

SEQ ID NO: 909636 - RNA, 19 nt, Homo sapiens
gagcucuucuccaacaucu

SEQ ID NO: 909637 - RNA, 19 nt, Homo sapiens
ucacagagaagcuggaagu

SEQ ID NO: 909638 - RNA, 19 nt, Homo sapiens
gaagcagauuguucagcau

SEQ ID NO: 909639 - RNA, 19 nt, Homo sapiens
ccaguaaagugcauuugac

SEQ ID NO: 909640 - RNA, 19 nt, Homo sapiens
gggaggaggcuacagagau

SEQ ID NO: 909641 - RNA, 19 nt, Homo sapiens
acucugggcugcugugugu

SEQ ID NO: 909642 - RNA, 19 nt, Homo sapiens
gaaaauucaugcugaugca

SEQ ID NO: 909643 - RNA, 19 nt, Homo sapiens
aggagcagguggcugguuu

SEQ ID NO: 909644 - RNA, 19 nt, Homo sapiens
gccugaagcauuacaguga

SEQ ID NO: 909645 - RNA, 19 nt, Homo sapiens
ggccaucaaugcccucaag

SEQ ID NO: 909646 - RNA, 19 nt, Homo sapiens
ccaggugucacucacauug

SEQ ID NO: 909647 - RNA, 19 nt, Homo sapiens
ugacuagcuuggccaguag

SEQ ID NO: 909648 - RNA, 19 nt, Homo sapiens
ccugugcccugcucuacuu

SEQ ID NO: 909649 - RNA, 19 nt, Homo sapiens
ggagaauggucagcaacag

SEQ ID NO: 909650 - RNA, 19 nt, Homo sapiens
aagcagcccaggccuuuaa

SEQ ID NO: 909651 - RNA, 19 nt, Homo sapiens
agacugcccagauguggua

SEQ ID NO: 909652 - RNA, 19 nt, Homo sapiens
ccaaucacaaccuccauau

SEQ ID NO: 909653 - RNA, 19 nt, Homo sapiens
gaugaugaagccagugaug

SEQ ID NO: 909654 - RNA, 19 nt, Homo sapiens
caucaaaaguacuugcaaa

SEQ ID NO: 909655 - RNA, 19 nt, Homo sapiens
ccacugagaaggaugucuu

SEQ ID NO: 909656 - RNA, 19 nt, Homo sapiens
auaagccugucaccucgua

SEQ ID NO: 909657 - RNA, 19 nt, Homo sapiens
caugaggcccugcuucaga

SEQ ID NO: 909658 - RNA, 19 nt, Homo sapiens
gauccagccauacuucaau

SEQ ID NO: 909659 - RNA, 19 nt, Homo sapiens
aaggguuccucacagauga

SEQ ID NO: 909660 - RNA, 19 nt, Homo sapiens
ggucgggcacuccagcuuu

SEQ ID NO: 909661 - RNA, 19 nt, Homo sapiens
gaugaaggcauggacuaug

SEQ ID NO: 909662 - RNA, 19 nt, Homo sapiens
ggaugaaggcauggacuau

SEQ ID NO: 909663 - RNA, 19 nt, Homo sapiens
cugcgagacuccuccauuc

SEQ ID NO: 909664 - RNA, 19 nt, Homo sapiens
guacuugcaaagauuccua

SEQ ID NO: 909665 - RNA, 19 nt, Homo sapiens
ccagggaggaggcuacaga

SEQ ID NO: 909666 - RNA, 19 nt, Homo sapiens
gcagaaaauucaugcugau

SEQ ID NO: 909667 - RNA, 19 nt, Homo sapiens
gggagaagaagcagaagag

SEQ ID NO: 909668 - RNA, 19 nt, Homo sapiens
agaauggucagcaacagaa

SEQ ID NO: 909669 - RNA, 19 nt, Homo sapiens
gaucuggaagcccucauca

SEQ ID NO: 909670 - RNA, 19 nt, Homo sapiens
gagcagguggcugguuuga

SEQ ID NO: 909671 - RNA, 19 nt, Homo sapiens
agaggagaauggucagcaa

SEQ ID NO: 909672 - RNA, 19 nt, Homo sapiens
gaagcggauggcugagaaa

SEQ ID NO: 909673 - RNA, 19 nt, Homo sapiens
gcugcgagacuccuccauu

SEQ ID NO: 909674 - RNA, 19 nt, Homo sapiens
gccaucggccugaagcauu

SEQ ID NO: 909675 - RNA, 19 nt, Homo sapiens
gcccaggugucacucacau

SEQ ID NO: 909676 - RNA, 19 nt, Homo sapiens
gguaggagaacagccauuc

SEQ ID NO: 909677 - RNA, 19 nt, Homo sapiens
agagggagaagaagcagaa

SEQ ID NO: 909678 - RNA, 19 nt, Homo sapiens
gcagacaguccagaaagca

SEQ ID NO: 909679 - RNA, 19 nt, Homo sapiens
ggauccagccauacuucaa

SEQ ID NO: 909680 - RNA, 19 nt, Homo sapiens
agaaggcgaccaaucacaa

SEQ ID NO: 909681 - RNA, 19 nt, Homo sapiens
ggagggaagagggagaaga

SEQ ID NO: 909682 - RNA, 19 nt, Homo sapiens
aagcccagcccaucucuga

SEQ ID NO: 909683 - RNA, 19 nt, Homo sapiens
cacuccagcuuucuucuag

SEQ ID NO: 909684 - RNA, 19 nt, Homo sapiens
ggaugucuucaggcucuua

SEQ ID NO: 909685 - RNA, 19 nt, Homo sapiens
ggugcccuauagcgaguuu

SEQ ID NO: 909686 - RNA, 19 nt, Homo sapiens
ucgacgugcucaucacuca

SEQ ID NO: 909687 - RNA, 19 nt, Homo sapiens
gcggauggcugagaaaauc

SEQ ID NO: 909688 - RNA, 19 nt, Homo sapiens
ccaagacugcccagaugug

SEQ ID NO: 909689 - RNA, 19 nt, Homo sapiens
ucacaaccuccauaucaca

SEQ ID NO: 909690 - RNA, 19 nt, Homo sapiens
gcugaggagagccgaguug

SEQ ID NO: 909691 - RNA, 19 nt, Homo sapiens
ccugaccaacgcuccaaua

SEQ ID NO: 909692 - RNA, 19 nt, Homo sapiens
ugagagcgugccugucuug

SEQ ID NO: 909693 - RNA, 19 nt, Homo sapiens
gcccucaagagcuuccaua

SEQ ID NO: 909694 - RNA, 19 nt, Homo sapiens
gaaggcgaccaaucacaac

SEQ ID NO: 909695 - RNA, 19 nt, Homo sapiens
cugcuguccuggauaagug

SEQ ID NO: 909696 - RNA, 19 nt, Homo sapiens
ccacucccacugagaagga

SEQ ID NO: 909697 - RNA, 19 nt, Homo sapiens
guuccucacagaugacuug

SEQ ID NO: 909698 - RNA, 19 nt, Homo sapiens
gugagagcgugccugucuu

SEQ ID NO: 909699 - RNA, 19 nt, Homo sapiens
gcacguccagagcaacuua

SEQ ID NO: 909700 - RNA, 19 nt, Homo sapiens
gccagcacguccagagcaa

SEQ ID NO: 909701 - RNA, 19 nt, Homo sapiens
guacuugcugggacggauu

SEQ ID NO: 909702 - RNA, 19 nt, Homo sapiens
gaaggaggcuuguagaaag

SEQ ID NO: 909703 - RNA, 19 nt, Homo sapiens
caacaguacuggaaagaug

SEQ ID NO: 909704 - RNA, 19 nt, Homo sapiens
ggacaucugggucucauuu

SEQ ID NO: 909705 - RNA, 19 nt, Homo sapiens
gcuaaagggucaagaucuu

SEQ ID NO: 909706 - RNA, 19 nt, Homo sapiens
ggaaggaggcuuguagaaa

SEQ ID NO: 909707 - RNA, 19 nt, Homo sapiens
gaaacaggcacaacuggaa

SEQ ID NO: 909708 - RNA, 19 nt, Homo sapiens
uggaaagugucaugaauug

SEQ ID NO: 909709 - RNA, 19 nt, Homo sapiens
agaguggucuguguuauuu

SEQ ID NO: 909710 - RNA, 19 nt, Homo sapiens
ccucaaagcuuguauucca

SEQ ID NO: 909711 - RNA, 19 nt, Homo sapiens
gucaagaucuuagcuguau

SEQ ID NO: 909712 - RNA, 19 nt, Homo sapiens
gagauuguccuccugcauu

SEQ ID NO: 909713 - RNA, 19 nt, Homo sapiens
uggaguaacuauuucagaa

SEQ ID NO: 909714 - RNA, 19 nt, Homo sapiens
agaagaauuuggaaagugu

SEQ ID NO: 909715 - RNA, 19 nt, Homo sapiens
gcugaagucugaaccuuac

SEQ ID NO: 909716 - RNA, 19 nt, Homo sapiens
cagaagaauuuggaaagug

SEQ ID NO: 909717 - RNA, 19 nt, Homo sapiens
gaaccucaaagcuuguauu

SEQ ID NO: 909718 - RNA, 19 nt, Homo sapiens
ucaaagaccagaugaugug

SEQ ID NO: 909719 - RNA, 19 nt, Homo sapiens
guagaaagcaaaguacaga

SEQ ID NO: 909720 - RNA, 19 nt, Homo sapiens
aagcgcaaguucucuuaaa

SEQ ID NO: 909721 - RNA, 19 nt, Homo sapiens
gaagcgcaaguucucuuaa

SEQ ID NO: 909722 - RNA, 19 nt, Homo sapiens
guacuggaaagaugagauu

SEQ ID NO: 909723 - RNA, 19 nt, Homo sapiens
gcuuagaacaccaggguuu

SEQ ID NO: 909724 - RNA, 19 nt, Homo sapiens
gucugaaccuuacugugua

SEQ ID NO: 909725 - RNA, 19 nt, Homo sapiens
cggcucggcuuguuucuca

SEQ ID NO: 909726 - RNA, 19 nt, Homo sapiens
ggucaagaucuuagcugua

SEQ ID NO: 909727 - RNA, 19 nt, Homo sapiens
cuaaagggucaagaucuua

SEQ ID NO: 909728 - RNA, 19 nt, Homo sapiens
ucagaagaauuuggaaagu

SEQ ID NO: 909729 - RNA, 19 nt, Homo sapiens
gauuccugcugaagucuga

SEQ ID NO: 909730 - RNA, 19 nt, Homo sapiens
gggaaggaggcuuguagaa

SEQ ID NO: 909731 - RNA, 19 nt, Homo sapiens
gaauuuggaaagugucaug

SEQ ID NO: 909732 - RNA, 19 nt, Homo sapiens
gcagaucggcgagguguuc

SEQ ID NO: 909733 - RNA, 19 nt, Homo sapiens
ucagaaaacccuauaagaa

SEQ ID NO: 909734 - RNA, 19 nt, Homo sapiens
aggcacaacuggaagacuu

SEQ ID NO: 909735 - RNA, 19 nt, Homo sapiens
aauagaguggucuguguua

SEQ ID NO: 909736 - RNA, 19 nt, Homo sapiens
gccauuuacuugcuauuuu

SEQ ID NO: 909737 - RNA, 19 nt, Homo sapiens
ggugggcguucucauugug

SEQ ID NO: 909738 - RNA, 19 nt, Homo sapiens
gagagaaaaucagaagaau

SEQ ID NO: 909739 - RNA, 19 nt, Homo sapiens
ccuauaucccucccuguaa

SEQ ID NO: 909740 - RNA, 19 nt, Homo sapiens
gaggacaucugggucucau

SEQ ID NO: 909741 - RNA, 19 nt, Homo sapiens
uagaguggucuguguuauu

SEQ ID NO: 909742 - RNA, 19 nt, Homo sapiens
ccggguggcuuacgaguac

SEQ ID NO: 909743 - RNA, 19 nt, Homo sapiens
agauuguccuccugcauug

SEQ ID NO: 909744 - RNA, 19 nt, Homo sapiens
gaagucugaaccuuacugu

SEQ ID NO: 909745 - RNA, 19 nt, Homo sapiens
gaagacuuggaaccucaaa

SEQ ID NO: 909746 - RNA, 19 nt, Homo sapiens
guucccagccauuuacuug

SEQ ID NO: 909747 - RNA, 19 nt, Homo sapiens
uguauggaguaacuauuuc

SEQ ID NO: 909748 - RNA, 19 nt, Homo sapiens
gcauccggcucggcuuguu

SEQ ID NO: 909749 - RNA, 19 nt, Homo sapiens
cuauaucccucccuguaag

SEQ ID NO: 909750 - RNA, 19 nt, Homo sapiens
uagaacaccaggguuuaaa

SEQ ID NO: 909751 - RNA, 19 nt, Homo sapiens
guggugggcguucucauug

SEQ ID NO: 909752 - RNA, 19 nt, Homo sapiens
aagaccagaugaugugcuu

SEQ ID NO: 909753 - RNA, 19 nt, Homo sapiens
agucugaaccuuacugugu

SEQ ID NO: 909754 - RNA, 19 nt, Homo sapiens
cuguauggaguaacuauuu

SEQ ID NO: 909755 - RNA, 19 nt, Homo sapiens
caagaucuuagcuguaugg

SEQ ID NO: 909756 - RNA, 19 nt, Homo sapiens
gcaacaguacuggaaagau

SEQ ID NO: 909757 - RNA, 19 nt, Homo sapiens
ugaauuggcaacaguacug

SEQ ID NO: 909758 - RNA, 19 nt, Homo sapiens
uuuggaaagugucaugaau

SEQ ID NO: 909759 - RNA, 19 nt, Homo sapiens
uaaagggucaagaucuuag

SEQ ID NO: 909760 - RNA, 19 nt, Homo sapiens
caaagcuuguauuccaucu

SEQ ID NO: 909761 - RNA, 19 nt, Homo sapiens
gucaugaauuggcaacagu

SEQ ID NO: 909762 - RNA, 19 nt, Homo sapiens
caguuuccacuauuaaaga

SEQ ID NO: 909763 - RNA, 19 nt, Homo sapiens
ccucaguuuccacuauuaa

SEQ ID NO: 909764 - RNA, 19 nt, Homo sapiens
uuagaacaccaggguuuaa

SEQ ID NO: 909765 - RNA, 19 nt, Homo sapiens
gaaaacccuauaagaaguu

SEQ ID NO: 909766 - RNA, 19 nt, Homo sapiens
ucgugucgcucuucaucuu

SEQ ID NO: 909767 - RNA, 19 nt, Homo sapiens
cccucaguuuccacuauua

SEQ ID NO: 909768 - RNA, 19 nt, Homo sapiens
cuuagaacaccaggguuua

SEQ ID NO: 909769 - RNA, 19 nt, Homo sapiens
aaaauagaguggucugugu

SEQ ID NO: 909770 - RNA, 19 nt, Homo sapiens
aaauagaguggucuguguu

SEQ ID NO: 909771 - RNA, 19 nt, Homo sapiens
gcgcaaguucucuuaaagg

SEQ ID NO: 909772 - RNA, 19 nt, Homo sapiens
cggcuuguuucucaucauc

SEQ ID NO: 909773 - RNA, 19 nt, Homo sapiens
cccaagugcuccuauaucc

SEQ ID NO: 909774 - RNA, 19 nt, Homo sapiens
cagaaaacccuauaagaag

SEQ ID NO: 909775 - RNA, 19 nt, Homo sapiens
acacggaagccgaggacaa

SEQ ID NO: 909776 - RNA, 19 nt, Homo sapiens
ggaagacuuggaaccucaa

SEQ ID NO: 909777 - RNA, 19 nt, Homo sapiens
caacagaaacaggcacaac

SEQ ID NO: 909778 - RNA, 19 nt, Homo sapiens
gcguccaggucuacgugaa

SEQ ID NO: 909779 - RNA, 19 nt, Homo sapiens
gaccagaugaugugcuucu

SEQ ID NO: 909780 - RNA, 19 nt, Homo sapiens
gauugguucccagccauuu

SEQ ID NO: 909781 - RNA, 19 nt, Homo sapiens
ucaugaauuggcaacagua

SEQ ID NO: 909782 - RNA, 19 nt, Homo sapiens
agaaaacccuauaagaagu

SEQ ID NO: 909783 - RNA, 19 nt, Homo sapiens
guauggaguaacuauuuca

SEQ ID NO: 909784 - RNA, 19 nt, Homo sapiens
ccacgacagggcucugaga

SEQ ID NO: 909785 - RNA, 19 nt, Homo sapiens
ccaugaagaagcgcaaguu

SEQ ID NO: 909786 - RNA, 19 nt, Homo sapiens
aaagcaaaguacagaagcu

SEQ ID NO: 909787 - RNA, 19 nt, Homo sapiens
aggcggaagccaugaagaa

SEQ ID NO: 909788 - RNA, 19 nt, Homo sapiens
gaagaugacugcaaaggua

SEQ ID NO: 909789 - RNA, 19 nt, Homo sapiens
gcaagaacguguagcaaua

SEQ ID NO: 909790 - RNA, 19 nt, Homo sapiens
gaaaggaacuuaaugacau

SEQ ID NO: 909791 - RNA, 19 nt, Homo sapiens
uauaguggcugcuaauuua

SEQ ID NO: 909792 - RNA, 19 nt, Homo sapiens
ggaauagucucagaucuaa

SEQ ID NO: 909793 - RNA, 19 nt, Homo sapiens
gaacagagaguaccugauu

SEQ ID NO: 909794 - RNA, 19 nt, Homo sapiens
gagaguaccugauugagaa

SEQ ID NO: 909795 - RNA, 19 nt, Homo sapiens
ggauaucccuuaagugaaa

SEQ ID NO: 909796 - RNA, 19 nt, Homo sapiens
gcacgacuguugcucauuu

SEQ ID NO: 909797 - RNA, 19 nt, Homo sapiens
caguauggaugaacuauua

SEQ ID NO: 909798 - RNA, 19 nt, Homo sapiens
ugaaaugacugaauuagga

SEQ ID NO: 909799 - RNA, 19 nt, Homo sapiens
ggucggagauuccugauga

SEQ ID NO: 909800 - RNA, 19 nt, Homo sapiens
caaauauccucccaugaaa

SEQ ID NO: 909801 - RNA, 19 nt, Homo sapiens
ucagaaagauccuuccaaa

SEQ ID NO: 909802 - RNA, 19 nt, Homo sapiens
uuacacaccuuagcuauaa

SEQ ID NO: 909803 - RNA, 19 nt, Homo sapiens
gacauacgauuugaguuua

SEQ ID NO: 909804 - RNA, 19 nt, Homo sapiens
ggaggugccuugcaaacuu

SEQ ID NO: 909805 - RNA, 19 nt, Homo sapiens
ggagauuccugaugaagug

SEQ ID NO: 909806 - RNA, 19 nt, Homo sapiens
gauuguagaugaucccaaa

SEQ ID NO: 909807 - RNA, 19 nt, Homo sapiens
gcaauaauagcaacaauuc

SEQ ID NO: 909808 - RNA, 19 nt, Homo sapiens
cagguggucuuauuuauug

SEQ ID NO: 909809 - RNA, 19 nt, Homo sapiens
ccaacguagugaccuauua

SEQ ID NO: 909810 - RNA, 19 nt, Homo sapiens
uggaauaacugccauugaa

SEQ ID NO: 909811 - RNA, 19 nt, Homo sapiens
gaauaacugccauugaauu

SEQ ID NO: 909812 - RNA, 19 nt, Homo sapiens
guaaaacgcuguuaagguu

SEQ ID NO: 909813 - RNA, 19 nt, Homo sapiens
gguggcauauguuaaguuu

SEQ ID NO: 909814 - RNA, 19 nt, Homo sapiens
gguagaggauaaagaaaug

SEQ ID NO: 909815 - RNA, 19 nt, Homo sapiens
cuugcaaacuuucacauua

SEQ ID NO: 909816 - RNA, 19 nt, Homo sapiens
uagccaaacuugaauucua

SEQ ID NO: 909817 - RNA, 19 nt, Homo sapiens
gagguucaauguuggauau

SEQ ID NO: 909818 - RNA, 19 nt, Homo sapiens
cuaguaaaccuuaggauuu

SEQ ID NO: 909819 - RNA, 19 nt, Homo sapiens
caauuuggauaucccuuaa

SEQ ID NO: 909820 - RNA, 19 nt, Homo sapiens
ugacauacgauuugaguuu

SEQ ID NO: 909821 - RNA, 19 nt, Homo sapiens
gaagagcgaagaagggaaa

SEQ ID NO: 909822 - RNA, 19 nt, Homo sapiens
gagcagcgccuuaucacaa

SEQ ID NO: 909823 - RNA, 19 nt, Homo sapiens
acacucagguggucuuauu

SEQ ID NO: 909824 - RNA, 19 nt, Homo sapiens
cagcagaacuuuuaaaaug

SEQ ID NO: 909825 - RNA, 19 nt, Homo sapiens
gcaguuaaucucguuauuu

SEQ ID NO: 909826 - RNA, 19 nt, Homo sapiens
acaaauauccucccaugaa

SEQ ID NO: 909827 - RNA, 19 nt, Homo sapiens
uuaggaauuuggaugcuua

SEQ ID NO: 909828 - RNA, 19 nt, Homo sapiens
gaggugccuugcaaacuuu

SEQ ID NO: 909829 - RNA, 19 nt, Homo sapiens
ccagaaaggaacuuaauga

SEQ ID NO: 909830 - RNA, 19 nt, Homo sapiens
gauguuacccgaaauaaag

SEQ ID NO: 909831 - RNA, 19 nt, Homo sapiens
gaggaugguucaguacaaa

SEQ ID NO: 909832 - RNA, 19 nt, Homo sapiens
gaaagcugguaauauucuu

SEQ ID NO: 909833 - RNA, 19 nt, Homo sapiens
caaguggucaccuucauaa

SEQ ID NO: 909834 - RNA, 19 nt, Homo sapiens
ccaugaaaguguuaauguu

SEQ ID NO: 909835 - RNA, 19 nt, Homo sapiens
gccauuugcauacaauuua

SEQ ID NO: 909836 - RNA, 19 nt, Homo sapiens
gcaaaggaaguuucaagug

SEQ ID NO: 909837 - RNA, 19 nt, Homo sapiens
uuaagaaacuccagaaagg

SEQ ID NO: 909838 - RNA, 19 nt, Homo sapiens
gaaccucguuuugagauua

SEQ ID NO: 909839 - RNA, 19 nt, Homo sapiens
caacaggagcagcgccuua

SEQ ID NO: 909840 - RNA, 19 nt, Homo sapiens
gugcagccaucccaacgua

SEQ ID NO: 909841 - RNA, 19 nt, Homo sapiens
gcaauccacaguacaagaa

SEQ ID NO: 909842 - RNA, 19 nt, Homo sapiens
gcugauguaugucccuuga

SEQ ID NO: 909843 - RNA, 19 nt, Homo sapiens
uagaugaucccaaagcuuu

SEQ ID NO: 909844 - RNA, 19 nt, Homo sapiens
guaagugcguuccuagcaa

SEQ ID NO: 909845 - RNA, 19 nt, Homo sapiens
uauaagguggcauauguua

SEQ ID NO: 909846 - RNA, 19 nt, Homo sapiens
gaaaugacugaauuaggaa

SEQ ID NO: 909847 - RNA, 19 nt, Homo sapiens
ggaugguucaguacaaaua

SEQ ID NO: 909848 - RNA, 19 nt, Homo sapiens
gugauaggauuuguuauuc

SEQ ID NO: 909849 - RNA, 19 nt, Homo sapiens
gggugaggaugguucagua

SEQ ID NO: 909850 - RNA, 19 nt, Homo sapiens
gaggauaaagaaaugauga

SEQ ID NO: 909851 - RNA, 19 nt, Homo sapiens
gagaggcuaugacuucaag

SEQ ID NO: 909852 - RNA, 19 nt, Homo sapiens
acacagaaacggucagauu

SEQ ID NO: 909853 - RNA, 19 nt, Homo sapiens
gaagaggcaauaauagcaa

SEQ ID NO: 909854 - RNA, 19 nt, Homo sapiens
gaggagaacacaagaaugg

SEQ ID NO: 909855 - RNA, 19 nt, Homo sapiens
gucaugaaauuacuaagug

SEQ ID NO: 909856 - RNA, 19 nt, Homo sapiens
gaacuuuggcuggucauga

SEQ ID NO: 909857 - RNA, 19 nt, Homo sapiens
ggugagaggcuaugacuuc

SEQ ID NO: 909858 - RNA, 19 nt, Homo sapiens
cugcuugacuguauauuau

SEQ ID NO: 909859 - RNA, 19 nt, Homo sapiens
gguggauggucacgaugua

SEQ ID NO: 909860 - RNA, 19 nt, Homo sapiens
ggaacuuaaugacauacga

SEQ ID NO: 909861 - RNA, 19 nt, Homo sapiens
uaaugaagacuacagagaa

SEQ ID NO: 909862 - RNA, 19 nt, Homo sapiens
caagaacguguagcaauaa

SEQ ID NO: 909863 - RNA, 19 nt, Homo sapiens
acucgaagaugacugcaaa

SEQ ID NO: 909864 - RNA, 19 nt, Homo sapiens
gaacuaguaaaccuuagga

SEQ ID NO: 909865 - RNA, 19 nt, Homo sapiens
ggaagaggcaauaauagca

SEQ ID NO: 909866 - RNA, 19 nt, Homo sapiens
ggaauaacugccauugaau

SEQ ID NO: 909867 - RNA, 19 nt, Homo sapiens
gaauggaguucuggaagag

SEQ ID NO: 909868 - RNA, 19 nt, Homo sapiens
gaaaagucacgaagaguaa

SEQ ID NO: 909869 - RNA, 19 nt, Homo sapiens
ggaaaagucacgaagagua

SEQ ID NO: 909870 - RNA, 19 nt, Homo sapiens
ucaauuuggauaucccuua

SEQ ID NO: 909871 - RNA, 19 nt, Homo sapiens
aaacagggguagaggauaa

SEQ ID NO: 909872 - RNA, 19 nt, Homo sapiens
caugaaaguguuaauguug

SEQ ID NO: 909873 - RNA, 19 nt, Homo sapiens
gccuauuucuccuuucauu

SEQ ID NO: 909874 - RNA, 19 nt, Homo sapiens
ugauguaugucccuugaug

SEQ ID NO: 909875 - RNA, 19 nt, Homo sapiens
ccagaaagccaagaacaga

SEQ ID NO: 909876 - RNA, 19 nt, Homo sapiens
gauuugaaagcugguaaua

SEQ ID NO: 909877 - RNA, 19 nt, Homo sapiens
ucuggaagaggcaauaaua

SEQ ID NO: 909878 - RNA, 19 nt, Homo sapiens
aaguggagguucaauguug

SEQ ID NO: 909879 - RNA, 19 nt, Homo sapiens
gcucuuuaauguacuucaa

SEQ ID NO: 909880 - RNA, 19 nt, Homo sapiens
uggcagcucuuuaauguac

SEQ ID NO: 909881 - RNA, 19 nt, Homo sapiens
ugauuuggcucuccuuaag

SEQ ID NO: 909882 - RNA, 19 nt, Homo sapiens
cguuuagaaugcuauguaa

SEQ ID NO: 909883 - RNA, 19 nt, Homo sapiens
gcauuacacaccuuagcua

SEQ ID NO: 909884 - RNA, 19 nt, Homo sapiens
agugucagcugauguaugu

SEQ ID NO: 909885 - RNA, 19 nt, Homo sapiens
gcugcuaauuuacagaaga

SEQ ID NO: 909886 - RNA, 19 nt, Homo sapiens
gcuuuacucuggaauaguc

SEQ ID NO: 909887 - RNA, 19 nt, Homo sapiens
agagggaggugccuugcaa

SEQ ID NO: 909888 - RNA, 19 nt, Homo sapiens
ggaaaugccuuacguggua

SEQ ID NO: 909889 - RNA, 19 nt, Homo sapiens
gaucugagcugaccugugu

SEQ ID NO: 909890 - RNA, 19 nt, Homo sapiens
uauaggacguugcuuauuu

SEQ ID NO: 909891 - RNA, 19 nt, Homo sapiens
gcaaagccaucuucaucuu

SEQ ID NO: 909892 - RNA, 19 nt, Homo sapiens
caaaaggucugaagaguaa

SEQ ID NO: 909893 - RNA, 19 nt, Homo sapiens
gaucuuaaaugauggaagu

SEQ ID NO: 909894 - RNA, 19 nt, Homo sapiens
guacauauccucaaauugg

SEQ ID NO: 909895 - RNA, 19 nt, Homo sapiens
gggucaaucucucacuuua

SEQ ID NO: 909896 - RNA, 19 nt, Homo sapiens
caaacaaggucagucuaaa

SEQ ID NO: 909897 - RNA, 19 nt, Homo sapiens
gucaaucucucacuuuauu

SEQ ID NO: 909898 - RNA, 19 nt, Homo sapiens
gaaaacacgugaaucuauu

SEQ ID NO: 909899 - RNA, 19 nt, Homo sapiens
ggacguugcuuauuuuaaa

SEQ ID NO: 909900 - RNA, 19 nt, Homo sapiens
gucggagucuucaauaaua

SEQ ID NO: 909901 - RNA, 19 nt, Homo sapiens
cagcagaccuggacagaca

SEQ ID NO: 909902 - RNA, 19 nt, Homo sapiens
ugccauagaugaagacauu

SEQ ID NO: 909903 - RNA, 19 nt, Homo sapiens
ucaaauuggagcuaaguua

SEQ ID NO: 909904 - RNA, 19 nt, Homo sapiens
acaacaacgugcagcauuu

SEQ ID NO: 909905 - RNA, 19 nt, Homo sapiens
aagcuacggucacaacuaa

SEQ ID NO: 909906 - RNA, 19 nt, Homo sapiens
gguaauacauggucacaac

SEQ ID NO: 909907 - RNA, 19 nt, Homo sapiens
acacagaguucacugacuu

SEQ ID NO: 909908 - RNA, 19 nt, Homo sapiens
gaagaaagagggaagacau

SEQ ID NO: 909909 - RNA, 19 nt, Homo sapiens
gcuugaugaucuuaaauga

SEQ ID NO: 909910 - RNA, 19 nt, Homo sapiens
gaagcuacggucacaacua

SEQ ID NO: 909911 - RNA, 19 nt, Homo sapiens
ucauagaguugaaucacaa

SEQ ID NO: 909912 - RNA, 19 nt, Homo sapiens
cagccugccuugugccaua

SEQ ID NO: 909913 - RNA, 19 nt, Homo sapiens
aaaauccccuucacacuua

SEQ ID NO: 909914 - RNA, 19 nt, Homo sapiens
ggccuugccuuucagaaga

SEQ ID NO: 909915 - RNA, 19 nt, Homo sapiens
caaauuggagcuaaguuau

SEQ ID NO: 909916 - RNA, 19 nt, Homo sapiens
gaccguuggcuuugaauuu

SEQ ID NO: 909917 - RNA, 19 nt, Homo sapiens
gaaagagggaagacauuca

SEQ ID NO: 909918 - RNA, 19 nt, Homo sapiens
ucaaacaaggucagucuaa

SEQ ID NO: 909919 - RNA, 19 nt, Homo sapiens
cuugaaguauacucaguua

SEQ ID NO: 909920 - RNA, 19 nt, Homo sapiens
gcggggaccuuauaacuaa

SEQ ID NO: 909921 - RNA, 19 nt, Homo sapiens
uugacgagauggauaaauu

SEQ ID NO: 909922 - RNA, 19 nt, Homo sapiens
ugacaugggcccagacuga

SEQ ID NO: 909923 - RNA, 19 nt, Homo sapiens
gaagaccgcuuugggguuu

SEQ ID NO: 909924 - RNA, 19 nt, Homo sapiens
gcaaucaagccguuucuag

SEQ ID NO: 909925 - RNA, 19 nt, Homo sapiens
aaauauguuugccaccuuu

SEQ ID NO: 909926 - RNA, 19 nt, Homo sapiens
aaaauggaaugacugcuua

SEQ ID NO: 909927 - RNA, 19 nt, Homo sapiens
gagaaaaucuacucagaca

SEQ ID NO: 909928 - RNA, 19 nt, Homo sapiens
uaaauauguuugccaccuu

SEQ ID NO: 909929 - RNA, 19 nt, Homo sapiens
cggagugucuuaccgcaaa

SEQ ID NO: 909930 - RNA, 19 nt, Homo sapiens
gcaagaauuuugucaguca

SEQ ID NO: 909931 - RNA, 19 nt, Homo sapiens
gaaaugccuuacgugguau

SEQ ID NO: 909932 - RNA, 19 nt, Homo sapiens
guacagacaugugaaaaug

SEQ ID NO: 909933 - RNA, 19 nt, Homo sapiens
ucaagccguuucuagacua

SEQ ID NO: 909934 - RNA, 19 nt, Homo sapiens
ggaugugcuuguucuggaa

SEQ ID NO: 909935 - RNA, 19 nt, Homo sapiens
caaugagaccguuggcuuu

SEQ ID NO: 909936 - RNA, 19 nt, Homo sapiens
ggaguacagacaugugaaa

SEQ ID NO: 909937 - RNA, 19 nt, Homo sapiens
uaacuuuguccaccuguuu

SEQ ID NO: 909938 - RNA, 19 nt, Homo sapiens
gguaucacacuuagucuug

SEQ ID NO: 909939 - RNA, 19 nt, Homo sapiens
gcgcauuugucauuuagca

SEQ ID NO: 909940 - RNA, 19 nt, Homo sapiens
ccucauugauuacuuuauc

SEQ ID NO: 909941 - RNA, 19 nt, Homo sapiens
caaucaagccguuucuaga

SEQ ID NO: 909942 - RNA, 19 nt, Homo sapiens
cagccagugugaaucauug

SEQ ID NO: 909943 - RNA, 19 nt, Homo sapiens
ucagcuugaugaucuuaaa

SEQ ID NO: 909944 - RNA, 19 nt, Homo sapiens
agaaguggauccgcgguaa

SEQ ID NO: 909945 - RNA, 19 nt, Homo sapiens
gaucaaacaaggucagucu

SEQ ID NO: 909946 - RNA, 19 nt, Homo sapiens
gcuuugaauuugagucguu

SEQ ID NO: 909947 - RNA, 19 nt, Homo sapiens
ggaaaacacgugaaucuau

SEQ ID NO: 909948 - RNA, 19 nt, Homo sapiens
cagcugggauauagaaucu

SEQ ID NO: 909949 - RNA, 19 nt, Homo sapiens
ccgaguagcugggauuaca

SEQ ID NO: 909950 - RNA, 19 nt, Homo sapiens
cuuaguccuuucucagaua

SEQ ID NO: 909951 - RNA, 19 nt, Homo sapiens
gaaucuauugcgcgcauuu

SEQ ID NO: 909952 - RNA, 19 nt, Homo sapiens
uuacgugguaucacacuua

SEQ ID NO: 909953 - RNA, 19 nt, Homo sapiens
ucacaaccguggaucaaac

SEQ ID NO: 909954 - RNA, 19 nt, Homo sapiens
ggugagaugcuuguuaaga

SEQ ID NO: 909955 - RNA, 19 nt, Homo sapiens
gcgcgcauuugucauuuag

SEQ ID NO: 909956 - RNA, 19 nt, Homo sapiens
ugagaccguuggcuuugaa

SEQ ID NO: 909957 - RNA, 19 nt, Homo sapiens
ucggagucuucaauaauaa

SEQ ID NO: 909958 - RNA, 19 nt, Homo sapiens
ccacugacccuuuccuuac

SEQ ID NO: 909959 - RNA, 19 nt, Homo sapiens
aaguauaggacguugcuua

SEQ ID NO: 909960 - RNA, 19 nt, Homo sapiens
auggugagaugcuuguuaa

SEQ ID NO: 909961 - RNA, 19 nt, Homo sapiens
uuucauauuugacgagaug

SEQ ID NO: 909962 - RNA, 19 nt, Homo sapiens
ggucugaagaguaacuuug

SEQ ID NO: 909963 - RNA, 19 nt, Homo sapiens
uaucacacuuagucuugaa

SEQ ID NO: 909964 - RNA, 19 nt, Homo sapiens
cauggugagaugcuuguua

SEQ ID NO: 909965 - RNA, 19 nt, Homo sapiens
ccgcaaagccaucuucauc

SEQ ID NO: 909966 - RNA, 19 nt, Homo sapiens
gauccgcgguaaugugagu

SEQ ID NO: 909967 - RNA, 19 nt, Homo sapiens
guaucacacuuagucuuga

SEQ ID NO: 909968 - RNA, 19 nt, Homo sapiens
gugagaugcuuguuaagac

SEQ ID NO: 909969 - RNA, 19 nt, Homo sapiens
uaucucagcuuggaucucu

SEQ ID NO: 909970 - RNA, 19 nt, Homo sapiens
gcucccgguuugagugauu

SEQ ID NO: 909971 - RNA, 19 nt, Homo sapiens
guucugccauagaugaaga

SEQ ID NO: 909972 - RNA, 19 nt, Homo sapiens
ccuggaaccuguacugucu

SEQ ID NO: 909973 - RNA, 19 nt, Homo sapiens
gaaggaccuggaaccugua

SEQ ID NO: 909974 - RNA, 19 nt, Homo sapiens
ccugauaccaccacccuuu

SEQ ID NO: 909975 - RNA, 19 nt, Homo sapiens
ccggcuaccuguccuacaa

SEQ ID NO: 909976 - RNA, 19 nt, Homo sapiens
gcuuaguccuuucucagau

SEQ ID NO: 909977 - RNA, 19 nt, Homo sapiens
ccauauaucauagaguuga

SEQ ID NO: 909978 - RNA, 19 nt, Homo sapiens
gccgagcacucuugaucug

SEQ ID NO: 909979 - RNA, 19 nt, Homo sapiens
agacagaaguaccugaaaa

SEQ ID NO: 909980 - RNA, 19 nt, Homo sapiens
gagacagaaguaccugaaa

SEQ ID NO: 909981 - RNA, 19 nt, Homo sapiens
gauuuccacugagcuccua

SEQ ID NO: 909982 - RNA, 19 nt, Homo sapiens
gaaaaucuacucagacaag

SEQ ID NO: 909983 - RNA, 19 nt, Homo sapiens
ccucaugagcagaagauaa

SEQ ID NO: 909984 - RNA, 19 nt, Homo sapiens
guaacuuuguccaccuguu

SEQ ID NO: 909985 - RNA, 19 nt, Homo sapiens
gaugcuuguuaagacuuua

SEQ ID NO: 909986 - RNA, 19 nt, Homo sapiens
acucugcacuucccucaug

SEQ ID NO: 909987 - RNA, 19 nt, Homo sapiens
gucgagagaagacaagauu

SEQ ID NO: 909988 - RNA, 19 nt, Homo sapiens
gaagaauuccucuaaguuu

SEQ ID NO: 909989 - RNA, 19 nt, Homo sapiens
gcugaaggcucuacgguuu

SEQ ID NO: 909990 - RNA, 19 nt, Homo sapiens
uaaaggcagucgacauuaa

SEQ ID NO: 909991 - RNA, 19 nt, Homo sapiens
gaaagggauuuguuugcaa

SEQ ID NO: 909992 - RNA, 19 nt, Homo sapiens
cagaagaauuccucuaagu

SEQ ID NO: 909993 - RNA, 19 nt, Homo sapiens
gcuggccgcugucgagaaa

SEQ ID NO: 909994 - RNA, 19 nt, Homo sapiens
ggagugaaagggauuuguu

SEQ ID NO: 909995 - RNA, 19 nt, Homo sapiens
gacgaugcaugccauauac

SEQ ID NO: 909996 - RNA, 19 nt, Homo sapiens
gagugaaagggauuuguuu

SEQ ID NO: 909997 - RNA, 19 nt, Homo sapiens
uuaagaagccucugguuuc

SEQ ID NO: 909998 - RNA, 19 nt, Homo sapiens
ugaaagggauuuguuugca

SEQ ID NO: 909999 - RNA, 19 nt, Homo sapiens
agacgaugcaugccauaua

SEQ ID NO: 910000 - RNA, 19 nt, Homo sapiens
aagaauuccucuaaguuuc

SEQ ID NO: 910001 - RNA, 19 nt, Homo sapiens
ccagaagaauuccucuaag

SEQ ID NO: 910002 - RNA, 19 nt, Homo sapiens
accaggauguugccgguua

SEQ ID NO: 910003 - RNA, 19 nt, Homo sapiens
agaagaauuccucuaaguu

SEQ ID NO: 910004 - RNA, 19 nt, Homo sapiens
gcuacgaccugcuggaacu

SEQ ID NO: 910005 - RNA, 19 nt, Homo sapiens
guuugcagcccuaguguuu

SEQ ID NO: 910006 - RNA, 19 nt, Homo sapiens
uuaaaggcagucgacauua

SEQ ID NO: 910007 - RNA, 19 nt, Homo sapiens
gcagacgaugcaugccaua

SEQ ID NO: 910008 - RNA, 19 nt, Homo sapiens
uuuaaaggcagucgacauu

SEQ ID NO: 910009 - RNA, 19 nt, Homo sapiens
uccagaagaauuccucuaa

SEQ ID NO: 910010 - RNA, 19 nt, Homo sapiens
cugcagcccucggugauug

SEQ ID NO: 910011 - RNA, 19 nt, Homo sapiens
ccucuaaguuucauuucag

SEQ ID NO: 910012 - RNA, 19 nt, Homo sapiens
gaauuccucuaaguuucau

SEQ ID NO: 910013 - RNA, 19 nt, Homo sapiens
gugcuuugaaggccacaua

SEQ ID NO: 910014 - RNA, 19 nt, Homo sapiens
guaacaugcaggccuggaa

SEQ ID NO: 910015 - RNA, 19 nt, Homo sapiens
gcuuugaaggccacauaaa

SEQ ID NO: 910016 - RNA, 19 nt, Homo sapiens
gcugggagccauccugaag

SEQ ID NO: 910017 - RNA, 19 nt, Homo sapiens
ugccauauacgaaaggaaa

SEQ ID NO: 910018 - RNA, 19 nt, Homo sapiens
ugcagacccucgaacaugu

SEQ ID NO: 910019 - RNA, 19 nt, Homo sapiens
gaugcaugccauauacgaa

SEQ ID NO: 910020 - RNA, 19 nt, Homo sapiens
auuaagaagccucugguuu

SEQ ID NO: 910021 - RNA, 19 nt, Homo sapiens
ccucggugauugagaacug

SEQ ID NO: 910022 - RNA, 19 nt, Homo sapiens
caacguccacgggcauaga

SEQ ID NO: 910023 - RNA, 19 nt, Homo sapiens
cuacagcgccguggaugug

SEQ ID NO: 910024 - RNA, 19 nt, Homo sapiens
ugccggagccauggaauuu

SEQ ID NO: 910025 - RNA, 19 nt, Homo sapiens
ugaaggcucuacgguuucu

SEQ ID NO: 910026 - RNA, 19 nt, Homo sapiens
cuaauggcuccuccucuga

SEQ ID NO: 910027 - RNA, 19 nt, Homo sapiens
agaauuccucuaaguuuca

SEQ ID NO: 910028 - RNA, 19 nt, Homo sapiens
gggcuacgaccugcuggaa

SEQ ID NO: 910029 - RNA, 19 nt, Homo sapiens
gcagacccucgaacaugug

SEQ ID NO: 910030 - RNA, 19 nt, Homo sapiens
ccaggauguugccgguuag

SEQ ID NO: 910031 - RNA, 19 nt, Homo sapiens
ggaauuugcugaagguuug

SEQ ID NO: 910032 - RNA, 19 nt, Homo sapiens
gaagaauuccucuaaguuu

SEQ ID NO: 910033 - RNA, 19 nt, Homo sapiens
uaaaggcagucgacauuaa

SEQ ID NO: 910034 - RNA, 19 nt, Homo sapiens
gaaagggauuuguuugcaa

SEQ ID NO: 910035 - RNA, 19 nt, Homo sapiens
caacuucgccuguuuggaa

SEQ ID NO: 910036 - RNA, 19 nt, Homo sapiens
cugcaagucuuuaggcaua

SEQ ID NO: 910037 - RNA, 19 nt, Homo sapiens
cagaagaauuccucuaagu

SEQ ID NO: 910038 - RNA, 19 nt, Homo sapiens
uaugugaaguguccaacua

SEQ ID NO: 910039 - RNA, 19 nt, Homo sapiens
gcuggccgcugucgagaaa

SEQ ID NO: 910040 - RNA, 19 nt, Homo sapiens
ggagugaaagggauuuguu

SEQ ID NO: 910041 - RNA, 19 nt, Homo sapiens
ccagugggaugcugucugu

SEQ ID NO: 910042 - RNA, 19 nt, Homo sapiens
gacgaugcaugccauauac

SEQ ID NO: 910043 - RNA, 19 nt, Homo sapiens
gaacacugcaagucuuuag

SEQ ID NO: 910044 - RNA, 19 nt, Homo sapiens
gaagguuuguaugcaguga

SEQ ID NO: 910045 - RNA, 19 nt, Homo sapiens
gagugaaagggauuuguuu

SEQ ID NO: 910046 - RNA, 19 nt, Homo sapiens
uuaagaagccucugguuuc

SEQ ID NO: 910047 - RNA, 19 nt, Homo sapiens
ugaaagggauuuguuugca

SEQ ID NO: 910048 - RNA, 19 nt, Homo sapiens
agacgaugcaugccauaua

SEQ ID NO: 910049 - RNA, 19 nt, Homo sapiens
aagaauuccucuaaguuuc

SEQ ID NO: 910050 - RNA, 19 nt, Homo sapiens
ccagaagaauuccucuaag

SEQ ID NO: 910051 - RNA, 19 nt, Homo sapiens
gcaagucuuuaggcauaga

SEQ ID NO: 910052 - RNA, 19 nt, Homo sapiens
accaggauguugccgguua

SEQ ID NO: 910053 - RNA, 19 nt, Homo sapiens
agaagaauuccucuaaguu

SEQ ID NO: 910054 - RNA, 19 nt, Homo sapiens
gcuacgaccugcuggaacu

SEQ ID NO: 910055 - RNA, 19 nt, Homo sapiens
ggaacacugcaagucuuua

SEQ ID NO: 910056 - RNA, 19 nt, Homo sapiens
gggaacacugcaagucuuu

SEQ ID NO: 910057 - RNA, 19 nt, Homo sapiens
guuugcagcccuaguguuu

SEQ ID NO: 910058 - RNA, 19 nt, Homo sapiens
uuaaaggcagucgacauua

SEQ ID NO: 910059 - RNA, 19 nt, Homo sapiens
ccagauugcagggugauuu

SEQ ID NO: 910060 - RNA, 19 nt, Homo sapiens
gcagacgaugcaugccaua

SEQ ID NO: 910061 - RNA, 19 nt, Homo sapiens
uuuaaaggcagucgacauu

SEQ ID NO: 910062 - RNA, 19 nt, Homo sapiens
uccagaagaauuccucuaa

SEQ ID NO: 910063 - RNA, 19 nt, Homo sapiens
cgggaacacugcaagucuu

SEQ ID NO: 910064 - RNA, 19 nt, Homo sapiens
cauggaauuugcugaaggu

SEQ ID NO: 910065 - RNA, 19 nt, Homo sapiens
ccucuaaguuucauuucag

SEQ ID NO: 910066 - RNA, 19 nt, Homo sapiens
cugcagcccucggugauug

SEQ ID NO: 910067 - RNA, 19 nt, Homo sapiens
gaauuccucuaaguuucau

SEQ ID NO: 910068 - RNA, 19 nt, Homo sapiens
gcagguguccgaccaugag

SEQ ID NO: 910069 - RNA, 19 nt, Homo sapiens
caacuaccucuuuccagau

SEQ ID NO: 910070 - RNA, 19 nt, Homo sapiens
gugcuuugaaggccacaua

SEQ ID NO: 910071 - RNA, 19 nt, Homo sapiens
guaacaugcaggccuggaa

SEQ ID NO: 910072 - RNA, 19 nt, Homo sapiens
gcuuugaaggccacauaaa

SEQ ID NO: 910073 - RNA, 19 nt, Homo sapiens
gcugggagccauccugaag

SEQ ID NO: 910074 - RNA, 19 nt, Homo sapiens
ugccauauacgaaaggaaa

SEQ ID NO: 910075 - RNA, 19 nt, Homo sapiens
ugcagacccucgaacaugu

SEQ ID NO: 910076 - RNA, 19 nt, Homo sapiens
gaugcaugccauauacgaa

SEQ ID NO: 910077 - RNA, 19 nt, Homo sapiens
auuaagaagccucugguuu

SEQ ID NO: 910078 - RNA, 19 nt, Homo sapiens
aacuaccucuuuccagauu

SEQ ID NO: 910079 - RNA, 19 nt, Homo sapiens
ccucggugauugagaacug

SEQ ID NO: 910080 - RNA, 19 nt, Homo sapiens
caacguccacgggcauaga

SEQ ID NO: 910081 - RNA, 19 nt, Homo sapiens
cagccucaguccaaguuca

SEQ ID NO: 910082 - RNA, 19 nt, Homo sapiens
cuacagcgccguggaugug

SEQ ID NO: 910083 - RNA, 19 nt, Homo sapiens
ugccggagccauggaauuu

SEQ ID NO: 910084 - RNA, 19 nt, Homo sapiens
cuaauggcuccuccucuga

SEQ ID NO: 910085 - RNA, 19 nt, Homo sapiens
agaauuccucuaaguuuca

SEQ ID NO: 910086 - RNA, 19 nt, Homo sapiens
guucaacuucgccuguuug

SEQ ID NO: 910087 - RNA, 19 nt, Homo sapiens
gggcuacgaccugcuggaa

SEQ ID NO: 910088 - RNA, 19 nt, Homo sapiens
uggaauuugcugaagguuu

SEQ ID NO: 910089 - RNA, 19 nt, Homo sapiens
gcagacccucgaacaugug

SEQ ID NO: 910090 - RNA, 19 nt, Homo sapiens
ccaggauguugccgguuag

SEQ ID NO: 910091 - RNA, 19 nt, Homo sapiens
agguuuguaugcagugaaa

SEQ ID NO: 910092 - RNA, 19 nt, Homo sapiens
gaaaccagguggauucuga

SEQ ID NO: 910093 - RNA, 19 nt, Homo sapiens
gaacaugaauccacagauc

SEQ ID NO: 910094 - RNA, 19 nt, Homo sapiens
gaaaggugcuuccucucuu

SEQ ID NO: 910095 - RNA, 19 nt, Homo sapiens
cuaagaggcugaacaugaa

SEQ ID NO: 910096 - RNA, 19 nt, Homo sapiens
ggacaagcauaucuaagag

SEQ ID NO: 910097 - RNA, 19 nt, Homo sapiens
aaagagggcugcucaacug

SEQ ID NO: 910098 - RNA, 19 nt, Homo sapiens
gaaacccgaugaaggcaau

SEQ ID NO: 910099 - RNA, 19 nt, Homo sapiens
gggacaagcauaucuaaga

SEQ ID NO: 910100 - RNA, 19 nt, Homo sapiens
ucaguugucuccuggaaga

SEQ ID NO: 910101 - RNA, 19 nt, Homo sapiens
ucuaagaggcugaacauga

SEQ ID NO: 910102 - RNA, 19 nt, Homo sapiens
gcuguaagcaggaagagaa

SEQ ID NO: 910103 - RNA, 19 nt, Homo sapiens
gcucaguugucuccuggaa

SEQ ID NO: 910104 - RNA, 19 nt, Homo sapiens
ccacagcgcuucagaaaag

SEQ ID NO: 910105 - RNA, 19 nt, Homo sapiens
cacauucuacuuccaauuu

SEQ ID NO: 910106 - RNA, 19 nt, Homo sapiens
gcauaaccaaaucuuacua

SEQ ID NO: 910107 - RNA, 19 nt, Homo sapiens
cauacugucuccuaacaca

SEQ ID NO: 910108 - RNA, 19 nt, Homo sapiens
gcacauucuacuuccaauu

SEQ ID NO: 910109 - RNA, 19 nt, Homo sapiens
aaaggugcuuccucucuug

SEQ ID NO: 910110 - RNA, 19 nt, Homo sapiens
gaaacuuggcugugcuuca

SEQ ID NO: 910111 - RNA, 19 nt, Homo sapiens
gagggcugcucaacugcaa

SEQ ID NO: 910112 - RNA, 19 nt, Homo sapiens
caacugcaaggacgcugua

SEQ ID NO: 910113 - RNA, 19 nt, Homo sapiens
ccagcauaaccaaaucuua

SEQ ID NO: 910114 - RNA, 19 nt, Homo sapiens
gaucagaaacccgaugaag

SEQ ID NO: 910115 - RNA, 19 nt, Homo sapiens
ugacaaagccccaucucua

SEQ ID NO: 910116 - RNA, 19 nt, Homo sapiens
ccaaaucuuacuaaacuca

SEQ ID NO: 910117 - RNA, 19 nt, Homo sapiens
cagcauaaccaaaucuuac

SEQ ID NO: 910118 - RNA, 19 nt, Homo sapiens
ugaauccacagaucagaaa

SEQ ID NO: 910119 - RNA, 19 nt, Homo sapiens
ggacagggacaagcauauc

SEQ ID NO: 910120 - RNA, 19 nt, Homo sapiens
cauggucugucuccucuag

SEQ ID NO: 910121 - RNA, 19 nt, Homo sapiens
cuguggagaucauggacua

SEQ ID NO: 910122 - RNA, 19 nt, Homo sapiens
ggugcuuccucucuugguu

SEQ ID NO: 910123 - RNA, 19 nt, Homo sapiens
gacccauugucaugcagaa

SEQ ID NO: 910124 - RNA, 19 nt, Homo sapiens
cauggacuaugaagauuuu

SEQ ID NO: 910125 - RNA, 19 nt, Homo sapiens
aggcaaaggugggagaauc

SEQ ID NO: 910126 - RNA, 19 nt, Homo sapiens
aaaaccaacuuucgacuuc

SEQ ID NO: 910127 - RNA, 19 nt, Homo sapiens
cagggacaagcauaucuaa

SEQ ID NO: 910128 - RNA, 19 nt, Homo sapiens
aaacuuggcugugcuucac

SEQ ID NO: 910129 - RNA, 19 nt, Homo sapiens
uaucuaagaggcugaacau

SEQ ID NO: 910130 - RNA, 19 nt, Homo sapiens
cagaucagaaacccgauga

SEQ ID NO: 910131 - RNA, 19 nt, Homo sapiens
gggacagggacaagcauau

SEQ ID NO: 910132 - RNA, 19 nt, Homo sapiens
ugagacccauugucaugca

SEQ ID NO: 910133 - RNA, 19 nt, Homo sapiens
acagggacaagcauaucua

SEQ ID NO: 910134 - RNA, 19 nt, Homo sapiens
ucugagacccauugucaug

SEQ ID NO: 910135 - RNA, 19 nt, Homo sapiens
gcacagcaacgugaaucuc

SEQ ID NO: 910136 - RNA, 19 nt, Homo sapiens
guucugcgacgacauacug

SEQ ID NO: 910137 - RNA, 19 nt, Homo sapiens
agccacagcgcuucagaaa

SEQ ID NO: 910138 - RNA, 19 nt, Homo sapiens
agaaaggugcuuccucucu

SEQ ID NO: 910139 - RNA, 19 nt, Homo sapiens
ccaacgaucggaacgaaac

SEQ ID NO: 910140 - RNA, 19 nt, Homo sapiens
gcucuaagauagcaggaua

SEQ ID NO: 910141 - RNA, 19 nt, Homo sapiens
gagcugggcuuccgcaaga

SEQ ID NO: 910142 - RNA, 19 nt, Homo sapiens
gcaagcaccuggccuaucu

SEQ ID NO: 910143 - RNA, 19 nt, Homo sapiens
ggaugaagauggcaaaguc

SEQ ID NO: 910144 - RNA, 19 nt, Homo sapiens
gcaccuggccuaucucauu

SEQ ID NO: 910145 - RNA, 19 nt, Homo sapiens
gaacucggccuccaucuuc

SEQ ID NO: 910146 - RNA, 19 nt, Homo sapiens
gaggacgccuucuggauga

SEQ ID NO: 910147 - RNA, 19 nt, Homo sapiens
ccaagcagaucgagaagga

SEQ ID NO: 910148 - RNA, 19 nt, Homo sapiens
gauaggagacuucuaagau

SEQ ID NO: 910149 - RNA, 19 nt, Homo sapiens
gaucucaccugggacaaga

SEQ ID NO: 910150 - RNA, 19 nt, Homo sapiens
caggauaggagacuucuaa

SEQ ID NO: 910151 - RNA, 19 nt, Homo sapiens
gauuggagcugcagaagac

SEQ ID NO: 910152 - RNA, 19 nt, Homo sapiens
uaggagacuucuaagauug

SEQ ID NO: 910153 - RNA, 19 nt, Homo sapiens
ccaaggcccugcuggacuu

SEQ ID NO: 910154 - RNA, 19 nt, Homo sapiens
gaagaacagcuccaacgau

SEQ ID NO: 910155 - RNA, 19 nt, Homo sapiens
auaggagacuucuaagauu

SEQ ID NO: 910156 - RNA, 19 nt, Homo sapiens
ucacaaucgugucucagaa

SEQ ID NO: 910157 - RNA, 19 nt, Homo sapiens
gaacagcuccaacgaugag

SEQ ID NO: 910158 - RNA, 19 nt, Homo sapiens
ggaggucgagagagacuuu

SEQ ID NO: 910159 - RNA, 19 nt, Homo sapiens
agaacgacaucaucacaau

SEQ ID NO: 910160 - RNA, 19 nt, Homo sapiens
ggaagagucagcagagcaa

SEQ ID NO: 910161 - RNA, 19 nt, Homo sapiens
ccaaguacacgcagaagga

SEQ ID NO: 910162 - RNA, 19 nt, Homo sapiens
caccuggaguucacccaua

SEQ ID NO: 910163 - RNA, 19 nt, Homo sapiens
cgaguccucugcugcuuug

SEQ ID NO: 910164 - RNA, 19 nt, Homo sapiens
cagcagagcaaccagaguu

SEQ ID NO: 910165 - RNA, 19 nt, Homo sapiens
ggauaggagacuucuaaga

SEQ ID NO: 910166 - RNA, 19 nt, Homo sapiens
ggagcucccugcgaagaga

SEQ ID NO: 910167 - RNA, 19 nt, Homo sapiens
guucgaacauggacugaag

SEQ ID NO: 910168 - RNA, 19 nt, Homo sapiens
guucuacuacgaugaguuu

SEQ ID NO: 910169 - RNA, 19 nt, Homo sapiens
cggaggaaguccaccauca

SEQ ID NO: 910170 - RNA, 19 nt, Homo sapiens
caccuggccuaucucauug

SEQ ID NO: 910171 - RNA, 19 nt, Homo sapiens
gcgcaucugggaccuguuu

SEQ ID NO: 910172 - RNA, 19 nt, Homo sapiens
gaugagcgcagcaaagagu

SEQ ID NO: 910173 - RNA, 19 nt, Homo sapiens
gaguuugguuuccgugugu

SEQ ID NO: 910174 - RNA, 19 nt, Homo sapiens
uaaacugugucugucuuug

SEQ ID NO: 910175 - RNA, 19 nt, Homo sapiens
ggguccagaucaaguguga

SEQ ID NO: 910176 - RNA, 19 nt, Homo sapiens
caagaacgacaucaucaca

SEQ ID NO: 910177 - RNA, 19 nt, Homo sapiens
gagcugacuccagacuaua

SEQ ID NO: 910178 - RNA, 19 nt, Homo sapiens
uggccucuuugguuuauaa

SEQ ID NO: 910179 - RNA, 19 nt, Homo sapiens
gcuccuggccucuuugguu

SEQ ID NO: 910180 - RNA, 19 nt, Homo sapiens
acauugagcugucccugau

SEQ ID NO: 910181 - RNA, 19 nt, Homo sapiens
aaccagaguucuacuacga

SEQ ID NO: 910182 - RNA, 19 nt, Homo sapiens
gaacgacaucaucacaauc

SEQ ID NO: 910183 - RNA, 19 nt, Homo sapiens
aauaaacugugucugucuu

SEQ ID NO: 910184 - RNA, 19 nt, Homo sapiens
ccaugucugugcucaggaa

SEQ ID NO: 910185 - RNA, 19 nt, Homo sapiens
agacuuugccuccguguau

SEQ ID NO: 910186 - RNA, 19 nt, Homo sapiens
caucacugcucugcucuuc

SEQ ID NO: 910187 - RNA, 19 nt, Homo sapiens
guacaaggaagaaggugau

SEQ ID NO: 910188 - RNA, 19 nt, Homo sapiens
gggcagggcagaugauucu

SEQ ID NO: 910189 - RNA, 19 nt, Homo sapiens
ggaacucugagcuguccua

SEQ ID NO: 910190 - RNA, 19 nt, Homo sapiens
aaacugugucugucuuuga

SEQ ID NO: 910191 - RNA, 19 nt, Homo sapiens
ggagacuucuaagauugga

SEQ ID NO: 910192 - RNA, 19 nt, Homo sapiens
cagccaaguucguggaagu

SEQ ID NO: 910193 - RNA, 19 nt, Homo sapiens
gcacucaaggccaagaaca

SEQ ID NO: 910194 - RNA, 19 nt, Homo sapiens
gcaaccagaguucuacuac

SEQ ID NO: 910195 - RNA, 19 nt, Homo sapiens
cuccuggccucuuugguuu

SEQ ID NO: 910196 - RNA, 19 nt, Homo sapiens
ugaucacacugcacugguu

SEQ ID NO: 910197 - RNA, 19 nt, Homo sapiens
cagagcaaccagaguucua

SEQ ID NO: 910198 - RNA, 19 nt, Homo sapiens
uaagauuggagcugcagaa

SEQ ID NO: 910199 - RNA, 19 nt, Homo sapiens
uccaggagcaugacauuga

SEQ ID NO: 910200 - RNA, 19 nt, Homo sapiens
caaggaagaaggugaugag

SEQ ID NO: 910201 - RNA, 19 nt, Homo sapiens
gaagcuccgcucacugauc

SEQ ID NO: 910202 - RNA, 19 nt, Homo sapiens
gacuuugccuccguguauu

SEQ ID NO: 910203 - RNA, 19 nt, Homo sapiens
aagcuccgcucacugaucu

SEQ ID NO: 910204 - RNA, 19 nt, Homo sapiens
ucguggaaguccuggauga

SEQ ID NO: 910205 - RNA, 19 nt, Homo sapiens
ccaggagcaugacauugag

SEQ ID NO: 910206 - RNA, 19 nt, Homo sapiens
ccuuccagcucuaagauag

SEQ ID NO: 910207 - RNA, 19 nt, Homo sapiens
caaguacacgcagaaggaa

SEQ ID NO: 910208 - RNA, 19 nt, Homo sapiens
ugaagaacagcuccaacga

SEQ ID NO: 910209 - RNA, 19 nt, Homo sapiens
cuacuacgaugaguuuggu

SEQ ID NO: 910210 - RNA, 19 nt, Homo sapiens
ggauaucccgucgcagaug

SEQ ID NO: 910211 - RNA, 19 nt, Homo sapiens
cugcagagcccagggaaga

SEQ ID NO: 910212 - RNA, 19 nt, Homo sapiens
uggaugagcgcagcaaaga

SEQ ID NO: 910213 - RNA, 19 nt, Homo sapiens
ccaccucauuguccaguac

SEQ ID NO: 910214 - RNA, 19 nt, Homo sapiens
gcgagauugugaagaacag

SEQ ID NO: 910215 - RNA, 19 nt, Homo sapiens
cgucuggugcucuguaaga

SEQ ID NO: 910216 - RNA, 19 nt, Homo sapiens
ucaucacaaucgugucuca

SEQ ID NO: 910217 - RNA, 19 nt, Homo sapiens
accgcgagauugugaagaa

SEQ ID NO: 910218 - RNA, 19 nt, Homo sapiens
gcaagaacgacaucaucac

SEQ ID NO: 910219 - RNA, 19 nt, Homo sapiens
ccagcgugguggacaucaa

SEQ ID NO: 910220 - RNA, 19 nt, Homo sapiens
gcccugacuccgagcauau

SEQ ID NO: 910221 - RNA, 19 nt, Homo sapiens
gggcugugcagucugugaa

SEQ ID NO: 910222 - RNA, 19 nt, Homo sapiens
gagacuuugccuccgugua

SEQ ID NO: 910223 - RNA, 19 nt, Homo sapiens
gaggaaguccaccaucacu

SEQ ID NO: 910224 - RNA, 19 nt, Homo sapiens
gcuaacccgacccggauug

SEQ ID NO: 910225 - RNA, 19 nt, Homo sapiens
ggaagagcugauccaguca

SEQ ID NO: 910226 - RNA, 19 nt, Homo sapiens
guccugcgccaccucauug

SEQ ID NO: 910227 - RNA, 19 nt, Homo sapiens
gguccugcgccaccucauu

SEQ ID NO: 910228 - RNA, 19 nt, Homo sapiens
accuggaguucacccauaa

SEQ ID NO: 910229 - RNA, 19 nt, Homo sapiens
cuaccgggcugugcagucu

SEQ ID NO: 910230 - RNA, 19 nt, Homo sapiens
guucacccauaaccacgau

SEQ ID NO: 910231 - RNA, 19 nt, Homo sapiens
gagaaacacugaccuuaua

SEQ ID NO: 910232 - RNA, 19 nt, Homo sapiens
gaauagaucaccaagagua

SEQ ID NO: 910233 - RNA, 19 nt, Homo sapiens
acacugaccuuauauguga

SEQ ID NO: 910234 - RNA, 19 nt, Homo sapiens
gagggaagcuccauaacug

SEQ ID NO: 910235 - RNA, 19 nt, Homo sapiens
gggcagugcuguuguuguu

SEQ ID NO: 910236 - RNA, 19 nt, Homo sapiens
gcaccgagacagaggguua

SEQ ID NO: 910237 - RNA, 19 nt, Homo sapiens
gaucacauccggcauuguu

SEQ ID NO: 910238 - RNA, 19 nt, Homo sapiens
gcagugcuguuguuguugu

SEQ ID NO: 910239 - RNA, 19 nt, Homo sapiens
gaaaaugagcugcugaaaa

SEQ ID NO: 910240 - RNA, 19 nt, Homo sapiens
agacagaggguuaaaugaa

SEQ ID NO: 910241 - RNA, 19 nt, Homo sapiens
ucaaacugaugcagcuauu

SEQ ID NO: 910242 - RNA, 19 nt, Homo sapiens
ccaaaaggcuagagguaaa

SEQ ID NO: 910243 - RNA, 19 nt, Homo sapiens
ugaggucacagaaugaaua

SEQ ID NO: 910244 - RNA, 19 nt, Homo sapiens
guacucauccauaaaguca

SEQ ID NO: 910245 - RNA, 19 nt, Homo sapiens
ucgcagaugugguggagaa

SEQ ID NO: 910246 - RNA, 19 nt, Homo sapiens
gaccacaauucccggcauu

SEQ ID NO: 910247 - RNA, 19 nt, Homo sapiens
ggcuagagguaaagcugua

SEQ ID NO: 910248 - RNA, 19 nt, Homo sapiens
gacagaggguuaaaugaac

SEQ ID NO: 910249 - RNA, 19 nt, Homo sapiens
gaaacacugaccuuauaug

SEQ ID NO: 910250 - RNA, 19 nt, Homo sapiens
cgagaaacacugaccuuau

SEQ ID NO: 910251 - RNA, 19 nt, Homo sapiens
aaacugaugcagcuauuga

SEQ ID NO: 910252 - RNA, 19 nt, Homo sapiens
cauccugaccuccuauuaa

SEQ ID NO: 910253 - RNA, 19 nt, Homo sapiens
cgagacagaggguuaaaug

SEQ ID NO: 910254 - RNA, 19 nt, Homo sapiens
ggucacagaaugaauagau

SEQ ID NO: 910255 - RNA, 19 nt, Homo sapiens
gaaggucacagcuggaauc

SEQ ID NO: 910256 - RNA, 19 nt, Homo sapiens
gcgcagaguccgugugaga

SEQ ID NO: 910257 - RNA, 19 nt, Homo sapiens
ggcuagcggucccagcaua

SEQ ID NO: 910258 - RNA, 19 nt, Homo sapiens
ccugggcucugaagaauca

SEQ ID NO: 910259 - RNA, 19 nt, Homo sapiens
gaacuacagcuucgagaac

SEQ ID NO: 910260 - RNA, 19 nt, Homo sapiens
gcuaagcggcgacacguau

SEQ ID NO: 910261 - RNA, 19 nt, Homo sapiens
caccugccguggucuauau

SEQ ID NO: 910262 - RNA, 19 nt, Homo sapiens
gagacagaggguuaaauga

SEQ ID NO: 910263 - RNA, 19 nt, Homo sapiens
ucgcaacgcugaggauuca

SEQ ID NO: 910264 - RNA, 19 nt, Homo sapiens
ggaccggcacccuuucuug

SEQ ID NO: 910265 - RNA, 19 nt, Homo sapiens
ugaccauccugaccuccua

SEQ ID NO: 910266 - RNA, 19 nt, Homo sapiens
aaacacugaccuuauaugu

SEQ ID NO: 910267 - RNA, 19 nt, Homo sapiens
gggagcagaugguacaaaa

SEQ ID NO: 910268 - RNA, 19 nt, Homo sapiens
ccaaaccaauguggaauac

SEQ ID NO: 910269 - RNA, 19 nt, Homo sapiens
cuccauaacugcugcuuca

SEQ ID NO: 910270 - RNA, 19 nt, Homo sapiens
auccugaccuccuauuaaa

SEQ ID NO: 910271 - RNA, 19 nt, Homo sapiens
augaauagaucaccaagag

SEQ ID NO: 910272 - RNA, 19 nt, Homo sapiens
acaaaaugcugaagauguu

SEQ ID NO: 910273 - RNA, 19 nt, Homo sapiens
gcaccugccguggucuaua

SEQ ID NO: 910274 - RNA, 19 nt, Homo sapiens
ggaggugauuggagugaac

SEQ ID NO: 910275 - RNA, 19 nt, Homo sapiens
ugaggcuccugcucugauu

SEQ ID NO: 910276 - RNA, 19 nt, Homo sapiens
uagaucaccaagaguauga

SEQ ID NO: 910277 - RNA, 19 nt, Homo sapiens
ugaugcagcuauugauuuu

SEQ ID NO: 910278 - RNA, 19 nt, Homo sapiens
ugcugaagauguuuaugaa

SEQ ID NO: 910279 - RNA, 19 nt, Homo sapiens
gagcagaugguacaaaaug

SEQ ID NO: 910280 - RNA, 19 nt, Homo sapiens
ccugaccuccuauuaaaga

SEQ ID NO: 910281 - RNA, 19 nt, Homo sapiens
ccugagggaagcuccauaa

SEQ ID NO: 910282 - RNA, 19 nt, Homo sapiens
ucacagaaugaauagauca

SEQ ID NO: 910283 - RNA, 19 nt, Homo sapiens
gcacugcagaacacgauca

SEQ ID NO: 910284 - RNA, 19 nt, Homo sapiens
agaaucacagaaacacuuu

SEQ ID NO: 910285 - RNA, 19 nt, Homo sapiens
cccaaaccaauguggaaua

SEQ ID NO: 910286 - RNA, 19 nt, Homo sapiens
gcagaugugguggagaaga

SEQ ID NO: 910287 - RNA, 19 nt, Homo sapiens
gaccuccuauuaaagaaaa

SEQ ID NO: 910288 - RNA, 19 nt, Homo sapiens
ugaagauguuuaugaagcu

SEQ ID NO: 910289 - RNA, 19 nt, Homo sapiens
gguguacucauccauaaag

SEQ ID NO: 910290 - RNA, 19 nt, Homo sapiens
cauccuugcugaacuacag

SEQ ID NO: 910291 - RNA, 19 nt, Homo sapiens
gggaggugauuggagugaa

SEQ ID NO: 910292 - RNA, 19 nt, Homo sapiens
cugaugcagcuauugauuu

SEQ ID NO: 910293 - RNA, 19 nt, Homo sapiens
ccauccugaccuccuauua

SEQ ID NO: 910294 - RNA, 19 nt, Homo sapiens
aagaaucacagaaacacuu

SEQ ID NO: 910295 - RNA, 19 nt, Homo sapiens
ugaacuacagcuucgagaa

SEQ ID NO: 910296 - RNA, 19 nt, Homo sapiens
cagcuggaaucuccuuugc

SEQ ID NO: 910297 - RNA, 19 nt, Homo sapiens
gccgaugggcucauuguca

SEQ ID NO: 910298 - RNA, 19 nt, Homo sapiens
gaagaaucacagaaacacu

SEQ ID NO: 910299 - RNA, 19 nt, Homo sapiens
acgagaaacacugaccuua

SEQ ID NO: 910300 - RNA, 19 nt, Homo sapiens
gacgagaaacacugaccuu

SEQ ID NO: 910301 - RNA, 19 nt, Homo sapiens
gguacaaaaugcugaagau

SEQ ID NO: 910302 - RNA, 19 nt, Homo sapiens
ccuuugccaucccuucuga

SEQ ID NO: 910303 - RNA, 19 nt, Homo sapiens
ugggagggcuggaucuuuu

SEQ ID NO: 910304 - RNA, 19 nt, Homo sapiens
gagugaacaccaugaaggu

SEQ ID NO: 910305 - RNA, 19 nt, Homo sapiens
guacaacuucaucgcagau

SEQ ID NO: 910306 - RNA, 19 nt, Homo sapiens
agaaacacugaccuuauau

SEQ ID NO: 910307 - RNA, 19 nt, Homo sapiens
gcaggacgaggaggcagaa

SEQ ID NO: 910308 - RNA, 19 nt, Homo sapiens
gaagcuguucgaacccaau

SEQ ID NO: 910309 - RNA, 19 nt, Homo sapiens
cagaugugguggagaagac

SEQ ID NO: 910310 - RNA, 19 nt, Homo sapiens
gaggucacagaaugaauag

SEQ ID NO: 910311 - RNA, 19 nt, Homo sapiens
gcggccuggugaugugauu

SEQ ID NO: 910312 - RNA, 19 nt, Homo sapiens
acucauccauaaagucauc

SEQ ID NO: 910313 - RNA, 19 nt, Homo sapiens
uugggaaggcggagucuuu

SEQ ID NO: 910314 - RNA, 19 nt, Homo sapiens
gcaaggggaguuuguuguu

SEQ ID NO: 910315 - RNA, 19 nt, Homo sapiens
uaagcggcgacacguauga

SEQ ID NO: 910316 - RNA, 19 nt, Homo sapiens
gucacagaaugaauagauc

SEQ ID NO: 910317 - RNA, 19 nt, Homo sapiens
gggaggagaccccguuuga

SEQ ID NO: 910318 - RNA, 19 nt, Homo sapiens
ucagcaugguguacucauc

SEQ ID NO: 910319 - RNA, 19 nt, Homo sapiens
gaugugauuuuggccauug

SEQ ID NO: 910320 - RNA, 19 nt, Homo sapiens
cggagucaguacaacuuca

SEQ ID NO: 910321 - RNA, 19 nt, Homo sapiens
ggagucaguacaacuucau

SEQ ID NO: 910322 - RNA, 19 nt, Homo sapiens
caaacugaugcagcuauug

SEQ ID NO: 910323 - RNA, 19 nt, Homo sapiens
ucacauccggcauuguuag

SEQ ID NO: 910324 - RNA, 19 nt, Homo sapiens
gagaaacacugaccuuaua

SEQ ID NO: 910325 - RNA, 19 nt, Homo sapiens
gaauagaucaccaagagua

SEQ ID NO: 910326 - RNA, 19 nt, Homo sapiens
acacugaccuuauauguga

SEQ ID NO: 910327 - RNA, 19 nt, Homo sapiens
gagggaagcuccauaacug

SEQ ID NO: 910328 - RNA, 19 nt, Homo sapiens
gggcagugcuguuguuguu

SEQ ID NO: 910329 - RNA, 19 nt, Homo sapiens
gcaccgagacagaggguua

SEQ ID NO: 910330 - RNA, 19 nt, Homo sapiens
gcagugcuguuguuguugu

SEQ ID NO: 910331 - RNA, 19 nt, Homo sapiens
gaaaaugagcugcugaaaa

SEQ ID NO: 910332 - RNA, 19 nt, Homo sapiens
agacagaggguuaaaugaa

SEQ ID NO: 910333 - RNA, 19 nt, Homo sapiens
ccaaaaggcuagagguaaa

SEQ ID NO: 910334 - RNA, 19 nt, Homo sapiens
ugaggucacagaaugaaua

SEQ ID NO: 910335 - RNA, 19 nt, Homo sapiens
ucgcagaugugguggagaa

SEQ ID NO: 910336 - RNA, 19 nt, Homo sapiens
gaccacaauucccggcauu

SEQ ID NO: 910337 - RNA, 19 nt, Homo sapiens
ggcuagagguaaagcugua

SEQ ID NO: 910338 - RNA, 19 nt, Homo sapiens
gacagaggguuaaaugaac

SEQ ID NO: 910339 - RNA, 19 nt, Homo sapiens
gaaacacugaccuuauaug

SEQ ID NO: 910340 - RNA, 19 nt, Homo sapiens
cgagaaacacugaccuuau

SEQ ID NO: 910341 - RNA, 19 nt, Homo sapiens
cauccugaccuccuauuaa

SEQ ID NO: 910342 - RNA, 19 nt, Homo sapiens
cgagacagaggguuaaaug

SEQ ID NO: 910343 - RNA, 19 nt, Homo sapiens
ggucacagaaugaauagau

SEQ ID NO: 910344 - RNA, 19 nt, Homo sapiens
gaaggucacagcuggaauc

SEQ ID NO: 910345 - RNA, 19 nt, Homo sapiens
gcgcagaguccgugugaga

SEQ ID NO: 910346 - RNA, 19 nt, Homo sapiens
ggcuagcggucccagcaua

SEQ ID NO: 910347 - RNA, 19 nt, Homo sapiens
ccugggcucugaagaauca

SEQ ID NO: 910348 - RNA, 19 nt, Homo sapiens
gcuaagcggcgacacguau

SEQ ID NO: 910349 - RNA, 19 nt, Homo sapiens
caccugccguggucuauau

SEQ ID NO: 910350 - RNA, 19 nt, Homo sapiens
gagacagaggguuaaauga

SEQ ID NO: 910351 - RNA, 19 nt, Homo sapiens
ucgcaacgcugaggauuca

SEQ ID NO: 910352 - RNA, 19 nt, Homo sapiens
ggaccggcacccuuucuug

SEQ ID NO: 910353 - RNA, 19 nt, Homo sapiens
ugaccauccugaccuccua

SEQ ID NO: 910354 - RNA, 19 nt, Homo sapiens
aaacacugaccuuauaugu

SEQ ID NO: 910355 - RNA, 19 nt, Homo sapiens
gggagcagaugguacaaaa

SEQ ID NO: 910356 - RNA, 19 nt, Homo sapiens
cuccauaacugcugcuuca

SEQ ID NO: 910357 - RNA, 19 nt, Homo sapiens
auccugaccuccuauuaaa

SEQ ID NO: 910358 - RNA, 19 nt, Homo sapiens
augaauagaucaccaagag

SEQ ID NO: 910359 - RNA, 19 nt, Homo sapiens
acaaaaugcugaagauguu

SEQ ID NO: 910360 - RNA, 19 nt, Homo sapiens
ggauucagacuaaguuugg

SEQ ID NO: 910361 - RNA, 19 nt, Homo sapiens
gcaccugccguggucuaua

SEQ ID NO: 910362 - RNA, 19 nt, Homo sapiens
ggaggugauuggagugaac

SEQ ID NO: 910363 - RNA, 19 nt, Homo sapiens
ugaggcuccugcucugauu

SEQ ID NO: 910364 - RNA, 19 nt, Homo sapiens
uagaucaccaagaguauga

SEQ ID NO: 910365 - RNA, 19 nt, Homo sapiens
ugcugaagauguuuaugaa

SEQ ID NO: 910366 - RNA, 19 nt, Homo sapiens
gagcagaugguacaaaaug

SEQ ID NO: 910367 - RNA, 19 nt, Homo sapiens
gaggauucagacuaaguuu

SEQ ID NO: 910368 - RNA, 19 nt, Homo sapiens
ccugaccuccuauuaaaga

SEQ ID NO: 910369 - RNA, 19 nt, Homo sapiens
ccugagggaagcuccauaa

SEQ ID NO: 910370 - RNA, 19 nt, Homo sapiens
ucacagaaugaauagauca

SEQ ID NO: 910371 - RNA, 19 nt, Homo sapiens
agaaucacagaaacacuuu

SEQ ID NO: 910372 - RNA, 19 nt, Homo sapiens
gcagaugugguggagaaga

SEQ ID NO: 910373 - RNA, 19 nt, Homo sapiens
gaccuccuauuaaagaaaa

SEQ ID NO: 910374 - RNA, 19 nt, Homo sapiens
ugaagauguuuaugaagcu

SEQ ID NO: 910375 - RNA, 19 nt, Homo sapiens
gggaggugauuggagugaa

SEQ ID NO: 910376 - RNA, 19 nt, Homo sapiens
ccauccugaccuccuauua

SEQ ID NO: 910377 - RNA, 19 nt, Homo sapiens
aagaaucacagaaacacuu

SEQ ID NO: 910378 - RNA, 19 nt, Homo sapiens
cagcuggaaucuccuuugc

SEQ ID NO: 910379 - RNA, 19 nt, Homo sapiens
gccgaugggcucauuguca

SEQ ID NO: 910380 - RNA, 19 nt, Homo sapiens
gaagaaucacagaaacacu

SEQ ID NO: 910381 - RNA, 19 nt, Homo sapiens
acgagaaacacugaccuua

SEQ ID NO: 910382 - RNA, 19 nt, Homo sapiens
gacgagaaacacugaccuu

SEQ ID NO: 910383 - RNA, 19 nt, Homo sapiens
gguacaaaaugcugaagau

SEQ ID NO: 910384 - RNA, 19 nt, Homo sapiens
ccuuugccaucccuucuga

SEQ ID NO: 910385 - RNA, 19 nt, Homo sapiens
ugggagggcuggaucuuuu

SEQ ID NO: 910386 - RNA, 19 nt, Homo sapiens
gagugaacaccaugaaggu

SEQ ID NO: 910387 - RNA, 19 nt, Homo sapiens
ugaggauucagacuaaguu

SEQ ID NO: 910388 - RNA, 19 nt, Homo sapiens
agaaacacugaccuuauau

SEQ ID NO: 910389 - RNA, 19 nt, Homo sapiens
gcaggacgaggaggcagaa

SEQ ID NO: 910390 - RNA, 19 nt, Homo sapiens
gaagcuguucgaacccaau

SEQ ID NO: 910391 - RNA, 19 nt, Homo sapiens
cagaugugguggagaagac

SEQ ID NO: 910392 - RNA, 19 nt, Homo sapiens
guacaacuucaucgcagau

SEQ ID NO: 910393 - RNA, 19 nt, Homo sapiens
gaggucacagaaugaauag

SEQ ID NO: 910394 - RNA, 19 nt, Homo sapiens
gcggccuggugaugugauu

SEQ ID NO: 910395 - RNA, 19 nt, Homo sapiens
uaagcggcgacacguauga

SEQ ID NO: 910396 - RNA, 19 nt, Homo sapiens
uugggaaggcggagucuuu

SEQ ID NO: 910397 - RNA, 19 nt, Homo sapiens
gucacagaaugaauagauc

SEQ ID NO: 910398 - RNA, 19 nt, Homo sapiens
gggaggagaccccguuuga

SEQ ID NO: 910399 - RNA, 19 nt, Homo sapiens
cggagucaguacaacuuca

SEQ ID NO: 910400 - RNA, 19 nt, Homo sapiens
ggagucaguacaacuucau

SEQ ID NO: 910401 - RNA, 19 nt, Homo sapiens
gaugugauuuuggccauug

SEQ ID NO: 910402 - RNA, 19 nt, Homo sapiens
gauucagacuaaguuugga

SEQ ID NO: 910403 - RNA, 19 nt, Homo sapiens
ggaccaaacuucuaaacua

SEQ ID NO: 910404 - RNA, 19 nt, Homo sapiens
gacaaacggucuuucauua

SEQ ID NO: 910405 - RNA, 19 nt, Homo sapiens
gaaguuaacaucccuaaua

SEQ ID NO: 910406 - RNA, 19 nt, Homo sapiens
gacaagagauggagacaaa

SEQ ID NO: 910407 - RNA, 19 nt, Homo sapiens
gcaaugaacagaugacuaa

SEQ ID NO: 910408 - RNA, 19 nt, Homo sapiens
gaccaaacuucuaaacuaa

SEQ ID NO: 910409 - RNA, 19 nt, Homo sapiens
gaaauggcaugugcaauug

SEQ ID NO: 910410 - RNA, 19 nt, Homo sapiens
gaugcugccucucaacuua

SEQ ID NO: 910411 - RNA, 19 nt, Homo sapiens
uggcagagcuguacacaaa

SEQ ID NO: 910412 - RNA, 19 nt, Homo sapiens
gagaagaccagauguugua

SEQ ID NO: 910413 - RNA, 19 nt, Homo sapiens
gcauuucucaucuacauua

SEQ ID NO: 910414 - RNA, 19 nt, Homo sapiens
gaacagaugacuaaguaug

SEQ ID NO: 910415 - RNA, 19 nt, Homo sapiens
gcagagcuguacacaaaga

SEQ ID NO: 910416 - RNA, 19 nt, Homo sapiens
gaaagagcguguguacaug

SEQ ID NO: 910417 - RNA, 19 nt, Homo sapiens
gaacaaauccaccuuacag

SEQ ID NO: 910418 - RNA, 19 nt, Homo sapiens
ucaaagauguggccacugu

SEQ ID NO: 910419 - RNA, 19 nt, Homo sapiens
gcaguuggcugugguuuca

SEQ ID NO: 910420 - RNA, 19 nt, Homo sapiens
guaaggaccaaacuucuaa

SEQ ID NO: 910421 - RNA, 19 nt, Homo sapiens
gaccauuucauguugauua

SEQ ID NO: 910422 - RNA, 19 nt, Homo sapiens
gaauuggaaucaaagaauc

SEQ ID NO: 910423 - RNA, 19 nt, Homo sapiens
gcacaacguccgagaaaug

SEQ ID NO: 910424 - RNA, 19 nt, Homo sapiens
gagcauuucucaucuacau

SEQ ID NO: 910425 - RNA, 19 nt, Homo sapiens
cuuaggaucuuucagguaa

SEQ ID NO: 910426 - RNA, 19 nt, Homo sapiens
acaaagaauuucagcagaa

SEQ ID NO: 910427 - RNA, 19 nt, Homo sapiens
gaaauuguucauucucgua

SEQ ID NO: 910428 - RNA, 19 nt, Homo sapiens
ugaaauggcaugugcaauu

SEQ ID NO: 910429 - RNA, 19 nt, Homo sapiens
uuacagagaggaagacaua

SEQ ID NO: 910430 - RNA, 19 nt, Homo sapiens
cagaucugcuguagacuuu

SEQ ID NO: 910431 - RNA, 19 nt, Homo sapiens
caaacggucuuucauuagu

SEQ ID NO: 910432 - RNA, 19 nt, Homo sapiens
ucacuggucuggcaaugaa

SEQ ID NO: 910433 - RNA, 19 nt, Homo sapiens
gcagagagaagaccagaug

SEQ ID NO: 910434 - RNA, 19 nt, Homo sapiens
ucucguaaccuccauauuu

SEQ ID NO: 910435 - RNA, 19 nt, Homo sapiens
caacaagucagcaaacaug

SEQ ID NO: 910436 - RNA, 19 nt, Homo sapiens
gagcacaacguccgagaaa

SEQ ID NO: 910437 - RNA, 19 nt, Homo sapiens
augaacagaugacuaagua

SEQ ID NO: 910438 - RNA, 19 nt, Homo sapiens
caaagaauuucagcagaau

SEQ ID NO: 910439 - RNA, 19 nt, Homo sapiens
ggaugcuucugggaauuua

SEQ ID NO: 910440 - RNA, 19 nt, Homo sapiens
gagagaagaccagauguug

SEQ ID NO: 910441 - RNA, 19 nt, Homo sapiens
gagcguguguacauguauu

SEQ ID NO: 910442 - RNA, 19 nt, Homo sapiens
gaacuucuacagcuugaug

SEQ ID NO: 910443 - RNA, 19 nt, Homo sapiens
cagcuugacugcuccaaau

SEQ ID NO: 910444 - RNA, 19 nt, Homo sapiens
uacauuagcucagauuaug

SEQ ID NO: 910445 - RNA, 19 nt, Homo sapiens
ugaaagagcguguguacau

SEQ ID NO: 910446 - RNA, 19 nt, Homo sapiens
cuagugaaauugucuaaag

SEQ ID NO: 910447 - RNA, 19 nt, Homo sapiens
gaccagauguuguagaaaa

SEQ ID NO: 910448 - RNA, 19 nt, Homo sapiens
aaaugaugcucuugcacua

SEQ ID NO: 910449 - RNA, 19 nt, Homo sapiens
aagaaucacuuuggccuuu

SEQ ID NO: 910450 - RNA, 19 nt, Homo sapiens
caaauccaccuuacagaga

SEQ ID NO: 910451 - RNA, 19 nt, Homo sapiens
gcucagauuauguauuuga

SEQ ID NO: 910452 - RNA, 19 nt, Homo sapiens
ugaaugcaaacguguauuu

SEQ ID NO: 910453 - RNA, 19 nt, Homo sapiens
cgagaaaugcucagcuuga

SEQ ID NO: 910454 - RNA, 19 nt, Homo sapiens
uugaagcuguugaccauuu

SEQ ID NO: 910455 - RNA, 19 nt, Homo sapiens
gaacaccauuucgaauugg

SEQ ID NO: 910456 - RNA, 19 nt, Homo sapiens
cgaagaaagugcagugacu

SEQ ID NO: 910457 - RNA, 19 nt, Homo sapiens
gguaaaugaugcucuugca

SEQ ID NO: 910458 - RNA, 19 nt, Homo sapiens
aauaggaggguucugguua

SEQ ID NO: 910459 - RNA, 19 nt, Homo sapiens
gagcucagaucaaaauguu

SEQ ID NO: 910460 - RNA, 19 nt, Homo sapiens
guacuuuaauugugacucu

SEQ ID NO: 910461 - RNA, 19 nt, Homo sapiens
aaacggucuuucauuaguu

SEQ ID NO: 910462 - RNA, 19 nt, Homo sapiens
aagaccagauguuguagaa

SEQ ID NO: 910463 - RNA, 19 nt, Homo sapiens
cauaauaaugggccuugua

SEQ ID NO: 910464 - RNA, 19 nt, Homo sapiens
gagcuguacacaaagaauu

SEQ ID NO: 910465 - RNA, 19 nt, Homo sapiens
ucagguaaaugaugcucuu

SEQ ID NO: 910466 - RNA, 19 nt, Homo sapiens
ggauuccuauucuguaugg

SEQ ID NO: 910467 - RNA, 19 nt, Homo sapiens
gguguucauuauuugcuuu

SEQ ID NO: 910468 - RNA, 19 nt, Homo sapiens
ggaguuugaguauaguaaa

SEQ ID NO: 910469 - RNA, 19 nt, Homo sapiens
cgaauuggaaucaaagaau

SEQ ID NO: 910470 - RNA, 19 nt, Homo sapiens
uaaugggccuuguaagucu

SEQ ID NO: 910471 - RNA, 19 nt, Homo sapiens
caucccauguugccgcuaa

SEQ ID NO: 910472 - RNA, 19 nt, Homo sapiens
guacugcuggcauguaaug

SEQ ID NO: 910473 - RNA, 19 nt, Homo sapiens
gagaaaugcucagcuugac

SEQ ID NO: 910474 - RNA, 19 nt, Homo sapiens
acagaugacuaaguaugaa

SEQ ID NO: 910475 - RNA, 19 nt, Homo sapiens
gcagcuagcagagaagaga

SEQ ID NO: 910476 - RNA, 19 nt, Homo sapiens
guucaucacaucauucaug

SEQ ID NO: 910477 - RNA, 19 nt, Homo sapiens
auaauaaugggccuuguaa

SEQ ID NO: 910478 - RNA, 19 nt, Homo sapiens
aaagugcaguucagcaaca

SEQ ID NO: 910479 - RNA, 19 nt, Homo sapiens
cauuagcucagauuaugua

SEQ ID NO: 910480 - RNA, 19 nt, Homo sapiens
gaagaccagauguuguaga

SEQ ID NO: 910481 - RNA, 19 nt, Homo sapiens
uaaugcaguucaucacauc

SEQ ID NO: 910482 - RNA, 19 nt, Homo sapiens
aaguuaacaucccuaauag

SEQ ID NO: 910483 - RNA, 19 nt, Homo sapiens
aaacuaaagggcagucaug

SEQ ID NO: 910484 - RNA, 19 nt, Homo sapiens
ggaaauaguuuuguaugag

SEQ ID NO: 910485 - RNA, 19 nt, Homo sapiens
gccggcagcuagcagagaa

SEQ ID NO: 910486 - RNA, 19 nt, Homo sapiens
ucuaggagcugcuguuuug

SEQ ID NO: 910487 - RNA, 19 nt, Homo sapiens
ggaggaggaaguuaacauc

SEQ ID NO: 910488 - RNA, 19 nt, Homo sapiens
ggaacaaauccaccuuaca

SEQ ID NO: 910489 - RNA, 19 nt, Homo sapiens
gaauuuagcaaaggaagca

SEQ ID NO: 910490 - RNA, 19 nt, Homo sapiens
gccgcuaagugauauuuca

SEQ ID NO: 910491 - RNA, 19 nt, Homo sapiens
aagagcguguguacaugua

SEQ ID NO: 910492 - RNA, 19 nt, Homo sapiens
gcacuagugaaauugucua

SEQ ID NO: 910493 - RNA, 19 nt, Homo sapiens
ggccuuuccucauugacaa

SEQ ID NO: 910494 - RNA, 19 nt, Homo sapiens
aaugcuggauccaucaauu

SEQ ID NO: 910495 - RNA, 19 nt, Homo sapiens
gaauaauuggcaugcaguu

SEQ ID NO: 910496 - RNA, 19 nt, Homo sapiens
cuaaugcaguucaucacau

SEQ ID NO: 910497 - RNA, 19 nt, Homo sapiens
ggaucuuucagguaaauga

SEQ ID NO: 910498 - RNA, 19 nt, Homo sapiens
gcaacaagucagcaaacau

SEQ ID NO: 910499 - RNA, 19 nt, Homo sapiens
aauaaugggccuuguaagu

SEQ ID NO: 910500 - RNA, 19 nt, Homo sapiens
gcagaauaauuggcaugca

SEQ ID NO: 910501 - RNA, 19 nt, Homo sapiens
agcagucacuuaagaccua

SEQ ID NO: 910502 - RNA, 19 nt, Homo sapiens
gcaguucagcaacaaguca

SEQ ID NO: 910503 - RNA, 19 nt, Homo sapiens
gcagauggcuucucaaacu

SEQ ID NO: 910504 - RNA, 19 nt, Homo sapiens
gcaaagccaucuucaucuu

SEQ ID NO: 910505 - RNA, 19 nt, Homo sapiens
guucagcucuacagccuua

SEQ ID NO: 910506 - RNA, 19 nt, Homo sapiens
uaaaguacguggcaugugu

SEQ ID NO: 910507 - RNA, 19 nt, Homo sapiens
gguggagccuucucaguuu

SEQ ID NO: 910508 - RNA, 19 nt, Homo sapiens
acagaguucuuguccuuua

SEQ ID NO: 910509 - RNA, 19 nt, Homo sapiens
ccaaggcgcugguggugaa

SEQ ID NO: 910510 - RNA, 19 nt, Homo sapiens
gcacugagccauguuccua

SEQ ID NO: 910511 - RNA, 19 nt, Homo sapiens
ggacagcaccaccuucuuc

SEQ ID NO: 910512 - RNA, 19 nt, Homo sapiens
ggacucaugcugccacuug

SEQ ID NO: 910513 - RNA, 19 nt, Homo sapiens
gaagguggcugagggaacu

SEQ ID NO: 910514 - RNA, 19 nt, Homo sapiens
ucgaugagauggacaagau

SEQ ID NO: 910515 - RNA, 19 nt, Homo sapiens
gaacugaggccagcauuuu

SEQ ID NO: 910516 - RNA, 19 nt, Homo sapiens
gaaguucagugagggaaag

SEQ ID NO: 910517 - RNA, 19 nt, Homo sapiens
gaacccagagcaccaagug

SEQ ID NO: 910518 - RNA, 19 nt, Homo sapiens
ggaacugaggccagcauuu

SEQ ID NO: 910519 - RNA, 19 nt, Homo sapiens
aaagccaucuucaucuuca

SEQ ID NO: 910520 - RNA, 19 nt, Homo sapiens
ucagaauccucgcuguguu

SEQ ID NO: 910521 - RNA, 19 nt, Homo sapiens
ugauuucccuuuggacauu

SEQ ID NO: 910522 - RNA, 19 nt, Homo sapiens
cgggacagauggccaggaa

SEQ ID NO: 910523 - RNA, 19 nt, Homo sapiens
ucaaccagguggcauugga

SEQ ID NO: 910524 - RNA, 19 nt, Homo sapiens
guacguggcauguguaggu

SEQ ID NO: 910525 - RNA, 19 nt, Homo sapiens
cagaauccucgcuguguuu

SEQ ID NO: 910526 - RNA, 19 nt, Homo sapiens
gagccauguuccuauguca

SEQ ID NO: 910527 - RNA, 19 nt, Homo sapiens
ggacauucucagcaaauuc

SEQ ID NO: 910528 - RNA, 19 nt, Homo sapiens
ugacuuugggugagccuua

SEQ ID NO: 910529 - RNA, 19 nt, Homo sapiens
ccgcaaagccaucuucauc

SEQ ID NO: 910530 - RNA, 19 nt, Homo sapiens
ggcauguguaggugaauua

SEQ ID NO: 910531 - RNA, 19 nt, Homo sapiens
gggcuuagcugggcuuucc

SEQ ID NO: 910532 - RNA, 19 nt, Homo sapiens
agaaauggagggacucaug

SEQ ID NO: 910533 - RNA, 19 nt, Homo sapiens
ggaaguucagugagggaaa

SEQ ID NO: 910534 - RNA, 19 nt, Homo sapiens
gagcaccaagugagaugaa

SEQ ID NO: 910535 - RNA, 19 nt, Homo sapiens
gaucaaccagguggcauug

SEQ ID NO: 910536 - RNA, 19 nt, Homo sapiens
cauuccgccugguugauuu

SEQ ID NO: 910537 - RNA, 19 nt, Homo sapiens
ugccgggucuggaguguga

SEQ ID NO: 910538 - RNA, 19 nt, Homo sapiens
gcuacaagaaggaucugaa

SEQ ID NO: 910539 - RNA, 19 nt, Homo sapiens
gccugagccuucuuacugu

SEQ ID NO: 910540 - RNA, 19 nt, Homo sapiens
uggaagagcgccuccuaga

SEQ ID NO: 910541 - RNA, 19 nt, Homo sapiens
ccacaucgagcgcuacaag

SEQ ID NO: 910542 - RNA, 19 nt, Homo sapiens
caaagccaucuucaucuuc

SEQ ID NO: 910543 - RNA, 19 nt, Homo sapiens
cauggaagagcgccuccua

SEQ ID NO: 910544 - RNA, 19 nt, Homo sapiens
acaagaaggaucugaagag

SEQ ID NO: 910545 - RNA, 19 nt, Homo sapiens
caaacucgggcaucaugga

SEQ ID NO: 910546 - RNA, 19 nt, Homo sapiens
gggaagcgaggguccaauc

SEQ ID NO: 910547 - RNA, 19 nt, Homo sapiens
ucucugagccucugucucu

SEQ ID NO: 910548 - RNA, 19 nt, Homo sapiens
gacauucucagcaaauucu

SEQ ID NO: 910549 - RNA, 19 nt, Homo sapiens
ccugguugauuucccuuug

SEQ ID NO: 910550 - RNA, 19 nt, Homo sapiens
gccaagggaugagguuguc

SEQ ID NO: 910551 - RNA, 19 nt, Homo sapiens
ggaagagcgccuccuagac

SEQ ID NO: 910552 - RNA, 19 nt, Homo sapiens
ggacacaggccugggaaaa

SEQ ID NO: 910553 - RNA, 19 nt, Homo sapiens
cgggaccaauuaccgcaaa

SEQ ID NO: 910554 - RNA, 19 nt, Homo sapiens
ggugcucccuccucagucu

SEQ ID NO: 910555 - RNA, 19 nt, Homo sapiens
cugcagauggcuucucaaa

SEQ ID NO: 910556 - RNA, 19 nt, Homo sapiens
acaucgagcgcuacaagaa

SEQ ID NO: 910557 - RNA, 19 nt, Homo sapiens
agucccagcucucagaauc

SEQ ID NO: 910558 - RNA, 19 nt, Homo sapiens
caaauucugggcucagucu

SEQ ID NO: 910559 - RNA, 19 nt, Homo sapiens
uggaaguccugcggccuuu

SEQ ID NO: 910560 - RNA, 19 nt, Homo sapiens
gccaggccaugcaggaaag

SEQ ID NO: 910561 - RNA, 19 nt, Homo sapiens
cuuuggcacucccagcuuu

SEQ ID NO: 910562 - RNA, 19 nt, Homo sapiens
uggcauguguaggugaauu

SEQ ID NO: 910563 - RNA, 19 nt, Homo sapiens
cagaguucuuguccuuuag

SEQ ID NO: 910564 - RNA, 19 nt, Homo sapiens
uggacauucucagcaaauu

SEQ ID NO: 910565 - RNA, 19 nt, Homo sapiens
guggagccuucucaguuuc

SEQ ID NO: 910566 - RNA, 19 nt, Homo sapiens
acucgggcaucauggaaga

SEQ ID NO: 910567 - RNA, 19 nt, Homo sapiens
cagauggcuucucaaacuc

SEQ ID NO: 910568 - RNA, 19 nt, Homo sapiens
gcaccggcaaauccuaugu

SEQ ID NO: 910569 - RNA, 19 nt, Homo sapiens
aaaguacguggcaugugua

SEQ ID NO: 910570 - RNA, 19 nt, Homo sapiens
gaaguuuucccucuuuugu

SEQ ID NO: 910571 - RNA, 19 nt, Homo sapiens
ccacuugggccugguuuua

SEQ ID NO: 910572 - RNA, 19 nt, Homo sapiens
aaacucgggcaucauggaa

SEQ ID NO: 910573 - RNA, 19 nt, Homo sapiens
cguggcauguguaggugaa

SEQ ID NO: 910574 - RNA, 19 nt, Homo sapiens
gccuucuuacugugaauua

SEQ ID NO: 910575 - RNA, 19 nt, Homo sapiens
ggagccaagggaugagguu

SEQ ID NO: 910576 - RNA, 19 nt, Homo sapiens
gcccugcgcuaguccucau

SEQ ID NO: 910577 - RNA, 19 nt, Homo sapiens
gcagagcccuuuaaugguu

SEQ ID NO: 910578 - RNA, 19 nt, Homo sapiens
gaugugcagugucucauua

SEQ ID NO: 910579 - RNA, 19 nt, Homo sapiens
gacauaagcugguuaacag

SEQ ID NO: 910580 - RNA, 19 nt, Homo sapiens
gcucugugcuucugccuuu

SEQ ID NO: 910581 - RNA, 19 nt, Homo sapiens
ccagaccacucaucacauu

SEQ ID NO: 910582 - RNA, 19 nt, Homo sapiens
cagaagagaaccaugcaua

SEQ ID NO: 910583 - RNA, 19 nt, Homo sapiens
gaaugucuccaagcaaaua

SEQ ID NO: 910584 - RNA, 19 nt, Homo sapiens
ggacauaagcugguuaaca

SEQ ID NO: 910585 - RNA, 19 nt, Homo sapiens
cugaaugucuccaagcaaa

SEQ ID NO: 910586 - RNA, 19 nt, Homo sapiens
gacguggacuuccucauca

SEQ ID NO: 910587 - RNA, 19 nt, Homo sapiens
gaccacucaucacauuaaa

SEQ ID NO: 910588 - RNA, 19 nt, Homo sapiens
ggacugcgaaccuuagaug

SEQ ID NO: 910589 - RNA, 19 nt, Homo sapiens
gcugggaggaagauaauuu

SEQ ID NO: 910590 - RNA, 19 nt, Homo sapiens
caaacuggccacugaaugu

SEQ ID NO: 910591 - RNA, 19 nt, Homo sapiens
ggagcugggaggaagauaa

SEQ ID NO: 910592 - RNA, 19 nt, Homo sapiens
gugaggagguggagagagu

SEQ ID NO: 910593 - RNA, 19 nt, Homo sapiens
ucgcagagcccuuuaaugg

SEQ ID NO: 910594 - RNA, 19 nt, Homo sapiens
ggaggaagauaauuuucaa

SEQ ID NO: 910595 - RNA, 19 nt, Homo sapiens
aacccuaaguccacacaua

SEQ ID NO: 910596 - RNA, 19 nt, Homo sapiens
gagaguggacuugguaguu

SEQ ID NO: 910597 - RNA, 19 nt, Homo sapiens
ugcagugucucauuaguug

SEQ ID NO: 910598 - RNA, 19 nt, Homo sapiens
ucagacaccugggccuuga

SEQ ID NO: 910599 - RNA, 19 nt, Homo sapiens
gcaaguggucccugaugug

SEQ ID NO: 910600 - RNA, 19 nt, Homo sapiens
ggcaaguggucccugaugu

SEQ ID NO: 910601 - RNA, 19 nt, Homo sapiens
agaguggacuugguaguug

SEQ ID NO: 910602 - RNA, 19 nt, Homo sapiens
ggaaguugcagggccauga

SEQ ID NO: 910603 - RNA, 19 nt, Homo sapiens
gagcugggaggaagauaau

SEQ ID NO: 910604 - RNA, 19 nt, Homo sapiens
ucaccggcuuccuauuuga

SEQ ID NO: 910605 - RNA, 19 nt, Homo sapiens
cagaaugcccagaagagaa

SEQ ID NO: 910606 - RNA, 19 nt, Homo sapiens
gagagguaccagaccauga

SEQ ID NO: 910607 - RNA, 19 nt, Homo sapiens
gcuggagcauggagugugu

SEQ ID NO: 910608 - RNA, 19 nt, Homo sapiens
agaccacucaucacauuaa

SEQ ID NO: 910609 - RNA, 19 nt, Homo sapiens
gcccuuuaaugguuccaaa

SEQ ID NO: 910610 - RNA, 19 nt, Homo sapiens
ggccugcagucaugaaugg

SEQ ID NO: 910611 - RNA, 19 nt, Homo sapiens
gugccagccucaucacugu

SEQ ID NO: 910612 - RNA, 19 nt, Homo sapiens
cgaggcagcaggcuuugaa

SEQ ID NO: 910613 - RNA, 19 nt, Homo sapiens
gggcugcugccuagaguga

SEQ ID NO: 910614 - RNA, 19 nt, Homo sapiens
ggauuucccagaccacuca

SEQ ID NO: 910615 - RNA, 19 nt, Homo sapiens
acucaccggcuuccuauuu

SEQ ID NO: 910616 - RNA, 19 nt, Homo sapiens
ucacguuccugcccuggau

SEQ ID NO: 910617 - RNA, 19 nt, Homo sapiens
gagcagccccagaaacuaa

SEQ ID NO: 910618 - RNA, 19 nt, Homo sapiens
cccagaaacuaacccaaca

SEQ ID NO: 910619 - RNA, 19 nt, Homo sapiens
gcugcugccuagagugaug

SEQ ID NO: 910620 - RNA, 19 nt, Homo sapiens
ccagaaugcccagaagaga

SEQ ID NO: 910621 - RNA, 19 nt, Homo sapiens
ccaaacuggccacugaaug

SEQ ID NO: 910622 - RNA, 19 nt, Homo sapiens
cgugagaguggacuuggua

SEQ ID NO: 910623 - RNA, 19 nt, Homo sapiens
cauggacgcuuuugagaga

SEQ ID NO: 910624 - RNA, 19 nt, Homo sapiens
agagccacauggacgcuuu

SEQ ID NO: 910625 - RNA, 19 nt, Homo sapiens
ugacguggacuuccucauc

SEQ ID NO: 910626 - RNA, 19 nt, Homo sapiens
gugcagugucucauuaguu

SEQ ID NO: 910627 - RNA, 19 nt, Homo sapiens
agaagggccuguggcugaa

SEQ ID NO: 910628 - RNA, 19 nt, Homo sapiens
gcucuucacccagaucuuc

SEQ ID NO: 910629 - RNA, 19 nt, Homo sapiens
agagguaccagaccaugaa

SEQ ID NO: 910630 - RNA, 19 nt, Homo sapiens
ugacucaccggcuuccuau

SEQ ID NO: 910631 - RNA, 19 nt, Homo sapiens
gagcagagaaacgccugaa

SEQ ID NO: 910632 - RNA, 19 nt, Homo sapiens
auaagcugguuaacagaga

SEQ ID NO: 910633 - RNA, 19 nt, Homo sapiens
cagaccacucaucacauua

SEQ ID NO: 910634 - RNA, 19 nt, Homo sapiens
gcccuccacgucccucaua

SEQ ID NO: 910635 - RNA, 19 nt, Homo sapiens
gcuccgaagcgacacaugu

SEQ ID NO: 910636 - RNA, 19 nt, Homo sapiens
aauugugccugcaggauca

SEQ ID NO: 910637 - RNA, 19 nt, Homo sapiens
gaagagaaccaugcauacc

SEQ ID NO: 910638 - RNA, 19 nt, Homo sapiens
gcccuggccaugucaucua

SEQ ID NO: 910639 - RNA, 19 nt, Homo sapiens
ccgaggcucuggagauacu

SEQ ID NO: 910640 - RNA, 19 nt, Homo sapiens
ggccuguucucagcacaau

SEQ ID NO: 910641 - RNA, 19 nt, Homo sapiens
ccucugagcccagcaugga

SEQ ID NO: 910642 - RNA, 19 nt, Homo sapiens
cucaccggcuuccuauuug

SEQ ID NO: 910643 - RNA, 19 nt, Homo sapiens
agaguucggcgcucagaga

SEQ ID NO: 910644 - RNA, 19 nt, Homo sapiens
ccagcaaggagccuacugu

SEQ ID NO: 910645 - RNA, 19 nt, Homo sapiens
gcccagaaugcccagaaga

SEQ ID NO: 910646 - RNA, 19 nt, Homo sapiens
cacugaaugucuccaagca

SEQ ID NO: 910647 - RNA, 19 nt, Homo sapiens
acccggagcagaagacauu

SEQ ID NO: 910648 - RNA, 19 nt, Homo sapiens
ggagaagacugaaucauua

SEQ ID NO: 910649 - RNA, 19 nt, Homo sapiens
ccaaauggcugcaaacuaa

SEQ ID NO: 910650 - RNA, 19 nt, Homo sapiens
gaagagagauuccaagcaa

SEQ ID NO: 910651 - RNA, 19 nt, Homo sapiens
ggaaaggacuguagagcua

SEQ ID NO: 910652 - RNA, 19 nt, Homo sapiens
gcaauucacuaacaagaaa

SEQ ID NO: 910653 - RNA, 19 nt, Homo sapiens
gaugagaaaugggauguua

SEQ ID NO: 910654 - RNA, 19 nt, Homo sapiens
gaugauagccguaauaaau

SEQ ID NO: 910655 - RNA, 19 nt, Homo sapiens
gcuaggauuucaaguauuu

SEQ ID NO: 910656 - RNA, 19 nt, Homo sapiens
gaagaggaaaguagaauaa

SEQ ID NO: 910657 - RNA, 19 nt, Homo sapiens
gaaaguagaauaagcaguu

SEQ ID NO: 910658 - RNA, 19 nt, Homo sapiens
cagcuaagccuucaucaua

SEQ ID NO: 910659 - RNA, 19 nt, Homo sapiens
gaggaacagucccuuaauu

SEQ ID NO: 910660 - RNA, 19 nt, Homo sapiens
ccagagaucuaguuucuau

SEQ ID NO: 910661 - RNA, 19 nt, Homo sapiens
gaauacagcucucagugau

SEQ ID NO: 910662 - RNA, 19 nt, Homo sapiens
aaucagagcuguagcagaa

SEQ ID NO: 910663 - RNA, 19 nt, Homo sapiens
acacaucccuucaaagauu

SEQ ID NO: 910664 - RNA, 19 nt, Homo sapiens
gauugcaacuggacagaua

SEQ ID NO: 910665 - RNA, 19 nt, Homo sapiens
caagaaauauacugacaug

SEQ ID NO: 910666 - RNA, 19 nt, Homo sapiens
gaacugucauucccuucua

SEQ ID NO: 910667 - RNA, 19 nt, Homo sapiens
gggagacuaugaaauauug

SEQ ID NO: 910668 - RNA, 19 nt, Homo sapiens
gaucaaaguccacaaauuc

SEQ ID NO: 910669 - RNA, 19 nt, Homo sapiens
guaaguaucaggcauauau

SEQ ID NO: 910670 - RNA, 19 nt, Homo sapiens
gaaagugucauccaaucua

SEQ ID NO: 910671 - RNA, 19 nt, Homo sapiens
gaaauauacugacaugaac

SEQ ID NO: 910672 - RNA, 19 nt, Homo sapiens
ggucaaaucauguuuagaa

SEQ ID NO: 910673 - RNA, 19 nt, Homo sapiens
ugagacagcugaagaggaa

SEQ ID NO: 910674 - RNA, 19 nt, Homo sapiens
gguguucauuuauguguua

SEQ ID NO: 910675 - RNA, 19 nt, Homo sapiens
ggaguaggaugccuggauu

SEQ ID NO: 910676 - RNA, 19 nt, Homo sapiens
cuagagaggugcugccuuu

SEQ ID NO: 910677 - RNA, 19 nt, Homo sapiens
ucacauaauucuugggaaa

SEQ ID NO: 910678 - RNA, 19 nt, Homo sapiens
gaacucccaaggacauuua

SEQ ID NO: 910679 - RNA, 19 nt, Homo sapiens
ggacaucagucaccuuugg

SEQ ID NO: 910680 - RNA, 19 nt, Homo sapiens
gaauggagauguucuuacu

SEQ ID NO: 910681 - RNA, 19 nt, Homo sapiens
agauucagguguucauuua

SEQ ID NO: 910682 - RNA, 19 nt, Homo sapiens
aaauagagguuccugauca

SEQ ID NO: 910683 - RNA, 19 nt, Homo sapiens
gaaaugccuugcuauacau

SEQ ID NO: 910684 - RNA, 19 nt, Homo sapiens
ugaaaugccuugcuauaca

SEQ ID NO: 910685 - RNA, 19 nt, Homo sapiens
agagagcauugguuuguua

SEQ ID NO: 910686 - RNA, 19 nt, Homo sapiens
gugaagauguugagccauu

SEQ ID NO: 910687 - RNA, 19 nt, Homo sapiens
gagaacagccuggaacaaa

SEQ ID NO: 910688 - RNA, 19 nt, Homo sapiens
ccacacaucccuucaaaga

SEQ ID NO: 910689 - RNA, 19 nt, Homo sapiens
gcuggcaacuacuguuuaa

SEQ ID NO: 910690 - RNA, 19 nt, Homo sapiens
caaggacauuuacaacauu

SEQ ID NO: 910691 - RNA, 19 nt, Homo sapiens
aaugauggcuuccaaauag

SEQ ID NO: 910692 - RNA, 19 nt, Homo sapiens
ccaaggacauuuacaacau

SEQ ID NO: 910693 - RNA, 19 nt, Homo sapiens
gggauaagauacucaucaa

SEQ ID NO: 910694 - RNA, 19 nt, Homo sapiens
ccacaugccuuuaaaacua

SEQ ID NO: 910695 - RNA, 19 nt, Homo sapiens
gcaaguacuucugauguuc

SEQ ID NO: 910696 - RNA, 19 nt, Homo sapiens
gcacaucacgaaacuuuau

SEQ ID NO: 910697 - RNA, 19 nt, Homo sapiens
ccaagaaggagaauauauu

SEQ ID NO: 910698 - RNA, 19 nt, Homo sapiens
ggaauacagcucucaguga

SEQ ID NO: 910699 - RNA, 19 nt, Homo sapiens
gaacagucccuuaauuucu

SEQ ID NO: 910700 - RNA, 19 nt, Homo sapiens
uaaguggugugauguaaau

SEQ ID NO: 910701 - RNA, 19 nt, Homo sapiens
guaccuaaguggugugaug

SEQ ID NO: 910702 - RNA, 19 nt, Homo sapiens
caaauacagccaacuuaaa

SEQ ID NO: 910703 - RNA, 19 nt, Homo sapiens
gugcuaggauuucaaguau

SEQ ID NO: 910704 - RNA, 19 nt, Homo sapiens
caaaucagcaaacaaauca

SEQ ID NO: 910705 - RNA, 19 nt, Homo sapiens
acagauagcuggcguggau

SEQ ID NO: 910706 - RNA, 19 nt, Homo sapiens
caaccaagaaggagaauau

SEQ ID NO: 910707 - RNA, 19 nt, Homo sapiens
gaaaaugaauccaaguguu

SEQ ID NO: 910708 - RNA, 19 nt, Homo sapiens
gcauauauaucugucuguu

SEQ ID NO: 910709 - RNA, 19 nt, Homo sapiens
gagcggcaauucacuaaca

SEQ ID NO: 910710 - RNA, 19 nt, Homo sapiens
caacccaucuuucuucagu

SEQ ID NO: 910711 - RNA, 19 nt, Homo sapiens
uuaacuugcugcauuguuu

SEQ ID NO: 910712 - RNA, 19 nt, Homo sapiens
ccagacaacaaguauauaa

SEQ ID NO: 910713 - RNA, 19 nt, Homo sapiens
gagcagaaauaaagacaac

SEQ ID NO: 910714 - RNA, 19 nt, Homo sapiens
gagcuaauguuuaccuucu

SEQ ID NO: 910715 - RNA, 19 nt, Homo sapiens
gaagcguuccagcuauuua

SEQ ID NO: 910716 - RNA, 19 nt, Homo sapiens
gauggagaaucacuguuga

SEQ ID NO: 910717 - RNA, 19 nt, Homo sapiens
gcaacgagauaagcaagga

SEQ ID NO: 910718 - RNA, 19 nt, Homo sapiens
ggauacuacucuaaccaaa

SEQ ID NO: 910719 - RNA, 19 nt, Homo sapiens
gcaacaagaagaugaaauc

SEQ ID NO: 910720 - RNA, 19 nt, Homo sapiens
gguauuucaucaucauuug

SEQ ID NO: 910721 - RNA, 19 nt, Homo sapiens
ucaagugaauggaaggaaa

SEQ ID NO: 910722 - RNA, 19 nt, Homo sapiens
ucaaauacagccaacuuaa

SEQ ID NO: 910723 - RNA, 19 nt, Homo sapiens
ggaacugccuccugagaag

SEQ ID NO: 910724 - RNA, 19 nt, Homo sapiens
ugaaaucacugugcuaaag

SEQ ID NO: 910725 - RNA, 19 nt, Homo sapiens
ggaacagucccuuaauuuc

SEQ ID NO: 910726 - RNA, 19 nt, Homo sapiens
caaauuacuguguaccuaa

SEQ ID NO: 910727 - RNA, 19 nt, Homo sapiens
gagaagacugaaucauuaa

SEQ ID NO: 910728 - RNA, 19 nt, Homo sapiens
gauaucaacugguggaaaa

SEQ ID NO: 910729 - RNA, 19 nt, Homo sapiens
gugaugcgcuacucaauag

SEQ ID NO: 910730 - RNA, 19 nt, Homo sapiens
gcauaugguuaucgaggaa

SEQ ID NO: 910731 - RNA, 19 nt, Homo sapiens
ccaauuaccauguucauuc

SEQ ID NO: 910732 - RNA, 19 nt, Homo sapiens
gaauccaaguguuucaugu

SEQ ID NO: 910733 - RNA, 19 nt, Homo sapiens
uaucuucucaggaguaaua

SEQ ID NO: 910734 - RNA, 19 nt, Homo sapiens
gagcauugguuuguuaaag

SEQ ID NO: 910735 - RNA, 19 nt, Homo sapiens
aaacagcaguugcauugau

SEQ ID NO: 910736 - RNA, 19 nt, Homo sapiens
uaaaugagacagcugaaga

SEQ ID NO: 910737 - RNA, 19 nt, Homo sapiens
aaagugucauccaaucuaa

SEQ ID NO: 910738 - RNA, 19 nt, Homo sapiens
gaugaaaucacugugcuaa

SEQ ID NO: 910739 - RNA, 19 nt, Homo sapiens
gaacacaggcuggaaugga

SEQ ID NO: 910740 - RNA, 19 nt, Homo sapiens
gagaaaugggauguuauua

SEQ ID NO: 910741 - RNA, 19 nt, Homo sapiens
gcugaaaagucacauaauu

SEQ ID NO: 910742 - RNA, 19 nt, Homo sapiens
uaccagugcugucucaauu

SEQ ID NO: 910743 - RNA, 19 nt, Homo sapiens
gcuaagccuucaucauaau

SEQ ID NO: 910744 - RNA, 19 nt, Homo sapiens
gaagacugaaucauuaaug

SEQ ID NO: 910745 - RNA, 19 nt, Homo sapiens
gcagccaugucaccaaugu

SEQ ID NO: 910746 - RNA, 19 nt, Homo sapiens
ccauguacaaugagauuua

SEQ ID NO: 910747 - RNA, 19 nt, Homo sapiens
acaagaagaugaaaucacu

SEQ ID NO: 910748 - RNA, 19 nt, Homo sapiens
ggaccaaacugcacccuuu

SEQ ID NO: 910749 - RNA, 19 nt, Homo sapiens
ggugaaacuugaagaauuu

SEQ ID NO: 910750 - RNA, 19 nt, Homo sapiens
ucuaaagacuguuccauuu

SEQ ID NO: 910751 - RNA, 19 nt, Homo sapiens
ccaagucacuggccguuaa

SEQ ID NO: 910752 - RNA, 19 nt, Homo sapiens
gaacauucccugcucugua

SEQ ID NO: 910753 - RNA, 19 nt, Homo sapiens
gggugaaacuugaagaauu

SEQ ID NO: 910754 - RNA, 19 nt, Homo sapiens
gcaccucacuagcauuuau

SEQ ID NO: 910755 - RNA, 19 nt, Homo sapiens
ggucagaagugccaaguca

SEQ ID NO: 910756 - RNA, 19 nt, Homo sapiens
ggagggagaccagcaguua

SEQ ID NO: 910757 - RNA, 19 nt, Homo sapiens
ggugauagauacaaagugu

SEQ ID NO: 910758 - RNA, 19 nt, Homo sapiens
ucucuaagguugaagguaa

SEQ ID NO: 910759 - RNA, 19 nt, Homo sapiens
cccaauagcuggcuggauu

SEQ ID NO: 910760 - RNA, 19 nt, Homo sapiens
gagaaccgccugcuccuaa

SEQ ID NO: 910761 - RNA, 19 nt, Homo sapiens
gaucugggcuuagaguaau

SEQ ID NO: 910762 - RNA, 19 nt, Homo sapiens
gcuguggccucucagaauu

SEQ ID NO: 910763 - RNA, 19 nt, Homo sapiens
caccugcgcuaccugcuua

SEQ ID NO: 910764 - RNA, 19 nt, Homo sapiens
gggcaaaccugagauuucu

SEQ ID NO: 910765 - RNA, 19 nt, Homo sapiens
gaagauguggauucuaguu

SEQ ID NO: 910766 - RNA, 19 nt, Homo sapiens
ggucggaucugggcuuaga

SEQ ID NO: 910767 - RNA, 19 nt, Homo sapiens
gaucagggucuauuuggaa

SEQ ID NO: 910768 - RNA, 19 nt, Homo sapiens
gcacugaugcugcuugcaa

SEQ ID NO: 910769 - RNA, 19 nt, Homo sapiens
caauacugcuccucucuuc

SEQ ID NO: 910770 - RNA, 19 nt, Homo sapiens
ucacuagcauuuaucacuu

SEQ ID NO: 910771 - RNA, 19 nt, Homo sapiens
gaugagugaucucuaaggu

SEQ ID NO: 910772 - RNA, 19 nt, Homo sapiens
uaauagcuuugguggguuu

SEQ ID NO: 910773 - RNA, 19 nt, Homo sapiens
gcuccuggaucgccacuga

SEQ ID NO: 910774 - RNA, 19 nt, Homo sapiens
ccacuucccuggauauguc

SEQ ID NO: 910775 - RNA, 19 nt, Homo sapiens
gggaggcugugauaaguuc

SEQ ID NO: 910776 - RNA, 19 nt, Homo sapiens
cacccuauguggcccaaua

SEQ ID NO: 910777 - RNA, 19 nt, Homo sapiens
ggcuuugagugacauauuu

SEQ ID NO: 910778 - RNA, 19 nt, Homo sapiens
ucccaugccuugaaauuga

SEQ ID NO: 910779 - RNA, 19 nt, Homo sapiens
uggcuggauuucacacuua

SEQ ID NO: 910780 - RNA, 19 nt, Homo sapiens
gaagacacccuuguagaca

SEQ ID NO: 910781 - RNA, 19 nt, Homo sapiens
ccuccgugcuuucaacuuu

SEQ ID NO: 910782 - RNA, 19 nt, Homo sapiens
gcucauggcuaugucaaca

SEQ ID NO: 910783 - RNA, 19 nt, Homo sapiens
gggccucccugacuguaaa

SEQ ID NO: 910784 - RNA, 19 nt, Homo sapiens
gcagaagacacccuuguag

SEQ ID NO: 910785 - RNA, 19 nt, Homo sapiens
ugaaagcccugguccugau

SEQ ID NO: 910786 - RNA, 19 nt, Homo sapiens
aaagguggcugggagagaa

SEQ ID NO: 910787 - RNA, 19 nt, Homo sapiens
cuaacaaggccaggaaaua

SEQ ID NO: 910788 - RNA, 19 nt, Homo sapiens
ugaggcaggauaaguauuu

SEQ ID NO: 910789 - RNA, 19 nt, Homo sapiens
ggaucugggcuuagaguaa

SEQ ID NO: 910790 - RNA, 19 nt, Homo sapiens
guguuucucugcuaccuaa

SEQ ID NO: 910791 - RNA, 19 nt, Homo sapiens
guaugucucugugugugua

SEQ ID NO: 910792 - RNA, 19 nt, Homo sapiens
gcaggaggacagcagcuaa

SEQ ID NO: 910793 - RNA, 19 nt, Homo sapiens
gccaggaaauacucacuuc

SEQ ID NO: 910794 - RNA, 19 nt, Homo sapiens
gaacccacuuuccacugau

SEQ ID NO: 910795 - RNA, 19 nt, Homo sapiens
gcacagggagggucagaag

SEQ ID NO: 910796 - RNA, 19 nt, Homo sapiens
cugcagaacuuucccucuu

SEQ ID NO: 910797 - RNA, 19 nt, Homo sapiens
caaacugcacccuuucuug

SEQ ID NO: 910798 - RNA, 19 nt, Homo sapiens
uaucaccacccuccucuuu

SEQ ID NO: 910799 - RNA, 19 nt, Homo sapiens
agaacccacuuuccacuga

SEQ ID NO: 910800 - RNA, 19 nt, Homo sapiens
aauuucagcucucacauuc

SEQ ID NO: 910801 - RNA, 19 nt, Homo sapiens
uaacaaggccaggaaauac

SEQ ID NO: 910802 - RNA, 19 nt, Homo sapiens
gggcuuagaguaauagcuu

SEQ ID NO: 910803 - RNA, 19 nt, Homo sapiens
gcugguaccucugcuucuu

SEQ ID NO: 910804 - RNA, 19 nt, Homo sapiens
gcuuaucgccgucuacuuc

SEQ ID NO: 910805 - RNA, 19 nt, Homo sapiens
gaggacagcagcuaacaag

SEQ ID NO: 910806 - RNA, 19 nt, Homo sapiens
ccucuccucucuucuccua

SEQ ID NO: 910807 - RNA, 19 nt, Homo sapiens
cacuagcauuuaucacuuu

SEQ ID NO: 910808 - RNA, 19 nt, Homo sapiens
agagcuagcuggcgguuag

SEQ ID NO: 910809 - RNA, 19 nt, Homo sapiens
gacccucucuaaagacugu

SEQ ID NO: 910810 - RNA, 19 nt, Homo sapiens
cagaagacacccuuguaga

SEQ ID NO: 910811 - RNA, 19 nt, Homo sapiens
ugagggugaugacaagaga

SEQ ID NO: 910812 - RNA, 19 nt, Homo sapiens
uagaagugccagccucuuu

SEQ ID NO: 910813 - RNA, 19 nt, Homo sapiens
gagggagaccagcaguuaa

SEQ ID NO: 910814 - RNA, 19 nt, Homo sapiens
caaccacugugugcucaga

SEQ ID NO: 910815 - RNA, 19 nt, Homo sapiens
gagcagaagacacccuugu

SEQ ID NO: 910816 - RNA, 19 nt, Homo sapiens
agaagcugauggcaacuug

SEQ ID NO: 910817 - RNA, 19 nt, Homo sapiens
uuucagcucucacauucuu

SEQ ID NO: 910818 - RNA, 19 nt, Homo sapiens
guagaaguuagaugaguga

SEQ ID NO: 910819 - RNA, 19 nt, Homo sapiens
cugauucugucacucauug

SEQ ID NO: 910820 - RNA, 19 nt, Homo sapiens
ggauuugugaccaugaauu

SEQ ID NO: 910821 - RNA, 19 nt, Homo sapiens
gaagugccagccucuuuua

SEQ ID NO: 910822 - RNA, 19 nt, Homo sapiens
uaccucugcuucuugcuuu

SEQ ID NO: 910823 - RNA, 19 nt, Homo sapiens
ggcuggauuucacacuuaa

SEQ ID NO: 910824 - RNA, 19 nt, Homo sapiens
uaggaaguguagaucagaa

SEQ ID NO: 910825 - RNA, 19 nt, Homo sapiens
ggaccuucucccuugcuua

SEQ ID NO: 910826 - RNA, 19 nt, Homo sapiens
uaauuucagcucucacauu

SEQ ID NO: 910827 - RNA, 19 nt, Homo sapiens
gggcugggccaucuucuuc

SEQ ID NO: 910828 - RNA, 19 nt, Homo sapiens
uuacagggucugcggagua

SEQ ID NO: 910829 - RNA, 19 nt, Homo sapiens
auacucagaaguugcauuu

SEQ ID NO: 910830 - RNA, 19 nt, Homo sapiens
gacaaaauacucagaaguu

SEQ ID NO: 910831 - RNA, 19 nt, Homo sapiens
gggauccauucucuaagga

SEQ ID NO: 910832 - RNA, 19 nt, Homo sapiens
ccuuugcccuugcuuucua

SEQ ID NO: 910833 - RNA, 19 nt, Homo sapiens
guccugaugcucccuguaa

SEQ ID NO: 910834 - RNA, 19 nt, Homo sapiens
cgaguuaccagaagaugug

SEQ ID NO: 910835 - RNA, 19 nt, Homo sapiens
gugggaggcugugauaagu

SEQ ID NO: 910836 - RNA, 19 nt, Homo sapiens
ccaauagcuggcuggauuu

SEQ ID NO: 910837 - RNA, 19 nt, Homo sapiens
agacacccuuguagacaga

SEQ ID NO: 910838 - RNA, 19 nt, Homo sapiens
gauguggauucuaguucug

SEQ ID NO: 910839 - RNA, 19 nt, Homo sapiens
uagacgaguuaccagaaga

SEQ ID NO: 910840 - RNA, 19 nt, Homo sapiens
gaaguguagaucagaaagu

SEQ ID NO: 910841 - RNA, 19 nt, Homo sapiens
gcaccuagaacucuuaucc

SEQ ID NO: 910842 - RNA, 19 nt, Homo sapiens
gauuugugaccaugaauuc

SEQ ID NO: 910843 - RNA, 19 nt, Homo sapiens
gggcucagaaucucgagaa

SEQ ID NO: 910844 - RNA, 19 nt, Homo sapiens
gauccugggcucagaaucu

SEQ ID NO: 910845 - RNA, 19 nt, Homo sapiens
ggauuucacacuuaauugg

SEQ ID NO: 910846 - RNA, 19 nt, Homo sapiens
cagaaggcuugaccagagu

SEQ ID NO: 910847 - RNA, 19 nt, Homo sapiens
gcccaccuccacucuaauu

SEQ ID NO: 910848 - RNA, 19 nt, Homo sapiens
ggacugggcuuccgaaaug

SEQ ID NO: 910849 - RNA, 19 nt, Homo sapiens
gcaaggagcugagauacga

SEQ ID NO: 910850 - RNA, 19 nt, Homo sapiens
ggacaucgauggagugcuu

SEQ ID NO: 910851 - RNA, 19 nt, Homo sapiens
ggaaaccauuuaccagaaa

SEQ ID NO: 910852 - RNA, 19 nt, Homo sapiens
gggaacaucuuacaacaca

SEQ ID NO: 910853 - RNA, 19 nt, Homo sapiens
gggcugggcuuuggaguga

SEQ ID NO: 910854 - RNA, 19 nt, Homo sapiens
gugauaacccuaugucuga

SEQ ID NO: 910855 - RNA, 19 nt, Homo sapiens
cauccucacuuaccaguau

SEQ ID NO: 910856 - RNA, 19 nt, Homo sapiens
caaguuauccucucucaca

SEQ ID NO: 910857 - RNA, 19 nt, Homo sapiens
gaucccugcugcucugaaa

SEQ ID NO: 910858 - RNA, 19 nt, Homo sapiens
ccacgggcaccgagacuua

SEQ ID NO: 910859 - RNA, 19 nt, Homo sapiens
cauguaugcuugguucuuu

SEQ ID NO: 910860 - RNA, 19 nt, Homo sapiens
ggaagaagacagugacucu

SEQ ID NO: 910861 - RNA, 19 nt, Homo sapiens
gcaaggagggcugggcuuu

SEQ ID NO: 910862 - RNA, 19 nt, Homo sapiens
uaacaccagaugcuacuuu

SEQ ID NO: 910863 - RNA, 19 nt, Homo sapiens
guacaggcgucuacaaucc

SEQ ID NO: 910864 - RNA, 19 nt, Homo sapiens
gaaaccauuuaccagaaag

SEQ ID NO: 910865 - RNA, 19 nt, Homo sapiens
uggaaaccauuuaccagaa

SEQ ID NO: 910866 - RNA, 19 nt, Homo sapiens
gggacuaaaucauguaugc

SEQ ID NO: 910867 - RNA, 19 nt, Homo sapiens
aguagggacuucugaaaug

SEQ ID NO: 910868 - RNA, 19 nt, Homo sapiens
guauggaacgguuggaauu

SEQ ID NO: 910869 - RNA, 19 nt, Homo sapiens
uggcauuacuggucacuug

SEQ ID NO: 910870 - RNA, 19 nt, Homo sapiens
cgagguggaugcagaccaa

SEQ ID NO: 910871 - RNA, 19 nt, Homo sapiens
uggaccagcuggcuccuaa

SEQ ID NO: 910872 - RNA, 19 nt, Homo sapiens
ucaguguccuucucauuuc

SEQ ID NO: 910873 - RNA, 19 nt, Homo sapiens
ccagcuggcuccuaaagag

SEQ ID NO: 910874 - RNA, 19 nt, Homo sapiens
guuuggacauggcaccuuu

SEQ ID NO: 910875 - RNA, 19 nt, Homo sapiens
caccgagacuuaugcuuca

SEQ ID NO: 910876 - RNA, 19 nt, Homo sapiens
aagccaagaugcccagguu

SEQ ID NO: 910877 - RNA, 19 nt, Homo sapiens
aacccagcauccucacuua

SEQ ID NO: 910878 - RNA, 19 nt, Homo sapiens
gagauacgagggccugaug

SEQ ID NO: 910879 - RNA, 19 nt, Homo sapiens
guagggacuucugaaaugg

SEQ ID NO: 910880 - RNA, 19 nt, Homo sapiens
gacuaaaucauguaugcuu

SEQ ID NO: 910881 - RNA, 19 nt, Homo sapiens
ccucccacguggugaauga

SEQ ID NO: 910882 - RNA, 19 nt, Homo sapiens
gccaagaugcccagguuug

SEQ ID NO: 910883 - RNA, 19 nt, Homo sapiens
acauggaucuccuguggau

SEQ ID NO: 910884 - RNA, 19 nt, Homo sapiens
cuucccagcuucucucaga

SEQ ID NO: 910885 - RNA, 19 nt, Homo sapiens
ggaugcagaccaaguuauc

SEQ ID NO: 910886 - RNA, 19 nt, Homo sapiens
caucuuacaacacagcaaa

SEQ ID NO: 910887 - RNA, 19 nt, Homo sapiens
ucuaugcugugggugauaa

SEQ ID NO: 910888 - RNA, 19 nt, Homo sapiens
gccugcagcugaucaugga

SEQ ID NO: 910889 - RNA, 19 nt, Homo sapiens
ucagagcccacccaccuuu

SEQ ID NO: 910890 - RNA, 19 nt, Homo sapiens
ucaugaugcugacucuugu

SEQ ID NO: 910891 - RNA, 19 nt, Homo sapiens
agucuaaccucaggccauu

SEQ ID NO: 910892 - RNA, 19 nt, Homo sapiens
ccaguucccacgugccuuu

SEQ ID NO: 910893 - RNA, 19 nt, Homo sapiens
ccaaccuguuccaccagua

SEQ ID NO: 910894 - RNA, 19 nt, Homo sapiens
gauguccuccucagcaaug

SEQ ID NO: 910895 - RNA, 19 nt, Homo sapiens
caaaugcugggaacaucuu

SEQ ID NO: 910896 - RNA, 19 nt, Homo sapiens
gggaggcaguguggaauac

SEQ ID NO: 910897 - RNA, 19 nt, Homo sapiens
guggaugcagaccaaguua

SEQ ID NO: 910898 - RNA, 19 nt, Homo sapiens
gguggaugcagaccaaguu

SEQ ID NO: 910899 - RNA, 19 nt, Homo sapiens
cauuacuggucacuuggaa

SEQ ID NO: 910900 - RNA, 19 nt, Homo sapiens
gcucuaugcugugggugau

SEQ ID NO: 910901 - RNA, 19 nt, Homo sapiens
uacaaaugcugggaacauc

SEQ ID NO: 910902 - RNA, 19 nt, Homo sapiens
cguggugaaugacgugaau

SEQ ID NO: 910903 - RNA, 19 nt, Homo sapiens
aaacccagcauccucacuu

SEQ ID NO: 910904 - RNA, 19 nt, Homo sapiens
caguagggacuucugaaau

SEQ ID NO: 910905 - RNA, 19 nt, Homo sapiens
cucaguguccuucucauuu

SEQ ID NO: 910906 - RNA, 19 nt, Homo sapiens
uauggaacgguuggaauuu

SEQ ID NO: 910907 - RNA, 19 nt, Homo sapiens
uuacuggucacuuggaaga

SEQ ID NO: 910908 - RNA, 19 nt, Homo sapiens
uaaaucauguaugcuuggu

SEQ ID NO: 910909 - RNA, 19 nt, Homo sapiens
gcagaaggcaacgcaugau

SEQ ID NO: 910910 - RNA, 19 nt, Homo sapiens
cccuaugucugacguauac

SEQ ID NO: 910911 - RNA, 19 nt, Homo sapiens
cacggagccuguccuugga

SEQ ID NO: 910912 - RNA, 19 nt, Homo sapiens
uaugcuugguucuuucuuc

SEQ ID NO: 910913 - RNA, 19 nt, Homo sapiens
gauggccuuuccucugcuu

SEQ ID NO: 910914 - RNA, 19 nt, Homo sapiens
agaccaaguuauccucucu

SEQ ID NO: 910915 - RNA, 19 nt, Homo sapiens
cugggaacaucuuacaaca

SEQ ID NO: 910916 - RNA, 19 nt, Homo sapiens
ucacuuggaagaagacagu

SEQ ID NO: 910917 - RNA, 19 nt, Homo sapiens
caaggagggcugggcuuug

SEQ ID NO: 910918 - RNA, 19 nt, Homo sapiens
cagcaacagcccucagcaa

SEQ ID NO: 910919 - RNA, 19 nt, Homo sapiens
cagaaggcaacgcaugaug

SEQ ID NO: 910920 - RNA, 19 nt, Homo sapiens
caagaugcccagguuugga

SEQ ID NO: 910921 - RNA, 19 nt, Homo sapiens
cguccuagccagcaacaug

SEQ ID NO: 910922 - RNA, 19 nt, Homo sapiens
gggacugggcuuccgaaau

SEQ ID NO: 910923 - RNA, 19 nt, Homo sapiens
cgggcaaggagcugagaua

SEQ ID NO: 910924 - RNA, 19 nt, Homo sapiens
gaccagcuggcuccuaaag

SEQ ID NO: 910925 - RNA, 19 nt, Homo sapiens
uccgaaggcuggugaacuc

SEQ ID NO: 910926 - RNA, 19 nt, Homo sapiens
ccucaguguccuucucauu

SEQ ID NO: 910927 - RNA, 19 nt, Homo sapiens
gguagcauuuuguauggaa

SEQ ID NO: 910928 - RNA, 19 nt, Homo sapiens
gcugggaacaucuuacaac

SEQ ID NO: 910929 - RNA, 19 nt, Homo sapiens
gagaggggacuaaaucaug

SEQ ID NO: 910930 - RNA, 19 nt, Homo sapiens
uggauguccuccucagcaa

SEQ ID NO: 910931 - RNA, 19 nt, Homo sapiens
gaauacuguggaugucugu

SEQ ID NO: 910932 - RNA, 19 nt, Homo sapiens
caguguccuucucauuuca

SEQ ID NO: 910933 - RNA, 19 nt, Homo sapiens
gcauuacuggucacuugga

SEQ ID NO: 910934 - RNA, 19 nt, Homo sapiens
aaggagggcugggcuuugg

SEQ ID NO: 910935 - RNA, 19 nt, Homo sapiens
ggacugggcuuccgaaaug

SEQ ID NO: 910936 - RNA, 19 nt, Homo sapiens
gcaaggagcugagauacga

SEQ ID NO: 910937 - RNA, 19 nt, Homo sapiens
ggacaucgauggagugcuu

SEQ ID NO: 910938 - RNA, 19 nt, Homo sapiens
ggaaaccauuuaccagaaa

SEQ ID NO: 910939 - RNA, 19 nt, Homo sapiens
gggaacaucuuacaacaca

SEQ ID NO: 910940 - RNA, 19 nt, Homo sapiens
gggcugggcuuuggaguga

SEQ ID NO: 910941 - RNA, 19 nt, Homo sapiens
gugauaacccuaugucuga

SEQ ID NO: 910942 - RNA, 19 nt, Homo sapiens
cauccucacuuaccaguau

SEQ ID NO: 910943 - RNA, 19 nt, Homo sapiens
caaguuauccucucucaca

SEQ ID NO: 910944 - RNA, 19 nt, Homo sapiens
gaucccugcugcucugaaa

SEQ ID NO: 910945 - RNA, 19 nt, Homo sapiens
ccacgggcaccgagacuua

SEQ ID NO: 910946 - RNA, 19 nt, Homo sapiens
ggaagaagacagugacucu

SEQ ID NO: 910947 - RNA, 19 nt, Homo sapiens
gcaaggagggcugggcuuu

SEQ ID NO: 910948 - RNA, 19 nt, Homo sapiens
uaacaccagaugcuacuuu

SEQ ID NO: 910949 - RNA, 19 nt, Homo sapiens
guacaggcgucuacaaucc

SEQ ID NO: 910950 - RNA, 19 nt, Homo sapiens
gaaaccauuuaccagaaag

SEQ ID NO: 910951 - RNA, 19 nt, Homo sapiens
uggaaaccauuuaccagaa

SEQ ID NO: 910952 - RNA, 19 nt, Homo sapiens
aguagggacuucugaaaug

SEQ ID NO: 910953 - RNA, 19 nt, Homo sapiens
guauggaacgguuggaauu

SEQ ID NO: 910954 - RNA, 19 nt, Homo sapiens
uggcauuacuggucacuug

SEQ ID NO: 910955 - RNA, 19 nt, Homo sapiens
cgagguggaugcagaccaa

SEQ ID NO: 910956 - RNA, 19 nt, Homo sapiens
ucaguguccuucucauuuc

SEQ ID NO: 910957 - RNA, 19 nt, Homo sapiens
guuuggacauggcaccuuu

SEQ ID NO: 910958 - RNA, 19 nt, Homo sapiens
caccgagacuuaugcuuca

SEQ ID NO: 910959 - RNA, 19 nt, Homo sapiens
aagccaagaugcccagguu

SEQ ID NO: 910960 - RNA, 19 nt, Homo sapiens
aacccagcauccucacuua

SEQ ID NO: 910961 - RNA, 19 nt, Homo sapiens
gagauacgagggccugaug

SEQ ID NO: 910962 - RNA, 19 nt, Homo sapiens
guagggacuucugaaaugg

SEQ ID NO: 910963 - RNA, 19 nt, Homo sapiens
ccucccacguggugaauga

SEQ ID NO: 910964 - RNA, 19 nt, Homo sapiens
gccaagaugcccagguuug

SEQ ID NO: 910965 - RNA, 19 nt, Homo sapiens
acauggaucuccuguggau

SEQ ID NO: 910966 - RNA, 19 nt, Homo sapiens
ggaugcagaccaaguuauc

SEQ ID NO: 910967 - RNA, 19 nt, Homo sapiens
caucuuacaacacagcaaa

SEQ ID NO: 910968 - RNA, 19 nt, Homo sapiens
ucuaugcugugggugauaa

SEQ ID NO: 910969 - RNA, 19 nt, Homo sapiens
ucagagcccacccaccuuu

SEQ ID NO: 910970 - RNA, 19 nt, Homo sapiens
gccugcagcugaucaugga

SEQ ID NO: 910971 - RNA, 19 nt, Homo sapiens
ucaugaugcugacucuugu

SEQ ID NO: 910972 - RNA, 19 nt, Homo sapiens
agucuaaccucaggccauu

SEQ ID NO: 910973 - RNA, 19 nt, Homo sapiens
ccaguucccacgugccuuu

SEQ ID NO: 910974 - RNA, 19 nt, Homo sapiens
ccaaccuguuccaccagua

SEQ ID NO: 910975 - RNA, 19 nt, Homo sapiens
caaaugcugggaacaucuu

SEQ ID NO: 910976 - RNA, 19 nt, Homo sapiens
gauguccuccucagcaaug

SEQ ID NO: 910977 - RNA, 19 nt, Homo sapiens
gggaggcaguguggaauac

SEQ ID NO: 910978 - RNA, 19 nt, Homo sapiens
guggaugcagaccaaguua

SEQ ID NO: 910979 - RNA, 19 nt, Homo sapiens
gguggaugcagaccaaguu

SEQ ID NO: 910980 - RNA, 19 nt, Homo sapiens
cauuacuggucacuuggaa

SEQ ID NO: 910981 - RNA, 19 nt, Homo sapiens
gcucuaugcugugggugau

SEQ ID NO: 910982 - RNA, 19 nt, Homo sapiens
uacaaaugcugggaacauc

SEQ ID NO: 910983 - RNA, 19 nt, Homo sapiens
cguggugaaugacgugaau

SEQ ID NO: 910984 - RNA, 19 nt, Homo sapiens
aaacccagcauccucacuu

SEQ ID NO: 910985 - RNA, 19 nt, Homo sapiens
caguagggacuucugaaau

SEQ ID NO: 910986 - RNA, 19 nt, Homo sapiens
cucaguguccuucucauuu

SEQ ID NO: 910987 - RNA, 19 nt, Homo sapiens
uauggaacgguuggaauuu

SEQ ID NO: 910988 - RNA, 19 nt, Homo sapiens
uuacuggucacuuggaaga

SEQ ID NO: 910989 - RNA, 19 nt, Homo sapiens
gcagaaggcaacgcaugau

SEQ ID NO: 910990 - RNA, 19 nt, Homo sapiens
cccuaugucugacguauac

SEQ ID NO: 910991 - RNA, 19 nt, Homo sapiens
cugggaacaucuuacaaca

SEQ ID NO: 910992 - RNA, 19 nt, Homo sapiens
agaccaaguuauccucucu

SEQ ID NO: 910993 - RNA, 19 nt, Homo sapiens
cacggagccuguccuugga

SEQ ID NO: 910994 - RNA, 19 nt, Homo sapiens
gauggccuuuccucugcuu

SEQ ID NO: 910995 - RNA, 19 nt, Homo sapiens
ucacuuggaagaagacagu

SEQ ID NO: 910996 - RNA, 19 nt, Homo sapiens
caaggagggcugggcuuug

SEQ ID NO: 910997 - RNA, 19 nt, Homo sapiens
cagcaacagcccucagcaa

SEQ ID NO: 910998 - RNA, 19 nt, Homo sapiens
cagaaggcaacgcaugaug

SEQ ID NO: 910999 - RNA, 19 nt, Homo sapiens
caagaugcccagguuugga

SEQ ID NO: 911000 - RNA, 19 nt, Homo sapiens
cguccuagccagcaacaug

SEQ ID NO: 911001 - RNA, 19 nt, Homo sapiens
gggacugggcuuccgaaau

SEQ ID NO: 911002 - RNA, 19 nt, Homo sapiens
cgggcaaggagcugagaua

SEQ ID NO: 911003 - RNA, 19 nt, Homo sapiens
uccgaaggcuggugaacuc

SEQ ID NO: 911004 - RNA, 19 nt, Homo sapiens
ccucaguguccuucucauu

SEQ ID NO: 911005 - RNA, 19 nt, Homo sapiens
gguagcauuuuguauggaa

SEQ ID NO: 911006 - RNA, 19 nt, Homo sapiens
gcugggaacaucuuacaac

SEQ ID NO: 911007 - RNA, 19 nt, Homo sapiens
uggauguccuccucagcaa

SEQ ID NO: 911008 - RNA, 19 nt, Homo sapiens
gaauacuguggaugucugu

SEQ ID NO: 911009 - RNA, 19 nt, Homo sapiens
caguguccuucucauuuca

SEQ ID NO: 911010 - RNA, 19 nt, Homo sapiens
gcauuacuggucacuugga

SEQ ID NO: 911011 - RNA, 19 nt, Homo sapiens
aaggagggcugggcuuugg

SEQ ID NO: 911012 - RNA, 19 nt, Homo sapiens
ggaauuaucuguuguaucu

SEQ ID NO: 911013 - RNA, 19 nt, Homo sapiens
gaacacgaauguacaaaga

SEQ ID NO: 911014 - RNA, 19 nt, Homo sapiens
agacacagaugaagaauuu

SEQ ID NO: 911015 - RNA, 19 nt, Homo sapiens
gcagguagcucacccaaug

SEQ ID NO: 911016 - RNA, 19 nt, Homo sapiens
ggaaagguuugaucuugua

SEQ ID NO: 911017 - RNA, 19 nt, Homo sapiens
ggagaaagcucagggaaga

SEQ ID NO: 911018 - RNA, 19 nt, Homo sapiens
gaauggagguuuauacugu

SEQ ID NO: 911019 - RNA, 19 nt, Homo sapiens
gagaugacguggaguuuau

SEQ ID NO: 911020 - RNA, 19 nt, Homo sapiens
gcacagguuugaauaggaa

SEQ ID NO: 911021 - RNA, 19 nt, Homo sapiens
gaacaaauuggcacuagaa

SEQ ID NO: 911022 - RNA, 19 nt, Homo sapiens
ggaauugucgaaaguauaa

SEQ ID NO: 911023 - RNA, 19 nt, Homo sapiens
gagauucuguugagugaaa

SEQ ID NO: 911024 - RNA, 19 nt, Homo sapiens
ggaagugacuacucagguu

SEQ ID NO: 911025 - RNA, 19 nt, Homo sapiens
ggacaacuguaaagcaaug

SEQ ID NO: 911026 - RNA, 19 nt, Homo sapiens
gguaaaggcucacaaggau

SEQ ID NO: 911027 - RNA, 19 nt, Homo sapiens
gcaaagaggaggaagaaga

SEQ ID NO: 911028 - RNA, 19 nt, Homo sapiens
gaauucagcugcccauuac

SEQ ID NO: 911029 - RNA, 19 nt, Homo sapiens
uagaguguuucacguauua

SEQ ID NO: 911030 - RNA, 19 nt, Homo sapiens
cacaagagccugagaauga

SEQ ID NO: 911031 - RNA, 19 nt, Homo sapiens
ggaagaagagcgucagauu

SEQ ID NO: 911032 - RNA, 19 nt, Homo sapiens
gggacucgauuauauugua

SEQ ID NO: 911033 - RNA, 19 nt, Homo sapiens
cagcuaaacucagguauau

SEQ ID NO: 911034 - RNA, 19 nt, Homo sapiens
gcagauaaguggcccaagu

SEQ ID NO: 911035 - RNA, 19 nt, Homo sapiens
gaauaguuguaaaccagua

SEQ ID NO: 911036 - RNA, 19 nt, Homo sapiens
ccugagaucugcaacauga

SEQ ID NO: 911037 - RNA, 19 nt, Homo sapiens
gaagcuggaugaaucuaug

SEQ ID NO: 911038 - RNA, 19 nt, Homo sapiens
caaggucccucuucucaga

SEQ ID NO: 911039 - RNA, 19 nt, Homo sapiens
ggagaacagugaagcacaa

SEQ ID NO: 911040 - RNA, 19 nt, Homo sapiens
uagaggacaucaucaacua

SEQ ID NO: 911041 - RNA, 19 nt, Homo sapiens
gguuugaucuuguaauaug

SEQ ID NO: 911042 - RNA, 19 nt, Homo sapiens
gaacguggaguuaaugaug

SEQ ID NO: 911043 - RNA, 19 nt, Homo sapiens
auaccaagaugucugauaa

SEQ ID NO: 911044 - RNA, 19 nt, Homo sapiens
ugacacaccuuucuaacau

SEQ ID NO: 911045 - RNA, 19 nt, Homo sapiens
gcuaaacucagguauauau

SEQ ID NO: 911046 - RNA, 19 nt, Homo sapiens
gaaauuccucccagccaua

SEQ ID NO: 911047 - RNA, 19 nt, Homo sapiens
gaugaugauuucacugcua

SEQ ID NO: 911048 - RNA, 19 nt, Homo sapiens
guacagaccaucaggaaug

SEQ ID NO: 911049 - RNA, 19 nt, Homo sapiens
cgaauucagcugcccauua

SEQ ID NO: 911050 - RNA, 19 nt, Homo sapiens
gcacccaguucuuuguuug

SEQ ID NO: 911051 - RNA, 19 nt, Homo sapiens
gaauugggaucgcuagagu

SEQ ID NO: 911052 - RNA, 19 nt, Homo sapiens
gaagaagagcgucagauuc

SEQ ID NO: 911053 - RNA, 19 nt, Homo sapiens
ggaacaaauuggcacuaga

SEQ ID NO: 911054 - RNA, 19 nt, Homo sapiens
aagagaagcuggaugaauc

SEQ ID NO: 911055 - RNA, 19 nt, Homo sapiens
gacacugaaugcugccuua

SEQ ID NO: 911056 - RNA, 19 nt, Homo sapiens
ggaaacagcagcccaugga

SEQ ID NO: 911057 - RNA, 19 nt, Homo sapiens
uaaaugacaugaagaccau

SEQ ID NO: 911058 - RNA, 19 nt, Homo sapiens
ucuacaagcuccucaguga

SEQ ID NO: 911059 - RNA, 19 nt, Homo sapiens
ucagcgaacuccuuacuau

SEQ ID NO: 911060 - RNA, 19 nt, Homo sapiens
gcggacaacuguaaagcaa

SEQ ID NO: 911061 - RNA, 19 nt, Homo sapiens
gcagagcucaccacaagaa

SEQ ID NO: 911062 - RNA, 19 nt, Homo sapiens
uaggaaagguuugaucuug

SEQ ID NO: 911063 - RNA, 19 nt, Homo sapiens
gcagcuaaacucagguaua

SEQ ID NO: 911064 - RNA, 19 nt, Homo sapiens
gcaacaugaucgcccagaa

SEQ ID NO: 911065 - RNA, 19 nt, Homo sapiens
gagaacaccuguccccuaa

SEQ ID NO: 911066 - RNA, 19 nt, Homo sapiens
gaagagaagcuggaugaau

SEQ ID NO: 911067 - RNA, 19 nt, Homo sapiens
ugaguuggaugaugauuuc

SEQ ID NO: 911068 - RNA, 19 nt, Homo sapiens
cuacucagguuuguauauu

SEQ ID NO: 911069 - RNA, 19 nt, Homo sapiens
gaagugacuacucagguuu

SEQ ID NO: 911070 - RNA, 19 nt, Homo sapiens
ugggaucgcuagaguguuu

SEQ ID NO: 911071 - RNA, 19 nt, Homo sapiens
cugcuaaagucccaaauga

SEQ ID NO: 911072 - RNA, 19 nt, Homo sapiens
ucacugcuauguauaaagu

SEQ ID NO: 911073 - RNA, 19 nt, Homo sapiens
ugauuucacugcuauguau

SEQ ID NO: 911074 - RNA, 19 nt, Homo sapiens
gcuagaguguuucacguau

SEQ ID NO: 911075 - RNA, 19 nt, Homo sapiens
ccagccagccuucagaaua

SEQ ID NO: 911076 - RNA, 19 nt, Homo sapiens
uaaugaacguggaguuaau

SEQ ID NO: 911077 - RNA, 19 nt, Homo sapiens
acacacagauugcaaaggu

SEQ ID NO: 911078 - RNA, 19 nt, Homo sapiens
ccaagaugucugauaauuu

SEQ ID NO: 911079 - RNA, 19 nt, Homo sapiens
ggaaauguacagaccauca

SEQ ID NO: 911080 - RNA, 19 nt, Homo sapiens
ucaggacugugaucuagaa

SEQ ID NO: 911081 - RNA, 19 nt, Homo sapiens
gaaucguccucaucacaga

SEQ ID NO: 911082 - RNA, 19 nt, Homo sapiens
gggcugcuaucaacgaaga

SEQ ID NO: 911083 - RNA, 19 nt, Homo sapiens
ggaaugggauuugguucau

SEQ ID NO: 911084 - RNA, 19 nt, Homo sapiens
gcagaacguugcaggaaac

SEQ ID NO: 911085 - RNA, 19 nt, Homo sapiens
ggcagaacguugcaggaaa

SEQ ID NO: 911086 - RNA, 19 nt, Homo sapiens
ggacagcccagagaugauu

SEQ ID NO: 911087 - RNA, 19 nt, Homo sapiens
gaagauggagacacagaug

SEQ ID NO: 911088 - RNA, 19 nt, Homo sapiens
gcacaaaggcagaguugca

SEQ ID NO: 911089 - RNA, 19 nt, Homo sapiens
auaaagaauugcacagguu

SEQ ID NO: 911090 - RNA, 19 nt, Homo sapiens
aaucaugucacacugaaua

SEQ ID NO: 911091 - RNA, 19 nt, Homo sapiens
gaaaugagccccaagcaau

SEQ ID NO: 911092 - RNA, 19 nt, Homo sapiens
ucaggagggucccaucuau

SEQ ID NO: 911093 - RNA, 19 nt, Homo sapiens
caucaaacccgucaagcaa

SEQ ID NO: 911094 - RNA, 19 nt, Homo sapiens
ccaccagcccuaccgaaua

SEQ ID NO: 911095 - RNA, 19 nt, Homo sapiens
gaccagccguccuguagau

SEQ ID NO: 911096 - RNA, 19 nt, Homo sapiens
ggaaagcugcacacgaaga

SEQ ID NO: 911097 - RNA, 19 nt, Homo sapiens
guauaugccuggccuagag

SEQ ID NO: 911098 - RNA, 19 nt, Homo sapiens
ucaaacccgucaagcaaga

SEQ ID NO: 911099 - RNA, 19 nt, Homo sapiens
gagaacggcagcucuacaa

SEQ ID NO: 911100 - RNA, 19 nt, Homo sapiens
gacgaugucuucgaucuuc

SEQ ID NO: 911101 - RNA, 19 nt, Homo sapiens
uaaagaauugcacagguuu

SEQ ID NO: 911102 - RNA, 19 nt, Homo sapiens
cagccagccuucagaauag

SEQ ID NO: 911103 - RNA, 19 nt, Homo sapiens
cagagagucccaaagaauu

SEQ ID NO: 911104 - RNA, 19 nt, Homo sapiens
gccagagagucccaaagaa

SEQ ID NO: 911105 - RNA, 19 nt, Homo sapiens
ccacaaggaaugagguauu

SEQ ID NO: 911106 - RNA, 19 nt, Homo sapiens
gcaaugaagggcaagaauc

SEQ ID NO: 911107 - RNA, 19 nt, Homo sapiens
aggcagagcucaccacaag

SEQ ID NO: 911108 - RNA, 19 nt, Homo sapiens
gaauugcacagguuugaau

SEQ ID NO: 911109 - RNA, 19 nt, Homo sapiens
aaaccaguaucaggaauug

SEQ ID NO: 911110 - RNA, 19 nt, Homo sapiens
gcgacccacucgugccaua

SEQ ID NO: 911111 - RNA, 19 nt, Homo sapiens
ucauaagccuccaacacuu

SEQ ID NO: 911112 - RNA, 19 nt, Homo sapiens
gaucagcuaugccgacuuu

SEQ ID NO: 911113 - RNA, 19 nt, Homo sapiens
ucaaccagcugaccgaauu

SEQ ID NO: 911114 - RNA, 19 nt, Homo sapiens
gaaaaugagugcguuugua

SEQ ID NO: 911115 - RNA, 19 nt, Homo sapiens
gaaggaggcguccgaguuc

SEQ ID NO: 911116 - RNA, 19 nt, Homo sapiens
ugaccgaauucuucucgua

SEQ ID NO: 911117 - RNA, 19 nt, Homo sapiens
gcagaaaagugcagaagga

SEQ ID NO: 911118 - RNA, 19 nt, Homo sapiens
guacggaaugauaaacuuu

SEQ ID NO: 911119 - RNA, 19 nt, Homo sapiens
ccguggaccuguacgagua

SEQ ID NO: 911120 - RNA, 19 nt, Homo sapiens
gaagggaagaucagcuaug

SEQ ID NO: 911121 - RNA, 19 nt, Homo sapiens
ugaaggaggcguccgaguu

SEQ ID NO: 911122 - RNA, 19 nt, Homo sapiens
gcuccuuccugcagaaugu

SEQ ID NO: 911123 - RNA, 19 nt, Homo sapiens
gaugauagacaggaucuuc

SEQ ID NO: 911124 - RNA, 19 nt, Homo sapiens
gcugcaagcuggccaacgu

SEQ ID NO: 911125 - RNA, 19 nt, Homo sapiens
ggagcuccuuccugcagaa

SEQ ID NO: 911126 - RNA, 19 nt, Homo sapiens
gcguuuguacggaaugaua

SEQ ID NO: 911127 - RNA, 19 nt, Homo sapiens
ccaagaugauagacaggau

SEQ ID NO: 911128 - RNA, 19 nt, Homo sapiens
gagcauuucuacgucaucu

SEQ ID NO: 911129 - RNA, 19 nt, Homo sapiens
cgaccagcaucgaguacug

SEQ ID NO: 911130 - RNA, 19 nt, Homo sapiens
aaacuguuguggaaaauga

SEQ ID NO: 911131 - RNA, 19 nt, Homo sapiens
caagcuggccaacgucuuc

SEQ ID NO: 911132 - RNA, 19 nt, Homo sapiens
gaucucugaggaagacaaa

SEQ ID NO: 911133 - RNA, 19 nt, Homo sapiens
ggaagggaagaucagcuau

SEQ ID NO: 911134 - RNA, 19 nt, Homo sapiens
gagcagaaagagcagaucu

SEQ ID NO: 911135 - RNA, 19 nt, Homo sapiens
ggaggaggcggacaucaac

SEQ ID NO: 911136 - RNA, 19 nt, Homo sapiens
uguacggaaugauaaacuu

SEQ ID NO: 911137 - RNA, 19 nt, Homo sapiens
cgagagggccaccauggau

SEQ ID NO: 911138 - RNA, 19 nt, Homo sapiens
gcagaaggaagggaagauc

SEQ ID NO: 911139 - RNA, 19 nt, Homo sapiens
cgucaucuacugcaaguuc

SEQ ID NO: 911140 - RNA, 19 nt, Homo sapiens
gcauuucuacgucaucuac

SEQ ID NO: 911141 - RNA, 19 nt, Homo sapiens
ccagcugaccgaauucuuc

SEQ ID NO: 911142 - RNA, 19 nt, Homo sapiens
cagaaggaagggaagauca

SEQ ID NO: 911143 - RNA, 19 nt, Homo sapiens
gauagacaggaucuucuca

SEQ ID NO: 911144 - RNA, 19 nt, Homo sapiens
acaaugaccacgcccuuuc

SEQ ID NO: 911145 - RNA, 19 nt, Homo sapiens
gcagucacacgaggcagaa

SEQ ID NO: 911146 - RNA, 19 nt, Homo sapiens
guucguccaucugcucaug

SEQ ID NO: 911147 - RNA, 19 nt, Homo sapiens
gaucuucuacgccgugaac

SEQ ID NO: 911148 - RNA, 19 nt, Homo sapiens
acaaguucgucgccaugug

SEQ ID NO: 911149 - RNA, 19 nt, Homo sapiens
ggaccacgaccugcucauc

SEQ ID NO: 911150 - RNA, 19 nt, Homo sapiens
cggccaaguucguccaucu

SEQ ID NO: 911151 - RNA, 19 nt, Homo sapiens
gugcguuuguacggaauga

SEQ ID NO: 911152 - RNA, 19 nt, Homo sapiens
gggccaccauggaugacau

SEQ ID NO: 911153 - RNA, 19 nt, Homo sapiens
ggacugaagggaagaucac

SEQ ID NO: 911154 - RNA, 19 nt, Homo sapiens
aagggaagaucagcuaugc

SEQ ID NO: 911155 - RNA, 19 nt, Homo sapiens
gaccacgcccuuucuacca

SEQ ID NO: 911156 - RNA, 19 nt, Homo sapiens
ccguguccguccacaaguu

SEQ ID NO: 911157 - RNA, 19 nt, Homo sapiens
ggaggaacuugcauaaaua

SEQ ID NO: 911158 - RNA, 19 nt, Homo sapiens
gaaaugcacuucaacuugu

SEQ ID NO: 911159 - RNA, 19 nt, Homo sapiens
gggaggaacuugcauaaau

SEQ ID NO: 911160 - RNA, 19 nt, Homo sapiens
gcuaugaccugcacagcua

SEQ ID NO: 911161 - RNA, 19 nt, Homo sapiens
gaacguguuuauagaaugu

SEQ ID NO: 911162 - RNA, 19 nt, Homo sapiens
ggaaaugcacuucaacuug

SEQ ID NO: 911163 - RNA, 19 nt, Homo sapiens
gaggugcccugcugaauau

SEQ ID NO: 911164 - RNA, 19 nt, Homo sapiens
gcagggaaaugcacuucaa

SEQ ID NO: 911165 - RNA, 19 nt, Homo sapiens
ggaggugcccugcugaaua

SEQ ID NO: 911166 - RNA, 19 nt, Homo sapiens
ugccauagccugcuucuua

SEQ ID NO: 911167 - RNA, 19 nt, Homo sapiens
gcuaugagguggaguugga

SEQ ID NO: 911168 - RNA, 19 nt, Homo sapiens
cagauggccuggaaacuug

SEQ ID NO: 911169 - RNA, 19 nt, Homo sapiens
ucaccuaccuggaugagaa

SEQ ID NO: 911170 - RNA, 19 nt, Homo sapiens
gcuuguguguccucaguua

SEQ ID NO: 911171 - RNA, 19 nt, Homo sapiens
cacgggaacuucuauuuga

SEQ ID NO: 911172 - RNA, 19 nt, Homo sapiens
gaaggccaccugaaccuaa

SEQ ID NO: 911173 - RNA, 19 nt, Homo sapiens
caucagaacguguuuauag

SEQ ID NO: 911174 - RNA, 19 nt, Homo sapiens
acacacaguuugcaucaga

SEQ ID NO: 911175 - RNA, 19 nt, Homo sapiens
cugaauaucuacacggaaa

SEQ ID NO: 911176 - RNA, 19 nt, Homo sapiens
gcuccgcggucaucaaguu

SEQ ID NO: 911177 - RNA, 19 nt, Homo sapiens
ggacacacaguuugcauca

SEQ ID NO: 911178 - RNA, 19 nt, Homo sapiens
ccugcaaccuucuacuuaa

SEQ ID NO: 911179 - RNA, 19 nt, Homo sapiens
gccauagccugcuucuuau

SEQ ID NO: 911180 - RNA, 19 nt, Homo sapiens
cagaacguguuuauagaau

SEQ ID NO: 911181 - RNA, 19 nt, Homo sapiens
gaagguguaccgagacugu

SEQ ID NO: 911182 - RNA, 19 nt, Homo sapiens
ccaagggcauccuguucuu

SEQ ID NO: 911183 - RNA, 19 nt, Homo sapiens
uaccgagacuguagcugua

SEQ ID NO: 911184 - RNA, 19 nt, Homo sapiens
gaggaacuugcauaaauau

SEQ ID NO: 911185 - RNA, 19 nt, Homo sapiens
ggccaugagccgcuacaua

SEQ ID NO: 911186 - RNA, 19 nt, Homo sapiens
gggaaaugcacuucaacuu

SEQ ID NO: 911187 - RNA, 19 nt, Homo sapiens
guagcuguaucccucagaa

SEQ ID NO: 911188 - RNA, 19 nt, Homo sapiens
ccaguggauuguaguuaga

SEQ ID NO: 911189 - RNA, 19 nt, Homo sapiens
cggcggaaaugcaccaguu

SEQ ID NO: 911190 - RNA, 19 nt, Homo sapiens
gcacuaacggcaacucuac

SEQ ID NO: 911191 - RNA, 19 nt, Homo sapiens
gaagcugccaccuuguuug

SEQ ID NO: 911192 - RNA, 19 nt, Homo sapiens
gguuuaaagucggcuguga

SEQ ID NO: 911193 - RNA, 19 nt, Homo sapiens
ucagaacguguuuauagaa

SEQ ID NO: 911194 - RNA, 19 nt, Homo sapiens
gggacaagccgcucaccuu

SEQ ID NO: 911195 - RNA, 19 nt, Homo sapiens
gccaugagccgcuacauac

SEQ ID NO: 911196 - RNA, 19 nt, Homo sapiens
gcgcuacgcggucaugaga

SEQ ID NO: 911197 - RNA, 19 nt, Homo sapiens
gaauaucuacacggaaaug

SEQ ID NO: 911198 - RNA, 19 nt, Homo sapiens
gcucggacggccucaugua

SEQ ID NO: 911199 - RNA, 19 nt, Homo sapiens
aaacugugcauaucgaaau

SEQ ID NO: 911200 - RNA, 19 nt, Homo sapiens
ccaucuggcuccugcugaa

SEQ ID NO: 911201 - RNA, 19 nt, Homo sapiens
ggaaaugcaccaguugaag

SEQ ID NO: 911202 - RNA, 19 nt, Homo sapiens
gcaaucacacgggaacuuc

SEQ ID NO: 911203 - RNA, 19 nt, Homo sapiens
ucagauggccuggaaacuu

SEQ ID NO: 911204 - RNA, 19 nt, Homo sapiens
gaauguggacggccagaag

SEQ ID NO: 911205 - RNA, 19 nt, Homo sapiens
ggugggaggaacuugcaua

SEQ ID NO: 911206 - RNA, 19 nt, Homo sapiens
ccaugccacugcagggaaa

SEQ ID NO: 911207 - RNA, 19 nt, Homo sapiens
acacgggaacuucuauuug

SEQ ID NO: 911208 - RNA, 19 nt, Homo sapiens
gcugggcguccucuucuuu

SEQ ID NO: 911209 - RNA, 19 nt, Homo sapiens
cacuucaacuugucagaga

SEQ ID NO: 911210 - RNA, 19 nt, Homo sapiens
ucaccggcauguccacguu

SEQ ID NO: 911211 - RNA, 19 nt, Homo sapiens
gugcccugcugaauaucua

SEQ ID NO: 911212 - RNA, 19 nt, Homo sapiens
gcugccggcuaccugauug

SEQ ID NO: 911213 - RNA, 19 nt, Homo sapiens
gcaucagaacguguuuaua

SEQ ID NO: 911214 - RNA, 19 nt, Homo sapiens
uaccagaauucggccauga

SEQ ID NO: 911215 - RNA, 19 nt, Homo sapiens
cggacggccucauguacuu

SEQ ID NO: 911216 - RNA, 19 nt, Homo sapiens
caacccggacuuugggaaa

SEQ ID NO: 911217 - RNA, 19 nt, Homo sapiens
gcggaaaugcaccaguuga

SEQ ID NO: 911218 - RNA, 19 nt, Homo sapiens
gaccugcaaccuucuacuu

SEQ ID NO: 911219 - RNA, 19 nt, Homo sapiens
gccguugggugaugcaauc

SEQ ID NO: 911220 - RNA, 19 nt, Homo sapiens
cagcauuccugcacuaacg

SEQ ID NO: 911221 - RNA, 19 nt, Homo sapiens
cagaagcugccaccuuguu

SEQ ID NO: 911222 - RNA, 19 nt, Homo sapiens
agaacguguuuauagaaug

SEQ ID NO: 911223 - RNA, 19 nt, Homo sapiens
gugggaggaacuugcauaa

SEQ ID NO: 911224 - RNA, 19 nt, Homo sapiens
cacacgggaacuucuauuu

SEQ ID NO: 911225 - RNA, 19 nt, Homo sapiens
ccauagccugcuucuuaua

SEQ ID NO: 911226 - RNA, 19 nt, Homo sapiens
cgucuacauugccaucuuc

SEQ ID NO: 911227 - RNA, 19 nt, Homo sapiens
guggauuguaguuagaaua

SEQ ID NO: 911228 - RNA, 19 nt, Homo sapiens
cgccagcuccuacgacauu

SEQ ID NO: 911229 - RNA, 19 nt, Homo sapiens
aacugugcauaucgaaaua

SEQ ID NO: 911230 - RNA, 19 nt, Homo sapiens
cggcaacucuacgaugugu

SEQ ID NO: 911231 - RNA, 19 nt, Homo sapiens
gggcgucaccuaccuggau

SEQ ID NO: 911232 - RNA, 19 nt, Homo sapiens
uagccugcuucuuauacaa

SEQ ID NO: 911233 - RNA, 19 nt, Homo sapiens
gggcauccucgucuucuca

SEQ ID NO: 911234 - RNA, 19 nt, Homo sapiens
caucaaguucugccuguuc

SEQ ID NO: 911235 - RNA, 19 nt, Homo sapiens
cggaaaugcaccaguugaa

SEQ ID NO: 911236 - RNA, 19 nt, Homo sapiens
ccugacagugccacagaua

SEQ ID NO: 911237 - RNA, 19 nt, Homo sapiens
agaagcugccaccuuguuu

SEQ ID NO: 911238 - RNA, 19 nt, Homo sapiens
ccguucccauccuugguua

SEQ ID NO: 911239 - RNA, 19 nt, Homo sapiens
cuacauugccaucuucuac

SEQ ID NO: 911240 - RNA, 19 nt, Homo sapiens
ccucagaagcugccaccuu

SEQ ID NO: 911241 - RNA, 19 nt, Homo sapiens
aucagaacguguuuauaga

SEQ ID NO: 911242 - RNA, 19 nt, Homo sapiens
aacggcaacucuacgaugu

SEQ ID NO: 911243 - RNA, 19 nt, Homo sapiens
cagaagguguaccgagacu

SEQ ID NO: 911244 - RNA, 19 nt, Homo sapiens
gcgagcaacccggacuuug

SEQ ID NO: 911245 - RNA, 19 nt, Homo sapiens
cacacaguuugcaucagaa

SEQ ID NO: 911246 - RNA, 19 nt, Homo sapiens
gucuucagauggccuggaa

SEQ ID NO: 911247 - RNA, 19 nt, Homo sapiens
cgaaggccaccugaaccua

SEQ ID NO: 911248 - RNA, 19 nt, Homo sapiens
guucuuggagucccaguuc

SEQ ID NO: 911249 - RNA, 19 nt, Homo sapiens
cgagcaacccggacuuugg

SEQ ID NO: 911250 - RNA, 19 nt, Homo sapiens
ucacacgggaacuucuauu

SEQ ID NO: 911251 - RNA, 19 nt, Homo sapiens
aaucacacgggaacuucua

SEQ ID NO: 911252 - RNA, 19 nt, Homo sapiens
aaaugcaccaguugaagga

SEQ ID NO: 911253 - RNA, 19 nt, Homo sapiens
gcccugaacucaagucuua

SEQ ID NO: 911254 - RNA, 19 nt, Homo sapiens
gcugaacucuguauuagua

SEQ ID NO: 911255 - RNA, 19 nt, Homo sapiens
ggauggacauuucuggaua

SEQ ID NO: 911256 - RNA, 19 nt, Homo sapiens
ggacauuucuggauacaca

SEQ ID NO: 911257 - RNA, 19 nt, Homo sapiens
gaacagugguggccagcuu

SEQ ID NO: 911258 - RNA, 19 nt, Homo sapiens
acacauaggacaaaguuua

SEQ ID NO: 911259 - RNA, 19 nt, Homo sapiens
ggaccagccugcggguuua

SEQ ID NO: 911260 - RNA, 19 nt, Homo sapiens
gcacagacacccucaguca

SEQ ID NO: 911261 - RNA, 19 nt, Homo sapiens
ggacuccucgcucuauaua

SEQ ID NO: 911262 - RNA, 19 nt, Homo sapiens
cgaaagagaauacgagaga

SEQ ID NO: 911263 - RNA, 19 nt, Homo sapiens
gaaggcaccucaugguuuu

SEQ ID NO: 911264 - RNA, 19 nt, Homo sapiens
ccacagagucuacuuugaa

SEQ ID NO: 911265 - RNA, 19 nt, Homo sapiens
gagcaccagugaguucuuu

SEQ ID NO: 911266 - RNA, 19 nt, Homo sapiens
gggcugaacucuguauuag

SEQ ID NO: 911267 - RNA, 19 nt, Homo sapiens
gcacacacacgcagacaga

SEQ ID NO: 911268 - RNA, 19 nt, Homo sapiens
acaauguggucuaccgaua

SEQ ID NO: 911269 - RNA, 19 nt, Homo sapiens
cuaccugucugccugcuuu

SEQ ID NO: 911270 - RNA, 19 nt, Homo sapiens
ggauacacauacacauaca

SEQ ID NO: 911271 - RNA, 19 nt, Homo sapiens
ugaaggcaccucaugguuu

SEQ ID NO: 911272 - RNA, 19 nt, Homo sapiens
gcaauaauaacugugaaug

SEQ ID NO: 911273 - RNA, 19 nt, Homo sapiens
cagaauaaggagagaauga

SEQ ID NO: 911274 - RNA, 19 nt, Homo sapiens
aaggagggcugaacucugu

SEQ ID NO: 911275 - RNA, 19 nt, Homo sapiens
acucaagucuuacgcuuug

SEQ ID NO: 911276 - RNA, 19 nt, Homo sapiens
uggaugcggucuucauuga

SEQ ID NO: 911277 - RNA, 19 nt, Homo sapiens
ucacgaugcugguauuugg

SEQ ID NO: 911278 - RNA, 19 nt, Homo sapiens
caaguaaccuggacaucac

SEQ ID NO: 911279 - RNA, 19 nt, Homo sapiens
gaugcggucuucauugaca

SEQ ID NO: 911280 - RNA, 19 nt, Homo sapiens
agacagacacaccgacuuu

SEQ ID NO: 911281 - RNA, 19 nt, Homo sapiens
cuucuucucuucccucuug

SEQ ID NO: 911282 - RNA, 19 nt, Homo sapiens
ccaaaccgauuccuucacu

SEQ ID NO: 911283 - RNA, 19 nt, Homo sapiens
ucucuucccucuugauguu

SEQ ID NO: 911284 - RNA, 19 nt, Homo sapiens
caucagagccagacaggau

SEQ ID NO: 911285 - RNA, 19 nt, Homo sapiens
gcaaaccagacacauagga

SEQ ID NO: 911286 - RNA, 19 nt, Homo sapiens
cuauaaacgcuacaucaaa

SEQ ID NO: 911287 - RNA, 19 nt, Homo sapiens
gccacagagucuacuuuga

SEQ ID NO: 911288 - RNA, 19 nt, Homo sapiens
gaauaaggagagaaugaca

SEQ ID NO: 911289 - RNA, 19 nt, Homo sapiens
gcucugcggugccuuacuc

SEQ ID NO: 911290 - RNA, 19 nt, Homo sapiens
ugacccaccaguacaagua

SEQ ID NO: 911291 - RNA, 19 nt, Homo sapiens
ccaucgcgcucaaauccuu

SEQ ID NO: 911292 - RNA, 19 nt, Homo sapiens
uacucgcccugcaauaaua

SEQ ID NO: 911293 - RNA, 19 nt, Homo sapiens
ggacggcuaccaacaugau

SEQ ID NO: 911294 - RNA, 19 nt, Homo sapiens
gauggacauuucuggauac

SEQ ID NO: 911295 - RNA, 19 nt, Homo sapiens
ggucuucauugacacaagu

SEQ ID NO: 911296 - RNA, 19 nt, Homo sapiens
aaaagaagguguccugcuu

SEQ ID NO: 911297 - RNA, 19 nt, Homo sapiens
agacacauaggacaaaguu

SEQ ID NO: 911298 - RNA, 19 nt, Homo sapiens
gggcugagcaccagugagu

SEQ ID NO: 911299 - RNA, 19 nt, Homo sapiens
ggaguccguuuuauaguga

SEQ ID NO: 911300 - RNA, 19 nt, Homo sapiens
cuacgucuccuuccucuuc

SEQ ID NO: 911301 - RNA, 19 nt, Homo sapiens
ggauggccaugcucgucaa

SEQ ID NO: 911302 - RNA, 19 nt, Homo sapiens
cuacguggaugcggucuuc

SEQ ID NO: 911303 - RNA, 19 nt, Homo sapiens
ccgcaaaccagacacauag

SEQ ID NO: 911304 - RNA, 19 nt, Homo sapiens
ucaaauccuucgccuucau

SEQ ID NO: 911305 - RNA, 19 nt, Homo sapiens
gcccugcaauaauaacugu

SEQ ID NO: 911306 - RNA, 19 nt, Homo sapiens
ugagagugaucccgaaggu

SEQ ID NO: 911307 - RNA, 19 nt, Homo sapiens
acaaguaaccuggacauca

SEQ ID NO: 911308 - RNA, 19 nt, Homo sapiens
gguuuauccugggcucuuu

SEQ ID NO: 911309 - RNA, 19 nt, Homo sapiens
gagccagacaggauucaga

SEQ ID NO: 911310 - RNA, 19 nt, Homo sapiens
ccuacucgcccugcaauaa

SEQ ID NO: 911311 - RNA, 19 nt, Homo sapiens
cuggauacacauacacaua

SEQ ID NO: 911312 - RNA, 19 nt, Homo sapiens
aggcacagaugcacacaca

SEQ ID NO: 911313 - RNA, 19 nt, Homo sapiens
gugcuugucuggguaucuu

SEQ ID NO: 911314 - RNA, 19 nt, Homo sapiens
gcucucaaacccuguguuc

SEQ ID NO: 911315 - RNA, 19 nt, Homo sapiens
cacagagucuacuuugaag

SEQ ID NO: 911316 - RNA, 19 nt, Homo sapiens
ggccacagagucuacuuug

SEQ ID NO: 911317 - RNA, 19 nt, Homo sapiens
cagcagugccuccuguuuc

SEQ ID NO: 911318 - RNA, 19 nt, Homo sapiens
gcugagcaccagugaguuc

SEQ ID NO: 911319 - RNA, 19 nt, Homo sapiens
cgacuccaccugccuguuc

SEQ ID NO: 911320 - RNA, 19 nt, Homo sapiens
cagacacccucagucauca

SEQ ID NO: 911321 - RNA, 19 nt, Homo sapiens
ccggacggcuaccaacaug

SEQ ID NO: 911322 - RNA, 19 nt, Homo sapiens
ggguuacuguucccuaugg

SEQ ID NO: 911323 - RNA, 19 nt, Homo sapiens
guaccuggagcagcaguuu

SEQ ID NO: 911324 - RNA, 19 nt, Homo sapiens
auccugggcucuuucugua

SEQ ID NO: 911325 - RNA, 19 nt, Homo sapiens
cuuggaggauggacauuuc

SEQ ID NO: 911326 - RNA, 19 nt, Homo sapiens
cacauaggacaaaguuuau

SEQ ID NO: 911327 - RNA, 19 nt, Homo sapiens
ucagucaucauccucauca

SEQ ID NO: 911328 - RNA, 19 nt, Homo sapiens
gaagaagcucagccugucu

SEQ ID NO: 911329 - RNA, 19 nt, Homo sapiens
ucccgaaggucaccaagca

SEQ ID NO: 911330 - RNA, 19 nt, Homo sapiens
gcaaccggacggcuaccaa

SEQ ID NO: 911331 - RNA, 19 nt, Homo sapiens
gcuuggaggauggacauuu

SEQ ID NO: 911332 - RNA, 19 nt, Homo sapiens
gggccacagagucuacuuu

SEQ ID NO: 911333 - RNA, 19 nt, Homo sapiens
ggagggcugaacucuguau

SEQ ID NO: 911334 - RNA, 19 nt, Homo sapiens
acagacacccucagucauc

SEQ ID NO: 911335 - RNA, 19 nt, Homo sapiens
cuuccucacuuuccucugu

SEQ ID NO: 911336 - RNA, 19 nt, Homo sapiens
gccuuacucuucuucucuu

SEQ ID NO: 911337 - RNA, 19 nt, Homo sapiens
acacaccgacuuuguccuu

SEQ ID NO: 911338 - RNA, 19 nt, Homo sapiens
ggccaugcucuccgaaaga

SEQ ID NO: 911339 - RNA, 19 nt, Homo sapiens
gauacacauacacauacaa

SEQ ID NO: 911340 - RNA, 19 nt, Homo sapiens
uaaaggagggcugaacucu

SEQ ID NO: 911341 - RNA, 19 nt, Homo sapiens
gcgcugacgugggugugau

SEQ ID NO: 911342 - RNA, 19 nt, Homo sapiens
ccagacacauaggacaaag

SEQ ID NO: 911343 - RNA, 19 nt, Homo sapiens
caauaauaacugugaaugc

SEQ ID NO: 911344 - RNA, 19 nt, Homo sapiens
cuacucgcccugcaauaau

SEQ ID NO: 911345 - RNA, 19 nt, Homo sapiens
acacacacaggcacagaug

SEQ ID NO: 911346 - RNA, 19 nt, Homo sapiens
agggcugaacucuguauua

SEQ ID NO: 911347 - RNA, 19 nt, Homo sapiens
cauaggacaaaguuuaucu

SEQ ID NO: 911348 - RNA, 19 nt, Homo sapiens
acuauaaacgcuacaucaa

SEQ ID NO: 911349 - RNA, 19 nt, Homo sapiens
gcaucgccaucgcgcucaa

SEQ ID NO: 911350 - RNA, 19 nt, Homo sapiens
cuacgacaauguggucuac

SEQ ID NO: 911351 - RNA, 19 nt, Homo sapiens
caccgucccugcugagaac

SEQ ID NO: 911352 - RNA, 19 nt, Homo sapiens
uuuccaacaucaagaucuu

SEQ ID NO: 911353 - RNA, 19 nt, Homo sapiens
gaaaggagauuugacauau

SEQ ID NO: 911354 - RNA, 19 nt, Homo sapiens
ggaauugguugucuccuua

SEQ ID NO: 911355 - RNA, 19 nt, Homo sapiens
gaaauuugcuugugauugu

SEQ ID NO: 911356 - RNA, 19 nt, Homo sapiens
ggauauagcuaugccuuua

SEQ ID NO: 911357 - RNA, 19 nt, Homo sapiens
gauggaagcuuugaaauug

SEQ ID NO: 911358 - RNA, 19 nt, Homo sapiens
gggcuuaucuauagcuuua

SEQ ID NO: 911359 - RNA, 19 nt, Homo sapiens
gaugauauccuucuuguuu

SEQ ID NO: 911360 - RNA, 19 nt, Homo sapiens
ggaccaacaucaacauuug

SEQ ID NO: 911361 - RNA, 19 nt, Homo sapiens
caaauugucuuuaguugga

SEQ ID NO: 911362 - RNA, 19 nt, Homo sapiens
gcacugggaucucuguuug

SEQ ID NO: 911363 - RNA, 19 nt, Homo sapiens
caacuaacauugcauugau

SEQ ID NO: 911364 - RNA, 19 nt, Homo sapiens
gaacaucaccugagauagu

SEQ ID NO: 911365 - RNA, 19 nt, Homo sapiens
gcacuagguggaaucauua

SEQ ID NO: 911366 - RNA, 19 nt, Homo sapiens
cgugguaucuguaguuuaa

SEQ ID NO: 911367 - RNA, 19 nt, Homo sapiens
gaaacacuuuggauguauu

SEQ ID NO: 911368 - RNA, 19 nt, Homo sapiens
guuagugugugauacaaua

SEQ ID NO: 911369 - RNA, 19 nt, Homo sapiens
ggaacaauggaauaacuua

SEQ ID NO: 911370 - RNA, 19 nt, Homo sapiens
gcaauggauucaagauguu

SEQ ID NO: 911371 - RNA, 19 nt, Homo sapiens
uggaauaacuuaccuguca

SEQ ID NO: 911372 - RNA, 19 nt, Homo sapiens
gaagcaaacuuagaauucu

SEQ ID NO: 911373 - RNA, 19 nt, Homo sapiens
gagcuuguaggauauauaa

SEQ ID NO: 911374 - RNA, 19 nt, Homo sapiens
ggacauucuuccuuguauu

SEQ ID NO: 911375 - RNA, 19 nt, Homo sapiens
gguugcaacuggaauguuu

SEQ ID NO: 911376 - RNA, 19 nt, Homo sapiens
ugacaucuuuaccacauuu

SEQ ID NO: 911377 - RNA, 19 nt, Homo sapiens
gacauauccucuucucuug

SEQ ID NO: 911378 - RNA, 19 nt, Homo sapiens
ggaauucuagcuccaauau

SEQ ID NO: 911379 - RNA, 19 nt, Homo sapiens
ggugaaugcccaagagaua

SEQ ID NO: 911380 - RNA, 19 nt, Homo sapiens
caaugcugcugccaacuaa

SEQ ID NO: 911381 - RNA, 19 nt, Homo sapiens
ggaugaagcaaacuuagaa

SEQ ID NO: 911382 - RNA, 19 nt, Homo sapiens
gcaauggguuuccagucaa

SEQ ID NO: 911383 - RNA, 19 nt, Homo sapiens
gcuaugccuuuaugguuaa

SEQ ID NO: 911384 - RNA, 19 nt, Homo sapiens
ggauaagucuaugcaucua

SEQ ID NO: 911385 - RNA, 19 nt, Homo sapiens
gaaucugggucacacaugu

SEQ ID NO: 911386 - RNA, 19 nt, Homo sapiens
uaugggaacuggaaguauu

SEQ ID NO: 911387 - RNA, 19 nt, Homo sapiens
aaagugagaggcaugguua

SEQ ID NO: 911388 - RNA, 19 nt, Homo sapiens
ccucuucucuugcugguuu

SEQ ID NO: 911389 - RNA, 19 nt, Homo sapiens
gaaccagucugugggaaca

SEQ ID NO: 911390 - RNA, 19 nt, Homo sapiens
ggacaagauagauuaauag

SEQ ID NO: 911391 - RNA, 19 nt, Homo sapiens
ggccuaaccuugaccuaug

SEQ ID NO: 911392 - RNA, 19 nt, Homo sapiens
caugggauauuauagguau

SEQ ID NO: 911393 - RNA, 19 nt, Homo sapiens
ucauucagcuauauugcua

SEQ ID NO: 911394 - RNA, 19 nt, Homo sapiens
ggagguaccacauuuaucu

SEQ ID NO: 911395 - RNA, 19 nt, Homo sapiens
ccuugugucuggacuauuu

SEQ ID NO: 911396 - RNA, 19 nt, Homo sapiens
ugggaucucuguuugcuaa

SEQ ID NO: 911397 - RNA, 19 nt, Homo sapiens
gucagcaucuucagagaaa

SEQ ID NO: 911398 - RNA, 19 nt, Homo sapiens
cuacacagaccgaaguuaa

SEQ ID NO: 911399 - RNA, 19 nt, Homo sapiens
acaagacgcugcaauggau

SEQ ID NO: 911400 - RNA, 19 nt, Homo sapiens
gaccuaugauggaaauaau

SEQ ID NO: 911401 - RNA, 19 nt, Homo sapiens
cuacuugggcuuaucuaua

SEQ ID NO: 911402 - RNA, 19 nt, Homo sapiens
caacaggagguaccacauu

SEQ ID NO: 911403 - RNA, 19 nt, Homo sapiens
gacauucuuccuuguauuu

SEQ ID NO: 911404 - RNA, 19 nt, Homo sapiens
ugacauauccucuucucuu

SEQ ID NO: 911405 - RNA, 19 nt, Homo sapiens
guaauuguuugguaguugu

SEQ ID NO: 911406 - RNA, 19 nt, Homo sapiens
gaaauuacucagcacacuu

SEQ ID NO: 911407 - RNA, 19 nt, Homo sapiens
agaccgaaguuaauuggaa

SEQ ID NO: 911408 - RNA, 19 nt, Homo sapiens
gaacagauaguaaaacaug

SEQ ID NO: 911409 - RNA, 19 nt, Homo sapiens
guaccacauuuaucuuguu

SEQ ID NO: 911410 - RNA, 19 nt, Homo sapiens
ucauguagauguaccacuu

SEQ ID NO: 911411 - RNA, 19 nt, Homo sapiens
uuacuucgaugauauccuu

SEQ ID NO: 911412 - RNA, 19 nt, Homo sapiens
gauuugacauauccucuuc

SEQ ID NO: 911413 - RNA, 19 nt, Homo sapiens
agaaaggagauuugacaua

SEQ ID NO: 911414 - RNA, 19 nt, Homo sapiens
aacaggagguaccacauuu

SEQ ID NO: 911415 - RNA, 19 nt, Homo sapiens
cauaaacucuuuguucucu

SEQ ID NO: 911416 - RNA, 19 nt, Homo sapiens
gcaauugugaugaaaguca

SEQ ID NO: 911417 - RNA, 19 nt, Homo sapiens
gauguaccacuuucuuauu

SEQ ID NO: 911418 - RNA, 19 nt, Homo sapiens
ggccuggauuuaugcuaua

SEQ ID NO: 911419 - RNA, 19 nt, Homo sapiens
gaccgaaguuaauuggaau

SEQ ID NO: 911420 - RNA, 19 nt, Homo sapiens
ggaaauuugcuugugauug

SEQ ID NO: 911421 - RNA, 19 nt, Homo sapiens
ugaaacacuuuggauguau

SEQ ID NO: 911422 - RNA, 19 nt, Homo sapiens
ugagaggcaugguuagugu

SEQ ID NO: 911423 - RNA, 19 nt, Homo sapiens
gguuuccagucaaugguua

SEQ ID NO: 911424 - RNA, 19 nt, Homo sapiens
gcagcuuuauugguucuuu

SEQ ID NO: 911425 - RNA, 19 nt, Homo sapiens
gauagaaaucaaacagcua

SEQ ID NO: 911426 - RNA, 19 nt, Homo sapiens
accagugacuagaauauaa

SEQ ID NO: 911427 - RNA, 19 nt, Homo sapiens
ccaacauucuuuacuuaca

SEQ ID NO: 911428 - RNA, 19 nt, Homo sapiens
ugaagcaaacuuagaauuc

SEQ ID NO: 911429 - RNA, 19 nt, Homo sapiens
gaauucuagcuccaauaua

SEQ ID NO: 911430 - RNA, 19 nt, Homo sapiens
guggaucuaugucuucaug

SEQ ID NO: 911431 - RNA, 19 nt, Homo sapiens
gcuugugauuguauuugua

SEQ ID NO: 911432 - RNA, 19 nt, Homo sapiens
uuccaucacucaaauagaa

SEQ ID NO: 911433 - RNA, 19 nt, Homo sapiens
gaauugaaagcacuugcaa

SEQ ID NO: 911434 - RNA, 19 nt, Homo sapiens
ggagcuugguggcuugguu

SEQ ID NO: 911435 - RNA, 19 nt, Homo sapiens
ggaaugauugguccaguca

SEQ ID NO: 911436 - RNA, 19 nt, Homo sapiens
ccauauuaauccaucagaa

SEQ ID NO: 911437 - RNA, 19 nt, Homo sapiens
caacauucuuuacuuacag

SEQ ID NO: 911438 - RNA, 19 nt, Homo sapiens
gaggaauucuagcuccaau

SEQ ID NO: 911439 - RNA, 19 nt, Homo sapiens
gucauaaacucuuuguucu

SEQ ID NO: 911440 - RNA, 19 nt, Homo sapiens
uuagguaguuugaaugcaa

SEQ ID NO: 911441 - RNA, 19 nt, Homo sapiens
aacaucaccugagauagua

SEQ ID NO: 911442 - RNA, 19 nt, Homo sapiens
ggaaguauuuugacaucuu

SEQ ID NO: 911443 - RNA, 19 nt, Homo sapiens
ugauggaagcuuugaaauu

SEQ ID NO: 911444 - RNA, 19 nt, Homo sapiens
gacaauuccaacauucuuu

SEQ ID NO: 911445 - RNA, 19 nt, Homo sapiens
ugcaaauccucaaguggua

SEQ ID NO: 911446 - RNA, 19 nt, Homo sapiens
uagauguaccacuuucuua

SEQ ID NO: 911447 - RNA, 19 nt, Homo sapiens
uggaacaucaccugagaua

SEQ ID NO: 911448 - RNA, 19 nt, Homo sapiens
gccuuuaugguuaagauua

SEQ ID NO: 911449 - RNA, 19 nt, Homo sapiens
caucggacaaugaaagaaa

SEQ ID NO: 911450 - RNA, 19 nt, Homo sapiens
gcccugucauucagcuaua

SEQ ID NO: 911451 - RNA, 19 nt, Homo sapiens
ugcaauggauucaagaugu

SEQ ID NO: 911452 - RNA, 19 nt, Homo sapiens
caauucaagucauaaacuc

SEQ ID NO: 911453 - RNA, 19 nt, Homo sapiens
gcagaugccuuugacauua

SEQ ID NO: 911454 - RNA, 19 nt, Homo sapiens
ggacagcgcucaugaacau

SEQ ID NO: 911455 - RNA, 19 nt, Homo sapiens
ggacagagaagccaaagaa

SEQ ID NO: 911456 - RNA, 19 nt, Homo sapiens
auacagagaugccaauuga

SEQ ID NO: 911457 - RNA, 19 nt, Homo sapiens
ucucagaugucaaugauaa

SEQ ID NO: 911458 - RNA, 19 nt, Homo sapiens
ccagaaacauuaccagaug

SEQ ID NO: 911459 - RNA, 19 nt, Homo sapiens
ggaaucagcuccaauuagc

SEQ ID NO: 911460 - RNA, 19 nt, Homo sapiens
ggagacggauccaucaaau

SEQ ID NO: 911461 - RNA, 19 nt, Homo sapiens
ugacaaugcuccagaguuc

SEQ ID NO: 911462 - RNA, 19 nt, Homo sapiens
gaacaaccauacagaucau

SEQ ID NO: 911463 - RNA, 19 nt, Homo sapiens
gaacaaucccucccagguu

SEQ ID NO: 911464 - RNA, 19 nt, Homo sapiens
gaggaaagagcccaguaua

SEQ ID NO: 911465 - RNA, 19 nt, Homo sapiens
ggaccgacccuuuguaugu

SEQ ID NO: 911466 - RNA, 19 nt, Homo sapiens
gaaccuggcuuuuacuuug

SEQ ID NO: 911467 - RNA, 19 nt, Homo sapiens
gcagagaugaaauauacua

SEQ ID NO: 911468 - RNA, 19 nt, Homo sapiens
gaaacaaccauacaucauc

SEQ ID NO: 911469 - RNA, 19 nt, Homo sapiens
caaagaauacuacgaagug

SEQ ID NO: 911470 - RNA, 19 nt, Homo sapiens
gcacagaucccaauuucca

SEQ ID NO: 911471 - RNA, 19 nt, Homo sapiens
ggauggagauggugcagau

SEQ ID NO: 911472 - RNA, 19 nt, Homo sapiens
uagaagcacuccugucaga

SEQ ID NO: 911473 - RNA, 19 nt, Homo sapiens
uagcacagaucccaauuuc

SEQ ID NO: 911474 - RNA, 19 nt, Homo sapiens
ggagaguguuugccaagga

SEQ ID NO: 911475 - RNA, 19 nt, Homo sapiens
acagagaagccaaagaaua

SEQ ID NO: 911476 - RNA, 19 nt, Homo sapiens
ggaacaaccauacagauca

SEQ ID NO: 911477 - RNA, 19 nt, Homo sapiens
ggaaagagcccaguauacu

SEQ ID NO: 911478 - RNA, 19 nt, Homo sapiens
gugcugguguugcucauuu

SEQ ID NO: 911479 - RNA, 19 nt, Homo sapiens
gaccuuauguggccacugu

SEQ ID NO: 911480 - RNA, 19 nt, Homo sapiens
gcagugacccuggaagauu

SEQ ID NO: 911481 - RNA, 19 nt, Homo sapiens
caacaucacccucucagau

SEQ ID NO: 911482 - RNA, 19 nt, Homo sapiens
guucuacucucguaucugu

SEQ ID NO: 911483 - RNA, 19 nt, Homo sapiens
gaaggaagagggcagaauc

SEQ ID NO: 911484 - RNA, 19 nt, Homo sapiens
cugcaucuuuguccucuua

SEQ ID NO: 911485 - RNA, 19 nt, Homo sapiens
caagaugacccacgcaaug

SEQ ID NO: 911486 - RNA, 19 nt, Homo sapiens
uaucauaacugugaagaag

SEQ ID NO: 911487 - RNA, 19 nt, Homo sapiens
ucaaugcagagaugaaaua

SEQ ID NO: 911488 - RNA, 19 nt, Homo sapiens
gagggcagcuuggaggauu

SEQ ID NO: 911489 - RNA, 19 nt, Homo sapiens
cuaaggccuuugucacuuu

SEQ ID NO: 911490 - RNA, 19 nt, Homo sapiens
gagggcagaaucuuuaauu

SEQ ID NO: 911491 - RNA, 19 nt, Homo sapiens
caaucaaagucuuagaugu

SEQ ID NO: 911492 - RNA, 19 nt, Homo sapiens
uacaacaggugcccuaaug

SEQ ID NO: 911493 - RNA, 19 nt, Homo sapiens
cagugacccuggaagauuu

SEQ ID NO: 911494 - RNA, 19 nt, Homo sapiens
gaucccaauuuccaaguug

SEQ ID NO: 911495 - RNA, 19 nt, Homo sapiens
caauggagcccgagucaga

SEQ ID NO: 911496 - RNA, 19 nt, Homo sapiens
cgacaccacuggagacauc

SEQ ID NO: 911497 - RNA, 19 nt, Homo sapiens
gcuaaggccuuugucacuu

SEQ ID NO: 911498 - RNA, 19 nt, Homo sapiens
uaagggacaaccaagauaa

SEQ ID NO: 911499 - RNA, 19 nt, Homo sapiens
gaaguguuccugucacaau

SEQ ID NO: 911500 - RNA, 19 nt, Homo sapiens
ggaaacaaccauacaucau

SEQ ID NO: 911501 - RNA, 19 nt, Homo sapiens
uaacacagcacggauucua

SEQ ID NO: 911502 - RNA, 19 nt, Homo sapiens
caacagugcacaucagugu

SEQ ID NO: 911503 - RNA, 19 nt, Homo sapiens
caagaaaagcuacaccuua

SEQ ID NO: 911504 - RNA, 19 nt, Homo sapiens
cagaaacauuaccagauga

SEQ ID NO: 911505 - RNA, 19 nt, Homo sapiens
gagacggauccaucaaaua

SEQ ID NO: 911506 - RNA, 19 nt, Homo sapiens
auacugugcuggagaguga

SEQ ID NO: 911507 - RNA, 19 nt, Homo sapiens
caacaacagugcacaucag

SEQ ID NO: 911508 - RNA, 19 nt, Homo sapiens
acagagaugccaauugaaa

SEQ ID NO: 911509 - RNA, 19 nt, Homo sapiens
cauccucgccugcaucuuu

SEQ ID NO: 911510 - RNA, 19 nt, Homo sapiens
gauacuccauugauagaag

SEQ ID NO: 911511 - RNA, 19 nt, Homo sapiens
aagaaaagcuacaccuuaa

SEQ ID NO: 911512 - RNA, 19 nt, Homo sapiens
gagaagccaaagaauacua

SEQ ID NO: 911513 - RNA, 19 nt, Homo sapiens
gaaagagcccaguauacuc

SEQ ID NO: 911514 - RNA, 19 nt, Homo sapiens
agggcagaaucuuuaauua

SEQ ID NO: 911515 - RNA, 19 nt, Homo sapiens
ggacaaccaagauaacaca

SEQ ID NO: 911516 - RNA, 19 nt, Homo sapiens
gaaugagcaaugcaaagaa

SEQ ID NO: 911517 - RNA, 19 nt, Homo sapiens
augcagagaugaaauauac

SEQ ID NO: 911518 - RNA, 19 nt, Homo sapiens
cagagaagccaaagaauac

SEQ ID NO: 911519 - RNA, 19 nt, Homo sapiens
ugagugcgguggaccaaga

SEQ ID NO: 911520 - RNA, 19 nt, Homo sapiens
gaccaacaacucaaucaga

SEQ ID NO: 911521 - RNA, 19 nt, Homo sapiens
ggaggugccugaggaugug

SEQ ID NO: 911522 - RNA, 19 nt, Homo sapiens
gagccaauccucaccuaga

SEQ ID NO: 911523 - RNA, 19 nt, Homo sapiens
gcaaucccauguggacuuc

SEQ ID NO: 911524 - RNA, 19 nt, Homo sapiens
ucggcaagcuucauucaga

SEQ ID NO: 911525 - RNA, 19 nt, Homo sapiens
gccauucgcuaaggccuuu

SEQ ID NO: 911526 - RNA, 19 nt, Homo sapiens
gcuaacaaccccaacuuua

SEQ ID NO: 911527 - RNA, 19 nt, Homo sapiens
cagcugauccagacaguga

SEQ ID NO: 911528 - RNA, 19 nt, Homo sapiens
ugaagaagccccugaguuu

SEQ ID NO: 911529 - RNA, 19 nt, Homo sapiens
ccagaugaguguguuggaa

SEQ ID NO: 911530 - RNA, 19 nt, Homo sapiens
cauguggacuucugguaga

SEQ ID NO: 911531 - RNA, 19 nt, Homo sapiens
aaagaauacuacgaaguga

SEQ ID NO: 911532 - RNA, 19 nt, Homo sapiens
gacuuggcauguccuugua

SEQ ID NO: 911533 - RNA, 19 nt, Homo sapiens
caucaucgacgacgaggaa

SEQ ID NO: 911534 - RNA, 19 nt, Homo sapiens
gauaacacagcacggauuc

SEQ ID NO: 911535 - RNA, 19 nt, Homo sapiens
ucacuguccuugcuaugga

SEQ ID NO: 911536 - RNA, 19 nt, Homo sapiens
gaacuugggcccauuucag

SEQ ID NO: 911537 - RNA, 19 nt, Homo sapiens
agucagaguucaucaucaa

SEQ ID NO: 911538 - RNA, 19 nt, Homo sapiens
gagaggaaagagcccagua

SEQ ID NO: 911539 - RNA, 19 nt, Homo sapiens
ccucagacgugcgcaguga

SEQ ID NO: 911540 - RNA, 19 nt, Homo sapiens
gcaagcuucauucagauau

SEQ ID NO: 911541 - RNA, 19 nt, Homo sapiens
caacaacucaaucagauac

SEQ ID NO: 911542 - RNA, 19 nt, Homo sapiens
ccaacaacucaaucagaua

SEQ ID NO: 911543 - RNA, 19 nt, Homo sapiens
gggagccaauccucaccua

SEQ ID NO: 911544 - RNA, 19 nt, Homo sapiens
guugguaucauaacuguga

SEQ ID NO: 911545 - RNA, 19 nt, Homo sapiens
aagaggagcuggguuugga

SEQ ID NO: 911546 - RNA, 19 nt, Homo sapiens
ggucagcauuucuacuaca

SEQ ID NO: 911547 - RNA, 19 nt, Homo sapiens
gaauacuacgaagugauua

SEQ ID NO: 911548 - RNA, 19 nt, Homo sapiens
agacaucaaugacaaugag

SEQ ID NO: 911549 - RNA, 19 nt, Homo sapiens
gauacagagaugccaauug

SEQ ID NO: 911550 - RNA, 19 nt, Homo sapiens
ggccuuggauacagagaug

SEQ ID NO: 911551 - RNA, 19 nt, Homo sapiens
ggaacagagcuucgacuuc

SEQ ID NO: 911552 - RNA, 19 nt, Homo sapiens
caagcuucauucagauaug

SEQ ID NO: 911553 - RNA, 19 nt, Homo sapiens
ggucugaguuccuauuaua

SEQ ID NO: 911554 - RNA, 19 nt, Homo sapiens
acacaaauaugcuccuaua

SEQ ID NO: 911555 - RNA, 19 nt, Homo sapiens
caaauaugcuccuauacug

SEQ ID NO: 911556 - RNA, 19 nt, Homo sapiens
ggccaaggcgggucgauua

SEQ ID NO: 911557 - RNA, 19 nt, Homo sapiens
gguauuguguguaugcauu

SEQ ID NO: 911558 - RNA, 19 nt, Homo sapiens
caaauacucuugguugaca

SEQ ID NO: 911559 - RNA, 19 nt, Homo sapiens
gagagcaggugcguuucua

SEQ ID NO: 911560 - RNA, 19 nt, Homo sapiens
gcaagacuccaucucgaaa

SEQ ID NO: 911561 - RNA, 19 nt, Homo sapiens
gcagcagugucccuucuug

SEQ ID NO: 911562 - RNA, 19 nt, Homo sapiens
caaggcgggucgauuacuu

SEQ ID NO: 911563 - RNA, 19 nt, Homo sapiens
caagaaggagauugacaaa

SEQ ID NO: 911564 - RNA, 19 nt, Homo sapiens
gagcugccguuccucuuuc

SEQ ID NO: 911565 - RNA, 19 nt, Homo sapiens
caacagagcaagacuccau

SEQ ID NO: 911566 - RNA, 19 nt, Homo sapiens
gcaggagaauugcuugaac

SEQ ID NO: 911567 - RNA, 19 nt, Homo sapiens
guccagguauuguguguau

SEQ ID NO: 911568 - RNA, 19 nt, Homo sapiens
uggagcagcuucuguaugg

SEQ ID NO: 911569 - RNA, 19 nt, Homo sapiens
cgacacugcuucucuugca

SEQ ID NO: 911570 - RNA, 19 nt, Homo sapiens
ggaagugcaaauacucuug

SEQ ID NO: 911571 - RNA, 19 nt, Homo sapiens
guaguggguucggagauga

SEQ ID NO: 911572 - RNA, 19 nt, Homo sapiens
gcuacguccuggucuauag

SEQ ID NO: 911573 - RNA, 19 nt, Homo sapiens
agaauugcuugaacucaga

SEQ ID NO: 911574 - RNA, 19 nt, Homo sapiens
ggaguguaguuuucuguuu

SEQ ID NO: 911575 - RNA, 19 nt, Homo sapiens
gagcaggugcguuucuaug

SEQ ID NO: 911576 - RNA, 19 nt, Homo sapiens
gcucagcacugggccaagu

SEQ ID NO: 911577 - RNA, 19 nt, Homo sapiens
uacgugggcuccauugaga

SEQ ID NO: 911578 - RNA, 19 nt, Homo sapiens
gaguguaguuuucuguuuu

SEQ ID NO: 911579 - RNA, 19 nt, Homo sapiens
ggagcccuuugucuacuug

SEQ ID NO: 911580 - RNA, 19 nt, Homo sapiens
acacacaaauaugcuccua

SEQ ID NO: 911581 - RNA, 19 nt, Homo sapiens
acaaauccaaggacaagaa

SEQ ID NO: 911582 - RNA, 19 nt, Homo sapiens
gcaggugcguuucuaugac

SEQ ID NO: 911583 - RNA, 19 nt, Homo sapiens
ugcaaauacucuugguuga

SEQ ID NO: 911584 - RNA, 19 nt, Homo sapiens
agaaggaggucaccaucgu

SEQ ID NO: 911585 - RNA, 19 nt, Homo sapiens
cgacacacacacacuuaug

SEQ ID NO: 911586 - RNA, 19 nt, Homo sapiens
caggagaauugcuugaacu

SEQ ID NO: 911587 - RNA, 19 nt, Homo sapiens
ccuguaaucccagcacuuu

SEQ ID NO: 911588 - RNA, 19 nt, Homo sapiens
ugaccuuucuccuguccuu

SEQ ID NO: 911589 - RNA, 19 nt, Homo sapiens
acaaauaugcuccuauacu

SEQ ID NO: 911590 - RNA, 19 nt, Homo sapiens
guguaugcauuuaguugug

SEQ ID NO: 911591 - RNA, 19 nt, Homo sapiens
gggucugaguuccuauuau

SEQ ID NO: 911592 - RNA, 19 nt, Homo sapiens
caggugcguuucuaugaca

SEQ ID NO: 911593 - RNA, 19 nt, Homo sapiens
ggagaauugcuugaacuca

SEQ ID NO: 911594 - RNA, 19 nt, Homo sapiens
ccucugggaagugcaaaua

SEQ ID NO: 911595 - RNA, 19 nt, Homo sapiens
ugacaaauccaaggacaag

SEQ ID NO: 911596 - RNA, 19 nt, Homo sapiens
ccaggcgucugugggcaaa

SEQ ID NO: 911597 - RNA, 19 nt, Homo sapiens
cauuaggcgucuccucauc

SEQ ID NO: 911598 - RNA, 19 nt, Homo sapiens
gcaaauacucuugguugac

SEQ ID NO: 911599 - RNA, 19 nt, Homo sapiens
cugaagagcugccguuccu

SEQ ID NO: 911600 - RNA, 19 nt, Homo sapiens
guauuguguguaugcauuu

SEQ ID NO: 911601 - RNA, 19 nt, Homo sapiens
cagauagcagagagucuuu

SEQ ID NO: 911602 - RNA, 19 nt, Homo sapiens
ggcugaggcaggagaauug

SEQ ID NO: 911603 - RNA, 19 nt, Homo sapiens
cuccuuggauggcugaaga

SEQ ID NO: 911604 - RNA, 19 nt, Homo sapiens
ugcgagagcaggugcguuu

SEQ ID NO: 911605 - RNA, 19 nt, Homo sapiens
uguaguggguucggagaug

SEQ ID NO: 911606 - RNA, 19 nt, Homo sapiens
aaaaggguguccagguauu

SEQ ID NO: 911607 - RNA, 19 nt, Homo sapiens
caucagcgacacacacaca

SEQ ID NO: 911608 - RNA, 19 nt, Homo sapiens
gaauugcuugaacucagaa

SEQ ID NO: 911609 - RNA, 19 nt, Homo sapiens
gcgacacacacacacuuau

SEQ ID NO: 911610 - RNA, 19 nt, Homo sapiens
ccaagucagagaaggugaa

SEQ ID NO: 911611 - RNA, 19 nt, Homo sapiens
gcguguagacccagaugug

SEQ ID NO: 911612 - RNA, 19 nt, Homo sapiens
gacacacacacacuuaugg

SEQ ID NO: 911613 - RNA, 19 nt, Homo sapiens
cugcuucucuugcacugau

SEQ ID NO: 911614 - RNA, 19 nt, Homo sapiens
ggcaggagaauugcuugaa

SEQ ID NO: 911615 - RNA, 19 nt, Homo sapiens
gggaagugcaaauacucuu

SEQ ID NO: 911616 - RNA, 19 nt, Homo sapiens
gcaaaguagaggacaagcu

SEQ ID NO: 911617 - RNA, 19 nt, Homo sapiens
gggcucugguagauguguu

SEQ ID NO: 911618 - RNA, 19 nt, Homo sapiens
caaauccaaggacaagaag

SEQ ID NO: 911619 - RNA, 19 nt, Homo sapiens
acagauagcagagagucuu

SEQ ID NO: 911620 - RNA, 19 nt, Homo sapiens
gaauaaccuugaauccuuu

SEQ ID NO: 911621 - RNA, 19 nt, Homo sapiens
auacauggcuucaguagaa

SEQ ID NO: 911622 - RNA, 19 nt, Homo sapiens
ugaauaaccuugaauccuu

SEQ ID NO: 911623 - RNA, 19 nt, Homo sapiens
gaaagaaaucgauaaguuc

SEQ ID NO: 911624 - RNA, 19 nt, Homo sapiens
gguagcaauugugguauua

SEQ ID NO: 911625 - RNA, 19 nt, Homo sapiens
gcaaaucaagcuuuccuuu

SEQ ID NO: 911626 - RNA, 19 nt, Homo sapiens
gcugauggcuucguucuug

SEQ ID NO: 911627 - RNA, 19 nt, Homo sapiens
caccagaggucuacaggaa

SEQ ID NO: 911628 - RNA, 19 nt, Homo sapiens
gaaacagaccgaggaguaa

SEQ ID NO: 911629 - RNA, 19 nt, Homo sapiens
gcgaaacaauggaagaugu

SEQ ID NO: 911630 - RNA, 19 nt, Homo sapiens
gaagaaagaaaucgauaag

SEQ ID NO: 911631 - RNA, 19 nt, Homo sapiens
aaagggaacucuaauucug

SEQ ID NO: 911632 - RNA, 19 nt, Homo sapiens
gaacaguuacaucuuuaug

SEQ ID NO: 911633 - RNA, 19 nt, Homo sapiens
agaaacagaccgaggagua

SEQ ID NO: 911634 - RNA, 19 nt, Homo sapiens
ggaaaucauacuauuggaa

SEQ ID NO: 911635 - RNA, 19 nt, Homo sapiens
gcugcaagguugugguuug

SEQ ID NO: 911636 - RNA, 19 nt, Homo sapiens
gcaauugugguauuaggaa

SEQ ID NO: 911637 - RNA, 19 nt, Homo sapiens
gcguggagcugccaaagca

SEQ ID NO: 911638 - RNA, 19 nt, Homo sapiens
aauggaagauugcgaaaca

SEQ ID NO: 911639 - RNA, 19 nt, Homo sapiens
aaacucugauugaaccauu

SEQ ID NO: 911640 - RNA, 19 nt, Homo sapiens
gaaccauucacuuuauuag

SEQ ID NO: 911641 - RNA, 19 nt, Homo sapiens
gggaaagggcugcaagguu

SEQ ID NO: 911642 - RNA, 19 nt, Homo sapiens
acaaagggaacucuaauuc

SEQ ID NO: 911643 - RNA, 19 nt, Homo sapiens
ucgauaaguucaaagacaa

SEQ ID NO: 911644 - RNA, 19 nt, Homo sapiens
cgaaacaauggaagaugua

SEQ ID NO: 911645 - RNA, 19 nt, Homo sapiens
caauugugguauuaggaaa

SEQ ID NO: 911646 - RNA, 19 nt, Homo sapiens
guucuuguguacaguguga

SEQ ID NO: 911647 - RNA, 19 nt, Homo sapiens
gcagcuccuuuauggaaau

SEQ ID NO: 911648 - RNA, 19 nt, Homo sapiens
aaaucaagcuuuccuuugc

SEQ ID NO: 911649 - RNA, 19 nt, Homo sapiens
cagagcaaaucaagcuuuc

SEQ ID NO: 911650 - RNA, 19 nt, Homo sapiens
gguugugguuuguggauug

SEQ ID NO: 911651 - RNA, 19 nt, Homo sapiens
ucacuuuauuagccaguaa

SEQ ID NO: 911652 - RNA, 19 nt, Homo sapiens
agagguagcaauuguggua

SEQ ID NO: 911653 - RNA, 19 nt, Homo sapiens
ugugguuuguggauuguua

SEQ ID NO: 911654 - RNA, 19 nt, Homo sapiens
gaaacaauggaagauguau

SEQ ID NO: 911655 - RNA, 19 nt, Homo sapiens
cuauuggaauggaagauug

SEQ ID NO: 911656 - RNA, 19 nt, Homo sapiens
aaacaaagggaacucuaau

SEQ ID NO: 911657 - RNA, 19 nt, Homo sapiens
caaagggaacucuaauucu

SEQ ID NO: 911658 - RNA, 19 nt, Homo sapiens
ccagagcaaaucaagcuuu

SEQ ID NO: 911659 - RNA, 19 nt, Homo sapiens
ggaauggaagauugcgaaa

SEQ ID NO: 911660 - RNA, 19 nt, Homo sapiens
caaagaguggagcuucuga

SEQ ID NO: 911661 - RNA, 19 nt, Homo sapiens
aaacagaccgaggaguaaa

SEQ ID NO: 911662 - RNA, 19 nt, Homo sapiens
gagcugccaaagcauuauu

SEQ ID NO: 911663 - RNA, 19 nt, Homo sapiens
acaaguggacgcugaagug

SEQ ID NO: 911664 - RNA, 19 nt, Homo sapiens
acaguuacaucuuuaugac

SEQ ID NO: 911665 - RNA, 19 nt, Homo sapiens
gaaagggcugcaagguugu

SEQ ID NO: 911666 - RNA, 19 nt, Homo sapiens
cugaagaaagaaaucgaua

SEQ ID NO: 911667 - RNA, 19 nt, Homo sapiens
gagacaaguggacgcugaa

SEQ ID NO: 911668 - RNA, 19 nt, Homo sapiens
guuuguggauuguuaucug

SEQ ID NO: 911669 - RNA, 19 nt, Homo sapiens
uggcuucaguagaaacaga

SEQ ID NO: 911670 - RNA, 19 nt, Homo sapiens
uagcaauugugguauuagg

SEQ ID NO: 911671 - RNA, 19 nt, Homo sapiens
cgauaaguucaaagacaaa

SEQ ID NO: 911672 - RNA, 19 nt, Homo sapiens
cagugugaauaaccuugaa

SEQ ID NO: 911673 - RNA, 19 nt, Homo sapiens
uggagcugccaaagcauua

SEQ ID NO: 911674 - RNA, 19 nt, Homo sapiens
aacaaagggaacucuaauu

SEQ ID NO: 911675 - RNA, 19 nt, Homo sapiens
gaucggaaaacucugauug

SEQ ID NO: 911676 - RNA, 19 nt, Homo sapiens
guauacauggcuucaguag

SEQ ID NO: 911677 - RNA, 19 nt, Homo sapiens
gagcaaaucaagcuuuccu

SEQ ID NO: 911678 - RNA, 19 nt, Homo sapiens
ugugggaggugacuguuac

SEQ ID NO: 911679 - RNA, 19 nt, Homo sapiens
aagggaacucuaauucuga

SEQ ID NO: 911680 - RNA, 19 nt, Homo sapiens
gaaaucgauaaguucaaag

SEQ ID NO: 911681 - RNA, 19 nt, Homo sapiens
uggcuucguucuuguguac

SEQ ID NO: 911682 - RNA, 19 nt, Homo sapiens
gccaguaaacuuucucaac

SEQ ID NO: 911683 - RNA, 19 nt, Homo sapiens
ggaaacaaaaucgaccuuu

SEQ ID NO: 911684 - RNA, 19 nt, Homo sapiens
agguagcaauugugguauu

SEQ ID NO: 911685 - RNA, 19 nt, Homo sapiens
gggcugcaagguugugguu

SEQ ID NO: 911686 - RNA, 19 nt, Homo sapiens
uggaaaucauacuauugga

SEQ ID NO: 911687 - RNA, 19 nt, Homo sapiens
guggagcugccaaagcauu

SEQ ID NO: 911688 - RNA, 19 nt, Homo sapiens
gcaaugaacuguuauuuac

SEQ ID NO: 911689 - RNA, 19 nt, Homo sapiens
ggagaaauguaaacaauca

SEQ ID NO: 911690 - RNA, 19 nt, Homo sapiens
ggaaaucuccuaucaggua

SEQ ID NO: 911691 - RNA, 19 nt, Homo sapiens
gcagugcagucaaauaauu

SEQ ID NO: 911692 - RNA, 19 nt, Homo sapiens
ggagcaaaguguucaauau

SEQ ID NO: 911693 - RNA, 19 nt, Homo sapiens
ccuaucagguauucuauua

SEQ ID NO: 911694 - RNA, 19 nt, Homo sapiens
ggaaagcccuagucuaugg

SEQ ID NO: 911695 - RNA, 19 nt, Homo sapiens
caacaggagucauaagaau

SEQ ID NO: 911696 - RNA, 19 nt, Homo sapiens
ugaaagaacaggugacaua

SEQ ID NO: 911697 - RNA, 19 nt, Homo sapiens
ucacagaacuuuuguauga

SEQ ID NO: 911698 - RNA, 19 nt, Homo sapiens
gaaccugucuucuacaucu

SEQ ID NO: 911699 - RNA, 19 nt, Homo sapiens
ccacagggaucauuuguag

SEQ ID NO: 911700 - RNA, 19 nt, Homo sapiens
gacgaucccucaaguggua

SEQ ID NO: 911701 - RNA, 19 nt, Homo sapiens
ggauaucaaugacaaugaa

SEQ ID NO: 911702 - RNA, 19 nt, Homo sapiens
gcuauucucauuugcauua

SEQ ID NO: 911703 - RNA, 19 nt, Homo sapiens
gcaaaguguucaauaucaa

SEQ ID NO: 911704 - RNA, 19 nt, Homo sapiens
ucaacgcaaugaacuguua

SEQ ID NO: 911705 - RNA, 19 nt, Homo sapiens
caagaugaguauuggguaa

SEQ ID NO: 911706 - RNA, 19 nt, Homo sapiens
aagaacaggugacauauau

SEQ ID NO: 911707 - RNA, 19 nt, Homo sapiens
uaacacagcugucauuuug

SEQ ID NO: 911708 - RNA, 19 nt, Homo sapiens
auagagaacugcaagauga

SEQ ID NO: 911709 - RNA, 19 nt, Homo sapiens
ccagaaggaacauuaguua

SEQ ID NO: 911710 - RNA, 19 nt, Homo sapiens
uacagaagcuugauagaga

SEQ ID NO: 911711 - RNA, 19 nt, Homo sapiens
cgaagaagcuaauacugau

SEQ ID NO: 911712 - RNA, 19 nt, Homo sapiens
cagaaccacuacgguauua

SEQ ID NO: 911713 - RNA, 19 nt, Homo sapiens
gaaaguuuauaccgcuuga

SEQ ID NO: 911714 - RNA, 19 nt, Homo sapiens
ccagugcgaucucauuuga

SEQ ID NO: 911715 - RNA, 19 nt, Homo sapiens
gaagauuucagagagaaua

SEQ ID NO: 911716 - RNA, 19 nt, Homo sapiens
guugggaccucgcuuuaaa

SEQ ID NO: 911717 - RNA, 19 nt, Homo sapiens
ggaaucccgucacuuacaa

SEQ ID NO: 911718 - RNA, 19 nt, Homo sapiens
gaaaucuccuaucagguau

SEQ ID NO: 911719 - RNA, 19 nt, Homo sapiens
gaacccaaugguagucuua

SEQ ID NO: 911720 - RNA, 19 nt, Homo sapiens
gcacacagaccugccagua

SEQ ID NO: 911721 - RNA, 19 nt, Homo sapiens
guacaaucacuacaaguaa

SEQ ID NO: 911722 - RNA, 19 nt, Homo sapiens
gugcuaauguguauucgaa

SEQ ID NO: 911723 - RNA, 19 nt, Homo sapiens
ugaaagcuaugauuaccuu

SEQ ID NO: 911724 - RNA, 19 nt, Homo sapiens
gguacaaucacuacaagua

SEQ ID NO: 911725 - RNA, 19 nt, Homo sapiens
ucaugaaacucaagaagga

SEQ ID NO: 911726 - RNA, 19 nt, Homo sapiens
gaaaauagacgagaaaaug

SEQ ID NO: 911727 - RNA, 19 nt, Homo sapiens
guagaagacacuaacaauu

SEQ ID NO: 911728 - RNA, 19 nt, Homo sapiens
cuuaagagcccagguaaua

SEQ ID NO: 911729 - RNA, 19 nt, Homo sapiens
ggaaguacuuuuaucauug

SEQ ID NO: 911730 - RNA, 19 nt, Homo sapiens
gaaaauguauagucagaga

SEQ ID NO: 911731 - RNA, 19 nt, Homo sapiens
aagauuagcaugcauguuu

SEQ ID NO: 911732 - RNA, 19 nt, Homo sapiens
gcagagcugaggaguagua

SEQ ID NO: 911733 - RNA, 19 nt, Homo sapiens
uagcagagcugaggaguag

SEQ ID NO: 911734 - RNA, 19 nt, Homo sapiens
gaaagaacaggugacauau

SEQ ID NO: 911735 - RNA, 19 nt, Homo sapiens
aaacaauucuuuccaguac

SEQ ID NO: 911736 - RNA, 19 nt, Homo sapiens
cuacaucuccaucuuaauu

SEQ ID NO: 911737 - RNA, 19 nt, Homo sapiens
gaagguacacagaaucaga

SEQ ID NO: 911738 - RNA, 19 nt, Homo sapiens
ccacagacccagacaauag

SEQ ID NO: 911739 - RNA, 19 nt, Homo sapiens
gaagaguaauaguuggaau

SEQ ID NO: 911740 - RNA, 19 nt, Homo sapiens
uaggaacaaucauggcaua

SEQ ID NO: 911741 - RNA, 19 nt, Homo sapiens
guaaauacuccaugguuau

SEQ ID NO: 911742 - RNA, 19 nt, Homo sapiens
gaaccaaaauuccuagaug

SEQ ID NO: 911743 - RNA, 19 nt, Homo sapiens
gaaccugagucugaguuug

SEQ ID NO: 911744 - RNA, 19 nt, Homo sapiens
gaucugauuuagacaaugg

SEQ ID NO: 911745 - RNA, 19 nt, Homo sapiens
uagguaaucuucguagaaa

SEQ ID NO: 911746 - RNA, 19 nt, Homo sapiens
caaccagauuugaaguaaa

SEQ ID NO: 911747 - RNA, 19 nt, Homo sapiens
cuaccuacaugcugucauu

SEQ ID NO: 911748 - RNA, 19 nt, Homo sapiens
gcugaggaguaguaccaua

SEQ ID NO: 911749 - RNA, 19 nt, Homo sapiens
aauggaaucccgucacuua

SEQ ID NO: 911750 - RNA, 19 nt, Homo sapiens
guuauuuacugcugcguuu

SEQ ID NO: 911751 - RNA, 19 nt, Homo sapiens
gauaaugguacaaucacua

SEQ ID NO: 911752 - RNA, 19 nt, Homo sapiens
gaaggaacauuaguuaucc

SEQ ID NO: 911753 - RNA, 19 nt, Homo sapiens
gggaauuccucuccuaugg

SEQ ID NO: 911754 - RNA, 19 nt, Homo sapiens
gacacaagauguagucgau

SEQ ID NO: 911755 - RNA, 19 nt, Homo sapiens
ggaaauucauucuggaaaa

SEQ ID NO: 911756 - RNA, 19 nt, Homo sapiens
cagauucuauuuccugaga

SEQ ID NO: 911757 - RNA, 19 nt, Homo sapiens
uagaagacacuaacaauuc

SEQ ID NO: 911758 - RNA, 19 nt, Homo sapiens
uauagaagguacacagaau

SEQ ID NO: 911759 - RNA, 19 nt, Homo sapiens
gaaccacuacgguauuaga

SEQ ID NO: 911760 - RNA, 19 nt, Homo sapiens
gaugagaggacacaagaug

SEQ ID NO: 911761 - RNA, 19 nt, Homo sapiens
uacagaggccuuugauaua

SEQ ID NO: 911762 - RNA, 19 nt, Homo sapiens
uagaacagaucucuucgau

SEQ ID NO: 911763 - RNA, 19 nt, Homo sapiens
ugguacaaccuaaguauua

SEQ ID NO: 911764 - RNA, 19 nt, Homo sapiens
gaacaggugacauauaugc

SEQ ID NO: 911765 - RNA, 19 nt, Homo sapiens
acaaccagauuugaaguaa

SEQ ID NO: 911766 - RNA, 19 nt, Homo sapiens
agaagacacuaacaauuca

SEQ ID NO: 911767 - RNA, 19 nt, Homo sapiens
ggaacaacaaguguauuaa

SEQ ID NO: 911768 - RNA, 19 nt, Homo sapiens
uggaacaacaaguguauua

SEQ ID NO: 911769 - RNA, 19 nt, Homo sapiens
gaaaugaauacgacuaguc

SEQ ID NO: 911770 - RNA, 19 nt, Homo sapiens
guacaaaucgagauaacau

SEQ ID NO: 911771 - RNA, 19 nt, Homo sapiens
gagaugaauccauagaaga

SEQ ID NO: 911772 - RNA, 19 nt, Homo sapiens
gagcaaaguguucaauauc

SEQ ID NO: 911773 - RNA, 19 nt, Homo sapiens
cgcaaugaacuguuauuua

SEQ ID NO: 911774 - RNA, 19 nt, Homo sapiens
auacagaggccuuugauau

SEQ ID NO: 911775 - RNA, 19 nt, Homo sapiens
ggacuucuauaggaacaau

SEQ ID NO: 911776 - RNA, 19 nt, Homo sapiens
aaagaacaggugacauaua

SEQ ID NO: 911777 - RNA, 19 nt, Homo sapiens
ccagcuaagaucugauuua

SEQ ID NO: 911778 - RNA, 19 nt, Homo sapiens
caugaaguauuguuuccuu

SEQ ID NO: 911779 - RNA, 19 nt, Homo sapiens
gaggaguaguaccauaaug

SEQ ID NO: 911780 - RNA, 19 nt, Homo sapiens
gguauuagagcaaaaguua

SEQ ID NO: 911781 - RNA, 19 nt, Homo sapiens
caucaaaguuucggauauc

SEQ ID NO: 911782 - RNA, 19 nt, Homo sapiens
gaguugggaccucgcuuua

SEQ ID NO: 911783 - RNA, 19 nt, Homo sapiens
ucccugagcuccuuagaau

SEQ ID NO: 911784 - RNA, 19 nt, Homo sapiens
gauaacacagcugucauuu

SEQ ID NO: 911785 - RNA, 19 nt, Homo sapiens
gguggaagauguugaugag

SEQ ID NO: 911786 - RNA, 19 nt, Homo sapiens
acagaggccuuugauauag

SEQ ID NO: 911787 - RNA, 19 nt, Homo sapiens
ucauugcuauucucauuug

SEQ ID NO: 911788 - RNA, 19 nt, Homo sapiens
cuguaaagcuugaguauuu

SEQ ID NO: 911789 - RNA, 19 nt, Homo sapiens
gcacggaccucaaguacuc

SEQ ID NO: 911790 - RNA, 19 nt, Homo sapiens
gaagugagauggcaagacu

SEQ ID NO: 911791 - RNA, 19 nt, Homo sapiens
gagaccggcuuuaaagaaa

SEQ ID NO: 911792 - RNA, 19 nt, Homo sapiens
caugauaucuguaaagcuu

SEQ ID NO: 911793 - RNA, 19 nt, Homo sapiens
gcacggaucucgagaacag

SEQ ID NO: 911794 - RNA, 19 nt, Homo sapiens
ggagaagcaucugaaagaa

SEQ ID NO: 911795 - RNA, 19 nt, Homo sapiens
cacaaacacugccuuuauu

SEQ ID NO: 911796 - RNA, 19 nt, Homo sapiens
cauaagcccugcaagaaug

SEQ ID NO: 911797 - RNA, 19 nt, Homo sapiens
uuaaaugggugaacugaau

SEQ ID NO: 911798 - RNA, 19 nt, Homo sapiens
cauagcaacugagguguaa

SEQ ID NO: 911799 - RNA, 19 nt, Homo sapiens
gcacuucgggucuauguga

SEQ ID NO: 911800 - RNA, 19 nt, Homo sapiens
ggacggcccuugcuuuaac

SEQ ID NO: 911801 - RNA, 19 nt, Homo sapiens
ggagaccggcuuuaaagaa

SEQ ID NO: 911802 - RNA, 19 nt, Homo sapiens
gaauuacgccuaagaagca

SEQ ID NO: 911803 - RNA, 19 nt, Homo sapiens
caacgaaugcugcugaaga

SEQ ID NO: 911804 - RNA, 19 nt, Homo sapiens
gugcaacccuggcuggaaa

SEQ ID NO: 911805 - RNA, 19 nt, Homo sapiens
ccacacagauucuccugau

SEQ ID NO: 911806 - RNA, 19 nt, Homo sapiens
caaaggcacuucgggucua

SEQ ID NO: 911807 - RNA, 19 nt, Homo sapiens
ccacagcgccgacaagaau

SEQ ID NO: 911808 - RNA, 19 nt, Homo sapiens
gagaagcaucugaaagaaa

SEQ ID NO: 911809 - RNA, 19 nt, Homo sapiens
cgacaagaauggcuucaag

SEQ ID NO: 911810 - RNA, 19 nt, Homo sapiens
ugaacugaauuacgccuaa

SEQ ID NO: 911811 - RNA, 19 nt, Homo sapiens
caacugagguguaaaaugg

SEQ ID NO: 911812 - RNA, 19 nt, Homo sapiens
ucaagaacaccaacaagaa

SEQ ID NO: 911813 - RNA, 19 nt, Homo sapiens
gcggacggcccuugcuuua

SEQ ID NO: 911814 - RNA, 19 nt, Homo sapiens
ggacuucgcagggcggaua

SEQ ID NO: 911815 - RNA, 19 nt, Homo sapiens
gcagggcggauauaaagaa

SEQ ID NO: 911816 - RNA, 19 nt, Homo sapiens
acacaaacacugccuuuau

SEQ ID NO: 911817 - RNA, 19 nt, Homo sapiens
ccaaguaccagucggugua

SEQ ID NO: 911818 - RNA, 19 nt, Homo sapiens
ugaacaaccuggccaacug

SEQ ID NO: 911819 - RNA, 19 nt, Homo sapiens
gcacgcacccugccacaau

SEQ ID NO: 911820 - RNA, 19 nt, Homo sapiens
acccagcgguggacuauaa

SEQ ID NO: 911821 - RNA, 19 nt, Homo sapiens
ggucauccuuguccucaug

SEQ ID NO: 911822 - RNA, 19 nt, Homo sapiens
gaagcucuccacacagauu

SEQ ID NO: 911823 - RNA, 19 nt, Homo sapiens
ugacgucgccguugcacua

SEQ ID NO: 911824 - RNA, 19 nt, Homo sapiens
gcaagacucccguuucucu

SEQ ID NO: 911825 - RNA, 19 nt, Homo sapiens
ggagccaccugcaccaaca

SEQ ID NO: 911826 - RNA, 19 nt, Homo sapiens
gggucuaugugacuauauu

SEQ ID NO: 911827 - RNA, 19 nt, Homo sapiens
cugaugaccucgcaacaga

SEQ ID NO: 911828 - RNA, 19 nt, Homo sapiens
uauugaagcucuccacaca

SEQ ID NO: 911829 - RNA, 19 nt, Homo sapiens
ggcaccuucucucugauua

SEQ ID NO: 911830 - RNA, 19 nt, Homo sapiens
gcucuucacccuguucuaa

SEQ ID NO: 911831 - RNA, 19 nt, Homo sapiens
uauggacaguugcucuuaa

SEQ ID NO: 911832 - RNA, 19 nt, Homo sapiens
guggacugcugcugagaaa

SEQ ID NO: 911833 - RNA, 19 nt, Homo sapiens
gugaugagcagcauggauu

SEQ ID NO: 911834 - RNA, 19 nt, Homo sapiens
acacagauucuccugauga

SEQ ID NO: 911835 - RNA, 19 nt, Homo sapiens
caccuucucucugauuauu

SEQ ID NO: 911836 - RNA, 19 nt, Homo sapiens
aaacacaaacacugccuuu

SEQ ID NO: 911837 - RNA, 19 nt, Homo sapiens
agacucccguuucucuuaa

SEQ ID NO: 911838 - RNA, 19 nt, Homo sapiens
uggagaagcaucugaaaga

SEQ ID NO: 911839 - RNA, 19 nt, Homo sapiens
agacggagaccaugaacaa

SEQ ID NO: 911840 - RNA, 19 nt, Homo sapiens
gaacugaauuacgccuaag

SEQ ID NO: 911841 - RNA, 19 nt, Homo sapiens
gaugaccucgcaacagaaa

SEQ ID NO: 911842 - RNA, 19 nt, Homo sapiens
caaaaucugugaauugagu

SEQ ID NO: 911843 - RNA, 19 nt, Homo sapiens
ggcaaaaucugugaauuga

SEQ ID NO: 911844 - RNA, 19 nt, Homo sapiens
agaagcaucugaaagaaaa

SEQ ID NO: 911845 - RNA, 19 nt, Homo sapiens
gggauggcgugaacgacuu

SEQ ID NO: 911846 - RNA, 19 nt, Homo sapiens
uugaagcucuccacacaga

SEQ ID NO: 911847 - RNA, 19 nt, Homo sapiens
ccgggcaccuucucucuga

SEQ ID NO: 911848 - RNA, 19 nt, Homo sapiens
ugauaucuguaaagcuuga

SEQ ID NO: 911849 - RNA, 19 nt, Homo sapiens
ccucgggcauccuugguuu

SEQ ID NO: 911850 - RNA, 19 nt, Homo sapiens
gacucgggcuguucaacuu

SEQ ID NO: 911851 - RNA, 19 nt, Homo sapiens
caagaacaccaacaagaag

SEQ ID NO: 911852 - RNA, 19 nt, Homo sapiens
gugccaauguuauuugagu

SEQ ID NO: 911853 - RNA, 19 nt, Homo sapiens
ccacgcagaucaagaacac

SEQ ID NO: 911854 - RNA, 19 nt, Homo sapiens
caaacacugccuuuauugu

SEQ ID NO: 911855 - RNA, 19 nt, Homo sapiens
gcggagaccggcuuuaaag

SEQ ID NO: 911856 - RNA, 19 nt, Homo sapiens
gccaauguuauuugaguuu

SEQ ID NO: 911857 - RNA, 19 nt, Homo sapiens
gggccacgcagaucaagaa

SEQ ID NO: 911858 - RNA, 19 nt, Homo sapiens
ugacgaguguauccgcuau

SEQ ID NO: 911859 - RNA, 19 nt, Homo sapiens
gagccagucuuuucuugaa

SEQ ID NO: 911860 - RNA, 19 nt, Homo sapiens
uaaaugggugaacugaauu

SEQ ID NO: 911861 - RNA, 19 nt, Homo sapiens
acaaacacugccuuuauug

SEQ ID NO: 911862 - RNA, 19 nt, Homo sapiens
aaaugggugaacugaauua

SEQ ID NO: 911863 - RNA, 19 nt, Homo sapiens
uggcaagacucccguuucu

SEQ ID NO: 911864 - RNA, 19 nt, Homo sapiens
ccauaagcccugcaagaau

SEQ ID NO: 911865 - RNA, 19 nt, Homo sapiens
ccuucucucugauuauuga

SEQ ID NO: 911866 - RNA, 19 nt, Homo sapiens
gaucaagaacaccaacaag

SEQ ID NO: 911867 - RNA, 19 nt, Homo sapiens
caccauaagcccugcaaga

SEQ ID NO: 911868 - RNA, 19 nt, Homo sapiens
gaacuacugcacacaccau

SEQ ID NO: 911869 - RNA, 19 nt, Homo sapiens
ggucuaugugacuauauuu

SEQ ID NO: 911870 - RNA, 19 nt, Homo sapiens
gaguguauauuuuggauuc

SEQ ID NO: 911871 - RNA, 19 nt, Homo sapiens
ggagaagggaaacgaaguc

SEQ ID NO: 911872 - RNA, 19 nt, Homo sapiens
guugcacuauggacaguug

SEQ ID NO: 911873 - RNA, 19 nt, Homo sapiens
ugcaggaguucgucaacaa

SEQ ID NO: 911874 - RNA, 19 nt, Homo sapiens
ugguaaauauguacaaagg

SEQ ID NO: 911875 - RNA, 19 nt, Homo sapiens
aaacacugccuuuauuguc

SEQ ID NO: 911876 - RNA, 19 nt, Homo sapiens
gaccacagcgccgacaaga

SEQ ID NO: 911877 - RNA, 19 nt, Homo sapiens
gauggcaagacucccguuu

SEQ ID NO: 911878 - RNA, 19 nt, Homo sapiens
gggagacggagaccaugaa

SEQ ID NO: 911879 - RNA, 19 nt, Homo sapiens
ggcugaggcugcagaagca

SEQ ID NO: 911880 - RNA, 19 nt, Homo sapiens
cagcauggauuuugugaca

SEQ ID NO: 911881 - RNA, 19 nt, Homo sapiens
ggaaaagauguguguuauu

SEQ ID NO: 911882 - RNA, 19 nt, Homo sapiens
ucauagcaacugaggugua

SEQ ID NO: 911883 - RNA, 19 nt, Homo sapiens
gcaagcgugacaccaagug

SEQ ID NO: 911884 - RNA, 19 nt, Homo sapiens
ccaacaagaaggcggacuu

SEQ ID NO: 911885 - RNA, 19 nt, Homo sapiens
ggcggagaccggcuuuaaa

SEQ ID NO: 911886 - RNA, 19 nt, Homo sapiens
ccagucuuuucuugaauua

SEQ ID NO: 911887 - RNA, 19 nt, Homo sapiens
gggcaccuucucucugauu

SEQ ID NO: 911888 - RNA, 19 nt, Homo sapiens
gaagaguugucgucuauaa

SEQ ID NO: 911889 - RNA, 19 nt, Homo sapiens
ccaccuagcugguaauuaa

SEQ ID NO: 911890 - RNA, 19 nt, Homo sapiens
gcugaaagcuaugaugaua

SEQ ID NO: 911891 - RNA, 19 nt, Homo sapiens
gcacaucgccgacugcuuu

SEQ ID NO: 911892 - RNA, 19 nt, Homo sapiens
gagaggagcuggugugcaa

SEQ ID NO: 911893 - RNA, 19 nt, Homo sapiens
gacuugggaugacauauua

SEQ ID NO: 911894 - RNA, 19 nt, Homo sapiens
ggauuugacugccuguaua

SEQ ID NO: 911895 - RNA, 19 nt, Homo sapiens
ggaaauucaucuuuaagga

SEQ ID NO: 911896 - RNA, 19 nt, Homo sapiens
ccaaaucacugaaauuauc

SEQ ID NO: 911897 - RNA, 19 nt, Homo sapiens
cgaauugccuggcugagua

SEQ ID NO: 911898 - RNA, 19 nt, Homo sapiens
gaacccagcucccucuuca

SEQ ID NO: 911899 - RNA, 19 nt, Homo sapiens
gaucgcaacuaaacauuug

SEQ ID NO: 911900 - RNA, 19 nt, Homo sapiens
gaaaugacauguuaaugcu

SEQ ID NO: 911901 - RNA, 19 nt, Homo sapiens
gaaauuauccugggugaga

SEQ ID NO: 911902 - RNA, 19 nt, Homo sapiens
ggagacaagccgucaauuu

SEQ ID NO: 911903 - RNA, 19 nt, Homo sapiens
gagcuugucuucccuaaca

SEQ ID NO: 911904 - RNA, 19 nt, Homo sapiens
gaccaaagccuauguguuc

SEQ ID NO: 911905 - RNA, 19 nt, Homo sapiens
gcacacagacugacaugaa

SEQ ID NO: 911906 - RNA, 19 nt, Homo sapiens
ggagcugacugaccacgua

SEQ ID NO: 911907 - RNA, 19 nt, Homo sapiens
gcaaggaagcuauuaggaa

SEQ ID NO: 911908 - RNA, 19 nt, Homo sapiens
guccuaaucucuucaauca

SEQ ID NO: 911909 - RNA, 19 nt, Homo sapiens
gaaucugugcuucauaaua

SEQ ID NO: 911910 - RNA, 19 nt, Homo sapiens
cagggcagcuauuuaguuu

SEQ ID NO: 911911 - RNA, 19 nt, Homo sapiens
guacucugaucgcaacuaa

SEQ ID NO: 911912 - RNA, 19 nt, Homo sapiens
gcaauggccugagauuuua

SEQ ID NO: 911913 - RNA, 19 nt, Homo sapiens
ggacacacacacagaguaa

SEQ ID NO: 911914 - RNA, 19 nt, Homo sapiens
gauuugcccuugauucuau

SEQ ID NO: 911915 - RNA, 19 nt, Homo sapiens
ccuaaucucuucaaucaau

SEQ ID NO: 911916 - RNA, 19 nt, Homo sapiens
gagacaagcgggaaggaua

SEQ ID NO: 911917 - RNA, 19 nt, Homo sapiens
gaaggauaauuagcugaaa

SEQ ID NO: 911918 - RNA, 19 nt, Homo sapiens
aaaccugggugcuacagua

SEQ ID NO: 911919 - RNA, 19 nt, Homo sapiens
uaaaugcucccuugcaauu

SEQ ID NO: 911920 - RNA, 19 nt, Homo sapiens
caagcgggaaggauaauua

SEQ ID NO: 911921 - RNA, 19 nt, Homo sapiens
cugcggaaauucaucuuua

SEQ ID NO: 911922 - RNA, 19 nt, Homo sapiens
cagacgccaucuacaguua

SEQ ID NO: 911923 - RNA, 19 nt, Homo sapiens
ggaaaugacauguuaaugc

SEQ ID NO: 911924 - RNA, 19 nt, Homo sapiens
ugacaggcauuccucuuug

SEQ ID NO: 911925 - RNA, 19 nt, Homo sapiens
gaacaguuggccaagaauu

SEQ ID NO: 911926 - RNA, 19 nt, Homo sapiens
uaaacaagccaaccaccua

SEQ ID NO: 911927 - RNA, 19 nt, Homo sapiens
ggaagacgccuacauucug

SEQ ID NO: 911928 - RNA, 19 nt, Homo sapiens
ucgaagaguugucgucuau

SEQ ID NO: 911929 - RNA, 19 nt, Homo sapiens
guuaaaugcucccuugcaa

SEQ ID NO: 911930 - RNA, 19 nt, Homo sapiens
gcaucgcacuguuagcauu

SEQ ID NO: 911931 - RNA, 19 nt, Homo sapiens
gaagauagaaaggagagaa

SEQ ID NO: 911932 - RNA, 19 nt, Homo sapiens
aaucugugcuucauaauag

SEQ ID NO: 911933 - RNA, 19 nt, Homo sapiens
ggaaggauaauuagcugaa

SEQ ID NO: 911934 - RNA, 19 nt, Homo sapiens
uuacagagaaugauccuuu

SEQ ID NO: 911935 - RNA, 19 nt, Homo sapiens
ccucuuugcugagaugaua

SEQ ID NO: 911936 - RNA, 19 nt, Homo sapiens
gcauguaugugcagacucu

SEQ ID NO: 911937 - RNA, 19 nt, Homo sapiens
cggcugaccucgcaggaaa

SEQ ID NO: 911938 - RNA, 19 nt, Homo sapiens
gaguauuucugucucugaa

SEQ ID NO: 911939 - RNA, 19 nt, Homo sapiens
uaagccaguacuucaauua

SEQ ID NO: 911940 - RNA, 19 nt, Homo sapiens
gcaagaaaucaaagaagga

SEQ ID NO: 911941 - RNA, 19 nt, Homo sapiens
caacauggaagagaacuug

SEQ ID NO: 911942 - RNA, 19 nt, Homo sapiens
cauaguaacaucaaccaaa

SEQ ID NO: 911943 - RNA, 19 nt, Homo sapiens
cguggacucuaguauguaa

SEQ ID NO: 911944 - RNA, 19 nt, Homo sapiens
agagaaauccaacuccuuu

SEQ ID NO: 911945 - RNA, 19 nt, Homo sapiens
gcaacucugugcccagcuu

SEQ ID NO: 911946 - RNA, 19 nt, Homo sapiens
gcagacucuuggaugcuuu

SEQ ID NO: 911947 - RNA, 19 nt, Homo sapiens
gagacaagccgucaauuuu

SEQ ID NO: 911948 - RNA, 19 nt, Homo sapiens
cacacagacugacaugaaa

SEQ ID NO: 911949 - RNA, 19 nt, Homo sapiens
caaccaaaucacugaaauu

SEQ ID NO: 911950 - RNA, 19 nt, Homo sapiens
gaacaaaacccaggauuuc

SEQ ID NO: 911951 - RNA, 19 nt, Homo sapiens
gguagacccgugcuuguuu

SEQ ID NO: 911952 - RNA, 19 nt, Homo sapiens
gaggagagguuggugacau

SEQ ID NO: 911953 - RNA, 19 nt, Homo sapiens
cccaguaccucacuuguuc

SEQ ID NO: 911954 - RNA, 19 nt, Homo sapiens
acagcucucuaucccaaua

SEQ ID NO: 911955 - RNA, 19 nt, Homo sapiens
gaagaaaggaaaagagaaa

SEQ ID NO: 911956 - RNA, 19 nt, Homo sapiens
gcaagcaagaaaucaaaga

SEQ ID NO: 911957 - RNA, 19 nt, Homo sapiens
aagccuauguguucuuuga

SEQ ID NO: 911958 - RNA, 19 nt, Homo sapiens
ggugcuuuguccuguauuu

SEQ ID NO: 911959 - RNA, 19 nt, Homo sapiens
ugaagauggugcuguguca

SEQ ID NO: 911960 - RNA, 19 nt, Homo sapiens
caaagaaggaggagacaag

SEQ ID NO: 911961 - RNA, 19 nt, Homo sapiens
gacacacucuuaaguuucu

SEQ ID NO: 911962 - RNA, 19 nt, Homo sapiens
ggaggcagccagacuguuc

SEQ ID NO: 911963 - RNA, 19 nt, Homo sapiens
ggugacacguggacucuag

SEQ ID NO: 911964 - RNA, 19 nt, Homo sapiens
acucuuaaguuucuugguu

SEQ ID NO: 911965 - RNA, 19 nt, Homo sapiens
ucaaccaaaucacugaaau

SEQ ID NO: 911966 - RNA, 19 nt, Homo sapiens
gcgcugaccgcaccaaguu

SEQ ID NO: 911967 - RNA, 19 nt, Homo sapiens
gggcaagcaagaaaucaaa

SEQ ID NO: 911968 - RNA, 19 nt, Homo sapiens
gcccagagaucuugaacac

SEQ ID NO: 911969 - RNA, 19 nt, Homo sapiens
caagcaagaaaucaaagaa

SEQ ID NO: 911970 - RNA, 19 nt, Homo sapiens
gacgccaucuacaguuaaa

SEQ ID NO: 911971 - RNA, 19 nt, Homo sapiens
aauaguguguggcauguau

SEQ ID NO: 911972 - RNA, 19 nt, Homo sapiens
cacguggacucuaguaugu

SEQ ID NO: 911973 - RNA, 19 nt, Homo sapiens
gcugguaauuaaugagguu

SEQ ID NO: 911974 - RNA, 19 nt, Homo sapiens
agacuguucuaccagauug

SEQ ID NO: 911975 - RNA, 19 nt, Homo sapiens
gcauugcguuucuuguauc

SEQ ID NO: 911976 - RNA, 19 nt, Homo sapiens
acagaacucuuuuggcaua

SEQ ID NO: 911977 - RNA, 19 nt, Homo sapiens
ugacuugggaugacauauu

SEQ ID NO: 911978 - RNA, 19 nt, Homo sapiens
guauuaagccaguacuuca

SEQ ID NO: 911979 - RNA, 19 nt, Homo sapiens
guaaggcccucugguuugg

SEQ ID NO: 911980 - RNA, 19 nt, Homo sapiens
gguugucccacauguauaa

SEQ ID NO: 911981 - RNA, 19 nt, Homo sapiens
gcauuccucuuugcugaga

SEQ ID NO: 911982 - RNA, 19 nt, Homo sapiens
cuuaaucgcucacuucaac

SEQ ID NO: 911983 - RNA, 19 nt, Homo sapiens
ugugcaagguguuugauau

SEQ ID NO: 911984 - RNA, 19 nt, Homo sapiens
ugauagcaauggccugaga

SEQ ID NO: 911985 - RNA, 19 nt, Homo sapiens
aggaacaguuggccaagaa

SEQ ID NO: 911986 - RNA, 19 nt, Homo sapiens
ccgccgaucuguccucguu

SEQ ID NO: 911987 - RNA, 19 nt, Homo sapiens
guagacccgugcuuguuuc

SEQ ID NO: 911988 - RNA, 19 nt, Homo sapiens
gcagagagcuggaaucuuc

SEQ ID NO: 911989 - RNA, 19 nt, Homo sapiens
ggaaggaggaggucuauaa

SEQ ID NO: 911990 - RNA, 19 nt, Homo sapiens
gaaaucaacucccuaucug

SEQ ID NO: 911991 - RNA, 19 nt, Homo sapiens
ccacugagcugguuguaga

SEQ ID NO: 911992 - RNA, 19 nt, Homo sapiens
agacagagcugggcaagaa

SEQ ID NO: 911993 - RNA, 19 nt, Homo sapiens
gagcucggcugcaguuuau

SEQ ID NO: 911994 - RNA, 19 nt, Homo sapiens
ccaaauaaaugaguaguuc

SEQ ID NO: 911995 - RNA, 19 nt, Homo sapiens
ggagugaaccgcagcauug

SEQ ID NO: 911996 - RNA, 19 nt, Homo sapiens
gcaggugacucagcuauuc

SEQ ID NO: 911997 - RNA, 19 nt, Homo sapiens
ccacugaccgcaacccuua

SEQ ID NO: 911998 - RNA, 19 nt, Homo sapiens
gcaagaagacccucagcaa

SEQ ID NO: 911999 - RNA, 19 nt, Homo sapiens
gaucccaaauaaaugagua

SEQ ID NO: 912000 - RNA, 19 nt, Homo sapiens
ccacucaggugucagaugu

SEQ ID NO: 912001 - RNA, 19 nt, Homo sapiens
ggaaaucaacucccuaucu

SEQ ID NO: 912002 - RNA, 19 nt, Homo sapiens
gcacggagcaggguuucua

SEQ ID NO: 912003 - RNA, 19 nt, Homo sapiens
uccgaaagcugcaggauug

SEQ ID NO: 912004 - RNA, 19 nt, Homo sapiens
ggagcucggcugcaguuua

SEQ ID NO: 912005 - RNA, 19 nt, Homo sapiens
gcacaugcccuagcuacuu

SEQ ID NO: 912006 - RNA, 19 nt, Homo sapiens
ggacacaggcaccaucaug

SEQ ID NO: 912007 - RNA, 19 nt, Homo sapiens
cugaugagcuuguguucaa

SEQ ID NO: 912008 - RNA, 19 nt, Homo sapiens
gaccgaauccucauccauu

SEQ ID NO: 912009 - RNA, 19 nt, Homo sapiens
gagcuuggcuaucagaacu

SEQ ID NO: 912010 - RNA, 19 nt, Homo sapiens
aggaagagaucaccaagau

SEQ ID NO: 912011 - RNA, 19 nt, Homo sapiens
guucaaggaugccaagaag

SEQ ID NO: 912012 - RNA, 19 nt, Homo sapiens
ccuaagggcucccgcuuca

SEQ ID NO: 912013 - RNA, 19 nt, Homo sapiens
ucagcaaccuggagaagau

SEQ ID NO: 912014 - RNA, 19 nt, Homo sapiens
uagcugcucugcacgagaa

SEQ ID NO: 912015 - RNA, 19 nt, Homo sapiens
caagaaggacgaugcuguu

SEQ ID NO: 912016 - RNA, 19 nt, Homo sapiens
gaaggccuauaaguaucua

SEQ ID NO: 912017 - RNA, 19 nt, Homo sapiens
gcaggaaggaggaggucua

SEQ ID NO: 912018 - RNA, 19 nt, Homo sapiens
ggacguuugcggugacuga

SEQ ID NO: 912019 - RNA, 19 nt, Homo sapiens
ggaagcagaaggaagagau

SEQ ID NO: 912020 - RNA, 19 nt, Homo sapiens
gaaggaggaggucuauaag

SEQ ID NO: 912021 - RNA, 19 nt, Homo sapiens
ucaaggaugccaagaagga

SEQ ID NO: 912022 - RNA, 19 nt, Homo sapiens
gcaacugacugagcaucug

SEQ ID NO: 912023 - RNA, 19 nt, Homo sapiens
uggcagagauccaagaacu

SEQ ID NO: 912024 - RNA, 19 nt, Homo sapiens
ucggaaggccuauaaguau

SEQ ID NO: 912025 - RNA, 19 nt, Homo sapiens
gaagcuggaccggacguuu

SEQ ID NO: 912026 - RNA, 19 nt, Homo sapiens
ccuuggagcuuggcuauca

SEQ ID NO: 912027 - RNA, 19 nt, Homo sapiens
gaccgcaacccuuauaugg

SEQ ID NO: 912028 - RNA, 19 nt, Homo sapiens
aggaggaggucuauaagca

SEQ ID NO: 912029 - RNA, 19 nt, Homo sapiens
cgaugggacugccaaccuu

SEQ ID NO: 912030 - RNA, 19 nt, Homo sapiens
gcucggcugcaguuuauug

SEQ ID NO: 912031 - RNA, 19 nt, Homo sapiens
cacaugcccuagcuacuuc

SEQ ID NO: 912032 - RNA, 19 nt, Homo sapiens
cguuugcggugacugauga

SEQ ID NO: 912033 - RNA, 19 nt, Homo sapiens
gcacagcaagcucaguaca

SEQ ID NO: 912034 - RNA, 19 nt, Homo sapiens
ccaagacuggugcuccuaa

SEQ ID NO: 912035 - RNA, 19 nt, Homo sapiens
gcuaucagaacuuccucua

SEQ ID NO: 912036 - RNA, 19 nt, Homo sapiens
gaacugcagccagcucauc

SEQ ID NO: 912037 - RNA, 19 nt, Homo sapiens
cggaaggccuauaaguauc

SEQ ID NO: 912038 - RNA, 19 nt, Homo sapiens
cggcacagcaagcucagua

SEQ ID NO: 912039 - RNA, 19 nt, Homo sapiens
aggagcagaucgagacaga

SEQ ID NO: 912040 - RNA, 19 nt, Homo sapiens
gcauggaccugggcuaucc

SEQ ID NO: 912041 - RNA, 19 nt, Homo sapiens
ccaagcacaugcccuagcu

SEQ ID NO: 912042 - RNA, 19 nt, Homo sapiens
agaccugcuucucuucuug

SEQ ID NO: 912043 - RNA, 19 nt, Homo sapiens
ggaaggccuauaaguaucu

SEQ ID NO: 912044 - RNA, 19 nt, Homo sapiens
gcaacauccggaagcagaa

SEQ ID NO: 912045 - RNA, 19 nt, Homo sapiens
ggagaucgugggcaacauc

SEQ ID NO: 912046 - RNA, 19 nt, Homo sapiens
caagacuggugcuccuaag

SEQ ID NO: 912047 - RNA, 19 nt, Homo sapiens
gaggugagccacgggaguu

SEQ ID NO: 912048 - RNA, 19 nt, Homo sapiens
ggcaguuccuccagaugug

SEQ ID NO: 912049 - RNA, 19 nt, Homo sapiens
gacccugggcgucagcuuu

SEQ ID NO: 912050 - RNA, 19 nt, Homo sapiens
gaggacacaggcaccauca

SEQ ID NO: 912051 - RNA, 19 nt, Homo sapiens
ugacugaugagcuuguguu

SEQ ID NO: 912052 - RNA, 19 nt, Homo sapiens
gaagcagaaggaagagauc

SEQ ID NO: 912053 - RNA, 19 nt, Homo sapiens
gagugaaccgcagcauuga

SEQ ID NO: 912054 - RNA, 19 nt, Homo sapiens
cuccagaugugcagaccuu

SEQ ID NO: 912055 - RNA, 19 nt, Homo sapiens
ccaggccacucagguguca

SEQ ID NO: 912056 - RNA, 19 nt, Homo sapiens
gagcaucugcgccaaagcu

SEQ ID NO: 912057 - RNA, 19 nt, Homo sapiens
ggagguugaggccgacaug

SEQ ID NO: 912058 - RNA, 19 nt, Homo sapiens
uggccucgcuccucgaaca

SEQ ID NO: 912059 - RNA, 19 nt, Homo sapiens
ggaccgaauccucauccau

SEQ ID NO: 912060 - RNA, 19 nt, Homo sapiens
ggucgugccagaauugagu

SEQ ID NO: 912061 - RNA, 19 nt, Homo sapiens
gaagauccgggaggacuac

SEQ ID NO: 912062 - RNA, 19 nt, Homo sapiens
uucggaaggccuauaagua

SEQ ID NO: 912063 - RNA, 19 nt, Homo sapiens
agaaggaagagaucaccaa

SEQ ID NO: 912064 - RNA, 19 nt, Homo sapiens
ucuauaagcagcugauguc

SEQ ID NO: 912065 - RNA, 19 nt, Homo sapiens
cagcuugugguggagaaua

SEQ ID NO: 912066 - RNA, 19 nt, Homo sapiens
guucggaaggccuauaagu

SEQ ID NO: 912067 - RNA, 19 nt, Homo sapiens
gcuggcagagauccaagaa

SEQ ID NO: 912068 - RNA, 19 nt, Homo sapiens
gcuuggcuaucagaacuuc

SEQ ID NO: 912069 - RNA, 19 nt, Homo sapiens
ggugauaguccagcaugug

SEQ ID NO: 912070 - RNA, 19 nt, Homo sapiens
gguugaggccgacaugaag

SEQ ID NO: 912071 - RNA, 19 nt, Homo sapiens
gagcagcuggaaggaguga

SEQ ID NO: 912072 - RNA, 19 nt, Homo sapiens
acucagagaaguucaccuu

SEQ ID NO: 912073 - RNA, 19 nt, Homo sapiens
cagaaacccucacaauaaa

SEQ ID NO: 912074 - RNA, 19 nt, Homo sapiens
ucagaaacccucacaauaa

SEQ ID NO: 912075 - RNA, 19 nt, Homo sapiens
ggaaagcgauggacagaca

SEQ ID NO: 912076 - RNA, 19 nt, Homo sapiens
gaaagaaggaagaagcaaa

SEQ ID NO: 912077 - RNA, 19 nt, Homo sapiens
gaaagaagcagcucaaagc

SEQ ID NO: 912078 - RNA, 19 nt, Homo sapiens
gaugauuggucuucugaau

SEQ ID NO: 912079 - RNA, 19 nt, Homo sapiens
gggagaagauguauaugag

SEQ ID NO: 912080 - RNA, 19 nt, Homo sapiens
gcgcaucaauaaaguacuu

SEQ ID NO: 912081 - RNA, 19 nt, Homo sapiens
cgucagggcgcaucaauaa

SEQ ID NO: 912082 - RNA, 19 nt, Homo sapiens
agaagcagcucaaagcaau

SEQ ID NO: 912083 - RNA, 19 nt, Homo sapiens
guaaauucaucgagacauc

SEQ ID NO: 912084 - RNA, 19 nt, Homo sapiens
gugccuaugucaucguaua

SEQ ID NO: 912085 - RNA, 19 nt, Homo sapiens
ucaggacacuauagaaaga

SEQ ID NO: 912086 - RNA, 19 nt, Homo sapiens
ggacagugcggccaaggaa

SEQ ID NO: 912087 - RNA, 19 nt, Homo sapiens
caucaggacacuauagaaa

SEQ ID NO: 912088 - RNA, 19 nt, Homo sapiens
uaccaaagaugacacucaa

SEQ ID NO: 912089 - RNA, 19 nt, Homo sapiens
gcugggagaagauguauau

SEQ ID NO: 912090 - RNA, 19 nt, Homo sapiens
gguguucgacuguaaauuc

SEQ ID NO: 912091 - RNA, 19 nt, Homo sapiens
cagcuuggccagccucuuu

SEQ ID NO: 912092 - RNA, 19 nt, Homo sapiens
gaacagcugggagaagaug

SEQ ID NO: 912093 - RNA, 19 nt, Homo sapiens
gcccagaccucuccaucuc

SEQ ID NO: 912094 - RNA, 19 nt, Homo sapiens
acaauaaaccagaccagaa

SEQ ID NO: 912095 - RNA, 19 nt, Homo sapiens
ggagaagauguauaugaga

SEQ ID NO: 912096 - RNA, 19 nt, Homo sapiens
ccaaagaugacacucaaca

SEQ ID NO: 912097 - RNA, 19 nt, Homo sapiens
cuacugcccucccaucuac

SEQ ID NO: 912098 - RNA, 19 nt, Homo sapiens
caauaaaccagaccagaag

SEQ ID NO: 912099 - RNA, 19 nt, Homo sapiens
cucagaaacccucacaaua

SEQ ID NO: 912100 - RNA, 19 nt, Homo sapiens
gaccgaggcagcuuugaga

SEQ ID NO: 912101 - RNA, 19 nt, Homo sapiens
ucaaagcaauuggcugaca

SEQ ID NO: 912102 - RNA, 19 nt, Homo sapiens
cagaaaaccuagggacuuu

SEQ ID NO: 912103 - RNA, 19 nt, Homo sapiens
ggaucuggaagaagccaua

SEQ ID NO: 912104 - RNA, 19 nt, Homo sapiens
ggaaagaaggaagaagcaa

SEQ ID NO: 912105 - RNA, 19 nt, Homo sapiens
gcccucccaucuacacuug

SEQ ID NO: 912106 - RNA, 19 nt, Homo sapiens
gcagaccgaggcagcuuug

SEQ ID NO: 912107 - RNA, 19 nt, Homo sapiens
ccaaucagccucccucaac

SEQ ID NO: 912108 - RNA, 19 nt, Homo sapiens
ccucagaaacccucacaau

SEQ ID NO: 912109 - RNA, 19 nt, Homo sapiens
ugggagaagauguauauga

SEQ ID NO: 912110 - RNA, 19 nt, Homo sapiens
acaccgagcaggaagcaaa

SEQ ID NO: 912111 - RNA, 19 nt, Homo sapiens
gcugugguguucgacugua

SEQ ID NO: 912112 - RNA, 19 nt, Homo sapiens
cagcucaucaggacacuau

SEQ ID NO: 912113 - RNA, 19 nt, Homo sapiens
gaagcagcucaaagcaauu

SEQ ID NO: 912114 - RNA, 19 nt, Homo sapiens
guucgacuguaaauucauc

SEQ ID NO: 912115 - RNA, 19 nt, Homo sapiens
ccaagcugggcacaaagua

SEQ ID NO: 912116 - RNA, 19 nt, Homo sapiens
agaguuggcgggucacuga

SEQ ID NO: 912117 - RNA, 19 nt, Homo sapiens
cagaaggaaagaaggaaga

SEQ ID NO: 912118 - RNA, 19 nt, Homo sapiens
ucagggcgcaucaauaaag

SEQ ID NO: 912119 - RNA, 19 nt, Homo sapiens
guguucgacuguaaauuca

SEQ ID NO: 912120 - RNA, 19 nt, Homo sapiens
cagugccuaugucaucgua

SEQ ID NO: 912121 - RNA, 19 nt, Homo sapiens
augaacagcugggagaaga

SEQ ID NO: 912122 - RNA, 19 nt, Homo sapiens
ccgagaaacuggauaaaag

SEQ ID NO: 912123 - RNA, 19 nt, Homo sapiens
caauguggccgagcucuuc

SEQ ID NO: 912124 - RNA, 19 nt, Homo sapiens
gcucaucaggacacuauag

SEQ ID NO: 912125 - RNA, 19 nt, Homo sapiens
gcgucagggcgcaucaaua

SEQ ID NO: 912126 - RNA, 19 nt, Homo sapiens
agaaagaagcagcucaaag

SEQ ID NO: 912127 - RNA, 19 nt, Homo sapiens
caaucuggccgugcucuga

SEQ ID NO: 912128 - RNA, 19 nt, Homo sapiens
cagggcgcaucaauaaagu

SEQ ID NO: 912129 - RNA, 19 nt, Homo sapiens
uuacguggugggugucuuu

SEQ ID NO: 912130 - RNA, 19 nt, Homo sapiens
ccacgcugcagcacaaugu

SEQ ID NO: 912131 - RNA, 19 nt, Homo sapiens
ccucugagcuccgcaucca

SEQ ID NO: 912132 - RNA, 19 nt, Homo sapiens
gaaggaaagaaggaagaag

SEQ ID NO: 912133 - RNA, 19 nt, Homo sapiens
aaccagaccagaaggaugu

SEQ ID NO: 912134 - RNA, 19 nt, Homo sapiens
aaagaaggaagaagcaaac

SEQ ID NO: 912135 - RNA, 19 nt, Homo sapiens
gaauccagcgacucugaag

SEQ ID NO: 912136 - RNA, 19 nt, Homo sapiens
caagcugggcacaaaguag

SEQ ID NO: 912137 - RNA, 19 nt, Homo sapiens
gaagagagauugggacuga

SEQ ID NO: 912138 - RNA, 19 nt, Homo sapiens
cagcugcgauggauguuua

SEQ ID NO: 912139 - RNA, 19 nt, Homo sapiens
uuaggaggcuuacuucuuu

SEQ ID NO: 912140 - RNA, 19 nt, Homo sapiens
gauucucgcuccuucauuu

SEQ ID NO: 912141 - RNA, 19 nt, Homo sapiens
ggccuuggcuucugauuau

SEQ ID NO: 912142 - RNA, 19 nt, Homo sapiens
ucaaugugcugauccugua

SEQ ID NO: 912143 - RNA, 19 nt, Homo sapiens
ugauaaaccugucuaagca

SEQ ID NO: 912144 - RNA, 19 nt, Homo sapiens
guacuacgccuuccucaug

SEQ ID NO: 912145 - RNA, 19 nt, Homo sapiens
gcuggugagugccacguua

SEQ ID NO: 912146 - RNA, 19 nt, Homo sapiens
ugaguguugugccuacuua

SEQ ID NO: 912147 - RNA, 19 nt, Homo sapiens
gcaauacuuaggaggcuua

SEQ ID NO: 912148 - RNA, 19 nt, Homo sapiens
gcccgaggcuggucuuaga

SEQ ID NO: 912149 - RNA, 19 nt, Homo sapiens
cagagagguuccuguuuga

SEQ ID NO: 912150 - RNA, 19 nt, Homo sapiens
gcuccuucauuucagguua

SEQ ID NO: 912151 - RNA, 19 nt, Homo sapiens
cgauggauguuuacaggaa

SEQ ID NO: 912152 - RNA, 19 nt, Homo sapiens
gagaggacacuucaaacug

SEQ ID NO: 912153 - RNA, 19 nt, Homo sapiens
caacgugggccucgucuuc

SEQ ID NO: 912154 - RNA, 19 nt, Homo sapiens
gaugugaguugagccuuca

SEQ ID NO: 912155 - RNA, 19 nt, Homo sapiens
ggagaggacacuucaaacu

SEQ ID NO: 912156 - RNA, 19 nt, Homo sapiens
gcuuacuucuuuggauuaa

SEQ ID NO: 912157 - RNA, 19 nt, Homo sapiens
gcaagaggcaucccaagac

SEQ ID NO: 912158 - RNA, 19 nt, Homo sapiens
gaacccagccagaguuugc

SEQ ID NO: 912159 - RNA, 19 nt, Homo sapiens
gggacugagugcugagguu

SEQ ID NO: 912160 - RNA, 19 nt, Homo sapiens
ggagaguggaagagagauu

SEQ ID NO: 912161 - RNA, 19 nt, Homo sapiens
gaggcuuacuucuuuggau

SEQ ID NO: 912162 - RNA, 19 nt, Homo sapiens
ucagguuacucguucuuca

SEQ ID NO: 912163 - RNA, 19 nt, Homo sapiens
gagaguggaagagagauug

SEQ ID NO: 912164 - RNA, 19 nt, Homo sapiens
acucggagcucgacgucuu

SEQ ID NO: 912165 - RNA, 19 nt, Homo sapiens
gauaaaccugucuaagcaa

SEQ ID NO: 912166 - RNA, 19 nt, Homo sapiens
aggcuuacuucuuuggauu

SEQ ID NO: 912167 - RNA, 19 nt, Homo sapiens
uaaaccugucuaagcaaua

SEQ ID NO: 912168 - RNA, 19 nt, Homo sapiens
gagcucgacgucuuugaug

SEQ ID NO: 912169 - RNA, 19 nt, Homo sapiens
guguugugccuacuuaauu

SEQ ID NO: 912170 - RNA, 19 nt, Homo sapiens
aaaccugucuaagcaauac

SEQ ID NO: 912171 - RNA, 19 nt, Homo sapiens
auaaaccugucuaagcaau

SEQ ID NO: 912172 - RNA, 19 nt, Homo sapiens
guuacucguucuucagcaa

SEQ ID NO: 912173 - RNA, 19 nt, Homo sapiens
ccagcuccguuugauguga

SEQ ID NO: 912174 - RNA, 19 nt, Homo sapiens
ucggagaggacacuucaaa

SEQ ID NO: 912175 - RNA, 19 nt, Homo sapiens
ggagcucgacgucuuugau

SEQ ID NO: 912176 - RNA, 19 nt, Homo sapiens
auacuuaggaggcuuacuu

SEQ ID NO: 912177 - RNA, 19 nt, Homo sapiens
uggaguacaucguccucaa

SEQ ID NO: 912178 - RNA, 19 nt, Homo sapiens
cgucuuugaugcguacuug

SEQ ID NO: 912179 - RNA, 19 nt, Homo sapiens
ggcuuacuucuuuggauua

SEQ ID NO: 912180 - RNA, 19 nt, Homo sapiens
uuagaugcagcgacuguuu

SEQ ID NO: 912181 - RNA, 19 nt, Homo sapiens
caggagaguggaagagaga

SEQ ID NO: 912182 - RNA, 19 nt, Homo sapiens
uguugugccuacuuaauuc

SEQ ID NO: 912183 - RNA, 19 nt, Homo sapiens
ucugaaaguaugaguguug

SEQ ID NO: 912184 - RNA, 19 nt, Homo sapiens
ggccuguucuucgucaaug

SEQ ID NO: 912185 - RNA, 19 nt, Homo sapiens
aaauguaugcaacuccaaa

SEQ ID NO: 912186 - RNA, 19 nt, Homo sapiens
gcgacucccagcuccguuu

SEQ ID NO: 912187 - RNA, 19 nt, Homo sapiens
uaggaggcuuacuucuuug

SEQ ID NO: 912188 - RNA, 19 nt, Homo sapiens
caggaacccagccagaguu

SEQ ID NO: 912189 - RNA, 19 nt, Homo sapiens
uggccuuggcuucugauua

SEQ ID NO: 912190 - RNA, 19 nt, Homo sapiens
ggcaccugcucccacagaa

SEQ ID NO: 912191 - RNA, 19 nt, Homo sapiens
cuuaggaggcuuacuucuu

SEQ ID NO: 912192 - RNA, 19 nt, Homo sapiens
acgccuuccucauggagua

SEQ ID NO: 912193 - RNA, 19 nt, Homo sapiens
aaagcuucgugccaacaga

SEQ ID NO: 912194 - RNA, 19 nt, Homo sapiens
gcugcugcccucuauguuc

SEQ ID NO: 912195 - RNA, 19 nt, Homo sapiens
gcagcugcgauggauguuu

SEQ ID NO: 912196 - RNA, 19 nt, Homo sapiens
cgcaagaggcaucccaaga

SEQ ID NO: 912197 - RNA, 19 nt, Homo sapiens
cuuggcuucugauuauuug

SEQ ID NO: 912198 - RNA, 19 nt, Homo sapiens
gaaccaagcguuuaaugaa

SEQ ID NO: 912199 - RNA, 19 nt, Homo sapiens
gcacccugcugcugaauaa

SEQ ID NO: 912200 - RNA, 19 nt, Homo sapiens
aaacucaacuccugcauga

SEQ ID NO: 912201 - RNA, 19 nt, Homo sapiens
ugaagacaaucucaaauuc

SEQ ID NO: 912202 - RNA, 19 nt, Homo sapiens
ggaaccaagcguuuaauga

SEQ ID NO: 912203 - RNA, 19 nt, Homo sapiens
gaagacaaucucaaauuca

SEQ ID NO: 912204 - RNA, 19 nt, Homo sapiens
ccaaguggcggcaucuuaa

SEQ ID NO: 912205 - RNA, 19 nt, Homo sapiens
gaucacugcuggccuacuc

SEQ ID NO: 912206 - RNA, 19 nt, Homo sapiens
ucaaauucauccucaugga

SEQ ID NO: 912207 - RNA, 19 nt, Homo sapiens
gaaccuucuuagacaaugg

SEQ ID NO: 912208 - RNA, 19 nt, Homo sapiens
ggcggugccuccuagaaga

SEQ ID NO: 912209 - RNA, 19 nt, Homo sapiens
ggaggaugggacuuuguuu

SEQ ID NO: 912210 - RNA, 19 nt, Homo sapiens
ccgcugccauagccaguaa

SEQ ID NO: 912211 - RNA, 19 nt, Homo sapiens
ucggagaucugggugcaaa

SEQ ID NO: 912212 - RNA, 19 nt, Homo sapiens
acucaacuccugcaugaaa

SEQ ID NO: 912213 - RNA, 19 nt, Homo sapiens
gaccgugggcuuuggaaug

SEQ ID NO: 912214 - RNA, 19 nt, Homo sapiens
caaggagaccgugggcuuu

SEQ ID NO: 912215 - RNA, 19 nt, Homo sapiens
gggaggaugggacuuuguu

SEQ ID NO: 912216 - RNA, 19 nt, Homo sapiens
cccaaguggcggcaucuua

SEQ ID NO: 912217 - RNA, 19 nt, Homo sapiens
accaagcguuuaaugaaga

SEQ ID NO: 912218 - RNA, 19 nt, Homo sapiens
gggaaccaagcguuuaaug

SEQ ID NO: 912219 - RNA, 19 nt, Homo sapiens
aaccaagcguuuaaugaag

SEQ ID NO: 912220 - RNA, 19 nt, Homo sapiens
gugcaaaagcccaggguua

SEQ ID NO: 912221 - RNA, 19 nt, Homo sapiens
cccaggcuuuggugcagua

SEQ ID NO: 912222 - RNA, 19 nt, Homo sapiens
gguggaagcuggggucaga

SEQ ID NO: 912223 - RNA, 19 nt, Homo sapiens
ugccauagccaguaacauc

SEQ ID NO: 912224 - RNA, 19 nt, Homo sapiens
cugcuggccuacucugguu

SEQ ID NO: 912225 - RNA, 19 nt, Homo sapiens
gaggaugggacuuuguuuu

SEQ ID NO: 912226 - RNA, 19 nt, Homo sapiens
ccaagaauaaacucaacuc

SEQ ID NO: 912227 - RNA, 19 nt, Homo sapiens
ggacggaucuuucauauug

SEQ ID NO: 912228 - RNA, 19 nt, Homo sapiens
gcuauuagaucuugaacuu

SEQ ID NO: 912229 - RNA, 19 nt, Homo sapiens
gaacuuugcuuaguggauu

SEQ ID NO: 912230 - RNA, 19 nt, Homo sapiens
gaaagaagaacaucaugaa

SEQ ID NO: 912231 - RNA, 19 nt, Homo sapiens
ggagaaugaucuguacaua

SEQ ID NO: 912232 - RNA, 19 nt, Homo sapiens
agaaugaucuguacauaga

SEQ ID NO: 912233 - RNA, 19 nt, Homo sapiens
caacuguacuagaggcuaa

SEQ ID NO: 912234 - RNA, 19 nt, Homo sapiens
ggagagaaauaccagaaag

SEQ ID NO: 912235 - RNA, 19 nt, Homo sapiens
caucaagaaugcaauuaga

SEQ ID NO: 912236 - RNA, 19 nt, Homo sapiens
gaagucaguuauucaucaa

SEQ ID NO: 912237 - RNA, 19 nt, Homo sapiens
ggucagagguaaagaaguc

SEQ ID NO: 912238 - RNA, 19 nt, Homo sapiens
agaaguggauggagagaaa

SEQ ID NO: 912239 - RNA, 19 nt, Homo sapiens
gaugggaccugcaaaggau

SEQ ID NO: 912240 - RNA, 19 nt, Homo sapiens
gaaagugguaguuccaaug

SEQ ID NO: 912241 - RNA, 19 nt, Homo sapiens
gagaguggauccgaaagug

SEQ ID NO: 912242 - RNA, 19 nt, Homo sapiens
cgaaagaagaacaucauga

SEQ ID NO: 912243 - RNA, 19 nt, Homo sapiens
ggaauccuuugcaucuaug

SEQ ID NO: 912244 - RNA, 19 nt, Homo sapiens
caagaaugcaauuagacua

SEQ ID NO: 912245 - RNA, 19 nt, Homo sapiens
gagaaauaccagaaaggaa

SEQ ID NO: 912246 - RNA, 19 nt, Homo sapiens
gaucuugaacuuacgucua

SEQ ID NO: 912247 - RNA, 19 nt, Homo sapiens
gagaaugaucuguacauag

SEQ ID NO: 912248 - RNA, 19 nt, Homo sapiens
gcgaguguuucucuucuuc

SEQ ID NO: 912249 - RNA, 19 nt, Homo sapiens
cgaaagugguaguuccaau

SEQ ID NO: 912250 - RNA, 19 nt, Homo sapiens
aaaugaacuuugcuuagug

SEQ ID NO: 912251 - RNA, 19 nt, Homo sapiens
caucuaugcugagacauuc

SEQ ID NO: 912252 - RNA, 19 nt, Homo sapiens
uaaagacucaagaucgaaa

SEQ ID NO: 912253 - RNA, 19 nt, Homo sapiens
aggauaaacuggucauugg

SEQ ID NO: 912254 - RNA, 19 nt, Homo sapiens
uggaauccuuugcaucuau

SEQ ID NO: 912255 - RNA, 19 nt, Homo sapiens
gaucgaaagaagaacauca

SEQ ID NO: 912256 - RNA, 19 nt, Homo sapiens
gcaguucucuugggaaucc

SEQ ID NO: 912257 - RNA, 19 nt, Homo sapiens
acuagaggcuaaugcaguu

SEQ ID NO: 912258 - RNA, 19 nt, Homo sapiens
gacauucuccucuuacaca

SEQ ID NO: 912259 - RNA, 19 nt, Homo sapiens
aguaaagacucaagaucga

SEQ ID NO: 912260 - RNA, 19 nt, Homo sapiens
gacucaagaucgaaagaag

SEQ ID NO: 912261 - RNA, 19 nt, Homo sapiens
uuaguggauugacuccuuu

SEQ ID NO: 912262 - RNA, 19 nt, Homo sapiens
caagaucgaaagaagaaca

SEQ ID NO: 912263 - RNA, 19 nt, Homo sapiens
guaaagacucaagaucgaa

SEQ ID NO: 912264 - RNA, 19 nt, Homo sapiens
uagaagaccagaaguggau

SEQ ID NO: 912265 - RNA, 19 nt, Homo sapiens
guggaauccuuugcaucua

SEQ ID NO: 912266 - RNA, 19 nt, Homo sapiens
ccaaugccaaggagccuaa

SEQ ID NO: 912267 - RNA, 19 nt, Homo sapiens
gauugacuccuuugcugaa

SEQ ID NO: 912268 - RNA, 19 nt, Homo sapiens
cuuaguggauugacuccuu

SEQ ID NO: 912269 - RNA, 19 nt, Homo sapiens
ggauaaacuggucauugga

SEQ ID NO: 912270 - RNA, 19 nt, Homo sapiens
agucaguuauucaucaaga

SEQ ID NO: 912271 - RNA, 19 nt, Homo sapiens
gcaacaacagauacaacug

SEQ ID NO: 912272 - RNA, 19 nt, Homo sapiens
ggucauuggacggaucuuu

SEQ ID NO: 912273 - RNA, 19 nt, Homo sapiens
gaauccaggagaguaaaga

SEQ ID NO: 912274 - RNA, 19 nt, Homo sapiens
uuggacggaucuuucauau

SEQ ID NO: 912275 - RNA, 19 nt, Homo sapiens
gucaguuauucaucaagaa

SEQ ID NO: 912276 - RNA, 19 nt, Homo sapiens
agagaaauaccagaaagga

SEQ ID NO: 912277 - RNA, 19 nt, Homo sapiens
gagagaaauaccagaaagg

SEQ ID NO: 912278 - RNA, 19 nt, Homo sapiens
gagcaacaacagauacaac

SEQ ID NO: 912279 - RNA, 19 nt, Homo sapiens
guauguagaagaccagaag

SEQ ID NO: 912280 - RNA, 19 nt, Homo sapiens
guaguuccaaugccaagga

SEQ ID NO: 912281 - RNA, 19 nt, Homo sapiens
acacagaugggaccugcaa

SEQ ID NO: 912282 - RNA, 19 nt, Homo sapiens
ggagcaacaacagauacaa

SEQ ID NO: 912283 - RNA, 19 nt, Homo sapiens
gacggaucuuucauauugu

SEQ ID NO: 912284 - RNA, 19 nt, Homo sapiens
gguugcggcuauuagaucu

SEQ ID NO: 912285 - RNA, 19 nt, Homo sapiens
ucuuucauauuguggagaa

SEQ ID NO: 912286 - RNA, 19 nt, Homo sapiens
aaggauaaacuggucauug

SEQ ID NO: 912287 - RNA, 19 nt, Homo sapiens
cucaagaucgaaagaagaa

SEQ ID NO: 912288 - RNA, 19 nt, Homo sapiens
gaguguuucucuucuucag

SEQ ID NO: 912289 - RNA, 19 nt, Homo sapiens
ucaagaaugcaauuagacu

SEQ ID NO: 912290 - RNA, 19 nt, Homo sapiens
ggaauccaggagaguaaag

SEQ ID NO: 912291 - RNA, 19 nt, Homo sapiens
gggaauccaggagaguaaa

SEQ ID NO: 912292 - RNA, 19 nt, Homo sapiens
gauccgaaagugguaguuc

SEQ ID NO: 912293 - RNA, 19 nt, Homo sapiens
ggcuaaugcaguucucuug

SEQ ID NO: 912294 - RNA, 19 nt, Homo sapiens
gcacucggagcuucuacag

SEQ ID NO: 912295 - RNA, 19 nt, Homo sapiens
gaaguggauggagagaaau

SEQ ID NO: 912296 - RNA, 19 nt, Homo sapiens
ccaugacccuguagaaauu

SEQ ID NO: 912297 - RNA, 19 nt, Homo sapiens
gcagcucugugcaguguuu

SEQ ID NO: 912298 - RNA, 19 nt, Homo sapiens
guaguuuguuuccuuguuu

SEQ ID NO: 912299 - RNA, 19 nt, Homo sapiens
ccaagaaaccagggacuua

SEQ ID NO: 912300 - RNA, 19 nt, Homo sapiens
gaauccugcucacaacauu

SEQ ID NO: 912301 - RNA, 19 nt, Homo sapiens
ggauggguauugaucaugu

SEQ ID NO: 912302 - RNA, 19 nt, Homo sapiens
ggauacauagggucaaauu

SEQ ID NO: 912303 - RNA, 19 nt, Homo sapiens
ugacugagcccuuucuugu

SEQ ID NO: 912304 - RNA, 19 nt, Homo sapiens
uuucugacuuugugguuua

SEQ ID NO: 912305 - RNA, 19 nt, Homo sapiens
gugacccucuggauucuaa

SEQ ID NO: 912306 - RNA, 19 nt, Homo sapiens
gcccugguguuggcuauuu

SEQ ID NO: 912307 - RNA, 19 nt, Homo sapiens
uacaaugacugagcccuuu

SEQ ID NO: 912308 - RNA, 19 nt, Homo sapiens
gguguuggcuauuuauggu

SEQ ID NO: 912309 - RNA, 19 nt, Homo sapiens
uguuggcuauuuaugguua

SEQ ID NO: 912310 - RNA, 19 nt, Homo sapiens
gaccguggcuuuucccaaa

SEQ ID NO: 912311 - RNA, 19 nt, Homo sapiens
accagggacuuacgcauuu

SEQ ID NO: 912312 - RNA, 19 nt, Homo sapiens
ggguauugaucauguccaa

SEQ ID NO: 912313 - RNA, 19 nt, Homo sapiens
uaaucuggauggguauuga

SEQ ID NO: 912314 - RNA, 19 nt, Homo sapiens
gcuagaagacgaggccaaa

SEQ ID NO: 912315 - RNA, 19 nt, Homo sapiens
gacugagcccuuucuugua

SEQ ID NO: 912316 - RNA, 19 nt, Homo sapiens
cacuugcuguguacaauga

SEQ ID NO: 912317 - RNA, 19 nt, Homo sapiens
acugagcccuuucuuguag

SEQ ID NO: 912318 - RNA, 19 nt, Homo sapiens
uuguuggccuucuuacuaa

SEQ ID NO: 912319 - RNA, 19 nt, Homo sapiens
gaagcugacacccgagcaa

SEQ ID NO: 912320 - RNA, 19 nt, Homo sapiens
gauacauagggucaaauug

SEQ ID NO: 912321 - RNA, 19 nt, Homo sapiens
gcuggugacccucuggauu

SEQ ID NO: 912322 - RNA, 19 nt, Homo sapiens
aaggaggaguggcaacaug

SEQ ID NO: 912323 - RNA, 19 nt, Homo sapiens
ccgagcaacugcauuccau

SEQ ID NO: 912324 - RNA, 19 nt, Homo sapiens
ccagggacuuacgcauuug

SEQ ID NO: 912325 - RNA, 19 nt, Homo sapiens
guggcaacauggcgucuuc

SEQ ID NO: 912326 - RNA, 19 nt, Homo sapiens
ugggauacauagggucaaa

SEQ ID NO: 912327 - RNA, 19 nt, Homo sapiens
uggcagcucugugcagugu

SEQ ID NO: 912328 - RNA, 19 nt, Homo sapiens
uguaguuuguuuccuuguu

SEQ ID NO: 912329 - RNA, 19 nt, Homo sapiens
caagaaaccagggacuuac

SEQ ID NO: 912330 - RNA, 19 nt, Homo sapiens
cccaugacccuguagaaau

SEQ ID NO: 912331 - RNA, 19 nt, Homo sapiens
ucuuguaguuuguuuccuu

SEQ ID NO: 912332 - RNA, 19 nt, Homo sapiens
gaaggaggaguggcaacau

SEQ ID NO: 912333 - RNA, 19 nt, Homo sapiens
cgauuucccaggagcguuu

SEQ ID NO: 912334 - RNA, 19 nt, Homo sapiens
guuucugacuuugugguuu

SEQ ID NO: 912335 - RNA, 19 nt, Homo sapiens
gccuacagugggauacaua

SEQ ID NO: 912336 - RNA, 19 nt, Homo sapiens
auuguuggccuucuuacua

SEQ ID NO: 912337 - RNA, 19 nt, Homo sapiens
acgcaguuguuacgagguu

SEQ ID NO: 912338 - RNA, 19 nt, Homo sapiens
uuuguuuccuuguuugaga

SEQ ID NO: 912339 - RNA, 19 nt, Homo sapiens
uaguuuguuuccuuguuug

SEQ ID NO: 912340 - RNA, 19 nt, Homo sapiens
gcccuuucuuguaguuugu

SEQ ID NO: 912341 - RNA, 19 nt, Homo sapiens
ugagcccuuucuuguaguu

SEQ ID NO: 912342 - RNA, 19 nt, Homo sapiens
cccugguguuggcuauuua

SEQ ID NO: 912343 - RNA, 19 nt, Homo sapiens
aaccagggacuuacgcauu

SEQ ID NO: 912344 - RNA, 19 nt, Homo sapiens
gauggguauugaucauguc

SEQ ID NO: 912345 - RNA, 19 nt, Homo sapiens
aaccuuggaccgugauuga

SEQ ID NO: 912346 - RNA, 19 nt, Homo sapiens
ucaggguccuaaucuggau

SEQ ID NO: 912347 - RNA, 19 nt, Homo sapiens
caaacuugcuggcuauaua

SEQ ID NO: 912348 - RNA, 19 nt, Homo sapiens
ccacaaugcugauuaaaca

SEQ ID NO: 912349 - RNA, 19 nt, Homo sapiens
ucaaguccaugaacagaua

SEQ ID NO: 912350 - RNA, 19 nt, Homo sapiens
gcugaaagcuggagguucu

SEQ ID NO: 912351 - RNA, 19 nt, Homo sapiens
gaggaaggaucagagaaga

SEQ ID NO: 912352 - RNA, 19 nt, Homo sapiens
gggaguaggucuucgaaac

SEQ ID NO: 912353 - RNA, 19 nt, Homo sapiens
ggaaguuguucacagcaau

SEQ ID NO: 912354 - RNA, 19 nt, Homo sapiens
ccacagccaggauugguua

SEQ ID NO: 912355 - RNA, 19 nt, Homo sapiens
ugacacaacugcugaaagc

SEQ ID NO: 912356 - RNA, 19 nt, Homo sapiens
gaguaggucuucgaaacuu

SEQ ID NO: 912357 - RNA, 19 nt, Homo sapiens
gaagucaagagaaccaaug

SEQ ID NO: 912358 - RNA, 19 nt, Homo sapiens
gagcuuacaugcagaugcu

SEQ ID NO: 912359 - RNA, 19 nt, Homo sapiens
cagccaggauugguuauga

SEQ ID NO: 912360 - RNA, 19 nt, Homo sapiens
gcuggagguucucugaaga

SEQ ID NO: 912361 - RNA, 19 nt, Homo sapiens
gucauuguguccuugguuu

SEQ ID NO: 912362 - RNA, 19 nt, Homo sapiens
guugugaguuguguucuug

SEQ ID NO: 912363 - RNA, 19 nt, Homo sapiens
ggaggcaggaugacgcaaa

SEQ ID NO: 912364 - RNA, 19 nt, Homo sapiens
guuguccucugcgugaaua

SEQ ID NO: 912365 - RNA, 19 nt, Homo sapiens
cuggcaaacugaacccuuu

SEQ ID NO: 912366 - RNA, 19 nt, Homo sapiens
acacggugauugugaaugg

SEQ ID NO: 912367 - RNA, 19 nt, Homo sapiens
gaguugcuauggccucuag

SEQ ID NO: 912368 - RNA, 19 nt, Homo sapiens
acaugcagaugcugaggaa

SEQ ID NO: 912369 - RNA, 19 nt, Homo sapiens
caccaggagucagcuuuga

SEQ ID NO: 912370 - RNA, 19 nt, Homo sapiens
ggaggaguguagagcuuac

SEQ ID NO: 912371 - RNA, 19 nt, Homo sapiens
aaacuugcuggcuauauau

SEQ ID NO: 912372 - RNA, 19 nt, Homo sapiens
uuuccacaaugcugauuaa

SEQ ID NO: 912373 - RNA, 19 nt, Homo sapiens
gaccuccacugccauuguc

SEQ ID NO: 912374 - RNA, 19 nt, Homo sapiens
gcccgcaugucccugucua

SEQ ID NO: 912375 - RNA, 19 nt, Homo sapiens
ggaguaggucuucgaaacu

SEQ ID NO: 912376 - RNA, 19 nt, Homo sapiens
gacccugucuucccuacca

SEQ ID NO: 912377 - RNA, 19 nt, Homo sapiens
gcagaaggaggaguguaga

SEQ ID NO: 912378 - RNA, 19 nt, Homo sapiens
gguugugaguuguguucuu

SEQ ID NO: 912379 - RNA, 19 nt, Homo sapiens
gaaguuguucacagcaauc

SEQ ID NO: 912380 - RNA, 19 nt, Homo sapiens
gggccauuguccaugagaa

SEQ ID NO: 912381 - RNA, 19 nt, Homo sapiens
cuccagacccuccuccuuu

SEQ ID NO: 912382 - RNA, 19 nt, Homo sapiens
gaggcaggaugacgcaaaa

SEQ ID NO: 912383 - RNA, 19 nt, Homo sapiens
caaaacacggugauuguga

SEQ ID NO: 912384 - RNA, 19 nt, Homo sapiens
aaggaggaguguagagcuu

SEQ ID NO: 912385 - RNA, 19 nt, Homo sapiens
ggcagaaggaggaguguag

SEQ ID NO: 912386 - RNA, 19 nt, Homo sapiens
ccacauccaccaggaguca

SEQ ID NO: 912387 - RNA, 19 nt, Homo sapiens
guucuuggagugugucuca

SEQ ID NO: 912388 - RNA, 19 nt, Homo sapiens
aaagcuggagguucucuga

SEQ ID NO: 912389 - RNA, 19 nt, Homo sapiens
ugaggaaggaucagagaag

SEQ ID NO: 912390 - RNA, 19 nt, Homo sapiens
ggucauuguguccuugguu

SEQ ID NO: 912391 - RNA, 19 nt, Homo sapiens
gcggcgaagucaagagaac

SEQ ID NO: 912392 - RNA, 19 nt, Homo sapiens
ccaccaggagucagcuuug

SEQ ID NO: 912393 - RNA, 19 nt, Homo sapiens
ugcagaugcugaggaaguu

SEQ ID NO: 912394 - RNA, 19 nt, Homo sapiens
gaucagagaagaggcuacu

SEQ ID NO: 912395 - RNA, 19 nt, Homo sapiens
ugaaugaggaaggaucaga

SEQ ID NO: 912396 - RNA, 19 nt, Homo sapiens
gauugugaauggaguugcu

SEQ ID NO: 912397 - RNA, 19 nt, Homo sapiens
aaaacacggugauugugaa

SEQ ID NO: 912398 - RNA, 19 nt, Homo sapiens
ggacgcagcuccucaacua

SEQ ID NO: 912399 - RNA, 19 nt, Homo sapiens
ggagaugacuacaggaaua

SEQ ID NO: 912400 - RNA, 19 nt, Homo sapiens
agaaacaccugcagaagua

SEQ ID NO: 912401 - RNA, 19 nt, Homo sapiens
caagacaacugaaugaugu

SEQ ID NO: 912402 - RNA, 19 nt, Homo sapiens
ugaauuaacucaggcagaa

SEQ ID NO: 912403 - RNA, 19 nt, Homo sapiens
gaagcggaccggauuguuu

SEQ ID NO: 912404 - RNA, 19 nt, Homo sapiens
gaugacuacaggaauauua

SEQ ID NO: 912405 - RNA, 19 nt, Homo sapiens
gagaccaucugcgaguaua

SEQ ID NO: 912406 - RNA, 19 nt, Homo sapiens
ggcaguaacucgguugaaa

SEQ ID NO: 912407 - RNA, 19 nt, Homo sapiens
cuacagcaccuaucacuug

SEQ ID NO: 912408 - RNA, 19 nt, Homo sapiens
gcccugagcuccaauugca

SEQ ID NO: 912409 - RNA, 19 nt, Homo sapiens
gagaaacaccugcagaagu

SEQ ID NO: 912410 - RNA, 19 nt, Homo sapiens
uugcaguucuccaaugaua

SEQ ID NO: 912411 - RNA, 19 nt, Homo sapiens
gcagcucgaugacuuguac

SEQ ID NO: 912412 - RNA, 19 nt, Homo sapiens
uggcugaggugaucgagaa

SEQ ID NO: 912413 - RNA, 19 nt, Homo sapiens
caagaggaagcgcgaauug

SEQ ID NO: 912414 - RNA, 19 nt, Homo sapiens
gcaaagcugaauuaacuca

SEQ ID NO: 912415 - RNA, 19 nt, Homo sapiens
gaguauaccugcacuaccu

SEQ ID NO: 912416 - RNA, 19 nt, Homo sapiens
gggagaccaucugcgagua

SEQ ID NO: 912417 - RNA, 19 nt, Homo sapiens
cugcagcgcuaccggauga

SEQ ID NO: 912418 - RNA, 19 nt, Homo sapiens
uguauaacauucucgacaa

SEQ ID NO: 912419 - RNA, 19 nt, Homo sapiens
cagcaccuaucacuuguuc

SEQ ID NO: 912420 - RNA, 19 nt, Homo sapiens
gcaggaggcucagcaaagc

SEQ ID NO: 912421 - RNA, 19 nt, Homo sapiens
guaaagacgaccgugguuu

SEQ ID NO: 912422 - RNA, 19 nt, Homo sapiens
gcuuauuccuaguauugaa

SEQ ID NO: 912423 - RNA, 19 nt, Homo sapiens
ccucaucccugaccucaag

SEQ ID NO: 912424 - RNA, 19 nt, Homo sapiens
gcaagaggaagcgcgaauu

SEQ ID NO: 912425 - RNA, 19 nt, Homo sapiens
ucgagaacuuggaguguga

SEQ ID NO: 912426 - RNA, 19 nt, Homo sapiens
ucccugaccucaaguggaa

SEQ ID NO: 912427 - RNA, 19 nt, Homo sapiens
cagagaaacaccugcagaa

SEQ ID NO: 912428 - RNA, 19 nt, Homo sapiens
ccaagacaacugaaugaug

SEQ ID NO: 912429 - RNA, 19 nt, Homo sapiens
gcaguucuccaaugauauc

SEQ ID NO: 912430 - RNA, 19 nt, Homo sapiens
acaacugaaugauguaaag

SEQ ID NO: 912431 - RNA, 19 nt, Homo sapiens
gcaggaguuggaaauggua

SEQ ID NO: 912432 - RNA, 19 nt, Homo sapiens
guauaacauucucgacaag

SEQ ID NO: 912433 - RNA, 19 nt, Homo sapiens
ggaggcaggaguuggaaau

SEQ ID NO: 912434 - RNA, 19 nt, Homo sapiens
cggcuuauuccuaguauug

SEQ ID NO: 912435 - RNA, 19 nt, Homo sapiens
aacagcagcucgaugacuu

SEQ ID NO: 912436 - RNA, 19 nt, Homo sapiens
gggacucucagccuucuuu

SEQ ID NO: 912437 - RNA, 19 nt, Homo sapiens
gcauccaguggguguauaa

SEQ ID NO: 912438 - RNA, 19 nt, Homo sapiens
gcaguaacucgguugaaag

SEQ ID NO: 912439 - RNA, 19 nt, Homo sapiens
gagaugacuacaggaauau

SEQ ID NO: 912440 - RNA, 19 nt, Homo sapiens
gagagacgggagaugacua

SEQ ID NO: 912441 - RNA, 19 nt, Homo sapiens
ggcaggaguuggaaauggu

SEQ ID NO: 912442 - RNA, 19 nt, Homo sapiens
ggagaccaucugcgaguau

SEQ ID NO: 912443 - RNA, 19 nt, Homo sapiens
cucgaugacuuguacuuga

SEQ ID NO: 912444 - RNA, 19 nt, Homo sapiens
gagcuccaauugcaguucu

SEQ ID NO: 912445 - RNA, 19 nt, Homo sapiens
gagaggaugccguugugau

SEQ ID NO: 912446 - RNA, 19 nt, Homo sapiens
ugcacuaccugcccuccua

SEQ ID NO: 912447 - RNA, 19 nt, Homo sapiens
ccaguggguguauaacauu

SEQ ID NO: 912448 - RNA, 19 nt, Homo sapiens
caacugaaugauguaaaga

SEQ ID NO: 912449 - RNA, 19 nt, Homo sapiens
ggcagaagagcacagaugu

SEQ ID NO: 912450 - RNA, 19 nt, Homo sapiens
agaggaagcgcgaauugga

SEQ ID NO: 912451 - RNA, 19 nt, Homo sapiens
uggagaagacgccauuuca

SEQ ID NO: 912452 - RNA, 19 nt, Homo sapiens
ggaaaaggaggcaggaguu

SEQ ID NO: 912453 - RNA, 19 nt, Homo sapiens
guucuccaaugauaucuac

SEQ ID NO: 912454 - RNA, 19 nt, Homo sapiens
ggagaagacgccauuucag

SEQ ID NO: 912455 - RNA, 19 nt, Homo sapiens
ucgaugacuuguacuugau

SEQ ID NO: 912456 - RNA, 19 nt, Homo sapiens
gacaacugaaugauguaaa

SEQ ID NO: 912457 - RNA, 19 nt, Homo sapiens
uggagaggaugccguugug

SEQ ID NO: 912458 - RNA, 19 nt, Homo sapiens
ggaguggggacaagauuuu

SEQ ID NO: 912459 - RNA, 19 nt, Homo sapiens
aaaggaggcaggaguugga

SEQ ID NO: 912460 - RNA, 19 nt, Homo sapiens
gaucgagaacuuggagugu

SEQ ID NO: 912461 - RNA, 19 nt, Homo sapiens
gaaccaacagcagcucgau

SEQ ID NO: 912462 - RNA, 19 nt, Homo sapiens
gcucgaugacuuguacuug

SEQ ID NO: 912463 - RNA, 19 nt, Homo sapiens
cugaggugaucgagaacuu

SEQ ID NO: 912464 - RNA, 19 nt, Homo sapiens
ggagaggaugccguuguga

SEQ ID NO: 912465 - RNA, 19 nt, Homo sapiens
uacagcaccuaucacuugu

SEQ ID NO: 912466 - RNA, 19 nt, Homo sapiens
guugugauccuggagaaga

SEQ ID NO: 912467 - RNA, 19 nt, Homo sapiens
uccaguggguguauaacau

SEQ ID NO: 912468 - RNA, 19 nt, Homo sapiens
agacaacugaaugauguaa

SEQ ID NO: 912469 - RNA, 19 nt, Homo sapiens
uaucacuuguucccuccaa

SEQ ID NO: 912470 - RNA, 19 nt, Homo sapiens
caguggguguauaacauuc

SEQ ID NO: 912471 - RNA, 19 nt, Homo sapiens
acaggaauauuacuuuacc

SEQ ID NO: 912472 - RNA, 19 nt, Homo sapiens
gggagaugacuacaggaau

SEQ ID NO: 912473 - RNA, 19 nt, Homo sapiens
accaacagcagcucgauga

SEQ ID NO: 912474 - RNA, 19 nt, Homo sapiens
gacuacaggaauauuacuu

SEQ ID NO: 912475 - RNA, 19 nt, Homo sapiens
gaaaaggaggcaggaguug

SEQ ID NO: 912476 - RNA, 19 nt, Homo sapiens
uguaguggaugcagaauaa

SEQ ID NO: 912477 - RNA, 19 nt, Homo sapiens
cuacagcccucccagcuaa

SEQ ID NO: 912478 - RNA, 19 nt, Homo sapiens
gauccaugcuuuacugugu

SEQ ID NO: 912479 - RNA, 19 nt, Homo sapiens
gaaccauucuugggauuca

SEQ ID NO: 912480 - RNA, 19 nt, Homo sapiens
gcuggugccuccauaacaa

SEQ ID NO: 912481 - RNA, 19 nt, Homo sapiens
caaacaaacagcaguacuu

SEQ ID NO: 912482 - RNA, 19 nt, Homo sapiens
gguuggaucuguguaguug

SEQ ID NO: 912483 - RNA, 19 nt, Homo sapiens
ccaaagugcugggauuaca

SEQ ID NO: 912484 - RNA, 19 nt, Homo sapiens
gugcugggauuacagguau

SEQ ID NO: 912485 - RNA, 19 nt, Homo sapiens
ccucccagcuaaacauuug

SEQ ID NO: 912486 - RNA, 19 nt, Homo sapiens
guacuugccagaaccauuc

SEQ ID NO: 912487 - RNA, 19 nt, Homo sapiens
cuacaaacaaacagcagua

SEQ ID NO: 912488 - RNA, 19 nt, Homo sapiens
ggcagaaccucguuuuauu

SEQ ID NO: 912489 - RNA, 19 nt, Homo sapiens
ugacuggauccaugcuuua

SEQ ID NO: 912490 - RNA, 19 nt, Homo sapiens
aaacaaacagcaguacuug

SEQ ID NO: 912491 - RNA, 19 nt, Homo sapiens
ccgcuagccucccaaagug

SEQ ID NO: 912492 - RNA, 19 nt, Homo sapiens
gcuuuacuguguuuaaugg

SEQ ID NO: 912493 - RNA, 19 nt, Homo sapiens
gcagaaccucguuuuauuu

SEQ ID NO: 912494 - RNA, 19 nt, Homo sapiens
uuaauccaaucaccuacaa

SEQ ID NO: 912495 - RNA, 19 nt, Homo sapiens
cagcuaaacauuuggaaca

SEQ ID NO: 912496 - RNA, 19 nt, Homo sapiens
cugacuggauccaugcuuu

SEQ ID NO: 912497 - RNA, 19 nt, Homo sapiens
cagcaguacuugccagaac

SEQ ID NO: 912498 - RNA, 19 nt, Homo sapiens
caccagcccuuuuguagug

SEQ ID NO: 912499 - RNA, 19 nt, Homo sapiens
uccaugcuuuacuguguuu

SEQ ID NO: 912500 - RNA, 19 nt, Homo sapiens
acaagcgucuggcguugag

SEQ ID NO: 912501 - RNA, 19 nt, Homo sapiens
cugcuucacuccugcucuu

SEQ ID NO: 912502 - RNA, 19 nt, Homo sapiens
cuggauccaugcuuuacug

SEQ ID NO: 912503 - RNA, 19 nt, Homo sapiens
cuucacuccugcucuuugu

SEQ ID NO: 912504 - RNA, 19 nt, Homo sapiens
gaaauaggcuuuguuguaa

SEQ ID NO: 912505 - RNA, 19 nt, Homo sapiens
gaaagaagauaaacuguga

SEQ ID NO: 912506 - RNA, 19 nt, Homo sapiens
ggaaauaggcuuuguugua

SEQ ID NO: 912507 - RNA, 19 nt, Homo sapiens
ggauuugcaucgugaauua

SEQ ID NO: 912508 - RNA, 19 nt, Homo sapiens
gaaauguacuuguuaggaa

SEQ ID NO: 912509 - RNA, 19 nt, Homo sapiens
uaugguaacugguuucuua

SEQ ID NO: 912510 - RNA, 19 nt, Homo sapiens
gaagauaaacugugauuug

SEQ ID NO: 912511 - RNA, 19 nt, Homo sapiens
gaacaucacucgaaaacua

SEQ ID NO: 912512 - RNA, 19 nt, Homo sapiens
acacacagcuuauauguau

SEQ ID NO: 912513 - RNA, 19 nt, Homo sapiens
gucaagcucuuaagaaaua

SEQ ID NO: 912514 - RNA, 19 nt, Homo sapiens
ucacuggauugcuuuauua

SEQ ID NO: 912515 - RNA, 19 nt, Homo sapiens
gaacuuagcacugucuuga

SEQ ID NO: 912516 - RNA, 19 nt, Homo sapiens
gaauuugaaucccuuccua

SEQ ID NO: 912517 - RNA, 19 nt, Homo sapiens
gcagauagaaugcaaauag

SEQ ID NO: 912518 - RNA, 19 nt, Homo sapiens
gaacaugcaagaacaauca

SEQ ID NO: 912519 - RNA, 19 nt, Homo sapiens
gauaaacugugauuugaca

SEQ ID NO: 912520 - RNA, 19 nt, Homo sapiens
ugacauaucacgugaauga

SEQ ID NO: 912521 - RNA, 19 nt, Homo sapiens
gaacacauuuaugcauuga

SEQ ID NO: 912522 - RNA, 19 nt, Homo sapiens
ggacagugguguguauuga

SEQ ID NO: 912523 - RNA, 19 nt, Homo sapiens
gcaaugaacaucacucgaa

SEQ ID NO: 912524 - RNA, 19 nt, Homo sapiens
ucugguaucuucuuacuaa

SEQ ID NO: 912525 - RNA, 19 nt, Homo sapiens
gagaggaugcucacuguaa

SEQ ID NO: 912526 - RNA, 19 nt, Homo sapiens
ugaaaccacugauugcaaa

SEQ ID NO: 912527 - RNA, 19 nt, Homo sapiens
ggaacacauuuaugcauug

SEQ ID NO: 912528 - RNA, 19 nt, Homo sapiens
guuaggaaguagcuuaauu

SEQ ID NO: 912529 - RNA, 19 nt, Homo sapiens
caaugaacaucacucgaaa

SEQ ID NO: 912530 - RNA, 19 nt, Homo sapiens
ugaguagucuguacaguga

SEQ ID NO: 912531 - RNA, 19 nt, Homo sapiens
guuuacaugugcagaguua

SEQ ID NO: 912532 - RNA, 19 nt, Homo sapiens
guucugcugucacuguuua

SEQ ID NO: 912533 - RNA, 19 nt, Homo sapiens
ccuguugucuucuaccuua

SEQ ID NO: 912534 - RNA, 19 nt, Homo sapiens
ggaggcaaauugugcaaau

SEQ ID NO: 912535 - RNA, 19 nt, Homo sapiens
gugauacgauugaaaugaa

SEQ ID NO: 912536 - RNA, 19 nt, Homo sapiens
gcaaauaguugugauucuc

SEQ ID NO: 912537 - RNA, 19 nt, Homo sapiens
ucagaauuguucacaguuu

SEQ ID NO: 912538 - RNA, 19 nt, Homo sapiens
gaaauacaaggacuucaga

SEQ ID NO: 912539 - RNA, 19 nt, Homo sapiens
ugagcaccuuucaguauua

SEQ ID NO: 912540 - RNA, 19 nt, Homo sapiens
gaaagugauacgauugaaa

SEQ ID NO: 912541 - RNA, 19 nt, Homo sapiens
gaaagggaccugagaggau

SEQ ID NO: 912542 - RNA, 19 nt, Homo sapiens
uaacugguuucuuacuuga

SEQ ID NO: 912543 - RNA, 19 nt, Homo sapiens
gaaccuggaacacauuuau

SEQ ID NO: 912544 - RNA, 19 nt, Homo sapiens
gauagaaugcaaauaguug

SEQ ID NO: 912545 - RNA, 19 nt, Homo sapiens
guauuaagcgcuacccuaa

SEQ ID NO: 912546 - RNA, 19 nt, Homo sapiens
gaguucaggauuucauuua

SEQ ID NO: 912547 - RNA, 19 nt, Homo sapiens
agaccuagcaucagcaaua

SEQ ID NO: 912548 - RNA, 19 nt, Homo sapiens
caacagugaagaauuauca

SEQ ID NO: 912549 - RNA, 19 nt, Homo sapiens
ggaagacacaacuugguuu

SEQ ID NO: 912550 - RNA, 19 nt, Homo sapiens
gugaaugaaugguggaaga

SEQ ID NO: 912551 - RNA, 19 nt, Homo sapiens
gagucgaacuuucaacugu

SEQ ID NO: 912552 - RNA, 19 nt, Homo sapiens
caacaggucgucagcaaga

SEQ ID NO: 912553 - RNA, 19 nt, Homo sapiens
guugagucauugcucuuua

SEQ ID NO: 912554 - RNA, 19 nt, Homo sapiens
gcaaaccucccugacaauu

SEQ ID NO: 912555 - RNA, 19 nt, Homo sapiens
gaaugcacauagucuuuua

SEQ ID NO: 912556 - RNA, 19 nt, Homo sapiens
caaacagcacaguauauuu

SEQ ID NO: 912557 - RNA, 19 nt, Homo sapiens
ucauugcucuuuagaccua

SEQ ID NO: 912558 - RNA, 19 nt, Homo sapiens
caugcaagaacaaucauua

SEQ ID NO: 912559 - RNA, 19 nt, Homo sapiens
cauaucacgugaaugaaug

SEQ ID NO: 912560 - RNA, 19 nt, Homo sapiens
caaacaacagugaagaauu

SEQ ID NO: 912561 - RNA, 19 nt, Homo sapiens
aagucaagcucuuaagaaa

SEQ ID NO: 912562 - RNA, 19 nt, Homo sapiens
ccacauggcaggaggcaaa

SEQ ID NO: 912563 - RNA, 19 nt, Homo sapiens
caagucaagcucuuaagaa

SEQ ID NO: 912564 - RNA, 19 nt, Homo sapiens
ugaccugcuuugaacauaa

SEQ ID NO: 912565 - RNA, 19 nt, Homo sapiens
aaacagcacaguauauuuc

SEQ ID NO: 912566 - RNA, 19 nt, Homo sapiens
acacuccguuucagaauug

SEQ ID NO: 912567 - RNA, 19 nt, Homo sapiens
ucaaacagcacaguauauu

SEQ ID NO: 912568 - RNA, 19 nt, Homo sapiens
uaucaaacagcacaguaua

SEQ ID NO: 912569 - RNA, 19 nt, Homo sapiens
gcgcuacccuaaagugugu

SEQ ID NO: 912570 - RNA, 19 nt, Homo sapiens
aaaguaguaagccacauua

SEQ ID NO: 912571 - RNA, 19 nt, Homo sapiens
ugccagaagucucuuaaug

SEQ ID NO: 912572 - RNA, 19 nt, Homo sapiens
acacauuuaugcauugaug

SEQ ID NO: 912573 - RNA, 19 nt, Homo sapiens
uggaacacauuuaugcauu

SEQ ID NO: 912574 - RNA, 19 nt, Homo sapiens
gggaaugcacauagucuuu

SEQ ID NO: 912575 - RNA, 19 nt, Homo sapiens
gcuguuacacuuucucuga

SEQ ID NO: 912576 - RNA, 19 nt, Homo sapiens
gaugaaagugauacgauug

SEQ ID NO: 912577 - RNA, 19 nt, Homo sapiens
uaacagaacaugcaagaac

SEQ ID NO: 912578 - RNA, 19 nt, Homo sapiens
gaagacacaacuugguuuc

SEQ ID NO: 912579 - RNA, 19 nt, Homo sapiens
aaagaaacgcaaacucauu

SEQ ID NO: 912580 - RNA, 19 nt, Homo sapiens
gcacauagucuuuuacaga

SEQ ID NO: 912581 - RNA, 19 nt, Homo sapiens
caucagcaauagauuucaa

SEQ ID NO: 912582 - RNA, 19 nt, Homo sapiens
ugaaucccuuccuauacua

SEQ ID NO: 912583 - RNA, 19 nt, Homo sapiens
gaucauccuuauuguuucu

SEQ ID NO: 912584 - RNA, 19 nt, Homo sapiens
gauuuaugguaacugguuu

SEQ ID NO: 912585 - RNA, 19 nt, Homo sapiens
caaaccucccugacaauuu

SEQ ID NO: 912586 - RNA, 19 nt, Homo sapiens
gacacaacuugguuucaga

SEQ ID NO: 912587 - RNA, 19 nt, Homo sapiens
gaaugaacuugagaauaag

SEQ ID NO: 912588 - RNA, 19 nt, Homo sapiens
gcacaguauauuuccuuaa

SEQ ID NO: 912589 - RNA, 19 nt, Homo sapiens
auauaaggcucuuggaugu

SEQ ID NO: 912590 - RNA, 19 nt, Homo sapiens
guagcuuucuucacucaga

SEQ ID NO: 912591 - RNA, 19 nt, Homo sapiens
gagcaccuuucaguauuau

SEQ ID NO: 912592 - RNA, 19 nt, Homo sapiens
cagauagaaugcaaauagu

SEQ ID NO: 912593 - RNA, 19 nt, Homo sapiens
cauaguucgugcucagaaa

SEQ ID NO: 912594 - RNA, 19 nt, Homo sapiens
agaugaaagugauacgauu

SEQ ID NO: 912595 - RNA, 19 nt, Homo sapiens
caucgugaauuacauuaag

SEQ ID NO: 912596 - RNA, 19 nt, Homo sapiens
cuuaguagcuuucuucacu

SEQ ID NO: 912597 - RNA, 19 nt, Homo sapiens
cauguucaauucuguaagu

SEQ ID NO: 912598 - RNA, 19 nt, Homo sapiens
gcacugucuugauuugaag

SEQ ID NO: 912599 - RNA, 19 nt, Homo sapiens
gaaugcaaauaguugugau

SEQ ID NO: 912600 - RNA, 19 nt, Homo sapiens
uugcaaaccucccugacaa

SEQ ID NO: 912601 - RNA, 19 nt, Homo sapiens
ccacuucuuucuaacagau

SEQ ID NO: 912602 - RNA, 19 nt, Homo sapiens
uaacaaacaacagugaaga

SEQ ID NO: 912603 - RNA, 19 nt, Homo sapiens
ugucuugauuugaagcaua

SEQ ID NO: 912604 - RNA, 19 nt, Homo sapiens
gcucagagaagauccauuu

SEQ ID NO: 912605 - RNA, 19 nt, Homo sapiens
ggccaaagcugcuaagaag

SEQ ID NO: 912606 - RNA, 19 nt, Homo sapiens
ccaaagaccucagcaagca

SEQ ID NO: 912607 - RNA, 19 nt, Homo sapiens
cagagcaggucaccaagaa

SEQ ID NO: 912608 - RNA, 19 nt, Homo sapiens
ggacgacgccaucuauuca

SEQ ID NO: 912609 - RNA, 19 nt, Homo sapiens
gcacacccauugacuaugc

SEQ ID NO: 912610 - RNA, 19 nt, Homo sapiens
cgagguggaucgaagagaa

SEQ ID NO: 912611 - RNA, 19 nt, Homo sapiens
ccaaagcugcuaagaagaa

SEQ ID NO: 912612 - RNA, 19 nt, Homo sapiens
ggaugucccugcccuguag

SEQ ID NO: 912613 - RNA, 19 nt, Homo sapiens
guacauagucuccauggau

SEQ ID NO: 912614 - RNA, 19 nt, Homo sapiens
ggcaaacacuggaaagucu

SEQ ID NO: 912615 - RNA, 19 nt, Homo sapiens
ccaagaacauucaggaacu

SEQ ID NO: 912616 - RNA, 19 nt, Homo sapiens
gaagggaagagguuucuag

SEQ ID NO: 912617 - RNA, 19 nt, Homo sapiens
ucaugaaggucaacaguag

SEQ ID NO: 912618 - RNA, 19 nt, Homo sapiens
gggcagcucuccguacaug

SEQ ID NO: 912619 - RNA, 19 nt, Homo sapiens
cgagauggccucccucuuc

SEQ ID NO: 912620 - RNA, 19 nt, Homo sapiens
ccacagcacucuggugaca

SEQ ID NO: 912621 - RNA, 19 nt, Homo sapiens
caagacgugucauguacau

SEQ ID NO: 912622 - RNA, 19 nt, Homo sapiens
ggaccucacuggccauagg

SEQ ID NO: 912623 - RNA, 19 nt, Homo sapiens
gcaagccggaucacaagaa

SEQ ID NO: 912624 - RNA, 19 nt, Homo sapiens
agacgugucauguacauuu

SEQ ID NO: 912625 - RNA, 19 nt, Homo sapiens
ggacgccacaucuccauug

SEQ ID NO: 912626 - RNA, 19 nt, Homo sapiens
gagccgacagugacuauga

SEQ ID NO: 912627 - RNA, 19 nt, Homo sapiens
ccacagcacugagcuagag

SEQ ID NO: 912628 - RNA, 19 nt, Homo sapiens
gaagaaggcccuggcuaca

SEQ ID NO: 912629 - RNA, 19 nt, Homo sapiens
agacagagcaggucaccaa

SEQ ID NO: 912630 - RNA, 19 nt, Homo sapiens
cgccacaucuccauuguca

SEQ ID NO: 912631 - RNA, 19 nt, Homo sapiens
cccaggaguucaagcauga

SEQ ID NO: 912632 - RNA, 19 nt, Homo sapiens
gcaguggagccgacaguga

SEQ ID NO: 912633 - RNA, 19 nt, Homo sapiens
ucaucgacauucucaguga

SEQ ID NO: 912634 - RNA, 19 nt, Homo sapiens
gaucaucgacauucucagu

SEQ ID NO: 912635 - RNA, 19 nt, Homo sapiens
cagagugagugccggaaga

SEQ ID NO: 912636 - RNA, 19 nt, Homo sapiens
gagcaggucaccaagaaca

SEQ ID NO: 912637 - RNA, 19 nt, Homo sapiens
agaaggcccuggcuacauc

SEQ ID NO: 912638 - RNA, 19 nt, Homo sapiens
caagccggaucacaagaau

SEQ ID NO: 912639 - RNA, 19 nt, Homo sapiens
gccaauaugagcucacuga

SEQ ID NO: 912640 - RNA, 19 nt, Homo sapiens
gacgugucauguacauuug

SEQ ID NO: 912641 - RNA, 19 nt, Homo sapiens
gucaagacgugucauguac

SEQ ID NO: 912642 - RNA, 19 nt, Homo sapiens
ccuaccggcugcagaguga

SEQ ID NO: 912643 - RNA, 19 nt, Homo sapiens
caagaacauucaggaacug

SEQ ID NO: 912644 - RNA, 19 nt, Homo sapiens
gcaggucaccaagaacauu

SEQ ID NO: 912645 - RNA, 19 nt, Homo sapiens
aggaguaccuggagcugaa

SEQ ID NO: 912646 - RNA, 19 nt, Homo sapiens
ccgagcugcuuguagugua

SEQ ID NO: 912647 - RNA, 19 nt, Homo sapiens
ugucaagacgugucaugua

SEQ ID NO: 912648 - RNA, 19 nt, Homo sapiens
ccagugcgccuaugacauc

SEQ ID NO: 912649 - RNA, 19 nt, Homo sapiens
ccacaucuccauugucaag

SEQ ID NO: 912650 - RNA, 19 nt, Homo sapiens
gggccacuccagacauuaa

SEQ ID NO: 912651 - RNA, 19 nt, Homo sapiens
uaugagaacacgcaaagug

SEQ ID NO: 912652 - RNA, 19 nt, Homo sapiens
cguggaggaugucccgaaa

SEQ ID NO: 912653 - RNA, 19 nt, Homo sapiens
cugugacgcugcaggagua

SEQ ID NO: 912654 - RNA, 19 nt, Homo sapiens
uuaacuuugugguaacuga

SEQ ID NO: 912655 - RNA, 19 nt, Homo sapiens
aagccuggauggagaccua

SEQ ID NO: 912656 - RNA, 19 nt, Homo sapiens
gacagugacuaugagaaca

SEQ ID NO: 912657 - RNA, 19 nt, Homo sapiens
gcgcucagcaaccggcuuu

SEQ ID NO: 912658 - RNA, 19 nt, Homo sapiens
ccuugcugcucucccuuua

SEQ ID NO: 912659 - RNA, 19 nt, Homo sapiens
gagguggaucgaagagaaa

SEQ ID NO: 912660 - RNA, 19 nt, Homo sapiens
uugaggaacucgccaugga

SEQ ID NO: 912661 - RNA, 19 nt, Homo sapiens
gacgcaagccggaucacaa

SEQ ID NO: 912662 - RNA, 19 nt, Homo sapiens
cgagcugcuuguaguguau

SEQ ID NO: 912663 - RNA, 19 nt, Homo sapiens
gaggacgacgccaucuauu

SEQ ID NO: 912664 - RNA, 19 nt, Homo sapiens
caaagcugcuaagaagaag

SEQ ID NO: 912665 - RNA, 19 nt, Homo sapiens
ggagacagcagggcaagag

SEQ ID NO: 912666 - RNA, 19 nt, Homo sapiens
uugcugcucucccuuuaau

SEQ ID NO: 912667 - RNA, 19 nt, Homo sapiens
gcaccuccccucuguauau

SEQ ID NO: 912668 - RNA, 19 nt, Homo sapiens
aagaagcagugaccucucu

SEQ ID NO: 912669 - RNA, 19 nt, Homo sapiens
ugacagccuugacuuaucc

SEQ ID NO: 912670 - RNA, 19 nt, Homo sapiens
accaugagcuggcggaaag

SEQ ID NO: 912671 - RNA, 19 nt, Homo sapiens
ugcagcagcucaugaaggu

SEQ ID NO: 912672 - RNA, 19 nt, Homo sapiens
ccgcacacccauugacuau

SEQ ID NO: 912673 - RNA, 19 nt, Homo sapiens
gggcauccccuccuuugua

SEQ ID NO: 912674 - RNA, 19 nt, Homo sapiens
uggccucccucuucccaaa

SEQ ID NO: 912675 - RNA, 19 nt, Homo sapiens
ggacuccucggacuugucu

SEQ ID NO: 912676 - RNA, 19 nt, Homo sapiens
gacgccacaucuccauugu

SEQ ID NO: 912677 - RNA, 19 nt, Homo sapiens
ccaccuugaucaucgacau

SEQ ID NO: 912678 - RNA, 19 nt, Homo sapiens
ccuucucuaugaacuuaaa

SEQ ID NO: 912679 - RNA, 19 nt, Homo sapiens
cgacagugacuaugagaac

SEQ ID NO: 912680 - RNA, 19 nt, Homo sapiens
agaggacgacgccaucuau

SEQ ID NO: 912681 - RNA, 19 nt, Homo sapiens
gaguuugccaccuugauca

SEQ ID NO: 912682 - RNA, 19 nt, Homo sapiens
cccgagaguuugccaccuu

SEQ ID NO: 912683 - RNA, 19 nt, Homo sapiens
uggaggaugucccgaaagg

SEQ ID NO: 912684 - RNA, 19 nt, Homo sapiens
gccuugacuuauccgaauu

SEQ ID NO: 912685 - RNA, 19 nt, Homo sapiens
ucagagaagauccauuugg

SEQ ID NO: 912686 - RNA, 19 nt, Homo sapiens
gcucaugaaggucaacagu

SEQ ID NO: 912687 - RNA, 19 nt, Homo sapiens
gaauuggccaaagcugcua

SEQ ID NO: 912688 - RNA, 19 nt, Homo sapiens
gcugguugagugccaauau

SEQ ID NO: 912689 - RNA, 19 nt, Homo sapiens
gugccugcguguugagugu

SEQ ID NO: 912690 - RNA, 19 nt, Homo sapiens
uucuagagcugggcaaaga

SEQ ID NO: 912691 - RNA, 19 nt, Homo sapiens
ggaagggaagagguuucua

SEQ ID NO: 912692 - RNA, 19 nt, Homo sapiens
cauuacaucaucccacaga

SEQ ID NO: 912693 - RNA, 19 nt, Homo sapiens
gcggaaaggcugguugagu

SEQ ID NO: 912694 - RNA, 19 nt, Homo sapiens
aggccgagcugcuuguagu

SEQ ID NO: 912695 - RNA, 19 nt, Homo sapiens
gcauggacuccucggacuu

SEQ ID NO: 912696 - RNA, 19 nt, Homo sapiens
cuuuaaugcccgagaguuu

SEQ ID NO: 912697 - RNA, 19 nt, Homo sapiens
ggggugugcugguguguga

SEQ ID NO: 912698 - RNA, 19 nt, Homo sapiens
gcaggcaaacacuggaaag

SEQ ID NO: 912699 - RNA, 19 nt, Homo sapiens
cuacaucggaggcaaaggu

SEQ ID NO: 912700 - RNA, 19 nt, Homo sapiens
gcagugcugugcccuuccu

SEQ ID NO: 912701 - RNA, 19 nt, Homo sapiens
ggacgcaagccggaucaca

SEQ ID NO: 912702 - RNA, 19 nt, Homo sapiens
cugaccggcuggccuucua

SEQ ID NO: 912703 - RNA, 19 nt, Homo sapiens
caaagaccucagcaagcaa

SEQ ID NO: 912704 - RNA, 19 nt, Homo sapiens
ggaauggcuucuauuauuu

SEQ ID NO: 912705 - RNA, 19 nt, Homo sapiens
gacaagaacuucaggugua

SEQ ID NO: 912706 - RNA, 19 nt, Homo sapiens
gaacuacacugggagaauu

SEQ ID NO: 912707 - RNA, 19 nt, Homo sapiens
ggagauguuuaccuuaaua

SEQ ID NO: 912708 - RNA, 19 nt, Homo sapiens
uaacauuucuaccagcuua

SEQ ID NO: 912709 - RNA, 19 nt, Homo sapiens
gcaggaauggcuucuauua

SEQ ID NO: 912710 - RNA, 19 nt, Homo sapiens
gaaagauucuguuccacaa

SEQ ID NO: 912711 - RNA, 19 nt, Homo sapiens
gauaaauucuugagucaug

SEQ ID NO: 912712 - RNA, 19 nt, Homo sapiens
gaaccuggacuucucauuu

SEQ ID NO: 912713 - RNA, 19 nt, Homo sapiens
ugacugugcuggauaaauu

SEQ ID NO: 912714 - RNA, 19 nt, Homo sapiens
ccacuuuacuucauggaua

SEQ ID NO: 912715 - RNA, 19 nt, Homo sapiens
gagcaggaauggcuucuau

SEQ ID NO: 912716 - RNA, 19 nt, Homo sapiens
gagcaggguugguguauuc

SEQ ID NO: 912717 - RNA, 19 nt, Homo sapiens
uaauucggcugaagaagua

SEQ ID NO: 912718 - RNA, 19 nt, Homo sapiens
ccagggaacuuuaugauca

SEQ ID NO: 912719 - RNA, 19 nt, Homo sapiens
gcauaucuuucaugaacua

SEQ ID NO: 912720 - RNA, 19 nt, Homo sapiens
ccacugagguugcugaugu

SEQ ID NO: 912721 - RNA, 19 nt, Homo sapiens
ccacuuguguguuaaagaa

SEQ ID NO: 912722 - RNA, 19 nt, Homo sapiens
aggaauggcuucuauuauu

SEQ ID NO: 912723 - RNA, 19 nt, Homo sapiens
ccaacucccuccugaauug

SEQ ID NO: 912724 - RNA, 19 nt, Homo sapiens
ucaagcauaucuuucauga

SEQ ID NO: 912725 - RNA, 19 nt, Homo sapiens
gguggaagauggauuuaau

SEQ ID NO: 912726 - RNA, 19 nt, Homo sapiens
gaacaacaggucuaccaaa

SEQ ID NO: 912727 - RNA, 19 nt, Homo sapiens
gaugaaagauucuguucca

SEQ ID NO: 912728 - RNA, 19 nt, Homo sapiens
gaaauggcauacggaguga

SEQ ID NO: 912729 - RNA, 19 nt, Homo sapiens
gaagguggugcucauuaua

SEQ ID NO: 912730 - RNA, 19 nt, Homo sapiens
acaaacuucuuuccacuuu

SEQ ID NO: 912731 - RNA, 19 nt, Homo sapiens
caaacaaucuaagagagaa

SEQ ID NO: 912732 - RNA, 19 nt, Homo sapiens
agaaacuccuguucccuua

SEQ ID NO: 912733 - RNA, 19 nt, Homo sapiens
ugagguugcugauguuauu

SEQ ID NO: 912734 - RNA, 19 nt, Homo sapiens
gaaucaagcauaucuuuca

SEQ ID NO: 912735 - RNA, 19 nt, Homo sapiens
gcagcuauccugggaauuu

SEQ ID NO: 912736 - RNA, 19 nt, Homo sapiens
gaaccauuccucucugaaa

SEQ ID NO: 912737 - RNA, 19 nt, Homo sapiens
uauaucagguuaugaagga

SEQ ID NO: 912738 - RNA, 19 nt, Homo sapiens
gcaaacaaucuaagagaga

SEQ ID NO: 912739 - RNA, 19 nt, Homo sapiens
gaacuuugucgcuaccuuu

SEQ ID NO: 912740 - RNA, 19 nt, Homo sapiens
ggagacaucuacaccuauc

SEQ ID NO: 912741 - RNA, 19 nt, Homo sapiens
acaggaacauucaaacuau

SEQ ID NO: 912742 - RNA, 19 nt, Homo sapiens
ccuuaauacuggagacuua

SEQ ID NO: 912743 - RNA, 19 nt, Homo sapiens
gggugccacuuguguguua

SEQ ID NO: 912744 - RNA, 19 nt, Homo sapiens
ggagacacuuucagaugga

SEQ ID NO: 912745 - RNA, 19 nt, Homo sapiens
gaaauauaaagguguguga

SEQ ID NO: 912746 - RNA, 19 nt, Homo sapiens
gggaauuucuggauguguu

SEQ ID NO: 912747 - RNA, 19 nt, Homo sapiens
gcucaugacauuguuuaua

SEQ ID NO: 912748 - RNA, 19 nt, Homo sapiens
ggaagcaacaggaacauuc

SEQ ID NO: 912749 - RNA, 19 nt, Homo sapiens
aagcauaucuuucaugaac

SEQ ID NO: 912750 - RNA, 19 nt, Homo sapiens
ggagugacugcaagaagua

SEQ ID NO: 912751 - RNA, 19 nt, Homo sapiens
gaugaacccaugagaaaug

SEQ ID NO: 912752 - RNA, 19 nt, Homo sapiens
gagcugugcuuggaagaga

SEQ ID NO: 912753 - RNA, 19 nt, Homo sapiens
uaucauaguucagcagcua

SEQ ID NO: 912754 - RNA, 19 nt, Homo sapiens
gaaagaugaacccaugaga

SEQ ID NO: 912755 - RNA, 19 nt, Homo sapiens
gcaaugagccggacuucgu

SEQ ID NO: 912756 - RNA, 19 nt, Homo sapiens
caagaaguaugaugugacu

SEQ ID NO: 912757 - RNA, 19 nt, Homo sapiens
ugaagguggugcucauuau

SEQ ID NO: 912758 - RNA, 19 nt, Homo sapiens
ggagugauguauggagaga

SEQ ID NO: 912759 - RNA, 19 nt, Homo sapiens
acaagaacuucagguguaa

SEQ ID NO: 912760 - RNA, 19 nt, Homo sapiens
agggagauguuuaccuuaa

SEQ ID NO: 912761 - RNA, 19 nt, Homo sapiens
aagaugaacccaugagaaa

SEQ ID NO: 912762 - RNA, 19 nt, Homo sapiens
uuaagaagggagauguuua

SEQ ID NO: 912763 - RNA, 19 nt, Homo sapiens
gcuaugcugggccuuauaa

SEQ ID NO: 912764 - RNA, 19 nt, Homo sapiens
guggagagcugugcuugga

SEQ ID NO: 912765 - RNA, 19 nt, Homo sapiens
caggaacauucaaacuauu

SEQ ID NO: 912766 - RNA, 19 nt, Homo sapiens
gaagcaacaggaacauuca

SEQ ID NO: 912767 - RNA, 19 nt, Homo sapiens
ccacgcagccaccauguug

SEQ ID NO: 912768 - RNA, 19 nt, Homo sapiens
uguaagcccugaguaguga

SEQ ID NO: 912769 - RNA, 19 nt, Homo sapiens
uaaggugcguuuggcaauu

SEQ ID NO: 912770 - RNA, 19 nt, Homo sapiens
uauauaacccuuccucugu

SEQ ID NO: 912771 - RNA, 19 nt, Homo sapiens
gaaggaagagcaggaaugg

SEQ ID NO: 912772 - RNA, 19 nt, Homo sapiens
auauaacccuuccucugua

SEQ ID NO: 912773 - RNA, 19 nt, Homo sapiens
aagcagcugugauuaguca

SEQ ID NO: 912774 - RNA, 19 nt, Homo sapiens
cacuuuacuucauggauaa

SEQ ID NO: 912775 - RNA, 19 nt, Homo sapiens
gggagauguuuaccuuaau

SEQ ID NO: 912776 - RNA, 19 nt, Homo sapiens
gaucauaaggugcguuugg

SEQ ID NO: 912777 - RNA, 19 nt, Homo sapiens
guacugcucaugacauugu

SEQ ID NO: 912778 - RNA, 19 nt, Homo sapiens
gguguaauuucacucaaag

SEQ ID NO: 912779 - RNA, 19 nt, Homo sapiens
cagcagcuauccugggaau

SEQ ID NO: 912780 - RNA, 19 nt, Homo sapiens
cagaguggcccaugucuuc

SEQ ID NO: 912781 - RNA, 19 nt, Homo sapiens
gcagcagaguggcccaugu

SEQ ID NO: 912782 - RNA, 19 nt, Homo sapiens
gaggggagcuggugacugu

SEQ ID NO: 912783 - RNA, 19 nt, Homo sapiens
caaauaauguuaggggaaa

SEQ ID NO: 912784 - RNA, 19 nt, Homo sapiens
gcacacaaaagacaaauug

SEQ ID NO: 912785 - RNA, 19 nt, Homo sapiens
ucucauuucucgagugaau

SEQ ID NO: 912786 - RNA, 19 nt, Homo sapiens
gacaaccucggaaaccuuu

SEQ ID NO: 912787 - RNA, 19 nt, Homo sapiens
uggauaaauucuugaguca

SEQ ID NO: 912788 - RNA, 19 nt, Homo sapiens
aaagaugaacccaugagaa

SEQ ID NO: 912789 - RNA, 19 nt, Homo sapiens
gcuaccgaaucaagcauau

SEQ ID NO: 912790 - RNA, 19 nt, Homo sapiens
gaauggucguccugcacuu

SEQ ID NO: 912791 - RNA, 19 nt, Homo sapiens
ccaagccucucagaaaaua

SEQ ID NO: 912792 - RNA, 19 nt, Homo sapiens
cuaucaggauguagacaaa

SEQ ID NO: 912793 - RNA, 19 nt, Homo sapiens
agggagacaucuacaccua

SEQ ID NO: 912794 - RNA, 19 nt, Homo sapiens
cagggaacuuuaugaucaa

SEQ ID NO: 912795 - RNA, 19 nt, Homo sapiens
ccgaaucaagcauaucuuu

SEQ ID NO: 912796 - RNA, 19 nt, Homo sapiens
uuaugcagcuaccgaauca

SEQ ID NO: 912797 - RNA, 19 nt, Homo sapiens
ggaacaacaggucuaccaa

SEQ ID NO: 912798 - RNA, 19 nt, Homo sapiens
cuacugaccagggaacuuu

SEQ ID NO: 912799 - RNA, 19 nt, Homo sapiens
ugaguugggugccacuugu

SEQ ID NO: 912800 - RNA, 19 nt, Homo sapiens
uauaacccuuccucuguau

SEQ ID NO: 912801 - RNA, 19 nt, Homo sapiens
caacaggaacauucaaacu

SEQ ID NO: 912802 - RNA, 19 nt, Homo sapiens
uccaggaucaggacaauuu

SEQ ID NO: 912803 - RNA, 19 nt, Homo sapiens
aaccuggacuucucauuuc

SEQ ID NO: 912804 - RNA, 19 nt, Homo sapiens
ucacugaccucauuuguug

SEQ ID NO: 912805 - RNA, 19 nt, Homo sapiens
ggaacuaaacuggaaauua

SEQ ID NO: 912806 - RNA, 19 nt, Homo sapiens
gaucaacuuugguagcuuu

SEQ ID NO: 912807 - RNA, 19 nt, Homo sapiens
ucaaggaaaucaauaccua

SEQ ID NO: 912808 - RNA, 19 nt, Homo sapiens
gaaacaagcaagaacuaaa

SEQ ID NO: 912809 - RNA, 19 nt, Homo sapiens
gccacaggauuucauguua

SEQ ID NO: 912810 - RNA, 19 nt, Homo sapiens
guucagaucuuaugacaca

SEQ ID NO: 912811 - RNA, 19 nt, Homo sapiens
gcagggacauuuccauuag

SEQ ID NO: 912812 - RNA, 19 nt, Homo sapiens
ggaaaucaauaccuaccaa

SEQ ID NO: 912813 - RNA, 19 nt, Homo sapiens
caucauccuuugaguagua

SEQ ID NO: 912814 - RNA, 19 nt, Homo sapiens
gcuagccuauuuaugguua

SEQ ID NO: 912815 - RNA, 19 nt, Homo sapiens
gaaaucccuucuaaacaug

SEQ ID NO: 912816 - RNA, 19 nt, Homo sapiens
uaaccuaaacgcuaugaua

SEQ ID NO: 912817 - RNA, 19 nt, Homo sapiens
gccaaguguuuaagaagua

SEQ ID NO: 912818 - RNA, 19 nt, Homo sapiens
gcagaaaguuguggaucuu

SEQ ID NO: 912819 - RNA, 19 nt, Homo sapiens
gaaaagagauacagcgaau

SEQ ID NO: 912820 - RNA, 19 nt, Homo sapiens
gcacagucccagcuuaauu

SEQ ID NO: 912821 - RNA, 19 nt, Homo sapiens
gcacauaacuuuuaacacu

SEQ ID NO: 912822 - RNA, 19 nt, Homo sapiens
caaggucaguacauaggua

SEQ ID NO: 912823 - RNA, 19 nt, Homo sapiens
ccuaaacgcuaugauauau

SEQ ID NO: 912824 - RNA, 19 nt, Homo sapiens
aaagagauacagcgaauuu

SEQ ID NO: 912825 - RNA, 19 nt, Homo sapiens
gaagcaaguuucgaaguca

SEQ ID NO: 912826 - RNA, 19 nt, Homo sapiens
ucaagggugugcauucauu

SEQ ID NO: 912827 - RNA, 19 nt, Homo sapiens
gacacacacugcuaaaugu

SEQ ID NO: 912828 - RNA, 19 nt, Homo sapiens
guacaucauccuuugagua

SEQ ID NO: 912829 - RNA, 19 nt, Homo sapiens
ccacaggauuucauguuau

SEQ ID NO: 912830 - RNA, 19 nt, Homo sapiens
ggaaacaagcaagaacuaa

SEQ ID NO: 912831 - RNA, 19 nt, Homo sapiens
ugauauaacuccacuguac

SEQ ID NO: 912832 - RNA, 19 nt, Homo sapiens
ggaaaccuguacaucacaa

SEQ ID NO: 912833 - RNA, 19 nt, Homo sapiens
agaguggaguugcaucaua

SEQ ID NO: 912834 - RNA, 19 nt, Homo sapiens
uuagaagggugccauguug

SEQ ID NO: 912835 - RNA, 19 nt, Homo sapiens
uaagccugcugcaaacuuu

SEQ ID NO: 912836 - RNA, 19 nt, Homo sapiens
gcauuucauugagaucuaa

SEQ ID NO: 912837 - RNA, 19 nt, Homo sapiens
ggaucuaaauauucagguu

SEQ ID NO: 912838 - RNA, 19 nt, Homo sapiens
agauagaagugcuaaugaa

SEQ ID NO: 912839 - RNA, 19 nt, Homo sapiens
cacaggauuucauguuauu

SEQ ID NO: 912840 - RNA, 19 nt, Homo sapiens
gaacugacaaggagugaag

SEQ ID NO: 912841 - RNA, 19 nt, Homo sapiens
gaagugcuaaugaauggaa

SEQ ID NO: 912842 - RNA, 19 nt, Homo sapiens
gcuaaggccaaguguuuaa

SEQ ID NO: 912843 - RNA, 19 nt, Homo sapiens
uuagaauggugcucuuaaa

SEQ ID NO: 912844 - RNA, 19 nt, Homo sapiens
ggcagggacauuuccauua

SEQ ID NO: 912845 - RNA, 19 nt, Homo sapiens
cagcgaauuucaugcuuug

SEQ ID NO: 912846 - RNA, 19 nt, Homo sapiens
gauagaagugcuaaugaau

SEQ ID NO: 912847 - RNA, 19 nt, Homo sapiens
uaagauagaagugcuaaug

SEQ ID NO: 912848 - RNA, 19 nt, Homo sapiens
uagaagugcuaaugaaugg

SEQ ID NO: 912849 - RNA, 19 nt, Homo sapiens
gaagucacagucaaggaaa

SEQ ID NO: 912850 - RNA, 19 nt, Homo sapiens
gggaaacaagcaagaacua

SEQ ID NO: 912851 - RNA, 19 nt, Homo sapiens
gcuaaugaauggaagaaaa

SEQ ID NO: 912852 - RNA, 19 nt, Homo sapiens
uaacuccacuguacaucau

SEQ ID NO: 912853 - RNA, 19 nt, Homo sapiens
ccacagacacacacugcua

SEQ ID NO: 912854 - RNA, 19 nt, Homo sapiens
ugaaucauacugagacuga

SEQ ID NO: 912855 - RNA, 19 nt, Homo sapiens
ggccaaguguuuaagaagu

SEQ ID NO: 912856 - RNA, 19 nt, Homo sapiens
uuccaaaugugguuauuga

SEQ ID NO: 912857 - RNA, 19 nt, Homo sapiens
gaguggaguugcaucauac

SEQ ID NO: 912858 - RNA, 19 nt, Homo sapiens
agauggaacuaaacuggaa

SEQ ID NO: 912859 - RNA, 19 nt, Homo sapiens
agacugaucaacuuuggua

SEQ ID NO: 912860 - RNA, 19 nt, Homo sapiens
ccaccuggguuuacucaag

SEQ ID NO: 912861 - RNA, 19 nt, Homo sapiens
cuuccaaggucaguacaua

SEQ ID NO: 912862 - RNA, 19 nt, Homo sapiens
uggcagaugugaacugaca

SEQ ID NO: 912863 - RNA, 19 nt, Homo sapiens
agaaucagcccgcaagaug

SEQ ID NO: 912864 - RNA, 19 nt, Homo sapiens
agacacacacugcuaaaug

SEQ ID NO: 912865 - RNA, 19 nt, Homo sapiens
gaaaucaauaccuaccaau

SEQ ID NO: 912866 - RNA, 19 nt, Homo sapiens
ggcagaaaguuguggaucu

SEQ ID NO: 912867 - RNA, 19 nt, Homo sapiens
ggcauuucauugagaucua

SEQ ID NO: 912868 - RNA, 19 nt, Homo sapiens
caucacaacaaguagcuuu

SEQ ID NO: 912869 - RNA, 19 nt, Homo sapiens
cgaagucacagucaaggaa

SEQ ID NO: 912870 - RNA, 19 nt, Homo sapiens
ugaaguuguugguguuugu

SEQ ID NO: 912871 - RNA, 19 nt, Homo sapiens
acagcgaauuucaugcuuu

SEQ ID NO: 912872 - RNA, 19 nt, Homo sapiens
agaagcaaguuucgaaguc

SEQ ID NO: 912873 - RNA, 19 nt, Homo sapiens
gaagagucaagcaaacugu

SEQ ID NO: 912874 - RNA, 19 nt, Homo sapiens
guuggaaaccuguacauca

SEQ ID NO: 912875 - RNA, 19 nt, Homo sapiens
aggcuaaggccaaguguuu

SEQ ID NO: 912876 - RNA, 19 nt, Homo sapiens
gggcagggacauuuccauu

SEQ ID NO: 912877 - RNA, 19 nt, Homo sapiens
ccucagggauccauauguc

SEQ ID NO: 912878 - RNA, 19 nt, Homo sapiens
ccacuguacaucauccuuu

SEQ ID NO: 912879 - RNA, 19 nt, Homo sapiens
uaccaaaggcagaaaguug

SEQ ID NO: 912880 - RNA, 19 nt, Homo sapiens
uaugugggcauuucauuga

SEQ ID NO: 912881 - RNA, 19 nt, Homo sapiens
auauguaugugcuguaugu

SEQ ID NO: 912882 - RNA, 19 nt, Homo sapiens
uagguaaaaugggcuauua

SEQ ID NO: 912883 - RNA, 19 nt, Homo sapiens
cugacaauauuauggcauu

SEQ ID NO: 912884 - RNA, 19 nt, Homo sapiens
ucgcaccauuugcuaauug

SEQ ID NO: 912885 - RNA, 19 nt, Homo sapiens
gaagaccaagugaaguugu

SEQ ID NO: 912886 - RNA, 19 nt, Homo sapiens
ggagacggccacagacaca

SEQ ID NO: 912887 - RNA, 19 nt, Homo sapiens
gugcacagucccagcuuaa

SEQ ID NO: 912888 - RNA, 19 nt, Homo sapiens
gauauaacuccacuguaca

SEQ ID NO: 912889 - RNA, 19 nt, Homo sapiens
gaagggugccauguuggaa

SEQ ID NO: 912890 - RNA, 19 nt, Homo sapiens
cagaucuuaugacacacua

SEQ ID NO: 912891 - RNA, 19 nt, Homo sapiens
uuuaagaaguagaguguag

SEQ ID NO: 912892 - RNA, 19 nt, Homo sapiens
cuauauguaugugcuguau

SEQ ID NO: 912893 - RNA, 19 nt, Homo sapiens
caagggugugcauucauuu

SEQ ID NO: 912894 - RNA, 19 nt, Homo sapiens
aaaugugguuauugaagga

SEQ ID NO: 912895 - RNA, 19 nt, Homo sapiens
ccaaaugugguuauugaag

SEQ ID NO: 912896 - RNA, 19 nt, Homo sapiens
guaugugggcauuucauug

SEQ ID NO: 912897 - RNA, 19 nt, Homo sapiens
ugggaucgccacaggauuu

SEQ ID NO: 912898 - RNA, 19 nt, Homo sapiens
cagggacauuuccauuaga

SEQ ID NO: 912899 - RNA, 19 nt, Homo sapiens
gaaauccuacauggcuaaa

SEQ ID NO: 912900 - RNA, 19 nt, Homo sapiens
cacuguacaucauccuuug

SEQ ID NO: 912901 - RNA, 19 nt, Homo sapiens
gagauacagcgaauuucau

SEQ ID NO: 912902 - RNA, 19 nt, Homo sapiens
aguuguugguguuuguuua

SEQ ID NO: 912903 - RNA, 19 nt, Homo sapiens
agagauacagcgaauuuca

SEQ ID NO: 912904 - RNA, 19 nt, Homo sapiens
gcacaacacauauacaaua

SEQ ID NO: 912905 - RNA, 19 nt, Homo sapiens
ggacaacacccuccauaua

SEQ ID NO: 912906 - RNA, 19 nt, Homo sapiens
gaacagauccaauagacaa

SEQ ID NO: 912907 - RNA, 19 nt, Homo sapiens
ugauaaaccugcucacuuu

SEQ ID NO: 912908 - RNA, 19 nt, Homo sapiens
ugagaggaaugcugaaaua

SEQ ID NO: 912909 - RNA, 19 nt, Homo sapiens
gguaaucuaugucuuggua

SEQ ID NO: 912910 - RNA, 19 nt, Homo sapiens
gcaaugcuguuggugaaua

SEQ ID NO: 912911 - RNA, 19 nt, Homo sapiens
ucacauaacauaucccuua

SEQ ID NO: 912912 - RNA, 19 nt, Homo sapiens
gaggaaugcugaaauacuu

SEQ ID NO: 912913 - RNA, 19 nt, Homo sapiens
caacauagagacucaguuu

SEQ ID NO: 912914 - RNA, 19 nt, Homo sapiens
gaugaacucuaguggcuuu

SEQ ID NO: 912915 - RNA, 19 nt, Homo sapiens
cauaacauaucccuuagaa

SEQ ID NO: 912916 - RNA, 19 nt, Homo sapiens
caggugggcuucucuauga

SEQ ID NO: 912917 - RNA, 19 nt, Homo sapiens
caagcaaauuucuguauug

SEQ ID NO: 912918 - RNA, 19 nt, Homo sapiens
uaacauaucccuuagaaca

SEQ ID NO: 912919 - RNA, 19 nt, Homo sapiens
gaaacaaaguacccaucaa

SEQ ID NO: 912920 - RNA, 19 nt, Homo sapiens
caucgucguugucguauuu

SEQ ID NO: 912921 - RNA, 19 nt, Homo sapiens
uaucggauguguacaauau

SEQ ID NO: 912922 - RNA, 19 nt, Homo sapiens
gaagguaaucuaugucuug

SEQ ID NO: 912923 - RNA, 19 nt, Homo sapiens
auacaaagcugcucauagu

SEQ ID NO: 912924 - RNA, 19 nt, Homo sapiens
guaaagagguucaaaagga

SEQ ID NO: 912925 - RNA, 19 nt, Homo sapiens
ccaagcaaauuucuguauu

SEQ ID NO: 912926 - RNA, 19 nt, Homo sapiens
ggagaaaugucccuuaacg

SEQ ID NO: 912927 - RNA, 19 nt, Homo sapiens
gaagacaaggguucauuga

SEQ ID NO: 912928 - RNA, 19 nt, Homo sapiens
guaugaagccgauuaccua

SEQ ID NO: 912929 - RNA, 19 nt, Homo sapiens
ugucucagauguucaguuu

SEQ ID NO: 912930 - RNA, 19 nt, Homo sapiens
uaaugugacuuccuaacuu

SEQ ID NO: 912931 - RNA, 19 nt, Homo sapiens
aaaugucccuuaacgauga

SEQ ID NO: 912932 - RNA, 19 nt, Homo sapiens
gcucauagugggagucuuu

SEQ ID NO: 912933 - RNA, 19 nt, Homo sapiens
aauaucagcuugcaacugu

SEQ ID NO: 912934 - RNA, 19 nt, Homo sapiens
guccugcccuucuuucuuu

SEQ ID NO: 912935 - RNA, 19 nt, Homo sapiens
gagagucugugugagauga

SEQ ID NO: 912936 - RNA, 19 nt, Homo sapiens
gagccaguccuuccaguuu

SEQ ID NO: 912937 - RNA, 19 nt, Homo sapiens
ggaagacaaggguucauug

SEQ ID NO: 912938 - RNA, 19 nt, Homo sapiens
caagauaucggauguguac

SEQ ID NO: 912939 - RNA, 19 nt, Homo sapiens
ggaagguaaucuaugucuu

SEQ ID NO: 912940 - RNA, 19 nt, Homo sapiens
caaguccacugggaaggua

SEQ ID NO: 912941 - RNA, 19 nt, Homo sapiens
caaugcuguuggugaauaa

SEQ ID NO: 912942 - RNA, 19 nt, Homo sapiens
uaauuuggcuucacauaac

SEQ ID NO: 912943 - RNA, 19 nt, Homo sapiens
ucaggcagcuacuucauca

SEQ ID NO: 912944 - RNA, 19 nt, Homo sapiens
gcauuccuguccuuuguug

SEQ ID NO: 912945 - RNA, 19 nt, Homo sapiens
uaaaccugcucacuuuguu

SEQ ID NO: 912946 - RNA, 19 nt, Homo sapiens
gcagaugacagagaagaaa

SEQ ID NO: 912947 - RNA, 19 nt, Homo sapiens
gaacucuaguggcuuugau

SEQ ID NO: 912948 - RNA, 19 nt, Homo sapiens
cuauagaugucucagaugu

SEQ ID NO: 912949 - RNA, 19 nt, Homo sapiens
gagcagcgcaauagggauu

SEQ ID NO: 912950 - RNA, 19 nt, Homo sapiens
gcugauaaaccuagggaaa

SEQ ID NO: 912951 - RNA, 19 nt, Homo sapiens
uuucacaucuuucaacuuc

SEQ ID NO: 912952 - RNA, 19 nt, Homo sapiens
gauaucggauguguacaau

SEQ ID NO: 912953 - RNA, 19 nt, Homo sapiens
gcuuugauccugaauguga

SEQ ID NO: 912954 - RNA, 19 nt, Homo sapiens
guacuucaauguggucaau

SEQ ID NO: 912955 - RNA, 19 nt, Homo sapiens
agacaacucuuaauaucag

SEQ ID NO: 912956 - RNA, 19 nt, Homo sapiens
gacaacacccuccauauac

SEQ ID NO: 912957 - RNA, 19 nt, Homo sapiens
ugugugagaugaagacaga

SEQ ID NO: 912958 - RNA, 19 nt, Homo sapiens
caucaucgucguugucgua

SEQ ID NO: 912959 - RNA, 19 nt, Homo sapiens
uagaacagauccaauagac

SEQ ID NO: 912960 - RNA, 19 nt, Homo sapiens
gaaauucuacaaguugaug

SEQ ID NO: 912961 - RNA, 19 nt, Homo sapiens
gggcacugcucuugaugau

SEQ ID NO: 912962 - RNA, 19 nt, Homo sapiens
cagcaaaacugaguauauu

SEQ ID NO: 912963 - RNA, 19 nt, Homo sapiens
ccuuagaacagauccaaua

SEQ ID NO: 912964 - RNA, 19 nt, Homo sapiens
caggacaccuucucuuucu

SEQ ID NO: 912965 - RNA, 19 nt, Homo sapiens
gagacucaguuucuuaagg

SEQ ID NO: 912966 - RNA, 19 nt, Homo sapiens
caaccuccaucuacaaugc

SEQ ID NO: 912967 - RNA, 19 nt, Homo sapiens
gccaagauaucggaugugu

SEQ ID NO: 912968 - RNA, 19 nt, Homo sapiens
ccaucaacuuguaauguga

SEQ ID NO: 912969 - RNA, 19 nt, Homo sapiens
ccagucagcccaagcaaau

SEQ ID NO: 912970 - RNA, 19 nt, Homo sapiens
caacuuguaaugugacuuc

SEQ ID NO: 912971 - RNA, 19 nt, Homo sapiens
gcugagugacuacuggaua

SEQ ID NO: 912972 - RNA, 19 nt, Homo sapiens
ggacaccuucucuuucuuc

SEQ ID NO: 912973 - RNA, 19 nt, Homo sapiens
cauagagacucaguuucuu

SEQ ID NO: 912974 - RNA, 19 nt, Homo sapiens
ucggauguguacaauauga

SEQ ID NO: 912975 - RNA, 19 nt, Homo sapiens
cuuccagucuguauuaguu

SEQ ID NO: 912976 - RNA, 19 nt, Homo sapiens
acacauacaugcacaacac

SEQ ID NO: 912977 - RNA, 19 nt, Homo sapiens
ugaagccgauuaccuacau

SEQ ID NO: 912978 - RNA, 19 nt, Homo sapiens
ucacaucuuucaacuucug

SEQ ID NO: 912979 - RNA, 19 nt, Homo sapiens
ccacugggaagguaaucua

SEQ ID NO: 912980 - RNA, 19 nt, Homo sapiens
cacaacacauauacaauac

SEQ ID NO: 912981 - RNA, 19 nt, Homo sapiens
cauacaugcacaacacaua

SEQ ID NO: 912982 - RNA, 19 nt, Homo sapiens
cuuguaaugugacuuccua

SEQ ID NO: 912983 - RNA, 19 nt, Homo sapiens
acaaguugaugaaacaaag

SEQ ID NO: 912984 - RNA, 19 nt, Homo sapiens
uagcgagggcccaaaguuu

SEQ ID NO: 912985 - RNA, 19 nt, Homo sapiens
gggcgacagucaucacaca

SEQ ID NO: 912986 - RNA, 19 nt, Homo sapiens
agaaaugucccuuaacgau

SEQ ID NO: 912987 - RNA, 19 nt, Homo sapiens
gaagucaaacgugggaaga

SEQ ID NO: 912988 - RNA, 19 nt, Homo sapiens
ucuacaaguugaugaaaca

SEQ ID NO: 912989 - RNA, 19 nt, Homo sapiens
aagaggugcuucgaccaua

SEQ ID NO: 912990 - RNA, 19 nt, Homo sapiens
uagagacucaguuucuuaa

SEQ ID NO: 912991 - RNA, 19 nt, Homo sapiens
cagagaagaaagagaguga

SEQ ID NO: 912992 - RNA, 19 nt, Homo sapiens
uuucuuugcuggugucuug

SEQ ID NO: 912993 - RNA, 19 nt, Homo sapiens
caugagaaggugcagauga

SEQ ID NO: 912994 - RNA, 19 nt, Homo sapiens
caacaucuuggaccucaga

SEQ ID NO: 912995 - RNA, 19 nt, Homo sapiens
gugccugucuccuggaaug

SEQ ID NO: 912996 - RNA, 19 nt, Homo sapiens
acauaucccuuagaacaga

SEQ ID NO: 912997 - RNA, 19 nt, Homo sapiens
uaaagagguucaaaaggaa

SEQ ID NO: 912998 - RNA, 19 nt, Homo sapiens
auagagacucaguuucuua

SEQ ID NO: 912999 - RNA, 19 nt, Homo sapiens
cauugucggugguuucuuc

SEQ ID NO: 913000 - RNA, 19 nt, Homo sapiens
ccuuaacgaugaacucuag

SEQ ID NO: 913001 - RNA, 19 nt, Homo sapiens
gggaaacugccuccugaug

SEQ ID NO: 913002 - RNA, 19 nt, Homo sapiens
gauaaaccugcucacuuug

SEQ ID NO: 913003 - RNA, 19 nt, Homo sapiens
ggucaccagucuacagucu

SEQ ID NO: 913004 - RNA, 19 nt, Homo sapiens
ggaaggaacugcagaagga

SEQ ID NO: 913005 - RNA, 19 nt, Homo sapiens
ucaaggagguggugcuuua

SEQ ID NO: 913006 - RNA, 19 nt, Homo sapiens
gaaauuuguugagugguua

SEQ ID NO: 913007 - RNA, 19 nt, Homo sapiens
ugaagcaccugaagcaaua

SEQ ID NO: 913008 - RNA, 19 nt, Homo sapiens
aaacagagcagacaaaguu

SEQ ID NO: 913009 - RNA, 19 nt, Homo sapiens
gaaggcauuugaagaugaa

SEQ ID NO: 913010 - RNA, 19 nt, Homo sapiens
gacagaguguggaucauuu

SEQ ID NO: 913011 - RNA, 19 nt, Homo sapiens
gaacaagaaggaagaacuu

SEQ ID NO: 913012 - RNA, 19 nt, Homo sapiens
uuaaauggcucaacaagca

SEQ ID NO: 913013 - RNA, 19 nt, Homo sapiens
uuaaggagcuuuccgacuu

SEQ ID NO: 913014 - RNA, 19 nt, Homo sapiens
gcucaggucuucaauaaac

SEQ ID NO: 913015 - RNA, 19 nt, Homo sapiens
ggucuucuguggacaugua

SEQ ID NO: 913016 - RNA, 19 nt, Homo sapiens
gcagacacacucuucgaua

SEQ ID NO: 913017 - RNA, 19 nt, Homo sapiens
ggagaaggcauuugaagau

SEQ ID NO: 913018 - RNA, 19 nt, Homo sapiens
cgaagaagcaauacugaaa

SEQ ID NO: 913019 - RNA, 19 nt, Homo sapiens
aagaagaaaugaagaggaa

SEQ ID NO: 913020 - RNA, 19 nt, Homo sapiens
gcucauguaugugauuuga

SEQ ID NO: 913021 - RNA, 19 nt, Homo sapiens
aagcaauacugaaauggua

SEQ ID NO: 913022 - RNA, 19 nt, Homo sapiens
uccagaagguucaggaaua

SEQ ID NO: 913023 - RNA, 19 nt, Homo sapiens
gaaaugaagaggaaugauc

SEQ ID NO: 913024 - RNA, 19 nt, Homo sapiens
aaacucaucaggagauaua

SEQ ID NO: 913025 - RNA, 19 nt, Homo sapiens
gaggaacgcgcauagauga

SEQ ID NO: 913026 - RNA, 19 nt, Homo sapiens
ggcaucagcuauuauacuu

SEQ ID NO: 913027 - RNA, 19 nt, Homo sapiens
gagaaggcauuugaagaug

SEQ ID NO: 913028 - RNA, 19 nt, Homo sapiens
gaagaaaugaagaggaaug

SEQ ID NO: 913029 - RNA, 19 nt, Homo sapiens
gaaaccauccgaaacuaug

SEQ ID NO: 913030 - RNA, 19 nt, Homo sapiens
gaagaagcaauacugaaau

SEQ ID NO: 913031 - RNA, 19 nt, Homo sapiens
ggagauauaaguauuugga

SEQ ID NO: 913032 - RNA, 19 nt, Homo sapiens
ccaaauuucuggacucuac

SEQ ID NO: 913033 - RNA, 19 nt, Homo sapiens
gacaacauccauuucauga

SEQ ID NO: 913034 - RNA, 19 nt, Homo sapiens
ucuguuaccucgucuuuga

SEQ ID NO: 913035 - RNA, 19 nt, Homo sapiens
aaagaugccaacucuguua

SEQ ID NO: 913036 - RNA, 19 nt, Homo sapiens
gaaaugguauaaggaagca

SEQ ID NO: 913037 - RNA, 19 nt, Homo sapiens
uuauaaagcugauguucug

SEQ ID NO: 913038 - RNA, 19 nt, Homo sapiens
gaccaaccacuguguguuu

SEQ ID NO: 913039 - RNA, 19 nt, Homo sapiens
cagacacacucuucgauau

SEQ ID NO: 913040 - RNA, 19 nt, Homo sapiens
caacaaggagucaaguaga

SEQ ID NO: 913041 - RNA, 19 nt, Homo sapiens
ucaacaagcacaauaccua

SEQ ID NO: 913042 - RNA, 19 nt, Homo sapiens
ccuugaagcuguagccaaa

SEQ ID NO: 913043 - RNA, 19 nt, Homo sapiens
ggagucaaguagaucugaa

SEQ ID NO: 913044 - RNA, 19 nt, Homo sapiens
cucacuauaugcuaacuua

SEQ ID NO: 913045 - RNA, 19 nt, Homo sapiens
gcagagggagaaaugguuu

SEQ ID NO: 913046 - RNA, 19 nt, Homo sapiens
gaaggaagaacuuguugca

SEQ ID NO: 913047 - RNA, 19 nt, Homo sapiens
augcucaggucuucaauaa

SEQ ID NO: 913048 - RNA, 19 nt, Homo sapiens
gaaacuaugcucaggucuu

SEQ ID NO: 913049 - RNA, 19 nt, Homo sapiens
agaaauuuguugagugguu

SEQ ID NO: 913050 - RNA, 19 nt, Homo sapiens
agaaggcauuugaagauga

SEQ ID NO: 913051 - RNA, 19 nt, Homo sapiens
aaacuaugcucaggucuuc

SEQ ID NO: 913052 - RNA, 19 nt, Homo sapiens
ggaggaacgcgcauagaug

SEQ ID NO: 913053 - RNA, 19 nt, Homo sapiens
gaggcugcuugaacucuuu

SEQ ID NO: 913054 - RNA, 19 nt, Homo sapiens
caggagauauaaguauuug

SEQ ID NO: 913055 - RNA, 19 nt, Homo sapiens
guccuucacuccuccauug

SEQ ID NO: 913056 - RNA, 19 nt, Homo sapiens
ugaggcaucagcuauuaua

SEQ ID NO: 913057 - RNA, 19 nt, Homo sapiens
aagaagcaauacugaaaug

SEQ ID NO: 913058 - RNA, 19 nt, Homo sapiens
gguggugcuuuaugucaaa

SEQ ID NO: 913059 - RNA, 19 nt, Homo sapiens
aagcuucuccucuuccuua

SEQ ID NO: 913060 - RNA, 19 nt, Homo sapiens
uaaagccauucaacaagga

SEQ ID NO: 913061 - RNA, 19 nt, Homo sapiens
gagcgaagaagcaauacug

SEQ ID NO: 913062 - RNA, 19 nt, Homo sapiens
gaaugaucuuccagaaaca

SEQ ID NO: 913063 - RNA, 19 nt, Homo sapiens
gcugaaccauuugagaaga

SEQ ID NO: 913064 - RNA, 19 nt, Homo sapiens
gaccagaugaagaaauuug

SEQ ID NO: 913065 - RNA, 19 nt, Homo sapiens
caagaugaccaaccacugu

SEQ ID NO: 913066 - RNA, 19 nt, Homo sapiens
ucauguaugugauuugaca

SEQ ID NO: 913067 - RNA, 19 nt, Homo sapiens
gagcgucuuucucaggaau

SEQ ID NO: 913068 - RNA, 19 nt, Homo sapiens
ggucuucaauaaacucauc

SEQ ID NO: 913069 - RNA, 19 nt, Homo sapiens
gaagcaauacugaaauggu

SEQ ID NO: 913070 - RNA, 19 nt, Homo sapiens
gcuacgacaacauccauuu

SEQ ID NO: 913071 - RNA, 19 nt, Homo sapiens
ucucuucaccgacagcuua

SEQ ID NO: 913072 - RNA, 19 nt, Homo sapiens
uugaccagaugaagaaauu

SEQ ID NO: 913073 - RNA, 19 nt, Homo sapiens
ugaacgcuguugaguggaa

SEQ ID NO: 913074 - RNA, 19 nt, Homo sapiens
uaaggagcuuuccgacuuc

SEQ ID NO: 913075 - RNA, 19 nt, Homo sapiens
ucuacaggcucaagauuag

SEQ ID NO: 913076 - RNA, 19 nt, Homo sapiens
uuguguaucugcucaugua

SEQ ID NO: 913077 - RNA, 19 nt, Homo sapiens
ggagaaaugguuuuguuuu

SEQ ID NO: 913078 - RNA, 19 nt, Homo sapiens
caagcacaauaccuagguu

SEQ ID NO: 913079 - RNA, 19 nt, Homo sapiens
gcgaagaagcaauacugaa

SEQ ID NO: 913080 - RNA, 19 nt, Homo sapiens
cgacaacauccauuucaug

SEQ ID NO: 913081 - RNA, 19 nt, Homo sapiens
caucagaagccagugcuaa

SEQ ID NO: 913082 - RNA, 19 nt, Homo sapiens
cuguggacauguauaauga

SEQ ID NO: 913083 - RNA, 19 nt, Homo sapiens
gaaacagagcagacaaagu

SEQ ID NO: 913084 - RNA, 19 nt, Homo sapiens
uguaucugcucauguaugu

SEQ ID NO: 913085 - RNA, 19 nt, Homo sapiens
gaauacugcuacgacaaca

SEQ ID NO: 913086 - RNA, 19 nt, Homo sapiens
ccagaagguucaggaauac

SEQ ID NO: 913087 - RNA, 19 nt, Homo sapiens
caucaggagauauaaguau

SEQ ID NO: 913088 - RNA, 19 nt, Homo sapiens
ggacucuaccucucacuca

SEQ ID NO: 913089 - RNA, 19 nt, Homo sapiens
aaagccaacuuagacaaga

SEQ ID NO: 913090 - RNA, 19 nt, Homo sapiens
cgacagcuuagucaaagaa

SEQ ID NO: 913091 - RNA, 19 nt, Homo sapiens
agaccaagaugaccaacca

SEQ ID NO: 913092 - RNA, 19 nt, Homo sapiens
uaucugcucauguauguga

SEQ ID NO: 913093 - RNA, 19 nt, Homo sapiens
gaagcuguagccaaauuuc

SEQ ID NO: 913094 - RNA, 19 nt, Homo sapiens
auaccuagguuaccacaca

SEQ ID NO: 913095 - RNA, 19 nt, Homo sapiens
guauaaggaagcacauguu

SEQ ID NO: 913096 - RNA, 19 nt, Homo sapiens
ggaacaagaaggaagaacu

SEQ ID NO: 913097 - RNA, 19 nt, Homo sapiens
uugaagcuguagccaaauu

SEQ ID NO: 913098 - RNA, 19 nt, Homo sapiens
cauagaugauggugacaag

SEQ ID NO: 913099 - RNA, 19 nt, Homo sapiens
ggaacgcgcauagaugaug

SEQ ID NO: 913100 - RNA, 19 nt, Homo sapiens
gcucaagauuagauuaucg

SEQ ID NO: 913101 - RNA, 19 nt, Homo sapiens
aggauaggcuucccuugug

SEQ ID NO: 913102 - RNA, 19 nt, Homo sapiens
uuaaugaggcuggugauga

SEQ ID NO: 913103 - RNA, 19 nt, Homo sapiens
uaaugaggcuggugaugac

SEQ ID NO: 913104 - RNA, 19 nt, Homo sapiens
gaacacaagccuccuguaa

SEQ ID NO: 913105 - RNA, 19 nt, Homo sapiens
gaaauacagugagaaaugu

SEQ ID NO: 913106 - RNA, 19 nt, Homo sapiens
cgaaaucagucauguuuau

SEQ ID NO: 913107 - RNA, 19 nt, Homo sapiens
gcuguggacucuugugaua

SEQ ID NO: 913108 - RNA, 19 nt, Homo sapiens
cauaauuccucccuuguuu

SEQ ID NO: 913109 - RNA, 19 nt, Homo sapiens
guuauuaccugcaggauau

SEQ ID NO: 913110 - RNA, 19 nt, Homo sapiens
ggacucuugugauaauuaa

SEQ ID NO: 913111 - RNA, 19 nt, Homo sapiens
gaaagagauugggaacaaa

SEQ ID NO: 913112 - RNA, 19 nt, Homo sapiens
gaacucugaugaagaagug

SEQ ID NO: 913113 - RNA, 19 nt, Homo sapiens
uggcaagccugcagaauuu

SEQ ID NO: 913114 - RNA, 19 nt, Homo sapiens
ugaaagagauugggaacaa

SEQ ID NO: 913115 - RNA, 19 nt, Homo sapiens
ugacacuacuccagauaua

SEQ ID NO: 913116 - RNA, 19 nt, Homo sapiens
ccaaagaucaacucucuaa

SEQ ID NO: 913117 - RNA, 19 nt, Homo sapiens
acacaagccuccuguaaau

SEQ ID NO: 913118 - RNA, 19 nt, Homo sapiens
cagaaacuguucauacuug

SEQ ID NO: 913119 - RNA, 19 nt, Homo sapiens
acacaaacauuagcaacua

SEQ ID NO: 913120 - RNA, 19 nt, Homo sapiens
ggagaaauacagugagaaa

SEQ ID NO: 913121 - RNA, 19 nt, Homo sapiens
cuucuuaccugcagaguuu

SEQ ID NO: 913122 - RNA, 19 nt, Homo sapiens
uaucaggaaucaugcaauu

SEQ ID NO: 913123 - RNA, 19 nt, Homo sapiens
gaaguuaaaccauagaagu

SEQ ID NO: 913124 - RNA, 19 nt, Homo sapiens
uaucacaacugcuaaguag

SEQ ID NO: 913125 - RNA, 19 nt, Homo sapiens
cacaauggcucaugccuau

SEQ ID NO: 913126 - RNA, 19 nt, Homo sapiens
caagcugccuggagccuuu

SEQ ID NO: 913127 - RNA, 19 nt, Homo sapiens
ccucacaccuaaagaagaa

SEQ ID NO: 913128 - RNA, 19 nt, Homo sapiens
caaucuagcuaaugugcaa

SEQ ID NO: 913129 - RNA, 19 nt, Homo sapiens
ucauagaucugucugaaag

SEQ ID NO: 913130 - RNA, 19 nt, Homo sapiens
cagaagggguuaaaagaua

SEQ ID NO: 913131 - RNA, 19 nt, Homo sapiens
gauguuagcuaugucuugu

SEQ ID NO: 913132 - RNA, 19 nt, Homo sapiens
cacuaucguugcugaaaua

SEQ ID NO: 913133 - RNA, 19 nt, Homo sapiens
gaguuucucuaucgcauug

SEQ ID NO: 913134 - RNA, 19 nt, Homo sapiens
gacagaaagugaacacaag

SEQ ID NO: 913135 - RNA, 19 nt, Homo sapiens
aaguagauguuucugagua

SEQ ID NO: 913136 - RNA, 19 nt, Homo sapiens
gaagagcuugcuggaguua

SEQ ID NO: 913137 - RNA, 19 nt, Homo sapiens
caauggcucaugccuauaa

SEQ ID NO: 913138 - RNA, 19 nt, Homo sapiens
guaguugauugcccugauu

SEQ ID NO: 913139 - RNA, 19 nt, Homo sapiens
aaagagacgcauucaauug

SEQ ID NO: 913140 - RNA, 19 nt, Homo sapiens
gaagguggacacuaccauu

SEQ ID NO: 913141 - RNA, 19 nt, Homo sapiens
cuugaacucugaugaagaa

SEQ ID NO: 913142 - RNA, 19 nt, Homo sapiens
ggaaucaugcaauuauuuc

SEQ ID NO: 913143 - RNA, 19 nt, Homo sapiens
agugagaaaugucaugauu

SEQ ID NO: 913144 - RNA, 19 nt, Homo sapiens
gaggugugccuuacuuauu

SEQ ID NO: 913145 - RNA, 19 nt, Homo sapiens
aaacuagaauugcagaagu

SEQ ID NO: 913146 - RNA, 19 nt, Homo sapiens
uguccaaccucacaccuaa

SEQ ID NO: 913147 - RNA, 19 nt, Homo sapiens
agaaauacagugagaaaug

SEQ ID NO: 913148 - RNA, 19 nt, Homo sapiens
gagggugccuacuggagaa

SEQ ID NO: 913149 - RNA, 19 nt, Homo sapiens
caaauuaguaucacaacug

SEQ ID NO: 913150 - RNA, 19 nt, Homo sapiens
caggaaucaugcaauuauu

SEQ ID NO: 913151 - RNA, 19 nt, Homo sapiens
gacuggagcacacucauuu

SEQ ID NO: 913152 - RNA, 19 nt, Homo sapiens
ccuggagccuuuauucuug

SEQ ID NO: 913153 - RNA, 19 nt, Homo sapiens
ccaggucucuguaguugau

SEQ ID NO: 913154 - RNA, 19 nt, Homo sapiens
aagaucaacucucuaaugg

SEQ ID NO: 913155 - RNA, 19 nt, Homo sapiens
aaagaucaacucucuaaug

SEQ ID NO: 913156 - RNA, 19 nt, Homo sapiens
gaccccaucucuauuauuu

SEQ ID NO: 913157 - RNA, 19 nt, Homo sapiens
gcaaauuaguaucacaacu

SEQ ID NO: 913158 - RNA, 19 nt, Homo sapiens
ggugccuacuggagaaaua

SEQ ID NO: 913159 - RNA, 19 nt, Homo sapiens
caaccucacaccuaaagaa

SEQ ID NO: 913160 - RNA, 19 nt, Homo sapiens
cagcugauacuuauuuaga

SEQ ID NO: 913161 - RNA, 19 nt, Homo sapiens
cggguucaauucugaguuu

SEQ ID NO: 913162 - RNA, 19 nt, Homo sapiens
guagauguuucugaguauu

SEQ ID NO: 913163 - RNA, 19 nt, Homo sapiens
ucaggaaucaugcaauuau

SEQ ID NO: 913164 - RNA, 19 nt, Homo sapiens
gcgaaaucagucauguuua

SEQ ID NO: 913165 - RNA, 19 nt, Homo sapiens
gguggacacuaccauuaug

SEQ ID NO: 913166 - RNA, 19 nt, Homo sapiens
gcccugauuugacuaagga

SEQ ID NO: 913167 - RNA, 19 nt, Homo sapiens
gauaauuaaccaagaguag

SEQ ID NO: 913168 - RNA, 19 nt, Homo sapiens
caaaagagacgcauucaau

SEQ ID NO: 913169 - RNA, 19 nt, Homo sapiens
ccacuaucguugcugaaau

SEQ ID NO: 913170 - RNA, 19 nt, Homo sapiens
ucagucauguuuauaccuu

SEQ ID NO: 913171 - RNA, 19 nt, Homo sapiens
gagaccagcuugggcaaca

SEQ ID NO: 913172 - RNA, 19 nt, Homo sapiens
guucaauucugaguuuaug

SEQ ID NO: 913173 - RNA, 19 nt, Homo sapiens
aagugaagcuguugcugaa

SEQ ID NO: 913174 - RNA, 19 nt, Homo sapiens
ccuauaaucccagcacuuu

SEQ ID NO: 913175 - RNA, 19 nt, Homo sapiens
uuguuucgauugccaguua

SEQ ID NO: 913176 - RNA, 19 nt, Homo sapiens
caacugcuaaguagauguu

SEQ ID NO: 913177 - RNA, 19 nt, Homo sapiens
guccaggucucuguaguug

SEQ ID NO: 913178 - RNA, 19 nt, Homo sapiens
ucacaacugcuaaguagau

SEQ ID NO: 913179 - RNA, 19 nt, Homo sapiens
ggaggugugccuuacuuau

SEQ ID NO: 913180 - RNA, 19 nt, Homo sapiens
aagauaacuuugcugaugu

SEQ ID NO: 913181 - RNA, 19 nt, Homo sapiens
ugaagagcuugcuggaguu

SEQ ID NO: 913182 - RNA, 19 nt, Homo sapiens
ccacaggccaggcacaaug

SEQ ID NO: 913183 - RNA, 19 nt, Homo sapiens
uaacgugggcggagcucua

SEQ ID NO: 913184 - RNA, 19 nt, Homo sapiens
uaauggcaaucuagcuaau

SEQ ID NO: 913185 - RNA, 19 nt, Homo sapiens
uugcuaccgugaccguuua

SEQ ID NO: 913186 - RNA, 19 nt, Homo sapiens
gaccagcuugggcaacaua

SEQ ID NO: 913187 - RNA, 19 nt, Homo sapiens
caauugggcgagauuaaau

SEQ ID NO: 913188 - RNA, 19 nt, Homo sapiens
ucaauugggcgagauuaaa

SEQ ID NO: 913189 - RNA, 19 nt, Homo sapiens
uggagaagguggacacuac

SEQ ID NO: 913190 - RNA, 19 nt, Homo sapiens
guaucacaacugcuaagua

SEQ ID NO: 913191 - RNA, 19 nt, Homo sapiens
uguuagcuaugucuuguga

SEQ ID NO: 913192 - RNA, 19 nt, Homo sapiens
gcuaaguagauguuucuga

SEQ ID NO: 913193 - RNA, 19 nt, Homo sapiens
gauccggacucuggguguu

SEQ ID NO: 913194 - RNA, 19 nt, Homo sapiens
aagguggacacuaccauua

SEQ ID NO: 913195 - RNA, 19 nt, Homo sapiens
uguggacucuugugauaau

SEQ ID NO: 913196 - RNA, 19 nt, Homo sapiens
ggguucaauucugaguuua

SEQ ID NO: 913197 - RNA, 19 nt, Homo sapiens
gcuaugucuugugaguaua

SEQ ID NO: 913198 - RNA, 19 nt, Homo sapiens
ggacacuaccauuaugaca

SEQ ID NO: 913199 - RNA, 19 nt, Homo sapiens
agacagaaagugaacacaa

SEQ ID NO: 913200 - RNA, 19 nt, Homo sapiens
aggugugccuuacuuauug

SEQ ID NO: 913201 - RNA, 19 nt, Homo sapiens
uaauggugcuaauggcaau

SEQ ID NO: 913202 - RNA, 19 nt, Homo sapiens
agccaaagaucaacucucu

SEQ ID NO: 913203 - RNA, 19 nt, Homo sapiens
ggugcgcuguggacucuug

SEQ ID NO: 913204 - RNA, 19 nt, Homo sapiens
gcaaugaagucaccuaagu

SEQ ID NO: 913205 - RNA, 19 nt, Homo sapiens
gagcuggacugacaucaaa

SEQ ID NO: 913206 - RNA, 19 nt, Homo sapiens
ugaaauugcuuccuuauca

SEQ ID NO: 913207 - RNA, 19 nt, Homo sapiens
gaaggaaguuguugagaag

SEQ ID NO: 913208 - RNA, 19 nt, Homo sapiens
ucagugaaguuccuuauga

SEQ ID NO: 913209 - RNA, 19 nt, Homo sapiens
uauaaggacugcaaaguau

SEQ ID NO: 913210 - RNA, 19 nt, Homo sapiens
ccaguuggcucgcaucuga

SEQ ID NO: 913211 - RNA, 19 nt, Homo sapiens
guaaaaggcucuaauacaa

SEQ ID NO: 913212 - RNA, 19 nt, Homo sapiens
ugaaggaaguuguugagaa

SEQ ID NO: 913213 - RNA, 19 nt, Homo sapiens
gcucuaauacaaccuauaa

SEQ ID NO: 913214 - RNA, 19 nt, Homo sapiens
gaaauuguaggaaaccaaa

SEQ ID NO: 913215 - RNA, 19 nt, Homo sapiens
gaaauugcuuccuuaucau

SEQ ID NO: 913216 - RNA, 19 nt, Homo sapiens
caucaaacaugcuguaacu

SEQ ID NO: 913217 - RNA, 19 nt, Homo sapiens
ucaaacaugcuguaacuug

SEQ ID NO: 913218 - RNA, 19 nt, Homo sapiens
caaugaagucaccuaagua

SEQ ID NO: 913219 - RNA, 19 nt, Homo sapiens
cuauaaggacugcaaagua

SEQ ID NO: 913220 - RNA, 19 nt, Homo sapiens
ggaaguccaagaccaguug

SEQ ID NO: 913221 - RNA, 19 nt, Homo sapiens
guacagacucuugugauug

SEQ ID NO: 913222 - RNA, 19 nt, Homo sapiens
ggagagaaacaggaacuga

SEQ ID NO: 913223 - RNA, 19 nt, Homo sapiens
uguacagacucuugugauu

SEQ ID NO: 913224 - RNA, 19 nt, Homo sapiens
aaacaggaacugagcauuc

SEQ ID NO: 913225 - RNA, 19 nt, Homo sapiens
cuuaagaucacccuuuauu

SEQ ID NO: 913226 - RNA, 19 nt, Homo sapiens
aacaggagcuggacugaca

SEQ ID NO: 913227 - RNA, 19 nt, Homo sapiens
gcuguaacuugcaaugaag

SEQ ID NO: 913228 - RNA, 19 nt, Homo sapiens
ugacaucaaacaugcugua

SEQ ID NO: 913229 - RNA, 19 nt, Homo sapiens
cauggcacauccuuugaga

SEQ ID NO: 913230 - RNA, 19 nt, Homo sapiens
ugagaaggguguacagacu

SEQ ID NO: 913231 - RNA, 19 nt, Homo sapiens
gaaacaggaacugagcauu

SEQ ID NO: 913232 - RNA, 19 nt, Homo sapiens
uucuuaagaucacccuuua

SEQ ID NO: 913233 - RNA, 19 nt, Homo sapiens
ggacuugggauuggagaga

SEQ ID NO: 913234 - RNA, 19 nt, Homo sapiens
cuaauacaaccuauaagga

SEQ ID NO: 913235 - RNA, 19 nt, Homo sapiens
gccaucagguguucauguc

SEQ ID NO: 913236 - RNA, 19 nt, Homo sapiens
cugcagaugugaaggaagu

SEQ ID NO: 913237 - RNA, 19 nt, Homo sapiens
ggagcuggacugacaucaa

SEQ ID NO: 913238 - RNA, 19 nt, Homo sapiens
uacagacucuugugauugg

SEQ ID NO: 913239 - RNA, 19 nt, Homo sapiens
caaccuauaaggacugcaa

SEQ ID NO: 913240 - RNA, 19 nt, Homo sapiens
uggcacauccuuugagaga

SEQ ID NO: 913241 - RNA, 19 nt, Homo sapiens
cccugaaauugcuuccuua

SEQ ID NO: 913242 - RNA, 19 nt, Homo sapiens
gugauuggccgagggauga

SEQ ID NO: 913243 - RNA, 19 nt, Homo sapiens
ugcuguaacuugcaaugaa

SEQ ID NO: 913244 - RNA, 19 nt, Homo sapiens
gguacaauuccaccugcua

SEQ ID NO: 913245 - RNA, 19 nt, Homo sapiens
gauuggagagaaacaggaa

SEQ ID NO: 913246 - RNA, 19 nt, Homo sapiens
gacuugggauuggagagaa

SEQ ID NO: 913247 - RNA, 19 nt, Homo sapiens
gaaaguaaaaggcucuaau

SEQ ID NO: 913248 - RNA, 19 nt, Homo sapiens
gacaucaaacaugcuguaa

SEQ ID NO: 913249 - RNA, 19 nt, Homo sapiens
cuucauggcacauccuuug

SEQ ID NO: 913250 - RNA, 19 nt, Homo sapiens
cagcugccaucagguguuc

SEQ ID NO: 913251 - RNA, 19 nt, Homo sapiens
gcagaugugaaggaaguug

SEQ ID NO: 913252 - RNA, 19 nt, Homo sapiens
gguguacagacucuuguga

SEQ ID NO: 913253 - RNA, 19 nt, Homo sapiens
gcagcugccaucagguguu

SEQ ID NO: 913254 - RNA, 19 nt, Homo sapiens
ggaugagugaggccuugaa

SEQ ID NO: 913255 - RNA, 19 nt, Homo sapiens
gaugugaaggaaguuguug

SEQ ID NO: 913256 - RNA, 19 nt, Homo sapiens
agaaggguguacagacucu

SEQ ID NO: 913257 - RNA, 19 nt, Homo sapiens
ugaaauuguaggaaaccaa

SEQ ID NO: 913258 - RNA, 19 nt, Homo sapiens
gccaucauucuuaagauca

SEQ ID NO: 913259 - RNA, 19 nt, Homo sapiens
aacaggaacugagcauucu

SEQ ID NO: 913260 - RNA, 19 nt, Homo sapiens
uaaggacugcaaaguaugg

SEQ ID NO: 913261 - RNA, 19 nt, Homo sapiens
ucuaauacaaccuauaagg

SEQ ID NO: 913262 - RNA, 19 nt, Homo sapiens
gaagcuagcugaacagaug

SEQ ID NO: 913263 - RNA, 19 nt, Homo sapiens
gaacagaacacacaaguau

SEQ ID NO: 913264 - RNA, 19 nt, Homo sapiens
gagcuaaauugcuuucaua

SEQ ID NO: 913265 - RNA, 19 nt, Homo sapiens
gagaugagcuaaauugcuu

SEQ ID NO: 913266 - RNA, 19 nt, Homo sapiens
gugguuaccuguucaagaa

SEQ ID NO: 913267 - RNA, 19 nt, Homo sapiens
ccacgcagauggauuacaa

SEQ ID NO: 913268 - RNA, 19 nt, Homo sapiens
gaccuucucuucauaaucu

SEQ ID NO: 913269 - RNA, 19 nt, Homo sapiens
gaaguuucuuucaggugua

SEQ ID NO: 913270 - RNA, 19 nt, Homo sapiens
cggguggacugucuauaua

SEQ ID NO: 913271 - RNA, 19 nt, Homo sapiens
ccaguuggguuuugauuua

SEQ ID NO: 913272 - RNA, 19 nt, Homo sapiens
gaacacacaaguaugaagu

SEQ ID NO: 913273 - RNA, 19 nt, Homo sapiens
uggacugucuauauaguua

SEQ ID NO: 913274 - RNA, 19 nt, Homo sapiens
ccaauuaaaccucauagug

SEQ ID NO: 913275 - RNA, 19 nt, Homo sapiens
ggaacagaacacacaagua

SEQ ID NO: 913276 - RNA, 19 nt, Homo sapiens
gccagaagcuagcugaaca

SEQ ID NO: 913277 - RNA, 19 nt, Homo sapiens
acacacaaguaugaaguuu

SEQ ID NO: 913278 - RNA, 19 nt, Homo sapiens
acacaaguaugaaguuucu

SEQ ID NO: 913279 - RNA, 19 nt, Homo sapiens
acagcuguguauagauuua

SEQ ID NO: 913280 - RNA, 19 nt, Homo sapiens
acagaacacacaaguauga

SEQ ID NO: 913281 - RNA, 19 nt, Homo sapiens
aaauuaagaggcaugcuaa

SEQ ID NO: 913282 - RNA, 19 nt, Homo sapiens
guuuagaccuucucuucau

SEQ ID NO: 913283 - RNA, 19 nt, Homo sapiens
aagcacagacgacaagaaa

SEQ ID NO: 913284 - RNA, 19 nt, Homo sapiens
ggcauccucucaagugguu

SEQ ID NO: 913285 - RNA, 19 nt, Homo sapiens
ugcaauaguuggauuuauc

SEQ ID NO: 913286 - RNA, 19 nt, Homo sapiens
guguauagauuuaguucuc

SEQ ID NO: 913287 - RNA, 19 nt, Homo sapiens
gcaauaguuggauuuaucu

SEQ ID NO: 913288 - RNA, 19 nt, Homo sapiens
uuuagaccuucucuucaua

SEQ ID NO: 913289 - RNA, 19 nt, Homo sapiens
gguggacugucuauauagu

SEQ ID NO: 913290 - RNA, 19 nt, Homo sapiens
ucugugagaugagcuaaau

SEQ ID NO: 913291 - RNA, 19 nt, Homo sapiens
ucaagugguuaccuguuca

SEQ ID NO: 913292 - RNA, 19 nt, Homo sapiens
gggaacagaacacacaagu

SEQ ID NO: 913293 - RNA, 19 nt, Homo sapiens
ugagcuaaauugcuuucau

SEQ ID NO: 913294 - RNA, 19 nt, Homo sapiens
ugugagaugagcuaaauug

SEQ ID NO: 913295 - RNA, 19 nt, Homo sapiens
acagauguuucagggaauu

SEQ ID NO: 913296 - RNA, 19 nt, Homo sapiens
gcacagacgacaagaaacc

SEQ ID NO: 913297 - RNA, 19 nt, Homo sapiens
gagcuaaaaccaccuaaug

SEQ ID NO: 913298 - RNA, 19 nt, Homo sapiens
gaaaccaggggaaagaaaa

SEQ ID NO: 913299 - RNA, 19 nt, Homo sapiens
gacugucuauauaguuaug

SEQ ID NO: 913300 - RNA, 19 nt, Homo sapiens
gguuaccuguucaagaauc

SEQ ID NO: 913301 - RNA, 19 nt, Homo sapiens
gauguuucagggaauuauu

SEQ ID NO: 913302 - RNA, 19 nt, Homo sapiens
caaguaugaaguuucuuuc

SEQ ID NO: 913303 - RNA, 19 nt, Homo sapiens
uaguuuagaccuucucuuc

SEQ ID NO: 913304 - RNA, 19 nt, Homo sapiens
cuucauuucuagcccaguu

SEQ ID NO: 913305 - RNA, 19 nt, Homo sapiens
ggacugucuauauaguuau

SEQ ID NO: 913306 - RNA, 19 nt, Homo sapiens
uuacaagggccagaagcua

SEQ ID NO: 913307 - RNA, 19 nt, Homo sapiens
ucauaaucuugcucugaga

SEQ ID NO: 913308 - RNA, 19 nt, Homo sapiens
caagcacagacgacaagaa

SEQ ID NO: 913309 - RNA, 19 nt, Homo sapiens
ugcccacgcagauggauua

SEQ ID NO: 913310 - RNA, 19 nt, Homo sapiens
uuagaccuucucuucauaa

SEQ ID NO: 913311 - RNA, 19 nt, Homo sapiens
ucggguggacugucuauau

SEQ ID NO: 913312 - RNA, 19 nt, Homo sapiens
uagaccuucucuucauaau

SEQ ID NO: 913313 - RNA, 19 nt, Homo sapiens
gaugagcuaaauugcuuuc

SEQ ID NO: 913314 - RNA, 19 nt, Homo sapiens
cucaagugguuaccuguuc

SEQ ID NO: 913315 - RNA, 19 nt, Homo sapiens
guuaccuguucaagaauca

SEQ ID NO: 913316 - RNA, 19 nt, Homo sapiens
uaaguaguuuagaccuucu

SEQ ID NO: 913317 - RNA, 19 nt, Homo sapiens
cugcaauaguuggauuuau

SEQ ID NO: 913318 - RNA, 19 nt, Homo sapiens
caagaaaccaggggaaaga

SEQ ID NO: 913319 - RNA, 19 nt, Homo sapiens
gaucacaaguugcauguug

SEQ ID NO: 913320 - RNA, 19 nt, Homo sapiens
caauaaagcucuacugucu

SEQ ID NO: 913321 - RNA, 19 nt, Homo sapiens
gaauaaaguuguugggaau

SEQ ID NO: 913322 - RNA, 19 nt, Homo sapiens
ggaaaugaauguugcugau

SEQ ID NO: 913323 - RNA, 19 nt, Homo sapiens
gaucauggucuccucauuu

SEQ ID NO: 913324 - RNA, 19 nt, Homo sapiens
gaaaugaauguugcugaua

SEQ ID NO: 913325 - RNA, 19 nt, Homo sapiens
gaugagcccuggaaauauc

SEQ ID NO: 913326 - RNA, 19 nt, Homo sapiens
ggugaaaccucgucuuuac

SEQ ID NO: 913327 - RNA, 19 nt, Homo sapiens
gaugggauaucacccugaa

SEQ ID NO: 913328 - RNA, 19 nt, Homo sapiens
gugcacaccuguagucuca

SEQ ID NO: 913329 - RNA, 19 nt, Homo sapiens
gggcugggcuaaacauugu

SEQ ID NO: 913330 - RNA, 19 nt, Homo sapiens
gauaucacccugaagaguu

SEQ ID NO: 913331 - RNA, 19 nt, Homo sapiens
ugacaaauccaggaaauga

SEQ ID NO: 913332 - RNA, 19 nt, Homo sapiens
caacucagcuuuuacacaa

SEQ ID NO: 913333 - RNA, 19 nt, Homo sapiens
gauaauguguauguagguu

SEQ ID NO: 913334 - RNA, 19 nt, Homo sapiens
gcaccaaagcucccucuga

SEQ ID NO: 913335 - RNA, 19 nt, Homo sapiens
guauguagguuuaugugau

SEQ ID NO: 913336 - RNA, 19 nt, Homo sapiens
ccacacggguaucaucuuc

SEQ ID NO: 913337 - RNA, 19 nt, Homo sapiens
aaaugaauguugcugauag

SEQ ID NO: 913338 - RNA, 19 nt, Homo sapiens
aaggugggcugaucacuug

SEQ ID NO: 913339 - RNA, 19 nt, Homo sapiens
acacggguaucaucuucua

SEQ ID NO: 913340 - RNA, 19 nt, Homo sapiens
ugauagggauaaaucuuga

SEQ ID NO: 913341 - RNA, 19 nt, Homo sapiens
ggagauaauguguauguag

SEQ ID NO: 913342 - RNA, 19 nt, Homo sapiens
aagaauaccaggagcgaua

SEQ ID NO: 913343 - RNA, 19 nt, Homo sapiens
acuaggagauaauguguau

SEQ ID NO: 913344 - RNA, 19 nt, Homo sapiens
ggaucauggucuccucauu

SEQ ID NO: 913345 - RNA, 19 nt, Homo sapiens
ggacucggaagacauguau

SEQ ID NO: 913346 - RNA, 19 nt, Homo sapiens
aggaugagcccuggaaaua

SEQ ID NO: 913347 - RNA, 19 nt, Homo sapiens
guucccauuucuccuuaua

SEQ ID NO: 913348 - RNA, 19 nt, Homo sapiens
gaaaccucgucuuuaccaa

SEQ ID NO: 913349 - RNA, 19 nt, Homo sapiens
aucauggucuccucauuua

SEQ ID NO: 913350 - RNA, 19 nt, Homo sapiens
ggacuaggagauaaugugu

SEQ ID NO: 913351 - RNA, 19 nt, Homo sapiens
uagagggacuaggagauaa

SEQ ID NO: 913352 - RNA, 19 nt, Homo sapiens
gcagacaggcccucagagu

SEQ ID NO: 913353 - RNA, 19 nt, Homo sapiens
gcuaagguaggaucacuug

SEQ ID NO: 913354 - RNA, 19 nt, Homo sapiens
uauguagguuuaugugaug

SEQ ID NO: 913355 - RNA, 19 nt, Homo sapiens
gcuguagacugggaagaga

SEQ ID NO: 913356 - RNA, 19 nt, Homo sapiens
ccagggucaucuccaagaa

SEQ ID NO: 913357 - RNA, 19 nt, Homo sapiens
ggaugagcccuggaaauau

SEQ ID NO: 913358 - RNA, 19 nt, Homo sapiens
gcacaccuguagucucaac

SEQ ID NO: 913359 - RNA, 19 nt, Homo sapiens
caguucccauuucuccuua

SEQ ID NO: 913360 - RNA, 19 nt, Homo sapiens
gugcugaggcggcuuccua

SEQ ID NO: 913361 - RNA, 19 nt, Homo sapiens
ccacagcggacucggaaga

SEQ ID NO: 913362 - RNA, 19 nt, Homo sapiens
gacaaauccaggaaaugaa

SEQ ID NO: 913363 - RNA, 19 nt, Homo sapiens
caaggugggcugaucacuu

SEQ ID NO: 913364 - RNA, 19 nt, Homo sapiens
gaccuugacuucaguaccu

SEQ ID NO: 913365 - RNA, 19 nt, Homo sapiens
auaaagcucuacugucucu

SEQ ID NO: 913366 - RNA, 19 nt, Homo sapiens
agguuuaugugaugggaua

SEQ ID NO: 913367 - RNA, 19 nt, Homo sapiens
ccgagguucucacagaguu

SEQ ID NO: 913368 - RNA, 19 nt, Homo sapiens
cuggaaauaucuggaauca

SEQ ID NO: 913369 - RNA, 19 nt, Homo sapiens
cuuccgagguucucacaga

SEQ ID NO: 913370 - RNA, 19 nt, Homo sapiens
gcugauagggauaaaucuu

SEQ ID NO: 913371 - RNA, 19 nt, Homo sapiens
uaggagauaauguguaugu

SEQ ID NO: 913372 - RNA, 19 nt, Homo sapiens
gaaacagccaccggagaga

SEQ ID NO: 913373 - RNA, 19 nt, Homo sapiens
gacccaggccauccagaaa

SEQ ID NO: 913374 - RNA, 19 nt, Homo sapiens
gagaucacaaguugcaugu

SEQ ID NO: 913375 - RNA, 19 nt, Homo sapiens
gaggcggcuuccuaugcua

SEQ ID NO: 913376 - RNA, 19 nt, Homo sapiens
uagaugggcugggcuaaac

SEQ ID NO: 913377 - RNA, 19 nt, Homo sapiens
ccuguaaucccagcacuuu

SEQ ID NO: 913378 - RNA, 19 nt, Homo sapiens
guggcucacuccuguaauc

SEQ ID NO: 913379 - RNA, 19 nt, Homo sapiens
uuaccagggucaucuccaa

SEQ ID NO: 913380 - RNA, 19 nt, Homo sapiens
cacaauaaagcucuacugu

SEQ ID NO: 913381 - RNA, 19 nt, Homo sapiens
acaaauccaggaaaugaau

SEQ ID NO: 913382 - RNA, 19 nt, Homo sapiens
ggauaucacccugaagagu

SEQ ID NO: 913383 - RNA, 19 nt, Homo sapiens
aaaccucgucuuuaccaaa

SEQ ID NO: 913384 - RNA, 19 nt, Homo sapiens
agggucaucuccaagaaga

SEQ ID NO: 913385 - RNA, 19 nt, Homo sapiens
uuaggaacgugaagcucuu

SEQ ID NO: 913386 - RNA, 19 nt, Homo sapiens
cuaucucucuuccgagguu

SEQ ID NO: 913387 - RNA, 19 nt, Homo sapiens
caaccccuauauauuguaa

SEQ ID NO: 913388 - RNA, 19 nt, Homo sapiens
agugacaaauccaggaaau

SEQ ID NO: 913389 - RNA, 19 nt, Homo sapiens
gggacuaggagauaaugug

SEQ ID NO: 913390 - RNA, 19 nt, Homo sapiens
auaucacccugaagaguug

SEQ ID NO: 913391 - RNA, 19 nt, Homo sapiens
ugggauaucacccugaaga

SEQ ID NO: 913392 - RNA, 19 nt, Homo sapiens
cugucgagaucacaaguug

SEQ ID NO: 913393 - RNA, 19 nt, Homo sapiens
gauucuuuguccucaguuc

SEQ ID NO: 913394 - RNA, 19 nt, Homo sapiens
ugacccaggccauccagaa

SEQ ID NO: 913395 - RNA, 19 nt, Homo sapiens
ucauacuucuaccaacuca

SEQ ID NO: 913396 - RNA, 19 nt, Homo sapiens
caaauccaggaaaugaaug

SEQ ID NO: 913397 - RNA, 19 nt, Homo sapiens
gacuaggagauaaugugua

SEQ ID NO: 913398 - RNA, 19 nt, Homo sapiens
cugagucaaugcccaagau

SEQ ID NO: 913399 - RNA, 19 nt, Homo sapiens
ucccauuucuccuuauaag

SEQ ID NO: 913400 - RNA, 19 nt, Homo sapiens
gaaagccagggaucauggu

SEQ ID NO: 913401 - RNA, 19 nt, Homo sapiens
ccagaaagccagggaucau

SEQ ID NO: 913402 - RNA, 19 nt, Homo sapiens
ucuacugucucuggguaaa

SEQ ID NO: 913403 - RNA, 19 nt, Homo sapiens
cugauagggauaaaucuug

SEQ ID NO: 913404 - RNA, 19 nt, Homo sapiens
ccagugacaaauccaggaa

SEQ ID NO: 913405 - RNA, 19 nt, Homo sapiens
uggugaaaccucgucuuua

SEQ ID NO: 913406 - RNA, 19 nt, Homo sapiens
ucacuugaucccaggaguu

SEQ ID NO: 913407 - RNA, 19 nt, Homo sapiens
ggaacgugaagcucuugga

SEQ ID NO: 913408 - RNA, 19 nt, Homo sapiens
gaauaccaggagcgauaug

SEQ ID NO: 913409 - RNA, 19 nt, Homo sapiens
acucagcuuuuacacaaua

SEQ ID NO: 913410 - RNA, 19 nt, Homo sapiens
uaaggaugagcccuggaaa

SEQ ID NO: 913411 - RNA, 19 nt, Homo sapiens
uguccucaguucccauuuc

SEQ ID NO: 913412 - RNA, 19 nt, Homo sapiens
ucaguucccauuucuccuu

SEQ ID NO: 913413 - RNA, 19 nt, Homo sapiens
ccacgggaccuugacuuca

SEQ ID NO: 913414 - RNA, 19 nt, Homo sapiens
cagaaagccagggaucaug

SEQ ID NO: 913415 - RNA, 19 nt, Homo sapiens
ggaagaagaucgaacauga

SEQ ID NO: 913416 - RNA, 19 nt, Homo sapiens
gcacugggcuucaccuaga

SEQ ID NO: 913417 - RNA, 19 nt, Homo sapiens
gcacaaacccgcaaagagu

SEQ ID NO: 913418 - RNA, 19 nt, Homo sapiens
gaacaugacguggugauga

SEQ ID NO: 913419 - RNA, 19 nt, Homo sapiens
caauaaaccuggcuuuguc

SEQ ID NO: 913420 - RNA, 19 nt, Homo sapiens
aaaccuggcuuugucagua

SEQ ID NO: 913421 - RNA, 19 nt, Homo sapiens
gaacaauaaaccuggcuuu

SEQ ID NO: 913422 - RNA, 19 nt, Homo sapiens
gaagauacagucacuaacu

SEQ ID NO: 913423 - RNA, 19 nt, Homo sapiens
gcaaugaccaggaagauac

SEQ ID NO: 913424 - RNA, 19 nt, Homo sapiens
gaaccuagaagucggaauc

SEQ ID NO: 913425 - RNA, 19 nt, Homo sapiens
uaugggaccuugcaaguca

SEQ ID NO: 913426 - RNA, 19 nt, Homo sapiens
guuuaacccagaacaauaa

SEQ ID NO: 913427 - RNA, 19 nt, Homo sapiens
aagauacagucacuaacuu

SEQ ID NO: 913428 - RNA, 19 nt, Homo sapiens
caagaagaaccuagaaguc

SEQ ID NO: 913429 - RNA, 19 nt, Homo sapiens
cacaaacccgcaaagagua

SEQ ID NO: 913430 - RNA, 19 nt, Homo sapiens
ccaggaagauacagucacu

SEQ ID NO: 913431 - RNA, 19 nt, Homo sapiens
agaaaaggcggucguguua

SEQ ID NO: 913432 - RNA, 19 nt, Homo sapiens
aacaugacguggugaugaa

SEQ ID NO: 913433 - RNA, 19 nt, Homo sapiens
ucaagaagaaccuagaagu

SEQ ID NO: 913434 - RNA, 19 nt, Homo sapiens
agcaaaagcucaagaagaa

SEQ ID NO: 913435 - RNA, 19 nt, Homo sapiens
aggaagauacagucacuaa

SEQ ID NO: 913436 - RNA, 19 nt, Homo sapiens
ggccaagggugcugagaac

SEQ ID NO: 913437 - RNA, 19 nt, Homo sapiens
gcucaagaagaaccuagaa

SEQ ID NO: 913438 - RNA, 19 nt, Homo sapiens
gauacagucacuaacuuca

SEQ ID NO: 913439 - RNA, 19 nt, Homo sapiens
aaccuggcuuugucaguaa

SEQ ID NO: 913440 - RNA, 19 nt, Homo sapiens
uguuaucgcucccaagaag

SEQ ID NO: 913441 - RNA, 19 nt, Homo sapiens
gaagaagaucgaacaugac

SEQ ID NO: 913442 - RNA, 19 nt, Homo sapiens
gcgcacaaacccgcaaaga

SEQ ID NO: 913443 - RNA, 19 nt, Homo sapiens
acaaacccgcaaagaguaa

SEQ ID NO: 913444 - RNA, 19 nt, Homo sapiens
uacagucacuaacuucauc

SEQ ID NO: 913445 - RNA, 19 nt, Homo sapiens
gggcuucaccuagaacuuc

SEQ ID NO: 913446 - RNA, 19 nt, Homo sapiens
gggccaagggugcugagaa

SEQ ID NO: 913447 - RNA, 19 nt, Homo sapiens
cauaugggaccuugcaagu

SEQ ID NO: 913448 - RNA, 19 nt, Homo sapiens
gcagcggcagccucugaaa

SEQ ID NO: 913449 - RNA, 19 nt, Homo sapiens
gaagcuggcacugcugaag

SEQ ID NO: 913450 - RNA, 19 nt, Homo sapiens
cguguuaucgcucccaaga

SEQ ID NO: 913451 - RNA, 19 nt, Homo sapiens
aaaaggcggucguguuauc

SEQ ID NO: 913452 - RNA, 19 nt, Homo sapiens
ggaagauacagucacuaac

SEQ ID NO: 913453 - RNA, 19 nt, Homo sapiens
gaccaggaagauacaguca

SEQ ID NO: 913454 - RNA, 19 nt, Homo sapiens
acccagcaaugaccaggaa

SEQ ID NO: 913455 - RNA, 19 nt, Homo sapiens
gaacugagccggagagaga

SEQ ID NO: 913456 - RNA, 19 nt, Homo sapiens
gaagauaaauuaggcauuc

SEQ ID NO: 913457 - RNA, 19 nt, Homo sapiens
gcagaaagccaaauacuug

SEQ ID NO: 913458 - RNA, 19 nt, Homo sapiens
ggacaaguaugcuccagaa

SEQ ID NO: 913459 - RNA, 19 nt, Homo sapiens
gaaacccgaagauaaauua

SEQ ID NO: 913460 - RNA, 19 nt, Homo sapiens
ggagaaauuugcacugaug

SEQ ID NO: 913461 - RNA, 19 nt, Homo sapiens
ggacagugccaacaaguuu

SEQ ID NO: 913462 - RNA, 19 nt, Homo sapiens
uaucacagguuaagccuuu

SEQ ID NO: 913463 - RNA, 19 nt, Homo sapiens
gaagcgagccuauaucugu

SEQ ID NO: 913464 - RNA, 19 nt, Homo sapiens
ucagaaggcuuacgucaug

SEQ ID NO: 913465 - RNA, 19 nt, Homo sapiens
ucucucagcuggacaagua

SEQ ID NO: 913466 - RNA, 19 nt, Homo sapiens
gcaagucccagaagaauau

SEQ ID NO: 913467 - RNA, 19 nt, Homo sapiens
gagcagagccacacuaagu

SEQ ID NO: 913468 - RNA, 19 nt, Homo sapiens
ggagagagagaauggaauu

SEQ ID NO: 913469 - RNA, 19 nt, Homo sapiens
agacugaggucguugauuc

SEQ ID NO: 913470 - RNA, 19 nt, Homo sapiens
ugaaaugacugcugaguac

SEQ ID NO: 913471 - RNA, 19 nt, Homo sapiens
ccaacaaguuugaggagaa

SEQ ID NO: 913472 - RNA, 19 nt, Homo sapiens
aaucacagcauucauagua

SEQ ID NO: 913473 - RNA, 19 nt, Homo sapiens
ugaaaucaaucaguucuug

SEQ ID NO: 913474 - RNA, 19 nt, Homo sapiens
ggaaccauuuaacaaagaa

SEQ ID NO: 913475 - RNA, 19 nt, Homo sapiens
aaaccuagaugagcagauu

SEQ ID NO: 913476 - RNA, 19 nt, Homo sapiens
acaagaggcucagugaauu

SEQ ID NO: 913477 - RNA, 19 nt, Homo sapiens
ccaaauacuugccuaaacu

SEQ ID NO: 913478 - RNA, 19 nt, Homo sapiens
uagaugagcagauuaagaa

SEQ ID NO: 913479 - RNA, 19 nt, Homo sapiens
gaagcuuacuugcagaauc

SEQ ID NO: 913480 - RNA, 19 nt, Homo sapiens
ggucauucauuuaaacuag

SEQ ID NO: 913481 - RNA, 19 nt, Homo sapiens
ggaggacuggccaauauuu

SEQ ID NO: 913482 - RNA, 19 nt, Homo sapiens
ccaggaaccauuuaacaaa

SEQ ID NO: 913483 - RNA, 19 nt, Homo sapiens
gguuuaagguggccaugaa

SEQ ID NO: 913484 - RNA, 19 nt, Homo sapiens
caggagaaauuugcacuga

SEQ ID NO: 913485 - RNA, 19 nt, Homo sapiens
gaugaaacuuuggagaaau

SEQ ID NO: 913486 - RNA, 19 nt, Homo sapiens
uguacgagcuuucgccaaa

SEQ ID NO: 913487 - RNA, 19 nt, Homo sapiens
uagccaagaugaacuuaau

SEQ ID NO: 913488 - RNA, 19 nt, Homo sapiens
caaaaucacagcauucaua

SEQ ID NO: 913489 - RNA, 19 nt, Homo sapiens
ggaaacccgaagauaaauu

SEQ ID NO: 913490 - RNA, 19 nt, Homo sapiens
caagaggcucagugaauuu

SEQ ID NO: 913491 - RNA, 19 nt, Homo sapiens
ucacagcauucauaguaga

SEQ ID NO: 913492 - RNA, 19 nt, Homo sapiens
agaugaaacuuuggagaaa

SEQ ID NO: 913493 - RNA, 19 nt, Homo sapiens
gaaagugucccagcagauc

SEQ ID NO: 913494 - RNA, 19 nt, Homo sapiens
gaguacgccugcacaagga

SEQ ID NO: 913495 - RNA, 19 nt, Homo sapiens
cgagggaaccaaugagauu

SEQ ID NO: 913496 - RNA, 19 nt, Homo sapiens
ggccugggcuucuccaaca

SEQ ID NO: 913497 - RNA, 19 nt, Homo sapiens
cagaagguguugggauuau

SEQ ID NO: 913498 - RNA, 19 nt, Homo sapiens
gagaagcgagccuauaucu

SEQ ID NO: 913499 - RNA, 19 nt, Homo sapiens
aaccacacauucucuaaga

SEQ ID NO: 913500 - RNA, 19 nt, Homo sapiens
gaaguuagccaagaugaac

SEQ ID NO: 913501 - RNA, 19 nt, Homo sapiens
cagugaauuuggauugauu

SEQ ID NO: 913502 - RNA, 19 nt, Homo sapiens
ggucggagauggguuuaag

SEQ ID NO: 913503 - RNA, 19 nt, Homo sapiens
ggucguugauucugaugga

SEQ ID NO: 913504 - RNA, 19 nt, Homo sapiens
cagaugaaacuuuggagaa

SEQ ID NO: 913505 - RNA, 19 nt, Homo sapiens
gaagguguugggauuauca

SEQ ID NO: 913506 - RNA, 19 nt, Homo sapiens
caagagauugauugaaaug

SEQ ID NO: 913507 - RNA, 19 nt, Homo sapiens
gccaagaugaacuuaauga

SEQ ID NO: 913508 - RNA, 19 nt, Homo sapiens
caggaaccauuuaacaaag

SEQ ID NO: 913509 - RNA, 19 nt, Homo sapiens
gagauugauugaaaugacu

SEQ ID NO: 913510 - RNA, 19 nt, Homo sapiens
ugggaaacccgaagauaaa

SEQ ID NO: 913511 - RNA, 19 nt, Homo sapiens
gccaaauacuugccuaaac

SEQ ID NO: 913512 - RNA, 19 nt, Homo sapiens
caaucuguguacuguuaaa

SEQ ID NO: 913513 - RNA, 19 nt, Homo sapiens
ggagacaccauaguggaaa

SEQ ID NO: 913514 - RNA, 19 nt, Homo sapiens
caggauccaugagcuuaaa

SEQ ID NO: 913515 - RNA, 19 nt, Homo sapiens
gcucagugaauuuggauug

SEQ ID NO: 913516 - RNA, 19 nt, Homo sapiens
gagguucucuuggccaaca

SEQ ID NO: 913517 - RNA, 19 nt, Homo sapiens
gugaagacaagaagcacua

SEQ ID NO: 913518 - RNA, 19 nt, Homo sapiens
gcacugaggagcagaaagc

SEQ ID NO: 913519 - RNA, 19 nt, Homo sapiens
gagagagaauggaauugcu

SEQ ID NO: 913520 - RNA, 19 nt, Homo sapiens
aaucccagaugaaacuuug

SEQ ID NO: 913521 - RNA, 19 nt, Homo sapiens
gaggcucagugaauuugga

SEQ ID NO: 913522 - RNA, 19 nt, Homo sapiens
caaagacugaggucguuga

SEQ ID NO: 913523 - RNA, 19 nt, Homo sapiens
ucuaagaaacagcuugaaa

SEQ ID NO: 913524 - RNA, 19 nt, Homo sapiens
ucauugaggagacaccaua

SEQ ID NO: 913525 - RNA, 19 nt, Homo sapiens
cggguauucuggucauuga

SEQ ID NO: 913526 - RNA, 19 nt, Homo sapiens
aggagcagcugguacugaa

SEQ ID NO: 913527 - RNA, 19 nt, Homo sapiens
gaaacuuuggagaaauuga

SEQ ID NO: 913528 - RNA, 19 nt, Homo sapiens
uggagucacuaaugggaaa

SEQ ID NO: 913529 - RNA, 19 nt, Homo sapiens
ucagaagguguugggauua

SEQ ID NO: 913530 - RNA, 19 nt, Homo sapiens
ggaugacuguuacucuuuu

SEQ ID NO: 913531 - RNA, 19 nt, Homo sapiens
cccagcagauccuugagaa

SEQ ID NO: 913532 - RNA, 19 nt, Homo sapiens
gagcagauuaagaaagugu

SEQ ID NO: 913533 - RNA, 19 nt, Homo sapiens
gcauugggcuccgcaacca

SEQ ID NO: 913534 - RNA, 19 nt, Homo sapiens
caacaaguuugaggagaac

SEQ ID NO: 913535 - RNA, 19 nt, Homo sapiens
caaagugagcacagucaug

SEQ ID NO: 913536 - RNA, 19 nt, Homo sapiens
gaguaugaccuaccucaca

SEQ ID NO: 913537 - RNA, 19 nt, Homo sapiens
gauugauucaggagaaauu

SEQ ID NO: 913538 - RNA, 19 nt, Homo sapiens
uaacaagaggcucagugaa

SEQ ID NO: 913539 - RNA, 19 nt, Homo sapiens
gagcagaaagccaaauacu

SEQ ID NO: 913540 - RNA, 19 nt, Homo sapiens
agaagcagaggcacuuaaa

SEQ ID NO: 913541 - RNA, 19 nt, Homo sapiens
cuaagaaacagcuugaaag

SEQ ID NO: 913542 - RNA, 19 nt, Homo sapiens
ggaacuggcggguauucug

SEQ ID NO: 913543 - RNA, 19 nt, Homo sapiens
aagcuuacuugcagaaucu

SEQ ID NO: 913544 - RNA, 19 nt, Homo sapiens
ccaagaugaacuuaaugaa

SEQ ID NO: 913545 - RNA, 19 nt, Homo sapiens
auggaggacuggccaauau

SEQ ID NO: 913546 - RNA, 19 nt, Homo sapiens
gaaaaucccagaugaaacu

SEQ ID NO: 913547 - RNA, 19 nt, Homo sapiens
caagauaccuguggaaaac

SEQ ID NO: 913548 - RNA, 19 nt, Homo sapiens
gauagccauuucugcucaa

SEQ ID NO: 913549 - RNA, 19 nt, Homo sapiens
ugcaggcagugcucucuaa

SEQ ID NO: 913550 - RNA, 19 nt, Homo sapiens
uucagaagguguugggauu

SEQ ID NO: 913551 - RNA, 19 nt, Homo sapiens
caacaccuucugcguggaa

SEQ ID NO: 913552 - RNA, 19 nt, Homo sapiens
gaacaucgggcagcaugag

SEQ ID NO: 913553 - RNA, 19 nt, Homo sapiens
ugauggcucagaaggcuua

SEQ ID NO: 913554 - RNA, 19 nt, Homo sapiens
uggcugggcugcucaagag

SEQ ID NO: 913555 - RNA, 19 nt, Homo sapiens
gagaagccgucaaggagua

SEQ ID NO: 913556 - RNA, 19 nt, Homo sapiens
ggauguaacccuaugauaa

SEQ ID NO: 913557 - RNA, 19 nt, Homo sapiens
gaauagagaguaaaggaaa

SEQ ID NO: 913558 - RNA, 19 nt, Homo sapiens
gaauguuugugauacagua

SEQ ID NO: 913559 - RNA, 19 nt, Homo sapiens
ucacagaugucguaagaau

SEQ ID NO: 913560 - RNA, 19 nt, Homo sapiens
uaucacagaugucguaaga

SEQ ID NO: 913561 - RNA, 19 nt, Homo sapiens
cauaaggucuaccaagaaa

SEQ ID NO: 913562 - RNA, 19 nt, Homo sapiens
gaaauugguaugcuuagaa

SEQ ID NO: 913563 - RNA, 19 nt, Homo sapiens
caucagaaauucaacacuu

SEQ ID NO: 913564 - RNA, 19 nt, Homo sapiens
ucaguuggcuucuaggaaa

SEQ ID NO: 913565 - RNA, 19 nt, Homo sapiens
ggccagauccugugcauaa

SEQ ID NO: 913566 - RNA, 19 nt, Homo sapiens
ccauacauauucaguagaa

SEQ ID NO: 913567 - RNA, 19 nt, Homo sapiens
uaugugcggucuccaauuu

SEQ ID NO: 913568 - RNA, 19 nt, Homo sapiens
cagauccugugcauaauaa

SEQ ID NO: 913569 - RNA, 19 nt, Homo sapiens
uacagugacucgaaccuua

SEQ ID NO: 913570 - RNA, 19 nt, Homo sapiens
guagaaauugguaugcuua

SEQ ID NO: 913571 - RNA, 19 nt, Homo sapiens
ggaccaggauugaaacaag

SEQ ID NO: 913572 - RNA, 19 nt, Homo sapiens
guucugagcauauuuaaga

SEQ ID NO: 913573 - RNA, 19 nt, Homo sapiens
gcaggacaauaguaugcua

SEQ ID NO: 913574 - RNA, 19 nt, Homo sapiens
uaaaaugggugaugucaaa

SEQ ID NO: 913575 - RNA, 19 nt, Homo sapiens
gcuuauguaugauccuuaa

SEQ ID NO: 913576 - RNA, 19 nt, Homo sapiens
gagaauaaacucauaaggu

SEQ ID NO: 913577 - RNA, 19 nt, Homo sapiens
ccaaagccauacauauuca

SEQ ID NO: 913578 - RNA, 19 nt, Homo sapiens
ggauuugacauucucauuu

SEQ ID NO: 913579 - RNA, 19 nt, Homo sapiens
gugcauggcuuuccugaag

SEQ ID NO: 913580 - RNA, 19 nt, Homo sapiens
agaaacacaugaucaagug

SEQ ID NO: 913581 - RNA, 19 nt, Homo sapiens
ugacuauaauugcaacgua

SEQ ID NO: 913582 - RNA, 19 nt, Homo sapiens
gaccaggauugaaacaaga

SEQ ID NO: 913583 - RNA, 19 nt, Homo sapiens
caucagccaagcauuguua

SEQ ID NO: 913584 - RNA, 19 nt, Homo sapiens
guaacccuaugauaaguug

SEQ ID NO: 913585 - RNA, 19 nt, Homo sapiens
gauagaacaacuuagcaaa

SEQ ID NO: 913586 - RNA, 19 nt, Homo sapiens
ggagcuuuauauuguguuu

SEQ ID NO: 913587 - RNA, 19 nt, Homo sapiens
ugaggaaggaccuaugaua

SEQ ID NO: 913588 - RNA, 19 nt, Homo sapiens
caaacuaucaggcuccaaa

SEQ ID NO: 913589 - RNA, 19 nt, Homo sapiens
ggaauagagaguaaaggaa

SEQ ID NO: 913590 - RNA, 19 nt, Homo sapiens
gauguaacccuaugauaag

SEQ ID NO: 913591 - RNA, 19 nt, Homo sapiens
agagaacuaucuugaaaca

SEQ ID NO: 913592 - RNA, 19 nt, Homo sapiens
guagaauguuugugauaca

SEQ ID NO: 913593 - RNA, 19 nt, Homo sapiens
uaaguguucugagcauauu

SEQ ID NO: 913594 - RNA, 19 nt, Homo sapiens
ccagaugacuauaauugca

SEQ ID NO: 913595 - RNA, 19 nt, Homo sapiens
gccaggagccaaacuauca

SEQ ID NO: 913596 - RNA, 19 nt, Homo sapiens
ccagauccugugcauaaua

SEQ ID NO: 913597 - RNA, 19 nt, Homo sapiens
ugauaagcaucuugaaaca

SEQ ID NO: 913598 - RNA, 19 nt, Homo sapiens
gaagugugaggaauagaga

SEQ ID NO: 913599 - RNA, 19 nt, Homo sapiens
uaauggugacccucuguua

SEQ ID NO: 913600 - RNA, 19 nt, Homo sapiens
cagccaagcauuguuagua

SEQ ID NO: 913601 - RNA, 19 nt, Homo sapiens
caacugauaguagguuuau

SEQ ID NO: 913602 - RNA, 19 nt, Homo sapiens
cauauucaguagaacauca

SEQ ID NO: 913603 - RNA, 19 nt, Homo sapiens
cuacuaagcaccguuggua

SEQ ID NO: 913604 - RNA, 19 nt, Homo sapiens
ugaagaaacacaugaucaa

SEQ ID NO: 913605 - RNA, 19 nt, Homo sapiens
cuagaauaguguuaggaaa

SEQ ID NO: 913606 - RNA, 19 nt, Homo sapiens
ccaagcauuguuaguagua

SEQ ID NO: 913607 - RNA, 19 nt, Homo sapiens
gccaaagccauacauauuc

SEQ ID NO: 913608 - RNA, 19 nt, Homo sapiens
uaauucugcugccucuauu

SEQ ID NO: 913609 - RNA, 19 nt, Homo sapiens
guuaaggucacuagaauag

SEQ ID NO: 913610 - RNA, 19 nt, Homo sapiens
gaaccuuacccaaacaagu

SEQ ID NO: 913611 - RNA, 19 nt, Homo sapiens
gggauguaacccuaugaua

SEQ ID NO: 913612 - RNA, 19 nt, Homo sapiens
guagguuuauugggaugua

SEQ ID NO: 913613 - RNA, 19 nt, Homo sapiens
aaacgggcuucguguuaga

SEQ ID NO: 913614 - RNA, 19 nt, Homo sapiens
uaaaacgggcuucguguua

SEQ ID NO: 913615 - RNA, 19 nt, Homo sapiens
gaagaaacacaugaucaag

SEQ ID NO: 913616 - RNA, 19 nt, Homo sapiens
gacccucuguuaagugguu

SEQ ID NO: 913617 - RNA, 19 nt, Homo sapiens
ugugaggaauagagaguaa

SEQ ID NO: 913618 - RNA, 19 nt, Homo sapiens
cugcagcucugugauuaaa

SEQ ID NO: 913619 - RNA, 19 nt, Homo sapiens
guaaguguucugagcauau

SEQ ID NO: 913620 - RNA, 19 nt, Homo sapiens
ugccaaagccauacauauu

SEQ ID NO: 913621 - RNA, 19 nt, Homo sapiens
uaccagaugacuauaauug

SEQ ID NO: 913622 - RNA, 19 nt, Homo sapiens
cucauaaggucuaccaaga

SEQ ID NO: 913623 - RNA, 19 nt, Homo sapiens
gcagucugguguauucagu

SEQ ID NO: 913624 - RNA, 19 nt, Homo sapiens
gauggcaggacaauaguau

SEQ ID NO: 913625 - RNA, 19 nt, Homo sapiens
uuuaggaggugaagaaucu

SEQ ID NO: 913626 - RNA, 19 nt, Homo sapiens
ggucuccaauuuaggacuu

SEQ ID NO: 913627 - RNA, 19 nt, Homo sapiens
ggugagaagccgucaagga

SEQ ID NO: 913628 - RNA, 19 nt, Homo sapiens
ucauaccacuugauaagca

SEQ ID NO: 913629 - RNA, 19 nt, Homo sapiens
ggcuguagcugcaguaaaa

SEQ ID NO: 913630 - RNA, 19 nt, Homo sapiens
ucaaguggccagugaagug

SEQ ID NO: 913631 - RNA, 19 nt, Homo sapiens
gaaaagggaguauaauuac

SEQ ID NO: 913632 - RNA, 19 nt, Homo sapiens
gaaaaugcagucuggugua

SEQ ID NO: 913633 - RNA, 19 nt, Homo sapiens
ugggugaugucaaagagaa

SEQ ID NO: 913634 - RNA, 19 nt, Homo sapiens
uaaaagcaguuucucuuca

SEQ ID NO: 913635 - RNA, 19 nt, Homo sapiens
ugucuacugugauuuaagu

SEQ ID NO: 913636 - RNA, 19 nt, Homo sapiens
ccuaugauaaguugagaaa

SEQ ID NO: 913637 - RNA, 19 nt, Homo sapiens
ccauagugccaaagccaua

SEQ ID NO: 913638 - RNA, 19 nt, Homo sapiens
gcaaaauguucuuuacuac

SEQ ID NO: 913639 - RNA, 19 nt, Homo sapiens
caaggaguagaaauuggua

SEQ ID NO: 913640 - RNA, 19 nt, Homo sapiens
agucugguguauucaguaa

SEQ ID NO: 913641 - RNA, 19 nt, Homo sapiens
aaugcagucugguguauuc

SEQ ID NO: 913642 - RNA, 19 nt, Homo sapiens
ccagugaagugugaggaau

SEQ ID NO: 913643 - RNA, 19 nt, Homo sapiens
uguaugauccuuaauagca

SEQ ID NO: 913644 - RNA, 19 nt, Homo sapiens
gugugucuacugugauuua

SEQ ID NO: 913645 - RNA, 19 nt, Homo sapiens
gaaucugaauccuccaaaa

SEQ ID NO: 913646 - RNA, 19 nt, Homo sapiens
gauccugugcauaauaaug

SEQ ID NO: 913647 - RNA, 19 nt, Homo sapiens
ucuaccagaugacuauaau

SEQ ID NO: 913648 - RNA, 19 nt, Homo sapiens
guaugauccuuaauagcau

SEQ ID NO: 913649 - RNA, 19 nt, Homo sapiens
uaugcuagcuuuagaacac

SEQ ID NO: 913650 - RNA, 19 nt, Homo sapiens
gagccaggagccaaacuau

SEQ ID NO: 913651 - RNA, 19 nt, Homo sapiens
ucauaaggucuaccaagaa

SEQ ID NO: 913652 - RNA, 19 nt, Homo sapiens
agaaauugguaugcuuaga

SEQ ID NO: 913653 - RNA, 19 nt, Homo sapiens
ggaaucaaagagaaaugug

SEQ ID NO: 913654 - RNA, 19 nt, Homo sapiens
agauuaugcuagcuuuaga

SEQ ID NO: 913655 - RNA, 19 nt, Homo sapiens
ggauguaacccuaugauaa

SEQ ID NO: 913656 - RNA, 19 nt, Homo sapiens
gaauagagaguaaaggaaa

SEQ ID NO: 913657 - RNA, 19 nt, Homo sapiens
gaauguuugugauacagua

SEQ ID NO: 913658 - RNA, 19 nt, Homo sapiens
ucacagaugucguaagaau

SEQ ID NO: 913659 - RNA, 19 nt, Homo sapiens
uaucacagaugucguaaga

SEQ ID NO: 913660 - RNA, 19 nt, Homo sapiens
cauaaggucuaccaagaaa

SEQ ID NO: 913661 - RNA, 19 nt, Homo sapiens
gaaauugguaugcuuagaa

SEQ ID NO: 913662 - RNA, 19 nt, Homo sapiens
caucagaaauucaacacuu

SEQ ID NO: 913663 - RNA, 19 nt, Homo sapiens
ucaguuggcuucuaggaaa

SEQ ID NO: 913664 - RNA, 19 nt, Homo sapiens
ggccagauccugugcauaa

SEQ ID NO: 913665 - RNA, 19 nt, Homo sapiens
ccauacauauucaguagaa

SEQ ID NO: 913666 - RNA, 19 nt, Homo sapiens
uaugugcggucuccaauuu

SEQ ID NO: 913667 - RNA, 19 nt, Homo sapiens
cagauccugugcauaauaa

SEQ ID NO: 913668 - RNA, 19 nt, Homo sapiens
uacagugacucgaaccuua

SEQ ID NO: 913669 - RNA, 19 nt, Homo sapiens
guagaaauugguaugcuua

SEQ ID NO: 913670 - RNA, 19 nt, Homo sapiens
guucugagcauauuuaaga

SEQ ID NO: 913671 - RNA, 19 nt, Homo sapiens
ggaccaggauugaaacaag

SEQ ID NO: 913672 - RNA, 19 nt, Homo sapiens
gcaggacaauaguaugcua

SEQ ID NO: 913673 - RNA, 19 nt, Homo sapiens
uaaaaugggugaugucaaa

SEQ ID NO: 913674 - RNA, 19 nt, Homo sapiens
gcuuauguaugauccuuaa

SEQ ID NO: 913675 - RNA, 19 nt, Homo sapiens
gagaauaaacucauaaggu

SEQ ID NO: 913676 - RNA, 19 nt, Homo sapiens
ccaaagccauacauauuca

SEQ ID NO: 913677 - RNA, 19 nt, Homo sapiens
ggauuugacauucucauuu

SEQ ID NO: 913678 - RNA, 19 nt, Homo sapiens
gugcauggcuuuccugaag

SEQ ID NO: 913679 - RNA, 19 nt, Homo sapiens
agaaacacaugaucaagug

SEQ ID NO: 913680 - RNA, 19 nt, Homo sapiens
ugacuauaauugcaacgua

SEQ ID NO: 913681 - RNA, 19 nt, Homo sapiens
gaccaggauugaaacaaga

SEQ ID NO: 913682 - RNA, 19 nt, Homo sapiens
caucagccaagcauuguua

SEQ ID NO: 913683 - RNA, 19 nt, Homo sapiens
guaacccuaugauaaguug

SEQ ID NO: 913684 - RNA, 19 nt, Homo sapiens
gauagaacaacuuagcaaa

SEQ ID NO: 913685 - RNA, 19 nt, Homo sapiens
ggagcuuuauauuguguuu

SEQ ID NO: 913686 - RNA, 19 nt, Homo sapiens
ugaggaaggaccuaugaua

SEQ ID NO: 913687 - RNA, 19 nt, Homo sapiens
caaacuaucaggcuccaaa

SEQ ID NO: 913688 - RNA, 19 nt, Homo sapiens
ggaauagagaguaaaggaa

SEQ ID NO: 913689 - RNA, 19 nt, Homo sapiens
gauguaacccuaugauaag

SEQ ID NO: 913690 - RNA, 19 nt, Homo sapiens
agagaacuaucuugaaaca

SEQ ID NO: 913691 - RNA, 19 nt, Homo sapiens
guagaauguuugugauaca

SEQ ID NO: 913692 - RNA, 19 nt, Homo sapiens
uaaguguucugagcauauu

SEQ ID NO: 913693 - RNA, 19 nt, Homo sapiens
ucaagcaggaguagaaauu

SEQ ID NO: 913694 - RNA, 19 nt, Homo sapiens
ccagaugacuauaauugca

SEQ ID NO: 913695 - RNA, 19 nt, Homo sapiens
gccaggagccaaacuauca

SEQ ID NO: 913696 - RNA, 19 nt, Homo sapiens
ccagauccugugcauaaua

SEQ ID NO: 913697 - RNA, 19 nt, Homo sapiens
ugauaagcaucuugaaaca

SEQ ID NO: 913698 - RNA, 19 nt, Homo sapiens
gaagugugaggaauagaga

SEQ ID NO: 913699 - RNA, 19 nt, Homo sapiens
uaauggugacccucuguua

SEQ ID NO: 913700 - RNA, 19 nt, Homo sapiens
cagccaagcauuguuagua

SEQ ID NO: 913701 - RNA, 19 nt, Homo sapiens
caacugauaguagguuuau

SEQ ID NO: 913702 - RNA, 19 nt, Homo sapiens
cauauucaguagaacauca

SEQ ID NO: 913703 - RNA, 19 nt, Homo sapiens
cuacuaagcaccguuggua

SEQ ID NO: 913704 - RNA, 19 nt, Homo sapiens
ugaagaaacacaugaucaa

SEQ ID NO: 913705 - RNA, 19 nt, Homo sapiens
cuagaauaguguuaggaaa

SEQ ID NO: 913706 - RNA, 19 nt, Homo sapiens
ccaagcauuguuaguagua

SEQ ID NO: 913707 - RNA, 19 nt, Homo sapiens
gccaaagccauacauauuc

SEQ ID NO: 913708 - RNA, 19 nt, Homo sapiens
uaauucugcugccucuauu

SEQ ID NO: 913709 - RNA, 19 nt, Homo sapiens
guuaaggucacuagaauag

SEQ ID NO: 913710 - RNA, 19 nt, Homo sapiens
gaaccuuacccaaacaagu

SEQ ID NO: 913711 - RNA, 19 nt, Homo sapiens
gggauguaacccuaugaua

SEQ ID NO: 913712 - RNA, 19 nt, Homo sapiens
guagguuuauugggaugua

SEQ ID NO: 913713 - RNA, 19 nt, Homo sapiens
aaacgggcuucguguuaga

SEQ ID NO: 913714 - RNA, 19 nt, Homo sapiens
uaaaacgggcuucguguua

SEQ ID NO: 913715 - RNA, 19 nt, Homo sapiens
gaagaaacacaugaucaag

SEQ ID NO: 913716 - RNA, 19 nt, Homo sapiens
gacccucuguuaagugguu

SEQ ID NO: 913717 - RNA, 19 nt, Homo sapiens
ugugaggaauagagaguaa

SEQ ID NO: 913718 - RNA, 19 nt, Homo sapiens
cugcagcucugugauuaaa

SEQ ID NO: 913719 - RNA, 19 nt, Homo sapiens
guaaguguucugagcauau

SEQ ID NO: 913720 - RNA, 19 nt, Homo sapiens
ugccaaagccauacauauu

SEQ ID NO: 913721 - RNA, 19 nt, Homo sapiens
uaccagaugacuauaauug

SEQ ID NO: 913722 - RNA, 19 nt, Homo sapiens
cucauaaggucuaccaaga

SEQ ID NO: 913723 - RNA, 19 nt, Homo sapiens
gcagucugguguauucagu

SEQ ID NO: 913724 - RNA, 19 nt, Homo sapiens
gauggcaggacaauaguau

SEQ ID NO: 913725 - RNA, 19 nt, Homo sapiens
gcaggaguagaaauuggua

SEQ ID NO: 913726 - RNA, 19 nt, Homo sapiens
uuuaggaggugaagaaucu

SEQ ID NO: 913727 - RNA, 19 nt, Homo sapiens
ggucuccaauuuaggacuu

SEQ ID NO: 913728 - RNA, 19 nt, Homo sapiens
ucauaccacuugauaagca

SEQ ID NO: 913729 - RNA, 19 nt, Homo sapiens
ggcuguagcugcaguaaaa

SEQ ID NO: 913730 - RNA, 19 nt, Homo sapiens
ucaaguggccagugaagug

SEQ ID NO: 913731 - RNA, 19 nt, Homo sapiens
gaaaagggaguauaauuac

SEQ ID NO: 913732 - RNA, 19 nt, Homo sapiens
gaaaaugcagucuggugua

SEQ ID NO: 913733 - RNA, 19 nt, Homo sapiens
ugggugaugucaaagagaa

SEQ ID NO: 913734 - RNA, 19 nt, Homo sapiens
uaaaagcaguuucucuuca

SEQ ID NO: 913735 - RNA, 19 nt, Homo sapiens
ugucuacugugauuuaagu

SEQ ID NO: 913736 - RNA, 19 nt, Homo sapiens
ccuaugauaaguugagaaa

SEQ ID NO: 913737 - RNA, 19 nt, Homo sapiens
ccauagugccaaagccaua

SEQ ID NO: 913738 - RNA, 19 nt, Homo sapiens
gcaaaauguucuuuacuac

SEQ ID NO: 913739 - RNA, 19 nt, Homo sapiens
agucugguguauucaguaa

SEQ ID NO: 913740 - RNA, 19 nt, Homo sapiens
aaugcagucugguguauuc

SEQ ID NO: 913741 - RNA, 19 nt, Homo sapiens
ccagugaagugugaggaau

SEQ ID NO: 913742 - RNA, 19 nt, Homo sapiens
uguaugauccuuaauagca

SEQ ID NO: 913743 - RNA, 19 nt, Homo sapiens
gugugucuacugugauuua

SEQ ID NO: 913744 - RNA, 19 nt, Homo sapiens
gaaucugaauccuccaaaa

SEQ ID NO: 913745 - RNA, 19 nt, Homo sapiens
gauccugugcauaauaaug

SEQ ID NO: 913746 - RNA, 19 nt, Homo sapiens
ucuaccagaugacuauaau

SEQ ID NO: 913747 - RNA, 19 nt, Homo sapiens
guaugauccuuaauagcau

SEQ ID NO: 913748 - RNA, 19 nt, Homo sapiens
uaugcuagcuuuagaacac

SEQ ID NO: 913749 - RNA, 19 nt, Homo sapiens
gagccaggagccaaacuau

SEQ ID NO: 913750 - RNA, 19 nt, Homo sapiens
ucauaaggucuaccaagaa

SEQ ID NO: 913751 - RNA, 19 nt, Homo sapiens
agaaauugguaugcuuaga

SEQ ID NO: 913752 - RNA, 19 nt, Homo sapiens
ggaaucaaagagaaaugug

SEQ ID NO: 913753 - RNA, 19 nt, Homo sapiens
agauuaugcuagcuuuaga

SEQ ID NO: 913754 - RNA, 19 nt, Homo sapiens
aaauugguaugcuuagaag

SEQ ID NO: 913755 - RNA, 19 nt, Homo sapiens
ggauguaacccuaugauaa

SEQ ID NO: 913756 - RNA, 19 nt, Homo sapiens
gaauagagaguaaaggaaa

SEQ ID NO: 913757 - RNA, 19 nt, Homo sapiens
gaauguuugugauacagua

SEQ ID NO: 913758 - RNA, 19 nt, Homo sapiens
ucacagaugucguaagaau

SEQ ID NO: 913759 - RNA, 19 nt, Homo sapiens
uaucacagaugucguaaga

SEQ ID NO: 913760 - RNA, 19 nt, Homo sapiens
cauaaggucuaccaagaaa

SEQ ID NO: 913761 - RNA, 19 nt, Homo sapiens
gaaauugguaugcuuagaa

SEQ ID NO: 913762 - RNA, 19 nt, Homo sapiens
caucagaaauucaacacuu

SEQ ID NO: 913763 - RNA, 19 nt, Homo sapiens
ucaguuggcuucuaggaaa

SEQ ID NO: 913764 - RNA, 19 nt, Homo sapiens
ggccagauccugugcauaa

SEQ ID NO: 913765 - RNA, 19 nt, Homo sapiens
gcagauggagcuuuauauu

SEQ ID NO: 913766 - RNA, 19 nt, Homo sapiens
ccauacauauucaguagaa

SEQ ID NO: 913767 - RNA, 19 nt, Homo sapiens
uaugugcggucuccaauuu

SEQ ID NO: 913768 - RNA, 19 nt, Homo sapiens
cagauccugugcauaauaa

SEQ ID NO: 913769 - RNA, 19 nt, Homo sapiens
uacagugacucgaaccuua

SEQ ID NO: 913770 - RNA, 19 nt, Homo sapiens
guagaaauugguaugcuua

SEQ ID NO: 913771 - RNA, 19 nt, Homo sapiens
guucugagcauauuuaaga

SEQ ID NO: 913772 - RNA, 19 nt, Homo sapiens
ggaccaggauugaaacaag

SEQ ID NO: 913773 - RNA, 19 nt, Homo sapiens
gcaggacaauaguaugcua

SEQ ID NO: 913774 - RNA, 19 nt, Homo sapiens
agauggagcuuuauauugu

SEQ ID NO: 913775 - RNA, 19 nt, Homo sapiens
uaaaaugggugaugucaaa

SEQ ID NO: 913776 - RNA, 19 nt, Homo sapiens
gcuuauguaugauccuuaa

SEQ ID NO: 913777 - RNA, 19 nt, Homo sapiens
gagaauaaacucauaaggu

SEQ ID NO: 913778 - RNA, 19 nt, Homo sapiens
ccaaagccauacauauuca

SEQ ID NO: 913779 - RNA, 19 nt, Homo sapiens
ggauuugacauucucauuu

SEQ ID NO: 913780 - RNA, 19 nt, Homo sapiens
gugcauggcuuuccugaag

SEQ ID NO: 913781 - RNA, 19 nt, Homo sapiens
agaaacacaugaucaagug

SEQ ID NO: 913782 - RNA, 19 nt, Homo sapiens
ugacuauaauugcaacgua

SEQ ID NO: 913783 - RNA, 19 nt, Homo sapiens
gaccaggauugaaacaaga

SEQ ID NO: 913784 - RNA, 19 nt, Homo sapiens
caucagccaagcauuguua

SEQ ID NO: 913785 - RNA, 19 nt, Homo sapiens
guaacccuaugauaaguug

SEQ ID NO: 913786 - RNA, 19 nt, Homo sapiens
gauagaacaacuuagcaaa

SEQ ID NO: 913787 - RNA, 19 nt, Homo sapiens
ggagcuuuauauuguguuu

SEQ ID NO: 913788 - RNA, 19 nt, Homo sapiens
ugaggaaggaccuaugaua

SEQ ID NO: 913789 - RNA, 19 nt, Homo sapiens
caaacuaucaggcuccaaa

SEQ ID NO: 913790 - RNA, 19 nt, Homo sapiens
ggaauagagaguaaaggaa

SEQ ID NO: 913791 - RNA, 19 nt, Homo sapiens
gauguaacccuaugauaag

SEQ ID NO: 913792 - RNA, 19 nt, Homo sapiens
agagaacuaucuugaaaca

SEQ ID NO: 913793 - RNA, 19 nt, Homo sapiens
guagaauguuugugauaca

SEQ ID NO: 913794 - RNA, 19 nt, Homo sapiens
uaaguguucugagcauauu

SEQ ID NO: 913795 - RNA, 19 nt, Homo sapiens
ucaagcaggaguagaaauu

SEQ ID NO: 913796 - RNA, 19 nt, Homo sapiens
ccagaugacuauaauugca

SEQ ID NO: 913797 - RNA, 19 nt, Homo sapiens
gccaggagccaaacuauca

SEQ ID NO: 913798 - RNA, 19 nt, Homo sapiens
ccagauccugugcauaaua

SEQ ID NO: 913799 - RNA, 19 nt, Homo sapiens
cagauggagcuuuauauug

SEQ ID NO: 913800 - RNA, 19 nt, Homo sapiens
ugauaagcaucuugaaaca

SEQ ID NO: 913801 - RNA, 19 nt, Homo sapiens
gaagugugaggaauagaga

SEQ ID NO: 913802 - RNA, 19 nt, Homo sapiens
uaauggugacccucuguua

SEQ ID NO: 913803 - RNA, 19 nt, Homo sapiens
cagccaagcauuguuagua

SEQ ID NO: 913804 - RNA, 19 nt, Homo sapiens
caacugauaguagguuuau

SEQ ID NO: 913805 - RNA, 19 nt, Homo sapiens
cauauucaguagaacauca

SEQ ID NO: 913806 - RNA, 19 nt, Homo sapiens
cuacuaagcaccguuggua

SEQ ID NO: 913807 - RNA, 19 nt, Homo sapiens
ugaagaaacacaugaucaa

SEQ ID NO: 913808 - RNA, 19 nt, Homo sapiens
cuagaauaguguuaggaaa

SEQ ID NO: 913809 - RNA, 19 nt, Homo sapiens
ccaagcauuguuaguagua

SEQ ID NO: 913810 - RNA, 19 nt, Homo sapiens
gccaaagccauacauauuc

SEQ ID NO: 913811 - RNA, 19 nt, Homo sapiens
gauggagcuuuauauugug

SEQ ID NO: 913812 - RNA, 19 nt, Homo sapiens
gggcguacaugugcagaug

SEQ ID NO: 913813 - RNA, 19 nt, Homo sapiens
uaauucugcugccucuauu

SEQ ID NO: 913814 - RNA, 19 nt, Homo sapiens
guuaaggucacuagaauag

SEQ ID NO: 913815 - RNA, 19 nt, Homo sapiens
gaaccuuacccaaacaagu

SEQ ID NO: 913816 - RNA, 19 nt, Homo sapiens
gggauguaacccuaugaua

SEQ ID NO: 913817 - RNA, 19 nt, Homo sapiens
guagguuuauugggaugua

SEQ ID NO: 913818 - RNA, 19 nt, Homo sapiens
aaacgggcuucguguuaga

SEQ ID NO: 913819 - RNA, 19 nt, Homo sapiens
uaaaacgggcuucguguua

SEQ ID NO: 913820 - RNA, 19 nt, Homo sapiens
gaagaaacacaugaucaag

SEQ ID NO: 913821 - RNA, 19 nt, Homo sapiens
gugcagauggagcuuuaua

SEQ ID NO: 913822 - RNA, 19 nt, Homo sapiens
gacccucuguuaagugguu

SEQ ID NO: 913823 - RNA, 19 nt, Homo sapiens
ugugaggaauagagaguaa

SEQ ID NO: 913824 - RNA, 19 nt, Homo sapiens
cugcagcucugugauuaaa

SEQ ID NO: 913825 - RNA, 19 nt, Homo sapiens
guaaguguucugagcauau

SEQ ID NO: 913826 - RNA, 19 nt, Homo sapiens
ugccaaagccauacauauu

SEQ ID NO: 913827 - RNA, 19 nt, Homo sapiens
uaccagaugacuauaauug

SEQ ID NO: 913828 - RNA, 19 nt, Homo sapiens
cucauaaggucuaccaaga

SEQ ID NO: 913829 - RNA, 19 nt, Homo sapiens
gcaggaguagaaauuggua

SEQ ID NO: 913830 - RNA, 19 nt, Homo sapiens
gcagucugguguauucagu

SEQ ID NO: 913831 - RNA, 19 nt, Homo sapiens
gauggcaggacaauaguau

SEQ ID NO: 913832 - RNA, 19 nt, Homo sapiens
uuuaggaggugaagaaucu

SEQ ID NO: 913833 - RNA, 19 nt, Homo sapiens
ggucuccaauuuaggacuu

SEQ ID NO: 913834 - RNA, 19 nt, Homo sapiens
ggcuguagcugcaguaaaa

SEQ ID NO: 913835 - RNA, 19 nt, Homo sapiens
ucauaccacuugauaagca

SEQ ID NO: 913836 - RNA, 19 nt, Homo sapiens
ucaaguggccagugaagug

SEQ ID NO: 913837 - RNA, 19 nt, Homo sapiens
gaaaagggaguauaauuac

SEQ ID NO: 913838 - RNA, 19 nt, Homo sapiens
gaaaaugcagucuggugua

SEQ ID NO: 913839 - RNA, 19 nt, Homo sapiens
ugggugaugucaaagagaa

SEQ ID NO: 913840 - RNA, 19 nt, Homo sapiens
ugucuacugugauuuaagu

SEQ ID NO: 913841 - RNA, 19 nt, Homo sapiens
ccuaugauaaguugagaaa

SEQ ID NO: 913842 - RNA, 19 nt, Homo sapiens
uaaaagcaguuucucuuca

SEQ ID NO: 913843 - RNA, 19 nt, Homo sapiens
ccauagugccaaagccaua

SEQ ID NO: 913844 - RNA, 19 nt, Homo sapiens
gcaaaauguucuuuacuac

SEQ ID NO: 913845 - RNA, 19 nt, Homo sapiens
agucugguguauucaguaa

SEQ ID NO: 913846 - RNA, 19 nt, Homo sapiens
aaugcagucugguguauuc

SEQ ID NO: 913847 - RNA, 19 nt, Homo sapiens
ccagugaagugugaggaau

SEQ ID NO: 913848 - RNA, 19 nt, Homo sapiens
uguaugauccuuaauagca

SEQ ID NO: 913849 - RNA, 19 nt, Homo sapiens
gugugucuacugugauuua

SEQ ID NO: 913850 - RNA, 19 nt, Homo sapiens
gaaucugaauccuccaaaa

SEQ ID NO: 913851 - RNA, 19 nt, Homo sapiens
gauccugugcauaauaaug

SEQ ID NO: 913852 - RNA, 19 nt, Homo sapiens
ucuaccagaugacuauaau

SEQ ID NO: 913853 - RNA, 19 nt, Homo sapiens
gcguacaugugcagaugga

SEQ ID NO: 913854 - RNA, 19 nt, Homo sapiens
agaaauugguaugcuuaga

SEQ ID NO: 913855 - RNA, 19 nt, Homo sapiens
caaguaagcuuaaacuaca

SEQ ID NO: 913856 - RNA, 19 nt, Homo sapiens
gauauacucuuccauuugu

SEQ ID NO: 913857 - RNA, 19 nt, Homo sapiens
caauggaccugaucgguuu

SEQ ID NO: 913858 - RNA, 19 nt, Homo sapiens
ucacauaaaggaagucuua

SEQ ID NO: 913859 - RNA, 19 nt, Homo sapiens
cauaaugggugugagauuu

SEQ ID NO: 913860 - RNA, 19 nt, Homo sapiens
ggaguucacagaaugauaa

SEQ ID NO: 913861 - RNA, 19 nt, Homo sapiens
gaggugguguuccgucuuu

SEQ ID NO: 913862 - RNA, 19 nt, Homo sapiens
aauaaugccugcugguuug

SEQ ID NO: 913863 - RNA, 19 nt, Homo sapiens
caacuugucacauaaagga

SEQ ID NO: 913864 - RNA, 19 nt, Homo sapiens
gcacugucaccucuaauau

SEQ ID NO: 913865 - RNA, 19 nt, Homo sapiens
gguguuccgucuuugauug

SEQ ID NO: 913866 - RNA, 19 nt, Homo sapiens
uaaguggaguucacagaau

SEQ ID NO: 913867 - RNA, 19 nt, Homo sapiens
caauauggaaugcuagaaa

SEQ ID NO: 913868 - RNA, 19 nt, Homo sapiens
uguccuaacugaauguauu

SEQ ID NO: 913869 - RNA, 19 nt, Homo sapiens
caaacgagauguaaaagug

SEQ ID NO: 913870 - RNA, 19 nt, Homo sapiens
acugucaccucuaauauga

SEQ ID NO: 913871 - RNA, 19 nt, Homo sapiens
gauuuaagagguccaagaa

SEQ ID NO: 913872 - RNA, 19 nt, Homo sapiens
gaaucaugauauacucuuc

SEQ ID NO: 913873 - RNA, 19 nt, Homo sapiens
ggaaugcuagaaacacaaa

SEQ ID NO: 913874 - RNA, 19 nt, Homo sapiens
gcucggggcugcagaauug

SEQ ID NO: 913875 - RNA, 19 nt, Homo sapiens
uaaugggugugagauuuaa

SEQ ID NO: 913876 - RNA, 19 nt, Homo sapiens
caugauauacucuuccauu

SEQ ID NO: 913877 - RNA, 19 nt, Homo sapiens
guaaugggcagagcauauu

SEQ ID NO: 913878 - RNA, 19 nt, Homo sapiens
gagcuuaccgugucuccaa

SEQ ID NO: 913879 - RNA, 19 nt, Homo sapiens
gcacacuguuauguccuaa

SEQ ID NO: 913880 - RNA, 19 nt, Homo sapiens
guucacagaaugauaaugu

SEQ ID NO: 913881 - RNA, 19 nt, Homo sapiens
caaauacucaugucucaag

SEQ ID NO: 913882 - RNA, 19 nt, Homo sapiens
aaauaaugccugcugguuu

SEQ ID NO: 913883 - RNA, 19 nt, Homo sapiens
cauaaaggaagucuuaagu

SEQ ID NO: 913884 - RNA, 19 nt, Homo sapiens
aagcuuaaacuacaacuug

SEQ ID NO: 913885 - RNA, 19 nt, Homo sapiens
ucaaguaagcuuaaacuac

SEQ ID NO: 913886 - RNA, 19 nt, Homo sapiens
auaaugggugugagauuua

SEQ ID NO: 913887 - RNA, 19 nt, Homo sapiens
augcagcccucgugacauu

SEQ ID NO: 913888 - RNA, 19 nt, Homo sapiens
ugauauacucuuccauuug

SEQ ID NO: 913889 - RNA, 19 nt, Homo sapiens
caaugacaaacgagaugua

SEQ ID NO: 913890 - RNA, 19 nt, Homo sapiens
uccaaauacucaugucuca

SEQ ID NO: 913891 - RNA, 19 nt, Homo sapiens
ugguuugguugcagguuua

SEQ ID NO: 913892 - RNA, 19 nt, Homo sapiens
uuuaagagguccaagaaaa

SEQ ID NO: 913893 - RNA, 19 nt, Homo sapiens
cuuccuggcuaccauaaug

SEQ ID NO: 913894 - RNA, 19 nt, Homo sapiens
cgugacauuuggaagcauu

SEQ ID NO: 913895 - RNA, 19 nt, Homo sapiens
auagcacugucaccucuaa

SEQ ID NO: 913896 - RNA, 19 nt, Homo sapiens
gcagguuuaagccucauga

SEQ ID NO: 913897 - RNA, 19 nt, Homo sapiens
ugacaaacgagauguaaaa

SEQ ID NO: 913898 - RNA, 19 nt, Homo sapiens
acucaugucucaaguaagc

SEQ ID NO: 913899 - RNA, 19 nt, Homo sapiens
ccauuuguugugucuauuu

SEQ ID NO: 913900 - RNA, 19 nt, Homo sapiens
gaaacacaaauagcacugu

SEQ ID NO: 913901 - RNA, 19 nt, Homo sapiens
aaguggaguucacagaaug

SEQ ID NO: 913902 - RNA, 19 nt, Homo sapiens
uuaaguggaguucacagaa

SEQ ID NO: 913903 - RNA, 19 nt, Homo sapiens
ggaagucuuaaguggaguu

SEQ ID NO: 913904 - RNA, 19 nt, Homo sapiens
gcagcccucgugacauuug

SEQ ID NO: 913905 - RNA, 19 nt, Homo sapiens
uaaugggcagagcauauuu

SEQ ID NO: 913906 - RNA, 19 nt, Homo sapiens
cugagcaucuggaggaaca

SEQ ID NO: 913907 - RNA, 19 nt, Homo sapiens
uaagagguccaagaaaaua

SEQ ID NO: 913908 - RNA, 19 nt, Homo sapiens
gucaagcacuauuuucauu

SEQ ID NO: 913909 - RNA, 19 nt, Homo sapiens
cuaauugucaagcacuauu

SEQ ID NO: 913910 - RNA, 19 nt, Homo sapiens
aaacuucaauauggaaugc

SEQ ID NO: 913911 - RNA, 19 nt, Homo sapiens
augaugauccugagacuug

SEQ ID NO: 913912 - RNA, 19 nt, Homo sapiens
aacauuaguuugagguagu

SEQ ID NO: 913913 - RNA, 19 nt, Homo sapiens
aauauggaaugcuagaaac

SEQ ID NO: 913914 - RNA, 19 nt, Homo sapiens
uguaaugggcagagcauau

SEQ ID NO: 913915 - RNA, 19 nt, Homo sapiens
cugguuugguugcagguuu

SEQ ID NO: 913916 - RNA, 19 nt, Homo sapiens
aaugacaaacgagauguaa

SEQ ID NO: 913917 - RNA, 19 nt, Homo sapiens
auaaaggaagucuuaagug

SEQ ID NO: 913918 - RNA, 19 nt, Homo sapiens
ugucucaaguaagcuuaaa

SEQ ID NO: 913919 - RNA, 19 nt, Homo sapiens
caugucauccugcuguaau

SEQ ID NO: 913920 - RNA, 19 nt, Homo sapiens
auucuuagcacacuguuau

SEQ ID NO: 913921 - RNA, 19 nt, Homo sapiens
cuuaccgugucuccaauga

SEQ ID NO: 913922 - RNA, 19 nt, Homo sapiens
ggugguguuccgucuuuga

SEQ ID NO: 913923 - RNA, 19 nt, Homo sapiens
ugaacauuaguuugaggua

SEQ ID NO: 913924 - RNA, 19 nt, Homo sapiens
acuucaauauggaaugcua

SEQ ID NO: 913925 - RNA, 19 nt, Homo sapiens
ugaaugaccuuaucuguuu

SEQ ID NO: 913926 - RNA, 19 nt, Homo sapiens
gaaccaagccugucuguau

SEQ ID NO: 913927 - RNA, 19 nt, Homo sapiens
gcucagauguguuuaagga

SEQ ID NO: 913928 - RNA, 19 nt, Homo sapiens
ggaaugauguucuguagag

SEQ ID NO: 913929 - RNA, 19 nt, Homo sapiens
gagauggccuuucacuuga

SEQ ID NO: 913930 - RNA, 19 nt, Homo sapiens
ccacaaauguccacagugu

SEQ ID NO: 913931 - RNA, 19 nt, Homo sapiens
ggaaucuacuuucauuguu

SEQ ID NO: 913932 - RNA, 19 nt, Homo sapiens
gcaauauguucacuauguu

SEQ ID NO: 913933 - RNA, 19 nt, Homo sapiens
uaaagacacuugaccuguu

SEQ ID NO: 913934 - RNA, 19 nt, Homo sapiens
gcucggggcuuuuaaauuu

SEQ ID NO: 913935 - RNA, 19 nt, Homo sapiens
auaaacagcugguauuugu

SEQ ID NO: 913936 - RNA, 19 nt, Homo sapiens
guacuagauuuguguaugu

SEQ ID NO: 913937 - RNA, 19 nt, Homo sapiens
aaacugaacacugugauua

SEQ ID NO: 913938 - RNA, 19 nt, Homo sapiens
aaagacacuugaccuguuu

SEQ ID NO: 913939 - RNA, 19 nt, Homo sapiens
guacagaaaguuauagaga

SEQ ID NO: 913940 - RNA, 19 nt, Homo sapiens
agaauaauguccugaguca

SEQ ID NO: 913941 - RNA, 19 nt, Homo sapiens
ucagauuggucacauaaau

SEQ ID NO: 913942 - RNA, 19 nt, Homo sapiens
agaccugaauuauguguaa

SEQ ID NO: 913943 - RNA, 19 nt, Homo sapiens
aaccaagccugucuguaua

SEQ ID NO: 913944 - RNA, 19 nt, Homo sapiens
guuaauacuuggcgcuuga

SEQ ID NO: 913945 - RNA, 19 nt, Homo sapiens
guguugcucuucagucaua

SEQ ID NO: 913946 - RNA, 19 nt, Homo sapiens
ggauaaacagcugguauuu

SEQ ID NO: 913947 - RNA, 19 nt, Homo sapiens
gcugguauuuguaucuaaa

SEQ ID NO: 913948 - RNA, 19 nt, Homo sapiens
gagauuauauugugaugcu

SEQ ID NO: 913949 - RNA, 19 nt, Homo sapiens
caggauuacuguguguuua

SEQ ID NO: 913950 - RNA, 19 nt, Homo sapiens
gaaauggaaauucuuugug

SEQ ID NO: 913951 - RNA, 19 nt, Homo sapiens
aaacucgaauccugaaaug

SEQ ID NO: 913952 - RNA, 19 nt, Homo sapiens
gaacuuggagugagacaca

SEQ ID NO: 913953 - RNA, 19 nt, Homo sapiens
gauauuccacuuagcugua

SEQ ID NO: 913954 - RNA, 19 nt, Homo sapiens
gaaauucuuuguggcagau

SEQ ID NO: 913955 - RNA, 19 nt, Homo sapiens
gaaacucgaauccugaaau

SEQ ID NO: 913956 - RNA, 19 nt, Homo sapiens
agagauggccuuucacuug

SEQ ID NO: 913957 - RNA, 19 nt, Homo sapiens
guaaaguuguacagaaagu

SEQ ID NO: 913958 - RNA, 19 nt, Homo sapiens
gauuaacauugacaggauu

SEQ ID NO: 913959 - RNA, 19 nt, Homo sapiens
uuaaggagacccuauauuc

SEQ ID NO: 913960 - RNA, 19 nt, Homo sapiens
caugauuucucccuguauu

SEQ ID NO: 913961 - RNA, 19 nt, Homo sapiens
gaccacaaauguccacagu

SEQ ID NO: 913962 - RNA, 19 nt, Homo sapiens
gggauaaacagcugguauu

SEQ ID NO: 913963 - RNA, 19 nt, Homo sapiens
gauaaacagcugguauuug

SEQ ID NO: 913964 - RNA, 19 nt, Homo sapiens
uuuggaagguuuaaucuga

SEQ ID NO: 913965 - RNA, 19 nt, Homo sapiens
gagguuagcccugaucaug

SEQ ID NO: 913966 - RNA, 19 nt, Homo sapiens
gccuuucacuugaggagua

SEQ ID NO: 913967 - RNA, 19 nt, Homo sapiens
acagcaauauguucacuau

SEQ ID NO: 913968 - RNA, 19 nt, Homo sapiens
guagcucccuuucuugcuu

SEQ ID NO: 913969 - RNA, 19 nt, Homo sapiens
uggaagguuuaaucugaua

SEQ ID NO: 913970 - RNA, 19 nt, Homo sapiens
gguuauugauguacuagau

SEQ ID NO: 913971 - RNA, 19 nt, Homo sapiens
ucugguagcucccuuucuu

SEQ ID NO: 913972 - RNA, 19 nt, Homo sapiens
uaaggagacccuauauuca

SEQ ID NO: 913973 - RNA, 19 nt, Homo sapiens
agcaauauguucacuaugu

SEQ ID NO: 913974 - RNA, 19 nt, Homo sapiens
ccagugcucagauguguuu

SEQ ID NO: 913975 - RNA, 19 nt, Homo sapiens
uaagaauaauguccugagu

SEQ ID NO: 913976 - RNA, 19 nt, Homo sapiens
aaacagcugguauuuguau

SEQ ID NO: 913977 - RNA, 19 nt, Homo sapiens
gcuggaacuuggagugaga

SEQ ID NO: 913978 - RNA, 19 nt, Homo sapiens
ccacggcauuccgaaguuu

SEQ ID NO: 913979 - RNA, 19 nt, Homo sapiens
aguggaaucuacuuucauu

SEQ ID NO: 913980 - RNA, 19 nt, Homo sapiens
caguaaugcugccguuguu

SEQ ID NO: 913981 - RNA, 19 nt, Homo sapiens
uuaccaguauucugccuaa

SEQ ID NO: 913982 - RNA, 19 nt, Homo sapiens
gaaugauguucuguagaga

SEQ ID NO: 913983 - RNA, 19 nt, Homo sapiens
ucacuauguuaccaauuug

SEQ ID NO: 913984 - RNA, 19 nt, Homo sapiens
cagcugguauuuguaucua

SEQ ID NO: 913985 - RNA, 19 nt, Homo sapiens
aaugugcaguuaauacuug

SEQ ID NO: 913986 - RNA, 19 nt, Homo sapiens
caacauagcgagaccucau

SEQ ID NO: 913987 - RNA, 19 nt, Homo sapiens
gaaugaccuuaucuguuuc

SEQ ID NO: 913988 - RNA, 19 nt, Homo sapiens
uaacacugagcuaaagaaa

SEQ ID NO: 913989 - RNA, 19 nt, Homo sapiens
ugauuaacauugacaggau

SEQ ID NO: 913990 - RNA, 19 nt, Homo sapiens
caacuugugcuucaauagu

SEQ ID NO: 913991 - RNA, 19 nt, Homo sapiens
aaguucaagugcucauaua

SEQ ID NO: 913992 - RNA, 19 nt, Homo sapiens
cuucugugaugguuauauu

SEQ ID NO: 913993 - RNA, 19 nt, Homo sapiens
gcuguagaguccaucuguu

SEQ ID NO: 913994 - RNA, 19 nt, Homo sapiens
aaaggaaugauguucugua

SEQ ID NO: 913995 - RNA, 19 nt, Homo sapiens
ccacagugucuuccucuga

SEQ ID NO: 913996 - RNA, 19 nt, Homo sapiens
caagugcucauauaacaca

SEQ ID NO: 913997 - RNA, 19 nt, Homo sapiens
gaacucuuacugguagaaa

SEQ ID NO: 913998 - RNA, 19 nt, Homo sapiens
ggagaauugagaauaguca

SEQ ID NO: 913999 - RNA, 19 nt, Homo sapiens
gcaccagaacccugucuuc

SEQ ID NO: 914000 - RNA, 19 nt, Homo sapiens
gcagugcccugugguugca

SEQ ID NO: 914001 - RNA, 19 nt, Homo sapiens
guuaccaauuugcaacuug

SEQ ID NO: 914002 - RNA, 19 nt, Homo sapiens
uuugggcuguugccacuua

SEQ ID NO: 914003 - RNA, 19 nt, Homo sapiens
caauaguggaaucuacuuu

SEQ ID NO: 914004 - RNA, 19 nt, Homo sapiens
uaugacaccuugaaaaguu

SEQ ID NO: 914005 - RNA, 19 nt, Homo sapiens
gagugagacacacaucauu

SEQ ID NO: 914006 - RNA, 19 nt, Homo sapiens
ggagugagacacacaucau

SEQ ID NO: 914007 - RNA, 19 nt, Homo sapiens
aaacucagauuggucacau

SEQ ID NO: 914008 - RNA, 19 nt, Homo sapiens
gccuaucagucucacagaa

SEQ ID NO: 914009 - RNA, 19 nt, Homo sapiens
cuguagagauggccuuuca

SEQ ID NO: 914010 - RNA, 19 nt, Homo sapiens
aaggaaugauguucuguag

SEQ ID NO: 914011 - RNA, 19 nt, Homo sapiens
uucaagugcucauauaaca

SEQ ID NO: 914012 - RNA, 19 nt, Homo sapiens
ccugaaauggaaauucuuu

SEQ ID NO: 914013 - RNA, 19 nt, Homo sapiens
gccacggcauuccgaaguu

SEQ ID NO: 914014 - RNA, 19 nt, Homo sapiens
cuuuaaagauuggagaaga

SEQ ID NO: 914015 - RNA, 19 nt, Homo sapiens
agacauuacugagcaccuu

SEQ ID NO: 914016 - RNA, 19 nt, Homo sapiens
gaagguuuaaucugauauc

SEQ ID NO: 914017 - RNA, 19 nt, Homo sapiens
ucagggaaguugcgugaac

SEQ ID NO: 914018 - RNA, 19 nt, Homo sapiens
auaguggaaucuacuuuca

SEQ ID NO: 914019 - RNA, 19 nt, Homo sapiens
guucuaguuucaccuuaca

SEQ ID NO: 914020 - RNA, 19 nt, Homo sapiens
caguucuaguuucaccuua

SEQ ID NO: 914021 - RNA, 19 nt, Homo sapiens
gccuaacguuugcuucugu

SEQ ID NO: 914022 - RNA, 19 nt, Homo sapiens
ccaguauucugccuaacgu

SEQ ID NO: 914023 - RNA, 19 nt, Homo sapiens
uagcucccuuucuugcuuu

SEQ ID NO: 914024 - RNA, 19 nt, Homo sapiens
guagaguccaucuguuugu

SEQ ID NO: 914025 - RNA, 19 nt, Homo sapiens
ccacagugaugucaagguu

SEQ ID NO: 914026 - RNA, 19 nt, Homo sapiens
gaucauguuguauaaguga

SEQ ID NO: 914027 - RNA, 19 nt, Homo sapiens
cuagaagcauuugggagua

SEQ ID NO: 914028 - RNA, 19 nt, Homo sapiens
gaaccagaccacccugaug

SEQ ID NO: 914029 - RNA, 19 nt, Homo sapiens
guacaucguuguuuugugu

SEQ ID NO: 914030 - RNA, 19 nt, Homo sapiens
gcuggacucuggccacaca

SEQ ID NO: 914031 - RNA, 19 nt, Homo sapiens
gagcauauuuccccucugu

SEQ ID NO: 914032 - RNA, 19 nt, Homo sapiens
ggaucauguuguauaagug

SEQ ID NO: 914033 - RNA, 19 nt, Homo sapiens
uggaucauguuguauaagu

SEQ ID NO: 914034 - RNA, 19 nt, Homo sapiens
uggaaacaagccagucuuu

SEQ ID NO: 914035 - RNA, 19 nt, Homo sapiens
ggaaacaagccagucuuuu

SEQ ID NO: 914036 - RNA, 19 nt, Homo sapiens
uagaagcauuugggaguag

SEQ ID NO: 914037 - RNA, 19 nt, Homo sapiens
uggguggacuagaagcauu

SEQ ID NO: 914038 - RNA, 19 nt, Homo sapiens
gaagggguuuucccaugga

SEQ ID NO: 914039 - RNA, 19 nt, Homo sapiens
ggguggacuagaagcauuu

SEQ ID NO: 914040 - RNA, 19 nt, Homo sapiens
guugaccaagagcauauuu

SEQ ID NO: 914041 - RNA, 19 nt, Homo sapiens
caaauaaacuugguacgua

SEQ ID NO: 914042 - RNA, 19 nt, Homo sapiens
gcauauaucucuucugauc

SEQ ID NO: 914043 - RNA, 19 nt, Homo sapiens
ggaaagaaacuucgggaaa

SEQ ID NO: 914044 - RNA, 19 nt, Homo sapiens
guaauaacccaguggcuua

SEQ ID NO: 914045 - RNA, 19 nt, Homo sapiens
gaaagucaugguccaaaua

SEQ ID NO: 914046 - RNA, 19 nt, Homo sapiens
gaagaaaguagauaccauu

SEQ ID NO: 914047 - RNA, 19 nt, Homo sapiens
gaaagaaacuucgggaaaa

SEQ ID NO: 914048 - RNA, 19 nt, Homo sapiens
gaaaagaaaucccaguaug

SEQ ID NO: 914049 - RNA, 19 nt, Homo sapiens
cuauaagccuaaucucaua

SEQ ID NO: 914050 - RNA, 19 nt, Homo sapiens
cuaauacugugaauucuug

SEQ ID NO: 914051 - RNA, 19 nt, Homo sapiens
cugaugagaugaaggcaua

SEQ ID NO: 914052 - RNA, 19 nt, Homo sapiens
gaaaggccauuagggaaca

SEQ ID NO: 914053 - RNA, 19 nt, Homo sapiens
aggcauauaucucuucuga

SEQ ID NO: 914054 - RNA, 19 nt, Homo sapiens
caaauuagaacaggaaguu

SEQ ID NO: 914055 - RNA, 19 nt, Homo sapiens
gagccauucuuuauuaagu

SEQ ID NO: 914056 - RNA, 19 nt, Homo sapiens
agccuaaucucauaaugua

SEQ ID NO: 914057 - RNA, 19 nt, Homo sapiens
aaauacugcugaacaagaa

SEQ ID NO: 914058 - RNA, 19 nt, Homo sapiens
caacaaagccaaacuucca

SEQ ID NO: 914059 - RNA, 19 nt, Homo sapiens
cagcaggccucgaaagcaa

SEQ ID NO: 914060 - RNA, 19 nt, Homo sapiens
cgaaagcaaucgguccaaa

SEQ ID NO: 914061 - RNA, 19 nt, Homo sapiens
gaaagcaaucgguccaaau

SEQ ID NO: 914062 - RNA, 19 nt, Homo sapiens
acuaauaucucuuguucug

SEQ ID NO: 914063 - RNA, 19 nt, Homo sapiens
gaugaaggcauauaucucu

SEQ ID NO: 914064 - RNA, 19 nt, Homo sapiens
gauuaagaaccuagaaguu

SEQ ID NO: 914065 - RNA, 19 nt, Homo sapiens
gcuauaagccuaaucucau

SEQ ID NO: 914066 - RNA, 19 nt, Homo sapiens
gaacaggaaguuagaagac

SEQ ID NO: 914067 - RNA, 19 nt, Homo sapiens
gcaaauaaacuugguacgu

SEQ ID NO: 914068 - RNA, 19 nt, Homo sapiens
gaauucuugugucaucguu

SEQ ID NO: 914069 - RNA, 19 nt, Homo sapiens
ggcgugauuuggaacaauu

SEQ ID NO: 914070 - RNA, 19 nt, Homo sapiens
gcaaucgguccaaauuaga

SEQ ID NO: 914071 - RNA, 19 nt, Homo sapiens
aaagcaaucgguccaaauu

SEQ ID NO: 914072 - RNA, 19 nt, Homo sapiens
ggagugugaugaaaagaaa

SEQ ID NO: 914073 - RNA, 19 nt, Homo sapiens
ggaacuaauaucucuuguu

SEQ ID NO: 914074 - RNA, 19 nt, Homo sapiens
gagaaagucaugguccaaa

SEQ ID NO: 914075 - RNA, 19 nt, Homo sapiens
agaaagucaugguccaaau

SEQ ID NO: 914076 - RNA, 19 nt, Homo sapiens
gaugagaugaaggcauaua

SEQ ID NO: 914077 - RNA, 19 nt, Homo sapiens
gaagacuccgugaagaaug

SEQ ID NO: 914078 - RNA, 19 nt, Homo sapiens
guucagcaguuccuacagu

SEQ ID NO: 914079 - RNA, 19 nt, Homo sapiens
aaacaacaaagccaaacuu

SEQ ID NO: 914080 - RNA, 19 nt, Homo sapiens
ccaaauaugaaacaagcaa

SEQ ID NO: 914081 - RNA, 19 nt, Homo sapiens
uagaagacuccgugaagaa

SEQ ID NO: 914082 - RNA, 19 nt, Homo sapiens
uuagaagacuccgugaaga

SEQ ID NO: 914083 - RNA, 19 nt, Homo sapiens
cggcuaauacugugaauuc

SEQ ID NO: 914084 - RNA, 19 nt, Homo sapiens
gccauuagggaacaguaua

SEQ ID NO: 914085 - RNA, 19 nt, Homo sapiens
aagcaaucgguccaaauua

SEQ ID NO: 914086 - RNA, 19 nt, Homo sapiens
agaaaucccaguaugauag

SEQ ID NO: 914087 - RNA, 19 nt, Homo sapiens
aagaaaucccaguaugaua

SEQ ID NO: 914088 - RNA, 19 nt, Homo sapiens
aaagaaaucccaguaugau

SEQ ID NO: 914089 - RNA, 19 nt, Homo sapiens
uaucucuucugaucaacaa

SEQ ID NO: 914090 - RNA, 19 nt, Homo sapiens
ucacuggcgucuucugagu

SEQ ID NO: 914091 - RNA, 19 nt, Homo sapiens
cuugauaccacuagcuaua

SEQ ID NO: 914092 - RNA, 19 nt, Homo sapiens
gcuaauacugugaauucuu

SEQ ID NO: 914093 - RNA, 19 nt, Homo sapiens
caaagccaaacuuccauug

SEQ ID NO: 914094 - RNA, 19 nt, Homo sapiens
gaggaccggcuaauacugu

SEQ ID NO: 914095 - RNA, 19 nt, Homo sapiens
agaagaaaguagauaccau

SEQ ID NO: 914096 - RNA, 19 nt, Homo sapiens
gguacguauuucauaucua

SEQ ID NO: 914097 - RNA, 19 nt, Homo sapiens
gaaacaacaaagccaaacu

SEQ ID NO: 914098 - RNA, 19 nt, Homo sapiens
aaagucaugguccaaauau

SEQ ID NO: 914099 - RNA, 19 nt, Homo sapiens
aagaaaaccuuggaaagaa

SEQ ID NO: 914100 - RNA, 19 nt, Homo sapiens
uaagccuaaucucauaaug

SEQ ID NO: 914101 - RNA, 19 nt, Homo sapiens
guuagaagacuccgugaag

SEQ ID NO: 914102 - RNA, 19 nt, Homo sapiens
cuugguacguauuucauau

SEQ ID NO: 914103 - RNA, 19 nt, Homo sapiens
acuggcgucuucugaguuu

SEQ ID NO: 914104 - RNA, 19 nt, Homo sapiens
caaucgguccaaauuagaa

SEQ ID NO: 914105 - RNA, 19 nt, Homo sapiens
agcaaucgguccaaauuag

SEQ ID NO: 914106 - RNA, 19 nt, Homo sapiens
aaacuugguacguauuuca

SEQ ID NO: 914107 - RNA, 19 nt, Homo sapiens
ccacuagcuauaagccuaa

SEQ ID NO: 914108 - RNA, 19 nt, Homo sapiens
gaaacauuuaucugacguu

SEQ ID NO: 914109 - RNA, 19 nt, Homo sapiens
ugugaauucuugugucauc

SEQ ID NO: 914110 - RNA, 19 nt, Homo sapiens
uggaacaauuaauggaaug

SEQ ID NO: 914111 - RNA, 19 nt, Homo sapiens
aauguggcgugauuuggaa

SEQ ID NO: 914112 - RNA, 19 nt, Homo sapiens
aagacuccgugaagaaugu

SEQ ID NO: 914113 - RNA, 19 nt, Homo sapiens
uaaacuugguacguauuuc

SEQ ID NO: 914114 - RNA, 19 nt, Homo sapiens
agaaaaccuuggaaagaaa

SEQ ID NO: 914115 - RNA, 19 nt, Homo sapiens
uaggaacuaauaucucuug

SEQ ID NO: 914116 - RNA, 19 nt, Homo sapiens
caucacuggcgucuucuga

SEQ ID NO: 914117 - RNA, 19 nt, Homo sapiens
uuaugagacaggaaacuaa

SEQ ID NO: 914118 - RNA, 19 nt, Homo sapiens
guucaacuucgucgugcua

SEQ ID NO: 914119 - RNA, 19 nt, Homo sapiens
aaaagaaaucccaguauga

SEQ ID NO: 914120 - RNA, 19 nt, Homo sapiens
aaaggcaaauaaacuuggu

SEQ ID NO: 914121 - RNA, 19 nt, Homo sapiens
ugacuaacaugucuuuucu

SEQ ID NO: 914122 - RNA, 19 nt, Homo sapiens
ugauaccacuagcuauaag

SEQ ID NO: 914123 - RNA, 19 nt, Homo sapiens
gcagcaggccucgaaagca

SEQ ID NO: 914124 - RNA, 19 nt, Homo sapiens
acugugaauucuuguguca

SEQ ID NO: 914125 - RNA, 19 nt, Homo sapiens
ggaggaccggcuaauacug

SEQ ID NO: 914126 - RNA, 19 nt, Homo sapiens
gcgugauuuggaacaauua

SEQ ID NO: 914127 - RNA, 19 nt, Homo sapiens
uuagggaacaguauaccaa

SEQ ID NO: 914128 - RNA, 19 nt, Homo sapiens
uuccauaguuuagacauca

SEQ ID NO: 914129 - RNA, 19 nt, Homo sapiens
ccauuggucagguaauuca

SEQ ID NO: 914130 - RNA, 19 nt, Homo sapiens
ggaacaauuaauggaaugu

SEQ ID NO: 914131 - RNA, 19 nt, Homo sapiens
aaaguuauacgagaaaguc

SEQ ID NO: 914132 - RNA, 19 nt, Homo sapiens
agaacaggaaguuagaaga

SEQ ID NO: 914133 - RNA, 19 nt, Homo sapiens
gcauuuuguuuucagaaga

SEQ ID NO: 914134 - RNA, 19 nt, Homo sapiens
gggaggaccggcuaauacu

SEQ ID NO: 914135 - RNA, 19 nt, Homo sapiens
ugauuaagaaccuagaagu

SEQ ID NO: 914136 - RNA, 19 nt, Homo sapiens
gaaaucccaguaugauagc

SEQ ID NO: 914137 - RNA, 19 nt, Homo sapiens
caacuucgucgugcuacug

SEQ ID NO: 914138 - RNA, 19 nt, Homo sapiens
uagggaacaguauaccaaa

SEQ ID NO: 914139 - RNA, 19 nt, Homo sapiens
auucuugugucaucguuug

SEQ ID NO: 914140 - RNA, 19 nt, Homo sapiens
guccaaauuagaacaggaa

SEQ ID NO: 914141 - RNA, 19 nt, Homo sapiens
gauuaugccuggaguauua

SEQ ID NO: 914142 - RNA, 19 nt, Homo sapiens
caacaggcaucuaucauuu

SEQ ID NO: 914143 - RNA, 19 nt, Homo sapiens
guacaaaccuucaggaaau

SEQ ID NO: 914144 - RNA, 19 nt, Homo sapiens
gaaauuaaccaguugauug

SEQ ID NO: 914145 - RNA, 19 nt, Homo sapiens
caaagcaacuuguggauau

SEQ ID NO: 914146 - RNA, 19 nt, Homo sapiens
uaagagaguugaacauuug

SEQ ID NO: 914147 - RNA, 19 nt, Homo sapiens
ccacagauaugaguacuuu

SEQ ID NO: 914148 - RNA, 19 nt, Homo sapiens
ggaaguaaaccuguaauuu

SEQ ID NO: 914149 - RNA, 19 nt, Homo sapiens
acagaaagcuggaagaaau

SEQ ID NO: 914150 - RNA, 19 nt, Homo sapiens
ggcaaacucucacuguaua

SEQ ID NO: 914151 - RNA, 19 nt, Homo sapiens
gcagaaauaagaaaggaua

SEQ ID NO: 914152 - RNA, 19 nt, Homo sapiens
ugaaacacaugauggaauu

SEQ ID NO: 914153 - RNA, 19 nt, Homo sapiens
gaaaggauaucagugcaau

SEQ ID NO: 914154 - RNA, 19 nt, Homo sapiens
guagagucaucaauaguuu

SEQ ID NO: 914155 - RNA, 19 nt, Homo sapiens
acacagaaauuaaccaguu

SEQ ID NO: 914156 - RNA, 19 nt, Homo sapiens
agaaaggucugcuugcaaa

SEQ ID NO: 914157 - RNA, 19 nt, Homo sapiens
gauguggucucacuauguu

SEQ ID NO: 914158 - RNA, 19 nt, Homo sapiens
ggauaucagugcaauggaa

SEQ ID NO: 914159 - RNA, 19 nt, Homo sapiens
ggaaaugccacagauauga

SEQ ID NO: 914160 - RNA, 19 nt, Homo sapiens
gaaugugccuagaugauca

SEQ ID NO: 914161 - RNA, 19 nt, Homo sapiens
gaaaucagacccgugaauu

SEQ ID NO: 914162 - RNA, 19 nt, Homo sapiens
gaaccaggaguuggauuua

SEQ ID NO: 914163 - RNA, 19 nt, Homo sapiens
ugcaaagccugaaaguuua

SEQ ID NO: 914164 - RNA, 19 nt, Homo sapiens
gagagaagcaucaguaaag

SEQ ID NO: 914165 - RNA, 19 nt, Homo sapiens
gcaacaggcaucuaucauu

SEQ ID NO: 914166 - RNA, 19 nt, Homo sapiens
gaugaucagcuccuaguaa

SEQ ID NO: 914167 - RNA, 19 nt, Homo sapiens
gaaguuagccagccuagag

SEQ ID NO: 914168 - RNA, 19 nt, Homo sapiens
ccaauaaacaguaugaaga

SEQ ID NO: 914169 - RNA, 19 nt, Homo sapiens
gcagacagccaaacgaaug

SEQ ID NO: 914170 - RNA, 19 nt, Homo sapiens
ugaagagugugcuuuaugu

SEQ ID NO: 914171 - RNA, 19 nt, Homo sapiens
ccugaaaguuuaaugaaga

SEQ ID NO: 914172 - RNA, 19 nt, Homo sapiens
gaaagacacagugggaauu

SEQ ID NO: 914173 - RNA, 19 nt, Homo sapiens
ggagugcgguggugugauc

SEQ ID NO: 914174 - RNA, 19 nt, Homo sapiens
ggacuaaugaacugaagaa

SEQ ID NO: 914175 - RNA, 19 nt, Homo sapiens
agacugcuaucccuagaaa

SEQ ID NO: 914176 - RNA, 19 nt, Homo sapiens
gauaaaggaucugagacau

SEQ ID NO: 914177 - RNA, 19 nt, Homo sapiens
gauuggaaguaaaccugua

SEQ ID NO: 914178 - RNA, 19 nt, Homo sapiens
gaacacgcacguccugguu

SEQ ID NO: 914179 - RNA, 19 nt, Homo sapiens
caccuugccuaaaguauau

SEQ ID NO: 914180 - RNA, 19 nt, Homo sapiens
gcaaagccugaaaguuuaa

SEQ ID NO: 914181 - RNA, 19 nt, Homo sapiens
augcaaagccugaaaguuu

SEQ ID NO: 914182 - RNA, 19 nt, Homo sapiens
caacagaaacaggaacaaa

SEQ ID NO: 914183 - RNA, 19 nt, Homo sapiens
gaguugaacauuugaagaa

SEQ ID NO: 914184 - RNA, 19 nt, Homo sapiens
gugaguuucuucaggauga

SEQ ID NO: 914185 - RNA, 19 nt, Homo sapiens
gcuguagagucaucaauag

SEQ ID NO: 914186 - RNA, 19 nt, Homo sapiens
gagagagaagcaucaguaa

SEQ ID NO: 914187 - RNA, 19 nt, Homo sapiens
caagauaucuggauuuucu

SEQ ID NO: 914188 - RNA, 19 nt, Homo sapiens
uggcugagauugacccaaa

SEQ ID NO: 914189 - RNA, 19 nt, Homo sapiens
gcgacucguuugugguuaa

SEQ ID NO: 914190 - RNA, 19 nt, Homo sapiens
gagcagacagccaaacgaa

SEQ ID NO: 914191 - RNA, 19 nt, Homo sapiens
ggagccaaugcaacuauua

SEQ ID NO: 914192 - RNA, 19 nt, Homo sapiens
guggugugaucauggcuua

SEQ ID NO: 914193 - RNA, 19 nt, Homo sapiens
ugaauuugaugguacugaa

SEQ ID NO: 914194 - RNA, 19 nt, Homo sapiens
gaaggcaaacucucacugu

SEQ ID NO: 914195 - RNA, 19 nt, Homo sapiens
gaaaaggaucagcucauua

SEQ ID NO: 914196 - RNA, 19 nt, Homo sapiens
ugacaccaauaaacaguau

SEQ ID NO: 914197 - RNA, 19 nt, Homo sapiens
gaaaagagcauauuuagcu

SEQ ID NO: 914198 - RNA, 19 nt, Homo sapiens
gaaacacaugauggaauua

SEQ ID NO: 914199 - RNA, 19 nt, Homo sapiens
agaaauagucaaccugaaa

SEQ ID NO: 914200 - RNA, 19 nt, Homo sapiens
agagagagaagcaucagua

SEQ ID NO: 914201 - RNA, 19 nt, Homo sapiens
caucuaucauuucccguaa

SEQ ID NO: 914202 - RNA, 19 nt, Homo sapiens
gaaaagaugguguucagaa

SEQ ID NO: 914203 - RNA, 19 nt, Homo sapiens
cagaaagcuggaagaaaua

SEQ ID NO: 914204 - RNA, 19 nt, Homo sapiens
aagcaucaguaaagagaaa

SEQ ID NO: 914205 - RNA, 19 nt, Homo sapiens
cagcagaaauaagaaagga

SEQ ID NO: 914206 - RNA, 19 nt, Homo sapiens
acacaucaucuguuacuaa

SEQ ID NO: 914207 - RNA, 19 nt, Homo sapiens
gagccaccaugcccagcua

SEQ ID NO: 914208 - RNA, 19 nt, Homo sapiens
ucagaggacuaaugaacug

SEQ ID NO: 914209 - RNA, 19 nt, Homo sapiens
uauuacaaguucucaguga

SEQ ID NO: 914210 - RNA, 19 nt, Homo sapiens
caaugcaacuauuacaagu

SEQ ID NO: 914211 - RNA, 19 nt, Homo sapiens
caccaugcccagcuaauuu

SEQ ID NO: 914212 - RNA, 19 nt, Homo sapiens
ucagugcaauggaagaaga

SEQ ID NO: 914213 - RNA, 19 nt, Homo sapiens
ccaaagcaacuuguggaua

SEQ ID NO: 914214 - RNA, 19 nt, Homo sapiens
ucaccuugccuaaaguaua

SEQ ID NO: 914215 - RNA, 19 nt, Homo sapiens
cgguuucucucccaaauug

SEQ ID NO: 914216 - RNA, 19 nt, Homo sapiens
guaugaagaguuaauggaa

SEQ ID NO: 914217 - RNA, 19 nt, Homo sapiens
aaggcaaacucucacugua

SEQ ID NO: 914218 - RNA, 19 nt, Homo sapiens
guacaaaaccagcugaaaa

SEQ ID NO: 914219 - RNA, 19 nt, Homo sapiens
gcucaagauaucuggauuu

SEQ ID NO: 914220 - RNA, 19 nt, Homo sapiens
caggaaaugccacagauau

SEQ ID NO: 914221 - RNA, 19 nt, Homo sapiens
uaagcugacuugccugaca

SEQ ID NO: 914222 - RNA, 19 nt, Homo sapiens
guaauuacuauacccaguu

SEQ ID NO: 914223 - RNA, 19 nt, Homo sapiens
agagaagcaucaguaaaga

SEQ ID NO: 914224 - RNA, 19 nt, Homo sapiens
acacagugggaauugauua

SEQ ID NO: 914225 - RNA, 19 nt, Homo sapiens
gaaauagucaaccugaaac

SEQ ID NO: 914226 - RNA, 19 nt, Homo sapiens
cuaaugaacugaagaaaag

SEQ ID NO: 914227 - RNA, 19 nt, Homo sapiens
augaucagcuccuaguaaa

SEQ ID NO: 914228 - RNA, 19 nt, Homo sapiens
gcagaaugugccuagauga

SEQ ID NO: 914229 - RNA, 19 nt, Homo sapiens
gcgccuggcuguaauuacu

SEQ ID NO: 914230 - RNA, 19 nt, Homo sapiens
cacagaaauuaaccaguug

SEQ ID NO: 914231 - RNA, 19 nt, Homo sapiens
gcagaugcaaagccugaaa

SEQ ID NO: 914232 - RNA, 19 nt, Homo sapiens
gaauaucuugcacaacaga

SEQ ID NO: 914233 - RNA, 19 nt, Homo sapiens
ugagguaccaagugaguuu

SEQ ID NO: 914234 - RNA, 19 nt, Homo sapiens
gauaagaauggcucaccuu

SEQ ID NO: 914235 - RNA, 19 nt, Homo sapiens
aucaauaguuugcacauga

SEQ ID NO: 914236 - RNA, 19 nt, Homo sapiens
ccugcuugcuugccucuuu

SEQ ID NO: 914237 - RNA, 19 nt, Homo sapiens
acaaaagacuagagaaaga

SEQ ID NO: 914238 - RNA, 19 nt, Homo sapiens
gacagaaagcuggaagaaa

SEQ ID NO: 914239 - RNA, 19 nt, Homo sapiens
aaucagacccgugaauuug

SEQ ID NO: 914240 - RNA, 19 nt, Homo sapiens
agccaaagcugaggaacuu

SEQ ID NO: 914241 - RNA, 19 nt, Homo sapiens
gcacagauauuuggaauuu

SEQ ID NO: 914242 - RNA, 19 nt, Homo sapiens
gcaauugccuucaaagaaa

SEQ ID NO: 914243 - RNA, 19 nt, Homo sapiens
gaagagaaaggcaaaguua

SEQ ID NO: 914244 - RNA, 19 nt, Homo sapiens
gaagaguacuccuauaaga

SEQ ID NO: 914245 - RNA, 19 nt, Homo sapiens
caaacagacuacccugaua

SEQ ID NO: 914246 - RNA, 19 nt, Homo sapiens
gaggagaccuucaucuguu

SEQ ID NO: 914247 - RNA, 19 nt, Homo sapiens
ggaauaaacacacuuacuu

SEQ ID NO: 914248 - RNA, 19 nt, Homo sapiens
gugcuuggcuucuucauga

SEQ ID NO: 914249 - RNA, 19 nt, Homo sapiens
caaaucuccuggcuuguaa

SEQ ID NO: 914250 - RNA, 19 nt, Homo sapiens
ugaaaucacuuacccugaa

SEQ ID NO: 914251 - RNA, 19 nt, Homo sapiens
uaucaugacuggugccuuu

SEQ ID NO: 914252 - RNA, 19 nt, Homo sapiens
aaggaaagcucacaucaga

SEQ ID NO: 914253 - RNA, 19 nt, Homo sapiens
gaauaaacacacuuacuug

SEQ ID NO: 914254 - RNA, 19 nt, Homo sapiens
uaacagcaauugccuucaa

SEQ ID NO: 914255 - RNA, 19 nt, Homo sapiens
ucacuuacccugaaucuga

SEQ ID NO: 914256 - RNA, 19 nt, Homo sapiens
gaaaucacuuacccugaau

SEQ ID NO: 914257 - RNA, 19 nt, Homo sapiens
gcuuauggcuggauuauac

SEQ ID NO: 914258 - RNA, 19 nt, Homo sapiens
gaucauccuuggagagaga

SEQ ID NO: 914259 - RNA, 19 nt, Homo sapiens
cgaagacacaacauaaaua

SEQ ID NO: 914260 - RNA, 19 nt, Homo sapiens
caccaaggcuggguuugua

SEQ ID NO: 914261 - RNA, 19 nt, Homo sapiens
cagcauuaaucaagucuga

SEQ ID NO: 914262 - RNA, 19 nt, Homo sapiens
gcagucagaaucagcaauu

SEQ ID NO: 914263 - RNA, 19 nt, Homo sapiens
cauuggaccuuagauauau

SEQ ID NO: 914264 - RNA, 19 nt, Homo sapiens
gaucacuuaugguaucaug

SEQ ID NO: 914265 - RNA, 19 nt, Homo sapiens
gcgaagacacaacauaaau

SEQ ID NO: 914266 - RNA, 19 nt, Homo sapiens
caucuggucuucuuaaugc

SEQ ID NO: 914267 - RNA, 19 nt, Homo sapiens
ggaggagaccuucaucugu

SEQ ID NO: 914268 - RNA, 19 nt, Homo sapiens
ucacauuggaccuuagaua

SEQ ID NO: 914269 - RNA, 19 nt, Homo sapiens
ucagcaauuugaagagaaa

SEQ ID NO: 914270 - RNA, 19 nt, Homo sapiens
ccacagaccaagaaccaaa

SEQ ID NO: 914271 - RNA, 19 nt, Homo sapiens
uaacagcauuaaucaaguc

SEQ ID NO: 914272 - RNA, 19 nt, Homo sapiens
cacauuggcucaaggaaag

SEQ ID NO: 914273 - RNA, 19 nt, Homo sapiens
guugaucacuuaugguauc

SEQ ID NO: 914274 - RNA, 19 nt, Homo sapiens
acacacagaaugacacaaa

SEQ ID NO: 914275 - RNA, 19 nt, Homo sapiens
agucaaugcuggaaggauu

SEQ ID NO: 914276 - RNA, 19 nt, Homo sapiens
aaagagguguccacagcuu

SEQ ID NO: 914277 - RNA, 19 nt, Homo sapiens
ggaaagcucacaucagacu

SEQ ID NO: 914278 - RNA, 19 nt, Homo sapiens
ggauugggcuaacgcuagu

SEQ ID NO: 914279 - RNA, 19 nt, Homo sapiens
agaguacuccuauaagaaa

SEQ ID NO: 914280 - RNA, 19 nt, Homo sapiens
cugaagaguacuccuauaa

SEQ ID NO: 914281 - RNA, 19 nt, Homo sapiens
acauuggaccuuagauaua

SEQ ID NO: 914282 - RNA, 19 nt, Homo sapiens
ggaaugguuaucuuuacuu

SEQ ID NO: 914283 - RNA, 19 nt, Homo sapiens
ggugggcucuauucuuugu

SEQ ID NO: 914284 - RNA, 19 nt, Homo sapiens
auggugggcucuauucuuu

SEQ ID NO: 914285 - RNA, 19 nt, Homo sapiens
gaagaagucaaugcuggaa

SEQ ID NO: 914286 - RNA, 19 nt, Homo sapiens
ccugaagaguacuccuaua

SEQ ID NO: 914287 - RNA, 19 nt, Homo sapiens
guacuccuauaagaaauca

SEQ ID NO: 914288 - RNA, 19 nt, Homo sapiens
uaauaucagcaccauguuu

SEQ ID NO: 914289 - RNA, 19 nt, Homo sapiens
ucacauuggcucaaggaaa

SEQ ID NO: 914290 - RNA, 19 nt, Homo sapiens
gucagaaucagcaauuuga

SEQ ID NO: 914291 - RNA, 19 nt, Homo sapiens
ggaauuacaaauguugaug

SEQ ID NO: 914292 - RNA, 19 nt, Homo sapiens
gcaccaaggcuggguuugu

SEQ ID NO: 914293 - RNA, 19 nt, Homo sapiens
aaucagcaauuugaagaga

SEQ ID NO: 914294 - RNA, 19 nt, Homo sapiens
ucuccuggcuuguaauauc

SEQ ID NO: 914295 - RNA, 19 nt, Homo sapiens
agaaucagcaauuugaaga

SEQ ID NO: 914296 - RNA, 19 nt, Homo sapiens
gaaagcucacaucagacua

SEQ ID NO: 914297 - RNA, 19 nt, Homo sapiens
cacauuggaccuuagauau

SEQ ID NO: 914298 - RNA, 19 nt, Homo sapiens
gaguacuccuauaagaaau

SEQ ID NO: 914299 - RNA, 19 nt, Homo sapiens
uguaauaucagcaccaugu

SEQ ID NO: 914300 - RNA, 19 nt, Homo sapiens
cugcgaagacacaacauaa

SEQ ID NO: 914301 - RNA, 19 nt, Homo sapiens
gaucugcgaagacacaaca

SEQ ID NO: 914302 - RNA, 19 nt, Homo sapiens
ucaaggaaagcucacauca

SEQ ID NO: 914303 - RNA, 19 nt, Homo sapiens
gcuucuucaugacugguua

SEQ ID NO: 914304 - RNA, 19 nt, Homo sapiens
aaaccucgguauccaccaa

SEQ ID NO: 914305 - RNA, 19 nt, Homo sapiens
gagcaccaaggcuggguuu

SEQ ID NO: 914306 - RNA, 19 nt, Homo sapiens
agagagaugugagcaccaa

SEQ ID NO: 914307 - RNA, 19 nt, Homo sapiens
gagaaaggcaaaguuacug

SEQ ID NO: 914308 - RNA, 19 nt, Homo sapiens
ugaagagaaaggcaaaguu

SEQ ID NO: 914309 - RNA, 19 nt, Homo sapiens
gacacaacauaaauauagg

SEQ ID NO: 914310 - RNA, 19 nt, Homo sapiens
gggaggagaccuucaucug

SEQ ID NO: 914311 - RNA, 19 nt, Homo sapiens
cagcaauugccuucaaaga

SEQ ID NO: 914312 - RNA, 19 nt, Homo sapiens
guacccaacacacagaaug

SEQ ID NO: 914313 - RNA, 19 nt, Homo sapiens
ggcaucauauuaacagcau

SEQ ID NO: 914314 - RNA, 19 nt, Homo sapiens
ccuaaggcagggaacauuu

SEQ ID NO: 914315 - RNA, 19 nt, Homo sapiens
aaacagacuacccugauag

SEQ ID NO: 914316 - RNA, 19 nt, Homo sapiens
caucagcuguugccacacu

SEQ ID NO: 914317 - RNA, 19 nt, Homo sapiens
ucaccuugcugcacaucga

SEQ ID NO: 914318 - RNA, 19 nt, Homo sapiens
ugagggagaagaagucaau

SEQ ID NO: 914319 - RNA, 19 nt, Homo sapiens
gauccaguacagcaucauu

SEQ ID NO: 914320 - RNA, 19 nt, Homo sapiens
aagaguacuccuauaagaa

SEQ ID NO: 914321 - RNA, 19 nt, Homo sapiens
caagucugaucugcgaaga

SEQ ID NO: 914322 - RNA, 19 nt, Homo sapiens
cucugugucuggauguuua

SEQ ID NO: 914323 - RNA, 19 nt, Homo sapiens
cugcacagauauuuggaau

SEQ ID NO: 914324 - RNA, 19 nt, Homo sapiens
cuacccugauaguuuauau

SEQ ID NO: 914325 - RNA, 19 nt, Homo sapiens
aaacauacaaacagacuac

SEQ ID NO: 914326 - RNA, 19 nt, Homo sapiens
aaacauuccuuuuguccuu

SEQ ID NO: 914327 - RNA, 19 nt, Homo sapiens
caacacacagaaugacaca

SEQ ID NO: 914328 - RNA, 19 nt, Homo sapiens
cagucagaaucagcaauuu

SEQ ID NO: 914329 - RNA, 19 nt, Homo sapiens
uuuauucagucucaacguu

SEQ ID NO: 914330 - RNA, 19 nt, Homo sapiens
gggaauaaacacacuuacu

SEQ ID NO: 914331 - RNA, 19 nt, Homo sapiens
uuauucagucucaacguua

SEQ ID NO: 914332 - RNA, 19 nt, Homo sapiens
guccuucuguugaucacuu

SEQ ID NO: 914333 - RNA, 19 nt, Homo sapiens
cacacagaaugacacaaau

SEQ ID NO: 914334 - RNA, 19 nt, Homo sapiens
gcucacaucagacuauggu

SEQ ID NO: 914335 - RNA, 19 nt, Homo sapiens
acaaacagacuacccugau

SEQ ID NO: 914336 - RNA, 19 nt, Homo sapiens
gcuggaaggauugggcuaa

SEQ ID NO: 914337 - RNA, 19 nt, Homo sapiens
uauucagucucaacguuau

SEQ ID NO: 914338 - RNA, 19 nt, Homo sapiens
aacagcaauugccuucaaa

SEQ ID NO: 914339 - RNA, 19 nt, Homo sapiens
ggacaaugugaucauccuu

SEQ ID NO: 914340 - RNA, 19 nt, Homo sapiens
cacuuacccugaaucugaa

SEQ ID NO: 914341 - RNA, 19 nt, Homo sapiens
gcaaugaaccucaagcuua

SEQ ID NO: 914342 - RNA, 19 nt, Homo sapiens
gaaaugagccagagacuug

SEQ ID NO: 914343 - RNA, 19 nt, Homo sapiens
ggagcaaccuuaauuaaug

SEQ ID NO: 914344 - RNA, 19 nt, Homo sapiens
uaaaguagauccucacuca

SEQ ID NO: 914345 - RNA, 19 nt, Homo sapiens
gagaauaauuguccaugaa

SEQ ID NO: 914346 - RNA, 19 nt, Homo sapiens
ggagaauaauuguccauga

SEQ ID NO: 914347 - RNA, 19 nt, Homo sapiens
gaaacagacagcuaucuaa

SEQ ID NO: 914348 - RNA, 19 nt, Homo sapiens
gcucauaugcuguugauuu

SEQ ID NO: 914349 - RNA, 19 nt, Homo sapiens
gcagagaggcuucuaacaa

SEQ ID NO: 914350 - RNA, 19 nt, Homo sapiens
guuaugugcuggcuccuua

SEQ ID NO: 914351 - RNA, 19 nt, Homo sapiens
ugacugaucucaauaaacu

SEQ ID NO: 914352 - RNA, 19 nt, Homo sapiens
ggaagaauuugucaagucu

SEQ ID NO: 914353 - RNA, 19 nt, Homo sapiens
cauaugcuguugauuugua

SEQ ID NO: 914354 - RNA, 19 nt, Homo sapiens
cagagaggcuucuaacaau

SEQ ID NO: 914355 - RNA, 19 nt, Homo sapiens
cagauggacugcuuccuuu

SEQ ID NO: 914356 - RNA, 19 nt, Homo sapiens
gggacuggauuacuucaaa

SEQ ID NO: 914357 - RNA, 19 nt, Homo sapiens
guaccuugcuggaauagug

SEQ ID NO: 914358 - RNA, 19 nt, Homo sapiens
gcuguugauuuguagauuu

SEQ ID NO: 914359 - RNA, 19 nt, Homo sapiens
gggaagaauuugucaaguc

SEQ ID NO: 914360 - RNA, 19 nt, Homo sapiens
gagaggcuucuaacaauuu

SEQ ID NO: 914361 - RNA, 19 nt, Homo sapiens
cgccauaacuccuagaaug

SEQ ID NO: 914362 - RNA, 19 nt, Homo sapiens
gcauuggacucacuguuca

SEQ ID NO: 914363 - RNA, 19 nt, Homo sapiens
ggagaagacuugcaaaaca

SEQ ID NO: 914364 - RNA, 19 nt, Homo sapiens
caaugaaccucaagcuuac

SEQ ID NO: 914365 - RNA, 19 nt, Homo sapiens
gcugcaagaugcuguagga

SEQ ID NO: 914366 - RNA, 19 nt, Homo sapiens
gaagaccuacaauuacuau

SEQ ID NO: 914367 - RNA, 19 nt, Homo sapiens
aaacagacagcuaucuaaa

SEQ ID NO: 914368 - RNA, 19 nt, Homo sapiens
ucacaggacucuucauugc

SEQ ID NO: 914369 - RNA, 19 nt, Homo sapiens
caaaugcaguacauagagu

SEQ ID NO: 914370 - RNA, 19 nt, Homo sapiens
acagaagcauggaguguug

SEQ ID NO: 914371 - RNA, 19 nt, Homo sapiens
acagcuaucuaaaccauug

SEQ ID NO: 914372 - RNA, 19 nt, Homo sapiens
guagauccucacucaguua

SEQ ID NO: 914373 - RNA, 19 nt, Homo sapiens
caaguucagucaacagaag

SEQ ID NO: 914374 - RNA, 19 nt, Homo sapiens
ucaaccaggugaugugaug

SEQ ID NO: 914375 - RNA, 19 nt, Homo sapiens
cuacacaaaugcaguacau

SEQ ID NO: 914376 - RNA, 19 nt, Homo sapiens
caggugaugugauguuugu

SEQ ID NO: 914377 - RNA, 19 nt, Homo sapiens
ugaggauccugaaacugua

SEQ ID NO: 914378 - RNA, 19 nt, Homo sapiens
gagcaaccuuaauuaaugc

SEQ ID NO: 914379 - RNA, 19 nt, Homo sapiens
agucucagguuaucaaguu

SEQ ID NO: 914380 - RNA, 19 nt, Homo sapiens
agagaggcuucuaacaauu

SEQ ID NO: 914381 - RNA, 19 nt, Homo sapiens
gaaccucaagcuuacaaug

SEQ ID NO: 914382 - RNA, 19 nt, Homo sapiens
gcacaggugacucucauag

SEQ ID NO: 914383 - RNA, 19 nt, Homo sapiens
gauacagaauuggagaaga

SEQ ID NO: 914384 - RNA, 19 nt, Homo sapiens
acaaacacccaucacauga

SEQ ID NO: 914385 - RNA, 19 nt, Homo sapiens
gacagaaacagacagcuau

SEQ ID NO: 914386 - RNA, 19 nt, Homo sapiens
ggauguagaccucgaccuu

SEQ ID NO: 914387 - RNA, 19 nt, Homo sapiens
ugaugcauccuaugaguuu

SEQ ID NO: 914388 - RNA, 19 nt, Homo sapiens
guggagcaaccuuaauuaa

SEQ ID NO: 914389 - RNA, 19 nt, Homo sapiens
gaucguuggugggacagaa

SEQ ID NO: 914390 - RNA, 19 nt, Homo sapiens
cauggaguguuggcucaua

SEQ ID NO: 914391 - RNA, 19 nt, Homo sapiens
aagaagaccuacaauuacu

SEQ ID NO: 914392 - RNA, 19 nt, Homo sapiens
aaagaagaccuacaauuac

SEQ ID NO: 914393 - RNA, 19 nt, Homo sapiens
ggagaugaaugugcgaaac

SEQ ID NO: 914394 - RNA, 19 nt, Homo sapiens
ucauagacgcuacaacuug

SEQ ID NO: 914395 - RNA, 19 nt, Homo sapiens
agacagcuaucuaaaccau

SEQ ID NO: 914396 - RNA, 19 nt, Homo sapiens
agaaacagacagcuaucua

SEQ ID NO: 914397 - RNA, 19 nt, Homo sapiens
uggacucacuguucauuau

SEQ ID NO: 914398 - RNA, 19 nt, Homo sapiens
ucauggaacagauaacauu

SEQ ID NO: 914399 - RNA, 19 nt, Homo sapiens
aaugaugguuacagucaaa

SEQ ID NO: 914400 - RNA, 19 nt, Homo sapiens
agacagaaacagacagcua

SEQ ID NO: 914401 - RNA, 19 nt, Homo sapiens
uccugaaacuguagauaaa

SEQ ID NO: 914402 - RNA, 19 nt, Homo sapiens
caaaagaagaccuacaauu

SEQ ID NO: 914403 - RNA, 19 nt, Homo sapiens
ccuguucccuacacaaaug

SEQ ID NO: 914404 - RNA, 19 nt, Homo sapiens
gauccucacucaguuaaaa

SEQ ID NO: 914405 - RNA, 19 nt, Homo sapiens
cucauaugcuguugauuug

SEQ ID NO: 914406 - RNA, 19 nt, Homo sapiens
aagaauuugucaagucuca

SEQ ID NO: 914407 - RNA, 19 nt, Homo sapiens
ggacucacuguucauuaug

SEQ ID NO: 914408 - RNA, 19 nt, Homo sapiens
guucagaugcuagagauau

SEQ ID NO: 914409 - RNA, 19 nt, Homo sapiens
ggugaugugauguuuguga

SEQ ID NO: 914410 - RNA, 19 nt, Homo sapiens
ccagauggacugcuuccuu

SEQ ID NO: 914411 - RNA, 19 nt, Homo sapiens
ucaacaagacagaaacaga

SEQ ID NO: 914412 - RNA, 19 nt, Homo sapiens
caacagaagcauggagugu

SEQ ID NO: 914413 - RNA, 19 nt, Homo sapiens
uuugucaagucucagguua

SEQ ID NO: 914414 - RNA, 19 nt, Homo sapiens
ggacuggauuacuucaaaa

SEQ ID NO: 914415 - RNA, 19 nt, Homo sapiens
acacaaaugcaguacauag

SEQ ID NO: 914416 - RNA, 19 nt, Homo sapiens
ucugguaccuugcuggaau

SEQ ID NO: 914417 - RNA, 19 nt, Homo sapiens
auaagaacccugccagaug

SEQ ID NO: 914418 - RNA, 19 nt, Homo sapiens
cagcuagauuugacugauc

SEQ ID NO: 914419 - RNA, 19 nt, Homo sapiens
cagaauuggagaagacuug

SEQ ID NO: 914420 - RNA, 19 nt, Homo sapiens
cauggaacagauaacauuu

SEQ ID NO: 914421 - RNA, 19 nt, Homo sapiens
aaacacccaucacaugacu

SEQ ID NO: 914422 - RNA, 19 nt, Homo sapiens
gaccuacaauuacuauagc

SEQ ID NO: 914423 - RNA, 19 nt, Homo sapiens
cgcuacaacuugcaaugaa

SEQ ID NO: 914424 - RNA, 19 nt, Homo sapiens
uacaaacacccaucacaug

SEQ ID NO: 914425 - RNA, 19 nt, Homo sapiens
gacucacuguucauuaugu

SEQ ID NO: 914426 - RNA, 19 nt, Homo sapiens
gauccugaaacuguagaua

SEQ ID NO: 914427 - RNA, 19 nt, Homo sapiens
uccauuaagggaagaauuu

SEQ ID NO: 914428 - RNA, 19 nt, Homo sapiens
caacugacaaacuauaugc

SEQ ID NO: 914429 - RNA, 19 nt, Homo sapiens
gccauaacuccuagaaugu

SEQ ID NO: 914430 - RNA, 19 nt, Homo sapiens
uguggagcaaccuuaauua

SEQ ID NO: 914431 - RNA, 19 nt, Homo sapiens
ggaacacgaagaaguaaaa

SEQ ID NO: 914432 - RNA, 19 nt, Homo sapiens
gaccuucacaggacucuuc

SEQ ID NO: 914433 - RNA, 19 nt, Homo sapiens
guuaucaaguucagucaac

SEQ ID NO: 914434 - RNA, 19 nt, Homo sapiens
ucaagucucagguuaucaa

SEQ ID NO: 914435 - RNA, 19 nt, Homo sapiens
ugucaagucucagguuauc

SEQ ID NO: 914436 - RNA, 19 nt, Homo sapiens
gacaaacuauaugcugagu

SEQ ID NO: 914437 - RNA, 19 nt, Homo sapiens
auacagaauuggagaagac

SEQ ID NO: 914438 - RNA, 19 nt, Homo sapiens
gagauacagaauuggagaa

SEQ ID NO: 914439 - RNA, 19 nt, Homo sapiens
uugcgggacuggauuacuu

SEQ ID NO: 914440 - RNA, 19 nt, Homo sapiens
gcuacaacuugcaaugaac

SEQ ID NO: 914441 - RNA, 19 nt, Homo sapiens
gcaguaagcuuucccauua

SEQ ID NO: 914442 - RNA, 19 nt, Homo sapiens
aaacauagcuuuccuguaa

SEQ ID NO: 914443 - RNA, 19 nt, Homo sapiens
ggaaauagcaguaagcuuu

SEQ ID NO: 914444 - RNA, 19 nt, Homo sapiens
gcaaguaugugaaacaaga

SEQ ID NO: 914445 - RNA, 19 nt, Homo sapiens
gggagaagcuucagaaagu

SEQ ID NO: 914446 - RNA, 19 nt, Homo sapiens
gaacagacgauccaugcua

SEQ ID NO: 914447 - RNA, 19 nt, Homo sapiens
gauccaugcuaauauugua

SEQ ID NO: 914448 - RNA, 19 nt, Homo sapiens
cagauucacuuuauaggaa

SEQ ID NO: 914449 - RNA, 19 nt, Homo sapiens
gacgauccaugcuaauauu

SEQ ID NO: 914450 - RNA, 19 nt, Homo sapiens
ggacaaagacgugcacuca

SEQ ID NO: 914451 - RNA, 19 nt, Homo sapiens
ggagaagcuucagaaaguu

SEQ ID NO: 914452 - RNA, 19 nt, Homo sapiens
aguaagcuuucccauuaua

SEQ ID NO: 914453 - RNA, 19 nt, Homo sapiens
gcagauucacuuuauagga

SEQ ID NO: 914454 - RNA, 19 nt, Homo sapiens
acauagcuuuccuguaauu

SEQ ID NO: 914455 - RNA, 19 nt, Homo sapiens
acaaagacgugcacucaac

SEQ ID NO: 914456 - RNA, 19 nt, Homo sapiens
uaagggagaagcuucagaa

SEQ ID NO: 914457 - RNA, 19 nt, Homo sapiens
aacagacgauccaugcuaa

SEQ ID NO: 914458 - RNA, 19 nt, Homo sapiens
ucuggguccuuucaucaua

SEQ ID NO: 914459 - RNA, 19 nt, Homo sapiens
gaaguucuggguccuuuca

SEQ ID NO: 914460 - RNA, 19 nt, Homo sapiens
uagcaaguaugugaaacaa

SEQ ID NO: 914461 - RNA, 19 nt, Homo sapiens
aaacugaauucuccaacag

SEQ ID NO: 914462 - RNA, 19 nt, Homo sapiens
cagacgauccaugcuaaua

SEQ ID NO: 914463 - RNA, 19 nt, Homo sapiens
gaagugugcgggacagcaa

SEQ ID NO: 914464 - RNA, 19 nt, Homo sapiens
guaagcuuucccauuauaa

SEQ ID NO: 914465 - RNA, 19 nt, Homo sapiens
ugacuuuguuuaccugcuu

SEQ ID NO: 914466 - RNA, 19 nt, Homo sapiens
cacugucacuccucagaaa

SEQ ID NO: 914467 - RNA, 19 nt, Homo sapiens
caguaagcuuucccauuau

SEQ ID NO: 914468 - RNA, 19 nt, Homo sapiens
gagaagcuucagaaaguuc

SEQ ID NO: 914469 - RNA, 19 nt, Homo sapiens
aaaaucagcuacuagaauc

SEQ ID NO: 914470 - RNA, 19 nt, Homo sapiens
ucacuccucagaaagcuaa

SEQ ID NO: 914471 - RNA, 19 nt, Homo sapiens
caauuuagacagugaaacu

SEQ ID NO: 914472 - RNA, 19 nt, Homo sapiens
gacgugcacucaaccuucu

SEQ ID NO: 914473 - RNA, 19 nt, Homo sapiens
gugcagauucacuuuauag

SEQ ID NO: 914474 - RNA, 19 nt, Homo sapiens
gacaaagacgugcacucaa

SEQ ID NO: 914475 - RNA, 19 nt, Homo sapiens
agacgauccaugcuaauau

SEQ ID NO: 914476 - RNA, 19 nt, Homo sapiens
ggacgcgcugugcgaguuu

SEQ ID NO: 914477 - RNA, 19 nt, Homo sapiens
guaugugaaacaagaaguu

SEQ ID NO: 914478 - RNA, 19 nt, Homo sapiens
cauugcugaucuugacaaa

SEQ ID NO: 914479 - RNA, 19 nt, Homo sapiens
cuggguccuuucaucauaa

SEQ ID NO: 914480 - RNA, 19 nt, Homo sapiens
ggacuggcagggcugaagu

SEQ ID NO: 914481 - RNA, 19 nt, Homo sapiens
ccgaggaccugcuaaaauc

SEQ ID NO: 914482 - RNA, 19 nt, Homo sapiens
gcuaaaaucagcuacuaga

SEQ ID NO: 914483 - RNA, 19 nt, Homo sapiens
gcaccuggagcgcaugaag

SEQ ID NO: 914484 - RNA, 19 nt, Homo sapiens
ccuguaauuuaaagugcuu

SEQ ID NO: 914485 - RNA, 19 nt, Homo sapiens
caaguaugugaaacaagaa

SEQ ID NO: 914486 - RNA, 19 nt, Homo sapiens
ccacugucacuccucagaa

SEQ ID NO: 914487 - RNA, 19 nt, Homo sapiens
acucucaggcucaccuuaa

SEQ ID NO: 914488 - RNA, 19 nt, Homo sapiens
guucuggguccuuucauca

SEQ ID NO: 914489 - RNA, 19 nt, Homo sapiens
cuucauugcugaucuugac

SEQ ID NO: 914490 - RNA, 19 nt, Homo sapiens
gagcaccuggagcgcauga

SEQ ID NO: 914491 - RNA, 19 nt, Homo sapiens
guuccgaggaccugcuaaa

SEQ ID NO: 914492 - RNA, 19 nt, Homo sapiens
uaagaaagauccugucaaa

SEQ ID NO: 914493 - RNA, 19 nt, Homo sapiens
uaaaggagccaucaaauuu

SEQ ID NO: 914494 - RNA, 19 nt, Homo sapiens
gaaagauccugucaaaaua

SEQ ID NO: 914495 - RNA, 19 nt, Homo sapiens
caaaggaauuggcauugaa

SEQ ID NO: 914496 - RNA, 19 nt, Homo sapiens
ggaaugcacuugggcuaaa

SEQ ID NO: 914497 - RNA, 19 nt, Homo sapiens
uaucauguguccaggcuua

SEQ ID NO: 914498 - RNA, 19 nt, Homo sapiens
gagcggaaguagucagauu

SEQ ID NO: 914499 - RNA, 19 nt, Homo sapiens
cagaagacauugagaaagu

SEQ ID NO: 914500 - RNA, 19 nt, Homo sapiens
gaaagucaacaaaggaauu

SEQ ID NO: 914501 - RNA, 19 nt, Homo sapiens
gaugggcuguggcauauga

SEQ ID NO: 914502 - RNA, 19 nt, Homo sapiens
gaaccauggcuuaaucaaa

SEQ ID NO: 914503 - RNA, 19 nt, Homo sapiens
caacaaaggaauuggcauu

SEQ ID NO: 914504 - RNA, 19 nt, Homo sapiens
gcacuugggcuaaauaugg

SEQ ID NO: 914505 - RNA, 19 nt, Homo sapiens
ccgaugccaugaacauaua

SEQ ID NO: 914506 - RNA, 19 nt, Homo sapiens
gaagauaaugccugugguu

SEQ ID NO: 914507 - RNA, 19 nt, Homo sapiens
aaccauggcuuaaucaaau

SEQ ID NO: 914508 - RNA, 19 nt, Homo sapiens
gguauugaaccauggcuua

SEQ ID NO: 914509 - RNA, 19 nt, Homo sapiens
caucaaauuuguacucagu

SEQ ID NO: 914510 - RNA, 19 nt, Homo sapiens
gauaaaggagccaucaaau

SEQ ID NO: 914511 - RNA, 19 nt, Homo sapiens
ggaucauguucaagaaauu

SEQ ID NO: 914512 - RNA, 19 nt, Homo sapiens
ggaauuggcauugaaaaua

SEQ ID NO: 914513 - RNA, 19 nt, Homo sapiens
acaaaggaauuggcauuga

SEQ ID NO: 914514 - RNA, 19 nt, Homo sapiens
aaucaaaucaugccuaaga

SEQ ID NO: 914515 - RNA, 19 nt, Homo sapiens
gagaaagucaacaaaggaa

SEQ ID NO: 914516 - RNA, 19 nt, Homo sapiens
guagauaccauuguugcua

SEQ ID NO: 914517 - RNA, 19 nt, Homo sapiens
auagagcaauuuccaggua

SEQ ID NO: 914518 - RNA, 19 nt, Homo sapiens
ccaugaacauauagaaauc

SEQ ID NO: 914519 - RNA, 19 nt, Homo sapiens
gaaaacagcaugcucuaug

SEQ ID NO: 914520 - RNA, 19 nt, Homo sapiens
uagauaccauuguugcuau

SEQ ID NO: 914521 - RNA, 19 nt, Homo sapiens
guacucaguggagcaaaua

SEQ ID NO: 914522 - RNA, 19 nt, Homo sapiens
ugugacagcaugaagauaa

SEQ ID NO: 914523 - RNA, 19 nt, Homo sapiens
gaaugcacuugggcuaaau

SEQ ID NO: 914524 - RNA, 19 nt, Homo sapiens
auaaaggagccaucaaauu

SEQ ID NO: 914525 - RNA, 19 nt, Homo sapiens
gccaugaacauauagaaau

SEQ ID NO: 914526 - RNA, 19 nt, Homo sapiens
caaaucaugccuaagaaag

SEQ ID NO: 914527 - RNA, 19 nt, Homo sapiens
caccuuggaucauguucaa

SEQ ID NO: 914528 - RNA, 19 nt, Homo sapiens
ugaggaaccgguugccuaa

SEQ ID NO: 914529 - RNA, 19 nt, Homo sapiens
ccagcagguugauaaagga

SEQ ID NO: 914530 - RNA, 19 nt, Homo sapiens
gaagacauugagaaaguca

SEQ ID NO: 914531 - RNA, 19 nt, Homo sapiens
aaaggagccaucaaauuug

SEQ ID NO: 914532 - RNA, 19 nt, Homo sapiens
ugagaaagucaacaaagga

SEQ ID NO: 914533 - RNA, 19 nt, Homo sapiens
ucaaaucaugccuaagaaa

SEQ ID NO: 914534 - RNA, 19 nt, Homo sapiens
gcaguagauaccauuguug

SEQ ID NO: 914535 - RNA, 19 nt, Homo sapiens
cagaggagcggaaguaguc

SEQ ID NO: 914536 - RNA, 19 nt, Homo sapiens
uggaucauguucaagaaau

SEQ ID NO: 914537 - RNA, 19 nt, Homo sapiens
ugcaguagauaccauuguu

SEQ ID NO: 914538 - RNA, 19 nt, Homo sapiens
aaggagccaucaaauuugu

SEQ ID NO: 914539 - RNA, 19 nt, Homo sapiens
ccuaagauuacuucacaaa

SEQ ID NO: 914540 - RNA, 19 nt, Homo sapiens
uuauccaacccuaagauua

SEQ ID NO: 914541 - RNA, 19 nt, Homo sapiens
aagauaaugccugugguua

SEQ ID NO: 914542 - RNA, 19 nt, Homo sapiens
aaugaugggcuguggcaua

SEQ ID NO: 914543 - RNA, 19 nt, Homo sapiens
gccaucaaauuuguacuca

SEQ ID NO: 914544 - RNA, 19 nt, Homo sapiens
agaaagauccugucaaaau

SEQ ID NO: 914545 - RNA, 19 nt, Homo sapiens
gugacagcaugaagauaau

SEQ ID NO: 914546 - RNA, 19 nt, Homo sapiens
aaaggaauuggcauugaaa

SEQ ID NO: 914547 - RNA, 19 nt, Homo sapiens
gcagaagacauugagaaag

SEQ ID NO: 914548 - RNA, 19 nt, Homo sapiens
cagcaugcucuauguguug

SEQ ID NO: 914549 - RNA, 19 nt, Homo sapiens
aaucaugccuaagaaagau

SEQ ID NO: 914550 - RNA, 19 nt, Homo sapiens
guauugaaccauggcuuaa

SEQ ID NO: 914551 - RNA, 19 nt, Homo sapiens
uagagcaauuuccagguau

SEQ ID NO: 914552 - RNA, 19 nt, Homo sapiens
gcggaaguagucagauuug

SEQ ID NO: 914553 - RNA, 19 nt, Homo sapiens
cacaccagcagguugauaa

SEQ ID NO: 914554 - RNA, 19 nt, Homo sapiens
acccuaagauuacuucaca

SEQ ID NO: 914555 - RNA, 19 nt, Homo sapiens
uaccauuguugcuaucaug

SEQ ID NO: 914556 - RNA, 19 nt, Homo sapiens
agagcaauuuccagguauu

SEQ ID NO: 914557 - RNA, 19 nt, Homo sapiens
uaucuguguuugugucugu

SEQ ID NO: 914558 - RNA, 19 nt, Homo sapiens
cggaaguagucagauuuga

SEQ ID NO: 914559 - RNA, 19 nt, Homo sapiens
acagcaugcucuauguguu

SEQ ID NO: 914560 - RNA, 19 nt, Homo sapiens
cuucaguuauuaaggguau

SEQ ID NO: 914561 - RNA, 19 nt, Homo sapiens
guccagaggagcggaagua

SEQ ID NO: 914562 - RNA, 19 nt, Homo sapiens
aaaucaugccuaagaaaga

SEQ ID NO: 914563 - RNA, 19 nt, Homo sapiens
uucaauuucuuucccauuc

SEQ ID NO: 914564 - RNA, 19 nt, Homo sapiens
uauccaacccuaagauuac

SEQ ID NO: 914565 - RNA, 19 nt, Homo sapiens
cacuugggcuaaauaugga

SEQ ID NO: 914566 - RNA, 19 nt, Homo sapiens
ccacaccagcagguugaua

SEQ ID NO: 914567 - RNA, 19 nt, Homo sapiens
aaagucaacaaaggaauug

SEQ ID NO: 914568 - RNA, 19 nt, Homo sapiens
ugcagaagacauugagaaa

SEQ ID NO: 914569 - RNA, 19 nt, Homo sapiens
uggagcaaauaucaugugu

SEQ ID NO: 914570 - RNA, 19 nt, Homo sapiens
augaugggcuguggcauau

SEQ ID NO: 914571 - RNA, 19 nt, Homo sapiens
guguuggagucaugaagau

SEQ ID NO: 914572 - RNA, 19 nt, Homo sapiens
caguggagcaaauaucaug

SEQ ID NO: 914573 - RNA, 19 nt, Homo sapiens
ugaagaugucugcagaaga

SEQ ID NO: 914574 - RNA, 19 nt, Homo sapiens
ucuauguguuggagucaug

SEQ ID NO: 914575 - RNA, 19 nt, Homo sapiens
uaucauggcagaaggaaaa

SEQ ID NO: 914576 - RNA, 19 nt, Homo sapiens
cugcagaagacauugagaa

SEQ ID NO: 914577 - RNA, 19 nt, Homo sapiens
ccuaagaaagauccuguca

SEQ ID NO: 914578 - RNA, 19 nt, Homo sapiens
aagaaaauguguccaacug

SEQ ID NO: 914579 - RNA, 19 nt, Homo sapiens
aaaacagcaugcucuaugu

SEQ ID NO: 914580 - RNA, 19 nt, Homo sapiens
uguccaggcuuaacuucuc

SEQ ID NO: 914581 - RNA, 19 nt, Homo sapiens
uguacucaguggagcaaau

SEQ ID NO: 914582 - RNA, 19 nt, Homo sapiens
cuaagaaagauccugucaa

SEQ ID NO: 914583 - RNA, 19 nt, Homo sapiens
gaagaaggauggaggauuu

SEQ ID NO: 914584 - RNA, 19 nt, Homo sapiens
gaggguaccugauuuauaa

SEQ ID NO: 914585 - RNA, 19 nt, Homo sapiens
gaaauagaguguuugcuuu

SEQ ID NO: 914586 - RNA, 19 nt, Homo sapiens
gagaacggcuuguuuauug

SEQ ID NO: 914587 - RNA, 19 nt, Homo sapiens
gaaauaagcuguucuuuug

SEQ ID NO: 914588 - RNA, 19 nt, Homo sapiens
gauggaggauuucuucaua

SEQ ID NO: 914589 - RNA, 19 nt, Homo sapiens
guacagcacuuauagaaau

SEQ ID NO: 914590 - RNA, 19 nt, Homo sapiens
caaagacucuauugacauu

SEQ ID NO: 914591 - RNA, 19 nt, Homo sapiens
cgaagaagaucgucacaga

SEQ ID NO: 914592 - RNA, 19 nt, Homo sapiens
gugugaagauugacauuua

SEQ ID NO: 914593 - RNA, 19 nt, Homo sapiens
gaagagaaccgcaacaauc

SEQ ID NO: 914594 - RNA, 19 nt, Homo sapiens
gcaguccgguggaguauga

SEQ ID NO: 914595 - RNA, 19 nt, Homo sapiens
ugaagucguuccaucauaa

SEQ ID NO: 914596 - RNA, 19 nt, Homo sapiens
gcagaggguaccugauuua

SEQ ID NO: 914597 - RNA, 19 nt, Homo sapiens
ggacgaugaugcagagguu

SEQ ID NO: 914598 - RNA, 19 nt, Homo sapiens
gcugagaacggcuuguuua

SEQ ID NO: 914599 - RNA, 19 nt, Homo sapiens
ucuaaagacuggccuugua

SEQ ID NO: 914600 - RNA, 19 nt, Homo sapiens
agacuggccuuguaauuau

SEQ ID NO: 914601 - RNA, 19 nt, Homo sapiens
gaaguugaaauacccagua

SEQ ID NO: 914602 - RNA, 19 nt, Homo sapiens
gaucgucacagaagaguuu

SEQ ID NO: 914603 - RNA, 19 nt, Homo sapiens
gcuguugugugaagauuga

SEQ ID NO: 914604 - RNA, 19 nt, Homo sapiens
cgaaauagaguguuugcuu

SEQ ID NO: 914605 - RNA, 19 nt, Homo sapiens
gaagaagaucgucacagaa

SEQ ID NO: 914606 - RNA, 19 nt, Homo sapiens
ggacugcuguaagcuuuga

SEQ ID NO: 914607 - RNA, 19 nt, Homo sapiens
gcgcagaggguaccugauu

SEQ ID NO: 914608 - RNA, 19 nt, Homo sapiens
agauugacauuuaccauga

SEQ ID NO: 914609 - RNA, 19 nt, Homo sapiens
gaggauuucuucauaucug

SEQ ID NO: 914610 - RNA, 19 nt, Homo sapiens
cuucauaucugacguuucu

SEQ ID NO: 914611 - RNA, 19 nt, Homo sapiens
uacaaagacucuauugaca

SEQ ID NO: 914612 - RNA, 19 nt, Homo sapiens
uauauuagcgcucaucuuc

SEQ ID NO: 914613 - RNA, 19 nt, Homo sapiens
caagaaaagucuccugaug

SEQ ID NO: 914614 - RNA, 19 nt, Homo sapiens
uaggacugcuguaagcuuu

SEQ ID NO: 914615 - RNA, 19 nt, Homo sapiens
aagacuggccuuguaauua

SEQ ID NO: 914616 - RNA, 19 nt, Homo sapiens
ggaaagugcuggggaaguu

SEQ ID NO: 914617 - RNA, 19 nt, Homo sapiens
ccaguaaaauguugaagaa

SEQ ID NO: 914618 - RNA, 19 nt, Homo sapiens
gaaauacccaguaaaaugu

SEQ ID NO: 914619 - RNA, 19 nt, Homo sapiens
uaaaagagagucacaggua

SEQ ID NO: 914620 - RNA, 19 nt, Homo sapiens
cuaaagacuggccuuguaa

SEQ ID NO: 914621 - RNA, 19 nt, Homo sapiens
ggacacuguauuugauauu

SEQ ID NO: 914622 - RNA, 19 nt, Homo sapiens
gguccuaaguugaaaauga

SEQ ID NO: 914623 - RNA, 19 nt, Homo sapiens
aaacugaaagucaugcauu

SEQ ID NO: 914624 - RNA, 19 nt, Homo sapiens
gggacacuguauuugauau

SEQ ID NO: 914625 - RNA, 19 nt, Homo sapiens
ggaaucgagcaaacugaaa

SEQ ID NO: 914626 - RNA, 19 nt, Homo sapiens
aggaagcucuggucuggaa

SEQ ID NO: 914627 - RNA, 19 nt, Homo sapiens
cguaaccgaugcucuaaag

SEQ ID NO: 914628 - RNA, 19 nt, Homo sapiens
guucguaaccgaugcucua

SEQ ID NO: 914629 - RNA, 19 nt, Homo sapiens
aaagucuccugaugucuau

SEQ ID NO: 914630 - RNA, 19 nt, Homo sapiens
gaaccgcaacaaucgcaaa

SEQ ID NO: 914631 - RNA, 19 nt, Homo sapiens
gaagaucgucacagaagag

SEQ ID NO: 914632 - RNA, 19 nt, Homo sapiens
gaagauugacauuuaccau

SEQ ID NO: 914633 - RNA, 19 nt, Homo sapiens
guagcaguccgguggagua

SEQ ID NO: 914634 - RNA, 19 nt, Homo sapiens
aaguugaaauacccaguaa

SEQ ID NO: 914635 - RNA, 19 nt, Homo sapiens
augcagagguugaggcuau

SEQ ID NO: 914636 - RNA, 19 nt, Homo sapiens
gcuacaaagacucuauuga

SEQ ID NO: 914637 - RNA, 19 nt, Homo sapiens
cgagcaaacugaaagucau

SEQ ID NO: 914638 - RNA, 19 nt, Homo sapiens
aaagacuggccuuguaauu

SEQ ID NO: 914639 - RNA, 19 nt, Homo sapiens
aacugaaagucaugcauuu

SEQ ID NO: 914640 - RNA, 19 nt, Homo sapiens
agaggguaccugauuuaua

SEQ ID NO: 914641 - RNA, 19 nt, Homo sapiens
cgcagaggguaccugauuu

SEQ ID NO: 914642 - RNA, 19 nt, Homo sapiens
uauuagcgcucaucuucau

SEQ ID NO: 914643 - RNA, 19 nt, Homo sapiens
guaaaauguugaagaagga

SEQ ID NO: 914644 - RNA, 19 nt, Homo sapiens
gagcaaacugaaagucaug

SEQ ID NO: 914645 - RNA, 19 nt, Homo sapiens
gaaucgagcaaacugaaag

SEQ ID NO: 914646 - RNA, 19 nt, Homo sapiens
ugagaacggcuuguuuauu

SEQ ID NO: 914647 - RNA, 19 nt, Homo sapiens
gagcacugcccaagcacaa

SEQ ID NO: 914648 - RNA, 19 nt, Homo sapiens
gaaggauggaggauuucuu

SEQ ID NO: 914649 - RNA, 19 nt, Homo sapiens
caacugcgaaauagagugu

SEQ ID NO: 914650 - RNA, 19 nt, Homo sapiens
cagcggcagcagcuucuua

SEQ ID NO: 914651 - RNA, 19 nt, Homo sapiens
agaagaucgucacagaaga

SEQ ID NO: 914652 - RNA, 19 nt, Homo sapiens
cuacaaagacucuauugac

SEQ ID NO: 914653 - RNA, 19 nt, Homo sapiens
ugaaauacccaguaaaaug

SEQ ID NO: 914654 - RNA, 19 nt, Homo sapiens
gaucuuguacagcacuuau

SEQ ID NO: 914655 - RNA, 19 nt, Homo sapiens
gaagucguuccaucauaau

SEQ ID NO: 914656 - RNA, 19 nt, Homo sapiens
guagaugccaggguccuaa

SEQ ID NO: 914657 - RNA, 19 nt, Homo sapiens
guaauuaugacugggauuc

SEQ ID NO: 914658 - RNA, 19 nt, Homo sapiens
gggcaacagcgccaaggaa

SEQ ID NO: 914659 - RNA, 19 nt, Homo sapiens
cgugggaacuacccuuugu

SEQ ID NO: 914660 - RNA, 19 nt, Homo sapiens
gucguuccaucauaaucua

SEQ ID NO: 914661 - RNA, 19 nt, Homo sapiens
aaauuccguuuguugagaa

SEQ ID NO: 914662 - RNA, 19 nt, Homo sapiens
gauugacauuuaccaugau

SEQ ID NO: 914663 - RNA, 19 nt, Homo sapiens
gccaggguccuaaguugaa

SEQ ID NO: 914664 - RNA, 19 nt, Homo sapiens
guucuaaaaugaagucguu

SEQ ID NO: 914665 - RNA, 19 nt, Homo sapiens
ugacugggauucggacgau

SEQ ID NO: 914666 - RNA, 19 nt, Homo sapiens
gcagcuucuuacgguauaa

SEQ ID NO: 914667 - RNA, 19 nt, Homo sapiens
gguggaguaugaguucuuc

SEQ ID NO: 914668 - RNA, 19 nt, Homo sapiens
cagaagagaaccgcaacaa

SEQ ID NO: 914669 - RNA, 19 nt, Homo sapiens
uggaggauuucuucauauc

SEQ ID NO: 914670 - RNA, 19 nt, Homo sapiens
ccaggguccuaaguugaaa

SEQ ID NO: 914671 - RNA, 19 nt, Homo sapiens
ugugucugcuguuguguga

SEQ ID NO: 914672 - RNA, 19 nt, Homo sapiens
ggauggaggauuucuucau

SEQ ID NO: 914673 - RNA, 19 nt, Homo sapiens
ugaagaaggauggaggauu

SEQ ID NO: 914674 - RNA, 19 nt, Homo sapiens
aaaugaagucguuccauca

SEQ ID NO: 914675 - RNA, 19 nt, Homo sapiens
cuccugaugucuauauuag

SEQ ID NO: 914676 - RNA, 19 nt, Homo sapiens
gaugccaggguccuaaguu

SEQ ID NO: 914677 - RNA, 19 nt, Homo sapiens
aagaagaucgucacagaag

SEQ ID NO: 914678 - RNA, 19 nt, Homo sapiens
uuccguuuguugagaauaa

SEQ ID NO: 914679 - RNA, 19 nt, Homo sapiens
acugcgaaauagaguguuu

SEQ ID NO: 914680 - RNA, 19 nt, Homo sapiens
gacuggccuuguaauuaug

SEQ ID NO: 914681 - RNA, 19 nt, Homo sapiens
cgucagcacagcaucuuug

SEQ ID NO: 914682 - RNA, 19 nt, Homo sapiens
ucauaucugacguuucuga

SEQ ID NO: 914683 - RNA, 19 nt, Homo sapiens
gaaagaaguuugugaagaa

SEQ ID NO: 914684 - RNA, 19 nt, Homo sapiens
gcccagagaucaugcauuu

SEQ ID NO: 914685 - RNA, 19 nt, Homo sapiens
caacaucgaucaugaacug

SEQ ID NO: 914686 - RNA, 19 nt, Homo sapiens
gaauuuaguuccuucaugu

SEQ ID NO: 914687 - RNA, 19 nt, Homo sapiens
gaacaagacccugaagaaa

SEQ ID NO: 914688 - RNA, 19 nt, Homo sapiens
ggaagaacauuuacaccau

SEQ ID NO: 914689 - RNA, 19 nt, Homo sapiens
ggaacaagacccugaagaa

SEQ ID NO: 914690 - RNA, 19 nt, Homo sapiens
gcacauuucugguuuccau

SEQ ID NO: 914691 - RNA, 19 nt, Homo sapiens
aaacaccucugcacauuuc

SEQ ID NO: 914692 - RNA, 19 nt, Homo sapiens
gcaaccuccugugcauuua

SEQ ID NO: 914693 - RNA, 19 nt, Homo sapiens
ugacagaggugaggacguu

SEQ ID NO: 914694 - RNA, 19 nt, Homo sapiens
agaaagaaguuugugaaga

SEQ ID NO: 914695 - RNA, 19 nt, Homo sapiens
gugaggacguuccaaguga

SEQ ID NO: 914696 - RNA, 19 nt, Homo sapiens
gaaacaccucugcacauuu

SEQ ID NO: 914697 - RNA, 19 nt, Homo sapiens
agaaacaccucugcacauu

SEQ ID NO: 914698 - RNA, 19 nt, Homo sapiens
aaggugagcucaucgauuc

SEQ ID NO: 914699 - RNA, 19 nt, Homo sapiens
acaagacccugaagaaagu

SEQ ID NO: 914700 - RNA, 19 nt, Homo sapiens
gaguuccggugacccauuu

SEQ ID NO: 914701 - RNA, 19 nt, Homo sapiens
ccugagaaccuggaauuua

SEQ ID NO: 914702 - RNA, 19 nt, Homo sapiens
ccaguaacaucaagcagau

SEQ ID NO: 914703 - RNA, 19 nt, Homo sapiens
ugccauggcuguuucaaga

SEQ ID NO: 914704 - RNA, 19 nt, Homo sapiens
ccagagaucaugcauuuag

SEQ ID NO: 914705 - RNA, 19 nt, Homo sapiens
ucacugagauucgggacaa

SEQ ID NO: 914706 - RNA, 19 nt, Homo sapiens
gagaucaugcauuuagauu

SEQ ID NO: 914707 - RNA, 19 nt, Homo sapiens
ccagaaagaaguuugugaa

SEQ ID NO: 914708 - RNA, 19 nt, Homo sapiens
cugagaaccuggaauuuag

SEQ ID NO: 914709 - RNA, 19 nt, Homo sapiens
gggcggagacgcuuaaauc

SEQ ID NO: 914710 - RNA, 19 nt, Homo sapiens
ugacugaguuuucaaagaa

SEQ ID NO: 914711 - RNA, 19 nt, Homo sapiens
ccacagacuucgccaugca

SEQ ID NO: 914712 - RNA, 19 nt, Homo sapiens
ggacaucgggaagaacauu

SEQ ID NO: 914713 - RNA, 19 nt, Homo sapiens
ccaguuggaagcagaguuu

SEQ ID NO: 914714 - RNA, 19 nt, Homo sapiens
ggaccacccgauggaaaua

SEQ ID NO: 914715 - RNA, 19 nt, Homo sapiens
cagagaucaugcauuuaga

SEQ ID NO: 914716 - RNA, 19 nt, Homo sapiens
gaaacccuuugcccaacau

SEQ ID NO: 914717 - RNA, 19 nt, Homo sapiens
gccagaaaauacaagguua

SEQ ID NO: 914718 - RNA, 19 nt, Homo sapiens
ggagguggucacugagauu

SEQ ID NO: 914719 - RNA, 19 nt, Homo sapiens
gcugauacuugagcugugu

SEQ ID NO: 914720 - RNA, 19 nt, Homo sapiens
ggucaucucaaggcugaua

SEQ ID NO: 914721 - RNA, 19 nt, Homo sapiens
gcgcugccauggcuguuuc

SEQ ID NO: 914722 - RNA, 19 nt, Homo sapiens
cugcuuaggucaucucaag

SEQ ID NO: 914723 - RNA, 19 nt, Homo sapiens
ucccaacgcuuccagaaag

SEQ ID NO: 914724 - RNA, 19 nt, Homo sapiens
gaaaagaugacagcgauga

SEQ ID NO: 914725 - RNA, 19 nt, Homo sapiens
ccuccugugcauuuaauua

SEQ ID NO: 914726 - RNA, 19 nt, Homo sapiens
ugacaugagccgaguguuc

SEQ ID NO: 914727 - RNA, 19 nt, Homo sapiens
caaccuccugugcauuuaa

SEQ ID NO: 914728 - RNA, 19 nt, Homo sapiens
gggagguggucacugagau

SEQ ID NO: 914729 - RNA, 19 nt, Homo sapiens
gagaaccuggaauuuaguu

SEQ ID NO: 914730 - RNA, 19 nt, Homo sapiens
gcagaaaaccaacguguuc

SEQ ID NO: 914731 - RNA, 19 nt, Homo sapiens
aaaggacacucagcuugug

SEQ ID NO: 914732 - RNA, 19 nt, Homo sapiens
uaaggugagcucaucgauu

SEQ ID NO: 914733 - RNA, 19 nt, Homo sapiens
caaaaggccaggcagaaaa

SEQ ID NO: 914734 - RNA, 19 nt, Homo sapiens
gggcaaauacgccaucaac

SEQ ID NO: 914735 - RNA, 19 nt, Homo sapiens
ggaggaggaggaggaagaa

SEQ ID NO: 914736 - RNA, 19 nt, Homo sapiens
cagcugcgacucucccaaa

SEQ ID NO: 914737 - RNA, 19 nt, Homo sapiens
gggaacaagacccugaaga

SEQ ID NO: 914738 - RNA, 19 nt, Homo sapiens
ccuacgagcugcgguucaa

SEQ ID NO: 914739 - RNA, 19 nt, Homo sapiens
ggugaggacguuccaagug

SEQ ID NO: 914740 - RNA, 19 nt, Homo sapiens
uccgggagguggucacuga

SEQ ID NO: 914741 - RNA, 19 nt, Homo sapiens
ggaguuccggugacccauu

SEQ ID NO: 914742 - RNA, 19 nt, Homo sapiens
ccauggcuguuucaagaca

SEQ ID NO: 914743 - RNA, 19 nt, Homo sapiens
gugaacggcaugcugauuc

SEQ ID NO: 914744 - RNA, 19 nt, Homo sapiens
ugcccaacaucgaucauga

SEQ ID NO: 914745 - RNA, 19 nt, Homo sapiens
acaacgcccuggagccaau

SEQ ID NO: 914746 - RNA, 19 nt, Homo sapiens
gacaucgggaagaacauuu

SEQ ID NO: 914747 - RNA, 19 nt, Homo sapiens
cacccuuugucgagaauga

SEQ ID NO: 914748 - RNA, 19 nt, Homo sapiens
gaccacccgauggaaauaa

SEQ ID NO: 914749 - RNA, 19 nt, Homo sapiens
ugagcugugugcccagaga

SEQ ID NO: 914750 - RNA, 19 nt, Homo sapiens
aacaagacccugaagaaag

SEQ ID NO: 914751 - RNA, 19 nt, Homo sapiens
gacaugagccgaguguucu

SEQ ID NO: 914752 - RNA, 19 nt, Homo sapiens
gcgaguucccgcaggcaaa

SEQ ID NO: 914753 - RNA, 19 nt, Homo sapiens
acaucgggaagaacauuua

SEQ ID NO: 914754 - RNA, 19 nt, Homo sapiens
guuuccaucugcccuacaa

SEQ ID NO: 914755 - RNA, 19 nt, Homo sapiens
gcugggcggagacgcuuaa

SEQ ID NO: 914756 - RNA, 19 nt, Homo sapiens
guuggaagcagaguuuguu

SEQ ID NO: 914757 - RNA, 19 nt, Homo sapiens
agaaacccuuugcccaaca

SEQ ID NO: 914758 - RNA, 19 nt, Homo sapiens
caggaccacccgauggaaa

SEQ ID NO: 914759 - RNA, 19 nt, Homo sapiens
cagaaagaaguuugugaag

SEQ ID NO: 914760 - RNA, 19 nt, Homo sapiens
gcccaacaucgaucaugaa

SEQ ID NO: 914761 - RNA, 19 nt, Homo sapiens
ggugaacggcaugcugauu

SEQ ID NO: 914762 - RNA, 19 nt, Homo sapiens
cccaacgcuuccagaaaga

SEQ ID NO: 914763 - RNA, 19 nt, Homo sapiens
ugucacccuuugucgagaa

SEQ ID NO: 914764 - RNA, 19 nt, Homo sapiens
ugcaggacaucgggaagaa

SEQ ID NO: 914765 - RNA, 19 nt, Homo sapiens
ccucugcacauuucugguu

SEQ ID NO: 914766 - RNA, 19 nt, Homo sapiens
agacauggcuuccuuauug

SEQ ID NO: 914767 - RNA, 19 nt, Homo sapiens
acacagagaucuccuuuga

SEQ ID NO: 914768 - RNA, 19 nt, Homo sapiens
gcagggaauuugucuuguu

SEQ ID NO: 914769 - RNA, 19 nt, Homo sapiens
ccaccacuguuuagaauga

SEQ ID NO: 914770 - RNA, 19 nt, Homo sapiens
ccagacagcuuggcucuug

SEQ ID NO: 914771 - RNA, 19 nt, Homo sapiens
gcacauugaccaccacauu

SEQ ID NO: 914772 - RNA, 19 nt, Homo sapiens
gaacagugaacguagagaa

SEQ ID NO: 914773 - RNA, 19 nt, Homo sapiens
uagcagaguuugugaccaa

SEQ ID NO: 914774 - RNA, 19 nt, Homo sapiens
gcucauccgugucucugaa

SEQ ID NO: 914775 - RNA, 19 nt, Homo sapiens
ccaaauuuguccucaucaa

SEQ ID NO: 914776 - RNA, 19 nt, Homo sapiens
gcaauggccuggugauucc

SEQ ID NO: 914777 - RNA, 19 nt, Homo sapiens
gaggaggccugggaguuga

SEQ ID NO: 914778 - RNA, 19 nt, Homo sapiens
gcccagcacuccuccaugu

SEQ ID NO: 914779 - RNA, 19 nt, Homo sapiens
cagggaauuugucuuguug

SEQ ID NO: 914780 - RNA, 19 nt, Homo sapiens
ggccaccacuguuuagaau

SEQ ID NO: 914781 - RNA, 19 nt, Homo sapiens
acucuggacugcccaaauu

SEQ ID NO: 914782 - RNA, 19 nt, Homo sapiens
aagaggaggcuguguauga

SEQ ID NO: 914783 - RNA, 19 nt, Homo sapiens
gggaauuugucuuguugga

SEQ ID NO: 914784 - RNA, 19 nt, Homo sapiens
gaacguagagaauuguuuu

SEQ ID NO: 914785 - RNA, 19 nt, Homo sapiens
cagaagaggaggcugugua

SEQ ID NO: 914786 - RNA, 19 nt, Homo sapiens
gaaggcaacagcaaugaca

SEQ ID NO: 914787 - RNA, 19 nt, Homo sapiens
aagaagugguuucaaggaa

SEQ ID NO: 914788 - RNA, 19 nt, Homo sapiens
gcccaaauuuguccucauc

SEQ ID NO: 914789 - RNA, 19 nt, Homo sapiens
cagugaacguagagaauug

SEQ ID NO: 914790 - RNA, 19 nt, Homo sapiens
cgacacagagaucuccuuu

SEQ ID NO: 914791 - RNA, 19 nt, Homo sapiens
ccaaugccgugucugagau

SEQ ID NO: 914792 - RNA, 19 nt, Homo sapiens
cagcagggaauuugucuug

SEQ ID NO: 914793 - RNA, 19 nt, Homo sapiens
ucucagacauggcuuccuu

SEQ ID NO: 914794 - RNA, 19 nt, Homo sapiens
gugugugccucaacugauu

SEQ ID NO: 914795 - RNA, 19 nt, Homo sapiens
caagaagugguuucaagga

SEQ ID NO: 914796 - RNA, 19 nt, Homo sapiens
gcgagggcgugaacgaugu

SEQ ID NO: 914797 - RNA, 19 nt, Homo sapiens
gcauguucccugccaacua

SEQ ID NO: 914798 - RNA, 19 nt, Homo sapiens
gaaugacccuugggaacag

SEQ ID NO: 914799 - RNA, 19 nt, Homo sapiens
caacuacagcuuucacaag

SEQ ID NO: 914800 - RNA, 19 nt, Homo sapiens
ggaugcagauggccaagcu

SEQ ID NO: 914801 - RNA, 19 nt, Homo sapiens
cgacugggcucucuuuacc

SEQ ID NO: 914802 - RNA, 19 nt, Homo sapiens
ccacacauccuuccugcau

SEQ ID NO: 914803 - RNA, 19 nt, Homo sapiens
gggcucucuuuaccuauga

SEQ ID NO: 914804 - RNA, 19 nt, Homo sapiens
cauguucccugccaacuac

SEQ ID NO: 914805 - RNA, 19 nt, Homo sapiens
cagagaaggaggaggagaa

SEQ ID NO: 914806 - RNA, 19 nt, Homo sapiens
acugggcucucuuuaccua

SEQ ID NO: 914807 - RNA, 19 nt, Homo sapiens
gcugccuucugcauuuauu

SEQ ID NO: 914808 - RNA, 19 nt, Homo sapiens
ccgugucucugaagaacaa

SEQ ID NO: 914809 - RNA, 19 nt, Homo sapiens
gaccgacugggcucucuuu

SEQ ID NO: 914810 - RNA, 19 nt, Homo sapiens
uggcugccuucugcauuua

SEQ ID NO: 914811 - RNA, 19 nt, Homo sapiens
gccuuggccuguugucuuc

SEQ ID NO: 914812 - RNA, 19 nt, Homo sapiens
gaccaaagucagaguggau

SEQ ID NO: 914813 - RNA, 19 nt, Homo sapiens
cuggcugccuucugcauuu

SEQ ID NO: 914814 - RNA, 19 nt, Homo sapiens
gggcccaugugaccaucaa

SEQ ID NO: 914815 - RNA, 19 nt, Homo sapiens
gaguggaucauggugguuu

SEQ ID NO: 914816 - RNA, 19 nt, Homo sapiens
caacuacguggagcucauu

SEQ ID NO: 914817 - RNA, 19 nt, Homo sapiens
ccaacuacguggagcucau

SEQ ID NO: 914818 - RNA, 19 nt, Homo sapiens
cgagggagauuuucaagca

SEQ ID NO: 914819 - RNA, 19 nt, Homo sapiens
gggagcagcagcaagaagu

SEQ ID NO: 914820 - RNA, 19 nt, Homo sapiens
gaagaggaggcuguguaug

SEQ ID NO: 914821 - RNA, 19 nt, Homo sapiens
agaagaggaggcuguguau

SEQ ID NO: 914822 - RNA, 19 nt, Homo sapiens
ccaaccagagacccacuuu

SEQ ID NO: 914823 - RNA, 19 nt, Homo sapiens
gcagcaagaagugguuuca

SEQ ID NO: 914824 - RNA, 19 nt, Homo sapiens
cugagugcaucauggagaa

SEQ ID NO: 914825 - RNA, 19 nt, Homo sapiens
acagugaacguagagaauu

SEQ ID NO: 914826 - RNA, 19 nt, Homo sapiens
cagagcaggagaccuucua

SEQ ID NO: 914827 - RNA, 19 nt, Homo sapiens
uuaaaaggguugguaaaga

SEQ ID NO: 914828 - RNA, 19 nt, Homo sapiens
ugccgugucugagauuaaa

SEQ ID NO: 914829 - RNA, 19 nt, Homo sapiens
cccgugcccuguacgacua

SEQ ID NO: 914830 - RNA, 19 nt, Homo sapiens
agcaagaagugguuucaag

SEQ ID NO: 914831 - RNA, 19 nt, Homo sapiens
ccaacuacagcuuucacaa

SEQ ID NO: 914832 - RNA, 19 nt, Homo sapiens
ggugccaacuacagcuuuc

SEQ ID NO: 914833 - RNA, 19 nt, Homo sapiens
ugggaacagugaacguaga

SEQ ID NO: 914834 - RNA, 19 nt, Homo sapiens
gacauggcuuccuuauugc

SEQ ID NO: 914835 - RNA, 19 nt, Homo sapiens
cggcagacacaacauguuc

SEQ ID NO: 914836 - RNA, 19 nt, Homo sapiens
uaugaaggcaacagcaaug

SEQ ID NO: 914837 - RNA, 19 nt, Homo sapiens
caacagcgggaaggugaug

SEQ ID NO: 914838 - RNA, 19 nt, Homo sapiens
cgugggagcagcagcaaga

SEQ ID NO: 914839 - RNA, 19 nt, Homo sapiens
uaaaaggguugguaaagac

SEQ ID NO: 914840 - RNA, 19 nt, Homo sapiens
aaacggcagacacaacaug

SEQ ID NO: 914841 - RNA, 19 nt, Homo sapiens
agaaugacccuugggaaca

SEQ ID NO: 914842 - RNA, 19 nt, Homo sapiens
caaccagagacccacuuug

SEQ ID NO: 914843 - RNA, 19 nt, Homo sapiens
cagcucacccaaccagaga

SEQ ID NO: 914844 - RNA, 19 nt, Homo sapiens
ugucucugaagaacaaaua

SEQ ID NO: 914845 - RNA, 19 nt, Homo sapiens
cagacauggcuuccuuauu

SEQ ID NO: 914846 - RNA, 19 nt, Homo sapiens
caaauuuguccucaucaac

SEQ ID NO: 914847 - RNA, 19 nt, Homo sapiens
gcagcagcaagaagugguu

SEQ ID NO: 914848 - RNA, 19 nt, Homo sapiens
gugccucaacugauucuga

SEQ ID NO: 914849 - RNA, 19 nt, Homo sapiens
ugaacguagagaauuguuu

SEQ ID NO: 914850 - RNA, 19 nt, Homo sapiens
cagcaauggccuggugauu

SEQ ID NO: 914851 - RNA, 19 nt, Homo sapiens
ucagacauggcuuccuuau

SEQ ID NO: 914852 - RNA, 19 nt, Homo sapiens
agaggaggcuguguaugag

SEQ ID NO: 914853 - RNA, 19 nt, Homo sapiens
cugaagaacaaauaugcuu

SEQ ID NO: 914854 - RNA, 19 nt, Homo sapiens
gccugggaguugacauuca

SEQ ID NO: 914855 - RNA, 19 nt, Homo sapiens
agaggaggccugggaguug

SEQ ID NO: 914856 - RNA, 19 nt, Homo sapiens
ggagcagcagcaagaagug

SEQ ID NO: 914857 - RNA, 19 nt, Homo sapiens
gcaagagggugaggaacua

SEQ ID NO: 914858 - RNA, 19 nt, Homo sapiens
ggaaguuucugcagagguu

SEQ ID NO: 914859 - RNA, 19 nt, Homo sapiens
ggaauaggguggccacauc

SEQ ID NO: 914860 - RNA, 19 nt, Homo sapiens
gaugagaucuaccaugucu

SEQ ID NO: 914861 - RNA, 19 nt, Homo sapiens
caacagcucccggaaguuu

SEQ ID NO: 914862 - RNA, 19 nt, Homo sapiens
cgagcgaggugauagaaga

SEQ ID NO: 914863 - RNA, 19 nt, Homo sapiens
ccacaucaguaaccgauuc

SEQ ID NO: 914864 - RNA, 19 nt, Homo sapiens
gagaugggauuggguggaa

SEQ ID NO: 914865 - RNA, 19 nt, Homo sapiens
ccgaugagaucuaccaugu

SEQ ID NO: 914866 - RNA, 19 nt, Homo sapiens
ucagagagguggauauggu

SEQ ID NO: 914867 - RNA, 19 nt, Homo sapiens
cgaggcaccacuaaauaua

SEQ ID NO: 914868 - RNA, 19 nt, Homo sapiens
gugaggaacuacuucuguu

SEQ ID NO: 914869 - RNA, 19 nt, Homo sapiens
ucagugugaucuuuaccua

SEQ ID NO: 914870 - RNA, 19 nt, Homo sapiens
agacuucagugugaucuuu

SEQ ID NO: 914871 - RNA, 19 nt, Homo sapiens
ggagggugcugcugaacca

SEQ ID NO: 914872 - RNA, 19 nt, Homo sapiens
uaccaugucuauagcuuug

SEQ ID NO: 914873 - RNA, 19 nt, Homo sapiens
gauagaagacgagaagcaa

SEQ ID NO: 914874 - RNA, 19 nt, Homo sapiens
gccaagaccuacuggaaac

SEQ ID NO: 914875 - RNA, 19 nt, Homo sapiens
gcaucaucgucaucaaaga

SEQ ID NO: 914876 - RNA, 19 nt, Homo sapiens
guugugggcuccaggacuu

SEQ ID NO: 914877 - RNA, 19 nt, Homo sapiens
cgacauaacggaggacuuc

SEQ ID NO: 914878 - RNA, 19 nt, Homo sapiens
ggccaagaccuacuggaaa

SEQ ID NO: 914879 - RNA, 19 nt, Homo sapiens
uagaagacgagaagcaauu

SEQ ID NO: 914880 - RNA, 19 nt, Homo sapiens
gaucuaccaugucuauagc

SEQ ID NO: 914881 - RNA, 19 nt, Homo sapiens
ugagaucuaccaugucuau

SEQ ID NO: 914882 - RNA, 19 nt, Homo sapiens
gaauaggguggccacauca

SEQ ID NO: 914883 - RNA, 19 nt, Homo sapiens
gucgaggcaccacuaaaua

SEQ ID NO: 914884 - RNA, 19 nt, Homo sapiens
ugucugccguccacucaaa

SEQ ID NO: 914885 - RNA, 19 nt, Homo sapiens
gaggaacuacuucuguugu

SEQ ID NO: 914886 - RNA, 19 nt, Homo sapiens
ggacuguggagcuggcauu

SEQ ID NO: 914887 - RNA, 19 nt, Homo sapiens
ggugauagaagacgagaag

SEQ ID NO: 914888 - RNA, 19 nt, Homo sapiens
gagagucgcgguugcugau

SEQ ID NO: 914889 - RNA, 19 nt, Homo sapiens
ggugaggaacuacuucugu

SEQ ID NO: 914890 - RNA, 19 nt, Homo sapiens
gagcuggcauugggaggau

SEQ ID NO: 914891 - RNA, 19 nt, Homo sapiens
ggaaggcccgaacaagaca

SEQ ID NO: 914892 - RNA, 19 nt, Homo sapiens
uaggguggccacaucagua

SEQ ID NO: 914893 - RNA, 19 nt, Homo sapiens
gaggcaccacuaaauauag

SEQ ID NO: 914894 - RNA, 19 nt, Homo sapiens
gacuucagugugaucuuua

SEQ ID NO: 914895 - RNA, 19 nt, Homo sapiens
ugaucguggugcuugagua

SEQ ID NO: 914896 - RNA, 19 nt, Homo sapiens
gaucguggugcuugaguag

SEQ ID NO: 914897 - RNA, 19 nt, Homo sapiens
ccagcagcaucgacaucaa

SEQ ID NO: 914898 - RNA, 19 nt, Homo sapiens
cuauagcuuugcccugaga

SEQ ID NO: 914899 - RNA, 19 nt, Homo sapiens
guucagagagguggauaug

SEQ ID NO: 914900 - RNA, 19 nt, Homo sapiens
gggaaggcccgaacaagac

SEQ ID NO: 914901 - RNA, 19 nt, Homo sapiens
ucgaggcaccacuaaauau

SEQ ID NO: 914902 - RNA, 19 nt, Homo sapiens
ugucgaggcaccacuaaau

SEQ ID NO: 914903 - RNA, 19 nt, Homo sapiens
gacgugguccgcaggauca

SEQ ID NO: 914904 - RNA, 19 nt, Homo sapiens
cggcaucaucgucaucaaa

SEQ ID NO: 914905 - RNA, 19 nt, Homo sapiens
uaggccaccucaccgauca

SEQ ID NO: 914906 - RNA, 19 nt, Homo sapiens
gaguagagccgugguuggu

SEQ ID NO: 914907 - RNA, 19 nt, Homo sapiens
aagaccuacuggaaacaaa

SEQ ID NO: 914908 - RNA, 19 nt, Homo sapiens
ugaggaacuacuucuguug

SEQ ID NO: 914909 - RNA, 19 nt, Homo sapiens
caagaccuacuggaaacaa

SEQ ID NO: 914910 - RNA, 19 nt, Homo sapiens
gacgagcgaggugauagaa

SEQ ID NO: 914911 - RNA, 19 nt, Homo sapiens
gcuggcgguucgugagugu

SEQ ID NO: 914912 - RNA, 19 nt, Homo sapiens
gagaucuaccaugucuaua

SEQ ID NO: 914913 - RNA, 19 nt, Homo sapiens
ggcaggagaaacugaggaa

SEQ ID NO: 914914 - RNA, 19 nt, Homo sapiens
uagcuuugcccugagauga

SEQ ID NO: 914915 - RNA, 19 nt, Homo sapiens
ccgaggagaggcaggagaa

SEQ ID NO: 914916 - RNA, 19 nt, Homo sapiens
cgucaucaaagacaacaug

SEQ ID NO: 914917 - RNA, 19 nt, Homo sapiens
agggaaggcccgaacaaga

SEQ ID NO: 914918 - RNA, 19 nt, Homo sapiens
ucuaccaugucuauagcuu

SEQ ID NO: 914919 - RNA, 19 nt, Homo sapiens
ggacucuuacgacgugauc

SEQ ID NO: 914920 - RNA, 19 nt, Homo sapiens
gagggaaggcccgaacaag

SEQ ID NO: 914921 - RNA, 19 nt, Homo sapiens
gcacaagacuggacuuaga

SEQ ID NO: 914922 - RNA, 19 nt, Homo sapiens
caacagcccugguaaggaa

SEQ ID NO: 914923 - RNA, 19 nt, Homo sapiens
gccaaaugcucacagaaua

SEQ ID NO: 914924 - RNA, 19 nt, Homo sapiens
gaaagucuccugagcauau

SEQ ID NO: 914925 - RNA, 19 nt, Homo sapiens
gggauaaacaucacaauaa

SEQ ID NO: 914926 - RNA, 19 nt, Homo sapiens
gaaguggaaaggauuaaua

SEQ ID NO: 914927 - RNA, 19 nt, Homo sapiens
caaggaucauucugacuua

SEQ ID NO: 914928 - RNA, 19 nt, Homo sapiens
agacacagcucacaucuuc

SEQ ID NO: 914929 - RNA, 19 nt, Homo sapiens
gacaagacauccuggaaug

SEQ ID NO: 914930 - RNA, 19 nt, Homo sapiens
ggaagauggugcuaagaug

SEQ ID NO: 914931 - RNA, 19 nt, Homo sapiens
ucacugaaguugcccauug

SEQ ID NO: 914932 - RNA, 19 nt, Homo sapiens
uaucagaaccucaaucauu

SEQ ID NO: 914933 - RNA, 19 nt, Homo sapiens
gcuaggagcucuggccaaa

SEQ ID NO: 914934 - RNA, 19 nt, Homo sapiens
gcugaaauauuccuaccaa

SEQ ID NO: 914935 - RNA, 19 nt, Homo sapiens
gcucacaucuucugucagu

SEQ ID NO: 914936 - RNA, 19 nt, Homo sapiens
gcaggaagauggugcuaag

SEQ ID NO: 914937 - RNA, 19 nt, Homo sapiens
gcauauguccugaggcuaa

SEQ ID NO: 914938 - RNA, 19 nt, Homo sapiens
aggaagagcugcaggaaga

SEQ ID NO: 914939 - RNA, 19 nt, Homo sapiens
ugacugagcucuccuugag

SEQ ID NO: 914940 - RNA, 19 nt, Homo sapiens
gcaucgaccucuguagaaa

SEQ ID NO: 914941 - RNA, 19 nt, Homo sapiens
aauaccagcuguucuaaga

SEQ ID NO: 914942 - RNA, 19 nt, Homo sapiens
gauguuguaugcagaguuc

SEQ ID NO: 914943 - RNA, 19 nt, Homo sapiens
cuuuaggacugaccuguua

SEQ ID NO: 914944 - RNA, 19 nt, Homo sapiens
aagcaaagcuacaucaucu

SEQ ID NO: 914945 - RNA, 19 nt, Homo sapiens
uagaaacccugaaggugaa

SEQ ID NO: 914946 - RNA, 19 nt, Homo sapiens
gugcuaagauguuguaugc

SEQ ID NO: 914947 - RNA, 19 nt, Homo sapiens
uuaaaugccucaccacauc

SEQ ID NO: 914948 - RNA, 19 nt, Homo sapiens
gaagauggugcuaagaugu

SEQ ID NO: 914949 - RNA, 19 nt, Homo sapiens
aaagcuacaucaucuacaa

SEQ ID NO: 914950 - RNA, 19 nt, Homo sapiens
ggacaagacauccuggaau

SEQ ID NO: 914951 - RNA, 19 nt, Homo sapiens
ggaccuuucuucacacaca

SEQ ID NO: 914952 - RNA, 19 nt, Homo sapiens
gcagaguuccaaagaguga

SEQ ID NO: 914953 - RNA, 19 nt, Homo sapiens
gcuaagcaacuuuaugaau

SEQ ID NO: 914954 - RNA, 19 nt, Homo sapiens
gcaguccugucuccagaug

SEQ ID NO: 914955 - RNA, 19 nt, Homo sapiens
cagcucacaucuucuguca

SEQ ID NO: 914956 - RNA, 19 nt, Homo sapiens
ccaaggaucauucugacuu

SEQ ID NO: 914957 - RNA, 19 nt, Homo sapiens
uagaaagucuccugagcau

SEQ ID NO: 914958 - RNA, 19 nt, Homo sapiens
agaccuaacucgacuguac

SEQ ID NO: 914959 - RNA, 19 nt, Homo sapiens
gaacuggccaaggaucauu

SEQ ID NO: 914960 - RNA, 19 nt, Homo sapiens
ucagugaaguggaaaggau

SEQ ID NO: 914961 - RNA, 19 nt, Homo sapiens
ccaaagcgcguaccaccuu

SEQ ID NO: 914962 - RNA, 19 nt, Homo sapiens
gcaaagcuacaucaucuac

SEQ ID NO: 914963 - RNA, 19 nt, Homo sapiens
caagaagagucgagaaaau

SEQ ID NO: 914964 - RNA, 19 nt, Homo sapiens
uuaccacccuugaaacaau

SEQ ID NO: 914965 - RNA, 19 nt, Homo sapiens
aaacuuagaggaacauagu

SEQ ID NO: 914966 - RNA, 19 nt, Homo sapiens
ucaggcaaaucaucuaugg

SEQ ID NO: 914967 - RNA, 19 nt, Homo sapiens
ccaaaugcucacagaauau

SEQ ID NO: 914968 - RNA, 19 nt, Homo sapiens
agugaggccuccaacauug

SEQ ID NO: 914969 - RNA, 19 nt, Homo sapiens
gggcacaagacuggacuua

SEQ ID NO: 914970 - RNA, 19 nt, Homo sapiens
gagaaaauguuaaggaacu

SEQ ID NO: 914971 - RNA, 19 nt, Homo sapiens
ccaaagcaaagcuacauca

SEQ ID NO: 914972 - RNA, 19 nt, Homo sapiens
gcaggacuucuuccaguau

SEQ ID NO: 914973 - RNA, 19 nt, Homo sapiens
ggccaaaugcucacagaau

SEQ ID NO: 914974 - RNA, 19 nt, Homo sapiens
aggcuaagcaacuuuauga

SEQ ID NO: 914975 - RNA, 19 nt, Homo sapiens
cggugaagcugcaggacuu

SEQ ID NO: 914976 - RNA, 19 nt, Homo sapiens
ucuaugggcuucuuuuaaa

SEQ ID NO: 914977 - RNA, 19 nt, Homo sapiens
caccacaucuggacaagac

SEQ ID NO: 914978 - RNA, 19 nt, Homo sapiens
gaaauauuccuaccaaaag

SEQ ID NO: 914979 - RNA, 19 nt, Homo sapiens
guaugcagaguuccaaaga

SEQ ID NO: 914980 - RNA, 19 nt, Homo sapiens
acaccgagaccaaagcaaa

SEQ ID NO: 914981 - RNA, 19 nt, Homo sapiens
guaugguaguuaugucugu

SEQ ID NO: 914982 - RNA, 19 nt, Homo sapiens
gaagagcugcaggaagaug

SEQ ID NO: 914983 - RNA, 19 nt, Homo sapiens
ugcaggacuucuuccagua

SEQ ID NO: 914984 - RNA, 19 nt, Homo sapiens
gcgcguaccaccuuucauc

SEQ ID NO: 914985 - RNA, 19 nt, Homo sapiens
guacggacgcuucggaucu

SEQ ID NO: 914986 - RNA, 19 nt, Homo sapiens
gcacggacuaugccagcaa

SEQ ID NO: 914987 - RNA, 19 nt, Homo sapiens
uacaucaucuacaauccuu

SEQ ID NO: 914988 - RNA, 19 nt, Homo sapiens
gaaggugaaacagaccauu

SEQ ID NO: 914989 - RNA, 19 nt, Homo sapiens
gaaccacugcacacaccaa

SEQ ID NO: 914990 - RNA, 19 nt, Homo sapiens
aaaggcagaagaaacagaa

SEQ ID NO: 914991 - RNA, 19 nt, Homo sapiens
uagcaucgaccucuguaga

SEQ ID NO: 914992 - RNA, 19 nt, Homo sapiens
caaaugcucacagaauauc

SEQ ID NO: 914993 - RNA, 19 nt, Homo sapiens
uaccacccuugaaacaauu

SEQ ID NO: 914994 - RNA, 19 nt, Homo sapiens
uaugguaguuaugucugua

SEQ ID NO: 914995 - RNA, 19 nt, Homo sapiens
ccuccaacauugaauaaaa

SEQ ID NO: 914996 - RNA, 19 nt, Homo sapiens
gcggccaaaugcucacaga

SEQ ID NO: 914997 - RNA, 19 nt, Homo sapiens
auaaucaacagcccuggua

SEQ ID NO: 914998 - RNA, 19 nt, Homo sapiens
cguaccaccuuucaucagu

SEQ ID NO: 914999 - RNA, 19 nt, Homo sapiens
gaccaaagcaaagcuacau

SEQ ID NO: 915000 - RNA, 19 nt, Homo sapiens
uaccaccuuucaucaguga

SEQ ID NO: 915001 - RNA, 19 nt, Homo sapiens
uagugaggccuccaacauu

SEQ ID NO: 915002 - RNA, 19 nt, Homo sapiens
aggcagaagaaacagaaua

SEQ ID NO: 915003 - RNA, 19 nt, Homo sapiens
gcuagcaucgaccucugua

SEQ ID NO: 915004 - RNA, 19 nt, Homo sapiens
caggacuucuuccaguaug

SEQ ID NO: 915005 - RNA, 19 nt, Homo sapiens
agacacggcugggcacaag

SEQ ID NO: 915006 - RNA, 19 nt, Homo sapiens
uaaggaagagcugcaggaa

SEQ ID NO: 915007 - RNA, 19 nt, Homo sapiens
ccauugcugucaguugcua

SEQ ID NO: 915008 - RNA, 19 nt, Homo sapiens
ggaucauucugacuuaagc

SEQ ID NO: 915009 - RNA, 19 nt, Homo sapiens
aauaucagaaccucaauca

SEQ ID NO: 915010 - RNA, 19 nt, Homo sapiens
gaauaucucagcccaucag

SEQ ID NO: 915011 - RNA, 19 nt, Homo sapiens
ggggauaaacaucacaaua

SEQ ID NO: 915012 - RNA, 19 nt, Homo sapiens
ggccuccaacauugaauaa

SEQ ID NO: 915013 - RNA, 19 nt, Homo sapiens
ccaaaagguagaucaaauu

SEQ ID NO: 915014 - RNA, 19 nt, Homo sapiens
gcacaccgagaccaaagca

SEQ ID NO: 915015 - RNA, 19 nt, Homo sapiens
caagacauccuggaaugca

SEQ ID NO: 915016 - RNA, 19 nt, Homo sapiens
uaggagcucuggccaaagc

SEQ ID NO: 915017 - RNA, 19 nt, Homo sapiens
cgguuuggguuguuaaugg

SEQ ID NO: 915018 - RNA, 19 nt, Homo sapiens
gaauaccagcuguucuaag

SEQ ID NO: 915019 - RNA, 19 nt, Homo sapiens
cagaagaaacagaauacca

SEQ ID NO: 915020 - RNA, 19 nt, Homo sapiens
ucaaugccacaaggucaua

SEQ ID NO: 915021 - RNA, 19 nt, Homo sapiens
gaaaguugcugaaguuugu

SEQ ID NO: 915022 - RNA, 19 nt, Homo sapiens
gcucaaggcucccaggaua

SEQ ID NO: 915023 - RNA, 19 nt, Homo sapiens
gaaccacagucuccucauu

SEQ ID NO: 915024 - RNA, 19 nt, Homo sapiens
gaagagcacugggcaccua

SEQ ID NO: 915025 - RNA, 19 nt, Homo sapiens
gaaauaaacaggaacaaag

SEQ ID NO: 915026 - RNA, 19 nt, Homo sapiens
acacagucguugcagauua

SEQ ID NO: 915027 - RNA, 19 nt, Homo sapiens
ggacuuggccagcguggua

SEQ ID NO: 915028 - RNA, 19 nt, Homo sapiens
gcugugagacaauaaauuu

SEQ ID NO: 915029 - RNA, 19 nt, Homo sapiens
ggagaaggcagccguguga

SEQ ID NO: 915030 - RNA, 19 nt, Homo sapiens
cuaaggagauggccacaug

SEQ ID NO: 915031 - RNA, 19 nt, Homo sapiens
gagcauggauugugaugag

SEQ ID NO: 915032 - RNA, 19 nt, Homo sapiens
ggucagacaucuccuugau

SEQ ID NO: 915033 - RNA, 19 nt, Homo sapiens
gaauggagagcauggauug

SEQ ID NO: 915034 - RNA, 19 nt, Homo sapiens
gcagagccuuugacaguuc

SEQ ID NO: 915035 - RNA, 19 nt, Homo sapiens
cauccgagcuggcgaggaa

SEQ ID NO: 915036 - RNA, 19 nt, Homo sapiens
caaaggagacaaagcaaga

SEQ ID NO: 915037 - RNA, 19 nt, Homo sapiens
cguagaaucugaaauaaac

SEQ ID NO: 915038 - RNA, 19 nt, Homo sapiens
ggacaggauccuucccuaa

SEQ ID NO: 915039 - RNA, 19 nt, Homo sapiens
gaucaaaccaugacaggau

SEQ ID NO: 915040 - RNA, 19 nt, Homo sapiens
gacaggauccuucccuaaa

SEQ ID NO: 915041 - RNA, 19 nt, Homo sapiens
aaugugaccuuguuuggaa

SEQ ID NO: 915042 - RNA, 19 nt, Homo sapiens
guggaaacgugcaagagaa

SEQ ID NO: 915043 - RNA, 19 nt, Homo sapiens
cacagucguugcagauuaa

SEQ ID NO: 915044 - RNA, 19 nt, Homo sapiens
ccagaugacugucuaacca

SEQ ID NO: 915045 - RNA, 19 nt, Homo sapiens
ggagauggccacaugaaca

SEQ ID NO: 915046 - RNA, 19 nt, Homo sapiens
gacaggagcacguucagaa

SEQ ID NO: 915047 - RNA, 19 nt, Homo sapiens
ucacaggccugcucauuuu

SEQ ID NO: 915048 - RNA, 19 nt, Homo sapiens
ccagaagggugggaagcua

SEQ ID NO: 915049 - RNA, 19 nt, Homo sapiens
ucagagaaaugauaagacu

SEQ ID NO: 915050 - RNA, 19 nt, Homo sapiens
ggaagcagcagcaaugucu

SEQ ID NO: 915051 - RNA, 19 nt, Homo sapiens
agacaaagcaagaccagaa

SEQ ID NO: 915052 - RNA, 19 nt, Homo sapiens
cuuguucacucauucgaua

SEQ ID NO: 915053 - RNA, 19 nt, Homo sapiens
uaaccagaccucagaauca

SEQ ID NO: 915054 - RNA, 19 nt, Homo sapiens
ucaagaggcugacaaucca

SEQ ID NO: 915055 - RNA, 19 nt, Homo sapiens
uggcagaucuggagaagag

SEQ ID NO: 915056 - RNA, 19 nt, Homo sapiens
gggagauucugaccacugu

SEQ ID NO: 915057 - RNA, 19 nt, Homo sapiens
gcagugggugcccugguua

SEQ ID NO: 915058 - RNA, 19 nt, Homo sapiens
gcagacccaucucccuugu

SEQ ID NO: 915059 - RNA, 19 nt, Homo sapiens
ccacgcagccacaggguuu

SEQ ID NO: 915060 - RNA, 19 nt, Homo sapiens
ucucaaaagugguuucaua

SEQ ID NO: 915061 - RNA, 19 nt, Homo sapiens
ggacugcccagaugacugu

SEQ ID NO: 915062 - RNA, 19 nt, Homo sapiens
ggagcacguucagaaaguu

SEQ ID NO: 915063 - RNA, 19 nt, Homo sapiens
agucguugcagauuaauua

SEQ ID NO: 915064 - RNA, 19 nt, Homo sapiens
caacacacggcuaugauca

SEQ ID NO: 915065 - RNA, 19 nt, Homo sapiens
ccacaacacacggcuauga

SEQ ID NO: 915066 - RNA, 19 nt, Homo sapiens
agaccacacugacuucuuc

SEQ ID NO: 915067 - RNA, 19 nt, Homo sapiens
ggucugaguucugaaugga

SEQ ID NO: 915068 - RNA, 19 nt, Homo sapiens
gggaagcuaccacggauug

SEQ ID NO: 915069 - RNA, 19 nt, Homo sapiens
guucggagagcucuggaua

SEQ ID NO: 915070 - RNA, 19 nt, Homo sapiens
ggauguccauguccucaca

SEQ ID NO: 915071 - RNA, 19 nt, Homo sapiens
ucagaaacgucuccaaagc

SEQ ID NO: 915072 - RNA, 19 nt, Homo sapiens
gcucagagaaaugauaaga

SEQ ID NO: 915073 - RNA, 19 nt, Homo sapiens
agacccaucucccuuguca

SEQ ID NO: 915074 - RNA, 19 nt, Homo sapiens
gcaggcucuucaagcgaua

SEQ ID NO: 915075 - RNA, 19 nt, Homo sapiens
gaaggagucggagaucaga

SEQ ID NO: 915076 - RNA, 19 nt, Homo sapiens
ugaagcaccucagaaugug

SEQ ID NO: 915077 - RNA, 19 nt, Homo sapiens
uggagagcauggauuguga

SEQ ID NO: 915078 - RNA, 19 nt, Homo sapiens
ucccauaggauucugauuu

SEQ ID NO: 915079 - RNA, 19 nt, Homo sapiens
aaucagaaacgucuccaaa

SEQ ID NO: 915080 - RNA, 19 nt, Homo sapiens
cacagucuccucauucaaa

SEQ ID NO: 915081 - RNA, 19 nt, Homo sapiens
ggacugaccccucacuuga

SEQ ID NO: 915082 - RNA, 19 nt, Homo sapiens
ugggcuggcugaucaaaga

SEQ ID NO: 915083 - RNA, 19 nt, Homo sapiens
acacacggcuaugaucaug

SEQ ID NO: 915084 - RNA, 19 nt, Homo sapiens
ggcagagccuuugacaguu

SEQ ID NO: 915085 - RNA, 19 nt, Homo sapiens
gguggaaacgugcaagaga

SEQ ID NO: 915086 - RNA, 19 nt, Homo sapiens
ugaccacugucccauagga

SEQ ID NO: 915087 - RNA, 19 nt, Homo sapiens
gcguggcccugguccuaaa

SEQ ID NO: 915088 - RNA, 19 nt, Homo sapiens
caugacugguguccuucua

SEQ ID NO: 915089 - RNA, 19 nt, Homo sapiens
gaaugugaccuuguuugga

SEQ ID NO: 915090 - RNA, 19 nt, Homo sapiens
gagaaaugauaagacuaca

SEQ ID NO: 915091 - RNA, 19 nt, Homo sapiens
aaacaggaacaaagacguu

SEQ ID NO: 915092 - RNA, 19 nt, Homo sapiens
gcagggcuggguucuguga

SEQ ID NO: 915093 - RNA, 19 nt, Homo sapiens
gaagguaaagccugucacu

SEQ ID NO: 915094 - RNA, 19 nt, Homo sapiens
ccacacuccucgcaucucu

SEQ ID NO: 915095 - RNA, 19 nt, Homo sapiens
uaucugaaguggcucugau

SEQ ID NO: 915096 - RNA, 19 nt, Homo sapiens
gauggcagaucuggagaag

SEQ ID NO: 915097 - RNA, 19 nt, Homo sapiens
uaacuugaagcaccucaga

SEQ ID NO: 915098 - RNA, 19 nt, Homo sapiens
gcuaugaucaugacaacca

SEQ ID NO: 915099 - RNA, 19 nt, Homo sapiens
caggaggccuuccagacau

SEQ ID NO: 915100 - RNA, 19 nt, Homo sapiens
agaggaagcagcagcaaug

SEQ ID NO: 915101 - RNA, 19 nt, Homo sapiens
uacagggucugaguucuga

SEQ ID NO: 915102 - RNA, 19 nt, Homo sapiens
gaaacaguacagggucuga

SEQ ID NO: 915103 - RNA, 19 nt, Homo sapiens
gugcucagagaaaugauaa

SEQ ID NO: 915104 - RNA, 19 nt, Homo sapiens
aaacacagucguugcagau

SEQ ID NO: 915105 - RNA, 19 nt, Homo sapiens
cuucuguccuacucuguaa

SEQ ID NO: 915106 - RNA, 19 nt, Homo sapiens
aagccaggauucugaggaa

SEQ ID NO: 915107 - RNA, 19 nt, Homo sapiens
aaguggcucugaugccuuu

SEQ ID NO: 915108 - RNA, 19 nt, Homo sapiens
gugaaggagucggagauca

SEQ ID NO: 915109 - RNA, 19 nt, Homo sapiens
ugacugguguccuucuaag

SEQ ID NO: 915110 - RNA, 19 nt, Homo sapiens
ccaggaggccuuccagaca

SEQ ID NO: 915111 - RNA, 19 nt, Homo sapiens
guacagggucugaguucug

SEQ ID NO: 915112 - RNA, 19 nt, Homo sapiens
gcaaccacaagccaaggaa

SEQ ID NO: 915113 - RNA, 19 nt, Homo sapiens
gaagcaccucagaauguga

SEQ ID NO: 915114 - RNA, 19 nt, Homo sapiens
acaaucacguucacaacca

SEQ ID NO: 915115 - RNA, 19 nt, Homo sapiens
gacacaaucacguucacaa

SEQ ID NO: 915116 - RNA, 19 nt, Homo sapiens
gcacucucucccugacuuu

SEQ ID NO: 915117 - RNA, 19 nt, Homo sapiens
ucacuugaccagucccauu

SEQ ID NO: 915118 - RNA, 19 nt, Homo sapiens
acaggauccuucccuaaag

SEQ ID NO: 915119 - RNA, 19 nt, Homo sapiens
acaagccgguggccucugu

SEQ ID NO: 915120 - RNA, 19 nt, Homo sapiens
gcccugugcucagagaaau

SEQ ID NO: 915121 - RNA, 19 nt, Homo sapiens
ggaaggagauggcgaaagg

SEQ ID NO: 915122 - RNA, 19 nt, Homo sapiens
uaauaaagaucucguugug

SEQ ID NO: 915123 - RNA, 19 nt, Homo sapiens
ugaagaagaucccgacaug

SEQ ID NO: 915124 - RNA, 19 nt, Homo sapiens
ccgaggagccuaauaaaga

SEQ ID NO: 915125 - RNA, 19 nt, Homo sapiens
cgaggagccuaauaaagau

SEQ ID NO: 915126 - RNA, 19 nt, Homo sapiens
uggaggagcccagguauaa

SEQ ID NO: 915127 - RNA, 19 nt, Homo sapiens
gaaggacgaggacaucuac

SEQ ID NO: 915128 - RNA, 19 nt, Homo sapiens
guggacggcugcauucauc

SEQ ID NO: 915129 - RNA, 19 nt, Homo sapiens
gcagcgacaucaccaagcu

SEQ ID NO: 915130 - RNA, 19 nt, Homo sapiens
aagaagaucccgacaugga

SEQ ID NO: 915131 - RNA, 19 nt, Homo sapiens
ugaagggccugagugacaa

SEQ ID NO: 915132 - RNA, 19 nt, Homo sapiens
ccgcucaugucucuacaga

SEQ ID NO: 915133 - RNA, 19 nt, Homo sapiens
caucuccaccggcguguuu

SEQ ID NO: 915134 - RNA, 19 nt, Homo sapiens
ggaggagcccagguauaaa

SEQ ID NO: 915135 - RNA, 19 nt, Homo sapiens
gggaggaacauuacuucug

SEQ ID NO: 915136 - RNA, 19 nt, Homo sapiens
aggacaagcagcucaauga

SEQ ID NO: 915137 - RNA, 19 nt, Homo sapiens
cgaaagggguggcugugaa

SEQ ID NO: 915138 - RNA, 19 nt, Homo sapiens
agaaggacgaggacaucua

SEQ ID NO: 915139 - RNA, 19 nt, Homo sapiens
ucugagaggucgccaaagc

SEQ ID NO: 915140 - RNA, 19 nt, Homo sapiens
gaggagcccagguauaaaa

SEQ ID NO: 915141 - RNA, 19 nt, Homo sapiens
guggaggagcccagguaua

SEQ ID NO: 915142 - RNA, 19 nt, Homo sapiens
cuaauaaagaucucguugu

SEQ ID NO: 915143 - RNA, 19 nt, Homo sapiens
ggacccugcagagcuguaa

SEQ ID NO: 915144 - RNA, 19 nt, Homo sapiens
agaagaucccgacauggaa

SEQ ID NO: 915145 - RNA, 19 nt, Homo sapiens
gcgggaggaacauuacuuc

SEQ ID NO: 915146 - RNA, 19 nt, Homo sapiens
cugaagggccugagugaca

SEQ ID NO: 915147 - RNA, 19 nt, Homo sapiens
gcugaucaucugcguguuc

SEQ ID NO: 915148 - RNA, 19 nt, Homo sapiens
acaagcagcgggaggaaca

SEQ ID NO: 915149 - RNA, 19 nt, Homo sapiens
ggucaguagucuuguaaua

SEQ ID NO: 915150 - RNA, 19 nt, Homo sapiens
gcaaugauacuaggauaua

SEQ ID NO: 915151 - RNA, 19 nt, Homo sapiens
guuaccagaugaugaauuu

SEQ ID NO: 915152 - RNA, 19 nt, Homo sapiens
gaagaaacaccaaacuaug

SEQ ID NO: 915153 - RNA, 19 nt, Homo sapiens
gaacgagccuacgugugua

SEQ ID NO: 915154 - RNA, 19 nt, Homo sapiens
aagcagaacaugcguaaua

SEQ ID NO: 915155 - RNA, 19 nt, Homo sapiens
gaacuggugugaggaggaa

SEQ ID NO: 915156 - RNA, 19 nt, Homo sapiens
gaacaugcguaauauucuc

SEQ ID NO: 915157 - RNA, 19 nt, Homo sapiens
guaacucauuucuuccaua

SEQ ID NO: 915158 - RNA, 19 nt, Homo sapiens
gcaagcagaacaugcguaa

SEQ ID NO: 915159 - RNA, 19 nt, Homo sapiens
guacagccuugaaugugaa

SEQ ID NO: 915160 - RNA, 19 nt, Homo sapiens
gcagaaugacuacgaauag

SEQ ID NO: 915161 - RNA, 19 nt, Homo sapiens
uccaaauacuugugcuuua

SEQ ID NO: 915162 - RNA, 19 nt, Homo sapiens
ugaagaaacaccaaacuau

SEQ ID NO: 915163 - RNA, 19 nt, Homo sapiens
ccaaauacuugugcuuuag

SEQ ID NO: 915164 - RNA, 19 nt, Homo sapiens
guuauuugcuggcuauugu

SEQ ID NO: 915165 - RNA, 19 nt, Homo sapiens
guaguuaccagaugaugaa

SEQ ID NO: 915166 - RNA, 19 nt, Homo sapiens
ccacguuguuguauguauu

SEQ ID NO: 915167 - RNA, 19 nt, Homo sapiens
gcacuuucaucuguugaga

SEQ ID NO: 915168 - RNA, 19 nt, Homo sapiens
uaggauaaaugacuaguac

SEQ ID NO: 915169 - RNA, 19 nt, Homo sapiens
cagaacaugcguaauauuc

SEQ ID NO: 915170 - RNA, 19 nt, Homo sapiens
gcagaacaugcguaauauu

SEQ ID NO: 915171 - RNA, 19 nt, Homo sapiens
ucuauugggucagugauuu

SEQ ID NO: 915172 - RNA, 19 nt, Homo sapiens
ggcagaaugacuacgaaua

SEQ ID NO: 915173 - RNA, 19 nt, Homo sapiens
gauacuaggauauacacuu

SEQ ID NO: 915174 - RNA, 19 nt, Homo sapiens
uaccuggucuguagcugua

SEQ ID NO: 915175 - RNA, 19 nt, Homo sapiens
cuacguguguaccugaauu

SEQ ID NO: 915176 - RNA, 19 nt, Homo sapiens
ugaacgagccuacgugugu

SEQ ID NO: 915177 - RNA, 19 nt, Homo sapiens
uguacagccuugaauguga

SEQ ID NO: 915178 - RNA, 19 nt, Homo sapiens
guuguuguauguauugaug

SEQ ID NO: 915179 - RNA, 19 nt, Homo sapiens
gggccacguuguuguaugu

SEQ ID NO: 915180 - RNA, 19 nt, Homo sapiens
caaacuauguacagagaac

SEQ ID NO: 915181 - RNA, 19 nt, Homo sapiens
agaaacaccaaacuaugua

SEQ ID NO: 915182 - RNA, 19 nt, Homo sapiens
gagccuauguugacucacu

SEQ ID NO: 915183 - RNA, 19 nt, Homo sapiens
gauguacagccuugaaugu

SEQ ID NO: 915184 - RNA, 19 nt, Homo sapiens
gucaguagucuuguaauaa

SEQ ID NO: 915185 - RNA, 19 nt, Homo sapiens
uauggucaguagucuugua

SEQ ID NO: 915186 - RNA, 19 nt, Homo sapiens
aaacuugacaugagccuau

SEQ ID NO: 915187 - RNA, 19 nt, Homo sapiens
acaccaaacuauguacaga

SEQ ID NO: 915188 - RNA, 19 nt, Homo sapiens
aagaaacaccaaacuaugu

SEQ ID NO: 915189 - RNA, 19 nt, Homo sapiens
guucagucuguguuauuua

SEQ ID NO: 915190 - RNA, 19 nt, Homo sapiens
gauguacagacaaagcaaa

SEQ ID NO: 915191 - RNA, 19 nt, Homo sapiens
ggauaaaugacuaguacgu

SEQ ID NO: 915192 - RNA, 19 nt, Homo sapiens
cagccuugaaugugaauaa

SEQ ID NO: 915193 - RNA, 19 nt, Homo sapiens
accaaacuauguacagaga

SEQ ID NO: 915194 - RNA, 19 nt, Homo sapiens
uacuugugcuuuaggugua

SEQ ID NO: 915195 - RNA, 19 nt, Homo sapiens
aagguuauuugcuggcuau

SEQ ID NO: 915196 - RNA, 19 nt, Homo sapiens
augcaaugauacuaggaua

SEQ ID NO: 915197 - RNA, 19 nt, Homo sapiens
acaaaugcaaugauacuag

SEQ ID NO: 915198 - RNA, 19 nt, Homo sapiens
cguauggucaguagucuug

SEQ ID NO: 915199 - RNA, 19 nt, Homo sapiens
aaaugacuaguacgucuuu

SEQ ID NO: 915200 - RNA, 19 nt, Homo sapiens
cauaugaagaaacaccaaa

SEQ ID NO: 915201 - RNA, 19 nt, Homo sapiens
caacugaacgagccuacgu

SEQ ID NO: 915202 - RNA, 19 nt, Homo sapiens
cuauugggucagugauuua

SEQ ID NO: 915203 - RNA, 19 nt, Homo sapiens
gccacguuguuguauguau

SEQ ID NO: 915204 - RNA, 19 nt, Homo sapiens
cagaaugacuacgaauagg

SEQ ID NO: 915205 - RNA, 19 nt, Homo sapiens
gaaacaccaaacuauguac

SEQ ID NO: 915206 - RNA, 19 nt, Homo sapiens
caaugauacuaggauauac

SEQ ID NO: 915207 - RNA, 19 nt, Homo sapiens
agcagaacaugcguaauau

SEQ ID NO: 915208 - RNA, 19 nt, Homo sapiens
agagcacuuucaucuguug

SEQ ID NO: 915209 - RNA, 19 nt, Homo sapiens
cuaguucagucuguguuau

SEQ ID NO: 915210 - RNA, 19 nt, Homo sapiens
uaaaugacuaguacgucuu

SEQ ID NO: 915211 - RNA, 19 nt, Homo sapiens
ugcuguagcuguuccuuca

SEQ ID NO: 915212 - RNA, 19 nt, Homo sapiens
uagcuguaacugugaugua

SEQ ID NO: 915213 - RNA, 19 nt, Homo sapiens
aagagcacuuucaucuguu

SEQ ID NO: 915214 - RNA, 19 nt, Homo sapiens
aagccucuauuacgacugu

SEQ ID NO: 915215 - RNA, 19 nt, Homo sapiens
uagguguaguuaccagaug

SEQ ID NO: 915216 - RNA, 19 nt, Homo sapiens
aguucagucuguguuauuu

SEQ ID NO: 915217 - RNA, 19 nt, Homo sapiens
ucuaguucagucuguguua

SEQ ID NO: 915218 - RNA, 19 nt, Homo sapiens
augaagaaacaccaaacua

SEQ ID NO: 915219 - RNA, 19 nt, Homo sapiens
aagaugucgucauacacuu

SEQ ID NO: 915220 - RNA, 19 nt, Homo sapiens
gccuugaaugugaauaauu

SEQ ID NO: 915221 - RNA, 19 nt, Homo sapiens
guauuuagagcugcuguag

SEQ ID NO: 915222 - RNA, 19 nt, Homo sapiens
ccaguacccuuacauauaa

SEQ ID NO: 915223 - RNA, 19 nt, Homo sapiens
gagaaucacuccaaucgaa

SEQ ID NO: 915224 - RNA, 19 nt, Homo sapiens
gcacacacgucaaaucaug

SEQ ID NO: 915225 - RNA, 19 nt, Homo sapiens
gaucagauucgguauauuu

SEQ ID NO: 915226 - RNA, 19 nt, Homo sapiens
agacagggauuaagucaaa

SEQ ID NO: 915227 - RNA, 19 nt, Homo sapiens
ggacaaagacaacuagguu

SEQ ID NO: 915228 - RNA, 19 nt, Homo sapiens
ggacaccagugaaacuuga

SEQ ID NO: 915229 - RNA, 19 nt, Homo sapiens
gaacaugacgacagauuug

SEQ ID NO: 915230 - RNA, 19 nt, Homo sapiens
gauggcagauucccacuga

SEQ ID NO: 915231 - RNA, 19 nt, Homo sapiens
ggugggaaaucuaugguuu

SEQ ID NO: 915232 - RNA, 19 nt, Homo sapiens
ucauugaccuguugaagaa

SEQ ID NO: 915233 - RNA, 19 nt, Homo sapiens
gaagcaagaaaguacauuu

SEQ ID NO: 915234 - RNA, 19 nt, Homo sapiens
caacaaugccaaugccuuu

SEQ ID NO: 915235 - RNA, 19 nt, Homo sapiens
agaagaugcugaccauuga

SEQ ID NO: 915236 - RNA, 19 nt, Homo sapiens
ggaguucauugaccuguug

SEQ ID NO: 915237 - RNA, 19 nt, Homo sapiens
ggagagugccgaugacuau

SEQ ID NO: 915238 - RNA, 19 nt, Homo sapiens
ucaagugccuucuguagug

SEQ ID NO: 915239 - RNA, 19 nt, Homo sapiens
ccacagcccugaugaaacu

SEQ ID NO: 915240 - RNA, 19 nt, Homo sapiens
gcagaaccucuaugacuuu

SEQ ID NO: 915241 - RNA, 19 nt, Homo sapiens
gcaagcagcacuucuguca

SEQ ID NO: 915242 - RNA, 19 nt, Homo sapiens
cagcacagcccuuaaaugu

SEQ ID NO: 915243 - RNA, 19 nt, Homo sapiens
caaauacauucgcccaguu

SEQ ID NO: 915244 - RNA, 19 nt, Homo sapiens
gaaccucuaugacuuucug

SEQ ID NO: 915245 - RNA, 19 nt, Homo sapiens
ugacacacuuacucgauuu

SEQ ID NO: 915246 - RNA, 19 nt, Homo sapiens
ccaucaagauccugaagaa

SEQ ID NO: 915247 - RNA, 19 nt, Homo sapiens
uauccacgcugaccucaaa

SEQ ID NO: 915248 - RNA, 19 nt, Homo sapiens
gagcagagaagagaacauu

SEQ ID NO: 915249 - RNA, 19 nt, Homo sapiens
caaccaguacccuuacaua

SEQ ID NO: 915250 - RNA, 19 nt, Homo sapiens
auacuaaacuacccaucua

SEQ ID NO: 915251 - RNA, 19 nt, Homo sapiens
ggguuugccugcugaauau

SEQ ID NO: 915252 - RNA, 19 nt, Homo sapiens
gaggugcugugcuccauga

SEQ ID NO: 915253 - RNA, 19 nt, Homo sapiens
ugaagaagaugcugaccau

SEQ ID NO: 915254 - RNA, 19 nt, Homo sapiens
ggagcgacauguugguaga

SEQ ID NO: 915255 - RNA, 19 nt, Homo sapiens
ggacucaccauauccuuug

SEQ ID NO: 915256 - RNA, 19 nt, Homo sapiens
gaagaaccgcccauccuau

SEQ ID NO: 915257 - RNA, 19 nt, Homo sapiens
cccgaagucuccauacuaa

SEQ ID NO: 915258 - RNA, 19 nt, Homo sapiens
caaaucauguuuccagaac

SEQ ID NO: 915259 - RNA, 19 nt, Homo sapiens
ggaagggagcgacauguug

SEQ ID NO: 915260 - RNA, 19 nt, Homo sapiens
ccgccaaggucaaccagua

SEQ ID NO: 915261 - RNA, 19 nt, Homo sapiens
gauccaagcgugucaagga

SEQ ID NO: 915262 - RNA, 19 nt, Homo sapiens
gagcagaaccucuaugacu

SEQ ID NO: 915263 - RNA, 19 nt, Homo sapiens
gaagguauggccucacaug

SEQ ID NO: 915264 - RNA, 19 nt, Homo sapiens
gcaagcgucgggugaauau

SEQ ID NO: 915265 - RNA, 19 nt, Homo sapiens
ccacagcacacacgucaaa

SEQ ID NO: 915266 - RNA, 19 nt, Homo sapiens
caacagcgagggcgacuau

SEQ ID NO: 915267 - RNA, 19 nt, Homo sapiens
gcagagacagggauuaagu

SEQ ID NO: 915268 - RNA, 19 nt, Homo sapiens
gacaccagaugaccaugaa

SEQ ID NO: 915269 - RNA, 19 nt, Homo sapiens
uaaagagggugggaaaucu

SEQ ID NO: 915270 - RNA, 19 nt, Homo sapiens
cagcaccagucaucuguga

SEQ ID NO: 915271 - RNA, 19 nt, Homo sapiens
gagcucagccucuucagau

SEQ ID NO: 915272 - RNA, 19 nt, Homo sapiens
ucaaucaagugccuucugu

SEQ ID NO: 915273 - RNA, 19 nt, Homo sapiens
gcucacggaagccauuaua

SEQ ID NO: 915274 - RNA, 19 nt, Homo sapiens
gauuaaagagggugggaaa

SEQ ID NO: 915275 - RNA, 19 nt, Homo sapiens
ggacguagagcagagaaga

SEQ ID NO: 915276 - RNA, 19 nt, Homo sapiens
gaaaugucuccaccuguga

SEQ ID NO: 915277 - RNA, 19 nt, Homo sapiens
gacaggaacagcccagauu

SEQ ID NO: 915278 - RNA, 19 nt, Homo sapiens
acaaccagcugaccacugu

SEQ ID NO: 915279 - RNA, 19 nt, Homo sapiens
guacggcucccacagcaaa

SEQ ID NO: 915280 - RNA, 19 nt, Homo sapiens
gacaagagaaucacuccaa

SEQ ID NO: 915281 - RNA, 19 nt, Homo sapiens
ccuacgaggucuuagaguu

SEQ ID NO: 915282 - RNA, 19 nt, Homo sapiens
gagcauccacccaugauuc

SEQ ID NO: 915283 - RNA, 19 nt, Homo sapiens
aauguggacucaagcguaa

SEQ ID NO: 915284 - RNA, 19 nt, Homo sapiens
gaccauugaugcugacaag

SEQ ID NO: 915285 - RNA, 19 nt, Homo sapiens
ugaagaugccgcacacaaa

SEQ ID NO: 915286 - RNA, 19 nt, Homo sapiens
gaacggcagcggcagacaa

SEQ ID NO: 915287 - RNA, 19 nt, Homo sapiens
gaagacaccagaugaccau

SEQ ID NO: 915288 - RNA, 19 nt, Homo sapiens
gacaaagacaacuagguuu

SEQ ID NO: 915289 - RNA, 19 nt, Homo sapiens
gcuguguuauugcagaauu

SEQ ID NO: 915290 - RNA, 19 nt, Homo sapiens
gcugguggauccaucuaga

SEQ ID NO: 915291 - RNA, 19 nt, Homo sapiens
gggcaccaaugagaucgua

SEQ ID NO: 915292 - RNA, 19 nt, Homo sapiens
acugugagccuccuugaua

SEQ ID NO: 915293 - RNA, 19 nt, Homo sapiens
ccaagcgugucaaggagaa

SEQ ID NO: 915294 - RNA, 19 nt, Homo sapiens
ccagucaucugugagaaau

SEQ ID NO: 915295 - RNA, 19 nt, Homo sapiens
ugagaucauccuugguuua

SEQ ID NO: 915296 - RNA, 19 nt, Homo sapiens
ugaagaaccgcccauccua

SEQ ID NO: 915297 - RNA, 19 nt, Homo sapiens
gaagaugccgcacacaaac

SEQ ID NO: 915298 - RNA, 19 nt, Homo sapiens
gaagcagagacagggauua

SEQ ID NO: 915299 - RNA, 19 nt, Homo sapiens
ggucaucgacuuugguuca

SEQ ID NO: 915300 - RNA, 19 nt, Homo sapiens
agacaaccauacagaguca

SEQ ID NO: 915301 - RNA, 19 nt, Homo sapiens
gcaccagucaucugugaga

SEQ ID NO: 915302 - RNA, 19 nt, Homo sapiens
guaagcagcaccagucauc

SEQ ID NO: 915303 - RNA, 19 nt, Homo sapiens
aagaagaugcugaccauug

SEQ ID NO: 915304 - RNA, 19 nt, Homo sapiens
gcgaggagaucgagaacac

SEQ ID NO: 915305 - RNA, 19 nt, Homo sapiens
gcagagaagagaacauuuu

SEQ ID NO: 915306 - RNA, 19 nt, Homo sapiens
ccaaugccuuugacaccaa

SEQ ID NO: 915307 - RNA, 19 nt, Homo sapiens
ucacggaagccauuauaau

SEQ ID NO: 915308 - RNA, 19 nt, Homo sapiens
gacacggacucaccauauc

SEQ ID NO: 915309 - RNA, 19 nt, Homo sapiens
gagcuucggaguaugauca

SEQ ID NO: 915310 - RNA, 19 nt, Homo sapiens
ggaagugggaggacguaga

SEQ ID NO: 915311 - RNA, 19 nt, Homo sapiens
cagcagcacagcccuuaaa

SEQ ID NO: 915312 - RNA, 19 nt, Homo sapiens
cuggcggacuggagaaaua

SEQ ID NO: 915313 - RNA, 19 nt, Homo sapiens
cagcacacacgucaaauca

SEQ ID NO: 915314 - RNA, 19 nt, Homo sapiens
cauugaugcugacaagaga

SEQ ID NO: 915315 - RNA, 19 nt, Homo sapiens
ugacacggacucaccauau

SEQ ID NO: 915316 - RNA, 19 nt, Homo sapiens
accaguacccuuacauaua

SEQ ID NO: 915317 - RNA, 19 nt, Homo sapiens
caccagcggucacucuuca

SEQ ID NO: 915318 - RNA, 19 nt, Homo sapiens
acaagagaaucacuccaau

SEQ ID NO: 915319 - RNA, 19 nt, Homo sapiens
guuccuggguuggccguua

SEQ ID NO: 915320 - RNA, 19 nt, Homo sapiens
gaggagaucgagaacacaa

SEQ ID NO: 915321 - RNA, 19 nt, Homo sapiens
gcaggccucucccucuaag

SEQ ID NO: 915322 - RNA, 19 nt, Homo sapiens
gaacaaugauggaaagguu

SEQ ID NO: 915323 - RNA, 19 nt, Homo sapiens
ggaggaaacucgaggaaga

SEQ ID NO: 915324 - RNA, 19 nt, Homo sapiens
ggaaacaaaugggaacaaa

SEQ ID NO: 915325 - RNA, 19 nt, Homo sapiens
ggacuccaccugaagauua

SEQ ID NO: 915326 - RNA, 19 nt, Homo sapiens
gaagaacaaugauggaaag

SEQ ID NO: 915327 - RNA, 19 nt, Homo sapiens
guacacacaagaagaaaua

SEQ ID NO: 915328 - RNA, 19 nt, Homo sapiens
uauaagacuucagggauua

SEQ ID NO: 915329 - RNA, 19 nt, Homo sapiens
agaggaauaugucgaguuu

SEQ ID NO: 915330 - RNA, 19 nt, Homo sapiens
aaaguauacucuucgcaua

SEQ ID NO: 915331 - RNA, 19 nt, Homo sapiens
ggagaagacuggaggaaac

SEQ ID NO: 915332 - RNA, 19 nt, Homo sapiens
cuaaacgucuagaugagua

SEQ ID NO: 915333 - RNA, 19 nt, Homo sapiens
ggaaaggucaggaagguau

SEQ ID NO: 915334 - RNA, 19 nt, Homo sapiens
gggaucauguuguuauaau

SEQ ID NO: 915335 - RNA, 19 nt, Homo sapiens
gcuagaauaugguaucucu

SEQ ID NO: 915336 - RNA, 19 nt, Homo sapiens
gaaaggucaggaagguaua

SEQ ID NO: 915337 - RNA, 19 nt, Homo sapiens
gaaaauaacagugaaguga

SEQ ID NO: 915338 - RNA, 19 nt, Homo sapiens
cuauaagacuucagggauu

SEQ ID NO: 915339 - RNA, 19 nt, Homo sapiens
gagaauaagaauugcagaa

SEQ ID NO: 915340 - RNA, 19 nt, Homo sapiens
gaauaugguaucucuuaga

SEQ ID NO: 915341 - RNA, 19 nt, Homo sapiens
guacgguccugcuaguaga

SEQ ID NO: 915342 - RNA, 19 nt, Homo sapiens
ccagguggauuuagacaag

SEQ ID NO: 915343 - RNA, 19 nt, Homo sapiens
gaacacaagacacauugca

SEQ ID NO: 915344 - RNA, 19 nt, Homo sapiens
ggaucauguuguuauaaug

SEQ ID NO: 915345 - RNA, 19 nt, Homo sapiens
gaguauauuccagaagaua

SEQ ID NO: 915346 - RNA, 19 nt, Homo sapiens
uaaccuacaggauggagua

SEQ ID NO: 915347 - RNA, 19 nt, Homo sapiens
cuacccagguggauuuaga

SEQ ID NO: 915348 - RNA, 19 nt, Homo sapiens
cacaagacacauugcauuu

SEQ ID NO: 915349 - RNA, 19 nt, Homo sapiens
uaucggcuauaagagaaua

SEQ ID NO: 915350 - RNA, 19 nt, Homo sapiens
gauccaguggcaauuguaa

SEQ ID NO: 915351 - RNA, 19 nt, Homo sapiens
gcugcuauggcaucuauaa

SEQ ID NO: 915352 - RNA, 19 nt, Homo sapiens
acacaagacacauugcauu

SEQ ID NO: 915353 - RNA, 19 nt, Homo sapiens
gacuccaccugaagauuau

SEQ ID NO: 915354 - RNA, 19 nt, Homo sapiens
caagacacauugcauuuuc

SEQ ID NO: 915355 - RNA, 19 nt, Homo sapiens
cuucagggauuacauaaac

SEQ ID NO: 915356 - RNA, 19 nt, Homo sapiens
agacuucagggauuacaua

SEQ ID NO: 915357 - RNA, 19 nt, Homo sapiens
gcuauggcaucuauaagac

SEQ ID NO: 915358 - RNA, 19 nt, Homo sapiens
ugaguacacacaagaagaa

SEQ ID NO: 915359 - RNA, 19 nt, Homo sapiens
uaccuaaacgucuagauga

SEQ ID NO: 915360 - RNA, 19 nt, Homo sapiens
gaauaugucgaguuucucu

SEQ ID NO: 915361 - RNA, 19 nt, Homo sapiens
gggauccaguggcaauugu

SEQ ID NO: 915362 - RNA, 19 nt, Homo sapiens
aggaauaugucgaguuucu

SEQ ID NO: 915363 - RNA, 19 nt, Homo sapiens
aauagacgccuucccaaga

SEQ ID NO: 915364 - RNA, 19 nt, Homo sapiens
agaagaacaaugauggaaa

SEQ ID NO: 915365 - RNA, 19 nt, Homo sapiens
ucacagaagaacaaugaug

SEQ ID NO: 915366 - RNA, 19 nt, Homo sapiens
acagugaagugauugaaac

SEQ ID NO: 915367 - RNA, 19 nt, Homo sapiens
augaguauauuccagaaga

SEQ ID NO: 915368 - RNA, 19 nt, Homo sapiens
uauggcaucuauaagacuu

SEQ ID NO: 915369 - RNA, 19 nt, Homo sapiens
gcuaguagaggaauauguc

SEQ ID NO: 915370 - RNA, 19 nt, Homo sapiens
gguauaguccuucaauagg

SEQ ID NO: 915371 - RNA, 19 nt, Homo sapiens
gaugaguuucucuaaccua

SEQ ID NO: 915372 - RNA, 19 nt, Homo sapiens
ggcuauaagagaauaagaa

SEQ ID NO: 915373 - RNA, 19 nt, Homo sapiens
auuauaugcuccuuucaug

SEQ ID NO: 915374 - RNA, 19 nt, Homo sapiens
gaguuucucuaaccuacag

SEQ ID NO: 915375 - RNA, 19 nt, Homo sapiens
cagaagaacaaugauggaa

SEQ ID NO: 915376 - RNA, 19 nt, Homo sapiens
uaacagugaagugauugaa

SEQ ID NO: 915377 - RNA, 19 nt, Homo sapiens
auagacgccuucccaagau

SEQ ID NO: 915378 - RNA, 19 nt, Homo sapiens
gaaacaaaugggaacaaaa

SEQ ID NO: 915379 - RNA, 19 nt, Homo sapiens
acauaaaccuguguaccau

SEQ ID NO: 915380 - RNA, 19 nt, Homo sapiens
gacguacgguccugcuagu

SEQ ID NO: 915381 - RNA, 19 nt, Homo sapiens
agaauaugguaucucuuag

SEQ ID NO: 915382 - RNA, 19 nt, Homo sapiens
uagaugaguacacacaaga

SEQ ID NO: 915383 - RNA, 19 nt, Homo sapiens
cuagaugaguacacacaag

SEQ ID NO: 915384 - RNA, 19 nt, Homo sapiens
gaauuuaguagaggagcuu

SEQ ID NO: 915385 - RNA, 19 nt, Homo sapiens
gggaaaggucaggaaggua

SEQ ID NO: 915386 - RNA, 19 nt, Homo sapiens
uagacgccuucccaagauu

SEQ ID NO: 915387 - RNA, 19 nt, Homo sapiens
ggauccaguggcaauugua

SEQ ID NO: 915388 - RNA, 19 nt, Homo sapiens
auaaugaacacaagacaca

SEQ ID NO: 915389 - RNA, 19 nt, Homo sapiens
uugcugcuauggcaucuau

SEQ ID NO: 915390 - RNA, 19 nt, Homo sapiens
gaugaguacacacaagaag

SEQ ID NO: 915391 - RNA, 19 nt, Homo sapiens
ugaguauauuccagaagau

SEQ ID NO: 915392 - RNA, 19 nt, Homo sapiens
agaugaguauauuccagaa

SEQ ID NO: 915393 - RNA, 19 nt, Homo sapiens
gacuucagggauuacauaa

SEQ ID NO: 915394 - RNA, 19 nt, Homo sapiens
ccaccaagcgagauauuuu

SEQ ID NO: 915395 - RNA, 19 nt, Homo sapiens
uggcuacccagguggauuu

SEQ ID NO: 915396 - RNA, 19 nt, Homo sapiens
ccuacaggauggaguaaaa

SEQ ID NO: 915397 - RNA, 19 nt, Homo sapiens
acacacaagaagaaauaga

SEQ ID NO: 915398 - RNA, 19 nt, Homo sapiens
gaguacacacaagaagaaa

SEQ ID NO: 915399 - RNA, 19 nt, Homo sapiens
gagcuuccucaaccacgaa

SEQ ID NO: 915400 - RNA, 19 nt, Homo sapiens
agguggauuuagacaagua

SEQ ID NO: 915401 - RNA, 19 nt, Homo sapiens
ugagggauccaguggcaau

SEQ ID NO: 915402 - RNA, 19 nt, Homo sapiens
ggccagaacuuuagugcua

SEQ ID NO: 915403 - RNA, 19 nt, Homo sapiens
gaaccugcccuccaaguuu

SEQ ID NO: 915404 - RNA, 19 nt, Homo sapiens
ggaggagauugaagaguuu

SEQ ID NO: 915405 - RNA, 19 nt, Homo sapiens
gcagcaagauguacaccaa

SEQ ID NO: 915406 - RNA, 19 nt, Homo sapiens
gaagaugaaaugugcaguu

SEQ ID NO: 915407 - RNA, 19 nt, Homo sapiens
gaugaaaugugcaguuuug

SEQ ID NO: 915408 - RNA, 19 nt, Homo sapiens
gaacugaaagcgcccugaa

SEQ ID NO: 915409 - RNA, 19 nt, Homo sapiens
uggaggagauugaagaguu

SEQ ID NO: 915410 - RNA, 19 nt, Homo sapiens
caucuuggacuuccuauug

SEQ ID NO: 915411 - RNA, 19 nt, Homo sapiens
aagaugaaaugugcaguuu

SEQ ID NO: 915412 - RNA, 19 nt, Homo sapiens
ucccaacccugauuuagaa

SEQ ID NO: 915413 - RNA, 19 nt, Homo sapiens
cuaugaagcugguguacau

SEQ ID NO: 915414 - RNA, 19 nt, Homo sapiens
gggcugcacugugguguga

SEQ ID NO: 915415 - RNA, 19 nt, Homo sapiens
ggugugagagaacuagaua

SEQ ID NO: 915416 - RNA, 19 nt, Homo sapiens
gaacccagccgcagaacuc

SEQ ID NO: 915417 - RNA, 19 nt, Homo sapiens
gaaaugugcaguuuugaaa

SEQ ID NO: 915418 - RNA, 19 nt, Homo sapiens
ccgcagaacucaucaaaau

SEQ ID NO: 915419 - RNA, 19 nt, Homo sapiens
caagaacccagccgcagaa

SEQ ID NO: 915420 - RNA, 19 nt, Homo sapiens
ugcaugugcuugaguuaaa

SEQ ID NO: 915421 - RNA, 19 nt, Homo sapiens
uuucuuugguccuucauaa

SEQ ID NO: 915422 - RNA, 19 nt, Homo sapiens
gaagcugguguacauaugu

SEQ ID NO: 915423 - RNA, 19 nt, Homo sapiens
gaaggaaguaggccagaag

SEQ ID NO: 915424 - RNA, 19 nt, Homo sapiens
gaggguggcuuugucuaag

SEQ ID NO: 915425 - RNA, 19 nt, Homo sapiens
gagucaugcuggaggagaa

SEQ ID NO: 915426 - RNA, 19 nt, Homo sapiens
ugaagcugguguacauaug

SEQ ID NO: 915427 - RNA, 19 nt, Homo sapiens
gaacuagcuuguuuugaca

SEQ ID NO: 915428 - RNA, 19 nt, Homo sapiens
gcaugugcuugaguuaaau

SEQ ID NO: 915429 - RNA, 19 nt, Homo sapiens
aauguuggguuuccagaga

SEQ ID NO: 915430 - RNA, 19 nt, Homo sapiens
gcgaccaccucuccaagca

SEQ ID NO: 915431 - RNA, 19 nt, Homo sapiens
guacccuccuccaacuuga

SEQ ID NO: 915432 - RNA, 19 nt, Homo sapiens
auagguccauccacauaaa

SEQ ID NO: 915433 - RNA, 19 nt, Homo sapiens
acauagguccauccacaua

SEQ ID NO: 915434 - RNA, 19 nt, Homo sapiens
ggacagcaucuuggacuuc

SEQ ID NO: 915435 - RNA, 19 nt, Homo sapiens
cauagguccauccacauaa

SEQ ID NO: 915436 - RNA, 19 nt, Homo sapiens
ugaggguggcuuugucuaa

SEQ ID NO: 915437 - RNA, 19 nt, Homo sapiens
cauggagccuggagucaag

SEQ ID NO: 915438 - RNA, 19 nt, Homo sapiens
gagccaggacagcaucuug

SEQ ID NO: 915439 - RNA, 19 nt, Homo sapiens
gggcagcggcaguagcauu

SEQ ID NO: 915440 - RNA, 19 nt, Homo sapiens
ccucacccgucucugaaga

SEQ ID NO: 915441 - RNA, 19 nt, Homo sapiens
gccaaccgcugccuuucuc

SEQ ID NO: 915442 - RNA, 19 nt, Homo sapiens
aaccugcccuccaaguuug

SEQ ID NO: 915443 - RNA, 19 nt, Homo sapiens
ugacagguuuauuucacau

SEQ ID NO: 915444 - RNA, 19 nt, Homo sapiens
agaaggaaguaggccagaa

SEQ ID NO: 915445 - RNA, 19 nt, Homo sapiens
aagcugguguacauauguu

SEQ ID NO: 915446 - RNA, 19 nt, Homo sapiens
ugugagagaacuagauaga

SEQ ID NO: 915447 - RNA, 19 nt, Homo sapiens
cagugcaugugcuugaguu

SEQ ID NO: 915448 - RNA, 19 nt, Homo sapiens
cccagagaaugucaagguu

SEQ ID NO: 915449 - RNA, 19 nt, Homo sapiens
gugcaugugcuugaguuaa

SEQ ID NO: 915450 - RNA, 19 nt, Homo sapiens
gccaaggccagaacuuuag

SEQ ID NO: 915451 - RNA, 19 nt, Homo sapiens
gccagaaguuccccaagaa

SEQ ID NO: 915452 - RNA, 19 nt, Homo sapiens
gaacuucucgucgccaaaa

SEQ ID NO: 915453 - RNA, 19 nt, Homo sapiens
ggccagaaguuccccaaga

SEQ ID NO: 915454 - RNA, 19 nt, Homo sapiens
gguacccuccuccaacuug

SEQ ID NO: 915455 - RNA, 19 nt, Homo sapiens
gcccucugcuccugcuaug

SEQ ID NO: 915456 - RNA, 19 nt, Homo sapiens
gagccucccaacccugauu

SEQ ID NO: 915457 - RNA, 19 nt, Homo sapiens
ucacccgucucugaagaug

SEQ ID NO: 915458 - RNA, 19 nt, Homo sapiens
ggcagcggcaguagcauug

SEQ ID NO: 915459 - RNA, 19 nt, Homo sapiens
cagcaucuuggacuuccua

SEQ ID NO: 915460 - RNA, 19 nt, Homo sapiens
ggguggcuuugucuaagau

SEQ ID NO: 915461 - RNA, 19 nt, Homo sapiens
cagcaagauguacaccaaa

SEQ ID NO: 915462 - RNA, 19 nt, Homo sapiens
agguuuauuucacauccua

SEQ ID NO: 915463 - RNA, 19 nt, Homo sapiens
ugaacuagcuuguuuugac

SEQ ID NO: 915464 - RNA, 19 nt, Homo sapiens
ugaaccugcccuccaaguu

SEQ ID NO: 915465 - RNA, 19 nt, Homo sapiens
guuuugaaauguuggguuu

SEQ ID NO: 915466 - RNA, 19 nt, Homo sapiens
gcccucacccgucucugaa

SEQ ID NO: 915467 - RNA, 19 nt, Homo sapiens
gugguacccuccuccaacu

SEQ ID NO: 915468 - RNA, 19 nt, Homo sapiens
gaacagaugcuucaacuuu

SEQ ID NO: 915469 - RNA, 19 nt, Homo sapiens
ggaaaguaauuaagacaga

SEQ ID NO: 915470 - RNA, 19 nt, Homo sapiens
gcaauugucuggccagugu

SEQ ID NO: 915471 - RNA, 19 nt, Homo sapiens
ggaaagucaugcugcaauu

SEQ ID NO: 915472 - RNA, 19 nt, Homo sapiens
gauaugccauuccucauug

SEQ ID NO: 915473 - RNA, 19 nt, Homo sapiens
guauugaucugaacauuuc

SEQ ID NO: 915474 - RNA, 19 nt, Homo sapiens
uggcagaacuuucgguuaa

SEQ ID NO: 915475 - RNA, 19 nt, Homo sapiens
ggaaagaacagaugcuuca

SEQ ID NO: 915476 - RNA, 19 nt, Homo sapiens
gaacagcagagaaacacua

SEQ ID NO: 915477 - RNA, 19 nt, Homo sapiens
uaaauuguauccucaagug

SEQ ID NO: 915478 - RNA, 19 nt, Homo sapiens
gaacaacaugcaacaauca

SEQ ID NO: 915479 - RNA, 19 nt, Homo sapiens
guagagguguuuccuaaag

SEQ ID NO: 915480 - RNA, 19 nt, Homo sapiens
gcagaaccguccuguugug

SEQ ID NO: 915481 - RNA, 19 nt, Homo sapiens
guuaaacuccuuccauaaa

SEQ ID NO: 915482 - RNA, 19 nt, Homo sapiens
cgguuaaacuccuuccaua

SEQ ID NO: 915483 - RNA, 19 nt, Homo sapiens
ucagcaaacuucagccauu

SEQ ID NO: 915484 - RNA, 19 nt, Homo sapiens
gcagagaaacacuaaaaua

SEQ ID NO: 915485 - RNA, 19 nt, Homo sapiens
gaaaaguuaucaaggauuc

SEQ ID NO: 915486 - RNA, 19 nt, Homo sapiens
ggauaugccauuccucauu

SEQ ID NO: 915487 - RNA, 19 nt, Homo sapiens
ggugggugcuucucuguau

SEQ ID NO: 915488 - RNA, 19 nt, Homo sapiens
ggagguugguauuaucaau

SEQ ID NO: 915489 - RNA, 19 nt, Homo sapiens
ccaaauugcugggauuaca

SEQ ID NO: 915490 - RNA, 19 nt, Homo sapiens
gaaaucauggaacaucaga

SEQ ID NO: 915491 - RNA, 19 nt, Homo sapiens
caccacaccuggcccuaaa

SEQ ID NO: 915492 - RNA, 19 nt, Homo sapiens
ugaacaacaugcaacaauc

SEQ ID NO: 915493 - RNA, 19 nt, Homo sapiens
cagcaaacuucagccauug

SEQ ID NO: 915494 - RNA, 19 nt, Homo sapiens
agucaggauugaacucaua

SEQ ID NO: 915495 - RNA, 19 nt, Homo sapiens
agguagagguguuuccuaa

SEQ ID NO: 915496 - RNA, 19 nt, Homo sapiens
gaaagucaugcugcaauug

SEQ ID NO: 915497 - RNA, 19 nt, Homo sapiens
gguuaaacuccuuccauaa

SEQ ID NO: 915498 - RNA, 19 nt, Homo sapiens
gagggaaggugagcguaau

SEQ ID NO: 915499 - RNA, 19 nt, Homo sapiens
guaggaaaguaauuaagac

SEQ ID NO: 915500 - RNA, 19 nt, Homo sapiens
gcguggagguugguauuau

SEQ ID NO: 915501 - RNA, 19 nt, Homo sapiens
ccauugaacagcagagaaa

SEQ ID NO: 915502 - RNA, 19 nt, Homo sapiens
gaacucauaggcaccaucu

SEQ ID NO: 915503 - RNA, 19 nt, Homo sapiens
gaagucaggauugaacuca

SEQ ID NO: 915504 - RNA, 19 nt, Homo sapiens
aggaauuugucaccucuuu

SEQ ID NO: 915505 - RNA, 19 nt, Homo sapiens
gcagaacuuucgguuaaac

SEQ ID NO: 915506 - RNA, 19 nt, Homo sapiens
gaaggugagcguaaucucu

SEQ ID NO: 915507 - RNA, 19 nt, Homo sapiens
ggcagaacuuucgguuaaa

SEQ ID NO: 915508 - RNA, 19 nt, Homo sapiens
guuaugcucugguguucug

SEQ ID NO: 915509 - RNA, 19 nt, Homo sapiens
cuucagagcccacuaucaa

SEQ ID NO: 915510 - RNA, 19 nt, Homo sapiens
caacuucagagcccacuau

SEQ ID NO: 915511 - RNA, 19 nt, Homo sapiens
gcuucaacuuucucacaaa

SEQ ID NO: 915512 - RNA, 19 nt, Homo sapiens
ugccauuccucauugcuuu

SEQ ID NO: 915513 - RNA, 19 nt, Homo sapiens
aaucauggaacaucagaaa

SEQ ID NO: 915514 - RNA, 19 nt, Homo sapiens
cuacgagcgccaucuaauu

SEQ ID NO: 915515 - RNA, 19 nt, Homo sapiens
ugcagcagcuacaaucuau

SEQ ID NO: 915516 - RNA, 19 nt, Homo sapiens
gagguuaugcucugguguu

SEQ ID NO: 915517 - RNA, 19 nt, Homo sapiens
aagaacagaugcuucaacu

SEQ ID NO: 915518 - RNA, 19 nt, Homo sapiens
gaaagaacagaugcuucaa

SEQ ID NO: 915519 - RNA, 19 nt, Homo sapiens
cguaggaaaguaauuaaga

SEQ ID NO: 915520 - RNA, 19 nt, Homo sapiens
aggcagaaccguccuguug

SEQ ID NO: 915521 - RNA, 19 nt, Homo sapiens
aaagaccauuugccaagga

SEQ ID NO: 915522 - RNA, 19 nt, Homo sapiens
gugaacaacaugcaacaau

SEQ ID NO: 915523 - RNA, 19 nt, Homo sapiens
ccacuacgagcgccaucua

SEQ ID NO: 915524 - RNA, 19 nt, Homo sapiens
gggaaagucaugcugcaau

SEQ ID NO: 915525 - RNA, 19 nt, Homo sapiens
gaggaaagaacagaugcuu

SEQ ID NO: 915526 - RNA, 19 nt, Homo sapiens
aauaaaaccucguuaccuu

SEQ ID NO: 915527 - RNA, 19 nt, Homo sapiens
uagcaucucagcaaacuuc

SEQ ID NO: 915528 - RNA, 19 nt, Homo sapiens
acagaaaaguuaucaagga

SEQ ID NO: 915529 - RNA, 19 nt, Homo sapiens
gaccauuugccaaggacua

SEQ ID NO: 915530 - RNA, 19 nt, Homo sapiens
gcaggagguagagguguuu

SEQ ID NO: 915531 - RNA, 19 nt, Homo sapiens
ggaguuugggaaggaauuu

SEQ ID NO: 915532 - RNA, 19 nt, Homo sapiens
cagcagcuacaaucuaugu

SEQ ID NO: 915533 - RNA, 19 nt, Homo sapiens
acauaacagugaacaacau

SEQ ID NO: 915534 - RNA, 19 nt, Homo sapiens
gagguagagguguuuccua

SEQ ID NO: 915535 - RNA, 19 nt, Homo sapiens
gccauucuccugccucaga

SEQ ID NO: 915536 - RNA, 19 nt, Homo sapiens
aacagaugcuucaacuuuc

SEQ ID NO: 915537 - RNA, 19 nt, Homo sapiens
gguagagguguuuccuaaa

SEQ ID NO: 915538 - RNA, 19 nt, Homo sapiens
gcucugguguucuguuuug

SEQ ID NO: 915539 - RNA, 19 nt, Homo sapiens
cguaaucucuauucgucau

SEQ ID NO: 915540 - RNA, 19 nt, Homo sapiens
gaacuccuggacucaagug

SEQ ID NO: 915541 - RNA, 19 nt, Homo sapiens
aaagaggaaagaacagaug

SEQ ID NO: 915542 - RNA, 19 nt, Homo sapiens
agcccacuaucaaucaaua

SEQ ID NO: 915543 - RNA, 19 nt, Homo sapiens
aaggugagcguaaucucua

SEQ ID NO: 915544 - RNA, 19 nt, Homo sapiens
caaaauguccauaacugaa

SEQ ID NO: 915545 - RNA, 19 nt, Homo sapiens
acagaugcuucaacuuucu

SEQ ID NO: 915546 - RNA, 19 nt, Homo sapiens
aaagucaugcugcaauugu

SEQ ID NO: 915547 - RNA, 19 nt, Homo sapiens
uucuuucucuggaaucuaa

SEQ ID NO: 915548 - RNA, 19 nt, Homo sapiens
cugcauagggcuucauuuc

SEQ ID NO: 915549 - RNA, 19 nt, Homo sapiens
uacgagcgccaucuaauuc

SEQ ID NO: 915550 - RNA, 19 nt, Homo sapiens
ucagagcccacuaucaauc

SEQ ID NO: 915551 - RNA, 19 nt, Homo sapiens
uaacagugaacaacaugca

SEQ ID NO: 915552 - RNA, 19 nt, Homo sapiens
cauuugccaaggacuauuu

SEQ ID NO: 915553 - RNA, 19 nt, Homo sapiens
gccguaggaaaguaauuaa

SEQ ID NO: 915554 - RNA, 19 nt, Homo sapiens
cgcaggagguagagguguu

SEQ ID NO: 915555 - RNA, 19 nt, Homo sapiens
ugccguaggaaaguaauua

SEQ ID NO: 915556 - RNA, 19 nt, Homo sapiens
uccaggaagucaggauuga

SEQ ID NO: 915557 - RNA, 19 nt, Homo sapiens
uuccuaccaugacugcaua

SEQ ID NO: 915558 - RNA, 19 nt, Homo sapiens
cagcagagaaacacuaaaa

SEQ ID NO: 915559 - RNA, 19 nt, Homo sapiens
acucauaggcaccaucuuc

SEQ ID NO: 915560 - RNA, 19 nt, Homo sapiens
ccaccacaccuggcccuaa

SEQ ID NO: 915561 - RNA, 19 nt, Homo sapiens
ccaggaguuugggaaggaa

SEQ ID NO: 915562 - RNA, 19 nt, Homo sapiens
cagaaaaguuaucaaggau

SEQ ID NO: 915563 - RNA, 19 nt, Homo sapiens
ucuggaaucuaaggagguu

SEQ ID NO: 915564 - RNA, 19 nt, Homo sapiens
agagggaaggugagcguaa

SEQ ID NO: 915565 - RNA, 19 nt, Homo sapiens
cauaacagugaacaacaug

SEQ ID NO: 915566 - RNA, 19 nt, Homo sapiens
cacaaaauguccauaacug

SEQ ID NO: 915567 - RNA, 19 nt, Homo sapiens
ucaacuuucucacaaaaug

SEQ ID NO: 915568 - RNA, 19 nt, Homo sapiens
gcaggaagcucacuaauaa

SEQ ID NO: 915569 - RNA, 19 nt, Homo sapiens
gauauucccuaaacugaaa

SEQ ID NO: 915570 - RNA, 19 nt, Homo sapiens
acagacaucuuuccucuuu

SEQ ID NO: 915571 - RNA, 19 nt, Homo sapiens
cuacagacauuuaggaguu

SEQ ID NO: 915572 - RNA, 19 nt, Homo sapiens
caugagaucuacagacauu

SEQ ID NO: 915573 - RNA, 19 nt, Homo sapiens
caacgugacugcuguucuu

SEQ ID NO: 915574 - RNA, 19 nt, Homo sapiens
gaaaauaggcuuacuuugu

SEQ ID NO: 915575 - RNA, 19 nt, Homo sapiens
gaggugaaucuuuagaaua

SEQ ID NO: 915576 - RNA, 19 nt, Homo sapiens
aaaugaagcuguuguacau

SEQ ID NO: 915577 - RNA, 19 nt, Homo sapiens
ugacaucuacuuucaguuu

SEQ ID NO: 915578 - RNA, 19 nt, Homo sapiens
cuucuucacuccaauguuu

SEQ ID NO: 915579 - RNA, 19 nt, Homo sapiens
acaauacuguagugcauaa

SEQ ID NO: 915580 - RNA, 19 nt, Homo sapiens
gaccagaugcaacuaauau

SEQ ID NO: 915581 - RNA, 19 nt, Homo sapiens
gugcaugcaugugugguua

SEQ ID NO: 915582 - RNA, 19 nt, Homo sapiens
gagaccagaugcaacuaau

SEQ ID NO: 915583 - RNA, 19 nt, Homo sapiens
ugagaucuacagacauuua

SEQ ID NO: 915584 - RNA, 19 nt, Homo sapiens
guucagaaauaugcuagaa

SEQ ID NO: 915585 - RNA, 19 nt, Homo sapiens
uuacugcuguucucaaguu

SEQ ID NO: 915586 - RNA, 19 nt, Homo sapiens
caauuuggauguuaguaca

SEQ ID NO: 915587 - RNA, 19 nt, Homo sapiens
gaagcaacguuuuaaaauc

SEQ ID NO: 915588 - RNA, 19 nt, Homo sapiens
gcaugcaugugugguuaaa

SEQ ID NO: 915589 - RNA, 19 nt, Homo sapiens
aggaagcucacuaauaaua

SEQ ID NO: 915590 - RNA, 19 nt, Homo sapiens
ccagaugcaacuaauauau

SEQ ID NO: 915591 - RNA, 19 nt, Homo sapiens
ugaggugaaucuuuagaau

SEQ ID NO: 915592 - RNA, 19 nt, Homo sapiens
caacuuucuuucucacugu

SEQ ID NO: 915593 - RNA, 19 nt, Homo sapiens
caucuuuccucuuuguaga

SEQ ID NO: 915594 - RNA, 19 nt, Homo sapiens
agacaucuuuccucuuugu

SEQ ID NO: 915595 - RNA, 19 nt, Homo sapiens
gaagcucacuaauaauagc

SEQ ID NO: 915596 - RNA, 19 nt, Homo sapiens
uaacucagccuuggcaaau

SEQ ID NO: 915597 - RNA, 19 nt, Homo sapiens
ugaagcuguuguacaugua

SEQ ID NO: 915598 - RNA, 19 nt, Homo sapiens
gaaaauaugcuagucaguu

SEQ ID NO: 915599 - RNA, 19 nt, Homo sapiens
caggaacaacuuuaagauu

SEQ ID NO: 915600 - RNA, 19 nt, Homo sapiens
guaacuaauccauacagaa

SEQ ID NO: 915601 - RNA, 19 nt, Homo sapiens
cgcaggaagcucacuaaua

SEQ ID NO: 915602 - RNA, 19 nt, Homo sapiens
cuaccaacuuucuuucuca

SEQ ID NO: 915603 - RNA, 19 nt, Homo sapiens
gaucuacagacauuuagga

SEQ ID NO: 915604 - RNA, 19 nt, Homo sapiens
aacaugagaucuacagaca

SEQ ID NO: 915605 - RNA, 19 nt, Homo sapiens
gcaguaauugcaucaagau

SEQ ID NO: 915606 - RNA, 19 nt, Homo sapiens
gaauuuuccuuaagagguu

SEQ ID NO: 915607 - RNA, 19 nt, Homo sapiens
agacaauacuguagugcau

SEQ ID NO: 915608 - RNA, 19 nt, Homo sapiens
ggaagcucacuaauaauag

SEQ ID NO: 915609 - RNA, 19 nt, Homo sapiens
ccuaaagacauuucauaug

SEQ ID NO: 915610 - RNA, 19 nt, Homo sapiens
gacaauacuguagugcaua

SEQ ID NO: 915611 - RNA, 19 nt, Homo sapiens
caugaaugacaucuacuuu

SEQ ID NO: 915612 - RNA, 19 nt, Homo sapiens
guucucaaguucauugucu

SEQ ID NO: 915613 - RNA, 19 nt, Homo sapiens
gcuagaagcacacucaaaa

SEQ ID NO: 915614 - RNA, 19 nt, Homo sapiens
gcagauucaguagcaguaa

SEQ ID NO: 915615 - RNA, 19 nt, Homo sapiens
ugacugcuguucuucaaac

SEQ ID NO: 915616 - RNA, 19 nt, Homo sapiens
gaagcuguuguacauguau

SEQ ID NO: 915617 - RNA, 19 nt, Homo sapiens
ucucaaguucauugucuua

SEQ ID NO: 915618 - RNA, 19 nt, Homo sapiens
aaugacaucuacuuucagu

SEQ ID NO: 915619 - RNA, 19 nt, Homo sapiens
gggaaaauaggcuuacuuu

SEQ ID NO: 915620 - RNA, 19 nt, Homo sapiens
ccucaguaacuaauccaua

SEQ ID NO: 915621 - RNA, 19 nt, Homo sapiens
cgagaccagaugcaacuaa

SEQ ID NO: 915622 - RNA, 19 nt, Homo sapiens
uagcaguaauugcaucaag

SEQ ID NO: 915623 - RNA, 19 nt, Homo sapiens
cagauucaguagcaguaau

SEQ ID NO: 915624 - RNA, 19 nt, Homo sapiens
acucagccuuggcaaauuc

SEQ ID NO: 915625 - RNA, 19 nt, Homo sapiens
aaaugguacucuggaaaug

SEQ ID NO: 915626 - RNA, 19 nt, Homo sapiens
uuacuuaggaaaucucgaa

SEQ ID NO: 915627 - RNA, 19 nt, Homo sapiens
gaugaggugaaucuuuaga

SEQ ID NO: 915628 - RNA, 19 nt, Homo sapiens
cgugacugcuguucuucaa

SEQ ID NO: 915629 - RNA, 19 nt, Homo sapiens
ucaggaacaacuuuaagau

SEQ ID NO: 915630 - RNA, 19 nt, Homo sapiens
uccuuuagcagguaagaua

SEQ ID NO: 915631 - RNA, 19 nt, Homo sapiens
cagaugcaacuaauauauc

SEQ ID NO: 915632 - RNA, 19 nt, Homo sapiens
gcuguucucaaguucauug

SEQ ID NO: 915633 - RNA, 19 nt, Homo sapiens
uacagacauuuaggaguuu

SEQ ID NO: 915634 - RNA, 19 nt, Homo sapiens
ccuacaaaauccucaguaa

SEQ ID NO: 915635 - RNA, 19 nt, Homo sapiens
caaaauccucaguaacuaa

SEQ ID NO: 915636 - RNA, 19 nt, Homo sapiens
uuuagcagauucaguagca

SEQ ID NO: 915637 - RNA, 19 nt, Homo sapiens
ugaaacgucaugcgugugu

SEQ ID NO: 915638 - RNA, 19 nt, Homo sapiens
agaccagaugcaacuaaua

SEQ ID NO: 915639 - RNA, 19 nt, Homo sapiens
gacaucuacuuucaguuuu

SEQ ID NO: 915640 - RNA, 19 nt, Homo sapiens
acaaaauccucaguaacua

SEQ ID NO: 915641 - RNA, 19 nt, Homo sapiens
augaagcuguuguacaugu

SEQ ID NO: 915642 - RNA, 19 nt, Homo sapiens
uguauuccuucaguuggua

SEQ ID NO: 915643 - RNA, 19 nt, Homo sapiens
uaaguuuuccugcaacaua

SEQ ID NO: 915644 - RNA, 19 nt, Homo sapiens
gagaucuacagacauuuag

SEQ ID NO: 915645 - RNA, 19 nt, Homo sapiens
ccacuaccaacuuucuuuc

SEQ ID NO: 915646 - RNA, 19 nt, Homo sapiens
cucaguaacuaauccauac

SEQ ID NO: 915647 - RNA, 19 nt, Homo sapiens
agcaguaauugcaucaaga

SEQ ID NO: 915648 - RNA, 19 nt, Homo sapiens
guuucucaguguauguaaa

SEQ ID NO: 915649 - RNA, 19 nt, Homo sapiens
gugaagcaacguuuuaaaa

SEQ ID NO: 915650 - RNA, 19 nt, Homo sapiens
ugauauucccuaaacugaa

SEQ ID NO: 915651 - RNA, 19 nt, Homo sapiens
augguacucuggaaauguu

SEQ ID NO: 915652 - RNA, 19 nt, Homo sapiens
acuccaauguuuuccuuua

SEQ ID NO: 915653 - RNA, 19 nt, Homo sapiens
uaaguugcgagaccagaug

SEQ ID NO: 915654 - RNA, 19 nt, Homo sapiens
caaaaugguacucuggaaa

SEQ ID NO: 915655 - RNA, 19 nt, Homo sapiens
aguaacuaauccauacaga

SEQ ID NO: 915656 - RNA, 19 nt, Homo sapiens
gcgcaggaagcucacuaau

SEQ ID NO: 915657 - RNA, 19 nt, Homo sapiens
ccucuuuguagauuuguuu

SEQ ID NO: 915658 - RNA, 19 nt, Homo sapiens
caaaaucagacaauacugu

SEQ ID NO: 915659 - RNA, 19 nt, Homo sapiens
gcaacguuuuaaaaucgua

SEQ ID NO: 915660 - RNA, 19 nt, Homo sapiens
gaaaucaccugcaaauaaa

SEQ ID NO: 915661 - RNA, 19 nt, Homo sapiens
gagcauauauccacaaugu

SEQ ID NO: 915662 - RNA, 19 nt, Homo sapiens
gauaggacaugguauaaug

SEQ ID NO: 915663 - RNA, 19 nt, Homo sapiens
gcaacaagcuacucuggaa

SEQ ID NO: 915664 - RNA, 19 nt, Homo sapiens
gcaaauaaaucacaagaac

SEQ ID NO: 915665 - RNA, 19 nt, Homo sapiens
ggagagccuucaaauuuaa

SEQ ID NO: 915666 - RNA, 19 nt, Homo sapiens
ccagaaagauuacagaaug

SEQ ID NO: 915667 - RNA, 19 nt, Homo sapiens
agacaaagcuauuaagaga

SEQ ID NO: 915668 - RNA, 19 nt, Homo sapiens
uaaagcaucuguaacauuc

SEQ ID NO: 915669 - RNA, 19 nt, Homo sapiens
uaggagagccuucaaauuu

SEQ ID NO: 915670 - RNA, 19 nt, Homo sapiens
uuagauggguucaguauuu

SEQ ID NO: 915671 - RNA, 19 nt, Homo sapiens
agaaaucaccugcaaauaa

SEQ ID NO: 915672 - RNA, 19 nt, Homo sapiens
caugagugcuauguaauua

SEQ ID NO: 915673 - RNA, 19 nt, Homo sapiens
guaaagauaggacauggua

SEQ ID NO: 915674 - RNA, 19 nt, Homo sapiens
ucuguaacauucuggauua

SEQ ID NO: 915675 - RNA, 19 nt, Homo sapiens
gacaugaccaauugaaaua

SEQ ID NO: 915676 - RNA, 19 nt, Homo sapiens
aggagagccuucaaauuua

SEQ ID NO: 915677 - RNA, 19 nt, Homo sapiens
caaaugacaugagugcuau

SEQ ID NO: 915678 - RNA, 19 nt, Homo sapiens
cagcacaaauguuacuauu

SEQ ID NO: 915679 - RNA, 19 nt, Homo sapiens
agaaagaaaucaccugcaa

SEQ ID NO: 915680 - RNA, 19 nt, Homo sapiens
aaagauaggacaugguaua

SEQ ID NO: 915681 - RNA, 19 nt, Homo sapiens
gagcuucaccacugcuuua

SEQ ID NO: 915682 - RNA, 19 nt, Homo sapiens
gcauauauccacaauguuc

SEQ ID NO: 915683 - RNA, 19 nt, Homo sapiens
gaaagaaaucaccugcaaa

SEQ ID NO: 915684 - RNA, 19 nt, Homo sapiens
caaaggguuuccuacaguu

SEQ ID NO: 915685 - RNA, 19 nt, Homo sapiens
acaaagaauuccuguauac

SEQ ID NO: 915686 - RNA, 19 nt, Homo sapiens
guaacauucuggauuaauc

SEQ ID NO: 915687 - RNA, 19 nt, Homo sapiens
uagauggguucaguauuua

SEQ ID NO: 915688 - RNA, 19 nt, Homo sapiens
gcauagcacacuuucaauu

SEQ ID NO: 915689 - RNA, 19 nt, Homo sapiens
gauaagcaguagcugacuu

SEQ ID NO: 915690 - RNA, 19 nt, Homo sapiens
cauagcacacuuucaauuu

SEQ ID NO: 915691 - RNA, 19 nt, Homo sapiens
agacauaagacaucuguuu

SEQ ID NO: 915692 - RNA, 19 nt, Homo sapiens
ccuguauacucuguuauua

SEQ ID NO: 915693 - RNA, 19 nt, Homo sapiens
aauaaguucugguguguga

SEQ ID NO: 915694 - RNA, 19 nt, Homo sapiens
gaagaaaacagcacaaaug

SEQ ID NO: 915695 - RNA, 19 nt, Homo sapiens
gaaaugacaaaugacauga

SEQ ID NO: 915696 - RNA, 19 nt, Homo sapiens
gcucaguucuacuuccaaa

SEQ ID NO: 915697 - RNA, 19 nt, Homo sapiens
ccugugaaguauauuguaa

SEQ ID NO: 915698 - RNA, 19 nt, Homo sapiens
ucuuggcucuaucaaauua

SEQ ID NO: 915699 - RNA, 19 nt, Homo sapiens
cuucaccacugcuuuauug

SEQ ID NO: 915700 - RNA, 19 nt, Homo sapiens
caaagaucaucauaauugg

SEQ ID NO: 915701 - RNA, 19 nt, Homo sapiens
guuacaugauggcauuuaa

SEQ ID NO: 915702 - RNA, 19 nt, Homo sapiens
uagaagugcuugagaugug

SEQ ID NO: 915703 - RNA, 19 nt, Homo sapiens
gagccaauucucacaguaa

SEQ ID NO: 915704 - RNA, 19 nt, Homo sapiens
ucaaaggguuuccuacagu

SEQ ID NO: 915705 - RNA, 19 nt, Homo sapiens
aaagaaaucaccugcaaau

SEQ ID NO: 915706 - RNA, 19 nt, Homo sapiens
agucugaauuuccauauug

SEQ ID NO: 915707 - RNA, 19 nt, Homo sapiens
aagcuacucuggaaauaau

SEQ ID NO: 915708 - RNA, 19 nt, Homo sapiens
uggauacacucaaagauca

SEQ ID NO: 915709 - RNA, 19 nt, Homo sapiens
cagaaagauuacagaaugu

SEQ ID NO: 915710 - RNA, 19 nt, Homo sapiens
acaagcuacucuggaaaua

SEQ ID NO: 915711 - RNA, 19 nt, Homo sapiens
aaauagucauccagaaaga

SEQ ID NO: 915712 - RNA, 19 nt, Homo sapiens
uuucuuggcucuaucaaau

SEQ ID NO: 915713 - RNA, 19 nt, Homo sapiens
uuaaaucucaggcuaagaa

SEQ ID NO: 915714 - RNA, 19 nt, Homo sapiens
uagcacacuuucaauuuca

SEQ ID NO: 915715 - RNA, 19 nt, Homo sapiens
gaauuccuguauacucugu

SEQ ID NO: 915716 - RNA, 19 nt, Homo sapiens
acaaaugacaugagugcua

SEQ ID NO: 915717 - RNA, 19 nt, Homo sapiens
ugacaugaccaauugaaau

SEQ ID NO: 915718 - RNA, 19 nt, Homo sapiens
uaccugugauuacuauuga

SEQ ID NO: 915719 - RNA, 19 nt, Homo sapiens
aagcauagcacacuuucaa

SEQ ID NO: 915720 - RNA, 19 nt, Homo sapiens
uuaauaaguucuggugugu

SEQ ID NO: 915721 - RNA, 19 nt, Homo sapiens
caagcuacucuggaaauaa

SEQ ID NO: 915722 - RNA, 19 nt, Homo sapiens
caacaagcuacucuggaaa

SEQ ID NO: 915723 - RNA, 19 nt, Homo sapiens
ugaaaugacaaaugacaug

SEQ ID NO: 915724 - RNA, 19 nt, Homo sapiens
gagccuaccugugauuacu

SEQ ID NO: 915725 - RNA, 19 nt, Homo sapiens
ugacuucugauaagcagua

SEQ ID NO: 915726 - RNA, 19 nt, Homo sapiens
aagaauuccuguauacucu

SEQ ID NO: 915727 - RNA, 19 nt, Homo sapiens
guucuggugugugaaguug

SEQ ID NO: 915728 - RNA, 19 nt, Homo sapiens
caccacugcuuuauuggau

SEQ ID NO: 915729 - RNA, 19 nt, Homo sapiens
ggaagacuuuuaaaaccaa

SEQ ID NO: 915730 - RNA, 19 nt, Homo sapiens
gcuacucuggaaauaauaa

SEQ ID NO: 915731 - RNA, 19 nt, Homo sapiens
agaauacuauacacaccuu

SEQ ID NO: 915732 - RNA, 19 nt, Homo sapiens
gcuaagaauacuauacaca

SEQ ID NO: 915733 - RNA, 19 nt, Homo sapiens
gcacacuuucaauuucauu

SEQ ID NO: 915734 - RNA, 19 nt, Homo sapiens
gcuauguaauuaggagaga

SEQ ID NO: 915735 - RNA, 19 nt, Homo sapiens
acuguuacaugauggcauu

SEQ ID NO: 915736 - RNA, 19 nt, Homo sapiens
gugaggcauuccuuagaug

SEQ ID NO: 915737 - RNA, 19 nt, Homo sapiens
auagcacacuuucaauuuc

SEQ ID NO: 915738 - RNA, 19 nt, Homo sapiens
acacucaaagaucaucaua

SEQ ID NO: 915739 - RNA, 19 nt, Homo sapiens
cuauguugguuauuucuca

SEQ ID NO: 915740 - RNA, 19 nt, Homo sapiens
gacaaagcuauuaagagaa

SEQ ID NO: 915741 - RNA, 19 nt, Homo sapiens
aauuagaagugcuugagau

SEQ ID NO: 915742 - RNA, 19 nt, Homo sapiens
aaugacaaaugacaugagu

SEQ ID NO: 915743 - RNA, 19 nt, Homo sapiens
agaagugcuugagauguga

SEQ ID NO: 915744 - RNA, 19 nt, Homo sapiens
ugagugcuuuaauaaguuc

SEQ ID NO: 915745 - RNA, 19 nt, Homo sapiens
ccacugcuuuauuggauac

SEQ ID NO: 915746 - RNA, 19 nt, Homo sapiens
acuauacacaccuucauuu

SEQ ID NO: 915747 - RNA, 19 nt, Homo sapiens
cccaguaccuuguuaaucc

SEQ ID NO: 915748 - RNA, 19 nt, Homo sapiens
caaauuagaagugcuugag

SEQ ID NO: 915749 - RNA, 19 nt, Homo sapiens
ugugaggcauuccuuagau

SEQ ID NO: 915750 - RNA, 19 nt, Homo sapiens
ugagugcuauguaauuagg

SEQ ID NO: 915751 - RNA, 19 nt, Homo sapiens
aggcuuaacagucuuauuc

SEQ ID NO: 915752 - RNA, 19 nt, Homo sapiens
gccuaccugugauuacuau

SEQ ID NO: 915753 - RNA, 19 nt, Homo sapiens
uuaggagagccuucaaauu

SEQ ID NO: 915754 - RNA, 19 nt, Homo sapiens
cugagaaauuacccaguga

SEQ ID NO: 915755 - RNA, 19 nt, Homo sapiens
cauaggcuuaacagucuua

SEQ ID NO: 915756 - RNA, 19 nt, Homo sapiens
uauuaaaucucaggcuaag

SEQ ID NO: 915757 - RNA, 19 nt, Homo sapiens
aagaaaucaccugcaaaua

SEQ ID NO: 915758 - RNA, 19 nt, Homo sapiens
gauggguucaguauuuaau

SEQ ID NO: 915759 - RNA, 19 nt, Homo sapiens
gagagccuucaaauuuaaa

SEQ ID NO: 915760 - RNA, 19 nt, Homo sapiens
gaaauaaaccauuccaguu

SEQ ID NO: 915761 - RNA, 19 nt, Homo sapiens
ccacucagcggaagaaaua

SEQ ID NO: 915762 - RNA, 19 nt, Homo sapiens
ucagcaacauggaguuuaa

SEQ ID NO: 915763 - RNA, 19 nt, Homo sapiens
ggaugucacuucacuuaag

SEQ ID NO: 915764 - RNA, 19 nt, Homo sapiens
cggaagaaauaaaccauuc

SEQ ID NO: 915765 - RNA, 19 nt, Homo sapiens
cauauucucccuuugcuuu

SEQ ID NO: 915766 - RNA, 19 nt, Homo sapiens
aaauaaaccauuccaguug

SEQ ID NO: 915767 - RNA, 19 nt, Homo sapiens
caaagcaggguauaaaaua

SEQ ID NO: 915768 - RNA, 19 nt, Homo sapiens
cagauaaaguugacaugca

SEQ ID NO: 915769 - RNA, 19 nt, Homo sapiens
gaccagugcuugucuuugc

SEQ ID NO: 915770 - RNA, 19 nt, Homo sapiens
agauaaaguugacaugcaa

SEQ ID NO: 915771 - RNA, 19 nt, Homo sapiens
cuggaggccuuaacccuuu

SEQ ID NO: 915772 - RNA, 19 nt, Homo sapiens
ugggaugucacuucacuua

SEQ ID NO: 915773 - RNA, 19 nt, Homo sapiens
gaggguaacucauuuugga

SEQ ID NO: 915774 - RNA, 19 nt, Homo sapiens
ccuuguggcuucaugaaug

SEQ ID NO: 915775 - RNA, 19 nt, Homo sapiens
gaguuuaaguggcccucuu

SEQ ID NO: 915776 - RNA, 19 nt, Homo sapiens
gaagaaauaaaccauucca

SEQ ID NO: 915777 - RNA, 19 nt, Homo sapiens
gaugucacuucacuuaagg

SEQ ID NO: 915778 - RNA, 19 nt, Homo sapiens
gguuugggaugucacuuca

SEQ ID NO: 915779 - RNA, 19 nt, Homo sapiens
gcaacauggaguuuaagug

SEQ ID NO: 915780 - RNA, 19 nt, Homo sapiens
aggagaagaugcugugucu

SEQ ID NO: 915781 - RNA, 19 nt, Homo sapiens
gggaugucacuucacuuaa

SEQ ID NO: 915782 - RNA, 19 nt, Homo sapiens
gcggaagaaauaaaccauu

SEQ ID NO: 915783 - RNA, 19 nt, Homo sapiens
ccaguugcaauaccugaaa

SEQ ID NO: 915784 - RNA, 19 nt, Homo sapiens
gcaaagcaggguauaaaau

SEQ ID NO: 915785 - RNA, 19 nt, Homo sapiens
agaggagggugggccauga

SEQ ID NO: 915786 - RNA, 19 nt, Homo sapiens
gaacugcugguggacugaa

SEQ ID NO: 915787 - RNA, 19 nt, Homo sapiens
aaccauuccaguugcaaua

SEQ ID NO: 915788 - RNA, 19 nt, Homo sapiens
uaaccacucagcggaagaa

SEQ ID NO: 915789 - RNA, 19 nt, Homo sapiens
aaguugacaugcaauaaac

SEQ ID NO: 915790 - RNA, 19 nt, Homo sapiens
augcaaagcaggguauaaa

SEQ ID NO: 915791 - RNA, 19 nt, Homo sapiens
gauaaaguugacaugcaau

SEQ ID NO: 915792 - RNA, 19 nt, Homo sapiens
gugcuugucuuugcagaac

SEQ ID NO: 915793 - RNA, 19 nt, Homo sapiens
caagauagcuguuuccaaa

SEQ ID NO: 915794 - RNA, 19 nt, Homo sapiens
gaaggaauauuuagucuga

SEQ ID NO: 915795 - RNA, 19 nt, Homo sapiens
gcagcaaacuuacaauuaa

SEQ ID NO: 915796 - RNA, 19 nt, Homo sapiens
guacgaagcagcaaacuua

SEQ ID NO: 915797 - RNA, 19 nt, Homo sapiens
ggagauagaagcucagaua

SEQ ID NO: 915798 - RNA, 19 nt, Homo sapiens
ggaaauagccagaaaguca

SEQ ID NO: 915799 - RNA, 19 nt, Homo sapiens
caagaugaauucccuauca

SEQ ID NO: 915800 - RNA, 19 nt, Homo sapiens
caaaugaugcucugacuuu

SEQ ID NO: 915801 - RNA, 19 nt, Homo sapiens
gaagauaauuggagagucu

SEQ ID NO: 915802 - RNA, 19 nt, Homo sapiens
ucagauagcuuaguggauu

SEQ ID NO: 915803 - RNA, 19 nt, Homo sapiens
gaaagucauucuugcagau

SEQ ID NO: 915804 - RNA, 19 nt, Homo sapiens
gcauuuggccauguuauua

SEQ ID NO: 915805 - RNA, 19 nt, Homo sapiens
agauagcuguuuccaaaua

SEQ ID NO: 915806 - RNA, 19 nt, Homo sapiens
uaacaagcagucuucuuua

SEQ ID NO: 915807 - RNA, 19 nt, Homo sapiens
gcacuacuuggaagaaaua

SEQ ID NO: 915808 - RNA, 19 nt, Homo sapiens
aaacaggaaugauagaauc

SEQ ID NO: 915809 - RNA, 19 nt, Homo sapiens
ccaaggaucugaaguccau

SEQ ID NO: 915810 - RNA, 19 nt, Homo sapiens
gggaggaaauagccagaaa

SEQ ID NO: 915811 - RNA, 19 nt, Homo sapiens
gaucaugaggagaauauuu

SEQ ID NO: 915812 - RNA, 19 nt, Homo sapiens
caagcagucuucuuuaagu

SEQ ID NO: 915813 - RNA, 19 nt, Homo sapiens
agagagaagucuugaugaa

SEQ ID NO: 915814 - RNA, 19 nt, Homo sapiens
gguggaaacaggaaugaua

SEQ ID NO: 915815 - RNA, 19 nt, Homo sapiens
uagggaggcuguugaagaa

SEQ ID NO: 915816 - RNA, 19 nt, Homo sapiens
gcagucuucuuuaaguuau

SEQ ID NO: 915817 - RNA, 19 nt, Homo sapiens
gauagcuguuuccaaauau

SEQ ID NO: 915818 - RNA, 19 nt, Homo sapiens
caacaucugguucaccuaa

SEQ ID NO: 915819 - RNA, 19 nt, Homo sapiens
caauggagaaccucuaauu

SEQ ID NO: 915820 - RNA, 19 nt, Homo sapiens
gaaacaggaaugauagaau

SEQ ID NO: 915821 - RNA, 19 nt, Homo sapiens
ggcaaggacuagauuuaga

SEQ ID NO: 915822 - RNA, 19 nt, Homo sapiens
gcccagauccuaauaaaca

SEQ ID NO: 915823 - RNA, 19 nt, Homo sapiens
caugacauauucacuacuu

SEQ ID NO: 915824 - RNA, 19 nt, Homo sapiens
aaaugaugcucugacuuua

SEQ ID NO: 915825 - RNA, 19 nt, Homo sapiens
aacaagcagucuucuuuaa

SEQ ID NO: 915826 - RNA, 19 nt, Homo sapiens
cuaaugcccuggcucuuug

SEQ ID NO: 915827 - RNA, 19 nt, Homo sapiens
ggggauaccuauuuuguuu

SEQ ID NO: 915828 - RNA, 19 nt, Homo sapiens
cuacagcaaugcaccaaau

SEQ ID NO: 915829 - RNA, 19 nt, Homo sapiens
uuaacaagcagucuucuuu

SEQ ID NO: 915830 - RNA, 19 nt, Homo sapiens
gcauaagcuuggagagguu

SEQ ID NO: 915831 - RNA, 19 nt, Homo sapiens
gagaagucuugaugaaaca

SEQ ID NO: 915832 - RNA, 19 nt, Homo sapiens
ugucugagggugauauuua

SEQ ID NO: 915833 - RNA, 19 nt, Homo sapiens
gagagaagucuugaugaaa

SEQ ID NO: 915834 - RNA, 19 nt, Homo sapiens
caaagcacauuggcaagga

SEQ ID NO: 915835 - RNA, 19 nt, Homo sapiens
augaugcucugacuuuaua

SEQ ID NO: 915836 - RNA, 19 nt, Homo sapiens
ucaagaaggaacacucuaa

SEQ ID NO: 915837 - RNA, 19 nt, Homo sapiens
uuagagagcccacaacaga

SEQ ID NO: 915838 - RNA, 19 nt, Homo sapiens
guagggaggcuguugaaga

SEQ ID NO: 915839 - RNA, 19 nt, Homo sapiens
gagaaagaggcaugucuga

SEQ ID NO: 915840 - RNA, 19 nt, Homo sapiens
ggaaacaggaaugauagaa

SEQ ID NO: 915841 - RNA, 19 nt, Homo sapiens
gaccaaagccugaaaauuc

SEQ ID NO: 915842 - RNA, 19 nt, Homo sapiens
ggagaauauuugaaggaau

SEQ ID NO: 915843 - RNA, 19 nt, Homo sapiens
ccagugacuuggaaucaug

SEQ ID NO: 915844 - RNA, 19 nt, Homo sapiens
uaucacagcacacauucua

SEQ ID NO: 915845 - RNA, 19 nt, Homo sapiens
ucugaaaccugaaccaaca

SEQ ID NO: 915846 - RNA, 19 nt, Homo sapiens
ucaaauaucaucaccaucu

SEQ ID NO: 915847 - RNA, 19 nt, Homo sapiens
uaauugaggugaugugaac

SEQ ID NO: 915848 - RNA, 19 nt, Homo sapiens
cagauagcuuaguggauuu

SEQ ID NO: 915849 - RNA, 19 nt, Homo sapiens
cauuugggcucccuuggaa

SEQ ID NO: 915850 - RNA, 19 nt, Homo sapiens
uggaugacauuaggcauuu

SEQ ID NO: 915851 - RNA, 19 nt, Homo sapiens
gaauagcauuuggccaugu

SEQ ID NO: 915852 - RNA, 19 nt, Homo sapiens
ccaaagcugccacugugua

SEQ ID NO: 915853 - RNA, 19 nt, Homo sapiens
gccaaauacucauaaagag

SEQ ID NO: 915854 - RNA, 19 nt, Homo sapiens
caaaggcagaauagcauuu

SEQ ID NO: 915855 - RNA, 19 nt, Homo sapiens
guucauucauugcagaguu

SEQ ID NO: 915856 - RNA, 19 nt, Homo sapiens
gaaauagccagaaagucau

SEQ ID NO: 915857 - RNA, 19 nt, Homo sapiens
ccauacaauugcauuaaca

SEQ ID NO: 915858 - RNA, 19 nt, Homo sapiens
aaacaaaguucugcaugag

SEQ ID NO: 915859 - RNA, 19 nt, Homo sapiens
aaggaacacucuaauacga

SEQ ID NO: 915860 - RNA, 19 nt, Homo sapiens
aagaaggaacacucuaaua

SEQ ID NO: 915861 - RNA, 19 nt, Homo sapiens
gcaagaucaugaggagaau

SEQ ID NO: 915862 - RNA, 19 nt, Homo sapiens
ucaggaggcuaagguaaga

SEQ ID NO: 915863 - RNA, 19 nt, Homo sapiens
caaauaucaucaccaucug

SEQ ID NO: 915864 - RNA, 19 nt, Homo sapiens
cauauucacuacuugaucu

SEQ ID NO: 915865 - RNA, 19 nt, Homo sapiens
acgcacaguucauucauug

SEQ ID NO: 915866 - RNA, 19 nt, Homo sapiens
gaggaaauagccagaaagu

SEQ ID NO: 915867 - RNA, 19 nt, Homo sapiens
agagaagucuugaugaaac

SEQ ID NO: 915868 - RNA, 19 nt, Homo sapiens
cagaaaggacugggcauuu

SEQ ID NO: 915869 - RNA, 19 nt, Homo sapiens
guucauaauugaggugaug

SEQ ID NO: 915870 - RNA, 19 nt, Homo sapiens
gacgcacaguucauucauu

SEQ ID NO: 915871 - RNA, 19 nt, Homo sapiens
uaguggauuugcucaauga

SEQ ID NO: 915872 - RNA, 19 nt, Homo sapiens
aaaggaaugagaaaucuga

SEQ ID NO: 915873 - RNA, 19 nt, Homo sapiens
gcccuccacuucaaccaaa

SEQ ID NO: 915874 - RNA, 19 nt, Homo sapiens
caagauuucaugcuccaaa

SEQ ID NO: 915875 - RNA, 19 nt, Homo sapiens
gauauuuauuccugcuguu

SEQ ID NO: 915876 - RNA, 19 nt, Homo sapiens
ggagagguucaacuucuga

SEQ ID NO: 915877 - RNA, 19 nt, Homo sapiens
cgaagcagcaaacuuacaa

SEQ ID NO: 915878 - RNA, 19 nt, Homo sapiens
gaggagaauauuugaagga

SEQ ID NO: 915879 - RNA, 19 nt, Homo sapiens
ggaguuccaccauuacuag

SEQ ID NO: 915880 - RNA, 19 nt, Homo sapiens
gacaaaugaugcucugacu

SEQ ID NO: 915881 - RNA, 19 nt, Homo sapiens
caaaugccagguaguuaga

SEQ ID NO: 915882 - RNA, 19 nt, Homo sapiens
gcuacuacuuucccuucaa

SEQ ID NO: 915883 - RNA, 19 nt, Homo sapiens
cuacuuggaagaaauauca

SEQ ID NO: 915884 - RNA, 19 nt, Homo sapiens
caagaaggaacacucuaau

SEQ ID NO: 915885 - RNA, 19 nt, Homo sapiens
gcucaagcuuguauuacca

SEQ ID NO: 915886 - RNA, 19 nt, Homo sapiens
gggaggcuguugaagaaag

SEQ ID NO: 915887 - RNA, 19 nt, Homo sapiens
gcagauggucacaugucua

SEQ ID NO: 915888 - RNA, 19 nt, Homo sapiens
ugacauauucacuacuuga

SEQ ID NO: 915889 - RNA, 19 nt, Homo sapiens
gggcugccuuacaagauga

SEQ ID NO: 915890 - RNA, 19 nt, Homo sapiens
gaaggaacacucuaauacg

SEQ ID NO: 915891 - RNA, 19 nt, Homo sapiens
ggacucugcaagaucauga

SEQ ID NO: 915892 - RNA, 19 nt, Homo sapiens
ucauaaagagcaagauuuc

SEQ ID NO: 915893 - RNA, 19 nt, Homo sapiens
gcauaaaccuugaaaugaa

SEQ ID NO: 915894 - RNA, 19 nt, Homo sapiens
gaagauaacaggacugaaa

SEQ ID NO: 915895 - RNA, 19 nt, Homo sapiens
caacauagacuacuccauu

SEQ ID NO: 915896 - RNA, 19 nt, Homo sapiens
ccaaacaccugacucuuau

SEQ ID NO: 915897 - RNA, 19 nt, Homo sapiens
gguauugcuugcuuaauuu

SEQ ID NO: 915898 - RNA, 19 nt, Homo sapiens
caaaguacaccagaaauuu

SEQ ID NO: 915899 - RNA, 19 nt, Homo sapiens
gugguuaccugaaaucauu

SEQ ID NO: 915900 - RNA, 19 nt, Homo sapiens
agacugcaauugaagauaa

SEQ ID NO: 915901 - RNA, 19 nt, Homo sapiens
agaaugggcaguacaaaua

SEQ ID NO: 915902 - RNA, 19 nt, Homo sapiens
caacucuguuuaaaccaua

SEQ ID NO: 915903 - RNA, 19 nt, Homo sapiens
aaagaacacuucaggaauc

SEQ ID NO: 915904 - RNA, 19 nt, Homo sapiens
ccaaagaacacuucaggaa

SEQ ID NO: 915905 - RNA, 19 nt, Homo sapiens
aaacaccugacucuuauua

SEQ ID NO: 915906 - RNA, 19 nt, Homo sapiens
ucauucagcuuaacauuuc

SEQ ID NO: 915907 - RNA, 19 nt, Homo sapiens
auaccuaacuccuaucuga

SEQ ID NO: 915908 - RNA, 19 nt, Homo sapiens
aacauagacuacuccauua

SEQ ID NO: 915909 - RNA, 19 nt, Homo sapiens
gaagggccagaguauauuu

SEQ ID NO: 915910 - RNA, 19 nt, Homo sapiens
ucacugugguuaccugaaa

SEQ ID NO: 915911 - RNA, 19 nt, Homo sapiens
aaacaaacauggagcaaaa

SEQ ID NO: 915912 - RNA, 19 nt, Homo sapiens
ugaaagcaauaaccaaaca

SEQ ID NO: 915913 - RNA, 19 nt, Homo sapiens
acaaagaacauucaacguu

SEQ ID NO: 915914 - RNA, 19 nt, Homo sapiens
gcuagguauugcuugcuua

SEQ ID NO: 915915 - RNA, 19 nt, Homo sapiens
ucucauaccuaacuccuau

SEQ ID NO: 915916 - RNA, 19 nt, Homo sapiens
ccucaucuauguuaccaaa

SEQ ID NO: 915917 - RNA, 19 nt, Homo sapiens
ugaacaaucugccuuaaaa

SEQ ID NO: 915918 - RNA, 19 nt, Homo sapiens
ggugauugguuccuauaug

SEQ ID NO: 915919 - RNA, 19 nt, Homo sapiens
gaccuaaaaugaccuguaa

SEQ ID NO: 915920 - RNA, 19 nt, Homo sapiens
caaagaacacuucaggaau

SEQ ID NO: 915921 - RNA, 19 nt, Homo sapiens
aaagacagcagccguuauu

SEQ ID NO: 915922 - RNA, 19 nt, Homo sapiens
ggcauaaaccuugaaauga

SEQ ID NO: 915923 - RNA, 19 nt, Homo sapiens
caagaagggccagaguaua

SEQ ID NO: 915924 - RNA, 19 nt, Homo sapiens
gaacacuucaggaaucuca

SEQ ID NO: 915925 - RNA, 19 nt, Homo sapiens
gaaugggcaguacaaauau

SEQ ID NO: 915926 - RNA, 19 nt, Homo sapiens
ucaaaguacaccagaaauu

SEQ ID NO: 915927 - RNA, 19 nt, Homo sapiens
ggacugaaaauauccuuua

SEQ ID NO: 915928 - RNA, 19 nt, Homo sapiens
uaaugaacaaucugccuua

SEQ ID NO: 915929 - RNA, 19 nt, Homo sapiens
gacagcagccguuauuuua

SEQ ID NO: 915930 - RNA, 19 nt, Homo sapiens
ccaaagacagcagccguua

SEQ ID NO: 915931 - RNA, 19 nt, Homo sapiens
ucuguacgcugucacacua

SEQ ID NO: 915932 - RNA, 19 nt, Homo sapiens
gguaaugaccaacuaaaca

SEQ ID NO: 915933 - RNA, 19 nt, Homo sapiens
gaaguuuucuuuccauuca

SEQ ID NO: 915934 - RNA, 19 nt, Homo sapiens
gcagaacuauuggcuaggu

SEQ ID NO: 915935 - RNA, 19 nt, Homo sapiens
uaacaggacugaaaauauc

SEQ ID NO: 915936 - RNA, 19 nt, Homo sapiens
ucaucuauguuaccaaaga

SEQ ID NO: 915937 - RNA, 19 nt, Homo sapiens
guuccuauauggacccaaa

SEQ ID NO: 915938 - RNA, 19 nt, Homo sapiens
gaacuauuggcuagguauu

SEQ ID NO: 915939 - RNA, 19 nt, Homo sapiens
gguaaagauucaaacaaac

SEQ ID NO: 915940 - RNA, 19 nt, Homo sapiens
gcaaugucagguaaagauu

SEQ ID NO: 915941 - RNA, 19 nt, Homo sapiens
agguauugcuugcuuaauu

SEQ ID NO: 915942 - RNA, 19 nt, Homo sapiens
uuauaggaaucccaacaaa

SEQ ID NO: 915943 - RNA, 19 nt, Homo sapiens
aagaagggccagaguauau

SEQ ID NO: 915944 - RNA, 19 nt, Homo sapiens
ucaagaagggccagaguau

SEQ ID NO: 915945 - RNA, 19 nt, Homo sapiens
uaaaaugaccuguaacuga

SEQ ID NO: 915946 - RNA, 19 nt, Homo sapiens
agacuacuccauuauugua

SEQ ID NO: 915947 - RNA, 19 nt, Homo sapiens
auagacuacuccauuauug

SEQ ID NO: 915948 - RNA, 19 nt, Homo sapiens
uggcauaaaccuugaaaug

SEQ ID NO: 915949 - RNA, 19 nt, Homo sapiens
ugacaaaugcuuauaacca

SEQ ID NO: 915950 - RNA, 19 nt, Homo sapiens
accaaacaccugacucuua

SEQ ID NO: 915951 - RNA, 19 nt, Homo sapiens
aacaaugucugacucugaa

SEQ ID NO: 915952 - RNA, 19 nt, Homo sapiens
aaacaaugucugacucuga

SEQ ID NO: 915953 - RNA, 19 nt, Homo sapiens
gugauugguuccuauaugg

SEQ ID NO: 915954 - RNA, 19 nt, Homo sapiens
cagcuuaacauuucacugu

SEQ ID NO: 915955 - RNA, 19 nt, Homo sapiens
cauagacuacuccauuauu

SEQ ID NO: 915956 - RNA, 19 nt, Homo sapiens
aagcggcaaugucagguaa

SEQ ID NO: 915957 - RNA, 19 nt, Homo sapiens
guaaugaccaacuaaacau

SEQ ID NO: 915958 - RNA, 19 nt, Homo sapiens
gcaguacaaauaugagguu

SEQ ID NO: 915959 - RNA, 19 nt, Homo sapiens
gauguaauccucaaaagaa

SEQ ID NO: 915960 - RNA, 19 nt, Homo sapiens
ggugacaaaugcuuauaac

SEQ ID NO: 915961 - RNA, 19 nt, Homo sapiens
caaacaaacauggagcaaa

SEQ ID NO: 915962 - RNA, 19 nt, Homo sapiens
agaaaggggucgauacaaa

SEQ ID NO: 915963 - RNA, 19 nt, Homo sapiens
aauccacccucaucuaugu

SEQ ID NO: 915964 - RNA, 19 nt, Homo sapiens
aaacacugaagcacaaauu

SEQ ID NO: 915965 - RNA, 19 nt, Homo sapiens
caacguugggauuauuaaa

SEQ ID NO: 915966 - RNA, 19 nt, Homo sapiens
ggagcaacauagacuacuc

SEQ ID NO: 915967 - RNA, 19 nt, Homo sapiens
aaaccuaaacaaugucuga

SEQ ID NO: 915968 - RNA, 19 nt, Homo sapiens
ggauuuccuaauucuguua

SEQ ID NO: 915969 - RNA, 19 nt, Homo sapiens
uuaaggcccucuucucaag

SEQ ID NO: 915970 - RNA, 19 nt, Homo sapiens
aaacucuucauucagcuua

SEQ ID NO: 915971 - RNA, 19 nt, Homo sapiens
gauaacaggacugaaaaua

SEQ ID NO: 915972 - RNA, 19 nt, Homo sapiens
uaaagacugcaauugaaga

SEQ ID NO: 915973 - RNA, 19 nt, Homo sapiens
acaaauugcccagaccuaa

SEQ ID NO: 915974 - RNA, 19 nt, Homo sapiens
guaucaagccauuguuuca

SEQ ID NO: 915975 - RNA, 19 nt, Homo sapiens
cagaacuauuggcuaggua

SEQ ID NO: 915976 - RNA, 19 nt, Homo sapiens
gagucaaaguacaccagaa

SEQ ID NO: 915977 - RNA, 19 nt, Homo sapiens
guagguaaugaccaacuaa

SEQ ID NO: 915978 - RNA, 19 nt, Homo sapiens
ucuauccacucucaguuga

SEQ ID NO: 915979 - RNA, 19 nt, Homo sapiens
gugaaaaccugcuaauagu

SEQ ID NO: 915980 - RNA, 19 nt, Homo sapiens
cauuaaggcccucuucuca

SEQ ID NO: 915981 - RNA, 19 nt, Homo sapiens
ucaggaaucucacuuuuca

SEQ ID NO: 915982 - RNA, 19 nt, Homo sapiens
uguagguaaugaccaacua

SEQ ID NO: 915983 - RNA, 19 nt, Homo sapiens
cuauggcacucuguaggua

SEQ ID NO: 915984 - RNA, 19 nt, Homo sapiens
auuugaagcugugaucuaa

SEQ ID NO: 915985 - RNA, 19 nt, Homo sapiens
aaugaacaaucugccuuaa

SEQ ID NO: 915986 - RNA, 19 nt, Homo sapiens
cgauacaaagccauuuaaa

SEQ ID NO: 915987 - RNA, 19 nt, Homo sapiens
cuauauggacccaaacuau

SEQ ID NO: 915988 - RNA, 19 nt, Homo sapiens
aaccaaacccugugagaga

SEQ ID NO: 915989 - RNA, 19 nt, Homo sapiens
ggcaaugucagguaaagau

SEQ ID NO: 915990 - RNA, 19 nt, Homo sapiens
gucgauacaaagccauuua

SEQ ID NO: 915991 - RNA, 19 nt, Homo sapiens
ggacuauggcacucuguag

SEQ ID NO: 915992 - RNA, 19 nt, Homo sapiens
ucugaaagcaauaaccaaa

SEQ ID NO: 915993 - RNA, 19 nt, Homo sapiens
cagcaaacuuuaucuguaa

SEQ ID NO: 915994 - RNA, 19 nt, Homo sapiens
gaaugaauguggcaauguu

SEQ ID NO: 915995 - RNA, 19 nt, Homo sapiens
gcacaugccucagguacaa

SEQ ID NO: 915996 - RNA, 19 nt, Homo sapiens
gaccagauagcaaauauuu

SEQ ID NO: 915997 - RNA, 19 nt, Homo sapiens
gaauauucauacucccaua

SEQ ID NO: 915998 - RNA, 19 nt, Homo sapiens
ggaacacuauuaacucuca

SEQ ID NO: 915999 - RNA, 19 nt, Homo sapiens
gaaguggaacuacuaggua

SEQ ID NO: 916000 - RNA, 19 nt, Homo sapiens
ucagcaaacuuuaucugua

SEQ ID NO: 916001 - RNA, 19 nt, Homo sapiens
gaaaagaauuccugaagug

SEQ ID NO: 916002 - RNA, 19 nt, Homo sapiens
caaaagcacccacauaaua

SEQ ID NO: 916003 - RNA, 19 nt, Homo sapiens
guaaugccacgaugaauau

SEQ ID NO: 916004 - RNA, 19 nt, Homo sapiens
gggaccagauagcaaauau

SEQ ID NO: 916005 - RNA, 19 nt, Homo sapiens
ccagggaucagcaaacuuu

SEQ ID NO: 916006 - RNA, 19 nt, Homo sapiens
caagguccaugaagagcaa

SEQ ID NO: 916007 - RNA, 19 nt, Homo sapiens
guggcaauguucaaauaaa

SEQ ID NO: 916008 - RNA, 19 nt, Homo sapiens
uuucagugcuguuugcuuu

SEQ ID NO: 916009 - RNA, 19 nt, Homo sapiens
acucccauauuuaggauua

SEQ ID NO: 916010 - RNA, 19 nt, Homo sapiens
cgaugaauaucucugugaa

SEQ ID NO: 916011 - RNA, 19 nt, Homo sapiens
uaguaaagguucuugauac

SEQ ID NO: 916012 - RNA, 19 nt, Homo sapiens
guaaccaccauauaacuga

SEQ ID NO: 916013 - RNA, 19 nt, Homo sapiens
uaagggaccagauagcaaa

SEQ ID NO: 916014 - RNA, 19 nt, Homo sapiens
ugaaagcaguggguggaaa

SEQ ID NO: 916015 - RNA, 19 nt, Homo sapiens
uaugcaagguccaugaaga

SEQ ID NO: 916016 - RNA, 19 nt, Homo sapiens
gaauguggcaauguucaaa

SEQ ID NO: 916017 - RNA, 19 nt, Homo sapiens
aaagguacauaguaaaggu

SEQ ID NO: 916018 - RNA, 19 nt, Homo sapiens
ucaguagcauuuguuauca

SEQ ID NO: 916019 - RNA, 19 nt, Homo sapiens
aaguggaacuacuagguaa

SEQ ID NO: 916020 - RNA, 19 nt, Homo sapiens
gggaggugucggcacauua

SEQ ID NO: 916021 - RNA, 19 nt, Homo sapiens
aguaaugccacgaugaaua

SEQ ID NO: 916022 - RNA, 19 nt, Homo sapiens
ccucaguaaugaagauaau

SEQ ID NO: 916023 - RNA, 19 nt, Homo sapiens
ucacuuauacucggaauuc

SEQ ID NO: 916024 - RNA, 19 nt, Homo sapiens
gagcaaaagcacccacaua

SEQ ID NO: 916025 - RNA, 19 nt, Homo sapiens
caugaguaaccaccauaua

SEQ ID NO: 916026 - RNA, 19 nt, Homo sapiens
uccaauggcaccaagauuu

SEQ ID NO: 916027 - RNA, 19 nt, Homo sapiens
guaagggaccagauagcaa

SEQ ID NO: 916028 - RNA, 19 nt, Homo sapiens
aaaccucaguaaugaagau

SEQ ID NO: 916029 - RNA, 19 nt, Homo sapiens
ggaauucuggaguaucuca

SEQ ID NO: 916030 - RNA, 19 nt, Homo sapiens
ggaccagauagcaaauauu

SEQ ID NO: 916031 - RNA, 19 nt, Homo sapiens
gaguucuacuacaaccuuu

SEQ ID NO: 916032 - RNA, 19 nt, Homo sapiens
augaguaaccaccauauaa

SEQ ID NO: 916033 - RNA, 19 nt, Homo sapiens
gguucuugauacauaauga

SEQ ID NO: 916034 - RNA, 19 nt, Homo sapiens
ucaguaaugccacgaugaa

SEQ ID NO: 916035 - RNA, 19 nt, Homo sapiens
cauauucaguacaaucagu

SEQ ID NO: 916036 - RNA, 19 nt, Homo sapiens
ucugcaagaucacuuauac

SEQ ID NO: 916037 - RNA, 19 nt, Homo sapiens
gaucagcaaacuuuaucug

SEQ ID NO: 916038 - RNA, 19 nt, Homo sapiens
uuaacucucaguagcauuu

SEQ ID NO: 916039 - RNA, 19 nt, Homo sapiens
ccacuuuguuucaauuugc

SEQ ID NO: 916040 - RNA, 19 nt, Homo sapiens
aguaaagguucuugauaca

SEQ ID NO: 916041 - RNA, 19 nt, Homo sapiens
gaucacuuauacucggaau

SEQ ID NO: 916042 - RNA, 19 nt, Homo sapiens
ugacugggaugaggugagu

SEQ ID NO: 916043 - RNA, 19 nt, Homo sapiens
gggaucagcaaacuuuauc

SEQ ID NO: 916044 - RNA, 19 nt, Homo sapiens
gcaccaagauuuuauaacc

SEQ ID NO: 916045 - RNA, 19 nt, Homo sapiens
ggaggugucggcacauuac

SEQ ID NO: 916046 - RNA, 19 nt, Homo sapiens
gaaagcaguggguggaaaa

SEQ ID NO: 916047 - RNA, 19 nt, Homo sapiens
cuacauagucugaaaauuc

SEQ ID NO: 916048 - RNA, 19 nt, Homo sapiens
ccuuugugauuucuucuau

SEQ ID NO: 916049 - RNA, 19 nt, Homo sapiens
caguagcauuuguuaucaa

SEQ ID NO: 916050 - RNA, 19 nt, Homo sapiens
auguggcaauguucaaaua

SEQ ID NO: 916051 - RNA, 19 nt, Homo sapiens
gcaaaagcacccacauaau

SEQ ID NO: 916052 - RNA, 19 nt, Homo sapiens
ugacuuugcaggccauaug

SEQ ID NO: 916053 - RNA, 19 nt, Homo sapiens
ugugauuucuucuaucucu

SEQ ID NO: 916054 - RNA, 19 nt, Homo sapiens
ucggaauucuggaguaucu

SEQ ID NO: 916055 - RNA, 19 nt, Homo sapiens
cauaguaaagguucuugau

SEQ ID NO: 916056 - RNA, 19 nt, Homo sapiens
guacauaguaaagguucuu

SEQ ID NO: 916057 - RNA, 19 nt, Homo sapiens
caaccuuucagugcuguuu

SEQ ID NO: 916058 - RNA, 19 nt, Homo sapiens
uaacacauuacacagagau

SEQ ID NO: 916059 - RNA, 19 nt, Homo sapiens
acauaacacauuacacaga

SEQ ID NO: 916060 - RNA, 19 nt, Homo sapiens
cauacucccauauuuagga

SEQ ID NO: 916061 - RNA, 19 nt, Homo sapiens
gaugaauaucucugugaau

SEQ ID NO: 916062 - RNA, 19 nt, Homo sapiens
uaauguuuccgcauauuca

SEQ ID NO: 916063 - RNA, 19 nt, Homo sapiens
ugccucagguacaaaauua

SEQ ID NO: 916064 - RNA, 19 nt, Homo sapiens
gaguaaccaccauauaacu

SEQ ID NO: 916065 - RNA, 19 nt, Homo sapiens
uuaccuuugugauuucuuc

SEQ ID NO: 916066 - RNA, 19 nt, Homo sapiens
cggcacauuacucaaguuu

SEQ ID NO: 916067 - RNA, 19 nt, Homo sapiens
ccacgaugaauaucucugu

SEQ ID NO: 916068 - RNA, 19 nt, Homo sapiens
guaaagguucuugauacau

SEQ ID NO: 916069 - RNA, 19 nt, Homo sapiens
uauggucucugucccaacu

SEQ ID NO: 916070 - RNA, 19 nt, Homo sapiens
ucuucuaucucuuacaaag

SEQ ID NO: 916071 - RNA, 19 nt, Homo sapiens
ggugucggcacauuacuca

SEQ ID NO: 916072 - RNA, 19 nt, Homo sapiens
acacuauuaacucucagua

SEQ ID NO: 916073 - RNA, 19 nt, Homo sapiens
guuucaauuugcagcuauu

SEQ ID NO: 916074 - RNA, 19 nt, Homo sapiens
ugaaguggaacuacuaggu

SEQ ID NO: 916075 - RNA, 19 nt, Homo sapiens
acacguauuuuaagucaug

SEQ ID NO: 916076 - RNA, 19 nt, Homo sapiens
ucaguacaaucaguaaugc

SEQ ID NO: 916077 - RNA, 19 nt, Homo sapiens
caggccauauggucucugu

SEQ ID NO: 916078 - RNA, 19 nt, Homo sapiens
cauaaugacagguuguuuu

SEQ ID NO: 916079 - RNA, 19 nt, Homo sapiens
uauaaccacaacacaaugu

SEQ ID NO: 916080 - RNA, 19 nt, Homo sapiens
ccaauggcaccaagauuuu

SEQ ID NO: 916081 - RNA, 19 nt, Homo sapiens
ugaguaaccaccauauaac

SEQ ID NO: 916082 - RNA, 19 nt, Homo sapiens
aaaagcacccacauaauau

SEQ ID NO: 916083 - RNA, 19 nt, Homo sapiens
guuaucaacauuuccucaa

SEQ ID NO: 916084 - RNA, 19 nt, Homo sapiens
ugaguucuacuacaaccuu

SEQ ID NO: 916085 - RNA, 19 nt, Homo sapiens
ugauacauaaugacagguu

SEQ ID NO: 916086 - RNA, 19 nt, Homo sapiens
agaaaagaauuccugaagu

SEQ ID NO: 916087 - RNA, 19 nt, Homo sapiens
gaggaacgcuguagaauaa

SEQ ID NO: 916088 - RNA, 19 nt, Homo sapiens
gaacagagauugaguuuac

SEQ ID NO: 916089 - RNA, 19 nt, Homo sapiens
gaaaugagaucagcuagga

SEQ ID NO: 916090 - RNA, 19 nt, Homo sapiens
gcaacguuguucaaauaua

SEQ ID NO: 916091 - RNA, 19 nt, Homo sapiens
caucaucaauuacccuaua

SEQ ID NO: 916092 - RNA, 19 nt, Homo sapiens
gaagagcuuuaaucccuuu

SEQ ID NO: 916093 - RNA, 19 nt, Homo sapiens
gagaucagcuaggauacua

SEQ ID NO: 916094 - RNA, 19 nt, Homo sapiens
aagcaucucucuccaugua

SEQ ID NO: 916095 - RNA, 19 nt, Homo sapiens
gaaaagaguuguucauuac

SEQ ID NO: 916096 - RNA, 19 nt, Homo sapiens
caauuacccuauaugcuaa

SEQ ID NO: 916097 - RNA, 19 nt, Homo sapiens
ucaauuacccuauaugcua

SEQ ID NO: 916098 - RNA, 19 nt, Homo sapiens
gaccaaaacugucaaggua

SEQ ID NO: 916099 - RNA, 19 nt, Homo sapiens
gcuaaagcuugaagacuga

SEQ ID NO: 916100 - RNA, 19 nt, Homo sapiens
uaaguaaccugcccauagu

SEQ ID NO: 916101 - RNA, 19 nt, Homo sapiens
gagcaauuauagucagauu

SEQ ID NO: 916102 - RNA, 19 nt, Homo sapiens
gcaaacacaucuaacuaac

SEQ ID NO: 916103 - RNA, 19 nt, Homo sapiens
gaacgcuguagaauaaaua

SEQ ID NO: 916104 - RNA, 19 nt, Homo sapiens
gacaggaugguaaguauaa

SEQ ID NO: 916105 - RNA, 19 nt, Homo sapiens
cuugaagacugagcaauua

SEQ ID NO: 916106 - RNA, 19 nt, Homo sapiens
cauguaaucucagaaauuc

SEQ ID NO: 916107 - RNA, 19 nt, Homo sapiens
ccaaggcuaucuggcuuua

SEQ ID NO: 916108 - RNA, 19 nt, Homo sapiens
ggaacgcuguagaauaaau

SEQ ID NO: 916109 - RNA, 19 nt, Homo sapiens
ggaaccuguuaaucacuua

SEQ ID NO: 916110 - RNA, 19 nt, Homo sapiens
ucaccaggaaucuuaauua

SEQ ID NO: 916111 - RNA, 19 nt, Homo sapiens
ugaaagcuguaaacugcua

SEQ ID NO: 916112 - RNA, 19 nt, Homo sapiens
caauuaaucucucuaagcu

SEQ ID NO: 916113 - RNA, 19 nt, Homo sapiens
ucagauacuugacuuagga

SEQ ID NO: 916114 - RNA, 19 nt, Homo sapiens
gagagucaaucuacguuca

SEQ ID NO: 916115 - RNA, 19 nt, Homo sapiens
caccaggaaucuuaauuau

SEQ ID NO: 916116 - RNA, 19 nt, Homo sapiens
uaaaauggcuaaagcuuga

SEQ ID NO: 916117 - RNA, 19 nt, Homo sapiens
ucauaauucugcaaucuga

SEQ ID NO: 916118 - RNA, 19 nt, Homo sapiens
augcaacguuguucaaaua

SEQ ID NO: 916119 - RNA, 19 nt, Homo sapiens
uuacacagccagcaaauga

SEQ ID NO: 916120 - RNA, 19 nt, Homo sapiens
ucaaaggauuucucucuca

SEQ ID NO: 916121 - RNA, 19 nt, Homo sapiens
agaauauugucgcauguuu

SEQ ID NO: 916122 - RNA, 19 nt, Homo sapiens
cuaauaggcacuugauaaa

SEQ ID NO: 916123 - RNA, 19 nt, Homo sapiens
uacccuauaugcuaaauga

SEQ ID NO: 916124 - RNA, 19 nt, Homo sapiens
ucacuuaaaggccauauga

SEQ ID NO: 916125 - RNA, 19 nt, Homo sapiens
gauaaucuauaacccuuac

SEQ ID NO: 916126 - RNA, 19 nt, Homo sapiens
gguauuaucccucauuuac

SEQ ID NO: 916127 - RNA, 19 nt, Homo sapiens
gacuaccacagcaauauua

SEQ ID NO: 916128 - RNA, 19 nt, Homo sapiens
ugaagagacucagaacaga

SEQ ID NO: 916129 - RNA, 19 nt, Homo sapiens
gcaauuauagucagauucu

SEQ ID NO: 916130 - RNA, 19 nt, Homo sapiens
ccuauaugcuaaaugacua

SEQ ID NO: 916131 - RNA, 19 nt, Homo sapiens
cauaugaccuuagacaagu

SEQ ID NO: 916132 - RNA, 19 nt, Homo sapiens
gaggcaacccuaucucuug

SEQ ID NO: 916133 - RNA, 19 nt, Homo sapiens
gccagcaggugagaaauga

SEQ ID NO: 916134 - RNA, 19 nt, Homo sapiens
gaagacugagcaauuauag

SEQ ID NO: 916135 - RNA, 19 nt, Homo sapiens
ggaauggacacaaccacaa

SEQ ID NO: 916136 - RNA, 19 nt, Homo sapiens
ggucauaauucugcaaucu

SEQ ID NO: 916137 - RNA, 19 nt, Homo sapiens
caauuuaaccuuccacauc

SEQ ID NO: 916138 - RNA, 19 nt, Homo sapiens
uagcaaacacaucuaacua

SEQ ID NO: 916139 - RNA, 19 nt, Homo sapiens
gaaucagauacuugacuua

SEQ ID NO: 916140 - RNA, 19 nt, Homo sapiens
auaaagaaacugacacuug

SEQ ID NO: 916141 - RNA, 19 nt, Homo sapiens
ugaaugccaucaauguaau

SEQ ID NO: 916142 - RNA, 19 nt, Homo sapiens
uccauucuccucccuauua

SEQ ID NO: 916143 - RNA, 19 nt, Homo sapiens
agaggaacgcuguagaaua

SEQ ID NO: 916144 - RNA, 19 nt, Homo sapiens
agaagaaucagauacuuga

SEQ ID NO: 916145 - RNA, 19 nt, Homo sapiens
ugaagacugagcaauuaua

SEQ ID NO: 916146 - RNA, 19 nt, Homo sapiens
caaccacaagaaacuauaa

SEQ ID NO: 916147 - RNA, 19 nt, Homo sapiens
gcaucucucuccauguaau

SEQ ID NO: 916148 - RNA, 19 nt, Homo sapiens
caagaauauugucgcaugu

SEQ ID NO: 916149 - RNA, 19 nt, Homo sapiens
gaugguaaguauaaucaac

SEQ ID NO: 916150 - RNA, 19 nt, Homo sapiens
cagaacagagauugaguuu

SEQ ID NO: 916151 - RNA, 19 nt, Homo sapiens
gaaugccaucaauguaaua

SEQ ID NO: 916152 - RNA, 19 nt, Homo sapiens
gcacaacaaccaccauuuu

SEQ ID NO: 916153 - RNA, 19 nt, Homo sapiens
uagcaaggcuuuuauuuuc

SEQ ID NO: 916154 - RNA, 19 nt, Homo sapiens
aauuuaaccuuccacauca

SEQ ID NO: 916155 - RNA, 19 nt, Homo sapiens
cagauucacccaaguauag

SEQ ID NO: 916156 - RNA, 19 nt, Homo sapiens
gcuugaagacugagcaauu

SEQ ID NO: 916157 - RNA, 19 nt, Homo sapiens
ggacacaaccacaagaaac

SEQ ID NO: 916158 - RNA, 19 nt, Homo sapiens
agaaucagauacuugacuu

SEQ ID NO: 916159 - RNA, 19 nt, Homo sapiens
gaagugggaaaucgacaga

SEQ ID NO: 916160 - RNA, 19 nt, Homo sapiens
ccauucuccucccuauuaa

SEQ ID NO: 916161 - RNA, 19 nt, Homo sapiens
gcuuuaaucccuuugcauu

SEQ ID NO: 916162 - RNA, 19 nt, Homo sapiens
aaugagaucagcuaggaua

SEQ ID NO: 916163 - RNA, 19 nt, Homo sapiens
caaaccaccccaaaacuua

SEQ ID NO: 916164 - RNA, 19 nt, Homo sapiens
ggaaaucgacagaaaagaa

SEQ ID NO: 916165 - RNA, 19 nt, Homo sapiens
uagguauuaucccucauuu

SEQ ID NO: 916166 - RNA, 19 nt, Homo sapiens
caugaaugccaucaaugua

SEQ ID NO: 916167 - RNA, 19 nt, Homo sapiens
aacccaaacugaaaggaaa

SEQ ID NO: 916168 - RNA, 19 nt, Homo sapiens
ccauguaaucucagaaauu

SEQ ID NO: 916169 - RNA, 19 nt, Homo sapiens
ugagaaaugagaucagcua

SEQ ID NO: 916170 - RNA, 19 nt, Homo sapiens
acacaucuaacuaacauga

SEQ ID NO: 916171 - RNA, 19 nt, Homo sapiens
uuaaguaaccugcccauag

SEQ ID NO: 916172 - RNA, 19 nt, Homo sapiens
ugacuucacacgagcauga

SEQ ID NO: 916173 - RNA, 19 nt, Homo sapiens
caaacugaaaggaaaguga

SEQ ID NO: 916174 - RNA, 19 nt, Homo sapiens
ggauaaucuauaacccuua

SEQ ID NO: 916175 - RNA, 19 nt, Homo sapiens
gaccuuagacaagucaauu

SEQ ID NO: 916176 - RNA, 19 nt, Homo sapiens
caacccaaacugaaaggaa

SEQ ID NO: 916177 - RNA, 19 nt, Homo sapiens
gcuacaggcccaacccaaa

SEQ ID NO: 916178 - RNA, 19 nt, Homo sapiens
ugucaggugcuguugguua

SEQ ID NO: 916179 - RNA, 19 nt, Homo sapiens
ggaggcaacccuaucucuu

SEQ ID NO: 916180 - RNA, 19 nt, Homo sapiens
ggucagauucuuacaugau

SEQ ID NO: 916181 - RNA, 19 nt, Homo sapiens
cuaucuggcuuuaaugcaa

SEQ ID NO: 916182 - RNA, 19 nt, Homo sapiens
aaggcuaucuggcuuuaau

SEQ ID NO: 916183 - RNA, 19 nt, Homo sapiens
guagguauuaucccucauu

SEQ ID NO: 916184 - RNA, 19 nt, Homo sapiens
cuauaacccuuacaauaac

SEQ ID NO: 916185 - RNA, 19 nt, Homo sapiens
ucuccucccuauuaauaaa

SEQ ID NO: 916186 - RNA, 19 nt, Homo sapiens
ugacaggaugguaaguaua

SEQ ID NO: 916187 - RNA, 19 nt, Homo sapiens
ggaagugugucaacuauuu

SEQ ID NO: 916188 - RNA, 19 nt, Homo sapiens
gaaagucccucugcaauug

SEQ ID NO: 916189 - RNA, 19 nt, Homo sapiens
caagaagggauauaaguua

SEQ ID NO: 916190 - RNA, 19 nt, Homo sapiens
gaaaugggcuugauauucc

SEQ ID NO: 916191 - RNA, 19 nt, Homo sapiens
gaccagugcuugcuucauu

SEQ ID NO: 916192 - RNA, 19 nt, Homo sapiens
guucagaauuccuggauuu

SEQ ID NO: 916193 - RNA, 19 nt, Homo sapiens
ccaaacagauaucuaaaca

SEQ ID NO: 916194 - RNA, 19 nt, Homo sapiens
aaauaaagcuucugugucu

SEQ ID NO: 916195 - RNA, 19 nt, Homo sapiens
gcaauugcauaguucagaa

SEQ ID NO: 916196 - RNA, 19 nt, Homo sapiens
gaggaagugugucaacuau

SEQ ID NO: 916197 - RNA, 19 nt, Homo sapiens
gcaaaggcauguggaacuu

SEQ ID NO: 916198 - RNA, 19 nt, Homo sapiens
ggaaugccguacuuggaaa

SEQ ID NO: 916199 - RNA, 19 nt, Homo sapiens
aaauuucucucgggaauaa

SEQ ID NO: 916200 - RNA, 19 nt, Homo sapiens
guaaucagcuguguauucu

SEQ ID NO: 916201 - RNA, 19 nt, Homo sapiens
cuaggccucuguuucuuua

SEQ ID NO: 916202 - RNA, 19 nt, Homo sapiens
ggagccagcugaccugcuu

SEQ ID NO: 916203 - RNA, 19 nt, Homo sapiens
ggaggaagugugucaacua

SEQ ID NO: 916204 - RNA, 19 nt, Homo sapiens
gaagcaagaccaaacagau

SEQ ID NO: 916205 - RNA, 19 nt, Homo sapiens
guucagaagcccucacuuu

SEQ ID NO: 916206 - RNA, 19 nt, Homo sapiens
acagauaucuaaacacuac

SEQ ID NO: 916207 - RNA, 19 nt, Homo sapiens
gaagagugagguugucaug

SEQ ID NO: 916208 - RNA, 19 nt, Homo sapiens
agaccaaacagauaucuaa

SEQ ID NO: 916209 - RNA, 19 nt, Homo sapiens
gcauguggaacuucuauau

SEQ ID NO: 916210 - RNA, 19 nt, Homo sapiens
gcaggugaaugugauguuc

SEQ ID NO: 916211 - RNA, 19 nt, Homo sapiens
acagcagacuugauuguga

SEQ ID NO: 916212 - RNA, 19 nt, Homo sapiens
ucaagaagggauauaaguu

SEQ ID NO: 916213 - RNA, 19 nt, Homo sapiens
aagcaagaccaaacagaua

SEQ ID NO: 916214 - RNA, 19 nt, Homo sapiens
caaaacagcagacuugauu

SEQ ID NO: 916215 - RNA, 19 nt, Homo sapiens
gauaucacacagacucaaa

SEQ ID NO: 916216 - RNA, 19 nt, Homo sapiens
ugaaaugggcuugauauuc

SEQ ID NO: 916217 - RNA, 19 nt, Homo sapiens
gauccucugccacggguua

SEQ ID NO: 916218 - RNA, 19 nt, Homo sapiens
ucacacagacucaaagcaa

SEQ ID NO: 916219 - RNA, 19 nt, Homo sapiens
ggacgucugcgcagcaaga

SEQ ID NO: 916220 - RNA, 19 nt, Homo sapiens
aaucagcuguguauucuag

SEQ ID NO: 916221 - RNA, 19 nt, Homo sapiens
gaaucucaguugccaagca

SEQ ID NO: 916222 - RNA, 19 nt, Homo sapiens
gggaaugccguacuuggaa

SEQ ID NO: 916223 - RNA, 19 nt, Homo sapiens
gaccaaacagauaucuaaa

SEQ ID NO: 916224 - RNA, 19 nt, Homo sapiens
cacacagacucaaagcaaa

SEQ ID NO: 916225 - RNA, 19 nt, Homo sapiens
agaaagucccucugcaauu

SEQ ID NO: 916226 - RNA, 19 nt, Homo sapiens
aaagaaagucccucugcaa

SEQ ID NO: 916227 - RNA, 19 nt, Homo sapiens
cuaguaaucagcuguguau

SEQ ID NO: 916228 - RNA, 19 nt, Homo sapiens
uaucgggaaugccguacuu

SEQ ID NO: 916229 - RNA, 19 nt, Homo sapiens
gcuaggccucuguuucuuu

SEQ ID NO: 916230 - RNA, 19 nt, Homo sapiens
caagaagcaagaccaaaca

SEQ ID NO: 916231 - RNA, 19 nt, Homo sapiens
ccaagcagauugauaucac

SEQ ID NO: 916232 - RNA, 19 nt, Homo sapiens
uauaaacucgguagacuuc

SEQ ID NO: 916233 - RNA, 19 nt, Homo sapiens
caaccgauagugcagaaug

SEQ ID NO: 916234 - RNA, 19 nt, Homo sapiens
guuauuuacuuugggcauu

SEQ ID NO: 916235 - RNA, 19 nt, Homo sapiens
guucaugcuugccauucuu

SEQ ID NO: 916236 - RNA, 19 nt, Homo sapiens
ccuugaacaugucauugaa

SEQ ID NO: 916237 - RNA, 19 nt, Homo sapiens
auaaagcuucugugucuaa

SEQ ID NO: 916238 - RNA, 19 nt, Homo sapiens
gaagugugucaacuauuuc

SEQ ID NO: 916239 - RNA, 19 nt, Homo sapiens
caagcagauugauaucaca

SEQ ID NO: 916240 - RNA, 19 nt, Homo sapiens
uaaacucgguagacuucug

SEQ ID NO: 916241 - RNA, 19 nt, Homo sapiens
gaauauaaacucgguagac

SEQ ID NO: 916242 - RNA, 19 nt, Homo sapiens
gaccgaaggauuucugaca

SEQ ID NO: 916243 - RNA, 19 nt, Homo sapiens
caucuuccaccaccuuuga

SEQ ID NO: 916244 - RNA, 19 nt, Homo sapiens
aaacagcagacuugauugu

SEQ ID NO: 916245 - RNA, 19 nt, Homo sapiens
gaauuuugguguugaaagu

SEQ ID NO: 916246 - RNA, 19 nt, Homo sapiens
cauguggaacuucuauauu

SEQ ID NO: 916247 - RNA, 19 nt, Homo sapiens
cagaagcccucacuuuuca

SEQ ID NO: 916248 - RNA, 19 nt, Homo sapiens
cugcuugaccgaaggauuu

SEQ ID NO: 916249 - RNA, 19 nt, Homo sapiens
uguggaacuucuauauuuc

SEQ ID NO: 916250 - RNA, 19 nt, Homo sapiens
ugccguacuuggaaagaaa

SEQ ID NO: 916251 - RNA, 19 nt, Homo sapiens
gagaugaauuuugguguug

SEQ ID NO: 916252 - RNA, 19 nt, Homo sapiens
ugucaacuauuucuuuagg

SEQ ID NO: 916253 - RNA, 19 nt, Homo sapiens
ggauuucaccucacuucug

SEQ ID NO: 916254 - RNA, 19 nt, Homo sapiens
gugaaaugggcuugauauu

SEQ ID NO: 916255 - RNA, 19 nt, Homo sapiens
ucuaccagcuucccaugug

SEQ ID NO: 916256 - RNA, 19 nt, Homo sapiens
cuaccagcuucccauguga

SEQ ID NO: 916257 - RNA, 19 nt, Homo sapiens
ugucauggccucagcuaug

SEQ ID NO: 916258 - RNA, 19 nt, Homo sapiens
caaccacuucuacuacgaa

SEQ ID NO: 916259 - RNA, 19 nt, Homo sapiens
aauauaaacucgguagacu

SEQ ID NO: 916260 - RNA, 19 nt, Homo sapiens
cagacuugauugugacauc

SEQ ID NO: 916261 - RNA, 19 nt, Homo sapiens
gcaagaccaaacagauauc

SEQ ID NO: 916262 - RNA, 19 nt, Homo sapiens
acagaagugucuccuugca

SEQ ID NO: 916263 - RNA, 19 nt, Homo sapiens
aaccgauagugcagaauga

SEQ ID NO: 916264 - RNA, 19 nt, Homo sapiens
gugugucaacuauuucuuu

SEQ ID NO: 916265 - RNA, 19 nt, Homo sapiens
gggaggaagugugucaacu

SEQ ID NO: 916266 - RNA, 19 nt, Homo sapiens
aaaggcauguggaacuucu

SEQ ID NO: 916267 - RNA, 19 nt, Homo sapiens
ccacuucuacuacgaaagg

SEQ ID NO: 916268 - RNA, 19 nt, Homo sapiens
cuacaaccacuucuacuac

SEQ ID NO: 916269 - RNA, 19 nt, Homo sapiens
uaucuaaacacuacaacca

SEQ ID NO: 916270 - RNA, 19 nt, Homo sapiens
aguaaucagcuguguauuc

SEQ ID NO: 916271 - RNA, 19 nt, Homo sapiens
aagaaagucccucugcaau

SEQ ID NO: 916272 - RNA, 19 nt, Homo sapiens
gacuucuggucccuucauu

SEQ ID NO: 916273 - RNA, 19 nt, Homo sapiens
aaacacacacacacacaca

SEQ ID NO: 916274 - RNA, 19 nt, Homo sapiens
ccauucuucugacauucuu

SEQ ID NO: 916275 - RNA, 19 nt, Homo sapiens
cagaauuccuggauuucac

SEQ ID NO: 916276 - RNA, 19 nt, Homo sapiens
aauaaagcuucugugucua

SEQ ID NO: 916277 - RNA, 19 nt, Homo sapiens
gcuccgaagccuauaugug

SEQ ID NO: 916278 - RNA, 19 nt, Homo sapiens
acuacaaccacuucuacua

SEQ ID NO: 916279 - RNA, 19 nt, Homo sapiens
uaaacacuacaaccacuuc

SEQ ID NO: 916280 - RNA, 19 nt, Homo sapiens
gaaugugauguucaugcuu

SEQ ID NO: 916281 - RNA, 19 nt, Homo sapiens
cauagugucugggugaaaa

SEQ ID NO: 916282 - RNA, 19 nt, Homo sapiens
cccaaccgauagugcagaa

SEQ ID NO: 916283 - RNA, 19 nt, Homo sapiens
ugugaaaugggcuugauau

SEQ ID NO: 916284 - RNA, 19 nt, Homo sapiens
ggugaagagugagguuguc

SEQ ID NO: 916285 - RNA, 19 nt, Homo sapiens
uaaagcuucugugucuaag

SEQ ID NO: 916286 - RNA, 19 nt, Homo sapiens
ugagaugaauuuugguguu

SEQ ID NO: 916287 - RNA, 19 nt, Homo sapiens
ggaagugugucaacuauuu

SEQ ID NO: 916288 - RNA, 19 nt, Homo sapiens
gaaagucccucugcaauug

SEQ ID NO: 916289 - RNA, 19 nt, Homo sapiens
ggaaacagcugagcaugaa

SEQ ID NO: 916290 - RNA, 19 nt, Homo sapiens
caagaagggauauaaguua

SEQ ID NO: 916291 - RNA, 19 nt, Homo sapiens
gcagucuuccuuauuauua

SEQ ID NO: 916292 - RNA, 19 nt, Homo sapiens
ggaauggccugcucaugga

SEQ ID NO: 916293 - RNA, 19 nt, Homo sapiens
aaauaaagcuucugugucu

SEQ ID NO: 916294 - RNA, 19 nt, Homo sapiens
gcaauugcauaguucagaa

SEQ ID NO: 916295 - RNA, 19 nt, Homo sapiens
gaggaagugugucaacuau

SEQ ID NO: 916296 - RNA, 19 nt, Homo sapiens
gcaaaggcauguggaacuu

SEQ ID NO: 916297 - RNA, 19 nt, Homo sapiens
ggaauccuguuucucauca

SEQ ID NO: 916298 - RNA, 19 nt, Homo sapiens
ugacugggcugcuggaaug

SEQ ID NO: 916299 - RNA, 19 nt, Homo sapiens
ggaaugccguacuuggaaa

SEQ ID NO: 916300 - RNA, 19 nt, Homo sapiens
acagggagcuacagucaaa

SEQ ID NO: 916301 - RNA, 19 nt, Homo sapiens
aaauuucucucgggaauaa

SEQ ID NO: 916302 - RNA, 19 nt, Homo sapiens
gaaggaagcaagaaagaca

SEQ ID NO: 916303 - RNA, 19 nt, Homo sapiens
caacaccguucgaccauca

SEQ ID NO: 916304 - RNA, 19 nt, Homo sapiens
ggagccagcugaccugcuu

SEQ ID NO: 916305 - RNA, 19 nt, Homo sapiens
ucggcagucuuccuuauua

SEQ ID NO: 916306 - RNA, 19 nt, Homo sapiens
ggaggaagugugucaacua

SEQ ID NO: 916307 - RNA, 19 nt, Homo sapiens
guucagaagcccucacuuu

SEQ ID NO: 916308 - RNA, 19 nt, Homo sapiens
caucaucacucuguacaau

SEQ ID NO: 916309 - RNA, 19 nt, Homo sapiens
gcagauugggaaccuauuu

SEQ ID NO: 916310 - RNA, 19 nt, Homo sapiens
ggaauggcaccacaaagga

SEQ ID NO: 916311 - RNA, 19 nt, Homo sapiens
gaagagugagguugucaug

SEQ ID NO: 916312 - RNA, 19 nt, Homo sapiens
caucuucacccucaucaaa

SEQ ID NO: 916313 - RNA, 19 nt, Homo sapiens
gaaggaaacagcugagcau

SEQ ID NO: 916314 - RNA, 19 nt, Homo sapiens
ucaagaagggauauaaguu

SEQ ID NO: 916315 - RNA, 19 nt, Homo sapiens
ccacaaaggaagagaagga

SEQ ID NO: 916316 - RNA, 19 nt, Homo sapiens
gaaccuauuuggccaacac

SEQ ID NO: 916317 - RNA, 19 nt, Homo sapiens
ccagagagcuacgggaaag

SEQ ID NO: 916318 - RNA, 19 nt, Homo sapiens
ugaaacaaccagagagcua

SEQ ID NO: 916319 - RNA, 19 nt, Homo sapiens
gauaucacacagacucaaa

SEQ ID NO: 916320 - RNA, 19 nt, Homo sapiens
gaagcaagaaagacagguu

SEQ ID NO: 916321 - RNA, 19 nt, Homo sapiens
gcauguagcacgcacuuuc

SEQ ID NO: 916322 - RNA, 19 nt, Homo sapiens
gauccucugccacggguua

SEQ ID NO: 916323 - RNA, 19 nt, Homo sapiens
ucacacagacucaaagcaa

SEQ ID NO: 916324 - RNA, 19 nt, Homo sapiens
ggacgucugcgcagcaaga

SEQ ID NO: 916325 - RNA, 19 nt, Homo sapiens
gaauggcaccacaaaggaa

SEQ ID NO: 916326 - RNA, 19 nt, Homo sapiens
gaaucucaguugccaagca

SEQ ID NO: 916327 - RNA, 19 nt, Homo sapiens
gggaaugccguacuuggaa

SEQ ID NO: 916328 - RNA, 19 nt, Homo sapiens
gcauguggaacuucuuuau

SEQ ID NO: 916329 - RNA, 19 nt, Homo sapiens
cacacagacucaaagcaaa

SEQ ID NO: 916330 - RNA, 19 nt, Homo sapiens
aaacugggagagacgguua

SEQ ID NO: 916331 - RNA, 19 nt, Homo sapiens
ggcacuaccucuucauugg

SEQ ID NO: 916332 - RNA, 19 nt, Homo sapiens
gaacaacuucaugacauuc

SEQ ID NO: 916333 - RNA, 19 nt, Homo sapiens
agaaagucccucugcaauu

SEQ ID NO: 916334 - RNA, 19 nt, Homo sapiens
gcucauggaccggcuuaaa

SEQ ID NO: 916335 - RNA, 19 nt, Homo sapiens
aaacagggagcuacaguca

SEQ ID NO: 916336 - RNA, 19 nt, Homo sapiens
ggccuucacuaguguuugu

SEQ ID NO: 916337 - RNA, 19 nt, Homo sapiens
aaagaaagucccucugcaa

SEQ ID NO: 916338 - RNA, 19 nt, Homo sapiens
gucagcaccuacacaaaug

SEQ ID NO: 916339 - RNA, 19 nt, Homo sapiens
uaucgggaaugccguacuu

SEQ ID NO: 916340 - RNA, 19 nt, Homo sapiens
gcacuuuggcaagcucuuu

SEQ ID NO: 916341 - RNA, 19 nt, Homo sapiens
cgaccaucaucacucugua

SEQ ID NO: 916342 - RNA, 19 nt, Homo sapiens
ccaagcagauugauaucac

SEQ ID NO: 916343 - RNA, 19 nt, Homo sapiens
cagaaggaagcaagaaaga

SEQ ID NO: 916344 - RNA, 19 nt, Homo sapiens
uuaaacagaaguaccagaa

SEQ ID NO: 916345 - RNA, 19 nt, Homo sapiens
aaagugggauuugaagauc

SEQ ID NO: 916346 - RNA, 19 nt, Homo sapiens
gggaauggcaccacaaagg

SEQ ID NO: 916347 - RNA, 19 nt, Homo sapiens
guuauuuacuuugggcauu

SEQ ID NO: 916348 - RNA, 19 nt, Homo sapiens
guucaugcuugccauucuu

SEQ ID NO: 916349 - RNA, 19 nt, Homo sapiens
agacagguuccuccacuuu

SEQ ID NO: 916350 - RNA, 19 nt, Homo sapiens
ugcaguaccuggcauguag

SEQ ID NO: 916351 - RNA, 19 nt, Homo sapiens
gagguucucacucaucuuc

SEQ ID NO: 916352 - RNA, 19 nt, Homo sapiens
uggcuggccuucacuagug

SEQ ID NO: 916353 - RNA, 19 nt, Homo sapiens
auaaagcuucugugucuaa

SEQ ID NO: 916354 - RNA, 19 nt, Homo sapiens
gaagugugucaacuauuuc

SEQ ID NO: 916355 - RNA, 19 nt, Homo sapiens
caagcagauugauaucaca

SEQ ID NO: 916356 - RNA, 19 nt, Homo sapiens
gcuauugggauccagagaa

SEQ ID NO: 916357 - RNA, 19 nt, Homo sapiens
cuauugggauccagagaau

SEQ ID NO: 916358 - RNA, 19 nt, Homo sapiens
gaccgaaggauuucugaca

SEQ ID NO: 916359 - RNA, 19 nt, Homo sapiens
caucuuccaccaccuuuga

SEQ ID NO: 916360 - RNA, 19 nt, Homo sapiens
ggaggacaaagugggauuu

SEQ ID NO: 916361 - RNA, 19 nt, Homo sapiens
gcaccacaaaggaagagaa

SEQ ID NO: 916362 - RNA, 19 nt, Homo sapiens
gaauuuugguguugaaagu

SEQ ID NO: 916363 - RNA, 19 nt, Homo sapiens
cauguggaacuucuuuauu

SEQ ID NO: 916364 - RNA, 19 nt, Homo sapiens
cagaagcccucacuuuuca

SEQ ID NO: 916365 - RNA, 19 nt, Homo sapiens
gcacgagucagcaccuaca

SEQ ID NO: 916366 - RNA, 19 nt, Homo sapiens
gaaacagcugagcaugaaa

SEQ ID NO: 916367 - RNA, 19 nt, Homo sapiens
gguccuucaugaacaacuu

SEQ ID NO: 916368 - RNA, 19 nt, Homo sapiens
ucacuaguguuugucuuca

SEQ ID NO: 916369 - RNA, 19 nt, Homo sapiens
cugcuugaccgaaggauuu

SEQ ID NO: 916370 - RNA, 19 nt, Homo sapiens
uguggaacuucuuuauuuc

SEQ ID NO: 916371 - RNA, 19 nt, Homo sapiens
ugccguacuuggaaagaaa

SEQ ID NO: 916372 - RNA, 19 nt, Homo sapiens
uggaccggcuuaaacagaa

SEQ ID NO: 916373 - RNA, 19 nt, Homo sapiens
ugauacaguuguggcacua

SEQ ID NO: 916374 - RNA, 19 nt, Homo sapiens
caaaggaagagaaggaaac

SEQ ID NO: 916375 - RNA, 19 nt, Homo sapiens
ucaucacucuguacaaugg

SEQ ID NO: 916376 - RNA, 19 nt, Homo sapiens
gagaugaauuuugguguug

SEQ ID NO: 916377 - RNA, 19 nt, Homo sapiens
ugucaacuauuucuuuagg

SEQ ID NO: 916378 - RNA, 19 nt, Homo sapiens
cauccucccucuccaguac

SEQ ID NO: 916379 - RNA, 19 nt, Homo sapiens
cgagucagcaccuacacaa

SEQ ID NO: 916380 - RNA, 19 nt, Homo sapiens
ccucagggccuccuucauc

SEQ ID NO: 916381 - RNA, 19 nt, Homo sapiens
ccucggcagucuuccuuau

SEQ ID NO: 916382 - RNA, 19 nt, Homo sapiens
ugucauggccucagcuaug

SEQ ID NO: 916383 - RNA, 19 nt, Homo sapiens
ccacuccacuucugcucau

SEQ ID NO: 916384 - RNA, 19 nt, Homo sapiens
uuacgugaaugugauguuc

SEQ ID NO: 916385 - RNA, 19 nt, Homo sapiens
cggcagucuuccuuauuau

SEQ ID NO: 916386 - RNA, 19 nt, Homo sapiens
guucgaccaucaucacucu

SEQ ID NO: 916387 - RNA, 19 nt, Homo sapiens
gaaggaaucugaauguuaa

SEQ ID NO: 916388 - RNA, 19 nt, Homo sapiens
gcaagcuacugcagaauua

SEQ ID NO: 916389 - RNA, 19 nt, Homo sapiens
gaaaaucgcucuaaucauu

SEQ ID NO: 916390 - RNA, 19 nt, Homo sapiens
gaaaugcuguuaccuacaa

SEQ ID NO: 916391 - RNA, 19 nt, Homo sapiens
ggaaggaaucugaauguua

SEQ ID NO: 916392 - RNA, 19 nt, Homo sapiens
gggcggaguuuccaagaua

SEQ ID NO: 916393 - RNA, 19 nt, Homo sapiens
gagcccaaauguauauaua

SEQ ID NO: 916394 - RNA, 19 nt, Homo sapiens
gcugauacauaacuacuuu

SEQ ID NO: 916395 - RNA, 19 nt, Homo sapiens
caaaacagguugcaaguaa

SEQ ID NO: 916396 - RNA, 19 nt, Homo sapiens
acacugaucucaaguacaa

SEQ ID NO: 916397 - RNA, 19 nt, Homo sapiens
ggaguaaaauuucccauaa

SEQ ID NO: 916398 - RNA, 19 nt, Homo sapiens
ucaaagaauuggauacuag

SEQ ID NO: 916399 - RNA, 19 nt, Homo sapiens
uagcaaauguaucaccuuu

SEQ ID NO: 916400 - RNA, 19 nt, Homo sapiens
gagaaugggcccucaaaug

SEQ ID NO: 916401 - RNA, 19 nt, Homo sapiens
gaagggaauuuguuagacu

SEQ ID NO: 916402 - RNA, 19 nt, Homo sapiens
caagauaacagcuauugug

SEQ ID NO: 916403 - RNA, 19 nt, Homo sapiens
caaacuaaauacuccacuu

SEQ ID NO: 916404 - RNA, 19 nt, Homo sapiens
gaaaauaccaucagauuag

SEQ ID NO: 916405 - RNA, 19 nt, Homo sapiens
ucucccaacuggccacuua

SEQ ID NO: 916406 - RNA, 19 nt, Homo sapiens
gaaucugaauguuaagcuu

SEQ ID NO: 916407 - RNA, 19 nt, Homo sapiens
ggacuagacuccgcucagu

SEQ ID NO: 916408 - RNA, 19 nt, Homo sapiens
aaaccuacauuuacucaca

SEQ ID NO: 916409 - RNA, 19 nt, Homo sapiens
gcuguugacuuugcaaaug

SEQ ID NO: 916410 - RNA, 19 nt, Homo sapiens
ucagaaaugcuguuaccua

SEQ ID NO: 916411 - RNA, 19 nt, Homo sapiens
gaucucaaguacaaucaca

SEQ ID NO: 916412 - RNA, 19 nt, Homo sapiens
gagagaaugggcccucaaa

SEQ ID NO: 916413 - RNA, 19 nt, Homo sapiens
guaaaaggcugggaguaaa

SEQ ID NO: 916414 - RNA, 19 nt, Homo sapiens
ucccuuaucuguauagaau

SEQ ID NO: 916415 - RNA, 19 nt, Homo sapiens
ccaauggcaggaaucauaa

SEQ ID NO: 916416 - RNA, 19 nt, Homo sapiens
guaguccucccuaaauaaa

SEQ ID NO: 916417 - RNA, 19 nt, Homo sapiens
gccuuucacugccaaacua

SEQ ID NO: 916418 - RNA, 19 nt, Homo sapiens
ggaaaccuacauuuacuca

SEQ ID NO: 916419 - RNA, 19 nt, Homo sapiens
gucaaagaauuggauacua

SEQ ID NO: 916420 - RNA, 19 nt, Homo sapiens
gagaaaaucgcucuaauca

SEQ ID NO: 916421 - RNA, 19 nt, Homo sapiens
guauagaauucggaucaga

SEQ ID NO: 916422 - RNA, 19 nt, Homo sapiens
acagguugcaaguaaauua

SEQ ID NO: 916423 - RNA, 19 nt, Homo sapiens
gaacaggagcagcuauuuu

SEQ ID NO: 916424 - RNA, 19 nt, Homo sapiens
guuaagcuuuagcaaaugu

SEQ ID NO: 916425 - RNA, 19 nt, Homo sapiens
agacaaggaaggaaucuga

SEQ ID NO: 916426 - RNA, 19 nt, Homo sapiens
ggcuaggaauguaauguug

SEQ ID NO: 916427 - RNA, 19 nt, Homo sapiens
uuacucacaugccaaggaa

SEQ ID NO: 916428 - RNA, 19 nt, Homo sapiens
caugugauuucuccuuuua

SEQ ID NO: 916429 - RNA, 19 nt, Homo sapiens
uccaauggcaggaaucaua

SEQ ID NO: 916430 - RNA, 19 nt, Homo sapiens
gagcagcuauuuucacuca

SEQ ID NO: 916431 - RNA, 19 nt, Homo sapiens
cacuuccgcuguugacuuu

SEQ ID NO: 916432 - RNA, 19 nt, Homo sapiens
gguugcaaguaaauuaaga

SEQ ID NO: 916433 - RNA, 19 nt, Homo sapiens
gaagguccuaggagugauu

SEQ ID NO: 916434 - RNA, 19 nt, Homo sapiens
ggcggaguuuccaagauaa

SEQ ID NO: 916435 - RNA, 19 nt, Homo sapiens
aaaucgcucuaaucauuga

SEQ ID NO: 916436 - RNA, 19 nt, Homo sapiens
caaggaaggaaucugaaug

SEQ ID NO: 916437 - RNA, 19 nt, Homo sapiens
gaguaaagcagccagucuu

SEQ ID NO: 916438 - RNA, 19 nt, Homo sapiens
caaauggugcuccugugaa

SEQ ID NO: 916439 - RNA, 19 nt, Homo sapiens
ucaaauggugcuccuguga

SEQ ID NO: 916440 - RNA, 19 nt, Homo sapiens
ggcaagcuacugcagaauu

SEQ ID NO: 916441 - RNA, 19 nt, Homo sapiens
agaaugggcccucaaaugg

SEQ ID NO: 916442 - RNA, 19 nt, Homo sapiens
gaauucggaucagaugucu

SEQ ID NO: 916443 - RNA, 19 nt, Homo sapiens
gugaagggaauuuguuaga

SEQ ID NO: 916444 - RNA, 19 nt, Homo sapiens
ucucaaguacaaucacaua

SEQ ID NO: 916445 - RNA, 19 nt, Homo sapiens
agacuccgcucagugcauu

SEQ ID NO: 916446 - RNA, 19 nt, Homo sapiens
acucaguagucaaagaauu

SEQ ID NO: 916447 - RNA, 19 nt, Homo sapiens
guaucaccuuugucagaaa

SEQ ID NO: 916448 - RNA, 19 nt, Homo sapiens
cauguaguccucccuaaau

SEQ ID NO: 916449 - RNA, 19 nt, Homo sapiens
guagucaaagaauuggaua

SEQ ID NO: 916450 - RNA, 19 nt, Homo sapiens
ccaacuggccacuuaggaa

SEQ ID NO: 916451 - RNA, 19 nt, Homo sapiens
uguaucaccuuugucagaa

SEQ ID NO: 916452 - RNA, 19 nt, Homo sapiens
ucacucaguagucaaagaa

SEQ ID NO: 916453 - RNA, 19 nt, Homo sapiens
aaacagguugcaaguaaau

SEQ ID NO: 916454 - RNA, 19 nt, Homo sapiens
aaauguaucaccuuuguca

SEQ ID NO: 916455 - RNA, 19 nt, Homo sapiens
gcuaggaauguaauguuga

SEQ ID NO: 916456 - RNA, 19 nt, Homo sapiens
gaaugggcccucaaauggu

SEQ ID NO: 916457 - RNA, 19 nt, Homo sapiens
cuagauaccuccgucuucu

SEQ ID NO: 916458 - RNA, 19 nt, Homo sapiens
ccuuaucuguauagaauuc

SEQ ID NO: 916459 - RNA, 19 nt, Homo sapiens
uauccaauccuucccuuau

SEQ ID NO: 916460 - RNA, 19 nt, Homo sapiens
uaucaccuuugucagaaau

SEQ ID NO: 916461 - RNA, 19 nt, Homo sapiens
auguaguccucccuaaaua

SEQ ID NO: 916462 - RNA, 19 nt, Homo sapiens
uuagaaggguggcccaucu

SEQ ID NO: 916463 - RNA, 19 nt, Homo sapiens
cagguugcaaguaaauuaa

SEQ ID NO: 916464 - RNA, 19 nt, Homo sapiens
cauacacugaucucaagua

SEQ ID NO: 916465 - RNA, 19 nt, Homo sapiens
gcacaguggcugccuccau

SEQ ID NO: 916466 - RNA, 19 nt, Homo sapiens
aaauggugcuccugugaag

SEQ ID NO: 916467 - RNA, 19 nt, Homo sapiens
cagccagucuucucuuguc

SEQ ID NO: 916468 - RNA, 19 nt, Homo sapiens
acauaacuacuuugucuug

SEQ ID NO: 916469 - RNA, 19 nt, Homo sapiens
uagaacaggagcagcuauu

SEQ ID NO: 916470 - RNA, 19 nt, Homo sapiens
uauauaacacucagacaag

SEQ ID NO: 916471 - RNA, 19 nt, Homo sapiens
uguaguccucccuaaauaa

SEQ ID NO: 916472 - RNA, 19 nt, Homo sapiens
ccauguaguccucccuaaa

SEQ ID NO: 916473 - RNA, 19 nt, Homo sapiens
agucuucucuugucacagu

SEQ ID NO: 916474 - RNA, 19 nt, Homo sapiens
ccagucuucucuugucaca

SEQ ID NO: 916475 - RNA, 19 nt, Homo sapiens
gacaaggaaggaaucugaa

SEQ ID NO: 916476 - RNA, 19 nt, Homo sapiens
cauaacuacuuugucuugu

SEQ ID NO: 916477 - RNA, 19 nt, Homo sapiens
aaagaccaguagacgaauc

SEQ ID NO: 916478 - RNA, 19 nt, Homo sapiens
cucaugugauuucuccuuu

SEQ ID NO: 916479 - RNA, 19 nt, Homo sapiens
uaaagcagccagucuucuc

SEQ ID NO: 916480 - RNA, 19 nt, Homo sapiens
ggaagguccuaggagugau

SEQ ID NO: 916481 - RNA, 19 nt, Homo sapiens
guagacgaaucaggaaggu

SEQ ID NO: 916482 - RNA, 19 nt, Homo sapiens
cagcuauuguguuuucuuu

SEQ ID NO: 916483 - RNA, 19 nt, Homo sapiens
ccacuuaggaagaguaaaa

SEQ ID NO: 916484 - RNA, 19 nt, Homo sapiens
ucuauuuccuuccgauuac

SEQ ID NO: 916485 - RNA, 19 nt, Homo sapiens
ccugcguacucaugugauu

SEQ ID NO: 916486 - RNA, 19 nt, Homo sapiens
uuuccaagauaacagcuau

SEQ ID NO: 916487 - RNA, 19 nt, Homo sapiens
gaacagaagucaacaggaa

SEQ ID NO: 916488 - RNA, 19 nt, Homo sapiens
gaaacggucuguacauuaa

SEQ ID NO: 916489 - RNA, 19 nt, Homo sapiens
gugagaagcuugcacauua

SEQ ID NO: 916490 - RNA, 19 nt, Homo sapiens
ggacaaacauguaagcaaa

SEQ ID NO: 916491 - RNA, 19 nt, Homo sapiens
gaggagagaugaacccuuu

SEQ ID NO: 916492 - RNA, 19 nt, Homo sapiens
gcaaaucacuguuagaagu

SEQ ID NO: 916493 - RNA, 19 nt, Homo sapiens
gcaaggaccaguaaguuua

SEQ ID NO: 916494 - RNA, 19 nt, Homo sapiens
gaacuggaauuaucuuugu

SEQ ID NO: 916495 - RNA, 19 nt, Homo sapiens
gaaauuaagugggaagaug

SEQ ID NO: 916496 - RNA, 19 nt, Homo sapiens
guacauuaaugccucauaa

SEQ ID NO: 916497 - RNA, 19 nt, Homo sapiens
caauguaccuucucuaaug

SEQ ID NO: 916498 - RNA, 19 nt, Homo sapiens
aaacaaagauuuccuaugc

SEQ ID NO: 916499 - RNA, 19 nt, Homo sapiens
gaagugugcuaaucaccua

SEQ ID NO: 916500 - RNA, 19 nt, Homo sapiens
gcagauugcuguuuagagu

SEQ ID NO: 916501 - RNA, 19 nt, Homo sapiens
ggacaugacugcagauugc

SEQ ID NO: 916502 - RNA, 19 nt, Homo sapiens
gaucuuggauuucacuuuc

SEQ ID NO: 916503 - RNA, 19 nt, Homo sapiens
gaagucaacaggaaauauu

SEQ ID NO: 916504 - RNA, 19 nt, Homo sapiens
gaaccuccgugcuacaaga

SEQ ID NO: 916505 - RNA, 19 nt, Homo sapiens
caggaaauauuaagagaug

SEQ ID NO: 916506 - RNA, 19 nt, Homo sapiens
ggaaaggguuauaguacau

SEQ ID NO: 916507 - RNA, 19 nt, Homo sapiens
aaaguagaauccaaaggua

SEQ ID NO: 916508 - RNA, 19 nt, Homo sapiens
cagcuucccugacuaauuc

SEQ ID NO: 916509 - RNA, 19 nt, Homo sapiens
gacugcagauugcuguuua

SEQ ID NO: 916510 - RNA, 19 nt, Homo sapiens
gauuguugaucuuggauuu

SEQ ID NO: 916511 - RNA, 19 nt, Homo sapiens
gaagaagaaauauggagaa

SEQ ID NO: 916512 - RNA, 19 nt, Homo sapiens
gcaauaggaaugaacagaa

SEQ ID NO: 916513 - RNA, 19 nt, Homo sapiens
gagaaacaauuacaaagcu

SEQ ID NO: 916514 - RNA, 19 nt, Homo sapiens
caaccaaguauacauauga

SEQ ID NO: 916515 - RNA, 19 nt, Homo sapiens
ccacuagaguagcuuugua

SEQ ID NO: 916516 - RNA, 19 nt, Homo sapiens
agauugcuguuuagaguua

SEQ ID NO: 916517 - RNA, 19 nt, Homo sapiens
gggaaaggguuauaguaca

SEQ ID NO: 916518 - RNA, 19 nt, Homo sapiens
ugaaacggucuguacauua

SEQ ID NO: 916519 - RNA, 19 nt, Homo sapiens
ugaagaguuucuaaaguga

SEQ ID NO: 916520 - RNA, 19 nt, Homo sapiens
gaaguugaagaguuucuaa

SEQ ID NO: 916521 - RNA, 19 nt, Homo sapiens
caagaaggaguuuggguuu

SEQ ID NO: 916522 - RNA, 19 nt, Homo sapiens
guaagcaaaucacuguuag

SEQ ID NO: 916523 - RNA, 19 nt, Homo sapiens
gcaaccaaguauacauaug

SEQ ID NO: 916524 - RNA, 19 nt, Homo sapiens
guagagaugaugacacaaa

SEQ ID NO: 916525 - RNA, 19 nt, Homo sapiens
caaaucacuguuagaagua

SEQ ID NO: 916526 - RNA, 19 nt, Homo sapiens
gagaaacuuuauagagcaa

SEQ ID NO: 916527 - RNA, 19 nt, Homo sapiens
gagcaaggaccaguaaguu

SEQ ID NO: 916528 - RNA, 19 nt, Homo sapiens
guuucugucucuaacuuua

SEQ ID NO: 916529 - RNA, 19 nt, Homo sapiens
ggaaugaacagaagucaac

SEQ ID NO: 916530 - RNA, 19 nt, Homo sapiens
caauaggaaugaacagaag

SEQ ID NO: 916531 - RNA, 19 nt, Homo sapiens
gcuugcacauuauuucauu

SEQ ID NO: 916532 - RNA, 19 nt, Homo sapiens
ccauuaggagaaacaauua

SEQ ID NO: 916533 - RNA, 19 nt, Homo sapiens
agaaggaguuuggguuuga

SEQ ID NO: 916534 - RNA, 19 nt, Homo sapiens
ccuaagaaccuccgugcua

SEQ ID NO: 916535 - RNA, 19 nt, Homo sapiens
ggaacuggaauuaucuuug

SEQ ID NO: 916536 - RNA, 19 nt, Homo sapiens
gcaaacaaagauuuccuau

SEQ ID NO: 916537 - RNA, 19 nt, Homo sapiens
ugagaagcuugcacauuau

SEQ ID NO: 916538 - RNA, 19 nt, Homo sapiens
caacugcuacucauuaagu

SEQ ID NO: 916539 - RNA, 19 nt, Homo sapiens
uugaagaguuucuaaagug

SEQ ID NO: 916540 - RNA, 19 nt, Homo sapiens
guugaagaguuucuaaagu

SEQ ID NO: 916541 - RNA, 19 nt, Homo sapiens
gaagcuugcacauuauuuc

SEQ ID NO: 916542 - RNA, 19 nt, Homo sapiens
uuacuuaguuucugucucu

SEQ ID NO: 916543 - RNA, 19 nt, Homo sapiens
uguaagcaaaucacuguua

SEQ ID NO: 916544 - RNA, 19 nt, Homo sapiens
ucucuuaaccuccaauuau

SEQ ID NO: 916545 - RNA, 19 nt, Homo sapiens
ccuggucccucauuuguau

SEQ ID NO: 916546 - RNA, 19 nt, Homo sapiens
gagaagcuugcacauuauu

SEQ ID NO: 916547 - RNA, 19 nt, Homo sapiens
auuaagagaugggaucaaa

SEQ ID NO: 916548 - RNA, 19 nt, Homo sapiens
caacaggaaauauuaagag

SEQ ID NO: 916549 - RNA, 19 nt, Homo sapiens
gaaaggguuauaguacauu

SEQ ID NO: 916550 - RNA, 19 nt, Homo sapiens
gucccucauuuguauguua

SEQ ID NO: 916551 - RNA, 19 nt, Homo sapiens
ggagaaacaauuacaaagc

SEQ ID NO: 916552 - RNA, 19 nt, Homo sapiens
ccuaucaugugcuugcaaa

SEQ ID NO: 916553 - RNA, 19 nt, Homo sapiens
gacuggcuauuuguguuua

SEQ ID NO: 916554 - RNA, 19 nt, Homo sapiens
caauaauguuccuugcaau

SEQ ID NO: 916555 - RNA, 19 nt, Homo sapiens
gaguuuggguuugaccauu

SEQ ID NO: 916556 - RNA, 19 nt, Homo sapiens
gcucccagaugccacuaga

SEQ ID NO: 916557 - RNA, 19 nt, Homo sapiens
gaggcaggaagacugguua

SEQ ID NO: 916558 - RNA, 19 nt, Homo sapiens
cuaaacugcauuucacaaa

SEQ ID NO: 916559 - RNA, 19 nt, Homo sapiens
gauuuccuaugccacuaaa

SEQ ID NO: 916560 - RNA, 19 nt, Homo sapiens
ugaauuagaaguugaagag

SEQ ID NO: 916561 - RNA, 19 nt, Homo sapiens
aagcaaccaaguauacaua

SEQ ID NO: 916562 - RNA, 19 nt, Homo sapiens
gcuauagcuacgauacaua

SEQ ID NO: 916563 - RNA, 19 nt, Homo sapiens
aguuaagacuggcuauuug

SEQ ID NO: 916564 - RNA, 19 nt, Homo sapiens
caaacaaagauuuccuaug

SEQ ID NO: 916565 - RNA, 19 nt, Homo sapiens
aguuuggguuugaccauua

SEQ ID NO: 916566 - RNA, 19 nt, Homo sapiens
uguguuuagugucagaaua

SEQ ID NO: 916567 - RNA, 19 nt, Homo sapiens
gaaguuacuaauucugcaa

SEQ ID NO: 916568 - RNA, 19 nt, Homo sapiens
ggauuucacuuucauuacc

SEQ ID NO: 916569 - RNA, 19 nt, Homo sapiens
aagcaaaucacuguuagaa

SEQ ID NO: 916570 - RNA, 19 nt, Homo sapiens
uccaacugcuacucauuaa

SEQ ID NO: 916571 - RNA, 19 nt, Homo sapiens
ugguagagaugaugacaca

SEQ ID NO: 916572 - RNA, 19 nt, Homo sapiens
gcaggaagacugguuaaaa

SEQ ID NO: 916573 - RNA, 19 nt, Homo sapiens
ucaugugcuugcaaacaaa

SEQ ID NO: 916574 - RNA, 19 nt, Homo sapiens
acaaacauguaagcaaauc

SEQ ID NO: 916575 - RNA, 19 nt, Homo sapiens
gaugaacccuuuugcuuag

SEQ ID NO: 916576 - RNA, 19 nt, Homo sapiens
cuauuuguguuuaguguca

SEQ ID NO: 916577 - RNA, 19 nt, Homo sapiens
cagcaucaaggaucgauug

SEQ ID NO: 916578 - RNA, 19 nt, Homo sapiens
aaaaggggaagaagaaaua

SEQ ID NO: 916579 - RNA, 19 nt, Homo sapiens
gagccagaacuuagauaug

SEQ ID NO: 916580 - RNA, 19 nt, Homo sapiens
gcuuagagccagaacuuag

SEQ ID NO: 916581 - RNA, 19 nt, Homo sapiens
uaacuccaauguaccuucu

SEQ ID NO: 916582 - RNA, 19 nt, Homo sapiens
gaugaugacacaaaaugua

SEQ ID NO: 916583 - RNA, 19 nt, Homo sapiens
cauguaagcaaaucacugu

SEQ ID NO: 916584 - RNA, 19 nt, Homo sapiens
guuccuaagcaaccaagua

SEQ ID NO: 916585 - RNA, 19 nt, Homo sapiens
ccagaugccacuagaguag

SEQ ID NO: 916586 - RNA, 19 nt, Homo sapiens
gcuaaacugcauuucacaa

SEQ ID NO: 916587 - RNA, 19 nt, Homo sapiens
gauaaggucuguuagguua

SEQ ID NO: 916588 - RNA, 19 nt, Homo sapiens
gaagacugaugacugaaua

SEQ ID NO: 916589 - RNA, 19 nt, Homo sapiens
ggagcacaguucaguguua

SEQ ID NO: 916590 - RNA, 19 nt, Homo sapiens
gcacaguucaguguuauua

SEQ ID NO: 916591 - RNA, 19 nt, Homo sapiens
uugcauagcucagaaauuu

SEQ ID NO: 916592 - RNA, 19 nt, Homo sapiens
acaaagggcuuccaaagau

SEQ ID NO: 916593 - RNA, 19 nt, Homo sapiens
gcaggaagaucgcuugagu

SEQ ID NO: 916594 - RNA, 19 nt, Homo sapiens
aaagaaaguugcuguaagu

SEQ ID NO: 916595 - RNA, 19 nt, Homo sapiens
guaaggaagugggaagaaa

SEQ ID NO: 916596 - RNA, 19 nt, Homo sapiens
caaagaaaguugcuguaag

SEQ ID NO: 916597 - RNA, 19 nt, Homo sapiens
gaagaaaaccgaagacuga

SEQ ID NO: 916598 - RNA, 19 nt, Homo sapiens
ugucguugcuccucaauuu

SEQ ID NO: 916599 - RNA, 19 nt, Homo sapiens
acauuuagguugcuacauu

SEQ ID NO: 916600 - RNA, 19 nt, Homo sapiens
ucaguggaauuacacagua

SEQ ID NO: 916601 - RNA, 19 nt, Homo sapiens
ccaaagaucauuauuagca

SEQ ID NO: 916602 - RNA, 19 nt, Homo sapiens
ggagguggcagcaguggua

SEQ ID NO: 916603 - RNA, 19 nt, Homo sapiens
gcauagcucagaaauuuga

SEQ ID NO: 916604 - RNA, 19 nt, Homo sapiens
ccauaacucuguucaucuu

SEQ ID NO: 916605 - RNA, 19 nt, Homo sapiens
gagcacaguucaguguuau

SEQ ID NO: 916606 - RNA, 19 nt, Homo sapiens
uguaguggauuaugucuug

SEQ ID NO: 916607 - RNA, 19 nt, Homo sapiens
uggauuaugucuuguuaga

SEQ ID NO: 916608 - RNA, 19 nt, Homo sapiens
cauuuagguugcuacauuu

SEQ ID NO: 916609 - RNA, 19 nt, Homo sapiens
uaucagaauuuccuuccuu

SEQ ID NO: 916610 - RNA, 19 nt, Homo sapiens
ccaguaaccacuauucuau

SEQ ID NO: 916611 - RNA, 19 nt, Homo sapiens
gaaaauugcccuaauaugg

SEQ ID NO: 916612 - RNA, 19 nt, Homo sapiens
uaauaugggugacuauguc

SEQ ID NO: 916613 - RNA, 19 nt, Homo sapiens
caaagggcuuccaaagauc

SEQ ID NO: 916614 - RNA, 19 nt, Homo sapiens
guucugagauaaguuugaa

SEQ ID NO: 916615 - RNA, 19 nt, Homo sapiens
ggauucauguaauguguag

SEQ ID NO: 916616 - RNA, 19 nt, Homo sapiens
gcucagaaauuugaauacu

SEQ ID NO: 916617 - RNA, 19 nt, Homo sapiens
uaagaagauuaccgaggaa

SEQ ID NO: 916618 - RNA, 19 nt, Homo sapiens
ucgcuugaguccaggauuu

SEQ ID NO: 916619 - RNA, 19 nt, Homo sapiens
gcccuaauaugggugacua

SEQ ID NO: 916620 - RNA, 19 nt, Homo sapiens
gcacauuaugcuaaaguau

SEQ ID NO: 916621 - RNA, 19 nt, Homo sapiens
caucuugaguugauagaag

SEQ ID NO: 916622 - RNA, 19 nt, Homo sapiens
gggcuuccaaagaucauua

SEQ ID NO: 916623 - RNA, 19 nt, Homo sapiens
uaaggucuguuagguuaga

SEQ ID NO: 916624 - RNA, 19 nt, Homo sapiens
acugaugacugaauaagau

SEQ ID NO: 916625 - RNA, 19 nt, Homo sapiens
gaaaucacaacaucuugag

SEQ ID NO: 916626 - RNA, 19 nt, Homo sapiens
uugaagaaaucacaacauc

SEQ ID NO: 916627 - RNA, 19 nt, Homo sapiens
caucuaagugagagaaauu

SEQ ID NO: 916628 - RNA, 19 nt, Homo sapiens
cuucaugucaguggaauua

SEQ ID NO: 916629 - RNA, 19 nt, Homo sapiens
gaaaaccgaagacugauga

SEQ ID NO: 916630 - RNA, 19 nt, Homo sapiens
aguggauuaugucuuguua

SEQ ID NO: 916631 - RNA, 19 nt, Homo sapiens
uacaaagggcuuccaaaga

SEQ ID NO: 916632 - RNA, 19 nt, Homo sapiens
gcucgugcaccauggauga

SEQ ID NO: 916633 - RNA, 19 nt, Homo sapiens
gcugauggacauuuagguu

SEQ ID NO: 916634 - RNA, 19 nt, Homo sapiens
gaagauuaccgaggaaagg

SEQ ID NO: 916635 - RNA, 19 nt, Homo sapiens
ccaucuggcugacaugaag

SEQ ID NO: 916636 - RNA, 19 nt, Homo sapiens
cuauauacuucaugucagu

SEQ ID NO: 916637 - RNA, 19 nt, Homo sapiens
agaaaucacaacaucuuga

SEQ ID NO: 916638 - RNA, 19 nt, Homo sapiens
uggcugacaugaagaacug

SEQ ID NO: 916639 - RNA, 19 nt, Homo sapiens
gguuauuucacuuagcaua

SEQ ID NO: 916640 - RNA, 19 nt, Homo sapiens
accgaagacugaugacuga

SEQ ID NO: 916641 - RNA, 19 nt, Homo sapiens
aaucacaacaucuugaguu

SEQ ID NO: 916642 - RNA, 19 nt, Homo sapiens
uagcaauucuugugguucu

SEQ ID NO: 916643 - RNA, 19 nt, Homo sapiens
cgugcaccauggaugauuu

SEQ ID NO: 916644 - RNA, 19 nt, Homo sapiens
gaaaagugguaaggaagug

SEQ ID NO: 916645 - RNA, 19 nt, Homo sapiens
agugguagccugcaucuga

SEQ ID NO: 916646 - RNA, 19 nt, Homo sapiens
aguauucacugcugaugga

SEQ ID NO: 916647 - RNA, 19 nt, Homo sapiens
uaggauucauguaaugugu

SEQ ID NO: 916648 - RNA, 19 nt, Homo sapiens
gugcaaccauuaccaccau

SEQ ID NO: 916649 - RNA, 19 nt, Homo sapiens
gcaauucuugugguucuga

SEQ ID NO: 916650 - RNA, 19 nt, Homo sapiens
guucgugugacucagcuua

SEQ ID NO: 916651 - RNA, 19 nt, Homo sapiens
cacugcugauggacauuua

SEQ ID NO: 916652 - RNA, 19 nt, Homo sapiens
ccuuaggauucauguaaug

SEQ ID NO: 916653 - RNA, 19 nt, Homo sapiens
uuacaaagggcuuccaaag

SEQ ID NO: 916654 - RNA, 19 nt, Homo sapiens
ccaccauccaucuccauaa

SEQ ID NO: 916655 - RNA, 19 nt, Homo sapiens
gaccgacaauuauguucgu

SEQ ID NO: 916656 - RNA, 19 nt, Homo sapiens
gaucauuauuagcaguaag

SEQ ID NO: 916657 - RNA, 19 nt, Homo sapiens
ccucaucucuuaaaacugu

SEQ ID NO: 916658 - RNA, 19 nt, Homo sapiens
auaauaauccagugaaugg

SEQ ID NO: 916659 - RNA, 19 nt, Homo sapiens
guggaauuacacaguauuu

SEQ ID NO: 916660 - RNA, 19 nt, Homo sapiens
cauaacucuguucaucuua

SEQ ID NO: 916661 - RNA, 19 nt, Homo sapiens
ggacauuuagguugcuaca

SEQ ID NO: 916662 - RNA, 19 nt, Homo sapiens
caguggaauuacacaguau

SEQ ID NO: 916663 - RNA, 19 nt, Homo sapiens
ucaugucaguggaauuaca

SEQ ID NO: 916664 - RNA, 19 nt, Homo sapiens
cuccauaacucuguucauc

SEQ ID NO: 916665 - RNA, 19 nt, Homo sapiens
gguaaggaagugggaagaa

SEQ ID NO: 916666 - RNA, 19 nt, Homo sapiens
cgaagacugaugacugaau

SEQ ID NO: 916667 - RNA, 19 nt, Homo sapiens
gauuaccgaggaaaggaaa

SEQ ID NO: 916668 - RNA, 19 nt, Homo sapiens
gaggaaaggaaaaguggua

SEQ ID NO: 916669 - RNA, 19 nt, Homo sapiens
cagcuaugcaagagguuaa

SEQ ID NO: 916670 - RNA, 19 nt, Homo sapiens
gcuggguuauuucacuuag

SEQ ID NO: 916671 - RNA, 19 nt, Homo sapiens
cccaguaaccacuauucua

SEQ ID NO: 916672 - RNA, 19 nt, Homo sapiens
caccauccaucuccauaac

SEQ ID NO: 916673 - RNA, 19 nt, Homo sapiens
gugguucugagauaaguuu

SEQ ID NO: 916674 - RNA, 19 nt, Homo sapiens
gacaauuauguucguguga

SEQ ID NO: 916675 - RNA, 19 nt, Homo sapiens
gaccucaucucuuaaaacu

SEQ ID NO: 916676 - RNA, 19 nt, Homo sapiens
caguaaccacuauucuauu

SEQ ID NO: 916677 - RNA, 19 nt, Homo sapiens
ccauccaucuccauaacuc

SEQ ID NO: 916678 - RNA, 19 nt, Homo sapiens
aaaguugcuguaaguggua

SEQ ID NO: 916679 - RNA, 19 nt, Homo sapiens
cuaauaugggugacuaugu

SEQ ID NO: 916680 - RNA, 19 nt, Homo sapiens
ggauuaugucuuguuagaa

SEQ ID NO: 916681 - RNA, 19 nt, Homo sapiens
gacugaugacugaauaaga

SEQ ID NO: 916682 - RNA, 19 nt, Homo sapiens
cccuuggguuuauuuagaa

SEQ ID NO: 916683 - RNA, 19 nt, Homo sapiens
ucugagauaaguuugaaga

SEQ ID NO: 916684 - RNA, 19 nt, Homo sapiens
ggucuguuagguuagauau

SEQ ID NO: 916685 - RNA, 19 nt, Homo sapiens
ccagcuaugcaagagguua

SEQ ID NO: 916686 - RNA, 19 nt, Homo sapiens
ucacugcugauggacauuu

SEQ ID NO: 916687 - RNA, 19 nt, Homo sapiens
gaacauaucucaaggaaac

SEQ ID NO: 916688 - RNA, 19 nt, Homo sapiens
gagaaaaccuugaacauua

SEQ ID NO: 916689 - RNA, 19 nt, Homo sapiens
caaaccaucuacuaucuaa

SEQ ID NO: 916690 - RNA, 19 nt, Homo sapiens
caaauaaagucucagaauc

SEQ ID NO: 916691 - RNA, 19 nt, Homo sapiens
aggaaugacuaccuuauua

SEQ ID NO: 916692 - RNA, 19 nt, Homo sapiens
ugaaauaaguccuuuguag

SEQ ID NO: 916693 - RNA, 19 nt, Homo sapiens
caaggaaaccuaagagaaa

SEQ ID NO: 916694 - RNA, 19 nt, Homo sapiens
gcaaugacaauaaagguaa

SEQ ID NO: 916695 - RNA, 19 nt, Homo sapiens
gcaaauaaagucucagaau

SEQ ID NO: 916696 - RNA, 19 nt, Homo sapiens
guacaguugucccuuggua

SEQ ID NO: 916697 - RNA, 19 nt, Homo sapiens
ggaaugacuaccuuauuaa

SEQ ID NO: 916698 - RNA, 19 nt, Homo sapiens
gcacuacaguacaucuuug

SEQ ID NO: 916699 - RNA, 19 nt, Homo sapiens
guaaauaaguacaguuguc

SEQ ID NO: 916700 - RNA, 19 nt, Homo sapiens
gcaauagacuccugcaaaa

SEQ ID NO: 916701 - RNA, 19 nt, Homo sapiens
gaaauaaguccuuuguagu

SEQ ID NO: 916702 - RNA, 19 nt, Homo sapiens
gcaacaaaccaucuacuau

SEQ ID NO: 916703 - RNA, 19 nt, Homo sapiens
uuaggacucucccuguuua

SEQ ID NO: 916704 - RNA, 19 nt, Homo sapiens
gcaugugauucuccuguuu

SEQ ID NO: 916705 - RNA, 19 nt, Homo sapiens
cagaguacauggauacaga

SEQ ID NO: 916706 - RNA, 19 nt, Homo sapiens
uaaguuagccagccaauca

SEQ ID NO: 916707 - RNA, 19 nt, Homo sapiens
cauaacaguucuauuugga

SEQ ID NO: 916708 - RNA, 19 nt, Homo sapiens
cauaacgguucauuccuuu

SEQ ID NO: 916709 - RNA, 19 nt, Homo sapiens
caacaaaccaucuacuauc

SEQ ID NO: 916710 - RNA, 19 nt, Homo sapiens
ucaaauagcacuacaguac

SEQ ID NO: 916711 - RNA, 19 nt, Homo sapiens
aaguauggcaggauaauua

SEQ ID NO: 916712 - RNA, 19 nt, Homo sapiens
uaacaguucuagcaugcaa

SEQ ID NO: 916713 - RNA, 19 nt, Homo sapiens
acuaauaccuaaugcaaug

SEQ ID NO: 916714 - RNA, 19 nt, Homo sapiens
gauaauuacccaccuguuc

SEQ ID NO: 916715 - RNA, 19 nt, Homo sapiens
gaaaguucucaguuuauga

SEQ ID NO: 916716 - RNA, 19 nt, Homo sapiens
ucaagucccuuacauaaaa

SEQ ID NO: 916717 - RNA, 19 nt, Homo sapiens
gaucugcaauugguuuaau

SEQ ID NO: 916718 - RNA, 19 nt, Homo sapiens
cauaagaagcuugcaauga

SEQ ID NO: 916719 - RNA, 19 nt, Homo sapiens
caacaauacuaacaguucu

SEQ ID NO: 916720 - RNA, 19 nt, Homo sapiens
cuuuaucccuagacuaaua

SEQ ID NO: 916721 - RNA, 19 nt, Homo sapiens
cuacaggaaugacuaccuu

SEQ ID NO: 916722 - RNA, 19 nt, Homo sapiens
ggaaugauacccacaacuc

SEQ ID NO: 916723 - RNA, 19 nt, Homo sapiens
caacgcacauccgccugua

SEQ ID NO: 916724 - RNA, 19 nt, Homo sapiens
ucaaggaaaccuaagagaa

SEQ ID NO: 916725 - RNA, 19 nt, Homo sapiens
gaugcagaguacauggaua

SEQ ID NO: 916726 - RNA, 19 nt, Homo sapiens
uaagaagcuugcaaugaca

SEQ ID NO: 916727 - RNA, 19 nt, Homo sapiens
ccuauaaaguuuccauaag

SEQ ID NO: 916728 - RNA, 19 nt, Homo sapiens
caacucuacaagcaucuua

SEQ ID NO: 916729 - RNA, 19 nt, Homo sapiens
uaguaucacuuacgcaaau

SEQ ID NO: 916730 - RNA, 19 nt, Homo sapiens
acucaagucccuuacauaa

SEQ ID NO: 916731 - RNA, 19 nt, Homo sapiens
acaguucuauuuggaauga

SEQ ID NO: 916732 - RNA, 19 nt, Homo sapiens
gaaacauaacgguucauuc

SEQ ID NO: 916733 - RNA, 19 nt, Homo sapiens
auaagaagcuugcaaugac

SEQ ID NO: 916734 - RNA, 19 nt, Homo sapiens
caaaggcaaauaugaagga

SEQ ID NO: 916735 - RNA, 19 nt, Homo sapiens
acagaugaguucuugacaa

SEQ ID NO: 916736 - RNA, 19 nt, Homo sapiens
uacaguacaucuuugacaa

SEQ ID NO: 916737 - RNA, 19 nt, Homo sapiens
acauaacgguucauuccuu

SEQ ID NO: 916738 - RNA, 19 nt, Homo sapiens
ccacuauauuuaaguaugg

SEQ ID NO: 916739 - RNA, 19 nt, Homo sapiens
guaaaccauuaucuugcuu

SEQ ID NO: 916740 - RNA, 19 nt, Homo sapiens
ggagaaaaccuugaacauu

SEQ ID NO: 916741 - RNA, 19 nt, Homo sapiens
aaaaucaccugugguaaaa

SEQ ID NO: 916742 - RNA, 19 nt, Homo sapiens
aggaacauaucucaaggaa

SEQ ID NO: 916743 - RNA, 19 nt, Homo sapiens
gcaaauucuguaaaccauu

SEQ ID NO: 916744 - RNA, 19 nt, Homo sapiens
ccuugaacauuauuggaaa

SEQ ID NO: 916745 - RNA, 19 nt, Homo sapiens
cuuaaacacacacacauuu

SEQ ID NO: 916746 - RNA, 19 nt, Homo sapiens
aaauagcacuacaguacau

SEQ ID NO: 916747 - RNA, 19 nt, Homo sapiens
gaagcuugcaaugacaaua

SEQ ID NO: 916748 - RNA, 19 nt, Homo sapiens
uuagaaacauaacgguuca

SEQ ID NO: 916749 - RNA, 19 nt, Homo sapiens
uuuaacagaugaguucuug

SEQ ID NO: 916750 - RNA, 19 nt, Homo sapiens
uaaagucucagaaucauac

SEQ ID NO: 916751 - RNA, 19 nt, Homo sapiens
uuacagguacuucaaauag

SEQ ID NO: 916752 - RNA, 19 nt, Homo sapiens
ucaacaauacuaacaguuc

SEQ ID NO: 916753 - RNA, 19 nt, Homo sapiens
ucauaacaguucuauuugg

SEQ ID NO: 916754 - RNA, 19 nt, Homo sapiens
cuacaucacuggguauuuu

SEQ ID NO: 916755 - RNA, 19 nt, Homo sapiens
caggcacacuucuacauca

SEQ ID NO: 916756 - RNA, 19 nt, Homo sapiens
cauacaagcacaacacugu

SEQ ID NO: 916757 - RNA, 19 nt, Homo sapiens
guguaaagcaaauucugua

SEQ ID NO: 916758 - RNA, 19 nt, Homo sapiens
guuaggacucucccuguuu

SEQ ID NO: 916759 - RNA, 19 nt, Homo sapiens
caugaaaccaaaguaauug

SEQ ID NO: 916760 - RNA, 19 nt, Homo sapiens
agacuaauaccuaaugcaa

SEQ ID NO: 916761 - RNA, 19 nt, Homo sapiens
ucuuaucccucuacaggaa

SEQ ID NO: 916762 - RNA, 19 nt, Homo sapiens
uggaaucacucaaacaaaa

SEQ ID NO: 916763 - RNA, 19 nt, Homo sapiens
uaauaaacaggcacacuuc

SEQ ID NO: 916764 - RNA, 19 nt, Homo sapiens
uuacgcaaauaaagucuca

SEQ ID NO: 916765 - RNA, 19 nt, Homo sapiens
caaauagcacuacaguaca

SEQ ID NO: 916766 - RNA, 19 nt, Homo sapiens
guuacagguacuucaaaua

SEQ ID NO: 916767 - RNA, 19 nt, Homo sapiens
ucccuagacuaauaccuaa

SEQ ID NO: 916768 - RNA, 19 nt, Homo sapiens
uacuuuaucccuagacuaa

SEQ ID NO: 916769 - RNA, 19 nt, Homo sapiens
ccaccuacuucccuuaaac

SEQ ID NO: 916770 - RNA, 19 nt, Homo sapiens
caggaaugacuaccuuauu

SEQ ID NO: 916771 - RNA, 19 nt, Homo sapiens
cauguuucaucucuguaaa

SEQ ID NO: 916772 - RNA, 19 nt, Homo sapiens
guucauuuauccacauucu

SEQ ID NO: 916773 - RNA, 19 nt, Homo sapiens
acagguacuucaaauagca

SEQ ID NO: 916774 - RNA, 19 nt, Homo sapiens
aacaaaccaucuacuaucu

SEQ ID NO: 916775 - RNA, 19 nt, Homo sapiens
ccacagaugcagaguacau

SEQ ID NO: 916776 - RNA, 19 nt, Homo sapiens
aagcuugcaaugacaauaa

SEQ ID NO: 916777 - RNA, 19 nt, Homo sapiens
aaacauaacgguucauucc

SEQ ID NO: 916778 - RNA, 19 nt, Homo sapiens
ccaaucaaacuacuucagu

SEQ ID NO: 916779 - RNA, 19 nt, Homo sapiens
guucucaguuuaugaugca

SEQ ID NO: 916780 - RNA, 19 nt, Homo sapiens
ugucauguuucaucucugu

SEQ ID NO: 916781 - RNA, 19 nt, Homo sapiens
uuacucagacugucauguu

SEQ ID NO: 916782 - RNA, 19 nt, Homo sapiens
gaaugauacccacaacucu

SEQ ID NO: 916783 - RNA, 19 nt, Homo sapiens
uaaacaggcacacuucuac

SEQ ID NO: 916784 - RNA, 19 nt, Homo sapiens
gcaugcaacaaaccaucua

SEQ ID NO: 916785 - RNA, 19 nt, Homo sapiens
acauccgccuguauacuuu

SEQ ID NO: 916786 - RNA, 19 nt, Homo sapiens
acgcacauccgccuguaua

SEQ ID NO: 916787 - RNA, 19 nt, Homo sapiens
gaacugaucucaugaugca

SEQ ID NO: 916788 - RNA, 19 nt, Homo sapiens
caggaagacugaaguguua

SEQ ID NO: 916789 - RNA, 19 nt, Homo sapiens
ugaggcaucuuguguaaua

SEQ ID NO: 916790 - RNA, 19 nt, Homo sapiens
gcauguauuuggaguagua

SEQ ID NO: 916791 - RNA, 19 nt, Homo sapiens
ggagagguuugaauuagaa

SEQ ID NO: 916792 - RNA, 19 nt, Homo sapiens
guaaagguaugucucaaug

SEQ ID NO: 916793 - RNA, 19 nt, Homo sapiens
caccaugccuggcuaauuu

SEQ ID NO: 916794 - RNA, 19 nt, Homo sapiens
gaagguacguuagcacuau

SEQ ID NO: 916795 - RNA, 19 nt, Homo sapiens
uaagguggcuaguauaaga

SEQ ID NO: 916796 - RNA, 19 nt, Homo sapiens
uaacaguucuaucucguuu

SEQ ID NO: 916797 - RNA, 19 nt, Homo sapiens
ggagaacucauagugauua

SEQ ID NO: 916798 - RNA, 19 nt, Homo sapiens
ccaagcagcugggauugua

SEQ ID NO: 916799 - RNA, 19 nt, Homo sapiens
gacagaagaggaagaauuu

SEQ ID NO: 916800 - RNA, 19 nt, Homo sapiens
gaccagauauucaaguuca

SEQ ID NO: 916801 - RNA, 19 nt, Homo sapiens
gaggaagcauuguagaaga

SEQ ID NO: 916802 - RNA, 19 nt, Homo sapiens
caccacgccuggcuaauuu

SEQ ID NO: 916803 - RNA, 19 nt, Homo sapiens
gauauuagaccuuucuuag

SEQ ID NO: 916804 - RNA, 19 nt, Homo sapiens
uuagagaaguagcugauuu

SEQ ID NO: 916805 - RNA, 19 nt, Homo sapiens
uagcagagaagguacguua

SEQ ID NO: 916806 - RNA, 19 nt, Homo sapiens
ccaagagacuagcagagaa

SEQ ID NO: 916807 - RNA, 19 nt, Homo sapiens
ggaggucaguggagagguu

SEQ ID NO: 916808 - RNA, 19 nt, Homo sapiens
gccauguacuauaagguua

SEQ ID NO: 916809 - RNA, 19 nt, Homo sapiens
cgaaucaguugcuuugugu

SEQ ID NO: 916810 - RNA, 19 nt, Homo sapiens
uuaaugaacuacugagugu

SEQ ID NO: 916811 - RNA, 19 nt, Homo sapiens
ggauauuagaccuuucuua

SEQ ID NO: 916812 - RNA, 19 nt, Homo sapiens
aaagguaugucucaaugga

SEQ ID NO: 916813 - RNA, 19 nt, Homo sapiens
ccaaagugcugggaucugu

SEQ ID NO: 916814 - RNA, 19 nt, Homo sapiens
aaaauaagguggcuaguau

SEQ ID NO: 916815 - RNA, 19 nt, Homo sapiens
gaacucauagugauuaguc

SEQ ID NO: 916816 - RNA, 19 nt, Homo sapiens
aagcaauucucgugccuaa

SEQ ID NO: 916817 - RNA, 19 nt, Homo sapiens
ggcaucuuguguaauauaa

SEQ ID NO: 916818 - RNA, 19 nt, Homo sapiens
gagacuagcagagaaggua

SEQ ID NO: 916819 - RNA, 19 nt, Homo sapiens
ggagugcaguggcaugauc

SEQ ID NO: 916820 - RNA, 19 nt, Homo sapiens
acauuuagcuugccagaca

SEQ ID NO: 916821 - RNA, 19 nt, Homo sapiens
gaacuacugaguguuaaga

SEQ ID NO: 916822 - RNA, 19 nt, Homo sapiens
ccaaagugcugggauuaca

SEQ ID NO: 916823 - RNA, 19 nt, Homo sapiens
gcaguaggauuuuaaagga

SEQ ID NO: 916824 - RNA, 19 nt, Homo sapiens
ccacuuacaggaagacuga

SEQ ID NO: 916825 - RNA, 19 nt, Homo sapiens
aaugaacuacugaguguua

SEQ ID NO: 916826 - RNA, 19 nt, Homo sapiens
guggagagguuugaauuag

SEQ ID NO: 916827 - RNA, 19 nt, Homo sapiens
gaagacugaaguguuaauu

SEQ ID NO: 916828 - RNA, 19 nt, Homo sapiens
uaagguaacaguucuaucu

SEQ ID NO: 916829 - RNA, 19 nt, Homo sapiens
agacagaagaggaagaauu

SEQ ID NO: 916830 - RNA, 19 nt, Homo sapiens
ggcauuguccaucucuuua

SEQ ID NO: 916831 - RNA, 19 nt, Homo sapiens
gcuuuguguuuguuucuuu

SEQ ID NO: 916832 - RNA, 19 nt, Homo sapiens
ucacgaaucaguugcuuug

SEQ ID NO: 916833 - RNA, 19 nt, Homo sapiens
uuauaaagcacuccucuug

SEQ ID NO: 916834 - RNA, 19 nt, Homo sapiens
agggagagcuuuugauuuu

SEQ ID NO: 916835 - RNA, 19 nt, Homo sapiens
aauaagguggcuaguauaa

SEQ ID NO: 916836 - RNA, 19 nt, Homo sapiens
gcauuguccaucucuuuaa

SEQ ID NO: 916837 - RNA, 19 nt, Homo sapiens
cagccauaauagugaauuu

SEQ ID NO: 916838 - RNA, 19 nt, Homo sapiens
cgaugucugucuuuagaga

SEQ ID NO: 916839 - RNA, 19 nt, Homo sapiens
uaacaccuucuucugguaa

SEQ ID NO: 916840 - RNA, 19 nt, Homo sapiens
uuucuuagaugcauagcuu

SEQ ID NO: 916841 - RNA, 19 nt, Homo sapiens
uuagaagcauguauuugga

SEQ ID NO: 916842 - RNA, 19 nt, Homo sapiens
uuugaggcaucuuguguaa

SEQ ID NO: 916843 - RNA, 19 nt, Homo sapiens
caauggagaacucauagug

SEQ ID NO: 916844 - RNA, 19 nt, Homo sapiens
guccaucucuuuaaugaac

SEQ ID NO: 916845 - RNA, 19 nt, Homo sapiens
gauuaaccacuuacaggaa

SEQ ID NO: 916846 - RNA, 19 nt, Homo sapiens
gaccauucaagaccagaua

SEQ ID NO: 916847 - RNA, 19 nt, Homo sapiens
gagaacucauagugauuag

SEQ ID NO: 916848 - RNA, 19 nt, Homo sapiens
ccaccacgccuggcuaauu

SEQ ID NO: 916849 - RNA, 19 nt, Homo sapiens
guacacauaacaccuucuu

SEQ ID NO: 916850 - RNA, 19 nt, Homo sapiens
ucaaacuccugaccuuaag

SEQ ID NO: 916851 - RNA, 19 nt, Homo sapiens
gaagcauguauuuggagua

SEQ ID NO: 916852 - RNA, 19 nt, Homo sapiens
auaaagcacuccucuugag

SEQ ID NO: 916853 - RNA, 19 nt, Homo sapiens
aagaccagauauucaaguu

SEQ ID NO: 916854 - RNA, 19 nt, Homo sapiens
gaccuuucuuagaugcaua

SEQ ID NO: 916855 - RNA, 19 nt, Homo sapiens
cagaagaggaagaauuuua

SEQ ID NO: 916856 - RNA, 19 nt, Homo sapiens
ugccuaagccucccgagua

SEQ ID NO: 916857 - RNA, 19 nt, Homo sapiens
uggagagguuugaauuaga

SEQ ID NO: 916858 - RNA, 19 nt, Homo sapiens
uaucucagccauaauagug

SEQ ID NO: 916859 - RNA, 19 nt, Homo sapiens
uauaaagcacuccucuuga

SEQ ID NO: 916860 - RNA, 19 nt, Homo sapiens
gccaagagacuagcagaga

SEQ ID NO: 916861 - RNA, 19 nt, Homo sapiens
gguaaagguaugucucaau

SEQ ID NO: 916862 - RNA, 19 nt, Homo sapiens
gcaauucucgugccuaagc

SEQ ID NO: 916863 - RNA, 19 nt, Homo sapiens
cuacugaguguuaagaaga

SEQ ID NO: 916864 - RNA, 19 nt, Homo sapiens
ggaagacugaaguguuaau

SEQ ID NO: 916865 - RNA, 19 nt, Homo sapiens
gcuaguauaagaggaagaa

SEQ ID NO: 916866 - RNA, 19 nt, Homo sapiens
ucaguugcuuuguguuugu

SEQ ID NO: 916867 - RNA, 19 nt, Homo sapiens
cagagaagguacguuagca

SEQ ID NO: 916868 - RNA, 19 nt, Homo sapiens
guuucgaugucugucuuua

SEQ ID NO: 916869 - RNA, 19 nt, Homo sapiens
uaguagagaugggguuuua

SEQ ID NO: 916870 - RNA, 19 nt, Homo sapiens
aaauaagguggcuaguaua

SEQ ID NO: 916871 - RNA, 19 nt, Homo sapiens
uagaggaagcauuguagaa

SEQ ID NO: 916872 - RNA, 19 nt, Homo sapiens
uguggauucuuuauuggaa

SEQ ID NO: 916873 - RNA, 19 nt, Homo sapiens
cauagugauuagucuuugu

SEQ ID NO: 916874 - RNA, 19 nt, Homo sapiens
aaucaguugcuuuguguuu

SEQ ID NO: 916875 - RNA, 19 nt, Homo sapiens
gccuaagccucccgaguag

SEQ ID NO: 916876 - RNA, 19 nt, Homo sapiens
cauuguccaucucuuuaau

SEQ ID NO: 916877 - RNA, 19 nt, Homo sapiens
acaggaagacugaaguguu

SEQ ID NO: 916878 - RNA, 19 nt, Homo sapiens
cucuugagcugacauuguu

SEQ ID NO: 916879 - RNA, 19 nt, Homo sapiens
guggauucuuuauuggaaa

SEQ ID NO: 916880 - RNA, 19 nt, Homo sapiens
ucauagugauuagucuuug

SEQ ID NO: 916881 - RNA, 19 nt, Homo sapiens
acacauaacaccuucuucu

SEQ ID NO: 916882 - RNA, 19 nt, Homo sapiens
uauuuagguuguagggaaa

SEQ ID NO: 916883 - RNA, 19 nt, Homo sapiens
auaacaccuucuucuggua

SEQ ID NO: 916884 - RNA, 19 nt, Homo sapiens
gccuuagccucccaaagug

SEQ ID NO: 916885 - RNA, 19 nt, Homo sapiens
ccaccaugccuggcuaauu

SEQ ID NO: 916886 - RNA, 19 nt, Homo sapiens
ccagacagaagaggaagaa

SEQ ID NO: 916887 - RNA, 19 nt, Homo sapiens
gaucuaaucuguaguaaug

SEQ ID NO: 916888 - RNA, 19 nt, Homo sapiens
gcaacuagauucuucagua

SEQ ID NO: 916889 - RNA, 19 nt, Homo sapiens
ucaaagaacugaugaagaa

SEQ ID NO: 916890 - RNA, 19 nt, Homo sapiens
gcacagaauucuucagauu

SEQ ID NO: 916891 - RNA, 19 nt, Homo sapiens
gcauagagccugugcuuua

SEQ ID NO: 916892 - RNA, 19 nt, Homo sapiens
gaaaggugcugauugucua

SEQ ID NO: 916893 - RNA, 19 nt, Homo sapiens
gaaacuuacuuaaccauug

SEQ ID NO: 916894 - RNA, 19 nt, Homo sapiens
gaacuuugcuagaacaaga

SEQ ID NO: 916895 - RNA, 19 nt, Homo sapiens
acaagacccuguaguaaua

SEQ ID NO: 916896 - RNA, 19 nt, Homo sapiens
gaacaagacccuguaguaa

SEQ ID NO: 916897 - RNA, 19 nt, Homo sapiens
cagaagaggugcaagaauu

SEQ ID NO: 916898 - RNA, 19 nt, Homo sapiens
ccacagaucuauaccacua

SEQ ID NO: 916899 - RNA, 19 nt, Homo sapiens
gaagauacauuuagagaac

SEQ ID NO: 916900 - RNA, 19 nt, Homo sapiens
ugaagaagauggagaagaa

SEQ ID NO: 916901 - RNA, 19 nt, Homo sapiens
guaaucagccaauguauuu

SEQ ID NO: 916902 - RNA, 19 nt, Homo sapiens
ccaaagagcugugacauca

SEQ ID NO: 916903 - RNA, 19 nt, Homo sapiens
ccagagcacuugccaauga

SEQ ID NO: 916904 - RNA, 19 nt, Homo sapiens
gaggaaaggugcugauugu

SEQ ID NO: 916905 - RNA, 19 nt, Homo sapiens
gagaaagcccaacauauuu

SEQ ID NO: 916906 - RNA, 19 nt, Homo sapiens
cgucgaaguuguaggauua

SEQ ID NO: 916907 - RNA, 19 nt, Homo sapiens
guacagaacacuuacauga

SEQ ID NO: 916908 - RNA, 19 nt, Homo sapiens
gagaacagcaccaaguaua

SEQ ID NO: 916909 - RNA, 19 nt, Homo sapiens
gcagaauucagaacaaaua

SEQ ID NO: 916910 - RNA, 19 nt, Homo sapiens
cugaugagguuccugauua

SEQ ID NO: 916911 - RNA, 19 nt, Homo sapiens
gcuucuagcucucagauaa

SEQ ID NO: 916912 - RNA, 19 nt, Homo sapiens
aagaagaacuugaugaaga

SEQ ID NO: 916913 - RNA, 19 nt, Homo sapiens
ccaagaauauugauaguag

SEQ ID NO: 916914 - RNA, 19 nt, Homo sapiens
gagagaacuugaagacuug

SEQ ID NO: 916915 - RNA, 19 nt, Homo sapiens
gaauagaaaugcuuguuac

SEQ ID NO: 916916 - RNA, 19 nt, Homo sapiens
ccaaaccacuggacacauu

SEQ ID NO: 916917 - RNA, 19 nt, Homo sapiens
cccaagagguuguuuguuu

SEQ ID NO: 916918 - RNA, 19 nt, Homo sapiens
uuggaucucucuucaauua

SEQ ID NO: 916919 - RNA, 19 nt, Homo sapiens
uaacacugcugaagcugua

SEQ ID NO: 916920 - RNA, 19 nt, Homo sapiens
gcacagagaagacaaagug

SEQ ID NO: 916921 - RNA, 19 nt, Homo sapiens
gcaguaaucagccaaugua

SEQ ID NO: 916922 - RNA, 19 nt, Homo sapiens
guaguaaugccuuagaaua

SEQ ID NO: 916923 - RNA, 19 nt, Homo sapiens
ugagagaacuugaagacuu

SEQ ID NO: 916924 - RNA, 19 nt, Homo sapiens
ucaggaaucuagaaagaaa

SEQ ID NO: 916925 - RNA, 19 nt, Homo sapiens
gcagcucugugaagaaauu

SEQ ID NO: 916926 - RNA, 19 nt, Homo sapiens
caauggaccuuucaucugu

SEQ ID NO: 916927 - RNA, 19 nt, Homo sapiens
ugagaagaauguggaaaua

SEQ ID NO: 916928 - RNA, 19 nt, Homo sapiens
ccuaauugauguaguauga

SEQ ID NO: 916929 - RNA, 19 nt, Homo sapiens
agagaaagcccaacauauu

SEQ ID NO: 916930 - RNA, 19 nt, Homo sapiens
ggccaacucuuaauaaagu

SEQ ID NO: 916931 - RNA, 19 nt, Homo sapiens
gcucucagauaauacauau

SEQ ID NO: 916932 - RNA, 19 nt, Homo sapiens
gaaagacuauuugagagau

SEQ ID NO: 916933 - RNA, 19 nt, Homo sapiens
acaaguaucugacugugaa

SEQ ID NO: 916934 - RNA, 19 nt, Homo sapiens
gcaguuggaucucucuuca

SEQ ID NO: 916935 - RNA, 19 nt, Homo sapiens
gcuuuaagaucuuugagaa

SEQ ID NO: 916936 - RNA, 19 nt, Homo sapiens
gcaccacaauucuguacuu

SEQ ID NO: 916937 - RNA, 19 nt, Homo sapiens
gcgaaugacucgagcuaga

SEQ ID NO: 916938 - RNA, 19 nt, Homo sapiens
gacaagcgauuccgagugu

SEQ ID NO: 916939 - RNA, 19 nt, Homo sapiens
gaagugcgucgaaguugua

SEQ ID NO: 916940 - RNA, 19 nt, Homo sapiens
gaaauaacggagcaacuug

SEQ ID NO: 916941 - RNA, 19 nt, Homo sapiens
gguuguagcuccuccaaau

SEQ ID NO: 916942 - RNA, 19 nt, Homo sapiens
uuaaggaaguugaaaccua

SEQ ID NO: 916943 - RNA, 19 nt, Homo sapiens
ccaagaacaugaagaugau

SEQ ID NO: 916944 - RNA, 19 nt, Homo sapiens
agaaacaucguucaaagua

SEQ ID NO: 916945 - RNA, 19 nt, Homo sapiens
gacaaagugauuccaguua

SEQ ID NO: 916946 - RNA, 19 nt, Homo sapiens
ggaaauaacggagcaacuu

SEQ ID NO: 916947 - RNA, 19 nt, Homo sapiens
uaugaaacccugcaucuuu

SEQ ID NO: 916948 - RNA, 19 nt, Homo sapiens
gagaaaagaugcacagaau

SEQ ID NO: 916949 - RNA, 19 nt, Homo sapiens
gaaagcaaacuggaauuga

SEQ ID NO: 916950 - RNA, 19 nt, Homo sapiens
gaucagacccagagcagaa

SEQ ID NO: 916951 - RNA, 19 nt, Homo sapiens
cauagagccugugcuuuaa

SEQ ID NO: 916952 - RNA, 19 nt, Homo sapiens
gaugaagaaacaacugaua

SEQ ID NO: 916953 - RNA, 19 nt, Homo sapiens
gauuagaagucguuauagu

SEQ ID NO: 916954 - RNA, 19 nt, Homo sapiens
uagaaaugcuuguuaccaa

SEQ ID NO: 916955 - RNA, 19 nt, Homo sapiens
ggaucucucuucaauuaau

SEQ ID NO: 916956 - RNA, 19 nt, Homo sapiens
cgacgacgcuacccacaga

SEQ ID NO: 916957 - RNA, 19 nt, Homo sapiens
gagaagaagagaaucagaa

SEQ ID NO: 916958 - RNA, 19 nt, Homo sapiens
gagaagaauguggaaauaa

SEQ ID NO: 916959 - RNA, 19 nt, Homo sapiens
gaaaagcuacuguuuacua

SEQ ID NO: 916960 - RNA, 19 nt, Homo sapiens
augaaacccugcaucuuua

SEQ ID NO: 916961 - RNA, 19 nt, Homo sapiens
gaauugagagacaagauug

SEQ ID NO: 916962 - RNA, 19 nt, Homo sapiens
gaacugaggauuuucuuaa

SEQ ID NO: 916963 - RNA, 19 nt, Homo sapiens
gauaccagccucccaaaga

SEQ ID NO: 916964 - RNA, 19 nt, Homo sapiens
ccagagaaagcccaacaua

SEQ ID NO: 916965 - RNA, 19 nt, Homo sapiens
guacagaauugagagacaa

SEQ ID NO: 916966 - RNA, 19 nt, Homo sapiens
gaagugaaacgacuagaag

SEQ ID NO: 916967 - RNA, 19 nt, Homo sapiens
ugacuuggcuuacagugau

SEQ ID NO: 916968 - RNA, 19 nt, Homo sapiens
ugaugaagaugaagaagau

SEQ ID NO: 916969 - RNA, 19 nt, Homo sapiens
ugaagaugaugaagaugaa

SEQ ID NO: 916970 - RNA, 19 nt, Homo sapiens
ugaugaagaugaugaagau

SEQ ID NO: 916971 - RNA, 19 nt, Homo sapiens
gaagaaacaacugauaauc

SEQ ID NO: 916972 - RNA, 19 nt, Homo sapiens
gaacagcagcagcucauca

SEQ ID NO: 916973 - RNA, 19 nt, Homo sapiens
gaagaacaagaagaagaua

SEQ ID NO: 916974 - RNA, 19 nt, Homo sapiens
ggucaucaguuaaggaagu

SEQ ID NO: 916975 - RNA, 19 nt, Homo sapiens
gguaggagaaucugaaaga

SEQ ID NO: 916976 - RNA, 19 nt, Homo sapiens
ccaagaaguccuuacugua

SEQ ID NO: 916977 - RNA, 19 nt, Homo sapiens
gagaaaagcuacuguuuac

SEQ ID NO: 916978 - RNA, 19 nt, Homo sapiens
agaacaagacccuguagua

SEQ ID NO: 916979 - RNA, 19 nt, Homo sapiens
gaaaauggagcaagaggua

SEQ ID NO: 916980 - RNA, 19 nt, Homo sapiens
uaaaagagauggugguguu

SEQ ID NO: 916981 - RNA, 19 nt, Homo sapiens
caaugcaacuagauucuuc

SEQ ID NO: 916982 - RNA, 19 nt, Homo sapiens
gaagaugaacagcacuuug

SEQ ID NO: 916983 - RNA, 19 nt, Homo sapiens
aaacaucguucaaaguaca

SEQ ID NO: 916984 - RNA, 19 nt, Homo sapiens
gaaacaucguucaaaguac

SEQ ID NO: 916985 - RNA, 19 nt, Homo sapiens
gagugcaagucaugauuug

SEQ ID NO: 916986 - RNA, 19 nt, Homo sapiens
agaacuugaugaagacuuu

SEQ ID NO: 916987 - RNA, 19 nt, Homo sapiens
ggagagggcugagaacaua

SEQ ID NO: 916988 - RNA, 19 nt, Homo sapiens
gaggaaugguuuaaagaua

SEQ ID NO: 916989 - RNA, 19 nt, Homo sapiens
gauggaaacucgcaaaugu

SEQ ID NO: 916990 - RNA, 19 nt, Homo sapiens
gaacgagcuugauuuguau

SEQ ID NO: 916991 - RNA, 19 nt, Homo sapiens
agaacgagcuugauuugua

SEQ ID NO: 916992 - RNA, 19 nt, Homo sapiens
agugugaucucauguauua

SEQ ID NO: 916993 - RNA, 19 nt, Homo sapiens
gaaacucgcaaaugugaua

SEQ ID NO: 916994 - RNA, 19 nt, Homo sapiens
gaagaacgagcuugauuug

SEQ ID NO: 916995 - RNA, 19 nt, Homo sapiens
ugaaucaccucccauuuga

SEQ ID NO: 916996 - RNA, 19 nt, Homo sapiens
caaaguggcucaggaggaa

SEQ ID NO: 916997 - RNA, 19 nt, Homo sapiens
agagacaacugaaaucuug

SEQ ID NO: 916998 - RNA, 19 nt, Homo sapiens
cauauacccuuugaacuaa

SEQ ID NO: 916999 - RNA, 19 nt, Homo sapiens
uaagguauguaaacaguug

SEQ ID NO: 917000 - RNA, 19 nt, Homo sapiens
ccagccagcuucuuaauuc

SEQ ID NO: 917001 - RNA, 19 nt, Homo sapiens
caagaagaaucuauaaggu

SEQ ID NO: 917002 - RNA, 19 nt, Homo sapiens
gccacacuaugaaauauaa

SEQ ID NO: 917003 - RNA, 19 nt, Homo sapiens
caccucagaugccuauuaa

SEQ ID NO: 917004 - RNA, 19 nt, Homo sapiens
gucaagaucuaacacuaaa

SEQ ID NO: 917005 - RNA, 19 nt, Homo sapiens
gcacaauuauaugccagua

SEQ ID NO: 917006 - RNA, 19 nt, Homo sapiens
uaacaugcccuucuagaug

SEQ ID NO: 917007 - RNA, 19 nt, Homo sapiens
gguuccggcucauucauua

SEQ ID NO: 917008 - RNA, 19 nt, Homo sapiens
ggcguagacuaugaaauua

SEQ ID NO: 917009 - RNA, 19 nt, Homo sapiens
gaacuaacuauuccacuuc

SEQ ID NO: 917010 - RNA, 19 nt, Homo sapiens
aaagaggaaugguuuaaag

SEQ ID NO: 917011 - RNA, 19 nt, Homo sapiens
acauauacccuuugaacua

SEQ ID NO: 917012 - RNA, 19 nt, Homo sapiens
gaauuaugggagagaaaua

SEQ ID NO: 917013 - RNA, 19 nt, Homo sapiens
cugagaacauaguaucaua

SEQ ID NO: 917014 - RNA, 19 nt, Homo sapiens
cacagcaucuagaguguuu

SEQ ID NO: 917015 - RNA, 19 nt, Homo sapiens
gcugaaacccuaagaaugg

SEQ ID NO: 917016 - RNA, 19 nt, Homo sapiens
ugaacuaacuauuccacuu

SEQ ID NO: 917017 - RNA, 19 nt, Homo sapiens
gagcugaaacccuaagaau

SEQ ID NO: 917018 - RNA, 19 nt, Homo sapiens
cuauuccacuucuauguaa

SEQ ID NO: 917019 - RNA, 19 nt, Homo sapiens
gagaacauaguaucauaga

SEQ ID NO: 917020 - RNA, 19 nt, Homo sapiens
gcagagaggcauuccuuuc

SEQ ID NO: 917021 - RNA, 19 nt, Homo sapiens
gcucauucauuaacaucaa

SEQ ID NO: 917022 - RNA, 19 nt, Homo sapiens
acucgcaaaugugauauua

SEQ ID NO: 917023 - RNA, 19 nt, Homo sapiens
caugugaaauccauauaca

SEQ ID NO: 917024 - RNA, 19 nt, Homo sapiens
cuacagaguuuuacauuug

SEQ ID NO: 917025 - RNA, 19 nt, Homo sapiens
gagcuugauuuguauguac

SEQ ID NO: 917026 - RNA, 19 nt, Homo sapiens
auucauaaguccucacaaa

SEQ ID NO: 917027 - RNA, 19 nt, Homo sapiens
caauuuccauucauaaguc

SEQ ID NO: 917028 - RNA, 19 nt, Homo sapiens
auacuuacguggcauuuua

SEQ ID NO: 917029 - RNA, 19 nt, Homo sapiens
agaagaacgagcuugauuu

SEQ ID NO: 917030 - RNA, 19 nt, Homo sapiens
gccagcuucuuaauucauu

SEQ ID NO: 917031 - RNA, 19 nt, Homo sapiens
guuauucgguuaaagaaac

SEQ ID NO: 917032 - RNA, 19 nt, Homo sapiens
agaaacaugugaaauccau

SEQ ID NO: 917033 - RNA, 19 nt, Homo sapiens
caagaucuaacacuaaaca

SEQ ID NO: 917034 - RNA, 19 nt, Homo sapiens
aggcguagacuaugaaauu

SEQ ID NO: 917035 - RNA, 19 nt, Homo sapiens
cauccuacacacacuauaa

SEQ ID NO: 917036 - RNA, 19 nt, Homo sapiens
guacugacaagaagaaucu

SEQ ID NO: 917037 - RNA, 19 nt, Homo sapiens
ggaaugguuuaaagauacu

SEQ ID NO: 917038 - RNA, 19 nt, Homo sapiens
cuacacacacuauaagaga

SEQ ID NO: 917039 - RNA, 19 nt, Homo sapiens
gaaacaugugaaauccaua

SEQ ID NO: 917040 - RNA, 19 nt, Homo sapiens
ugagugagauuuggagagu

SEQ ID NO: 917041 - RNA, 19 nt, Homo sapiens
uauuaucccugcccugaau

SEQ ID NO: 917042 - RNA, 19 nt, Homo sapiens
ucuccucucucccuuagaa

SEQ ID NO: 917043 - RNA, 19 nt, Homo sapiens
acaccucagaugccuauua

SEQ ID NO: 917044 - RNA, 19 nt, Homo sapiens
acaauuauaugccaguaac

SEQ ID NO: 917045 - RNA, 19 nt, Homo sapiens
cguagacuaugaaauuaca

SEQ ID NO: 917046 - RNA, 19 nt, Homo sapiens
ggucuccucucucccuuag

SEQ ID NO: 917047 - RNA, 19 nt, Homo sapiens
cgagcuugauuuguaugua

SEQ ID NO: 917048 - RNA, 19 nt, Homo sapiens
aagaagaacgagcuugauu

SEQ ID NO: 917049 - RNA, 19 nt, Homo sapiens
ccuaagaaugggugaguuu

SEQ ID NO: 917050 - RNA, 19 nt, Homo sapiens
ggauggaaacucgcaaaug

SEQ ID NO: 917051 - RNA, 19 nt, Homo sapiens
uuaagaagaacgagcuuga

SEQ ID NO: 917052 - RNA, 19 nt, Homo sapiens
ucagaugccuauuaaaaga

SEQ ID NO: 917053 - RNA, 19 nt, Homo sapiens
gugaucucauguauuaguu

SEQ ID NO: 917054 - RNA, 19 nt, Homo sapiens
agugagauuuggagaguau

SEQ ID NO: 917055 - RNA, 19 nt, Homo sapiens
gcuacagaguuuuacauuu

SEQ ID NO: 917056 - RNA, 19 nt, Homo sapiens
gccaguaacacucauuuua

SEQ ID NO: 917057 - RNA, 19 nt, Homo sapiens
uugaaggcguagacuauga

SEQ ID NO: 917058 - RNA, 19 nt, Homo sapiens
gagugagauuuggagagua

SEQ ID NO: 917059 - RNA, 19 nt, Homo sapiens
uggaaacucgcaaauguga

SEQ ID NO: 917060 - RNA, 19 nt, Homo sapiens
aaugagccguggauggaaa

SEQ ID NO: 917061 - RNA, 19 nt, Homo sapiens
ugucaagaucuaacacuaa

SEQ ID NO: 917062 - RNA, 19 nt, Homo sapiens
uagccacacuaugaaauau

SEQ ID NO: 917063 - RNA, 19 nt, Homo sapiens
gaaggcguagacuaugaaa

SEQ ID NO: 917064 - RNA, 19 nt, Homo sapiens
gaaggagcugaaacccuaa

SEQ ID NO: 917065 - RNA, 19 nt, Homo sapiens
aaauccauauacacacgua

SEQ ID NO: 917066 - RNA, 19 nt, Homo sapiens
acaagaagaaucuauaagg

SEQ ID NO: 917067 - RNA, 19 nt, Homo sapiens
cugaaucaccucccauuug

SEQ ID NO: 917068 - RNA, 19 nt, Homo sapiens
ggagcugaaacccuaagaa

SEQ ID NO: 917069 - RNA, 19 nt, Homo sapiens
acuauaagacugagugaga

SEQ ID NO: 917070 - RNA, 19 nt, Homo sapiens
gaagaaucuauaagguaug

SEQ ID NO: 917071 - RNA, 19 nt, Homo sapiens
ugauuuguauguacugaca

SEQ ID NO: 917072 - RNA, 19 nt, Homo sapiens
aggaaugguuuaaagauac

SEQ ID NO: 917073 - RNA, 19 nt, Homo sapiens
aaacaccucagaugccuau

SEQ ID NO: 917074 - RNA, 19 nt, Homo sapiens
ccaguaacacucauuuuaa

SEQ ID NO: 917075 - RNA, 19 nt, Homo sapiens
ccuucuagaugcccuccua

SEQ ID NO: 917076 - RNA, 19 nt, Homo sapiens
gggcugagaacauaguauc

SEQ ID NO: 917077 - RNA, 19 nt, Homo sapiens
uaagacugagugagauuug

SEQ ID NO: 917078 - RNA, 19 nt, Homo sapiens
gacaagaagaaucuauaag

SEQ ID NO: 917079 - RNA, 19 nt, Homo sapiens
uaacuauuccacuucuaug

SEQ ID NO: 917080 - RNA, 19 nt, Homo sapiens
cuaacuauuccacuucuau

SEQ ID NO: 917081 - RNA, 19 nt, Homo sapiens
ccagcuucuuaauucauuu

SEQ ID NO: 917082 - RNA, 19 nt, Homo sapiens
cuauaagacugagugagau

SEQ ID NO: 917083 - RNA, 19 nt, Homo sapiens
uaaagacuagcacuauaag

SEQ ID NO: 917084 - RNA, 19 nt, Homo sapiens
cagccagcuucuuaauuca

SEQ ID NO: 917085 - RNA, 19 nt, Homo sapiens
uaagagacaacugaaaucu

SEQ ID NO: 917086 - RNA, 19 nt, Homo sapiens
cugacaagaagaaucuaua

SEQ ID NO: 917087 - RNA, 19 nt, Homo sapiens
uaaaugagcuuacccaaau

SEQ ID NO: 917088 - RNA, 19 nt, Homo sapiens
gcacaucgccuaucauuuc

SEQ ID NO: 917089 - RNA, 19 nt, Homo sapiens
ccaguagucuguaccauuu

SEQ ID NO: 917090 - RNA, 19 nt, Homo sapiens
ugaaauuucugucugcuuu

SEQ ID NO: 917091 - RNA, 19 nt, Homo sapiens
guaguugucuguauaaaca

SEQ ID NO: 917092 - RNA, 19 nt, Homo sapiens
gaacugcuauacuggcuau

SEQ ID NO: 917093 - RNA, 19 nt, Homo sapiens
acagguauaugaacaacua

SEQ ID NO: 917094 - RNA, 19 nt, Homo sapiens
ccacuuagauuuaguuugc

SEQ ID NO: 917095 - RNA, 19 nt, Homo sapiens
uaaagugcuucaagauuug

SEQ ID NO: 917096 - RNA, 19 nt, Homo sapiens
agauuuaguuugcagguua

SEQ ID NO: 917097 - RNA, 19 nt, Homo sapiens
caaacucccugauccugaa

SEQ ID NO: 917098 - RNA, 19 nt, Homo sapiens
gcaaggauucauuucuuaa

SEQ ID NO: 917099 - RNA, 19 nt, Homo sapiens
guuugcagguuaaguuaua

SEQ ID NO: 917100 - RNA, 19 nt, Homo sapiens
aacaacagcuauucuaaga

SEQ ID NO: 917101 - RNA, 19 nt, Homo sapiens
ugacauaccuccucaucag

SEQ ID NO: 917102 - RNA, 19 nt, Homo sapiens
cuaagacaguauguuguua

SEQ ID NO: 917103 - RNA, 19 nt, Homo sapiens
ugcaaggauucauuucuua

SEQ ID NO: 917104 - RNA, 19 nt, Homo sapiens
cacauaaagugcuucaaga

SEQ ID NO: 917105 - RNA, 19 nt, Homo sapiens
gaaaacaacagcuauucua

SEQ ID NO: 917106 - RNA, 19 nt, Homo sapiens
caacuaccucccaggguua

SEQ ID NO: 917107 - RNA, 19 nt, Homo sapiens
aaagacagguauaugaaca

SEQ ID NO: 917108 - RNA, 19 nt, Homo sapiens
ucaggcauauucccuaaga

SEQ ID NO: 917109 - RNA, 19 nt, Homo sapiens
gaaccuaaugugcacacua

SEQ ID NO: 917110 - RNA, 19 nt, Homo sapiens
gauuuaguuugcagguuaa

SEQ ID NO: 917111 - RNA, 19 nt, Homo sapiens
cauaaagugcuucaagauu

SEQ ID NO: 917112 - RNA, 19 nt, Homo sapiens
cuaaugacucugugaaauu

SEQ ID NO: 917113 - RNA, 19 nt, Homo sapiens
aaaugagcuuacccaaaua

SEQ ID NO: 917114 - RNA, 19 nt, Homo sapiens
ggaguugugagaaauaaau

SEQ ID NO: 917115 - RNA, 19 nt, Homo sapiens
gagccuacauuuccuuaac

SEQ ID NO: 917116 - RNA, 19 nt, Homo sapiens
cuauaacuuucaggacuua

SEQ ID NO: 917117 - RNA, 19 nt, Homo sapiens
caucgccuaucauuucuau

SEQ ID NO: 917118 - RNA, 19 nt, Homo sapiens
gcagcgagcucugaucacu

SEQ ID NO: 917119 - RNA, 19 nt, Homo sapiens
aaucaaacuuucugugcuu

SEQ ID NO: 917120 - RNA, 19 nt, Homo sapiens
aaugaucucucucacuguu

SEQ ID NO: 917121 - RNA, 19 nt, Homo sapiens
ccacacuucuaagacagua

SEQ ID NO: 917122 - RNA, 19 nt, Homo sapiens
gaacauucuccaucacauc

SEQ ID NO: 917123 - RNA, 19 nt, Homo sapiens
guggaguugugagaaauaa

SEQ ID NO: 917124 - RNA, 19 nt, Homo sapiens
caacuuauuugagccuaca

SEQ ID NO: 917125 - RNA, 19 nt, Homo sapiens
caaauacuaaugacucugu

SEQ ID NO: 917126 - RNA, 19 nt, Homo sapiens
gugggaggauccauugaga

SEQ ID NO: 917127 - RNA, 19 nt, Homo sapiens
uaaggcaggaggaaggaua

SEQ ID NO: 917128 - RNA, 19 nt, Homo sapiens
ccaacacccugggagacua

SEQ ID NO: 917129 - RNA, 19 nt, Homo sapiens
cugaggaacugcuauacug

SEQ ID NO: 917130 - RNA, 19 nt, Homo sapiens
guccuguauucaagucuua

SEQ ID NO: 917131 - RNA, 19 nt, Homo sapiens
gccuacauuuccuuaacua

SEQ ID NO: 917132 - RNA, 19 nt, Homo sapiens
cucaguauacccaauaaua

SEQ ID NO: 917133 - RNA, 19 nt, Homo sapiens
uagcacaucgccuaucauu

SEQ ID NO: 917134 - RNA, 19 nt, Homo sapiens
ccucacguguccuguauuc

SEQ ID NO: 917135 - RNA, 19 nt, Homo sapiens
gcagguuaaguuauaaaug

SEQ ID NO: 917136 - RNA, 19 nt, Homo sapiens
uugcaaggauucauuucuu

SEQ ID NO: 917137 - RNA, 19 nt, Homo sapiens
caacacccugggagacuaa

SEQ ID NO: 917138 - RNA, 19 nt, Homo sapiens
ucacguguccuguauucaa

SEQ ID NO: 917139 - RNA, 19 nt, Homo sapiens
gcuucaagauuuguacuuc

SEQ ID NO: 917140 - RNA, 19 nt, Homo sapiens
acuaggcacuguucucaau

SEQ ID NO: 917141 - RNA, 19 nt, Homo sapiens
acuaaugacucugugaaau

SEQ ID NO: 917142 - RNA, 19 nt, Homo sapiens
gagcuuacccaaauaaaau

SEQ ID NO: 917143 - RNA, 19 nt, Homo sapiens
gcaggaggaaggauagcuu

SEQ ID NO: 917144 - RNA, 19 nt, Homo sapiens
uaacuuucaggacuuagaa

SEQ ID NO: 917145 - RNA, 19 nt, Homo sapiens
acucaggcauauucccuaa

SEQ ID NO: 917146 - RNA, 19 nt, Homo sapiens
aaccuaaugugcacacuag

SEQ ID NO: 917147 - RNA, 19 nt, Homo sapiens
acuaagggcuggucauggu

SEQ ID NO: 917148 - RNA, 19 nt, Homo sapiens
caucacaucugagacuuuu

SEQ ID NO: 917149 - RNA, 19 nt, Homo sapiens
cagccuggguaacaaagug

SEQ ID NO: 917150 - RNA, 19 nt, Homo sapiens
cuaagaaugaucucucuca

SEQ ID NO: 917151 - RNA, 19 nt, Homo sapiens
aaacaacagcuauucuaag

SEQ ID NO: 917152 - RNA, 19 nt, Homo sapiens
cgccuaucauuucuaugua

SEQ ID NO: 917153 - RNA, 19 nt, Homo sapiens
cuuagcacaucgccuauca

SEQ ID NO: 917154 - RNA, 19 nt, Homo sapiens
auaaaugagcuuacccaaa

SEQ ID NO: 917155 - RNA, 19 nt, Homo sapiens
ugacacaaacucccugauc

SEQ ID NO: 917156 - RNA, 19 nt, Homo sapiens
ccugagggcuuagcacauc

SEQ ID NO: 917157 - RNA, 19 nt, Homo sapiens
cauucuauguccacacuuc

SEQ ID NO: 917158 - RNA, 19 nt, Homo sapiens
gguggacucaggcauauuc

SEQ ID NO: 917159 - RNA, 19 nt, Homo sapiens
ccagagaagguauaagucu

SEQ ID NO: 917160 - RNA, 19 nt, Homo sapiens
ucuaagacaguauguuguu

SEQ ID NO: 917161 - RNA, 19 nt, Homo sapiens
cuucuaagacaguauguug

SEQ ID NO: 917162 - RNA, 19 nt, Homo sapiens
uaggcacuguucucaauca

SEQ ID NO: 917163 - RNA, 19 nt, Homo sapiens
guuauugcaaggauucauu

SEQ ID NO: 917164 - RNA, 19 nt, Homo sapiens
ugagacguucaacuuauuu

SEQ ID NO: 917165 - RNA, 19 nt, Homo sapiens
ccagacaguccauuuuaua

SEQ ID NO: 917166 - RNA, 19 nt, Homo sapiens
cauucuccaucacaucuga

SEQ ID NO: 917167 - RNA, 19 nt, Homo sapiens
acuauaacuuucaggacuu

SEQ ID NO: 917168 - RNA, 19 nt, Homo sapiens
ggucuccaccauucuaugu

SEQ ID NO: 917169 - RNA, 19 nt, Homo sapiens
aguguggaguugugagaaa

SEQ ID NO: 917170 - RNA, 19 nt, Homo sapiens
uaguuugcagguuaaguua

SEQ ID NO: 917171 - RNA, 19 nt, Homo sapiens
cugcuauacuggcuauuca

SEQ ID NO: 917172 - RNA, 19 nt, Homo sapiens
ccaaccagagaagguauaa

SEQ ID NO: 917173 - RNA, 19 nt, Homo sapiens
gccuaucauuucuauguag

SEQ ID NO: 917174 - RNA, 19 nt, Homo sapiens
ugaacauucuccaucacau

SEQ ID NO: 917175 - RNA, 19 nt, Homo sapiens
uacugaacauucuccauca

SEQ ID NO: 917176 - RNA, 19 nt, Homo sapiens
ggcagugaaugacacaaac

SEQ ID NO: 917177 - RNA, 19 nt, Homo sapiens
cuaccguucuagcuuacuu

SEQ ID NO: 917178 - RNA, 19 nt, Homo sapiens
ccaggguuauugcaaggau

SEQ ID NO: 917179 - RNA, 19 nt, Homo sapiens
aaugagcuuacccaaauaa

SEQ ID NO: 917180 - RNA, 19 nt, Homo sapiens
ggugacagaccgagacucu

SEQ ID NO: 917181 - RNA, 19 nt, Homo sapiens
caaggauucauuucuuaag

SEQ ID NO: 917182 - RNA, 19 nt, Homo sapiens
gcuccucacguguccugua

SEQ ID NO: 917183 - RNA, 19 nt, Homo sapiens
uuaguuugcagguuaaguu

SEQ ID NO: 917184 - RNA, 19 nt, Homo sapiens
gugauguggcagugaauga

SEQ ID NO: 917185 - RNA, 19 nt, Homo sapiens
gagacguucaacuuauuug

SEQ ID NO: 917186 - RNA, 19 nt, Homo sapiens
aaccagagaagguauaagu

SEQ ID NO: 917187 - RNA, 19 nt, Homo sapiens
gaaagagaauucagugaua

SEQ ID NO: 917188 - RNA, 19 nt, Homo sapiens
gggcuuaucucuucccuua

SEQ ID NO: 917189 - RNA, 19 nt, Homo sapiens
gaaguauucuuaccacaaa

SEQ ID NO: 917190 - RNA, 19 nt, Homo sapiens
caagagaucuauuguacuu

SEQ ID NO: 917191 - RNA, 19 nt, Homo sapiens
gaccauaucuccuccagaa

SEQ ID NO: 917192 - RNA, 19 nt, Homo sapiens
gaaauacagggaaagaaua

SEQ ID NO: 917193 - RNA, 19 nt, Homo sapiens
gcagaaacaauauggguua

SEQ ID NO: 917194 - RNA, 19 nt, Homo sapiens
caucuuaccuggauuauag

SEQ ID NO: 917195 - RNA, 19 nt, Homo sapiens
ucacagagaucacaugcuu

SEQ ID NO: 917196 - RNA, 19 nt, Homo sapiens
gaauauaacuacugugaac

SEQ ID NO: 917197 - RNA, 19 nt, Homo sapiens
gggagggaguguaugaaua

SEQ ID NO: 917198 - RNA, 19 nt, Homo sapiens
ccagaacucauucaaauaa

SEQ ID NO: 917199 - RNA, 19 nt, Homo sapiens
gaaccaacaucucuaucau

SEQ ID NO: 917200 - RNA, 19 nt, Homo sapiens
gaguagauuugaaguauuc

SEQ ID NO: 917201 - RNA, 19 nt, Homo sapiens
ugaaccagcuguggaauuu

SEQ ID NO: 917202 - RNA, 19 nt, Homo sapiens
gaaggaauaacugacuuua

SEQ ID NO: 917203 - RNA, 19 nt, Homo sapiens
caugaugacuccaguaaau

SEQ ID NO: 917204 - RNA, 19 nt, Homo sapiens
ucacaugcuucacaaggua

SEQ ID NO: 917205 - RNA, 19 nt, Homo sapiens
guauaucucuuccacuaga

SEQ ID NO: 917206 - RNA, 19 nt, Homo sapiens
gaauuuguuucacaguuug

SEQ ID NO: 917207 - RNA, 19 nt, Homo sapiens
uaagauaucacaaggcaaa

SEQ ID NO: 917208 - RNA, 19 nt, Homo sapiens
aaaguaggcucaggagaaa

SEQ ID NO: 917209 - RNA, 19 nt, Homo sapiens
gaaguuauucaccuauuga

SEQ ID NO: 917210 - RNA, 19 nt, Homo sapiens
gagaucacaugcuucacaa

SEQ ID NO: 917211 - RNA, 19 nt, Homo sapiens
guaguauucuauugcauga

SEQ ID NO: 917212 - RNA, 19 nt, Homo sapiens
ccauuuagcuauuccacaa

SEQ ID NO: 917213 - RNA, 19 nt, Homo sapiens
ucagugauauuucuccuau

SEQ ID NO: 917214 - RNA, 19 nt, Homo sapiens
uuucagaacuucagauaug

SEQ ID NO: 917215 - RNA, 19 nt, Homo sapiens
acacacacaccuucuauuu

SEQ ID NO: 917216 - RNA, 19 nt, Homo sapiens
gaucuauuguacuucauga

SEQ ID NO: 917217 - RNA, 19 nt, Homo sapiens
ucacuacaguuccugacua

SEQ ID NO: 917218 - RNA, 19 nt, Homo sapiens
gaauuuccucauccuaaua

SEQ ID NO: 917219 - RNA, 19 nt, Homo sapiens
gcacgcauugucauugaua

SEQ ID NO: 917220 - RNA, 19 nt, Homo sapiens
gggcacgcauugucauuga

SEQ ID NO: 917221 - RNA, 19 nt, Homo sapiens
gcuauugaguaguauucua

SEQ ID NO: 917222 - RNA, 19 nt, Homo sapiens
ggaagcagacaauaguuug

SEQ ID NO: 917223 - RNA, 19 nt, Homo sapiens
gugaggaagugguauagga

SEQ ID NO: 917224 - RNA, 19 nt, Homo sapiens
cuaaaugacagauugcuuu

SEQ ID NO: 917225 - RNA, 19 nt, Homo sapiens
gguaaugcauauguuaguu

SEQ ID NO: 917226 - RNA, 19 nt, Homo sapiens
ugacuagccuucagauuac

SEQ ID NO: 917227 - RNA, 19 nt, Homo sapiens
caaguugccuagucuccuu

SEQ ID NO: 917228 - RNA, 19 nt, Homo sapiens
ucccuuaucuacaaucgua

SEQ ID NO: 917229 - RNA, 19 nt, Homo sapiens
gcuuaucucuucccuuauc

SEQ ID NO: 917230 - RNA, 19 nt, Homo sapiens
ggagggaguguaugaauag

SEQ ID NO: 917231 - RNA, 19 nt, Homo sapiens
ucucuucccuuaucuacaa

SEQ ID NO: 917232 - RNA, 19 nt, Homo sapiens
cuccagaacucauucaaau

SEQ ID NO: 917233 - RNA, 19 nt, Homo sapiens
gauaggaagcagacaauag

SEQ ID NO: 917234 - RNA, 19 nt, Homo sapiens
ugagguaaugcauauguua

SEQ ID NO: 917235 - RNA, 19 nt, Homo sapiens
ccuaaguguuggccuguuu

SEQ ID NO: 917236 - RNA, 19 nt, Homo sapiens
ccaaagcagccauuucaga

SEQ ID NO: 917237 - RNA, 19 nt, Homo sapiens
ugaaagaagagaaauaugg

SEQ ID NO: 917238 - RNA, 19 nt, Homo sapiens
gagaaagagaauucaguga

SEQ ID NO: 917239 - RNA, 19 nt, Homo sapiens
gaaaccagccccugauauu

SEQ ID NO: 917240 - RNA, 19 nt, Homo sapiens
agacagacauucccaaagc

SEQ ID NO: 917241 - RNA, 19 nt, Homo sapiens
gaauugauccaucccaucu

SEQ ID NO: 917242 - RNA, 19 nt, Homo sapiens
agagaucuauuguacuuca

SEQ ID NO: 917243 - RNA, 19 nt, Homo sapiens
gguguuccuugcugagaaa

SEQ ID NO: 917244 - RNA, 19 nt, Homo sapiens
uaucaucuuaccuggauua

SEQ ID NO: 917245 - RNA, 19 nt, Homo sapiens
cagaaggaauaacugacuu

SEQ ID NO: 917246 - RNA, 19 nt, Homo sapiens
gguaauaagauaucacaag

SEQ ID NO: 917247 - RNA, 19 nt, Homo sapiens
ucucucccuugaauuguua

SEQ ID NO: 917248 - RNA, 19 nt, Homo sapiens
gcuauuccacaauguauau

SEQ ID NO: 917249 - RNA, 19 nt, Homo sapiens
ugaugacuccaguaaauaa

SEQ ID NO: 917250 - RNA, 19 nt, Homo sapiens
ugugugagguaaugcauau

SEQ ID NO: 917251 - RNA, 19 nt, Homo sapiens
guuggcagguucugugaug

SEQ ID NO: 917252 - RNA, 19 nt, Homo sapiens
gagucucucucccuugaau

SEQ ID NO: 917253 - RNA, 19 nt, Homo sapiens
uccaguaaauaaccaugua

SEQ ID NO: 917254 - RNA, 19 nt, Homo sapiens
gaagugguauaggacaagu

SEQ ID NO: 917255 - RNA, 19 nt, Homo sapiens
gaaccuaucccaguugaac

SEQ ID NO: 917256 - RNA, 19 nt, Homo sapiens
gcauugucauugauaacau

SEQ ID NO: 917257 - RNA, 19 nt, Homo sapiens
aaagggagggaguguauga

SEQ ID NO: 917258 - RNA, 19 nt, Homo sapiens
agaaauacagggaaagaau

SEQ ID NO: 917259 - RNA, 19 nt, Homo sapiens
gagaaauacagggaaagaa

SEQ ID NO: 917260 - RNA, 19 nt, Homo sapiens
aaacacacacaccuucuau

SEQ ID NO: 917261 - RNA, 19 nt, Homo sapiens
uaaacacacacaccuucua

SEQ ID NO: 917262 - RNA, 19 nt, Homo sapiens
gaaauauggcucuguucca

SEQ ID NO: 917263 - RNA, 19 nt, Homo sapiens
gagaauucagugauauuuc

SEQ ID NO: 917264 - RNA, 19 nt, Homo sapiens
aaagacagacauucccaaa

SEQ ID NO: 917265 - RNA, 19 nt, Homo sapiens
auguauaucucuuccacua

SEQ ID NO: 917266 - RNA, 19 nt, Homo sapiens
caggaugugugagguaaug

SEQ ID NO: 917267 - RNA, 19 nt, Homo sapiens
aaacaggaugugugaggua

SEQ ID NO: 917268 - RNA, 19 nt, Homo sapiens
guguuggccuguuugagaa

SEQ ID NO: 917269 - RNA, 19 nt, Homo sapiens
guucucuuguguccacuuu

SEQ ID NO: 917270 - RNA, 19 nt, Homo sapiens
ggugugaggaagugguaua

SEQ ID NO: 917271 - RNA, 19 nt, Homo sapiens
caucccaucucuucauuuu

SEQ ID NO: 917272 - RNA, 19 nt, Homo sapiens
ugaguaguauucuauugca

SEQ ID NO: 917273 - RNA, 19 nt, Homo sapiens
cagaaacaauauggguuau

SEQ ID NO: 917274 - RNA, 19 nt, Homo sapiens
guuaguuaguuccauuuag

SEQ ID NO: 917275 - RNA, 19 nt, Homo sapiens
gugagguaaugcauauguu

SEQ ID NO: 917276 - RNA, 19 nt, Homo sapiens
agaaagagaauucagugau

SEQ ID NO: 917277 - RNA, 19 nt, Homo sapiens
gacagacauucccaaagca

SEQ ID NO: 917278 - RNA, 19 nt, Homo sapiens
ggggagacgucacauguug

SEQ ID NO: 917279 - RNA, 19 nt, Homo sapiens
ugaaguauucuuaccacaa

SEQ ID NO: 917280 - RNA, 19 nt, Homo sapiens
gaggcagggugagaucaga

SEQ ID NO: 917281 - RNA, 19 nt, Homo sapiens
gauaucacaaggcaaaugg

SEQ ID NO: 917282 - RNA, 19 nt, Homo sapiens
guaucaugcuauugaguag

SEQ ID NO: 917283 - RNA, 19 nt, Homo sapiens
ugaaccaacaucucuauca

SEQ ID NO: 917284 - RNA, 19 nt, Homo sapiens
gaaguuguuccccaagaua

SEQ ID NO: 917285 - RNA, 19 nt, Homo sapiens
gagggagucacuacaguuc

SEQ ID NO: 917286 - RNA, 19 nt, Homo sapiens
ggguguuccuugcugagaa

SEQ ID NO: 917287 - RNA, 19 nt, Homo sapiens
uaacaagagcucccuauua

SEQ ID NO: 917288 - RNA, 19 nt, Homo sapiens
aacaagagcucccuauuaa

SEQ ID NO: 917289 - RNA, 19 nt, Homo sapiens
aagaauagauggccacuaa

SEQ ID NO: 917290 - RNA, 19 nt, Homo sapiens
gcuagaaacuuauaguaug

SEQ ID NO: 917291 - RNA, 19 nt, Homo sapiens
gagagaggcugagaagauu

SEQ ID NO: 917292 - RNA, 19 nt, Homo sapiens
guacaucaccucuuucauu

SEQ ID NO: 917293 - RNA, 19 nt, Homo sapiens
uaugaaaccacuccaauua

SEQ ID NO: 917294 - RNA, 19 nt, Homo sapiens
agacguacaucaccucuuu

SEQ ID NO: 917295 - RNA, 19 nt, Homo sapiens
guaccgcacucccuuugua

SEQ ID NO: 917296 - RNA, 19 nt, Homo sapiens
gaaggcagguugagauucu

SEQ ID NO: 917297 - RNA, 19 nt, Homo sapiens
ggaauugaaccuauacauu

SEQ ID NO: 917298 - RNA, 19 nt, Homo sapiens
aaugacaucugacauauug

SEQ ID NO: 917299 - RNA, 19 nt, Homo sapiens
ccuaaacccugaacucauu

SEQ ID NO: 917300 - RNA, 19 nt, Homo sapiens
gaugaaaccagcuauaguu

SEQ ID NO: 917301 - RNA, 19 nt, Homo sapiens
gauaaauagcuuucccuua

SEQ ID NO: 917302 - RNA, 19 nt, Homo sapiens
ucauagagauccuugagaa

SEQ ID NO: 917303 - RNA, 19 nt, Homo sapiens
caagagcucccuauuaaug

SEQ ID NO: 917304 - RNA, 19 nt, Homo sapiens
ggucugaaguugaaagaau

SEQ ID NO: 917305 - RNA, 19 nt, Homo sapiens
ggaaggagcagacuaugga

SEQ ID NO: 917306 - RNA, 19 nt, Homo sapiens
ggagagaggcugagaagau

SEQ ID NO: 917307 - RNA, 19 nt, Homo sapiens
gcugauggaaugaauguua

SEQ ID NO: 917308 - RNA, 19 nt, Homo sapiens
uacaucaccucuuucauuu

SEQ ID NO: 917309 - RNA, 19 nt, Homo sapiens
cuaccugucuccaucauuu

SEQ ID NO: 917310 - RNA, 19 nt, Homo sapiens
gcauagcaauuugauaaug

SEQ ID NO: 917311 - RNA, 19 nt, Homo sapiens
gagguugaagugucuauua

SEQ ID NO: 917312 - RNA, 19 nt, Homo sapiens
gaaaagaccugggguggaa

SEQ ID NO: 917313 - RNA, 19 nt, Homo sapiens
gaacaguagacagcaaaua

SEQ ID NO: 917314 - RNA, 19 nt, Homo sapiens
ugacauacguucugauuuu

SEQ ID NO: 917315 - RNA, 19 nt, Homo sapiens
ugacuuaaguuucccuuuc

SEQ ID NO: 917316 - RNA, 19 nt, Homo sapiens
uaaaucauccuuucuagug

SEQ ID NO: 917317 - RNA, 19 nt, Homo sapiens
gaguuuccuugcccuauuu

SEQ ID NO: 917318 - RNA, 19 nt, Homo sapiens
gcauuuauuugccgacaau

SEQ ID NO: 917319 - RNA, 19 nt, Homo sapiens
gaaaccagcuauaguugcu

SEQ ID NO: 917320 - RNA, 19 nt, Homo sapiens
ggagcuagcgauuuauuug

SEQ ID NO: 917321 - RNA, 19 nt, Homo sapiens
cagcuauaguugcuuguaa

SEQ ID NO: 917322 - RNA, 19 nt, Homo sapiens
ggaauucuaucugacaaag

SEQ ID NO: 917323 - RNA, 19 nt, Homo sapiens
gagauucuaacuaagcaua

SEQ ID NO: 917324 - RNA, 19 nt, Homo sapiens
ugaaaccacuccaauuaag

SEQ ID NO: 917325 - RNA, 19 nt, Homo sapiens
ucagagaacuccaaaauuc

SEQ ID NO: 917326 - RNA, 19 nt, Homo sapiens
gaaguggaacucacagaug

SEQ ID NO: 917327 - RNA, 19 nt, Homo sapiens
aaggguauauugauaguga

SEQ ID NO: 917328 - RNA, 19 nt, Homo sapiens
caugucaaaugcuugguuu

SEQ ID NO: 917329 - RNA, 19 nt, Homo sapiens
gaauagauggccacuaaag

SEQ ID NO: 917330 - RNA, 19 nt, Homo sapiens
aaguaaaccugaaguggaa

SEQ ID NO: 917331 - RNA, 19 nt, Homo sapiens
gaugcaaaugcuauucuua

SEQ ID NO: 917332 - RNA, 19 nt, Homo sapiens
uaucucugcugccaaugua

SEQ ID NO: 917333 - RNA, 19 nt, Homo sapiens
cucaacugcuucuguguua

SEQ ID NO: 917334 - RNA, 19 nt, Homo sapiens
uauguaaggccuugaguuu

SEQ ID NO: 917335 - RNA, 19 nt, Homo sapiens
gucugaaguugaaagaaua

SEQ ID NO: 917336 - RNA, 19 nt, Homo sapiens
gaggaauucuaucugacaa

SEQ ID NO: 917337 - RNA, 19 nt, Homo sapiens
uacgacagcugauggaaug

SEQ ID NO: 917338 - RNA, 19 nt, Homo sapiens
agguugagauucuaacuaa

SEQ ID NO: 917339 - RNA, 19 nt, Homo sapiens
uagcagauguuauugugau

SEQ ID NO: 917340 - RNA, 19 nt, Homo sapiens
caucaccucuuucauuucu

SEQ ID NO: 917341 - RNA, 19 nt, Homo sapiens
ggucugaguccucugcuuu

SEQ ID NO: 917342 - RNA, 19 nt, Homo sapiens
acgcauagcaauuugauaa

SEQ ID NO: 917343 - RNA, 19 nt, Homo sapiens
guuccacccuugugcauug

SEQ ID NO: 917344 - RNA, 19 nt, Homo sapiens
auagcugacuuacauauug

SEQ ID NO: 917345 - RNA, 19 nt, Homo sapiens
ggaaugaauguuaaguaug

SEQ ID NO: 917346 - RNA, 19 nt, Homo sapiens
aaguggaacucacagauga

SEQ ID NO: 917347 - RNA, 19 nt, Homo sapiens
cacauucuguugcauuuau

SEQ ID NO: 917348 - RNA, 19 nt, Homo sapiens
uagaauggcugucuuuagc

SEQ ID NO: 917349 - RNA, 19 nt, Homo sapiens
caauauccagggaggcuua

SEQ ID NO: 917350 - RNA, 19 nt, Homo sapiens
uaaaggaagcaauugauag

SEQ ID NO: 917351 - RNA, 19 nt, Homo sapiens
guaacaagagcucccuauu

SEQ ID NO: 917352 - RNA, 19 nt, Homo sapiens
gcuuguaaaucauccuuuc

SEQ ID NO: 917353 - RNA, 19 nt, Homo sapiens
aggaagcaauugauagcua

SEQ ID NO: 917354 - RNA, 19 nt, Homo sapiens
cugauggaaugaauguuaa

SEQ ID NO: 917355 - RNA, 19 nt, Homo sapiens
gguugaagugucuauuaua

SEQ ID NO: 917356 - RNA, 19 nt, Homo sapiens
aaagaugaaaccagcuaua

SEQ ID NO: 917357 - RNA, 19 nt, Homo sapiens
ugaguuuccuugcccuauu

SEQ ID NO: 917358 - RNA, 19 nt, Homo sapiens
gcagauguuauugugauuu

SEQ ID NO: 917359 - RNA, 19 nt, Homo sapiens
aacaguagacagcaaauaa

SEQ ID NO: 917360 - RNA, 19 nt, Homo sapiens
uauagucuguucuacuguu

SEQ ID NO: 917361 - RNA, 19 nt, Homo sapiens
gcugagaagauuaguuguu

SEQ ID NO: 917362 - RNA, 19 nt, Homo sapiens
cagggaggcuuagucauca

SEQ ID NO: 917363 - RNA, 19 nt, Homo sapiens
gugcuagaaacuuauagua

SEQ ID NO: 917364 - RNA, 19 nt, Homo sapiens
caguagacagcaaauaauu

SEQ ID NO: 917365 - RNA, 19 nt, Homo sapiens
caacugcuucuguguuaga

SEQ ID NO: 917366 - RNA, 19 nt, Homo sapiens
gauccacggcguuagcaaa

SEQ ID NO: 917367 - RNA, 19 nt, Homo sapiens
cagaugauccacggcguua

SEQ ID NO: 917368 - RNA, 19 nt, Homo sapiens
acugaggaauucuaucuga

SEQ ID NO: 917369 - RNA, 19 nt, Homo sapiens
aaaucauccuuucuaguga

SEQ ID NO: 917370 - RNA, 19 nt, Homo sapiens
cugagaagauuaguuguuc

SEQ ID NO: 917371 - RNA, 19 nt, Homo sapiens
acuuacauauugcgaguuu

SEQ ID NO: 917372 - RNA, 19 nt, Homo sapiens
gacagcugauggaaugaau

SEQ ID NO: 917373 - RNA, 19 nt, Homo sapiens
cgaugcaaaugcuauucuu

SEQ ID NO: 917374 - RNA, 19 nt, Homo sapiens
gcuacuuguuguaauaaag

SEQ ID NO: 917375 - RNA, 19 nt, Homo sapiens
gacuuaaguuucccuuucu

SEQ ID NO: 917376 - RNA, 19 nt, Homo sapiens
gaauacgacagcugaugga

SEQ ID NO: 917377 - RNA, 19 nt, Homo sapiens
gcacgcauagcaauuugau

SEQ ID NO: 917378 - RNA, 19 nt, Homo sapiens
aagcuaaaguaaaccugaa

SEQ ID NO: 917379 - RNA, 19 nt, Homo sapiens
cuuaaucucugcuucuagu

SEQ ID NO: 917380 - RNA, 19 nt, Homo sapiens
ucuccugccucaacaucua

SEQ ID NO: 917381 - RNA, 19 nt, Homo sapiens
ccagggaggcuuagucauc

SEQ ID NO: 917382 - RNA, 19 nt, Homo sapiens
ccacuaaagcuaccugucu

SEQ ID NO: 917383 - RNA, 19 nt, Homo sapiens
ccagaaggcagguugagau

SEQ ID NO: 917384 - RNA, 19 nt, Homo sapiens
aaacugaggaauucuaucu

SEQ ID NO: 917385 - RNA, 19 nt, Homo sapiens
cuagaaacuuauaguaugc

SEQ ID NO: 917386 - RNA, 19 nt, Homo sapiens
ucaaaugccuaugaaacca

SEQ ID NO: 917387 - RNA, 19 nt, Homo sapiens
gcacaaaguuccauuacug

SEQ ID NO: 917388 - RNA, 19 nt, Homo sapiens
gagaagagcagcacguuaa

SEQ ID NO: 917389 - RNA, 19 nt, Homo sapiens
gcaagaacguuuacuuaca

SEQ ID NO: 917390 - RNA, 19 nt, Homo sapiens
aaucaaagcuaaccacuga

SEQ ID NO: 917391 - RNA, 19 nt, Homo sapiens
guuaccaguucucaaauua

SEQ ID NO: 917392 - RNA, 19 nt, Homo sapiens
gggcaagaacguuuacuua

SEQ ID NO: 917393 - RNA, 19 nt, Homo sapiens
ucaaaugccuaacucaaga

SEQ ID NO: 917394 - RNA, 19 nt, Homo sapiens
gcagcaagguuaucuuuac

SEQ ID NO: 917395 - RNA, 19 nt, Homo sapiens
gcgcagaugacuccgauua

SEQ ID NO: 917396 - RNA, 19 nt, Homo sapiens
gggauuaacuccagaaagg

SEQ ID NO: 917397 - RNA, 19 nt, Homo sapiens
uaaauuacacucccagaaa

SEQ ID NO: 917398 - RNA, 19 nt, Homo sapiens
ccaaauuucucaaucuuca

SEQ ID NO: 917399 - RNA, 19 nt, Homo sapiens
gauagauguugaagcaauu

SEQ ID NO: 917400 - RNA, 19 nt, Homo sapiens
ccagcaaccuauaaucaaa

SEQ ID NO: 917401 - RNA, 19 nt, Homo sapiens
ccacugaggcacuauuuaa

SEQ ID NO: 917402 - RNA, 19 nt, Homo sapiens
aaacaaaccuauggacuca

SEQ ID NO: 917403 - RNA, 19 nt, Homo sapiens
gaaaggaaccaccauaaaa

SEQ ID NO: 917404 - RNA, 19 nt, Homo sapiens
gaagcaauuuacucaguca

SEQ ID NO: 917405 - RNA, 19 nt, Homo sapiens
caaaugggcaagaacguuu

SEQ ID NO: 917406 - RNA, 19 nt, Homo sapiens
gcaauuuacucagucacaa

SEQ ID NO: 917407 - RNA, 19 nt, Homo sapiens
acaaaccuauggacucaaa

SEQ ID NO: 917408 - RNA, 19 nt, Homo sapiens
caaccuauauauggccuaa

SEQ ID NO: 917409 - RNA, 19 nt, Homo sapiens
ugcaagguauucaagguua

SEQ ID NO: 917410 - RNA, 19 nt, Homo sapiens
ccugagcacuacugacuuu

SEQ ID NO: 917411 - RNA, 19 nt, Homo sapiens
gcucaacgcuucucaaccu

SEQ ID NO: 917412 - RNA, 19 nt, Homo sapiens
cagaaaggaaccaccauaa

SEQ ID NO: 917413 - RNA, 19 nt, Homo sapiens
ucaaauugcuagagaagag

SEQ ID NO: 917414 - RNA, 19 nt, Homo sapiens
ggauaauucuucgcugaga

SEQ ID NO: 917415 - RNA, 19 nt, Homo sapiens
uaccaagaaugcacaaaug

SEQ ID NO: 917416 - RNA, 19 nt, Homo sapiens
gcuaaccacugaggcacua

SEQ ID NO: 917417 - RNA, 19 nt, Homo sapiens
ggagggaggugucaaaauc

SEQ ID NO: 917418 - RNA, 19 nt, Homo sapiens
ugauagauguugaagcaau

SEQ ID NO: 917419 - RNA, 19 nt, Homo sapiens
acucuuaucuucccucaau

SEQ ID NO: 917420 - RNA, 19 nt, Homo sapiens
ccagaaaggaaccaccaua

SEQ ID NO: 917421 - RNA, 19 nt, Homo sapiens
gaacguuuacuuacacauc

SEQ ID NO: 917422 - RNA, 19 nt, Homo sapiens
caagaacguuuacuuacac

SEQ ID NO: 917423 - RNA, 19 nt, Homo sapiens
agaaaggaaccaccauaaa

SEQ ID NO: 917424 - RNA, 19 nt, Homo sapiens
gguuaucuuuaccuuugua

SEQ ID NO: 917425 - RNA, 19 nt, Homo sapiens
gcaagguauucaagguuag

SEQ ID NO: 917426 - RNA, 19 nt, Homo sapiens
aacaucaacucuuaucuuc

SEQ ID NO: 917427 - RNA, 19 nt, Homo sapiens
ucaaaacucucaacagaau

SEQ ID NO: 917428 - RNA, 19 nt, Homo sapiens
gcaccuucauagcccguuu

SEQ ID NO: 917429 - RNA, 19 nt, Homo sapiens
uaucuucccucaaugucuu

SEQ ID NO: 917430 - RNA, 19 nt, Homo sapiens
acugauagauguugaagca

SEQ ID NO: 917431 - RNA, 19 nt, Homo sapiens
ucaaauuacugucccaaaa

SEQ ID NO: 917432 - RNA, 19 nt, Homo sapiens
cggcaaugcagcaagguua

SEQ ID NO: 917433 - RNA, 19 nt, Homo sapiens
gagcacuacugacuuuagg

SEQ ID NO: 917434 - RNA, 19 nt, Homo sapiens
gcagaugacuccgauuagc

SEQ ID NO: 917435 - RNA, 19 nt, Homo sapiens
caaaguuccauuacuguuc

SEQ ID NO: 917436 - RNA, 19 nt, Homo sapiens
gauuaacuccagaaaggaa

SEQ ID NO: 917437 - RNA, 19 nt, Homo sapiens
cauagcccguuucaaccua

SEQ ID NO: 917438 - RNA, 19 nt, Homo sapiens
gaucaaauugcuagagaag

SEQ ID NO: 917439 - RNA, 19 nt, Homo sapiens
gcagaaaacacacuuggaa

SEQ ID NO: 917440 - RNA, 19 nt, Homo sapiens
aaaucuaaacccaccguua

SEQ ID NO: 917441 - RNA, 19 nt, Homo sapiens
ucaagcagcaccuucauag

SEQ ID NO: 917442 - RNA, 19 nt, Homo sapiens
ucaagaaaucucacaagga

SEQ ID NO: 917443 - RNA, 19 nt, Homo sapiens
ggccauuugcacauucuua

SEQ ID NO: 917444 - RNA, 19 nt, Homo sapiens
guaagacuggacuauuauu

SEQ ID NO: 917445 - RNA, 19 nt, Homo sapiens
ugacacacucggucugaaa

SEQ ID NO: 917446 - RNA, 19 nt, Homo sapiens
cagcacugauagauguuga

SEQ ID NO: 917447 - RNA, 19 nt, Homo sapiens
ccauuacuguucugagcaa

SEQ ID NO: 917448 - RNA, 19 nt, Homo sapiens
gaagagcagcacguuaaca

SEQ ID NO: 917449 - RNA, 19 nt, Homo sapiens
gcacuauuuaaccauguuu

SEQ ID NO: 917450 - RNA, 19 nt, Homo sapiens
acaagaugcugcggccauu

SEQ ID NO: 917451 - RNA, 19 nt, Homo sapiens
aaauuacacucccagaaac

SEQ ID NO: 917452 - RNA, 19 nt, Homo sapiens
aaaguuccauuacuguucu

SEQ ID NO: 917453 - RNA, 19 nt, Homo sapiens
agagaagagcagcacguua

SEQ ID NO: 917454 - RNA, 19 nt, Homo sapiens
ugaucaaauugcuagagaa

SEQ ID NO: 917455 - RNA, 19 nt, Homo sapiens
uguuaccaguucucaaauu

SEQ ID NO: 917456 - RNA, 19 nt, Homo sapiens
auucucaaguugcaaggua

SEQ ID NO: 917457 - RNA, 19 nt, Homo sapiens
agacugccacgcuuucaaa

SEQ ID NO: 917458 - RNA, 19 nt, Homo sapiens
gccagcaaccuauaaucaa

SEQ ID NO: 917459 - RNA, 19 nt, Homo sapiens
acucaaaacucucaacaga

SEQ ID NO: 917460 - RNA, 19 nt, Homo sapiens
ggcaagaacguuuacuuac

SEQ ID NO: 917461 - RNA, 19 nt, Homo sapiens
caaaugccuaacucaagaa

SEQ ID NO: 917462 - RNA, 19 nt, Homo sapiens
uugaucaaauugcuagaga

SEQ ID NO: 917463 - RNA, 19 nt, Homo sapiens
aaaccaagagccauuccaa

SEQ ID NO: 917464 - RNA, 19 nt, Homo sapiens
ggcacuauuuaaccauguu

SEQ ID NO: 917465 - RNA, 19 nt, Homo sapiens
uuauuacaguuccucauuc

SEQ ID NO: 917466 - RNA, 19 nt, Homo sapiens
cuucauagcccguuucaac

SEQ ID NO: 917467 - RNA, 19 nt, Homo sapiens
uuacuuacacaucuucaug

SEQ ID NO: 917468 - RNA, 19 nt, Homo sapiens
aaaugggcaagaacguuua

SEQ ID NO: 917469 - RNA, 19 nt, Homo sapiens
uuacuguucugagcaacuu

SEQ ID NO: 917470 - RNA, 19 nt, Homo sapiens
gucaagcagcaccuucaua

SEQ ID NO: 917471 - RNA, 19 nt, Homo sapiens
caaguugcaagguauucaa

SEQ ID NO: 917472 - RNA, 19 nt, Homo sapiens
ggaaccaccauaaaacaaa

SEQ ID NO: 917473 - RNA, 19 nt, Homo sapiens
uugaagcaauuuacucagu

SEQ ID NO: 917474 - RNA, 19 nt, Homo sapiens
gaaaugcacaaaguuccau

SEQ ID NO: 917475 - RNA, 19 nt, Homo sapiens
guugcaagguauucaaggu

SEQ ID NO: 917476 - RNA, 19 nt, Homo sapiens
ccgauuagcaagcuuucaa

SEQ ID NO: 917477 - RNA, 19 nt, Homo sapiens
aaacccaccguuaccaaga

SEQ ID NO: 917478 - RNA, 19 nt, Homo sapiens
accuauauauggccuaaau

SEQ ID NO: 917479 - RNA, 19 nt, Homo sapiens
augccuaacucaagaaucu

SEQ ID NO: 917480 - RNA, 19 nt, Homo sapiens
ggauuaacuccagaaagga

SEQ ID NO: 917481 - RNA, 19 nt, Homo sapiens
gccauuugcacauucuuau

SEQ ID NO: 917482 - RNA, 19 nt, Homo sapiens
uaccaguucucaaauuacu

SEQ ID NO: 917483 - RNA, 19 nt, Homo sapiens
gcuuucaaaugccuaacuc

SEQ ID NO: 917484 - RNA, 19 nt, Homo sapiens
cugccacgcuuucaaaugc

SEQ ID NO: 917485 - RNA, 19 nt, Homo sapiens
uuaccaagaaugcacaaau

SEQ ID NO: 917486 - RNA, 19 nt, Homo sapiens
caagaugcugcggccauuu

SEQ ID NO: 917487 - RNA, 19 nt, Homo sapiens
ggucacaucuuauuguuua

SEQ ID NO: 917488 - RNA, 19 nt, Homo sapiens
gaaggugauugucuaaaua

SEQ ID NO: 917489 - RNA, 19 nt, Homo sapiens
ggacagcucucauauuguu

SEQ ID NO: 917490 - RNA, 19 nt, Homo sapiens
gauacugucuucuagaaua

SEQ ID NO: 917491 - RNA, 19 nt, Homo sapiens
ccucuaaucugaauaguaa

SEQ ID NO: 917492 - RNA, 19 nt, Homo sapiens
uggcaaaucugacaaacua

SEQ ID NO: 917493 - RNA, 19 nt, Homo sapiens
guggacagcucucauauug

SEQ ID NO: 917494 - RNA, 19 nt, Homo sapiens
guuuaaaccugauguauug

SEQ ID NO: 917495 - RNA, 19 nt, Homo sapiens
uuaaacaccucuaaucuga

SEQ ID NO: 917496 - RNA, 19 nt, Homo sapiens
ucucuaaccuuguuucuuu

SEQ ID NO: 917497 - RNA, 19 nt, Homo sapiens
gagcuuguaucguaacauu

SEQ ID NO: 917498 - RNA, 19 nt, Homo sapiens
gagaauauauacgacauga

SEQ ID NO: 917499 - RNA, 19 nt, Homo sapiens
ucccagagauacuuauuua

SEQ ID NO: 917500 - RNA, 19 nt, Homo sapiens
gguauaggcugcugucuca

SEQ ID NO: 917501 - RNA, 19 nt, Homo sapiens
ccacauuuccuauugauuu

SEQ ID NO: 917502 - RNA, 19 nt, Homo sapiens
ggagccacauuuccuauug

SEQ ID NO: 917503 - RNA, 19 nt, Homo sapiens
acucugggauuacuauuua

SEQ ID NO: 917504 - RNA, 19 nt, Homo sapiens
guaaagggacaucaguaua

SEQ ID NO: 917505 - RNA, 19 nt, Homo sapiens
caguauaucuggaucauca

SEQ ID NO: 917506 - RNA, 19 nt, Homo sapiens
gagauuggagugaagauuu

SEQ ID NO: 917507 - RNA, 19 nt, Homo sapiens
gccaaguuauagacauuua

SEQ ID NO: 917508 - RNA, 19 nt, Homo sapiens
cagagguucuugacaguuu

SEQ ID NO: 917509 - RNA, 19 nt, Homo sapiens
uagaauagcuacucugucu

SEQ ID NO: 917510 - RNA, 19 nt, Homo sapiens
uaucaugucuuguuuacug

SEQ ID NO: 917511 - RNA, 19 nt, Homo sapiens
gaaaguaguauucuuaagg

SEQ ID NO: 917512 - RNA, 19 nt, Homo sapiens
aaguaaagcuucagcagaa

SEQ ID NO: 917513 - RNA, 19 nt, Homo sapiens
gcaaaucugacaaacuauu

SEQ ID NO: 917514 - RNA, 19 nt, Homo sapiens
ggguauauaugguaacaug

SEQ ID NO: 917515 - RNA, 19 nt, Homo sapiens
uaaagggacaucaguauau

SEQ ID NO: 917516 - RNA, 19 nt, Homo sapiens
cuacuugauuucugucuuu

SEQ ID NO: 917517 - RNA, 19 nt, Homo sapiens
guguagagauaaugaggua

SEQ ID NO: 917518 - RNA, 19 nt, Homo sapiens
cauauuccuuguugaacua

SEQ ID NO: 917519 - RNA, 19 nt, Homo sapiens
gagauauguuuggcuaauu

SEQ ID NO: 917520 - RNA, 19 nt, Homo sapiens
ggagugaagauuucuguga

SEQ ID NO: 917521 - RNA, 19 nt, Homo sapiens
aaacaccucuaaucugaau

SEQ ID NO: 917522 - RNA, 19 nt, Homo sapiens
gaaacgcuguucauuuacu

SEQ ID NO: 917523 - RNA, 19 nt, Homo sapiens
gugauacugucuucuagaa

SEQ ID NO: 917524 - RNA, 19 nt, Homo sapiens
guaaagcuucagcagaaua

SEQ ID NO: 917525 - RNA, 19 nt, Homo sapiens
gaauagcuacucugucuuc

SEQ ID NO: 917526 - RNA, 19 nt, Homo sapiens
uuacagguaucucugcauu

SEQ ID NO: 917527 - RNA, 19 nt, Homo sapiens
gagccacauuuccuauuga

SEQ ID NO: 917528 - RNA, 19 nt, Homo sapiens
uaaccuuguuucuuucuga

SEQ ID NO: 917529 - RNA, 19 nt, Homo sapiens
guagugauacugucuucua

SEQ ID NO: 917530 - RNA, 19 nt, Homo sapiens
ggaauccugacuuuaauau

SEQ ID NO: 917531 - RNA, 19 nt, Homo sapiens
ggaauccugacuuuaauau

SEQ ID NO: 917532 - RNA, 19 nt, Homo sapiens
agaaggugauugucuaaau

SEQ ID NO: 917533 - RNA, 19 nt, Homo sapiens
gauuugaucacaccuuauu

SEQ ID NO: 917534 - RNA, 19 nt, Homo sapiens
ugaaugcuuucccaucuug

SEQ ID NO: 917535 - RNA, 19 nt, Homo sapiens
cagaauagggcuuuguuga

SEQ ID NO: 917536 - RNA, 19 nt, Homo sapiens
gcugcugucucaugucuug

SEQ ID NO: 917537 - RNA, 19 nt, Homo sapiens
gcuguucauuuacuuguug

SEQ ID NO: 917538 - RNA, 19 nt, Homo sapiens
cagccaaguuauagacauu

SEQ ID NO: 917539 - RNA, 19 nt, Homo sapiens
cagacuagaucauccgaau

SEQ ID NO: 917540 - RNA, 19 nt, Homo sapiens
ugaguuaagcaacaguuua

SEQ ID NO: 917541 - RNA, 19 nt, Homo sapiens
ugaaacaggacaccacaaa

SEQ ID NO: 917542 - RNA, 19 nt, Homo sapiens
ggacuacuuuggcacuaca

SEQ ID NO: 917543 - RNA, 19 nt, Homo sapiens
guaagcagaugggacuuca

SEQ ID NO: 917544 - RNA, 19 nt, Homo sapiens
ccagagauacuuauuuaca

SEQ ID NO: 917545 - RNA, 19 nt, Homo sapiens
gcaagugucuguguuucuc

SEQ ID NO: 917546 - RNA, 19 nt, Homo sapiens
uauauucuuuggagaguug

SEQ ID NO: 917547 - RNA, 19 nt, Homo sapiens
gacaaacuauugaccuucu

SEQ ID NO: 917548 - RNA, 19 nt, Homo sapiens
uagcuacucugucuucauc

SEQ ID NO: 917549 - RNA, 19 nt, Homo sapiens
ccagauuggacauauguaa

SEQ ID NO: 917550 - RNA, 19 nt, Homo sapiens
caaccugccucugagaugu

SEQ ID NO: 917551 - RNA, 19 nt, Homo sapiens
gacauacucugagauugga

SEQ ID NO: 917552 - RNA, 19 nt, Homo sapiens
uuauuucccugcugcuuaa

SEQ ID NO: 917553 - RNA, 19 nt, Homo sapiens
aagaauaaccuuagaagca

SEQ ID NO: 917554 - RNA, 19 nt, Homo sapiens
caaaucugacaaacuauug

SEQ ID NO: 917555 - RNA, 19 nt, Homo sapiens
ggaaugcucauccauaugc

SEQ ID NO: 917556 - RNA, 19 nt, Homo sapiens
cauguuaguucucuucaag

SEQ ID NO: 917557 - RNA, 19 nt, Homo sapiens
gacccugucagaauugaua

SEQ ID NO: 917558 - RNA, 19 nt, Homo sapiens
gacccugucagaauugaua

SEQ ID NO: 917559 - RNA, 19 nt, Homo sapiens
cccagaaggugauugucua

SEQ ID NO: 917560 - RNA, 19 nt, Homo sapiens
aguaauaccaucagcagua

SEQ ID NO: 917561 - RNA, 19 nt, Homo sapiens
guauugcucucccagaaag

SEQ ID NO: 917562 - RNA, 19 nt, Homo sapiens
ucuauugccuggcuucuuc

SEQ ID NO: 917563 - RNA, 19 nt, Homo sapiens
gaauucaggcuggguuuau

SEQ ID NO: 917564 - RNA, 19 nt, Homo sapiens
gacuagaucauccgaauca

SEQ ID NO: 917565 - RNA, 19 nt, Homo sapiens
uggaugaguuacuguguga

SEQ ID NO: 917566 - RNA, 19 nt, Homo sapiens
uggaugaguuacuguguga

SEQ ID NO: 917567 - RNA, 19 nt, Homo sapiens
ucagcaguauguccuagaa

SEQ ID NO: 917568 - RNA, 19 nt, Homo sapiens
acagguaucucugcauuag

SEQ ID NO: 917569 - RNA, 19 nt, Homo sapiens
gucaguaagaugauugaua

SEQ ID NO: 917570 - RNA, 19 nt, Homo sapiens
gcuuguaucguaacauuau

SEQ ID NO: 917571 - RNA, 19 nt, Homo sapiens
cacauuuccuauugauuug

SEQ ID NO: 917572 - RNA, 19 nt, Homo sapiens
uuugugaucuuacagguau

SEQ ID NO: 917573 - RNA, 19 nt, Homo sapiens
agauauguuuggcuaauuc

SEQ ID NO: 917574 - RNA, 19 nt, Homo sapiens
guugucagguuuauauucu

SEQ ID NO: 917575 - RNA, 19 nt, Homo sapiens
gcagaauagggcuuuguug

SEQ ID NO: 917576 - RNA, 19 nt, Homo sapiens
uauucugacucugggauua

SEQ ID NO: 917577 - RNA, 19 nt, Homo sapiens
gauguagccuauucugacu

SEQ ID NO: 917578 - RNA, 19 nt, Homo sapiens
gggcuuuguugaccuguuc

SEQ ID NO: 917579 - RNA, 19 nt, Homo sapiens
uuaagacccugacauacuc

SEQ ID NO: 917580 - RNA, 19 nt, Homo sapiens
gcagugugggucaguaaga

SEQ ID NO: 917581 - RNA, 19 nt, Homo sapiens
gcagaugggacuucauuuu

SEQ ID NO: 917582 - RNA, 19 nt, Homo sapiens
aaagggacaucaguauauc

SEQ ID NO: 917583 - RNA, 19 nt, Homo sapiens
gagaauucaggcuggguuu

SEQ ID NO: 917584 - RNA, 19 nt, Homo sapiens
cuucucccaucuuggaaua

SEQ ID NO: 917585 - RNA, 19 nt, Homo sapiens
agagauauguuuggcuaau

SEQ ID NO: 917586 - RNA, 19 nt, Homo sapiens
aaacgcuguucauuuacuu

SEQ ID NO: 917587 - RNA, 19 nt, Homo sapiens
ccaaaucccugacuucuua

SEQ ID NO: 917588 - RNA, 19 nt, Homo sapiens
gcaaauauuucaaguugug

SEQ ID NO: 917589 - RNA, 19 nt, Homo sapiens
ccacuuugauugcuaauuu

SEQ ID NO: 917590 - RNA, 19 nt, Homo sapiens
uaacagugcuuaacacaau

SEQ ID NO: 917591 - RNA, 19 nt, Homo sapiens
gaaaggcauuggauuuaga

SEQ ID NO: 917592 - RNA, 19 nt, Homo sapiens
guagaucacuguaguacuu

SEQ ID NO: 917593 - RNA, 19 nt, Homo sapiens
aaucacagcuaaugaguaa

SEQ ID NO: 917594 - RNA, 19 nt, Homo sapiens
aaccacagcugauucuuua

SEQ ID NO: 917595 - RNA, 19 nt, Homo sapiens
ggaaacagguauucuuaag

SEQ ID NO: 917596 - RNA, 19 nt, Homo sapiens
cauaauacaucaucucuag

SEQ ID NO: 917597 - RNA, 19 nt, Homo sapiens
gcucuccucuccuccaaua

SEQ ID NO: 917598 - RNA, 19 nt, Homo sapiens
uccaauagcuuacuucaga

SEQ ID NO: 917599 - RNA, 19 nt, Homo sapiens
gaaaaugggugagugaaaa

SEQ ID NO: 917600 - RNA, 19 nt, Homo sapiens
gaagcauccugcccagaaa

SEQ ID NO: 917601 - RNA, 19 nt, Homo sapiens
guacuugcuuccuaagaaa

SEQ ID NO: 917602 - RNA, 19 nt, Homo sapiens
ggagauguucuuacucuaa

SEQ ID NO: 917603 - RNA, 19 nt, Homo sapiens
gauccucaguuucuugauu

SEQ ID NO: 917604 - RNA, 19 nt, Homo sapiens
gaucuuauccuaaaugagu

SEQ ID NO: 917605 - RNA, 19 nt, Homo sapiens
uaaaaugacugccaugaaa

SEQ ID NO: 917606 - RNA, 19 nt, Homo sapiens
gacaaguucuaaucucuau

SEQ ID NO: 917607 - RNA, 19 nt, Homo sapiens
ucccuugucugcuuucuua

SEQ ID NO: 917608 - RNA, 19 nt, Homo sapiens
gaagguaggaguagcaugu

SEQ ID NO: 917609 - RNA, 19 nt, Homo sapiens
gauguguacuugcuuccua

SEQ ID NO: 917610 - RNA, 19 nt, Homo sapiens
ccacuuugcucuuccuaga

SEQ ID NO: 917611 - RNA, 19 nt, Homo sapiens
caucaucucuaguccuuug

SEQ ID NO: 917612 - RNA, 19 nt, Homo sapiens
guccugaucuggaacugua

SEQ ID NO: 917613 - RNA, 19 nt, Homo sapiens
ucagauggauuugcagaaa

SEQ ID NO: 917614 - RNA, 19 nt, Homo sapiens
agagaaggauagagaggua

SEQ ID NO: 917615 - RNA, 19 nt, Homo sapiens
ggaagcuuaucuauggaaa

SEQ ID NO: 917616 - RNA, 19 nt, Homo sapiens
gugcugcccuuuaguauag

SEQ ID NO: 917617 - RNA, 19 nt, Homo sapiens
aagggaagcuuaucuaugg

SEQ ID NO: 917618 - RNA, 19 nt, Homo sapiens
guacccaucucccauaucu

SEQ ID NO: 917619 - RNA, 19 nt, Homo sapiens
caugaaaggcauuggauuu

SEQ ID NO: 917620 - RNA, 19 nt, Homo sapiens
ggacaaguucuaaucucua

SEQ ID NO: 917621 - RNA, 19 nt, Homo sapiens
ggcauuggauuuagaguca

SEQ ID NO: 917622 - RNA, 19 nt, Homo sapiens
gaugugugcugcccuuuag

SEQ ID NO: 917623 - RNA, 19 nt, Homo sapiens
ugaauuggcuguuuuaguu

SEQ ID NO: 917624 - RNA, 19 nt, Homo sapiens
gcuugcaucugccaucauu

SEQ ID NO: 917625 - RNA, 19 nt, Homo sapiens
guggauucuuucagaguua

SEQ ID NO: 917626 - RNA, 19 nt, Homo sapiens
cagugcagcugaguacaua

SEQ ID NO: 917627 - RNA, 19 nt, Homo sapiens
caaguucuaaucucuauga

SEQ ID NO: 917628 - RNA, 19 nt, Homo sapiens
gcaaaguccuagguacugu

SEQ ID NO: 917629 - RNA, 19 nt, Homo sapiens
uuacccaaaugcuguuuaa

SEQ ID NO: 917630 - RNA, 19 nt, Homo sapiens
gaaauucaugauccuaaga

SEQ ID NO: 917631 - RNA, 19 nt, Homo sapiens
gaaucacagcuaaugagua

SEQ ID NO: 917632 - RNA, 19 nt, Homo sapiens
cagguauucuuaaguauag

SEQ ID NO: 917633 - RNA, 19 nt, Homo sapiens
uuacugguguccacuuuga

SEQ ID NO: 917634 - RNA, 19 nt, Homo sapiens
gugcuuaacacaaugguuu

SEQ ID NO: 917635 - RNA, 19 nt, Homo sapiens
ggauuuagagucagaguuc

SEQ ID NO: 917636 - RNA, 19 nt, Homo sapiens
ggaugugugcugcccuuua

SEQ ID NO: 917637 - RNA, 19 nt, Homo sapiens
ucucuaugauccucaguuu

SEQ ID NO: 917638 - RNA, 19 nt, Homo sapiens
uaaccacagcugauucuuu

SEQ ID NO: 917639 - RNA, 19 nt, Homo sapiens
guacuauguucucaucauc

SEQ ID NO: 917640 - RNA, 19 nt, Homo sapiens
caaaccauccaaucucuug

SEQ ID NO: 917641 - RNA, 19 nt, Homo sapiens
gaaacagguauucuuaagu

SEQ ID NO: 917642 - RNA, 19 nt, Homo sapiens
ugacuuguaugccauugga

SEQ ID NO: 917643 - RNA, 19 nt, Homo sapiens
ugaaaggcauuggauuuag

SEQ ID NO: 917644 - RNA, 19 nt, Homo sapiens
gaauauaauguuccagcuu

SEQ ID NO: 917645 - RNA, 19 nt, Homo sapiens
cuagaguccugaucuggaa

SEQ ID NO: 917646 - RNA, 19 nt, Homo sapiens
ccgacuaccuuagaaauuc

SEQ ID NO: 917647 - RNA, 19 nt, Homo sapiens
uuaugugccugucuaagaa

SEQ ID NO: 917648 - RNA, 19 nt, Homo sapiens
ugaacgcacuguacaugug

SEQ ID NO: 917649 - RNA, 19 nt, Homo sapiens
gcuuacugguguccacuuu

SEQ ID NO: 917650 - RNA, 19 nt, Homo sapiens
cauccaaucucuuguaagc

SEQ ID NO: 917651 - RNA, 19 nt, Homo sapiens
cauacagccuuggaacaaa

SEQ ID NO: 917652 - RNA, 19 nt, Homo sapiens
gaaaagagucacuaaguca

SEQ ID NO: 917653 - RNA, 19 nt, Homo sapiens
cuuccuagaugaauacguu

SEQ ID NO: 917654 - RNA, 19 nt, Homo sapiens
uguacuugcuuccuaagaa

SEQ ID NO: 917655 - RNA, 19 nt, Homo sapiens
cuaagucaguauucguuga

SEQ ID NO: 917656 - RNA, 19 nt, Homo sapiens
cgacuaccuuagaaauuca

SEQ ID NO: 917657 - RNA, 19 nt, Homo sapiens
ccugacuucuuaaugcuaa

SEQ ID NO: 917658 - RNA, 19 nt, Homo sapiens
gggagauguucuuacucua

SEQ ID NO: 917659 - RNA, 19 nt, Homo sapiens
agacucagauggauuugca

SEQ ID NO: 917660 - RNA, 19 nt, Homo sapiens
cacagggucuuucuagcuu

SEQ ID NO: 917661 - RNA, 19 nt, Homo sapiens
uccaaucucuuguaagcaa

SEQ ID NO: 917662 - RNA, 19 nt, Homo sapiens
cgcuuuggcuugacuugua

SEQ ID NO: 917663 - RNA, 19 nt, Homo sapiens
guacaugugcugagagaag

SEQ ID NO: 917664 - RNA, 19 nt, Homo sapiens
gcuuaucuauggaaaagua

SEQ ID NO: 917665 - RNA, 19 nt, Homo sapiens
uacaucaucucuaguccuu

SEQ ID NO: 917666 - RNA, 19 nt, Homo sapiens
cuaaaugaguguuauugac

SEQ ID NO: 917667 - RNA, 19 nt, Homo sapiens
gugaggauaugcaaaccau

SEQ ID NO: 917668 - RNA, 19 nt, Homo sapiens
gagaaucacagcuaaugag

SEQ ID NO: 917669 - RNA, 19 nt, Homo sapiens
ucaguuucuugauugguaa

SEQ ID NO: 917670 - RNA, 19 nt, Homo sapiens
aagagucacuaagucagua

SEQ ID NO: 917671 - RNA, 19 nt, Homo sapiens
caaaaugccugcuuacacu

SEQ ID NO: 917672 - RNA, 19 nt, Homo sapiens
ccacaguucccaccuuugu

SEQ ID NO: 917673 - RNA, 19 nt, Homo sapiens
guaaguggcuuuucugaac

SEQ ID NO: 917674 - RNA, 19 nt, Homo sapiens
ugacacagggucuuucuag

SEQ ID NO: 917675 - RNA, 19 nt, Homo sapiens
gguguacccaucucccaua

SEQ ID NO: 917676 - RNA, 19 nt, Homo sapiens
acagggucuuucuagcuua

SEQ ID NO: 917677 - RNA, 19 nt, Homo sapiens
auagcuuacuucagacuuu

SEQ ID NO: 917678 - RNA, 19 nt, Homo sapiens
uuagggagauguucuuacu

SEQ ID NO: 917679 - RNA, 19 nt, Homo sapiens
gaccucaggacaaguucua

SEQ ID NO: 917680 - RNA, 19 nt, Homo sapiens
gaucuggaacuguaauucu

SEQ ID NO: 917681 - RNA, 19 nt, Homo sapiens
guggaaaucuaugcagaca

SEQ ID NO: 917682 - RNA, 19 nt, Homo sapiens
gugccugucuaagaaauau

SEQ ID NO: 917683 - RNA, 19 nt, Homo sapiens
uguaguacuuacccaaaug

SEQ ID NO: 917684 - RNA, 19 nt, Homo sapiens
guaugccauuggaaucuga

SEQ ID NO: 917685 - RNA, 19 nt, Homo sapiens
guuauuccaucccuugucu

SEQ ID NO: 917686 - RNA, 19 nt, Homo sapiens
agaagcauccugcccagaa

SEQ ID NO: 917687 - RNA, 19 nt, Homo sapiens
ggaaauggauucaugaaau

SEQ ID NO: 917688 - RNA, 19 nt, Homo sapiens
gaaaguaacucugacauag

SEQ ID NO: 917689 - RNA, 19 nt, Homo sapiens
gaacugaaaucuugugaag

SEQ ID NO: 917690 - RNA, 19 nt, Homo sapiens
gccaaggacuaauauaaua

SEQ ID NO: 917691 - RNA, 19 nt, Homo sapiens
gccaaggacuaauauaaua

SEQ ID NO: 917692 - RNA, 19 nt, Homo sapiens
gccaaggacuaauauaaua

SEQ ID NO: 917693 - RNA, 19 nt, Homo sapiens
gccaaggacuaauauaaua

SEQ ID NO: 917694 - RNA, 19 nt, Homo sapiens
gccaaggacuaauauaaua

SEQ ID NO: 917695 - RNA, 19 nt, Homo sapiens
gccaaggacuaauauaaua

SEQ ID NO: 917696 - RNA, 19 nt, Homo sapiens
gccaaggacuaauauaaua

SEQ ID NO: 917697 - RNA, 19 nt, Homo sapiens
gagaaaguauguccaagaa

SEQ ID NO: 917698 - RNA, 19 nt, Homo sapiens
caacauaguucaggaaguu

SEQ ID NO: 917699 - RNA, 19 nt, Homo sapiens
caagaaacaucaccaagga

SEQ ID NO: 917700 - RNA, 19 nt, Homo sapiens
gaaaguauguccaagaaac

SEQ ID NO: 917701 - RNA, 19 nt, Homo sapiens
gaaauaacuaggucucaua

SEQ ID NO: 917702 - RNA, 19 nt, Homo sapiens
gcuauggucugaauauuug

SEQ ID NO: 917703 - RNA, 19 nt, Homo sapiens
gacaagcucuuucucuauu

SEQ ID NO: 917704 - RNA, 19 nt, Homo sapiens
uaagucaggugcucuguuu

SEQ ID NO: 917705 - RNA, 19 nt, Homo sapiens
gccaaggacuaauauaauu

SEQ ID NO: 917706 - RNA, 19 nt, Homo sapiens
acugaaaucuugugaagua

SEQ ID NO: 917707 - RNA, 19 nt, Homo sapiens
aaacugagauguguagauu

SEQ ID NO: 917708 - RNA, 19 nt, Homo sapiens
caagcucuuucucuauuua

SEQ ID NO: 917709 - RNA, 19 nt, Homo sapiens
ggaaauccuucuuaacuac

SEQ ID NO: 917710 - RNA, 19 nt, Homo sapiens
gaaacccaaucccuaguau

SEQ ID NO: 917711 - RNA, 19 nt, Homo sapiens
gaaaucuugugaaguagga

SEQ ID NO: 917712 - RNA, 19 nt, Homo sapiens
gaacugaugccugaacuga

SEQ ID NO: 917713 - RNA, 19 nt, Homo sapiens
uaacuaggucucauacaua

SEQ ID NO: 917714 - RNA, 19 nt, Homo sapiens
agacaacuaugcauuaugu

SEQ ID NO: 917715 - RNA, 19 nt, Homo sapiens
ggcagaacauaaucucuuu

SEQ ID NO: 917716 - RNA, 19 nt, Homo sapiens
agacacaaaugaccacuug

SEQ ID NO: 917717 - RNA, 19 nt, Homo sapiens
gaaguacaaugcaaacaac

SEQ ID NO: 917718 - RNA, 19 nt, Homo sapiens
ucaccaaggacuaauauaa

SEQ ID NO: 917719 - RNA, 19 nt, Homo sapiens
ucaccaaggacuaauauaa

SEQ ID NO: 917720 - RNA, 19 nt, Homo sapiens
ggaaguacaaugcaaacaa

SEQ ID NO: 917721 - RNA, 19 nt, Homo sapiens
ggagaaaguauguccaaga

SEQ ID NO: 917722 - RNA, 19 nt, Homo sapiens
cggcugaucugacacaaga

SEQ ID NO: 917723 - RNA, 19 nt, Homo sapiens
gcucugcccucaugaaugg

SEQ ID NO: 917724 - RNA, 19 nt, Homo sapiens
ucacacacuuagacaacua

SEQ ID NO: 917725 - RNA, 19 nt, Homo sapiens
guacaaugcaaacaacaaa

SEQ ID NO: 917726 - RNA, 19 nt, Homo sapiens
gaauuaaugagcaugcaaa

SEQ ID NO: 917727 - RNA, 19 nt, Homo sapiens
caaaugaccacuugcuaug

SEQ ID NO: 917728 - RNA, 19 nt, Homo sapiens
ugccugaacugaaaucuug

SEQ ID NO: 917729 - RNA, 19 nt, Homo sapiens
ugaaaguaacucugacaua

SEQ ID NO: 917730 - RNA, 19 nt, Homo sapiens
ugcaauaacugaauagaca

SEQ ID NO: 917731 - RNA, 19 nt, Homo sapiens
uguuacagcucuccaaaug

SEQ ID NO: 917732 - RNA, 19 nt, Homo sapiens
gacacaagaugauaugcau

SEQ ID NO: 917733 - RNA, 19 nt, Homo sapiens
acaaggcucugcccucaug

SEQ ID NO: 917734 - RNA, 19 nt, Homo sapiens
aaacaucaccaaggacuaa

SEQ ID NO: 917735 - RNA, 19 nt, Homo sapiens
ggaguuaggaaguacaaug

SEQ ID NO: 917736 - RNA, 19 nt, Homo sapiens
gguacuagacauauaauca

SEQ ID NO: 917737 - RNA, 19 nt, Homo sapiens
uuucuaagccucccaguuu

SEQ ID NO: 917738 - RNA, 19 nt, Homo sapiens
gaaguaggaguuaggaagu

SEQ ID NO: 917739 - RNA, 19 nt, Homo sapiens
uucauuagcucccaguaaa

SEQ ID NO: 917740 - RNA, 19 nt, Homo sapiens
acugaugccugaacugaaa

SEQ ID NO: 917741 - RNA, 19 nt, Homo sapiens
gaaacaucaccaaggacua

SEQ ID NO: 917742 - RNA, 19 nt, Homo sapiens
acaccaagaucaaagucaa

SEQ ID NO: 917743 - RNA, 19 nt, Homo sapiens
acacacacauacaccaaga

SEQ ID NO: 917744 - RNA, 19 nt, Homo sapiens
gguaacccaucacacacuu

SEQ ID NO: 917745 - RNA, 19 nt, Homo sapiens
aagaugauaugcauugaca

SEQ ID NO: 917746 - RNA, 19 nt, Homo sapiens
acugcuaguucuaucuuua

SEQ ID NO: 917747 - RNA, 19 nt, Homo sapiens
uugacaagcucuuucucua

SEQ ID NO: 917748 - RNA, 19 nt, Homo sapiens
guuaggaaguacaaugcaa

SEQ ID NO: 917749 - RNA, 19 nt, Homo sapiens
ugagaaggcagaacauaau

SEQ ID NO: 917750 - RNA, 19 nt, Homo sapiens
ugggauuggugcccugaua

SEQ ID NO: 917751 - RNA, 19 nt, Homo sapiens
gcaacauaguucaggaagu

SEQ ID NO: 917752 - RNA, 19 nt, Homo sapiens
uacaaaguaucgccaagga

SEQ ID NO: 917753 - RNA, 19 nt, Homo sapiens
uacaaaguaucgccaagga

SEQ ID NO: 917754 - RNA, 19 nt, Homo sapiens
uacaaaguaucgccaagga

SEQ ID NO: 917755 - RNA, 19 nt, Homo sapiens
uacaaaguaucgccaagga

SEQ ID NO: 917756 - RNA, 19 nt, Homo sapiens
uacaaaguaucgccaagga

SEQ ID NO: 917757 - RNA, 19 nt, Homo sapiens
uacaaaguaucgccaagga

SEQ ID NO: 917758 - RNA, 19 nt, Homo sapiens
acacauacaccaagaucaa

SEQ ID NO: 917759 - RNA, 19 nt, Homo sapiens
cuuagacaacuaugcauua

SEQ ID NO: 917760 - RNA, 19 nt, Homo sapiens
acaagcucuuucucuauuu

SEQ ID NO: 917761 - RNA, 19 nt, Homo sapiens
caaagucucagguccaaca

SEQ ID NO: 917762 - RNA, 19 nt, Homo sapiens
ggcaaagucucagguccaa

SEQ ID NO: 917763 - RNA, 19 nt, Homo sapiens
auaacuaggucucauacau

SEQ ID NO: 917764 - RNA, 19 nt, Homo sapiens
ugaaacccaaucccuagua

SEQ ID NO: 917765 - RNA, 19 nt, Homo sapiens
cacaagaugauaugcauug

SEQ ID NO: 917766 - RNA, 19 nt, Homo sapiens
ucgccaaggacuaauauaa

SEQ ID NO: 917767 - RNA, 19 nt, Homo sapiens
aaauaucgccaaggacuaa

SEQ ID NO: 917768 - RNA, 19 nt, Homo sapiens
ucgccaaggacuaauauaa

SEQ ID NO: 917769 - RNA, 19 nt, Homo sapiens
ucgccaaggacuaauauaa

SEQ ID NO: 917770 - RNA, 19 nt, Homo sapiens
ucgccaaggacuaauauaa

SEQ ID NO: 917771 - RNA, 19 nt, Homo sapiens
ucgccaaggacuaauauaa

SEQ ID NO: 917772 - RNA, 19 nt, Homo sapiens
ucgccaaggacuaauauaa

SEQ ID NO: 917773 - RNA, 19 nt, Homo sapiens
ucgccaaggacuaauauaa

SEQ ID NO: 917774 - RNA, 19 nt, Homo sapiens
ucgccaaggacuaauauaa

SEQ ID NO: 917775 - RNA, 19 nt, Homo sapiens
ugacaagcucuuucucuau

SEQ ID NO: 917776 - RNA, 19 nt, Homo sapiens
aaauaucgccaaggacuaa

SEQ ID NO: 917777 - RNA, 19 nt, Homo sapiens
gaugauaugcauugacaag

SEQ ID NO: 917778 - RNA, 19 nt, Homo sapiens
caccaaggacuaauauaau

SEQ ID NO: 917779 - RNA, 19 nt, Homo sapiens
caccaaggacuaauauaau

SEQ ID NO: 917780 - RNA, 19 nt, Homo sapiens
ucacagggagucauuaaag

SEQ ID NO: 917781 - RNA, 19 nt, Homo sapiens
uauuacuacugaagaggua

SEQ ID NO: 917782 - RNA, 19 nt, Homo sapiens
gauaagagaccuggcuagu

SEQ ID NO: 917783 - RNA, 19 nt, Homo sapiens
ggcaagggcgagucauaaa

SEQ ID NO: 917784 - RNA, 19 nt, Homo sapiens
uaguggaaauggauucaug

SEQ ID NO: 917785 - RNA, 19 nt, Homo sapiens
gggauuggugcccugauaa

SEQ ID NO: 917786 - RNA, 19 nt, Homo sapiens
cccaaucccuaguaugaug

SEQ ID NO: 917787 - RNA, 19 nt, Homo sapiens
caaagucucagcauuauua

SEQ ID NO: 917788 - RNA, 19 nt, Homo sapiens
ggaccaggaugaacaaauu

SEQ ID NO: 917789 - RNA, 19 nt, Homo sapiens
gaagacaaaugcagaguag

SEQ ID NO: 917790 - RNA, 19 nt, Homo sapiens
gagagaggaugcaauguga

SEQ ID NO: 917791 - RNA, 19 nt, Homo sapiens
aaacaccaguugucauaua

SEQ ID NO: 917792 - RNA, 19 nt, Homo sapiens
gaagguaacagaaaggaaa

SEQ ID NO: 917793 - RNA, 19 nt, Homo sapiens
guacaaaugcagagaauga

SEQ ID NO: 917794 - RNA, 19 nt, Homo sapiens
guagccagauuauauaaga

SEQ ID NO: 917795 - RNA, 19 nt, Homo sapiens
ggaauagcauguuuguugu

SEQ ID NO: 917796 - RNA, 19 nt, Homo sapiens
gaaugaagguaacagaaag

SEQ ID NO: 917797 - RNA, 19 nt, Homo sapiens
auacaaagucucagcauua

SEQ ID NO: 917798 - RNA, 19 nt, Homo sapiens
gcucaugccuguaauagca

SEQ ID NO: 917799 - RNA, 19 nt, Homo sapiens
gcacauacacggaauagca

SEQ ID NO: 917800 - RNA, 19 nt, Homo sapiens
gcauggcacuggagcugua

SEQ ID NO: 917801 - RNA, 19 nt, Homo sapiens
guacaaaucugaaaaccuu

SEQ ID NO: 917802 - RNA, 19 nt, Homo sapiens
gcucacgccuguaaucuca

SEQ ID NO: 917803 - RNA, 19 nt, Homo sapiens
cggaauagcauguuuguug

SEQ ID NO: 917804 - RNA, 19 nt, Homo sapiens
gaacuugccauacugaauc

SEQ ID NO: 917805 - RNA, 19 nt, Homo sapiens
uuaaacaccaguugucaua

SEQ ID NO: 917806 - RNA, 19 nt, Homo sapiens
agucacuucugaaaucuua

SEQ ID NO: 917807 - RNA, 19 nt, Homo sapiens
cuucugaaaucuuacauga

SEQ ID NO: 917808 - RNA, 19 nt, Homo sapiens
ccuguaaucucagcacuuu

SEQ ID NO: 917809 - RNA, 19 nt, Homo sapiens
ucucagagcuguuacaaaa

SEQ ID NO: 917810 - RNA, 19 nt, Homo sapiens
gaccaggaugaacaaauua

SEQ ID NO: 917811 - RNA, 19 nt, Homo sapiens
gagaaugaagguaacagaa

SEQ ID NO: 917812 - RNA, 19 nt, Homo sapiens
uauacaaagucucagcauu

SEQ ID NO: 917813 - RNA, 19 nt, Homo sapiens
ggcaaaaccuauaugaaaa

SEQ ID NO: 917814 - RNA, 19 nt, Homo sapiens
guaaaguagccagauuaua

SEQ ID NO: 917815 - RNA, 19 nt, Homo sapiens
caaaugcagaguagaaaug

SEQ ID NO: 917816 - RNA, 19 nt, Homo sapiens
gaauuguacacuucaaaug

SEQ ID NO: 917817 - RNA, 19 nt, Homo sapiens
cuggugauauuguuggaua

SEQ ID NO: 917818 - RNA, 19 nt, Homo sapiens
uaucugaacuugccauacu

SEQ ID NO: 917819 - RNA, 19 nt, Homo sapiens
uacaaagucucagcauuau

SEQ ID NO: 917820 - RNA, 19 nt, Homo sapiens
uuaguaaaguagccagauu

SEQ ID NO: 917821 - RNA, 19 nt, Homo sapiens
cugaaaaccuugaauugua

SEQ ID NO: 917822 - RNA, 19 nt, Homo sapiens
agacaaaugcagaguagaa

SEQ ID NO: 917823 - RNA, 19 nt, Homo sapiens
uaguaaaguagccagauua

SEQ ID NO: 917824 - RNA, 19 nt, Homo sapiens
uguaaucucagcacuuuaa

SEQ ID NO: 917825 - RNA, 19 nt, Homo sapiens
gguggugguuguacaaauc

SEQ ID NO: 917826 - RNA, 19 nt, Homo sapiens
gaaaugagagaggaugcaa

SEQ ID NO: 917827 - RNA, 19 nt, Homo sapiens
guacuugccaaaucuaaau

SEQ ID NO: 917828 - RNA, 19 nt, Homo sapiens
gggaugagcuuucuuuugg

SEQ ID NO: 917829 - RNA, 19 nt, Homo sapiens
agggagagguaauggcuaa

SEQ ID NO: 917830 - RNA, 19 nt, Homo sapiens
ugaggcaaaccaagacaua

SEQ ID NO: 917831 - RNA, 19 nt, Homo sapiens
agaaugaagguaacagaaa

SEQ ID NO: 917832 - RNA, 19 nt, Homo sapiens
ggguacaaaugcagagaau

SEQ ID NO: 917833 - RNA, 19 nt, Homo sapiens
gaauagcauguuuguuguu

SEQ ID NO: 917834 - RNA, 19 nt, Homo sapiens
ugcauuugcuggugauauu

SEQ ID NO: 917835 - RNA, 19 nt, Homo sapiens
gagauggugccacugcauu

SEQ ID NO: 917836 - RNA, 19 nt, Homo sapiens
gagagguaauggcuaaagg

SEQ ID NO: 917837 - RNA, 19 nt, Homo sapiens
caagacauacagagacaga

SEQ ID NO: 917838 - RNA, 19 nt, Homo sapiens
gagcuauacaaguuacaaa

SEQ ID NO: 917839 - RNA, 19 nt, Homo sapiens
ucauaucucagagcuguua

SEQ ID NO: 917840 - RNA, 19 nt, Homo sapiens
aaaccaagacauacagaga

SEQ ID NO: 917841 - RNA, 19 nt, Homo sapiens
gacaaaugcagaguagaaa

SEQ ID NO: 917842 - RNA, 19 nt, Homo sapiens
guuuuaaccugcuauguuu

SEQ ID NO: 917843 - RNA, 19 nt, Homo sapiens
cccuggagcuauacaaguu

SEQ ID NO: 917844 - RNA, 19 nt, Homo sapiens
gcaaaccaagacauacaga

SEQ ID NO: 917845 - RNA, 19 nt, Homo sapiens
gcaaugugaggcaaaccaa

SEQ ID NO: 917846 - RNA, 19 nt, Homo sapiens
gaaaacagaagacaaaugc

SEQ ID NO: 917847 - RNA, 19 nt, Homo sapiens
gauuaaacaccaguuguca

SEQ ID NO: 917848 - RNA, 19 nt, Homo sapiens
uaagauuaaacaccaguug

SEQ ID NO: 917849 - RNA, 19 nt, Homo sapiens
ugagagaggaugcaaugug

SEQ ID NO: 917850 - RNA, 19 nt, Homo sapiens
cuaaauggaccaggaugaa

SEQ ID NO: 917851 - RNA, 19 nt, Homo sapiens
agaagacaaaugcagagua

SEQ ID NO: 917852 - RNA, 19 nt, Homo sapiens
uaagucucccuccugagua

SEQ ID NO: 917853 - RNA, 19 nt, Homo sapiens
aagaaaagguaucuacaga

SEQ ID NO: 917854 - RNA, 19 nt, Homo sapiens
uaguaaggcugggcacugu

SEQ ID NO: 917855 - RNA, 19 nt, Homo sapiens
gaugagcuuucuuuuggaa

SEQ ID NO: 917856 - RNA, 19 nt, Homo sapiens
caaaaccccaucucuacua

SEQ ID NO: 917857 - RNA, 19 nt, Homo sapiens
uacacggaauagcauguuu

SEQ ID NO: 917858 - RNA, 19 nt, Homo sapiens
agacauacagagacagaga

SEQ ID NO: 917859 - RNA, 19 nt, Homo sapiens
aaugagagaggaugcaaug

SEQ ID NO: 917860 - RNA, 19 nt, Homo sapiens
uaacagaaaggaaaacaga

SEQ ID NO: 917861 - RNA, 19 nt, Homo sapiens
uggcaaaaccuauaugaaa

SEQ ID NO: 917862 - RNA, 19 nt, Homo sapiens
uguacuggcuguguggauu

SEQ ID NO: 917863 - RNA, 19 nt, Homo sapiens
augcagagaaugaagguaa

SEQ ID NO: 917864 - RNA, 19 nt, Homo sapiens
ggagcuauacaaguuacaa

SEQ ID NO: 917865 - RNA, 19 nt, Homo sapiens
aaccugcuauguuuuguua

SEQ ID NO: 917866 - RNA, 19 nt, Homo sapiens
gagauggagguugcaguga

SEQ ID NO: 917867 - RNA, 19 nt, Homo sapiens
aaccuugaauuguacacuu

SEQ ID NO: 917868 - RNA, 19 nt, Homo sapiens
ggagagguaauggcuaaag

SEQ ID NO: 917869 - RNA, 19 nt, Homo sapiens
cagaagcuacuggccauug

SEQ ID NO: 917870 - RNA, 19 nt, Homo sapiens
gcagaguagaaaugagaga

SEQ ID NO: 917871 - RNA, 19 nt, Homo sapiens
guacacuucaaaugacaau

SEQ ID NO: 917872 - RNA, 19 nt, Homo sapiens
aaaugcagaguagaaauga

SEQ ID NO: 917873 - RNA, 19 nt, Homo sapiens
gauuaugguggugguugua

SEQ ID NO: 917874 - RNA, 19 nt, Homo sapiens
ggaaaacagaagacaaaug

SEQ ID NO: 917875 - RNA, 19 nt, Homo sapiens
ggaugaacaaauuaagucu

SEQ ID NO: 917876 - RNA, 19 nt, Homo sapiens
gcagagaaugaagguaaca

SEQ ID NO: 917877 - RNA, 19 nt, Homo sapiens
caggaugaacaaauuaagu

SEQ ID NO: 917878 - RNA, 19 nt, Homo sapiens
ggaaaagggagagguaaug

SEQ ID NO: 917879 - RNA, 19 nt, Homo sapiens
gaugcaaugugaggcaaac

SEQ ID NO: 917880 - RNA, 19 nt, Homo sapiens
guacuggcuguguggauuc

SEQ ID NO: 917881 - RNA, 19 nt, Homo sapiens
aaaaccccaucucuacuaa

SEQ ID NO: 917882 - RNA, 19 nt, Homo sapiens
aaucucagcacuuuaagag

SEQ ID NO: 917883 - RNA, 19 nt, Homo sapiens
gaacuguuaaagaaguagu

SEQ ID NO: 917884 - RNA, 19 nt, Homo sapiens
ugauuaugguggugguugu

SEQ ID NO: 917885 - RNA, 19 nt, Homo sapiens
aaauggaccaggaugaaca

SEQ ID NO: 917886 - RNA, 19 nt, Homo sapiens
ccuggagcuauacaaguua

SEQ ID NO: 917887 - RNA, 19 nt, Homo sapiens
gagauaauguggugguuua

SEQ ID NO: 917888 - RNA, 19 nt, Homo sapiens
gaccugaacuuguaucuuu

SEQ ID NO: 917889 - RNA, 19 nt, Homo sapiens
ccaaagugcugggauuaua

SEQ ID NO: 917890 - RNA, 19 nt, Homo sapiens
gcaacuauaagacacauua

SEQ ID NO: 917891 - RNA, 19 nt, Homo sapiens
aaacacaacuacaaagcua

SEQ ID NO: 917892 - RNA, 19 nt, Homo sapiens
gcaaacaggugcuuuccau

SEQ ID NO: 917893 - RNA, 19 nt, Homo sapiens
aaagcuaccugccuuauga

SEQ ID NO: 917894 - RNA, 19 nt, Homo sapiens
cagcagaaguccaguauuc

SEQ ID NO: 917895 - RNA, 19 nt, Homo sapiens
gaaaucaggcagucuaaga

SEQ ID NO: 917896 - RNA, 19 nt, Homo sapiens
ugacuuaucuucugguuuc

SEQ ID NO: 917897 - RNA, 19 nt, Homo sapiens
aaauaaagcugggacacua

SEQ ID NO: 917898 - RNA, 19 nt, Homo sapiens
guucuagaaucuccauaua

SEQ ID NO: 917899 - RNA, 19 nt, Homo sapiens
ccaagugacuaguaaacaa

SEQ ID NO: 917900 - RNA, 19 nt, Homo sapiens
gugaugaggugucuaagga

SEQ ID NO: 917901 - RNA, 19 nt, Homo sapiens
gccaaaagcuucagauauu

SEQ ID NO: 917902 - RNA, 19 nt, Homo sapiens
gguuuacagucuuuaagua

SEQ ID NO: 917903 - RNA, 19 nt, Homo sapiens
gauauaccacugugcauuu

SEQ ID NO: 917904 - RNA, 19 nt, Homo sapiens
gccuggcccuuauuuguua

SEQ ID NO: 917905 - RNA, 19 nt, Homo sapiens
aggaacaccuucaaauaaa

SEQ ID NO: 917906 - RNA, 19 nt, Homo sapiens
guuaaaggcuuaucaagac

SEQ ID NO: 917907 - RNA, 19 nt, Homo sapiens
guaaucagcaacuauaaga

SEQ ID NO: 917908 - RNA, 19 nt, Homo sapiens
gaagugcaguggcgcaauc

SEQ ID NO: 917909 - RNA, 19 nt, Homo sapiens
uuaacaaggucuuaggaaa

SEQ ID NO: 917910 - RNA, 19 nt, Homo sapiens
gaacuucuuugaccugaac

SEQ ID NO: 917911 - RNA, 19 nt, Homo sapiens
gcaguugguucucuuugau

SEQ ID NO: 917912 - RNA, 19 nt, Homo sapiens
cuaccugccuuaugagauu

SEQ ID NO: 917913 - RNA, 19 nt, Homo sapiens
uacacugcauccagaauua

SEQ ID NO: 917914 - RNA, 19 nt, Homo sapiens
uguggugguuuaacauuua

SEQ ID NO: 917915 - RNA, 19 nt, Homo sapiens
acacacaccuuucaucaag

SEQ ID NO: 917916 - RNA, 19 nt, Homo sapiens
ggaacaccuucaaauaaag

SEQ ID NO: 917917 - RNA, 19 nt, Homo sapiens
gucuaagaauucccaaaua

SEQ ID NO: 917918 - RNA, 19 nt, Homo sapiens
caacccauucucacaguua

SEQ ID NO: 917919 - RNA, 19 nt, Homo sapiens
cuucugcugugucuuauuu

SEQ ID NO: 917920 - RNA, 19 nt, Homo sapiens
caagcagaguauuuaaguu

SEQ ID NO: 917921 - RNA, 19 nt, Homo sapiens
gaauucaugcuaccuaugu

SEQ ID NO: 917922 - RNA, 19 nt, Homo sapiens
ggugaaagcaggccauaug

SEQ ID NO: 917923 - RNA, 19 nt, Homo sapiens
gcuugaggcaucccaaaua

SEQ ID NO: 917924 - RNA, 19 nt, Homo sapiens
ccaaaagcuucagauauua

SEQ ID NO: 917925 - RNA, 19 nt, Homo sapiens
uaucuucugcugugucuua

SEQ ID NO: 917926 - RNA, 19 nt, Homo sapiens
ucuuugaccugaacuugua

SEQ ID NO: 917927 - RNA, 19 nt, Homo sapiens
ggucaucuucacuguguua

SEQ ID NO: 917928 - RNA, 19 nt, Homo sapiens
ccaaaaugcugcgauuaua

SEQ ID NO: 917929 - RNA, 19 nt, Homo sapiens
aagcauccuccaagaauua

SEQ ID NO: 917930 - RNA, 19 nt, Homo sapiens
ucuaauaggccgauacuug

SEQ ID NO: 917931 - RNA, 19 nt, Homo sapiens
uagcugcucugaacuagau

SEQ ID NO: 917932 - RNA, 19 nt, Homo sapiens
gcagaaguccaguauucaa

SEQ ID NO: 917933 - RNA, 19 nt, Homo sapiens
cauauucuguggagccauu

SEQ ID NO: 917934 - RNA, 19 nt, Homo sapiens
cuaacacucuuguacaugu

SEQ ID NO: 917935 - RNA, 19 nt, Homo sapiens
gcugggacacuaaauggua

SEQ ID NO: 917936 - RNA, 19 nt, Homo sapiens
uauuugaucgggcuauuua

SEQ ID NO: 917937 - RNA, 19 nt, Homo sapiens
gaucaccuaugggucuauu

SEQ ID NO: 917938 - RNA, 19 nt, Homo sapiens
ugcugugucuuauuuguua

SEQ ID NO: 917939 - RNA, 19 nt, Homo sapiens
cagcccaacagcaaauuua

SEQ ID NO: 917940 - RNA, 19 nt, Homo sapiens
uaccacguauggcuaaauu

SEQ ID NO: 917941 - RNA, 19 nt, Homo sapiens
uaauugguauuccuucugu

SEQ ID NO: 917942 - RNA, 19 nt, Homo sapiens
aaagcauccuccaagaauu

SEQ ID NO: 917943 - RNA, 19 nt, Homo sapiens
aacaggugcuuuccaugua

SEQ ID NO: 917944 - RNA, 19 nt, Homo sapiens
ucucuaggaauuccaaaua

SEQ ID NO: 917945 - RNA, 19 nt, Homo sapiens
gcucaagcagaguauuuaa

SEQ ID NO: 917946 - RNA, 19 nt, Homo sapiens
gauuuagucuaccuguaug

SEQ ID NO: 917947 - RNA, 19 nt, Homo sapiens
ucuuguacauguuucagua

SEQ ID NO: 917948 - RNA, 19 nt, Homo sapiens
caucuucacuguguuaucu

SEQ ID NO: 917949 - RNA, 19 nt, Homo sapiens
uuacaccaguuacccuaaa

SEQ ID NO: 917950 - RNA, 19 nt, Homo sapiens
gcuucagucucacaaauag

SEQ ID NO: 917951 - RNA, 19 nt, Homo sapiens
ugaucgggcuauuuaguug

SEQ ID NO: 917952 - RNA, 19 nt, Homo sapiens
gcauauuaaucacaguuac

SEQ ID NO: 917953 - RNA, 19 nt, Homo sapiens
aaacaggugcuuuccaugu

SEQ ID NO: 917954 - RNA, 19 nt, Homo sapiens
ggagccauuacaccaguua

SEQ ID NO: 917955 - RNA, 19 nt, Homo sapiens
ggugugcacuaccacguau

SEQ ID NO: 917956 - RNA, 19 nt, Homo sapiens
uccacugucuccuagcuua

SEQ ID NO: 917957 - RNA, 19 nt, Homo sapiens
aaccacaccuugcagauag

SEQ ID NO: 917958 - RNA, 19 nt, Homo sapiens
aaaccacaccuugcagaua

SEQ ID NO: 917959 - RNA, 19 nt, Homo sapiens
cuaauaggccgauacuugu

SEQ ID NO: 917960 - RNA, 19 nt, Homo sapiens
cuugaggcaucccaaauau

SEQ ID NO: 917961 - RNA, 19 nt, Homo sapiens
gaaguccaguauucaacca

SEQ ID NO: 917962 - RNA, 19 nt, Homo sapiens
cauggugccuggcccuuau

SEQ ID NO: 917963 - RNA, 19 nt, Homo sapiens
ccaccacgcccagcuaauu

SEQ ID NO: 917964 - RNA, 19 nt, Homo sapiens
uaaaagcacuaaucuacug

SEQ ID NO: 917965 - RNA, 19 nt, Homo sapiens
uccaguguaugccuucuaa

SEQ ID NO: 917966 - RNA, 19 nt, Homo sapiens
gagagauaauguggugguu

SEQ ID NO: 917967 - RNA, 19 nt, Homo sapiens
ggucuuaggaaacuauaau

SEQ ID NO: 917968 - RNA, 19 nt, Homo sapiens
uaauaggccgauacuugua

SEQ ID NO: 917969 - RNA, 19 nt, Homo sapiens
ucacaugccauuccacugu

SEQ ID NO: 917970 - RNA, 19 nt, Homo sapiens
caucaaguccuaugugucu

SEQ ID NO: 917971 - RNA, 19 nt, Homo sapiens
ucaagcagaguauuuaagu

SEQ ID NO: 917972 - RNA, 19 nt, Homo sapiens
agucaaggcugguuuacag

SEQ ID NO: 917973 - RNA, 19 nt, Homo sapiens
auaauguggugguuuaaca

SEQ ID NO: 917974 - RNA, 19 nt, Homo sapiens
ucuacucucuucucuagga

SEQ ID NO: 917975 - RNA, 19 nt, Homo sapiens
acucuacucucuucucuag

SEQ ID NO: 917976 - RNA, 19 nt, Homo sapiens
uuagcauucuuguuuguga

SEQ ID NO: 917977 - RNA, 19 nt, Homo sapiens
cuaguaaacaagcaaauuc

SEQ ID NO: 917978 - RNA, 19 nt, Homo sapiens
caccuucaaauaaagcuua

SEQ ID NO: 917979 - RNA, 19 nt, Homo sapiens
ugccuuagccauccacuuu

SEQ ID NO: 917980 - RNA, 19 nt, Homo sapiens
uaacaaggucuuaggaaac

SEQ ID NO: 917981 - RNA, 19 nt, Homo sapiens
cuaccuauguggucuaaaa

SEQ ID NO: 917982 - RNA, 19 nt, Homo sapiens
gcuuagacaccaacccauu

SEQ ID NO: 917983 - RNA, 19 nt, Homo sapiens
uugauucucuggugcauuc

SEQ ID NO: 917984 - RNA, 19 nt, Homo sapiens
cauccagaauuagcagauu

SEQ ID NO: 917985 - RNA, 19 nt, Homo sapiens
aagauuuagucuaccugua

SEQ ID NO: 917986 - RNA, 19 nt, Homo sapiens
ucuauucccauaauuggua

SEQ ID NO: 917987 - RNA, 19 nt, Homo sapiens
ggagagaucugaagaaaua

SEQ ID NO: 917988 - RNA, 19 nt, Homo sapiens
ucacuaagcauccauguua

SEQ ID NO: 917989 - RNA, 19 nt, Homo sapiens
gcaguaggcugaagucaug

SEQ ID NO: 917990 - RNA, 19 nt, Homo sapiens
gagauaaugggauguaaua

SEQ ID NO: 917991 - RNA, 19 nt, Homo sapiens
gagcagaacuggaauucau

SEQ ID NO: 917992 - RNA, 19 nt, Homo sapiens
gaacuggaauucauacucu

SEQ ID NO: 917993 - RNA, 19 nt, Homo sapiens
agaaagaccuauggagaua

SEQ ID NO: 917994 - RNA, 19 nt, Homo sapiens
gcauauaucagacuucauu

SEQ ID NO: 917995 - RNA, 19 nt, Homo sapiens
ggauuuaccuguucuggau

SEQ ID NO: 917996 - RNA, 19 nt, Homo sapiens
uaucagacuucauuccuuu

SEQ ID NO: 917997 - RNA, 19 nt, Homo sapiens
gaauggauauaucaguguu

SEQ ID NO: 917998 - RNA, 19 nt, Homo sapiens
ggaaggaguaacaagauuu

SEQ ID NO: 917999 - RNA, 19 nt, Homo sapiens
ggaaguggagguugcagua

SEQ ID NO: 918000 - RNA, 19 nt, Homo sapiens
gacaugcccacuagaaaua

SEQ ID NO: 918001 - RNA, 19 nt, Homo sapiens
ugucaguucuucuagauuu

SEQ ID NO: 918002 - RNA, 19 nt, Homo sapiens
auacuuugcugaauggaua

SEQ ID NO: 918003 - RNA, 19 nt, Homo sapiens
gcauccauguuauagcaua

SEQ ID NO: 918004 - RNA, 19 nt, Homo sapiens
gaaacaauugguucugaaa

SEQ ID NO: 918005 - RNA, 19 nt, Homo sapiens
ccuaagaguuuauaaugga

SEQ ID NO: 918006 - RNA, 19 nt, Homo sapiens
cagaguagguggauugcuu

SEQ ID NO: 918007 - RNA, 19 nt, Homo sapiens
gaacagaaagaccuaugga

SEQ ID NO: 918008 - RNA, 19 nt, Homo sapiens
cuacagagcuagggagaga

SEQ ID NO: 918009 - RNA, 19 nt, Homo sapiens
gcccugcccucccuuauau

SEQ ID NO: 918010 - RNA, 19 nt, Homo sapiens
guuaagagcagaacuggaa

SEQ ID NO: 918011 - RNA, 19 nt, Homo sapiens
guagaacucucugcauuag

SEQ ID NO: 918012 - RNA, 19 nt, Homo sapiens
gagugggagugucucauuu

SEQ ID NO: 918013 - RNA, 19 nt, Homo sapiens
caacaccuguaucuaguuc

SEQ ID NO: 918014 - RNA, 19 nt, Homo sapiens
aauaaaggaccguuuguuu

SEQ ID NO: 918015 - RNA, 19 nt, Homo sapiens
ucuaaucccuaagaguuua

SEQ ID NO: 918016 - RNA, 19 nt, Homo sapiens
gggaugauucgucuaauug

SEQ ID NO: 918017 - RNA, 19 nt, Homo sapiens
gaaugccuguugucaguuc

SEQ ID NO: 918018 - RNA, 19 nt, Homo sapiens
uaucuaaucccuaagaguu

SEQ ID NO: 918019 - RNA, 19 nt, Homo sapiens
gaauucauacucuguggaa

SEQ ID NO: 918020 - RNA, 19 nt, Homo sapiens
uaacuucuuucacuaagca

SEQ ID NO: 918021 - RNA, 19 nt, Homo sapiens
gaaagaccuauggagauaa

SEQ ID NO: 918022 - RNA, 19 nt, Homo sapiens
caccucagccucccaagua

SEQ ID NO: 918023 - RNA, 19 nt, Homo sapiens
gguaauuucucuguuucaa

SEQ ID NO: 918024 - RNA, 19 nt, Homo sapiens
gaaaauuguugacaucauc

SEQ ID NO: 918025 - RNA, 19 nt, Homo sapiens
agaacucucugcauuagug

SEQ ID NO: 918026 - RNA, 19 nt, Homo sapiens
ggacagagugagacccuau

SEQ ID NO: 918027 - RNA, 19 nt, Homo sapiens
gcauauaccccuacaugua

SEQ ID NO: 918028 - RNA, 19 nt, Homo sapiens
aaagaccuauggagauaau

SEQ ID NO: 918029 - RNA, 19 nt, Homo sapiens
gccaacaccuguaucuagu

SEQ ID NO: 918030 - RNA, 19 nt, Homo sapiens
agugaacaauuuaguggua

SEQ ID NO: 918031 - RNA, 19 nt, Homo sapiens
guagguggauugcuucaac

SEQ ID NO: 918032 - RNA, 19 nt, Homo sapiens
uagcauauaucagacuuca

SEQ ID NO: 918033 - RNA, 19 nt, Homo sapiens
gaccguuuguuucuaacuu

SEQ ID NO: 918034 - RNA, 19 nt, Homo sapiens
uaaaggaccguuuguuucu

SEQ ID NO: 918035 - RNA, 19 nt, Homo sapiens
cgauaaaacucacauaaca

SEQ ID NO: 918036 - RNA, 19 nt, Homo sapiens
acaauugguucugaaauca

SEQ ID NO: 918037 - RNA, 19 nt, Homo sapiens
cagcaaaaguugauguaaa

SEQ ID NO: 918038 - RNA, 19 nt, Homo sapiens
uguagaacucucugcauua

SEQ ID NO: 918039 - RNA, 19 nt, Homo sapiens
gucaguucuucuagauuua

SEQ ID NO: 918040 - RNA, 19 nt, Homo sapiens
aaggaccguuuguuucuaa

SEQ ID NO: 918041 - RNA, 19 nt, Homo sapiens
uggaaggaguaacaagauu

SEQ ID NO: 918042 - RNA, 19 nt, Homo sapiens
gauaaugggauguaauaac

SEQ ID NO: 918043 - RNA, 19 nt, Homo sapiens
cuguagaacucucugcauu

SEQ ID NO: 918044 - RNA, 19 nt, Homo sapiens
caugcccacuagaaauaua

SEQ ID NO: 918045 - RNA, 19 nt, Homo sapiens
ggagauaaugggauguaau

SEQ ID NO: 918046 - RNA, 19 nt, Homo sapiens
agggagagaucugaagaaa

SEQ ID NO: 918047 - RNA, 19 nt, Homo sapiens
ugggaugauucgucuaauu

SEQ ID NO: 918048 - RNA, 19 nt, Homo sapiens
ucaugccacugcacucaaa

SEQ ID NO: 918049 - RNA, 19 nt, Homo sapiens
ggaaugaaucagcaaugug

SEQ ID NO: 918050 - RNA, 19 nt, Homo sapiens
cagaaagaccuauggagau

SEQ ID NO: 918051 - RNA, 19 nt, Homo sapiens
gagaucugaagaaauacua

SEQ ID NO: 918052 - RNA, 19 nt, Homo sapiens
uauuugggccuauauggua

SEQ ID NO: 918053 - RNA, 19 nt, Homo sapiens
uggaauugcugggucauau

SEQ ID NO: 918054 - RNA, 19 nt, Homo sapiens
aagcauccauguuauagca

SEQ ID NO: 918055 - RNA, 19 nt, Homo sapiens
gguauuuagugcauucaca

SEQ ID NO: 918056 - RNA, 19 nt, Homo sapiens
gcaaaacccuaucucuaca

SEQ ID NO: 918057 - RNA, 19 nt, Homo sapiens
cauacucuguggaaugaau

SEQ ID NO: 918058 - RNA, 19 nt, Homo sapiens
uaauugcuguguaccuguu

SEQ ID NO: 918059 - RNA, 19 nt, Homo sapiens
ccacuagaaauauaugaga

SEQ ID NO: 918060 - RNA, 19 nt, Homo sapiens
cacugugccuggccuaauu

SEQ ID NO: 918061 - RNA, 19 nt, Homo sapiens
ugacaugcccacuagaaau

SEQ ID NO: 918062 - RNA, 19 nt, Homo sapiens
aaaggaccguuuguuucua

SEQ ID NO: 918063 - RNA, 19 nt, Homo sapiens
aacaauugguucugaaauc

SEQ ID NO: 918064 - RNA, 19 nt, Homo sapiens
gaucugaagaaauacuaga

SEQ ID NO: 918065 - RNA, 19 nt, Homo sapiens
gcuguguaccuguuacgua

SEQ ID NO: 918066 - RNA, 19 nt, Homo sapiens
guugucaguucuucuagau

SEQ ID NO: 918067 - RNA, 19 nt, Homo sapiens
caauaaaggaccguuuguu

SEQ ID NO: 918068 - RNA, 19 nt, Homo sapiens
aaugggauguaauaacaga

SEQ ID NO: 918069 - RNA, 19 nt, Homo sapiens
ugucucauuugcuguagaa

SEQ ID NO: 918070 - RNA, 19 nt, Homo sapiens
uaagcaaaaugacuaguug

SEQ ID NO: 918071 - RNA, 19 nt, Homo sapiens
cacaucuucugacagcuuu

SEQ ID NO: 918072 - RNA, 19 nt, Homo sapiens
cauuugacaugcccacuag

SEQ ID NO: 918073 - RNA, 19 nt, Homo sapiens
guggacauuuggguucuuu

SEQ ID NO: 918074 - RNA, 19 nt, Homo sapiens
agacuagccuggacagcau

SEQ ID NO: 918075 - RNA, 19 nt, Homo sapiens
ggccagaguagguggauug

SEQ ID NO: 918076 - RNA, 19 nt, Homo sapiens
gaaggaguaacaagauuuu

SEQ ID NO: 918077 - RNA, 19 nt, Homo sapiens
uggaaugaaucagcaaugu

SEQ ID NO: 918078 - RNA, 19 nt, Homo sapiens
ccuguaacuucauggcauu

SEQ ID NO: 918079 - RNA, 19 nt, Homo sapiens
uguauccuguuucagauug

SEQ ID NO: 918080 - RNA, 19 nt, Homo sapiens
ggaauugcugggucauaug

SEQ ID NO: 918081 - RNA, 19 nt, Homo sapiens
gugaacaauuuagugguau

SEQ ID NO: 918082 - RNA, 19 nt, Homo sapiens
gagcuagggagagaucuga

SEQ ID NO: 918083 - RNA, 19 nt, Homo sapiens
gagugucucauuugcugua

SEQ ID NO: 918084 - RNA, 19 nt, Homo sapiens
guugggaugauucgucuaa

SEQ ID NO: 918085 - RNA, 19 nt, Homo sapiens
uaccuguucuggauauuuc

SEQ ID NO: 918086 - RNA, 19 nt, Homo sapiens
uaccuuauuugggccuaua

SEQ ID NO: 918087 - RNA, 19 nt, Homo sapiens
caacuuaucuccauguuua

SEQ ID NO: 918088 - RNA, 19 nt, Homo sapiens
gaaauauccucuagguuaa

SEQ ID NO: 918089 - RNA, 19 nt, Homo sapiens
ugaaauauccucuagguua

SEQ ID NO: 918090 - RNA, 19 nt, Homo sapiens
gagccgagaucauaccauu

SEQ ID NO: 918091 - RNA, 19 nt, Homo sapiens
aaaaggaagugcugaaaua

SEQ ID NO: 918092 - RNA, 19 nt, Homo sapiens
gaggaguggugagaucaua

SEQ ID NO: 918093 - RNA, 19 nt, Homo sapiens
ucacugcccuucuuacuca

SEQ ID NO: 918094 - RNA, 19 nt, Homo sapiens
gaacacugagcuuaaauuc

SEQ ID NO: 918095 - RNA, 19 nt, Homo sapiens
gaacuuguaucaucaaccu

SEQ ID NO: 918096 - RNA, 19 nt, Homo sapiens
ggaaaugauaccuuacaaa

SEQ ID NO: 918097 - RNA, 19 nt, Homo sapiens
gcauuucacugguaccaau

SEQ ID NO: 918098 - RNA, 19 nt, Homo sapiens
gcugaaauauccucuaggu

SEQ ID NO: 918099 - RNA, 19 nt, Homo sapiens
ucacugaaagaucaacuua

SEQ ID NO: 918100 - RNA, 19 nt, Homo sapiens
ucaucaaccugaacacuga

SEQ ID NO: 918101 - RNA, 19 nt, Homo sapiens
guuagcaugugcagaauuc

SEQ ID NO: 918102 - RNA, 19 nt, Homo sapiens
uuacucaucucuacugcaa

SEQ ID NO: 918103 - RNA, 19 nt, Homo sapiens
ucacugguaccaauucuuu

SEQ ID NO: 918104 - RNA, 19 nt, Homo sapiens
uaaguuacgugugcuuuca

SEQ ID NO: 918105 - RNA, 19 nt, Homo sapiens
gcaagacucauuccuacug

SEQ ID NO: 918106 - RNA, 19 nt, Homo sapiens
uaucugcauuucacuggua

SEQ ID NO: 918107 - RNA, 19 nt, Homo sapiens
gcaggagaaugaugugaac

SEQ ID NO: 918108 - RNA, 19 nt, Homo sapiens
ugaauggugaggagaauuu

SEQ ID NO: 918109 - RNA, 19 nt, Homo sapiens
caugagaaguccaggauac

SEQ ID NO: 918110 - RNA, 19 nt, Homo sapiens
acugaaagaucaacuuauc

SEQ ID NO: 918111 - RNA, 19 nt, Homo sapiens
caauuuaucugcauuucac

SEQ ID NO: 918112 - RNA, 19 nt, Homo sapiens
ggauuaacccugucucuac

SEQ ID NO: 918113 - RNA, 19 nt, Homo sapiens
ccugaacacugagcuuaaa

SEQ ID NO: 918114 - RNA, 19 nt, Homo sapiens
gaaaccccgucucuacuaa

SEQ ID NO: 918115 - RNA, 19 nt, Homo sapiens
gagagucccaggcccauga

SEQ ID NO: 918116 - RNA, 19 nt, Homo sapiens
aagccaagaucacgccauu

SEQ ID NO: 918117 - RNA, 19 nt, Homo sapiens
caagacucauuccuacugu

SEQ ID NO: 918118 - RNA, 19 nt, Homo sapiens
gugcugaaauauccucuag

SEQ ID NO: 918119 - RNA, 19 nt, Homo sapiens
ggcccucacugaaagauca

SEQ ID NO: 918120 - RNA, 19 nt, Homo sapiens
gagaaguccaggauacaug

SEQ ID NO: 918121 - RNA, 19 nt, Homo sapiens
ucauagcucacaccuguaa

SEQ ID NO: 918122 - RNA, 19 nt, Homo sapiens
agugagacucguaauaaua

SEQ ID NO: 918123 - RNA, 19 nt, Homo sapiens
gauuaacccugucucuacu

SEQ ID NO: 918124 - RNA, 19 nt, Homo sapiens
caagaucacgccauuguac

SEQ ID NO: 918125 - RNA, 19 nt, Homo sapiens
acucaucucuacugcaaga

SEQ ID NO: 918126 - RNA, 19 nt, Homo sapiens
uuaacccugucucuacuaa

SEQ ID NO: 918127 - RNA, 19 nt, Homo sapiens
gccaagaucacgccauugu

SEQ ID NO: 918128 - RNA, 19 nt, Homo sapiens
ggaagcggagguugcaaug

SEQ ID NO: 918129 - RNA, 19 nt, Homo sapiens
gaucaacuuaucuccaugu

SEQ ID NO: 918130 - RNA, 19 nt, Homo sapiens
ccaagaucacgccauugua

SEQ ID NO: 918131 - RNA, 19 nt, Homo sapiens
cauccuggccaacauggua

SEQ ID NO: 918132 - RNA, 19 nt, Homo sapiens
uggaaaugauaccuuacaa

SEQ ID NO: 918133 - RNA, 19 nt, Homo sapiens
acaaaucguucuggcugaa

SEQ ID NO: 918134 - RNA, 19 nt, Homo sapiens
gaauucuggcccucacuga

SEQ ID NO: 918135 - RNA, 19 nt, Homo sapiens
gucaggagaucaagaccau

SEQ ID NO: 918136 - RNA, 19 nt, Homo sapiens
caucucacugcccuucuua

SEQ ID NO: 918137 - RNA, 19 nt, Homo sapiens
ucacacugcacaaaugcua

SEQ ID NO: 918138 - RNA, 19 nt, Homo sapiens
ugguaccaauucuuuauga

SEQ ID NO: 918139 - RNA, 19 nt, Homo sapiens
guagugcacaccuguaauc

SEQ ID NO: 918140 - RNA, 19 nt, Homo sapiens
uuacugcccuacaccacaa

SEQ ID NO: 918141 - RNA, 19 nt, Homo sapiens
gaucaugaggucaggagau

SEQ ID NO: 918142 - RNA, 19 nt, Homo sapiens
gcugaauggugaggagaau

SEQ ID NO: 918143 - RNA, 19 nt, Homo sapiens
ugaacacugagcuuaaauu

SEQ ID NO: 918144 - RNA, 19 nt, Homo sapiens
gguaccaauucuuuaugau

SEQ ID NO: 918145 - RNA, 19 nt, Homo sapiens
aagcggagguugcaaugag

SEQ ID NO: 918146 - RNA, 19 nt, Homo sapiens
gucaggagaucgagaccau

SEQ ID NO: 918147 - RNA, 19 nt, Homo sapiens
ccuguaaucccagcacuuu

SEQ ID NO: 918148 - RNA, 19 nt, Homo sapiens
gcccuacaccacaaauuug

SEQ ID NO: 918149 - RNA, 19 nt, Homo sapiens
gaagcggagguugcaauga

SEQ ID NO: 918150 - RNA, 19 nt, Homo sapiens
ccuguaaucccagcacuuu

SEQ ID NO: 918151 - RNA, 19 nt, Homo sapiens
agaccagccugaccaacau

SEQ ID NO: 918152 - RNA, 19 nt, Homo sapiens
aaaggaagugcugaaauau

SEQ ID NO: 918153 - RNA, 19 nt, Homo sapiens
gaccgugucucaaaaucaa

SEQ ID NO: 918154 - RNA, 19 nt, Homo sapiens
ggcaggagaaugaugugaa

SEQ ID NO: 918155 - RNA, 19 nt, Homo sapiens
gugagacucguaauaauac

SEQ ID NO: 918156 - RNA, 19 nt, Homo sapiens
ccaucucacugcccuucuu

SEQ ID NO: 918157 - RNA, 19 nt, Homo sapiens
gcuaaacuccccucuguga

SEQ ID NO: 918158 - RNA, 19 nt, Homo sapiens
aauucacacugcacaaaug

SEQ ID NO: 918159 - RNA, 19 nt, Homo sapiens
ucacagcaacuucaaacuc

SEQ ID NO: 918160 - RNA, 19 nt, Homo sapiens
ggcugaggcacaagaauug

SEQ ID NO: 918161 - RNA, 19 nt, Homo sapiens
gcucacagcaacuucaaac

SEQ ID NO: 918162 - RNA, 19 nt, Homo sapiens
gaaguccaggauacauguu

SEQ ID NO: 918163 - RNA, 19 nt, Homo sapiens
ugaccaacauggauuaacc

SEQ ID NO: 918164 - RNA, 19 nt, Homo sapiens
ucacagcucacagcaacuu

SEQ ID NO: 918165 - RNA, 19 nt, Homo sapiens
ggcugaggcaggagaauga

SEQ ID NO: 918166 - RNA, 19 nt, Homo sapiens
aaaucguucuggcugaaug

SEQ ID NO: 918167 - RNA, 19 nt, Homo sapiens
uaauucacacugcacaaau

SEQ ID NO: 918168 - RNA, 19 nt, Homo sapiens
aggaagugcugaaauaucc

SEQ ID NO: 918169 - RNA, 19 nt, Homo sapiens
ggaggcugaggcacaagaa

SEQ ID NO: 918170 - RNA, 19 nt, Homo sapiens
uaaaaccccaucucuacua

SEQ ID NO: 918171 - RNA, 19 nt, Homo sapiens
cugcacaaaugcuaaacuc

SEQ ID NO: 918172 - RNA, 19 nt, Homo sapiens
ugcccuacaccacaaauuu

SEQ ID NO: 918173 - RNA, 19 nt, Homo sapiens
gaucgcuugugcccagaag

SEQ ID NO: 918174 - RNA, 19 nt, Homo sapiens
aaaauuagcugggcguagu

SEQ ID NO: 918175 - RNA, 19 nt, Homo sapiens
aaccugaacacugagcuua

SEQ ID NO: 918176 - RNA, 19 nt, Homo sapiens
gguaaaaccccaucucuac

SEQ ID NO: 918177 - RNA, 19 nt, Homo sapiens
ugggugcggugguguagug

SEQ ID NO: 918178 - RNA, 19 nt, Homo sapiens
uuaauucacacugcacaaa

SEQ ID NO: 918179 - RNA, 19 nt, Homo sapiens
cuacaccacaaauuuggaa

SEQ ID NO: 918180 - RNA, 19 nt, Homo sapiens
guagacgcaaacuuccuuu

SEQ ID NO: 918181 - RNA, 19 nt, Homo sapiens
gccuuuacauaauuacucu

SEQ ID NO: 918182 - RNA, 19 nt, Homo sapiens
caguggcucaugccuguaa

SEQ ID NO: 918183 - RNA, 19 nt, Homo sapiens
ccaugagaaguccaggaua

SEQ ID NO: 918184 - RNA, 19 nt, Homo sapiens
acacugcacaaaugcuaaa

SEQ ID NO: 918185 - RNA, 19 nt, Homo sapiens
gccugaccaacauggauua

SEQ ID NO: 918186 - RNA, 19 nt, Homo sapiens
ucaacuuaucuccauguuu

SEQ ID NO: 918187 - RNA, 19 nt, Homo sapiens
caagaaagaugccaagaua

SEQ ID NO: 918188 - RNA, 19 nt, Homo sapiens
caaauuaacucgcugauuc

SEQ ID NO: 918189 - RNA, 19 nt, Homo sapiens
gcaaaggaccuaaacuuaa

SEQ ID NO: 918190 - RNA, 19 nt, Homo sapiens
gcacacgccuauaauccua

SEQ ID NO: 918191 - RNA, 19 nt, Homo sapiens
ggaagacucagacuaguaa

SEQ ID NO: 918192 - RNA, 19 nt, Homo sapiens
guagaucaauggaaaggaa

SEQ ID NO: 918193 - RNA, 19 nt, Homo sapiens
gaaagaugccaagauaauu

SEQ ID NO: 918194 - RNA, 19 nt, Homo sapiens
aauagugaguccagaaaua

SEQ ID NO: 918195 - RNA, 19 nt, Homo sapiens
caaaucaaccuauagaguu

SEQ ID NO: 918196 - RNA, 19 nt, Homo sapiens
gaaaccucgucucuacuaa

SEQ ID NO: 918197 - RNA, 19 nt, Homo sapiens
caaaggaccuaaacuuaac

SEQ ID NO: 918198 - RNA, 19 nt, Homo sapiens
cuauagaguuagugcaaua

SEQ ID NO: 918199 - RNA, 19 nt, Homo sapiens
ggugaaaccucgucucuac

SEQ ID NO: 918200 - RNA, 19 nt, Homo sapiens
ggaccuaaacuuaaccaaa

SEQ ID NO: 918201 - RNA, 19 nt, Homo sapiens
gagcuagacuccaucucaa

SEQ ID NO: 918202 - RNA, 19 nt, Homo sapiens
gaccuaaacuuaaccaaaa

SEQ ID NO: 918203 - RNA, 19 nt, Homo sapiens
uuaacucgcugauucuaaa

SEQ ID NO: 918204 - RNA, 19 nt, Homo sapiens
ucaagaccauccuggcuaa

SEQ ID NO: 918205 - RNA, 19 nt, Homo sapiens
cagccuggauuacagagua

SEQ ID NO: 918206 - RNA, 19 nt, Homo sapiens
aaacauugcugagggaaau

SEQ ID NO: 918207 - RNA, 19 nt, Homo sapiens
ggaauagugaguccagaaa

SEQ ID NO: 918208 - RNA, 19 nt, Homo sapiens
gacucagacuaguaaauuu

SEQ ID NO: 918209 - RNA, 19 nt, Homo sapiens
gauggaagacucagacuag

SEQ ID NO: 918210 - RNA, 19 nt, Homo sapiens
agucucagcaggcaaauua

SEQ ID NO: 918211 - RNA, 19 nt, Homo sapiens
ugacagagccuucucaaaa

SEQ ID NO: 918212 - RNA, 19 nt, Homo sapiens
caaagucucagcaggcaaa

SEQ ID NO: 918213 - RNA, 19 nt, Homo sapiens
guaaaacugucucaaacaa

SEQ ID NO: 918214 - RNA, 19 nt, Homo sapiens
cuacugcacucuagauugg

SEQ ID NO: 918215 - RNA, 19 nt, Homo sapiens
gaaaccccaucucuacuaa

SEQ ID NO: 918216 - RNA, 19 nt, Homo sapiens
agaaagaugccaagauaau

SEQ ID NO: 918217 - RNA, 19 nt, Homo sapiens
gcucacgccuauaauccaa

SEQ ID NO: 918218 - RNA, 19 nt, Homo sapiens
gcaaauuaacucgcugauu

SEQ ID NO: 918219 - RNA, 19 nt, Homo sapiens
auacagagcuagacuccau

SEQ ID NO: 918220 - RNA, 19 nt, Homo sapiens
gcaggagaaucacuugaac

SEQ ID NO: 918221 - RNA, 19 nt, Homo sapiens
gagccuagauugugcuacu

SEQ ID NO: 918222 - RNA, 19 nt, Homo sapiens
aaguguagaucaauggaaa

SEQ ID NO: 918223 - RNA, 19 nt, Homo sapiens
uaguguggcuuugguguaa

SEQ ID NO: 918224 - RNA, 19 nt, Homo sapiens
ugaaaccucgucucuacua

SEQ ID NO: 918225 - RNA, 19 nt, Homo sapiens
caauggaaaggaauaguga

SEQ ID NO: 918226 - RNA, 19 nt, Homo sapiens
agcaaaggaccuaaacuua

SEQ ID NO: 918227 - RNA, 19 nt, Homo sapiens
ggagguggagguuauagug

SEQ ID NO: 918228 - RNA, 19 nt, Homo sapiens
ccuauaauccuagcuacua

SEQ ID NO: 918229 - RNA, 19 nt, Homo sapiens
aaaauuagcuggacaucau

SEQ ID NO: 918230 - RNA, 19 nt, Homo sapiens
gaauagugaguccagaaau

SEQ ID NO: 918231 - RNA, 19 nt, Homo sapiens
uagaguuagugcaauauca

SEQ ID NO: 918232 - RNA, 19 nt, Homo sapiens
ccaaaucaaccuauagagu

SEQ ID NO: 918233 - RNA, 19 nt, Homo sapiens
ucacgccacugcacucuag

SEQ ID NO: 918234 - RNA, 19 nt, Homo sapiens
caucauggcacacgccuau

SEQ ID NO: 918235 - RNA, 19 nt, Homo sapiens
agacucagacuaguaaauu

SEQ ID NO: 918236 - RNA, 19 nt, Homo sapiens
ccugggagguggagguuau

SEQ ID NO: 918237 - RNA, 19 nt, Homo sapiens
aaagaugccaagauaauuc

SEQ ID NO: 918238 - RNA, 19 nt, Homo sapiens
aagcaaaggaccuaaacuu

SEQ ID NO: 918239 - RNA, 19 nt, Homo sapiens
ccuauaauccaagcacuuu

SEQ ID NO: 918240 - RNA, 19 nt, Homo sapiens
gaaaagcaaaggaccuaaa

SEQ ID NO: 918241 - RNA, 19 nt, Homo sapiens
gucaggagaucaagaccau

SEQ ID NO: 918242 - RNA, 19 nt, Homo sapiens
gagguggagguuauaguga

SEQ ID NO: 918243 - RNA, 19 nt, Homo sapiens
ucauggcacacgccuauaa

SEQ ID NO: 918244 - RNA, 19 nt, Homo sapiens
ggcaggagaaucacuugaa

SEQ ID NO: 918245 - RNA, 19 nt, Homo sapiens
ucaagaaagaugccaagau

SEQ ID NO: 918246 - RNA, 19 nt, Homo sapiens
agaccauccuggcuaacaa

SEQ ID NO: 918247 - RNA, 19 nt, Homo sapiens
acagccaacugacuuucaa

SEQ ID NO: 918248 - RNA, 19 nt, Homo sapiens
gcuacugcacucuagauug

SEQ ID NO: 918249 - RNA, 19 nt, Homo sapiens
ccuguaaucccagcacuuu

SEQ ID NO: 918250 - RNA, 19 nt, Homo sapiens
uggaagacucagacuagua

SEQ ID NO: 918251 - RNA, 19 nt, Homo sapiens
gaguaaaacugucucaaac

SEQ ID NO: 918252 - RNA, 19 nt, Homo sapiens
gguggugcaugccuguaau

SEQ ID NO: 918253 - RNA, 19 nt, Homo sapiens
ccuguaaucccagcacuuu

SEQ ID NO: 918254 - RNA, 19 nt, Homo sapiens
gaguuagugcaauaucaaa

SEQ ID NO: 918255 - RNA, 19 nt, Homo sapiens
acacuguauucagaaauug

SEQ ID NO: 918256 - RNA, 19 nt, Homo sapiens
cagcugagacacaagaauc

SEQ ID NO: 918257 - RNA, 19 nt, Homo sapiens
gccaacugacuuucaagaa

SEQ ID NO: 918258 - RNA, 19 nt, Homo sapiens
gggcagcugagacacaaga

SEQ ID NO: 918259 - RNA, 19 nt, Homo sapiens
uagggcagcugagacacaa

SEQ ID NO: 918260 - RNA, 19 nt, Homo sapiens
aagaaagaugccaagauaa

SEQ ID NO: 918261 - RNA, 19 nt, Homo sapiens
gugaguccagaaauacaua

SEQ ID NO: 918262 - RNA, 19 nt, Homo sapiens
caguggcucacgccuauaa

SEQ ID NO: 918263 - RNA, 19 nt, Homo sapiens
aaaccucgucucuacuaaa

SEQ ID NO: 918264 - RNA, 19 nt, Homo sapiens
ucaauggaaaggaauagug

SEQ ID NO: 918265 - RNA, 19 nt, Homo sapiens
guuauagugagccuagauu

SEQ ID NO: 918266 - RNA, 19 nt, Homo sapiens
agcaguggcucacgccuau

SEQ ID NO: 918267 - RNA, 19 nt, Homo sapiens
ucaagauaguguggcuuug

SEQ ID NO: 918268 - RNA, 19 nt, Homo sapiens
gaagacucagacuaguaaa

SEQ ID NO: 918269 - RNA, 19 nt, Homo sapiens
guaaaacccugucucuacu

SEQ ID NO: 918270 - RNA, 19 nt, Homo sapiens
cauacagccaacugacuuu

SEQ ID NO: 918271 - RNA, 19 nt, Homo sapiens
agagcuagacuccaucuca

SEQ ID NO: 918272 - RNA, 19 nt, Homo sapiens
gaucaauggaaaggaauag

SEQ ID NO: 918273 - RNA, 19 nt, Homo sapiens
caaguguagaucaauggaa

SEQ ID NO: 918274 - RNA, 19 nt, Homo sapiens
caagauaguguggcuuugg

SEQ ID NO: 918275 - RNA, 19 nt, Homo sapiens
gguaaaacccugucucuac

SEQ ID NO: 918276 - RNA, 19 nt, Homo sapiens
uauagugagccuagauugu

SEQ ID NO: 918277 - RNA, 19 nt, Homo sapiens
augccaagauaauucaaug

SEQ ID NO: 918278 - RNA, 19 nt, Homo sapiens
uuagugcaauaucaaaguc

SEQ ID NO: 918279 - RNA, 19 nt, Homo sapiens
gaacccgggagguggagau

SEQ ID NO: 918280 - RNA, 19 nt, Homo sapiens
gcagcugagacacaagaau

SEQ ID NO: 918281 - RNA, 19 nt, Homo sapiens
aaaacccugucucuacuaa

SEQ ID NO: 918282 - RNA, 19 nt, Homo sapiens
gugacagagccuucucaaa

SEQ ID NO: 918283 - RNA, 19 nt, Homo sapiens
ugagacacaagaaucacuu

SEQ ID NO: 918284 - RNA, 19 nt, Homo sapiens
gaugccaagauaauucaau

SEQ ID NO: 918285 - RNA, 19 nt, Homo sapiens
acauacagccaacugacuu

SEQ ID NO: 918286 - RNA, 19 nt, Homo sapiens
aaucccagcuacccugaag

SEQ ID NO: 918287 - RNA, 19 nt, Homo sapiens
ggaaaugccugcacagaua

SEQ ID NO: 918288 - RNA, 19 nt, Homo sapiens
ggaagaacaugguuaggaa

SEQ ID NO: 918289 - RNA, 19 nt, Homo sapiens
ggaaauacaucuguggaaa

SEQ ID NO: 918290 - RNA, 19 nt, Homo sapiens
caacuucucugcuacgaaa

SEQ ID NO: 918291 - RNA, 19 nt, Homo sapiens
gggcaggguuugaaagaua

SEQ ID NO: 918292 - RNA, 19 nt, Homo sapiens
gaugagccgucuuagauaa

SEQ ID NO: 918293 - RNA, 19 nt, Homo sapiens
gaaacccugucucuacuaa

SEQ ID NO: 918294 - RNA, 19 nt, Homo sapiens
acacacaacuucucugcua

SEQ ID NO: 918295 - RNA, 19 nt, Homo sapiens
ggaggugauucuuguuaaa

SEQ ID NO: 918296 - RNA, 19 nt, Homo sapiens
cgacuugccauuugaguua

SEQ ID NO: 918297 - RNA, 19 nt, Homo sapiens
gaaauugggaaacagguaa

SEQ ID NO: 918298 - RNA, 19 nt, Homo sapiens
uuagucagcuuuccucaaa

SEQ ID NO: 918299 - RNA, 19 nt, Homo sapiens
cauuacaaaucucugcuua

SEQ ID NO: 918300 - RNA, 19 nt, Homo sapiens
gaugugaacaguauagaaa

SEQ ID NO: 918301 - RNA, 19 nt, Homo sapiens
uaacuguucuugcuacuca

SEQ ID NO: 918302 - RNA, 19 nt, Homo sapiens
cgagacacaugagaauuaa

SEQ ID NO: 918303 - RNA, 19 nt, Homo sapiens
caaguaguccaucauagua

SEQ ID NO: 918304 - RNA, 19 nt, Homo sapiens
cgaaaagucuugauugauu

SEQ ID NO: 918305 - RNA, 19 nt, Homo sapiens
ggaaauguguauccuucau

SEQ ID NO: 918306 - RNA, 19 nt, Homo sapiens
gaaauacaucuguggaaau

SEQ ID NO: 918307 - RNA, 19 nt, Homo sapiens
gcacaucgaaauuaccauu

SEQ ID NO: 918308 - RNA, 19 nt, Homo sapiens
gcaauagcgugcacaucga

SEQ ID NO: 918309 - RNA, 19 nt, Homo sapiens
aaagagaaauugggaaaca

SEQ ID NO: 918310 - RNA, 19 nt, Homo sapiens
ccgagacacaugagaauua

SEQ ID NO: 918311 - RNA, 19 nt, Homo sapiens
cagaugagccgucuuagau

SEQ ID NO: 918312 - RNA, 19 nt, Homo sapiens
aaauacaucuguggaaaug

SEQ ID NO: 918313 - RNA, 19 nt, Homo sapiens
uuacacagcagaggaaaua

SEQ ID NO: 918314 - RNA, 19 nt, Homo sapiens
gaguugaauuguaaccauu

SEQ ID NO: 918315 - RNA, 19 nt, Homo sapiens
ggagggaagaacaugguua

SEQ ID NO: 918316 - RNA, 19 nt, Homo sapiens
ucacaccacugaccucuag

SEQ ID NO: 918317 - RNA, 19 nt, Homo sapiens
cuagucaaaugccuuuaaa

SEQ ID NO: 918318 - RNA, 19 nt, Homo sapiens
ggaguugaauuguaaccau

SEQ ID NO: 918319 - RNA, 19 nt, Homo sapiens
gaaugucacaaguguauau

SEQ ID NO: 918320 - RNA, 19 nt, Homo sapiens
aagguuauauggugcuuaa

SEQ ID NO: 918321 - RNA, 19 nt, Homo sapiens
gauuaacccucaucuuguc

SEQ ID NO: 918322 - RNA, 19 nt, Homo sapiens
caugagaauuaaccaauca

SEQ ID NO: 918323 - RNA, 19 nt, Homo sapiens
uuacaaaucucugcuuaag

SEQ ID NO: 918324 - RNA, 19 nt, Homo sapiens
gaaaacugaugauuugugu

SEQ ID NO: 918325 - RNA, 19 nt, Homo sapiens
uaagcgacuugccauuuga

SEQ ID NO: 918326 - RNA, 19 nt, Homo sapiens
gcagcugcauuacaaaucu

SEQ ID NO: 918327 - RNA, 19 nt, Homo sapiens
gaagaacaugguuaggaaa

SEQ ID NO: 918328 - RNA, 19 nt, Homo sapiens
gccaagaucacaccacuga

SEQ ID NO: 918329 - RNA, 19 nt, Homo sapiens
gcagaugagccgucuuaga

SEQ ID NO: 918330 - RNA, 19 nt, Homo sapiens
gcaccuaccucagcgucaa

SEQ ID NO: 918331 - RNA, 19 nt, Homo sapiens
ggaaagggcgaaagacagu

SEQ ID NO: 918332 - RNA, 19 nt, Homo sapiens
gaaauggacacggaccaaa

SEQ ID NO: 918333 - RNA, 19 nt, Homo sapiens
gaaaagagaaauugggaaa

SEQ ID NO: 918334 - RNA, 19 nt, Homo sapiens
cauguaagccucucugaau

SEQ ID NO: 918335 - RNA, 19 nt, Homo sapiens
uuaagcgacuugccauuug

SEQ ID NO: 918336 - RNA, 19 nt, Homo sapiens
ccgauuaacccucaucuug

SEQ ID NO: 918337 - RNA, 19 nt, Homo sapiens
gagaauuaaccaaucaaug

SEQ ID NO: 918338 - RNA, 19 nt, Homo sapiens
caagguaggccaaguaguc

SEQ ID NO: 918339 - RNA, 19 nt, Homo sapiens
gcagauaaagcagaaacaa

SEQ ID NO: 918340 - RNA, 19 nt, Homo sapiens
gaaaagucuugauugauuc

SEQ ID NO: 918341 - RNA, 19 nt, Homo sapiens
gaaauguguauccuucaug

SEQ ID NO: 918342 - RNA, 19 nt, Homo sapiens
ccaacucauugauuucaga

SEQ ID NO: 918343 - RNA, 19 nt, Homo sapiens
gcaggagaaucgcuugaac

SEQ ID NO: 918344 - RNA, 19 nt, Homo sapiens
ggugaaacccugucucuac

SEQ ID NO: 918345 - RNA, 19 nt, Homo sapiens
uuagauaacuguucuugcu

SEQ ID NO: 918346 - RNA, 19 nt, Homo sapiens
ugucccagcucucugugua

SEQ ID NO: 918347 - RNA, 19 nt, Homo sapiens
uggaggugauucuuguuaa

SEQ ID NO: 918348 - RNA, 19 nt, Homo sapiens
gcacagauagucaaaauag

SEQ ID NO: 918349 - RNA, 19 nt, Homo sapiens
ggccaaguaguccaucaua

SEQ ID NO: 918350 - RNA, 19 nt, Homo sapiens
gggaagaacaugguuagga

SEQ ID NO: 918351 - RNA, 19 nt, Homo sapiens
gaaaugccugcacagauag

SEQ ID NO: 918352 - RNA, 19 nt, Homo sapiens
ggcaggguuugaaagauau

SEQ ID NO: 918353 - RNA, 19 nt, Homo sapiens
acugaugauuuguguguaa

SEQ ID NO: 918354 - RNA, 19 nt, Homo sapiens
aaacugaugauuugugugu

SEQ ID NO: 918355 - RNA, 19 nt, Homo sapiens
gaauuaaccaaucaauguc

SEQ ID NO: 918356 - RNA, 19 nt, Homo sapiens
ccaaguaguccaucauagu

SEQ ID NO: 918357 - RNA, 19 nt, Homo sapiens
caucuuguccaacucauug

SEQ ID NO: 918358 - RNA, 19 nt, Homo sapiens
ggaugugaacaguauagaa

SEQ ID NO: 918359 - RNA, 19 nt, Homo sapiens
acauggaggugauucuugu

SEQ ID NO: 918360 - RNA, 19 nt, Homo sapiens
gaaguuaggggaaauggaa

SEQ ID NO: 918361 - RNA, 19 nt, Homo sapiens
gcaaaauggaguugaauug

SEQ ID NO: 918362 - RNA, 19 nt, Homo sapiens
gaacaugguuaggaaaaca

SEQ ID NO: 918363 - RNA, 19 nt, Homo sapiens
ucgagaccauccuggcuaa

SEQ ID NO: 918364 - RNA, 19 nt, Homo sapiens
uauaagacacacacaacuu

SEQ ID NO: 918365 - RNA, 19 nt, Homo sapiens
cuaaaacucgccauuauaa

SEQ ID NO: 918366 - RNA, 19 nt, Homo sapiens
acgcagaugagccgucuua

SEQ ID NO: 918367 - RNA, 19 nt, Homo sapiens
gccaaguaguccaucauag

SEQ ID NO: 918368 - RNA, 19 nt, Homo sapiens
gugaaacccugucucuacu

SEQ ID NO: 918369 - RNA, 19 nt, Homo sapiens
gacugucuauuccacauca

SEQ ID NO: 918370 - RNA, 19 nt, Homo sapiens
ggccaaggcgggaagauca

SEQ ID NO: 918371 - RNA, 19 nt, Homo sapiens
cgucuuagauaacuguucu

SEQ ID NO: 918372 - RNA, 19 nt, Homo sapiens
cucauugauuucagagaua

SEQ ID NO: 918373 - RNA, 19 nt, Homo sapiens
gagggaagaacaugguuag

SEQ ID NO: 918374 - RNA, 19 nt, Homo sapiens
cucaggaugugaacaguau

SEQ ID NO: 918375 - RNA, 19 nt, Homo sapiens
guaagccucucugaauguc

SEQ ID NO: 918376 - RNA, 19 nt, Homo sapiens
ucuccuaguuauccacauu

SEQ ID NO: 918377 - RNA, 19 nt, Homo sapiens
cgauuaacccucaucuugu

SEQ ID NO: 918378 - RNA, 19 nt, Homo sapiens
gaucacaaggucaggagau

SEQ ID NO: 918379 - RNA, 19 nt, Homo sapiens
ugacggacaccuuuacaca

SEQ ID NO: 918380 - RNA, 19 nt, Homo sapiens
gucaggagaucgagaccau

SEQ ID NO: 918381 - RNA, 19 nt, Homo sapiens
ccuguaaucccagcacuuu

SEQ ID NO: 918382 - RNA, 19 nt, Homo sapiens
uaacauggaggugauucuu

SEQ ID NO: 918383 - RNA, 19 nt, Homo sapiens
cuacuagucaaaugccuuu

SEQ ID NO: 918384 - RNA, 19 nt, Homo sapiens
gcuacucauucccuacuag

SEQ ID NO: 918385 - RNA, 19 nt, Homo sapiens
ugccauugcucaccacuag

SEQ ID NO: 918386 - RNA, 19 nt, Homo sapiens
cagaaacaacucucagcuu

SEQ ID NO: 918387 - RNA, 19 nt, Homo sapiens
cguaagaucucuacuaaga

SEQ ID NO: 918388 - RNA, 19 nt, Homo sapiens
ccacuuugcuguaaacauu

SEQ ID NO: 918389 - RNA, 19 nt, Homo sapiens
gcacauuccuuguauacug

SEQ ID NO: 918390 - RNA, 19 nt, Homo sapiens
ccauuuggcuuaaaccuaa

SEQ ID NO: 918391 - RNA, 19 nt, Homo sapiens
ggcguaagaucucuacuaa

SEQ ID NO: 918392 - RNA, 19 nt, Homo sapiens
gaaacccuguaucuacuaa

SEQ ID NO: 918393 - RNA, 19 nt, Homo sapiens
ucaaggcaauucaauauuc

SEQ ID NO: 918394 - RNA, 19 nt, Homo sapiens
gugaacacauccuuaaaug

SEQ ID NO: 918395 - RNA, 19 nt, Homo sapiens
gaacacauccuuaaaugac

SEQ ID NO: 918396 - RNA, 19 nt, Homo sapiens
cuacagagcauuaacaaau

SEQ ID NO: 918397 - RNA, 19 nt, Homo sapiens
cgaaaagggucaaguuauu

SEQ ID NO: 918398 - RNA, 19 nt, Homo sapiens
caaggcaauucaauauuca

SEQ ID NO: 918399 - RNA, 19 nt, Homo sapiens
guacuaaauucucacacau

SEQ ID NO: 918400 - RNA, 19 nt, Homo sapiens
gcaauucaauauucagcau

SEQ ID NO: 918401 - RNA, 19 nt, Homo sapiens
gagcccaucuucuguacug

SEQ ID NO: 918402 - RNA, 19 nt, Homo sapiens
agacuucuuucauuucuga

SEQ ID NO: 918403 - RNA, 19 nt, Homo sapiens
gguacuaaauucucacaca

SEQ ID NO: 918404 - RNA, 19 nt, Homo sapiens
caaguuccuuuggcaauga

SEQ ID NO: 918405 - RNA, 19 nt, Homo sapiens
cauggaaucucccaaaugc

SEQ ID NO: 918406 - RNA, 19 nt, Homo sapiens
caauggagcuacagagcau

SEQ ID NO: 918407 - RNA, 19 nt, Homo sapiens
ucacaucaauagacuucuu

SEQ ID NO: 918408 - RNA, 19 nt, Homo sapiens
guaauucucaggugcuuug

SEQ ID NO: 918409 - RNA, 19 nt, Homo sapiens
ggugaaacccuguaucuac

SEQ ID NO: 918410 - RNA, 19 nt, Homo sapiens
uaugagccauuacugaaau

SEQ ID NO: 918411 - RNA, 19 nt, Homo sapiens
cuagugaacacauccuuaa

SEQ ID NO: 918412 - RNA, 19 nt, Homo sapiens
cauguaaucccagcacuuu

SEQ ID NO: 918413 - RNA, 19 nt, Homo sapiens
gaaaagggucaaguuauuu

SEQ ID NO: 918414 - RNA, 19 nt, Homo sapiens
gcugacacaagacauauug

SEQ ID NO: 918415 - RNA, 19 nt, Homo sapiens
cacauuccuuguauacuga

SEQ ID NO: 918416 - RNA, 19 nt, Homo sapiens
aaugaccacuuugcuguaa

SEQ ID NO: 918417 - RNA, 19 nt, Homo sapiens
agcauuagcuagacuuaug

SEQ ID NO: 918418 - RNA, 19 nt, Homo sapiens
aaaauaugcugacacaaga

SEQ ID NO: 918419 - RNA, 19 nt, Homo sapiens
guaaaauaguggccuuuga

SEQ ID NO: 918420 - RNA, 19 nt, Homo sapiens
cuagacuuaugagccauua

SEQ ID NO: 918421 - RNA, 19 nt, Homo sapiens
gcuuaaaccuaauaaacac

SEQ ID NO: 918422 - RNA, 19 nt, Homo sapiens
gugaaacccuguaucuacu

SEQ ID NO: 918423 - RNA, 19 nt, Homo sapiens
ugacacaagacauauugaa

SEQ ID NO: 918424 - RNA, 19 nt, Homo sapiens
gugggcacauuccuuguau

SEQ ID NO: 918425 - RNA, 19 nt, Homo sapiens
ucccaagaauuacuauuuc

SEQ ID NO: 918426 - RNA, 19 nt, Homo sapiens
acacggcauuugguacuaa

SEQ ID NO: 918427 - RNA, 19 nt, Homo sapiens
guuaacacggcauuuggua

SEQ ID NO: 918428 - RNA, 19 nt, Homo sapiens
ugccuauacucacgcauaa

SEQ ID NO: 918429 - RNA, 19 nt, Homo sapiens
gacacaagacauauugaau

SEQ ID NO: 918430 - RNA, 19 nt, Homo sapiens
gcauuagcuagacuuauga

SEQ ID NO: 918431 - RNA, 19 nt, Homo sapiens
aaacacuagugaacacauc

SEQ ID NO: 918432 - RNA, 19 nt, Homo sapiens
gagcauuaacaaauacuca

SEQ ID NO: 918433 - RNA, 19 nt, Homo sapiens
caaugaccacuuugcugua

SEQ ID NO: 918434 - RNA, 19 nt, Homo sapiens
cccaagaauuacuauuuca

SEQ ID NO: 918435 - RNA, 19 nt, Homo sapiens
gagcuacagagcauuaaca

SEQ ID NO: 918436 - RNA, 19 nt, Homo sapiens
acacauccuuaaaugacuu

SEQ ID NO: 918437 - RNA, 19 nt, Homo sapiens
ugaacacauccuuaaauga

SEQ ID NO: 918438 - RNA, 19 nt, Homo sapiens
ggcuuaaaccuaauaaaca

SEQ ID NO: 918439 - RNA, 19 nt, Homo sapiens
gagacuauucgcauucugu

SEQ ID NO: 918440 - RNA, 19 nt, Homo sapiens
uugugaugcuucugugaua

SEQ ID NO: 918441 - RNA, 19 nt, Homo sapiens
gagaaauuagucacaucaa

SEQ ID NO: 918442 - RNA, 19 nt, Homo sapiens
ucaggugcuuugagaguuc

SEQ ID NO: 918443 - RNA, 19 nt, Homo sapiens
uaaauucucacacauaagc

SEQ ID NO: 918444 - RNA, 19 nt, Homo sapiens
gucaggagaucgagaccau

SEQ ID NO: 918445 - RNA, 19 nt, Homo sapiens
acaaguuccuuuggcaaug

SEQ ID NO: 918446 - RNA, 19 nt, Homo sapiens
ugagaaauuagucacauca

SEQ ID NO: 918447 - RNA, 19 nt, Homo sapiens
guugagaaauuagucacau

SEQ ID NO: 918448 - RNA, 19 nt, Homo sapiens
cuaauaaacacuagugaac

SEQ ID NO: 918449 - RNA, 19 nt, Homo sapiens
ccuaauaaacacuagugaa

SEQ ID NO: 918450 - RNA, 19 nt, Homo sapiens
gggcacauuccuuguauac

SEQ ID NO: 918451 - RNA, 19 nt, Homo sapiens
acagagcauuaacaaauac

SEQ ID NO: 918452 - RNA, 19 nt, Homo sapiens
gcauguaaucccagcacuu

SEQ ID NO: 918453 - RNA, 19 nt, Homo sapiens
cuuaugagccauuacugaa

SEQ ID NO: 918454 - RNA, 19 nt, Homo sapiens
caauauucagcauuagcua

SEQ ID NO: 918455 - RNA, 19 nt, Homo sapiens
cuauucgcauucuguauca

SEQ ID NO: 918456 - RNA, 19 nt, Homo sapiens
ccgggagacuauucgcauu

SEQ ID NO: 918457 - RNA, 19 nt, Homo sapiens
ugugaugcuucugugauaa

SEQ ID NO: 918458 - RNA, 19 nt, Homo sapiens
ugaaacccuguaucuacua

SEQ ID NO: 918459 - RNA, 19 nt, Homo sapiens
gcuacagagcauuaacaaa

SEQ ID NO: 918460 - RNA, 19 nt, Homo sapiens
uaaaauaguggccuuugaa

SEQ ID NO: 918461 - RNA, 19 nt, Homo sapiens
uaaauccaacccuauugug

SEQ ID NO: 918462 - RNA, 19 nt, Homo sapiens
gcauuaacaaauacucauc

SEQ ID NO: 918463 - RNA, 19 nt, Homo sapiens
aauaaacacuagugaacac

SEQ ID NO: 918464 - RNA, 19 nt, Homo sapiens
gggagacuauucgcauucu

SEQ ID NO: 918465 - RNA, 19 nt, Homo sapiens
ggggagaaguaaaauagug

SEQ ID NO: 918466 - RNA, 19 nt, Homo sapiens
ggagacuauucgcauucug

SEQ ID NO: 918467 - RNA, 19 nt, Homo sapiens
uggcguaagaucucuacua

SEQ ID NO: 918468 - RNA, 19 nt, Homo sapiens
agacuauucgcauucugua

SEQ ID NO: 918469 - RNA, 19 nt, Homo sapiens
cuuuggcaaugaccacuuu

SEQ ID NO: 918470 - RNA, 19 nt, Homo sapiens
gagccauuacugaaauuuc

SEQ ID NO: 918471 - RNA, 19 nt, Homo sapiens
ucucuacuaagauccauuu

SEQ ID NO: 918472 - RNA, 19 nt, Homo sapiens
uaacacggcauuugguacu

SEQ ID NO: 918473 - RNA, 19 nt, Homo sapiens
gaaucucccaaaugccuau

SEQ ID NO: 918474 - RNA, 19 nt, Homo sapiens
uuaaauccaacccuauugu

SEQ ID NO: 918475 - RNA, 19 nt, Homo sapiens
ugagggcaauggagcuaca

SEQ ID NO: 918476 - RNA, 19 nt, Homo sapiens
gaauggcguaagaucucua

SEQ ID NO: 918477 - RNA, 19 nt, Homo sapiens
ugaccacuuugcuguaaac

SEQ ID NO: 918478 - RNA, 19 nt, Homo sapiens
cacggcauuugguacuaaa

SEQ ID NO: 918479 - RNA, 19 nt, Homo sapiens
ucccaaaugccuauacuca

SEQ ID NO: 918480 - RNA, 19 nt, Homo sapiens
ucauggaaucucccaaaug

SEQ ID NO: 918481 - RNA, 19 nt, Homo sapiens
ucagcauuagcuagacuua

SEQ ID NO: 918482 - RNA, 19 nt, Homo sapiens
cccaucuucuguacugcua

SEQ ID NO: 918483 - RNA, 19 nt, Homo sapiens
caucaauagacuucuuuca

SEQ ID NO: 918484 - RNA, 19 nt, Homo sapiens
cacaucaauagacuucuuu

SEQ ID NO: 918485 - RNA, 19 nt, Homo sapiens
gauaauccuuuugcugaau

SEQ ID NO: 918486 - RNA, 19 nt, Homo sapiens
acuagugaacacauccuua

SEQ ID NO: 918487 - RNA, 19 nt, Homo sapiens
gggaaaggcucauuuauuu

SEQ ID NO: 918488 - RNA, 19 nt, Homo sapiens
gaacaauagucuacugaua

SEQ ID NO: 918489 - RNA, 19 nt, Homo sapiens
ggauaucccuuccagaaua

SEQ ID NO: 918490 - RNA, 19 nt, Homo sapiens
guaugugacucucaacuua

SEQ ID NO: 918491 - RNA, 19 nt, Homo sapiens
gaaagaaugucacaauguc

SEQ ID NO: 918492 - RNA, 19 nt, Homo sapiens
gaaaggcucauuuauuuga

SEQ ID NO: 918493 - RNA, 19 nt, Homo sapiens
gaugaacaaugauguguga

SEQ ID NO: 918494 - RNA, 19 nt, Homo sapiens
gcaaaggaauggaaggaau

SEQ ID NO: 918495 - RNA, 19 nt, Homo sapiens
caacagugguuugggauuu

SEQ ID NO: 918496 - RNA, 19 nt, Homo sapiens
ucaacauucucacugauua

SEQ ID NO: 918497 - RNA, 19 nt, Homo sapiens
gaauggagcucuguauaca

SEQ ID NO: 918498 - RNA, 19 nt, Homo sapiens
caacaucucauuugugaaa

SEQ ID NO: 918499 - RNA, 19 nt, Homo sapiens
aaacuuggauggaggcuaa

SEQ ID NO: 918500 - RNA, 19 nt, Homo sapiens
gaagauacaaggccacauu

SEQ ID NO: 918501 - RNA, 19 nt, Homo sapiens
gacgggcucucacguauuu

SEQ ID NO: 918502 - RNA, 19 nt, Homo sapiens
ggaagguuguuacauaaau

SEQ ID NO: 918503 - RNA, 19 nt, Homo sapiens
aauggaagguuguuacaua

SEQ ID NO: 918504 - RNA, 19 nt, Homo sapiens
gaacagacccaucauaugc

SEQ ID NO: 918505 - RNA, 19 nt, Homo sapiens
gauaguagcaucaacauuc

SEQ ID NO: 918506 - RNA, 19 nt, Homo sapiens
gauggaggcuaaauaacaa

SEQ ID NO: 918507 - RNA, 19 nt, Homo sapiens
uaaaguggguuagaugaaa

SEQ ID NO: 918508 - RNA, 19 nt, Homo sapiens
gcccugagcugcaacagaa

SEQ ID NO: 918509 - RNA, 19 nt, Homo sapiens
cgguauagaugaacaauga

SEQ ID NO: 918510 - RNA, 19 nt, Homo sapiens
gaauuucucugcccucauc

SEQ ID NO: 918511 - RNA, 19 nt, Homo sapiens
gcaucaacauucucacuga

SEQ ID NO: 918512 - RNA, 19 nt, Homo sapiens
acucugggcuauagaaaua

SEQ ID NO: 918513 - RNA, 19 nt, Homo sapiens
gaagugguguucacauugg

SEQ ID NO: 918514 - RNA, 19 nt, Homo sapiens
ccaagauaauguaagcuuu

SEQ ID NO: 918515 - RNA, 19 nt, Homo sapiens
uuaaguaucuagaggaaga

SEQ ID NO: 918516 - RNA, 19 nt, Homo sapiens
gauuacaccucuacaugga

SEQ ID NO: 918517 - RNA, 19 nt, Homo sapiens
cccaacaucucauuuguga

SEQ ID NO: 918518 - RNA, 19 nt, Homo sapiens
gugacuggcuugcuccuuu

SEQ ID NO: 918519 - RNA, 19 nt, Homo sapiens
acaaugaugugugacagua

SEQ ID NO: 918520 - RNA, 19 nt, Homo sapiens
gcuaaucaaugagaauuuc

SEQ ID NO: 918521 - RNA, 19 nt, Homo sapiens
guauuuggcuguugguuag

SEQ ID NO: 918522 - RNA, 19 nt, Homo sapiens
uaacaauggcucagaauuc

SEQ ID NO: 918523 - RNA, 19 nt, Homo sapiens
guagugcccuuuuagcuua

SEQ ID NO: 918524 - RNA, 19 nt, Homo sapiens
caugaugaauuccuauguu

SEQ ID NO: 918525 - RNA, 19 nt, Homo sapiens
ucagggacccacacucuua

SEQ ID NO: 918526 - RNA, 19 nt, Homo sapiens
ggauggaggcuaaauaaca

SEQ ID NO: 918527 - RNA, 19 nt, Homo sapiens
ccagggaaaggcucauuua

SEQ ID NO: 918528 - RNA, 19 nt, Homo sapiens
ccaagaacgugagaguuga

SEQ ID NO: 918529 - RNA, 19 nt, Homo sapiens
gggccuggauggucuaaga

SEQ ID NO: 918530 - RNA, 19 nt, Homo sapiens
ggaaaggcucauuuauuug

SEQ ID NO: 918531 - RNA, 19 nt, Homo sapiens
cagcccagauucaagauug

SEQ ID NO: 918532 - RNA, 19 nt, Homo sapiens
caggauaacauuccaagaa

SEQ ID NO: 918533 - RNA, 19 nt, Homo sapiens
uagguauguucacagauua

SEQ ID NO: 918534 - RNA, 19 nt, Homo sapiens
aaauaacaauggcucagaa

SEQ ID NO: 918535 - RNA, 19 nt, Homo sapiens
gauacucucaugcuuugua

SEQ ID NO: 918536 - RNA, 19 nt, Homo sapiens
aaagaggagcgaaauauau

SEQ ID NO: 918537 - RNA, 19 nt, Homo sapiens
caaaggaauggaaggaauu

SEQ ID NO: 918538 - RNA, 19 nt, Homo sapiens
ucagguacauguuaguguu

SEQ ID NO: 918539 - RNA, 19 nt, Homo sapiens
cagaauaccaagauaaugu

SEQ ID NO: 918540 - RNA, 19 nt, Homo sapiens
gcccauagccuuacugaag

SEQ ID NO: 918541 - RNA, 19 nt, Homo sapiens
caucucaucucagcuguau

SEQ ID NO: 918542 - RNA, 19 nt, Homo sapiens
auagguauguucacagauu

SEQ ID NO: 918543 - RNA, 19 nt, Homo sapiens
uaacugcagccaucuuuga

SEQ ID NO: 918544 - RNA, 19 nt, Homo sapiens
uuacugagaccaccaauuc

SEQ ID NO: 918545 - RNA, 19 nt, Homo sapiens
aggagaacauagaucauuu

SEQ ID NO: 918546 - RNA, 19 nt, Homo sapiens
ggaaguacauaggguuugg

SEQ ID NO: 918547 - RNA, 19 nt, Homo sapiens
gugaacagacccaucauau

SEQ ID NO: 918548 - RNA, 19 nt, Homo sapiens
ggagaacauagaucauuug

SEQ ID NO: 918549 - RNA, 19 nt, Homo sapiens
gguaggagaacauagauca

SEQ ID NO: 918550 - RNA, 19 nt, Homo sapiens
gguaauuugcuaaacauug

SEQ ID NO: 918551 - RNA, 19 nt, Homo sapiens
caacuuacaagaagcuaga

SEQ ID NO: 918552 - RNA, 19 nt, Homo sapiens
gaaauaauggaagguuguu

SEQ ID NO: 918553 - RNA, 19 nt, Homo sapiens
acucucaugcuuuguauua

SEQ ID NO: 918554 - RNA, 19 nt, Homo sapiens
uaggauaucccuuccagaa

SEQ ID NO: 918555 - RNA, 19 nt, Homo sapiens
uaagacgggcucucacgua

SEQ ID NO: 918556 - RNA, 19 nt, Homo sapiens
caacauucucacugauuaa

SEQ ID NO: 918557 - RNA, 19 nt, Homo sapiens
cugaagagacuauuuacaa

SEQ ID NO: 918558 - RNA, 19 nt, Homo sapiens
caggguaauuugcuaaaca

SEQ ID NO: 918559 - RNA, 19 nt, Homo sapiens
ugaaagaaugucacaaugu

SEQ ID NO: 918560 - RNA, 19 nt, Homo sapiens
gguacauguuaguguuuaa

SEQ ID NO: 918561 - RNA, 19 nt, Homo sapiens
augcauauauacacuggua

SEQ ID NO: 918562 - RNA, 19 nt, Homo sapiens
acaauagucuacugauaag

SEQ ID NO: 918563 - RNA, 19 nt, Homo sapiens
guacauaggguuugguuuu

SEQ ID NO: 918564 - RNA, 19 nt, Homo sapiens
gaaaagcaaaggcauagaa

SEQ ID NO: 918565 - RNA, 19 nt, Homo sapiens
ucagugacuucauuguuuc

SEQ ID NO: 918566 - RNA, 19 nt, Homo sapiens
gauuagaguuuuacugaga

SEQ ID NO: 918567 - RNA, 19 nt, Homo sapiens
cauaaguagugcccuuuua

SEQ ID NO: 918568 - RNA, 19 nt, Homo sapiens
gauaucccuuccagaauac

SEQ ID NO: 918569 - RNA, 19 nt, Homo sapiens
ucucugcccucaucaacuu

SEQ ID NO: 918570 - RNA, 19 nt, Homo sapiens
aaaggaauggaaggaauua

SEQ ID NO: 918571 - RNA, 19 nt, Homo sapiens
caaaggcauagaagggaua

SEQ ID NO: 918572 - RNA, 19 nt, Homo sapiens
gagauuagaguuuuacuga

SEQ ID NO: 918573 - RNA, 19 nt, Homo sapiens
aagaggagcgaaauauauu

SEQ ID NO: 918574 - RNA, 19 nt, Homo sapiens
cccauagccuuacugaaga

SEQ ID NO: 918575 - RNA, 19 nt, Homo sapiens
caagauugaggaaauagau

SEQ ID NO: 918576 - RNA, 19 nt, Homo sapiens
caucucauuugugaaagaa

SEQ ID NO: 918577 - RNA, 19 nt, Homo sapiens
caaauaccuuguccgaaaa

SEQ ID NO: 918578 - RNA, 19 nt, Homo sapiens
aaaguggguuagaugaaau

SEQ ID NO: 918579 - RNA, 19 nt, Homo sapiens
uuauagguauguucacaga

SEQ ID NO: 918580 - RNA, 19 nt, Homo sapiens
uguaauagcaacagugguu

SEQ ID NO: 918581 - RNA, 19 nt, Homo sapiens
aucagugacuucauuguuu

SEQ ID NO: 918582 - RNA, 19 nt, Homo sapiens
auagaucauuugccaguga

SEQ ID NO: 918583 - RNA, 19 nt, Homo sapiens
gaaaucugguaggagaaca

SEQ ID NO: 918584 - RNA, 19 nt, Homo sapiens
auggagcucuguauacauu

SEQ ID NO: 918585 - RNA, 19 nt, Homo sapiens
caacagaagacugaaugga

SEQ ID NO: 918586 - RNA, 19 nt, Homo sapiens
ggaauggaaggaauuaacu

SEQ ID NO: 918587 - RNA, 19 nt, Homo sapiens
gaacagagaucuuaacaug

SEQ ID NO: 918588 - RNA, 19 nt, Homo sapiens
caaaggaccuggcggcaaa

SEQ ID NO: 918589 - RNA, 19 nt, Homo sapiens
ucaaagagcugugauccua

SEQ ID NO: 918590 - RNA, 19 nt, Homo sapiens
gaaccuccuuaguuaauaa

SEQ ID NO: 918591 - RNA, 19 nt, Homo sapiens
agagguagcuguuauuuau

SEQ ID NO: 918592 - RNA, 19 nt, Homo sapiens
gcaaauaagcaaugucuga

SEQ ID NO: 918593 - RNA, 19 nt, Homo sapiens
cagaguagaugcugcguaa

SEQ ID NO: 918594 - RNA, 19 nt, Homo sapiens
gaaggugucuaaacuaucu

SEQ ID NO: 918595 - RNA, 19 nt, Homo sapiens
ucacaugacuggcacuaaa

SEQ ID NO: 918596 - RNA, 19 nt, Homo sapiens
gcguaagucucuaaacaaa

SEQ ID NO: 918597 - RNA, 19 nt, Homo sapiens
guaagucucuaaacaaagu

SEQ ID NO: 918598 - RNA, 19 nt, Homo sapiens
gagcugggccaaacacaua

SEQ ID NO: 918599 - RNA, 19 nt, Homo sapiens
gaaccagaguaauuagaug

SEQ ID NO: 918600 - RNA, 19 nt, Homo sapiens
ggaaccuccuuaguuaaua

SEQ ID NO: 918601 - RNA, 19 nt, Homo sapiens
cagaaggugucuaaacuau

SEQ ID NO: 918602 - RNA, 19 nt, Homo sapiens
ccacaaauacuccaaacaa

SEQ ID NO: 918603 - RNA, 19 nt, Homo sapiens
uaaccaaguugccaauaau

SEQ ID NO: 918604 - RNA, 19 nt, Homo sapiens
uaacagagcugggccaaac

SEQ ID NO: 918605 - RNA, 19 nt, Homo sapiens
gcagaaggugucuaaacua

SEQ ID NO: 918606 - RNA, 19 nt, Homo sapiens
aaagagcugugauccuaaa

SEQ ID NO: 918607 - RNA, 19 nt, Homo sapiens
uuaaccaaguugccaauaa

SEQ ID NO: 918608 - RNA, 19 nt, Homo sapiens
cgagccagguugguaguua

SEQ ID NO: 918609 - RNA, 19 nt, Homo sapiens
cguaaaaucucgaaaagaa

SEQ ID NO: 918610 - RNA, 19 nt, Homo sapiens
cagacuaaauacacacaaa

SEQ ID NO: 918611 - RNA, 19 nt, Homo sapiens
cacgugcaaugccaaguua

SEQ ID NO: 918612 - RNA, 19 nt, Homo sapiens
accauuaucucuuguagaa

SEQ ID NO: 918613 - RNA, 19 nt, Homo sapiens
gcaccgagccagguuggua

SEQ ID NO: 918614 - RNA, 19 nt, Homo sapiens
ggcagaaggugucuaaacu

SEQ ID NO: 918615 - RNA, 19 nt, Homo sapiens
guagaacuuuccaaauagu

SEQ ID NO: 918616 - RNA, 19 nt, Homo sapiens
cacaaauacuccaaacaau

SEQ ID NO: 918617 - RNA, 19 nt, Homo sapiens
gauaaacggucaaaagcaa

SEQ ID NO: 918618 - RNA, 19 nt, Homo sapiens
cuacagagaaacacacaaa

SEQ ID NO: 918619 - RNA, 19 nt, Homo sapiens
aaagaugccacaacacaaa

SEQ ID NO: 918620 - RNA, 19 nt, Homo sapiens
gaauugguaccuacagaga

SEQ ID NO: 918621 - RNA, 19 nt, Homo sapiens
agcaaugucugagguauaa

SEQ ID NO: 918622 - RNA, 19 nt, Homo sapiens
uaacaugccacccgcagaa

SEQ ID NO: 918623 - RNA, 19 nt, Homo sapiens
uacauaccauuaucucuug

SEQ ID NO: 918624 - RNA, 19 nt, Homo sapiens
ccagguugguaguuacaaa

SEQ ID NO: 918625 - RNA, 19 nt, Homo sapiens
caagaagugcaaccugaaa

SEQ ID NO: 918626 - RNA, 19 nt, Homo sapiens
ggaccuggcggcaaaguca

SEQ ID NO: 918627 - RNA, 19 nt, Homo sapiens
gaaaggcucacuggaagau

SEQ ID NO: 918628 - RNA, 19 nt, Homo sapiens
acagaaaggcucacuggaa

SEQ ID NO: 918629 - RNA, 19 nt, Homo sapiens
uguagaacuuuccaaauag

SEQ ID NO: 918630 - RNA, 19 nt, Homo sapiens
gagggagggugccaaaggu

SEQ ID NO: 918631 - RNA, 19 nt, Homo sapiens
gaaaagaugccacaacaca

SEQ ID NO: 918632 - RNA, 19 nt, Homo sapiens
caaagucaaauggcuaauu

SEQ ID NO: 918633 - RNA, 19 nt, Homo sapiens
gagguagcuguuauuuaua

SEQ ID NO: 918634 - RNA, 19 nt, Homo sapiens
aaaggcagaaggugucuaa

SEQ ID NO: 918635 - RNA, 19 nt, Homo sapiens
caagugcugugcucagucu

SEQ ID NO: 918636 - RNA, 19 nt, Homo sapiens
aaacagacaagaagugcaa

SEQ ID NO: 918637 - RNA, 19 nt, Homo sapiens
uggagugacugcagacaga

SEQ ID NO: 918638 - RNA, 19 nt, Homo sapiens
agagggaagugaaaauaua

SEQ ID NO: 918639 - RNA, 19 nt, Homo sapiens
ccuaaaaggucaucaaauc

SEQ ID NO: 918640 - RNA, 19 nt, Homo sapiens
caaagagcugugauccuaa

SEQ ID NO: 918641 - RNA, 19 nt, Homo sapiens
caaugucugagguauaauu

SEQ ID NO: 918642 - RNA, 19 nt, Homo sapiens
cugcguaagucucuaaaca

SEQ ID NO: 918643 - RNA, 19 nt, Homo sapiens
gaguagaugcugcguaagu

SEQ ID NO: 918644 - RNA, 19 nt, Homo sapiens
aaagagguagcuguuauuu

SEQ ID NO: 918645 - RNA, 19 nt, Homo sapiens
cagaaaagaugccacaaca

SEQ ID NO: 918646 - RNA, 19 nt, Homo sapiens
uaagcaaugucugagguau

SEQ ID NO: 918647 - RNA, 19 nt, Homo sapiens
cauuaucucuuguagaacu

SEQ ID NO: 918648 - RNA, 19 nt, Homo sapiens
aagaauugguaccuacaga

SEQ ID NO: 918649 - RNA, 19 nt, Homo sapiens
caaguugccaauaaugguu

SEQ ID NO: 918650 - RNA, 19 nt, Homo sapiens
gggccaaacacauauuuua

SEQ ID NO: 918651 - RNA, 19 nt, Homo sapiens
aagagguagcuguuauuua

SEQ ID NO: 918652 - RNA, 19 nt, Homo sapiens
ugccaauaaugguuucaaa

SEQ ID NO: 918653 - RNA, 19 nt, Homo sapiens
uagccuauguggauuaaaa

SEQ ID NO: 918654 - RNA, 19 nt, Homo sapiens
gagccagguugguaguuac

SEQ ID NO: 918655 - RNA, 19 nt, Homo sapiens
cacaaagucaaauggcuaa

SEQ ID NO: 918656 - RNA, 19 nt, Homo sapiens
ccaaugauaaguauuaagc

SEQ ID NO: 918657 - RNA, 19 nt, Homo sapiens
agucuaacaauaccaauga

SEQ ID NO: 918658 - RNA, 19 nt, Homo sapiens
auugguaccuacagagaaa

SEQ ID NO: 918659 - RNA, 19 nt, Homo sapiens
cagaacagagaucuuaaca

SEQ ID NO: 918660 - RNA, 19 nt, Homo sapiens
gguagcuguuauuuauaug

SEQ ID NO: 918661 - RNA, 19 nt, Homo sapiens
gaaaauucccacaauccaa

SEQ ID NO: 918662 - RNA, 19 nt, Homo sapiens
ucacgugcaaugccaaguu

SEQ ID NO: 918663 - RNA, 19 nt, Homo sapiens
caaacucucaggcacaaag

SEQ ID NO: 918664 - RNA, 19 nt, Homo sapiens
gccaaagguucuaaaacuu

SEQ ID NO: 918665 - RNA, 19 nt, Homo sapiens
ucccuggugugguaaguga

SEQ ID NO: 918666 - RNA, 19 nt, Homo sapiens
gaaacacacaaaacacuga

SEQ ID NO: 918667 - RNA, 19 nt, Homo sapiens
ugaaccagaguaauuagau

SEQ ID NO: 918668 - RNA, 19 nt, Homo sapiens
ucuagccuauguggauuaa

SEQ ID NO: 918669 - RNA, 19 nt, Homo sapiens
gaagugcaaccugaaaauu

SEQ ID NO: 918670 - RNA, 19 nt, Homo sapiens
aagcaaugucugagguaua

SEQ ID NO: 918671 - RNA, 19 nt, Homo sapiens
cuaaacaaaguauccaaag

SEQ ID NO: 918672 - RNA, 19 nt, Homo sapiens
ggagacguuuuaucacaug

SEQ ID NO: 918673 - RNA, 19 nt, Homo sapiens
ggggagacguuuuaucaca

SEQ ID NO: 918674 - RNA, 19 nt, Homo sapiens
gagggaagugaaaauauaa

SEQ ID NO: 918675 - RNA, 19 nt, Homo sapiens
acuugaaccagaguaauua

SEQ ID NO: 918676 - RNA, 19 nt, Homo sapiens
ggaaaacagacaagaagug

SEQ ID NO: 918677 - RNA, 19 nt, Homo sapiens
ggccaaacacauauuuuaa

SEQ ID NO: 918678 - RNA, 19 nt, Homo sapiens
cauccaaaaugucuuagga

SEQ ID NO: 918679 - RNA, 19 nt, Homo sapiens
aagaaugguuagauaaagc

SEQ ID NO: 918680 - RNA, 19 nt, Homo sapiens
acaagaagugcaaccugaa

SEQ ID NO: 918681 - RNA, 19 nt, Homo sapiens
agagcuccauguccaagug

SEQ ID NO: 918682 - RNA, 19 nt, Homo sapiens
ggaggguauuaugcaccua

SEQ ID NO: 918683 - RNA, 19 nt, Homo sapiens
cuccaucagcaaagaauuu

SEQ ID NO: 918684 - RNA, 19 nt, Homo sapiens
uuacgccacuaugaaacaa

SEQ ID NO: 918685 - RNA, 19 nt, Homo sapiens
ucucuagccuauguggauu

SEQ ID NO: 918686 - RNA, 19 nt, Homo sapiens
gaauccacauuuuccacaa

SEQ ID NO: 918687 - RNA, 19 nt, Homo sapiens
guaaauaccuggaggaaug

SEQ ID NO: 918688 - RNA, 19 nt, Homo sapiens
guucaccgcuguacuauuu

SEQ ID NO: 918689 - RNA, 19 nt, Homo sapiens
ggaaaggaauguggaauga

SEQ ID NO: 918690 - RNA, 19 nt, Homo sapiens
gcaaugugcugcccugaga

SEQ ID NO: 918691 - RNA, 19 nt, Homo sapiens
gcacuaggccuguugaaau

SEQ ID NO: 918692 - RNA, 19 nt, Homo sapiens
gugauaagcuacauguaug

SEQ ID NO: 918693 - RNA, 19 nt, Homo sapiens
uuacguaugugauaagcua

SEQ ID NO: 918694 - RNA, 19 nt, Homo sapiens
aaaggaauguggaaugaga

SEQ ID NO: 918695 - RNA, 19 nt, Homo sapiens
gaugacagcugcagagacu

SEQ ID NO: 918696 - RNA, 19 nt, Homo sapiens
ggagugggcccucaguaaa

SEQ ID NO: 918697 - RNA, 19 nt, Homo sapiens
gcccugagauccaguuuca

SEQ ID NO: 918698 - RNA, 19 nt, Homo sapiens
gagauccaguuucaagaau

SEQ ID NO: 918699 - RNA, 19 nt, Homo sapiens
uaagagaucacaugucugu

SEQ ID NO: 918700 - RNA, 19 nt, Homo sapiens
gagaagcgccagcgagaga

SEQ ID NO: 918701 - RNA, 19 nt, Homo sapiens
cgaccugacugccuuggaa

SEQ ID NO: 918702 - RNA, 19 nt, Homo sapiens
cagcaucgccuuccaaauc

SEQ ID NO: 918703 - RNA, 19 nt, Homo sapiens
aaugugaccuggccaguga

SEQ ID NO: 918704 - RNA, 19 nt, Homo sapiens
ggaagguccucauguuucg

SEQ ID NO: 918705 - RNA, 19 nt, Homo sapiens
ggaauugaagcgaaugaga

SEQ ID NO: 918706 - RNA, 19 nt, Homo sapiens
gaauguggaaugagaacuu

SEQ ID NO: 918707 - RNA, 19 nt, Homo sapiens
guaguagucucccuuacag

SEQ ID NO: 918708 - RNA, 19 nt, Homo sapiens
aguaagagaucacaugucu

SEQ ID NO: 918709 - RNA, 19 nt, Homo sapiens
gaacuggccaggaggaagu

SEQ ID NO: 918710 - RNA, 19 nt, Homo sapiens
gaagugacgucuggguucu

SEQ ID NO: 918711 - RNA, 19 nt, Homo sapiens
cacuaggccuguugaaaug

SEQ ID NO: 918712 - RNA, 19 nt, Homo sapiens
ugacugccuuggaauugaa

SEQ ID NO: 918713 - RNA, 19 nt, Homo sapiens
gggaaaggaauguggaaug

SEQ ID NO: 918714 - RNA, 19 nt, Homo sapiens
gauccaguuucaagaaugg

SEQ ID NO: 918715 - RNA, 19 nt, Homo sapiens
ugaugcauguugucgcuuu

SEQ ID NO: 918716 - RNA, 19 nt, Homo sapiens
gcuguacuauuuguguaaa

SEQ ID NO: 918717 - RNA, 19 nt, Homo sapiens
acacauuccucgccaccuu

SEQ ID NO: 918718 - RNA, 19 nt, Homo sapiens
cgaguaguagucucccuua

SEQ ID NO: 918719 - RNA, 19 nt, Homo sapiens
agugggcccucaguaaaua

SEQ ID NO: 918720 - RNA, 19 nt, Homo sapiens
cccauuaggugacagaagu

SEQ ID NO: 918721 - RNA, 19 nt, Homo sapiens
ggaccagaccuccauggau

SEQ ID NO: 918722 - RNA, 19 nt, Homo sapiens
cugagaaccuccagcuuca

SEQ ID NO: 918723 - RNA, 19 nt, Homo sapiens
acaugucuguguaguguga

SEQ ID NO: 918724 - RNA, 19 nt, Homo sapiens
cgaaggcaccgcugaaugg

SEQ ID NO: 918725 - RNA, 19 nt, Homo sapiens
cccuaacagucgaguagua

SEQ ID NO: 918726 - RNA, 19 nt, Homo sapiens
ucaagaaugggcagguaaa

SEQ ID NO: 918727 - RNA, 19 nt, Homo sapiens
ugagauccaguuucaagaa

SEQ ID NO: 918728 - RNA, 19 nt, Homo sapiens
ccagugagguuauuuucuu

SEQ ID NO: 918729 - RNA, 19 nt, Homo sapiens
ugugauaagcuacauguau

SEQ ID NO: 918730 - RNA, 19 nt, Homo sapiens
gagugggcccucaguaaau

SEQ ID NO: 918731 - RNA, 19 nt, Homo sapiens
ccgcuguacuauuugugua

SEQ ID NO: 918732 - RNA, 19 nt, Homo sapiens
gugguucaccgcuguacua

SEQ ID NO: 918733 - RNA, 19 nt, Homo sapiens
ggauggcugugaggcauuc

SEQ ID NO: 918734 - RNA, 19 nt, Homo sapiens
cucaguggcuugacucuca

SEQ ID NO: 918735 - RNA, 19 nt, Homo sapiens
ggagaagacccuggaagag

SEQ ID NO: 918736 - RNA, 19 nt, Homo sapiens
guaaacgcagugugggaaa

SEQ ID NO: 918737 - RNA, 19 nt, Homo sapiens
acagaagucagaaucgauu

SEQ ID NO: 918738 - RNA, 19 nt, Homo sapiens
ggagacaccgcgaucacau

SEQ ID NO: 918739 - RNA, 19 nt, Homo sapiens
gaaugagaacuuggugguu

SEQ ID NO: 918740 - RNA, 19 nt, Homo sapiens
gggagaggcuggaguuccu

SEQ ID NO: 918741 - RNA, 19 nt, Homo sapiens
ccucugagaagcagcacua

SEQ ID NO: 918742 - RNA, 19 nt, Homo sapiens
gaaggcaccgcugaaugga

SEQ ID NO: 918743 - RNA, 19 nt, Homo sapiens
uggagugggcccucaguaa

SEQ ID NO: 918744 - RNA, 19 nt, Homo sapiens
ggguuccucaucaucaaua

SEQ ID NO: 918745 - RNA, 19 nt, Homo sapiens
ucaccgcuguacuauuugu

SEQ ID NO: 918746 - RNA, 19 nt, Homo sapiens
uuucaagaaugggcaggua

SEQ ID NO: 918747 - RNA, 19 nt, Homo sapiens
aagcagugguuagaggaaa

SEQ ID NO: 918748 - RNA, 19 nt, Homo sapiens
ggugggagaggcuggaguu

SEQ ID NO: 918749 - RNA, 19 nt, Homo sapiens
gccagaaucuccccauuag

SEQ ID NO: 918750 - RNA, 19 nt, Homo sapiens
ucaguaagagaucacaugu

SEQ ID NO: 918751 - RNA, 19 nt, Homo sapiens
caagggaugcugcguacca

SEQ ID NO: 918752 - RNA, 19 nt, Homo sapiens
gagacaccgcgaucacaug

SEQ ID NO: 918753 - RNA, 19 nt, Homo sapiens
gcauuccugcggcauguga

SEQ ID NO: 918754 - RNA, 19 nt, Homo sapiens
ccgaugaugggccucagua

SEQ ID NO: 918755 - RNA, 19 nt, Homo sapiens
gcaucgccuuccaaaucuu

SEQ ID NO: 918756 - RNA, 19 nt, Homo sapiens
gaaaggaauguggaaugag

SEQ ID NO: 918757 - RNA, 19 nt, Homo sapiens
ggagagcaaaauaauguuu

SEQ ID NO: 918758 - RNA, 19 nt, Homo sapiens
gacagaagucagaaucgau

SEQ ID NO: 918759 - RNA, 19 nt, Homo sapiens
ugacagcugcagagacuuc

SEQ ID NO: 918760 - RNA, 19 nt, Homo sapiens
cagcaucgaccuugugaac

SEQ ID NO: 918761 - RNA, 19 nt, Homo sapiens
aauguggaaugagaacuug

SEQ ID NO: 918762 - RNA, 19 nt, Homo sapiens
gaugcauguugucgcuuuc

SEQ ID NO: 918763 - RNA, 19 nt, Homo sapiens
gcaagcuguggucggauga

SEQ ID NO: 918764 - RNA, 19 nt, Homo sapiens
cacaggagacagaggagaa

SEQ ID NO: 918765 - RNA, 19 nt, Homo sapiens
gaugaugggccucaguaac

SEQ ID NO: 918766 - RNA, 19 nt, Homo sapiens
guagucucccuuacaggaa

SEQ ID NO: 918767 - RNA, 19 nt, Homo sapiens
uaaacgcagugugggaaag

SEQ ID NO: 918768 - RNA, 19 nt, Homo sapiens
ugcguuuggugcagcauuu

SEQ ID NO: 918769 - RNA, 19 nt, Homo sapiens
agccacaggccgaaucuuu

SEQ ID NO: 918770 - RNA, 19 nt, Homo sapiens
aggcuggaguuccuucaga

SEQ ID NO: 918771 - RNA, 19 nt, Homo sapiens
aggagaagacccuggaaga

SEQ ID NO: 918772 - RNA, 19 nt, Homo sapiens
gaguaguagucucccuuac

SEQ ID NO: 918773 - RNA, 19 nt, Homo sapiens
ccucaccgcaucucacaug

SEQ ID NO: 918774 - RNA, 19 nt, Homo sapiens
ccacaggccgaaucuuucu

SEQ ID NO: 918775 - RNA, 19 nt, Homo sapiens
ggaggagacaccgcgauca

SEQ ID NO: 918776 - RNA, 19 nt, Homo sapiens
uaacagucgaguaguaguc

SEQ ID NO: 918777 - RNA, 19 nt, Homo sapiens
cugacugccuuggaauuga

SEQ ID NO: 918778 - RNA, 19 nt, Homo sapiens
agauccaguuucaagaaug

SEQ ID NO: 918779 - RNA, 19 nt, Homo sapiens
gcagcacuaggccuguuga

SEQ ID NO: 918780 - RNA, 19 nt, Homo sapiens
ugacugacccgaggaaggu

SEQ ID NO: 918781 - RNA, 19 nt, Homo sapiens
gccacaggccgaaucuuuc

SEQ ID NO: 918782 - RNA, 19 nt, Homo sapiens
cgaugugaaugucgauacu

SEQ ID NO: 918783 - RNA, 19 nt, Homo sapiens
gcagugugggaaaggaaug

SEQ ID NO: 918784 - RNA, 19 nt, Homo sapiens
guucugcccgcacacauuc

SEQ ID NO: 918785 - RNA, 19 nt, Homo sapiens
ccugagauccaguuucaag

SEQ ID NO: 918786 - RNA, 19 nt, Homo sapiens
caagcagugguuagaggaa

SEQ ID NO: 918787 - RNA, 19 nt, Homo sapiens
guaaauacuuccucuguuu

SEQ ID NO: 918788 - RNA, 19 nt, Homo sapiens
ucagugaguucaucuguaa

SEQ ID NO: 918789 - RNA, 19 nt, Homo sapiens
acauugaccuucaguuuaa

SEQ ID NO: 918790 - RNA, 19 nt, Homo sapiens
caagauguucugcagauua

SEQ ID NO: 918791 - RNA, 19 nt, Homo sapiens
ugguauggcuaauuucuua

SEQ ID NO: 918792 - RNA, 19 nt, Homo sapiens
ccaaagauguuaagugaac

SEQ ID NO: 918793 - RNA, 19 nt, Homo sapiens
gagcugagcauuucuuuua

SEQ ID NO: 918794 - RNA, 19 nt, Homo sapiens
ucccaaagauguuaaguga

SEQ ID NO: 918795 - RNA, 19 nt, Homo sapiens
ggaccauucugauccaguu

SEQ ID NO: 918796 - RNA, 19 nt, Homo sapiens
uaagauaucuagcagaaac

SEQ ID NO: 918797 - RNA, 19 nt, Homo sapiens
caccuuaguuugauucuau

SEQ ID NO: 918798 - RNA, 19 nt, Homo sapiens
gaaauccaaauccuagaaa

SEQ ID NO: 918799 - RNA, 19 nt, Homo sapiens
gcuagcaccuuguaguaug

SEQ ID NO: 918800 - RNA, 19 nt, Homo sapiens
gcuugcagauguuuaagaa

SEQ ID NO: 918801 - RNA, 19 nt, Homo sapiens
aaucaaagaucagugaguu

SEQ ID NO: 918802 - RNA, 19 nt, Homo sapiens
caaccuggcuacuggaauc

SEQ ID NO: 918803 - RNA, 19 nt, Homo sapiens
gauguuaagugaaccuaca

SEQ ID NO: 918804 - RNA, 19 nt, Homo sapiens
aaugugguauggcuaauuu

SEQ ID NO: 918805 - RNA, 19 nt, Homo sapiens
ugaaacauguagugguuau

SEQ ID NO: 918806 - RNA, 19 nt, Homo sapiens
aaugaaacauguagugguu

SEQ ID NO: 918807 - RNA, 19 nt, Homo sapiens
caaauggaacaauguggua

SEQ ID NO: 918808 - RNA, 19 nt, Homo sapiens
uuaagugaaccuacaguua

SEQ ID NO: 918809 - RNA, 19 nt, Homo sapiens
ggaacugucccagcuuuaa

SEQ ID NO: 918810 - RNA, 19 nt, Homo sapiens
gaaaaccccuccuaagauc

SEQ ID NO: 918811 - RNA, 19 nt, Homo sapiens
cacagacgauggcuacauu

SEQ ID NO: 918812 - RNA, 19 nt, Homo sapiens
cuagaucaccuuaguuuga

SEQ ID NO: 918813 - RNA, 19 nt, Homo sapiens
cugaguauauuauccugua

SEQ ID NO: 918814 - RNA, 19 nt, Homo sapiens
ugucccagcuuuaagauau

SEQ ID NO: 918815 - RNA, 19 nt, Homo sapiens
gcgccuuucucauuauuau

SEQ ID NO: 918816 - RNA, 19 nt, Homo sapiens
gauuggcgccuuucucauu

SEQ ID NO: 918817 - RNA, 19 nt, Homo sapiens
cuacauugaccuucaguuu

SEQ ID NO: 918818 - RNA, 19 nt, Homo sapiens
gcagcuugcagauguuuaa

SEQ ID NO: 918819 - RNA, 19 nt, Homo sapiens
aacuauagcugaggacuaa

SEQ ID NO: 918820 - RNA, 19 nt, Homo sapiens
ccugggcccugacaaguuu

SEQ ID NO: 918821 - RNA, 19 nt, Homo sapiens
gaaccuacaguuagcuaau

SEQ ID NO: 918822 - RNA, 19 nt, Homo sapiens
uaagugaaccuacaguuag

SEQ ID NO: 918823 - RNA, 19 nt, Homo sapiens
uacauugaccuucaguuua

SEQ ID NO: 918824 - RNA, 19 nt, Homo sapiens
ugacagcaaccaggaauuu

SEQ ID NO: 918825 - RNA, 19 nt, Homo sapiens
uuacuugcuuucuuacuga

SEQ ID NO: 918826 - RNA, 19 nt, Homo sapiens
gcugaggacuaaggaauuc

SEQ ID NO: 918827 - RNA, 19 nt, Homo sapiens
guggaacugucccagcuuu

SEQ ID NO: 918828 - RNA, 19 nt, Homo sapiens
cagcauauaauuugcauca

SEQ ID NO: 918829 - RNA, 19 nt, Homo sapiens
aagauguucugcagauuau

SEQ ID NO: 918830 - RNA, 19 nt, Homo sapiens
uuacuccuaugaugacauu

SEQ ID NO: 918831 - RNA, 19 nt, Homo sapiens
guacacuuaucccuaccuu

SEQ ID NO: 918832 - RNA, 19 nt, Homo sapiens
ccaguaguaaagugaaaua

SEQ ID NO: 918833 - RNA, 19 nt, Homo sapiens
ccaauuuguucuuguagca

SEQ ID NO: 918834 - RNA, 19 nt, Homo sapiens
uagagguuauucuguaaug

SEQ ID NO: 918835 - RNA, 19 nt, Homo sapiens
ugaugacauuccagacuuu

SEQ ID NO: 918836 - RNA, 19 nt, Homo sapiens
uguaaauacuuccucuguu

SEQ ID NO: 918837 - RNA, 19 nt, Homo sapiens
acacuuaucccuaccuuca

SEQ ID NO: 918838 - RNA, 19 nt, Homo sapiens
cuaccgugcuuacuccuau

SEQ ID NO: 918839 - RNA, 19 nt, Homo sapiens
gaucagugaguucaucugu

SEQ ID NO: 918840 - RNA, 19 nt, Homo sapiens
gaacugucccagcuuuaag

SEQ ID NO: 918841 - RNA, 19 nt, Homo sapiens
uguaguaugucaucauucu

SEQ ID NO: 918842 - RNA, 19 nt, Homo sapiens
gcagauuauuccuuuaacg

SEQ ID NO: 918843 - RNA, 19 nt, Homo sapiens
gaccuucaguuuaagaaaa

SEQ ID NO: 918844 - RNA, 19 nt, Homo sapiens
uagguuggacagcauauaa

SEQ ID NO: 918845 - RNA, 19 nt, Homo sapiens
uguagcaaauggaacaaug

SEQ ID NO: 918846 - RNA, 19 nt, Homo sapiens
gauguucugcagauuauuc

SEQ ID NO: 918847 - RNA, 19 nt, Homo sapiens
gguuggacagcauauaauu

SEQ ID NO: 918848 - RNA, 19 nt, Homo sapiens
aaagaucagugaguucauc

SEQ ID NO: 918849 - RNA, 19 nt, Homo sapiens
ugaaauccaaauccuagaa

SEQ ID NO: 918850 - RNA, 19 nt, Homo sapiens
ucaagauguucugcagauu

SEQ ID NO: 918851 - RNA, 19 nt, Homo sapiens
gagguuauucuguaaugga

SEQ ID NO: 918852 - RNA, 19 nt, Homo sapiens
gugcuuacuccuaugauga

SEQ ID NO: 918853 - RNA, 19 nt, Homo sapiens
cuuguaguaugucaucauu

SEQ ID NO: 918854 - RNA, 19 nt, Homo sapiens
auuggcgccuuucucauua

SEQ ID NO: 918855 - RNA, 19 nt, Homo sapiens
gugaguucaucuguaauau

SEQ ID NO: 918856 - RNA, 19 nt, Homo sapiens
ucaaagaucagugaguuca

SEQ ID NO: 918857 - RNA, 19 nt, Homo sapiens
accuacaguuagcuaauua

SEQ ID NO: 918858 - RNA, 19 nt, Homo sapiens
gcacagacgauggcuacau

SEQ ID NO: 918859 - RNA, 19 nt, Homo sapiens
gacagcauauaauuugcau

SEQ ID NO: 918860 - RNA, 19 nt, Homo sapiens
ggacagcauauaauuugca

SEQ ID NO: 918861 - RNA, 19 nt, Homo sapiens
guuggacagcauauaauuu

SEQ ID NO: 918862 - RNA, 19 nt, Homo sapiens
cuguagagcugagcauuuc

SEQ ID NO: 918863 - RNA, 19 nt, Homo sapiens
cugcagauuauuccuuuaa

SEQ ID NO: 918864 - RNA, 19 nt, Homo sapiens
ccaucgcacuugccacugu

SEQ ID NO: 918865 - RNA, 19 nt, Homo sapiens
uugccaauuuguucuugua

SEQ ID NO: 918866 - RNA, 19 nt, Homo sapiens
aaccuacaguuagcuaauu

SEQ ID NO: 918867 - RNA, 19 nt, Homo sapiens
aaacuauagcugaggacua

SEQ ID NO: 918868 - RNA, 19 nt, Homo sapiens
gcugaucauuggcauucug

SEQ ID NO: 918869 - RNA, 19 nt, Homo sapiens
cuggaugccuagaggacua

SEQ ID NO: 918870 - RNA, 19 nt, Homo sapiens
gaaacauguagugguuauu

SEQ ID NO: 918871 - RNA, 19 nt, Homo sapiens
gcugagcauuucuuuuaaa

SEQ ID NO: 918872 - RNA, 19 nt, Homo sapiens
uuccagacuuugaugacua

SEQ ID NO: 918873 - RNA, 19 nt, Homo sapiens
uccaaaggcuaccgugcuu

SEQ ID NO: 918874 - RNA, 19 nt, Homo sapiens
guauugcuagcaccuugua

SEQ ID NO: 918875 - RNA, 19 nt, Homo sapiens
ccaguagguuggacagcau

SEQ ID NO: 918876 - RNA, 19 nt, Homo sapiens
cugauccaguucaccagua

SEQ ID NO: 918877 - RNA, 19 nt, Homo sapiens
agugaguucaucuguaaua

SEQ ID NO: 918878 - RNA, 19 nt, Homo sapiens
ccaguggaagaccuuagua

SEQ ID NO: 918879 - RNA, 19 nt, Homo sapiens
cuaaggaauucugcagcuu

SEQ ID NO: 918880 - RNA, 19 nt, Homo sapiens
ccaaaggcuaccgugcuua

SEQ ID NO: 918881 - RNA, 19 nt, Homo sapiens
uuggacagcauauaauuug

SEQ ID NO: 918882 - RNA, 19 nt, Homo sapiens
ggaagaccuuaguaaaauc

SEQ ID NO: 918883 - RNA, 19 nt, Homo sapiens
uggaagaccuuaguaaaau

SEQ ID NO: 918884 - RNA, 19 nt, Homo sapiens
caguggaagaccuuaguaa

SEQ ID NO: 918885 - RNA, 19 nt, Homo sapiens
guagagcugagcauuucuu

SEQ ID NO: 918886 - RNA, 19 nt, Homo sapiens
ucauuggcauucugguguu

SEQ ID NO: 918887 - RNA, 19 nt, Homo sapiens
gacaagagaugcggaguau

SEQ ID NO: 918888 - RNA, 19 nt, Homo sapiens
gauuguagagcgaggauua

SEQ ID NO: 918889 - RNA, 19 nt, Homo sapiens
acagaaagcucgcacucuu

SEQ ID NO: 918890 - RNA, 19 nt, Homo sapiens
caagagaugcggaguaugu

SEQ ID NO: 918891 - RNA, 19 nt, Homo sapiens
ccucugcacucucaacuug

SEQ ID NO: 918892 - RNA, 19 nt, Homo sapiens
gccacgagcugauaauuac

SEQ ID NO: 918893 - RNA, 19 nt, Homo sapiens
guagagcgaggauuauuau

SEQ ID NO: 918894 - RNA, 19 nt, Homo sapiens
gauaauuacagacaagaga

SEQ ID NO: 918895 - RNA, 19 nt, Homo sapiens
acaggugucuucccagaug

SEQ ID NO: 918896 - RNA, 19 nt, Homo sapiens
ggagagccaaguuugcauu

SEQ ID NO: 918897 - RNA, 19 nt, Homo sapiens
gagcugauaauuacagaca

SEQ ID NO: 918898 - RNA, 19 nt, Homo sapiens
acacuccucugcacucuca

SEQ ID NO: 918899 - RNA, 19 nt, Homo sapiens
gagagccaaguuugcauuu

SEQ ID NO: 918900 - RNA, 19 nt, Homo sapiens
gcugauaauuacagacaag

SEQ ID NO: 918901 - RNA, 19 nt, Homo sapiens
uguagagcgaggauuauua

SEQ ID NO: 918902 - RNA, 19 nt, Homo sapiens
ccugguguuuccuagguua

SEQ ID NO: 918903 - RNA, 19 nt, Homo sapiens
gacacuaacgcuacagcua

SEQ ID NO: 918904 - RNA, 19 nt, Homo sapiens
gguguuuccuagguuauga

SEQ ID NO: 918905 - RNA, 19 nt, Homo sapiens
uuuccuagguuaugauugu

SEQ ID NO: 918906 - RNA, 19 nt, Homo sapiens
ccagggagagccaaguuug

SEQ ID NO: 918907 - RNA, 19 nt, Homo sapiens
agacaagagaugcggagua

SEQ ID NO: 918908 - RNA, 19 nt, Homo sapiens
ggccaggaguucaauacca

SEQ ID NO: 918909 - RNA, 19 nt, Homo sapiens
gagccaaguuugcauuuuc

SEQ ID NO: 918910 - RNA, 19 nt, Homo sapiens
ggaggccaggaguucaaua

SEQ ID NO: 918911 - RNA, 19 nt, Homo sapiens
cagaaagcucgcacucuug

SEQ ID NO: 918912 - RNA, 19 nt, Homo sapiens
cacuaacgcuacagcuaga

SEQ ID NO: 918913 - RNA, 19 nt, Homo sapiens
ucaccacccucauccugau

SEQ ID NO: 918914 - RNA, 19 nt, Homo sapiens
agagaugagacaagaggua

SEQ ID NO: 918915 - RNA, 19 nt, Homo sapiens
ucuggucacuccucacugu

SEQ ID NO: 918916 - RNA, 19 nt, Homo sapiens
gguagccacgagcugauaa

SEQ ID NO: 918917 - RNA, 19 nt, Homo sapiens
ggccugguguuuccuaggu

SEQ ID NO: 918918 - RNA, 19 nt, Homo sapiens
agccacgagcugauaauua

SEQ ID NO: 918919 - RNA, 19 nt, Homo sapiens
uaccagagacucacccaau

SEQ ID NO: 918920 - RNA, 19 nt, Homo sapiens
gggcucauuauccugcaua

SEQ ID NO: 918921 - RNA, 19 nt, Homo sapiens
ccuagguuaugauuguaga

SEQ ID NO: 918922 - RNA, 19 nt, Homo sapiens
agaaagcucgcacucuugu

SEQ ID NO: 918923 - RNA, 19 nt, Homo sapiens
cguccgggcauaacagaaa

SEQ ID NO: 918924 - RNA, 19 nt, Homo sapiens
agguagagaugagacaaga

SEQ ID NO: 918925 - RNA, 19 nt, Homo sapiens
ucauuauccugcauagucu

SEQ ID NO: 918926 - RNA, 19 nt, Homo sapiens
accagagacucacccaaug

SEQ ID NO: 918927 - RNA, 19 nt, Homo sapiens
gccagggagagccaaguuu

SEQ ID NO: 918928 - RNA, 19 nt, Homo sapiens
ucccuuuccuggucugcua

SEQ ID NO: 918929 - RNA, 19 nt, Homo sapiens
uaauuacagacaagagaug

SEQ ID NO: 918930 - RNA, 19 nt, Homo sapiens
gaggggagagguagaggua

SEQ ID NO: 918931 - RNA, 19 nt, Homo sapiens
acucauuccugcugcauua

SEQ ID NO: 918932 - RNA, 19 nt, Homo sapiens
ggagcucgguuggugauuu

SEQ ID NO: 918933 - RNA, 19 nt, Homo sapiens
gcgaaauuguggacuguug

SEQ ID NO: 918934 - RNA, 19 nt, Homo sapiens
aaagagguuuguaaucaug

SEQ ID NO: 918935 - RNA, 19 nt, Homo sapiens
ggauccacuuugcgaaauu

SEQ ID NO: 918936 - RNA, 19 nt, Homo sapiens
gggaggugcuuggaacuga

SEQ ID NO: 918937 - RNA, 19 nt, Homo sapiens
gagcucgguuggugauuuc

SEQ ID NO: 918938 - RNA, 19 nt, Homo sapiens
gauccacuuugcgaaauug

SEQ ID NO: 918939 - RNA, 19 nt, Homo sapiens
gcagagugacggacuagug

SEQ ID NO: 918940 - RNA, 19 nt, Homo sapiens
gaggcagagugacggacua

SEQ ID NO: 918941 - RNA, 19 nt, Homo sapiens
gaaauuguggacuguugga

SEQ ID NO: 918942 - RNA, 19 nt, Homo sapiens
ccagacccuuguaauuguu

SEQ ID NO: 918943 - RNA, 19 nt, Homo sapiens
ucccggugcuaaugguuua

SEQ ID NO: 918944 - RNA, 19 nt, Homo sapiens
cuucauuguuaacggauuu

SEQ ID NO: 918945 - RNA, 19 nt, Homo sapiens
ggaggugcuuggaacugau

SEQ ID NO: 918946 - RNA, 19 nt, Homo sapiens
gaacgccccucagcccuuu

SEQ ID NO: 918947 - RNA, 19 nt, Homo sapiens
gaucuacuccacugucuac

SEQ ID NO: 918948 - RNA, 19 nt, Homo sapiens
gugcuaaugguuuaugaga

SEQ ID NO: 918949 - RNA, 19 nt, Homo sapiens
gcgcggugcccguuauuuc

SEQ ID NO: 918950 - RNA, 19 nt, Homo sapiens
ugcauuaaccuucauuguu

SEQ ID NO: 918951 - RNA, 19 nt, Homo sapiens
uccagacccuuguaauugu

SEQ ID NO: 918952 - RNA, 19 nt, Homo sapiens
ggacuguuggacugugauu

SEQ ID NO: 918953 - RNA, 19 nt, Homo sapiens
caggauccacuuugcgaaa

SEQ ID NO: 918954 - RNA, 19 nt, Homo sapiens
gguuuguaaucaugaaagu

SEQ ID NO: 918955 - RNA, 19 nt, Homo sapiens
guggacuguuggacuguga

SEQ ID NO: 918956 - RNA, 19 nt, Homo sapiens
ggugauuucucggguuucu

SEQ ID NO: 918957 - RNA, 19 nt, Homo sapiens
guuccugcgucccgccaaa

SEQ ID NO: 918958 - RNA, 19 nt, Homo sapiens
uuggugauuucucggguuu

SEQ ID NO: 918959 - RNA, 19 nt, Homo sapiens
ggaucuacuccacugucua

SEQ ID NO: 918960 - RNA, 19 nt, Homo sapiens
agagguuuguaaucaugaa

SEQ ID NO: 918961 - RNA, 19 nt, Homo sapiens
ccucgcggacuaagagaaa

SEQ ID NO: 918962 - RNA, 19 nt, Homo sapiens
uuccagacccuuguaauug

SEQ ID NO: 918963 - RNA, 19 nt, Homo sapiens
guuggacugugauucuaag

SEQ ID NO: 918964 - RNA, 19 nt, Homo sapiens
gcuggcaggauccacuuug

SEQ ID NO: 918965 - RNA, 19 nt, Homo sapiens
gagguggaggcgcuuugaa

SEQ ID NO: 918966 - RNA, 19 nt, Homo sapiens
uuuccagacccuuguaauu

SEQ ID NO: 918967 - RNA, 19 nt, Homo sapiens
guauauaugugcccauuua

SEQ ID NO: 918968 - RNA, 19 nt, Homo sapiens
gaacaccacucauccauca

SEQ ID NO: 918969 - RNA, 19 nt, Homo sapiens
gaacagugcgucucuauga

SEQ ID NO: 918970 - RNA, 19 nt, Homo sapiens
gaggaaagcuccggaagaa

SEQ ID NO: 918971 - RNA, 19 nt, Homo sapiens
gaccaaagcaucuucauuu

SEQ ID NO: 918972 - RNA, 19 nt, Homo sapiens
caaagcaucuucauuucaa

SEQ ID NO: 918973 - RNA, 19 nt, Homo sapiens
cauaaagccugaugacuug

SEQ ID NO: 918974 - RNA, 19 nt, Homo sapiens
ggaggagagucgcagcuua

SEQ ID NO: 918975 - RNA, 19 nt, Homo sapiens
ggaagaaggagaaacauug

SEQ ID NO: 918976 - RNA, 19 nt, Homo sapiens
caacacaaauugccuccuu

SEQ ID NO: 918977 - RNA, 19 nt, Homo sapiens
caagaagaaucucugugaa

SEQ ID NO: 918978 - RNA, 19 nt, Homo sapiens
aaucaccgcugcugucuuu

SEQ ID NO: 918979 - RNA, 19 nt, Homo sapiens
caaauugccuccuuauguc

SEQ ID NO: 918980 - RNA, 19 nt, Homo sapiens
gaaauccaccgacugaaga

SEQ ID NO: 918981 - RNA, 19 nt, Homo sapiens
gacauaugcuucccagaga

SEQ ID NO: 918982 - RNA, 19 nt, Homo sapiens
ugacaaggcucaggaguuc

SEQ ID NO: 918983 - RNA, 19 nt, Homo sapiens
gaacuuugaugcggagugu

SEQ ID NO: 918984 - RNA, 19 nt, Homo sapiens
caguagaaauugacaguau

SEQ ID NO: 918985 - RNA, 19 nt, Homo sapiens
ggagauauaggacaggaaa

SEQ ID NO: 918986 - RNA, 19 nt, Homo sapiens
ccaagaagaaucucuguga

SEQ ID NO: 918987 - RNA, 19 nt, Homo sapiens
guacagccuucaaucacaa

SEQ ID NO: 918988 - RNA, 19 nt, Homo sapiens
gaaucucugugaaaucaau

SEQ ID NO: 918989 - RNA, 19 nt, Homo sapiens
ccacggaacuccagaacca

SEQ ID NO: 918990 - RNA, 19 nt, Homo sapiens
agaagaaucucugugaaau

SEQ ID NO: 918991 - RNA, 19 nt, Homo sapiens
gcucaggaguucuuugcaa

SEQ ID NO: 918992 - RNA, 19 nt, Homo sapiens
ccucagagcucggccaaga

SEQ ID NO: 918993 - RNA, 19 nt, Homo sapiens
ccauaaagccugaugacuu

SEQ ID NO: 918994 - RNA, 19 nt, Homo sapiens
aagaaucucugugaaauca

SEQ ID NO: 918995 - RNA, 19 nt, Homo sapiens
caagaguggccucaaggua

SEQ ID NO: 918996 - RNA, 19 nt, Homo sapiens
gcugaaauccaccgacuga

SEQ ID NO: 918997 - RNA, 19 nt, Homo sapiens
caccuuugcuaccuacuuu

SEQ ID NO: 918998 - RNA, 19 nt, Homo sapiens
caaggaggcucaggugcuu

SEQ ID NO: 918999 - RNA, 19 nt, Homo sapiens
acaaauugccuccuuaugu

SEQ ID NO: 919000 - RNA, 19 nt, Homo sapiens
cgaggaagcaguauuaucu

SEQ ID NO: 919001 - RNA, 19 nt, Homo sapiens
gaguacagccucccucaga

SEQ ID NO: 919002 - RNA, 19 nt, Homo sapiens
uaaugcagguguaugacuu

SEQ ID NO: 919003 - RNA, 19 nt, Homo sapiens
uggcugcccuucgggauua

SEQ ID NO: 919004 - RNA, 19 nt, Homo sapiens
gaagaaucucugugaaauc

SEQ ID NO: 919005 - RNA, 19 nt, Homo sapiens
gaguucagcuaugaugaga

SEQ ID NO: 919006 - RNA, 19 nt, Homo sapiens
ggacccacguggaguaggu

SEQ ID NO: 919007 - RNA, 19 nt, Homo sapiens
cagcaugagugcgcgauga

SEQ ID NO: 919008 - RNA, 19 nt, Homo sapiens
gcaacagccagaagaggaa

SEQ ID NO: 919009 - RNA, 19 nt, Homo sapiens
caauaucaacgacaacaug

SEQ ID NO: 919010 - RNA, 19 nt, Homo sapiens
acacggaagccaagaagaa

SEQ ID NO: 919011 - RNA, 19 nt, Homo sapiens
uggaguaggugacauaugc

SEQ ID NO: 919012 - RNA, 19 nt, Homo sapiens
ccacccuccuggcccauaa

SEQ ID NO: 919013 - RNA, 19 nt, Homo sapiens
cagaacccauugcuaucaa

SEQ ID NO: 919014 - RNA, 19 nt, Homo sapiens
ccaaagcaucuucauuuca

SEQ ID NO: 919015 - RNA, 19 nt, Homo sapiens
gaagaaagaggagcaacag

SEQ ID NO: 919016 - RNA, 19 nt, Homo sapiens
gaaagcuccggaagaagga

SEQ ID NO: 919017 - RNA, 19 nt, Homo sapiens
ggaaauuacaugcugacau

SEQ ID NO: 919018 - RNA, 19 nt, Homo sapiens
ccuuugugcugucuggaua

SEQ ID NO: 919019 - RNA, 19 nt, Homo sapiens
caacggggcucuuuagucu

SEQ ID NO: 919020 - RNA, 19 nt, Homo sapiens
aagaagaaucucugugaaa

SEQ ID NO: 919021 - RNA, 19 nt, Homo sapiens
ugaagcagcagcuccaguu

SEQ ID NO: 919022 - RNA, 19 nt, Homo sapiens
gccauggugugcagccaaa

SEQ ID NO: 919023 - RNA, 19 nt, Homo sapiens
aacacaaauugccuccuua

SEQ ID NO: 919024 - RNA, 19 nt, Homo sapiens
gaagaaggagaaacauugc

SEQ ID NO: 919025 - RNA, 19 nt, Homo sapiens
cagugacucugcagggaaa

SEQ ID NO: 919026 - RNA, 19 nt, Homo sapiens
ucagagcucggccaagaaa

SEQ ID NO: 919027 - RNA, 19 nt, Homo sapiens
gggcugacaccuucauugu

SEQ ID NO: 919028 - RNA, 19 nt, Homo sapiens
uaugugcccauuuaucuuu

SEQ ID NO: 919029 - RNA, 19 nt, Homo sapiens
gauccagaacccauugcua

SEQ ID NO: 919030 - RNA, 19 nt, Homo sapiens
gaggagagucgcagcuuag

SEQ ID NO: 919031 - RNA, 19 nt, Homo sapiens
gcuacaagcagguucaagu

SEQ ID NO: 919032 - RNA, 19 nt, Homo sapiens
ccgcugcugucuuugaaug

SEQ ID NO: 919033 - RNA, 19 nt, Homo sapiens
guacagccucccucagaug

SEQ ID NO: 919034 - RNA, 19 nt, Homo sapiens
uacgggaggucuacucugu

SEQ ID NO: 919035 - RNA, 19 nt, Homo sapiens
caacuguacagccuucaau

SEQ ID NO: 919036 - RNA, 19 nt, Homo sapiens
gggaacagugcgucucuau

SEQ ID NO: 919037 - RNA, 19 nt, Homo sapiens
ucuacacaauccagacaaa

SEQ ID NO: 919038 - RNA, 19 nt, Homo sapiens
gaguacaugugagacuaug

SEQ ID NO: 919039 - RNA, 19 nt, Homo sapiens
ggaguacaugugagacuau

SEQ ID NO: 919040 - RNA, 19 nt, Homo sapiens
caucuguggugacuggaau

SEQ ID NO: 919041 - RNA, 19 nt, Homo sapiens
gcaguggugugggaacagu

SEQ ID NO: 919042 - RNA, 19 nt, Homo sapiens
gcagagaagaaaccagaag

SEQ ID NO: 919043 - RNA, 19 nt, Homo sapiens
gccucaagguauccgagua

SEQ ID NO: 919044 - RNA, 19 nt, Homo sapiens
gauauauacagacccacaa

SEQ ID NO: 919045 - RNA, 19 nt, Homo sapiens
ggaacagugcgucucuaug

SEQ ID NO: 919046 - RNA, 19 nt, Homo sapiens
ccgagcagcccuuuauugu

SEQ ID NO: 919047 - RNA, 19 nt, Homo sapiens
ccugugauccugaacuuug

SEQ ID NO: 919048 - RNA, 19 nt, Homo sapiens
uauaugugcccauuuaucu

SEQ ID NO: 919049 - RNA, 19 nt, Homo sapiens
aagaguggccucaagguau

SEQ ID NO: 919050 - RNA, 19 nt, Homo sapiens
ccauugcuaucaacuguac

SEQ ID NO: 919051 - RNA, 19 nt, Homo sapiens
caccgcugcugucuuugaa

SEQ ID NO: 919052 - RNA, 19 nt, Homo sapiens
cucaggaguucuuugcaaa

SEQ ID NO: 919053 - RNA, 19 nt, Homo sapiens
ccagaacccauugcuauca

SEQ ID NO: 919054 - RNA, 19 nt, Homo sapiens
gugcuggacaggaggagua

SEQ ID NO: 919055 - RNA, 19 nt, Homo sapiens
ccacaauccacaagcugaa

SEQ ID NO: 919056 - RNA, 19 nt, Homo sapiens
gugagacuaugggaggaaa

SEQ ID NO: 919057 - RNA, 19 nt, Homo sapiens
caagcuggguggcgaugag

SEQ ID NO: 919058 - RNA, 19 nt, Homo sapiens
agaguggccucaagguauc

SEQ ID NO: 919059 - RNA, 19 nt, Homo sapiens
caaagcaggccacggaacu

SEQ ID NO: 919060 - RNA, 19 nt, Homo sapiens
caauccagacaaacagaaa

SEQ ID NO: 919061 - RNA, 19 nt, Homo sapiens
gcaguuaaugcagguguau

SEQ ID NO: 919062 - RNA, 19 nt, Homo sapiens
cggaagaaggagaaacauu

SEQ ID NO: 919063 - RNA, 19 nt, Homo sapiens
aggaguacaugugagacua

SEQ ID NO: 919064 - RNA, 19 nt, Homo sapiens
gaagcagcagcuccaguuc

SEQ ID NO: 919065 - RNA, 19 nt, Homo sapiens
caccagacaucggcagcaa

SEQ ID NO: 919066 - RNA, 19 nt, Homo sapiens
ucaaggcggacaaggagaa

SEQ ID NO: 919067 - RNA, 19 nt, Homo sapiens
gacaagaagucuaacauua

SEQ ID NO: 919068 - RNA, 19 nt, Homo sapiens
gaagauagcuuuugccauu

SEQ ID NO: 919069 - RNA, 19 nt, Homo sapiens
gaucaaaguugcagcauca

SEQ ID NO: 919070 - RNA, 19 nt, Homo sapiens
aagccaagguguauaauuu

SEQ ID NO: 919071 - RNA, 19 nt, Homo sapiens
gagcaucaguucuggguau

SEQ ID NO: 919072 - RNA, 19 nt, Homo sapiens
gcuauuacauucaagaagu

SEQ ID NO: 919073 - RNA, 19 nt, Homo sapiens
gaacaccaagguugcauga

SEQ ID NO: 919074 - RNA, 19 nt, Homo sapiens
ucaaagccaagguguauaa

SEQ ID NO: 919075 - RNA, 19 nt, Homo sapiens
ucaaacaugucagcaguug

SEQ ID NO: 919076 - RNA, 19 nt, Homo sapiens
gaagauaaaggcgaaggaa

SEQ ID NO: 919077 - RNA, 19 nt, Homo sapiens
uaugugucauuaccaguua

SEQ ID NO: 919078 - RNA, 19 nt, Homo sapiens
ggucaaagccaagguguau

SEQ ID NO: 919079 - RNA, 19 nt, Homo sapiens
ccacucuucuguuuguaaa

SEQ ID NO: 919080 - RNA, 19 nt, Homo sapiens
uaaaggcgaaggaaucauu

SEQ ID NO: 919081 - RNA, 19 nt, Homo sapiens
aaagacugcccuugaagua

SEQ ID NO: 919082 - RNA, 19 nt, Homo sapiens
gaaagacugcccuugaagu

SEQ ID NO: 919083 - RNA, 19 nt, Homo sapiens
uggaaagacugcccuugaa

SEQ ID NO: 919084 - RNA, 19 nt, Homo sapiens
ugcaugagcugaucaaagu

SEQ ID NO: 919085 - RNA, 19 nt, Homo sapiens
agagacaaaugcccaguau

SEQ ID NO: 919086 - RNA, 19 nt, Homo sapiens
gaacgcauuguggaaagua

SEQ ID NO: 919087 - RNA, 19 nt, Homo sapiens
gcucauaaccgaagauguc

SEQ ID NO: 919088 - RNA, 19 nt, Homo sapiens
gacccacucuucuguuugu

SEQ ID NO: 919089 - RNA, 19 nt, Homo sapiens
gcgaaggaaucauuauggu

SEQ ID NO: 919090 - RNA, 19 nt, Homo sapiens
agacugcccuugaaguaug

SEQ ID NO: 919091 - RNA, 19 nt, Homo sapiens
gauaaaggcgaaggaauca

SEQ ID NO: 919092 - RNA, 19 nt, Homo sapiens
ugacaagaagucuaacauu

SEQ ID NO: 919093 - RNA, 19 nt, Homo sapiens
guuaauugcuauguggaaa

SEQ ID NO: 919094 - RNA, 19 nt, Homo sapiens
caaaugcccaguaucuguu

SEQ ID NO: 919095 - RNA, 19 nt, Homo sapiens
uaauugcuauguggaaaga

SEQ ID NO: 919096 - RNA, 19 nt, Homo sapiens
ggaaagacugcccuugaag

SEQ ID NO: 919097 - RNA, 19 nt, Homo sapiens
gucaacuccuuaucacuga

SEQ ID NO: 919098 - RNA, 19 nt, Homo sapiens
cggacccacucuucuguuu

SEQ ID NO: 919099 - RNA, 19 nt, Homo sapiens
agacaaaugcccaguaucu

SEQ ID NO: 919100 - RNA, 19 nt, Homo sapiens
caacauagugagcaucagu

SEQ ID NO: 919101 - RNA, 19 nt, Homo sapiens
gaaaaguugucaggagcua

SEQ ID NO: 919102 - RNA, 19 nt, Homo sapiens
caggugacaagaagucuaa

SEQ ID NO: 919103 - RNA, 19 nt, Homo sapiens
ugaucgagcugucagucuu

SEQ ID NO: 919104 - RNA, 19 nt, Homo sapiens
guuaagagccagucaacuc

SEQ ID NO: 919105 - RNA, 19 nt, Homo sapiens
aaaggugacccaagggaaa

SEQ ID NO: 919106 - RNA, 19 nt, Homo sapiens
aaaggcgaaggaaucauua

SEQ ID NO: 919107 - RNA, 19 nt, Homo sapiens
uagacuugcugcccgagaa

SEQ ID NO: 919108 - RNA, 19 nt, Homo sapiens
gaaccucuggcuauuacau

SEQ ID NO: 919109 - RNA, 19 nt, Homo sapiens
ggauauugauuuucgguau

SEQ ID NO: 919110 - RNA, 19 nt, Homo sapiens
cagcaucaggugacaagaa

SEQ ID NO: 919111 - RNA, 19 nt, Homo sapiens
cagagaguacuguguguug

SEQ ID NO: 919112 - RNA, 19 nt, Homo sapiens
uguucagccuguagagaua

SEQ ID NO: 919113 - RNA, 19 nt, Homo sapiens
agaaguuaauugcuaugug

SEQ ID NO: 919114 - RNA, 19 nt, Homo sapiens
guugaaccucuggcuauua

SEQ ID NO: 919115 - RNA, 19 nt, Homo sapiens
acaaaugcccaguaucugu

SEQ ID NO: 919116 - RNA, 19 nt, Homo sapiens
gugggaagaugaaaaguug

SEQ ID NO: 919117 - RNA, 19 nt, Homo sapiens
uggagguggugcuuccuuu

SEQ ID NO: 919118 - RNA, 19 nt, Homo sapiens
ggaagauaaaggcgaagga

SEQ ID NO: 919119 - RNA, 19 nt, Homo sapiens
cccaguaucuguugcugau

SEQ ID NO: 919120 - RNA, 19 nt, Homo sapiens
caucaguucuggguaugug

SEQ ID NO: 919121 - RNA, 19 nt, Homo sapiens
caugucagcaguuguuguu

SEQ ID NO: 919122 - RNA, 19 nt, Homo sapiens
guaugugucauuaccaguu

SEQ ID NO: 919123 - RNA, 19 nt, Homo sapiens
ggagguggugcuuccuuug

SEQ ID NO: 919124 - RNA, 19 nt, Homo sapiens
gacccaagggaaagaagaa

SEQ ID NO: 919125 - RNA, 19 nt, Homo sapiens
ggacccacucuucuguuug

SEQ ID NO: 919126 - RNA, 19 nt, Homo sapiens
caacuccuuaucacugaaa

SEQ ID NO: 919127 - RNA, 19 nt, Homo sapiens
agauaaaggcgaaggaauc

SEQ ID NO: 919128 - RNA, 19 nt, Homo sapiens
gagaguacuguguguugga

SEQ ID NO: 919129 - RNA, 19 nt, Homo sapiens
cgagcugucagucuuggua

SEQ ID NO: 919130 - RNA, 19 nt, Homo sapiens
gaucgagcugucagucuug

SEQ ID NO: 919131 - RNA, 19 nt, Homo sapiens
gccagucaacuccuuauca

SEQ ID NO: 919132 - RNA, 19 nt, Homo sapiens
agccaagguguauaauuua

SEQ ID NO: 919133 - RNA, 19 nt, Homo sapiens
caugagcugaucaaaguug

SEQ ID NO: 919134 - RNA, 19 nt, Homo sapiens
ccagucaacuccuuaucac

SEQ ID NO: 919135 - RNA, 19 nt, Homo sapiens
aaagccaagguguauaauu

SEQ ID NO: 919136 - RNA, 19 nt, Homo sapiens
gcccuugacucagagaaag

SEQ ID NO: 919137 - RNA, 19 nt, Homo sapiens
uuuauugaguugcccuuga

SEQ ID NO: 919138 - RNA, 19 nt, Homo sapiens
gcccucggauucagagagu

SEQ ID NO: 919139 - RNA, 19 nt, Homo sapiens
gauagcuuuugccauuaua

SEQ ID NO: 919140 - RNA, 19 nt, Homo sapiens
agaguacuguguguuggaa

SEQ ID NO: 919141 - RNA, 19 nt, Homo sapiens
gaaaacaagagacaaaugc

SEQ ID NO: 919142 - RNA, 19 nt, Homo sapiens
ugucagcaguuguuguuac

SEQ ID NO: 919143 - RNA, 19 nt, Homo sapiens
cuugaaguuuauugaguug

SEQ ID NO: 919144 - RNA, 19 nt, Homo sapiens
gguggugcuuccuuuggau

SEQ ID NO: 919145 - RNA, 19 nt, Homo sapiens
gucaggagcuagacuugcu

SEQ ID NO: 919146 - RNA, 19 nt, Homo sapiens
guucuggguaugugucauu

SEQ ID NO: 919147 - RNA, 19 nt, Homo sapiens
ggcaacauagugagcauca

SEQ ID NO: 919148 - RNA, 19 nt, Homo sapiens
aaaguugucaggagcuaga

SEQ ID NO: 919149 - RNA, 19 nt, Homo sapiens
ccgaacgcauuguggaaag

SEQ ID NO: 919150 - RNA, 19 nt, Homo sapiens
uugaaccucuggcuauuac

SEQ ID NO: 919151 - RNA, 19 nt, Homo sapiens
ggcgaaggaaucauuaugg

SEQ ID NO: 919152 - RNA, 19 nt, Homo sapiens
ucacggacccacucuucug

SEQ ID NO: 919153 - RNA, 19 nt, Homo sapiens
aagaagaaacucggagguu

SEQ ID NO: 919154 - RNA, 19 nt, Homo sapiens
gacaaaugcccaguaucug

SEQ ID NO: 919155 - RNA, 19 nt, Homo sapiens
ucaacuccuuaucacugaa

SEQ ID NO: 919156 - RNA, 19 nt, Homo sapiens
gagccagucaacuccuuau

SEQ ID NO: 919157 - RNA, 19 nt, Homo sapiens
gcaguuguuguuaccagau

SEQ ID NO: 919158 - RNA, 19 nt, Homo sapiens
cuagaacugugagaaauaa

SEQ ID NO: 919159 - RNA, 19 nt, Homo sapiens
gaggaaggaugugcaguug

SEQ ID NO: 919160 - RNA, 19 nt, Homo sapiens
ggaggaaggaugugcaguu

SEQ ID NO: 919161 - RNA, 19 nt, Homo sapiens
gaacgggaggucaagaguu

SEQ ID NO: 919162 - RNA, 19 nt, Homo sapiens
ggaggaaggacgugcaguu

SEQ ID NO: 919163 - RNA, 19 nt, Homo sapiens
ggacuucacagccucuaga

SEQ ID NO: 919164 - RNA, 19 nt, Homo sapiens
gcagggaucucggcaugag

SEQ ID NO: 919165 - RNA, 19 nt, Homo sapiens
agacgggccucagaccuaa

SEQ ID NO: 919166 - RNA, 19 nt, Homo sapiens
ggacuuucccuugcucuug

SEQ ID NO: 919167 - RNA, 19 nt, Homo sapiens
ggacuugcuuuggacuuuc

SEQ ID NO: 919168 - RNA, 19 nt, Homo sapiens
gaggaaggacgugcaguug

SEQ ID NO: 919169 - RNA, 19 nt, Homo sapiens
aacgggaggucaagaguug

SEQ ID NO: 919170 - RNA, 19 nt, Homo sapiens
ucuagaacugugagaaaua

SEQ ID NO: 919171 - RNA, 19 nt, Homo sapiens
agaagguccucgccagaug

SEQ ID NO: 919172 - RNA, 19 nt, Homo sapiens
caccugugcucuuggacuu

SEQ ID NO: 919173 - RNA, 19 nt, Homo sapiens
ggauaugccacggacauug

SEQ ID NO: 919174 - RNA, 19 nt, Homo sapiens
cagacgggccucagaccua

SEQ ID NO: 919175 - RNA, 19 nt, Homo sapiens
uggacuugcuuuggacuuu

SEQ ID NO: 919176 - RNA, 19 nt, Homo sapiens
gagagaggagcaagaaggu

SEQ ID NO: 919177 - RNA, 19 nt, Homo sapiens
ccucuagaacugugagaaa

SEQ ID NO: 919178 - RNA, 19 nt, Homo sapiens
gauaugccacggacauugg

SEQ ID NO: 919179 - RNA, 19 nt, Homo sapiens
ggcacagccuggagacaca

SEQ ID NO: 919180 - RNA, 19 nt, Homo sapiens
gagaacgggaggucaagag

SEQ ID NO: 919181 - RNA, 19 nt, Homo sapiens
ggaacggacggaggaagga

SEQ ID NO: 919182 - RNA, 19 nt, Homo sapiens
gaacggacggaggaaggau

SEQ ID NO: 919183 - RNA, 19 nt, Homo sapiens
cugcagaugcccugagaga

SEQ ID NO: 919184 - RNA, 19 nt, Homo sapiens
ccugagagaggagcaagaa

SEQ ID NO: 919185 - RNA, 19 nt, Homo sapiens
gaaccuagcucucugucuu

SEQ ID NO: 919186 - RNA, 19 nt, Homo sapiens
aaagugaagugaaggauuu

SEQ ID NO: 919187 - RNA, 19 nt, Homo sapiens
gagaauaccuguccuucau

SEQ ID NO: 919188 - RNA, 19 nt, Homo sapiens
cagcaucagucacauguaa

SEQ ID NO: 919189 - RNA, 19 nt, Homo sapiens
guaauuaacagcuacauug

SEQ ID NO: 919190 - RNA, 19 nt, Homo sapiens
gguaaaagcuuucugcaaa

SEQ ID NO: 919191 - RNA, 19 nt, Homo sapiens
aggcaaagaugaugggaua

SEQ ID NO: 919192 - RNA, 19 nt, Homo sapiens
gaaucuagacaucccuuua

SEQ ID NO: 919193 - RNA, 19 nt, Homo sapiens
gcuaagaucugguccaaaa

SEQ ID NO: 919194 - RNA, 19 nt, Homo sapiens
ggaaguagcagguggagau

SEQ ID NO: 919195 - RNA, 19 nt, Homo sapiens
gaacagugaugagcuaggu

SEQ ID NO: 919196 - RNA, 19 nt, Homo sapiens
aagcaagacucauaaggaa

SEQ ID NO: 919197 - RNA, 19 nt, Homo sapiens
gaaagugaagugaaggauu

SEQ ID NO: 919198 - RNA, 19 nt, Homo sapiens
uagcgcagcuccuauacuu

SEQ ID NO: 919199 - RNA, 19 nt, Homo sapiens
uuacagcuguggaaaguga

SEQ ID NO: 919200 - RNA, 19 nt, Homo sapiens
ugacaagugugacccaguu

SEQ ID NO: 919201 - RNA, 19 nt, Homo sapiens
gcuccuggcuaaucaaugu

SEQ ID NO: 919202 - RNA, 19 nt, Homo sapiens
cuagacaucccuuuaauug

SEQ ID NO: 919203 - RNA, 19 nt, Homo sapiens
gcuaguacccuaagcaaga

SEQ ID NO: 919204 - RNA, 19 nt, Homo sapiens
gagaagcacccaaaugcaa

SEQ ID NO: 919205 - RNA, 19 nt, Homo sapiens
gcagguggagauaauuuaa

SEQ ID NO: 919206 - RNA, 19 nt, Homo sapiens
gcacccaaaugcaaacauc

SEQ ID NO: 919207 - RNA, 19 nt, Homo sapiens
gcuccuauacuucagauuu

SEQ ID NO: 919208 - RNA, 19 nt, Homo sapiens
gaauaccuguccuucauac

SEQ ID NO: 919209 - RNA, 19 nt, Homo sapiens
uacauugugugcuuacuuu

SEQ ID NO: 919210 - RNA, 19 nt, Homo sapiens
ucugauaucuccaugaauc

SEQ ID NO: 919211 - RNA, 19 nt, Homo sapiens
acacaagaaucuagacauc

SEQ ID NO: 919212 - RNA, 19 nt, Homo sapiens
caaguuagagcccagcauu

SEQ ID NO: 919213 - RNA, 19 nt, Homo sapiens
cuccuauacuucagauuua

SEQ ID NO: 919214 - RNA, 19 nt, Homo sapiens
ugagcuaggugcagagaga

SEQ ID NO: 919215 - RNA, 19 nt, Homo sapiens
cuagcucucugucuugauu

SEQ ID NO: 919216 - RNA, 19 nt, Homo sapiens
gaaguagcagguggagaua

SEQ ID NO: 919217 - RNA, 19 nt, Homo sapiens
guugccagcuuaugguaaa

SEQ ID NO: 919218 - RNA, 19 nt, Homo sapiens
cuacugcucuuuccauugg

SEQ ID NO: 919219 - RNA, 19 nt, Homo sapiens
gaacuacugcucuuuccau

SEQ ID NO: 919220 - RNA, 19 nt, Homo sapiens
ugccacagcuucaugcuau

SEQ ID NO: 919221 - RNA, 19 nt, Homo sapiens
uaagcaagacucauaagga

SEQ ID NO: 919222 - RNA, 19 nt, Homo sapiens
cagcuacauugugugcuua

SEQ ID NO: 919223 - RNA, 19 nt, Homo sapiens
gcaucagucacauguaauu

SEQ ID NO: 919224 - RNA, 19 nt, Homo sapiens
caaaugcaaacaucuacuu

SEQ ID NO: 919225 - RNA, 19 nt, Homo sapiens
gcgcagcuccuauacuuca

SEQ ID NO: 919226 - RNA, 19 nt, Homo sapiens
gcaaagaugaugggauauc

SEQ ID NO: 919227 - RNA, 19 nt, Homo sapiens
ggaguaagcaugacaucag

SEQ ID NO: 919228 - RNA, 19 nt, Homo sapiens
uagcuaagaucugguccaa

SEQ ID NO: 919229 - RNA, 19 nt, Homo sapiens
gaaggucgggccuccauag

SEQ ID NO: 919230 - RNA, 19 nt, Homo sapiens
guuagggauugauaggaaa

SEQ ID NO: 919231 - RNA, 19 nt, Homo sapiens
caucuacaguugccagcuu

SEQ ID NO: 919232 - RNA, 19 nt, Homo sapiens
ccaguggcagcccaaguua

SEQ ID NO: 919233 - RNA, 19 nt, Homo sapiens
uuucugauaucuccaugaa

SEQ ID NO: 919234 - RNA, 19 nt, Homo sapiens
ugacccaguucccaguaaa

SEQ ID NO: 919235 - RNA, 19 nt, Homo sapiens
auuaacagcuacauugugu

SEQ ID NO: 919236 - RNA, 19 nt, Homo sapiens
caucagucacauguaauua

SEQ ID NO: 919237 - RNA, 19 nt, Homo sapiens
aaucuagacaucccuuuaa

SEQ ID NO: 919238 - RNA, 19 nt, Homo sapiens
ucugaacagugaugagcua

SEQ ID NO: 919239 - RNA, 19 nt, Homo sapiens
ccauaggucucuguuucuu

SEQ ID NO: 919240 - RNA, 19 nt, Homo sapiens
cacauguaauuaacagcua

SEQ ID NO: 919241 - RNA, 19 nt, Homo sapiens
cuccauaggucucuguuuc

SEQ ID NO: 919242 - RNA, 19 nt, Homo sapiens
uuaauuggguggcauucug

SEQ ID NO: 919243 - RNA, 19 nt, Homo sapiens
uagcagguggagauaauuu

SEQ ID NO: 919244 - RNA, 19 nt, Homo sapiens
auacagagaagcacccaaa

SEQ ID NO: 919245 - RNA, 19 nt, Homo sapiens
gaagcuaguacccuaagca

SEQ ID NO: 919246 - RNA, 19 nt, Homo sapiens
cagagaagcacccaaaugc

SEQ ID NO: 919247 - RNA, 19 nt, Homo sapiens
ccacagcuucaugcuauuu

SEQ ID NO: 919248 - RNA, 19 nt, Homo sapiens
ggaaggucgggccuccaua

SEQ ID NO: 919249 - RNA, 19 nt, Homo sapiens
gguggcuccuggcuaauca

SEQ ID NO: 919250 - RNA, 19 nt, Homo sapiens
ugccagaacugacuugaac

SEQ ID NO: 919251 - RNA, 19 nt, Homo sapiens
gugacccaguucccaguaa

SEQ ID NO: 919252 - RNA, 19 nt, Homo sapiens
ucagucacauguaauuaac

SEQ ID NO: 919253 - RNA, 19 nt, Homo sapiens
aguagcagguggagauaau

SEQ ID NO: 919254 - RNA, 19 nt, Homo sapiens
gauaucuccaugaauccua

SEQ ID NO: 919255 - RNA, 19 nt, Homo sapiens
uaauguagcgcagcuccua

SEQ ID NO: 919256 - RNA, 19 nt, Homo sapiens
auugguggcuccuggcuaa

SEQ ID NO: 919257 - RNA, 19 nt, Homo sapiens
gccaguaagugccagaacu

SEQ ID NO: 919258 - RNA, 19 nt, Homo sapiens
uuaccaaucccuccacaga

SEQ ID NO: 919259 - RNA, 19 nt, Homo sapiens
acagcuacauugugugcuu

SEQ ID NO: 919260 - RNA, 19 nt, Homo sapiens
aguuagggauugauaggaa

SEQ ID NO: 919261 - RNA, 19 nt, Homo sapiens
guccgccucugcacaucua

SEQ ID NO: 919262 - RNA, 19 nt, Homo sapiens
acagagaagcacccaaaug

SEQ ID NO: 919263 - RNA, 19 nt, Homo sapiens
agaauaccuguccuucaua

SEQ ID NO: 919264 - RNA, 19 nt, Homo sapiens
agaagcacccaaaugcaaa

SEQ ID NO: 919265 - RNA, 19 nt, Homo sapiens
uuaaggccuuccagcauca

SEQ ID NO: 919266 - RNA, 19 nt, Homo sapiens
aguuagagcccagcauuaa

SEQ ID NO: 919267 - RNA, 19 nt, Homo sapiens
uaaagguccuaugcagcuu

SEQ ID NO: 919268 - RNA, 19 nt, Homo sapiens
ggucucuguuucuucugaa

SEQ ID NO: 919269 - RNA, 19 nt, Homo sapiens
ggaaagugaagugaaggau

SEQ ID NO: 919270 - RNA, 19 nt, Homo sapiens
gaggugacucucaugaaca

SEQ ID NO: 919271 - RNA, 19 nt, Homo sapiens
acccuaagcaagacucaua

SEQ ID NO: 919272 - RNA, 19 nt, Homo sapiens
uguggaaagugaagugaag

SEQ ID NO: 919273 - RNA, 19 nt, Homo sapiens
cagguggagauaauuuaaa

SEQ ID NO: 919274 - RNA, 19 nt, Homo sapiens
uuucagaggugagcaagca

SEQ ID NO: 919275 - RNA, 19 nt, Homo sapiens
ugucuugauucaggaacua

SEQ ID NO: 919276 - RNA, 19 nt, Homo sapiens
guaagugccagaacugacu

SEQ ID NO: 919277 - RNA, 19 nt, Homo sapiens
gguuaaggccuuccagcau

SEQ ID NO: 919278 - RNA, 19 nt, Homo sapiens
ucuagacaucccuuuaauu

SEQ ID NO: 919279 - RNA, 19 nt, Homo sapiens
ccacuuggcugggguuuca

SEQ ID NO: 919280 - RNA, 19 nt, Homo sapiens
cuaggugcagagagaguua

SEQ ID NO: 919281 - RNA, 19 nt, Homo sapiens
ucagaagcuaguacccuaa

SEQ ID NO: 919282 - RNA, 19 nt, Homo sapiens
aaguuagagcccagcauua

SEQ ID NO: 919283 - RNA, 19 nt, Homo sapiens
gccacagcuucaugcuauu

SEQ ID NO: 919284 - RNA, 19 nt, Homo sapiens
acuuugaaauguagcauag

SEQ ID NO: 919285 - RNA, 19 nt, Homo sapiens
ggaaacagcuguaaauuug

SEQ ID NO: 919286 - RNA, 19 nt, Homo sapiens
gaauauagcugauuaugca

SEQ ID NO: 919287 - RNA, 19 nt, Homo sapiens
gagaaacggucaagucauu

SEQ ID NO: 919288 - RNA, 19 nt, Homo sapiens
gauuaaaccuguacuguug

SEQ ID NO: 919289 - RNA, 19 nt, Homo sapiens
ggacuuacaugaaggagaa

SEQ ID NO: 919290 - RNA, 19 nt, Homo sapiens
acaaaugccuuuacaguuu

SEQ ID NO: 919291 - RNA, 19 nt, Homo sapiens
gaacugaaagucuggauaa

SEQ ID NO: 919292 - RNA, 19 nt, Homo sapiens
gaacaccgcuuaacaacag

SEQ ID NO: 919293 - RNA, 19 nt, Homo sapiens
cagaauacaugauggauga

SEQ ID NO: 919294 - RNA, 19 nt, Homo sapiens
gaucauaaguguaagaaag

SEQ ID NO: 919295 - RNA, 19 nt, Homo sapiens
gcaauauaguccucaguuu

SEQ ID NO: 919296 - RNA, 19 nt, Homo sapiens
aaacuaauaugcuggcuuu

SEQ ID NO: 919297 - RNA, 19 nt, Homo sapiens
ccagauugcucauuuagaa

SEQ ID NO: 919298 - RNA, 19 nt, Homo sapiens
gaaaugacuuuggaaacuu

SEQ ID NO: 919299 - RNA, 19 nt, Homo sapiens
gaaagaugcccuucacuau

SEQ ID NO: 919300 - RNA, 19 nt, Homo sapiens
ggaaagaugcccuucacua

SEQ ID NO: 919301 - RNA, 19 nt, Homo sapiens
gagaaugggauacaagaua

SEQ ID NO: 919302 - RNA, 19 nt, Homo sapiens
aaacagguaucucacauga

SEQ ID NO: 919303 - RNA, 19 nt, Homo sapiens
cagaggagcugcagauuuc

SEQ ID NO: 919304 - RNA, 19 nt, Homo sapiens
gaaggaaacagcuguaaau

SEQ ID NO: 919305 - RNA, 19 nt, Homo sapiens
gaggaggaauguagauauu

SEQ ID NO: 919306 - RNA, 19 nt, Homo sapiens
gagacaagcuugccagauc

SEQ ID NO: 919307 - RNA, 19 nt, Homo sapiens
cgaaggaacccaugaauug

SEQ ID NO: 919308 - RNA, 19 nt, Homo sapiens
caauauaguccucaguuua

SEQ ID NO: 919309 - RNA, 19 nt, Homo sapiens
ccaacaggcuauuucagua

SEQ ID NO: 919310 - RNA, 19 nt, Homo sapiens
ugaaggaaaugacguuuau

SEQ ID NO: 919311 - RNA, 19 nt, Homo sapiens
gaagagaugcccuaaagau

SEQ ID NO: 919312 - RNA, 19 nt, Homo sapiens
agaacuagcucagaaauug

SEQ ID NO: 919313 - RNA, 19 nt, Homo sapiens
ggaccaauacugccuguaa

SEQ ID NO: 919314 - RNA, 19 nt, Homo sapiens
guaagagaauaaacacuug

SEQ ID NO: 919315 - RNA, 19 nt, Homo sapiens
gcaagaagcaguuccuguu

SEQ ID NO: 919316 - RNA, 19 nt, Homo sapiens
guuaguguauggaccaaua

SEQ ID NO: 919317 - RNA, 19 nt, Homo sapiens
gagaugcccuaaagaugaa

SEQ ID NO: 919318 - RNA, 19 nt, Homo sapiens
gagcgcagguacuugguaa

SEQ ID NO: 919319 - RNA, 19 nt, Homo sapiens
gaacaugauuggaacaacu

SEQ ID NO: 919320 - RNA, 19 nt, Homo sapiens
ggaugaaauucuuuacaug

SEQ ID NO: 919321 - RNA, 19 nt, Homo sapiens
uagaugaccugcuugauuc

SEQ ID NO: 919322 - RNA, 19 nt, Homo sapiens
uacaagauauggagcaauu

SEQ ID NO: 919323 - RNA, 19 nt, Homo sapiens
gaacguaagaaguggauga

SEQ ID NO: 919324 - RNA, 19 nt, Homo sapiens
gguacuugguaaucaaaua

SEQ ID NO: 919325 - RNA, 19 nt, Homo sapiens
ucaagagucuaaacgauau

SEQ ID NO: 919326 - RNA, 19 nt, Homo sapiens
ggauaaagaauguugaaga

SEQ ID NO: 919327 - RNA, 19 nt, Homo sapiens
gcccuaaguuaauggauuu

SEQ ID NO: 919328 - RNA, 19 nt, Homo sapiens
gaguugguccuucauauaa

SEQ ID NO: 919329 - RNA, 19 nt, Homo sapiens
uuaggaaccuuacccauug

SEQ ID NO: 919330 - RNA, 19 nt, Homo sapiens
gaaggagaaugggauacaa

SEQ ID NO: 919331 - RNA, 19 nt, Homo sapiens
gcagguacuugguaaucaa

SEQ ID NO: 919332 - RNA, 19 nt, Homo sapiens
caagucagccuagaaauga

SEQ ID NO: 919333 - RNA, 19 nt, Homo sapiens
aagaagagaugcccuaaag

SEQ ID NO: 919334 - RNA, 19 nt, Homo sapiens
ugagagugaugucuauuga

SEQ ID NO: 919335 - RNA, 19 nt, Homo sapiens
acagguaucucacaugaug

SEQ ID NO: 919336 - RNA, 19 nt, Homo sapiens
gaaggaacccaugaauuga

SEQ ID NO: 919337 - RNA, 19 nt, Homo sapiens
gaaagaagagaugcccuaa

SEQ ID NO: 919338 - RNA, 19 nt, Homo sapiens
ccauauugcuucugggaaa

SEQ ID NO: 919339 - RNA, 19 nt, Homo sapiens
gaacacaggagcaauaugc

SEQ ID NO: 919340 - RNA, 19 nt, Homo sapiens
gccaacagauuaugcugaa

SEQ ID NO: 919341 - RNA, 19 nt, Homo sapiens
uaaaucguauugccugcua

SEQ ID NO: 919342 - RNA, 19 nt, Homo sapiens
caugauggaugaaauucuu

SEQ ID NO: 919343 - RNA, 19 nt, Homo sapiens
gaagauauugagccagauu

SEQ ID NO: 919344 - RNA, 19 nt, Homo sapiens
cguauugccugcuauucua

SEQ ID NO: 919345 - RNA, 19 nt, Homo sapiens
gguaagagaauaaacacuu

SEQ ID NO: 919346 - RNA, 19 nt, Homo sapiens
agaaugggauacaagauau

SEQ ID NO: 919347 - RNA, 19 nt, Homo sapiens
gcucaagagucuaaacgau

SEQ ID NO: 919348 - RNA, 19 nt, Homo sapiens
gaagaugagugcuuuuaug

SEQ ID NO: 919349 - RNA, 19 nt, Homo sapiens
ccagguaguuuguuugcuu

SEQ ID NO: 919350 - RNA, 19 nt, Homo sapiens
gaauggaccagguaguuug

SEQ ID NO: 919351 - RNA, 19 nt, Homo sapiens
ugaacuagaugaccugcuu

SEQ ID NO: 919352 - RNA, 19 nt, Homo sapiens
aaaggcagcagaacauuaa

SEQ ID NO: 919353 - RNA, 19 nt, Homo sapiens
ggaaaugccgaacuucaug

SEQ ID NO: 919354 - RNA, 19 nt, Homo sapiens
aauaaugccuggauuucuu

SEQ ID NO: 919355 - RNA, 19 nt, Homo sapiens
gauauuggcagaauuugga

SEQ ID NO: 919356 - RNA, 19 nt, Homo sapiens
gccgucagcuuuagucaga

SEQ ID NO: 919357 - RNA, 19 nt, Homo sapiens
gaaccauucuguggaagau

SEQ ID NO: 919358 - RNA, 19 nt, Homo sapiens
ccuugaauauagcugauua

SEQ ID NO: 919359 - RNA, 19 nt, Homo sapiens
gaaaugccgaacuucauga

SEQ ID NO: 919360 - RNA, 19 nt, Homo sapiens
agacauagccagucaguca

SEQ ID NO: 919361 - RNA, 19 nt, Homo sapiens
agaaacaaaugccuuuaca

SEQ ID NO: 919362 - RNA, 19 nt, Homo sapiens
cguaagaaguggaugaaca

SEQ ID NO: 919363 - RNA, 19 nt, Homo sapiens
guuaauggauuucacuuac

SEQ ID NO: 919364 - RNA, 19 nt, Homo sapiens
ucggaaaucuaaggcuuua

SEQ ID NO: 919365 - RNA, 19 nt, Homo sapiens
gaccaauacugccuguaau

SEQ ID NO: 919366 - RNA, 19 nt, Homo sapiens
ggaaggacugcaguuuaua

SEQ ID NO: 919367 - RNA, 19 nt, Homo sapiens
gaacagacuuuuggaugaa

SEQ ID NO: 919368 - RNA, 19 nt, Homo sapiens
cagauuuccugcuuguauu

SEQ ID NO: 919369 - RNA, 19 nt, Homo sapiens
ucagagcauugaccagaaa

SEQ ID NO: 919370 - RNA, 19 nt, Homo sapiens
aaucuaaggcuuuaaguga

SEQ ID NO: 919371 - RNA, 19 nt, Homo sapiens
ccaauacugccuguaauaa

SEQ ID NO: 919372 - RNA, 19 nt, Homo sapiens
guacugggaucagaauaca

SEQ ID NO: 919373 - RNA, 19 nt, Homo sapiens
gaaaagaucacuuaauugg

SEQ ID NO: 919374 - RNA, 19 nt, Homo sapiens
ugugauagguauaugaaug

SEQ ID NO: 919375 - RNA, 19 nt, Homo sapiens
gugaagacauagccaguca

SEQ ID NO: 919376 - RNA, 19 nt, Homo sapiens
aaacaaaugccuuuacagu

SEQ ID NO: 919377 - RNA, 19 nt, Homo sapiens
gaaguucgguauggcuguu

SEQ ID NO: 919378 - RNA, 19 nt, Homo sapiens
uaagugccuuguccacauu

SEQ ID NO: 919379 - RNA, 19 nt, Homo sapiens
aggaaggacugcaguuuau

SEQ ID NO: 919380 - RNA, 19 nt, Homo sapiens
caauacugccuguaauaaa

SEQ ID NO: 919381 - RNA, 19 nt, Homo sapiens
ugaugucuauugaacguaa

SEQ ID NO: 919382 - RNA, 19 nt, Homo sapiens
uaaacgauauuggcagaau

SEQ ID NO: 919383 - RNA, 19 nt, Homo sapiens
uaaccuuacuguguucaaa

SEQ ID NO: 919384 - RNA, 19 nt, Homo sapiens
agauuaaccuuacuguguu

SEQ ID NO: 919385 - RNA, 19 nt, Homo sapiens
gaauauugcucaccuacua

SEQ ID NO: 919386 - RNA, 19 nt, Homo sapiens
cuacuggacugccauauua

SEQ ID NO: 919387 - RNA, 19 nt, Homo sapiens
gcacagagcugaaaacuga

SEQ ID NO: 919388 - RNA, 19 nt, Homo sapiens
agaaauaccugcaacauga

SEQ ID NO: 919389 - RNA, 19 nt, Homo sapiens
ugagagaaaucacaaagua

SEQ ID NO: 919390 - RNA, 19 nt, Homo sapiens
gaaaguuacugggagauaa

SEQ ID NO: 919391 - RNA, 19 nt, Homo sapiens
gcaauaagauuugaugugu

SEQ ID NO: 919392 - RNA, 19 nt, Homo sapiens
gcagaaagccaaucucauu

SEQ ID NO: 919393 - RNA, 19 nt, Homo sapiens
gugaguagcuuugauuuaa

SEQ ID NO: 919394 - RNA, 19 nt, Homo sapiens
gaaauaccuuccaaugcua

SEQ ID NO: 919395 - RNA, 19 nt, Homo sapiens
ggaguauagugguaaguaa

SEQ ID NO: 919396 - RNA, 19 nt, Homo sapiens
ggagauaacuucgaaggau

SEQ ID NO: 919397 - RNA, 19 nt, Homo sapiens
ccauguaccucacuuuauu

SEQ ID NO: 919398 - RNA, 19 nt, Homo sapiens
gagaaucgcuagcauaacu

SEQ ID NO: 919399 - RNA, 19 nt, Homo sapiens
ggaccaggaaugaaaguua

SEQ ID NO: 919400 - RNA, 19 nt, Homo sapiens
agaaauguaugcacuggua

SEQ ID NO: 919401 - RNA, 19 nt, Homo sapiens
guguagagcuggagcaauu

SEQ ID NO: 919402 - RNA, 19 nt, Homo sapiens
gagauaacuucgaaggauu

SEQ ID NO: 919403 - RNA, 19 nt, Homo sapiens
caacaugacagucuaauca

SEQ ID NO: 919404 - RNA, 19 nt, Homo sapiens
gaugaggaguauaguggua

SEQ ID NO: 919405 - RNA, 19 nt, Homo sapiens
ggauaagccuauugagaug

SEQ ID NO: 919406 - RNA, 19 nt, Homo sapiens
ggagugacgucaaccugaa

SEQ ID NO: 919407 - RNA, 19 nt, Homo sapiens
ggagaauuguuaccacaga

SEQ ID NO: 919408 - RNA, 19 nt, Homo sapiens
cuacaaaguucgaaugcaa

SEQ ID NO: 919409 - RNA, 19 nt, Homo sapiens
aauaggauguccauuugua

SEQ ID NO: 919410 - RNA, 19 nt, Homo sapiens
cagaggagcuacuguauac

SEQ ID NO: 919411 - RNA, 19 nt, Homo sapiens
ugacuaagcauauugaaga

SEQ ID NO: 919412 - RNA, 19 nt, Homo sapiens
uaaccucacuguccuacaa

SEQ ID NO: 919413 - RNA, 19 nt, Homo sapiens
agaaacaggagaaguauuu

SEQ ID NO: 919414 - RNA, 19 nt, Homo sapiens
guauuagaguuuaccauga

SEQ ID NO: 919415 - RNA, 19 nt, Homo sapiens
uagcagaaagagcaaauua

SEQ ID NO: 919416 - RNA, 19 nt, Homo sapiens
ugcaagcacugaaauguuu

SEQ ID NO: 919417 - RNA, 19 nt, Homo sapiens
uauuaucccugccuuauug

SEQ ID NO: 919418 - RNA, 19 nt, Homo sapiens
aaagguagauagacagaug

SEQ ID NO: 919419 - RNA, 19 nt, Homo sapiens
gcaaacauacuagugauau

SEQ ID NO: 919420 - RNA, 19 nt, Homo sapiens
gcagaaagagcaaauuagu

SEQ ID NO: 919421 - RNA, 19 nt, Homo sapiens
gcaauucggacagaugaua

SEQ ID NO: 919422 - RNA, 19 nt, Homo sapiens
guaaagggccagaucauca

SEQ ID NO: 919423 - RNA, 19 nt, Homo sapiens
ggacugaaagguagauaga

SEQ ID NO: 919424 - RNA, 19 nt, Homo sapiens
cagagaaucgcuagcauaa

SEQ ID NO: 919425 - RNA, 19 nt, Homo sapiens
gggauaagccuauugagau

SEQ ID NO: 919426 - RNA, 19 nt, Homo sapiens
gaccugaaguuuauugaag

SEQ ID NO: 919427 - RNA, 19 nt, Homo sapiens
gaaagaggaguauggaaca

SEQ ID NO: 919428 - RNA, 19 nt, Homo sapiens
ugacgccaauguucaguuu

SEQ ID NO: 919429 - RNA, 19 nt, Homo sapiens
gaaaguccuaccauuagaa

SEQ ID NO: 919430 - RNA, 19 nt, Homo sapiens
gcagagugacuaagcauau

SEQ ID NO: 919431 - RNA, 19 nt, Homo sapiens
ugaaccagauguugagcua

SEQ ID NO: 919432 - RNA, 19 nt, Homo sapiens
guacguugguguauugcaa

SEQ ID NO: 919433 - RNA, 19 nt, Homo sapiens
cuaagcauauugaagaaug

SEQ ID NO: 919434 - RNA, 19 nt, Homo sapiens
uuuaggagcuguuccaaga

SEQ ID NO: 919435 - RNA, 19 nt, Homo sapiens
ggacuguguaacuuaaaua

SEQ ID NO: 919436 - RNA, 19 nt, Homo sapiens
cuucaggccuguagaaaga

SEQ ID NO: 919437 - RNA, 19 nt, Homo sapiens
uuaaaaggcuugaucauga

SEQ ID NO: 919438 - RNA, 19 nt, Homo sapiens
ugaaaguccuaccauuaga

SEQ ID NO: 919439 - RNA, 19 nt, Homo sapiens
ggcaugguguucugauaaa

SEQ ID NO: 919440 - RNA, 19 nt, Homo sapiens
uuaaagacauacccugguu

SEQ ID NO: 919441 - RNA, 19 nt, Homo sapiens
gaauuguuaccacagauuu

SEQ ID NO: 919442 - RNA, 19 nt, Homo sapiens
cgaugacccugguaaaugu

SEQ ID NO: 919443 - RNA, 19 nt, Homo sapiens
agaaagagcaaauuaguca

SEQ ID NO: 919444 - RNA, 19 nt, Homo sapiens
guguauaauuuccugguaa

SEQ ID NO: 919445 - RNA, 19 nt, Homo sapiens
ggaccacaaugggaaauag

SEQ ID NO: 919446 - RNA, 19 nt, Homo sapiens
gacacugccuaucugauga

SEQ ID NO: 919447 - RNA, 19 nt, Homo sapiens
ggucgaaugugcaguaagg

SEQ ID NO: 919448 - RNA, 19 nt, Homo sapiens
ugaguggucaucugaauuu

SEQ ID NO: 919449 - RNA, 19 nt, Homo sapiens
gagcaauucggacagauga

SEQ ID NO: 919450 - RNA, 19 nt, Homo sapiens
gagcaaaccacauguucug

SEQ ID NO: 919451 - RNA, 19 nt, Homo sapiens
cuugaaaguccuaccauua

SEQ ID NO: 919452 - RNA, 19 nt, Homo sapiens
uaggagcuguuccaagauu

SEQ ID NO: 919453 - RNA, 19 nt, Homo sapiens
gacuaagcauauugaagaa

SEQ ID NO: 919454 - RNA, 19 nt, Homo sapiens
ccagaggagcuacuguaua

SEQ ID NO: 919455 - RNA, 19 nt, Homo sapiens
gugauaucauguucuagaa

SEQ ID NO: 919456 - RNA, 19 nt, Homo sapiens
gguuuaggaugguuauuag

SEQ ID NO: 919457 - RNA, 19 nt, Homo sapiens
gcaaauacuggcgugcuuu

SEQ ID NO: 919458 - RNA, 19 nt, Homo sapiens
gcaugccggugcuugaaug

SEQ ID NO: 919459 - RNA, 19 nt, Homo sapiens
ccagaucaucaaacaauuu

SEQ ID NO: 919460 - RNA, 19 nt, Homo sapiens
gaaacugaaguaauagcaa

SEQ ID NO: 919461 - RNA, 19 nt, Homo sapiens
aaaggaaccauuucuugaa

SEQ ID NO: 919462 - RNA, 19 nt, Homo sapiens
gagagaaaucacaaaguau

SEQ ID NO: 919463 - RNA, 19 nt, Homo sapiens
caaaccacauguucugucu

SEQ ID NO: 919464 - RNA, 19 nt, Homo sapiens
uuugauauguggcuuaguu

SEQ ID NO: 919465 - RNA, 19 nt, Homo sapiens
gagcugagacacugccuau

SEQ ID NO: 919466 - RNA, 19 nt, Homo sapiens
gaccaggaaugaaaguuac

SEQ ID NO: 919467 - RNA, 19 nt, Homo sapiens
ggaaacaacaagcagaaag

SEQ ID NO: 919468 - RNA, 19 nt, Homo sapiens
caugacagucuaaucagua

SEQ ID NO: 919469 - RNA, 19 nt, Homo sapiens
gggagaggcuuuuauaaca

SEQ ID NO: 919470 - RNA, 19 nt, Homo sapiens
cagagugacuaagcauauu

SEQ ID NO: 919471 - RNA, 19 nt, Homo sapiens
aaggcuugaucaugauuua

SEQ ID NO: 919472 - RNA, 19 nt, Homo sapiens
cauaacugaucaccucaug

SEQ ID NO: 919473 - RNA, 19 nt, Homo sapiens
ugucagaucuucucacacu

SEQ ID NO: 919474 - RNA, 19 nt, Homo sapiens
gcuaacuccugaucguuuc

SEQ ID NO: 919475 - RNA, 19 nt, Homo sapiens
ucucauggacugaaaggua

SEQ ID NO: 919476 - RNA, 19 nt, Homo sapiens
uauuagggcccauuagaaa

SEQ ID NO: 919477 - RNA, 19 nt, Homo sapiens
aaagcaaacauacuaguga

SEQ ID NO: 919478 - RNA, 19 nt, Homo sapiens
guaccucacuuuauuucag

SEQ ID NO: 919479 - RNA, 19 nt, Homo sapiens
uggaacaaccuuacauuug

SEQ ID NO: 919480 - RNA, 19 nt, Homo sapiens
ggaguauggaacaaccuua

SEQ ID NO: 919481 - RNA, 19 nt, Homo sapiens
gaguuuaccaugauucaga

SEQ ID NO: 919482 - RNA, 19 nt, Homo sapiens
gagaauuguuaccacagau

SEQ ID NO: 919483 - RNA, 19 nt, Homo sapiens
gccagaucaucaaacaauu

SEQ ID NO: 919484 - RNA, 19 nt, Homo sapiens
ggccagaucaucaaacaau

SEQ ID NO: 919485 - RNA, 19 nt, Homo sapiens
gcaauaaccuucaaaguag

SEQ ID NO: 919486 - RNA, 19 nt, Homo sapiens
guagaagaauggcugauua

SEQ ID NO: 919487 - RNA, 19 nt, Homo sapiens
gcacauaagugguuacuag

SEQ ID NO: 919488 - RNA, 19 nt, Homo sapiens
gaaguagcaucaucacauu

SEQ ID NO: 919489 - RNA, 19 nt, Homo sapiens
caagaggaccuucugauua

SEQ ID NO: 919490 - RNA, 19 nt, Homo sapiens
gcaggacauuucugauuua

SEQ ID NO: 919491 - RNA, 19 nt, Homo sapiens
uaaagggcauuucacauuu

SEQ ID NO: 919492 - RNA, 19 nt, Homo sapiens
agacagaacucuugauuuc

SEQ ID NO: 919493 - RNA, 19 nt, Homo sapiens
ucaguaagcaucaucauua

SEQ ID NO: 919494 - RNA, 19 nt, Homo sapiens
uaaauaugcugcgaaauga

SEQ ID NO: 919495 - RNA, 19 nt, Homo sapiens
gaugaucggucaguacuaa

SEQ ID NO: 919496 - RNA, 19 nt, Homo sapiens
gcucagaguucaugaaauc

SEQ ID NO: 919497 - RNA, 19 nt, Homo sapiens
gagccacucuaucaauuaa

SEQ ID NO: 919498 - RNA, 19 nt, Homo sapiens
uaccaugacuggcuuuaua

SEQ ID NO: 919499 - RNA, 19 nt, Homo sapiens
cgauaugacuucugccuaa

SEQ ID NO: 919500 - RNA, 19 nt, Homo sapiens
gccaaagucugaucuguau

SEQ ID NO: 919501 - RNA, 19 nt, Homo sapiens
caagaguuguagaaguuua

SEQ ID NO: 919502 - RNA, 19 nt, Homo sapiens
caaagcacgucuagcacua

SEQ ID NO: 919503 - RNA, 19 nt, Homo sapiens
caagaaauguguuggaucu

SEQ ID NO: 919504 - RNA, 19 nt, Homo sapiens
gaagauguccggucaaagu

SEQ ID NO: 919505 - RNA, 19 nt, Homo sapiens
aaagggcauuucacauuua

SEQ ID NO: 919506 - RNA, 19 nt, Homo sapiens
gaagaauggcugauuaugu

SEQ ID NO: 919507 - RNA, 19 nt, Homo sapiens
uacccggacuuuagaauua

SEQ ID NO: 919508 - RNA, 19 nt, Homo sapiens
ggucaaaguagaagauuaa

SEQ ID NO: 919509 - RNA, 19 nt, Homo sapiens
caaaguagaagauuaagug

SEQ ID NO: 919510 - RNA, 19 nt, Homo sapiens
gcagccagcuauaugcaaa

SEQ ID NO: 919511 - RNA, 19 nt, Homo sapiens
gaaagaaccauuccugucu

SEQ ID NO: 919512 - RNA, 19 nt, Homo sapiens
ugucaacucugccuauaaa

SEQ ID NO: 919513 - RNA, 19 nt, Homo sapiens
gaacacaaccaggcucauu

SEQ ID NO: 919514 - RNA, 19 nt, Homo sapiens
cuaaagcccuacacgauau

SEQ ID NO: 919515 - RNA, 19 nt, Homo sapiens
aagaauggcugauuaugug

SEQ ID NO: 919516 - RNA, 19 nt, Homo sapiens
ugaaaguccuguaaagugu

SEQ ID NO: 919517 - RNA, 19 nt, Homo sapiens
caaaguagccucugauugc

SEQ ID NO: 919518 - RNA, 19 nt, Homo sapiens
gaagugaacaaguccaaga

SEQ ID NO: 919519 - RNA, 19 nt, Homo sapiens
gaaaauacccggacuuuag

SEQ ID NO: 919520 - RNA, 19 nt, Homo sapiens
ugcaauaaccuucaaagua

SEQ ID NO: 919521 - RNA, 19 nt, Homo sapiens
gcauuucguuaccucuuaa

SEQ ID NO: 919522 - RNA, 19 nt, Homo sapiens
cgcaaaagcuacauuguua

SEQ ID NO: 919523 - RNA, 19 nt, Homo sapiens
cuaaauaugcugcgaaaug

SEQ ID NO: 919524 - RNA, 19 nt, Homo sapiens
auauaucccugucuacuuu

SEQ ID NO: 919525 - RNA, 19 nt, Homo sapiens
ccuaccaccuuuauuugua

SEQ ID NO: 919526 - RNA, 19 nt, Homo sapiens
guagcaucaucacauuaua

SEQ ID NO: 919527 - RNA, 19 nt, Homo sapiens
gaagagcaucuguagaaga

SEQ ID NO: 919528 - RNA, 19 nt, Homo sapiens
cgcaggacauuucugauuu

SEQ ID NO: 919529 - RNA, 19 nt, Homo sapiens
gccaggaaaugcuuggaaa

SEQ ID NO: 919530 - RNA, 19 nt, Homo sapiens
ccaccucacuucaguauac

SEQ ID NO: 919531 - RNA, 19 nt, Homo sapiens
aagaggaccuucugauuag

SEQ ID NO: 919532 - RNA, 19 nt, Homo sapiens
aguagaagauuaagugaug

SEQ ID NO: 919533 - RNA, 19 nt, Homo sapiens
ccagcuauaugcaaauguu

SEQ ID NO: 919534 - RNA, 19 nt, Homo sapiens
cauuucaucucaagaguug

SEQ ID NO: 919535 - RNA, 19 nt, Homo sapiens
ccaagaggaccuucugauu

SEQ ID NO: 919536 - RNA, 19 nt, Homo sapiens
agaauuaccuggcccaucu

SEQ ID NO: 919537 - RNA, 19 nt, Homo sapiens
cagccuaccaccuuuauuu

SEQ ID NO: 919538 - RNA, 19 nt, Homo sapiens
cugauuaugugacuuguga

SEQ ID NO: 919539 - RNA, 19 nt, Homo sapiens
aaucguaucuguaccaagu

SEQ ID NO: 919540 - RNA, 19 nt, Homo sapiens
guuuacaacuccaaauuca

SEQ ID NO: 919541 - RNA, 19 nt, Homo sapiens
cuaccaccuuuauuuguaa

SEQ ID NO: 919542 - RNA, 19 nt, Homo sapiens
ccaguugacucuuccuuag

SEQ ID NO: 919543 - RNA, 19 nt, Homo sapiens
ucuagaugcuggacaagaa

SEQ ID NO: 919544 - RNA, 19 nt, Homo sapiens
uaagucagauuaugucacu

SEQ ID NO: 919545 - RNA, 19 nt, Homo sapiens
ggagaaagcgcaaaagcua

SEQ ID NO: 919546 - RNA, 19 nt, Homo sapiens
uuucuaaucuguacuguag

SEQ ID NO: 919547 - RNA, 19 nt, Homo sapiens
caguaagcaucaucauuau

SEQ ID NO: 919548 - RNA, 19 nt, Homo sapiens
auaaagggcauuucacauu

SEQ ID NO: 919549 - RNA, 19 nt, Homo sapiens
cucaagaguuguagaaguu

SEQ ID NO: 919550 - RNA, 19 nt, Homo sapiens
guacuaacauagcauuucg

SEQ ID NO: 919551 - RNA, 19 nt, Homo sapiens
aagaagauguccggucaaa

SEQ ID NO: 919552 - RNA, 19 nt, Homo sapiens
uaacaaggccaagacagaa

SEQ ID NO: 919553 - RNA, 19 nt, Homo sapiens
ucaaaguaaugaaguagca

SEQ ID NO: 919554 - RNA, 19 nt, Homo sapiens
ccacagucuuccucuauag

SEQ ID NO: 919555 - RNA, 19 nt, Homo sapiens
gauguccggucaaaguaga

SEQ ID NO: 919556 - RNA, 19 nt, Homo sapiens
ucuaaagcccuacacgaua

SEQ ID NO: 919557 - RNA, 19 nt, Homo sapiens
caacucugccuauaaaaua

SEQ ID NO: 919558 - RNA, 19 nt, Homo sapiens
ggucaguacuaacauagca

SEQ ID NO: 919559 - RNA, 19 nt, Homo sapiens
augcaaauguucaguguug

SEQ ID NO: 919560 - RNA, 19 nt, Homo sapiens
cucauuugcugacauauug

SEQ ID NO: 919561 - RNA, 19 nt, Homo sapiens
gggcuugccuacacuucaa

SEQ ID NO: 919562 - RNA, 19 nt, Homo sapiens
guagaagauuaagugauga

SEQ ID NO: 919563 - RNA, 19 nt, Homo sapiens
gaaaguuaagcacgcagaa

SEQ ID NO: 919564 - RNA, 19 nt, Homo sapiens
gauaugacuucugccuaau

SEQ ID NO: 919565 - RNA, 19 nt, Homo sapiens
cuaagucaccaccaucuuu

SEQ ID NO: 919566 - RNA, 19 nt, Homo sapiens
guugagugguugaaacaga

SEQ ID NO: 919567 - RNA, 19 nt, Homo sapiens
ggagguccaugaggaagug

SEQ ID NO: 919568 - RNA, 19 nt, Homo sapiens
uugaagagcaucuguagaa

SEQ ID NO: 919569 - RNA, 19 nt, Homo sapiens
cgagccacucuaucaauua

SEQ ID NO: 919570 - RNA, 19 nt, Homo sapiens
ugccuugacuacugcaaua

SEQ ID NO: 919571 - RNA, 19 nt, Homo sapiens
ucaucucccucguaguuaa

SEQ ID NO: 919572 - RNA, 19 nt, Homo sapiens
uggaauugaucgaaggauu

SEQ ID NO: 919573 - RNA, 19 nt, Homo sapiens
cagauuaugucacuguuuu

SEQ ID NO: 919574 - RNA, 19 nt, Homo sapiens
gcucauuugcugacauauu

SEQ ID NO: 919575 - RNA, 19 nt, Homo sapiens
gccuuuagguaccgaagaa

SEQ ID NO: 919576 - RNA, 19 nt, Homo sapiens
aaauagaaaccaaccaguu

SEQ ID NO: 919577 - RNA, 19 nt, Homo sapiens
gcagagugguagaaagaac

SEQ ID NO: 919578 - RNA, 19 nt, Homo sapiens
guauaaagggcauuucaca

SEQ ID NO: 919579 - RNA, 19 nt, Homo sapiens
ugaaguagcaucaucacau

SEQ ID NO: 919580 - RNA, 19 nt, Homo sapiens
agaguucgcugagugauca

SEQ ID NO: 919581 - RNA, 19 nt, Homo sapiens
cggucaaaguagaagauua

SEQ ID NO: 919582 - RNA, 19 nt, Homo sapiens
gugcagagugguagaaaga

SEQ ID NO: 919583 - RNA, 19 nt, Homo sapiens
gaugagaaacaagaaaugu

SEQ ID NO: 919584 - RNA, 19 nt, Homo sapiens
gccuugcuaugccuucuaa

SEQ ID NO: 919585 - RNA, 19 nt, Homo sapiens
gaaaagagcuacuugaaaa

SEQ ID NO: 919586 - RNA, 19 nt, Homo sapiens
gaaauuagggugugucuuu

SEQ ID NO: 919587 - RNA, 19 nt, Homo sapiens
gaauaugucuucuguguca

SEQ ID NO: 919588 - RNA, 19 nt, Homo sapiens
caaauuagcuguggacuuc

SEQ ID NO: 919589 - RNA, 19 nt, Homo sapiens
ggaagcagcuggccgaguu

SEQ ID NO: 919590 - RNA, 19 nt, Homo sapiens
gaaauucgauggagugaag

SEQ ID NO: 919591 - RNA, 19 nt, Homo sapiens
guaaucagcuccuuucuag

SEQ ID NO: 919592 - RNA, 19 nt, Homo sapiens
ggacaugaaggaugacuua

SEQ ID NO: 919593 - RNA, 19 nt, Homo sapiens
ccacauacacuuuaucuaa

SEQ ID NO: 919594 - RNA, 19 nt, Homo sapiens
uagcagagauguccuuaaa

SEQ ID NO: 919595 - RNA, 19 nt, Homo sapiens
gggcaaacauauuucuuaa

SEQ ID NO: 919596 - RNA, 19 nt, Homo sapiens
gcagagugaugacugauga

SEQ ID NO: 919597 - RNA, 19 nt, Homo sapiens
gauggugcauucuauaauu

SEQ ID NO: 919598 - RNA, 19 nt, Homo sapiens
uaaauggugugcaagcaua

SEQ ID NO: 919599 - RNA, 19 nt, Homo sapiens
caccacaccuggcuaauuu

SEQ ID NO: 919600 - RNA, 19 nt, Homo sapiens
ggagugaaguuucgagaga

SEQ ID NO: 919601 - RNA, 19 nt, Homo sapiens
ucagcgaccuccacgauua

SEQ ID NO: 919602 - RNA, 19 nt, Homo sapiens
gggauaauaugaaggagaa

SEQ ID NO: 919603 - RNA, 19 nt, Homo sapiens
ugucuuaacuguaguggua

SEQ ID NO: 919604 - RNA, 19 nt, Homo sapiens
ccacgauuaucagaaauua

SEQ ID NO: 919605 - RNA, 19 nt, Homo sapiens
agacugagauguuugagaa

SEQ ID NO: 919606 - RNA, 19 nt, Homo sapiens
cugcaaagcugccgugauu

SEQ ID NO: 919607 - RNA, 19 nt, Homo sapiens
acaaggcaauggaaauaua

SEQ ID NO: 919608 - RNA, 19 nt, Homo sapiens
gaguagaaauagcuuagaa

SEQ ID NO: 919609 - RNA, 19 nt, Homo sapiens
gcaaacacucaauagaaua

SEQ ID NO: 919610 - RNA, 19 nt, Homo sapiens
gauagagaacgcucaauuu

SEQ ID NO: 919611 - RNA, 19 nt, Homo sapiens
cgagagaagugcaugaguu

SEQ ID NO: 919612 - RNA, 19 nt, Homo sapiens
gaucugaggaaguaugaua

SEQ ID NO: 919613 - RNA, 19 nt, Homo sapiens
gggagaagaucuuaaaugc

SEQ ID NO: 919614 - RNA, 19 nt, Homo sapiens
uguaaacucugcucucaaa

SEQ ID NO: 919615 - RNA, 19 nt, Homo sapiens
gcacucagcauucucaguu

SEQ ID NO: 919616 - RNA, 19 nt, Homo sapiens
gaaauguugguguuuguuu

SEQ ID NO: 919617 - RNA, 19 nt, Homo sapiens
ucaguuuacucuucaguuu

SEQ ID NO: 919618 - RNA, 19 nt, Homo sapiens
ggaaauauaccucaaucug

SEQ ID NO: 919619 - RNA, 19 nt, Homo sapiens
gaaauacauugaggacaug

SEQ ID NO: 919620 - RNA, 19 nt, Homo sapiens
gaaggaaaccaagaugauu

SEQ ID NO: 919621 - RNA, 19 nt, Homo sapiens
gaaacacucugcagguucu

SEQ ID NO: 919622 - RNA, 19 nt, Homo sapiens
gaagaccucuggacaugag

SEQ ID NO: 919623 - RNA, 19 nt, Homo sapiens
guagaagcuuggcaucauu

SEQ ID NO: 919624 - RNA, 19 nt, Homo sapiens
caagaugacuuuuccuuuu

SEQ ID NO: 919625 - RNA, 19 nt, Homo sapiens
gcaauauacuguuuguucu

SEQ ID NO: 919626 - RNA, 19 nt, Homo sapiens
ggagaaauuacguuugaaa

SEQ ID NO: 919627 - RNA, 19 nt, Homo sapiens
gagagaagugcaugaguuu

SEQ ID NO: 919628 - RNA, 19 nt, Homo sapiens
aaggagaaauuacguuuga

SEQ ID NO: 919629 - RNA, 19 nt, Homo sapiens
ugaaauacauugaggacau

SEQ ID NO: 919630 - RNA, 19 nt, Homo sapiens
cucagaaagugaugaaaua

SEQ ID NO: 919631 - RNA, 19 nt, Homo sapiens
gagaagugcaugaguuuga

SEQ ID NO: 919632 - RNA, 19 nt, Homo sapiens
gagaacauauuuccaagac

SEQ ID NO: 919633 - RNA, 19 nt, Homo sapiens
cagcaaacacucaauagaa

SEQ ID NO: 919634 - RNA, 19 nt, Homo sapiens
aaucuauccuugugcaaua

SEQ ID NO: 919635 - RNA, 19 nt, Homo sapiens
gauccaacauggcccaguu

SEQ ID NO: 919636 - RNA, 19 nt, Homo sapiens
aaggagaucuugcugagaa

SEQ ID NO: 919637 - RNA, 19 nt, Homo sapiens
caaggcaacuaguagguau

SEQ ID NO: 919638 - RNA, 19 nt, Homo sapiens
caacauggcccaguucaga

SEQ ID NO: 919639 - RNA, 19 nt, Homo sapiens
ggaaaggaaaguggagaua

SEQ ID NO: 919640 - RNA, 19 nt, Homo sapiens
cuaaagcugucaucuggaa

SEQ ID NO: 919641 - RNA, 19 nt, Homo sapiens
ggacgggucaccauuaaau

SEQ ID NO: 919642 - RNA, 19 nt, Homo sapiens
gcaaguaugauccaacaug

SEQ ID NO: 919643 - RNA, 19 nt, Homo sapiens
aaacugagacugagauguu

SEQ ID NO: 919644 - RNA, 19 nt, Homo sapiens
gagaggcaguccuucaugu

SEQ ID NO: 919645 - RNA, 19 nt, Homo sapiens
caacaucuuugaaauuagg

SEQ ID NO: 919646 - RNA, 19 nt, Homo sapiens
caaggaagccacaccagaa

SEQ ID NO: 919647 - RNA, 19 nt, Homo sapiens
aauauuagcuaccaucauc

SEQ ID NO: 919648 - RNA, 19 nt, Homo sapiens
gaaugugauuuaggacaaa

SEQ ID NO: 919649 - RNA, 19 nt, Homo sapiens
cggccuaauuucuguauuu

SEQ ID NO: 919650 - RNA, 19 nt, Homo sapiens
ggccaaaccuucccucucu

SEQ ID NO: 919651 - RNA, 19 nt, Homo sapiens
ucacaaggcaauggaaaua

SEQ ID NO: 919652 - RNA, 19 nt, Homo sapiens
gcagaggacccaguacaaa

SEQ ID NO: 919653 - RNA, 19 nt, Homo sapiens
ucaauugacuggugaagag

SEQ ID NO: 919654 - RNA, 19 nt, Homo sapiens
ggaaauggggcaaauuaua

SEQ ID NO: 919655 - RNA, 19 nt, Homo sapiens
gaaccacagggcacucuaa

SEQ ID NO: 919656 - RNA, 19 nt, Homo sapiens
caaaugauuggaugaguga

SEQ ID NO: 919657 - RNA, 19 nt, Homo sapiens
gcuauaaaggccagcauuu

SEQ ID NO: 919658 - RNA, 19 nt, Homo sapiens
gcucagcuauguaaacucu

SEQ ID NO: 919659 - RNA, 19 nt, Homo sapiens
gcauuuaguucacaagcau

SEQ ID NO: 919660 - RNA, 19 nt, Homo sapiens
ucuaaugguuugacacuug

SEQ ID NO: 919661 - RNA, 19 nt, Homo sapiens
aagaagaaagggaguauuu

SEQ ID NO: 919662 - RNA, 19 nt, Homo sapiens
caugaaggaugacuuacga

SEQ ID NO: 919663 - RNA, 19 nt, Homo sapiens
ucuuagaucugaggaagua

SEQ ID NO: 919664 - RNA, 19 nt, Homo sapiens
ggaaacccauaggcagauu

SEQ ID NO: 919665 - RNA, 19 nt, Homo sapiens
caaggugggaacacaguua

SEQ ID NO: 919666 - RNA, 19 nt, Homo sapiens
agaccugccugauuccuuu

SEQ ID NO: 919667 - RNA, 19 nt, Homo sapiens
gaacugacccagcuaaagc

SEQ ID NO: 919668 - RNA, 19 nt, Homo sapiens
gaagauagagaacgcucaa

SEQ ID NO: 919669 - RNA, 19 nt, Homo sapiens
aauaggcacucaauagaug

SEQ ID NO: 919670 - RNA, 19 nt, Homo sapiens
ggagugcaguggcaugauc

SEQ ID NO: 919671 - RNA, 19 nt, Homo sapiens
gcagagauguccuuaaaag

SEQ ID NO: 919672 - RNA, 19 nt, Homo sapiens
gaaauauuacgcuaaacug

SEQ ID NO: 919673 - RNA, 19 nt, Homo sapiens
aaagcuauaucuucacugu

SEQ ID NO: 919674 - RNA, 19 nt, Homo sapiens
gaaggagaaauuacguuug

SEQ ID NO: 919675 - RNA, 19 nt, Homo sapiens
ggagggauaauaugaagga

SEQ ID NO: 919676 - RNA, 19 nt, Homo sapiens
gaggcaguccuucauguuu

SEQ ID NO: 919677 - RNA, 19 nt, Homo sapiens
uauaauuggcagcaucuua

SEQ ID NO: 919678 - RNA, 19 nt, Homo sapiens
aaaccaaccugaacuuugc

SEQ ID NO: 919679 - RNA, 19 nt, Homo sapiens
ggaauuguggcuuugaaga

SEQ ID NO: 919680 - RNA, 19 nt, Homo sapiens
ggccaagaaugacgugguu

SEQ ID NO: 919681 - RNA, 19 nt, Homo sapiens
gcaacaaggcaacuaguag

SEQ ID NO: 919682 - RNA, 19 nt, Homo sapiens
gcacacagcaaacacucaa

SEQ ID NO: 919683 - RNA, 19 nt, Homo sapiens
ccacaaauuccaacaagau

SEQ ID NO: 919684 - RNA, 19 nt, Homo sapiens
gcacgaaggaaaccaagau

SEQ ID NO: 919685 - RNA, 19 nt, Homo sapiens
ggaauugucuuaaguguag

SEQ ID NO: 919686 - RNA, 19 nt, Homo sapiens
gaacagggagggaugauuu

SEQ ID NO: 919687 - RNA, 19 nt, Homo sapiens
ggaaggaggaauugucuua

SEQ ID NO: 919688 - RNA, 19 nt, Homo sapiens
ggacguguguugucauuau

SEQ ID NO: 919689 - RNA, 19 nt, Homo sapiens
ggaaagaaguguuuuaaga

SEQ ID NO: 919690 - RNA, 19 nt, Homo sapiens
gagaaaagcuuacaaauac

SEQ ID NO: 919691 - RNA, 19 nt, Homo sapiens
aguaagagcuuucgaguau

SEQ ID NO: 919692 - RNA, 19 nt, Homo sapiens
guaaauguguuggaaagaa

SEQ ID NO: 919693 - RNA, 19 nt, Homo sapiens
gaaggcuguuguucagaua

SEQ ID NO: 919694 - RNA, 19 nt, Homo sapiens
uuaaagaggcaaugacuua

SEQ ID NO: 919695 - RNA, 19 nt, Homo sapiens
aaacaaacuucuccauaga

SEQ ID NO: 919696 - RNA, 19 nt, Homo sapiens
ccuacaagcuccuaacaaa

SEQ ID NO: 919697 - RNA, 19 nt, Homo sapiens
caaaugacaugugguuaau

SEQ ID NO: 919698 - RNA, 19 nt, Homo sapiens
gggaugauuuggaagauau

SEQ ID NO: 919699 - RNA, 19 nt, Homo sapiens
ccugaaauaugcuggagua

SEQ ID NO: 919700 - RNA, 19 nt, Homo sapiens
gacaugugguuaaugauga

SEQ ID NO: 919701 - RNA, 19 nt, Homo sapiens
gguauaaccacacauuaaa

SEQ ID NO: 919702 - RNA, 19 nt, Homo sapiens
gcuagcaguuugccugaaa

SEQ ID NO: 919703 - RNA, 19 nt, Homo sapiens
gaccaaacacugugacaaa

SEQ ID NO: 919704 - RNA, 19 nt, Homo sapiens
cuuaacagccuucucaaua

SEQ ID NO: 919705 - RNA, 19 nt, Homo sapiens
gaggaguuguugcaaaguu

SEQ ID NO: 919706 - RNA, 19 nt, Homo sapiens
uuaacagccuucucaauau

SEQ ID NO: 919707 - RNA, 19 nt, Homo sapiens
guugcaaaguuccaguuua

SEQ ID NO: 919708 - RNA, 19 nt, Homo sapiens
caaaugguucugacaauga

SEQ ID NO: 919709 - RNA, 19 nt, Homo sapiens
guagaaggcuguuguucag

SEQ ID NO: 919710 - RNA, 19 nt, Homo sapiens
uaucuaggccacacuauaa

SEQ ID NO: 919711 - RNA, 19 nt, Homo sapiens
aaugacaugugguuaauga

SEQ ID NO: 919712 - RNA, 19 nt, Homo sapiens
gcauggagcucaguaagag

SEQ ID NO: 919713 - RNA, 19 nt, Homo sapiens
guaacuacauauccaauac

SEQ ID NO: 919714 - RNA, 19 nt, Homo sapiens
ugucuuaaguguagaauca

SEQ ID NO: 919715 - RNA, 19 nt, Homo sapiens
gcaguuugccugaaauaug

SEQ ID NO: 919716 - RNA, 19 nt, Homo sapiens
uaacagccuucucaauauc

SEQ ID NO: 919717 - RNA, 19 nt, Homo sapiens
cuggagaccuugaauaugu

SEQ ID NO: 919718 - RNA, 19 nt, Homo sapiens
aagcagaguucuucaguuc

SEQ ID NO: 919719 - RNA, 19 nt, Homo sapiens
ccaaaugguucugacaaug

SEQ ID NO: 919720 - RNA, 19 nt, Homo sapiens
guaagagcuuucgaguaua

SEQ ID NO: 919721 - RNA, 19 nt, Homo sapiens
gaggaauugucuuaagugu

SEQ ID NO: 919722 - RNA, 19 nt, Homo sapiens
caucacagccuuucuaucu

SEQ ID NO: 919723 - RNA, 19 nt, Homo sapiens
gaaggaggaauugucuuaa

SEQ ID NO: 919724 - RNA, 19 nt, Homo sapiens
gcaaaguuccaguuuauac

SEQ ID NO: 919725 - RNA, 19 nt, Homo sapiens
acaaaugacaugugguuaa

SEQ ID NO: 919726 - RNA, 19 nt, Homo sapiens
uaagagcuuucgaguauac

SEQ ID NO: 919727 - RNA, 19 nt, Homo sapiens
ucuguugggcuuucuauua

SEQ ID NO: 919728 - RNA, 19 nt, Homo sapiens
cagaagaugcugauggaaa

SEQ ID NO: 919729 - RNA, 19 nt, Homo sapiens
caaacacugugacaaagca

SEQ ID NO: 919730 - RNA, 19 nt, Homo sapiens
uugcaaaguuccaguuuau

SEQ ID NO: 919731 - RNA, 19 nt, Homo sapiens
cuguugggcuuucuauuaa

SEQ ID NO: 919732 - RNA, 19 nt, Homo sapiens
ucacagccuuucuaucuag

SEQ ID NO: 919733 - RNA, 19 nt, Homo sapiens
ugacaaagcagaguucuuc

SEQ ID NO: 919734 - RNA, 19 nt, Homo sapiens
gcgugaauaugaucuuugu

SEQ ID NO: 919735 - RNA, 19 nt, Homo sapiens
ccaaaucagaugcauguga

SEQ ID NO: 919736 - RNA, 19 nt, Homo sapiens
guucagauauggcuguuac

SEQ ID NO: 919737 - RNA, 19 nt, Homo sapiens
ggagggaugauuuggaaga

SEQ ID NO: 919738 - RNA, 19 nt, Homo sapiens
cacauuaaagucaguagua

SEQ ID NO: 919739 - RNA, 19 nt, Homo sapiens
uaaauguguuggaaagaag

SEQ ID NO: 919740 - RNA, 19 nt, Homo sapiens
aagaggcaaugacuuauca

SEQ ID NO: 919741 - RNA, 19 nt, Homo sapiens
uagaaaagcgugaauauga

SEQ ID NO: 919742 - RNA, 19 nt, Homo sapiens
cagauauggcuguuacuuu

SEQ ID NO: 919743 - RNA, 19 nt, Homo sapiens
caaaacaaacuucuccaua

SEQ ID NO: 919744 - RNA, 19 nt, Homo sapiens
gacguguguugucauuauu

SEQ ID NO: 919745 - RNA, 19 nt, Homo sapiens
uagaggaguuguugcaaag

SEQ ID NO: 919746 - RNA, 19 nt, Homo sapiens
uacaagcuccuaacaaaga

SEQ ID NO: 919747 - RNA, 19 nt, Homo sapiens
agaugcaugugaugaugua

SEQ ID NO: 919748 - RNA, 19 nt, Homo sapiens
gcuggaguauuugcagaaa

SEQ ID NO: 919749 - RNA, 19 nt, Homo sapiens
cauuggaagcuaaagauuu

SEQ ID NO: 919750 - RNA, 19 nt, Homo sapiens
ccacuacguuugcuaucau

SEQ ID NO: 919751 - RNA, 19 nt, Homo sapiens
ggaggaauugucuuaagug

SEQ ID NO: 919752 - RNA, 19 nt, Homo sapiens
uauaaaaucuggagaccuu

SEQ ID NO: 919753 - RNA, 19 nt, Homo sapiens
aauacgccuuugauaagua

SEQ ID NO: 919754 - RNA, 19 nt, Homo sapiens
auagaggaguuguugcaaa

SEQ ID NO: 919755 - RNA, 19 nt, Homo sapiens
aaagcagaguucuucaguu

SEQ ID NO: 919756 - RNA, 19 nt, Homo sapiens
caaagcagaguucuucagu

SEQ ID NO: 919757 - RNA, 19 nt, Homo sapiens
uaaccacacauuaaaguca

SEQ ID NO: 919758 - RNA, 19 nt, Homo sapiens
uaggacguguguugucauu

SEQ ID NO: 919759 - RNA, 19 nt, Homo sapiens
ugacaaugacugagaagug

SEQ ID NO: 919760 - RNA, 19 nt, Homo sapiens
gggcauauuuucaaugaug

SEQ ID NO: 919761 - RNA, 19 nt, Homo sapiens
ucagaugcaugugaugaug

SEQ ID NO: 919762 - RNA, 19 nt, Homo sapiens
agauauggcuguuacuuuu

SEQ ID NO: 919763 - RNA, 19 nt, Homo sapiens
agacuuaacagccuucuca

SEQ ID NO: 919764 - RNA, 19 nt, Homo sapiens
aaaacaaacuucuccauag

SEQ ID NO: 919765 - RNA, 19 nt, Homo sapiens
uaggauuggucauggaaau

SEQ ID NO: 919766 - RNA, 19 nt, Homo sapiens
uauaggacguguguuguca

SEQ ID NO: 919767 - RNA, 19 nt, Homo sapiens
gauuggucauggaaauaga

SEQ ID NO: 919768 - RNA, 19 nt, Homo sapiens
gcuaggacacauuaggauu

SEQ ID NO: 919769 - RNA, 19 nt, Homo sapiens
ugacugagaagugguagaa

SEQ ID NO: 919770 - RNA, 19 nt, Homo sapiens
agaaggcuguuguucagau

SEQ ID NO: 919771 - RNA, 19 nt, Homo sapiens
ugacaugugguuaaugaug

SEQ ID NO: 919772 - RNA, 19 nt, Homo sapiens
gagggaugauuuggaagau

SEQ ID NO: 919773 - RNA, 19 nt, Homo sapiens
agggagggaugauuuggaa

SEQ ID NO: 919774 - RNA, 19 nt, Homo sapiens
gcuccuaacaaagaagaua

SEQ ID NO: 919775 - RNA, 19 nt, Homo sapiens
acaagcuccuaacaaagaa

SEQ ID NO: 919776 - RNA, 19 nt, Homo sapiens
gguaguagaaggcuguugu

SEQ ID NO: 919777 - RNA, 19 nt, Homo sapiens
agaagaugcugauggaaaa

SEQ ID NO: 919778 - RNA, 19 nt, Homo sapiens
ugcagaagaugcugaugga

SEQ ID NO: 919779 - RNA, 19 nt, Homo sapiens
gcgccaacgugagaggaaa

SEQ ID NO: 919780 - RNA, 19 nt, Homo sapiens
ggaccaaacacugugacaa

SEQ ID NO: 919781 - RNA, 19 nt, Homo sapiens
aaauacgccuuugauaagu

SEQ ID NO: 919782 - RNA, 19 nt, Homo sapiens
agacgcggaugaagugcaa

SEQ ID NO: 919783 - RNA, 19 nt, Homo sapiens
caaugacugagaaguggua

SEQ ID NO: 919784 - RNA, 19 nt, Homo sapiens
caguuugccugaaauaugc

SEQ ID NO: 919785 - RNA, 19 nt, Homo sapiens
gcaauaaacuuucuacaga

SEQ ID NO: 919786 - RNA, 19 nt, Homo sapiens
aagaagagcugccaauuua

SEQ ID NO: 919787 - RNA, 19 nt, Homo sapiens
gcaagaggcucaagaagaa

SEQ ID NO: 919788 - RNA, 19 nt, Homo sapiens
gcaaagaaguauucagaaa

SEQ ID NO: 919789 - RNA, 19 nt, Homo sapiens
ggacagaauuauaguguuu

SEQ ID NO: 919790 - RNA, 19 nt, Homo sapiens
gcaaaguacuuccaauuau

SEQ ID NO: 919791 - RNA, 19 nt, Homo sapiens
ccaaagaccuuccuucgaa

SEQ ID NO: 919792 - RNA, 19 nt, Homo sapiens
gaaauugugucuacaguuc

SEQ ID NO: 919793 - RNA, 19 nt, Homo sapiens
ugaaagagcucaaggugaa

SEQ ID NO: 919794 - RNA, 19 nt, Homo sapiens
caaauaaucucuuggaucu

SEQ ID NO: 919795 - RNA, 19 nt, Homo sapiens
gaaagugauucagaagaua

SEQ ID NO: 919796 - RNA, 19 nt, Homo sapiens
gaaagcccauuuagagaaa

SEQ ID NO: 919797 - RNA, 19 nt, Homo sapiens
gauaauagaugccacucaa

SEQ ID NO: 919798 - RNA, 19 nt, Homo sapiens
caaagaggacacugaauua

SEQ ID NO: 919799 - RNA, 19 nt, Homo sapiens
gaaaagagaugucccaguu

SEQ ID NO: 919800 - RNA, 19 nt, Homo sapiens
gaauaaagguggacagucu

SEQ ID NO: 919801 - RNA, 19 nt, Homo sapiens
gaagaagaguauaagaaga

SEQ ID NO: 919802 - RNA, 19 nt, Homo sapiens
gaacaccuuuguccuagaa

SEQ ID NO: 919803 - RNA, 19 nt, Homo sapiens
gagagguacucgaucauaa

SEQ ID NO: 919804 - RNA, 19 nt, Homo sapiens
aaccaaagauucagacaua

SEQ ID NO: 919805 - RNA, 19 nt, Homo sapiens
gguagugaauuaagaauga

SEQ ID NO: 919806 - RNA, 19 nt, Homo sapiens
gaaagaagaggcaaguauu

SEQ ID NO: 919807 - RNA, 19 nt, Homo sapiens
gaggauggguggucaggua

SEQ ID NO: 919808 - RNA, 19 nt, Homo sapiens
gaaggaaugugccaagcaa

SEQ ID NO: 919809 - RNA, 19 nt, Homo sapiens
ggaagacagugauggugua

SEQ ID NO: 919810 - RNA, 19 nt, Homo sapiens
gaccagaaaucucuuuaga

SEQ ID NO: 919811 - RNA, 19 nt, Homo sapiens
cagaagggaagauuuauua

SEQ ID NO: 919812 - RNA, 19 nt, Homo sapiens
gaagacagcucgagaucca

SEQ ID NO: 919813 - RNA, 19 nt, Homo sapiens
ggaauuagacucuuuaucu

SEQ ID NO: 919814 - RNA, 19 nt, Homo sapiens
ggacacaaguaucagcaaa

SEQ ID NO: 919815 - RNA, 19 nt, Homo sapiens
gaagaugucccaaauaagu

SEQ ID NO: 919816 - RNA, 19 nt, Homo sapiens
guagugaccuuccugauuc

SEQ ID NO: 919817 - RNA, 19 nt, Homo sapiens
cuagaugaauugccuauuu

SEQ ID NO: 919818 - RNA, 19 nt, Homo sapiens
gaacugggguuguguauga

SEQ ID NO: 919819 - RNA, 19 nt, Homo sapiens
cagaagagcucagaaacuu

SEQ ID NO: 919820 - RNA, 19 nt, Homo sapiens
ucagaacgaucucauuauu

SEQ ID NO: 919821 - RNA, 19 nt, Homo sapiens
ggucagaacgaucucauua

SEQ ID NO: 919822 - RNA, 19 nt, Homo sapiens
gagcugaaguacuguaaga

SEQ ID NO: 919823 - RNA, 19 nt, Homo sapiens
gcucagaguuaacguuuga

SEQ ID NO: 919824 - RNA, 19 nt, Homo sapiens
gaagagcugccaauuuauu

SEQ ID NO: 919825 - RNA, 19 nt, Homo sapiens
ggacaucauccuauucuaa

SEQ ID NO: 919826 - RNA, 19 nt, Homo sapiens
ccagagugaugguguagua

SEQ ID NO: 919827 - RNA, 19 nt, Homo sapiens
ggagauggguauucuagug

SEQ ID NO: 919828 - RNA, 19 nt, Homo sapiens
gcuagaagcucugauggaa

SEQ ID NO: 919829 - RNA, 19 nt, Homo sapiens
ccaguuauaugugauagua

SEQ ID NO: 919830 - RNA, 19 nt, Homo sapiens
cgacgagggucaucauauu

SEQ ID NO: 919831 - RNA, 19 nt, Homo sapiens
ccagugaacuagcaaagaa

SEQ ID NO: 919832 - RNA, 19 nt, Homo sapiens
caacagaccacuuuccaaa

SEQ ID NO: 919833 - RNA, 19 nt, Homo sapiens
guagaaauuugacagauca

SEQ ID NO: 919834 - RNA, 19 nt, Homo sapiens
gaucgucgcuaccauagga

SEQ ID NO: 919835 - RNA, 19 nt, Homo sapiens
agaccugacuccacucuua

SEQ ID NO: 919836 - RNA, 19 nt, Homo sapiens
gcacagaagcugacacaga

SEQ ID NO: 919837 - RNA, 19 nt, Homo sapiens
gagaacaggcguaauaaug

SEQ ID NO: 919838 - RNA, 19 nt, Homo sapiens
cagcuucuguuaaucauuu

SEQ ID NO: 919839 - RNA, 19 nt, Homo sapiens
uaccacaacugaagacuuu

SEQ ID NO: 919840 - RNA, 19 nt, Homo sapiens
gugagggucucucugauaa

SEQ ID NO: 919841 - RNA, 19 nt, Homo sapiens
uugaagaugucccaaauaa

SEQ ID NO: 919842 - RNA, 19 nt, Homo sapiens
caagaagagcugccaauuu

SEQ ID NO: 919843 - RNA, 19 nt, Homo sapiens
gaaaguauagcaaguaaag

SEQ ID NO: 919844 - RNA, 19 nt, Homo sapiens
ugguguaacuuaugcauua

SEQ ID NO: 919845 - RNA, 19 nt, Homo sapiens
ggaaagaagaggcaaguau

SEQ ID NO: 919846 - RNA, 19 nt, Homo sapiens
gcaaugagaaugugaaaca

SEQ ID NO: 919847 - RNA, 19 nt, Homo sapiens
caucaccacugcccuauga

SEQ ID NO: 919848 - RNA, 19 nt, Homo sapiens
gcauuaaagugugacagua

SEQ ID NO: 919849 - RNA, 19 nt, Homo sapiens
gacauauacuguacuuuga

SEQ ID NO: 919850 - RNA, 19 nt, Homo sapiens
agaaguacaugcagaaguu

SEQ ID NO: 919851 - RNA, 19 nt, Homo sapiens
uaaaggagguauaucgaau

SEQ ID NO: 919852 - RNA, 19 nt, Homo sapiens
gaagucauacucacagaaa

SEQ ID NO: 919853 - RNA, 19 nt, Homo sapiens
gaaauaagcagcaauucca

SEQ ID NO: 919854 - RNA, 19 nt, Homo sapiens
gcaagcaccugaaauaagc

SEQ ID NO: 919855 - RNA, 19 nt, Homo sapiens
gaaaucaaacagucucauu

SEQ ID NO: 919856 - RNA, 19 nt, Homo sapiens
ccaaagaggacacugaauu

SEQ ID NO: 919857 - RNA, 19 nt, Homo sapiens
gaaauagagcccaaagaga

SEQ ID NO: 919858 - RNA, 19 nt, Homo sapiens
gaaaccgucuccagucugu

SEQ ID NO: 919859 - RNA, 19 nt, Homo sapiens
cauauugccugaaagaaga

SEQ ID NO: 919860 - RNA, 19 nt, Homo sapiens
ugaauaaggagcugaagua

SEQ ID NO: 919861 - RNA, 19 nt, Homo sapiens
acagacaacuccaccaauu

SEQ ID NO: 919862 - RNA, 19 nt, Homo sapiens
ggaaguuguuugagcaaga

SEQ ID NO: 919863 - RNA, 19 nt, Homo sapiens
gaauugggaucaacaggau

SEQ ID NO: 919864 - RNA, 19 nt, Homo sapiens
guauguaucuucccgaugu

SEQ ID NO: 919865 - RNA, 19 nt, Homo sapiens
gaugauagcaguauuccaa

SEQ ID NO: 919866 - RNA, 19 nt, Homo sapiens
ggaaagaaacaauaguaga

SEQ ID NO: 919867 - RNA, 19 nt, Homo sapiens
gaagaauuaccacaacuga

SEQ ID NO: 919868 - RNA, 19 nt, Homo sapiens
ccagaugacagauaugaua

SEQ ID NO: 919869 - RNA, 19 nt, Homo sapiens
uaagaaggauucaguggau

SEQ ID NO: 919870 - RNA, 19 nt, Homo sapiens
gaaaaugccauguuacuuu

SEQ ID NO: 919871 - RNA, 19 nt, Homo sapiens
gagaagaauccggaaauuu

SEQ ID NO: 919872 - RNA, 19 nt, Homo sapiens
agaagggaauuccauauug

SEQ ID NO: 919873 - RNA, 19 nt, Homo sapiens
acccaagucugauaaauuu

SEQ ID NO: 919874 - RNA, 19 nt, Homo sapiens
aggaguacauuaagaagua

SEQ ID NO: 919875 - RNA, 19 nt, Homo sapiens
cacaacagcugccugaaug

SEQ ID NO: 919876 - RNA, 19 nt, Homo sapiens
ccugaagaaugaugagaua

SEQ ID NO: 919877 - RNA, 19 nt, Homo sapiens
gaggacaugugcauacuuc

SEQ ID NO: 919878 - RNA, 19 nt, Homo sapiens
ccaaagauucagacauaua

SEQ ID NO: 919879 - RNA, 19 nt, Homo sapiens
caagauaaacucaugucua

SEQ ID NO: 919880 - RNA, 19 nt, Homo sapiens
ccacagcgauggaaggaau

SEQ ID NO: 919881 - RNA, 19 nt, Homo sapiens
ucaaacagucucauucuuu

SEQ ID NO: 919882 - RNA, 19 nt, Homo sapiens
gcagacaccuccagugaac

SEQ ID NO: 919883 - RNA, 19 nt, Homo sapiens
aaacuuagguugggacuuc

SEQ ID NO: 919884 - RNA, 19 nt, Homo sapiens
caaggagacauuuguauga

SEQ ID NO: 919885 - RNA, 19 nt, Homo sapiens
gaaaagcagucaucaauua

SEQ ID NO: 919886 - RNA, 19 nt, Homo sapiens
gaaaugugguggcuuguga

SEQ ID NO: 919887 - RNA, 19 nt, Homo sapiens
uggcacagguugcgaguua

SEQ ID NO: 919888 - RNA, 19 nt, Homo sapiens
gacagaagguggugugguu

SEQ ID NO: 919889 - RNA, 19 nt, Homo sapiens
gcuugucccugacuuuaua

SEQ ID NO: 919890 - RNA, 19 nt, Homo sapiens
gagagcaucuggaagaaca

SEQ ID NO: 919891 - RNA, 19 nt, Homo sapiens
gcacagguugcgaguuaua

SEQ ID NO: 919892 - RNA, 19 nt, Homo sapiens
aaagagagcaucuggaaga

SEQ ID NO: 919893 - RNA, 19 nt, Homo sapiens
ggacucagcaucauguaga

SEQ ID NO: 919894 - RNA, 19 nt, Homo sapiens
gcaagucagaaguuguuua

SEQ ID NO: 919895 - RNA, 19 nt, Homo sapiens
gaaucaacuucauggucua

SEQ ID NO: 919896 - RNA, 19 nt, Homo sapiens
caauaauguugcaguggaa

SEQ ID NO: 919897 - RNA, 19 nt, Homo sapiens
caagucagaaguuguuuau

SEQ ID NO: 919898 - RNA, 19 nt, Homo sapiens
gaacagccagcuuggaagu

SEQ ID NO: 919899 - RNA, 19 nt, Homo sapiens
gaaguggacccuguggaaa

SEQ ID NO: 919900 - RNA, 19 nt, Homo sapiens
gaugaaacgacuacaaagu

SEQ ID NO: 919901 - RNA, 19 nt, Homo sapiens
acagccagcuuggaaguuu

SEQ ID NO: 919902 - RNA, 19 nt, Homo sapiens
gggcaagucagaaguuguu

SEQ ID NO: 919903 - RNA, 19 nt, Homo sapiens
cucagagaaucuaugaaua

SEQ ID NO: 919904 - RNA, 19 nt, Homo sapiens
gcaucagaauggcaagguu

SEQ ID NO: 919905 - RNA, 19 nt, Homo sapiens
ccucagagaaucuaugaau

SEQ ID NO: 919906 - RNA, 19 nt, Homo sapiens
caaaagagagcaucuggaa

SEQ ID NO: 919907 - RNA, 19 nt, Homo sapiens
gaagaacagccagcuugga

SEQ ID NO: 919908 - RNA, 19 nt, Homo sapiens
gaaccucagagaaucuaug

SEQ ID NO: 919909 - RNA, 19 nt, Homo sapiens
caaagugccaugacagaag

SEQ ID NO: 919910 - RNA, 19 nt, Homo sapiens
ugaaguggacccuguggaa

SEQ ID NO: 919911 - RNA, 19 nt, Homo sapiens
auaaaucugucagccacua

SEQ ID NO: 919912 - RNA, 19 nt, Homo sapiens
ucagaagcaucuaagaaaa

SEQ ID NO: 919913 - RNA, 19 nt, Homo sapiens
auguugcaguggaauauua

SEQ ID NO: 919914 - RNA, 19 nt, Homo sapiens
ucgaugaaacgacuacaaa

SEQ ID NO: 919915 - RNA, 19 nt, Homo sapiens
gaauggcaagguugugguu

SEQ ID NO: 919916 - RNA, 19 nt, Homo sapiens
aagaacagccagcuuggaa

SEQ ID NO: 919917 - RNA, 19 nt, Homo sapiens
gacucagcaucauguagaa

SEQ ID NO: 919918 - RNA, 19 nt, Homo sapiens
gcacuuguggagcaucaga

SEQ ID NO: 919919 - RNA, 19 nt, Homo sapiens
uaaggacucagcaucaugu

SEQ ID NO: 919920 - RNA, 19 nt, Homo sapiens
uauaaggacucagcaucau

SEQ ID NO: 919921 - RNA, 19 nt, Homo sapiens
ugugguggcuugugagagu

SEQ ID NO: 919922 - RNA, 19 nt, Homo sapiens
ucaaagggcaagucagaag

SEQ ID NO: 919923 - RNA, 19 nt, Homo sapiens
aagagagcaucuggaagaa

SEQ ID NO: 919924 - RNA, 19 nt, Homo sapiens
uucagaagcaucuaagaaa

SEQ ID NO: 919925 - RNA, 19 nt, Homo sapiens
cuacagccaucaaaagaga

SEQ ID NO: 919926 - RNA, 19 nt, Homo sapiens
caaagggcaagucagaagu

SEQ ID NO: 919927 - RNA, 19 nt, Homo sapiens
aaagggcaagucagaaguu

SEQ ID NO: 919928 - RNA, 19 nt, Homo sapiens
uuucaaagggcaagucaga

SEQ ID NO: 919929 - RNA, 19 nt, Homo sapiens
cuacgggaaccucagagaa

SEQ ID NO: 919930 - RNA, 19 nt, Homo sapiens
uaauguugcaguggaauau

SEQ ID NO: 919931 - RNA, 19 nt, Homo sapiens
gggaaccucagagaaucua

SEQ ID NO: 919932 - RNA, 19 nt, Homo sapiens
gcuggcacagagaugcuua

SEQ ID NO: 919933 - RNA, 19 nt, Homo sapiens
uuauaaggacucagcauca

SEQ ID NO: 919934 - RNA, 19 nt, Homo sapiens
uacaaagugccaugacaga

SEQ ID NO: 919935 - RNA, 19 nt, Homo sapiens
cgacuacaaagugccauga

SEQ ID NO: 919936 - RNA, 19 nt, Homo sapiens
aggcuugucccugacuuua

SEQ ID NO: 919937 - RNA, 19 nt, Homo sapiens
acaaagugccaugacagaa

SEQ ID NO: 919938 - RNA, 19 nt, Homo sapiens
acuacaaagugccaugaca

SEQ ID NO: 919939 - RNA, 19 nt, Homo sapiens
gaauuaagaucauccaaga

SEQ ID NO: 919940 - RNA, 19 nt, Homo sapiens
gaugagagaucacauggaa

SEQ ID NO: 919941 - RNA, 19 nt, Homo sapiens
caccucagcuccuuauuua

SEQ ID NO: 919942 - RNA, 19 nt, Homo sapiens
gcacaggccuccaaauauc

SEQ ID NO: 919943 - RNA, 19 nt, Homo sapiens
ugaaauugcugucuucuug

SEQ ID NO: 919944 - RNA, 19 nt, Homo sapiens
ccaaauauccagaucuaaa

SEQ ID NO: 919945 - RNA, 19 nt, Homo sapiens
gcaaggaacacaacugguu

SEQ ID NO: 919946 - RNA, 19 nt, Homo sapiens
caagugcuauggacucuga

SEQ ID NO: 919947 - RNA, 19 nt, Homo sapiens
caagcacauuucaagauuu

SEQ ID NO: 919948 - RNA, 19 nt, Homo sapiens
acaagcacauuucaagauu

SEQ ID NO: 919949 - RNA, 19 nt, Homo sapiens
caucaucucugcuaaaauu

SEQ ID NO: 919950 - RNA, 19 nt, Homo sapiens
ggcaagacauccuacacaa

SEQ ID NO: 919951 - RNA, 19 nt, Homo sapiens
aagcacaggccuccaaaua

SEQ ID NO: 919952 - RNA, 19 nt, Homo sapiens
acacaacugguucaaauaa

SEQ ID NO: 919953 - RNA, 19 nt, Homo sapiens
gaaugaggccacaaucguu

SEQ ID NO: 919954 - RNA, 19 nt, Homo sapiens
gaaguggaagaaacugaaa

SEQ ID NO: 919955 - RNA, 19 nt, Homo sapiens
gagaagggccaccugaaca

SEQ ID NO: 919956 - RNA, 19 nt, Homo sapiens
cacaaucguuccagccaaa

SEQ ID NO: 919957 - RNA, 19 nt, Homo sapiens
ugagagaucacauggaaug

SEQ ID NO: 919958 - RNA, 19 nt, Homo sapiens
ggaaugaggccacaaucgu

SEQ ID NO: 919959 - RNA, 19 nt, Homo sapiens
cuccaaauauccagaucua

SEQ ID NO: 919960 - RNA, 19 nt, Homo sapiens
gcuagugguuggcccaugu

SEQ ID NO: 919961 - RNA, 19 nt, Homo sapiens
caacacagagggcaagaca

SEQ ID NO: 919962 - RNA, 19 nt, Homo sapiens
ucaccucagcuccuuauuu

SEQ ID NO: 919963 - RNA, 19 nt, Homo sapiens
gcccagaaguggaagaaac

SEQ ID NO: 919964 - RNA, 19 nt, Homo sapiens
caucccaagucuguccuua

SEQ ID NO: 919965 - RNA, 19 nt, Homo sapiens
ucuccaagccuuucaauca

SEQ ID NO: 919966 - RNA, 19 nt, Homo sapiens
ucccaagucuguccuuaug

SEQ ID NO: 919967 - RNA, 19 nt, Homo sapiens
gaauccucuuccugaaauu

SEQ ID NO: 919968 - RNA, 19 nt, Homo sapiens
gcucgcaucaucucugcua

SEQ ID NO: 919969 - RNA, 19 nt, Homo sapiens
gcuggaggaugagagauca

SEQ ID NO: 919970 - RNA, 19 nt, Homo sapiens
gcaucccgccugagaaguu

SEQ ID NO: 919971 - RNA, 19 nt, Homo sapiens
ccacaucuuccaccacgaa

SEQ ID NO: 919972 - RNA, 19 nt, Homo sapiens
cuagugacaugagcuggaa

SEQ ID NO: 919973 - RNA, 19 nt, Homo sapiens
ggaauuaggaaaguuagag

SEQ ID NO: 919974 - RNA, 19 nt, Homo sapiens
gagaaguucagaugagaag

SEQ ID NO: 919975 - RNA, 19 nt, Homo sapiens
gaggaugagagaucacaug

SEQ ID NO: 919976 - RNA, 19 nt, Homo sapiens
aaauugcugucuucuugga

SEQ ID NO: 919977 - RNA, 19 nt, Homo sapiens
ccucagcuccuuauuuauc

SEQ ID NO: 919978 - RNA, 19 nt, Homo sapiens
gcaagacauccuacacaag

SEQ ID NO: 919979 - RNA, 19 nt, Homo sapiens
gggcaagacauccuacaca

SEQ ID NO: 919980 - RNA, 19 nt, Homo sapiens
acacagagggcaagacauc

SEQ ID NO: 919981 - RNA, 19 nt, Homo sapiens
cuaaggauguacugcugau

SEQ ID NO: 919982 - RNA, 19 nt, Homo sapiens
ccgggaauuaggaaaguua

SEQ ID NO: 919983 - RNA, 19 nt, Homo sapiens
cacaagcacauuucaagau

SEQ ID NO: 919984 - RNA, 19 nt, Homo sapiens
acacaagcacauuucaaga

SEQ ID NO: 919985 - RNA, 19 nt, Homo sapiens
agccaaagccccaguaaua

SEQ ID NO: 919986 - RNA, 19 nt, Homo sapiens
cuagccugcuggaggauga

SEQ ID NO: 919987 - RNA, 19 nt, Homo sapiens
ccauggagcaucccaaguc

SEQ ID NO: 919988 - RNA, 19 nt, Homo sapiens
ugaaaguggaguccugaga

SEQ ID NO: 919989 - RNA, 19 nt, Homo sapiens
gaacccuuccaccaucaug

SEQ ID NO: 919990 - RNA, 19 nt, Homo sapiens
cacaacugguucaaauaag

SEQ ID NO: 919991 - RNA, 19 nt, Homo sapiens
cagagcaaacccagaagga

SEQ ID NO: 919992 - RNA, 19 nt, Homo sapiens
aaggauguacugcugauga

SEQ ID NO: 919993 - RNA, 19 nt, Homo sapiens
cagaaguggaagaaacuga

SEQ ID NO: 919994 - RNA, 19 nt, Homo sapiens
caacugguucaaauaagca

SEQ ID NO: 919995 - RNA, 19 nt, Homo sapiens
agaaguggaagaaacugaa

SEQ ID NO: 919996 - RNA, 19 nt, Homo sapiens
aaccagagcaaacccagaa

SEQ ID NO: 919997 - RNA, 19 nt, Homo sapiens
agaagggccaccugaacaa

SEQ ID NO: 919998 - RNA, 19 nt, Homo sapiens
gagagaucacauggaauga

SEQ ID NO: 919999 - RNA, 19 nt, Homo sapiens
cauggagcaucccaagucu

SEQ ID NO: 920000 - RNA, 19 nt, Homo sapiens
cuacacaagcacauuucaa

SEQ ID NO: 920001 - RNA, 19 nt, Homo sapiens
cauggcaucccgccugaga

SEQ ID NO: 920002 - RNA, 19 nt, Homo sapiens
acaacugguucaaauaagc

SEQ ID NO: 920003 - RNA, 19 nt, Homo sapiens
ugaagaguggcuagugguu

SEQ ID NO: 920004 - RNA, 19 nt, Homo sapiens
ugugaggccuacuaaggau

SEQ ID NO: 920005 - RNA, 19 nt, Homo sapiens
gugaagaagccuggucuag

SEQ ID NO: 920006 - RNA, 19 nt, Homo sapiens
cagaaggacaacucuccaa

SEQ ID NO: 920007 - RNA, 19 nt, Homo sapiens
gcucagcugguccauccuu

SEQ ID NO: 920008 - RNA, 19 nt, Homo sapiens
ccaaagcaaggaacacaac

SEQ ID NO: 920009 - RNA, 19 nt, Homo sapiens
gaaguuccauugaaauuga

SEQ ID NO: 920010 - RNA, 19 nt, Homo sapiens
gaaauugagugucuuuaca

SEQ ID NO: 920011 - RNA, 19 nt, Homo sapiens
gaaacucccuuccuuuguc

SEQ ID NO: 920012 - RNA, 19 nt, Homo sapiens
aagaaugggugaaauguug

SEQ ID NO: 920013 - RNA, 19 nt, Homo sapiens
gcauccauccguuuaauaa

SEQ ID NO: 920014 - RNA, 19 nt, Homo sapiens
ggaggcauccauccguuua

SEQ ID NO: 920015 - RNA, 19 nt, Homo sapiens
gaaggaagaaugggugaaa

SEQ ID NO: 920016 - RNA, 19 nt, Homo sapiens
gaagaaugggugaaauguu

SEQ ID NO: 920017 - RNA, 19 nt, Homo sapiens
ggucuaggcuuggucucua

SEQ ID NO: 920018 - RNA, 19 nt, Homo sapiens
ugucguacguacaaaguaa

SEQ ID NO: 920019 - RNA, 19 nt, Homo sapiens
acuagaacauuuccaaguu

SEQ ID NO: 920020 - RNA, 19 nt, Homo sapiens
ccacuucccauuucucaaa

SEQ ID NO: 920021 - RNA, 19 nt, Homo sapiens
ggaagaaugggugaaaugu

SEQ ID NO: 920022 - RNA, 19 nt, Homo sapiens
aaccuaaguuggacuagaa

SEQ ID NO: 920023 - RNA, 19 nt, Homo sapiens
uuuccuaccuguaaccuaa

SEQ ID NO: 920024 - RNA, 19 nt, Homo sapiens
uaugcuacuuucaccauuu

SEQ ID NO: 920025 - RNA, 19 nt, Homo sapiens
uaaccuaaguuggacuaga

SEQ ID NO: 920026 - RNA, 19 nt, Homo sapiens
ccauugaaauugagugucu

SEQ ID NO: 920027 - RNA, 19 nt, Homo sapiens
cccuguaaauucuaucuuu

SEQ ID NO: 920028 - RNA, 19 nt, Homo sapiens
caacagacaguuugaacag

SEQ ID NO: 920029 - RNA, 19 nt, Homo sapiens
ccuguaaauucuaucuuug

SEQ ID NO: 920030 - RNA, 19 nt, Homo sapiens
uaaguuggacuagaacauu

SEQ ID NO: 920031 - RNA, 19 nt, Homo sapiens
aaucuucuauucccacuuc

SEQ ID NO: 920032 - RNA, 19 nt, Homo sapiens
aaguuggacuagaacauuu

SEQ ID NO: 920033 - RNA, 19 nt, Homo sapiens
ccgcaccacuccagcauca

SEQ ID NO: 920034 - RNA, 19 nt, Homo sapiens
ggacagaugaaggaagaau

SEQ ID NO: 920035 - RNA, 19 nt, Homo sapiens
ugggugaaauguuggaaau

SEQ ID NO: 920036 - RNA, 19 nt, Homo sapiens
aaacucccuuccuuuguca

SEQ ID NO: 920037 - RNA, 19 nt, Homo sapiens
gagugucuuuacagccuuu

SEQ ID NO: 920038 - RNA, 19 nt, Homo sapiens
cauuugaccugucguacgu

SEQ ID NO: 920039 - RNA, 19 nt, Homo sapiens
ggcauccauccguuuaaua

SEQ ID NO: 920040 - RNA, 19 nt, Homo sapiens
uacaagggcuuagcagucu

SEQ ID NO: 920041 - RNA, 19 nt, Homo sapiens
ggggacagaugaaggaaga

SEQ ID NO: 920042 - RNA, 19 nt, Homo sapiens
gacuagaacauuuccaagu

SEQ ID NO: 920043 - RNA, 19 nt, Homo sapiens
gaggcauccauccguuuaa

SEQ ID NO: 920044 - RNA, 19 nt, Homo sapiens
ucccagcccuguaaauucu

SEQ ID NO: 920045 - RNA, 19 nt, Homo sapiens
gggaggcauccauccguuu

SEQ ID NO: 920046 - RNA, 19 nt, Homo sapiens
ccacaacagacaguuugaa

SEQ ID NO: 920047 - RNA, 19 nt, Homo sapiens
ugaaauugagugucuuuac

SEQ ID NO: 920048 - RNA, 19 nt, Homo sapiens
aaauaagggaagagaguug

SEQ ID NO: 920049 - RNA, 19 nt, Homo sapiens
caucuuccucucuggguuu

SEQ ID NO: 920050 - RNA, 19 nt, Homo sapiens
ccagcccuguaaauucuau

SEQ ID NO: 920051 - RNA, 19 nt, Homo sapiens
ccucccagcccuguaaauu

SEQ ID NO: 920052 - RNA, 19 nt, Homo sapiens
ugaccugucguacguacaa

SEQ ID NO: 920053 - RNA, 19 nt, Homo sapiens
gacagaugaaggaagaaug

SEQ ID NO: 920054 - RNA, 19 nt, Homo sapiens
guuccucccagcccuguaa

SEQ ID NO: 920055 - RNA, 19 nt, Homo sapiens
gaccugucguacguacaaa

SEQ ID NO: 920056 - RNA, 19 nt, Homo sapiens
ccaucuccaucuuccacaa

SEQ ID NO: 920057 - RNA, 19 nt, Homo sapiens
agaaguuccauugaaauug

SEQ ID NO: 920058 - RNA, 19 nt, Homo sapiens
uugugaagcugagugagaa

SEQ ID NO: 920059 - RNA, 19 nt, Homo sapiens
guuggaaauuugugaagcu

SEQ ID NO: 920060 - RNA, 19 nt, Homo sapiens
aaggaagaaugggugaaau

SEQ ID NO: 920061 - RNA, 19 nt, Homo sapiens
caagagccaggagaggauu

SEQ ID NO: 920062 - RNA, 19 nt, Homo sapiens
gaaugggugaaauguugga

SEQ ID NO: 920063 - RNA, 19 nt, Homo sapiens
gaugugaauucucuucuua

SEQ ID NO: 920064 - RNA, 19 nt, Homo sapiens
ucacagaaauuuccuaugu

SEQ ID NO: 920065 - RNA, 19 nt, Homo sapiens
gaauucagauugccgaaag

SEQ ID NO: 920066 - RNA, 19 nt, Homo sapiens
aaggagagauugcucguaa

SEQ ID NO: 920067 - RNA, 19 nt, Homo sapiens
gguaaaagcugcugaaaca

SEQ ID NO: 920068 - RNA, 19 nt, Homo sapiens
caagaaagcaauacgauca

SEQ ID NO: 920069 - RNA, 19 nt, Homo sapiens
gaacagaaagaugugaauu

SEQ ID NO: 920070 - RNA, 19 nt, Homo sapiens
gaugggagcacuagugauu

SEQ ID NO: 920071 - RNA, 19 nt, Homo sapiens
ugacacuucucaauaauca

SEQ ID NO: 920072 - RNA, 19 nt, Homo sapiens
uaucaggaauuucaaccua

SEQ ID NO: 920073 - RNA, 19 nt, Homo sapiens
gcaauacgaucaaaaugaa

SEQ ID NO: 920074 - RNA, 19 nt, Homo sapiens
gucaagagccgaaggaauu

SEQ ID NO: 920075 - RNA, 19 nt, Homo sapiens
ccucaucccuccugcugua

SEQ ID NO: 920076 - RNA, 19 nt, Homo sapiens
gaaccugagcgcauaaugu

SEQ ID NO: 920077 - RNA, 19 nt, Homo sapiens
agagauugcucguaaagau

SEQ ID NO: 920078 - RNA, 19 nt, Homo sapiens
gaaguuaaaggagagauug

SEQ ID NO: 920079 - RNA, 19 nt, Homo sapiens
gaacgggaaaucagcaaga

SEQ ID NO: 920080 - RNA, 19 nt, Homo sapiens
acagaaauuuccuaugugu

SEQ ID NO: 920081 - RNA, 19 nt, Homo sapiens
aagcugcugucguuucuaa

SEQ ID NO: 920082 - RNA, 19 nt, Homo sapiens
gagaugggagcacuaguga

SEQ ID NO: 920083 - RNA, 19 nt, Homo sapiens
ggagaugggagcacuagug

SEQ ID NO: 920084 - RNA, 19 nt, Homo sapiens
guauguugauuccaaagau

SEQ ID NO: 920085 - RNA, 19 nt, Homo sapiens
agaaagcaauacgaucaaa

SEQ ID NO: 920086 - RNA, 19 nt, Homo sapiens
ucaggaauuucaaccuaga

SEQ ID NO: 920087 - RNA, 19 nt, Homo sapiens
aaccuggacugcugagaaa

SEQ ID NO: 920088 - RNA, 19 nt, Homo sapiens
ggagagauugcucguaaag

SEQ ID NO: 920089 - RNA, 19 nt, Homo sapiens
gagcauucccaaaggcaaa

SEQ ID NO: 920090 - RNA, 19 nt, Homo sapiens
cgaaagaccaucauuuuga

SEQ ID NO: 920091 - RNA, 19 nt, Homo sapiens
gcagauuagucucuaucca

SEQ ID NO: 920092 - RNA, 19 nt, Homo sapiens
cgggaaaucagcaagauga

SEQ ID NO: 920093 - RNA, 19 nt, Homo sapiens
gacaagaaagcaauacgau

SEQ ID NO: 920094 - RNA, 19 nt, Homo sapiens
ggaauuucaaccuagagaa

SEQ ID NO: 920095 - RNA, 19 nt, Homo sapiens
ugaagacaagaaagcaaua

SEQ ID NO: 920096 - RNA, 19 nt, Homo sapiens
gaaauuuccuauguguacu

SEQ ID NO: 920097 - RNA, 19 nt, Homo sapiens
gccugaaccugagcgcaua

SEQ ID NO: 920098 - RNA, 19 nt, Homo sapiens
gagauugcucguaaagaug

SEQ ID NO: 920099 - RNA, 19 nt, Homo sapiens
caucccuccugcuguauau

SEQ ID NO: 920100 - RNA, 19 nt, Homo sapiens
gcaagaugaagcccucugu

SEQ ID NO: 920101 - RNA, 19 nt, Homo sapiens
ggaauucagauugccgaaa

SEQ ID NO: 920102 - RNA, 19 nt, Homo sapiens
aaaccuggacugcugagaa

SEQ ID NO: 920103 - RNA, 19 nt, Homo sapiens
gaauuucaaccuagagaac

SEQ ID NO: 920104 - RNA, 19 nt, Homo sapiens
uuaagagcauucccaaagg

SEQ ID NO: 920105 - RNA, 19 nt, Homo sapiens
gccgaaggaauucagauug

SEQ ID NO: 920106 - RNA, 19 nt, Homo sapiens
gagcagauuagucucuauc

SEQ ID NO: 920107 - RNA, 19 nt, Homo sapiens
agaaauuuccuauguguac

SEQ ID NO: 920108 - RNA, 19 nt, Homo sapiens
cgaaaucuucccuccugaa

SEQ ID NO: 920109 - RNA, 19 nt, Homo sapiens
gaagacaagaaagcaauac

SEQ ID NO: 920110 - RNA, 19 nt, Homo sapiens
ccgaaggaauucagauugc

SEQ ID NO: 920111 - RNA, 19 nt, Homo sapiens
ggaaaucagcaagaugaag

SEQ ID NO: 920112 - RNA, 19 nt, Homo sapiens
gaaagcaauacgaucaaaa

SEQ ID NO: 920113 - RNA, 19 nt, Homo sapiens
gccgaaagaccaucauuuu

SEQ ID NO: 920114 - RNA, 19 nt, Homo sapiens
uuccaaagauccugugucu

SEQ ID NO: 920115 - RNA, 19 nt, Homo sapiens
aaccugagcgcauaauguu

SEQ ID NO: 920116 - RNA, 19 nt, Homo sapiens
cagaaauuuccuaugugua

SEQ ID NO: 920117 - RNA, 19 nt, Homo sapiens
agaugugaauucucuucuu

SEQ ID NO: 920118 - RNA, 19 nt, Homo sapiens
gagagauugcucguaaaga

SEQ ID NO: 920119 - RNA, 19 nt, Homo sapiens
gagcggaacgggaaaucag

SEQ ID NO: 920120 - RNA, 19 nt, Homo sapiens
ggcaaaauuuccauuguag

SEQ ID NO: 920121 - RNA, 19 nt, Homo sapiens
gggaaaucagcaagaugaa

SEQ ID NO: 920122 - RNA, 19 nt, Homo sapiens
ugucuuccuugcagguaaa

SEQ ID NO: 920123 - RNA, 19 nt, Homo sapiens
augaaaagcugcugucguu

SEQ ID NO: 920124 - RNA, 19 nt, Homo sapiens
uauguugauuccaaagauc

SEQ ID NO: 920125 - RNA, 19 nt, Homo sapiens
agacaagaaagcaauacga

SEQ ID NO: 920126 - RNA, 19 nt, Homo sapiens
aggcaaaauuuccauugua

SEQ ID NO: 920127 - RNA, 19 nt, Homo sapiens
uagucucuauccagaaguu

SEQ ID NO: 920128 - RNA, 19 nt, Homo sapiens
agauugcucguaaagauga

SEQ ID NO: 920129 - RNA, 19 nt, Homo sapiens
aaaagcugcugaaacaugu

SEQ ID NO: 920130 - RNA, 19 nt, Homo sapiens
uaaaagcugcugaaacaug

SEQ ID NO: 920131 - RNA, 19 nt, Homo sapiens
gaggagaugggagcacuag

SEQ ID NO: 920132 - RNA, 19 nt, Homo sapiens
uagaacagaaagaugugaa

SEQ ID NO: 920133 - RNA, 19 nt, Homo sapiens
gugucuuccuugcagguaa

SEQ ID NO: 920134 - RNA, 19 nt, Homo sapiens
uguguauguugauuccaaa

SEQ ID NO: 920135 - RNA, 19 nt, Homo sapiens
aacagaaagaugugaauuc

SEQ ID NO: 920136 - RNA, 19 nt, Homo sapiens
auuaagagcauucccaaag

SEQ ID NO: 920137 - RNA, 19 nt, Homo sapiens
gaaauagaguugagggaaa

SEQ ID NO: 920138 - RNA, 19 nt, Homo sapiens
guacauagccauucuagaa

SEQ ID NO: 920139 - RNA, 19 nt, Homo sapiens
gaacaauccuuccacuaau

SEQ ID NO: 920140 - RNA, 19 nt, Homo sapiens
caaaugacaugucgaugaa

SEQ ID NO: 920141 - RNA, 19 nt, Homo sapiens
gaagagagacagugauauu

SEQ ID NO: 920142 - RNA, 19 nt, Homo sapiens
gcaggaagauugccagaug

SEQ ID NO: 920143 - RNA, 19 nt, Homo sapiens
aaaggaagcagaacaaaua

SEQ ID NO: 920144 - RNA, 19 nt, Homo sapiens
cuaaugaaauuggcacuua

SEQ ID NO: 920145 - RNA, 19 nt, Homo sapiens
uaucuccucugaagaaaua

SEQ ID NO: 920146 - RNA, 19 nt, Homo sapiens
gccacuagguagauauuua

SEQ ID NO: 920147 - RNA, 19 nt, Homo sapiens
gagaagagagacagugaua

SEQ ID NO: 920148 - RNA, 19 nt, Homo sapiens
gagggaaauuauccauaua

SEQ ID NO: 920149 - RNA, 19 nt, Homo sapiens
gcagggaaauguaaacuac

SEQ ID NO: 920150 - RNA, 19 nt, Homo sapiens
gcucuuggcuucuguugga

SEQ ID NO: 920151 - RNA, 19 nt, Homo sapiens
guugcuaugugcuuucuua

SEQ ID NO: 920152 - RNA, 19 nt, Homo sapiens
ugagggaaauuauccauau

SEQ ID NO: 920153 - RNA, 19 nt, Homo sapiens
cuagggaacuuauagaaau

SEQ ID NO: 920154 - RNA, 19 nt, Homo sapiens
gaagaugauguagagauua

SEQ ID NO: 920155 - RNA, 19 nt, Homo sapiens
cuaauaggcuucuuggaau

SEQ ID NO: 920156 - RNA, 19 nt, Homo sapiens
ugaagaugauguagagauu

SEQ ID NO: 920157 - RNA, 19 nt, Homo sapiens
ugaacaauccuuccacuaa

SEQ ID NO: 920158 - RNA, 19 nt, Homo sapiens
guagaauugugcagucauu

SEQ ID NO: 920159 - RNA, 19 nt, Homo sapiens
cauagccauucuagaaaua

SEQ ID NO: 920160 - RNA, 19 nt, Homo sapiens
aaugacaugucgaugaaua

SEQ ID NO: 920161 - RNA, 19 nt, Homo sapiens
gaaacucaagucaauagaa

SEQ ID NO: 920162 - RNA, 19 nt, Homo sapiens
gaauugugcagucauuaaa

SEQ ID NO: 920163 - RNA, 19 nt, Homo sapiens
guagugagucugauugaaa

SEQ ID NO: 920164 - RNA, 19 nt, Homo sapiens
gaaccuccugggcauaaua

SEQ ID NO: 920165 - RNA, 19 nt, Homo sapiens
gguaaacacuggcuuuggu

SEQ ID NO: 920166 - RNA, 19 nt, Homo sapiens
ucaaaugacaugucgauga

SEQ ID NO: 920167 - RNA, 19 nt, Homo sapiens
uaauaggcuucuuggaauu

SEQ ID NO: 920168 - RNA, 19 nt, Homo sapiens
gaaauuggcacuuaaucag

SEQ ID NO: 920169 - RNA, 19 nt, Homo sapiens
ggagaaacucaagucaaua

SEQ ID NO: 920170 - RNA, 19 nt, Homo sapiens
aaaugaagaugauguagag

SEQ ID NO: 920171 - RNA, 19 nt, Homo sapiens
gagaaacucaagucaauag

SEQ ID NO: 920172 - RNA, 19 nt, Homo sapiens
gaugagaaguggguuacug

SEQ ID NO: 920173 - RNA, 19 nt, Homo sapiens
gaacaaauacuggcaacag

SEQ ID NO: 920174 - RNA, 19 nt, Homo sapiens
guuacaggcuggagaggaa

SEQ ID NO: 920175 - RNA, 19 nt, Homo sapiens
gggaaauuauccauauaca

SEQ ID NO: 920176 - RNA, 19 nt, Homo sapiens
aggagaaacucaagucaau

SEQ ID NO: 920177 - RNA, 19 nt, Homo sapiens
ggaagcagaacaaauacug

SEQ ID NO: 920178 - RNA, 19 nt, Homo sapiens
caucaugaaaugcaaguuu

SEQ ID NO: 920179 - RNA, 19 nt, Homo sapiens
guaaacacuggcuuuggua

SEQ ID NO: 920180 - RNA, 19 nt, Homo sapiens
gacccuacccaacugauuu

SEQ ID NO: 920181 - RNA, 19 nt, Homo sapiens
ggaauuucaagaacuaaug

SEQ ID NO: 920182 - RNA, 19 nt, Homo sapiens
ugacugaauaggcaucaua

SEQ ID NO: 920183 - RNA, 19 nt, Homo sapiens
cauaggaucagugcaagua

SEQ ID NO: 920184 - RNA, 19 nt, Homo sapiens
gaaggagaaacucaaguca

SEQ ID NO: 920185 - RNA, 19 nt, Homo sapiens
gcuaaaggaagcagaacaa

SEQ ID NO: 920186 - RNA, 19 nt, Homo sapiens
gauauucagcagcuacaaa

SEQ ID NO: 920187 - RNA, 19 nt, Homo sapiens
gcaguaguagugagucuga

SEQ ID NO: 920188 - RNA, 19 nt, Homo sapiens
caacugauuuagagaugag

SEQ ID NO: 920189 - RNA, 19 nt, Homo sapiens
ggggaauagucaaaauuua

SEQ ID NO: 920190 - RNA, 19 nt, Homo sapiens
ggugcuaucuccucugaag

SEQ ID NO: 920191 - RNA, 19 nt, Homo sapiens
uaaaggaagcagaacaaau

SEQ ID NO: 920192 - RNA, 19 nt, Homo sapiens
aaauagaguugagggaaau

SEQ ID NO: 920193 - RNA, 19 nt, Homo sapiens
guaaacuacaggugacaaa

SEQ ID NO: 920194 - RNA, 19 nt, Homo sapiens
ugucugcgcuugaggacuu

SEQ ID NO: 920195 - RNA, 19 nt, Homo sapiens
guccuggaguuguuaauuc

SEQ ID NO: 920196 - RNA, 19 nt, Homo sapiens
uaaaggcucuuggcuucug

SEQ ID NO: 920197 - RNA, 19 nt, Homo sapiens
acuaauaggcuucuuggaa

SEQ ID NO: 920198 - RNA, 19 nt, Homo sapiens
gagagacagugauauucag

SEQ ID NO: 920199 - RNA, 19 nt, Homo sapiens
ucaacggacuccucaagca

SEQ ID NO: 920200 - RNA, 19 nt, Homo sapiens
cuacccaacugauuuagag

SEQ ID NO: 920201 - RNA, 19 nt, Homo sapiens
ugaaauuggcacuuaauca

SEQ ID NO: 920202 - RNA, 19 nt, Homo sapiens
acauagccauucuagaaau

SEQ ID NO: 920203 - RNA, 19 nt, Homo sapiens
uuaagccacuagguagaua

SEQ ID NO: 920204 - RNA, 19 nt, Homo sapiens
gcuaucuccucugaagaaa

SEQ ID NO: 920205 - RNA, 19 nt, Homo sapiens
caccaaaucauaguaguga

SEQ ID NO: 920206 - RNA, 19 nt, Homo sapiens
gaauauguuaccaccaaau

SEQ ID NO: 920207 - RNA, 19 nt, Homo sapiens
ugaauauguuaccaccaaa

SEQ ID NO: 920208 - RNA, 19 nt, Homo sapiens
uuauagaaaugcuggcaau

SEQ ID NO: 920209 - RNA, 19 nt, Homo sapiens
ccaacugauuuagagauga

SEQ ID NO: 920210 - RNA, 19 nt, Homo sapiens
uagggaacuuauagaaaug

SEQ ID NO: 920211 - RNA, 19 nt, Homo sapiens
agaauugugcagucauuaa

SEQ ID NO: 920212 - RNA, 19 nt, Homo sapiens
gaugauguagagauuaugu

SEQ ID NO: 920213 - RNA, 19 nt, Homo sapiens
augaauauguuaccaccaa

SEQ ID NO: 920214 - RNA, 19 nt, Homo sapiens
caagaacuaaugaaauugg

SEQ ID NO: 920215 - RNA, 19 nt, Homo sapiens
guaguagugagucugauug

SEQ ID NO: 920216 - RNA, 19 nt, Homo sapiens
caggaagauugccagaugu

SEQ ID NO: 920217 - RNA, 19 nt, Homo sapiens
aacaauccuuccacuaaug

SEQ ID NO: 920218 - RNA, 19 nt, Homo sapiens
uaggaucagugcaaguaau

SEQ ID NO: 920219 - RNA, 19 nt, Homo sapiens
ucaccgagauggggaauuu

SEQ ID NO: 920220 - RNA, 19 nt, Homo sapiens
ccacuaauggcgugaaugg

SEQ ID NO: 920221 - RNA, 19 nt, Homo sapiens
aaggugcuaucuccucuga

SEQ ID NO: 920222 - RNA, 19 nt, Homo sapiens
gccaaagaccauaguuuua

SEQ ID NO: 920223 - RNA, 19 nt, Homo sapiens
uguccuugcuccacaguau

SEQ ID NO: 920224 - RNA, 19 nt, Homo sapiens
uagagaagagagacaguga

SEQ ID NO: 920225 - RNA, 19 nt, Homo sapiens
ugucucaauuuguacaguu

SEQ ID NO: 920226 - RNA, 19 nt, Homo sapiens
guuguuaauucaccgagau

SEQ ID NO: 920227 - RNA, 19 nt, Homo sapiens
aauaggcuucuuggaauua

SEQ ID NO: 920228 - RNA, 19 nt, Homo sapiens
ggauuuguacauagccauu

SEQ ID NO: 920229 - RNA, 19 nt, Homo sapiens
ccacuagguagauauuuag

SEQ ID NO: 920230 - RNA, 19 nt, Homo sapiens
agagagacagugauauuca

SEQ ID NO: 920231 - RNA, 19 nt, Homo sapiens
cgaaggagaaacucaaguc

SEQ ID NO: 920232 - RNA, 19 nt, Homo sapiens
aacacuggcuuugguagaa

SEQ ID NO: 920233 - RNA, 19 nt, Homo sapiens
ggucagaugaacaauccuu

SEQ ID NO: 920234 - RNA, 19 nt, Homo sapiens
uacauagccauucuagaaa

SEQ ID NO: 920235 - RNA, 19 nt, Homo sapiens
ggaaccuccugggcauaau

SEQ ID NO: 920236 - RNA, 19 nt, Homo sapiens
gaaguagagaagagagaca

SEQ ID NO: 920237 - RNA, 19 nt, Homo sapiens
gaagaacaguguagcauug

SEQ ID NO: 920238 - RNA, 19 nt, Homo sapiens
gacauaaacuggauugcua

SEQ ID NO: 920239 - RNA, 19 nt, Homo sapiens
gaagaucaguguagcuuug

SEQ ID NO: 920240 - RNA, 19 nt, Homo sapiens
gaacuaaauuugucgacau

SEQ ID NO: 920241 - RNA, 19 nt, Homo sapiens
caaacgugcugcuaagaaa

SEQ ID NO: 920242 - RNA, 19 nt, Homo sapiens
caaccaaacuugaauguac

SEQ ID NO: 920243 - RNA, 19 nt, Homo sapiens
gaaggaagguuggccugaa

SEQ ID NO: 920244 - RNA, 19 nt, Homo sapiens
gcagugaacuaaauuuguc

SEQ ID NO: 920245 - RNA, 19 nt, Homo sapiens
ccagaagaacaauguauua

SEQ ID NO: 920246 - RNA, 19 nt, Homo sapiens
ugacgagccuuuauuugaa

SEQ ID NO: 920247 - RNA, 19 nt, Homo sapiens
cuauuuagcugaagaggaa

SEQ ID NO: 920248 - RNA, 19 nt, Homo sapiens
aaacgucacuggaaucuca

SEQ ID NO: 920249 - RNA, 19 nt, Homo sapiens
uaaaauaucugcugccuau

SEQ ID NO: 920250 - RNA, 19 nt, Homo sapiens
ggaaagacauaggaagcaa

SEQ ID NO: 920251 - RNA, 19 nt, Homo sapiens
acagaucgauacccagaua

SEQ ID NO: 920252 - RNA, 19 nt, Homo sapiens
aaacuggauugcuaaacua

SEQ ID NO: 920253 - RNA, 19 nt, Homo sapiens
gcucaaacgucacuggaau

SEQ ID NO: 920254 - RNA, 19 nt, Homo sapiens
ggaauaagaaugugagaca

SEQ ID NO: 920255 - RNA, 19 nt, Homo sapiens
cagcaaaguuacaagaaau

SEQ ID NO: 920256 - RNA, 19 nt, Homo sapiens
caaauggaguaccuucuuc

SEQ ID NO: 920257 - RNA, 19 nt, Homo sapiens
gaagaggaaagacauagga

SEQ ID NO: 920258 - RNA, 19 nt, Homo sapiens
ggacaaggcuuugcuuuuc

SEQ ID NO: 920259 - RNA, 19 nt, Homo sapiens
gcccaagcauguaauacuu

SEQ ID NO: 920260 - RNA, 19 nt, Homo sapiens
ugaaacaucucuauuuagc

SEQ ID NO: 920261 - RNA, 19 nt, Homo sapiens
uaaacuggauugcuaaacu

SEQ ID NO: 920262 - RNA, 19 nt, Homo sapiens
acagcaaaguuacaagaaa

SEQ ID NO: 920263 - RNA, 19 nt, Homo sapiens
caagaagaauaugaacaga

SEQ ID NO: 920264 - RNA, 19 nt, Homo sapiens
gcaaaguuacaagaaauug

SEQ ID NO: 920265 - RNA, 19 nt, Homo sapiens
gaagaaaauggaaguguuu

SEQ ID NO: 920266 - RNA, 19 nt, Homo sapiens
gcauugacgagccuuuauu

SEQ ID NO: 920267 - RNA, 19 nt, Homo sapiens
guacaggaauaagaaugug

SEQ ID NO: 920268 - RNA, 19 nt, Homo sapiens
ccaaacgugcugcuaagaa

SEQ ID NO: 920269 - RNA, 19 nt, Homo sapiens
cuauuagguucuucuguga

SEQ ID NO: 920270 - RNA, 19 nt, Homo sapiens
gaacagauacaagccaaac

SEQ ID NO: 920271 - RNA, 19 nt, Homo sapiens
gagagaagaagcccaaagg

SEQ ID NO: 920272 - RNA, 19 nt, Homo sapiens
gaauaugaacagauacaag

SEQ ID NO: 920273 - RNA, 19 nt, Homo sapiens
gccagaagaacaauguauu

SEQ ID NO: 920274 - RNA, 19 nt, Homo sapiens
agaaauugcuacggaagga

SEQ ID NO: 920275 - RNA, 19 nt, Homo sapiens
auaagaaugugagacagaa

SEQ ID NO: 920276 - RNA, 19 nt, Homo sapiens
ugaagaacaguguagcauu

SEQ ID NO: 920277 - RNA, 19 nt, Homo sapiens
ggaagguuggccugaagaa

SEQ ID NO: 920278 - RNA, 19 nt, Homo sapiens
gcugaagaggaaagacaua

SEQ ID NO: 920279 - RNA, 19 nt, Homo sapiens
gacaggcccaagcauguaa

SEQ ID NO: 920280 - RNA, 19 nt, Homo sapiens
cagcagugaacuaaauuug

SEQ ID NO: 920281 - RNA, 19 nt, Homo sapiens
uggaguaccuucuucaaaa

SEQ ID NO: 920282 - RNA, 19 nt, Homo sapiens
ggagaaaacaggagagaga

SEQ ID NO: 920283 - RNA, 19 nt, Homo sapiens
gacgagccuuuauuugaag

SEQ ID NO: 920284 - RNA, 19 nt, Homo sapiens
cauugacgagccuuuauuu

SEQ ID NO: 920285 - RNA, 19 nt, Homo sapiens
ucccagcagugaacuaaau

SEQ ID NO: 920286 - RNA, 19 nt, Homo sapiens
uugacgagccuuuauuuga

SEQ ID NO: 920287 - RNA, 19 nt, Homo sapiens
gaccauccuuugucagaac

SEQ ID NO: 920288 - RNA, 19 nt, Homo sapiens
gguacaggaauaagaaugu

SEQ ID NO: 920289 - RNA, 19 nt, Homo sapiens
gaaaauacagcaaaguuac

SEQ ID NO: 920290 - RNA, 19 nt, Homo sapiens
cgaccauccuuugucagaa

SEQ ID NO: 920291 - RNA, 19 nt, Homo sapiens
gaaauugcuacggaaggaa

SEQ ID NO: 920292 - RNA, 19 nt, Homo sapiens
ccaagcauguaauacuuuu

SEQ ID NO: 920293 - RNA, 19 nt, Homo sapiens
acaaauggaguaccuucuu

SEQ ID NO: 920294 - RNA, 19 nt, Homo sapiens
gcacaagaagaauaugaac

SEQ ID NO: 920295 - RNA, 19 nt, Homo sapiens
ugaccagccucagccagaa

SEQ ID NO: 920296 - RNA, 19 nt, Homo sapiens
uagcauugacgagccuuua

SEQ ID NO: 920297 - RNA, 19 nt, Homo sapiens
ugaauguacaaauggagua

SEQ ID NO: 920298 - RNA, 19 nt, Homo sapiens
caagaauucgagaggagaa

SEQ ID NO: 920299 - RNA, 19 nt, Homo sapiens
ccaaccaaacuugaaugua

SEQ ID NO: 920300 - RNA, 19 nt, Homo sapiens
auaggaagcaagcaagaaa

SEQ ID NO: 920301 - RNA, 19 nt, Homo sapiens
agacauaggaagcaagcaa

SEQ ID NO: 920302 - RNA, 19 nt, Homo sapiens
gaucgauacccagauaauc

SEQ ID NO: 920303 - RNA, 19 nt, Homo sapiens
gaaaacaggagagagaaga

SEQ ID NO: 920304 - RNA, 19 nt, Homo sapiens
caccagccguugcuugaag

SEQ ID NO: 920305 - RNA, 19 nt, Homo sapiens
gauaaucugaaacaucucu

SEQ ID NO: 920306 - RNA, 19 nt, Homo sapiens
ucaauucacagaucgauac

SEQ ID NO: 920307 - RNA, 19 nt, Homo sapiens
agacaggcccaagcaugua

SEQ ID NO: 920308 - RNA, 19 nt, Homo sapiens
cauaaacuggauugcuaaa

SEQ ID NO: 920309 - RNA, 19 nt, Homo sapiens
aaccaaacuugaauguaca

SEQ ID NO: 920310 - RNA, 19 nt, Homo sapiens
acaagaagaauaugaacag

SEQ ID NO: 920311 - RNA, 19 nt, Homo sapiens
aagcacaagaagaauauga

SEQ ID NO: 920312 - RNA, 19 nt, Homo sapiens
gaaaagaaggcucaaacgu

SEQ ID NO: 920313 - RNA, 19 nt, Homo sapiens
aauaagaaugugagacaga

SEQ ID NO: 920314 - RNA, 19 nt, Homo sapiens
ggauugcuaaacuaugcua

SEQ ID NO: 920315 - RNA, 19 nt, Homo sapiens
ccagcagugaacuaaauuu

SEQ ID NO: 920316 - RNA, 19 nt, Homo sapiens
agaagaaaauggaaguguu

SEQ ID NO: 920317 - RNA, 19 nt, Homo sapiens
aagccaaacgugcugcuaa

SEQ ID NO: 920318 - RNA, 19 nt, Homo sapiens
uuauuugccucugaaggaa

SEQ ID NO: 920319 - RNA, 19 nt, Homo sapiens
acauaaacuggauugcuaa

SEQ ID NO: 920320 - RNA, 19 nt, Homo sapiens
ggaaguguuuaaaauacug

SEQ ID NO: 920321 - RNA, 19 nt, Homo sapiens
cuaagaaacaagaauucga

SEQ ID NO: 920322 - RNA, 19 nt, Homo sapiens
gagccuuuauuugaagauc

SEQ ID NO: 920323 - RNA, 19 nt, Homo sapiens
agucgaccauccuuuguca

SEQ ID NO: 920324 - RNA, 19 nt, Homo sapiens
cuuauuuauuugccucuga

SEQ ID NO: 920325 - RNA, 19 nt, Homo sapiens
cugcuaagaaacaagaauu

SEQ ID NO: 920326 - RNA, 19 nt, Homo sapiens
ugaagaucaguguagcuuu

SEQ ID NO: 920327 - RNA, 19 nt, Homo sapiens
gugaagggguuuccacugu

SEQ ID NO: 920328 - RNA, 19 nt, Homo sapiens
cauaggaagcaagcaagaa

SEQ ID NO: 920329 - RNA, 19 nt, Homo sapiens
ggccugaagaacugaaaga

SEQ ID NO: 920330 - RNA, 19 nt, Homo sapiens
cgaagaaaacugaaaauac

SEQ ID NO: 920331 - RNA, 19 nt, Homo sapiens
gggccaaccaaacuugaau

SEQ ID NO: 920332 - RNA, 19 nt, Homo sapiens
aaagggccaaccaaacuug

SEQ ID NO: 920333 - RNA, 19 nt, Homo sapiens
auacagcaaaguuacaaga

SEQ ID NO: 920334 - RNA, 19 nt, Homo sapiens
gcaagacaggcccaagcau

SEQ ID NO: 920335 - RNA, 19 nt, Homo sapiens
aaauugcuacggaaggaaa

SEQ ID NO: 920336 - RNA, 19 nt, Homo sapiens
aaggaagguuggccugaag

SEQ ID NO: 920337 - RNA, 19 nt, Homo sapiens
ggacagauauggcuuucua

SEQ ID NO: 920338 - RNA, 19 nt, Homo sapiens
caucggaacugcaauguua

SEQ ID NO: 920339 - RNA, 19 nt, Homo sapiens
aaagaaagcugcagaaugg

SEQ ID NO: 920340 - RNA, 19 nt, Homo sapiens
gaacagcaguauauuccuu

SEQ ID NO: 920341 - RNA, 19 nt, Homo sapiens
uagcagaacuucgauauga

SEQ ID NO: 920342 - RNA, 19 nt, Homo sapiens
gaagacgcauuggaaauau

SEQ ID NO: 920343 - RNA, 19 nt, Homo sapiens
gagcgaaacuccaucucaa

SEQ ID NO: 920344 - RNA, 19 nt, Homo sapiens
uaaagucguugcagaucua

SEQ ID NO: 920345 - RNA, 19 nt, Homo sapiens
uuacacaaauccucaacua

SEQ ID NO: 920346 - RNA, 19 nt, Homo sapiens
ucaaugugcugugugcuua

SEQ ID NO: 920347 - RNA, 19 nt, Homo sapiens
gcugugugcuuauuaucua

SEQ ID NO: 920348 - RNA, 19 nt, Homo sapiens
cagaagaguuugaguuaca

SEQ ID NO: 920349 - RNA, 19 nt, Homo sapiens
gcaacaaguggauggauuu

SEQ ID NO: 920350 - RNA, 19 nt, Homo sapiens
caaagaaagcugcagaaug

SEQ ID NO: 920351 - RNA, 19 nt, Homo sapiens
gagauccugugccuucaaa

SEQ ID NO: 920352 - RNA, 19 nt, Homo sapiens
acaaguggauggauuugaa

SEQ ID NO: 920353 - RNA, 19 nt, Homo sapiens
ggagcagaguuguguguug

SEQ ID NO: 920354 - RNA, 19 nt, Homo sapiens
ggcaagaacagcaguauau

SEQ ID NO: 920355 - RNA, 19 nt, Homo sapiens
ugaagacgcauuggaaaua

SEQ ID NO: 920356 - RNA, 19 nt, Homo sapiens
agaguuguguguuggauuu

SEQ ID NO: 920357 - RNA, 19 nt, Homo sapiens
caacaacagaccagaaaug

SEQ ID NO: 920358 - RNA, 19 nt, Homo sapiens
gaaagcugcagaauggaaa

SEQ ID NO: 920359 - RNA, 19 nt, Homo sapiens
acacaaauccucaacuaga

SEQ ID NO: 920360 - RNA, 19 nt, Homo sapiens
gauuugacauagaugaaga

SEQ ID NO: 920361 - RNA, 19 nt, Homo sapiens
gcaagaacagcaguauauu

SEQ ID NO: 920362 - RNA, 19 nt, Homo sapiens
ugacucacaccaccuuaua

SEQ ID NO: 920363 - RNA, 19 nt, Homo sapiens
caacagaccagaaaugacu

SEQ ID NO: 920364 - RNA, 19 nt, Homo sapiens
gaugaagacgcauuggaaa

SEQ ID NO: 920365 - RNA, 19 nt, Homo sapiens
gaucuaggaugugguugug

SEQ ID NO: 920366 - RNA, 19 nt, Homo sapiens
caagaacagcaguauauuc

SEQ ID NO: 920367 - RNA, 19 nt, Homo sapiens
ucacaccaccuuauagcua

SEQ ID NO: 920368 - RNA, 19 nt, Homo sapiens
gagagucgccugcaacaag

SEQ ID NO: 920369 - RNA, 19 nt, Homo sapiens
cuacgaguccauacuuuaa

SEQ ID NO: 920370 - RNA, 19 nt, Homo sapiens
uauuaugaauccucccuuu

SEQ ID NO: 920371 - RNA, 19 nt, Homo sapiens
caagucauucgauacagua

SEQ ID NO: 920372 - RNA, 19 nt, Homo sapiens
uaacagaauguccaaguca

SEQ ID NO: 920373 - RNA, 19 nt, Homo sapiens
gcagaucuaggaugugguu

SEQ ID NO: 920374 - RNA, 19 nt, Homo sapiens
gcagaagaguuugaguuac

SEQ ID NO: 920375 - RNA, 19 nt, Homo sapiens
ugcagaagaguuugaguua

SEQ ID NO: 920376 - RNA, 19 nt, Homo sapiens
ggaaugcagaagaguuuga

SEQ ID NO: 920377 - RNA, 19 nt, Homo sapiens
uaauaggaaugcagaagag

SEQ ID NO: 920378 - RNA, 19 nt, Homo sapiens
gccagcaucauacaaguuu

SEQ ID NO: 920379 - RNA, 19 nt, Homo sapiens
guacuuagcaucggaacug

SEQ ID NO: 920380 - RNA, 19 nt, Homo sapiens
acacuuaugaugacauuga

SEQ ID NO: 920381 - RNA, 19 nt, Homo sapiens
gcaguauauuccuuacaca

SEQ ID NO: 920382 - RNA, 19 nt, Homo sapiens
ccaagucauucgauacagu

SEQ ID NO: 920383 - RNA, 19 nt, Homo sapiens
caucauacaaguuucacaa

SEQ ID NO: 920384 - RNA, 19 nt, Homo sapiens
gauauuauagcagaacuuc

SEQ ID NO: 920385 - RNA, 19 nt, Homo sapiens
ccuacgaguccauacuuua

SEQ ID NO: 920386 - RNA, 19 nt, Homo sapiens
ucaucuaaaucacccgaaa

SEQ ID NO: 920387 - RNA, 19 nt, Homo sapiens
uaggaaugcagaagaguuu

SEQ ID NO: 920388 - RNA, 19 nt, Homo sapiens
cacaccaccuuauagcuau

SEQ ID NO: 920389 - RNA, 19 nt, Homo sapiens
ccaagcuacuucuggaaca

SEQ ID NO: 920390 - RNA, 19 nt, Homo sapiens
uaauaaagggacagauaug

SEQ ID NO: 920391 - RNA, 19 nt, Homo sapiens
cacaaauccucaacuagag

SEQ ID NO: 920392 - RNA, 19 nt, Homo sapiens
acagauauggcuuucuaaa

SEQ ID NO: 920393 - RNA, 19 nt, Homo sapiens
agacgcauuggaaauauuu

SEQ ID NO: 920394 - RNA, 19 nt, Homo sapiens
gcagaguuguguguuggau

SEQ ID NO: 920395 - RNA, 19 nt, Homo sapiens
caaauccucaacuagagaa

SEQ ID NO: 920396 - RNA, 19 nt, Homo sapiens
gcaacaacagaccagaaau

SEQ ID NO: 920397 - RNA, 19 nt, Homo sapiens
caaguggauggauuugaaa

SEQ ID NO: 920398 - RNA, 19 nt, Homo sapiens
aggaugugguuguggagua

SEQ ID NO: 920399 - RNA, 19 nt, Homo sapiens
uauagcagaacuucgauau

SEQ ID NO: 920400 - RNA, 19 nt, Homo sapiens
ugcaacaaguggauggauu

SEQ ID NO: 920401 - RNA, 19 nt, Homo sapiens
cuaacagaauguccaaguc

SEQ ID NO: 920402 - RNA, 19 nt, Homo sapiens
aaauaaagucguugcagau

SEQ ID NO: 920403 - RNA, 19 nt, Homo sapiens
caacaaguggauggauuug

SEQ ID NO: 920404 - RNA, 19 nt, Homo sapiens
gaaaagcccaagcuacuuc

SEQ ID NO: 920405 - RNA, 19 nt, Homo sapiens
agaagaguuugaguuacaa

SEQ ID NO: 920406 - RNA, 19 nt, Homo sapiens
uuaauaggaaugcagaaga

SEQ ID NO: 920407 - RNA, 19 nt, Homo sapiens
agaugaagacgcauuggaa

SEQ ID NO: 920408 - RNA, 19 nt, Homo sapiens
ucaaagaaagcugcagaau

SEQ ID NO: 920409 - RNA, 19 nt, Homo sapiens
aagacgcauuggaaauauu

SEQ ID NO: 920410 - RNA, 19 nt, Homo sapiens
aacaacagaccagaaauga

SEQ ID NO: 920411 - RNA, 19 nt, Homo sapiens
uauuauagcagaacuucga

SEQ ID NO: 920412 - RNA, 19 nt, Homo sapiens
guuaggagcagaguugugu

SEQ ID NO: 920413 - RNA, 19 nt, Homo sapiens
agaaagcugcagaauggaa

SEQ ID NO: 920414 - RNA, 19 nt, Homo sapiens
aauguuaggagcagaguug

SEQ ID NO: 920415 - RNA, 19 nt, Homo sapiens
ggaugugguuguggaguac

SEQ ID NO: 920416 - RNA, 19 nt, Homo sapiens
cguugcagaucuaggaugu

SEQ ID NO: 920417 - RNA, 19 nt, Homo sapiens
gugcuuauuaucuaacaga

SEQ ID NO: 920418 - RNA, 19 nt, Homo sapiens
caaauauugacaugguuca

SEQ ID NO: 920419 - RNA, 19 nt, Homo sapiens
cauagaugaagacgcauug

SEQ ID NO: 920420 - RNA, 19 nt, Homo sapiens
cacuuaugaugacauugaa

SEQ ID NO: 920421 - RNA, 19 nt, Homo sapiens
gcgaaacuccaucucaaaa

SEQ ID NO: 920422 - RNA, 19 nt, Homo sapiens
caagagcgaaacuccaucu

SEQ ID NO: 920423 - RNA, 19 nt, Homo sapiens
uggcaagaacagcaguaua

SEQ ID NO: 920424 - RNA, 19 nt, Homo sapiens
gacagauauggcuuucuaa

SEQ ID NO: 920425 - RNA, 19 nt, Homo sapiens
agagucgccugcaacaagu

SEQ ID NO: 920426 - RNA, 19 nt, Homo sapiens
gcaucggaacugcaauguu

SEQ ID NO: 920427 - RNA, 19 nt, Homo sapiens
auaaagucguugcagaucu

SEQ ID NO: 920428 - RNA, 19 nt, Homo sapiens
caaacccuacgaguccaua

SEQ ID NO: 920429 - RNA, 19 nt, Homo sapiens
aacagcaguauauuccuua

SEQ ID NO: 920430 - RNA, 19 nt, Homo sapiens
aaugugcugugugcuuauu

SEQ ID NO: 920431 - RNA, 19 nt, Homo sapiens
cagcaucauacaaguuuca

SEQ ID NO: 920432 - RNA, 19 nt, Homo sapiens
caguauauuccuuacacaa

SEQ ID NO: 920433 - RNA, 19 nt, Homo sapiens
cccuacgaguccauacuuu

SEQ ID NO: 920434 - RNA, 19 nt, Homo sapiens
ugugcugugugcuuauuau

SEQ ID NO: 920435 - RNA, 19 nt, Homo sapiens
guguuggauuugacauaga

SEQ ID NO: 920436 - RNA, 19 nt, Homo sapiens
uguguuggauuugacauag

SEQ ID NO: 920437 - RNA, 19 nt, Homo sapiens
caaaguggaugaagaugaa

SEQ ID NO: 920438 - RNA, 19 nt, Homo sapiens
caagguagaugaacugaug

SEQ ID NO: 920439 - RNA, 19 nt, Homo sapiens
gaagaacccucagucaaau

SEQ ID NO: 920440 - RNA, 19 nt, Homo sapiens
uagaugaacugaugacuga

SEQ ID NO: 920441 - RNA, 19 nt, Homo sapiens
gcucaacucugaagaagga

SEQ ID NO: 920442 - RNA, 19 nt, Homo sapiens
agaaggaucuugcuacaga

SEQ ID NO: 920443 - RNA, 19 nt, Homo sapiens
ggaugaagaugaagaagca

SEQ ID NO: 920444 - RNA, 19 nt, Homo sapiens
uaagagagcugcccuacag

SEQ ID NO: 920445 - RNA, 19 nt, Homo sapiens
gagaagauacugaucaaga

SEQ ID NO: 920446 - RNA, 19 nt, Homo sapiens
gaaggagacagagaagaua

SEQ ID NO: 920447 - RNA, 19 nt, Homo sapiens
gaagaagaacccucaguca

SEQ ID NO: 920448 - RNA, 19 nt, Homo sapiens
ggaauuggcccaggaguug

SEQ ID NO: 920449 - RNA, 19 nt, Homo sapiens
gaagauacugaucaagaaa

SEQ ID NO: 920450 - RNA, 19 nt, Homo sapiens
agaagauacugaucaagaa

SEQ ID NO: 920451 - RNA, 19 nt, Homo sapiens
gcccaggaguuguuaaaug

SEQ ID NO: 920452 - RNA, 19 nt, Homo sapiens
ugaagaagcaauacagaaa

SEQ ID NO: 920453 - RNA, 19 nt, Homo sapiens
gaagcaauacagaaacuga

SEQ ID NO: 920454 - RNA, 19 nt, Homo sapiens
agaagaacccucagucaaa

SEQ ID NO: 920455 - RNA, 19 nt, Homo sapiens
gaucaagaaacaggaauuu

SEQ ID NO: 920456 - RNA, 19 nt, Homo sapiens
gaaggaucuugcuacagaa

SEQ ID NO: 920457 - RNA, 19 nt, Homo sapiens
cagagaagauacugaucaa

SEQ ID NO: 920458 - RNA, 19 nt, Homo sapiens
gagaaugccacuaccaaug

SEQ ID NO: 920459 - RNA, 19 nt, Homo sapiens
gggcuugucuuccuaaugc

SEQ ID NO: 920460 - RNA, 19 nt, Homo sapiens
ugacugacaucacggaaca

SEQ ID NO: 920461 - RNA, 19 nt, Homo sapiens
ggacauggacauugacaag

SEQ ID NO: 920462 - RNA, 19 nt, Homo sapiens
aagaagcacuaaagcaguu

SEQ ID NO: 920463 - RNA, 19 nt, Homo sapiens
gaagaugaagaagcacuaa

SEQ ID NO: 920464 - RNA, 19 nt, Homo sapiens
guugguccuuucuuccuua

SEQ ID NO: 920465 - RNA, 19 nt, Homo sapiens
ccaaaguggaugaagauga

SEQ ID NO: 920466 - RNA, 19 nt, Homo sapiens
ucagucaaauugccuagug

SEQ ID NO: 920467 - RNA, 19 nt, Homo sapiens
cccaggaguuguuaaaugu

SEQ ID NO: 920468 - RNA, 19 nt, Homo sapiens
cauggacauugacaaggua

SEQ ID NO: 920469 - RNA, 19 nt, Homo sapiens
caaacugacgggacauuau

SEQ ID NO: 920470 - RNA, 19 nt, Homo sapiens
ggaucuugcuacagaagga

SEQ ID NO: 920471 - RNA, 19 nt, Homo sapiens
caaauugccuaguguaccu

SEQ ID NO: 920472 - RNA, 19 nt, Homo sapiens
gguccuuucuuccuuaagu

SEQ ID NO: 920473 - RNA, 19 nt, Homo sapiens
aguaugggaccaagaauaa

SEQ ID NO: 920474 - RNA, 19 nt, Homo sapiens
uacaaacagccaagaagua

SEQ ID NO: 920475 - RNA, 19 nt, Homo sapiens
gaagaagcaauacagaaac

SEQ ID NO: 920476 - RNA, 19 nt, Homo sapiens
gcaguuauaaugcccuugu

SEQ ID NO: 920477 - RNA, 19 nt, Homo sapiens
gccaagugcugagcuaaag

SEQ ID NO: 920478 - RNA, 19 nt, Homo sapiens
ugaaggagacagagaagau

SEQ ID NO: 920479 - RNA, 19 nt, Homo sapiens
ggaagaugauguggaugag

SEQ ID NO: 920480 - RNA, 19 nt, Homo sapiens
gaaugccacuaccaaugca

SEQ ID NO: 920481 - RNA, 19 nt, Homo sapiens
acaaacagccaagaaguau

SEQ ID NO: 920482 - RNA, 19 nt, Homo sapiens
agaaguaugggaccaagaa

SEQ ID NO: 920483 - RNA, 19 nt, Homo sapiens
caacaggagcuacaaacag

SEQ ID NO: 920484 - RNA, 19 nt, Homo sapiens
ugauaaaucugggcuuguc

SEQ ID NO: 920485 - RNA, 19 nt, Homo sapiens
caauaaaacugggcagaug

SEQ ID NO: 920486 - RNA, 19 nt, Homo sapiens
aagaagaacccucagucaa

SEQ ID NO: 920487 - RNA, 19 nt, Homo sapiens
caauacagaaacugaagga

SEQ ID NO: 920488 - RNA, 19 nt, Homo sapiens
uggaagaugauguggauga

SEQ ID NO: 920489 - RNA, 19 nt, Homo sapiens
ggacauugacaagguagau

SEQ ID NO: 920490 - RNA, 19 nt, Homo sapiens
accaggacauggacauuga

SEQ ID NO: 920491 - RNA, 19 nt, Homo sapiens
acaaacugacgggacauua

SEQ ID NO: 920492 - RNA, 19 nt, Homo sapiens
gaagauucaacaggagcua

SEQ ID NO: 920493 - RNA, 19 nt, Homo sapiens
agacagagaagauacugau

SEQ ID NO: 920494 - RNA, 19 nt, Homo sapiens
aaacagccaagaaguaugg

SEQ ID NO: 920495 - RNA, 19 nt, Homo sapiens
gggcgacaaggaagaagaa

SEQ ID NO: 920496 - RNA, 19 nt, Homo sapiens
gaaguaugggaccaagaau

SEQ ID NO: 920497 - RNA, 19 nt, Homo sapiens
acagagaagauacugauca

SEQ ID NO: 920498 - RNA, 19 nt, Homo sapiens
gcucccuucucuuugauag

SEQ ID NO: 920499 - RNA, 19 nt, Homo sapiens
caagugcugagcuaaagga

SEQ ID NO: 920500 - RNA, 19 nt, Homo sapiens
cuaaagcaguuggcugagu

SEQ ID NO: 920501 - RNA, 19 nt, Homo sapiens
ugauguggaugaggaugaa

SEQ ID NO: 920502 - RNA, 19 nt, Homo sapiens
aaacugacgggacauuauc

SEQ ID NO: 920503 - RNA, 19 nt, Homo sapiens
cuacaaacagccaagaagu

SEQ ID NO: 920504 - RNA, 19 nt, Homo sapiens
ugggcucccuucucuuuga

SEQ ID NO: 920505 - RNA, 19 nt, Homo sapiens
gcugagggugguaguguga

SEQ ID NO: 920506 - RNA, 19 nt, Homo sapiens
ugaagaugaagaagcacua

SEQ ID NO: 920507 - RNA, 19 nt, Homo sapiens
uaaaugugggcgacaagga

SEQ ID NO: 920508 - RNA, 19 nt, Homo sapiens
gaugaacugaugacugaca

SEQ ID NO: 920509 - RNA, 19 nt, Homo sapiens
acauggacauugacaaggu

SEQ ID NO: 920510 - RNA, 19 nt, Homo sapiens
aaacugaaggagacagaga

SEQ ID NO: 920511 - RNA, 19 nt, Homo sapiens
agauacugaucaagaaaca

SEQ ID NO: 920512 - RNA, 19 nt, Homo sapiens
aagaagcaauacagaaacu

SEQ ID NO: 920513 - RNA, 19 nt, Homo sapiens
uaugggaccaagaauaaga

SEQ ID NO: 920514 - RNA, 19 nt, Homo sapiens
aaguaugggaccaagaaua

SEQ ID NO: 920515 - RNA, 19 nt, Homo sapiens
gcuacaaacagccaagaag

SEQ ID NO: 920516 - RNA, 19 nt, Homo sapiens
gcaugaagaaggccuacca

SEQ ID NO: 920517 - RNA, 19 nt, Homo sapiens
ugacaagguagaugaacug

SEQ ID NO: 920518 - RNA, 19 nt, Homo sapiens
uaguguaccuucuacucau

SEQ ID NO: 920519 - RNA, 19 nt, Homo sapiens
aaaugugggcgacaaggaa

SEQ ID NO: 920520 - RNA, 19 nt, Homo sapiens
gagacagagaagauacuga

SEQ ID NO: 920521 - RNA, 19 nt, Homo sapiens
gccuaugggcuuauuggaa

SEQ ID NO: 920522 - RNA, 19 nt, Homo sapiens
ugacaucacggaacaacag

SEQ ID NO: 920523 - RNA, 19 nt, Homo sapiens
aaacugggcagauggaaaa

SEQ ID NO: 920524 - RNA, 19 nt, Homo sapiens
ucucuuugauagcaguuau

SEQ ID NO: 920525 - RNA, 19 nt, Homo sapiens
agugugacccugccugaaa

SEQ ID NO: 920526 - RNA, 19 nt, Homo sapiens
caaacagccaagaaguaug

SEQ ID NO: 920527 - RNA, 19 nt, Homo sapiens
cugaagaagcaauacagaa

SEQ ID NO: 920528 - RNA, 19 nt, Homo sapiens
ucaacaggagcuacaaaca

SEQ ID NO: 920529 - RNA, 19 nt, Homo sapiens
ggagacagagaagauacug

SEQ ID NO: 920530 - RNA, 19 nt, Homo sapiens
agaacccucagucaaauug

SEQ ID NO: 920531 - RNA, 19 nt, Homo sapiens
gaaggccuaccaggacaug

SEQ ID NO: 920532 - RNA, 19 nt, Homo sapiens
caguuauaaugcccuuguu

SEQ ID NO: 920533 - RNA, 19 nt, Homo sapiens
cuugggcucccuucucuuu

SEQ ID NO: 920534 - RNA, 19 nt, Homo sapiens
gaaaaggccaaccccugaa

SEQ ID NO: 920535 - RNA, 19 nt, Homo sapiens
auuggaagaugauguggau

SEQ ID NO: 920536 - RNA, 19 nt, Homo sapiens
acauugacaagguagauga

SEQ ID NO: 920537 - RNA, 19 nt, Homo sapiens
cgacugagccgcuauaaua

SEQ ID NO: 920538 - RNA, 19 nt, Homo sapiens
cgaaggaacuugaagagaa

SEQ ID NO: 920539 - RNA, 19 nt, Homo sapiens
ggauagcguuguuggaauu

SEQ ID NO: 920540 - RNA, 19 nt, Homo sapiens
gaauuugcauuaccuuaug

SEQ ID NO: 920541 - RNA, 19 nt, Homo sapiens
ccagaaauuuguuaacaug

SEQ ID NO: 920542 - RNA, 19 nt, Homo sapiens
gaacuugaagagaacauuu

SEQ ID NO: 920543 - RNA, 19 nt, Homo sapiens
gaacgaaggaacuugaaga

SEQ ID NO: 920544 - RNA, 19 nt, Homo sapiens
gaauccaccuguugagaug

SEQ ID NO: 920545 - RNA, 19 nt, Homo sapiens
caagggacaucuuuuaaaa

SEQ ID NO: 920546 - RNA, 19 nt, Homo sapiens
gaaggaacuugaagagaac

SEQ ID NO: 920547 - RNA, 19 nt, Homo sapiens
ugcauuaccuuaugugauu

SEQ ID NO: 920548 - RNA, 19 nt, Homo sapiens
ugaaaugccugcggugcua

SEQ ID NO: 920549 - RNA, 19 nt, Homo sapiens
acuaaugguucccgguuua

SEQ ID NO: 920550 - RNA, 19 nt, Homo sapiens
cagacaauauugccauaga

SEQ ID NO: 920551 - RNA, 19 nt, Homo sapiens
ccucaguuguuuccuguaa

SEQ ID NO: 920552 - RNA, 19 nt, Homo sapiens
ggaaaaucaucucuaauca

SEQ ID NO: 920553 - RNA, 19 nt, Homo sapiens
gcagagcaauguuggaaaa

SEQ ID NO: 920554 - RNA, 19 nt, Homo sapiens
caucucuaaucaagcuuua

SEQ ID NO: 920555 - RNA, 19 nt, Homo sapiens
ccauagaaaugugugaaga

SEQ ID NO: 920556 - RNA, 19 nt, Homo sapiens
gacaauauugccauagaaa

SEQ ID NO: 920557 - RNA, 19 nt, Homo sapiens
uuagagcaccugaagauuu

SEQ ID NO: 920558 - RNA, 19 nt, Homo sapiens
gugugaagaauuugcauua

SEQ ID NO: 920559 - RNA, 19 nt, Homo sapiens
caauauugccauagaaaug

SEQ ID NO: 920560 - RNA, 19 nt, Homo sapiens
agacaauauugccauagaa

SEQ ID NO: 920561 - RNA, 19 nt, Homo sapiens
gacuaaugguucccgguuu

SEQ ID NO: 920562 - RNA, 19 nt, Homo sapiens
ggaauccaccuguugagau

SEQ ID NO: 920563 - RNA, 19 nt, Homo sapiens
uguaagugcugugaccuuu

SEQ ID NO: 920564 - RNA, 19 nt, Homo sapiens
caugaaaacucaaggaugu

SEQ ID NO: 920565 - RNA, 19 nt, Homo sapiens
gggagacucuuugaaaugc

SEQ ID NO: 920566 - RNA, 19 nt, Homo sapiens
ggacaucuuuuaaaacaag

SEQ ID NO: 920567 - RNA, 19 nt, Homo sapiens
aaagaacgaaggaacuuga

SEQ ID NO: 920568 - RNA, 19 nt, Homo sapiens
uagagcaccugaagauuuu

SEQ ID NO: 920569 - RNA, 19 nt, Homo sapiens
ugguggacaugccagguua

SEQ ID NO: 920570 - RNA, 19 nt, Homo sapiens
gagcaauguuggaaaauca

SEQ ID NO: 920571 - RNA, 19 nt, Homo sapiens
cuguugagaugcuuuauag

SEQ ID NO: 920572 - RNA, 19 nt, Homo sapiens
gcugugaccuuuucuggaa

SEQ ID NO: 920573 - RNA, 19 nt, Homo sapiens
guuggaaaaucaucucuaa

SEQ ID NO: 920574 - RNA, 19 nt, Homo sapiens
cauagaaaugugugaagaa

SEQ ID NO: 920575 - RNA, 19 nt, Homo sapiens
gaccuucaccugcguaucu

SEQ ID NO: 920576 - RNA, 19 nt, Homo sapiens
ucaguuguuuccuguaagu

SEQ ID NO: 920577 - RNA, 19 nt, Homo sapiens
gcauuaccuuaugugauug

SEQ ID NO: 920578 - RNA, 19 nt, Homo sapiens
gaagaauuugcauuaccuu

SEQ ID NO: 920579 - RNA, 19 nt, Homo sapiens
ugaagaauuugcauuaccu

SEQ ID NO: 920580 - RNA, 19 nt, Homo sapiens
aacagacaauauugccaua

SEQ ID NO: 920581 - RNA, 19 nt, Homo sapiens
gaagucagagucuccaaaa

SEQ ID NO: 920582 - RNA, 19 nt, Homo sapiens
guggauagcguuguuggaa

SEQ ID NO: 920583 - RNA, 19 nt, Homo sapiens
aaucaucucuaaucaagcu

SEQ ID NO: 920584 - RNA, 19 nt, Homo sapiens
aaaccaggacacacaagaa

SEQ ID NO: 920585 - RNA, 19 nt, Homo sapiens
gaggugagaggcgauucua

SEQ ID NO: 920586 - RNA, 19 nt, Homo sapiens
ggaacuugaagagaacauu

SEQ ID NO: 920587 - RNA, 19 nt, Homo sapiens
ggaaccgcaucgacuacgu

SEQ ID NO: 920588 - RNA, 19 nt, Homo sapiens
ggacacacaagaaaaugaa

SEQ ID NO: 920589 - RNA, 19 nt, Homo sapiens
uagcguuguuggaauucaa

SEQ ID NO: 920590 - RNA, 19 nt, Homo sapiens
aauagcacgucccaagcuu

SEQ ID NO: 920591 - RNA, 19 nt, Homo sapiens
ugaagucagagucuccaaa

SEQ ID NO: 920592 - RNA, 19 nt, Homo sapiens
ccuguugagaugcuuuaua

SEQ ID NO: 920593 - RNA, 19 nt, Homo sapiens
gugaagaauuugcauuacc

SEQ ID NO: 920594 - RNA, 19 nt, Homo sapiens
uggauagcguuguuggaau

SEQ ID NO: 920595 - RNA, 19 nt, Homo sapiens
aaccaggacacacaagaaa

SEQ ID NO: 920596 - RNA, 19 nt, Homo sapiens
cuuuauagccaguguaaca

SEQ ID NO: 920597 - RNA, 19 nt, Homo sapiens
gaugcuuuauagccagugu

SEQ ID NO: 920598 - RNA, 19 nt, Homo sapiens
uaagugcugugaccuuuuc

SEQ ID NO: 920599 - RNA, 19 nt, Homo sapiens
ccaagggacaucuuuuaaa

SEQ ID NO: 920600 - RNA, 19 nt, Homo sapiens
uauaggcagagcaauguug

SEQ ID NO: 920601 - RNA, 19 nt, Homo sapiens
acaagaagauucacgugua

SEQ ID NO: 920602 - RNA, 19 nt, Homo sapiens
ggacaucuacgacaaagug

SEQ ID NO: 920603 - RNA, 19 nt, Homo sapiens
ggaacuggauugcgauugg

SEQ ID NO: 920604 - RNA, 19 nt, Homo sapiens
ccacagaauuaaacguguu

SEQ ID NO: 920605 - RNA, 19 nt, Homo sapiens
gaagcaaggcugcgacugu

SEQ ID NO: 920606 - RNA, 19 nt, Homo sapiens
gauuccacguuuccuuuaa

SEQ ID NO: 920607 - RNA, 19 nt, Homo sapiens
uagccuggccacagaauua

SEQ ID NO: 920608 - RNA, 19 nt, Homo sapiens
caagaagauucacguguac

SEQ ID NO: 920609 - RNA, 19 nt, Homo sapiens
ggacgcagagggcaaggaa

SEQ ID NO: 920610 - RNA, 19 nt, Homo sapiens
caagugggcugaguaccau

SEQ ID NO: 920611 - RNA, 19 nt, Homo sapiens
ggaccucgcucucauuccu

SEQ ID NO: 920612 - RNA, 19 nt, Homo sapiens
gaacuggauugcgauuggu

SEQ ID NO: 920613 - RNA, 19 nt, Homo sapiens
gcgcaucucccaccagagu

SEQ ID NO: 920614 - RNA, 19 nt, Homo sapiens
gcuacaagugggcugagua

SEQ ID NO: 920615 - RNA, 19 nt, Homo sapiens
cgauuccacguuuccuuua

SEQ ID NO: 920616 - RNA, 19 nt, Homo sapiens
cuucuccguuggcugauuu

SEQ ID NO: 920617 - RNA, 19 nt, Homo sapiens
gauuucaucaccacccauu

SEQ ID NO: 920618 - RNA, 19 nt, Homo sapiens
caccacccauucccgauuc

SEQ ID NO: 920619 - RNA, 19 nt, Homo sapiens
gcggacaucuacgacaaag

SEQ ID NO: 920620 - RNA, 19 nt, Homo sapiens
uccguuggcugauuucauc

SEQ ID NO: 920621 - RNA, 19 nt, Homo sapiens
ccgauuccacguuuccuuu

SEQ ID NO: 920622 - RNA, 19 nt, Homo sapiens
ggcuaacgacggcuacuga

SEQ ID NO: 920623 - RNA, 19 nt, Homo sapiens
gaaaaucaaagccaaguac

SEQ ID NO: 920624 - RNA, 19 nt, Homo sapiens
cauucccgauuccacguuu

SEQ ID NO: 920625 - RNA, 19 nt, Homo sapiens
gcccagcacgccauuucaa

SEQ ID NO: 920626 - RNA, 19 nt, Homo sapiens
gagaugaguuggaagauau

SEQ ID NO: 920627 - RNA, 19 nt, Homo sapiens
ggagaugaguuggaagaua

SEQ ID NO: 920628 - RNA, 19 nt, Homo sapiens
ggaggaggaugaagccauu

SEQ ID NO: 920629 - RNA, 19 nt, Homo sapiens
ggucaacuguccagagaaa

SEQ ID NO: 920630 - RNA, 19 nt, Homo sapiens
gcccauauuucuucuuuga

SEQ ID NO: 920631 - RNA, 19 nt, Homo sapiens
gauggcggcuuccuaguga

SEQ ID NO: 920632 - RNA, 19 nt, Homo sapiens
ugacggagcccaugaagaa

SEQ ID NO: 920633 - RNA, 19 nt, Homo sapiens
gaagaugauugagauguuc

SEQ ID NO: 920634 - RNA, 19 nt, Homo sapiens
ugccaaagcuggagucguu

SEQ ID NO: 920635 - RNA, 19 nt, Homo sapiens
guucuucccugugugauuu

SEQ ID NO: 920636 - RNA, 19 nt, Homo sapiens
ggaaguccuuggccuaaag

SEQ ID NO: 920637 - RNA, 19 nt, Homo sapiens
ggaugaagccauugagguu

SEQ ID NO: 920638 - RNA, 19 nt, Homo sapiens
gaugggagccucaacacuu

SEQ ID NO: 920639 - RNA, 19 nt, Homo sapiens
gugcccauauuucuucuuu

SEQ ID NO: 920640 - RNA, 19 nt, Homo sapiens
ggagggaaacccaggauuc

SEQ ID NO: 920641 - RNA, 19 nt, Homo sapiens
agaagaugauugagauguu

SEQ ID NO: 920642 - RNA, 19 nt, Homo sapiens
ccuaguuugucauggauaa

SEQ ID NO: 920643 - RNA, 19 nt, Homo sapiens
guacaucugcaccuucuug

SEQ ID NO: 920644 - RNA, 19 nt, Homo sapiens
gguaccagcuacaaguaug

SEQ ID NO: 920645 - RNA, 19 nt, Homo sapiens
ugaguuggaagauauguuu

SEQ ID NO: 920646 - RNA, 19 nt, Homo sapiens
gaggagaugaguuggaaga

SEQ ID NO: 920647 - RNA, 19 nt, Homo sapiens
cagagaacgugcagacgau

SEQ ID NO: 920648 - RNA, 19 nt, Homo sapiens
gcacguaggguaccuugca

SEQ ID NO: 920649 - RNA, 19 nt, Homo sapiens
ccuaaagccuugguucuca

SEQ ID NO: 920650 - RNA, 19 nt, Homo sapiens
guagcugccucuaugaucu

SEQ ID NO: 920651 - RNA, 19 nt, Homo sapiens
ccacacaggagccauggaa

SEQ ID NO: 920652 - RNA, 19 nt, Homo sapiens
gcaccauccuugucuacag

SEQ ID NO: 920653 - RNA, 19 nt, Homo sapiens
cccagaagaugauugagau

SEQ ID NO: 920654 - RNA, 19 nt, Homo sapiens
uaaagauggcggcuuccua

SEQ ID NO: 920655 - RNA, 19 nt, Homo sapiens
ccagagaaagugauuaucu

SEQ ID NO: 920656 - RNA, 19 nt, Homo sapiens
cgacaaaagccacgaguuu

SEQ ID NO: 920657 - RNA, 19 nt, Homo sapiens
ggaaaugucacugccaaag

SEQ ID NO: 920658 - RNA, 19 nt, Homo sapiens
gaaccaucccuguacaucu

SEQ ID NO: 920659 - RNA, 19 nt, Homo sapiens
cucaaugucucccagaaga

SEQ ID NO: 920660 - RNA, 19 nt, Homo sapiens
ccauuuccacuccuaguuu

SEQ ID NO: 920661 - RNA, 19 nt, Homo sapiens
ggagggaucccaggaacug

SEQ ID NO: 920662 - RNA, 19 nt, Homo sapiens
aaaccaacgcccucaaugu

SEQ ID NO: 920663 - RNA, 19 nt, Homo sapiens
cuaaagccuugguucucaa

SEQ ID NO: 920664 - RNA, 19 nt, Homo sapiens
gcacaacugcauggcgaaa

SEQ ID NO: 920665 - RNA, 19 nt, Homo sapiens
ggagaaggaggaggagaug

SEQ ID NO: 920666 - RNA, 19 nt, Homo sapiens
ggaccugucagaggaaaug

SEQ ID NO: 920667 - RNA, 19 nt, Homo sapiens
cauuuccacuccuaguuug

SEQ ID NO: 920668 - RNA, 19 nt, Homo sapiens
ggacaaaacacaagaucga

SEQ ID NO: 920669 - RNA, 19 nt, Homo sapiens
aggaggagaugaguuggaa

SEQ ID NO: 920670 - RNA, 19 nt, Homo sapiens
ccagugcccauauuucuuc

SEQ ID NO: 920671 - RNA, 19 nt, Homo sapiens
gagacggccuccuguucca

SEQ ID NO: 920672 - RNA, 19 nt, Homo sapiens
gaugaugggagccucaaca

SEQ ID NO: 920673 - RNA, 19 nt, Homo sapiens
gaaaugucacugccaaagc

SEQ ID NO: 920674 - RNA, 19 nt, Homo sapiens
guaccagcuacaaguauga

SEQ ID NO: 920675 - RNA, 19 nt, Homo sapiens
agauauguuugccuucaug

SEQ ID NO: 920676 - RNA, 19 nt, Homo sapiens
caacuuccggcuguaaaga

SEQ ID NO: 920677 - RNA, 19 nt, Homo sapiens
caauggcacugaggagaag

SEQ ID NO: 920678 - RNA, 19 nt, Homo sapiens
gagcuuccggucacagaga

SEQ ID NO: 920679 - RNA, 19 nt, Homo sapiens
ggacaccaagggucaacug

SEQ ID NO: 920680 - RNA, 19 nt, Homo sapiens
guccagagaaagugauuau

SEQ ID NO: 920681 - RNA, 19 nt, Homo sapiens
cagcccauuuccacuccua

SEQ ID NO: 920682 - RNA, 19 nt, Homo sapiens
aaccaucccuguacaucug

SEQ ID NO: 920683 - RNA, 19 nt, Homo sapiens
aaaugucacugccaaagcu

SEQ ID NO: 920684 - RNA, 19 nt, Homo sapiens
gagaacgugcagacgauuc

SEQ ID NO: 920685 - RNA, 19 nt, Homo sapiens
augaagccauugagguuga

SEQ ID NO: 920686 - RNA, 19 nt, Homo sapiens
gaaggaggaggagaugagu

SEQ ID NO: 920687 - RNA, 19 nt, Homo sapiens
agggucaacuguccagaga

SEQ ID NO: 920688 - RNA, 19 nt, Homo sapiens
acaauggcacugaggagaa

SEQ ID NO: 920689 - RNA, 19 nt, Homo sapiens
cagaagaugauugagaugu

SEQ ID NO: 920690 - RNA, 19 nt, Homo sapiens
uaaagccuugguucucaaa

SEQ ID NO: 920691 - RNA, 19 nt, Homo sapiens
gccagagccaugcuuccua

SEQ ID NO: 920692 - RNA, 19 nt, Homo sapiens
gaggaggagaugaguugga

SEQ ID NO: 920693 - RNA, 19 nt, Homo sapiens
gagauguucgugcggacaa

SEQ ID NO: 920694 - RNA, 19 nt, Homo sapiens
caaugucucccagaagaug

SEQ ID NO: 920695 - RNA, 19 nt, Homo sapiens
gagaaggaggaggagauga

SEQ ID NO: 920696 - RNA, 19 nt, Homo sapiens
acuccuaguuugucaugga

SEQ ID NO: 920697 - RNA, 19 nt, Homo sapiens
aagaggaggaggaggaaga

SEQ ID NO: 920698 - RNA, 19 nt, Homo sapiens
cugcauggcgaaacuguug

SEQ ID NO: 920699 - RNA, 19 nt, Homo sapiens
gcucuguagcugccucuau

SEQ ID NO: 920700 - RNA, 19 nt, Homo sapiens
ccaggagggaucccaggaa

SEQ ID NO: 920701 - RNA, 19 nt, Homo sapiens
ucuuugacguuguuuacau

SEQ ID NO: 920702 - RNA, 19 nt, Homo sapiens
caacuguccagagaaagug

SEQ ID NO: 920703 - RNA, 19 nt, Homo sapiens
ggcggcugauuuagaagga

SEQ ID NO: 920704 - RNA, 19 nt, Homo sapiens
acaacugcauggcgaaacu

SEQ ID NO: 920705 - RNA, 19 nt, Homo sapiens
ccaaggguaccagcuacaa

SEQ ID NO: 920706 - RNA, 19 nt, Homo sapiens
aggaggaggagaugaguug

SEQ ID NO: 920707 - RNA, 19 nt, Homo sapiens
ucaacuguccagagaaagu

SEQ ID NO: 920708 - RNA, 19 nt, Homo sapiens
ugauuuagaaggagguuca

SEQ ID NO: 920709 - RNA, 19 nt, Homo sapiens
acacaaggcuuacuuauau

SEQ ID NO: 920710 - RNA, 19 nt, Homo sapiens
gcaaagaggacaacccuaa

SEQ ID NO: 920711 - RNA, 19 nt, Homo sapiens
gcaaauuacuucaucaucu

SEQ ID NO: 920712 - RNA, 19 nt, Homo sapiens
caagguaacacaaggcuua

SEQ ID NO: 920713 - RNA, 19 nt, Homo sapiens
gaaccaaguuaacugagau

SEQ ID NO: 920714 - RNA, 19 nt, Homo sapiens
ggaaccaaguuaacugaga

SEQ ID NO: 920715 - RNA, 19 nt, Homo sapiens
uggcugagcucaaauccua

SEQ ID NO: 920716 - RNA, 19 nt, Homo sapiens
ugaacuacauacugagaua

SEQ ID NO: 920717 - RNA, 19 nt, Homo sapiens
caugguggauguacaguuu

SEQ ID NO: 920718 - RNA, 19 nt, Homo sapiens
ucaugaagaucgugaaaga

SEQ ID NO: 920719 - RNA, 19 nt, Homo sapiens
uagcaaggauaacaaggua

SEQ ID NO: 920720 - RNA, 19 nt, Homo sapiens
caaguuaacugagauacug

SEQ ID NO: 920721 - RNA, 19 nt, Homo sapiens
gcucaaauccuaucaucaa

SEQ ID NO: 920722 - RNA, 19 nt, Homo sapiens
ccagagagccgccuagaga

SEQ ID NO: 920723 - RNA, 19 nt, Homo sapiens
agagaaagguguagaugug

SEQ ID NO: 920724 - RNA, 19 nt, Homo sapiens
gagcucaaauccuaucauc

SEQ ID NO: 920725 - RNA, 19 nt, Homo sapiens
gacauuagcauucuuucuu

SEQ ID NO: 920726 - RNA, 19 nt, Homo sapiens
ggacagaaccgagaagagu

SEQ ID NO: 920727 - RNA, 19 nt, Homo sapiens
ccaugaagcugggagaaga

SEQ ID NO: 920728 - RNA, 19 nt, Homo sapiens
caagaaucguccgcacuaa

SEQ ID NO: 920729 - RNA, 19 nt, Homo sapiens
ccaagaaucguccgcacua

SEQ ID NO: 920730 - RNA, 19 nt, Homo sapiens
gacaagggacuaucaggaa

SEQ ID NO: 920731 - RNA, 19 nt, Homo sapiens
gggaugguguucguaacua

SEQ ID NO: 920732 - RNA, 19 nt, Homo sapiens
gauuauccauucaguugau

SEQ ID NO: 920733 - RNA, 19 nt, Homo sapiens
ucaucuagauuauccauuc

SEQ ID NO: 920734 - RNA, 19 nt, Homo sapiens
gucuguagccagcaaauua

SEQ ID NO: 920735 - RNA, 19 nt, Homo sapiens
acaagggacuaucaggaaa

SEQ ID NO: 920736 - RNA, 19 nt, Homo sapiens
ccacacacaguuugagaaa

SEQ ID NO: 920737 - RNA, 19 nt, Homo sapiens
uagauuauccauucaguug

SEQ ID NO: 920738 - RNA, 19 nt, Homo sapiens
ucgcaggacucaugaagau

SEQ ID NO: 920739 - RNA, 19 nt, Homo sapiens
aaacguaggcgucuguguu

SEQ ID NO: 920740 - RNA, 19 nt, Homo sapiens
ggaaaaggaaccaaguuaa

SEQ ID NO: 920741 - RNA, 19 nt, Homo sapiens
gcacagcccaaacagacaa

SEQ ID NO: 920742 - RNA, 19 nt, Homo sapiens
gaggacauuagcauucuuu

SEQ ID NO: 920743 - RNA, 19 nt, Homo sapiens
uaacacaaggcuuacuuau

SEQ ID NO: 920744 - RNA, 19 nt, Homo sapiens
caaauccuaucaucaagcu

SEQ ID NO: 920745 - RNA, 19 nt, Homo sapiens
agaaagguguagaugugaa

SEQ ID NO: 920746 - RNA, 19 nt, Homo sapiens
acauuagcauucuuucuug

SEQ ID NO: 920747 - RNA, 19 nt, Homo sapiens
gauaacggagggaaggauu

SEQ ID NO: 920748 - RNA, 19 nt, Homo sapiens
ggaagaguuugauuuuguu

SEQ ID NO: 920749 - RNA, 19 nt, Homo sapiens
gccagcaaauuacuucauc

SEQ ID NO: 920750 - RNA, 19 nt, Homo sapiens
gagaaagguguagauguga

SEQ ID NO: 920751 - RNA, 19 nt, Homo sapiens
gaaaacgcaccaaaacuga

SEQ ID NO: 920752 - RNA, 19 nt, Homo sapiens
ggaggacauuagcauucuu

SEQ ID NO: 920753 - RNA, 19 nt, Homo sapiens
cacaaggcuuacuuauauu

SEQ ID NO: 920754 - RNA, 19 nt, Homo sapiens
ucaaagcacagcccaaaca

SEQ ID NO: 920755 - RNA, 19 nt, Homo sapiens
aacacaaggcuuacuuaua

SEQ ID NO: 920756 - RNA, 19 nt, Homo sapiens
gauaacaagguaacacaag

SEQ ID NO: 920757 - RNA, 19 nt, Homo sapiens
aaaacaauccccauuauga

SEQ ID NO: 920758 - RNA, 19 nt, Homo sapiens
caggugaggcauuagcuaa

SEQ ID NO: 920759 - RNA, 19 nt, Homo sapiens
ggaaauggcgcagauaacg

SEQ ID NO: 920760 - RNA, 19 nt, Homo sapiens
gauagggguuccuggauga

SEQ ID NO: 920761 - RNA, 19 nt, Homo sapiens
uccauucaguugauccuaa

SEQ ID NO: 920762 - RNA, 19 nt, Homo sapiens
cuaccaggcucggaacuuc

SEQ ID NO: 920763 - RNA, 19 nt, Homo sapiens
gaaguucagcauugaggau

SEQ ID NO: 920764 - RNA, 19 nt, Homo sapiens
ggugaggcauuagcuaaag

SEQ ID NO: 920765 - RNA, 19 nt, Homo sapiens
gacagaaccgagaagaguu

SEQ ID NO: 920766 - RNA, 19 nt, Homo sapiens
gagaaggaccaaggacaga

SEQ ID NO: 920767 - RNA, 19 nt, Homo sapiens
gggcuugcuugguaugcuu

SEQ ID NO: 920768 - RNA, 19 nt, Homo sapiens
ggauaacaagguaacacaa

SEQ ID NO: 920769 - RNA, 19 nt, Homo sapiens
caucuagauuauccauuca

SEQ ID NO: 920770 - RNA, 19 nt, Homo sapiens
ggaaaacgcaccaaaacug

SEQ ID NO: 920771 - RNA, 19 nt, Homo sapiens
ccagcaaauuacuucauca

SEQ ID NO: 920772 - RNA, 19 nt, Homo sapiens
gcugggaugguguucguaa

SEQ ID NO: 920773 - RNA, 19 nt, Homo sapiens
ccauucaguugauccuaau

SEQ ID NO: 920774 - RNA, 19 nt, Homo sapiens
gagauacugcugcuggaau

SEQ ID NO: 920775 - RNA, 19 nt, Homo sapiens
gcaaggauaacaagguaac

SEQ ID NO: 920776 - RNA, 19 nt, Homo sapiens
gaaagguguagaugugaag

SEQ ID NO: 920777 - RNA, 19 nt, Homo sapiens
ucuuguaucuccguugauu

SEQ ID NO: 920778 - RNA, 19 nt, Homo sapiens
agauacugcugcuggaaug

SEQ ID NO: 920779 - RNA, 19 nt, Homo sapiens
aaauaugguucucuucacu

SEQ ID NO: 920780 - RNA, 19 nt, Homo sapiens
guacaguuuguucggauga

SEQ ID NO: 920781 - RNA, 19 nt, Homo sapiens
gaccacacacaguuugaga

SEQ ID NO: 920782 - RNA, 19 nt, Homo sapiens
ggaugguguucguaacuac

SEQ ID NO: 920783 - RNA, 19 nt, Homo sapiens
ggacauuagcauucuuucu

SEQ ID NO: 920784 - RNA, 19 nt, Homo sapiens
uaacggagggaaggauuug

SEQ ID NO: 920785 - RNA, 19 nt, Homo sapiens
acagaaccgagaagaguuu

SEQ ID NO: 920786 - RNA, 19 nt, Homo sapiens
gaacuacauacugagauag

SEQ ID NO: 920787 - RNA, 19 nt, Homo sapiens
ugacccaucuagcaaagag

SEQ ID NO: 920788 - RNA, 19 nt, Homo sapiens
cuaauuagcaaggauaaca

SEQ ID NO: 920789 - RNA, 19 nt, Homo sapiens
gauggaaauggcgcagaua

SEQ ID NO: 920790 - RNA, 19 nt, Homo sapiens
guaucuccguugauuccaa

SEQ ID NO: 920791 - RNA, 19 nt, Homo sapiens
gaaccgagaagaguuuagg

SEQ ID NO: 920792 - RNA, 19 nt, Homo sapiens
ccaggaagaguuugauuuu

SEQ ID NO: 920793 - RNA, 19 nt, Homo sapiens
caguugauccuaauuagca

SEQ ID NO: 920794 - RNA, 19 nt, Homo sapiens
ucucaaagcacagcccaaa

SEQ ID NO: 920795 - RNA, 19 nt, Homo sapiens
agagagccgccuagagaaa

SEQ ID NO: 920796 - RNA, 19 nt, Homo sapiens
guagccagcaaauuacuuc

SEQ ID NO: 920797 - RNA, 19 nt, Homo sapiens
guucggaugaugaaacguu

SEQ ID NO: 920798 - RNA, 19 nt, Homo sapiens
caaagaggacaacccuaag

SEQ ID NO: 920799 - RNA, 19 nt, Homo sapiens
uuucuuguaucuccguuga

SEQ ID NO: 920800 - RNA, 19 nt, Homo sapiens
ccaaggacagaaccgagaa

SEQ ID NO: 920801 - RNA, 19 nt, Homo sapiens
gaaaaggaaccaaguuaac

SEQ ID NO: 920802 - RNA, 19 nt, Homo sapiens
cccaggaagaguuugauuu

SEQ ID NO: 920803 - RNA, 19 nt, Homo sapiens
gucggagucugcagagugu

SEQ ID NO: 920804 - RNA, 19 nt, Homo sapiens
ccagaccacacacaguuug

SEQ ID NO: 920805 - RNA, 19 nt, Homo sapiens
cauuagcauucuuucuugu

SEQ ID NO: 920806 - RNA, 19 nt, Homo sapiens
aaaggaaccaaguuaacug

SEQ ID NO: 920807 - RNA, 19 nt, Homo sapiens
uagagaaagguguagaugu

SEQ ID NO: 920808 - RNA, 19 nt, Homo sapiens
cagagagccgccuagagaa

SEQ ID NO: 920809 - RNA, 19 nt, Homo sapiens
cagaagaacugguaccaua

SEQ ID NO: 920810 - RNA, 19 nt, Homo sapiens
gaauauggccgauaagaaa

SEQ ID NO: 920811 - RNA, 19 nt, Homo sapiens
guacucauaugucucauuu

SEQ ID NO: 920812 - RNA, 19 nt, Homo sapiens
gcagaguuguuaaagagua

SEQ ID NO: 920813 - RNA, 19 nt, Homo sapiens
gaagcagaguuguuaaaga

SEQ ID NO: 920814 - RNA, 19 nt, Homo sapiens
caagaagucuggacauugu

SEQ ID NO: 920815 - RNA, 19 nt, Homo sapiens
caaggaagcagaguuguua

SEQ ID NO: 920816 - RNA, 19 nt, Homo sapiens
ggaucuauauucccuuauu

SEQ ID NO: 920817 - RNA, 19 nt, Homo sapiens
guuaaagaguacuggaaua

SEQ ID NO: 920818 - RNA, 19 nt, Homo sapiens
caggauggguggugaauau

SEQ ID NO: 920819 - RNA, 19 nt, Homo sapiens
gcaaaccuguuccauucuu

SEQ ID NO: 920820 - RNA, 19 nt, Homo sapiens
uaacccagcuugucaaugg

SEQ ID NO: 920821 - RNA, 19 nt, Homo sapiens
gaagaacugguaccauauu

SEQ ID NO: 920822 - RNA, 19 nt, Homo sapiens
gaucuauauucccuuauug

SEQ ID NO: 920823 - RNA, 19 nt, Homo sapiens
ggagaaaggcaaagaggaa

SEQ ID NO: 920824 - RNA, 19 nt, Homo sapiens
ucaauagacugcaguaucu

SEQ ID NO: 920825 - RNA, 19 nt, Homo sapiens
cgaaggacauaguuucaga

SEQ ID NO: 920826 - RNA, 19 nt, Homo sapiens
gaacugguaccauauuaca

SEQ ID NO: 920827 - RNA, 19 nt, Homo sapiens
aagaacugguaccauauua

SEQ ID NO: 920828 - RNA, 19 nt, Homo sapiens
gagaagagguagaaaaugu

SEQ ID NO: 920829 - RNA, 19 nt, Homo sapiens
uaccugauaucacuaaaga

SEQ ID NO: 920830 - RNA, 19 nt, Homo sapiens
ggaaguaugguuauaucuu

SEQ ID NO: 920831 - RNA, 19 nt, Homo sapiens
gacuugaacucgccaggaa

SEQ ID NO: 920832 - RNA, 19 nt, Homo sapiens
agacugcaguaucuuauug

SEQ ID NO: 920833 - RNA, 19 nt, Homo sapiens
caaaccuguuccauucuuu

SEQ ID NO: 920834 - RNA, 19 nt, Homo sapiens
ggcggauccugccaaauuu

SEQ ID NO: 920835 - RNA, 19 nt, Homo sapiens
gaaacaaggacugcauaga

SEQ ID NO: 920836 - RNA, 19 nt, Homo sapiens
gccaggaaguaugguuaua

SEQ ID NO: 920837 - RNA, 19 nt, Homo sapiens
gauccuagucaaccuauug

SEQ ID NO: 920838 - RNA, 19 nt, Homo sapiens
aagcagaguuguuaaagag

SEQ ID NO: 920839 - RNA, 19 nt, Homo sapiens
cauauuacacugaugcaaa

SEQ ID NO: 920840 - RNA, 19 nt, Homo sapiens
gcaguaucuuauugauuug

SEQ ID NO: 920841 - RNA, 19 nt, Homo sapiens
uaacgaaggacauaguuuc

SEQ ID NO: 920842 - RNA, 19 nt, Homo sapiens
augcaaaccuguuccauuc

SEQ ID NO: 920843 - RNA, 19 nt, Homo sapiens
ccaagaaaccggagagaag

SEQ ID NO: 920844 - RNA, 19 nt, Homo sapiens
caagaaaccggagagaaga

SEQ ID NO: 920845 - RNA, 19 nt, Homo sapiens
caggaaguaugguuauauc

SEQ ID NO: 920846 - RNA, 19 nt, Homo sapiens
ggagaggugugaccaucca

SEQ ID NO: 920847 - RNA, 19 nt, Homo sapiens
gaacucgccaggaaguaug

SEQ ID NO: 920848 - RNA, 19 nt, Homo sapiens
cggcaaaaguuaauauuga

SEQ ID NO: 920849 - RNA, 19 nt, Homo sapiens
ugaauauggccgauaagaa

SEQ ID NO: 920850 - RNA, 19 nt, Homo sapiens
uggugaauauggccgauaa

SEQ ID NO: 920851 - RNA, 19 nt, Homo sapiens
ccaagaagucuggacauug

SEQ ID NO: 920852 - RNA, 19 nt, Homo sapiens
ggaaacaaggacugcauag

SEQ ID NO: 920853 - RNA, 19 nt, Homo sapiens
gcugaaggaucuauauucc

SEQ ID NO: 920854 - RNA, 19 nt, Homo sapiens
aaaaugcucuguacuagga

SEQ ID NO: 920855 - RNA, 19 nt, Homo sapiens
uuacuacagccuucuauga

SEQ ID NO: 920856 - RNA, 19 nt, Homo sapiens
ggaagcagaguuguuaaag

SEQ ID NO: 920857 - RNA, 19 nt, Homo sapiens
cagaggccauaaaggagaa

SEQ ID NO: 920858 - RNA, 19 nt, Homo sapiens
gauguuacuuuucagugua

SEQ ID NO: 920859 - RNA, 19 nt, Homo sapiens
uaaaggagaaaggcaaaga

SEQ ID NO: 920860 - RNA, 19 nt, Homo sapiens
cagauggugauguuacuuu

SEQ ID NO: 920861 - RNA, 19 nt, Homo sapiens
ccugauaucacuaaagaug

SEQ ID NO: 920862 - RNA, 19 nt, Homo sapiens
aauagacugcaguaucuua

SEQ ID NO: 920863 - RNA, 19 nt, Homo sapiens
ccaaggaagcagaguuguu

SEQ ID NO: 920864 - RNA, 19 nt, Homo sapiens
ggaaggauccaaggcagau

SEQ ID NO: 920865 - RNA, 19 nt, Homo sapiens
aagaaugcuuccaccagaa

SEQ ID NO: 920866 - RNA, 19 nt, Homo sapiens
gaaucccggcuccaagaaa

SEQ ID NO: 920867 - RNA, 19 nt, Homo sapiens
gagccuggccaacuuaaag

SEQ ID NO: 920868 - RNA, 19 nt, Homo sapiens
uuaaauggcaggaaacaag

SEQ ID NO: 920869 - RNA, 19 nt, Homo sapiens
ucaguguacucauaugucu

SEQ ID NO: 920870 - RNA, 19 nt, Homo sapiens
gggcugaaggaucuauauu

SEQ ID NO: 920871 - RNA, 19 nt, Homo sapiens
ggucggagaagagguagaa

SEQ ID NO: 920872 - RNA, 19 nt, Homo sapiens
cauaaaggagaaaggcaaa

SEQ ID NO: 920873 - RNA, 19 nt, Homo sapiens
ccuaaaaccuacagaugaa

SEQ ID NO: 920874 - RNA, 19 nt, Homo sapiens
ccuguuccauucuuucuuc

SEQ ID NO: 920875 - RNA, 19 nt, Homo sapiens
gguaccauauuacacugau

SEQ ID NO: 920876 - RNA, 19 nt, Homo sapiens
cuucagaacuagcuauugc

SEQ ID NO: 920877 - RNA, 19 nt, Homo sapiens
ugauuugggucguguugau

SEQ ID NO: 920878 - RNA, 19 nt, Homo sapiens
cuugaaaguucuuggaucu

SEQ ID NO: 920879 - RNA, 19 nt, Homo sapiens
ccaggaaguaugguuauau

SEQ ID NO: 920880 - RNA, 19 nt, Homo sapiens
aguauaagccuuugagucu

SEQ ID NO: 920881 - RNA, 19 nt, Homo sapiens
gugaauauggccgauaaga

SEQ ID NO: 920882 - RNA, 19 nt, Homo sapiens
uaugcaaaccuguuccauu

SEQ ID NO: 920883 - RNA, 19 nt, Homo sapiens
caaggcagauuuucuuugg

SEQ ID NO: 920884 - RNA, 19 nt, Homo sapiens
gugugagccuggccaacuu

SEQ ID NO: 920885 - RNA, 19 nt, Homo sapiens
gcuauugcugccauugaaa

SEQ ID NO: 920886 - RNA, 19 nt, Homo sapiens
aaguacaguuggcuucaga

SEQ ID NO: 920887 - RNA, 19 nt, Homo sapiens
uuaaagaguacuggaauag

SEQ ID NO: 920888 - RNA, 19 nt, Homo sapiens
agaagaacugguaccauau

SEQ ID NO: 920889 - RNA, 19 nt, Homo sapiens
gaagucuggacauuguaug

SEQ ID NO: 920890 - RNA, 19 nt, Homo sapiens
gaggccagacuccauuuua

SEQ ID NO: 920891 - RNA, 19 nt, Homo sapiens
accaagaggucggagaaga

SEQ ID NO: 920892 - RNA, 19 nt, Homo sapiens
ggcugaaggaucuauauuc

SEQ ID NO: 920893 - RNA, 19 nt, Homo sapiens
guccaaggaagcagaguug

SEQ ID NO: 920894 - RNA, 19 nt, Homo sapiens
caaaauacggguuuaacga

SEQ ID NO: 920895 - RNA, 19 nt, Homo sapiens
ugccaaauuuccugaagca

SEQ ID NO: 920896 - RNA, 19 nt, Homo sapiens
guaccauauuacacugaug

SEQ ID NO: 920897 - RNA, 19 nt, Homo sapiens
ggguuuaacgaaggacaua

SEQ ID NO: 920898 - RNA, 19 nt, Homo sapiens
agaggucggagaagaggua

SEQ ID NO: 920899 - RNA, 19 nt, Homo sapiens
gaaggauccaaggcagauu

SEQ ID NO: 920900 - RNA, 19 nt, Homo sapiens
ucaaaaugcucuguacuag

SEQ ID NO: 920901 - RNA, 19 nt, Homo sapiens
auauuacacugaugcaaag

SEQ ID NO: 920902 - RNA, 19 nt, Homo sapiens
gacuuaacccagcuuguca

SEQ ID NO: 920903 - RNA, 19 nt, Homo sapiens
uuaacgaaggacauaguuu

SEQ ID NO: 920904 - RNA, 19 nt, Homo sapiens
ugacuuaacccagcuuguc

SEQ ID NO: 920905 - RNA, 19 nt, Homo sapiens
ccgaaucccggcuccaaga

SEQ ID NO: 920906 - RNA, 19 nt, Homo sapiens
uuacacugaugcaaagaac

SEQ ID NO: 920907 - RNA, 19 nt, Homo sapiens
acuacagccuucuaugauc

SEQ ID NO: 920908 - RNA, 19 nt, Homo sapiens
acucauaugucucauuuuc

SEQ ID NO: 920909 - RNA, 19 nt, Homo sapiens
caacacaccuuaugagaaa

SEQ ID NO: 920910 - RNA, 19 nt, Homo sapiens
ugacauauccucagaauuu

SEQ ID NO: 920911 - RNA, 19 nt, Homo sapiens
guacacaacucaacacaga

SEQ ID NO: 920912 - RNA, 19 nt, Homo sapiens
ccugcgagcucaaauauua

SEQ ID NO: 920913 - RNA, 19 nt, Homo sapiens
aggaagagaugcuugauaa

SEQ ID NO: 920914 - RNA, 19 nt, Homo sapiens
agagagagcugcacauguu

SEQ ID NO: 920915 - RNA, 19 nt, Homo sapiens
gaaguuaucauuccugaga

SEQ ID NO: 920916 - RNA, 19 nt, Homo sapiens
gacauauccucagaauuua

SEQ ID NO: 920917 - RNA, 19 nt, Homo sapiens
gaucuaaguugccuaccuu

SEQ ID NO: 920918 - RNA, 19 nt, Homo sapiens
gaaggccagucagcuagua

SEQ ID NO: 920919 - RNA, 19 nt, Homo sapiens
gaagagaugcuugauaauc

SEQ ID NO: 920920 - RNA, 19 nt, Homo sapiens
gcucauggcugacauaucc

SEQ ID NO: 920921 - RNA, 19 nt, Homo sapiens
caucuuaguuaauguguuc

SEQ ID NO: 920922 - RNA, 19 nt, Homo sapiens
gaagagagagcugcacaug

SEQ ID NO: 920923 - RNA, 19 nt, Homo sapiens
gaggaagagaugcuugaua

SEQ ID NO: 920924 - RNA, 19 nt, Homo sapiens
uaaguugccuaccuugaau

SEQ ID NO: 920925 - RNA, 19 nt, Homo sapiens
ccugagagguacccauuug

SEQ ID NO: 920926 - RNA, 19 nt, Homo sapiens
gagagagcugcacauguua

SEQ ID NO: 920927 - RNA, 19 nt, Homo sapiens
ggauuugucuggauguucu

SEQ ID NO: 920928 - RNA, 19 nt, Homo sapiens
ccucagauccgauuucuca

SEQ ID NO: 920929 - RNA, 19 nt, Homo sapiens
cgauuucucacuccaauuu

SEQ ID NO: 920930 - RNA, 19 nt, Homo sapiens
gcgcguugcugcguuguga

SEQ ID NO: 920931 - RNA, 19 nt, Homo sapiens
gagccaacacaccuuauga

SEQ ID NO: 920932 - RNA, 19 nt, Homo sapiens
acaaaaggcugaugaggaa

SEQ ID NO: 920933 - RNA, 19 nt, Homo sapiens
gcaagauaaagaccaaaug

SEQ ID NO: 920934 - RNA, 19 nt, Homo sapiens
gucuggauguucucaaauu

SEQ ID NO: 920935 - RNA, 19 nt, Homo sapiens
ccaacacaccuuaugagaa

SEQ ID NO: 920936 - RNA, 19 nt, Homo sapiens
gaccugcgagcucaaauau

SEQ ID NO: 920937 - RNA, 19 nt, Homo sapiens
gaagcaugcaagacagaaa

SEQ ID NO: 920938 - RNA, 19 nt, Homo sapiens
ucacauguuggcaagauaa

SEQ ID NO: 920939 - RNA, 19 nt, Homo sapiens
cagagaagcaugcaagaca

SEQ ID NO: 920940 - RNA, 19 nt, Homo sapiens
auaaagaccaaauggauga

SEQ ID NO: 920941 - RNA, 19 nt, Homo sapiens
caagauaaagaccaaaugg

SEQ ID NO: 920942 - RNA, 19 nt, Homo sapiens
guucucaaauugccaccaa

SEQ ID NO: 920943 - RNA, 19 nt, Homo sapiens
caucacauguuggcaagau

SEQ ID NO: 920944 - RNA, 19 nt, Homo sapiens
gccagacaguggacagaga

SEQ ID NO: 920945 - RNA, 19 nt, Homo sapiens
cuaaguugccuaccuugaa

SEQ ID NO: 920946 - RNA, 19 nt, Homo sapiens
acacaacucaacacagaaa

SEQ ID NO: 920947 - RNA, 19 nt, Homo sapiens
ggaagagaugcuugauaau

SEQ ID NO: 920948 - RNA, 19 nt, Homo sapiens
gagaagcaugcaagacaga

SEQ ID NO: 920949 - RNA, 19 nt, Homo sapiens
gauuucucacuccaauuua

SEQ ID NO: 920950 - RNA, 19 nt, Homo sapiens
ugaccugcgagcucaaaua

SEQ ID NO: 920951 - RNA, 19 nt, Homo sapiens
cuauucagcugcucauguc

SEQ ID NO: 920952 - RNA, 19 nt, Homo sapiens
gagaccaucccucaacauc

SEQ ID NO: 920953 - RNA, 19 nt, Homo sapiens
cauguuggcaagauaaaga

SEQ ID NO: 920954 - RNA, 19 nt, Homo sapiens
ugagagguacccauuugaa

SEQ ID NO: 920955 - RNA, 19 nt, Homo sapiens
gccaacacaccuuaugaga

SEQ ID NO: 920956 - RNA, 19 nt, Homo sapiens
aagccagccuuccucaaga

SEQ ID NO: 920957 - RNA, 19 nt, Homo sapiens
agauaaagaccaaauggau

SEQ ID NO: 920958 - RNA, 19 nt, Homo sapiens
ugauucugcuggaaggauu

SEQ ID NO: 920959 - RNA, 19 nt, Homo sapiens
ggagccaacacaccuuaug

SEQ ID NO: 920960 - RNA, 19 nt, Homo sapiens
ccugguucaucuuaguuaa

SEQ ID NO: 920961 - RNA, 19 nt, Homo sapiens
caugcaagacagaaacaaa

SEQ ID NO: 920962 - RNA, 19 nt, Homo sapiens
gccaaggugaucuaaguug

SEQ ID NO: 920963 - RNA, 19 nt, Homo sapiens
ucuggauguucucaaauug

SEQ ID NO: 920964 - RNA, 19 nt, Homo sapiens
cagcuaguaggcauagaaa

SEQ ID NO: 920965 - RNA, 19 nt, Homo sapiens
guggagccaacacaccuua

SEQ ID NO: 920966 - RNA, 19 nt, Homo sapiens
uugccaaggugaucuaagu

SEQ ID NO: 920967 - RNA, 19 nt, Homo sapiens
ccagacaguggacagagaa

SEQ ID NO: 920968 - RNA, 19 nt, Homo sapiens
uaagccagccuuccucaag

SEQ ID NO: 920969 - RNA, 19 nt, Homo sapiens
gcuagaaguuaucauuccu

SEQ ID NO: 920970 - RNA, 19 nt, Homo sapiens
ugguucaucuuaguuaaug

SEQ ID NO: 920971 - RNA, 19 nt, Homo sapiens
aaggaaggccagucagcua

SEQ ID NO: 920972 - RNA, 19 nt, Homo sapiens
gacagagaagcaugcaaga

SEQ ID NO: 920973 - RNA, 19 nt, Homo sapiens
ggcaagauaaagaccaaau

SEQ ID NO: 920974 - RNA, 19 nt, Homo sapiens
gagagguacccauuugaac

SEQ ID NO: 920975 - RNA, 19 nt, Homo sapiens
uaguuaauguguucuuugc

SEQ ID NO: 920976 - RNA, 19 nt, Homo sapiens
ucagcuaguaggcauagaa

SEQ ID NO: 920977 - RNA, 19 nt, Homo sapiens
gaaggauuugucuggaugu

SEQ ID NO: 920978 - RNA, 19 nt, Homo sapiens
uggaaggauuugucuggau

SEQ ID NO: 920979 - RNA, 19 nt, Homo sapiens
cauuugaaccuccucagau

SEQ ID NO: 920980 - RNA, 19 nt, Homo sapiens
gaugaccugcgagcucaaa

SEQ ID NO: 920981 - RNA, 19 nt, Homo sapiens
cagccuuccucaagaaugc

SEQ ID NO: 920982 - RNA, 19 nt, Homo sapiens
ggaaggccagucagcuagu

SEQ ID NO: 920983 - RNA, 19 nt, Homo sapiens
gaugcuugauaaucuacca

SEQ ID NO: 920984 - RNA, 19 nt, Homo sapiens
cagaacccaacccugauga

SEQ ID NO: 920985 - RNA, 19 nt, Homo sapiens
gacuuguccugguucaucu

SEQ ID NO: 920986 - RNA, 19 nt, Homo sapiens
gacaguggacagagaagca

SEQ ID NO: 920987 - RNA, 19 nt, Homo sapiens
uggagaccaucccucaaca

SEQ ID NO: 920988 - RNA, 19 nt, Homo sapiens
ccauuugaaccuccucaga

SEQ ID NO: 920989 - RNA, 19 nt, Homo sapiens
cauaaugucugcagaauaa

SEQ ID NO: 920990 - RNA, 19 nt, Homo sapiens
gauaaucgaucccaagaug

SEQ ID NO: 920991 - RNA, 19 nt, Homo sapiens
gaugugggcuucaauauca

SEQ ID NO: 920992 - RNA, 19 nt, Homo sapiens
gaaagaagccggaagagau

SEQ ID NO: 920993 - RNA, 19 nt, Homo sapiens
cgaccuagauguauucuug

SEQ ID NO: 920994 - RNA, 19 nt, Homo sapiens
cccuaaagcuuuccuaauu

SEQ ID NO: 920995 - RNA, 19 nt, Homo sapiens
uaacaaagcguacuugaag

SEQ ID NO: 920996 - RNA, 19 nt, Homo sapiens
cauuacagguggcuuguuu

SEQ ID NO: 920997 - RNA, 19 nt, Homo sapiens
gcagguuucugauggaugu

SEQ ID NO: 920998 - RNA, 19 nt, Homo sapiens
guguauggcuuauaaagug

SEQ ID NO: 920999 - RNA, 19 nt, Homo sapiens
caagcaagcagguuucuga

SEQ ID NO: 921000 - RNA, 19 nt, Homo sapiens
ccuaaagcuuuccuaauug

SEQ ID NO: 921001 - RNA, 19 nt, Homo sapiens
gaucccaagaugauuaaua

SEQ ID NO: 921002 - RNA, 19 nt, Homo sapiens
gaaguggugaauaugauuu

SEQ ID NO: 921003 - RNA, 19 nt, Homo sapiens
gcauaaugucugcagaaua

SEQ ID NO: 921004 - RNA, 19 nt, Homo sapiens
gaaccgccgucccaacauc

SEQ ID NO: 921005 - RNA, 19 nt, Homo sapiens
aggaguguauggcuuauaa

SEQ ID NO: 921006 - RNA, 19 nt, Homo sapiens
aaacguauaggcuugagua

SEQ ID NO: 921007 - RNA, 19 nt, Homo sapiens
gaaagagaacccaggaagu

SEQ ID NO: 921008 - RNA, 19 nt, Homo sapiens
guagugaacccuaaagcuu

SEQ ID NO: 921009 - RNA, 19 nt, Homo sapiens
ugugugaaauucuacauug

SEQ ID NO: 921010 - RNA, 19 nt, Homo sapiens
ugccauacaucgugcuuaa

SEQ ID NO: 921011 - RNA, 19 nt, Homo sapiens
cuaaagcuuuccuaauugu

SEQ ID NO: 921012 - RNA, 19 nt, Homo sapiens
agaaggaguguauggcuua

SEQ ID NO: 921013 - RNA, 19 nt, Homo sapiens
cccaggaaguggugaauau

SEQ ID NO: 921014 - RNA, 19 nt, Homo sapiens
gaaggaguguauggcuuau

SEQ ID NO: 921015 - RNA, 19 nt, Homo sapiens
ggaaguggugaauaugauu

SEQ ID NO: 921016 - RNA, 19 nt, Homo sapiens
gcugcgaccuagauguauu

SEQ ID NO: 921017 - RNA, 19 nt, Homo sapiens
aagcguacuugaagacuga

SEQ ID NO: 921018 - RNA, 19 nt, Homo sapiens
aaagaagccggaagagauu

SEQ ID NO: 921019 - RNA, 19 nt, Homo sapiens
ccuagaagaacuauuauca

SEQ ID NO: 921020 - RNA, 19 nt, Homo sapiens
gagaugugggcuucaauau

SEQ ID NO: 921021 - RNA, 19 nt, Homo sapiens
ggugaucggugucuuuggu

SEQ ID NO: 921022 - RNA, 19 nt, Homo sapiens
gauauaugggagagccuua

SEQ ID NO: 921023 - RNA, 19 nt, Homo sapiens
ugagaugugggcuucaaua

SEQ ID NO: 921024 - RNA, 19 nt, Homo sapiens
gugugaaauucuacauuga

SEQ ID NO: 921025 - RNA, 19 nt, Homo sapiens
gagcccaguuugagaugug

SEQ ID NO: 921026 - RNA, 19 nt, Homo sapiens
cagaauguguucaaaagaa

SEQ ID NO: 921027 - RNA, 19 nt, Homo sapiens
ucugauggauguugaaugg

SEQ ID NO: 921028 - RNA, 19 nt, Homo sapiens
caagcagguuucugaugga

SEQ ID NO: 921029 - RNA, 19 nt, Homo sapiens
ggaagagauuuuaccuauu

SEQ ID NO: 921030 - RNA, 19 nt, Homo sapiens
aaagagaacccaggaagug

SEQ ID NO: 921031 - RNA, 19 nt, Homo sapiens
cggaagagauuuuaccuau

SEQ ID NO: 921032 - RNA, 19 nt, Homo sapiens
gcacagguccucggcaaag

SEQ ID NO: 921033 - RNA, 19 nt, Homo sapiens
cagcugccuuccagaaugu

SEQ ID NO: 921034 - RNA, 19 nt, Homo sapiens
cauguguagugaacccuaa

SEQ ID NO: 921035 - RNA, 19 nt, Homo sapiens
ucccuaagcggaacgauuu

SEQ ID NO: 921036 - RNA, 19 nt, Homo sapiens
aacaccaucuuucgugauu

SEQ ID NO: 921037 - RNA, 19 nt, Homo sapiens
uagugaacccuaaagcuuu

SEQ ID NO: 921038 - RNA, 19 nt, Homo sapiens
ucacagcugccuuccagaa

SEQ ID NO: 921039 - RNA, 19 nt, Homo sapiens
caggaaguggugaauauga

SEQ ID NO: 921040 - RNA, 19 nt, Homo sapiens
aaagaugggcugaaacaca

SEQ ID NO: 921041 - RNA, 19 nt, Homo sapiens
ggaagcaaggaacggugua

SEQ ID NO: 921042 - RNA, 19 nt, Homo sapiens
ugaaagaagccggaagaga

SEQ ID NO: 921043 - RNA, 19 nt, Homo sapiens
caccaucuuucgugauuag

SEQ ID NO: 921044 - RNA, 19 nt, Homo sapiens
gacucaaucaugacaauau

SEQ ID NO: 921045 - RNA, 19 nt, Homo sapiens
uaaucaagcaagcagguuu

SEQ ID NO: 921046 - RNA, 19 nt, Homo sapiens
acagcugccuuccagaaug

SEQ ID NO: 921047 - RNA, 19 nt, Homo sapiens
cccauguaauguaaacgua

SEQ ID NO: 921048 - RNA, 19 nt, Homo sapiens
gguguaugcgcaagugaaa

SEQ ID NO: 921049 - RNA, 19 nt, Homo sapiens
uaugggagagccuuagaaa

SEQ ID NO: 921050 - RNA, 19 nt, Homo sapiens
gcagcaaacaagugucugu

SEQ ID NO: 921051 - RNA, 19 nt, Homo sapiens
ggaagguagacaucagguu

SEQ ID NO: 921052 - RNA, 19 nt, Homo sapiens
gaacccaggaaguggugaa

SEQ ID NO: 921053 - RNA, 19 nt, Homo sapiens
gaagcaaggaacgguguau

SEQ ID NO: 921054 - RNA, 19 nt, Homo sapiens
ccauacaucgugcuuaaca

SEQ ID NO: 921055 - RNA, 19 nt, Homo sapiens
gaggugaucggugucuuug

SEQ ID NO: 921056 - RNA, 19 nt, Homo sapiens
ccaguccuagcaagauaua

SEQ ID NO: 921057 - RNA, 19 nt, Homo sapiens
cauacaucgugcuuaacaa

SEQ ID NO: 921058 - RNA, 19 nt, Homo sapiens
gugaacaugauuuguacuu

SEQ ID NO: 921059 - RNA, 19 nt, Homo sapiens
uguauggcuuauaaaguga

SEQ ID NO: 921060 - RNA, 19 nt, Homo sapiens
gacaagaaggaguguaugg

SEQ ID NO: 921061 - RNA, 19 nt, Homo sapiens
auacaucgugcuuaacaaa

SEQ ID NO: 921062 - RNA, 19 nt, Homo sapiens
acaccaucuuucgugauua

SEQ ID NO: 921063 - RNA, 19 nt, Homo sapiens
gaguguauggcuuauaaag

SEQ ID NO: 921064 - RNA, 19 nt, Homo sapiens
gaaagacaagaaggagugu

SEQ ID NO: 921065 - RNA, 19 nt, Homo sapiens
aacaaagcguacuugaaga

SEQ ID NO: 921066 - RNA, 19 nt, Homo sapiens
uuaacaaagcguacuugaa

SEQ ID NO: 921067 - RNA, 19 nt, Homo sapiens
ggaguguauggcuuauaaa

SEQ ID NO: 921068 - RNA, 19 nt, Homo sapiens
uguaaaagaugggcugaaa

SEQ ID NO: 921069 - RNA, 19 nt, Homo sapiens
gcauuuaaacaaacuagac

SEQ ID NO: 921070 - RNA, 19 nt, Homo sapiens
gaacccuaaagcuuuccua

SEQ ID NO: 921071 - RNA, 19 nt, Homo sapiens
gguuucugauggauguuga

SEQ ID NO: 921072 - RNA, 19 nt, Homo sapiens
uaaucgaucccaagaugau

SEQ ID NO: 921073 - RNA, 19 nt, Homo sapiens
gaacgguguaugcgcaagu

SEQ ID NO: 921074 - RNA, 19 nt, Homo sapiens
ugaggugaucggugucuuu

SEQ ID NO: 921075 - RNA, 19 nt, Homo sapiens
gggcuucaauaucaaaaga

SEQ ID NO: 921076 - RNA, 19 nt, Homo sapiens
aggaaguggugaauaugau

SEQ ID NO: 921077 - RNA, 19 nt, Homo sapiens
aagauaaucgaucccaaga

SEQ ID NO: 921078 - RNA, 19 nt, Homo sapiens
uaacaccccauguaaugua

SEQ ID NO: 921079 - RNA, 19 nt, Homo sapiens
ugacucaaucaugacaaua

SEQ ID NO: 921080 - RNA, 19 nt, Homo sapiens
ccgugaacaugauuuguac

SEQ ID NO: 921081 - RNA, 19 nt, Homo sapiens
aagacaagaaggaguguau

SEQ ID NO: 921082 - RNA, 19 nt, Homo sapiens
uguaugcgcaagugaaaga

SEQ ID NO: 921083 - RNA, 19 nt, Homo sapiens
uccgugaacaugauuugua

SEQ ID NO: 921084 - RNA, 19 nt, Homo sapiens
agugaacccuaaagcuuuc

SEQ ID NO: 921085 - RNA, 19 nt, Homo sapiens
uaaaagaugggcugaaaca

SEQ ID NO: 921086 - RNA, 19 nt, Homo sapiens
acgcugcgaccuagaugua

SEQ ID NO: 921087 - RNA, 19 nt, Homo sapiens
cauuuacgcugcggaaacu

SEQ ID NO: 921088 - RNA, 19 nt, Homo sapiens
auccaguccuagcaagaua

SEQ ID NO: 921089 - RNA, 19 nt, Homo sapiens
gaagugcagucccaacuaa

SEQ ID NO: 921090 - RNA, 19 nt, Homo sapiens
gcacaaauguugagaaacu

SEQ ID NO: 921091 - RNA, 19 nt, Homo sapiens
ucacaaaggucaaacaguu

SEQ ID NO: 921092 - RNA, 19 nt, Homo sapiens
aaacagcagucuuagauuu

SEQ ID NO: 921093 - RNA, 19 nt, Homo sapiens
gaacagcgcccagcaguuu

SEQ ID NO: 921094 - RNA, 19 nt, Homo sapiens
gaccuccgcuugcuucuuu

SEQ ID NO: 921095 - RNA, 19 nt, Homo sapiens
ggaaacagcauccuccauu

SEQ ID NO: 921096 - RNA, 19 nt, Homo sapiens
aagaaaggguguugcauuu

SEQ ID NO: 921097 - RNA, 19 nt, Homo sapiens
gaaacagcauccuccauuc

SEQ ID NO: 921098 - RNA, 19 nt, Homo sapiens
ggucaaggcgaauauuuaa

SEQ ID NO: 921099 - RNA, 19 nt, Homo sapiens
ggacaggaagccagaguuu

SEQ ID NO: 921100 - RNA, 19 nt, Homo sapiens
gcacguuuccuguuuagaa

SEQ ID NO: 921101 - RNA, 19 nt, Homo sapiens
gucaagcagugauuaguuu

SEQ ID NO: 921102 - RNA, 19 nt, Homo sapiens
gcugggagcuguccaaguc

SEQ ID NO: 921103 - RNA, 19 nt, Homo sapiens
cagaagaccugaagaacag

SEQ ID NO: 921104 - RNA, 19 nt, Homo sapiens
gagcagaggagaagacaga

SEQ ID NO: 921105 - RNA, 19 nt, Homo sapiens
cggcagaguuugauuuguu

SEQ ID NO: 921106 - RNA, 19 nt, Homo sapiens
aagcacaaauguugagaaa

SEQ ID NO: 921107 - RNA, 19 nt, Homo sapiens
gcacaagcuugccaugaag

SEQ ID NO: 921108 - RNA, 19 nt, Homo sapiens
uuaaugguaucgauccuaa

SEQ ID NO: 921109 - RNA, 19 nt, Homo sapiens
aaacugcacugagucuaaa

SEQ ID NO: 921110 - RNA, 19 nt, Homo sapiens
gagcagcuucgccagguua

SEQ ID NO: 921111 - RNA, 19 nt, Homo sapiens
gcugcacguuuccuguuua

SEQ ID NO: 921112 - RNA, 19 nt, Homo sapiens
ggaagccagaguuuauuaa

SEQ ID NO: 921113 - RNA, 19 nt, Homo sapiens
aaacuggcaacauguauuu

SEQ ID NO: 921114 - RNA, 19 nt, Homo sapiens
guguauguguguauaugua

SEQ ID NO: 921115 - RNA, 19 nt, Homo sapiens
ccaugaagcacaaauguug

SEQ ID NO: 921116 - RNA, 19 nt, Homo sapiens
gaagacagaagaccugaag

SEQ ID NO: 921117 - RNA, 19 nt, Homo sapiens
agucuaaacuggcaacaug

SEQ ID NO: 921118 - RNA, 19 nt, Homo sapiens
aaagaaaggguguugcauu

SEQ ID NO: 921119 - RNA, 19 nt, Homo sapiens
uaaacugcacugagucuaa

SEQ ID NO: 921120 - RNA, 19 nt, Homo sapiens
gaggucaaggcgaauauuu

SEQ ID NO: 921121 - RNA, 19 nt, Homo sapiens
aaaguucugcuccuucaua

SEQ ID NO: 921122 - RNA, 19 nt, Homo sapiens
ugaaggcuccacaucauuu

SEQ ID NO: 921123 - RNA, 19 nt, Homo sapiens
gcuaucagcaaggaaauuu

SEQ ID NO: 921124 - RNA, 19 nt, Homo sapiens
cgcacaagcuugccaugaa

SEQ ID NO: 921125 - RNA, 19 nt, Homo sapiens
gacaggaagccagaguuua

SEQ ID NO: 921126 - RNA, 19 nt, Homo sapiens
ggcagaguuugauuuguug

SEQ ID NO: 921127 - RNA, 19 nt, Homo sapiens
caaggcgaauauuuaacuu

SEQ ID NO: 921128 - RNA, 19 nt, Homo sapiens
agacagaagaccugaagaa

SEQ ID NO: 921129 - RNA, 19 nt, Homo sapiens
gaguuugauuuguuguuug

SEQ ID NO: 921130 - RNA, 19 nt, Homo sapiens
uguccuagcuacacuuaau

SEQ ID NO: 921131 - RNA, 19 nt, Homo sapiens
acacaggcguccaucacaa

SEQ ID NO: 921132 - RNA, 19 nt, Homo sapiens
gcccagcaguuugcagaaa

SEQ ID NO: 921133 - RNA, 19 nt, Homo sapiens
acaggaagccagaguuuau

SEQ ID NO: 921134 - RNA, 19 nt, Homo sapiens
ucaagaggaggacaaagaa

SEQ ID NO: 921135 - RNA, 19 nt, Homo sapiens
gaagcacaaauguugagaa

SEQ ID NO: 921136 - RNA, 19 nt, Homo sapiens
caacuaaaaggcugcguua

SEQ ID NO: 921137 - RNA, 19 nt, Homo sapiens
gugcuguccucacuuguuc

SEQ ID NO: 921138 - RNA, 19 nt, Homo sapiens
cagaggagaagacagaaga

SEQ ID NO: 921139 - RNA, 19 nt, Homo sapiens
gaaggcuccacaucauuug

SEQ ID NO: 921140 - RNA, 19 nt, Homo sapiens
gucaagaggaggacaaaga

SEQ ID NO: 921141 - RNA, 19 nt, Homo sapiens
uaaacuggcaacauguauu

SEQ ID NO: 921142 - RNA, 19 nt, Homo sapiens
gggauucggcagaguuuga

SEQ ID NO: 921143 - RNA, 19 nt, Homo sapiens
caagaggaggacaaagaaa

SEQ ID NO: 921144 - RNA, 19 nt, Homo sapiens
uacaaugagugccaaaucu

SEQ ID NO: 921145 - RNA, 19 nt, Homo sapiens
ccuaaugaucuugcuaaua

SEQ ID NO: 921146 - RNA, 19 nt, Homo sapiens
ggcugcacguuuccuguuu

SEQ ID NO: 921147 - RNA, 19 nt, Homo sapiens
cuagcuacacuuaauuuga

SEQ ID NO: 921148 - RNA, 19 nt, Homo sapiens
guauguguguauauguaug

SEQ ID NO: 921149 - RNA, 19 nt, Homo sapiens
gaaagaaaggguguugcau

SEQ ID NO: 921150 - RNA, 19 nt, Homo sapiens
aaguucugcuccuucauaa

SEQ ID NO: 921151 - RNA, 19 nt, Homo sapiens
ugaagugcagucccaacua

SEQ ID NO: 921152 - RNA, 19 nt, Homo sapiens
aaacagcauccuccauuca

SEQ ID NO: 921153 - RNA, 19 nt, Homo sapiens
aggaagccagaguuuauua

SEQ ID NO: 921154 - RNA, 19 nt, Homo sapiens
gauaaacugcacugagucu

SEQ ID NO: 921155 - RNA, 19 nt, Homo sapiens
augauaaacugcacugagu

SEQ ID NO: 921156 - RNA, 19 nt, Homo sapiens
ggaccuugaaguacuagga

SEQ ID NO: 921157 - RNA, 19 nt, Homo sapiens
gaagccagaguuuauuaac

SEQ ID NO: 921158 - RNA, 19 nt, Homo sapiens
uuccagauccuccaccaua

SEQ ID NO: 921159 - RNA, 19 nt, Homo sapiens
ccuggugacucuucuuaag

SEQ ID NO: 921160 - RNA, 19 nt, Homo sapiens
gcgcacaagcuugccauga

SEQ ID NO: 921161 - RNA, 19 nt, Homo sapiens
acagaagaccugaagaaca

SEQ ID NO: 921162 - RNA, 19 nt, Homo sapiens
caaacaagaaacccacaca

SEQ ID NO: 921163 - RNA, 19 nt, Homo sapiens
ccagguuaaugguaucgau

SEQ ID NO: 921164 - RNA, 19 nt, Homo sapiens
uauaucugccugucaguga

SEQ ID NO: 921165 - RNA, 19 nt, Homo sapiens
ucuaaacuggcaacaugua

SEQ ID NO: 921166 - RNA, 19 nt, Homo sapiens
ugaaagaaaggguguugca

SEQ ID NO: 921167 - RNA, 19 nt, Homo sapiens
agaguuuguucagcaguuu

SEQ ID NO: 921168 - RNA, 19 nt, Homo sapiens
uuuauuaacugccaaucca

SEQ ID NO: 921169 - RNA, 19 nt, Homo sapiens
cuaaaaggcugcguuaaag

SEQ ID NO: 921170 - RNA, 19 nt, Homo sapiens
aagaguuuguucagcaguu

SEQ ID NO: 921171 - RNA, 19 nt, Homo sapiens
ggaggucaaggcgaauauu

SEQ ID NO: 921172 - RNA, 19 nt, Homo sapiens
gccaugaagcacaaauguu

SEQ ID NO: 921173 - RNA, 19 nt, Homo sapiens
aaaggcugcguuaaagauu

SEQ ID NO: 921174 - RNA, 19 nt, Homo sapiens
cagcuucgccagguuaaug

SEQ ID NO: 921175 - RNA, 19 nt, Homo sapiens
ucaaggcgaauauuuaacu

SEQ ID NO: 921176 - RNA, 19 nt, Homo sapiens
aggucaaggcgaauauuua

SEQ ID NO: 921177 - RNA, 19 nt, Homo sapiens
guguguauguguguauaug

SEQ ID NO: 921178 - RNA, 19 nt, Homo sapiens
cuacaaugagugccaaauc

SEQ ID NO: 921179 - RNA, 19 nt, Homo sapiens
uuugaaggcuccacaucau

SEQ ID NO: 921180 - RNA, 19 nt, Homo sapiens
caugaagcacaaauguuga

SEQ ID NO: 921181 - RNA, 19 nt, Homo sapiens
caucauuuguucggagauc

SEQ ID NO: 921182 - RNA, 19 nt, Homo sapiens
gagcguggagagcgauuag

SEQ ID NO: 921183 - RNA, 19 nt, Homo sapiens
caggaagccagaguuuauu

SEQ ID NO: 921184 - RNA, 19 nt, Homo sapiens
guuugaaggcuccacauca

SEQ ID NO: 921185 - RNA, 19 nt, Homo sapiens
caagcagugauuaguuuca

SEQ ID NO: 921186 - RNA, 19 nt, Homo sapiens
uugcaccucuugaugaaag

SEQ ID NO: 921187 - RNA, 19 nt, Homo sapiens
cagauguuaaugugaaaga

SEQ ID NO: 921188 - RNA, 19 nt, Homo sapiens
caagucaagaggaggacaa

SEQ ID NO: 921189 - RNA, 19 nt, Homo sapiens
guagaagucuggaacguuu

SEQ ID NO: 921190 - RNA, 19 nt, Homo sapiens
ccaaagagguaaucaacuu

SEQ ID NO: 921191 - RNA, 19 nt, Homo sapiens
gaacuuccacuuucuuuga

SEQ ID NO: 921192 - RNA, 19 nt, Homo sapiens
gagcuugucuuugguugua

SEQ ID NO: 921193 - RNA, 19 nt, Homo sapiens
gaccugauauccacacaaa

SEQ ID NO: 921194 - RNA, 19 nt, Homo sapiens
auacagaaguccagaauga

SEQ ID NO: 921195 - RNA, 19 nt, Homo sapiens
ugagaucacuacccaauga

SEQ ID NO: 921196 - RNA, 19 nt, Homo sapiens
ccagagacacaaagaaaua

SEQ ID NO: 921197 - RNA, 19 nt, Homo sapiens
uggcaugaaugaaagguua

SEQ ID NO: 921198 - RNA, 19 nt, Homo sapiens
gaguuucucuguccucuug

SEQ ID NO: 921199 - RNA, 19 nt, Homo sapiens
ccagaaugaucaaaugaga

SEQ ID NO: 921200 - RNA, 19 nt, Homo sapiens
cagaaucacuggcuaaguc

SEQ ID NO: 921201 - RNA, 19 nt, Homo sapiens
gccagaaauuguccuacua

SEQ ID NO: 921202 - RNA, 19 nt, Homo sapiens
caacugcacccaugggaaa

SEQ ID NO: 921203 - RNA, 19 nt, Homo sapiens
ucaggaaguucugcuauga

SEQ ID NO: 921204 - RNA, 19 nt, Homo sapiens
aaucugaacuuccacuuuc

SEQ ID NO: 921205 - RNA, 19 nt, Homo sapiens
ggagcagacuguggaaaug

SEQ ID NO: 921206 - RNA, 19 nt, Homo sapiens
acaaagaaauacagaaguc

SEQ ID NO: 921207 - RNA, 19 nt, Homo sapiens
aaaguuugguccucaauca

SEQ ID NO: 921208 - RNA, 19 nt, Homo sapiens
ggucuuauccugaucuuuc

SEQ ID NO: 921209 - RNA, 19 nt, Homo sapiens
ucuuagaguuccagaauug

SEQ ID NO: 921210 - RNA, 19 nt, Homo sapiens
gggugcccuugaaauauua

SEQ ID NO: 921211 - RNA, 19 nt, Homo sapiens
cggcagagguucaggaagu

SEQ ID NO: 921212 - RNA, 19 nt, Homo sapiens
gaauugugacugaagugua

SEQ ID NO: 921213 - RNA, 19 nt, Homo sapiens
gaaauacagaaguccagaa

SEQ ID NO: 921214 - RNA, 19 nt, Homo sapiens
ugaagacucuguugaagac

SEQ ID NO: 921215 - RNA, 19 nt, Homo sapiens
caccagagacccucaguga

SEQ ID NO: 921216 - RNA, 19 nt, Homo sapiens
gaaguucugcuaugaggau

SEQ ID NO: 921217 - RNA, 19 nt, Homo sapiens
guuccagaauugugacuga

SEQ ID NO: 921218 - RNA, 19 nt, Homo sapiens
ccagagacccucagugaag

SEQ ID NO: 921219 - RNA, 19 nt, Homo sapiens
gaggcagcuuuauuuccua

SEQ ID NO: 921220 - RNA, 19 nt, Homo sapiens
cagagacccucagugaaga

SEQ ID NO: 921221 - RNA, 19 nt, Homo sapiens
gaucacuacccaaugaaau

SEQ ID NO: 921222 - RNA, 19 nt, Homo sapiens
ggagucauuugugggaguu

SEQ ID NO: 921223 - RNA, 19 nt, Homo sapiens
agacucuguugaagacuuu

SEQ ID NO: 921224 - RNA, 19 nt, Homo sapiens
guuagggucuuauccugau

SEQ ID NO: 921225 - RNA, 19 nt, Homo sapiens
gcacccaugggaaaucuga

SEQ ID NO: 921226 - RNA, 19 nt, Homo sapiens
acacaaaggagcagacugu

SEQ ID NO: 921227 - RNA, 19 nt, Homo sapiens
gaaaucugaacuuccacuu

SEQ ID NO: 921228 - RNA, 19 nt, Homo sapiens
caugggaaaucugaacuuc

SEQ ID NO: 921229 - RNA, 19 nt, Homo sapiens
cauaugagaagucaaccaa

SEQ ID NO: 921230 - RNA, 19 nt, Homo sapiens
uuuaagaccaugcuagaaa

SEQ ID NO: 921231 - RNA, 19 nt, Homo sapiens
ccagaauugugacugaagu

SEQ ID NO: 921232 - RNA, 19 nt, Homo sapiens
ucuuugagcuugucuuugg

SEQ ID NO: 921233 - RNA, 19 nt, Homo sapiens
gugaagacucuguugaaga

SEQ ID NO: 921234 - RNA, 19 nt, Homo sapiens
uugcucagccugcauauga

SEQ ID NO: 921235 - RNA, 19 nt, Homo sapiens
uuaagaccaugcuagaaag

SEQ ID NO: 921236 - RNA, 19 nt, Homo sapiens
ugugggaguuagggucuua

SEQ ID NO: 921237 - RNA, 19 nt, Homo sapiens
gagguaaucaacuuuaacu

SEQ ID NO: 921238 - RNA, 19 nt, Homo sapiens
uuauguauccaaagaggua

SEQ ID NO: 921239 - RNA, 19 nt, Homo sapiens
gcacuuugugacaugcuuu

SEQ ID NO: 921240 - RNA, 19 nt, Homo sapiens
cagcuuuauuuccuacaga

SEQ ID NO: 921241 - RNA, 19 nt, Homo sapiens
gagaagucaaccaagcauu

SEQ ID NO: 921242 - RNA, 19 nt, Homo sapiens
gguggcagcugcguagaag

SEQ ID NO: 921243 - RNA, 19 nt, Homo sapiens
ggcagagguucaggaaguu

SEQ ID NO: 921244 - RNA, 19 nt, Homo sapiens
ccgaggagccagaaauugu

SEQ ID NO: 921245 - RNA, 19 nt, Homo sapiens
ggggugcccuugaaauauu

SEQ ID NO: 921246 - RNA, 19 nt, Homo sapiens
ugaggcagcuuuauuuccu

SEQ ID NO: 921247 - RNA, 19 nt, Homo sapiens
cagugaagacucuguugaa

SEQ ID NO: 921248 - RNA, 19 nt, Homo sapiens
ggccgaggagccagaaauu

SEQ ID NO: 921249 - RNA, 19 nt, Homo sapiens
acuacccaaugaaaugaua

SEQ ID NO: 921250 - RNA, 19 nt, Homo sapiens
acacaaagaaauacagaag

SEQ ID NO: 921251 - RNA, 19 nt, Homo sapiens
gaagucaaccaagcauucu

SEQ ID NO: 921252 - RNA, 19 nt, Homo sapiens
guacccagagacacaaaga

SEQ ID NO: 921253 - RNA, 19 nt, Homo sapiens
gagcucaagcacagagaug

SEQ ID NO: 921254 - RNA, 19 nt, Homo sapiens
ccacuuucuuugagcuugu

SEQ ID NO: 921255 - RNA, 19 nt, Homo sapiens
ggagccagaaauuguccua

SEQ ID NO: 921256 - RNA, 19 nt, Homo sapiens
ucacuacccaaugaaauga

SEQ ID NO: 921257 - RNA, 19 nt, Homo sapiens
ucaugaaucuugguuuggu

SEQ ID NO: 921258 - RNA, 19 nt, Homo sapiens
gcagcuuuauuuccuacag

SEQ ID NO: 921259 - RNA, 19 nt, Homo sapiens
agaagucaaccaagcauuc

SEQ ID NO: 921260 - RNA, 19 nt, Homo sapiens
aaucagaaucacuggcuaa

SEQ ID NO: 921261 - RNA, 19 nt, Homo sapiens
ucagugaagacucuguuga

SEQ ID NO: 921262 - RNA, 19 nt, Homo sapiens
cagaaguccagaaugauca

SEQ ID NO: 921263 - RNA, 19 nt, Homo sapiens
aaauacagaaguccagaau

SEQ ID NO: 921264 - RNA, 19 nt, Homo sapiens
gagaucacuacccaaugaa

SEQ ID NO: 921265 - RNA, 19 nt, Homo sapiens
aguccagaaugaucaaaug

SEQ ID NO: 921266 - RNA, 19 nt, Homo sapiens
ugucuuugguuguaauaag

SEQ ID NO: 921267 - RNA, 19 nt, Homo sapiens
ucccuuuccuggagucauu

SEQ ID NO: 921268 - RNA, 19 nt, Homo sapiens
aaaucugaacuuccacuuu

SEQ ID NO: 921269 - RNA, 19 nt, Homo sapiens
gacccucagugaagacucu

SEQ ID NO: 921270 - RNA, 19 nt, Homo sapiens
cauccuggaaucagaauca

SEQ ID NO: 921271 - RNA, 19 nt, Homo sapiens
guccagaaugaucaaauga

SEQ ID NO: 921272 - RNA, 19 nt, Homo sapiens
uagaguuccagaauuguga

SEQ ID NO: 921273 - RNA, 19 nt, Homo sapiens
agacacaaagaaauacaga

SEQ ID NO: 921274 - RNA, 19 nt, Homo sapiens
gacacaaagaaauacagaa

SEQ ID NO: 921275 - RNA, 19 nt, Homo sapiens
guucaggaaguucugcuau

SEQ ID NO: 921276 - RNA, 19 nt, Homo sapiens
ccagaaauuguccuacuac

SEQ ID NO: 921277 - RNA, 19 nt, Homo sapiens
acccagagacacaaagaaa

SEQ ID NO: 921278 - RNA, 19 nt, Homo sapiens
gguuugguggcaugaauga

SEQ ID NO: 921279 - RNA, 19 nt, Homo sapiens
aauugugacugaaguguac

SEQ ID NO: 921280 - RNA, 19 nt, Homo sapiens
ugaaguguacccagagaca

SEQ ID NO: 921281 - RNA, 19 nt, Homo sapiens
ggaguuagggucuuauccu

SEQ ID NO: 921282 - RNA, 19 nt, Homo sapiens
aaugagaucacuacccaau

SEQ ID NO: 921283 - RNA, 19 nt, Homo sapiens
aagacucuguugaagacuu

SEQ ID NO: 921284 - RNA, 19 nt, Homo sapiens
gaaguccagaaugaucaaa

SEQ ID NO: 921285 - RNA, 19 nt, Homo sapiens
gagugguugucucccuuuc

SEQ ID NO: 921286 - RNA, 19 nt, Homo sapiens
gcuugucuuugguuguaau

SEQ ID NO: 921287 - RNA, 19 nt, Homo sapiens
acagaaguccagaaugauc

SEQ ID NO: 921288 - RNA, 19 nt, Homo sapiens
uugaagacuuuaagaccau

SEQ ID NO: 921289 - RNA, 19 nt, Homo sapiens
gcaaagacaagauguggua

SEQ ID NO: 921290 - RNA, 19 nt, Homo sapiens
gacaagaugugguauuugg

SEQ ID NO: 921291 - RNA, 19 nt, Homo sapiens
gaccaucguucacacucua

SEQ ID NO: 921292 - RNA, 19 nt, Homo sapiens
aagacaagaugugguauuu

SEQ ID NO: 921293 - RNA, 19 nt, Homo sapiens
gugcuucucuugacauuuc

SEQ ID NO: 921294 - RNA, 19 nt, Homo sapiens
gagagaccauaacguggaa

SEQ ID NO: 921295 - RNA, 19 nt, Homo sapiens
gaaaaugggagaagaagaa

SEQ ID NO: 921296 - RNA, 19 nt, Homo sapiens
ccacacaagugcuucucuu

SEQ ID NO: 921297 - RNA, 19 nt, Homo sapiens
aaucauauauccacacaag

SEQ ID NO: 921298 - RNA, 19 nt, Homo sapiens
gcuuugggaucauggagaa

SEQ ID NO: 921299 - RNA, 19 nt, Homo sapiens
aaugggagaagaagaauaa

SEQ ID NO: 921300 - RNA, 19 nt, Homo sapiens
gaaaucuaccacugucgaa

SEQ ID NO: 921301 - RNA, 19 nt, Homo sapiens
uacgaggaaugucuauuga

SEQ ID NO: 921302 - RNA, 19 nt, Homo sapiens
gauucagacuccacagugu

SEQ ID NO: 921303 - RNA, 19 nt, Homo sapiens
gaccauaacguggaauuca

SEQ ID NO: 921304 - RNA, 19 nt, Homo sapiens
aagcuggccuuggguguuu

SEQ ID NO: 921305 - RNA, 19 nt, Homo sapiens
ucaaucauauauccacaca

SEQ ID NO: 921306 - RNA, 19 nt, Homo sapiens
agaggucgcuuugggauca

SEQ ID NO: 921307 - RNA, 19 nt, Homo sapiens
ucauauauccacacaagug

SEQ ID NO: 921308 - RNA, 19 nt, Homo sapiens
gcacaagauauggcaguga

SEQ ID NO: 921309 - RNA, 19 nt, Homo sapiens
gaagcuggccuuggguguu

SEQ ID NO: 921310 - RNA, 19 nt, Homo sapiens
ggagaccagcagaaaucua

SEQ ID NO: 921311 - RNA, 19 nt, Homo sapiens
ggaccaucguucacacucu

SEQ ID NO: 921312 - RNA, 19 nt, Homo sapiens
cuuagaagcacaagauaug

SEQ ID NO: 921313 - RNA, 19 nt, Homo sapiens
aaaaggggccaaaauaauu

SEQ ID NO: 921314 - RNA, 19 nt, Homo sapiens
gagaccagcagaaaucuac

SEQ ID NO: 921315 - RNA, 19 nt, Homo sapiens
cguucacacucuaugauga

SEQ ID NO: 921316 - RNA, 19 nt, Homo sapiens
gagaccauaacguggaauu

SEQ ID NO: 921317 - RNA, 19 nt, Homo sapiens
auacgaggaaugucuauug

SEQ ID NO: 921318 - RNA, 19 nt, Homo sapiens
aaagacaagaugugguauu

SEQ ID NO: 921319 - RNA, 19 nt, Homo sapiens
acuccacaguguauauauu

SEQ ID NO: 921320 - RNA, 19 nt, Homo sapiens
gccauuauuuugugaaguu

SEQ ID NO: 921321 - RNA, 19 nt, Homo sapiens
gggccaaaauaauuaaaga

SEQ ID NO: 921322 - RNA, 19 nt, Homo sapiens
ggcuuuggcucaguuggaa

SEQ ID NO: 921323 - RNA, 19 nt, Homo sapiens
ccaccugagccaccaaaga

SEQ ID NO: 921324 - RNA, 19 nt, Homo sapiens
uggcucaguuggaauucaa

SEQ ID NO: 921325 - RNA, 19 nt, Homo sapiens
cuccacaguguauauauuu

SEQ ID NO: 921326 - RNA, 19 nt, Homo sapiens
guugggugcguuauggaua

SEQ ID NO: 921327 - RNA, 19 nt, Homo sapiens
caguuggaauucaaugaca

SEQ ID NO: 921328 - RNA, 19 nt, Homo sapiens
aaaggggccaaaauaauua

SEQ ID NO: 921329 - RNA, 19 nt, Homo sapiens
ccucggagaccagcagaaa

SEQ ID NO: 921330 - RNA, 19 nt, Homo sapiens
gggagaagaagaauaaaau

SEQ ID NO: 921331 - RNA, 19 nt, Homo sapiens
agacuccacaguguauaua

SEQ ID NO: 921332 - RNA, 19 nt, Homo sapiens
acaguugggugcguuaugg

SEQ ID NO: 921333 - RNA, 19 nt, Homo sapiens
gagauucagacuccacagu

SEQ ID NO: 921334 - RNA, 19 nt, Homo sapiens
gcagugagagaccauaacg

SEQ ID NO: 921335 - RNA, 19 nt, Homo sapiens
gauacgaggaaugucuauu

SEQ ID NO: 921336 - RNA, 19 nt, Homo sapiens
caucguucacacucuauga

SEQ ID NO: 921337 - RNA, 19 nt, Homo sapiens
guuggaauucaaugacaaa

SEQ ID NO: 921338 - RNA, 19 nt, Homo sapiens
aaauugauacgaggaaugu

SEQ ID NO: 921339 - RNA, 19 nt, Homo sapiens
guagcgggagggcgaaaga

SEQ ID NO: 921340 - RNA, 19 nt, Homo sapiens
ucucuugacauuucucgaa

SEQ ID NO: 921341 - RNA, 19 nt, Homo sapiens
gaaacgcauccgcuaccau

SEQ ID NO: 921342 - RNA, 19 nt, Homo sapiens
aaaugggagaagaagaaua

SEQ ID NO: 921343 - RNA, 19 nt, Homo sapiens
acucuaugaugaggagauu

SEQ ID NO: 921344 - RNA, 19 nt, Homo sapiens
gcccaugccaaagaguaua

SEQ ID NO: 921345 - RNA, 19 nt, Homo sapiens
gaccaggcuuuggcucagu

SEQ ID NO: 921346 - RNA, 19 nt, Homo sapiens
ucggagaccagcagaaauc

SEQ ID NO: 921347 - RNA, 19 nt, Homo sapiens
ccagagagcuuugcaauca

SEQ ID NO: 921348 - RNA, 19 nt, Homo sapiens
gcaagaagguguuagugau

SEQ ID NO: 921349 - RNA, 19 nt, Homo sapiens
agcaagaucuggagacuua

SEQ ID NO: 921350 - RNA, 19 nt, Homo sapiens
gcaauugacaccauaaaga

SEQ ID NO: 921351 - RNA, 19 nt, Homo sapiens
caaagacaccgagccauua

SEQ ID NO: 921352 - RNA, 19 nt, Homo sapiens
uaaaccaccucuauuucaa

SEQ ID NO: 921353 - RNA, 19 nt, Homo sapiens
guacuucccacgacugaua

SEQ ID NO: 921354 - RNA, 19 nt, Homo sapiens
cauuaaagguggcaugaga

SEQ ID NO: 921355 - RNA, 19 nt, Homo sapiens
gguuugcccuuaagaagaa

SEQ ID NO: 921356 - RNA, 19 nt, Homo sapiens
ggguggaaauucuuuguga

SEQ ID NO: 921357 - RNA, 19 nt, Homo sapiens
gaugauggccauuuaaaca

SEQ ID NO: 921358 - RNA, 19 nt, Homo sapiens
ggaaauucuuugugaguac

SEQ ID NO: 921359 - RNA, 19 nt, Homo sapiens
gaaguguccuagcaagauc

SEQ ID NO: 921360 - RNA, 19 nt, Homo sapiens
acuagaugauggccauuua

SEQ ID NO: 921361 - RNA, 19 nt, Homo sapiens
ggaagaaguguccuagcaa

SEQ ID NO: 921362 - RNA, 19 nt, Homo sapiens
aagcuuggcugauuuaaac

SEQ ID NO: 921363 - RNA, 19 nt, Homo sapiens
agaaagcuguugggacaaa

SEQ ID NO: 921364 - RNA, 19 nt, Homo sapiens
caaacguuaucugcaauug

SEQ ID NO: 921365 - RNA, 19 nt, Homo sapiens
ccacaacuaucugacuguu

SEQ ID NO: 921366 - RNA, 19 nt, Homo sapiens
gaagaacagucagcaaucc

SEQ ID NO: 921367 - RNA, 19 nt, Homo sapiens
guucacagaucggcagcua

SEQ ID NO: 921368 - RNA, 19 nt, Homo sapiens
uggaaauucuuugugagua

SEQ ID NO: 921369 - RNA, 19 nt, Homo sapiens
gaucacgugccacaacuau

SEQ ID NO: 921370 - RNA, 19 nt, Homo sapiens
gauuuaaaccaccucuauu

SEQ ID NO: 921371 - RNA, 19 nt, Homo sapiens
ucuuugagcucuccaguuc

SEQ ID NO: 921372 - RNA, 19 nt, Homo sapiens
acaaagacaccgagccauu

SEQ ID NO: 921373 - RNA, 19 nt, Homo sapiens
caauugacaccauaaagau

SEQ ID NO: 921374 - RNA, 19 nt, Homo sapiens
ggcaagaagguguuaguga

SEQ ID NO: 921375 - RNA, 19 nt, Homo sapiens
uggaagaaguguccuagca

SEQ ID NO: 921376 - RNA, 19 nt, Homo sapiens
ccaucgcauucaaacguua

SEQ ID NO: 921377 - RNA, 19 nt, Homo sapiens
gaucggcagcuacucagaa

SEQ ID NO: 921378 - RNA, 19 nt, Homo sapiens
caagaagguguuagugaug

SEQ ID NO: 921379 - RNA, 19 nt, Homo sapiens
caagaucuggagacuuaaa

SEQ ID NO: 921380 - RNA, 19 nt, Homo sapiens
cggcagcuacucagaaauu

SEQ ID NO: 921381 - RNA, 19 nt, Homo sapiens
uagaugauggccauuuaaa

SEQ ID NO: 921382 - RNA, 19 nt, Homo sapiens
caagcuuggcugauuuaaa

SEQ ID NO: 921383 - RNA, 19 nt, Homo sapiens
gugaagaacagucagcaau

SEQ ID NO: 921384 - RNA, 19 nt, Homo sapiens
uuaaaccaccucuauuuca

SEQ ID NO: 921385 - RNA, 19 nt, Homo sapiens
auucaaacguuaucugcaa

SEQ ID NO: 921386 - RNA, 19 nt, Homo sapiens
guggauggacaccaacuuu

SEQ ID NO: 921387 - RNA, 19 nt, Homo sapiens
agucagcaaucccuuacuu

SEQ ID NO: 921388 - RNA, 19 nt, Homo sapiens
ugauuuaaaccaccucuau

SEQ ID NO: 921389 - RNA, 19 nt, Homo sapiens
gcgaugccguggugaaacu

SEQ ID NO: 921390 - RNA, 19 nt, Homo sapiens
gaaagcuguugggacaaag

SEQ ID NO: 921391 - RNA, 19 nt, Homo sapiens
aaagacaccgagccauuau

SEQ ID NO: 921392 - RNA, 19 nt, Homo sapiens
aaaccaccucuauuucaaa

SEQ ID NO: 921393 - RNA, 19 nt, Homo sapiens
ucagcaaucccuuacuuuc

SEQ ID NO: 921394 - RNA, 19 nt, Homo sapiens
gagccauuauacccagaau

SEQ ID NO: 921395 - RNA, 19 nt, Homo sapiens
cuagaugauggccauuuaa

SEQ ID NO: 921396 - RNA, 19 nt, Homo sapiens
uaucugcaauugacaccau

SEQ ID NO: 921397 - RNA, 19 nt, Homo sapiens
ccauuuaaacaacucuuug

SEQ ID NO: 921398 - RNA, 19 nt, Homo sapiens
gcaaucccuuacuuuccau

SEQ ID NO: 921399 - RNA, 19 nt, Homo sapiens
ugaagaacagucagcaauc

SEQ ID NO: 921400 - RNA, 19 nt, Homo sapiens
cgacugauaguuccauuuu

SEQ ID NO: 921401 - RNA, 19 nt, Homo sapiens
aaacguuaucugcaauuga

SEQ ID NO: 921402 - RNA, 19 nt, Homo sapiens
guuuguggauggacaccaa

SEQ ID NO: 921403 - RNA, 19 nt, Homo sapiens
ggagaggggugaagaacag

SEQ ID NO: 921404 - RNA, 19 nt, Homo sapiens
ucacgugccacaacuaucu

SEQ ID NO: 921405 - RNA, 19 nt, Homo sapiens
caugagaccaggcaagaag

SEQ ID NO: 921406 - RNA, 19 nt, Homo sapiens
gccauuuaaacaacucuuu

SEQ ID NO: 921407 - RNA, 19 nt, Homo sapiens
gcaugagaccaggcaagaa

SEQ ID NO: 921408 - RNA, 19 nt, Homo sapiens
ucaaacguuaucugcaauu

SEQ ID NO: 921409 - RNA, 19 nt, Homo sapiens
ggcaugagaccaggcaaga

SEQ ID NO: 921410 - RNA, 19 nt, Homo sapiens
ggcagcuacucagaaauuc

SEQ ID NO: 921411 - RNA, 19 nt, Homo sapiens
gacuguuggucuggaagaa

SEQ ID NO: 921412 - RNA, 19 nt, Homo sapiens
ggaucacgugccacaacua

SEQ ID NO: 921413 - RNA, 19 nt, Homo sapiens
cagcgaugccguggugaaa

SEQ ID NO: 921414 - RNA, 19 nt, Homo sapiens
ucacagaucggcagcuacu

SEQ ID NO: 921415 - RNA, 19 nt, Homo sapiens
ggugguuugcccuuaagaa

SEQ ID NO: 921416 - RNA, 19 nt, Homo sapiens
gaccaggcaagaagguguu

SEQ ID NO: 921417 - RNA, 19 nt, Homo sapiens
gauggccauuuaaacaacu

SEQ ID NO: 921418 - RNA, 19 nt, Homo sapiens
guagaccucaacccagaga

SEQ ID NO: 921419 - RNA, 19 nt, Homo sapiens
acaaauggcaaguuucacu

SEQ ID NO: 921420 - RNA, 19 nt, Homo sapiens
agaaguguccuagcaagau

SEQ ID NO: 921421 - RNA, 19 nt, Homo sapiens
ugauggccauuuaaacaac

SEQ ID NO: 921422 - RNA, 19 nt, Homo sapiens
guggaaauucuuugugagu

SEQ ID NO: 921423 - RNA, 19 nt, Homo sapiens
gucagcaaucccuuacuuu

SEQ ID NO: 921424 - RNA, 19 nt, Homo sapiens
guagagagcuguccucaua

SEQ ID NO: 921425 - RNA, 19 nt, Homo sapiens
gagaagagauuggcaaaug

SEQ ID NO: 921426 - RNA, 19 nt, Homo sapiens
caacacagccucauugcua

SEQ ID NO: 921427 - RNA, 19 nt, Homo sapiens
gaggugcccuucacucuaa

SEQ ID NO: 921428 - RNA, 19 nt, Homo sapiens
gcccuucacucuaagcuua

SEQ ID NO: 921429 - RNA, 19 nt, Homo sapiens
gugauuacaucuuuccaua

SEQ ID NO: 921430 - RNA, 19 nt, Homo sapiens
agauacagguugccaguua

SEQ ID NO: 921431 - RNA, 19 nt, Homo sapiens
aaacauccuucucuuauuc

SEQ ID NO: 921432 - RNA, 19 nt, Homo sapiens
gauuacaucuuuccauauc

SEQ ID NO: 921433 - RNA, 19 nt, Homo sapiens
ggaauacugaccuaaugua

SEQ ID NO: 921434 - RNA, 19 nt, Homo sapiens
ccaaaucacucuccuccau

SEQ ID NO: 921435 - RNA, 19 nt, Homo sapiens
cagcaucucuccuauugug

SEQ ID NO: 921436 - RNA, 19 nt, Homo sapiens
caacaaagagggaagauac

SEQ ID NO: 921437 - RNA, 19 nt, Homo sapiens
gcacugaaacagaggacua

SEQ ID NO: 921438 - RNA, 19 nt, Homo sapiens
ugagaacuauacaaccuuu

SEQ ID NO: 921439 - RNA, 19 nt, Homo sapiens
ugaaacagaggacuauaaa

SEQ ID NO: 921440 - RNA, 19 nt, Homo sapiens
uccauaaccuggcuacgua

SEQ ID NO: 921441 - RNA, 19 nt, Homo sapiens
gcuaguggcaaguuucuuu

SEQ ID NO: 921442 - RNA, 19 nt, Homo sapiens
ggacuaugggcuccaguuu

SEQ ID NO: 921443 - RNA, 19 nt, Homo sapiens
gauacagguugccaguuau

SEQ ID NO: 921444 - RNA, 19 nt, Homo sapiens
caaaucacucuccuccaua

SEQ ID NO: 921445 - RNA, 19 nt, Homo sapiens
gaaggcaggugagguaagg

SEQ ID NO: 921446 - RNA, 19 nt, Homo sapiens
cuacguaugucuuccuuca

SEQ ID NO: 921447 - RNA, 19 nt, Homo sapiens
gcaacaaagagggaagaua

SEQ ID NO: 921448 - RNA, 19 nt, Homo sapiens
gacuaugggcuccaguuua

SEQ ID NO: 921449 - RNA, 19 nt, Homo sapiens
gggagcaaauggacuaugg

SEQ ID NO: 921450 - RNA, 19 nt, Homo sapiens
guugccaguuauacauuua

SEQ ID NO: 921451 - RNA, 19 nt, Homo sapiens
ggaggugcccuucacucua

SEQ ID NO: 921452 - RNA, 19 nt, Homo sapiens
gugggaagauggaauacug

SEQ ID NO: 921453 - RNA, 19 nt, Homo sapiens
gcaucuggcuggccuacau

SEQ ID NO: 921454 - RNA, 19 nt, Homo sapiens
gcagcuucuuuggugauua

SEQ ID NO: 921455 - RNA, 19 nt, Homo sapiens
ggcuuuaaauagucaugua

SEQ ID NO: 921456 - RNA, 19 nt, Homo sapiens
gguugccaguuauacauuu

SEQ ID NO: 921457 - RNA, 19 nt, Homo sapiens
cuuuaaagccugagaacua

SEQ ID NO: 921458 - RNA, 19 nt, Homo sapiens
caucaacacagccucauug

SEQ ID NO: 921459 - RNA, 19 nt, Homo sapiens
caggaaggcaggugaggua

SEQ ID NO: 921460 - RNA, 19 nt, Homo sapiens
gcagugggcaugaaucuac

SEQ ID NO: 921461 - RNA, 19 nt, Homo sapiens
cucagcaucucuccuauug

SEQ ID NO: 921462 - RNA, 19 nt, Homo sapiens
gggaaggcacugaaacaga

SEQ ID NO: 921463 - RNA, 19 nt, Homo sapiens
gauggaauacugaccuaau

SEQ ID NO: 921464 - RNA, 19 nt, Homo sapiens
gcugcgcacuuccucauca

SEQ ID NO: 921465 - RNA, 19 nt, Homo sapiens
gcaaguuucuuugaaucag

SEQ ID NO: 921466 - RNA, 19 nt, Homo sapiens
guucgugucuuuggcauca

SEQ ID NO: 921467 - RNA, 19 nt, Homo sapiens
uuuaaagccugagaacuau

SEQ ID NO: 921468 - RNA, 19 nt, Homo sapiens
caagggcagugggcaugaa

SEQ ID NO: 921469 - RNA, 19 nt, Homo sapiens
guggcaaguuucuuugaau

SEQ ID NO: 921470 - RNA, 19 nt, Homo sapiens
aacacagccucauugcuaa

SEQ ID NO: 921471 - RNA, 19 nt, Homo sapiens
uugguaggauugcugcaua

SEQ ID NO: 921472 - RNA, 19 nt, Homo sapiens
gagcuggcaggaugaaugu

SEQ ID NO: 921473 - RNA, 19 nt, Homo sapiens
aaaucacucuccuccauag

SEQ ID NO: 921474 - RNA, 19 nt, Homo sapiens
agaagagauuggcaaaugg

SEQ ID NO: 921475 - RNA, 19 nt, Homo sapiens
ccaagaagagaagagauug

SEQ ID NO: 921476 - RNA, 19 nt, Homo sapiens
acuaugggcuccaguuuac

SEQ ID NO: 921477 - RNA, 19 nt, Homo sapiens
gauaauccccuggcuuuaa

SEQ ID NO: 921478 - RNA, 19 nt, Homo sapiens
gcuauaugggcaacaaaga

SEQ ID NO: 921479 - RNA, 19 nt, Homo sapiens
aagauggaauacugaccua

SEQ ID NO: 921480 - RNA, 19 nt, Homo sapiens
uaggauugcugcauauggu

SEQ ID NO: 921481 - RNA, 19 nt, Homo sapiens
cugaaacagaggacuauaa

SEQ ID NO: 921482 - RNA, 19 nt, Homo sapiens
guguacugcugccgaaguu

SEQ ID NO: 921483 - RNA, 19 nt, Homo sapiens
guaugaugcugcgcacuuc

SEQ ID NO: 921484 - RNA, 19 nt, Homo sapiens
agagagcuguccucauaag

SEQ ID NO: 921485 - RNA, 19 nt, Homo sapiens
gcaaguuccucagcaucuc

SEQ ID NO: 921486 - RNA, 19 nt, Homo sapiens
aaagggcuccggcuauaug

SEQ ID NO: 921487 - RNA, 19 nt, Homo sapiens
ccauuugggcagcuucuuu

SEQ ID NO: 921488 - RNA, 19 nt, Homo sapiens
aauacaaacccuuggauca

SEQ ID NO: 921489 - RNA, 19 nt, Homo sapiens
uacaaacccuuggaucaca

SEQ ID NO: 921490 - RNA, 19 nt, Homo sapiens
cagcuucuuuggugauuac

SEQ ID NO: 921491 - RNA, 19 nt, Homo sapiens
ugagguaagggccaaauca

SEQ ID NO: 921492 - RNA, 19 nt, Homo sapiens
uggcaaguuucuuugaauc

SEQ ID NO: 921493 - RNA, 19 nt, Homo sapiens
uaaccuggcuacguauguc

SEQ ID NO: 921494 - RNA, 19 nt, Homo sapiens
uaaucaggauggguagaga

SEQ ID NO: 921495 - RNA, 19 nt, Homo sapiens
cuuuggugauuacaucuuu

SEQ ID NO: 921496 - RNA, 19 nt, Homo sapiens
caucaucuugguaggauug

SEQ ID NO: 921497 - RNA, 19 nt, Homo sapiens
ccucuccuuugguccagua

SEQ ID NO: 921498 - RNA, 19 nt, Homo sapiens
ccaccuuccagcucuguuu

SEQ ID NO: 921499 - RNA, 19 nt, Homo sapiens
cccaagaagagaagagauu

SEQ ID NO: 921500 - RNA, 19 nt, Homo sapiens
gguggcacacagcgaagua

SEQ ID NO: 921501 - RNA, 19 nt, Homo sapiens
auacagguugccaguuaua

SEQ ID NO: 921502 - RNA, 19 nt, Homo sapiens
ccugagaacuauacaaccu

SEQ ID NO: 921503 - RNA, 19 nt, Homo sapiens
gggcuccaguuuaccucuu

SEQ ID NO: 921504 - RNA, 19 nt, Homo sapiens
acacccgagugaugaauag

SEQ ID NO: 921505 - RNA, 19 nt, Homo sapiens
auggaauacugaccuaaug

SEQ ID NO: 921506 - RNA, 19 nt, Homo sapiens
gcacuuccucaucaacaca

SEQ ID NO: 921507 - RNA, 19 nt, Homo sapiens
ggcagcuucuuuggugauu

SEQ ID NO: 921508 - RNA, 19 nt, Homo sapiens
gaaacagaggacuauaaaa

SEQ ID NO: 921509 - RNA, 19 nt, Homo sapiens
uggcaucaacaaauacuga

SEQ ID NO: 921510 - RNA, 19 nt, Homo sapiens
cagccucauugcuaagugu

SEQ ID NO: 921511 - RNA, 19 nt, Homo sapiens
uauagcugcaguuuaauca

SEQ ID NO: 921512 - RNA, 19 nt, Homo sapiens
cuucuuuggugauuacauc

SEQ ID NO: 921513 - RNA, 19 nt, Homo sapiens
cauagcaggaagccauuug

SEQ ID NO: 921514 - RNA, 19 nt, Homo sapiens
aguggcaaguuucuuugaa

SEQ ID NO: 921515 - RNA, 19 nt, Homo sapiens
ggcaaguuucuuugaauca

SEQ ID NO: 921516 - RNA, 19 nt, Homo sapiens
aagagaagagauuggcaaa

SEQ ID NO: 921517 - RNA, 19 nt, Homo sapiens
uacaucaucuugguaggau

SEQ ID NO: 921518 - RNA, 19 nt, Homo sapiens
guaagggccaaaucacucu

SEQ ID NO: 921519 - RNA, 19 nt, Homo sapiens
ggaaggcaggugagguaag

SEQ ID NO: 921520 - RNA, 19 nt, Homo sapiens
uaaagccugagaacuauac

SEQ ID NO: 921521 - RNA, 19 nt, Homo sapiens
ucucuccuauugugcucua

SEQ ID NO: 921522 - RNA, 19 nt, Homo sapiens
uagagagcuguccucauaa

SEQ ID NO: 921523 - RNA, 19 nt, Homo sapiens
cauuugggcagcuucuuug

SEQ ID NO: 921524 - RNA, 19 nt, Homo sapiens
gaccauagcaguauauauu

SEQ ID NO: 921525 - RNA, 19 nt, Homo sapiens
ccagagacuucuuaaauca

SEQ ID NO: 921526 - RNA, 19 nt, Homo sapiens
caucuuccuucucaacuua

SEQ ID NO: 921527 - RNA, 19 nt, Homo sapiens
caacagaaauacacaaucg

SEQ ID NO: 921528 - RNA, 19 nt, Homo sapiens
cagcugaagucacacauga

SEQ ID NO: 921529 - RNA, 19 nt, Homo sapiens
gaaagaagccaugaucaag

SEQ ID NO: 921530 - RNA, 19 nt, Homo sapiens
gagggcagcugaagucaca

SEQ ID NO: 921531 - RNA, 19 nt, Homo sapiens
gaagucagccuacacuaca

SEQ ID NO: 921532 - RNA, 19 nt, Homo sapiens
gccagagacuucuuaaauc

SEQ ID NO: 921533 - RNA, 19 nt, Homo sapiens
gagaagccgugguugaagu

SEQ ID NO: 921534 - RNA, 19 nt, Homo sapiens
ucggucuacuucauaauua

SEQ ID NO: 921535 - RNA, 19 nt, Homo sapiens
aguaugaucuuagcuuuga

SEQ ID NO: 921536 - RNA, 19 nt, Homo sapiens
ugaaagaagccaugaucaa

SEQ ID NO: 921537 - RNA, 19 nt, Homo sapiens
uuaaacaaguggguaauuc

SEQ ID NO: 921538 - RNA, 19 nt, Homo sapiens
gcugaagucacacaugaaa

SEQ ID NO: 921539 - RNA, 19 nt, Homo sapiens
ugaagucacacaugaaaga

SEQ ID NO: 921540 - RNA, 19 nt, Homo sapiens
uauuacugcucaugucauu

SEQ ID NO: 921541 - RNA, 19 nt, Homo sapiens
gaagucacacaugaaagaa

SEQ ID NO: 921542 - RNA, 19 nt, Homo sapiens
gccauaccauugucacugu

SEQ ID NO: 921543 - RNA, 19 nt, Homo sapiens
cauuaaugcuagaucaugu

SEQ ID NO: 921544 - RNA, 19 nt, Homo sapiens
gcuucuucauguaucuuua

SEQ ID NO: 921545 - RNA, 19 nt, Homo sapiens
ugucugauuuagaauguga

SEQ ID NO: 921546 - RNA, 19 nt, Homo sapiens
cauugucacuguauuacug

SEQ ID NO: 921547 - RNA, 19 nt, Homo sapiens
ggauggaggcggugguguu

SEQ ID NO: 921548 - RNA, 19 nt, Homo sapiens
cuucuuaaaucauccuuag

SEQ ID NO: 921549 - RNA, 19 nt, Homo sapiens
cgucuucucucuccucgau

SEQ ID NO: 921550 - RNA, 19 nt, Homo sapiens
uaccauugucacuguauua

SEQ ID NO: 921551 - RNA, 19 nt, Homo sapiens
agagacuucuuaaaucauc

SEQ ID NO: 921552 - RNA, 19 nt, Homo sapiens
ccauaccauugucacugua

SEQ ID NO: 921553 - RNA, 19 nt, Homo sapiens
ucauugcacugguucaucu

SEQ ID NO: 921554 - RNA, 19 nt, Homo sapiens
gagccagagacuucuuaaa

SEQ ID NO: 921555 - RNA, 19 nt, Homo sapiens
ggagccagagacuucuuaa

SEQ ID NO: 921556 - RNA, 19 nt, Homo sapiens
agccagagacuucuuaaau

SEQ ID NO: 921557 - RNA, 19 nt, Homo sapiens
gcucugcuucuucauguau

SEQ ID NO: 921558 - RNA, 19 nt, Homo sapiens
ccacuuggaauauauaucg

SEQ ID NO: 921559 - RNA, 19 nt, Homo sapiens
gcucaaaauuaaacaagug

SEQ ID NO: 921560 - RNA, 19 nt, Homo sapiens
gcuagaucauguugcucaa

SEQ ID NO: 921561 - RNA, 19 nt, Homo sapiens
guugccacuuggaauauau

SEQ ID NO: 921562 - RNA, 19 nt, Homo sapiens
ccuguugccacuuggaaua

SEQ ID NO: 921563 - RNA, 19 nt, Homo sapiens
cagaauugauuggccauac

SEQ ID NO: 921564 - RNA, 19 nt, Homo sapiens
ccuuagaaccgugaccaua

SEQ ID NO: 921565 - RNA, 19 nt, Homo sapiens
ucucucuccucgauuguug

SEQ ID NO: 921566 - RNA, 19 nt, Homo sapiens
gccaugaucaagcuugguu

SEQ ID NO: 921567 - RNA, 19 nt, Homo sapiens
ugguucaucuuccuucuca

SEQ ID NO: 921568 - RNA, 19 nt, Homo sapiens
gcacugguucaucuuccuu

SEQ ID NO: 921569 - RNA, 19 nt, Homo sapiens
ccucucggucuacuucaua

SEQ ID NO: 921570 - RNA, 19 nt, Homo sapiens
ggagaagccgugguugaag

SEQ ID NO: 921571 - RNA, 19 nt, Homo sapiens
uggagaagccgugguugaa

SEQ ID NO: 921572 - RNA, 19 nt, Homo sapiens
ccacuugcucugcuucuuc

SEQ ID NO: 921573 - RNA, 19 nt, Homo sapiens
aagaagccaugaucaagcu

SEQ ID NO: 921574 - RNA, 19 nt, Homo sapiens
ucaucuuccuucucaacuu

SEQ ID NO: 921575 - RNA, 19 nt, Homo sapiens
uagaucauguugcucaaaa

SEQ ID NO: 921576 - RNA, 19 nt, Homo sapiens
ucaugucauugcacugguu

SEQ ID NO: 921577 - RNA, 19 nt, Homo sapiens
gaucauguugcucaaaauu

SEQ ID NO: 921578 - RNA, 19 nt, Homo sapiens
gcagcugaagucacacaug

SEQ ID NO: 921579 - RNA, 19 nt, Homo sapiens
gauggaggcggugguguuc

SEQ ID NO: 921580 - RNA, 19 nt, Homo sapiens
gaauugauuggccauacca

SEQ ID NO: 921581 - RNA, 19 nt, Homo sapiens
gauccaacagaaauacaca

SEQ ID NO: 921582 - RNA, 19 nt, Homo sapiens
uguugccacuuggaauaua

SEQ ID NO: 921583 - RNA, 19 nt, Homo sapiens
caaguggguaauuccagaa

SEQ ID NO: 921584 - RNA, 19 nt, Homo sapiens
cacuugcucugcuucuuca

SEQ ID NO: 921585 - RNA, 19 nt, Homo sapiens
ucuucucucuccucgauug

SEQ ID NO: 921586 - RNA, 19 nt, Homo sapiens
uugauuggccauaccauug

SEQ ID NO: 921587 - RNA, 19 nt, Homo sapiens
ccgugaccauagcaguaua

SEQ ID NO: 921588 - RNA, 19 nt, Homo sapiens
ugaagucagccuacacuac

SEQ ID NO: 921589 - RNA, 19 nt, Homo sapiens
gacaacaggucaucucuug

SEQ ID NO: 921590 - RNA, 19 nt, Homo sapiens
gaaaagagguugaaaagag

SEQ ID NO: 921591 - RNA, 19 nt, Homo sapiens
gcaagcagcagauagcuaa

SEQ ID NO: 921592 - RNA, 19 nt, Homo sapiens
gacaaucccucuucagaau

SEQ ID NO: 921593 - RNA, 19 nt, Homo sapiens
guaccagacugaucucuug

SEQ ID NO: 921594 - RNA, 19 nt, Homo sapiens
caaaggacgugacacuuca

SEQ ID NO: 921595 - RNA, 19 nt, Homo sapiens
caaucccucuucagaauaa

SEQ ID NO: 921596 - RNA, 19 nt, Homo sapiens
gcaaaggacgugacacuuc

SEQ ID NO: 921597 - RNA, 19 nt, Homo sapiens
ucacgauccuaacaucuuu

SEQ ID NO: 921598 - RNA, 19 nt, Homo sapiens
gagccugggugacuuugaa

SEQ ID NO: 921599 - RNA, 19 nt, Homo sapiens
agacugaucucuugcuuac

SEQ ID NO: 921600 - RNA, 19 nt, Homo sapiens
ggacuucuuuuaaaccuuu

SEQ ID NO: 921601 - RNA, 19 nt, Homo sapiens
cugaagcacugcaugaugu

SEQ ID NO: 921602 - RNA, 19 nt, Homo sapiens
gacccaauguggacuucuu

SEQ ID NO: 921603 - RNA, 19 nt, Homo sapiens
gguuuccucuuauuucuuc

SEQ ID NO: 921604 - RNA, 19 nt, Homo sapiens
cagcagauagcuaaggaaa

SEQ ID NO: 921605 - RNA, 19 nt, Homo sapiens
ccauggagcccacgagaga

SEQ ID NO: 921606 - RNA, 19 nt, Homo sapiens
ugaccagucugacccuuca

SEQ ID NO: 921607 - RNA, 19 nt, Homo sapiens
gcagauagcuaaggaaaac

SEQ ID NO: 921608 - RNA, 19 nt, Homo sapiens
gaugccacgugacccaaug

SEQ ID NO: 921609 - RNA, 19 nt, Homo sapiens
ggcuagggcuguccaugug

SEQ ID NO: 921610 - RNA, 19 nt, Homo sapiens
gcgcugaagcacugcauga

SEQ ID NO: 921611 - RNA, 19 nt, Homo sapiens
ccagacugaucucuugcuu

SEQ ID NO: 921612 - RNA, 19 nt, Homo sapiens
agacaaucccucuucagaa

SEQ ID NO: 921613 - RNA, 19 nt, Homo sapiens
ugauguugcugagaacuug

SEQ ID NO: 921614 - RNA, 19 nt, Homo sapiens
ugcaugauguugcugagaa

SEQ ID NO: 921615 - RNA, 19 nt, Homo sapiens
gcugaagcacugcaugaug

SEQ ID NO: 921616 - RNA, 19 nt, Homo sapiens
gggcuagggcuguccaugu

SEQ ID NO: 921617 - RNA, 19 nt, Homo sapiens
gguaccacuuugaggaugu

SEQ ID NO: 921618 - RNA, 19 nt, Homo sapiens
cagacugaucucuugcuua

SEQ ID NO: 921619 - RNA, 19 nt, Homo sapiens
guaccacuuugaggauguu

SEQ ID NO: 921620 - RNA, 19 nt, Homo sapiens
acaaucccucuucagaaua

SEQ ID NO: 921621 - RNA, 19 nt, Homo sapiens
gcguaaacauaagacaauc

SEQ ID NO: 921622 - RNA, 19 nt, Homo sapiens
caauguggacuucuuuuaa

SEQ ID NO: 921623 - RNA, 19 nt, Homo sapiens
caucuuugguccccaguaa

SEQ ID NO: 921624 - RNA, 19 nt, Homo sapiens
ggacgugacacuucaucag

SEQ ID NO: 921625 - RNA, 19 nt, Homo sapiens
cccggacaaucaagaaguu

SEQ ID NO: 921626 - RNA, 19 nt, Homo sapiens
gaagcacugcaugauguug

SEQ ID NO: 921627 - RNA, 19 nt, Homo sapiens
caguaaaggcgcugaagca

SEQ ID NO: 921628 - RNA, 19 nt, Homo sapiens
gcugcgcgguaccacuuug

SEQ ID NO: 921629 - RNA, 19 nt, Homo sapiens
gcaugauguugcugagaac

SEQ ID NO: 921630 - RNA, 19 nt, Homo sapiens
ccaauguggacuucuuuua

SEQ ID NO: 921631 - RNA, 19 nt, Homo sapiens
gugcguaaacauaagacaa

SEQ ID NO: 921632 - RNA, 19 nt, Homo sapiens
ggcaagcagcagauagcua

SEQ ID NO: 921633 - RNA, 19 nt, Homo sapiens
cuguucagccucucaguuu

SEQ ID NO: 921634 - RNA, 19 nt, Homo sapiens
gggaaaagagguugaaaag

SEQ ID NO: 921635 - RNA, 19 nt, Homo sapiens
ggaccagagccugauagug

SEQ ID NO: 921636 - RNA, 19 nt, Homo sapiens
ggaaaagagguugaaaaga

SEQ ID NO: 921637 - RNA, 19 nt, Homo sapiens
uuucuucccugugcguaaa

SEQ ID NO: 921638 - RNA, 19 nt, Homo sapiens
gacaacaggucaucucuug

SEQ ID NO: 921639 - RNA, 19 nt, Homo sapiens
gaaaagagguugaaaagag

SEQ ID NO: 921640 - RNA, 19 nt, Homo sapiens
gcaagcagcagauagcuaa

SEQ ID NO: 921641 - RNA, 19 nt, Homo sapiens
gacaaucccucuucagaau

SEQ ID NO: 921642 - RNA, 19 nt, Homo sapiens
guaccagacugaucucuug

SEQ ID NO: 921643 - RNA, 19 nt, Homo sapiens
caaaggacgugacacuuca

SEQ ID NO: 921644 - RNA, 19 nt, Homo sapiens
caaucccucuucagaauaa

SEQ ID NO: 921645 - RNA, 19 nt, Homo sapiens
gcaaaggacgugacacuuc

SEQ ID NO: 921646 - RNA, 19 nt, Homo sapiens
ucacgauccuaacaucuuu

SEQ ID NO: 921647 - RNA, 19 nt, Homo sapiens
gagccugggugacuuugaa

SEQ ID NO: 921648 - RNA, 19 nt, Homo sapiens
agacugaucucuugcuuac

SEQ ID NO: 921649 - RNA, 19 nt, Homo sapiens
ggacuucuuuuaaaccuuu

SEQ ID NO: 921650 - RNA, 19 nt, Homo sapiens
cugaagcacugcaugaugu

SEQ ID NO: 921651 - RNA, 19 nt, Homo sapiens
gacccaauguggacuucuu

SEQ ID NO: 921652 - RNA, 19 nt, Homo sapiens
gguuuccucuuauuucuuc

SEQ ID NO: 921653 - RNA, 19 nt, Homo sapiens
cagcagauagcuaaggaaa

SEQ ID NO: 921654 - RNA, 19 nt, Homo sapiens
ccauggagcccacgagaga

SEQ ID NO: 921655 - RNA, 19 nt, Homo sapiens
ugaccagucugacccuuca

SEQ ID NO: 921656 - RNA, 19 nt, Homo sapiens
gcagauagcuaaggaaaac

SEQ ID NO: 921657 - RNA, 19 nt, Homo sapiens
gaugccacgugacccaaug

SEQ ID NO: 921658 - RNA, 19 nt, Homo sapiens
ggcuagggcuguccaugug

SEQ ID NO: 921659 - RNA, 19 nt, Homo sapiens
ccagacugaucucuugcuu

SEQ ID NO: 921660 - RNA, 19 nt, Homo sapiens
agacaaucccucuucagaa

SEQ ID NO: 921661 - RNA, 19 nt, Homo sapiens
ugauguugcugagaacuug

SEQ ID NO: 921662 - RNA, 19 nt, Homo sapiens
ugcaugauguugcugagaa

SEQ ID NO: 921663 - RNA, 19 nt, Homo sapiens
gggcuagggcuguccaugu

SEQ ID NO: 921664 - RNA, 19 nt, Homo sapiens
gguaccacuuugaggaugu

SEQ ID NO: 921665 - RNA, 19 nt, Homo sapiens
cagacugaucucuugcuua

SEQ ID NO: 921666 - RNA, 19 nt, Homo sapiens
guaccacuuugaggauguu

SEQ ID NO: 921667 - RNA, 19 nt, Homo sapiens
acaaucccucuucagaaua

SEQ ID NO: 921668 - RNA, 19 nt, Homo sapiens
gcguaaacauaagacaauc

SEQ ID NO: 921669 - RNA, 19 nt, Homo sapiens
caauguggacuucuuuuaa

SEQ ID NO: 921670 - RNA, 19 nt, Homo sapiens
caucuuugguccccaguaa

SEQ ID NO: 921671 - RNA, 19 nt, Homo sapiens
ggacgugacacuucaucag

SEQ ID NO: 921672 - RNA, 19 nt, Homo sapiens
cccggacaaucaagaaguu

SEQ ID NO: 921673 - RNA, 19 nt, Homo sapiens
ggccugaagcacugcauga

SEQ ID NO: 921674 - RNA, 19 nt, Homo sapiens
gaagcacugcaugauguug

SEQ ID NO: 921675 - RNA, 19 nt, Homo sapiens
gcugcgcgguaccacuuug

SEQ ID NO: 921676 - RNA, 19 nt, Homo sapiens
gcaugauguugcugagaac

SEQ ID NO: 921677 - RNA, 19 nt, Homo sapiens
ccaauguggacuucuuuua

SEQ ID NO: 921678 - RNA, 19 nt, Homo sapiens
gugcguaaacauaagacaa

SEQ ID NO: 921679 - RNA, 19 nt, Homo sapiens
ggcaagcagcagauagcua

SEQ ID NO: 921680 - RNA, 19 nt, Homo sapiens
cuguucagccucucaguuu

SEQ ID NO: 921681 - RNA, 19 nt, Homo sapiens
gggaaaagagguugaaaag

SEQ ID NO: 921682 - RNA, 19 nt, Homo sapiens
ggaccagagccugauagug

SEQ ID NO: 921683 - RNA, 19 nt, Homo sapiens
ggaaaagagguugaaaaga

SEQ ID NO: 921684 - RNA, 19 nt, Homo sapiens
uuucuucccugugcguaaa

SEQ ID NO: 921685 - RNA, 19 nt, Homo sapiens
ccaguaaaggccugaagca

SEQ ID NO: 921686 - RNA, 19 nt, Homo sapiens
gaacaugugucuacuugga

SEQ ID NO: 921687 - RNA, 19 nt, Homo sapiens
ugacaaagaucauccuaga

SEQ ID NO: 921688 - RNA, 19 nt, Homo sapiens
gaagaagugggaauaauug

SEQ ID NO: 921689 - RNA, 19 nt, Homo sapiens
cuaauucccuucuucauga

SEQ ID NO: 921690 - RNA, 19 nt, Homo sapiens
gcucaugagugauaaaugu

SEQ ID NO: 921691 - RNA, 19 nt, Homo sapiens
caagauggcugcccugaca

SEQ ID NO: 921692 - RNA, 19 nt, Homo sapiens
cugcauagcuguuugagaa

SEQ ID NO: 921693 - RNA, 19 nt, Homo sapiens
ucacuaggcugguggcauu

SEQ ID NO: 921694 - RNA, 19 nt, Homo sapiens
gaaauucaggcccaaauca

SEQ ID NO: 921695 - RNA, 19 nt, Homo sapiens
gaagugggaauaauuggaa

SEQ ID NO: 921696 - RNA, 19 nt, Homo sapiens
gcucaaggccuccucgaaa

SEQ ID NO: 921697 - RNA, 19 nt, Homo sapiens
gaaccgaagcccaggcaaa

SEQ ID NO: 921698 - RNA, 19 nt, Homo sapiens
ucacucaucuucuuucucu

SEQ ID NO: 921699 - RNA, 19 nt, Homo sapiens
ugaagaagugggaauaauu

SEQ ID NO: 921700 - RNA, 19 nt, Homo sapiens
caugcagccuauccaauaa

SEQ ID NO: 921701 - RNA, 19 nt, Homo sapiens
ucaugcagccuauccaaua

SEQ ID NO: 921702 - RNA, 19 nt, Homo sapiens
agacaaacccuccaucuca

SEQ ID NO: 921703 - RNA, 19 nt, Homo sapiens
cuacugccauccagaaguu

SEQ ID NO: 921704 - RNA, 19 nt, Homo sapiens
agaugaagauccaagaaga

SEQ ID NO: 921705 - RNA, 19 nt, Homo sapiens
ggaaauaaacaacaguucu

SEQ ID NO: 921706 - RNA, 19 nt, Homo sapiens
gcuccugagugcaacuuaa

SEQ ID NO: 921707 - RNA, 19 nt, Homo sapiens
caaagaucauccuagaaca

SEQ ID NO: 921708 - RNA, 19 nt, Homo sapiens
gcauagcuguuugagaaau

SEQ ID NO: 921709 - RNA, 19 nt, Homo sapiens
cagccuauccaauaaguaa

SEQ ID NO: 921710 - RNA, 19 nt, Homo sapiens
gugaagaagugggaauaau

SEQ ID NO: 921711 - RNA, 19 nt, Homo sapiens
cagcugcucaugagugaua

SEQ ID NO: 921712 - RNA, 19 nt, Homo sapiens
cauagcuguuugagaaauu

SEQ ID NO: 921713 - RNA, 19 nt, Homo sapiens
gagugcaacuuaauuacca

SEQ ID NO: 921714 - RNA, 19 nt, Homo sapiens
uaaaugauccagccagcuu

SEQ ID NO: 921715 - RNA, 19 nt, Homo sapiens
gcuaauucccuucuucaug

SEQ ID NO: 921716 - RNA, 19 nt, Homo sapiens
cagaacacauggagggaau

SEQ ID NO: 921717 - RNA, 19 nt, Homo sapiens
ccugagugcaacuuaauua

SEQ ID NO: 921718 - RNA, 19 nt, Homo sapiens
ugaaaugggugcuaauucc

SEQ ID NO: 921719 - RNA, 19 nt, Homo sapiens
gcagggugagggaacauuu

SEQ ID NO: 921720 - RNA, 19 nt, Homo sapiens
gaaaagcuccugagugcaa

SEQ ID NO: 921721 - RNA, 19 nt, Homo sapiens
ccagggcccucuuccuuca

SEQ ID NO: 921722 - RNA, 19 nt, Homo sapiens
gcucugcaccgccucacua

SEQ ID NO: 921723 - RNA, 19 nt, Homo sapiens
acaguuggauugggaagaa

SEQ ID NO: 921724 - RNA, 19 nt, Homo sapiens
cucgaaagauguugucaga

SEQ ID NO: 921725 - RNA, 19 nt, Homo sapiens
gagaaauucaggcccaaau

SEQ ID NO: 921726 - RNA, 19 nt, Homo sapiens
ucucugccguggccaguaa

SEQ ID NO: 921727 - RNA, 19 nt, Homo sapiens
ccucuuccuucaucuaaug

SEQ ID NO: 921728 - RNA, 19 nt, Homo sapiens
gcaacuuaauuaccaccau

SEQ ID NO: 921729 - RNA, 19 nt, Homo sapiens
aagaaacacuggacaccau

SEQ ID NO: 921730 - RNA, 19 nt, Homo sapiens
ccaccugccugcuccagau

SEQ ID NO: 921731 - RNA, 19 nt, Homo sapiens
gcaauucuggcucucuuuc

SEQ ID NO: 921732 - RNA, 19 nt, Homo sapiens
ccguggagcugagcaaaga

SEQ ID NO: 921733 - RNA, 19 nt, Homo sapiens
ggugcuaauucccuucuuc

SEQ ID NO: 921734 - RNA, 19 nt, Homo sapiens
ugauaaaugucuccccaua

SEQ ID NO: 921735 - RNA, 19 nt, Homo sapiens
ugacccagcugcucaugag

SEQ ID NO: 921736 - RNA, 19 nt, Homo sapiens
ggugaagaagugggaauaa

SEQ ID NO: 921737 - RNA, 19 nt, Homo sapiens
gaugaagauccaagaagau

SEQ ID NO: 921738 - RNA, 19 nt, Homo sapiens
gugggaauaauuggaaaua

SEQ ID NO: 921739 - RNA, 19 nt, Homo sapiens
acuccuaggugaagaagug

SEQ ID NO: 921740 - RNA, 19 nt, Homo sapiens
gaaccccucuucaguguag

SEQ ID NO: 921741 - RNA, 19 nt, Homo sapiens
gcucuaauuaguucauuuc

SEQ ID NO: 921742 - RNA, 19 nt, Homo sapiens
gacaaagaucauccuagaa

SEQ ID NO: 921743 - RNA, 19 nt, Homo sapiens
gaaguuacaguuggauugg

SEQ ID NO: 921744 - RNA, 19 nt, Homo sapiens
caagaagaucccagccuau

SEQ ID NO: 921745 - RNA, 19 nt, Homo sapiens
acaaagaucauccuagaac

SEQ ID NO: 921746 - RNA, 19 nt, Homo sapiens
agucugaaaugggugcuaa

SEQ ID NO: 921747 - RNA, 19 nt, Homo sapiens
cgucagcugccucugcaua

SEQ ID NO: 921748 - RNA, 19 nt, Homo sapiens
uguuccagcuugucuguga

SEQ ID NO: 921749 - RNA, 19 nt, Homo sapiens
cagccuaugccgagacaaa

SEQ ID NO: 921750 - RNA, 19 nt, Homo sapiens
uaauucccuucuucaugaa

SEQ ID NO: 921751 - RNA, 19 nt, Homo sapiens
caucuucuuucucuuucug

SEQ ID NO: 921752 - RNA, 19 nt, Homo sapiens
gggaagaagcagccagauc

SEQ ID NO: 921753 - RNA, 19 nt, Homo sapiens
gggcuacugccauccagaa

SEQ ID NO: 921754 - RNA, 19 nt, Homo sapiens
gaaacacuggacaccaugu

SEQ ID NO: 921755 - RNA, 19 nt, Homo sapiens
ccagaugaagauccaagaa

SEQ ID NO: 921756 - RNA, 19 nt, Homo sapiens
gcuguucucacucaucuuc

SEQ ID NO: 921757 - RNA, 19 nt, Homo sapiens
cccagcugcucaugaguga

SEQ ID NO: 921758 - RNA, 19 nt, Homo sapiens
gaucauccuagaacaugug

SEQ ID NO: 921759 - RNA, 19 nt, Homo sapiens
ccgaagcccaggcaaauca

SEQ ID NO: 921760 - RNA, 19 nt, Homo sapiens
gcccucuuccuucaucuaa

SEQ ID NO: 921761 - RNA, 19 nt, Homo sapiens
uguaggaagucugaaaugg

SEQ ID NO: 921762 - RNA, 19 nt, Homo sapiens
acucaucuucuuucucuuu

SEQ ID NO: 921763 - RNA, 19 nt, Homo sapiens
agaaguuacaguuggauug

SEQ ID NO: 921764 - RNA, 19 nt, Homo sapiens
auaaaugucuccccauaug

SEQ ID NO: 921765 - RNA, 19 nt, Homo sapiens
gagggaacauuugcaucgu

SEQ ID NO: 921766 - RNA, 19 nt, Homo sapiens
ggaggaggcagaggaacug

SEQ ID NO: 921767 - RNA, 19 nt, Homo sapiens
ucaaggccuccucgaaaga

SEQ ID NO: 921768 - RNA, 19 nt, Homo sapiens
gcugacaaagaucauccua

SEQ ID NO: 921769 - RNA, 19 nt, Homo sapiens
gcagccuauccaauaagua

SEQ ID NO: 921770 - RNA, 19 nt, Homo sapiens
guucucacucaucuucuuu

SEQ ID NO: 921771 - RNA, 19 nt, Homo sapiens
ugccguggccaguaaauga

SEQ ID NO: 921772 - RNA, 19 nt, Homo sapiens
gaagcccaggcaaaucaga

SEQ ID NO: 921773 - RNA, 19 nt, Homo sapiens
gggaaucggacaggugaug

SEQ ID NO: 921774 - RNA, 19 nt, Homo sapiens
ccaggcaaaucagaucucu

SEQ ID NO: 921775 - RNA, 19 nt, Homo sapiens
ccaggaggaggcagaggaa

SEQ ID NO: 921776 - RNA, 19 nt, Homo sapiens
ccgcuguucucacucaucu

SEQ ID NO: 921777 - RNA, 19 nt, Homo sapiens
ggagcugagcaaagaaaca

SEQ ID NO: 921778 - RNA, 19 nt, Homo sapiens
cgagacaaacccuccaucu

SEQ ID NO: 921779 - RNA, 19 nt, Homo sapiens
aagaagaucccagccuaug

SEQ ID NO: 921780 - RNA, 19 nt, Homo sapiens
aaagaucauccuagaacau

SEQ ID NO: 921781 - RNA, 19 nt, Homo sapiens
gaacacauggagggaaucg

SEQ ID NO: 921782 - RNA, 19 nt, Homo sapiens
cccaaaucaugcagccuau

SEQ ID NO: 921783 - RNA, 19 nt, Homo sapiens
guggagcugagcaaagaaa

SEQ ID NO: 921784 - RNA, 19 nt, Homo sapiens
cagaugaagauccaagaag

SEQ ID NO: 921785 - RNA, 19 nt, Homo sapiens
cuggagaguggauaucaaa

SEQ ID NO: 921786 - RNA, 19 nt, Homo sapiens
gcaaucaaguuucuucuuu

SEQ ID NO: 921787 - RNA, 19 nt, Homo sapiens
caaauaaacugugcauaug

SEQ ID NO: 921788 - RNA, 19 nt, Homo sapiens
ggaaugaccuggaauuguc

SEQ ID NO: 921789 - RNA, 19 nt, Homo sapiens
gaugaaagcaaucaaguuu

SEQ ID NO: 921790 - RNA, 19 nt, Homo sapiens
acaaugaucuucuuaggaa

SEQ ID NO: 921791 - RNA, 19 nt, Homo sapiens
acaaagaacucuauacaca

SEQ ID NO: 921792 - RNA, 19 nt, Homo sapiens
gaacagggacucacgugaa

SEQ ID NO: 921793 - RNA, 19 nt, Homo sapiens
ccaaauaaacugugcauau

SEQ ID NO: 921794 - RNA, 19 nt, Homo sapiens
gaacugcaaagaccuguuu

SEQ ID NO: 921795 - RNA, 19 nt, Homo sapiens
ggacagaaauaagagaauc

SEQ ID NO: 921796 - RNA, 19 nt, Homo sapiens
gaaagacaaagaacucuau

SEQ ID NO: 921797 - RNA, 19 nt, Homo sapiens
aaagaacucuauacacaga

SEQ ID NO: 921798 - RNA, 19 nt, Homo sapiens
ccagaaagauuccagaacu

SEQ ID NO: 921799 - RNA, 19 nt, Homo sapiens
gaagaguggccgcaccuuu

SEQ ID NO: 921800 - RNA, 19 nt, Homo sapiens
gggcguuucucaucuguga

SEQ ID NO: 921801 - RNA, 19 nt, Homo sapiens
gcgaagagagaguguauga

SEQ ID NO: 921802 - RNA, 19 nt, Homo sapiens
ccgacaagcccaauguuua

SEQ ID NO: 921803 - RNA, 19 nt, Homo sapiens
gaccagauguacaaugauc

SEQ ID NO: 921804 - RNA, 19 nt, Homo sapiens
ggaaagacaaagaacucua

SEQ ID NO: 921805 - RNA, 19 nt, Homo sapiens
guacaaugaucuucuuagg

SEQ ID NO: 921806 - RNA, 19 nt, Homo sapiens
gauguacaaugaucuucuu

SEQ ID NO: 921807 - RNA, 19 nt, Homo sapiens
gcacaacauccucagcaaa

SEQ ID NO: 921808 - RNA, 19 nt, Homo sapiens
cgacaagcccaauguuuau

SEQ ID NO: 921809 - RNA, 19 nt, Homo sapiens
gcuggugacgguagcauua

SEQ ID NO: 921810 - RNA, 19 nt, Homo sapiens
uacauaugcuggacagaaa

SEQ ID NO: 921811 - RNA, 19 nt, Homo sapiens
gauccucacuugcgaagag

SEQ ID NO: 921812 - RNA, 19 nt, Homo sapiens
cggaagacauggagaacga

SEQ ID NO: 921813 - RNA, 19 nt, Homo sapiens
aaacugugcauaugaaaug

SEQ ID NO: 921814 - RNA, 19 nt, Homo sapiens
cauaugaccagauguacaa

SEQ ID NO: 921815 - RNA, 19 nt, Homo sapiens
gcccaauguuuaugauuuc

SEQ ID NO: 921816 - RNA, 19 nt, Homo sapiens
ugugagcucugccagugua

SEQ ID NO: 921817 - RNA, 19 nt, Homo sapiens
agacaaagaacucuauaca

SEQ ID NO: 921818 - RNA, 19 nt, Homo sapiens
aaagaccuguuugaucuga

SEQ ID NO: 921819 - RNA, 19 nt, Homo sapiens
cagaaagauuccagaacug

SEQ ID NO: 921820 - RNA, 19 nt, Homo sapiens
cuuaugagcgggauauuga

SEQ ID NO: 921821 - RNA, 19 nt, Homo sapiens
aaaggaaagacaacgguuu

SEQ ID NO: 921822 - RNA, 19 nt, Homo sapiens
cauaugcuggacagaaaua

SEQ ID NO: 921823 - RNA, 19 nt, Homo sapiens
gcgggauauugauuacaaa

SEQ ID NO: 921824 - RNA, 19 nt, Homo sapiens
agcccaauguuuaugauuu

SEQ ID NO: 921825 - RNA, 19 nt, Homo sapiens
gcauggaggcgcacaacau

SEQ ID NO: 921826 - RNA, 19 nt, Homo sapiens
caaugaucuucuuaggaaa

SEQ ID NO: 921827 - RNA, 19 nt, Homo sapiens
ggagcuuccuguuguucau

SEQ ID NO: 921828 - RNA, 19 nt, Homo sapiens
gcacaccgucugcuucuac

SEQ ID NO: 921829 - RNA, 19 nt, Homo sapiens
aaccacauaugaccagaug

SEQ ID NO: 921830 - RNA, 19 nt, Homo sapiens
augaccagauguacaauga

SEQ ID NO: 921831 - RNA, 19 nt, Homo sapiens
gagcuuccuguuguucaua

SEQ ID NO: 921832 - RNA, 19 nt, Homo sapiens
caagcccaauguuuaugau

SEQ ID NO: 921833 - RNA, 19 nt, Homo sapiens
cagaaugggauuuuacaua

SEQ ID NO: 921834 - RNA, 19 nt, Homo sapiens
uuacauaugcuggacagaa

SEQ ID NO: 921835 - RNA, 19 nt, Homo sapiens
gaaugggauuuuacauaug

SEQ ID NO: 921836 - RNA, 19 nt, Homo sapiens
gugugcacuucccgacaua

SEQ ID NO: 921837 - RNA, 19 nt, Homo sapiens
ugcaggaguucgaggagaa

SEQ ID NO: 921838 - RNA, 19 nt, Homo sapiens
gagaggagaugccaaaacg

SEQ ID NO: 921839 - RNA, 19 nt, Homo sapiens
gacagaaauaagagaauca

SEQ ID NO: 921840 - RNA, 19 nt, Homo sapiens
agaacucuauacacagaau

SEQ ID NO: 921841 - RNA, 19 nt, Homo sapiens
aaggaaagacaacgguuug

SEQ ID NO: 921842 - RNA, 19 nt, Homo sapiens
guagcauuacccaaauaaa

SEQ ID NO: 921843 - RNA, 19 nt, Homo sapiens
acacggaagacauggagaa

SEQ ID NO: 921844 - RNA, 19 nt, Homo sapiens
gaacucuauacacagaaug

SEQ ID NO: 921845 - RNA, 19 nt, Homo sapiens
uguuaggaaugaccuggaa

SEQ ID NO: 921846 - RNA, 19 nt, Homo sapiens
aaagcaaucaaguuucuuc

SEQ ID NO: 921847 - RNA, 19 nt, Homo sapiens
cagaugaaagcaaucaagu

SEQ ID NO: 921848 - RNA, 19 nt, Homo sapiens
acaagcccaauguuuauga

SEQ ID NO: 921849 - RNA, 19 nt, Homo sapiens
gcauuacccaaauaaacug

SEQ ID NO: 921850 - RNA, 19 nt, Homo sapiens
uagcauuacccaaauaaac

SEQ ID NO: 921851 - RNA, 19 nt, Homo sapiens
ggccagaaagauuccagaa

SEQ ID NO: 921852 - RNA, 19 nt, Homo sapiens
uuaggaaugaccuggaauu

SEQ ID NO: 921853 - RNA, 19 nt, Homo sapiens
ugaaaugggagaggagaug

SEQ ID NO: 921854 - RNA, 19 nt, Homo sapiens
agcgggauauugauuacaa

SEQ ID NO: 921855 - RNA, 19 nt, Homo sapiens
uaugagcgggauauugauu

SEQ ID NO: 921856 - RNA, 19 nt, Homo sapiens
ugagcgggauauugauuac

SEQ ID NO: 921857 - RNA, 19 nt, Homo sapiens
caccgucugcuucuacuga

SEQ ID NO: 921858 - RNA, 19 nt, Homo sapiens
gacaaagaacucuauacac

SEQ ID NO: 921859 - RNA, 19 nt, Homo sapiens
guauccagcacacggaaga

SEQ ID NO: 921860 - RNA, 19 nt, Homo sapiens
ggugguggaagaucugaau

SEQ ID NO: 921861 - RNA, 19 nt, Homo sapiens
aaagauuccagaacugcaa

SEQ ID NO: 921862 - RNA, 19 nt, Homo sapiens
agaugaaagcaaucaaguu

SEQ ID NO: 921863 - RNA, 19 nt, Homo sapiens
ccagaugaaagcaaucaag

SEQ ID NO: 921864 - RNA, 19 nt, Homo sapiens
aagaguggccgcaccuuuc

SEQ ID NO: 921865 - RNA, 19 nt, Homo sapiens
aacagggacucacgugaag

SEQ ID NO: 921866 - RNA, 19 nt, Homo sapiens
uaggaaagacaaagaacuc

SEQ ID NO: 921867 - RNA, 19 nt, Homo sapiens
ugggagaggagaugccaaa

SEQ ID NO: 921868 - RNA, 19 nt, Homo sapiens
uuccuguuguucauacuuu

SEQ ID NO: 921869 - RNA, 19 nt, Homo sapiens
ccucuggagcuuccuguug

SEQ ID NO: 921870 - RNA, 19 nt, Homo sapiens
gacaagcccaauguuuaug

SEQ ID NO: 921871 - RNA, 19 nt, Homo sapiens
gaagcucgaugaagauuua

SEQ ID NO: 921872 - RNA, 19 nt, Homo sapiens
gcagaaauaugcagaagaa

SEQ ID NO: 921873 - RNA, 19 nt, Homo sapiens
ucaaggagcugauaaucua

SEQ ID NO: 921874 - RNA, 19 nt, Homo sapiens
gaaggacacuuaacuuugu

SEQ ID NO: 921875 - RNA, 19 nt, Homo sapiens
ggaaacacaugucacagaa

SEQ ID NO: 921876 - RNA, 19 nt, Homo sapiens
gaagugugcucauugaaau

SEQ ID NO: 921877 - RNA, 19 nt, Homo sapiens
cagaaaggcugaaacacua

SEQ ID NO: 921878 - RNA, 19 nt, Homo sapiens
ggaauuauaugacuggaau

SEQ ID NO: 921879 - RNA, 19 nt, Homo sapiens
gcaagacgcacaggaauua

SEQ ID NO: 921880 - RNA, 19 nt, Homo sapiens
gaagcucuuuggugaauaa

SEQ ID NO: 921881 - RNA, 19 nt, Homo sapiens
gcaagggcauucacauuga

SEQ ID NO: 921882 - RNA, 19 nt, Homo sapiens
ccaacucccucgaggauua

SEQ ID NO: 921883 - RNA, 19 nt, Homo sapiens
caacauagacuacacgauu

SEQ ID NO: 921884 - RNA, 19 nt, Homo sapiens
cugaagacaucaagaaaua

SEQ ID NO: 921885 - RNA, 19 nt, Homo sapiens
ggaauuaggcacagcauuu

SEQ ID NO: 921886 - RNA, 19 nt, Homo sapiens
aauaggagcuguuuacuug

SEQ ID NO: 921887 - RNA, 19 nt, Homo sapiens
ucaaaucgcuauuguuguu

SEQ ID NO: 921888 - RNA, 19 nt, Homo sapiens
gaaaugaggugggaaagag

SEQ ID NO: 921889 - RNA, 19 nt, Homo sapiens
ggccaacuguuauagaaua

SEQ ID NO: 921890 - RNA, 19 nt, Homo sapiens
agacgaagcucgaugaaga

SEQ ID NO: 921891 - RNA, 19 nt, Homo sapiens
gaaguacagacaagaguua

SEQ ID NO: 921892 - RNA, 19 nt, Homo sapiens
caacaaugcuggcagacuu

SEQ ID NO: 921893 - RNA, 19 nt, Homo sapiens
ccaaugccuuguccuaaua

SEQ ID NO: 921894 - RNA, 19 nt, Homo sapiens
ggacugccauuguucagaa

SEQ ID NO: 921895 - RNA, 19 nt, Homo sapiens
gcaaauagucccaaaguca

SEQ ID NO: 921896 - RNA, 19 nt, Homo sapiens
gaaaggaagugcuguccau

SEQ ID NO: 921897 - RNA, 19 nt, Homo sapiens
ggaggaagccaagcaguua

SEQ ID NO: 921898 - RNA, 19 nt, Homo sapiens
guacagaucugauuaugac

SEQ ID NO: 921899 - RNA, 19 nt, Homo sapiens
ucagacaucucccuccaua

SEQ ID NO: 921900 - RNA, 19 nt, Homo sapiens
gaacggaaguacagacaag

SEQ ID NO: 921901 - RNA, 19 nt, Homo sapiens
gcagaagaauacaaugaga

SEQ ID NO: 921902 - RNA, 19 nt, Homo sapiens
gaauuaggcacagcauuua

SEQ ID NO: 921903 - RNA, 19 nt, Homo sapiens
gggauuaacaccuugauaa

SEQ ID NO: 921904 - RNA, 19 nt, Homo sapiens
gaauucggcagcccaaaua

SEQ ID NO: 921905 - RNA, 19 nt, Homo sapiens
ugaaagggcuugaacucuu

SEQ ID NO: 921906 - RNA, 19 nt, Homo sapiens
gaguaggcuucgugacuua

SEQ ID NO: 921907 - RNA, 19 nt, Homo sapiens
gaccaugccugacaagaau

SEQ ID NO: 921908 - RNA, 19 nt, Homo sapiens
gcaaaggcaugauuguuac

SEQ ID NO: 921909 - RNA, 19 nt, Homo sapiens
aaacacaugucacagaaug

SEQ ID NO: 921910 - RNA, 19 nt, Homo sapiens
gauaggauauacuuuccaa

SEQ ID NO: 921911 - RNA, 19 nt, Homo sapiens
caaacaaacugacaaacag

SEQ ID NO: 921912 - RNA, 19 nt, Homo sapiens
gauacgcccugcacaguug

SEQ ID NO: 921913 - RNA, 19 nt, Homo sapiens
gacaagaacuauaccucaa

SEQ ID NO: 921914 - RNA, 19 nt, Homo sapiens
gcaaagacaagaacuauac

SEQ ID NO: 921915 - RNA, 19 nt, Homo sapiens
gcaaugaugcuaccuguuc

SEQ ID NO: 921916 - RNA, 19 nt, Homo sapiens
ggaaggaguuacgguuuau

SEQ ID NO: 921917 - RNA, 19 nt, Homo sapiens
ggaaagagagcaucaagag

SEQ ID NO: 921918 - RNA, 19 nt, Homo sapiens
ggauauacuuuccaagauc

SEQ ID NO: 921919 - RNA, 19 nt, Homo sapiens
gcucuuuggugaauaauag

SEQ ID NO: 921920 - RNA, 19 nt, Homo sapiens
ggauuaacaccuugauaaa

SEQ ID NO: 921921 - RNA, 19 nt, Homo sapiens
uggaaggaguuacgguuua

SEQ ID NO: 921922 - RNA, 19 nt, Homo sapiens
uauaagagaucuggaagga

SEQ ID NO: 921923 - RNA, 19 nt, Homo sapiens
gauaugaggcagucucuga

SEQ ID NO: 921924 - RNA, 19 nt, Homo sapiens
ugaagaagcaauuggagua

SEQ ID NO: 921925 - RNA, 19 nt, Homo sapiens
gaucgacaacuuauugaaa

SEQ ID NO: 921926 - RNA, 19 nt, Homo sapiens
gacgcuugcucuuuaauga

SEQ ID NO: 921927 - RNA, 19 nt, Homo sapiens
gaagaaggaggauuagcaa

SEQ ID NO: 921928 - RNA, 19 nt, Homo sapiens
caacccauaucaucaagga

SEQ ID NO: 921929 - RNA, 19 nt, Homo sapiens
gacccuagacuuucaauug

SEQ ID NO: 921930 - RNA, 19 nt, Homo sapiens
ggaaaugggagcagcaaug

SEQ ID NO: 921931 - RNA, 19 nt, Homo sapiens
gggaaaggaccaaguauuc

SEQ ID NO: 921932 - RNA, 19 nt, Homo sapiens
guacaagacucugcagaca

SEQ ID NO: 921933 - RNA, 19 nt, Homo sapiens
gcagcgcuguacacugaua

SEQ ID NO: 921934 - RNA, 19 nt, Homo sapiens
gaagaagcaauuggaguaa

SEQ ID NO: 921935 - RNA, 19 nt, Homo sapiens
gaguauaucuuugaaggau

SEQ ID NO: 921936 - RNA, 19 nt, Homo sapiens
caacuacaagagccaaaua

SEQ ID NO: 921937 - RNA, 19 nt, Homo sapiens
ggaggaagaagaagaacuu

SEQ ID NO: 921938 - RNA, 19 nt, Homo sapiens
ggcagucucugagcuuaua

SEQ ID NO: 921939 - RNA, 19 nt, Homo sapiens
guggaagaguuaugugaaa

SEQ ID NO: 921940 - RNA, 19 nt, Homo sapiens
gaaauaugcagaagaaugc

SEQ ID NO: 921941 - RNA, 19 nt, Homo sapiens
gaggcagucucugagcuua

SEQ ID NO: 921942 - RNA, 19 nt, Homo sapiens
gaucacgaguauaucuuug

SEQ ID NO: 921943 - RNA, 19 nt, Homo sapiens
gaacuauaccucaaucaag

SEQ ID NO: 921944 - RNA, 19 nt, Homo sapiens
gaaagagagcaucaagaga

SEQ ID NO: 921945 - RNA, 19 nt, Homo sapiens
gauaaggauuuggaauaug

SEQ ID NO: 921946 - RNA, 19 nt, Homo sapiens
gcgaagcucuuuggugaau

SEQ ID NO: 921947 - RNA, 19 nt, Homo sapiens
ugagaacugugggauuuaa

SEQ ID NO: 921948 - RNA, 19 nt, Homo sapiens
ggaagaaggaggauuagca

SEQ ID NO: 921949 - RNA, 19 nt, Homo sapiens
gugaugcuguuguugaauu

SEQ ID NO: 921950 - RNA, 19 nt, Homo sapiens
ggaauucauuaucuaacug

SEQ ID NO: 921951 - RNA, 19 nt, Homo sapiens
gagcuggaguggcagaaau

SEQ ID NO: 921952 - RNA, 19 nt, Homo sapiens
gagagaagguccccagaaa

SEQ ID NO: 921953 - RNA, 19 nt, Homo sapiens
aaacuugacuuuggugaau

SEQ ID NO: 921954 - RNA, 19 nt, Homo sapiens
uugcagcgcuguacacuga

SEQ ID NO: 921955 - RNA, 19 nt, Homo sapiens
ugaacuggauccauuuaug

SEQ ID NO: 921956 - RNA, 19 nt, Homo sapiens
gccaggaauucauuaucua

SEQ ID NO: 921957 - RNA, 19 nt, Homo sapiens
ucauccaagucaucauuua

SEQ ID NO: 921958 - RNA, 19 nt, Homo sapiens
cgaugaagauuuagagagu

SEQ ID NO: 921959 - RNA, 19 nt, Homo sapiens
caaagacgaagcucgauga

SEQ ID NO: 921960 - RNA, 19 nt, Homo sapiens
gaaugaggaggaagaagaa

SEQ ID NO: 921961 - RNA, 19 nt, Homo sapiens
caagaacuauaccucaauc

SEQ ID NO: 921962 - RNA, 19 nt, Homo sapiens
gcaccgagaucacagucau

SEQ ID NO: 921963 - RNA, 19 nt, Homo sapiens
uacaagagccaaauacuga

SEQ ID NO: 921964 - RNA, 19 nt, Homo sapiens
uuuggacgcuugcucuuua

SEQ ID NO: 921965 - RNA, 19 nt, Homo sapiens
caagacagccgguacagau

SEQ ID NO: 921966 - RNA, 19 nt, Homo sapiens
gauugugacccuagacuuu

SEQ ID NO: 921967 - RNA, 19 nt, Homo sapiens
uggauggucuuuauuacaa

SEQ ID NO: 921968 - RNA, 19 nt, Homo sapiens
acagaguacuuauucauuc

SEQ ID NO: 921969 - RNA, 19 nt, Homo sapiens
aaagaaacuugaacuggau

SEQ ID NO: 921970 - RNA, 19 nt, Homo sapiens
ccaagaucguugucuguug

SEQ ID NO: 921971 - RNA, 19 nt, Homo sapiens
gcgagaagcuggucuuauu

SEQ ID NO: 921972 - RNA, 19 nt, Homo sapiens
gaagaaaccgcgcuaacua

SEQ ID NO: 921973 - RNA, 19 nt, Homo sapiens
caccaaacauugaugcuua

SEQ ID NO: 921974 - RNA, 19 nt, Homo sapiens
ccauuaagcuguauaacaa

SEQ ID NO: 921975 - RNA, 19 nt, Homo sapiens
gaaacaaccaccaaacauu

SEQ ID NO: 921976 - RNA, 19 nt, Homo sapiens
ggaccaggcccaaguauau

SEQ ID NO: 921977 - RNA, 19 nt, Homo sapiens
gauuucaacuccuagcuuu

SEQ ID NO: 921978 - RNA, 19 nt, Homo sapiens
aaacauugaugcuuaagga

SEQ ID NO: 921979 - RNA, 19 nt, Homo sapiens
gaacaaguuaucacagaaa

SEQ ID NO: 921980 - RNA, 19 nt, Homo sapiens
ggaaaccucuagaacaagu

SEQ ID NO: 921981 - RNA, 19 nt, Homo sapiens
ucacagaaacugcaaagaa

SEQ ID NO: 921982 - RNA, 19 nt, Homo sapiens
gcgcuacgcugaguacuug

SEQ ID NO: 921983 - RNA, 19 nt, Homo sapiens
gggaaccucgccuuuaaua

SEQ ID NO: 921984 - RNA, 19 nt, Homo sapiens
ccgggaaccucgccuuuaa

SEQ ID NO: 921985 - RNA, 19 nt, Homo sapiens
cauaggagagucaugauuu

SEQ ID NO: 921986 - RNA, 19 nt, Homo sapiens
uagaacaaguuaucacaga

SEQ ID NO: 921987 - RNA, 19 nt, Homo sapiens
aagaagauuucaacuccua

SEQ ID NO: 921988 - RNA, 19 nt, Homo sapiens
aaacaaccaccaaacauug

SEQ ID NO: 921989 - RNA, 19 nt, Homo sapiens
gcaaagaagauuucaacuc

SEQ ID NO: 921990 - RNA, 19 nt, Homo sapiens
gaaacugcaaagaagauuu

SEQ ID NO: 921991 - RNA, 19 nt, Homo sapiens
ggacugguaagaaguuuga

SEQ ID NO: 921992 - RNA, 19 nt, Homo sapiens
agucuuaucuuccaccauu

SEQ ID NO: 921993 - RNA, 19 nt, Homo sapiens
gcaggucgcuacgcauuuc

SEQ ID NO: 921994 - RNA, 19 nt, Homo sapiens
cuggaaaccucuagaacaa

SEQ ID NO: 921995 - RNA, 19 nt, Homo sapiens
cacagaaacugcaaagaag

SEQ ID NO: 921996 - RNA, 19 nt, Homo sapiens
gaacagcucauaggagagu

SEQ ID NO: 921997 - RNA, 19 nt, Homo sapiens
gaaaccgcgcuaacuaguu

SEQ ID NO: 921998 - RNA, 19 nt, Homo sapiens
gaaccucgccuuuaauagc

SEQ ID NO: 921999 - RNA, 19 nt, Homo sapiens
aaaggaggauuugaacaga

SEQ ID NO: 922000 - RNA, 19 nt, Homo sapiens
gguaagaaguuugauagcu

SEQ ID NO: 922001 - RNA, 19 nt, Homo sapiens
gaccaggcccaaguauaua

SEQ ID NO: 922002 - RNA, 19 nt, Homo sapiens
agaacaaguuaucacagaa

SEQ ID NO: 922003 - RNA, 19 nt, Homo sapiens
gaucuggaaaccucuagaa

SEQ ID NO: 922004 - RNA, 19 nt, Homo sapiens
ugaccacagucuuaucuuc

SEQ ID NO: 922005 - RNA, 19 nt, Homo sapiens
gcuggcaaggcuaagauua

SEQ ID NO: 922006 - RNA, 19 nt, Homo sapiens
cgagaagcuggucuuauuu

SEQ ID NO: 922007 - RNA, 19 nt, Homo sapiens
uggauugaccacagucuua

SEQ ID NO: 922008 - RNA, 19 nt, Homo sapiens
gcuagaaacaaccaccaaa

SEQ ID NO: 922009 - RNA, 19 nt, Homo sapiens
uuacguagcagccaaaaua

SEQ ID NO: 922010 - RNA, 19 nt, Homo sapiens
agguggaucuccuuacgua

SEQ ID NO: 922011 - RNA, 19 nt, Homo sapiens
aggaggauuugaacagaaa

SEQ ID NO: 922012 - RNA, 19 nt, Homo sapiens
gaaaaugaguaggcgagaa

SEQ ID NO: 922013 - RNA, 19 nt, Homo sapiens
uaaaggaggauuugaacag

SEQ ID NO: 922014 - RNA, 19 nt, Homo sapiens
aaaccucuagaacaaguua

SEQ ID NO: 922015 - RNA, 19 nt, Homo sapiens
gggaccaggcccaaguaua

SEQ ID NO: 922016 - RNA, 19 nt, Homo sapiens
aagauuagaacagcucaua

SEQ ID NO: 922017 - RNA, 19 nt, Homo sapiens
ggagagucaugauuuugaa

SEQ ID NO: 922018 - RNA, 19 nt, Homo sapiens
cuauaaaggaggauuugaa

SEQ ID NO: 922019 - RNA, 19 nt, Homo sapiens
gagggaccaggcccaagua

SEQ ID NO: 922020 - RNA, 19 nt, Homo sapiens
cagcagggacugguaagaa

SEQ ID NO: 922021 - RNA, 19 nt, Homo sapiens
ggucuuauuuuagguguaa

SEQ ID NO: 922022 - RNA, 19 nt, Homo sapiens
gagaagaaaccgcgcuaac

SEQ ID NO: 922023 - RNA, 19 nt, Homo sapiens
ccaccauuaagcuguauaa

SEQ ID NO: 922024 - RNA, 19 nt, Homo sapiens
uagaaacaaccaccaaaca

SEQ ID NO: 922025 - RNA, 19 nt, Homo sapiens
caaaagacuugcuagaaac

SEQ ID NO: 922026 - RNA, 19 nt, Homo sapiens
gaggguccgcguuggcuuu

SEQ ID NO: 922027 - RNA, 19 nt, Homo sapiens
agaagcuggucuuauuuua

SEQ ID NO: 922028 - RNA, 19 nt, Homo sapiens
ggauugaccacagucuuau

SEQ ID NO: 922029 - RNA, 19 nt, Homo sapiens
aaggaggauuugaacagaa

SEQ ID NO: 922030 - RNA, 19 nt, Homo sapiens
aaacugcaaagaagauuuc

SEQ ID NO: 922031 - RNA, 19 nt, Homo sapiens
accaaacauugaugcuuaa

SEQ ID NO: 922032 - RNA, 19 nt, Homo sapiens
gauuagaacagcucauagg

SEQ ID NO: 922033 - RNA, 19 nt, Homo sapiens
gagaagcuggucuuauuuu

SEQ ID NO: 922034 - RNA, 19 nt, Homo sapiens
ggugucaucgcuccaguug

SEQ ID NO: 922035 - RNA, 19 nt, Homo sapiens
ccagugcccuuggcuccuu

SEQ ID NO: 922036 - RNA, 19 nt, Homo sapiens
agaaacaaccaccaaacau

SEQ ID NO: 922037 - RNA, 19 nt, Homo sapiens
gcuuugcgccugugagugu

SEQ ID NO: 922038 - RNA, 19 nt, Homo sapiens
gaaucacccagauaaaggu

SEQ ID NO: 922039 - RNA, 19 nt, Homo sapiens
cuacuauaaaggaggauuu

SEQ ID NO: 922040 - RNA, 19 nt, Homo sapiens
cagaaacugcaaagaagau

SEQ ID NO: 922041 - RNA, 19 nt, Homo sapiens
caucaguucgcagggcuua

SEQ ID NO: 922042 - RNA, 19 nt, Homo sapiens
uauauggauugaccacagu

SEQ ID NO: 922043 - RNA, 19 nt, Homo sapiens
cuuccaccauuaagcugua

SEQ ID NO: 922044 - RNA, 19 nt, Homo sapiens
ugaaucacccagauaaagg

SEQ ID NO: 922045 - RNA, 19 nt, Homo sapiens
caucugcuggcaaggcuaa

SEQ ID NO: 922046 - RNA, 19 nt, Homo sapiens
acagaaacugcaaagaaga

SEQ ID NO: 922047 - RNA, 19 nt, Homo sapiens
gcagggacugguaagaagu

SEQ ID NO: 922048 - RNA, 19 nt, Homo sapiens
gucuuaucuuccaccauua

SEQ ID NO: 922049 - RNA, 19 nt, Homo sapiens
ggaaccucgccuuuaauag

SEQ ID NO: 922050 - RNA, 19 nt, Homo sapiens
cacuggaucugcgagaaga

SEQ ID NO: 922051 - RNA, 19 nt, Homo sapiens
gaaaccucuagaacaaguu

SEQ ID NO: 922052 - RNA, 19 nt, Homo sapiens
gcuguaggacuggguguug

SEQ ID NO: 922053 - RNA, 19 nt, Homo sapiens
ccaccaaacauugaugcuu

SEQ ID NO: 922054 - RNA, 19 nt, Homo sapiens
uauaaaggaggauuugaac

SEQ ID NO: 922055 - RNA, 19 nt, Homo sapiens
gcuugcacgggacacguua

SEQ ID NO: 922056 - RNA, 19 nt, Homo sapiens
agcccacccucaggcauua

SEQ ID NO: 922057 - RNA, 19 nt, Homo sapiens
cuaaaacauggucuucuua

SEQ ID NO: 922058 - RNA, 19 nt, Homo sapiens
ucuaaaacauggucuucuu

SEQ ID NO: 922059 - RNA, 19 nt, Homo sapiens
caucugauucgaccaacau

SEQ ID NO: 922060 - RNA, 19 nt, Homo sapiens
ucuggaaaccucuagaaca

SEQ ID NO: 922061 - RNA, 19 nt, Homo sapiens
gagugugauucaagaacgu

SEQ ID NO: 922062 - RNA, 19 nt, Homo sapiens
guagaaagguggaacauuc

SEQ ID NO: 922063 - RNA, 19 nt, Homo sapiens
gguaggaagucacggaaua

SEQ ID NO: 922064 - RNA, 19 nt, Homo sapiens
ggaaauaugccuggaagua

SEQ ID NO: 922065 - RNA, 19 nt, Homo sapiens
ccaagaggauuauucuauu

SEQ ID NO: 922066 - RNA, 19 nt, Homo sapiens
agucaggccuauagaauua

SEQ ID NO: 922067 - RNA, 19 nt, Homo sapiens
gaacauucccuuucaguca

SEQ ID NO: 922068 - RNA, 19 nt, Homo sapiens
gcacaaguacaaguaaaua

SEQ ID NO: 922069 - RNA, 19 nt, Homo sapiens
gaggacacguuucugcuuu

SEQ ID NO: 922070 - RNA, 19 nt, Homo sapiens
guaacaaaguucacauuca

SEQ ID NO: 922071 - RNA, 19 nt, Homo sapiens
aaacaacccagaagaaauu

SEQ ID NO: 922072 - RNA, 19 nt, Homo sapiens
uguaguaucugcauuccua

SEQ ID NO: 922073 - RNA, 19 nt, Homo sapiens
cuaccaagauugaccgaaa

SEQ ID NO: 922074 - RNA, 19 nt, Homo sapiens
gucagggucugguguagua

SEQ ID NO: 922075 - RNA, 19 nt, Homo sapiens
ccacugcacuuuccagaca

SEQ ID NO: 922076 - RNA, 19 nt, Homo sapiens
cagaacuacuggaaacuga

SEQ ID NO: 922077 - RNA, 19 nt, Homo sapiens
gucaaaggcuugcuaccaa

SEQ ID NO: 922078 - RNA, 19 nt, Homo sapiens
gaaauaugccuggaaguag

SEQ ID NO: 922079 - RNA, 19 nt, Homo sapiens
gcaaggaaccacugcacuu

SEQ ID NO: 922080 - RNA, 19 nt, Homo sapiens
gauaggcccucaggcuuug

SEQ ID NO: 922081 - RNA, 19 nt, Homo sapiens
gaaacugaaugcauuuagc

SEQ ID NO: 922082 - RNA, 19 nt, Homo sapiens
gaagucauucauuagguaa

SEQ ID NO: 922083 - RNA, 19 nt, Homo sapiens
ucaaguucaccaagucuua

SEQ ID NO: 922084 - RNA, 19 nt, Homo sapiens
caaggaaccacugcacuuu

SEQ ID NO: 922085 - RNA, 19 nt, Homo sapiens
gaaaacaacccagaagaaa

SEQ ID NO: 922086 - RNA, 19 nt, Homo sapiens
gaacgcagcgaaggacuau

SEQ ID NO: 922087 - RNA, 19 nt, Homo sapiens
gggaagucauggacagguu

SEQ ID NO: 922088 - RNA, 19 nt, Homo sapiens
acuggaaacugaaugcauu

SEQ ID NO: 922089 - RNA, 19 nt, Homo sapiens
gaacuacuggaaacugaau

SEQ ID NO: 922090 - RNA, 19 nt, Homo sapiens
cagacaagcaggccaagaa

SEQ ID NO: 922091 - RNA, 19 nt, Homo sapiens
ccagaucuccuuucaccaa

SEQ ID NO: 922092 - RNA, 19 nt, Homo sapiens
ggaagucauggacagguuu

SEQ ID NO: 922093 - RNA, 19 nt, Homo sapiens
cacauucaaccaguuauua

SEQ ID NO: 922094 - RNA, 19 nt, Homo sapiens
guucacauucaaccaguua

SEQ ID NO: 922095 - RNA, 19 nt, Homo sapiens
ggaaacugaaugcauuuag

SEQ ID NO: 922096 - RNA, 19 nt, Homo sapiens
ggaacgcagcgaaggacua

SEQ ID NO: 922097 - RNA, 19 nt, Homo sapiens
gaaauggucgggaagucau

SEQ ID NO: 922098 - RNA, 19 nt, Homo sapiens
gaucuucugguguuuaauc

SEQ ID NO: 922099 - RNA, 19 nt, Homo sapiens
uggcaggaguggaaauaug

SEQ ID NO: 922100 - RNA, 19 nt, Homo sapiens
auuccuagccucuaugaua

SEQ ID NO: 922101 - RNA, 19 nt, Homo sapiens
ggaggacacguuucugcuu

SEQ ID NO: 922102 - RNA, 19 nt, Homo sapiens
gaacuggcaggaguggaaa

SEQ ID NO: 922103 - RNA, 19 nt, Homo sapiens
ucaggccuauagaauuauu

SEQ ID NO: 922104 - RNA, 19 nt, Homo sapiens
caccaagucuuagcauaca

SEQ ID NO: 922105 - RNA, 19 nt, Homo sapiens
gacaaaaggucugcaagga

SEQ ID NO: 922106 - RNA, 19 nt, Homo sapiens
aaguugaucuucugguguu

SEQ ID NO: 922107 - RNA, 19 nt, Homo sapiens
caugugcacugauaucaac

SEQ ID NO: 922108 - RNA, 19 nt, Homo sapiens
ugauaggcccucaggcuuu

SEQ ID NO: 922109 - RNA, 19 nt, Homo sapiens
guacaugugcacugauauc

SEQ ID NO: 922110 - RNA, 19 nt, Homo sapiens
ccucaggcuuuguacaugu

SEQ ID NO: 922111 - RNA, 19 nt, Homo sapiens
cgaacuggcaggaguggaa

SEQ ID NO: 922112 - RNA, 19 nt, Homo sapiens
uuguacaugugcacugaua

SEQ ID NO: 922113 - RNA, 19 nt, Homo sapiens
gaucuccuuucaccaagag

SEQ ID NO: 922114 - RNA, 19 nt, Homo sapiens
gguuccagaucuccuuuca

SEQ ID NO: 922115 - RNA, 19 nt, Homo sapiens
caaccaguuauuacagauu

SEQ ID NO: 922116 - RNA, 19 nt, Homo sapiens
gguagaaagguggaacauu

SEQ ID NO: 922117 - RNA, 19 nt, Homo sapiens
agacaagcaggccaagaaa

SEQ ID NO: 922118 - RNA, 19 nt, Homo sapiens
uugaucuucugguguuuaa

SEQ ID NO: 922119 - RNA, 19 nt, Homo sapiens
ucacauucaaccaguuauu

SEQ ID NO: 922120 - RNA, 19 nt, Homo sapiens
ucagucaggccuauagaau

SEQ ID NO: 922121 - RNA, 19 nt, Homo sapiens
gcauuccuagccucuauga

SEQ ID NO: 922122 - RNA, 19 nt, Homo sapiens
uucauuagguaacaaggaa

SEQ ID NO: 922123 - RNA, 19 nt, Homo sapiens
uguagugacuccaccucaa

SEQ ID NO: 922124 - RNA, 19 nt, Homo sapiens
ggucaaaggcuugcuacca

SEQ ID NO: 922125 - RNA, 19 nt, Homo sapiens
cagucaggccuauagaauu

SEQ ID NO: 922126 - RNA, 19 nt, Homo sapiens
ucaaccaguuauuacagau

SEQ ID NO: 922127 - RNA, 19 nt, Homo sapiens
uugcacaaguacaaguaaa

SEQ ID NO: 922128 - RNA, 19 nt, Homo sapiens
cagaaauggucgggaaguc

SEQ ID NO: 922129 - RNA, 19 nt, Homo sapiens
gcagaaauggucgggaagu

SEQ ID NO: 922130 - RNA, 19 nt, Homo sapiens
cugcauuccuagccucuau

SEQ ID NO: 922131 - RNA, 19 nt, Homo sapiens
aaacugaaugcauuuagca

SEQ ID NO: 922132 - RNA, 19 nt, Homo sapiens
accaagaggauuauucuau

SEQ ID NO: 922133 - RNA, 19 nt, Homo sapiens
ucaccaagaggauuauucu

SEQ ID NO: 922134 - RNA, 19 nt, Homo sapiens
cauuagguaacaaggaauu

SEQ ID NO: 922135 - RNA, 19 nt, Homo sapiens
ucaccaagucuuagcauac

SEQ ID NO: 922136 - RNA, 19 nt, Homo sapiens
guugaucuucugguguuua

SEQ ID NO: 922137 - RNA, 19 nt, Homo sapiens
ggacacguuucugcuuuug

SEQ ID NO: 922138 - RNA, 19 nt, Homo sapiens
guccucaaguucaccaagu

SEQ ID NO: 922139 - RNA, 19 nt, Homo sapiens
guaggaagucacggaauag

SEQ ID NO: 922140 - RNA, 19 nt, Homo sapiens
guagugacuccaccucaag

SEQ ID NO: 922141 - RNA, 19 nt, Homo sapiens
uguaacaaaguucacauuc

SEQ ID NO: 922142 - RNA, 19 nt, Homo sapiens
acaagcaggccaagaaacu

SEQ ID NO: 922143 - RNA, 19 nt, Homo sapiens
ccuuucaccaagaggauua

SEQ ID NO: 922144 - RNA, 19 nt, Homo sapiens
ggagauaccuuuaccauga

SEQ ID NO: 922145 - RNA, 19 nt, Homo sapiens
gagcauacggcaccaauua

SEQ ID NO: 922146 - RNA, 19 nt, Homo sapiens
gaacaaggcaaagcaauaa

SEQ ID NO: 922147 - RNA, 19 nt, Homo sapiens
gcagauccaugcaaauugu

SEQ ID NO: 922148 - RNA, 19 nt, Homo sapiens
ccaugaacuuacagaauua

SEQ ID NO: 922149 - RNA, 19 nt, Homo sapiens
gaacaugccguaacucugu

SEQ ID NO: 922150 - RNA, 19 nt, Homo sapiens
gcaaagcaauaacuggaau

SEQ ID NO: 922151 - RNA, 19 nt, Homo sapiens
gaaugugcgucgucgcuuu

SEQ ID NO: 922152 - RNA, 19 nt, Homo sapiens
agaagacgcugggaauuaa

SEQ ID NO: 922153 - RNA, 19 nt, Homo sapiens
gguacuagaugacaagaau

SEQ ID NO: 922154 - RNA, 19 nt, Homo sapiens
caugaacgcuggagcuuau

SEQ ID NO: 922155 - RNA, 19 nt, Homo sapiens
gagauaccuuuaccaugaa

SEQ ID NO: 922156 - RNA, 19 nt, Homo sapiens
gaauuaaacuuccuuuccu

SEQ ID NO: 922157 - RNA, 19 nt, Homo sapiens
gcaagccucugcaaaucug

SEQ ID NO: 922158 - RNA, 19 nt, Homo sapiens
guaagcaccacauauauca

SEQ ID NO: 922159 - RNA, 19 nt, Homo sapiens
guaacucugugacugcauu

SEQ ID NO: 922160 - RNA, 19 nt, Homo sapiens
agugauauauuccugguuu

SEQ ID NO: 922161 - RNA, 19 nt, Homo sapiens
gaauuccagaccaauauuu

SEQ ID NO: 922162 - RNA, 19 nt, Homo sapiens
accaugaacuuacagaauu

SEQ ID NO: 922163 - RNA, 19 nt, Homo sapiens
aagaagacgcugggaauua

SEQ ID NO: 922164 - RNA, 19 nt, Homo sapiens
gcuguaguucuguuauuua

SEQ ID NO: 922165 - RNA, 19 nt, Homo sapiens
gguaagcaguccugugagu

SEQ ID NO: 922166 - RNA, 19 nt, Homo sapiens
cagacagacucuacucaga

SEQ ID NO: 922167 - RNA, 19 nt, Homo sapiens
aaacuuccuuuccuuguca

SEQ ID NO: 922168 - RNA, 19 nt, Homo sapiens
cagcaagccucugcaaauc

SEQ ID NO: 922169 - RNA, 19 nt, Homo sapiens
gauauauuccugguuugua

SEQ ID NO: 922170 - RNA, 19 nt, Homo sapiens
agaacaaggcaaagcaaua

SEQ ID NO: 922171 - RNA, 19 nt, Homo sapiens
ggaauuccagaccaauauu

SEQ ID NO: 922172 - RNA, 19 nt, Homo sapiens
gcaugaacgcuggagcuua

SEQ ID NO: 922173 - RNA, 19 nt, Homo sapiens
gaagugcagguacuagaug

SEQ ID NO: 922174 - RNA, 19 nt, Homo sapiens
ccaagaagacgcugggaau

SEQ ID NO: 922175 - RNA, 19 nt, Homo sapiens
gagauugaagggacaaaug

SEQ ID NO: 922176 - RNA, 19 nt, Homo sapiens
gacagacucuacucagaag

SEQ ID NO: 922177 - RNA, 19 nt, Homo sapiens
gaagacgcugggaauuaaa

SEQ ID NO: 922178 - RNA, 19 nt, Homo sapiens
gauugaagggacaaaugua

SEQ ID NO: 922179 - RNA, 19 nt, Homo sapiens
aauugugacucgagggaua

SEQ ID NO: 922180 - RNA, 19 nt, Homo sapiens
caagaagacgcugggaauu

SEQ ID NO: 922181 - RNA, 19 nt, Homo sapiens
gccgguaguugcugugguu

SEQ ID NO: 922182 - RNA, 19 nt, Homo sapiens
uaaacuuccuuuccuuguc

SEQ ID NO: 922183 - RNA, 19 nt, Homo sapiens
agacagacucuacucagaa

SEQ ID NO: 922184 - RNA, 19 nt, Homo sapiens
gcucugcuguaguucuguu

SEQ ID NO: 922185 - RNA, 19 nt, Homo sapiens
gagcaccacccgggucaaa

SEQ ID NO: 922186 - RNA, 19 nt, Homo sapiens
gcauacggcaccaauuaca

SEQ ID NO: 922187 - RNA, 19 nt, Homo sapiens
auaaggaauuccagaccaa

SEQ ID NO: 922188 - RNA, 19 nt, Homo sapiens
caaagcaauaacuggaauu

SEQ ID NO: 922189 - RNA, 19 nt, Homo sapiens
gcugaagaucgcggacuua

SEQ ID NO: 922190 - RNA, 19 nt, Homo sapiens
gagcucaaccacccuucuu

SEQ ID NO: 922191 - RNA, 19 nt, Homo sapiens
guacggaauggccacauca

SEQ ID NO: 922192 - RNA, 19 nt, Homo sapiens
gguacggaauggccacauc

SEQ ID NO: 922193 - RNA, 19 nt, Homo sapiens
uuccugcgguuuauucuau

SEQ ID NO: 922194 - RNA, 19 nt, Homo sapiens
gugauauauuccugguuug

SEQ ID NO: 922195 - RNA, 19 nt, Homo sapiens
cucugugacugcauuguaa

SEQ ID NO: 922196 - RNA, 19 nt, Homo sapiens
ugcuguaguucuguuauuu

SEQ ID NO: 922197 - RNA, 19 nt, Homo sapiens
aguuugcucugcuguaguu

SEQ ID NO: 922198 - RNA, 19 nt, Homo sapiens
gcugugguuuccguucuga

SEQ ID NO: 922199 - RNA, 19 nt, Homo sapiens
ggcaaagcaauaacuggaa

SEQ ID NO: 922200 - RNA, 19 nt, Homo sapiens
gcaccacauauaucacaug

SEQ ID NO: 922201 - RNA, 19 nt, Homo sapiens
aaggaauuccagaccaaua

SEQ ID NO: 922202 - RNA, 19 nt, Homo sapiens
cugcuguaguucuguuauu

SEQ ID NO: 922203 - RNA, 19 nt, Homo sapiens
gcagguacuagaugacaag

SEQ ID NO: 922204 - RNA, 19 nt, Homo sapiens
gcucggugccuguaucuac

SEQ ID NO: 922205 - RNA, 19 nt, Homo sapiens
caaggcaaagcaauaacug

SEQ ID NO: 922206 - RNA, 19 nt, Homo sapiens
aagugcagguacuagauga

SEQ ID NO: 922207 - RNA, 19 nt, Homo sapiens
cgaagugcagguacuagau

SEQ ID NO: 922208 - RNA, 19 nt, Homo sapiens
gcugugucauacucauaau

SEQ ID NO: 922209 - RNA, 19 nt, Homo sapiens
uuaguuugcucugcuguag

SEQ ID NO: 922210 - RNA, 19 nt, Homo sapiens
ccgacggguuuacuucuca

SEQ ID NO: 922211 - RNA, 19 nt, Homo sapiens
gaagggacaaauguaagca

SEQ ID NO: 922212 - RNA, 19 nt, Homo sapiens
ugcgguuuauucuauguuu

SEQ ID NO: 922213 - RNA, 19 nt, Homo sapiens
uaccaugaacuuacagaau

SEQ ID NO: 922214 - RNA, 19 nt, Homo sapiens
uauacuugguguugcuugu

SEQ ID NO: 922215 - RNA, 19 nt, Homo sapiens
cugcaaaucugggacaaaa

SEQ ID NO: 922216 - RNA, 19 nt, Homo sapiens
caacuugcuagacuucaca

SEQ ID NO: 922217 - RNA, 19 nt, Homo sapiens
agacucuacucagaagaug

SEQ ID NO: 922218 - RNA, 19 nt, Homo sapiens
cggguuuacuucucagaca

SEQ ID NO: 922219 - RNA, 19 nt, Homo sapiens
cagaacaaggcaaagcaau

SEQ ID NO: 922220 - RNA, 19 nt, Homo sapiens
ggaauggccacaucaaaag

SEQ ID NO: 922221 - RNA, 19 nt, Homo sapiens
guacuagaugacaagaaug

SEQ ID NO: 922222 - RNA, 19 nt, Homo sapiens
caaaggaagccaacaauua

SEQ ID NO: 922223 - RNA, 19 nt, Homo sapiens
caagacaaaucucuacaua

SEQ ID NO: 922224 - RNA, 19 nt, Homo sapiens
ggugaaauauggaacaaua

SEQ ID NO: 922225 - RNA, 19 nt, Homo sapiens
acacagcccuggaaacaua

SEQ ID NO: 922226 - RNA, 19 nt, Homo sapiens
ugagagacuucaucaauaa

SEQ ID NO: 922227 - RNA, 19 nt, Homo sapiens
gcaguaagguagaaauaga

SEQ ID NO: 922228 - RNA, 19 nt, Homo sapiens
ugaagaugauggugaaaua

SEQ ID NO: 922229 - RNA, 19 nt, Homo sapiens
gauuaugacucuacuaaga

SEQ ID NO: 922230 - RNA, 19 nt, Homo sapiens
uaauaaaccuugcuacugu

SEQ ID NO: 922231 - RNA, 19 nt, Homo sapiens
gagaaagaaacacugauua

SEQ ID NO: 922232 - RNA, 19 nt, Homo sapiens
cagaauauguugcuuugaa

SEQ ID NO: 922233 - RNA, 19 nt, Homo sapiens
ggaagaagcagcuaagaug

SEQ ID NO: 922234 - RNA, 19 nt, Homo sapiens
gcacuuggauucugguguu

SEQ ID NO: 922235 - RNA, 19 nt, Homo sapiens
gaagagucaugaagaaaca

SEQ ID NO: 922236 - RNA, 19 nt, Homo sapiens
uugaggaacuccaauauuu

SEQ ID NO: 922237 - RNA, 19 nt, Homo sapiens
agaauuaagugcagaaaga

SEQ ID NO: 922238 - RNA, 19 nt, Homo sapiens
cuaauggacugaccuuaaa

SEQ ID NO: 922239 - RNA, 19 nt, Homo sapiens
aacaauaucuccagaagaa

SEQ ID NO: 922240 - RNA, 19 nt, Homo sapiens
ccacaucucaguuaucuaa

SEQ ID NO: 922241 - RNA, 19 nt, Homo sapiens
aaagacagaugaacccaaa

SEQ ID NO: 922242 - RNA, 19 nt, Homo sapiens
uauggaagcuugaaggauu

SEQ ID NO: 922243 - RNA, 19 nt, Homo sapiens
gagcgugucuauuacaaga

SEQ ID NO: 922244 - RNA, 19 nt, Homo sapiens
gcaaagggccaggcaguaa

SEQ ID NO: 922245 - RNA, 19 nt, Homo sapiens
uugcagagcgugucuauua

SEQ ID NO: 922246 - RNA, 19 nt, Homo sapiens
ggacugaccuuaaaacuca

SEQ ID NO: 922247 - RNA, 19 nt, Homo sapiens
ggaacaauaucuccagaag

SEQ ID NO: 922248 - RNA, 19 nt, Homo sapiens
gcagaagaagacaagauua

SEQ ID NO: 922249 - RNA, 19 nt, Homo sapiens
ggacaaauaagggaauaaa

SEQ ID NO: 922250 - RNA, 19 nt, Homo sapiens
ggucauaaacacugcauaa

SEQ ID NO: 922251 - RNA, 19 nt, Homo sapiens
uauaggauuugcuggauuu

SEQ ID NO: 922252 - RNA, 19 nt, Homo sapiens
acaaauggcuuggaaagga

SEQ ID NO: 922253 - RNA, 19 nt, Homo sapiens
gaaacaguaucuaacacau

SEQ ID NO: 922254 - RNA, 19 nt, Homo sapiens
gaaaugauugcucuucaga

SEQ ID NO: 922255 - RNA, 19 nt, Homo sapiens
agaaagugcugaauuuaca

SEQ ID NO: 922256 - RNA, 19 nt, Homo sapiens
cacauacacuggaagauga

SEQ ID NO: 922257 - RNA, 19 nt, Homo sapiens
cagaagaagacaagauuaa

SEQ ID NO: 922258 - RNA, 19 nt, Homo sapiens
gaacuuuucugucuuacaa

SEQ ID NO: 922259 - RNA, 19 nt, Homo sapiens
gcaauagguuuguaaaaug

SEQ ID NO: 922260 - RNA, 19 nt, Homo sapiens
ccaggagucuuucaacugu

SEQ ID NO: 922261 - RNA, 19 nt, Homo sapiens
agagaagagucaugaagaa

SEQ ID NO: 922262 - RNA, 19 nt, Homo sapiens
gcacauacacuggaagaug

SEQ ID NO: 922263 - RNA, 19 nt, Homo sapiens
gaauccuuauuuccucaua

SEQ ID NO: 922264 - RNA, 19 nt, Homo sapiens
aaaggaagccaacaauuau

SEQ ID NO: 922265 - RNA, 19 nt, Homo sapiens
aaucauuccuuccuuguga

SEQ ID NO: 922266 - RNA, 19 nt, Homo sapiens
cauaaacacugcauaaagc

SEQ ID NO: 922267 - RNA, 19 nt, Homo sapiens
gaacaauaucuccagaaga

SEQ ID NO: 922268 - RNA, 19 nt, Homo sapiens
gaacuaaaaccuacaguga

SEQ ID NO: 922269 - RNA, 19 nt, Homo sapiens
gagaaagaaagacaaucua

SEQ ID NO: 922270 - RNA, 19 nt, Homo sapiens
uauguacucucuaagaaga

SEQ ID NO: 922271 - RNA, 19 nt, Homo sapiens
cagaugaacccaaaggaaa

SEQ ID NO: 922272 - RNA, 19 nt, Homo sapiens
ccaaucagcacucuguaaa

SEQ ID NO: 922273 - RNA, 19 nt, Homo sapiens
aaucagcgcucuguagcua

SEQ ID NO: 922274 - RNA, 19 nt, Homo sapiens
aaacacugauugacuuugu

SEQ ID NO: 922275 - RNA, 19 nt, Homo sapiens
gaugaaacaguaucuaaca

SEQ ID NO: 922276 - RNA, 19 nt, Homo sapiens
aagaguggauuggaucaua

SEQ ID NO: 922277 - RNA, 19 nt, Homo sapiens
aaacagaagccuauuugga

SEQ ID NO: 922278 - RNA, 19 nt, Homo sapiens
agaaaacgaugaaacagua

SEQ ID NO: 922279 - RNA, 19 nt, Homo sapiens
acagaaagccaagcacaua

SEQ ID NO: 922280 - RNA, 19 nt, Homo sapiens
uuuaaccgcugaagacauu

SEQ ID NO: 922281 - RNA, 19 nt, Homo sapiens
gcuaaaggcaauaacagaa

SEQ ID NO: 922282 - RNA, 19 nt, Homo sapiens
uguggaagcuuuguccuuu

SEQ ID NO: 922283 - RNA, 19 nt, Homo sapiens
gagaagagucaugaagaaa

SEQ ID NO: 922284 - RNA, 19 nt, Homo sapiens
ucuaacacauuaaccuuga

SEQ ID NO: 922285 - RNA, 19 nt, Homo sapiens
cagagaaagugacuccaau

SEQ ID NO: 922286 - RNA, 19 nt, Homo sapiens
gcaccaaucagcacucugu

SEQ ID NO: 922287 - RNA, 19 nt, Homo sapiens
ggucagagcaacuauucuu

SEQ ID NO: 922288 - RNA, 19 nt, Homo sapiens
ggaaaagguuaaugaacuu

SEQ ID NO: 922289 - RNA, 19 nt, Homo sapiens
guauaggauuugcuggauu

SEQ ID NO: 922290 - RNA, 19 nt, Homo sapiens
caaggcaugccaaguacua

SEQ ID NO: 922291 - RNA, 19 nt, Homo sapiens
gaagaugauggugaaauau

SEQ ID NO: 922292 - RNA, 19 nt, Homo sapiens
gaaagaaacacugauuacu

SEQ ID NO: 922293 - RNA, 19 nt, Homo sapiens
ccaagcacauacacuggaa

SEQ ID NO: 922294 - RNA, 19 nt, Homo sapiens
gagcaacuauucuuuuguu

SEQ ID NO: 922295 - RNA, 19 nt, Homo sapiens
aaacauauccuccagaaaa

SEQ ID NO: 922296 - RNA, 19 nt, Homo sapiens
gagacuucaucaauaaaca

SEQ ID NO: 922297 - RNA, 19 nt, Homo sapiens
aaacagacaguaccaagga

SEQ ID NO: 922298 - RNA, 19 nt, Homo sapiens
agaguggauuggaucauaa

SEQ ID NO: 922299 - RNA, 19 nt, Homo sapiens
uguggaagauguugauuca

SEQ ID NO: 922300 - RNA, 19 nt, Homo sapiens
ggagggagcgagaguaaag

SEQ ID NO: 922301 - RNA, 19 nt, Homo sapiens
ggaggaagccaagacaaau

SEQ ID NO: 922302 - RNA, 19 nt, Homo sapiens
ucucuaagaagacaaauga

SEQ ID NO: 922303 - RNA, 19 nt, Homo sapiens
aaacacagcccuggaaaca

SEQ ID NO: 922304 - RNA, 19 nt, Homo sapiens
cagaagaagguguuuccua

SEQ ID NO: 922305 - RNA, 19 nt, Homo sapiens
guucuuaacacuuccuauu

SEQ ID NO: 922306 - RNA, 19 nt, Homo sapiens
gccaucaagcgcauuuaua

SEQ ID NO: 922307 - RNA, 19 nt, Homo sapiens
agaagcagcuaagauggaa

SEQ ID NO: 922308 - RNA, 19 nt, Homo sapiens
cccacaagcuggacugaga

SEQ ID NO: 922309 - RNA, 19 nt, Homo sapiens
gagaaugcuuugaaaaugu

SEQ ID NO: 922310 - RNA, 19 nt, Homo sapiens
guaugccacaucucaguua

SEQ ID NO: 922311 - RNA, 19 nt, Homo sapiens
ucuaauggacugaccuuaa

SEQ ID NO: 922312 - RNA, 19 nt, Homo sapiens
cagagaagagucaugaaga

SEQ ID NO: 922313 - RNA, 19 nt, Homo sapiens
caucagagaagagucauga

SEQ ID NO: 922314 - RNA, 19 nt, Homo sapiens
caacaauuaugaggaggau

SEQ ID NO: 922315 - RNA, 19 nt, Homo sapiens
ucaaaggaagccaacaauu

SEQ ID NO: 922316 - RNA, 19 nt, Homo sapiens
gguauaggauuugcuggau

SEQ ID NO: 922317 - RNA, 19 nt, Homo sapiens
aacagaagccuauuuggaa

SEQ ID NO: 922318 - RNA, 19 nt, Homo sapiens
aaagagaaagaaacacuga

SEQ ID NO: 922319 - RNA, 19 nt, Homo sapiens
cuacagugaagacaacuuu

SEQ ID NO: 922320 - RNA, 19 nt, Homo sapiens
caagcuggacugagaauca

SEQ ID NO: 922321 - RNA, 19 nt, Homo sapiens
cuaaaggcaauaacagaaa

SEQ ID NO: 922322 - RNA, 19 nt, Homo sapiens
auacacauguugcuucuua

SEQ ID NO: 922323 - RNA, 19 nt, Homo sapiens
gaauggcaaugcuguuuca

SEQ ID NO: 922324 - RNA, 19 nt, Homo sapiens
ggagucccuuuccugaaua

SEQ ID NO: 922325 - RNA, 19 nt, Homo sapiens
caaguucauuucuguuguu

SEQ ID NO: 922326 - RNA, 19 nt, Homo sapiens
gaacaaacaacgggacuuc

SEQ ID NO: 922327 - RNA, 19 nt, Homo sapiens
guggaucagugaaguuuga

SEQ ID NO: 922328 - RNA, 19 nt, Homo sapiens
uguggaagaucgcaaguga

SEQ ID NO: 922329 - RNA, 19 nt, Homo sapiens
ucccuuuccugaauauaua

SEQ ID NO: 922330 - RNA, 19 nt, Homo sapiens
cagaguaagccuccaagaa

SEQ ID NO: 922331 - RNA, 19 nt, Homo sapiens
gagcccuccuuccauagaa

SEQ ID NO: 922332 - RNA, 19 nt, Homo sapiens
ccucgacucucaaggaugu

SEQ ID NO: 922333 - RNA, 19 nt, Homo sapiens
cugaggaguuugucaaugu

SEQ ID NO: 922334 - RNA, 19 nt, Homo sapiens
augcaaaccucgacucuca

SEQ ID NO: 922335 - RNA, 19 nt, Homo sapiens
cuggaaauucugacaaaua

SEQ ID NO: 922336 - RNA, 19 nt, Homo sapiens
cagagcugcugaggaguuu

SEQ ID NO: 922337 - RNA, 19 nt, Homo sapiens
cagccacccuggucuggaa

SEQ ID NO: 922338 - RNA, 19 nt, Homo sapiens
gcugaggaguuugucaaug

SEQ ID NO: 922339 - RNA, 19 nt, Homo sapiens
uaauacacauguugcuucu

SEQ ID NO: 922340 - RNA, 19 nt, Homo sapiens
agaguaagccuccaagaag

SEQ ID NO: 922341 - RNA, 19 nt, Homo sapiens
ggaauggcaaugcuguuuc

SEQ ID NO: 922342 - RNA, 19 nt, Homo sapiens
uggcaucuguggauuucaa

SEQ ID NO: 922343 - RNA, 19 nt, Homo sapiens
gaaggaggaggaggagaga

SEQ ID NO: 922344 - RNA, 19 nt, Homo sapiens
agacucugauucuggaaau

SEQ ID NO: 922345 - RNA, 19 nt, Homo sapiens
aaaccucgacucucaagga

SEQ ID NO: 922346 - RNA, 19 nt, Homo sapiens
gaggucucuuugcuucauu

SEQ ID NO: 922347 - RNA, 19 nt, Homo sapiens
acaaacaacgggacuucaa

SEQ ID NO: 922348 - RNA, 19 nt, Homo sapiens
acacauguugcuucuuaaa

SEQ ID NO: 922349 - RNA, 19 nt, Homo sapiens
gcaaaccucgacucucaag

SEQ ID NO: 922350 - RNA, 19 nt, Homo sapiens
aacacaaguucauuucugu

SEQ ID NO: 922351 - RNA, 19 nt, Homo sapiens
cacaaguucauuucuguug

SEQ ID NO: 922352 - RNA, 19 nt, Homo sapiens
gguccuuguugucaucugu

SEQ ID NO: 922353 - RNA, 19 nt, Homo sapiens
ccacgguccuuguugucau

SEQ ID NO: 922354 - RNA, 19 nt, Homo sapiens
gagacucugauucuggaaa

SEQ ID NO: 922355 - RNA, 19 nt, Homo sapiens
auucagcccuagcucugua

SEQ ID NO: 922356 - RNA, 19 nt, Homo sapiens
ugucauaguuuccuuuuca

SEQ ID NO: 922357 - RNA, 19 nt, Homo sapiens
gagucccuuuccugaauau

SEQ ID NO: 922358 - RNA, 19 nt, Homo sapiens
gagcugcugaggaguuugu

SEQ ID NO: 922359 - RNA, 19 nt, Homo sapiens
ccacugugccgagguugaa

SEQ ID NO: 922360 - RNA, 19 nt, Homo sapiens
caaaucagcgugguagacu

SEQ ID NO: 922361 - RNA, 19 nt, Homo sapiens
aagaauccuugagugaguu

SEQ ID NO: 922362 - RNA, 19 nt, Homo sapiens
ggucuggaauggcaaugcu

SEQ ID NO: 922363 - RNA, 19 nt, Homo sapiens
uacacauguugcuucuuaa

SEQ ID NO: 922364 - RNA, 19 nt, Homo sapiens
ggaacaaacaacgggacuu

SEQ ID NO: 922365 - RNA, 19 nt, Homo sapiens
guagacugccagccuguuc

SEQ ID NO: 922366 - RNA, 19 nt, Homo sapiens
uggaauggcaaugcuguuu

SEQ ID NO: 922367 - RNA, 19 nt, Homo sapiens
ucaaggaugugaggaacac

SEQ ID NO: 922368 - RNA, 19 nt, Homo sapiens
ccagcgaguuccaaaucag

SEQ ID NO: 922369 - RNA, 19 nt, Homo sapiens
ugaggaguuugucaauguc

SEQ ID NO: 922370 - RNA, 19 nt, Homo sapiens
caaugcuguuucaggacaa

SEQ ID NO: 922371 - RNA, 19 nt, Homo sapiens
aggaggaggaggagagaaa

SEQ ID NO: 922372 - RNA, 19 nt, Homo sapiens
caaacaacgggacuucaac

SEQ ID NO: 922373 - RNA, 19 nt, Homo sapiens
guuugucaaugucuacuac

SEQ ID NO: 922374 - RNA, 19 nt, Homo sapiens
ggaagguccugacggauga

SEQ ID NO: 922375 - RNA, 19 nt, Homo sapiens
ccgaggagcucaagaaguu

SEQ ID NO: 922376 - RNA, 19 nt, Homo sapiens
caaaucauccugaaucuga

SEQ ID NO: 922377 - RNA, 19 nt, Homo sapiens
gaccaaggguguaguaagg

SEQ ID NO: 922378 - RNA, 19 nt, Homo sapiens
gcuucuaccuggagaccua

SEQ ID NO: 922379 - RNA, 19 nt, Homo sapiens
ccaaggguguaguaaggaa

SEQ ID NO: 922380 - RNA, 19 nt, Homo sapiens
cauccugaaucugaucuuu

SEQ ID NO: 922381 - RNA, 19 nt, Homo sapiens
aagccaggccugcacuuua

SEQ ID NO: 922382 - RNA, 19 nt, Homo sapiens
gcaaucccaccaaaucauc

SEQ ID NO: 922383 - RNA, 19 nt, Homo sapiens
caccaaaucauccugaauc

SEQ ID NO: 922384 - RNA, 19 nt, Homo sapiens
ggaccaaggguguaguaag

SEQ ID NO: 922385 - RNA, 19 nt, Homo sapiens
agccaggccugcacuuuau

SEQ ID NO: 922386 - RNA, 19 nt, Homo sapiens
ggaacuggaccugcaagga

SEQ ID NO: 922387 - RNA, 19 nt, Homo sapiens
caagcaagaugcggaagcu

SEQ ID NO: 922388 - RNA, 19 nt, Homo sapiens
caagccaggccugcacuuu

SEQ ID NO: 922389 - RNA, 19 nt, Homo sapiens
ccuuggaccucaccgacaa

SEQ ID NO: 922390 - RNA, 19 nt, Homo sapiens
gcugcuggaugcucuguac

SEQ ID NO: 922391 - RNA, 19 nt, Homo sapiens
gaggagcucaagaaguuca

SEQ ID NO: 922392 - RNA, 19 nt, Homo sapiens
gccaggccugcacuuuaua

SEQ ID NO: 922393 - RNA, 19 nt, Homo sapiens
acaugggccugcaggagau

SEQ ID NO: 922394 - RNA, 19 nt, Homo sapiens
ggaagguccugacggauga

SEQ ID NO: 922395 - RNA, 19 nt, Homo sapiens
ccgaggagcucaagaaguu

SEQ ID NO: 922396 - RNA, 19 nt, Homo sapiens
caaaucauccugaaucuga

SEQ ID NO: 922397 - RNA, 19 nt, Homo sapiens
gaccaaggguguaguaagg

SEQ ID NO: 922398 - RNA, 19 nt, Homo sapiens
gcuucuaccuggagaccua

SEQ ID NO: 922399 - RNA, 19 nt, Homo sapiens
ccaaggguguaguaaggaa

SEQ ID NO: 922400 - RNA, 19 nt, Homo sapiens
cauccugaaucugaucuuu

SEQ ID NO: 922401 - RNA, 19 nt, Homo sapiens
gcaaucccaccaaaucauc

SEQ ID NO: 922402 - RNA, 19 nt, Homo sapiens
caccaaaucauccugaauc

SEQ ID NO: 922403 - RNA, 19 nt, Homo sapiens
ggaccaaggguguaguaag

SEQ ID NO: 922404 - RNA, 19 nt, Homo sapiens
ggaacuggaccugcaagga

SEQ ID NO: 922405 - RNA, 19 nt, Homo sapiens
caagcaagaugcggaagcu

SEQ ID NO: 922406 - RNA, 19 nt, Homo sapiens
ccuuggaccucaccgacaa

SEQ ID NO: 922407 - RNA, 19 nt, Homo sapiens
gcugcuggaugcucuguac

SEQ ID NO: 922408 - RNA, 19 nt, Homo sapiens
gaggagcucaagaaguuca

SEQ ID NO: 922409 - RNA, 19 nt, Homo sapiens
acaugggccugcaggagau

SEQ ID NO: 922410 - RNA, 19 nt, Homo sapiens
ggaagguccugacggauga

SEQ ID NO: 922411 - RNA, 19 nt, Homo sapiens
ccgaggagcucaagaaguu

SEQ ID NO: 922412 - RNA, 19 nt, Homo sapiens
caaaucauccugaaucuga

SEQ ID NO: 922413 - RNA, 19 nt, Homo sapiens
gaccaaggguguaguaagg

SEQ ID NO: 922414 - RNA, 19 nt, Homo sapiens
ccaaggguguaguaaggaa

SEQ ID NO: 922415 - RNA, 19 nt, Homo sapiens
cauccugaaucugaucuuu

SEQ ID NO: 922416 - RNA, 19 nt, Homo sapiens
aagccaggccugcacuuua

SEQ ID NO: 922417 - RNA, 19 nt, Homo sapiens
gcaaucccaccaaaucauc

SEQ ID NO: 922418 - RNA, 19 nt, Homo sapiens
ggaccaaggguguaguaag

SEQ ID NO: 922419 - RNA, 19 nt, Homo sapiens
caccaaaucauccugaauc

SEQ ID NO: 922420 - RNA, 19 nt, Homo sapiens
agccaggccugcacuuuau

SEQ ID NO: 922421 - RNA, 19 nt, Homo sapiens
ggaacuggaccugcaagga

SEQ ID NO: 922422 - RNA, 19 nt, Homo sapiens
caagcaagaugcggaagcu

SEQ ID NO: 922423 - RNA, 19 nt, Homo sapiens
caagccaggccugcacuuu

SEQ ID NO: 922424 - RNA, 19 nt, Homo sapiens
gcugcuggaugcucuguac

SEQ ID NO: 922425 - RNA, 19 nt, Homo sapiens
gaggagcucaagaaguuca

SEQ ID NO: 922426 - RNA, 19 nt, Homo sapiens
gccaggccugcacuuuaua

SEQ ID NO: 922427 - RNA, 19 nt, Homo sapiens
gagcaguccucgugccuua

SEQ ID NO: 922428 - RNA, 19 nt, Homo sapiens
uaccagagcuacauccuua

SEQ ID NO: 922429 - RNA, 19 nt, Homo sapiens
ggucaacgcuaucuuggaa

SEQ ID NO: 922430 - RNA, 19 nt, Homo sapiens
gacgaaagccuucuucuga

SEQ ID NO: 922431 - RNA, 19 nt, Homo sapiens
gccgagaacuuccugauga

SEQ ID NO: 922432 - RNA, 19 nt, Homo sapiens
gagaaggugucagauguga

SEQ ID NO: 922433 - RNA, 19 nt, Homo sapiens
gaagagcggcagaagauug

SEQ ID NO: 922434 - RNA, 19 nt, Homo sapiens
gaacagcugguacagaaug

SEQ ID NO: 922435 - RNA, 19 nt, Homo sapiens
uggaacagcugguacagaa

SEQ ID NO: 922436 - RNA, 19 nt, Homo sapiens
ggaauuugcgcuugaguau

SEQ ID NO: 922437 - RNA, 19 nt, Homo sapiens
gagaagcuacugaccauga

SEQ ID NO: 922438 - RNA, 19 nt, Homo sapiens
gcacccaggcucucuauug

SEQ ID NO: 922439 - RNA, 19 nt, Homo sapiens
gugccaagguggacuuuga

SEQ ID NO: 922440 - RNA, 19 nt, Homo sapiens
gcaaggauggcauugagaa

SEQ ID NO: 922441 - RNA, 19 nt, Homo sapiens
ccuucaagcuggacuauga

SEQ ID NO: 922442 - RNA, 19 nt, Homo sapiens
gagaggagcaucuacaaag

SEQ ID NO: 922443 - RNA, 19 nt, Homo sapiens
cgagaacgcccugaaauug

SEQ ID NO: 922444 - RNA, 19 nt, Homo sapiens
uugaacagcugacugagaa

SEQ ID NO: 922445 - RNA, 19 nt, Homo sapiens
gaauguggcggcagcagaa

SEQ ID NO: 922446 - RNA, 19 nt, Homo sapiens
gcacgaacgccaucaacau

SEQ ID NO: 922447 - RNA, 19 nt, Homo sapiens
gcgcugacccugaguuguu

SEQ ID NO: 922448 - RNA, 19 nt, Homo sapiens
uggagaaggugucagaugu

SEQ ID NO: 922449 - RNA, 19 nt, Homo sapiens
gaaaguggguauggaacag

SEQ ID NO: 922450 - RNA, 19 nt, Homo sapiens
gcucagcccuccccacuaa

SEQ ID NO: 922451 - RNA, 19 nt, Homo sapiens
ggacggagagccgguauca

SEQ ID NO: 922452 - RNA, 19 nt, Homo sapiens
ugaguccucugaccucuau

SEQ ID NO: 922453 - RNA, 19 nt, Homo sapiens
ggauugugcucugcaagug

SEQ ID NO: 922454 - RNA, 19 nt, Homo sapiens
ugaccucuauucagaaauc

SEQ ID NO: 922455 - RNA, 19 nt, Homo sapiens
gaaggugucagaugugaag

SEQ ID NO: 922456 - RNA, 19 nt, Homo sapiens
cauccuggcuacccuccua

SEQ ID NO: 922457 - RNA, 19 nt, Homo sapiens
gcccaaggagccacugaua

SEQ ID NO: 922458 - RNA, 19 nt, Homo sapiens
gcaugugagugugugugua

SEQ ID NO: 922459 - RNA, 19 nt, Homo sapiens
agagugggcucggagauga

SEQ ID NO: 922460 - RNA, 19 nt, Homo sapiens
cagcaaggauggcauugag

SEQ ID NO: 922461 - RNA, 19 nt, Homo sapiens
agccaugccuugagcagua

SEQ ID NO: 922462 - RNA, 19 nt, Homo sapiens
gcaccgccgugucugcaau

SEQ ID NO: 922463 - RNA, 19 nt, Homo sapiens
gugggcaacuuccucaaug

SEQ ID NO: 922464 - RNA, 19 nt, Homo sapiens
ggaggauugugcucugcaa

SEQ ID NO: 922465 - RNA, 19 nt, Homo sapiens
gaacgacgaaagccuucuu

SEQ ID NO: 922466 - RNA, 19 nt, Homo sapiens
gcacggagcaaaauaaaau

SEQ ID NO: 922467 - RNA, 19 nt, Homo sapiens
gggaauuugcgcuugagua

SEQ ID NO: 922468 - RNA, 19 nt, Homo sapiens
gggccaaucugguguccau

SEQ ID NO: 922469 - RNA, 19 nt, Homo sapiens
cuucgcaugugccaacuuu

SEQ ID NO: 922470 - RNA, 19 nt, Homo sapiens
ugaagcugcuguugguguu

SEQ ID NO: 922471 - RNA, 19 nt, Homo sapiens
cuacaacucugggccuuca

SEQ ID NO: 922472 - RNA, 19 nt, Homo sapiens
gaccaggacaugcugaaug

SEQ ID NO: 922473 - RNA, 19 nt, Homo sapiens
uucaguggcuguacacauu

SEQ ID NO: 922474 - RNA, 19 nt, Homo sapiens
ccacuaagaggaagacagu

SEQ ID NO: 922475 - RNA, 19 nt, Homo sapiens
agaacgcccugaaauugga

SEQ ID NO: 922476 - RNA, 19 nt, Homo sapiens
gagaacgcccugaaauugg

SEQ ID NO: 922477 - RNA, 19 nt, Homo sapiens
gagggucaacgcuaucuug

SEQ ID NO: 922478 - RNA, 19 nt, Homo sapiens
gaggaagagcggcagaaga

SEQ ID NO: 922479 - RNA, 19 nt, Homo sapiens
gugcugcccuccaagaaag

SEQ ID NO: 922480 - RNA, 19 nt, Homo sapiens
gccacacgcugcgggaauu

SEQ ID NO: 922481 - RNA, 19 nt, Homo sapiens
ggaugaagaccaggacaug

SEQ ID NO: 922482 - RNA, 19 nt, Homo sapiens
gaacgcacggagcaaaaua

SEQ ID NO: 922483 - RNA, 19 nt, Homo sapiens
gugugugugugcaugcaua

SEQ ID NO: 922484 - RNA, 19 nt, Homo sapiens
ucaccgagacagagaaguu

SEQ ID NO: 922485 - RNA, 19 nt, Homo sapiens
gaggacaccacacacaauc

SEQ ID NO: 922486 - RNA, 19 nt, Homo sapiens
ggagaaggugucagaugug

SEQ ID NO: 922487 - RNA, 19 nt, Homo sapiens
ggauggcauugagaagcua

SEQ ID NO: 922488 - RNA, 19 nt, Homo sapiens
acuaagaggaagacaguaa

SEQ ID NO: 922489 - RNA, 19 nt, Homo sapiens
cgagaggagcaucuacaaa

SEQ ID NO: 922490 - RNA, 19 nt, Homo sapiens
gaagagugggcucggagau

SEQ ID NO: 922491 - RNA, 19 nt, Homo sapiens
gcgcuugaguaucggacuu

SEQ ID NO: 922492 - RNA, 19 nt, Homo sapiens
gcauggagcgggaaauugc

SEQ ID NO: 922493 - RNA, 19 nt, Homo sapiens
ggaagagcggcagaagauu

SEQ ID NO: 922494 - RNA, 19 nt, Homo sapiens
gacuggaacaccucuuuga

SEQ ID NO: 922495 - RNA, 19 nt, Homo sapiens
guauuagccguguguguau

SEQ ID NO: 922496 - RNA, 19 nt, Homo sapiens
aggcugcucugcucaacuu

SEQ ID NO: 922497 - RNA, 19 nt, Homo sapiens
caccugugcaugucauuaa

SEQ ID NO: 922498 - RNA, 19 nt, Homo sapiens
cuaagaggaagacaguaaa

SEQ ID NO: 922499 - RNA, 19 nt, Homo sapiens
gcgagaggagcaucuacaa

SEQ ID NO: 922500 - RNA, 19 nt, Homo sapiens
gcuggagggcuucuaugaa

SEQ ID NO: 922501 - RNA, 19 nt, Homo sapiens
agcagaagcaggccacaua

SEQ ID NO: 922502 - RNA, 19 nt, Homo sapiens
gccacuguuugaccugaaa

SEQ ID NO: 922503 - RNA, 19 nt, Homo sapiens
cagcauggagcgggaaauu

SEQ ID NO: 922504 - RNA, 19 nt, Homo sapiens
ccuggugccugaauuugug

SEQ ID NO: 922505 - RNA, 19 nt, Homo sapiens
caaccccucugucccagua

SEQ ID NO: 922506 - RNA, 19 nt, Homo sapiens
gaaauugcugagccacugu

SEQ ID NO: 922507 - RNA, 19 nt, Homo sapiens
ccucgcugcucgucuacaa

SEQ ID NO: 922508 - RNA, 19 nt, Homo sapiens
gaugacucuugccuccauu

SEQ ID NO: 922509 - RNA, 19 nt, Homo sapiens
cacccaggcucucuauugg

SEQ ID NO: 922510 - RNA, 19 nt, Homo sapiens
cgacgaaagccuucuucug

SEQ ID NO: 922511 - RNA, 19 nt, Homo sapiens
cuacgagaacgcccugaaa

SEQ ID NO: 922512 - RNA, 19 nt, Homo sapiens
gcaugugugugagcuccuu

SEQ ID NO: 922513 - RNA, 19 nt, Homo sapiens
aguauuagccgugugugua

SEQ ID NO: 922514 - RNA, 19 nt, Homo sapiens
gagaaggacguugaagagu

SEQ ID NO: 922515 - RNA, 19 nt, Homo sapiens
ugagaaggacguugaagag

SEQ ID NO: 922516 - RNA, 19 nt, Homo sapiens
gcuccaguuuacccaguga

SEQ ID NO: 922517 - RNA, 19 nt, Homo sapiens
caagguggacuuugaacag

SEQ ID NO: 922518 - RNA, 19 nt, Homo sapiens
aggaagagcggcagaagau

SEQ ID NO: 922519 - RNA, 19 nt, Homo sapiens
acccugaguuguuggugua

SEQ ID NO: 922520 - RNA, 19 nt, Homo sapiens
gcuguaucccggaaaucua

SEQ ID NO: 922521 - RNA, 19 nt, Homo sapiens
ggugcuguaucccggaaau

SEQ ID NO: 922522 - RNA, 19 nt, Homo sapiens
caaccgcaagucuuugaga

SEQ ID NO: 922523 - RNA, 19 nt, Homo sapiens
gcagaagcaggccacauac

SEQ ID NO: 922524 - RNA, 19 nt, Homo sapiens
uugcugagccacuguuuga

SEQ ID NO: 922525 - RNA, 19 nt, Homo sapiens
ggugcugcccuccaagaaa

SEQ ID NO: 922526 - RNA, 19 nt, Homo sapiens
acgagaacgcccugaaauu

SEQ ID NO: 922527 - RNA, 19 nt, Homo sapiens
gaacguagauuagcuuaua

SEQ ID NO: 922528 - RNA, 19 nt, Homo sapiens
ggaaauaucaugcguguua

SEQ ID NO: 922529 - RNA, 19 nt, Homo sapiens
gcaaaugucuuucguggaa

SEQ ID NO: 922530 - RNA, 19 nt, Homo sapiens
ugacagagauuuacuauca

SEQ ID NO: 922531 - RNA, 19 nt, Homo sapiens
gaagaaauauggagcaaca

SEQ ID NO: 922532 - RNA, 19 nt, Homo sapiens
aaauaacgcuugggcauua

SEQ ID NO: 922533 - RNA, 19 nt, Homo sapiens
caaagcagaacguagauua

SEQ ID NO: 922534 - RNA, 19 nt, Homo sapiens
gagagaauuugaaguguug

SEQ ID NO: 922535 - RNA, 19 nt, Homo sapiens
uaaaguacauccacguuau

SEQ ID NO: 922536 - RNA, 19 nt, Homo sapiens
ugacagcucauaagauuua

SEQ ID NO: 922537 - RNA, 19 nt, Homo sapiens
ccaaggagcuacugcaaau

SEQ ID NO: 922538 - RNA, 19 nt, Homo sapiens
gaaauuaaaggaagagaug

SEQ ID NO: 922539 - RNA, 19 nt, Homo sapiens
ggaaaacccuauauuugua

SEQ ID NO: 922540 - RNA, 19 nt, Homo sapiens
gauagucacuuguuucuac

SEQ ID NO: 922541 - RNA, 19 nt, Homo sapiens
ccacaaauuugauaagcaa

SEQ ID NO: 922542 - RNA, 19 nt, Homo sapiens
ggauaucgacagcagauua

SEQ ID NO: 922543 - RNA, 19 nt, Homo sapiens
gaaccgcaccacuguuaua

SEQ ID NO: 922544 - RNA, 19 nt, Homo sapiens
gaaaugacucuugguauga

SEQ ID NO: 922545 - RNA, 19 nt, Homo sapiens
gcagagcacuucuaaucau

SEQ ID NO: 922546 - RNA, 19 nt, Homo sapiens
ggccauaaauguguaauug

SEQ ID NO: 922547 - RNA, 19 nt, Homo sapiens
cuacaaguccuguuaaauu

SEQ ID NO: 922548 - RNA, 19 nt, Homo sapiens
gggauacgauggcugauug

SEQ ID NO: 922549 - RNA, 19 nt, Homo sapiens
gaaaagaucaucagaagaa

SEQ ID NO: 922550 - RNA, 19 nt, Homo sapiens
ucagaagaauggauaagaa

SEQ ID NO: 922551 - RNA, 19 nt, Homo sapiens
gaagaauggauaagaaaga

SEQ ID NO: 922552 - RNA, 19 nt, Homo sapiens
gaaaccagucuucaggaua

SEQ ID NO: 922553 - RNA, 19 nt, Homo sapiens
uguacaaacucacagauuu

SEQ ID NO: 922554 - RNA, 19 nt, Homo sapiens
ggaauaaagaagugaugua

SEQ ID NO: 922555 - RNA, 19 nt, Homo sapiens
agaaaugacucuugguaug

SEQ ID NO: 922556 - RNA, 19 nt, Homo sapiens
aaaccagucuucaggauau

SEQ ID NO: 922557 - RNA, 19 nt, Homo sapiens
uacgauggcugauugaauu

SEQ ID NO: 922558 - RNA, 19 nt, Homo sapiens
guacauccacguuaugauu

SEQ ID NO: 922559 - RNA, 19 nt, Homo sapiens
guaccuuacugcuuuauca

SEQ ID NO: 922560 - RNA, 19 nt, Homo sapiens
gcaguuuguuucucuguau

SEQ ID NO: 922561 - RNA, 19 nt, Homo sapiens
guagaaaugacucuuggua

SEQ ID NO: 922562 - RNA, 19 nt, Homo sapiens
gcacaacauuucccuaaaa

SEQ ID NO: 922563 - RNA, 19 nt, Homo sapiens
uacaaguccuguuaaauug

SEQ ID NO: 922564 - RNA, 19 nt, Homo sapiens
gaaauaucaugcguguuau

SEQ ID NO: 922565 - RNA, 19 nt, Homo sapiens
cagaaccgcaccacuguua

SEQ ID NO: 922566 - RNA, 19 nt, Homo sapiens
aaauaggcauccuuacaaa

SEQ ID NO: 922567 - RNA, 19 nt, Homo sapiens
gaaagacagaaauguagaa

SEQ ID NO: 922568 - RNA, 19 nt, Homo sapiens
ugcagaaacuagugauaua

SEQ ID NO: 922569 - RNA, 19 nt, Homo sapiens
gaagggccucguaggaaua

SEQ ID NO: 922570 - RNA, 19 nt, Homo sapiens
gauaucaagccaggaaaua

SEQ ID NO: 922571 - RNA, 19 nt, Homo sapiens
ggaaucaaacauaccauga

SEQ ID NO: 922572 - RNA, 19 nt, Homo sapiens
gaagaacaaauccacaaau

SEQ ID NO: 922573 - RNA, 19 nt, Homo sapiens
uaaauugcaugacagagau

SEQ ID NO: 922574 - RNA, 19 nt, Homo sapiens
gcuauaauacugcuacuau

SEQ ID NO: 922575 - RNA, 19 nt, Homo sapiens
uggugcagcuagagaauua

SEQ ID NO: 922576 - RNA, 19 nt, Homo sapiens
gagacaacaacaagacaua

SEQ ID NO: 922577 - RNA, 19 nt, Homo sapiens
gaauaagucagaagaaugg

SEQ ID NO: 922578 - RNA, 19 nt, Homo sapiens
agaaggcacucauccgaaa

SEQ ID NO: 922579 - RNA, 19 nt, Homo sapiens
gaucccaguuauccuugua

SEQ ID NO: 922580 - RNA, 19 nt, Homo sapiens
agacugacuugacacguuu

SEQ ID NO: 922581 - RNA, 19 nt, Homo sapiens
cagaauugccaguaccuua

SEQ ID NO: 922582 - RNA, 19 nt, Homo sapiens
gaaauauggagcaacaguu

SEQ ID NO: 922583 - RNA, 19 nt, Homo sapiens
gaagaggagacaacaacaa

SEQ ID NO: 922584 - RNA, 19 nt, Homo sapiens
ggucuucagguucuacuua

SEQ ID NO: 922585 - RNA, 19 nt, Homo sapiens
cuagagaauuagaagauga

SEQ ID NO: 922586 - RNA, 19 nt, Homo sapiens
ugacuugacacguuuguaa

SEQ ID NO: 922587 - RNA, 19 nt, Homo sapiens
gauguggucguguaaauau

SEQ ID NO: 922588 - RNA, 19 nt, Homo sapiens
ugagagaauuugaaguguu

SEQ ID NO: 922589 - RNA, 19 nt, Homo sapiens
ccauaaauguguaauuguc

SEQ ID NO: 922590 - RNA, 19 nt, Homo sapiens
uccaaguucuaacacauua

SEQ ID NO: 922591 - RNA, 19 nt, Homo sapiens
gcacuuuacagaugaaugu

SEQ ID NO: 922592 - RNA, 19 nt, Homo sapiens
ugacgcacuuuacagauga

SEQ ID NO: 922593 - RNA, 19 nt, Homo sapiens
gagauuuacuaucaguuca

SEQ ID NO: 922594 - RNA, 19 nt, Homo sapiens
agacauacacaccaaauug

SEQ ID NO: 922595 - RNA, 19 nt, Homo sapiens
ccuggaagcggcagaguua

SEQ ID NO: 922596 - RNA, 19 nt, Homo sapiens
gaaacuagugauauacuuc

SEQ ID NO: 922597 - RNA, 19 nt, Homo sapiens
gcauugggguaacauuuua

SEQ ID NO: 922598 - RNA, 19 nt, Homo sapiens
gaauauuugcacccugaua

SEQ ID NO: 922599 - RNA, 19 nt, Homo sapiens
gaugaugagcaguuuguuu

SEQ ID NO: 922600 - RNA, 19 nt, Homo sapiens
ggaaauuugaccucaguga

SEQ ID NO: 922601 - RNA, 19 nt, Homo sapiens
uaagucagaagaauggaua

SEQ ID NO: 922602 - RNA, 19 nt, Homo sapiens
agacaaagcagaacguaga

SEQ ID NO: 922603 - RNA, 19 nt, Homo sapiens
ucaagaacuuaucuacgaa

SEQ ID NO: 922604 - RNA, 19 nt, Homo sapiens
gggaguuuauacacuguuu

SEQ ID NO: 922605 - RNA, 19 nt, Homo sapiens
caggaagacugacuugaca

SEQ ID NO: 922606 - RNA, 19 nt, Homo sapiens
cuacgaagggcgacgcuua

SEQ ID NO: 922607 - RNA, 19 nt, Homo sapiens
ccacuguuauacugggaua

SEQ ID NO: 922608 - RNA, 19 nt, Homo sapiens
uguuaugccugcagaauug

SEQ ID NO: 922609 - RNA, 19 nt, Homo sapiens
cuaaaguacauccacguua

SEQ ID NO: 922610 - RNA, 19 nt, Homo sapiens
gaaggauaaaguggcauua

SEQ ID NO: 922611 - RNA, 19 nt, Homo sapiens
acauccacguuaugauuua

SEQ ID NO: 922612 - RNA, 19 nt, Homo sapiens
ggaaggcuggcacaacauu

SEQ ID NO: 922613 - RNA, 19 nt, Homo sapiens
gagacaugccuguuucuug

SEQ ID NO: 922614 - RNA, 19 nt, Homo sapiens
ggaaagccuucuggugcaa

SEQ ID NO: 922615 - RNA, 19 nt, Homo sapiens
ugaagggccucguaggaau

SEQ ID NO: 922616 - RNA, 19 nt, Homo sapiens
gacaacaacaagacauaaa

SEQ ID NO: 922617 - RNA, 19 nt, Homo sapiens
gaaauuugaccucagugau

SEQ ID NO: 922618 - RNA, 19 nt, Homo sapiens
ugaaugccuuuauagauag

SEQ ID NO: 922619 - RNA, 19 nt, Homo sapiens
aaauuucccucccuaaagu

SEQ ID NO: 922620 - RNA, 19 nt, Homo sapiens
ggcacaacauuucccuaaa

SEQ ID NO: 922621 - RNA, 19 nt, Homo sapiens
ugauauacuucaccgaaug

SEQ ID NO: 922622 - RNA, 19 nt, Homo sapiens
aaacauccuugaagcagau

SEQ ID NO: 922623 - RNA, 19 nt, Homo sapiens
ugacuggaguggagacaug

SEQ ID NO: 922624 - RNA, 19 nt, Homo sapiens
acaagaggauugccugauc

SEQ ID NO: 922625 - RNA, 19 nt, Homo sapiens
gggaaccucugaauaccau

SEQ ID NO: 922626 - RNA, 19 nt, Homo sapiens
gaggaaaacccuauauuug

SEQ ID NO: 922627 - RNA, 19 nt, Homo sapiens
gcaaugauauccaaggaau

SEQ ID NO: 922628 - RNA, 19 nt, Homo sapiens
gaucuaagccucccagaga

SEQ ID NO: 922629 - RNA, 19 nt, Homo sapiens
gaucccagcuccaaggaaa

SEQ ID NO: 922630 - RNA, 19 nt, Homo sapiens
gaucaaggguggaaucuac

SEQ ID NO: 922631 - RNA, 19 nt, Homo sapiens
gaaguaacauguccaaaau

SEQ ID NO: 922632 - RNA, 19 nt, Homo sapiens
ggucucagcuccuugaucu

SEQ ID NO: 922633 - RNA, 19 nt, Homo sapiens
gaaggacacaggaggauau

SEQ ID NO: 922634 - RNA, 19 nt, Homo sapiens
gcacuugugauaugacuug

SEQ ID NO: 922635 - RNA, 19 nt, Homo sapiens
gcuuugaaaugcaacagaa

SEQ ID NO: 922636 - RNA, 19 nt, Homo sapiens
ggaagucuguuagccuuuc

SEQ ID NO: 922637 - RNA, 19 nt, Homo sapiens
ggaccuccaagcaaugaua

SEQ ID NO: 922638 - RNA, 19 nt, Homo sapiens
caugggcccugacuucuug

SEQ ID NO: 922639 - RNA, 19 nt, Homo sapiens
ggaaggacacaggaggaua

SEQ ID NO: 922640 - RNA, 19 nt, Homo sapiens
gcacagccugggaagaauu

SEQ ID NO: 922641 - RNA, 19 nt, Homo sapiens
gacuuuggcacuugugaua

SEQ ID NO: 922642 - RNA, 19 nt, Homo sapiens
gaagucuguuagccuuuca

SEQ ID NO: 922643 - RNA, 19 nt, Homo sapiens
gcacacagaccccagcuuu

SEQ ID NO: 922644 - RNA, 19 nt, Homo sapiens
gaaaugcaacagaaaccau

SEQ ID NO: 922645 - RNA, 19 nt, Homo sapiens
ccuagaauguuucccucaa

SEQ ID NO: 922646 - RNA, 19 nt, Homo sapiens
ugaccgacuuugccacaug

SEQ ID NO: 922647 - RNA, 19 nt, Homo sapiens
aaagagcucucggcacaca

SEQ ID NO: 922648 - RNA, 19 nt, Homo sapiens
uguuagccuuucagaagua

SEQ ID NO: 922649 - RNA, 19 nt, Homo sapiens
aagcaaugauauccaagga

SEQ ID NO: 922650 - RNA, 19 nt, Homo sapiens
ucucagcuccuugaucuaa

SEQ ID NO: 922651 - RNA, 19 nt, Homo sapiens
aagcacagccugggaagaa

SEQ ID NO: 922652 - RNA, 19 nt, Homo sapiens
ggagccagcaaaccauuuc

SEQ ID NO: 922653 - RNA, 19 nt, Homo sapiens
acacagaucccagcuccaa

SEQ ID NO: 922654 - RNA, 19 nt, Homo sapiens
guuagccuuucagaaguaa

SEQ ID NO: 922655 - RNA, 19 nt, Homo sapiens
ccucaggaauccaccuauc

SEQ ID NO: 922656 - RNA, 19 nt, Homo sapiens
uccaagcaaugauauccaa

SEQ ID NO: 922657 - RNA, 19 nt, Homo sapiens
gaccccagcuuuacaagga

SEQ ID NO: 922658 - RNA, 19 nt, Homo sapiens
ggaaaucgagacucaugac

SEQ ID NO: 922659 - RNA, 19 nt, Homo sapiens
cuagaauguuucccucaag

SEQ ID NO: 922660 - RNA, 19 nt, Homo sapiens
gcaucaguccugccaaugg

SEQ ID NO: 922661 - RNA, 19 nt, Homo sapiens
aaugauauccaaggaauuc

SEQ ID NO: 922662 - RNA, 19 nt, Homo sapiens
gaaaucgagacucaugacu

SEQ ID NO: 922663 - RNA, 19 nt, Homo sapiens
ccaguggcuuugaaaugca

SEQ ID NO: 922664 - RNA, 19 nt, Homo sapiens
caggaugacugcagaaaag

SEQ ID NO: 922665 - RNA, 19 nt, Homo sapiens
gcagccagccaucuaugca

SEQ ID NO: 922666 - RNA, 19 nt, Homo sapiens
ccacauggagccagcaaac

SEQ ID NO: 922667 - RNA, 19 nt, Homo sapiens
agaaguaacauguccaaaa

SEQ ID NO: 922668 - RNA, 19 nt, Homo sapiens
cuuuggcacuugugauaug

SEQ ID NO: 922669 - RNA, 19 nt, Homo sapiens
ucagaaguaacauguccaa

SEQ ID NO: 922670 - RNA, 19 nt, Homo sapiens
cccaguggcuuugaaaugc

SEQ ID NO: 922671 - RNA, 19 nt, Homo sapiens
caaugauauccaaggaauu

SEQ ID NO: 922672 - RNA, 19 nt, Homo sapiens
guccaugggcccugacuuc

SEQ ID NO: 922673 - RNA, 19 nt, Homo sapiens
agagaccccuagaauguuu

SEQ ID NO: 922674 - RNA, 19 nt, Homo sapiens
gaccuccaagcaaugauau

SEQ ID NO: 922675 - RNA, 19 nt, Homo sapiens
guuaauccugaccgacuuu

SEQ ID NO: 922676 - RNA, 19 nt, Homo sapiens
cguuaauccugaccgacuu

SEQ ID NO: 922677 - RNA, 19 nt, Homo sapiens
ggagagaccugccugaaac

SEQ ID NO: 922678 - RNA, 19 nt, Homo sapiens
cuccugagauccauacuua

SEQ ID NO: 922679 - RNA, 19 nt, Homo sapiens
guaaggugguguucucaau

SEQ ID NO: 922680 - RNA, 19 nt, Homo sapiens
uuaaaccucuuccucauuc

SEQ ID NO: 922681 - RNA, 19 nt, Homo sapiens
gaagaguacagauaaugga

SEQ ID NO: 922682 - RNA, 19 nt, Homo sapiens
ggcaggaacuaucaguaga

SEQ ID NO: 922683 - RNA, 19 nt, Homo sapiens
gggcuacgguacuguguuc

SEQ ID NO: 922684 - RNA, 19 nt, Homo sapiens
uaaggugguguucucaaua

SEQ ID NO: 922685 - RNA, 19 nt, Homo sapiens
ggugguguucucaauauuu

SEQ ID NO: 922686 - RNA, 19 nt, Homo sapiens
ggaagaguacagauaaugg

SEQ ID NO: 922687 - RNA, 19 nt, Homo sapiens
aaggugguguucucaauau

SEQ ID NO: 922688 - RNA, 19 nt, Homo sapiens
gugguguucucaauauuuc

SEQ ID NO: 922689 - RNA, 19 nt, Homo sapiens
gggaagaguacagauaaug

SEQ ID NO: 922690 - RNA, 19 nt, Homo sapiens
ccaugauccucaacuggaa

SEQ ID NO: 922691 - RNA, 19 nt, Homo sapiens
ccgggaagaguacagauaa

SEQ ID NO: 922692 - RNA, 19 nt, Homo sapiens
gaugccaaguggguauuga

SEQ ID NO: 922693 - RNA, 19 nt, Homo sapiens
gccuaagccuacucuccua

SEQ ID NO: 922694 - RNA, 19 nt, Homo sapiens
gcacaccagaggcaucuca

SEQ ID NO: 922695 - RNA, 19 nt, Homo sapiens
guccucacaucgcccguuu

SEQ ID NO: 922696 - RNA, 19 nt, Homo sapiens
uagaacggauccuccucaa

SEQ ID NO: 922697 - RNA, 19 nt, Homo sapiens
guccuguucugacgguauu

SEQ ID NO: 922698 - RNA, 19 nt, Homo sapiens
guggauggagggugugaaa

SEQ ID NO: 922699 - RNA, 19 nt, Homo sapiens
ccuuaaaccucuuccucau

SEQ ID NO: 922700 - RNA, 19 nt, Homo sapiens
caggaacuaucaguagaca

SEQ ID NO: 922701 - RNA, 19 nt, Homo sapiens
uggagagaccugccugaaa

SEQ ID NO: 922702 - RNA, 19 nt, Homo sapiens
ccaguacgcagccaugauc

SEQ ID NO: 922703 - RNA, 19 nt, Homo sapiens
gguacuguguucccuucug

SEQ ID NO: 922704 - RNA, 19 nt, Homo sapiens
cgggaagaguacagauaau

SEQ ID NO: 922705 - RNA, 19 nt, Homo sapiens
gguuugaccaguccuguuc

SEQ ID NO: 922706 - RNA, 19 nt, Homo sapiens
gcggcaggaacuaucagua

SEQ ID NO: 922707 - RNA, 19 nt, Homo sapiens
cagccaugauccucaacug

SEQ ID NO: 922708 - RNA, 19 nt, Homo sapiens
ccugagauccauacuuagu

SEQ ID NO: 922709 - RNA, 19 nt, Homo sapiens
cggcaggaacuaucaguag

SEQ ID NO: 922710 - RNA, 19 nt, Homo sapiens
gaacccguaaggugguguu

SEQ ID NO: 922711 - RNA, 19 nt, Homo sapiens
ucaggaggagccagaccua

SEQ ID NO: 922712 - RNA, 19 nt, Homo sapiens
cauacuuaguccucacauc

SEQ ID NO: 922713 - RNA, 19 nt, Homo sapiens
ggaggagccagaccuagac

SEQ ID NO: 922714 - RNA, 19 nt, Homo sapiens
gggaagcgcugccugaaga

SEQ ID NO: 922715 - RNA, 19 nt, Homo sapiens
uaacauguuuccagcacua

SEQ ID NO: 922716 - RNA, 19 nt, Homo sapiens
gaggauccuuggcagauga

SEQ ID NO: 922717 - RNA, 19 nt, Homo sapiens
ggaggcagcuggggaaaua

SEQ ID NO: 922718 - RNA, 19 nt, Homo sapiens
ccagcuggcuucccuaauc

SEQ ID NO: 922719 - RNA, 19 nt, Homo sapiens
gcucaucuccaauaaaaua

SEQ ID NO: 922720 - RNA, 19 nt, Homo sapiens
gguaccagcuggggaaaua

SEQ ID NO: 922721 - RNA, 19 nt, Homo sapiens
uggcaaggguuccucugaa

SEQ ID NO: 922722 - RNA, 19 nt, Homo sapiens
ggaaauauuaaucgguauc

SEQ ID NO: 922723 - RNA, 19 nt, Homo sapiens
ccuccuggcucuucuugga

SEQ ID NO: 922724 - RNA, 19 nt, Homo sapiens
gggaaauauuaaucgguau

SEQ ID NO: 922725 - RNA, 19 nt, Homo sapiens
ggcaaggguuccucugaag

SEQ ID NO: 922726 - RNA, 19 nt, Homo sapiens
agagggaaacccaacauug

SEQ ID NO: 922727 - RNA, 19 nt, Homo sapiens
gagggaaucugggguauca

SEQ ID NO: 922728 - RNA, 19 nt, Homo sapiens
gaauauuaaucgguaucca

SEQ ID NO: 922729 - RNA, 19 nt, Homo sapiens
gaaucugggguaucaauaa

SEQ ID NO: 922730 - RNA, 19 nt, Homo sapiens
cugcucaucuccaauaaaa

SEQ ID NO: 922731 - RNA, 19 nt, Homo sapiens
cgacugccccguucuaauu

SEQ ID NO: 922732 - RNA, 19 nt, Homo sapiens
ggaagcgcugccugaagaa

SEQ ID NO: 922733 - RNA, 19 nt, Homo sapiens
cccuaggucuaaugacuug

SEQ ID NO: 922734 - RNA, 19 nt, Homo sapiens
caacauugggaguuagagu

SEQ ID NO: 922735 - RNA, 19 nt, Homo sapiens
agagcacgauagagggaaa

SEQ ID NO: 922736 - RNA, 19 nt, Homo sapiens
gauagagggaaacccaaca

SEQ ID NO: 922737 - RNA, 19 nt, Homo sapiens
ugaggauccuuggcagaug

SEQ ID NO: 922738 - RNA, 19 nt, Homo sapiens
ggaaucugggguaucaaua

SEQ ID NO: 922739 - RNA, 19 nt, Homo sapiens
uagagggaaacccaacauu

SEQ ID NO: 922740 - RNA, 19 nt, Homo sapiens
gaaugcaccuaauaaagua

SEQ ID NO: 922741 - RNA, 19 nt, Homo sapiens
guaauuaagucuuguggaa

SEQ ID NO: 922742 - RNA, 19 nt, Homo sapiens
gcaagcugauaaauaguuu

SEQ ID NO: 922743 - RNA, 19 nt, Homo sapiens
gcaaaucucccaguuccua

SEQ ID NO: 922744 - RNA, 19 nt, Homo sapiens
ggagaccuauggugucaga

SEQ ID NO: 922745 - RNA, 19 nt, Homo sapiens
ggagagccauccugguuuc

SEQ ID NO: 922746 - RNA, 19 nt, Homo sapiens
gcagugcgccgaggacaua

SEQ ID NO: 922747 - RNA, 19 nt, Homo sapiens
gccgagaggugcaggagaa

SEQ ID NO: 922748 - RNA, 19 nt, Homo sapiens
gcgcgugucuucucuucuu

SEQ ID NO: 922749 - RNA, 19 nt, Homo sapiens
agaaauaguuagucaccuu

SEQ ID NO: 922750 - RNA, 19 nt, Homo sapiens
gaagaucgagcagaaguau

SEQ ID NO: 922751 - RNA, 19 nt, Homo sapiens
ugugcaagcugauaaauag

SEQ ID NO: 922752 - RNA, 19 nt, Homo sapiens
guagagaggacgaauguuc

SEQ ID NO: 922753 - RNA, 19 nt, Homo sapiens
caaggaugauggcugcuau

SEQ ID NO: 922754 - RNA, 19 nt, Homo sapiens
agaggacccugauggcuuu

SEQ ID NO: 922755 - RNA, 19 nt, Homo sapiens
cagaaccaccgacaucuuu

SEQ ID NO: 922756 - RNA, 19 nt, Homo sapiens
uuaagcagauggagcaaau

SEQ ID NO: 922757 - RNA, 19 nt, Homo sapiens
gccaccuccuguucauuua

SEQ ID NO: 922758 - RNA, 19 nt, Homo sapiens
caagagcccauacccaaga

SEQ ID NO: 922759 - RNA, 19 nt, Homo sapiens
aggagaagaucgagcagaa

SEQ ID NO: 922760 - RNA, 19 nt, Homo sapiens
ccagggacagaacguaaua
